US008394390B2

(12) United States Patent
Galeotti et al.

(10) Patent No.: US 8,394,390 B2
(45) Date of Patent: *Mar. 12, 2013

(54) NEISSERIAL ANTIGENIC PEPTIDES

(75) Inventors: Cesira Galeotti, Montegriggioni (IT);
Guido Grandi, Siena (IT); Vega Masignani, Siena (IT); Mariarosa Mora, Siena (IT); Mariagrazia Pizza, Siena (IT); Rino Rappuoli, Siena (IT); Guilio Ratti, Siena (IT); Vincenzo Scarlato, Siena (IT); Maria Scarselli, Siena (IT)

(73) Assignee: Novartis AG, Basel (CH)

( * ) Notice: Subject to any disclaimer, the term of this patent is extended or adjusted under 35 U.S.C. 154(b) by 0 days.

This patent is subject to a terminal disclaimer.

(21) Appl. No.: 13/405,162
(22) Filed: Feb. 24, 2012
(65) Prior Publication Data US 2012/0219578 A1    Aug. 30, 2012

Related U.S. Application Data

(62) Division of application No. 10/111,983, filed as application No. PCT/IB00/01661 on Oct. 30, 2000.

(60) Provisional application No. 60/162,616, filed on Oct. 29, 1999.

(51) Int. Cl.
*A61K 39/095* (2006.01)
*A61K 39/02* (2006.01)
*A61K 39/38* (2006.01)
*A61K 38/00* (2006.01)
*C07K 1/00* (2006.01)

(52) U.S. Cl. ............... 424/250.1; 424/190.1; 424/234.1; 424/184.1; 514/1.1; 530/350; 530/300; 530/825

(58) Field of Classification Search .................. None
See application file for complete search history.

(56) References Cited

U.S. PATENT DOCUMENTS

| 7,348,006 | B2 | 3/2008 | Contorni et al. | |
|---|---|---|---|---|
| 7,576,176 | B1 * | 8/2009 | Fraser et al. | 530/350 |
| 7,785,608 | B2 | 8/2010 | Zlotnick et al. | |
| 7,862,827 | B2 | 1/2011 | Giuliani et al. | |
| 2004/0092711 | A1 | 5/2004 | Arico | |
| 2004/0110670 | A1 | 6/2004 | Arico et al. | |
| 2004/0167068 | A1 | 8/2004 | Zlotnick et al. | |
| 2005/0222385 | A1 | 10/2005 | Pizza | |
| 2006/0051840 | A1 | 3/2006 | Arico et al. | |
| 2006/0171957 | A1 | 8/2006 | Pizza | |
| 2006/0240045 | A1 | 10/2006 | Berthet et al. | |
| 2006/0251670 | A1 | 11/2006 | Comanducci et al. | |
| 2007/0026021 | A1 | 2/2007 | Fraser et al. | |
| 2007/0082014 | A1 | 4/2007 | Costantino | |
| 2008/0241180 | A1 | 10/2008 | Contorni | |
| 2009/0285845 | A1 | 11/2009 | Masignani et al. | |
| 2010/0267931 | A1 | 10/2010 | Arico et al. | |

FOREIGN PATENT DOCUMENTS

| EP | 0467714 | 1/1992 |
|---|---|---|
| EP | 1790660 | 5/2007 |
| WO | WO-93/18150 | 9/1993 |
| WO | WO-96/12020 A2 | 4/1996 |
| WO | WO-96/29412 A1 | 9/1996 |
| WO | WO-98/17805 | 4/1998 |
| WO | WO-98/18810 A1 | 5/1998 |
| WO | WO-98/49288 A1 | 11/1998 |
| WO | WO-98/55495 A2 | 12/1998 |
| WO | WO-99/57280 A | 11/1999 |
| WO | WO-00/22430 A2 | 4/2000 |
| WO | WO-00/66791 | 11/2000 |
| WO | WO-01/31019 | 5/2001 |
| WO | WO-01/52885 | 7/2001 |
| WO | WO-01/64920 A | 9/2001 |
| WO | WO-01/64922 A2 | 9/2001 |
| WO | WO-03/009869 A1 | 2/2003 |
| WO | WO-03/020756 A | 3/2003 |
| WO | WO-03/063766 | 8/2003 |
| WO | WO-2004/032958 A1 | 4/2004 |
| WO | WO-2004/048404 | 6/2004 |
| WO | WO-2006/024954 A2 | 3/2006 |
| WO | WO-2006/081259 | 8/2006 |
| WO | WO-2007/060548 A2 | 5/2007 |
| WO | WO-2009/104097 A2 | 8/2009 |
| WO | WO-2010/046715 A1 | 4/2010 |

OTHER PUBLICATIONS 1997-11-17-NM_shotgun.dbs and 1997-12-15-NM.dbs, located at <ftp://ftp.sanger.ac.uk/pub/pathogens/nm/old data/>.
Aasel et al. (1998). Abstract from the 11th International Pathogenic Neisseria Conference, Nice France, Nov. 1-6, 1998. pp. 37-38.
Beernink et al (Jul. 2006). "Rapid Genetic Grouping of Factor H-Binding Protein (Genome-Derived Neisserial Antigen 1870), a Promising Group B Meningococcal Vaccine Candidate," Clinical and Vaccine Immunology 13(7):758-763.
Beernink et al. (Jun. 2008). "Bactericidal antibody responses, induced by meningococcal recombinant chimeric factor H-binding protein vaccines," Infection and Immunity 76(6):2568-2575.
Beernink et al. (Sep. 2008). "Fine antigenic specificity and cooperative bactericidal activity of monoclonal antibodies directed at the meningococcal vaccine candidate factor h-binding protein," Infection and Immunity 76(9):4232-4240.
Beernick (Jul. 2010) "Impaired immungenicity of a meningococcal factor H-binding protein vaccine engineered to eliminate factor h binding," Clin Vac Immunol 17(7):1074-1078.
Bernfield L. et al. (Sep. 2002). "Identification of a novel vaccine candidate for group B *Neisseria meningitidis*," Thirteenth International Pathogenic Neisseria Conference, Norwegian Institute of Public Health, Oslo, Norway, pp. 116 and 124.
Boslego et al. (1991). "Gonorrhea Vaccines," Chapter 17 In Vaccines and Immunotherapy, Cryz S.J. (Ed.), Pergamon Press: New York, NY, pp. 211-223.

(Continued)

*Primary Examiner* — S. Devi
(74) *Attorney, Agent, or Firm* — Amy Hessler; Otis Littlefield

(57) ABSTRACT

This invention provides, among other things, proteins, polypeptides, and fragments thereof, derived from the bacteria *Neisseria meningitidis* B. Also provided are nucleic acids encoding for such proteins, polypeptides, and/or fragments, as well as nucleic acids complementary thereto e.g., antisense nucleic acids). Additionally, this invention provides antibodies which bind to the proteins, polypeptides, and/or fragments. This invention further provides expression vectors useful for making the proteins, polypeptides, and/or fragments, as well as host cells transformed with such vectors. This invention also provides compositions of the proteins, polypeptides, fragments, and/or nucleic acids, for use as vaccines, diagnostic reagents, immunogenic compositions, and the like. Methods of making the compositions and methods of treatment with the compositions are also provided. This invention also provides methods of detecting the proteins, polypeptides, fragments, and/or nucleic acids.

24 Claims, No Drawings

OTHER PUBLICATIONS

Cannon (1989). "Conserved Lipoproteins of Pathogenic Neisseria Species Bearing the H.8 Epitope: Lipid-Modified Azurin and H.8 Outer Membrane Protein," Clinical Microbiology Reviews 2(Suppl.):S1-S4.

Cantini et al. (Mar. 2006). "Solution Structure of the Immunodominant Domain of Protective Antigen GNA 1870 of *Neisseria meningitidis*," Journal of Biological Chemistry 281(11):7220-7227.

Cruse et al. (2003). Illustrated Dictionary of Immunology, 2nd Edn.m CRC Press, pp. 46, 166, and 382.

Database accession No. NMB1994 (cf. XP2231040) (Tettelin et al.), uploaded Oct. 1, 2000.

Declaration by Dr. Julian Parkhill dated Jun. 12, 2008, submitted in opposition proceedings for EP1645631, 2 pages.

Delvig, A. A. et al. (Jul. 1997). "Vaccine-Induced IgG Antibodies to the Linear Epitope on the PorB Outer Membrane Protein Promote Opsonophagocytosis of *Neisseria meningitides* by Human Neutrophils," Clinical Immunology and Immunopathology 84(1):27-35.

Dillard, J. P. et al. (1997) "A Peptidoglcan Hydrolase Similar to Bacteriophage Endolysins Acts as an Autolysin in *Neisseria gonorrhoeae*," Molecular Microbiology 25(5):893-907.

European Search Report and Examination Report mailed Jun. 18, 2007, for European Application No. 07075161.5 filed Oct. 30, 2000, 10 pages.

Farley J. et al. (Sep. 2002). "Characterization, cloning and expression of different subfamilies of the ORF 2086 gene from *Neisseria meningitidis*," Thirteenth International Pathogenic Neisseria Conference, Norwegian Institute of Public Health, Oslo, Norway, p. 124.

Feavers et al. (2009). "Meningococcal protein antigens and vaccines," Vaccine 275:B42-B50.

Fleischmann et al. (1995). "Whole-Genome Random Sequencing and Assembly of *Haemophilus influenzae* Rd," Science 269:496-501.

Fletcher et al. (2004). "Vaccine Potential of the *Neisseria meningitidis* 2086 Lipoprotein," Infection and Immunity 72(4):2088-2100.

Fontana et al. (2002). A genomic approach Abstract from the 13th International Pathogenic Neisseria Conference, Oslo, Norway, Sep. 1-6, 2002. p. 248.

Forster et al. (1998). "The complete nucleotide sequence of the potexvirus white clover mosaic virus," Nucleic Acid Research. 16:291-303.

Fussenegger et al. (1996). "Tetrapac (tpc), a Novel Genotype of *Neisseria gonorrhoeae* Affecting Epithelial Cell Invasion, Natural Transformation Competence and Cell Separation," Molecular Microbiology 19:1357-1372.

Giuliani et al. (2006). "A universal vaccine for serogroup B meningococcus," PNAS 103(29):10834-10839.

Giuliani et al. (Feb. 2005). "The Region Comprising Amino Acids 100 to 255 of *Neisseria meningitidis* Lipoprotein GNA 1870 Elicits Bactericidal Antibodies," Infection and Immunity 73(2):1151-1160.

Greenspan et al. (1999). "Defining Epitopes: It's Not as Easy as It Seems," Nature Biotechnology 17:936-937.

Harlow et al. (1988). Antibodies: A Laboratory Manual. Cold Spring Harbor Laboratory: New York, p. 76.

Hou et al. (2005) "Protective antibody responses elicited by a meningococcal outer membrane vesicle vaccine with overexpressed genome-derived neisserial antigen 1870," J Infect Dis 192(4):580-90.

Jacobsson et al. (2009). "Prevalence and sequence variations of the genes encoding the five antigens included in the novel 5CVMB vaccine covering group B meningococcal disease" Vaccine 27:1579-1584.

JCVI-CMR website showing Z2491 Sanger sequence (http://cmr.jcvi.org/tigr-scripts/CMR/shared/Genomes.cgi and links). (2010).

Jiang et al., (2010) "Broad vaccine coverage predicted for a bivalent recombinant factor H binding protein based vaccine to prevent serogroup B meningococcal disease" Vaccine 28:6086-6093.

Koeberling et al. (2007). "Improved immunogenicity of a H44/76 group B outer membrane vesicle vaccine with over-expressed genome-derived Neisserial antigen 1870," Vaccine 25(10):1912-1920.

Lommatzsch et al. (1997). "Outer membrane localization of murein hydrolases: MltA, a third lipoprotein lytic transglycosylase in *Escherichia coli*," Journal of Bacteriology 179(17): 5465-5470.

Lucidarme et al., (Sep. 16, 2009) "Characterization of fHbp, nhba (gna2132), nadA, porA, sequence type (ST), and genomic presence of IS1301 in group B meningococcal ST269 clonal complex isolates from England and Wales" Journal of Clinical Microbiology, 47(11):3577-85.

Lucidarme et al., 2010 "Characterization of fHbp, nhba (gna2132), nadA, porA, and sequence type in group B meningococcal case isolates collected in England and Wales during Jan. 2008 and potential coverage of an investigational group B meningococcal vaccine" Clinical and Vaccine Immunology 17(6):919-929.

Malorny et al. (1998). "Sequence Diversity, Predicted Two-Dimensional Protein Structure, and Epitope Mapping of Neisserial Opa Proteins," J. Bacteriol, 180(5):1323-1330.

Masignani V. (Mar. 17. 2003). "Vaccination against *Neisseria meningitidis* using three variants of the lipoprotein GNA1870," J. Exp. Med. 197(6):789-799.

Millan et al. (1998). "CpG DNA Can Induce Strong Th1 Humoral and Cell-Mediated Immune Responses Against Hepatitis B Surface Antigen in Young Mice," Proc. Natl. Acad. Sci. USA 95(26):15553-15558.

Morley, S. et al. (Dec. 12, 2001). "Vaccine prevention of meningococcal disease, coming soon?" Vaccine 20(5-6):666-687.

Murphy et al., (2009) "Sequence diversity of the factor H binding protein vaccine candidate in epidemiologically relevant strains of serogroup B Neisseria meningitidis" J Infect Dis 200:379-389.

Nassif (2000). "A Furtive Pathogen Revealed," Science 287:1767-1768.

Notice of Opposition against European Patent EP 1645631, granted on Oct. 24, 2007. Opposition filed on Jul. 23, 2008. 20 pages.

Notice of Opposition mailed Apr. 3, 2008 by GlaxoSmithKline Biologicals S.A., directed to European Patent No. EP 1534326 B1, granted Jul. 4, 2007. 21 pages.

Novartis (Oct. 9, 2008) "New Phase II data show Novartis investigational Meningitis B vaccine may also protect infants six months and older," Media Release, 4 pages.

Pajon et al., "Frequency of factor H-binding protein modular groups and susceptibility to cross-reactive bactericidal activity in invasive meningococcal isolates" Vaccine 28(2010):2122-2129.

Parkhill, J. et al. (Mar. 2000). "Complete DNA Sequence of a Serogroup A Strain of *Neisseria meningitides* Z2491," Nature 404:502-505.

Parkhill, "Campylobacter jejuni genome sequence as the Sanger Centre," Post on BIOSCI/Bionet of May 8, 1998.

Patentee's Response to Opposition mailed Jan. 19, 2009, by Novartis Vaccines and Diagnostics S.R.L., directed to European Patent No. EP 1534326 B1, granted Jul. 4, 2007. 29 pages.

Patentees' Response to Opposition against European Patent EP 1645631, granted on Oct. 24, 2007, 13 pages.

Pizza et al. (2000). "Identification of Vaccine Candidates Against Serogroup B Meningococcus by Whole-Genome Sequencing," Science 287(5459):1816-1820.

Pizza et al. (2008) "Factor H-binding protein, a unique meningococcal vaccine antigen" Vaccine 26S:I46-8.

Progress through the Sanger Institute FTP server (May 12, 2009), 15 pages.

PSORT analysis of 200 of the sequences disclosed in PCT/US99/09346 (Jan. 1, 2010), 209 pages.

PSORT analysis of SEQ ID Nos. 4 and 6, and of 'Contig295' 300mer (May 8, 2009), 5 pages.

PSORT prediction result for SEQ ID No. 2 (Mar. 30, 2010), 1 page.

Response to Communication, filed in EP Application No. 07075161.5. Oct. 28, 2009.

Rinaudo et al. (2009). "Vaccinology in the genome era", The Journal of Clinical Investigation, 119(9):2515-2525.

Romero et al., "Current status of Meningococcal group B vaccine candidates: capsular or noncapsular?" Clin. Microbiol. Rev. 7(4):559-575, 1994.

Sanger Centre's "Projects" website as of Dec. 10, 1997 as retrievable via http://web.archive.org.

Scarselli et al. (Feb. 13, 2009). "Epitope Mapping of a Bactericidal Monoclonal Antibody against the Factor H Binding Protein of *Neisseria meningitides*," Journal of Molecular Biology 386(1):97-108.

Schneider et al. (Apr. 16, 2009) "*Neisseria meningitidis* recruits factor H using protein mimicry of host carbohydrates," Nature 458(7240):890-893.

Sequence for "Putative Lipoprotein [*Neisseria meningitidis* Z2491]," NCBI Reference Sequence: YP_002342062.1, Mar. 30, 2000.

Serruto et al. (2009). "Genome-based approaches to develop vaccines against bacterial pathogens," Vaccine 27:3245-3250.

Sun et al. (1998). "DNA as an Adjuvant: Capacity of insect DNA and Synthetic Oligodeoxynucleotides to Augment T Cell Responses to Specific Antigen," J. Experimental Medicine 187(7):1145-1150.

Supplemental Submissions in Opposition against European Patent EP 1645631, granted on Oct. 24, 2007. Opposition filed on May 25, 2010. 28 pages.

Supplementary Declaration by Dr. Julian Parkhill, dated May 10, 2010, submitted in opposition proceedings for EP1645631, 4 pages.

Tabata. (1996). "Membrane Bound Lytic Translycosylase a MltA Synechocystis sp Strain PCC 6803," Database EMBL EB1 Acc No. Q55666.

Teerlink et al. (1987). "Antigenic and Immunogenic Properties of Cyanogen Bromide Peptides from Gonococcal Outer Membrane Protein Ib," J. Exp. Med. 166:63-76.

Telford et al. (2003). "Genomic and Proteomics in Vaccine Design", in New Bacterial Vaccines, edited by Ellis et al. Kleweur Academic/Plenum Publishers, USA. pp. 1-11.

Tettelin H et al. (Mar. 10, 2000). "Complete genome sequence of *Neisseria meningitidis* serogroup B strain MC58," Science 287(5459):789-799.

The printed output from the NCBI open reading frame finder (Oct. 20, 2008), 12 pages.

United States Office Action mailed on Feb. 11, 2009, for U.S. Appl. No. 10/181,600, filed Jan. 17, 2001, 5 pages.

United States Office Action mailed on Jul. 24, 2008, for U.S. Appl. No. 10/181,600, filed Jan. 17, 2001, 23 pages.

United States Office Action mailed on Jul. 7, 2009, for U.S. Appl. No. 10/181,600, filed Jan. 17, 2001, 23 pages.

U.S. Appl. No. 60/098,685, "Neisseria Spp, Polypeptide, Gene Sequence and Uses Thereof," filed Sep. 1, 1998.

Welsch et al. (2004). "Protective Activity of Monclonal Antibodies to Genome-Derived Neisserial Antigen 1870, a *Neisseria meningitidis* Candidate Vaccine," The Journal of Immunology 172:5606-5615.

Welsch et al. (Oct. 30, 2006) "A novel mechanism for complement-mediated killing of encapsulated *Neisseria meningitidis* elicited by monoclonal antibodies to factor H-binding protein (genome-derived Neisserial antigen 1870)" Molecular Immunology 44(1-3):256.

Welsch et al. (Apr. 1, 2008). "Complement-dependent synergistic bactericidal activity of antibodies against factor H-binding protein, a sparsely distributed meningococcal vaccine antigen," J Infect Dis 197(7):1053-1061.

Zhu et al. (2005) "Evaluation of recombinant lipidated P2086 protein as a vaccine candidate for group B *Neisseria meningitidis* in a murine nasal challenge model," Infect Immun 73(10):6838-45.

Zollinger (1997). "New and Improved Vaccines Against Meningococcal Disease" in New Generation Vaccines, 2nd Ed., edited by Levine et al., Marcel Dekker, New York. pp. 469-488.

* cited by examiner

NEISSERIAL ANTIGENIC PEPTIDES

CROSS REFERENCE TO RELATED APPLICATIONS

This application is a Divisional of U.S. patent application Ser. No. 10/111,983, filed Feb. 26, 2003, currently pending, which is the National Stage of International Patent Application of PCT/IB2000/001661, filed Oct. 30, 2000, which claims the benefit of U.S. Provisional Patent Application Ser. No. 60/162,616, filed Oct. 29, 1999, each of which is hereby incorporated by reference in its entirety.

SUBMISSION OF SEQUENCE LISTING AS ASCII TEXT FILE

The content of the following submission on ASCII text file is incorporated herein by reference in its entirety: a computer readable form (CRF) of the Sequence Listing (file name: 223002100010SeqListing.txt, date recorded: Feb. 23, 2012, size: 19,155 KB).

TECHNICAL FIELD

This invention relates to antigenic peptide sequences from the bacteria *Neisseria meningitidis* and *Neisseria gonorrhoea*.

BACKGROUND ART

*N. meningitidis* is a non-motile, Gram-negative diplococcus that is pathogenic in humans.

Based on the organism's capsular polysaccharide, 12 serogroups of *N. meningitidis* have been identified. Group A is the pathogen most often implicated in epidemic disease in sub-Saharan Africa. Serogroups B and C are responsible for the vast majority of cases in the United States and in most developed countries. Serogroups W135 and Y are responsible for the rest of the cases in the United States and developed countries.

The meningococcal vaccine currently in use is a tetravalent polysaccharide vaccine composed of serogroups A, C, Y and W135. Meningococcus B remains a problem, however. The polysaccharide approach cannot be used because the menB capsular polysaccharide is a polymer of α(2-8)-linked N-acetyl neuraminic acid that is also present in mammalian tissue. One approach to a menB vaccine uses mixtures of outer membrane proteins (OMPs). To overcome the antigenic variability, multivalent vaccines containing up to nine different porins have been constructed [e.g., Poolman J T (1992) Development of a meningococcal vaccine. *Infect. Agents Dis.* 4:13-28]. Additional proteins to be used in outer membrane vaccines have been the opa and opc proteins, but none of these approaches have been able to overcome the antigenic variability [e.g., Ala'Aldeen & Borriello (1996)]. The meningococcal transferrin-binding proteins 1 and 2 are both surface exposed and generate bactericidal antibodies capable of killing homologous and heterologous strains. [*Vaccine* 14(1):49-53].

DISCLOSURE OF THE INVENTION

The invention provides fragments of the proteins disclosed in international patent applications WO99/57280 and WO00/22430 (the "International Applications"), wherein the fragments comprise at least one antigenic determinant.

Thus, if the length of any particular protein sequence disclosed in the International Applications is x amino acids, the present invention provides fragments of at most x−1 amino acids of that protein. The fragment may be shorter than this (e.g., x−2, x−3, x−4, . . . ), and is preferably 100 amino acids or less (e.g., 90 amino acids, 80 amino acids etc.). The fragment may be as short as 3 amino acids, but is preferably longer (e.g., up to 5, 6, 7, 8, 9, 10, 12, 15, 20, 25, 30, 35, 40, 50, 75, or 100 amino acids).

Preferred fragments comprise the meningococcal peptide sequences disclosed in Table 1, or sub-sequences thereof. The fragments may be longer than those given in Table 1 e.g., where a fragment in Table 1 runs from amino acid residue p to residue q of a protein, the invention also relates to fragments from residue (p−1), (p−2), or (p−3) to residue (q+1), (q+2), or (q+3).

The invention also provides polypeptides that are homologous (i.e., have sequence identity) to these fragments. Depending on the particular fragment, the degree of sequence identity is preferably greater than 50% (e.g., 60%, 70%, 80%, 90%, 95%, 99% or more). These homologous polypeptides include mutants and allelic variants of the fragments. Identity between the two sequences is preferably determined by the Smith-Waterman homology search algorithm as implemented in the MPSRCH program (Oxford Molecular), using an affine gap search with parameters gap open penalty=12 and gap extension penalty=1.

The invention also provides proteins comprising one or more of the above-defined fragments.

The invention is subject to the proviso that it does not include within its scope proteins limited to any of the full length protein sequences disclosed in the International Applications (i.e., the even SEQ IDs: 2-3020 of WO99/57280 and the odd SEQ IDs: 963-1045 of WO00/22430).

The proteins of the invention can, of course, be prepared by various means (e.g., recombinant expression, purification from cell culture, chemical synthesis etc.) and in various forms (e.g., native, C-terminal and/or N-terminal fusions etc.). They are preferably prepared in substantially pure form (i.e., substantially free from other Neisserial or host cell proteins). Short proteins are preferably produced using chemical peptide synthesis.

According to a further aspect, the invention provides antibodies which recognise the fragments of the invention, with the proviso that the invention does not include within its scope antibodies which recognise any of the complete protein sequences in the International Applications. The antibodies may be polyclonal or monoclonal, and may be produced by any suitable means.

The invention also provides proteins comprising peptide sequences recognised by these antibodies. These peptide sequences will, of course, include fragments of the meningococcal proteins in the International Applications, but will also include peptides that mimic the antigenic structure of the meningococcal peptides when bound to immunoglobulin.

According to a further aspect, the invention provides nucleic acid encoding the fragments and proteins of the invention, with the proviso that the invention does not include within its scope nucleic acid encoding any of the full length protein sequences in the International Applications. The nucleic acids may be as short as 10 nucleotides, but are preferably longer (e.g., up to 10, 12, 15, 18, 20, 25, 30, 35, 40, 50, 75, or 100 nucleotides).

In addition, the invention provides nucleic acid comprising sequences homologous (i.e., having sequence identity) to these sequences. The degree of sequence identity is preferably greater than 50% (e.g., 60%, 70%, 80%, 90%, 95%, 99% or more). Furthermore, the invention provides nucleic acid which can hybridise to these sequences, preferably under "high stringency" conditions (e.g., 65° C. in a 0.1×SSC, 0.5% SDS solution).

It should also be appreciated that the invention provides nucleic acid comprising sequences complementary to those described above (e.g., for antisense or probing purposes).

Nucleic acid according to the invention can, of course, be prepared in many ways (e.g., by chemical synthesis, from genomic or cDNA libraries, from the organism itself etc.) and can take various forms (e.g., single stranded, double stranded, vectors, probes etc.). In addition, the term "nucleic acid" includes DNA and RNA, and also their analogues, such as those containing modified backbones, and also peptide nucleic acids (PNA), etc.

According to a further aspect, the invention provides vectors comprising nucleotide sequences of the invention (e.g., expression vectors) and host cells transformed with such vectors.

According to a further aspect, the invention provides compositions comprising protein, antibody, and/or nucleic acid according to the invention. These compositions may be suitable as vaccines, for instance, or as diagnostic reagents, or as immunogenic compositions.

The invention also provides nucleic acid, protein, or antibody according to the invention for use as medicaments (e.g., as vaccines or as immunogenic compositions) or as diagnostic reagents. It also provides the use of nucleic acid, protein, or antibody according to the invention in the manufacture of: (i) a medicament for treating or preventing infection due to Neisserial bacteria; (ii) a diagnostic reagent for detecting the presence of Neisserial bacteria or of antibodies raised against Neisserial bacteria; and/or (iii) a reagent which can raise antibodies against Neisserial bacteria. Said Neisserial bacteria may be any species or strain (such as *N. gonorrhoeae*) but are preferably *N. meningitidis*, especially strain A or strain B.

The invention also provides a method of treating a patient, comprising administering to the patient a therapeutically effective amount of nucleic acid, protein, and/or antibody according to the invention.

According to further aspects, the invention provides various processes, for example:

A process for producing proteins of the invention is provided, comprising the step of culturing a host cell according to the invention under conditions which induce protein expression;

A process for producing protein or nucleic acid of the invention is provided, wherein the protein or nucleic acid is synthesised in part or in whole using chemical means;

A process for detecting polynucleotides of the invention is provided, comprising the steps of: (a) contacting a nucleic probe according to the invention with a biological sample under hybridizing conditions to form duplexes; and (b) detecting said duplexes; and A process for detecting proteins of the invention is provided, comprising the steps of: (a) contacting an antibody according to the invention with a biological sample under conditions suitable for the formation of an antibody-antigen complexes; and (b) detecting said complexes.

A summary of standard techniques and procedures which may be employed in order to perform the invention (e.g., to utilise the disclosed sequences for vaccination or diagnostic purposes) follows. This summary is not a limitation on the invention but, rather, gives examples which may be used, but which are not required.

General

The practice of the present invention will employ, unless otherwise indicated, conventional techniques of molecular biology, microbiology, recombinant DNA, and immunology, which are within the skill of the art. Such techniques are explained fully in the literature e.g., Sambrook *Molecular CloningL A Laboratory Manual, Second Edition* (1989); *DNA Cloning, Volumes I and ii* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology, Volumes I-IV* (D. M. Weir and C. C. Blackwell eds 1986).

Standard abbreviations for nucleotides and amino acids are used in this specification.

All publications, patents, and patent applications cited herein are incorporated in full by reference.

DEFINITIONS

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

The term "comprising" means "including" as well as "consisting" e.g., a composition "comprising" X may consist exclusively of X or may include something additional to X, such as X+Y.

The term "antigenic determinant" includes B-cell epitopes and T-cell epitopes.

The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to the gene. Another example is where a meningococcal sequence is heterologous to a mouse host cell. A further example would be two epitopes from the same or different proteins which have been assembled in a single protein in an arrangement not found in nature.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

Expression Systems

The meningococcal nucleotide sequences can be expressed in a variety of different expression systems; for example those used with mammalian cells, baculoviruses, plants, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (e.g., structural gene) into mRNA. A promoter will have a transcription initiating region, which is usually placed proximal to the 5' end of the coding sequence, and a TATA box, usually located 25-30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation [Sambrook et al. (1989) "Expression of Cloned Genes in Mammalian Cells." In *Molecular Cloning: A Laboratory Manual, 2nd ed.*].

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallotheionein gene, also provide useful promoter sequences. Expression may be either constitutive or regulated (inducible), depending on the promoter can be induced with glucocorticoid in hormone-responsive cells.

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter [Maniatis et al. (1987) *Science* 236:1237; Alberts et al. (1989) *Molecular Biology of the Cell,* 2nd ed.]. Enhancer elements derived from viruses may be particularly useful, because they usually have a broader host range. Examples include the SV40 early gene enhancer [Dijkema et al (1985) *EMBO J.* 4:761] and the enhancer/promoters derived from the long terminal repeat (LTR) of the Rous Sarcoma Virus [Gorman et al. (1982b) *Proc. Natl. Acad. Sci.* 79:6777] and from human cytomegalovirus [Boshart et al. (1985) *Cell* 41:521]. Additionally, some enhancers are regulatable and become active only in the presence of an inducer, such as a hormone or metal ion [Sassone-Corsi and Borelli (1986) *Trends Genet.* 2:215; Maniatis et al. (1987) *Science* 236:1237].

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus triparite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation [Birnstiel et al. (1985) *Cell* 41:349; Proudfoot and Whitelaw (1988) "Termination and 3' end processing of eukaryotic RNA." In *Transcription and splicing* (ed. B. D. Hames and D. M. Glover); Proudfoot (1989) *Trends Biochem. Sci.* 14:105]. These sequences direct the transcription of an mRNA which can be translated into the polypeptide encoded by the DNA. Examples of transcription terminater/polyadenylation signals include those derived from SV40 [Sambrook et al (1989) "Expression of cloned genes in cultured mammalian cells." In *Molecular Cloning: A Laboratory Manual*].

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (e.g., plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 [Gluzman (1981) *Cell* 23:175] or polyomavirus, replicate to extremely high copy number in the presence of the appropriate viral T antigen. Additional examples of mammalian replicons include those derived from bovine papillomavirus and Epstein-Ban virus. Additionally, the replicon may have two replicaton systems, thus allowing it to be maintained, for example, in mammalian cells for expression and in a prokaryotic host for cloning and amplification. Examples of such mammalian-bacteria shuttle vectors include pMT2 [Kaufman et al. (1989) *Mol. Cell. Biol.* 9:946] and pHEBO [Shimizu et al. (1986) *Mol. Cell. Biol.* 6:1074].

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (e.g., Hep G2), and a number of other cell lines.

ii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and Methods for baculovirus/insect cell expression systems are commercially available in kit form from, inter alia, INVITROGEN, Carlsbad Calif. ("MaxBac" kit). These techniques are generally known to those skilled in the art and fully described in Summers and Smith, *Texas Agricultural Experiment Station Bulletin No.* 1555 (1987) (hereinafter "Summers and Smith").

Prior to inserting the DNA sequence encoding the protein into the baculovirus genome, the above described components, comprising a promoter, leader (if desired), coding sequence of interest, and transcription termination sequence, are usually assembled into an intermediate transplacement construct (transfer vector). This construct may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extrachromosomal element (e.g., plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, Virology (1989)17: 31.

The plasmid usually also contains the polyhedrin polyadenylation signal (Miller et al. (1988) *Ann. Rev. Microbial.,* 42:177) and a prokaryotic ampicillin-resistance (amp) gene and origin of replication for selection and propagation in *E. coli.*

Baculovirus transfer vectors usually contain a baculovirus promoter. A baculovirus promoter is any DNA sequence capable of binding a baculovirus RNA polymerase and initiating the downstream (5' to 3') transcription of a coding sequence (e.g., structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Viral.* 69:765.

DNA encoding suitable signal sequences can be derived from genes for secreted insect or baculovirus proteins, such as the baculovirus polyhedrin gene (Carbonell et al. (1988) *Gene,* 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA,* 82:8404; mouse IL-3, (Miyajima et al., (1987) *Gene* 58:273; and human glucocerebrosidase, Martin et al. (1988) *DNA,* 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2-5 kb section of the baculovirus genome. Methods for introducing heterologous DNA into the desired site in the baculovirus virus are known in the art. (See Summers and Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91. The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 m in size, are highly refractile, giving them a bright shiny appearance that is readily visualized under the light microscope. Cells infected with recombinant viruses lack occlusion bodies. To distinguish recombinant virus from wild-type virus, the transfection supernatant is plagued onto a monolayer of insect cells by techniques known to those skilled in the art. Namely, the plaques are screened under the light microscope for the presence (indicative of wild-type virus) or absence (indicative of recombinant virus) of occlusion bodies. "Current Protocols in Microbiology" Vol. 2 (Ausubel et al. eds) at 16.8 (Supp. 10, 1990); Summers and Smith, supra; Miller et al. (1989).

Recombinant baculovirus expression vectors have been developed for infection into several insect cells. For example, recombinant baculoviruses have been developed for, inter alia: *Aedes aegypti, Autographa californica, Bombyx mori, Drosophila melanogaster, Spodoptera frugiperda,* and *Trichoplusia ni* (WO 89/046699; Carbonell et al., (1985) *J. Virol.* 56:153; Wright (1986) *Nature* 321:718; Smith et al., (1983) *Mol. Cell. Biol.* 3:2156; and see generally, Fraser, et al. (1989) *In Vitro Cell. Dev. Biol.* 25:225).

Cells and cell culture media are commercially available for both direct and fusion expression of heterologous polypeptides in a baculovirus/expression system; cell culture technology is generally known to those skilled in the art. See, e.g., Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, e.g., HPLC, affinity chromatography, ion exchange chromatography, etc.; electrophoresis; density gradient centrifugation; solvent extraction, or the like. As appropriate, the product may be further purified, as required, so as to remove substantially any insect proteins which are also secreted in the medium or result from lysis of insect cells, so as to provide a product which is at least substantially free of host debris, e.g., proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iii. Plant Systems

There are many plant cell culture and whole plant genetic expression systems known in the art. Exemplary plant cellular genetic expression systems include those described in patents, such as: U.S. Pat. No. 5,693,506; U.S. Pat. No. 5,659,122; and U.S. Pat. No. 5,608,143. Additional examples of genetic expression in plant cell culture has been described by Zenk, *Phytochemistry* 30:3861-3863 (1991). Descriptions of plant protein signal peptides may be found in addition to the references described above in Vaulcombe et al., *Mol. Gen. Genet.* 209:33-40 (1987); Chandler et al., *Plant Molecular Biology* 3:407-418 (1984); Rogers, *J. Biol. Chem.* 260:3731-3738 (1985); Rothstein et al., *Gene* 55:353-356 (1987); Whittier et al., *Nucleic Acids Research* 15:2515-2535 (1987); Wirsel et al., *Molecular Microbiology* 3:3-14 (1989); Yu et al., *Gene* 122:247-253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology*, Malcolm B. Wilkins, ed., 1984 Pitman Publishing Limited, London, pp. 21-52. References that describe other metabolically-regulated genes: Sheen, *Plant Cell*, 2:1027-1038 (1990); Maas et al., *EMBO J.* 9:3447-3452 (1990); Benkel and Hickey, *Proc. Natl. Acad. Sci.* 84:1337-1339 (1987)

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for *Agrobacterium* transformations, T DNA sequences for *Agrobacterium*-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr,* 11(2):165-185.

Sequences suitable for permitting integration of the heterologous sequence into the plant genome are also recommended. These might include transposon sequences and the like for homologous recombination as well as Ti sequences which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95-105, 1985.

The vector can be microinjected directly into plant cells by use of micropipettes to mechanically transfer the recombinant DNA. Crossway, *Mol. Gen. Genet*, 202:179-185, 1985. The genetic material may also be transferred into the plant cell by using polyethylene glycol, Krens, et al., *Nature*, 296, 72-74, 1982. Another method of introduction of nucleic acid segments is high velocity ballistic penetration by small particles with the nucleic acid either within the matrix of small beads or particles, or on the surface, Klein, et al., *Nature*, 327, 70-73, 1987 and Knudsen and Muller, 1991, *Planta*, 185:330-336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA*, 79, 1859-1863, 1982.

The vector may also be introduced into the plant cells by electroporation. (Fromm et al., *Proc. Natl. Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Herocallis, Nemesia, Pelargonium, Panicum, Pennisetum, Ranunculus, Senecio, Salpiglossis, Cucumis, Browaalia, Glycine, Lolium, Zea, Triticum, Sorghum*, and *Datura*.

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iv. Bacterial Systems

Bacterial expression techniques are known in the art. A bacterial promoter is any DNA sequence capable of binding bacterial RNA polymerase and initiating the downstream (3') transcription of a coding sequence (e.g., structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) [Raibaud et al. (1984) *Annu. Rev. Genet.* 18:173]. Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) [Chang et al. (1977) *Nature* 198:1056], and maltose. Additional examples include promoter sequences derived from biosynthetic enzymes such as tryptophan (trp) [Goeddel et al. (1980) *Nuc. Acids Res.* 8:4057; Yelverton et al. (1981) *Nucl. Acids Res.* 9:731; U.S. Pat. No. 4,738,921; EP-A-0036776 and EP-A-0121775]. The g-laotamase (bla) promoter system [Weissmann (1981) "The cloning of interferon and other mistakes." In *Interferon* 3 (ed. I. Gresser)], bacteriophage lambda PL [Shimatake et al. (1981) *Nature* 292:128] and T5 [U.S. Pat. No. 4,689,406] promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter [U.S. Pat. No. 4,551,433]. For example, the tac promoter is a hybrid trp-lac promoter comprised of both trp promoter and lac operon sequences that is regulated by the lac repressor [Amann et al. (1983) *Gene* 25:167; de Boer et al. (1983) *Proc. Natl. Acad. Sci.* 80:21].

Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system [Studier et al. (1986) *J. Mol. Biol.* 189:113; Tabor et al. (1985) *Proc Natl. Acad. Sci.* 82:1074]. In addition, a hybrid promoter can also be comprised of a bacteriophage promoter and an *E. coli* operator region (EPO-A-0 267 851).

In addition to a functioning promoter sequence, an efficient ribosome binding site is also useful for the expression of foreign genes in prokaryotes. In *E. coli*, the ribosome binding site is called the Shine-Dalgarno (SD) sequence and includes an initiation codon (ATG) and a sequence 3-9 nucleotides in length located 3-11 nucleotides upstream of the initiation codon [Shine et al. (1975) *Nature* 254:34]. The SD sequence is thought to promote binding of mRNA to the ribosome by the pairing of bases between the SD sequence and the 3' and of *E. coli* 16S rRNA [Steitz et al. (1979) "Genetic signals and nucleotide sequences in messenger RNA." In *Biological Regulation and Development: Gene Expression* (ed. R. F. Goldberger)]. To express eukaryotic genes and prokaryotic genes with weak ribosome-binding site [Sambrook et al. (1989) "Expression of cloned genes in *Escherichia coli*." In *Molecular Cloning: A Laboratory Manual*].

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo on in vitro incubation with a bacterial methionine N-terminal peptidase (EPO-A-0 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene [Nagai et al. (1984) *Nature* 309:810]. Fusion proteins can also be made with sequences from the lacZ [Jia et al. (1987) *Gene* 60:197], trpE [Allen et al. (1987) J. Biotechnol. 5:93; Makoff et al. (1989) *J. Gen. Microbiol.* 135:11], and Chey [EP-A-0 324 647] genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (e.g., ubiquitin specific processing-protease) to cleave the ubiquitin from the foreign protein. Through this method, native foreign protein can be isolated [Miller et al. (1989) *Bio/Technology* 7:698].

Alternatively, foreign proteins can also be secreted from the cell by creating chimeric DNA molecules that encode a fusion protein comprised of a signal peptide sequence fragment that provides for secretion of the foreign protein in bacteria [U.S. Pat. No. 4,336,336]. The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the *E. coli* outer membrane protein gene (ompA) [Masui et al. (1983), in: *Experimental Manipulation of Gene Expression*; Ghrayeb et al. (1984) *EMBO J.* 3:2437] and the *E. coli* alkaline phosphatase signal sequence (phoA) [Oka et al. (1985) *Proc. Natl. Acad. Sci.* 82:7212]. As an additional example, the signal sequence of the alpha-amylase gene from various *Bacillus* strains can be used to secrete heterologous proteins from *B. subtilis* [Palva et al. (1982) *Proc. Natl. Acad. Sci. USA* 79:5582; EP-A-0 244 042].

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (e.g., plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EP-A-0 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, KANAMYCIN (neomycin), and tetracycline [Davies et al. (1978) *Annu. Rev. Microbiol.* 32:469]. Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: *Bacillus subtilis* [Palva et al. (1982) *Proc. Natl. Acad. Sci. USA* 79:5582; EP-A-0 036 259 and EP-A-0 063 953; WO 84/04541], *Escherichia coli* [Shimatake et al. (1981) *Nature* 292:128; Amann et al. (1985) *Gene* 40:183; Studier et al. (1986) *J. Mol. Biol.* 189:113; EP-A-0 036 776, EP-A-0 136 829 and EP-A-0 136 907], *Streptococcus cremoris* [Powell et al. (1988) *Appl. Environ. Microbiol.* 54:655]; *Streptococcus lividans* [Powell et al. (1988) *Appl. Environ. Microbiol.* 54:655], *Streptomyces lividans* [U.S. Pat. No. 4,745,056].

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. See e.g., [Masson et al. (1989) *FEMS Microbiol. Lett.* 60:273; Palva et al. (1982) *Proc. Natl. Acad. Sci. USA* 79:5582; EP-A-0 036 259 and EP-A-0 063 953; WO 84/04541, *Bacillus*], [Miller et al. (1988) *Proc. Natl. Acad. Sci.* 85:856; Wang et al. (1990) *J. Bacteriol.* 172:949, *Campylobacter*], [Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE1-derived plasmids." In *Genetic Engineering: Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; *Escherichia*], [Chassy et al. (1987) *FEMS Microbiol. Lett.* 44:173 *Lactobacillus*]; [Fiedler et al. (1988) *Anal. Biochem* 170:38, *Pseudomonas*]; [Augustin et al. (1990) *FEMS Microbiol. Lett.* 66:203, *Staphylococcus*], [Barany et al. (1980) *J. Bacteriol.* 144:698; Harlander (1987) "Transformation of *Streptococcus lactis* by electroporation," in: *Streptococcal Genetics* (ed. J. Ferretti and R. Curtiss III); Perry et al. (1981) *Infect. Immun.* 32:1295; Powell et al. (1988) *Appl. Environ. Microbiol.* 54:655; Somkuti et al. (1987) *Proc. 4th Evr. Cong. Biotechnology* 1:412, *Streptococcus*].

v. Yeast Expression

Yeast expression systems are also known to one of ordinary skill in the art. A yeast promoter is any DNA sequence capable of binding yeast RNA polymerase and initiating the downstream (3') transcription of a coding sequence (e.g., structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EP-A-0 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO-A-0 329 203). The yeast PHO5 gene, encoding acid phosphatase, also provides useful promoter sequences [Myanohara et al. (1983) *Proc. Natl. Acad. Sci. USA* 80:1].

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876, 197 and 4,880,734). Other examples of hybrid promoters include promoters which consist of the regulatory sequences of either the ADH2, GAL4, GAL10, OR PHO5 genes, combined with the transcriptional activation region of a glycolytic enzyme gene such as GAP or PyK (EP-A-0 164 556). Furthermore, a yeast promoter can include naturally occurring promoters of non-yeast origin that have the ability to bind yeast RNA polymerase and initiate transcription. Examples of such promoters include, inter alia, [Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast *Saccharomyces cerevisiae*," in: *Plasmids of Medical, Environmental and Commercial Importance* (eds. K. N. Timmis and A. Puhler); Mercerau-Puigalon et al. (1980) *Gene* 11:163; Panthier et al. (1980) *Curr. Genet.* 2:109;].

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See e.g., EP-A-0 196 056. Another example is a ubiquitin fusion protein. Such a fusion protein is made with the ubiquitin region that preferably retains a site for a processing enzyme (e.g., ubiquitin-specific processing protease) to cleave the ubiquitin from the foreign protein. Through this method, therefore, native foreign protein can be isolated (e.g., WO88/024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EP-A-0 012 873; JPO. 62,096,086) and the A-factor gene (U.S. Pat. No. 4,588,684). Alternatively, leaders of non-yeast origin, such as an interferon leader, exist that also provide for secretion in yeast (EP-A-0 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EP-A-0 324 274). Additional leaders employing an alpha-factor leader fragment that provides for secretion include hybrid alpha-factor leaders made with a presequence of a first yeast, but a pro-region from a second yeast alphafactor. (e.g., see WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (e.g., plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 [Botstein et al. (1979) Gene 8:17-24], pCl/1 [Brake et al. (1984) PNAS USA 81:4642-4646], and YRp17 [Stinchcomb et al. (1982) J. Mol. Biol. 158:157]. In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Either a high or low copy number vector may be selected, depending upon the effect of the vector and the foreign protein on the host. See e.g., Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome [Orr-Weaver et al. (1983) Methods in Enzymol. 101:228-245]. An integrating vector may be directed to a specific locus in yeast by selecting the appropriate homologous sequence for inclusion in the vector. See Orr-Weaver et al., supra. One or more expression construct may integrate, possibly affecting levels of recombinant protein produced [Rine et al. (1983) Proc. Natl. Acad. Sci. USA 80:6750]. The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, H154, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions [Butt et al. (1987) Microbiol. Rev. 51:351].

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors have been developed for, inter alia, the following yeasts: *Candida albicans* [Kurtz, et al. (1986) *Mol. Cell. Biol.* 6:142], *Candida maltosa* [Kunze, et al. (1985) *J. Basic Microbiol.* 25:141]. *Hansenula polymorpha* [Gleeson, et al. (1986) *J. Gen. Microbiol.* 132:3459; Roggenkamp et al. (1986) *Mol. Gen. Genet.* 202:302], *Kluyveromyces fragilis* [Das, et al. (1984) *J. Bacteriol.* 158:1165], *Kluyveromyces lactis* [De Louvencourt et al. (1983) *J. Bacteriol.* 154:737; Van den Berg et al. (1990) *Bio/Technology* 8:135], *Pichia guillerimondii* [Kunze et al. (1985) *J. Basic Microbiol.* 25:141], *Pichia pastoris* [Cregg, et al. (1985) *Mol. Cell. Biol.* 5:3376; U.S. Pat. Nos. 4,837,148 and 4,929,555], *Saccharomyces cerevisiae* [Hinnen et al. (1978) *Proc. Natl. Acad. Sci. USA* 75:1929; Ito et al. (1983) *J. Bacteriol.* 153:163], *Schizosaccharomyces pombe* [Beach and Nurse (1981) *Nature* 300:706], and *Yarrowia lipolytica* [Davidow, et al. (1985) *Curr. Genet.* 10:380471 Gaillardin, et al. (1985) *Curr. Genet.* 10:49].

Methods of introducing exogenous DNA into yeast hosts are well-known in the art, and usually include either the transformation of spheroplasts or of intact yeast cells treated with alkali cations. Transformation procedures usually vary with the yeast species to be transformed. See e.g., [Kurtz et al. (1986) *Mol. Cell. Biol.* 6:142; Kunze et al. (1985) *J. Basic Microbiol.* 25:141; *Candida*]; [Gleeson et al. (1986) *J. Gen. Microbiol.* 132:3459; Roggenkamp et al. (1986) *Mol. Gen. Genet.* 202:302; *Hansenula*]; [Das et al. (1984) *J. Bacteriol.* 158:1165; De Louvencourt et al. (1983) *J. Bacteriol.* 154: 1165; Van den Berg et al. (1990) Bio/Technology 8:135; *Kluyveromyces*]; [Cregg et al. (1985) *Mol. Cell. Biol.* 5:3376; Kunze et al. (1985) *J. Basic Microbiol.* 25:141; U.S. Pat. Nos. 4,837,148 and 4,929,555; *Pichia*]; [Hinnen et al. (1978) *Proc. Natl. Acad. Sci. USA* 75; 1929; Ito et al. (1983) *J. Bacteriol.* 153:163 *Saccharomyces*]; [Beach and Nurse (1981) *Nature* 300:706; *Schizosaccharomyces*]; [Davidow et al. (1985) *Curr. Genet.* 10:39; Gaillardin et al. (1985) *Curr. Genet.* 10:49; *Yarrowia*].

Antibodies

As used herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanised antibodies, altered antibodies, univalent antibodies, Fab proteins, and single domain antibodies.

Antibodies against the proteins of the invention are useful for affinity chromatography, immunoassays, and distinguishing/identifying meningococcal proteins.

Antibodies to the proteins of the invention, both polyclonal and monoclonal, may be prepared by conventional methods. In general, the protein is first used to immunize a suitable animal, preferably a mouse, rat, rabbit or goat. Rabbits and goats are preferred for the preparation of polyclonal sera due to the volume of serum obtainable, and the availability of labeled anti-rabbit and anti-goat antibodies Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50-200 g/injection is typically sufficient Immunization is generally boosted 2-6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25 C for one hour, followed by incubating at 4 C for 2-18 hours. The serum is recovered by centrifugation (e.g., 1,000 g for 10 minutes). About 20-50 ml per bleed may be obtained from rabbits.

Monoclonal antibodies are prepared using the standard method of Kohler & Milstein [Nature (1975) 256:495-96], or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells expressing membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (e.g., hypoxanthine, aminopterin, thymidine medium, "HAT"). The resulting hybridomas are plated by limiting dilution, and are assayed for the production of antibodies which bind specifically to the immunizing antigen (and which do not bind to unrelated antigens). The selected MAb-secreting hybridomas are then cultured either in vitro (e.g., in tissue culture bottles or hollow fiber reactors), or in vivo (as ascites in mice).

If desired, the antibodies (whether polyclonal or monoclonal) may be labeled using conventional techniques. Suitable labels include fluorophores, chromophores, radioactive atoms (particularly $^{32}P$ and $^{125}I$), electron-dense reagents, enzymes, and ligands having specific binding partners. Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}I$ may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}I$, or with an anti-biotin MAb labeled with HRP. Other permutations and possibilities will be readily apparent to those of ordinary skill in the art, and are considered as equivalents within the scope of the invention.

Pharmaceutical Compositions

Pharmaceutical compositions can comprise either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation can be determined by routine experimentation and is within the judgement of the clinician.

For purposes of the present invention, an effective dose will be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (e.g., see WO98/20734), needles, and gene guns or hyposprays. Dosage treatment may be a single dose schedule or a multiple dose schedule.

Vaccines

Vaccines according to the invention may either be prophylactic (i.e., to prevent infection) or therapeutic (i.e., to treat disease after infection).

Such vaccines comprise immunising antigen(s), immunogen(s), polypeptide(s), protein(s) or nucleic acid, usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the antigen or immunogen may be conjugated to a bacterial toxoid, such as a toxoid from diphtheria, tetanus, cholera, *H. pylori*, etc. pathogens.

Preferred adjuvants to enhance effectiveness of the composition include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59™ (WO 90/14837; Chapter 10 in *Vaccine design: the subunit and adjuvant approach*, eds. Powell & Newman, Plenum Press 1995), containing 5% Squalene, 0.5% TWEEN™ 80, and 0.5% SPAN™ 85 (optionally containing various amounts of MTP-PE (see below), although not required) formulated into submicron particles using a microfluidizer such as Model 110Y MICROFLUIDIZER™ (Microfluidics, Newton, Mass.), (b) SAF, containing 10% Squalane, 0.4% TWEEN™ 80, 5% PLURONIC™ blocked polymer L121, and thr-MDP (see below) either microfluidized into a submicron emulsion or vortexed to generate a larger particle size emulsion, and (c) Ribi™ adjuvant system (RAS), (Ribi Immunochem, Hamilton, Mont.) containing 2% Squalene, 0.2% TWEEN™ 80, and one or more bacterial cell wall components from the group consisting of monophosphorylipid A (MPL), trehalose dimycolate (TDM), and cell wall skeleton (CWS), preferably MPL+CWS (Detox™); (3) saponin adjuvants, such as Stimulon™ (Cambridge Bioscience, Worcester, Mass.) may be used or particles generated therefrom such as ISCOMs (immunostimulating complexes); (4) Complete Freund's Adjuvant (CFA) and Incomplete Freund's Adjuvant (IFA); (5) cytokines, such as interleukins (e.g., IL-1, IL-2, IL-4, IL-5, IL-6, IL-7, IL-12, etc.), interferons (e.g., gamma interferon), macrophage colony stimulating factor (M-CSF), tumor necrosis factor (TNF), etc; and (6) other substances that act as immunostimulating agents to enhance the effectiveness of the composition. Alum and MF59™ are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (MTP-PE), etc.

The immunogenic compositions (e.g., the immunising antigen/immunogen/polypeptide/protein/nucleic acid, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles.

Typically, the immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

Immunogenic compositions used as vaccines comprise an immunologically effective amount of the antigenic or immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (e.g., nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

The immunogenic compositions are conventionally administered parenterally, e.g., by injection, either subcutaneously, intramuscularly, or transdermally/transcutaneously (e.g., WO98/20734). Additional formulations suitable for other modes of administration include oral and pulmonary formulations, suppositories, and transdermal applications. Dosage treatment may be a single dose schedule or a multiple dose schedule. The vaccine may be administered in conjunction with other immunoregulatory agents.

As an alternative to protein-based vaccines, DNA vaccination may be employed [e.g., Robinson & Tones (1997) *Seminars in Immunology* 9:271-283; Donnelly et al. (1997) *Annu Rev Immunol* 15:617-648; see later herein].

Gene Delivery Vehicles

Gene therapy vehicles for delivery of constructs including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) *Cancer Gene Therapy* 1:51-64; Kimura (1994) *Human Gene Therapy* 5:845-852; Connelly (1995) *Human Gene Therapy* 6:185-193; and Kaplitt (1994) *Nature Genetics* 6:148-153.

Retroviral vectors are well known in the art and we contemplate that any retroviral gene therapy vector is employable in the invention, including B, C and D type retroviruses, xenotropic retroviruses (for example, NZB-X1, NZB-X2 and NZB9-1 (see O'Neill (1985) *J. Virol.* 53:160) polytropic retroviruses e.g., MCF and MCF-MLV (see Kelly (1983) *J. Virol.* 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (e.g., HT1080 cells) or mink parent cell lines, which eliminates inactivation in human serum.

Preferred retroviruses for the construction of retroviral gene therapy vectors include Avian Leukosis Virus, Bovine Leukemia Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) *J Virol* 19:19-25), Abelson (ATCC No. VR-999), Friend (ATCC No. VR-245), Graffi, Gross (ATCC No. VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") in 10801 University Boulevard, Manassas, Va. 20110-2209 or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. No. 5,219,740, U.S. Pat. No. 4,405,712, U.S. Pat. No. 4,861,719, U.S. Pat. No. 4,980,289, U.S. Pat. No. 4,777,127, U.S. Pat. No. 5,591,624. See also Vile (1993) *Cancer Res* 53:3860-3864; Vile (1993) *Cancer Res* 53:962-967; Ram (1993) *Cancer Res* 53 (1993) 83-88; Takamiya (1992) *J Neurosci Res* 33:493-503; Baba (1993) *J Neurosurg* 79:729-735; Mann (1983) *Cell* 33:153; Cane (1984) *Proc Natl Acad Sci* 81:6349; and Miller (1990) *Human Gene Therapy* 1.

Human adenoviral gene therapy vectors are also known in the art and employable in this invention. See, for example, Berkner (1988) Biotechniques 6:616 and Rosenfeld (1991) Science 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) *Hum. Gene Ther.* 3:147-154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (i.e., there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257-262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463-470. Additional AAV gene therapy vectors are described in U.S. Pat. No. 5,354,678, U.S. Pat. No. 5,173,414, U.S. Pat. No. 5,139,941, and U.S. Pat. No. 5,252,479.

The gene therapy vectors of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) *Science* 241:1667-1669 and in WO90/09441 and WO92/07945, HSV Us3::pgC-lacZ described in Fink (1992) *Human Gene Therapy* 3:11-19 and HSV 7134, 2 RH 105 and GAL4 described in EP 0453242 (Breakefield), and those deposited with the ATCC as accession numbers ATCC VR-977 and ATCC VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. No. 5,091,309 and U.S. Pat. No. 5,217,879 are employable. Such alpha viruses may be obtained from depositories or collections such as the ATCC in 10801 University Boulevard, Manassas, Va. 20110-2209 or isolated from known sources using commonly available techniques. Preferably, alphavirus vectors with reduced cytotoxicity are used (see U.S. Ser. No. 08/679,640).

DNA vector systems such as eukaryotic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, Nature 339 (1989) 385 and Sabin (1973) *J. Biol. Standardization* 1:115; rhinovirus, for example ATCC VR-1110 and those described in Arnold (1990) *J Cell Biochem* L401; pox viruses such as canary pox virus or vaccinia virus, for example ATCC VR-111 and ATCC VR-2010 and those described in Fisher-Hoch (1989) *Proc Natl Acad Sci* 86:317; Flexner (1989) *Ann NY Acad Sci* 569: 86, Flexner (1990) *Vaccine* 8:17; in U.S. Pat. No. 4,603,112 and U.S. Pat. No. 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802-3805; Enami & Palese (1991) *J Virol* 65:2711-2713 and Luytjes (1989) *Cell* 59:110, (see also McMichael (1983) *NEJ Med* 309:13, and Yap (1978) *Nature* 273:238 and *Nature* (1979) 277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-1251, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147-154 ligand linked DNA, for example see Wu (1989) *J Biol Chem* 264:16985-16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411-2418 and in Woffendin (1994) *Proc Natl Acad Sci* 91:1581-1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429-4432, insulin as described in Hucked (1990) *Biochem Pharmacol* 40:253-263, galactose as described in Plank (1992) *Bioconjugate Chem* 3:533-539, lactose or transferrin.

Naked DNA may also be employed. Exemplary naked DNA introduction methods are described in WO 90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. Ser. No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24):11581-11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033

Exemplary liposome and polycationic gene delivery vehicles are those described in U.S. Pat. Nos. 5,422,120 and 4,762,915; in WO 95/13796; WO94/23697; and WO91/14445; in EP-0524968; and in Stryer, Biochemistry, pages 236-240 (1975) W.H. Freeman, San Francisco; Szoka (1980) *Biochem Biophys Acta* 600:1; Bayer (1979) *Biochem Biophys*

*Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprise therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (e.g., see WO98/20734), needles, and gene guns or hyposprays. Dosage treatment may be a single dose schedule or a multiple dose schedule.

Methods for the ex vivo delivery and reimplantation of transformed cells into a subject are known in the art and described in e.g., WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of *plasmodium falciparum* known as R11.

B. Hormones, Vitamins, Etc.

Other groups that can be included are, for example: hormones, steroids, androgens, estrogens, thyroid hormone, or vitamins, folic acid.

C. Polyalkylenes, Polysaccharides, Etc.

Also, polyalkylene glycol can be included with the desired polynucleotides/polypeptides. In a preferred embodiment, the polyalkylene glycol is polyethlylene glycol. In addition, mono-, di-, or polysaccharides can be included. In a preferred embodiment of this aspect, the polysaccharide is dextran or DEAE-dextran. Also, chitosan and poly(lactide-co-glycolide)

D. Lipids, and Liposomes

The desired polynucleotide/polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide to lipid preparation can vary but will generally be around 1:1 (mg DNA:micromoles lipid), or more of lipid. For a review of the use of liposomes as carriers for delivery of nucleic acids, see, Hug and Sleight (1991) *Biochim. Biophys. Acta.* 1097:1-17; Straubinger (1983) *Meth. Enzymol.* 101:512-527.

Liposomal preparations for use in the present invention include cationic (positively charged), anionic (negatively charged) and neutral preparations. Cationic liposomes have been shown to mediate intracellular delivery of plasmid DNA (Felgner (1987) *Proc. Natl. Acad. Sci. USA* 84:7413-7416); mRNA (Malone (1989) *Proc. Natl. Acad. Sci. USA* 86:6077-6081); and purified transcription factors (Debs (1990) *J. Biol. Chem.* 265:10189-10192), in functional form.

Cationic liposomes are readily available. For example, N[1-2,3-dioleyloxy)propyl]-N,N,N-triethylammonium (DOTMA) liposomes are available under the trademark LIPOFECTIN™, from GIBCO BRL, Grand Island, N.Y. (See, also, Felgner supra). Other commercially available liposomes include transfectace (DDAB/DOPE) and DOTAP/DOPE (Boerhinger). Other cationic liposomes can be prepared from readily available materials using techniques well known in the art. See, e.g., Szoka (1978) *Proc. Natl. Acad. Sci. USA* 75:4194-4198; WO90/11092 for a description of the synthesis of DOTAP (1,2-bis(oleoyloxy)-3-(trimethylammonio)propane) liposomes.

Similarly, anionic and neutral liposomes are readily available, such as from Avanti Polar Lipids (Alabaster, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See e.g., Straubinger (1983) *Meth. Immunol.* 101:512-527; Szoka (1978) *Proc. Natl. Acad. Sci. USA* 75:4194-4198; Papahadjopoulos (1975) *Biochim. Biophys. Acta* 394:483; Wilson (1979) *Cell* 17:77); Deamer & Bangham (1976) *Biochim. Biophys. Acta* 443:629; Ostro (1977) *Biochem. Biophys. Res. Commun.* 76:836; Fraley (1979) *Proc. Natl. Acad. Sci. USA* 76:3348); Enoch & Strittmatter (1979) *Proc. Natl. Acad. Sci. USA* 76:145; Fraley (1980) *J. Biol. Chem.* (1980) 255:10431; Szoka & Papahadjopoulos (1978) *Proc. Natl. Acad. Sci. USA* 75:145; and Schaefer-Ridder (1982) *Science* 215:166.

E. Lipoproteins

In addition, lipoproteins can be included with the polynucleotide/polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C, and E, over time these lipoproteins lose A and acquire C and E apoproteins. VLDL comprises A, B, C, and E apoproteins, LDL comprises apoprotein B; and HDL comprises apoproteins A, C, and E.

The amino acid of these apoproteins are known and are described in, for example, Breslow (1985) Annu Rev. Biochem 54:699; Law (1986) Adv. Exp Med. Biol. 151:162; Chen (1986) J Biol Chem 261:12918; Kane (1980) Proc Natl Acad Sci USA 77:2465; and Utermann (1984) Hum Genet. 65:232.

Lipoproteins contain a variety of lipids including, triglycerides, cholesterol (free and esters), and phospholipids. The composition of the lipids varies in naturally occurring lipoproteins. For example, chylomicrons comprise mainly triglycerides. A more detailed description of the lipid content of naturally occurring lipoproteins can be found, for example, in *Meth. Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454-5460 and Mahey (1979) *J Clin. Invest* 64:743-750. Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30: 443. Lipoproteins can also be purchased from commercial suppliers, such as Biomedical Technologies, Inc., Stoughton, Mass., USA. Further description of lipoproteins can be found in Zuckermann et al. WO98/06437.

F. Polycationic Agents

Polycationic agents can be included, with or without lipoprotein, in a composition with the desired polynucleotide/polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples include histones, protamines, human serum albumin, DNA binding proteins, non-histone chromosomal proteins, coat proteins from DNA viruses, such as X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic polycationic agents which are useful include, for example, DEAE-dextran, POLYBRENE. Lipofectin™, and lipofectAMINE™ are monomers that form polycationic complexes when combined with polynucleotides/polypeptides.

Immunodiagnostic Assays

Meningogoccal antigens of the invention can be used in immunoassays to detect antibody levels (or, conversely, anti-meningococcal antibodies can be used to detect antigen levels). Immunoassays based on well defined, recombinant antigens can be developed to replace invasive diagnostics methods. Antibodies to meningococcal proteins within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol); and the stringency of the washing conditions following hybridization. See Sambrook et al. [supra] Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200° C. below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1 μg for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 μg of yeast DNA, blotting for two hours, and hybridizing for 4-8 hours with a probe of $10^8$ cpm/μg. For a single-copy mammalian gene a conservative approach would start with 10 μg of DNA, blot overnight, and hybridize overnight in the presence of 10% dextran sulfate using a probe of greater than $10^8$ cpm/μg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$T_m = 81 + 16.6(\log_{10} Ci) + 0.4[\%(G+C)] - 0.6(\% \text{ formamide}) - 600/n - 1.5(\% \text{ mismatch}).$$

where Ci is the salt concentration (monovalent ions) and n is the length of the hybrid in base pairs (slightly modified from Meinkoth & Wahl (1984) *Anal. Biochem.* 138: 267-284).

In designing a hybridization experiment, some factors affecting nucleic acid hybridization can be conveniently altered. The temperature of the hybridization and washes and the salt concentration during the washes are the simplest to adjust. As the temperature of the hybridization increases (i.e., stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C. for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA.

A probe is said to "hybridize" with a sequence of the invention if it can form a duplex or double stranded complex, which is stable enough to be detected.

The nucleic acid probes will hybridize to the meningococcal nucleotide sequences of the invention (including both sense and antisense strands). Though many different nucleotide sequences will encode the amino acid sequence, the native meningococcal sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the meningococcal sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex. Additional meningococcal sequence may also be helpful as a label to detect the formed duplex. For example, a non-complementary nucleotide sequence may be attached to the 5' end of the probe, with the remainder of the probe sequence being complementary to a meningococcal sequence. Alternatively, non-complementary bases or longer sequences can be interspersed into the probe, provided that the probe sequence has sufficient complementarity with the a meningococcal sequence in order to hybridize therewith and thereby form a duplex which can be detected.

The exact length and sequence of the probe will depend on the hybridization conditions, such as temperature, salt condition and the like. For example, for diagnostic applications, depending on the complexity of the analyte sequence, the nucleic acid probe typically contains at least 10-20 nucleotides, preferably 15-25, and more preferably at least 30 nucleotides, although it may be shorter than this. Short primers generally require cooler temperatures to form sufficiently stable hybrid complexes with the template.

Probes may be produced by synthetic procedures, such as the triester method of Matteucci et al. [*J. Am. Chem. Soc.* (1981) 103:3185], or according to Urdea et al. [*Proc. Natl. Acad. Sci. USA* (1983) 80: 7461], or using commercially available automated oligonucleotide synthesizers.

The chemical nature of the probe can be selected according to preference. For certain applications, DNA or RNA are appropriate. For other applications, modifications may be incorporated e.g., backbone modifications, such as phosphorothioates or methylphosphonates, can be used to increase in vivo half-life, alter RNA affinity, increase nuclease resistance etc. [e.g., see Agrawal & Iyer (1995) *Curr Opin Biotechnol* 6:12-19; Agrawal (1996) *TIBTECH* 14:376-387]; analogues such as peptide nucleic acids may also be used [e.g., see Corey (1997) *TIBTECH* 15:224-229; Buchardt et al. (1993) *TIBTECH* 11:384-386].

Alternatively, the polymerase chain reaction (PCR) is another well-known means for detecting small amounts of target nucleic acids. The assay is described in: Mullis et al. [*Meth. Enzymol.* (1987) 155: 335-350]; U.S. Pat. Nos. 4,683, 195 and 4,683,202. Two "primer" nucleotides hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired meningococcal sequence.

A thermostable polymerase creates copies of target nucleic acids from the primers using the original target nucleic acids as a template. After a threshold amount of target nucleic acids are generated by the polymerase, they can be detected by more traditional methods, such as Southern blots. When using the Southern blot method, the labelled probe will hybridize to the meningococcal sequence (or its complement).

Also, mRNA or cDNA can be detected by traditional blotting techniques described in Sambrook et al [supra]. mRNA, or cDNA generated from mRNA using a polymerase enzyme, can be purified and separated using gel electrophoresis. The nucleic acids on the gel are then blotted onto a solid support, such as nitrocellulose. The solid support is exposed to a labelled probe and then washed to remove any unhybridized probe. Next, the duplexes containing the labeled probe are detected. Typically, the probe is labelled with a radioactive moiety.

MODES FOR CARRYING OUT THE INVENTION

Preferred Fragments

The protein sequences disclosed in the International Applications have been, inter alia, subjected to computer analysis to predict antigenic peptide fragments within the full-length proteins. Three algorithms have been used in this analysis:

AMPHI This program has been used to predict T-cell epitopes [Gail et al. (1989) *J. Immunol.* 143:3007; Roberts et al. (1996) *AIDS Res Hum Retrovir* 12:593; Quakyi et al. (1992) *Scand J Immunol suppl.* 11:9] and is available in the Protean package of DNASTAR, Inc. (1228 South Park Street, Madison, Wis. 53715 USA).

ANTIGENIC INDEX as disclosed by Jameson & Wolf (1988) The antigenic index: a novel algorithm for predicting antigenic determinants. CABIOS, 4:181:186

HYDROPHILICITY as disclosed by Hopp & Woods (1981) Prediction of protein antigenic determinants from amino acid sequences. PNAS, 78:3824-3828

The three algorithms often identify the same fragments. Such multiply-identified fragments are particularly preferred. The algorithms often identify overlapping fragments (e.g., for antigen "013", AMPHI identifies aa 42-46, and Antigenic Index identifies aa 39-45). The invention explicitly includes fragments resulting from a combination of these overlapping fragments (e.g., the fragment from residue 39 to residue 46, in the case of "013"). Fragments separated by a single amino acid are also often identified (e.g., for "018-2", antigenic index identifies aa 19-23 and 25-41). The invention also includes fragments spanning the two extremes of such "adjacent" fragments (e.g., 19-41 for "081-2"). The Example provides preferred antigenic fragments of the proteins disclosed in the International Applications.

Example 1

Preferred Antigenic Protein Fragments

The following amino acid sequences in Table 1 are identified by titles indicating the number assigned to the particular open reading frame (ORF), consistent with those designated in the International Applications. The titles are of the following form: [no prefix, g, or a] [#], where "no prefix" means a sequence from *N. meningitidis* serotype B, "a" means a sequence from *N. meningitidis* serotype A, and "g" means a sequence from *N. gonorrhoeae*; and "#" means the number assigned to that open reading frame (ORF). For example, "127" refers to an *N. meningitidis* B amino acid sequence, ORF number 127. The presence of a suffix "−1" or "−2" to these titles indicates an additional sequence found for that particular ORF. Thus, for example, "a12-2" refers to an *N. meningitidis* A amino acid sequence, ORF number 12, which is another sequence found for ORF 12 in addition to the originally designated ORF 12 and ORF 12-1. Each amino acid sequence is preceded by the beginning amino acid position number and followed by the ending amino acid position number.

TABLE 1

012-1
AMPHI Regions - AMPHI
SEQ. ID. NO. 1      19-LysLeuLeuGluGlnLeuMetArgPheLeuGlnPheLeuSerGluPheLeuPheAlaLeuPheArgIle-41
SEQ. ID. NO. 2      48-ArgAlaLeuLysPheAlaArgArg-55
SEQ. ID. NO. 3      90-AsnPheIleArgHisThr-95
SEQ. ID. NO. 4      133-HisAlaAlaArgThrPhe-138
SEQ. ID. NO. 5      160-GlnGlyPheTyrGlyVal-165
SEQ. ID. NO. 6      179-GlyPheLeuArgPheGlyArgPheLeuProThrLeuLeuGlnThrLeu-194
Antigenic Index - Jameson-Wolf
SEQ. ID. NO. 7      42-PheThrHisLysSerAsnArgAlaLeuLysPheAlaArgArgHisHis-57
SEQ. ID. NO. 8      77-HisThrHisArgThrAspAsnArgLysArgSerGlySerAsnPhe-91
SEQ. ID. NO. 9      93-ArgHisThrArgHis-97
SEQ. ID. NO. 10     101-AlaAlaArgArgHisLeuIleAspGlyAspGlyGlnArgAsn-114
SEQ. ID. NO. 11     120-ThrXxxLysLeuArgSerArgGlnThr-128
SEQ. ID. NO. 12     137-ThrPheGlnSerGluGlnAsnLeu-144
SEQ. ID. NO. 13     147-ArgLeuGlyAsnGlnLysHisArgArgAsnLeuMetThrGln-160
SEQ. ID. NO. 14     173-IleGlnHisLysLysAlaGly-179
Hydrophilic Regions - Hopp-Woods
SEQ. ID. NO. 15     45-LysSerAsnArgAlaLeuLysPheAlaArgArgHisHis-57
SEQ. ID. NO. 16     77-HisThrHisArgThrAspAsnArgLysArgSerGly-88
SEQ. ID. NO. 17     101-AlaAlaArgArgHisLeuIleAspGlyAspGlyGlnArg-113
SEQ. ID. NO. 18     121-XxxLysLeuArgSerArgGln-127
SEQ. ID. NO. 19     149-GlyAsnGlnLysHisArgArgAsnLeu-157
SEQ. ID. NO. 20     173-IleGlnHisLysLysAlaGly-179
013
AMPHI Regions - AMPHI
SEQ. ID. NO. 21     42-AspSerTyrThrPhe-46
Antigenic Index - Jameson-Wolf
SEQ. ID. NO. 22     17-LysSerGluArgXxxSerGlyGlyAsnMetValProArgProSerProPheLeuPro-35
SEQ. ID. NO. 23     39-ThrGlnLeuAspSerTyrThr-45

TABLE 1-continued

| SEQ. ID. NO. 24 | 58-GluAlaAlaAlaGlnLysGlnProLysThrArgAlaValGly-71 |
| SEQ. ID. NO. 25 | 91-ArgSerGlyXxxLysIle-96 |

Hydrophilic Regions - Hopp-Woods
| SEQ. ID. NO. 26 | 17-LysSerGluArgXxxSerGly-23 |
| SEQ. ID. NO. 27 | 58-GluAlaAlaAlaGlnLysGlnProLysThrArgAlaValGly-71 |

015-2
AMPHI Regions - AMPHI
| SEQ. ID. NO. 28 | 33-GluLysProLeuAlaGlyPheTrpLysAlaLeuProHis-45 |
| SEQ. ID. NO. 29 | 107-MetCysCysValAlaCysIleVal-114 |

Antigenic Index - Jameson-Wolf
| SEQ. ID. NO. 30 | 29-TrpLysAsnProGluLysProLeu-36 |
| SEQ. ID. NO. 31 | 90-MetArgAlaArgProArgSerThrLys-98 |

Hydrophilic Regions - Hopp-Woods
| SEQ. ID. NO. 32 | 31-AsnProGluLysProLeu-36 |
| SEQ. ID. NO. 33 | 90-MetArgAlaArgProArgSerThrLys-98 |

018-2
AMPHI Regions - AMPHI
| SEQ. ID. NO. 34 | 6-IleGlnHisLeuArg-10 |
| SEQ. ID. NO. 35 | 180-HisGlyCysGlnHisIlePhe-186 |

Antigenic Index - Jameson-Wolf
| SEQ. ID. NO. 36 | 1-MetValGluArgHisIleGln-7 |
| SEQ. ID. NO. 37 | 9-LeuArgAsnGlyHis-13 |
| SEQ. ID. NO. 38 | 19-ProSerGlnGlnVal-23 |
| SEQ. ID. NO. 39 | 25-GlnMetPheGlyGlyArgAlaTyrAspPheArgAlaAspLysAlaAlaGly-41 |
| SEQ. ID. NO. 40 | 67-TyrPheAlaAspAspLysPhe-73 |
| SEQ. ID. NO. 41 | 78-LeuArgGlyAsnLeuArg-83 |
| SEQ. ID. NO. 42 | 85-PheGlnThrAspLysAlaAspLeuArgThrGlyLysHisHisAlaAspGlyAlaAlaPro-104 |
| SEQ. ID. NO. 43 | 106-ThrAlaAlaAspIleArgValAlaAla-114 |
| SEQ. ID. NO. 44 | 129-GlnGlnArgGlnLeuVal-134 |
| SEQ. ID. NO. 45 | 137-IleAlaCysAspGluAspMetArgAsnThrGlyLeuHis-149 |
| SEQ. ID. NO. 46 | 151-GlnArgValGlyAsnArgTyrAla-158 |

Hydrophilic Regions - Hopp-Woods
| SEQ. ID. NO. 47 | 1-MetValGluArgHisIleGln-7 |
| SEQ. ID. NO. 48 | 30-ArgAlaTyrAspPheArgAlaAspLysAlaAla-40 |
| SEQ. ID. NO. 49 | 67-TyrPheAlaAspAspLysPhe-73 |
| SEQ. ID. NO. 50 | 85-PheGlnThrAspLysAlaAspLeuArgThrGlyLysHisHisAlaAspGlyAlaAla-103 |
| SEQ. ID. NO. 51 | 106-ThrAlaAlaAspIleArgValAlaAla-114 |
| SEQ. ID. NO. 52 | 137-IleAlaCysAspGluAspMetArgAsn-145 |

019-2
AMPHI Regions - AMPHI
| SEQ. ID. NO. 53 | 33-ProAlaAspAsnIleGlu-38 |
| SEQ. ID. NO. 54 | 60-AspTyrGlyGlyTyrProSerAlaLeuAspAla-70 |
| SEQ. ID. NO. 55 | 80-AlaAlaTyrLeuGluAsnAlaGlyAsp-88 |
| SEQ. ID. NO. 56 | 90-AlaMetAlaGluAsnValArgAsnGluTrpLeuLysSer-102 |
| SEQ. ID. NO. 57 | 142-AlaAlaGluLeuValLysAsnThrGlyLysLeuProSerGlyCysThrLysLeuLeuGluGlnAlaAlaAlaSer-166 |
| SEQ. ID. NO. 58 | 173-AspAlaTrpArgArgValArg-179 |
| SEQ. ID. NO. 59 | 193-LeuAlaAlaAlaLeuGlySerProPheAspGlyGlyThrGlnGly-207 |
| SEQ. ID. NO. 60 | 215-AsnValIleGlyLysGluAlaArgLysSer-224 |
| SEQ. ID. NO. 61 | 229-AlaLeuLeuSerGluMet-234 |
| SEQ. ID. NO. 62 | 259-AsnValProAlaAlaValAspTyrTyrGly-268 |
| SEQ. ID. NO. 63 | 292-ArgArgTrpAspGluLeuAlaSerValIleSerHisMetProGluLysLeuGlnLys-310 |
| SEQ. ID. NO. 64 | 329-GlnGluAlaGluLysLeuTyrLysGlnAla-338 |
| SEQ. ID. NO. 65 | 367-AlaGlyLysAsnSerValArgArgMetAlaGlu-377 |
| SEQ. ID. NO. 66 | 451-ArgTyrIleSerPro-455 |
| SEQ. ID. NO. 67 | 495-GlnGlyLeuMetGlnValMet-501 |
| SEQ. ID. NO. 68 | 582-ArgAspTyrValLysLysValMet-589 |

Antigenic Index - Jameson-Wolf
| SEQ. ID. NO. 69 | 22-SerSerThrAsnThr-26 |
| SEQ. ID. NO. 70 | 28-ProAlaGlyLysThrProAlaAspAsnIleGluThrAlaAspLeuSerAlaSerValProThrArgProAlaGluProGluArgLysThrLeuAlaAspTyrGlyGlyTyrProSerAla-67 |
| SEQ. ID. NO. 71 | 69-AspAlaValLysGlnLysAsnAspAla-77 |
| SEQ. ID. NO. 72 | 85-AsnAlaGlyAspSerAlaMet-91 |
| SEQ. ID. NO. 73 | 103-LeuGlyAlaArgArgGln-108 |
| SEQ. ID. NO. 74 | 115-GluTyrAlaLysLeuGluProAlaGlyArgAlaGlnGluValGluCysTyrAlaAspSerSerArgAsnAspTyrThrArgAlaAlaGluLeuValLysAsnThrGlyLysLeuProSerGlyCys-156 |
| SEQ. ID. NO. 75 | 167-GlyLeuLeuAspGlyAsnAspAlaTrpArgArgValArgGly-180 |
| SEQ. ID. NO. 76 | 182-LeuAlaGlyArgGlnThrThrAspAlaArgAsn-192 |
| SEQ. ID. NO. 77 | 199-SerProPheAspGlyGlyThrGlnGlySerArgGluTyr-211 |
| SEQ. ID. NO. 78 | 217-IleGlyLysGluAlaArgLysSerProAsnAla-227 |
| SEQ. ID. NO. 79 | 232-SerGluMetGluSerGlyLeuSerLeuGluGlnArgSer-244 |
| SEQ. ID. NO. 80 | 254-GlnSerGlnAsnLeu-258 |
| SEQ. ID. NO. 81 | 266-TyrTyrGlyLysValAlaAspArgArgGlnLeuThrAspAspGlnIle-281 |
| SEQ. ID. NO. 82 | 287-AlaAlaLeuArgAlaArgArgTrpAspGlu-296 |
| SEQ. ID. NO. 83 | 304-MetProGluLysLeuGlnLysSerProThr-313 |
| SEQ. ID. NO. 84 | 320-ArgSerArgAlaAlaThrGlyAsnThrGlnGluAlaGluLysLeuTyrLys-336 |
| SEQ. ID. NO. 85 | 339-AlaAlaThrGlyArgAsn-344 |
| SEQ. ID. NO. 86 | 350-AlaGlyGluGluLeuGlyArgLysIleAspThrArgAsnAsnValProAspAlaGlyLysAsnSerValArgArgMetAlaGluAspGlyAlaValLysArg-383 |
| SEQ. ID. NO. 87 | 389-GlnAsnSerGlnSerAlaGlyAspAlaLysMetArgArgGlnAlaGlnAla-405 |
| SEQ. ID. NO. 88 | 409-PheAlaThrArgGlyPheAspGluAspLysLeuLeu-420 |

TABLE 1-continued

| | |
|---|---|
| SEQ. ID. NO. 89 | 438-SerAlaGluArgThrAspArgLysLeuAsnTyr-448 |
| SEQ. ID. NO. 90 | 454-SerProPheLysAspThrValIle-461 |
| SEQ. ID. NO. 91 | 464-AlaGlnAsnValAsnValAspProAla-472 |
| SEQ. ID. NO. 92 | 478-IleArgGlnGluSerArgPhe-484 |
| SEQ. ID. NO. 93 | 488-AlaGlnSerArgValGlyAla-494 |
| SEQ. ID. NO. 94 | 504-ThrAlaArgGluIleAlaGly-510 |
| SEQ. ID. NO. 95 | 520-TyrThrAlaAspGlyAsnIleArgMetGly-529 |
| SEQ. ID. NO. 96 | 535-AspThrLysArgArgLeuGlnAsnAsnGluVal-545 |
| SEQ. ID. NO. 97 | 550-GlyTyrAsnAlaGlyProGlyArgAlaArgArgTrpGlnAlaAspThrProLeuGlu-568 |
| SEQ. ID. NO. 98 | 579-SerGluThrArgAspTyrValLys-586 |
| SEQ. ID. NO. 99 | 606-LeuLysGlnArgMet-610 |
| Hydrophilic Regions - Hopp-Woods | |
| SEQ. ID. NO. 100 | 30-GlyLysThrProAlaAspAsnIleGluThrAlaAspLeu-42 |
| SEQ. ID. NO. 101 | 46-ValProThrArgProAlaGluProGluArgLysThrLeuAla-59 |
| SEQ. ID. NO. 102 | 69-AspAlaValLysGlnLysAsnAspAla-77 |
| SEQ. ID. NO. 103 | 85-AsnAlaGlyAspSerAlaMet-91 |
| SEQ. ID. NO. 104 | 103-LeuGlyAlaArgArgGln-108 |
| SEQ. ID. NO. 105 | 115-GluTyrAlaLysLeuGluProAlaGlyArgAlaGlnGluValGluCysTyrAla<br>AspSerSerArgAsnAspTyrThrArgAlaAlaGluLeuValLysAsnThrGlyLysLeuProSerGlyCys-156 |
| SEQ. ID. NO. 106 | 170-AspGlyAsnAspAlaTrpArgArgValArgGly-180 |
| SEQ. ID. NO. 107 | 185-ArgGlnThrThrAspAlaArgAsn-192 |
| SEQ. ID. NO. 108 | 201-PheAspGlyGlyThrGlnGlySerArgGlu-210 |
| SEQ. ID. NO. 109 | 217-IleGlyLysGluAlaArgLysSerProAsn-226 |
| SEQ. ID. NO. 110 | 232-SerGluMetGluSer-236 |
| SEQ. ID. NO. 111 | 238-LeuSerLeuGluGlnArgSer-244 |
| SEQ. ID. NO. 112 | 270-ValAlaAspArgArgGlnLeuThrAspAspGlnIle-281 |
| SEQ. ID. NO. 113 | 287-AlaAlaLeuArgAlaArgArgTrpAspGlu-296 |
| SEQ. ID. NO. 114 | 304-MetProGluLysLeuGlnLys-310 |
| SEQ. ID. NO. 115 | 320-ArgSerArgAlaAlaThr-325 |
| SEQ. ID. NO. 116 | 327-AsnThrGlnGluAlaGluLysLeuTyrLys-336 |
| SEQ. ID. NO. 117 | 350-AlaGlyGluGluLeuGlyArgLysIleAspThrArgAsnAsnValProAspAla<br>GlyLysAsnSerValArgArgMetAlaGluAspGlyAlaValLysArg-383 |
| SEQ. ID. NO. 118 | 392-GlnSerAlaGlyAlaAlaLysMetArgArgGlnAlaGlnAla-405 |
| SEQ. ID. NO. 119 | 411-ThrArgGlyPheAspGluAspLysLeuLeu-420 |
| SEQ. ID. NO. 120 | 438-SerAlaGluArgThrAspArgLysLeu-446 |
| SEQ. ID. NO. 121 | 478-IleArgGlnGluSerArgPhe-484 |
| SEQ. ID. NO. 122 | 504-ThrAlaArgGluIleAlaGly-510 |
| SEQ. ID. NO. 123 | 535-AspThrLysArgArgLeuGlnAsn-542 |
| SEQ. ID. NO. 124 | 554-GlyProGlyArgAlaArgArgTrpGlnAla-563 |
| SEQ. ID. NO. 125 | 579-SerGluThrArgAspTyrValLys-586 |
| SEQ. ID. NO. 126 | 606-LeuLysGlnArgMet-610 |
| 023 | |
| AMPHI Regions - AMPHI | |
| SEQ. ID. NO. 127 | 42-LysGluTyrSerAlaTrpGlnAlaPhePheSerGlnThrTrpValLysValPhePhrGlnValSerPheIleAlaValPheLeuHisAlaTrpValGly-74 |
| SEQ. ID. NO. 128 | 77-AspLeuTrpMetAspTyrIleLys-84 |
| Antigenic Index - Jameson-Wolf | |
| SEQ. ID. NO. 129 | 1-MetValGluArgLysLeuThr-7 |
| SEQ. ID. NO. 130 | 40-LeuProLysGluTyrSer-45 |
| Hydrophilic Regions - Hopp-Woods | |
| SEQ. ID. NO. 131 | 1-MetValGluArgLysLeuThr-7 |
| 025-2 | |
| AMPHI Regions - AMPHI | |
| SEQ. ID. NO. 132 | 9-AlaAlaCysThrAlaValAlaAlaLeuLeuGlyGlyCysAla-22 |
| SEQ. ID. NO. 133 | 36-MetGlnAspAlaProSerSerAlaValTyrAsnAsnProTyrGlyAla-51 |
| SEQ. ID. NO. 134 | 126-AspPheArgAlaTrpAsnGlyMetThrAsp-135 |
| SEQ. ID. NO. 135 | 140-IleGlyGlnIleValLysVal-146 |
| SEQ. ID. NO. 136 | 206-AspPheArgAlaTrpAsnGlyMetThrAspAsnMet-217 |
| SEQ. ID. NO. 137 | 219-SerIleGlyGlnIleValLysVal-226 |
| SEQ. ID. NO. 138 | 248-AlaValGlnThrProValLysProAlaAla-257 |
| SEQ. ID. NO. 139 | 261-ValGlnSerAlaProGlnPro-267 |
| SEQ. ID. NO. 140 | 290-SerGlyThrArgSer-294 |
| SEQ. ID. NO. 141 | 307-LysValValAlaAspPhe-312 |
| SEQ. ID. NO. 142 | 343-GlyLeuArgGlyTyrGlyAsn-349 |
| Antigenic Index - Jameson-Wolf | |
| SEQ. ID. NO. 143 | 22-AlaThrGlnGlnPro-26 |
| SEQ. ID. NO. 144 | 33-AsnSerGlyMetGlnAspAlaProSerSer-42 |
| SEQ. ID. NO. 145 | 52-ThrProTyrSerProAlaProAlaGlyAspAlaProTyr-64 |
| SEQ. ID. NO. 146 | 108-ValArgGlyAspThr-112 |
| SEQ. ID. NO. 147 | 115-AsnIleSerLysArgTyrHisIleSerGlnAspAspPheArgAla-129 |
| SEQ. ID. NO. 148 | 131-AsnGlyMetThrAspAsnThrLeu-138 |
| SEQ. ID. NO. 149 | 144-ValLysValLysProAlaGly-150 |
| SEQ. ID. NO. 150 | 157-AlaAlaValLysSerArgProAlaVal-165 |
| SEQ. ID. NO. 151 | 170-GlnProProValGln-174 |
| SEQ. ID. NO. 152 | 188-ValArgGlyAspThr-192 |
| SEQ. ID. NO. 153 | 195-AsnIleSerLysArgTyrHisIleSerGlnAspAspPheArgAla-209 |
| SEQ. ID. NO. 154 | 211-AsnGlyMetThrAspAsnMetLeu-218 |
| SEQ. ID. NO. 155 | 224-ValLysValLysProAlaGly-230 |
| SEQ. ID. NO. 156 | 232-AlaAlaProLysThrAlaAlaValGluSerArgProAlaValPro-246 |
| SEQ. ID. NO. 157 | 252-ProValLysProAlaAlaGlnProProValGlnSerAlaProGlnPro-267 |
| SEQ. ID. NO. 158 | 270-ProAlaAlaGluAsnLysAlaValPro-278 |

TABLE 1-continued

| | |
|---|---|
| SEQ. ID. NO. 159 | 280-ProAlaProGlnSerProAlaAlaSerProSerGlyThrArgSerValGly-296 |
| SEQ. ID. NO. 160 | 302-ArgProThrGlnGlyLysValValAlaAspPheGlyGlyAsnAsnLysGlyValAsp-320 |
| SEQ. ID. NO. 161 | 333-AlaAspGlyLysVal-337 |
| SEQ. ID. NO. 162 | 342-SerGlyLeuArgGlyTyrGly-348 |
| SEQ. ID. NO. 163 | 363-TyrGlyHisAsnGln-367 |
| SEQ. ID. NO. 164 | 370-LeuValGlyGluGlyGlnGlnValLysArgGlyGlnGln-382 |
| SEQ. ID. NO. 165 | 387-GlyAsnThrAspAlaSerArgThrGlnLeu-396 |
| SEQ. ID. NO. 166 | 398-PheGluValArgGlnAsnGlyLysProValAsnProAsnSer-411 |
| Hydrophilic Regions - Hopp-Woods | |
| SEQ. ID. NO. 167 | 35-GlyMetGlnAspAlaProSer-41 |
| SEQ. ID. NO. 168 | 108-ValArgGlyAspThr-112 |
| SEQ. ID. NO. 169 | 120-TyrHisIleSerGlnAspAspPheArg-128 |
| SEQ. ID. NO. 170 | 144-ValLysValLysPro-148 |
| SEQ. ID. NO. 171 | 157-AlaAlaValLysSerArgProAlaVal-165 |
| SEQ. ID. NO. 172 | 188-ValArgGlyAspThr-192 |
| SEQ. ID. NO. 173 | 200-TyrHisIleSerGlnAspAspPheArg-208 |
| SEQ. ID. NO. 174 | 224-ValLysValLysPro-228 |
| SEQ. ID. NO. 175 | 237-AlaAlaValGluSerArgProAlaVal-245 |
| SEQ. ID. NO. 176 | 253-ValLysProAlaAla-257 |
| SEQ. ID. NO. 177 | 270-ProAlaAlaGluAsnLysAlaValPro-278 |
| SEQ. ID. NO. 178 | 290-SerGlyThrArgSer-294 |
| SEQ. ID. NO. 179 | 313-GlyGlyAsnAsnLysGlyValAsp-320 |
| SEQ. ID. NO. 180 | 333-AlaAspGlyLysVal-337 |
| SEQ. ID. NO. 181 | 373-GluGlyGlnGlnValLysArgGlyGln-381 |
| SEQ. ID. NO. 182 | 389-ThrAspAlaSerArgThr-394 |
| SEQ. ID. NO. 183 | 400-ValArgGlnAsnGlyLysProValAsn-408 |
| 031 | |
| AMPHI Regions - AMPHI | |
| SEQ. ID. NO. 184 | 11-TyrSerAlaIleArgLeuPheThrGlnAlaValIleGluPheProGlnThrAlaGluHisCysArgArgThrArgAsp-36 |
| SEQ. ID. NO. 185 | 48-ArgArgProValGln-52 |
| Antigenic Index - Jameson-Wolf | |
| SEQ. ID. NO. 186 | 1-ArgLeuLysHisGlyVal-6 |
| SEQ. ID. NO. 187 | 25-ProGlnThrAlaGluHisCysArgArgThrArgAspGlnHisGlnGluArgArgAsnArgGlnGlyPheArgArgProValGlnHisValGlyArgArgAsnGlnGlnGlnArgHisSerGlnThrCysGlyGlnSerGlyArgAsnHisAlaGlnLysGlnGlnCysAlaThrArgGln-84 |
| Hydrophilic Regions - Hopp-Woods | |
| SEQ. ID. NO. 188 | 28-AlaGluHisCysArgArgThrArgAspGlnHisGlnGluArgArgAsnArgGlnGlyPheArgArgProVal-51 |
| SEQ. ID. NO. 189 | 54-ValGlyArgArgAsnGlnGlnGlnArgHisSerGln-65 |
| SEQ. ID. NO. 190 | 69-GlnSerGlyArgAsnHisAlaGlnLysGlnGlnCysAlaThrArgGln-84 |
| 032-2 | |
| AMPHI Regions - AMPHI | |
| SEQ. ID. NO. 191 | 11-LeuArgArgProLeuArgGln-17 |
| SEQ. ID. NO. 192 | 67-ProPheAlaAspAsnValTyrPro-74 |
| SEQ. ID. NO. 193 | 94-ThrAlaAlaValHisGlnPheGluGln-102 |
| SEQ. ID. NO. 194 | 114-ValHisGlyGlnIleGlnHisProValGlnProPheLeuArg-127 |
| SEQ. ID. NO. 195 | 134-LeuGlyLeuLeuArgArgPheAspVal-142 |
| Antigenic Index - Jameson-Wolf | |
| SEQ. ID. NO. 196 | 1-MetArgArgAsnVal-5 |
| SEQ. ID. NO. 197 | 10-ValLeuArgArgProLeuArg-16 |
| SEQ. ID. NO. 198 | 28-ArgAlaValProAlaGlyLysGlnGlyPhe-37 |
| SEQ. ID. NO. 199 | 41-CysArgLeuThrGlnArgGln-47 |
| SEQ. ID. NO. 200 | 57-AlaAspGlnArgHis-61 |
| SEQ. ID. NO. 201 | 107-HisArgGlnArgVal-111 |
| SEQ. ID. NO. 202 | 138-ArgArgPheAspValGlyGlyArgVal-146 |
| SEQ. ID. NO. 203 | 160-LeuProProArgArgLysLeuAlaSerGlnArgProPheProGln-174 |
| Hydrophilic Regions - Hopp-Woods | |
| SEQ. ID. NO. 204 | 1-MetArgArgAsnVal-5 |
| SEQ. ID. NO. 205 | 10-ValLeuArgArgProLeuArg-16 |
| SEQ. ID. NO. 206 | 28-ArgAlaValProAlaGlyLys-34 |
| SEQ. ID. NO. 207 | 41-CysArgLeuThrGln-45 |
| SEQ. ID. NO. 208 | 57-AlaAspGlnArgHis-61 |
| SEQ. ID. NO. 209 | 107-HisArgGlnArgVal-111 |
| SEQ. ID. NO. 210 | 138-ArgArgPheAspValGlyGly-144 |
| SEQ. ID. NO. 211 | 161-ProProArgArgLysLeuAlaSer-168 |
| 033-2 | |
| AMPHI Regions - AMPHI | |
| SEQ. ID. NO. 212 | 6-GlnTyrGlyGlyLeuAlaGlyPheProLysArgCysGluSerGlu-20 |
| SEQ. ID. NO. 213 | 64-GlyGlnAlaPheGluAlaLeuAsnCys-72 |
| SEQ. ID. NO. 214 | 95-ValGlyAlaLeuProLysTyrLeuAlaSerAsnValValArgAspMetHisGlyLeuLeuSerThrVal-117 |
| SEQ. ID. NO. 215 | 120-GlnThrGlyLysValLeuAspLysIleProGlyAlaMetGlu-133 |
| SEQ. ID. NO. 216 | 142-IleLysThrLeuAlaGlu-147 |
| SEQ. ID. NO. 217 | 157-SerLeuPheGluAsnPhe-162 |
| SEQ. ID. NO. 218 | 168-GlyProValAspGlyHisAsnValGluAsnLeuValAspValLeuLysAspLeuArgSerArg-188 |
| SEQ. ID. NO. 219 | 207-AlaGluAsnAspPro-211 |
| SEQ. ID. NO. 220 | 213-LysTyrHisAlaValAlaAsnLeuProLysGluSerAlaAla-226 |
| SEQ. ID. NO. 221 | 242-TyrThrGlnValPheGlyLys-248 |
| SEQ. ID. NO. 222 | 280-PheProAspArgTyrPheAspVal-287 |

TABLE 1-continued

| | |
|---|---|
| SEQ. ID. NO. 223 | 307-LysProValValAlaIleTyrSer-314 |
| SEQ. ID. NO. 224 | 316-PheLeuGlnArgAlaTyrAspGlnLeu-324 |
| SEQ. ID. NO. 225 | 363-CysValProAsnMet-367 |
| SEQ. ID. NO. 226 | 390-AlaProAlaAlaValArgTyrProArgGlyThr-400 |
| SEQ. ID. NO. 227 | 406-ValSerAspGlyMetGluThrValGlu-414 |
| SEQ. ID. NO. 228 | 419-IleIleArgArgGlu-423 |
| SEQ. ID. NO. 229 | 432-PheGlySerMetValAla-437 |
| SEQ. ID. NO. 230 | 453-MetArgPheValLysProIleAspGluGlu-462 |
| SEQ. ID. NO. 231 | 469-ArgSerHisAspArgIle-474 |
| SEQ. ID. NO. 232 | 489-AlaValLeuGluValLeu-494 |
| SEQ. ID. NO. 233 | 510-AspThrValThrGlyHisGly-516 |
| SEQ. ID. NO. 234 | 518-ProLysLysLeuLeu-522 |
| Antigenic Index - Jameson-Wolf | |
| SEQ. ID. NO. 235 | 11-AlaGlyPheProLysArgCysGluSerGluTyrAspAla-23 |
| SEQ. ID. NO. 236 | 28-HisSerSerThrSerIle-33 |
| SEQ. ID. NO. 237 | 41-AlaAlaAspLysLeuLeuGlySerAspArgArgSerVal-53 |
| SEQ. ID. NO. 238 | 57-GlyAspGlyAlaMetThr-62 |
| SEQ. ID. NO. 239 | 72-CysAlaGlyAspMetAspVal-78 |
| SEQ. ID. NO. 240 | 85-AsnAspAsnGluMetSerIle-91 |
| SEQ. ID. NO. 241 | 105-AsnValValArgAspMetHisGly-112 |
| SEQ. ID. NO. 242 | 117-ValLysAlaGlnThrGlyLysValLeuAspLysIleProGly-130 |
| SEQ. ID. NO. 243 | 134-PheAlaGlnLysValGluHisLysIleLysThrLeuAlaGluGluAlaGluHisAlaLysGln-154 |
| SEQ. ID. NO. 244 | 166-TyrThrGlyProValAspGlyHisAsn-174 |
| SEQ. ID. NO. 245 | 181-ValLeuLysAspLeuArgSerArgLysGlyProGln-192 |
| SEQ. ID. NO. 246 | 198-ThrLysLysGlyAsnGlyTyrLysLeuAlaGluAsnAspProValLys-213 |
| SEQ. ID. NO. 247 | 220-LeuProLysGluSerAlaAla-226 |
| SEQ. ID. NO. 248 | 228-MetProSerGluLysGluProLysProAlaAlaLysProThrTyr-242 |
| SEQ. ID. NO. 249 | 253-ArgAlaAlaAlaAspSerArgLeu-260 |
| SEQ. ID. NO. 250 | 266-AlaMetArgGluGlySerGlyLeuValGluPheGluGlnArgPheProAspArgTyrPhe-285 |
| SEQ. ID. NO. 251 | 345-ValGlyAlaAspGlyProThrHis-352 |
| SEQ. ID. NO. 252 | 370-AlaAlaProSerAspGluAsnGluCysArg-379 |
| SEQ. ID. NO. 253 | 395-ArgTyrProArgGlyThrGlyThrGlyAlaProValSerAspGlyMetGluThr ValGluIleGlyLysGlyIleIleArgArgGluGlyGluLysThrAla-428 |
| SEQ. ID. NO. 254 | 457-LysProIleAspGluGluLeuIle-464 |
| SEQ. ID. NO. 255 | 467-LeuAlaArgSerHisAspArgIleValThrLeuGluGluAsnAlaGluGlnGlyGlyAlaGlyGly-488 |
| SEQ. ID. NO. 256 | 512-ValThrGlyHisGlyAspProLysLysLeuLeuAspAspLeuGlyLeu-527 |
| SEQ. ID. NO. 257 | 530-GluAlaValGluArgArgValArg-537 |
| SEQ. ID. NO. 258 | 540-LeuSerArgAspArgAspAlaAlaAsn-547 |
| Hydrophilic Regions - Hopp-Woods | |
| SEQ. ID. NO. 259 | 13-PheProLysArgCysGluSerGluTyrAsp-22 |
| SEQ. ID. NO. 260 | 41-AlaAlaAspLysLeuLeuGlySerAspArgArgSerVal-53 |
| SEQ. ID. NO. 261 | 74-GlyAspMetAspVal-78 |
| SEQ. ID. NO. 262 | 85-AsnAspAsnGluMetSerIle-91 |
| SEQ. ID. NO. 263 | 106-ValValArgAspMetHis-111 |
| SEQ. ID. NO. 264 | 123-LysValLeuAspLysIleProGly-130 |
| SEQ. ID. NO. 265 | 134-PheAlaGlnLysValGluHisLysIleLysThrLeuAlaGluGluAlaGluHisAlaLysGln-154 |
| SEQ. ID. NO. 266 | 181-ValLeuLysAspLeuArgSerArgLysGlyPro-191 |
| SEQ. ID. NO. 267 | 198-ThrLysLysGlyAsnGly-203 |
| SEQ. ID. NO. 268 | 205-LysLeuAlaGluAsnAspProValLys-213 |
| SEQ. ID. NO. 269 | 220-LeuProLysGluSerAlaAla-226 |
| SEQ. ID. NO. 270 | 228-MetProSerGluLysGluProLysProAlaAla-238 |
| SEQ. ID. NO. 271 | 253-ArgAlaAlaAlaAspSerArgLeu-260 |
| SEQ. ID. NO. 272 | 266-AlaMetArgGluGlySerGly-272 |
| SEQ. ID. NO. 273 | 274-ValGluPheGluGlnArgPheProAspArgTyrPhe-285 |
| SEQ. ID. NO. 274 | 372-ProSerAspGluAsnGluCys-378 |
| SEQ. ID. NO. 275 | 405-ProValSerAspGlyMetGluThrValGluIleGlyLysGlyIleIleArgArgGluGlyGluLysThrAla-428 |
| SEQ. ID. NO. 276 | 457-LysProIleAspGluGluLeuIle-464 |
| SEQ. ID. NO. 277 | 467-LeuAlaArgSerHisAspArgIleValThrLeuGluGluAsnAlaGluGlnGlyGly-485 |
| SEQ. ID. NO. 278 | 513-ThrGlyHisGlyAspProLysLysLeuLeuAsp-523 |
| SEQ. ID. NO. 279 | 530-GluAlaValGluArgArgValArg-537 |
| SEQ. ID. NO. 280 | 540-LeuSerArgAspArgAspAlaAlaAsn-547 |
| 034-2 | |
| AMPHI Regions - AMPHI | |
| SEQ. ID. NO. 281 | 35-LeuAspHisAlaAla-39 |
| SEQ. ID. NO. 282 | 52-AsnLeuGluGlnMetArgAlaIleMetGluAlaAlaAspGln-65 |
| SEQ. ID. NO. 283 | 94-AlaValGluGluPheProHisIlePro-102 |
| SEQ. ID. NO. 284 | 152-ThrValValAsnPheSer-157 |
| SEQ. ID. NO. 285 | 168-IleGlyValLeuGlyAsnLeuGluThrGly-177 |
| SEQ. ID. NO. 286 | 186-GlyAlaValGlyLysLeuSer-192 |
| SEQ. ID. NO. 287 | 226-TyrLysPheThrArgProProThrGly-234 |
| SEQ. ID. NO. 288 | 236-ValLeuArgIleAspArgIleLysGluIleHisGlnAlaLeu-249 |
| SEQ. ID. NO. 289 | 261-SerValProGlnGluTrpLeuLysValIleAsnGluTyrGlyGlyAsnIleGly GluThrTyrGlyValProValGluGluIleValGluGlyIleLysHisGly-295 |
| SEQ. ID. NO. 290 | 314-ArgArgTyrLeuAlaGluAsn-320 |
| SEQ. ID. NO. 291 | 330-LeuSerLysThrIleGluAlaMetLys-338 |
| Antigenic Index - Jameson-Wolf | |
| SEQ. ID. NO. 292 | 20-LeuProLysGluThrGln-25 |
| SEQ. ID. NO. 293 | 37-HisAlaAlaGluAsnSerTyrGly-44 |
| SEQ. ID. NO. 294 | 54-GluGlnMetArgAlaIleMetGluAlaAlaAspGlnValAsp-67 |
| SEQ. ID. NO. 295 | 75-SerAlaGlyAlaArgLysTyrAla-82 |

TABLE 1-continued

| | |
|---|---|
| SEQ. ID. NO. 296 | 106-HisGlnAspHisGlyAlaSerProAspValCysGlnArgSerIle-120 |
| SEQ. ID. NO. 297 | 129-MetAspGlySerLeuMetGluAspGlyLysThrProSerSerTyrGluTyr-145 |
| SEQ. ID. NO. 298 | 164-ValGluGlyGluIle-168 |
| SEQ. ID. NO. 299 | 173-AsnLeuGluThrGlyGluAlaGlyGluGluAspGlyVal-185 |
| SEQ. ID. NO. 300 | 191-LeuSerHisAspGln-195 |
| SEQ. ID. NO. 301 | 208-LysAspThrGlyVal-212 |
| SEQ. ID. NO. 302 | 221-ThrSerHisGlyAla-225 |
| SEQ. ID. NO. 303 | 227-LysPheThrArgProProThrGlyAspValLeuArgIleAspArgIleLysGluIleHis-246 |
| SEQ. ID. NO. 304 | 258-GlySerSerSerValPro-263 |
| SEQ. ID. NO. 305 | 271-AsnGluTyrGlyGlyAsnIleGlyGlu-279 |
| SEQ. ID. NO. 306 | 287-GluIleValGluGlyIleLysHisGlyValArgLysValAsnIleAspThrAsp<br>LeuArgLeuAlaSerThrGlyAlaVal-313 |
| SEQ. ID. NO. 307 | 316-TyrLeuAlaGluAsnProSerAspPheAspProArgLysTyrLeuSer-331 |
| SEQ. ID. NO. 308 | 333-ThrIleGluAlaMetLys-338 |
| SEQ. ID. NO. 309 | 350-CysGluGlyGlnAlaGlyLysIleLysProValSerLeuGluLysMetAlaSerArgTyrAlaLysGlyGluLeu-374 |
| Hydrophilic Regions - Hopp-Woods | |
| SEQ. ID. NO. 310 | 54-GluGlnMetArgAlaIleMetGluAlaAlaAspGlnValAsp-67 |
| SEQ. ID. NO. 311 | 76-AlaGlyAlaArgLysTyrAla-82 |
| SEQ. ID. NO. 312 | 108-AspHisGlyAlaSerProAspValCysGln-117 |
| SEQ. ID. NO. 313 | 132-SerLeuMetGluAspGlyLysThrProSer-141 |
| SEQ. ID. NO. 314 | 164-ValGluGlyGluIle-168 |
| SEQ. ID. NO. 315 | 175-GluThrGlyGluAlaGlyGluGluAspGlyVal-185 |
| SEQ. ID. NO. 316 | 208-LysAspThrGlyVal-212 |
| SEQ. ID. NO. 317 | 235-AspValLeuArgIleAspArgIleLysGluIleHis-246 |
| SEQ. ID. NO. 318 | 287-GluIleValGluGlyIleLysHisGlyValArgLysValAsnIleAspThrAspLeuArgLeu-307 |
| SEQ. ID. NO. 319 | 320-AsnProSerAspPheAspProArgLysTyrLeu-330 |
| SEQ. ID. NO. 320 | 333-ThrIleGluAlaMetLys-338 |
| SEQ. ID. NO. 321 | 352-GlyGlnAlaGlyLysIleLysProValSerLeuGluLysMetAlaSerArgTyrAlaLysGlyGluLeu-374 |
| 036-1 | |
| AMPHI Regions - AMPHI | |
| SEQ. ID. NO. 322 | 6-AlaValTyrSerAlaCysAlaAla-13 |
| SEQ. ID. NO. 323 | 29-GlyArgCysValAsnGlnTyr-35 |
| SEQ. ID. NO. 324 | 59-SerSerGlyArgPheCysGlnThrIleLys-68 |
| SEQ. ID. NO. 325 | 106-AlaAlaSerSerSerGlnSer-112 |
| SEQ. ID. NO. 326 | 142-AlaAsnArgArgVal-146 |
| Antigenic Index - Jameson-Wolf | |
| SEQ. ID. NO. 327 | 16-ProAlaArgThrSerSerSerArgArgCysValSerSerGlyArgCysValAsnG<br>lnTyrSerSerArgAlaAspAla-41 |
| SEQ. ID. NO. 328 | 43-ProTrpArgArgHisSerGlyAla-50 |
| SEQ. ID. NO. 329 | 55-CysSerSerAspSerSerGlyArgPhe-63 |
| SEQ. ID. NO. 330 | 73-ProSerPheSerAlaArgLysThrCysSerAspGlyGluThrSerAlaAspSerAsnTrpArg-93 |
| SEQ. ID. NO. 331 | 96-HisAlaAspGlyLeuGlnThrAlaSerSerAlaAlaSerSerSerGlnSerAlaGlnThrAlaArgMetPhe-120 |
| SEQ. ID. NO. 332 | 133-SerGlyArgPheCysCysGlyArgArgAlaAsnArgArgValArgHisGlyArgGlnAspAsnArgPro-155 |
| SEQ. ID. NO. 333 | 158-ProMetArgGluSerArgArgGlnSerAla-167 |
| SEQ. ID. NO. 334 | 178-LeuProAlaArgThrArgCys-184 |
| SEQ. ID. NO. 335 | 186-CysArgLeuLysArgArgIleProProAla-195 |
| SEQ. ID. NO. 336 | 200-ProProAlaArgProAspAsnArgSerAsnGlyGlySerSerAlaTyrArgThrMetHisLysThrLeuArgProTyrGluArgPro-228 |
| Hydrophilic Regions - Hopp-Woods | |
| SEQ. ID. NO. 337 | 18-ArgThrSerSerSerArgArgCysValSerSer-28 |
| SEQ. ID. NO. 338 | 35-TyrSerSerArgAlaAsp-40 |
| SEQ. ID. NO. 339 | 45-ArgArgHisSerGly-49 |
| SEQ. ID. NO. 340 | 55-CysSerSerAspSerSerGlyArg-62 |
| SEQ. ID. NO. 341 | 75-PheSerAlaArgLysThrCysSerAspGlyGluThrSerAla-88 |
| SEQ. ID. NO. 342 | 107-AlaSerSerSerGlnSer-112 |
| SEQ. ID. NO. 343 | 114-GlnThrAlaArgArgMetPhe-120 |
| SEQ. ID. NO. 344 | 137-CysCysGlyArgArgAlaAsnArgArgValArgHisGlyArgGlnAspAsnArgPro-155 |
| SEQ. ID. NO. 345 | 160-ArgGluSerArgArgGlnSer-166 |
| SEQ. ID. NO. 346 | 178-LeuProAlaArgThrArgCys-184 |
| SEQ. ID. NO. 347 | 186-CysArgLeuLysArgArgIleProPro-194 |
| SEQ. ID. NO. 348 | 202-AlaArgProAspAsnArgSerAsnGlyGly-211 |
| SEQ. ID. NO. 349 | 217-ThrMetHisLysThrLeuArgProTyrGluArgPro-228 |
| 038 | |
| AMPHI Regions - AMPHI | |
| SEQ. ID. NO. 350 | 100-GluAlaLysAspHis-104 |
| SEQ. ID. NO. 351 | 134-GluSerIleLys-137 |
| SEQ. ID. NO. 352 | 157-GluLysGlyThrGlyGluLeuSerAlaValGlnGluValGluLys-171 |
| SEQ. ID. NO. 353 | 178-AlaProIleAlaSerLeuAsn-184 |
| SEQ. ID. NO. 354 | 195-GluPheGlyGlnPheLeuGluProValArgAlaTyrArgArgGlnTyrGlyVal-212 |
| Antigenic Index - Jameson-Wolf | |
| SEQ. ID. NO. 355 | 2-ThrAspPheArgGlnAspPhe-8 |
| SEQ. ID. NO. 356 | 22-GluPheThrThrLysAlaGlyArgArgSerPro-32 |
| SEQ. ID. NO. 357 | 38-GlyLeuPheAsnAspGlyLeu-44 |
| SEQ. ID. NO. 358 | 58-IleGluSerGlyIleArg-63 |
| SEQ. ID. NO. 359 | 85-LeuAlaGluLysGlyVal-90 |
| SEQ. ID. NO. 360 | 96-TyrAsnArgLysGluAlaLysAspHisGlyGluGlyGly-108 |
| SEQ. ID. NO. 361 | 125-ValIleSerAlaGlyThrSerValArgGluSerIleLysLeuIleGluAlaGlu<br>GlyAlaThrLeuAspArgMetGluLysGlyThrGlyGlu-162 |
| SEQ. ID. NO. 362 | 167-GlnGluValGluLysGlnTyrGlyLeu-175 |
| SEQ. ID. NO. 363 | 191-GlnAsnAsnProGluPheGlyGln-198 |
| SEQ. ID. NO. 364 | 203-ValArgAlaTyrArgArgGlnTyrGlyValGlu-213 |

TABLE 1-continued

Hydrophilic Regions - Hopp-Woods
SEQ. ID. NO. 365    2-ThrAspPheArgGlnAspPhe-8
SEQ. ID. NO. 366    22-GluPheThrThrLysAlaGlyArgArgSer-31
SEQ. ID. NO. 367    85-LeuAlaGluLysGlyVal-90
SEQ. ID. NO. 368    96-TyrAsnArgLysGluAlaLysAspHisGlyGlu-106
SEQ. ID. NO. 369    130-ThrSerValArgGluSerIleLysLeuIleGluAlaGluGlyAlaThr-145
SEQ. ID. NO. 370    153-LeuAspArgMetGluLysGlyThrGlyGlu-162
SEQ. ID. NO. 371    167-GlnGluValGluLysGlnTyr-173
SEQ. ID. NO. 372    204-ArgAlaTyrArgArgGlnTyrGly-211
040-2
AMPHI Regions - AMPHI
SEQ. ID. NO. 373    8-ValAlaHisPheArgGluAlaValProTyrIleArg-19
SEQ. ID. NO. 374    28-AlaGlyIleAspAsp-32
SEQ. ID. NO. 375    38-AspThrLeuAsnLysLeu-43
SEQ. ID. NO. 376    78-ProHisTyrCysArgGlyLeuArgValThrAspGlu-89
SEQ. ID. NO. 377    92-LeuGluGlnAlaGlnGlnPheAlaGly-100
SEQ. ID. NO. 378    113-SerValSerGlyPheAlaArgAlaPro-121
SEQ. ID. NO. 379    134-ArgProIleGlyValIleAspGly-141
SEQ. ID. NO. 380    146-TyrAlaGlyValIleArg-151
SEQ. ID. NO. 381    187-LeuGlnThrAlaAla-191
SEQ. ID. NO. 382    207-LeuSerAspGlyIleSerArgProAspGlyThrLeuAlaGlu-220
SEQ. ID. NO. 383    223-SerAlaGlnGluAlaGlnSerLeuAlaGluHisAla-234
SEQ. ID. NO. 384    244-SerAlaValAlaAlaLeuGluGly-251
SEQ. ID. NO. 385    277-IleGlyThrSerIle-281
SEQ. ID. NO. 386    289-IleArgGlnAlaHisSerGlyAspIleProHisIleAlaAlaLeuIleArgProLeuGlu-308
SEQ. ID. NO. 387    320-TyrLeuGluAsnHisIleSerGluPheSerIle-330
SEQ. ID. NO. 388    338-TyrGlyCysAlaAlaLeuLysThrPheAlaGluAlaAsp-350
SEQ. ID. NO. 389    371-ArgLeuLeuAlaHisIle-376
SEQ. ID. NO. 390    386-SerArgLeuPheAla-390
Antigenic Index - Jameson-Wolf
SEQ. ID. NO. 391    19-ArgGlnMetArgGlyLysThrLeu-26
SEQ. ID. NO. 392    29-GlyIleAspAspArgLeuLeuGluGlyAspThrLeuAsn-41
SEQ. ID. NO. 393    65-HisPheLeuAspArgHisAlaAlaAlaGlnGlyArgThrProHisTyrCysArgG
                    lyLeuArgValThrAspGluThrSerLeuGluGlnAlaGln-96
SEQ. ID. NO. 394    101-ThrValArgSerArgPheGlu-107
SEQ. ID. NO. 395    119-ArgAlaProSerVal-123
SEQ. ID. NO. 396    140-AspGlyThrAspMetGluTyr-146
SEQ. ID. NO. 397    150-IleArgLysThrAspThrAlaAla-157
SEQ. ID. NO. 398    173-LeuGlyHisSerTyrSerGlyLysThrPhe-182
SEQ. ID. NO. 399    208-SerAspGlyIleSerArgProAspGlyThrLeuAla-219
SEQ. ID. NO. 400    222-LeuSerAlaGlnGluAlaGlnSerLeuAlaGluHisAlaGlyGlyGluThrArgArgLeuIle-242
SEQ. ID. NO. 401    249-LeuGluGlyGlyVal-253
SEQ. ID. NO. 402    261-GlyAlaAlaAspGlySerLeuLeu-268
SEQ. ID. NO. 403    272-PheThrArgAsnGlyIleGlyThrSerIleAlaLysGluAlaPheVal-287
SEQ. ID. NO. 404    289-IleArgGlnAlaHisSerGlyAspIle-297
SEQ. ID. NO. 405    305-ArgProLeuGluGluGlnGly-311
SEQ. ID. NO. 406    313-LeuLeuHisArgSerArgGluTyrLeu-321
SEQ. ID. NO. 407    331-LeuGluHisAspGlyAsnLeuTyr-338
SEQ. ID. NO. 408    345-ThrPheAlaGluAlaAspCysGlyGlu-353
SEQ. ID. NO. 409    361-ProGlnAlaGlnAspGlyGlyTyrGlyGluArgLeu-372
SEQ. ID. NO. 410    377-IleAspLysAlaArgGly-382
SEQ. ID. NO. 411    393-ThrAsnThrGlyGlu-397
SEQ. ID. NO. 412    402-ArgGlyPheGlnThrAlaSerGluAspGluLeuProGluThrArgArgLysAspTyrArgSerAsnGlyArgAsnSerHisIleLeu-430
Hydrophilic Regions - Hopp-Woods
SEQ. ID. NO. 413    19-ArgGlnMetArgGlyLysThr-25
SEQ. ID. NO. 414    29-GlyIleAspAspArgLeuLeuGluGlyAspThrLeuAsn-41
SEQ. ID. NO. 415    65-HisPheLeuAspArgHisAlaAlaAlaGlnGlyArgThr-77
SEQ. ID. NO. 416    84-LeuArgValThrAspGluThrSerLeuGluGln-94
SEQ. ID. NO. 417    102-ValArgSerArgPheGlu-107
SEQ. ID. NO. 418    140-AspGlyThrAspMetGluTyr-146
SEQ. ID. NO. 419    150-IleArgLysThrAspThrAlaAla-157
SEQ. ID. NO. 420    210-GlyIleSerArgProAspGlyThrLeu-218
SEQ. ID. NO. 421    222-LeuSerAlaGlnGluAlaGlnSerLeuAlaGlu-232
SEQ. ID. NO. 422    234-AlaGlyGlyGluThrArgArgLeuIle-242
SEQ. ID. NO. 423    291-GlnAlaHisSerGlyAsp-296
SEQ. ID. NO. 424    305-ArgProLeuGluGluGlnGly-311
SEQ. ID. NO. 425    315-HisArgSerArgGluTyrLeu-321
SEQ. ID. NO. 426    345-ThrPheAlaGluAlaAspCysGlyGlu-353
SEQ. ID. NO. 427    362-GlnAlaGlnAspGlyGlyTyrGlyGlu-370
SEQ. ID. NO. 428    377-IleAspLysAlaArgGly-382
SEQ. ID. NO. 429    402-ArgGlyPheGlnThrAlaSerGluAspGluLeuProGluThrArgArgLysAspTyrArgSerAsnGlyArgAsn-426
041-1
AMPHI Regions - AMPHI
SEQ. ID. NO. 430    6-AspProTyrArgHisPheGluAsnLeuAspSerAlaGluThr-19
SEQ. ID. NO. 431    45-AspGlyIleLeuAla-49
SEQ. ID. NO. 432    78-LysGlyValTyrArgValCysThrAlaAla-87
SEQ. ID. NO. 433    102-ValAlaAspPheAspGluLeuLeu-109
SEQ. ID. NO. 434    117-GlyValSerHisLeuValGluGlnProAsn-126
SEQ. ID. NO. 435    219-ValAsnAlaTrpArgTyrLeuAsp-226
SEQ. ID. NO. 436    232-IleAspLeuIleGluAlaSer-238

TABLE 1-continued

| | |
|---|---|
| SEQ. ID. NO. 437 | 258-LeuAsnLeuProAsnAspCysAspValValGlyTyrLeu-270 |
| SEQ. ID. NO. 438 | 282-TrpAsnArgAlaAsnGln-287 |
| SEQ. ID. NO. 439 | 317-GlnAlaLeuGluSerValGluThr-324 |
| SEQ. ID. NO. 440 | 331-AlaSerLeuLeuGluAsnValGlnGlyArg-340 |
| SEQ. ID. NO. 441 | 382-AspPheThrThrProLeu-387 |
| SEQ. ID. NO. 442 | 405-GlnProGlnGlnPhe-409 |
| SEQ. ID. NO. 443 | 451-GlyPheGlyIleProGluLeuProHisTyrLeuGlySerIleGlyLys-466 |
| SEQ. ID. NO. 444 | 493-AlaAlaGlnGlyIleSerLysHisLysSerValAspAspLeuLeuAlaValValArgAspLeuSerGluArg-516 |
| SEQ. ID. NO. 445 | 519-SerSerProGluHis-523 |
| SEQ. ID. NO. 446 | 541-ValArgGluProGlnSer-546 |
| SEQ. ID. NO. 447 | 556-LeuThrAspMetIleArgTyr-562 |
| SEQ. ID. NO. 448 | 571-TrpThrAspGluTyrGlyAsnProGlnLysTyrGlu-582 |
| SEQ. ID. NO. 449 | 591-LeuSerProTyrHisAsnLeuSerAspGlyIleAspTyrProPro-605 |
| SEQ. ID. NO. 450 | 620-AlaHisAlaLeuLys-624 |
| SEQ. ID. NO. 451 | 626-TyrAlaLysLeuArg-630 |
| SEQ. ID. NO. 452 | 645-GlyHisThrGlyAsn-649 |
| SEQ. ID. NO. 453 | 651-ThrGlnArgGluSer-655 |
| AntigenicIndex - Jameson-Wolf | |
| SEQ. ID. NO. 454 | 1-MetLysSerTyrProAspProTyrArgHisPheGluAsnLeuAspSerAlaGluThrGln-20 |
| SEQ. ID. NO. 455 | 26-AlaAsnAlaGluThrArgAlaArgPheLeuGluAsnAspLysAlaArgAlaLeuSerAspGly-46 |
| SEQ. ID. NO. 456 | 51-LeuGlnAspThrArgGlnIleProPhe-59 |
| SEQ. ID. NO. 457 | 61-GlnGluHisArgAlaArg-66 |
| SEQ. ID. NO. 458 | 72-GlnAspAlaGluTyrProLysGlyVal-80 |
| SEQ. ID. NO. 459 | 89-TyrArgSerGlyTyrProGluTrp-96 |
| SEQ. ID. NO. 460 | 104-AspPheAspGluLeuLeuGlyAspValTyr-114 |
| SEQ. ID. NO. 461 | 123-GluGlnProAsnArg-127 |
| SEQ. ID. NO. 462 | 133-SerLysLeuGlySerAspThrAlaTyr-141 |
| SEQ. ID. NO. 463 | 145-ValAspLeuGluAlaGlyGluLeuValGlu-154 |
| SEQ. ID. NO. 464 | 161-AlaGlyLysAsnHisValSerTrpArgAspGluAsnSerVal-174 |
| SEQ. ID. NO. 465 | 178-ProAlaTrpAsnGluArgGlnLeuThrGlnSerGlyTyrProArgGluValTrpLeuValGluArgGlyLysSerPheGluGluSerLeu-207 |
| SEQ. ID. NO. 466 | 212-IleGlyGluAspGlyMet-217 |
| SEQ. ID. NO. 467 | 223-ArgTyrLeuAspProGlnGlySerProIleAspLeuIleGluAlaSerAspGlyPheTyr-242 |
| SEQ. ID. NO. 468 | 249-ValSerAlaGluGlyGluAlaLysProLeuAsnLeuProAsnAspCysAspVal-266 |
| SEQ. ID. NO. 469 | 277-ThrLeuArgLysAspTrpAsnArgAlaAsnGlnSerTyrProSer-291 |
| SEQ. ID. NO. 470 | 298-LysLeuAsnArgGlyGluLeuGly-305 |
| SEQ. ID. NO. 471 | 313-ProAspGluThrGlnAla-318 |
| SEQ. ID. NO. 472 | 320-GluSerValGluThrThrLys-326 |
| SEQ. ID. NO. 473 | 337-ValGlnGlyArgLeuLysAla-343 |
| SEQ. ID. NO. 474 | 345-ArgPheAlaAspGlyLysTrpGlnGluValGluLeuProArgLeuProSerGly-362 |
| SEQ. ID. NO. 475 | 365-GluMetThrAspGlnProTrpGlyGly-373 |
| SEQ. ID. NO. 476 | 401-ValMetArgArgGlnProGlnGlnPheAspSerAspGlyIleAsn-415 |
| SEQ. ID. NO. 477 | 422-ThrSerAlaAspGlyAlaArgIle-429 |
| SEQ. ID. NO. 478 | 435-GlyLysAsnAlaAlaProAspMet-442 |
| SEQ. ID. NO. 479 | 479-AsnIleArgGlyGlyGlyGluPheGlyProArgTrpHis-491 |
| SEQ. ID. NO. 480 | 496-GlyIleSerLysHisLysSerValAspAsp-505 |
| SEQ. ID. NO. 481 | 511-ArgAspLeuSerGluArgGlyIleSerSerProGluHisIle-524 |
| SEQ. ID. NO. 482 | G528-lyGlySerAsnGly-532 |
| SEQ. ID. NO. 483 | 540-PheValArgGluProGlnSerIleGlyAla-549 |
| SEQ. ID. NO. 484 | 568-GlySerSerTrpThrAspGluTyrGlyAsnProGlnLysTyrGluValCysLysArgArgLeuGlyGluLeuSerProTyr-594 |
| SEQ. ID. NO. 485 | 596-AsnLeuSerAspGlyIleAspTyrPro-604 |
| SEQ. ID. NO. 486 | 610-ThrSerLeuSerAspAspArgValHis-618 |
| SEQ. ID. NO. 487 | 627-AlaLysLeuArgGluThrSerAla-634 |
| SEQ. ID. NO. 488 | 639-TyrSerProAspGlyGlyGlyHisThrGlyAsnGlyThrGlnArgGluSerAlaAspGluLeu-659 |
| Hydrophilic Regions - Hopp-Woods | |
| SEQ. ID. NO. 489 | 3-SerTyrProAspProTyrArgHis-10 |
| SEQ. ID. NO. 490 | 12-GluAsnLeuAspSerAlaGluThr-19 |
| SEQ. ID. NO. 491 | 26-AlaAsnAlaGluThrArgAlaArgPheLeuGluAsnAspLysAlaArgAlaLeuSer-44 |
| SEQ. ID. NO. 492 | 52-GlnAspThrArgGln-56 |
| SEQ. ID. NO. 493 | 61-GlnGluHisArgAlaArg-66 |
| SEQ. ID. NO. 494 | 72-GlnAspAlaGluTyrPro-77 |
| SEQ. ID. NO. 495 | 104-AspPheAspGluLeuLeuGly-110 |
| SEQ. ID. NO. 496 | 145-ValAspLeuGluAlaGlyGluLeuValGlu-154 |
| SEQ. ID. NO. 497 | 166-ValSerTrpArgAspGluAsnSer-173 |
| SEQ. ID. NO. 498 | 180-TrpAsnGluArgGlnLeuThr-186 |
| SEQ. ID. NO. 499 | 198-GluArgGlyLysSerPheGluGluSerLeu-207 |
| SEQ. ID. NO. 500 | 212-IleGlyGluAspGlyMet-217 |
| SEQ. ID. NO. 501 | 233-AspLeuIleGluAlaSerAsp-239 |
| SEQ. ID. NO. 502 | 249-ValSerAlaGluGlyGluAlaLysPro-257 |
| SEQ. ID. NO. 503 | 278-LeuArgLysAspTrpAsnArg-284 |
| SEQ. ID. NO. 504 | 298-LysLeuAsnArgGlyGluLeuGly-305 |
| SEQ. ID. NO. 505 | 313-ProAspGluThrGlnAla-318 |
| SEQ. ID. NO. 506 | 320-GluSerValGluThrThrLys-326 |
| SEQ. ID. NO. 507 | 337-ValGlnGlyArgLeuLysAla-343 |
| SEQ. ID. NO. 508 | 401-ValMetArgArgGlnProGlnGlnPheAspSerAspGlyIleAsn-415 |
| SEQ. ID. NO. 509 | 424-AlaAspGlyAlaArg-428 |
| SEQ. ID. NO. 510 | 436-LysAsnAlaAlaProAsp-441 |
| SEQ. ID. NO. 511 | 481-ArgGlyGlyGlyGluPheGly-487 |
| SEQ. ID. NO. 512 | 496-GlyIleSerLysHisLysSerValAspAsp-505 |
| SEQ. ID. NO. 513 | 511-ArgAspLeuSerGluArgGlyIleSerSer-520 |
| SEQ. ID. NO. 514 | 540-PheValArgGluProGlnSer-546 |

TABLE 1-continued

| | |
|---|---|
| SEQ. ID. NO. 515 | 571-TrpThrAspGluTyrGlyAsn-577 |
| SEQ. ID. NO. 516 | 579-GlnLysTyrGluValCysLysArgArgLeuGlyGlu-590 |
| SEQ. ID. NO. 517 | 612-LeuSerAspAspArgValHis-618 |
| SEQ. ID. NO. 518 | 627-AlaLysLeuArgGluThrSer-633 |
| SEQ. ID. NO. 519 | 650-GlyThrGlnArgGluSerAlaAspGluLeu-659 |

042-1
AMPHI Regions - AMPHI

| | |
|---|---|
| SEQ. ID. NO. 520 | 17-AlaLeuSerAsnThrSerThr-23 |
| SEQ. ID. NO. 521 | 33-AlaValArgSerMetMetLysIle-40 |
| SEQ. ID. NO. 522 | 138-SerProLeuValArgIleLeuProLeuSer-147 |
| SEQ. ID. NO. 523 | 151-SerMetValValAlaPhePheAlaAsn-159 |

Antigenic Index - Jameson-Wolf

| | |
|---|---|
| SEQ. ID. NO. 524 | 14-ArgThrSerAlaLeuSerAsnThrSerThrAlaAlaGlyProSerCys-29 |
| SEQ. ID. NO. 525 | 49-TyrSerLysGluThrGlyCysProCysProSerLeuArgLysAspSerSerThrGlyGlyArgProMetSerProCys-74 |
| SEQ. ID. NO. 526 | 77-LeuAlaAsnArgAspCysValProLysAlaAspThr-88 |
| SEQ. ID. NO. 527 | 93-ThrAspSerThrSerProArgProLeu-101 |
| SEQ. ID. NO. 528 | 122-AlaArgAlaSerLeuProLysIleArgAlaLysVal-133 |
| SEQ. ID. NO. 529 | 160-CysSerTyrAlaSerAlaProGlyPro-168 |

Hydrophilic Regions - Hopp-Woods

| | |
|---|---|
| SEQ. ID. NO. 530 | 49-TyrSerLysGluThrGlyCys-55 |
| SEQ. ID. NO. 531 | 59-SerLeuArgLysAspSerSerThrGlyGlyArgProMet-71 |
| SEQ. ID. NO. 532 | 78-AlaAsnArgAspCysValProLysAlaAspThr-88 |
| SEQ. ID. NO. 533 | 94-AspSerThrSerProArg-99 |
| SEQ. ID. NO. 534 | 125-SerLeuProLysIleArgAlaLysVal-133 |

043-2
AMPHI Regions - AMPHI

| | |
|---|---|
| SEQ. ID. NO. 535 | 24-ValGluProSerArg-28 |
| SEQ. ID. NO. 536 | 36-HisGlyGlyLeuAspGlyAlaAlaGlyPheAspGluGlyGluArg-50 |
| SEQ. ID. NO. 537 | 59-AlaSerGlyAspGlyPhe-64 |
| SEQ. ID. NO. 538 | 83-AlaGlyAspPheGlyAspGlyGlnArg-91 |

Antigenic Index - Jameson-Wolf

| | |
|---|---|
| SEQ. ID. NO. 539 | 1-MetProProAlaPro-5 |
| SEQ. ID. NO. 540 | 11-IleArgArgGlnLysSerValMetProSerGluArgPheValGluProSerArg-28 |
| SEQ. ID. NO. 541 | 35-ValHisGlyGlyLeuAspGlyAlaAlaGlyPheAspGluGlyGluArgValPhe-52 |
| SEQ. ID. NO. 542 | 56-AlaAlaGlnAlaSerGlyAspGlyPheAla-65 |
| SEQ. ID. NO. 543 | 79-GlnSerAspAlaAlaGlyAspPheGlyAspGlyGlnArgThrGlyGlu-94 |
| SEQ. ID. NO. 544 | 96-ValLeuGlnAspValGlyGly-102 |
| SEQ. ID. NO. 545 | 116-AlaGluGlyGluAlaGln-121 |

Hydrophilic Regions - Hopp-Woods

| | |
|---|---|
| SEQ. ID. NO. 546 | 11-IleArgArgGlnLysSerValMetProSerGluArgPheValGluProSerArg-28 |
| SEQ. ID. NO. 547 | 43-AlaGlyPheAspGluGlyGluArgValPhe-52 |
| SEQ. ID. NO. 548 | 81-AspAlaAlaGlyAspPheGlyAspGlyGlnArgThrGly-93 |
| SEQ. ID. NO. 549 | 116-AlaGluGlyGluAlaGln-121 |

046-2
AMPHI Regions - AMPHI

| | |
|---|---|
| SEQ. ID. NO. 550 | 6-ArgProThrSerSerPro-11 |
| SEQ. ID. NO. 551 | 46-ThrSerCysSerGlyLeuMetValSer-54 |
| SEQ. ID. NO. 552 | 64-PheSerLeuPheSerSer-69 |
| SEQ. ID. NO. 553 | 113-LysSerAlaSerSer-117 |
| SEQ. ID. NO. 554 | 143-SerCysAsnAlaPheSerSer-149 |
| SEQ. ID. NO. 555 | 155-ThrSerLeuLeuGlyMetAlaAlaArgPheCysAlaThrVal-168 |

Antigenic Index - Jameson-Wolf

| | |
|---|---|
| SEQ. ID. NO. 556 | 6-ArgProThrSerSerProProArgArgAlaCys-16 |
| SEQ. ID. NO. 557 | 20-IleArgThrArgSerSerAlaLysArgLysThrCysAsnAlaProGlyGlnSerIleArgProAlaSerCysSer-44 |
| SEQ. ID. NO. 558 | 57-ProAsnMetGluArgLeuPro-63 |
| SEQ. ID. NO. 559 | 75-SerArgTyrSerLeuGluArgThrArgAlaMetArgProGlyMetLeuAsnArgSerAlaAla-95 |
| SEQ. ID. NO. 560 | 105-SerLeuArgGluSerAlaSerSerLysSerAlaSerSerAlaProAlaArgSerAsnValLysGlyAspAlaProLeuProLysThrValTrpThrSerArgArgLeuProVal-142 |
| SEQ. ID. NO. 561 | 169-GluProThrCysProLeuProLys-176 |

Hydrophilic Regions - Hopp-Woods

| | |
|---|---|
| SEQ. ID. NO. 562 | 7-ProThrSerSerProProArgArgAlaCys-16 |
| SEQ. ID. NO. 563 | 20-IleArgThrArgSerSerAlaLysArgLysThrCysAsn-32 |
| SEQ. ID. NO. 564 | 36-GlnSerIleArgProAlaSer-42 |
| SEQ. ID. NO. 565 | 58-AsnMetGluArgLeuPro-63 |
| SEQ. ID. NO. 566 | 75-SerArgTyrSerLeuGluArgThrArgAlaMetArg-86 |
| SEQ. ID. NO. 567 | 105-SerLeuArgGluSerAlaSerSerLysSerAlaSer-116 |
| SEQ. ID. NO. 568 | 118-AlaProAlaArgSerAsnValLysGlyAspAlaProLeu-130 |

047-2
AMPHI Regions - AMPHI

| | |
|---|---|
| SEQ. ID. NO. 569 | 17-IleAlaAspIleAlaGlnAspLeuProAspGlyAla-28 |
| SEQ. ID. NO. 570 | 62-AlaGluAsnIleGlyAlaVal-68 |
| SEQ. ID. NO. 571 | 93-ArgLeuAlaLysGlnLeuGlu-99 |
| SEQ. ID. NO. 572 | 141-TyrIleAspGluIleAspValPhe-148 |
| SEQ. ID. NO. 573 | 161-SerAlaLeuLeuAla-165 |
| SEQ. ID. NO. 574 | 185-LeuLeuGluGlyAsn-189 |
| SEQ. ID. NO. 575 | 202-IleGlySerIleLeuAla-207 |
| SEQ. ID. NO. 576 | 247-SerGlyIleLysTrpProGluGlyCys-255 |

TABLE 1-continued

| | |
|---|---|
| SEQ. ID. NO. 577 | 257-IleAlaAlaValValArgAlaGlyThrGly-266 |
| SEQ. ID. NO. 578 | 293-IleLeuAsnGluLeuGluLysLeuIle-301 |

Antigenic Index - Jameson-Wolf

| | |
|---|---|
| SEQ. ID. NO. 579 | 5-GlnAlaArgArgGlyGlyLeuLeu-12 |
| SEQ. ID. NO. 580 | 20-IleAlaGlnAspLeuProAspGlyAlaAsp-29 |
| SEQ. ID. NO. 581 | 36-TyrArgAsnAsnArgLeu-41 |
| SEQ. ID. NO. 582 | 51-IleGluGlyAspGlu-55 |
| SEQ. ID. NO. 583 | 70-ProGluLeuArgProLysGluThrSerThrArgArgIleMet-83 |
| SEQ. ID. NO. 584 | 86-GlyGlyGlyAsnIle-90 |
| SEQ. ID. NO. 585 | 96-LysGlnLeuGluHis-100 |
| SEQ. ID. NO. 586 | 106-IleIleGluCysArgProArgArgAlaGluTrpIle-117 |
| SEQ. ID. NO. 587 | 119-GluAsnLeuAspAsnThrLeu-125 |
| SEQ. ID. NO. 588 | 130-SerAlaThrAspGluThrLeuLeuAspAsnGluTyrIleAspGluIleAsp-146 |
| SEQ. ID. NO. 589 | 152-ThrAsnAspAspGluSerAsnIle-159 |
| SEQ. ID. NO. 590 | 168-LeuGlyAlaLysArgVal-173 |
| SEQ. ID. NO. 591 | 178-AsnArgSerSerTyr-182 |
| SEQ. ID. NO. 592 | 186-LeuGluGlyAsnLysIle-191 |
| SEQ. ID. NO. 593 | 208-HisIleArgArgGlyAspIleVal-215 |
| SEQ. ID. NO. 594 | 219-ProIleArgArgGlyThrAlaGluAlaIleGlu-229 |
| SEQ. ID. NO. 595 | 232-AlaHisGlyAspLysLysThrSer-239 |
| SEQ. ID. NO. 596 | 242-IleGlyArgArgIleSerGlyIleLysTrpProGluGlyCysHis-256 |
| SEQ. ID. NO. 597 | 262-ArgAlaGlyThrGlyGluThr-268 |
| SEQ. ID. NO. 598 | 277-ValIleGlnAspGlyAspHis-283 |
| SEQ. ID. NO. 599 | 288-ValSerArgArgArgIleLeuAsnGluLeuGluLys-299 |

Hydrophilic Regions - Hopp-Woods

| | |
|---|---|
| SEQ. ID. NO. 600 | 5-GlnAlaArgArgGlyGly-10 |
| SEQ. ID. NO. 601 | 20-IleAlaGlnAspLeuProAspGlyAlaAsp-29 |
| SEQ. ID. NO. 602 | 51-IleGluGlyAspGlu-55 |
| SEQ. ID. NO. 603 | 70-ProGluLeuArgProLysGluThrSerThrArgArgIleMet-83 |
| SEQ. ID. NO. 604 | 106-IleIleGluCysArgProArgArgAlaGluTrpIle-117 |
| SEQ. ID. NO. 605 | 130-SerAlaThrAspGluThrLeuLeu-137 |
| SEQ. ID. NO. 606 | 140-GluTyrIleAspGluIleAsp-146 |
| SEQ. ID. NO. 607 | 152-ThrAsnAspAspGluSerAsnIle-159 |
| SEQ. ID. NO. 608 | 168-LeuGlyAlaLysArgVal-173 |
| SEQ. ID. NO. 609 | 186-LeuGluGlyAsnLysIle-191 |
| SEQ. ID. NO. 610 | 209-IleArgArgGlyAspIle-214 |
| SEQ. ID. NO. 611 | 219-ProIleArgArgGlyThrAlaGluAlaIleGlu-229 |
| SEQ. ID. NO. 612 | 232-AlaHisGlyAspLysLysThrSer-239 |
| SEQ. ID. NO. 613 | 242-IleGlyArgArgIleSer-247 |
| SEQ. ID. NO. 614 | 277-ValIleGlnAspGlyAsp-282 |
| SEQ. ID. NO. 615 | 289-SerArgArgArgIleLeuAsnGluLeuGluLys-299 |

049-2
AMPHI Regions - AMPHI

| | |
|---|---|
| SEQ. ID. NO. 616 | 15-GlnHisLeuLeuGlu-19 |
| SEQ. ID. NO. 617 | 34-AspAspAlaValAspGlyIleGlyGlnMet-43 |
| SEQ. ID. NO. 618 | 50-GlnProPheGlyGln-54 |
| SEQ. ID. NO. 619 | 61-GluHisPheAlaProValAspGlyPheArg-70 |
| SEQ. ID. NO. 620 | 79-HisGlnArgPhePheArgIle-85 |
| SEQ. ID. NO. 621 | 202-ArgGlyAlaGlyGlnArgArgValSerArgHisCys-213 |
| SEQ. ID. NO. 622 | 217-AlaArgLeuThrGlnValPheGlnThrPhePhe-227 |

Antigenic Index - Jameson-Wolf

| | |
|---|---|
| SEQ. ID. NO. 623 | 6-PheAspTyrArgProArgLeuLeu-13 |
| SEQ. ID. NO. 624 | 21-IleGlyGluAsnArgHis-26 |
| SEQ. ID. NO. 625 | 28-LeuLeuHisArgArgSerAspAspAlaValAspGlyIleGly-41 |
| SEQ. ID. NO. 626 | 49-AspGlnProPheGly-53 |
| SEQ. ID. NO. 627 | 64-AlaProValAspGlyPheArgValGlnAspIleAspLeuAspGlyHisGlnArgPhe-82 |
| SEQ. ID. NO. 628 | 89-ValPheArgAsnArgArgLeuIle-96 |
| SEQ. ID. NO. 629 | 111-LeuSerGlyPheLys-115 |
| SEQ. ID. NO. 630 | 122-GlyIleLysProAspSerProProArgPhe-131 |
| SEQ. ID. NO. 631 | 135-PheArgAsnArgHisLeuGlnGlySerLeuArgVal-146 |
| SEQ. ID. NO. 632 | 150-PheLeuLysAspAspHisArgValGly-158 |
| SEQ. ID. NO. 633 | 182-GlnHisThrGlySer-186 |
| SEQ. ID. NO. 634 | 193-ArgHisArgArgValArgSerGlyPheArgGlyAlaGlyGlnArgArgValSerArgHisCys-213 |
| SEQ. ID. NO. 635 | 246-LysGlnThrAsnProArgProLysArgGlyLeu-256 |

Hydrophilic Regions - Hopp-Woods

| | |
|---|---|
| SEQ. ID. NO. 636 | 21-IleGlyGluAsnArgHis-26 |
| SEQ. ID. NO. 637 | 30-HisArgArgSerAspAspAlaValAsp-38 |
| SEQ. ID. NO. 638 | 67-AspGlyPheArgValGlnAspIleAspLeuAspGlyHisGlnArg-81 |
| SEQ. ID. NO. 639 | 91-ArgAsnArgArgLeuIle-96 |
| SEQ. ID. NO. 640 | 124-LysProAspSerProProArg-130 |
| SEQ. ID. NO. 641 | 150-PheLeuLysAspAspHisArgVal-157 |
| SEQ. ID. NO. 642 | 193-ArgHisArgArgValArgSerGlyPheArgGlyAlaGlyGlnArgArgValSerArg-211 |
| SEQ. ID. NO. 643 | 246-LysGlnThrAsnProArgProLysArgGlyLeu-256 |

050-1
AMPHI Regions - AMPHI

| | |
|---|---|
| SEQ. ID. NO. 644 | 10-IleGlnSerIleCysAspAlaPheGlnPheIleSerTyrTyr-23 |
| SEQ. ID. NO. 645 | 25-ProLysAspTyrIleAspAlaLeuTyrLysAlaTrpGlnLys-38 |
| SEQ. ID. NO. 646 | 94-ValAsnGluGlyVal-98 |
| SEQ. ID. NO. 647 | 163-AsnProSerAspAsnIleValAspTrpValLeuLys-174 |
| SEQ. ID. NO. 648 | 177-ProThrMetGlyAla-181 |

TABLE 1-continued

| | |
|---|---|
| SEQ. ID. NO. 649 | 235-LeuGluLeuPheGluLysValAsnAla-243 |
| SEQ. ID. NO. 650 | 250-GlyLeuGlyGlyLeuThrThr-256 |
| SEQ. ID. NO. 651 | 275-AlaMetIleProAsn-279 |
| SEQ. ID. NO. 652 | 302-ArgValGluAspTrpProAspLeuThr-310 |
| SEQ. ID. NO. 653 | 315-AsnGlyLysArgValAspValAsp-322 |
| SEQ. ID. NO. 654 | 353-LysArgLeuValAspMetLeuAsnLys-361 |
| SEQ. ID. NO. 655 | 367-ValAspPheThrAsnArgLeu-373 |
| SEQ. ID. NO. 656 | 379-ProValAspProValGlyAspGlu-386 |
| SEQ. ID. NO. 657 | 396-AlaThrArgMetAspLysPheThrArgGlnMet-406 |
| SEQ. ID. NO. 658 | 410-ThrAspLeuLeuGlyMet-415 |
| SEQ. ID. NO. 659 | 422-GlyValAlaThrCysGluAlaIleAla-430 |
| SEQ. ID. NO. 660 | 452-LysSerSerLysValLeuAlaPhe-459 |
| SEQ. ID. NO. 661 | 490-AlaThrAlaProArgLysTrp-496 |
| Antigenic Index - Jameson-Wolf | |
| SEQ. ID. NO. 662 | 4-IleLysGlnGluAspPheIle-10 |
| SEQ. ID. NO. 663 | 23-TyrHisProLysAspTyrIleAspAlaLeu-32 |
| SEQ. ID. NO. 664 | 36-TrpGlnLysGluGluAsnProAlaAlaLysAspAlaMet-48 |
| SEQ. ID. NO. 665 | 55-SerArgMetCysAlaGluAsnAsnArgProIleCysGlnAspThrGly-70 |
| SEQ. ID. NO. 666 | 88-MetSerValGluGluMetValAsnGluGlyValArgArgAlaTyrThrTrpGluGlyAsnThrLeuArgAlaSerVal-113 |
| SEQ. ID. NO. 667 | 116-AspProAlaGlyLysArgGlnAsnThrLysAspAsnThr-128 |
| SEQ. ID. NO. 668 | 138-ProGlyGlyLysValGluVal-144 |
| SEQ. ID. NO. 669 | 148-AlaLysGlyGlyGlySerGluAsnLysSerLysLeu-159 |
| SEQ. ID. NO. 670 | 163-AsnProSerAspAsnIle-168 |
| SEQ. ID. NO. 671 | 192-GlyIleGlyGlyThrProGluLysAlaValLeuMetAlaLysGluSerLeu-208 |
| SEQ. ID. NO. 672 | 213-AspIleGlnGluLeuGlnGluLysAlaAlaSerGlyAlaGluLeuSerThr-229 |
| SEQ. ID. NO. 673 | 284-ArgHisValGluPheGluLeuAspGlySerGlyProValGluLeuThrProProArgValGluAspTrpProAspLeuThrTyrSerProAspAsnGlyLysArgValAspValAspLysLeuThrLysGluGluValAlaSer-331 |
| SEQ. ID. NO. 674 | 345-LeuThrGlyArgAspAlaAlaHisLysArgLeuVal-356 |
| SEQ. ID. NO. 675 | 359-LeuAsnLysGlyGluGluLeuPro-366 |
| SEQ. ID. NO. 676 | 379-ProValAspProValGlyAspGluValValGlyProAlaGlyProThrThrAlaThrArgMetAspLysPheThrArgGlnMetLeuGluGlnThrAsp-411 |
| SEQ. ID. NO. 677 | 417-GlyLysSerGluArgGlyValAlaThr-425 |
| SEQ. ID. NO. 678 | 428-AlaIleAlaAspAsnLysAla-434 |
| SEQ. ID. NO. 679 | 450-AlaIleLysSerSerLys-455 |
| SEQ. ID. NO. 680 | 470-PheGluValLysAspMetPro-476 |
| SEQ. ID. NO. 681 | 481-ValAspSerLysGlyGluSerIle-488 |
| SEQ. ID. NO. 682 | 492-AlaProArgLysTrpGlnAla-498 |
| Hydrophilic Regions - Hopp-Woods | |
| SEQ. ID. NO. 683 | 4-IleLysGlnGluAspPheIle-10 |
| SEQ. ID. NO. 684 | 36-TrpGlnLysGluGluAsnProAlaAlaLysAspAlaMet-48 |
| SEQ. ID. NO. 685 | 57-MetCysAlaGluAsnAsnArgProIleCys-66 |
| SEQ. ID. NO. 686 | 88-MetSerValGluGluMetValAsnGluGlyValArgArg-100 |
| SEQ. ID. NO. 687 | 117-ProAlaGlyLysArgGlnAsnThrLysAspAsnThr-128 |
| SEQ. ID. NO. 688 | 140-GlyLysValGluVal-144 |
| SEQ. ID. NO. 689 | 148-AlaLysGlyGlyGlySerGluAsnLysSerLysLeu-159 |
| SEQ. ID. NO. 690 | 195-GlyThrProLysAlaValLeuMetAlaLysGluSerLeu-208 |
| SEQ. ID. NO. 691 | 213-AspIleGlnGluLeuGlnGluLysAlaAlaSer-223 |
| SEQ. ID. NO. 692 | 225-AlaGluLeuSerThr-229 |
| SEQ. ID. NO. 693 | 284-ArgHisValGluPheGluLeuAspGly-292 |
| SEQ. ID. NO. 694 | 299-ThrProProArgValGluAspTrpPro-307 |
| SEQ. ID. NO. 695 | 313-ProAspAsnGlyLysArgValAspValAspLysLeuThrLysGluGluValAlaSer-331 |
| SEQ. ID. NO. 696 | 345-LeuThrGlyArgAspAlaAlaHisLysArgLeuVal-356 |
| SEQ. ID. NO. 697 | 359-LeuAsnLysGlyGluGluLeuPro-366 |
| SEQ. ID. NO. 698 | 382-ProValAspGluValVal-388 |
| SEQ. ID. NO. 699 | 397-ThrArgMetAspLysPheThrArgGlnMetLeuGluGlnThrAsp-411 |
| SEQ. ID. NO. 700 | 417-GlyLysSerGluArgGlyValAla-424 |
| SEQ. ID. NO. 701 | 428-AlaIleAlaAspAsnLysAla-434 |
| SEQ. ID. NO. 702 | 450-AlaIleLysSerSerLys-455 |
| SEQ. ID. NO. 703 | 470-PheGluValLysAspMetPro-476 |
| SEQ. ID. NO. 704 | 481-ValAspSerLysGlyGluSerIle-488 |
| SEQ. ID. NO. 705 | 492-AlaProArgLysTrpGlnAla-498 |
| 052 | |
| AMPHI Regions - AMPHI | |
| SEQ. ID. NO. 706 | 12-AlaProCysPheLysGlyCysGluProThrGlyAsp-23 |
| SEQ. ID. NO. 707 | 41-AlaLysAlaSerLysSerAlaThrSerProLysGlyLeuAspGlyValSerLys-58 |
| SEQ. ID. NO. 708 | 67-ThrAlaAlaPheHisSerPheIleSer-75 |
| SEQ. ID. NO. 709 | 84-MetProAsnLeuValThrMetLeu-91 |
| Antigenic Index - Jameson-Wolf | |
| SEQ. ID. NO. 710 | 4-ValAlaGluGluThrGluIle-10 |
| SEQ. ID. NO. 711 | 14-CysPheLysGlyCysGluProThrGlyAspSerArgLeuLeuSerThrThrLysSerAlaPro-34 |
| SEQ. ID. NO. 712 | 37-CysAlaAsnSerAlaLysAlaSerLysSerAlaThrSerProLysGlyLeuAspGlyValSerLysAsnSerSer-61 |
| SEQ. ID. NO. 713 | 75-SerValGlyAspThrArgLeuThrProMet-84 |
| SEQ. ID. NO. 714 | 97-ValValProAsnArgLeuArgLeuGluThrThrTrpSerProAlaCysArgLysValLysAsnAlaAla-119 |
| Hydrophilic Regions - Hopp-Woods | |
| SEQ. ID. NO. 715 | 4-ValAlaGluGluThrGluIle-10 |
| SEQ. ID. NO. 716 | 16-LysGlyCysGluProThrGlyAspSerArgLeu-26 |
| SEQ. ID. NO. 717 | 30-ThrLysSerAlaPro-34 |
| SEQ. ID. NO. 718 | 39-AsnSerAlaLysAlaSerLysSerAlaThrSerProLysGlyLeuAspGlyValSerLysAsnSer-60 |
| SEQ. ID. NO. 719 | 77-GlyAspThrArgLeu-81 |
| SEQ. ID. NO. 720 | 100-AsnArgLeuArgLeu-104 |

TABLE 1-continued

| SEQ. ID. NO. 721 | 111-AlaCysArgLysValLysAsnAlaAla-119 |

075
AMPHI Regions - AMPHI
| SEQ. ID. NO. 722 | 15-LysSerAlaAlaLysMetProThrThrIleGlnProAlaSerIleProSer-31 |
| SEQ. ID. NO. 723 | 65-AlaProTyrLeuArgGlnValLeu-72 |
| SEQ. ID. NO. 724 | 80-PheLysLysCysLeuAla-85 |
| SEQ. ID. NO. 725 | 116-AspPhePheGlnThrCysValAsnArgPhePheGluValValGluIleIleGlyIleGly-135 |

Antigenic Index - Jameson-Wolf
| SEQ. ID. NO. 726 | 12-GluAsnThrLysSerAlaAlaLysMetPro-21 |
| SEQ. ID. NO. 727 | 52-AlaLysAlaArgGly-56 |
| SEQ. ID. NO. 728 | 91-PhePheArgArgProProAsnIleArgLysSerValPheGlnLysSerGluTyrAspLys-110 |

Hydrophilic Regions - Hopp-Woods
| SEQ. ID. NO. 729 | 12-GluAsnThrLysSerAlaAlaLys-19 |
| SEQ. ID. NO. 730 | 52-AlaLysAlaArgGly-56 |
| SEQ. ID. NO. 731 | 91-PhePheArgArgProProAsnIleArgLysSerValPheGlnLysSerGluTyrAspLys-110 |

080
AMPHI Regions - AMPHI
| SEQ. ID. NO. 732 | 6-GluAlaMetGluArgLeuThrArg-13 |
| SEQ. ID. NO. 733 | 95-PheProAspThrValGlu-100 |
| SEQ. ID. NO. 734 | 108-ProValAlaArgTrpGlyAspHis-115 |
| SEQ. ID. NO. 735 | 144-SerAlaGluMetLeuArgArgTyrAspGluPheSerThrValLeu-158 |
| SEQ. ID. NO. 736 | 195-LysArgLeuArgLeuPheThrGluAlaTrpGlnHis-206 |

Antigenic Index - Jameson-Wolf
| SEQ. ID. NO. 737 | 1-MetTrpAspAsnAlaGluAlaMetGluArgLeuThr-12 |
| SEQ. ID. NO. 738 | 33-AsnSerAsnHisLeuPro-38 |
| SEQ. ID. NO. 739 | 42-ValSerLeuLysGly-46 |
| SEQ. ID. NO. 740 | 48-LeuValTyrSerAspLysLysThrLeu-56 |
| SEQ. ID. NO. 741 | 67-AsnIleLeuArgThrAspIleAsnGlyAlaGlnGluAlaTyrArg-81 |
| SEQ. ID. NO. 742 | 90-MetValArgArgArgPheProAspThrValGlu-100 |
| SEQ. ID. NO. 743 | 103-LeuThrGluArgLysProValAlaArgTrpGly-113 |
| SEQ. ID. NO. 744 | 116-AlaLeuValAspGlyGluGlyAsnValPhe-125 |
| SEQ. ID. NO. 745 | 127-AlaArgLeuAspArgProGlyMetPro-135 |
| SEQ. ID. NO. 746 | 138-ArgGlyAlaGluGlyThrSer-144 |
| SEQ. ID. NO. 747 | 146-GluMetLeuArgArgTyrAspGlu-153 |
| SEQ. ID. NO. 748 | 163-LeuGlyIleLysGlu-167 |
| SEQ. ID. NO. 749 | 187-ArgLeuGlyArgGluAsnGluMetLysArgLeuArgLeu-199 |
| SEQ. ID. NO. 750 | 207-LeuLeuArgLysAsnLysAsnArgLeuSer-216 |
| SEQ. ID. NO. 751 | 220-MetArgTyrLysAspGlyPheSer-227 |
| SEQ. ID. NO. 752 | 230-TyrAlaSerAspGlyLeuProGluLysGluSerGluGlu-242 |

Hydrophilic Regions - Hopp-Woods
| SEQ. ID. NO. 753 | 3-AspAsnAlaGluAlaMetGluArgLeuThr-12 |
| SEQ. ID. NO. 754 | 50-TyrSerAspLysLysThrLeu-56 |
| SEQ. ID. NO. 755 | 69-LeuArgThrAspIleAsnGlyAlaGlnGluAlaTyrArg-81 |
| SEQ. ID. NO. 756 | 90-MetValArgArgArgPheProAspThrVal-99 |
| SEQ. ID. NO. 757 | 103-LeuThrGluArgLysProValAlaArgTrpGly-113 |
| SEQ. ID. NO. 758 | 116-AlaLeuValAspGlyGluGlyAsnValPhe-125 |
| SEQ. ID. NO. 759 | 127-AlaArgLeuAspArgProGly-133 |
| SEQ. ID. NO. 760 | 138-ArgGlyAlaGluGlyThrSer-144 |
| SEQ. ID. NO. 761 | 146-GluMetLeuArgArgTyrAspGlu153153 |
| SEQ. ID. NO. 762 | 163-LeuGlyIleLysGlu-167 |
| SEQ. ID. NO. 763 | 187-ArgLeuGlyArgGluAsnGluMetLysArgLeuArgLeu-199 |
| SEQ. ID. NO. 764 | 208-LeuArgLysAsnLysAsnArgLeuSer-216 |
| SEQ. ID. NO. 765 | 220-MetArgTyrLysAspGlyPheSer-227 |
| SEQ. ID. NO. 766 | 234-GlyLeuProGluLysGluSerGluGlu-242 |

081
AMPHI Regions - AMPHI
| SEQ. ID. NO. 767 | 22-LysProValSerArgIleValThrAspSer-31 |
| SEQ. ID. NO. 768 | 85-LeuAlaAlaLeuGlnThrLeuAlaLysAlaTrpArgGluAsn-98 |
| SEQ. ID. NO. 769 | 116-LysGluMetLeuAlaAlaValLeuArg-124 |
| SEQ. ID. NO. 770 | 135-ThrAlaGlyAspAsnPhe-139 |
| SEQ. ID. NO. 771 | 165-MetAsnHisPheGlyGluLeuAlaValLeuThrXxxIleAlaLys-179 |
| SEQ. ID. NO. 772 | 185-ValAsnAsnAlaMetArg-190 |
| SEQ. ID. NO. 773 | 198-AspGlyValGlyAspIleAlaLysAla-206 |
| SEQ. ID. NO. 774 | 303-LeuAsnAspValAlaGluGlyLeuLysGlyPheSerAsnIle-316 |
| SEQ. ID. NO. 775 | 345-AlaAlaIleAspValLeuAlaArgMetPro-354 |
| SEQ. ID. NO. 776 | 360-ValMetGlyAspMetGlyGluLeuGlyGluLeuGlyGlu-372 |
| SEQ. ID. NO. 777 | 402-ValGluAlaAlaGlu-406 |

Antigenic Index - Jameson-Wolf
| SEQ. ID. NO. 778 | 16-ProMetProSerGluSerLysProValSer-25 |
| SEQ. ID. NO. 779 | 27-IleValThrAspSerArgAspIleArgAlaGlyAsp-38 |
| SEQ. ID. NO. 780 | 44-AlaGlyGluArgPheAspAla-50 |
| SEQ. ID. NO. 781 | 67-ValSerArgGluAspCysAlaAla-74 |
| SEQ. ID. NO. 782 | 77-GlyAlaLeuLysValAspAspThrLeu-85 |
| SEQ. ID. NO. 783 | 94-AlaTrpArgGluAsnValAsnProPhe-102 |
| SEQ. ID. NO. 784 | 108-GlySerGlyGlyLysThrThrValLysGluMetLeu-119 |
| SEQ. ID. NO. 785 | 123-LeuArgArgArgPheGlyAspAspAlaVal-132 |
| SEQ. ID. NO. 786 | 138-AsnPheAsnAsnHisIle-143 |
| SEQ. ID. NO. 787 | 151-LysLeuAsnGluLysHisArg-157 |
| SEQ. ID. NO. 788 | 178-AlaLysProAsnAla-182 |
| SEQ. ID. NO. 789 | 194-GlyCysGlyPheAspGlyValGlyAspIleAlaLysAlaLysSerGluIle-210 |

TABLE 1-continued

| | |
|---|---|
| SEQ. ID. NO. 790 | 212-GlnGlyLeuCysSerAspGly-218 |
| SEQ. ID. NO. 791 | 223-ProGlnGluAspAlaAsn-228 |
| SEQ. ID. NO. 792 | 239-LeuAsnThrArgThrPheGlyIleAspSerGlyAspValHisAla-253 |
| SEQ. ID. NO. 793 | 269-CysGlyAspGluArgAlaAla-275 |
| SEQ. ID. NO. 794 | 280-ValProGlyArgHisAsnVal-286 |
| SEQ. ID. NO. 795 | 305-AspValAlaGluGlyLeuLys-311 |
| SEQ. ID. NO. 796 | 313-PheSerAsnIleLysGlyArgLeuAsnValLysSerGlyIleLysGly-328 |
| SEQ. ID. NO. 797 | 330-ThrLeuIleAspAspThrTyrAsnAlaAsnProAspSerMetLysAlaAla-346 |
| SEQ. ID. NO. 798 | 363-AspMetGlyGluLeuGlyGluLeuGlyGluAspGluAlaAla-376 |
| SEQ. ID. NO. 799 | 384-AlaTyrAlaArgAspGlnGlyIle-391 |
| SEQ. ID. NO. 800 | 398-GlyAspAsnSerValGluAlaAlaGluLysPheGlyAla-410 |
| SEQ. ID. NO. 801 | 425-LeuArgHisAspLeuProGluArgAlaThrVal-435 |
| SEQ. ID. NO. 802 | 437-ValLysGlySerArg-441 |
| SEQ. ID. NO. 803 | 446-GluGluValValGluAlaLeuGluAspLys-455 |
| Hydrophilic Regions - Hopp-Woods | |
| SEQ. ID. NO. 804 | 17-MetProSerGluSerLysProValSer-25 |
| SEQ. ID. NO. 805 | 27-IleValThrAspSerArgAspIleArgAla-36 |
| SEQ. ID. NO. 806 | 44-AlaGlyGluArgPheAspAla-50 |
| SEQ. ID. NO. 807 | 67-ValSerArgGluAspCysAlaAla-74 |
| SEQ. ID. NO. 808 | 77-GlyAlaLeuLysValAspAspThrLeu-85 |
| SEQ. ID. NO. 809 | 94-AlaTrpArgGluAsnVal-99 |
| SEQ. ID. NO. 810 | 109-SerGlyGlyLysThrThrValLysGluMetLeu-119 |
| SEQ. ID. NO. 811 | 123-LeuArgArgArgPheGlyAsp-129 |
| SEQ. ID. NO. 812 | 151-LysLeuAsnGluLysHisArg-157 |
| SEQ. ID. NO. 813 | 199-GlyValGlyAspIleAlaLysAlaLysSerGluIle-210 |
| SEQ. ID. NO. 814 | 223-ProGlnGluAspAlaAsn-228 |
| SEQ. ID. NO. 815 | 247-AspSerGlyAspValHisAla-253 |
| SEQ. ID. NO. 816 | 269-CysGlyAspGluArgAlaAla-275 |
| SEQ. ID. NO. 817 | 305-AspValAlaGluGlyLeuLys-311 |
| SEQ. ID. NO. 818 | 316-IleLysGlyArgLeuAsnVal-322 |
| SEQ. ID. NO. 819 | 335-ThrTyrAsnAlaAsnProAspSerMetLysAlaAla-346 |
| SEQ. ID. NO. 820 | 363-AspMetGlyGluLeuGlyGluLeuGlyGluAspGluAlaAla-376 |
| SEQ. ID. NO. 821 | 384-AlaTyrAlaArgAspGlnGlyIle-391 |
| SEQ. ID. NO. 822 | 400-AsnSerValGluAlaAlaGluLysPheGlyAla-410 |
| SEQ. ID. NO. 823 | 425-LeuArgHisAspLeuProGluArgAlaThrVal-435 |
| SEQ. ID. NO. 824 | 446-GluGluValValGluAlaLeuGluAspLys-455 |
| 084-2 | |
| AMPHI Regions - AMPHI | |
| SEQ. ID. NO. 825 | 6-ArgIleLysAsnMetAsnGlnThrLeuLysAsnThrLeuGly-19 |
| SEQ. ID. NO. 826 | 21-CysAlaLeuLeuAla-25 |
| SEQ. ID. NO. 827 | 48-AlaValGlyAlaLeuAla-53 |
| SEQ. ID. NO. 828 | 65-PheProArgValSer-69 |
| SEQ. ID. NO. 829 | 96-GlnIleValGlySerIleLeuGluSer-104 |
| SEQ. ID. NO. 830 | 111-GluPheValGlyAsnLeuProGly-118 |
| Antigenic Index - Jameson-Wolf | |
| SEQ. ID. NO. 831 | 1-MetLysGlnSerAlaArgIleLysAsnMetAsnGlnThrLeuLysAsnThr-17 |
| SEQ. ID. NO. 832 | 40-TyrGluTyrGlyTyrArgTyrSer-47 |
| SEQ. ID. NO. 833 | 102-LeuGluSerAsnProAlaGluAlaArgGluPheValGly-114 |
| SEQ. ID. NO. 834 | 139-ValSerGlyGlyGly-143 |
| Hydrophilic Regions - Hopp-Woods | |
| SEQ. ID. NO. 835 | 1-MetLysGlnSerAlaArgIleLysAsnMetAsnGlnThrLeu-14 |
| SEQ. ID. NO. 836 | 105-AsnProAlaGluAlaArgGluPheVal-113 |
| 085-2 | |
| AMPHI Regions - AMPHI | |
| SEQ. ID. NO. 837 | 41-GluArgValSerGlnIleGlyLysMetPheAspGlyLeu-53 |
| SEQ. ID. NO. 838 | 60-LeuLysAspAlaLeuAspAsnGlyPheAsp-69 |
| SEQ. ID. NO. 839 | 90-AsnGlyGlyArgValLeuGlyAspIleGluLeuLeuAlaAsp-103 |
| SEQ. ID. NO. 840 | 125-ThrSerLeuValGlyTyr-130 |
| SEQ. ID. NO. 841 | 141-IleAlaGlyAsnIleGlyThr-147 |
| SEQ. ID. NO. 842 | 174-GluAsnThrGluSerLeu-179 |
| SEQ. ID. NO. 843 | 193-HisLeuAspArgTyrAspAspLeuLeuAspTyr-203 |
| SEQ. ID. NO. 844 | 212-ArgGlyAspGlyValGln-217 |
| SEQ. ID. NO. 845 | 225-PheCysArgAlaMetLysArgAla-232 |
| SEQ. ID. NO. 846 | 275-HisAsnAlaAlaAsnValMetAlaAlaValAlaLeuCysGluAla-289 |
| SEQ. ID. NO. 847 | 300-HisValLysThrPheGlnGlyLeuProHisArgValGluLysIleGly-315 |
| SEQ. ID. NO. 848 | 336-AlaAlaIleAlaGlyLeu-341 |
| SEQ. ID. NO. 849 | 353-GlyLysGlyGlnAspPheThr-359 |
| SEQ. ID. NO. 850 | 395-AspCysAlaThrLeuGlyGluAlaValGlnThr-405 |
| SEQ. ID. NO. 851 | 424-SerPheAspMetPheLysGlyTyr-431 |
| Antigenic Index - Jameson-Wolf | |
| SEQ. ID. NO. 852 | 4-GlnAsnLysLysIleLeu-9 |
| SEQ. ID. NO. 853 | 23-TyrLeuArgLysAsnGlyAlaGluValAlaAlaTyrAspAlaGluLeuLysProGluArgValSerGlnIleGlyLysMetPheAsp-51 |
| SEQ. ID. NO. 854 | 58-GlyArgLeuLysAspAlaLeuAspAsnGlyPhe-68 |
| SEQ. ID. NO. 855 | 74-SerProGlyIleSerGluArgGlnProAspIleGluAlaPheLysGlnAsnGlyGlyArgValLeuGly-96 |
| SEQ. ID. NO. 856 | 104-IleValAsnArgArgAspAspLysValIle-113 |
| SEQ. ID. NO. 857 | 116-ThrGlySerAsnGlyLysThrThr-123 |
| SEQ. ID. NO. 858 | 153-GluTrpGlnArgGluGlyLysLysAlaAsp-162 |
| SEQ. ID. NO. 859 | 169-SerSerPheGlnLeuGluAsnThrGluSerLeuArgProThrAla-183 |
| SEQ. ID. NO. 860 | 189-IleSerGluAspHisLeuAspArgTyrAspAspLeuLeu-201 |
| SEQ. ID. NO. 861 | 204-AlaHisThrLysAlaLysIlePheArgGlyAspGlyVal-216 |

TABLE 1-continued

| | |
|---|---|
| SEQ. ID. NO. 862 | 220-AsnAlaAspAspAlaPheCysArgAlaMetLysArgAlaGlyArgGluValLys-237 |
| SEQ. ID. NO. 863 | 247-PheTrpLeuGluArgGluThrGlyArgLeuLysGlnGlyAsnGluAspLeuIleVal-265 |
| SEQ. ID. NO. 864 | 291-GlyLeuSerArgGluAlaLeu-297 |
| SEQ. ID. NO. 865 | 307-LeuProHisArgValGluLysIleGlyGluLysAsnGly-319 |
| SEQ. ID. NO. 866 | 322-PheIleAspAspSerLysGlyThrAsnVal-331 |
| SEQ. ID. NO. 867 | 351-GlyMetGlyLysGlyGlnAspPheThrProLeuArgAspAlaLeuValGlyLysAlaLys-370 |
| SEQ. ID. NO. 868 | 378-AspAlaProGlnIleArgArgAspLeuAspGlyCysGly-390 |
| SEQ. ID. NO. 869 | 431-TyrAlaHisArgSer-435 |
| Hydrophilic Regions - Hopp-Woods | |
| SEQ. ID. NO. 870 | 4-GlnAsnLysLysIleLeu-9 |
| SEQ. ID. NO. 871 | 25-ArgLysAsnGlyAlaGlu-30 |
| SEQ. ID. NO. 872 | 32-AlaAlaTyrAspAlaGluLeuLysProGluArgValSerGln-45 |
| SEQ. ID. NO. 873 | 59-ArgLeuLysAspAlaLeuAspAsnGlyPhe-68 |
| SEQ. ID. NO. 874 | 76-GlyIleSerGluArgGlnProAspIleGluAlaPheLysGlnAsnGlyGly-92 |
| SEQ. ID. NO. 875 | 104-IleValAsnArgArgAspAspLysVal-112 |
| SEQ. ID. NO. 876 | 118-SerAsnGlyLysThrThr-123 |
| SEQ. ID. NO. 877 | 153-GluTrpGlnArgGluGlyLysLysAlaAsp-162 |
| SEQ. ID. NO. 878 | 174-GluAsnThrGluSerLeuArgPro-181 |
| SEQ. ID. NO. 879 | 189-IleSerGluAspHisLeuAspArgTyrAspAspLeuLeu-201 |
| SEQ. ID. NO. 880 | 204-AlaHisThrLysAlaLysIlePheArgGlyAspGly-215 |
| SEQ. ID. NO. 881 | 220-AsnAlaAspAspAlaPheCysArgAlaMetLysArgAlaGlyArgGluValLys-237 |
| SEQ. ID. NO. 882 | 247-PheTrpLeuGluArgGluThrGlyArgLeuLysGlnGlyAsnGluAspLeuIleVal-265 |
| SEQ. ID. NO. 883 | 291-GlyLeuSerArgGluAlaLeu-297 |
| SEQ. ID. NO. 884 | 309-HisArgValGluLysIleGlyGluLysAsnGly-319 |
| SEQ. ID. NO. 885 | 324-AspAspSerLysGlyThrAsn-330 |
| SEQ. ID. NO. 886 | 353-GlyLysGlyGlnAsp-357 |
| SEQ. ID. NO. 887 | 359-ThrProLeuArgAspAlaLeuValGlyLysAlaLys-370 |
| SEQ. ID. NO. 888 | 380-ProGlnIleArgArgAspLeuAspGly-388 |
| SEQ. ID. NO. 889 | 431-TyrAlaHisArgSer-435 |
| 086-2 | |
| AMPHI Regions - AMPHI | |
| SEQ. ID. NO. 890 | 55-MetArgThrTrpArgArgLeuValPro-63 |
| SEQ. ID. NO. 891 | 83-IleAsnGlyAlaThrArg-88 |
| SEQ. ID. NO. 892 | 99-ProThrGluLeuPheLysLeuAlaVal-107 |
| SEQ. ID. NO. 893 | 120-GluValLeuArgSerMetGluSerLeuGlyTrpGlnSerIleTrpArgGlyThrAlaAsn-139 |
| SEQ. ID. NO. 894 | 155-GluMetTyrGlyArgPhe-160 |
| SEQ. ID. NO. 895 | 185-SerPheValValIle-189 |
| SEQ. ID. NO. 896 | 228-ArgValGlnArgValValAlaPheLeuAspProTrpLysAspProGln-243 |
| SEQ. ID. NO. 897 | 293-GlyPhePheGlyMetCys-298 |
| SEQ. ID. NO. 898 | 336-TrpIleGlyIleGlnSerPhe-342 |
| Antigenic Index - Jameson-Wolf | |
| SEQ. ID. NO. 899 | 20-LeuAlaSerLysGluGlyGlyAsp-27 |
| SEQ. ID. NO. 900 | 55-MetArgThrTrpArgArg-60 |
| SEQ. ID. NO. 901 | 79-AlaGlyArgGluIleAsnGlyAlaThr-87 |
| SEQ. ID. NO. 902 | 115-PheThrArgArgGluGluValLeuArgSerMetGlu-126 |
| SEQ. ID. NO. 903 | 134-TrpArgGlyThrAla-138 |
| SEQ. ID. NO. 904 | 144-AlaThrAsnProGlnAlaArgArgGluThrLeuGluMet-156 |
| SEQ. ID. NO. 905 | 225-AlaProTyrArgVal-229 |
| SEQ. ID. NO. 906 | 236-LeuAspProTrpLysAspProGlnGlyAla-245 |
| SEQ. ID. NO. 907 | 265-GlyLeuGlyAlaSerLeuSerLysArgGlyPheLeu-276 |
| SEQ. ID. NO. 908 | 313-SerIleGlyLysGlnSerArgAspLeuGly-322 |
| SEQ. ID. NO. 909 | 352-LeuProThrLysGlyLeu-357 |
| SEQ. ID. NO. 910 | 382-IleAspTyrGluAsnArgArgLysMetArgGlyTyrArgValGlu-396 |
| Hydrophilic Regions - Hopp-Woods | |
| SEQ. ID. NO. 911 | 21-AlaSerLysGluGlyGlyAsp-27 |
| SEQ. ID. NO. 912 | 79-AlaGlyArgGluIleAsnGly-85 |
| SEQ. ID. NO. 913 | 115-PheThrArgArgGluGluValLeuArgSerMetGlu-126 |
| SEQ. ID. NO. 914 | 147-ProGlnAlaArgArgGluThrLeuGluMet-156 |
| SEQ. ID. NO. 915 | 238-ProTrpLysAspProGlnGly-244 |
| SEQ. ID. NO. 916 | 270-LeuSerLysArgGlyPheLeu-276 |
| SEQ. ID. NO. 917 | 316-LysGlnSerArgAspLeu-321 |
| SEQ. ID. NO. 918 | 382-IleAspTyrGluAsnArgArgLysMetArgGlyTyrArgValGlu-396 |
| 087-2 | |
| AMPHI Regions - AMPHI | |
| SEQ. ID. NO. 919 | 23-ValAlaAspSerLeuArg-28 |
| SEQ. ID. NO. 920 | 80-GlnThrValArgGluAlaGlnArgIleIle-89 |
| SEQ. ID. NO. 921 | 99-GlyPheGlyGlyPheValThrPheProGlyLeuAlaAlaLysLeuLeu-115 |
| SEQ. ID. NO. 922 | 129-GlyLeuSerAsnArgHisLeuSerArgTrpAlaLysArgValLeuTyrAlaPheProLys-148 |
| SEQ. ID. NO. 923 | 157-ValGlyAsnProValArg-162 |
| SEQ. ID. NO. 924 | 192-GlyAlaAspValLeuAsnLysThrVal-200 |
| SEQ. ID. NO. 925 | 241-ValGluPheIleThrAspMetValSerAlaTyr-251 |
| SEQ. ID. NO. 926 | 313-GluLysLeuAlaGluIleLeuGly-320 |
| SEQ. ID. NO. 927 | 330-TrpAlaGluAsnAla-334 |
| Antigenic Index - Jameson-Wolf | |
| SEQ. ID. NO. 928 | 25-AspSerLeuArgAlaArgGly-31 |
| SEQ. ID. NO. 929 | 37-LeuGlySerLysAspSerMetGluGluArgIleValProGlnTyrGlyIle-53 |
| SEQ. ID. NO. 930 | 61-LysGlyValArgGlyAsnGlyIleLysArgLysLeu-72 |
| SEQ. ID. NO. 931 | 81-ThrValArgGluAlaGlnArgIleIleArgLysHisArgVal-94 |
| SEQ. ID. NO. 932 | 130-LeuSerAsnArgHisLeuSerArgTrpAlaLys-140 |
| SEQ. ID. NO. 933 | 150-PheSerHisGluGlyGlyLeu-156 |

TABLE 1-continued

| | |
|---|---|
| SEQ. ID. NO. 934 | 159-AsnProValArgAlaAspIleSer-166 |
| SEQ. ID. NO. 935 | 171-ProAlaGluArgPheGlnGlyArgGluGlyArgLeu-182 |
| SEQ. ID. NO. 936 | 195-ValLeuAsnLysThrVal-200 |
| SEQ. ID. NO. 937 | 207-LeuProAspAsnAlaArgProGlnMetTyrHisGlnSerGlyArgGlyLysLeuGly-225 |
| SEQ. ID. NO. 938 | 229-AlaAspTyrArgAspAla-233 |
| SEQ. ID. NO. 939 | 235-GlyValLysAlaGluCys-240 |
| SEQ. ID. NO. 940 | 249-SerAlaTyrArgAspAlaAsp-255 |
| SEQ. ID. NO. 941 | 284-AlaValAspAspHisGlnThrAla-291 |
| SEQ. ID. NO. 942 | 309-GlnLeuThrAlaGluLysLeuAlaGlu-317 |
| SEQ. ID. NO. 943 | 321-GlyLeuAsnArgGluLysCysLeuLys-329 |
| SEQ. ID. NO. 944 | 331-AlaGluAsnAlaArgThr-336 |
| SEQ. ID. NO. 945 | 341-HisSerAlaAspAspValAlaGlu-348 |
| Hydrophilic Regions - Hopp-Woods | |
| SEQ. ID. NO. 946 | 25-AspSerLeuArgAlaArgGly-31 |
| SEQ. ID. NO. 947 | 39-SerLysAspSerMetGluGluArgIleVal-48 |
| SEQ. ID. NO. 948 | 66-AsnGlyIleLysArgLysLeu-72 |
| SEQ. ID. NO. 949 | 81-ThrValArgGluAlaGlnArgIleIleArgLysHisArgVal-94 |
| SEQ. ID. NO. 950 | 134-HisLeuSerArgTrpAlaLys-140 |
| SEQ. ID. NO. 951 | 161-ValArgAlaAspIle-165 |
| SEQ. ID. NO. 952 | 171-ProAlaGluArgPheGlnGlyArgGluGlyArgLeu-182 |
| SEQ. ID. NO. 953 | 219-SerGlyArgGlyLysLeu-224 |
| SEQ. ID. NO. 954 | 235-GlyValLysAlaGluCys-240 |
| SEQ. ID. NO. 955 | 249-SerAlaTyrArgAspAlaAsp-255 |
| SEQ. ID. NO. 956 | 284-AlaValAspAspHisGlnThrAla-291 |
| SEQ. ID. NO. 957 | 310-LeuThrAlaGluLysLeuAlaGlu-317 |
| SEQ. ID. NO. 958 | 322-LeuAsnArgGluLysCysLeuLys-329 |
| SEQ. ID. NO. 959 | 331-AlaGluAsnAlaArg-335 |
| SEQ. ID. NO. 960 | 341-HisSerAlaAspAspValAlaGlu-348 |
| 088-2 | |
| AMPHI Regions - AMPHI | |
| SEQ. ID. NO. 961 | 7-HisPheSerAsnTrpLeuThrGlyLeuAsnIlePheGlnTyrThrThr-22 |
| SEQ. ID. NO. 962 | 24-ArgAlaValMetAlaAlaLeu-30 |
| SEQ. ID. NO. 963 | 43-ThrIleArgArgLeuThrAlaLeuLysCysGlyGln-54 |
| SEQ. ID. NO. 964 | 88-LeuTrpGlyAsnTrpAlaAsn-94 |
| SEQ. ID. NO. 965 | 111-GlyPheTyrAspAspTrpArgLysValValTyr-121 |
| SEQ. ID. NO. 966 | 140-AlaIleIleAlaSerLeuAlaLeu-147 |
| SEQ. ID. NO. 967 | 175-GlyPheLeuValLeuSerTyrLeuThrIle-184 |
| SEQ. ID. NO. 968 | 187-ThrSerAsnAlaValAsnLeuThrAspGlyLeuAspGlyLeuAlaThr-202 |
| SEQ. ID. NO. 969 | 221-HisSerGlnPheAlaGlnTyrLeuGlnLeuProTyr-232 |
| SEQ. ID. NO. 970 | 245-AlaMetCysGlyAlaCysLeuGlyPhe-253 |
| Antigenic Index - Jameson-Wolf | |
| SEQ. ID. NO. 971 | 48-ThrAlaLeuLysCysGlyGlnAlaValArgThrAspGlyProGln-62 |
| SEQ. ID. NO. 972 | 66-ValLysAsnGlyThrProThrMet-73 |
| SEQ. ID. NO. 973 | 114-AspAspTrpArgLysValValTyrLysAspProAsnGlyValSerAlaLysPhe-131 |
| SEQ. ID. NO. 974 | 193-LeuThrAspGlyLeuAsp-198 |
| SEQ. ID. NO. 975 | 312-LysLysThrLysLysArgIle-318 |
| SEQ. ID. NO. 976 | 328-TyrGluGlnLysGlyTrpLysGluThrGlnVal-338 |
| Hydrophilic Regions - Hopp-Woods | |
| SEQ. ID. NO. 977 | 56-ValArgThrAspGlyProGln-62 |
| SEQ. ID. NO. 978 | 114-AspAspTrpArgLysValValTyrLysAspProAsnGlyVal-127 |
| SEQ. ID. NO. 979 | 312-LysLysThrLysLysArgIle-318 |
| SEQ. ID. NO. 980 | 331-LysGlyTrpLysGlu-335 |
| 089-2 | |
| AMPHI Regions - AMPHI | |
| SEQ. ID. NO. 981 | 40-PheSerThrArgCysGlyArgProTrpLysValLeu-51 |
| SEQ. ID. NO. 982 | 74-LeuAlaAlaLeuCysArgProCysAsnGlyMetSerCys-86 |
| SEQ. ID. NO. 983 | 118-SerArgProAlaArgPhe-123 |
| Antigenic Index - Jameson-Wolf | |
| SEQ. ID. NO. 984 | 1-MetProProLysIleThrLysSerGlyPhe-10 |
| SEQ. ID. NO. 985 | 40-PheSerThrArgCysGlyArgProTrpLys-49 |
| SEQ. ID. NO. 986 | 54-SerSerAsnAlaSerArgAspLysProMetAlaSerHisLysAla-68 |
| SEQ. ID. NO. 987 | 79-ArgProCysAsnGlyMetSerCys-86 |
| SEQ. ID. NO. 988 | 95-CysPheArgArgProValSerArgSerAsnGlnLysSerAlaSerCysSerAsnGluAsnHisPheThrSerArgProAlaArgPheIleAla ArgGlnAsnAlaSerSerAlaPheLysThrCysThrProSerProArgLysIleLeu-144 |
| Hydrophilic Regions - Hopp-Woods | |
| SEQ. ID. NO. 989 | 43-ArgCysGlyArgPro-47 |
| SEQ. ID. NO. 990 | 56-AsnAlaSerArgAspLysProMetAlaSerHisLysAla-68 |
| SEQ. ID. NO. 991 | 95-CysPheArgArgProValSerArgSerAsnGlnLysSerAlaSerCysSerAsn-112 |
| SEQ. ID. NO. 992 | 119-ArgProAlaArgPheIleAla-125 |
| SEQ. ID. NO. 993 | 137-ThrProSerProArgLysIle-143 |
| 090-1 | |
| AMPHI Regions - AMPHI | |
| SEQ. ID. NO. 994 | 10-SerGlnSerLeuLysArgPheAspLysHisPheArg-21 |
| SEQ. ID. NO. 995 | 56-SerGlnSerGlyAlaValGlyHisIle-64 |
| SEQ. ID. NO. 996 | 141-AlaAspPhePheHisAlaValArgGlnAla-150 |
| SEQ. ID. NO. 997 | 152-GluGlyPheAspValPheGluGlnCysPheAla-162 |
| SEQ. ID. NO. 998 | 164-GlnThrAspGlyLeuThrGln-170 |
| SEQ. ID. NO. 999 | 177-ValSerGlyValValGlnThrLeuGlnArg-186 |
| SEQ. ID. NO. 1000 | 226-LeuHisArgAlaAlaGluArgIleValArgIleGlnAsnLeuHisAlaVal-242 |
| SEQ. ID. NO. 1001 | 387-IleGluThrValValGlnArgIlePheGlnThrAla-398 |

TABLE 1-continued

| SEQ. ID. NO. 1002 | 404-ProValLysHisLeuThrAspLeuArg-412 |
| SEQ. ID. NO. 1003 | 425-AsnLeuArgAlaValPheAlaGlnValGlyAsnHisGlyAsnThrArgThrAlaGluSer-444 |

Antigenic Index - Jameson-Wolf

| SEQ. ID. NO. 1004 | 9-AlaSerGlnSerLeuLysArgPheAspLysHisPheArg-21 |
| SEQ. ID. NO. 1005 | 29-HisIleLysAlaArgAlaGlyGlyAlaGluGlnHis-40 |
| SEQ. ID. NO. 1006 | 53-AsnGlyPheSerGlnSerGly-59 |
| SEQ. ID. NO. 1007 | 73-AlaAspLeuArgArgIleAspThrAsnGlnGlu-83 |
| SEQ. ID. NO. 1008 | 94-AlaGlnGlyArgGluVal-99 |
| SEQ. ID. NO. 1009 | 107-GlnAsnHisGluGluArgIleLeuGlnThrGlyAsnArgGlyGlySerArgAlaAspIleArg-127 |
| SEQ. ID. NO. 1010 | 149-GlnAlaLeuGluGly-153 |
| SEQ. ID. NO. 1011 | 161-PheAlaArgGlnThrAspGlyLeuThrGlnSerHisGlySerHisAspValSerGly-179 |
| SEQ. ID. NO. 1012 | 187-AsnValLeuArgAspAsnGln-193 |
| SEQ. ID. NO. 1013 | 214-PheGlnArgLysProPheTyr-220 |
| SEQ. ID. NO. 1014 | 228-ArgAlaAlaGluArgIleValArg-235 |
| SEQ. ID. NO. 1015 | 269-GlnHisArgArgArgSerArgThrGlnAla-278 |
| SEQ. ID. NO. 1016 | 285-GluAlaGlyLysLeuGln-290 |
| SEQ. ID. NO. 1017 | 304-ArgLeuGlnAsnArgArgAlaAspIleAlaArgAspAsnGlyIle-318 |
| SEQ. ID. NO. 1018 | 320-ProAlaLeuAspThrGluIleAlaAspGlnAlaArgTyrArgGly-334 |
| SEQ. ID. NO. 1019 | 339-AlaGlyAsnArgAsnTyr-344 |
| SEQ. ID. NO. 1020 | 353-ValArgGlnGlnPhe-357 |
| SEQ. ID. NO. 1021 | 379-AspAlaGlyThrGluSerGlnAsnIle-387 |
| SEQ. ID. NO. 1022 | 398-AlaArgValLysHisGlnProValLysHisLeuThrAspLeuArgHis-413 |
| SEQ. ID. NO. 1023 | 421-IleIleArgSerAsnLeuArg-427 |
| SEQ. ID. NO. 1024 | 434-GlyAsnHisGlyAsnThrArgThrAlaGluSerGlyAspGluAspPhePhe-450 |

Hydrophilic Regions - Hopp-Woods

| SEQ. ID. NO. 1025 | 11-GlnSerLeuLysArgPheAspLysHisPheArg-21 |
| SEQ. ID. NO. 1026 | 29-HisIleLysAlaArgAlaGlyGlyAlaGluGlnHis-40 |
| SEQ. ID. NO. 1027 | 73-AlaAspLeuArgArgIleAspThrAsnGln-82 |
| SEQ. ID. NO. 1028 | 94-AlaGlnGlyArgGluVal-99 |
| SEQ. ID. NO. 1029 | 107-GlnAsnHisGluGluArgIleLeu-114 |
| SEQ. ID. NO. 1030 | 117-GlyAsnArgGlyGlySerArgAlaAspIleArg-127 |
| SEQ. ID. NO. 1031 | 163-ArgGlnThrAspGlyLeuThr-169 |
| SEQ. ID. NO. 1032 | 173-GlySerHisAspVal-177 |
| SEQ. ID. NO. 1033 | 187-AsnValLeuArgAspAsnGln-193 |
| SEQ. ID. NO. 1034 | 228-ArgAlaAlaGluArgIleValArg-235 |
| SEQ. ID. NO. 1035 | 269-GlnHisArgArgArgSerArgThrGln-277 |
| SEQ. ID. NO. 1036 | 285-GluAlaGlyLysLeuGln-290 |
| SEQ. ID. NO. 1037 | 305-LeuGlnAsnArgArgAlaAspIleAlaArgAspAsnGlyIle-318 |
| SEQ. ID. NO. 1038 | 322-LeuAspThrGluIleAlaAspGlnAlaArgTyrArg-333 |
| SEQ. ID. NO. 1039 | 380-AlaGlyThrGluSerGlnAsnIle-387 |
| SEQ. ID. NO. 1040 | 398-AlaArgValLysHisGlnPro-404 |
| SEQ. ID. NO. 1041 | 407-HisLeuThrAspLeuArgHis-413 |
| SEQ. ID. NO. 1042 | 421-IleIleArgSerAsnLeu-426 |
| SEQ. ID. NO. 1043 | 437-GlyAsnThrArgThrAlaGluSerGlyAspGluAspPhePhe-450 |

091-2
AMPHI Regions - AMPHI

| SEQ. ID. NO. 1044 | 11-ProLeuSerAspGlyIleAlaSerCys-19 |
| SEQ. ID. NO. 1045 | 21-IleThrArgLeuGlnAlaLeuVal-28 |
| SEQ. ID. NO. 1046 | 33-ValLeuValSerValLeuThrSerLeuAlaLys-43 |

Antigenic Index - Jameson-Wolf

| SEQ. ID. NO. 1047 | 1-LeuSerArgArgCysProProLeuProLysProLeuSerAspGlyIleAla-17 |
| SEQ. ID. NO. 1048 | 73-LeuArgCysArgLeuProLysProSerAspArgPheAsp-85 |
| SEQ. ID. NO. 1049 | 105-LeuAspAsnProLeuArgCysArgLeuProIleProSerAspArgPheGly-121 |

Hydrophilic Regions - Hopp-Woods

| SEQ. ID. NO. 1050 | 1-LeuSerArgArgCysProProLeu-8 |
| SEQ. ID. NO. 1051 | 75-CysArgLeuProLysProSerAspArgPheAsp-85 |
| SEQ. ID. NO. 1052 | 107-AsnProLeuArgCys-111 |
| SEQ. ID. NO. 1053 | 115-IleProSerAspArgPhe-120 |

092
AMPHI Regions - AMPHI

| SEQ. ID. NO. 1054 | 55-GlyMetSerGlyIleAlaGluValLeuHis-64 |
| SEQ. ID. NO. 1055 | 76-AlaArgAsnAlaAlaThrGluHisLeu-84 |
| SEQ. ID. NO. 1056 | 95-HisThrAlaGluHisValAsnGly-102 |
| SEQ. ID. NO. 1057 | 120-ValAlaAlaLeuGlu-124 |
| SEQ. ID. NO. 1058 | 137-AlaGluLeuMetArgPheArgAsp-144 |
| SEQ. ID. NO. 1059 | 209-LeuThrProIleMetSerValValThrAsnIleAsp-220 |
| SEQ. ID. NO. 1060 | 226-ThrTyrGlyHisSerValGluLysLeuHisGlnAlaPheIleAspPheIleHisArg-244 |
| SEQ. ID. NO. 1061 | 259-HisValArgAlaIleLeuProLysValSerLysProTyr-271 |
| SEQ. ID. NO. 1062 | 273-ThrTyrGlyLeuAspAspThrAla-280 |
| SEQ. ID. NO. 1063 | 321-AsnValLeuAsnAlaLeuAlaAlaIle-329 |
| SEQ. ID. NO. 1064 | 339-ValGluAlaIleGlnLysGly-345 |
| SEQ. ID. NO. 1065 | 353-GlyArgArgPheGlnLysTyrGlyAspIleLys-363 |
| SEQ. ID. NO. 1066 | 407-ArgTyrThrArgThrArgAspLeuPheGluAspPheThrLysValLeuAsnThrValAspAlaLeu-428 |
| SEQ. ID. NO. 1067 | 449-LeuAlaArgAlaIleArgValLeuGlyLysLeu-459 |
| SEQ. ID. NO. 1068 | 464-CysGluAsnValAlaAspLeuProGluMetLeuLeuAsn-476 |

Antigenic Index - Jameson-Wolf

| SEQ. ID. NO. 1069 | 14-LeuTrpArgAlaAsnGlyGlnProPheLys-23 |
| SEQ. ID. NO. 1070 | 25-ThrProLeuArgIleGluAsnProProGluArgAsnIleMetMetLysAsnArgVal-43 |
| SEQ. ID. NO. 1071 | 70-ValSerGlySerAspGlnAlaArgAsnAlaAla-80 |
| SEQ. ID. NO. 1072 | 111-AlaValLysLysGluAsnProGluVal-119 |

TABLE 1-continued

| | |
|---|---|
| SEQ. ID. NO. 1073 | 140-MetArgPheArgAspGlyIle-146 |
| SEQ. ID. NO. 1074 | 150-GlyThrHisGlyLysThrThrThr-157 |
| SEQ. ID. NO. 1075 | 184-GlyThrAsnAlaArgLeuGlyLysGlyGluTyr-194 |
| SEQ. ID. NO. 1076 | 198-GluAlaAspGluSerAspAla-204 |
| SEQ. ID. NO. 1077 | 218-AsnIleAspGluAspHisMetAspThrTyrGly-228 |
| SEQ. ID. NO. 1078 | 230-SerValGluLysLeuHis-235 |
| SEQ. ID. NO. 1079 | 255-IleAspSerGluHisVal-260 |
| SEQ. ID. NO. 1080 | 263-IleLeuProLysValSerLysProTyrAla-272 |
| SEQ. ID. NO. 1081 | 275-GlyLeuAspAspThrAlaAsp-281 |
| SEQ. ID. NO. 1082 | 286-AspIleGluAsnValGlyAla-292 |
| SEQ. ID. NO. 1083 | 302-MetLysGlyHisGluGlnGlySerPhe-310 |
| SEQ. ID. NO. 1084 | 351-GlyValGlyArgArgPheGlnLysTyrGlyAspIleLysLeuProAsnGlyGly-368 |
| SEQ. ID. NO. 1085 | 374-AspAspTyrGlyHisHisPro-380 |
| SEQ. ID. NO. 1086 | 393-AlaTyrLeuGluLysArgLeu-399 |
| SEQ. ID. NO. 1087 | 404-GlnProHisArgTyrThrArgThrArgAspLeuPheGluAspPheThrLys-420 |
| SEQ. ID. NO. 1088 | 435-AlaAlaGlyGluGluProIleAlaAlaAlaAspSerArgAlaLeuAlaArg-451 |
| SEQ. ID. NO. 1089 | 466-AsnValAlaAspLeuPro-471 |
| SEQ. ID. NO. 1090 | 478-LeuGlnAspGlyAspIle-483 |
| SEQ. ID. NO. 1091 | 488-GlyAlaGlySerIleAsn-493 |
| Hydrophilic Regions - Hopp-Woods | |
| SEQ. ID. NO. 1092 | 26-ProLeuArgIleGluAsnProProGluArgAsnIleMetMetLysAsnArgVal-43 |
| SEQ. ID. NO. 1093 | 71-SerGlySerAspGlnAlaArgAsnAlaAla-80 |
| SEQ. ID. NO. 1094 | 111-AlaValLysLysGluAsnProGlu-118 |
| SEQ. ID. NO. 1095 | 140-MetArgPheArgAsp-144 |
| SEQ. ID. NO. 1096 | 152-HisGlyLysThrThr-156 |
| SEQ. ID. NO. 1097 | 187-AlaArgLeuGlyLysGlyGlu-193 |
| SEQ. ID. NO. 1098 | 198-GluAlaAspGluSerAspAla-204 |
| SEQ. ID. NO. 1099 | 218-AsnIleAspGluAspHisMetAsp-225 |
| SEQ. ID. NO. 1100 | 230-SerValGluLysLeuHis-235 |
| SEQ. ID. NO. 1101 | 256-AspSerGluHisVal-260 |
| SEQ. ID. NO. 1102 | 275-GlyLeuAspAspThrAlaAsp-281 |
| SEQ. ID. NO. 1103 | 303-LysGlyHisGluGlnGlySer-309 |
| SEQ. ID. NO. 1104 | 351-GlyValGlyArgArgPheGlnLys-358 |
| SEQ. ID. NO. 1105 | 360-GlyAspIleLysLeu-364 |
| SEQ. ID. NO. 1106 | 393-AlaTyrLeuGluLysArgLeu-399 |
| SEQ. ID. NO. 1107 | 407-ArgTyrThrArgThrArgAspLeuPheGluAspPheThrLys-420 |
| SEQ. ID. NO. 1108 | 435-AlaAlaGlyGluGluProIleAlaAlaAlaAspSerArgAlaLeuAlaArg-451 |
| SEQ. ID. NO. 1109 | 466-AsnValAlaAspLeuPro-471 |
| SEQ. ID. NO. 1110 | 479-GlnAspGlyAspIle-483 |
| 093-2 | |
| AMPHI Regions - AMPHI | |
| SEQ. ID. NO. 1111 | 26-ThrAlaIleLeuAsn-30 |
| SEQ. ID. NO. 1112 | 59-ThrAlaPheAsnIleLeuHisGly-66 |
| SEQ. ID. NO. 1113 | 159-LysSerValTyrGluGluLeuLysHisLeu-168 |
| SEQ. ID. NO. 1114 | 196-IleHisIleIleProAlaThrGluPhe-204 |
| SEQ. ID. NO. 1115 | 254-PheLeuLysAspThr-258 |
| SEQ. ID. NO. 1116 | 267-IleAsnThrLeuProGlyMetThrSer-275 |
| Antigenic Index - Jameson-Wolf | |
| SEQ. ID. NO. 1117 | 12-GlyGlyPheSerSerGluArgGluIleSerLeuAspSerGlyThr-26 |
| SEQ. ID. NO. 1118 | 32-LeuLysSerLysGlyIleAsp-38 |
| SEQ. ID. NO. 1119 | 41-AlaPheAspProLysGluThrProLeuSerGluLeuLysAlaGlnGly-56 |
| SEQ. ID. NO. 1120 | 66-GlyThrTyrGlyGluAspGlyAlaVal-74 |
| SEQ. ID. NO. 1121 | 96-GlyMetAspLysTyrArgCys-102 |
| SEQ. ID. NO. 1122 | 120-HisAspAspThrAspPheAspAlaValGluGluLysLeuGly-133 |
| SEQ. ID. NO. 1123 | 140-ProAlaAlaGluGlySerSer-146 |
| SEQ. ID. NO. 1124 | 151-LysValLysGlyLysGlyArgLeuLysSerValTyrGluGluLeuLysHisLeuGln-169 |
| SEQ. ID. NO. 1125 | 176-ArgPheIleGlyGlyGlyGluTyrSer-184 |
| SEQ. ID. NO. 1126 | 189-AsnGlyLysGlyLeuPro-194 |
| SEQ. ID. NO. 1127 | 203-GluPheTyrAspTyrGluAlaLysTyrAsnArgAspAspThrIleTyrGlnCysProSerGluAspLeuThrGluAlaGluGluSerLeuMetArg-234 |
| SEQ. ID. NO. 1128 | 245-GlyAlaGluGlyCysVal-250 |
| SEQ. ID. NO. 1129 | 253-AspPheLeuLysAspThrAspGly-260 |
| SEQ. ID. NO. 1130 | 270-LeuProGlyMetThr-274 |
| SEQ. ID. NO. 1131 | 279-ValProLysSerAlaAla-284 |
| Hydrophilic Regions - Hopp-Woods | |
| SEQ. ID. NO. 1132 | 15-SerSerGluArgGluIleSerLeu-22 |
| SEQ. ID. NO. 1133 | 32-LeuLysSerLysGlyIleAsp-38 |
| SEQ. ID. NO. 1134 | 41-AlaPheAspProLysGluThrProLeuSerGluLeuLysAla-54 |
| SEQ. ID. NO. 1135 | 68-TyrGlyGluAspGlyAlaVal-74 |
| SEQ. ID. NO. 1136 | 96-GlyMetAspLysTyrArgCys-102 |
| SEQ. ID. NO. 1137 | 120-HisAspAspThrAspPheAspAlaValGluGluLysLeuGly-133 |
| SEQ. ID. NO. 1138 | 140-ProAlaAlaGluGlySerSer-146 |
| SEQ. ID. NO. 1139 | 151-LysValLysGlyLysGlyArgLeuLysSerValTyrGluGluLeuLysHisLeuGln-169 |
| SEQ. ID. NO. 1140 | 205-TyrAspTyrGluAlaLysTyrAsnArgAspAspThrIle-217 |
| SEQ. ID. NO. 1141 | 221-ProSerGluAspLeuThrGluAlaGluGluSerLeuMetArg-234 |
| SEQ. ID. NO. 1142 | 253-AspPheLeuLysAspThrAspGly-260 |
| 094 | |

TABLE 1-continued

AMPHI Regions - AMPHI
SEQ. ID. NO. 1143    17-LeuProProIleThrLysValGlySer-25
SEQ. ID. NO. 1144    80-PheSerPheLeuThrAlaVal-86
Antigenic Index - Jameson-Wolf
SEQ. ID. NO. 1145    3-SerProLeuProLysArgAlaLeu-10
SEQ. ID. NO. 1146    24-GlySerSerProAlaAlaProArgMetGluAla-34
SEQ. ID. NO. 1147    50-MetProSerArgLysArgIleAsnSerAlaAsnIleArgAlaArgGlyIleThr-67
Hydrophilic Regions - Hopp-Woods
SEQ. ID. NO. 1148    5-LeuProLysArgAlaLeu-10
SEQ. ID. NO. 1149    28-AlaAlaProArgMetGluAla-34
SEQ. ID. NO. 1150    51-ProSerArgLysArgIleAsn-57
SEQ. ID. NO. 1151    60-AsnIleArgAlaArgGly-65
095-2
AMPHI Regions - AMPHI
SEQ. ID. NO. 1152    9-CysAlaSerAsnLeuPheArgGlnCysGlnGlnArgGlyGlyAspAlaValAsp-26
SEQ. ID. NO. 1153    38-ValLeuGlnAsnValGlnGlnHisPheGlyGlnIleGlyAsnValPheAlaVal-55
SEQ. ID. NO. 1154    86-PheGlyGlnHisGlnArgValAsnGlyIleGluAspPheGlyLysValPheLysGlnIleAlaArg-107
SEQ. ID. NO. 1155    132-GlyArgArgHisPheAspGlyValValSer-141
SEQ. ID. NO. 1156    174-PheLeuAspArgPheAsnArgCysAlaAspPheGlnArgHisAlaAspGlyCysGlnCysValGlnHisVal-197
SEQ. ID. NO. 1157    204-GlnHisAspPheLys-208
SEQ. ID. NO. 1158    236-AspValGlyGlyIleValGlnThrValSerSerIle-247
SEQ. ID. NO. 1159    274-ThrValAspGluIleAspLysArgLeuMetGlnPhePheAspAlaVal-289
SEQ. ID. NO. 1160    313-GlyCysIleArgLeuValGly-319
SEQ. ID. NO. 1161    370-AsnGlyAspAlaValThrGluAlaHisGlnLeuArgGlnHisGlnGlyAla-386
SEQ. ID. NO. 1162    412-AspAspIleArgThrValAsnValPheGlyGlyMet-423
SEQ. ID. NO. 1163    435-MetLeuGlySerGlyIleSerArgLeuIleArgThrGly-447
SEQ. ID. NO. 1164    451-AlaGlnIleValGlnAspPheGlyAspAlaAlaHisAla-463
Antigenic Index - Jameson-Wolf
SEQ. ID. NO. 1165    6-SerGlyGlyCysAlaSerAsnLeu-13
SEQ. ID. NO. 1166    16-GlnCysGlnGlnArgGlyGlyAspAlaValAspAlaSerArgAlaHisIle-32
SEQ. ID. NO. 1167    62-GlnHisAlaAspGlyAlaGlyLysSerAlaGlyIleGlyGlyGlyAsnArgLeuPhe-80
SEQ. ID. NO. 1168    88-GlnHisGlnArgValAsnGlyIleGluAspPheGlyLys-100
SEQ. ID. NO. 1169    112-ValArgLeuGluGlyGluTyr-118
SEQ. ID. NO. 1170    127-AlaCysGlyGlyLysGlyArgArgHisPheAspGly-138
SEQ. ID. NO. 1171    144-ValHisGlnGluArgGlyProAla-151
SEQ. ID. NO. 1172    163-AlaAlaAlaAspAlaPheLysAlaGluGlnAlaPhe-174
SEQ. ID. NO. 1173    176-AspArgPheAsnArgCysAlaAspPheGlnArgHisAlaAspGlyCysGln-192
SEQ. ID. NO. 1174    205-HisAspPheLysArg-209
SEQ. ID. NO. 1175    253-GlyGlnAsnArgAlaAspVal-259
SEQ. ID. NO. 1176    263-AsnThrGlnLysGlyPheAlaVal-270
SEQ. ID. NO. 1177    273-HisThrValAspGluIleAspLysArgLeu-282
SEQ. ID. NO. 1178    300-IleGlyAsnAspGlyHisAsnArgCysGlnValGlnLysGlyCys-314
SEQ. ID. NO. 1179    339-PheAlaAlaAspAsnGluSerArgValLysSerCysArgAlaGluAspGlyGlyGlyGlnAlaGlyGlyArg
                     GlyPheAlaValArgAlaGlyAsnGlyAspAlaValThr-375
SEQ. ID. NO. 1180    378-HisGlnLeuArgGlnHisGlnGlyAlaArgAsnAsnGlyAsn-391
SEQ. ID. NO. 1181    394-LeuGlnArgSerAspAsnPheGly-401
SEQ. ID. NO. 1182    405-PheAspGlyGlyArgGlyAsnAspAspIleArgThr-416
SEQ. ID. NO. 1183    442-ArgLeuIleArgThrGlyAsnPheLys-450
SEQ. ID. NO. 1184    461-AlaHisAlaAspAlaAlaAspThrAspLysMetAspValGlyAsn-475
Hydrophilic Regions - Hopp-Woods
SEQ. ID. NO. 1185    17-CysGlnGlnArgGlyGlyAspAlaValAspAlaSerArgAlaHisIle-32
SEQ. ID. NO. 1186    64-AlaAspGlyAlaGlyLysSerAlaGly-72
SEQ. ID. NO. 1187    93-AsnGlyIleGluAspPheGlyLys-100
SEQ. ID. NO. 1188    112-ValArgLeuGluGlyGluTyr-118
SEQ. ID. NO. 1189    128-CysGlyGlyLysGlyArgArgHisPhe-136
SEQ. ID. NO. 1190    145-HisGlnGluArgGlyPro-150
SEQ. ID. NO. 1191    163-AlaAlaAlaAspAlaPheLysAlaGluGlnAlaPhe-174
SEQ. ID. NO. 1192    182-AlaAspPheGlnArgHisAlaAspGly-190
SEQ. ID. NO. 1193    205-HisAspPheLysArg-209
SEQ. ID. NO. 1194    273-HisThrValAspGluIleAspLysArgLeu-282
SEQ. ID. NO. 1195    300-IleGlyAsnAspGlyHisAsnArgCysGlnVal-310
SEQ. ID. NO. 1196    339-PheAlaAlaAspAsnGluSerArgValLysSerCysArgAlaGluAspGlyGlyGly-357
SEQ. ID. NO. 1197    368-AlaGlyAsnGlyAspAlaValThr-375
SEQ. ID. NO. 1198    378-HisGlnLeuArgGlnHisGlnGlyAlaArgAsnAsnGly-390
SEQ. ID. NO. 1199    395-GlnArgSerAspAsn-399
SEQ. ID. NO. 1200    407-GlyGlyArgGlyAsnAspAspIleArgThr-416
SEQ. ID. NO. 1201    461-AlaHisAlaAspAlaAlaAspThrAspLysMetAspVal-473
096-2
AMPHI Regions - AMPHI
SEQ. ID. NO. 1202    19-GlyIlePheGluGluIleAspAlaHis-27
SEQ. ID. NO. 1203    37-AlaAlaAsnArgGln-41
SEQ. ID. NO. 1204    61-GlyValValAlaVal-65
SEQ. ID. NO. 1205    112-GlnPhePheValAsnAlaPheGln-119
SEQ. ID. NO. 1206    129-AlaTyrAlaAlaAlaPheGlyArg-136
SEQ. ID. NO. 1207    172-AsnGlnPheAlaAla-176
SEQ. ID. NO. 1208    187-AspThrAlaAlaGlyIleGlyAsnAlaGln-196
SEQ. ID. NO. 1209    228-GlnTrpGlyPhePhe-232
Antigenic Index - Jameson-Wolf
SEQ. ID. NO. 1210    1-MetAlaArgHisThrGlyGlnGlyVal-9
SEQ. ID. NO. 1211    22-GluGluIleAspAla-26

TABLE 1-continued

| | |
|---|---|
| SEQ. ID. NO. 1212 | 30-PheArgThrAspCysLeuArgAlaAlaAsn-39 |
| SEQ. ID. NO. 1213 | 75-GlyCysGlyAsnAspValTyrAla-82 |
| SEQ. ID. NO. 1214 | 88-ValGlnAspGlyAla-92 |
| SEQ. ID. NO. 1215 | 97-AlaAlaAspLysThrPheGlyAsn-104 |
| SEQ. ID. NO. 1216 | 137-ArgPheHisLysHisArgGln-143 |
| SEQ. ID. NO. 1217 | 157-ValGlnAspGlyGluLeuGlyAsnGlyGlnSerGlnCysLeu-170 |
| SEQ. ID. NO. 1218 | 181-AlaAspGlyGlyCysGlyAspThr-188 |
| SEQ. ID. NO. 1219 | 211-ThrValLysAspValGluCysArgLeu-219 |
| Hydrophilic Regions - Hopp-Woods | |
| SEQ. ID. NO. 1220 | 1-MetAlaArgHisThrGlyGln-7 |
| SEQ. ID. NO. 1221 | 22-GluGluIleAspAla-26 |
| SEQ. ID. NO. 1222 | 33-AspCysLeuArgAlaAlaAsn-39 |
| SEQ. ID. NO. 1223 | 97-AlaAlaAspLysThrPheGly-103 |
| SEQ. ID. NO. 1224 | 137-ArgPheHisLysHisArgGln-143 |
| SEQ. ID. NO. 1225 | 158-GlnAspGlyGluLeuGlyAsn-164 |
| SEQ. ID. NO. 1226 | 183-GlyGlyCysGlyAspThr-188 |
| SEQ. ID. NO. 1227 | 211-ThrValLysAspValGluCysArgLeu-219 |
| 097-2 | |
| AMPHI Regions - AMPHI | |
| SEQ. ID. NO. 1228 | 28-AlaGlyLeuThrThrPheLeuThrMetCysTyrIleVal-40 |
| SEQ. ID. NO. 1229 | 72-MetGlyPheValGly-76 |
| SEQ. ID. NO. 1230 | 166-AlaThrLeuValGlyLeuGlyAspIleHisGlnProSerAlaLeuLeuAlaLeuPheGly-185 |
| SEQ. ID. NO. 1231 | 207-ThrIleThrValIleAlaSerLeuMetGlyLeuAsnGluPheHisGlyIleIleGlyGluValProSerIle-230 |
| SEQ. ID. NO. 1232 | 242-LeuPheThrValSer-246 |
| SEQ. ID. NO. 1233 | 260-PheAspSerThrGlyThrLeu-266 |
| SEQ. ID. NO. 1234 | 342-LeuAlaLysSerValProAlaPheAlaThr-351 |
| SEQ. ID. NO. 1235 | 362-MetLeuArgSerAlaArgAspIle-369 |
| Antigenic Index - Jameson-Wolf | |
| SEQ. ID. NO. 1236 | 1-MetAspThrSerLysGlnThrLeu-8 |
| SEQ. ID. NO. 1237 | 13-PheLysLeuLysAlaAsnGlyThrThrValArgThrGluLeu-26 |
| SEQ. ID. NO. 1238 | 125-LysValArgGluMetLeu-130 |
| SEQ. ID. NO. 1239 | 260-PheAspSerThrGly-264 |
| SEQ. ID. NO. 1240 | 277-ValAspGlyLysLeuProArgLeuLysArg-286 |
| SEQ. ID. NO. 1241 | 317-SerAlaGlyGlyArgThrGly-323 |
| SEQ. ID. NO. 1242 | 364-ArgSerAlaArgAspIleAspTrpAspAspMetThrGlu-376 |
| SEQ. ID. NO. 1243 | 410-LeuCysArgArgThrLysAspValProPro-419 |
| Hydrophilic Regions - Hopp-Woods | |
| SEQ. ID. NO. 1244 | 1-MetAspThrSerLys-5 |
| SEQ. ID. NO. 1245 | 16-LysAlaAsnGlyThrThrValArgThrGluLeu-26 |
| SEQ. ID. NO. 1246 | 125-LysValArgGluMetLeu-130 |
| SEQ. ID. NO. 1247 | 279-GlyLysLeuProArgLeuLysArg-286 |
| SEQ. ID. NO. 1248 | 318-AlaGlyGlyArgThr-322 |
| SEQ. ID. NO. 1249 | 364-ArgSerAlaArgAspIleAspTrpAspAspMetThrGlu-376 |
| SEQ. ID. NO. 1250 | 410-LeuCysArgArgThrLysAspValPro-418 |
| 098-2 | |
| AMPHI Regions - AMPHI | |
| SEQ. ID. NO. 1251 | 29-AlaGluAlaGlyAspGlnPheValGlyAsp-38 |
| SEQ. ID. NO. 1252 | 110-ValGlyAspPhePheLysLeuAlaPhe-118 |
| SEQ. ID. NO. 1253 | 120-CysGlnIleGlnAsnValValThrAlaIleAlaGlnIleValAla-134 |
| SEQ. ID. NO. 1254 | 163-LeuSerSerPheSerHisGly-169 |
| Antigenic Index - Jameson-Wolf | |
| SEQ. ID. NO. 1255 | 24-ValGlnGluAspAlaAlaGluAlaGlyAspGlnPheVal-36 |
| SEQ. ID. NO. 1256 | 68-MetGlyMetCysArg-72 |
| SEQ. ID. NO. 1257 | 78-PheAsnHisThrAspArgGlnAlaAla-86 |
| SEQ. ID. NO. 1258 | 136-ThrAlaAsnGlyThrGlnSerGlyIleThrGlyArgAsnAlaArgLysArgAsnGlyPhe-155 |
| SEQ. ID. NO. 1259 | 158-PheGluGlyArgGlyLeuSerSerPheSerHisGlyIle-170 |
| SEQ. ID. NO. 1260 | 180-ValPheArgArgProMetArgIleCys-188 |
| Hydrophilic Regions - Hopp-Woods | |
| SEQ. ID. NO. 1261 | 24-ValGlnGluAspAlaAlaGluAlaGlyAsp-33 |
| SEQ. ID. NO. 1262 | 79-AsnHisThrAspArgGlnAla-85 |
| SEQ. ID. NO. 1263 | 144-IleThrGlyArgAsnAlaArgLysArgAsnGly-154 |
| SEQ. ID. NO. 1264 | 158-PheGluGlyArgGly-162 |
| SEQ. ID. NO. 1265 | 180-ValPheArgArgProMetArg-186 |
| 099 (delete this one--mistaken sequence) | |
| AMPHI Regions - AMPHI | |
| SEQ. ID. NO. 1266 | 6-SerMetMetArgLeuProAspIle-13 |
| SEQ. ID. NO. 1267 | 47-AlaPheValGluPhePheGlyGluGly-55 |
| SEQ. ID. NO. 1268 | 102-LysLeuValGluThrTyrAlaLysThr-110 |
| SEQ. ID. NO. 1269 | 114-TrpAlaAspAlaLeuLysThrAla-121 |
| SEQ. ID. NO. 1270 | 135-ThrArgAsnMetAlaGlyProSerAsn-143 |
| SEQ. ID. NO. 1271 | 154-AlaLysGlyLeuAlaLysProTyrGluGluProSerAspGly-168 |
| SEQ. ID. NO. 1272 | 178-AlaAlaIleThrSerCysThrAsnThrSerAsnProArgAsnVal-192 |
| SEQ. ID. NO. 1273 | 251-ThrCysAsnGlyMetSer-256 |
| SEQ. ID. NO. 1274 | 341-IleAspAlaValValAlaGluTyrValLysProGlnGlnPheArgAspValTyrVal-359 |
| SEQ. ID. NO. 1275 | 371-ProSerProLeuTyrAspTrpArg-378 |
| SEQ. ID. NO. 1276 | 381-SerThrTyrIleArg-385 |
| SEQ. ID. NO. 1277 | 398-ArgThrLeuArgGlyMetArgProLeu-406 |
| SEQ. ID. NO. 1278 | 443-AspPheAsnSerTyrAlaThr-449 |
| SEQ. ID. NO. 1279 | 468-PheAsnGluMetValLys-473 |
| SEQ. ID. NO. 1280 | 494-MetArgMetTrpGluAlaIleGluThrTyrMet-504 |

TABLE 1-continued

| | |
|---|---|
| SEQ. ID. NO. 1281 | 532-ArgLeuAlaGlyVal-536 |
| SEQ. ID. NO. 1282 | 539-IleValAlaGluGlyPheGluArgIleHisArgThrAsn-551 |
| SEQ. ID. NO. 1283 | 575-GlyThrGluThrTyr-579 |
| Antigenic Index - Jameson-Wolf | |
| SEQ. ID. NO. 1284 | 17-GluLeuAsnGlyLysArgGlnAlaGly-25 |
| SEQ. ID. NO. 1285 | 38-PheLeuArgLysGluArgValVal-45 |
| SEQ. ID. NO. 1286 | 53-GlyGluGlyAlaArgSer-58 |
| SEQ. ID. NO. 1287 | 60-SerIleGlyAspArgAlaThr-66 |
| SEQ. ID. NO. 1288 | 70-MetThrProGluPhe-74 |
| SEQ. ID. NO. 1289 | 83-IleAspGluGlnThr-87 |
| SEQ. ID. NO. 1290 | 94-ThrGlyArgAspAspAlaGlnValLysLeu-103 |
| SEQ. ID. NO. 1291 | 133-SerValThrArgAsnMetAlaGlyProSerAsnProHis-145 |
| SEQ. ID. NO. 1292 | 157-GlyLeuAlaLysProTyrGluGluProSerAspGlyGlnMetProAspGly-173 |
| SEQ. ID. NO. 1293 | 183-CysThrAsnThrSerAsnProArgAsnVal-192 |
| SEQ. ID. NO. 1294 | 201-AsnAlaAsnArgLeuGlyLeuLysArgLysProTrpVal-213 |
| SEQ. ID. NO. 1295 | 216-SerPheAlaProGlySerLysValAla-224 |
| SEQ. ID. NO. 1296 | 235-ProGluMetGluLysLeu-240 |
| SEQ. ID. NO. 1297 | 251-ThrCysAsnGlyMetSerGlyAlaLeuAspProLysIleGlnLysGluIleIleAspArgAspLeuTyr-273 |
| SEQ. ID. NO. 1298 | 279-SerGlyAsnArgAsnPheAspGlyArgIleHisProTyrAlaLys-293 |
| SEQ. ID. NO. 1299 | 312-IleArgPheAspIleGluAsnAspVal-320 |
| SEQ. ID. NO. 1300 | 322-GlyValAlaAspGlyLysGluIleArgLeuLysAsp-333 |
| SEQ. ID. NO. 1301 | 335-TrpProAlaAspGluGluIleAspAlaVal-344 |
| SEQ. ID. NO. 1302 | 348-TyrValLysProGlnGlnPheArgAspVal-357 |
| SEQ. ID. NO. 1303 | 363-AspThrGlyThrAlaGlnLysAlaProSerProLeuTyrAspTrpArgProMetSerThrTyrIleArgArgProProTyrTrp-390 |
| SEQ. ID. NO. 1304 | 394-LeuAlaGlyGluArgThrLeuArgGlyMetArg-404 |
| SEQ. ID. NO. 1305 | 409-LeuProAspAsnIleThrThrAspHisLeuSerProSerAsn-422 |
| SEQ. ID. NO. 1306 | 438-GlyLeuProGluGluAspPheAsnSerTyrAlaThrHisArgGlyAspHisLeuThr-456 |
| SEQ. ID. NO. 1307 | 463-AlaAsnProLysLeuPhe-468 |
| SEQ. ID. NO. 1308 | 471-MetValLysAsnGluAspGlySerValArgGlnGlySerPheAlaArgValGluProGluGlyGluThr-493 |
| SEQ. ID. NO. 1309 | 503-TyrMetAsnArgLysGlnPro-509 |
| SEQ. ID. NO. 1310 | 516-AlaAspTyrGlyGlnGlySerSerArgAspTrpAlaAlaLysGlyValArg-532 |
| SEQ. ID. NO. 1311 | 543-GlyPheGluArgIleHisArgThrAsnLeu-552 |
| SEQ. ID. NO. 1312 | 562-PheLysProAspThrAsnArgHis-569 |
| SEQ. ID. NO. 1313 | 571-LeuGlnLeuAspGlyThrGluThrTyrAspValValGlyGluArgThrProArgCysAspLeu-591 |
| SEQ. ID. NO. 1314 | 595-IleHisArgLysAsnGlyGluThrValGlu-604 |
| SEQ. ID. NO. 1315 | 612-AspThrAlaGluGlu-616 |
| Hydrophilic Regions - Hopp-Woods | |
| SEQ. ID. NO. 1316 | 18-LeuAsnGlyLysArgGlnAlaGly-25 |
| SEQ. ID. NO. 1317 | 38-PheLeuArgLysGluArgValVal-45 |
| SEQ. ID. NO. 1318 | 53-GlyGluGlyAlaArg-57 |
| SEQ. ID. NO. 1319 | 60-SerIleGlyAspArgAlaThr-66 |
| SEQ. ID. NO. 1320 | 83-IleAspGluGlnThr-87 |
| SEQ. ID. NO. 1321 | 94-ThrGlyArgAspAspAlaGlnValLysLeu-103 |
| SEQ. ID. NO. 1322 | 157-GlyLeuAlaLysProTyrGluGluProSerAspGlyGlnMetProAsp-172 |
| SEQ. ID. NO. 1323 | 205-LeuGlyLeuLysArgLysProTrpVal-213 |
| SEQ. ID. NO. 1324 | 235-ProGluMetGluLysLeu-240 |
| SEQ. ID. NO. 1325 | 259-LeuAspProLysIleGlnLysGluIleIleAspArgAspLeuTyr-273 |
| SEQ. ID. NO. 1326 | 282-ArgAsnPheAspGlyArgIle-288 |
| SEQ. ID. NO. 1327 | 312-IleArgPheAspIleGluAsnAspVal-320 |
| SEQ. ID. NO. 1328 | 324-AlaAspGlyLysGluIleArgLeuLysAsp-333 |
| SEQ. ID. NO. 1329 | 335-TrpProAlaAspGluGluIleAspAlaVal-344 |
| SEQ. ID. NO. 1330 | 366-ThrAlaGlnLysAlaPro-371 |
| SEQ. ID. NO. 1331 | 394-LeuAlaGlyGluArgThrLeuArgGlyMetArg-404 |
| SEQ. ID. NO. 1332 | 438-GlyLeuProGluGluAspPheAsn-445 |
| SEQ. ID. NO. 1333 | 450-HisArgGlyAspHis-454 |
| SEQ. ID. NO. 1334 | 471-MetValLysAsnGluAspGlySerValArg-480 |
| SEQ. ID. NO. 1335 | 485-AlaArgValGluProGluGlyGluThr-493 |
| SEQ. ID. NO. 1336 | 503-TyrMetAsnArgLysGlnPro-509 |
| SEQ. ID. NO. 1337 | 518-TyrGlyGlnGlySerSerArgAspTrpAlaAlaLysGlyValArg-532 |
| SEQ. ID. NO. 1338 | 543-GlyPheGluArgIleHisArg-549 |
| SEQ. ID. NO. 1339 | 562-PheLysProAspThrAsnArgHis-569 |
| SEQ. ID. NO. 1340 | 574-AspGlyThrGluThr-578 |
| SEQ. ID. NO. 1341 | 580-AspValValGlyGluArgThrProArgCysAsp-590 |
| SEQ. ID. NO. 1342 | 596-HisArgLysAsnGlyGluThrValGlu-604 |
| SEQ. ID. NO. 1343 | 612-AspThrAlaGluGlu-616 |
| 099-2 | |
| AMPHI Regions - AMPHI | |
| SEQ. ID. NO. 1344 | 30-ProGlySerTyrAspLysLeuPro-37 |
| SEQ. ID. NO. 1345 | 57-ProThrLeuGlnSerTrpLeuGlyGln-65 |
| SEQ. ID. NO. 1346 | 91-ThrAlaLeuValAspLeuAlaGlyLeuArgAsp-101 |
| SEQ. ID. NO. 1347 | 106-LysGlyGlyAspProAlaLysValAsn-114 |
| SEQ. ID. NO. 1348 | 138-AlaPheArgLysAsn-142 |
| SEQ. ID. NO. 1349 | 212-AspSerLeuGlyVal-216 |
| SEQ. ID. NO. 1350 | 234-AlaSerMetMetArgLeuProAspIle-242 |
| SEQ. ID. NO. 1351 | 276-AlaPheValGluPhePheGlyGluGly-284 |
| SEQ. ID. NO. 1352 | 331-LysLeuValGluThrTyrAlaLysThr-339 |
| SEQ. ID. NO. 1353 | 343-TrpAlaAspAlaLeuLysThrAla-350 |
| SEQ. ID. NO. 1354 | 364-ThrArgAsnMetAlaGlyProSerAsn-372 |
| SEQ. ID. NO. 1355 | 383-AlaAlaLysGlyLeuAlaLysProTyrGluGluProSerAspGly-397 |
| SEQ. ID. NO. 1356 | 407-AlaAlaIleThrSerCysThrAsnThrSerAsnProArgAsnVal-421 |

TABLE 1-continued

| | |
|---|---|
| SEQ. ID. NO. 1357 | 480-ThrCysAsnGlyMetSer-485 |
| SEQ. ID. NO. 1358 | 570-IleAspAlaValValAlaGluTyrValLysProGlnGlnPheArgAspValTyrVal-588 |
| SEQ. ID. NO. 1359 | 600-ProSerProLeuTyrAspTrpArg-607 |
| SEQ. ID. NO. 1360 | 610-SerThrTyrIleArg-614 |
| SEQ. ID. NO. 1361 | 627-ArgThrLeuArgGlyMetArgProLeu-635 |
| SEQ. ID. NO. 1362 | 672-AspPheAsnSerTyrAlaThr-678 |
| SEQ. ID. NO. 1363 | 697-PheAsnGluMetValLys-702 |
| SEQ. ID. NO. 1364 | 723-MetArgMetTrpGluAlaIleGluThrTyrMet-733 |
| SEQ. ID. NO. 1365 | 761-ArgLeuAlaGlyVal-765 |
| SEQ. ID. NO. 1366 | 768-IleValAlaGluGlyPheGluArgIleHisArgThrAsn-780 |
| SEQ. ID. NO. 1367 | 804-GlyThrGluThrTyr-808 |
| Antigenic Index - Jameson-Wolf | |
| SEQ. ID. NO. 1368 | 3-AlaAsnGlnArgTyrArgLysProLeuProGlyThrAspLeuGluTyrTyrAsp-20 |
| SEQ. ID. NO. 1369 | 22-ArgAlaAlaCysGluAspIleLysProGlySerTyrAspLysLeuProTyr-38 |
| SEQ. ID. NO. 1370 | 47-LeuValAsnArgAlaAspLysValAspLeuPro-57 |
| SEQ. ID. NO. 1371 | 67-IleGluGlyLysGlnGluIle-73 |
| SEQ. ID. NO. 1372 | 97-AlaGlyLeuArgAspAlaIleAlaGluLysGlyGlyAspProAlaLys-112 |
| SEQ. ID. NO. 1373 | 131-CysGlyGlyTyrAspProAspAlaPheArgLysAsnArgGluIleGluAspArgArgAsnGluAspArgPhe-154 |
| SEQ. ID. NO. 1374 | 162-ThrAlaPheGluAsn-166 |
| SEQ. ID. NO. 1375 | 181-AsnLeuGluLysMetSer-186 |
| SEQ. ID. NO. 1376 | 200-ThrCysValGlyThrAspSerHisThrProHisValAspSer-213 |
| SEQ. ID. NO. 1377 | 222-GlyGlyLeuGluAlaGluThr-228 |
| SEQ. ID. NO. 1378 | 246-GluLeuAsnGlyLysArgGlnAlaGly-254 |
| SEQ. ID. NO. 1379 | 267-PheLeuArgLysGluArgValVal-274 |
| SEQ. ID. NO. 1380 | 282-GlyGluGlyAlaArgSer-287 |
| SEQ. ID. NO. 1381 | 289-SerIleGlyAspArgAlaThr-295 |
| SEQ. ID. NO. 1382 | 299-MetThrProGluPhe-303 |
| SEQ. ID. NO. 1383 | 312-IleAspGluGlnThr-316 |
| SEQ. ID. NO. 1384 | 323-ThrGlyArgAspAspAlaGlnValLysLeu-332 |
| SEQ. ID. NO. 1385 | 362-SerValThrArgAsnMetAlaGlyProSerAsnProHis-374 |
| SEQ. ID. NO. 1386 | 386-GlyLeuAlaLysProTyrGluGluProSerAspGlyGlnMetProAspGly-402 |
| SEQ. ID. NO. 1387 | 412-CysThrAsnThrSerAsnProArgAsnVal-421 |
| SEQ. ID. NO. 1388 | 430-AsnAlaAsnArgLeuGlyLeuLysArgLysProTrpVal-442 |
| SEQ. ID. NO. 1389 | 445-SerPheAlaProGlySerLysValAla-453 |
| SEQ. ID. NO. 1390 | 464-ProGluMetGluLysLeu-469 |
| SEQ. ID. NO. 1391 | 480-ThrCysAsnGlyMetSerGlyAlaLeuAspProLysIleGlnLysGluIleIleAspArgAspLeuTyr-502 |
| SEQ. ID. NO. 1392 | 508-SerGlyAsnArgAsnPheAspGlyArgIleHisProTyrAlaLys-522 |
| SEQ. ID. NO. 1393 | 541-IleArgPheAspIleGluAsnAspVal-549 |
| SEQ. ID. NO. 1394 | 551-GlyValAlaAspGlyLysGluIleArgLeuLysAsp-562 |
| SEQ. ID. NO. 1395 | 564-TrpProAlaAspGluGluIleAspAlaVal-573 |
| SEQ. ID. NO. 1396 | 577-TyrValLysProGlnGlnPheArgAspVal-586 |
| SEQ. ID. NO. 1397 | 592-AspThrGlyThrAlaGlnLysAlaProSerProLeuTyrAspTrpArgProMetSerThrTyrIleArgArgProProTyrTrp-619 |
| SEQ. ID. NO. 1398 | 623-LeuAlaGlyGluArgThrLeuArgGlyMetArg-633 |
| SEQ. ID. NO. 1399 | 638-LeuProAspAsnIleThrThrAspHisLeuSerProSerAsn-651 |
| SEQ. ID. NO. 1400 | 667-GlyLeuProGluGluAspPheAsnSerTyrAlaThrHisArgGlyAspHisLeuThr-685 |
| SEQ. ID. NO. 1401 | 692-AlaAsnProLysLeuPro-697 |
| SEQ. ID. NO. 1402 | 700-MetValLysAsnGluAspGlySerValArgGlnGlySerPheAlaArgValGluProGluGlyGluThr-722 |
| SEQ. ID. NO. 1403 | 732-TyrMetAsnArgLysGlnPro-738 |
| SEQ. ID. NO. 1404 | 745-AlaAspTyrGlyGlnGlySerSerArgAspTrpAlaAlaLysGlyValArg-761 |
| SEQ. ID. NO. 1405 | 772-GlyPheGluArgIleHisArgThrAsnLeu-781 |
| SEQ. ID. NO. 1406 | 791-PheLysProAspThrAsnArgHis-798 |
| SEQ. ID. NO. 1407 | 800-LeuGlnLeuAspGlyThrGluThrTyrAspValValGlyGluArgThrProArgCysAspLeu-820 |
| SEQ. ID. NO. 1408 | 824-IleHisArgLysAsnGlyGluThrValGlu-833 |
| SEQ. ID. NO. 1409 | 841-AspThrAlaGluGlu-845 |
| Hydrophilic Regions - Hopp-Woods | |
| SEQ. ID. NO. 1410 | 5-GlnArgTyrArgLysProLeuPro-12 |
| SEQ. ID. NO. 1411 | 22-ArgAlaAlaCysGluAspIleLysProGlySerTyrAsp-34 |
| SEQ. ID. NO. 1412 | 47-LeuValAsnArgAlaAspLysValAspLeu-56 |
| SEQ. ID. NO. 1413 | 67-IleGluGlyLysGlnGluIle-73 |
| SEQ. ID. NO. 1414 | 97-AlaGlyLeuArgAspAlaIleAlaGluLysGlyGlyAspProAlaLys-112 |
| SEQ. ID. NO. 1415 | 132-GlyGlyTyrAspProAspAlaPheArgLysAsnArgGluIleGluAspArgArgAsnGluAspArgPhe-154 |
| SEQ. ID. NO. 1416 | 181-AsnLeuGluLysMetSer-186 |
| SEQ. ID. NO. 1417 | 205-AspSerHisThrProHis-210 |
| SEQ. ID. NO. 1418 | 224-LeuGluAlaGluThr-228 |
| SEQ. ID. NO. 1419 | 247-LeuAsnGlyLysArgGlnAlaGly-254 |
| SEQ. ID. NO. 1420 | 267-PheLeuArgLysGluArgValVal-274 |
| SEQ. ID. NO. 1421 | 282-GlyGluGlyAlaArg-286 |
| SEQ. ID. NO. 1422 | 289-SerIleGlyAspArgAlaThr-295 |
| SEQ. ID. NO. 1423 | 312-IleAspGluGlnThr-316 |
| SEQ. ID. NO. 1424 | 323-ThrGlyArgAspAspAlaGlnValLysLeu-332 |
| SEQ. ID. NO. 1425 | 386-GlyLeuAlaLysProTyrGluGluProSerAspGlyGlnMetProAsp-401 |
| SEQ. ID. NO. 1426 | 434-LeuGlyLeuLysArgLysProTrpVal-442 |
| SEQ. ID. NO. 1427 | 464-ProGluMetGluLysLeu-469 |
| SEQ. ID. NO. 1428 | 488-LeuAspProLysIleGlnLysGluIleIleAspArgAspLeuTyr-502 |
| SEQ. ID. NO. 1429 | 511-ArgAsnPheAspGlyArgIle-517 |
| SEQ. ID. NO. 1430 | 541-IleArgPheAspIleGluAsnAspVal-549 |
| SEQ. ID. NO. 1431 | 553-AlaAspGlyLysGluIleArgLeuLysAsp-562 |
| SEQ. ID. NO. 1432 | 564-TrpProAlaAspGluGluIleAspAlaVal-573 |
| SEQ. ID. NO. 1433 | 595-ThrAlaGlnLysAlaPro-600 |
| SEQ. ID. NO. 1434 | 623-LeuAlaGlyGluArgThrLeuArgGlyMetArg-633 |

TABLE 1-continued

| SEQ. ID. NO. | Sequence |
|---|---|
| SEQ. ID. NO. 1435 | 667-GlyLeuProGluGluAspPheAsn-674 |
| SEQ. ID. NO. 1436 | 679-HisArgGlyAspHisLeuThr-685 |
| SEQ. ID. NO. 1437 | 700-MetValLysAsnGluAspGlySerValArg-709 |
| SEQ. ID. NO. 1438 | 714-AlaArgValGluProGluGlyGluThr-722 |
| SEQ. ID. NO. 1439 | 732-TyrMetAsnArgLysGlnPro-738 |
| SEQ. ID. NO. 1440 | 747-TyrGlyGlnGlySerSerArgAspTrpAlaAlaLysGlyValArg-761 |
| SEQ. ID. NO. 1441 | 772-GlyPheGluArgIleHisArg-778 |
| SEQ. ID. NO. 1442 | 791-PheLysProAspThrAsnArgHis-798 |
| SEQ. ID. NO. 1443 | 803-AspGlyThrGluThr-807 |
| SEQ. ID. NO. 1444 | 809-AspValValGlyGluArgThrProArgCysAsp-819 |
| SEQ. ID. NO. 1445 | 824-IleHisArgLysAsnGlyGluThrValGlu-833 |
| SEQ. ID. NO. 1446 | 841-AspThrAlaGluGlu-845 |

102
AMPHI Regions - AMPHI

| SEQ. ID. NO. | Sequence |
|---|---|
| SEQ. ID. NO. 1447 | 42-ValLeuLeuTyrThrTrpPheSerMetLeu-51 |
| SEQ. ID. NO. 1448 | 67-GlyAlaSerPheAspThrMetValLysAspLeuLeuGlyArgGlyTrpAsnIleIleAsnGlyIleAla-89 |
| SEQ. ID. NO. 1449 | 109-ThrAlaLysGlyLeuGlySerAlaAla-117 |
| SEQ. ID. NO. 1450 | 128-LeuValPhePheGlyIleLeuAlaPheCys-137 |
| SEQ. ID. NO. 1451 | 144-LeuValAspArgPheThrGlyValLeu-152 |
| SEQ. ID. NO. 1452 | 155-GlyMetValLeuThr-159 |
| SEQ. ID. NO. 1453 | 207-AsnValSerSerLeuLeuLysTyrPheLys-216 |
| SEQ. ID. NO. 1454 | 221-LysValAlaLysSerIle-226 |
| SEQ. ID. NO. 1455 | 265-ValLeuIleGluThrLeuSerLysPheAlaGlnThrGlyAsnMetAspLysIleLeuSerLeuPheSerTyrMetAla-290 |
| SEQ. ID. NO. 1456 | 303-PheAspTyrIleAlaAspIlePheLysTrpAsnAsp-314 |
| SEQ. ID. NO. 1457 | 341-PheValThrAlaIleGlyTyr-347 |
| SEQ. ID. NO. 1458 | 352-AlaThrValTrpThrGlyIleIlePro-360 |
| SEQ. ID. NO. 1459 | 374-GlyLysThrTyrLysVal-379 |

Antigenic Index - Jameson-Wolf

| SEQ. ID. NO. | Sequence |
|---|---|
| SEQ. ID. NO. 1460 | 1-MetProAsnLysThrProSer-7 |
| SEQ. ID. NO. 1461 | 64-TyrProHisGlyAla-68 |
| SEQ. ID. NO. 1462 | 77-LeuLeuGlyArgGly-81 |
| SEQ. ID. NO. 1463 | 107-AspLeuThrAlaLysGlyLeuGlySerAlaAlaGlyGly-119 |
| SEQ. ID. NO. 1464 | 169-AlaAspAlaLysProSerVal-175 |
| SEQ. ID. NO. 1465 | 179-ThrGlnAlaProAlaGlyThr-185 |
| SEQ. ID. NO. 1466 | 214-TyrPheLysGlyAspAlaProLysValAla-223 |
| SEQ. ID. NO. 1467 | 246-GlyAsnLeuProArgAsnGluPhe-253 |
| SEQ. ID. NO. 1468 | 274-AlaGlnThrGlyAsnMetAspLysIle-282 |
| SEQ. ID. NO. 1469 | 311-LysTrpAsnAspSerIleSerGlyArgThrLysThr-322 |
| SEQ. ID. NO. 1470 | 364-LeuTyrArgSerArgLysLysPheGlyAlaGlyLysThrTyrLysVal-379 |

Hydrophilic Regions - Hopp-Woods

| SEQ. ID. NO. | Sequence |
|---|---|
| SEQ. ID. NO. 1471 | 1-MetProAsnLysThr-5 |
| SEQ. ID. NO. 1472 | 169-AlaAspAlaLysPro-173 |
| SEQ. ID. NO. 1473 | 215-PheLysGlyAspAlaProLysValAla-223 |
| SEQ. ID. NO. 1474 | 248-LeuProArgAsnGluPhe-253 |
| SEQ. ID. NO. 1475 | 277-GlyAsnMetAspLys-281 |
| SEQ. ID. NO. 1476 | 316-IleSerGlyArgThrLysThr-322 |
| SEQ. ID. NO. 1477 | 366-ArgSerArgLysLysPheGlyAla-373 |

105-2
AMPHI Regions - AMPHI

| SEQ. ID. NO. | Sequence |
|---|---|
| SEQ. ID. NO. 1478 | 11-TrpIleGlyLeuGly-15 |
| SEQ. ID. NO. 1479 | 22-ValThrArgLeuLeuAsp-27 |
| SEQ. ID. NO. 1480 | 51-LysValTyrGlyAsnThrAlaGluLeu-59 |
| SEQ. ID. NO. 1481 | 74-AlaAlaValCysAspIleLeuAsnGlyValArgAspGlyLeu-87 |
| SEQ. ID. NO. 1482 | 97-ThrIleSerProThr-101 |
| SEQ. ID. NO. 1483 | 110-ValGluAlaAlaGlyGlyGlnPheAlaGluAlaProVal-122 |
| SEQ. ID. NO. 1484 | 143-AlaValLeuAsnProLeuGlnLysIlePheSer-153 |
| SEQ. ID. NO. 1485 | 162-PheGlyAspValGlyLysGlySer-169 |
| SEQ. ID. NO. 1486 | 176-AsnSerLeuLeuGlyIlePheGlyGluAlaTyr-186 |
| SEQ. ID. NO. 1487 | 203-IleValGluAlaIleGlyXxxSerAla-211 |
| SEQ. ID. NO. 1488 | 249-LeuGluGlnAlaGlyAsnThrLeuProAlaValGlu-260 |
| SEQ. ID. NO. 1489 | 263-AlaAlaSerTyrArgLysAlaValGluAla-272 |

Antigenic Index - Jameson-Wolf

| SEQ. ID. NO. | Sequence |
|---|---|
| SEQ. ID. NO. 1490 | 25-LeuLeuAspGlyGlyIleGlu-31 |
| SEQ. ID. NO. 1491 | 34-ValTyrAsnArgSerProAspLysThrAlaProIleSerAlaLysGlyAlaLysValTyrGlyAsnThr-56 |
| SEQ. ID. NO. 1492 | 81-AsnGlyValArgAspGlyLeuAla-88 |
| SEQ. ID. NO. 1493 | 96-SerThrIleSerProThrGluAsnLeuAla-105 |
| SEQ. ID. NO. 1494 | 121-ProValSerGlySerValGlyProAlaThr-130 |
| SEQ. ID. NO. 1495 | 139-GlyGlySerGluAla-143 |
| SEQ. ID. NO. 1496 | 155-ValGlyLysLysThrPheHisPheGlyAspValGlyLysGlySerGly-170 |
| SEQ. ID. NO. 1497 | 196-PheGlyIleAspThrAspThrIleVal-204 |
| SEQ. ID. NO. 1498 | 211-AlaMetAlaSerProMetPheGlnThrLysLysSerLeuTrpAlaAsnArgGluPheProPro-231 |
| SEQ. ID. NO. 1499 | 237-HisAlaSerLysAspLeuAsnLeuAlaValLysGluLeuGluGlnAlaGlyAsnThrLeuPro-257 |
| SEQ. ID. NO. 1500 | 264-AlaSerTyrArgLysAlaValGluAlaGlyTyrGlyGluGlnAspValSerGly-281 |

Hydrophilic Regions - Hopp-Woods

| SEQ. ID. NO. | Sequence |
|---|---|
| SEQ. ID. NO. 1501 | 25-LeuLeuAspGlyGlyIle-30 |
| SEQ. ID. NO. 1502 | 37-ArgSerProAspLysThrAlaProIleSerAlaLysGlyAlaLys-51 |
| SEQ. ID. NO. 1503 | 81-AsnGlyValArgAspGlyLeuAla-88 |
| SEQ. ID. NO. 1504 | 164-AspValGlyLysGlySerGly-170 |
| SEQ. ID. NO. 1505 | 196-PheGlyIleAspThrAspThrIle-203 |
| SEQ. ID. NO. 1506 | 218-GlnThrLysLysSerLeuTrpAla-225 |

TABLE 1-continued

| | |
|---|---|
| SEQ. ID. NO. 1507 | 237-HisAlaSerLysAspLeuAsnLeuAlaValLysGluLeuGluGlnAlaGly-253 |
| SEQ. ID. NO. 1508 | 265-SerTyrArgLysAlaValGlu-271 |
| SEQ. ID. NO. 1509 | 273-GlyTyrGlyGluGlnAspVal-279 |
| 109-2 | |
| AMPHI Regions - AMPHI | |
| SEQ. ID. NO. 1510 | 6-GlyThrTyrArgAspLeuHisArgProAlaSerGlu-17 |
| SEQ. ID. NO. 1511 | 53-LeuIleProAlaMetAlaGlyThrIleGly-62 |
| SEQ. ID. NO. 1512 | 69-AlaValAlaAlaAlaPhe-74 |
| SEQ. ID. NO. 1513 | 145-GlyLeuLeuMetAla-149 |
| SEQ. ID. NO. 1514 | 156-IleMetAlaLysLeuThrSer-162 |
| SEQ. ID. NO. 1515 | 177-GlyThrThrGlyGlnValLysLysLeuPheSerTrpAlaGly-190 |
| SEQ. ID. NO. 1516 | 207-ValMetTyrAlaLeuLeuGluHisTrpLysLysArgTrpLeu-220 |
| SEQ. ID. NO. 1517 | 222-ValProLeuGlyCysLeuIleAla-229 |
| SEQ. ID. NO. 1518 | 294-HisGlnValPheGlnLysIle-300 |
| SEQ. ID. NO. 1519 | 326-ValGlySerIleLeuGly-331 |
| SEQ. ID. NO. 1520 | 336-ThrSerSerTrpGlyThr-341 |
| SEQ. ID. NO. 1521 | 471-AlaValAlaGlyMetLeuProGlyIleProProPheLeuGluHisPheLysSerLeu-488 |
| Antigenic Index - Jameson-Wolf | |
| SEQ. ID. NO. 1522 | 1-MetGluLysHisAsnGlyThrTyrArgAspLeuHisArgProAlaSer-16 |
| SEQ. ID. NO. 1523 | 18-PheAlaThrArgAspGluTyrLeuGlu-26 |
| SEQ. ID. NO. 1524 | 32-MetGlnProLysArgTrpArgProAsnLeuProPheArgAspTyrArgPheGluTrp-50 |
| SEQ. ID. NO. 1525 | 78-LeuGlyLeuProAsp-82 |
| SEQ. ID. NO. 1526 | 109-ProGlyAlaAsnLeuProGlyThrHis-117 |
| SEQ. ID. NO. 1527 | 160-LeuThrSerAsnGlyVal-165 |
| SEQ. ID. NO. 1528 | 179-ThrGlyGlnValLysLys-184 |
| SEQ. ID. NO. 1529 | 259-GluAsnSerGlyTrp-263 |
| SEQ. ID. NO. 1530 | 301-SerTyrProGluLysThrAspLysVal-309 |
| SEQ. ID. NO. 1531 | 312-AsnIleAspAspThrMetThr-318 |
| SEQ. ID. NO. 1532 | 348-IleAlaLysArgProIleProGlyGly-356 |
| SEQ. ID. NO. 1533 | 398-AlaGlyMetGluMetThrArgLysGlyLysThrThrGln-410 |
| SEQ. ID. NO. 1534 | 441-GlyCysLysGluArgSerAla-447 |
| Hydrophilic Regions - Hopp-Woods | |
| SEQ. ID. NO. 1535 | 1-MetGluLysHisAsnGlyThrTyrArgAspLeuHisArgProAlaSer-16 |
| SEQ. ID. NO. 1536 | 18-PheAlaThrArgAspGluTyrLeuGlu-26 |
| SEQ. ID. NO. 1537 | 35-LysArgTrpArgPro-39 |
| SEQ. ID. NO. 1538 | 44-ArgAspTyrArgPheGluTrp-50 |
| SEQ. ID. NO. 1539 | 180-GlyGlnValLysLys-184 |
| SEQ. ID. NO. 1540 | 301-SerTyrProGluLysThrAspLysVal-309 |
| SEQ. ID. NO. 1541 | 313-IleAspAspThrMetThr-318 |
| SEQ. ID. NO. 1542 | 348-IleAlaLysArgProIlePro-354 |
| SEQ. ID. NO. 1543 | 398-AlaGlyMetGluMetThrArgLysGlyLysThrThrGln-410 |
| SEQ. ID. NO. 1544 | 441-GlyCysLysGluArgSerAla-447 |
| 111-2 | |
| AMPHI Regions - AMPHI | |
| SEQ. ID. NO. 1545 | 6-ArgLeuProAsnPheIleArgVal-13 |
| SEQ. ID. NO. 1546 | 27-SerGluGlnThrTyrThrValLys-48 |
| SEQ. ID. NO. 1547 | 58-ProSerProAlaGluIleGlnLysArgIleAspAspAlaLeuLysGluValAsnArgGlnMetSerPheAsnGlnHisThrAlaGlyLeuArgIleSer-102 |
| SEQ. ID. NO. 1548 | 128-GlyProLeuValAsnLeuTrp-134 |
| SEQ. ID. NO. 1549 | 151-IleLysGlnAlaAlaSerTyrThrGlyAspTyrAlaSerLeu-174 |
| SEQ. ID. NO. 1550 | 183-LeuAspLeuSerSerIleAlaLys-190 |
| SEQ. ID. NO. 1551 | 198-AlaGlyGluTyrLeuValGluIleGlyGly-215 |
| SEQ. ID. NO. 1552 | 237-AsnIleValGlnLeuSerHisIle-276 |
| SEQ. ID. NO. 1553 | 314-GluThrGluAlaLeu-318 |
| Antigenic Index - Jameson-Wolf | |
| SEQ. ID. NO. 1554 | 1-MetProSerGluThrArgLeuProAsnPhe-10 |
| SEQ. ID. NO. 1555 | CysSerGluGlnThrAla-31 |
| SEQ. ID. NO. 1556 | 37-GlnGlyGluThrMetGlyTyr-45 |
| SEQ. ID. NO. 1557 | 49-TyrLeuSerAsnAsnArgAspLysLeuProSerProAlaGluIleGlnLysArgIleAspAspAlaLeuLysGluValAsnArgGlnMetSerThrTyrGln ProAspSerGluIleSerArgPheAsnGlnHisThrAlaGlyLysProLeuArgIleSerSerAspPhe-105 |
| SEQ. ID. NO. 1558 | 111-GluAlaValArgLeuAsnArg-117 |
| SEQ. ID. NO. 1559 | GlyPheGlyProAspLysSerValThrArgGluProSerProGluGlnIleLysGlnThrGly-159 |
| SEQ. ID. NO. 1560 | 163-IleIleLeuLysGlnGlyLysAspTyrAlaSerLeuSerLysThrHisProLysAla-181 |
| SEQ. ID. NO. 1561 | 187-SerPheGlyValAspLysValAlaGlyGluLeuGluLysTyrGly-205 |
| SEQ. ID. NO. 1562 | 213-IleGlyGlyGluLeuHisGlyLysGlyLysAsnAlaArgGlyGluProTrpArgIleGlyIleGlnProAsnIle-238 |
| SEQ. ID. NO. 1563 | 240-GlnGlyGlyAsnLeuAsnAsnArgSerLeuAlaThrSerGlyAspTyrArg-262 |
| SEQ. ID. NO. 1564 | 264-PheHisValAspLysAsnGlyLysArgLeuSerIleAsnProAsnAsnLysArgProIleSerAlaMetThrAlaAspGlyLeuSer-306 |
| SEQ. ID. NO. 1565 | 314-GluThrGluAlaLeuLeuAlaGluArgGluLysLeu-326 |
| SEQ. ID. NO. 1566 | 332-ValArgAspLysGlyGlyTyrArgMetSerSerGluPheGluLysLeuLeuArg-351 |
| Hydrophilic Regions - Hopp-Woods | |
| SEQ. ID. NO. 1567 | 1-MetProSerGluThrArgLeu-7 |
| SEQ. ID. NO. 1568 | 26-CysSerGluGlnThrAlaThrMet-41 |
| SEQ. ID. NO. 1569 | 51-SerAsnAsnArgAspLysLeuProSer-59 |
| SEQ. ID. NO. 1570 | 61-AlaGluIleGlnLysArgIleAspAspAlaLeuLysGluValAsnArgGlnGlnProAspSerGluIleSerArg-89 |
| SEQ. ID. NO. 1571 | 97-LysProLeuArgIleSerSer-103 |
| SEQ. ID. NO. 1572 | 111-GluAlaValArgLeuAsnArg-117 |
| SEQ. ID. NO. 1573 | 137-GlyProAspLysSerValThrArgGluProSerProGluGlnIleLysGln-153 |
| SEQ. ID. NO. 1574 | 163-IleIleLeuLysGlnGlyLysAspTyrAlaSer-173 |
| SEQ. ID. NO. 1575 | 175-SerLysThrHisPro-179 |
| SEQ. ID. NO. 1576 | 196-LysValAlaGlyGluLeuGluLysTyrGly-205 |
| SEQ. ID. NO. 1577 | 217-LeuHisGlyLysGlyLysAsnAlaArgGlyGluProTrp-229 |

TABLE 1-continued

| | |
|---|---|
| SEQ. ID. NO. 1578 | 267-AspLysAsnGlyLysArgLeuSerProAsnAsnLysArgProIle-285 |
| SEQ. ID. NO. 1579 | 299-AlaMetThrGlyLeuGluThrGluAlaLeuLysLeuAlaGluArgGluLysLeu-326 |
| SEQ. ID. NO. 1580 | 332-ValArgAspLysGlyGlyTyr-338 |
| SEQ. ID. NO. 1581 | 344-SerGluPheGluLysLeuLeuArg-351 |
| 117-1 | |
| AMPHI Regions - AMPHI | |
| SEQ. ID. NO. 1582 | 6-ProIleGlnAspThrGlnSerAla-13 |
| SEQ. ID. NO. 1583 | 15-LeuGlnGluLeuArgGluTrpPheAspSerTyrCysAlaThrPro-55 |
| SEQ. ID. NO. 1584 | 57-GlyGluProLeuProAspHisHisGluLeuAspLeuLeu-77 |
| SEQ. ID. NO. 1585 | 79-AspAlaValAlaAlaThrLeuLeuAlaAspIleGlyArgTyr-92 |
| SEQ. ID. NO. 1586 | 94-ProAspTrpLeuValSerCysAsnSerThrValAlaGluLeuValLysGlyValAspGluValGlnLysLeuThrHisPheAlaArgValAspSerLeuGlnAlaGluThrLysMetLeuLeuAlaMet-150 |
| SEQ. ID. NO. 1587 | 170-PheLeuSerAsnAlaProAspSerProGluLysAspIlePhe-191 |
| SEQ. ID. NO. 1588 | 216-LysProGluLysTyrArgArgLeuGluTyrIleGluAsnPheLeuAsnIleLeuArg-246 |
| SEQ. ID. NO. 1589 | 260-GlyArgProLysHisIleTyrSerIleTyrLys-270 |
| SEQ. ID. NO. 1590 | 282-LeuPheAspIleArg-286 |
| SEQ. ID. NO. 1591 | 290-IleLeuValAspThrValProGluCysTyrThrThrLeuGlyIleValHisSerLeuTrpGlnProIleProGlyGluPheAspAspTyrIleAla-321 |
| SEQ. ID. NO. 1592 | 327-GlyTyrLysSerLeuHisThr-333 |
| SEQ. ID. NO. 1593 | 351-AspMetHisGlnPheAsnGluPheGlyValAla-361 |
| SEQ. ID. NO. 1594 | 385-GlnLeuLeuAspTrp-389 |
| SEQ. ID. NO. 1595 | 412-AspThrHisGlyLysValHisSerSerIleGlyAspArgLeuGluAsn-465 |
| SEQ. ID. NO. 1596 | 485-TyrGluLysAlaIleGlyLysIleArgAlaTyrGlnGlnAsnAlaAsp-508 |
| SEQ. ID. NO. 1597 | 510-ValArgGluGlnLeuAlaLysLeuGlnGluLeuAlaGluGlyTyrLysLysProGluAspLeuTyrThrAsnArgAlaIleGlnLysAlaCysGlyThrLeuAsnGluProPro-571 |
| SEQ. ID. NO. 1598 | 585-LysIleLysLysGlyGlyMetThrThrLeuAlaLysCysCysLysProAlaAspAspIleIleGly-620 |
| SEQ. ID. NO. 1599 | 636-ProSerPheGlnHisLeuAlaGluHisAlaProGluLysValLeuAspAlaLeuGlnGlu-659 |
| SEQ. ID. NO. 1600 | 679-ArgAspValSerAspAla-684 |
| SEQ. ID. NO. 1601 | 714-GlnValAsnAspLeuProArgValLeuAlaSerLeuGlyAspValLysGlyValLeuSerValThrArg-736 |
| Antigenic Index - Jameson-Wolf | |
| SEQ. ID. NO. 1602 | 5-SerProIleGlnAspThrGlnSerAlaThr-14 |
| SEQ. ID. NO. 1603 | 16-GlnGluLeuArgGluTrpPheAspSerTyrCysAlaAlaLeuProAspAsnAspLysAsnLeuHisTyrProAla-50 |
| SEQ. ID. NO. 1604 | 52-AlaAlaThrProTyrGlyGluProLeuProAspHisPhe-64 |
| SEQ. ID. NO. 1605 | 72-HisAspLeuLeuPro-78 |
| SEQ. ID. NO. 1606 | 88-AspIleGlyArgTyrValProAspTrp-96 |
| SEQ. ID. NO. 1607 | 100-ValSerGluArgCysAsnSerThrVal-108 |
| SEQ. ID. NO. 1608 | 110-GluLeuValLysGlyValAspGluValGlnLysHis-123 |
| SEQ. ID. NO. 1609 | 125-AlaArgValAspSerLeuAlaThrProGluGluArgAlaGlnGlnAlaGluThrMetArg-144 |
| SEQ. ID. NO. 1610 | 162-AlaMetArgThrArgThr-167 |
| SEQ. ID. NO. 1611 | 173-AsnAlaProAspSerProGluLysArgAlaValAlaLysGluThrLeu-188 |
| SEQ. ID. NO. 1612 | 209-AspLeuGlyPheArgHisGlnLysProGluLysTyrArgGluLeuAspGluLysArgThrGluArgLeuGluTyr-237 |
| SEQ. ID. NO. 1613 | 245-LeuArgGlyGluLeuLysLysTyrAsnValAlaGlyArgProLysHisLysMetValLysLysLysLeuSerPhe-279 |
| SEQ. ID. NO. 1614 | 283-PheArgAlaThrValProGluCysTyr-299 |
| SEQ. ID. NO. 1615 | 311-ProIleProGlyGluPheAspAspTyrIleAlaAsnProLysGlyAsnGlyTyrLysSerIleValGlyProGluAspLysGlyValGluValGlnIleArgThr-349 |
| SEQ. ID. NO. 1616 | 356-AsnGlyTrpArgTyrLysGluGlyGlyLysGlyAspSerAlaTyrGluGlnLys-379 |
| SEQ. ID. NO. 1617 | 387-LeuAspTrpArgGluAsnMetAlaGluSerGlyLysGluAspLeuAlaAla-403 |
| SEQ. ID. NO. 1618 | 418-ThrProHisGlyLysProThrGly-429 |
| SEQ. ID. NO. 1619 | 440-HisSerSerIleGlyAspArgCysArgGlyAlaLysValGluGlyThrProLeuGluAsnGlyGlnArgValGluIleIleThrAlaLysGluGlyHisProSerValAsnGlyTrpValLysSerAsnLysAlaIleGlyLysAla-500 |
| SEQ. ID. NO. 1620 | 502-IleArgGlnGlnAsnAlaAspThrValArgGluGluGlyArgValGlnLeuAspLysGlnLeuAla-523 |
| SEQ. ID. NO. 1621 | 525-LeuThrProLysProAsnLeuGlnGluLeuAlaGlu-536 |
| SEQ. ID. NO. 1622 | 538-LeuGlyTyrLysLysProGluAspLeuGlyGlnGlyGluIleSerAsnArgAlaIleGlnLysAlaCysGlyThrLeuAsnGluProProValPro-574 |
| SEQ. ID. NO. 1623 | 582-LysGlnSerLysIleLysLysGlyGlyLysAsnGlyVal-594 |
| SEQ. ID. NO. 1624 | 596-IleAspGlyGluAspGlyLeu-602 |
| SEQ. ID. NO. 1625 | 608-LysCysCysLysProAlaProAspAspIleIleValThrArgGluArgGlyIleSerValHisArgLysThrCysProSerPhe-638 |
| SEQ. ID. NO. 1626 | 644-HisAlaProGluLysValLeuAspGlnIleGluIleArgAlaGlnAspArgSerGlyLeuLeuArgAspValSerAspAlaLeuAlaArgHisLysLeu-690 |
| SEQ. ID. NO. 1627 | 696-GlnThrGlnSerArgAspLeuGluGluAlaSerMet-706 |
| SEQ. ID. NO. 1628 | 710-LeuGluValLysGlnValAsnAspLeuProArg-720 |
| SEQ. ID. NO. 1629 | 726-GlyAspValLysGly-730 |
| Hydrophilic Regions - Hopp-Woods | |
| SEQ. ID. NO. 1630 | 8-GlnAspThrGlnSer-12 |
| SEQ. ID. NO. 1631 | 16-GlnGluLeuArgGluTrpPhe-22 |
| SEQ. ID. NO. 1632 | 30-ProAspAsnAspLysAsnLeu-36 |
| SEQ. ID. NO. 1633 | 48-TyrProAlaProLeuProHisAspLeuLeuPro-78 |
| SEQ. ID. NO. 1634 | 100-ValSerGluArgCysAsnSerThrGluLeuValLysGlyValAspGluValGlnLysHis-123 |
| SEQ. ID. NO. 1635 | 125-AlaArgValAspSer-129 |
| SEQ. ID. NO. 1636 | 131-AlaThrProGluGluArgAlaGlnGlnAlaGluThrMetArg-144 |
| SEQ. ID. NO. 1637 | 162-AlaMetArgThrArgThrAlaProAspSerProGluLysArgAlaValAlaLysGluThrLeu-188 |
| SEQ. ID. NO. 1638 | 209-AspLeuGlyPheArgHisGlnLysProGluLysTyrArgGluLeuAspGluLysArgThrGluArgLeuGluTyr-237 |
| SEQ. ID. NO. 1639 | 245-LeuArgGlyGluLeuLysLysTyr-252 |
| SEQ. ID. NO. 1640 | 258-ValAlaGlyArgLysHisLysMetValLysLysLysLeuSerPhe-279 |
| SEQ. ID. NO. 1641 | 283-PheArgAlaThrValPro-296 |
| SEQ. ID. NO. 1642 | 314-GlyGluPheAspAsp-318 |
| SEQ. ID. NO. 1643 | 323-ProLysGlyAsnGly-327 |
| SEQ. ID. NO. 1644 | 337-GlyProGluAspLysGlyValGluValGlnIleArgThr-349 |
| SEQ. ID. NO. 1645 | 351-AspGlnArgTyrLysGluGlyGlyLysGlyGlyAspSerAlaTyrGluGlnLeuAspTrpArgGluAsnMetAlaGluSerGlyLysGluAspLeuAlaAla-403 |
| SEQ. ID. NO. 1646 | 405-PheLysLeuPheIleGlyAspArgCysArgGlyAlaLysValGluGlyLeuGluAsnGlyGlnArgValGluIleIleThrAlaLysGluGlyHisPro-479 |
| SEQ. ID. NO. 1647 | 489-ValLysSerAsnLysAlaIleGlyLysAla-500 |

TABLE 1-continued

| | |
|---|---|
| SEQ. ID. NO. 1648 | 502-IleGlnAsnAlaAspThrValArgGluGluGlyArgValGlnLeuAspLysGlnLeuAla-523 |
| SEQ. ID. NO. 1649 | 538-LeuGlyTyrLysLysProGluAspLeuGly-551 |
| SEQ. ID. NO. 1650 | 553-GlyGluIleSerAsn-557 |
| SEQ. ID. NO. 1651 | 582-LysGlnSerLysIleLysLysGlyGlyLysVal-594 |
| SEQ. ID. NO. 1652 | 596-IleAspGlyGluAspGlyLeu-602 |
| SEQ. ID. NO. 1653 | 608-LysCysCysLysProAlaProProAspAsp-617 |
| SEQ. ID. NO. 1654 | 623-ThrArgGluArgGlyIleSerValHisArgLysThrCysHisAlaProGluLysValLeu-650 |
| SEQ. ID. NO. 1655 | 658-GlnIleGluIleArgAlaGlnAspArgSerGlyLeuLeuArgAspValSerAspAlaLeuAlaArgHisLysLeuThrGlnSerArgAspLeuGlu AlaSerMet-706 |
| SEQ. ID. NO. 1656 | 710-LeuGluValLysGlnValAsnAspLeuProArg-720 |
| SEQ. ID. NO. 1657 | 726-GlyAspValLysGly-730 |
| 118-2 | |
| AMPHI Regions - AMPHI | |
| SEQ. ID. NO. 1658 | 11-ArgArgAsnIleGlyLysTrpTyrAsp-31 |
| SEQ. ID. NO. 1659 | 61-ProArgTyrIleGlyThrIleIleAspPheLeuMetValProAsn-79 |
| SEQ. ID. NO. 1660 | 102-GluArgLeuLysThrMetLeuArg-109 |
| Antigenic Index - Jameson-Wolf | |
| SEQ. ID. NO. 1661 | 8-LysAsnPheArgArgAsnIleThrCysPheGluGlyTyrAspGluAsnSerPhe-25 |
| SEQ. ID. NO. 1662 | 27-GlyLysTrpTyrAspAspGlyValTrpAspAspGluGluTyrTrpLysLeuGluAsnAspLeuIleGluValArgLysLysTyrProTyrPro MetAspIle-60 |
| SEQ. ID. NO. 1663 | 93-AspSerValGlyIleAsnGluArgTyrGluArgLeuLysThr-106 |
| SEQ. ID. NO. 1664 | 112-PheThrGluLysAspIleValAspTyrTyrAsnLysLys-128 |
| Hydrophilic Regions - Hopp-Woods | |
| SEQ. ID. NO. 1665 | 8-LysAsnPheArgArgAsnIleThr-15 |
| SEQ. ID. NO. 1666 | 33-GlyValTrpAspAspGluGluTyrTrpLysLeuGluAsnAspLeuIleGluValArgLysLysTyrProTyrAspIle-60 |
| SEQ. ID. NO. 1667 | 95-ValGlyIleAsnGluArgTyrGluArgLeuLysThr-106 |
| SEQ. ID. NO. 1668 | 112-PheThrGluLysAspIleVal-118 |
| 120-2 | |
| AMPHI Regions - AMPHI | |
| SEQ. ID. NO. 1669 | 6-LysAsnIlePheSerAla-11 |
| SEQ. ID. NO. 1670 | 49-SerGlyAsnAlaTyrLysIleValSerThrIleLys-60 |
| SEQ. ID. NO. 1671 | 77-AsnThrLeuHisProThrTyrTyrArgAspIleArgArg-89 |
| SEQ. ID. NO. 1672 | 142-IleThrAsnGlyLysLysLeuTyrSerValGlyGlyLeuAsnLysAlaGly-158 |
| SEQ. ID. NO. 1673 | 189-ProSerLeuAsnAsnIleProAla-196 |
| Antigenic Index - Jameson-Wolf | |
| SEQ. ID. NO. 1674 | 3-LysThrPheLys-6 |
| SEQ. ID. NO. 1675 | 35-SerGlySerTyrGly-39 |
| SEQ. ID. NO. 1676 | 45-ThrPheGluArgSerGlyAsnAlaTyrLys-54 |
| SEQ. ID. NO. 1677 | 68-PheGluSerGlyGlyThrValVal-75 |
| SEQ. ID. NO. 1678 | 85-ArgAspIleArgArgGlyLysLeuTyrAlaGlu-95 |
| SEQ. ID. NO. 1679 | 97-LysPheAlaAspGlySerValThrTyrGlyLysAlaGlyGluSerLysThrGluGlnSerProLysAla-119 |
| SEQ. ID. NO. 1680 | 131-AlaAsnAspAlaLysLeuProProGlyLeuLysIleThrAsnGlyLysLysLeuTyrSer-150 |
| SEQ. ID. NO. 1681 | 153-GlyLeuAsnLysAlaGlyThrGlyLysTyrSerIleGlyGlyValGluThrGluValValLysTyrArgValArgArgGlyAspAspAlaVal-183 |
| SEQ. ID. NO. 1682 | 199-GlyTyrThrAspAspGlyLysThrTyr-207 |
| SEQ. ID. NO. 1683 | 218-GlyGlnAlaAlaLysPro-223 |
| Hydrophilic Regions - Hopp-Woods | |
| SEQ. ID. NO. 1684 | 45-ThrPheGluArgSerGlyAsn-51 |
| SEQ. ID. NO. 1685 | 85-ArgAspIleArgArgGlyLysLeuTyrAla-94 |
| SEQ. ID. NO. 1686 | 107-LysAlaGlyGluSerLysThrGluGlnSerProLysAla-119 |
| SEQ. ID. NO. 1687 | 131-AlaAsnAspAlaLysLeu-136 |
| SEQ. ID. NO. 1688 | 143-ThrAsnGlyLysLysLeuTyr-149 |
| SEQ. ID. NO. 1689 | 155-AsnLysAlaGlyThrGly-160 |
| SEQ. ID. NO. 1690 | 167-ValGluThrGluValValLysTyrArgValArgArgGlyAspAspAla-182 |
| SEQ. ID. NO. 1691 | 200-TyrThrAspAspGlyLysThrTyr-207 |
| SEQ. ID. NO. 1692 | 219-GlnAlaAlaLysPro-223 |
| 121-1 | |
| AMPHI Regions - AMPHI | |
| SEQ. ID. NO. 1693 | 42-ProGlyArgLeuArgArg-47 |
| SEQ. ID. NO. 1694 | 68-GlnGluLeuSerArgLeuTyrAlaGlnThr-77 |
| SEQ. ID. NO. 1695 | 101-ThrValArgHisAlaPro-106 |
| SEQ. ID. NO. 1696 | 148-ProAlaPheHisGlu-152 |
| SEQ. ID. NO. 1697 | 165-LeuAsnIleGlyGlyIleAlaAsnIle-173 |
| SEQ. ID. NO. 1698 | 189-ProGlyAsnMetLeuMetAspAlaTrpThr-198 |
| SEQ. ID. NO. 1699 | 216-GlyAsnIleLeuProGlnLeuLeuAspArgLeuLeu-227 |
| SEQ. ID. NO. 1700 | 237-ProLysSerThrGly-241 |
| SEQ. ID. NO. 1701 | 251-GluThrTyrLeuAsp-255 |
| SEQ. ID. NO. 1702 | 262-AspValLeuArgThrLeuSerArgPheThrAlaGlnThrValCysAspAlaValSerHis-281 |
| SEQ. ID. NO. 1703 | 303-AlaAspLeuAlaGluCysPhe-309 |
| SEQ. ID. NO. 1704 | 341-IleAsnArgIleProGlySerPro-348 |
| Antigenic Index - Jameson-Wolf | |
| SEQ. ID. NO. 1705 | 13-ThrSerMetAspGlyAlaAsp-19 |
| SEQ. ID. NO. 1706 | 23-IleArgMetAspGlyGlyLysTrpLeuGly-32 |
| SEQ. ID. NO. 1707 | 40-ProTyrProGlyArgLeuArgArgGlnLeuLeuAspLeuGlnAspThrGlyAlaAspGluLeuHisArgSerArgIleLeuSer-67 |
| SEQ. ID. NO. 1708 | 86-AsnLeuAlaProSerAspIleThrAla-94 |
| SEQ. ID. NO. 1709 | 97-CysHisGlyGlnThrValArgHisAlaProGluHisGlyTyrSer-111 |
| SEQ. ID. NO. 1710 | 119-LeuLeuAlaGluArgThrArg-125 |
| SEQ. ID. NO. 1711 | 128-ThrValGlyAspPheArgSerArgAspLeuAlaAlaGlyGlyGlnGly-143 |
| SEQ. ID. NO. 1712 | 154-LeuPheArgAspAsnArgGluThrArgAla-163 |
| SEQ. ID. NO. 1713 | 177-ProProAspAlaPro-181 |
| SEQ. ID. NO. 1714 | 184-GlyPheAspThrGlyProGlyAsn-191 |

TABLE 1-continued

| | |
|---|---|
| SEQ. ID. NO. 1715 | 205-ProTyrAspLysAsnGlyAlaLysAlaAlaGlnGlyAsn-217 |
| SEQ. ID. NO. 1716 | 235-ProHisProLysSerThrGlyArgGlu-243 |
| SEQ. ID. NO. 1717 | 253-TyrLeuAspGlyGlyGluAsnArgTyrAspValLeuArgThrLeuSerArg-269 |
| SEQ. ID. NO. 1718 | 283-AlaAlaAspAlaArgGln-288 |
| SEQ. ID. NO. 1719 | 293-GlyGlyGlyIleArgAsnProValLeu-301 |
| SEQ. ID. NO. 1720 | 321-LeuAsnLeuAspProGlnTrp-327 |
| SEQ. ID. NO. 1721 | 344-IleProGlySerProHisLysAlaThrGlyAlaSerLysProCysIle-359 |

Hydrophilic Regions - Hopp-Woods

| | |
|---|---|
| SEQ. ID. NO. 1722 | 13-ThrSerMetAspGlyAlaAsp-19 |
| SEQ. ID. NO. 1723 | 43-GlyArgLeuArgArgGlnLeuLeuAspLeuGlnAspThrGlyAlaAspGluLeuHisArgSerArgIleLeuSer-67 |
| SEQ. ID. NO. 1724 | 101-ThrValArgHisAlaPro-106 |
| SEQ. ID. NO. 1725 | 119-LeuLeuAlaGluArgThrArg-125 |
| SEQ. ID. NO. 1726 | 131-AspPheArgSerArgAspLeuAlaAla-139 |
| SEQ. ID. NO. 1727 | 154-LeuPheArgAspAsnArgGluThrArgAla-163 |
| SEQ. ID. NO. 1728 | 206-TyrAspLysAsnGlyAlaLysAlaAlaGln-215 |
| SEQ. ID. NO. 1729 | 236-HisProLysSerThrGlyArgGlu-243 |
| SEQ. ID. NO. 1730 | 254-LeuAspGlyGlyGluAsnArgTyrAspVal-263 |
| SEQ. ID. NO. 1731 | 283-AlaAlaAspAlaArgGln-288 |
| SEQ. ID. NO. 1732 | 345-ProGlySerProHisLysAlaThrGlyAlaSer-355 |

122-1
AMPHI Regions - AMPHI

| | |
|---|---|
| SEQ. ID. NO. 1733 | 6-AsnIleHisLysThrPhe-11 |
| SEQ. ID. NO. 1734 | 42-ThrPheLeuArgCysLeuAsnAlaLeuGluMetProGlu-54 |
| SEQ. ID. NO. 1735 | 102-LeuGluAsnValMetGlu-107 |
| SEQ. ID. NO. 1736 | 126-LysLeuLeuGluLys-130 |
| SEQ. ID. NO. 1737 | 176-ProGluLeuValGlnAspValLeuAspThrMetLysGluLeuAla-190 |
| SEQ. ID. NO. 1738 | 227-ProGlnAspLeuPheAspHisPro-234 |

Antigenic Index - Jameson-Wolf

| | |
|---|---|
| SEQ. ID. NO. 1739 | 5-ArgAsnIleHisLysThrPheGlyGluAsnThrIle-16 |
| SEQ. ID. NO. 1740 | 23-AspValCysLysGlyGln-28 |
| SEQ. ID. NO. 1741 | 34-GlyProSerGlySerGlyLysThrThr-42 |
| SEQ. ID. NO. 1742 | 51-GluMetProGluAspGlyGlnIleGluPheAspAsnGluArgProLeuLysIleAspPheSerLysLysProSerLysHisAspIle-79 |
| SEQ. ID. NO. 1743 | 81-AlaLeuArgArgLysSerGlyMet-88 |
| SEQ. ID. NO. 1744 | 96-PheProHisLysThrAlaLeu-102 |
| SEQ. ID. NO. 1745 | 114-GlyLysProAlaAlaGlnAlaArgGluGluAlaLeuLysLeuLeuGlu-129 |
| SEQ. ID. NO. 1746 | 131-ValGlyLeuGlyAspLysValAspLeuTyr-140 |
| SEQ. ID. NO. 1747 | 142-TyrGlnLeuSerGlyGlyGlnGlnGlnArgValGlyIle-154 |
| SEQ. ID. NO. 1748 | 168-AspGluProThrSerAlaLeuAspProGluLeuVal-179 |
| SEQ. ID. NO. 1749 | 182-ValLeuAspThrMetLysGluLeuAlaGlnGluGly-193 |
| SEQ. ID. NO. 1750 | 216-MetAspGlyGlyVal-220 |
| SEQ. ID. NO. 1751 | 222-ValGluGlnGlySerProGlnAspLeuPheAspHisProLysHisGluArgThrArgArgPheLeuSer-244 |
| SEQ. ID. NO. 1752 | 246-IleGlnSerThrLysIle-251 |

Hydrophilic Regions - Hopp-Woods

| | |
|---|---|
| SEQ. ID. NO. 1753 | 51-GluMetProGluAspGlyGlnIleGluPheAspAsnGluArgProLeuLysIleAspPheSerLysLysProSerLysHisAsp-78 |
| SEQ. ID. NO. 1754 | 81-AlaLeuArgArgLysSerGly-87 |
| SEQ. ID. NO. 1755 | 114-GlyLysProAlaAlaGlnAlaArgGluGluAlaLeuLysLeuLeuGlu-129 |
| SEQ. ID. NO. 1756 | 131-ValGlyLeuGlyAspLysValAsp-138 |
| SEQ. ID. NO. 1757 | 168-AspGluProThrSerAlaLeuAspProGluLeuVal-179 |
| SEQ. ID. NO. 1758 | 182-ValLeuAspThrMetLysGluLeuAlaGln-191 |
| SEQ. ID. NO. 1759 | 229-AspLeuPheAspHisProLysHisGluArgThrArgArgPheLeu-243 |

126-1
AMPHI Regions - AMPHI

| | |
|---|---|
| SEQ. ID. NO. 1760 | 73-GlyCysGlnSerValGlnGluAla-80 |
| SEQ. ID. NO. 1761 | 112-PheGlnLeuValGluAla-117 |
| SEQ. ID. NO. 1762 | 143-LeuAspAlaGlyCysGln-148 |
| SEQ. ID. NO. 1763 | 150-LeuMetProTrpAlaAlaProIleGlyThrGlyLeuGlyAlaVal-164 |
| SEQ. ID. NO. 1764 | 213-SerGlyAspProValAsnMetAlaArgAlaPhe-223 |

Antigenic Index - Jameson-Wolf

| | |
|---|---|
| SEQ. ID. NO. 1765 | 7-GluThrPheProSerArgLeu-13 |
| SEQ. ID. NO. 1766 | 24-GluIleLeuLysGlnSerIle-30 |
| SEQ. ID. NO. 1767 | 41-SerLeuArgArgAlaGlySerGlyGlyGluAlaHisGlyGlnGlyPhe-56 |
| SEQ. ID. NO. 1768 | 85-GlnMetAlaArgGluValPheGlu-92 |
| SEQ. ID. NO. 1769 | 99-GluLeuIleGlyAspAspAspThrLeuGln-108 |
| SEQ. ID. NO. 1770 | 121-LeuIleLysAspGlyPheLysValLeu-129 |
| SEQ. ID. NO. 1771 | 141-ArgLeuLeuAspAlaGlyCys-147 |
| SEQ. ID. NO. 1772 | 171-ValLeuArgGluArgLeuProAspThrProLeu-181 |
| SEQ. ID. NO. 1773 | 209-AlaValSerArgSerGlyAspProValAsn-218 |
| SEQ. ID. NO. 1774 | 228-GluSerGlyArgLeuAlaPhe-234 |
| SEQ. ID. NO. 1775 | 237-GlyProValGluAlaArgAspLysAlaGlnAlaSerThrProThrVal-252 |

Hydrophilic Regions - Hopp-Woods

| | |
|---|---|
| SEQ. ID. NO. 1776 | 41-SerLeuArgArgAlaGlySerGlyGlyGluAlaHis-52 |
| SEQ. ID. NO. 1777 | 85-GlnMetAlaArgGluValPheGlu-92 |
| SEQ. ID. NO. 1778 | 100-LeuIleGlyAspAspAspThrLeuGln-108 |
| SEQ. ID. NO. 1779 | 171-ValLeuArgGluArgLeuProAsp-178 |
| SEQ. ID. NO. 1780 | 210-ValSerArgSerGlyAspPro-216 |
| SEQ. ID. NO. 1781 | 228-GluSerGlyArgLeuAlaPhe-234 |
| SEQ. ID. NO. 1782 | 237-GlyProValGluAlaArgAspLysAlaGlnAla-247 |

127

TABLE 1-continued

AMPHI Regions - AMPHI
SEQ. ID. NO. 1783    6-MetLeuAspThrTrpLeuGlyAla-13
SEQ. ID. NO. 1784    20-AlaValGluSerValAlaAla-26
SEQ. ID. NO. 1785    119-ValGlyAspTyrIleGluIle-125
SEQ. ID. NO. 1786    135-IleAsnLeuLeuAsnThrLeuMet-142
SEQ. ID. NO. 1787    147-ProAsnProLeuValGlyGlnLeuAla-155
SEQ. ID. NO. 1788    206-LeuGluProLeuCysAlaPro-212
SEQ. ID. NO. 1789    214-IleProAlaIleGlnArgXxxLeuGluAsnValGln-225
SEQ. ID. NO. 1790    250-ArgIleIleValArgPheAlaSerProVal-259
SEQ. ID. NO. 1791    268-AlaValMetAspGluPheLeuArgVal-276
Antigenic Index - Jameson-Wolf
SEQ. ID. NO. 1792    16-IleArgAlaGluAlaValGlu-22
SEQ. ID. NO. 1793    41-HisPheLysArgHisProAspPheGlyIleGluSerLysArgArgPheLeuVal-58
SEQ. ID. NO. 1794    112-SerAlaThrGlnGlnTyrSerVal-119
SEQ. ID. NO. 1795    126-AsnGlyLeuArgGlyArgValValAsp-134
SEQ. ID. NO. 1796    169-HisProValArgArgAspAsnIleLeu-177
SEQ. ID. NO. 1797    193-LeuAspSerAspGluAlaValCysArg-201
SEQ. ID. NO. 1798    234-AlaAlaArgProArgValThrArgValProTyrAspAspLysAlaTyr-249
SEQ. ID. NO. 1799    257-SerProValSerLysArgLeuGluIle-265
SEQ. ID. NO. 1800    282-AsnHisProAlaGlySerGluThrLeu-290
Hydrophilic Regions - Hopp-Woods
SEQ. ID. NO. 1801    16-IleArgAlaGluAlaValGlu-22
SEQ. ID. NO. 1802    42-PheLysArgHisProAspPheGlyIleGluSerLysArgArgPheLeuVal-58
SEQ. ID. NO. 1803    126-AsnGlyLeuArgGlyArgValVal-133
SEQ. ID. NO. 1804    170-ProValArgArgAspAsnIleLeu-177
SEQ. ID. NO. 1805    193-LeuAspSerAspGluAlaValCysArg-201
SEQ. ID. NO. 1806    235-AlaArgProArgValThrArgValProTyrAspAspLysAlaTyr-249
SEQ. ID. NO. 1807    259-ValSerLysArgLeuGluIle-265
SEQ. ID. NO. 1808    285-AlaGlySerGluThrLeu-290
128-1
AMPHI Regions - AMPHI
SEQ. ID. NO. 1809    43-AlaGlnThrHisThrGlyTrpAlaAsnThrValGluProLeuThrGlyIleThrG
                     luArgValGlyArgIleTrpGlyValValSerHisLeuAsnSerValAlaAspThrProGluLeu-82
SEQ. ID. NO. 1810    85-ValTyrAsnGluLeuMetProGluIle-93
SEQ. ID. NO. 1811    102-GlnAspIleGluLeuTyrAsnArgPheLysThrIleLysAsnSerProGluPhe-119
SEQ. ID. NO. 1812    166-PheSerGlnAsnValLeuAspAlaThrAsp-175
SEQ. ID. NO. 1813    189-GlyIleProGluAspAla-194
SEQ. ID. NO. 1814    218-HisTyrLeuAlaVal-222
SEQ. ID. NO. 1815    245-GluLeuSerAspAspGlyLysPheAspAsnThrAlaAsnIleAspArgThrLeu
                     AlaAsnAlaLeuGlnThrAlaLysLeuLeuGlyPheLysAsnTyrAlaGlu-279
SEQ. ID. NO. 1816    286-MetAlaAspThrProGluGlnValLeuAsnPheLeuHisAspLeuAlaArgArg
                     Ala-304
SEQ. ID. NO. 1817    313-AlaGluValLysAlaPheAlaArg-320
SEQ. ID. NO. 1818    359-GlyLysValLeuAsnGlyLeuPheAlaGlnIleLysLysLeuTyrGly-374
SEQ. ID. NO. 1819    472-LeuHisHisLeuLeuThrGlnValAspGluLeu-482
SEQ. ID. NO. 1820    496-GluLeuProSerGlnPhe-501
SEQ. ID. NO. 1821    565-GlyArgLeuLysAsnTrpGlnGlnValLeuAspSerVal-577
SEQ. ID. NO. 1822    610-SerTyrAlaTrpAlaGlu-615
SEQ. ID. NO. 1823    623-AlaAlaPheGluGluSerAspAsp-630
SEQ. ID. NO. 1824    636-LysArgPheTrpGluIleLeuAla-644
SEQ. ID. NO. 1825    651-AlaAlaGluSerPheLysAlaPheArg-659
Antigenic Index - Jameson-Wolf
SEQ. ID. NO. 1826    9-LeuGlyGluGluProArgPheAspGlnIleLysThrGluAspIleLysProAlaLeu-27
SEQ. ID. NO. 1827    32-AlaGluAlaArgGluGlnIleAla-39
SEQ. ID. NO. 1828    43-AlaGlnThrHisThrGlyTrp-49
SEQ. ID. NO. 1829    51-AsnThrValGluProLeuThrGlyIleThrGluArgValGlyArgIleTrp-67
SEQ. ID. NO. 1830    75-SerValAlaAspThrProGluLeu-82
SEQ. ID. NO. 1831    100-IleGlyGlnAspIleGluLeuTyrAsnArgPheLysThrIleLysAsnSerPro
                     GluPheAspThrLeuSerProAlaGlnLysThrLysLeuAsnHisAspLeuArgAsp-136
SEQ. ID. NO. 1832    138-ValLeuSerGlyAlaGluLeuProProGluGlnGlnAlaGluLeuAlaLysLeuGlnThrGluGlyAlaGlnLeu-162
SEQ. ID. NO. 1833    165-LysPheSerGlnAsnVal-170
SEQ. ID. NO. 1834    172-AspAlaThrAspAla-176
SEQ. ID. NO. 1835    190-IleProGluAspAla-194
SEQ. ID. NO. 1836    202-AlaGlnSerGluSerLysThrGlyTyrLysIle-212
SEQ. ID. NO. 1837    226-AlaAspAsnArgGluLeuArgGluGlnIle-235
SEQ. ID. NO. 1838    240-ValThrArgAlaSerGluLeuSerAspAspGlyLysPheAspAsnThrAlaAsnIleAspArgThrLeu-262
SEQ. ID. NO. 1839    285-LysMetAlaAspThrProGluGln-292
SEQ. ID. NO. 1840    300-LeuAlaArgArgAlaLysProTyrAlaGluLysAspLeuAlaGlu-314
SEQ. ID. NO. 1841    316-LysAlaPheAlaArgGluSerLeuAsn-324
SEQ. ID. NO. 1842    335-TyrAlaSerGluLysLeuArgGluAlaLysTyrAlaPheSerGluThrGluValLysLys-354
SEQ. ID. NO. 1843    376-GlyPheThrGluLysThrVal-382
SEQ. ID. NO. 1844    387-LysAspValArgTyrPheGluLeuGlnGlnAsnGlyGluThrIle-401
SEQ. ID. NO. 1845    409-TyrAlaArgGluGlyLysArgGlyGlyAla-418
SEQ. ID. NO. 1846    420-MetAsnAspTyrLysGlyArgArgArgPheSerAspGlyThrLeu-434
SEQ. ID. NO. 1847    447-ProProValGlyGlyArgGluAlaArgLeuSerHisAspGlu-460
SEQ. ID. NO. 1848    478-GlnValAspGluLeuGlyVal-484
SEQ. ID. NO. 1849    496-GluLeuProSerGln-500
SEQ. ID. NO. 1850    516-SerAlaHisGluGluThrGlyVal-523
SEQ. ID. NO. 1851    560-SerGluAspAspGluGlyArgLeuLysAsn-569
SEQ. ID. NO. 1852    575-AspSerValArgLysLysValAla-582

TABLE 1-continued

| | |
|---|---|
| SEQ. ID. NO. 1853 | 586-ProProGluTyrAsnArg-591 |
| SEQ. ID. NO. 1854 | 605-SerAlaGlyTyrTyrSerTyr-611 |
| SEQ. ID. NO. 1855 | 625-PheGluGluSerAspAspValAlaAlaThrGlyLysArgPheTrp-639 |
| SEQ. ID. NO. 1856 | 646-GlyGlySerArgSerAlaAlaGluSerPheLysAlaPheArgGlyArgGluProSerIle-665 |
| SEQ. ID. NO. 1857 | 669-LeuArgHisSerGlyPheAspAsnAlaVal-678 |
| Hydrophilic Regions - Hopp-Woods | |
| SEQ. ID. NO. 1858 | 9-LeuGlyGluGluProArgPheAspGlnIleLysThrGluAspIleLysPro-25 |
| SEQ. ID. NO. 1859 | 32-AlaGluAlaArgGluGlnIleAla-39 |
| SEQ. ID. NO. 1860 | 59-IleThrGluArgValGly-64 |
| SEQ. ID. NO. 1861 | 77-AlaAspThrProGluLeu-82 |
| SEQ. ID. NO. 1862 | 100-IleGlyGlnAspIleGluLeu-106 |
| SEQ. ID. NO. 1863 | 111-LysThrIleLysAsnSerProGluPheAspThr-121 |
| SEQ. ID. NO. 1864 | 123-SerProAlaGlnLysThrLysLeuAsnHisAspLeuArgAsp-136 |
| SEQ. ID. NO. 1865 | 143-GluLeuProProGluGlnGlnAlaGluLeuAlaLysLeuGlnThrGluGlyAlaGlnLeu-162 |
| SEQ. ID. NO. 1866 | 190-IleProGluAspAla-194 |
| SEQ. ID. NO. 1867 | 202-AlaGlnSerGluSerLysThrGlyTyr-210 |
| SEQ. ID. NO. 1868 | 226-AlaAspAsnArgGluLeuArgGluGlnIle-235 |
| SEQ. ID. NO. 1869 | 242-ArgAlaSerGluLeuSerAspAspGlyLysPheAspAsn-254 |
| SEQ. ID. NO. 1870 | 256-AlaAsnIleAspArgThrProLeu-262 |
| SEQ. ID. NO. 1871 | 285-LysMetAlaAspThrProGlu-291 |
| SEQ. ID. NO. 1872 | 300-LeuAlaArgArgAlaLysProTyrAlaGluLysAspLeuAlaGlu-314 |
| SEQ. ID. NO. 1873 | 316-LysAlaPheAlaArgGluSerLeuAsn-324 |
| SEQ. ID. NO. 1874 | 335-TyrAlaSerGluLysLeuArgGluAlaLysTyrAlaPheSerGluThrGluValLysLys-354 |
| SEQ. ID. NO. 1875 | 377-PheThrGluLysThr-381 |
| SEQ. ID. NO. 1876 | 387-LysAspValArgTyr-391 |
| SEQ. ID. NO. 1877 | 396-GlnAsnGlyGluThr-400 |
| SEQ. ID. NO. 1878 | 409-TyrAlaArgGluGlyLysArgGlyGly-417 |
| SEQ. ID. NO. 1879 | 423-TyrLysGlyArgArgArgPheSerAsp-431 |
| SEQ. ID. NO. 1880 | 449-ValGlyGlyArgGluAlaArgLeuSerHisAspGlu-460 |
| SEQ. ID. NO. 1881 | 478-GlnValAspGluLeuGly-483 |
| SEQ. ID. NO. 1882 | 516-SerAlaHisGluGluThrGly-522 |
| SEQ. ID. NO. 1883 | 560-SerGluAspAspGluGlyArgLeuLysAsn-569 |
| SEQ. ID. NO. 1884 | 575-AspSerValArgLysLysValAla-582 |
| SEQ. ID. NO. 1885 | 625-PheGluGluSerAspAspValAlaAlaThrGly-635 |
| SEQ. ID. NO. 1886 | 647-GlySerArgSerAlaAlaGluSerPheLysAlaPheArgGlyArgGluProSerIle-665 |
| 130-2 | |
| AMPHI Regions - AMPHI | |
| SEQ. ID. NO. 1887 | 16-ThrLeuValSerGlyIle-21 |
| SEQ. ID. NO. 1888 | 36-GlySerGlySerPheGly-41 |
| SEQ. ID. NO. 1889 | 56-GlnProValGlyGlnLeu-61 |
| SEQ. ID. NO. 1890 | 91-AsnValProAsnAlaPro-96 |
| SEQ. ID. NO. 1891 | 110-GlnGlyPheAspThrLeuPheGlnHisAlaLeuAsnGlyPheAsnAlaMet-126 |
| SEQ. ID. NO. 1892 | 171-ThrAlaSerAlaPro-175 |
| SEQ. ID. NO. 1893 | 204-PheGluAlaThrCysGln-209 |
| SEQ. ID. NO. 1894 | 211-CysHisGlyGlySerIleProGlyIlePro-220 |
| SEQ. ID. NO. 1895 | 234-LysGlyLysGluThr-238 |
| SEQ. ID. NO. 1896 | 245-GluGlyPheAsnAlaMet-250 |
| Antigenic Index - Jameson-Wolf | |
| SEQ. ID. NO. 1897 | 1-MetLysGlnLeuArgAspAsnLysAlaGlnGlySer-12 |
| SEQ. ID. NO. 1898 | 35-AlaGlySerGlySerPheGlyAspValAspAlaThrThrGluAlaAlaThrGlnThrArgIleGlnProValGly-59 |
| SEQ. ID. NO. 1899 | 63-MetGlyAspGlyIleProValGlyGluArgGlnGlyGlu-75 |
| SEQ. ID. NO. 1900 | 87-AlaAlaAspSerAsnValProAsnAlaProLysLeuGluHisAsnGlyAspTrpAla-105 |
| SEQ. ID. NO. 1901 | 108-IleAlaGlnGlyPhe-112 |
| SEQ. ID. NO. 1902 | 126-MetProAlaLysGlyGlyAla-132 |
| SEQ. ID. NO. 1903 | 134-AspLeuThrAspGlnGluLeuLysArg-142 |
| SEQ. ID. NO. 1904 | 148-AspAsnLysSerGlyGlySerPheProAsnProAspGluAlaAlaProAlaAspAsnAlaAlaSerGlyThrAlaSerAlaProAla<br>AspSerAlaAlaProAlaGluAlaLysAlaGluAspLysGlyAlaAla-192 |
| SEQ. ID. NO. 1905 | 197-GlyValAspGlyLysLysValPheGlu-205 |
| SEQ. ID. NO. 1906 | 221-GlyIleGlyLysLysAspAspTrpAlaProArgIleLysLysGlyLysGluThrLeuHis-240 |
| SEQ. ID. NO. 1907 | 251-ProAlaLysGlyGlyAsnAlaGlyLeuSerAspAspGluValLysAla-266 |
| SEQ. ID. NO. 1908 | 274-GlnSerGlyAlaLys-278 |
| Hydrophilic Regions - Hopp-Woods | |
| SEQ. ID. NO. 1909 | 1-MetLysGlnLeuArgAspAsnLysAlaGlnGly-11 |
| SEQ. ID. NO. 1910 | 41-GlyAspValAspAlaThrThrGluAlaAlaThr-51 |
| SEQ. ID. NO. 1911 | 68-ProValGlyGluArgGlnGlyGlu-75 |
| SEQ. ID. NO. 1912 | 87-AlaAlaAspSerAsnVal-92 |
| SEQ. ID. NO. 1913 | 96-ProLysLeuGluHisAsnGly-102 |
| SEQ. ID. NO. 1914 | 127-ProAlaLysGlyGlyAla-132 |
| SEQ. ID. NO. 1915 | 134-AspLeuThrAspGlnGluLeuLysArg-142 |
| SEQ. ID. NO. 1916 | 156-ProAsnProAspGluAlaAlaProAlaAspAsnAlaAla-168 |
| SEQ. ID. NO. 1917 | 174-AlaProAlaAspSerAlaAlaProAlaGluAlaLysAlaGluAspLysGlyAlaAla-192 |
| SEQ. ID. NO. 1918 | 198-ValAspGlyLysLysValPheGlu-205 |
| SEQ. ID. NO. 1919 | 222-IleGlyLysLysAspAspTrpAlaProArgIleLysLysGlyLysGluThrLeuHis-240 |
| SEQ. ID. NO. 1920 | 251-ProAlaLysGlyGlyAsn-256 |
| SEQ. ID. NO. 1921 | 258-GlyLeuSerAspAspGluValLysAla-266 |
| 132-2 | |
| AMPHI Regions - AMPHI | |
| SEQ. ID. NO. 1922 | 13-IleIleSerAlaLeuAlaVal-19 |
| SEQ. ID. NO. 1923 | 70-AlaThrCysMetAlaMetVal-76 |
| SEQ. ID. NO. 1924 | 92-ValGlnGlnThrGlnGlnAlaProLysProValSerAsnThr-105 |

TABLE 1-continued

Antigenic Index - Jameson-Wolf
SEQ. ID. NO. 1925 26-GlnHisGlyLysGlyAlaAspAla-33
SEQ. ID. NO. 1926 38-GlySerGlySerGlySerAla-44
SEQ. ID. NO. 1927 81-HisThrThrLysHisGlyLeuAspPhe-89
SEQ. ID. NO. 1928 91-AsnValGlnGlnThrGlnGlnAlaProLysProValSerAsnThrGluProSerAlaProValProGlnGlnGlnLys-116
Hydrophilic Regions - Hopp-Woods
SEQ. ID. NO. 1929 28-GlyLysGlyAlaAspAla-33
SEQ. ID. NO. 1930 97-GlnAlaProLysProValSerAsnThrGluProSerAla-109
134
AMPHI Regions - AMPHI
SEQ. ID. NO. 1931 39-IleGlnSerAlaGlyThrVal-45
SEQ. ID. NO. 1932 47-GlyLysLysThrGly-51
SEQ. ID. NO. 1933 58-TrpMetGluIleGluLysGlnArg-65
SEQ. ID. NO. 1934 83-ValAsnLeuLeuAspThrProGlyHis-91
SEQ. ID. NO. 1935 97-AspThrTyrArgValLeuThrAlaVal-105
SEQ. ID. NO. 1936 114-AlaAlaGlyValGlu-119
SEQ. ID. NO. 1937 123-IleLysLeuLeuAsnValCysArg-130
SEQ. ID. NO. 1938 142-LysTyrAspArgGluVal-147
SEQ. ID. NO. 1939 149-AspSerLeuGluLeuLeuAspGluValGluAsnIleLeuLys-162
SEQ. ID. NO. 1940 176-LysAsnPheLysGlyValTyrHisIleLeu-185
SEQ. ID. NO. 1941 201-HisGluPheAspIleIleLysGlyIleAspAsn-211
SEQ. ID. NO. 1942 254-PheGlySerAlaIle-258
SEQ. ID. NO. 1943 265-GluIleLeuAsnSerLeuIleAspTrpAlaPro-275
SEQ. ID. NO. 1944 322-LysPheGluArgGlyMetLys-328
SEQ. ID. NO. 1945 361-AspIleIleGlyIleProAsnHis-368
SEQ. ID. NO. 1946 395-LeuPheArgSerValArgIleLys-402
SEQ. ID. NO. 1947 404-ProLeuLysIleLysGln-409
SEQ. ID. NO. 1948 411-GlnLysGlyLeuGlnLeuGlyGlu-419
SEQ. ID. NO. 1949 423-ValGlnValPheLysProMetSer-430
SEQ. ID. NO. 1950 449-SerArgLeuAlaAsnGluTyr-455
SEQ. ID. NO. 1951 481-AlaGluPheGluLysAlaAsn-487
SEQ. ID. NO. 1952 515-ArgTrpProAspIle-519
Antigenic Index - Jameson-Wolf
SEQ. ID. NO. 1953 4-GluIleLeuAspGlnValArgArgArgArgThrPhe-15
SEQ. ID. NO. 1954 19-SerHisProAspAlaGlyLysThrThrLeuThr-29
SEQ. ID. NO. 1955 43-GlyThrValLysGlyLysLysThrGlyLysPheAlaThr-55
SEQ. ID. NO. 1956 57-AspTrpMetGluIleGluLysGlnArgGly-66
SEQ. ID. NO. 1957 76-PheAspTyrLysAspHisThrVal-83
SEQ. ID. NO. 1958 85-LeuLeuAspThrProGlyHisGlnAspPheSerGluAspThrTyrArg-100
SEQ. ID. NO. 1959 113-AspAlaAlaLysGlyValGlu-119
SEQ. ID. NO. 1960 129-CysArgLeuArgAspThrPro-135
SEQ. ID. NO. 1961 140-MetAsnLysTyrAspArgGluValArgAspSerLeuGluLeuLeuAspGluValGluAsn-159
SEQ. ID. NO. 1962 173-GlyMetGlyLysAsnPheLys-179
SEQ. ID. NO. 1963 194-AlaGlyGlyGluArgLeuProHis-201
SEQ. ID. NO. 1964 207-LysGlyIleAspAsnProGluLeuGluGlnArgPheProLeu-220
SEQ. ID. NO. 1965 223-GlnGlnLeuArgAspGluIleGluLeu-231
SEQ. ID. NO. 1966 235-AlaSerAsnGluPheAsnLeu-241
SEQ. ID. NO. 1967 275-ProAlaProLysProArgAspAlaThrValArgMetValGluProAspGluProLysPhe-294
SEQ. ID. NO. 1968 302-GlnAlaAsnMetAspProLysHisArgAspArgIleAla-314
SEQ. ID. NO. 1969 317-ArgValCysSerGlyLysPheGluArgGlyMetLysMetLysHisLeuArgIleAsnArgGluIleAla-339
SEQ. ID. NO. 1970 348-SerHisAspArgGluLeuValGlu-355
SEQ. ID. NO. 1971 365-IleProAsnHisGly-369
SEQ. ID. NO. 1972 373-IleGlyAspSerPheSerGluGlyGluGln-382
SEQ. ID. NO. 1973 399-ValArgIleLysAsnProLeuLysIleLysGlnLeuGlnLysGlyLeuGlnGlnLeuGlyGluGluGlyAla-422
SEQ. ID. NO. 1974 450-ArgLeuAlaAsnGluTyrGlyVal-457
SEQ. ID. NO. 1975 459-AlaValPheAspSer-463
SEQ. ID. NO. 1976 473-SerCysAspAspLysLysLysLeuAlaGluPheGluLysAlaAsnAla-488
SEQ. ID. NO. 1977 503-AlaProAsnArgValAsnLeu-509
SEQ. ID. NO. 1978 511-LeuThrGlnGluArgTrpProAspIleVal-520
SEQ. ID. NO. 1979 523-GluThrArgGluHisSerVal-529
Hydrophilic Regions - Hopp-Woods
SEQ. ID. NO. 1980 4-GluIleLeuAspGlnValArgArgArgArgThr-14
SEQ. ID. NO. 1981 21-ProAspAlaGlyLys-25
SEQ. ID. NO. 1982 43-GlyThrValLysGlyLysLysThrGlyLys-52
SEQ. ID. NO. 1983 59-MetGluIleGluLysGlnArgGly-66
SEQ. ID. NO. 1984 77-AspTyrLysAspHisThr-82
SEQ. ID. NO. 1985 92-GlnAspPheSerGluAspThrTyr-99
SEQ. ID. NO. 1986 113-AspAlaAlaLysGlyValGlu-119
SEQ. ID. NO. 1987 129-CysArgLeuArgAspThrPro-135
SEQ. ID. NO. 1988 142-LysTyrAspArgGluValArgAspSerLeuGluLeuLeuAspGluValGluAsn-159
SEQ. ID. NO. 1989 194-AlaGlyGlyGluArgLeuProHis-201
SEQ. ID. NO. 1990 207-LysGlyIleAspAsnProGluLeuGluGlnArgPheProLeu-220
SEQ. ID. NO. 1991 223-GlnGlnLeuArgAspGluIleGluLeu-231
SEQ. ID. NO. 1992 277-ProLysProArgAspAlaThrValArgMetValGluProAspGluProLysPhe-294
SEQ. ID. NO. 1993 305-MetAspProLysHisArgAspArgIleAla-314
SEQ. ID. NO. 1994 319-CysSerGlyLysPheGluArgGlyMetLysMetLysHisLeuArgIleAsnArgGluIleAla-339
SEQ. ID. NO. 1995 348-SerHisAspArgGluLeuValGlu-355
SEQ. ID. NO. 1996 376-SerPheSerGluGlyGluGln-382
SEQ. ID. NO. 1997 399-ValArgIleLysAsnProLeuLysIleLysGlnLeuGlnLysGlyLeu-414
SEQ. ID. NO. 1998 417-LeuGlyGluGluGlyAla-422

TABLE 1-continued

| SEQ. ID. NO. 1999 | 473-SerCysAspAspLysLysLysLeuAlaGluPheGluLysAlaAsnAla-488 |
| SEQ. ID. NO. 2000 | 512-ThrGlnGluArgTrpPro-517 |
| SEQ. ID. NO. 2001 | 523-GluThrArgGluHisSerVal-529 |

135
AMPHI Regions - AMPHI
| SEQ. ID. NO. 2002 | 85-GluTyrThrAlaAsnLeu-90 |
| SEQ. ID. NO. 2003 | 169-AspIleAspGlyLeuTyrThr-175 |
| SEQ. ID. NO. 2004 | 185-ValArgLeuAspLysIleGluHis-192 |
| SEQ. ID. NO. 2005 | 212-GlyMetLeuThrLysIle-217 |
| SEQ. ID. NO. 2006 | 236-LeuLysProAspAla-240 |
| SEQ. ID. NO. 2007 | 242-AlaGluAlaAlaGlu-246 |
| SEQ. ID. NO. 2008 | 284-AlaGluHisAlaLeuSer-289 |
| SEQ. ID. NO. 2009 | 300-IleAlaGlyIleGluGly-305 |
| SEQ. ID. NO. 2010 | 308-SerArgMetAspThrValThrValTyr-316 |
| SEQ. ID. NO. 2011 | 318-LysAlaThrLysGlnPro-323 |

Antigenic Index - Jameson-Wolf
| SEQ. ID. NO. 2012 | 1-MetLysTyrLysArgIleVal-7 |
| SEQ. ID. NO. 2013 | 11-GlyThrSerSerIleThrHisSerAspGlySerLeuSerArgGlyLysIleGlnThr-29 |
| SEQ. ID. NO. 2014 | 60-GlyPheLysLysArgProValLysIleAlaAspLysGlnAlaSer-74 |
| SEQ. ID. NO. 2015 | 90-LeuSerSerAspGlyIle-95 |
| SEQ. ID. NO. 2016 | 105-AlaAspPheAlaAspLysArgArgTyrGlnAsnAlaGlyGly-118 |
| SEQ. ID. NO. 2017 | 124-LeuGlnArgArgAlaVal-129 |
| SEQ. ID. NO. 2018 | 132-IleAsnGluAsnAspThrValSerValGluGluLeuLysIleGlyAspAsnAspThrLeu-151 |
| SEQ. ID. NO. 2019 | 176-GlyAsnProAsnSerAsnProAspAlaValArgLeuAspLysIleGluHisIleAsn-194 |
| SEQ. ID. NO. 2020 | 202-GlyGlySerGlySerAlaAsnGlyThrGly-211 |
| SEQ. ID. NO. 2021 | 215-ThrLysIleLysAla-219 |
| SEQ. ID. NO. 2022 | 224-AlaGluSerGlyVal-228 |
| SEQ. ID. NO. 2023 | 233-CysSerSerLeuLysProAspAlaLeuAlaGluAlaAlaGluHisGlnAlaAspGly-251 |
| SEQ. ID. NO. 2024 | 257-ArgAlaLysGlyLeuArgThrGlnLysGln-266 |
| SEQ. ID. NO. 2025 | 271-TyrSerGluSerArgGlySerValTyrValAspGluGlyAlaGluHisAlaLeuSerGluGlnGlyLysSerLeuLeu-296 |
| SEQ. ID. NO. 2026 | 305-GlyHisPheSerArgMetAspThr-312 |
| SEQ. ID. NO. 2027 | 317-SerLysAlaThrLysGlnProLeuGlyLysGlyArgVal-329 |
| SEQ. ID. NO. 2028 | 335-AlaAlaGluAspLeuLeuLysSerArgLysAlaLys-346 |
| SEQ. ID. NO. 2029 | 350-IleHisArgAspAspTrpIleSer-357 |

Hydrophilic Regions - Hopp-Woods
| SEQ. ID. NO. 2030 | 1-MetLysTyrLysArgIleVal-7 |
| SEQ. ID. NO. 2031 | 16-ThrHisSerAspGlySerLeuSerArgGlyLysIle-27 |
| SEQ. ID. NO. 2032 | 60-GlyPheLysLysArgProValLysIleAlaAspLysGlnAlaSer-74 |
| SEQ. ID. NO. 2033 | 105-AlaAspPheAlaAspLysArgArgTyrGlnAsn-115 |
| SEQ. ID. NO. 2034 | 124-LeuGlnArgArgAlaVal-129 |
| SEQ. ID. NO. 2035 | 133-AsnGluAsnAspThrValSerValGluGluLeuLysIleGlyAspAsnAspThrLeu-151 |
| SEQ. ID. NO. 2036 | 178-ProAsnSerAsnProAspAlaValArgLeuAspLysIleGluHisIleAsn-194 |
| SEQ. ID. NO. 2037 | 215-ThrLysIleLysAla-219 |
| SEQ. ID. NO. 2038 | 236-LeuLysProAspAlaLeuAlaGluAlaAlaGluHisGlnAlaAsp-250 |
| SEQ. ID. NO. 2039 | 257-ArgAlaLysGlyLeuArgThrGlnLys-265 |
| SEQ. ID. NO. 2040 | 272-SerGluSerArgGly-276 |
| SEQ. ID. NO. 2041 | 278-ValTyrValAspGluGlyAlaGluHisAlaLeuSerGluGlnGlyLys-293 |
| SEQ. ID. NO. 2042 | 306-HisPheSerArgMetAspThr-312 |
| SEQ. ID. NO. 2043 | 318-LysAlaThrLysGlnProLeuGlyLysGlyArgVal-329 |
| SEQ. ID. NO. 2044 | 335-AlaAlaGluAspLeuLeuLysSerArgLysAlaLys-346 |
| SEQ. ID. NO. 2045 | 351-HisArgAspAspTrp-355 |

136
AMPHI Regions - AMPHI
| SEQ. ID. NO. 2046 | 37-LeuArgPheValAspAspCysLeuPro-45 |
| SEQ. ID. NO. 2047 | 50-IleArgGlnCysIleArgGln-56 |
| SEQ. ID. NO. 2048 | 84-GlnCysHisAspGlyIleLysGlnLeuPheLysArgPheIleIleAspGlyPheLysProIleGlyArgHis-107 |
| SEQ. ID. NO. 2049 | 119-CysValLysIleAla-123 |
| SEQ. ID. NO. 2050 | 148-ArgHisCysGlnAsn-152 |
| SEQ. ID. NO. 2051 | 170-GlnHisPheGlyGlnPro-175 |
| SEQ. ID. NO. 2052 | 177-GluArgCysGlnPheVal-182 |
| SEQ. ID. NO. 2053 | 194-AsnLeuValAlaThr-198 |
| SEQ. ID. NO. 2054 | 210-GlnPheAlaGlnPro-214 |
| SEQ. ID. NO. 2055 | 216-PheGlyCysPheGlyLysPheSerGlyIleHis-226 |

Antigenic Index - Jameson-Wolf
| SEQ. ID. NO. 2056 | 1-MetGluThrAsnAla-5 |
| SEQ. ID. NO. 2057 | 38-ArgPheValAspAspCysLeu-44 |
| SEQ. ID. NO. 2058 | 48-ValAspIleArgGlnCysIle-54 |
| SEQ. ID. NO. 2059 | 69-LeuGlnThrAspSer-73 |
| SEQ. ID. NO. 2060 | 84-GlnCysHisAspGlyIleLysGlnLeuPhe-93 |
| SEQ. ID. NO. 2061 | 99-AspGlyPheLysProIleGlyArgHisAsnIle-109 |
| SEQ. ID. NO. 2062 | 139-IleArgHisArgGlyGlyCysPheHisArgHisCysGlnAsnGlnProPheAsp-156 |
| SEQ. ID. NO. 2063 | 159-ThrPheGlyGlyGlyLysLeuArg-166 |
| SEQ. ID. NO. 2064 | 171-HisPheGlyGlnProValGluArg-178 |
| SEQ. ID. NO. 2065 | 184-ProAlaGlnGlnArgArgHisLysThr-192 |
| SEQ. ID. NO. 2066 | 214-ProProPheGlyCysPheGlyLysPheSerGly-224 |
| SEQ. ID. NO. 2067 | 236-ProTyrTyrArgArgAsnAlaVal-243 |

Hydrophilic Regions - Hopp-Woods
| SEQ. ID. NO. 2068 | 48-ValAspIleArgGlnCysIle-54 |
| SEQ. ID. NO. 2069 | 87-AspGlyIleLysGlnLeuPhe-93 |
| SEQ. ID. NO. 2070 | 185-AlaGlnGlnArgArgHisLysThr-192 |

TABLE 1-continued

137
AMPHI Regions - AMPHI
SEQ. ID. NO. 2071   24-LeuSerTyrIleLeuGlyPhe-30
SEQ. ID. NO. 2072   49-ThrLysGluSerLeu-53
SEQ. ID. NO. 2073   55-AspPheLeuThrTrpGly-60
SEQ. ID. NO. 2074   78-PheSerAspTyrLeuAlaHisProLeuAspIlePheLysValTrpGluGlyGly-95
SEQ. ID. NO. 2075   120-PheLeuLysLeuMetAspThrValAlaProLeuValPro-132
SEQ. ID. NO. 2076   139-ArgIleGlyValAsnPheIle-144
SEQ. ID. NO. 2077   149-TrpGlyArgValThrAspIleAsnAlaPhe-158
SEQ. ID. NO. 2078   178-ProLeuTrpAlaGluTrpLeuGlnGlnTyr-187
SEQ. ID. NO. 2079   190-LeuProArgHisProSerGlnLeu-197
SEQ. ID. NO. 2080   232-TyrGlyIlePheArgPheIleAlaGluPheAlaArgGlnProAspAspTyrLeuGly-250
Antigenic Index - Jameson-Wolf
SEQ. ID. NO. 2081   36-LeuGlyArgArgArgIleAlaGln-43
SEQ. ID. NO. 2082   48-PheThrLysGluSerLeuAspAsp-55
SEQ. ID. NO. 2083   92-TrpGluGlyGlyMet-96
SEQ. ID. NO. 2084   111-LeuPheGlyArgLysHisGly-117
SEQ. ID. NO. 2085   136-AlaSerGlyArgIle-140
SEQ. ID. NO. 2086   164-ProGlnAlaArgTyrGluAspAlaGluAlaAlaAla-175
SEQ. ID. NO. 2087   191-ProArgHisProSerGlnLeu-197
SEQ. ID. NO. 2088   214-PheSerLysLysGlnArgSerThrGlyGln-223
SEQ. ID. NO. 2089   241-PheAlaArgGlnProAspAspTyrLeu-249
SEQ. ID. NO. 2090   277-PheGlyMetLysLysGlnHis-283
Hydrophilic Regions - Hopp-Woods
SEQ. ID. NO. 2091   37-GlyArgArgArgIleAla-42
SEQ. ID. NO. 2092   48-PheThrLysGluSerLeuAsp-54
SEQ. ID. NO. 2093   112-PheGlyArgLysHisGly-117
SEQ. ID. NO. 2094   166-AlaArgTyrGluAspAlaGluAlaAlaAla-175
SEQ. ID. NO. 2095   216-LysLysGlnArgSerThrGly-222
SEQ. ID. NO. 2096   241-PheAlaArgGlnProAspAspTyr-248
SEQ. ID. NO. 2097   278-GlyMetLysLysGlnHis-283
138
AMPHI Regions - AMPHI
SEQ. ID. NO. 2098   21-ProTyrIleArgArgPheSerGlySer-29
SEQ. ID. NO. 2099   74-AsnAlaMetLeuGluLysVal-80
SEQ. ID. NO. 2100   85-GluPheValGlnGlyMet-90
SEQ. ID. NO. 2101   109-ValAsnLysGluIleValSerMetIleAsnThrTyrGly-121
SEQ. ID. NO. 2102   152-IleGlyGlnValGlyThrValGluSerIle-161
SEQ. ID. NO. 2103   163-ThrGlyLeuValLysGlyLeu-169
SEQ. ID. NO. 2104   199-GlyLysLeuAlaGluGluLeu-205
SEQ. ID. NO. 2105   213-MetThrAsnIleAlaGlyValMetAspLysThrGlyAsnLeuLeuThrLysLeuThr-231
SEQ. ID. NO. 2106   234-ArgIleAspGluLeuIle-239
SEQ. ID. NO. 2107   247-GlyMetLeuProLysIleAlaSerAlaValGluAlaAlaValAsn-261
SEQ. ID. NO. 2108   276-AlaLeuLeuLeuGluIlePheThrAspAla-285
Antigenic Index - Jameson-Wolf
SEQ. ID. NO. 2109   1-MetGluSerGluAsnIle-6
SEQ. ID. NO. 2110   9-AlaAlaAspLysAlaArgIleLeu-16
SEQ. ID. NO. 2111   23-IleArgArgPheSerGlySer-29
SEQ. ID. NO. 2112   35-TyrGlyGlyAsnAlaMetThr-41
SEQ. ID. NO. 2113   43-ProAlaLeuLysGluGlyPheAla-50
SEQ. ID. NO. 2114   68-GlyGlyGlyProGln-72
SEQ. ID. NO. 2115   76-MetLeuGluLysValGlyLysLysGlyGluPhe-86
SEQ. ID. NO. 2116   91-ArgValThrAspLysGluAlaMetAsp-99
SEQ. ID. NO. 2117   109-ValAsnLysGluIle-113
SEQ. ID. NO. 2118   128-SerGlyArgAspAspHisPheIleLysAlaLysLysLeuLeuIleAspThrProGluGlnAsnGlyValAspIleGlyGln-154
SEQ. ID. NO. 2119   159-GluSerIleAspThrGlyLeu-165
SEQ. ID. NO. 2120   169-LeuIleGluArgGlyCysIle-175
SEQ. ID. NO. 2121   182-GlyValGlyGluLysGlyGluAla-189
SEQ. ID. NO. 2122   200-LysLeuAlaGluGluLeuAsnAlaGluLys-209
SEQ. ID. NO. 2123   219-ValMetAspLysThrGlyAsnLeuLeuThrLysLeuThrProLysArgIleAspGluLeuIleAla-240
SEQ. ID. NO. 2124   259-AlaValAsnGlyValLys-264
SEQ. ID. NO. 2125   269-IleAspGlyArgLeuProAsnAla-276
SEQ. ID. NO. 2126   292-LeuGlyGlyGlyGluAspAla-298
Hydrophilic Regions - Hopp-Woods
SEQ. ID. NO. 2127   1-MetGluSerGluAsn-5
SEQ. ID. NO. 2128   9-AlaAlaAspLysAlaArgIleLeu-16
SEQ. ID. NO. 2129   43-ProAlaLeuLysGluGlyPheAla-50
SEQ. ID. NO. 2130   76-MetLeuGluLysValGlyLysLysGlyGluPhe-86
SEQ. ID. NO. 2131   91-ArgValThrAspLysGluAlaMetAsp-99
SEQ. ID. NO. 2132   109-ValAsnLysGluIle-113
SEQ. ID. NO. 2133   128-SerGlyArgAspAspHisPheIleLysAlaLysLysLeuLeuIleAspThrProGluGlnAsnGlyValAsp-151
SEQ. ID. NO. 2134   183-ValGlyGluLysGlyGluAla-189
SEQ. ID. NO. 2135   200-LysLeuAlaGluGluLeuAsnAlaGluLys-209
SEQ. ID. NO. 2136   219-ValMetAspLysThrGly-224
SEQ. ID. NO. 2137   230-LeuThrProLysArgIleAspGluLeuIleAla-240
SEQ. ID. NO. 2138   269-IleAspGlyArgLeu-273
SEQ. ID. NO. 2139   294-GlyGlyGluAspAla-298
140-2

TABLE 1-continued

AMPHI Regions - AMPHI
SEQ. ID. NO. 2140  23-ThrThrLeuSerAlaCysLeuGly-30
SEQ. ID. NO. 2141  105-AspPheProAsnProAsnAspAlaTyrLysAsnLeuIle-117
SEQ. ID. NO. 2142  139-ThrGlyGluSerValGlySerIleSerPhePro-149
SEQ. ID. NO. 2143  201-AspIleArgHisValLysGluIleGlyHisIleAspLeuValSer-215
SEQ. ID. NO. 2144  253-AlaAlaIleArgAsnAlaTrpValLysLeuGly-263
SEQ. ID. NO. 2145  266-GlyValArgIleVal-270
SEQ. ID. NO. 2146  282-ThrAlaAspLeuPheGlnIle-288
SEQ. ID. NO. 2147  311-GlyIleArgLeuMetGlnGlnSerAsp-319
SEQ. ID. NO. 2148  370-AspArgSerGlyGluLysPheLysArgGluMetTyr-381
SEQ. ID. NO. 2149  415-ThrArgThrAsnPro-419
SEQ. ID. NO. 2150  458-ThrAlaGlnAspIle-462
SEQ. ID. NO. 2151  476-LeuAspAlaGlyLysAlaMetAsnGlyPro-485
SEQ. ID. NO. 2152  608-TyrThrArgLeuGlyLysLeuLeuLys-616
SEQ. ID. NO. 2153  673-SerLeuAspSerValGluLysThrAlaGly-682
SEQ. ID. NO. 2154  696-AsnAlaAlaArgThrAlaSer-702
SEQ. ID. NO. 2155  736-SerAlaThrProGluThrValGluThrAlaAla-746
SEQ. ID. NO. 2156  763-ArgAlaAlaAlaAlaValGlnHisAlaAsnAlaAlaAspGlyValArgIlePheAsnSerLeuAlaAlaThr-786
SEQ. ID. NO. 2157  803-LeuLysAlaValSerAspGlyLeuAsp-811
SEQ. ID. NO. 2158  817-LeuArgValIleAlaGln-822
SEQ. ID. NO. 2159  882-SerLeuPheAlaGly-886
SEQ. ID. NO. 2160  894-IleGlyTyrLeuLysGlyLeuPheSerTyr-903
SEQ. ID. NO. 2161  918-GluHisAlaGluGlySer-923
SEQ. ID. NO. 2162  931-LeuGlyAlaLeuGly-935
SEQ. ID. NO. 2163  980-GlyThrLeuValGlyLeu-985
SEQ. ID. NO. 2164  1019-GlyGlyPheThrGlyAlaThr-1025
SEQ. ID. NO. 2165  1040-ArgLeuValAlaGlyLeu-1045
SEQ. ID. NO. 2166  1053-AsnGlyTrpAsnGlyLeuAlaArg-1060
Antigenic Index - Jameson-Wolf
SEQ. ID. NO. 2167  1-MetArgThrThrPro-5
SEQ. ID. NO. 2168  7-PheProThrLysThrPheLysProThr-15
SEQ. ID. NO. 2169  30-GlyGlyGlyGlyGlyGlyThrSerAlaProAspPheAsnAlaGlyGlyThrGlyIleGlySerAsnSerArgAlaThrThrAlaLys-58
SEQ. ID. NO. 2170  67-IleLysAsnGluMetCysLysAspArgSerMet-77
SEQ. ID. NO. 2171  79-CysAlaGlyArgAspAspValAlaValThrAspArgAspAlaLysIleAsnAlaProProProAsnLeuHisThrGlyAspPheProAsnProAsnAsp
AlaTyrLysAsn-115
SEQ. ID. NO. 2172  127-TyrThrGlyArgGlyValGlu-133
SEQ. ID. NO. 2173  138-AspThrGlyGluSerValGlySerIleSerPhe-148
SEQ. ID. NO. 2174  151-LeuTyrGlyArgLysGluHisGlyTyrAsnGluAsnTyrLysAsn-165
SEQ. ID. NO. 2175  170-MetArgLysGluAlaProGluAspGlyGlyGlyLysAspIleGluAlaSerPheAspAspGluAlaValIleGluThrGluAlaLysProThrAsp
IleArgHisValLysGluIleGlyHis-210
SEQ. ID. NO. 2176  220-GlyArgSerValAspGlyArgProAlaGlyGlyIleAlaProAspAla-235
SEQ. ID. NO. 2177  241-AsnThrAsnAspGluThrLysAsnGluMet-250
SEQ. ID. NO. 2178  262-LeuGlyGluArgGlyValArg-268
SEQ. ID. NO. 2179  272-AsnSerPheGlyThrThrSerArgAlaGlyThrAlaAsp-284
SEQ. ID. NO. 2180  288-IleAlaAsnSerGluGluGlnTyrArg-296
SEQ. ID. NO. 2181  301-AspTyrSerGlyGlyAspLysThrAspGluGlyIleArg-313
SEQ. ID. NO. 2182  315-MetGlnGlnSerAspTyrGlyAsn-322
SEQ. ID. NO. 2183  327-IleArgAsnLysAsnMet-332
SEQ. ID. NO. 2184  337-SerThrGlyAsnAspAlaGlnAlaGlnProAsnThr-348
SEQ. ID. NO. 2185  355-TyrGluLysAspAlaGlnLys-361
SEQ. ID. NO. 2186  368-GlyValAspArgSerGlyGluLysPheLysArgGluMetTyrGlyGluProGlyThrGluProLeuGluTyrGlySerAsnHis-395
SEQ. ID. NO. 2187  412-ValArgPheThrArgThrAsnPro-419
SEQ. ID. NO. 2188  446-MetSerAsnAspAsnLeuArgThr-453
SEQ. ID. NO. 2189  467-ValAspSerLysPheGly-472
SEQ. ID. NO. 2190  477-AspAlaGlyLysAlaMetAsnGlyProAla-486
SEQ. ID. NO. 2191  492-AspPheThrAlaAspThrLysGlyThrSer-501
SEQ. ID. NO. 2192  506-SerPheArgAsnAspIleSerGlyThr-514
SEQ. ID. NO. 2193  516-GlyLeuIleLysLysGlyGlySerGln-524
SEQ. ID. NO. 2194  529-GlyAsnAsnThrTyrThrGlyLysThrIleIleGluGlyGlySer-543
SEQ. ID. NO. 2195  548-GlyAsnAsnLysSerAspMetArgValGluThrLysGly-560
SEQ. ID. NO. 2196  568-AlaSerGlyGlySerLeuAsnSerAspGly-577
SEQ. ID. NO. 2197  582-AlaAspThrAspGlnSerGlyAlaAsnGlu-591
SEQ. ID. NO. 2198  593-ValHisIleLysGlySerLeuGlnLeuAspGlyLysGlyThrLeu-607
SEQ. ID. NO. 2199  615-LeuLysValAspGly-619
SEQ. ID. NO. 2200  629-MetSerAlaArgGlyLysGlyAlaGly-637
SEQ. ID. NO. 2201  640-AsnSerThrGlyArgArgValPro-647
SEQ. ID. NO. 2202  653-LysIleGlyGlnAspTyr-658
SEQ. ID. NO. 2203  663-AsnIleGluThrAspGlyGlyLeu-670
SEQ. ID. NO. 2204  675-AspSerValGluLysThrAlaGlySerGluGlyAspThrLeu-688
SEQ. ID. NO. 2205  691-TyrValArgArgGlyAsnAlaAlaArgThrAlaSer-702
SEQ. ID. NO. 2206  714-HisAlaValGluGlnGlyGlySerAsnLeuGlu-724
SEQ. ID. NO. 2207  730-LeuAspAlaSerGluSerSerAlaThrProGluThrValGlu-743
SEQ. ID. NO. 2208  745-AlaAlaAlaAspArgThrAspMetProGlyIleArgProTyrGly-759
SEQ. ID. NO. 2209  772-AsnAlaAlaAspGly-776
SEQ. ID. NO. 2210  788-TyrAlaAspSerThrAlaAla-794
SEQ. ID. NO. 2211  797-AspMetGlnGlyArgArgLeuLysAlaValSerAspGlyLeuAspHisAsnGlyThrGlyLeu-817
SEQ. ID. NO. 2212  823-ThrGlnGlnAspGlyGlyThrTrpGluGlnGlyGlyValGluGlyLysMetArgGlySerThrGln-844
SEQ. ID. NO. 2213  849-AlaAlaLysThrGlyGluAsnThrThr-857
SEQ. ID. NO. 2214  863-GlyMetGlyArgSerThrTrpSerGluAsnSerAlaAsnAlaLysThrAspSerIle-881
SEQ. ID. NO. 2215  887-IleArgHisAspAlaGlyAsp-893

TABLE 1-continued

| SEQ. ID. NO. 2216 | 902-SerTyrGlyArgTyrLysAsnSerIleSerArgSerThrGlyAlaAspGluHisAlaGluGlySerValAsn-925 |
| SEQ. ID. NO. 2217 | 943-AlaThrGlyAspLeuThrValGluGlyGlyLeuArg-954 |
| SEQ. ID. NO. 2218 | 961-AspAlaPheAlaGluLysGlySerAlaLeuGlyTrpSerGlyAsnSerLeuThrGluGlyThr-981 |
| SEQ. ID. NO. 2219 | 990-LeuSerGlnProLeuSerAspLys-997 |
| SEQ. ID. NO. 2220 | 1005-GlyValGluArgAspLeuAsnGlyArgAspTyrThrVal-1017 |
| SEQ. ID. NO. 2221 | 1027-AlaThrGlyLysThrGlyAlaArgAsnMetProHisThr-1039 |
| SEQ. ID. NO. 2222 | 1049-ValGluPheGlyAsnGlyTrp-1055 |
| SEQ. ID. NO. 2223 | 1062-SerTyrAlaGlySerLysGlnTyrGlyAsnHisSerGlyArgValGlyVal-1078 |

Hydrophilic Regions - Hopp-Woods

| SEQ. ID. NO. 2224 | 50-SerAsnSerArgAlaThrThrAlaLys-58 |
| SEQ. ID. NO. 2225 | 67-IleLysAsnGluMetCysLysAspArgSerMet-77 |
| SEQ. ID. NO. 2226 | 80-AlaGlyArgAspAspValAlaValThrAspArgAspAlaLysIleAsnAla-96 |
| SEQ. ID. NO. 2227 | 106-PheProAsnProAsnAspAlaTyr-113 |
| SEQ. ID. NO. 2228 | 138-AspThrGlyGluSerValGly-144 |
| SEQ. ID. NO. 2229 | 152-TyrGlyArgLysGluHisGlyTyr-159 |
| SEQ. ID. NO. 2230 | 170-MetArgLysGluAlaProGluAspGlyGlyGlyLysAspIleGluAlaSerPheAspAspGluAlaValIleGluThrGluAlaLysProThrAspIleArgHisValLysGluIleGlyHis-210 |
| SEQ. ID. NO. 2231 | 221-ArgSerValAspGlyArgProAlaGly-229 |
| SEQ. ID. NO. 2232 | 242-ThrAsnAspGluThrLysAsnGluMet-250 |
| SEQ. ID. NO. 2233 | 262-LeuGlyGluArgGlyValArg-268 |
| SEQ. ID. NO. 2234 | 278-SerArgAlaGlyThr-282 |
| SEQ. ID. NO. 2235 | 290-AsnSerGluGluGlnTyrArg-296 |
| SEQ. ID. NO. 2236 | 303-SerGlyGlyAspLysThrAspGluGlyIleArg-313 |
| SEQ. ID. NO. 2237 | 327-IleArgAsnLysAsn-331 |
| SEQ. ID. NO. 2238 | 339-GlyAsnAspAlaGlnAla-344 |
| SEQ. ID. NO. 2239 | 355-TyrGluLysAspAlaGlnLys-361 |
| SEQ. ID. NO. 2240 | 368-GlyValAspArgSerGlyGluLysPheLysArgGluMetTyrGly-382 |
| SEQ. ID. NO. 2241 | 384-ProGlyThrGluProLeuGlu-390 |
| SEQ. ID. NO. 2242 | 412-ValArgPheThrArg-416 |
| SEQ. ID. NO. 2243 | 477-AspAlaGlyLysAlaMetAsn-483 |
| SEQ. ID. NO. 2244 | 493-PheThrAlaAspThrLysGlyThrSer-501 |
| SEQ. ID. NO. 2245 | 509-AsnAspIleSerGly-513 |
| SEQ. ID. NO. 2246 | 517-LeuIleLysLysGlyGlySer-523 |
| SEQ. ID. NO. 2247 | 550-AsnLysSerAspMetArgValGluThrLysGly-560 |
| SEQ. ID. NO. 2248 | 583-AspThrAspGlnSerGlyAlaAsnGlu-591 |
| SEQ. ID. NO. 2249 | 601-LeuAspGlyLysGly-605 |
| SEQ. ID. NO. 2250 | 615-LeuLysValAspGly-619 |
| SEQ. ID. NO. 2251 | 631-AlaArgGlyLysGly-635 |
| SEQ. ID. NO. 2252 | 642-ThrGlyArgArgValPro-647 |
| SEQ. ID. NO. 2253 | 664-IleGluThrAspGly-668 |
| SEQ. ID. NO. 2254 | 675-AspSerValGluLysThrAlaGlySerGluGlyAspThr-687 |
| SEQ. ID. NO. 2255 | 692-ValArgArgGlyAsnAlaAlaArgThrAlaSer-702 |
| SEQ. ID. NO. 2256 | 714-HisAlaValGluGlnGlyGlySerAsnLeu-723 |
| SEQ. ID. NO. 2257 | 730-LeuAspAlaSerGluSerSerAlaThrProGluThrValGlu-743 |
| SEQ. ID. NO. 2258 | 745-AlaAlaAlaAspArgThrAspMetProGly-754 |
| SEQ. ID. NO. 2259 | 772-AsnAlaAlaAspGly-776 |
| SEQ. ID. NO. 2260 | 797-AspMetGlnGlyArgArgLeuLysAlaValSerAspGlyLeuAspHisAsnGlyThr-815 |
| SEQ. ID. NO. 2261 | 833-GlyGlyValGluGlyLysMetArgGlySerThr-843 |
| SEQ. ID. NO. 2262 | 851-LysThrGlyGluAsnThrThr-857 |
| SEQ. ID. NO. 2263 | 872-AsnSerAlaAsnAlaLysThrAspSer-880 |
| SEQ. ID. NO. 2264 | 887-IleArgHisAspAlaGlyAsp-893 |
| SEQ. ID. NO. 2265 | 905-ArgTyrLysAsnSerIleSerArgSerThrGlyAlaAspGluHisAlaGluGlySerVal-924 |
| SEQ. ID. NO. 2266 | 961-AspAlaPheAlaGluLysGlySer-968 |
| SEQ. ID. NO. 2267 | 992-GlnProLeuSerAspLys-997 |
| SEQ. ID. NO. 2268 | 1005-GlyValGluArgAspLeuAsnGlyArgAspTyrThr-1016 |
| SEQ. ID. NO. 2269 | 1027-AlaThrGlyLysThrGlyAlaArgAsnMetPro-1037 |
| 141 | |

AMPHI Regions - AMPHI

| SEQ. ID. NO. 2270 | 11-GlnSerSerThrMetArgProIleGlyGluIle-21 |
| SEQ. ID. NO. 2271 | 44-ProAlaGluAlaPheLysLeuPro-51 |
| SEQ. ID. NO. 2272 | 80-AlaAspAlaLeuArgHisIle-86 |
| SEQ. ID. NO. 2273 | 131-PheHisAlaIleGlyAla-136 |
| SEQ. ID. NO. 2274 | 139-AsnLeuLeuAlaAlaMetLeuAspAsn-147 |
| SEQ. ID. NO. 2275 | 174-GlnLeuArgAsnIleIleAspGlyMetGlyLysProValAspGlyValMetArgPro-192 |
| SEQ. ID. NO. 2276 | 212-AspIleSerAspLeuLysGluArgLeuGlyIleLeuVal-225 |
| SEQ. ID. NO. 2277 | 245-MetAlaAlaLeuLeuLysAspAlaIleLysProAsnLeu-257 |
| SEQ. ID. NO. 2278 | 259-GlnThrIleGluGlyThrPro-265 |
| SEQ. ID. NO. 2279 | 272-ProPheAlaAsnIleAlaHisGlyCysAsnSerValThrAlaThrArgLeuAlaLysHisLeuAlaAspTyrAla-296 |
| SEQ. ID. NO. 2280 | 330-AlaThrValArgAla-334 |
| SEQ. ID. NO. 2281 | 351-LeuAspAlaLeuGluLysGlyLeuProAsnLeuLeuLysHisIleSersnLeuLysAsnValPheGly-373 |
| SEQ. ID. NO. 2282 | 406-SerLeuThrGluValTrpLysLys-413 |
| SEQ. ID. NO. 2283 | 420-AspLeuAlaArgLysValValAsnAlaIleGluSerGln-432 |
| SEQ. ID. NO. 2284 | 473-IleAlaSerLeuGluLys-478 |
| SEQ. ID. NO. 2285 | 525-ValAlaLeuCysGlyAsnMetMetLysMetProGlyLeuProLysValProAlaAla-543 |

Antigenic Index - Jameson-Wolf

| SEQ. ID. NO. 2286 | 3-PheLysThrAspAlaGluIleAlaGlnSerSerThrMetArgProIleGly-19 |
| SEQ. ID. NO. 2287 | 27-LeuAsnAlaAspAsnIleGluProTyrGly-36 |
| SEQ. ID. NO. 2288 | 38-TyrLysAlaLysIleAsnProAlaGluAlaPheLysLeuProGlnLysGlnGlyArg-56 |
| SEQ. ID. NO. 2289 | 64-AsnProThrProAlaGlyGluGlyLysThrThr-74 |
| SEQ. ID. NO. 2290 | 81-AspAlaLeuArgHisIleGlyLysAspAla-90 |

TABLE 1-continued

| | |
|---|---|
| SEQ. ID. NO. 2291 | 94-LeuArgGluProSerLeuGlyPro-101 |
| SEQ. ID. NO. 2292 | 105-ValLysGlyGlyAlaAlaGlyGlyGly-113 |
| SEQ. ID. NO. 2293 | 151-GlnGlyAsnGluLeuAsnIleAspProLysArgValLeuTrp-164 |
| SEQ. ID. NO. 2294 | 166-ArgValValAspMetAsnAspArgGlnLeuArgAsnIleIleAspGlyMetGlyLysProValAspGlyValMetArgProAspGlyPheAspIle-197 |
| SEQ. ID. NO. 2295 | 211-LysAspIleSerAspLeuLysGluArgLeuGly-221 |
| SEQ. ID. NO. 2296 | 227-TyrAlaLysAspGlySerProValTyr-235 |
| SEQ. ID. NO. 2297 | 237-LysAspLeuLysAlaAsnGly-243 |
| SEQ. ID. NO. 2298 | 251-AspAlaIleLysProAsnLeu-257 |
| SEQ. ID. NO. 2299 | 287-ArgLeuAlaLysHisLeuAla-293 |
| SEQ. ID. NO. 2300 | 306-LeuGlyAlaGluLysPheCysAspIleLysCysArgLeuAlaGlyLeuLysProAspAla-325 |
| SEQ. ID. NO. 2301 | 335-LeuLysTyrAsnGlyGlyValGluArgAlaAsnLeuGlyGluAsnLeuAspAlaLeuGluLysGlyLeuProAsnLeu-361 |
| SEQ. ID. NO. 2302 | 383-PheValSerAspAlaAspAlaGluLeuAlaMetIleGluLysAlaCysAla-399 |
| SEQ. ID. NO. 2303 | 411-TrpGlyLysGlyGlyAlaGlyGlyAlaAspLeuAlaArgLysValValAsn-427 |
| SEQ. ID. NO. 2304 | 429-IleGluSerGlnThrAsnAsnPheGly-437 |
| SEQ. ID. NO. 2305 | 444-LeuGlyIleLysAspLysIleArgAlaIleAla-454 |
| SEQ. ID. NO. 2306 | 458-TyrGlyAlaGluAspValAspPheSerAla-467 |
| SEQ. ID. NO. 2307 | 474-AlaSerLeuGluLysLeuGlyLeuAspLysMetPro-485 |
| SEQ. ID. NO. 2308 | 494-SerLeuSerAspAsnAlaLys-500 |
| SEQ. ID. NO. 2309 | 503-GlyCysProGluAspPheArgIle-510 |
| SEQ. ID. NO. 2310 | 534-MetProGlyLeuPro-538 |
| SEQ. ID. NO. 2311 | 541-ProAlaAlaGluLysIleAspValAspAlaGluGly-552 |
| Hydrophilic Regions - Hopp-Woods | |
| SEQ. ID. NO. 2312 | 3-PheLysThrAspAlaGluIleAlaGln-11 |
| SEQ. ID. NO. 2313 | 38-TyrLysAlaLysIleAsnPro-44 |
| SEQ. ID. NO. 2314 | 46-GluAlaPheLysLeuProGlnLysGlnGlyArg-56 |
| SEQ. ID. NO. 2315 | 67-ProAlaGlyGluGlyLysThr-73 |
| SEQ. ID. NO. 2316 | 81-AspAlaLeuArgHisIleGlyLysAspAla-90 |
| SEQ. ID. NO. 2317 | 94-LeuArgGluProSer-98 |
| SEQ. ID. NO. 2318 | 155-LeuAsnIleAspProLysArgValLeuTrp-164 |
| SEQ. ID. NO. 2319 | 166-ArgValValAspMetAsnAspArgGlnLeuArgAsnIleIle-179 |
| SEQ. ID. NO. 2320 | 181-GlyMetGlyLysProValAspGlyValMetArgProAspGlyPhe-195 |
| SEQ. ID. NO. 2321 | 211-LysAspIleSerAspLeuLysGluArgLeuGly-221 |
| SEQ. ID. NO. 2322 | 228-AlaLysAspGlySer-232 |
| SEQ. ID. NO. 2323 | 237-LysAspLeuLysAla-241 |
| SEQ. ID. NO. 2324 | 287-ArgLeuAlaLysHisLeuAla-293 |
| SEQ. ID. NO. 2325 | 306-LeuGlyAlaGluLysPheCysAspIleLysCysArgLeuAlaGlyLeuLysProAspAla-325 |
| SEQ. ID. NO. 2326 | 339-GlyGlyValGluArgAlaAsnLeuGlyGluAsnLeuAspAlaLeuGluLysGlyLeu-358 |
| SEQ. ID. NO. 2327 | 383-PheValSerAspAlaAspAlaGluLeuAlaMetIleGluLysAlaCysAla-399 |
| SEQ. ID. NO. 2328 | 420-AspLeuAlaArgLysValValAsn-427 |
| SEQ. ID. NO. 2329 | 444-LeuGlyIleLysAspLysIleArgAlaIleAla-454 |
| SEQ. ID. NO. 2330 | 458-TyrGlyAlaGluAspValAspPheSerAla-467 |
| SEQ. ID. NO. 2331 | 474-AlaSerLeuGluLysLeuGlyLeuAspLysMetPro-485 |
| SEQ. ID. NO. 2332 | 503-GlyCysProGluAspPheArgIle-510 |
| SEQ. ID. NO. 2333 | 541-ProAlaAlaGluLysIleAspValAspAlaGluGly-552 |
| 142-2 | |
| AMPHI Regions - AMPHI | |
| SEQ. ID. NO. 2334 | 26-ArgPheAlaAlaMetProAspValValGlyLys-36 |
| SEQ. ID. NO. 2335 | 44-GlyGlnProGlyLysMetPhe-50 |
| SEQ. ID. NO. 2336 | 100-AlaValThrProCysArg-105 |
| SEQ. ID. NO. 2337 | 107-ValCysArgAspAspMet-112 |
| SEQ. ID. NO. 2338 | 130-PheLeuGlnIleArgHisPheSerProLeu-139 |
| SEQ. ID. NO. 2339 | 174-LeuArgValGlnArgIleLeuAspPheGlyLysPheCysGlnGlnVal-189 |
| SEQ. ID. NO. 2340 | 202-LeuAspSerValValAlaPheValHisPhePheAlaAspPheLeuIle-217 |
| SEQ. ID. NO. 2341 | 239-AlaAspAsnGlnThrArgPhePheLysAlaGly-249 |
| SEQ. ID. NO. 2342 | 259-AsnAlaArgLeuIleArgGlnIleLeuLys-268 |
| Antigenic Index - Jameson-Wolf | |
| SEQ. ID. NO. 2343 | 31-ProAspValValGly-35 |
| SEQ. ID. NO. 2344 | 38-LeuPheGlyArgGlnAlaGlyGlnProGlyLysMet-49 |
| SEQ. ID. NO. 2345 | 59-GlnArgIleAspAlaGluAlaAlaValPheArgGlnAspArgAsnAspSerArgThrProValAspAlaGlnHisHisGlyArgArgLeuValGlyAsnArgArgAspArgArgHisCysAsnAla-100 |
| SEQ. ID. NO. 2346 | 102-ThrProCysArgThrValCysArgAspAspMetAsnAlaCysArgAlaArgCysHisArgIleThrGluArgSerLeu-127 |
| SEQ. ID. NO. 2347 | 147-AlaAlaHisLysAlaSerPro-153 |
| SEQ. ID. NO. 2348 | 155-CysSerSerPheAspSerLysSerArgArgSerAspValSerAlaArgTyr-171 |
| SEQ. ID. NO. 2349 | 180-LeuAspPheGlyLysPheCys-186 |
| SEQ. ID. NO. 2350 | 225-GlnLeuGlnLysAsnThrSer-231 |
| SEQ. ID. NO. 2351 | 237-PheGlnAlaAspAsnGlnThrArgPhePheLysAlaGlyGlnAspThrGlyGlnAlaGlyAlaGlnAsn-259 |
| SEQ. ID. NO. 2352 | 267-LeuLysValGlnArgAlaValPheArgGlnLysThrAspAsnProPro-282 |
| SEQ. ID. NO. 2353 | 291-IleGlnAsnArgProGluLeuGlyHisGlnGly-301 |
| SEQ. ID. NO. 2354 | 307-GlnThrAspIleAspArgArgMetPhe-315 |
| Hydrophilic Regions - Hopp-Woods | |
| SEQ. ID. NO. 2355 | 42-GlnAlaGlyGlnPro-46 |
| SEQ. ID. NO. 2356 | 59-GlnArgIleAspAlaGluAlaAlaValPheArgGlnAspArgAsnAspSerArgThrProValAspAlaGlnHisHisGlyArgArgLeuValGlyAsnArgArgAspArgArgHisCys-98 |
| SEQ. ID. NO. 2357 | 106-ThrValCysArgAspAspMetAsnAlaCysArgAlaArgCysHisArgIleThrGluArgSerLeu-127 |
| SEQ. ID. NO. 2358 | 147-AlaAlaHisLysAlaSerPro-153 |
| SEQ. ID. NO. 2359 | 158-PheAspSerLysSerArgArgSerAspValSerAla-169 |
| SEQ. ID. NO. 2360 | 237-PheGlnAlaAspAsnGlnThrArgPhePheLysAlaGlyGlnAspThrGlyGln-254 |
| SEQ. ID. NO. 2361 | 267-LeuLysValGlnArgAlaValPheArgGlnLysThrAspAsn-280 |
| SEQ. ID. NO. 2362 | 291-IleGlnAsnArgProGluLeuGly-298 |
| SEQ. ID. NO. 2363 | 309-AspIleAspArgArgMetPhe-315 |

TABLE 1-continued 144-2
AMPHI Regions - AMPHI
SEQ. ID. NO. 2364    36-LeuGlyGlyIleValGlnGluPhe-43
SEQ. ID. NO. 2365    45-ValLeuAlaAspGlyValArg-51
SEQ. ID. NO. 2366    71-IleAsnLysGlnIleGlyArgValAlaGlyArg-81
SEQ. ID. NO. 2367    136-SerAlaAspGlyTyr-140
SEQ. ID. NO. 2368    212-SerAspAspLeuGluValPheAspPheSerArgProLys-224
SEQ. ID. NO. 2369    234-ArgArgGluThrGlyArgAlaGlyPhe-242
SEQ. ID. NO. 2370    244-AlaTyrArgValProSerAspIleGlyArgProAlaAla-257
SEQ. ID. NO. 2371    283-ProGlnAspPheAlaArg-288
SEQ. ID. NO. 2372    295-AspAlaLeuAlaThr-299
SEQ. ID. NO. 2373    306-AspSerLeuAsnTrpProGluPheGlyAsn-315
Antigenic Index - Jameson-Wolf
SEQ. ID. NO. 2374    1-MetSerAspThrProAlaThrArgAspPheGlyLeuIleAspGlyArgAla-17
SEQ. ID. NO. 2375    23-LeuSerAsnArgArgGlyThrArg-30
SEQ. ID. NO. 2376    48-AspGlyValArgGlu-52
SEQ. ID. NO. 2377    58-PheAspAspAlaAlaSerTyrAlaAspAsnProPheGlnIleAsn-72
SEQ. ID. NO. 2378    78-ValAlaGlyArgIleArgGlyAlaAla-86
SEQ. ID. NO. 2379    88-AspIleAsnGlyArgThrTyrArgValGluAlaAsnGluGlyArgAsnAlaLeuHisGlyGlySerHis-110
SEQ. ID. NO. 2380    121-AlaAlaAspGlyArgSerValValLeu-129
SEQ. ID. NO. 2381    131-SerArgLeuGlnGlnSerAlaAspGlyTyrProAsnAspLeuAspLeuAspIleSerTyrArgLeuAspGluAspAspArgLeuThrVal-160
SEQ. ID. NO. 2382    199-MetProAlaAspAlaGluLysLeuPro-207
SEQ. ID. NO. 2383    210-ThrValSerAspAspLeuGluValPheAspPheSerArgProLysProLeuAsp-227
SEQ. ID. NO. 2384    232-AlaLeuArgArgGluThrGlyArgAlaGlyPheAspAspAlaTyrArgValProSerAspIleGlyArgPro-255
SEQ. ID. NO. 2385    261-AlaGlyArgArgArgArgIleSerIleTyrSerAspArgAsnGly-275
SEQ. ID. NO. 2386    282-AlaProGlnAspPheAlaArgHisAspAlaGlyVal-293
SEQ. ID. NO. 2387    300-GluAlaGlnThrLeuProAspSerLeuAsnTrpProGlu-312
SEQ. ID. NO. 2388    314-GlyAsnIleArgLeuAsnLysGlyAspThrArgGluAlaThr-327
Hydrophilic Regions - Hopp-Woods
SEQ. ID. NO. 2389    1-MetSerAspThrProAlaThrArgAsp-9
SEQ. ID. NO. 2390    24-SerAsnArgArgGlyThrArg-30
SEQ. ID. NO. 2391    48-AspGlyValArgGlu-52
SEQ. ID. NO. 2392    58-PheAspAspAlaAlaSer-63
SEQ. ID. NO. 2393    78-ValAlaGlyArgIleArgGlyAlaAla-86
SEQ. ID. NO. 2394    89-IleAsnGlyArgThrTyrArgValGluAlaAsnGluGlyArgAsnAlaLeu-105
SEQ. ID. NO. 2395    121-AlaAlaAspGlyArgSerValValLeu-129
SEQ. ID. NO. 2396    131-SerArgLeuGlnGlnSerAlaAspGlyTyrProAsnAspLeuAspLeu-146
SEQ. ID. NO. 2397    150-TyrArgLeuAspGluAspAspArgLeuThrVal-160
SEQ. ID. NO. 2398    199-MetProAlaAspAlaGluLysLeuPro-207
SEQ. ID. NO. 2399    210-ThrValSerAspAspLeuGluVal-217
SEQ. ID. NO. 2400    221-SerArgProLysProLeuAsp-227
SEQ. ID. NO. 2401    232-AlaLeuArgArgGluThrGlyArgAlaGlyPheAspAspAlaTyrArgValProSerAspIleGlyArg-254
SEQ. ID. NO. 2402    261-AlaGlyArgArgArgArgIleSerIleTyrSerAspArgAsnGly-275
SEQ. ID. NO. 2403    285-AspPheAlaArgHisAspAlaGlyVal-293
SEQ. ID. NO. 2404    317-ArgLeuAsnLysGlyAspThrArgGluAlaThr-327
146
AMPHI Regions - AMPHI
SEQ. ID. NO. 2405    19-LysGlnTyrGlyLeuLeuAspPheMetProCys-29
SEQ. ID. NO. 2406    24-ProLeuAspAsnPheProThrVal-41
SEQ. ID. NO. 2407    69-ValAlaAsnLeuArgArg-74
SEQ. ID. NO. 2408    95-LeuArgAlaCysAlaValIleValAlaLysTyrValGlyValPheGlnLys-111
SEQ. ID. NO. 2409    140-AlaArgArgValArg-144
SEQ. ID. NO. 2410    158-ArgHisGlnArgGlyPheAlaArg-165
SEQ. ID. NO. 2411    191-ProIleValSerGlnTrpThrPro-198
Antigenic Index - Jameson-Wolf
SEQ. ID. NO. 2412    6-LeuArgSerArgGlnValValIleAspHisAspLysValLysGln-20
SEQ. ID. NO. 2413    30-LeuArgGlnProProLeuAspAsn-37
SEQ. ID. NO. 2414    41-ValArgProAlaSerValGluAlaArgGlyLysTyrValGluArgArgArgGlnAspLysAspAlaAspGlyPheGlyGlnArg-68
SEQ. ID. NO. 2415    70-AlaAsnLeuArgArgAlaLeu-76
SEQ. ID. NO. 2416    86-AlaCysArgArgGlnArgIleHisThr-94
SEQ. ID. NO. 2417    112-SerPheLeuArgAspLysArgLeuLys-120
SEQ. ID. NO. 2418    138-ArgArgAlaArgArgValArgHisGlyAsnAlaGln-149
SEQ. ID. NO. 2419    155-GlnGlnProArgHisGlnArgGlyPheAla-164
SEQ. ID. NO. 2420    166-AlaGlySerGlyArgAsnAspLysAspValAlaPheSerIle-179
Hydrophilic Regions - Hopp-Woods
SEQ. ID. NO. 2421    6-LeuArgSerArgGlnValValIleAspHisAspLysValLysGln-20
SEQ. ID. NO. 2422    44-AlaSerValGluAlaArgGlyLysTyrValGluArgArgArgGlnAspLysAspAlaAspGlyPheGly-66
SEQ. ID. NO. 2423    70-AlaAsnLeuArgArgAlaLeu-76
SEQ. ID. NO. 2424    86-AlaCysArgArgGlnArgIleHisThr-94
SEQ. ID. NO. 2425    113-PheLeuArgAspLysArgLeuLys-120
SEQ. ID. NO. 2426    138-ArgArgAlaArgArgValArgHisGlyAsn-147
SEQ. ID. NO. 2427    156-GlnProArgHisGlnArgGlyPheAla-164
SEQ. ID. NO. 2428    167-GlySerGlyArgAsnAspLysAspValAla-176
148
AMPHI Regions - AMPHI
SEQ. ID. NO. 2429    25-AlaAspLysIleArgLysIleGluAsnTrpPro-35
SEQ. ID. NO. 2430    49-GlnSerAlaGluTyrPheArgLeuLeuValAspLeu-60

TABLE 1-continued

| | |
|---|---|
| SEQ. ID. NO. 2431 | 150-AlaGlyLeuGluLeuIleArgLysLeuGlyGlyGluIle-162 |
| SEQ. ID. NO. 2432 | 165-AlaAlaAlaIleLeuGluPheThrAspLeuGlnGlyGlyLysAsnIleArg-181 |

Antigenic Index - Jameson-Wolf

| | |
|---|---|
| SEQ. ID. NO. 2433 | 4-LysThrSerAsnLeu-8 |
| SEQ. ID. NO. 2434 | 24-LeuAlaAspLysIleArgLysIleGluAsnTrpProGlnLysGly-38 |
| SEQ. ID. NO. 2435 | 66-MetAspGlnLysIleAspIle-72 |
| SEQ. ID. NO. 2436 | 76-LeuAspAlaArgGly-80 |
| SEQ. ID. NO. 2437 | 97-ProIleArgLysLysGlyLysLeuPro-105 |
| SEQ. ID. NO. 2438 | 117-TyrGlyGluAlaAlaVal-122 |
| SEQ. ID. NO. 2439 | 124-IleHisThrAspAlaValLysLeuGlySer-133 |
| SEQ. ID. NO. 2440 | 153-GluLeuIleArgLysLeuGlyGlyGluIleValGlu-164 |
| SEQ. ID. NO. 2441 | 172-ThrAspLeuGlnGlyGlyLysAsnIleArgAlaSerGlyAlaPro-186 |
| SEQ. ID. NO. 2442 | 192-GlnAsnGluGlyCysMetLysGly-199 |

Hydrophilic Regions - Hopp-Woods

| | |
|---|---|
| SEQ. ID. NO. 2443 | 24-LeuAlaAspLysIleArgLysIleGluAsnTrpPro-35 |
| SEQ. ID. NO. 2444 | 66-MetAspGlnLysIleAspIle-72 |
| SEQ. ID. NO. 2445 | 97-ProIleArgLysLysGlyLysLeuPro-105 |
| SEQ. ID. NO. 2446 | 117-TyrGlyGluAlaAlaVal-122 |
| SEQ. ID. NO. 2447 | 124-IleHisThrAspAlaValLysLeuGlySer-133 |
| SEQ. ID. NO. 2448 | 153-GluLeuIleArgLysLeuGlyGlyGluIleValGlu-164 |
| SEQ. ID. NO. 2449 | 178-LysAsnIleArgAlaSerGly-184 |
| SEQ. ID. NO. 2450 | 195-GlyCysMetLysGly-199 |

149-2
AMPHI Regions - AMPHI

| | |
|---|---|
| SEQ. ID. NO. 2451 | 78-AsnLeuGlyAspAlaLeuAspGlyValProGlyIle-89 |
| SEQ. ID. NO. 2452 | 107-ThrGlyArgArgIleLysValLeuAsnHisHisGlyGluThrGlyAspMet-123 |
| SEQ. ID. NO. 2453 | 141-GlnValGluIleLeuArgGlyProValThr-150 |
| SEQ. ID. NO. 2454 | 158-ValAlaGlyLeuValAsp-163 |
| SEQ. ID. NO. 2455 | 170-ProGluLysMetProGluAsnGlyVal-178 |
| SEQ. ID. NO. 2456 | 190-AsnLeuGluLysLeu-194 |
| SEQ. ID. NO. 2457 | 226-TyrArgAsnLeuLysArgLeuProAspSerHis-236 |
| SEQ. ID. NO. 2458 | 351-PheProGlyPheGlu-355 |
| SEQ. ID. NO. 2459 | 372-AlaGlyAspAlaValGluAsnPhePheAsnAsn-382 |
| SEQ. ID. NO. 2460 | 395-ProIleGlyArgLeuLys-400 |
| SEQ. ID. NO. 2461 | 415-LeuSerAlaIleSerGluAlaVal-422 |
| SEQ. ID. NO. 2462 | 571-ArgPheGlyAsnTyrIleTyrAlaGln-579 |
| SEQ. ID. NO. 2463 | 582-AsnAspGlyArgGlyProLysSerIleGluAsp-592 |
| SEQ. ID. NO. 2464 | 633-ArgGlyArgLeuLysAsnLeuProSer-641 |

Antigenic Index - Jameson-Wolf

| | |
|---|---|
| SEQ. ID. NO. 2465 | 1-MetArgArgGluAlaLysMetAla-8 |
| SEQ. ID. NO. 2466 | 31-HisGluThrGluGlnSerValAspLeuGluThr-41 |
| SEQ. ID. NO. 2467 | 46-GlyLysSerArgProArgAlaThrSerGly-55 |
| SEQ. ID. NO. 2468 | 61-ThrAlaSerAspLysIleIleSerGlyAspThrLeuArgGlnLysAla-76 |
| SEQ. ID. NO. 2469 | 103-IleArgGlyGlnThrGlyArgArgIleLysVal-113 |
| SEQ. ID. NO. 2470 | 115-AsnHisHisGlyGluThrGlyAspMetAlaAspPheSerProAspHis-130 |
| SEQ. ID. NO. 2471 | 143-GluIleLeuArgGlyPro-148 |
| SEQ. ID. NO. 2472 | 163-AspValAlaAspGlyLysIleProGluLysMetProGluAsnGlyValSerGlyGluLeuGlyLeu-184 |
| SEQ. ID. NO. 2473 | 186-LeuSerSerGlyAsnLeuGluLysLeuThrSerGlyGly-198 |
| SEQ. ID. NO. 2474 | 213-GlyLeuTyrArgLysSerGlyAspTyrAlaValProArgTyrArgAsnLeuLysArgLeuProAspSerHisAlaAspSerGlnThrGly-242 |
| SEQ. ID. NO. 2475 | 250-GlyGluLysGlyPhe-254 |
| SEQ. ID. NO. 2476 | 258-AlaTyrSerAspArgArgAspGlnTyrGly-267 |
| SEQ. ID. NO. 2477 | 269-ProAlaHisSerHisGluTyrAspAspCysHisAla-280 |
| SEQ. ID. NO. 2478 | 287-SerLeuIleAsnLysArgTyrLeu-294 |
| SEQ. ID. NO. 2479 | 301-LeuThrGluGluAspIleAspTyrAspAsnProGlyLeu-313 |
| SEQ. ID. NO. 2480 | 316-GlyPheHisAspAspAspAsnAlaHis-324 |
| SEQ. ID. NO. 2481 | 326-HisThrHisSerGlyArgProTrpIleAspLeuArgAsnLysArgTyrGluLeuArgAlaGluTrpLysGlnProPheProGly-353 |
| SEQ. ID. NO. 2482 | 360-HisLeuAsnArgAsnAspTyrArgHisAspGluLysAlaGlyAspAlaVal-376 |
| SEQ. ID. NO. 2483 | 380-PheAsnAsnGlnThrGlnAsnAlaArgIleGluLeuArgHisGlnProIleGlyArgLeuLysGlySerTrp-403 |
| SEQ. ID. NO. 2484 | 408-LeuGlnGlnLysSerSerAla-414 |
| SEQ. ID. NO. 2485 | 428-LeuAspAsnLysVal-432 |
| SEQ. ID. NO. 2486 | 443-AlaAsnTrpAspAsnPheThrLeuGluGlyGlyValArgValGluLysGlnLysAlaSerIleGlnTyrAspLysAlaLeuIleAspArgGluAsnTyrTyrAsnHisProLeuProAsp-482 |
| SEQ. ID. NO. 2487 | 484-GlyAlaHisArgGlnThrAla-490 |
| SEQ. ID. NO. 2488 | 512-SerHisGlnGluArgLeuProSerThrGlnGluLeuTyrAlaHisGly-527 |
| SEQ. ID. NO. 2489 | 537-ValGlyAsnLysHisLeuAsnLysGluArgSerAsnAsnIle-550 |
| SEQ. ID. NO. 2490 | 556-TyrGluGlyAspArgTrpGln-562 |
| SEQ. ID. NO. 2491 | 568-TyrArgAsnArgPheGlyAsn-574 |
| SEQ. ID. NO. 2492 | 580-ThrLeuAsnAspGlyArgGlyProLysSerIleGluAspAspSerGluMetLysLeu-598 |
| SEQ. ID. NO. 2493 | 600-ArgTyrAsnGlnSerGlyAlaAspPheTyrGlyAlaGluGly-613 |
| SEQ. ID. NO. 2494 | 615-IleTyrPheLysProThrProArgTyrArgIle-625 |
| SEQ. ID. NO. 2495 | 627-ValSerGlyAspTyrValArgGlyArgLeuLysAsnLeuProSerLeuProGlyArgGluAspAlaTyrGlyAsnArgPro-653 |
| SEQ. ID. NO. 2496 | 655-IleAlaGlnAspAspGlnAsnAlaProArgValProAla-667 |
| SEQ. ID. NO. 2497 | 677-SerLeuThrAspArgIleAspAla-684 |
| SEQ. ID. NO. 2498 | 695-AsnLysLeuAlaArgTyrGluThrArgThrProGlyHis-707 |
| SEQ. ID. NO. 2499 | 713-GlyAlaAsnTyrArgArgAsnThrArgTyrGlyGluTrp-725 |
| SEQ. ID. NO. 2500 | 731-AlaAspAsnLeuLeu-735 |
| SEQ. ID. NO. 2501 | 745-PheLeuSerAspThrProGlnMetGlyArgSerPheThrGlyGlyVal-760 |

Hydrophilic Regions - Hopp-Woods

| | |
|---|---|
| SEQ. ID. NO. 2502 | 1-MetArgArgGluAlaLysMetAla-8 |
| SEQ. ID. NO. 2503 | 31-HisGluThrGluGlnSerValAspLeuGluThr-41 |

TABLE 1-continued

| | |
|---|---|
| SEQ. ID. NO. 2504 | 46-GlyLysSerArgProArgAlaThr-53 |
| SEQ. ID. NO. 2505 | 61-ThrAlaSerAspLysIleIleSer-68 |
| SEQ. ID. NO. 2506 | 70-AspThrLeuArgGlnLysAla-76 |
| SEQ. ID. NO. 2507 | 106-GlnThrGlyArgArgIleLysVal-113 |
| SEQ. ID. NO. 2508 | 118-GlyGluThrGlyAspMetAlaAspPheSerPro-128 |
| SEQ. ID. NO. 2509 | 163-AspValAlaAspGlyLysIleProGluLysMetProGluAsnGlyValSer-179 |
| SEQ. ID. NO. 2510 | 187-SerSerGlyAsnLeuGluLysLeuThr-195 |
| SEQ. ID. NO. 2511 | 213-GlyLeuTyrArgLysSerGlyAsp-220 |
| SEQ. ID. NO. 2512 | 225-ArgTyrArgAsnLeuLysArgLeuProAspSerHisAlaAspSerGlnThr-241 |
| SEQ. ID. NO. 2513 | 259-TyrSerAspArgArgAspGlnTyr-266 |
| SEQ. ID. NO. 2514 | 273-HisGluTyrAspAspCysHisAla-280 |
| SEQ. ID. NO. 2515 | 301-LeuThrGluGluAspIleAspTyrAspAsn-310 |
| SEQ. ID. NO. 2516 | 317-PheHisAspAspAsnAlaHis-324 |
| SEQ. ID. NO. 2517 | 336-LeuArgAsnLysArgTyrGluLeuArgAlaGluTrp-347 |
| SEQ. ID. NO. 2518 | 360-HisLeuAsnArgAsnAspTyrArgHisAspGluLysAlaGlyAspAlaVal-376 |
| SEQ. ID. NO. 2519 | 384-ThrGlnAsnAlaArgIleGluLeuArgHis-393 |
| SEQ. ID. NO. 2520 | 397-GlyArgLeuLysGly-401 |
| SEQ. ID. NO. 2521 | 452-GlyGlyValArgValGluLysGlnLysAla-461 |
| SEQ. ID. NO. 2522 | 468-AlaLeuIleAspArgGluAsnTyr-475 |
| SEQ. ID. NO. 2523 | 484-GlyAlaHisArgGlnThrAla-490 |
| SEQ. ID. NO. 2524 | 512-SerHisGlnGluArgLeuProSer-519 |
| SEQ. ID. NO. 2525 | 541-HisLeuAsnLysGluArgSerAsnAsn-549 |
| SEQ. ID. NO. 2526 | 556-TyrGluGlyAspArgTrp-561 |
| SEQ. ID. NO. 2527 | 581-LeuAsnAspGlyArgGlyProLysSerIleGluAspAspSerGluMetLysLeu-598 |
| SEQ. ID. NO. 2528 | 609-TyrGlyAlaGluGly-613 |
| SEQ. ID. NO. 2529 | 619-ProThrProArgTyrArgIle-625 |
| SEQ. ID. NO. 2530 | 630-AspTyrValArgGlyArgLeuLysAsn-638 |
| SEQ. ID. NO. 2531 | 643-ProGlyArgGluAspAlaTyrGly-650 |
| SEQ. ID. NO. 2532 | 655-IleAlaGlnAspAspGlnAsnAlaProArgValProAla-667 |
| SEQ. ID. NO. 2533 | 677-SerLeuThrAspArgIleAspAla-684 |
| SEQ. ID. NO. 2534 | 696-LysLeuAlaArgTyrGluThrArgThrProGly-706 |
| SEQ. ID. NO. 2535 | 715-AsnTyrArgArgAsnThrArgTyrGly-723 |

150-2
AMPHI Regions - AMPHI

| | |
|---|---|
| SEQ. ID. NO. 2536 | 20-IleThrGlnLeuLeuSerGlyLeuAsp-28 |
| SEQ. ID. NO. 2537 | 80-ValAlaAspLysAlaAlaAspSerLeuGlu-89 |
| SEQ. ID. NO. 2538 | 138-AsnGlyLysLysAlaProLysLeu-145 |
| SEQ. ID. NO. 2539 | 159-SerTyrProAsnPheCysGlnAlaGlyLysAspPheAspArgArgPheGlu-175 |
| SEQ. ID. NO. 2540 | 198-AlaTrpThrAspAsnIleAla-204 |
| SEQ. ID. NO. 2541 | 223-ThrProProAlaGlyLeuGln-229 |
| SEQ. ID. NO. 2542 | 293-ArgGluIleLeuAspLeuLeu-299 |
| SEQ. ID. NO. 2543 | 316-ValAlaArgAlaLeuSer-321 |
| SEQ. ID. NO. 2544 | 333-PheValLysGlyTyrAlaAlaPheAlaHisTyrGluGluLeuAspLysIleIle-350 |
| SEQ. ID. NO. 2545 | 365-IleValAspValLeuHisArgPheProAlaSerLeu-376 |
| SEQ. ID. NO. 2546 | 379-GluGlnPheIleArgLeuLeuArgProLeuAla-389 |
| SEQ. ID. NO. 2547 | 468-GlyValAlaProPheArg-473 |
| SEQ. ID. NO. 2548 | 505-ThrGluTrpGlnGlnPheAlaLys-512 |
| SEQ. ID. NO. 2549 | 537-IleArgGluGlnAla-541 |
| SEQ. ID. NO. 2550 | 560-AlaAlaLysMetAlaLysAspValGluAlaAlaLeuLeuAspValIle-575 |
| SEQ. ID. NO. 2551 | 588-GluTyrLeuAspMetLeuArgGluGlu-596 |

Antigenic Index - Jameson-Wolf

| | |
|---|---|
| SEQ. ID. NO. 2552 | 1-MetSerGluHisAspMetGlnAsnThrAsnProPro-12 |
| SEQ. ID. NO. 2553 | 16-LeuProProGluIle-20 |
| SEQ. ID. NO. 2554 | 42-LysAlaGlyAsnGlyAlaSerAlaGlyLeu-51 |
| SEQ. ID. NO. 2555 | 72-SerGlnThrGlyAsnAlaLysSerValAlaAspLysAlaAlaAspSerLeuGlu-89 |
| SEQ. ID. NO. 2556 | 96-SerArgAlaGluLeuLysAspTyrLysAlaLysAsnIleAlaGlyGluArgArgLeu-114 |
| SEQ. ID. NO. 2557 | 118-ThrSerThrGlnGlyGluGlyGluProProLysGluAlaValVal-132 |
| SEQ. ID. NO. 2558 | 137-LeuAsnGlyLysLysAlaProLysLeuAspLys-147 |
| SEQ. ID. NO. 2559 | 154-GlyLeuGlyAspSerSerTyrProAsnPheCysGlnAlaGlyLysAspPheAspArgArgPheGluGluLeuGlyAlaLysArgLeuLeuGluArgVal AspAlaAspLeuAspPhe-192 |
| SEQ. ID. NO. 2560 | 207-LeuLysGluGluAlaAlaLysAsnArgAlaThrProAlaProGlnThrThrProProAlaGlyLeuGlnThrAlaProAspGlyArgTyrCysLys-238 |
| SEQ. ID. NO. 2561 | 250-GlnLysIleThrAlaArgGlnSerAspLysAspValArgHisIleGluIleGluAspLeuSerGlySerAspLeu-273 |
| SEQ. ID. NO. 2562 | 276-LeuProGlyAspAla-280 |
| SEQ. ID. NO. 2563 | 285-PheAspAsnAspProAlaLeuVal-292 |
| SEQ. ID. NO. 2564 | 302-AspProAlaThrGluIleGlnAlaGlyGlyLysMetMetPro-315 |
| SEQ. ID. NO. 2565 | 324-PheGluLeuThrGlnAsnThrProAlaPhe-333 |
| SEQ. ID. NO. 2566 | 344-GluGluLeuAspLysIleIleAla-351 |
| SEQ. ID. NO. 2567 | 397-SerAlaGlnAlaGluValGlyAspGluValHis-407 |
| SEQ. ID. NO. 2568 | 415-PheGluHisGluGlyArgAlaArgThrGlyGlyAlaSerGlyPheLeu-430 |
| SEQ. ID. NO. 2569 | 432-AspArgLeuGluGluAspGlyThrVal-440 |
| SEQ. ID. NO. 2570 | 443-PheValGluArgAsnAspGlyPheArgLeuProGluAspSerArgLysPro-459 |
| SEQ. ID. NO. 2571 | 464-GlySerGlyThrGly-468 |
| SEQ. ID. NO. 2572 | 478-GlnArgAlaAlaGluAsnAlaGluGlyLysAsn-488 |
| SEQ. ID. NO. 2573 | 509-GlnPheAlaLysAspGlyPheLeuHisArgTyrAspPheAlaTrpSerArgAspGlnGluGluLysIleTyrVal-533 |
| SEQ. ID. NO. 2574 | 535-AspLysIleArgGluGlnAlaGlu-542 |
| SEQ. ID. NO. 2575 | 559-AspAlaAlaLysMetAlaLysAspValGlu-568 |
| SEQ. ID. NO. 2576 | 579-GlyHisLeuAspGluGluGlyAlaGluGluThrTyrLeuAspMetLeuArgGluGluLysArgTyrGlnArgAspValTyr |

Hydrophilic Regions - Hopp-Woods

| | |
|---|---|
| SEQ. ID. NO. 2577 | 1-MetSerGluHisAspMetGlnAsn-8 |
| SEQ. ID. NO. 2578 | 75-GlyAsnAlaLysSerValAlaAspLysAlaAlaAspSerLeuGlu-89 |

TABLE 1-continued

| | |
|---|---|
| SEQ. ID. NO. 2579 | 96-SerArgAlaGluLeuLysAspTyrLysAlaLysAsnIleAlaGlyGluArgArgLeu-114 |
| SEQ. ID. NO. 2580 | 120-ThrGlnGlyGluGlyGluProProLysGluAlaValVal-132 |
| SEQ. ID. NO. 2581 | 137-LeuAsnGlyLysLysAlaProLysLeuAspLys-147 |
| SEQ. ID. NO. 2582 | 166-AlaGlyLysAspPheAspArgArgPheGluGluLeuGlyAlaLysArgLeuLeuGluArgValAspAlaAspLeuAspPhe-192 |
| SEQ. ID. NO. 2583 | 207-LeuLysGluGluAlaAlaLysAsnArgAlaThrPro-218 |
| SEQ. ID. NO. 2584 | 230-ThrAlaProAspGlyArgTyrCysLys-238 |
| SEQ. ID. NO. 2585 | 251-LysIleThrAlaArgGlnSerAspLysAspValArgHisIleGluIleAspLeuSerGly-270 |
| SEQ. ID. NO. 2586 | 288-AspProAlaLeuVal-292 |
| SEQ. ID. NO. 2587 | 344-GluGluLeuAspLysIleIleAla-351 |
| SEQ. ID. NO. 2588 | 398-AlaGlnAlaGluValGlyAspGluValHis-407 |
| SEQ. ID. NO. 2589 | 415-PheGluHisGluGlyArgAlaArgThrGlyGly-425 |
| SEQ. ID. NO. 2590 | 432-AspArgLeuGluGluAspGlyThrVal-440 |
| SEQ. ID. NO. 2591 | 443-PheValGluArgAsnAspGlyPheArgLeuProGluAspSerArgLysPro-459 |
| SEQ. ID. NO. 2592 | 479-ArgAlaAlaGluAsnAlaGluGlyLys-487 |
| SEQ. ID. NO. 2593 | 523-TrpSerArgAspGlnGluGluLysIleTyrVal-533 |
| SEQ. ID. NO. 2594 | 535-AspLysIleArgGluGlnAlaGlu-542 |
| SEQ. ID. NO. 2595 | 559-AspAlaAlaLysMetAlaLysAspValGlu-568 |
| SEQ. ID. NO. 2596 | 580-HisLeuAspGluGluGlyAlaGluGluTyrLeuAspMetLeuArgGluGluLysArgTyrGlnArgAspValTyr-604 |
| 151 | |
| AMPHI Regions - AMPHI | |
| SEQ. ID. NO. 2597 | 6-AsnIleAlaIleIleAla-11 |
| SEQ. ID. NO. 2598 | 22-AspGlnLeuLeuArg-26 |
| SEQ. ID. NO. 2599 | 72-ValAspThrProGlyHis-77 |
| SEQ. ID. NO. 2600 | 81-GlyGlyGluValGluArgValLeuGlyMetValAspCysVal-94 |
| SEQ. ID. NO. 2601 | 128-LysIleAspLysPro-132 |
| SEQ. ID. NO. 2602 | 144-PheGluLeuPheAspAsnLeuGlyAlaThr-153 |
| SEQ. ID. NO. 2603 | 165-SerGlyLeuSerGlyPheAlaLysLeuGluGluThrAspGluSerAsn-180 |
| SEQ. ID. NO. 2604 | 184-ProLeuPheAspThrIleLeuLysTyrThr-193 |
| SEQ. ID. NO. 2605 | 248-GlyArgIleAsnGlnLeuLeuGlyPheLysGlyLeuGluArgVal-262 |
| SEQ. ID. NO. 2606 | 273-ValIleIleSerGlyIleGlu-279 |
| SEQ. ID. NO. 2607 | 330-IleArgAspArgLeuGlnLysGluLeu-338 |
| SEQ. ID. NO. 2608 | 348-AspThrAlaAspAla-352 |
| SEQ. ID. NO. 2609 | 396-CysGluProTyrGluAsnLeuThrValAsp-405 |
| SEQ. ID. NO. 2610 | 457-LeuThrArgGlyValGly-462 |
| SEQ. ID. NO. 2611 | 464-MetSerHisValPheAsp-469 |
| SEQ. ID. NO. 2612 | 537-LysGlyLysLysLeuThrAsnIle-544 |
| SEQ. ID. NO. 2613 | 551-GluAlaValArgLeuThrThr-557 |
| Antigenic Index - Jameson-Wolf | |
| SEQ. ID. NO. 2614 | 1-MetLysGlnIleArg-5 |
| SEQ. ID. NO. 2615 | 13-ValAspHisGlyLysThrThrLeu-20 |
| SEQ. ID. NO. 2616 | 24-LeuLeuArgGlnSerGlyThrPheArgAlaAsnGlnGlnValAspGluArgValMetAspSerAsnAspLeuGluLysGluArgGlyIle-53 |
| SEQ. ID. NO. 2617 | 59-AsnThrAlaIleAspTyrGluGlyTyr-67 |
| SEQ. ID. NO. 2618 | 72-ValAspThrProGlyHisAlaAspPheGlyGlyGluValGluArg-86 |
| SEQ. ID. NO. 2619 | 99-AspAlaGlnGluGlyProMetProGlnThrArgPheValThr-112 |
| SEQ. ID. NO. 2620 | 128-LysIleAspLysProSerAlaArgProSerTrp-138 |
| SEQ. ID. NO. 2621 | 151-GlyAlaThrAspGluGlnLeuAsp-158 |
| SEQ. ID. NO. 2622 | 171-AlaLysLeuGluGluThrAspGluSerAsnAspMetArgProLeu-185 |
| SEQ. ID. NO. 2623 | 193-ThrProAlaProSerGlySerAlaAspGluThrLeu-204 |
| SEQ. ID. NO. 2624 | 211-LeuAspTyrAspAsnTyrThrGly-218 |
| SEQ. ID. NO. 2625 | 226-LeuAsnGlyArgIleLysProGlyGln-234 |
| SEQ. ID. NO. 2626 | 240-AsnHisAspGlnGlnIleAla-246 |
| SEQ. ID. NO. 2627 | 257-LysGlyLeuGluArgValProLeuGluGluAlaGluAlaGlyAsp-271 |
| SEQ. ID. NO. 2628 | 277-GlyIleGluAspIleGly-282 |
| SEQ. ID. NO. 2629 | 287-IleThrLysAspAsnProLysGlyLeuPro-297 |
| SEQ. ID. NO. 2630 | 300-SerValAspGluProThrLeu-306 |
| SEQ. ID. NO. 2631 | 314-ThrSerProLeuAlaGlyThrGluGlyLysPheValThrSerArgGlnIleArgAspArgLeuGlnLysGluLeuLeu-339 |
| SEQ. ID. NO. 2632 | 344-LeuArgValGluAspThrAlaAspAlaAspValPheArgValSerGlyArgGlyGluLeu-363 |
| SEQ. ID. NO. 2633 | 371-AsnMetArgArgGluGlyTyr-377 |
| SEQ. ID. NO. 2634 | 381-ValGlyLysProArgValValTyrArgArgPheAspIleAspGlyGlnLysCysGluProTyrGluAsnLeuThrValAspValProAspAspAsnGlnGlyAla<br>ValMetGluGluLeuGlyArgArgArgGlyGluLeuThrAsnMetGluSerAspGlyAsnGlyArgThrArgLeuGluTyr-440 |
| SEQ. ID. NO. 2635 | 467-ValPheAspAspTyrAlaProValLysProAspMetProGlyArgHisAsnGly-484 |
| SEQ. ID. NO. 2636 | 489-GlnGluGlnGlyGlu-493 |
| SEQ. ID. NO. 2637 | 501-AsnLeuGluAspArgGlyArgMetPheValSerProAsnAspLysIleTyr-517 |
| SEQ. ID. NO. 2638 | 524-IleHisSerArgAspAsnAspLeu-531 |
| SEQ. ID. NO. 2639 | 535-ProLeuLysGlyLysLysLeuThrAsnIleArgAlaSerGlyThrAspGluAlaValArg-554 |
| SEQ. ID. NO. 2640 | 569-PheIleAspAspAspGluLeuValGlu-577 |
| SEQ. ID. NO. 2641 | 579-ThrProGlnSerIleArgLeuArgLysArgTyrLeuSerGluLeuGluArgArgHisPheLysLysLeuAsp-603 |
| Hydrophilic Regions - Hopp-Woods | |
| SEQ. ID. NO. 2642 | 1-MetLysGlnIleArg-5 |
| SEQ. ID. NO. 2643 | 29-GlyThrPheArgAla-33 |
| SEQ. ID. NO. 2644 | 35-GlnGlnValAspGluArgValMetAspSerAsnAspLeuGluLysGluArgGlyIle-53 |
| SEQ. ID. NO. 2645 | 80-PheGlyGlyGluValGluArg-86 |
| SEQ. ID. NO. 2646 | 99-AspAlaGlnGluGlyProMetPro-106 |
| SEQ. ID. NO. 2647 | 128-LysIleAspLysProSerAla-134 |
| SEQ. ID. NO. 2648 | 151-GlyAlaThrAspGluGlnLeuAsp-158 |
| SEQ. ID. NO. 2649 | 171-AlaLysLeuGluGluThrAspGluSerAsnAspMetArgProLeu-185 |
| SEQ. ID. NO. 2650 | 198-GlySerAlaAspGluThrLeu-204 |
| SEQ. ID. NO. 2651 | 226-LeuAsnGlyArgIleLysPro-232 |
| SEQ. ID. NO. 2652 | 241-HisAspGlnGlnIleAla-246 |
| SEQ. ID. NO. 2653 | 258-GlyLeuGluArgValProLeuGluGluAlaGluAlaGlyAsp-271 |

TABLE 1-continued

| SEQ. ID. NO. 2654 | 277-GlyIleGluAspIleGly-282 |
| SEQ. ID. NO. 2655 | 287-IleThrAspLysAspAsnProLysGly-295 |
| SEQ. ID. NO. 2656 | 300-SerValAspGluProThrLeu-306 |
| SEQ. ID. NO. 2657 | 318-AlaGlyThrGluGlyLysPheValThr-326 |
| SEQ. ID. NO. 2658 | 328-ArgGlnIleArgAspArgLeuGlnLysGluLeuLeu-339 |
| SEQ. ID. NO. 2659 | 344-LeuArgValGluAspThrAlaAspAlaAspValPheArgValSerGlyArgGlyGluLeu-363 |
| SEQ. ID. NO. 2660 | 371-AsnMetArgArgGluGlyTyr-377 |
| SEQ. ID. NO. 2661 | 381-ValGlyLysProArgValValTyrArgAspIleAspGlyGlnLysCysGluProTyrGlu-400 |
| SEQ. ID. NO. 2662 | 405-AspValProAspAspAsnGlnGlyAlaValMetGluGluLeuGlyArgArgArgGlyGluLeuThrAsnMetGluSerAspGlyAsnGlyArgThrArgLeu-438 |
| SEQ. ID. NO. 2663 | 472-AlaProValLysProAspMetProGlyArgHis-482 |
| SEQ. ID. NO. 2664 | 489-GlnGluGlnGlyGlu-493 |
| SEQ. ID. NO. 2665 | 502-LeuGluAspArgGlyArgMet-508 |
| SEQ. ID. NO. 2666 | 512-ProAsnAspLysIleTyr-517 |
| SEQ. ID. NO. 2667 | 525-HisSerArgAspAsnAspLeu-531 |
| SEQ. ID. NO. 2668 | 536-LeuLysGlyLysLysLeuThrAsn-543 |
| SEQ. ID. NO. 2669 | 545-ArgAlaSerGlyThrAspGluAlaValArg-554 |
| SEQ. ID. NO. 2670 | 569-PheIleAspAspAspGluLeuValGlu-577 |
| SEQ. ID. NO. 2671 | 583-IleArgLeuArgLysArgTyrLeuSerGluLeuGluArgArgArgHisPheLysLysLeuAsp-603 |

152
AMPHI Regions - AMPHI

| SEQ. ID. NO. 2672 | 10-LeuProThrArgLeuPhe-15 |
| SEQ. ID. NO. 2673 | 66-ArgPheSerArgPheValGlnGlyTrpAlaGlyIleArgGlyTyrLeuLysAsnGlyIleProGluHisIleGlnProGlyHisAsnProLeu-96 |
| SEQ. ID. NO. 2674 | 103-AlaLeuLeuAlaAla-107 |
| SEQ. ID. NO. 2675 | 130-LeuAsnHisLeuValSerGluHisThrGlySerLeu-141 |
| SEQ. ID. NO. 2676 | 150-PheLysLeuLeuAlaValPheSerAlaIleHisIleAlaAlaValAlaAlaTyr-167 |

Antigenic Index - Jameson-Wolf

| SEQ. ID. NO. 2677 | 1-MetLysAsnLysThrLysVal-7 |
| SEQ. ID. NO. 2678 | 29-SerAlaLysAlaGlyGlyAsp-35 |
| SEQ. ID. NO. 2679 | 61-GlySerAspThrAlaArgPheSerArg-69 |
| SEQ. ID. NO. 2680 | 79-GlyTyrLeuLysAsnGlyIleProGluHisIleGlnProGlyHisAsnProLeu-96 |
| SEQ. ID. NO. 2681 | 118-AlaAlaAspGluAsnThrPheSerThrAsnGlyTyr-129 |
| SEQ. ID. NO. 2682 | 137-HisThrGlySerLeuMetArg-143 |
| SEQ. ID. NO. 2683 | 169-ValPheLysLysLysAsnLeu-175 |
| SEQ. ID. NO. 2684 | 186-IleGluGlyLysThrSerIle-192 |

Hydrophilic Regions - Hopp-Woods

| SEQ. ID. NO. 2685 | 1-MetLysAsnLysThrLysVal-7 |
| SEQ. ID. NO. 2686 | 63-AspThrAlaArgPhe-67 |
| SEQ. ID. NO. 2687 | 118-AlaAlaAspGluAsnThrPhe-124 |
| SEQ. ID. NO. 2688 | 169-ValPheLysLysLysAsnLeu-175 |
| SEQ. ID. NO. 2689 | 186-IleGluGlyLysThrSerIle-192 |

153
AMPHI Regions - AMPHI

| SEQ. ID. NO. 2690 | 17-AlaAlaSerValLeuSerLeuProGluMetMetArgLeuMetValPhe-32 |
| SEQ. ID. NO. 2691 | 96-ThrLeuValAlaTyrIleLysLeuSerSerValAlaGlu-108 |
| SEQ. ID. NO. 2692 | 130-ValSerValProGlnHisTrp-136 |
| SEQ. ID. NO. 2693 | 222-ValAsnThrIleLeuAsnGlyIleAlaTyr-231 |
| SEQ. ID. NO. 2694 | 274-AlaLysLeuSerHisLeuTyrArgIleThrGluAlaValGlyArgTrpSerMetIleAspIlePheValIle-298 |

Antigenic Index - Jameson-Wolf

| SEQ. ID. NO. 2695 | 65-IleArgLysGlnAla-69 |
| SEQ. ID. NO. 2696 | 81-ValArgLeuArgGln-85 |
| SEQ. ID. NO. 2697 | 107-AlaGluValArgPhe-111 |
| SEQ. ID. NO. 2698 | 143-ArgLeuThrGlyAspAsnAlaValGlnThrAlaSerGluGlyLysThrCysCysSer-161 |
| SEQ. ID. NO. 2699 | 165-TyrPheArgAspSerAlaGluSerProCysGly-175 |
| SEQ. ID. NO. 2700 | 180-GluLeuTyrArgArgArgProLysSerLeuSer-190 |
| SEQ. ID. NO. 2701 | 215-SerAsnProAlaAlaThr-220 |
| SEQ. ID. NO. 2702 | 234-AspGluGlyAspArgLeu-239 |
| SEQ. ID. NO. 2703 | 272-ThrGlyAlaLysLysLeu-277 |
| SEQ. ID. NO. 2704 | 339-LeuLeuTrpAspLysArgAlaSerAspGlyIleAla-350 |
| SEQ. ID. NO. 2705 | 352-AsnGluThrGluLysHisAsp-358 |

Hydrophilic Regions - Hopp-Woods

| SEQ. ID. NO. 2706 | 81-ValArgLeuArgGln-85 |
| SEQ. ID. NO. 2707 | 107-AlaGluValArgPhe-111 |
| SEQ. ID. NO. 2708 | 152-ThrAlaSerGluGlyLysThrCysCys-160 |
| SEQ. ID. NO. 2709 | 168-AspSerAlaGluSerPro-173 |
| SEQ. ID. NO. 2710 | 180-GluLeuTyrArgArgArgProLysSerLeuSer-190 |
| SEQ. ID. NO. 2711 | 234-AspGluGlyAspArgLeu-239 |
| SEQ. ID. NO. 2712 | 273-GlyAlaLysLysLeu-277 |
| SEQ. ID. NO. 2713 | 339-LeuLeuTrpAspLysArgAlaSerAsp-347 |
| SEQ. ID. NO. 2714 | 352-AsnGluThrGluLysHisAsp |

154
AMPHI Regions - AMPHI

| SEQ. ID. NO. 2715 | 122-GlyValThrGlyLeuGlyThrLeuLeu-130 |
| SEQ. ID. NO. 2716 | 152-GlnAspIleProProValThr-158 |
| SEQ. ID. NO. 2717 | 262-ThrLysAsnSerLysAsnValLysSer-270 |
| SEQ. ID. NO. 2718 | 298-PheLysGlnSerVal-302 |
| SEQ. ID. NO. 2719 | 360-SerLysGluHisTrpLysGlnGlnPheGlnThrAlaLeuAsnLysGlyLeuThrAla-378 |
| SEQ. ID. NO. 2720 | 389-SerLysMetIleGluLeuAsnAsp-396 |
| SEQ. ID. NO. 2721 | 429-LysLeuAlaAspLeuLeuAspLysPheAspLysLeuPro-441 |
| SEQ. ID. NO. 2722 | 446-ValAlaGluLeuAsnGly-451 |

TABLE 1-continued

| | |
|---|---|
| SEQ. ID. NO. 2723 | 467-LeuSerSerIleAspLysLeuValGlyLysProGlnThrGlnAsnIleProAsnGluLeuAsnGlnThrLeuLysGluLeuArgThrThr-496 |
| SEQ. ID. NO. 2724 | 506-IleTyrGlyAspValGlnAsnThrLeuGlnSerLeuAspLysThrLeuLysAspValGlnProValIleAsnThrLeuLysGluLys-534 |

Antigenic Index - Jameson-Wolf

| | |
|---|---|
| SEQ. ID. NO. 2725 | 1-MetThrAspAsnSerProProProAsnGlyHisAlaGlnAlaArgValArgLysAsnAsnThr-21 |
| SEQ. ID. NO. 2726 | 43-LysGluIleArgAsnArgGlyProVal-51 |
| SEQ. ID. NO. 2727 | 57-AspSerAlaGluGlyIleGluValAsnAsnThr-67 |
| SEQ. ID. NO. 2728 | 75-AspValGlyArgValThrArgIleLysLeuArgAspAspGlnLysGlyValGlu-92 |
| SEQ. ID. NO. 2729 | 100-AspValSerGlyLeuIleArgSerAspThrGln-110 |
| SEQ. ID. NO. 2730 | 114-ValLysProArgIleAspGlnSerGly-122 |
| SEQ. ID. NO. 2731 | 138-ThrProGlyLysSerAspGluAlaLysAspValPheGln-150 |
| SEQ. ID. NO. 2732 | 169-LeuIleGlyLysAsnAspArgIleLeuAsn-178 |
| SEQ. ID. NO. 2733 | 196-AlaHisPheAspProSerAspGlnSer-204 |
| SEQ. ID. NO. 2734 | 212-GlnSerProAsnAspLysLeuIle-219 |
| SEQ. ID. NO. 2735 | 228-GluSerGlyIleAsnIleGluThrThrGlySerGlyIleLysLeuAsnSer-244 |
| SEQ. ID. NO. 2736 | 256-SerPheAspSerProLysThrLysAsnSerLysAsnValLysSerGluAspSer-273 |
| SEQ. ID. NO. 2737 | 275-ThrLeuTyrAspSerArgSerGluValAlaAsnLeuProAspAspArgSerLeu-292 |
| SEQ. ID. NO. 2738 | 300-GlnSerValArgGlyLeu-305 |
| SEQ. ID. NO. 2739 | 311-ValGluTyrLysGlyLeuAsn-317 |
| SEQ. ID. NO. 2740 | 325-ProTyrPheAspArgAsnAspSer-332 |
| SEQ. ID. NO. 2741 | 345-IleArgIleGluProSerArgLeuGluIleAsnAlaAspGluGlnSerLysGluHisTrpLysGlnGlnPhe-368 |
| SEQ. ID. NO. 2742 | 371-AlaLeuAsnLysGlyLeu-376 |
| SEQ. ID. NO. 2743 | 386-LeuThrGlySerLysMetIleGluLeuAsnAspGlnProSerAlaSerProLysLeuArgPro-406 |
| SEQ. ID. NO. 2744 | 419-GlnGlyGlyGlyLeuAspAspLeuGlnValLysLeu-430 |
| SEQ. ID. NO. 2745 | 432-AspLeuLeuAspLysPheAspLysLeuProLeuAspLysThrValAla-447 |
| SEQ. ID. NO. 2746 | 450-AsnGlySerLeuAlaGluLeuLysSerThrLeuLysSerAlaAsn-464 |
| SEQ. ID. NO. 2747 | 469-SerIleAspLysLeuValGlyLysProGlnThrGlnAsnIleProAsnGluLeuAsnGlnThrLeuLysGluLeuArgThrThr-496 |
| SEQ. ID. NO. 2748 | 500-ValSerProGlnSer-504 |
| SEQ. ID. NO. 2749 | 516-SerLeuAspLysThrLeuLysAspValGln-525 |
| SEQ. ID. NO. 2750 | 530-ThrLeuLysGluLysProAsn-536 |
| SEQ. ID. NO. 2751 | 541-AsnSerSerLysAspProIleProLysGlySerArg-553 |

Hydrophilic Regions - Hopp-Woods

| | |
|---|---|
| SEQ. ID. NO. 2752 | 1-MetThrAspAsnSerProProPro-8 |
| SEQ. ID. NO. 2753 | 12-AlaGlnAlaArgValArgLysAsnAsn-20 |
| SEQ. ID. NO. 2754 | 43-LysGluIleArgAsnArgGly-49 |
| SEQ. ID. NO. 2755 | 57-AspSerAlaGluGlyIleGlu-63 |
| SEQ. ID. NO. 2756 | 75-AspValGlyArgValThrArgIleLysLeuArgAspAspGlnLysGlyValGlu-92 |
| SEQ. ID. NO. 2757 | 105-IleArgSerAspThr-109 |
| SEQ. ID. NO. 2758 | 116-ProArgIleAspGln-120 |
| SEQ. ID. NO. 2759 | 140-GlyLysSerAspGluAlaLysAspValPheGln-150 |
| SEQ. ID. NO. 2760 | 171-GlyLysAsnAspArgIleLeu-177 |
| SEQ. ID. NO. 2761 | 196-AlaHisPheAspProSerAspGln-203 |
| SEQ. ID. NO. 2762 | 214-ProAsnAspLysLeuIle-219 |
| SEQ. ID. NO. 2763 | 258-AspSerProLysThrLysAsnSerLysAsnValLysSerGluAspSer-273 |
| SEQ. ID. NO. 2764 | 278-AspSerArgSerGluVal-283 |
| SEQ. ID. NO. 2765 | 285-AsnLeuProAspAspArgSer-291 |
| SEQ. ID. NO. 2766 | 311-ValGluTyrLysGly-315 |
| SEQ. ID. NO. 2767 | 328-AspArgAsnAspSer-332 |
| SEQ. ID. NO. 2768 | 345-IleArgIleGluProSerArgLeuGluIleAsnAlaAspGluGlnSerLysGluHisTrpLys-365 |
| SEQ. ID. NO. 2769 | 390-LysMetIleGluLeuAsnAspGlnProSerAlaSerProLysLeuArgPro-406 |
| SEQ. ID. NO. 2770 | 421-GlyGlyLeuAspAspLeuGlnValLysLeu-430 |
| SEQ. ID. NO. 2771 | 432-AspLeuLeuAspLysPheAspLysLeuProLeuAspLysThrValAla-447 |
| SEQ. ID. NO. 2772 | 454-AlaGluLeuLysSerThrLeuLysSerAlaAsn-464 |
| SEQ. ID. NO. 2773 | 469-SerIleAspLysLeuValGly-475 |
| SEQ. ID. NO. 2774 | 482-IleProAsnGluLeu-486 |
| SEQ. ID. NO. 2775 | 498-GlnThrLeuLysGluLeuArgThr-495 |
| SEQ. ID. NO. 2776 | 516-SerLeuAspLysThrLeuLysAspValGln-525 |
| SEQ. ID. NO. 2777 | 530-ThrLeuLysGluLysProAsn-536 |
| SEQ. ID. NO. 2778 | 543-SerSerLysAspProIleProLysGlySerArg-553 |

155
AMPHI Regions - AMPHI

| | |
|---|---|
| SEQ. ID. NO. 2779 | 28-LysLeuGlyPheGlu-32 |
| SEQ. ID. NO. 2780 | 42-AlaAlaSerLeuAsp-46 |
| SEQ. ID. NO. 2781 | 105-LeuArgAlaLysLysVal-110 |
| SEQ. ID. NO. 2782 | 118-ValProArgIleSerArgAlaGlnAlaLeuAspAlaLeuSerSerMetAlaAsnIleSerGlyTyrArgAlaValIleGluAlaAlaAsn AlaPheGlyArgPhePheThrGly-155 |
| SEQ. ID. NO. 2783 | 175-ValAlaGlyLeuAlaAlaIleGlyThrAlaAsnSerLeuGlyAlaValValArgAlaPhe-194 |
| SEQ. ID. NO. 2784 | 201-AlaGluGlnIleGluSerMetGlyGly-209 |
| SEQ. ID. NO. 2785 | 225-AspGlyTyrAlaLysValMet-231 |
| SEQ. ID. NO. 2786 | 262-LysProAlaProLysLeuIleThrLysGluMetValGluSerMetLys-277 |
| SEQ. ID. NO. 2787 | 295-LeuThrArgProGlyGlu-300 |
| SEQ. ID. NO. 2788 | 308-ValLysIleIleGlyTyrThrAspMetAlaAsnArgLeuAlaGlyGln-323 |
| SEQ. ID. NO. 2789 | 330-ThrAsnLeuValAsnLeuThrLysLeuLeuSer-340 |
| SEQ. ID. NO. 2790 | 404-LysLeuAlaProAlaVal-409 |
| SEQ. ID. NO. 2791 | 428-AsnHisPheIleVal-432 |
| SEQ. ID. NO. 2792 | 451-LeuHisThrProLeuMetSerValThrAsnAlaIleSerGlyIleIle-466 |
| SEQ. ID. NO. 2793 | 469-GlyAlaLeuLeuGln-473 |
| SEQ. ID. NO. 2794 | 478-AsnGlyPheValSerLeuLeuSerPheValAla-488 |
| SEQ. ID. NO. 2795 | 494-IleAsnIlePheGlyGly-499 |

TABLE 1-continued

Antigenic Index - Jameson-Wolf
SEQ. ID. NO. 2796    4-GlyIleProArgGluSerLeuSerGlyGluThrArgVal-16
SEQ. ID. NO. 2797    44-SerLeuAspAspAlaAla-49
SEQ. ID. NO. 2798    72-ValAsnAlaProSerGluGlnGluLeu-80
SEQ. ID. NO. 2799    94-TrpProArgGlnAsnGluAlaLeu-101
SEQ. ID. NO. 2800    105-LeuArgAlaLysLysValAsn-111
SEQ. ID. NO. 2801    117-MetValProArgIleSerArg-123
SEQ. ID. NO. 2802    159-AlaAlaGlyLysValProProAla-166
SEQ. ID. NO. 2803    194-PheAspThrArgLeuGluValAlaGluGlnIleGluSerMetGlyGlyLys-210
SEQ. ID. NO. 2804    215-AspPheProGlnGluSerGlyGlySerGlyAspGlyTyrAlaLysValMetSer-232
SEQ. ID. NO. 2805    242-LeuPheAlaGluGlnAlaLysGluValAsp-251
SEQ. ID. NO. 2806    259-IleProGlyLysProAlaProLysLeuIleThr-269
SEQ. ID. NO. 2807    271-GluMetValGluSerMetLysSerGlySer-280
SEQ. ID. NO. 2808    289-ThrGlyGlyAsnCysGluLeuThrArgProGlyGluLeuSerVal-303
SEQ. ID. NO. 2809    320-LeuAlaGlyGlnSerSer-325
SEQ. ID. NO. 2810    338-LeuLeuSerProAsnLysAspGlyGluIle-347
SEQ. ID. NO. 2811    349-LeuAspPheGluAspValIle-355
SEQ. ID. NO. 2812    361-ValThrHisAspGlyGluIleThrPhePro-370
SEQ. ID. NO. 2813    378-AlaGlnProGlnGlnThrProSerGluLysAlaValProAlaAlaLysProGluProLysPro-398
Hydrophilic Regions - Hopp-Woods
SEQ. ID. NO. 2814    4-GlyIleProArgGluSerLeuSerGlyGluThrArgVal-16
SEQ. ID. NO. 2815    44-SerLeuAspAspAlaAla-49
SEQ. ID. NO. 2816    74-AlaProSerGluGlnGluLeu-80
SEQ. ID. NO. 2817    96-ArgGlnAsnGluAlaLeu-101
SEQ. ID. NO. 2818    105-LeuArgAlaLysLysValAsn-111
SEQ. ID. NO. 2819    117-MetValProArgIleSerArg-123
SEQ. ID. NO. 2820    194-PheAspThrArgLeuGluValAlaGluGlnIleGluSerMetGly-208
SEQ. ID. NO. 2821    215-AspPheProGlnGluSerGlyGlySerGlyAspGlyTyrAla-228
SEQ. ID. NO. 2822    242-LeuPheAlaGluGlnAlaLysGluValAsp-251
SEQ. ID. NO. 2823    260-ProGlyLysProAlaPro-265
SEQ. ID. NO. 2824    271-GluMetValGluSerMetLysSer-278
SEQ. ID. NO. 2825    291-GlyAsnCysGluLeuThrArgProGlyGlu-300
SEQ. ID. NO. 2826    340-SerProAsnLysAspGlyGluIle-347
SEQ. ID. NO. 2827    349-LeuAspPheGluAspValIle-355
SEQ. ID. NO. 2828    363-HisAspGlyGluIle-367
SEQ. ID. NO. 2829    382-GlnThrProSerGluLysAlaValProAlaAlaLysProGluProLysPro-398
156
AMPHI Regions - AMPHI
SEQ. ID. NO. 2830    56-AsnGlyPheGluAlaPheAlaProPhe-64
Antigenic Index - Jameson-Wolf
SEQ. ID. NO. 2831    21-TyrAlaLysLysAlaGlyGlyPheArgPheLysAspAsnHisAsnProArgGly-38
SEQ. ID. NO. 2832    44-GlnGlyAlaAlaAla-48
SEQ. ID. NO. 2833    51-HisAlaAlaGlnGlnAsnGlyPheGlu-59
SEQ. ID. NO. 2834    73-AlaThrGlyAsnAlaAla-78
SEQ. ID. NO. 2835    103-AspLysAlaAlaMet-107
Hydrophilic Regions - Hopp-Woods
SEQ. ID. NO. 2836    21-TyrAlaLysLysAlaGlyGlyPheArgPheLysAspAsnHisAsnPro-36
SEQ. ID. NO. 2837    103-AspLysAlaAlaMet-107
157
AMPHI Regions - AMPHI
SEQ. ID. NO. 2838    21-GlyArgAspValArgAlaAla-27
SEQ. ID. NO. 2839    32-IleAsnHisLeuLeuLysArg-38
SEQ. ID. NO. 2840    61-PheValArgAlaAlaGln-66
SEQ. ID. NO. 2841    167-GlnLeuValAspArg-171
SEQ. ID. NO. 2842    176-AlaHisAspArgSerLeuAspGlyPhe-184
Antigenic Index - Jameson-Wolf
SEQ. ID. NO. 2843    1-MetArgAsnGluGluLysArgAlaLeuArgArgGluLeuArgGlyArgArgSerGlnMetGlyArgAspValArgAla-26
SEQ. ID. NO. 2844    38-ArgTyrIleLysLysGlyArgLysIle-46
SEQ. ID. NO. 2845    51-ProMetGlyLysGluLeuArgLeuAspGlyPheVal-62
SEQ. ID. NO. 2846    64-AlaAlaGlnLysArgGlyAla-70
SEQ. ID. NO. 2847    77-IleGluProArgSerArgArgMetTrp-85
SEQ. ID. NO. 2848    89-TyrProAlaAspGlyValLysGlnGluArgLysArgGlyArgAlaLysLeuHis-106
SEQ. ID. NO. 2849    111-AlaGlyArgLysLysArgValHisAsp-119
SEQ. ID. NO. 2850    129-GlyMetAspArgLeuGlyTyr-135
SEQ. ID. NO. 2851    151-MetLysTyrArgLeuGlnAla-157
SEQ. ID. NO. 2852    172-LeuProValGluAlaHisAspArgSerLeuAspGlyPheVal-185
Hydrophilic Regions - Hopp-Woods
SEQ. ID. NO. 2853    1-MetArgAsnGluGluLysArgAlaLeuArgArgGluLeuArgGlyArgArgSerGlnMetGlyArgAspValArgAla-26
SEQ. ID. NO. 2854    38-ArgTyrIleLysLysGlyArgLysIle-46
SEQ. ID. NO. 2855    54-LysGluLeuArgLeu-58
SEQ. ID. NO. 2856    64-AlaAlaGlnLysArgGlyAla-70
SEQ. ID. NO. 2857    77-IleGluProArgSerArgArg-83
SEQ. ID. NO. 2858    92-AspGlyValLysGlnGluArgLysArgGlyArgAlaLysLeu-105
SEQ. ID. NO. 2859    111-AlaGlyArgLysLysArgValHisAsp-119
SEQ. ID. NO. 2860    131-AspArgLeuGlyTyr-135

TABLE 1-continued

| | |
|---|---|
| SEQ. ID. NO. 2861 | 151-MetLysTyrArgLeuGlnAla-157 |
| SEQ. ID. NO. 2862 | 172-LeuProValGluAlaHisAspArgSerLeuAsp-182 |

158
AMPHI Regions - AMPHI

| | |
|---|---|
| SEQ. ID. NO. 2863 | 20-PheSerArgAlaAlaGluGlnLeu-27 |
| SEQ. ID. NO. 2864 | 33-AlaValSerArgIleValLysArgLeuGlu-42 |
| SEQ. ID. NO. 2865 | 46-GlyValAsnLeuLeuAsnArgThr-53 |
| SEQ. ID. NO. 2866 | 63-GlyAlaGlnTyrPheArgArgAlaGlnArgIleLeuGlnGlu-76 |
| SEQ. ID. NO. 2867 | 85-LeuAlaValHisGluIleProGln-92 |
| SEQ. ID. NO. 2868 | 166-ValIleAlaSerPro-170 |
| SEQ. ID. NO. 2869 | 178-ThrProGlnSerThrGluGluLeu-185 |
| SEQ. ID. NO. 2870 | 188-HisGlnCysLeuGlyPheThrGluProGlySerLeuAsnThrTrpAlaVal-204 |

Antigenic Index - Jameson-Wolf

| | |
|---|---|
| SEQ. ID. NO. 2871 | 1-MetLysThrAsnSerGluGluLeu-8 |
| SEQ. ID. NO. 2872 | 16-GluSerGlySerPheSerArgAlaAlaGlu-25 |
| SEQ. ID. NO. 2873 | 36-ArgIleValLysArgLeuGluGluLysLeuGly-46 |
| SEQ. ID. NO. 2874 | 49-LeuLeuAsnArgThrThrArgGlnLeuSerLeuThrGluGluGlyAlaGlnTyrPheArgArgAlaGlnArgIleLeuGln-75 |
| SEQ. ID. NO. 2875 | 78-AlaAlaAlaGluThrGluMet-84 |
| SEQ. ID. NO. 2876 | 114-LysPheAsnGluArgTyrProHisIleArg-123 |
| SEQ. ID. NO. 2877 | 136-IleGluArgLysValAspIle-142 |
| SEQ. ID. NO. 2878 | 144-LeuArgAlaGlyGluLeuAspAspSerGlyLeuArgAla-156 |
| SEQ. ID. NO. 2879 | 158-HisLeuPheAspSerArgPheArgVal-166 |
| SEQ. ID. NO. 2880 | 168-AlaSerProGluTyrLeuAlaLysHisGlyThrProGlnSerThrGluGluLeuAla-186 |
| SEQ. ID. NO. 2881 | 192-GlyPheThrGluProGlySerLeuAsn-200 |
| SEQ. ID. NO. 2882 | 207-AlaGlnGlyAsnProTyrLysIle-214 |
| SEQ. ID. NO. 2883 | 216-ProHisPheThrAlaSerSerGlyGluIleLeu-226 |
| SEQ. ID. NO. 2884 | 229-LeuCysLeuSerGlyCys-234 |
| SEQ. ID. NO. 2885 | 243-LeuValAspAsnAspIleAlaGluGlyLysLeu-253 |
| SEQ. ID. NO. 2886 | 259-GluGlnThrSerAspLysThrHisProPhe-268 |
| SEQ. ID. NO. 2887 | 273-TyrSerAspLysAlaValAsnLeu-280 |
| SEQ. ID. NO. 2888 | 292-GluLeuGlyAsnAsnLeuCysGly-299 |

Hydrophilic Regions - Hopp-Woods

| | |
|---|---|
| SEQ. ID. NO. 2889 | 1-MetLysThrAsnSerGluGluLeu-8 |
| SEQ. ID. NO. 2890 | 19-SerPheSerArgAlaAlaGlu-25 |
| SEQ. ID. NO. 2891 | 36-ArgIleValLysArgLeuGluGluLysLeuGly-46 |
| SEQ. ID. NO. 2892 | 58-SerLeuThrGluGluGlyAlaGlnTyrPheArgArgAlaGlnArgIleLeuGln-75 |
| SEQ. ID. NO. 2893 | 78-AlaAlaAlaGluThrGluMet-84 |
| SEQ. ID. NO. 2894 | 114-LysPheAsnGluArgTyrPro-120 |
| SEQ. ID. NO. 2895 | 136-IleGluArgLysValAspIle-142 |
| SEQ. ID. NO. 2896 | 144-LeuArgAlaGlyGluLeuAspAspSerGlyLeuArgAla-156 |
| SEQ. ID. NO. 2897 | 162-SerArgPheArgVal-166 |
| SEQ. ID. NO. 2898 | 180-GlnSerThrGluGluLeuAla-186 |
| SEQ. ID. NO. 2899 | 246-AsnIleAlaGluGlyLysLeu-253 |
| SEQ. ID. NO. 2900 | 260-GlnThrSerAspLysThrHis-266 |
| SEQ. ID. NO. 2901 | 276-LysAlaValAsnLeu-280 |

160
AMPHI Regions - AMPHI

| | |
|---|---|
| SEQ. ID. NO. 2902 | 6-LysLeuValAspPheAlaGlnLeuThrGly-15 |
| SEQ. ID. NO. 2903 | 72-GlyLeuGlyHisVal-76 |
| SEQ. ID. NO. 2904 | 121-AlaAspLeuMetAsnGlyLeuProGluThr-130 |
| SEQ. ID. NO. 2905 | 157-GlyThrValSerMetValAsnAlaLeuSerSer-167 |
| SEQ. ID. NO. 2906 | 186-LeuSerGlyValLeuLysGlyTrpGlnAspLysArg-197 |
| SEQ. ID. NO. 2907 | 200-HisLeuIleGlnLysValIleAspLysProGlu-210 |
| SEQ. ID. NO. 2908 | 218-MetValAlaAlaAlaAsn-223 |
| SEQ. ID. NO. 2909 | 229-LeuMetArgArgPhe-233 |
| SEQ. ID. NO. 2910 | 242-HisAlaPheValAsnHisIleArg-249 |
| SEQ. ID. NO. 2911 | 279-PheGlyLysAlaPheLys-284 |

Antigenic Index - Jameson-Wolf

| | |
|---|---|
| SEQ. ID. NO. 2912 | 2-AspIleLeuAspLysLeuVal-8 |
| SEQ. ID. NO. 2913 | 28-SerValArgHisGluThrLeuGlnArgGluGlyLeu-39 |
| SEQ. ID. NO. 2914 | 51-CysIleAspGlyGluThrSerProArgProValSerThrGlyAsp-65 |
| SEQ. ID. NO. 2915 | 77-LeuSerHisAspGlyLysCysGlyGluSerLeuGlnProAspMetArgGlnHisGly-95 |
| SEQ. ID. NO. 2916 | 101-GlnCysGlyAsnGlyGlnAspMet-108 |
| SEQ. ID. NO. 2917 | 115-PheArgTyrAspThrHisAla-121 |
| SEQ. ID. NO. 2918 | 123-LeuMetAsnGlyLeu-127 |
| SEQ. ID. NO. 2919 | 149-LeuGluSerLysLysProLeu-155 |
| SEQ. ID. NO. 2920 | 178-LeuGluAspLysLysArgValGluLeu-186 |
| SEQ. ID. NO. 2921 | 192-GlyTrpGlnAspLysArgLeuGly-199 |
| SEQ. ID. NO. 2922 | 205-ValIleAspLysProGluAspGluTrpAsnValAspLysMetVal-219 |
| SEQ. ID. NO. 2923 | 228-GlnLeuMetArgArgPheLysSerArgValGlyLeuSerProHis-242 |
| SEQ. ID. NO. 2924 | 255-LeuLeuLeuLysLysAsnProAspSerVal-264 |
| SEQ. ID. NO. 2925 | 274-GlnSerGluThrHisPhe-279 |
| SEQ. ID. NO. 2926 | 281-LysAlaPheLysArg-285 |
| SEQ. ID. NO. 2927 | 290-SerProGlyGlnTyrArgLysGluGlyGlyGlnLys-301 |

Hydrophilic Regions - Hopp-Woods

| | |
|---|---|
| SEQ. ID. NO. 2928 | 2-AspIleLeuAspLysLeuVal-8 |
| SEQ. ID. NO. 2929 | 29-ValArgHisGluThrLeuGlnArgGluGlyLeu-39 |
| SEQ. ID. NO. 2930 | 53-AspGlyGluThrSerProArgProValSer-62 |
| SEQ. ID. NO. 2931 | 79-HisAspGlyLysCysGlyGluSerLeuGlnProAspMetArgGln-93 |
| SEQ. ID. NO. 2932 | 101-GlnCysGlyAsnGlyGlnAsp-107 |

TABLE 1-continued

| | |
|---|---|
| SEQ. ID. NO. 2933 | 149-LeuGluSerLysLysProLeu-155 |
| SEQ. ID. NO. 2934 | 178-LeuGluGlnAspLysAspValGluLeu-186 |
| SEQ. ID. NO. 2935 | 193-TrpGlnAspLysArgLeuGly-199 |
| SEQ. ID. NO. 2936 | 205-ValIleAspLysProGluAspGluTrpAsnVal-215 |
| SEQ. ID. NO. 2937 | 228-GlnLeuMetArgArgPheLysSerArgValGly-238 |
| SEQ. ID. NO. 2938 | 255-LeuLeuLeuLysLysAsnProAspSer-263 |
| SEQ. ID. NO. 2939 | 281-LysAlaPheLysArg-285 |
| SEQ. ID. NO. 2940 | 293-GlnTyrArgLysGluGlyGlyGlnLys-301 |

163
AMPHI Regions - AMPHI

| | |
|---|---|
| SEQ. ID. NO. 2941 | 60-SerSerLeuGlyAsnIle-65 |
| SEQ. ID. NO. 2942 | 67-LeuGlyArgAspGluAsp-72 |
| SEQ. ID. NO. 2943 | 76-PheGlyPheLeuSerTrpLeuAlaMetLeuPhe-86 |
| SEQ. ID. NO. 2944 | 100-AlaGluProLeuMetHisTyrPheSerAspIleThrAla-112 |
| SEQ. ID. NO. 2945 | 170-IleSerGlyArgPheGlyAspAlaIleAspIleMetAlaLeuLeuAlaThrPhePheGlyIleIleThrThr-193 |
| SEQ. ID. NO. 2946 | 227-MetSerLeuAlaValValSerAlaIleSerGlyValGlyLysGlyValLysValLeuSer-246 |
| SEQ. ID. NO. 2947 | 272-AlaPheGlyAspAsnIleGlyAsnTyrLeuGlyAsnLeuValArg-286 |
| SEQ. ID. NO. 2948 | 313-TrpCysSerTrpAlaProPheValGlyLeuPheIleAla-325 |
| SEQ. ID. NO. 2949 | 346-LeuPheGlyValLeuTrpPhe-352 |
| SEQ. ID. NO. 2950 | 367-AlaGlyGlyMetLeuGluLysMetThrSerSer-377 |
| SEQ. ID. NO. 2951 | 380-ThrLeuLeuPheLysPhePheAsnTyrLeuProLeuProGluLeuThrSerIleValSerLeuLeu-401 |
| SEQ. ID. NO. 2952 | 438-TrpGlyValLeuMetSerAla-444 |
| SEQ. ID. NO. 2953 | 454-GlyLeuGlyAsnLeuGlnSerMetThrLeu-463 |
| SEQ. ID. NO. 2954 | 520-GluGlnAspIleLeuLysPheLeuLysGlnThrAlaSerPro-533 |
| SEQ. ID. NO. 2955 | 535-MetHisGluLeuGlnLeuArgGluLeu-542 |
| SEQ. ID. NO. 2956 | 574-AspPheMetTyrGlyIle-579 |
| SEQ. ID. NO. 2957 | 583-GlyGlnAspValSerAspGlnLeu-590 |
| SEQ. ID. NO. 2958 | 630-AlaAspIleLeuLysAsnTyr-636 |

Antigenic Index - Jameson-Wolf

| | |
|---|---|
| SEQ. ID. NO. 2959 | 29-AspArgAlaLysGlu-33 |
| SEQ. ID. NO. 2960 | 65-IleArgLeuGlyArgAspGluAspValPro-74 |
| SEQ. ID. NO. 2961 | 111-ThrAlaGlyThrProGluHisArgGlnGln-120 |
| SEQ. ID. NO. 2962 | 166-LeuLysGluLysIleSerGlyArgPheGlyAspAlaIleAsp-179 |
| SEQ. ID. NO. 2963 | 200-GlnLeuGlyAlaGlyLeu-205 |
| SEQ. ID. NO. 2964 | 237-GlyValGlyLysGlyValLysVal-244 |
| SEQ. ID. NO. 2965 | 293-AlaTyrGluArgGluHisLysProTrpPhe-302 |
| SEQ. ID. NO. 2966 | 326-ArgIleSerLysGlyArgThrIleArg-334 |
| SEQ. ID. NO. 2967 | 370-MetLeuGluLysMetThrSerSerProGlu-379 |
| SEQ. ID. NO. 2968 | 409-ThrSerAlaAspSerGlyIle-415 |
| SEQ. ID. NO. 2969 | 421-IleThrSerArgAspLysGlyLeuSerAlaProArgTrp-433 |
| SEQ. ID. NO. 2970 | 451-ArgSerGlyGlyLeuGlyAsn-457 |
| SEQ. ID. NO. 2971 | 484-LeuSerAlaAspLysLysTyrPheGluThrArgValAsnProThrSer-499 |
| SEQ. ID. NO. 2972 | 503-ThrGlyGlyLysTrpLysGluArgLeu-511 |
| SEQ. ID. NO. 2973 | 516-SerGlnThrGlnGluGlnAspIle-523 |
| SEQ. ID. NO. 2974 | 527-LeuLysGlnThrAlaSer-532 |
| SEQ. ID. NO. 2975 | 537-GluLeuGlnArgGluLeuSerGluGluTyrGlyLeu-548 |
| SEQ. ID. NO. 2976 | 550-ValArgValAspLysMetPheHisArgAspGluProAla-562 |
| SEQ. ID. NO. 2977 | 566-ValIleArgLysGluThrMetArg-573 |
| SEQ. ID. NO. 2978 | 581-SerValGlyGlnAspValSerAspGlnLeuIleAsnAspGlyLysLeuProHisIleArgHisGlnThrThrTyrLysProTyr-608 |
| SEQ. ID. NO. 2979 | 612-PheAspGlyArgValGlyTyr-618 |
| SEQ. ID. NO. 2980 | 622-TyrMetAsnLysAspGluLeuIle-629 |
| SEQ. ID. NO. 2981 | 632-IleLeuLysAsnTyrGlu-637 |
| SEQ. ID. NO. 2982 | 654-GluGlnValGluLeuAlaGlu-660 |

Hydrophilic Regions - Hopp-Woods

| | |
|---|---|
| SEQ. ID. NO. 2983 | 29-AspArgAlaLysGlu-33 |
| SEQ. ID. NO. 2984 | 66-ArgLeuGlyArgAspGluAspValPro-74 |
| SEQ. ID. NO. 2985 | 114-ThrProGluHisArgGlnGln-120 |
| SEQ. ID. NO. 2986 | 166-LeuLysGluLysIleSerGlyArgPheGlyAsp-176 |
| SEQ. ID. NO. 2987 | 238-ValGlyLysGlyValLysVal-244 |
| SEQ. ID. NO. 2988 | 293-AlaTyrGluArgGluHisLysPro-300 |
| SEQ. ID. NO. 2989 | 327-IleSerLysGlyArgThrIleArg-334 |
| SEQ. ID. NO. 2990 | 370-MetLeuGluLysMetThrSerSerPro-378 |
| SEQ. ID. NO. 2991 | 422-ThrSerArgAspLysGlyLeuSer-429 |
| SEQ. ID. NO. 2992 | 484-LeuSerAlaAspLysLysTyrPheGlu-492 |
| SEQ. ID. NO. 2993 | 506-LysTrpLysGluArgLeu-511 |
| SEQ. ID. NO. 2994 | 517-GlnThrGlnGluGlnAspIle-523 |
| SEQ. ID. NO. 2995 | 537-GluLeuGlnArgGluLeuSerGluGluTyrGlyLeu-548 |
| SEQ. ID. NO. 2996 | 550-ValArgValAspLysMetPheHisArgAspGluProAla-562 |
| SEQ. ID. NO. 2997 | 566-ValIleArgLysGluThrMetArg-573 |
| SEQ. ID. NO. 2998 | 581-SerValGlyGlnAspValSerAsp-588 |
| SEQ. ID. NO. 2999 | 590-LeuIleAsnAspGlyLysLeuProHis-598 |
| SEQ. ID. NO. 3000 | 622-TyrMetAsnLysAspGluLeuIle-629 |
| SEQ. ID. NO. 3001 | 654-GluGlnValGluLeuAlaGlu-660 |

164
AMPHI Regions - AMPHI

| | |
|---|---|
| SEQ. ID. NO. 3002 | 6-AlaAsnPheTyrGluMetLeuAlaAlaAla-15 |
| SEQ. ID. NO. 3003 | 33-AlaTyrArgAlaLeuLysGlnGlu-40 |
| SEQ. ID. NO. 3004 | 75-AlaIleSerAlaIleGlyAlaVal-82 |
| SEQ. ID. NO. 3005 | 97-TyrIleLeuAsnAspCys-102 |
| SEQ. ID. NO. 3006 | 113-LeuSerLysGluLeuAlaGlyLeuLysAla-122 |

TABLE 1-continued

| | |
|---|---|
| SEQ. ID. NO. 3007 | 148-PheGluAspValArgArgPheProGlu-156 |
| SEQ. ID. NO. 3008 | 160-LeuGlyArgGlnProArgIleAsnAspLeuAlaHis-171 |
| SEQ. ID. NO. 3009 | 189-TyrAlaAsnLeuPheAlaAsnLeuAsnGlyIleGluArgIlePheLys-204 |
| SEQ. ID. NO. 3010 | 264-ValProAlaIleTyrThr-269 |
| SEQ. ID. NO. 3011 | 282-TrpPheAsnArgIle-286 |
| SEQ. ID. NO. 3012 | 311-AlaLysLeuLeuGluGlyTyrGlyLeuSer-320 |
| SEQ. ID. NO. 3013 | 362-GluValGlyGluLeuIle-367 |
| SEQ. ID. NO. 3014 | 374-MetArgGlyTyrLeuAsn-379 |
| SEQ. ID. NO. 3015 | 387-ThrIleValAsnGlyTrpLeuLys-394 |
| SEQ. ID. NO. 3016 | 424-ValTyrProArgGluIleGluGluGlu-432 |
| SEQ. ID. NO. 3017 | 459-PheValGlnLeuLysGluGlyMet-466 |
| SEQ. ID. NO. 3018 | 472-GluIleArgArgHisLeuArgThrVal-480 |
| SEQ. ID. NO. 3019 | 484-PheLysIleProLysGln-489 |
| SEQ. ID. NO. 3020 | 499-AsnAlaThrGlyLysValLeuLysArgValLeuLysGluGlnPheAspGlyAsn-516 |
| Antigenic Index - Jameson-Wolf | |
| SEQ. ID. NO. 3021 | 1-MetAsnArgThrTyr-5 |
| SEQ. ID. NO. 3022 | 15-AlaCysArgLysAsnGlyAsnGly-22 |
| SEQ. ID. NO. 3023 | 26-PheAspGlyLysGluLysThrAlaTyrArgAlaLeuLysGlnGluAlaGluAla-43 |
| SEQ. ID. NO. 3024 | 63-ValSerAsnSerThrGlu-68 |
| SEQ. ID. NO. 3025 | 88-ThrPheLeuLysAsnSerGlu-94 |
| SEQ. ID. NO. 3026 | 100-AsnAspCysLysAla-104 |
| SEQ. ID. NO. 3027 | 112-GlyLeuSerLysGluLeuAlaGly-119 |
| SEQ. ID. NO. 3028 | 121-LysAlaGlnThrProValGlu-127 |
| SEQ. ID. NO. 3029 | 130-IleTrpThrAspLysSerArgProThrGlyGluThrAlaGluGlyAsp AlaPhePheAspValArgArgPheProGluLysProAspLeuGlyArgGlnProArgIleAsnAsp-168 |
| SEQ. ID. NO. 3030 | 176-SerGlyThrThrGlyHisProLysGlyAla-185 |
| SEQ. ID. NO. 3031 | 196-LeuAsnGlyIleGluArgIlePheLysIleSerLysArgAspArgPhe-211 |
| SEQ. ID. NO. 3032 | 253-ThrLeuLeuLysArg-257 |
| SEQ. ID. NO. 3033 | 290-IleSerGlyGlyAlaProLeuAla-297 |
| SEQ. ID. NO. 3034 | 304-PheLysAlaLysPheProArg-310 |
| SEQ. ID. NO. 3035 | 317-TyrGlyLeuSerGluAlaSer-323 |
| SEQ. ID. NO. 3036 | 330-ThrProGluArgGlnLysAlaArgSer-338 |
| SEQ. ID. NO. 3037 | 343-LeuProGlyLeuGluAlaLysAlaValAspGluGluLeuValGluValProArgGlyGluValGly-364 |
| SEQ. ID. NO. 3038 | 367-IleValArgGlyGlySerValMet-374 |
| SEQ. ID. NO. 3039 | 382-AlaAlaThrAspGluThrIle-388 |
| SEQ. ID. NO. 3040 | 393-LeuLysThrGlyAsp-397 |
| SEQ. ID. NO. 3041 | 400-ThrIleAspGluAspGly-405 |
| SEQ. ID. NO. 3042 | 410-ValAspArgLysLysAspLeuIleIleSerLysGlyGlnAsnValTyrProArgGluIleGluGluGluIleTyrLys-435 |
| SEQ. ID. NO. 3043 | 446-GlyValLysAspArgTyrAlaAspGluGluIle-456 |
| SEQ. ID. NO. 3044 | 462-LeuLysGluGlyMetAspLeuGlyGluAsnGluIleArgArgHisLeuArg-478 |
| SEQ. ID. NO. 3045 | 490-IleHisPheLysAspGlyLeuProArgAsnAlaThrGlyLysValLeuLysArgValLeuLysGluGlnPheAspGlyAsnLys-517 |
| Hydrophilic Regions - Hopp-Woods | |
| SEQ. ID. NO. 3046 | 15-AlaCysArgLysAsnGlyAsn-21 |
| SEQ. ID. NO. 3047 | 26-PheAspGlyLysGluLysThrAlaTyrArgAlaLeuLysGlnGluAlaGluAla-43 |
| SEQ. ID. NO. 3048 | 112-GlyLeuSerLysGluLeuAlaGly-119 |
| SEQ. ID. NO. 3049 | 133-AspLysSerArgProThrGlyGluThrAlaGluGlyAspAlaPhePheGluAspValArgArgPheProGluLysProAspLeuGlyArgGlnProArg IleAsnAsp-168 |
| SEQ. ID. NO. 3050 | 198-GlyIleGluArgIlePheLysIleSerLysArgAspArgPhe-211 |
| SEQ. ID. NO. 3051 | 253-ThrLeuLeuLysArg-257 |
| SEQ. ID. NO. 3052 | 304-PheLysAlaLysPheProArg-310 |
| SEQ. ID. NO. 3053 | 330-ThrProGluArgGlnLysAlaArgSer-338 |
| SEQ. ID. NO. 3054 | 346-LeuGluAlaLysAlaValAspGluGluLeuValGluValProArgGlyGluValGly-364 |
| SEQ. ID. NO. 3055 | 382-AlaAlaThrAspGluThrIle-388 |
| SEQ. ID. NO. 3056 | 400-ThrIleAspGluAspGly-405 |
| SEQ. ID. NO. 3057 | 410-ValAspArgLysLysAspLeuIleIle-418 |
| SEQ. ID. NO. 3058 | 425-TyrProArgGluIleGluGluGluIleTyrLys-435 |
| SEQ. ID. NO. 3059 | 446-GlyValLysAspArgTyrAlaAspGluGluIle-456 |
| SEQ. ID. NO. 3060 | 462-LeuLysGluGlyMetAspLeuGlyGluAsnGluIleArgArgHisLeuArg-478 |
| SEQ. ID. NO. 3061 | 494-AspGlyLeuProArgAsnAlaThr-501 |
| SEQ. ID. NO. 3062 | 503-LysValLeuLysArgValLeuLysGluGlnPheAspGlyAsnLys-517 |
| 165-1 | |
| AMPHI Regions - AMPHI | |
| SEQ. ID. NO. 3063 | 17-AlaThrLeuGlyValLeuLeuLysGluLeu-26 |
| SEQ. ID. NO. 3064 | 33-ThrLeuIleGluArgLeuGluAsp-40 |
| SEQ. ID. NO. 3065 | 72-IleIleAspProAlaArgAlaLeuAsnIleAla-82 |
| SEQ. ID. NO. 3066 | 90-GlnPheTrpAlaThr-94 |
| SEQ. ID. NO. 3067 | 108-AsnAlaValProHis-112 |
| SEQ. ID. NO. 3068 | 125-LeuGlnLysArgTyrAspAlaPheLysThrGlnLysLeuPheGluAsnMet-141 |
| SEQ. ID. NO. 3069 | 182-ArgLeuThrArgGlnMetValLysTyrLeuGlnGly-193 |
| SEQ. ID. NO. 3070 | 198-ThrGluPheAsnArgHisValGluAspIleLysArgGlu-210 |
| SEQ. ID. NO. 3071 | 348-GlyTrpAlaAsnMetPro-353 |
| SEQ. ID. NO. 3072 | 364-LysThrLysGluGlu-368 |
| SEQ. ID. NO. 3073 | 371-AlaSerLeuLeuGluTyrTyr-377 |
| SEQ. ID. NO. 3074 | 453-TrpGluAspArgLeuLysGluLeu-460 |
| Antigenic Index - Jameson-Wolf | |
| SEQ. ID. NO. 3075 | 1-MetAlaGluAlaThrAsp-6 |
| SEQ. ID. NO. 3076 | 24-LysGluLeuGluProSerTrp-30 |
| SEQ. ID. NO. 3077 | 36-GluArgLeuGluAspValAlaLeuGluSerSerAsnAlaTrpAsnAsnAlaGlyThrGly-55 |
| SEQ. ID. NO. 3078 | 97-AlaGluGlyLysLeuGluAspAsnSer-105 |
| SEQ. ID. NO. 3079 | 117-MetAsnGluAspHisCysSerTyrLeuGlnLysArgTyrAspAlaPheLysThrGlnLysLeuPheGlu-139 |

TABLE 1-continued

| | |
|---|---|
| SEQ. ID. NO. 3080 | 141-MetGluPheSerThrAspArgAsnLysIleSerAsp-152 |
| SEQ. ID. NO. 3081 | 157-MetMetArgGlyArgAspGluAsnGlnPro-166 |
| SEQ. ID. NO. 3082 | 169-AlaAsnTyrSerAlaGluGlyThrAspValAspPheGlyArgLeuThrArgGlnMet-187 |
| SEQ. ID. NO. 3083 | 191-LeuGlnGlyLysGlyValLysThrGluPheAsnArgHisValGluAspIleLysArgGluSerAspGly-213 |
| SEQ. ID. NO. 3084 | 319-ThrAlaAspThrArgAsnProAspGlyGlnLeu-229 |
| SEQ. ID. NO. 3085 | 249-GlnLysSerGlyIleProGluGlyLysGlyTyrGly-260 |
| SEQ. ID. NO. 3086 | 269-PheArgAsnSerAsnProGluThrAlaGluGlnHisAsn-281 |
| SEQ. ID. NO. 3087 | 300-LeuAspThrArgAsnValAspGlyLysArgHisLeu-311 |
| SEQ. ID. NO. 3088 | 322-AsnPheLeuLysGlnGlySerLeuMet-330 |
| SEQ. ID. NO. 3089 | 361-GluLeuArgLysThrLysGluGluArgPhe-370 |
| SEQ. ID. NO. 3090 | 377-TyrProGluAlaAsnProAspAspTrpGlu-386 |
| SEQ. ID. NO. 3091 | 395-GlnIleIleLysLysAspSerGluLysGlyGly-405 |
| SEQ. ID. NO. 3092 | 415-AlaHisAlaAspGlySer-420 |
| SEQ. ID. NO. 3093 | 428-SerProGlyAlaSerThr-433 |
| SEQ. ID. NO. 3094 | 446-PheProGluArgAlaProSerTrpGluAspArgLeuLysGluLeuValProGlyTyr-464 |
| SEQ. ID. NO. 3095 | 467-LysLeuAsnGluAsnProGluArgAlaAspGlu-477 |
| Hydrophilic Regions - Hopp-Woods | |
| SEQ. ID. NO. 3096 | 1-MetAlaGluAlaThrAsp-6 |
| SEQ. ID. NO. 3097 | 24-LysGluLeuGluPro-28 |
| SEQ. ID. NO. 3098 | 36-GluArgLeuGluAspValAlaLeuGluSer-45 |
| SEQ. ID. NO. 3099 | 97-AlaGluGlyLysLeuGluAspAsnSer-105 |
| SEQ. ID. NO. 3100 | 117-MetAsnGluAspHisCys-122 |
| SEQ. ID. NO. 3101 | 125-LeuGlnLysArgTyrAspAlaPheLysThr-134 |
| SEQ. ID. NO. 3102 | 141-MetGluPheSerThrAspArgAsnLysIleSerAsp-152 |
| SEQ. ID. NO. 3103 | 158-MetArgGlyArgAspGluAsnGlnPro-166 |
| SEQ. ID. NO. 3104 | 172-SerAlaGluGlyThrAspValAspPhe-180 |
| SEQ. ID. NO. 3105 | 182-ArgLeuThrArgGlnMet-187 |
| SEQ. ID. NO. 3106 | 194-LysGlyValLysThrGluPheAsnArgHisValGluAspIleLysArgGluSerAspGly-213 |
| SEQ. ID. NO. 3107 | 219-ThrAlaAspThrArgAsnProAspGly-227 |
| SEQ. ID. NO. 3108 | 252-GlyIleProGluGlyLysGly-258 |
| SEQ. ID. NO. 3109 | 272-SerAsnProGluThrAlaGluGlnHisAsn-281 |
| SEQ. ID. NO. 3110 | 300-LeuAspThrArgAsnValAspGlyLysArg-309 |
| SEQ. ID. NO. 3111 | 361-GluLeuArgLysThrLysGluGluArgPhe-370 |
| SEQ. ID. NO. 3112 | 380-AlaAsnProAspAspTrpGlu-386 |
| SEQ. ID. NO. 3113 | 395-GlnIleIleLysLysAspSerGluLysGlyGly-405 |
| SEQ. ID. NO. 3114 | 446-PheProGluArgAlaProSerTrpGluAspArgLeuLysGluLeuVal-461 |
| SEQ. ID. NO. 3115 | 467-LysLeuAsnGluAsnProGluArgAlaAspGlu-477 |
| Hydrophilic Regions - Hopp-Woods | |
| SEQ. ID. NO. 3116 | 1-MetAlaGluAlaThrAsp-6 |
| SEQ. ID. NO. 3117 | 24-LysGluLeuGluPro-28 |
| SEQ. ID. NO. 3118 | 36-GluArgLeuGluAspValAlaLeuGluSer-45 |
| SEQ. ID. NO. 3119 | 97-AlaGluGlyLysLeuGluAspAsnSer-105 |
| SEQ. ID. NO. 3120 | 117-MetAsnGluAspHisCys-122 |
| SEQ. ID. NO. 3121 | 125-LeuGlnLysArgTyrAspAlaPheLysThr-134 |
| SEQ. ID. NO. 3122 | 141-MetGluPheSerThrAspArgAsnLysIleSerAsp-152 |
| SEQ. ID. NO. 3123 | 158-MetArgGlyArgAspGluAsnGlnPro-166 |
| SEQ. ID. NO. 3124 | 172-SerAlaGluGlyThrAspValAspPhe-180 |
| SEQ. ID. NO. 3125 | 182-ArgLeuThrArgGlnMet-187 |
| SEQ. ID. NO. 3126 | 194-LysGlyValLysThrGluPheAsnArgHisValGluAspIleLysArgGluSerAspGly-213 |
| SEQ. ID. NO. 3127 | 219-ThrAlaAspThrArgAsnProAspGly-227 |
| SEQ. ID. NO. 3128 | 252-GlyIleProGluGlyLysGly-258 |
| SEQ. ID. NO. 3129 | 272-SerAsnProGluThrAlaGluGlnHisAsn-281 |
| SEQ. ID. NO. 3130 | 300-LeuAspThrArgAsnValAspGlyLysArg-309 |
| SEQ. ID. NO. 3131 | 361-GluLeuArgLysThrLysGluGluArgPhe-370 |
| SEQ. ID. NO. 3132 | 380-AlaAsnProAspAspTrpGlu-386 |
| SEQ. ID. NO. 3133 | 395-GlnIleIleLysLysAspSerGluLysGlyGly-405 |
| SEQ. ID. NO. 3134 | 446-PheProGluArgAlaProSerTrpGluAspArgLeuLysGluLeuVal-461 |
| SEQ. ID. NO. 3135 | 467-LysLeuAsnGluAsnProGluArgAlaAspGlu-477 |
| 204-2 | |
| AMPHI Regions - AMPHI | |
| SEQ. ID. NO. 3136 | 43-GlnAlaPheAsnArgIleThrAspLeuPhePhe-53 |
| SEQ. ID. NO. 3137 | 62-AlaLeuSerGlnIle-66 |
| SEQ. ID. NO. 3138 | 70-AsnArgArgIleValAspIlePheAspPheGluAsn-81 |
| SEQ. ID. NO. 3139 | 83-PheArgArgAlaLeuTyrArgValLeuArgLeuPheArgArgIlePheGly-99 |
| Antigenic Index - Jameson-Wolf | |
| SEQ. ID. NO. 3140 | 34-AspGlnSerAspAsnIleLeu-40 |
| SEQ. ID. NO. 3141 | 44-AlaPheAsnArgIle-48 |
| SEQ. ID. NO. 3142 | 66-IleGlnThrGlyAsnArgArgIleValAsp-75 |
| SEQ. ID. NO. 3143 | 77-PheAspPheGluAsnArgPheArgArgAlaLeu-87 |
| SEQ. ID. NO. 3144 | 101-AlaAlaGlyGlyLysGlnGlnAla-108 |
| SEQ. ID. NO. 3145 | 112-TyrGlyLysArgCysPhe-117 |
| SEQ. ID. NO. 3146 | 126-SerLysCysArgLeuLysArgGlyArgArgArgPheGlyArgHisArgValHisPheAsnGlyArgMetProThrAlaSerArgThrLeuSerAsn AsnSerArgAlaSerLeu-163 |
| SEQ. ID. NO. 3147 | 169-ProAlaCysLysIle-173 |
| SEQ. ID. NO. 3148 | 177-CysGluGlySerAla-181 |
| Hydrophilic Regions - Hopp-Woods | |
| SEQ. ID. NO. 3149 | 68-ThrGlyAsnArgArgIleValAsp-75 |
| SEQ. ID. NO. 3150 | 77-PheAspPheGluAsnArgPheArgArgAlaLeu-87 |
| SEQ. ID. NO. 3151 | 104-GlyLysGlnGlnAla-108 |
| SEQ. ID. NO. 3152 | 112-TyrGlyLysArgCysPhe-117 |

TABLE 1-continued

| SEQ. ID. NO. 3153 | 126-SerLysCysArgLeuLysArgGlyArgArgArgPheGlyArgHisArgVal-142 |
| SEQ. ID. NO. 3154 | 148-MetProThrAlaSerArgThrLeuSerAsnAsnSerArgAlaSerLeu-163 |

205-1 (same as orf108, so delete this one)

AMPHI Regions - AMPHI

| SEQ. ID. NO. 3155 | 21-SerGluAsnThrAlaGluGlnProGlnAsnAlaValGlnSerAlaProLys-37 |
| SEQ. ID. NO. 3156 | 79-GluGlnAsnValIleArgLeuIleGlyLysHisProGlyAspLeu-93 |
| SEQ. ID. NO. 3157 | 119-HisThrLeuPheAlaLysLeuValGlyAsnIleAlaGluAspGlyGlyLys-135 |

Antigenic Index - Jameson-Wolf

| SEQ. ID. NO. 3158 | 18-CysGlyLysSerGluAsnThrAlaGluGlnProGlnAsnAlaValGlnSerAlaProLysProValPhe-40 |
| SEQ. ID. NO. 3159 | 55-LeuGlyGlnSerSerGluGlyLysThrAsnAspGlyLysLysGlnIle-70 |
| SEQ. ID. NO. 3160 | 73-ProIleLysGlyLeuProGluGlnAsnVal-82 |
| SEQ. ID. NO. 3161 | 86-IleGlyLysHisProGlyAspLeuGluAlaValSerGlyLysCysMetGluThrAspAspLysAspSerProAlaGlyTrpAlaGlu-114 |
| SEQ. ID. NO. 3162 | 129-IleAlaGluAspGlyGlyLysLeuThr-137 |
| SEQ. ID. NO. 3163 | 149-TyrGlnAlaGlyLysSerGlyTyr-156 |
| SEQ. ID. NO. 3164 | 168-IleAspSerGluGly-172 |
| SEQ. ID. NO. 3165 | 175-TyrPheArgArgArgHisTyr-181 |

Hydrophilic Regions - Hopp-Woods

| SEQ. ID. NO. 3166 | 19-GlyLysSerGluAsnThrAlaGluGlnProGln-29 |
| SEQ. ID. NO. 3167 | 56-GlyGlnSerSerGluGlyLysThrAsnAspGlyLysLysGlnIle-70 |
| SEQ. ID. NO. 3168 | 89-HisProGlyAspLeuGluAlaValSer-97 |
| SEQ. ID. NO. 3169 | 99-LysCysMetGluThrAspAspLysAspSerPro-109 |
| SEQ. ID. NO. 3170 | 129-IleAlaGluAspGlyGlyLysLeu-136 |
| SEQ. ID. NO. 3171 | 150-GlnAlaGlyLysSerGly-155 |
| SEQ. ID. NO. 3172 | 168-IleAspSerGluGly-172 |
| SEQ. ID. NO. 3173 | 176-PheArgArgArgHisTyr-181 |

206-2

AMPHI Regions - AMPHI

| SEQ. ID. NO. 3174 | 32-ProLysGlnThrValArgGlnIleGlnAlaVal-42 |
| SEQ. ID. NO. 3175 | 44-IleSerHisIleAspArgThrGlnGly-52 |
| SEQ. ID. NO. 3176 | 81-CysSerGlyMetIleGln-86 |
| SEQ. ID. NO. 3177 | 99-ArgThrAlaArgAspMet-104 |
| SEQ. ID. NO. 3178 | 150-SerGlyLysThrIleLysThrGlu-157 |

Antigenic Index - Jameson-Wolf

| SEQ. ID. NO. 3179 | 2-PheProProAspLysThrLeu-8 |
| SEQ. ID. NO. 3180 | 21-GlyThrThrSerGlyLysHisArgGlnProLysProLysGlnThrValArg-37 |
| SEQ. ID. NO. 3181 | 45-SerHisIleAspArgThrGlnGlySerGln-54 |
| SEQ. ID. NO. 3182 | 66-ThrProTyrLysTrpGlyGlySerSerThr-75 |
| SEQ. ID. NO. 3183 | 96-LysLeuProArgThrAlaArgAspMetAlaAlaAlaSerArgLysIleProAspSerArgLeuLysAlaGly-119 |
| SEQ. ID. NO. 3184 | 126-ThrGlyGlyAlaHisArgTyrSer-133 |
| SEQ. ID. NO. 3185 | 148-ProSerSerGlyLysThrIleLysThrGluLysLeuSer-160 |

Hydrophilic Regions - Hopp-Woods

| SEQ. ID. NO. 3186 | 23-ThrSerGlyLysHisArgGlnProLysProLysGlnThrVal-36 |
| SEQ. ID. NO. 3187 | 45-SerHisIleAspArgThrGlnGlySerGln-54 |
| SEQ. ID. NO. 3188 | 96-LysLeuProArgThrAlaArgAspMetAlaAlaAlaSerArgLysIleProAspSerArgLeuLysAlaGly-119 |
| SEQ. ID. NO. 3189 | 149-SerSerGlyLysThrIleLysThrGluLysLeuSer-160 |

211-2

AMPHI Regions - AMPHI

| SEQ. ID. NO. 3190 | 18-ValGlyAsnGlyValAspGluPheGlyArgGlyAla-29 |
| SEQ. ID. NO. 3191 | 57-GlnPheGluArgAla-61 |
| SEQ. ID. NO. 3192 | 98-IleGluGlyPheAspLysIleAsnProAla-107 |

Antigenic Index - Jameson-Wolf

| SEQ. ID. NO. 3193 | 8-AsnGlnLeuGlyGlyArgAsnGlyThrAlaValGlyAsnGlyValAspGluPheGlyArgGlyAlaAspAsnGlnValGluPheLeuGlu-37 |
| SEQ. ID. NO. 3194 | 44-GlyAlaSerGlyArgAlaAla-50 |
| SEQ. ID. NO. 3195 | 73-GlyGluAspAspValVal-78 |
| SEQ. ID. NO. 3196 | 100-GlyPheAspLysIleAsnProAlaVal-108 |

Hydrophilic Regions - Hopp-Woods

| SEQ. ID. NO. 3197 | 10-LeuGlyGlyArgAsnGlyThr-16 |
| SEQ. ID. NO. 3198 | 21-GlyValAspGluPheGlyArgGlyAlaAspAsnGlnValGluPheLeuGlu-37 |
| SEQ. ID. NO. 3199 | 73-GlyGluAspAspValVal-78 |
| SEQ. ID. NO. 3200 | 100-GlyPheAspLysIleAsn-105 |

212-2

AMPHI Regions - AMPHI

| SEQ. ID. NO. 3201 | 6-TrpAspGlyIleProAspIleArgThr-14 |
| SEQ. ID. NO. 3202 | 40-PheGlnThrAlaGlnAsp-45 |
| SEQ. ID. NO. 3203 | 64-LeuGlnPheAspSerIleAsnLeuIleGluHisIle-75 |
| SEQ. ID. NO. 3204 | 91-HisLeuHisGluHis-95 |
| SEQ. ID. NO. 3205 | 199-ArgLeuLeuGlyHis-203 |
| SEQ. ID. NO. 3206 | 238-HisAsnHisLeuTyrArgSerIleThrSerAlaGluAlaGluLysIle-253 |
| SEQ. ID. NO. 3207 | 397-TrpAsnGluAlaGluGluAla-403 |
| SEQ. ID. NO. 3208 | 439-AspSerProAspHis-443 |
| SEQ. ID. NO. 3209 | 445-ProLeuValGlyAlaLeuGlyAspIleAlaAlaMet-456 |
| SEQ. ID. NO. 3210 | 487-HisGlyThrArgGlyLeu-492 |
| SEQ. ID. NO. 3211 | 501-AlaIleAlaAlaGlnIleLeuGlyLeuPro-510 |

Antigenic Index - Jameson-Wolf

| SEQ. ID. NO. 3212 | 8-GlyIleProAspIleArgThrLeuAspGlnAlaIleArgLysHisAlaProProLeuAsn-27 |
| SEQ. ID. NO. 3213 | 33-ProAspAsnGlnIleProAspPheGlnThrAlaGlnAspAlaSerAspAlaGluCysArgLeuLysHisArgLeuAspGln-59 |
| SEQ. ID. NO. 3214 | 85-ProProSerArgThr-89 |
| SEQ. ID. NO. 3215 | 105-AlaIleProGlnThrGluSerLysProAspLysProTrp-117 |
| SEQ. ID. NO. 3216 | 120-LeuProGlnThrSerGluArgGlnLysProGluHis-131 |
| SEQ. ID. NO. 3217 | 158-LeuGluAlaArgLysAlaAlaGln-165 |

TABLE 1-continued

| | |
|---|---|
| SEQ. ID. NO. 3218 | 168-SerGlyAsnArgGlnGly-173 |
| SEQ. ID. NO. 3219 | 178-LysIleSerProHisAspThrGluGlnThrGlu-188 |
| SEQ. ID. NO. 3220 | 193-GlyTyrGlyTyrThrLys-198 |
| SEQ. ID. NO. 3221 | 205-LeuProGluSerGluThrTrpGlyGlyAsnGly-215 |
| SEQ. ID. NO. 3222 | 220-AsnTyrSerArgThrGluGlnGlnArgAsnHisGluLeuGlyLeu-234 |
| SEQ. ID. NO. 3223 | 246-ThrSerAlaGluAlaGluLysIleAla-254 |
| SEQ. ID. NO. 3224 | 260-ValProTyrAspHisProSerCys-267 |
| SEQ. ID. NO. 3225 | 294-LeuHisGluAspThrProLeu-300 |
| SEQ. ID. NO. 3226 | 302-AspIleSerHisAspGlyGluLysTrpIle-311 |
| SEQ. ID. NO. 3227 | 328-ThrGlyAlaAsnSerProTyrLeuPro-336 |
| SEQ. ID. NO. 3228 | 346-ArgGlnIleArgGlyGlnThrGlyLeuThrProSerThrProPheSerGluGlnLeuArg-365 |
| SEQ. ID. NO. 3229 | 376-ProSerTrpHisGly-380 |
| SEQ. ID. NO. 3230 | 391-AsnSerSerHisThrGlyTrpAsnGluAlaGluGluAlaSerAsnArgGlnAla-408 |
| SEQ. ID. NO. 3231 | 424-AsnProAsnProGlnLysHisGlnGly-432 |
| SEQ. ID. NO. 3232 | 436-IleArgCysAspSerProAspHisLeuPro-445 |
| SEQ. ID. NO. 3233 | 464-AlaLeuAspLysAsnTyrArgIleAspThrProCys-475 |
| SEQ. ID. NO. 3234 | 487-HisGlyThrArgGlyLeuAla-493 |
| SEQ. ID. NO. 3235 | 511-HisProPheSerGlnArgLeuArgHisAlaLeuHisProAsnArgThrIle-527 |
| SEQ. ID. NO. 3236 | 531-IleValArgArgLysAspLeuThrPro-539 |
| Hydrophilic Regions - Hopp-Woods | |
| SEQ. ID. NO. 3237 | 10-ProAspIleArgThrLeuAspGlnAlaIleArgLysHisAlaPro-24 |
| SEQ. ID. NO. 3238 | 44-GlnAspAlaSerAspAlaGluCysArgLeuLysHisArgLeuAspGln-59 |
| SEQ. ID. NO. 3239 | 105-AlaIleProGlnThrGluSerLysProAspLys-115 |
| SEQ. ID. NO. 3240 | 122-GlnThrSerGluArgGlnLysProGluHis-131 |
| SEQ. ID. NO. 3241 | 158-LeuGluAlaArgLysAlaAlaGln-165 |
| SEQ. ID. NO. 3242 | 180-SerProHisAspThrGluGlnThrGlu-188 |
| SEQ. ID. NO. 3243 | 206-ProGluSerGluThr-210 |
| SEQ. ID. NO. 3244 | 222-SerArgThrGluGlnGlnArgAsnHisGlu-231 |
| SEQ. ID. NO. 3245 | 246-ThrSerAlaGluAlaGluLysIleAla-254 |
| SEQ. ID. NO. 3246 | 294-LeuHisGluAspThrProLeu-300 |
| SEQ. ID. NO. 3247 | 303-IleSerHisAspGlyGluLysTrpIle-311 |
| SEQ. ID. NO. 3248 | 346-ArgGlnIleArgGly-350 |
| SEQ. ID. NO. 3249 | 398-AsnGluAlaGluGluAlaSerAsnArgGlnAla-408 |
| SEQ. ID. NO. 3250 | 426-AsnProGlnLysHisGlnGly-432 |
| SEQ. ID. NO. 3251 | 436-IleArgCysAspSerProAsp-442 |
| SEQ. ID. NO. 3252 | 467-LysAsnTyrArgIleAspThr-473 |
| SEQ. ID. NO. 3253 | 515-GlnArgLeuArgHis-519 |
| SEQ. ID. NO. 3254 | 531-IleValArgArgLysAspLeuThrPro-539 |
| 214-1 | |
| AMPHI Regions - AMPHI | |
| SEQ. ID. NO. 3255 | 6-CysLysLeuPheValLeuIle-12 |
| SEQ. ID. NO. 3256 | 69-ValThrArgGlyGlyLysGlyGlyGluSerVal-79 |
| SEQ. ID. NO. 3257 | 88-PheSerGlnThrLeuAsp-93 |
| SEQ. ID. NO. 3258 | 122-LysValGlnArgGlyGlyAspVal-129 |
| SEQ. ID. NO. 3259 | 150-ThrLysSerGlyAlaLysSerAlaSerLys-159 |
| Antigenic Index - Jameson-Wolf | |
| SEQ. ID. NO. 3260 | 23-LeuGlnSerAspSerArgGlnProIle-31 |
| SEQ. ID. NO. 3261 | 33-IleGluAlaAspGlnGlySerLeuAspGlnAlaAsnGlnSerThrThrPheSerGlyAsn-52 |
| SEQ. ID. NO. 3262 | 71-ArgGlyGlyLysGlyGlyGluSerValArgAlaGluGlySerProValArgPheSerGlnThrLeuAspGlyGlyLysGlyThrValArgGlyGlnAlaAsnAsn-105 |
| SEQ. ID. NO. 3263 | 119-GlyAsnAlaLysValGlnArgGlyGlyAspValAlaGlu-131 |
| SEQ. ID. NO. 3264 | 137-TyrAsnThrLysThrGluVal-143 |
| SEQ. ID. NO. 3265 | 148-GlySerThrLysSerGlyAlaLysSerAlaSerLysSerGlyArgValSerVal-165 |
| SEQ. ID. NO. 3266 | 168-GlnProSerSerThrGlnLysSerGlu-176 |
| Hydrophilic Regions - Hopp-Woods | |
| SEQ. ID. NO. 3267 | 25-SerAspSerArgGlnProIle-31 |
| SEQ. ID. NO. 3268 | 33-IleGluAlaAspGlnGlySerLeuAspGlnAlaAsn-44 |
| SEQ. ID. NO. 3269 | 71-ArgGlyGlyLysGlyGlyGluSerValArgAlaGluGlySerPro-85 |
| SEQ. ID. NO. 3270 | 92-LeuAspGlyGlyLysGlyThrValArgGlyGlnAla-103 |
| SEQ. ID. NO. 3271 | 121-AlaLysValGlnArgGlyGlyAspValAlaGlu-131 |
| SEQ. ID. NO. 3272 | 148-GlySerThrLysSerGlyAlaLysSerAlaSerLysSerGlyArg-162 |
| SEQ. ID. NO. 3273 | 171-SerThrGlnLysSerGlu-176 |
| 215-2 | |
| AMPHI Regions - AMPHI | |
| SEQ. ID. NO. 3274 | 21-SerLeuSerAlaTrpLeuGlyArgIle-29 |
| SEQ. ID. NO. 3275 | 67-SerAlaLysGlyAlaLysGlnPheProGlu-76 |
| Antigenic Index - Jameson-Wolf | |
| SEQ. ID. NO. 3276 | 3-ValArgTrpArgTyrGly-8 |
| SEQ. ID. NO. 3277 | 28-ArgIleSerGluValGluIleGluGluValArgLeuAsnProAspGluProGlnTyrThrMetAspGlyLeuAspGlyArgArgPheAspGluGlnGlyTyrLeuLys-63 |
| SEQ. ID. NO. 3278 | 65-HisLeuSerAlaLysGlyAlaLysGlnPheProGluSerSerAspIleHisPheAspSerProHisLeu-87 |
| SEQ. ID. NO. 3279 | 99-ValGlySerAspGluAlaValTyrHisThrGluAsnLysGlnValLeuPhe-115 |
| SEQ. ID. NO. 3280 | 123-LysThrAlaAspGlyLysArgGlnAlaGlyLysValGluAlaGluLysLeuHisValAspThrGluSerGlnTyrAlaGlnThrAspThrProVal-154 |
| SEQ. ID. NO. 3281 | 160-AlaSerHisGlyGlnAlaGlyGlyMetThrTyrAspHisLysThrGly-175 |
| SEQ. ID. NO. 3282 | 179-PheSerSerLysValLys-184 |
| SEQ. ID. NO. 3283 | 187-IleTyrAspThrLysAspMet-193 |
| Hydrophilic Regions - Hopp-Woods | |
| SEQ. ID. NO. 3284 | 29-IleSerGluValGluIleGluGluValArgLeuAsnProAspGluProGlnTyr-46 |
| SEQ. ID. NO. 3285 | 49-AspGlyLeuAspGlyArgArgPheAspGlu-58 |
| SEQ. ID. NO. 3286 | 65-HisLeuSerAlaLysGlyAlaLysGlnPheProGluSerSerAspIleHisPhe-82 |

TABLE 1-continued

| | |
|---|---|
| SEQ. ID. NO. 3287 | 99-ValGlySerAspGluAlaValTyr-106 |
| SEQ. ID. NO. 3288 | 108-ThrGluAsnLysGlnValLeu-114 |
| SEQ. ID. NO. 3289 | 123-LysThrAlaAspGlyLysArgGlnAlaGlyLysValGluAlaGluLysLeuHisValAspThrGluSerGlnTyrAla-148 |
| SEQ. ID. NO. 3290 | 170-TyrAspHisLysThr-174 |
| SEQ. ID. NO. 3291 | 187-IleTyrAspThrLysAspMet-193 |

216-2
AMPHI Regions - AMPHI

| | |
|---|---|
| SEQ. ID. NO. 3292 | 6-LysTyrLeuAspTrpAlaArg-12 |
| SEQ. ID. NO. 3293 | 19-AlaGluGlyLeuArgGluIleAlaAlaGluLeu-29 |
| SEQ. ID. NO. 3294 | 60-ArgLysMetAlaAla-64 |
| SEQ. ID. NO. 3295 | 165-LeuGlyAspAlaLeuAlaVal-171 |
| SEQ. ID. NO. 3296 | 201-ValAlaAspIleMetHis-206 |
| SEQ. ID. NO. 3297 | 216-LeuGlyThrProLeuLysGlu-222 |
| SEQ. ID. NO. 3298 | 242-GlyArgLeuLysGlyVal-247 |
| SEQ. ID. NO. 3299 | 251-GlyAspLeuArgArgLeuPheGlnGluCysAspAsnPheThrGlyLeuSerIle-268 |
| SEQ. ID. NO. 3300 | 272-MetHisThrHisProLysThrIleSerAla-281 |
| SEQ. ID. NO. 3301 | 290-LysValMetGlnAlaAsn-295 |

Antigenic Index - Jameson-Wolf

| | |
|---|---|
| SEQ. ID. NO. 3302 | 1-MetAlaGluAsnGlyLysTyr-7 |
| SEQ. ID. NO. 3303 | 14-ValLeuHisAlaGluAlaGluGlyLeuArgGluIleAlaAlaGluLeuAspLysAsnPhe-33 |
| SEQ. ID. NO. 3304 | 43-CysLysGlyArgVal-47 |
| SEQ. ID. NO. 3305 | 51-GlyMetGlyLysSerGlyHisIleGlyArgLysMetAla-63 |
| SEQ. ID. NO. 3306 | 80-GluAlaAlaHisGlyAspLeu-86 |
| SEQ. ID. NO. 3307 | 90-ValAspAsnAspVal-94 |
| SEQ. ID. NO. 3308 | 99-SerAsnSerGlyGluSerAspGluIle-107 |
| SEQ. ID. NO. 3309 | 113-AlaLeuLysArgLysAspIle-119 |
| SEQ. ID. NO. 3310 | 125-ThrAlaArgProAspSerThrMetAlaArgHisAlaAsp-137 |
| SEQ. ID. NO. 3311 | 144-ValSerLysGluAlaCysPro-150 |
| SEQ. ID. NO. 3312 | 177-ArgAlaPheThrProAspAspPheAla-185 |
| SEQ. ID. NO. 3313 | 188-HisProAlaGlySerLeuGlyLys-195 |
| SEQ. ID. NO. 3314 | 203-AspIleMetHisLysGlyGlyGlyLeuProAla-213 |
| SEQ. ID. NO. 3315 | 216-LeuGlyThrProLeuLysGluAlaIle-224 |
| SEQ. ID. NO. 3316 | 227-MetSerGluLysGlyLeu-232 |
| SEQ. ID. NO. 3317 | 237-ValThrAspGlyGlnGlyArgLeuLysGly-246 |
| SEQ. ID. NO. 3318 | 248-PheThrAspGlyAspLeuArgArgLeuPheGlnGluCysAspAsnPheThr-264 |
| SEQ. ID. NO. 3319 | 275-HisProLysThrIleSerAlaGluArgLeuAlaThrGluAlaLeuLys-290 |
| SEQ. ID. NO. 3320 | 303-ThrAspAlaAspGly-307 |

Hydrophilic Regions - Hopp-Woods

| | |
|---|---|
| SEQ. ID. NO. 3321 | 1-MetAlaGluAsnGlyLys-6 |
| SEQ. ID. NO. 3322 | 14-ValLeuHisAlaGluAlaGluGlyLeuArgGluIleAlaAlaGluLeuAspLys-31 |
| SEQ. ID. NO. 3323 | 43-CysLysGlyArgVal-47 |
| SEQ. ID. NO. 3324 | 56-GlyHisIleGlyArgLysMetAla-63 |
| SEQ. ID. NO. 3325 | 100-AsnSerGlyGluSerAspGluIle-107 |
| SEQ. ID. NO. 3326 | 113-AlaLeuLysArgLysAspIle-119 |
| SEQ. ID. NO. 3327 | 126-AlaArgProAspSerThrMetAlaArgHisAlaAsp-137 |
| SEQ. ID. NO. 3328 | 144-ValSerLysGluAlaCys-149 |
| SEQ. ID. NO. 3329 | 177-ArgAlaPheThrProAspAspPheAla-185 |
| SEQ. ID. NO. 3330 | 218-ThrProLeuLysGluAlaIle-224 |
| SEQ. ID. NO. 3331 | 227-MetSerGluLysGlyLeu-232 |
| SEQ. ID. NO. 3332 | 239-AspGlyGlnGlyArgLeuLys-245 |
| SEQ. ID. NO. 3333 | 251-GlyAspLeuArgArgLeuPheGlnGluCysAspAsn-262 |
| SEQ. ID. NO. 3334 | 277-LysThrIleSerAlaGluArgLeuAlaThrGluAlaLeuLys-290 |
| SEQ. ID. NO. 3335 | 303-ThrAspAlaAspGly-307 |

218-2
AMPHI Regions - AMPHI

| | |
|---|---|
| SEQ. ID. NO. 3336 | 37-LeuLeuAlaValThr-41 |
| SEQ. ID. NO. 3337 | 121-AlaLysValValSerThrMet-127 |
| SEQ. ID. NO. 3338 | 136-ThrMetAspGluIleHisSer-142 |
| SEQ. ID. NO. 3339 | 190-AlaArgSerTrpTrpArgAsnLeuHisGlyThrPheGlyThrTrpValSerLeuIleLeu-209 |
| SEQ. ID. NO. 3340 | 223-TrpGlyGlyLysPheValGlnAlaTrpSerGlnPhePro-235 |
| SEQ. ID. NO. 3341 | 288-AspGluProMetThrLeuGluThrValAspArgPheAlaArgGlu-302 |
| SEQ. ID. NO. 3342 | 359-TyrAsnProPheGlyLysPheMet-366 |
| SEQ. ID. NO. 3343 | 377-LeuGlyTrpTrpSerValLeuAlaAsn-385 |

Antigenic Index - Jameson-Wolf

| | |
|---|---|
| SEQ. ID. NO. 3344 | 3-ThrGlnIleLysThrGluAlaAspAsnGlnSerAsnArgArgTyrLeu-18 |
| SEQ. ID. NO. 3345 | 51-IleThrGlyLysGluGlyGluArgIleHis-60 |
| SEQ. ID. NO. 3346 | 74-AlaGluAlaAlaArgSerAlaValAsnProGluThrSerSer-87 |
| SEQ. ID. NO. 3347 | 94-ProArgAlaAspAspMet-99 |
| SEQ. ID. NO. 3348 | 105-ValAsnAsnGluGlyLysAla-111 |
| SEQ. ID. NO. 3349 | 125-SerThrMetProArgAsnGlnGlyTrp-133 |
| SEQ. ID. NO. 3350 | 174-ValLysArgArgGlyIleLysAla-181 |
| SEQ. ID. NO. 3351 | 183-LeuLeuProSerLysGlyArgAlaArgSerTrpTrp-194 |
| SEQ. ID. NO. 3352 | 196-AsnLeuHisGlyThrPheGly-202 |
| SEQ. ID. NO. 3353 | 235-ProAlaGlyLysTrpGlyValGluProAsnProVal-246 |
| SEQ. ID. NO. 3354 | 255-ValLeuAsnAspGlyLysValLysGlu-263 |
| SEQ. ID. NO. 3355 | 279-ThrValGlyLysAspGlyIleAsnProAspGluProMetThr-292 |
| SEQ. ID. NO. 3356 | 294-GluThrValAspArgPheAlaArg-301 |
| SEQ. ID. NO. 3357 | 303-IleGlyPheLysGlyArgTyrGlnLeuAsnLeuProLysGlyGluAspGly-319 |
| SEQ. ID. NO. 3358 | 323-LeuSerGlnAspSerMetSerTyr-330 |
| SEQ. ID. NO. 3359 | 336-PheAlaAspArgThrValHis-342 |

TABLE 1-continued

| | |
|---|---|
| SEQ. ID. NO. 3360 | 344-AspGlnTyrSerGlyLysIleLeuAla-352 |
| SEQ. ID. NO. 3361 | 354-IleArgPheAspAspTyrAsnProPhe-362 |
| SEQ. ID. NO. 3362 | 404-TrpLysArgArgProThrGlyAla-411 |
| SEQ. ID. NO. 3363 | 417-ProAlaGlnLysValLysLeu-423 |

Hydrophilic Regions - Hopp-Woods

| | |
|---|---|
| SEQ. ID. NO. 3364 | 3-ThrGlnIleLysThrGluAlaAspAsnGlnSerAsnArgArgTyr-17 |
| SEQ. ID. NO. 3365 | 52-ThrGlyLysGluGlyGluArgIleHis-60 |
| SEQ. ID. NO. 3366 | 74-AlaGluAlaAlaArgSerAlaValAsnProGluThrSerSer-87 |
| SEQ. ID. NO. 3367 | 94-ProArgAlaAspAspMet-99 |
| SEQ. ID. NO. 3368 | 105-ValAsnAsnGluGlyLysAla-111 |
| SEQ. ID. NO. 3369 | 175-LysArgArgGlyIleLys-180 |
| SEQ. ID. NO. 3370 | 186-SerLysGlyArgAla-190 |
| SEQ. ID. NO. 3371 | 255-ValLeuAsnAspGlyLysValLysGlu-263 |
| SEQ. ID. NO. 3372 | 279-ThrValGlyLysAspGlyIleAsnProAspGluProMetThr-292 |
| SEQ. ID. NO. 3373 | 294-GluThrValAspArgPheAlaArg-301 |
| SEQ. ID. NO. 3374 | 314-ProLysGlyGluAspGly-319 |
| SEQ. ID. NO. 3375 | 325-GlnAspSerMetSer-329 |
| SEQ. ID. NO. 3376 | 336-PheAlaAspArgThrValHis-342 |
| SEQ. ID. NO. 3377 | 354-IleArgPheAspAsp-358 |
| SEQ. ID. NO. 3378 | 405-LysArgArgProThrGly-410 |

219-2 (included in 218, so delete this one)
AMPHI Regions - AMPHI

| | |
|---|---|
| SEQ. ID. NO. 3379 | 37-LeuLeuAlaValThr-41 |
| SEQ. ID. NO. 3380 | 121-AlaLysValValSerThrMet-127 |
| SEQ. ID. NO. 3381 | 136-ThrMetAspGluIleHisSer-142 |
| SEQ. ID. NO. 3382 | 190-AlaArgSerTrpArgAsnLeuHisGlyThrPheGlyThrTrpValSerLeuIleLeu-209 |
| SEQ. ID. NO. 3383 | 223-TrpGlyGlyLysPheValGlnAlaTrpSerGlnPhePro-235 |
| SEQ. ID. NO. 3384 | 288-AspGluProMetThrLeuGluThrValAspArgPheAlaArgGlu-302 |
| SEQ. ID. NO. 3385 | 359-TyrAsnProPheGlyLysPheMet-366 |
| SEQ. ID. NO. 3386 | 377-LeuGlyTrpTrpSerValLeuAlaAsn-385 |

Antigenic Index - Jameson-Wolf

| | |
|---|---|
| SEQ. ID. NO. 3387 | 3-ThrGlnIleLysThrGluAlaAspAsnGlnSerAsnArgArgTyrLeu-18 |
| SEQ. ID. NO. 3388 | 51-IleThrGlyLysGluGlyGluArgIleHis-60 |
| SEQ. ID. NO. 3389 | 74-AlaGluAlaAlaArgSerAlaValAsnProGluThrSerSer-87 |
| SEQ. ID. NO. 3390 | 94-ProArgAlaAspAspMet-99 |
| SEQ. ID. NO. 3391 | 105-ValAsnAsnGluGlyLysAla-111 |
| SEQ. ID. NO. 3392 | 125-SerThrMetProArgAsnGlnGlyTrp-133 |
| SEQ. ID. NO. 3393 | 174-ValLysArgArgGlyIleLysAla-181 |
| SEQ. ID. NO. 3394 | 183-LeuLeuProSerLysGlyArgAlaArgSerTrpTrp-194 |
| SEQ. ID. NO. 3395 | 196-AsnLeuHisGlyThrPheGly-202 |
| SEQ. ID. NO. 3396 | 235-ProAlaGlyLysTrpGlyValGluProAsnProVal-246 |
| SEQ. ID. NO. 3397 | 255-ValLeuAsnAspGlyLysValLysGlu-263 |
| SEQ. ID. NO. 3398 | 279-ThrValGlyLysAspGlyIleAsnProAspGluProMetThr-292 |
| SEQ. ID. NO. 3399 | 294-GluThrValAspArgPheAlaArg-301 |
| SEQ. ID. NO. 3400 | 303-IleGlyPheLysGlyArgTyrGlnLeuAsnLeuProLysGlyGluAspGly-319 |
| SEQ. ID. NO. 3401 | 323-LeuSerGlnAspSerMetSerTyr-330 |
| SEQ. ID. NO. 3402 | 336-PheAlaAspArgThrValHis-342 |
| SEQ. ID. NO. 3403 | 344-AspGlnTyrSerGlyLysIleLeuAla-352 |
| SEQ. ID. NO. 3404 | 354-IleArgPheAspAspTyrAsnProPhe-362 |
| SEQ. ID. NO. 3405 | 404-TrpLysArgArgProThrGlyAla-411 |
| SEQ. ID. NO. 3406 | 417-ProAlaGlnLysValLysLeu-423 |

Hydrophilic Regions - Hopp-Woods

| | |
|---|---|
| SEQ. ID. NO. 3407 | 3-ThrGlnIleLysThrGluAlaAspAsnGlnSerAsnArgArgTyr-17 |
| SEQ. ID. NO. 3408 | 52-ThrGlyLysGluGlyGluArgIleHis-60 |
| SEQ. ID. NO. 3409 | 74-AlaGluAlaAlaArgSerAlaValAsnProGluThrSerSer-87 |
| SEQ. ID. NO. 3410 | 94-ProArgAlaAspAspMet-99 |
| SEQ. ID. NO. 3411 | 105-ValAsnAsnGluGlyLysAla-111 |
| SEQ. ID. NO. 3412 | 175-LysArgArgGlyIleLys-180 |
| SEQ. ID. NO. 3413 | 186-SerLysGlyArgAla-190 |
| SEQ. ID. NO. 3414 | 255-ValLeuAsnAspGlyLysValLysGlu-263 |
| SEQ. ID. NO. 3415 | 279-ThrValGlyLysAspGlyIleAsnProAspGluProMetThr-292 |
| SEQ. ID. NO. 3416 | 294-GluThrValAspArgPheAlaArg-301 |
| SEQ. ID. NO. 3417 | 314-ProLysGlyGluAspGly-319 |
| SEQ. ID. NO. 3418 | 325-GlnAspSerMetSer-329 |
| SEQ. ID. NO. 3419 | 336-PheAlaAspArgThrValHis-342 |
| SEQ. ID. NO. 3420 | 354-IleArgPheAspAsp-358 |
| SEQ. ID. NO. 3421 | 405-LysArgArgProThrGly-410 |

225-1
AMPHI Regions - AMPHI

| | |
|---|---|
| SEQ. ID. NO. 3422 | 23-LeuAlaAspGluLeuThrAsn-29 |
| SEQ. ID. NO. 3423 | 37-IleLeuArgGlnPhe-41 |
| SEQ. ID. NO. 3424 | 126-AsnAlaMetGlyLeu-130 |
| SEQ. ID. NO. 3425 | 151-PheMetGlnHisIlePheLys-157 |
| SEQ. ID. NO. 3426 | 217-ThrGlyLysAsnIle-221 |

Antigenic Index - Jameson-Wolf

| | |
|---|---|
| SEQ. ID. NO. 3427 | 22-AlaLeuAlaAspGluLeuThr-28 |
| SEQ. ID. NO. 3428 | 32-SerSerArgGluGlnIleLeu-38 |
| SEQ. ID. NO. 3429 | 41-PheAlaGluAspGluGlnProVal-48 |
| SEQ. ID. NO. 3430 | 52-AsnArgAlaProAlaArgArgAlaGlyAsnAlaAspGluLeuIle-66 |
| SEQ. ID. NO. 3431 | 71-GlyLeuAsnGluGlnProVal-77 |

TABLE 1-continued

| | |
|---|---|
| SEQ. ID. NO. 3432 | 81-AsnArgValProAlaArgArgAlaGlyAsnAlaAspGluLeuIle-95 |
| SEQ. ID. NO. 3433 | 100-GlyLeuAsnGluGlnProVal-106 |
| SEQ. ID. NO. 3434 | 108-ProValAsnArgAlaProAlaArgArgAlaGlyAsnAlaAspGluLeuIle-124 |
| SEQ. ID. NO. 3435 | 144-ThrGlyPheAspCysSerGly-150 |
| SEQ. ID. NO. 3436 | 164-LeuProArgThrSerAlaGluGlnAlaArgMet-174 |
| SEQ. ID. NO. 3437 | 176-ThrProValAlaArgSerGluLeuGlnProGlyAsp-187 |
| SEQ. ID. NO. 3438 | 194-LeuGlyGlySerArgIle-199 |
| SEQ. ID. NO. 3439 | 213-HisAlaProArgThrGlyLysAsnIleGlu-222 |
| SEQ. ID. NO. 3440 | 225-SerLeuSerHisLysTyrTrpSerGlyLys-234 |
| SEQ. ID. NO. 3441 | 239-ArgArgValLysLysAsnAspProSerArgPhe-249 |
| Hydrophilic Regions - Hopp-Woods | |
| SEQ. ID. NO. 3442 | 22-AlaLeuAlaAspGluLeuThr-28 |
| SEQ. ID. NO. 3443 | 32-SerSerArgGluGlnIleLeu-38 |
| SEQ. ID. NO. 3444 | 41-PheAlaGluAspGluGlnPro-47 |
| SEQ. ID. NO. 3445 | 53-ArgAlaProAlaArgArgAlaGlyAsnAlaAspGluLeuIle-66 |
| SEQ. ID. NO. 3446 | 83-ValProAlaArgArgAlaGlyAsnAlaAspGluLeuIle-95 |
| SEQ. ID. NO. 3447 | 111-ArgAlaProAlaArgArgAlaGlyAsnAlaAspGluLeuIle-124 |
| SEQ. ID. NO. 3448 | 166-ArgThrSerAlaGluGlnAlaArgMet-174 |
| SEQ. ID. NO. 3449 | 178-ValAlaArgSerGluLeuGlnPro-185 |
| SEQ. ID. NO. 3450 | 216-ArgThrGlyLysAsnIleGlu-222 |
| SEQ. ID. NO. 3451 | 239-ArgArgValLysLysAsnAspProSerArg-248 |
| 226 | |
| AMPHI Regions - AMPHI | |
| SEQ. ID. NO. 3452 | 44-LeuIleAlaTyrLeuLys-49 |
| SEQ. ID. NO. 3453 | 61-AlaAlaGlnPheIleAspPheTrpLeu-69 |
| SEQ. ID. NO. 3454 | 98-GlnLeuAlaGlySerValThrGlyIleValThr-108 |
| SEQ. ID. NO. 3455 | 141-ArgSerIleGlyGlyIleProAlaIleThr-150 |
| SEQ. ID. NO. 3456 | 157-AlaGlyLeuValGlyGlnIleAlaGlyTyrLys-167 |
| SEQ. ID. NO. 3457 | 197-GluArgSerArgArg-201 |
| Antigenic Index - Jameson-Wolf | |
| SEQ. ID. NO. 3458 | 3-GluIleLeuArgGlnProSer-9 |
| SEQ. ID. NO. 3459 | 25-ValArgThrArgThrGlyAsnIle-32 |
| SEQ. ID. NO. 3460 | 81-TyrGlnAsnArgArgLysIle-87 |
| SEQ. ID. NO. 3461 | 117-GlyAlaGluArgGluVal-122 |
| SEQ. ID. NO. 3462 | 128-SerLysSerValThrAsn-133 |
| SEQ. ID. NO. 3463 | 139-IleThrArgSerIleGlyGly-145 |
| SEQ. ID. NO. 3464 | 167-LysMetLeuLysAsnThrVal-173 |
| SEQ. ID. NO. 3465 | 195-SerLeuGluArgSerArgArgMetAla-203 |
| Hydrophilic Regions - Hopp-Woods | |
| SEQ. ID. NO. 3466 | 25-ValArgThrArgThr-29 |
| SEQ. ID. NO. 3467 | 82-GlnAsnArgArgLysIle-87 |
| SEQ. ID. NO. 3468 | 117-GlyAlaGluArgGluVal-122 |
| SEQ. ID. NO. 3469 | 195-SerLeuGluArgSerArgArgMetAla-203 |
| 227-2 | |
| AMPHI Regions - AMPHI | |
| SEQ. ID. NO. 3470 | 36-GlyValLeuPheAlaLeuLeuGlnAla-44 |
| SEQ. ID. NO. 3471 | 52-LeuGlnGlnLeuThrAspAlaLeu-59 |
| SEQ. ID. NO. 3472 | 74-ValIleSerTyrLeuAspLeuIleAlaAspAspTrpPheSer-87 |
| 228 | |
| AMPHI Regions - AMPHI | |
| SEQ. ID. NO. 3473 | 24-GluValLysGluAlaValGlnAlaValGlu-33 |
| SEQ. ID. NO. 3474 | 40-AlaAlaSerAlaAlaGluSerAlaAlaSerAlaValGluGluAlaLysAspGlnValLysAspAla-61 |
| SEQ. ID. NO. 3475 | 78-GluAlaValThrGluAlaAlaLysAspThrLeuAsnLysAlaAlaAspAlaThrGlnGluAlaAlaAspLysMetLysAspAlaAla-106 |
| Antigenic Index - Jameson-Wolf | |
| SEQ. ID. NO. 3476 | 18-SerGlnGluAlaLysGlnGluValLysGluAlaValGln-30 |
| SEQ. ID. NO. 3477 | 32-ValGluSerAspValLysAspThrAlaAlaSerAlaAlaGluSerAlaAlaSerAlaValGluGluAlaLysAspGlnValLysAspAlaAlaAlaAspAlaLysAlaSerAlaGluGluAlaValThrGluAlaLysGluAlaValThrGluAlaAlaLysAspThrLeuAsnLysAlaAlaAspAlaThrGlnGluAlaAlaAspLysMetLysAspAlaAlaLys-107 |
| Hydrophilic Regions - Hopp-Woods | |
| SEQ. ID. NO. 3478 | 18-SerGlnGluAlaLysGlnGluValLysGluAlaValGln-30 |
| SEQ. ID. NO. 3479 | 32-ValGluSerAspValLysAspThrAlaAlaSerAlaAlaGluSerAlaAlaSerAlaValGluGluAlaLysAspGlnValLysAspAlaAlaAlaAspAlaLysAlaSerAlaGluGluAlaValThrGluAlaLysGluAlaValThrGluAlaAlaLysAspThrLeuAsnLysAlaAlaAspAlaThrGlnGluAlaAlaAspLysMetLysAspAlaAlaLys-107 |
| 230-1 | |
| AMPHI Regions - AMPHI | |
| SEQ. ID. NO. 3480 | 6-GluLysTyrArgThr-10 |
| SEQ. ID. NO. 3481 | 49-AspHisSerIleAsnAsn-54 |
| SEQ. ID. NO. 3482 | 56-IleGlnAsnGluGln-60 |
| SEQ. ID. NO. 3483 | 73-GlnSerLeuLeuGln-77 |
| SEQ. ID. NO. 3484 | 81-LeuLysGlnGlyAlaLys-86 |
| SEQ. ID. NO. 3485 | 96-GlnIleLysGlnIleIle-101 |
| SEQ. ID. NO. 3486 | 133-PheValGluGluIleArgAspGlnPhe-141 |
| SEQ. ID. NO. 3487 | 144-GlnAsnLeuValAsnLeuVal-150 |
| SEQ. ID. NO. 3488 | 161-AlaGluGlnLeuIleArgLeuThrGlnValAsnArgThrIleArg-175 |
| SEQ. ID. NO. 3489 | 184-PheIleAlaGlnVal-188 |
| SEQ. ID. NO. 3490 | 194-AspLeuGlnLysPheTyrAsn-200 |
| SEQ. ID. NO. 3491 | 234-GluValLysAsnAlaPheGluGluArgValAlaArgLeu-246 |
| SEQ. ID. NO. 3492 | 272-ValAlaAspPheAsnLys-277 |
| SEQ. ID. NO. 3493 | 284-AspAspAlaPheAsnHisProSerLeuAlaGluAla-296 |
| SEQ. ID. NO. 3494 | 319-SerGlyMetProGluAsnLeuIleAsnAlaVal-329 |

TABLE 1-continued

| | |
|---|---|
| SEQ. ID. NO. 3495 | 398-LeuAsnGlyGlyLys-402 |
| SEQ. ID. NO. 3496 | 426-GluAlaTyrAlaGluLeu-431 |
| SEQ. ID. NO. 3497 | 444-ValArgLeuIleGlyLeuProAlaPro-452 |
| SEQ. ID. NO. 3498 | 456-GluValGlnAlaValThrProProAspAspIleAla-467 |
| SEQ. ID. NO. 3499 | 488-LeuLeuIleArgTyrPheAsn-494 |
| Antigenic Index - Jameson-Wolf | |
| SEQ. ID. NO. 3500 | 4-SerIleGluLysTyrArgThrProAla-12 |
| SEQ. ID. NO. 3501 | 32-SerHisProGlyAlaAsp-37 |
| SEQ. ID. NO. 3502 | 42-ValGlyAspGluLysIleSerAspHisSerIle-52 |
| SEQ. ID. NO. 3503 | 56-IleGlnAsnGluGlnAlaAspGlyGlyGlyProSerArgAspAlaVal-71 |
| SEQ. ID. NO. 3504 | 80-TyrLeuLysGlnGlyAla-85 |
| SEQ. ID. NO. 3505 | 92-ValSerSerGluGlnIleLys-98 |
| SEQ. ID. NO. 3506 | 101-IleValAspAspProAsnPheHisAspAlaAsnGlyLysPheAsp-115 |
| SEQ. ID. NO. 3507 | 122-TyrLeuSerGlnArgHisMetSerGluAspGlnPheValGluGluIleArgAsp-139 |
| SEQ. ID. NO. 3508 | 169-GlnValAsnArgThrIleArgSerHisThrPheAsnProAspGluPhe-184 |
| SEQ. ID. NO. 3509 | 189-LysValSerGluAlaAspLeu-195 |
| SEQ. ID. NO. 3510 | 199-TyrAsnAlaAsnLysLysAspTyrLeu-207 |
| SEQ. ID. NO. 3511 | 223-AspPheAlaAspLysGlnThrValSerGluThrGluValLysAsnAlaPheGluGluArgValAlaArg-245 |
| SEQ. ID. NO. 3512 | 247-ProAlaAsnGluAlaLysProSerPheGluGlnGluLysAlaAlaValGluAsnGluLeuLysMetLysLysAlaValAlaAspPheAsnLysAlaLys GluLysLeuGlyAspAspAlaPheAsnHisProSerSerLeuAlaGluAlaAlaLysAsnSerGlyLeuLysValGluThrGlnGluThrTrpLeuSerArgGln AspAlaGlnMetSerGlyMetProGluAsn-324 |
| SEQ. ID. NO. 3513 | 330-PheSerAspAspValLeuLysLysLysHisAsnSerGlu-342 |
| SEQ. ID. NO. 3514 | 355-ArgAlaLysGluValArgGluGluLysThrLeuPro-366 |
| SEQ. ID. NO. 3515 | 368-AlaGluAlaLysAspAlaValArg-375 |
| SEQ. ID. NO. 3516 | 377-AlaTyrIleArgThrGluAlaAlaLysLeuAlaGluAsnLysAlaLysAspValLeu-395 |
| SEQ. ID. NO. 3517 | 399-AsnGlyGlyLysAlaValAsp-405 |
| SEQ. ID. NO. 3518 | 417-GlnGlnAlaArgGlnSerMetProProGluAlaTyr-428 |
| SEQ. ID. NO. 3519 | 432-LeuLysAlaLysProAlaAsnGlyLysProAla-442 |
| SEQ. ID. NO. 3520 | 459-AlaValThrProProAspAspIleAla-467 |
| SEQ. ID. NO. 3521 | 476-AlaLeuAlaGlnGlnGlnSerAlaAsnThrPhe-486 |
| SEQ. ID. NO. 3522 | 493-PheAsnGlyLysIleLysGlnThrLysGlyAlaGlnSerValAspAsnGlyAspGlyGln-512 |
| Hydrophilic Regions - Hopp-Woods | |
| SEQ. ID. NO. 3523 | 6-GluLysTyrArgThr-10 |
| SEQ. ID. NO. 3524 | 42-ValGlyAspGluLysIleSerAsp-49 |
| SEQ. ID. NO. 3525 | 56-IleGlnAsnGluGlnAlaAspGlyGlyGlyProSerArgAspAlaVal-71 |
| SEQ. ID. NO. 3526 | 92-ValSerSerGluGlnIleLys-98 |
| SEQ. ID. NO. 3527 | 101-IleValAspAspProAsnPhe-107 |
| SEQ. ID. NO. 3528 | 110-AlaAsnGlyLysPheAsp-115 |
| SEQ. ID. NO. 3529 | 126-ArgHisMetSerGluAspGlnPheValGluGluIleArgAsp-139 |
| SEQ. ID. NO. 3530 | 189-LysValSerGluAlaAspLeu-195 |
| SEQ. ID. NO. 3531 | 200-AsnAlaAsnLysLysAspTyrLeu-207 |
| SEQ. ID. NO. 3532 | 223-AspPheAlaAspLysGlnThrValSerGluThrGluValLysAsnAlaPheGluGluArgValAlaArg-245 |
| SEQ. ID. NO. 3533 | 247-ProAlaAsnGluAlaLysProSerPheGluGlnGluLysAlaAlaValGluAsnGluLeuLysMetLysLysAlaValAlaAspPheAsnLysAlaLys GluLysLeuGlyAspAspAlaPhe-287 |
| SEQ. ID. NO. 3534 | 292-SerLeuAlaGluAlaAlaLysAsnSerGlyLeuLysValGluThrGlnGlu-308 |
| SEQ. ID. NO. 3535 | 310-TrpLeuSerArgGlnAspAlaGlnMet-318 |
| SEQ. ID. NO. 3536 | 333-AspValLeuLysLysLysHisAsnSer-341 |
| SEQ. ID. NO. 3537 | 355-ArgAlaLysGluValArgGluGluLysThrLeuPro-366 |
| SEQ. ID. NO. 3538 | 368-AlaGluAlaLysAspAlaValArg-375 |
| SEQ. ID. NO. 3539 | 377-AlaTyrIleArgThrGluAlaAlaLysLeuAlaGluAsnLysAlaLysAspValLeu-395 |
| SEQ. ID. NO. 3540 | 417-GlnGlnAlaArgGlnSerMetPro-424 |
| SEQ. ID. NO. 3541 | 432-LeuLysAlaLysProAlaAsnGly-439 |
| SEQ. ID. NO. 3542 | 461-ThrProProAspAspIleAla-467 |
| SEQ. ID. NO. 3543 | 496-LysIleLysGlnThrLysGlyAlaGlnSerValAspAsnGlyAspGlyGln-512 |
| 231-1 | |
| AMPHI Regions - AMPHI | |
| SEQ. ID. NO. 3544 | 7-IleAsnArgProTyrGlnLysProAlaGluLeu-17 |
| SEQ. ID. NO. 3545 | 98-ArgIlePheSerPheProGln-104 |
| SEQ. ID. NO. 3546 | 209-AlaValAspAsnValLysGlyValAlaVal-218 |
| SEQ. ID. NO. 3547 | 228-AlaValAlaGlyPheArgArgCysSerAlaAla-238 |
| SEQ. ID. NO. 3548 | 263-LeuAlaAlaValProArgIleThrGln-271 |
| SEQ. ID. NO. 3549 | 281-LysProPheHisAspPhePheAsnLeu-289 |
| Antigenic Index - Jameson-Wolf | |
| SEQ. ID. NO. 3550 | 1-MetSerLysArgLysSerIleAsnArgProTyrGlnLysProAlaGlu-16 |
| SEQ. ID. NO. 3551 | 18-ProProLeuGlnAsnAsnProProPheTyrArgLysAsnArgArgLeuAsn-34 |
| SEQ. ID. NO. 3552 | 39-AlaAspGlyGlyCysAlaSerProGlnLysCysArgAlaArgGlyPheGln-55 |
| SEQ. ID. NO. 3553 | 90-SerAlaValArgProArgArgLeuArg-98 |
| SEQ. ID. NO. 3554 | 135-MetProArgArgProVal-140 |
| SEQ. ID. NO. 3555 | 150-PheAlaAspArgAsnLeuArg-156 |
| SEQ. ID. NO. 3556 | 174-AlaPheArgArgArgAlaGlnVal-181 |
| SEQ. ID. NO. 3557 | 183-AlaArgThrArgAla-187 |
| SEQ. ID. NO. 3558 | 194-ArgArgValAspIleArgHisProAspPhe-203 |
| SEQ. ID. NO. 3559 | 211-AspAsnValLysGly-215 |
| SEQ. ID. NO. 3560 | 231-GlyPheArgArgCysSerAlaAlaGlyGlyArgValGlyThr-244 |
| SEQ. ID. NO. 3561 | 246-ValProCysArgAlaGluTyrValGluTyrGlyAsnArgArgProHisArgLeuAlaAla-265 |
| SEQ. ID. NO. 3562 | 269-IleThrGlnArgThrLysArgGlnGlyAspGlyLysProPhe-283 |
| SEQ. ID. NO. 3563 | 294-MetProMetProSerGluHis |
| Hydrophilic Regions - Hopp-Woods | |
| SEQ. ID. NO. 3564 | 1-MetSerLysArgLysSerIleAsn-8 |
| SEQ. ID. NO. 3565 | 10-ProTyrGlnLysProAlaGlu-16 |

TABLE 1-continued

| | |
|---|---|
| SEQ. ID. NO. 3566 | 26-PheTyrArgLysAsnArgArg-32 |
| SEQ. ID. NO. 3567 | 45-SerProGlnLysCysArgAlaArgGly-53 |
| SEQ. ID. NO. 3568 | 92-ValArgProArgArgLeuArg-98 |
| SEQ. ID. NO. 3569 | 136-ProArgArgProVal-140 |
| SEQ. ID. NO. 3570 | 150-PheAlaAspArgAsnLeuArg-156 |
| SEQ. ID. NO. 3571 | 174-AlaPheArgArgArgAlaGlnVal-181 |
| SEQ. ID. NO. 3572 | 183-AlaArgThrArgAla-187 |
| SEQ. ID. NO. 3573 | 194-ArgArgValAspIleArgHis-200 |
| SEQ. ID. NO. 3574 | 231-GlyPheArgArgCysSerAlaAlaGlyGlyArgValGlyThr-244 |
| SEQ. ID. NO. 3575 | 246-ValProCysArgAlaGluTyr-252 |
| SEQ. ID. NO. 3576 | 254-GluTyrGlyAsnArgArgProHisArg-262 |
| SEQ. ID. NO. 3577 | 269-IleThrGlnArgThrGlnLysArgGlnGlyAspGlyLysProPhe-283 |

232-2
AMPHI Regions - AMPHI

| | |
|---|---|
| SEQ. ID. NO. 3578 | 23-GlnPheLeuGlyAlaPheAsnAspAsnVal-32 |
| SEQ. ID. NO. 3579 | 55-GlyGlnMetLeuAsn-59 |
| SEQ. ID. NO. 3580 | 74-SerLeuSerGlyGlnLeuGlyAsnLysPheAspLysAlaValLeuAlaArgTrpValLysValLeuGluMetIleIleMet-100 |
| SEQ. ID. NO. 3581 | 127-ThrLeuPheGlyProLeuLysTyr-134 |
| SEQ. ID. NO. 3582 | 160-AlaIleLeuPheGly-164 |
| SEQ. ID. NO. 3583 | 167-LeuGlyThrAlaValAlaGlyValProProTyrIleValGlyIleLeuVal-183 |
| SEQ. ID. NO. 3584 | 214-ValArgGlyThrLysSerLeuLeuArgGlu-223 |
| SEQ. ID. NO. 3585 | 251-LeuProThrPheThrGln-256 |
| SEQ. ID. NO. 3586 | 319-ArgPheGluGlyLeuAsn-324 |
| SEQ. ID. NO. 3587 | 340-AlaValMetThrLeuIleGlyPhePheGlyGlyPhePheSerValProLeuTyrThrTrpLeu-360 |

Antigenic Index - Jameson-Wolf

| | |
|---|---|
| SEQ. ID. NO. 3588 | 1-MetTyrAlaLysLysGlyGlyLeuGlyLeuValLysSerArgArgPhe-16 |
| SEQ. ID. NO. 3589 | 75-LeuSerGlyGlnLeuGlyAsnLysPheAspLys-85 |
| SEQ. ID. NO. 3590 | 139-AspTyrLeuAspAspLysGluLeuMetMet-148 |
| SEQ. ID. NO. 3591 | 200-ValProAlaLysAlaAlaAspThrGlnIle-209 |
| SEQ. ID. NO. 3592 | 215-ArgGlyThrLysSerLeuLeuArgGluThrValArgHisLysPro-229 |
| SEQ. ID. NO. 3593 | 258-HisLeuGlyGlyAsnAspAsnVal-265 |
| SEQ. ID. NO. 3594 | 286-LysPheSerArgGluArgLeu-292 |
| SEQ. ID. NO. 3595 | 316-HisGlyHisArgPheGluGly-322 |
| SEQ. ID. NO. 3596 | 363-AlaSerSerGluThrPheArgAlaArgAla-372 |
| SEQ. ID. NO. 3597 | 420-IleLysArgGluArgArgPheLeu-427 |
| SEQ. ID. NO. 3598 | 431-AlaIleArgLysLysPro-436 |

Hydrophilic Regions - Hopp-Woods

| | |
|---|---|
| SEQ. ID. NO. 3599 | 2-TyrAlaLysLysGlyGly-7 |
| SEQ. ID. NO. 3600 | 11-ValLysSerArgArgPhe-16 |
| SEQ. ID. NO. 3601 | 81-AsnLysPheAspLys-85 |
| SEQ. ID. NO. 3602 | 140-TyrLeuAspAspLysGluLeuMet-147 |
| SEQ. ID. NO. 3603 | 201-ProAlaLysAlaAlaAspThrGlnIle-209 |
| SEQ. ID. NO. 3604 | 215-ArgGlyThrLysSerLeuLeuArgGluThrValArgHis-227 |
| SEQ. ID. NO. 3605 | 286-LysPheSerArgGluArgLeu-292 |
| SEQ. ID. NO. 3606 | 318-HisArgPheGluGly-322 |
| SEQ. ID. NO. 3607 | 366-GluThrPheArgAlaArgAla-372 |
| SEQ. ID. NO. 3608 | 420-IleLysArgGluArgArgPheLeu-427 |
| SEQ. ID. NO. 3609 | 431-AlaIleArgLysLysPro-436 |

233-2
AMPHI Regions - AMPHI

| | |
|---|---|
| SEQ. ID. NO. 3610 | 61-PheAlaAspLysValGlnThr-67 |
| SEQ. ID. NO. 3611 | 71-GlnValArgValTrpLysAsn-77 |
| SEQ. ID. NO. 3612 | 88-AsnGlyValAlaLysLeuLeuGluThr-96 |
| SEQ. ID. NO. 3613 | 119-AlaLeuThrArgLeuIleGluGlnAlaGlyAsnAla-130 |
| SEQ. ID. NO. 3614 | 138-IleProIleAlaAspThrLeuLysCysAlaAspGlyGlyAsn-151 |
| SEQ. ID. NO. 3615 | 180-AlaAlaGluAsnLeuAspGlyIleThrAsp-189 |

Antigenic Index - Jameson-Wolf

| | |
|---|---|
| SEQ. ID. NO. 3616 | 1-MetLysArgLysAsnIle-6 |
| SEQ. ID. NO. 3617 | 16-AlaArgPheGlyAlaAspLysProLysGlnTyrValGluIleGlySerLysThrValLeu-35 |
| SEQ. ID. NO. 3618 | 43-GluArgHisGluAlaValAsp-49 |
| SEQ. ID. NO. 3619 | 56-SerProGluAspThrPheAlaAspLysValGln-66 |
| SEQ. ID. NO. 3620 | 75-TrpLysAsnGlyGlyGlnThrArgAlaGluThrValArgAsnGlyVal-90 |
| SEQ. ID. NO. 3621 | 100-AlaGluThrAspAsn-104 |
| SEQ. ID. NO. 3622 | 109-AspAlaAlaArgCys-113 |
| SEQ. ID. NO. 3623 | 115-LeuProSerGluAlaLeu-120 |
| SEQ. ID. NO. 3624 | 123-LeuIleGluGlnAlaGlyAsnAlaAlaGluGlyGly-134 |
| SEQ. ID. NO. 3625 | 142-AspThrLeuLysCysAlaAspGlyGlyAsnIle-152 |
| SEQ. ID. NO. 3626 | 155-ThrValGluArgThrSerLeu-161 |
| SEQ. ID. NO. 3627 | 182-GluAsnLeuAspGlyIleThrAspGluAlaSerAlaValGluLysLeuGlyVal-199 |
| SEQ. ID. NO. 3628 | 206-GlyAspValArgAsnLeuLysLeuThrGlnProGlnAspAlaTyr-220 |

Hydrophilic Regions - Hopp-Woods

| | |
|---|---|
| SEQ. ID. NO. 3629 | 1-MetLysArgLysAsnIle-6 |
| SEQ. ID. NO. 3630 | 18-PheGlyAlaAspLysProLysGlnTyrVal-27 |
| SEQ. ID. NO. 3631 | 43-GluArgHisGluAlaValAsp-49 |
| SEQ. ID. NO. 3632 | 56-SerProGluAspThrPheAlaAspLysValGln-66 |
| SEQ. ID. NO. 3633 | 79-GlyGlnThrArgAlaGluThrValArg-87 |
| SEQ. ID. NO. 3634 | 100-AlaGluThrAspAsn-104 |
| SEQ. ID. NO. 3635 | 127-AlaGlyAsnAlaAlaGlu-132 |
| SEQ. ID. NO. 3636 | 142-AspThrLeuLysCysAlaAsp-148 |
| SEQ. ID. NO. 3637 | 182-GluAsnLeuAspGlyIleThrAspGluAlaSerAlaValGluLysLeuGlyVal-199 |

TABLE 1-continued

SEQ. ID. NO. 3638	206-GlyAspValArgAsnLeuLys-212
234-2
AMPHI Regions - AMPHI
SEQ. ID. NO. 3639	26-ArgSerLeuGluValGluLysValAlaSer-35
SEQ. ID. NO. 3640	68-AspArgLeuGlySerGln-73
SEQ. ID. NO. 3641	83-GlnGlnThrAsnArgPheAsnValLeuAsnArgThrAsn-95
SEQ. ID. NO. 3642	121-GlyAspValThrGluPhe-126
SEQ. ID. NO. 3643	206-AlaValAsnSerLeuValGlnAlaValAsp-215
Antigenic Index - Jameson-Wolf
SEQ. ID. NO. 3644	21-AlaThrGluSerSerArgSerLeuGluValGluLysValAlaSer-35
SEQ. ID. NO. 3645	51-ThrPheAspAsnArgSerSerPhe-58
SEQ. ID. NO. 3646	62-IlePheSerAspGlyGluAspArgLeuGlySerGlnAla-74
SEQ. ID. NO. 3647	83-GlnGlnThrAsnArgPheAsnValLeuAsnArgThrAsn-95
SEQ. ID. NO. 3648	99-LeuLysGlnGluSerGlyIleSerGlyLysAlaHisAsnLeuLysGlyAlaAspTyr-117
SEQ. ID. NO. 3649	121-GlyAspValThrGluPheGlyArgArgAspValGlyAsp-133
SEQ. ID. NO. 3650	140-LeuGlyArgGlyLysSerGlnIle-147
SEQ. ID. NO. 3651	160-AsnThrSerGluIle-164
SEQ. ID. NO. 3652	169-GlnGlyAlaGlyGlu-173
SEQ. ID. NO. 3653	175-AlaLeuSerAsnArgGluIle-181
SEQ. ID. NO. 3654	185-GlyGlyThrSerGlyTyrAspAlaThrLeuAsnGlyLysValLeu-199
SEQ. ID. NO. 3655	214-ValAspAsnGlyAlaTrpGlnProAsnArg-223
Hydrophilic Regions - Hopp-Woods
SEQ. ID. NO. 3656	21-AlaThrGluSerSerArgSerLeuGluValGluLysValAla-34
SEQ. ID. NO. 3657	52-PheAspAsnArgSerSerPhe-58
SEQ. ID. NO. 3658	62-IlePheSerAspGlyGluAspArgLeuGlySerGlnAla-74
SEQ. ID. NO. 3659	99-LeuLysGlnGluSerGlyIleSerGlyLysAlaHisAsn-111
SEQ. ID. NO. 3660	122-AspValThrGluPheGlyArgArgAspValGlyAsp-133
SEQ. ID. NO. 3661	141-GlyArgGlyLysSer-145
SEQ. ID. NO. 3662	176-LeuSerAsnArgGluIle-181
235
AMPHI Regions - AMPHI
SEQ. ID. NO. 3663	8-LeuAlaAlaValLeuAlaLeu-14
SEQ. ID. NO. 3664	18-GlnValGlnLysAlaProAsp-24
SEQ. ID. NO. 3665	86-LeuThrAsnAlaAlaAspIle-92
SEQ. ID. NO. 3666	95-ValArgProGluLysLeuHisGlnIlePhe-104
SEQ. ID. NO. 3667	120-SerTyrGlnIleLeuAspSerValThrThr-129
SEQ. ID. NO. 3668	165-GlyAlaLeuValSerAlaValValAsnGlnIleAlaAsnSerLeuThr-180
SEQ. ID. NO. 3669	187-SerLysThrAlaAlaTyrAsnLeuLeuSerProTyr-198
Antigenic Index - Jameson-Wolf
SEQ. ID. NO. 3670	20-GlnLysAlaProAspPheAspTyrThrSerPheLysGluSerLysProAla-36
SEQ. ID. NO. 3671	43-ProLeuAsnGluSerProAspValAsnGlyThr-53
SEQ. ID. NO. 3672	62-AlaProLeuSerGlu-66
SEQ. ID. NO. 3673	79-GluThrPheLysGlnAsnGlyLeuThrAsn-88
SEQ. ID. NO. 3674	93-HisAlaValArgProGluLysLeu-100
SEQ. ID. NO. 3675	131-SerAlaLysAlaArgLeuValAspSerArgAsnGlyLysGluLeuTrpSerGlySerAlaSerIleArgGluGlySerAsnAsnSerAsnSer-161
SEQ. ID. NO. 3676	178-SerLeuThrAspArgGlyTyrGlnValSerLysThrAla-190
SEQ. ID. NO. 3677	202-GlyIleLeuLysGlyProArgPheValGluGluGlnProLys-215
Hydrophilic Regions - Hopp-Woods
SEQ. ID. NO. 3678	20-GlnLysAlaProAspPheAsp-26
SEQ. ID. NO. 3679	29-SerPheLysGluSerLysPro-35
SEQ. ID. NO. 3680	44-LeuAsnGluSerProAspVal-50
SEQ. ID. NO. 3681	93-HisAlaValArgProGluLysLeu-100
SEQ. ID. NO. 3682	131-SerAlaLysAlaArgLeuValAspSerArgAsnGlyLysGluLeuTrp-146
SEQ. ID. NO. 3683	150-AlaSerIleArgGluGlySerAsnAsnSer-159
SEQ. ID. NO. 3684	179-LeuThrAspArgGlyTyrGln-185
SEQ. ID. NO. 3685	207-ProArgPheValGluGluGlnProLys-215
236-2
AMPHI Regions - AMPHI
SEQ. ID. NO. 3686	11-LeuCysThrAlaPheAlaAsp-17
SEQ. ID. NO. 3687	107-PheAlaGlyPheAlaAspCysArgProPhe-116
SEQ. ID. NO. 3688	146-AspAspValProArgPhePheAlaGlyGlu-155
SEQ. ID. NO. 3689	178-AlaAlaCysMetAlaValCysPheGly-186
SEQ. ID. NO. 3690	214-LysValGluGlyIleThrArgIle-221
SEQ. ID. NO. 3691	245-IleArgLeuLeuHisGlyIlePheAsnArgIleLysValAla-258
SEQ. ID. NO. 3692	288-PheAlaAlaValIle-292
SEQ. ID. NO. 3693	311-LeuArgCysAsnAspValAlaAspGlyPheArgHisPhe-323
Antigenic Index - Jameson-Wolf
SEQ. ID. NO. 3694	42-GlyPheSerGlyAsnGlyLysPhe-49
SEQ. ID. NO. 3695	58-ArgHisGlnGlnSerLysAlaGln-65
SEQ. ID. NO. 3696	77-PhePheArgArgGlyAsnPheGlyPheGlyLeuGlnGlyArgThrAspGlyPhe-94
SEQ. ID. NO. 3697	98-GlnArgLeuAspGlyGlyGlyTyr-105
SEQ. ID. NO. 3698	109-GlyPheAlaAspCysArgProPhe-116
SEQ. ID. NO. 3699	126-ValAspGlyArgGluLeuValProSerMetGluGluAspAla-139
SEQ. ID. NO. 3700	145-AlaAspAspValPro-149
SEQ. ID. NO. 3701	155-GluAlaGlnAsnArgCysAsnGlnGluAsnGlnThrAla-167
SEQ. ID. NO. 3702	195-ValGluValGluArgThrGlnValPheArgAlaGluArgAsnAsnValPhe-211
SEQ. ID. NO. 3703	213-GlyLysValGluGlyIleThr-219
SEQ. ID. NO. 3704	261-GlyLysGlnLysAlaGlnGly-267
SEQ. ID. NO. 3705	292-IleGlyArgCysArgProGlnAlaGln-300
SEQ. ID. NO. 3706	312-ArgCysAsnAspValAlaAspGly-319

TABLE 1-continued

| SEQ. ID. NO. 3707 | 328-ValAspAsnGluThrMet-333 |

Hydrophilic Regions - Hopp-Woods

| SEQ. ID. NO. 3708 | 89-GlyArgThrAspGly-93 |
| SEQ. ID. NO. 3709 | 98-GlnArgLeuAspGlyGlyGly-104 |
| SEQ. ID. NO. 3710 | 127-AspGlyArgGluLeuValProSerMetGluGluAspAla-139 |
| SEQ. ID. NO. 3711 | 145-AlaAspAspValPro-149 |
| SEQ. ID. NO. 3712 | 156-AlaGlnAsnArgCysAsnGlnGluAsnGlnThr-166 |
| SEQ. ID. NO. 3713 | 195-ValGluValGluArgThrGlnValPheArgAlaGluArgAsnAsn-209 |
| SEQ. ID. NO. 3714 | 215-ValGluGlyIleThr-219 |
| SEQ. ID. NO. 3715 | 261-GlyLysGlnLysAlaGlnGly-267 |
| SEQ. ID. NO. 3716 | 293-GlyArgCysArgProGlnAlaGln-300 |
| SEQ. ID. NO. 3717 | 312-ArgCysAsnAspValAlaAspGly-319 |
| SEQ. ID. NO. 3718 | 328-ValAspAsnGluThrMet-333 |

238
AMPHI Regions - AMPHI

| SEQ. ID. NO. 3719 | 103-ValHisSerProPhe-107 |
| SEQ. ID. NO. 3720 | 112-SerLysSerThrSerAspPheSerGlyGlyVal-122 |
| SEQ. ID. NO. 3721 | 129-TyrGlnLeuHisArgThrGlySer-136 |
| SEQ. ID. NO. 3722 | 141-GluAspGlyTyrAspGlyProGlnGlySer-150 |
| SEQ. ID. NO. 3723 | 158-AlaArgAspIleTyrSerTyrTyrVal-166 |
| SEQ. ID. NO. 3724 | 224-AspAspValArgGlyIleValGlnGlyAlaValAsnPro-236 |
| SEQ. ID. NO. 3725 | 246-IleGlyAlaIleThrAspSerAlaValSerProValThrAspThrAlaAlaGlnGlnThrLeuGlnGlyIleAsnAspLeuGlyLysLeu-275 |
| SEQ. ID. NO. 3726 | 298-IleAsnSerAlaLysGlnTrpAlaAspAla-307 |
| SEQ. ID. NO. 3727 | 342-AspTrpValLysAsn-346 |
| SEQ. ID. NO. 3728 | 351-LysProAlaAlaArgHisMetGlnThrLeu-360 |
| SEQ. ID. NO. 3729 | 367-GlyAsnLysProIleLysSerLeuProAsn-376 |
| SEQ. ID. NO. 3730 | 398-PheAspSerValHisLysThrLeuThr-406 |
| SEQ. ID. NO. 3731 | 465-GlyLysGlnAlaLysAspTyrLeu-472 |

Antigenic Index - Jameson-Wolf

| SEQ. ID. NO. 3732 | 25-HisAlaAsnGlyLeuAspAlaArgLeuArgAspAspMetGlnAlaLysHisTyrGluProGlyGlyLys-47 |
| SEQ. ID. NO. 3733 | 53-AsnAlaArgGlySerValLysLysArgValTyr-63 |
| SEQ. ID. NO. 3734 | 80-ThrHisGluArgThrGlyPheGluGly-88 |
| SEQ. ID. NO. 3735 | 96-PheSerGlyHisGlyHisGlyGluValHisSerProPheAspHisHisAspSerLysSerThrSerAspPheSerGlyGlyValAspGlyGly-125 |
| SEQ. ID. NO. 3736 | 131-LeuHisArgThrGlySerGluIleHisProGluAspGlyTyrAspGlyProGlnGlySerAspTyrProProProGlyGlyAlaArgAsp-160 |
| SEQ. ID. NO. 3737 | 166-ValLysGlyThrSerThrLysThrLysThr-175 |
| SEQ. ID. NO. 3738 | 182-ProPheSerAspArgTrpLeuLysGluAsnAlaGlyAla-194 |
| SEQ. ID. NO. 3739 | 200-SerArgAlaAspGluAlaGly-206 |
| SEQ. ID. NO. 3740 | 210-TrpGluSerAspProAsnLysAsnTrp-218 |
| SEQ. ID. NO. 3741 | 221-AsnArgMetAspAspValArgGlyIle-229 |
| SEQ. ID. NO. 3742 | 268-GlyIleAsnAspLeuGlyLysLeuSerProGluAlaGln-280 |
| SEQ. ID. NO. 3743 | 292-PheAlaValLysAspGlyIleAsnSerAlaLysGlnTrpAla-305 |
| SEQ. ID. NO. 3744 | 307-AlaHisProAsnIle-311 |
| SEQ. ID. NO. 3745 | 329-TrpArgGlyLysLysValGluLeuAsnProThrLysTrpAspTrpValLysAsnThrGlyTyrLysLysProAlaAlaArg-355 |
| SEQ. ID. NO. 3746 | 360-LeuAspGlyGluMetAlaGlyGlyAsnLysProIleLysSerLeuProAsnSerAlaAlaGluLysArgLysGlnAsnPheGluLysPheAsnSerAsnTrpSer-394 |
| SEQ. ID. NO. 3747 | 396-AlaSerPheAspSerValHisLysThrLeuThrProAsnAla-409 |
| SEQ. ID. NO. 3748 | 413-LeuSerProAspLysValLysThrArgTyrThrSerLeuAspGlyLysIleThrIleIleLysAspAsnGluAsnAsnTyr-439 |
| SEQ. ID. NO. 3749 | 441-ArgIleHisAspAsnSerArgLysGlnTyrLeuAspSerAsnGlyAsnAlaValLysThrGlyAsnLeuGlnGlyLysGlnAlaLysAspTyrLeuGln-473 |
| SEQ. ID. NO. 3750 | 476-ThrHisIleArgAsnLeuAspLys-483 |

Hydrophilic Regions - Hopp-Woods

| SEQ. ID. NO. 3751 | 29-LeuAspAlaArgLeuArgAspAspMetGlnAlaLysHisTyrGluProGlyGly-46 |
| SEQ. ID. NO. 3752 | 54-AlaArgGlySerValLysLysArgValTyr-63 |
| SEQ. ID. NO. 3753 | 80-ThrHisGluArgThrGlyPhe-86 |
| SEQ. ID. NO. 3754 | 108-AspHisHisAspSerLysSerThrSerAspPhe-118 |
| SEQ. ID. NO. 3755 | 133-ArgThrGlySerGluIleHisProGluAspGlyTyrAspGlyProGlnGlySerAspTyrProPro-154 |
| SEQ. ID. NO. 3756 | 156-GlyGlyAlaArgAsp-160 |
| SEQ. ID. NO. 3757 | 169-ThrSerThrLysThrLysThr-175 |
| SEQ. ID. NO. 3758 | 186-ArgTrpLeuLysGluAsnAlaGly-193 |
| SEQ. ID. NO. 3759 | 200-SerArgAlaAspGluAlaGly-206 |
| SEQ. ID. NO. 3760 | 222-ArgMetAspAspValArgGly-228 |
| SEQ. ID. NO. 3761 | 271-AspLeuGlyLysLeuSerPro-277 |
| SEQ. ID. NO. 3762 | 296-AspGlyIleAsnSer-300 |
| SEQ. ID. NO. 3763 | 329-TrpArgGlyLysLysValGluLeuAsnProThr-339 |
| SEQ. ID. NO. 3764 | 347-ThrGlyTyrLysLysProAlaAlaArg-355 |
| SEQ. ID. NO. 3765 | 360-LeuAspGlyGluMetAlaGlyGlyAsnLysProIleLys-372 |
| SEQ. ID. NO. 3766 | 377-SerAlaAlaGluLysArgLysGlnAsnPheGluLysPheAsn-390 |
| SEQ. ID. NO. 3767 | 414-SerProAspLysValLysThrArgTyrThrSerLeuAspGlyLysIleThrIleIleLysAspAsnGluAsnAsn-438 |
| SEQ. ID. NO. 3768 | 443-HisAspAsnSerArgLysGlnTyrLeu-451 |
| SEQ. ID. NO. 3769 | 454-AsnGlyAsnAlaValLys-459 |
| SEQ. ID. NO. 3770 | 462-AsnLeuGlnGlyLysGlnAlaLysAspTyrLeu-472 |
| SEQ. ID. NO. 3771 | 479-ArgAsnLeuAspLys-483 |

239-2
AMPHI Regions - AMPHI

| SEQ. ID. NO. 3772 | 49-PheArgLeuIleGlnSerCys-55 |
| SEQ. ID. NO. 3773 | 72-AsnAlaHisArgLysGln-77 |
| SEQ. ID. NO. 3774 | 123-ProGlyPheAsnAlaLeuProThrIlePhe-132 |
| SEQ. ID. NO. 3775 | 165-SerSerAsnGluTrp-169 |
| SEQ. ID. NO. 3776 | 221-PheCysAlaThrIleCysAlaSerLeuArg-230 |

TABLE 1-continued

Antigenic Index - Jameson-Wolf
SEQ. ID. NO. 3777    6-GlyIleAlaArgAsnArgArgMetGlu-14
SEQ. ID. NO. 3778    19-CysArgArgProAspArgPheValValArgGlnThrArgLeuLeu-33
SEQ. ID. NO. 3779    53-GlnSerCysGluIleGluPro-59
SEQ. ID. NO. 3780    66-HisAsnGlyLysSerGlyAsnAlaHisArgLysGlnGlnLysGluIle-81
SEQ. ID. NO. 3781    100-ProAlaValArgSerAlaThrArgLysThrAla-110
SEQ. ID. NO. 3782    132-PheArgGlySerSerGlyLysSerAlaSer-141
SEQ. ID. NO. 3783    144-AlaAlaGlnArgGlyArgGlyAlaCys-152
SEQ. ID. NO. 3784    164-ArgSerSerAsnGluTrpLys-170
SEQ. ID. NO. 3785    173-ThrAlaLysArgProProSerPheArgArgHisMetThrCysGlyAsnThrAlaProThrSerSerSerSerArgLeuIleLysMet-201
SEQ. ID. NO. 3786    209-ValAlaGlySerCysProArgSerArgValArgThr-220
SEQ. ID. NO. 3787    245-ArgAlaIleArgArgLeuAsnArgSerSerPro-255
Hydrophilic Regions - Hopp-Woods
SEQ. ID. NO. 3788    6-GlyIleAlaArgAsnArgArgMetGlu-14
SEQ. ID. NO. 3789    20-ArgArgProAspArgPheValValArgGlnThrArg-31
SEQ. ID. NO. 3790    67-AsnGlyLysSerGlyAsnAlaHisArgLysGlnGlnLysGluIle-81
SEQ. ID. NO. 3791    102-ValArgSerAlaThrArgLysThrAla-110
SEQ. ID. NO. 3792    135-SerSerGlyLysSerAlaSer-141
SEQ. ID. NO. 3793    146-GlnArgGlyArgGlyAlaCys-152
SEQ. ID. NO. 3794    165-SerSerAsnGluTrpLys-170
SEQ. ID. NO. 3795    173-ThrAlaLysArgProProSerPheArgArgHisMet-184
SEQ. ID. NO. 3796    193-SerSerSerArgLeuIleLysMet-201
SEQ. ID. NO. 3797    211-GlySerCysProArgSerArgValArgThr-220
SEQ. ID. NO. 3798    245-ArgAlaIleArgArgLeuAsnArgSerSerPro-255
240-2
AMPHI Regions - AMPHI
SEQ. ID. NO. 3799    19-AlaAspValGlyArgPheLeuHis-26
SEQ. ID. NO. 3800    63-IleGlnCysLeuArgAsnHis-69
SEQ. ID. NO. 3801    87-AlaProLeuPheAlaValCysPro-94
SEQ. ID. NO. 3802    107-GlnGlyGluAspPheProArgAlaGlyIleGlnAsnHis-119
SEQ. ID. NO. 3803    154-ValPheArgGlyPheIleAlaArgGlyValGlnAlaValHisAsn-168
SEQ. ID. NO. 3804    188-PheLysArgLysPheGln-193
Antigenic Index - Jameson-Wolf
SEQ. ID. NO. 3805    9-GlyThrGluThrArgArgGlnPheAla-17
SEQ. ID. NO. 3806    39-IleAlaHisGlyArgArgSerAspPheIleArg-49
SEQ. ID. NO. 3807    67-ArgAsnHisLysArgPheAspCysArgThrGlyPheAsp-79
SEQ. ID. NO. 3808    101-ValGlyGlyArgIleGlyGlnGlyGluAspPheProArgAlaGlyIleGlnAsnHisHisArgSerGly-123
SEQ. ID. NO. 3809    139-GlnGlyLeuAsnProLeuIleGluGlyLysAspAspVal-151
SEQ. ID. NO. 3810    173-ValProGlnAsnAspPheArg-179
SEQ. ID. NO. 3811    187-ValPheLysArgLysPhe-192
SEQ. ID. NO. 3812    201-AsnIleGlyLysSerAspAspValCysLys-210
Hydrophilic Regions - Hopp-Woods
SEQ. ID. NO. 3813    10-ThrGluThrArgArgGlnPheAla-17
SEQ. ID. NO. 3814    41-HisGlyArgArgSerAspPheIleArg-49
SEQ. ID. NO. 3815    67-ArgAsnHisLysArgPheAspCys-74
SEQ. ID. NO. 3816    105-IleGlyGlnGlyGluAspPheProArg-113
SEQ. ID. NO. 3817    145-IleGluGlyLysAspAspVal-151
SEQ. ID. NO. 3818    187-ValPheLysArgLysPhe-192
SEQ. ID. NO. 3819    203-GlyLysSerAspAspValCysLys-210
241-1
AMPHI Regions - AMPHI
SEQ. ID. NO. 3820    6-ThrArgAlaAlaAsnProPro-12
SEQ. ID. NO. 3821    35-ThrArgThrProArgGluProAlaSer-43
SEQ. ID. NO. 3822    109-PheLeuIleGlyCysIleAla-115
SEQ. ID. NO. 3823    126-PheHisAlaCysGlnArgMetValAlaVal-135
SEQ. ID. NO. 3824    194-ArgHisIleAspArgIleAlaGlyIleLeuThrValGln-206
SEQ. ID. NO. 3825    229-PheValGlnLysLeuIleValGlyIleIleHis-239
Antigenic Index - Jameson-Wolf
SEQ. ID. NO. 3826    1-MetProThrArgProThrArgAlaAlaAsnProProThrProProThr-16
SEQ. ID. NO. 3827    23-CysProArgProProTyrArgProProSerValGlnThrArgThrProArgGluProAlaSerSerThrCysAlaAlaLysSerAlaAsnArgArgGlu
                     AsnSerHisAsnAlaGlnPro-62
SEQ. ID. NO. 3828    68-ProSerAsnLysMetProSerGluThrGluGlnThrLeuPheArgArgHisGlnIleProProSerCysArgGlnSer-93
SEQ. ID. NO. 3829    122-LeuLysAlaAspPhe-126
SEQ. ID. NO. 3830    147-ThrIleAspAspAsnIleAla-153
SEQ. ID. NO. 3831    166-PheAspPheAsnArgGluHisAlaArgIlePheAspThrAspGlnLeu-181
SEQ. ID. NO. 3832    188-ArgIleValGlyArgGlnArgHisIleAspArgIleAla-200
SEQ. ID. NO. 3833    209-PheHisGlnArgGluAsnAla-215
SEQ. ID. NO. 3834    244-ArgAsnHisGlyIle-248
SEQ. ID. NO. 3835    250-HisAspSerHisIleCysProPheArgAsnSerArgLeuIle-263
Hydrophilic Regions - Hopp-Woods
SEQ. ID. NO. 3836    1-MetProThrArgProThrArgAlaAlaAsn-10
SEQ. ID. NO. 3837    32-SerValGlnThrArgThrProArgGluProAlaSer-43
SEQ. ID. NO. 3838    46-CysAlaAlaLysSerAlaAsnArgArgGluAsnSerHis-58
SEQ. ID. NO. 3839    70-AsnLysMetProSerGluThrGluGlnThrLeuPheArg-82
SEQ. ID. NO. 3840    122-LeuLysAlaAspPhe-126

TABLE 1-continued

| | |
|---|---|
| SEQ. ID. NO. 3841 | 166-PheAspPheAsnArgGluHisAlaArgIlePheAsp-177 |
| SEQ. ID. NO. 3842 | 188-ArgIleValGlyArgGlnArgHisIleAspArgIleAla-200 |
| SEQ. ID. NO. 3843 | 209-PheHisGlnArgGluAsnAla-215 |

242
AMPHI Regions - AMPHI

| | |
|---|---|
| SEQ. ID. NO. 3844 | 23-SerGluValValThrGlnPheValAspPheValGlu-34 |
| SEQ. ID. NO. 3845 | 42-AlaGlyPheCysHisIleLeuGlnAsn-50 |
| SEQ. ID. NO. 3846 | 100-AlaAspGlnAlaGln-104 |
| SEQ. ID. NO. 3847 | 122-AsnProPhePheAspPhePheGlnAlaValVal-132 |
| SEQ. ID. NO. 3848 | 137-HisGlnSerGlyPheGlyAspValPhe-145 |
| SEQ. ID. NO. 3849 | 156-LeuGluGlnSerVal-160 |
| SEQ. ID. NO. 3850 | 177-PheGluLeuPheGln-181 |
| SEQ. ID. NO. 3851 | 191-PheGlyHisThrArgLeuPheAspIleCys-200 |
| SEQ. ID. NO. 3852 | 262-HisProPheAlaAspPheGlyAsnPheGlnAsnLeuLeuAlaLeu-276 |

Antigenic Index - Jameson-Wolf

| | |
|---|---|
| SEQ. ID. NO. 3853 | 13-HisPheGluGlnArgAlaGlyGlyIleAla-22 |
| SEQ. ID. NO. 3854 | 33-ValGluGlnGluGln-37 |
| SEQ. ID. NO. 3855 | 52-ThrGlyHisArgAlaAspIle-58 |
| SEQ. ID. NO. 3856 | 75-SerHisAlaAspIlePheProProArgCysPheGlyAspGlyPheAlaGlnArgGlyPheAlaHisAlaArgArgAlaAspGlnAlaGlnAsnArgAla-107 |
| SEQ. ID. NO. 3857 | 137-HisGlnSerGlyPhe-141 |
| SEQ. ID. NO. 3858 | 154-ArgGlnLeuGluGlnSerVal-160 |
| SEQ. ID. NO. 3859 | 164-AlaTyrAspGlyGlyPheArgArgHisArgTrpHis-175 |
| SEQ. ID. NO. 3860 | 283-MetArgCysAspArgIleGly-289 |

Hydrophilic Regions - Hopp-Woods

| | |
|---|---|
| SEQ. ID. NO. 3861 | 13-HisPheGluGlnArgAlaGlyGlyIle-21 |
| SEQ. ID. NO. 3862 | 33-ValGluGlnGluGln-37 |
| SEQ. ID. NO. 3863 | 52-ThrGlyHisArgAlaAspIle-58 |
| SEQ. ID. NO. 3864 | 95-AlaHisAlaArgArgAlaAspGlnAlaGlnAsnArgAla-107 |
| SEQ. ID. NO. 3865 | 154-ArgGlnLeuGluGlnSerVal-160 |
| SEQ. ID. NO. 3866 | 167-GlyGlyPheArgArgHisArg-173 |
| SEQ. ID. NO. 3867 | 283-MetArgCysAspArgIleGly-289 |

243
AMPHI Regions - AMPHI

| | |
|---|---|
| SEQ. ID. NO. 3868 | 35-IleThrArgLeuAlaArgLysAlaValGlnArgLeuThr-47 |
| SEQ. ID. NO. 3869 | 50-HisIleGlnXxxPhePheThrGlu-57 |
| SEQ. ID. NO. 3870 | 80-AspSerSerArgIleThrSerThrIle-88 |

Antigenic Index - Jameson-Wolf

| | |
|---|---|
| SEQ. ID. NO. 3871 | 29-LeuProSerAsnAlaPro-34 |
| SEQ. ID. NO. 3872 | 37-ArgLeuAlaArgLysAlaValGln-44 |
| SEQ. ID. NO. 3873 | 58-SerHisThrGlyAlaAsnArgSerSerSerCysLysPro-71 |
| SEQ. ID. NO. 3874 | 77-SerAlaSerAspSerSerArgIle-84 |
| SEQ. ID. NO. 3875 | 102-SerThrThrGlyAlaValThrLysSer-110 |

Hydrophilic Regions - Hopp-Woods

| | |
|---|---|
| SEQ. ID. NO. 3876 | 37-ArgLeuAlaArgLysAlaValGln-44 |
| SEQ. ID. NO. 3877 | 59-HisThrGlyAlaAsnArgSerSerSerCysLys-70 |
| SEQ. ID. NO. 3878 | 78-AlaSerAspSerSerArgIle-84 |

244-2
AMPHI Regions - AMPHI

| | |
|---|---|
| SEQ. ID. NO. 3879 | 22-LysCysPheLeuGlnLeuValGln-29 |
| SEQ. ID. NO. 3880 | 31-HisLeuHisAlaHis-35 |
| SEQ. ID. NO. 3881 | 109-IleSerArgLeuCysGlySerLeuPhe-117 |
| SEQ. ID. NO. 3882 | 126-CysLeuAspGlyPheHisArgLeuHis-134 |
| SEQ. ID. NO. 3883 | 137-AsnArgPhePheThr-141 |
| SEQ. ID. NO. 3884 | 165-TyrProArgLysIleArgThrPheSerArgAsnPheLysGlnLys-179 |

Antigenic Index - Jameson-Wolf

| | |
|---|---|
| SEQ. ID. NO. 3885 | 1-MetAspIleArgIle-5 |
| SEQ. ID. NO. 3886 | 11-PheArgValAspPheLeuAsp-17 |
| SEQ. ID. NO. 3887 | 45-IleGlnLysArgHis-49 |
| SEQ. ID. NO. 3888 | 54-LeuAspArgGlnHisPheHisGlyLysLeuLeuSerGlyGluLeuValArg-70 |
| SEQ. ID. NO. 3889 | 99-GlnLeuGlyAsnProArgLeu-105 |
| SEQ. ID. NO. 3890 | 154-LeuLysThrAsnTrpLysSerLysSerSerTyrTyrProArgLysIleArgThrPheSerArgAsnPheLysGlnLysGlnArgIleSerAsnSerPheSerAsnProLeuProLysLys-193 |

Hydrophilic Regions - Hopp-Woods

| | |
|---|---|
| SEQ. ID. NO. 3891 | 1-MetAspIleArgIle-5 |
| SEQ. ID. NO. 3892 | 11-PheArgValAspPheLeuAsp-17 |
| SEQ. ID. NO. 3893 | 156-ThrAsnTrpLysSerLysSer-162 |
| SEQ. ID. NO. 3894 | 167-ArgLysIleArgThrPheSerArgAsnPheLysGlnLysGlnArgIle-182 |

246-2
AMPHI Regions - AMPHI

| | |
|---|---|
| SEQ. ID. NO. 3895 | 39-AlaValAsnIleAlaGlnCysPheThr-47 |
| SEQ. ID. NO. 3896 | 67-GluGlnPheAlaAsnLeuPhePhe-74 |
| SEQ. ID. NO. 3897 | 83-AspMetGlyArgPhe-87 |
| SEQ. ID. NO. 3898 | 132-PheGlyCysAspAspValValAspAsnLeuAlaGlyPheGlyArg-146 |
| SEQ. ID. NO. 3899 | 156-GlnLeuSerGlnValPhePheGlnLeuLeuGln-166 |

Antigenic Index - Jameson-Wolf

| | |
|---|---|
| SEQ. ID. NO. 3900 | 1-MetHisGlyArgTyrGlyGlyThrGln-9 |
| SEQ. ID. NO. 3901 | 18-GlnThrGlnArgThrCysPheSerAsnGlyLysValTyr-30 |
| SEQ. ID. NO. 3902 | 34-ThrAspIleGlySer-38 |
| SEQ. ID. NO. 3903 | 59-GlnArgArgThrGluValLeu-65 |
| SEQ. ID. NO. 3904 | 78-AspSerArgHisHisAspMetGlyArg-86 |

TABLE 1-continued

| | |
|---|---|
| SEQ. ID. NO. 3905 | 92-LeuAspAspGluLeuAla-97 |
| SEQ. ID. NO. 3906 | 133-GlyCysAspAspValValAspAsn-140 |
| SEQ. ID. NO. 3907 | 143-GlyPheGlyArgGlyPhe-148 |

Hydrophilic Regions - Hopp-Woods

| | |
|---|---|
| SEQ. ID. NO. 3908 | 59-GlnArgArgThrGluValLeu-65 |
| SEQ. ID. NO. 3909 | 78-AspSerArgHisHisAspMet-84 |
| SEQ. ID. NO. 3910 | 92-LeuAspAspGluLeuAla-97 |

247-1
AMPHI Regions - AMPHI

| | |
|---|---|
| SEQ. ID. NO. 3911 | 12-SerTyrAspGlyMetLysGlyPheThrIleIle-22 |
| SEQ. ID. NO. 3912 | 25-LeuValAlaGlyLeuLeuSerMetIleValLeu-35 |
| SEQ. ID. NO. 3913 | 48-LeuAsnAspAlaAlaAsn-53 |
| SEQ. ID. NO. 3914 | 81-CysPheAsnMetSerGlu-86 |
| SEQ. ID. NO. 3915 | 123-AsnTyrGlnAsnPhePheGln-129 |
| SEQ. ID. NO. 3916 | 150-ThrValValSerSerCysAlaAlaIleSerLysProGlyLysGlnIleProThrLeu-168 |
| SEQ. ID. NO. 3917 | 256-LysTyrThrAspLysPheAspSerAla-264 |

Antigenic Index - Jameson-Wolf

| | |
|---|---|
| SEQ. ID. NO. 3918 | 1-MetArgArgLysMetLeuAsnValProLysGlySerTyrAspGlyMetLys-17 |
| SEQ. ID. NO. 3919 | 42-TyrPheThrSerArgLysLeuAsnAspAlaAlaAsnGluArgLeuAlaAla-58 |
| SEQ. ID. NO. 3920 | 60-GlnAspLeuArgAsn-64 |
| SEQ. ID. NO. 3921 | 71-ArgAspAlaArgMetAlaGlyGlyPhe-79 |
| SEQ. ID. NO. 3922 | 83-AsnMetSerGluHisProAlaThrAspValIleProAspThrThrGlnGlnAsnSerProPheSerLeuLysArgAsnGlyIleAspLys-112 |
| SEQ. ID. NO. 3923 | 117-AlaGluSerSerAsnIleAsnTyrGln-125 |
| SEQ. ID. NO. 3924 | 140-IleAspAspValAsnAlaSerThr-147 |
| SEQ. ID. NO. 3925 | 157-AlaIleSerLysProGlyLysGlnIleProThrLeuGluAspAlaLysLysGluLeuLysIleProAspGlnAspLysGluGlnAsnGlyAsnIleAlaArgGlnArgHis-193 |
| SEQ. ID. NO. 3926 | 202-ArgIleAlaAspGluGluGlyLeu-209 |
| SEQ. ID. NO. 3927 | 212-PheGlnLeuAspAspLysGlyLysTrpGlyAsn-222 |
| SEQ. ID. NO. 3928 | 228-LysLysValArgHisMetLys-234 |
| SEQ. ID. NO. 3929 | 242-GlyCysProGluAspAspAspAlaGlyLysGluGluThrPheLysTyrThrAspLysPheAspSerAlaGln-265 |
| SEQ. ID. NO. 3930 | 279-SerGlyThrAspThrLysIleAlaAlaSerSerAspAsnHis-292 |
| SEQ. ID. NO. 3931 | 300-AlaThrIleArgGlyGlyAsnValCysAlaAsnArgThrLeu-313 |

Hydrophilic Regions - Hopp-Woods

| | |
|---|---|
| SEQ. ID. NO. 3932 | 1-MetArgArgLysMetLeuAsn-7 |
| SEQ. ID. NO. 3933 | 11-GlySerTyrAspGly-15 |
| SEQ. ID. NO. 3934 | 46-ArgLysLeuAsnAspAlaAlaAsnGluArgLeuAlaAla-58 |
| SEQ. ID. NO. 3935 | 60-GlnAspLeuArgAsn-64 |
| SEQ. ID. NO. 3936 | 71-ArgAspAlaArgMet-75 |
| SEQ. ID. NO. 3937 | 104-SerLeuLysArgAsnGlyIleAspLys-112 |
| SEQ. ID. NO. 3938 | 140-IleAspAspValAsnAla-145 |
| SEQ. ID. NO. 3939 | 159-SerLysProGlyLysGln-164 |
| SEQ. ID. NO. 3940 | 166-ProThrLeuGluAspAlaLysLysGluLeuLysIleProAspGlnAspLysGluGlnAsnGlyAsnIleAlaArgGlnArgHis-193 |
| SEQ. ID. NO. 3941 | 202-ArgIleAlaAspGluGluGlyLeu-209 |
| SEQ. ID. NO. 3942 | 213-GlnLeuAspAspLysGlyLysTrpGly-221 |
| SEQ. ID. NO. 3943 | 228-LysLysValArgHisMetLys-234 |
| SEQ. ID. NO. 3944 | 243-CysProGluAspAspAspAlaGlyLysGluGluThrPheLysTyrThrAspLysPheAspSerAlaGln-265 |
| SEQ. ID. NO. 3945 | 280-GlyThrAspThrLysIleAlaAlaSerSerAsp-290 |

248-2
Hydrophilic Regions - Hopp-Woods

| | |
|---|---|
| SEQ. ID. NO. 3946 | 1-MetArgArgLysMetLeuAsn-7 |
| SEQ. ID. NO. 3947 | 11-GlySerTyrAspGly-15 |
| SEQ. ID. NO. 3948 | 46-ArgLysLeuAsnAspAlaAlaAsnGluArgLeuAlaAla-58 |
| SEQ. ID. NO. 3949 | 60-GlnAspLeuArgAsn-64 |
| SEQ. ID. NO. 3950 | 71-ArgAspAlaArgMet-75 |
| SEQ. ID. NO. 3951 | 104-SerLeuLysArgAsnGlyIleAspLys-112 |
| SEQ. ID. NO. 3952 | 140-IleAspAspValAsnAla-145 |
| SEQ. ID. NO. 3953 | 159-SerLysProGlyLysGln-164 |
| SEQ. ID. NO. 3954 | 166-ProThrLeuGluAspAlaLysLysGluLeuLysIleProAspGlnAspLysGluGlnAsnGlyAsnIleAlaArgGlnArgHis-193 |
| SEQ. ID. NO. 3955 | 202-ArgIleAlaAspGluGluGlyLeu-209 |
| SEQ. ID. NO. 3956 | 213-GlnLeuAspAspLysGlyLysTrpGly-221 |
| SEQ. ID. NO. 3957 | 228-LysLysValArgHisMetLys-234 |
| SEQ. ID. NO. 3958 | 243-CysProGluAspAspAspAlaGlyLysGluGluThrPheLysTyrThrAspLysPheAspSerAlaGln-265 |
| SEQ. ID. NO. 3959 | 280-GlyThrAspThrLysIleAlaAlaSerSerAsp-290 |

Antigenic Index - Jameson-Wolf

| | |
|---|---|
| SEQ. ID. NO. 3960 | 1-MetArgLysGlnAsnThrLeuThr-8 |
| SEQ. ID. NO. 3961 | 11-ProThrSerAspGlyGlnArgGly-18 |
| SEQ. ID. NO. 3962 | 40-GlnSerTyrAsnThrGluGlnArgIleSerAlaAsnGluSerAspArgLysLeuAla-58 |
| SEQ. ID. NO. 3963 | 64-AlaAlaLeuArgGluGlyGluLeuGln-72 |
| SEQ. ID. NO. 3964 | 76-LeuGluTyrAspThrAspSerLysValThrPheSerGluAsnCysGlyLysGlyLeu-94 |
| SEQ. ID. NO. 3965 | 99-AsnValArgThrAsnAsnAspAsnGluGluAlaPhe-110 |
| SEQ. ID. NO. 3966 | 116-GlnGlyLysProThrValGluAlaValLysArgSerCysProAlaAsnSerThrAspLeuCysIleAspLysLysGlyMetGluTyrLysLysGlyThrArgSerValSerLysMetProArgTyr-157 |
| SEQ. ID. NO. 3967 | 162-LeuGlyValLysAsnGlyGluAsnValTyr-171 |
| SEQ. ID. NO. 3968 | 177-AlaTrpGlyLysAsnAlaAsnThr-184 |
| SEQ. ID. NO. 3969 | 192-ValSerAsnAsnAspGlu-197 |

Hydrophilic Regions - Hopp-Woods

| | |
|---|---|
| SEQ. ID. NO. 3970 | 1-MetArgLysGlnAsnThr-6 |
| SEQ. ID. NO. 3971 | 11-ProThrSerAspGlyGlnArg-17 |
| SEQ. ID. NO. 3972 | 42-TyrAsnThrGluGlnArgIleSerAlaAsnGluSerAspArgLysLeuAla-58 |
| SEQ. ID. NO. 3973 | 64-AlaAlaLeuArgGluGlyGluLeuGln-72 |

TABLE 1-continued

| | |
|---|---|
| SEQ. ID. NO. 3974 | 76-LeuGluTyrAspThrAspSerLysValThrPhe-86 |
| SEQ. ID. NO. 3975 | 101-ArgThrAsnAsnAspAsnGluGluAlaPhe-110 |
| SEQ. ID. NO. 3976 | 119-ProThrValGluAlaValLysArgSerCysPro-129 |
| SEQ. ID. NO. 3977 | 135-LeuCysIleAspLysLysGlyMetGluTyrLysLysGlyThrArgSerValSerLysMetPro-155 |
| SEQ. ID. NO. 3978 | 165-LysAsnGlyGluAsnValTyr-171 |
| SEQ. ID. NO. 3979 | 193-SerAsnAsnAspGlu-197 |

249-1
AMPHI Regions - AMPHI
SEQ. ID. NO. 3980    6-CysPheArgLeuLys-10
SEQ. ID. NO. 3981    17-AlaLeuIleGluValLeuVal-23
SEQ. ID. NO. 3982    42-ThrValAlaSerValArgGluAla-49
SEQ. ID. NO. 3983    53-ThrIleValSerGlnIleThrGlnAsnLeuMetGluGlyMet-66
Antigenic Index - Jameson-Wolf
SEQ. ID. NO. 3984    1-MetLysAsnAsnAspCysPheArgLeuLysAspSerGlnSerGlyMetAla-17
SEQ. ID. NO. 3985    44-AlaSerValArgGluAlaGluThr-51
SEQ. ID. NO. 3986    70-ProThrIleAspSerAspSerAsnLysLysAsnTyr-81
SEQ. ID. NO. 3987    93-ValAspGlyAspPheAla-98
SEQ. ID. NO. 3988    101-AlaMetLysThrLysGlyGlnLeuAla-109
SEQ. ID. NO. 3989    134-ValCysLysAspSerSerGlyAsnAlaProThrLeuSer-146
SEQ. ID. NO. 3990    148-AsnAlaPheSerSerAsnCysAspAsnLysAlaAsnGlyAspThrLeu-163
SEQ. ID. NO. 3991    171-AspSerAlaGlyAspSerAspIleSerArgThrAsnLeuGluValSerGlyAspAsn-189
SEQ. ID. NO. 3992    196-AlaArgValGlyGlyArgGlu-202
Hydrophilic Regions - Hopp-Woods
SEQ. ID. NO. 3993    1-MetLysAsnAsnAspCysPheArgLeuLysAspSerGlnSer-14
SEQ. ID. NO. 3994    44-AlaSerValArgGluAlaGluThr-51
SEQ. ID. NO. 3995    72-IleAspSerAspSerAsnLysLysAsn-80
SEQ. ID. NO. 3996    101-AlaMetLysThrLysGlyGlnLeuAla-109
SEQ. ID. NO. 3997    134-ValCysLysAspSerSerGly-140
SEQ. ID. NO. 3998    153-AsnCysAspAsnLysAlaAsnGly-160
SEQ. ID. NO. 3999    172-SerAlaGlyAspSerAspIleSerArgThrAsnLeu-183
SEQ. ID. NO. 4000    198-ValGlyGlyArgGlu-202
250-2
AMPHI Regions - AMPHI
SEQ. ID. NO. 4001    34-PheAlaGlyGlySerGlu-39
SEQ. ID. NO. 4002    41-AlaThrValAsnLeuTrpAlaGluPro-49
SEQ. ID. NO. 4003    123-LeuThrLysThrSerThrAlaLeuPro-131
Antigenic Index - Jameson-Wolf
SEQ. ID. NO. 4004    14-MetGlnGlyGlyGlnLysGlyMetSer-22
SEQ. ID. NO. 4005    35-AlaGlyGlySerGlu-39
SEQ. ID. NO. 4006    80-IleProLeuLysLysAlaVal-86
SEQ. ID. NO. 4007    103-GluIleGlnLysArgLysAlaAla-110
SEQ. ID. NO. 4008    119-PheTyrSerGlyLeuThrLysThrSerThrAlaLeuProArgLeuSerSerLysLysThrIle-139
Hydrophilic Regions - Hopp-Woods
SEQ. ID. NO. 4009    80-IleProLeuLysLysAlaVal-86
SEQ. ID. NO. 4010    103-GluIleGlnLysArgLysAlaAla-110
SEQ. ID. NO. 4011    133-LeuSerSerLysLysThrIle-139
251
AMPHI Regions - AMPHI
SEQ. ID. NO. 4012    59-AlaTyrGlyAspProIleGlyAlaGlyPhe-68
SEQ. ID. NO. 4013    114-GlnValValAlaAspPheGlyGlyIleGluGlyPhe-125
SEQ. ID. NO. 4014    160-ArgThrValGlyArgThrValArgLeuLeuLysMetIle-172
SEQ. ID. NO. 4015    215-AlaArgThrValPheArgAlaHis-222
SEQ. ID. NO. 4016    260-LeuGlyGlnGluCysArg-265
SEQ. ID. NO. 4017    267-ArgHisIleAlaArgValGluSerLeuLeuArgValPheGluTyrAlaAlaAsp-284
Antigenic Index - Jameson-Wolf
SEQ. ID. NO. 4018    10-AlaArgAlaAspIleArgProProAlaGlnThrAspIleValProAsnCys-26
SEQ. ID. NO. 4019    34-AspAlaAlaArgArgAlaValArg-41
SEQ. ID. NO. 4020    49-AlaAspLeuProArgAsnAspIleSerProAlaTyrGlyAspProIleGlyAlaGly-67
SEQ. ID. NO. 4021    80-LeuArgGlyArgValArgArgIleGly-88
SEQ. ID. NO. 4022    101-GluIleArgAlaLysAlaValLysProGluIle-111
SEQ. ID. NO. 4023    149-ArgLeuValGlyThr-153
SEQ. ID. NO. 4024    161-ThrValGlyArgThrValArg-167
SEQ. ID. NO. 4025    179-ProValValArgGluAlaGlyIle-186
SEQ. ID. NO. 4026    212-ValLysHisAlaArgThrValPhe-219
SEQ. ID. NO. 4027    244-ValThrGlyGlnArgThrArg-250
SEQ. ID. NO. 4028    256-IleLysAsnArgLeuGlyGlnGluCysArgAsnArgHisIleAlaArgValGluSer-274
SEQ. ID. NO. 4029    290-LeuLysThrLysThrArgAlaGluGlnProArgProAlaPhe-303
Hydrophilic Regions - Hopp-Woods
SEQ. ID. NO. 4030    10-AlaArgAlaAspIleArgProProAlaGln-19
SEQ. ID. NO. 4031    34-AspAlaAlaArgArgAlaValArg-41
SEQ. ID. NO. 4032    50-AspLeuProArgAsnAspIle-56
SEQ. ID. NO. 4033    82-GlyArgValArgArgIleGly-88
SEQ. ID. NO. 4034    101-GluIleArgAlaLysAlaValLysProGluIle-111
SEQ. ID. NO. 4035    161-ThrValGlyArgThrValArg-167
SEQ. ID. NO. 4036    179-ProValValArgGluAlaGlyIle-186
SEQ. ID. NO. 4037    212-ValLysHisAlaArgThrValPhe-219
SEQ. ID. NO. 4038    258-AsnArgLeuGlyGlnGluCysArgAsnArgHisIleAlaArgValGluSer-274
SEQ. ID. NO. 4039    292-ThrLysThrArgAlaGluGlnProArg-300

TABLE 1-continued 254-2
AMPHI Regions - AMPHI
SEQ. ID. NO. 4040	6-ArgPheAsnThrTyrSerHis-12
SEQ. ID. NO. 4041	32-GlyHisGlyAspGlyTyrArg-38
SEQ. ID. NO. 4042	66-LysLeuLysSerIleLeuLys-72
SEQ. ID. NO. 4043	142-ValLeuAlaValMetLysSerLeuThrAlaSerLeuPro-154
Antigenic Index - Jameson-Wolf
SEQ. ID. NO. 4044	2-TyrThrGlyGluArgPheAsnThrTyrSer-11
SEQ. ID. NO. 4045	32-GlyHisGlyAspGlyTyrArg-38
SEQ. ID. NO. 4046	65-GlyLysLeuLysSerIleLeuLysLysThrAspHis-76
SEQ. ID. NO. 4047	94-SerLeuArgAsnGlyProGly-100
SEQ. ID. NO. 4048	120-ThrIleGlyArgLysSerGluLysArgLeu-129
SEQ. ID. NO. 4049	177-AsnAspGluLysIleArgHisGlyHisGly-186
Hydrophilic Regions - Hopp-Woods
SEQ. ID. NO. 4050	65-GlyLysLeuLysSerIleLeuLysLysThrAspHis-76
SEQ. ID. NO. 4051	120-ThrIleGlyArgLysSerGluLysArgLeu-129
SEQ. ID. NO. 4052	177-AsnAspGluLysIleArgHis-183
255
AMPHI Regions - AMPHI
SEQ. ID. NO. 4053	23-ValLysThrCysAlaAspPheHisAlaPheAspGlyValAspAlaHisHisArg-40
SEQ. ID. NO. 4054	71-GlyIleGlnGlyPheAlaHis-77
SEQ. ID. NO. 4055	139-AlaGlyGlyGlyPhe-143
Antigenic Index - Jameson-Wolf
SEQ. ID. NO. 4056	33-AspGlyValAspAlaHisHisArgValGlyAspPheGly-45
SEQ. ID. NO. 4057	48-AlaValLysAsnArgPheAlaGlnAlaAspArgAspIleGlyCys-62
SEQ. ID. NO. 4058	66-GlnLeuArgAlaAspGlyIleGln-73
SEQ. ID. NO. 4059	91-ValGlyGlyLysLysArgIleLeu-98
SEQ. ID. NO. 4060	115-GlyAsnValGlyAspPheArgAla-123
SEQ. ID. NO. 4061	130-PhePheGlyAsnGlySerGlySerAsnAlaGlyGly-141
SEQ. ID. NO. 4062	143-PheThrGlyGlyAla-147
SEQ. ID. NO. 4063	169-GlyAlaGluAlaGlyGly-174
Hydrophilic Regions - Hopp-Woods
SEQ. ID. NO. 4064	33-AspGlyValAspAlaHisHisArgValGlyAspPheGly-45
SEQ. ID. NO. 4065	48-AlaValLysAsnArgPheAlaGlnAlaAspArgAspIleGly-61
SEQ. ID. NO. 4066	66-GlnLeuArgAlaAspGly-71
SEQ. ID. NO. 4067	92-GlyGlyLysLysArgIleLeu-98
SEQ. ID. NO. 4068	119-GlyAspPheArgAla-123
SEQ. ID. NO. 4069	135-SerGlySerAsnAla-139
SEQ. ID. NO. 4070	169-GlyAlaGluAlaGlyGly-174
256-1
AMPHI Regions - AMPHI
SEQ. ID. NO. 4071	90-GlyValValValHisPheArgSerCysGlyGlyIleAlaAsn-103
SEQ. ID. NO. 4072	127-ArgTyrArgGluIleTyrAlaVal-134
SEQ. ID. NO. 4073	141-AsnAlaLeuAlaLysTyrLeuGlyGluGln-150
SEQ. ID. NO. 4074	173-ArgArgPheAspSerGlyIleThrArgLeuLeu-183
SEQ. ID. NO. 4075	197-LysSerLeuGlnGlyPheGlnThrAla-205
SEQ. ID. NO. 4076	207-AlaAlaGlyCysLysThrLeuGlyGluPheAspAspArgPheThrAlaProLeuHisGly-226
SEQ. ID. NO. 4077	233-TyrTyrArgGlnThrSerCysLysProLeuLeuLysHisValAla-247
SEQ. ID. NO. 4078	267-ProArgAlaAspGluValSer-273
Antigenic Index - Jameson-Wolf
SEQ. ID. NO. 4079	4-ThrProProAspThrProPhe-10
SEQ. ID. NO. 4080	12-LeuArgAsnGlyAsnAlaAspThrIleAla-21
SEQ. ID. NO. 4081	24-PheLeuGlnArgProAlaProAlaTyrArgArgGluLeuLeuProAspSerThrGlyLysThrLysVal-46
SEQ. ID. NO. 4082	49-AspPheSerAspGlyIleSerProAspAla-58
SEQ. ID. NO. 4083	67-LeuGluGlySerSerArgSerHisTyr-75
SEQ. ID. NO. 4084	82-AlaValArgAspArgGlyTrpHis-89
SEQ. ID. NO. 4085	112-GlyAspThrAlaGlu-116
SEQ. ID. NO. 4086	147-LeuGlyGluGlnGlyLysLysAlaLeu-155
SEQ. ID. NO. 4087	166-ValAspAlaGluAlaAlaGlyArgArgPheAspSerGlyIleThr-180
SEQ. ID. NO. 4088	192-LeuIleProLysAlaLysSerLeuGln-200
SEQ. ID. NO. 4089	212-ThrLeuGlyGluPheAspAspArgPheThr-221
SEQ. ID. NO. 4090	227-PheAlaAspArgHisAspTyrTyrArgGlnThrSerCysLysProLeuLeu-243
SEQ. ID. NO. 4091	259-ProPheLeuProProGluAlaLeuProArgAlaAspGluValSerGlu-274
SEQ. ID. NO. 4092	291-SerSerThrGlyGlyArgLeu-297
SEQ. ID. NO. 4093	311-AspSerPheArgPheThrAsnArgArg-318
Hydrophilic Regions - Hopp-Woods
SEQ. ID. NO. 4094	30-ProAlaTyrArgArgGluLeuLeuPro-38
SEQ. ID. NO. 4095	40-SerThrGlyLysThrLysVal-46
SEQ. ID. NO. 4096	68-GluGlySerSerArgSer-73
SEQ. ID. NO. 4097	83-ValArgAspArgGlyTrp-88
SEQ. ID. NO. 4098	147-LeuGlyGluGlnGlyLysLysAlaLeu-155
SEQ. ID. NO. 4099	166-ValAspAlaGluAlaAlaGlyArgArgPheAspSerGlyIle-179
SEQ. ID. NO. 4100	192-LeuIleProLysAlaLysSer-198
SEQ. ID. NO. 4101	212-ThrLeuGlyGluPheAspAspArgPheThr-221
SEQ. ID. NO. 4102	227-PheAlaAspArgHisAspTyrTyrArg-235

TABLE 1-continued

| | |
|---|---|
| SEQ. ID. NO. 4103 | 265-AlaLeuProArgAlaAspGluValSerGlu-274 |
| SEQ. ID. NO. 4104 | 313-PheArgThrAsnArgArg-318 |

257-2
AMPHI Regions - AMPHI

| | |
|---|---|
| SEQ. ID. NO. 4105 | 24-SerPheLeuProAsn-28 |
| SEQ. ID. NO. 4106 | 73-AspLeuValAsnLysValLeuAlaGluValAlaArgLeuGluLysIleValGlnProLeu-92 |

Antigenic Index - Jameson-Wolf

| | |
|---|---|
| SEQ. ID. NO. 4107 | 1-MetGlyArgHisPheGlyArgArgArgPhe-10 |
| SEQ. ID. NO. 4108 | 31-AlaAlaAspAspGluLysArgAsnGlyAspGluLysArgAsnGluAsn-46 |
| SEQ. ID. NO. 4109 | 56-GlySerGlyAlaGlu-60 |
| SEQ. ID. NO. 4110 | 65-GlyValAspAspArgArgAlaAlaAspLeuVal-75 |
| SEQ. ID. NO. 4111 | 83-AlaArgLeuGluLysIleVal-89 |

Hydrophilic Regions - Hopp-Woods

| | |
|---|---|
| SEQ. ID. NO. 4112 | 4-HisPheGlyArgArgArgPhe-10 |
| SEQ. ID. NO. 4113 | 31-AlaAlaAspAspGluLysArgAsnGlyAspGluLysArgAsnGlu-45 |
| SEQ. ID. NO. 4114 | 65-GlyValAspAspArgArgAlaAlaAspLeuVal-75 |
| SEQ. ID. NO. 4115 | 83-AlaArgLeuGluLysIleVal-89 |

259-1
AMPHI Regions - AMPHI

| | |
|---|---|
| SEQ. ID. NO. 4116 | 154-TyrGlyArgValPheAlaAspIlePheGluLeuSer-165 |
| SEQ. ID. NO. 4117 | 172-AlaPheLysGlyMetLeuLysLeuThrAlaGluTyrLysAsnIlePheGlyAspAlaCysArg-192 |
| SEQ. ID. NO. 4118 | 203-AsnGlnAlaLeuGlnGluIleSerLysThrSerGlu-214 |

Antigenic Index - Jameson-Wolf

| | |
|---|---|
| SEQ. ID. NO. 4119 | 34-LysAlaTyrThrGluGluLeuProPro-42 |
| SEQ. ID. NO. 4120 | 61-SerAlaArgSerLysAlaLysAlaGluLysPheTyrArgGluLysMetIleGln-78 |
| SEQ. ID. NO. 4121 | 93-LeuGluHisLysPro-97 |
| SEQ. ID. NO. 4122 | 105-LysAsnHisGlyLysGlyMetAlaGluGlnValArgPheLysAla-119 |
| SEQ. ID. NO. 4123 | 121-ValLeuProAspAspGluAspAlaArgThrIleAla-132 |
| SEQ. ID. NO. 4124 | 144-GlyThrAspAlaValAlaSerGlyGluThrTyrGlyArgVal-157 |
| SEQ. ID. NO. 4125 | 168-LeuGluGlyArgAlaPhe-173 |
| SEQ. ID. NO. 4126 | 189-AspAlaCysArgSerGluThrAlaLeu-197 |
| SEQ. ID. NO. 4127 | 208-GluIleSerLysThrSerGluLysSerLysArg-218 |

Hydrophilic Regions - Hopp-Woods

| | |
|---|---|
| SEQ. ID. NO. 4128 | 35-AlaTyrThrGluGluLeuPro-41 |
| SEQ. ID. NO. 4129 | 62-AlaArgSerLysAlaLysAlaGluLysPheTyrArgGluLysMetIleGln-78 |
| SEQ. ID. NO. 4130 | 93-LeuGluHisLysPro-97 |
| SEQ. ID. NO. 4131 | 106-AsnHisGlyLysGlyMetAlaGluGlnValArgPheLysAla-119 |
| SEQ. ID. NO. 4132 | 121-ValLeuProAspAspGluAspAlaArgThrIleAla-132 |
| SEQ. ID. NO. 4133 | 168-LeuGluGlyArgAlaPhe-173 |
| SEQ. ID. NO. 4134 | 189-AspAlaCysArgSerGluThrAlaLeu-197 |
| SEQ. ID. NO. 4135 | 208-GluIleSerLysThrSerGluLysSerLysArg-218 |

260-2
AMPHI Regions - AMPHI

| | |
|---|---|
| SEQ. ID. NO. 4136 | 12-ProPheSerSerLeuPheArgAlaLeuPhe-21 |
| SEQ. ID. NO. 4137 | 53-PheIleAspSerValGlyGlnValAlaAlaArgLeuPheGlnAlaPhe-68 |
| SEQ. ID. NO. 4138 | 158-GlnValGlyIleValAspLeuIlePro-166 |
| SEQ. ID. NO. 4139 | 175-LeuProArgAlaValGln-180 |

Antigenic Index - Jameson-Wolf

| | |
|---|---|
| SEQ. ID. NO. 4140 | 20-LeuPheGluAspArgValGlyIle-27 |
| SEQ. ID. NO. 4141 | 30-GlyAlaHisAspAlaAlaGlu-36 |
| SEQ. ID. NO. 4142 | 38-AspPheLeuProGluGluPheThrArg-46 |
| SEQ. ID. NO. 4143 | 80-ProAlaPheArgAlaArgGluGlnAlaArgArgGlySerGly-93 |
| SEQ. ID. NO. 4144 | 97-GlyAsnAspLeuArgMetProHisLysAspAlaValGluValAspIleAspGlyGlyAsnThrVal-118 |
| SEQ. ID. NO. 4145 | 126-ThrHisPheAspAspGlyAspAla-133 |
| SEQ. ID. NO. 4146 | 139-AlaGluAlaArgPhe-143 |
| SEQ. ID. NO. 4147 | 184-ArgAsnAlaProGlnGly-189 |
| SEQ. ID. NO. 4148 | 196-ValAlaPheArgArgValArgAla-203 |

Hydrophilic Regions - Hopp-Woods

| | |
|---|---|
| SEQ. ID. NO. 4149 | 20-LeuPheGluAspArgValGlyIle-27 |
| SEQ. ID. NO. 4150 | 30-GlyAlaHisAspAlaAlaGlu-36 |
| SEQ. ID. NO. 4151 | 82-PheArgAlaArgGluGlnAlaArgArgGlySer-92 |
| SEQ. ID. NO. 4152 | 98-AsnAspLeuArgMetProHisLysAspAlaValGluValAspIleAspGly-114 |
| SEQ. ID. NO. 4153 | 127-HisPheAspAspGlyAspAla-133 |
| SEQ. ID. NO. 4154 | 139-AlaGluAlaArgPhe-143 |
| SEQ. ID. NO. 4155 | 196-ValAlaPheArgArgValArgAla-203 |

261
AMPHI Regions - AMPHI

| | |
|---|---|
| SEQ. ID. NO. 4156 | 22-GlnIlePheArgGln-26 |
| SEQ. ID. NO. 4157 | 32-AspThrAlaArgAlaPheAlaAlaAla-40 |
| SEQ. ID. NO. 4158 | 50-GlyLeuLeuAlaAspIle-55 |
| SEQ. ID. NO. 4159 | 94-ArgPheAspLysHis-98 |
| SEQ. ID. NO. 4160 | 137-AlaValTyrLysGlyIleArgAsnAlaValPhe-147 |
| SEQ. ID. NO. 4161 | 158-GlnGlyIleValArgAsnLeu-164 |
| SEQ. ID. NO. 4162 | 203-AspValPheAlaProVal-208 |
| SEQ. ID. NO. 4163 | 212-CysLeuAsnGlnAlaGlyGly-218 |

Antigenic Index - Jameson-Wolf

| | |
|---|---|
| SEQ. ID. NO. 4164 | 40-AlaAlaAspAspAlaVal-45 |
| SEQ. ID. NO. 4165 | 62-ValArgGlnArgProArgLeuArgLeu-70 |
| SEQ. ID. NO. 4166 | 74-HisGlnArgArgValAspLeu-80 |
| SEQ. ID. NO. 4167 | 86-ArgGlnIleLysGlyAsnValHisArgPheAspLysHisVal-99 |

TABLE 1-continued

| | |
|---|---|
| SEQ. ID. NO. 4168 | 111-AlaHisAlaArgAspAspValProTyr-119 |
| SEQ. ID. NO. 4169 | 126-AsnArgGlyIleGluGlnGluLysArgVal-135 |
| SEQ. ID. NO. 4170 | 149-SerPheAspGlyGlyGly-154 |
| SEQ. ID. NO. 4171 | 181-ArgAsnProAlaGly-185 |
| SEQ. ID. NO. 4172 | 197-LeuGluSerAsnGlyLeuAsp-203 |
| SEQ. ID. NO. 4173 | 214-AsnGlnAlaGlyGlyArgIleLeuThrAlaArgLysAspAspGlnGlyLeu-230 |

Hydrophilic Regions - Hopp-Woods

| | |
|---|---|
| SEQ. ID. NO. 4174 | 40-AlaAlaAspAspAlaVal-45 |
| SEQ. ID. NO. 4175 | 62-ValArgGlnArgProArgLeuArgLeu-70 |
| SEQ. ID. NO. 4176 | 74-HisGlnArgArgValAspLeu-80 |
| SEQ. ID. NO. 4177 | 91-AsnValHisArgPheAspLysHisVal-99 |
| SEQ. ID. NO. 4178 | 112-HisAlaArgAspAspValPro-118 |
| SEQ. ID. NO. 4179 | 127-ArgGlyIleGluGlnGluLysArgVal-135 |
| SEQ. ID. NO. 4180 | 221-LeuThrAlaArgLysAspAspGlnGly-229 |

263-2
AMPHI Regions - AMPHI

| | |
|---|---|
| SEQ. ID. NO. 4181 | 32-AsnLeuIleGlyValLeuSerAsnAla-40 |
| SEQ. ID. NO. 4182 | 42-GluAlaLeuAlaPheTyrGlnGluValGlyLysLeuAsnAlaAlaAsnSerLeuThr-60 |
| SEQ. ID. NO. 4183 | 86-LysLeuAlaThrLeuLysLys-92 |
| SEQ. ID. NO. 4184 | 100-LysAlaAlaArgAlaLeuAlaAlaGlyGlu-109 |
| SEQ. ID. NO. 4185 | 115-LeuGlyAlaLeuAlaAlaPheThrGln-123 |
| SEQ. ID. NO. 4186 | 135-GluGluLeuLysAlaPhePheAspAla-143 |
| SEQ. ID. NO. 4187 | 157-ValAlaLeuAlaThrLeuCysAsnTyrValAsnAsnLeuGly-170 |

Antigenic Index - Jameson-Wolf

| | |
|---|---|
| SEQ. ID. NO. 4188 | 10-GluThrAlaProGluAlaAlaLysAlaArgValGluAla-22 |
| SEQ. ID. NO. 4189 | 37-LeuSerAsnAlaPro-41 |
| SEQ. ID. NO. 4190 | 72-AlaArgThrAsnGlnCysGly-78 |
| SEQ. ID. NO. 4191 | 97-GlnSerValLysAlaAlaArg-103 |
| SEQ. ID. NO. 4192 | 108-GlyGluPheAspAspAlaLysLeu-115 |
| SEQ. ID. NO. 4193 | 126-MetAlaLysLysGlyAlaValSerAspGluGluLeuLysAla-139 |
| SEQ. ID. NO. 4194 | 170-GlyGlnThrGluIleAsnProGluLeu-178 |

Hydrophilic Regions - Hopp-Woods

| | |
|---|---|
| SEQ. ID. NO. 4195 | 11-ThrAlaProGluAlaAlaLysAlaArgValGluAla-22 |
| SEQ. ID. NO. 4196 | 97-GlnSerValLysAlaAlaArg-103 |
| SEQ. ID. NO. 4197 | 108-GlyGluPheAspAspAlaLysLeu-115 |
| SEQ. ID. NO. 4198 | 126-MetAlaLysLysGlyAlaValSerAspGluGluLeuLysAla-139 |

264
AMPHI Regions - AMPHI

| | |
|---|---|
| SEQ. ID. NO. 4199 | 55-ValAlaGluPheThrGlnThrGly-62 |
| SEQ. ID. NO. 4200 | 96-IleProSerTyrValArgValThrAsnThrLys-106 |
| SEQ. ID. NO. 4201 | 124-AsnArgIleIleAspValSer-130 |
| SEQ. ID. NO. 4202 | 183-LeuAsnGlnAlaAla-187 |

Antigenic Index - Jameson-Wolf

| | |
|---|---|
| SEQ. ID. NO. 4203 | 27-AlaValValLysAlaGluLysLeuHisAlaSerAlaAsnArgSerTyrLysValAlaGlyLysArgTyrThrProLysAsnGlnVal-55 |
| SEQ. ID. NO. 4204 | 57-GluPheThrGlnThrGlyAsnAlaSerTrp-66 |
| SEQ. ID. NO. 4205 | 68-GlyGlyArgPheHisGlyArgLysThrSerGlyGlyGluArgTyrAsp-83 |
| SEQ. ID. NO. 4206 | 103-ThrAsnThrLysAsnGlyLysSerVal-111 |
| SEQ. ID. NO. 4207 | 114-ArgValAsnAspArgGlyProPheHisGlyAsnArgIleIleAspValSerLysAlaAlaAla-134 |
| SEQ. ID. NO. 4208 | 153-ValProGlyGlnSerAlaProValAlaGluAsnLysAspIlePheIle-168 |
| SEQ. ID. NO. 4209 | 170-LeuLysSerPheGlyThrGluHisGluAla-179 |
| SEQ. ID. NO. 4210 | 200-SerValGluLysArgArgTyrGluTyr-208 |
| SEQ. ID. NO. 4211 | 213-GlyProPheThrSerGlnGluArgAlaAlaGluAlaGluAlaGlnAla-228 |

Hydrophilic Regions - Hopp-Woods

| | |
|---|---|
| SEQ. ID. NO. 4212 | 27-AlaValValLysAlaGluLysLeuHisAlaSerAlaAsnArgSerTyrLysValAlaGlyLysArgTyrThrPro-51 |
| SEQ. ID. NO. 4213 | 71-PheHisGlyArgLysThrSerGlyGlyGluArgTyrAsp-83 |
| SEQ. ID. NO. 4214 | 103-ThrAsnThrLysAsnGlyLys-109 |
| SEQ. ID. NO. 4215 | 115-ValAsnAspArgGlyProPheHis-122 |
| SEQ. ID. NO. 4216 | 125-ArgIleIleAspValSerLysAlaAlaAla-134 |
| SEQ. ID. NO. 4217 | 159-ProValAlaGluAsnLysAspIlePheIle-168 |
| SEQ. ID. NO. 4218 | 171-LysSerPheGlyThrGluHisGluAla-179 |
| SEQ. ID. NO. 4219 | 200-SerValGluLysArgArgTyrGluTyr-208 |
| SEQ. ID. NO. 4220 | 216-ThrSerGlnGluArgAlaAlaGluAlaGluAlaGlnAla-228 |

266-2
Antigenic Index - Jameson-Wolf

| | |
|---|---|
| SEQ. ID. NO. 4221 | 30-AlaLeuLysArgLysHisPhe-36 |
| SEQ. ID. NO. 4222 | 57-LeuGluSerArgAlaGlySerValHisAspGlnGlyTrpGlu-70 |
| SEQ. ID. NO. 4223 | 93-TrpHisThrArgAsnArgGlu-99 |

Hydrophilic Regions - Hopp-Woods

| | |
|---|---|
| SEQ. ID. NO. 4224 | 30-AlaLeuLysArgLysHisPhe-36 |
| SEQ. ID. NO. 4225 | 59-SerArgAlaGlySerValHis-65 |

268-1
AMPHI Regions - AMPHI

| | |
|---|---|
| SEQ. ID. NO. 4226 | 6-AspGlyLeuHisLysPheLysHisIleCysSerAlaAla-18 |
| SEQ. ID. NO. 4227 | 22-IleLysGluProLeuAspLysVal-29 |
| SEQ. ID. NO. 4228 | 52-GlnGluAlaAlaArgValSerGluTrp-60 |
| SEQ. ID. NO. 4229 | 70-GluPheGluGlnPheTrpLysGlyLeuProGlnThrValGlnAsn-84 |
| SEQ. ID. NO. 4230 | 89-SerGlnLysThrTrpLysSerGlyMetAspLys-99 |
| SEQ. ID. NO. 4231 | 110-LysThrProAsnGlyIleLys-116 |

TABLE 1-continued

Antigenic Index - Jameson-Wolf
SEQ. ID. NO. 4232  1-ValGlnSerArgTyrAspGly-7
SEQ. ID. NO. 4233  21-LeuIleLysGluProLeuAspLysValLysGlnArgAsnGluGluLeuGluAlaAlaGluGluAlaAlaAla-44
SEQ. ID. NO. 4234  47-AlaLeuGlyArgGluGlnGluAlaAlaArgValSerGluTrpGluGluArgTyrLysLeuSerArgSerGluPhe-71
SEQ. ID. NO. 4235  82-ValGlnAsnLysLeuGlnAlaSerGlnLysThrTrpLysSerGlyMetAspLysIleCysAlaAsnAsnAlaLysAlaGluGlyLysThrProAsnGly
       IleLysPhe-117
SEQ. ID. NO. 4236  119-GluLeuAlaCysLysThrAlaLysThrGluAlaArgLeuGluGluLeuHisAsnArgLysLysAlaLeuIleAspGluMetAlaArgGluAlaAspLys
       LysGluLeuSerLysArgLeu-158
Hydrophilic Regions - Hopp-Woods
SEQ. ID. NO. 4237  3-SerArgTyrAspGly-7
SEQ. ID. NO. 4238  21-LeuIleLysGluProLeuAspLysValLysGlnArgAsnGluGluLeuGluAlaAlaGluGluAlaAlaAla-44
SEQ. ID. NO. 4239  47-AlaLeuGlyArgGluGlnGluAlaAlaArgValSerGluTrpGluGluArgTyrLysLeuSerArgSerGluPhe-71
SEQ. ID. NO. 4240  91-LysThrTrpLysSerGlyMetAspLysIleCys-101
SEQ. ID. NO. 4241  104-AsnAlaLysAlaGluGlyLysThrProAsn-113
SEQ. ID. NO. 4242  119-GluLeuAlaCysLysThrAlaLysThrGluAlaArgLeuGluGluLeuHisAsnArgLysLysAlaLeuIleAspGluMetAlaArgGluAlaAspLys
       LysGluLeuSerLysArgLeu-158
269-2
AMPHI Regions - AMPHI
SEQ. ID. NO. 4243  39-AlaSerValProAla-43
SEQ. ID. NO. 4244  54-TrpAspPheIleGlnAsnThr-60
SEQ. ID. NO. 4245  73-PheLysThrArgAlaLeuGlyArgPheSerSerPro-84
Antigenic Index - Jameson-Wolf
SEQ. ID. NO. 4246  30-ArgSerAlaLeuSerCysLysProCysAlaSerValProAlaSerSer-45
SEQ. ID. NO. 4247  60-ThrAlaSerProLysValSer-66
SEQ. ID. NO. 4248  73-PheLysThrArgAlaLeuGlyArgPheSerSer-83
SEQ. ID. NO. 4249  90-LeuSerGluArgGlyValLysLysProLeu-99
SEQ. ID. NO. 4250  107-GlnValAspThrSerAla-112
SEQ. ID. NO. 4251  117-SerLeuArgSerSer-121
Hydrophilic Regions - Hopp-Woods
SEQ. ID. NO. 4252  61-AlaSerProLysVal-65
SEQ. ID. NO. 4253  73-PheLysThrArgAlaLeuGly-79
SEQ. ID. NO. 4254  90-LeuSerGluArgGlyValLysLysProLeu-99
270-2
AMPHI Regions - AMPHI
SEQ. ID. NO. 4255  41-AspLeuThrGluGlyCys-46
SEQ. ID. NO. 4256  49-ProAspGlySerArg-53
SEQ. ID. NO. 4257  100-GlnProSerGlyThrTrp-105
Antigenic Index - Jameson-Wolf
SEQ. ID. NO. 4258  1-MetAsnLysAsnArgLysLeu-7
SEQ. ID. NO. 4259  41-AspLeuThrGluGlyCysThrLeuProAspGlySerArgValArgAlaAlaAlaValSerThrLysLysProPhe-65
SEQ. ID. NO. 4260  71-HisAlaProAlaGlyThrGlu-77
SEQ. ID. NO. 4261  86-LysAsnMetAspMetGlyPhe-92
SEQ. ID. NO. 4262  95-TyrMetPheGluArgGlnProSerGlyThr-104
SEQ. ID. NO. 4263  116-ValGluGlyArgArgAspPheThrAla-124
SEQ. ID. NO. 4264  128-IleGlySerArgThrPhe-133
Hydrophilic Regions - Hopp-Woods
SEQ. ID. NO. 4265  1-MetAsnLysAsnArgLysLeu-7
SEQ. ID. NO. 4266  49-ProAspGlySerArgValArgAla-56
SEQ. ID. NO. 4267  60-SerThrLysLysProPhe-65
SEQ. ID. NO. 4268  73-ProAlaGlyThrGlu-77
SEQ. ID. NO. 4269  96-MetPheGluArgGlnPro-101
SEQ. ID. NO. 4270  116-ValGluGlyArgArgAspPheThrAla-124
271-2
AMPHI Regions - AMPHI
SEQ. ID. NO. 4271  6-MetAlaArgIleTrp-10
SEQ. ID. NO. 4272  20-SerProCysProAla-24
SEQ. ID. NO. 4273  29-ProLysSerProAla-33
Antigenic Index - Jameson-Wolf
SEQ. ID. NO. 4274  2-PheSerSerArgMetAlaArg-8
SEQ. ID. NO. 4275  25-LeuThrThrLysProLysSerProAlaLys-34
SEQ. ID. NO. 4276  41-ArgSerAsnCysLeu-45
SEQ. ID. NO. 4277  61-SerSerThrThrGlyAlaProThrSerArg-70
SEQ. ID. NO. 4278  78-SerAlaSerIleAsnLysAspThrArgMetProAlaSerVal-91
SEQ. ID. NO. 4279  102-CysCysAlaAsnThrSerLysProProSer-111
Hydrophilic Regions - Hopp-Woods
SEQ. ID. NO. 4280  27-ThrLysProLysSerProAlaLys-34
SEQ. ID. NO. 4281  80-SerIleAsnLysAspThrArgMet-87
SEQ. ID. NO. 4282  105-AsnThrSerLysProPro-110
272-2
AMPHI Regions - AMPHI
SEQ. ID. NO. 4283  44-IleThrArgIleThrAspGlu-50
SEQ. ID. NO. 4284  70-AlaGluGluPheSerSerThrAsn-77
SEQ. ID. NO. 4285  106-PheArgThrIleThrSer-111
SEQ. ID. NO. 4286  165-IleIleThrIleGluAspProIleGlu-173
SEQ. ID. NO. 4287  194-AsnTrpMetAlaAlaLeuLysAsnThrLeuArgGlnAla-206
SEQ. ID. NO. 4288  244-AsnGlnAlaLeuAspArgIleIleAsn-252
SEQ. ID. NO. 4289  307-GlyAsnIleHisGluIleLysGluValMetLys-317
SEQ. ID. NO. 4290  328-AspGlnHisLeuTyrGln-333
SEQ. ID. NO. 4291  345-AlaLeuLysAsnAlaAspSer-351

TABLE 1-continued

```
Antigenic Index - Jameson-Wolf
SEQ. ID. NO. 4292        2-PheThrAspGluAsnMetThrAlaLysGluGluLeu-13
SEQ. ID. NO. 4293        20-MetAsnGlnAsnLysGlySerAsp-27
SEQ. ID. NO. 4294        38-MetLysLeuAspGlyLysIleThrArgIleThrAspGluProLeuThrAlaGluLysCysMet-58
SEQ. ID. NO. 4295        68-LysGlnAlaGluGluPheSerSerThrAsnGlu-78
SEQ. ID. NO. 4296        85-LeuProAspThrSerArgPheArgVal-93
SEQ. ID. NO. 4297        109-IleThrSerLysIleProLysPheGluSerLeuAsn-120
SEQ. ID. NO. 4298        128-ValAlaLeuLysLysArgGly-134
SEQ. ID. NO. 4299        142-ThrGlySerGlyLysSerThrSerLeu-150
SEQ. ID. NO. 4300        154-IleAspTyrArgAsnGluAsnSerPheGly-163
SEQ. ID. NO. 4301        168-IleGluAspProIle-172
SEQ. ID. NO. 4302        176-HisGluHisLysAsnCys-181
SEQ. ID. NO. 4303        184-ThrGlnArgGluValGlyValAspThrGluAsn-194
SEQ. ID. NO. 4304        199-LeuLysAsnThrLeuArgGlnAlaProAsp-208
SEQ. ID. NO. 4305        214-GluIleArgAspArgGluThrMet-221
SEQ. ID. NO. 4306        241-AsnSerThrAsnGlnAlaLeuAspArg-249
SEQ. ID. NO. 4307        254-PheProGluGluArgArgGluGlnLeuLeu-263
SEQ. ID. NO. 4308        278-LeuValProArgAspGlyGlyLysGlyArgValAlaAla-290
SEQ. ID. NO. 4309        310-HisGluIleLysGluValMetLysLysSerThr-320
SEQ. ID. NO. 4310        334-LeuTyrGluLysGlyAspIleSerLeu-342
SEQ. ID. NO. 4311        344-GluAlaLeuLysAsnAlaAspSerAlaHisAspLeu-355
SEQ. ID. NO. 4312        361-LeuArgSerArgArgAlaGlnSerSerSerProAspLeuGluLeu-375
Hydrophilic Regions - Hopp-Woods
SEQ. ID. NO. 4313        2-PheThrAspGluAsnMetThrAlaLysGluGluLeu-13
SEQ. ID. NO. 4314        20-MetAsnGlnAsnLysGlySerAsp-27
SEQ. ID. NO. 4315        38-MetLysLeuAspGlyLysIleThrArgIleThrAspGluProLeuThrAlaGluLysCysMet-58
SEQ. ID. NO. 4316        68-LysGlnAlaGluGluPheSerSer-75
SEQ. ID. NO. 4317        87-AspThrSerArgPheArgVal-93
SEQ. ID. NO. 4318        112-LysIleProLysPheGluSer-118
SEQ. ID. NO. 4319        128-ValAlaLeuLysLysArgGly-134
SEQ. ID. NO. 4320        143-GlySerGlyLysSerThrSer-149
SEQ. ID. NO. 4321        155-AspTyrArgAsnGluAsnSer-161
SEQ. ID. NO. 4322        168-IleGluAspProIle-172
SEQ. ID. NO. 4323        176-HisGluHisLysAsn-180
SEQ. ID. NO. 4324        184-ThrGlnArgGluValGlyValAspThr-192
SEQ. ID. NO. 4325        201-AsnThrLeuArgGlnAlaPro-207
SEQ. ID. NO. 4326        214-GluIleArgAspArgGluThrMet-221
SEQ. ID. NO. 4327        245-GlnAlaLeuAspArg-249
SEQ. ID. NO. 4328        255-ProGluGluArgArgGluGlnLeuLeu-263
SEQ. ID. NO. 4329        278-LeuValProArgAspGlyGlyLysGlyArgValAlaAla-290
SEQ. ID. NO. 4330        310-HisGluIleLysGluValMetLysLysSerThr-320
SEQ. ID. NO. 4331        336-GluLysGlyAspIleSerLeu-342
SEQ. ID. NO. 4332        344-GluAlaLeuLysAsnAlaAspSerAlaHisAspLeu-355
SEQ. ID. NO. 4333        361-LeuArgSerArgArgAlaGlnSerSerSerProAspLeuGluLeu
274
AMPHI Regions - AMPHI
SEQ. ID. NO. 4334        31-TyrLysAspGlyLys-35
SEQ. ID. NO. 4335        111-GluAlaValPheLysThrLeuSerPro-119
Antigenic Index - Jameson-Wolf
SEQ. ID. NO. 4336        25-LeuValThrAspAspTyrTyrLysAspGlyLysHisIleAsp-38
SEQ. ID. NO. 4337        40-GlnLeuHisArgAspGluGluAlaValArgArgHisIle-52
SEQ. ID. NO. 4338        60-ProAspMetAsnAla-64
SEQ. ID. NO. 4339        71-GlyGluPheAspGlyLysGlnPro-78
SEQ. ID. NO. 4340        85-HisProThrArgLysAlaAspAspGlnThrVal-95
SEQ. ID. NO. 4341        99-ProValGlySerAlaGlnAsnGlyArgAlaGluTyr-110
SEQ. ID. NO. 4342        117-LeuSerProThrAsnHis-122
SEQ. ID. NO. 4343        126-ArgValGluAspAlaAlaGly-132
SEQ. ID. NO. 4344        136-ValGluAsnLysTrpIleThrSerGlnGlyAsnAlaValAspLeuThrProMetAspLysLeuPheAsnAsnThrGluSerLys-163
Hydrophilic Regions - Hopp-Woods
SEQ. ID. NO. 4345        29-AspTyrTyrLysAspGlyLysHisIleAsp-38
SEQ. ID. NO. 4346        40-GlnLeuHisArgAspGluGluAlaValArgArgHisIle-52
SEQ. ID. NO. 4347        72-GluPheAspGlyLysGln-77
SEQ. ID. NO. 4348        86-ProThrArgLysAlaAspAspGlnThrVal-95
SEQ. ID. NO. 4349        104-GlnAsnGlyArgAlaGluTyr-110
SEQ. ID. NO. 4350        126-ArgValGluAspAlaAlaGly-132
SEQ. ID. NO. 4351        151-ThrProMetAspLysLeuPheAsn-158
276
AMPHI Regions - AMPHI
SEQ. ID. NO. 4352        9-MetMetArgSerAlaProSerMetValValArgArgTrpAlaThrMetMet-25
SEQ. ID. NO. 4353        60-SerPheLysMetAlaArg-65
SEQ. ID. NO. 4354        80-ProPheAspProMetGlyTrp-86
SEQ. ID. NO. 4355        115-GlyArgLeuTyrArgThrPheSerAsn-123
SEQ. ID. NO. 4356        164-ThrLysArgGlySerArgLeu-170
SEQ. ID. NO. 4357        207-SerThrSerThrLeuArgLysLeuMetArgProSerThr-219
Antigenic Index - Jameson-Wolf
SEQ. ID. NO. 4358        10-MetArgSerAlaProSerMetVal-17
SEQ. ID. NO. 4359        29-PheSerIleArgArgSerSerAlaCysTrpThrArgSerAspSerLeuSer-46
SEQ. ID. NO. 4360        52-SerSerAsnAsnAsnIle-57
SEQ. ID. NO. 4361        67-MetAlaThrArgCysArgCysProProAspLysLeuLeuPro-80
SEQ. ID. NO. 4362        82-AspProMetGlyTrpCysSerProSerGlyGluLeuSer-94
```

| | |
|---|---|
| SEQ. ID. NO. 4363 | 104-ArgAlaAsnArgThrSerAlaSerProAlaSerGlyArgLeuTyr-118 |
| SEQ. ID. NO. 4364 | 121-PheSerAsnArgValSerSerAsnArgAsnThrSerTrpGluThrArgAlaAsnTrpAlaArgArgGlnSerSerLeu-146 |
| SEQ. ID. NO. 4365 | 158-LeuProAlaAspGlySerThrLysArgGlySerArgLeuThrThr-172 |
| SEQ. ID. NO. 4366 | 176-ProLeuProGluArgProThrArgAlaThrArgSerProCysLeu-190 |
| SEQ. ID. NO. 4367 | 194-LeuLysLeuSerArg-198 |
| SEQ. ID. NO. 4368 | 200-LeuMetProSerGluArgTyrSerThrSerThrLeuArgLysLeuMetArgProSerThrArgCysGlyAla-223 |
| SEQ. ID. NO. 4369 | 229-CysSerGlyGlyValSerArgAsnAlaHisThrProSerAlaAlaArgAsn-245 |

Hydrophilic Regions - Hopp-Woods

| | |
|---|---|
| SEQ. ID. NO. 4370 | 29-PheSerIleArgArgSerSer-35 |
| SEQ. ID. NO. 4371 | 38-TrpThrArgArgSerAspSerLeu-45 |
| SEQ. ID. NO. 4372 | 67-MetAlaThrArgCysArgCysProProAspLys-77 |
| SEQ. ID. NO. 4373 | 90-SerGlyGluLeuSer-94 |
| SEQ. ID. NO. 4374 | 104-ArgAlaAsnArgThrSerAla-110 |
| SEQ. ID. NO. 4375 | 124-ArgValSerSerAsnArgAsnThrSerTrpGluThr-135 |
| SEQ. ID. NO. 4376 | 137-AlaAsnTrpAlaArgArgGlnSerSer-145 |
| SEQ. ID. NO. 4377 | 161-AspGlySerThrLysArgGlySerArg-169 |
| SEQ. ID. NO. 4378 | 176-ProLeuProGluArgProThrArgAlaThrArg-186 |
| SEQ. ID. NO. 4379 | 194-LeuLysLeuSerArg-198 |
| SEQ. ID. NO. 4380 | 200-LeuMetProSerGluArgTyrSer-207 |
| SEQ. ID. NO. 4381 | 210-ThrLeuArgLysLeuMetArgProSerThrArgCys-221 |
| SEQ. ID. NO. 4382 | 232-GlyValSerArgAsnAlaHis-238 |

277

AMPHI Regions - AMPHI

| | |
|---|---|
| SEQ. ID. NO. 4383 | 39-GlyIleAlaValPheGluValValGlyGlyLeuLeuAspPheValLeu-54 |
| SEQ. ID. NO. 4384 | 70-CysProAsnGluValValAspValPheTyrThr-80 |
| SEQ. ID. NO. 4385 | 87-AlaPheAspAlaValGlyAspPheAlaGluTyrGlyArgAlaValAspAlaAlaAspLeuLeuGluIleGlyLysLeuGlyTyrPheHis-116 |
| SEQ. ID. NO. 4386 | 180-AlaValGlyValValAlaValAla-187 |

Antigenic Index - Jameson-Wolf

| | |
|---|---|
| SEQ. ID. NO. 4387 | 2-ProArgPheGluAspLysLeuValGlyArgGlnGlyGluGlyGlyVal-17 |
| SEQ. ID. NO. 4388 | 60-ValGlyAspGlyValAlaVal-66 |
| SEQ. ID. NO. 4389 | 68-ArgPheCysProAsnGluVal-74 |
| SEQ. ID. NO. 4390 | 95-AlaGluTyrGlyArgAlaValAspAla-103 |
| SEQ. ID. NO. 4391 | 118-ValGluProAspPheProAlaGlnThrProArgAlaGluGlyGly-132 |
| SEQ. ID. NO. 4392 | 138-PheAspLysAlaAspValVal-144 |
| SEQ. ID. NO. 4393 | 156-ValGluIleGluVal-160 |
| SEQ. ID. NO. 4394 | 164-GlyGlySerGlyLeuGluGlyAspLeu-172 |
| SEQ. ID. NO. 4395 | 196-LeuAspValGlyGlyLysProArgLeuGlyAla-206 |
| SEQ. ID. NO. 4396 | 208-CysAlaGlnAlaGlyGlyGly-214 |
| SEQ. ID. NO. 4397 | 219-GlyThrAspPheHis-223 |
| SEQ. ID. NO. 4398 | 226-GlyLeuAspAspGlyAla-231 |
| SEQ. ID. NO. 4399 | 239-LeuGlnPheGluAspAspLeuLeuGluGlyLysHisGlyLeu-252 |

Hydrophilic Regions - Hopp-Woods

| | |
|---|---|
| SEQ. ID. NO. 4400 | 2-ProArgPheGluAspLysLeuValGlyArgGlnGlyGlu-14 |
| SEQ. ID. NO. 4401 | 95-AlaGluTyrGlyArgAlaValAspAla-103 |
| SEQ. ID. NO. 4402 | 118-ValGluProAspPhe-122 |
| SEQ. ID. NO. 4403 | 126-ThrProArgAlaGluGly-131 |
| SEQ. ID. NO. 4404 | 138-PheAspLysAlaAspValVal-144 |
| SEQ. ID. NO. 4405 | 156-ValGluIleGluVal-160 |
| SEQ. ID. NO. 4406 | 167-GlyLeuGluGlyAspLeu-172 |
| SEQ. ID. NO. 4407 | 198-ValGlyGlyLysProArgLeuGlyAla-206 |
| SEQ. ID. NO. 4408 | 226-GlyLeuAspAspGlyAla-231 |
| SEQ. ID. NO. 4409 | 239-LeuGlnPheGluAspAspLeuLeuGluGlyLysHisGlyLeu-252 |

278

AMPHI Regions - AMPHI

| | |
|---|---|
| SEQ. ID. NO. 4410 | 7-GlyAlaIlePheSerIleGly-13 |
| SEQ. ID. NO. 4411 | 20-IleGlyProLeuProSerIleGlyArg-28 |
| SEQ. ID. NO. 4412 | 42-ThrGlyThrSerLys-46 |
| SEQ. ID. NO. 4413 | 101-ArgThrIleProSerValThrGluIle-109 |
| SEQ. ID. NO. 4414 | 123-PheSerIleLeuAlaLeuIleLysSerLeuIleSer-134 |
| SEQ. ID. NO. 4415 | 157-LeuTyrArgGlnIleGlnAsnLeuIleThrHisPheAsnPheTyrAlaAla-173 |
| SEQ. ID. NO. 4416 | 189-GluThrLeuIleGlnHisLeuHisGlnLeuAlaAsp-200 |

Antigenic Index - Jameson-Wolf

| | |
|---|---|
| SEQ. ID. NO. 4417 | 25-SerIleGlyArgProAsnAlaSerThrThrArgProThrSerSerArgProThrGlyThrSerLysIleArgPro-49 |
| SEQ. ID. NO. 4418 | 63-SerProAsnThrThrAlaProThrGluSerArgSerArgPheIleAla-78 |
| SEQ. ID. NO. 4419 | 80-ProLysValLeuProGlyAsnSerSerIle-89 |
| SEQ. ID. NO. 4420 | 93-IleAlaSerAspLysProTrpMetArg-101 |
| SEQ. ID. NO. 4421 | 117-SerAlaPheThrAspArgPheSer-124 |
| SEQ. ID. NO. 4422 | 146-ArgHisSerArgValGlnGlyThr-153 |
| SEQ. ID. NO. 4423 | 178-PheAspPheAspArgAspPhe-184 |
| SEQ. ID. NO. 4424 | 209-ThrValAsnAspGlyArgPheAspMetValGlu-219 |

Hydrophilic Regions - Hopp-Woods

| | |
|---|---|
| SEQ. ID. NO. 4425 | 27-GlyArgProAsnAlaSerThrThrArgProThrSerSerArgProThrGlyThrSerLysIleArgPro-49 |
| SEQ. ID. NO. 4426 | 68-AlaProThrGluSerArgSerArgPheIleAla-78 |
| SEQ. ID. NO. 4427 | 93-IleAlaSerAspLysProTrp-99 |
| SEQ. ID. NO. 4428 | 146-ArgHisSerArgValGln-151 |
| SEQ. ID. NO. 4429 | 178-PheAspPheAspArgAspPhe-184 |
| SEQ. ID. NO. 4430 | 211-AsnAspGlyArgPheAspMetValGlu-219 |

279

TABLE 1-continued

AMPHI Regions - AMPHI
SEQ. ID. NO. 4431    6-GlyCysLeuIleSerThr-11
SEQ. ID. NO. 4432    13-PheArgAlaSerAla-17
SEQ. ID. NO. 4433    47-AlaAlaAlaMetAlaArgProThrAla-55
Antigenic Index - Jameson-Wolf
SEQ. ID. NO. 4434    28-GlnTrpGluGlyThrAspThrGlySerGlyArgAlaArgLeuAla-42
SEQ. ID. NO. 4435    64-CysProGlyGluLeuLysLeuThr-71
SEQ. ID. NO. 4436    88-CysSerSerSerLysProArgIle-95
SEQ. ID. NO. 4437    101-ThrProCysGlyThrAlaAspCysIleSerSerAlaArgArgArgThrSerLeu-118
Hydrophilic Regions - Hopp-Woods
SEQ. ID. NO. 4438    29-TrpGluGlyThrAspThrGlySerGlyArgAlaArgLeuAla-42
SEQ. ID. NO. 4439    66-GlyGluLeuLysLeu-70
SEQ. ID. NO. 4440    89-SerSerSerLysProArgIle-95
SEQ. ID. NO. 4441    110-SerSerAlaArgArgArgThrSerLeu-118
280
AMPHI Regions - AMPHI
SEQ. ID. NO. 4442    27-SerPheSerIleLeuGlyAspValAlaLys-36
SEQ. ID. NO. 4443    64-AspIleLysLysIleArgSerAla-71
SEQ. ID. NO. 4444    85-AspValGlnArgAlaValLys-91
SEQ. ID. NO. 4445    97-TyrThrGluAlaThrLysGlyIleGlnProLeuLys-108
SEQ. ID. NO. 4446    146-AlaTyrAlaGlnAsnValAlaLysAlaLeuIleLys-157
SEQ. ID. NO. 4447    233-ValAlaAlaIleIleArgGlnIleLys-241
SEQ. ID. NO. 4448    243-GluGlyIleLysAlaValPheThrGlu-251
SEQ. ID. NO. 4449    254-LysAspThrArgMetValAspArgIleAlaLysGluThr-266
SEQ. ID. NO. 4450    274-LeuTyrSerAspAlaLeuGlyAsnAlaProAlaAspThrTyrIle-288
Antigenic Index - Jameson-Wolf
SEQ. ID. NO. 4451    38-IleGlyGlyGluArgValSer-44
SEQ. ID. NO. 4452    51-AlaAsnGlnAspThrHis-56
SEQ. ID. NO. 4453    61-ThrSerGlyAspIleLysLysIleArgSerAlaLys-72
SEQ. ID. NO. 4454    82-GluAlaAlaAspValGlnArgAlaValLysGlnSerLysValSerTyrThrGluAlaThrLysGlyIleGln-105
SEQ. ID. NO. 4455    107-LeuLysAlaGluGluGluGlyGlyHisHisHisAspHisAspHisAspHisGluGlyHisHisHisAspHisGlyGluTyrAspProHisValTrpAsn
                     AspPro-141
SEQ. ID. NO. 4456    155-LeuIleLysAlaAspProGluGlyLysValTyrTyr-166
SEQ. ID. NO. 4457    176-GlnLeuLysLysLeuHisSerAspAla-184
SEQ. ID. NO. 4458    192-ProAlaAlaLysArgLysValLeuThr-200
SEQ. ID. NO. 4459    208-MetGlyLysArgTyrHis-213
SEQ. ID. NO. 4460    218-AlaProGlnGlyValSerSerGluAlaGluProSerAlaLysGln-232
SEQ. ID. NO. 4461    238-ArgGlnIleLysArgGluGlyIle-245
SEQ. ID. NO. 4462    251-GluAsnIleLysAspThrArgMetValAspArgIleAlaLysGluThrGlyVal-268
SEQ. ID. NO. 4463    270-ValSerGlyLysLeuTyrSer-276
SEQ. ID. NO. 4464    282-AlaProAlaAspThr-286
SEQ. ID. NO. 4465    291-TyrArgHisAsnIle-295
Hydrophilic Regions - Hopp-Woods
SEQ. ID. NO. 4466    38-IleGlyGlyGluArgValSer-44
SEQ. ID. NO. 4467    63-GlyAspIleLysLysIleArgSerAlaLys-72
SEQ. ID. NO. 4468    82-GluAlaAlaAspValGlnArgAlaValLysGlnSerLys-94
SEQ. ID. NO. 4469    99-GluAlaThrLysGly-103
SEQ. ID. NO. 4470    107-LeuLysAlaGluGluGluGlyGlyHisHisHisAspHisAspHisAspHisGluGlyHisHisHisAspHisGlyGluTyrAsp-134
SEQ. ID. NO. 4471    155-LeuIleLysAlaAspProGluGly-162
SEQ. ID. NO. 4472    176-GlnLeuLysLysLeuHisSerAspAla-184
SEQ. ID. NO. 4473    192-ProAlaAlaLysArgLysValLeuThr-200
SEQ. ID. NO. 4474    222-ValSerSerGluAlaGluProSerAlaLysGln-232
SEQ. ID. NO. 4475    238-ArgGlnIleLysArgGluGlyIle-245
SEQ. ID. NO. 4476    251-GluAsnIleLysAspThrArgMetValAspArgIleAlaLysGluThrGlyVal-268
281-2
AMPHI Regions - AMPHI
SEQ. ID. NO. 4477    62-AlaAlaGlyMetLeuMetAlaLeuLeuAlaGlyLeuValSerArgPhe-77
SEQ. ID. NO. 4478    126-LeuGlnLeuIleAlaAlaValSerSerLeuThr-136
SEQ. ID. NO. 4479    179-LeuValSerGlyPheGlnAlaLeuGlyThrLeuMetSerVal-192
SEQ. ID. NO. 4480    205-TrpAlaLysHisMet-209
SEQ. ID. NO. 4481    216-SerValLeuThrAlaLeuLeuCysGly-224
Antigenic Index - Jameson-Wolf
SEQ. ID. NO. 4482    25-ArgArgMetSerLeu-29
SEQ. ID. NO. 4483    78-ThrThrLeuLysGluAspAlaAsn-85
SEQ. ID. NO. 4484    102-SerLysAsnGlySerSerVal-108
SEQ. ID. NO. 4485    159-SerValGlyGlyLysGlyGly-165
SEQ. ID. NO. 4486    236-IleProSerGlyPro-240
SEQ. ID. NO. 4487    256-LeuGlyLysGluGlyGlyIle-262
SEQ. ID. NO. 4488    270-HisArgHisHisThrThr-275
Hydrophilic Regions - Hopp-Woods
SEQ. ID. NO. 4489    25-ArgArgMetSerLeu-29
SEQ. ID. NO. 4490    78-ThrThrLeuLysGluAspAlaAsn-85
SEQ. ID. NO. 4491    103-LysAsnGlySerSer-107
SEQ. ID. NO. 4492    256-LeuGlyLysGluGlyGlyIle-262
SEQ. ID. NO. 4493    270-HisArgHisHisThr-274
282
AMPHI Regions - AMPHI
SEQ. ID. NO. 4494    10-LeuIleValAlaPheLeuValLeuIleAsnProPheSerAlaLeu-24
SEQ. ID. NO. 4495    50-ValPheAlaValIleAlaValPheAlaLeuIleGlyGlyThrLeu-64
SEQ. ID. NO. 4496    112-ArgProAlaArgAsn-116

TABLE 1-continued

| | |
|---|---|
| SEQ. ID. NO. 4497 | 176-ValSerArgLeuLeu-180 |
| SEQ. ID. NO. 4498 | 186-ThrIleLeuAsnArgIleMetGlyMet-194 |

Antigenic Index - Jameson-Wolf

| | |
|---|---|
| SEQ. ID. NO. 4499 | 31-ThrAsnGlyHisSerThrLysGluArgArgLysValAlaArg-44 |
| SEQ. ID. NO. 4500 | 92-AsnGlyAsnAspAsnProAlaLysGlnAsnLeuGlyAlaGlnProGluThrGlyGlnAlaArgProAlaArgAsnAlaGly-118 |

Hydrophilic Regions - Hopp-Woods

| | |
|---|---|
| SEQ. ID. NO. 4501 | 34-HisSerThrLysGluArgArgLysValAlaArg-44 |
| SEQ. ID. NO. 4502 | 92-AsnGlyAsnAspAsnProAlaLysGlnAsnLeu-102 |
| SEQ. ID. NO. 4503 | 104-AlaGlnProGluThrGlyGlnAlaArgProAlaArgAsn-116 |

283

AMPHI Regions - AMPHI

| | |
|---|---|
| SEQ. ID. NO. 4504 | 11-ThrLeuAlaSerPheLeuPro-17 |
| SEQ. ID. NO. 4505 | 32-GlyGlyAsnSerTyrSerAspValProLysGlnLeuHis-44 |
| SEQ. ID. NO. 4506 | 67-AlaAspAlaGlyLysArgThr-73 |

Antigenic Index - Jameson-Wolf

| | |
|---|---|
| SEQ. ID. NO. 4507 | 28-TrpLysAspGlyGlyGlyAsnSerTyrSerAspValProLysGlnLeuHisProAspGlnSerGln-49 |
| SEQ. ID. NO. 4508 | 53-LeuArgThrArgGlnThrLysProAlaValLysProAlaGlnAlaAspAlaGlyLysArgThrAspGlyAlaAlaGlnGluAsnAsnProAspThrAla GluLysAsnArgGlnLeuGluGluGluLysLysArgIleAlaGluThrGluArgGlnAsnLysGluGluAsnCysArgIleSerLysMetAsnLeu-117 |
| SEQ. ID. NO. 4509 | 121-GlyAsnSerAsnAlaLysAsnLysAspAspLeuIleArgLysTyrAsnAsnAlaValAsnLysTyrCysArg-144 |

Hydrophilic Regions - Hopp-Woods

| | |
|---|---|
| SEQ. ID. NO. 4510 | 35-SerTyrSerAspValProLys-41 |
| SEQ. ID. NO. 4511 | 43-LeuHisProAspGlnSerGln-49 |
| SEQ. ID. NO. 4512 | 53-LeuArgThrArgGlnThrLysProAlaValLysProAlaGlnAlaAspAlaGlyLysArgThrAspGlyAlaAlaGlnGluAsnAsnProAspThrAla GluLysAsnArgGlnLeuGluGluGluLysLysArgIleAlaGluThrGluArgGlnAsnLysGluGluAsnCysArgIleSerLysMetAsnLeu-117 |
| SEQ. ID. NO. 4513 | 123-SerAsnAlaLysAsnLysAspAspLeuIleArgLysTyrAsn-136 |

284

AMPHI Regions - AMPHI

| | |
|---|---|
| SEQ. ID. NO. 4514 | 43-GluAlaPheAlaGlyPhePheGluThrVal-52 |
| SEQ. ID. NO. 4515 | 61-ThrPheAlaAlaArgPhe-66 |
| SEQ. ID. NO. 4516 | 125-ValAspPheAspValPhe-130 |
| SEQ. ID. NO. 4517 | 154-ValValPheArgLeuPheArgGlnValValValAsp-165 |
| SEQ. ID. NO. 4518 | 174-AspThrAlaCysGlyAsnIleGlyGly-182 |
| SEQ. ID. NO. 4519 | 186-PheAlaAlaAlaPheThrGlnIleHisGln-195 |
| SEQ. ID. NO. 4520 | 216-PheValGlnPheIleArgAsnAspPheGlyHisGly-227 |
| SEQ. ID. NO. 4521 | 277-PheArgValPheGlyGlnPheAlaArgGlnPheAla-288 |
| SEQ. ID. NO. 4522 | 307-CysPheHisAspGlyPheAspValValAspLys-317 |
| SEQ. ID. NO. 4523 | 342-LeuHisGlnValHisGlnThrAla-349 |
| SEQ. ID. NO. 4524 | 352-GlyAspAsnGlnIleAspArgPheAlaGln-361 |
| SEQ. ID. NO. 4525 | 372-AlaAspAspAlaAspGlyAla-378 |
| SEQ. ID. NO. 4526 | 405-GlnSerThrArgAlaPheAlaArgPhePheAlaAlaPheGlyGlnPheLeuGlnSer-423 |

Antigenic Index - Jameson-Wolf

| | |
|---|---|
| SEQ. ID. NO. 4527 | 1-MetProSerGluThrArgAsnArgPhe-9 |
| SEQ. ID. NO. 4528 | 109-PheAspGlyGlnPhe-113 |
| SEQ. ID. NO. 4529 | 132-HisPheGlyLysArgAsnArgAsnThrArgAla-142 |
| SEQ. ID. NO. 4530 | 147-GlyAlaProAspAlaVal-152 |
| SEQ. ID. NO. 4531 | 166-AsnValGlyAsnGlyArgTyrValAspThrAlaCysGlyAsnIleGlyGlyAsnGlnAsnPhe-186 |
| SEQ. ID. NO. 4532 | 220-IleArgAsnAspPheGlyHisGlyPheGlyGlyArgGluAsnHisAla-235 |
| SEQ. ID. NO. 4533 | 273-AspPheAspAspPheArg-278 |
| SEQ. ID. NO. 4534 | 286-GlnPheAlaAspArgAlaValProSerGlyGlyGluGlnGlnSer-300 |
| SEQ. ID. NO. 4535 | 303-ValAlaArgArgCysPheHisAspGlyPheAspValValAspLysAlaHis-319 |
| SEQ. ID. NO. 4536 | 347-GlnThrAlaArgArgGlyAspAsnGlnIleAspArgPheAlaGlnGlyThrGlyLeuValAlaGluArgArgAlaAlaAspAspAlaAspGlyAla Glu-379 |
| SEQ. ID. NO. 4537 | 398-PheAlaGlyArgGlyGlnHisGlnSerThrArgAla-409 |

Hydrophilic Regions - Hopp-Woods

| | |
|---|---|
| SEQ. ID. NO. 4538 | 1-MetProSerGluThrArgAsnArgPhe-9 |
| SEQ. ID. NO. 4539 | 134-GlyLysArgAsnArgAsnThrArgAla-142 |
| SEQ. ID. NO. 4540 | 229-GlyGlyArgGluAsnHisAla-235 |
| SEQ. ID. NO. 4541 | 286-GlnPheAlaAspArgAlaValProSerGlyGlyGluGlnGln-299 |
| SEQ. ID. NO. 4542 | 313-AspValValAspLysAlaHis-319 |
| SEQ. ID. NO. 4543 | 347-GlnThrAlaArgArgGlyAspAsnGlnIleAspArgPheAla-360 |
| SEQ. ID. NO. 4544 | 366-ValAlaGluArgArgAlaAlaAspAspAlaAspGlyAlaGlu-379 |
| SEQ. ID. NO. 4545 | 402-GlyGlnHisGlnSer-406 |

285-1

AMPHI Regions - AMPHI

| | |
|---|---|
| SEQ. ID. NO. 4546 | 15-ValCysPheLeuGly-19 |
| SEQ. ID. NO. 4547 | 34-GlnIleProSerTrp-38 |
| SEQ. ID. NO. 4548 | 50-GlyThrLeuLeuAspGlyPheAsp-57 |
| SEQ. ID. NO. 4549 | 116-SerLeuProAspSerIleAspLeuPro-124 |
| SEQ. ID. NO. 4550 | 208-HisSerThrAlaArg-212 |
| SEQ. ID. NO. 4551 | 240-HisProPheAlaGluSerLeuAspLysThrLeuGluGluValLeu-254 |
| SEQ. ID. NO. 4552 | 266-ValProSerLeuPro-270 |
| SEQ. ID. NO. 4553 | 280-AlaIleProSerPheSerAsp-286 |
| SEQ. ID. NO. 4554 | 313-GlnValLeuGlyGly-317 |
| SEQ. ID. NO. 4555 | 592-IleGlyLysAlaAlaAspIle-598 |
| SEQ. ID. NO. 4556 | 609-ProAspThrSerArg-613 |
| SEQ. ID. NO. 4557 | 671-GlyIleAsnArgGluLeuThrArgTrp-679 |
| SEQ. ID. NO. 4558 | 747-IleAlaGluLeuHisAsnPhePheLysProProPhe-758 |
| SEQ. ID. NO. 4559 | 776-AlaArgGlyTyrLeu-780 |
| SEQ. ID. NO. 4560 | 836-PheGlyGlyAsnMetAlaAsn-842 |
| SEQ. ID. NO. 4561 | 848-ArgIleThrAlaSerLeu-853 |

TABLE 1-continued

| | |
|---|---|
| SEQ. ID. NO. 4562 | 855-AspLeuGlyAlaLeu-859 |
| SEQ. ID. NO. 4563 | 868-GlnAsnIleThrGlySerLeuAsnAlaAla-877 |
| SEQ. ID. NO. 4564 | 955-GlySerIleAlaAsp-959 |
| SEQ. ID. NO. 4565 | 1008-ThrAlaGluLeu-1012 |
| SEQ. ID. NO. 4566 | 1061-ValThrGlyMetIleLys-1066 |
| SEQ. ID. NO. 4567 | 1135-SerGlyGlySerValArgGlyValGlyThrValArg-1146 |
| SEQ. ID. NO. 4568 | 1165-ThrValSerPheValGlyProLeuAsn-1173 |
| SEQ. ID. NO. 4569 | 1190-AlaGlyValGluIleLeuGlySerLeuAsn-1199 |
| SEQ. ID. NO. 4570 | 1244-LeuAlaGlyGlnIle-1248 |
| SEQ. ID. NO. 4571 | 1305-ValLysLeuIleTyrArgLeuThrArgAlaIleGlnAlaValAlaArgIleGlySer-1323 |
| Antigenic Index - Jameson-Wolf | |
| SEQ. ID. NO. 4572 | 43-IleSerSerGlnAsnLeuLysGlyThrLeuLeuAspGlyPheAspGlyAspAsnTrpSerIleGluThrGluGlyAlaAspLeuLysIleSerArg-74 |
| SEQ. ID. NO. 4573 | 80-LysProSerGluLeuMetArgArgSerLeuHis-90 |
| SEQ. ID. NO. 4574 | 104-LysProThrProProLysGluGluArgProProLeuSerLeuProAspSerIleAsp-122 |
| SEQ. ID. NO. 4575 | 130-AspArgPheGluThrGlyLysIleSerMetGlyLysAlaPheAspLysGlnThrValTyr-149 |
| SEQ. ID. NO. 4576 | 151-GluArgLeuAspAlaSerTyrArgTyrAspArgLysGlyHisArgLeuAspLeuLysAlaAlaAspThrProTrpSerSerSerGlyAlaAla-182 |
| SEQ. ID. NO. 4577 | 185-GlyLeuLysLysProPheAla-191 |
| SEQ. ID. NO. 4578 | 198-ThrLysGlyGlyLeuGluGlyLysThrIle-207 |
| SEQ. ID. NO. 4579 | 209-SerThrAlaArgLeuSerGlySerLeuLysAspValArgAla-222 |
| SEQ. ID. NO. 4580 | 224-LeuAlaIleAspGlyGlyAsnIleArgLeuSerGlyLysSer-237 |
| SEQ. ID. NO. 4581 | 244-GluSerLeuAspLysThrLeuGlu-251 |
| SEQ. ID. NO. 4582 | 268-SerLeuProAspAla-272 |
| SEQ. ID. NO. 4583 | 292-GlySerLeuAspLeuGluAsnThrLys-300 |
| SEQ. ID. NO. 4584 | 302-GlyPheAlaAspArgAsnGlyIleProVal-311 |
| SEQ. ID. NO. 4585 | 320-IleArgGlnAspGlyThrVal-326 |
| SEQ. ID. NO. 4586 | 337-GlyArgGlyGlyIleArgLeuSerGlyLysIleAspThrGluLysAspIleLeu-354 |
| SEQ. ID. NO. 4587 | 362-SerValGlyAlaGluAspValLeu-369 |
| SEQ. ID. NO. 4588 | 372-AlaPheLysGlyArgLeuAspGlySerIle-381 |
| SEQ. ID. NO. 4589 | 387-ThrAlaSerProLysIle-392 |
| SEQ. ID. NO. 4590 | 400-ThrAlaArgThrAspGlySerLeu-407 |
| SEQ. ID. NO. 4591 | 411-SerAspProAlaAsnGlyGlnArgLysLeuVal-421 |
| SEQ. ID. NO. 4592 | 430-GlyGlnGlySerLeuThr-435 |
| SEQ. ID. NO. 4593 | 442-LeuPheLysAspArgLeuLeuLysLeuAspIleArgSerArgAlaPheAspProSerArgIleAspProGlnLeu-466 |
| SEQ. ID. NO. 4594 | 480-GluLeuAlaLysGluLysPheThrGlyLys-489 |
| SEQ. ID. NO. 4595 | 508-IleValTyrGluSerArgHisLeuProArgAlaAlaVal-520 |
| SEQ. ID. NO. 4596 | 522-LeuArgLeuGlyArgAsnIleIleLysThrAspGlyGlyPheGlyLysLysGlyAspArgLeuAsn-543 |
| SEQ. ID. NO. 4597 | 548-AlaProAspLeuSerArgPheGly-555 |
| SEQ. ID. NO. 4598 | 563-AsnValArgGlyHisLeuSerGlyAspLeuAspGlyGlyIleArgThrPheGluThrAspLeuSerGlyAlaAla-587 |
| SEQ. ID. NO. 4599 | 594-LysAlaAlaAlaAspIleArgSer-600 |
| SEQ. ID. NO. 4600 | 605-LeuLysGlySerProAspThrSerArgProIleArgAlaAspIleLysGlySerArgLeuSerLeuSerGlyGly-629 |
| SEQ. ID. NO. 4601 | 634-AspThrAlaAspLeuMetLeuAspGlyThrGlyVal-645 |
| SEQ. ID. NO. 4602 | 647-HisArgIleArgThr-651 |
| SEQ. ID. NO. 4603 | 656-ThrLeuAspGlyLysProPheLysPheAspLeuAspAlaSerGlyGlyIleAsnArgGluLeuThrArgTrpLysGlySerIle-683 |
| SEQ. ID. NO. 4604 | 696-LeuGlnAsnArgMetThrLeu-702 |
| SEQ. ID. NO. 4605 | 704-AlaGlyAlaGluArgValAla-710 |
| SEQ. ID. NO. 4606 | 729-SerTrpAspLysLysThrGlyIleSerAlaLysGlyGlyAla-742 |
| SEQ. ID. NO. 4607 | 764-LeuAsnGlyAspTrp-768 |
| SEQ. ID. NO. 4608 | 772-TyrGlyArgAsnAlaArgGly-778 |
| SEQ. ID. NO. 4609 | 782-IleSerArgGlnSerGlyAspAlaValLeu-791 |
| SEQ. ID. NO. 4610 | 803-SerLeuLysThrArgPheGlnAsnAspArgIleGly-814 |
| SEQ. ID. NO. 4611 | 817-LeuAspGlyGlyAlaArgPheGlyArgIleAsnAla-828 |
| SEQ. ID. NO. 4612 | 844-ProLeuGlyGlyArgIleThr-850 |
| SEQ. ID. NO. 4613 | 882-GlyArgValGlySerProSerVal-889 |
| SEQ. ID. NO. 4614 | 893-ValAsnGlySerSerAsnTyrGlyLysIleAsnGly-904 |
| SEQ. ID. NO. 4615 | 908-ValGlyGlnSerArgSerPheAspThrAlaProLeuGlyGlyArgLeuAsn-924 |
| SEQ. ID. NO. 4616 | 941-GlnThrValLysGlySerLeu-947 |
| SEQ. ID. NO. 4617 | 956-SerIleAlaAspProHisLeuGlyGly-964 |
| SEQ. ID. NO. 4618 | 966-IleAsnGlyAspLysLeuTyrTyrArgAsnGlnThr-977 |
| SEQ. ID. NO. 4619 | 982-LeuAspAsnGlySerLeuArg-988 |
| SEQ. ID. NO. 4620 | 991-IleAlaGlyArgLysTrpVal-997 |
| SEQ. ID. NO. 4621 | 1001-LeuLysPheArgHisGluGlyThrAlaGluLeuSerGly-1013 |
| SEQ. ID. NO. 4622 | 1015-ValGlyMetGluAsnSerGlyProAspValAspIle-1026 |
| SEQ. ID. NO. 4623 | 1031-AspLysTyrArgIleLeuSerArgProAsnArgArgLeuThr-1044 |
| SEQ. ID. NO. 4624 | 1047-GlyAsnThrArgLeuArgTyrSerProGlnLysGlyIle-1059 |
| SEQ. ID. NO. 4625 | 1065-IleLysThrAspGlnGlyLeuPheGlySerGlnLysSerSerMetProSerValGlyAspAspVal-1086 |
| SEQ. ID. NO. 4626 | 1091-GluValLysLysGluAlaAla-1097 |
| SEQ. ID. NO. 4627 | 1109-AspLeuAsnAsnGlyIleArg-1115 |
| SEQ. ID. NO. 4628 | 1134-GlnSerGlyGlySerValArgGlyValGly-1143 |
| SEQ. ID. NO. 4629 | 1146-ArgValIleLysGlyArgTyrLysAlaTyrGlyGlnAspLeuAspIle ThrLysGlyThr-1165 |
| SEQ. ID. NO. 4630 | |
| SEQ. ID. NO. 4631 | 1171-ProLeuAsnAspProAsnLeuAsnIleArgAlaGluArgArgLeuSerProValGly-1189 |
| SEQ. ID. NO. 4632 | 1197-SerLeuAsnSerProArgIle-1203 |
| SEQ. ID. NO. 4633 | 1207-AlaAsnGluProMetSerGluLysAspLysLeu-1217 |
| SEQ. ID. NO. 4634 | 1225-AlaGlySerGlySerSerGlyAspAsnAlaAla-1235 |
| SEQ. ID. NO. 4635 | 1246-GlyGlnIleAsnAspArgIleGlyLeu-1254 |
| SEQ. ID. NO. 4636 | 1256-AspAspLeuGlyPheThrSerLysArgSerArgAsnAlaGlnThrGlyGluLeuAsnProAlaGlu-1277 |
| SEQ. ID. NO. 4637 | 1283-GlyLysGlnLeuThrGlyLys-1289 |
| SEQ. ID. NO. 4638 | 1299-SerSerAlaGluGlnSerVal-1305 |
| SEQ. ID. NO. 4639 | 1321-IleGlySerArgSerSerGlyGlyGluLeu-1330 |
| SEQ. ID. NO. 4640 | 1335-ArgPheAspArgPheSerGlySerAspLysLysAspSerAlaGlyAsnGlyLysGlyLys-1354 |

TABLE 1-continued

Hydrophilic Regions - Hopp-Woods
SEQ. ID. NO. 4641    56-PheAspGlyAspAsnTrpSerIleGluThrGluGlyAlaAspLeuLysIleSerArg-74
SEQ. ID. NO. 4642    83-GluLeuMetArgArgSerLeuHis-90
SEQ. ID. NO. 4643    105-ProThrProProLysGluGluArgProPro-114
SEQ. ID. NO. 4644    130-AspArgPheGluThrGlyLys-136
SEQ. ID. NO. 4645    141-LysAlaPheAspLys-145
SEQ. ID. NO. 4646    151-GluArgLeuAspAla-155
SEQ. ID. NO. 4647    157-TyrArgTyrAspArgLysGlyHisArgLeuAspLeuLysAlaAlaAsp-172
SEQ. ID. NO. 4648    200-GlyGlyLeuGluGlyLysThrIle-207
SEQ. ID. NO. 4649    215-GlySerLeuLysAspValArgAla-222
SEQ. ID. NO. 4650    244-GluSerLeuAspLysThrLeuGlu-251
SEQ. ID. NO. 4651    292-GlySerLeuAspLeuGluAsnThrLys-300
SEQ. ID. NO. 4652    302-GlyPheAlaAspArgAsnGlyIlePro-310
SEQ. ID. NO. 4653    320-IleArgGlnAspGly-324
SEQ. ID. NO. 4654    343-LeuSerGlyLysIleAspThrGluLysAspIleLeu-354
SEQ. ID. NO. 4655    364-GlyAlaGluAspValLeu-369
SEQ. ID. NO. 4656    373-PheLysGlyArgLeuAspGly-379
SEQ. ID. NO. 4657    401-AlaArgThrAspGly-405
SEQ. ID. NO. 4658    412-AspProAlaAsnGlyGlnArgLysLeuVal-421
SEQ. ID. NO. 4659    442-LeuPheLysAspArgLeuLeuLysLeuAspIleArgSerArgAlaPheAspProSerArgIleAspPro-464
SEQ. ID. NO. 4660    480-GluLeuAlaLysGluLysPheThrGly-488
SEQ. ID. NO. 4661    508-IleValTyrGluSerArgHisLeuPro-516
SEQ. ID. NO. 4662    522-LeuArgLeuGlyArgAsnIleIleLysThrAspGlyGlyPheGlyLysLysGlyAspArgLeuAsn-543
SEQ. ID. NO. 4663    570-GlyAspLeuAspGlyGlyIleArgThrPheGluThrAspLeuSerGlyAlaAla-587
SEQ. ID. NO. 4664    594-LysAlaAlaAspIleArgSer-600
SEQ. ID. NO. 4665    607-GlySerProAspThrSerArgProIleArgAlaAspIleLysGlySerArgLeuSerLeu-626
SEQ. ID. NO. 4666    634-AspThrAlaAspLeuMetLeu-640
SEQ. ID. NO. 4667    647-HisArgIleArgThr-651
SEQ. ID. NO. 4668    657-LeuAspGlyLysProPheLysPheAspLeuAspAla-668
SEQ. ID. NO. 4669    670-GlyGlyIleAsnArgGluLeuThrArgTrpLysGly-681
SEQ. ID. NO. 4670    704-AlaGlyAlaGluArgValAla-710
SEQ. ID. NO. 4671    729-SerTrpAspLysLysThrGlyIleSerAlaLysGlyGlyAla-742
SEQ. ID. NO. 4672    783-SerArgGlnSerGly-787
SEQ. ID. NO. 4673    806-ThrArgPheGlnAsnAspArgIle-813
SEQ. ID. NO. 4674    819-GlyGlyAlaArgPheGlyArgIleAsnAla-828
SEQ. ID. NO. 4675    1001-LeuLysPheArgHisGluGlyThrAlaGluLeu-1011
SEQ. ID. NO. 4676    1015-ValGlyMetGluAsnSerGlyProAspValAspIle-1026
SEQ. ID. NO. 4677    1031-AspLysTyrArgIleLeuSerArgProAsnArgArgLeuThr-1044
SEQ. ID. NO. 4678    1049-ThrArgLeuArgTyrSerPro-1055
SEQ. ID. NO. 4679    1065-IleLysThrAspGln-1069
SEQ. ID. NO. 4680    1075-GlnLysSerSerMet-1079
SEQ. ID. NO. 4681    1081-SerValGlyAspAsp-1085
SEQ. ID. NO. 4682    1091-GluValLysLysGluAlaAla-1097
SEQ. ID. NO. 4683    1109-AspLeuAsnAspGlyIleArg-1115
SEQ. ID. NO. 4684    1146-ArgValIleLysGlyArgTyrLysAlaTyrGlyGlnAspLeuAspIleThrLys-1163
SEQ. ID. NO. 4685    1179-IleArgAlaGluArgArgLeuSer-1186
SEQ. ID. NO. 4686    1209-GluProMetSerGluLysAspLysLeu-1217
SEQ. ID. NO. 4687    1225-AlaGlySerGlySerSerGlyAspAsnAlaAla-1235
SEQ. ID. NO. 4688    1248-IleAsnAspArgIleGlyLeu-1254
SEQ. ID. NO. 4689    1259-GlyPheThrSerLysArgSerArgAsnAlaGlnThrGlyGluLeuAsnPro-1275
SEQ. ID. NO. 4690    1300-SerAlaGluGlnSerVal-1305
SEQ. ID. NO. 4691    1321-IleGlySerArgSerSerGlyGly-1328
SEQ. ID. NO. 4692    1335-ArgPheAspArgPheSerGlySerAspLysLysAspSerAlaGlyAsnGlyLysGlyLys-1354
286
AMPHI Regions - AMPHI
SEQ. ID. NO. 4693    69-GluIleLysAspMetVal-74
SEQ. ID. NO. 4694    102-ProAspAsnValLysThr-107
SEQ. ID. NO. 4695    145-ValAlaIleLeuGlyAsp-150
SEQ. ID. NO. 4696    157-LeuAlaGluTyrTyrArgAsnAlaLeuGluAsnTrpGlnGlnProValGlySer-174
SEQ. ID. NO. 4697    198-ProLeuAlaLysLeuGlyAsnThr-205
SEQ. ID. NO. 4698    238-ThrGlnArgTyrProGluGlnIleValSerGlyLeuAlaArgPhe-252
SEQ. ID. NO. 4699    326-AspTyrTyrAsnLeuPheAsnLys-333
SEQ. ID. NO. 4700    354-IleSerGlnProArg-358
SEQ. ID. NO. 4701    375-ThrThrGlnAsnLeu-379
SEQ. ID. NO. 4702    428-ThrAlaSerTrpLysArgGlnLeuLeu-436
SEQ. ID. NO. 4703    455-ThrLeuGlyThrPheLeu-460
SEQ. ID. NO. 4704    513-GlyAlaSerSerVal-517
SEQ. ID. NO. 4705    555-LeuSerGlyAlaValPheHisAspMetGlyAspAlaAlaAlaAsn-569
SEQ. ID. NO. 4706    584-ArgTrpPheSerProLeu-589
Antigenic Index - Jameson-Wolf
SEQ. ID. NO. 4707    1-MetHisAspThrArgThrMetMet-8
SEQ. ID. NO. 4708    30-AlaAspLeuSerGluAsnLysAla-37
SEQ. ID. NO. 4709    43-PheLysAsnLysSerProAspThrGluSerValLysLeuLysProLysPheProVal-61
SEQ. ID. NO. 4710    64-AspThrGlnAspSerGluIleLysAspMetValGluGluHisLeu-78
SEQ. ID. NO. 4711    83-GlnGlnGlnGluGluValLeuAspLysGluGlnThr-94
SEQ. ID. NO. 4712    97-LeuAlaGluGluAlaProAspAsnValLysThrMetLeuArgSerLysGlyTyrPheSerSerLysValSerLeuThrGluLysAspGlyAla-127
SEQ. ID. NO. 4713    133-ThrProGlyProArgThrLysIle-140
SEQ. ID. NO. 4714    151-IleLeuSerAspGlyAsnLeuAlaGluTyrTyrArgAsnAlaLeuGluAsnTrpGln-169
SEQ. ID. NO. 4715    172-ValGlySerAspPheAspGlnAspSerTrpGluAsnSerLysThrSerVal-188
SEQ. ID. NO. 4716    192-ValThrArgLysAlaTyrPro-198

TABLE 1-continued

| | |
|---|---|
| SEQ. ID. NO. 4717 | 208-AlaValAsnProAspThrAlaThr-215 |
| SEQ. ID. NO. 4718 | 223-AspSerGlyArgProIleAla-229 |
| SEQ. ID. NO. 4719 | 234-GluIleThrGlyThrGlnArgTyrProGluGlnIle-245 |
| SEQ. ID. NO. 4720 | 252-PheGlnProGlyMetProTyrAspLeu-260 |
| SEQ. ID. NO. 4721 | 270-LeuGluGlnAsnGlyHisTyrSerGly-278 |
| SEQ. ID. NO. 4722 | 283-AlaAspPheAspArgLeuGlnGlyAspArgValProVal-295 |
| SEQ. ID. NO. 4723 | 298-SerValThrGluValLysArgHisLysLeuGluThrGlyIleArgLeuAspSerGluTyrGlyLeuGlyGly-321 |
| SEQ. ID. NO. 4724 | 342-AspMetAspLysTyrGluThr-348 |
| SEQ. ID. NO. 4725 | 355-SerGlnProArgAsnTyrArgGlyAsnTyrTrp-365 |
| SEQ. ID. NO. 4726 | 368-AsnValSerTyrAsnArgSerThrThrGlnAsnLeuGluLysArgAlaPheSerGlyGly-387 |
| SEQ. ID. NO. 4727 | 390-TyrValArgAspArgAlaGlyIleAspAlaArgLeuGly-402 |
| SEQ. ID. NO. 4728 | 405-PheLeuAlaGluGlyArgLysIleProGlySerAla-416 |
| SEQ. ID. NO. 4729 | 430-SerTrpLysArgGlnLeu-435 |
| SEQ. ID. NO. 4730 | 441-HisProGluAsnGlyHisTyrLeuAspGlyLysIle-452 |
| SEQ. ID. NO. 4731 | 468-ThrSerAlaArgAlaGly-473 |
| SEQ. ID. NO. 4732 | 476-PheThrProGluAsnLysLysLeu-483 |
| SEQ. ID. NO. 4733 | 496-ValAlaArgAspAsnAlaAspValProSer-505 |
| SEQ. ID. NO. 4734 | 509-PheArgSerGlyGlyAlaSerSerValArgGlyTyrGluLeuAspSer-524 |
| SEQ. ID. NO. 4735 | 534-ValLeuProGluArgAlaLeu-540 |
| SEQ. ID. NO. 4736 | 562-AspMetGlyAspAla-566 |
| SEQ. ID. NO. 4737 | 568-AlaAsnPheLysArgMetLysLeuLysHisGlySerGlyLeu-581 |
| SEQ. ID. NO. 4738 | 598-TyrGlyHisSerAspLysLysIleArg-606 |
| Hydrophilic Regions - Hopp-Woods | |
| SEQ. ID. NO. 4739 | 1-MetHisAspThrArgThrMetMet-8 |
| SEQ. ID. NO. 4740 | 30-AlaAspLeuSerGluAsnLysAla-37 |
| SEQ. ID. NO. 4741 | 44-LysAsnLysSerProAspThrGluSerValLysLeuLysProLysPhe-59 |
| SEQ. ID. NO. 4742 | 64-AspThrGlnAspSerGluIleLysAspMetValGluGluHisLeu-78 |
| SEQ. ID. NO. 4743 | 84-GlnGlnGluGluValLeuAspLysGluGlnThr-94 |
| SEQ. ID. NO. 4744 | 97-LeuAlaGluGluAlaProAspAsnValLysThrMetLeuArgSer-111 |
| SEQ. ID. NO. 4745 | 119-ValSerLeuThrGluLysAspGlyAla-127 |
| SEQ. ID. NO. 4746 | 134-ProGlyProArgThrLysIle-140 |
| SEQ. ID. NO. 4747 | 174-SerAspPheAspGlnAspSerTrpGluAsnSerLysThr-186 |
| SEQ. ID. NO. 4748 | 192-ValThrArgLysAlaTyrPro-198 |
| SEQ. ID. NO. 4749 | 209-ValAsnProAspThrAlaThr-215 |
| SEQ. ID. NO. 4750 | 239-GlnArgTyrProGlu-243 |
| SEQ. ID. NO. 4751 | 283-AlaAspPheAspArgLeuGlnGlyAspArgValProVal-295 |
| SEQ. ID. NO. 4752 | 298-SerValThrGluValLysArgHisLysLeuGluThrGlyIleArgLeuAspSerGluTyr-317 |
| SEQ. ID. NO. 4753 | 342-AspMetAspLysTyrGluThr-348 |
| SEQ. ID. NO. 4754 | 373-ArgSerThrThrGlnAsnLeuGluLysArgAlaPhe-384 |
| SEQ. ID. NO. 4755 | 391-ValArgAspArgAla395GlyIleAspAlaArgLeuGly-402 |
| SEQ. ID. NO. 4756 | 405-PheLeuAlaGluGlyArgLysIlePro-413 |
| SEQ. ID. NO. 4757 | 478-ProGluAsnLysLysLeu-483 |
| SEQ. ID. NO. 4758 | 496-ValAlaArgAspAsnAlaAspVal-503 |
| SEQ. ID. NO. 4759 | 518-ArgGlyTyrGluLeuAspSer-524 |
| SEQ. ID. NO. 4760 | 534-ValLeuProGluArgAlaLeu-540 |
| SEQ. ID. NO. 4761 | 562-AspMetGlyAspAla-566 |
| SEQ. ID. NO. 4762 | 568-AlaAsnPheLysArgMetLysLeuLysHis-577 |
| SEQ. ID. NO. 4763 | 600-HisSerAspLysLysIleArg-606 |
| 287 | |
| AMPHI Regions - AMPHI | |
| SEQ. ID. NO. 4764 | 29-LysSerAlaAspThrLeuSerLysProAlaAla-39 |
| SEQ. ID. NO. 4765 | 68-GlySerGlnAspMet-72 |
| SEQ. ID. NO. 4766 | 131-AlaThrAspAlaGlyGluSerSerGlnProAlaAsnGlnProAspMetAlaAsnAlaAlaAspGlyMet-153 |
| SEQ. ID. NO. 4767 | 164-AsnAlaGlyAsnThrAlaAlaGlnGlyAlaAsnGlnAlaGly-177 |
| SEQ. ID. NO. 4768 | 246-PheGluLysLeuSerAspAlaAspLysIleSerAsnTyrLys-259 |
| SEQ. ID. NO. 4769 | 291-ProThrSerPheAlaArgPheArgArgSerAlaArg-302 |
| SEQ. ID. NO. 4770 | 410-LysSerValAspGlyIleIleAspSer-418 |
| SEQ. ID. NO. 4771 | 437-GlyPheLysGlyThrTrpThr-443 |
| SEQ. ID. NO. 4772 | 450-ValSerGlyLysPheTyr-455 |
| Antigenic Index - Jameson-Wolf | |
| SEQ. ID. NO. 4773 | 18-CysGlyGlyGlyGlyGlyGlySerProAspValLysSerAlaAspThrLeuSerLysProAla-38 |
| SEQ. ID. NO. 4774 | 42-ValSerGluLysGluThrGluAlaLysGluAspAlaProGlnAlaGlySerGlnGlyGlnGlyAlaProSerAlaGlnGlySerGlnAspMet-72 |
| SEQ. ID. NO. 4775 | 74-AlaValSerGluGluAsnThrGlyAsnGlyGlyAlaValThrAlaAspAsnProLysAsnGluAspGluValAlaGlnAsnAspMetProGlnAsnAla<br>AlaGlyThrAspSerSerThrProAsnHisThrProAspProAsnMet-122 |
| SEQ. ID. NO. 4776 | 126-AsnMetGluAsnGlnAlaThrAspAlaGlyGluSerSerGlnProAlaAsnGlnProAspMetAlaAsnAlaAlaAspGlyMetGlnGlyAspAspPro<br>SerAlaGlyGlyGlnAsnAlaGlyAsnThrAlaAlaGlnGlyAlaAsnGlnAlaGlyAsnAsnGlnAlaAlaGlySerSerAspProIleProAlaSerAsnPro<br>AlaProAlaAsnGlyGlySerAsnPheGlyArgValAspLeuAlaAsn-209 |
| SEQ. ID. NO. 4777 | 214-AspGlyProSerGlnAsn-219 |
| SEQ. ID. NO. 4778 | 223-ThrHisCysLysGlyAspSerCysSerGlyAsnAsnPheLeuAspGluGluValGlnLeuLysSerGluPheGluLysLeuSerAspAlaAspLysIle<br>SerAsnTyrLysLysAspGlyLysAsnAspLysPhe-267 |
| SEQ. ID. NO. 4779 | 287-TyrLysProLysProThrSerPheAlaArgPheArgArgSerAlaArgSerArgArgSerLeuProAla-309 |
| SEQ. ID. NO. 4780 | 321-ThrLeuIleValAspGlyGluAla-328 |
| SEQ. ID. NO. 4781 | 340-AlaProGluGlyAsnTyrArgTyrLeu-348 |
| SEQ. ID. NO. 4782 | 351-GlyAlaGluLysLeuProGlyGlySerTyr-360 |
| SEQ. ID. NO. 4783 | 364-ValGlnGlyGluProAlaLysGlyGluMet-373 |
| SEQ. ID. NO. 4784 | 388-HisThrGluAsnGlyArgProTyrProThrArgGlyArgPheAlaAla-403 |
| SEQ. ID. NO. 4785 | 405-ValAspPheGlySerLysSerValAspGlyIleIleAspSerGlyAspAspLeuHisMetGlyThrGlnLysPheLysAlaAlaIleAspGlyAsnGly<br>PheLysGlyThrTrpThrGluAsnGlySerGlyAspValSerGly-452 |
| SEQ. ID. NO. 4786 | 454-PheTyrGlyProAlaGlyGluGluValAlaGlyLysTyrSerTyrArgProThrAspAlaGluLysGlyGlyPhe-478 |
| SEQ. ID. NO. 4787 | 482-AlaGlyLysLysGluGlnAsp-488 |

TABLE 1-continued

Hydrophilic Regions - Hopp-Woods
SEQ. ID. NO. 4788  22-GlyGlyGlySerProAspValLysSerAlaAspThrLeuSerLysProAla-38
SEQ. ID. NO. 4789  42-ValSerGluLysGluThrGluAlaLysGluAspAlaProGln-55
SEQ. ID. NO. 4790  57-GlySerGlnGlyGlnGly-62
SEQ. ID. NO. 4791  67-GlnGlySerGlnAsp-71
SEQ. ID. NO. 4792  74-AlaValSerGluGluAsnThrGly-81
SEQ. ID. NO. 4793  86-ValThrAlaAspAsnProLysAsnGluAspGluValAlaGlnAsnAspMetProGln-104
SEQ. ID. NO. 4794  107-AlaGlyThrAspSerSerThr-113
SEQ. ID. NO. 4795  127-MetGluAsnGlnAlaThrAspAlaGlyGluSerSerGlnProAlaAsnGlnProAspMetAlaAsnAlaAlaAspGlyMetGlnGlyAspAspProSerAlaGly-161
SEQ. ID. NO. 4796  182-AlaGlySerSerAspProIlePro-189
SEQ. ID. NO. 4797  225-CysLysGlyAspSerCysSer-231
SEQ. ID. NO. 4798  235-PheLeuAspGluGluValGlnLeuLysSerGluPheGluLysLeuSerAspAlaAspLysIleSerAsnTyrLysLysAspGlyLysAsnAspLysPhe-267
SEQ. ID. NO. 4799  295-AlaArgPheArgArgSerAlaArgSerArgArgSerLeuPro-308
SEQ. ID. NO. 4800  322-LeuIleValAspGlyGluAla-328
SEQ. ID. NO. 4801  351-GlyAlaGluLysLeuPro-356
SEQ. ID. NO. 4802  364-ValGlnGlyGluProAlaLysGlyGluMet-373
SEQ. ID. NO. 4803  390-GluAsnGlyArgProTyrProThrArgGlyArgPheAlaAla-403
SEQ. ID. NO. 4804  405-ValAspPheGlySerLysSerValAspGlyIleIleAspSerGlyAspAspLeuHis-423
SEQ. ID. NO. 4805  427-GlnLysPheLysAlaAlaIleAsp-434
SEQ. ID. NO. 4806  446-GlySerGlyAspValSerGly-452
SEQ. ID. NO. 4807  458-AlaGlyGluGluValAlaGly-464
SEQ. ID. NO. 4808  466-TyrSerTyrArgProThrAspAlaGluLysGlyGly-477
SEQ. ID. NO. 4809  482-AlaGlyLysLysGluGlnAsp-488
288
AMPHI Regions - AMPHI
SEQ. ID. NO. 4810  7-ValSerArgValLeu-11
SEQ. ID. NO. 4811  54-IleValThrLysCysAla-59
SEQ. ID. NO. 4812  61-ArgProTyrArgThrPheSerProLeuProVal-71
SEQ. ID. NO. 4813  97-HisSerThrLeuArg-101
SEQ. ID. NO. 4814  150-AlaLeuPheGlnAlaGlyPheAsp-157
Antigenic Index - Jameson-Wolf
SEQ. ID. NO. 4815  2-HisThrGlyGlnAla-6
SEQ. ID. NO. 4816  28-AsnLeuProGluArgSerAlaGlySer-36
SEQ. ID. NO. 4817  58-CysAlaValArgProTyrArgThrPheSerPro-68
SEQ. ID. NO. 4818  72-LeuProLysGlnProSerAla-78
SEQ. ID. NO. 4819  89-LeuProArgProAlaValAsnArgHisSerThrLeuArgSerProAspPheProProArgMet-109
SEQ. ID. NO. 4820  113-IleArgGlyAspCysLeuAsp-119
SEQ. ID. NO. 4821  126-IleIleThrArgAsnThrLysMetProSerGluThrValGlnValSerAspGlyIleGlnProLys-147
SEQ. ID. NO. 4822  155-GlyPheAspGluAlaVal-160
Hydrophilic Regions - Hopp-Woods
SEQ. ID. NO. 4823  28-AsnLeuProGluArgSerAla-34
SEQ. ID. NO. 4824  58-CysAlaValArgPro-62
SEQ. ID. NO. 4825  98-SerThrLeuArgSerProAspPheProPro-107
SEQ. ID. NO. 4826  113-IleArgGlyAspCys-117
SEQ. ID. NO. 4827  126-IleIleThrArgAsnThrLysMetProSerGluThrValGlnVal-140
SEQ. ID. NO. 4828  155-GlyPheAspGluAlaVal-160
292
AMPHI Regions - AMPHI
SEQ. ID. NO. 4829  7-LysIleLeuThrProPheThrValLeuProLeu-17
SEQ. ID. NO. 4830  40-GlyLysSerValAla-44
SEQ. ID. NO. 4831  62-ValLeuSerValSerGlu-67
SEQ. ID. NO. 4832  69-ProValLysGlyIleTyrGlu-75
SEQ. ID. NO. 4833  110-GluArgAlaAlaAspLeu-115
SEQ. ID. NO. 4834  124-ProLeuAspLysAlaIleLysGluValArgGly-134
SEQ. ID. NO. 4835  150-PheCysLysArgLeuGluHisGluPheGluLysMetThrAspValThr-165
SEQ. ID. NO. 4836  195-LysAlaTrpThrAspTrpMetArg-202
SEQ. ID. NO. 4837  212-IleCysAspAsnProVal-217
Antigenic Index - Jameson-Wolf
SEQ. ID. NO. 4838  1-MetLysThrLysLeu-5
SEQ. ID. NO. 4839  23-ThrProValSerAsnAlaAsnAlaGluProAlaValLysAlaGluSerAlaGlyLysSerVal-43
SEQ. ID. NO. 4840  47-LeuLysAlaArgLeuGluLysThrTyrSerAlaGlnAspLeuLys-61
SEQ. ID. NO. 4841  66-SerGluThrProValLysGlyIle-73
SEQ. ID. NO. 4842  85-TyrThrAspAlaGluGlyGlyTyr-92
SEQ. ID. NO. 4843  99-IleAsnIleAspThrArgLysAsnLeuThrGluGluArgAlaAlaAspLeuAsnLys-117
SEQ. ID. NO. 4844  124-ProLeuAspLysAlaIleLysGluValArgGlyAsnGlyLysLeuLysVal-140
SEQ. ID. NO. 4845  142-ValPheSerAspProAspCysProPhe-150
SEQ. ID. NO. 4846  152-LysArgLeuGluHisGluPheGluLysMetThrAsp-163
SEQ. ID. NO. 4847  177-HisProAspAlaAlaArgLysAla-184
SEQ. ID. NO. 4848  189-CysGlnProAspArgAlaLysAla-196
SEQ. ID. NO. 4849  200-TrpMetArgLysGlyLysPheProVal-208
SEQ. ID. NO. 4850  210-GlySerIleCysAspAsnProValAlaGluThrThrSerLeuGlyGlu-225
SEQ. ID. NO. 4851  237-PheProAsnGlyArgSerGlnSerGlyTyrSerPro-248
SEQ. ID. NO. 4852  250-ProGlnLeuGluGluIleIleArgLysAsnGln-260
Hydrophilic Regions - Hopp-Woods
SEQ. ID. NO. 4853  1-MetLysThrLysLeu-5
SEQ. ID. NO. 4854  28-AlaAsnAlaGluProAlaValLysAlaGluSerAlaGlyLysSerVal-43
SEQ. ID. NO. 4855  47-LeuLysAlaArgLeuGluLysThrTyrSer-56
SEQ. ID. NO. 4856  99-IleAsnIleAspThrArgLysAsnLeuThrGluGluArgAlaAlaAspLeuAsnLys-117

TABLE 1-continued

| | |
|---|---|
| SEQ. ID. NO. 4857 | 124-ProLeuAspLysAlaIleLysGluValArgGlyAsnGlyLysLeuLys-139 |
| SEQ. ID. NO. 4858 | 144-SerAspProAspCysProPhe-150 |
| SEQ. ID. NO. 4859 | 152-LysArgLeuGluHisGluPheGluLysMetThrAsp-163 |
| SEQ. ID. NO. 4860 | 179-AspAlaAlaArgLysAla-184 |
| SEQ. ID. NO. 4861 | 190-GlnProAspAlaLysAla-196 |
| SEQ. ID. NO. 4862 | 200-TrpMetArgLysGlyLysPhe-206 |
| SEQ. ID. NO. 4863 | 240-GlyArgSerGlnSer-244 |
| SEQ. ID. NO. 4864 | 250-ProGlnLeuGluGluIleIleArgLysAsnGln-260 |

294
AMPHI Regions - AMPHI

| | |
|---|---|
| SEQ. ID. NO. 4865 | 27-ArgPheProAlaAlaPheArgArgTyrSerAla-37 |
| SEQ. ID. NO. 4866 | 45-LysProAlaAspThr-49 |
| SEQ. ID. NO. 4867 | 51-TrpHisArgValArgArgPheLysSerAsnArgArgMetArgGlyGlyLysProLeuLysLysProTyrArg-74 |
| SEQ. ID. NO. 4868 | 84-ArgAlaTrpThrAlaLeuSerHisAsnIleAlaGluArgAlaArgGluSerProArgArgCysGlyLysArgTyrAlaAspIleGlyGly-113 |
| SEQ. ID. NO. 4869 | 132-TyrAlaValAlaHisIleValHisLeu-140 |
| SEQ. ID. NO. 4870 | 165-ValSerArgGluAlaArgArgGluVal-173 |
| SEQ. ID. NO. 4871 | 176-AlaMetSerTyrArg-180 |
| SEQ. ID. NO. 4872 | 206-SerIleLeuGlyGluProPheAlaThrSerPheGly-217 |
| SEQ. ID. NO. 4873 | 227-AlaPheSerValLeuAlaHisPhe-234 |
| SEQ. ID. NO. 4874 | 247-ThrValGlyTrpSerLysTyrIleHisAlaVal-257 |

Antigenic Index - Jameson-Wolf

| | |
|---|---|
| SEQ. ID. NO. 4875 | 20-ValValArgThrSerSerAsnArgPhe-28 |
| SEQ. ID. NO. 4876 | 32-PheArgArgTyrSerAlaPhe-38 |
| SEQ. ID. NO. 4877 | 43-PheProLysProAlaAspThrProTrpHisArgValArgArgPheLysSerAsnArgArgMetArgGlyGlyLysProLeuLysLysProTyrArgProArgGlyGlyGlyCysArgCysArgArgAla-85 |
| SEQ. ID. NO. 4878 | 93-IleAlaGluArgAlaArgGluSerProArgArgCysGlyLysArgTyrAlaAspIleGlyGlyAspSerAspThrIleArgIleArgValPheArgLeuGluHisArgMet-129 |
| SEQ. ID. NO. 4879 | 161-HisThrGlyArgValSerArgGluAlaArgArgGluValGluLysAlaMetSer-178 |
| SEQ. ID. NO. 4880 | 240-LysMetAlaArgSer-244 |

Hydrophilic Regions - Hopp-Woods

| | |
|---|---|
| SEQ. ID. NO. 4881 | 20-ValValArgThrSerSerAsnArg-27 |
| SEQ. ID. NO. 4882 | 50-ProTrpHisArgValArgArgPheLysSerAsnArgArgMetArgGlyGlyLysProLeuLysLysProTyrArgProArgGlyGlyGlyCysArgCysArgArgAla-85 |
| SEQ. ID. NO. 4883 | 93-IleAlaGluArgAlaArgGluSerProArgArgCysGlyLysArgTyrAlaAspIleGlyGlyAspSerAspThrIleArg-119 |
| SEQ. ID. NO. 4884 | 121-ArgValPheArgLeuGluHisArgMet-129 |
| SEQ. ID. NO. 4885 | 164-ArgValSerArgGluAlaArgArgGluValGluLysAlaMetSer-178 |

295
AMPHI Regions - AMPHI

| | |
|---|---|
| SEQ. ID. NO. 4886 | 79-PheArgGlnProArgArgIle-85 |
| SEQ. ID. NO. 4887 | 111-ValGlnArgPhePheArgGlnPro-118 |
| SEQ. ID. NO. 4888 | 163-ValIleArgLysIleAlaAlaLeu-170 |
| SEQ. ID. NO. 4889 | 189-HisGlnGlnArgArgIleGlyLysThr-197 |
| SEQ. ID. NO. 4890 | 240-IleCysArgGlyThrSerGly-246 |
| SEQ. ID. NO. 4891 | 263-TyrIleIleLysProLeuGluHis-270 |

Antigenic Index - Jameson-Wolf

| | |
|---|---|
| SEQ. ID. NO. 4892 | 4-MetAlaArgHisAspAspGlnGlnArg-12 |
| SEQ. ID. NO. 4893 | 18-LeuProArgArgGlnGln-23 |
| SEQ. ID. NO. 4894 | 36-AlaAlaAlaHisGlyAsnArgProAlaSerAspAlaPhePheLysLeuProArgGlnArgPheHisLeu-58 |
| SEQ. ID. NO. 4895 | 73-HisGlyCysArgAlaGlnPheArgGlnProArgArgIleArgLeu-87 |
| SEQ. ID. NO. 4896 | 89-LeuArgGlnThrProArgGlnArgSerGlyGlyArgThrAspGlnAlaAla-105 |
| SEQ. ID. NO. 4897 | 115-PheArgGlnProArgIleArgGlnLysGlnArgHisThrArgAlaProAla-131 |
| SEQ. ID. NO. 4898 | 136-ValGlyProAspPheGly-141 |
| SEQ. ID. NO. 4899 | 144-GlnAsnAlaGluHisArgAla-150 |
| SEQ. ID. NO. 4900 | 171-ArgIleGlyLysGlnAsnLeuArgGlyPheProProArgArgGlyHisLeuArgHisGlnGlnArgArgIleGlyLysThrProProGlnLeuAla-202 |
| SEQ. ID. NO. 4901 | 207-GlyGlyThrArgPheSerAspArgAsnGlyValTyrProAsnArgAlaGlyAsnGlyIleArgIleArgLeu-230 |
| SEQ. ID. NO. 4902 | 239-ProIleCysArgGlyThrSerGly-246 |
| SEQ. ID. NO. 4903 | 253-ProTyrProTyrArgArgLysGlnProGlnTyr-263 |
| SEQ. ID. NO. 4904 | 273-IleSerCysLysThrAsnAla-279 |
| SEQ. ID. NO. 4905 | 287-PheArgGlnArgAsnGlnIleSer-294 |

Hydrophilic Regions - Hopp-Woods

| | |
|---|---|
| SEQ. ID. NO. 4906 | 5-AlaArgHisAspAspGlnGlnArg-12 |
| SEQ. ID. NO. 4907 | 18-LeuProArgArgGlnGln-23 |
| SEQ. ID. NO. 4908 | 36-AlaAlaAlaHisGlyAsnArgProAlaSer-45 |
| SEQ. ID. NO. 4909 | 77-AlaGlnPheArgGlnProArgArgIleArgLeu-87 |
| SEQ. ID. NO. 4910 | 91-GlnThrProArgGlnArgSerGlyGlyArgThrAspGlnAlaAla-105 |
| SEQ. ID. NO. 4911 | 118-ProArgIleArgGlnLysGlnArgHisThrArg-128 |
| SEQ. ID. NO. 4912 | 146-AlaGluHisArgAla-150 |
| SEQ. ID. NO. 4913 | 171-ArgIleGlyLysGlnAsnLeu-177 |
| SEQ. ID. NO. 4914 | 180-PheProProArgArgGlyHisLeuArgHisGlnGlnArgArgIleGlyLysThrProPro-199 |
| SEQ. ID. NO. 4915 | 210-ArgPheSerAspArgAsnGly-216 |
| SEQ. ID. NO. 4916 | 226-IleArgIleArgLeu-230 |
| SEQ. ID. NO. 4917 | 239-ProIleCysArgGlyThr-244 |
| SEQ. ID. NO. 4918 | 255-ProTyrArgArgLysGlnPro-261 |
| SEQ. ID. NO. 4919 | 287-PheArgGlnArgAsnGlnIle-293 |

297
AMPHI Regions - AMPHI

| | |
|---|---|
| SEQ. ID. NO. 4920 | 35-ArgThrGluArgVal-39 |
| SEQ. ID. NO. 4921 | 69-GlnProGlyAspSerLeuAlaAspValLeuAla-79 |
| SEQ. ID. NO. 4922 | 86-AspGluIleAlaArgIleThrGluLysTyr-95 |
| SEQ. ID. NO. 4923 | 157-LeuProThrLeuArg-161 |

TABLE 1-continued

| | |
|---|---|
| SEQ. ID. NO. 4924 | 199-LeuLysGluGlyAspAla-204 |
| SEQ. ID. NO. 4925 | 272-LeuValTyrThrArgIleSerSer-279 |
| SEQ. ID. NO. 4926 | 333-HisAlaAsnGlyValGluThrLeuTyrAlaHisLeuSerAlaPheSer-348 |
| Antigenic Index - Jameson-Wolf | |
| SEQ. ID. NO. 4927 | 8-AlaLysHisArgLysTyrAla-14 |
| SEQ. ID. NO. 4928 | 32-SerThrGluArgThrGluArgValArgProGlnArgValGluGlnAsnLeuProProLeuSerTrpGlyGlySerGly-57 |
| SEQ. ID. NO. 4929 | 67-AlaValGlnProGlyAspSerLeuAla-75 |
| SEQ. ID. NO. 4930 | 78-LeuAlaArgSerGlyMetAlaArgAspGluIleAlaArgIleThrGluLysTyrGlyGlyGluAlaAspLeuArgHisLeuArgAlaAspGlnSerVal-110 |
| SEQ. ID. NO. 4931 | 115-GlyGlyAspGlyGlyAlaArgGluVal-123 |
| SEQ. ID. NO. 4932 | 127-ThrAspGluAspGlyGluArgAsnLeuValAlaLeuGluLysLysGlyGlyIleTrpArgArgSerAlaSerGluAlaAspMetLysVal-156 |
| SEQ. ID. NO. 4933 | 167-ThrSerAlaArgGlySerLeuAlaArgAlaGluValProValGluIleArgGluSerLeuSer-187 |
| SEQ. ID. NO. 4934 | 194-PheSerLeuAspGlyLeuLysGluGlyAspAlaVal-205 |
| SEQ. ID. NO. 4935 | 228-GluValValLysGlyGlyThrArgHis-236 |
| SEQ. ID. NO. 4936 | 240-TyrTyrArgSerAspLysGluGlyGlyGlyGlyGlyAsnTyrTyrAspGluAspGlyLysValLeuGlnGluLysGlyGlyPheAsn-268 |
| SEQ. ID. NO. 4937 | 276-ArgIleSerSerProPheGlyTyr-283 |
| SEQ. ID. NO. 4938 | 295-HisThrGlyIleAspTyrAla-301 |
| SEQ. ID. NO. 4939 | 303-ProGlnGlyThrProValArgAlaSerAlaAspGly-314 |
| SEQ. ID. NO. 4940 | 318-PheLysGlyArgLysGlyGlyTyrGly-326 |
| SEQ. ID. NO. 4941 | 333-HisAlaAsnGlyValGlu-338 |
| SEQ. ID. NO. 4942 | 350-AlaGluGlyAsnValArgGlyGlyGlu-358 |
| SEQ. ID. NO. 4943 | 365-SerThrGlyArgSerThrGlyProHisLeu-374 |
| SEQ. ID. NO. 4944 | 376-TyrGluAlaArgIleAsnGlyGlnProValAsn-386 |
| SEQ. ID. NO. 4945 | 393-ProThrProGluLeuThrGlnAlaAspLysAlaAla-404 |
| SEQ. ID. NO. 4946 | 408-GlnLysGlnLysAlaAspAlaLeu-415 |
| SEQ. ID. NO. 4947 | 426-ValSerGlnSerAsp-430 |
| Hydrophilic Regions - Hopp-Woods | |
| SEQ. ID. NO. 4948 | 8-AlaLysHisArgLysTyrAla-14 |
| SEQ. ID. NO. 4949 | 32-SerThrGluArgThrGluArgValArgProGlnArgValGluGlnAsn-47 |
| SEQ. ID. NO. 4950 | 68-ValGlnProGlyAspSerLeuAla-75 |
| SEQ. ID. NO. 4951 | 82-GlyMetAlaArgAspGluIleAlaArgIleThrGluLysTyrGlyGlyGluAlaAspLeuArgHisLeuArgAlaAspGln-108 |
| SEQ. ID. NO. 4952 | 117-AspGlyGlyAlaArgGlu-122 |
| SEQ. ID. NO. 4953 | 127-ThrAspGluAspGlyGluArgAsnLeuValAlaLeuGluLysLysGlyGlyIleTrpArgArgSerAlaSerGluAlaAspMetLysVal-156 |
| SEQ. ID. NO. 4954 | 167-ThrSerAlaArgGlySerLeuAlaArgAlaGluValProValGluIleArgGluSerLeu-186 |
| SEQ. ID. NO. 4955 | 194-PheSerLeuAspGlyLeuLysGluGlyAspAlaVal-205 |
| SEQ. ID. NO. 4956 | 228-GluValValLysGlyGlyThrArg-235 |
| SEQ. ID. NO. 4957 | 242-ArgSerAspLysGluGlyGlyGlyGly-249 |
| SEQ. ID. NO. 4958 | 253-TyrTyrAspGluAspGlyLysValLeuGlnGluLysGlyGlyPhe-267 |
| SEQ. ID. NO. 4959 | 306-ThrProValArgAlaSerAla-312 |
| SEQ. ID. NO. 4960 | 319-LysGlyArgLysGlyGlyTyr-325 |
| SEQ. ID. NO. 4961 | 350-AlaGluGlyAsnValArgGlyGlyGlu-358 |
| SEQ. ID. NO. 4962 | 366-ThrGlyArgSerThrGly-371 |
| SEQ. ID. NO. 4963 | 378-AlaArgIleAsnGly-382 |
| SEQ. ID. NO. 4964 | 396-GluLeuThrGlnAlaAspLysAlaAla-404 |
| SEQ. ID. NO. 4965 | 408-GlnLysGlnLysAlaAspAlaLeu-415 |
| 298 | |
| AMPHI Regions - AMPHI | |
| SEQ. ID. NO. 4966 | 6-SerLeuPheSerSerIle-11 |
| SEQ. ID. NO. 4967 | 13-MetSerAlaLeuIleAla-18 |
| SEQ. ID. NO. 4968 | 26-IleAsnAlaTyrTrpGlnGln-32 |
| SEQ. ID. NO. 4969 | 42-ProLeuAlaAlaTyr-46 |
| SEQ. ID. NO. 4970 | 62-LeuSerAspGlyIleLysAlaPhe-69 |
| SEQ. ID. NO. 4971 | 82-GlySerAlaAspMetProSerGlu-89 |
| SEQ. ID. NO. 4972 | 126-LeuMetGlnGlyValAla-131 |
| SEQ. ID. NO. 4973 | 134-ValGlnLysSerLeuLys-139 |
| SEQ. ID. NO. 4974 | 157-SerTyrProSerPhePheAspTrpProLysThrIleGluGluThrLeuGlnLysHisProGluIleSer-179 |
| SEQ. ID. NO. 4975 | 188-AsnAspProTrpAspPhe-193 |
| SEQ. ID. NO. 4976 | 208-AlaGlnGluTyrLeuLysArgValAspArgIleLeuGlu-220 |
| SEQ. ID. NO. 4977 | 245-GlnMetArgTyrLeuAspLysLeuLeuSerGluHisLeu-257 |
| SEQ. ID. NO. 4978 | 276-ArgTyrThrAspSer-280 |
| SEQ. ID. NO. 4979 | 308-AlaLysIleMetGluLys-313 |
| Antigenic Index - Jameson-Wolf | |
| SEQ. ID. NO. 4980 | 22-SerGlnAsnProIleAsnAlaTyr-29 |
| SEQ. ID. NO. 4981 | 34-TyrHisArgAsnSerProLeuGluPro-42 |
| SEQ. ID. NO. 4982 | 47-GlyTrpTrpArgSerGlyAlaAlaLeuGlnGlu-57 |
| SEQ. ID. NO. 4983 | 70-LeuSerGlyGluThrProProThrAlaGlnAspGlyGlySerAlaAspMetProSerGluAlaAlaAla-92 |
| SEQ. ID. NO. 4984 | 94-GluAlaValProGlnThrGlyGluThrGluTrpLysGlnAspThrGluAlaAlaAlaValArgSerGlyAspLysValPhe-120 |
| SEQ. ID. NO. 4985 | 136-LysSerLeuLysGlnGlnTyrGlyIleGluSerValAsnLeuSerLysGlnSerThrGly-155 |
| SEQ. ID. NO. 4986 | 162-PheAspTrpProLysThrIleGluGluThrLeuGlnLysHisProGlu-177 |
| SEQ. ID. NO. 4987 | 186-GlyProAsnAspProTrpAspPheProVal-195 |
| SEQ. ID. NO. 4988 | 203-AlaSerAspGluTrpAla-208 |
| SEQ. ID. NO. 4989 | 211-TyrLeuLysArgValAspArgIleLeuGlu-220 |
| SEQ. ID. NO. 4990 | 236-TyrMetLysLysAlaLysLeuAspGlyGlnMetArgTyrLeuAsp-250 |
| SEQ. ID. NO. 4991 | 252-LeuLeuSerGluHisLeuLysGly-259 |
| SEQ. ID. NO. 4992 | 270-LeuSerGlyGlyLysAspArgTyrThrAspSerValAsnValAsnGlyLysProValArgTyrArgSerLysAspGlyIle-296 |
| SEQ. ID. NO. 4993 | 318-ProSerThrGlnProSerSerThrGlnPro-327 |
| Hydrophilic Regions - Hopp-Woods | |
| SEQ. ID. NO. 4994 | 73-GluThrProProThrAlaGlnAspGlyGlySerAlaAspMetProSerGluAlaAlaAla-92 |
| SEQ. ID. NO. 4995 | 94-GluAlaValProGlnThrGlyGluThrGluTrpLysGlnAspThrGluAlaAlaAlaValArgSerGlyAsp-117 |
| SEQ. ID. NO. 4996 | 148-AsnLeuSerLysGlnSerThr-154 |
| SEQ. ID. NO. 4997 | 166-LysThrIleGluGluThrLeuGlnLysHisProGlu-177 |

TABLE 1-continued

| | |
|---|---|
| SEQ. ID. NO. 4998 | 211-TyrLeuLysArgValAspArgIleLeuGlu-220 |
| SEQ. ID. NO. 4999 | 236-TyrMetLysLysAlaLysLeuAspGlyGlnMetArgTyrLeuAsp-250 |
| SEQ. ID. NO. 5000 | 252-LeuLeuSerGluHisLeuLysGly-259 |
| SEQ. ID. NO. 5001 | 271-SerGlyGlyLysAspArgTyrThrAsp-279 |
| SEQ. ID. NO. 5002 | 281-ValAsnValAsnGlyLysProValArgTyrArgSerLysAspGlyIle-296 |
| SEQ. ID. NO. 5003 | 319-SerThrGlnProSerSerThrGlnPro-327 |

299
AMPHI Regions - AMPHI

| | |
|---|---|
| SEQ. ID. NO. 5004 | 54-AlaSerProTrpMetLysLysLeuGlnSerValAlaGlnGlySer-68 |
| SEQ. ID. NO. 5005 | 71-ThrPheArgIleLeuGlnIleGly-78 |
| SEQ. ID. NO. 5006 | 85-AspPhePheThrAspSerLeuArgLysArgLeuGlnLysThrTrpGly-100 |
| SEQ. ID. NO. 5007 | 238-GlnLeuThrGlnTrpSerLysTrp-245 |
| SEQ. ID. NO. 5008 | 247-AlaAspArgMetAsnAspLeuAlaGlnThr-256 |
| SEQ. ID. NO. 5009 | 281-GluGlnLysTrpLeuAspThrValArgGlnIleArgAspSerLeu-295 |
| SEQ. ID. NO. 5010 | 307-GluSerLeuLysAsnThrLeu-313 |
| SEQ. ID. NO. 5011 | 322-ArgLeuThrGluValGlnGlnMetGlnArgArgValAlaArgGln-336 |
| SEQ. ID. NO. 5012 | 344-TrpGlnAsnAlaMetGly-349 |
| SEQ. ID. NO. 5013 | 374-GlyTyrArgArgAlaAlaGluMetLeuAlaAspSerLeuGluGluLeuValArgSerAlaAlaIleArg-396 |

Antigenic Index - Jameson-Wolf

| | |
|---|---|
| SEQ. ID. NO. 5014 | 1-MetAsnProLysHis-5 |
| SEQ. ID. NO. 5015 | 35-ProSerAlaProTyrThrAspThrAsnGlyLeu-45 |
| SEQ. ID. NO. 5016 | 48-AspTyrGlyAsnAlaSerAlaSerProTrpMetLysLysLeuGln-62 |
| SEQ. ID. NO. 5017 | 65-AlaGlnGlySerGlyGluThr-71 |
| SEQ. ID. NO. 5018 | 78-GlyAspSerHisThrAlaGlyAspPhePheThrAspSerLeuArgLysArgLeuGlnLysThrTrpGlyAspGlyGly-103 |
| SEQ. ID. NO. 5019 | 110-AlaAsnValLysGlyGlnArg-116 |
| SEQ. ID. NO. 5020 | 121-ArgHisAsnGlyAsnTrpGlnSerLeuThrSerArgAsnAsnThrGlyAspPheProLeu-140 |
| SEQ. ID. NO. 5021 | 157-AlaSerAspGlyIleAlaSerLysGlnArgVal-167 |
| SEQ. ID. NO. 5022 | 184-GlyAsnThrValSerAlaAsnGlyGlyGly-193 |
| SEQ. ID. NO. 5023 | 221-GluAsnProAlaGlyGly-226 |
| SEQ. ID. NO. 5024 | 241-GlnTrpSerLysTrpArgAlaAspArgMetAsnAspLeuAlaGlnThrGlyAla-258 |
| SEQ. ID. NO. 5025 | 266-GlyThrAsnGluAlaPheAsnAsnAsnIleAspIleAlaAspThrGluGlnLysTrp-284 |
| SEQ. ID. NO. 5026 | 286-AspThrValArgGlnIleArgAspSerLeuPro-296 |
| SEQ. ID. NO. 5027 | 305-AlaProGluSerLeuLysAsnThr-312 |
| SEQ. ID. NO. 5028 | 319-ArgProValArgLeuThrGluValGlnGlnMetGlnArgArgValAlaArgGlnGlyGlnThr-339 |
| SEQ. ID. NO. 5029 | 361-GlyTrpAlaAlaLysAspGlyVal-368 |
| SEQ. ID. NO. 5030 | 370-PheSerAlaLysGlyTyrArgArgAlaAlaGluMetLeuAlaAspSerLeuGluGluLeuValArg-391 |
| SEQ. ID. NO. 5031 | 393-AlaAlaIleArgGln-397 |

Hydrophilic Regions - Hopp-Woods

| | |
|---|---|
| SEQ. ID. NO. 5032 | 67-GlySerGlyGluThr-71 |
| SEQ. ID. NO. 5033 | 90-SerLeuArgLysArgLeuGlnLysThrTrpGly-100 |
| SEQ. ID. NO. 5034 | 112-ValLysGlyGlnArg-116 |
| SEQ. ID. NO. 5035 | 130-ThrSerArgAsnAsnThrGly-136 |
| SEQ. ID. NO. 5036 | 159-AspGlyIleAlaSerLysGlnArgVal-167 |
| SEQ. ID. NO. 5037 | 245-TrpArgAlaAspArgMetAsnAsp-252 |
| SEQ. ID. NO. 5038 | 276-AspIleAlaAspThrGluGlnLysTrp-284 |
| SEQ. ID. NO. 5039 | 288-ValArgGlnIleArgAspSerLeuPro-296 |
| SEQ. ID. NO. 5040 | 319-ArgProValArgLeuThrGlu-325 |
| SEQ. ID. NO. 5041 | 327-GlnGlnMetGlnArgArgValAlaArgGlnGly-337 |
| SEQ. ID. NO. 5042 | 363-AlaAlaLysAspGlyVal-368 |
| SEQ. ID. NO. 5043 | 373-LysGlyTyrArgArgAlaAlaGluMetLeuAlaAspSerLeuGluGluLeuValArg-391 |
| SEQ. ID. NO. 5044 | 393-AlaAlaIleArgGln-397 |

302-2
AMPHI Regions - AMPHI

| | |
|---|---|
| SEQ. ID. NO. 5045 | 20-AspGlyArgPheLeuArgThrValGluTrpLeuGlyAsnMetLeuProHisPro-37 |
| SEQ. ID. NO. 5046 | 85-LeuAsnAlaAspGlyPheIleLysIleLeuThrHisThrValLysAsnPheThrGlyPheAlaProLeuGlyThrValLeuValSerLeu-114 |
| SEQ. ID. NO. 5047 | 127-SerAlaLeuMetArg-131 |
| SEQ. ID. NO. 5048 | 176-GlyArgHisProLeuAlaGlyLeuAlaAlaAlaPheAlaGlyValSerGly-192 |
| SEQ. ID. NO. 5049 | 201-GlyThrIleAspProLeuLeuAlaGlyIleThrGlnGlnAla-214 |
| SEQ. ID. NO. 5050 | 239-ValIleAlaLeuIleGly-244 |
| SEQ. ID. NO. 5051 | 271-ArgHisSerAsnGluIle-276 |
| SEQ. ID. NO. 5052 | 294-LeuSerAlaLeuLeuAlaTrp-300 |
| SEQ. ID. NO. 5053 | 308-IleLeuArgHisProGluThrGly-315 |
| SEQ. ID. NO. 5054 | 341-TyrGlyArgValThrArgSerLeuArgGlyGluGlnGluValValAsnAlaMetAlaGluSerMetSer-363 |
| SEQ. ID. NO. 5055 | 378-PheValAlaPhePheAsnTrpThrAsnIleGlyGlnTyrIle-391 |
| SEQ. ID. NO. 5056 | 448-AlaProGluValIleGlnAlaAlaTyrArgIleGlyAspSerValThrAsnIleIleThrProMetMetSerTyrPheGlyLeuIleMetAla-478 |
| SEQ. ID. NO. 5057 | 505-IleAlaTrpIleAlaLeuPheCysIle-513 |

Antigenic Index - Jameson-Wolf

| | |
|---|---|
| SEQ. ID. NO. 5058 | 8-LysGluLysGlnMetSerGlnThrAspThrGlnArgAspGlyArgPhe-23 |
| SEQ. ID. NO. 5059 | 61-SerValProAspProArgProValGlyAlaLysGlyArgAlaAspAspGlyLeu-78 |
| SEQ. ID. NO. 5060 | 119-IleAlaGluLysSerGly-124 |
| SEQ. ID. NO. 5061 | 134-LeuThrLysSerProArgLysLeuThr-142 |
| SEQ. ID. NO. 5062 | 152-LeuSerAsnThrAlaSerGly-158 |
| SEQ. ID. NO. 5063 | 175-LeuGlyArgHisProLeu-180 |
| SEQ. ID. NO. 5064 | 250-LysIleValGluProGlnLeuGlyProTyrGlnSerAspLeuSerGlnGluGluLysAspIleArgHisSerAsnGluIleThrProLeuGluTyrLys-282 |
| SEQ. ID. NO. 5065 | 304-ProAlaAspGlyIleLeuArgHisProGluThrGlyLeuValSer-318 |
| SEQ. ID. NO. 5066 | 343-ArgValThrArgSerLeuArgGlyGluGlnGluVal-354 |
| SEQ. ID. NO. 5067 | 402-ValGlyLeuGlyGly-406 |
| SEQ. ID. NO. 5068 | 482-LysTyrLysLysAspAlaGlyVal-489 |

Hydrophilic Regions - Hopp-Woods

| | |
|---|---|
| SEQ. ID. NO. 5069 | 8-LysGluLysGlnMetSerGlnThrAspThrGlnArgAspGlyArgPhe-23 |

TABLE 1-continued

| | |
|---|---|
| SEQ. ID. NO. 5070 | 63-ProAspProArgProValGlyAlaLysGlyArgAlaAspAsp-76 |
| SEQ. ID. NO. 5071 | 119-IleAlaGluLysSerGly-124 |
| SEQ. ID. NO. 5072 | 136-LysSerProArgLysLeu-141 |
| SEQ. ID. NO. 5073 | 263-LeuSerGlnGluGluLysAspIleArgHisSerAsnGlu-275 |
| SEQ. ID. NO. 5074 | 307-GlyIleLeuArgHisProGlu-313 |
| SEQ. ID. NO. 5075 | 343-ArgValThrArgSerLeuArgGlyGluGlnGluVal-354 |
| SEQ. ID. NO. 5076 | 482-LysTyrLysLysAspAlaGly-488 |

305-2
AMPHI Regions - AMPHI

| | |
|---|---|
| SEQ. ID. NO. 5077 | 10-LeuMetMetGlyLeuValGluGlyPheThrGluPheLeuPro-23 |
| SEQ. ID. NO. 5078 | 33-PheGlyAsnLeuIleGly-38 |
| SEQ. ID. NO. 5079 | 66-PheSerAsnValLeuHis-71 |
| SEQ. ID. NO. 5080 | 93-AlaAlaValMetGly-97 |
| SEQ. ID. NO. 5081 | 99-LeuPheGlyLysGlnIleLysGluTyrLeuPhe-109 |
| SEQ. ID. NO. 5082 | 141-AspValAspAlaLeuArgProIleAspAla-150 |
| SEQ. ID. NO. 5083 | 155-ValAlaGlnValPheAla-160 |
| SEQ. ID. NO. 5084 | 202-AlaTyrAspValLeuLysHisTyrArgPhePheThrLeuHis-215 |
| SEQ. ID. NO. 5085 | 222-IleGlyPheIleAlaAlaPheValSer-230 |
| SEQ. ID. NO. 5086 | 235-ValLysAlaLeuLeuArg-240 |

Antigenic Index - Jameson-Wolf

| | |
|---|---|
| SEQ. ID. NO. 5087 | 41-SerAsnHisLysValPhe-469 |
| SEQ. ID. NO. 5088 | 61-GluTyrArgGlnArgPheSerAsn-68 |
| SEQ. ID. NO. 5089 | 72-GlyLeuGlyLysAspArgLysAlaAsn-80 |
| SEQ. ID. NO. 5090 | 128-ValGluLysArgGlnSerArgAlaGluProLysIleAlaAsp-141 |
| SEQ. ID. NO. 5091 | 143-AspAlaLeuArgProIleAsp-149 |
| SEQ. ID. NO. 5092 | 163-ProGlyThrSerArgSerGlySer-170 |
| SEQ. ID. NO. 5093 | 180-IleGluArgLysThrAlaThr-186 |
| SEQ. ID. NO. 5094 | 241-PheValSerLysLysAsnTyr-247 |

Hydrophilic Regions - Hopp-Woods

| | |
|---|---|
| SEQ. ID. NO. 5095 | 62-TyrArgGlnArgPhe-66 |
| SEQ. ID. NO. 5096 | 73-LeuGlyLysAspArgLysAlaAsn-80 |
| SEQ. ID. NO. 5097 | 128-ValGluLysArgGlnSerArgAlaGluProLysIleAlaAsp-141 |
| SEQ. ID. NO. 5098 | 143-AspAlaLeuArgProIleAsp-149 |
| SEQ. ID. NO. 5099 | 165-ThrSerArgSerGlySer-170 |
| SEQ. ID. NO. 5100 | 180-IleGluArgLysThrAlaThr-186 |
| SEQ. ID. NO. 5101 | 242-ValSerLysLysAsn-246 |

308-1
AMPHI Regions - AMPHI

| | |
|---|---|
| SEQ. ID. NO. 5102 | 6-PheTyrArgIleLeuGlyValAla-13 |
| SEQ. ID. NO. 5103 | 15-AsnLeuTyrProArgLeu-20 |
| SEQ. ID. NO. 5104 | 27-ThrIleIleAlaGlyLeu-32 |
| SEQ. ID. NO. 5105 | 64-AlaLeuGluLeuLeuArgAlaGln-71 |
| SEQ. ID. NO. 5106 | 83-AlaGluMetAlaArgAlaSerGlu-90 |
| SEQ. ID. NO. 5107 | 101-LeuAlaAspPheValHisProIleGlyAsnIleGlyAlaCys-114 |
| SEQ. ID. NO. 5108 | 131-SerMetArgThrLeuAlaSerValAlaHisGlyPheGlyAsp-144 |
| SEQ. ID. NO. 5109 | 172-LeuAlaHisLeuAspAsnMetLysArgValThrGlu-183 |

Antigenic Index - Jameson-Wolf

| | |
|---|---|
| SEQ. ID. NO. 5110 | 16-LeuTyrProArgLeuSerAspPheCys-24 |
| SEQ. ID. NO. 5111 | 39-TrpGluArgArgMetMetVal-45 |
| SEQ. ID. NO. 5112 | 68-LeuArgAlaGlnAspValGluThr-75 |
| SEQ. ID. NO. 5113 | 80-SerLysGlyAlaGluMetAlaArgAlaSerGluThrAlaTyrAlaArgAspGluVal-98 |
| SEQ. ID. NO. 5114 | 118-GlyThrPheLysThrAspGlyMet-125 |
| SEQ. ID. NO. 5115 | 141-GlyPheGlyAspAsnLeuLeu-147 |
| SEQ. ID. NO. 5116 | 149-ArgAlaAlaAspValValLeuLysGluArgArgArgLeu-161 |
| SEQ. ID. NO. 5117 | 166-ArgGluThrProLeu-170 |
| SEQ. ID. NO. 5118 | 176-AspAsnMetLysArgValThrGluMetGly-185 |
| SEQ. ID. NO. 5119 | 195-MetTyrArgLysProGlnThrAlaAspAspIleVal-206 |
| SEQ. ID. NO. 5120 | 219-IleAspThrProAspSerAlaGlu-226 |

Hydrophilic Regions - Hopp-Woods

| | |
|---|---|
| SEQ. ID. NO. 5121 | 39-TrpGluArgArgMetMetVal-45 |
| SEQ. ID. NO. 5122 | 68-LeuArgAlaGlnAspValGluThr-75 |
| SEQ. ID. NO. 5123 | 81-LysGlyAlaGluMetAlaArgAlaSerGlu-90 |
| SEQ. ID. NO. 5124 | 92-AlaTyrAlaArgAspGluVal-98 |
| SEQ. ID. NO. 5125 | 120-PheLysThrAspGly-124 |
| SEQ. ID. NO. 5126 | 149-ArgAlaAlaAspValValLeuLysGluArgArgArgLeu-161 |
| SEQ. ID. NO. 5127 | 176-AspAsnMetLysArgValThrGlu-183 |
| SEQ. ID. NO. 5128 | 195-MetTyrArgLysProGlnThrAlaAspAspIleVal-206 |
| SEQ. ID. NO. 5129 | 220-AspThrProAspSerAlaGlu-226 |

311-1
AMPHI Regions - AMPHI

| | |
|---|---|
| SEQ. ID. NO. 5130 | 7-SerHisTrpArgValLeuAlaGluLeuAlaAspGlyLeuProGlnHisValSerGlnLeuAlaArgMetAlaAsp-31 |
| SEQ. ID. NO. 5131 | 37-LeuAsnGlyPheTrpGlnGlnMetProAlaHisIleArgGlyLeuLeuArg-53 |
| SEQ. ID. NO. 5132 | 55-HisAspGlyTyrTrpArgLeuValArgProLeuAlaValPheAspAlaGluGlyLeuArgGluLeuGly-77 |
| SEQ. ID. NO. 5133 | 124-ArgGlnGlyArgLysTrpSerHisArgLeu-133 |
| SEQ. ID. NO. 5134 | 165-ArgAlaLeuSerArg-169 |
| SEQ. ID. NO. 5135 | 219-ValGluAsnAlaAlaSerValGlnSerLeuPheGln-230 |
| SEQ. ID. NO. 5136 | 291-PheGluGlyThrValLysGlyValAspGlyGlnGlyVal-303 |
| SEQ. ID. NO. 5137 | 362-ThrValGlySerAlaProTyrArgAspLeuSerProLeu-374 |
| SEQ. ID. NO. 5138 | 391-CysAlaValCysGlyGluPheLysLys-399 |
| SEQ. ID. NO. 5139 | 426-TyrArgHisProGluGluHisGlySerAspArgTrpPheAsnAlaLeuGlySer-443 |

TABLE 1-continued

| | |
|---|---|
| SEQ. ID. NO. 5140 | 493-AsnLeuAsnArgHisAla-498 |
| SEQ. ID. NO. 5141 | 511-AlaValAlaSerGlyMetMetAspAlaValCys-521 |
| SEQ. ID. NO. 5142 | 550-AlaAlaLysValAlaGluAlaLeuProPro-559 |
| SEQ. ID. NO. 5143 | 576-TyrGlyLeuLeuAsnMet-581 |

Antigenic Index - Jameson-Wolf

| | |
|---|---|
| SEQ. ID. NO. 5144 | 28-ArgMetAlaAspMetLysProGlnGln-36 |
| SEQ. ID. NO. 5145 | 50-GlyLeuLeuArgGlnHisAspGlyTyr-58 |
| SEQ. ID. NO. 5146 | 71-GluGlyLeuArgGluLeuGlyGluArgSerGlyPhe-82 |
| SEQ. ID. NO. 5147 | 86-LeuLysHisGluCysAlaSerSerAsnAspGluIleLeuGlu-99 |
| SEQ. ID. NO. 5148 | 102-ArgIleAlaProAspLysAlaHisLys-110 |
| SEQ. ID. NO. 5149 | 116-HisLeuGlnSerLysGlyArgGlyArgGlnGlyArgLysTrpSerHisArgLeuGlyGlu-135 |
| SEQ. ID. NO. 5150 | 145-PheAspArgProGlnTyrGluLeuGlySer-154 |
| SEQ. ID. NO. 5151 | 162-AlaCysArgArgAlaLeuSer-168 |
| SEQ. ID. NO. 5152 | 182-LeuValValGlyArgAspLysLeuGly-190 |
| SEQ. ID. NO. 5153 | 196-ThrValArgThrGlyGlyLysThrVal-204 |
| SEQ. ID. NO. 5154 | 215-LeuProLysGluValGluAsn-221 |
| SEQ. ID. NO. 5155 | 231-ThrAlaSerArgArgGlyAsnAlaAsp-239 |
| SEQ. ID. NO. 5156 | 258-TyrAlaArgAspGlyPheAla-264 |
| SEQ. ID. NO. 5157 | 272-AlaAlaAsnArgAspHisGlyLys-279 |
| SEQ. ID. NO. 5158 | 284-LeuArgAspGlyGluThrValPhe-291 |
| SEQ. ID. NO. 5159 | 293-GlyThrValLysGlyValAspGlyGlnGly-302 |
| SEQ. ID. NO. 5160 | 307-GluThrAlaGluGlyLysGlnThrValValSerGlyGluIleSerLeuArgSerAspAspArgProValSerValProLysArgArgAspSerGluArg-339 |
| SEQ. ID. NO. 5161 | 344-AspGlyGlyAsnSerArgLeu-350 |
| SEQ. ID. NO. 5162 | 364-GlySerAlaProTyrArgAspLeuSerProLeuGly-375 |
| SEQ. ID. NO. 5163 | 378-TrpAlaGluLysAlaAspGlyAsnValArgIle-388 |
| SEQ. ID. NO. 5164 | 385-GlyGluPheLysLysAlaGlnValGln-403 |
| SEQ. ID. NO. 5165 | 405-GlnLeuAlaArgLysIleGlu-411 |
| SEQ. ID. NO. 5166 | 424-AsnHisTyrArgHisProGluGluHisGlySerAspArgTrp-437 |
| SEQ. ID. NO. 5167 | 440-AlaLeuGlySerArgArgPheSerArgAsnAla-450 |
| SEQ. ID. NO. 5168 | 464-AlaLeuThrAspAspGlyHisTyrLeuGly-473 |
| SEQ. ID. NO. 5169 | 483-MetLysGluSerLeuAla-488 |
| SEQ. ID. NO. 5170 | 492-AlaAsnLeuAsnArgHisAlaGlyLysArgTyrPro-503 |
| SEQ. ID. NO. 5171 | 529-GlyArgLeuLysGluLysThrGlyAlaGlyLysProVal-541 |
| SEQ. ID. NO. 5172 | 547-GlyGlyGlyAlaAlaLysValAlaGlu-555 |
| SEQ. ID. NO. 5173 | 565-AsnThrValArgValAlaAsp-571 |
| SEQ. ID. NO. 5174 | 584-AlaGluGlyArgGluTyrGluHis-591 |

Hydrophilic Regions - Hopp-Woods

| | |
|---|---|
| SEQ. ID. NO. 5175 | 28-ArgMetAlaAspMetLysProGlnGln-36 |
| SEQ. ID. NO. 5176 | 50-GlyLeuLeuArgGlnHis-55 |
| SEQ. ID. NO. 5177 | 71-GluGlyLeuArgGluLeuGlyGluArgSerGlyPhe-82 |
| SEQ. ID. NO. 5178 | 86-LeuLysHisGluCysAlaSerSerAsnAspGluIleLeuGlu-99 |
| SEQ. ID. NO. 5179 | 102-ArgIleAlaProAspLysAlaHisLys-110 |
| SEQ. ID. NO. 5180 | 118-GlnSerLysGlyArgGlyArgGlnGlyArgLysTrpSerHisArgLeuGlyGlu-135 |
| SEQ. ID. NO. 5181 | 162-AlaCysArgArgAlaLeuSer-168 |
| SEQ. ID. NO. 5182 | 183-ValValGlyArgAspLysLeuGly-190 |
| SEQ. ID. NO. 5183 | 196-ThrValArgThrGlyGlyLys-202 |
| SEQ. ID. NO. 5184 | 217-LysGluValGluAsn-221 |
| SEQ. ID. NO. 5185 | 232-AlaSerArgArgGlyAsnAlaAsp-239 |
| SEQ. ID. NO. 5186 | 259-AlaArgAspGlyPhe-263 |
| SEQ. ID. NO. 5187 | 272-AlaAlaAsnArgAspHisGlyLys-279 |
| SEQ. ID. NO. 5188 | 285-ArgAspGlyGluThrValPhe-291 |
| SEQ. ID. NO. 5189 | 293-GlyThrValLysGlyValAspGly-300 |
| SEQ. ID. NO. 5190 | 307-GluThrAlaGluGlyLysGlnThrValVal-316 |
| SEQ. ID. NO. 5191 | 320-IleSerLeuArgSerAspAspArgProValSerValProLysArgArgAspSerGluArg-339 |
| SEQ. ID. NO. 5192 | 346-GlyAsnSerArgLeu-350 |
| SEQ. ID. NO. 5193 | 367-ProTyrArgAspLeuSer-372 |
| SEQ. ID. NO. 5194 | 378-TrpAlaGluLysAlaAspGlyAsnVal-386 |
| SEQ. ID. NO. 5195 | 395-GlyGluPheLysLysAlaGlnVal-402 |
| SEQ. ID. NO. 5196 | 405-GlnLeuAlaArgLysIleGlu-411 |
| SEQ. ID. NO. 5197 | 424-AsnHisTyrArgHisProGluGluHisGlySer-434 |
| SEQ. ID. NO. 5198 | 442-GlySerArgArgPheSerArg-448 |
| SEQ. ID. NO. 5199 | 464-AlaLeuThrAspAspGlyHis-470 |
| SEQ. ID. NO. 5200 | 483-MetLysGluSerLeuAla-488 |
| SEQ. ID. NO. 5201 | 493-AsnLeuAsnArgHisAlaGlyLysArgTyrPro-503 |
| SEQ. ID. NO. 5202 | 529-GlyArgLeuLysGluLysThrGlyAlaGlyLysProVal-541 |
| SEQ. ID. NO. 5203 | 549-GlyAlaAlaLysValAlaGlu-555 |
| SEQ. ID. NO. 5204 | 565-AsnThrValArgValAlaAsp-571 |
| SEQ. ID. NO. 5205 | 584-AlaGluGlyArgGluTyrGluHis-591 |

312-2
AMPHIRegions - AMPHI

| | |
|---|---|
| SEQ. ID. NO. 5206 | 6-GlyGluIleLeuGluThrValLysMetValAla-16 |
| SEQ. ID. NO. 5207 | 33-AspCysIleSerSer-37 |
| SEQ. ID. NO. 5208 | 44-GlnAsnIleTyrAsnLysIleThrThrValGlyLys-55 |
| SEQ. ID. NO. 5209 | 82-IleAlaGlnIleAlaAlaAlaThr-89 |
| SEQ. ID. NO. 5210 | 95-ValSerValAlaGlnThrLeuAspLysAlaAlaLys-106 |
| SEQ. ID. NO. 5211 | 109-GlyValSerPheIleGlyGlyPheSerAlaLeuValGln-121 |
| SEQ. ID. NO. 5212 | 133-ArgSerIleProGluAlaMetLysThr-141 |
| SEQ. ID. NO. 5213 | 167-GlyGluThrValLysArgThrAla-174 |
| SEQ. ID. NO. 5214 | 182-GlyCysAlaLysIleValValPheCys-190 |
| SEQ. ID. NO. 5215 | 230-SerAspAlaThrThrLeuThrGluValAlaGluValValLysLys-244 |

TABLE 1-continued

| | |
|---|---|
| SEQ. ID. NO. 5216 | 249-IleThrArgValGlyGluLeuIleGlyArgGluAlaSerLys-262 |
| SEQ. ID. NO. 5217 | 281-ValGlyAspSerValAlaArgIleLeuGluGluMetGly-293 |
| SEQ. ID. NO. 5218 | 309-LeuAsnAspAlaVal-313 |
| SEQ. ID. NO. 5219 | 322-SerAlaValGlyGlyLeuSerGly-329 |
| SEQ. ID. NO. 5220 | 349-LeuThrLeuAspLysLeuGluAlaMetThrAla-359 |
| SEQ. ID. NO. 5221 | 374-ThrProAlaHisThrIleSerGlyIleIle-383 |
| SEQ. ID. NO. 5222 | 409-ValGlyAspSerValGluPheGlyGlyLeuLeuGly-420 |

Antigenic Index - Jameson-Wolf

| | |
|---|---|
| SEQ. ID. NO. 5223 | 4-GlnSerGlyGluIleLeuGlu-10 |
| SEQ. ID. NO. 5224 | 13-LysMetValAlaAspGlnAsnPheAspVal-22 |
| SEQ. ID. NO. 5225 | 35-IleSerSerAspIle-39 |
| SEQ. ID. NO. 5226 | 52-ThrValGlyLysAspLeuValThr-59 |
| SEQ. ID. NO. 5227 | 89-ThrHisAlaAspSer-93 |
| SEQ. ID. NO. 5228 | 100-ThrLeuAspLysAlaAlaLys-106 |
| SEQ. ID. NO. 5229 | 121-GlnLysGlyMetSerProSerAspGluValLeu-131 |
| SEQ. ID. NO. 5230 | 134-SerIleProGluAlaMetLysThrThrAsp-143 |
| SEQ. ID. NO. 5231 | 152-GlySerThrArgAla-156 |
| SEQ. ID. NO. 5232 | 161-AspAlaValLysLeuAlaGlyGluThrValLysArgThrAlaGluIleThrProGluGlyPheGly-182 |
| SEQ. ID. NO. 5233 | 192-AlaValGluAspAsnProPhe-198 |
| SEQ. ID. NO. 5234 | 204-HisGlySerGlyGluAlaAspAla-211 |
| SEQ. ID. NO. 5235 | 225-AlaAlaLeuGluAsnSerAspAla-232 |
| SEQ. ID. NO. 5236 | 237-GluValAlaGluValValLys-243 |
| SEQ. ID. NO. 5237 | 251-ArgValGlyGluLeuIleGlyArgGluAlaSerLys-262 |
| SEQ. ID. NO. 5238 | 280-AlaValGlyAspSerValAlaArgIleLeuGlu-290 |
| SEQ. ID. NO. 5239 | 311-AspAlaValLysLysGlyGlyMet-318 |
| SEQ. ID. NO. 5240 | 334-ValSerGluAspGluGlyMet-340 |
| SEQ. ID. NO. 5241 | 352-AspLysLeuGluAla-356 |
| SEQ. ID. NO. 5242 | 370-ValProGlyAspThrProAla-376 |
| SEQ. ID. NO. 5243 | 383-IleAlaAspGluAlaAla-388 |
| SEQ. ID. NO. 5244 | 392-IleAsnSerLysThrThrAla-398 |
| SEQ. ID. NO. 5245 | 405-ThrGlyLysThrValGlyAspSerValGlu-414 |
| SEQ. ID. NO. 5246 | 426-ProValLysGluGlySerCys-432 |
| SEQ. ID. NO. 5247 | 435-PheValAsnArgGlyGlyArgIle-442 |
| SEQ. ID. NO. 5248 | 447-GlnSerMetLysAsn-451 |

Hydrophilic Regions - Hopp-Woods

| | |
|---|---|
| SEQ. ID. NO. 5249 | 18-GlnAsnPheAspVal-22 |
| SEQ. ID. NO. 5250 | 52-ThrValGlyLysAspLeuValThr-59 |
| SEQ. ID. NO. 5251 | 100-ThrLeuAspLysAlaAlaLys-106 |
| SEQ. ID. NO. 5252 | 123-GlyMetSerProSerAspGluValLeu-131 |
| SEQ. ID. NO. 5253 | 134-SerIleProGluAlaMetLysThrThrAsp-143 |
| SEQ. ID. NO. 5254 | 161-AspAlaValLysLeuAlaGlyGluThrValLysArgThrAlaGluIleThrPro-178 |
| SEQ. ID. NO. 5255 | 192-AlaValGluAspAsnPro-197 |
| SEQ. ID. NO. 5256 | 207-GlyGluAlaAspAla-211 |
| SEQ. ID. NO. 5257 | 225-AlaAlaLeuGluAsnSerAspAla-232 |
| SEQ. ID. NO. 5258 | 237-GluValAlaGluValValLys-243 |
| SEQ. ID. NO. 5259 | 251-ArgValGlyGluLeuIleGlyArgGluAlaSerLys-262 |
| SEQ. ID. NO. 5260 | 284-SerValAlaArgIleLeuGlu-290 |
| SEQ. ID. NO. 5261 | 311-AspAlaValLysLysGlyGlyMet-318 |
| SEQ. ID. NO. 5262 | 334-ValSerGluAspGluGlyMet-340 |
| SEQ. ID. NO. 5263 | 352-AspLysLeuGluAla-356 |
| SEQ. ID. NO. 5264 | 383-IleAlaAspGluAlaAla-388 |
| SEQ. ID. NO. 5265 | 408-ThrValGlyAspSerValGlu-414 |
| SEQ. ID. NO. 5266 | 426-ProValLysGluGlySerCys-432 |
| SEQ. ID. NO. 5267 | 438-ArgGlyGlyArgIle-442 |
| SEQ. ID. NO. 5268 | 447-GlnSerMetLysAsn-451 |

313-2
AMPHI Regions - AMPHI

| | |
|---|---|
| SEQ. ID. NO. 5269 | 27-GlyMetAspAspProArgThrTyrGlySerGly-37 |
| SEQ. ID. NO. 5270 | 41-AlaThrAsnValLeu-45 |
| SEQ. ID. NO. 5271 | 60-AspAlaAlaLysGly-64 |
| SEQ. ID. NO. 5272 | 66-ValAlaValLeuLeuAlaArgValLeuGlnGluPro-77 |
| SEQ. ID. NO. 5273 | 88-ValAlaLeuAlaAlaLeuValGlyHisMetTrpPro-99 |
| SEQ. ID. NO. 5274 | 143-SerLeuAlaAlaLeuThrAlaThrIleAlaAlaProVal-155 |

Antigenic Index - Jameson-Wolf

| | |
|---|---|
| SEQ. ID. NO. 5275 | 26-TyrGlyMetAspAspProArgThrTyrGlySerGlyAsnProGlyAla-41 |
| SEQ. ID. NO. 5276 | 46-ArgSerGlyLysLysLysAlaAla-53 |
| SEQ. ID. NO. 5277 | 73-ValLeuGlnGluProLeuGlyLeuSerAspSerAla-84 |
| SEQ. ID. NO. 5278 | 104-PheLysGlyGlyLysGlyVal-110 |
| SEQ. ID. NO. 5279 | 181-HisLysSerAsnIle-185 |
| SEQ. ID. NO. 5280 | 189-LeuGluGlyArgGluSerLysIleGlyGlySerArg-200 |

Hydrophilic Regions - Hopp-Woods

| | |
|---|---|
| SEQ. ID. NO. 5281 | 26-TyrGlyMetAspAspProArgThrTyrGly-35 |
| SEQ. ID. NO. 5282 | 46-ArgSerGlyLysLysLysAlaAla-53 |
| SEQ. ID. NO. 5283 | 105-LysGlyGlyLysGlyVal-110 |
| SEQ. ID. NO. 5284 | 181-HisLysSerAsnIle-185 |
| SEQ. ID. NO. 5285 | 189-LeuGluGlyArgGluSerLysIleGlyGlySerArg-200 |

401
AMPHI Regions - AMPHI

| | |
|---|---|
| SEQ. ID. NO. 5286 | 46-ValLysProTyrAsnAlaLeu-52 |
| SEQ. ID. NO. 5287 | 65-CysTyrAsnCysHisSerGlnMetIleArgProPheArg-77 |

TABLE 1-continued

| | |
|---|---|
| SEQ. ID. NO. 5288 | 112-ValGlyGlyArgTyrSerAspGluTrpHisArgIle-123 |
| SEQ. ID. NO. 5289 | 157-MetLysAlaLeuArgLysValGlyThr-165 |
| SEQ. ID. NO. 5290 | 172-IleAlaLysAlaProGluAlaLeu-179 |

Antigenic Index - Jameson-Wolf

| | |
|---|---|
| SEQ. ID. NO. 5291 | 5-GlnLeuAlaGluGluLysIle-11 |
| SEQ. ID. NO. 5292 | 38-AlaAlaThrGlnProAlaProGlyValLysProTyrAsn-50 |
| SEQ. ID. NO. 5293 | 55-AlaGlyArgAspIleTyrIleArgGluGlyCysTyrAsnCysHis-69 |
| SEQ. ID. NO. 5294 | 74-ArgProPheArgAlaGluThrGluArgTyrGlyHis-85 |
| SEQ. ID. NO. 5295 | 90-GlyGluSerValTyr-94 |
| SEQ. ID. NO. 5296 | 98-PheGlnTrpGlySerLysArgThrGlyProAspLeuAlaArgValGlyGlyArgTyrSerAspGluTrpHis-121 |
| SEQ. ID. NO. 5297 | 125-LeuLeuAsnProArgAspValValProGluSerAsnMetPro-138 |
| SEQ. ID. NO. 5298 | 146-AsnLysValAspValAspAla-152 |
| SEQ. ID. NO. 5299 | 158-LysAlaLeuArgLysValGlyThrProTyrSerAspGluGluIleAlaLysAlaProGlu-177 |
| SEQ. ID. NO. 5300 | 179-LeuAlaAsnLysSerGluLeuAspAla-187 |

Hydrophilic Regions - Hopp-Woods

| | |
|---|---|
| SEQ. ID. NO. 5301 | 5-GlnLeuAlaGluGluLysIle-11 |
| SEQ. ID. NO. 5302 | 76-PheArgAlaGluThrGluArgTyrGly-84 |
| SEQ. ID. NO. 5303 | 101-GlySerLysArgThrGlyProAspLeuAlaArgValGlyGlyArgTyrSerAspGluTrpHis-121 |
| SEQ. ID. NO. 5304 | 127-AsnProArgAspValValPro-133 |
| SEQ. ID. NO. 5305 | 146-AsnLysValAspValAspAla-152 |
| SEQ. ID. NO. 5306 | 158-LysAlaLeuArgLysValGly-164 |
| SEQ. ID. NO. 5307 | 167-TyrSerAspGluGluIleAlaLysAlaProGlu-177 |
| SEQ. ID. NO. 5308 | 179-LeuAlaAsnLysSerGluLeuAspAla-187 |

402-2
AMPHI Regions - AMPHI

| | |
|---|---|
| SEQ. ID. NO. 5309 | 18-PheLeuSerGlyLeu-22 |
| SEQ. ID. NO. 5310 | 85-AlaGlyIleAlaAspPhe-90 |
| SEQ. ID. NO. 5311 | 100-ThrGlyPheSerGlyPheValHis-107 |
| SEQ. ID. NO. 5312 | 117-AlaValValArgGlyLeu-122 |
| SEQ. ID. NO. 5313 | 136-LysSerGlyArgGln-140 |
| SEQ. ID. NO. 5314 | 146-PheAlaAsnValAlaGly-151 |
| SEQ. ID. NO. 5315 | 218-ValPheGlnAsnIleAlaAspArgProAspArgLeuIle-230 |
| SEQ. ID. NO. 5316 | 261-AspValPheAsnSerValAsnGlyIleGlu-270 |
| SEQ. ID. NO. 5317 | 279-LysSerGlyIleArg-283 |
| SEQ. ID. NO. 5318 | 294-SerTrpAlaArgValLeuSerAlaIleProGluMetGln-306 |
| SEQ. ID. NO. 5319 | 344-ArgLysTrpLeuArgArgHisPro-351 |
| SEQ. ID. NO. 5320 | 376-AlaGluPheLeuLysGlnValGlnSerHisLeu-386 |
| SEQ. ID. NO. 5321 | 398-HisSerProHisAlaPheAlaThrAlaValHisSerIlePro-411 |
| SEQ. ID. NO. 5322 | 437-GlnArgLeuSerArgLeu-442 |
| SEQ. ID. NO. 5323 | 460-AlaAlaGlnLysVal-464 |

Antigenic Index - Jameson-Wolf

| | |
|---|---|
| SEQ. ID. NO. 5324 | 4-ValAsnThrLysProAsnThrSer-11 |
| SEQ. ID. NO. 5325 | 66-ArgIleCysArgSerArgPheValAsp-74 |
| SEQ. ID. NO. 5326 | 130-ValGlyThrAspGlyAsnLysSerGlyArgGlnValSer-142 |
| SEQ. ID. NO. 5327 | 222-IleAlaAspArgProAspArgLeuIleGluAsnLysHisGly-235 |
| SEQ. ID. NO. 5328 | 240-TyrHisArgAspGlyAspLysValVal-248 |
| SEQ. ID. NO. 5329 | 264-AsnSerValAsnGlyIleGluArg-271 |
| SEQ. ID. NO. 5330 | 277-SerLeuLysSerGlyIleArgArg-284 |
| SEQ. ID. NO. 5331 | 321-IleAlaAspGluProGln-326 |
| SEQ. ID. NO. 5332 | 331-LeuGlnAspLysArgValGluIleValLeuAspAspGlyArgLysTrpLeuArgArgHisProAspGluLysPheAsp-356 |
| SEQ. ID. NO. 5333 | 385-HisLeuThrProAspGly-390 |
| SEQ. ID. NO. 5334 | 429-PheProAsnLysGluLeuLeuLysGlnArgLeuSer-440 |
| SEQ. ID. NO. 5335 | 444-TrpProGluSerGlyArgHisValPheAspSerSerThrVal-457 |
| SEQ. ID. NO. 5336 | 472-MetThrGluProSerAlaGly-478 |
| SEQ. ID. NO. 5337 | 481-ValIleThrAspAspAsnMet-487 |
| SEQ. ID. NO. 5338 | 489-ValGluTyrLysTyrGlyArgGlyIle-497 |

Hydrophilic Regions - Hopp-Woods

| | |
|---|---|
| SEQ. ID. NO. 5339 | 131-GlyThrAspGlyAsnLysSerGlyArgGlnVal-141 |
| SEQ. ID. NO. 5340 | 222-IleAlaAspArgProAspArgLeuIleGluAsnLysHis-234 |
| SEQ. ID. NO. 5341 | 241-HisArgAspGlyAspLysValVal-248 |
| SEQ. ID. NO. 5342 | 278-LeuLysSerGlyIleArg-283 |
| SEQ. ID. NO. 5343 | 321-IleAlaAspGluProGln-326 |
| SEQ. ID. NO. 5344 | 331-LeuGlnAspLysArgValGluIleValLeuAspAspGlyArgLysTrpLeuArgArgHisProAspGluLysPheAsp-356 |
| SEQ. ID. NO. 5345 | 430-ProAsnLysGluLeuLeuLysGlnArgLeuSer-440 |
| SEQ. ID. NO. 5346 | 446-GluSerGlyArgHisValPhe-452 |
| SEQ. ID. NO. 5347 | 473-ThrGluProSerAlaGly-478 |
| SEQ. ID. NO. 5348 | 481-ValIleThrAspAspAsnMet-487 |

501-2
AMPHI Regions - AMPHI

| | |
|---|---|
| SEQ. ID. NO. 5349 | 63-ValGluValLeuGlnGluLeuPheArgGlnTyrArgValAlaArgGlnLeu-79 |
| SEQ. ID. NO. 5350 | 88-ValPheAlaAlaPheGlnAlaVal-95 |
| SEQ. ID. NO. 5351 | 97-PheGlnGlyPheAspAsnGlyPhe-104 |
| SEQ. ID. NO. 5352 | 126-AlaAspAlaPheGlnGly-131 |
| SEQ. ID. NO. 5353 | 139-ValPheGluValValGlyAspIleThrArgArgThrThrGluAla-153 |
| SEQ. ID. NO. 5354 | 183-AspGlyPheThrArgIleAsnArgCysGlyGlnCys-194 |
| SEQ. ID. NO. 5355 | 196-HisAlaPheGlyAspPheIleAsp-203 |

Antigenic Index - Jameson-Wolf

| | |
|---|---|
| SEQ. ID. NO. 5356 | 6-LeuThrAlaAspAla-10 |
| SEQ. ID. NO. 5357 | 17-AlaAlaGlyGlyAspGlyLysValGlnHisHisPheAspGlyArgValAlaPhe-34 |

TABLE 1-continued

| | |
|---|---|
| SEQ. ID. NO. 5358 | 46-ValGluThrGluGlyGln-51 |
| SEQ. ID. NO. 5359 | 56-ValArgAlaAspGlyGluAlaValGluVal-65 |
| SEQ. ID. NO. 5360 | 100-PheAspAsnGlyPhe-104 |
| SEQ. ID. NO. 5361 | 108-GlnSerAlaAspGluArgAsnHisAspPheAsnValGlyGln-121 |
| SEQ. ID. NO. 5362 | 144-GlyAspIleThrArgArgThrThrGluAlaGlnHis-155 |
| SEQ. ID. NO. 5363 | 179-GlyHisThrAspAspGlyPheThrArgIleAsnArgCysGlyGlnCysArgHisAlaPhe-198 |
| SEQ. ID. NO. 5364 | 202-IleAspValGluValAspArgGlyArgValThrGlyAspThrAlaGlyAsnPhe-219 |

Hydrophilic Regions - Hopp-Woods

| | |
|---|---|
| SEQ. ID. NO. 5365 | 6-LeuThrAlaAspAla-10 |
| SEQ. ID. NO. 5366 | 19-GlyGlyAspGlyLysVal-24 |
| SEQ. ID. NO. 5367 | 46-ValGluThrGluGlyGln-51 |
| SEQ. ID. NO. 5368 | 56-ValArgAlaAspGlyGluAlaValGluVal-65 |
| SEQ. ID. NO. 5369 | 108-GlnSerAlaAspGluArgAsnHisAsp-116 |
| SEQ. ID. NO. 5370 | 144-GlyAspIleThrArgArgThrThrGluAlaGlnHis-155 |
| SEQ. ID. NO. 5371 | 179-GlyHisThrAspAspGlyPheThrArgIleAsnArg-190 |
| SEQ. ID. NO. 5372 | 202-IleAspValGluValAspArgGlyArgValThrGlyAspThr-215 |

502-1
AMPHI Regions - AMPHI

| | |
|---|---|
| SEQ. ID. NO. 5373 | 6-AsnLeuPheGlnPheLeuAlaValCys-14 |
| SEQ. ID. NO. 5374 | 26-GlyAlaValAspAlaLeuLysGlnPheAsnAsnAspAlaAspGlyIleSerGlySerPheThrGln-47 |
| SEQ. ID. NO. 5375 | 98-GlnValThrLysSerSerGlnAsp-105 |

Antigenic Index - Jameson-Wolf

| | |
|---|---|
| SEQ. ID. NO. 5376 | 32-LysGlnPheAsnAsnAspAlaAspGlyIleSerGlySer-44 |
| SEQ. ID. NO. 5377 | 48-ThrValGlnSerLysLysLysThrGlnThrAlaHisGlyThr-61 |
| SEQ. ID. NO. 5378 | 73-GluTyrThrLysProTyrArg-79 |
| SEQ. ID. NO. 5379 | 98-GlnValThrLysSerSerGlnAspGlnAlaIleGlyGlySerPro-112 |
| SEQ. ID. NO. 5380 | 116-LeuSerAsnLysThrAlaLeuGluSerSerTyrThrLeuLysGluAspGlySerSerAsnGly-136 |
| SEQ. ID. NO. 5381 | 142-AlaThrProLysArgAsnAsnAlaGly-150 |
| SEQ. ID. NO. 5382 | 158-PheLysGlyGlyAsn-162 |
| SEQ. ID. NO. 5383 | 167-GlnLeuLysAspSerPheGlyAsnGlnThr-176 |
| SEQ. ID. NO. 5384 | 184-AsnThrAsnProGlnLeuSerArgGlyAlaPhe-194 |
| SEQ. ID. NO. 5385 | 196-PheThrProProLysGlyValAspVal-204 |

Hydrophilic Regions - Hopp-Woods

| | |
|---|---|
| SEQ. ID. NO. 5386 | 34-PheAsnAsnAspAlaAspGlyIle-41 |
| SEQ. ID. NO. 5387 | 49-ValGlnSerLysLysLysThrGlnThr-57 |
| SEQ. ID. NO. 5388 | ThrLysSerSerGlnAspGlnAlaIle-108 |
| SEQ. ID. NO. 5389 | 126-TyrThrLeuLysGluAspGlySerSerAsn-135 |
| SEQ. ID. NO. 5390 | 143-ThrProLysArgAsnAsnAla-149 |
| SEQ. ID. NO. 5391 | 167-GlnLeuLysAspSerPheGly-173 |

503-1
AMPHI Regions - AMPHI

| | |
|---|---|
| SEQ. ID. NO. 5392 | 96-SerSerThrSerAsnPheAlaSerAlaAlaGluMetArgSerLeu-110 |

Antigenic Index - Jameson-Wolf

| | |
|---|---|
| SEQ. ID. NO. 5393 | 4-SerLeuTyrArgGluAlaAsnThrTrpCys-13 |
| SEQ. ID. NO. 5394 | 32-ProAlaAsnAspAlaSerGlyArgSerSerAlaValAlaGluGluArgThrAlaThrGluMetSerAlaProProAla-57 |
| SEQ. ID. NO. 5395 | 69-SerAlaSerSerCysSerGlyLysGlyValSer-79 |
| SEQ. ID. NO. 5396 | 87-LeuProThrArgAlaSerSerAlaThrSerSerThrSerAsn-100 |
| SEQ. ID. NO. 5397 | 105-AlaGluMetArgSerLeuArg-111 |
| SEQ. ID. NO. 5398 | 113-LeuCysAlaArgAsnAlaArg-119 |

Hydrophilic Regions - Hopp-Woods

| | |
|---|---|
| SEQ. ID. NO. 5399 | 4-SerLeuTyrArgGlu-8 |
| SEQ. ID. NO. 5400 | 32-ProAlaAsnAspAlaSerGlyArgSerSerAlaValAlaGluGluArgThrAlaThrGluMetSerAla-54 |
| SEQ. ID. NO. 5401 | 73-CysSerGlyLysGlyValSer-79 |
| SEQ. ID. NO. 5402 | 89-ThrArgAlaSerSer-93 |
| SEQ. ID. NO. 5403 | 105-AlaGluMetArgSerLeuArg-111 |

505-2
AMPHI Regions - AMPHI

| | |
|---|---|
| SEQ. ID. NO. 5404 | 20-LeuThrAlaLeuLeuLysCysLeuSerLeuLeuProLeuSerCysLeu-35 |
| SEQ. ID. NO. 5405 | 37-ThrLeuGlyAsnArg-41 |
| SEQ. ID. NO. 5406 | 89-ProAlaPhePheArgLysProGluAspIleGluThrMetPheLysAlaValHisGlyTrpGluHisValGlnGlnAlaLeuAsp-116 |
| SEQ. ID. NO. 5407 | 148-AlaMetTyrLysProProLysIleLysAlaIleAspLysIleMetGlnAlaGly-165 |
| SEQ. ID. NO. 5408 | 178-IleGlnGlyValLysGlnIleIleLysAlaLeuArg-189 |
| SEQ. ID. NO. 5409 | 210-GlyValTrpValAspPhePheGlyLysPro-219 |

Antigenic Index - Jameson-Wolf

| | |
|---|---|
| SEQ. ID. NO. 5410 | 39-GlyAsnArgLeuGly-43 |
| SEQ. ID. NO. 5411 | 50-LeuLysGluAspArgAlaArgIle-57 |
| SEQ. ID. NO. 5412 | 64-AlaGlyLeuAsnProAspProLysThrValLys-74 |
| SEQ. ID. NO. 5413 | 79-GluThrAlaLysGlyGlyLeu-85 |
| SEQ. ID. NO. 5414 | 92-PheArgLysProGluAspIleGluThr-100 |
| SEQ. ID. NO. 5415 | 114-AlaLeuAspLysHisGlu-119 |
| SEQ. ID. NO. 5416 | 131-TyrAspLeuGlyGlyArgTyrIleSer-139 |
| SEQ. ID. NO. 5417 | 150-TyrLysProProLysIleLysAlaIleAspLysIleMetGln-163 |
| SEQ. ID. NO. 5418 | 165-GlyArgValArgGlyLysGlyLysThrAlaProThrSer-177 |
| SEQ. ID. NO. 5419 | 183-GlnIleIleLysAlaLeuArgSerGlyGluAlaThr-194 |
| SEQ. ID. NO. 5420 | 199-AspHisValProSerProGlnGluGlyGlyGluGlyVal-211 |
| SEQ. ID. NO. 5421 | 243-GluArgLeuProGlyGlyGlnGly-250 |
| SEQ. ID. NO. 5422 | 258-ValGlnGlyGluLeuAsnGlyAspLysAlaHisAsp-269 |
| SEQ. ID. NO. 5423 | 293-AsnArgTyrLysMetPro-298 |

TABLE 1-continued

Hydrophilic Regions - Hopp-Woods
SEQ. ID. NO. 5424   50-LeuLysGluAspArgAlaArgIle-57
SEQ. ID. NO. 5425   65-GlyLeuAsnProAspProLysThrVal-73
SEQ. ID. NO. 5426   79-GluThrAlaLysGlyGlyLeu-85
SEQ. ID. NO. 5427   92-PheArgLysProGluAspIleGluThr-100
SEQ. ID. NO. 5428   114-AlaLeuAspLysHisGlu-119
SEQ. ID. NO. 5429   151-LysProProLysIleLysAlaIleAspLysIleMetGln-163
SEQ. ID. NO. 5430   165-GlyArgValArgGlyLysGlyLysThrAlaPro-175
SEQ. ID. NO. 5431   183-GlnIleIleLysAlaLeuArgSerGlyGlu-192
SEQ. ID. NO. 5432   201-ValProSerProGlnGluGlyGlyGlu-209
SEQ. ID. NO. 5433   258-ValGlnGlyGluLeuAsnGlyAspLysAlaHisAsp-269
506-2
AMPHI Regions - AMPHI
SEQ. ID. NO. 5434   6-GluValGlyArgValAlaHisCysGlyGlyGlyVal-17
SEQ. ID. NO. 5435   25-ArgValValHisGlnValGluGlnGlyAlaArg-35
SEQ. ID. NO. 5436   56-PheGlnArgArgPhe-60
SEQ. ID. NO. 5437   99-AlaThrArgThrIleAspGlyAsnLeuAlaGluValTyrAlaGlnThr-114
SEQ. ID. NO. 5438   138-GlyAsnGluValAlaArgCys-144
SEQ. ID. NO. 5439   180-GlnValLysArgMetIleArgTyrPhePheArgVal-191
Antigenic Index - Jameson-Wolf
SEQ. ID. NO. 5440   13-CysGlyGlyGlyGlyValAla-18
SEQ. ID. NO. 5441   31-GluGlnGlyAlaArgLeu-36
SEQ. ID. NO. 5442   54-ValAspPheGlnArgArgPheGlyGluVal-63
SEQ. ID. NO. 5443   98-ArgAlaThrArgThrIleAspGlyAsnLeu-107
SEQ. ID. NO. 5444   134-GlyAlaAspThrGlyAsnGluValAlaArgCysGluGly-146
SEQ. ID. NO. 5445   176-ProAsnPheGlyGlnValLysArgMetIle-185
SEQ. ID. NO. 5446   195-HisAspLeuAspVal-199
SEQ. ID. NO. 5447   201-ArgProPheArgLys-205
Hydrophilic Regions - Hopp-Woods
SEQ. ID. NO. 5448   31-GluGlnGlyAlaArgLeu-36
SEQ. ID. NO. 5449   54-ValAspPheGlnArgArgPheGlyGlu-62
SEQ. ID. NO. 5450   98-ArgAlaThrArgThrIleAsp-104
SEQ. ID. NO. 5451   136-AspThrGlyAsnGluValAlaArgCysGluGly-146
SEQ. ID. NO. 5452   180-GlnValLysArgMetIle-185
SEQ. ID. NO. 5453   195-HisAspLeuAspVal-199
SEQ. ID. NO. 5454   201-ArgProPheArgLys-205
513
AMPHI Regions - AMPHI
SEQ. ID. NO. 5455   6-AsnAlaAlaAlaAlaAla-11
SEQ. ID. NO. 5456   19-GlnGlyMetIleGlnMetLeuGlyValPheValAsp-30
SEQ. ID. NO. 5457   48-ProTyrGlyAspLeu-52
SEQ. ID. NO. 5458   63-ValSerGlnValGlyGlnTrp-69
SEQ. ID. NO. 5459   107-ThrAlaValPheArgMet-112
SEQ. ID. NO. 5460   119-TyrPheGlyAlaValAla-124
SEQ. ID. NO. 5461   139-IleMetAlaTrpIleAsnLeuValAlaIleLeuLeuLeuSer-152
Antigenic Index - Jameson-Wolf
SEQ. ID. NO. 5462   2-GlySerAlaProAsnAla-7
SEQ. ID. NO. 5463   11-AlaGluValLysHisProVal-17
SEQ. ID. NO. 5464   47-GlnProTyrGlyAspLeuSerGly-54
SEQ. ID. NO. 5465   91-AlaTyrAlaGluSerAsnVal-97
SEQ. ID. NO. 5466   160-ArgAspTyrThrAlaLysLeuLysMetGlyLysAspProGluPheLysLeuSerGluHisProGlyLeuLysArgArgIleLysSerAspValTrp-191
Hydrophilic Regions - Hopp-Woods
SEQ. ID. NO. 5467   11-AlaGluValLysHis-15
SEQ. ID. NO. 5468   166-LeuLysMetGlyLysAspProGluPheLysLeuSerGlu-178
SEQ. ID. NO. 5469   180-ProGlyLeuLysArgArgIleLysSer-188
515-1
AMPHI Regions - AMPHI
SEQ. ID. NO. 5470   8-ArgAlaAlaGlyValAlaArgGlyLeuHisThrGluPheAlaArgAlaVal-24
SEQ. ID. NO. 5471   59-AspValArgPhePheAlaGlnValGluGluIleGlyGlnAspPhePheAlaAspAla-77
SEQ. ID. NO. 5472   90-AlaGlyGluCysAlaAspGluValSerAspLysThr-101
SEQ. ID. NO. 5473   122-GluSerAlaGlnSerAlaAlaGlyGlyGlyLeuThrAspGlyPheGly-137
SEQ. ID. NO. 5474   176-CysGlyLysThrValGlyVal-182
SEQ. ID. NO. 5475   198-GlyValPheAspAla-202
SEQ. ID. NO. 5476   251-PheGlyGlyValAla-255
SEQ. ID. NO. 5477   259-AspGlyGlyPheAspGlyValLeuGlnGlyPhePheGlyGluVal-273
Antigenic Index - Jameson-Wolf
SEQ. ID. NO. 5478   24-ValThrAlaGluGluIleAlaPhe-31
SEQ. ID. NO. 5479   38-HisGluAlaArgCysGlyGlyAsn-45
SEQ. ID. NO. 5480   51-IleAlaAlaAlaGluArgAlaGlyAsp-59
SEQ. ID. NO. 5481   67-GluGluIleGlyGln-71
SEQ. ID. NO. 5482   77-AlaValAspGlnGluThr-82
SEQ. ID. NO. 5483   84-LeuAlaValGluArgAlaAlaGlyGluCysAlaAspGluValSerAspLysThrAlaArgAsnGlyGlyIleGluGluAspGlyValAlaAlaCysArg
                    AspAlaAlaAlaAlaGluSerAlaGln-125
SEQ. ID. NO. 5484   128-AlaGlyGlyGlyLeuThrAspGly-135
SEQ. ID. NO. 5485   160-GlyGlyAsnAspAlaAlaGlyAsn-167
SEQ. ID. NO. 5486   192-LeuHisArgArgAla-196
SEQ. ID. NO. 5487   217-AlaAspGlyGlyPheArg-222
SEQ. ID. NO. 5488   239-HisGlnThrGlyIleGlyLysSerGly-247
SEQ. ID. NO. 5489   256-GlyAspValAspGlyGlyPheAspGly-264

TABLE 1-continued

| | |
|---|---|
| SEQ. ID. NO. 5490 | 273-ValGlySerThrGlyAla-278 |
| SEQ. ID. NO. 5491 | 284-AspValAsnGlyAsnValGln-290 |
| Hydrophilic Regions - Hopp-Woods | |
| SEQ. ID. NO. 5492 | 24-ValThrAlaGluGluIleAlaPhe-31 |
| SEQ. ID. NO. 5493 | 38-HisGluAlaArgCysGly-43 |
| SEQ. ID. NO. 5494 | 51-IleAlaAlaAlaGluArgAlaGlyAsp-59 |
| SEQ. ID. NO. 5495 | 77-AlaValAspGlnGluThr-82 |
| SEQ. ID. NO. 5496 | 84-LeuAlaValGluArgAlaAlaGlyGluCysAlaAspGluValSerAspLysThr AlaArgAsnGlyGlyIleGluGluAspGlyValAlaAlaCysArgAspAlaAlaAlaGluSerAlaGln-125 |
| SEQ. ID. NO. 5497 | 162-AsnAspAlaAlaGly-166 |
| SEQ. ID. NO. 5498 | 192-LeuHisArgArgAla-196 |
| SEQ. ID. NO. 5499 | 242-GlyIleGlyLysSerGly-247 |
| SEQ. ID. NO. 5500 | 256-GlyAspValAspGlyGlyPhe-262 |
| 519-1 | |
| AMPHI Regions - AMPHI | |
| SEQ. ID. NO. 5501 | 15-GlyPheLysSerPhe-19 |
| SEQ. ID. NO. 5502 | 29-ValValGluArgLeuGlyArgPheHisArgAlaLeuThrAlaGly-43 |
| SEQ. ID. NO. 5503 | 105-MetAlaIleThrGlnLeuAlaGlnThrThrLeuArgSerVal-118 |
| SEQ. ID. NO. 5504 | 141-AlaLeuAspGluAlaAla-146 |
| SEQ. ID. NO. 5505 | 166-GluIleLeuArgSerMetGlnAla-173 |
| SEQ. ID. NO. 5506 | 192-LysIleGluGlnIle-196 |
| SEQ. ID. NO. 5507 | 221-SerAsnAlaGluLysIleAlaArgIleAsn-230 |
| SEQ. ID. NO. 5508 | 249-AlaIleArgGlnIleAlaAlaAla-256 |
| SEQ. ID. NO. 5509 | 273-GlnTyrValAlaAlaPheAsnAsnLeuAlaLys-283 |
| SEQ. ID. NO. 5510 | 292-AlaAsnValAlaAspIleGlySerLeuIleSerAlaGlyMetLysIleIleAspSerSerLysThrAla-314 |
| Antigenic Index - Jameson-Wolf | |
| SEQ. ID. NO. 5511 | 31-GluArgLeuGlyArgPheHisArg-38 |
| SEQ. ID. NO. 5512 | 58-HisSerLeuLysGluIleProLeuAspValProSerGln-70 |
| SEQ. ID. NO. 5513 | 72-CysIleThrArgAspAsnThrGlnLeuThrVal-82 |
| SEQ. ID. NO. 5514 | 91-ThrAspProLysLeuAlaSer-97 |
| SEQ. ID. NO. 5515 | 122-MetGluLeuAspLysThrPheGluGluArgAspGluIleAsn-135 |
| SEQ. ID. NO. 5516 | 141-AlaLeuAspGluAlaAlaGly-147 |
| SEQ. ID. NO. 5517 | 154-LeuArgTyrGluIleLysAspLeuValPro-163 |
| SEQ. ID. NO. 5518 | 175-IleThrAlaGluArgGluLysArgAlaArgIleAlaGluSerGluGlyArgLysIleGluGln-195 |
| SEQ. ID. NO. 5519 | 197-AsnLeuAlaSerGlyGlnArgGluAlaGluIleGlnGlnSerGluGlyGluAlaGlnAla-216 |
| SEQ. ID. NO. 5520 | 219-AsnAlaSerAsnAlaGluLysIleAlaArgIleAsnArgAlaLysGlyGluAlaGluSerLeuArgLeu-241 |
| SEQ. ID. NO. 5521 | 245-AlaAsnAlaGluAlaAlaIleArg-251 |
| SEQ. ID. NO. 5522 | 258-GlnThrGlnGlyGlyAlaAspAlaValAsn-267 |
| SEQ. ID. NO. 5523 | 281-LeuAlaLysGluSerAsnThr-287 |
| SEQ. ID. NO. 5524 | 303-AlaGlyMetLysIleIleAspSerSerLysThrAlaLys-315 |
| Hydrophilic Regions - Hopp-Woods | |
| SEQ. ID. NO. 5525 | 31-GluArgLeuGlyArgPheHisArg-38 |
| SEQ. ID. NO. 5526 | 58-HisSerLeuLysGluIleProLeu-65 |
| SEQ. ID. NO. 5527 | 73-IleThrArgAspAsnThr-78 |
| SEQ. ID. NO. 5528 | 91-ThrAspProLysLeu-95 |
| SEQ. ID. NO. 5529 | 122-MetGluLeuAspLysThrPheGluGluArgAspGluIleAsn-135 |
| SEQ. ID. NO. 5530 | 141-AlaLeuAspGluAlaAla-146 |
| SEQ. ID. NO. 5531 | 154-LeuArgTyrGluIleLysAspLeuValPro-163 |
| SEQ. ID. NO. 5532 | 175-IleThrAlaGluArgGluLysArgAlaArgIleAlaGluSerGluGlyArgLysIleGluGln-195 |
| SEQ. ID. NO. 5533 | 200-SerGlyGlnArgGluAlaGluIleGlnGlnSerGluGlyGluAlaGlnAla-216 |
| SEQ. ID. NO. 5534 | 221-SerAsnAlaGluLysIleAlaArgIleAsnArgAlaLysGlyGluAlaGluSerLeuArgLeu-241 |
| SEQ. ID. NO. 5535 | 245-AlaAsnAlaGluAlaAlaIleArg-251 |
| SEQ. ID. NO. 5536 | 281-LeuAlaLysGluSerAsn-286 |
| SEQ. ID. NO. 5537 | 306-LysIleIleAspSerSerLysThrAlaLys-315 |
| 520-1 | |
| AMPHI Regions - AMPHI | |
| SEQ. ID. NO. 5538 | 104-LeuThrLysAlaAlaAspGlyGlnValCysArgAlaPheSerSerLeu-119 |
| Antigenic Index - Jameson-Wolf | |
| SEQ. ID. NO. 5539 | 20-LysProSerArgArgAlaLeu-26 |
| SEQ. ID. NO. 5540 | 47-AlaSerGlyLysIleSerLeuPro-54 |
| SEQ. ID. NO. 5541 | 84-ProProAsnAsnSerThrThrThrSerThrSerSerArgAlaThrSerSerAsnGlySerLeuThrLysAlaAlaAspGlyGlnVal-112 |
| SEQ. ID. NO. 5542 | 117-SerSerLeuLysSerHisThrAlaGluIleArgIleSerArgProLysArgArgGluIleSerSerAlaLeuSerArgAsnThrAlaAla-146 |
| SEQ. ID. NO. 5543 | 150-ProThrValProLysProLysArgProMet-159 |
| SEQ. ID. NO. 5544 | 166-SerProCysLysProThrGluMet-173 |
| Hydrophilic Regions - Hopp-Woods | |
| SEQ. ID. NO. 5545 | 20-LysProSerArgArgAlaLeu-26 |
| SEQ. ID. NO. 5546 | 93-ThrSerSerArgAlaThrSerSer-100 |
| SEQ. ID. NO. 5547 | 103-SerLeuThrLysAlaAlaAsp-109 |
| SEQ. ID. NO. 5548 | 120-LysSerHisThrAlaGluIleArgIleSerArgProLysArgArgGluIleSer-137 |
| SEQ. ID. NO. 5549 | 140-LeuSerArgAsnThrAla-145 |
| SEQ. ID. NO. 5550 | 151-ThrValProLysProLysArgProMet-159 |
| SEQ. ID. NO. 5551 | 168-CysLysProThrGluMet-173 |
| 521-2 | |
| AMPHI Regions - AMPHI | |
| SEQ. ID. NO. 5552 | 39-ThrLysProSerLysSerCys-45 |
| SEQ. ID. NO. 5553 | 50-LeuProProIleGly-54 |
| SEQ. ID. NO. 5554 | 65-GlnThrProGluProValSerSerProSer-74 |
| SEQ. ID. NO. 5555 | 76-GlyGlyGlnValVal-80 |
| SEQ. ID. NO. 5556 | 86-ValLysThrValSerLysProAlaLys-94 |
| SEQ. ID. NO. 5557 | 133-GlnAlaArgLeuAlaLysGlyGlyAsn-141 |

TABLE 1-continued

Antigenic Index - Jameson-Wolf
SEQ. ID. NO. 5558  36-ValTyrThrThrLysProSerLysSerCysHisSerThrAspLeuProProIleGlyAsnTyrSerSerGluArgTyrIleProProGlnThrProGlu
ProValSerSerProSerAsnGlyGlyGlnValValLysTyrLysAlaProValLysThrValSerLysProAlaLysSerAsnThrProProProGlnGlnAla
ProSerAsnAsnSerArgArgSerIleLeuGluThrGluLeuSerAsnGluArgLysAlaLeuValGluAlaGlnLysMetLeuSer-132
SEQ. ID. NO. 5559  135-ArgLeuAlaLysGlyGlyAsnIleAsn-143
SEQ. ID. NO. 5560  152-SerAsnValLeuAspArgGlnGlnAsn-160
SEQ. ID. NO. 5561  164-LeuGlnArgGluLeuGlyArg-170
Hydrophilic Regions - Hopp-Woods
SEQ. ID. NO. 5562  40-LysProSerLysSerCysHis-46
SEQ. ID. NO. 5563  57-SerSerGluArgTyrIle-62
SEQ. ID. NO. 5564  65-GlnThrProGluProValSer-71
SEQ. ID. NO. 5565  80-ValLysTyrLysAlaProVal-86
SEQ. ID. NO. 5566  88-ThrValSerLysProAlaLysSerAsnThrProPro-99
SEQ. ID. NO. 5567  102-GlnAlaProSerAsnAsnSerArgArgSerIleLeuGluThrGluLeuSerAsnGluArgLysAlaLeuValGluAlaGlnLysMetLeuSer-132
SEQ. ID. NO. 5568  154-ValLeuAspArgGlnGlnAsn-160
SEQ. ID. NO. 5569  164-LeuGlnArgGluLeuGlyArg-170
522
AMPHI Regions - AMPHI
SEQ. ID. NO. 5570  32-TrpValIleLeuAlaLeuLeuAlaLeuThrAlaLeuLeuSer-45
SEQ. ID. NO. 5571  57-LysIleValGluSerCysValLys-64
SEQ. ID. NO. 5572  96-MetTrpGluGlnProLeuAspArgLeuSerGluLysGlnIleArgSerPheGlyLysLeuGlyAlaGlnGluGlnLeuAspLeuLeuGlyGlyAla-127
Antigenic Index - Jameson-Wolf
SEQ. ID. NO. 5573  1-MetThrGluProLysHisGluMetLeuThrLysGluGlnValAlaAlaArgLysLysAlaLysAlaLysIleArgThr-26
SEQ. ID. NO. 5574  48-AlaMetSerLysProGlnAlaLysGlnLysIleValGluSerCysValLys-64
SEQ. ID. NO. 5575  71-LysTrpGlnAsnAspLeuArgAlaArgGlyLeuAspSerAsnAsnThrArgLeuAla-89
SEQ. ID. NO. 5576  99-GlnProLeuAspArgLeuSerGluLysGlnIleArgSerPheGlyLysLeuGlyAla-117
SEQ. ID. NO. 5577  128-AsnAlaPheGluAlaArgAspLysGlnCysValAlaAspLeuLysSerGlu-144
Hydrophilic Regions - Hopp-Woods
SEQ. ID. NO. 5578  1-MetThrGluProLysHisGluMetLeuThrLysGluGlnValAlaAlaArgLysLysAlaLysAlaLysIleArgThr-26
SEQ. ID. NO. 5579  48-AlaMetSerLysProGlnAlaLysGlnLysIleValGluSerCysVal-63
SEQ. ID. NO. 5580  71-LysTrpGlnAsnAspLeuArgAlaArgGlyLeuAspSerAsnAsnThr-86
SEQ. ID. NO. 5581  100-ProLeuAspArgLeuSerGluLysGlnIleArgSerPheGly-113
SEQ. ID. NO. 5582  130-PheGluAlaArgAspLysGlnCysValAlaAspLeuLysSerGlu-144
525-1
AMPHI Regions - AMPHI
SEQ. ID. NO. 5583  59-GluPheAlaGluPheValAsnSerHisProGln-69
SEQ. ID. NO. 5584  86-LysHisTrpMetLysAsnGly-92
SEQ. ID. NO. 5585  125-ArgLeuProThrIleAspGluTrpGluPhe-134
SEQ. ID. NO. 5586  154-ThrIleLeuAspTrpTyr-159
SEQ. ID. NO. 5587  164-ArgLysGlyLeuHisAspValGly-171
SEQ. ID. NO. 5588  178-TrpGlyValTyrAsp-182
SEQ. ID. NO. 5589  188-TrpGluTrpThrGlu-192
Antigenic Index - Jameson-Wolf
SEQ. ID. NO. 5590  24-ValGlnIleGluGlyGlySerTyrArgProLeuTyrLeuLysLysAspThrGlyLeuIleLys-44
SEQ. ID. NO. 5591  46-LysProPheLysLeuAspLysTyrProValThr-56
SEQ. ID. NO. 5592  67-HisProGlnTrpGlnLysGlyArgIleGlySerLysGlnAlaGlu-81
SEQ. ID. NO. 5593  88-TrpMetLysAsnGlySerArgSerTyrAlaProLysAlaGlyGluLeuLysGlnPro-106
SEQ. ID. NO. 5594  122-GlnGlyLysArgLeuProThrIleAspGluTrpGlu-133
SEQ. ID. NO. 5595  140-AlaThrGlnLysAsnGlySerAsnGluProGlyTyrAsnArgThr-154
SEQ. ID. NO. 5596  159-TyrAlaAspGlyGlyArgLysGlyLeuHisAspValGlyLysGlyArgProAsnTyr-177
SEQ. ID. NO. 5597  190-TrpThrGluAspPheAsnSerSerLeuLeuSerSerGlyAsnAla-204
SEQ. ID. NO. 5598  213-AlaSerIleGlySerSerAspSerSerAsnTyr-223
SEQ. ID. NO. 5599  234-SerLeuGlnSerLysTyr-239
Hydrophilic Regions - Hopp-Woods
SEQ. ID. NO. 5600  35-TyrLeuLysLysAspThrGlyLeuIleLys-44
SEQ. ID. NO. 5601  46-LysProPheLysLeuAspLysTyrPro-54
SEQ. ID. NO. 5602  71-GlnLysGlyArgIleGlySerLysGlnAlaGlu-81
SEQ. ID. NO. 5603  91-AsnGlySerArgSerTyrAlaProLysAlaGlyGluLeuLysGln-105
SEQ. ID. NO. 5604  122-GlnGlyLysArgLeuProThr-128
SEQ. ID. NO. 5605  140-AlaThrGlnLysAsnGlySerAsnGluProGlyTyr-151
SEQ. ID. NO. 5606  162-GlyGlyArgLysGlyLeuHisAspValGlyLysGlyArgPro-175
SEQ. ID. NO. 5607  216-GlySerSerAspSerSerAsn-222
527-2
AMPHI Regions - AMPHI
SEQ. ID. NO. 5608  7-PhePheGlnProValGln-12
SEQ. ID. NO. 5609  28-SerAspAlaAlaGluLeuValGluLeuPheAlaLeuPhePro-41
SEQ. ID. NO. 5610  73-GlyLysGlyIleGluArgGlnValAspAsnIleAlaAspValTyrGlyPhe-89
Antigenic Index - Jameson-Wolf
SEQ. ID. NO. 5611  26-GlyGlySerAspAlaAlaGlu-32
SEQ. ID. NO. 5612  52-GlnLysProArgLeuGlyCys-58
SEQ. ID. NO. 5613  71-PheIleGlyLysGlyIleGluArgGlnValAspAsnIleAla-84
SEQ. ID. NO. 5614  107-LeuLeuArgLysGlyThrGlyLeuGluLysThrCysArgProLysProPheValGlnProHisGlyGlyArg-130
Hydrophilic Regions - Hopp-Woods
SEQ. ID. NO. 5615  27-GlySerAspAlaAlaGlu-32
SEQ. ID. NO. 5616  52-GlnLysProArgLeuGlyCys-58
SEQ. ID. NO. 5617  75-GlyIleGluArgGlnValAspAsnIleAla-84
SEQ. ID. NO. 5618  107-LeuLeuArgLysGlyThrGlyLeuGluLysThrCysArgProLysPro-122
528-1

TABLE 1-continued

AMPHI Regions - AMPHI
SEQ. ID. NO. 5619	7-LysTyrThrAlaMetAlaAlaLeuLeuAlaPhe-17
SEQ. ID. NO. 5620	23-ArgLeuAlaGlyTrpTyrGluCysSerSerLeuThrGlyTrpCysLysProArgLysProAlaAlaIle-45
SEQ. ID. NO. 5621	69-AsnArgSerValArg-73
SEQ. ID. NO. 5622	86-TyrArgLysIleGlyLysPhe-92
SEQ. ID. NO. 5623	106-ProLeuIleGluThrPheLys-112
Antigenic Index - Jameson-Wolf
SEQ. ID. NO. 5624	1-MetGluIleArgAla-5
SEQ. ID. NO. 5625	29-GluCysSerSerLeuThrGlyTrpCysLysProArgLysProAlaAla-44
SEQ. ID. NO. 5626	49-AspIleGlyGlyGluSerProProSerLeuGlyAspTyrGluIleProLeuSerAspGlyAsnArgSerValArgAlaAsnGluTyrGluSerAlaGln
	GlnSer-83
SEQ. ID. NO. 5627	88-LysIleGlyLysPheGluAlaCysGlyLeuAspTrpArgThrArgAspGlyLysProLeu-107
SEQ. ID. NO. 5628	110-ThrPheLysGlnGlyGlyPheAspCysLeuGluLysGlnGlyLeuArgArgAsnGlyLeuSerGluArgValArgTrp-135
Hydrophilic Regions - Hopp-Woods
SEQ. ID. NO. 5629	1-MetGluIleArgAla-5
SEQ. ID. NO. 5630	37-CysLysProArgLysProAlaAla-44
SEQ. ID. NO. 5631	51-GlyGlyGluSerProProSer-57
SEQ. ID. NO. 5632	59-GlyAspTyrGluIleProLeu-65
SEQ. ID. NO. 5633	67-AspGlyAsnArgSerValArgAlaAsnGluTyrGluSerAlaGln-81
SEQ. ID. NO. 5634	88-LysIleGlyLysPheGluAlaCys-95
SEQ. ID. NO. 5635	99-TrpArgThrArgAspGlyLysProLeu-107
SEQ. ID. NO. 5636	117-AspCysLeuGluLysGlnGlyLeuArgArgAsnGlyLeuSerGluArgValArgTrp-135
529
AMPHI Regions - AMPHI
SEQ. ID. NO. 5637	11-LeuAlaLeuIleGlyLeuAlaAlaCysSer-20
SEQ. ID. NO. 5638	35-SerHisArgLeuIle-39
SEQ. ID. NO. 5639	49-AsnProAspGlnGlyAsnLeuTyrArgLeuProAla-60
SEQ. ID. NO. 5640	79-GlnGlnProAlaAspAlaGluValLeuLysSerValLysGlyValArg-94
SEQ. ID. NO. 5641	152-GlnAspSerLeuArgArgLeuPheAsp-160
SEQ. ID. NO. 5642	196-AlaMetLysGluVal-200
SEQ. ID. NO. 5643	223-AlaPheLeuThrArgPheMetGlnTyrLeu-232
SEQ. ID. NO. 5644	252-AlaAsnGluMetAla-256
SEQ. ID. NO. 5645	270-GlyArgAsnTrpArgArgThrVal-277
Antigenic Index - Jameson-Wolf
SEQ. ID. NO. 5646	19-CysSerGlySerLysThrGluGlnProLysLeuAspTyrGlnSerArgSerHisArgLeuIleLys-40
SEQ. ID. NO. 5647	42-GluValProProAspLeuAsnAsnProAspGlnGlyAsnLeuTyr-56
SEQ. ID. NO. 5648	60-AlaGlySerGlyAlaValArgAlaSerAspLeuGluLysArgArgThrProAlaVal-78
SEQ. ID. NO. 5649	80-GlnProAlaAspAlaGluValLeuLysSerValLysGlyValArgLeuGluArgAspGlySerGln-101
SEQ. ID. NO. 5650	105-ValValAspGlyLysSerProAlaGlu-113
SEQ. ID. NO. 5651	123-GlnGluAsnGlyPheAspIleLysSerGluGluProAla-135
SEQ. ID. NO. 5652	139-MetGluThrGluTrpAlaGluAsnArgAlaLysIleProGlnAspSerLeuArgArgLeuPheAsp-160
SEQ. ID. NO. 5653	169-SerThrGlyGluArgAspLysPheIleValArgIleGluGlnGlyLysAsnGlyValSer-188
SEQ. ID. NO. 5654	195-LysAlaMetLysGluValTyrGlyGlyLysAspLysAspThrThr-209
SEQ. ID. NO. 5655	212-GlnProSerProSerAspProAsnLeu-220
SEQ. ID. NO. 5656	233-GlyValAspGlyGlnGlnAlaGluAsnAlaSerAlaLysLysProThrLeu-249
SEQ. ID. NO. 5657	253-AsnGluMetAlaArgIleGluGlyLysSer-262
SEQ. ID. NO. 5658	268-AspTyrGlyArgAsnTrpArgArgThrVal-277
SEQ. ID. NO. 5659	289-GlyGlnAsnThrGluArgHisAla-296
SEQ. ID. NO. 5660	300-GlnLysAlaProAsnGluSerAsnAlaValThrGluGlnLysProGlyLeu-316
SEQ. ID. NO. 5661	320-LeuLeuGlyLysGlyLysAlaGluLysProAlaGluGlnProGlu-334
SEQ. ID. NO. 5662	342-ValAlaAsnGlySerArg-347
SEQ. ID. NO. 5663	350-LeuLeuAsnLysAspGlySerAlaTyrAlaGlyLysAspAlaSer-364
SEQ. ID. NO. 5664	370-LeuHisSerGluLeuArg-375
Hydrophilic Regions - Hopp-Woods
SEQ. ID. NO. 5665	20-SerGlySerLysThrGluGlnProLysLeuAspTyrGlnSerArgSerHisArgLeuIleLys-40
SEQ. ID. NO. 5666	42-GluValProProAspLeuAsnAsnProAspGln-52
SEQ. ID. NO. 5667	63-GlyAlaValArgAlaSerAspLeuGluLysArgArgThrProAla-77
SEQ. ID. NO. 5668	80-GlnProAlaAspAlaGluValLeuLysSerValLysGlyValArgLeuGluArgAspGlySerGln-101
SEQ. ID. NO. 5669	107-AspGlyLysSerProAla-112
SEQ. ID. NO. 5670	125-AsnGlyPheAspIleLysSerGluGluProAla-135
SEQ. ID. NO. 5671	139-MetGluThrGluTrpAlaGluAsnArgAlaLysIleProGlnAspSerLeuArgArgLeuPheAsp-160
SEQ. ID. NO. 5672	170-ThrGlyGluArgAspLysPheIleVal-178
SEQ. ID. NO. 5673	180-IleGluGlnGlyLysAsnGlyVal-187
SEQ. ID. NO. 5674	195-LysAlaMetLysGluValTyrGlyGlyLysAspLysAspThrThr-209
SEQ. ID. NO. 5675	214-SerProSerAspProAsnLeu-220
SEQ. ID. NO. 5676	235-AspGlyGlnGlnAlaGluAsnAlaSerAlaLysLysProThr-248
SEQ. ID. NO. 5677	253-AsnGluMetAlaArgIleGluGlyLysSer-262
SEQ. ID. NO. 5678	269-TyrGlyArgAsnTrpArg-274
SEQ. ID. NO. 5679	291-AsnThrGluArgHis-295
SEQ. ID. NO. 5680	302-AlaProAsnGluSerAsnAlaValThrGluGlnLysProGlyLeu-316
SEQ. ID. NO. 5681	320-LeuLeuGlyLysGlyLysAlaGluLysProAlaGluGlnProGlu-334
SEQ. ID. NO. 5682	352-AsnLysAspGlySer-356
SEQ. ID. NO. 5683	359-AlaGlyLysAspAlaSer-364
SEQ. ID. NO. 5684	370-LeuHisSerGluLeuArg-375
531
AMPHI Regions - AMPHI
SEQ. ID. NO. 5685	59-SerLeuAlaGlyIleLeuAlaAspTyrValAlaGlyIleTrpGlyThr-74
SEQ. ID. NO. 5686	90-GlySerIleIleGlyIlePhePheSerLeuProGlyLeuIleLeuGly-105
SEQ. ID. NO. 5687	108-IleGlyAlaAlaAlaGly-113
SEQ. ID. NO. 5688	132-LeuLeuGlyLeuValVal-137

TABLE 1-continued

Antigenic Index - Jameson-Wolf
SEQ. ID. NO. 5689  74-ThrLysTyrThrGlyAlaGlyLysLeuAlaVal-84
SEQ. ID. NO. 5690  114-GluLeuIleGluArgArgAsnMet-121
Hydrophilic Regions - Hopp-Woods
SEQ. ID. NO. 5691  114-GluLeuIleGluArgArgAsnMet-121
532
AMPHI Regions - AMPHI
SEQ. ID. NO. 5692  6-GlyLysGlyAlaAsp-10
SEQ. ID. NO. 5693  27-AlaLeuLeuSerAlaValThrHisLeuLeuAlaIlePheValProMetIleThr-44
SEQ. ID. NO. 5694  76-TyrLeuGlnValAsnArgPheGlyPro-84
SEQ. ID. NO. 5695  122-SerThrLeuLeuGly-126
SEQ. ID. NO. 5696  147-LysValIleThrProThrVal-153
SEQ. ID. NO. 5697  184-ThrPheGlySerMetGluAsnLeuGly-192
SEQ. ID. NO. 5698  206-CysMetLysAsnPro-210
SEQ. ID. NO. 5699  224-GlyTyrIleValAlaLeu-229
SEQ. ID. NO. 5700  236-PheSerAlaLeuGlnAsnLeuPro-243
SEQ. ID. NO. 5701  271-LeuSerValPheGluAlaValGlyAspLeuThrAla-282
SEQ. ID. NO. 5702  297-ThrLysArgLeuArgGlyGlyVal-304
SEQ. ID. NO. 5703  307-AspGlyLeuValSerValIleAlaThrAlaLeuGly-318
SEQ. ID. NO. 5704  338-AlaSerArgHisValGlyLysTyr-345
SEQ. ID. NO. 5705  361-ArgAlaPheThrThrIleProSerProVal-370
Antigenic Index - Jameson-Wolf
SEQ. ID. NO. 5706  1-MetSerGlyGlnLeuGlyLysGlyAlaAspAlaPro-12
SEQ. ID. NO. 5707  18-LeuGluAspArgProProPheGlyAsn-26
SEQ. ID. NO. 5708  80-AsnArgPheGlyPro-84
SEQ. ID. NO. 5709  108-AlaGlyMetLysGluGlyGlyLeuThrLysAspAlaMet-120
SEQ. ID. NO. 5710  177-PheGlyAlaLysAlaAspGlyThrPheGlySer-187
SEQ. ID. NO. 5711  207-MetLysAsnProLeuLeuArg-213
SEQ. ID. NO. 5712  286-ValSerAspGlnProIleGluGlyGluGluTyrThrLysArgLeuArgGlyGlyValLeu-305
SEQ. ID. NO. 5713  391-ValSerHisGlyIleArgArgArgGluAlaVal-401
SEQ. ID. NO. 5714  445-LeuProGluAspLysThrGluAlaAlaValLysPheAspThrAspHisLeuGluHis-463
Hydrophilic Regions - Hopp-Woods
SEQ. ID. NO. 5715  4-GlnLeuGlyLysGlyAlaAspAlaPro-12
SEQ. ID. NO. 5716  18-LeuGluAspArgProProPhe-24
SEQ. ID. NO. 5717  109-GlyMetLysGluGlyGlyLeuThrLysAspAlaMet-120
SEQ. ID. NO. 5718  179-AlaLysAlaAspGly-183
SEQ. ID. NO. 5719  289-GlnProIleGluGlyGluGluTyrThrLysArgLeuArgGly-302
SEQ. ID. NO. 5720  394-GlyIleArgArgArgGluAlaVal-401
SEQ. ID. NO. 5721  445-LeuProGluAspLysThrGluAlaAlaValLysPheAspThrAspHisLeuGluHis-463
537-2
AMPHI Regions - AMPHI
SEQ. ID. NO. 5722  38-GlnIleArgAspGlyGlyAspAlaLeuHisTyrLeuAsnArgIle-52
SEQ. ID. NO. 5723  86-HisGlyGluHisHis-90
SEQ. ID. NO. 5724  109-GlyTyrLeuTyrAsnGlyValHisGlu-117
SEQ. ID. NO. 5725  138-ArgGlnValAspGlyLeuMetSerAlaIleTyr-148
SEQ. ID. NO. 5726  182-ArgPheGluArgHisCys-187
SEQ. ID. NO. 5727  194ProGluAlaGlyArgLysTyrTyrArgAsnAla-204
SEQ. ID. NO. 5728  281-ArgProValArgValLeuThrAlaGly-289
SEQ. ID. NO. 5729  315-TyrThrAlaValPheAspTyrValArgAsnGlyArgArgAla-328
Antigenic Index - Jameson-Wolf
SEQ. ID. NO. 5730  21-ThrGlnAsnGlnSerLeuProAlaGly-29
SEQ. ID. NO. 5731  32-ValTyrProSerAlaProGlnIleArgAspGlyGlyAspAla-45
SEQ. ID. NO. 5732  69-AsnSerAlaArgArgHisAlaSer-76
SEQ. ID. NO. 5733  80-LeuAsnProGluAspGlyHisGlyGluHisHisProAspAsnProHis-95
SEQ. ID. NO. 5734  99-GlnLysLeuThrGluArgThrArgLeu-107
SEQ. ID. NO. 5735  115-ValHisGluAsnIleSerThrGluGluGluAlaAlaGluSerSerAspSerAspIleArgThrGlnGlnArgGlnValAspGlyLeu-143
SEQ. ID. NO. 5736  152-SerLeuLeuAspArgHisThrAspGluAlaGly-162
SEQ. ID. NO. 5737  165-PheValArgGluAsnGlyLysThr-172
SEQ. ID. NO. 5738  178-GlnGlyAsnGlyArgPheGluArgHisCysAlaGlnGlyArgAsnGlnProGluAlaGlyArgLysTyrTyrArgAsnAlaCysHisAsnGly-208
SEQ. ID. NO. 5739  212-TyrThrAspGluAlaMetPro-218
SEQ. ID. NO. 5740  237-PheHisGlyGluArgProAspProValProGluTyrGluIleThrGlyAsnProAlaSer-256
SEQ. ID. NO. 5741  258-AspPheSerGluAlaAlaGly-264
SEQ. ID. NO. 5742  266-IleThrMetLysSer-270
SEQ. ID. NO. 5743  274-TyrGlnGlyLysAsnGluIleArgPro-282
SEQ. ID. NO. 5744  287-ThrAlaGlyAsnAspProAsnGlyArgLeuThr-297
SEQ. ID. NO. 5745  320-AspTyrValArgAsnGlyArgArgAlaGlnAla-330
SEQ. ID. NO. 5746  334-PheArgThrArgLysProAspTyrProTyr-343
SEQ. ID. NO. 5747  345-GluValAsnGlyGlyGluThrLeuAlaValArgLysGlyGluLys-359
SEQ. ID. NO. 5748  364-TrpArgGlyArgTrpCysLeu-370
SEQ. ID. NO. 5749  376-TyrThrTyrArgGlnArgProGlySerArgLeuSerIleGlyArgHisGluAlaGlyGly-395
SEQ. ID. NO. 5750  401-AspGlyMetAlaGlySer-406
SEQ. ID. NO. 5751  408-IleThrLeuAlaProGluGlyGluThrGluArgGly-419
Hydrophilic Regions - Hopp-Woods
SEQ. ID. NO. 5752  37-ProGlnIleArgAspGlyGlyAsp-44
SEQ. ID. NO. 5753  69-AsnSerAlaArgArgHisAla-75
SEQ. ID. NO. 5754  81-AsnProGluAspGlyHisGlyGluHisHisProAsp-92
SEQ. ID. NO. 5755  100-LysLeuThrGluArgThrArgLeu-107
SEQ. ID. NO. 5756  119-IleSerThrGluGluGluAlaAlaGluSerSerAspSerAspIleArgThrGlnGlnArgGlnValAsp-141
SEQ. ID. NO. 5757  152-SerLeuLeuAspArgHisThrAspGluAlaGly-162
SEQ. ID. NO. 5758  165-PheValArgGluAsnGlyLys-171

TABLE 1-continued

| | |
|---|---|
| SEQ. ID. NO. 5759 | 179-GlyAsnGlyArgPheGluArgHisCysAlaGlnGlyArgAsnGlnProGluAlaGlyArgLysTyrTyrArg-202 |
| SEQ. ID. NO. 5760 | 238-HisGlyGluArgProAspProValProGlu-247 |
| SEQ. ID. NO. 5761 | 258-AspPheSerGluAlaAlaGly-264 |
| SEQ. ID. NO. 5762 | 266-IleThrMetLysSer-270 |
| SEQ. ID. NO. 5763 | 275-GlnGlyLysAsnGluIleArgPro-282 |
| SEQ. ID. NO. 5764 | 289-GlyAsnAspProAsnGlyArg-295 |
| SEQ. ID. NO. 5765 | 323-ArgAsnGlyArgArgAlaGlnAla-330 |
| SEQ. ID. NO. 5766 | 334-PheArgThrArgLysProAsp-340 |
| SEQ. ID. NO. 5767 | 352-LeuAlaValArgLysGlyGluLys-359 |
| SEQ. ID. NO. 5768 | 377-ThrTyrArgGlnArgProGlySer-384 |
| SEQ. ID. NO. 5769 | 387-SerIleGlyArgHisGluAla-393 |
| SEQ. ID. NO. 5770 | 412-ProGluGlyGluThrGluArgGly-419 |
| 538-2 | |
| AMPHI Regions - AMPHI | |
| SEQ. ID. NO. 5771 | 42-ThrAlaLeuAlaGluAlaValGluLeuValLysAlaAlaGly-55 |
| SEQ. ID. NO. 5772 | 79-LysAlaAlaGluLeuSerGluAlaValAla-88 |
| SEQ. ID. NO. 5773 | 145-GlnLeuSerHisLeuAlaGlyArgLeuIleArgGlyTyrGlyHisLeuGln-161 |
| SEQ. ID. NO. 5774 | 188-IleAsnAlaLeuLysLysGlnLeuAla-196 |
| SEQ. ID. NO. 5775 | 211-SerGlyThrIleLysThrPheAlaLeuValGlyTyrThrAsn-224 |
| SEQ. ID. NO. 5776 | 231-PheAsnArgLeuThrLys-236 |
| SEQ. ID. NO. 5777 | 271-GlyPheValSerAspLeuProHisLysLeuIleSerAlaPheSerAlaThrLeuGlu-289 |
| SEQ. ID. NO. 5778 | 307-AsnSerGlyGlnGlnIleGluAspValGluAsnValLeuGlnGluIleHis-323 |
| SEQ. ID. NO. 5779 | 365-GluAsnThrGlyIleAspAlaLeuArgGluAlaIleAlaGluSerCysAla-381 |
| Antigenic Index - Jameson-Wolf | |
| SEQ. ID. NO. 5780 | 1-MetThrGlyArgThrGlyGlyAsnGlySerThrGlnAlaGlnProGluArg-17 |
| SEQ. ID. NO. 5781 | 24-MetLeuAspLysAspGlyThrGlySerSerAlaAlaArg-36 |
| SEQ. ID. NO. 5782 | 48-ValGluLeuValLys-52 |
| SEQ. ID. NO. 5783 | 54-AlaGlyGlyAspSerValArgValGluThrAlaLysArgAspArgProHisThr-71 |
| SEQ. ID. NO. 5784 | 77-ThrGlyLysAlaAlaGluLeuSerGlu-85 |
| SEQ. ID. NO. 5785 | 100-GluLeuThrProThrGlnGluArgAsnLeuGluLysGluLeuLysCysArgValLeuAsp-119 |
| SEQ. ID. NO. 5786 | 129-AlaArgArgAlaArgThrGlnGluGlyArgLeuGlnVal-141 |
| SEQ. ID. NO. 5787 | 161-GlnSerGlnArgGlyGlyIleGlyMetLysGlyProGlyGluThrLysLeuGluThrAspArgArgLeuIle-184 |
| SEQ. ID. NO. 5788 | 189-AsnAlaLeuLysLysGlnLeuAlaAsnLeuLysLysGlnArgAlaLeuArgArgLysSerArgGluSerGlyThrIleLysThr-216 |
| SEQ. ID. NO. 5789 | 224-AsnValGlyLysSerSerLeu-230 |
| SEQ. ID. NO. 5790 | 233-ArgLeuThrLysSerGlyIleTyrAla-241 |
| SEQ. ID. NO. 5791 | 257-TyrIleSerProGluCys-262 |
| SEQ. ID. NO. 5792 | 287-ThrLeuGluGluThrAlaGln-293 |
| SEQ. ID. NO. 5793 | 304-AlaAlaProAsnSerGlyGlnGlnIleGluAspValGluAsnValLeu-319 |
| SEQ. ID. NO. 5794 | 323-HisAlaGlyAspIlePro-328 |
| SEQ. ID. NO. 5795 | 333-TyrAsnLysThrAspLeuLeuProSerGluGluGlnAsnThrGlyIle-348 |
| SEQ. ID. NO. 5796 | 365-GluAsnThrGlyIleAspAlaLeuArgGluAlaIleAla-377 |
| SEQ. ID. NO. 5797 | 380-CysAlaAlaAlaProAsnThrAspGluThrGluMetPro-392 |
| Hydrophilic Regions - Hopp-Woods | |
| SEQ. ID. NO. 5798 | 1-MetThrGlyArgThrGlyGly-7 |
| SEQ. ID. NO. 5799 | 13-AlaGlnProGluArg-17 |
| SEQ. ID. NO. 5800 | 25-LeuAspLysAspGlyThrGly-31 |
| SEQ. ID. NO. 5801 | 48-ValGluLeuValLys-52 |
| SEQ. ID. NO. 5802 | 54-AlaGlyGlyAspSerValArgValGluThrAlaLysArgAspArgProHis-70 |
| SEQ. ID. NO. 5803 | 78-GlyLysAlaAlaGluLeuSerGlu-85 |
| SEQ. ID. NO. 5804 | 101-LeuThrProThrGlnGluArgAsnLeuGluLysGluLeuLysCysArgValLeuAsp-119 |
| SEQ. ID. NO. 5805 | 129-AlaArgArgAlaArgThrGlnGluGlyArgLeuGlnVal-141 |
| SEQ. ID. NO. 5806 | 161-GlnSerGlnArgGlyGlyIle-167 |
| SEQ. ID. NO. 5807 | 171-GlyProGlyGluThrLysLeuGluThrAspArgArgLeuIle-184 |
| SEQ. ID. NO. 5808 | 189-AsnAlaLeuLysLysGlnLeuAlaAsnLeuLysLysGlnArgAlaLeuArgArgLysSerArgGluSerGlyThr-213 |
| SEQ. ID. NO. 5809 | 287-ThrLeuGluGluThrAlaGln-293 |
| SEQ. ID. NO. 5810 | 310-GlnGlnIleGluAspValGluAsnValLeu-319 |
| SEQ. ID. NO. 5811 | 337-AspLeuLeuProSerGluGluGlnAsn-345 |
| SEQ. ID. NO. 5812 | 370-AspAlaLeuArgGluAlaIleAla-377 |
| SEQ. ID. NO. 5813 | 384-ProAsnThrAspGluThrGluMetPro-392 |
| 539-2 | |
| AMPHI Regions - AMPHI | |
| SEQ. ID. NO. 5814 | 18-ArgGlnArgGluHisHisArgLeu-25 |
| SEQ. ID. NO. 5815 | 44-LeuValGlyGlyPheAspPheLeuArgValIleGlyCysGlyGlyValAlaTyrLeuProAspPheGlnGln-67 |
| Antigenic Index - Jameson-Wolf | |
| SEQ. ID. NO. 5816 | 1-MetGluAspLeuGlnGluIleGly-8 |
| SEQ. ID. NO. 5817 | 15-LysValGlyArgGlnArgGluHisHisArgLeuHisHisProGlnProGlyAsnGlyGluAlaAspAsp-37 |
| SEQ. ID. NO. 5818 | 63-ProAspPheGlnGlnAsnValGlyLysAlaAsp-73 |
| SEQ. ID. NO. 5819 | 77-ValProAspAspAlaAlaAla-83 |
| SEQ. ID. NO. 5820 | 88-IleGluValAspAlaAspAspAlaValCys-97 |
| SEQ. ID. NO. 5821 | 102-LeuPheAspGlnProAspAlaGlyGlyAlaGlyAspAlaAlaGluHis-117 |
| Hydrophilic Regions - Hopp-Woods | |
| SEQ. ID. NO. 5822 | 1-MetGluAspLeuGlnGluIleGly-8 |
| SEQ. ID. NO. 5823 | 15-LysValGlyArgGlnArgGluHisHisArg-24 |
| SEQ. ID. NO. 5824 | 31-GlyAsnGlyGluAlaAspAsp-37 |
| SEQ. ID. NO. 5825 | 69-ValGlyLysAlaAsp-73 |
| SEQ. ID. NO. 5826 | 78-ProAspAspAlaAlaAla-83 |
| SEQ. ID. NO. 5827 | 88-IleGluValAspAlaAspAspAlaValCys-97 |
| SEQ. ID. NO. 5828 | 102-LeuPheAspGlnProAspAlaGlyGlyAlaGlyAspAlaAlaGluHis-117 |
| 542-2 | |

TABLE 1-continued

```
AMPHI Regions - AMPHI
SEQ. ID. NO. 5829    6-ArgIleArgArgCysSerVal-12
Antigenic Index - Jameson-Wolf
SEQ. ID. NO. 5830    1-MetProLysTrpSerArgIleArgArgCysSerVal-12
SEQ. ID. NO. 5831    37-ValArgLeuLysSerSerAspGlyIleAlaSer-47
SEQ. ID. NO. 5832    56-GlyProMetProSerGluThrValSerHisLysSerAspSerSerArgAsnThrSerAlaSerArgArgAsnValSerProLysCysProPhe-86
SEQ. ID. NO. 5833    90-PheArgGlnAspAlaAlaLysProArgArgPheGlyGlyLys-103
SEQ. ID. NO. 5834    107-LeuThrGlySerArg-111
Hydrophilic Regions - Hopp-Woods
SEQ. ID. NO. 5835    5-SerArgIleArgArgCysSer-11
SEQ. ID. NO. 5836    37-ValArgLeuLysSerSerAspGlyIleAla-46
SEQ. ID. NO. 5837    58-MetProSerGluThrValSerHisLysSerAspSerSerArgAsnThrSerAlaSerArgArgAsnValSerPro-82
SEQ. ID. NO. 5838    90-PheArgGlnAspAlaAlaLysProArgArgPheGlyGly-102
544-2
AMPHI Regions - AMPHI
SEQ. ID. NO. 5839    11-AlaLeuIleGlyIleLeu-16
SEQ. ID. NO. 5840    55-PheTrpPheProSerCysProGlyCysValSerGluMetProLysIleIleLysThrAla-74
SEQ. ID. NO. 5841    85-LeuAlaValAlaGlnProIleAspProIleGluSerValArgGlnTyrVal-101
SEQ. ID. NO. 5842    116-LysAlaValGlyGlnAlaPhe-122
Antigenic Index - Jameson-Wolf
SEQ. ID. NO. 5843    1-MetLysLysIleLeu-5
SEQ. ID. NO. 5844    22-IleProAspSerLysThrAlaPro-29
SEQ. ID. NO. 5845    35-AspLeuHisGlyLysThrValSerAsnAlaAspLeuGlnGly-48
SEQ. ID. NO. 5846    59-SerCysProGlyCys-63
SEQ. ID. NO. 5847    66-GluMetProLysIleIleLysThrAlaAsnAspTyrLysAsnLysAsnPhe-82
SEQ. ID. NO. 5848    90-ProIleAspProIleGluSerValArgGlnTyrValLysAspTyrGly-105
SEQ. ID. NO. 5849    113-AspAlaAspLysAlaVal-118
SEQ. ID. NO. 5850    133-IleGlyLysLysGlyGluIleLeu-140
SEQ. ID. NO. 5851    144-ValGlyGluProAspPheGlyLysLeuTyrGlnGluIleAspThrAlaTrpArgAsnSerAspAlaVal-166
Hydrophilic Regions - Hopp-Woods
SEQ. ID. NO. 5852    1-MetLysLysIleLeu-5
SEQ. ID. NO. 5853    23-ProAspSerLysThr-27
SEQ. ID. NO. 5854    66-GluMetProLysIleIleLysThrAlaAsnAspTyrLysAsnLysAsn-81
SEQ. ID. NO. 5855    92-AspProIleGluSerValArgGlnTyrValLys-102
SEQ. ID. NO. 5856    113-AspAlaAspLysAlaVal-118
SEQ. ID. NO. 5857    133-IleGlyLysLysGlyGluIle-139
SEQ. ID. NO. 5858    156-IleAspThrAlaTrpArgAsnSerAspAlaVal-166
547-2
AMPHI Regions - AMPHI
SEQ. ID. NO. 5859    7-PheAsnLysThrValAlaSerPheAlaGlnIleValGluThrPheAspVal-23
SEQ. ID. NO. 5860    62-AsnArgSerPheLys-66
SEQ. ID. NO. 5861    105-LeuHisIlePheThrAsnIle-111
SEQ. ID. NO. 5862    121-GluLeuLeuThrIleLeuValLys-128
Antigenic Index - Jameson-Wolf
SEQ. ID. NO. 5863    3-ValAspAsnGlyPheAsnLysThrVal-11
SEQ. ID. NO. 5864    35-GlnMetLysGlnArgCysGly-41
SEQ. ID. NO. 5865    53-PheProArgCysGlyPheGluIleProAsnArgSerPheLysGlu-67
SEQ. ID. NO. 5866    76-LeuSerGluArgPheArgThrAsnAlaGluValGluMet-88
SEQ. ID. NO. 5867    129-AsnLeuSerProAsnGlyLysLysArgPhe-138
Hydrophilic Regions - Hopp-Woods
SEQ. ID. NO. 5868    36-MetLysGlnArgCys-40
SEQ. ID. NO. 5869    60-IleProAsnArgSerPheLysGlu-67
SEQ. ID. NO. 5870    76-LeuSerGluArgPheArgThrAsnAlaGluValGluMet-88
SEQ. ID. NO. 5871    130-LeuSerProAsnGlyLysLysArgPhe-138
548-2 (from 23)
AMPHI Regions - AMPHI
SEQ. ID. NO. 5872    14-ValLeuAlaAlaLeuAlaAlaCysLys-22
SEQ. ID. NO. 5873    39-SerAlaAlaGluAsnAlaAlaLysPro-47
SEQ. ID. NO. 5874    89-PheThrHisCysProAspValCysProThr-98
SEQ. ID. NO. 5875    103-TyrSerAspThrLeuLysGlnLeuGlyGlyGln-113
SEQ. ID. NO. 5876    132-GluIleIleGlyLysTyrAlaLys-139
Antigenic Index - Jameson-Wolf
SEQ. ID. NO. 5877    21-CysLysProGlnAspAsnSerAlaAla-29
SEQ. ID. NO. 5878    39-SerAlaAlaGluAsnAlaAlaLysProGlnThrArgGlyThrAspMetArgLysGluAspIleGlyGlyAspPheThrLeuThrAspGlyGluGly
                     LysProPheAsn-74
SEQ. ID. NO. 5879    76-SerAspLeuLysGly-80
SEQ. ID. NO. 5880    91-HisCysProAspValCysPro-97
SEQ. ID. NO. 5881    104-SerAspThrLeuLysGlnLeuGlyGlyGlnAlaLysAspValLys-118
SEQ. ID. NO. 5882    124-IleAspProGluArgAspThrProGluIleIleGlyLysTyrAlaLysGlnPheAsnProAspPhe-145
SEQ. ID. NO. 5883    150-AlaThrGlyGlyGln-154
SEQ. ID. NO. 5884    169-LysValAsnGlnLysAspSerGluAsnTyrLeu-180
SEQ. ID. NO. 5885    189-LeuIleAspLysAsnGlyGlu-195
SEQ. ID. NO. 5886    200-SerProTyrGlySerGluProGluThrIleAlaAlaAspVal-213
Hydrophilic Regions - Hopp-Woods
SEQ. ID. NO. 5887    22-LysProGlnAspAsnSerAla-28
SEQ. ID. NO. 5888    39-SerAlaAlaGluAsnAlaAlaLysProGlnThrArgGlyThrAspMetArgLysGluAspIleGlyGly-61
SEQ. ID. NO. 5889    64-ThrLeuThrAspGlyGluGlyLysPro-72
SEQ. ID. NO. 5890    76-SerAspLeuLysGly-80
SEQ. ID. NO. 5891    111-GlyGlyGlnAlaLysAspValLys-118
SEQ. ID. NO. 5892    124-IleAspProGluArgAspThrProGluIleIle-134
```

TABLE 1-continued

| SEQ. ID. NO. 5893 | 169-LysValAsnGlnLysAspAspSerGluAsnTyrLeu-180 |
| SEQ. ID. NO. 5894 | 191-AspLysAsnGlyGlu-195 |
| SEQ. ID. NO. 5895 | 203-GlySerGluProGluThrIleAlaAlaAspVal-213 |

548-2 (from earlier--to be deleted)
AMPHI Regions - AMPHI

| SEQ. ID. NO. 5896 | 14-ValLeuAlaAlaLeuAlaAlaCysLys-22 |
| SEQ. ID. NO. 5897 | 39-SerAlaAlaGluAsnAlaAlaLysPro-47 |
| SEQ. ID. NO. 5898 | 89-PheThrHisCysProAspValCysProThr-98 |
| SEQ. ID. NO. 5899 | 103-TyrSerAspThrLeuLysGlnLeuGlyGlyGln-113 |
| SEQ. ID. NO. 5900 | 132-GluIleIleGlyLysTyrAlaLys-139 |

Antigenic Index - Jameson-Wolf

| SEQ. ID. NO. 5901 | 21-CysLysProGlnAspAsnSerAlaAla-29 |
| SEQ. ID. NO. 5902 | 39-SerAlaAlaGluAsnAlaAlaLysProGlnThrArgGlyThrAspMetArgLysGluAspIleGlyGlyAspPheThrLeuThrAspGlyGluGlyLysProPheAsn-74 |
| SEQ. ID. NO. 5903 | 76-SerAspLeuLysGly-80 |
| SEQ. ID. NO. 5904 | 91-HisCysProAspValCysPro-97 |
| SEQ. ID. NO. 5905 | 104-SerAspThrLeuLysGlnLeuGlyGlyGlnAlaLysAspValLys-118 |
| SEQ. ID. NO. 5906 | 124-IleAspProGluArgAspThrProGluIleIleGlyLysTyrAlaLysGlnPheAsnProAspPhe-145 |
| SEQ. ID. NO. 5907 | 150-AlaThrGlyGlyGln-154 |
| SEQ. ID. NO. 5908 | 169-LysValAsnGlnLysAspAspSerGluAsnTyrLeu-180 |
| SEQ. ID. NO. 5909 | 189-LeuIleAspLysAsnGlyGlu-195 |
| SEQ. ID. NO. 5910 | 200-SerProTyrGlySerGluProGluThrIleAlaAlaAspVal-213 |

Hydrophilic Regions - Hopp-Woods

| SEQ. ID. NO. 5911 | 22-LysProGlnAspAsnSerAla-28 |
| SEQ. ID. NO. 5912 | 39-SerAlaAlaGluAsnAlaAlaLysProGlnThrArgGlyThrAspMetArgLysGluAspIleGlyGly-61 |
| SEQ. ID. NO. 5913 | 64-ThrLeuThrAspGlyGluGlyLysPro-72 |
| SEQ. ID. NO. 5914 | 76-SerAspLeuLysGly-80 |
| SEQ. ID. NO. 5915 | 111-GlyGlyGlnAlaLysAspValLys-118 |
| SEQ. ID. NO. 5916 | 124-IleAspProGluArgAspThrProGluIleIle-134 |
| SEQ. ID. NO. 5917 | 169-LysValAsnGlnLysAspAspSerGluAsnTyrLeu-180 |
| SEQ. ID. NO. 5918 | 191-AspLysAsnGlyGlu-195 |
| SEQ. ID. NO. 5919 | 203-GlySerGluProGluThrIleAlaAlaAspVal-213 |

552-1
AMPHI Regions - AMPHI

| SEQ. ID. NO. 5920 | 18-CysThrAsnAlaPheAlaAlaPro-25 |
| SEQ. ID. NO. 5921 | 29-AlaSerLeuAlaArgTrpLeuAspThr-37 |
| SEQ. ID. NO. 5922 | 41-AspArgAspIleGluLysAsnMetIleGluGlyPheAsnAlaGlyPheLysProTyrAlaAspLysAlaLeuAlaGluMet-67 |
| SEQ. ID. NO. 5923 | 75-AlaAlaGluAlaPheAsnArgTyrArgGluAsnVal-86 |
| SEQ. ID. NO. 5924 | 89-AspLeuIleThrProGluValLys-96 |
| SEQ. ID. NO. 5925 | 116-IleAspGlyMetIleAla-121 |
| SEQ. ID. NO. 5926 | 139-IleLysLysSerMetSerGluIle-146 |
| SEQ. ID. NO. 5927 | 154-SerGlyLysIleAlaGlnHisHisLeuProGluPheThrGluGluLeuArgArg-171 |

Antigenic Index - Jameson-Wolf

| SEQ. ID. NO. 5928 | 25-ProProSerAspAlaSerLeu-31 |
| SEQ. ID. NO. 5929 | 35-LeuAspThrGlnAsnPheAspArgAspIleGluLysAsnMetIle-49 |
| SEQ. ID. NO. 5930 | 58-ProTyrAlaAspLysAlaLeuAlaGluMetProGluAlaLysLysAspGlnAlaAla-76 |
| SEQ. ID. NO. 5931 | 78-AlaPheAsnArgTyrArgGluAsnValLeu-87 |
| SEQ. ID. NO. 5932 | 90-LeuIleThrProGluValLysGlnAlaVal-99 |
| SEQ. ID. NO. 5933 | 105-LysAsnAlaArgGluIleTyrThrGlnGluGluIleAspGly-118 |
| SEQ. ID. NO. 5934 | 131-ValValAlaLysAsnProArgLeuIleLysLysSerMetSer-144 |
| SEQ. ID. NO. 5935 | 153-LeuSerGlyLysIle-157 |
| SEQ. ID. NO. 5936 | 164-GluPheThrGluGluLeuArgArg-171 |
| SEQ. ID. NO. 5937 | 173-IleCysGlyGlyLysAsnProAspAlaGlyCysLysGlnAlaGlyGlnValGlyLysArgHisGlnLys-195 |

Hydrophilic Regions - Hopp-Woods

| SEQ. ID. NO. 5938 | 26-ProSerAspAlaSerLeu-31 |
| SEQ. ID. NO. 5939 | 38-GlnAsnPheAspArgAspIleGluLysAsnMetIle-49 |
| SEQ. ID. NO. 5940 | 58-ProTyrAlaAspLysAlaLeuAlaGluMetProGluAlaLysLysAspGlnAlaAla-76 |
| SEQ. ID. NO. 5941 | 78-AlaPheAsnArgTyrArgGluAsnValLeu-87 |
| SEQ. ID. NO. 5942 | 90-LeuIleThrProGluValLysGlnAlaVal-99 |
| SEQ. ID. NO. 5943 | 105-LysAsnAlaArgGluIleTyrThr-112 |
| SEQ. ID. NO. 5944 | 114-GluGluIleAspGly-118 |
| SEQ. ID. NO. 5945 | 131-ValValAlaLysAsnProArgLeuIleLysLysSerMetSer-144 |
| SEQ. ID. NO. 5946 | 164-GluPheThrGluGluLeuArgArg-171 |
| SEQ. ID. NO. 5947 | 176-GlyLysAsnProAspAlaGlyCysLysGlnAlaGlyGlnValGlyLysArgHisGlnLys-195 |

553-2
AMPHI Regions - AMPHI

| SEQ. ID. NO. 5948 | 31-LeuThrSerIleLeuSerTyrTyrGly-39 |
| SEQ. ID. NO. 5949 | 59-AsnLeuAlaAspIleMetArgPheGlyAsn-68 |
| SEQ. ID. NO. 5950 | 83-GluLeuSerAsnLeu-87 |

Antigenic Index - Jameson-Wolf

| SEQ. ID. NO. 5951 | 10-GlyPheAsnLysLysLeuPro-16 |
| SEQ. ID. NO. 5952 | 42-ThrAspLeuArgThrLeuArgGlnLysTyr-51 |
| SEQ. ID. NO. 5953 | 56-LysGlyAlaAsnLeu-60 |
| SEQ. ID. NO. 5954 | 65-ArgPheGlyAsnGluMetAsnLeuThrProArgAlaLeuArgLeuGluLeuAspGluLeuSerAsn-86 |
| SEQ. ID. NO. 5955 | 105-SerIleSerLysAspSerIle-111 |
| SEQ. ID. NO. 5956 | 116-ProAlaValGlyMetArgLysIleLysMetAspGluValSerGlnLys-131 |
| SEQ. ID. NO. 5957 | 143-ThrHisPheGluGluLysLysGluThrLysLysIleLys-155 |
| SEQ. ID. NO. 5958 | 160-LeuArgGlyGlyGlnAla-165 |

TABLE 1-continued

Hydrophilic Regions - Hopp-Woods
SEQ. ID. NO. 5959  42-ThrAspLeuArgThrLeuArgGln-49
SEQ. ID. NO. 5960  75-ArgAlaLeuArgLeuGluLeuAspGluLeuSer-85
SEQ. ID. NO. 5961  106-IleSerLysAspSer-110
SEQ. ID. NO. 5962  118-ValGlyMetArgLysIleLysMetAspGluValSerGln-130
SEQ. ID. NO. 5963  144-HisPheGluGluLysLysGluThrLysLysIleLys-155
554
AMPHI Regions - AMPHI
SEQ. ID. NO. 5964  35-AlaProThrPheGlnThrProGluThrLeu-44
SEQ. ID. NO. 5965  71-AlaAlaLeuThrGlnLeuMet-77
SEQ. ID. NO. 5966  110-ArgMetPheValArgProGlyAspThrVal-119
SEQ. ID. NO. 5967  124-LeuLeuLysGlyMet-128
SEQ. ID. NO. 5968  148-SerIleGluAsnPheValGlnGlnMetAsnLysGlu-159
SEQ. ID. NO. 5969  193-GluAlaLeuMetArgAspPheProGluTyrTyrProLeuPheSer-207
SEQ. ID. NO. 5970  296-ThrValAlaGlnIle-300
SEQ. ID. NO. 5971  331-GluGlnIleLeuGluThrIleGlnProIleProAla-342
Antigenic Index - Jameson-Wolf
SEQ. ID. NO. 5972  24-SerProAlaProAsnArgProThrVal-32
SEQ. ID. NO. 5973  37-ThrPheGlnThrProGluThr-43
SEQ. ID. NO. 5974  53-LeuGlnSerLysGln-57
SEQ. ID. NO. 5975  61-AlaLysAsnIleAsnThrProValGlu-69
SEQ. ID. NO. 5976  84-LysAsnMetLysSerGlyAsnIleGlnSerGluGluAsnLeuLysIleProGlu-101
SEQ. ID. NO. 5977  104-TrpAlaSerGluGlySerArgMetPheValArgProGlyAspThrValSerThrAspLysLeuLeu-125
SEQ. ID. NO. 5978  143-ArgLeuGlyAsnGlySerIleGluAsnPhe-152
SEQ. ID. NO. 5979  156-MetAsnLysGluAlaAlaArgArgLeuGlyMetLysAsnThrValPheLysAsnProThrGlyLeuSerArgGluGlyGlnValSerThrAlaLysAsp-187
SEQ. ID. NO. 5980  194-AlaLeuMetArgAspPheProGluTyrTyr-203
SEQ. ID. NO. 5981  214-LysAsnIleGluGlnAsnAsnArgAsnIleLeu-224
SEQ. ID. NO. 5982  226-TyrArgAspAsnAsnValAsnGlyLeuLysAlaGlyHisThrGluSerGlyGlyTyrAsn-245
SEQ. ID. NO. 5983  250-TyrSerGlyAsnGlyArgHis-256
SEQ. ID. NO. 5984  262-LeuGlySerGluSerAlaGluThrArgAlaSerAspAsnSerLys-276
SEQ. ID. NO. 5985  285-PheAspThrProLysIleTyrProLysGlyLysThr-296
SEQ. ID. NO. 5986  302-IleSerGlyGlySerLysLysThrValArg-311
SEQ. ID. NO. 5987  323-ProHisLysGluAlaLysMetAlaGluGlnIleLeu-334
SEQ. ID. NO. 5988  342-AlaProValLysLysGlyGlnIleLeuGlyLysIleLysIleArgGlnAsnGlyTyr-360
SEQ. ID. NO. 5989  362-IleAlaGluLysGluIleValAla-369
SEQ. ID. NO. 5990  371-GluAsnValLysLysArgSerArgTrpGlnArg-381
Hydrophilic Regions - Hopp-Woods
SEQ. ID. NO. 5991  26-AlaProAsnArgProThr-31
SEQ. ID. NO. 5992  85-AsnMetLysSerGlyAsnIleGlnSerGluGluAsnLeuLysIleProGlu-101
SEQ. ID. NO. 5993  107-GluGlySerArgMetPheValArgProGlyAspThrValSerThrAspLysLeuLeu-125
SEQ. ID. NO. 5994  156-MetAsnLysGluAlaAlaArgArgLeuGlyMet-165
SEQ. ID. NO. 5995  174-ThrGlyLeuSerArgGluGlyGlnValSerThrAlaLysAsp-187
SEQ. ID. NO. 5996  214-LysAsnIleGluGlnAsnAsnArg-221
SEQ. ID. NO. 5997  227-ArgAspAsnAsnValAsn-232
SEQ. ID. NO. 5998  237-GlyHisThrGluSerGly-242
SEQ. ID. NO. 5999  264-SerGluSerAlaGluThrArgAlaSerAspAsnSerLys-276
SEQ. ID. NO. 6000  289-LysIleTyrProLysGlyLysThr-296
SEQ. ID. NO. 6001  304-GlyGlySerLysLysThrValArg-311
SEQ. ID. NO. 6002  323-ProHisLysGluAlaLysMetAlaGluGlnIleLeu-334
SEQ. ID. NO. 6003  343-ProValLysLysGlyGlnIle-349
SEQ. ID. NO. 6004  353-IleLysIleArgGln-357
SEQ. ID. NO. 6005  362-IleAlaGluLysGluIleValAla-369
SEQ. ID. NO. 6006  371-GluAsnValLysLysArgSerArgTrp-379
556
AMPHI Regions - AMPHI
SEQ. ID. NO. 6007  61-IleGluArgLeuLys-65
Antigenic Index - Jameson-Wolf
SEQ. ID. NO. 6008  1-MetAspAsnLysThrLysLeuArgLeu-9
SEQ. ID. NO. 6009  52-ThrSerArgArgGlnGlnArgGlnPheIleGluArgLeuLysLysPheAspIleAspProGluLysGlyArgIleAsnGluAlaAsnLeuArgArgMet
TyrHisSerGlyGlyGlnHisGlnLysAspAla-95
SEQ. ID. NO. 6010  102-SerGlnLysCysSerValAspGluAlaHisAlaMetPheLysLysArgProThrArgGlnGluIleAsn-124
SEQ. ID. NO. 6011  127-AlaAlaLysGlnSerArgGlyGlnLysArgProHisArg-139
Hydrophilic Regions - Hopp-Woods
SEQ. ID. NO. 6012  1-MetAspAsnLysThrLysLeuArgLeu-9
SEQ. ID. NO. 6013  53-SerArgArgGlnGlnArgGlnPheIleGluArgLeuLysLysPheAspIleAspProGluLysGlyArgIleAsnGluAlaAsnLeuArgArgMet
Tyr-85
SEQ. ID. NO. 6014  90-GlnHisGlnLysAspAla-95
SEQ. ID. NO. 6015  105-CysSerValAspGluAlaHisAlaMetPheLysLysArgProThrArgGlnGluIleAsn-124
SEQ. ID. NO. 6016  127-AlaAlaLysGlnSerArgGlyGlnLysArgProHisArg-139
557
AMPHI Regions - AMPHI
SEQ. ID. NO. 6017  22-GlyAlaAspGlyIle-26
SEQ. ID. NO. 6018  55-SerGlyArgValAspAspAlaAla-62
Antigenic Index - Jameson-Wolf
SEQ. ID. NO. 6019  20-LeuLysGlyAlaAspGlyIleSerProProLeuThrTyrArgSerTrpHisIleGluGlyGlyGlnAlaLeuArg-44
SEQ. ID. NO. 6020  54-AlaSerGlyArgValAspAspAlaAlaGly-63
SEQ. ID. NO. 6021  68-LeuArgIleAspSerValSerGlnAsnLysGluThrTyrThr-81
SEQ. ID. NO. 6022  100-GlnValLeuLysArgGlyGluProValGlyLysProMet-112
SEQ. ID. NO. 6023  123-AlaAspAsnGluIleLeuGlyLysGlnGluGluGluAla-135
SEQ. ID. NO. 6024  141-MetArgGlnAspAlaAlaGluGlnIleValArg-151

TABLE 1-continued

Hydrophilic Regions - Hopp-Woods
SEQ. ID. NO. 6025    21-LysGlyAlaAspGlyIle-26
SEQ. ID. NO. 6026    56-GlyArgValAspAspAlaAlaGly-63
SEQ. ID. NO. 6027    68-LeuArgIleAspSerValSerGlnAsnLysGluThrTyrThr-81
SEQ. ID. NO. 6028    100-GlnValLeuLysArgGlyGluProValGly-109
SEQ. ID. NO. 6029    126-GluIleLeuGlyLysGlnGluGluGluAla-135
SEQ. ID. NO. 6030    141-MetArgGlnAspAlaAlaGluGlnIleValArg-151
560
AMPHI Regions - AMPHI
SEQ. ID. NO. 6031    30-PheArgAspGlyAlaHisLysMetAlaArgValTrpValGly-43
SEQ. ID. NO. 6032    167-ArgMetAlaLysMetPhe-172
SEQ. ID. NO. 6033    192-PheLeuLysTyrProGlyGlu-198
SEQ. ID. NO. 6034    216-GluLeuMetGluLysCysGluHisLeuIleGlu-226
Antigenic Index - Jameson-Wolf
SEQ. ID. NO. 6035    29-ProPheArgAspGlyAlaHisLysMet-37
SEQ. ID. NO. 6036    61-GlyAlaGluAsnIleProAspArgProAla-70
SEQ. ID. NO. 6037    76-HisGlnSerGlyTrpGlu-81
SEQ. ID. NO. 6038    95-ValAlaLysArgGluLeuPhe-101
SEQ. ID. NO. 6039    116-IleGlyIleAspArgAsnAsnArgArgGluAlaAsnGluGlnLeuIle-131
SEQ. ID. NO. 6040    134-GlyLeuValArgLysAsnGluGlyTyr-142
SEQ. ID. NO. 6041    148-ProGluGlyThrArgLeuAlaProGlyLysArgGlyLysTyrLysLeuGlyGly-165
SEQ. ID. NO. 6042    182-AsnSerGlyGluPheTrpProLysAsnSerPheLeuLysTyrProGlyGluIle-199
SEQ. ID. NO. 6043    209-HisAlaSerGlySerGluAlaGluLeuMetGluLysCysGluHisLeuIle-225
SEQ. ID. NO. 6044    242-MetProSerGluThrAla-247
Hydrophilic Regions - Hopp-Woods
SEQ. ID. NO. 6045    29-ProPheArgAspGlyAlaHisLysMet-37
SEQ. ID. NO. 6046    64-AsnIleProAspArgProAla-70
SEQ. ID. NO. 6047    95-ValAlaLysArgGluLeuPhe-101
SEQ. ID. NO. 6048    116-IleGlyIleAspArgAsnAsnArgArgGluAlaAsnGluGlnLeuIle-131
SEQ. ID. NO. 6049    134-GlyLeuValArgLysAsnGlu-140
SEQ. ID. NO. 6050    149-GluGlyThrArgLeuAlaProGlyLysArgGlyLysTyrLysLeuGlyGly-165
SEQ. ID. NO. 6051    211-SerGlySerGluAlaGluLeuMetGluLysCysGluHisLeuIle-225
SEQ. ID. NO. 6052    242-MetProSerGluThrAla-247
561
AMPHI Regions - AMPHI
SEQ. ID. NO. 6053    22-GlyLeuTrpValGlyLeuAlaAla-29
SEQ. ID. NO. 6054    46-AlaSerValIleGluGluAlaGlyAsn-54
SEQ. ID. NO. 6055    79-ValAlaGluPheGluLysSerLeuLysArgIleAlaGln-91
SEQ. ID. NO. 6056    128-SerTyrArgArgProThrGlnVal-135
SEQ. ID. NO. 6057    172-MetThrLeuValSerSer-177
SEQ. ID. NO. 6058    188-ValIleArgProLeuGlnAlaLeuArgGluGlyAlaGluArgIleGlyArgArgCysPheAspIle-209
SEQ. ID. NO. 6059    219-PheLysGlnValGlyArgCysPheAsnGlnMet-229
SEQ. ID. NO. 6060    238-AspAspLeuGluGlyGlnValAlaGluGlnThrArgSerLeuGluLysGln-254
SEQ. ID. NO. 6061    265-ThrArgAspLeuHisGlnSer-271
SEQ. ID. NO. 6062    275-GlnGlnAlaAlaGluHisPhe-281
SEQ. ID. NO. 6063    283-AsnArgIleLeuPro-287
SEQ. ID. NO. 6064    317-AlaSerAspLeuGlyLysTyrHisGlu-325
SEQ. ID. NO. 6065    339-ArgLeuLeuLeuSerPheProAsnGly-347
SEQ. ID. NO. 6066    358-LeuGlnThrLeuGlyArgGlnLeuGly-366
SEQ. ID. NO. 6067    392-GlnGlyLeuHisAspSerIleAlaGlnAlaLeuThr-403
SEQ. ID. NO. 6068    434-GlyValGlnGluCysTyrGluAspValArgGluLeu-445
SEQ. ID. NO. 6069    456-LysGluPheProGluAlaValAlaAspLeuPheAlaArgPhe-469
SEQ. ID. NO. 6070    504-LeuSerAsnIleArgLysHisAlaArg-512
SEQ. ID. NO. 6071    540-ThrGluLysIleGlyGluProThr-547
Antigenic Index - Jameson-Wolf
SEQ. ID. NO. 6072    6-ArgPheSerAspGlyIleSer-12
SEQ. ID. NO. 6073    48-ValIleGluGluAlaGlyAsn-54
SEQ. ID. NO. 6074    66-AlaGlyGluGlySerProArgAlaGlnIleAspAsnGlnValAlaGluPheGluLysSerLeuLysArgIleAlaGlnSerAspAlaIleHisPro-97
SEQ. ID. NO. 6075    99-IleProSerAspThrProLeu-105
SEQ. ID. NO. 6076    124-ProProLeuGlnSerTyrArgArgProThrGlnValAspLeu-137
SEQ. ID. NO. 6077    152-GluAsnAlaAsnGluLysAsnThr-159
SEQ. ID. NO. 6078    193-GlnAlaLeuArgGluGlyAlaGluArgIleGlyArgArgCysPheAsp-208
SEQ. ID. NO. 6079    210-ProValProGluGlyGlyThrProGluPheLysGlnValGlyArgCysPheAsnGlnMetGlyGlyArgLeuLysIleLeuTyrAspAspLeuGluGly
                     GlnValAlaGluGlnThrArgSerLeuGluLysGlnAsnGlnAsnLeu-258
SEQ. ID. NO. 6080    263-GlnThrThrArgAspLeuHisGlnSerTyrIle-273
SEQ. ID. NO. 6081    289-ValGlyAlaAspSerGlyArgValCysLeuAspGlyGlySerAsp-303
SEQ. ID. NO. 6082    310-HisAlaAspCysGlyThrAlaAlaSerAspLeuGlyLysTyrHisGlu-325
SEQ. ID. NO. 6083    332-TyrGlnAsnGluThrLeuGly-338
SEQ. ID. NO. 6084    344-PheProAsnGlyIleSerLeuAspGluAspAspArgIleLeu-357
SEQ. ID. NO. 6085    360-ThrLeuGlyArgGlnLeu-365
SEQ. ID. NO. 6086    371-GlyAlaLysGlnGluGluGluLysArgLeu-380
SEQ. ID. NO. 6087    384-LeuGlnGluArgAsnLeu-389
SEQ. ID. NO. 6088    394-LeuHisAspSerIle-398
SEQ. ID. NO. 6089    415-AlaPheAlaGluAsnLysArgGluGluAlaAlaGlu-426
SEQ. ID. NO. 6090    434-GlyValGlnGluCysTyrGluAspValArgGlu-444
SEQ. ID. NO. 6091    450-ArgThrLysIleSerAsnLysGluPheProGluAlaVal-462
SEQ. ID. NO. 6092    480-AlaTrpGluAsnGlySer-485
SEQ. ID. NO. 6093    488-ProProGlnGluAla-492
SEQ. ID. NO. 6094    503-SerLeuSerAsnIleArgLysHisAlaArg-512
SEQ. ID. NO. 6095    519-ThrLeuSerGluHisGlyGlyArgPhe-527

TABLE 1-continued

| | |
|---|---|
| SEQ. ID. NO. 6096 | 531-IleGlnAspAsnGlyGlnGlyPheAspThrGluLysIleGlyGluProThrGlySerHis-550 |
| SEQ. ID. NO. 6097 | 556-MetGlnGluArgAlaLysArgIle-563 |
| SEQ. ID. NO. 6098 | 568-GluIleArgSerGlnAlaGlnGlnGlyThrThr-578 |
| SEQ. ID. NO. 6099 | 584-AlaSerGluGluSerLeuLys-590 |
| Hydrophilic Regions - Hopp-Woods | |
| SEQ. ID. NO. 6100 | 48-ValIleGluGluAlaGlyAsn-54 |
| SEQ. ID. NO. 6101 | 68-GluGlySerProArgAlaGlnIle-75 |
| SEQ. ID. NO. 6102 | 78-GlnValAlaGluPheGluLysSerLeuLysArgIleAlaGln-91 |
| SEQ. ID. NO. 6103 | 128-SerTyrArgArgProThrGln-134 |
| SEQ. ID. NO. 6104 | 152-GluAsnAlaAsnGluLys-157 |
| SEQ. ID. NO. 6105 | 193-GlnAlaLeuArgGluGlyAlaGluArgIleGlyArgArgCysPhe-207 |
| SEQ. ID. NO. 6106 | 213-GluGlyGlyThrProGluPheLysGlnValGly-223 |
| SEQ. ID. NO. 6107 | 235-IleLeuTyrAspAspLeuGluGlyGlnValAlaGluGlnThrArgSerLeuGluLysGlnAsnGln-256 |
| SEQ. ID. NO. 6108 | 264-ThrThrArgAspLeuHis-269 |
| SEQ. ID. NO. 6109 | 290-GlyAlaAspSerGlyArgValCysLeu-298 |
| SEQ. ID. NO. 6110 | 312-AspCysGlyThrAlaAlaSerAspLeuGlyLysTyrHisGlu-325 |
| SEQ. ID. NO. 6111 | 349-SerLeuAspGluAspArgIleLeu-357 |
| SEQ. ID. NO. 6112 | 371-GlyAlaLysGlnGluGluGluLysArgLeu-380 |
| SEQ. ID. NO. 6113 | 384-LeuGlnGluArgAsnLeu-389 |
| SEQ. ID. NO. 6114 | 415-AlaPheAlaGluAsnLysArgGluGluAlaAlaGlu-426 |
| SEQ. ID. NO. 6115 | 437-GluCysTyrGluAspValArgGlu-444 |
| SEQ. ID. NO. 6116 | 451-ThrLysIleSerAsnLysGluPheProGluAlaVal-462 |
| SEQ. ID. NO. 6117 | 503-SerLeuSerAsnIleArgLysHisAlaArg-512 |
| SEQ. ID. NO. 6118 | 533-AspAsnGlyGlnGlyPheAspThrGluLysIleGlyGluProThrGly-548 |
| SEQ. ID. NO. 6119 | 556-MetGlnGluArgAlaLysArgIle-563 |
| SEQ. ID. NO. 6120 | 568-GluIleArgSerGlnAlaGln-574 |
| SEQ. ID. NO. 6121 | 584-AlaSerGluGluSerLeuLys-590 |
| 562 | |
| AMPHI Regions - AMPHI | |
| SEQ. ID. NO. 6122 | 48-TrpSerLeuValSerAlaTrpMetValValIle-58 |
| SEQ. ID. NO. 6123 | 84-LeuGluThrThrValMetSerAlaValArgThrLeu-95 |
| SEQ. ID. NO. 6124 | 97-PheThrProTyrThrThrValAlaSerThrSer-107 |
| SEQ. ID. NO. 6125 | 116-ThrPhePheAlaProLeuSerArgTrp-124 |
| SEQ. ID. NO. 6126 | 133-AsnAlaProValHisSerMetThrLysSerThrProSerSerPheHis-148 |
| SEQ. ID. NO. 6127 | 184-ValSerAsnLeuValArgTrpAlaLeu-192 |
| Antigenic Index - Jameson-Wolf | |
| SEQ. ID. NO. 6128 | 9-PheAsnSerGlySerThrLysProThr-17 |
| SEQ. ID. NO. 6129 | 32-ProLeuArgAlaArgArgArgSerLeuTrpArg-42 |
| SEQ. ID. NO. 6130 | 72-AlaThrGlyGluArgGlnLeuVal-79 |
| SEQ. ID. NO. 6131 | 105-SerThrSerSerProProGlyAlaGluMet-114 |
| SEQ. ID. NO. 6132 | 139-MetThrLysSerThrProSerSerPheHisGlySerSerAla-152 |
| SEQ. ID. NO. 6133 | 154-LeuArgValGluLysLysGlyIleLeuSerProLeuThr-166 |
| SEQ. ID. NO. 6134 | 168-ArgLeuProProSerTrpAspThrSerAlaSerLysArgProCysThr-183 |
| Hydrophilic Regions - Hopp-Woods | |
| SEQ. ID. NO. 6135 | 33-LeuArgAlaArgArgArgSerLeuTrp-41 |
| SEQ. ID. NO. 6136 | 72-AlaThrGlyGluArgGlnLeuVal-79 |
| SEQ. ID. NO. 6137 | 110-ProGlyAlaGluMet-114 |
| SEQ. ID. NO. 6138 | 140-ThrLysSerThrPro-144 |
| SEQ. ID. NO. 6139 | 154-LeuArgValGluLysLysGlyIle-161 |
| SEQ. ID. NO. 6140 | 176-SerAlaSerLysArgProCysThr-183 |
| 563 | |
| AMPHI Regions - AMPHI | |
| SEQ. ID. NO. 6141 | 24-ThrLysArgGluGlyLys-29 |
| SEQ. ID. NO. 6142 | 120-AsnGlnTyrAlaGlnPhe-125 |
| SEQ. ID. NO. 6143 | 164-ValAsnGlnIleAsnSerSerHisSerSer-173 |
| SEQ. ID. NO. 6144 | 246-AspPheThrArgIleLeuSerTyrHisSer-255 |
| SEQ. ID. NO. 6145 | 290-AlaAlaAsnThrSerAsnAsnThrAla-298 |
| SEQ. ID. NO. 6146 | 313-LysLeuGlyGlyMetTyr-318 |
| SEQ. ID. NO. 6147 | 366-LysAspThrAspAsn-370 |
| SEQ. ID. NO. 6148 | 443-AsnAsnGlnGlyLysLeu-448 |
| SEQ. ID. NO. 6149 | 483-SerSerAsnGlnThrGlyAsn-489 |
| SEQ. ID. NO. 6150 | 516-SerAsnIleThrAlaProThr-522 |
| SEQ. ID. NO. 6151 | 529-ArgThrHisGlyAlaLeuAsp-535 |
| SEQ. ID. NO. 6152 | 551-GlnGlnGlyLeuAsnAsnAlaGlyGlnIle-560 |
| SEQ. ID. NO. 6153 | 611-LeuAspAsnAlaHisGlyLysLeuLeuSerAla-621 |
| SEQ. ID. NO. 6154 | 736-LeuAspAsnAlaAlaGlnGly-742 |
| SEQ. ID. NO. 6155 | 775-GlnMetAsnAsnIleGlyThr-781 |
| SEQ. ID. NO. 6156 | 848-ThrGlyLysAlaGlnArgIleHisAsnAlaGlyAlaThrIleGlu-862 |
| SEQ. ID. NO. 6157 | 874-LeuHisAsnThrAsnGlu-879 |
| SEQ. ID. NO. 6158 | 896-TyrGluAlaPheGlyArg-901 |
| SEQ. ID. NO. 6159 | 922-SerAspHisLeuArgThrProAspGlyAlaAlaHisGluAsnTrp-936 |
| SEQ. ID. NO. 6160 | 953-ThrAlaProAlaLys-957 |
| SEQ. ID. NO. 6161 | 1011-LeuHisSerTyrTrpArg-1016 |
| SEQ. ID. NO. 6162 | 1036-GluGluIleThrArg-1040 |
| SEQ. ID. NO. 6163 | 1131-LeuHisLysArgLeuGlyAspGlyTyr-1139 |
| SEQ. ID. NO. 6164 | 1147-GluGlnIleAlaGluLeuThrGlyHisArgArgLeuAspGlyTyrGlnAsn-1163 |
| SEQ. ID. NO. 6165 | 1169-LysAlaLeuMetAsp-1173 |
| SEQ. ID. NO. 6166 | 1194-GlnValAlaGlnLeu-1198 |
| SEQ. ID. NO. 6167 | 1272-ThrLeuAspAsnIleGlyGly-1278 |
| SEQ. ID. NO. 6168 | 1289-AlaThrGlnAspIleAsnAsnIleGlyGlyMetLeu-1300 |

TABLE 1-continued

| | |
|---|---|
| SEQ. ID. NO. 6169 | 1376-GlnAlaGlyArgAspIle-1381 |
| SEQ. ID. NO. 6170 | 1403-IleArgGlySerThrAsnGluValGlySerSer-1413 |
| SEQ. ID. NO. 6171 | 1461-ValAspAspAlaSerLysHisThrGlyArg-1470 |
| SEQ. ID. NO. 6172 | 1485-SerHisHisGluThr-1489 |
| SEQ. ID. NO. 6173 | 1524-GlnAlaGlyAsnHisVal-1529 |
| SEQ. ID. NO. 6174 | 1539-GlnSerGluThrTyrHisGln-1545 |
| SEQ. ID. NO. 6175 | 1594-LysHisTyrGluGlnIleGlySerThrVal-1603 |
| SEQ. ID. NO. 6176 | 1646-ProValThrAspLeuAla-1651 |
| SEQ. ID. NO. 6177 | 1685-TyrGlnThrGlyLysSerAlaGlnAsnLeuAlaAsnGlyThrThrAsn-1700 |
| SEQ. ID. NO. 6178 | 1777-GluGlnSerAsnThrGluArgGlyGln-1785 |
| SEQ. ID. NO. 6179 | 1811-GlyGlyAsnValGlyLysGlyTyrGly-1819 |
| SEQ. ID. NO. 6180 | 1964-LysAsnHisSerGlnTyr-1969 |
| SEQ. ID. NO. 6181 | 1987-LeuGlyGlnGlyAlaGlnAsnLysProGln-1996 |
| SEQ. ID. NO. 6182 | 2064-ThrAspThrAlaGluArgHisSerGlySerLeuLysAsnThrPheAsn-2079 |
| SEQ. ID. NO. 6183 | 2093-ValSerGlnAspPheSerLysAsnValGln-2102 |
| SEQ. ID. NO. 6184 | 2161-IleLeuAsnMetLeuAlaSerGlyLeuAla-2170 |
| SEQ. ID. NO. 6185 | 2193-GlyGlnHisPheLysAspLeuAlaGly-2201 |
| SEQ. ID. NO. 6186 | 2223-LeuGlyAlaAlaValAla-2228 |
| SEQ. ID. NO. 6187 | 2275-AlaIleThrAsnValLeuGlyThrAlaThrGly-2285 |
| SEQ. ID. NO. 6188 | 2289-GlyAsnSerAlaThrAspAlaAla-2296 |
| SEQ. ID. NO. 6189 | 2332-HisLysAspProGly-2336 |
| SEQ. ID. NO. 6190 | 2379-IleThrArgGluPheGlyLysAspIleAla-2388 |
| SEQ. ID. NO. 6191 | 2393-AsnSerHisGluSer-2397 |
| SEQ. ID. NO. 6192 | 2414-AlaAspGluMetIleAspGlnLeuAsnAsnGluIle-2425 |
| Antigenic Index - Jameson-Wolf | |
| SEQ. ID. NO. 6193 | 1-MetAsnLysThrLeu-5 |
| SEQ. ID. NO. 6194 | 9-IlePheAsnArgLysArgGlyAlaVal-17 |
| SEQ. ID. NO. 6195 | 22-GluThrThrLysArgGluGlyLysSerCysAlaAspSerAspSerGlySerAlaHis-40 |
| SEQ. ID. NO. 6196 | 83-IleIleAlaAspLysAlaAlaProLysThrGlnGln-94 |
| SEQ. ID. NO. 6197 | 127-ValGlyAsnArgGlyAlaIleLeuAsnAsnSerArgSerAsnThrGlnThr-143 |
| SEQ. ID. NO. 6198 | 152-AsnProTrpLeuAla-156 |
| SEQ. ID. NO. 6199 | 158-GlyGluAlaArgVal-162 |
| SEQ. ID. NO. 6200 | 167-IleAsnSerSerHisSerSerGlnMetAsnGly-177 |
| SEQ. ID. NO. 6201 | 179-IleGluValGlyGlyArgArgAlaGluVal-188 |
| SEQ. ID. NO. 6202 | 205-AsnAlaSerArgAlaThrLeu-211 |
| SEQ. ID. NO. 6203 | 213-ThrGlyGlnProGlnTyrGlnAlaGlyAspLeuSerGlyPheLysIleArgGlnGlyAsn-232 |
| SEQ. ID. NO. 6204 | 239-GlyLeuAspAlaArgAspThrAspPhe-247 |
| SEQ. ID. NO. 6205 | 252-SerTyrHisSerLysIleAspAla-259 |
| SEQ. ID. NO. 6206 | 264-GlnAspValArgVal-268 |
| SEQ. ID. NO. 6207 | 292-AsnThrSerAsnAsnThrAlaAsnAsnGlyThr-302 |
| SEQ. ID. NO. 6208 | 310-AspThrGlyLysLeuGlyGly-316 |
| SEQ. ID. NO. 6209 | 331-AlaGlyIleArgAsnGlnGlyGlnLeu-339 |
| SEQ. ID. NO. 6210 | 349-AspAlaAsnGlyArgLeuValAsn-356 |
| SEQ. ID. NO. 6211 | 364-AsnAlaLysAspThrAspAsnThrAlaGluHisLysValAsnIleArgSerGlnGlyValGluAsnSerGlyThrAlaValSerGlnGlnGlyThrGln IleHis-398 |
| SEQ. ID. NO. 6212 | 400-GlnSerIleGlnAsnThr-405 |
| SEQ. ID. NO. 6213 | 418-AsnSerGlySerLeuLysAsnGluThrSerGlyThrIleGluAlaAlaArgLeuAlaIleAspThrAspThrLeuAsnAsnGlnGlyLysLeuSerGln ThrGlySerGlnLysLeuHisIle-458 |
| SEQ. ID. NO. 6214 | 460-AlaGlnGlyLysMetProAsnArgGlyArgMetGlyLeuGlnAspThrAlaProThrAlaSerAsnGlySerSerAsnGlnThrGlyAsnSerTyr-491 |
| SEQ. ID. NO. 6215 | 497-SerSerThrThrThrProThrThr-504 |
| SEQ. ID. NO. 6216 | 522-ThrPheAlaAspGlyThrIleArgThrHisGlyAlaLeuAspAsnSerGlySer-539 |
| SEQ. ID. NO. 6217 | 542-AlaAsnGlyGlnThrAspValSerAla-550 |
| SEQ. ID. NO. 6218 | 552-GlnGlyLeuAsnAsnAlaGlyGln-559 |
| SEQ. ID. NO. 6219 | 566-AsnAlaLysGlySerAla-571 |
| SEQ. ID. NO. 6220 | 573-AspAsnHisAsnGly-577 |
| SEQ. ID. NO. 6221 | 589-GlySerLeuAsnAsnGlnAsnGlyAsnIleThrThrArgGlnGlnLeuGluIleGluThrAspGlnLeuAspAsnAlaHisGly-616 |
| SEQ. ID. NO. 6222 | 631-SerLeuAsnAsnGlnAsnGlyGluIleAlaThrAsn-642 |
| SEQ. ID. NO. 6223 | 646-IleIleHisAspGlyGlnGlnSer-653 |
| SEQ. ID. NO. 6224 | 659-AsnThrAsnGlyThrIleGlnSerGlyArgAspValAlaIle-672 |
| SEQ. ID. NO. 6225 | 675-LysSerLeuSerAsnAsnGly-681 |
| SEQ. ID. NO. 6226 | 685-AlaAspAsnLysLeuAspIleAlaLeu-693 |
| SEQ. ID. NO. 6227 | 695-AspAspPheTyrValGlu-700 |
| SEQ. ID. NO. 6228 | 702-AsnIleValAlaGlyAsnGluLeu-709 |
| SEQ. ID. NO. 6229 | 711-LeuSerThrArgGlySerLeuLysAsnSerHisThr-722 |
| SEQ. ID. NO. 6230 | 725-AlaGlyLysArgIleArgIleLysAlaAsnAsnLeuAspAsnAlaAlaGlnGlyAsnIleGlnSerGlyGlyThrThrAspIleGlyThrGlnHisAsn LeuThrAsnArgGlyLeuIleAspGlyGlnGlnThrLysIleGln-772 |
| SEQ. ID. NO. 6231 | 793-AlaThrArgLeuAspAsnAsnGlnAspGluAsnGlyThrGly-805 |
| SEQ. ID. NO. 6232 | 809-AlaAlaArgGluAsnLeuAsn-815 |
| SEQ. ID. NO. 6233 | 821-LeuAsnAsnArgGluAsnSerLeu-828 |
| SEQ. ID. NO. 6234 | 839-GlyAlaLeuAspThrAsnGlyGlnAlaThrGlyLysAlaGlnArgIleHisAsnAlaGlyAla-859 |
| SEQ. ID. NO. 6235 | 863-AlaAlaGlyLysMetArgLeuGlyValGluLysLeuHisAsnThrAsnGluHisLeuLys-882 |
| SEQ. ID. NO. 6236 | 887-GluThrGlyArgGluHisIleVal-894 |
| SEQ. ID. NO. 6237 | 903-GluLeuLeuArgGluGlyThrGlnHis-911 |
| SEQ. ID. NO. 6238 | 917-ValTyrAsnAspGluSerAspHisLeuArgThrProAspGlyAlaAlaHis-933 |
| SEQ. ID. NO. 6239 | 937-HisLysTyrAspTyrGluLysValThrGlnLysThrGlnVal-950 |
| SEQ. ID. NO. 6240 | 960-SerGlyAsnAspLeuThrIleAspGlyLysGluValPheAsnThrAspSer-976 |
| SEQ. ID. NO. 6241 | 987-GlnThrGluLysAspGlyLeuHisAsnGluGlnThrPheGlyLysLysValPheSerGluAsnGlyLysLeuHisSerTyrTrpArgGluLysHis LysGlyArgAspSerThrGlyHisSerGluGlnAsnTyrThrLeuProGluGluIleThrArgAsn-1041 |
| SEQ. ID. NO. 6242 | 1050-GluSerHisArgLysAlaLeu-1056 |
| SEQ. ID. NO. 6243 | 1059-HisAlaProSerGlnGlyThrGluLeuProGlnSerAsnGlyIle-1073 |

TABLE 1-continued

| SEQ. ID. NO. 6244 | 1100-TyrLeuValGluThrAspProArgPheAlaAsn-1110 |
|---|---|
| SEQ. ID. NO. 6245 | 1124-LeuLysLeuAspProAsnAsnLeuHisLysArgLeuGlyAspGlyTyrTyrGluGlnArgLeuIleAsn-1146 |
| SEQ. ID. NO. 6246 | 1153-ThrGlyHisArgArgLeuAspGlyTyrGlnAsnAspGluGluGlnPheLysAlaLeuMetAspAsnGlyAlaThrAlaAlArgSerMetAsn-1183 |
| SEQ. ID. NO. 6247 | 1208-LysGluValLysLeuProAspGlyGlyThr-1217 |
| SEQ. ID. NO. 6248 | 1228-ArgValLysAsnGlyAspIleAspGlyLysGly-1238 |
| SEQ. ID. NO. 6249 | 1252-GlySerLeuLysAsSerGlyThrIleAlaGlyArgAsnAla-1265 |
| SEQ. ID. NO. 6250 | 1269-AsnThrAspThrLeuAspAsnIleGlyGly-1278 |
| SEQ. ID. NO. 6251 | 1280-IleHisAlaGlnLysSerAla-1286 |
| SEQ. ID. NO. 6252 | 1310-AlaGlyAsnAsnIleAsnSerGlnSerThrThrAlaSerSerGlnAsnThrGlnGlySerSerThrTyrLeu-1333 |
| SEQ. ID. NO. 6253 | 1342-ThrGlyLysGluLysGlyVal-1348 |
| SEQ. ID. NO. 6254 | 1353-AlaGlyLysAspIleAsnIle-1359 |
| SEQ. ID. NO. 6255 | 1364-IleSerAsnGlnSerGluGlnGlyGlnThrArgLeuGlnAlaGlyArgAspIleAsnLeuAspThrValGlnThrSerLysHisGln-1392 |
| SEQ. ID. NO. 6256 | 1396-PheAspAlaAspAsnHisValIleArgGlySerThrAsnGluValGlySerSerIleGlnThrLysGlyAspVal-1420 |
| SEQ. ID. NO. 6257 | 1425-GlyAsnAsnLeuAsnAlaLysAlaAlaGluValSerSerAlaAsnGly-1440 |
| SEQ. ID. NO. 6258 | 1446-AlaLysAsnAspIle-1450 |
| SEQ. ID. NO. 6259 | 1459-ThrHisValAspAspAlaSerLysHisThrGlyArgSerGlyGlyGlyAsnLysLeuValIle-1479 |
| SEQ. ID. NO. 6260 | 1481-AspLysAlaGlnSerHisHisGluThrAlaGlnSerSerThrPheGluGlyLysGln-1499 |
| SEQ. ID. NO. 6261 | 1503-GlnAlaGlyAsnAspAlaAsn-1509 |
| SEQ. ID. NO. 6262 | 1515-ValIleSerAspAsnGlyThrGlnIleGlnAla-1525 |
| SEQ. ID. NO. 6263 | 1532-GlyThrThrGlnThrGlnSerGlnSerGluThrTyrHisGlnThrGlnLysSerGlyLeu-1551 |
| SEQ. ID. NO. 6264 | 1561-GlySerLysThrAsnThrGlnGluAsnGlnSerAsnGluHisThrGlySerThrValGlySerLeuLysGlyAspThrThrIle-1590 |
| SEQ. ID. NO. 6265 | 1592-AlaGlyLysHisTyrGluGlnIle-1599 |
| SEQ. ID. NO. 6266 | 1603-ValSerSerProGluGlyAsnAsn-1610 |
| SEQ. ID. NO. 6267 | 1621-AlaAlaHisAsnLysLeuAsnSerAsnThrThrGlnThrTyrGluGlnLysGlyLeu-1639 |
| SEQ. ID. NO. 6268 | 1659-GlnSerSerLysGlnValGlyGlnSerLysAsnAspArgValAsn-1673 |
| SEQ. ID. NO. 6269 | 1684-AlaTyrGlnThrGlyLysSerAlaGln-1692 |
| SEQ. ID. NO. 6270 | 1694-LeuAlaAsnGlyThrThrAsnAlaLys-1702 |
| SEQ. ID. NO. 6271 | 1710-TyrGlyGluGlnGlnAsnArgGlnThrThrGln-1720 |
| SEQ. ID. NO. 6272 | 1729-SerGlnIleGlnAlaGlyGlyLysThrThr-1738 |
| SEQ. ID. NO. 6273 | 1744-AlaAlaGluGlnSerAsn-1749 |
| SEQ. ID. NO. 6274 | 1754-GlySerAspValAlaGlyLys-1760 |
| SEQ. ID. NO. 6275 | 1767-AlaAspAsnAspIleThr-1772 |
| SEQ. ID. NO. 6276 | 1774-GlnSerAlaGluGlnSerAsnThrGluArgGlyGlnAsnLysSerAlaGlyTrpAsn-1792 |
| SEQ. ID. NO. 6277 | 1812-GlyAsnValGlyLysGlyTyrGlyAsnGlyAspSerIleThrHisArgHisSerHisIleGlyAspLysGlySer-1836 |
| SEQ. ID. NO. 6278 | 1841-GlnSerGlyGlyAspThrThrIleLys-1849 |
| SEQ. ID. NO. 6279 | 1851-AlaGlnValArgGlyLysGlyValGlnValAsnAlaLysAsn-1864 |
| SEQ. ID. NO. 6280 | 1869-SerValGlnAspArgGlu1874ThrTyrGlnSerLysGlnGlnAsnAla-1883 |
| SEQ. ID. NO. 6281 | 1895-AlaGlyGlyAspTyrSerGlnSerLysIleArgAlaAspHis-1908 |
| SEQ. ID. NO. 6282 | 1912-ThrGluGlnSerGlyIleTyrAlaGlyGluAspGlyTyrGln-1925 |
| SEQ. ID. NO. 6283 | 1929-GlyAsnHisThrAspLeuLysGlyGlyIle-1938 |
| SEQ. ID. NO. 6284 | 1942-ThrGlnSerAlaGluAspLysGlyLyAsnArgPheGln-1954 |
| SEQ. ID. NO. 6285 | 1959-ThrHisSerAspIleLysAsnHisSerGlnTyrLysGlyGluSerPheGly-1975 |
| SEQ. ID. NO. 6286 | 1982-IleSerGlyLysThrLeuGlyGlnGlyAlaGlnAsnLysProGlnAsnLysHis-1999 |
| SEQ. ID. NO. 6287 | 2003-ValAlaAspLysAsnSerAlaSer Ser-2011 |
| SEQ. ID. NO. 6288 | 2014-GlyTyrGlySerAspSerAspSerGlnSerSerIleThrLysSerGlyIleAsnThrArgAsn-2034 |
| SEQ. ID. NO. 6289 | 2036-GlnIleThrAspGluAlaAlaGln-2043 |
| SEQ. ID. NO. 6290 | 2045-ArgLeuThrGlyLysThrAlaAlaGlnThrLyAlaAspIleAspThrAsnValThrThrAspThrAlaGluArgHisSerGlySerLeuLysAsnThr PheAsnLysGluAlaValGlnSerGluLeuAspLeuGlnArgThrValSerGlnAspPheSerLysAsnValGlnGlnAlaAsnThrGluIle-2108 |
| SEQ. ID. NO. 6291 | 2110-GlnHisLeuAspLysLeuLysAlaAspLysGluAlaAlaGluThrAlaAla-2126 |
| SEQ. ID. NO. 6292 | 2131-AlaAsnGlyAspMetGluThrAlaLysArgLysAlaHisGluAlaGlnAspAlaAlaLysAlaAspAsnTrpGlnGln-2157 |
| SEQ. ID. NO. 6293 | 2172-ProThrGlnSerGly-2176 |
| SEQ. ID. NO. 6294 | 2195-HisPheLysAspLeuAlaGlyGlnAsnAlaAsnGlyLysLeuThrAlaSerGlnGluThr-2214 |
| SEQ. ID. NO. 6295 | 2231-GlyAspAsnAsnAla-2235 |
| SEQ. ID. NO. 6296 | 2241-SerAlaGlyGlySerGluAla-2247 |
| SEQ. ID. NO. 6297 | 2256-LeuTyrGlyLysGluLysGlySerAspLeuThrAlaGluGluLysGluThrVal-2273 |
| SEQ. ID. NO. 6298 | 2288-ValGlyAsnSerAlaThrAspAlaAlaGlnGlySerLeuAsnAla-2302 |
| SEQ. ID. NO. 6299 | 2304-SerAlaValGluAsnAsnAspThrValGluGlnVal-2315 |
| SEQ. ID. NO. 6300 | 2319-LeuArgHisProArg-2323 |
| SEQ. ID. NO. 6301 | 2331-ValHisLysAspProGlySerThrLeuGluProAsnIle-2343 |
| SEQ. ID. NO. 6302 | 2355-PheProAsnSerGluPheGlyGlyGluGlyGlyVal-2366 |
| SEQ. ID. NO. 6303 | 2379-IleThrArgGluPheGlyLysAspIleAlaVal-2389 |
| SEQ. ID. NO. 6304 | 2391-ValGlyAsnSerHisGluSerGlyGluLysIleAsnTyrSerIleArgArgAsnLeuSerLeuAspLysAlaAspGluMetIleAsp-2419 |
| SEQ. ID. NO. 6305 | 2421-LeuAsnAsnGluIleGlyArgGluIleAla-2430 |
| SEQ. ID. NO. 6306 | 2432-AsnThrAsnArgLeuAsnThrLysGluLeu-2441 |
| SEQ. ID. NO. 6307 | 2447-GluThrTyrLysAsnAsnGlyPhe-2454 |
| SEQ. ID. NO. 6308 | 2456-GlnAlaGluArgAsnSerAsnGlyAsnTyrAspValValArgLysArgLeuSerGluLysAspTyrGlnAsnThrSerAsn-2482 |
| SEQ. ID. NO. 6309 | 2496-IleGlnGlnArgArgLysGlnIleArg-2504 |
| SEQ. ID. NO. 6310 | 2510-ArgGlnTrpArgArg-2514 |
| Hydrophilic Regions - Hopp-Woods | |
| SEQ. ID. NO. 6311 | 10-PheAsnArgLysArgGlyAla-16 |
| SEQ. ID. NO. 6312 | 22-GluThrThrLysArgGluGlyLysSerCysAlaAspSerAspSerGlySerAlaHis-40 |
| SEQ. ID. NO. 6313 | 83-IleIleAlaAspLysAlaAlaProLysThrGlnGln-94 |
| SEQ. ID. NO. 6314 | 136-AsnSerArgSerAsnThr-141 |
| SEQ. ID. NO. 6315 | 158-GlyGluAlaArgVal-162 |
| SEQ. ID. NO. 6316 | 181-ValGlyGlyArgArgAlaGluVal-188 |
| SEQ. ID. NO. 6317 | 224-SerGlyPheLysIleArgGln-230 |
| SEQ. ID. NO. 6318 | 240-LeuAspAlaArgAspThrAspPhe-247 |
| SEQ. ID. NO. 6319 | 331-AlaGlyIleArgAsn-335 |
| SEQ. ID. NO. 6320 | 364-AsnAlaLysAspThrAspAsnThrAlaGluHisLysValAsnIleArgSerGlnGlyValGluAsnSerGly-387 |
| SEQ. ID. NO. 6321 | 420-GlySerLeuLysAsnGluThrSerGlyThrIleGluAlaAlaArgLeuAlaIleAspThrAspThrLeuAsnAsn-444 |

TABLE 1-continued

| | |
|---|---|
| SEQ. ID. NO. 6322 | 446-GlyLysLeuSerGln-450 |
| SEQ. ID. NO. 6323 | 460-AlaGlnGlyLysMetAspAsnArgGlyArgMetGlyLeu-472 |
| SEQ. ID. NO. 6324 | 481-AsnGlySerSerAsnGlnThr-487 |
| SEQ. ID. NO. 6325 | 534-LeuAspAsnSerGly-538 |
| SEQ. ID. NO. 6326 | 544-GlyGlnThrAspValSerAla-550 |
| SEQ. ID. NO. 6327 | 602-GlnGlnLeuGluIleGluThrAspGlnLeuAspAsnAlaHis-615 |
| SEQ. ID. NO. 6328 | 635-GlnAsnGlyGluIleAlaThr-641 |
| SEQ. ID. NO. 6329 | 665-GlnSerGlyArgAspValAlaIle-672 |
| SEQ. ID. NO. 6330 | 685-AlaAspAsnLysLeuAspIleAlaLeu-693 |
| SEQ. ID. NO. 6331 | 715-GlySerLeuLysAsn-719 |
| SEQ. ID. NO. 6332 | 725-AlaGlyLysArgIleArgIleLysAlaAsnAsnLeuAspAsnAlaAla-740 |
| SEQ. ID. NO. 6333 | 767-GlnGlnThrLysIleGln-772 |
| SEQ. ID. NO. 6334 | 794-ThrArgLeuAspAsnGlnAspGluAsnGlyThr-804 |
| SEQ. ID. NO. 6335 | 809-AlaAlaArgGluAsnLeu-814 |
| SEQ. ID. NO. 6336 | 822-AsnAsnArgGluAsnSer-827 |
| SEQ. ID. NO. 6337 | 841-LeuAspThrAsnGly-845 |
| SEQ. ID. NO. 6338 | 847-AlaThrGlyLysAlaGlnArgIleHis-855 |
| SEQ. ID. NO. 6339 | 863-AlaAlaGlyLysMetArgLeuGlyValGluLysLeuHisAsnThrAsnGluHisLeuLys-882 |
| SEQ. ID. NO. 6340 | 887-GluThrGlyArgGluHisIleVal-894 |
| SEQ. ID. NO. 6341 | 903-GluLeuLeuArgGluGlyThrGlnHis-911 |
| SEQ. ID. NO. 6342 | 919-AsnAspGluSerAspHisLeuArgThrProAspGlyAlaAla-932 |
| SEQ. ID. NO. 6343 | 939-TyrAspTyrGluLysValThrGln-946 |
| SEQ. ID. NO. 6344 | 964-LeuThrIleAspGlyLysGluValPheAsn-973 |
| SEQ. ID. NO. 6345 | 987-GlnThrGluLysAspGlyLeuHisAsn-995 |
| SEQ. ID. NO. 6346 | 998-ThrPheGlyGluLysLysValPheSerGluAsnGlyLys-1010 |
| SEQ. ID. NO. 6347 | 1015-TrpArgGluLysHisLysGlyArgAspSerThrGlyHisSerGluGln-1030 |
| SEQ. ID. NO. 6348 | 1036-GluGluIleThrArg-1040 |
| SEQ. ID. NO. 6349 | 1050-GluSerHisArgLysAlaLeu-1056 |
| SEQ. ID. NO. 6350 | 1063-GlnGlyThrGluLeuProGln-1069 |
| SEQ. ID. NO. 6351 | 1104-ThrAspProArgPheAlaAsn-1110 |
| SEQ. ID. NO. 6352 | 1124-LeuLysLeuAspPro-1128 |
| SEQ. ID. NO. 6353 | 1130-AsnLeuHisLysArgLeuGly-1136 |
| SEQ. ID. NO. 6354 | 1153-ThrGlyHisArgArgLeuAspGlyTyrGlnAsnAspGluGluGlnPheLysAlaLeuMet-1172 |
| SEQ. ID. NO. 6355 | 1175-GlyAlaThrAlaAlaArg-1180 |
| SEQ. ID. NO. 6356 | 1208-LysGluValLysLeuProAspGlyGlyThr-1217 |
| SEQ. ID. NO. 6357 | 1229-ValLysAsnGlyAspIleAspGlyLysGly-1238 |
| SEQ. ID. NO. 6358 | 1252-GlySerLeuLysAsn-1256 |
| SEQ. ID. NO. 6359 | 1280-IleHisAlaGlnLysSerAla-1286 |
| SEQ. ID. NO. 6360 | 1324-GlnAsnThrGlnGly-1328 |
| SEQ. ID. NO. 6361 | 1343-GlyLysGluLysGlyVal-1348 |
| SEQ. ID. NO. 6362 | 1353-AlaGlyLysAspIleAsn-1358 |
| SEQ. ID. NO. 6363 | 1366-AsnGlnSerGluGlnGlyGlnThrArgLeuGlnAlaGlyArgAspIleAsnLeu-1383 |
| SEQ. ID. NO. 6364 | 1387-GlnThrSerLysHisGln-1392 |
| SEQ. ID. NO. 6365 | 1396-PheAspAlaAspAsnHisVal-1402 |
| SEQ. ID. NO. 6366 | 1406-SerThrAsnGluValGlySer-1412 |
| SEQ. ID. NO. 6367 | 1414-IleGlnThrLysGlyAspVal-1420 |
| SEQ. ID. NO. 6368 | 1428-LeuAsnAlaLysAlaAlaGluValSerSer-1437 |
| SEQ. ID. NO. 6369 | 1446-AlaLysAsnAspIle-1450 |
| SEQ. ID. NO. 6370 | 1460-HisValAspAspAlaSerLysHisThrGlyArgSerGlyGlyGly-1474 |
| SEQ. ID. NO. 6371 | 1481-AspLysAlaGlnSerHisHisGluThrAlaGln-1491 |
| SEQ. ID. NO. 6372 | 1493-SerThrPheGluGlyLysGln-1499 |
| SEQ. ID. NO. 6373 | 1537-GlnSerGlnSerGluThr-1542 |
| SEQ. ID. NO. 6374 | 1562-SerLysThrAsnThrGlnGluAsnGlnSerGlnSerAsnGluHisThrGly-1578 |
| SEQ. ID. NO. 6375 | 1584-LeuLysGlyAspThr-1588 |
| SEQ. ID. NO. 6376 | 1604-SerSerProGluGlyAsn-1609 |
| SEQ. ID. NO. 6377 | 1621-AlaAlaHisAsnLysLeuAsnSer-1628 |
| SEQ. ID. NO. 6378 | 1634-TyrGluGlnLysGly-1638 |
| SEQ. ID. NO. 6379 | 1659-GlnSerSerLysGlnValGlyGlnSerLysAsnAspArgValAsn-1673 |
| SEQ. ID. NO. 6380 | 1686-GlnThrGlyLysSerAlaGln-1692 |
| SEQ. ID. NO. 6381 | 1712-GluGlnGlnAsnArgGlnThrThr-1719 |
| SEQ. ID. NO. 6382 | 1744-AlaAlaGluGlnSerAsn-1749 |
| SEQ. ID. NO. 6383 | 1756-AspValAlaGlyLys-1760 |
| SEQ. ID. NO. 6384 | 1767-AlaAspAsnAspIle-1771 |
| SEQ. ID. NO. 6385 | 1775-SerAlaGluGlnSerAsnThrGluArgGlyGlnAsnLys-1787 |
| SEQ. ID. NO. 6386 | 1822-AspSerIleThrHis-1826 |
| SEQ. ID. NO. 6387 | 1830-HisIleGlyAspLysGlySer-1836 |
| SEQ. ID. NO. 6388 | 1843-GlyGlyAspThrThrIleLys-1849 |
| SEQ. ID. NO. 6389 | 1851-AlaGlnValArgGlyLysGlyVal-1858 |
| SEQ. ID. NO. 6390 | 1869-SerValGlnAspArgGluThrTyrGlnSerLysGlnGlnAsnAla-1883 |
| SEQ. ID. NO. 6391 | 1897-GlyAspTyrSerGlnSerLysIleArgAlaAspHis-1908 |
| SEQ. ID. NO. 6392 | 1919-AlaGlyGluAspGlyTyrGln-1925 |
| SEQ. ID. NO. 6393 | 1932-ThrAspLeuLysGly-1936 |
| SEQ. ID. NO. 6394 | 1943-GlnSerAlaGluAspLysGlyLysAsnArgPhe-1953 |
| SEQ. ID. NO. 6395 | 1961-SerAspIleLysAsn-1965 |
| SEQ. ID. NO. 6396 | 1967-SerGlnTyrLysGlyGluSer-1973 |
| SEQ. ID. NO. 6397 | 1991-AlaGlnAsnLysProGlnAsnLysHis-1999 |
| SEQ. ID. NO. 6398 | 2003-ValAlaAspLysAsnSerAla-2009 |
| SEQ. ID. NO. 6399 | 2017-SerAspSerAspSerGlnSerSerIleThr-2026 |
| SEQ. ID. NO. 6400 | 2036-GlnIleThrAspGluAlaAlaGln-2043 |
| SEQ. ID. NO. 6401 | 2050-ThrAlaAlaGlnThrLysAlaAspIleAspThr-2060 |

TABLE 1-continued

| | |
|---|---|
| SEQ. ID. NO. 6402 | 2065-AspThrAlaGluArgHisSerGlySerLeu-2074 |
| SEQ. ID. NO. 6403 | 2077-ThrPheAsnLysGluAlaValGlnSerGluLeuAspLeuGlnArg-2091 |
| SEQ. ID. NO. 6404 | 2104-AlaAsnThrGluIle-2108 |
| SEQ. ID. NO. 6405 | 2110-GlnHisLeuAspLysLeuLysAlaAspLysGluAlaAlaGluThrAlaAla-2126 |
| SEQ. ID. NO. 6406 | 2133-GlyAspMetGluThrAlaLysArgLysAlaHisGluAlaGlnAspAlaAlaAlaLysAlaAspAsn-2154 |
| SEQ. ID. NO. 6407 | 2195-HisPheLysAspLeuAlaGly-2201 |
| SEQ. ID. NO. 6408 | 2208-LeuThrAlaSerGlnGluThr-2214 |
| SEQ. ID. NO. 6409 | 2243-GlyGlySerGluAla-2247 |
| SEQ. ID. NO. 6410 | 2257-TyrGlyLysGluLysGlySerAspLeuThrAlaGluGluLysGluThrVal-2273 |
| SEQ. ID. NO. 6411 | 2291-SerAlaThrAspAlaAlaGln-2297 |
| SEQ. ID. NO. 6412 | 2304-SerAlaValGluAsnAsnAspThrValGluGlnVal-2315 |
| SEQ. ID. NO. 6413 | 2319-LeuArgHisProArg-2323 |
| SEQ. ID. NO. 6414 | 2331-ValHisLysAspProGlySerThrLeu-2339 |
| SEQ. ID. NO. 6415 | 2379-IleThrArgGluPheGlyLys-2385 |
| SEQ. ID. NO. 6416 | 2393-AsnSerHisGluSerGlyGluLysIleAsnTyrSerIleArgArgAsnLeuSerLeuAspLysAlaAspGluMetIleAsp-2419 |
| SEQ. ID. NO. 6417 | 2424-GluIleGlyArgGluIleAla-2430 |
| SEQ. ID. NO. 6418 | 2435-ArgLeuAsnThrLysGluLeu-2441 |
| SEQ. ID. NO. 6419 | 2456-GlnAlaGluArgAsnSerAsnGly-2463 |
| SEQ. ID. NO. 6420 | 2466-AspValValArgLysArgLeuSerGluLysAspTyrGlnAsn-2479 |
| SEQ. ID. NO. 6421 | 2496-IleGlnGlnArgArgLysGlnIleArg-2504 |
| SEQ. ID. NO. 6422 | 2510-ArgGlnTrpArgArg-2514 |
| 564-2 | |
| AMPHIRegions - AMPHI | |
| SEQ. ID. NO. 6423 | 6-TyrLysValValPhe-10 |
| SEQ. ID. NO. 6424 | 25-LysArgGluGlyLysAsnThr-31 |
| SEQ. ID. NO. 6425 | 40-LeuProAsnAspIleAlaGlyPheAlaGlyPheIleHisSerIleSer-55 |
| SEQ. ID. NO. 6426 | 118-AsnGlnTyrAlaGlnPhe-123 |
| SEQ. ID. NO. 6427 | 162-ValAsnGlnIleAsnSerSerHisSerSerGlnLeuAsn-174 |
| SEQ. ID. NO. 6428 | 244-AspTyrThrArgIleLeuSerTyrHisSer-253 |
| SEQ. ID. NO. 6429 | 288-AlaAlaAsnThrSerAsnAsnThrAla-296 |
| SEQ. ID. NO. 6430 | 311-LysLeuGlyGlyMetTyr-316 |
| SEQ. ID. NO. 6431 | 322-LeuIleSerThrValGluGln-328 |
| SEQ. ID. NO. 6432 | 390-SerGlnThrLeuAsp-394 |
| SEQ. ID. NO. 6433 | 407-ValArgAsnLeuGlyArgLeuLysAsnGlnAsn-417 |
| SEQ. ID. NO. 6434 | 433-LeuAspAsnThrGlyAsnIleThrGlnThrGly-443 |
| SEQ. ID. NO. 6435 | 449-LeuValSerAlaGlyLysPheAspAsnSer-458 |
| SEQ. ID. NO. 6436 | 478-IleProGlnIleProSerThr-484 |
| SEQ. ID. NO. 6437 | 518-IleGlnThrThrGlyAlaPheAspAsnAlaGlySerIleAsnAla-532 |
| SEQ. ID. NO. 6438 | 561-SerPheAsnAsnThrValLys-567 |
| SEQ. ID. NO. 6439 | 600-LeuHisAsnAlaGly-604 |
| SEQ. ID. NO. 6440 | 638-GlyLeuHisAsnAlaGly-643 |
| SEQ. ID. NO. 6441 | 658-LeuArgAsnThrGlyLysVal-664 |
| SEQ. ID. NO. 6442 | 736-LeuTyrAsnGlnHisGly-741 |
| SEQ. ID. NO. 6443 | 765-AspGlyThrIleGlnSerAla-771 |
| SEQ. ID. NO. 6444 | 841-AspAsnGlnValThrGlyLys-847 |
| SEQ. ID. NO. 6445 | 871-AspGlyLeuThrHisIleGlyAlaGly-879 |
| SEQ. ID. NO. 6446 | 882-LeuThrAsnThrGlyThrGlyLysIleTyr-891 |
| SEQ. ID. NO. 6447 | 958-AlaGlyMetAlaAspThrPheVal-965 |
| SEQ. ID. NO. 6448 | 980-SerValArgAsnMetGlnAsnIleAsnAsnHis-990 |
| SEQ. ID. NO. 6449 | 1000-AlaGluLysGlnVal-1004 |
| SEQ. ID. NO. 6450 | 1125-ThrGlnTrpAspSerValThrLys-1132 |
| SEQ. ID. NO. 6451 | 1185-IleLysLeuIleAspGlyValSerThr-1193 |
| SEQ. ID. NO. 6452 | 1263-HisLysArgLeuGlyAspGlyTyr-1270 |
| SEQ. ID. NO. 6453 | 1278-GluGlnIleHisGlnLeuThrGlyTyrArgArgLeuAspGlyTyr-1292 |
| SEQ. ID. NO. 6454 | 1299-PheLysAlaLeuMetAspAsn-1305 |
| SEQ. ID. NO. 6455 | 1325-GlnValAlaArgLeu-1329 |
| SEQ. ID. NO. 6456 | 1461-ThrAlaIleAspArgMetAlaGlyIleAsnValValGlySerHisThrGluGlnValAspAsnArg-1482 |
| SEQ. ID. NO. 6457 | 1504-SerAsnGlnValLysAspGlyThrThr-1512 |
| SEQ. ID. NO. 6458 | 1515-ThrAlaGlyAsnAsn-1519 |
| SEQ. ID. NO. 6459 | 1542-ArgHisValArgGlnSerThrGluVal-1550 |
| SEQ. ID. NO. 6460 | 1596-ArgGlnIleThrGluLeu-1601 |
| SEQ. ID. NO. 6461 | 1720-IleIleGlySerLeuAsn-1725 |
| SEQ. ID. NO. 6462 | 1791-AlaGlnAsnPheIleGlnAlaAlaGlnAsnValGlyLysSer-1804 |
| SEQ. ID. NO. 6463 | 1822-TyrGlnAlaThrGlnGlnMet-1828 |
| SEQ. ID. NO. 6464 | 1870-GluAlaAlaAlaSerGln-1875 |
| SEQ. ID. NO. 6465 | 1925-GlySerGluGlnSer-1929 |
| SEQ. ID. NO. 6466 | 1955-GlyGlyAsnIleGlyLysGlyLys-1962 |
| SEQ. ID. NO. 6467 | 2106-AspIleGlnAsnHisSer-2111 |
| SEQ. ID. NO. 6468 | 2138-GlnGlyArgProThrAspArgIleSerProAla-2148 |
| SEQ. ID. NO. 6469 | 2177-AlaGlyGlnLeuAlaArgThrGlyArgThrAlaLys-2188 |
| SEQ. ID. NO. 6470 | 2204-AspGlnHisSerGlyHisLeuLysAsnSerPhe-2214 |
| SEQ. ID. NO. 6471 | 2228-GluValThrLysGluPheGlyArgAsnAlaAla-2238 |
| SEQ. ID. NO. 6472 | 2243-AlaValAlaAspLysLeuGlyAsnThrGlnSerTyrGluArgTyrGln-2258 |
| SEQ. ID. NO. 6473 | 2297-ArgTyrAspThrTrpLysGlu-2303 |
| SEQ. ID. NO. 6474 | 2308-ArgSerIleLeuHisGlyAlaAlaGly-2316 |
| SEQ. ID. NO. 6475 | 2320-ThrGlySerLeuGlyGlyIleLeuAla-2328 |
| SEQ. ID. NO. 6476 | 2336-AlaProTyrLeuAspLysAlaAlaGluAsnLeuGlyPro-2348 |
| SEQ. ID. NO. 6477 | 2352-AlaAlaValAsnAlaLeuGly-2358 |
| SEQ. ID. NO. 6478 | 2395-LysTyrAlaGluAlaLeuLysArg-2402 |
| SEQ. ID. NO. 6479 | 2404-ValGluLysArgGluGly-2409 |

TABLE 1-continued

| | |
|---|---|
| SEQ. ID. NO. 6480 | 2424-GlnIleLeuArgTrpValAspLysGlySerGlnAspGly-2436 |
| SEQ. ID. NO. 6481 | 2470-GlnThrTyrAsnAspProLysLeuPheGluGluTyr-2481 |
| SEQ. ID. NO. 6482 | 2520-GluGlyLeuThrSerLeuVal-2526 |
| SEQ. ID. NO. 6483 | 2537-LeuAlaGlyIleArgAsnLeuLysAsnIle-2546 |
| SEQ. ID. NO. 6484 | 2571-ValAlaLysGlyAspArg-2576 |
| SEQ. ID. NO. 6485 | 2620-LysProGlnArgGln-2624 |
| SEQ. ID. NO. 6486 | 2647-AspValCysThrGluCys-2652 |
| SEQ. ID. NO. 6487 | 2669-ProGluIleGluArg-2673 |
| Antigenic Index - Jameson-Wolf | |
| SEQ. ID. NO. 6488 | 10-PheAsnLysHisArgAsnCysMet-17 |
| SEQ. ID. NO. 6489 | 22-GluAsnAlaLysArgGluGlyLysAsnThrAlaAsp-33 |
| SEQ. ID. NO. 6490 | 82-ValAlaAspLysSerAlaProAlaGlnGlnGln-92 |
| SEQ. ID. NO. 6491 | 125-ValGlyAsnArgGlyAlaIleLeuAlaAsnAsnSerArgSerAsnThrGlnThr-141 |
| SEQ. ID. NO. 6492 | 150-AsnProTrpLeuAla-154 |
| SEQ. ID. NO. 6493 | 156-GlyGluAlaArgVal-160 |
| SEQ. ID. NO. 6494 | 165-IleAsnSerSerHisSerSerGlnLeuAsnGly-175 |
| SEQ. ID. NO. 6495 | 177-IleGluValGlyGlyArgArgAlaGluVal-186 |
| SEQ. ID. NO. 6496 | 203-AsnAlaSerArgAlaThrLeu-209 |
| SEQ. ID. NO. 6497 | 214-ProGlnTyrGlnAlaGlyAspLeuSerGlyPheLysIleArgGlnGlyAsn-230 |
| SEQ. ID. NO. 6498 | 237-GlyLeuAspAlaArgAspThrAspTyrThrArg-247 |
| SEQ. ID. NO. 6499 | 250-SerTyrHisSerLysIleAspAla-257 |
| SEQ. ID. NO. 6500 | 262-GlnAspValArgVal-266 |
| SEQ. ID. NO. 6501 | 269-GlyGlnAsnAspValAlaAlaThrGlyAspAlaHisSerPro-282 |
| SEQ. ID. NO. 6502 | 290-AsnThrSerAsnAsnThrAlaAsnAsnGlyThr-300 |
| SEQ. ID. NO. 6503 | 308-AspThrGlyLysLeuGlyGly-314 |
| SEQ. ID. NO. 6504 | 327-GluGlnAlaGlyIleArgAsnGlnGlyGln-336 |
| SEQ. ID. NO. 6505 | 347-AsnAlaGluGlyLysLeuValAsn-354 |
| SEQ. ID. NO. 6506 | 361-ThrGlyGluAsnHis-365 |
| SEQ. ID. NO. 6507 | 373-AsnValHisAsnSerGlyThrValAlaSerGlnAspAspAlaAsnIleHis-389 |
| SEQ. ID. NO. 6508 | 391-GlnThrLeuAspAsnSerGlyThrVal-399 |
| SEQ. ID. NO. 6509 | 401-SerSerGlyArgLeuThrVal-407 |
| SEQ. ID. NO. 6510 | 409-AsnLeuGlyArgLeuLysAsnGlnAsnAsnGly-419 |
| SEQ. ID. NO. 6511 | 424-AlaArgLeuAspMetSerThrGlyGlyLeuAspAsnThrGlyAsnIleThrGlnThrGlySerGln-445 |
| SEQ. ID. NO. 6512 | 453-GlyLysPheAspAsnSerGlyLysIleGlyValSerAspValProGlnThrGlyLeuAsnProAsnProSerVal-477 |
| SEQ. ID. NO. 6513 | 486-ThrGlySerGlyGlySer-490 |
| SEQ. ID. NO. 6514 | 493-ValSerValSerLysProGlySerAsnAsnProValSerProThrAlaProAlaLysAsnTyrAla-514 |
| SEQ. ID. NO. 6515 | 525-AspAsnAlaGlySerIleAsnAlaGlyGlyGlnIleAsp-537 |
| SEQ. ID. NO. 6516 | 542-AsnGlyLeuGlyAsnSerGlySer-549 |
| SEQ. ID. NO. 6517 | 553-AlaLysLeuArgValSerGlyAspSerPheAsnAsnThrValLysGlyLysLeuGlnAla-572 |
| SEQ. ID. NO. 6518 | 580-GlnThrAlaLysAsnSerGlyHis-587 |
| SEQ. ID. NO. 6519 | 591-GlnThrGlyLysIleAspAsnArgGluLeuHisAsnAlaGlyGlu-605 |
| SEQ. ID. NO. 6520 | 615-HisSerGlyArgLeuSerAsnAspLysLysGlyAsnIle-627 |
| SEQ. ID. NO. 6521 | 647-AlaAspSerGlyThrValThrThrLysAsnAsnLeuArgAsnThrGlyLysValSerValAlaArgLeuAsnThrGluGlyGlnThrLeuAspAsnThrArgGlyArgIleGluAlaGluThrValAsn-689 |
| SEQ. ID. NO. 6522 | 694-GlnLeuThrAsnGlnAsnSerGlyHis-701 |
| SEQ. ID. NO. 6523 | 710-IleAsnSerArgAsnValAspAsnGlnAsnGlyLysLeuLeuSer-724 |
| SEQ. ID. NO. 6524 | 732-ValSerAspGlyLeuTyrAsnGlnHisGly-741 |
| SEQ. ID. NO. 6525 | 750-SerIleHisAspLysAsnGlnAsnThr-758 |
| SEQ. ID. NO. 6526 | 761-LeuAsnAsnAlaAspGlyThrIle-768 |
| SEQ. ID. NO. 6527 | 780-SerLeuAlaAsnAsnGlyThr-786 |
| SEQ. ID. NO. 6528 | 789-AlaGlyAsnLysLeuAsp-794 |
| SEQ. ID. NO. 6529 | 797-LeuThrAspAspPheValValGluArgAspLeuThrAlaGlyLys-811 |
| SEQ. ID. NO. 6530 | 817-IleLysGlyArgLeuLysAsnThrHisThr-826 |
| SEQ. ID. NO. 6531 | 836-AsnAlaGlyAsnIleAspAsnGlnVal-844 |
| SEQ. ID. NO. 6532 | 849-IleGlyGlyGluGlnThrAspIleThrSerGluGlnHisValAspAsnArgGlyLeuIleAsnSerAspGly-872 |
| SEQ. ID. NO. 6533 | 881-ThrLeuThrAsnThrGlyThrGlyLysIleTyr-891 |
| SEQ. ID. NO. 6534 | 903-LeuAsnArgGluGluThrThrGluGlySerThrLysAla-915 |
| SEQ. ID. NO. 6535 | 919-AlaAlaArgLysArgLeuAspIleGlyAlaLysGluIleHisAsnGlnGluGly-936 |
| SEQ. ID. NO. 6536 | 939-LeuSerSerGluGly-943 |
| SEQ. ID. NO. 6537 | 948-GlyAsnArgLeuAspGluGlnHisHis-956 |
| SEQ. ID. NO. 6538 | 985-GlnAsnIleAsnAsnHisPheLysThrGluThrTyrLeuAlaLysAlaGluLysGlnValArgAsp-1006 |
| SEQ. ID. NO. 6539 | 1017-GlnAlaGlyLysAspGlyLeuPheAspAsnSerGlnGlyGlnLysAspGlnThrThr-1035 |
| SEQ. ID. NO. 6540 | 1039-HisLeuLysAsnGlySerArgIleGluAla-1048 |
| SEQ. ID. NO. 6541 | 1060-ThrTyrLysGluArgIleGluAsnArgProAlaHis-1072 |
| SEQ. ID. NO. 6542 | 1076-GlyGlyAspLeuThrAlaSerGlyGlnAsnTrpLeuAsnLysAspSerArgIle-1093 |
| SEQ. ID. NO. 6543 | 1098-ArgIleIleThrAspAspLeuAsnGlnLysGluIleThrAsnGlnSerThrThrGlyLysGlyArgThrAspAlaVal-1123 |
| SEQ. ID. NO. 6544 | 1126-GlnTrpAspSerValThrLysLysGlyTrpTyrSerGlyArgLysArgGlnArgArgThrGluArgAsnHisThrProTyrHisAsp-1154 |
| SEQ. ID. NO. 6545 | 1160-HisAspPheAspThrProVal-1166 |
| SEQ. ID. NO. 6546 | 1172-AsnAlaAlaSerProSerPhe-1178 |
| SEQ. ID. NO. 6547 | 1196-ValAsnGlyGlnArgIleHisThr-1203 |
| SEQ. ID. NO. 6548 | 1223-ThrThrHisProAspAsnLysGlyTrp-1231 |
| SEQ. ID. NO. 6549 | 1234-GluThrAspProGlnPheAlaAspTyrArgArgTrpLeuGlySerAspTyr-1250 |
| SEQ. ID. NO. 6550 | 1258-AspThrAsnHisLeuHisLysArgLeuGlyAspGlyTyrTyrGluGlnLysLeuValAsn-1277 |
| SEQ. ID. NO. 6551 | 1285-GlyTyrArgArgLeuAspGlyTyrArgSerAspGluGluGlnPheLysAlaLeuMetAspAsnGly-1306 |
| SEQ. ID. NO. 6552 | 1343-LeuSerAspGlySerThrGln-1349 |
| SEQ. ID. NO. 6553 | 1359-LeuAlaArgLysGlyAspLeuAsnThrSerGlyGly-1370 |
| SEQ. ID. NO. 6554 | 1382-GlnAsnGlyAsnLeuThrAsn-1388 |
| SEQ. ID. NO. 6555 | 1403-ArgAsnIleAsnSerAsnGlyAsnIleGln-1412 |
| SEQ. ID. NO. 6556 | 1416-IleGlyLeuLysAlaGluLysSerIleAsnIleAspGlyGlyGlnValGln-1432 |
| SEQ. ID. NO. 6557 | 1445-AsnLeuAsnGlyThrThrGlnThrSerGlyAsnGluArgAsnGlyAsnThrAlaIleAspArgMetAla-1467 |

TABLE 1-continued

| | |
|---|---|
| SEQ. ID. NO. 6558 | 1473-GlySerHisThrGluGlnValAspAsnArgThrSerAspGly-1486 |
| SEQ. ID. NO. 6559 | 1491-HisAlaSerAsnAspIle-1496 |
| SEQ. ID. NO. 6560 | 1503-ValSerAsnGlnValLysAspGlyThrThr-1512 |
| SEQ. ID. NO. 6561 | 1525-IleArgThrGluHisArgGluAlaTyrGlyThrLeuAspAspGluAsnHisArgHisValArgGlnSerThrGluValGlySerSerIleArgThrGln AsnGly-1559 |
| SEQ. ID. NO. 6562 | 1564-AlaGlyAsnAspLeuLysIleArgGlnGlyGluLeuGluAlaGluGluGlyLysThr-1582 |
| SEQ. ID. NO. 6563 | 1586-AlaGlyArgAspValThrIleSerGluGlyArgGlnIleThrGluLeuAspThrSerValSerGlyLysSerLysGlyIleLeuSerSerThrLysThr HisAspArgTyrArgPheSerHisAspGluAlaVal-1630 |
| SEQ. ID. NO. 6564 | 1633-AsnIleGlyGlyGlyLysMet-1639 |
| SEQ. ID. NO. 6565 | 1644-GlyGlnAspIleAsnValArgGlySerAsnLeuIleSerAspLysGlyIleVal-1661 |
| SEQ. ID. NO. 6566 | 1664-AlaGlyHisAspIleAspIleSerThrAlaHisAsnArgTyrThrGlyAsnGluTyrHisGluSerLysLysSerGlyVal-1690 |
| SEQ. ID. NO. 6567 | 1699-ThrIleGlyAsnArgLysThrThrAspAspThrAspArgThrAsnIle-1714 |
| SEQ. ID. NO. 6568 | 1723-SerLeuAsnGlyAspThr-1728 |
| SEQ. ID. NO. 6569 | 1732-AlaGlyAsnArgTyrArgGlnThrGlySerThrValSerProGluGlyArgAsnThrValThr-1753 |
| SEQ. ID. NO. 6570 | 1761-PheAlaAsnAsnArgTyrAlaThrAspTyrAlaHisThrGlnGluGlnLysGly-1778 |
| SEQ. ID. NO. 6571 | 1799-GlnAsnValGlyLysSerLysAsnLysArgValAsn-1810 |
| SEQ. ID. NO. 6572 | 1832-AlaProSerSerAlaGlyGlnGlyGlnAsnAsnAsnGlnSerProSerIle-1849 |
| SEQ. ID. NO. 6573 | 1854-ThrTyrGlyGluGlnLysSerArgAsnGluGlnLysArgHisTyrThr-1869 |
| SEQ. ID. NO. 6574 | 1878-GlyLysGlyGlnThr-1882 |
| SEQ. ID. NO. 6575 | 1886-AlaThrGlySerGlyGluGlnSerAsnIleAsn-1896 |
| SEQ. ID. NO. 6576 | 1898-ThrGlySerAspVal-1902 |
| SEQ. ID. NO. 6577 | 1919-GlnSerAlaLysGlnAspGlySerGluGlnSerLysAsnLysSerSerGlyTrpAsnAla-1938 |
| SEQ. ID. NO. 6578 | 1954-AlaGlyGlyAsnIleGlyLysGlyLysGluGlnGlyGlySerThrThrHisArgHisThrHisValGlySerThrThrGlyLysThrThrIleArgSer GlyGlyAspThrThrLeu-1992 |
| SEQ. ID. NO. 6579 | 1999-GlyLysGlyIleGlnAlaAspThrArgAsnLeuHis-2010 |
| SEQ. ID. NO. 6580 | 2013-SerValGlnAspThrGluThrTyrGlnSerLysGlnAsnGlyAsn-2028 |
| SEQ. ID. NO. 6581 | 2038-SerAlaSerGlySerTyrArgGlnSerLysValLysAlaAspHis-2052 |
| SEQ. ID. NO. 6582 | 2062-TyrAlaGlyGluAspGlyTyrGlnIleLysValArgAspAsnThrAspLeuLysGly-2080 |
| SEQ. ID. NO. 6583 | 2086-SerGlnSerAlaGluAspLysGlyLysAsnLeuPhe-2097 |
| SEQ. ID. NO. 6584 | 2105-SerAspIleGlnAsnHisSerArgTyrGluGlyArgSerPheGly-2119 |
| SEQ. ID. NO. 6585 | 2126-LeuAsnGlyGlyTrpAspGlyThrValThrAspLysGlnGlyArgProThrAspArgIleSerPro-2147 |
| SEQ. ID. NO. 6586 | 2151-TyrGlySerAspGlyAspSerLysAsnSerThrThrArgSerGlyValAsnThrHis-2169 |
| SEQ. ID. NO. 6587 | 2173-IleThrAspGluAlaGlyGlnLeuAlaArgThrGlyArgThrAlaLysGluThrGluAlaArgIle-2194 |
| SEQ. ID. NO. 6588 | 2197-GlyIleAspThrGluThrAlaAspGlnHisSerGlyHisLeuLysAsnSerPheAspLysAspAlaValAlaLysGluIleAsnLeuGlnArgGluVal ThrLysGluPheGlyArgAsnAlaAla-2238 |
| SEQ. ID. NO. 6589 | 2244-ValAlaAspLysLeuGlyAsnThrGlnSerTyrGluArgTyrGlnGluAlaArgThrLeuLeu-2264 |
| SEQ. ID. NO. 6590 | 2266-AlaGluLeuGlnAsnThrAspSerGluAlaGluLysAlaAlaPhe-2280 |
| SEQ. ID. NO. 6591 | 2292-GluAlaAsnGlnSerArgTyrAspThrTrpLysGluGlyGlyIleGlyArgSerIle-2310 |
| SEQ. ID. NO. 6592 | 2338-TyrLeuAspLysAlaAlaGluAsnLeuGlyProAlaGly-2350 |
| SEQ. ID. NO. 6593 | 2378-ValAspTrpAsnAsnArgGlnLeuHisProLysGluMetAlaLeu-2392 |
| SEQ. ID. NO. 6594 | 2394-AspLysTyrAlaGluAlaLeuLysArgGluValGluLysArgGluGlyArgLysIleSerSerGlnGluAlaAlaMetArgIleArgArgGln Ile-2425 |
| SEQ. ID. NO. 6595 | 2428-TrpValAspLysGlySerGlnAspGlyTyrThrAspGlnSerVal-2442 |
| SEQ. ID. NO. 6596 | 2448-MetLysGlyGluAspLysAlaLeu-2455 |
| SEQ. ID. NO. 6597 | 2460-AspTyrArgAspTyrGlyAlaArgAsnProGlnThrTyrAsnAspProLysLeuPheGluGluTyrArgArgGlnAspLysProGluTyrArg Asn-2491 |
| SEQ. ID. NO. 6598 | 2496-HisSerGlyThrLysAspThrLysIleArgGlnGlyGluArgLysAsnGluGluPhe-2514 |
| SEQ. ID. NO. 6599 | 2527-AsnProAsnProArgIleLysVal-2534 |
| SEQ. ID. NO. 6600 | 2541-ArgAsnLeuLysAsnIleLysProThrValThrGlySerAspPro-2555 |
| SEQ. ID. NO. 6601 | 2569-GlyAsnValAlaLysGlyAspArgIleProAspThrAlaLeuAlaSerLysGlyIleLysHisLysAsnArgLysAspGlnLeuGluLysAsnLysLys SerGlyGluAspPheGluMet-2608 |
| SEQ. ID. NO. 6602 | 2610-IleTyrGlnLysLysValLysGlnGlyPheLysProGlnArgGlnIleThrValLysThrLysSerGlyValLysThrArgLeuAspIleIleSerLys GluGlyGlyLeuAspValCysThrGluCysLysAla-2654 |
| SEQ. ID. NO. 6603 | 2659-ProLeuThrLysAsnGlnLysLysAlaPheProGluIleGluArgThrGlyAla-2676 |
| SEQ. ID. NO. 6604 | 2680-GlyLysGlyLysProGlyTyrProLysGlyThrLysIleGluProThrLysValIleIleGluArgLysArg-2703 |
| Hydrophilic Regions - Hopp-Woods | |
| SEQ. ID. NO. 6605 | 10-PheAsnLysHisArgAsn-15 |
| SEQ. ID. NO. 6606 | 22-GluAsnAlaLysArgGluGlyLysLysAsnThrAlaAsp-33 |
| SEQ. ID. NO. 6607 | 82-ValAlaAspLysSerAlaPro-88 |
| SEQ. ID. NO. 6608 | 134-AsnSerArgSerAsnThr-139 |
| SEQ. ID. NO. 6609 | 156-GlyGluAlaArgVal-160 |
| SEQ. ID. NO. 6610 | 179-ValGlyGlyGlyArgArgAlaGluVal-186 |
| SEQ. ID. NO. 6611 | 222-SerGlyPheLysIleArgGln-228 |
| SEQ. ID. NO. 6612 | 238-LeuAspAlaArgAspThrAspTyr-245 |
| SEQ. ID. NO. 6613 | 271-AsnAspValAlaAla-275 |
| SEQ. ID. NO. 6614 | 329-AlaGlyIleArgAsn-333 |
| SEQ. ID. NO. 6615 | 348-AlaGluGlyLysLeu-352 |
| SEQ. ID. NO. 6616 | 361-ThrGlyGluAsnHis-365 |
| SEQ. ID. NO. 6617 | 381-AlaSerGlnAspAspAlaAsnIle-388 |
| SEQ. ID. NO. 6618 | 409-AsnLeuGlyArgLeuLysAsnGlnAsn-417 |
| SEQ. ID. NO. 6619 | 424-AlaArgLeuAspMet-428 |
| SEQ. ID. NO. 6620 | 453-GlyLysPheAspAsnSerGlyLysIleGlyVal-463 |
| SEQ. ID. NO. 6621 | 494-SerValSerLysProGlySer-500 |
| SEQ. ID. NO. 6622 | 553-AlaLysLeuArgValSerGly-559 |
| SEQ. ID. NO. 6623 | 566-ValLysGlyLysLeuGlnAla-572 |
| SEQ. ID. NO. 6624 | 580-GlnThrAlaLysAsnSer-585 |
| SEQ. ID. NO. 6625 | 593-GlyLysIleAspAsnArgGluLeuHisAsn-602 |
| SEQ. ID. NO. 6626 | 618-ArgLeuSerAsnAspLysLysGlyAsnIle-627 |
| SEQ. ID. NO. 6627 | 650-GlyThrValThrThr-654 |
| SEQ. ID. NO. 6628 | 656-AsnAsnLeuArgAsnThrGlyLys-663 |

TABLE 1-continued

| SEQ. ID. NO. 6629 | 669-LeuAsnThrGluGlyGlnThrLeuAspAsnThrArgGlyArgIleGluAlaGluThr-687 |
| SEQ. ID. NO. 6630 | 713-ArgAsnValAspAsnGlnAsn-719 |
| SEQ. ID. NO. 6631 | 750-SerIleHisAspLysAsnGlnAsn-757 |
| SEQ. ID. NO. 6632 | 763-AsnAlaAspGlyThrIle-768 |
| SEQ. ID. NO. 6633 | 801-PheValGluArgAspLeuThrAla-809 |
| SEQ. ID. NO. 6634 | 817-IleLysGlyArgLeuLysAsn-823 |
| SEQ. ID. NO. 6635 | 852-GluGlnThrAspIleThrSer-858 |
| SEQ. ID. NO. 6636 | 860-GlnHisValAspAsnArgGlyLeuIle-868 |
| SEQ. ID. NO. 6637 | 903-LeuAsnArgGluGluThrThrGluGlySerThrLysAla-915 |
| SEQ. ID. NO. 6638 | 919-AlaAlaArgLysArgLeuAspIleGlyAlaLysGluIleHisAsnGlnGlu-935 |
| SEQ. ID. NO. 6639 | 949-AsnArgLeuAspGluGlnHisHis-956 |
| SEQ. ID. NO. 6640 | 995-ThrTyrLeuAlaLysAlaGluLysGlnValArgAsp-1006 |
| SEQ. ID. NO. 6641 | 1018-AlaGlyLysAspGlyLeuPhe-1024 |
| SEQ. ID. NO. 6642 | 1027-SerGlnGlyGlnLysAspGlnThr-1034 |
| SEQ. ID. NO. 6643 | 1042-AsnGlySerArgIleGluAla-1048 |
| SEQ. ID. NO. 6644 | 1060-ThrTyrLysGluArgIleIleGluAsnArgPro-1070 |
| SEQ. ID. NO. 6645 | 1087-LeuAsnLysAspSerArgIle-1093 |
| SEQ. ID. NO. 6646 | 1099-IleIleThrAspAspLeuAsnGlnLysGluIleThrAsn-1111 |
| SEQ. ID. NO. 6647 | 1114-ThrThrGlyLysGlyArgThrAspAlaVal-1123 |
| SEQ. ID. NO. 6648 | 1134-GlyTrpTyrSerGlyArgLysArgGlnArgArgThrGluArgAsnHis-1149 |
| SEQ. ID. NO. 6649 | 1235-ThrAspProGlnPheAlaAspTyrArgArg-1244 |
| SEQ. ID. NO. 6650 | 1261-HisLeuHisLysArgLeuGly-1267 |
| SEQ. ID. NO. 6651 | 1287-ArgArgLeuAspGlyTyrArgSerAspGluGluGlnPheLysAlaLeuMet-1303 |
| SEQ. ID. NO. 6652 | 1360-AlaArgLysGlyAspLeuAsnThr-1367 |
| SEQ. ID. NO. 6653 | 1416-IleGlyLeuLysAlaGluLysSerIleAsn-1425 |
| SEQ. ID. NO. 6654 | 1453-SerGlyAsnGluArgAsnGlyAsnThrAlaIleAspArgMetAla-1467 |
| SEQ. ID. NO. 6655 | 1475-HisThrGluGlnValAspAsnArgThrSerAsp-1485 |
| SEQ. ID. NO. 6656 | 1505-AsnGlnValLysAspGlyThrThr-1512 |
| SEQ. ID. NO. 6657 | 1525-IleArgThrGluHisArgGluAlaTyrGlyThrLeuAspAspGluAsnHisArgHisValArgGlnSerThrGluVal-1550 |
| SEQ. ID. NO. 6658 | 1554-IleArgThrGlnAsn-1558 |
| SEQ. ID. NO. 6659 | 1564-AlaGlyAsnAspLeuLysIleArgGlnGlyGluLeuGluAlaGluGluGlyLysThr-1582 |
| SEQ. ID. NO. 6660 | 1586-AlaGlyArgAspValThrIleSerGluGlyArgGlnIleThrGluLeuAspThr-1603 |
| SEQ. ID. NO. 6661 | 1605-ValSerGlyLysSerLysGlyIle-1612 |
| SEQ. ID. NO. 6662 | 1616-ThrLysThrHisAspArgTyrArgPheSerHisAspGluAlaVal-1630 |
| SEQ. ID. NO. 6663 | 1647-IleAsnValArgGly-1651 |
| SEQ. ID. NO. 6664 | 1653-AsnLeuIleSerAspLysGlyIleVal-1661 |
| SEQ. ID. NO. 6665 | 1664-AlaGlyHisAspIleAspIle-1670 |
| SEQ. ID. NO. 6666 | 1681-GluTyrHisGluSerLysSerGlyVal-1690 |
| SEQ. ID. NO. 6667 | 1701-GlyAsnArgLysThrThrAspAspThrAspArgThrAsn-1713 |
| SEQ. ID. NO. 6668 | 1734-AsnArgTyrArgGlnThrGly-1740 |
| SEQ. ID. NO. 6669 | 1744-SerSerProGluGlyArgAsnThrValThr-1753 |
| SEQ. ID. NO. 6670 | 1774-GlnGluGlnLysGly-1778 |
| SEQ. ID. NO. 6671 | 1800-AsnValGlyLysSerLysAsnLysArgValAsn-1810 |
| SEQ. ID. NO. 6672 | 1836-SerAlaGlyGlnGlyGlnAsnAsnAsnGln-1845 |
| SEQ. ID. NO. 6673 | 1856-GlyGluGlnLysSerArgAsnGluGlnLysArgHisTyrThr-1869 |
| SEQ. ID. NO. 6674 | 1888-GlySerGlyGluGlnSerAsn-1894 |
| SEQ. ID. NO. 6675 | 1919-GlnSerAlaLysGlnAspGlySerGluGlnSerLysAsnLysSerSer-1934 |
| SEQ. ID. NO. 6676 | 1957-AsnIleGlyLysGlyLysGluGlnGlyGly-1966 |
| SEQ. ID. NO. 6677 | 1982-ThrThrIleArgSerGlyGlyAspThrThrLeu-1992 |
| SEQ. ID. NO. 6678 | 2002-IleGlnAlaAspThrArgAsnLeuHis-2010 |
| SEQ. ID. NO. 6679 | 2013-SerValGlnAspThrGluThrTyrGlnSerLysGlnGlnAsn-2026 |
| SEQ. ID. NO. 6680 | 2041-GlySerTyrArgGlnSerLysValLysAlaAspHis-2052 |
| SEQ. ID. NO. 6681 | 2063-AlaGlyGluAspGlyTyrGlnIleLysValArgAspAsnThrAspLeuLysGly-2080 |
| SEQ. ID. NO. 6682 | 2087-GlnSerAlaGluAspLysGlyLysAsn-2095 |
| SEQ. ID. NO. 6683 | 2111-SerArgTyrGluGlyArgSer-2117 |
| SEQ. ID. NO. 6684 | 2133-ThrValThrAspLysGlnGlyArgProThrAspArgIleSerPro-2147 |
| SEQ. ID. NO. 6685 | 2152-GlySerAspGlyAspSerLysAsnSerThrThrArgSerGlyVal-2166 |
| SEQ. ID. NO. 6686 | 2173-IleThrAspGluAlaGlyGln-2179 |
| SEQ. ID. NO. 6687 | 2181-AlaArgThrGlyArgThrAlaLysGluThrGluAlaArgIle-2194 |
| SEQ. ID. NO. 6688 | 2198-IleAspThrGluThrAlaAspGlnHisSerGlyHisLeu-2210 |
| SEQ. ID. NO. 6689 | 2212-AsnSerPheAspLysAspAlaValAlaLysGluIleAsnLeuGlnArgGluValThrLysGluPheGlyArg-2235 |
| SEQ. ID. NO. 6690 | 2244-ValAlaAspLysLeuGlyAsn-2250 |
| SEQ. ID. NO. 6691 | 2252-GlnSerTyrGluArgTyrGlnGluAlaArgThrLeuLeu-2264 |
| SEQ. ID. NO. 6692 | 2266-AlaGluLeuGlnAsnThrAspSerGluAlaGluLysAlaAlaPhe-2280 |
| SEQ. ID. NO. 6693 | 2294-AsnGlnSerArgTyrAspThrTrpLysGluGlyGlyIle-2306 |
| SEQ. ID. NO. 6694 | 2338-TyrLeuAspLysAlaAlaGluAsnLeuGlyProAlaGly-2350 |
| SEQ. ID. NO. 6695 | 2384-GlnLeuHisProLysGluMetAlaLeu-2392 |
| SEQ. ID. NO. 6696 | 2394-AspLysTyrAlaGluAlaLeuLysArgGluValGluLysArgGluGlyArgLysIleSerSerGlnGluAlaAlaMetArgIleArgArgGlnIle-2425 |
| SEQ. ID. NO. 6697 | 2428-TrpValAspLysGlySerGlnAspGlyTyrThr-2438 |
| SEQ. ID. NO. 6698 | 2448-MetLysGlyGluAspLysAlaLeu-2455 |
| SEQ. ID. NO. 6699 | 2460-AspTyrArgAspTyrGlyAlaArgAsnProGlnThrTyrAsnAsp-2474 |
| SEQ. ID. NO. 6700 | 2476-LysLeuPheGluGluTyrArgArgGlnAspLysProGluTyrArg-2490 |
| SEQ. ID. NO. 6701 | 2498-GlyThrLysAspThrLysIleArgGlnGlyGluArgLysAsnGluGluPhe-2514 |
| SEQ. ID. NO. 6702 | 2528-ProAsnProArgIleLys-2533 |
| SEQ. ID. NO. 6703 | 2541-ArgAsnLeuLysAsnIleLys-2547 |
| SEQ. ID. NO. 6704 | 2570-AsnValAlaLysGlyAspArgIleProAsp-2579 |
| SEQ. ID. NO. 6705 | 2585-LysGlyIleLysHisLysAsnArgLysAspGlnLeuLysLysAsnLysLysSerGlyGluAspPheGluMet-2608 |
| SEQ. ID. NO. 6706 | 2610-IleTyrGlnLysLysValLysGlnGlyPheLysProGlnArg-2623 |
| SEQ. ID. NO. 6707 | 2625-IleThrValLysThrLysSerGlyValLysThrArgLeuAspIleIleSerLysGluGlyGlyLeu-2646 |

TABLE 1-continued

| | |
|---|---|
| SEQ. ID. NO. 6708 | 2648-ValCysThrGluCysLysAla-2654 |
| SEQ. ID. NO. 6709 | 2660-LeuThrLysAsnGlnLysLysAlaPheProGluIleGluArgThrGly-2675 |
| SEQ. ID. NO. 6710 | 2680-GlyLysGlyLysProGlyTyrProLysGlyThrLysIleGluProThrLysValIleIleGluArgLysArg-2703 |

565
AMPHI Regions - AMPHI

| | |
|---|---|
| SEQ. ID. NO. 6711 | 50-AlaThrCysThrArgAlaMetSerLysSer-59 |
| SEQ. ID. NO. 6712 | 66-SerSerTrpAlaArg-70 |
| SEQ. ID. NO. 6713 | 84-IleSerThrTrpSerAspLeu-90 |
| SEQ. ID. NO. 6714 | 103-AspPheMetSerGlnLeuAspLeuThr-111 |
| SEQ. ID. NO. 6715 | 140-SerHisSerGlyGluThrIleSerSerCysProAlaMetAlaSerIleThrLysProAsn-159 |
| SEQ. ID. NO. 6716 | 184-AlaAsnThrThrSerAlaPhe-190 |

Antigenic Index - Jameson-Wolf

| | |
|---|---|
| SEQ. ID. NO. 6717 | 1-MetAspSerThrLeuSerLysThrCys-9 |
| SEQ. ID. NO. 6718 | 23-PheAlaArgProArgProAlaAlaSerAsnThrSerLeu-35 |
| SEQ. ID. NO. 6719 | 37-PheAlaSerProAsnAspThrGlySer-45 |
| SEQ. ID. NO. 6720 | 55-AlaMetSerLysSerSerAlaLysTyrGly-64 |
| SEQ. ID. NO. 6721 | 67-SerTrpAlaArgThrArgProThrValCysProProLeuProLysProThrIle-84 |
| SEQ. ID. NO. 6722 | 99-CysArgSerSerAspPheMetSer-106 |
| SEQ. ID. NO. 6723 | 109-AspLeuThrLysArgProThrSerAlaSerLeuProProLysArgLysGlyAlaIle-127 |
| SEQ. ID. NO. 6724 | 129-IleAspSerArgThrAlaAla-135 |
| SEQ. ID. NO. 6725 | 140-SerHisSerGlyGluThrIleSerSer-148 |
| SEQ. ID. NO. 6726 | 154-SerIleThrLysProAsnSerProProCysAlaArgTyr-166 |
| SEQ. ID. NO. 6727 | 170-LeuArgLeuSerProThrGlu-176 |
| SEQ. ID. NO. 6728 | 194-SerIleAlaAsnSerIleAsnThrCysArgGlnProPro-206 |

Hydrophilic Regions - Hopp-Woods

| | |
|---|---|
| SEQ. ID. NO. 6729 | 24-AlaArgProArgProAlaAla-30 |
| SEQ. ID. NO. 6730 | 39-SerProAsnAspThrGlySer-45 |
| SEQ. ID. NO. 6731 | 55-AlaMetSerLysSerSerAla-61 |
| SEQ. ID. NO. 6732 | 69-AlaArgThrArgPro-73 |
| SEQ. ID. NO. 6733 | 100-ArgSerSerAspPhe-104 |
| SEQ. ID. NO. 6734 | 109-AspLeuThrLysArgProThrSer-116 |
| SEQ. ID. NO. 6735 | 119-LeuProProLysArgLysGlyAlaIle-127 |
| SEQ. ID. NO. 6736 | 129-IleAspSerArgThr-133 |
| SEQ. ID. NO. 6737 | 141-HisSerGlyGluThrIleSer-147 |
| SEQ. ID. NO. 6738 | 156-ThrLysProAsnSer-160 |

566
Hydrophilic Regions - Hopp-Woods

| | |
|---|---|
| SEQ. ID. NO. 6739 | 29-ProPheArgAspGlyAlaHisLysMet-37 |
| SEQ. ID. NO. 6740 | 64-AsnIleProAspArgProAla-70 |
| SEQ. ID. NO. 6741 | 95-ValAlaLysArgGluLeuPhe-101 |
| SEQ. ID. NO. 6742 | 116-IleGlyIleAspArgAsnAsnArgArgGluAlaAsnGluGlnLeuIle-131 |
| SEQ. ID. NO. 6743 | 134-GlyLeuValArgLysAsnGlu-140 |
| SEQ. ID. NO. 6744 | 149-GluGlyThrArgLeuAlaProGlyLysArgGlyLysTyrLysLeuGlyGly-165 |
| SEQ. ID. NO. 6745 | 211-SerGlySerGluAlaGluLeuMetGluLysCysGluHisLeuIle-225 |
| SEQ. ID. NO. 6746 | 242-MetProSerGluThrAla-247 |

Antigenic Index - Jameson-Wolf

| | |
|---|---|
| SEQ. ID. NO. 6747 | 32-PheAlaValAspProAsnCysGlyAlaAspGlyThrGlyGlyLysGlyHisAla-49 |
| SEQ. ID. NO. 6748 | 61-AlaValGlyGlyGluGluGlyGlyValValAlaAspAspValAlaCysAlaAspGlyGlyLysAlaAspGlyArgArgIleAlaArg-89 |
| SEQ. ID. NO. 6749 | 105-SerAlaGluArgAlaGlyAspAspPheAla-114 |

Hydrophilic Regions - Hopp-Woods

| | |
|---|---|
| SEQ. ID. NO. 6750 | 36-ProAsnCysGlyAlaAspGlyThrGlyGlyLysGlyHisAla-49 |
| SEQ. ID. NO. 6751 | 63-GlyGlyGluGluGlyGlyValValAlaAspAspValAlaCys-76 |
| SEQ. ID. NO. 6752 | 78-AspGlyGlyLysAlaAspGlyArgArgIleAlaArg-89 |
| SEQ. ID. NO. 6753 | 105-SerAlaGluArgAlaGlyAspAspPheAla-114 |

567
AMPHI Regions - AMPHI

| | |
|---|---|
| SEQ. ID. NO. 6754 | 60-GlyValTyrGlnVal-64 |
| SEQ. ID. NO. 6755 | 98-GluLeuValGlnGluIleAlaArgGluVal-107 |
| SEQ. ID. NO. 6756 | 112-AlaLeuLysAlaVal-116 |
| SEQ. ID. NO. 6757 | 154-TyrAlaLeuGluGlyIleSerAspLeuIleAlaThrValArgLysIleArgGln-171 |
| SEQ. ID. NO. 6758 | 180-ThrGlyIleValArg-184 |
| SEQ. ID. NO. 6759 | 195-AlaGluValSerGluGlnLeuArgSerHisPheGlyAspLeuLeu-209 |

Antigenic Index - Jameson-Wolf

| | |
|---|---|
| SEQ. ID. NO. 6760 | 10-AsnGlnLysGlyGlyValGlyLysThrThrThr-20 |
| SEQ. ID. NO. 6761 | 28-LeuAlaSerArgGlyLysArg-34 |
| SEQ. ID. NO. 6762 | 38-ValAspLeuAspProGlnGlyAsnAlaThrThrGlySerGlyIleAspLysAlaGlyLeuGlnSerGly-60 |
| SEQ. ID. NO. 6763 | 67-GlyAspAlaAspValGln-72 |
| SEQ. ID. NO. 6764 | 75-AlaValArgSerLysGluGlyGly-82 |
| SEQ. ID. NO. 6765 | 95-AlaGluIleGluLeu-99 |
| SEQ. ID. NO. 6766 | 101-GlnGluIleAlaArgGluValArgLeuLysAsnAlaLeuLysAlaValGluGluAspTyrAsp-121 |
| SEQ. ID. NO. 6767 | 127-CysProProSerLeu-131 |
| SEQ. ID. NO. 6768 | 164-AlaThrValArgLysIleArgGlnAlaValAsnProAspLeuAspIle-179 |
| SEQ. ID. NO. 6769 | 185-ThrMetTyrAspSerArgSerArgLeuValAlaGluValSerGluGlnLeuArgSerHisPheGlyAspLeu-208 |
| SEQ. ID. NO. 6770 | 214-IleProArgAsnIleArgLeuAlaGluAlaProSerHisGly-227 |
| SEQ. ID. NO. 6771 | 235-AlaGlnAlaLysGlyThrLys-241 |
| SEQ. ID. NO. 6772 | 248-AspGluLeuAlaAlaArgValSerGlyLys-257 |

Hydrophilic Regions - Hopp-Woods

| | |
|---|---|
| SEQ. ID. NO. 6773 | 10-AsnGlnLysGlyGlyValGlyLys-17 |
| SEQ. ID. NO. 6774 | 28-LeuAlaSerArgGlyLysArg-34 |
| SEQ. ID. NO. 6775 | 40-LeuAspProGlnGly-44 |

TABLE 1-continued

| SEQ. ID. NO. 6776 | 50-SerGlyIleAspLysAlaGlyLeu-57 |
| SEQ. ID. NO. 6777 | 67-GlyAspAlaAspValGln-72 |
| SEQ. ID. NO. 6778 | 75-AlaValArgSerLysGluGlyGly-82 |
| SEQ. ID. NO. 6779 | 95-AlaGluIleGluLeu-99 |
| SEQ. ID. NO. 6780 | 101-GlnGluIleAlaArgGluValArgLeuLysAsnAlaLeuLysAlaValGluGluAspTyrAsp-121 |
| SEQ. ID. NO. 6781 | 164-AlaThrValArgLysIleArgGln-171 |
| SEQ. ID. NO. 6782 | 175-ProAspLeuAspIle-179 |
| SEQ. ID. NO. 6783 | 186-MetTyrAspSerArgSerArgLeuValAlaGluValSerGluGlnLeuArg-202 |
| SEQ. ID. NO. 6784 | 216-ArgAsnIleArgLeuAlaGluAlaProSer-225 |
| SEQ. ID. NO. 6785 | 235-AlaGlnAlaLysGlyThrLys-241 |
| SEQ. ID. NO. 6786 | 248-AspGluLeuAlaAla-252 |

568
AMPHI Regions - AMPHI

| SEQ. ID. NO. 6787 | 32-AsnIlePheArgArgIle-37 |
| SEQ. ID. NO. 6788 | 49-LysAlaCysLysAsn-53 |
| SEQ. ID. NO. 6789 | 71-GluLysAlaAsnThrValArgTyr-78 |
| SEQ. ID. NO. 6790 | 82-SerLeuAlaGlnCysPheThr-88 |
| SEQ. ID. NO. 6791 | 112-ArgProLeuProSerIleIleThrAla-120 |
| SEQ. ID. NO. 6792 | 169-GluPheValGlyPheGlyAsnValPheValGlyGlnPheLeuAsnArgPhePhe-186 |
| SEQ. ID. NO. 6793 | 200-GluGluPhePheAspValValVal-207 |
| SEQ. ID. NO. 6794 | 228-PheAsnGlnValPheAlaAlaPheLeu-236 |
| SEQ. ID. NO. 6795 | 241-HisArgHisAlaAspGlnValAlaAspSerCysArgValGlnSerGln-256 |

Antigenic Index - Jameson-Wolf

| SEQ. ID. NO. 6796 | 14-SerAlaSerSerMetProCysArgIleCysArgLeuLysArgSerArgLeuProAsnIlePhe-34 |
| SEQ. ID. NO. 6797 | 39-PheSerCysArgArgArgThrCysPheCysLysAlaCysLysAsnSerProIleArgAsnGluThrSerSerSerGlyArgArgGlnPheSerValGluLysAlaAsnThr-75 |
| SEQ. ID. NO. 6798 | 91-SerAsnAlaSerLysProArgLeu-98 |
| SEQ. ID. NO. 6799 | 100-ProIleMetArgGlyArgLysArgPhePheAla-110 |
| SEQ. ID. NO. 6800 | 141-PheArgGlySerAlaPheLysCysArgLeuAsnAlaGluProCysArg-156 |
| SEQ. ID. NO. 6801 | 213-ValAlaAspArgAspAlaAla-219 |
| SEQ. ID. NO. 6802 | 237-GlyGlnHisGlyHisArgHisAlaAspGlnValAlaAspSerCysArgValGlnSerGln-256 |

Hydrophilic Regions - Hopp-Woods

| SEQ. ID. NO. 6803 | 21-ArgIleCysArgLeuLysArgSerArgLeu-30 |
| SEQ. ID. NO. 6804 | 41-CysArgArgArgThrCysPhe-47 |
| SEQ. ID. NO. 6805 | 49-LysAlaCysLysAsnSerProIleArgAsnGluThrSerSerSerGlyArgArgGlnPheSerValGluLysAlaAsnThr-75 |
| SEQ. ID. NO. 6806 | 93-AlaSerLysProArgLeu-98 |
| SEQ. ID. NO. 6807 | 102-MetArgGlyArgLysArgPhePheAla-110 |
| SEQ. ID. NO. 6808 | 144-SerAlaPheLysCysArgLeuAsnAlaGluProCysArg-156 |
| SEQ. ID. NO. 6809 | 213-ValAlaAspArgAspAlaAla-219 |
| SEQ. ID. NO. 6810 | 239HisGlyHisArgHisAlaAspGlnValAlaAspSerCysArgVal-253 |

569
AMPHI Regions - AMPHI

| SEQ. ID. NO. 6811 | 29-AlaAlaPheCysGlyLeuIleAlaLeuIleAlaLeuTrpGluTyrAlaArgMetGlyGlyLeuCysLys-51 |
| SEQ. ID. NO. 6812 | 86-PheTrpLeuAlaValMetPro-92 |
| SEQ. ID. NO. 6813 | 166-SerProGlyLysSerTrpGluGlyAlaIle-175 |
| SEQ. ID. NO. 6814 | 203-ThrValLeuIleGlyLeu-208 |
| SEQ. ID. NO. 6815 | 210-LeuThrValValSerValCysGlyAspLeuLeuGluSerTrpLeuLys-225 |
| SEQ. ID. NO. 6816 | 229-GlyIleLysAspSerSer-234 |

Antigenic Index - Jameson-Wolf

| SEQ. ID. NO. 6817 | 50-CysLysIleLysThrAsnHis-56 |
| SEQ. ID. NO. 6818 | 98-LysTrpArgLeuAsnGlyGlyTrp-105 |
| SEQ. ID. NO. 6819 | 124-SerLeuArgProHisProAspAspAlaLeu-133 |
| SEQ. ID. NO. 6820 | 154-LysAlaPheGlyLysHisLysIle-161 |
| SEQ. ID. NO. 6821 | 165-IleSerProGlyLysSerTrpGlu-172 |
| SEQ. ID. NO. 6822 | 227-AlaAlaGlyIleLysAspSerSerLysLeuLeuProGlyHis-240 |
| SEQ. ID. NO. 6823 | 242-GlyValPheAspArgThrAspSer-249 |

Hydrophilic Regions - Hopp-Woods

| SEQ. ID. NO. 6824 | 50-CysLysIleLysThr-54 |
| SEQ. ID. NO. 6825 | 127-ProHisProAspAspAlaLeu-133 |
| SEQ. ID. NO. 6826 | 155-AlaPheGlyLysHisLysIle-161 |
| SEQ. ID. NO. 6827 | 227-AlaAlaGlyIleLysAspSerSerLys-235 |
| SEQ. ID. NO. 6828 | 243-ValPheAspArgThrAspSer-249 |

570
AMPHI Regions - AMPHI

| SEQ. ID. NO. 6829 | 6-ArgAlaPheAlaAlaAlaLeuIleGlyLeu-15 |
| SEQ. ID. NO. 6830 | 22-HisAlaAspThrPheGlnLysIleGlyPheIleAsn-33 |
| SEQ. ID. NO. 6831 | 43-GlnAlaArgLysIleGlnLysThrLeuAspSer-53 |
| SEQ. ID. NO. 6832 | 60-AspGluLeuGlnLysLeuGln-66 |
| SEQ. ID. NO. 6833 | 81-LeuArgAsnAlaLysLys-86 |
| SEQ. ID. NO. 6834 | 91-GluLysTrpArgGlyLeuValAla-98 |
| SEQ. ID. NO. 6835 | 122-LeuGlnGlnAsnAlaAsnArgValIleValLysIle-133 |

Antigenic Index - Jameson-Wolf

| SEQ. ID. NO. 6836 | 33-AsnThrGluArgIleTyrLeuGluSerLysGlnAlaArgLysIleGlnLysThrLeuAspSerGluPheSerAlaArgGlnAspGluLeuGlnLysLeuGlnArgGluGlyLeuAspLeuGluArgGlnLeuAlaGluGlyLysLeuAsnAlaLysLysAlaGlnAlaGluGluLysTrpArg-94 |
| SEQ. ID. NO. 6837 | 100-PheArgLysLysGlnAlaGlnPheGluGluAspTyrAsnLeuArgArgAsnGluGluPheAla-120 |
| SEQ. ID. NO. 6838 | 123-GlnGlnAsnAlaAsnArgVal-129 |
| SEQ. ID. NO. 6839 | 133-IleAlaLysGlnGluGlyTyrAspVal-141 |
| SEQ. ID. NO. 6840 | 152-GlnTyrAspValThrAspSerValIleLysGluMetAsnAlaArg-166 |

TABLE 1-continued

Hydrophilic Regions - Hopp-Woods
SEQ. ID. NO. 6841    37-IleTyrLeuGluSerLysGlnAlaArgLysIleGlnLysThrLeuAspSerGluPheSerAlaArgGlnAspGluLeuGlnLysLeuGlnArgGluGly
LeuAspLeuGluArgGlnLeuAlaGluGlyLysLeuArgAsnAlaLysLysAlaGlnAlaGluGluLysTrpArg-94
SEQ. ID. NO. 6842    100-PheArgLysLysGlnAlaGlnPheGluGluAspTyrAsnLeuArgArgAsnGluGluPheAla-120
SEQ. ID. NO. 6843    133-IleAlaLysGlnGluGlyTyr-139
SEQ. ID. NO. 6844    154-AspValThrAspSerValIleLysGluMetAsnAlaArg-166
571
AMPHI Regions - AMPHI
SEQ. ID. NO. 6845    6-AlaValAsnValLeu-10
SEQ. ID. NO. 6846    40-AspGlyAlaArgValPheArgAlaGly-48
SEQ. ID. NO. 6847    63-AlaAlaValAlaAspPhePheAlaVal-71
SEQ. ID. NO. 6848    94-ValGluValPheLysGlu-99
Antigenic Index - Jameson-Wolf
SEQ. ID. NO. 6849    13-AlaAlaGlyArgGlyThr-18
SEQ. ID. NO. 6850    35-LysGlnAlaGlnAlaAspGlyAlaArgValPheArgAlaGlyHisArgGluGluGlnLeuGlyGlyAspVal-58
SEQ. ID. NO. 6851    76-PheArgThrGluArgAlaAla-82
SEQ. ID. NO. 6852    96-ValPheLysGluGlyAspPhe-102
SEQ. ID. NO. 6853    110-ArgAsnAlaAspPheAlaAlaGluHisGlnArGluGlyPheAlaGlnGlyGluGluProGlyLeu-131
SEQ. ID. NO. 6854    142-AlaAlaArgGlnGlyAspPheGlyVal-150
SEQ. ID. NO. 6855    155-ValAlaAlaArgArgPro-160
Hydrophilic Regions - Hopp-Woods
SEQ. ID. NO. 6856    13-AlaAlaGlyArgGly-17
SEQ. ID. NO. 6857    35-LysGlnAlaGlnAlaAspGlyAlaArgValPheArgAlaGlyHisArgGluGluGlnLeuGly-55
SEQ. ID. NO. 6858    76-PheArgThrGluArgAlaAla-82
SEQ. ID. NO. 6859    96-ValPheLysGluGlyAspPhe-102
SEQ. ID. NO. 6860    110-ArgAsnAlaAspPheAlaAlaGluHisGlnArgGluGlyPheAlaGlnGlyGluGluProGly-130
SEQ. ID. NO. 6861    155-ValAlaAlaArgArgPro-160
572-2
AMPHI Regions - AMPHI
SEQ. ID. NO. 6862    20-LeuAspValValSerArgHisProGluLysPheArgVal-32
SEQ. ID. NO. 6863    39-LysGlnValGluLysLeuAlaAlaGlnCys-48
SEQ. ID. NO. 6864    85-GlnAlaLeuValAspValAlaSerAlaAspGlu-95
SEQ. ID. NO. 6865    101-CysAlaIleValGlyAlaValGlyLeuProSerAlaLeuAla-114
SEQ. ID. NO. 6866    160-GlnValLeuProArgAspTyrAlaGlyArg-169
SEQ. ID. NO. 6867    192-LeuAsnThrPheAspArgIleThrProAlaGlnAlaValLys-205
SEQ. ID. NO. 6868    225-LysGlyLeuGluGlu-229
SEQ. ID. NO. 6869    253-IleHisSerMetValArg-258
SEQ. ID. NO. 6870    282-GlyLeuProGluArgIleAspSerGly-290
SEQ. ID. NO. 6871    299-LeuSerAlaLeuThr-303
SEQ. ID. NO. 6872    340-ValAlaAlaPheLeu-344
SEQ. ID. NO. 6873    350-PheThrAspIleAlaLysThrValAlaHisCysLeuAlaGlnAspPheSerAspGlyIleGlyAspIleGlyGly-374
Antigenic Index - Jameson-Wolf
SEQ. ID. NO. 6874    11-SerThrGlySerIleGlyGluSerThrLeu-20
SEQ. ID. NO. 6875    22-ValValSerArgHisProGluLysPheArg-31
SEQ. ID. NO. 6876    39-LysGlnValGluLysLeuAla-45
SEQ. ID. NO. 6877    59-AlaAspAlaGluHisAlaAlaArgLeu-67
SEQ. ID. NO. 6878    69-AlaLeuLeuLysArgAspGlyThrAla-77
SEQ. ID. NO. 6879    91-AlaSerAlaAspGluValSer-97
SEQ. ID. NO. 6880    117-GlnLysGlyLysThr-121
SEQ. ID. NO. 6881    125-AlaAsnLysGluThrLeu-130
SEQ. ID. NO. 6882    140-ThrAlaArgAlaAsnGly-145
SEQ. ID. NO. 6883    150-ProValAspSerGluHis-155
SEQ. ID. NO. 6884    162-LeuProArgAspTyrAlaGlyArgLeuAsnGluHisGly-174
SEQ. ID. NO. 6885    193-AsnThrPheAspArgIleThrProAlaGlnAlaValLysHisProAsnTrpArgMetGlyArgLysIleSerValAspSer-219
SEQ. ID. NO. 6886    224-AsnLysGlyLeuGluLeu-229
SEQ. ID. NO. 6887    237-AsnCysProProAspLysLeuGluVal-245
SEQ. ID. NO. 6888    257-ValArgTyrArgAspGlySerVal-264
SEQ. ID. NO. 6889    269-GlyAsnProAspMetArgThr-275
SEQ. ID. NO. 6890    283-LeuProGluArgIleAspSerGlyValGlyAspLeuAspPhe-296
SEQ. ID. NO. 6891    303-ThrPheGlnLysProAspPheAspArg-311
SEQ. ID. NO. 6892    363-GlnAspPheSerAspGlyIleGlyAspIleGly-373
SEQ. ID. NO. 6893    378-GlnAspAlaArgThrArgAlaGlnAla-386
Hydrophilic Regions - Hopp-Woods
SEQ. ID. NO. 6894    22-ValValSerArgHisProGluLysPheArg-31
SEQ. ID. NO. 6895    39-LysGlnValGluLysLeuAla-45
SEQ. ID. NO. 6896    59-AlaAspAlaGluHisAlaAlaArgLeu-67
SEQ. ID. NO. 6897    69-AlaLeuLeuLysArgAspGlyThrAla-77
SEQ. ID. NO. 6898    91-AlaSerAlaAspGluValSer-97
SEQ. ID. NO. 6899    126-AsnLysGluThrLeu-130
SEQ. ID. NO. 6900    140-ThrAlaArgAlaAsnGly-145
SEQ. ID. NO. 6901    151-ValAspSerGluHis-155
SEQ. ID. NO. 6902    165-AspTyrAlaGlyArgLeuAsnGlu-172
SEQ. ID. NO. 6903    196-AspArgIleThrPro-200
SEQ. ID. NO. 6904    210-ArgMetGlyArgLysIleSerVal-217
SEQ. ID. NO. 6905    225-LysGlyLeuGluLeu-229
SEQ. ID. NO. 6906    239-ProProAspLysLeuGlu-244
SEQ. ID. NO. 6907    257-ValArgTyrArgAspGlySer-263
SEQ. ID. NO. 6908    269-GlyAsnProAspMetArgThr-275
SEQ. ID. NO. 6909    283-LeuProGluArgIleAspSerGlyValGlyAspLeuAspPhe-296
SEQ. ID. NO. 6910    305-GlnLysProAspPheAspArg-311

TABLE 1-continued

| | |
|---|---|
| SEQ. ID. NO. 6911 | 364-AspPheSerAspGlyIleGly-370 |
| SEQ. ID. NO. 6912 | 378-GlnAspAlaArgThrArgAlaGlnAla-386 |

574
AMPHI Regions - AMPHI

| | |
|---|---|
| SEQ. ID. NO. 6913 | 6-ProAsnSerLeuLysLys-11 |
| SEQ. ID. NO. 6914 | 47-LeuLysGlnAlaLysSerIleProSerGlyPheTyrLysSerLeuAspAlaLeuValAspArgAsnSerGlyArgAlaAlaArgGluLeuAlaGluVal ValAsp-81 |
| SEQ. ID. NO. 6915 | 94-GlyLysLeuTyrArgGln-99 |
| SEQ. ID. NO. 6916 | 113-MetLeuAspSerProAspThr-119 |
| SEQ. ID. NO. 6917 | 175-GluLysAlaValGluThrAlaArgLeu-183 |
| SEQ. ID. NO. 6918 | 218-AsnValGlyLysAlaLeuGluAlaAsnLysLysCys-229 |
| SEQ. ID. NO. 6919 | 246-PheProAlaAlaValGluAlaTyrAlaAlaIleGlu-257 |
| SEQ. ID. NO. 6920 | 266-MetValGlyGluLysLeuTyrGluAlaTyrAla-276 |
| SEQ. ID. NO. 6921 | 281-ProGluGluGlyLeuAsnArgLeuThrGlyTyrMetGlnThrPheProGluLeuAspLeu-300 |
| SEQ. ID. NO. 6922 | 332-AsnGlyValTyrArg-336 |
| SEQ. ID. NO. 6923 | 357-ArgSerValIleGlyArgGlnLeuGlnArgSer-367 |

Antigenic Index - Jameson-Wolf

| | |
|---|---|
| SEQ. ID. NO. 6924 | 1-MetArgProAsnLeuProAsnSerLeuLysLysAlaAspMetAspAsn-16 |
| SEQ. ID. NO. 6925 | 45-ThrValLeuLysGlnAlaLysSerIleProSerGlyPheTyrLysSerLeuAspAlaLeuValAspArgAsnSerGlyArgAlaAlaArgGluLeuAla GluValValAspGlyArgProGlnSerTyrAsp-88 |
| SEQ. ID. NO. 6926 | 96-LeuTyrArgGlnArgGlyGluAsnAspLysAlaIleAsnIleHisArgThrMetLeuAspSerProAspThrValGlyGluLysArgAlaArgVal-127 |
| SEQ. ID. NO. 6927 | 135-TyrGlnSerAlaGlyLeuValAspArgAlaGlu-145 |
| SEQ. ID. NO. 6928 | 151-LeuGlnAspGlyLysMetAlaArgGluAlaArgGln-162 |
| SEQ. ID. NO. 6929 | 168-TyrGlnGlnAspArgAspTrpGluLysAlaValGluThr-180 |
| SEQ. ID. NO. 6930 | 182-ArgLeuLeuSerHisAspAspGlnThrTyr-191 |
| SEQ. ID. NO. 6931 | 221-LysAlaLeuGluAlaAsnLysLysCysThrArg-231 |
| SEQ. ID. NO. 6932 | 238-AspIleGluHisArgGlnGlyAsn-245 |
| SEQ. ID. NO. 6933 | 277-AlaGlnGlyLysProGluGluGlyLeuAsnArgLeuThrGlyTyr-291 |
| SEQ. ID. NO. 6934 | 312-LysCysGluLysGluAlaAla-318 |
| SEQ. ID. NO. 6935 | 323-GluLeuValArgLysProAspLeuAsnGly-333 |
| SEQ. ID. NO. 6936 | 341-LysLeuSerAspMetAsnProAlaTrpLysAlaAspAlaAspMetMetArg-357 |
| SEQ. ID. NO. 6937 | 368-ValMetTyrArgCysArgAsnCysHisPheLys-378 |
| SEQ. ID. NO. 6938 | 386-CysProAlaCysAsnLysTrpGlnThrPheThrProAsnLysIleGluVal-402 |

Hydrophilic Regions - Hopp-Woods

| | |
|---|---|
| SEQ. ID. NO. 6939 | 1-MetArgProAsnLeu-5 |
| SEQ. ID. NO. 6940 | 7-AsnSerLeuLysLysAlaAspMetAspAsn-16 |
| SEQ. ID. NO. 6941 | 45-ThrValLeuLysGlnAlaLysSerIle-53 |
| SEQ. ID. NO. 6942 | 62-AspAlaLeuValAspArgAsnSerGlyArgAlaAlaArgGluLeuAlaGluValValAspGlyArgProGlnSer-86 |
| SEQ. ID. NO. 6943 | 96-LeuTyrArgGlnArgGlyGluAsnAspLysAlaIleAsn-108 |
| SEQ. ID. NO. 6944 | 112-ThrMetLeuAspSerProAspThrValGlyGluLysArgAlaArgVal-127 |
| SEQ. ID. NO. 6945 | 140-LeuValAspArgAlaGlu-145 |
| SEQ. ID. NO. 6946 | 152-GlnAspGlyLysMetAlaArgGluAlaArgGln-162 |
| SEQ. ID. NO. 6947 | 169-GlnGlnAspArgAspTrpGluLysAlaValGluThr-180 |
| SEQ. ID. NO. 6948 | 184-LeuSerHisAspAspGlnThrTyr-191 |
| SEQ. ID. NO. 6949 | 221-LysAlaLeuGluAlaAsnLysLysCysThrArg-231 |
| SEQ. ID. NO. 6950 | 238-AspIleGluHisArgGlnGlyAsn-245 |
| SEQ. ID. NO. 6951 | 279-GlyLysProGluGluGlyLeuAsn-286 |
| SEQ. ID. NO. 6952 | 312-LysCysGluLysGluAlaAla-318 |
| SEQ. ID. NO. 6953 | 323-GluLeuValArgArgLysProAspLeu-331 |
| SEQ. ID. NO. 6954 | 349-TrpLysAlaAspAlaAspMetMetArg-357 |
| SEQ. ID. NO. 6955 | 368-ValMetTyrArgCysArgAsnCysHis-376 |
| SEQ. ID. NO. 6956 | 398-AsnLysIleGluVal-402 |

575
AMPHI Regions - AMPHI

| | |
|---|---|
| SEQ. ID. NO. 6957 | 8-PheArgLysProAlaSer-13 |
| SEQ. ID. NO. 6958 | 20-PheAlaGluAlaVal-24 |
| SEQ. ID. NO. 6959 | 42-SerThrValSerGlyLeuPheSerAla-50 |
| SEQ. ID. NO. 6960 | 114-LeuSerLysSerLysSer-119 |
| SEQ. ID. NO. 6961 | 139-SerSerAspSerPro-143 |
| SEQ. ID. NO. 6962 | 150-PheThrSerPhePheGly-155 |
| SEQ. ID. NO. 6963 | 163-ValSerThrSerAlaLysValIleSerMetPro-173 |
| SEQ. ID. NO. 6964 | 217-SerLysValTyrGluProProAsnArgProSerAsn-228 |
| SEQ. ID. NO. 6965 | 237-AlaGluThrCysSerThr-242 |
| SEQ. ID. NO. 6966 | 287-AlaGlyPheSerAlaPheAlaSerGlyAla-296 |
| SEQ. ID. NO. 6967 | 298-ThrPheAlaSerGlyPheSerThrGly-306 |
| SEQ. ID. NO. 6968 | 308-SerThrValAlaCys-312 |
| SEQ. ID. NO. 6969 | 315-GlySerAspGlyMetAspAlaValSerAlaLeu-325 |

Antigenic Index - Jameson-Wolf

| | |
|---|---|
| SEQ. ID. NO. 6970 | 2-ValSerGlyGluGluAlaPheArgLysProAlaSerProGluGlyGluAlaGlyPhe-20 |
| SEQ. ID. NO. 6971 | 34-GlyArgLeuSerGluLysSerValSer-42 |
| SEQ. ID. NO. 6972 | 54-ThrAspSerGlySerGlyVal-60 |
| SEQ. ID. NO. 6973 | 96-SerSerSerCysValSerAlaProAspLysMetProPhe-108 |
| SEQ. ID. NO. 6974 | 113-ArgLeuSerLysSerLysSerMetArgLeuGluGly-124 |
| SEQ. ID. NO. 6975 | 134-PheAlaAspAsnSerSerSerAspSerProSerLysAlaSerVal-148 |
| SEQ. ID. NO. 6976 | 155-GlyAlaGlySerGly-159 |
| SEQ. ID. NO. 6977 | 173-ProSerSerAlaAlaSerArgSerGlySerSerSerGlyThrAspSerSerValArgArgAlaArgLeuAspTrpAlaArgArgLysSerSerSer ArgAlaIle-208 |
| SEQ. ID. NO. 6978 | 211-AlaProProProAlaSer-216 |
| SEQ. ID. NO. 6979 | 218-LysValTyrGluProProAsnArgProSerAsnSer-229 |
| SEQ. ID. NO. 6980 | 232-SerValSerSerSerAlaGluThrCysSerThrGlySerGluThr-246 |

TABLE 1-continued

| | |
|---|---|
| SEQ. ID. NO. 6981 | 265-GlyAlaAspSerAlaAlaVal-271 |
| SEQ. ID. NO. 6982 | 280-GlyThrGlySerGlyArgThrAla-287 |
| SEQ. ID. NO. 6983 | 303-PheSerThrGlyPhe-307 |
| SEQ. ID. NO. 6984 | 313-LeuAspGlySerAspGlyMetAsp-320 |
| Hydrophilic Regions - Hopp-Woods | |
| SEQ. ID. NO. 6985 | 2-ValSerGlyGluGluAlaPheArgLysProAlaSerProGluGlyGluAlaGlyPhe-20 |
| SEQ. ID. NO. 6986 | 34-GlyArgLeuSerGluLysSerValSer-42 |
| SEQ. ID. NO. 6987 | 101-SerAlaProAspLysMetPro-107 |
| SEQ. ID. NO. 6988 | 113-ArgLeuSerLysSerLysSerMetArgLeuGluGly-124 |
| SEQ. ID. NO. 6989 | 137-AsnSerSerSerAspSerProSerLysAla-146 |
| SEQ. ID. NO. 6990 | 176-AlaAlaSerSerArgSerGlySerSerSerGlyThrAspSerSerValArgArgAlaArgLeuAspTrpAlaArgArgLysSerSerSerArgAla Ile-208 |
| SEQ. ID. NO. 6991 | 218-LysValTyrGluProProAsnArgProSerAsn-228 |
| SEQ. ID. NO. 6992 | 235-SerSerAlaGluThrCysSerThrGlySerGluThr-246 |
| SEQ. ID. NO. 6993 | 314-AspGlySerAspGlyMetAsp-320 |
| 576-1 | |
| AMPHI Regions - AMPHI | |
| SEQ. ID. NO. 6994 | 31-AlaSerGluProAlaAlaAla-37 |
| SEQ. ID. NO. 6995 | 46-SerIleGlySerThr-50 |
| SEQ. ID. NO. 6996 | 63-GlyArgSerLeuLysGlnMetLys-70 |
| SEQ. ID. NO. 6997 | 82-ThrGluAlaMetGln-86 |
| SEQ. ID. NO. 6998 | 102-GlnGluValMetMetLysPheLeuGlnGluGlnGlnAlaLysAlaValGluLysHis-120 |
| SEQ. ID. NO. 6999 | 140-AlaLysAspGlyValLysThrThr-147 |
| SEQ. ID. NO. 7000 | 199-SerGlnValIleProGlyTrpThrGluGlyVal-209 |
| Antigenic Index - Jameson-Wolf | |
| SEQ. ID. NO. 7001 | 20-AlaCysGlyLysLysGluAlaAlaPro-28 |
| SEQ. ID. NO. 7002 | 30-SerAlaSerGluProAlaAla-36 |
| SEQ. ID. NO. 7003 | 38-SerSerAlaGlnGlyAspThrSerSerIleGly-48 |
| SEQ. ID. NO. 7004 | 61-AspIleGlyArgSerLeuLysGlnMetLysGluGlnGlyAlaGluIleAspLeu-78 |
| SEQ. ID. NO. 7005 | 89-TyrAspGlyLysGluIleLysMetThrGluGluGlnAlaGln-102 |
| SEQ. ID. NO. 7006 | 109-LeuGlnGluGlnGlnAlaLysAlaValGluLysHisLysAlaAspAlaLysAlaAsnLysGluLysGlyGluAlaPheLeuLysGluAsnAlaAla LysAspGlyValLysThrThrAlaSerGlyLeu-151 |
| SEQ. ID. NO. 7007 | 154-LysIleThrLysGlnGlyGluGlyLysGlnProThrLysAspAspIleVal-170 |
| SEQ. ID. NO. 7008 | 173-GluTyrGluGlyArgLeuIleAsp-180 |
| SEQ. ID. NO. 7009 | 183-ValPheAspSerSerLysAlaAsnGlyGly-192 |
| SEQ. ID. NO. 7010 | 210-GlnLeuLeuLysGluGlyGlyGlu-217 |
| SEQ. ID. NO. 7011 | 224-SerAsnLeuAlaTyrArgGluGlnGlyAlaGlyAspLysIleGlyProAsnAla-241 |
| SEQ. ID. NO. 7012 | 253-GlyAlaProGluAsnAlaProAlaLysGlnProAla-264 |
| SEQ. ID. NO. 7013 | 266-ValAspIleLysLysValAsn-272 |
| Hydrophilic Regions - Hopp-Woods | |
| SEQ. ID. NO. 7014 | 21-CysGlyLysLysGluAlaAlaPro-28 |
| SEQ. ID. NO. 7015 | 30-SerAlaSerGluProAlaAla-36 |
| SEQ. ID. NO. 7016 | 40-AlaGlnGlyAspThrSerSer-46 |
| SEQ. ID. NO. 7017 | 61-AspIleGlyArgSerLeuLysGlnMetLysGluGlnGlyAlaGluIleAspLeu-78 |
| SEQ. ID. NO. 7018 | 89-TyrAspGlyLysGluIleLysMetThrGluGluGlnAlaGln-102 |
| SEQ. ID. NO. 7019 | 112-GlnGlnAlaLysAlaValGluLysHisLysAlaAspAlaLysAlaAsnLysGluLysGlyGluAlaPheLeuLysGluAsnAlaAlaLysAspGlyVal LysThrThrAla-148 |
| SEQ. ID. NO. 7020 | 155-IleThrLysGlnGlyGluGlyLysGlnProThrLysAspAspIleVal-170 |
| SEQ. ID. NO. 7021 | 173-GluTyrGluGlyArgLeuIleAsp-180 |
| SEQ. ID. NO. 7022 | 185-AspSerSerLysAlaAsnGly-191 |
| SEQ. ID. NO. 7023 | 210-GlnLeuLeuLysGluGlyGlyGlu-217 |
| SEQ. ID. NO. 7024 | 227-AlaTyrArgGluGlnGlyAlaGlyAspLysIleGlyPro-239 |
| SEQ. ID. NO. 7025 | 253-GlyAlaProGluAsnAlaProAlaLysGlnProAla-264 |
| SEQ. ID. NO. 7026 | 266-ValAspIleLysLysValAsn-272 |
| 577 | |
| AMPHI Regions - AMPHI | |
| SEQ. ID. NO. 7027 | 8-GlyLysIleValGlyAsn-13 |
| SEQ. ID. NO. 7028 | 24-AlaAlaSerTyrProLysProCysLysSerPheLysLeuAla-37 |
| SEQ. ID. NO. 7029 | 62-ThrValIleLysIleIle-67 |
| SEQ. ID. NO. 7030 | 104-AlaPheValValGlyIleIlePheGlyMetPheAlaLeuPheGlyArg-119 |
| SEQ. ID. NO. 7031 | 144-GluLeuThrAlaProProAlaGln-151 |
| Antigenic Index - Jameson-Wolf | |
| SEQ. ID. NO. 7032 | 1-MetGluArgAsnGlyVal-6 |
| SEQ. ID. NO. 7033 | 14-ArgIleLeuArgMetSerSerGluHisAla-23 |
| SEQ. ID. NO. 7034 | 26-SerTyrProLysProCysLysSerPheLys-35 |
| SEQ. ID. NO. 7035 | 88-LeuProGlyGlnLysPheAspLeu-95 |
| SEQ. ID. NO. 7036 | 121-LeuSerLeuArgGlyGluAsnGlyArgLeuArgAlaGluValLysLysAsnAlaArgLeuThrGlyLysGluLeuThrAlaProProAlaGlnAsnAla ProGluSerThrLysGlnPro-160 |
| Hydrophilic Regions - Hopp-Woods | |
| SEQ. ID. NO. 7037 | 1-MetGluArgAsnGlyVal-6 |
| SEQ. ID. NO. 7038 | 14-ArgIleLeuArgMetSerSerGluHisAla-23 |
| SEQ. ID. NO. 7039 | 29-LysProCysLysSerPheLys-35 |
| SEQ. ID. NO. 7040 | 121-LeuSerLeuArgGlyGluAsnGlyArgLeuArgAlaGluValLysLysAsnAlaArgLeuThrGlyLysGluLeuThr-146 |
| SEQ. ID. NO. 7041 | 152-AsnAlaProGluSerThrLysGlnPro-160 |
| 578 | |
| AMPHI Regions - AMPHI | |
| SEQ. ID. NO. 7042 | 10-PheAlaAspPhePheLysAspPheAlaProGlnPheGlyGlyPheGlnAsn-26 |
| SEQ. ID. NO. 7043 | 34-AspPhePheAlaAlaPheLeuGlyGlyLeuGluGlyAsnMetGlyAsnThrAla-51 |
| SEQ. ID. NO. 7044 | 71-AsnAlaAspAlaAlaArgPhe-77 |

TABLE 1-continued

```
Antigenic Index - Jameson-Wolf
SEQ. ID. NO. 7045    2-GlyLysLeuAspIle-6
SEQ. ID. NO. 7046    13-PhePheLysAspPheAlaProGlnPheGlyGly-23
SEQ. ID. NO. 7047    43-LeuGluGlyAsnMetGlyAsnThrAla-51
SEQ. ID. NO. 7048    73-AspAlaAlaArgPheAlaGlu-79
SEQ. ID. NO. 7049    90-GlnAsnIleGlnThrGlyAsnAspPheArgLeuGlnArgGlyGlyValGly-106
Hydrophilic Regions - Hopp-Woods
SEQ. ID. NO. 7050    2-GlyLysLeuAspIle-6
SEQ. ID. NO. 7051    73-AspAlaAlaArgPheAlaGlu-79
SEQ. ID. NO. 7052    96-AsnAspPheArgLeuGlnArg-102
579-1
AMPHI Regions - AMPHI
SEQ. ID. NO. 7053    6-PheAspPheLeuHisLeuIleSerValSerGlyTrpGluHisLeuAlaGlu-22
SEQ. ID. NO. 7054    49-ValAlaValMetArg-53
SEQ. ID. NO. 7055    66-IleSerPheLeuCysAsn-71
SEQ. ID. NO. 7056    115-LeuSerAsnPheAla-119
SEQ. ID. NO. 7057    129-ProPheLysValGlyAspPheIleArgValGlyGlyPheGluGlyTyrValArgGluIleLys-149
SEQ. ID. NO. 7058    258-GlnValValGluAsnLeuArg-264
Antigenic Index - Jameson-Wolf
SEQ. ID. NO. 7059    110-SerLeuLysAspGlnLeuSer-116
SEQ. ID. NO. 7060    128-ArgProPheLysVal-132
SEQ. ID. NO. 7061    136-IleArgValGlyGlyPheGluGlyTyrValArgGluIleLysMet-150
SEQ. ID. NO. 7062    154-SerLeuArgThrThrAspAsnGluGluValValLeu-165
SEQ. ID. NO. 7063    175-IleValAsnArgSerThrLeu-181
SEQ. ID. NO. 7064    198-LeuLysValAlaLysGluAlaValLeu-206
SEQ. ID. NO. 7065    216-ValGlnAsnGluGluArgGlnAla-223
SEQ. ID. NO. 7066    231-GlyAspAsnAlaIle-235
SEQ. ID. NO. 7067    244-AsnGluAlaAspArgTrpThrLeu-251
SEQ. ID. NO. 7068    253-CysAspLeuAsnGluGlnValValGluAsnLeuArgLysValAsn-267
SEQ. ID. NO. 7069    271-ProPheProGlnArgAspIleHis-278
Hydrophilic Regions - Hopp-Woods
SEQ. ID. NO. 7070    110-SerLeuLysAspGlnLeu-115
SEQ. ID. NO. 7071    144-TyrValArgGluIleLysMet-150
SEQ. ID. NO. 7072    155-LeuArgThrThrAspAsnGluGluValVal-164
SEQ. ID. NO. 7073    198-LeuLysValAlaLysGluAlaValLeu-206
SEQ. ID. NO. 7074    216-ValGlnAsnGluGluArgGlnAla-223
SEQ. ID. NO. 7075    244-AsnGluAlaAspArgTrp-249
SEQ. ID. NO. 7076    254-AspLeuAsnGluGlnValValGluAsnLeuArgLysValAsn-267
SEQ. ID. NO. 7077    273-ProGlnArgAspIleHis-278
580
AMPHI Regions - AMPHI
SEQ. ID. NO. 7078    47-ProValSerAlaSerLys-52
SEQ. ID. NO. 7079    54-SerLeuValLysProLeuSerGlnProLeuAla-64
Antigenic Index - Jameson-Wolf
SEQ. ID. NO. 7080    1-MetAspSerProLysValGlyCysGly-9
SEQ. ID. NO. 7081    35-ProPheGlyProThrMetPro-41
SEQ. ID. NO. 7082    48-ValSerAlaSerLys-52
SEQ. ID. NO. 7083    66-AlaArgProGluAlaAlaHis-72
SEQ. ID. NO. 7084    81-ArgProGluAlaLeuAlaAspSerSerValSerProThrHisAlaThrSerGlyGluVal-100
Hydrophilic Regions - Hopp-Woods
SEQ. ID. NO. 7085    1-MetAspSerProLysVal-6
SEQ. ID. NO. 7086    66-AlaArgProGluAlaAlaHis-72
SEQ. ID. NO. 7087    81-ArgProGluAlaLeuAla-86
SEQ. ID. NO. 7088    96-ThrSerGlyGluVal-100
581
AMPHI Regions - AMPHI
SEQ. ID. NO. 7089    43-SerHisPheIleSerLeu-48
SEQ. ID. NO. 7090    56-ArgGluCysPheValGlyPhe-62
SEQ. ID. NO. 7091    76-AlaThrAlaPheGlyArgIleAsnGln-84
SEQ. ID. NO. 7092    91-ValHisGlyPheLeuThrThrPheAlaGlyArgIleAlaAsnProAlaHisCysGlnSerGlnThr-112
Antigenic Index - Jameson-Wolf
SEQ. ID. NO. 7093    8-GlyGlnThrGlyIleGluGlnAsnThrPheCysArgArgGlyPheThrArgValAsnMetGlyGlyAsnThrAspVal-33
SEQ. ID. NO. 7094    35-ValGlnAlaAspArgGlyLeuThrSer-43
SEQ. ID. NO. 7095    49-SerLysLeuGluThrGluValArgGluCysPhe-59
SEQ. ID. NO. 7096    100-GlyArgIleAlaAsnProAlaHisCysGlnSerGlnThrAla-113
Hydrophilic Regions - Hopp-Woods
SEQ. ID. NO. 7097    35-ValGlnAlaAspArgGlyLeu-41
SEQ. ID. NO. 7098    49-SerLysLeuGluThrGluValArgGlu-57
582
AMPHI Regions - AMPHI
SEQ. ID. NO. 7099    27-ThrAspAsnValThrArgLeuAla-34
SEQ. ID. NO. 7100    65-ValArgSerSerLeu-69
SEQ. ID. NO. 7101    91-GlyGluThrAlaAspIleTyrThrProLeuSer-101
SEQ. ID. NO. 7102    139-GlySerProThrArg-143
SEQ. ID. NO. 7103    169-IleAlaGluAspLeuPhe-174
SEQ. ID. NO. 7104    246-SerArgSerTrpAsnArgIleTyrAlaMet-255
SEQ. ID. NO. 7105    263-LeuThrValIleProArgValTrpValArgAlaPheAspGlnSer-277
SEQ. ID. NO. 7106    286-IleAlaAspTyrMetGlyTyr-292
SEQ. ID. NO. 7107    334-LeuLysGlyValValArgGlyPheHisGlyTyrGlyGlu-346
```

TABLE 1-continued

Antigenic Index - Jameson-Wolf
SEQ. ID. NO. 7108   26-LeuThrAspAsnValThr-31
SEQ. ID. NO. 7109   34-AlaCysTyrAspArg-38
SEQ. ID. NO. 7110   44-LeuProSerSerAlaGlyGlnGluGlyGlnGluSerLysAla-57
SEQ. ID. NO. 7111   63-GluThrValArgSerSerLeuAspLysGlyGluAla-74
SEQ. ID. NO. 7112   77-ValValGluLysGlyGlyAspAlaLeuProAlaAspSerAlaGlyGluThrAlaAsp-95
SEQ. ID. NO. 7113   105-AspLeuAspLysAsnAspLeuArgGly-113
SEQ. ID. NO. 7114   115-LeuGlyValArgGluHisAsnProMetTyr-124
SEQ. ID. NO. 7115   131-AsnAsnSerProAsnTyrAlaProGlySerProThrArgGlyThrThrValGlnGluLysPheGlyGlnGlnLysArgAlaGluThrLysLeu-161
SEQ. ID. NO. 7116   165-PheLysSerLysIleAlaGluAspLeuPheLysThrArgAla-178
SEQ. ID. NO. 7117   183-GlyTyrThrGlnArgSerAspTrpGlnIleTyrAsnGlnGlyArgLysSerAlaProPheArgAsnThrAspTyrLysPro-209
SEQ. ID. NO. 7118   216-ProValLysAlaAspLeuProPheGlyGlyArgLeuArgMet-229
SEQ. ID. NO. 7119   237-GlnSerAsnGlyGlnSerArgProGluSerArgSerTrpAsn-250
SEQ. ID. NO. 7120   273-AlaPheAspGlnSerGlyAspLysAsnAspAsnProAspIleAlaAsp-288
SEQ. ID. NO. 7121   291-GlyTyrGlyAspValLysLeuGlnTyrArgLeuAsnAspArgGlnAsnVal-307
SEQ. ID. NO. 7122   312-ArgTyrAsnProLysThrGlyTyr-319
SEQ. ID. NO. 7123   330-IleLysGlyLysLeuLysGlyValVal-338
SEQ. ID. NO. 7124   342-HisGlyTyrGlyGluSerLeuIleAspTyrAsnHisLysGlnAsnGly-357
SEQ. ID. NO. 7125   365-AsnAspLeuAspGlyIle-370
Hydrophilic Regions - Hopp-Woods
SEQ. ID. NO. 7126   48-AlaGlyGlnGluGlyGlnGluSerLysAla-57
SEQ. ID. NO. 7127   63-GluThrValArgSerSerLeuAspLysGlyGluAla-74
SEQ. ID. NO. 7128   79-GluLysGlyGlyAspAlaLeuProAlaAspSerAlaGlyGluThrAlaAsp-95
SEQ. ID. NO. 7129   105-AspLeuAspLysAsnAspLeuArgGly-113
SEQ. ID. NO. 7130   115-LeuGlyValArgGluHisAsn-121
SEQ. ID. NO. 7131   140-SerProThrArgGlyThrThrValGlnGluLysPheGlyGlnGlnLysArgAlaGluThrLysLeu-161
SEQ. ID. NO. 7132   165-PheLysSerLysIleAlaGluAspLeuPheLysThrArgAla-178
SEQ. ID. NO. 7133   195-GlnGlyArgLysSerAlaProPheArgAsnThrAspTyrLysPro-209
SEQ. ID. NO. 7134   225-GlyArgLeuArgMet-229
SEQ. ID. NO. 7135   239-AsnGlyGlnSerArgProGluSerArgSerTrp-249
SEQ. ID. NO. 7136   274-PheAspGlnSerGlyAspLysAsnAspAsnProAspIleAlaAsp-288
SEQ. ID. NO. 7137   293-GlyAspValLysLeu-297
SEQ. ID. NO. 7138   299-TyrArgLeuAsnAspArgGlnAsn-306
SEQ. ID. NO. 7139   332-GlyLysLeuLysGlyValVal-338
SEQ. ID. NO. 7140   352-AsnHisLysGlnAsn-356
583
AMPHI Regions - AMPHI
SEQ. ID. NO. 7141   11-HisLeuAlaPheCysAlaPheCysGlyIle-20
SEQ. ID. NO. 7142   28-ArgLeuHisAsnArgMetTyrAsnAlaAlaAlaAlaArg-40
SEQ. ID. NO. 7143   58-ValThrAspAlaGln-62
SEQ. ID. NO. 7144   66-SerLysAsnGlyAspLysGlnIle-73
SEQ. ID. NO. 7145   75-AspThrHisProGlnPro-80
SEQ. ID. NO. 7146   117-GlyTyrAlaGlyTyrCysAspGln-124
SEQ. ID. NO. 7147   140-AspAsnGlyGlyAsnHisThrAsp-147
SEQ. ID. NO. 7148   162-GlyTyrGlyGlnCysGlnAsnGlnGlyAla-171
Antigenic Index - Jameson-Wolf
SEQ. ID. NO. 7149   24-ThrAlaGlyAsnArgLeuHisAsnArgMetTyr-34
SEQ. ID. NO. 7150   41-GlyIleGlyArgGlyAsnGlySerGlnGlnGlnPheGlyLysSerGluThrValThrAspAlaGlnArgPheSerSerLysAsnGlyAspLysGlnIle
                    SerAspThrHisProGlnProCysPheGluGlnThrAlaArgAsnHisAsnCysAspGlyAsnGlnProAsnGlnArgIleGlyGluArgThrGlnArgIleAla
                    HisArgArgAlaArgPhe-114
SEQ. ID. NO. 7151   117-GlyTyrAlaGlyTyCysAspGlnProAspGlyAsnAsnArgGlnArgAlaGlnArgHisGlyLeuAlaAspAsnGlyGlyAsnHisThrAspLysHis
                    GlyGlnGlnArgProSerLeuArgLeuAspProValGlyTyrGlyGlnCysGlnAsnGlnGlyAlaGlnTyrCysGlyAsnGlyGluGlyTyrArgPhe-182
SEQ. ID. NO. 7152   190-AspLeuArgLysLysAspArgProGluLysSerGluLys-202
Hydrophilic Regions - Hopp-Woods
SEQ. ID. NO. 7153   27-AsnArgLeuHisAsn-31
SEQ. ID. NO. 7154   41-GlyIleGlyArgGlyAsnGlySer-48
SEQ. ID. NO. 7155   51-GlnPheGlyLysSerGluThrValThrAspAlaGlnArgPheSerSerLysAsnGlyAspLysGlnIleSerAspThrHisPro-78
SEQ. ID. NO. 7156   84-GlnThrAlaArgAsnHisAsnCysAspGlyAsnGlnProAsnGlnArgIleGlyGluArgThrGlnArgIleAlaHisArgArgAlaArgPhe-114
SEQ. ID. NO. 7157   123-AspGlnProAspGlyAsnAsnArgGlnArgAlaGlnArg-135
SEQ. ID. NO. 7158   137-GlyLeuAlaAspAsnGlyGlyAsnHisThrAspLysHisGlyGlnGlnArgProSerLeuArgLeuAspPro-160
SEQ. ID. NO. 7159   178-GluGlyTyrArgPhe-182
SEQ. ID. NO. 7160   190-AspLeuArgLysLysAspArgProGluLysSerGluLys-202
584-2
AMPHI Regions - AMPHI
SEQ. ID. NO. 7161   28-GluPheSerGluSerAlaGly-34
SEQ. ID. NO. 7162   60-AlaGluPheValLysLysPheAsnLysPheIleArgLys-72
SEQ. ID. NO. 7163   115-AspPheAspGluLeuAsnArgPheIleAlaAspIle-126
SEQ. ID. NO. 7164   148-IleAspGlnValSerLysAsp-154
SEQ. ID. NO. 7165   166-LeuAlaGlyValLeuGly-171
SEQ. ID. NO. 7166   186-GlySerHisIleAla-190
SEQ. ID. NO. 7167   196-GlnAlaLysMetLeuArgAlaMet-203
Antigenic Index - Jameson-Wolf
SEQ. ID. NO. 7168   37-ValAlaGlnAspThrMetSer-43
SEQ. ID. NO. 7169   50-AlaGluGlyArgAspLysAsnAlaVal-58
SEQ. ID. NO. 7170   61-GluPheValLysLysPheAsnLysPheIleArgLysSerLysAsnGlySerPheLysThrGluLeuValSerArgSerAlaMetProArgTyrGlnTyr
                    ThrAsnGlyArgArgIleGlnThrGlyTrpGluGluArgAlaGluPheLysValGluGlyArgAspPheAspGluLeuAsn-120
SEQ. ID. NO. 7171   138-HisValSerArgGluArgArgAsnGluValIleAspGlnValSerLysAspAlaValLeu-157
SEQ. ID. NO. 7172   159-PheLysAlaArgAlaGluLysLeuAla-167
SEQ. ID. NO. 7173   189-IleAlaGlyGlyGly-193
SEQ. ID. NO. 7174   210-AsnMetGluGlyAlaAspSerAlaAlaProGlyValGluGluIleSer-225

TABLE 1-continued

Hydrophilic Regions - Hopp-Woods
SEQ. ID. NO. 7175    50-AlaGluGlyArgAspLysAsnAlaVal-58
SEQ. ID. NO. 7176    61-GluPheValLysLysPheAsnLysPheIleArgLysSerLysAsnGlySerPheLysThrGluLeuValSer-84
SEQ. ID. NO. 7177    95-AsnGlyArgArgIleGlnThrGlyTrpGluGluArgAlaGluPheLysValGluGlyArgAspPheAspGluLeuAsn-120
SEQ. ID. NO. 7178    138-HisValSerArgGluArgArgAsnGluValIleAspGlnValSerLysAspAlaValLeu-157
SEQ. ID. NO. 7179    159-PheLysAlaArgAlaGluLysLeuAla-167
SEQ. ID. NO. 7180    210-AsnMetGluGlyAlaAspSerAlaAlaProGlyValGluGluIleSer-225
585
AMPHI Regions - AMPHI
SEQ. ID. NO. 7181    6-ArgIlePheAlaThrPheCysAlaValIleValCys-17
SEQ. ID. NO. 7182    46-ThrThrLeuMetGlySerIleIleSer-54
SEQ. ID. NO. 7183    65-ArgGluIleLeuThrGluTrpLysAsp-73
SEQ. ID. NO. 7184    93-AsnArgTyrIleAsp-97
SEQ. ID. NO. 7185    133-LysAspTrpAspLysLeuGlnAlaArgArg-142
SEQ. ID. NO. 7186    153-ProLeuAlaProIleTrp-158
SEQ. ID. NO. 7187    178-LeuAlaGlyAsnIleAlaLysProIleArgIleLeuGlyAsnGlyMetAspArgValAla-197
SEQ. ID. NO. 7188    223-PheAspLysMetValGluLysLeuGluLysLeuVal-234
SEQ. ID. NO. 7189    247-GluMetArgSerPro-251
SEQ. ID. NO. 7190    255-MetGlnAlaIleValGlyLeuIle-262
SEQ. ID. NO. 7191    273-LeuLysArgLeuGluGly-278
SEQ. ID. NO. 7192    353-LeuTyrArgAlaPheAspAsnValIleArgAsnAlaValAsn-366
SEQ. ID. NO. 7193    430-IleIleGluGlnHisCysGlyLysIleIleAlaGlu-441
Antigenic Index - Jameson-Wolf
SEQ. ID. NO. 7194    36-AsnGlnPheAsnGlnArgArgThrIleGlu-45
SEQ. ID. NO. 7195    56-PheArgAlaArgGlyAspAlaGlyAlaArgGluIleLeuThrGluTrpLysAspSerProValSer-77
SEQ. ID. NO. 7196    84-GlnGlyAspGluLysLysAspIleLeu-92
SEQ. ID. NO. 7197    99-TyrThrIleGluArgAlaArgLeu-106
SEQ. ID. NO. 7198    120-GluTyrAspArgPheGlyGlu-126
SEQ. ID. NO. 7199    133-LysAspTrpAspLysLeuGlnAlaArgArgLeuProSerPro-146
SEQ. ID. NO. 7200    189-LeuGlyAsnGlyMetAspArgValAlaAsnGlyGluLeuGluThrArgIle-205
SEQ. ID. NO. 7201    207-GlnGlnValAspAspArgAspAspGluLeuSer-217
SEQ. ID. NO. 7202    225-LysMetValGluLysLeuGluLysLeuValAlaLysGluArgHisLeu-240
SEQ. ID. NO. 7203    246-HisGluMetArgSerProLeuAla-253
SEQ. ID. NO. 7204    264-AlaGlnProGlnLysGlnGluGlnTyrLeuLysArgLeuGluGlyGluLeuThrArgMetAspThrLeuAla-287
SEQ. ID. NO. 7205    294-SerArgLeuGluThrSerAsnMetAlaLeuGluLysGluSerLeuLys-309
SEQ. ID. NO. 7206    317-LeuValGluAspAsnGlnSerIleAlaGlnLysAsnGlyGln-330
SEQ. ID. NO. 7207    335-SerAlaAspGlyLysIleProGluAsnThr-344
SEQ. ID. NO. 7208    367-TyrSerProGluGlySerThr-373
SEQ. ID. NO. 7209    377-AsnIleGlyGlnAspHisLysHis-384
SEQ. ID. NO. 7210    388-AspValThrAspAsnGlyProGlyValAspGluMetGln-400
SEQ. ID. NO. 7211    409-TyrArgAlaAspSerSerAlaAsnLysProGlyThrGly-421
SEQ. ID. NO. 7212    432-GluGlnHisCysGlyLysIleIleAlaGluAsnIleLysProAsnGlyLeuArg-449
SEQ. ID. NO. 7213    453-IleLeuProLysLysLysThrGlySerLysThrGluLysSerAlaAsn-468
Hydrophilic Regions - Hopp-Woods
SEQ. ID. NO. 7214    37-GlnPheAsnGlnArgArgThrIleGlu-45
SEQ. ID. NO. 7215    56-PheArgAlaArgGlyAspAlaGlyAlaArgGluIleLeuThrGluTrpLysAspSerProVal-76
SEQ. ID. NO. 7216    84-GlnGlyAspGluLysLysAspIleLeu-92
SEQ. ID. NO. 7217    100-ThrIleGluArgAlaArgLeu-106
SEQ. ID. NO. 7218    120-GluTyrAspArgPheGlyGlu-126
SEQ. ID. NO. 7219    133-LysAspTrpAspLysLeuGlnAlaArgArgLeuPro-144
SEQ. ID. NO. 7220    192-GlyMetAspArgValAlaAsnGlyGluLeuGluThrArgIle-205
SEQ. ID. NO. 7221    207-GlnGlnValAspAspArgAspAspGluLeuSer-217
SEQ. ID. NO. 7222    225-LysMetValGluLysLeuGluLysLeuValAlaLysGluArgHisLeu-240
SEQ. ID. NO. 7223    246-HisGluMetArgSerProLeu-252
SEQ. ID. NO. 7224    265-GlnProGlnLysGlnGluGlnTyrLeuLysArgLeuGluGlyGluLeuThrArgMetAspThrLeuAla-287
SEQ. ID. NO. 7225    294-SerArgLeuGluThr-298
SEQ. ID. NO. 7226    302-AlaLeuGluLysGluSerLeuLys-309
SEQ. ID. NO. 7227    317-LeuValGluAspAsnGlnSerIleAlaGlnLysAsnGlyGln-330
SEQ. ID. NO. 7228    336-AlaAspGlyLysIleProGlu-342
SEQ. ID. NO. 7229    389-ValThrAspAsnGlyProGlyValAspGluMetGln-400
SEQ. ID. NO. 7230    410-ArgAlaAspSerSerAlaAsnLysProGlyThr-420
SEQ. ID. NO. 7231    438-IleIleAlaGluAsnIleLys-444
SEQ. ID. NO. 7232    454-LeuProLysLysLysThrGlySerLysThrGluLysSerAlaAsn-468
586
AMPHI Regions - AMPHI
SEQ. ID. NO. 7233    12-AspAsnPheLysTyrPheTrpLysThr-20
SEQ. ID. NO. 7234    30-IleLeuAlaAlaLeuGly-35
SEQ. ID. NO. 7235    56-ValLeuAlaAsnIleValGluLysAlaGlnSerLys-67
SEQ. ID. NO. 7236    80-LeuGlnGlnSerTyrProHisSerIleSer-89
SEQ. ID. NO. 7237    177-SerGlnGluAlaLeuLysAsnTyrGlyGlnAlaLeuGluLysMetProGlnAspSerValGlyArg-198
Antigenic Index - Jameson-Wolf
SEQ. ID. NO. 7238    4-HisLeuGluGluGlnGlnGluLeuAspAsn-13
SEQ. ID. NO. 7239    42-TyrGlnAsnArgLysValSerGlnAsnGlnGluAla-53
SEQ. ID. NO. 7240    60-IleValGluLysAlaGlnSerLysAlaProGlnSerGluIleAsnAlaGluLeuThrLysLeuGlnGln-82
SEQ. ID. NO. 7241    100-ThrGluPheAspAlaGlnArgTyrAspValAlaGluGly-112
SEQ. ID. NO. 7242    118-LeuSerLeuAsnGlnLysAspSerLeu-125
SEQ. ID. NO. 7243    140-GlnGlnLysLysTyrAspAla-146
SEQ. ID. NO. 7244    153-ThrProValGluAlaAspPhe-159
SEQ. ID. NO. 7245    164-MetGluThrLysGlyAspVal-170

TABLE 1-continued

| | |
|---|---|
| SEQ. ID. NO. 7246 | 173-AlaGlnGlyLysSerGlnGluAlaLeuLysAsnTyrGlyGlnAlaLeuGluLysMetProGlnAspSerValGlyArgGluLeuVal-201 |
| SEQ. ID. NO. 7247 | 204-LysLeuAspSerLeuLys-209 |
| Hydrophilic Regions - Hopp-Woods | |
| SEQ. ID. NO. 7248 | 4-HisLeuGluGluGlnGlnGluLeuAspAsn-13 |
| SEQ. ID. NO. 7249 | 43-GlnAsnArgLysValSerGlnAsnGlnGluAla-53 |
| SEQ. ID. NO. 7250 | 60-IleValGluLysAlaGlnSerLysAlaProGlnSerGluIleAsnAlaGluLeuThrLys-79 |
| SEQ. ID. NO. 7251 | 100-ThrGluPheAspAlaGlnArgTyrAspValAlaGluGly-112 |
| SEQ. ID. NO. 7252 | 120-AsnGlnLysAspSerLeu-125 |
| SEQ. ID. NO. 7253 | 140-GlnGlnLysLysTyrAspAla-146 |
| SEQ. ID. NO. 7254 | 153-ThrProValGluAlaAspPhe-159 |
| SEQ. ID. NO. 7255 | 164-MetGluThrLysGlyAspVal-170 |
| SEQ. ID. NO. 7256 | 174-GlnGlyLysSerGlnGluAlaLeuLys-182 |
| SEQ. ID. NO. 7257 | 187-AlaLeuGluLysMetProGlnAspSerValGlyArgGluLeuVal-201 |
| SEQ. ID. NO. 7258 | 204-LysLeuAspSerLeuLys-209 |
| 587 | |
| AMPHI Regions - AMPHI | |
| SEQ. ID. NO. 7259 | 6-LeuProAlaLeuProAlaIleLeuProLeuSerThr-17 |
| SEQ. ID. NO. 7260 | 190-AsnGlySerLysThrLeuSer-196 |
| Antigenic Index - Jameson-Wolf | |
| SEQ. ID. NO. 7261 | 27-AspIleMetThrAspLysGlyLysTrpLysLeuGluThr-39 |
| SEQ. ID. NO. 7262 | 44-LeuAsnSerGluAsnAsnArgAlaGluLeu-53 |
| SEQ. ID. NO. 7263 | 72-GluIleGlnGluAsnGlySerAsnThrAsp-81 |
| SEQ. ID. NO. 7264 | 95-GlyAsnThrAspIleTyrGlySerGlySer-104 |
| SEQ. ID. NO. 7265 | 108-HisGluGluArgLysLeuAspGlyAsnSerLysThrArgAsnLysArgMetSerAsp-126 |
| SEQ. ID. NO. 7266 | 135-PheLeuLysAspAspLysAsnProAla-143 |
| SEQ. ID. NO. 7267 | 151-ThrValTyrGluLysSerArgAsnLysAlaSerSerGlyLysSer-165 |
| SEQ. ID. NO. 7268 | 187-TyrArgIleAsnGlySerLysThrLeuSerAspGlyIleArgTyrLysSerGlyAsnTyr-206 |
| SEQ. ID. NO. 7269 | 217-AlaAsnAspArgIleSerLeuThrGlyGly-226 |
| SEQ. ID. NO. 7270 | 231-GlyArgGlnProAspArgThrAspGlyLysArgGluSerSerArgAsnThrSerThr-249 |
| SEQ. ID. NO. 7271 | 273-ValSerGlyGlnSerSerSerGluLeuLysPhe-283 |
| Hydrophilic Regions - Hopp-Woods | |
| SEQ. ID. NO. 7272 | 27-AspIleMetThrAspLysGlyLysTrpLysLeu-37 |
| SEQ. ID. NO. 7273 | 47-GluAsnAsnArgAlaGluLeu-53 |
| SEQ. ID. NO. 7274 | 72-GluIleGlnGluAsnGlySerAsnThr-80 |
| SEQ. ID. NO. 7275 | 108-HisGluGluArgLysLeuAspGlyAsnSerLysThrArgAsnLysArgMetSerAsp-126 |
| SEQ. ID. NO. 7276 | 135-PheLeuLysAspAspLysAsnPro-142 |
| SEQ. ID. NO. 7277 | 151-ThrValTyrGluLysSerArgAsnLysAlaSerSerGly-163 |
| SEQ. ID. NO. 7278 | 193-LysThrLeuSerAspGlyIleArgTyrLysSer-203 |
| SEQ. ID. NO. 7279 | 217-AlaAsnAspArgIleSer-222 |
| SEQ. ID. NO. 7280 | 232-ArgGlnProAspArgThrAspGlyLysArgGluSerSerArgAsnThr-247 |
| SEQ. ID. NO. 7281 | 277-SerSerSerGluLeuLysPhe-283 |
| 588 | |
| AMPHI Regions - AMPHI | |
| SEQ. ID. NO. 7282 | 52-GlnAspGlyArgAsnTyrThrGlySerPhe-61 |
| SEQ. ID. NO. 7283 | 99-GlyThrPheLysLys-103 |
| Antigenic Index - Jameson-Wolf | |
| SEQ. ID. NO. 7284 | 25-SerTyrGlnGluProGlyCysThrTyrAspGlyAsnValGlyLysAspGlyLysProAlaGlyLysGlyThrTrpArgCysGlnAspGlyArgAsnTyrThrGlySerPheLysAsnGlyLysPheAspGlyGlnGly-70 |
| SEQ. ID. NO. 7285 | 80-IlePheIleGluProPheAsnSerAspSerThrLysPheArg-93 |
| SEQ. ID. NO. 7286 | 100-ThrPheLysLysGlyLeuAlaHisGlyArgPheThrValSerGlnAsnGlyGluThr-118 |
| SEQ. ID. NO. 7287 | 124-CysGluAsnGlyMetIleLysGluValLysLeuProLysAsnLys-138 |
| Hydrophilic Regions - Hopp-Woods | |
| SEQ. ID. NO. 7288 | 36-AsnValGlyLysAspGlyLysProAlaGly-45 |
| SEQ. ID. NO. 7289 | 47-GlyThrTrpArgCysGlnAspGlyArgAsnTyr-57 |
| SEQ. ID. NO. 7290 | 61-PheLysAsnGlyLysPheAspGly-68 |
| SEQ. ID. NO. 7291 | 85-PheAsnSerAspSerThrLysPheArg-93 |
| SEQ. ID. NO. 7292 | 100-ThrPheLysLysGlyLeuAla-106 |
| SEQ. ID. NO. 7293 | 124-CysGluAsnGlyMetIleLysGluValLysLeuProLysAsnLys-138 |
| 589 | |
| AMPHI Regions - AMPHI | |
| SEQ. ID. NO. 7294 | 18-AlaSerArgIleGluLysValLeu-25 |
| SEQ. ID. NO. 7295 | 54-ValAlaAspIleAlaLysIleIleGluLys-63 |
| SEQ. ID. NO. 7296 | 125-SerValValGlnLeuTrpLeuAla-132 |
| SEQ. ID. NO. 7297 | 150-MetAspValLeuValThrIle-156 |
| SEQ. ID. NO. 7298 | 193-PheValSerLeuGlyLysPheLeuGluHisArg-203 |
| SEQ. ID. NO. 7299 | 225-ValGlnArgAsnGlyGlu-230 |
| SEQ. ID. NO. 7300 | 240-GlnIleGlyAspLeuIleArg-246 |
| SEQ. ID. NO. 7301 | 307-GlnThrGlnLeuGlyAspMetMetAsnAlaLeuSerGluAlaGln-321 |
| SEQ. ID. NO. 7302 | 325-AlaProIleAlaArgValAlaAspLys-333 |
| SEQ. ID. NO. 7303 | 391-MetGlyLysAlaVal-395 |
| SEQ. ID. NO. 7304 | 466-IleValSerAlaAlaGln-471 |
| SEQ. ID. NO. 7305 | 477-IleProAlaAlaGln-481 |
| SEQ. ID. NO. 7306 | 497-GlyValGlyLeuValLys-502 |
| SEQ. ID. NO. 7307 | 511-LeuAlaLeuProLysPheLeuAspGlyValTrpAspIleAlaSerIle-526 |
| SEQ. ID. NO. 7308 | 539-PheAlaLeuAlaAspAlaLeuLys-546 |
| SEQ. ID. NO. 7309 | 548-AspThrAlaGluAlaIleGlyArgLeu-556 |
| SEQ. ID. NO. 7310 | 598-GluValGlnLysLeuLysAlaAla-605 |
| SEQ. ID. NO. 7311 | 612-ValGlyAspGlyIleAsnAspAlaPro-620 |
| SEQ. ID. NO. 7312 | 635-AlaAspValAlaGluHisThr-641 |

TABLE 1-continued

| SEQ. ID. NO. 7313 | 648-GlnHisSerValAsnGlnLeuAlaAsp-656 |

SEQ. ID. NO. 7314     675-AlaPhePheTyrAsnIleLeu-681

Antigenic Index - Jameson-Wolf

SEQ. ID. NO. 7315     1-MetGlnGlnLysIleArgPheGlnIle-9
SEQ. ID. NO. 7316     17-CysAlaSerArgIleGluLysValLeuAsnLysLysAspPheValGluSer-33
SEQ. ID. NO. 7317     39-AlaSerGluGluAlaGlnValValPheAspAspSerLysThrSerVal-54
SEQ. ID. NO. 7318     59-LysIleIleGluLysThrGlyTyrGlyAlaLysGluLysThrGluAspThrLeuProGlnProGluAlaGluHis-83
SEQ. ID. NO. 7319     109-GlyArgHisAspTrp-113
SEQ. ID. NO. 7320     143-IleLysGlyGlyLeu-147
SEQ. ID. NO. 7321     200-LeuGluHisArgThrLysLysSerSerLeuAsn-210
SEQ. ID. NO. 7322     223-ValAsnValGlnArgAsnGlyGluTrpLysGlnLeuProIleAspGln-238
SEQ. ID. NO. 7323     248-AsnHisGlyGluArgIleAlaAla-255
SEQ. ID. NO. 7324     257-GlyIleIleGluSerGlySerGlyTrpAlaAspGluSerHisLeuThrGlyGluSerAsnProGluGluLysLysAlaGlyGly-284
SEQ. ID. NO. 7325     293-ThrGluGlySerVal-297
SEQ. ID. NO. 7326     318-SerGluAlaGlnGlySerLysAlaProIle-327
SEQ. ID. NO. 7327     329-ArgValAlaAspLysAlaAla-335
SEQ. ID. NO. 7328     356-IleLysGlyAspTrp-360
SEQ. ID. NO. 7329     391-MetGlyLysAlaValLys-396
SEQ. ID. NO. 7330     404-AlaAlaAlaMetGluGluAlaAlaHis-412
SEQ. ID. NO. 7331     417-ValLeuAspLysThrGlyThrLeuThrGluGlySerProGln-430
SEQ. ID. NO. 7332     438-ProAspSerGlyPheAspGluAspAlaLeu-447
SEQ. ID. NO. 7333     454-ValGluGlnAsnAla-458
SEQ. ID. NO. 7334     493-AlaGluValGluGly-497
SEQ. ID. NO. 7335     502-LysAlaGlyLysAlaGluPheAla-509
SEQ. ID. NO. 7336     530-SerValAspAsnLysProIleGly-537
SEQ. ID. NO. 7337     543-AspAlaLeuLysAlaAspThrAlaGluAlaIleGlyArgLeuLysLysHisAsnIle-561
SEQ. ID. NO. 7338     567-SerGlyAspAsnGlnGlyThrValGluTyrValAla-578
SEQ. ID. NO. 7339     588-GlyAsnMetSerProArgAspLysAlaAlaGluValGlnLysLeuLysAlaAlaGly-606
SEQ. ID. NO. 7340     612-ValGlyAspGlyIleAsnAspAla-619
SEQ. ID. NO. 7341     631-MetLysGlyGlyAlaAspValAlaGlu-639
SEQ. ID. NO. 7342     710-AsnAlaLeuArgLeuLysArgValLysIleAsp-720

Hydrophilic Regions - Hopp-Woods

SEQ. ID. NO. 7343     1-MetGlnGlnLysIleArgPheGlnIle-9
SEQ. ID. NO. 7344     19-SerArgIleGluLysValLeuAsnLysLysAspPheValGlu-32
SEQ. ID. NO. 7345     39-AlaSerGluGluAlaGlnValValPheAspAspSerLysThrSerVal-54
SEQ. ID. NO. 7346     64-ThrGlyTyrGlyAlaLysGluLysThrGluAspThrLeuProGlnProGluAlaGluHis-83
SEQ. ID. NO. 7347     200-LeuGluHisArgThrLysLysSerSerLeu-209
SEQ. ID. NO. 7348     224-AsnValGlnArgAsnGlyGluTrpLys-232
SEQ. ID. NO. 7349     248-AsnHisGlyGluArgIleAlaAla-255
SEQ. ID. NO. 7350     257-GlyIleIleGluSer-261
SEQ. ID. NO. 7351     265-TrpAlaAspGluSerHisLeuThrGlyGluSerAsnProGluGluLysLysAlaGlyGly-284
SEQ. ID. NO. 7352     318-SerGluAlaGlnGlySerLysAlaProIle-327
SEQ. ID. NO. 7353     329-ArgValAlaAspLysAlaAla-335
SEQ. ID. NO. 7354     404-AlaAlaAlaMetGluGluAlaAlaHis-412
SEQ. ID. NO. 7355     417-ValLeuAspLysThrGlyThrLeuThrGluGlySerPro-429
SEQ. ID. NO. 7356     440-SerGlyPheAspGluAspAlaLeu-447
SEQ. ID. NO. 7357     454-ValGluGlnAsnAla-458
SEQ. ID. NO. 7358     493-AlaGluValGluGly-497
SEQ. ID. NO. 7359     502-LysAlaGlyLysAlaGluPheAla-509
SEQ. ID. NO. 7360     531-ValAspAsnLysPro-535
SEQ. ID. NO. 7361     543-AspAlaLeuLysAlaAspThrAlaGluAlaIleGlyArgLeuLysLysHisAsnIle-561
SEQ. ID. NO. 7362     568-GlyAspAsnGlnGly-572
SEQ. ID. NO. 7363     591-SerProArgAspLysAlaAlaGluValGlnLysLeuLysAlaAlaGly-606
SEQ. ID. NO. 7364     633-GlyGlyAlaAspValAlaGlu-639
SEQ. ID. NO. 7365     712-LeuArgLeuLysArgValLysIleAsp-720

590-1

AMPHI Regions - AMPHI

SEQ. ID. NO. 7366     77-TyrLeuProAspAsnLeuLysThrValLeuGluGlnProValThrLeuValAsnHisIleThrHis-98
SEQ. ID. NO. 7367     100-ProPheAlaGlyGlyPhe-105
SEQ. ID. NO. 7368     123-LysValLeuGluArgPhePheGly-130
SEQ. ID. NO. 7369     132-GlnValProAlaSerLeu-137
SEQ. ID. NO. 7370     177-TyrGlnLysGlyPheLysSerTyrArgAsnGly-187
SEQ. ID. NO. 7371     214-ThrSerAspGlyIleAsnProLeu-221
SEQ. ID. NO. 7372     248-AsnGluLeuValAsnLeuVal-254
SEQ. ID. NO. 7373     331-LysArgLysPheAla-335
SEQ. ID. NO. 7374     420-LysMetLeuGluAsp-424
SEQ. ID. NO. 7375     450-AspIleAsnGluThrLeuArgLeuMet-458
SEQ. ID. NO. 7376     460-AspSerThrValGln-464

Antigenic Index - Jameson-Wolf

SEQ. ID. NO. 7377     1-MetLysLysProLeu-5
SEQ. ID. NO. 7378     26-LysAlaGluGluSerLeuThrGlnGlnGlnLysIleLeuGln-39
SEQ. ID. NO. 7379     47-GluSerHisGlnTyrGluArgGlyTrp-55
SEQ. ID. NO. 7380     62-ThrValIleArgLeuLysProGluLeu-70
SEQ. ID. NO. 7381     72-AsnAsnAlaArgLysTyrLeuProAspAsnLeuLysThrValLeu-86
SEQ. ID. NO. 7382     113-ThrGluPheLysTyrAlaProGluThrArgLysValLeuGlu-126
SEQ. ID. NO. 7383     128-PhePheGlyLysGlnValPro-134
SEQ. ID. NO. 7384     144-AsnGlySerGlyLysMetGluVal-151
SEQ. ID. NO. 7385     157-AspTyrGluGluLeuSerGly-163
SEQ. ID. NO. 7386     175-ThrValTyrGlnLysGlyPheLysSerTyrArgAsnGlyTyrAspAlaPro-191
SEQ. ID. NO. 7387     196-LysLeuAlaAspLysGlyAspAlaAlaPheGlu-206

TABLE 1-continued

| | |
|---|---|
| SEQ. ID. NO. 7388 | 208-ValHisPheAspSerGluThrSerAspGlyIleAsn-219 |
| SEQ. ID. NO. 7389 | 233-PheSerLeuGluTrpLysGluGlyValAspTyr-243 |
| SEQ. ID. NO. 7390 | 264-AsnProAsnGlySerIleAlaProSerLysIleGluValGly-277 |
| SEQ. ID. NO. 7391 | 281-PheSerThrLysThrGlyGluSerGlyAla-290 |
| SEQ. ID. NO. 7392 | 292-IleAsnSerGluGlyGlnPheArgPheAspThr-302 |
| SEQ. ID. NO. 7393 | 304-ValTyrGlyAspGluLysTyrGlyPro-312 |
| SEQ. ID. NO. 7394 | 330-LeuLysArgLysPheAla-335 |
| SEQ. ID. NO. 7395 | 338-SerAlaLysLysMetThrGluGluGlnIleArgAsnAspLeu-351 |
| SEQ. ID. NO. 7396 | 355-ValLysGlyGluAlaSerGlyLeuPheThrAsnAsnProValLeuAsp-370 |
| SEQ. ID. NO. 7397 | 378-LeuProSerGlyLysIleAspValGlyGly-387 |
| SEQ. ID. NO. 7398 | 389-IleMetPheLysAspMetLysLysGluAspLeuAsnGln-401 |
| SEQ. ID. NO. 7399 | 406-LeuLysLysThrGluAlaAspIleArgMet-415 |
| SEQ. ID. NO. 7400 | 437-AsnAlaGluAspGluAlaGluGlyArgAlaSerLeuAspAspIleAsnGluThrLeu-455 |
| SEQ. ID. NO. 7401 | 466-MetAlaArgGluLysTyr-471 |
| SEQ. ID. NO. 7402 | 475-AsnGlyAspGlnIleAsp-480 |
| SEQ. ID. NO. 7403 | 485-LeuLysAsnAsnGlnLeuLysLeuAsnGlyLysThrLeuGlnAsnGluProGluProAspPheAspGluGlyGlyMetValSerGluProGlnGln-516 |
| Hydrophilic Regions - Hopp-Woods | |
| SEQ. ID. NO. 7404 | 1-MetLysLysProLeu-5 |
| SEQ. ID. NO. 7405 | 26-LysAlaGluGluSerLeuThrGln-33 |
| SEQ. ID. NO. 7406 | 62-ThrValIleArgLeuLysProGluLeu-70 |
| SEQ. ID. NO. 7407 | 72-AsnAsnAlaArgLysTyrLeuProAspAsnLeuLysThrValLeu-86 |
| SEQ. ID. NO. 7408 | 113-ThrGluPheLysTyrAlaProGluThrGluLysValLeuGlu-126 |
| SEQ. ID. NO. 7409 | 147-GlyLysMetGluVal-151 |
| SEQ. ID. NO. 7410 | 157-AspTyrGluGluLeuSerGly-163 |
| SEQ. ID. NO. 7411 | 180-GlyPheLysSerTyrArgAsnGlyTyr-188 |
| SEQ. ID. NO. 7412 | 196-LysLeuAlaAspLysGlyAspAlaAlaPheGlu-206 |
| SEQ. ID. NO. 7413 | 208-ValHisPheAspSerGluThrSerAspGly-217 |
| SEQ. ID. NO. 7414 | 233-PheSerLeuGluTrpLysGluGlyValAspTyr-243 |
| SEQ. ID. NO. 7415 | 272-SerLysIleGluValGly-277 |
| SEQ. ID. NO. 7416 | 306-GlyAspGluLysTyrGlyPro-312 |
| SEQ. ID. NO. 7417 | 330-LeuLysArgLysPheAla-335 |
| SEQ. ID. NO. 7418 | 338-SerAlaLysLysMetThrGluGluGlnIleArgAsnAspLeu-351 |
| SEQ. ID. NO. 7419 | 355-ValLysGlyGluAla-359 |
| SEQ. ID. NO. 7420 | 381-GlyLysIleAspValGlyGly-387 |
| SEQ. ID. NO. 7421 | 389-IleMetPheLysAspMetLysLysGluAspLeuAsn-400 |
| SEQ. ID. NO. 7422 | 406-LeuLysLysThrGluAlaAspIleArgMet-415 |
| SEQ. ID. NO. 7423 | 437-AsnAlaGluAspGluAlaGluGlyArgAlaSerLeuAspAspIleAsnGluThrLeu-455 |
| SEQ. ID. NO. 7424 | 466-MetAlaArgGluLysTyr-471 |
| SEQ. ID. NO. 7425 | 486-LysAsnAsnGlnLeuLysLeuAsnGly-494 |
| SEQ. ID. NO. 7426 | 496-ThrLeuGlnAsnGluProGluProAspPheAspGluGlyGlyMetValSerGluProGlnGln-516 |
| 591 | |
| AMPHI Regions - AMPHI | |
| SEQ. ID. NO. 7427 | 6-AlaPheIlePheAla-10 |
| SEQ. ID. NO. 7428 | 17-LeuHisGluPheGlyHisTyrIleValAla-26 |
| SEQ. ID. NO. 7429 | 61-LeuGlyGlyTyrValLysMetValAsp-69 |
| SEQ. ID. NO. 7430 | 143-GlyAspLysIleGlnSerValAsnGlyThrProValAlaAspTrp-157 |
| SEQ. ID. NO. 7431 | 181-SerGlyAlaGlnThrValArgThrIleAspAlaAlaGlyThrProGluAlaGlyLysIleAlaLys-202 |
| SEQ. ID. NO. 7432 | 218-AlaGlyGlyValGluLys-223 |
| SEQ. ID. NO. 7433 | 234-ProGlyAspArgLeu-238 |
| SEQ. ID. NO. 7434 | 245-ProIleAlaSerTrpGlnGluTrpAlaAsnLeuThrArg-257 |
| SEQ. ID. NO. 7435 | 270-ArgAlaGlyGlnThr-274 |
| SEQ. ID. NO. 7436 | 304-AlaTrpAspAlaGlnIleArg-310 |
| SEQ. ID. NO. 7437 | 313-TyrArgProSerValValArgAlaPheGly-322 |
| SEQ. ID. NO. 7438 | 324-GlyTrpGluLysThrValSerHis-331 |
| SEQ. ID. NO. 7439 | 335-ThrLeuLysPhePheGlyLysLeuIle-343 |
| SEQ. ID. NO. 7440 | 351-HisIleSerGlyProLeuThrIleAla-359 |
| SEQ. ID. NO. 7441 | 373-TyrLeuGluPheLeuAlaLeu-379 |
| Antigenic Index - Jameson-Wolf | |
| SEQ. ID. NO. 7442 | 44-PhePheThrArgLysArgGlyAspThrGlu-53 |
| SEQ. ID. NO. 7443 | 68-ValAspThrArgGluGlyGluValSerGluAlaAspLeu-80 |
| SEQ. ID. NO. 7444 | 84-PheAspLysGlnHisProAlaLysArg-92 |
| SEQ. ID. NO. 7445 | 129-ValGluProAspThrIleAla-135 |
| SEQ. ID. NO. 7446 | 139-GlyPheGlnSerGlyAspLysIleGlnSer-148 |
| SEQ. ID. NO. 7447 | 157-TrpGlySerAlaGln-161 |
| SEQ. ID. NO. 7448 | 187-ArgThrIleAspAlaAlaGlyThrProGluAlaGlyLysIleLysAsnGlnGly-205 |
| SEQ. ID. NO. 7449 | 219-GlyGlyValGluLysGlySerProAlaGluLysAlaGlyLeuLysProGlyAspArgLeuThrAlaAlaAspGlyLysProIle-246 |
| SEQ. ID. NO. 7450 | 254-AsnLeuThrArgGlnSerProGlyLysLysIle-264 |
| SEQ. ID. NO. 7451 | 267-AsnTyrGluArgAlaGlyGlnThrHis-275 |
| SEQ. ID. NO. 7452 | 277-AlaAspIleArgProAspThrValGluGlnSerAspHis-289 |
| SEQ. ID. NO. 7453 | 295-ValGlyLeuArgProGlnProAspArgAlaTrp-305 |
| SEQ. ID. NO. 7454 | 307-AlaGlnIleArgArgSerTyrArgProSerVal-317 |
| SEQ. ID. NO. 7455 | 327-LysThrValSerHisSer-332 |
| SEQ. ID. NO. 7456 | 343-IleSerGlyAsnAla-347 |
| SEQ. ID. NO. 7457 | 362-AlaGlyGlnSerAla-366 |
| SEQ. ID. NO. 7458 | 408-IleArgGlyLysProLeuGlyGluArgValGln-418 |
| Hydrophilic Regions - Hopp-Woods | |
| SEQ. ID. NO. 7459 | 44-PhePheThrArgLysArgGlyAspThr-52 |
| SEQ. ID. NO. 7460 | 68-ValAspThrArgGluGlyGluValSerGluAlaAspLeu-80 |
| SEQ. ID. NO. 7461 | 84-PheAspLysGlnHisProAlaLysArg-92 |
| SEQ. ID. NO. 7462 | 129-ValGluProAspThrIleAla-135 |

TABLE 1-continued

| | |
|---|---|
| SEQ. ID. NO. 7463 | 139-GlyPheGlnSerGlyAspLysIleGlnSer-148 |
| SEQ. ID. NO. 7464 | 193-GlyThrProGluAlaGlyLysIleAlaLys-202 |
| SEQ. ID. NO. 7465 | 220-GlyValGluLysGlySerProAlaGluLysAlaGlyLeuLysProGlyAspArgLeuThrAlaAlaAspGlyLysPro-245 |
| SEQ. ID. NO. 7466 | 256-ThrArgGlnSerProGlyLysLysIle-264 |
| SEQ. ID. NO. 7467 | 268-TyrGluArgAlaGlyGln-273 |
| SEQ. ID. NO. 7468 | 277-AlaAspIleArgProAspThrValGluGlnSerAsp-288 |
| SEQ. ID. NO. 7469 | 299-ProGlnProAspArgAlaTrp-305 |
| SEQ. ID. NO. 7470 | 308-GlnIleArgArgSerTyrArg-314 |
| SEQ. ID. NO. 7471 | 362-AlaGlyGlnSerAla-366 |
| SEQ. ID. NO. 7472 | 411-LysProLeuGlyGluArgValGln-418 |

592
AMPHI Regions - AMPHI

| | |
|---|---|
| SEQ. ID. NO. 7473 | 6-PheGlyGlnIlePheSer-11 |
| SEQ. ID. NO. 7474 | 21-GlyGlyLeuLeuGlyGlyLeuIle-28 |
| SEQ. ID. NO. 7475 | 50-AlaProAsnAlaAlaAlaAlaAla-57 |
| SEQ. ID. NO. 7476 | 65-GlnGlyMetIleGlnMetLeuGlyValPheValAsp-76 |
| SEQ. ID. NO. 7477 | 94-ProTyrGlyAspLeu-98 |
| SEQ. ID. NO. 7478 | 109-ValSerGlnValGlyGlnTrp-115 |
| SEQ. ID. NO. 7479 | 153-ThrAlaValPheArgMet-158 |
| SEQ. ID. NO. 7480 | 165-TyrPheGlyAlaValAla-170 |
| SEQ. ID. NO. 7481 | 185-IleMetAlaTrpIleAsnLeuValAlaIleLeuLeuLeuSer-198 |

Antigenic Index - Jameson-Wolf

| | |
|---|---|
| SEQ. ID. NO. 7482 | 35-GlyIleLysArgGlyLeuTyrSerAsnGluAlaGlyMetGlySerAlaProAsnAla-53 |
| SEQ. ID. NO. 7483 | 57-AlaGluValLysHisProVal-63 |
| SEQ. ID. NO. 7484 | 93-GlnProTyrGlyAspLeuSerGly-100 |
| SEQ. ID. NO. 7485 | 137-AlaTyrAlaGluSerAsnVal-143 |
| SEQ. ID. NO. 7486 | 206-ArgAspTyrThrAlaLysLeuLysMetGlyLysAspProGluPheLysLeuSerGluHisProGlyLeuLysArgArgIleLysSerAspValTrp-237 |

Hydrophilic Regions - Hopp-Woods

| | |
|---|---|
| SEQ. ID. NO. 7487 | 35-GlyIleLysArgGlyLeuTyr-41 |
| SEQ. ID. NO. 7488 | 57-AlaGluValLysHis-61 |
| SEQ. ID. NO. 7489 | 212-LeuLysMetGlyLysAspProGluPheLysLeuSerGlu-224 |
| SEQ. ID. NO. 7490 | 226-ProGlyLeuLysArgArgIleLysSer-234 |

593
AMPHI Regions - AMPHI

| | |
|---|---|
| SEQ. ID. NO. 7491 | 6-GlyLeuCysLysArgPheGlyAsnLysThr-15 |
| SEQ. ID. NO. 7492 | 41-SerThrLeuLeuAsnIleIleAlaGlyIle-50 |
| SEQ. ID. NO. 7493 | 87-HisMetSerAlaLeuGlu-92 |
| SEQ. ID. NO. 7494 | 125-AlaHisArgLysProGluLysLeuSerGlyGlyGlu-136 |
| SEQ. ID. NO. 7495 | 159-PheSerSerLeuAsp-163 |
| SEQ. ID. NO. 7496 | 165-HisLeuArgGlyThrLeuArg-171 |
| SEQ. ID. NO. 7497 | 216-ProGluThrLeuValLysThrProSerCysValGlnValAlaArgLeuMetGlyLeu-234 |

Antigenic Index - Jameson-Wolf

| | |
|---|---|
| SEQ. ID. NO. 7498 | 6-GlyLeuCysLysArgPheGlyAsnLysThrValAla-17 |
| SEQ. ID. NO. 7499 | 24-ValGlyArgGlyLysIle-29 |
| SEQ. ID. NO. 7500 | 33-LeuGlyArgSerGlyCysGlyLysSerThr-42 |
| SEQ. ID. NO. 7501 | 50-IleValArgProAspGlyGlyGlu-57 |
| SEQ. ID. NO. 7502 | 61-AsnGlyGluAsnIleThrArgMetProProGluLysArgArgIle-75 |
| SEQ. ID. NO. 7503 | 99-LysMetGlnLysMetProLysAlaGluAlaGluArgLeuAla-112 |
| SEQ. ID. NO. 7504 | 119-ValGlyLeuGluAsnGluAlaHisArgLysProGluLysLeuSerGlyGlyGluLysGlnArgLeuAlaLeu-142 |
| SEQ. ID. NO. 7505 | 157-GluSerPheSerSerLeu-162 |
| SEQ. ID. NO. 7506 | 168-GlyThrLeuArgArgMetThrAlaGluArgIleArgAsnGlyGlyIle-183 |
| SEQ. ID. NO. 7507 | 190-HisSerProGluGluAlaCysThrThrAlaAspGluIleAlaVal-204 |
| SEQ. ID. NO. 7508 | 206-HisLysGlyArgIle-210 |
| SEQ. ID. NO. 7509 | 214-GlyThrProGluThrLeuValLysThrProSer-224 |
| SEQ. ID. NO. 7510 | 233-GlyLeuProAsnThrAspAspAsnArgHisIle-243 |
| SEQ. ID. NO. 7511 | 248-ValArgPheAspGlnAspGlyMetGluCysArgValLeuSer-261 |
| SEQ. ID. NO. 7512 | 263-ThrCysLeuProGluSer-268 |
| SEQ. ID. NO. 7513 | 291-GlyAlaValSerGlyLysAspThrVal-299 |
| SEQ. ID. NO. 7514 | 302-HisIleGluGluArgGluIleValArgPheArg-312 |

Hydrophilic Regions - Hopp-Woods

| | |
|---|---|
| SEQ. ID. NO. 7515 | 6-GlyLeuCysLysArgPheGlyAsn-13 |
| SEQ. ID. NO. 7516 | 25-GlyArgGlyLysIle-29 |
| SEQ. ID. NO. 7517 | 36-SerGlyCysGlyLys-40 |
| SEQ. ID. NO. 7518 | 51-ValArgProAspGlyGly-56 |
| SEQ. ID. NO. 7519 | 68-MetProProGluLysArgArgIle-75 |
| SEQ. ID. NO. 7520 | 99-LysMetGlnLysMetProLysAlaGluAlaGluArgLeuAla-112 |
| SEQ. ID. NO. 7521 | 119-ValGlyLeuGluAsnGluAlaHisArgLysProGluLysLeuSerGlyGlyGluLysGlnArgLeuAlaLeu-142 |
| SEQ. ID. NO. 7522 | 168-GlyThrLeuArgArgMetThrAlaGluArgIleArgAsn-180 |
| SEQ. ID. NO. 7523 | 191-SerProGluGluAlaCysThrThrAlaAspGluIleAlaVal-204 |
| SEQ. ID. NO. 7524 | 206-HisLysGlyArgIle-210 |
| SEQ. ID. NO. 7525 | 236-AsnThrAspAspAsnArgHisIle-243 |
| SEQ. ID. NO. 7526 | 248-ValArgPheAspGlnAspGlyMetGluCysArgValLeuSer-261 |
| SEQ. ID. NO. 7527 | 293-ValSerGlyLysAspThrVal-299 |
| SEQ. ID. NO. 7528 | 302-HisIleGluGluArgGluIleValArgPheArg-312 |

594
AMPHI Regions - AMPHI

| | |
|---|---|
| SEQ. ID. NO. 7529 | 21-SerIleLeuArgLeu-25 |
| SEQ. ID. NO. 7530 | 108-AlaGlyArgGluCysGlnGluThrAlaAlaAla-118 |
| SEQ. ID. NO. 7531 | 138-AlaIleLysArgCysAsn-143 |

TABLE 1-continued

Antigenic Index - Jameson-Wolf
SEQ. ID. NO. 7532   1-MetGlyAlaAspThrAspGlyAspLysAspValArgLeuAsnArgThr-16
SEQ. ID. NO. 7533   51-ValGluHisProAsnArgPhe-57
SEQ. ID. NO. 7534   75-HisLeuAspGlySerThrGlyGly-82
SEQ. ID. NO. 7535   86-PheArgArgGluLysThrGlyHisLysArgArgCysHisThrGlnCys-101
SEQ. ID. NO. 7536   103-HisSerAlaArgAlaAlaGlyArgGluCysGlnGluThr-115
SEQ. ID. NO. 7537   137-ArgAlaIleLysArgCysAsn-143
Hydrophilic Regions - Hopp-Woods
SEQ. ID. NO. 7538   1-MetGlyAlaAspThrAspGlyAspLysAspValArgLeuAsnArg-15
SEQ. ID. NO. 7539   86-PheArgArgGluLysThrGlyHisLysArgArgCysHis-98
SEQ. ID. NO. 7540   105-AlaArgAlaAlaGlyArgGluCysGlnGluThr-115
SEQ. ID. NO. 7541   137-ArgAlaIleLysArgCysAsn-143
595
AMPHI Regions - AMPHI
SEQ. ID. NO. 7542   20-CysGlnProProGluAla-25
SEQ. ID. NO. 7543   140-AlaAspLeuGluLysLeuSerGlnProLeuAla-150
SEQ. ID. NO. 7544   157-GlnGlyGluValLysGluLeuVal-164
SEQ. ID. NO. 7545   169-ThrPheThrGluAlaValLysAlaGlyAspIleGluLysAla-182
SEQ. ID. NO. 7546   196-IleGluProIleAlaGluLeuPheSerGluLeuAspPro-208
SEQ. ID. NO. 7547   224-AlaGlyPheThrGlyPheHisArg-231
SEQ. ID. NO. 7548   243-SerGlyValLysGluIleAlaAlaLysLeuMetThrAspValGluAlaLeuGlnLysGluIleAsp-264
SEQ. ID. NO. 7549   274-ValGlyGlyAlaSerGluLeuIleGluGluValAlaGly-286
SEQ. ID. NO. 7550   309-AspGlySerLysLysIleValAspLeuPheArgProLeu-321
SEQ. ID. NO. 7551   337-PheLysGlnValAsnGluIleLeuAlaLys-346
SEQ. ID. NO. 7552   351-AspGlyPheGluThrTyrAspLysLeuGlyGlu-361
SEQ. ID. NO. 7553   366-AlaLeuGlnAlaSerIleAsnAlaLeuAlaGluAspLeuAlaGlnLeuArgGlyIleLeuGlyLeu-387
Antigenic Index - Jameson-Wolf
SEQ. ID. NO. 7554   1-MetArgLysPheAsn-5
SEQ. ID. NO. 7555   21-GlnProProGluAlaGluLysAlaAlaPro-30
SEQ. ID. NO. 7556   32-AlaSerGlyGluAlaGlnThrAlaAsnGluGlyGlySer-44
SEQ. ID. NO. 7557   50-AsnAspAsnAlaCysGluProMetGlu-58
SEQ. ID. NO. 7558   70-IleLysAsnAsnSerGlyArgLysLeuGluTrpGluIle-82
SEQ. ID. NO. 7559   87-MetValValAspGluArgGluAsnIleAla-96
SEQ. ID. NO. 7560   98-GlyLeuSerAspLysMetThr-104
SEQ. ID. NO. 7561   108-LeuProGlyGluTyrGluMet-114
SEQ. ID. NO. 7562   120-ThrAsnProArgGlyLysLeuValValThrAspSerGlyPheLysAspThrAlaAsnGluAlaAspLeuGluLysLeuSer-146
SEQ. ID. NO. 7563   158-GlyGluValLysGluLeuValAlaLysThrLysThrPheThrGluAlaValLysAlaGlyAspIleGluLysAlaLysSerLeuPheAla-187
SEQ. ID. NO. 7564   189-ThrArgValHisTyrGluArgIleGluProIle-199
SEQ. ID. NO. 7565   204-SerGluLeuAspProValIleAspAlaArgGluAspAspPheLysAspGlyAlaLysAspAlaGly-225
SEQ. ID. NO. 7566   238-ValGluLysAspValSerGlyValLysGluIleAlaAla-250
SEQ. ID. NO. 7567   252-LeuMetThrAspValGluAlaLeuGlnLysGluIleAsp-264
SEQ. ID. NO. 7568   269-ProProGlyLysValValGlyGlyAla-277
SEQ. ID. NO. 7569   279-GluLeuIleGluGluValAlaGlySerLysIleSerGlyGluGluAspArgTyrSerHisThrAspLeuSerAspPheGlnAlaAsnValAspGlySerLysLysIleValAsp-316
SEQ. ID. NO. 7570   322-IleGluAlaLysAsnLysAlaLeuLeuGluLysThrAspThrAsnPheLysGlnValAsn-341
SEQ. ID. NO. 7571   345-AlaLysTyrArgThrLysAspGlyPheGluThrTyrAspLysLeuGlyGluAlaAspArgLysAlaLeu-367
SEQ. ID. NO. 7572   374-LeuAlaGluAspLeuAlaGln-380
Hydrophilic Regions - Hopp-Woods
SEQ. ID. NO. 7573   1-MetArgLysPheAsn-5
SEQ. ID. NO. 7574   21-GlnProProGluAlaGluLysAlaAlaPro-30
SEQ. ID. NO. 7575   32-AlaSerGlyGluAlaGlnThrAlaAsnGluGlyGlySer-44
SEQ. ID. NO. 7576   52-AsnAlaCysGluProMetGlu-58
SEQ. ID. NO. 7577   72-AsnAsnSerGlyArgLysLeuGluTrpGluIle-82
SEQ. ID. NO. 7578   87-MetValValAspGluArgGluAsnIle-95
SEQ. ID. NO. 7579   99-LeuSerAspLysMetThr-104
SEQ. ID. NO. 7580   110-GlyGluTyrGluMet-114
SEQ. ID. NO. 7581   122-ProArgGlyLysLeuValVal-128
SEQ. ID. NO. 7582   131-SerGlyPheLysAspThrAlaAsnGluAlaAspLeuGluLysLeuSer-146
SEQ. ID. NO. 7583   158-GlyGluValLysGluLeuValAlaLysThrLysThrPheThrGluAlaValLysAlaGlyAspIleGluLysAlaLysSerLeuPheAla-187
SEQ. ID. NO. 7584   189-ThrArgValHisTyrGluArgIleGluProIle-199
SEQ. ID. NO. 7585   204-SerGluLeuAspProValIleAspAlaArgGluAspAspPheLysAspGlyAlaLysAspAlaGly-225
SEQ. ID. NO. 7586   238-ValGluLysAspValSerGlyValLysGluIleAlaAla-250
SEQ. ID. NO. 7587   252-LeuMetThrAspValGluAlaLeuGlnLysGluIleAsp-264
SEQ. ID. NO. 7588   279-GluLeuIleGluGluValAlaGly-286
SEQ. ID. NO. 7589   288-LysIleSerGlyGluGluAspArgTyrSerHis-298
SEQ. ID. NO. 7590   308-ValAspGlySerLysLysIleValAsp-316
SEQ. ID. NO. 7591   322-IleGluAlaLysAsnLysAlaLeuLeuGluLysThrAspThrAsnPhe-337
SEQ. ID. NO. 7592   347-TyrArgThrLysAspGlyPheGluThrTyrAspLysLeuGlyGluAlaAspArgLysAlaLeu-367
SEQ. ID. NO. 7593   374-LeuAlaGluAspLeuAlaGln-380
596
AMPHI Regions - AMPHI
SEQ. ID. NO. 7594   9-MetLeuArgValSerLysValVal-16
SEQ. ID. NO. 7595   50-LeuArgIleMetAlaGlyValAspLys-58
SEQ. ID. NO. 7596   87-ValArgGluGluValGluSerGlyLeuGlyGluValAlaAlaAlaGlnLysArgLeuGluGluValTyrAlaGluTyr-112
SEQ. ID. NO. 7597   192-ProThrAsnHisLeuAsp-197
SEQ. ID. NO. 7598   202-GluTrpLeuGluGlnPheLeuValArgPheProGly-213
SEQ. ID. NO. 7599   295-AlaArgPheGluGluMetSerAsnTyr-303
SEQ. ID. NO. 7600   322-LeuGlyAsnGluValIleGluPheValAsnValSerLysSerPhe-336
SEQ. ID. NO. 7601   366-SerThrLeuPheLysMet-371
SEQ. ID. NO. 7602   409-AspAsnIleAlaGlu-413

TABLE 1-continued

| | |
|---|---|
| SEQ. ID. NO. 7603 | 440-AspGlnSerLysIleAlaGlyGlnLeuSerGlyGlyGlu-452 |
| SEQ. ID. NO. 7604 | 483-LeuArgAlaLeuGluAspAlaLeuLeuGluPheAla-494 |
| Antigenic Index - Jameson-Wolf | |
| SEQ. ID. NO. 7605 | 16-ValProProGlnLysThrIleIleLysAspIleSer-27 |
| SEQ. ID. NO. 7606 | 41-LeuAsnGlyAlaGlyLysSerThrVal-49 |
| SEQ. ID. NO. 7607 | 54-AlaGlyValAspLysGluPheGluGlyGluAla-64 |
| SEQ. ID. NO. 7608 | 75-LeuProGlnGluProGluLeuAspProGluLysThrValArgGluGluValGluSerGlyLeu-95 |
| SEQ. ID. NO. 7609 | 99-AlaAlaAlaGlnLysArgLeuGluGluValTyr-109 |
| SEQ. ID. NO. 7610 | 112-TyrAlaAsnProAspAlaAspPheAspAlaLeuAlaGluGluGlnGlyArgLeuGlu-130 |
| SEQ. ID. NO. 7611 | 136-GlySerSerThrGlyGlyGlyAlaGluHisGluLeuGluIleAlaAlaAspAlaLeuArg-155 |
| SEQ. ID. NO. 7612 | 157-ProGluTrpAspAlaLysIleAspAsnLeuSerGlyGlyGluLysArgArgValAla-175 |
| SEQ. ID. NO. 7613 | 181-LeuSerLysProAspMet-186 |
| SEQ. ID. NO. 7614 | 190-AspGluProThrAsnHisLeuAspAlaGluSer-200 |
| SEQ. ID. NO. 7615 | 219-ThrHisAspArgTyrPhe-224 |
| SEQ. ID. NO. 7616 | 233-LeuGluLeuAspArgGlyHisGlyIle-241 |
| SEQ. ID. NO. 7617 | 243-TrpLysGlyAsnTyrSerSer-249 |
| SEQ. ID. NO. 7618 | 251-LeuGluGlnLysGluLysArgLeuGluAsnGluAlaLysSerGluAlaAlaArgValLysAlaMetLysGlnGluLeuGluTrp-278 |
| SEQ. ID. NO. 7619 | 280-ArgGlnAsnAlaLysGlyArgGlnAlaLysSerLysAlaArgLeuAlaArgPheGluGluMetSerAsnTyrGluTyrGlnLysArgAsnGluThrGln Glu-313 |
| SEQ. ID. NO. 7620 | 319-AlaGluArgLeuGlyAsnGluVal-326 |
| SEQ. ID. NO. 7621 | 333-SerLysSerPheGlyAsp-338 |
| SEQ. ID. NO. 7622 | 360-ProAsnGlyAlaGlyLysSerThrLeu-368 |
| SEQ. ID. NO. 7623 | 372-IleSerGlyLysGluGlnProAspSerGlyGluValLysIle-385 |
| SEQ. ID. NO. 7624 | 395-AspGlnSerArgGluGlyLeuGlnAsnAspLysThrVal-407 |
| SEQ. ID. NO. 7625 | 411-IleAlaGluGlyArgAspIleLeu-418 |
| SEQ. ID. NO. 7626 | 425-IleProAlaArgGlnTyrLeuGlyArgPheAsnPheLysGlySerAspGlnSerLysIleAla-445 |
| SEQ. ID. NO. 7627 | 447-GlnLeuSerGlyGlyGluArgGlyArgLeuHisLeu-458 |
| SEQ. ID. NO. 7628 | 471-LeuAspGluProSerAsnAspLeuAspValGluThr-482 |
| SEQ. ID. NO. 7629 | 501-SerHisAspArgTrpPhe-506 |
| SEQ. ID. NO. 7630 | 516-AlaCysGluGlyAspSerLysTrp-523 |
| SEQ. ID. NO. 7631 | 527-AspGlyAsnTyrGlnGluTyrGluAlaAspLysLysArgArgLeuGlyGluGluGlyAlaLysProLysArgIleLysTyrLysProValThrArg-558 |
| Hydrophilic Regions - Hopp-Woods | |
| SEQ. ID. NO. 7632 | 54-AlaGlyValAspLysGluPheGluGlyGluAla-64 |
| SEQ. ID. NO. 7633 | 77-GlnGluProGluLeuAspProGluLysThrValArgGluGluValGluSerGlyLeu-95 |
| SEQ. ID. NO. 7634 | 99-AlaAlaAlaGlnLysArgLeuGluGluValTyr-109 |
| SEQ. ID. NO. 7635 | 113-AlaAsnProAspAlaAspPheAspAlaLeuAlaGluGluGlnGlyArgLeuGlu-130 |
| SEQ. ID. NO. 7636 | 141-GlyGlyAlaGluHisGluLeuGluIleAlaAlaAspAlaLeuArg-155 |
| SEQ. ID. NO. 7637 | 157-ProGluTrpAspAlaLysIleAspAsn-165 |
| SEQ. ID. NO. 7638 | 167-SerGlyGlyGluLysArgArgValAla-175 |
| SEQ. ID. NO. 7639 | 181-LeuSerLysProAsp-185 |
| SEQ. ID. NO. 7640 | 190-AspGluProThrAsn-194 |
| SEQ. ID. NO. 7641 | 196-LeuAspAlaGluSer-200 |
| SEQ. ID. NO. 7642 | 233-LeuGluLeuAspArgGlyHis-239 |
| SEQ. ID. NO. 7643 | 251-LeuGluGlnLysGluLysArgLeuGluAsnGluAlaLysSerGluAlaAlaArgValLysAlaMetLysGlnGluLeuGluTrp-278 |
| SEQ. ID. NO. 7644 | 280-ArgGlnAsnAlaLysGlyArgGlnAlaLysSerLysAlaArgLeuAlaArgPheGluGluMetSerAsn-302 |
| SEQ. ID. NO. 7645 | 304-GluTyrGlnLysArgAsnGluThrGln-312 |
| SEQ. ID. NO. 7646 | 319-AlaGluArgLeuGlyAsnGluVal-326 |
| SEQ. ID. NO. 7647 | 372-IleSerGlyLysGluGlnProAspSerGlyGluValLysIle-385 |
| SEQ. ID. NO. 7648 | 395-AspGlnSerArgGluGlyLeuGlnAsnAspLysThrVal-407 |
| SEQ. ID. NO. 7649 | 411-IleAlaGluGlyArgAspIleLeu-418 |
| SEQ. ID. NO. 7650 | 435-AsnPheLysGlySerAspGlnSerLysIle-444 |
| SEQ. ID. NO. 7651 | 449-SerGlyGlyGluArgGlyArgLeuHisLeu-458 |
| SEQ. ID. NO. 7652 | 472-AspGluProSerAsnAspLeuAspValGluThr-482 |
| SEQ. ID. NO. 7653 | 517-CysGluGlyAspSer-521 |
| SEQ. ID. NO. 7654 | 529-AsnTyrGlnGluTyrGluAlaAspLysLysArgArgLeuGlyGluGluGlyAlaLysProLysArgIleLysTyr-553 |
| 597-2 | |
| AMPHI Regions - AMPHI | |
| SEQ. ID. NO. 7655 | 30-AlaGluValLysLys-34 |
| SEQ. ID. NO. 7656 | 66-LysGluAlaAlaLysGluGlyLysGluSerLysLysThrAlaLys-80 |
| SEQ. ID. NO. 7657 | 93-GlnSerAlaArgLysGlyArgGluGly-101 |
| SEQ. ID. NO. 7658 | 112-AlaHisGlyLysPro-116 |
| SEQ. ID. NO. 7659 | 141-GlnGlyAsnProArgLysGlyGlyLys-149 |
| SEQ. ID. NO. 7660 | 163-SerAspLysAsnGlyLysAlaValLysGlnAspLysLysTyrArgGluGluLysAsn-181 |
| SEQ. ID. NO. 7661 | 217-ValSerAsnSerLeuLysGlnLeuGlnGlu-226 |
| SEQ. ID. NO. 7662 | 252-TrpAspLysPheGlnLysLeu-258 |
| SEQ. ID. NO. 7663 | 275-GlnIleSerArgPheValSerGly-282 |
| SEQ. ID. NO. 7664 | 308-LeuArgTyrThrArgTyrValAsnAla-316 |
| SEQ. ID. NO. 7665 | 318-AsnArgGluValValLysAspLeuGluLysGlnGln-329 |
| SEQ. ID. NO. 7666 | 339-IleAsnAsnGluLeuAlaArgLeuLysLys-348 |
| SEQ. ID. NO. 7667 | 351-AlaAsnValGlnSerLeu-356 |
| SEQ. ID. NO. 7668 | 364-AspAlaAlaGluGlnThrGlu-370 |
| SEQ. ID. NO. 7669 | 376-AlaLysIleAlaLysAspAlaArg-383 |
| SEQ. ID. NO. 7670 | 396-AsnLysLeuLeuSer-400 |
| SEQ. ID. NO. 7671 | 460-ProSerValMetGlyIleGlySerAlaAspGlyPheSerArgMetGlnGlyArgLeuLysLysProValAspGlyValProThrGly-488 |
| SEQ. ID. NO. 7672 | 509-ProAlaThrValGluSerIleAla-516 |
| SEQ. ID. NO. 7673 | 521-SerTyrAlaAspGluLeuAspGlyTyrGlyLys-531 |
| SEQ. ID. NO. 7674 | 543-SerIleTyrAlaGlyLeu-548 |
| Antigenic Index - Jameson-Wolf | |
| SEQ. ID. NO. 7675 | 23-AspAlaAlaHisAsnArgSerAlaGluValLysLysGlnThrLysAsnLysLysGluGlnProGluAlaAlaGluGlyLysLysGluLysGlyLysAsn GlyAlaValLysAspLysLysThrGlyGlyLysGluAlaAlaLysGluGlyLysGluSerLysLysThrAlaLysAsnArgLysGluAlaGluLysGluAlaThr |

TABLE 1-continued

| | |
|---|---|
| | SerArgGlnSerAlaArgLysGlyArgGluGlyAspLysLysSerLysAlaGluHisLysLysAlaHisGlyLysProValSerGlySerLysGluLysAsnAla LysThrGlnProGluAsnLysGlnGlyLysLysGluAlaLysGlyGlnGlyAsnProArgLysGlyGlyLysAlaGluLysAspThrValSerAlaAsnLysLys ValArgSerAspLysAsnGlyLysAlaValLysGlnAspLysLysTyrArgGluGluLysAsnAlaLysThrAspSerAspGluLeuLysAla-191 |
| SEQ. ID. NO. 7676 | 196-AlaThrAsnAspValGluAsnLysLysAlaLeuLeuLysGlnSerGluGly-212 |
| SEQ. ID. NO. 7677 | 219-AsnSerLeuLysGlnLeuGlnGluGluArgIleArgGlnGluArgIleArgGlnAlaArgGlyAsnLeu-241 |
| SEQ. ID. NO. 7678 | 243-SerValAsnArgLysGlnArgGluAlaTrpAspLysPheGlnLysLeuAsnThrGluLeuAsnArgLeuLysThrGluValAlaAla-271 |
| SEQ. ID. NO. 7679 | 281-SerGlyAsnTyrLysAsnSerGlnProAsn-290 |
| SEQ. ID. NO. 7680 | 298-AsnAlaGluProGlyGlnLysAsnArgPhe-307 |
| SEQ. ID. NO. 7681 | 314-ValAsnAlaSerAsnArgGluValValLysAspLeuGluLysGlnGlnLys-330 |
| SEQ. ID. NO. 7682 | 335-GlnGluGlnLysIleAsnAsnGluLeuAlaArgLeuLysLysIleGln-350 |
| SEQ. ID. NO. 7683 | 356-LeuLeuLysLysGlnGlyValThrAspAlaAlaGluGlnThrGluSerArgArgGlnAsnAlaLysIleAlaLysAspAlaArgLysLeuLeuGluGln LysGlyAsnGluGlnGlnLeu-395 |
| SEQ. ID. NO. 7684 | 398-LeuLeuSerSerAsnLeuGluLysLysLysAlaGluHisArgIleGlnAspAlaGluAlaLysArgLysLeuAlaGluAlaArgLeuAlaAlaAlaGluLys AlaArgLysGluAlaAlaGlnGlnLysAlaGluAlaArgArgAlaGluMetSerAsnLeuThrAlaGluAspArgAsnIleGlnAlaProSer-461 |
| SEQ. ID. NO. 7685 | 466-GlySerAlaAspGlyPheSerArgMetGlnGlyArgLeuLysLysProValAspGlyValProThr-487 |
| SEQ. ID. NO. 7686 | 491-GlyGlnAsnArgSerGlyGlyAspIle-499 |
| SEQ. ID. NO. 7687 | 521-SerTyrAlaAspGluLeuAspGlyTyrGly-530 |
| SEQ. ID. NO. 7688 | 536-AspHisGlyGluAsnTyr-541 |
| SEQ. ID. NO. 7689 | 561-AlaGlySerLysIleGlySerSerGlySerLeuProAspGlyGluGluGlyLeu-578 |
| SEQ. ID. NO. 7690 | 588-ValLeuAsnProSerSerTrp-594 |
| Hydrophilic Regions - Hopp-Woods | |
| SEQ. ID. NO. 7691 | 23-AspAlaAlaHisAsnArgSerAlaGluValLysLysGlnThrLysAsnLysLysGluGlnProGluAlaAlaGluGlyLysLysGluLysGlyLys AsnGlyAlaValLysAspLysLysThrGlyGlyLysGluAlaAlaLysGluGlyLysGluSerLysLysThrAlaLysAsnArgLysGluAlaGluLysGluAla ThrSerArgGlnSerAlaArgLysGlyArgGluGlyAspLysLysSerLysAlaGluHisLysLysAlaHisGlyLysProValSerGlySerLysGluLysAsn AlaLysThrGlnProGluAsnLysGlnGlyLysLysGluAlaLysGlyGlnGlyAsnProArgLysGlyGlyLysAlaGluLysAspThrValSerAlaAsnLys LysValArgSerAspLysAsnGlyLysAlaValLysGlnAspLysLysTyrArgGluGluLysAsnAlaLysThrAspSerAspGluLeuLysAla-191 |
| SEQ. ID. NO. 7692 | 198-AsnAspValGluAsnLysLysAlaLeuLeuLysGlnSerGlu-211 |
| SEQ. ID. NO. 7693 | 220-SerLeuLysGlnLeuGlnGluGluArgIleArgGlnGluArgIleArgGlnAlaArgGlyAsn-240 |
| SEQ. ID. NO. 7694 | 244-ValAsnArgLysGlnArgGluAlaTrpAspLysPheGlnLysLeuAsnThrGluLeuAsnArgLeuLysThrGluValAlaAla-271 |
| SEQ. ID. NO. 7695 | 284-TyrLysAsnSerGln-288 |
| SEQ. ID. NO. 7696 | 298-AsnAlaGluProGlyGlnLysAsnArgPhe-307 |
| SEQ. ID. NO. 7697 | 317-SerAsnArgGluValValLysAspLeuGluLysGlnGlnLys-330 |
| SEQ. ID. NO. 7698 | 335-GlnGluGlnLysIleAsnAsnGluLeuAlaArgLeuLysLysIleGln-350 |
| SEQ. ID. NO. 7699 | 356-LeuLeuLysLysGlnGlyValThrAspAlaAlaGluGlnThrGluSerArgArgGlnAsnAlaLysIleAlaLysAspAlaArgLysLeuLeuGluGln LysGlyAsnGluGlnGlnLeu-395 |
| SEQ. ID. NO. 7700 | 400-SerAsnLeuGluLysLysLysAlaGluHisArgIleGlnAspAlaGluAlaLysArgLysLeuAlaGluAlaArgLeuAlaAlaAlaGluLysAlaArg LysGluAlaAlaGlnGlnLysAlaGluAlaArgArgAlaGluMet-447 |
| SEQ. ID. NO. 7701 | 451-ThrAlaGluAspArgAsnIleGln-458 |
| SEQ. ID. NO. 7702 | 474-MetGlnGlyArgLeuLysLysProValAsp-483 |
| SEQ. ID. NO. 7703 | 493-AsnArgSerGlyGlyAspIle-499 |
| SEQ. ID. NO. 7704 | 522-TyrAlaAspGluLeuAspGlyTyrGly-530 |
| SEQ. ID. NO. 7705 | 563-SerLysIleGlySer-567 |
| SEQ. ID. NO. 7706 | 570-SerLeuProAspGlyGluGluGlyLeu-578 |
| 601-2 | |
| AMPHI Regions - AMPHI | |
| SEQ. ID. NO. 7707 | 29-AlaAlaArgGluAla-33 |
| SEQ. ID. NO. 7708 | 43-ArgValLeuGlySerPro-48 |
| SEQ. ID. NO. 7709 | 50-ProTyrGlyLysGlnIleAspGlyLeuGlyAsnAlaSerSerSer-64 |
| SEQ. ID. NO. 7710 | 94-PheValAspTrpSerGly-99 |
| SEQ. ID. NO. 7711 | 101-CysGlyAsnLeuThrAlaAla-107 |
| SEQ. ID. NO. 7712 | 134-TrpGlnLysAsnIleGlyLysThrIle-142 |
| SEQ. ID. NO. 7713 | 191-LeuValAspGluIleAspValProAsnIleGlyArg-202 |
| SEQ. ID. NO. 7714 | 210-AlaGlyIleProThrValPhe-216 |
| SEQ. ID. NO. 7715 | 226-GlyLysGluLeuGlnAspAspIleAsnAsnAspAlaAlaAlaLeuGluLysPheGluLysIleArgAlaTyrGlyAlaLeu-252 |
| SEQ. ID. NO. 7716 | 254-MetGlyLeuIleSerAspValSerGluAlaAla-264 |
| SEQ. ID. NO. 7717 | 284-SerSerGlyLysThrValAsn-290 |
| SEQ. ID. NO. 7718 | 321-AlaAlaAlaValProGlyThrLeuValAsnLeuAlaAla-333 |
| SEQ. ID. NO. 7719 | 353-GlyAlaAlaAlaGlu-357 |
| Antigenic Index - Jameson-Wolf | |
| SEQ. ID. NO. 7720 | 11-TyrArgGlyGlyThrSerLysGlyValPhePheLysArgSerAspLeuProGluAlaAlaArgGluAlaGlySerAlaArgAspLysIleLeu-41 |
| SEQ. ID. NO. 7721 | 46-GlySerProAspProTyrGlyLysGlnIleAspGlyLeuGlyAsnAlaSerSerSerThrSerLys-67 |
| SEQ. ID. NO. 7722 | 69-ValIleLeuAspLysSerGluArgAlaAspHisAspValAspTyr-83 |
| SEQ. ID. NO. 7723 | 89-SerIleAspLysProPhe-94 |
| SEQ. ID. NO. 7724 | 96-AspTrpSerGlyAsnCysGly-102 |
| SEQ. ID. NO. 7725 | 116-GlyLeuValAspLysGlyLysIleProSerAspGly-127 |
| SEQ. ID. NO. 7726 | 134-TrpGlnLysAsnIleGlyLysThrIle-142 |
| SEQ. ID. NO. 7727 | 155-GluThrGlyAspPheGluLeu-161 |
| SEQ. ID. NO. 7728 | 177-AspProAlaAspGlyGluGlySerMet-185 |
| SEQ. ID. NO. 7729 | 187-ProThrGlyAsnLeuValAspGluIleAspValProAsnIleGlyArgLeuLys-204 |
| SEQ. ID. NO. 7730 | 223-GlyTyrThrGlyLysGluLeuGlnAspAspIleAsnAsnAspAlaAlaAlaLeuGluLysPheGluLysIleArgAla-248 |
| SEQ. ID. NO. 7731 | 259-AspValSerGluAlaAlaAlaArgAlaHisThrPro-270 |
| SEQ. ID. NO. 7732 | 281-TyrThrAlaSerSerGlyLysThrValAsn-290 |
| SEQ. ID. NO. 7733 | 333-AlaGlyGlyGlyThrArgLysGluValArgPheGlyHisProSerGlyThrLeuArg-351 |
| SEQ. ID. NO. 7734 | 356-AlaGluCysGlnAspGlyGln-362 |
| SEQ. ID. NO. 7735 | 369-ValMetSerArgSerAlaArgValMet-377 |
| SEQ. ID. NO. 7736 | 382-ValArgValProGluAspCysPhe-389 |
| Hydrophilic Regions - Hopp-Woods | |
| SEQ. ID. NO. 7737 | 22-LysArgSerAspLeuProGluAlaAlaArgGluAlaGlySerAlaArgAspLysIleLeu-41 |
| SEQ. ID. NO. 7738 | 49-AspProTyrGlyLysGlnIleAsp-56 |
| SEQ. ID. NO. 7739 | 62-SerSerSerThrSer-66 |

TABLE 1-continued

| SEQ. ID. NO. | |
|---|---|
| SEQ. ID. NO. 7740 | 69-ValIleLeuAspLysSerGluArgAlaAspHisAspVal-81 |
| SEQ. ID. NO. 7741 | 89-SerIleAspLysProPhe-94 |
| SEQ. ID. NO. 7742 | 116-GlyLeuValAspLysGlyLysIleProSer-125 |
| SEQ. ID. NO. 7743 | 157-GlyAspPheGluLeu-161 |
| SEQ. ID. NO. 7744 | 177-AspProAlaAspGlyGluGly-183 |
| SEQ. ID. NO. 7745 | 191-LeuValAspGluIleAspVal-197 |
| SEQ. ID. NO. 7746 | 224-TyrThrGlyLysGluLeuGlnAspAspIleAsnAsnAspAlaAlaAlaLeuGluLysPheGluLysIleArgAla-248 |
| SEQ. ID. NO. 7747 | 259-AspValSerGluAlaAlaAlaArgAlaHisThr-269 |
| SEQ. ID. NO. 7748 | 283-AlaSerSerGlyLysThrValAsn-290 |
| SEQ. ID. NO. 7749 | 335-GlyGlyThrArgLysGluValArgPhe-343 |
| SEQ. ID. NO. 7750 | 356-AlaGluCysGlnAsp-360 |
| SEQ. ID. NO. 7751 | 372-ArgSerAlaArgValMet-377 |
| SEQ. ID. NO. 7752 | 384-ValProGluAspCysPhe-389 |

602-2
AMPHI Regions - AMPHI

| SEQ. ID. NO. 7753 | 21-ValAsnArgHisGlyGln-26 |
|---|---|
| SEQ. ID. NO. 7754 | 30-GlyGlyLeuAspAlaPheCys-36 |
| SEQ. ID. NO. 7755 | 54-ArgGlnIleAlaGlnIle-59 |
| SEQ. ID. NO. 7756 | 61-AlaGlyLeuHisValCysAsnSerVal-69 |
| SEQ. ID. NO. 7757 | 78-HisValIleValGluMetCysAlaTrpTyrGly-88 |

Antigenic Index - Jameson-Wolf

| SEQ. ID. NO. 7758 | 5-GlnCysAspLysThrArgHisMetArgPro-14 |
|---|---|
| SEQ. ID. NO. 7759 | 19-ArgGlnValAsnArgHisGlyGlnThrGlyAsnGlyGlyLeuAspAla-34 |
| SEQ. ID. NO. 7760 | 36-CysSerLeuGlnGlyAsnArgLysAlaGlnValPheAspThrAspLeuIleAspArgGlnIle-56 |
| SEQ. ID. NO. 7761 | 90-SerAlaGlyGluTyr-94 |
| SEQ. ID. NO. 7762 | 99-GlnMetArgAspTyrIle-104 |

Hydrophilic Regions - Hopp-Woods

| SEQ. ID. NO. 7763 | 5-GlnCysAspLysThrArgHisMetArg-13 |
|---|---|
| SEQ. ID. NO. 7764 | 20-GlnValAsnArgHisGlyGln-26 |
| SEQ. ID. NO. 7765 | 39-GlnGlyAsnArgLysAlaGlnValPhe-47 |
| SEQ. ID. NO. 7766 | 50-AspLeuIleAspArgGlnIle-56 |

603-2
AMPHI Regions - AMPHI

| SEQ. ID. NO. 7767 | 69-MetLeuLeuAsnGluLeuGluLys-76 |
|---|---|
| SEQ. ID. NO. 7768 | 107-ValMetAspGluLeuAsnAlaCysIlePro-116 |
| SEQ. ID. NO. 7769 | 121-HisAsnProAlaAsnIleSerGlyIleLeuAla-131 |
| SEQ. ID. NO. 7770 | 135-HisPheProGlyLeuProAsnValGly-143 |
| SEQ. ID. NO. 7771 | 148-SerPheHisGlnThrMetPro-154 |
| SEQ. ID. NO. 7772 | 161-AlaValProArgGluLeu-166 |
| SEQ. ID. NO. 7773 | 188-GluAlaAlaArgIleLeuGlyLysProLeuGluAspIleArgMetIleIleAlaHis-206 |
| SEQ. ID. NO. 7774 | 209-AsnGlyAlaSerIleThrAlaIleLysAsnGlyLysSerVal-222 |
| SEQ. ID. NO. 7775 | 229-ThrProIleGluGly-233 |
| SEQ. ID. NO. 7776 | 248-TyrSerTyrLeuThrSer-253 |
| SEQ. ID. NO. 7777 | 273-LeuGlyIleSerGlu-277 |
| SEQ. ID. NO. 7778 | 279-SerAsnAspCysArg-283 |
| SEQ. ID. NO. 7779 | 306-ArgLeuAlaLysTyrIleAlaSerMet-314 |
| SEQ. ID. NO. 7780 | 342-ValSerTyrLeuAsp-346 |

Antigenic Index - Jameson-Wolf

| SEQ. ID. NO. 7781 | 12-GlySerSerSerLeuLysGlyAlaValIleAspArgLysSerGlySer-27 |
|---|---|
| SEQ. ID. NO. 7782 | 33-LeuGlyGluArgLeuThrThrProGluAla-42 |
| SEQ. ID. NO. 7783 | 45-ThrPheAsnLysAspGlyAsnLysArgGlnValProLeuSerGlyArgAsnCysHis-63 |
| SEQ. ID. NO. 7784 | 73-GluLeuGluLysHisGlyLeuHisAspArgIleLysAlaIleGly-87 |
| SEQ. ID. NO. 7785 | 91-AlaHisGlyGlyGluLysTyrSerGlu-99 |
| SEQ. ID. NO. 7786 | 106-AlaValMetAspGluLeuAsn-112 |
| SEQ. ID. NO. 7787 | 152-ThrMetProGluArgAlaTyr-158 |
| SEQ. ID. NO. 7788 | 164-ArgGluLeuArgLysLysTyrAlaPheArgArgTyrGlyPheHisGlyThrSerMetArg-183 |
| SEQ. ID. NO. 7789 | 188-GluAlaAlaArgIleLeuGlyLysProLeuGluAspIleArg-201 |
| SEQ. ID. NO. 7790 | 207-LeuGlyAsnGlyAla-211 |
| SEQ. ID. NO. 7791 | 214-ThrAlaIleLysAsnGlyLysSerValAspThrSerMetGly-227 |
| SEQ. ID. NO. 7792 | 238-ThrArgCysGlyAspIleAspProGlyVal-247 |
| SEQ. ID. NO. 7793 | 260-AlaGlnValAspGluMetLeuAsnLysLysSerGly-271 |
| SEQ. ID. NO. 7794 | 276-SerGluLeuSerAsnAspCysArgThrLeuGluIleAlaAlaAspGluGlyHisGluGlyAlaArgLeu-298 |
| SEQ. ID. NO. 7795 | 329-GlyIleGlyGluAsnSerArgAsnIleArgAlaLysThr-341 |
| SEQ. ID. NO. 7796 | 352-IleAspThrLysAlaAsnMetGluLysArgTyrGlyAsnSerGlyIle-367 |
| SEQ. ID. NO. 7797 | 369-SerProThrAspSerSerPro-375 |
| SEQ. ID. NO. 7798 | 381-ProThrAsnGluGluLeu-386 |

Hydrophilic Regions - Hopp-Woods

| SEQ. ID. NO. 7799 | 19-AlaValIleAspArgLysSerGly-26 |
|---|---|
| SEQ. ID. NO. 7800 | 33-LeuGlyGluArgLeuThrThr-39 |
| SEQ. ID. NO. 7801 | 46-PheAsnLysAspGlyAsnLysArgGlnValProLeuSerGlyArgAsnCysHis-63 |
| SEQ. ID. NO. 7802 | 73-GluLeuGluLysHisGlyLeuHisAspArgIleLysAlaIleGly-87 |
| SEQ. ID. NO. 7803 | 92-HisGlyGlyGluLysTyrSerGlu-99 |
| SEQ. ID. NO. 7804 | 106-AlaValMetAspGluLeuAsn-112 |
| SEQ. ID. NO. 7805 | 153-MetProGluArgAlaTyr-158 |
| SEQ. ID. NO. 7806 | 164-ArgGluLeuArgLysLysTyrAlaPhe-172 |
| SEQ. ID. NO. 7807 | 188-GluAlaAlaArgIleLeuGlyLysProLeuGluAspIleArg-201 |
| SEQ. ID. NO. 7808 | 217-LysAsnGlyLysSerValAspThr-224 |
| SEQ. ID. NO. 7809 | 239-ArgCysGlyAspIleAspPro-245 |
| SEQ. ID. NO. 7810 | 260-AlaGlnValAspGluMetLeuAsnLysLysSerGly-271 |
| SEQ. ID. NO. 7811 | 277-GluLeuSerAsnAspCysArgThrLeuGluIleAlaAlaAspGluGlyHisGluGlyAlaArgLeu-298 |

TABLE 1-continued

| | |
|---|---|
| SEQ. ID. NO. 7812 | 330-IleGlyGluAsnSerArgAsnIleArgAlaLysThr-341 |
| SEQ. ID. NO. 7813 | 352-IleAspThrLysAlaAsnMetGluLysArgTyrGly-363 |
| SEQ. ID. NO. 7814 | 382-ThrAsnGluGluLeu-386 |

604-2
AMPHI Regions - AMPHI

| | |
|---|---|
| SEQ. ID. NO. 7815 | 36-HisArgValValGlnPheAla-42 |
| SEQ. ID. NO. 7816 | 3-ValGlyGlyValHisGlyPheAlaThr-61 |
| SEQ. ID. NO. 7817 | 95-ArgThrValSerAlaAspPheLeuGluPhePhe-105 |
| SEQ. ID. NO. 7818 | 113-AspValValLeuGlnLeuPheAlaCysValAlaGlnValGlyGlyIleGlnGluAsn-131 |
| SEQ. ID. NO. 7819 | 148-ArgHisIleAsnPheIleAspGlnIleAlaGlyTrpGlu-160 |
| SEQ. ID. NO. 7820 | 166-ValGlyTrpIleLysLysPheAsp-173 |
| SEQ. ID. NO. 7821 | 191-PheGlnAsnCysAlaValLeuHisArg-199 |

Antigenic Index - Jameson-Wolf

| | |
|---|---|
| SEQ. ID. NO. 7822 | 11-AlaAlaCysGlyLysValAspGlnArgThrGlyTyrGlyGlyGlyGlyArgAsnGlyAsnArgGlyGlyThrHis-35 |
| SEQ. ID. NO. 7823 | 67-GlyGlyGlyArgAspGluGlyAspPheArgArgValArgAlaSerGlySerPhe-84 |
| SEQ. ID. NO. 7824 | 106-GlnSerArgGlyIle-110 |
| SEQ. ID. NO. 7825 | 127-GlyIleGlnGluAsnGlyArgAsnAlaArgValAspGluArgGlyPheGln-143 |
| SEQ. ID. NO. 7826 | 175-TyrPheGlyCysArgGluArgTyrAlaVal-184 |
| SEQ. ID. NO. 7827 | 201-MetGlyAsnAsnGly-205 |
| SEQ. ID. NO. 7828 | 211-LeuProAspPheAspArgAlaAspAlaVal-220 |

Hydrophilic Regions - Hopp-Woods

| | |
|---|---|
| SEQ. ID. NO. 7829 | 14-GlyLysValAspGlnArgThrGlyTyr-22 |
| SEQ. ID. NO. 7830 | 24-GlyGlyGlyArgAsnGlyAsnArgGlyGlyThrHis-35 |
| SEQ. ID. NO. 7831 | 68-GlyGlyArgAspGluGlyAspPheArgArgValArgAla-80 |
| SEQ. ID. NO. 7832 | 127-GlyIleGlnGluAsnGlyArgAsnAlaArgValAspGluArgGlyPhe-142 |
| SEQ. ID. NO. 7833 | 178-CysArgGluArgTyrAlaVal-184 |
| SEQ. ID. NO. 7834 | 213-AspPheAspArgAlaAspAlaVal-220 |

605
AMPHI Regions - AMPHI

| | |
|---|---|
| SEQ. ID. NO. 7835 | 13-ArgGlnIleTrpLysIleAlaAsp-20 |
| SEQ. ID. NO. 7836 | 38-ThrLeuPheTyrArgPheIleSerGluAsnPheThrAspTyrMetGln-53 |
| SEQ. ID. NO. 7837 | 107-LysLeuLysGluIlePheThrAlaIle-115 |
| SEQ. ID. NO. 7838 | 128-IleLysGlyLeuPheAspAspPheAsp-136 |
| SEQ. ID. NO. 7839 | 141-ArgLeuGlySerThr-145 |
| SEQ. ID. NO. 7840 | 155-AlaValLeuLysGlyValAlaGluLeu-163 |
| SEQ. ID. NO. 7841 | 173-IleAspLeuPheGlyAspAlaTyrGluTyrLeuIleSerAsn-186 |
| SEQ. ID. NO. 7842 | 188-AlaAlaAsnAlaGlyLys-193 |
| SEQ. ID. NO. 7843 | 204-ValSerLysLeuIleAlaArg-210 |
| SEQ. ID. NO. 7844 | 217-GluLysValAsnLysIleTyrAspPro-225 |
| SEQ. ID. NO. 7845 | 240-PheAspGluHisIle-244 |
| SEQ. ID. NO. 7846 | 291-AspSerLysProPheAspAlaIleValSerAsn-301 |
| SEQ. ID. NO. 7847 | 341-HisAlaLeuAsnTyr-345 |
| SEQ. ID. NO. 7848 | 355-ValSerPheProGly-359 |
| SEQ. ID. NO. 7849 | 433-GluHisIleAlaGluIleValLysLeuPheAla-443 |
| SEQ. ID. NO. 7850 | 452-AlaGlnAsnAlaAlaGlnGlnThr-459 |
| SEQ. ID. NO. 7851 | 478-ThrArgGluIleIleAspIle-484 |
| SEQ. ID. NO. 7852 | 489-AlaGluIleGlyGluThrValAlaLysIleGluArgLeuArgArgGluIleAspGluValIleAlaGluIleGlu-513 |

Antigenic Index - Jameson-Wolf

| | |
|---|---|
| SEQ. ID. NO. 7853 | 5-MetGlnGlnArgAlaGlnLeu-11 |
| SEQ. ID. NO. 7854 | 18-IleAlaAspGluValArgGlyAlaValAspGlyTrpAsp-30 |
| SEQ. ID. NO. 7855 | 44-IleSerGluAsnPheThrAspTyrMetGlnAlaGlyAspSerSerIleAsp-60 |
| SEQ. ID. NO. 7856 | 63-AlaMetProAspSer-67 |
| SEQ. ID. NO. 7857 | 71-ProGluIleLysAspAspAlaValLysVal-80 |
| SEQ. ID. NO. 7858 | 98-AlaHisGlnAsnGluGluLeuAsnThrLysLeuLysGlu-110 |
| SEQ. ID. NO. 7859 | 116-GluSerSerAlaSerGlyTyrProSerGluGlnAspIleLysGlyLeuPheAspAspPheAspThrThrSerSerArgLeu-142 |
| SEQ. ID. NO. 7860 | 146-ValAlaAspLysAsnLysArgLeu-153 |
| SEQ. ID. NO. 7861 | 190-AsnAlaGlyLysSerGlyGlyGluPhePheThr-200 |
| SEQ. ID. NO. 7862 | 215-GlyGlnGluLysValAsnLysIleTyrAspProAlaCysGlySerGlySer-231 |
| SEQ. ID. NO. 7863 | 235-GlnAlaLysLysGlnPheAsp-241 |
| SEQ. ID. NO. 7864 | 253-GluIleAsnHisThrThrTyrAsn-260 |
| SEQ. ID. NO. 7865 | 280-LeuGlyAspThrLeuThrAsnProLysLeuLysAspSerLysProPheAsp-296 |
| SEQ. ID. NO. 7866 | 309-IleGlySerAspAspProThrLeuIleAsnAspAspArgPheAlaPro-324 |
| SEQ. ID. NO. 7867 | 330-ProLysSerLysAlaAsp-335 |
| SEQ. ID. NO. 7868 | 345-TyrLeuSerGlyArgGlyArgAlaAla-353 |
| SEQ. ID. NO. 7869 | 362-TyrArgGlyGlyAlaGluGlnLysIleArg-371 |
| SEQ. ID. NO. 7870 | 403-LeuSerLysHisLysAspAsnThrAsp-411 |
| SEQ. ID. NO. 7871 | 419-GlyPhePheLysLysGluThrAsnAsnAsnValLeuIle-431 |
| SEQ. ID. NO. 7872 | 442-PheAlaAspLysAlaAspVal-448 |
| SEQ. ID. NO. 7873 | 458-GlnThrValLysAspAsnGlyTyr-465 |
| SEQ. ID. NO. 7874 | 473-ValGluAlaGluAspThrArgGluIleIleAsp-483 |
| SEQ. ID. NO. 7875 | 490-GluIleGlyGluThrValAlaLysIleGluArgLeuArgArgGluIleAspGluValIleAla-510 |

Hydrophilic Regions - Hopp-Woods

| | |
|---|---|
| SEQ. ID. NO. 7876 | 5-MetGlnGlnArgAlaGlnLeu-11 |
| SEQ. ID. NO. 7877 | 18-IleAlaAspGluValArgGlyAlaValAsp-27 |
| SEQ. ID. NO. 7878 | 55-GlyAspSerSerIle-59 |
| SEQ. ID. NO. 7879 | 71-ProGluIleLysAspAspAlaValLysVal-80 |
| SEQ. ID. NO. 7880 | 98-AlaHisGlnAsnGluGluLeuAsnThrLysLeuLysGlu-110 |
| SEQ. ID. NO. 7881 | 122-TyrProSerGluGlnAspIleLysGlyLeuPheAspAspPheAspThrThrSerSerArgLeu-142 |
| SEQ. ID. NO. 7882 | 146-ValAlaAspLysAsnLysArgLeu-153 |
| SEQ. ID. NO. 7883 | 191-AlaGlyLysSerGlyGly-196 |

TABLE 1-continued

| | |
|---|---|
| SEQ. ID. NO. 7884 | 215-GlyGlnGluLysValAsnLysIleTyrAsp-224 |
| SEQ. ID. NO. 7885 | 235-GlnAlaLysLysGlnPheAsp-241 |
| SEQ. ID. NO. 7886 | 287-ProLysLeuLysAspSerLysProPhe-295 |
| SEQ. ID. NO. 7887 | 310-GlySerAspAspProThrLeuIleAsnAspAspArgPheAla-323 |
| SEQ. ID. NO. 7888 | 330-ProLysSerLysAlaAsp-335 |
| SEQ. ID. NO. 7889 | 348-GlyArgGlyArgAla-352 |
| SEQ. ID. NO. 7890 | 364-GlyGlyAlaGluGlnLysIleArg-371 |
| SEQ. ID. NO. 7891 | 404-SerLysHisLysAspAsnThrAsp-411 |
| SEQ. ID. NO. 7892 | 419-GlyPhePheLysLysGluThrAsn-426 |
| SEQ. ID. NO. 7893 | 442-PheAlaAspLysAlaAspVal-448 |
| SEQ. ID. NO. 7894 | 458-GlnThrValLysAspAsnGly-464 |
| SEQ. ID. NO. 7895 | 473-ValGluAlaGluAspThrArgGluIleIleAsp-483 |
| SEQ. ID. NO. 7896 | 490-GluIleGlyGluThrValAlaLysIleGluArgLeuArgArgGluIleAspGluValIleAla-510 |
| 606 | |
| AMPHI Regions - AMPHI | |
| SEQ. ID. NO. 7897 | 72-LeuLeuAspHisMetThrArgAspGlu-80 |
| SEQ. ID. NO. 7898 | 90-AlaHisValGlyAsnGlyAsp-96 |
| SEQ. ID. NO. 7899 | 100-LeuThrLeuIleGlnGlyValValAsnThrPhe-110 |
| SEQ. ID. NO. 7900 | 116-ArgIleIleAlaAsn-120 |
| SEQ. ID. NO. 7901 | 139-SerMetValPheGlnIleLeuPheGlyPheLeuAlaSerLeuIleVal-154 |
| SEQ. ID. NO. 7902 | 171-LysLeuValGlyAlaProLysMetIleSerAlaLeuGlnArg-184 |
| SEQ. ID. NO. 7903 | 191-AspLeuProGluGluMetAsnAla-198 |
| Antigenic Index - Jameson-Wolf | |
| SEQ. ID. NO. 7904 | 13-GluValIleAspThrProArgThrGluGluGluAla-24 |
| SEQ. ID. NO. 7905 | 31-GluAlaGlnAlaArgGlnTrpAsnLeuLysThrProGlu-43 |
| SEQ. ID. NO. 7906 | 48-HisSerProGluProAsnAla-54 |
| SEQ. ID. NO. 7907 | 57-ThrGlyAlaSerArgAsnSerSer-64 |
| SEQ. ID. NO. 7908 | 75-HisMetThrArgAspGluValGluAla-83 |
| SEQ. ID. NO. 7909 | 92-ValGlyAsnGlyAsp-96 |
| SEQ. ID. NO. 7910 | 122-IleAlaArgAsnAsnAspGlySerGlnSerGlnGlyThr-134 |
| SEQ. ID. NO. 7911 | 159-ArgGlnArgGluTyrArgAlaAspAlaGlyAla-169 |
| SEQ. ID. NO. 7912 | 182-LeuGlnArgLeuLysGlyAsnProValAspLeuProGluGluMetAsn-197 |
| SEQ. ID. NO. 7913 | 203-GlyAspThrArgAspSerLeuLeuSerThrHisProSerLeuAspAsnArgIleAlaArgLeuLysSer-225 |
| Hydrophilic Regions - Hopp-Woods | |
| SEQ. ID. NO. 7914 | 13-GluValIleAspThrProArgThrGluGluGluAla-24 |
| SEQ. ID. NO. 7915 | 59-AlaSerArgAsnSer-63 |
| SEQ. ID. NO. 7916 | 75-HisMetThrArgAspGluValGluAla-83 |
| SEQ. ID. NO. 7917 | 124-ArgAsnAsnAspGlySerGlnSer-131 |
| SEQ. ID. NO. 7918 | 159-ArgGlnArgGluTyrArgAlaAspAlaGlyAla-169 |
| SEQ. ID. NO. 7919 | 183-GlnArgLeuLysGlyAsnPro-189 |
| SEQ. ID. NO. 7920 | 191-AspLeuProGluGluMetAsn-197 |
| SEQ. ID. NO. 7921 | 203-GlyAspThrArgAspSerLeu-209 |
| SEQ. ID. NO. 7922 | 214-ProSerLeuAspAsnArgIleAlaArgLeuLysSer-225 |
| 607 | |
| AMPHI Regions - AMPHI | |
| SEQ. ID. NO. 7923 | 18-ArgLeuLeuThrThrLeuAlaLeu-25 |
| SEQ. ID. NO. 7924 | 70-PheMetGlyIleMetAlaAlaLeuAsnProMetIleAlaGln-83 |
| SEQ. ID. NO. 7925 | 90-ThrAspGluValGlyGluThr-96 |
| SEQ. ID. NO. 7926 | 104-GlyLeuPheLeuGlyValPheGlyMetValLeuMetTrpAlaAlaIleThrProPheArgAsnTrpLeuThrLeuSerAspTyrValGluGlyThrMet-136 |
| SEQ. ID. NO. 7927 | 151-MetValHisArgAlaLeuHisAlaTyrThrSerSer-162 |
| SEQ. ID. NO. 7928 | 226-PhePheArgProPheGly-231 |
| SEQ. ID. NO. 7929 | 244-PheLysGlnIleTrpLysIleGlyAla-252 |
| SEQ. ID. NO. 7930 | 320-AlaArgTyrIleSerGlyVal-326 |
| SEQ. ID. NO. 7931 | 337-IleThrValLeuSerLeuVal-343 |
| SEQ. ID. NO. 7932 | 373-PheGlnProAlaAspPheThrGlnCysIleAlaSerTyrAla-386 |
| SEQ. ID. NO. 7933 | 424-TyrGlyPheTrpThrAlaLeuIleAla-432 |
| Antigenic Index - Jameson-Wolf | |
| SEQ. ID. NO. 7934 | 15-LysGluValArgLeu-19 |
| SEQ. ID. NO. 7935 | 47-GlyAlaGlyLysGluAspLeuAla-54 |
| SEQ. ID. NO. 7936 | 86-GlyAlaGlyLysThrAspGluValGlyGluThrGlyArgGlnGlyIle-101 |
| SEQ. ID. NO. 7937 | 121-ProPheArgAsnTrp-125 |
| SEQ. ID. NO. 7938 | 128-LeuSerAspTyrValGluGlyThr-135 |
| SEQ. ID. NO. 7939 | 160-ThrSerSerLeuAsnArgProArgLeu-168 |
| SEQ. ID. NO. 7940 | 234-AlaLysPheGlyLysProAspTrp-241 |
| SEQ. ID. NO. 7941 | 311-SerLeuGlyArgArgGluPheSerArgAlaArgTyrIleSer-324 |
| SEQ. ID. NO. 7942 | 353-TyrAsnAsnAspPro-357 |
| SEQ. ID. NO. 7943 | 388-ArgGlyTyrLysValThrLys-394 |
| SEQ. ID. NO. 7944 | 447-LeuCysSerArgGluMetValArgSerHisLysAlaVal-459 |
| Hydrophilic Regions - Hopp-Woods | |
| SEQ. ID. NO. 7945 | 15-LysGluValArgLeu-19 |
| SEQ. ID. NO. 7946 | 47-GlyAlaGlyLysGluAspLeuAla-54 |
| SEQ. ID. NO. 7947 | 88-GlyLysThrAspGluValGlyGluThrGlyArg-98 |
| SEQ. ID. NO. 7948 | 163-LeuAsnArgProArg-167 |
| SEQ. ID. NO. 7949 | 312-LeuGlyArgArgGluPheSerArg-319 |
| SEQ. ID. NO. 7950 | 390-TyrLysValThrLys-394 |
| SEQ. ID. NO. 7951 | 447-LeuCysSerArgGluMetValArgSerHisLysAlaVal-459 |
| 608 | |

TABLE 1-continued

AMPHI Regions - AMPHI
SEQ. ID. NO. 7952    66-AlaValGlnLysIleLeuGln-72
SEQ. ID. NO. 7953    93-ValLeuSerLeuLeu-97
SEQ. ID. NO. 7954    103-ArgAlaSerAspGluLeuAlaArgIlePheGlyThrGln-115
SEQ. ID. NO. 7955    124-AspIleGlyHisGlyIleLysGlnIleGlyArgAsnIleAlaGluGlnIleGlyGlyPheSerArgGluSerGluSer-149
SEQ. ID. NO. 7956    154-AsnGluAlaLeuAlaAspCysLeuAspGluIleSerArgLeuArgAspGlyValGluArgLeuAsnGluArgLeuAspArgLeu-181
Antigenic Index - Jameson-Wolf
SEQ. ID. NO. 7957    13-LeuGlnSerProAspSerArgSerGluLeu-22
SEQ. ID. NO. 7958    39-LeuAlaGlyArgIleThrGluAspGlyLeuLeuSerAlaGlyAsnGlyPheAlaAspThrGluIleThrPheArgAsnSerAla-66
SEQ. ID. NO. 7959    71-LeuGlnGlyGlyGluProGlyAlaGlyAspIleGlyLeuGluGly-85
SEQ. ID. NO. 7960    98-GlySerLeuArgSerArgAlaSerAspGluLeuAla-109
SEQ. ID. NO. 7961    114-ThrGlnAlaAspIleGlySerArgAlaAlaAsp-124
SEQ. ID. NO. 7962    131-GlnIleGlyArgAsnIleAla-137
SEQ. ID. NO. 7963    140-IleGlyGlyPheSerArgGluSerGluSerAlaAsnIleGlyAsnGluAlaLeuAlaAspCysLeuAspGluIleSerArgLeuArg
                     AspGlyValGluArgLeuAsnGluArgLeuAspArgLeuGluArgAspIleTrp-186
Hydrophilic Regions - Hopp-Woods
SEQ. ID. NO. 7964    15-SerProAspSerArgSerGluLeu-22
SEQ. ID. NO. 7965    39-LeuAlaGlyArgIleThrGluAspGlyLeu-48
SEQ. ID. NO. 7966    56-AlaAspThrGluIleThrPhe-62
SEQ. ID. NO. 7967    74-GlyGluProGlyAlaGly-79
SEQ. ID. NO. 7968    81-IleGlyLeuGluGly-85
SEQ. ID. NO. 7969    100-LeuArgSerArgAlaSerAspGluLeuAla-109
SEQ. ID. NO. 7970    116-AlaAspIleGlySerArgAlaAlaAsp-124
SEQ. ID. NO. 7971    143-PheSerArgGluSerGluSerAlaAsnIleGly-153
SEQ. ID. NO. 7972    156-AlaLeuAlaAspCysLeuAspGluIleSerArgLeuArgAspGlyValGluArgLeuAsnGluArgLeuAspArgLeuGluArgAspIleTrp-186
609
AMPHI Regions - AMPHI
SEQ. ID. NO. 7973    15-ThrLeuAspAlaPheVal-20
SEQ. ID. NO. 7974    30-HisHisIlePheHisGluPheArgValPheValGlyPhePhe-43
SEQ. ID. NO. 7975    52-PheGluGlnAlaValGlu-57
SEQ. ID. NO. 7976    67-IleAspAspPheLeu-71
SEQ. ID. NO. 7977    114-ValAlaValCysProVal-119
Antigenic Index - Jameson-Wolf
SEQ. ID. NO. 7978    10-AlaLeuAspAspGluThrLeu-16
SEQ. ID. NO. 7979    20-ValGlyAsnGlnArgSerSerAspIleAla-29
SEQ. ID. NO. 7980    69-AspPheLeuAspThrAspPheGlyIle-77
SEQ. ID. NO. 7981    79-SerGlnAlaAspGlyAsnValArg-86
SEQ. ID. NO. 7982    99-GlyThrArgAlaLysArgGlyTyrGlyAsnHisAspLeu-111
SEQ. ID. NO. 7983    122-PheAlaArgGluThrAspIle-128
Hydrophilic Regions - Hopp-Woods
SEQ. ID. NO. 7984    10-AlaLeuAspAspGluThrLeu-16
SEQ. ID. NO. 7985    23-GlnArgSerSerAspIle-28
SEQ. ID. NO. 7986    79-SerGlnAlaAspGlyAsnVal-85
SEQ. ID. NO. 7987    100-ThrArgAlaLysArgGlyTyrGly-107
SEQ. ID. NO. 7988    122-PheAlaArgGluThrAspIle-128
610
AMPHI Regions - AMPHI
SEQ. ID. NO. 7989    6-MetGlnPheProTyrArg-11
SEQ. ID. NO. 7990    18-MetArgArgMetArgArg-23
SEQ. ID. NO. 7991    98-GluArgAlaGlnGluAlaTyr-104
SEQ. ID. NO. 7992    111-ProSerThrValArgAlaLeuArgGluArg-120
SEQ. ID. NO. 7993    187-IleArgGluAlaLeuGlu-192
SEQ. ID. NO. 7994    208-TyrAlaSerAlaPheTyrGlyProPheArgAsp-218
SEQ. ID. NO. 7995    223-SerGlyAsnLeuGlyLysAlaAsp-230
SEQ. ID. NO. 7996    268-LeuAspValValArgArgValLysAspGlu-277
SEQ. ID. NO. 7997    296-AlaAlaIleAlaAsn-300
Antigenic Index - Jameson-Wolf
SEQ. ID. NO. 7998    11-ArgAsnValProAlaSerArgMetArgArgMetArgArgAspAspPheSerArgArgLeuMetArgGluHisThrLeuThrAlaAspAsp-40
SEQ. ID. NO. 7999    50-GlySerAlaArgGluGluAspValProSerMetProGlyValLysArgGlnSerLeuAsp-69
SEQ. ID. NO. 8000    75-AlaGluGluAlaValLys-80
SEQ. ID. NO. 8001    94-AlaAsnLysThrGluArgAlaGlnGluAlaTyrAsnProGluGlyLeuVal-110
SEQ. ID. NO. 8002    115-ArgAlaLeuArgGluArgPhePro-122
SEQ. ID. NO. 8003    139-GlyGlnAspGlyLeuThrAspGluAsnGlyTyrValMetAsnAspGluThrVal-156
SEQ. ID. NO. 8004    175-AlaProSerAspMetMetAspGlyArgIleGlyAlaIleArgGluAlaLeuGluAspAlaGlyHis-196
SEQ. ID. NO. 8005    215-ProPheArgAspAlaValGlySerSerGlyAsnLeuGlyLysAlaAspLysLysThrTyrGlnMetAspProAlaAsnThrAspGluAlaLeuHis-246
SEQ. ID. NO. 8006    250-LeuAspIleGlnGluGlyAlaAsp-257
SEQ. ID. NO. 8007    270-ValValArgArgValLysAspGluPheGlyValVal-280
SEQ. ID. NO. 8008    301-GlyTrpLeuAspGlyGlyLysValVal-309
SEQ. ID. NO. 8009    317-LysArgAlaGlyAlaAspGly-323
SEQ. ID. NO. 8010    331-GluAlaAlaLysMetLeuLysArg-338
Hydrophilic Regions - Hopp-Woods
SEQ. ID. NO. 8011    14-ProAlaSerArgMetArgArgMetArgArgAspAspPheSerArgArgLeuMetArgGluHisThrLeuThrAla-38
SEQ. ID. NO. 8012    50-GlySerAlaArgGluGluAspValProSer-59
SEQ. ID. NO. 8013    61-ProGlyValLysArgGlnSerLeuAsp-69
SEQ. ID. NO. 8014    75-AlaGluGluAlaValLys-80
SEQ. ID. NO. 8015    95-AsnLysThrGluArgAlaGlnGluAlaTyrAsn-105
SEQ. ID. NO. 8016    115-ArgAlaLeuArgGluArgPhePro-122
SEQ. ID. NO. 8017    141-AspGlyLeuThrAspGluAsnGly-148
SEQ. ID. NO. 8018    151-MetAsnAspGluThrVal-156
SEQ. ID. NO. 8019    178-AspMetMetAspGlyArgIleGlyAlaIleArgGluAlaLeuGluAspAlaGly-195

TABLE 1-continued

| | |
|---|---|
| SEQ. ID. NO. 8020 | 216-PheArgAspAlaValGly-221 |
| SEQ. ID. NO. 8021 | 225-AsnLeuGlyLysAlaAspLysLysThrTyrGln-235 |
| SEQ. ID. NO. 8022 | 238-ProAlaAsnThrAspGluAlaLeuHis-246 |
| SEQ. ID. NO. 8023 | 250-LeuAspIleGlnGluGlyAlaAsp-257 |
| SEQ. ID. NO. 8024 | 270-ValValArgArgValLysAspGluPheGly-279 |
| SEQ. ID. NO. 8025 | 317-LysAlaGlyAla-321 |
| SEQ. ID. NO. 8026 | 331-GluAlaAlaLysMetLeuLysArg-338 |
| 611 | |
| AMPHI Regions - AMPHI | |
| SEQ. ID. NO. 8027 | 15-CysArgLeuPheGlyLysLeuSerLeu-23 |
| SEQ. ID. NO. 8028 | 26-ArgLeuLeuLeuGlyLeu-31 |
| SEQ. ID. NO. 8029 | 48-ArgSerValArgArgValIle-54 |
| SEQ. ID. NO. 8030 | 63-GlnValValAlaVal-67 |
| SEQ. ID. NO. 8031 | 104-ValPheIleGluAspPheVal-110 |
| SEQ. ID. NO. 8032 | 130-GlyPheLeuGlyAsnValLeuArgThr-138 |
| Antigenic Index - Jameson-Wolf | |
| SEQ. ID. NO. 8033 | 1-MetProSerGluAsnGlyMetGlyLysArgGlnLeuAla-13 |
| SEQ. ID. NO. 8034 | 32-CysArgSerGlyValCysArgGlyArgCys-41 |
| SEQ. ID. NO. 8035 | 45-PheProSerArgSerValArgArgValIlePheArgArgValArgIle-60 |
| SEQ. ID. NO. 8036 | 119-AsnProAlaAspPheArgVal-125 |
| SEQ. ID. NO. 8037 | 142-AlaSerGlnGluAsp-146 |
| Hydrophilic Regions - Hopp-Woods | |
| SEQ. ID. NO. 8038 | 1-MetProSerGluAsnGlyMetGlyLysArgGlnLeuAla-13 |
| SEQ. ID. NO. 8039 | 35-GlyValCysArgGlyArgCys-41 |
| SEQ. ID. NO. 8040 | 53-ValIlePheArgArgValArgIle-60 |
| SEQ. ID. NO. 8041 | 121-AlaAspPheArgVal-125 |
| SEQ. ID. NO. 8042 | 142-AlaSerGlnGluAsp-146 |
| 612-2 | |
| AMPHI Regions - AMPHI | |
| SEQ. ID. NO. 8043 | 6-AsnIleAlaLysLysLeuAlaGlyValAsp-15 |
| SEQ. ID. NO. 8044 | 57-LysAlaValGluLysCysAlaGluAsnValLeu-67 |
| SEQ. ID. NO. 8045 | 81-GlyAsnPheProAsn-85 |
| Antigenic Index - Jameson-Wolf | |
| SEQ. ID. NO. 8046 | 7-IleAlaLysLysLeuAlaGlyValAsp-15 |
| SEQ. ID. NO. 8047 | 27-AspPheGlyArgAspAspAlaValArgHisSerGlyVal-39 |
| SEQ. ID. NO. 8048 | 57-LysAlaValGluLysCysAlaGlu-64 |
| SEQ. ID. NO. 8049 | 97-GlyHisHisArgAsnProTyrLysSer-105 |
| Hydrophilic Regions - Hopp-Woods | |
| SEQ. ID. NO. 8050 | 7-IleAlaLysLysLeuAlaGlyValAsp-15 |
| SEQ. ID. NO. 8051 | 28-PheGlyArgAspAspAlaValArg-35 |
| SEQ. ID. NO. 8052 | 57-LysAlaValGluLysCysAlaGlu-64 |
| SEQ. ID. NO. 8053 | 101-AsnProTyrLysSer-105 |
| 613-2 | |
| AMPHI Regions - AMPHI | |
| SEQ. ID. NO. 8054 | 7-SerArgArgSerLeu-11 |
| SEQ. ID. NO. 8055 | 95-MetProArgMetArgSer-100 |
| SEQ. ID. NO. 8056 | 103-SerProMetSerProAla-108 |
| SEQ. ID. NO. 8057 | 115-ArgIlePheCysThrAlaLeuLeuArgLys-124 |
| SEQ. ID. NO. 8058 | 140-SerSerValMetArgProAla-146 |
| SEQ. ID. NO. 8059 | 168-LeuSerGlyLeuCysArgIle-174 |
| Antigenic Index - Jameson-Wolf | |
| SEQ. ID. NO. 8060 | 1-MetSerArgSerSerArgSerArgArgSerLeuArgArgSerThrProSerArg-18 |
| SEQ. ID. NO. 8061 | 23-SerSerArgGlnSerAlaArgAla-30 |
| SEQ. ID. NO. 8062 | 35-PheAlaAspSerAspSerArgGluAsnProProIleCysSer-48 |
| SEQ. ID. NO. 8063 | 73-ProLysIleArgAlaAsnSerSerAspAlaArgGluArgArgLeuProSerArgAspSerThrAla-94 |
| SEQ. ID. NO. 8064 | 96-ProArgMetArgSerProSerSerProMetSerProAlaProGlySerProProTrp-114 |
| SEQ. ID. NO. 8065 | 130-AlaLysProPheProAlaGluSerLysProSerSerValMetArgProAlaSer-147 |
| SEQ. ID. NO. 8066 | 162-AlaAlaSerSerGluArgLeuSerGlyLeuCysArgIleArgArg-176 |
| SEQ. ID. NO. 8067 | 178-MetMetGlyArgArgAlaAspIlePheSerAspArgGlyGlyGlu-192 |
| SEQ. ID. NO. 8068 | 205-LeuSerArgTyrArgLysArgTyrGly-213 |
| Hydrophilic Regions - Hopp-Woods | |
| SEQ. ID. NO. 8069 | 1-MetSerArgSerSerArgSerArgArgSerLeuArgArgSerThrProSer-17 |
| SEQ. ID. NO. 8070 | 24-SerArgGlnSerAlaArgAla-30 |
| SEQ. ID. NO. 8071 | 36-AlaAspSerAspSerArgGluAsnProPro-45 |
| SEQ. ID. NO. 8072 | 73-ProLysIleArgAlaAsnSerSerAspAlaArgGluArgArgLeuProSerArgAspSerThrAla-94 |
| SEQ. ID. NO. 8073 | 96-ProArgMetArgSerProSer-102 |
| SEQ. ID. NO. 8074 | 133-PheProAlaGluSerLysProSerSerValMetArg-144 |
| SEQ. ID. NO. 8075 | 162-AlaAlaSerSerGluArgLeuSerGly-170 |
| SEQ. ID. NO. 8076 | 172-CysArgIleArgArg-176 |
| SEQ. ID. NO. 8077 | 178-MetMetGlyArgArgAlaAspIlePheSerAspArgGlyGlyGlu-192 |
| SEQ. ID. NO. 8078 | 206-SerArgTyrArgLysArgTyrGly-213 |
| 614-2 | |
| AMPHI Regions - AMPHI | |
| SEQ. ID. NO. 8079 | 20-SerGlnPheIleGlnGlnVal-26 |
| SEQ. ID. NO. 8080 | 65-AsnLeuIleLysThrLeuLeuAsp-72 |
| SEQ. ID. NO. 8081 | 90-AlaLeuPheTyrSerLeuLeuProValLeu-99 |
| SEQ. ID. NO. 8082 | 144-ValAlaGlyCysAspGluAlaLysGluGluValGlnGluIleValAspTyrLeuLysAlaProAsnArgTyrGlnSerLeu-170 |
| SEQ. ID. NO. 8083 | 210-AspPheValGluMetPheVal-216 |
| SEQ. ID. NO. 8084 | 222-ArgValArgAspMetPheGluGln-229 |
| SEQ. ID. NO. 8085 | 242-GluIleAspAlaValGlyArg-248 |

TABLE 1-continued

| | |
|---|---|
| SEQ. ID. NO. 8086 | 295-ProAlaLeuGlnArgProGlyArgPheAsp-304 |
| SEQ. ID. NO. 8087 | 333-SerValAspLeuLeuSerLeuAla-340 |
| SEQ. ID. NO. 8088 | 349-AlaAspLeuAlaAsnLeuValAsn-356 |
| SEQ. ID. NO. 8089 | 478-SerAsnAspPheGluArgAlaThrGlnMet-487 |
| SEQ. ID. NO. 8090 | 526-SerGluLysThrGln-530 |
| SEQ. ID. NO. 8091 | 536-GluIleArgArgIleLeuAsp-542 |
| SEQ. ID. NO. 8092 | 561-ThrMetCysLysAlaLeuMetGluTrpGluThr-571 |
| SEQ. ID. NO. 8093 | 591-AspTyrSerHisAsn-595 |
| SEQ. ID. NO. 8094 | 619-ProAlaProAlaAspThr-624 |
| Antigenic Index - Jameson-Wolf | |
| SEQ. ID. NO. 8095 | 7-LeuAspGlyLysLysGluAspAsnGlyGlnIleGlu-18 |
| SEQ. ID. NO. 8096 | 26-ValAsnAsnGlyGluValSerGly-33 |
| SEQ. ID. NO. 8097 | 45-LeuIleLysGlyGluArgThrAspLysSerThrPhe-56 |
| SEQ. ID. NO. 8098 | 60-AlaProLeuAspAspAsnLeuIle-67 |
| SEQ. ID. NO. 8099 | 70-LeuLeuAspLysAsnValArgValLysValThrProGluGluLysProSerAla-87 |
| SEQ. ID. NO. 8100 | 111-MetGlnThrGlyGlyGlyGlyLysGlyGly-120 |
| SEQ. ID. NO. 8101 | 123-SerPheGlyLysSerArgAlaArgLeuLeuAspLysAspAlaAsnLys-138 |
| SEQ. ID. NO. 8102 | 145-AlaGlyCysAspGluAlaLysGluGluValGlnGlu-156 |
| SEQ. ID. NO. 8103 | 161-LeuLysAlaProAsnArgTyrGlnSerLeuGlyGlyArgValProArgGly-177 |
| SEQ. ID. NO. 8104 | 182-GlySerProGlyThrGlyLysThrLeuLeu-191 |
| SEQ. ID. NO. 8105 | 207-SerGlySerAspPhe-211 |
| SEQ. ID. NO. 8106 | 219-GlyAlaSerArgValArgAspMetPheGluGlnAlaLysLysAsnAla-234 |
| SEQ. ID. NO. 8107 | 241-AspGluIleAspAlaValGlyArgGlnArgGlyAlaGlyLeuGlyGlyGlyAsnAspGluArgGluGlnThrLeu-265 |
| SEQ. ID. NO. 8108 | 272-MetAspGlyPheGluSerAsnGln-279 |
| SEQ. ID. NO. 8109 | 287-ThrAsnArgProAspValLeuAspProAlaLeuGlnArgProGlyArgPheAspArg-305 |
| SEQ. ID. NO. 8110 | 311-LeuProAspIleArgGlyArgGluGlnIle-320 |
| SEQ. ID. NO. 8111 | 323-ValHisSerLysLysValProLeuAspGluSerValAsp-335 |
| SEQ. ID. NO. 8112 | 341-ArgGlyThrProGlyPheSerGly-348 |
| SEQ. ID. NO. 8113 | 362-AlaGlyArgArgAsnLysValLysValAspGlnSerAspPheGluAspAlaLysAspLysIleTyrMetGlyProGluArgArgSerMetValMetHisGluAspGluLysArgAlaThrAla-402 |
| SEQ. ID. NO. 8114 | 425-ThrIleMetProArgGlyArgAla-432 |
| SEQ. ID. NO. 8115 | 438-GlnLeuProGluArgAspArgIleSerMetTyrLysAspGlnMet-452 |
| SEQ. ID. NO. 8116 | 460-PheGlyGlyArgIleAlaGlu-466 |
| SEQ. ID. NO. 8117 | 474-SerThrGlyAlaSerAsnAspPheGluArgAlaThrGlnMetAlaArgGluMetValThr-493 |
| SEQ. ID. NO. 8118 | 495-TyrGlyMetSerAspLysMetGly-502 |
| SEQ. ID. NO. 8119 | 507-AlaGluAsnGluGlyGluValPheLeu-515 |
| SEQ. ID. NO. 8120 | 518-SerValThrArgSerGlnAsnIleSerGluLysThrGlnGlnAspIleAspAlaGluIleArgArgIleLeuAspGluGlnTyr-545 |
| SEQ. ID. NO. 8121 | 551-IleLeuAspGluAsnArgAspLysMetGluThrMetCys-563 |
| SEQ. ID. NO. 8122 | 570-GluThrIleAspArgAspGlnVal-577 |
| SEQ. ID. NO. 8123 | 581-MetAlaGlyLysGlnProSerProProLysAspTyrSerHisAsnLeuArgGluAsnAlaAspAlaAlaGluAspAsnAlaProHisAlaProThrArgGluGluThrGluAlaProAlaProAlaAspThrAlaSerThrGluSerGluGlnGlnProGluAsnLysAla-637 |
| Hydrophilic Regions - Hopp-Woods | |
| SEQ. ID. NO. 8124 | 7-LeuAspGlyLysLysGluAspAsnGlyGln-16 |
| SEQ. ID. NO. 8125 | 27-AsnAsnGlyGluValSer-32 |
| SEQ. ID. NO. 8126 | 46-IleLysGlyGluArgThrAspLysSerThr-55 |
| SEQ. ID. NO. 8127 | 61-ProLeuAspAspAsnLeuIle-67 |
| SEQ. ID. NO. 8128 | 70-LeuLeuAspLysAsnValArgValLysValThrProGluGluLysProSerAla-87 |
| SEQ. ID. NO. 8129 | 115-GlyGlyGlyLysGlyGly-120 |
| SEQ. ID. NO. 8130 | 125-GlyLysSerArgAlaArgLeuLeuAspLysAspAlaAsnLys-138 |
| SEQ. ID. NO. 8131 | 145-AlaGlyCysAspGluAlaLysGluGluValGlnGlu-156 |
| SEQ. ID. NO. 8132 | 162-LysAlaProAsnArg-166 |
| SEQ. ID. NO. 8133 | 171-GlyGlyArgValProArg-176 |
| SEQ. ID. NO. 8134 | 221-SerArgValArgAspMetPheGluGlnAlaLysLysAsnAla-234 |
| SEQ. ID. NO. 8135 | 241-AspGluIleAspAlaValGlyArgGlnArgGlyAlaGly-253 |
| SEQ. ID. NO. 8136 | 256-GlyGlyAsnAspGluArgGluGlnThr-264 |
| SEQ. ID. NO. 8137 | 273-AspGlyPheGluSer-277 |
| SEQ. ID. NO. 8138 | 287-ThrAsnArgProAspValLeuAsp-294 |
| SEQ. ID. NO. 8139 | 296-AlaLeuGlnArgProGlyArgPheAspArg-305 |
| SEQ. ID. NO. 8140 | 312-ProAspIleArgGlyArgGlnIle-320 |
| SEQ. ID. NO. 8141 | 324-HisSerLysLysValProLeuAspGluSerValAsp-335 |
| SEQ. ID. NO. 8142 | 362-AlaGlyArgArgAsnLysValLysValAspGlnSerAspPheGluAspAlaLysAspLysIleTyrMetGlyProGluArgArgSerMetValMetHisGluAspGluLysArgAlaThrAla-402 |
| SEQ. ID. NO. 8143 | 428-ProArgGlyArgAla-432 |
| SEQ. ID. NO. 8144 | 439-LeuProGluArgAspArgIleSerMetTyrLys-449 |
| SEQ. ID. NO. 8145 | 477-AlaSerAsnAspPheGluArgAlaThrGlnMetAlaArgGluMetValThr-493 |
| SEQ. ID. NO. 8146 | 496-GlyMetSerAspLysMetGly-502 |
| SEQ. ID. NO. 8147 | 507-AlaGluAsnGluGlyGluValPheLeu-515 |
| SEQ. ID. NO. 8148 | 518-SerValThrArgSerGlnAsnIleSerGluLysThrGlnGlnAspIleAspAlaGluIleArgArgIleLeuAspGluGlnTyr-545 |
| SEQ. ID. NO. 8149 | 551-IleLeuAspGluAsnArgAspLysMetGluThrMetCys-563 |
| SEQ. ID. NO. 8150 | 570-GluThrIleAspArgAspGlnVal-577 |
| SEQ. ID. NO. 8151 | 584-LysGlnProSerProProLysAspTyrSerHisAsnLeuArgGluAsnAlaAspAlaAlaGluAspAsnAlaPro-608 |
| SEQ. ID. NO. 8152 | 610-AlaProThrArgGluGluThrGluAlaProAlaProAlaAspThrAlaSerThrGluSerGluGlnGlnProGluAsnLysAla-637 |
| 616-2 | |
| AMPHI Regions - AMPHI | |
| SEQ. ID. NO. 8153 | 6-LysMetValValGlyLeu-11 |
| SEQ. ID. NO. 8154 | 13-AsnProGlyLysGluTyrGlu-19 |
| SEQ. ID. NO. 8155 | 48-PheGlyGluValAlaArgAla-54 |
| SEQ. ID. NO. 8156 | 77-ValAlaAlaLeuAlaGlnPheTyrLys-85 |
| SEQ. ID. NO. 8157 | 115-GlyHisAsnGlyLeuLysAspIle-122 |
| SEQ. ID. NO. 8158 | 159-HisArgArgGlnIleAspAspAlaValAlaLysSerLeuGlnAlaIleProAspIleLeuAlaGlyLysTrpGluGluAlaThrArgPheLeuHisSer-191 |

TABLE 1-continued

Antigenic Index - Jameson-Wolf
SEQ. ID. NO. 8159    11-LeuGlyAsnProGlyLysGluTyrGluGlnThrArgHisAsnAlaGlyPhe-27
SEQ. ID. NO. 8160    39-AlaSerPheLysGluGluLysLysPhePhe-48
SEQ. ID. NO. 8161    55-AlaLeuProAspGly-59
SEQ. ID. NO. 8162    70-MetAsnArgSerGlyGlnAla-76
SEQ. ID. NO. 8163    86-IleLysProGluGlu
SEQ. ID. NO. 8164    96-AspGluLeuAspIleProCysGlyArgIleLysPhe-107
SEQ. ID. NO. 8165    109-LeuGlyGlyGlyAsnGlyGlyHisAsnGlyLeuLysAspIleGlnAla-124
SEQ. ID. NO. 8166    127-GlyThrAlaAspTyrTyrArg-133
SEQ. ID. NO. 8167    138-IleGlyHisProGlyAspArgAsnLeu-146
SEQ. ID. NO. 8168    152-LeuAsnLysProSerThrGluHisArgArgGlnIleAspAspAlaValAla-168
SEQ. ID. NO. 8169    181-LysTrpGluGluAlaThrArg-187
Hydrophilic Regions - Hopp-Woods
SEQ. ID. NO. 8170    13-AsnProGlyLysGluTyrGluGlnThrArgHis-23
SEQ. ID. NO. 8171    39-AlaSerPheLysGluGluLysLysPhePhe-48
SEQ. ID. NO. 8172    86-IleLysProGluGlu-90
SEQ. ID. NO. 8173    96-AspGluLeuAspIleProCysGlyArgIleLysPhe-107
SEQ. ID. NO. 8174    117-AsnGlyLeuLysAspIleGlnAla-124
SEQ. ID. NO. 8175    140-HisProGlyAspArgAsnLeu-146
SEQ. ID. NO. 8176    155-ProSerThrGluHisArgArgGlnIleAspAspAlaValAla-168
SEQ. ID. NO. 8177    181-LysTrpGluGluAlaThrArg-187
619
AMPHI Regions - AMPHI
SEQ. ID. NO. 8178    50-LysLeuAlaAlaLeuLeu-55
SEQ. ID. NO. 8179    66-GlnLeuPheGlnThrLeuThrAsn-73
SEQ. ID. NO. 8180    134-GlnGlyGlyArgAspLeu-139
SEQ. ID. NO. 8181    146-GlyValIlePheGlyIleLeuPheArgSerLeuSerSerLeuLeuSerArg-162
SEQ. ID. NO. 8182    165-AspProGluGluPhe-169
SEQ. ID. NO. 8183    175-AsnMetPheAlaGlyPheAsnThrValHisSer-185
SEQ. ID. NO. 8184    246-AlaValValGlyProValSerPhePheGlyLeuLeuAlaAlaSerLeuAlaAsnHisPheSer-266
SEQ. ID. NO. 8185    294-GluHisLeuLeuGly-298
SEQ. ID. NO. 8186    303-LeuSerValValValGluPhe-309
Antigenic Index - Jameson-Wolf
SEQ. ID. NO. 8187    1-MetProSerGluLysAsnIle-7
SEQ. ID. NO. 8188    11-AlaGlySerSerArgPro-16
SEQ. ID. NO. 8189    35-AsnValLysGlyAspTrpAsp-41
SEQ. ID. NO. 8190    132-IleLysGlnGlyGlyArgAspLeuSer-140
SEQ. ID. NO. 8191    163-MetIleAspProGluGluPheThr-170
SEQ. ID. NO. 8192    203-TrpArgGluArgTyrArgLeuAsp-210
SEQ. ID. NO. 8193    215-GlyArgAspGlnAlaVal-220
SEQ. ID. NO. 8194    265-PheSerProSerValLysHisSerVal-273
Hydrophilic Regions - Hopp-Woods
SEQ. ID. NO. 8195    1-MetProSerGluLysAsnIle-7
SEQ. ID. NO. 8196    134-GlnGlyGlyArgAspLeuSer-140
SEQ. ID. NO. 8197    163-MetIleAspProGluGluPheThr-170
SEQ. ID. NO. 8198    203-TrpArgGluArgTyrArgLeu-209
SEQ. ID. NO. 8199    215-GlyArgAspGlnAla-219
SEQ. ID. NO. 8200    269-ValLysHisSerVal-273
620
AMPHI Regions - AMPHI
SEQ. ID. NO. 8201    9-ValAlaValSerAlaLeuSerAlaCysArgGlnAla-20
SEQ. ID. NO. 8202    31-IleSerAspArgSerVal-36
SEQ. ID. NO. 8203    67-SerThrIleLysGlnMetPheGlyTyrThrLysLeuProGluGluProLysGlyIleArgValIleTyrValThrAspMetGlyAsnValThrAspTrp
                     Thr-100
SEQ. ID. NO. 8204    139-GlnAlaGluLysPhe-143
Antigenic Index - Jameson-Wolf
SEQ. ID. NO. 8205    15-SerAlaCysArgGlnAlaGluGluGlyProProProLeuProArgGlnIleSerAspArgSerValGlyHis-38
SEQ. ID. NO. 8206    43-AsnLeuThrGluHisAsnGlyProLysAla-52
SEQ. ID. NO. 8207    57-AsnGlyLysProAspGlnProVal-64
SEQ. ID. NO. 8208    75-TyrThrLysLeuProGluGluProLysGlyIle-85
SEQ. ID. NO. 8209    97-ThrAspTrpThrAsnProAsnAlaAspThrGluTrpMetAspAlaLysLys-113
SEQ. ID. NO. 8210    125-GlyMetGlyAlaGluAspAlaLeuProPheGlyAsnLysGluGlnAlaGluLysPheAlaLysAspLysGlyGlyLysValValGlyPheAspAspMet
                     ProAspThrTyr-161
Hydrophilic Regions - Hopp-Woods
SEQ. ID. NO. 8211    18-ArgGlnAlaGluGluGlyProProProLeu-27
SEQ. ID. NO. 8212    30-GlnIleSerAspArgSerVal-36
SEQ. ID. NO. 8213    46-GluHisAsnGlyProLys-51
SEQ. ID. NO. 8214    58-GlyLysProAspGln-62
SEQ. ID. NO. 8215    77-LysLeuProGluGluProLysGlyIle-85
SEQ. ID. NO. 8216    103-AsnAlaAspThrGluTrpMetAspAlaLysLys-113
SEQ. ID. NO. 8217    127-GlyAlaGluAspAlaLeu-132
SEQ. ID. NO. 8218    135-GlyAsnLysGluGlnAlaGluLysPheAlaLysAspLysGlyGlyLys-150
SEQ. ID. NO. 8219    155-AspAspMetProAsp-159
622
AMPHI Regions - AMPHI
SEQ. ID. NO. 8220    28-LeuProLysAlaValArgAsnLeuAlaArg-37
SEQ. ID. NO. 8221    62-GluGluIleIleArgTrpLeuAlaAsp-70
SEQ. ID. NO. 8222    112-IleLeuGlyGlnIleLysAspAlaValArgValAlaGln-124
SEQ. ID. NO. 8223    131-LysLysLeuAsnAlaLeuPheGlnLys-139
SEQ. ID. NO. 8224    142-SerValAlaLysGluVal-147

TABLE 1-continued

| | |
|---|---|
| SEQ. ID. NO. 8225 | 169-GluGlnIlePheProAspIleGlyAsp-177 |
| SEQ. ID. NO. 8226 | 187-GluMetIleGluLeuValAla-193 |
| SEQ. ID. NO. 8227 | 214-AlaGlnGluLeuCysAspLys-220 |
| SEQ. ID. NO. 8228 | 232-AspLeuProAlaIleLeuHis-238 |
| SEQ. ID. NO. 8229 | 288-AspLeuAsnAspAla-292 |
| SEQ. ID. NO. 8230 | 297-ValAspAspMetValAsnIleValGlnSerGly-307 |
| SEQ. ID. NO. 8231 | 324-GluLysValAlaGluPheValArgGlnGln-333 |
| SEQ. ID. NO. 8232 | 345-LeuArgAspGluGlyGluLys-351 |
| SEQ. ID. NO. 8233 | 354-LysGlnValLeuGluAsnAlaMetLysGlnLeuAlaLys-366 |
| SEQ. ID. NO. 8234 | 372-GluValLeuGluArgLeuSerValGlnLeuThr-382 |
| SEQ. ID. NO. 8235 | 384-LysLeuLeuHisSerProThrGlnThrLeuAsnLysAlaGlyGlu-398 |
| Antigenic Index - Jameson-Wolf | |
| SEQ. ID. NO. 8236 | 16-SerIleArgGluLysLeuAla-22 |
| SEQ. ID. NO. 8237 | 30-LysAlaValArgAsnLeuAlaArgSerAsnAlaAla-41 |
| SEQ. ID. NO. 8238 | 49-ThrCysAsnArgThrGlu-54 |
| SEQ. ID. NO. 8239 | 57-CysValGlyAspSerGluGluIleIle-65 |
| SEQ. ID. NO. 8240 | 75-ProIleGluGluIleArgPro-81 |
| SEQ. ID. NO. 8241 | 87-AspMetGlnGluThrValArgHis-94 |
| SEQ. ID. NO. 8242 | 115-GlnIleLysAspAlaValArgValAlaGlnGluGlnGluSerMetGlyLysLysLeu-133 |
| SEQ. ID. NO. 8243 | 142-SerValAlaLysGluValArgThrAspThrAlaValGlyGluAsnSerVal-158 |
| SEQ. ID. NO. 8244 | 174-AspIleGlyAspLeuAsn-179 |
| SEQ. ID. NO. 8245 | 199-LysSerProArgLeu-203 |
| SEQ. ID. NO. 8246 | 210-ThrLeuAlaArgAlaGlnGluLeuCysAspLysLeuGlyValAsnAlaGlu-226 |
| SEQ. ID. NO. 8247 | 257-GlyMetValGluArgAlaLeuLysGlnArgGlnSer-268 |
| SEQ. ID. NO. 8248 | 277-AlaValProArgAspIleGluAlaGluValGlyAspLeuAsnAsp-291 |
| SEQ. ID. NO. 8249 | 305-GlnSerGlyLysGluAlaArgGlnLysAlaAlaAlaAla-317 |
| SEQ. ID. NO. 8250 | 321-LeuValSerGluLysValAlaGluPheValArgGlnGlnGlnGlyArgGlnSerVal-339 |
| SEQ. ID. NO. 8251 | 343-LysAlaLeuArgAspGluGlyGluLysAlaArgLysGlnValLeu-357 |
| SEQ. ID. NO. 8252 | 368-AlaThrAlaGluGluValLeuGlu-375 |
| SEQ. ID. NO. 8253 | 381-LeuThrAsnLysLeuLeuHisSerProThrGlnThrLeuAsnLysAlaGlyGluGluAspLysAspLeuVal-404 |
| Hydrophilic Regions - Hopp-Woods | |
| SEQ. ID. NO. 8254 | 16-SerIleArgGluLysLeuAla-22 |
| SEQ. ID. NO. 8255 | 30-LysAlaValArgAsnLeuAlaArgSerAsnAlaAla-41 |
| SEQ. ID. NO. 8256 | 59-GlyAspSerGluGluIleIle-65 |
| SEQ. ID. NO. 8257 | 75-ProIleGluGluIleArg-80 |
| SEQ. ID. NO. 8258 | 87-AspMetGlnGluThrValArgHis-94 |
| SEQ. ID. NO. 8259 | 115-GlnIleLysAspAlaValArgValAlaGlnGluGlnGluSerMetGlyLysLysLeu-133 |
| SEQ. ID. NO. 8260 | 142-SerValAlaLysGluValArgThrAspThrAlaValGlyGluAsnSerVal-158 |
| SEQ. ID. NO. 8261 | 210-ThrLeuAlaArgAlaGlnGluLeuCysAsp-219 |
| SEQ. ID. NO. 8262 | 257-GlyMetValGluArgAlaLeuLysGlnArgGlnSer-268 |
| SEQ. ID. NO. 8263 | 277-AlaValProArgAspIleGluAlaGluValGlyAspLeuAsn-290 |
| SEQ. ID. NO. 8264 | 305-GlnSerGlyLysGluAlaArgGlnLysAlaAlaAlaAla-317 |
| SEQ. ID. NO. 8265 | 321-LeuValSerGluLysValAlaGluPheValArg-331 |
| SEQ. ID. NO. 8266 | 333-GlnGlnGlyArgGlnSer-338 |
| SEQ. ID. NO. 8267 | 343-LysAlaLeuArgAspGluGlyGluLysAlaArgLysGlnValLeu-357 |
| SEQ. ID. NO. 8268 | 368-AlaThrAlaGluGluValLeuGlu-375 |
| SEQ. ID. NO. 8269 | 392-ThrLeuAsnLysAlaGlyGluGluAspLysAspLeuVal-404 |
| 624 | |
| AMPHI Regions - AMPHI | |
| SEQ. ID. NO. 8270 | 14-LeuLeuLeuGlyIleIleGlyIlePheLeuPro-24 |
| SEQ. ID. NO. 8271 | 45-ArgPheTyrArgTrpLeuHisArg-52 |
| SEQ. ID. NO. 8272 | 58-ProMetValHisAsn-62 |
| SEQ. ID. NO. 8273 | 92-PheProGlnArgTrpTrpValGlyAla-100 |
| SEQ. ID. NO. 8274 | 102-SerSerValPheCysSerLeuValAlaIle-111 |
| Antigenic Index - Jameson-Wolf | |
| SEQ. ID. NO. 8275 | 41-LysAlaSerProArgPheTyr-47 |
| SEQ. ID. NO. 8276 | 50-LeuHisArgHisArgTyrPheGlyPro-58 |
| SEQ. ID. NO. 8277 | 63-TrpGluGlnAsnGlyAlaValProArgLysAlaLys-74 |
| SEQ. ID. NO. 8278 | 115-ArgArgProGluSer-119 |
| Hydrophilic Regions - Hopp-Woods | |
| SEQ. ID. NO. 8279 | 67-GlyAlaValProArgLysAlaLys-74 |
| SEQ. ID. NO. 8280 | 115-ArgArgProGluSer-119 |
| 625 | |
| AMPHI Regions - AMPHI | |
| SEQ. ID. NO. 8281 | 25-SerGlyArgIleIleSerIleAlaAla-33 |
| SEQ. ID. NO. 8282 | 64-LysMetProProGluMetValTyrArgAla-73 |
| Antigenic Index - Jameson-Wolf | |
| SEQ. ID. NO. 8283 | 5-ArgLysMetLysLysMetThrMetCysThrArgArgVal-17 |
| SEQ. ID. NO. 8284 | 57-ProPheLysSerProGlnThrLysMetProPro-67 |
| SEQ. ID. NO. 8285 | 73-AlaSerSerSerArgMetLysGly-80 |
| SEQ. ID. NO. 8286 | 96-AspAlaProLysThrLysLeuAsnGlyMetArgLysSerAsnValGln-111 |
| Hydrophilic Regions - Hopp-Woods | |
| SEQ. ID. NO. 8287 | 5-ArgLysMetLysLysMetThrMetCysThrArgArgVal-17 |
| SEQ. ID. NO. 8288 | 60-SerProGlnThrLysMetProPro-67 |
| SEQ. ID. NO. 8289 | 74-SerSerSerArgMetLysGly-80 |
| SEQ. ID. NO. 8290 | 96-AspAlaProLysThrLysLeuAsnGlyMetArgLysSerAsnValGln-111 |
| 627-2 | |
| AMPHI Regions - AMPHI | |
| SEQ. ID. NO. 8291 | 52-TrpHisHisHisTyrGlyLysIleThrAlaPheTrpThrLeuLeuPheLeu-68 |
| SEQ. ID. NO. 8292 | 83-ThrValAlaHisAlaLeu-88 |

TABLE 1-continued

| | |
|---|---|
| SEQ. ID. NO. 8293 | 128-ValGlyThrAlaLeuAlaSerIleMetGly-137 |
| SEQ. ID. NO. 8294 | 173-IleGlyGlyGlyLeuThrPro-179 |
| SEQ. ID. NO. 8295 | 189-PheLeuLysGlyValAsp-194 |
| SEQ. ID. NO. 8296 | 245-AlaIlePheGlyLysTrp-250 |
| SEQ. ID. NO. 8297 | 258-ValValGlyAlaVal-262 |
| SEQ. ID. NO. 8298 | 284-LeuGlnAsnLeuVal-288 |
| SEQ. ID. NO. 8299 | 319-IleAlaGluValGlyLysLeuPheLeuGlyIlePheIleThrIlePheProValLeuSerIleLeuLysAlaGlyGluAlaGlyAlaLeuGlyGlyVal ValSerLeuValHisAspThrAlaGlyHisProIle-363 |
| SEQ. ID. NO. 8300 | 372-GlyIleLeuSerAlaPheLeuAspAsnAla-381 |
| SEQ. ID. NO. 8301 | 404-PheHisSerLeuLeuAlaValSer-411 |
| SEQ. ID. NO. 8302 | 416-PheMetGlyAlaLeuThrTyrIleGlyAsnAlaProAsnPheMetValLys-432 |
| SEQ. ID. NO. 8303 | 444-ThrPhePheGlyTyr-448 |

Antigenic Index - Jameson-Wolf

| | |
|---|---|
| SEQ. ID. NO. 8304 | 20-AspLeuAspGlyAlaAsn-25 |
| SEQ. ID. NO. 8305 | 114-AspLeuAsnGlyThrProLysLeu-121 |
| SEQ. ID. NO. 8306 | 149-LeuLeuLysAlaAsnGlnAsnArgThrArgArgVal-160 |
| SEQ. ID. NO. 8307 | 172-AsnIleGlyGlyGly-176 |
| SEQ. ID. NO. 8308 | 178-ThrProLeuGlyAspProPro-184 |
| SEQ. ID. NO. 8309 | 223-ArgPhePheLysGlnGluSerIleAlaGlnAspThrProAlaGlnGlnGluLysProGluLys-243 |
| SEQ. ID. NO. 8310 | 266-GlyLeuTrpLysProGluHisProGlyPhe-275 |
| SEQ. ID. NO. 8311 | 304-ThrProLysGlnValArgAlaGlyAsnGluPheAsnPhe-316 |
| SEQ. ID. NO. 8312 | 357-AspThrAlaGlyHis-361 |
| SEQ. ID. NO. 8313 | 391-AlaGlyGlyAspAla-395 |
| SEQ. ID. NO. 8314 | 433-AlaIleAlaGluGlnArgGlyValPro-441 |

Hydrophilic Regions - Hopp-Woods

| | |
|---|---|
| SEQ. ID. NO. 8315 | 153-AsnGlnAsnArgThrArgArgVal-160 |
| SEQ. ID. NO. 8316 | 228-GluSerIleAlaGln-232 |
| SEQ. ID. NO. 8317 | 234-ThrProAlaGlnGlnGluLysProGluLys-243 |
| SEQ. ID. NO. 8318 | 268-TrpLysProGluHisProGly-274 |
| SEQ. ID. NO. 8319 | 306-LysGlnValArgAlaGlyAsn-312 |
| SEQ. ID. NO. 8320 | 433-AlaIleAlaGluGlnArgGlyVal-440 |

628
AMPHI Regions - AMPHI

| | |
|---|---|
| SEQ. ID. NO. 8321 | 10-CysGlyProProAsnSerCysValSerMetLeuAlaAlaPheSerAspGlyThrSerAlaProAlaAla-32 |
| SEQ. ID. NO. 8322 | 34-GlnThrTrpIleLeuArgSer-40 |

Antigenic Index - Jameson-Wolf

| | |
|---|---|
| SEQ. ID. NO. 8323 | 6-LysProAlaGlyCysGlyProProAsnSer-15 |
| SEQ. ID. NO. 8324 | 23-PheSerAspGlyThrSerAla-29 |
| SEQ. ID. NO. 8325 | 40-SerValLysArgLeuAsnThrAsnArgProArgLeuLysSerSerAla-55 |
| SEQ. ID. NO. 8326 | 77-MetAlaAsnGlySerAlaSerThr-84 |
| SEQ. ID. NO. 8327 | 91-GlyArgValArgSerAlaValHisLysProAspTrpIleArgLeuArgArgThrSerSerProLeuLys-113 |

Hydrophilic Regions - Hopp-Woods

| | |
|---|---|
| SEQ. ID. NO. 8328 | 40-SerValLysArgLeuAsnThrAsnArgProArgLeuLysSerSerAla-55 |
| SEQ. ID. NO. 8329 | 91-GlyArgValArgSerAlaValHisLys-99 |
| SEQ. ID. NO. 8330 | 101-AspTrpIleArgLeuArgArgThrSerSer-110 |

629
AMPHI Regions - AMPHI

| | |
|---|---|
| SEQ. ID. NO. 8331 | 32-ArgTrpSerAspValPheSer-38 |
| SEQ. ID. NO. 8332 | 48-IleSerArgLeuProArgThrPhe-55 |
| SEQ. ID. NO. 8333 | 116-ValAlaAlaLeuIleGlyMetLeu-123 |
| SEQ. ID. NO. 8334 | 146-IlePheGlyGlyValIleGluAlaValAlaThr-156 |
| SEQ. ID. NO. 8335 | 167-MetLeuGlyValTrpGlnGlnGlyAsp-175 |
| SEQ. ID. NO. 8336 | 206-IleLeuGlyLeuGlyGlu-211 |
| SEQ. ID. NO. 8337 | 252-ValValProAsnIleIleSerArgLeuMetGlyAspArgLeuArgGlnSer-268 |
| SEQ. ID. NO. 8338 | 285-IleIleGlyArgVal-289 |
| SEQ. ID. NO. 8339 | 300-ThrValPheGlyValLeu-305 |

Antigenic Index - Jameson-Wolf

| | |
|---|---|
| SEQ. ID. NO. 8340 | 38-SerLeuSerAspSerGln-43 |
| SEQ. ID. NO. 8341 | 50-ArgLeuProArgThr-54 |
| SEQ. ID. NO. 8342 | 77-AsnArgPheValGluProSerMetValGlyAlaSerGln-89 |
| SEQ. ID. NO. 8343 | 130-ArgArgLeuProProThrAla-136 |
| SEQ. ID. NO. 8344 | 260-LeuMetGlyAspArgLeuArgGlnSer-268 |

Hydrophilic Regions - Hopp-Woods

| | |
|---|---|
| SEQ. ID. NO. 8345 | 260-LeuMetGlyAspArgLeuArgGln-267 |

630-2
AMPHI Regions - AMPHI

| | |
|---|---|
| SEQ. ID. NO. 8346 | 6-PheLeuGluLysIleGluPro-12 |
| SEQ. ID. NO. 8347 | 23-TrpTyrAlaLeuTyrGlu-28 |
| SEQ. ID. NO. 8348 | 64-LeuPheProAlaMetPheTyrGlyMetTyrAsn-74 |
| SEQ. ID. NO. 8349 | 87-LeuLeuGlnGlnAsnIleAlaAsnAspTrpHisTyrAlaPhe-100 |
| SEQ. ID. NO. 8350 | 137-GlyPheTrpGluValLeuPheAla-144 |
| SEQ. ID. NO. 8351 | 190-PheGlyGlyThrGlyLysAsnPhe-197 |
| SEQ. ID. NO. 8352 | 224-AlaValAspGlyTyrSerGlyAlaThrAlaLeuAlaGlnTrp-237 |
| SEQ. ID. NO. 8353 | 242-AlaAspGlyLeuLysAsnAlaVal-249 |
| SEQ. ID. NO. 8354 | 258-AspAlaPheIleGlyLysLeuProGlySerIleGlyGluValSer-272 |
| SEQ. ID. NO. 8355 | 285-PheAlaArgIleAlaSerTrpArgIleIleAlaGlyValMet-298 |
| SEQ. ID. NO. 8356 | 302-IleAlaMetSerSerLeuPheAsnPhe-310 |
| SEQ. ID. NO. 8357 | 344-ValSerAlaSerPheThrAsnValGlyLysTrpTrpTyrGlyAlaLeuIleGlyValMetCysValLeuIleArgVal-369 |
| SEQ. ID. NO. 8358 | 382-IleLeuPheAlaAsnLeuPheAlaProIlePheAspTyrPhe-395 |

TABLE 1-continued

Antigenic Index - Jameson-Wolf
SEQ. ID. NO. 8359   6-PheLeuGluLysIleGlu-11
SEQ. ID. NO. 8360   16-ProGlyGlyLysHisGluLys-22
SEQ. ID. NO. 8361   37-SerGlyAlaValThrArgLysAlaAlaHisValArgAspAlaLeuAspSerLysArgMet-56
SEQ. ID. NO. 8362   107-AsnMetSerSerGluAlaGlyValSerAspLysMet-118
SEQ. ID. NO. 8363   146-ValArgLysHisGluIleAsnGlu-153
SEQ. ID. NO. 8364   189-ValPheGlyGlyThrGlyLysAsnPheMet-198
SEQ. ID. NO. 8365   212-TyrProAlaAsnLeuSerGlyAspAla-220
SEQ. ID. NO. 8366   241-GlyAlaAspGlyLeuLys-246
SEQ. ID. NO. 8367   264-LeuProGlySerIleGly-269
SEQ. ID. NO. 8368   312-GlySerAspThrAsnAla-317
SEQ. ID. NO. 8369   400-AsnIleLysArgArgLysAlaArgSerAsnGly-410
Hydrophilic Regions - Hopp-Woods
SEQ. ID. NO. 8370   6-PheLeuGluLysIleGlu-11
SEQ. ID. NO. 8371   18-GlyLysHisGluLys-22
SEQ. ID. NO. 8372   39-AlaValThrArgLysAlaAlaHisValArgAspAlaLeuAspSerLysArgMet-56
SEQ. ID. NO. 8373   108-MetSerSerGluAlaGlyValSerAsp-116
SEQ. ID. NO. 8374   146-ValArgLysHisGluIleAsn-152
SEQ. ID. NO. 8375   400-AsnIleLysArgArgLysAlaArgSerAsnGly-410
638
AMPHI Regions - AMPHI
SEQ. ID. NO. 8376   30-IleValAspIleValGluHis-36
SEQ. ID. NO. 8377   46-AspIleValGluTyrPheGluProLeuGlyLys-56
SEQ. ID. NO. 8378   108-ProPheGlyAsnValValAlaAspAspLeuArgThrGly-120
SEQ. ID. NO. 8379   148-ArgIleGlyArgThrMet-153
SEQ. ID. NO. 8380   198-GluArgTyrValArgArgValTyrGlyTyrGlyThrPro-210
SEQ. ID. NO. 8381   212-ProValAlaPheAspGlyCysGlyThrValGlyArg-223
SEQ. ID. NO. 8382   242-SerGlnPheGluArgIleAlaArgProGly-251
Antigenic Index - Jameson-Wolf
SEQ. ID. NO. 8383   43-AlaAspGlyAspIle-47
SEQ. ID. NO. 8384   53-ProLeuGlyLysHisGln-58
SEQ. ID. NO. 8385   81-ValAspGlyGluThrGlnIle-87
SEQ. ID. NO. 8386   99-AlaGlyIleGlyLysAsnAlaVal-106
SEQ. ID. NO. 8387   113-ValAlaAspAspLeuArgThrGlyCysValProAsnGly-125
SEQ. ID. NO. 8388   135-GlnSerArgValAlaAsp-140
SEQ. ID. NO. 8389   156-TyrAlaAspArgIleIle-161
SEQ. ID. NO. 8390   168-AsnGlnGlyAlaArgGlySerPhe-175
SEQ. ID. NO. 8391   178-IleAsnThrGlyIleHis-183
SEQ. ID. NO. 8392   188-HisThrGlyThrGlyAsnGlyGlnValAlaGluArgTyrValArg-202
SEQ. ID. NO. 8393   205-TyrGlyTyrGlyThr-209
SEQ. ID. NO. 8394   216-AspGlyCysGlyThrValGlyArgProPheAsnArgAsnArgPheVal-231
SEQ. ID. NO. 8395   240-AlaGlySerGlnPheGluArgIleAlaArgProGlyAlaGlyLysCysGly-256
Hydrophilic Regions - Hopp-Woods
SEQ. ID. NO. 8396   43-AlaAspGlyAspIle-47
SEQ. ID. NO. 8397   81-ValAspGlyGluThrGlnIle-87
SEQ. ID. NO. 8398   113-ValAlaAspAspLeuArgThr-119
SEQ. ID. NO. 8399   136-SerArgValAlaAsp-140
SEQ. ID. NO. 8400   195-GlnValAlaGluArgTyrValArg-202
SEQ. ID. NO. 8401   243-GlnPheGluArgIleAlaArgProGlyAlaGly-253
639-1
AMPHI Regions - AMPHI
SEQ. ID. NO. 8402   95-TyrLysAsnAsnArg-99
SEQ. ID. NO. 8403   137-LeuLysValPheAspAsnIle-143
SEQ. ID. NO. 8404   157-ValAsnTyrSerAspIleHisAspAsnIleIleAsnLysAla-170
SEQ. ID. NO. 8405   181-TyrAspLysLeuPheAlaAsnHisPheGlu-190
SEQ. ID. NO. 8406   269-AlaProValSerArg-273
SEQ. ID. NO. 8407   290-GlnPheProAlaValLeuProGly-297
SEQ. ID. NO. 8408   322-AspGluLeuLeuLysGluValGlu-329
Antigenic Index - Jameson-Wolf
SEQ. ID. NO. 8409   13-GluGluThrAlaPro-17
SEQ. ID. NO. 8410   23-HisAsnAsnIleLeuAspAsnSer30
SEQ. ID. NO. 8411   41-AlaMetValArgGluAsnLysIleValGly-50
SEQ. ID. NO. 8412   52-AlaThrLeuArgValAsnGluArgGlyAsnGly-62
SEQ. ID. NO. 8413   75-GlyAsnAspIleSerLysGlyArgAspGlyIlePheSerAsnThrSerThrHisAsnThrTyrLysAsnAsnArgPheSerAsp-102
SEQ. ID. NO. 8414   111-TyrThrAsnAspSerGluIleSerGly-119
SEQ. ID. NO. 8415   121-IleSerValGlyAsnAsn-126
SEQ. ID. NO. 8416   135-GluArgLeuLysVal-139
SEQ. ID. NO. 8417   145-ValGlySerArgAspGlnGlyIle-152
SEQ. ID. NO. 8418   160-SerAspIleHisAspAsnIleIleAsnLysAlaGlyLys-172
SEQ. ID. NO. 8419   203-GluGlyThrSerLeuHisAspAsnSerPheIleAsnAsnGluSerGlnValLysTyrVal-222
SEQ. ID. NO. 8420   228-AspTrpSerGluGlyGlyHisGlyAsnTyrTrpSerAspAsnSerAla-243
SEQ. ID. NO. 8421   246-LeuAsnGlyAspGlyPheGlyAspSerAlaTyrArgProAsnGlyIleIle-262
SEQ. ID. NO. 8422   297-GlyGlyValValAspSerLysProLeuMetLysProTyrAlaProLysIleGlnThr-315
SEQ. ID. NO. 8423   318-GlnAlaMetLysAspGluLeuLeuLysGluValGluThrArgGlnSerGluTrpGlyArgAlaGluAsnGlySerLeuAsn-344
Hydrophilic Regions - Hopp-Woods
SEQ. ID. NO. 8424   41-AlaMetValArgGluAsnLysIleValGly-50
SEQ. ID. NO. 8425   52-AlaThrLeuArgValAsnGluArgGlyAsn-61
SEQ. ID. NO. 8426   77-AspIleSerLysGlyArgAspGlyIle-85
SEQ. ID. NO. 8427   95-TyrLysAsnAsnArgPheSerAsp-102
SEQ. ID. NO. 8428   113-AsnAspSerGluIleSerGly-119

TABLE 1-continued

| | |
|---|---|
| SEQ. ID. NO. 8429 | 135-GluArgLeuLysVal-139 |
| SEQ. ID. NO. 8430 | 146-GlySerArgAspGlnGly-151 |
| SEQ. ID. NO. 8431 | 299-ValValAspSerLysProLeuMet-306 |
| SEQ. ID. NO. 8432 | 318-GlnAlaMetLysAspGluLeuLeuLysGluValGluThrArgGlnSerGluTrpGlyArgAlaGluAsnGlySer-342 |

640-2
AMPHI Regions - AMPHI

| | |
|---|---|
| SEQ. ID. NO. 8433 | 6-SerIleLeuLysSerIleGlyIle-13 |
| SEQ. ID. NO. 8434 | 22-SerIleLysArgMetSer-27 |
| SEQ. ID. NO. 8435 | 47-LeuProAlaTyrAlaGluArgLeuProAspPheLeuAlaLysIleGlnPro-63 |
| SEQ. ID. NO. 8436 | 72-ArgTyrGlyLysPro-76 |
| SEQ. ID. NO. 8437 | 127-AlaLysLeuValAspHisHis-133 |
| SEQ. ID. NO. 8438 | 141-IleProHisLeuProAlaProGlyArgAlaIle-151 |
| SEQ. ID. NO. 8439 | 153-SerAsnTrpLeuProAla-158 |

Antigenic Index - Jameson-Wolf

| | |
|---|---|
| SEQ. ID. NO. 8440 | 24-LysArgMetSerAlaPheArgAlaArgIle-33 |
| SEQ. ID. NO. 8441 | 50-TyrAlaGluArgLeuProAspPhe-57 |
| SEQ. ID. NO. 8442 | 59-AlaLysIleGlnProSerGluIlePheProGlyAlaAspArgTyrGlyLysProGluGlyLysProMetVal-82 |
| SEQ. ID. NO. 8443 | 84-ArgValTyrLysGlyAspGluGlnLeu-92 |
| SEQ. ID. NO. 8444 | 101-AlaValAsnThrArgGlyTyrSerSerLysProIleAsp-113 |
| SEQ. ID. NO. 8445 | 128-LysLeuValAspHisHisGlu-134 |
| SEQ. ID. NO. 8446 | 144-LeuProAlaProGlyArgAlaIleArg-152 |
| SEQ. ID. NO. 8447 | 168-AsnArgLeuArgLeuLysGlyLeuPro-176 |
| SEQ. ID. NO. 8448 | 178-ValProGlnProSerLysAlaThrGly-186 |

Hydrophilic Regions - Hopp-Woods

| | |
|---|---|
| SEQ. ID. NO. 8449 | 24-LysArgMetSerAlaPheArgAlaArgIle-33 |
| SEQ. ID. NO. 8450 | 50-TyrAlaGluArgLeuPro-55 |
| SEQ. ID. NO. 8451 | 68-ProGlyAlaAspArgTyrGlyLysProGluGlyLysProMetVal-82 |
| SEQ. ID. NO. 8452 | 85-ValTyrLysGlyAspGluGlnLeu-92 |
| SEQ. ID. NO. 8453 | 128-LysLeuValAspHisHisGlu-134 |
| SEQ. ID. NO. 8454 | 146-AlaProGlyArgAlaIleArg-152 |
| SEQ. ID. NO. 8455 | 168-AsnArgLeuArgLeuLysGly-174 |
| SEQ. ID. NO. 8456 | 180-GlnProSerLysAlaThrGly-186 |

642-2
AMPHI Regions - AMPHI

| | |
|---|---|
| SEQ. ID. NO. 8457 | 157-IleLysHisIleValArgAlaPhe-164 |
| SEQ. ID. NO. 8458 | 179-GlyValSerAlaPheLysThrLeuArgThrGlnGluPheLeuGlnHisLeuArgGlyGlyVal-199 |
| SEQ. ID. NO. 8459 | 202-PheArgGlyGluGly-206 |
| SEQ. ID. NO. 8460 | 208-AspAspValArgLeu-212 |
| SEQ. ID. NO. 8461 | 228-AspValAlaValLysAsnLeuGlyAsnLeuMetAlaAlaProAsp-242 |
| SEQ. ID. NO. 8462 | 259-PheGlnIlePheLysAspValPheHisAsnAlaValArgHisAlaAspGlnLeuGln-277 |
| SEQ. ID. NO. 8463 | 311-ValAspGlyValThrAspGlyAla-318 |
| SEQ. ID. NO. 8464 | 337-GlnValAspAspPheGlyGluPheAlaValPhe-347 |
| SEQ. ID. NO. 8465 | 366-PheArgGlyValAsp-370 |
| SEQ. ID. NO. 8466 | 409-HisLeuGlnThrLeuArgAspLeuArgPheIleAlaGluLeuLeuGlnTrpLeuGlnHisGlnArgAlaPheAspAlaGlyThr-436 |
| SEQ. ID. NO. 8467 | 445-ProArgAsnProGlnAsp-450 |

Antigenic Index - Jameson-Wolf

| | |
|---|---|
| SEQ. ID. NO. 8468 | 1-MetArgHisProProGlnSerAlaAlaLeu-10 |
| SEQ. ID. NO. 8469 | 17-LeuLeuHisArgProLysSerValCysArgArgArgLysCysArgLeuLysAla-34 |
| SEQ. ID. NO. 8470 | 36-ProLeuSerAspGlyIleAlaCys-43 |
| SEQ. ID. NO. 8471 | 63-ValGlnGlnGluGlyCysGly-69 |
| SEQ. ID. NO. 8472 | 75-LeuTyrGluAspLysGluSerGlyAspAspPheAlaAspLysAspPheLeuGln-92 |
| SEQ. ID. NO. 8473 | 104-GluAlaAlaAspValPheArg-110 |
| SEQ. ID. NO. 8474 | 115-AlaGlyAspGlyGlyLysAlaGly-122 |
| SEQ. ID. NO. 8475 | 144-PheGlyGlyGlyAlaLysLeu-151 |
| SEQ. ID. NO. 8476 | 164-PheLysAsnArgGluGlyAlaAspValAspSerAspIleAlaGly-178 |
| SEQ. ID. NO. 8477 | 184-LysThrLeuArgThrGlnGlul-190 |
| SEQ. ID. NO. 8478 | 202-PheArgGlyGluGlyPheAspAspValArgLeu-212 |
| SEQ. ID. NO. 8479 | 217-GlyAspGlyGlyAsnArgArgAsnGlyMetAla-227 |
| SEQ. ID. NO. 8480 | 249-AspGluPheAspVal-253 |
| SEQ. ID. NO. 8481 | 271-ArgHisAlaAspGlnLeuGlnAlaAlaAlaAspLysAspValLeuGluArgAlaGlnThrGly-291 |
| SEQ. ID. NO. 8482 | 300-HisGlyGlyCysArg-304 |
| SEQ. ID. NO. 8483 | 306-PheGlyIleAspAlaValAspGlyValThrAspGly-317 |
| SEQ. ID. NO. 8484 | 331-CysPheGlyAspGluGlnGlnValAspAspPheGly-342 |
| SEQ. ID. NO. 8485 | 350-PheGlyGlyAsnGluGluGluValAlaLeu-359 |
| SEQ. ID. NO. 8486 | 369-ValAspValAsnGly-373 |
| SEQ. ID. NO. 8487 | 387-CysAsnArgArgAlaGlyGlyPhe-394 |
| SEQ. ID. NO. 8488 | 396-PheGlyAsnThrGln-400 |
| SEQ. ID. NO. 8489 | 411-GlnThrLeuArgAspLeuArgPhe-418 |
| SEQ. ID. NO. 8490 | 430-ArgAlaPheAspAlaGlyThrGlnArgAsnGly-440 |
| SEQ. ID. NO. 8491 | 443-ValMetProArgAsnProGlnAspPheLeuAsp-453 |
| SEQ. ID. NO. 8492 | 468-GluGlyGlnGlnGlnThrArg-474 |

Hydrophilic Regions - Hopp-Woods

| | |
|---|---|
| SEQ. ID. NO. 8493 | 1-MetArgHisProPro-5 |
| SEQ. ID. NO. 8494 | 17-LeuLeuHisArgProLysSerValCysArgArgArgLysCysArgLeuLysAla-34 |
| SEQ. ID. NO. 8495 | 75-LeuTyrGluLysGluSerGlyAspAspPheAlaAspLysAspPheLeu-91 |
| SEQ. ID. NO. 8496 | 104-GluAlaAlaAspValPheArg-110 |
| SEQ. ID. NO. 8497 | 117-AspGlyGlyLysAla-121 |
| SEQ. ID. NO. 8498 | 147-GlyAlaAspLysLeu-151 |
| SEQ. ID. NO. 8499 | 164-PheLysAsnArgGluGlyAlaAspValAspSerAspIle-176 |
| SEQ. ID. NO. 8500 | 184-LysThrLeuArgThr-188 |

TABLE 1-continued

| SEQ. ID. NO. 8501 | 205-GluGlyPheAspAspValArgLeu-212 |
| SEQ. ID. NO. 8502 | 217-GlyAspGlyGlyAsnArgArgAsnGlyMet-226 |
| SEQ. ID. NO. 8503 | 249-AspGluPheAspVal-253 |
| SEQ. ID. NO. 8504 | 271-ArgHisAlaAspGlnLeuGlnAlaAlaAlaAspLysAspValLeuGluArgAlaGlnThr-290 |
| SEQ. ID. NO. 8505 | 310-AlaValAspGlyValThrAspGly-317 |
| SEQ. ID. NO. 8506 | 331-CysPheGlyAspGluGlnGlnValAspAspPheGly-342 |
| SEQ. ID. NO. 8507 | 352-GlyAsnGluGluGluValAlaLeu-359 |
| SEQ. ID. NO. 8508 | 387-CysAsnArgArgAlaGly-392 |
| SEQ. ID. NO. 8509 | 412-ThrLeuArgAspLeuArgPhe-418 |
| SEQ. ID. NO. 8510 | 435-GlyThrGlnArgAsnGly-440 |
| SEQ. ID. NO. 8511 | 446-ArgAsnProGlnAsp-450 |
| SEQ. ID. NO. 8512 | 468-GluGlyGlnGlnGln-472 |

644-2
AMPHI Regions - AMPHI

| SEQ. ID. NO. 8513 | 13-MetAspThrAlaAlaPheLeuLysHisIleGluSerAlaPheArgArgIlePheSerAspGlyIleAspLeuMetArgTyrLeu-40 |
| SEQ. ID. NO. 8514 | 69-GlnPheGluIleGlnGluValLeuArgIleAlaGly-80 |
| SEQ. ID. NO. 8515 | 99-GlnProLeuGlnGluPheGlyAsp-106 |
| SEQ. ID. NO. 8516 | 139-ArgGluMetGlnSerTyrTyrGluTyrIleAspGly-150 |
| SEQ. ID. NO. 8517 | 160-TyrTrpGlnGlyAsn-164 |
| SEQ. ID. NO. 8518 | 182-LeuAlaLysValIleAspLeuLeu-189 |
| SEQ. ID. NO. 8519 | 234-AlaGlyLeuArgAlaPheGlnAsn-241 |
| SEQ. ID. NO. 8520 | 253-MetThrHisGlyIleMetGluTyrIleLeuGluAsnLeuGluArgTyrValArgAsn-271 |
| SEQ. ID. NO. 8521 | 291-GluIleLeuTyrArgTyrValCysHis-299 |
| SEQ. ID. NO. 8522 | 301-ValSerProValAlaProValAlaHis-309 |
| SEQ. ID. NO. 8523 | 314-AlaAsnIleValLysThrLeuAla-321 |
| SEQ. ID. NO. 8524 | 330-GlnMetLeuGlnLys-334 |
| SEQ. ID. NO. 8525 | 357-PheThrIlePheGluGlyProAsn-364 |
| SEQ. ID. NO. 8526 | 366-MetLeuTyrAlaGluIleTyrAspGlnPheValArgAla-378 |
| SEQ. ID. NO. 8527 | 397-AspArgLeuGlnThr-401 |
| SEQ. ID. NO. 8528 | 414-LeuProGluAspIleArgSerPhe-421 |
| SEQ. ID. NO. 8529 | 439-GlyLysIleIleAlaArgLeu-445 |

Antigenic Index - Jameson-Wolf

| SEQ. ID. NO. 8530 | 3-HisThrGluProSerAlaGlnProSerThrMetAsp-14 |
| SEQ. ID. NO. 8531 | 22-IleGluSerAlaPhe-26 |
| SEQ. ID. NO. 8532 | 29-IlePheSerAspGlyIleAsp-35 |
| SEQ. ID. NO. 8533 | 40-LeuProGluAspLysTrpLeu-46 |
| SEQ. ID. NO. 8534 | 57-PheLeuAspLysLysTyrGlyGlyArgLysGlySerGlnPheGluIle-72 |
| SEQ. ID. NO. 8535 | 103-GluPheGlyAspGluAlaGlnVal-110 |
| SEQ. ID. NO. 8536 | 118-PheLysGlyGluGlyGlyGlyLeuGly-126 |
| SEQ. ID. NO. 8537 | 128-ThrGluProGluThrSerGly-134 |
| SEQ. ID. NO. 8538 | 136-AlaIleAlaArgGluMetGlnSer-143 |
| SEQ. ID. NO. 8539 | 145-TyrGluTyrIleAspGlyGlnThr-152 |
| SEQ. ID. NO. 8540 | 160-TyrTrpGlnGlyAsnSerGlnSerAspPhe-169 |
| SEQ. ID. NO. 8541 | 174-AlaLysGluArgLysAsnGlyLysLeuAlaLys-184 |
| SEQ. ID. NO. 8542 | 193-LysThrTyrIleArg-197 |
| SEQ. ID. NO. 8543 | 199-GluThrLeuAlaSerGluGlyLeuArg-207 |
| SEQ. ID. NO. 8544 | 212-AlaValAsnArgIleAspAlaGluMet-220 |
| SEQ. ID. NO. 8545 | 228-LeuSerGlnSerAspAlaAlaGly-235 |
| SEQ. ID. NO. 8546 | 264-AsnLeuGluArgTyrValArgAsnAspIleLysPheValAspTyrGluArgArgGluIleArgArgArgHisGlnVal-289 |
| SEQ. ID. NO. 8547 | 339-LysGlyPheGluArgGlyHisThrAlaGlyAsn-349 |
| SEQ. ID. NO. 8548 | 361-GluGlyProAsnAspMetLeu-367 |
| SEQ. ID. NO. 8549 | 378-AlaThrAlaGluGluLysGluAlaGlyMetLysLeuAspLysAsnGlnThrLeuLeuAspArgLeuGlnThrAspAlaArgPhe-405 |
| SEQ. ID. NO. 8550 | 407-AlaValAlaArgAspTyrThrLeuProGluAspIleArgSerPheLeu-422 |
| SEQ. ID. NO. 8551 | 451-AlaLysHisGluAspThrAla-457 |
| SEQ. ID. NO. 8552 | 463-AspIleArgLysAspIleLeuAspCysArgTyrCysGly-475 |

Hydrophilic Regions - Hopp-Woods

| SEQ. ID. NO. 8553 | 22-IleGluSerAlaPhe-26 |
| SEQ. ID. NO. 8554 | 29-IlePheSerAspGlyIleAsp-35 |
| SEQ. ID. NO. 8555 | 40-LeuProGluAspLysTrpLeu-46 |
| SEQ. ID. NO. 8556 | 58-LeuAspLysLysTyrGlyGlyArgLysGlySerGln-69 |
| SEQ. ID. NO. 8557 | 103-GluPheGlyAspGluAlaGlnVal-110 |
| SEQ. ID. NO. 8558 | 118-PheLysGlyGluGlyGlyGly-123 |
| SEQ. ID. NO. 8559 | 128-ThrGluProGluThrSerGly-134 |
| SEQ. ID. NO. 8560 | 136-AlaIleAlaArgGluMetGlnSer-143 |
| SEQ. ID. NO. 8561 | 174-AlaLysGluArgLysAsnGlyLysLeuAlaLys-184 |
| SEQ. ID. NO. 8562 | 212-AlaValAsnArgIleAspAlaGluMet-220 |
| SEQ. ID. NO. 8563 | 229-SerGlnSerAspAlaAlaGly-235 |
| SEQ. ID. NO. 8564 | 264-AsnLeuGluArgTyrValArgAsnAspIleLysPheValAspTyrGluArgArgGluIleArgArgArgHisGlnVal-289 |
| SEQ. ID. NO. 8565 | 339-LysGlyPheGluArgGlyHisThr-346 |
| SEQ. ID. NO. 8566 | 378-AlaThrAlaGluGluLysGluAlaGlyMetLysLeuAspLysAsnGlnThrLeuLeuAspArgLeuGlnThrAspAlaArgPhe-405 |
| SEQ. ID. NO. 8567 | 416-GluAspIleArgSerPheLeu-422 |
| SEQ. ID. NO. 8568 | 451-AlaLysHisGluAspThrAla-457 |
| SEQ. ID. NO. 8569 | 463-AspIleArgLysAspIleLeuAsp-470 |

645-2
AMPHI Regions - AMPHI

| SEQ. ID. NO. 8570 | 21-AsnThrLeuAsnArgCysCysLys-28 |
| SEQ. ID. NO. 8571 | 87-ArgThrLeuProSerLeuLysGlyLeuThrLys-97 |

Antigenic Index - Jameson-Wolf

| SEQ. ID. NO. 8572 | 17-ValGluGlnSerAsnThrLeuAsnArgCysCysLysLysSerArgMetThrCysSerSerSerArgSerArgSerCysProCys-44 |
| SEQ. ID. NO. 8573 | 47-ProMetArgAlaSerGlySerArgValSerSerArgSerArgIle-61 |

TABLE 1-continued

| | |
|---|---|
| SEQ. ID. NO. 8574 | 68-SerLeuCysArgLysAsnThrCysProProArgLeuSerSerArgAsnThrAlaSerArgThrLeuProSerLeu-92 |
| SEQ. ID. NO. 8575 | 99-LeuThrAlaArgArgArgLeuGly-106 |
| SEQ. ID. NO. 8576 | 110-IleSerGluLysSerArgSerProSerAsn-119 |
| SEQ. ID. NO. 8577 | 137-ThrLeuAlaArgArgArgLeuSerCysSer-146 |

Hydrophilic Regions - Hopp-Woods

| | |
|---|---|
| SEQ. ID. NO. 8578 | 19-GlnSerAsnThrLeu-23 |
| SEQ. ID. NO. 8579 | 25-ArgCysCysLysLysSerArgMetThrCysSerSerSerArgSerArgSerCysPro-43 |
| SEQ. ID. NO. 8580 | 48-MetArgAlaSerGlySerArgValSerSerArgSerArgIle-61 |
| SEQ. ID. NO. 8581 | 69-LeuCysArgLysAsnThrCys-75 |
| SEQ. ID. NO. 8582 | 77-ProArgLeuSerSerArgAsnThrAlaSerArgThr-88 |
| SEQ. ID. NO. 8583 | 99-LeuThrAlaArgArgArgLeuGly-106 |
| SEQ. ID. NO. 8584 | 110-IleSerGluLysSerArgSerProSer-118 |
| SEQ. ID. NO. 8585 | 137-ThrLeuAlaArgArgArgLeuSer-144 |

647

AMPHI Regions - AMPHI

| | |
|---|---|
| SEQ. ID. NO. 8586 | 38-GlyLysValCysArgCysPheGluGlnVal-47 |
| SEQ. ID. NO. 8587 | 69-ThrValPheArgGlnIleIleSerIleVal-78 |

Antigenic Index - Jameson-Wolf

| | |
|---|---|
| SEQ. ID. NO. 8588 | 26-GlyLeuValLysGluArgAlaArg-33 |
| SEQ. ID. NO. 8589 | 39-LysValCysArgCysPhe-44 |
| SEQ. ID. NO. 8590 | 54-GlyThrValGlyGlnThrGluArgGlyThr-63 |
| SEQ. ID. NO. 8591 | 81-AlaAspAlaGluArgThrAlaAlaHisSerArgGlyThrArgGly-95 |

Hydrophilic Regions - Hopp-Woods

| | |
|---|---|
| SEQ. ID. NO. 8592 | 26-GlyLeuValLysGluArgAlaArg-33 |
| SEQ. ID. NO. 8593 | 56-ValGlyGlnThrGluArgGlyThr-63 |
| SEQ. ID. NO. 8594 | 81-AlaAspAlaGluArgThrAlaAlaHisSerArgGlyThrArgGly-95 |

648

AMPHI Regions - AMPHI

| | |
|---|---|
| SEQ. ID. NO. 8595 | 7-ArgIleGluArgAlaValArg-13 |
| SEQ. ID. NO. 8596 | 15-AlaValIleAspValLeuAsnValAsp-23 |
| SEQ. ID. NO. 8597 | 44-AlaLeuAlaAspIleArgValLeu-51 |
| SEQ. ID. NO. 8598 | 94-AlaValAspLeuHisAlaValIleLysLeuThrAspThr-106 |
| SEQ. ID. NO. 8599 | 127-GlnGlyValGluGlnGly-132 |
| SEQ. ID. NO. 8600 | 147-ArgArgLeuLysHisPheLysGluGlyAsnAlaAlaGlyMetProArgPhe-163 |
| SEQ. ID. NO. 8601 | 182-AlaArgThrLeuGlyAsnValPheHis-190 |
| SEQ. ID. NO. 8602 | 194-GlySerGlyIleAspGlyIleGlnThrIleValAlaPheAsnGlnHisThr-210 |

Antigenic Index - Jameson-Wolf

| | |
|---|---|
| SEQ. ID. NO. 8603 | 1-MetAsnArgArgAspAlaArgIleGluArgAlaValArg-13 |
| SEQ. ID. NO. 8604 | 23-AspAlaProGlySerGlyThrLeuLeuHisGlnArgGlyLysGlnValGlySerArgAsnAspAlaLeuAla-46 |
| SEQ. ID. NO. 8605 | 65-GlyLysLysArgPheValGlnSerArgAsnLeuValGlyArgLysGlnArgAsn-82 |
| SEQ. ID. NO. 8606 | 125-MetProGlnGlyValGluGlnGlyCysArgAla-135 |
| SEQ. ID. NO. 8607 | 143-ThrGlyPheAspArgArgLeuLysHisPheLysGluGlyAsnAla-157 |
| SEQ. ID. NO. 8608 | 172-ThrAlaAspThrSerGlyIleAspAlaAspAlaArgThr-184 |
| SEQ. ID. NO. 8609 | 191-AsnArgAlaGlySerGlyIleAspGly-199 |

Hydrophilic Regions - Hopp-Woods

| | |
|---|---|
| SEQ. ID. NO. 8610 | 1-MetAsnArgArgAspAlaArgIleGluArgAlaValArg-13 |
| SEQ. ID. NO. 8611 | 33-GlnArgGlyLysGlnValGlySerArgAsnAspAlaLeuAla-46 |
| SEQ. ID. NO. 8612 | 65-GlyLysLysArgPheValGln-71 |
| SEQ. ID. NO. 8613 | 74-AsnLeuValGlyArgLysGlnArgAsn-82 |
| SEQ. ID. NO. 8614 | 127-GlnGlyValGluGlnGlyCysArgAla-135 |
| SEQ. ID. NO. 8615 | 143-ThrGlyPheAspArgArgLeuLysHisPheLysGluGlyAsnAla-157 |
| SEQ. ID. NO. 8616 | 173-AlaAspThrSerGlyIleAspAlaAspAlaArgThr-184 |

649-2

AMPHI Regions - AMPHI

| | |
|---|---|
| SEQ. ID. NO. 8617 | 8-AlaIleLeuLeuSerAlaIleLeuGlyLeuVal-18 |
| SEQ. ID. NO. 8618 | 32-ArgAspThrLysHisIleArgLysAlaAsn-41 |
| SEQ. ID. NO. 8619 | 62-SerGlnGlyAsnVal-66 |
| SEQ. ID. NO. 8620 | 68-GluLeuArgGluAsnLys-73 |
| SEQ. ID. NO. 8621 | 76-ArgLysAlaPheArgSerLeuPro-83 |

Antigenic Index - Jameson-Wolf

| | |
|---|---|
| SEQ. ID. NO. 8622 | 1-MetSerValLysLys-5 |
| SEQ. ID. NO. 8623 | 25-GlyThrSerGluProAlaHisArgAspThrLysHisIleArgLysAlaAsnLys-42 |
| SEQ. ID. NO. 8624 | 45-LeuHisProGluCysArgLysTyrLeuGluArgArgAlaAla-58 |
| SEQ. ID. NO. 8625 | 61-ArgSerGlnGlyAsnValGlnGluLeuArgGluAsnLysLysAlaArgLysAlaPheArg-80 |
| SEQ. ID. NO. 8626 | 85-AlaGluGlnLysIleGlnCys-91 |
| SEQ. ID. NO. 8627 | 97-AlaPheAspAspPheAspGlyGlySerPheArgArg-108 |

Hydrophilic Regions - Hopp-Woods

| | |
|---|---|
| SEQ. ID. NO. 8628 | 1-MetSerValLysLys-5 |
| SEQ. ID. NO. 8629 | 25-GlyThrSerGluProAlaHisArgAspThrLysHisIleArgLysAlaAsnLys-42 |
| SEQ. ID. NO. 8630 | 47-ProGluCysArgLysTyrLeuGluArgArgAlaAla-58 |
| SEQ. ID. NO. 8631 | 64-GlyAsnValGlnGluLeuArgGluAsnLysLysAlaArgLysAlaPheArg-80 |
| SEQ. ID. NO. 8632 | 85-AlaGluGlnLysIleGlnCys-91 |
| SEQ. ID. NO. 8633 | 97-AlaPheAspAspPheAspGlyGlySerPheArgArg-108 |

650-2

AMPHI Regions - AMPHI

| | |
|---|---|
| SEQ. ID. NO. 8634 | 15-SerValCysProGly-19 |
| SEQ. ID. NO. 8635 | 57-LeuTrpGlyGluLeuArgGln-63 |
| SEQ. ID. NO. 8636 | 72-ProGluLeuValArgArgHisGlu-79 |
| SEQ. ID. NO. 8637 | 89-PheAsnArgValIleAsn-94 |
| SEQ. ID. NO. 8638 | 137-SerGlyLeuTrpGln-141 |

TABLE 1-continued

| | |
|---|---|
| SEQ. ID. NO. 8639 | 173-AsnTyrLeuGlnTyrLeuTyrGlyLeuPheGlyAspTrpPro-186 |
| SEQ. ID. NO. 8640 | 198-AsnValGlyArgAlaIleAsnArgAlaArg-207 |
| SEQ. ID. NO. 8641 | 218-LeuArgMetProAsnGluThr-224 |
| SEQ. ID. NO. 8642 | 269-GluAlaIleAlaArgLeuAlaGlyIleThrGlnSer-280 |
| SEQ. ID. NO. 8643 | 314-SerAsnTyrLeuAsnAlaAlaProAsp-322 |
| SEQ. ID. NO. 8644 | 341-IleSerThrAlaThrGlyMet-347 |
| SEQ. ID. NO. 8645 | 349-IleAlaAspIleLysArgLeuAsnAsnLeu-358 |
| SEQ. ID. NO. 8646 | 376-LysThrLeuGlnThrAlaSerGlu-383 |
| SEQ. ID. NO. 8647 | 484-AlaAspGluLeuMetGln-489 |
| SEQ. ID. NO. 8648 | 496-LeuArgArgGlnAlaGlu-501 |
| SEQ. ID. NO. 8649 | 503-ThrIleSerAlaValIleGlyThrProAspThrValAlaGlu-516 |
| SEQ. ID. NO. 8650 | 556-AlaSerIleHisArgValVal-562 |
| SEQ. ID. NO. 8651 | 621-AspThrPheLysSerIle-626 |
| SEQ. ID. NO. 8652 | 636-AspIleArgArgLeu-640 |
| Antigenic Index - Jameson-Wolf | |
| SEQ. ID. NO. 8653 | 1-MetSerLysLeuLys-5 |
| SEQ. ID. NO. 8654 | 24-GlnAsnThrSerSerHis-29 |
| SEQ. ID. NO. 8655 | 38-LeuAsnSerSerIleLeuAspLeuProProThrLysGlnTyrPhe-52 |
| SEQ. ID. NO. 8656 | 59-GlyGluLeuArgGlnGlyPheArgMetGlyGluValAsnProGluLeuValArgArgHisGluSerLysPhe-82 |
| SEQ. ID. NO. 8657 | 92-ValIleAsnArgSerArgProTyr-99 |
| SEQ. ID. NO. 8658 | 105-AsnGluValLysLysArgAsnMetProAla-114 |
| SEQ. ID. NO. 8659 | 128-ThrLysAlaLysSerHisValGlyAlaSerGly-138 |
| SEQ. ID. NO. 8660 | 145-AlaThrGlyArgHisTyrGlyLeuGluLysThrProValTyrAspGlyArgHisAspVal-164 |
| SEQ. ID. NO. 8661 | 192-TyrAsnTrpGlyGluGlyAsnValGlyArgAlaIleAsnArgAlaArgAlaGlnGlyLeuGluProThrTyrGluAsnLeuArgMetProAsnGluThrArgAsnTyrVal-228 |
| SEQ. ID. NO. 8662 | 247-AsnIleSerAspIleAspAsnLysProTyr-256 |
| SEQ. ID. NO. 8663 | 259-AlaValGluProAspArgProLeuAspAsnGluAlaIleAla-272 |
| SEQ. ID. NO. 8664 | 296-ProLysSerLysArgLysLeu-302 |
| SEQ. ID. NO. 8665 | 318-AsnAlaAlaProAspSer-323 |
| SEQ. ID. NO. 8666 | 332-ProAlaAlaLysThrSerLeuSerAspIleSerThr-343 |
| SEQ. ID. NO. 8667 | 350-AlaAspIleLysArgLeuAsnAsnLeuAsnGly-360 |
| SEQ. ID. NO. 8668 | 370-LeuValAlaLysAsnGlyLysThrLeuGlnThrAlaSer-382 |
| SEQ. ID. NO. 8669 | 388-IleAspIleAspAsnThrProAspThrTyrArgSerAsnMetProAla-403 |
| SEQ. ID. NO. 8670 | 411-AlaArgIleArgPro-415 |
| SEQ. ID. NO. 8671 | 428-LeuProGlnLysThrValArgThrGluProAspProLeuValArgIleAlaGlu-445 |
| SEQ. ID. NO. 8672 | 454-GlnProGlnThrGluLysGlnThrAlaMetProSerGluThrGln-468 |
| SEQ. ID. NO. 8673 | 477-ProGlnAsnAspMetGlnAlaAlaAspGluLeu-487 |
| SEQ. ID. NO. 8674 | 491-ValAlaArgAsnAsnLeuArgArgGlnAlaGluGluThrIle-504 |
| SEQ. ID. NO. 8675 | 509-GlyThrProAspThrValAlaGluHisLysIleSerAlaSerProGln-524 |
| SEQ. ID. NO. 8676 | 527-AlaAlaAlaAspGlyLysArgArgValArgLeuGluThrArgValAlaLysAlaAlaAspGlyGluAlaGluIle-551 |
| SEQ. ID. NO. 8677 | 560-ArgValValGluGlyAspThr-566 |
| SEQ. ID. NO. 8678 | 583-ValAlaAsnAsnIleLysGlyAsnThrIleGlnLysGlyGlnValLeuArg-599 |
| SEQ. ID. NO. 8679 | 606-AlaGlnThrArgIleGluLysValSerTyrThrAlaArgLysGlyAspThrPheLys-624 |
| SEQ. ID. NO. 8680 | 634-IleAspAspIleArgArgLeuAsnProAsnLeu-644 |
| SEQ. ID. NO. 8681 | 647-IleAsnProGlyGlnArgValLysLeu-655 |
| Hydrophilic Regions - Hopp-Woods | |
| SEQ. ID. NO. 8682 | 1-MetSerLysLeuLys-5 |
| SEQ. ID. NO. 8683 | 61-LeuArgGlnGlyPheArgMetGlyGluValAsnProGluLeuValArgArgHisGluSerLysPhe-82 |
| SEQ. ID. NO. 8684 | 92-ValIleAsnArgSerArgPro-98 |
| SEQ. ID. NO. 8685 | 105-AsnGluValLysLysArgAsnMetProAla-114 |
| SEQ. ID. NO. 8686 | 128-ThrLysAlaLysSerHisVal-134 |
| SEQ. ID. NO. 8687 | 150-TyrGlyLeuGluLys-154 |
| SEQ. ID. NO. 8688 | 156-ProValTyrAspGlyArgHisAspVal-164 |
| SEQ. ID. NO. 8689 | 202-AlaIleAsnArgAlaArgAlaGlnGlyLeu-211 |
| SEQ. ID. NO. 8690 | 213-ProThrTyrGluAsnLeuArgMetProAsnGluThrArgAsnTyrVal-228 |
| SEQ. ID. NO. 8691 | 249-SerAspIleAspAsn-253 |
| SEQ. ID. NO. 8692 | 260-ValGluProAspArgProLeuAspAsnGluAlaIleAla-272 |
| SEQ. ID. NO. 8693 | 296-ProLysSerLysArgLysLeu-302 |
| SEQ. ID. NO. 8694 | 334-AlaLysThrSerLeu-338 |
| SEQ. ID. NO. 8695 | 350-AlaAspIleLysArgLeuAsn-356 |
| SEQ. ID. NO. 8696 | 373-LysAsnGlyLysThrLeuGlnThrAlaSer-382 |
| SEQ. ID. NO. 8697 | 389-AspIleAspAsnThrProAspThrTyrArg-398 |
| SEQ. ID. NO. 8698 | 411-AlaArgIleArgPro-415 |
| SEQ. ID. NO. 8699 | 431-LysThrValArgThrGluProAspProLeuValArgIleAlaGlu-445 |
| SEQ. ID. NO. 8700 | 455-ProGlnThrGluLysGlnThrAlaMetProSerGluThrGln-468 |
| SEQ. ID. NO. 8701 | 479-AsnAspMetGlnAlaAlaAspGluLeu-487 |
| SEQ. ID. NO. 8702 | 494-AsnAsnLeuArgArgGlnAlaGluGluThrIle-504 |
| SEQ. ID. NO. 8703 | 512-AspThrValAlaGluHisLysIleSerAla-521 |
| SEQ. ID. NO. 8704 | 527-AlaAlaAlaAspGlyLysArgArgValArgLeuGluThrArgValAlaLysAlaAlaAspGlyGluAlaGluIle-551 |
| SEQ. ID. NO. 8705 | 560-ArgValValGluGly-564 |
| SEQ. ID. NO. 8706 | 608-ThrArgIleGluLysValSerTyrThrAlaArgLysGlyAspThrPheLys-624 |
| SEQ. ID. NO. 8707 | 634-IleAspAspIleArgArgLeuAsn-641 |
| SEQ. ID. NO. 8708 | 649-ProGlyGlnArgValLysLeu-655 |
| 652-1 | |
| AMPHI Regions - AMPHI | |
| SEQ. ID. NO. 8709 | 6-AspIlePheAlaArg-10 |
| SEQ. ID. NO. 8710 | 52-ArgAspGlyAspLys-56 |
| SEQ. ID. NO. 8711 | 62-LysGlyValLeuLysAlaValGluHisValAsnAsnGlnIleAlaGlnAla-78 |
| SEQ. ID. NO. 8712 | 130-LeuTyrArgTyrLeuGlyGlyAlaGlyPro-139 |
| SEQ. ID. NO. 8713 | 149-ValIleAsnGlyGly-153 |

TABLE 1-continued

| | |
|---|---|
| SEQ. ID. NO. 8714 | 173-LysSerPheArgGluAlaLeuArgCys-181 |
| SEQ. ID. NO. 8715 | 184-GluIlePheHisAlaLeuLysLys-191 |
| SEQ. ID. NO. 8716 | 266-AlaGluPheAlaGluTyrLeuGluGlyLeuValAsn-277 |
| SEQ. ID. NO. 8717 | 323-AlaGluGlyIleGluLysGlyVal-330 |
| SEQ. ID. NO. 8718 | 338-ValAsnGlnIleGlyThrLeuSerGluThrLeuLysAlaValAspLeuAlaLys-355 |
| SEQ. ID. NO. 8719 | 377-AspLeuAlaValAla-381 |
| SEQ. ID. NO. 8720 | 391-SerLeuSerArgSerAspArgMetAlaLysTyrAsnGlnLeuLeuArgIleGluGlu-409 |
| SEQ. ID. NO. 8721 | 411-LeuAlaGluAlaAlaAspTyr-417 |
| Antigenic Index - Jameson-Wolf | |
| SEQ. ID. NO. 8722 | 11-GluIleLeuAspSerArgGlyAsnProThrValGlu-22 |
| SEQ. ID. NO. 8723 | 36-AlaValProSerGlyAlaSerThrGlyGlnLysGluAlaLeuGluLeuArgAspGlyAspLysSerArgTyrSerGlyLysGlyValLeuLysAlaValGluHisValAsn-72 |
| SEQ. ID. NO. 8724 | 83-AspAlaAsnGluGlnSerTyr-89 |
| SEQ. ID. NO. 8725 | 97-LeuAspGlyThrGluAsnLysGlyAsnLeuGly-107 |
| SEQ. ID. NO. 8726 | 121-AlaAlaAlaGluAspSerGlyLeuPro-129 |
| SEQ. ID. NO. 8727 | 135-GlyGlyAlaGlyProMet-140 |
| SEQ. ID. NO. 8728 | 151-AsnGlyGlyGluHisAlaAsnAsnSer-159 |
| SEQ. ID. NO. 8729 | 173-LysSerPheArgGluAlaLeuArgCysGlyAla-183 |
| SEQ. ID. NO. 8730 | 190-LysLysLeuCysAspSerLysGlyPheProThrThrValGlyAspGluGlyGlyPhe-208 |
| SEQ. ID. NO. 8731 | 211-AsnLeuAsnSerHisLysGluAlaLeu-219 |
| SEQ. ID. NO. 8732 | 243-CysAlaSerSerGluPheTyrLysAspGlyLysTyrHisLeuGluAlaGluGlyArgSerTyrThrAsn-265 |
| SEQ. ID. NO. 8733 | 283-SerIleGluAspGlyMetAspGluAsnAspTrpGluGly-295 |
| SEQ. ID. NO. 8734 | 299-LeuThrGluLysLeuGlyGlyArgValGlnLeuValGlyAspAspLeu-314 |
| SEQ. ID. NO. 8735 | 318-AsnProLysIleLeuAlaGluGlyIleGluLysGlyVal-330 |
| SEQ. ID. NO. 8736 | 352-AspLeuAlaLysArgAsnArgTyrAla-360 |
| SEQ. ID. NO. 8737 | 363-MetSerHisArgSerGlyGluThrGluAspSerThrIle-375 |
| SEQ. ID. NO. 8738 | 388-LysThrGlySerLeuSerArgSerAspArgMetAlaLys-400 |
| SEQ. ID. NO. 8739 | 405-LeuArgIleGluGluGluLeuAlaGluAlaAlaAspTyrProSerLys-420 |
| Hydrophilic Regions - Hopp-Woods | |
| SEQ. ID. NO. 8740 | 11-GluIleLeuAspSerArgGlyAsnProThrValGlu-22 |
| SEQ. ID. NO. 8741 | 43-ThrGlyGlnLysGluAlaLeuGluLeuArgAspGlyAspLysSerArgTyrSerGly-61 |
| SEQ. ID. NO. 8742 | 63-GlyValLeuLysAlaValGlu-69 |
| SEQ. ID. NO. 8743 | 97-LeuAspGlyThrGluAsnLysGlyAsnLeu-106 |
| SEQ. ID. NO. 8744 | 121-AlaAlaAlaGluAspSerGly-127 |
| SEQ. ID. NO. 8745 | 153-GlyGluHisAlaAsn-157 |
| SEQ. ID. NO. 8746 | 173-LysSerPheArgGluAlaLeuArgCysGlyAla-183 |
| SEQ. ID. NO. 8747 | 190-LysLysLeuCysAspSerLysGly-197 |
| SEQ. ID. NO. 8748 | 202-ValGlyAspGluGlyGlyPhe-208 |
| SEQ. ID. NO. 8749 | 213-AsnSerHisLysGluAlaLeu-219 |
| SEQ. ID. NO. 8750 | 247-GluPheTyrLysAspGlyLysTyrHisLeuGluAlaGluGlyArgSerTyrThr-264 |
| SEQ. ID. NO. 8751 | 283-SerIleGluAspGlyMetAspGluAsnAspTrpGluGly-295 |
| SEQ. ID. NO. 8752 | 299-LeuThrGluLysLeuGlyGly-305 |
| SEQ. ID. NO. 8753 | 321-IleLeuAlaGluGlyIleGluLysGlyVal-330 |
| SEQ. ID. NO. 8754 | 352-AspLeuAlaLysArgAsnArgTyr-359 |
| SEQ. ID. NO. 8755 | 364-SerHisArgSerGlyGluThrGluAspSerThrIle-375 |
| SEQ. ID. NO. 8756 | 391-SerLeuSerArgSerAspArgMetAlaLys-400 |
| SEQ. ID. NO. 8757 | 405-LeuArgIleGluGluGluLeuAlaGluAlaAlaAspTyrProSer-419 |
| 653 | |
| AMPHI Regions - AMPHI | |
| SEQ. ID. NO. 8758 | 6-MetArgMetProGluValThrLysGlyPheSerGlySer-18 |
| SEQ. ID. NO. 8759 | 60-ThrMetArgLysProArgLeuThr-67 |
| SEQ. ID. NO. 8760 | 75-AlaLeuIlePheThrCysPheAla-82 |
| SEQ. ID. NO. 8761 | 96-ThrAlaLeuAlaAlaIleThrCysIle-104 |
| SEQ. ID. NO. 8762 | 111-LeuGlyLysMetGluGluPheAsn-118 |
| Antigenic Index - Jameson-Wolf | |
| SEQ. ID. NO. 8763 | 4-GluProMetArgMetProGluValThrLysGlyPheSerGlySer-18 |
| SEQ. ID. NO. 8764 | 45-GlyCysArgSerThrArgLysThr-52 |
| SEQ. ID. NO. 8765 | 56-ValArgProGluThrMetArgLysProArgLeuThrAsnSerSerAla-71 |
| SEQ. ID. NO. 8766 | 86-AsnSerGlyCysAsnAla-91 |
| SEQ. ID. NO. 8767 | 103-CysIleSerGlyProProCysArgLeuGlyLysMetGluGlu-116 |
| SEQ. ID. NO. 8768 | 125-SerArgHisLysIleThrProProArgGlyProArgArgVal-138 |
| SEQ. ID. NO. 8769 | 145-ThrLysSerGlnAsnGlyThrGly-152 |
| SEQ. ID. NO. 8770 | 154-GlyTyrSerProProAlaThrArgProAla-163 |
| Hydrophilic Regions - Hopp-Woods | |
| SEQ. ID. NO. 8771 | 4-GluProMetArgMetProGluValThrLys-13 |
| SEQ. ID. NO. 8772 | 47-ArgSerThrArgLysThr-52 |
| SEQ. ID. NO. 8773 | 57-ArgProGluThrMetArgLysProArgLeuThrAsn-68 |
| SEQ. ID. NO. 8774 | 107-ProProCysArgLeuGlyLysMetGluGlu-116 |
| SEQ. ID. NO. 8775 | 126-ArgHisLysIleThrProProArgGlyProArg-136 |
| SEQ. ID. NO. 8776 | 158-ProAlaThrArgProAla-163 |
| 656 | |
| AMPHI Regions - AMPHI | |
| SEQ. ID. NO. 8777 | 14-MetAlaArgThrLeuGlyAlaProGlu-22 |
| SEQ. ID. NO. 8778 | 42-ArgArgProSerThr-46 |
| SEQ. ID. NO. 8779 | 92-LeuAlaSerLeuAsnLysSerCys-99 |
| SEQ. ID. NO. 8780 | 117-MetGlyArgThrIleThr-122 |
| Antigenic Index - Jameson-Wolf | |
| SEQ. ID. NO. 8781 | 6-GlySerThrSerSer-10 |
| SEQ. ID. NO. 8782 | 19-GlyAlaProGluSerValProAlaGlyLysValAlaAla-31 |
| SEQ. ID. NO. 8783 | 40-SerPheArgArgProSerThrLeuGlu-48 |

TABLE 1-continued

SEQ. ID. NO. 8784   74-ArgProThrSerLeuArgProLysSerIleAsn-84
SEQ. ID. NO. 8785   94-SerLeuAsnLysSerCysSerLeuAlaArgSerSerAlaGlyValLeuProArgArgArgValProAla-116
SEQ. ID. NO. 8786   122-ThrSerLeuArgSerArgArgThrArgIleSerGlyGluGluProThrMetTrpLysSerProLysSer-144
Hydrophilic Regions - Hopp-Woods
SEQ. ID. NO. 8787   40-SerPheArgArgProSerThr-46
SEQ. ID. NO. 8788   76-ThrSerLeuArgProLysSerIle-83
SEQ. ID. NO. 8789   99-CysSerLeuAlaArgSerSer-105
SEQ. ID. NO. 8790   109-LeuProArgArgArgValProAla-116
SEQ. ID. NO. 8791   124-LeuArgSerArgArgThrArgIleSerGlyGluGluProThrMet-138
SEQ. ID. NO. 8792   140-LysSerProLysSer-144
657
AMPHI Regions - AMPHI
SEQ. ID. NO. 8793   9-ProAlaMetLeuGly-13
SEQ. ID. NO. 8794   20-LeuGlyArgMetPheThr-25
SEQ. ID. NO. 8795   62-AlaAlaLeuAspGluLeuAlaLysCysAlaAla-72
SEQ. ID. NO. 8796   85-MetArgPheLeuAlaLys-90
SEQ. ID. NO. 8797   132-AspIleThrGluAlaSer-137
SEQ. ID. NO. 8798   139-GlnPheLeuProGlyIleLeuLysThr-147
SEQ. ID. NO. 8799   161-LysThrLeuAspGluLeuLysAlaAla-169
SEQ. ID. NO. 8800   178-CysValLeuGluLysMetValAspLeu-186
SEQ. ID. NO. 8801   203-GlnThrPheAspProAlaGluAsnIle-211
SEQ. ID. NO. 8802   232-GlnGlnAlaArgGlnMetAlaGlnArgLeuAlaAspGluLeuAspTyrValGlyValLeu-251
SEQ. ID. NO. 8803   314-AsnIleLeuGlyAsp-318
Antigenic Index - Jameson-Wolf
SEQ. ID. NO. 8804   16-GlyGlyGlyGlnLeuGly-21
SEQ. ID. NO. 8805   37-ValLeuAspProAspProAspAlaProAla-46
SEQ. ID. NO. 8806   62-AlaAlaLeuAspGluLeuAlaLys-69
SEQ. ID. NO. 8807   75-ThrGluPheGluAsnValAsnAlaAspAla-84
SEQ. ID. NO. 8808   91-HisThrAsnValSerProSerGlyAsp-99
SEQ. ID. NO. 8809   106-AsnArgIleGlnGluLysAlaTrpIle-114
SEQ. ID. NO. 8810   128-CysLysAlaGluAspIleThrGluAla-136
SEQ. ID. NO. 8811   150-LeuGlyTyrAspGlyLysGlyGlnIleArgValLysThrLeuAspGluLeuLysAlaAlaPhe-170
SEQ. ID. NO. 8812   182-LysMetValAspLeuArgSerGluIle-190
SEQ. ID. NO. 8813   197-LeuAsnAsnAspAsnValGlnThrPheAspProAlaGluAsnIleHisGluAsnGly-215
SEQ. ID. NO. 8814   230-ValGlnGlnGlnAlaArgGlnMetAla-238
SEQ. ID. NO. 8815   240-ArgLeuAlaAspGluLeuAsp-246
SEQ. ID. NO. 8816   269-IleAlaProArgProHisAsnSerGlyHisHis-279
SEQ. ID. NO. 8817   288-GlnPheGlnGlnGln-292
SEQ. ID. NO. 8818   300-ProProAlaAspThrLysLeuLeuSer-308
SEQ. ID. NO. 8819   319-ValTrpGlnGluAspGlyGlyGluProAspTrp-329
SEQ. ID. NO. 8820   333-GlnSerHisProAsnAla-338
SEQ. ID. NO. 8821   344-GlyLysLysThrAlaHisLysGlyArgLysMetGly-355
SEQ. ID. NO. 8822   361-ThrThrAspSerAspThrAlaPheGlnGluAlaLysLysLeuHis-375
Hydrophilic Regions - Hopp-Woods
SEQ. ID. NO. 8823   37-ValLeuAspProAspProAspAlaProAla-46
SEQ. ID. NO. 8824   62-AlaAlaLeuAspGluLeuAlaLys-69
SEQ. ID. NO. 8825   75-ThrGluPheGluAsnValAsn-81
SEQ. ID. NO. 8826   128-CysLysAlaGluAspIleThrGluAla-136
SEQ. ID. NO. 8827   152-TyrAspGlyLysGlyGlnIleArgValLysThrLeuAspGluLeuLysAlaAlaPhe-170
SEQ. ID. NO. 8828   182-LysMetValAspLeuArgSerGluIle-190
SEQ. ID. NO. 8829   197-LeuAsnAsnAspAsn-201
SEQ. ID. NO. 8830   206-AspProAlaGluAsnIleHis-212
SEQ. ID. NO. 8831   230-ValGlnGlnGlnAlaArgGlnMetAla-238
SEQ. ID. NO. 8832   240-ArgLeuAlaAspGluLeuAsp-246
SEQ. ID. NO. 8833   269-IleAlaProArgProHisAsn-275
SEQ. ID. NO. 8834   301-ProAlaAspThrLysLeu-306
SEQ. ID. NO. 8835   320-TrpGlnGluAspGlyGlyGluProAsp-328
SEQ. ID. NO. 8836   344-GlyLysLysThrAlaHisLysGlyArgLysMetGly-355
SEQ. ID. NO. 8837   362-ThrAspSerAspThrAlaPheGlnGluAlaLysLysLeuHis-375
658
AMPHI Regions - AMPHI
SEQ. ID. NO. 8838   28-ArgGlnTyrAlaAspIleIleGlnPheValArgGlnAlaLeuArgHisLeuProArgLeuLeuLeu-49
SEQ. ID. NO. 8839   68-ValAspValPheGlyArgValGluSer-76
SEQ. ID. NO. 8840   92-ThrAlaGlnIleHisHisPhePheGlnAsnAlaIleHisAla-105
SEQ. ID. NO. 8841   139-GlnLysLeuArgAlaCysPheSerAspValPheSer-150
Antigenic Index - Jameson-Wolf
SEQ. ID. NO. 8842   6-ValArgAlaArgGlyAspPheValAspAspGlnPheMetArgValThrAspAsnLysHisPhe-26
SEQ. ID. NO. 8843   40-AlaLeuArgHisLeuPro-45
SEQ. ID. NO. 8844   53-ThrGlnSerArgGlyAspAspGlyIleSerGlnAspAlaVal-66
SEQ. ID. NO. 8845   72-GlyArgValGluSer-76
SEQ. ID. NO. 8846   107-ValPheGlyLysArgGlyPheGlu-114
SEQ. ID. NO. 8847   130-GlnArgSerArgPheGlnAspAlaGlyGlnLysLeuArgAlaCysPhe-145
SEQ. ID. NO. 8848   155-LeuIleArgArgGlyLeuGlnSerArgPhe-164
SEQ. ID. NO. 8849   177-AsnArgHisThrIleAlaAlaArgGlyAsnIle-187
SEQ. ID. NO. 8850   193-LysAlaHisArgIleGly-198
SEQ. ID. NO. 8851   202-PheLysPheSerGlyHisArgArgAla-210
SEQ. ID. NO. 8852   219-LeuValValLysArgArgAlaGln-226
SEQ. ID. NO. 8853   230-GlyLysPheCysCysArgArgValArgIleGlyValGluAsn-243
SEQ. ID. NO. 8854   250-GlyPheGlyGlyAsnGlyLysHisSerAla-259

TABLE 1-continued

Hydrophilic Regions - Hopp-Woods
SEQ. ID. NO. 8855   6-ValArgAlaArgGlyAspPheValAsp-14
SEQ. ID. NO. 8856   16-GlnPheMetArgValThrAspAsnLysHisPhe-26
SEQ. ID. NO. 8857   53-ThrGlnSerArgGlyAspAspGlyIleSer-62
SEQ. ID. NO. 8858   72-GlyArgValGluSer-76
SEQ. ID. NO. 8859   130-GlnArgSerArgPheGlnAspAlaGlyGlnLysLeuArgAlaCysPhe-145
SEQ. ID. NO. 8860   155-LeuIleArgArgGlyLeuGln-161
SEQ. ID. NO. 8861   193-LysAlaHisArgIleGly-198
SEQ. ID. NO. 8862   205-SerGlyHisArgArgAla-210
SEQ. ID. NO. 8863   220-ValValLysArgArgAlaGln-226
SEQ. ID. NO. 8864   233-CysCysArgArgValArgIleGlyVal-241
SEQ. ID. NO. 8865   253-GlyAsnGlyLysHisSerAla-259
661-2
AMPHI Regions - AMPHI
SEQ. ID. NO. 8866   19-GlyIleThrAspLysProPheArgArgLeuCysArgAspPheGlyAlaGly-35
SEQ. ID. NO. 8867   37-AlaValCysGluMetLeu-42
SEQ. ID. NO. 8868   75-AspProGlnGlnMetAlaAspAlaAla-83
SEQ. ID. NO. 8869   122-AlaAlaIleLeuGluAlaValValArg-130
SEQ. ID. NO. 8870   152-ProValIleAlaLysIleAlaGlu-159
SEQ. ID. NO. 8871   256-AlaAlaAlaIleLeuAsnHisIleArgAlaIleHisAlaPheTyrGly-271
SEQ. ID. NO. 8872   297-ArgArgGluIleAsnArgLeuAspSer-305
SEQ. ID. NO. 8873   310-TyrAspMetLeuAlaGlyTyrLeuGluArgLeuAlaGluLys-323
Antigenic Index - Jameson-Wolf
SEQ. ID. NO. 8874   20-IleThrAspLysProPheArgArgLeuCysArgAspPheGlyAlaGly-35
SEQ. ID. NO. 8875   42-LeuThrSerAspProThrLeuArgAsnThrArgLysThrLeuHisArgSerAspPheAlaAspGluGlyGly-65
SEQ. ID. NO. 8876   72-AlaGlySerAspProGlnGlnMetAlaAspAlaAlaArg-84
SEQ. ID. NO. 8877   97-AsnMetGlyCysProAlaLysLysValCys-106
SEQ. ID. NO. 8878   143-GlyTrpHisAspAspHisGlnAsnLeu-151
SEQ. ID. NO. 8879   157-IleAlaGluAspCysGly-162
SEQ. ID. NO. 8880   169-HisGlyArgThrArgThrGlnMetTyrLysGlyGluAlaArgTyr-183
SEQ. ID. NO. 8881   187-AlaGluThrLysCysArgLeu-193
SEQ. ID. NO. 8882   200-AsnGlyAspIleThrSerProGlnLysAla-209
SEQ. ID. NO. 8883   222-MetIleGlyArgGlyAlaGlnGlyArgProTrpPhe-233
SEQ. ID. NO. 8884   236-AspLeuLysHisTyrAla-241
SEQ. ID. NO. 8885   270-TyrGlyAspThrAlaGly-275
SEQ. ID. NO. 8886   277-ArgIleAlaArgLysHis-282
SEQ. ID. NO. 8887   288-AspGluMetProAspGlyGluGlnThrArgArgGluIleAsnArgLeuAspSerAla-306
SEQ. ID. NO. 8888   319-ArgLeuAlaGluLysThrAspSerTrp-327
SEQ. ID. NO. 8889   330-AlaTyrArgProAsnAla-335
Hydrophilic Regions - Hopp-Woods
SEQ. ID. NO. 8890   20-IleThrAspLysProPheArgArgLeuCysArgAspPhe-32
SEQ. ID. NO. 8891   46-ProThrLeuArgAsnThrArgLysThrLeuHisArgSerAspPheAlaAspGluGlyGly-65
SEQ. ID. NO. 8892   73-GlySerAspProGlnGlnMetAlaAspAlaAlaArg-84
SEQ. ID. NO. 8893   100-CysProAlaLysLysValCys-106
SEQ. ID. NO. 8894   157-IleAlaGluAspCysGly-162
SEQ. ID. NO. 8895   170-GlyArgThrArgThrGlnMetTyrLysGlyGluAlaArgTyr-183
SEQ. ID. NO. 8896   187-AlaGluThrLysCysArgLeu-193
SEQ. ID. NO. 8897   203-IleThrSerProGlnLysAla-209
SEQ. ID. NO. 8898   236-AspLeuLysHisTyrAla-241
SEQ. ID. NO. 8899   277-ArgIleAlaArgLys-281
SEQ. ID. NO. 8900   289-GluMetProAspGlyGluGlnThrArgArgGluIleAsnArgLeuAspSerAla-306
SEQ. ID. NO. 8901   319-ArgLeuAlaGluLysThrAspSer-326
663
AMPHI Regions - AMPHI
SEQ. ID. NO. 8902   19-ProPheAlaLeuLeuHisLysIleAlaAspLeuThrGlyLeuLeuAlaTyr-35
SEQ. ID. NO. 8903   47-IleAsnLeuAlaLysCysPheSerGluTrp-56
SEQ. ID. NO. 8904   66-LysGlnHisPheLysHisMetAlaLysLeu-75
SEQ. ID. NO. 8905   87-AlaGlyArgLeuLysSerLeuValArg-95
SEQ. ID. NO. 8906   168-GluGlyLeuArgAlaLeuValLysGlnPheArgLys-179
SEQ. ID. NO. 8907   209-ThrIleThrGlyLeuSerArgIleAlaAlaLeuAlaAsn-221
SEQ. ID. NO. 8908   243-ProAlaTrpLysSer-247
SEQ. ID. NO. 8909   258-GlnArgMetAsnArgPheIleGluAspArgValArgGluHis-271
Antigenic Index - Jameson-Wolf
SEQ. ID. NO. 8910   38-ValLysProArgArgArgIleGlyGlu-46
SEQ. ID. NO. 8911   56-TrpSerGluGluLysArgLysThrValLeu-65
SEQ. ID. NO. 8912   87-AlaGlyArgLeuLysSer-92
SEQ. ID. NO. 8913   94-ValArgTyrArgAsnLysHisTyrLeuAsp-103
SEQ. ID. NO. 8914   105-AlaLeuAlaAlaGlyGluLys-111
SEQ. ID. NO. 8915   139-TyrSerHisGlnLysAsnLysIleLeuAsp-148
SEQ. ID. NO. 8916   150-GlnIleLeuLysGlyArgAsnArgTyr-158
SEQ. ID. NO. 8917   166-ArgThrGluGlyLeuArgAlaLeu-173
SEQ. ID. NO. 8918   175-LysGlnPheArgLysSerSerAla-182
SEQ. ID. NO. 8919   188-ProAspGlnAspPheGlyArgAsnAspSerVal-198
SEQ. ID. NO. 8920   229-ProValArgGluAlaAspAsnThr-236
SEQ. ID. NO. 8921   243-ProAlaTrpLysSerPheProGlyGluAspAlaLysAlaAspAlaGlnArgMetAsnArgPheIleGluAspArgValArgGluHisProGlu-273
SEQ. ID. NO. 8922   280-LysArgPheLysThrArgProGluGlySerProAspPheTyr-293
Hydrophilic Regions - Hopp-Woods
SEQ. ID. NO. 8923   39-LysProArgArgArgIleGlyGlu-46
SEQ. ID. NO. 8924   56-TrpSerGluGluLysArgLysThrValLeu-65
SEQ. ID. NO. 8925   88-GlyArgLeuLysSer-92

TABLE 1-continued

| | |
|---|---|
| SEQ. ID. NO. 8926 | 94-ValArgTyrArgAsn-98 |
| SEQ. ID. NO. 8927 | 105-AlaLeuAlaAlaGlyGluLys-111 |
| SEQ. ID. NO. 8928 | 142-GlnLysAsnLysIleLeuAsp-148 |
| SEQ. ID. NO. 8929 | 150-GlnIleLeuLysGlyArgAsnArgTyr-158 |
| SEQ. ID. NO. 8930 | 166-ArgThrGluGlyLeuArgAlaLeu-173 |
| SEQ. ID. NO. 8931 | 176-GlnPheArgLysSerSer-181 |
| SEQ. ID. NO. 8932 | 190-GlnAspPheGlyArgAsnAspSerVal-198 |
| SEQ. ID. NO. 8933 | 229-ProValArgGluAlaAspAsn-235 |
| SEQ. ID. NO. 8934 | 248-PheProGlyGluAspAlaLysAlaAspAlaGlnArgMetAsnArgPheIleGluAspArgValArgGluHisProGlu-273 |
| SEQ. ID. NO. 8935 | 280-LysArgPheLysThrArgProGluGlySerPro-290 |
| 664-2 | |
| AMPHI Regions - AMPHI | |
| SEQ. ID. NO. 8936 | 47-AlaAspValPheAspAlaAlaHisGlyAlaAlaGly-58 |
| SEQ. ID. NO. 8937 | 90-ProValValGluIle-94 |
| SEQ. ID. NO. 8938 | 158-PheHisArgValPheGlnArgPhe-165 |
| SEQ. ID. NO. 8939 | 201-AlaArgAspGlnSerLysGlnIleAlaArgPheGlyLysArg-214 |
| Antigenic Index - Jameson-Wolf | |
| SEQ. ID. NO. 8940 | 27-GlyAlaHisArgMetGlyGlyArgAlaCysVal-37 |
| SEQ. ID. NO. 8941 | 73-PheLeuGlnArgLysLeuGluPro-80 |
| SEQ. ID. NO. 8942 | 108-IleGlyGlyGlyAlaAlaValGlyLysAspGluLeuGlyValLysAspValGln-125 |
| SEQ. ID. NO. 8943 | 137-AlaHisGlyAspAspHisGluAsn-144 |
| SEQ. ID. NO. 8944 | 165-PheHisGlyLysAlaAspLeuGly-172 |
| SEQ. ID. NO. 8945 | 177-GlyGlyValLysLeuAspPhe-183 |
| SEQ. ID. NO. 8946 | 199-GlnIleAlaArgAspGlnSerLysGlnIleAlaArgPheGlyLysArgValPhe-216 |
| Hydrophilic Regions - Hopp-Woods | |
| SEQ. ID. NO. 8947 | 28-AlaHisArgMetGlyGly-33 |
| SEQ. ID. NO. 8948 | 74-LeuGlnArgLysLeuGluPro-80 |
| SEQ. ID. NO. 8949 | 113-AlaValGlyLysAspGluLeuGlyValLysAspValGln-125 |
| SEQ. ID. NO. 8950 | 137-AlaHisGlyAspAspHisGluAsn-144 |
| SEQ. ID. NO. 8951 | 165-PheHisGlyLysAlaAspLeuGly-172 |
| SEQ. ID. NO. 8952 | 177-GlyGlyValLysLeuAspPhe-183 |
| SEQ. ID. NO. 8953 | 199-GlnIleAlaArgAspGlnSerLysGlnIleAlaArgPheGlyLys-213 |
| 665-1 | |
| Hydrophilic Regions - Hopp-Woods | |
| SEQ. ID. NO. 8954 | 39-LysProArgArgArgIleGlyGlu-46 |
| SEQ. ID. NO. 8955 | 56-TrpSerGluGluLysArgLysThrValLeu-65 |
| SEQ. ID. NO. 8956 | 88-GlyArgLeuLysSer-92 |
| SEQ. ID. NO. 8957 | 94-ValArgTyrArgAsn-98 |
| SEQ. ID. NO. 8958 | 105-AlaLeuAlaAlaGlyGluLys-111 |
| SEQ. ID. NO. 8959 | 142-GlnLysAsnLysIleLeuAsp-148 |
| SEQ. ID. NO. 8960 | 150-GlnIleLeuLysGlyArgAsnArgTyr-158 |
| SEQ. ID. NO. 8961 | 166-ArgThrGluGlyLeuArgAlaLeu-173 |
| SEQ. ID. NO. 8962 | 176-GlnPheArgLysSerSer-181 |
| SEQ. ID. NO. 8963 | 190-GlnAspPheGlyArgAsnAspSerVal-198 |
| SEQ. ID. NO. 8964 | 229-ProValArgGluAlaAspAsn-235 |
| SEQ. ID. NO. 8965 | 248-PheProGlyGluAspAlaLysAlaAspAlaGlnArgMetAsnArgPheIleGluAspArgValArgGluHisProGlu-273 |
| SEQ. ID. NO. 8966 | 280-LysArgPheLysThrArgProGluGlySerPro-290 |
| Antigenic Index - Jameson-Wolf | |
| SEQ. ID. NO. 8967 | 8-LeuLysAspTyrGlnThrProAlaTyr-16 |
| SEQ. ID. NO. 8968 | 26-AspIleAsnGluPro-30 |
| SEQ. ID. NO. 8969 | 32-ThrValValLysSerArgLeuThrValGluProGlnArgValGlyGlu-47 |
| SEQ. ID. NO. 8970 | 49-LeuValLeuAspGlySerAla-55 |
| SEQ. ID. NO. 8971 | 80-GlyValProSerGluArgPheThrVal-88 |
| SEQ. ID. NO. 8972 | 90-ValGluThrGluIleLeuProAlaGluAsnLysSerLeu-102 |
| SEQ. ID. NO. 8973 | 115-GlnCysGluProGluGlyPheArgLys-123 |
| SEQ. ID. NO. 8974 | 128-IleAspArgProAspValMetSer-135 |
| SEQ. ID. NO. 8975 | 142-ValAlaAspLysLysArgTyrPro-149 |
| SEQ. ID. NO. 8976 | 153-SerAsnGlyAsnLysIleAspGlyGlyGluPheSerAspGlyArgHisTrpValLysTrpGluAspProPheSerLysProSer-180 |
| SEQ. ID. NO. 8977 | 191-AlaValThrGluAspTyr-196 |
| SEQ. ID. NO. 8978 | 200-MetSerArgAsnValLysIle-207 |
| SEQ. ID. NO. 8979 | 211-ThrThrGluAlaAspLysProLysVal-219 |
| SEQ. ID. NO. 8980 | 230-MetLysTrpAspGluThrArgPhe-237 |
| SEQ. ID. NO. 8981 | 255-AsnMetGlyAlaMetGluAsnLysGlyLeu-264 |
| SEQ. ID. NO. 8982 | 275-AspSerArgThrAlaThrAspThrAspPheGluGlyIleGlu-288 |
| SEQ. ID. NO. 8983 | 295-TyrPheHisAsnTrpThrGlyAsnArgValThrCysArgAspTrp-309 |
| SEQ. ID. NO. 8984 | 313-SerLeuLysGluGly-317 |
| SEQ. ID. NO. 8985 | 322-ArgAspGlnGluPheSerGlyAspArgAlaSerArgAlaValArgArgIleGluAsn-340 |
| SEQ. ID. NO. 8986 | 347-HisGlnPheProGluAspAlaGlyProThrAlaHisProValArgProAlaSerTyrGluGluMetAsn-369 |
| SEQ. ID. NO. 8987 | 376-ValTyrGluLysGlyAlaGluVal-383 |
| SEQ. ID. NO. 8988 | 394-GluGlyPheGlnLysGlyMet-400 |
| SEQ. ID. NO. 8989 | 404-PheGlnArgHisAspGlyGlnAlaValThrCysAspAspPheArgAlaAlaMet-421 |
| SEQ. ID. NO. 8990 | 437-SerGlnAlaGlyThrPro-442 |
| SEQ. ID. NO. 8991 | 444-LeuGluAlaGluGlyArgLeuLysAsnAsnIle-454 |
| SEQ. ID. NO. 8992 | 459-ValLysGlnThrValProProThrProAspMetThrAspLysGlnPro-474 |
| SEQ. ID. NO. 8993 | 483-LeuLeuAsnArgAsnGlyGluAlaVal-491 |
| SEQ. ID. NO. 8994 | 494-AspTyrGlnGlyLysArgAlaThrGlu-502 |
| SEQ. ID. NO. 8995 | 537-LeuAsnTyrProTyrSerAspAspAspLeu-546 |
| SEQ. ID. NO. 8996 | 552-HisAspSerAspAla-556 |
| SEQ. ID. NO. 8997 | 578-LeuSerAspGlyValGluLeuProLysHisGluLysLeu-590 |
| SEQ. ID. NO. 8998 | 594-ValGluLysValIleSerAspAspLeuLeu-603 |

TABLE 1-continued

| | |
|---|---|
| SEQ. ID. NO. 8999 | 614-ValProSerGluAlaGluLeuTrpAspGlyAlaGluAsnIleAspProLeuArg-631 |
| SEQ. ID. NO. 9000 | 633-HisGlnAlaArgGluAlaLeu-639 |
| SEQ. ID. NO. 9001 | 652-HisGluLeuAsnArgGlnAlaAlaLysGlnGluAsnGlnSerTyrGluTyrSerProGluAlaAlaGly-674 |
| SEQ. ID. NO. 9002 | 677-ThrLeuArgAsnValCys-682 |
| SEQ. ID. NO. 9003 | 689-AlaAspProAlaHis-693 |
| SEQ. ID. NO. 9004 | 696-ThrValAlaGluLysTyrGlyGlu-703 |
| SEQ. ID. NO. 9005 | 719-AsnGlyAsnGluSerAspThrArgAsnArgLeu-729 |
| SEQ. ID. NO. 9006 | 733-PheAlaAspLysPheSerAspAspAlaLeuVal-743 |
| SEQ. ID. NO. 9007 | 752-GlySerSerArgArgSerAspThrLeuGlnLeuGlnVal-763 |
| SEQ. ID. NO. 9008 | 768-GlnHisProLysPheSerLeuGluAsnProAsnLysAlaArgSer-782 |
| SEQ. ID. NO. 9009 | 785-GlySerPheSerArgAsnValPro-792 |
| SEQ. ID. NO. 9010 | 795-HisAlaGluAspGlySerGlyTyrArgPheIleAla-806 |
| SEQ. ID. NO. 9011 | 808-LysValIleGluIleAspArgPheAsnProGlnVal-819 |
| SEQ. ID. NO. 9012 | 831-AsnLysLeuGluProHisArgLysAsnLeuVal-841 |
| SEQ. ID. NO. 9013 | 844-AlaLeuGlnArgIleArgAlaGlnGluGlyLeuSerLysAspValGlyGluIleVal-862 |
| Hydrophilic Regions - Hopp-Woods | |
| SEQ. ID. NO. 9014 | 32-ThrValValLysSerArgLeuThrValGluProGlnArgValGlyGlu-47 |
| SEQ. ID. NO. 9015 | 82-ProSerGluArgPheThrVal-88 |
| SEQ. ID. NO. 9016 | 90-ValGluThrGluIleLeuProAlaGluAsnLysSer-101 |
| SEQ. ID. NO. 9017 | 116-CysGluProGluGlyPheArg-122 |
| SEQ. ID. NO. 9018 | 129-AspArgProAspValMetSer-135 |
| SEQ. ID. NO. 9019 | 142-ValAlaAspLysLysArgTyr-148 |
| SEQ. ID. NO. 9020 | 154-AsnGlyAsnLysIleAspGlyGlyGluPheSerAsp-165 |
| SEQ. ID. NO. 9021 | 170-ValLysTrpGluAspProPheSer-177 |
| SEQ. ID. NO. 9022 | 201-SerGlyArgAsnValLys-206 |
| SEQ. ID. NO. 9023 | 213-GluAlaAspLysProLysVal-219 |
| SEQ. ID. NO. 9024 | 230-MetLysTrpAspGluThrArgPhe-237 |
| SEQ. ID. NO. 9025 | 258-AlaMetGluAsnLysGly-263 |
| SEQ. ID. NO. 9026 | 275-AspSerArgThrAlaThrAspThrAspPheGluGlyIleGlu-288 |
| SEQ. ID. NO. 9027 | 313-SerLeuLysGluGly-317 |
| SEQ. ID. NO. 9028 | 322-ArgAspGlnGluPheSerGlyAspArgAlaSerArgAlaValArgArgIleGluAsn-340 |
| SEQ. ID. NO. 9029 | 348-GlnPheProGluAspAlaGlyPro-355 |
| SEQ. ID. NO. 9030 | 363-AlaSerTyrGluGluMetAsn-369 |
| SEQ. ID. NO. 9031 | 376-ValTyrGluLysGlyAlaGluVal-383 |
| SEQ. ID. NO. 9032 | 394-GluGlyPheGlnLysGlyMet-400 |
| SEQ. ID. NO. 9033 | 406-ArgHisAspGlyGln-410 |
| SEQ. ID. NO. 9034 | 413-ThrCysAspAspPheArgAlaAlaMet-421 |
| SEQ. ID. NO. 9035 | 444-LeuGluAlaGluGlyArgLeuLysAsnAsnIle-454 |
| SEQ. ID. NO. 9036 | 467-ProAspMetThrAspLysGlnPro-474 |
| SEQ. ID. NO. 9037 | 495-TyrGlnGlyLysArgAlaThrGlu-502 |
| SEQ. ID. NO. 9038 | 541-TyrSerAspAspAspLeu-546 |
| SEQ. ID. NO. 9039 | 552-HisAspSerAspAla-556 |
| SEQ. ID. NO. 9040 | 580-AspGlyValGluLeuProLysHisGluLysLeu-590 |
| SEQ. ID. NO. 9041 | 594-ValGluLysValIleSer-599 |
| SEQ. ID. NO. 9042 | 616-SerGluAlaGluLeu-620 |
| SEQ. ID. NO. 9043 | 622-AspGlyAlaGluAsnIleAspPro-629 |
| SEQ. ID. NO. 9044 | 633-HisGlnAlaArgGluAlaLeu-639 |
| SEQ. ID. NO. 9045 | 652-HisGluLeuAsnArgGlnAlaAlaLysGlnGluAsnGlnSer-665 |
| SEQ. ID. NO. 9046 | 689-AlaAspProAlaHis-693 |
| SEQ. ID. NO. 9047 | 696-ThrValAlaGluLysTyrGlyGlu-703 |
| SEQ. ID. NO. 9048 | 719-AsnGlyAsnGluSerAspThrArgAsnArgLeu-729 |
| SEQ. ID. NO. 9049 | 733-PheAlaAspLysPheSerAsp-739 |
| SEQ. ID. NO. 9050 | 753-SerSerArgArgSerAspThr-759 |
| SEQ. ID. NO. 9051 | 776-AsnProAsnLysAlaArgSer-782 |
| SEQ. ID. NO. 9052 | 795-HisAlaGluAspGlySerGly-801 |
| SEQ. ID. NO. 9053 | 808-LysValIleGluIleAspArgPheAsn-816 |
| SEQ. ID. NO. 9054 | 831-AsnLysLeuGluProHisArgLysAsnLeuVal-841 |
| SEQ. ID. NO. 9055 666-2 | 844-AlaLeuGlnArgIleArgAlaGlnGluGlyLeuSerLysAspValGlyGluIleVal-862 |
| AMPHI Regions - AMPHI | |
| SEQ. ID. NO. 9056 | 89-GlyTyrAspIleLeuLysGlnGlyGlySer-98 |
| SEQ. ID. NO. 9057 | 162-LeuLysPheMetGluAla-167 |
| SEQ. ID. NO. 9058 | 177-ProAlaIleProLysLeuMetGluThrIleHisGln-188 |
| SEQ. ID. NO. 9059 | 193-LeuProTrpGlyLysLeuPheAspThrProIleArg-204 |
| SEQ. ID. NO. 9060 | 227-LeuAlaArgTyrProLys-232 |
| SEQ. ID. NO. 9061 | 249-LeuLeuLysAsnLeuGluPheAlaAspSerValGlnAlaLeu-262 |
| SEQ. ID. NO. 9062 | 265-GlnGlyAlaLysAlaLeuHisThr-272 |
| SEQ. ID. NO. 9063 | 274-LysTyrAlaGlnAsnIleValSerValVal-283 |
| SEQ. ID. NO. 9064 | 295-LeuGlnAspLeuSerAspTyrGln-302 |
| SEQ. ID. NO. 9065 | 313-TyrArgIleTyrGluValCysGlyMetGly-322 |
| SEQ. ID. NO. 9066 | 332-GlyGlnIleLeuGlyIleLeuAsnGluPheSer-342 |
| SEQ. ID. NO. 9067 | 353-LeuArgLeuLeuGlyAsp-358 |
| SEQ. ID. NO. 9068 | 411-AspPheIleHisGluTrp-416 |
| SEQ. ID. NO. 9069 | 424-LeuProSerThrSerHis-429 |
| SEQ. ID. NO. 9070 | 433-ValAspLysAlaGlyAsn-438 |
| SEQ. ID. NO. 9071 | 441-SerMetThrThrSerIleGluAsnAlaPheGlySer-452 |
| SEQ. ID. NO. 9072 | 511-ProGlyGlySerArgIleIleGlyTyrValAlaLys-522 |
| SEQ. ID. NO. 9073 | 537-AlaIleSerAlaProAsnLeuLeuAsnArgPheGly-548 |
| SEQ. ID. NO. 9074 | 562-GlnGlnAlaLeuAsnAsp-567 |
| SEQ. ID. NO. 9075 | 590-ArgLeuValGlyGly-594 |

TABLE 1-continued

Antigenic Index - Jameson-Wolf
SEQ. ID. NO. 9076   5-AsnHisGlnSerAsnSerGlyGluGlyValLeu-15
SEQ. ID. NO. 9077   40-AsnGlnGlyLysValAsnThr-46
SEQ. ID. NO. 9078   54-AlaAspAlaHisThrProGluHisAlaThr-63
SEQ. ID. NO. 9079   65-LeuThrGluGlnLysGln-70
SEQ. ID. NO. 9080   92-IleLeuLysGlnGlyGlySerAlaAla-100
SEQ. ID. NO. 9081   114-GluProGlnSerSerGlyLeuGlyGly-122
SEQ. ID. NO. 9082   130-AspAsnThrAlaLysThr-135
SEQ. ID. NO. 9083   137-ThrThrPheAspGlyArgGluThrAlaPro-146
SEQ. ID. NO. 9084   154-PheLeuAspLysAspGlyGlnPro-161
SEQ. ID. NO. 9085   169-ValGlyGlyArgSerValGly-175
SEQ. ID. NO. 9086   197-LysLeuPheAspThrProIleArgLeuAlaLysGlnGlyPhe-210
SEQ. ID. NO. 9087   212-ValSerProArgLeu-216
SEQ. ID. NO. 9088   221-GluGlnAsnGlnGlnHis-226
SEQ. ID. NO. 9089   228-AlaArgTyrProLysThrAlaAla-235
SEQ. ID. NO. 9090   271-HisThrGlyLysTyr-275
SEQ. ID. NO. 9091   284-GlnAsnAlaLysAspAsnProGlyGln-292
SEQ. ID. NO. 9092   296-GlnAspLeuSerAspTyrGlnValValGluArgProProValCys-310
SEQ. ID. NO. 9093   320-GlyMetGlyAlaProSerSerGlyGly-328
SEQ. ID. NO. 9094   340-GluPheSerProAsnGlnValGlyTyrAspAlaGluGlyLeuArgLeuLeuGlyAspAlaSerArg-361
SEQ. ID. NO. 9095   363-AlaPheAlaAspArgAspValTyrLeuGlyAspProAspPheVal-377
SEQ. ID. NO. 9096   384-LeuIleSerLysAspTyrLeuLysHisArgSerGlnLeuLeuGluGlnSerAspLysAlaLeu-404
SEQ. ID. NO. 9097   431-SerIleValAspLysAlaGly-437
SEQ. ID. NO. 9098   445-SerIleGluAsnAlaPhe-450
SEQ. ID. NO. 9099   472-ProIleLysGlnGlyLysGlnValAlaAsnArgValGluProGlyLysArgProArgSerSerMet-493
SEQ. ID. NO. 9100   500-LysAlaGlyLysProTyrMet-506
SEQ. ID. NO. 9101   510-SerProGlyGlySerArgIle-516
SEQ. ID. NO. 9102   548-GlySerTyrGluLeuGluThrGlyThr-556
SEQ. ID. NO. 9103   566-AsnAspLeuGlyTyrLysThrAspValArgGluLeuAsnSerGlyVal-581
SEQ. ID. NO. 9104   587-GluProSerArgLeuValGlyGlyAlaAspProArgArgGluGlyArgValMetGlyAsp-606
Hydrophilic Regions - Hopp-Woods
SEQ. ID. NO. 9105   8-SerAsnSerGlyGlu-12
SEQ. ID. NO. 9106   40-AsnGlnGlyLysValAsnThr-46
SEQ. ID. NO. 9107   55-AspAlaHisThrProGluHis-61
SEQ. ID. NO. 9108   65-LeuThrGluGlnLysGln-70
SEQ. ID. NO. 9109   96-GlyGlySerAlaAla-100
SEQ. ID. NO. 9110   139-PheAspGlyArgGluThrAlaPro-146
SEQ. ID. NO. 9111   154-PheLeuAspLysAspGlyGlnPro-161
SEQ. ID. NO. 9112   203-IleArgLeuAlaLysGlnGlyPhe-210
SEQ. ID. NO. 9113   284-GlnAsnAlaLysAspAsnProGly-291
SEQ. ID. NO. 9114   302-GlnValValGluArgProPro-308
SEQ. ID. NO. 9115   348-TyrAspAlaGluGlyLeuArgLeuLeuGlyAspAlaSerArg-361
SEQ. ID. NO. 9116   363-AlaPheAlaAspArgAspValTyrLeuGly-372
SEQ. ID. NO. 9117   388-AspTyrLeuLysHisArgSerGlnLeuLeuGluGlnSerAspLysAlaLeu-404
SEQ. ID. NO. 9118   432-IleValAspLysAlaGly-437
SEQ. ID. NO. 9119   472-ProIleLysGlnGlyLysGlnValAlaAsnArgValGluProGlyLysArgProArgSerSerMet-493
SEQ. ID. NO. 9120   572-ThrAspValArgGluLeuAsnSer-579
SEQ. ID. NO. 9121   595-AlaAspProArgArgGluGlyArgValMetGlyAsp-606
667-2
AMPHI Regions - AMPHI
SEQ. ID. NO. 9122   6-GlyLeuCysGlyGlnValIlePro-13
SEQ. ID. NO. 9123   48-IleIleAlaAspPheLeuGlnProAlaArg-57
SEQ. ID. NO. 9124   59-GluCysLeuProAsnLeuAlaAla-66
SEQ. ID. NO. 9125   74-LysThrAlaGlnPhe-78
SEQ. ID. NO. 9126   115-IleAlaAlaValAlaGluIle-121
SEQ. ID. NO. 9127   153-ThrAspGlnLeuArgArgMetPhePheAsnGlnPheGluLysPheSerAsnAspHis-171
SEQ. ID. NO. 9128   202-LysMetMetLeuHisLys-207
SEQ. ID. NO. 9129   234-ValGlnCysSerAspThr-239
Antigenic Index - Jameson-Wolf
SEQ. ID. NO. 9130   27-ProAlaAlaAspGlnThrGluThrGln-35
SEQ. ID. NO. 9131   56-AlaArgMetGluCysLeuPro-62
SEQ. ID. NO. 9132   71-LeuAlaArgLysThrAlaGln-77
SEQ. ID. NO. 9133   89-ArgLeuValLysArgGluGlnIle-96
SEQ. ID. NO. 9134   152-ProThrAspGlnLeuArg-157
SEQ. ID. NO. 9135   165-GluLysPheSerAsn-169
SEQ. ID. NO. 9136   190-ProThrHisAlaAlaArgAsnArgHisAsnLeu-200
SEQ. ID. NO. 9137   226-ValGlyGlnArgGlyArgGlnLeu-233
SEQ. ID. NO. 9138   248-IleGluSerGlnAsnArgGlyHisAspSer-257
Hydrophilic Regions - Hopp-Woods
SEQ. ID. NO. 9139   27-ProAlaAlaAspGlnThrGluThrGln-35
SEQ. ID. NO. 9140   56-AlaArgMetGluCys-60
SEQ. ID. NO. 9141   71-LeuAlaArgLysThrAlaGln-77
SEQ. ID. NO. 9142   89-ArgLeuValLysArgGluGlnIle-96
SEQ. ID. NO. 9143   165-GluLysPheSerAsn-169
SEQ. ID. NO. 9144   192-HisAlaAlaArgOAsnArgHisAsnLeu-200
SEQ. ID. NO. 9145   228-GlnArgGlyArgGln-232
SEQ. ID. NO. 9146   250-SerGlnAsnArgGlyHisAsp-256
669-2

TABLE 1-continued

AMPHI Regions - AMPHI
SEQ. ID. NO. 9147     24-PheLeuGlyIleLysArgPhePheArgGlnPro-34
SEQ. ID. NO. 9148     60-LysLeuHisArgAlaPhe-65
SEQ. ID. NO. 9149     95-GlnIlePheArgHisValGlnSer-102
SEQ. ID. NO. 9150     119-ThrArgGlnAlaPhe-123
Antigenic Index - Jameson-Wolf
SEQ. ID. NO. 9151     5-ArgLeuGlnAsnGlyArgThrGlyArgAsnProProPheValGlnLysArgLeuAsp-23
SEQ. ID. NO. 9152     29-ArgPhePheArgGlnProLeuGluMetArgArgIleIleLysLysHisGlnProIleAsnAla-49
SEQ. ID. NO. 9153     69-GlyArgLysArgProHisHisHisAspSerSerLeuArgArgGlnHisGlyIleGluGlyMetGlyPhe-91
SEQ. ID. NO. 9154     99-HisValGlnSerSerAsnArgGlnAsnGlyArgGlnProVal-112
SEQ. ID. NO. 9155     114-AlaProAsnArgGlnThrArgGlnAlaPhe-123
SEQ. ID. NO. 9156     137-ProThrSerAsnGlyTyrCys-143
SEQ. ID. NO. 9157     149-SerThrHisArgThrThrHisLysAlaProProTyr-160
Hydrophilic Regions - Hopp-Woods
SEQ. ID. NO. 9158     7-GlnAsnGlyArgThrGlyArgAsn-14
SEQ. ID. NO. 9159     18-ValGlnLysArgLeuAsp-23
SEQ. ID. NO. 9160     34-ProLeuGluMetArgArgIleIleLysLysHisGlnPro-46
SEQ. ID. NO. 9161     69-GlyArgLysArgProHisHisHisAspSerSerLeuArgArgGlnHisGly-85
SEQ. ID. NO. 9162     101-GlnSerSerAsnArgGlnAsnGlyArg-109
SEQ. ID. NO. 9163     116-AsnArgGlnThrArgGlnAlaPhe-123
SEQ. ID. NO. 9164     151-HisArgThrThrHisLys-156
670-2
AMPHI Regions - AMPHI
SEQ. ID. NO. 9165     10-ArgSerCysPheGly-14
SEQ. ID. NO. 9166     16-ValLysAsnAlaSerGlyValSer-23
SEQ. ID. NO. 9167     34-IleThrArgSerAla-38
SEQ. ID. NO. 9168     77-ValGlySerSerAsnAsnIle-83
Antigenic Index - Jameson-Wolf
SEQ. ID. NO. 9169     4-CysArgAlaAsnCysLeuAlaArgSerCys-12
SEQ. ID. NO. 9170     18-AsnAlaSerGlyValSerSerSerArgIleCysProLeuSer-31
SEQ. ID. NO. 9171     33-LysIleThrArgSerAlaThrSerArgAlaAsnProIle-45
SEQ. ID. NO. 9172     65-AsnThrSerProThrIleSerGlySerSerAlaGluValGlySerSerAsnAsnIleThrArgGlySerIleAlaLysProArgAlaIleAla-95
SEQ. ID. NO. 9173     98-CysCysTrpProProGluSerTrpGluGlyLysAla-109
SEQ. ID. NO. 9174     114-AlaSerProThrArgSerLysSerSer-122
SEQ. ID. NO. 9175     128-AlaCysSerAlaPhe-132
Hydrophilic Regions - Hopp-Woods
SEQ. ID. NO. 9176     33-LysIleThrArgSerAlaThrSerArgAlaAsn-43
SEQ. ID. NO. 9177     73-SerSerAlaGluValGlySer-79
SEQ. ID. NO. 9178     87-SerIleAlaLysProArgAlaIleAla-95
SEQ. ID. NO. 9179     116-ProThrArgSerLysSer-121
671
AMPHI Regions - AMPHI
SEQ. ID. NO. 9180     11-PheAsnAlaProAsn-15
SEQ. ID. NO. 9181     72-LysGluAlaAlaLysSerLeu-78
SEQ. ID. NO. 9182     96-ThrProArgIleAla-100
SEQ. ID. NO. 9183     119-ArgLeuPheIleArgTyr-124
Antigenic Index - Jameson-Wolf
SEQ. ID. NO. 9184     9-ThrProPheAsnAlaProAsnThrProProLysMetArgLeuAlaLysProLysProThrAlaGlu-30
SEQ. ID. NO. 9185     45-GlnAlaMetThrAsnArgGluMetAsnAspArgAlaAsnAlaAsnArgArgGlyTrpAsnGluAlaLysAlaArgSerAlaLysGluAlaAlaLysSer
                      LeuAlaLysLysLysGluThrThr-85
SEQ. ID. NO. 9186     98-ArgIleAlaAspSerThrMet-104
SEQ. ID. NO. 9187     110-AlaGluThrArgArgSerAlaMet-117
SEQ. ID. NO. 9188     125-LeuThrGlyAspThr-129
Hydrophilic Regions - Hopp-Woods
SEQ. ID. NO. 9189     16-ThrProProLysMetArgLeuAlaLysProLysProThrAla-29
SEQ. ID. NO. 9190     47-MetThrAsnArgGluMetAsnAspArgAlaAsnAlaAsnArgArgGlyTrpAsnGluAlaLysAlaArgSerAlaLysGluAlaAlaLysSerLeuAla
                      LysLysLysGluThrThr-85
SEQ. ID. NO. 9191     110-AlaGluThrArgArgSerAlaMet-117
672
AMPHI Regions - AMPHI
SEQ. ID. NO. 9192     38-ArgAlaValAspIleAlaArgAlaLysLys-47
SEQ. ID. NO. 9193     50-AlaAlaLeuProProPheValSerValVal-59
SEQ. ID. NO. 9194     67-AlaGlnAsnIleArgArgIleLeuAlaGluValPro-78
SEQ. ID. NO. 9195     91-AlaPheCysArgGlnPheHisArgProTyr-100
SEQ. ID. NO. 9196     105-ArgValGlnThrAlaSerAspIle-112
SEQ. ID. NO. 9197     115-AlaAlaThrArgPheProAsp-121
SEQ. ID. NO. 9198     131-HisProSerGluTyrGlyGlyThr-138
SEQ. ID. NO. 9199     163-ProGluAsnValGlyGluAlaValArgIleThrGlyAlaGluSer-177
Antigenic Index - Jameson-Wolf
SEQ. ID. NO. 9200     1-MetArgLysIleArgThrLysIle-8
SEQ. ID. NO. 9201     13-ThrProGluAspAlaAlaAla-19
SEQ. ID. NO. 9202     35-GlySerSerArgAlaValAspIleAlaArgAlaLysLysIleThr-49
SEQ. ID. NO. 9203     65-GluSerAlaGlnAsnIleArgArgIleLeuAla-75
SEQ. ID. NO. 9204     84-PheHisGlyAspGluAspAspAlaPhe-92
SEQ. ID. NO. 9205     110-SerAspIleArgAsnAlaAlaThrArgPheProAspAla-122
SEQ. ID. NO. 9206     130-TyrHisProSerGluTyrGlyGlyThrGlyAsnArgPheAsp-143
SEQ. ID. NO. 9207     148-AlaGluTyrSerGlyLysPro-154
SEQ. ID. NO. 9208     160-GlyLeuThrProGluAsnValGlyGluAlaValArg-171
SEQ. ID. NO. 9209     176-GluSerValAspValSerGlyGlyValGluAlaSerLysGlyLysLysAspAlaAlaLys-195
SEQ. ID. NO. 9210     202-ThrAlaAsnArgLeuSerArg-208

TABLE 1-continued

Hydrophilic Regions - Hopp-Woods
SEQ. ID. NO. 9211  1-MetArgLysIleArgThrLysIle-8
SEQ. ID. NO. 9212  13-ThrProGluAspAlaAlaAlaAla-19
SEQ. ID. NO. 9213  36-SerSerArgAlaValAspIleAlaArgAlaLysLysIleThr-49
SEQ. ID. NO. 9214  66-SerAlaGlnAsnIleArgArgIleLeuAla-75
SEQ. ID. NO. 9215  85-HisGlyAspGluAspAspAlaPhe-92
SEQ. ID. NO. 9216  110-SerAspIleArgAsnAlaAla-116
SEQ. ID. NO. 9217  134-GluTyrGlyGlyThrGlyAsn-140
SEQ. ID. NO. 9218  165-AsnValGlyGluAlaValArg-171
SEQ. ID. NO. 9219  176-GluSerValAspVal-180
SEQ. ID. NO. 9220  184-ValGluAlaSerLysGlyLysLysAspAlaAlaLys-195
SEQ. ID. NO. 9221  204-AsnArgLeuSerArg-208
673
AMPHI Regions - AMPHI
SEQ. ID. NO. 9222  84-LeuAsnAspArgLeuAsnGlnAsnValThrGluAlaLeuGlyGlyValAspVal-101
SEQ. ID. NO. 9223  110-ArgPheThrAspAla-114
SEQ. ID. NO. 9224  117-ValValLeuLysGlnLeuProLys-124
SEQ. ID. NO. 9225  172-ArgIleAlaAsnLeuLeuGluLeuIleLysProTyrLeu-184
SEQ. ID. NO. 9226  212-LysLeuPheArgTyrLeuGlyGluGlu-220
SEQ. ID. NO. 9227  261-GlyGluArgLeuLysLysIleSerThr-269
SEQ. ID. NO. 9228  275-MetGluLysLeuPhe-279
SEQ. ID. NO. 9229  285-LeuLysValTrpValLysValLys-292
Antigenic Index - Jameson-Wolf
SEQ. ID. NO. 9230  7-LeuAlaGlyGluArgAlaAlaGlyGlyTyrArg-17
SEQ. ID. NO. 9231  24-ValGlyArgProAsnValGlyLysSerThr-33
SEQ. ID. NO. 9232  44-SerIleThrSerLysLysAlaGlnThrThrArgAsnArgValThr-58
SEQ. ID. NO. 9233  61-TyrThrAspAspThrAla-66
SEQ. ID. NO. 9234  73-ThrProGlyPheGlnThrAspHisArgAsnAlaLeuAsnAspArgLeuAsnGlnAsnValThrGlu-94
SEQ. ID. NO. 9235  110-ArgPheThrAspAlaAspArgValVal-118
SEQ. ID. NO. 9236  121-GlnLeuProLysHisThr-126
SEQ. ID. NO. 9237  134-LysIleAspLysAspLysAlaLysAspArgTyrAla-145
SEQ. ID. NO. 9238  153-ValArgAlaGluPhe-157
SEQ. ID. NO. 9239  180-IleLysProTyrLeuProGluSerVal-188
SEQ. ID. NO. 9240  190-MetTyrProGluAspMetValThrAspLysSerAlaArg-202
SEQ. ID. NO. 9241  208-IleValArgGluLysLeuPhe-214
SEQ. ID. NO. 9242  217-LeuGlyGluGluLeuPro-222
SEQ. ID. NO. 9243  227-ValGluValGluGlnPheGluGluGluAspGlyLeuAsn-239
SEQ. ID. NO. 9244  247-ValAspLysGluSerGlnLys-253
SEQ. ID. NO. 9245  258-GlyLysGlyGlyGluArgLeuLysLysIleSerThrGluAlaArgLeuAspMetGluLysLeuPheAsp-280
SEQ. ID. NO. 9246  291-ValLysSerGlyTrpAlaAspAspIleArgPheLeuArg-303
Hydrophilic Regions - Hopp-Woods
SEQ. ID. NO. 9247  7-LeuAlaGlyGluArgAlaAlaGly-14
SEQ. ID. NO. 9248  45-IleThrSerLysLysAlaGlnThrThrArgAsnArgVal-57
SEQ. ID. NO. 9249  61-TyrThrAspAspThrAla-66
SEQ. ID. NO. 9250  78-ThrAspHisArgAsnAlaLeuAsnAspArgLeuAsn-89
SEQ. ID. NO. 9251  110-ArgPheThrAspAlaAspArgValVal-118
SEQ. ID. NO. 9252  134-LysIleAspLysAspLysAlaLysAspArgTyrAla-145
SEQ. ID. NO. 9253  153-ValArgAlaGluPhe-157
SEQ. ID. NO. 9254  194-AspMetValThrAspLysSerAlaArg-202
SEQ. ID. NO. 9255  208-IleValArgGluLysLeuPhe-214
SEQ. ID. NO. 9256  217-LeuGlyGluGluLeuPro-222
SEQ. ID. NO. 9257  227-ValGluValGluGlnPheGluGluGluAspGlyLeuAsn-239
SEQ. ID. NO. 9258  247-ValAspLysGluSerGlnLys-253
SEQ. ID. NO. 9259  259-LysGlyGlyGluArgLeuLysLysIleSerThrGluAlaArgLeuAspMetGluLysLeuPheAsp-280
SEQ. ID. NO. 9260  293-SerGlyTrpAlaAspAspIleArgPheLeuArg-303
674
AMPHI Regions - AMPHI
SEQ. ID. NO. 9261  16-ValTyrGlnSerLeuIle-21
SEQ. ID. NO. 9262  24-ThrAlaAlaProGluIleAlaLysAsnIleArgGluMetSerAspPheAlaLysAlaAspGluGluLeu-46
SEQ. ID. NO. 9263  58-AlaAlaGluTyrIleArgGlnIleArgPro-67
SEQ. ID. NO. 9264  86-ThrAlaCysHisGluLeuSerAlaMetProGluThr-97
SEQ. ID. NO. 9265  107-IleGluValThrLysThrPheGlyGlyThrAspGlyHisLysPheValAsnGlyIleLeuAspLysLeuAla-130
Antigenic Index - Jameson-Wolf
SEQ. ID. NO. 9266  1-MetLysThrAlaArgArgArgSerArgGluLeuAla-12
SEQ. ID. NO. 9267  28-GluIleAlaLysAsnIleArgGluMetSerAspPheAlaLysAlaAspGluGluLeuPhe-47
SEQ. ID. NO. 9268  54-ThrGlnThrAsnAla-58
SEQ. ID. NO. 9269  63-ArgGlnIleArgProLeuLeuAspArgAspGluLysAspLeuAsnProIleGluArg-81
SEQ. ID. NO. 9270  93-AlaMetProGluThrProTyr-99
SEQ. ID. NO. 9271  105-GluAlaIleGluValThrLysThrPheGlyGlyThrAspGlyHisLysPhe-121
SEQ. ID. NO. 9272  129-LeuAlaAlaGlnIleArgProAspGluProLysArgArg-141
Hydrophilic Regions - Hopp-Woods
SEQ. ID. NO. 9273  1-MetLysThrAlaArgArgArgSerArgGluLeuAla-12
SEQ. ID. NO. 9274  28-GluIleAlaLysAsnIleArgGluMetSerAspPheAlaLysAlaAspGluGluLeuPhe-47
SEQ. ID. NO. 9275  63-ArgGlnIleArgProLeuLeuAspArgAspGluLysAspLeuAsnProIleGluArg-81
SEQ. ID. NO. 9276  105-GluAlaIleGluVal-109
SEQ. ID. NO. 9277  133-IleArgProAspGluProLysArgArg-141
675
AMPHI Regions - AMPHI
SEQ. ID. NO. 9278  21-ArgPheThrAsnGluIleGlySerGluMetLeuLysValCysCysArgThrLeuGlnGluLeuGly-42
SEQ. ID. NO. 9279  74-AlaLeuIleAlaIle-78

TABLE 1-continued

SEQ. ID. NO. 9280  123-GlnAlaIleGluArgIleGluGluLysAlaSerAsp-134
SEQ. ID. NO. 9281  141-GluCysAlaAsnLeuValAsnLeuLeuLeuGlu-151
Antigenic Index - Jameson-Wolf
SEQ. ID. NO. 9282  6-ProAsnLeuAspGlyLysHisLeuArg-14
SEQ. ID. NO. 9283  26-IleGlySerGluMetLeu-31
SEQ. ID. NO. 9284  42-GlyValAlaAspGluAsnIle-48
SEQ. ID. NO. 9285  68-SerSerGluLysPheAsp-73
SEQ. ID. NO. 9286  82-IleArgGlyGluThrTyr-87
SEQ. ID. NO. 9287  92-ValSerAsnGluSerGlyAlaGlyVal-100
SEQ. ID. NO. 9288  118-ThrGluAsnAspAlaGlnAlaIleGluArgIleGluGluLysAlaSerAspAlaAlaLysValAlaVal-140
SEQ. ID. NO. 9289  152-GluGlnPheGluAspGluGlu-158
Hydrophilic Regions - Hopp-Woods
SEQ. ID. NO. 9290  8-LeuAspGlyLysHisLeuArg-14
SEQ. ID. NO. 9291  26-IleGlySerGluMetLeu-31
SEQ. ID. NO. 9292  42-GlyValAlaAspGluAsnIle-48
SEQ. ID. NO. 9293  68-SerSerGluLysPheAsp-73
SEQ. ID. NO. 9294  82-IleArgGlyGluThrTyr-87
SEQ. ID. NO. 9295  92-ValSerAsnGluSerGlyAlaGly-99
SEQ. ID. NO. 9296  118-ThrGluAsnAspAlaGlnAlaIleGluArgIleGluGluLysAlaSerAspAlaAlaLysValAlaVal-140
SEQ. ID. NO. 9297  152-GluGlnPheGluAspGluGlu-158
677
AMPHI Regions - AMPHI
SEQ. ID. NO. 9298  20-AlaArgPheCysArgPheArgArg-27
SEQ. ID. NO. 9299  45-LeuThrProPheArgArgValGlnAsnHisPheValAlaPheAlaArgPheAsnGln-63
SEQ. ID. NO. 9300  79-IleAspPheIleAspAlaAsp-85
SEQ. ID. NO. 9301  87-PheAspGlyLeuLeuAlaPro-93
SEQ. ID. NO. 9302  105-LysHisLeuValGlyArgPhe-111
SEQ. ID. NO. 9303  155-CysArgProValAspAspLeuAspAspPheGlyAlaPhePheValAspGlnLeuIleLysLeuValPheGlnCys-179
Antigenic Index - Jameson-Wolf
SEQ. ID. NO. 9304  23-CysArgPheArgArgHisSerArgSerValAsp-33
SEQ. ID. NO. 9305  35-AspValPheAspArgLysAspPheAsn-43
SEQ. ID. NO. 9306  47-ProPheArgArgValGln-52
SEQ. ID. NO. 9307  61-PheAsnGlnThrThrSerGlnArgArgAsnProArgAsnPheVal-75
SEQ. ID. NO. 9308  82-IleAspAlaAspAspPheAspGly-89
SEQ. ID. NO. 9309  97-GlnGlnSerAspArgArgAlaGluLysHisLeu-107
SEQ. ID. NO. 9310  115-GlyIleAspAspAspGlySerLeu-122
SEQ. ID. NO. 9311  125-PheGlyGlnGluThrAspAlaAlaVal-133
SEQ. ID. NO. 9312  156-ArgProValAspAspLeuAspAspPheGly-165
SEQ. ID. NO. 9313  181-ProSerGlyGlyArgAsn-186
Hydrophilic Regions - Hopp-Woods
SEQ. ID. NO. 9314  23-CysArgPheArgArgHisSerArgSerValAsp-33
SEQ. ID. NO. 9315  35-AspValPheAspArgLysAspPhe-42
SEQ. ID. NO. 9316  65-ThrSerGlnArgArgAsnProArg-72
SEQ. ID. NO. 9317  82-IleAspAlaAspAspPheAsp-88
SEQ. ID. NO. 9318  97-GlnGlnSerAspArgArgAlaGluLysHisLeu-107
SEQ. ID. NO. 9319  115-GlyIleAspAspAspGlySer-121
SEQ. ID. NO. 9320  126-GlyGlnGluThrAspAlaAlaVal-133
SEQ. ID. NO. 9321  156-ArgProValAspAspLeuAspAsp-163
678
AMPHI Regions - AMPHI
SEQ. ID. NO. 9322  10-LeuValSerAlaValIle-15
SEQ. ID. NO. 9323  24-MetArgGlyValIle-28
SEQ. ID. NO. 9324  80-IleGlnLysMetLeuArgSerLeuLeuThrSerAla-91
SEQ. ID. NO. 9325  102-ArgIleLeuGlyGlyValPheGlyAlaLeu-111
SEQ. ID. NO. 9326  130-ProAspThrGluGlu-134
Antigenic Index - Jameson-Wolf
SEQ. ID. NO. 9327  125-SerLysThrAspLeuProAspThrGluGluTrpArgGlnSerTyrTh-140
SEQ. ID. NO. 9328  154-HisSerGlyGlyThrAlaGluThrProGluAspAsp-165
Hydrophilic Regions - Hopp-Woods
SEQ. ID. NO. 9329  125-SerLysThrAspLeuProAspThrGluGluTrpArgGln-137
SEQ. ID. NO. 9330  157-GlyThrAlaGluThrProGluAspAsp-165
681-2
AMPHI Regions - AMPHI
SEQ. ID. NO. 9331  12-PheSerGluGluAlaLysPheIleSerAlaMet-22
SEQ. ID. NO. 9332  120-CysLeuArgValGlyArgAlaValArgArg-129
Antigenic Index - Jameson-Wolf
SEQ. ID. NO. 9333  9-AlaSerAsnPheSerGluGluAlaLysPhe-18
SEQ. ID. NO. 9334  39-AlaThrProAsnSerTrpArgValArgGlnGln-49
SEQ. ID. NO. 9335  59-LeuValLysArgAlaCys-64
SEQ. ID. NO. 9336  67-ProMetArgArgCysLeuProSerArgLeu-76
SEQ. ID. NO. 9337  90-GlyPheGlyMetProSerGluGly-97
SEQ. ID. NO. 9338  102-AlaAlaSerArgArgArgPheGlyMetCysArgLeuArgGlnAlaPrMetArgCysLeuArgValGlyArgAlaValArgArgPheGln-131
SEQ. ID. NO. 9339  134-PheTrpArgCysArgArgGly-140
Hydrophilic Regions - Hopp-Woods
SEQ. ID. NO. 9340  11-AsnPheSerGluGluAlaLysPhe-18
SEQ. ID. NO. 9341  44-TrpArgValArgGln-48
SEQ. ID. NO. 9342  59-LeuValLysArgAlaCys-64
SEQ. ID. NO. 9343  67-ProMetArgArgCysLeuPro-73
SEQ. ID. NO. 9344  102-AlaAlaSerArgArgArgPheGly-109
SEQ. ID. NO. 9345  112-ArgLeuArgGlnAlaPro-117

TABLE 1-continued

SEQ. ID. NO. 9346   119-ArgCysLeuArgValGlyArgAlaValArgArg-129
682-2
AMPHI Regions - AMPHI
SEQ. ID. NO. 9347   33-ArgLeuArgLysCysGlyArgIleLeuSerGlyIleCysGluProPhe-48
SEQ. ID. NO. 9348   99-CysArgLeuPheCysAspGly-105
Antigenic Index - Jameson-Wolf
SEQ. ID. NO. 9349   9-SerTyrGlyLysTrpArgLysAsnTrpAspIle-19
SEQ. ID. NO. 9350   30-SerSerThrArgLeuArgLysCysGlyArg-39
SEQ. ID. NO. 9351   69-ArgThrLeuArgLeuArgGlySerArgThrArg-79
SEQ. ID. NO. 9352   84-GlyProPheTrpPheCysHisArgProArgGlnSerHisGly-97
SEQ. ID. NO. 9353   102-PheCysAspGlySerMetAspGlnThrArgAspArgArgCysArgSer-117
SEQ. ID. NO. 9354   121-LeuHisSerAspArgTyrArgHisSerAsnLeuTrp-132
Hydrophilic Regions - Hopp-Woods
SEQ. ID. NO. 9355   12-LysTrpArgLysAsnTrpAsp-18
SEQ. ID. NO. 9356   32-ThrArgLeuArgLysCysGlyArg-39
SEQ. ID. NO. 9357   69-ArgThrLeuArgLeuArgGlySerArgThr-78
SEQ. ID. NO. 9358   91-ArgProArgGlnSerHisGly-97
SEQ. ID. NO. 9359   105-GlySerMetAspGlnThrArgAspArgArgCysArgSer-117
SEQ. ID. NO. 9360   122-HisSerAspArgTyrArgHis-128
683
AMPHI Regions - AMPHI
SEQ. ID. NO. 9361   26-ThrProAspLysSerAlaArgTrpGluAsnIleGlyThrIleSerAsn-41
SEQ. ID. NO. 9362   75-ArgPheAlaAsnThrPro-80
SEQ. ID. NO. 9363   101-SerSerLeuGlnLeuPhe-106
SEQ. ID. NO. 9364   124-ArgProMetSerIleLeuSerGly-131
Antigenic Index - Jameson-Wolf
SEQ. ID. NO. 9365   24-CysSerThrProAspLysSerAlaArgTrpGluAsn-35
SEQ. ID. NO. 9366   37-GlyThrIleSerAsnGly-42
SEQ. ID. NO. 9367   48-IleAsnLysAspSerValArgLysAsnGlyAsn-58
SEQ. ID. NO. 9368   63-GlnAspLysLysValValThrAsnLeuLysGlnGluArgPheAlaAsnThrProAlaTyr-82
SEQ. ID. NO. 9369   93-CysAsnAsnLysThrTyrArgLeu-100
SEQ. ID. NO. 9370   106-PheAspThrLysAsnThrGluIleSerThrGlnAsnTyrThrAlaSerSerLeuArgPro-125
SEQ. ID. NO. 9371   131-GlyThrLeuThrGluLysGlnTyrGlu-139
SEQ. ID. NO. 9372   141-ValCysGlyLysLysLeu-146
Hydrophilic Regions - Hopp-Woods
SEQ. ID. NO. 9373   25-SerThrProAspLysSerAlaArgTrpGluAsn-35
SEQ. ID. NO. 9374   48-IleAsnLysAspSerValArgLysAsnGly-57
SEQ. ID. NO. 9375   63-GlnAspLysLysValValThr-69
SEQ. ID. NO. 9376   71-LeuLysGlnGluArgPheAla-77
SEQ. ID. NO. 9377   107-AspThrLysAsnThrGluIleSer-114
SEQ. ID. NO. 9378   133-LeuThrGluLysGlnTyrGlu-139
SEQ. ID. NO. 9379   141-ValCysGlyLysLysLeu-146
684
AMPHI Regions - AMPHI
SEQ. ID. NO. 9380   13-AlaAlaCysGlyThrValGln-19
SEQ. ID. NO. 9381   47-LeuAlaGluProLeu-51
SEQ. ID. NO. 9382   73-TrpAlaAspThrLeuAspAspMetLeuGluAlaAlaLeuSerAsnAlaPheAsnArgLeuAspSerThr-95
SEQ. ID. NO. 9383   110-TrpThrValTyrIleAspAlaPheGlnGlySerTyr-121
SEQ. ID. NO. 9384   154-AlaMetThrAlaAlaLeuGluGlnGlyLeuLysGlnAlaAlaGlnGlnMetVal-171
Antigenic Index - Jameson-Wolf
SEQ. ID. NO. 9385   26-LeuProAspSerArgTyrIleArgProAlaThrGlnGlyGlyGluThrAlaValGluValArgLeuAlaGluProLeuLysArgGlyGlyLeu-56
SEQ. ID. NO. 9386   60-ThrAspProTyrArgLeuAsnThrAlaGln-69
SEQ. ID. NO. 9387   76-ThrLeuAspAspMetLeuGlu-82
SEQ. ID. NO. 9388   90-AsnArgLeuAspSerThrArg-96
SEQ. ID. NO. 9389   101-AlaSerArgSerGlySerThrGluLys-109
SEQ. ID. NO. 9390   117-PheGlnGlySerTyrThrGlyLysThrLeu-126
SEQ. ID. NO. 9391   133-LeuProAspGlyThrAsnArgProPheHisIleGluThrGluGlnGlnGlyAspGlyTyrAla-153
SEQ. ID. NO. 9392   161-GlnGlyLeuLysGlnAlaAla-167
Hydrophilic Regions - Hopp-Woods
SEQ. ID. NO. 9393   27-ProAspSerArgTyrIleArg-33
SEQ. ID. NO. 9394   35-AlaThrGlnGlyGlyGluThrAlaValGluValArgLeuAlaGluProLeuLysArgGlyGly-55
SEQ. ID. NO. 9395   76-ThrLeuAspAspMetLeuGlu-82
SEQ. ID. NO. 9396   90-AsnArgLeuAspSer-94
SEQ. ID. NO. 9397   102-SerArgSerGlySerThrGluLys-109
SEQ. ID. NO. 9398   141-PheHisIleGluThrGluGlnGlnGlyAsp-150
SEQ. ID. NO. 9399   161-GlnGlyLeuLysGlnAlaAla-167
685
AMPHI Regions - AMPHI
SEQ. ID. NO. 9400   7-AsnPheAlaPheCysGlyValVal-14
SEQ. ID. NO. 9401   44-CysAlaValLeuLeu-48
SEQ. ID. NO. 9402   94-TrpAlaAlaLeuAspThrLeuThrGluLeu-103
SEQ. ID. NO. 9403   137-TyrGluAlaLeuHisArgTyr-143
SEQ. ID. NO. 9404   154-GlyAlaGluAlaTyrGluGlnLeuAlaLysAsn-164
SEQ. ID. NO. 9405   182-GluLysGlnMetGluThrLeuAlaArgIlePheGlyLysGlu-195
SEQ. ID. NO. 9406   206-AspAlaLeuPheAla-210
SEQ. ID. NO. 9407   296-AlaValGluValLeuAspAsnAlaLeuVal-305
SEQ. ID. NO. 9408   336-AlaAlaGluGlnLeuLysAlaAla-343
Antigenic Index - Jameson-Wolf
SEQ. ID. NO. 9409   20-LeuAsnAsnLysHisSerTyrSerTyrAlaLysGluProHisThrValLysProArgPhe-39
SEQ. ID. NO. 9410   52-SerProGluProAlaAlaGluLysThrValSer-62

TABLE 1-continued

| | |
|---|---|
| SEQ. ID. NO. 9411 | 74-ProThrAlaArgGlyAspAlaValValProLysAsnProGluArgValAla-90 |
| SEQ. ID. NO. 9412 | 122-AlaPheAspLysAlaAla-127 |
| SEQ. ID. NO. 9413 | 133-PheGluProAspTyrGluAlaLeuHisArgTyrAsn-144 |
| SEQ. ID. NO. 9414 | 151-GlyGlyProGlyAlaGluAlaTyrGluGlnLeuAlaLysAsnAlaThr-166 |
| SEQ. ID. NO. 9415 | 170-LeuThrValAspAsnGlyAsnIleArgThrSerGlyGluLysGlnMetGluThrLeu-188 |
| SEQ. ID. NO. 9416 | 192-PheGlyLysGluAlaArgAlaAlaGluLeuLysAlaGlnIle-205 |
| SEQ. ID. NO. 9417 | 211-GlnThrArgGluAlaAlaLysGlyLysGlyArgGlyLeu-223 |
| SEQ. ID. NO. 9418 | 227-ValThrGlyAsnLysValSerAlaPheGlyThrGlnSerArgLeu-241 |
| SEQ. ID. NO. 9419 | 247-GlyAspIleGlyLeuProProValAspGluSerLeuArgAsnGluGlyHisGlyGln-265 |
| SEQ. ID. NO. 9420 | 271-TyrIleLysGluLysAsnProAspTrpIle-280 |
| SEQ. ID. NO. 9421 | 285-ArgThrAlaAlaIleGlyGlnGluGlyProAla-295 |
| SEQ. ID. NO. 9422 | 307-GlyThrAsnAlaTrpLysArgLysGln-315 |
| SEQ. ID. NO. 9423 | 338-GluGlnLeuLysAlaAlaPheLysLysAlaGluPro-349 |
| SEQ. ID. NO. 9424 | 351-AlaAlaGlyLysLys-355 |
| Hydrophilic Regions - Hopp-Woods | |
| SEQ. ID. NO. 9425 | 28-TyrAlaLysGluProHisThrValLys-36 |
| SEQ. ID. NO. 9426 | 52-SerProGluProAlaAlaGluLysThrValSer-62 |
| SEQ. ID. NO. 9427 | 75-ThrAlaArgGlyAspAlaValVal-82 |
| SEQ. ID. NO. 9428 | 84-LysAsnProGluArgValAla-90 |
| SEQ. ID. NO. 9429 | 122-AlaPheAspLysAlaAla-127 |
| SEQ. ID. NO. 9430 | 135-ProAspTyrGluAla-139 |
| SEQ. ID. NO. 9431 | 156-GluAlaTyrGluGlnLeuAlaLys-163 |
| SEQ. ID. NO. 9432 | 175-GlyAsnIleArgThrSerGlyGluLysGlnMetGluThrLeu-188 |
| SEQ. ID. NO. 9433 | 192-PheGlyLysGluAlaArgAlaAlaGluLeuLysAlaGlnIle-205 |
| SEQ. ID. NO. 9434 | 211-GlnThrArgGluAlaAlaLysGlyLysGlyArgGly-222 |
| SEQ. ID. NO. 9435 | 253-ProValAspGluSerLeuArgAsnGluGlyHisGly-264 |
| SEQ. ID. NO. 9436 | 271-TyrIleLysGluLysAsnPro-277 |
| SEQ. ID. NO. 9437 | 290-GlyGlnGluGlyProAla-295 |
| SEQ. ID. NO. 9438 | 309-AsnAlaTrpLysArgLysGln-315 |
| SEQ. ID. NO. 9439 | 338-GluGlnLeuLysAlaAlaPheLysLysAlaGluPro-349 |
| SEQ. ID. NO. 9440 | 351-AlaAlaGlyLysLys-355 |
| 686-2 | |
| AMPHI Regions - AMPHI | |
| SEQ. ID. NO. 9441 | 7-ValLeuGlyGlyIleAlaAlaLeu-14 |
| SEQ. ID. NO. 9442 | 39-GlySerLeuIleGluArgIleAsnAsn-47 |
| SEQ. ID. NO. 9443 | 146-SerAsnIleLysSerIleAlaAspIleLysGlyValLysThrAlaGlnSerLeuThrSerAsnTyr-167 |
| SEQ. ID. NO. 9444 | 179-ValAlaValAspGlyLeuAlaGlnSerLeu-188 |
| SEQ. ID. NO. 9445 | 204-LeuAlaValLeuAspTyrLeuLysLysAsnPro-214 |
| SEQ. ID. NO. 9446 | 241-AspGluAlaValAlaLysPheSerThrAlaIle-251 |
| SEQ. ID. NO. 9447 | 255-LysAlaAspGlyThrLeuLysLysLeuGlyGluGlnPhe-267 |
| Antigenic Index - Jameson-Wolf | |
| SEQ. ID. NO. 9448 | 20-GlyGlySerGluGlyGlyGlySerGlyAlaSerSerAlaProAlaGlnSerAlaVal-37 |
| SEQ. ID. NO. 9449 | 40-SerLeuIleGluArgIleAsnAsnLysGlyThrVal-51 |
| SEQ. ID. NO. 9450 | 54-GlyThrGluGlyThr-58 |
| SEQ. ID. NO. 9451 | 64-TyrHisAspLysAspGlyLysLeuThrGlyTyrAspValGluValThrArgAlaValAlaGluLysLeuGlyVal-88 |
| SEQ. ID. NO. 9452 | 90-ValGluPheLysGluThrGlnTrp-97 |
| SEQ. ID. NO. 9453 | 118-LeuThrSerProGluArgGlnAlaThrPheAspLysSerAspProTyrSerTrp-135 |
| SEQ. ID. NO. 9454 | 143-ArgAsnAspSerAsnIleLysSerIleAlaAspIleLysGlyValLysThrAlaGln-161 |
| SEQ. ID. NO. 9455 | 163-LeuThrSerAsnTyrGlyGluLysAlaLysAlaAlaGly-175 |
| SEQ. ID. NO. 9456 | 191-IleGluGlnLysArgAlaAspAlaThrLeuAsnAspGluLeuAla-205 |
| SEQ. ID. NO. 9457 | 209-TyrLeuLysLysAsnProAsnAlaGly-217 |
| SEQ. ID. NO. 9458 | 225-ProAlaAspGluLysValGlySer-232 |
| SEQ. ID. NO. 9459 | 235-IleValAsnLysGlyAsnAspGluAlaValAla-245 |
| SEQ. ID. NO. 9460 | 252-AsnGluLeuLysAlaAspGlyThrLeuLysLysLeuGly-264 |
| SEQ. ID. NO. 9461 | 267-PhePheGlyLysAspIleSerValGln-275 |
| Hydrophilic Regions - Hopp-Woods | |
| SEQ. ID. NO. 9462 | 20-GlyGlySerGluGlyGlySerGly-27 |
| SEQ. ID. NO. 9463 | 41-LeuIleGluArgIleAsnAsn-47 |
| SEQ. ID. NO. 9464 | 64-TyrHisAspLysAspGlyLysLeuThrGlyTyrAspValGluValThrArgAlaValAlaGluLysLeuGlyVal-88 |
| SEQ. ID. NO. 9465 | 90-ValGluPheLysGluThrGlnTrp-97 |
| SEQ. ID. NO. 9466 | 120-SerProGluArgGlnAlaThrPheAspLysSerAspPro-132 |
| SEQ. ID. NO. 9467 | 143-ArgAsnAspSerAsnIle-148 |
| SEQ. ID. NO. 9468 | 150-SerIleAlaAspIleLysGlyValLysThr-159 |
| SEQ. ID. NO. 9469 | 167-TyrGlyGluLysAlaLysAlaAlaGly-175 |
| SEQ. ID. NO. 9470 | 191-IleGluGlnLysArgAlaAspAlaThrLeuAsnAspGluLeuAla-205 |
| SEQ. ID. NO. 9471 | 209-TyrLeuLysLysAsnProAsnAla-216 |
| SEQ. ID. NO. 9472 | 225-ProAlaAspGluLysValGly-231 |
| SEQ. ID. NO. 9473 | 238-LysGlyAsnAspGluAlaValAla-245 |
| SEQ. ID. NO. 9474 | 252-AsnGluLeuLysAlaAspGlyThrLeuLysLysLeuGly-264 |
| 687 | |
| AMPHI Regions - AMPHI | |
| SEQ. ID. NO. 9475 | 11-AlaAlaLeuPheAlaLeu-16 |
| SEQ. ID. NO. 9476 | 64-LysValGluValLeuGluPhePheGlyTyrPheCysPro-76 |
| SEQ. ID. NO. 9477 | 78-CysAlaHisLeuGluProValLeuSerLysHisAlaLysSerPhe-92 |
| SEQ. ID. NO. 9478 | 112-LeuAlaArgLeuAlaAlaAla-118 |
| SEQ. ID. NO. 9479 | 148-ProGluValLeuLysLysTrpLeu-155 |
| SEQ. ID. NO. 9480 | 176-GlnAlaArgAlaAspLysMetGlnGluLeuThrGluThrPhe-189 |
| Antigenic Index - Jameson-Wolf | |
| SEQ. ID. NO. 9481 | 1-MetLysSerArgHis-5 |
| SEQ. ID. NO. 9482 | 19-CysAspSerLysValGlnThrSerValProAlaAspSerAlaPro-33 |

TABLE 1-continued

| SEQ. ID. NO. 9483 | 43-GlyLeuValGluGlyGlnAsnTyr-50 |
| SEQ. ID. NO. 9484 | 56-ProIleProGlnGlnGlnAlaGlyLysValGluVal-67 |
| SEQ. ID. NO. 9485 | 87-LysHisAlaLysSerPheLysAspAspMetTyrLeu-98 |
| SEQ. ID. NO. 9486 | 122-AlaAlaAlaAspSerLysAspValAlaAsn-131 |
| SEQ. ID. NO. 9487 | 141-GlnLysIleLysLeuGlnAsnProGluValLeuLys-152 |
| SEQ. ID. NO. 9488 | 159-ThrAlaPheAspGlyLysLysVal-166 |
| SEQ. ID. NO. 9489 | 171-GluSerProGluSerGlnAlaArgAlaAspLysMetGlnGluLeuThrGlu-187 |
| SEQ. ID. NO. 9490 | 189-PheGlnIleAspGlyThrPro-195 |
| SEQ. ID. NO. 9491 | 199-ValGlyGlyLysTyrLysValGluPheAlaAsp-209 |
| SEQ. ID. NO. 9492 | 211-GluSerGlyMetAsnThr-216 |
| SEQ. ID. NO. 9493 | 220-LeuAlaAspLysValArgGluGluGlnLysAlaAlaGln-232 |

Hydrophilic Regions - Hopp-Woods
| SEQ. ID. NO. 9494 | 1-MetLysSerArgHis-5 |
| SEQ. ID. NO. 9495 | 19-CysAspSerLysValGlnThr-25 |
| SEQ. ID. NO. 9496 | 27-ValProAlaAspSerAlaPro-33 |
| SEQ. ID. NO. 9497 | 61-GlnAlaGlyLysValGluVal-67 |
| SEQ. ID. NO. 9498 | 87-LysHisAlaLysSerPheLysAspAspMetTyrLeu-98 |
| SEQ. ID. NO. 9499 | 122-AlaAlaAlaAspSerLysAspValAla-130 |
| SEQ. ID. NO. 9500 | 141-GlnLysIleLysLeuGlnAsn-147 |
| SEQ. ID. NO. 9501 | 159-ThrAlaPheAspGlyLysLysVal-166 |
| SEQ. ID. NO. 9502 | 171-GluSerProGluSerGlnAlaArgAlaAspLysMetGlnGluLeuThrGlu-187 |
| SEQ. ID. NO. 9503 | 201-GlyLysTyrLysValGluPheAlaAsp-209 |
| SEQ. ID. NO. 9504 | 220-LeuAlaAspLysValArgGluGluGlnLysAlaAlaGln-232 |

688
AMPHI Regions - AMPHI
| SEQ. ID. NO. 9505 | 23-LeuSerAlaLeuLeuGlyLeu-29 |
| SEQ. ID. NO. 9506 | 121-AspValLeuGlnAsnAlaAlaGluAlaLeuLysAsp-132 |

Antigenic Index - Jameson-Wolf
| SEQ. ID. NO. 9507 | 4-TyrProSerArgPheAlaGln-10 |
| SEQ. ID. NO. 9508 | 13-IleSerValAsnLys-17 |
| SEQ. ID. NO. 9509 | 33-SerAlaGluArgValSer-38 |
| SEQ. ID. NO. 9510 | 47-IleIleGlnGlyAsnGluLeuGluProArgAla-57 |
| SEQ. ID. NO. 9511 | 62-ArgProGlyMetThrLysAspGln-69 |
| SEQ. ID. NO. 9512 | 82-AlaPheHisThrAspArgTrpAspTyr-90 |
| SEQ. ID. NO. 9513 | 92-PheAsnThrSerArgAsnGlyIleIleLysGluArgSerAsnLeu-106 |
| SEQ. ID. NO. 9514 | 116-ValArgThrGluGlyAspVal-122 |
| SEQ. ID. NO. 9515 | 126-AlaAlaGluAlaLeuLysAspArgGlnAsnThrAspLysPro-139 |

Hydrophilic Regions - Hopp-Woods
| SEQ. ID. NO. 9516 | 33-SerAlaGluArgValSer-38 |
| SEQ. ID. NO. 9517 | 51-AsnGluLeuGluProArgAla-57 |
| SEQ. ID. NO. 9518 | 64-GlyMetThrLysAspGln-69 |
| SEQ. ID. NO. 9519 | 98-GlyIleIleLysGluArgSerAsn-105 |
| SEQ. ID. NO. 9520 | 116-ValArgThrGluGlyAspVal-122 |
| SEQ. ID. NO. 9521 | 126-AlaAlaGluAlaLeuLysAspArgGlnAsnThrAspLysPro-139 |

689
AMPHI Regions - AMPHI
| SEQ. ID. NO. 9522 | 55-TyrProGluMetSerGluLysLeuMet-63 |
| SEQ. ID. NO. 9523 | 65-ValLeuMetAlaMetLeuValThrLeu-73 |
| SEQ. ID. NO. 9524 | 82-LeuProAlaIleProGluMetAlaGln-90 |
| SEQ. ID. NO. 9525 | 111-AlaPheGlyGlnValValGlyGly-118 |
| SEQ. ID. NO. 9526 | 123-IleLysGlyArgLys-127 |
| SEQ. ID. NO. 9527 | 154-LeuAsnLeuArgValValGlnAlaPheGlyAlaGly-165 |
| SEQ. ID. NO. 9528 | 188-PheAlaLeuIleGlyIleIleLeu-195 |
| SEQ. ID. NO. 9529 | 203-ProMetValGlyAlaLeuLeuGlnGlyLeuGlyGlyTrpGlnAlaIlePheVal-220 |
| SEQ. ID. NO. 9530 | 230-LeuGlyLeuValGlnTyrPhe-236 |
| SEQ. ID. NO. 9531 | 245-LysIleGlyArgAspVal-250 |
| SEQ. ID. NO. 9532 | 257-ArgPheLysArgValLeu-262 |
| SEQ. ID. NO. 9533 | 277-SerPheGlySerMetPheAla-283 |
| SEQ. ID. NO. 9534 | 293-GlnGlnLeuTyrArgVal-298 |
| SEQ. ID. NO. 9535 | 344-AlaAlaAsnLeuSerGlnLeuAlaAlaValLeuPhe-355 |
| SEQ. ID. NO. 9536 | 400-ValLeuGlyValPheGlnSerLeuIleGly-409 |

Antigenic Index - Jameson-Wolf
| SEQ. ID. NO. 9537 | 36-PheArgArgArgAlaVal-41 |
| SEQ. ID. NO. 9538 | 45-IleGlyArgGluPheMetProSer-52 |
| SEQ. ID. NO. 9539 | 57-GluMetSerGluLysLeu-62 |
| SEQ. ID. NO. 9540 | 95-AspValHisArgIleGluGln-101 |
| SEQ. ID. NO. 9541 | 119-SerValSerAspIleLysGlyArgLysProVal-129 |
| SEQ. ID. NO. 9542 | 174-MetValArgAspTyrTyrSerGlyArgLysAlaAla-185 |
| SEQ. ID. NO. 9543 | 238-ProLysProAlaValGlyGlyLysIleGlyArgAspValPhe-251 |
| SEQ. ID. NO. 9544 | 257-ArgPheLysArgValLeuLysThrArgAla-266 |
| SEQ. ID. NO. 9545 | 325-LeuLysThrGlyValHis-330 |
| SEQ. ID. NO. 9546 | 390-PheLysGluGluGlyGlySer-396 |
| SEQ. ID. NO. 9547 | 448-ArgAlaTrpLysGluAsnGlyGlnSerGluTyrLeu-459 |

Hydrophilic Regions - Hopp-Woods
| SEQ. ID. NO. 9548 | 36-PheArgArgArgAlaVal-41 |
| SEQ. ID. NO. 9549 | 45-IleGlyArgGluPheMet-50 |
| SEQ. ID. NO. 9550 | 57-GluMetSerGluLysLeu-62 |
| SEQ. ID. NO. 9551 | 95-AspValHisArgIleGluGln-101 |
| SEQ. ID. NO. 9552 | 119-SerValSerAspIleLysGlyArgLysProVal-129 |
| SEQ. ID. NO. 9553 | 178-TyrTyrSerGlyArgLysAlaAla-185 |

TABLE 1-continued

| | |
|---|---|
| SEQ. ID. NO. 9554 | 245-LysIleGlyArgAspVal-250 |
| SEQ. ID. NO. 9555 | 257-ArgPheLysArgValLeuLysThrArgAla-266 |
| SEQ. ID. NO. 9556 | 390-PheLysGluGluGlyGlySer-396 |
| SEQ. ID. NO. 9557 | 448-ArgAlaTrpLysGluAsnGlyGln-455 |

690
AMPHI Regions - AMPHI

| | |
|---|---|
| SEQ. ID. NO. 9558 | 38-SerSerAlaSerSerAla-43 |
| SEQ. ID. NO. 9559 | 54-SerAlaProAspAsnValLysGlnAla-62 |
| SEQ. ID. NO. 9560 | 68-SerAsnCysThrSerLeuHisProAlaThrGlyIleAspAspLeuMetGlnGlnIleAlaGluHisIle-90 |
| SEQ. ID. NO. 9561 | 113-GlyTyrAspAsnIleGlnArgLeu-120 |
| SEQ. ID. NO. 9562 | 148-ArgThrIleSerArgGlnAlaGlnAsnAla-157 |
| SEQ. ID. NO. 9563 | 186-ProLysArgThrArgTyrPhe-192 |
| SEQ. ID. NO. 9564 | 210-GlyAsnPheGlnTyrIleSerGlnLeuProGlyTyrLeuLys-223 |

Antigenic Index - Jameson-Wolf

| | |
|---|---|
| SEQ. ID. NO. 9565 | 1-MetLysAsnLysThrSer-6 |
| SEQ. ID. NO. 9566 | 20-CysSerProSerLysAspAspLysThrLysGluValGlyAla-33 |
| SEQ. ID. NO. 9567 | 37-SerSerSerAlaSerSerAlaProSerGlnThrAspLeuGlnProThrAlaSerAlaProAspAsnValLysGlnAlaGluSerAlaProProSerAsnCys-70 |
| SEQ. ID. NO. 9568 | 76-AlaThrGlyIleAspAspLeuMet-83 |
| SEQ. ID. NO. 9569 | 88-GluHisIleAspSerAspCys-94 |
| SEQ. ID. NO. 9570 | 101-HisGluLeuGluThrArgPheGlyLeuProAspGlyGlyTyrAspAsnIleGln-118 |
| SEQ. ID. NO. 9571 | 123-ProAspIleArgProGluAspProAspTyrHisGln-134 |
| SEQ. ID. NO. 9572 | 141-GluAspLeuArgTyrGlyLysArgThrIleSerArgGlnAlaGln-155 |
| SEQ. ID. NO. 9573 | 159-MetGluGlnGluArgArgLeuArgGlu-167 |
| SEQ. ID. NO. 9574 | 175-GlySerGlnGluThrArgGlyGlnGlyGluGluProLysArgThrArgTyr-191 |
| SEQ. ID. NO. 9575 | 196-AlaThrProAlaTyrSerSerArgHisAsnAsnGlyLeuGlyGly-210 |
| SEQ. ID. NO. 9576 | 225-HisGlyGluMetLeuGluAsnGlnSerLeu-234 |
| SEQ. ID. NO. 9577 | 236-ArgLeuSerAsnArgGluArgAsnProAspLysProPheLeu-249 |
| SEQ. ID. NO. 9578 | 252-HisPheAspGluAsnGlyLysIleThr-260 |
| SEQ. ID. NO. 9579 | 264-ValTyrGluLysAsnIle-269 |
| SEQ. ID. NO. 9580 | 272-AsnProAsnThrGlyArgIle-278 |

Hydrophilic Regions - Hopp-Woods

| | |
|---|---|
| SEQ. ID. NO. 9581 | 1-MetLysAsnLysThr-5 |
| SEQ. ID. NO. 9582 | 21-SerProSerLysAspAspLysThrLysGluValGlyAla-33 |
| SEQ. ID. NO. 9583 | 39-SerAlaSerSerAlaProSerGlnThrAspLeuGlnPro-51 |
| SEQ. ID. NO. 9584 | 54-SerAlaProAspAsnValLysGlnAlaGluSerAlaPro-66 |
| SEQ. ID. NO. 9585 | 78-GlyIleAspAspLeuMet-83 |
| SEQ. ID. NO. 9586 | 88-GluHisIleAspSer-92 |
| SEQ. ID. NO. 9587 | 101-HisGluLeuGluThr-105 |
| SEQ. ID. NO. 9588 | 125-IleArgProGluAspProAspTyrHis-133 |
| SEQ. ID. NO. 9589 | 141-GluAspLeuArgTyrGlyLysArgThrIleSerArgGlnAlaGln-155 |
| SEQ. ID. NO. 9590 | 159-MetGluGlnGluArgArgLeuArgGlu-167 |
| SEQ. ID. NO. 9591 | 175-GlySerGlnGluThrArgGlyGlnGlyGluGluProLysArgThrArgTyr-191 |
| SEQ. ID. NO. 9592 | 200-TyrSerSerArgHisAsnAsn-206 |
| SEQ. ID. NO. 9593 | 225-HisGlyGluMetLeuGlu-230 |
| SEQ. ID. NO. 9594 | 237-LeuSerAsnArgGluArgAsnProAspLysProPhe-248 |
| SEQ. ID. NO. 9595 | 252-HisPheAspGluAsnGlyLysIleThr-260 |
| SEQ. ID. NO. 9596 | 274-AsnThrGlyArgIle-278 |

691
AMPHI Regions - AMPHI

| | |
|---|---|
| SEQ. ID. NO. 9597 | 11-LysProAlaAlaSer-15 |
| SEQ. ID. NO. 9598 | 55-HisAsnGluLeuArgLysIleArgThrAla-64 |
| SEQ. ID. NO. 9599 | 108-ArgTyrLeuSerGly-112 |

Antigenic Index - Jameson-Wolf

| | |
|---|---|
| SEQ. ID. NO. 9600 | 7-CysArgPheAlaLys-11 |
| SEQ. ID. NO. 9601 | 35-ProProAsnAspPheGlnProAsnCysAspIleArgArgLeuGlyLeuThrGlnSerGlnHisAsnGluLeuArgLysIleArgThr-63 |
| SEQ. ID. NO. 9602 | 67-MetAlaGlyAspArgAlaArgLeuLysValMetHis-78 |
| SEQ. ID. NO. 9603 | 80-GluHisSerArgArgArgSerVal-87 |
| SEQ. ID. NO. 9604 | 91-IleSerSerAspValPheAsnArgAsnGluAlaArgAspTyrValGluSerArgTyrLeuSerGlyMetAspPheAlaValAspGluLeuGluIle-122 |
| SEQ. ID. NO. 9605 | 131-ThrProGlnGlnGlnGln-136 |
| SEQ. ID. NO. 9606 | 140-SerSerCysLeuLys-144 |

Hydrophilic Regions - Hopp-Woods

| | |
|---|---|
| SEQ. ID. NO. 9607 | 43-CysAspIleArgArgLeuGly-49 |
| SEQ. ID. NO. 9608 | 54-GlnHisAsnGluLeuArgLysIleArgThr-63 |
| SEQ. ID. NO. 9609 | 67-MetAlaGlyAspArgAlaArgLeuLysValMetHis-78 |
| SEQ. ID. NO. 9610 | 80-GluHisSerArgArgArgSerVal-87 |
| SEQ. ID. NO. 9611 | 95-ValPheAsnArgAsnGluAlaArgAspTyrValGlu-106 |
| SEQ. ID. NO. 9612 | 115-PheAlaValAspGluLeuGluIle-122 |

692
AMPHI Regions - AMPHI

| | |
|---|---|
| SEQ. ID. NO. 9613 | 6-CysArgCysSerGluSerIleArgArgIleArgArgAsn-18 |
| SEQ. ID. NO. 9614 | 77-LeuGlyTyrValPheLysProLeuAlaValPheVal-88 |
| SEQ. ID. NO. 9615 | 106-GlnGlyPheGlyGlnLeuHis-112 |
| SEQ. ID. NO. 9616 | 132-ThrArgGlnLeuArgGlyPheLys-139 |
| SEQ. ID. NO. 9617 | 143-PheAspProGlnValLeuGly-150 |
| SEQ. ID. NO. 9618 | 170-GlnPheValGluHisHis-175 |
| SEQ. ID. NO. 9619 | 177-AspAlaGlyValValArgValValGlyArgGlyTyrGlyAlaAlaValPheAspPhePheGlnArgPheGlnLeu-202 |
| SEQ. ID. NO. 9620 | 205-ValGlnSerGlnArgArgGlyArgHisLeuGluAspPheGlyAsp-219 |
| SEQ. ID. NO. 9621 | 253-IleValGlyLysLeuAspGlnPheAspGlyVal-263 |
| SEQ. ID. NO. 9622 | 275-PheAspHisIleAlaGluValAlaAsp-283 |

TABLE 1-continued

Antigenic Index - Jameson-Wolf
SEQ. ID. NO. 9623    6-CysArgCysSerGluSerIleArgArgIleArgArgAsnGlyArgGluTrpArgIleLysGlyGlnLysCysArgLeuAsnThrAspThrValGln-37
SEQ. ID. NO. 9624    89-GlyGlyPheAspGlyArgProValAspIleGlyLysAlaArgPheLeu-104
SEQ. ID. NO. 9625    120-AlaValAspAspGlyLysIle-126
SEQ. ID. NO. 9626    131-AlaThrArgGlnLeuArgGlyPheLysLeuAspAspPheAsp-144
SEQ. ID. NO. 9627    150-GlyAspValArgPheGlyCysGlyGlnArgIleAspAla-162
SEQ. ID. NO. 9628    174-HisHisGlnAspAlaGlyGluValGlyArgValValGlyArgGlyTyr-189
SEQ. ID. NO. 9629    204-ArgValGlnSerGlnArgArgGlyArgHisLeuGluAspPheGlyAsp-219
SEQ. ID. NO. 9630    236-GluAspValAspVal-240
SEQ. ID. NO. 9631    255-GlyLysLeuAspGlnPheAspGly-262
SEQ. ID. NO. 9632    279-AlaGluValAlaAspGlyArgAlaGluAspAspPhePhePhe-292
SEQ. ID. NO. 9633    295-AlaValValGlyGlyGlyArgSerGlyCysGlyGlyArg-307
SEQ. ID. NO. 9634    313-AlaAlaGlyGlyGluAspGluArgGluCysGlyGlyGlyLysGlyPheGluGlu-330
Hydrophilic Regions - Hopp-Woods
SEQ. ID. NO. 9635    7-ArgCysSerGluSerIleArgArgIleArgArgAsnGlyArgGluTrpArgIleLysGlyGlnLysCysArgLeuAsnThr-33
SEQ. ID. NO. 9636    91-PheAspGlyArgProValAspIleGlyLys-100
SEQ. ID. NO. 9637    120-AlaValAspAspGlyLysIle-126
SEQ. ID. NO. 9638    131-AlaThrArgGlnLeuArgGlyPheLysLeuAspAspPheAsp-144
SEQ. ID. NO. 9639    174-HisHisGlnAspAlaGlyGluValGlyArgValValGly-186
SEQ. ID. NO. 9640    206-GlnSerGlnArgArgGlyArgHisLeuGluAspPheGlyAsp-219
SEQ. ID. NO. 9641    236-GluAspValAspVal-240
SEQ. ID. NO. 9642    256-LysLeuAspGlnPheAsp-261
SEQ. ID. NO. 9643    279-AlaGluValAlaAspGlyArgAlaGluAspAspPhePhePhe-292
SEQ. ID. NO. 9644    299-GlyGlyArgSerGlyCysGlyGly-306
SEQ. ID. NO. 9645    315-GlyGlyGluAspGluArgGluCysGlyGly-324
SEQ. ID. NO. 9646    326-LysGlyPheGluGlu-330
694
AMPHI Regions - AMPHI
SEQ. ID. NO. 9647    82-ArgGlyArgAlaCysArg-87
SEQ. ID. NO. 9648    116-CysArgHisPheAlaGln-121
SEQ. ID. NO. 9649    123-ValAlaValGlyArgIleGly-129
SEQ. ID. NO. 9650    140-PheCysGlnLeuPheAsp-145
SEQ. ID. NO. 9651    156-AspIlePheLeuVal-160
SEQ. ID. NO. 9652    162-IleAlaAspIleGlyGlu-167
SEQ. ID. NO. 9653    184-ArgGlyLeuAlaAspIleGlyGluPheValGlyValSerAsp-197
SEQ. ID. NO. 9654    251-HisGlnArgAlaSerArgIleLys-258
SEQ. ID. NO. 9655    283-ArgAlaArgArgHisPheArgGlnValPheAsn-293
SEQ. ID. NO. 9656    311-AspPheValAlaHisIle-316
SEQ. ID. NO. 9657    340-AlaAlaArgIleGly-344
Antigenic Index - Jameson-Wolf
SEQ. ID. NO. 9658    3-SerAlaSerGlyThrArgGlnLysCysArgLeuLysProVal-16
SEQ. ID. NO. 9659    23-ProLysHisSerThrProAlaSer-30
SEQ. ID. NO. 9660    47-GlyGlnAspGluHisAsnAla-53
SEQ. ID. NO. 9661    66-ProProSerAlaTyrGly-71
SEQ. ID. NO. 9662    79-HisPheGlyArgGlyArgAlaCysArgTyr-88
SEQ. ID. NO. 9663    110-ArgIleAspSerAlaArgCysArgHis-118
SEQ. ID. NO. 9664    127-ArgIleGlyArgThrAspHisAsnHisAsp-136
SEQ. ID. NO. 9665    144-PheAspGlyGlyLeuProValGlyArgArgIleAla-155
SEQ. ID. NO. 9666    163-AlaAspIleGlyGluThrArgValGlnArgGlyAspAspValPhe-177
SEQ. ID. NO. 9667    180-IleAspArgGluArgGlyLeuAlaAsp-188
SEQ. ID. NO. 9668    202-HisIleSerAspArgPheAspGlnLysHisPheAlaArgArgLysLeuProHisArgSerPheAspLeu-224
SEQ. ID. NO. 9669    228-LeuMetProAspHisAspAspPheThr-236
SEQ. ID. NO. 9670    250-ArgHisGlnArgAlaSerArgIleLysHisAlaGluThrAlaLeu-264
SEQ. ID. NO. 9671    268-LeuProHisArgLeuArgTyrAla-275
SEQ. ID. NO. 9672    280-AsnGlnCysArgAlaArgArgHisPhe-288
SEQ. ID. NO. 9673    291-ValPheAsnLysHisArgThr-297
SEQ. ID. NO. 9674    316-IleAsnArgArgAlaGluLeu-322
SEQ. ID. NO. 9675    326-ThrPheAspAsnThrAspCysPro-333
SEQ. ID. NO. 9676    336-ThrSerAlaGluAlaAlaArgIleGlyLysAspAspGlyPhe-349
SEQ. ID. NO. 9677    370-TyrGlyGlyArgCysCysProThrProProThrProHisArgArgArg-385
Hydrophilic Regions - Hopp-Woods
SEQ. ID. NO. 9678    5-SerGlyThrArgGlnLysCysArgLeuLysPro-15
SEQ. ID. NO. 9679    47-GlyGlnAspGluHisAsnAla-53
SEQ. ID. NO. 9680    81-GlyArgGlyArgAlaCysArg-87
SEQ. ID. NO. 9681    110-ArgIleAspSerAlaArgCysArgHis-118
SEQ. ID. NO. 9682    127-ArgIleGlyArgThrAspHisAsnHis-135
SEQ. ID. NO. 9683    150-ValGlyArgArgIleAla-155
SEQ. ID. NO. 9684    163-AlaAspIleGlyGluThrArgValGlnArgGlyAspAsp-175
SEQ. ID. NO. 9685    180-IleAspArgGluArgGlyLeuAlaAsp-188
SEQ. ID. NO. 9686    202-HisIleSerAspArgPheAspGlnLysHisPheAlaArgArgLysLeuProHisArgSerPheAspLeu-224
SEQ. ID. NO. 9687    230-ProAspHisAspAsp-234
SEQ. ID. NO. 9688    250-ArgHisGlnArgAlaSerArgIleLysHisAlaGluThrAlaLeu-264
SEQ. ID. NO. 9689    280-AsnGlnCysArgAlaArgArgHisPhe-288
SEQ. ID. NO. 9690    292-PheAsnLysHisArg-296
SEQ. ID. NO. 9691    316-IleAsnArgArgAlaGluLeu-322
SEQ. ID. NO. 9692    327-PheAspAsnThrAsp-331
SEQ. ID. NO. 9693    338-AlaGluAlaAlaArgIleGlyLysAspAspGly-348
SEQ. ID. NO. 9694    380-ThrProHisArgArgArg-385
695

TABLE 1-continued

AMPHI Regions - AMPHI
SEQ. ID. NO. 9695    36-HisProGlnArgPheGlnSerLysProAlaGluArgProAlaHisArgPro-52
SEQ. ID. NO. 9696    129-ValArgLeuSerAsnGluValGlu-136
SEQ. ID. NO. 9697    144-AlaLeuGluHisAlaLysThrHisSer-152
SEQ. ID. NO. 9698    156-AlaTyrValGlnLysLeuAsp-162
SEQ. ID. NO. 9699    183-ValGluThrAlaGlnAsnLeuTyrAsnGlnAlaLeuLysHisTyrLysSerGly-200
SEQ. ID. NO. 9700    205-AlaAlaSerLeuLeuLysGlyAla-212
SEQ. ID. NO. 9701    238-CysGluSerValIleGluIle-244
SEQ. ID. NO. 9702    248-TyrAlaAsnArgPheLysAspSer-255
SEQ. ID. NO. 9703    278-AlaArgAlaThrTrpArgSerLeuIleGlnThrTyrProGly-291
Antigenic Index - Jameson-Wolf
SEQ. ID. NO. 9704    1-LeuProGlnThrArgProSerArgArgHisHisArgHisArgGlnTyrPheAlaGluArgLysGlyAspAlaArgSerGlyPhe-28
SEQ. ID. NO. 9705    31-AlaAlaGlnArgArgHisProGlnArgPheGlnSerLysProAlaGluArgProAlaHisArgProHisHisProAlaArgArgArgArgLeuAspPro
                     AlaSerGluLysIleMetLys-70
SEQ. ID. NO. 9706    83-SerAlaSerCysAlaSer-88
SEQ. ID. NO. 9707    93-ProAlaGlySerGlnThrGluMetSerThrArgGluAsnAlaSerAspGlyIleProTyr-112
SEQ. ID. NO. 9708    117-LeuGlnAspArgLeuAspTyrLeuGlu-125
SEQ. ID. NO. 9709    127-LysIleValArgLeuSerAsnGluValGluThrLeuAsnGlyLysValLysAlaLeuGluHisAlaLysThrHisSerSerGlyArgAlaTyrValGln
                     LysLeuAspAspArgLysLeuLysGlu-168
SEQ. ID. NO. 9710    170-TyrLeuAsnThrGluGlyGlySerAla-178
SEQ. ID. NO. 9711    193-AlaLeuLysHisTyrLysSerGlyLysPhe-202
SEQ. ID. NO. 9712    209-LeuLysGlyAlaAspGlyGlyAspGlyGlySerIleAlaGln-222
SEQ. ID. NO. 9713    230-GlnSerArgAlaArgMetGlyAsnCys-238
SEQ. ID. NO. 9714    244-IleGlyGlyArgTyrAlaAsnArgPheLysAspSerProThrAlaPro-259
SEQ. ID. NO. 9715    266-GlyGluCysGlnTyr-270
SEQ. ID. NO. 9716    272-LeuGlnGlnLysAspIleAla-278
SEQ. ID. NO. 9717    289-TyrProGlySerProAlaAlaLysArgAlaAlaAlaAlaValArgLysArg-305
Hydrophilic Regions - Hopp-Woods
SEQ. ID. NO. 9718    2-ProGlnThrArgProSerArgArgHisHisArgHisArgGlnTyrPheAlaGluArgLysGlyAspAlaArgSerGlyPhe-28
SEQ. ID. NO. 9719    31-AlaAlaGlnArgArgHisProGlnArgPheGlnSerLysProAlaGluArgProAlaHisArgProHisHisProAlaArgArgArgArgLeuAspPro
                     AlaSerGluLysIleMetLys-70
SEQ. ID. NO. 9720    96-SerGlnThrGluMetSerThrArgGluAsnAlaSerAsp-108
SEQ. ID. NO. 9721    117-LeuGlnAspArgLeuAspTyrLeuGlu-125
SEQ. ID. NO. 9722    127-LysIleValArgLeuSerAsnGluValGluThrLeuAsnGlyLysValLysAlaLeuGluHisAlaLysThrHisSerSerGly-154
SEQ. ID. NO. 9723    157-TyrValGlnLysLeuAspAspArgLysLeuLysGlu-168
SEQ. ID. NO. 9724    195-LysHisTyrLysSerGlyLysPhe-202
SEQ. ID. NO. 9725    210-LysGlyAlaAspGlyGlyAspGlyGlySerIleAlaGln-222
SEQ. ID. NO. 9726    231-SerArgAlaArgMetGlyAsn-237
SEQ. ID. NO. 9727    248-TyrAlaAsnArgPheLysAspSerProThrAlaPro-259
SEQ. ID. NO. 9728    266-GlyGluCysGlnTyr-270
SEQ. ID. NO. 9729    272-LeuGlnGlnLysAspIleAla-278
SEQ. ID. NO. 9730    293-ProAlaAlaLysArgAlaAlaAlaAlaValArgLysArg-305
696
AMPHI Regions - AMPHI
SEQ. ID. NO. 9731    18-PheGlyGlyIlePheHisPheValCysArgPheLeuSerArgValGlySerPheValGlnSerIlePheSerCysPheSer-44
SEQ. ID. NO. 9732    65-IlePheAspLeuValPhe-70
SEQ. ID. NO. 9733    94-GlyLeuAsnArgPheLeuAsnLeuLeuPheGlyPheLeuArg-107
Antigenic Index - Jameson-Wolf
SEQ. ID. NO. 9734    12-CysGlnGlyAsnLysLeu-17
SEQ. ID. NO. 9735    73-PheAspGlyArgSerGlyArgLeuGlyGlyArgSerArgSer-86
SEQ. ID. NO. 9736    108-ThrSerCysGlnGlySerArgHisHisCysGlyAsnGln-120
Hydrophilic Regions - Hopp-Woods
SEQ. ID. NO. 9737    73-PheAspGlyArgSerGlyArgLeuGlyGlyArgSerArgSer-86
SEQ. ID. NO. 9738    109-SerCysGlnGlySerArgHisHisCys-117
700
AMPHI Regions - AMPHI
SEQ. ID. NO. 9739    6-ThrLeuLeuSerValLeuIleProMetPheAlaGlyPhePheIleArgValProLys-24
SEQ. ID. NO. 9740    27-LeuProAlaLeuAspLysValLeuSerValLeu-37
SEQ. ID. NO. 9741    51-ArgValGluAspLeuGlySerArg-58
SEQ. ID. NO. 9742    80-AlaLeuAlaValLeuGlyLysLeu-87
SEQ. ID. NO. 9743    119-PheGlyLysLeuMetArgAsp-125
SEQ. ID. NO. 9744    191-SerTrpThrLysGlyLeu-196
SEQ. ID. NO. 9745    204-TrpTyrSerLeuSerGlyLeuVal-211
SEQ. ID. NO. 9746    216-TyrGlyAlaValTrp-220
SEQ. ID. NO. 9747    228-AspLeuAlaArgGluLeu-233
SEQ. ID. NO. 9748    268-GlyAlaGlyGlyLeu-272
Antigenic Index - Jameson-Wolf
SEQ. ID. NO. 9749    21-ArgValProLysProTyrLeu-27
SEQ. ID. NO. 9750    50-SerArgValGluAspLeuGlySerArgLeuAspAspMetAla-63
SEQ. ID. NO. 9751    90-TrpArgIleLysGlyLysGlyLysGlyVal-99
SEQ. ID. NO. 9752    128-MetProSerGluSerAlaGlyMetTyr-136
SEQ. ID. NO. 9753    149-LeuLysSerSerGlyValSerLeu-156
SEQ. ID. NO. 9754    160-LeuValAsnArgArgGlyIleArgLeu-168
SEQ. ID. NO. 9755    185-AlaSerThrAspGlyValSer-191
SEQ. ID. NO. 9756    245-ArgPheProAspAla-249
SEQ. ID. NO. 9757    268-GlyAlaGlyGlyLeu-272
Hydrophilic Regions - Hopp-Woods
SEQ. ID. NO. 9758    50-SerArgValGluAspLeuGlySerArgLeuAspAspMetAla-63
SEQ. ID. NO. 9759    92-IleLysGlyLysGlyLysGlyVal-99
SEQ. ID. NO. 9760    149-LeuLysSerSerGlyValSer-155

TABLE 1-continued

SEQ. ID. NO. 9761 160-LeuValAsnArgArgGlyIleArg-167
701
AMPHI Regions - AMPHI
SEQ. ID. NO. 9762 6-PheHisValAlaGly-10
SEQ. ID. NO. 9763 30-CysLeuAspThrSer-34
SEQ. ID. NO. 9764 45-ProAsnSerPheAlaSerPheLysArgPheSerSerIle-57
SEQ. ID. NO. 9765 79-GlyProAlaProAlaMet-84
Antigenic Index - Jameson-Wolf
SEQ. ID. NO. 9766 17-AlaGlnSerThrProSerSerProThrMet-26
SEQ. ID. NO. 9767 29-ThrCysLeuAspThrSerProGluAlaGly-38
SEQ. ID. NO. 9768 52-LysArgPheSerSerIleSer-58
SEQ. ID. NO. 9769 72-AsnArgAlaAspIleProThrGlyProAla-81
SEQ. ID. NO. 9770 104-GlyLysAlaSerLeuAsnAsnArgAla-112
SEQ. ID. NO. 9771 119-SerGlySerGlyThrArgLeu-125
Hydrophilic Regions - Hopp-Woods
SEQ. ID. NO. 9772 72-AsnArgAlaAspIleProThr-78
702
AMPHI Regions - AMPHI
SEQ. ID. NO. 9773 51-CysSerGlyLeuValThrVal-57
SEQ. ID. NO. 9774 118-LysIleSerArgGly-122
Antigenic Index - Jameson-Wolf
SEQ. ID. NO. 9775 1-MetProCysSerLysAlaSer-7
SEQ. ID. NO. 9776 28-LeuAlaArgAspSerCysSerProGlyLeu-37
SEQ. ID. NO. 9777 41-ThrAlaProAlaSerSer-46
SEQ. ID. NO. 9778 68-LeuAlaIleArgArgMetAlaSerArgProThrGlyValArgArgValIleSer-85
SEQ. ID. NO. 9779 88-GlyMetProProSerThrArgAlaTrpAspLysSerMetAla-101
SEQ. ID. NO. 9780 118-LysIleSerArgGlyValSer-124
SEQ. ID. NO. 9781 139-ArgTrpAspArgLeu-143
Hydrophilic Regions - Hopp-Woods
SEQ. ID. NO. 9782 29-AlaArgAspSerCysSer-34
SEQ. ID. NO. 9783 69-AlaIleArgArgMetAlaSerArgProThrGlyValArgArgValIleSer-85
SEQ. ID. NO. 9784 94-ArgAlaTrpAspLys-98
SEQ. ID. NO. 9785 139-ArgTrpAspArgLeu-143
703
AMPHI Regions - AMPHI
SEQ. ID. NO. 9786 21-GlnThrLeuAlaThrValAsnGly-28
SEQ. ID. NO. 9787 64-GluValValAsnThrValValAlaGlnGlu-73
SEQ. ID. NO. 9788 79-LeuAspArgSerAlaGlu-84
SEQ. ID. NO. 9789 140-AlaAlaTyrAspAsnIleSerGlyPheTyrLysGly-151
SEQ. ID. NO. 9790 181-PheAspAlaValLeu-185
SEQ. ID. NO. 9791 204-ValProLeuLysAspLeuGluGlnGlyValProProLeuTyrGlnAlaIleLysAspLeuLysLys-225
SEQ. ID. NO. 9792 252-ValProSerPheAsp-256
SEQ. ID. NO. 9793 270-ArgIleAspArgAlaValGlyAlaLeu-278
Antigenic Index - Jameson-Wolf
SEQ. ID. NO. 9794 1-MetLysAlaLysIle-5
SEQ. ID. NO. 9795 26-ValAsnGlyGlnLysIleAspSerSerVal-35
SEQ. ID. NO. 9796 43-PheArgAlaGluAsnSerArgAlaGluAspThrProGlnLeuArg-57
SEQ. ID. NO. 9797 72-GlnGluValLysArgLeuLysLeuAspArgSerAlaGluPheLysAsnAlaLeuAlaLysLeuArgAlaGluAlaLysLysSerGlyAspAspLysLys
ProSerPheLysThr-109
SEQ. ID. NO. 9798 129-LysThrGlnProValSerGluGlnGluValLysAlaAlaTyr-142
SEQ. ID. NO. 9799 144-AsnIleSerGlyPheTyrLysGlyThrGlnGluValGlnLeu-157
SEQ. ID. NO. 9800 160-IleLeuThrAspLysGluGluAsnAlaLysLysAlaValAlaAspLeuLysAlaLysLysGlyPhe-181
SEQ. ID. NO. 9801 188-TyrSerLeuAsnAspArgThrLysGlnThrGlyAlaProValGly-202
SEQ. ID. NO. 9802 207-LysAspLeuGluGlnGlyValProPro-215
SEQ. ID. NO. 9803 221-LysAspLeuLysLysGlyGluPheThrAlaThrProLeuLysAsnGlyAspPhe-238
SEQ. ID. NO. 9804 243-TyrValAsnAspSerArgGluValLysValProSerPheAspGluMetLysGly-260
SEQ. ID. NO. 9805 266-LeuGlnAlaGluArgIleAspArgAlaVal-275
SEQ. ID. NO. 9806 282-AlaAsnIleLysProAlaLys-288
Hydrophilic Regions - Hopp-Woods
SEQ. ID. NO. 9807 1-MetLysAlaLysIle-5
SEQ. ID. NO. 9808 29-GlnLysIleAspSerSerVal-35
SEQ. ID. NO. 9809 43-PheArgAlaGluAsnSerArgAlaGluAspThrProGlnLeuArg-57
SEQ. ID. NO. 9810 72-GlnGluValLysArgLeuLysLeuAspArgSerAlaGluPheLysAsnAlaLeuAlaLysLeuArgAlaGluAlaLysLysSerGlyAspAspLysLys
ProSerPhe-107
SEQ. ID. NO. 9811 131-GlnProValSerGluGlnGluValLysAlaAlaTyr-142
SEQ. ID. NO. 9812 160-IleLeuThrAspLysGluGluAsnAlaLysLysAlaValAlaAspLeuLysAlaLysLysGlyPhe-181
SEQ. ID. NO. 9813 189-SerLeuAsnAspArgThrLysGlnThrGly-198
SEQ. ID. NO. 9814 207-LysAspLeuGluGln-211
SEQ. ID. NO. 9815 221-LysAspLeuLysLysGlyGluPhe-228
SEQ. ID. NO. 9816 245-AsnAspSerArgGluValLysValProSerPheAspGluMetLysGly-260
SEQ. ID. NO. 9817 266-LeuGlnAlaGluArgIleAspArgAlaVal-275
SEQ. ID. NO. 9818 282-AlaAsnIleLysProAlaLys-288
704
AMPHI Regions - AMPHI
SEQ. ID. NO. 9819 33-GlyCysGlnAlaValAlaGlnSerIleIleAspAlaGlyLeuGly-47
SEQ. ID. NO. 9820 65-GlnGluIleLeuAspGlnIleArgLeuTyrAspLeuProGluValGlnSerAspPheValGluThrHis-87
SEQ. ID. NO. 9821 184-LeuGlyMetMetGln-188
SEQ. ID. NO. 9822 208-LeuGlnIleLeuHisTrpGlyGlyPheLeuMetValLeuPro-221
SEQ. ID. NO. 9823 232-GlnGlyAlaLeuArgAspLeuLys-239
SEQ. ID. NO. 9824 252-AlaIleIleMetThrPheIleAlaGlyValTyrSer-263

TABLE 1-continued

| SEQ. ID. NO. 9825 | 289-PheMetGluHisIleAlaArg-295 |
| --- | --- |
| SEQ. ID. NO. 9826 | 298-AlaGlyAspAlaAlaAlaGluArgLeuValLysLeuIleProAlaPheCysHisHisMetProAspTyrProAspThrGlnGluThr-325 |
| SEQ. ID. NO. 9827 | 400-GlyGlyThrArgLeuSerHisIleValArgLeuLeuAspArgAlaLeuAla-416 |
| SEQ. ID. NO. 9828 | 423-GluLeuAlaGluGlnTyr-428 |
| SEQ. ID. NO. 9829 | 499-AlaIleGluThrLeuAlaGln-505 |
| SEQ. ID. NO. 9830 | 527-IleSerLeuLeuArg-531 |
| SEQ. ID. NO. 9831 | 576-LeuAsnArgIleGlyGluGlyValGly-584 |
| SEQ. ID. NO. 9832 | 639-LeuLysAspSerAlaAlaGluAlaValArgGlnLeuAla-651 |
| SEQ. ID. NO. 9833 | 670-GluThrAlaArgAlaLeuGlyVal-677 |
| SEQ. ID. NO. 9834 | 691-GluTyrValLysAlaLeuGlnLysGlu-699 |
| SEQ. ID. NO. 9835 | 744-AspLeuArgThrValAlaHisLeuLeuAsp-753 |
| SEQ. ID. NO. 9836 | 780-AlaValLeuGlyTyrValGlnProTrpIleAlaAla-791 |
| SEQ. ID. NO. 9837 | 799-LeuAlaValLeuGly-803 |
| SEQ. ID. NO. 9838 | 805-AlaLeuArgLeuHisLysArg-811 |
| Antigenic Index - Jameson-Wolf | |
| SEQ. ID. NO. 9839 | 1-MetLysLysThrCys-5 |
| SEQ. ID. NO. 9840 | 8-CysGlyLeuAspValProGlu-14 |
| SEQ. ID. NO. 9841 | 21-ArgTyrGluAsnGluAspArgGluThrCysCys-31 |
| SEQ. ID. NO. 9842 | 46-LeuGlySerTyrTyrLysGlnArgThrAlaAspAlaGlnLysThrGluLeuProProGlnGluIleLeuAsp-69 |
| SEQ. ID. NO. 9843 | 77-ProGluValGlnSerAspPheValGluThrHisGlyGlyThrArgGluAla-93 |
| SEQ. ID. NO. 9844 | 112-GlnLeuLeuArgThrAspGlyIleVal-120 |
| SEQ. ID. NO. 9845 | 124-LeuAsnTyrSerThrHisArgCys-131 |
| SEQ. ID. NO. 9846 | 133-ValValTrpAspAspGlyLysIleArgLeu-142 |
| SEQ. ID. NO. 9847 | 158-ProTyrAspAlaGlnLysIleGluAlaAlaAsnGlnLysGluArgLysGlnTyr-175 |
| SEQ. ID. NO. 9848 | 199-TyrGlyGlyAspIleGluProAspPhe-207 |
| SEQ. ID. NO. 9849 | 234-AlaLeuArgAspLeuLysAsnArgArgValGlyMetAspThrProIle-249 |
| SEQ. ID. NO. 9850 | 293-IleAlaArgArgLysAlaGlyAspAlaAlaGluArgLeuVal-306 |
| SEQ. ID. NO. 9851 | 316-MetProAspTyrProAspThrGlnGluThrCysGlu-327 |
| SEQ. ID. NO. 9852 | 329-AlaValValLysLeuLysAlaGlyAsp-337 |
| SEQ. ID. NO. 9853 | 342-LysProGlyGluThrIleProValAspGlyThrVal-353 |
| SEQ. ID. NO. 9854 | 356-GlySerSerAlaValAsnGluSerMetLeuThrGlyGluSer-369 |
| SEQ. ID. NO. 9855 | 374-LysMetProSerGluLysValThrAla-382 |
| SEQ. ID. NO. 9856 | 393-IleArgThrAspArgThrGlyGlyGlyThrArg-403 |
| SEQ. ID. NO. 9857 | 414-AlaLeuAlaGlnLysProArgThrAlaGluLeuAlaGlu-426 |
| SEQ. ID. NO. 9858 | 486-ThrLeuAlaArgGluGlyIle-492 |
| SEQ. ID. NO. 9859 | 495-GlyGlyLysGlnAlaIle-500 |
| SEQ. ID. NO. 9860 | 510-IlePheAspLysThrGlyThrLeuThrGlnGlyLysProAlaValArgArg-526 |
| SEQ. ID. NO. 9861 | 528-SerLeuLeuArgGlyThrAspGluAlaPhe-537 |
| SEQ. ID. NO. 9862 | 545-LeuGluGlnGlnSerGluHisProLeu-553 |
| SEQ. ID. NO. 9863 | 560-CysArgIleSerAspGlySerValPro-568 |
| SEQ. ID. NO. 9864 | 570-IleAlaIleLysGlnArgLeuAsnArgIleGlyGluGlyVal-583 |
| SEQ. ID. NO. 9865 | 589-ValAsnGlyGluThrGln-594 |
| SEQ. ID. NO. 9866 | 605-AlaGluIleSerGlyLysGluProGlnThrGluGlyGlyGlySer-619 |
| SEQ. ID. NO. 9867 | 637-AspProLeuLysAspSerAlaAlaGluAlaValArg-648 |
| SEQ. ID. NO. 9868 | 650-LeuAlaGlyLysAsnLeu-655 |
| SEQ. ID. NO. 9869 | 659-IleLeuSerGlyAspArgGluThrAlaVal-668 |
| SEQ. ID. NO. 9870 | 684-AlaMetProGluAspLysLeuGluTyr-692 |
| SEQ. ID. NO. 9871 | 694-LysAlaLeuGlnLysGluGlyLysLys-702 |
| SEQ. ID. NO. 9872 | 707-GlyAspGlyIleAsnAspAla-713 |
| SEQ. ID. NO. 9873 | 725-AlaAlaGlyGlyThrAspIleAlaArgAspGlyAlaAsp-737 |
| SEQ. ID. NO. 9874 | 743-GluAspLeuArgThr-747 |
| SEQ. ID. NO. 9875 | 753-AspGlnAlaArgArgThrArgHisIleIle-762 |
| SEQ. ID. NO. 9876 | 807-ArgLeuHisLysArgGlyLysMetGlnSerGluLysMetProSerGluGln-823 |
| Hydrophilic Regions - Hopp-Woods | |
| SEQ. ID. NO. 9877 | 1-MetLysLysThrCys-5 |
| SEQ. ID. NO. 9878 | 21-ArgTyrGluAsnGluAspArgGluThrCys-30 |
| SEQ. ID. NO. 9879 | 50-TyrLysGlnArgThrAlaAspAlaGlnLysThrGluLeuProPro-64 |
| SEQ. ID. NO. 9880 | 77-ProGluValGlnSerAspPheValGlu-85 |
| SEQ. ID. NO. 9881 | 87-HisGlyGlyThrArgGluAla-93 |
| SEQ. ID. NO. 9882 | 112-GlnLeuLeuArgThrAspGlyIleVal-120 |
| SEQ. ID. NO. 9883 | 133-ValValTrpAspAspGlyLysIleArgLeu-142 |
| SEQ. ID. NO. 9884 | 160-AspAlaGlnLysIleGluAlaAlaAsnGlnLysGluArgLysGlnTyr-175 |
| SEQ. ID. NO. 9885 | 201-GlyAspIleGluProAspPhe-207 |
| SEQ. ID. NO. 9886 | 234-AlaLeuArgAspLeuLysAsnArgArgValGlyMet-245 |
| SEQ. ID. NO. 9887 | 293-IleAlaArgArgLysAlaGlyAspAlaAlaGluArgLeuVal-306 |
| SEQ. ID. NO. 9888 | 318-AspTyrProAspThrGlnGluThrCysGlu-327 |
| SEQ. ID. NO. 9889 | 329-AlaValValLysLeuLysAlaGlyAsp-337 |
| SEQ. ID. NO. 9890 | 374-LysMetProSerGluLysValThr-381 |
| SEQ. ID. NO. 9891 | 393-IleArgThrAspArgThrGlyGlyGlyThrArg-403 |
| SEQ. ID. NO. 9892 | 414-AlaLeuAlaGlnLysProArgThrAlaGluLeuAlaGlu-426 |
| SEQ. ID. NO. 9893 | 486-ThrLeuAlaArgGluGlyIle-492 |
| SEQ. ID. NO. 9894 | 518-ThrGlnGlyLysProAlaValArgArg-526 |
| SEQ. ID. NO. 9895 | 531-ArgGlyThrAspGlu-535 |
| SEQ. ID. NO. 9896 | 545-LeuGluGlnGlnSerGluHisProLeu-553 |
| SEQ. ID. NO. 9897 | 561-ArgIleSerAspGlySerVal-567 |
| SEQ. ID. NO. 9898 | 570-IleAlaIleLysGlnArgLeuAsnArgIleGlyGlu-581 |
| SEQ. ID. NO. 9899 | 607-IleSerGlyLysGluProGlnThrGluGlyGlyGly-618 |
| SEQ. ID. NO. 9900 | 638-ProLeuLysAspSerAlaAlaGluAlaValArg-648 |
| SEQ. ID. NO. 9901 | 661-SerGlyAspArgGluThrAlaVal-668 |
| SEQ. ID. NO. 9902 | 684-AlaMetProGluAspLysLeuGluTyr-692 |

TABLE 1-continued

| | |
|---|---|
| SEQ. ID. NO. 9903 | 694-LysAlaLeuGlnLysGluGlyLysLys-702 |
| SEQ. ID. NO. 9904 | 730-AspIleAlaArgAspGlyAlaAsp-737 |
| SEQ. ID. NO. 9905 | 743-GluAspLeuArgThr-747 |
| SEQ. ID. NO. 9906 | 753-AspGlnAlaArgArgThrArgHisIleIle-762 |
| SEQ. ID. NO. 9907 | 807-ArgLeuHisLysArgGlyLysMetGlnSerGluLysMetProSerGluGln-823 |

705
AMPHI Regions - AMPHI

| | |
|---|---|
| SEQ. ID. NO. 9908 | 67-LysIleLeuLeuLysLeu-72 |
| SEQ. ID. NO. 9909 | 104-AspProIleProAla-108 |
| SEQ. ID. NO. 9910 | 147-TyrMetGlnThrPheArgArgIleValAlaProGln-158 |
| SEQ. ID. NO. 9911 | 169-AsnGluPheIleGlyLeuPheLysAsn-177 |
| SEQ. ID. NO. 9912 | 183-ValValThrValThrGluLeuPheArgValAlaGln-194 |
| SEQ. ID. NO. 9913 | 196-ThrAlaAsnArgThr-200 |

Antigenic Index - Jameson-Wolf

| | |
|---|---|
| SEQ. ID. NO. 9914 | 13-ThrGluThrArgAlaAspMet-19 |
| SEQ. ID. NO. 9915 | 132-ValProLysGlyGlnTrpGlu-138 |
| SEQ. ID. NO. 9916 | 165-ProProLeuSerAsnGlu-170 |
| SEQ. ID. NO. 9917 | 193-AlaGlnGluThrAlaAsnArgThrTyrAsp-202 |
| SEQ. ID. NO. 9918 | 226-AlaArgLeuGluLysArgPheAspArgTyrValAla-237 |

Hydrophilic Regions - Hopp-Woods

| | |
|---|---|
| SEQ. ID. NO. 9919 | 13-ThrGluThrArgAlaAspMet-19 |
| SEQ. ID. NO. 9920 | 193-AlaGlnGluThrAlaAsnArgThr-200 |
| SEQ. ID. NO. 9921 | 226-AlaArgLeuGluLysArgPheAspArgTyrValAla-237 |

706
AMPHI Regions - AMPHI

| | |
|---|---|
| SEQ. ID. NO. 9922 | 9-LeuValSerArgTrpLeuAsnSerTyr-17 |
| SEQ. ID. NO. 9923 | 24-ArgLeuIleHisAlaValArg-30 |
| SEQ. ID. NO. 9924 | 70-IleTyrSerLysAlaValGluArgMetLeuGlyThrValIleGly-84 |
| SEQ. ID. NO. 9925 | 111-ThrAlaSerAlaLeuAlaGlyTrpAlaAla-120 |
| SEQ. ID. NO. 9926 | 153-ArgAlaMetAsnValLeu-158 |
| SEQ. ID. NO. 9927 | 183-LeuAlaAspAsnLeuAlaAspCysSerLysMetIleAlaGluIleSerAsnGlyArg-201 |
| SEQ. ID. NO. 9928 | 204-ThrArgGluArgLeuGluGluAsn-211 |
| SEQ. ID. NO. 9929 | 243-MetGluAlaMetGlnHisAlaHisArgLysIleVal-254 |
| SEQ. ID. NO. 9930 | 318-AlaLeuAlaGluHisLeuHis-324 |

Antigenic Index - Jameson-Wolf

| | |
|---|---|
| SEQ. ID. NO. 9931 | 1-MetAsnThrSerGlnArgAsnArgLeu-9 |
| SEQ. ID. NO. 9932 | 11-SerArgTrpLeuAsnSerTyrGluArgTyrArgTyrArgArg-24 |
| SEQ. ID. NO. 9933 | 73-LysAlaValGluArgMetLeu-79 |
| SEQ. ID. NO. 9934 | 97-HisTyrPheHisGlyAsnLeu-103 |
| SEQ. ID. NO. 9935 | 122-GlyLysAsnGlyTyrVal-127 |
| SEQ. ID. NO. 9936 | 140-GlyAspAsnGlySerGluTrpLeuAsp-148 |
| SEQ. ID. NO. 9937 | 186-AsnLeuAlaAspCysSerLysMetIleAlaGluIleSerAsnGlyArgArgMetThrArgGluArgLeuGluGluAsnMetAlaLysMetArgGlnIleAsn-219 |
| SEQ. ID. NO. 9938 | 221-ArgMetValLysSerArgSerHisLeuAlaAlaThrSerGlyGluSerArgIleSer-239 |
| SEQ. ID. NO. 9939 | 249-AlaHisArgLysIleValAsn-255 |
| SEQ. ID. NO. 9940 | 266-LysLeuGlnSerProLysLeuAsnGlySerGluIleArgLeuLeuAsp-281 |
| SEQ. ID. NO. 9941 | 300-GlyArgHisAlaArgArgIleArgIleAspThrAlaIleAsnProGluLeuGluAlaLeuAla-320 |
| SEQ. ID. NO. 9942 | 334-SerThrAsnMetArgGlnGluIle-341 |
| SEQ. ID. NO. 9943 | 349-GlnArgThrArgArgLysTrpLeuAspAlaHisGluArgGlnHisLeu-364 |
| SEQ. ID. NO. 9944 | 367-SerLeuLeuGluThrArgGluHisGly-375 |

Hydrophilic Regions - Hopp-Woods

| | |
|---|---|
| SEQ. ID. NO. 9945 | 3-ThrSerGlnArgAsnArgLeu-9 |
| SEQ. ID. NO. 9946 | 17-TyrGluArgTyrArgTyrArgArg-24 |
| SEQ. ID. NO. 9947 | 73-LysAlaValGluArgMetLeu-79 |
| SEQ. ID. NO. 9948 | 142-AsnGlySerGluTrpLeu-147 |
| SEQ. ID. NO. 9949 | 186-AsnLeuAlaAspCysSerLysMetIleAla-195 |
| SEQ. ID. NO. 9950 | 198-SerAsnGlyArgArgMetThrArgGluArgLeuGluGluAsnMetAlaLysMetArgGlnIleAsn-219 |
| SEQ. ID. NO. 9951 | 221-ArgMetValLysSerArgSerHis-228 |
| SEQ. ID. NO. 9952 | 232-ThrSerGlyGluSerArgIle-238 |
| SEQ. ID. NO. 9953 | 249-AlaHisArgLysIleValAsn-255 |
| SEQ. ID. NO. 9954 | 266-LysLeuGlnSerProLysLeuAsnGlySerGluIleArgLeuLeuAsp-281 |
| SEQ. ID. NO. 9955 | 301-ArgHisAlaArgArgIleArgIle-308 |
| SEQ. ID. NO. 9956 | 314-ProGluLeuGluAlaLeuAla-320 |
| SEQ. ID. NO. 9957 | 336-AsnMetArgGlnGluIle-341 |
| SEQ. ID. NO. 9958 | 349-GlnArgThrArgArgLysTrpLeuAspAlaHisGluArgGlnHisLeu-364 |
| SEQ. ID. NO. 9959 | 367-SerLeuLeuGluThrArgGluHisGly-375 |

707
AMPHI Regions - AMPHI

| | |
|---|---|
| SEQ. ID. NO. 9960 | 9-LeuIleArgSerMetGlnArgGln-16 |
| SEQ. ID. NO. 9961 | 88-AsnLeuSerArgLeuGlnLysAla-95 |
| SEQ. ID. NO. 9962 | 170-GluGlnGlyLeuGluAsnLeuArgArgLeuProSerVal-182 |
| SEQ. ID. NO. 9963 | 219-GlyGlyLysThrThrGlyLysTyr-226 |
| SEQ. ID. NO. 9964 | 241-SerAspLeuPheTyr-245 |
| SEQ. ID. NO. 9965 | 294-ArgTyrHisGluAlaThrGlu-300 |
| SEQ. ID. NO. 9966 | 339-ThrArgGlnThrTyrLysTyrIleAspAsp-348 |
| SEQ. ID. NO. 9967 | 539-HisLysProLysGlyPheGlnThrThrAsnThr-549 |

Antigenic Index - Jameson-Wolf

| | |
|---|---|
| SEQ. ID. NO. 9968 | 3-IleIleAsnAspAlaGluLeuIleArgSerMetGlnArgGlnGlnHisIleAsp-20 |
| SEQ. ID. NO. 9969 | 27-AlaAsnValArgPheGluGlnProLeuGluLysAsnAsnTyrValLeuSerGluAspGluThrProCysThrArg-51 |
| SEQ. ID. NO. 9970 | 56-SerLeuAspAspLysThrValArg-63 |

TABLE 1-continued

| | |
|---|---|
| SEQ. ID. NO. 9971 | 85-GlySerAsnAsnLeuSerArgLeuGlnLysAlaAla-96 |
| SEQ. ID. NO. 9972 | 114-ProGlnAsnMetAspSerGlyIleLeu-122 |
| SEQ. ID. NO. 9973 | 125-ArgValSerAlaGlyGluIleGlyAspIleArgTyrGluGluLysArgAspGlyLysSerAlaGluGlySerIle-149 |
| SEQ. ID. NO. 9974 | 157-ProLeuTyrArgAsnLysIleLeuAsn-165 |
| SEQ. ID. NO. 9975 | 167-ArgAspValGluGlnGlyLeuGluAsnLeuArgArgLeuProSerValLysThrAspIle-186 |
| SEQ. ID. NO. 9976 | 189-IleProSerGluGluGluGlyLysSerAspLeu-199 |
| SEQ. ID. NO. 9977 | 202-LysTrpGlnGlnAsnLysProIleArg-210 |
| SEQ. ID. NO. 9978 | 213-IleGlyIleAspAspAlaGlyGlyLysThrThrGlyLysTyrGlnGly-228 |
| SEQ. ID. NO. 9979 | 235-AspAsnProLeuGly-239 |
| SEQ. ID. NO. 9980 | 248-TyrGlyArgGlyLeuAlaHisLysThrAspLeuThrAspAlaThrGlyThrGluThrGluSerGlySerArgSerTyr-273 |
| SEQ. ID. NO. 9981 | 288-PheAsnHisAsnGlyHisArgTyrHisGluAlaThrGluGlyTyrSerValAsnTyrAspTyrAsnGlyLysGlnTyrGln-314 |
| SEQ. ID. NO. 9982 | 322-MetLeuTrpArgAsnArgLeuHisLysThrSerVal-333 |
| SEQ. ID. NO. 9983 | 341-GlnThrTyrLysTyrIleAspAspAlaGluIleGluValGlnArgArgArgSerAlaGlyTrpGluAlaGluLeuArgHis-367 |
| SEQ. ID. NO. 9984 | 374-TrpGlnLeuAspGlyLysLeuSerTyrLysArgGlyThrGlyMetArgGlnSerMetProAlaProGluGluAsnGlyGlyAspIleLeuProGlyThrSerArgMetLysIle-411 |
| SEQ. ID. NO. 9985 | 438-GlnTrpAsnLysThrPro-443 |
| SEQ. ID. NO. 9986 | 446-AlaGlnAspLysLeuSerIleGlySerArgTyrThrValArgGlyPheAspGlyGluGlnSerLeuPheGlyGluArgGlyPheTyrTrpGlnAsnThr-478 |
| SEQ. ID. NO. 9987 | 493-AlaAspTyrGlyArgValSerGlyGluSerAla-503 |
| SEQ. ID. NO. 9988 | 506-ValSerGlyLysGln-510 |
| SEQ. ID. NO. 9989 | 518-PheArgGlyGlyHisLysValGly-525 |
| SEQ. ID. NO. 9990 | 536-LysProLeuHisLysProLysGlyPheGln-545 |
| Hydrophilic Regions - Hopp-Woods | |
| SEQ. ID. NO. 9991 | 3-IleIleAsnAspAlaGluLeuIleArgSerMetGlnArgGlnGlnHisIleAsp-20 |
| SEQ. ID. NO. 9992 | 27-AlaAsnValArgPheGluGlnProLeuGluLysAsnAsn-39 |
| SEQ. ID. NO. 9993 | 42-LeuSerGluAspGluThrProCys-49 |
| SEQ. ID. NO. 9994 | 56-SerLeuAspAspLysThrValArg-63 |
| SEQ. ID. NO. 9995 | 88-AsnLeuSerArgLeuGlnLysAlaAla-96 |
| SEQ. ID. NO. 9996 | 130-GluIleGlyAspIleArgTyrGluGluLysArgAspGlyLysSerAlaGluGlySer-148 |
| SEQ. ID. NO. 9997 | 167-ArgAspValGluGlnGlyLeuGluAsnLeuArgArgLeuProSerValLysThrAspIle-186 |
| SEQ. ID. NO. 9998 | 190-ProSerGluGluGluGlyLysSerAspLeu-199 |
| SEQ. ID. NO. 9999 | 213-IleGlyIleAspAspAlaGlyGlyLysThrThrGlyLysTyr-226 |
| SEQ. ID. NO. 10000 | 252-LeuAlaHisLysThrAspLeuThrAsp-260 |
| SEQ. ID. NO. 10001 | 262-ThrGlyThrGluThrGluSerGlySerArgSer-272 |
| SEQ. ID. NO. 10002 | 294-ArgTyrHisGluAlaThrGlu-300 |
| SEQ. ID. NO. 10003 | 345-TyrIleAspAspAlaGluIleGluValGlnArgArgArgSerAlaGlyTrp-361 |
| SEQ. ID. NO. 10004 | 363-AlaGluLeuArgHis-367 |
| SEQ. ID. NO. 10005 | 378-GlyLysLeuSerTyrLysArgGlyThrGlyMetArgGlnSerMetProAlaProGluGluAsnGlyGly-400 |
| SEQ. ID. NO. 10006 | 407-SerArgMetLysIle-411 |
| SEQ. ID. NO. 10007 | 446-AlaGlnAspLysLeuSerIle-452 |
| SEQ. ID. NO. 10008 | 460-GlyPheAspGlyGluGln-465 |
| SEQ. ID. NO. 10009 | 494-AspTyrGlyArgValSerGlyGluSer-502 |
| SEQ. ID. NO. 10010 | 537-ProLeuHisLysProLysGly-543 |
| 708 | |
| AMPHI Regions - AMPHI | |
| SEQ. ID. NO. 10011 | 26-ProSerArgAlaGluLysAlaAsnGlnValSerAsnIle-38 |
| SEQ. ID. NO. 10012 | 56-ThrAlaSerIleGluAspAlaLeuLysSerAspPro-67 |
| SEQ. ID. NO. 10013 | 79-IleTyrGlnTyrLeuLys-84 |
| SEQ. ID. NO. 10014 | 89-AlaGlnGluSerPhe-93 |
| SEQ. ID. NO. 10015 | 119-AsnArgProAlaGluSerMetAla-126 |
| SEQ. ID. NO. 10016 | 128-PheAspLysAlaLeu-132 |
| SEQ. ID. NO. 10017 | 142-IleAlaAsnLeuAsnLys-147 |
| SEQ. ID. NO. 10018 | 176-ProAlaPheLysGluLeuAlaArg-183 |
| SEQ. ID. NO. 10019 | 221-LysAlaLeuGlyAsnAlaGln-227 |
| Antigenic Index - Jameson-Wolf | |
| SEQ. ID. NO. 10020 | 2-ProPheLysProSerLysArgIleSer-10 |
| SEQ. ID. NO. 10021 | 19-AlaCysSerThrSerTyrArgProSerArgAlaGluLysAlaAsnGln-34 |
| SEQ. ID. NO. 10022 | 46-TyrMetArgGlyGlnAspTyrArgGlnAlaThrAlaSerIleGluAspAlaLeuLysSerAspProLysAsnGlu-70 |
| SEQ. ID. NO. 10023 | 84-LysValAsnAspLysAlaGlnGluSerPheArg-94 |
| SEQ. ID. NO. 10024 | 97-LeuSerIleLysProAspSerAlaGluIleAsnAsnAsnTyrGlyTrp-112 |
| SEQ. ID. NO. 10025 | 115-CysGlyArgLeuAsnArgProAlaGlu-123 |
| SEQ. ID. NO. 10026 | 131-AlaLeuAlaAspProThrTyrProThr-139 |
| SEQ. ID. NO. 10027 | 145-LeuAsnLysGlyIleCysSerAlaLysGlnGlyGln-156 |
| SEQ. ID. NO. 10028 | 176-ProAlaPheLysGluLeuAlaArgThrLysMet-186 |
| SEQ. ID. NO. 10029 | 191-LeuGlyAspAlaAspTyrTyrPheLysLysTyrGlnSerArgValGluValLeuGlnAlaAspAspLeu-213 |
| SEQ. ID. NO. 10030 | 240-PheProTyrSerGluGluLeuGln-247 |
| Hydrophilic Regions - Hopp-Woods | |
| SEQ. ID. NO. 10031 | 4-LysProSerLysArgIle-9 |
| SEQ. ID. NO. 10032 | 24-TyrArgProSerArgAlaGluLysAlaAsnGln-34 |
| SEQ. ID. NO. 10033 | 46-TyrMetArgGlyGlnAspTyrArgGln-54 |
| SEQ. ID. NO. 10034 | 56-ThrAlaSerIleGluAspAlaLeuLysSerAspProLysAsnGlu-70 |
| SEQ. ID. NO. 10035 | 84-LysValAsnAspLysAlaGlnGluSerPheArg-94 |
| SEQ. ID. NO. 10036 | 99-IleLysProAspSerAlaGluIle-106 |
| SEQ. ID. NO. 10037 | 117-ArgLeuAsnArgProAlaGlu-123 |
| SEQ. ID. NO. 10038 | 149-IleCysSerAlaLysGlnGly-155 |
| SEQ. ID. NO. 10039 | 177-AlaPheLysGluLeuAlaArgThrLysMet-186 |
| SEQ. ID. NO. 10040 | 201-TyrGlnSerArgValGluValLeuGlnAlaAspAspLeu-213 |
| 709 | |

TABLE 1-continued

```
AMPHI Regions - AMPHI
SEQ. ID. NO. 10041    6-SerLeuLeuAspMetProArgGlyGlu-14
SEQ. ID. NO. 10042    18-ValValValAlaLeuIleAlaAlaMetGly-27
SEQ. ID. NO. 10043    37-ProHisMetSerIleIleAlaAlaIleValValLeu-48
SEQ. ID. NO. 10044    54-AlaArgGlyLeuLysTyrAsn-60
SEQ. ID. NO. 10045    64-GlnGlyMetIleGlyAlaLeuAsnGlnGly-73
SEQ. ID. NO. 10046    115-SerSerPheAlaLeuCysSerVal-122
SEQ. ID. NO. 10047    130-SerLeuThrThrCysAla-135
SEQ. ID. NO. 10048    171-ProLeuSerAspThr-175
SEQ. ID. NO. 10049    185-IleAspLeuPheGluHisIleLysAsnMetMetTyrThrThr-198
SEQ. ID. NO. 10050    221-LeuAsnSerValGluSerPheArg-228
SEQ. ID. NO. 10051    253-LeuMetArgIleAsnAla-258
SEQ. ID. NO. 10052    261-AlaMetLeuPheThr-265
SEQ. ID. NO. 10053    278-ThrProAspLeuArgGlnLeuGlyAlaTrpPhe-288
SEQ. ID. NO. 10054    298-AlaPheLysAspValValLysLeuIleSerArgGlyGly-310
SEQ. ID. NO. 10055    334-LeuGlyValIleProSerLeuLeuGluAlaIleArgThrPheLeuThr-349
SEQ. ID. NO. 10056    382-ThrPheLysProVal-386
SEQ. ID. NO. 10057    395-ArgAsnLeuSerArgThrLeuGluAspAlaGlyThrValIleAsnProLeuValProTrpSerValCysGlyValPheIleSerHis-423
Antigenic Index - Jameson-Wolf
SEQ. ID. NO. 10058    8-LeuAspMetProArgGlyGluAla-15
SEQ. ID. NO. 10059    55-ArgGlyLeuLysTyrAsnAspMetGln-63
SEQ. ID. NO. 10060    165-PheGlyAspLysMetSerProLeuSerAspThrThrGly-177
SEQ. ID. NO. 10061    222-AsnSerValGluSerPheArgSerGlnLeuGlu-232
SEQ. ID. NO. 10062    277-SerThrProAspLeuArgGln-283
SEQ. ID. NO. 10063    290-GlyGlyTyrLysLeuGluGlyGluAlaPheLysAspValVal-303
SEQ. ID. NO. 10064    306-IleSerArgGlyGlyLeuGlu-312
SEQ. ID. NO. 10065    378-LeuSerGlyGluThrPheLysProValTyrAspLysLeuGlyLeuHisSerArgAsnLeuSerArgThrLeuGluAspAlaGlyThr-406
Hydrophilic Regions - Hopp-Woods
SEQ. ID. NO. 10066    8-LeuAspMetProArgGlyGluAla-15
SEQ. ID. NO. 10067    57-LeuLysTyrAsnAspMetGln-63
SEQ. ID. NO. 10068    168-LysMetSerProLeuSerAsp-174
SEQ. ID. NO. 10069    225-GluSerPheArgSerGlnLeuGlu-232
SEQ. ID. NO. 10070    279-ProAspLeuArgGln-283
SEQ. ID. NO. 10071    293-LysLeuGluGlyGluAlaPheLysAspValVal-303
SEQ. ID. NO. 10072    396-AsnLeuSerArgThrLeuGluAspAlaGly-405
710
AMPHI Regions - AMPHI
SEQ. ID. NO. 10073    6-LysIleArgLeuMetArgGluLeuAsnLysTrpSerGln-18
SEQ. ID. NO. 10074    31-GlyTyrAlaLysIleGlu-36
SEQ. ID. NO. 10075    45-ProArgLeuGluGlnLeuAlaGlnIlePheLysIleAspMetTrpAspLeuLeuLys-63
SEQ. ID. NO. 10076    104-CysLysGluMetLeuGlu-109
Antigenic Index - Jameson-Wolf
SEQ. ID. NO. 10077    1-MetGluThrHisGluLysIleArgLeuMetArgGluLeuAsnLysTrpSerGlnGluAspMetAlaGluLysLeuAla-26
SEQ. ID. NO. 10078    33-AlaLysIleGluArgGlyGluThrGlnLeuAsnIleProArgLeuGluGln-49
SEQ. ID. NO. 10079    62-LeuLysSerGlyGlyGlyGly-68
SEQ. ID. NO. 10080    73-IleAsnGluGlyAspSerGlyGlyAsp-81
SEQ. ID. NO. 10081    86-AlaSerGlyAspValSerMet-92
SEQ. ID. NO. 10082    95-GluPheLeuLysMetGluLeuLysHisCysLysGluMetLeuGluGlnLysAspLysGluIleGluLeuLeuArgLysLeuThrGlu-123
Hydrophilic Regions - Hopp-Woods
SEQ. ID. NO. 10083    1-MetGluThrHisGluLysIleArgLeuMetArgGluLeuAsnLysTrpSerGlnGluAspMetAlaGluLysLeuAla-26
SEQ. ID. NO. 10084    33-AlaLysIleGluArgGlyGluThr-40
SEQ. ID. NO. 10085    45-ProArgLeuGluGln-49
SEQ. ID. NO. 10086    74-AsnGluGlyAspSerGlyGly-80
SEQ. ID. NO. 10087    95-GluPheLeuLysMetGluLeuLysHisCysLysGluMetLeuGluGlnLysAspLysGluIleGluLeuLeuArgLysLeuThrGlu-123
711
AMPHI Regions - AMPHI
SEQ. ID. NO. 10088    28-AlaGluSerTyrArgAsnLeuThrAlaSerGluIleAlaLysValTyrThrIleAlaArgMetThrAspLeuAspMetLeuAsnAspIleLys-58
SEQ. ID. NO. 10089    67-SerGlyGlnSerPheAspAspTrpArgLysGlyIleLeu-79
SEQ. ID. NO. 10090    95-GlyLysAspIleIleAspProAlaThrGlyGluValPheGlySerProArgArgLeuGluThrIleTyrArgThrAsnMet-121
SEQ. ID. NO. 10091    128-GlyGlnTyrGlnGlyTyrMet-134
SEQ. ID. NO. 10092    158-SerAlaIleAspGly-162
SEQ. ID. NO. 10093    195-ValGluArgGlnGly-199
SEQ. ID. NO. 10094    203-GlyGlnSerThrAlaAspAsnLeuValGluThrHis-214
SEQ. ID. NO. 10095    258-LysTyrArgAlaLeuAlaHisGlnPheAla-268
SEQ. ID. NO. 10096    281-PheLysGlnLeuGluLysGluPheTyr-289
SEQ. ID. NO. 10097    329-GlnGluLeuAlaGlyMetThr-335
SEQ. ID. NO. 10098    352-SerArgGlyGlnAsnPhe-358
SEQ. ID. NO. 10099    360-AspSerTyrTyrAlaPheLeuProAspMetLeuGlnAsnProGlu-374
SEQ. ID. NO. 10100    395-TrpAlaValLeuLysTyrIleLysGluValAspGluIle-407
SEQ. ID. NO. 10101    413-ArgIleSerAsnAspLysGluIleAlaLys-422
Antigenic Index - Jameson-Wolf
SEQ. ID. NO. 10102    11-SerLeuProProLysLysAlaIleGlu-19
SEQ. ID. NO. 10103    21-LeuGluSerLysLysValThrAlaGluSerTyrArgAsnLeuThr-35
SEQ. ID. NO. 10104    55-AsnAspIleLysThrSerMet-61
SEQ. ID. NO. 10105    63-GluSerAlaLysSerGlyGlnSerPheAspAspTrpArgLysGlyIle-78
SEQ. ID. NO. 10106    82-LeuSerAsnLysGlyTrpLeuHisProAsnGlyHisAsnGlyLysAspIleIleAspProAlaThrGlyGluValPheGlySerProArgArgLeuGlu
                      ThrIleTyrArgThrAsnMet-121
SEQ. ID. NO. 10107    126-AsnAlaGlyGlnTyrGlnGlyGly-132
SEQ. ID. NO. 10108    135-AlaAsnIleAspAlaArgProTyrTrp-143
SEQ. ID. NO. 10109    147-AlaValGlyAspSerArgThrArgProAlaHisSerAla-159
```

TABLE 1-continued

| | |
|---|---|
| SEQ. ID. NO. 10110 | 165-TyrArgTyrAspAspProPheTrp-172 |
| SEQ. ID. NO. 10111 | 177-ProProAsnGlyTyrAsnCysArgCysSer-186 |
| SEQ. ID. NO. 10112 | 190-LeuSerGluArgAspValGluArgGlnGlyArgIleValGlyGlnSerThrAlaAspAsnLeuValGlu-212 |
| SEQ. ID. NO. 10113 | 215-LysIleTyrAsnLysLysGlyAspThr-223 |
| SEQ. ID. NO. 10114 | 229-TyrLysAlaProAspGlySerLeuTyrThrThrAspArgGlyPheAspTyrAsnAlaGlyArgMetAsnTyrArgProAspLeuAspLysTyrAspArgAlaLeu-263 |
| SEQ. ID. NO. 10115 | 268-AlaLysAlaGluMetGlyGlyAlaAspPheLysThrSerPheLysGlnLeuGluLysGluPheTyrGluValLysGlnArgLeuAspIleAspGlyLysProAspLysGluGlnLysIleLysIleArgAsnAlaLeu-313 |
| SEQ. ID. NO. 10116 | 324-LeuSerLysGluThrGlnGlu-330 |
| SEQ. ID. NO. 10117 | 342-SerAspAspThrLeuValLysGlnValAspSerArgGluGlyGlnAsnPheAspAspSerTyrTyr-363 |
| SEQ. ID. NO. 10118 | 370-LeuGlnAsnProGluHisValIleArgAspAsnArgGlu-382 |
| SEQ. ID. NO. 10119 | 387-AlaArgTyrLysGlySer-392 |
| SEQ. ID. NO. 10120 | 400-TyrIleLysGluValAspGlu-406 |
| SEQ. ID. NO. 10121 | 411-SerTyrArgIleSerAsnAspLysGluIleAla-421 |
| SEQ. ID. NO. 10122 | 424-MetAlaLysLysLysValLeuLys-431 |
| Hydrophilic Regions - Hopp-Woods | |
| SEQ. ID. NO. 10123 | 13-ProProLysLysAlaIleGlu-19 |
| SEQ. ID. NO. 10124 | 21-LeuGluSerLysLysValThrAlaGluSerTyrArg-32 |
| SEQ. ID. NO. 10125 | 55-AsnAspIleLysThrSerMet-61 |
| SEQ. ID. NO. 10126 | 63-GluSerAlaLysSerGlyGlnSerPheAspAspTrpArgLys-76 |
| SEQ. ID. NO. 10127 | 93-HisAsnGlyLysAspIleIleAsp-100 |
| SEQ. ID. NO. 10128 | 108-GlySerProArgArgLeuGluThr-115 |
| SEQ. ID. NO. 10129 | 147-AlaValGlyAspSerArgThrArgProAlaHisSerAla-159 |
| SEQ. ID. NO. 10130 | 190-LeuSerGluArgAspValGluArgGlnGlyArgIleVal-202 |
| SEQ. ID. NO. 10131 | 215-LysIleTyrAsnLysLysGlyAspThr-223 |
| SEQ. ID. NO. 10132 | 238-ThrThrAspArgGlyPheAsp-244 |
| SEQ. ID. NO. 10133 | 250-MetAsnTyrArgProAspLeuAspLysTyrAspArgAlaLeu-263 |
| SEQ. ID. NO. 10134 | 268-AlaLysAlaGluMetGlyGlyAlaAspPheLysThrSerPheLysGlnLeuGluLysGluPheTyrGluValLysGlnArgLeuAspIleAspGlyLysProAspLysGluGlnLysIleLysIleArgAsnAlaLeu-313 |
| SEQ. ID. NO. 10135 | 324-LeuSerLysGluThrGlnGlu-330 |
| SEQ. ID. NO. 10136 | 344-AspThrLeuValLysGlnValAspSerArgGluGlyGlnAsnPheAsp-359 |
| SEQ. ID. NO. 10137 | 375-HisValIleArgAspAsnArgGlu-382 |
| SEQ. ID. NO. 10138 | 400-TyrIleLysGluValAspGlu-406 |
| SEQ. ID. NO. 10139 | 414-IleSerAsnAspLysGluIleAla-421 |
| SEQ. ID. NO. 10140 | 424-MetAlaLysLysLysValLeuLys-431 |
| 712 | |
| AMPHI Regions - AMPHI | |
| SEQ. ID. NO. 10141 | 12-GlySerIleArgVal-16 |
| SEQ. ID. NO. 10142 | 29-ValGlnGlyLeuProGlnAsnPro-36 |
| SEQ. ID. NO. 10143 | 55-GluProValGlnLeuPhe-60 |
| SEQ. ID. NO. 10144 | 72-GlySerLeuAlaHisLeuMet-78 |
| SEQ. ID. NO. 10145 | 131-SerThrAlaValAsn-135 |
| SEQ. ID. NO. 10146 | 142-ThrValAlaAspArgLeuLys-148 |
| SEQ. ID. NO. 10147 | 210-ThrAlaLeuSerLysValAla-216 |
| SEQ. ID. NO. 10148 | 231-AlaAsnAlaLysAlaLeuSerAsnHisIleThrAsnValSerAsnAlaIle-247 |
| SEQ. ID. NO. 10149 | 306-ProAlaLysProLeuAsnThrLeuGlu-314 |
| SEQ. ID. NO. 10150 | 329-PheAlaGluCysAsnAsnAlaLeuTyrAsnGlyLeuThrProLeu-343 |
| SEQ. ID. NO. 10151 | 352-IleMetArgAlaValSerThrTyrThrLysSerAlaAsnAsn-365 |
| SEQ. ID. NO. 10152 | 374-IleThrThrIleArgThrLeuAspTyrValArgArgSerVal-387 |
| SEQ. ID. NO. 10153 | 411-GluIleLeuAspValLeuIle-417 |
| SEQ. ID. NO. 10154 | 421-GlnAlaGluIleIleGluAsn-427 |
| SEQ. ID. NO. 10155 | 441-GlnAsnAspProAsn-445 |
| SEQ. ID. NO. 10156 | 454-AspValValAsnGlyLeu-459 |
| Antigenic Index - Jameson-Wolf | |
| SEQ. ID. NO. 10157 | 6-AspPheAspThrIleProGlySerIleArgValProGlyGln-19 |
| SEQ. ID. NO. 10158 | 23-PheAsnThrArgAsnAlaVal-29 |
| SEQ. ID. NO. 10159 | 32-LeuProGlnAsnProGlnLys-38 |
| SEQ. ID. NO. 10160 | 61-SerAspAlaGluAlaAlaAsp-67 |
| SEQ. ID. NO. 10161 | 125-IleGlyGlyLysGlnVal-130 |
| SEQ. ID. NO. 10162 | 134-ValAsnThrGlyGluThrAla-140 |
| SEQ. ID. NO. 10163 | 143-ValAlaAspArgLeuLysThr-149 |
| SEQ. ID. NO. 10164 | 171-AlaLysHisLysGlyGluIleGlyAsnGluSerGlyLeu-183 |
| SEQ. ID. NO. 10165 | 201-GlyGlyAlaLysAsnAlaAsp-207 |
| SEQ. ID. NO. 10166 | 215-ValAlaGlyLysHis-219 |
| SEQ. ID. NO. 10167 | 225-SerProPheSerAspAspAlaAsnAlaLysAlaLeuSer-237 |
| SEQ. ID. NO. 10168 | 243-ValSerAsnAlaIleGluGlnArgGlyCys-252 |
| SEQ. ID. NO. 10169 | 268-AlaThrGlyGluIleAsnAspGlyArgMet-277 |
| SEQ. ID. NO. 10170 | 284-GlyAlaValGluProAsnGly-290 |
| SEQ. ID. NO. 10171 | 302-PheGluGluAspProAlaLysProLeuAsn-311 |
| SEQ. ID. NO. 10172 | 313-LeuGluIleLysGly-317 |
| SEQ. ID. NO. 10173 | 320-ValThrProAspAlaGln-325 |
| SEQ. ID. NO. 10174 | 332-CysAsnAsnAlaLeuTyrAsnGly-339 |
| SEQ. ID. NO. 10175 | 358-ThrTyrThrLysSerAlaAsnAsnThrAspAspProAlaLeu-371 |
| SEQ. ID. NO. 10176 | 381-AspTyrValArgArgSerValLysGluArgIleAlaLeuArgPheProArgAspLysLeuSerAspArgLeuLeuProLysValLysSerGluIle-412 |
| SEQ. ID. NO. 10177 | 419-LeuAspGlnAlaGluIleIleGluAsnAlaAlaAsnLysGlyLysLeuValVal-437 |
| SEQ. ID. NO. 10178 | 440-AlaGlnAsnAspProAsnArgValAsnAla-449 |
| Hydrophilic Regions - Hopp-Woods | |
| SEQ. ID. NO. 10179 | 61-SerAspAlaGluAlaAlaAsp-67 |
| SEQ. ID. NO. 10180 | 135-AsnThrGlyGluThr-139 |
| SEQ. ID. NO. 10181 | 143-ValAlaAspArgLeuLysThr-149 |

TABLE 1-continued

| | |
|---|---|
| SEQ. ID. NO. 10182 | 171-AlaLysHisLysGlyGluIleGlyAsn-179 |
| SEQ. ID. NO. 10183 | 203-AlaLysAsnAlaAsp-207 |
| SEQ. ID. NO. 10184 | 227-PheSerAspAspAlaAsnAlaLysAlaLeu-236 |
| SEQ. ID. NO. 10185 | 247-IleGluGlnArgGly-251 |
| SEQ. ID. NO. 10186 | 270-GlyGluIleAsnAspGlyArgMet-277 |
| SEQ. ID. NO. 10187 | 302-PheGluGluAspProAlaLysPro-309 |
| SEQ. ID. NO. 10188 | 313-LeuGluIleLysGly-317 |
| SEQ. ID. NO. 10189 | 362-SerAlaAsnAsnThrAspAspProAlaLeu-371 |
| SEQ. ID. NO. 10190 | 381-AspTyrValArgArgSerValLysGluArgIleAla-392 |
| SEQ. ID. NO. 10191 | 395-PheProArgAspLysLeuSerAspArgLeuLeuProLysValLysSerGluIle-412 |
| SEQ. ID. NO. 10192 | 419-LeuAspGlnAlaGluIleIleGluAsnAlaGluAlaAsnLysGlyLysLeuValVal-437 |
| SEQ. ID. NO. 10193 | 440-AlaGlnAsnAspProAsnArg-446 |
| 713 | |
| AMPHI Regions - AMPHI | |
| SEQ. ID. NO. 10194 | 18-GluHisArgHisTrpGlu-23 |
| SEQ. ID. NO. 10195 | 115-AspAlaAlaLysLysLeuAlaAlaProTrpProGlnIle-127 |
| SEQ. ID. NO. 10196 | 150-ThrValTrpGlnAlaLeuThrHisIleAlaAsnSerVal-162 |
| SEQ. ID. NO. 10197 | 257-AspAsnLeuAlaAlaLeuGln-263 |
| SEQ. ID. NO. 10198 | 265-GlnAlaLysLysGln-269 |
| Antigenic Index - Jameson-Wolf | |
| SEQ. ID. NO. 10199 | 1-MetGlnAsnAsnSerTyrGly-7 |
| SEQ. ID. NO. 10200 | 13-ArgValGlyGlyLysGluHisArgHisTrpGluArgTyrAspIleAspSerAspPhe-31 |
| SEQ. ID. NO. 10201 | 44-ArgLeuGlyProGluAlaAlaIleProAspLeuSerGlyGluSerCysGluValIle-63 |
| SEQ. ID. NO. 10202 | 74-GlySerGlnArgHisGlyLysSerLysGlySerArgGluLeuSerLeuSerGlyArgAspLeu-94 |
| SEQ. ID. NO. 10203 | 106-LeuAsnValLysGly-110 |
| SEQ. ID. NO. 10204 | 115-AspAlaAlaLysLysLeu-120 |
| SEQ. ID. NO. 10205 | 131-ValLeuLysAlaGluAsnAsnProAlaLeuGlyLysIleAspIleGluProGlyGlu-149 |
| SEQ. ID. NO. 10206 | 167-TrpLeuGluProAspGlyThrLeu-174 |
| SEQ. ID. NO. 10207 | 177-GlyGlyAlaAspTyrSerSerProPro-185 |
| SEQ. ID. NO. 10208 | 192-SerArgThrAspSerArgCysAsnIleGluArgMetAspIleGluTrpAspThrAspAsnArgPheSerGlu-215 |
| SEQ. ID. NO. 10209 | 222-SerHisGlyArgSerGlyAspSerAlaLysHisAspLeu-234 |
| SEQ. ID. NO. 10210 | 237-ValTyrLysAspProThrMetThrLeuHisArgProLysThrValVal-252 |
| SEQ. ID. NO. 10211 | 254-SerAspAlaAspAsn-258 |
| SEQ. ID. NO. 10212 | 263-GlnLysGlnAlaLysLysGlnLeuAla-271 |
| SEQ. ID. NO. 10213 | 284-ValGlyGlyHisLysThrArgAspGly-292 |
| SEQ. ID. NO. 10214 | 303-ValIleAspAspGluHisGlyIle-310 |
| SEQ. ID. NO. 10215 | 321-PheMetLeuSerArgMetAspGlyThrGlnThrGluLeuArgLeuLysGluAspGlyIleTrpThrProAspAlaTyrProLysLysAlaGluAlaAla ArgLysArgLysGlyLysArgLysGlyValSerHisLysGlyLysLysGlyGlyLysLysGlnAlaGlu-376 |
| Hydrophilic Regions - Hopp-Woods | |
| SEQ. ID. NO. 10216 | 14-ValGlyGlyLysGluHisArgHisTrpGluArgTyrAspIleAspSer-29 |
| SEQ. ID. NO. 10217 | 54-LeuSerGlyGluSerCysGluValValIle-63 |
| SEQ. ID. NO. 10218 | 76-GlnArgHisGlyLysSerLysGlySerArgGluLeuSerLeuSerGlyArgAspLeu-94 |
| SEQ. ID. NO. 10219 | 115-AspAlaAlaLysLysLeu-120 |
| SEQ. ID. NO. 10220 | 131-ValLeuLysAlaGluAsnAsnProAla-139 |
| SEQ. ID. NO. 10221 | 141-GlyLysIleAspIleGluProGlyGlu-149 |
| SEQ. ID. NO. 10222 | 168-LeuGluProAspGly-172 |
| SEQ. ID. NO. 10223 | 193-ArgThrAspSerArgCysAsnIleGluArgMetAspIleGluTrpAspThrAspAsnArgPheSer-214 |
| SEQ. ID. NO. 10224 | 222-SerHisGlyArgSerGlyAspSerAlaLysHisAspLeu-234 |
| SEQ. ID. NO. 10225 | 246-HisArgProLysThr-250 |
| SEQ. ID. NO. 10226 | 254-SerAspAlaAspAsn-258 |
| SEQ. ID. NO. 10227 | 263-GlnLysGlnAlaLysLysGlnLeuAla-271 |
| SEQ. ID. NO. 10228 | 286-GlyHisLysThrArgAsp-291 |
| SEQ. ID. NO. 10229 | 303-ValIleAspAspGluHisGlyIle-310 |
| SEQ. ID. NO. 10230 | 325-ArgMetAspGlyThrGlnThrGluLeuArgLeuLysGluAspGlyIleTrp-341 |
| SEQ. ID. NO. 10231 | 345-AlaTyrProLysLysAlaGluAlaAlaArgLysArgLysGlyLysArgLysGlyValSerHisLysGlyLysLysGlyGlyLysLysGlnAlaGlu-376 |
| 714 | |
| AMPHI Regions - AMPHI | |
| SEQ. ID. NO. 10232 | 6-IleLeuArgGlyLeuLeuPro-12 |
| SEQ. ID. NO. 10233 | 34-LeuAspAlaValAlaGluSerAlaGlnSerValAla-45 |
| SEQ. ID. NO. 10234 | 54-GlyGlnMetLeuAlaAspTrpGluArgValLeuGlyLeu-66 |
| SEQ. ID. NO. 10235 | 79-AlaValMetAlaLysLeuAsnGluThrGly-88 |
| SEQ. ID. NO. 10236 | 98-LeuAlaGluAlaAla-102 |
| SEQ. ID. NO. 10237 | 110-GluProGlnProPhe-114 |
| SEQ. ID. NO. 10238 | 116-AlaGlyValAsnArgAlaGlyAspArgLeu-125 |
| SEQ. ID. NO. 10239 | 155-AlaGlyAspArgLeuThrAspTyrSerAspAlaValIleGluSerLeuPheAsnArgLeuLys-175 |
| Antigenic Index - Jameson-Wolf | |
| SEQ. ID. NO. 10240 | 15-SerTyrAlaArgAsnAlaProArgValArgAlaGlnAlaGluIleAspGlyAlaAla-33 |
| SEQ. ID. NO. 10241 | 36-AlaValAlaGluSerAlaGlnSerVal-44 |
| SEQ. ID. NO. 10242 | 46-AspAlaValAspProArgSerAla-53 |
| SEQ. ID. NO. 10243 | 64-LeuGlyLeuAspGlyThrGlyLysAsnArgGlnHisArg-76 |
| SEQ. ID. NO. 10244 | 83-LysLeuAsnGluThrGlyGlyLeu-90 |
| SEQ. ID. NO. 10245 | 107-GlnIleAspGluProGlnProPheArgAlaGlyValAsnArgAlaGlyAspArgLeuAlaPro-127 |
| SEQ. ID. NO. 10246 | 138-ValArgGlyGlyAsnAsnArgIleThrArgPheArgAlaGlyIle-152 |
| SEQ. ID. NO. 10247 | 154-AlaAlaGlyAspArgLeuThrAspTyrSerAspAlaValIle-167 |
| SEQ. ID. NO. 10248 | 170-LeuPheAsnArgLeuLysPro-176 |
| Hydrophilic Regions - Hopp-Woods | |
| SEQ. ID. NO. 10249 | 18-ArgAsnAlaProArgValArgAlaGlnAlaGluIleAspGlyAlaAla-33 |
| SEQ. ID. NO. 10250 | 36-AlaValAlaGluSerAlaGlnSerVal-44 |
| SEQ. ID. NO. 10251 | 46-AspAlaValAspProArgSerAla-53 |
| SEQ. ID. NO. 10252 | 68-GlyThrGlyLysAsnArgGlnHisArg-76 |

TABLE 1-continued

| | |
|---|---|
| SEQ. ID. NO. 10253 | 107-GlnIleAspGluProGlnProPhe-114 |
| SEQ. ID. NO. 10254 | 117-GlyValAsnArgAlaGlyAspArgLeuAlaPro-127 |
| SEQ. ID. NO. 10255 | 139-ArgGlyGlyAsnAsnArgIleThrArgPheArgAla-150 |
| SEQ. ID. NO. 10256 | 154-AlaAlaGlyAspArgLeuThrAspTyrSerAspAlaValIle-167 |
| SEQ. ID. NO. 10257 | 170-LeuPheAsnArgLeuLysPro-176 |

715
AMPHI Regions - AMPHI

| | |
|---|---|
| SEQ. ID. NO. 10258 | 15-GlnIleGluArgLeuGlyAsnGlyIle-23 |
| SEQ. ID. NO. 10259 | 31-ArgArgLeuSerGluThrMetHis-38 |
| SEQ. ID. NO. 10260 | 64-LeuSerAspSerGlyArgLeuLysAspSerPheSer-75 |
| SEQ. ID. NO. 10261 | 94-IleHisAsnPheGlyGly-99 |

Antigenic Index - Jameson-Wolf

| | |
|---|---|
| SEQ. ID. NO. 10262 | 15-GlnIleGluArgLeuGlyAsnGlyIleGluAsnArgTyrLeuLeu-29 |
| SEQ. ID. NO. 10263 | 47-TyrAlaGlyArgProLysTrpValGlyLeuLysTyrArgAspGlyLysProLeuSerAspSerGlyArgLeuLysAspSerPheSerThrLeuSerAspAsnAspThrAla-83 |
| SEQ. ID. NO. 10264 | 98-GlyGlyMetAlaGlyArgAsnArgLysValArgIleProGlnArgGluPhe-114 |
| SEQ. ID. NO. 10265 | 118-ThrAspAspAspLysGlnAlaLeuMetAspAspValGlnAsp-131 |

Hydrophilic Regions - Hopp-Woods

| | |
|---|---|
| SEQ. ID. NO. 10266 | 15-GlnIleGluArgLeuGlyAsn-21 |
| SEQ. ID. NO. 10267 | 57-LysTyrArgAspGlyLysProLeuSerAspSerGlyArgLeuLysAspSerPhe-74 |
| SEQ. ID. NO. 10268 | 78-SerAspAsnAspThr-82 |
| SEQ. ID. NO. 10269 | 101-AlaGlyArgAsnArgLysValArgIleProGlnArgGlu-113 |
| SEQ. ID. NO. 10270 | 118-ThrAspAspAspLysGlnAlaLeuMetAspAspValGlnAsp-131 |

716
AMPHI Regions - AMPHI

| | |
|---|---|
| SEQ. ID. NO. 10271 | 33-GlyValHisLysSerAlaHisGly-40 |
| SEQ. ID. NO. 10272 | 71-AlaThrValLysLysThrHisLysHisThrLysAla-82 |

Antigenic Index - Jameson-Wolf

| | |
|---|---|
| SEQ. ID. NO. 10273 | 1-MetAsnLysAsnIle-5 |
| SEQ. ID. NO. 10274 | 23-AlaAlaAsnLysProAlaSerAsnAlaThrGlyValHisLysSerAlaHisGlySerCysGlyAlaSerLysSerAlaGluGlySerCysGlyAlaAlaGlySerLysAlaGlyGluGlyLysCysGlyGluGlyLysCysGlyAlaThrValLysLysThrHisLysHisThrLysAlaSerLysAlaLysAlaLysSerAlaGluGlyLysCysGlyGluGlyLysCysGlySerLys-102 |

Hydrophilic Regions - Hopp-Woods

| | |
|---|---|
| SEQ. ID. NO. 10275 | 23-AlaAlaAsnLysProAlaSer-29 |
| SEQ. ID. NO. 10276 | 33-GlyValHisLysSerAlaHis-39 |
| SEQ. ID. NO. 10277 | 43-GlyAlaSerLysSerAlaGluGlySerCys-52 |
| SEQ. ID. NO. 10278 | 55-AlaGlySerLysAlaGlyGluGlyLysCysGlyGluGlyLysCys-69 |
| SEQ. ID. NO. 10279 | 71-AlaThrValLysLysThrHisLysHisThrLysAlaSerLysAlaLysAlaLysSerAlaGluGlyLysCysGlyGluGlyLysCysGlySerLys-102 |

717
AMPHI Regions - AMPHI

| | |
|---|---|
| SEQ. ID. NO. 10280 | 175-AlaValTyrAlaLeuAlaAsn-181 |
| SEQ. ID. NO. 10281 | 209-LeuHisArgGlyLeu-213 |
| SEQ. ID. NO. 10282 | 223-SerIleAlaTyrTrp-227 |
| SEQ. ID. NO. 10283 | 241-AlaGlyLeuGluGlnLeuGly-247 |
| SEQ. ID. NO. 10284 | 263-GlnSerIlePheSerThrValTrpThrProTyrIlePheArgAlaIleGluGlu-280 |
| SEQ. ID. NO. 10285 | 305-ThrGlyIlePheSerProLeuAlaSer-313 |
| SEQ. ID. NO. 10286 | 347-LeuAsnValValArgLysThr-353 |
| SEQ. ID. NO. 10287 | 358-LeuAlaThrLeuGlyAlaLeuAla-365 |
| SEQ. ID. NO. 10288 | 401-SerSerCysArgLeuTrpGlnProLeuLysArgLeu-412 |
| SEQ. ID. NO. 10289 | 430-CysPheGlyThrPro-434 |
| SEQ. ID. NO. 10290 | 442-GlyValTrpAlaAlaTyrLeuAlaGly-450 |
| SEQ. ID. NO. 10291 | 457-LysAspLeuHisLysLeuPheHisTyr-465 |

Antigenic Index - Jameson-Wolf

| | |
|---|---|
| SEQ. ID. NO. 10292 | 1-MetAspThrLysGlu-5 |
| SEQ. ID. NO. 10293 | 32-ProAlaAspAspIleGlyArg-38 |
| SEQ. ID. NO. 10294 | 66-TyrAlaThrAlaAspLysAspThrLeu-74 |
| SEQ. ID. NO. 10295 | 95-SerArgProSerLeuProSerGluIle-103 |
| SEQ. ID. NO. 10296 | 135-MetGluGlyArgAla-139 |
| SEQ. ID. NO. 10297 | 192-AsnArgCysArgLeuLysAlaValArg-200 |
| SEQ. ID. NO. 10298 | 231-SerAlaAspArgLeuPheLeu-237 |
| SEQ. ID. NO. 10299 | 277-AlaIleGluGluAsnAlaProProAlaArgLeu-287 |
| SEQ. ID. NO. 10300 | 289-AlaThrAlaGluSer-293 |
| SEQ. ID. NO. 10301 | 317-ProGluAsnTyrAla-321 |
| SEQ. ID. NO. 10302 | 349-ValValArgLysThrArgProIleAla-357 |
| SEQ. ID. NO. 10303 | 376-ProSerGlyGlyAlaArgGly-382 |
| SEQ. ID. NO. 10304 | 397-PheLysThrGluSerSerCysArgLeu-405 |
| SEQ. ID. NO. 10305 | 453-LeuArgHisArgLysAspLeuHis-460 |

Hydrophilic Regions - Hopp-Woods

| | |
|---|---|
| SEQ. ID. NO. 10306 | 1-MetAspThrLysGlu-5 |
| SEQ. ID. NO. 10307 | 66-TyrAlaThrAlaAspLysAspThrLeu-74 |
| SEQ. ID. NO. 10308 | 135-MetGluGlyArgAla-139 |
| SEQ. ID. NO. 10309 | 192-AsnArgCysArgLeuLysAlaValArg-200 |
| SEQ. ID. NO. 10310 | 277-AlaIleGluGluAsnAlaProProAlaArgLeu-287 |
| SEQ. ID. NO. 10311 | 289-AlaThrAlaGluSer-293 |
| SEQ. ID. NO. 10312 | 349-ValValArgLysThrArgPro-355 |
| SEQ. ID. NO. 10313 | 378-GlyGlyAlaArgGly-382 |
| SEQ. ID. NO. 10314 | 398-LysThrGluSerSerCys-403 |
| SEQ. ID. NO. 10315 | 453-LeuArgHisArgLysAspLeuHis-460 |

718-1

TABLE 1-continued

AMPHI Regions - AMPHI
SEQ. ID. NO. 10316	28-IleThrAlaThrGlyArgValIleAlaGluHisProSerAsnPheIleThrProGln-46
SEQ. ID. NO. 10317	49-ArgAlaLeuPheGlu-53
SEQ. ID. NO. 10318	110-AspGlnAlaTyrGluMetMetAspSerLeuProThr-121
SEQ. ID. NO. 10319	124-AspLeuIleMetAspLeuMetAspAlaValGlyHisGly-136
SEQ. ID. NO. 10320	160-ProGlnSerTrpPheLys-165
SEQ. ID. NO. 10321	198-ArgSerValGlnGln-202
SEQ. ID. NO. 10322	210-ThrLeuSerTrpLeuTyrMetPhe-217
SEQ. ID. NO. 10323	219-HisTyrAlaValHisAspPheAlaGluPheLeuGluLeu-231
SEQ. ID. NO. 10324	255-ArgAlaValAlaGluIle-260
SEQ. ID. NO. 10325	280-AlaAsnGlyThrThr-284
SEQ. ID. NO. 10326	320-ThrAsnAlaLeuGlyAsnIleHisAsnGluValArg-331
SEQ. ID. NO. 10327	341-GlnValAlaGlnThrIleThrSerGlnIleIleGlyProPhe-354
SEQ. ID. NO. 10328	363-AspProAsnArgVal-367
SEQ. ID. NO. 10329	376-GluProLysAspIleAlaValPheAlaAspAlaIleProLysLeuValAsp-392
SEQ. ID. NO. 10330	395-ValGlnIleProGlu-399
SEQ. ID. NO. 10331	420-ArgGlnValProAspAsnPro-426
SEQ. ID. NO. 10332	448-HisGlnGluIleLeuAspGlyAlaLeuAspAsp-458
SEQ. ID. NO. 10333	469-LeuAsnProMetValArgGlnAlaValAlaAlaLeuAsnAlaCysAsnSerTyrGlu-487
Antigenic Index - Jameson-Wolf
SEQ. ID. NO. 10334	4-IleMetAlaLysLysAsnAsnLysThrLysIleGlnLysProGluAlaAlaLeu-21
SEQ. ID. NO. 10335	30-AlaThrGlyArgValIleAla-36
SEQ. ID. NO. 10336	38-HisProSerAsnPhe-42
SEQ. ID. NO. 10337	44-ThrProGlnLysMetArgAlaLeuPheGluAspAlaGluSerGlyAspIleArgAlaGlnHis-64
SEQ. ID. NO. 10338	68-AlaAspIleGluGluArgAspSerAspIle-77
SEQ. ID. NO. 10339	81-MetGlyThrArgLysArgAla-87
SEQ. ID. NO. 10340	95-ValAlaProProArgAsnAlaThrProGluGluGluLysLeuSerAspGlnAlaTyrGluMet-115
SEQ. ID. NO. 10341	119-LeuProThrLeuGlu-123
SEQ. ID. NO. 10342	148-AspGlyLeuTyrLeuProArgAsnPheIleHisArgProGlnSerTrpPheLysTrpAspLysAspAsnGlyLeu-172
SEQ. ID. NO. 10343	174-LeuArgThrArgGluAsnProGluGlyGluAla-184
SEQ. ID. NO. 10344	193-HisThrGlnLysSerArgSerValGlnGlnAlaArgAsnGlyLeuPhe-208
SEQ. ID. NO. 10345	237-ArgIleGlyLysTyrGlyAlaGlyAlaThrLysGluGluLysAsnThrLeu-253
SEQ. ID. NO. 10346	268-MetProGluGlyMetGluIleGluLeu-276
SEQ. ID. NO. 10347	280-AlaAsnGlyThrThrAlaThr-286
SEQ. ID. NO. 10348	295-AspTrpCysGluLysSerAlaAla-302
SEQ. ID. NO. 10349	310-LeuThrSerGlyAlaAspGlyLysSerSerThrAsnAlaLeuGly-324
SEQ. ID. NO. 10350	328-AsnGluValArgArgAspLeuLeuValSerAspAlaLysGlnVal-342
SEQ. ID. NO. 10351	359-TyrProHisAlaAspProAsnArgValProLysPheGluPheAspThrArgGluProLysAspIle-380
SEQ. ID. NO. 10352	397-IleProGluSerTrpValArgAspLysLeuVal-407
SEQ. ID. NO. 10353	410-AspValGlnGluGlyGlyGluAlaValLeu-418
SEQ. ID. NO. 10354	420-ArgGlnValProAspAsnProValAsnArg-429
SEQ. ID. NO. 10355	440-ValProSerLysAlaThrGlyArgHisGlnGluIleLeuAspGlyAlaLeuAsp-457
SEQ. ID. NO. 10356	459-AlaLeuValGluProAspPheAsnSerGlnLeu-469
SEQ. ID. NO. 10357	484-AsnSerTyrGluGluAlaAspAla-491
SEQ. ID. NO. 10358	499-AsnLeuAspAsnAlaLysLeuArgThr-507
SEQ. ID. NO. 10359	519-LeuGlyGlnAspHisAlaArgAla-526
Hydrophilic Regions - Hopp-Woods
SEQ. ID. NO. 10360	4-IleMetAlaLysLysAsnAsnLysThrLysIleGlnLysProGluAlaAlaLeu-21
SEQ. ID. NO. 10361	46-GlnLysMetArgAlaLeuPheGluAspAlaGluSerGlyAspIleArgAlaGlnHis-64
SEQ. ID. NO. 10362	68-AlaAspIleGluGluArgAspSerAspIle-77
SEQ. ID. NO. 10363	81-MetGlyThrArgLysArgAla-87
SEQ. ID. NO. 10364	96-AlaProProArgAsnAlaThrProGluGluGluLysLeuSerAspGlnAlaTyrGluMet-115
SEQ. ID. NO. 10365	165-LysTrpAspLysAspAsnGlyLeu-172
SEQ. ID. NO. 10366	174-LeuArgThrArgGluAsnProGluGlyGluAla-184
SEQ. ID. NO. 10367	195-GlnLysSerArgSerValGlnGlnAlaArg-204
SEQ. ID. NO. 10368	245-AlaThrLysGluGluLysAsnThrLeu-253
SEQ. ID. NO. 10369	270-GluGlyMetGluIleGluLeu-276
SEQ. ID. NO. 10370	295-AspTrpCysGluLysSerAlaAla-302
SEQ. ID. NO. 10371	312-SerGlyAlaAspGlyLysSerSerThr-320
SEQ. ID. NO. 10372	328-AsnGluValArgArgAspLeuLeuValSerAspAlaLysGlnVal-342
SEQ. ID. NO. 10373	363-AspProAsnArgValProLysPheGluPheAspThrArgGluProLysAsp-379
SEQ. ID. NO. 10374	401-TrpValArgAspLysLeuVal-407
SEQ. ID. NO. 10375	410-AspValGlnGluGlyGlyGluAlaValLeu-418
SEQ. ID. NO. 10376	421-GlnValProAspAsnProValAsn-428
SEQ. ID. NO. 10377	440-ValProSerLysAlaThrGlyArgHisGlnGluIleLeuAspGlyAlaLeuAsp-457
SEQ. ID. NO. 10378	485-SerTyrGluGluAlaAspAla-491
SEQ. ID. NO. 10379	501-AspAsnAlaLysLeu-505
SEQ. ID. NO. 10380	522-AspHisAlaArgAla-526
719
AMPHIRegions - AMPHI
SEQ. ID. NO. 10381	21-ArgLeuLeuAlaAspThrGlnArgGlnLeuAspArgThrAla-34
SEQ. ID. NO. 10382	68-AlaPheAsnArgLeuAlaArgSerGlyLys-77
SEQ. ID. NO. 10383	79-SerGlnAsnAspLeu-83
SEQ. ID. NO. 10384	104-GlyThrGlyPheAlaAspLysMetGlyLysIleGlyArgPheGlyAla-119
SEQ. ID. NO. 10385	143-AspGluAsnIleAsnArgValSerArg-151
SEQ. ID. NO. 10386	191-AlaLeuAspLeuIleSerGlyMetMet-199
SEQ. ID. NO. 10387	229-ThrAlaLysLeuIleLysThrLeuLysAsp-238
SEQ. ID. NO. 10388	254-LeuGlnSerGlyLeu-258
SEQ. ID. NO. 10389	266-AspMetValArgGluLeuProSerLeuLeuSer-276
SEQ. ID. NO. 10390	280-GlnAlaGlyMetAsnGlyValGlyGlyLeuAspTyrLeuLeuSerLeuLeu-296

TABLE 1-continued

| | |
|---|---|
| SEQ. ID. NO. 10391 | 308-GluAlaAlaThrAsnValGlnAsnLeuLeuSerLys-319 |
| SEQ. ID. NO. 10392 | 324-AspThrIleGlyArgLeuLysLysMetAlaAsnProAsnAspProLysLysGlyValAspTrpIleGlySer-347 |
| SEQ. ID. NO. 10393 | 360-GlnValLeuSerArgLeuAlaAsp-367 |
| SEQ. ID. NO. 10394 | 404-GlnLeuLeuProAspLeu-409 |
| SEQ. ID. NO. 10395 | 418-AlaThrAspMetThrGlnIleArgGluTyrMetAlaSerLeu-431 |
| SEQ. ID. NO. 10396 | 467-GluSerLeuThrGlyThr-472 |
| SEQ. ID. NO. 10397 | 477-GluThrSerPheLysLysLeuAlaAlaGlu-486 |
| SEQ. ID. NO. 10398 | 497-LeuThrThrAlaAla-501 |
| SEQ. ID. NO. 10399 | 519-GlyPheLeuLysAspValGly-525 |
| SEQ. ID. NO. 10400 | 557-AlaGlySerGlyGlyLeu-561 |
| SEQ. ID. NO. 10401 | 588-LeuProLysGlyLeuArgGlyThr-595 |
| SEQ. ID. NO. 10402 | 597-ThrThrProGluMetIleAsnArgLeuLys-606 |
| SEQ. ID. NO. 10403 | 626-ProGlnTyrLeuAlaAlaPro-632 |
| SEQ. ID. NO. 10404 | 635-GlnProThrAspLysMetLeuSerProLeuPhe-645 |
| SEQ. ID. NO. 10405 | 676-ThrGlyLeuAlaGlnValGlnSerAlaMetAla-686 |
| SEQ. ID. NO. 10406 | 707-AsnGluValSerArg-711 |
| Antigenic Index - Jameson-Wolf | |
| SEQ. ID. NO. 10407 | 1-MetAlaAsnGlyAsnMet-6 |
| SEQ. ID. NO. 10408 | 14-AlaArgAspAspGlyAlaArgArgLeuLeuAlaAspThrGlnArgGlnLeuArgThrAlaLysSerArgAlaGlnLeuGluArgGlnSerHisThrTyr-47 |
| SEQ. ID. NO. 10409 | 51-GlyIleArgSerGluLysGlnIleGlnArg-60 |
| SEQ. ID. NO. 10410 | 71-ArgLeuAlaArgSerGlyLysAlaSerGlnAsnAspLeuAlaArg-85 |
| SEQ. ID. NO. 10411 | 90-ThrArgAsnArgIleArgGluLeuAsnAlaGluLeuLysGlnGlyThrGlyPheAlaAspLysMetGlyLysIleGlyArgPheGly-118 |
| SEQ. ID. NO. 10412 | 134-ProAlaMetAspAsnArgLysGlnLeuAspGluAsnIleAsnArgValSerArg-151 |
| SEQ. ID. NO. 10413 | 153-AlaPheIleGluAspAsnSerLysSerAla-162 |
| SEQ. ID. NO. 10414 | 168-GluGlyAlaGlnGlnIleLysAspLeuAla-177 |
| SEQ. ID. NO. 10415 | 180-LeuValGluLysLysAsnGlyGlyThrHisAspLysAlaLeuAsp-193 |
| SEQ. ID. NO. 10416 | 207-GlnThrLysAsnGluAla-212 |
| SEQ. ID. NO. 10417 | 222-SerGluGlySerGlyGluAspThrAlaLysLeu-232 |
| SEQ. ID. NO. 10418 | 234-LysThrLeuLysAspGlyGlyMetSerGlyLysAspLeuGlnLeu-248 |
| SEQ. ID. NO. 10419 | 256-SerGlyLeuAspGlyThrPheGluValArgAspMetValArgGluLeuProSer-273 |
| SEQ. ID. NO. 10420 | 299-AlaAlaAsnLysSerGlySerProAlaGluAla-309 |
| SEQ. ID. NO. 10421 | 318-SerLysThrLeuSerProAspThrIleGlyArgLeuLysLysMetAlaAsnProAsnAspProLysLysGlyValAspTrp-344 |
| SEQ. ID. NO. 10422 | 349-ValGlnGlyLysGlnAsnGlyGluAsn-357 |
| SEQ. ID. NO. 10423 | 369-MetLeuValLysAspLysGlnTyrGlnAspTyrLysLysArgAlaAlaAlaGlyAspLysThrAlaAlaGluGln-393 |
| SEQ. ID. NO. 10424 | 422-ThrGlnIleArgGluTyrMet-428 |
| SEQ. ID. NO. 10425 | 437-AspAsnGlyLysIleAlaLysAsnAsnGluAlaArgMet-449 |
| SEQ. ID. NO. 10426 | 454-AlaGlnGlnGluGlnGlnGluSer-461 |
| SEQ. ID. NO. 10427 | 463-AlaMetLeuArgGluSerLeu-469 |
| SEQ. ID. NO. 10428 | 474-ValAspMetGluThrSerPheLysLysLeuAlaAla-485 |
| SEQ. ID. NO. 10429 | 511-ThrAlaGlyGlyGlyLysGlyAlaGlyPhe-520 |
| SEQ. ID. NO. 10430 | 522-LysAspValGlySerLysAla-528 |
| SEQ. ID. NO. 10431 | 532-GlyLysAlaSerAlaGlyGly-538 |
| SEQ. ID. NO. 10432 | 545-AlaAlaGlyGlyLys-549 |
| SEQ. ID. NO. 10433 | 554-GlyLysSerAlaGlySerGlyLeuMetAsnAsnProAlaLeuValLysArgAlaGly-572 |
| SEQ. ID. NO. 10434 | 580-SerGluSerLeuGlyAspGlyThrLeuProLysGlyLeuArgGlyThrLysThrThrPro-599 |
| SEQ. ID. NO. 10435 | 601-MetIleAsnArgLeuLysAsnAsnGlyIleArgPheGluProAlaProLysArgGluGlnAlaArgGlyGlyValPro-626 |
| SEQ. ID. NO. 10436 | 631-AlaProSerAlaGlnProThrAspLysMetLeuSerPro-643 |
| SEQ. ID. NO. 10437 | 687-SerAlaSerGlnThrIleAsnThrAsnValSerLeuAsnIleAspGlyArgValIleAla-706 |
| SEQ. ID. NO. 10438 | 708-GluValSerArgTyrGln-713 |
| SEQ. ID. NO. 10439 | 718-GlyArgGlyAlaGlyGln-723 |
| Hydrophilic Regions - Hopp-Woods | |
| SEQ. ID. NO. 10440 | 14-AlaArgAspAspGlyAlaArgArgLeuLeuAlaAspThrGlnArgGlnLeuArgThrAlaLysSerArgAlaGlnLeuGluArgGlnSer-44 |
| SEQ. ID. NO. 10441 | 52-IleArgSerGluLysGlnIleGlnArg-60 |
| SEQ. ID. NO. 10442 | 71-ArgLeuAlaArgSerGlyLysAlaSerGlnAsnAspLeuAlaArg-85 |
| SEQ. ID. NO. 10443 | 90-ThrArgAsnArgIleArgGluLeuAsnAlaGluLeuLysGln-103 |
| SEQ. ID. NO. 10444 | 107-PheAlaAspLysMetGlyLysIleGlyArg-116 |
| SEQ. ID. NO. 10445 | 134-ProAlaMetAspAsnArgLysGlnLeuAspGluAsnIleAsnArgValSerArg-151 |
| SEQ. ID. NO. 10446 | 153-AlaPheIleGluAspAsnSerLys-160 |
| SEQ. ID. NO. 10447 | 168-GluGlyAlaGlnGlnIleLysAspLeuAla-177 |
| SEQ. ID. NO. 10448 | 180-LeuValGluLysLysAsnGlyGlyThrHisAspLysAlaLeuAsp-193 |
| SEQ. ID. NO. 10449 | 207-GlnThrLysAsnGluAla-212 |
| SEQ. ID. NO. 10450 | 222-SerGluGlySerGlyGluAspThrAlaLysLeu-232 |
| SEQ. ID. NO. 10451 | 234-LysThrLeuLysAspGlyGlyMetSerGlyLysAspLeuGlnLeu-248 |
| SEQ. ID. NO. 10452 | 262-PheGluValArgAspMetValArgGluLeuPro-272 |
| SEQ. ID. NO. 10453 | 299-AlaAlaAsnLysSerGlySerProAlaGluAla-309 |
| SEQ. ID. NO. 10454 | 325-ThrIleGlyArgLeuLysLysMetAlaAsnProAsnAspProLysLysGlyVal-342 |
| SEQ. ID. NO. 10455 | 349-ValGlnGlyLysGlnAsnGlyGluAsn-357 |
| SEQ. ID. NO. 10456 | 369-MetLeuValLysAspLysGlnTyrGlnAspTyrLysLysArgAlaAlaAlaGlyAspLysThrAlaAlaGluGln-393 |
| SEQ. ID. NO. 10457 | 422-ThrGlnIleArgGluTyrMet-428 |
| SEQ. ID. NO. 10458 | 437-AspAsnGlyLysIleAlaLysAsnAsnGluAlaArgMet-449 |
| SEQ. ID. NO. 10459 | 454-AlaGlnGlnGluGlnGlnGluSer-461 |
| SEQ. ID. NO. 10460 | 463-AlaMetLeuArgGluSerLeu-469 |
| SEQ. ID. NO. 10461 | 474-ValAspMetGluThrSerPheLysLysLeuAlaAla-485 |
| SEQ. ID. NO. 10462 | 522-LysAspValGlySer-526 |
| SEQ. ID. NO. 10463 | 567-LeuValLysArgAlaGly-572 |
| SEQ. ID. NO. 10464 | 590-LysGlyLeuArgGlyThrLysThrThrPro-599 |
| SEQ. ID. NO. 10465 | 601-MetIleAsnArgLeuLysAsnAsnGlyIleArgPheGluProAlaProLysArgGluGlnAlaArgGlyGly-624 |

TABLE 1-continued

| SEQ. ID. NO. 10466 | 635-GlnProThrAspLysMetLeu-641 |
| SEQ. ID. NO. 10467 | 700-IleAspGlyArgValIleAla-706 |

720
AMPHI Regions - AMPHI
| SEQ. ID. NO. 10468 | 6-ThrLeuLeuGlnAspAlaSer-12 |
| SEQ. ID. NO. 10469 | 24-AspGluSerAsnGlyLysAlaLeuAlaGluHisAlaArgProPhe-38 |
| SEQ. ID. NO. 10470 | 65-TyrAlaGlyArgLeuLysLysLeuLeuAspAlaLeuGluGlnPro-79 |
| SEQ. ID. NO. 10471 | 87-ProValTrpGlyArgMetHisAsnMetIleAlaAla-98 |
| SEQ. ID. NO. 10472 | 142-IleAlaAsnIleAspThrTyrArg-149 |
| SEQ. ID. NO. 10473 | 166-ValSerAlaLeuTrpGlySerAlaLeuGly-175 |
| SEQ. ID. NO. 10474 | 184-PheGlyAlaValArgArgLeuPheAspLeuAspLysIleAla-197 |
| SEQ. ID. NO. 10475 | 212-GlySerAlaLysLeuPheAlaAspIleSerVal-222 |
| SEQ. ID. NO. 10476 | 268-LeuThrGlyArgPheSerAspGlyLeuGlnAsnArgLeuAsnArgLeu-283 |
| SEQ. ID. NO. 10477 | 293-GlnAlaValArgLeuLeuSerThrSer-301 |
| SEQ. ID. NO. 10478 | 320-AlaProAspLeuIleGluValAsn-327 |
| SEQ. ID. NO. 10479 | 340-AlaLeuArgAlaValGlnThrAla-347 |
| SEQ. ID. NO. 10480 | 365-GlnThrAlaGluSerLeu-370 |
| SEQ. ID. NO. 10481 | 376-ArgLeuAsnAlaLeuValAla-382 |
| SEQ. ID. NO. 10482 | 400-GlyThrIleHisGlnIleAlaHisGluPheTyrGlyAspIleAlaArgAlaAlaGluLeuVal-420 |

Antigenic Index - Jameson-Wolf
| SEQ. ID. NO. 10483 | 8-LeuGlnAspAlaSerTyrLysGlyValGlyPhe-18 |
| SEQ. ID. NO. 10484 | 21-GluValValAspGluSerAsnGlyLysAlaLeuAlaGluHisAlaArg-36 |
| SEQ. ID. NO. 10485 | 42-IleAspLeuGluAspMetGlyMetThrGlyArg-52 |
| SEQ. ID. NO. 10486 | 62-GlyLysGlyTyrAlaGlyArgLeuLysLysLeuLeuAspAlaLeuGluGlnProGlyGlyGly-82 |
| SEQ. ID. NO. 10487 | 101-SerTyrArgHisGluAlaAspTyr-108 |
| SEQ. ID. NO. 10488 | 117-ThrPheArgGluAlaAlaGluAlaGln-125 |
| SEQ. ID. NO. 10489 | 146-AspThrTyrArgGluAlaAla-152 |
| SEQ. ID. NO. 10490 | 189-ArgLeuPheAspLeuAspLys-195 |
| SEQ. ID. NO. 10491 | 197-AlaPheProAspArgGlyGlyTyrSer-205 |
| SEQ. ID. NO. 10492 | 209-PheLysAsnGlySer-213 |
| SEQ. ID. NO. 10493 | 226-ThrGlyIleArgArgGluAlaGlyLeu-234 |
| SEQ. ID. NO. 10494 | 244-TrpSerProArgGlnArgPheAspGly-252 |
| SEQ. ID. NO. 10495 | 256-ValAlaAspArgAlaAlaAlaAlaIleProAspAsn-266 |
| SEQ. ID. NO. 10496 | 270-GlyArgPheSerAspGlyLeuGlnAsnArgLeuAsnArgLeuThrAlaLysGlnVal-288 |
| SEQ. ID. NO. 10497 | 313-AlaHisGlyGluGluMetThrAla-320 |
| SEQ. ID. NO. 10498 | 322-AspLeuIleGluValAsnArgAlaMetArgArgArgMetGlnAla-336 |
| SEQ. ID. NO. 10499 | 348-AlaAlaGluSerGlyGlyLeuThrAla-356 |
| SEQ. ID. NO. 10500 | 365-GlnThrAlaGluSerLeuArgAlaAlaAla-374 |
| SEQ. ID. NO. 10501 | 386-AsnGlnLysProProLeu-391 |
| SEQ. ID. NO. 10502 | 395-GlnAlaProIleAspGlyThr-401 |
| SEQ. ID. NO. 10503 | 413-IleAlaArgAlaAlaGlu-418 |
| SEQ. ID. NO. 10504 | 431-PheIleLysArgGlyThrLeuValAsnSerTyrAlaLys-443 |

Hydrophilic Regions - Hopp-Woods
| SEQ. ID. NO. 10505 | 21-GluValValAspGluSerAsnGlyLysAlaLeuAlaGluHisAlaArg-36 |
| SEQ. ID. NO. 10506 | 42-IleAspLeuGluAspMetGlyMetThr-50 |
| SEQ. ID. NO. 10507 | 65-TyrAlaGlyArgLeuLysLysLeuLeuAspAlaLeuGluGlnProGly-80 |
| SEQ. ID. NO. 10508 | 104-HisGluAlaAspTyr-108 |
| SEQ. ID. NO. 10509 | 117-ThrPheArgGluAlaAlaGluAlaGln-125 |
| SEQ. ID. NO. 10510 | 146-AspThrTyrArgGluAlaAla-152 |
| SEQ. ID. NO. 10511 | 189-ArgLeuPheAspLeuAspLys-195 |
| SEQ. ID. NO. 10512 | 197-AlaPheProAspArgGlyGly-203 |
| SEQ. ID. NO. 10513 | 226-ThrGlyIleArgArgGluAlaGlyLeu-234 |
| SEQ. ID. NO. 10514 | 246-ProArgGlnArgPheAspGly-252 |
| SEQ. ID. NO. 10515 | 256-ValAlaAspArgAlaAlaAlaAla-262 |
| SEQ. ID. NO. 10516 | 276-LeuGlnAsnArgLeuAsnArgLeuThrAla-285 |
| SEQ. ID. NO. 10517 | 313-AlaHisGlyGluGluMetThrAla-320 |
| SEQ. ID. NO. 10518 | 322-AspLeuIleGluValAsnArgAlaMetArgArgArgMetGlnAla-336 |
| SEQ. ID. NO. 10519 | 348-AlaAlaGluSerGlyGly-353 |
| SEQ. ID. NO. 10520 | 368-GluSerLeuArgAlaAlaAla-374 |
| SEQ. ID. NO. 10521 | 413-IleAlaArgAlaAlaGlu-418 |

721
AMPHI Regions - AMPHI
| SEQ. ID. NO. 10522 | 87-AlaGlyTrpMetArgTrpLeuGlu-94 |
| SEQ. ID. NO. 10523 | 120-ArgTyrIleSerAlaVal-125 |
| SEQ. ID. NO. 10524 | 135-SerLysIlePheHisAlaAlaLeuThrAsnPheProAlaLeuAspGlyMetAspGluValLeuAla-156 |
| SEQ. ID. NO. 10525 | 170-AsnProMetLysGluLeuLeuGlnGlnLeuPheAspLeuPro-183 |
| SEQ. ID. NO. 10526 | 210-AspValPheAlaGln-214 |
| SEQ. ID. NO. 10527 | 236-LysTyrAlaProIleSerValValGlnGluLeuGln-247 |
| SEQ. ID. NO. 10528 | 282-TrpAlaLysGlyValLeuLysGlnProGlyGly-292 |
| SEQ. ID. NO. 10529 | 294-AlaPheLeuThrGlyPheIleGlu-301 |

Antigenic Index - Jameson-Wolf
| SEQ. ID. NO. 10530 | 1-MetSerLysAsnAlaGln-6 |
| SEQ. ID. NO. 10531 | 16-GluValGlnProLysAspGlyArgIle-24 |
| SEQ. ID. NO. 10532 | 27-LeuProTyrGlyGlu-31 |
| SEQ. ID. NO. 10533 | 33-ArgAlaValAspGlyArgProThrAspValProAla-44 |
| SEQ. ID. NO. 10534 | 48-ThrGluGluAsnGlyHisAsp-54 |
| SEQ. ID. NO. 10535 | 58-LeuAlaAsnSerSerArgAsnGlnLeu-66 |
| SEQ. ID. NO. 10536 | 74-ThrLeuTyrLysGluLysAsnGlyGlnProAlaPro-85 |
| SEQ. ID. NO. 10537 | 94-GluPheThrProLysGlyMetPheAla-102 |
| SEQ. ID. NO. 10538 | 105-GluTrpThrAspLysAlaAla-111 |

TABLE 1-continued

| | |
|---|---|
| SEQ. ID. NO. 10539 | 115-AlaAlaLysGluTyrArg-120 |
| SEQ. ID. NO. 10540 | 126-PheSerTyrAspThrLysGlyTyrVal-134 |
| SEQ. ID. NO. 10541 | 149-AspGlyMetAspGluValLeu-155 |
| SEQ. ID. NO. 10542 | 161-GlnIleLeuLysProGluThrGluGlnAsnProMetLysGluLeuLeu-176 |
| SEQ. ID. NO. 10543 | 183-ProAspAlaGlyGluGluGluLeuLysAla-192 |
| SEQ. ID. NO. 10544 | 198-ValGluAlaLysProLysAspValAlaLeu-207 |
| SEQ. ID. NO. 10545 | 215-LeuAlaGluLysAspSerArgIle-222 |
| SEQ. ID. NO. 10546 | 228-GlnThrAlaLysProAspLeuThrLysTyrAla-238 |
| SEQ. ID. NO. 10547 | 255-AlaLysGlnGluAlaAspLysGlyAsnGlu-264 |
| SEQ. ID. NO. 10548 | 277-ProAlaGlnLysGluTrpAla-283 |
| SEQ. ID. NO. 10549 | 286-ValLeuLysGlnProGlyGly-292 |
| SEQ. ID. NO. 10550 | 311-GlySerGlnThrGlyGlyLysAlaProAspGluArgValAla-324 |
| SEQ. ID. NO. 10551 | 327-ThrAlaGluGluAlaAlaAla-333 |
| SEQ. ID. NO. 10552 | 338-GlyMetSerGlyGluGluPheValLysIleLysGluSerGluGlyLys-353 |
| Hydrophilic Regions - Hopp-Woods | |
| SEQ. ID. NO. 10553 | 1-MetSerLysAsnAlaGln-6 |
| SEQ. ID. NO. 10554 | 17-ValGlnProLysAspGlyArgIle-24 |
| SEQ. ID. NO. 10555 | 33-ArgAlaValAspGlyArgProThrAsp-41 |
| SEQ. ID. NO. 10556 | 49-GluGluAsnGlyHis-53 |
| SEQ. ID. NO. 10557 | 74-ThrLeuTyrLysGluLysAsnGlyGln-82 |
| SEQ. ID. NO. 10558 | 105-GluTrpThrAspLysAlaAla-111 |
| SEQ. ID. NO. 10559 | 115-AlaAlaLysGluTyrArg-120 |
| SEQ. ID. NO. 10560 | 149-AspGlyMetAspGluValLeu-155 |
| SEQ. ID. NO. 10561 | 163-LeuLysProGluThrGluGlnAsnProMetLysGluLeuLeu-176 |
| SEQ. ID. NO. 10562 | 183-ProAspAlaGlyGluGluGluLeuLysAla-192 |
| SEQ. ID. NO. 10563 | 198-ValGluAlaLysProLysAspValAlaLeu-207 |
| SEQ. ID. NO. 10564 | 215-LeuAlaGluLysAspSerArgIle-222 |
| SEQ. ID. NO. 10565 | 229-ThrAlaLysProAspLeuThrLys-236 |
| SEQ. ID. NO. 10566 | 255-AlaLysGlnGluAlaAspLysGlyAsnGlu-264 |
| SEQ. ID. NO. 10567 | 277-ProAlaGlnLysGluTrpAla-283 |
| SEQ. ID. NO. 10568 | 314-ThrGlyGlyLysAlaProAspGluArgValAla-324 |
| SEQ. ID. NO. 10569 | 327-ThrAlaGluGluAlaAlaAla-333 |
| SEQ. ID. NO. 10570 | 340-SerGlyGluGluPheValLysIleLysGluSerGluGlyLys-353 |
| 723 | |
| AMPHI Regions - AMPHI | |
| SEQ. ID. NO. 10571 | 57-ThrGlnGlnValGluHisValAspPheValAlaValAla-69 |
| SEQ. ID. NO. 10572 | 87-AsnValAlaAlaLys-91 |
| SEQ. ID. NO. 10573 | 123-CysAspLeuAlaVal-127 |
| SEQ. ID. NO. 10574 | 135-ValGlyGluLeuGlnAspPhe-141 |
| SEQ. ID. NO. 10575 | 208-SerIleThrSerArg-212 |
| SEQ. ID. NO. 10576 | 245-LysAlaValValSerIle-250 |
| Antigenic Index - Jameson-Wolf | |
| SEQ. ID. NO. 10577 | 1-MetArgProLysProArgPheArgArgSerVal-11 |
| SEQ. ID. NO. 10578 | 55-HisSerThrGlnGln-59 |
| SEQ. ID. NO. 10579 | 76-HisAlaLeuSerArgArgGlnThrVal-84 |
| SEQ. ID. NO. 10580 | 92-AlaHisGlnAspGlyArgGlnIleLeuLysArgSerSerGluProProGlnIleArgValAspPheGlySerGlyValHisGlnArgGlyLeuCys-123 |
| SEQ. ID. NO. 10581 | 142-GlnLeuThrGluThrArgAsnHisIleLeuAsnArgArgValCysHis-157 |
| SEQ. ID. NO. 10582 | 164-CysSerIleGlySer-168 |
| SEQ. ID. NO. 10583 | 177-SerProThrSerAlaArgPheThrSerArgGlnProProSerAsnSerArgProProArgGlnAsnSerLeuPro-201 |
| SEQ. ID. NO. 10584 | 213-LeuSerAlaLysAlaSerAla-219 |
| SEQ. ID. NO. 10585 | 229-SerAlaSerSerAlaAspSer-235 |
| SEQ. ID. NO. 10586 | 260-SerAlaCysThrAlaSerAsn-266 |
| SEQ. ID. NO. 10587 | 269-LeuMetSerSerAsnAspGlyAlaAla-277 |
| SEQ. ID. NO. 10588 | 294-CysPheArgArgArgArgIleArgIle-302 |
| Hydrophilic Regions - Hopp-Woods | |
| SEQ. ID. NO. 10589 | 1-MetArgProLysProArgPheArgArgSerVal-11 |
| SEQ. ID. NO. 10590 | 77-AlaLeuSerArgArgGlnThrVal-84 |
| SEQ. ID. NO. 10591 | 92-AlaHisGlnAspGlyArgGlnIleLeuLysArgSerSerGluProProGlnIleArgValAspPhe-113 |
| SEQ. ID. NO. 10592 | 142-GlnLeuThrGluThrArgAsn-148 |
| SEQ. ID. NO. 10593 | 150-IleLeuAsnArgArgValCys-156 |
| SEQ. ID. NO. 10594 | 183-PheThrSerArgGlnProProSerAsnSerArgProProArgGlnAsnSer-199 |
| SEQ. ID. NO. 10595 | 213-LeuSerAlaLysAlaSerAla-219 |
| SEQ. ID. NO. 10596 | 271-SerSerAsnAspGlyAlaAla-277 |
| SEQ. ID. NO. 10597 | 294-CysPheArgArgArgArgIleArgIle-302 |
| 724 | |
| AMPHI Regions - AMPHI | |
| SEQ. ID. NO. 10598 | 6-LeuAlaLysLysThr-10 |
| SEQ. ID. NO. 10599 | 12-GlnThrAlaLysAsnIleGlyGluThrLeuArg-22 |
| SEQ. ID. NO. 10600 | 40-ArgValGlnLeuSer-44 |
| SEQ. ID. NO. 10601 | 47-AlaAspGluThrLeuGlnAspLeuGluHisLeuGlnGlu-59 |
| Antigenic Index - Jameson-Wolf | |
| SEQ. ID. NO. 10602 | 5-LysLeuAlaLysLysThrAlaGlnThrAlaLysAsnIleGlyGluThrLeuArgAlaAlaPheArgGlyLysIle-29 |
| SEQ. ID. NO. 10603 | 34-SerSerGluProIleGlnArgValGlnLeuSerGlyLeuAlaAspGluThrLeuGlnAspLeuGluHis-56 |
| SEQ. ID. NO. 10604 | 60-TyrGlyPheAlaSerHisProProAspGlySerGluAla-72 |
| SEQ. ID. NO. 10605 | 77-LeuGlyGlyAsnThrSer-82 |
| SEQ. ID. NO. 10606 | 90-GlnHisGlySerTyrArgIleLysAsnLeuLysProGlyGluThr-104 |
| SEQ. ID. NO. 10607 | 108-AsnHisGluGlyAlaLysIleValIleLysGlnGlyLysIleIleGluAlaAspCysAspVal-128 |
| SEQ. ID. NO. 10608 | 130-ArgValAsnCysLysGlnTyrGlu-137 |
| SEQ. ID. NO. 10609 | 142-ThrAspAlaLysPhe-146 |
| SEQ. ID. NO. 10610 | 162-GlnIleAsnGlyAsnGly-167 |

TABLE 1-continued

| | |
|---|---|
| SEQ. ID. NO. 10611 | 170-AlaValGluGlyGlyAspGlyAlaThrPheSerGlyAspValAsnGlnThrGlyGlySerPheAsnThrAspGlyAspValValAla-198 |
| SEQ. ID. NO. 10612 | 205-GlnHisProHisThrAspSerIleGlyGlyLysThrLeuProAlaGluProAla-222 |

Hydrophilic Regions - Hopp-Woods

| | |
|---|---|
| SEQ. ID. NO. 10613 | 5-LysLeuAlaLysLysThrAlaGlnThrAlaLysAsnIleGlyGluThrLeuArgAlaAlaPheArgGly-27 |
| SEQ. ID. NO. 10614 | 46-LeuAlaAspGluThrLeuGlnAspLeuGluHis-56 |
| SEQ. ID. NO. 10615 | 66-ProProAspGlySerGlu-71 |
| SEQ. ID. NO. 10616 | 94-TyrArgIleLysAsnLeuLysProGlyGlu-103 |
| SEQ. ID. NO. 10617 | 110-GluGlyAlaLysIleValIleLysGlnGlyLysIleIleGluAlaAspCysAspVal-128 |
| SEQ. ID. NO. 10618 | 132-AsnCysLysGlnTyrGlu-137 |
| SEQ. ID. NO. 10619 | 142-ThrAspAlaLysPhe-146 |
| SEQ. ID. NO. 10620 | 190-PheAsnThrAspGlyAspVal-196 |
| SEQ. ID. NO. 10621 | 205-GlnHisProHisThrAspSerIleGly-213 |

725
AMPHI Regions - AMPHI

| | |
|---|---|
| SEQ. ID. NO. 10622 | 11-GluAlaAspAspLeuAlaGlyGlnIleHisThrLeuProAlaValTrp-26 |
| SEQ. ID. NO. 10623 | 41-GlyValCysGlyArgTyrGlnAsp-48 |
| SEQ. ID. NO. 10624 | 81-AspLeuIleArgAlaValArgArgLeuLeuAsp-91 |
| SEQ. ID. NO. 10625 | 104-ValProLysAlaValArgAlaIle-111 |
| SEQ. ID. NO. 10626 | 144-ProGluArgThrAspAsnProAsp-151 |
| SEQ. ID. NO. 10627 | 155-HisIlePheThrLysTyrGlnGlyThrLeuSerGluProTrpProAspPheGlu-172 |
| SEQ. ID. NO. 10628 | 180-AspProGlnSerAla-184 |

Antigenic Index - Jameson-Wolf

| | |
|---|---|
| SEQ. ID. NO. 10629 | 3-ArgThrValLysSerTyrAsnGlyGluAlaAspAspLeuAla-16 |
| SEQ. ID. NO. 10630 | 29-TyrGlyGlySerLysValGluProAlaSerThrGlyGlyValCysGlyArgTyrGlnAspThrAla-50 |
| SEQ. ID. NO. 10631 | 59-ArgAsnLeuArgAsnGluGlnAlaGlnArgGlnGlyGlyIleAspSerArgGluIleGlySerAsnAspLeuIleArgAlaValArgArgLeuLeuAsp GlyGlnArgLeuGlyPheAlaAspSerArgGlyLeuValProLysAlaValArg-109 |
| SEQ. ID. NO. 10632 | 134-AsnThrCysGlyLeuGluAsnAspArgTyrProGluArgThrAspAsnProAspProAsn-154 |
| SEQ. ID. NO. 10633 | 160-TyrGlnGlyThrLeuSerGluProTrpProAspPheGluGlyLeuAspGlyLysIleTyrAspProGlnSerAlaAspGluIlePro-188 |
| SEQ. ID. NO. 10634 | 192-ThrLeuLysAspLysGln-197 |

Hydrophilic Regions - Hopp-Woods

| | |
|---|---|
| SEQ. ID. NO. 10635 | 8-TyrAsnGlyGluAlaAspAspLeuAla-16 |
| SEQ. ID. NO. 10636 | 32-SerLysValGluProAlaSer-38 |
| SEQ. ID. NO. 10637 | 45-ArgTyrGlnAspThrAla-50 |
| SEQ. ID. NO. 10638 | 59-ArgAsnLeuArgAsnGluGlnAlaGlnArgGlnGlyGlyIleAspSerArgGluIleGlySer-79 |
| SEQ. ID. NO. 10639 | 81-AspLeuIleArgAlaValArgArgLeuLeuAspGlyGlnArg-94 |
| SEQ. ID. NO. 10640 | 96-GlyPheAlaAspSerArgGlyLeuVal-104 |
| SEQ. ID. NO. 10641 | 137-GlyLeuGluAsnAspArgTyrProGluArgThrAspAsnProAspProAsn-154 |
| SEQ. ID. NO. 10642 | 172-GluGlyLeuAspGlyLysIleTyrAsp-180 |
| SEQ. ID. NO. 10643 | 182-GlnSerAlaAspGluIlePro-188 |
| SEQ. ID. NO. 10644 | 192-ThrLeuLysAspLysGln-197 |

726
AMPHI Regions - AMPHI

| | |
|---|---|
| SEQ. ID. NO. 10645 | 12-AspThrLeuGlyGlyIleProGlu-19 |
| SEQ. ID. NO. 10646 | 55-ProArgProSerAspTyrHisGlu-62 |
| SEQ. ID. NO. 10647 | 74-AlaAlaAlaAlaArg-78 |
| SEQ. ID. NO. 10648 | 110-IleAspSerPheTyrArg-115 |
| SEQ. ID. NO. 10649 | 122-AlaArgGlnAlaAsp-126 |
| SEQ. ID. NO. 10650 | 137-IleAlaAlaAlaArg-141 |
| SEQ. ID. NO. 10651 | 180-IleGluThrAlaProGlyLeuAspAlaLeuGluLysGluIleGlu-194 |

Antigenic Index - Jameson-Wolf

| | |
|---|---|
| SEQ. ID. NO. 10652 | 5-PheLysAsnGlyPheTyrAspAspThrLeuGlyGlyIleProGluGly-20 |
| SEQ. ID. NO. 10653 | 24-ValArgAlaGluGluTyr-29 |
| SEQ. ID. NO. 10654 | 37-AlaGlnGlyGlyGlnIleAlaAlaAspSerAspGlyArgProValLeuThrProProArgProSerAspTyrHisGluTrpAspGlyLysLysTrpLys IleSerLys-72 |
| SEQ. ID. NO. 10655 | 78-ArgPheAlaLysGlnLysThr-84 |
| SEQ. ID. NO. 10656 | 90-LeuAlaGluLysAlaAspGluLeuLysAsnSer-100 |
| SEQ. ID. NO. 10657 | 106-ProGlnValGluIleAspSerPheTyrArgGlnGluLysGluAlaLeuAlaArgGlnAlaAspAsnAsnAlaProThr-131 |
| SEQ. ID. NO. 10658 | 151-LysValIleGluLysSerAlaArg-158 |
| SEQ. ID. NO. 10659 | 167-IleGlyLysArgGlnGlnLeuGluAspLysLeuAsnThr-179 |
| SEQ. ID. NO. 10660 | 181-GluThrAlaProGlyLeuAspAlaLeuGluLysGluIleGluGlu-195 |

Hydrophilic Regions - Hopp-Woods

| | |
|---|---|
| SEQ. ID. NO. 10661 | 24-ValArgAlaGluGluTyr-29 |
| SEQ. ID. NO. 10662 | 42-IleAlaAlaAspSerAspGlyArgPro-50 |
| SEQ. ID. NO. 10663 | 55-ProArgProSerAspTyrHisGluTrpAspGlyLysLysTrpLysIleSerLys-72 |
| SEQ. ID. NO. 10664 | 78-ArgPheAlaLysGlnLysThr-84 |
| SEQ. ID. NO. 10665 | 90-LeuAlaGluLysAlaAspGluLeuLysAsn-99 |
| SEQ. ID. NO. 10666 | 114-TyrArgGlnGluLysGluAlaLeuAlaArgGlnAlaAspAsnAsnAla-129 |
| SEQ. ID. NO. 10667 | 151-LysValIleGluLysSerAlaArg-158 |
| SEQ. ID. NO. 10668 | 167-IleGlyLysArgGlnGlnLeuGluAspLysLeuAsnThr-179 |
| SEQ. ID. NO. 10669 | 187-AspAlaLeuGluLysGluIleGluGlu-195 |

727
AMPHI Regions - AMPHI

| | |
|---|---|
| SEQ. ID. NO. 10670 | 6-LeuLeuAlaAsnAsn-10 |
| SEQ. ID. NO. 10671 | 12-GlnProIleAlaIleIleAla-18 |

Antigenic Index - Jameson-Wolf

| | |
|---|---|
| SEQ. ID. NO. 10672 | 28-HisHisGlnGlyTyrLysSerAlaPheAlaLysGln-39 |
| SEQ. ID. NO. 10673 | 41-AlaValIleAspLysMetGluArgAspLysAlaGln-52 |
| SEQ. ID. NO. 10674 | 60-AsnTyrAlaArgGluLeuGluLeuAlaArgAlaGluAlaLysTyrGluValLysAla-79 |
| SEQ. ID. NO. 10675 | 86-LeuAlaLysLysGlnAlaGluValSerArgLeuLysThrGluArgAspLeuCysLys-104 |

TABLE 1-continued

SEQ. ID. NO. 10676 106-ProPheProProAspSerArgAsnProAsnThrGlyPhe-118
SEQ. ID. NO. 10677 122-SerProGlnIleProProAsnPhe-129
Hydrophilic Regions - Hopp-Woods
SEQ. ID. NO. 10678 41-AlaValIleAspLysMetGluArgAspLysAlaGln-52
SEQ. ID. NO. 10679 60-AsnTyrAlaArgGluLeuGluLeuAlaArgAlaGluAlaLysLysTyrGluValLysAla-79
SEQ. ID. NO. 10680 86-LeuAlaLysLysGlnAlaGluValSerArgLeuLysThrGluArgAspLeuCys-103
SEQ. ID. NO. 10681 109-ProAspSerArgAsnProAsnThr-116
728
AMPHI Regions - AMPHI
SEQ. ID. NO. 10682 11-SerPhePheAlaLeuValPheAla-18
SEQ. ID. NO. 10683 39-AlaThrGluValProLysAsnPro-46
SEQ. ID. NO. 10684 48-AlaPheValAlaLysLeuAlaArgLeuPheArgAsnAla-60
SEQ. ID. NO. 10685 76-AsnLeuAlaGlyThrValAspAsp-83
SEQ. ID. NO. 10686 198-GluAspValTyrGluHisCysLeuGlyCysTyrGlnMet-210
SEQ. ID. NO. 10687 218-TyrArgAspValAlaAsnAspGlu-225
SEQ. ID. NO. 10688 235-SerAsnArgIleAlaSer-240
SEQ. ID. NO. 10689 249-GlnAsnMetArgGluLeuMetProArg-257
SEQ. ID. NO. 10690 355-GluLysGluValArgArgTyrAlaGluAlaAlaAlaArg-367
Antigenic Index - Jameson-Wolf
SEQ. ID. NO. 10691 29-IleAsnProArgTrp-33
SEQ. ID. NO. 10692 35-LeuSerAspThrAlaThrGluValProLysAsnProAsn-47
SEQ. ID. NO. 10693 57-PheArgAsnAlaAspArgAla-63
SEQ. ID. NO. 10694 69-GluSerIleArgThrGluGluAsnLeuAlaGlyThrValAspAspGlyProLeuGlnSerGluLysAspTyr-92
SEQ. ID. NO. 10695 98-ArgLeuSerArgLeuLysGluLysAlaLys-107
SEQ. ID. NO. 10696 112-ThrGluGlnGluHisGlyLys-118
SEQ. ID. NO. 10697 125-HisIleGlyGluGlyGlyGly-130
SEQ. ID. NO. 10698 136-LeuSerGlnArgSerProGluAlaPheVal-145
SEQ. ID. NO. 10699 149-TyrLeuTyrArgAsnAspArgProPheSer-158
SEQ. ID. NO. 10700 166-ValHisGlyGluAsnTyrGluThrThrGlyGluTyrArgVal-179
SEQ. ID. NO. 10701 182-GlnProAspGlySerVal-187
SEQ. ID. NO. 10702 190-AlaAlaGlyArgGlyLysIleGlyGluAspValTyr-201
SEQ. ID. NO. 10703 217-LysTyrArgAspValAlaAsnAspGluGlnLysValTrpAspPheArgLysGluSerAsnArgIleAlaSerAspSerArgAsnSerValPheTyrGln
AsnMetArgGluLeuMetProArgGlyMetLysAlaAsnSer-263
SEQ. ID. NO. 10704 267-GlyTyrAspAlaAspGlyLeuProGlnLys-276
SEQ. ID. NO. 10705 280-SerPheAspAsnGlyLysLysArgGlnSerPheGluTyrTyrLeuLysAsnGlyAsn-298
SEQ. ID. NO. 10706 309-LeuLysAlaAspGlyValThr-315
SEQ. ID. NO. 10707 329-LeuAspGlyGlyArgIleValArgGluGluLysGlnGlyAspArgLeuProAspPhe-347
SEQ. ID. NO. 10708 352-GluAsnLeuGluLysGluValArgArgTyrAlaGluAlaAlaAlaArgArgSerGlyGlyArgArgAspLeuSerHis-377
Hydrophilic Regions - Hopp-Woods
SEQ. ID. NO. 10709 38-ThrAlaThrGluValProLysAsnPro-46
SEQ. ID. NO. 10710 57-PheArgAsnAlaAspArgAla-63
SEQ. ID. NO. 10711 69-GluSerIleArgThrGluGluAsnLeu-77
SEQ. ID. NO. 10712 80-ThrValAspAspGlyProLeuGlnSerGluLysAspTyr-92
SEQ. ID. NO. 10713 98-ArgLeuSerArgLeuLysGluLysAlaLys-107
SEQ. ID. NO. 10714 112-ThrGluGlnGluHisGlyLys-118
SEQ. ID. NO. 10715 136-LeuSerGlnArgSerProGlu-142
SEQ. ID. NO. 10716 151-TyrArgAsnAspArgProPhe-157
SEQ. ID. NO. 10717 169-GluAsnTyrGluThrThrGlyGluTyr-177
SEQ. ID. NO. 10718 190-AlaAlaGlyArgGlyLysIleGlyGluAspValTyr-201
SEQ. ID. NO. 10719 217-LysTyrArgAspValAlaAsnAspGluGlnLysValTrpAspPheArgLysGluSerAsnArgIleAlaSerAspSerArgAsn-244
SEQ. ID. NO. 10720 250-AsnMetArgGluLeuMetProArgGlyMetLys-260
SEQ. ID. NO. 10721 268-TyrAspAlaAspGlyLeuPro-274
SEQ. ID. NO. 10722 282-AspAsnGlyLysLysArgGlnSer-289
SEQ. ID. NO. 10723 309-LeuLysAlaAspGlyValThr-315
SEQ. ID. NO. 10724 331-GlyGlyArgIleValArgGluGluLysGlnGlyAspArgLeuPro-345
SEQ. ID. NO. 10725 352-GluAsnLeuGluLysGluValArgArgTyrAlaGluAlaAlaAlaArgArgSerGlyGlyArgArgAspLeuSerHis-377
729
AMPHI Regions - AMPHI
SEQ. ID. NO. 10726 21-CysThrMetIleProGlnTyr-27
SEQ. ID. NO. 10727 33-GluValAlaGluThrPheLysAsnAspThr-42
SEQ. ID. NO. 10728 55-HisAspTyrPheAla-59
SEQ. ID. NO. 10729 61-ProArgLeuGlnLysLeuIleAspIle-69
SEQ. ID. NO. 10730 149-GlnGlyTyrPheAla-153
SEQ. ID. NO. 10731 164-SerLeuIleAlaThrValAlaLys-171
SEQ. ID. NO. 10732 242-LeuAlaThrLeuIleAsn-247
SEQ. ID. NO. 10733 268-LysLeuProAlaGlyLeu-273
SEQ. ID. NO. 10734 322-LeuGlyGlyLeuPheLysSerGly-329
SEQ. ID. NO. 10735 371-ValGlnSerAlaPheGlnAspValAlaAsnAla-381
SEQ. ID. NO. 10736 388-LeuAspLysAlaTyrAspAlaLeuSerLysGlnSerArg-400
SEQ. ID. NO. 10737 419-GlyAlaLeuAspLeuLeuAspAla-426
SEQ. ID. NO. 10738 442-LeuThrArgAlaGluAsnLeuAlaAspLeuTyrLysAlaLeuGlyGlyGlyLeuLys-460
Antigenic Index - Jameson-Wolf
SEQ. ID. NO. 10739 25-ProGlnTyrGluGlnProLysValGluVal-34
SEQ. ID. NO. 10740 36-GluThrPheLysAsnAspThrAlaAspSerGlyIleArgAlaValAsp-51
SEQ. ID. NO. 10741 53-GlyTrpHisAspTyrPheAlaAspProArgLeuGlnLys-65
SEQ. ID. NO. 10742 70-AlaLeuGluArgAsnThrSerLeuArgThr-79
SEQ. ID. NO. 10743 85-GluIleTyrArgLysGlnTyrMetIleGluArgAsnAsnLeuLeuPro-100
SEQ. ID. NO. 10744 105-AsnAlaAsnAspSerArgGlnGlySerLeuSerGlyGlyAsnValSerSerSerTyrLysVal-125
SEQ. ID. NO. 10745 138-GlyArgValArgSerSerSerGluAlaAla-147
SEQ. ID. NO. 10746 155-ThrAlaAsnArgAspAlaAla-161

TABLE 1-continued

| | |
|---|---|
| SEQ. ID. NO. 10747 | 173-TyrPheAsnGluArgTyrAlaGluGluAlaMet-183 |
| SEQ. ID. NO. 10748 | 188-ArgValLeuLysThrArgGluGluThrTyrLysLeuSerGluLeuArgTyr-204 |
| SEQ. ID. NO. 10749 | 215-ArgGlnGlnGluAlaLeuIleGluSerAlaLysAlaAspTyr-228 |
| SEQ. ID. NO. 10750 | 232-AlaArgSerArgGluGlnAlaArgAsn-240 |
| SEQ. ID. NO. 10751 | 248-GlnProIleProGluAspLeuProAla-256 |
| SEQ. ID. NO. 10752 | 277-ValLeuLeuAspArgProAspIleArgAlaAlaGluHisAlaLeuLysGlnAlaAsnAla-296 |
| SEQ. ID. NO. 10753 | 315-ValGlyThrGlySerAlaGluLeu-322 |
| SEQ. ID. NO. 10754 | 325-LeuPheLysSerGlyThr-330 |
| SEQ. ID. NO. 10755 | 347-GlyThrAsnLysAlaAsnLeuAspValAlaLysLeuArgGlnGln-361 |
| SEQ. ID. NO. 10756 | 383-AlaAlaArgGluGlnLeuAspLysAlaTyrAspAlaLeuSerLysGlnSerArgAlaSerLysGluAlaLeuArg-407 |
| SEQ. ID. NO. 10757 | 411-LeuArgTyrLysHisGlyValSer-418 |
| SEQ. ID. NO. 10758 | 424-LeuAspAlaGluArgSerSerTyrAla-432 |
| SEQ. ID. NO. 10759 | 442-LeuThrArgAlaGluAsnLeu-448 |
| SEQ. ID. NO. 10760 | 455-LeuGlyGlyGlyLeuLysArgAspThrGlnThrAspLys-467 |
| Hydrophilic Regions - Hopp-Woods | |
| SEQ. ID. NO. 10761 | 28-GluGlnProLysValGluVal-34 |
| SEQ. ID. NO. 10762 | 36-GluThrPheLysAsnAspThrAlaAspSerGlyIleArgAlaVal-50 |
| SEQ. ID. NO. 10763 | 61-ProArgLeuGlnLys-65 |
| SEQ. ID. NO. 10764 | 70-AlaLeuGluArgAsnThrSerLeu-77 |
| SEQ. ID. NO. 10765 | 91-TyrMetIleGluArgAsnAsn-97 |
| SEQ. ID. NO. 10766 | 105-AsnAlaAsnAspSerArgGlnGlySer-113 |
| SEQ. ID. NO. 10767 | 138-GlyArgValArgSerSerSerGluAlaAla-147 |
| SEQ. ID. NO. 10768 | 156-AlaAsnArgAspAlaAla-161 |
| SEQ. ID. NO. 10769 | 177-ArgTyrAlaGluGluAlaMet-183 |
| SEQ. ID. NO. 10770 | 188-ArgValLeuLysThrArgGluGluThrTyrLysLeuSerGluLeuArgTyr-204 |
| SEQ. ID. NO. 10771 | 215-ArgGlnGlnGluAlaLeuIleGluSerAlaLysAlaAspTyr-228 |
| SEQ. ID. NO. 10772 | 232-AlaArgSerArgGluGlnAlaArgAsn-240 |
| SEQ. ID. NO. 10773 | 250-IleProGluAspLeuPro-255 |
| SEQ. ID. NO. 10774 | 277-ValLeuLeuAspArgProAspIleArgAlaAlaGluHisAlaLeuLysGlnAlaAsn-295 |
| SEQ. ID. NO. 10775 | 350-LysAlaAsnLeuAspValAlaLysLeuArgGln-360 |
| SEQ. ID. NO. 10776 | 383-AlaAlaArgGluGlnLeuAspLysAlaTyrAspAlaLeuSerLysGlnSerArgAlaSerLysGluAlaLeuArg-407 |
| SEQ. ID. NO. 10777 | 424-LeuAspAlaGluArgSerSerTyrAla-432 |
| SEQ. ID. NO. 10778 | 442-LeuThrArgAlaGluAsnLeu-448 |
| SEQ. ID. NO. 10779 | 458-GlyLeuLysArgAspThrGlnThrAspLys-467 |
| 730 | |
| AMPHI Regions - AMPHI | |
| SEQ. ID. NO. 10780 | 6-ArgLeuThrAsnLeuLeuAlaAlaCys-14 |
| SEQ. ID. NO. 10781 | 26-LeuAlaAlaAspLeu-30 |
| SEQ. ID. NO. 10782 | 67-LysIleAsnValIleGlnAspTyrThrHisGln-77 |
| SEQ. ID. NO. 10783 | 111-AsnHisAlaAlaAsp-115 |
| SEQ. ID. NO. 10784 | 141-HisProAlaAspAlaTyrAspGlyProLysGlyGlyAsnTyrProLysProThr-158 |
| SEQ. ID. NO. 10785 | 187-GlnArgIleSerAspAsnTyrSerAsnLeuGlySerAsnPheSerAspArgAlaAspGlu-206 |
| SEQ. ID. NO. 10786 | 214-HisAsnAlaLysLeu-218 |
| SEQ. ID. NO. 10787 | 220-ArgTrpGlyAsnSerMetGluPheIleAsnGlyValAla-232 |
| SEQ. ID. NO. 10788 | 234-GlyAlaLeuAsnProPheIleSer-241 |
| SEQ. ID. NO. 10789 | 262-AlaAlaMetArgAsnIleAla-268 |
| SEQ. ID. NO. 10790 | 277-AlaValIleGlyGlyLeuGlySerValAlaGlyPheGluLysAsnThrArgGluAlaValAspArgTrpIleGlnGlu-302 |
| SEQ. ID. NO. 10791 | 305-AsnAlaAlaGluThrValGluAlaValPheAsnValAlaAlaAlaAlaLysValAlaLysLeuAlaLysAlaAlaLysPro-331 |
| SEQ. ID. NO. 10792 | 338-GlyAspPheAlaAspSerTyr-344 |
| SEQ. ID. NO. 10793 | 387-AsnGlyArgGluIleAspAlaVal-394 |
| SEQ. ID. NO. 10794 | 405-ThrIleSerAlaIleAspLysProLys-413 |
| Antigenic Index - Jameson-Wolf | |
| SEQ. ID. NO. 10795 | 2-LysProLeuArgArgLeuThr-8 |
| SEQ. ID. NO. 10796 | 35-PheIleThrAspAsnAlaGlnArgGlnHisTyrGluProGlyGlyLys-50 |
| SEQ. ID. NO. 10797 | 55-GlyAspProArgGlySerValSerAspArgThrGlyLysIleAsnVal-70 |
| SEQ. ID. NO. 10798 | 97-ArgPheSerGlyHisGlyHisGluGluHisAlaProPheAsp-110 |
| SEQ. ID. NO. 10799 | 112-HisAlaAlaAspSerAlaSerGluGluLysGlyAsnValAspGluGlyPhe-128 |
| SEQ. ID. NO. 10800 | 134-AsnTrpGluGlyHisGluHisHisProAlaAspAlaTyrAspGlyProLysGlyGlyAsnTyrProLysProThrGlyAlaArgAspGluTyrThr-165 |
| SEQ. ID. NO. 10801 | 167-HisValAsnGlyThrAlaArgSerIleLysLeuAsnProThrAspThrArgSerIleArgGlnArgIleSerAspAsnTyrSerAsn-195 |
| SEQ. ID. NO. 10802 | 197-GlySerAsnPheSerAspArgAlaAspGluAlaAsnArgLysMetPheGluHisAsnAlaLysLeuAspArgTrpGlyAsnSer-224 |
| SEQ. ID. NO. 10803 | 257-TyrAlaIleAspLysAlaAlaMet-264 |
| SEQ. ID. NO. 10804 | 271-ProAlaGluGlyLys-275 |
| SEQ. ID. NO. 10805 | 287-GlyPheGluLysAsnThrArgGluAlaValAsp-297 |
| SEQ. ID. NO. 10806 | 299-TrpIleGlnGluAsnProAsnAlaAlaGluThrVal-310 |
| SEQ. ID. NO. 10807 | 321-LysValAlaLysLeuAlaLysAlaAlaLysProGlyLysAlaAlaValSerGlyAspPheAlaAspSerTyrLysLysLeuAlaLeuSerAspSerAlaArgGln-356 |
| SEQ. ID. NO. 10808 | 359-GlnAsnAlaLysTyrArgGluAlaLeu-367 |
| SEQ. ID. NO. 10809 | 373-AspLeuIleArgArgLysThrAspGlySerSerLysPheIleAsnGlyArgGluIleAspAlaValThrAsnAsp-397 |
| SEQ. ID. NO. 10810 | 400-IleGlnAlaLysArgThrIleSerAlaIleAspLysProLysAsnPheLeuAsnGlnLysAsnArgLysGlnIleLysAlaThrIle-428 |
| SEQ. ID. NO. 10811 | 430-AlaAlaAsnGlnGlnGlyLysArgAlaGluPhe-440 |
| SEQ. ID. NO. 10812 | 452-SerTyrIleGluSerLysGlyGlyIleValLysThrGlyLeuGlyAsp-467 |
| Hydrophilic Regions - Hopp-Woods | |
| SEQ. ID. NO. 10813 | 2-LysProLeuArgArgLeuThr-8 |
| SEQ. ID. NO. 10814 | 39-AsnAlaGlnArgGlnHisTyrGluProGlyGly-49 |
| SEQ. ID. NO. 10815 | 55-GlyAspProArgGlySerValSerAspArgThrGlyLys-67 |
| SEQ. ID. NO. 10816 | 102-GlyHisGluGluHisAlaPro-108 |
| SEQ. ID. NO. 10817 | 112-HisAlaAlaAspSerAlaSerGluGluLysGlyAsnValAspGluGly-127 |
| SEQ. ID. NO. 10818 | 135-TrpGluGlyHisGluHisHisPro-142 |
| SEQ. ID. NO. 10819 | 144-AspAlaTyrAspGlyProLysGlyGlyAsnTyrProLys-156 |
| SEQ. ID. NO. 10820 | 158-ThrGlyAlaArgAspGluTyr-164 |

TABLE 1-continued

| | |
|---|---|
| SEQ. ID. NO. 10821 | 170-GlyThrAlaArgSerIleLys-176 |
| SEQ. ID. NO. 10822 | 178-AsnProThrAspThrArgSerIleArgGlnArgIleSerAsp-191 |
| SEQ. ID. NO. 10823 | 200-PheSerAspArgAlaAspGluAlaAsnArgLysMetPheGluHisAsnAlaLysLeuAspArgTrpGlyAsn-223 |
| SEQ. ID. NO. 10824 | 257-TyrAlaIleAspLysAlaAlaMet-264 |
| SEQ. ID. NO. 10825 | 271-ProAlaGluGlyLys-275 |
| SEQ. ID. NO. 10826 | 287-GlyPheGluLysAsnThrArgGluAlaValAsp-297 |
| SEQ. ID. NO. 10827 | 303-AsnProAsnAlaAlaGluThrVal-310 |
| SEQ. ID. NO. 10828 | 321-LysValAlaLysLeuAlaLysAlaAlaLysProGlyLysAlaAlaVal-336 |
| SEQ. ID. NO. 10829 | 339-AspPheAlaAspSerTyrLysLysLysLeuAlaLeu-350 |
| SEQ. ID. NO. 10830 | 361-AlaLysTyrArgGluAlaLeu-367 |
| SEQ. ID. NO. 10831 | 373-AspLeuIleArgArgLysThrAspGlySerSer-383 |
| SEQ. ID. NO. 10832 | 386-IleAsnGlyArgGluIleAspAlaValThr-395 |
| SEQ. ID. NO. 10833 | 400-IleGlnAlaLysArgThrIleSerAlaIleAspLysProLysAsn-414 |
| SEQ. ID. NO. 10834 | 418-GlnLysAsnArgLysGlnIleLysAlaThrIle-428 |
| SEQ. ID. NO. 10835 | 430-AlaAlaAsnGlnGlnGlyLysArgAlaGluPhe-440 |
| SEQ. ID. NO. 10836 | 452-SerTyrIleGluSerLysGlyGlyIle-460 |

731
AMPHI Regions - AMPHI

| | |
|---|---|
| SEQ. ID. NO. 10837 | 17-AlaCysAlaValPro-21 |

Antigenic Index - Jameson-Wolf

| | |
|---|---|
| SEQ. ID. NO. 10838 | 22-GluAlaTyrAspAspGlyGlyArgGlyHis-31 |
| SEQ. ID. NO. 10839 | 34-ProValGlnAsnGlnAlaGlyThrAspAspPheArg-45 |
| SEQ. ID. NO. 10840 | 48-SerCysGluAsnGlyLeu-53 |
| SEQ. ID. NO. 10841 | 55-ValArgValArgHisLeuAspSerGlyLysValAlaLeuArgLeuAspGlyArgArgAlaValLeuSerSerAspValAlaAlaSerGlyGluArgTyrThrAla-89 |
| SEQ. ID. NO. 10842 | 98-ThrGluTrpHisGlnLysGlyGlyGluAla-107 |
| SEQ. ID. NO. 10843 | 113-AspAlaTyrGlyAsnSerValGluThrSerCysArgAlaArg-126 |

Hydrophilic Regions - Hopp-Woods

| | |
|---|---|
| SEQ. ID. NO. 10844 | 22-GluAlaTyrAspAspGlyGlyArgGlyHis-31 |
| SEQ. ID. NO. 10845 | 39-AlaGlyThrAspAspPheArg-45 |
| SEQ. ID. NO. 10846 | 55-ValArgValArgHisLeuAspSerGlyLysValAlaLeuArgLeuAspGlyArgArgAlaValLeu-76 |
| SEQ. ID. NO. 10847 | 80-ValAlaAlaSerGlyGluArgTyrThrAla-89 |
| SEQ. ID. NO. 10848 | 100-TrpHisGlnLysGlyGlyGlu-106 |
| SEQ. ID. NO. 10849 | 119-ValGluThrSerCysArgAlaArg-126 |

732
AMPHI Regions - AMPHI

| | |
|---|---|
| SEQ. ID. NO. 10850 | 14-LeuGlyAlaIleSer-18 |
| SEQ. ID. NO. 10851 | 43-ValGlnSerIleArgThrMetAlaGluValTyrGly-54 |
| SEQ. ID. NO. 10852 | 66-AspAlaAspLeuPheGluGlyAlaMetLysGlyMetVal-78 |
| SEQ. ID. NO. 10853 | 95-GluIleLysGluSerThrSerGly-102 |
| SEQ. ID. NO. 10854 | 115-AspGlyPheValLysValValSerProIleGluAsp-126 |
| SEQ. ID. NO. 10855 | 155-GluAlaValLysLysMet-160 |
| SEQ. ID. NO. 10856 | 183-ValAsnLeuThrArg-187 |
| SEQ. ID. NO. 10857 | 214-GluArgThrValGluSerValAsnThrAlaAlaLys-225 |
| SEQ. ID. NO. 10858 | 283-LysAlaIleProGluAsp-288 |
| SEQ. ID. NO. 10859 | 297-SerLeuAlaGlyIleProAlaGluLeu-305 |
| SEQ. ID. NO. 10860 | 322-SerGluIleValAlaGly-327 |
| SEQ. ID. NO. 10861 | 400-LeuValGlyHisIleGlyAsn-406 |
| SEQ. ID. NO. 10862 | 446-ArgArgIleProAsnProAlaLysAsp-454 |
| SEQ. ID. NO. 10863 | 459-LysAlaLeuAspLeuValLysSerProGluGlnTrpGlnLysSerLeu-474 |

Antigenic Index - Jameson-Wolf

| | |
|---|---|
| SEQ. ID. NO. 10864 | 30-AlaAlaGluLysAspArgArgAspAsnGluVal-40 |
| SEQ. ID. NO. 10865 | 59-AsnTyrTyrGlnAspLysProAspAlaAspLeuPhe-70 |
| SEQ. ID. NO. 10866 | 82-AspProHisSerGluTyrMetAspLysLysGlyTyrAlaGluIleLysGluSerThrSerGlyGluPheGlyGly-106 |
| SEQ. ID. NO. 10867 | 111-IleGlyGlnGluAspGlyPhe-117 |
| SEQ. ID. NO. 10868 | 122-SerProIleGluAspThrProAlaGluArgAlaGlyValLysSerGlyAspPhe-139 |
| SEQ. ID. NO. 10869 | 144-AspAsnValSerThrArgGlyMetThr-152 |
| SEQ. ID. NO. 10870 | 155-GluAlaValLysLysMetArgGlyLysProGlyThrLysIle-168 |
| SEQ. ID. NO. 10871 | 172-LeuSerArgLysAsnAlaAspLysProIle-181 |
| SEQ. ID. NO. 10872 | 199-LeuIleGluProAspTyrGlyTyr-206 |
| SEQ. ID. NO. 10873 | 211-GlnPheGlnGluArgThrValGlu-218 |
| SEQ. ID. NO. 10874 | 221-AsnThrAlaAlaLysGluLeuValLysGluAsnLysGlyLysProLeuLys-237 |
| SEQ. ID. NO. 10875 | 242-AspLeuArgAspAspProGlyGlyLeu-250 |
| SEQ. ID. NO. 10876 | 269-ValSerThrLysGlyArgAspGlyLysAspArgMetVal-281 |
| SEQ. ID. NO. 10877 | 284-AlaIleProGluAspTyr-289 |
| SEQ. ID. NO. 10878 | 292-GlyMetGlyGlyAspSer-297 |
| SEQ. ID. NO. 10879 | 303-AlaGluLeuLysThr-307 |
| SEQ. ID. NO. 10880 | 316-SerGlySerAlaSerAla-321 |
| SEQ. ID. NO. 10881 | 330-GlnAspHisLysArgAlaVal-336 |
| SEQ. ID. NO. 10882 | 340-ThrGlnSerPheGlyLysGlySerVal-348 |
| SEQ. ID. NO. 10883 | 354-LeuSerAsnGlySer-358 |
| SEQ. ID. NO. 10884 | 368-TyrThrProAsnAspArgSerIleGln-376 |
| SEQ. ID. NO. 10885 | 384-ValGluValLysAspLysGluArgIlePheGluSerArgGluAlaAspLeu-400 |
| SEQ. ID. NO. 10886 | 405-GlyAsnProLeuGlyGlyGluAspValAsnGly-415 |
| SEQ. ID. NO. 10887 | 421-ProLeuGluLysAspAlaAspLysProLysGluLysGlyLysLysLysLysAspGluAspLeuSerSerArgArgIleProAsnProAlaLysAspAspGlnLeuArgLysAlaLeuAspLeuValLysSerProGluGlnTrpGlnLys-472 |
| SEQ. ID. NO. 10888 | 477-AlaAlaLysLysProValSerAsnLysAspLysLysAspLysLysAspLysLys-494 |

Hydrophilic Regions - Hopp-Woods

| | |
|---|---|
| SEQ. ID. NO. 10889 | 30-AlaAlaGluLysAspArgArgAspAsnGluVal-40 |
| SEQ. ID. NO. 10890 | 60-TyrTyrGlnAspLysProAspAlaAspLeuPhe-70 |

TABLE 1-continued

| | |
|---|---|
| SEQ. ID. NO. 10891 | 82-AspProHisSerGluTyrMetAspLysLysGlyTyrAlaGluIleLysGluSerThrSerGlyGlu-103 |
| SEQ. ID. NO. 10892 | 111-IleGlyGlnGluAspGlyPhe-117 |
| SEQ. ID. NO. 10893 | 122-SerProIleGluAspThrProAlaGluArgAlaGlyValLysSerGlyAspPhe-139 |
| SEQ. ID. NO. 10894 | 144-AspAsnValSerThr-148 |
| SEQ. ID. NO. 10895 | 155-GluAlaValLysLysMetArgGlyLysProGlyThr-166 |
| SEQ. ID. NO. 10896 | 172-LeuSerArgLysAsnAlaAspLysProIle-181 |
| SEQ. ID. NO. 10897 | 211-GlnPheGlnGluArgThrValGlu-218 |
| SEQ. ID. NO. 10898 | 221-AsnThrAlaAlaLysGluLeuValLysGluAsnLysGlyLysProLeuLys-237 |
| SEQ. ID. NO. 10899 | 242-AspLeuArgAspAspProGly-248 |
| SEQ. ID. NO. 10900 | 271-ThrLysGlyArgAspGlyLysAspArgMetVal-281 |
| SEQ. ID. NO. 10901 | 303-AlaGluLeuLysThr-307 |
| SEQ. ID. NO. 10902 | 330-GlnAspHisLysArgAlaVal-336 |
| SEQ. ID. NO. 10903 | 370-ProAsnAspArgSerIleGln-376 |
| SEQ. ID. NO. 10904 | 384-ValGluValLysAspLysGluArgIlePheGluSerArgGluAlaAspLeu-400 |
| SEQ. ID. NO. 10905 | 408-LeuGlyGlyGluAspValAsnGly-415 |
| SEQ. ID. NO. 10906 | 421-ProLeuGluLysAspAlaAspLysProAlaValLysGluLysGlyLysLysLysLysAspGluAspLeuSerSerArgArgIleProAsnProAlaLys AspAspGlnLeuArgLysAlaLeuAspLeuValLysSerProGluGlnTrpGln-471 |
| SEQ. ID. NO. 10907 | 477-AlaAlaLysLysProValSerAsnLysAspLysLysAspLysLysAspLysLys-494 |

733
AMPHI Regions - AMPHI
| | |
|---|---|
| SEQ. ID. NO. 10908 | 6-ThrLeuSerArgLeuSer-11 |
| SEQ. ID. NO. 10909 | 33-TyrGlyGlyTyrProAspThrValTyrGluGly-43 |
| SEQ. ID. NO. 10910 | 53-LysGlnThrGluLysMetGluLysTyrPheVal-63 |
| SEQ. ID. NO. 10911 | 92-GlyAlaPheArgGlnPheGluGlu-99 |

Antigenic Index - Jameson-Wolf
| | |
|---|---|
| SEQ. ID. NO. 10912 | 2-MetAsnProLysThrLeuSer-8 |
| SEQ. ID. NO. 10913 | 22-CysGlyGlyAsnGlyGlnLysSer-29 |
| SEQ. ID. NO. 10914 | 33-TyrGlyGlyTyrProAspThrValTyrGluGlyLeuLysAsnAspAspThrSerLeuGlyLysGlnThrGluLysMetGluLysTyrPhe-62 |
| SEQ. ID. NO. 10915 | 65-AlaGlyAsnLysLysMetAsnAlaAlaProGlyAla-76 |
| SEQ. ID. NO. 10916 | 84-LeuSerArgSerGlyAspLysGluGlyAlaPheArgGlnPheGluGluGluLysArgLeuPheProGlu-106 |
| SEQ. ID. NO. 10917 | 115-MetLysThrGlyLysGlyGlyLysArg-123 |

Hydrophilic Regions - Hopp-Woods
| | |
|---|---|
| SEQ. ID. NO. 10918 | 40-ValTyrGluGlyLeuLysAsnAspAspThrSerLeuGlyLysGlnThrGluLysMetGluLysTyrPhe-62 |
| SEQ. ID. NO. 10919 | 65-AlaGlyAsnLysLysMetAsnAla-72 |
| SEQ. ID. NO. 10920 | 86-ArgSerGlyAspLysGluGlyAlaPheArgGlnPheGluGluGluLysArgLeuPhePro-105 |
| SEQ. ID. NO. 10921 | 115-MetLysThrGlyLysGlyGlyLysArg-123 |

734-2
AMPHI Regions - AMPHI
| | |
|---|---|
| SEQ. ID. NO. 10922 | 19-ArgAlaAlaAspThrTyr-24 |
| SEQ. ID. NO. 10923 | 26-TyrLeuAlaValTrpGlnAsnProGlnAsnAlaAsp-37 |
| SEQ. ID. NO. 10924 | 53-GluAlaPheSerGluLeuGluAlaPheCysLys-63 |
| SEQ. ID. NO. 10925 | 77-ThrGlyCysArgSerValValSer-84 |
| SEQ. ID. NO. 10926 | 92-LeuAlaTyrProLysAlaLeuGlyAlaLeuArg-102 |
| SEQ. ID. NO. 10927 | 113-ArgPheThrSerVal-117 |
| SEQ. ID. NO. 10928 | 121-AlaLeuAsnGlnCysIleLys-127 |

Antigenic Index - Jameson-Wolf
| | |
|---|---|
| SEQ. ID. NO. 10929 | 18-AlaArgAlaAlaAsp-22 |
| SEQ. ID. NO. 10930 | 31-GlnAsnProGlnAsnAlaAspAspValLeuGln-41 |
| SEQ. ID. NO. 10931 | 43-LysThrThrLysGluAspSerThrLysSerGluAlaPheSerGlu-57 |
| SEQ. ID. NO. 10932 | 59-GluAlaPheCysLysGlyGlnAspThr-67 |
| SEQ. ID. NO. 10933 | 71-IleAlaGluAspGluProThrGlyCysArgSer-81 |
| SEQ. ID. NO. 10934 | 101-LeuArgValAspAsn-105 |
| SEQ. ID. NO. 10935 | 111-SerProArgPheThrSer-116 |
| SEQ. ID. NO. 10936 | 125-CysIleLysLysTyrGlyVal-131 |
| SEQ. ID. NO. 10937 | 145-SerSerTyrTyrGly-149 |

Hydrophilic Regions - Hopp-Woods
| | |
|---|---|
| SEQ. ID. NO. 10938 | 18-AlaArgAlaAlaAsp-22 |
| SEQ. ID. NO. 10939 | 34-GlnAsnAlaAspAspValLeuGln-41 |
| SEQ. ID. NO. 10940 | 43-LysThrThrLysGluAspSerThrLysSerGluAlaPheSerGlu-57 |
| SEQ. ID. NO. 10941 | 59-GluAlaPheCysLysGlyGlnAspThr-67 |
| SEQ. ID. NO. 10942 | 71-IleAlaGluAspGluProThrGlyCys-79 |
| SEQ. ID. NO. 10943 | 101-LeuArgValAspAsn-105 |

735
AMPHI Regions - AMPHI
| | |
|---|---|
| SEQ. ID. NO. 10944 | 6-LeuLeuAlaAsnAsn-10 |
| SEQ. ID. NO. 10945 | 12-GlnProIleAlaIleIleAla-18 |
| SEQ. ID. NO. 10946 | 118-GlyCysIleAspGlyPheGly-124 |

Antigenic Index - Jameson-Wolf
| | |
|---|---|
| SEQ. ID. NO. 10947 | 28-HisHisGlnGlyTyrLysSerAlaPheAlaLysGln-39 |
| SEQ. ID. NO. 10948 | 41-AlaValIleAspLysMetGluArgAspLysAlaGln-52 |
| SEQ. ID. NO. 10949 | 60-AsnTyrAlaArgGluLeuGluLeuAlaArgAlaGluAlaLysLysTyrGluValLysAla-79 |
| SEQ. ID. NO. 10950 | 86-LeuAlaLysLysGlnAlaGluValSerArgLeuLysThrGluAsnLysLysGluIleGluAsn-106 |
| SEQ. ID. NO. 10951 | 108-LeuThrGlnAspArgLysAsnAlaSerGlyGlyCysIleAspGlyPheGlySerHisGly-127 |
| SEQ. ID. NO. 10952 | 134-AlaLeuGlyTyrGlyAsn-139 |

Hydrophilic Regions - Hopp-Woods
| | |
|---|---|
| SEQ. ID. NO. 10953 | 41-AlaValIleAspLysMetGluArgAspLysAlaGln-52 |
| SEQ. ID. NO. 10954 | 60-AsnTyrAlaArgGluLeuGluLeuAlaArgAlaGluAlaLysLysTyrGluValLysAla-79 |

TABLE 1-continued

| | |
|---|---|
| SEQ. ID. NO. 10955 | 86-LeuAlaLysLysGlnAlaGluValSerArgLeuLysThrGluAsnLysLysGluIleGluAsn-106 |
| SEQ. ID. NO. 10956 | 108-LeuThrGlnAspArgLysAsnAlaSer-116 |

736
AMPHI Regions - AMPHI
| | |
|---|---|
| SEQ. ID. NO. 10957 | 13-GlyLeuIleGlnSerLeuGlySer-20 |
| SEQ. ID. NO. 10958 | 50-GlyValLeuSerVal-54 |
| SEQ. ID. NO. 10959 | 61-GlyLeuPheValGly-65 |
| SEQ. ID. NO. 10960 | 70-LeuGlnGlyTyrThrGlnLeuSerLysPheLysSerAlaAspIle-84 |
| SEQ. ID. NO. 10961 | 93-LeuLeuArgGluLeuGlyProVal-100 |
| SEQ. ID. NO. 10962 | 120-LeuMetLysThrThrGluGlnLeuGluAlaMetAsnValMet-133 |
| SEQ. ID. NO. 10963 | 135-ValAsnProValAlaArgValVal-142 |
| SEQ. ID. NO. 10964 | 144-ProArgPheTrpAlaGlyValPheSerMetPro-154 |
| SEQ. ID. NO. 10965 | 156-LeuAlaSerIlePheAsnValAlaGlyIlePheGlyAla-168 |
| SEQ. ID. NO. 10966 | 196-AspValIleAsnGlyLeu-201 |
| SEQ. ID. NO. 10967 | 230-LeuArgAlaSerThrArgThr-236 |

Antigenic Index - Jameson-Wolf
| | |
|---|---|
| SEQ. ID. NO. 10968 | 37-ValArgProArgLeuSerVal-43 |
| SEQ. ID. NO. 10969 | 77-SerLysPheLysSer-81 |
| SEQ. ID. NO. 10970 | 93-LeuLeuArgGluLeuGly-98 |
| SEQ. ID. NO. 10971 | 109-SerAlaGlyGlyAlaMetThrSer-116 |
| SEQ. ID. NO. 10972 | 122-LysThrThrGluGlnLeuGlu-128 |
| SEQ. ID. NO. 10973 | 186-GlnMetGlnAsnAsn-190 |
| SEQ. ID. NO. 10974 | 224-ProThrSerGluGlyIleLeuArgAlaSerThr-234 |

Hydrophilic Regions - Hopp-Woods
| | |
|---|---|
| SEQ. ID. NO. 10975 | 39-ProArgLeuSerVal-43 |
| SEQ. ID. NO. 10976 | 77-SerLysPheLysSer-81 |
| SEQ. ID. NO. 10977 | 93-LeuLeuArgGluLeuGly-98 |
| SEQ. ID. NO. 10978 | 122-LysThrThrGluGlnLeuGlu-128 |

737
AMPHI Regions - AMPHI
| | |
|---|---|
| SEQ. ID. NO. 10979 | 56-AlaAlaLeuAlaArgValGlyGly-63 |

Antigenic Index - Jameson-Wolf
| | |
|---|---|
| SEQ. ID. NO. 10980 | 24-AlaHisHisAspGlyHisGlyAspAspAspHisGlyHis-36 |
| SEQ. ID. NO. 10981 | 38-AlaHisGlnHisAsnLysGlnAspLysIleIleSer-49 |
| SEQ. ID. NO. 10982 | 51-AlaGlnAlaGluLysAlaAlaLeu-58 |
| SEQ. ID. NO. 10983 | 60-ArgValGlyGlyLysIleThrAspIleAspLeuGluHisAspAsnGlyArgProHisTyrAspValGluIleValLysAsnGlyGlnGluTyr-90 |
| SEQ. ID. NO. 10984 | 94-ValAspAlaArgThrGlyArgValIleSerSerArgArgAspAsp-108 |

Hydrophilic Regions - Hopp-Woods
| | |
|---|---|
| SEQ. ID. NO. 10985 | 27-AspGlyHisGlyAspAspAspHisGlyHis-36 |
| SEQ. ID. NO. 10986 | 40-GlnHisAsnLysGlnAspLysIleIleSer-49 |
| SEQ. ID. NO. 10987 | 51-AlaGlnAlaGluLysAlaAlaLeu-58 |
| SEQ. ID. NO. 10988 | 61-ValGlyGlyLysIleThrAspIleAspLeuGluHisAspAsnGlyArgProHisTyr-79 |
| SEQ. ID. NO. 10989 | 82-GluIleValLysAsnGlyGlnGluTyr-90 |
| SEQ. ID. NO. 10990 | 94-ValAspAlaArgThrGlyArg-100 |
| SEQ. ID. NO. 10991 | 102-IleSerSerArgArgAspAsp-108 |

738
AMPHI Regions - AMPHI
| | |
|---|---|
| SEQ. ID. NO. 10992 | 91-LeuMetAsnLeuIleTyrProGlyMetAsnAsp-101 |
| SEQ. ID. NO. 10993 | 139-IleGlySerLeuLeuGlnSerCysIle-147 |
| SEQ. ID. NO. 10994 | 228-ThrTyrIleAlaAlaIleAlaLeuIle-236 |
| SEQ. ID. NO. 10995 | 271-ThrIleLeuGluThrPheThrGlyIle-279 |
| SEQ. ID. NO. 10996 | 285-ValGluArgValAlaAsnGlyGlyPheThrAspLeuProArgGlnIleGluTrpAsn-303 |
| SEQ. ID. NO. 10997 | 305-AlaLeuAlaAlaPheGlnSer-311 |
| SEQ. ID. NO. 10998 | 316-GlyHisGlyTrpAsnSerPheAla-323 |
| SEQ. ID. NO. 10999 | 338-AspAsnLeuLeuSerAsnLeuPheThr-346 |
| SEQ. ID. NO. 11000 | 371-LeuLeuThrGlyIleAlaGlyLeuLeuLysArg-381 |
| SEQ. ID. NO. 11001 | 398-MetCysHisSerMetLeu-403 |
| SEQ. ID. NO. 11002 | 461-ArgLeuValAsnAlaPheSerPro-468 |
| SEQ. ID. NO. 11003 | 472-AspSerAlaLysThrLeuAsnArgLys-480 |
| SEQ. ID. NO. 11004 | 482-AsnGluLeuArgTyrIleSer-488 |
| SEQ. ID. NO. 11005 | 507-LeuProGluTyrProGluThr-513 |
| SEQ. ID. NO. 11006 | 549-AlaLysGlnTrpMetArgAlaThr-556 |
| SEQ. ID. NO. 11007 | 567-TyrAlaAspGluIleArgLysLeuProVal-576 |
| SEQ. ID. NO. 11008 | 579-ProLeuLeuProGluLeuLeuLysAspCysLysAlaPheAlaAlaAlaPro-595 |

Antigenic Index - Jameson-Wolf
| | |
|---|---|
| SEQ. ID. NO. 11009 | 37-LysLeuLysProSerProAspPheTyr-45 |
| SEQ. ID. NO. 11010 | 62-AlaGlyLysLysLeuPheAsp-68 |
| SEQ. ID. NO. 11011 | 124-PheGlyGlnGluArgIle-129 |
| SEQ. ID. NO. 11012 | 154-GlyTrpGluAspThrProLeu-160 |
| SEQ. ID. NO. 11013 | 177-GlyGlnArgAsnAsnLeuGly-183 |
| SEQ. ID. NO. 11014 | 196-LeuAsnGlyGlnArgLysIlePro-203 |
| SEQ. ID. NO. 11015 | 242-PheArgSerAspLysSerAsnArgThrMet-252 |
| SEQ. ID. NO. 11016 | 283-ThrAlaValGluArgValAlaAsnGlyGlyPheThrAspLeuProArgGlnIleGluTrp-302 |
| SEQ. ID. NO. 11017 | 316-GlyHisGlyTrpAsnSerPheAla-323 |
| SEQ. ID. NO. 11018 | 378-LeuLeuLysArgProLeuThr-384 |
| SEQ. ID. NO. 11019 | 424-ProAlaGluAlaSerAspGlyIleAlaPheLysLysAlaAla-437 |
| SEQ. ID. NO. 11020 | 468-ProAlaThrAspAspSerAlaLysThrLeuAsnArgLysIleAsnGlu-483 |
| SEQ. ID. NO. 11021 | 508-ProGluTyrProGluThrGlnThrTrpAlaGlu-518 |
| SEQ. ID. NO. 11022 | 520-AlaThrLeuLysSerLeuLysTyrArgProHisSerAla-532 |
| SEQ. ID. NO. 11023 | 542-ArgGlnGlyLysValAlaGluAlaLysGlnTrpMet-553 |

TABLE 1-continued

| | |
|---|---|
| SEQ. ID. NO. 11024 | 555-AlaThrGlnSerTyr-559 |
| SEQ. ID. NO. 11025 | 566-ArgTyrAlaAspGluIleArgLys-573 |
| SEQ. ID. NO. 11026 | 584-LeuLeuLysAspCysLysAla-590 |
| SEQ. ID. NO. 11027 | 595-ProGlyHisProGluAlaLysProCysLys-604 |

Hydrophilic Regions - Hopp-Woods

| | |
|---|---|
| SEQ. ID. NO. 11028 | 38-LeuLysProSerPro-42 |
| SEQ. ID. NO. 11029 | 62-AlaGlyLysLysLeuPheAsp-68 |
| SEQ. ID. NO. 11030 | 125-GlyGlnGluArgIle-129 |
| SEQ. ID. NO. 11031 | 198-GlyGlnArgLysIlePro-203 |
| SEQ. ID. NO. 11032 | 243-ArgSerAspLysSerAsnArgArgThrMet-252 |
| SEQ. ID. NO. 11033 | 283-ThrAlaValGluArgValAla-289 |
| SEQ. ID. NO. 11034 | 378-LeuLeuLysArgProLeuThr-384 |
| SEQ. ID. NO. 11035 | 425-AlaGluAlaSerAsp-429 |
| SEQ. ID. NO. 11036 | 431-IleAlaPheLysLysAlaAla-437 |
| SEQ. ID. NO. 11037 | 469-AlaThrAspAspSerAlaLysThrLeuAsnArgLysIleAsnGlu-483 |
| SEQ. ID. NO. 11038 | 525-LeuLysTyrArgPro-529 |
| SEQ. ID. NO. 11039 | 542-ArgGlnGlyLysValAlaGluAlaLysGlnTrpMet-553 |
| SEQ. ID. NO. 11040 | 566-ArgTyrAlaAspGluIleArgLys-573 |
| SEQ. ID. NO. 11041 | 584-LeuLeuLysAspCysLysAla-590 |
| SEQ. ID. NO. 11042 | 596-GlyHisProGluAlaLysProCysLys-604 |

739-2
AMPHI Regions - AMPHI

| | |
|---|---|
| SEQ. ID. NO. 11043 | 6-AsnLysProPheArgLeu-11 |
| SEQ. ID. NO. 11044 | 53-HisThrAspSerPro-57 |
| SEQ. ID. NO. 11045 | 88-GlnProAspGlyThrAsp-93 |
| SEQ. ID. NO. 11046 | 120-ThrAspArgGlnProAspAspAlaGlyThr-129 |
| SEQ. ID. NO. 11047 | 131-AlaGluAsnThrLeu-135 |

Antigenic Index - Jameson-Wolf

| | |
|---|---|
| SEQ. ID. NO. 11048 | 1-MetAlaLysLysProAsnLysProPheArgLeuThrPro-13 |
| SEQ. ID. NO. 11049 | 39-PheAsnProAsnGlyAspLysThrLeuGlnAlaGluProGlnHisThrAspSerProArgGluThrGluPhe-62 |
| SEQ. ID. NO. 11050 | 64-LeuProAsnGlyValValGlyGlnAspAlaAlaGlnProGluHisHisHis-80 |
| SEQ. ID. NO. 11051 | 82-AlaSerSerGluProAlaGlnProAspGlyThrAspGluSerGlySerGlyLeuProSerProAlaAlaProLysLysAsnArgValLysProGlnPro
AlaAspThrAlaGlnThrAspArgGlnProAspAspAlaGlyThrGlnAlaGluAsnThrLeuLysGluThrProValLeuProThrAsnValProArgPro
GluProArgLysGluThrProGluLysGlnAlaGlnProLysGluThrProLysGluAsnHisThrLysProAspThrProLysAsnThrProProLysPro
HisLysGluIleLeu-187 |

Hydrophilic Regions - Hopp-Woods

| | |
|---|---|
| SEQ. ID. NO. 11052 | 1-MetAlaLysProAsnLysProPheArgLeu-11 |
| SEQ. ID. NO. 11053 | 41-ProAsnGlyAspLysThrLeuGlnAlaGluProGlnHisThrAspSerProArgGluThrGlu-61 |
| SEQ. ID. NO. 11054 | 72-AspAlaAlaGlnProGluHisHisHis-80 |
| SEQ. ID. NO. 11055 | 82-AlaSerSerGluProAlaGlnProAspGlyThrAspGluSerGlySer-97 |
| SEQ. ID. NO. 11056 | 103-AlaAlaProLysLysAsnArgValLysProGlnProAlaAspThrAlaGlnThrAspArgGlnProAspAspAlaGlyThrGlnAlaGluAsnThrLeu
LysGluThrPro-139 |
| SEQ. ID. NO. 11057 | 145-ValProArgProGluProArgLysGluThrProGluLysGlnAlaGlnProLysGluThrProLysGluAsnHisThrLysProAspThrProLysAsn
ThrProProLysProHisLysGluIleLeu-187 |

740
AMPHI Regions - AMPHI

| | |
|---|---|
| SEQ. ID. NO. 11058 | 6-LeuValArgTrpLeuAlaVal-12 |
| SEQ. ID. NO. 11059 | 28-ProGluAspLysLeuGlnHisLeuIleAsnGlyIle-39 |

Antigenic Index - Jameson-Wolf

| | |
|---|---|
| SEQ. ID. NO. 11060 | 26-AsnProProGluAspLysLeuGln-33 |
| SEQ. ID. NO. 11061 | 57-IleLysHisHisLeuLysGlnGluPheAspLeuLysArgGlnThr-71 |

Hydrophilic Regions - Hopp-Woods

| | |
|---|---|
| SEQ. ID. NO. 11062 | 27-ProProGluAspLysLeuGln-33 |
| SEQ. ID. NO. 11063 | 57-IleLysHisHisLeuLysGlnGluPheAspLeuLysArgGlnThr-71 |

741
AMPHI Regions - AMPHI

| | |
|---|---|
| SEQ. ID. NO. 11064 | 32-GlyAlaGlyLeuAlaAspAlaLeuThrAla-41 |
| SEQ. ID. NO. 11065 | 93-SerArgPheAspPheIleArgGlnIleGlu-102 |
| SEQ. ID. NO. 11066 | 158-ThrSerPheAspLysLeuProGluGlyGlyArg-168 |
| SEQ. ID. NO. 11067 | 256-SerAlaGluValLysThrValAsnGlyIleArgHisIleGlyLeuAlaAlaLys-273 |

Antigenic Index - Jameson-Wolf

| | |
|---|---|
| SEQ. ID. NO. 11068 | 21-SerSerGlyGlyGly-25 |
| SEQ. ID. NO. 11069 | 43-LeuAspHisLysAspLysGlyLeu-50 |
| SEQ. ID. NO. 11070 | 56-AspGlnSerValArgLysAsnGluLysLeuLysLeu-67 |
| SEQ. ID. NO. 11071 | 71-GlyAlaGluLysThrTyrGlyAsnGlyAspSerLeuAsnThrGlyLysLeuLysAsnAspLysValSerArgPheAspPhe-97 |
| SEQ. ID. NO. 11072 | 101-IleGluValAspGlyGlnLeu-107 |
| SEQ. ID. NO. 11073 | 117-ValTyrLysGlnSerHisSerAla-124 |
| SEQ. ID. NO. 11074 | 129-GlnThrGluGlnIleGlnAspSerGluHisSerGlyLysMetValAlaLysArgGlnPheArgIleGlyAspIleAlaGlyGluHisThrSerPheAsp
LysLeuProGluGlyGlyArgAlaThrTyrArg-172 |
| SEQ. ID. NO. 11075 | 174-ThrAlaPheGlySerAspAspAlaGlyGly-183 |
| SEQ. ID. NO. 11076 | 191-PheAlaAlaLysGlnGlyAsnGlyLysIleGluHisLeuLysSerProGluLeuAsnVal-210 |
| SEQ. ID. NO. 11077 | 213-AlaAlaAlaAspIleLysProAspGlyLysArgHisAla-225 |
| SEQ. ID. NO. 11078 | 234-AsnGlnAlaGluLysGlySerTyrSer-242 |
| SEQ. ID. NO. 11079 | 247-GlyGlyLysAlaGlnGluValAlaGly-255 |
| SEQ. ID. NO. 11080 | 257-AlaGluValLysThrValAsnGly-264 |

Hydrophilic Regions - Hopp-Woods

| | |
|---|---|
| SEQ. ID. NO. 11081 | 43-LeuAspHisLysAspLysGlyLeu-50 |
| SEQ. ID. NO. 11082 | 57-GlnSerValArgLysAsnGluLysLeuLysLeu-67 |
| SEQ. ID. NO. 11083 | 71-GlyAlaGluLysThrTyrGlyAsn-78 |
| SEQ. ID. NO. 11084 | 85-GlyLysLeuLysAsnAspLysValSerArg-94 |

TABLE 1-continued

| SEQ. ID. NO. 11085 | 101-IleGluValAspGly-105 |
| SEQ. ID. NO. 11086 | 132-GlnIleGlnAspSerGluHisSerGly-140 |
| SEQ. ID. NO. 11087 | 142-MetValAlaLysArgGlnPheArgIle-150 |
| SEQ. ID. NO. 11088 | 152-AspIleAlaGlyGlu-156 |
| SEQ. ID. NO. 11089 | 158-ThrSerPheAspLysLeuProGluGlyGlyArgAlaThrTyr-171 |
| SEQ. ID. NO. 11090 | 177-GlySerAspAspAlaGlyGly-183 |
| SEQ. ID. NO. 11091 | 195-GlnGlyAsnGlyLysIleGluHisLeuLysSerProGluLeuAsnVal-210 |
| SEQ. ID. NO. 11092 | 213-AlaAlaAlaAspIleLysProAspGlyLysArgHisAla-225 |
| SEQ. ID. NO. 11093 | 235-GlnAlaGluLysGlySer-240 |
| SEQ. ID. NO. 11094 | 249-LysAlaGlnGluValAlaGly-255 |
| SEQ. ID. NO. 11095 | 257-AlaGluValLysThr-261 |

742
AMPHI Regions - AMPHI

| SEQ. ID. NO. 11096 | 26-ArgGluValProAsp-30 |
| SEQ. ID. NO. 11097 | 53-AsnArgProLeuGln-57 |
| SEQ. ID. NO. 11098 | 66-GluAspTrpSerArgLeu-71 |
| SEQ. ID. NO. 11099 | 77-AsnLeuPheSerGlyPheLysHisValPheAsp-87 |
| SEQ. ID. NO. 11100 | 143-LysAlaLeuGluLysLeuLysAla-150 |
| SEQ. ID. NO. 11101 | 153-AspGluThrAlaLysGluTyrArg-160 |
| SEQ. ID. NO. 11102 | 234-AsnAlaAlaGlnArgPheProAsnSerLeuTyrAsp-245 |
| SEQ. ID. NO. 11103 | 326-ValTyrAlaGlySerCysGlnGlu-333 |
| SEQ. ID. NO. 11104 | 340-SerSerProLeuVal-344 |
| SEQ. ID. NO. 11105 | 369-ArgAsnAlaLysLysIle-374 |
| SEQ. ID. NO. 11106 | 422-ThrProAlaPheThrGlyPheSerGlyThrValProValTrpLysThrValLys-439 |
| SEQ. ID. NO. 11107 | 448-LeuTyrAsnTyrAlaLysTyrLeuAsnThrAsn-458 |
| SEQ. ID. NO. 11108 | 475-LeuHisLeuLeuGlyGlyLeuHisTyr-483 |
| SEQ. ID. NO. 11109 | 505-PheGlnThrAlaSerSer-510 |
| SEQ. ID. NO. 11110 | 543-IleTyrGlySerTyrThrLysIlePheLysGlnGlnAspAsn-556 |
| SEQ. ID. NO. 11111 | 616-GlySerPheGlnThrValAlaLysProIleGlyLysValValSerArg-631 |
| SEQ. ID. NO. 11112 | 643-GluAspTrpLysValPheAlaGly-650 |
| SEQ. ID. NO. 11113 | 657-ArgTyrLysAsnAla-661 |
| SEQ. ID. NO. 11114 | 670-AlaLysAsnSerSer-674 |
| SEQ. ID. NO. 11115 | 677-ProTyrAsnPheSerAsnPheThrProValHisIle-688 |
| SEQ. ID. NO. 11116 | 714-ThrSerSerLeuTyrAsnIle-720 |
| SEQ. ID. NO. 11117 | 725-TyrGlyLeuIleAspGlyPheValArgTyr-734 |
| SEQ. ID. NO. 11118 | 736-LeuGlyLysHisAlaLysLeu-742 |
| SEQ. ID. NO. 11119 | 759-TyrAsnArgThrArgGlyAlaAsnAsnPheTyrGlyGluPro-772 |

Antigenic Index - Jameson-Wolf

| SEQ. ID. NO. 11120 | 6-AlaGluAlaAspAlaGlyAsp-12 |
| SEQ. ID. NO. 11121 | 21-MetTyrGlnLysSerArgGluValProAspPheSerGly-33 |
| SEQ. ID. NO. 11122 | 37-ProCysGluAsnGlnLysThrAlaProPheSerSerThrProAlaCysAsnArgProLeuGlnLeuProArgAsnThrTyrLeuGlyGluAspTrpSerArgLeuSerAlaAspLysTyrAsn-77 |
| SEQ. ID. NO. 11123 | 86-PheAspAsnGlyTrp-90 |
| SEQ. ID. NO. 11124 | 97-SerTyrThrLysAsnGluSerAspAlaLysVal-107 |
| SEQ. ID. NO. 11125 | 120-LeuSerGlyGluAspAla-125 |
| SEQ. ID. NO. 11126 | 130-ThrGluLysAsnGluValIleProPheGluProLysAspLysAlaLeuGluLysLeuLysAlaTyrArgAspGluThrAlaLysGluTyrArgGluArgLysAspAspPheValLysAsnArgPheAspAsnThrAla-175 |
| SEQ. ID. NO. 11127 | 177-GluGlnTyrArgSerArgArgAlaAlaGluArgLysAlaGlyPheAspLysCysMetSerAspProPheAla-200 |
| SEQ. ID. NO. 11128 | 205-CysGlnGlySerTrpGlyAspProGlyValAspAlaAspLysAlaGluPheValAsp-223 |
| SEQ. ID. NO. 11129 | 235-AlaAlaGlnArgPheProAsnSerLeuTyrAspSerSerPheAsnArgLysAlaThrAlaAsnArgArgTyrSerTyrMetPro-262 |
| SEQ. ID. NO. 11130 | 264-ArgHisThrLysAspAspArgGlnTrp-272 |
| SEQ. ID. NO. 11131 | 286-GlyArgGluHisAsp-290 |
| SEQ. ID. NO. 11132 | 295-TyrAlaTyrGlyAspGluLysIleArgSerGluTyr-306 |
| SEQ. ID. NO. 11133 | 308-GluIleTyrGluArgArgTyrArgValArgProAsnThrGlyAla-322 |
| SEQ. ID. NO. 11134 | 328-AlaGlySerCysGlnGluGluProAspGlyAspLeuSer-340 |
| SEQ. ID. NO. 11135 | 345-ArgGlyHisLysGluProAspTrpGlnAlaTyrAspGluLysGlyAsnArgThrValTyrAlaGluGluCysArgAsnAlaLysLysIleLysThrGluProLysLeuAspAlaGluGlyLysGln-386 |
| SEQ. ID. NO. 11136 | 389-TyrArgAspGluTyrSerGlySerArgThr-398 |
| SEQ. ID. NO. 11137 | 405-TyrGluLeuAspGluLysGlyAsnLysIleGlnGluThrAsnProAspGlyThrPro-423 |
| SEQ. ID. NO. 11138 | 439-LysValAlaAspAspHisVal-445 |
| SEQ. ID. NO. 11139 | 454-TyrLeuAsnThrAsnLysThrHis-461 |
| SEQ. ID. NO. 11140 | 485-ArgTyrGluThrSerGlnThrLysAspMetProValArgTyrGlyGlnProAlaSerAspPheGlnThr-507 |
| SEQ. ID. NO. 11141 | 509-SerSerIleAlaGlyAlaAspGlnAspHisTyrThr-519 |
| SEQ. ID. NO. 11142 | 521-LysMetGlnGlyHisLysLeuThrPro-529 |
| SEQ. ID. NO. 11143 | 545-GlySerTyrThrLys-549 |
| SEQ. ID. NO. 11144 | 551-PheLysGlnGlnAspAsnValAspValSerAla-561 |
| SEQ. ID. NO. 11145 | 584-GlyArgLeuAsnAla-588 |
| SEQ. ID. NO. 11146 | 595-LeuGluGlnLysAsnArgThrValVal-603 |
| SEQ. ID. NO. 11147 | 610-GlyAlaGlyGlyLysGlnGlySer-617 |
| SEQ. ID. NO. 11148 | 628-ValValSerArgGlyAlaGluPheGluLeuSerGlyGluLeuAsnGluAspTrpLys-646 |
| SEQ. ID. NO. 11149 | 652-ThrTyrAsnLysSerArgTyrLysAsnAlaAlaGluValAsnAlaGluArgLeuAlaLysAsnSerSerAlaAspProTyrAsnPheSerAsn-682 |
| SEQ. ID. NO. 11150 | 708-ValSerAlaGlnSerGlyThrSerSerLeuTyrAsnIleArgGlnGlyGly-724 |
| SEQ. ID. NO. 11151 | 735-GluLeuGlyLysHisAlaLys-741 |
| SEQ. ID. NO. 11152 | 746-GlyThrAsnLeuAsnGlyArgThrTyrPheGluAsnAsnTyrAsnArgThrArgGlyAlaAsnAsnPheTyrGlyGluProArgThrValSerMet-777 |

Hydrophilic Regions - Hopp-Woods

| SEQ. ID. NO. 11153 | 6-AlaGluAlaAspAlaGlyAsp-12 |
| SEQ. ID. NO. 11154 | 23-GlnLysSerArgGluValProAsp-30 |
| SEQ. ID. NO. 11155 | 67-AspTrpSerArgLeuSerAlaAspLys-75 |
| SEQ. ID. NO. 11156 | 97-SerTyrThrLysAsnGluSerAspAlaLysVal-107 |
| SEQ. ID. NO. 11157 | 120-LeuSerGlyGluAspAla-125 |

TABLE 1-continued

| SEQ. ID. NO. | |
|---|---|
| SEQ. ID. NO. 11158 | 130-ThrGluLysAsnGluValIleProPheGluProLysAspLysAlaLeuGluLysLeuLysAlaTyrArgAspGluThrAlaLysGluTyrArgGluArgLysAspAspPheValLysAsnArgPheAspAsnThrAla-175 |
| SEQ. ID. NO. 11159 | 177-GluGlnTyrArgSerArgArgAlaAlaGluArgLysAlaGlyPheAspLysCysMetSer-196 |
| SEQ. ID. NO. 11160 | 212-ProGlyValAspAlaAspLysAlaGluPheValAsp-223 |
| SEQ. ID. NO. 11161 | 247-SerPheAsnArgLysAlaThrAlaAsnArgArgTyrSer-259 |
| SEQ. ID. NO. 11162 | 264-ArgHisThrLysAspAspArgGlnTrp-272 |
| SEQ. ID. NO. 11163 | 286-GlyArgGluHisAsp-290 |
| SEQ. ID. NO. 11164 | 297-TyrGlyAspGluLysIleArgSerGluTyr-306 |
| SEQ. ID. NO. 11165 | 308-GluIleTyrGluArgArgTyrArgValArgProAsnThr-320 |
| SEQ. ID. NO. 11166 | 331-CysGlnGluGluProAspGlyAspLeu-339 |
| SEQ. ID. NO. 11167 | 345-ArgGlyHisLysGluProAsp-351 |
| SEQ. ID. NO. 11168 | 354-AlaTyrAspGluLysGlyAsnArg-361 |
| SEQ. ID. NO. 11169 | 363-ValTyrAlaGluGluCysArgAsnAlaLysLysIleLysThrGluProLysLeuAspAlaGluGlyLysGln-386 |
| SEQ. ID. NO. 11170 | 393-TyrSerGlySerArg-397 |
| SEQ. ID. NO. 11171 | 405-TyrGluLeuAspGluLysGlyAsnLysIleGlnGluThrAsnProAspGly-421 |
| SEQ. ID. NO. 11172 | 439-LysValAlaAspAspHisVal-445 |
| SEQ. ID. NO. 11173 | 485-ArgTyrGluThrSerGlnThrLysAspMetProVal-496 |
| SEQ. ID. NO. 11174 | 500-GlnProAlaSerAsp-504 |
| SEQ. ID. NO. 11175 | 509-SerSerIleArgAlaAspGlnAspHisTyrThr-519 |
| SEQ. ID. NO. 11176 | 551-PheLysGlnGlnAspAsnValAspValSerAla-561 |
| SEQ. ID. NO. 11177 | 597-GlnLysAsnArgThrValVal-603 |
| SEQ. ID. NO. 11178 | 611-AlaGlyGlyLysGlnGlySer-617 |
| SEQ. ID. NO. 11179 | 628-ValValSerArgGlyAlaGluPheGluLeuSerGlyGluLeuAsnGluAspTrpLys-646 |
| SEQ. ID. NO. 11180 | 654-AsnLysSerArgTyrLysAsnAlaAlaGluValAsnAlaGluArgLeuAlaLysAsnSerSerAlaAsp-676 |
| SEQ. ID. NO. 11181 | 735-GluLeuGlyLysHisAlaLys-741 |
| SEQ. ID. NO. 11182 | 758-AsnTyrAsnArgThrArgGly-764 |
| SEQ. ID. NO. 11183 | 770-GlyGluProArgThrValSerMet-777 |

743
AMPHI Regions - AMPHI

| SEQ. ID. NO. | |
|---|---|
| SEQ. ID. NO. 11184 | 19-TyrGlyGlySerPhe-23 |
| SEQ. ID. NO. 11185 | 58-SerTyrThrIleAsp-62 |
| SEQ. ID. NO. 11186 | 64-MetSerThrAlaThrGly-69 |
| SEQ. ID. NO. 11187 | 96-ThrLeuGluGlyAlaMetLysAsnThrThrGlyValAsnValValArgAsp-112 |
| SEQ. ID. NO. 11188 | 158-ValTyrAspHisIleGluValValArgGlyAlaThrGly-170 |

Antigenic Index - Jameson-Wolf

| SEQ. ID. NO. | |
|---|---|
| SEQ. ID. NO. 11189 | 1-MetAsnGlnAsnHis-5 |
| SEQ. ID. NO. 11190 | 30-ValSerAspGlyAsnThrVal-36 |
| SEQ. ID. NO. 11191 | 41-ValAsnValArgGlySer-46 |
| SEQ. ID. NO. 11192 | 51-GlyLysThrGluLysThrArgSerTyrThrIleAspArgMetSerThr-66 |
| SEQ. ID. NO. 11193 | 72-IleAlaGlyLysAspThrProGlnSer-80 |
| SEQ. ID. NO. 11194 | 85-ThrArgSerArgLeuAspAspLysAlaValHisThrLeuGluGluAlaMetLysAsnThrThrGly-106 |
| SEQ. ID. NO. 11195 | 109-ValValArgAspSerGlyLeuGlnThrArgPheLeuSerArgGlyPhe-124 |
| SEQ. ID. NO. 11196 | 128-GlnIleGlyGluAspGlyMet-134 |
| SEQ. ID. NO. 11197 | 140-GlyArgSerGlyTyrThrAlaLysIleAspValSerProSerThrAsp-155 |
| SEQ. ID. NO. 11198 | 163-GluValValArgGlyAlaThrGlyLeuThrGlnSerAsnSerGluProGlyGly-180 |

Hydrophilic Regions - Hopp-Woods

| SEQ. ID. NO. | |
|---|---|
| SEQ. ID. NO. 11199 | 51-GlyLysThrGluLysThrArgSerTyrThrIleAspArgMetSerThr-66 |
| SEQ. ID. NO. 11200 | 72-IleAlaGlyLysAspThrProGln-79 |
| SEQ. ID. NO. 11201 | 85-ThrArgSerArgLeuAspAspLysAlaValHisThrLeuGluGluAlaMetLysAsn-103 |
| SEQ. ID. NO. 11202 | 109-ValValArgAspSerGlyLeu-115 |
| SEQ. ID. NO. 11203 | 128-GlnIleGlyGluAspGlyMet-134 |
| SEQ. ID. NO. 11204 | 174-SerAsnSerGluProGlyGly-180 |

744
AMPHI Regions - AMPHI

| SEQ. ID. NO. | |
|---|---|
| SEQ. ID. NO. 11205 | 36-LeuAspGluLeuCys-40 |
| SEQ. ID. NO. 11206 | 65-AsnPheTyrLysAsnIleHisAlaThrThrLysPheValArgGluThrAspTyrSerLysPheIleGlnLeuLysLysAlaArgHisLeuThrValSerAspPheThrSerIleTrpLysValIleLeuTyr-108 |
| SEQ. ID. NO. 11207 | 124-SerSerIlePheAsnLysPheLysAlaLeuAspGluAlaIleAsnGluTyrTyrTyr-142 |
| SEQ. ID. NO. 11208 | 165-MetIlePheGlyLysPheValLysAlaLeuLysGly-174 |
| SEQ. ID. NO. 11209 | 197-ArgLysPheLysAspAla-202 |
| SEQ. ID. NO. 11210 | 228-PheAspGluTyrHisGluCysValLysGlyLeuAlaAsn-240 |
| SEQ. ID. NO. 11211 | 270-IlePheAspSerLeu-274 |
| SEQ. ID. NO. 11212 | 299-TyrArgSerSerLysIlePheGlyValPheAspHisLeuLeuArgThr-314 |
| SEQ. ID. NO. 11213 | 322-LeuGluLysGlyAsnSer-327 |
| SEQ. ID. NO. 11214 | 338-AsnLeuHisAspGluTyrLysAsnLeuThrSerPheIleSerPhe-352 |
| SEQ. ID. NO. 11215 | 361-ArgAspIleLeuGlnMetLeu-367 |
| SEQ. ID. NO. 11216 | 416-TyrGlnAsnPheLeuLysPhePheGluPhe-425 |
| SEQ. ID. NO. 11217 | 434-TyrSerAspPheLeuLysAlaPheGluArgLeuLysLysHis-447 |
| SEQ. ID. NO. 11218 | 454-GluIleProLysPheMetSerThrAlaAsnGlu-464 |
| SEQ. ID. NO. 11219 | 473-AsnValIleAlaTyrLeu-478 |
| SEQ. ID. NO. 11220 | 515-SerGlyLeuSerLysAlaLeuAspValGly-524 |

Antigenic Index - Jameson-Wolf

| SEQ. ID. NO. | |
|---|---|
| SEQ. ID. NO. 11221 | 15-AlaAsnTyrArgArgArgGluAsnLysAspLeuPhe-26 |
| SEQ. ID. NO. 11222 | 33-GlyGluTyrLeuAspGluLeuCysGluProAsnIle-44 |
| SEQ. ID. NO. 11223 | 48-IleGlyGluLysGlyThrArgGlyLysThr-56 |
| SEQ. ID. NO. 11224 | 64-AsnAsnPheTyrLys-68 |
| SEQ. ID. NO. 11225 | 75-LysPheValArgGluThrAspTyr-82 |
| SEQ. ID. NO. 11226 | 89-LysLysAlaArgHis-93 |
| SEQ. ID. NO. 11227 | 113-AsnGlnIleLysCysLysGluAsnGlyIle-122 |
| SEQ. ID. NO. 11228 | 131-LysAlaLeuAspGluAlaIleAsn-138 |

TABLE 1-continued

| | |
|---|---|
| SEQ. ID. NO. 11229 | 140-TyrTyrTyrGlyAlaPheAspProGluIle-149 |
| SEQ. ID. NO. 11230 | 157-GluAsnSerLysGluAlaAla-163 |
| SEQ. ID. NO. 11231 | 171-ValLysLeuGlyGluGluGluSerGln-179 |
| SEQ. ID. NO. 11232 | 184-ThrGluSerLysPhe-188 |
| SEQ. ID. NO. 11233 | 194-PheIleGluArgLysPheLysAspAlaLeuSer-204 |
| SEQ. ID. NO. 11234 | 206-LeuLysLeuLysAspAsn-211 |
| SEQ. ID. NO. 11235 | 217-AspGlyIleAspIleArgProSerGlnIleProPhe-228 |
| SEQ. ID. NO. 11236 | 230-GluTyrHisGluCysValLys-236 |
| SEQ. ID. NO. 11237 | 251-ProSerIleLysAspSerLysGlyArgMet-260 |
| SEQ. ID. NO. 11238 | 267-ArgProAspIlePheAspSerLeuGlyLeuGlnAsnGlnAsnThrLysLeuGlnAspAsnSerVal-288 |
| SEQ. ID. NO. 11239 | 291-AspTrpArgThrAspTyrLysSerTyrArgSerSerLysIle-304 |
| SEQ. ID. NO. 11240 | 312-LeuArgThrGlnGlnGluLysGlnAspSerLeuGluLysGlyAsnSerTrpAspTyrTyrPheProTrpAsnAlaProAsnLeuHisAspGluTyrLysAsnLeu-346 |
| SEQ. ID. NO. 11241 | 353-LeuArgLysSerTyrTyrArgProArgAspIle-363 |
| SEQ. ID. NO. 11242 | 371-GlnLysAsnLysLysSerLysGluAspTyrValVal-382 |
| SEQ. ID. NO. 11243 | 384-GluAspPheAspAsnThrSerPheGlnArgGluTyrSer-396 |
| SEQ. ID. NO. 11244 | 412-SerGlnSerAspTyrGlnAsn-418 |
| SEQ. ID. NO. 11245 | 427-AsnGlyLysAspArgPheLysTyrSerAspPhe-437 |
| SEQ. ID. NO. 11246 | 439-LysAlaPheGluArgLeuLysLysHisLeuGln-449 |
| SEQ. ID. NO. 11247 | 454-GluIleProLysPhe-458 |
| SEQ. ID. NO. 11248 | 478-LeuAspAsnProGluAspGluThrLysPro-487 |
| SEQ. ID. NO. 11249 | 493-PheLysAspArgAsnTyrAlaAsnIleSerProLysIleLysThrGluThr-509 |
| SEQ. ID. NO. 11250 | 518-SerLysAlaLeuAsp-522 |
| SEQ. ID. NO. 11251 | 524-GlyThrProPheLysAsnLysGln-531 |
| Hydrophilic Regions - Hopp-Woods | |
| SEQ. ID. NO. 11252 | 15-AlaAsnTyrArgArgArgGluAsnLysAspLeuPhe-26 |
| SEQ. ID. NO. 11253 | 34-GluTyrLeuAspGluLeuCysGlu-41 |
| SEQ. ID. NO. 11254 | 50-GluLysGlyThrGly-54 |
| SEQ. ID. NO. 11255 | 75-LysPheValArgGluThrAspTyr-82 |
| SEQ. ID. NO. 11256 | 89-LysLysAlaArgHis-93 |
| SEQ. ID. NO. 11257 | 115-IleLysCysLysGluAsnGlyIle-122 |
| SEQ. ID. NO. 11258 | 131-LysAlaLeuAspGluAlaIle-137 |
| SEQ. ID. NO. 11259 | 157-GluAsnSerLysGluAlaAla-163 |
| SEQ. ID. NO. 11260 | 171-ValLysLeuGlyGluGluGluSerGln-179 |
| SEQ. ID. NO. 11261 | 184-ThrGluSerLysPhe-188 |
| SEQ. ID. NO. 11262 | 194-PheIleGluArgLysPheLysAspAlaLeuSer-204 |
| SEQ. ID. NO. 11263 | 206-LeuLysLeuLysAspAsn-211 |
| SEQ. ID. NO. 11264 | 219-IleAspIleArgPro-223 |
| SEQ. ID. NO. 11265 | 230-GluTyrHisGluCysValLys-236 |
| SEQ. ID. NO. 11266 | 251-ProSerIleLysAspSerLysGlyArgMet-260 |
| SEQ. ID. NO. 11267 | 279-GlnAsnThrLysLeuGlnAsp-285 |
| SEQ. ID. NO. 11268 | 292-TrpArgThrAspTyrLysSerTyrArgSer-301 |
| SEQ. ID. NO. 11269 | 314-ThrGlnGlnGluLysGlnAspSerLeuGluLysGlyAsnSer-327 |
| SEQ. ID. NO. 11270 | 338-AsnLeuHisAspGluTyrLysAsn-345 |
| SEQ. ID. NO. 11271 | 356-SerTyrTyrArgProArgAspIle-363 |
| SEQ. ID. NO. 11272 | 371-GlnLysAsnLysLysSerLysGluAspTyrValVal-382 |
| SEQ. ID. NO. 11273 | 384-GluAspPheAspAsn-388 |
| SEQ. ID. NO. 11274 | 427-AsnGlyLysAspArgPheLysTyr-434 |
| SEQ. ID. NO. 11275 | 439-LysAlaPheGluArgLeuLysLysHisLeuGln-449 |
| SEQ. ID. NO. 11276 | 479-AspAsnProGluAspGluThrLysPro-487 |
| SEQ. ID. NO. 11277 | 493-PheLysAspArgAsnTyr-498 |
| SEQ. ID. NO. 11278 | 503-ProLysIleLysThrGluThr-509 |
| SEQ. ID. NO. 11279 | 527-PheLysAsnLysGln-531 |
| 745 | |
| AMPHI Regions - AMPHI | |
| SEQ. ID. NO. 11280 | 9-SerValThrAlaValIle-14 |
| SEQ. ID. NO. 11281 | 33-AspValIleLeuAsnAsp-38 |
| SEQ. ID. NO. 11282 | 116-CysThrAsnPheIleLysLeuTrpAsnAlaValSer-127 |
| SEQ. ID. NO. 11283 | 145-GluLeuGluIleLeuVal-150 |
| Antigenic Index - Jameson-Wolf | |
| SEQ. ID. NO. 11284 | 21-IleAsnLysLysThrSerLysGlnLysAlaThr-31 |
| SEQ. ID. NO. 11285 | 37-AsnAspTyrGlnAsp-41 |
| SEQ. ID. NO. 11286 | 43-GlnPheValGluAlaAspAsnHisIleSerProTyrIle-55 |
| SEQ. ID. NO. 11287 | 58-ThrAlaValAspAspAsnAsnAlaArg-66 |
| SEQ. ID. NO. 11288 | 73-TyrGlnAsnLysGlyGlyGlnTrpGluLysGluArgGlyHis-86 |
| SEQ. ID. NO. 11289 | 102-AsnSerGlyValLeuAspGluAspLeuPheLys-112 |
| SEQ. ID. NO. 11290 | 132-LysIleArgGluGluGluArgLysAspThrIlePheArgGluLeuGlu-147 |
| SEQ. ID. NO. 11291 | 156-AsnProLeuLysAlaSerAspLeu-163 |
| Hydrophilic Regions - Hopp-Woods | |
| SEQ. ID. NO. 11292 | 23-LysLysThrSerLysGlnLysAlaThr-31 |
| SEQ. ID. NO. 11293 | 43-GlnPheValGluAlaAspAsnHis-50 |
| SEQ. ID. NO. 11294 | 58-ThrAlaValAspAspAsnAsnAlaArg-66 |
| SEQ. ID. NO. 11295 | 76-LysGlyGlyGlnTrpGluLysGluArgGlyHis-86 |
| SEQ. ID. NO. 11296 | 105-ValLeuAspGluAspLeuPheLys-112 |
| SEQ. ID. NO. 11297 | 132-LysIleArgGluGluGluArgLysAspThrIlePheArgGluLeuGlu-147 |
| SEQ. ID. NO. 11298 | 156-AsnProLeuLysAlaSerAspLeu-163 |
| 746 | |
| AMPHI Regions - AMPHI | |
| SEQ. ID. NO. 11299 | 10-LeuSerGlyTyrGluGlnLeuLys-17 |
| SEQ. ID. NO. 11300 | 42-LeuSerSerGlyProAlaGluGlnThrAla-51 |

TABLE 1-continued

| | |
|---|---|
| SEQ. ID. NO. 11301 | 72-SerAlaAlaAspLysProGlnAsp-79 |
| SEQ. ID. NO. 11302 | 94-SerGluProGluAsn-98 |
| SEQ. ID. NO. 11303 | 118-LeuGluAlaSerGluLysLeuGlnGlnAlaGluThrAlaLysThrAlaPro-134 |
| SEQ. ID. NO. 11304 | 153-AspThrValAlaValGlu-158 |
| SEQ. ID. NO. 11305 | 160-ProLysArgThrAlaGluThr-166 |
| SEQ. ID. NO. 11306 | 170-LysAlaGluArgThr-174 |
| SEQ. ID. NO. 11307 | 184-ThrLysThrAlaGluLysValAlaAspLysProLys-195 |
| SEQ. ID. NO. 11308 | 210-SerAlaValLysGluAlaLysLysAlaAspLysAlaGluSer-223 |
| SEQ. ID. NO. 11309 | 238-GluThrAlaGlnLysThrAspLysAlaAspLysThrLysThrAlaGluLys-254 |
| SEQ. ID. NO. 11310 | 287-SerThrIleThrGluIleMetThr-294 |
| SEQ. ID. NO. 11311 | 307-TyrLysAsnAlaArgAspAlaGluArgAspLeu-317 |

Antigenic Index - Jameson-Wolf

| | |
|---|---|
| SEQ. ID. NO. 11312 | 1-MetSerGluAsnLysGlnAsnGluValLeuSerGlyTyrGluGlnLeuLysArgArgAsnArgArgArgLeuValThr-26 |
| SEQ. ID. NO. 11313 | 43-SerSerGlyProAlaGluGlnThrAlaGlyGluThrSerGlyValGluAsnLysAlaAlaGly-63 |
| SEQ. ID. NO. 11314 | 68-ProAlaLeuLysSerAlaAlaAspLysProGlnAspLeuAlaGlyGluAspLysProSerAlaAlaAspSerGluIleSerGluProGluAsnVal-99 |
| SEQ. ID. NO. 11315 | 108-GluArgLeuGluAspSerAsnIleLysGlyLeuGluAlaSerGluLysLeuGlnGlnAlaGluThrAlaLysThrAlaProLysGlnAlaLysGlnArg AlaAlaGluLysValProAlaThrAlaAspSerThrAspThrValAlaValGluLysProLysArgThrAlaGluThrLysProGlnLysAlaGluArgThrAla LysAlaLysProLysAlaLysGluThrLysThrAlaGluLysValAlaAspLysProLysThrAlaAlaGluLysThrLysProAspThrAlaLysSerAspSer AlaValLysGluAlaLysLysAlaAspLysAlaGluSerLysLysThrAlaGluLysAspArgSerAspGlyLysLysHisGluThrAlaGlnLysThrAspLys AlaAspLysThrLysThrAlaGluLysGluLysSerGlyLysLysAlaAla-262 |
| SEQ. ID. NO. 11316 | 266-GlyTyrAlaGluLysGlyGluArgAlaLeuSerLeuGlnArgLysMetLysAlaAlaGlyIle-285 |
| SEQ. ID. NO. 11317 | 292-IleMetThrAspAsnGlyLysValTyrArgValLysSerSerAsnTyrLysAsnAlaArgAspAlaGluArgAspLeuAsnLysLeuArgVal-322 |

Hydrophilic Regions - Hopp-Woods

| | |
|---|---|
| SEQ. ID. NO. 11318 | 1-MetSerGluAsnLysGlnAsnGluVal-9 |
| SEQ. ID. NO. 11319 | 14-GluGlnLeuLysArgArgAsnArgArgArgLeuVal-25 |
| SEQ. ID. NO. 11320 | 45-GlyProAlaGluGlnThrAlaGlyGluThrSerGlyValGluAsnLysAlaAlaGly-63 |
| SEQ. ID. NO. 11321 | 68-ProAlaLeuLysSerAlaAlaAspLysProGlnAspLeuAlaGlyGluAspLysProSerAlaAlaAspSerGluIleSerGluProGluAsnVal-99 |
| SEQ. ID. NO. 11322 | 108-GluArgLeuGluAspSerAsnIleLysGlyLeuGluAlaSerGluLysLeuGlnGlnAlaGluThrAlaLysThrAlaProLysGlnAlaLysGlnArg AlaAlaGluLysValProAlaThrAlaAspSerThrAsp-153 |
| SEQ. ID. NO. 11323 | 155-ValAlaValGluLysProLysArgThrAlaGluThrLysProGlnLysAlaGluArgThrAlaLysAlaLysProLysAlaLysGluThrLysThrAla GluLysValAlaAspLysProLysThrAlaAlaGluLysThrLysProAspThrAlaLysSerAspSerAlaValLysGluAlaLysLysAlaAspLysAlaGlu SerLysLysThrAlaGluLysAspArgSerAspGlyLysLysHisGluThrAlaGlnLysThrAspLysAlaAspLysThrLysThrAlaGluLysGluLysSer rGlyLysLysAlaAla-262 |
| SEQ. ID. NO. 11324 | 267-TyrAlaGluLysGlyGluArgAlaLeuSerLeuGlnArgLysMetLysAlaAlaGlyIle-285 |
| SEQ. ID. NO. 11325 | 292-IleMetThrAspAsnGlyLysValTyrArgValLysSerSerAsnTyrLysAsnAlaArgAspAlaGluArgAspLeuAsnLysLeuArgVal-322 |

747

AMPHI Regions - AMPHI

| | |
|---|---|
| SEQ. ID. NO. 11326 | 24-AlaSerArgAspValSerLysSerAlaLysGlyTrp-35 |

Antigenic Index - Jameson-Wolf

| | |
|---|---|
| SEQ. ID. NO. 11327 | 8-TyrAlaAspLeuArgGlyLysThrLysVal-17 |
| SEQ. ID. NO. 11328 | 23-GlyAlaSerArgAspValSerLysSerAlaLysGlyTrp-35 |
| SEQ. ID. NO. 11329 | 42-AsnValGlyLysGlnLeuThrAspSerValGlyLeuGluPheAspProTyrTyrArgHisLysThrIleTyrLysProArgGluIleValLeuAspGly AspLysThrLysMetGlyArgSerLysSerAsnGluTyrGly-88 |
| SEQ. ID. NO. 11330 | 97-SerGlnLeuLysSerLys-102 |

Hydrophilic Regions - Hopp-Woods

| | |
|---|---|
| SEQ. ID. NO. 11331 | 8-TyrAlaAspLeuArgGlyLysThrLysVal-17 |
| SEQ. ID. NO. 11332 | 23-GlyAlaSerArgAspValSerLysSerAlaLys-33 |
| SEQ. ID. NO. 11333 | 63-ThrIleTyrLysProArgGluIleValLeuAspGlyAspLysThrLysMetGlyArgSerLysSerAsnGluTyr-87 |

748

AMPHI Regions - AMPHI

| | |
|---|---|
| SEQ. ID. NO. 11334 | 22-GlyAlaValGlyAlaIleGlyGly-29 |
| SEQ. ID. NO. 11335 | 37-GlyGluThrAlaGluArgThrAlaGluSerGlnHis-48 |
| SEQ. ID. NO. 11336 | 82-SerAlaLysGlnLeuGluAsnLeuPheArgThrLeu-93 |
| SEQ. ID. NO. 11337 | 155-LeuGlnGluMetArgAspPheSerAsnAspLysLeuGlnLysSerTrp-170 |
| SEQ. ID. NO. 11338 | 188-GlnAlaAlaLeuArgAspIleIleLysHisThrValGln-200 |
| SEQ. ID. NO. 11339 | 250-GlyValAlaAlaAsnSer-255 |
| SEQ. ID. NO. 11340 | 257-AspGluProGluTrp-261 |
| SEQ. ID. NO. 11341 | 268-GlnAlaValArgLeuIleArgHisPheValGluPheTrpAspArg-282 |
| SEQ. ID. NO. 11342 | 310-GlnProAspPheAlaLysAspProGlu-318 |
| SEQ. ID. NO. 11343 | 334-ArgAspProGluPheLeu-339 |
| SEQ. ID. NO. 11344 | 390-LeuGluGluTyrIleSerProPhe-397 |

Antigenic Index - Jameson-Wolf

| | |
|---|---|
| SEQ. ID. NO. 11345 | 1-MetSerLysLysGlnProAlaGlnProThrArgArgThrLeuPhe-15 |
| SEQ. ID. NO. 11346 | 30-TyrLeuGlyGlyLysLysGlnGlyGluThrAlaGluArgThrAlaGluSerGlnHisSerProGlnAla-52 |
| SEQ. ID. NO. 11347 | 80-AlaGlnSerAlaLysGlnLeuGluAsn-88 |
| SEQ. ID. NO. 11348 | 101-ThrGlnGlyGlyGluTyrGlnAspGlyAspAspLysLeuProProAlaGlySerGly-119 |
| SEQ. ID. NO. 11349 | 125-PheAsnProAspGlyLeuThr-131 |
| SEQ. ID. NO. 11350 | 139-SerLeuPheArgAspGlyArgPheLeuLysAspLysLysProIleHis-154 |
| SEQ. ID. NO. 11351 | 156-GlnGluMetArgAspPheSerAsnAspLysLeuGlnLysSerTrpCysAspGlyAspLeuSer-176 |
| SEQ. ID. NO. 11352 | 183-ThrProGluThrCys-187 |
| SEQ. ID. NO. 11353 | 208-IleAspGlyTrpGlnProLysSerGluProGlyAlaMetAla-221 |
| SEQ. ID. NO. 11354 | 226-LeuGlyPheArgAspGlyThrGlyAsnProLysValSerAspProLysThrAlaAspGlu-245 |
| SEQ. ID. NO. 11355 | 255-SerLeuAlaGluProGluTrpAlaLysAsnGlySerTyrGlnAla-269 |
| SEQ. ID. NO. 11356 | 279-PheTrpAspArgThrProLeuGlnGluGlnThrAspIlePheGlyArgArgLysTyrSerGlyAlaProMetAspGlyLysLysGluAlaAspGlnPro AspPheAlaAspProGluGlyAspIleThrProLysAspSerHisIleArgLeuAlaAsnProArgAspProGluPheLeuLysLysHisArgLeuPhe Arg-346 |
| SEQ. ID. NO. 11357 | 348-AlaTyrSerTyrSerArgGlyLeuAlaSerSerGlyGlnLeu-361 |
| SEQ. ID. NO. 11358 | 385-LeuAsnGlyGluProLeuGluGluTyr-393 |
| SEQ. ID. NO. 11359 | 406-ProGlyValGluLysGlyGlyPhe-413 |

TABLE 1-continued

Hydrophilic Regions - Hopp-Woods
| | |
|---|---|
| SEQ. ID. NO. 11360 | 1-MetSerLysLysGlnProAlaGlnProThrArgArgThrLeuPhe-15 |
| SEQ. ID. NO. 11361 | 32-GlyGlyLysLysGlnGlyGluThrAlaGluArgThrAlaGluSerGlnHisSer-49 |
| SEQ. ID. NO. 11362 | 80-AlaGlnSerAlaLysGlnLeuGluAsn-88 |
| SEQ. ID. NO. 11363 | 104-GlyGluTyrGlnAspGlyAspAspLysLeuProPro-115 |
| SEQ. ID. NO. 11364 | 145-PheGlyLeuLysAspLysLysProIleHis-154 |
| SEQ. ID. NO. 11365 | 156-GlnGluMetArgAspPheSerAsnAspLysLeuGlnLysSerTrpCysAspGlyAspLeu-175 |
| SEQ. ID. NO. 11366 | 211-TrpGlnProLysSerGluProGlyAlaMetAla-221 |
| SEQ. ID. NO. 11367 | 229-ArgAspGlyThrGlyAsnProLysValSerAspProLysThrAlaAsp-244 |
| SEQ. ID. NO. 11368 | 255-SerLeuAspGluProGluTrpAlaLys-263 |
| SEQ. ID. NO. 11369 | 283-ThrProLeuGlnGluGlnThrAspIlePheGlyArgArgLysTyrSer-298 |
| SEQ. ID. NO. 11370 | 301-ProMetAspGlyLysLysGluAlaAspGlnProAspPheAlaLysAspProGluGlyAspIleThrProLysAspSerHisIle-328 |
| SEQ. ID. NO. 11371 | 331-AlaAsnProArgAspProGluPheLeuLysLysHisArgLeuPheArg-346 |
| SEQ. ID. NO. 11372 | 388-GluProLeuGluGluTyr-393 |
| SEQ. ID. NO. 11373 | 407-GlyValGluLysGlyGly-412 |

749
AMPHI Regions - AMPHI
| | |
|---|---|
| SEQ. ID. NO. 11374 | 20-CysGlnProProGluAla-25 |
| SEQ. ID. NO. 11375 | 140-AlaAspLeuGluLysLeuSerGlnProLeuAla-150 |
| SEQ. ID. NO. 11376 | 157-GlnGlyGluValLysGluLeuVal-164 |
| SEQ. ID. NO. 11377 | 169-ThrPheThrGluAlaValLysAlaGlyAspIleGluLysAla-182 |
| SEQ. ID. NO. 11378 | 196-IleGluProIleAlaGluLeuPheSerGluLeuAspPro-208 |
| SEQ. ID. NO. 11379 | 224-AlaGlyPheThrGlyPheHisArg-231 |
| SEQ. ID. NO. 11380 | 243-SerGlyValLysGluIleAlaAlaLysLeuMetThrAspValGluAlaLeuGlnLysGluIleAsp-264 |
| SEQ. ID. NO. 11381 | 274-ValGlyGlyAlaSerGluLeuIleGluGluValAlaGly-286 |
| SEQ. ID. NO. 11382 | 309-AspGlySerLysLysIleValAspLeuPheArgProLeu-321 |
| SEQ. ID. NO. 11383 | 337-PheLysGlnValAsnGluIleLeuAlaLys-346 |
| SEQ. ID. NO. 11384 | 351-AspGlyPheGluThrTyrAspLysLeuGlyGlu-361 |
| SEQ. ID. NO. 11385 | 366-AlaLeuGlnAlaSerIleAsnAlaLeuAlaGluAspLeuAlaGlnLeuArgGlyIleLeuGlyLeu-387 |

Antigenic Index - Jameson-Wolf
| | |
|---|---|
| SEQ. ID. NO. 11386 | 1-MetArgLysPheAsn-5 |
| SEQ. ID. NO. 11387 | 21-GlnProProGluAlaGluLysAlaAlaPro-30 |
| SEQ. ID. NO. 11388 | 32-AlaSerGlyGluAlaGlnThrAlaAsnGluGlyGlySer-44 |
| SEQ. ID. NO. 11389 | 50-AsnAspAsnAlaCysGluProMetGlu-58 |
| SEQ. ID. NO. 11390 | 70-IleLysAsnAsnSerGlyArgLysLeuGluTrpGluIle-82 |
| SEQ. ID. NO. 11391 | 87-MetValValAspGluArgGluAsnIleAla-96 |
| SEQ. ID. NO. 11392 | 98-GlyLeuSerAspLysMetThr-104 |
| SEQ. ID. NO. 11393 | 108-LeuProGlyGluTyrGluMet-114 |
| SEQ. ID. NO. 11394 | 120-ThrAsnProArgGlyLysLeuValValThrAspSerGlyPheLysAspThrAlaAsnGluAlaAspLeuGluLysLeuSer-146 |
| SEQ. ID. NO. 11395 | 158-GlyGluValLysGluLeuValAlaLysThrLysThrPheThrGluAlaValLysAlaGlyAspIleGluLysAlaLysSerLeuPheAla-187 |
| SEQ. ID. NO. 11396 | 189-ThrArgValHisTyrGluArgIleGluProIle-199 |
| SEQ. ID. NO. 11397 | 204-SerGluLeuAspProValIleAspAlaArgGluAspAspPheLysAspGlyAlaLysAspAlaGly-225 |
| SEQ. ID. NO. 11398 | 238-ValGluLysAspValSerGlyValLysGluIleAlaAla-250 |
| SEQ. ID. NO. 11399 | 252-LeuMetThrAspValGluAlaLeuGlnLysGluIleAsp-264 |
| SEQ. ID. NO. 11400 | 269-ProProGlyLysValValGlyGlyAla-277 |
| SEQ. ID. NO. 11401 | 279-GluLeuIleGluGluValAlaAlaGlySerLysIleSerGlyGluGluAspArgTyrSerHisThrAspLeuSerAspPheGlnAlaAsnValAspGlySerLysLysIleValAsp-316 |
| SEQ. ID. NO. 11402 | 322-IleGluAlaLysAsnLysAlaLeuLeuGluLysThrAspThrAsnPheLysGlnValAsn-341 |
| SEQ. ID. NO. 11403 | 345-AlaLysTyrArgThrLysAspGlyPheGluThrTyrAspLysLeuGlyGluAlaAspArgLysAlaLeu-367 |
| SEQ. ID. NO. 11404 | 374-LeuAlaGluAspLeuAlaGln-380 |

Hydrophilic Regions - Hopp-Woods
| | |
|---|---|
| SEQ. ID. NO. 11405 | 1-MetArgLysPheAsn-5 |
| SEQ. ID. NO. 11406 | 21-GlnProProGluAlaGluLysAlaAlaPro-30 |
| SEQ. ID. NO. 11407 | 32-AlaSerGlyGluAlaGlnThrAlaAsnGluGlyGlySer-44 |
| SEQ. ID. NO. 11408 | 52-AsnAlaCysGluProMetGlu-58 |
| SEQ. ID. NO. 11409 | 72-AsnAsnSerGlyArgLysLeuGluTrpGluIle-82 |
| SEQ. ID. NO. 11410 | 87-MetValValAspGluArgGluAsnIle-95 |
| SEQ. ID. NO. 11411 | 99-LeuSerAspLysMetThr-104 |
| SEQ. ID. NO. 11412 | 110-GlyGluTyrGluMet-114 |
| SEQ. ID. NO. 11413 | 122-ProArgGlyLysLeuValVal-128 |
| SEQ. ID. NO. 11414 | 131-SerGlyPheLysAspThrAlaAsnGluAlaAspLeuGluLysLeuSer-146 |
| SEQ. ID. NO. 11415 | 158-GlyGluValLysGluLeuValAlaLysThrLysThrPheThrGluAlaValLysAlaGlyAspIleGluLysAlaLysSerLeuPheAla-187 |
| SEQ. ID. NO. 11416 | 189-ThrArgValHisTyrGluArgIleGluProIle-199 |
| SEQ. ID. NO. 11417 | 204-SerGluLeuAspProValIleAspAlaArgGluAspAspPheLysAspGlyAlaLysAspAlaGly-225 |
| SEQ. ID. NO. 11418 | 238-ValGluLysAspValSerGlyValLysGluIleAlaAla-250 |
| SEQ. ID. NO. 11419 | 252-LeuMetThrAspValGluAlaLeuGlnLysGluIleAsp-264 |
| SEQ. ID. NO. 11420 | 279-GluLeuIleGluGluValAlaGly-286 |
| SEQ. ID. NO. 11421 | 288-LysIleSerGlyGluGluAspArgTyrSerHis-298 |
| SEQ. ID. NO. 11422 | 308-ValAspGlySerLysLysIleValAsp-316 |
| SEQ. ID. NO. 11423 | 322-IleGluAlaLysAsnLysAlaLeuLeuGluLysThrAspThrAsnPhe-337 |
| SEQ. ID. NO. 11424 | 347-TyrArgThrLysAspGlyPheGluThrTyrAspLysLeuGlyGluAlaAspArgLysAlaLeu-367 |
| SEQ. ID. NO. 11425 | 374-LeuAlaGluAspLeuAlaGln-380 |

750
AMPHI Regions - AMPHI
| | |
|---|---|
| SEQ. ID. NO. 11426 | 1-ValLysProArgPheTyrTrpAlaAlaCysAlaValLeuLeuThrAlaCysSerProGluProAlaAlaGluLysThrValSerAlaAlaSerAlaSerAla<br>AlaThrLeuThrValProThrAlaArgGlyAspAlaValValProLysAsnProGluArgValAlaValTyrAspTrpAlaAlaLeuAspThrLeuThrGlu<br>LeuGlyValAsnValGlyAlaThrThrAlaProValArgValAspTyrLeuGlnProAlaPheAspLysAlaAlaThrValGlyThrLeuPheGluProAspTyr<br>GluAlaLeuHisArgTyrAsnProGlnLeuValIleThrGlyGlyProGlyAlaGluAlaTyrGluGlnLeuAlaLysAsnAlaThrThrIleAspLeuThrVal<br>AspAsnGlyAsnIleArgThrSerGlyGluLysGlnMetGluThrLeuAlaArgIlePheGlyLysGluAlaArgAlaAlaGluLeuLysAlaGlnIleAspAla<br>LeuPheAlaGlnThrArgGluAlaAlaLysGlyLysGlyArgGlyLeuValLeuSerValThrGlyAsnLysValSerAlaPheGlyThrGlnSerArgLeuAla |

TABLE 1-continued

SerTrpIleHisGlyAspIleGlyLeuProProValAspGluSerLeuArgAsnGluGlyHisGlyGlnProValSerPheGluTyrIleLysGluLysAsnPro
    AspTrpIlePheIleIleAspArgThrAlaAlaIleGlyGlnGluGlyProAlaAlaValGluValLeuAspAsnAlaLeuValArgGlyThrAsnAlaTrpLys
    ArgLysGlnIleIleValMetProAlaAlaAsnTyrIleValAlaGlyGlyAlaArgGlnLeuIleGlnAlaAlaGluGlnLeuLysAlaAlaPheLysLysAla
    GluProValAlaAlaGlyLysLys-321

Antigenic Index - Jameson-Wolf (SEQ. ID. NO. 11426)
1-ValLysProArgPheTyrTrpAlaAlaCysAlaValLeuLeuThrAlaCysSerProGluProAlaAlaGluLys
ThrValSerAlaAlaSerAlaSerAlaAlaThrLeuThrValProThrAlaArgGlyAspAlaValValProLys
AsnProGluArgValAlaValTyrAspTrpAlaAlaLeuAspThrLeuThrGluLeuGlyValAsnValGlyAlaThr
ThrAlaProValArgValAspTyrLeuGlnProAlaPheAspLysAlaAlaThrValGlyThrLeuPheGluPro
AspTyrGluAlaLeuHisArgTyrAsnProGlnLeuValIleThrGlyGlyProGlyAlaGluAlaTyrGluGln
LeuAlaLysAsnAlaThrThrIleAspLeuThrValAspAsnGlyAsnIleArgThrSerGlyGluLysGlnMetGlu
ThrLeuAlaArgIlePheGlyLysGluAlaArgAlaAlaGluLeuLysAlaGlnIleAspAlaLeuPheAlaGln
ThrArgGluAlaLysGlyLysGlyArgGlyLeuValLeuSerValThrGlyAsnLysValSerAlaPheGly
ThrGlnSerArgLeuAlaSerTrpIleHisGlyAspIleGlyLeuProProValAspGluSerLeuArgAsnGlu
glyHisGlyGlnProValSerPheGluTyrIleLysGluLysAsnProAspTrpIlePheIleIleAspArgThr
AlaAlaIleGlyGlnGluGlyProAlaAlaValGluValLeuAspAsnAlaLeuValArgGlyThrAsnAlaTrpLys
ArgLysGlnIleIleValMetProAlaAlaAsnTyrIleValAlaGlyGlyAlaArgGlnLeuIleGlnAlaAla
GluGlnLeuLysAlaAlaPheLysLysAlaGluProValAlaAlaGlyLysLys-321

Hydrophilic Regions - Hopp-Woods (SEQ. ID. NO. 11426)
1-ValLysProArgPheTyrTrpAlaAlaCysAlaValLeuLeuThrAlaCysSerProGluProAlaAlaGluLys
ThrValSerAlaAlaSerAlaSerAlaAlaThrLeuThrValProThrAlaArgGlyAspAlaValValProLys
AsnProGluArgValAlaValTyrAspTrpAlaAlaLeuAspThrLeuThrGluLeuGlyValAsnValGlyAla
ThrThrAlaProValArgValAspTyrLeuGlnProAlaPheAspLysAlaAlaThrValGlyThrLeuPheGluPro
AspTyrGluAlaLeuHisArgTyrAsnProGlnLeuValIleThrGlyGlyProGlyAlaGluAlaTyrGluGln
LeuAlaLysAsnAlaThrThrIleAspLeuThrValAspAsnGlyAsnIleArgThrSerGlyGluLysGlnMet
GluThrLeuAlaArgIlePheGlyLysGluAlaArgAlaAlaGluLeuLysAlaGlnIleAspAlaLeuPheAlaGln
ThrArgGluAlaLysGlyLysGlyArgGlyLeuValLeuSerValThrGlyAsnLysValSerAlaPheGly
ThrGlnSerArgLeuAlaSerTrpIleHisGlyAspIleGlyLeuProProValAspGluSerLeuArgAsnGlu
GlyHisGlyGlnProValSerPheGluTyrIleLysGluLysAsnProAspTrpIlePheIleIleAspArgThrAla
AlaIleGlyGlnGluGlyProAlaAlaValGluValLeuAspAsnAlaLeuValArgGlyThrAsnAlaTrpLys
ArgLysGlnIleIleValMetProAlaAlaAsnTyrIleValAlaGlyGlyAlaArgGlnLeuIleGlnAlaAla
GluGlnLeuLysAlaAlaPheLysLysAlaGluProValAlaAlaGlyLysLys-321
751

AMPHI Regions - AMPHI
| SEQ. ID. NO. | | |
|---|---|---|
| SEQ. ID. NO. 11427 | 11-AlaAspArgAlaValArgSerAlaThr-19 |
| SEQ. ID. NO. 11428 | 59-IleGlnAspThrAsn-63 |
| SEQ. ID. NO. 11429 | 82-LeuSerAsnAlaAla-86 |
| SEQ. ID. NO. 11430 | 139-LeuAsnAsnLysValPheGlnGlyTyr-147 |
| SEQ. ID. NO. 11431 | 156-LeuAsnGlnAspIleTyrArgGluValGlnLysMetGly-168 |
| SEQ. ID. NO. 11432 | 215-AsnValGlnAsnAspTyrAlaAspValLeu-224 |
| SEQ. ID. NO. 11433 | 281-SerTyrPheAlaGluValProLysAlaGlyThrLysGluPheAspAsp TyrValLysIleTrpGlyGlu-303 |

Antigenic Index - Jameson-Wolf
| SEQ. ID. NO. 11434 | 9-ThrGlnAlaAspArgAlaValArg-16 |
|---|---|
| SEQ. ID. NO. 11435 | 18-AlaThrAlaProLys-22 |
| SEQ. ID. NO. 11436 | 29-LysIleIleAspGluLysThrGlyLysValSerPheAspThrArgGlnIle-45 |
| SEQ. ID. NO. 11437 | 50-AspLeuSerLysGluGluLeuAlaSerIleGlnAspThrAsnGlyLysVal-66 |
| SEQ. ID. NO. 11438 | 72-ProGlyIlePheAsnAsnArgGluAspSerLeuSerAsnAlaAlaLysGlnAsnArgAsnSerThrAsnGlySer-96 |
| SEQ. ID. NO. 11439 | 104-ProProThrGlyLysTyrLysSerAspSerAsnAsnLysIleLys-118 |
| SEQ. ID. NO. 11440 | 137-AspGlnLeuAsnAsnLys-142 |
| SEQ. ID. NO. 11441 | 147-TyrLeuProLysThrAsnSerGluLysLeuAsnGlnAspIleTyrArgGluValGlnLysMetGlyAsnGlyTrpSerValAspThrSerAsnHisSer ArgGlyGlyIle-183 |
| SEQ. ID. NO. 11442 | 190-LysAspTrpValAsnAsnGlnLysGlnAsnGly-200 |
| SEQ. ID. NO. 11443 | 203-ProIleArgLysAlaArgPhe-209 |
| SEQ. ID. NO. 11444 | 214-ThrAsnValGlnAsnAspTyrAlaAspValLeuGlnLysAsnGlyTyr-229 |
| SEQ. ID. NO. 11445 | 233-GlyAlaAspGlyLysThrTyrAsnSerGlySer-243 |
| SEQ. ID. NO. 11446 | 247-ValHisAspLysAspPheValGlyAsnLys-256 |
| SEQ. ID. NO. 11447 | 263-GlyThrAsnAspThrThrGlnGlyThrCysLysGlyLeuCys-276 |
| SEQ. ID. NO. 11448 | 286-ValProLysAlaGlyThrLysGluPheAspAspTyrVal-298 |
| SEQ. ID. NO. 11449 | 304-ValGluTyrAspAlaGlnGlyLysProIleAsnLysSerLysProLeuValGluProAsnLysThrLysAspAsnGluLysTyrGluLysGluAla Phe-337 |

Hydrophilic Regions - Hopp-Woods
| SEQ. ID. NO. 11450 | 10-GlnAlaAspArgAlaValArg-16 |
|---|---|
| SEQ. ID. NO. 11451 | 18-AlaThrAlaProLys-22 |
| SEQ. ID. NO. 11452 | 29-LysIleIleAspGluLysThrGlyLysValSerPheAspThr-42 |
| SEQ. ID. NO. 11453 | 50-AspLeuSerLysGluGluLeuAlaSer-58 |
| SEQ. ID. NO. 11454 | 60-GlnAspThrAsnGly-64 |
| SEQ. ID. NO. 11455 | 76-AsnAsnArgGluAspSerLeuSerAsnAlaAlaLysGlnAsnArgAsnSerThrAsn-94 |
| SEQ. ID. NO. 11456 | 105-ProThrGlyLysTyrLysSerAspSerAsnAsnLysIleLys-118 |
| SEQ. ID. NO. 11457 | 151-ThrAsnSerGluLysLeuAsnGlnAspIleTyrArgGluValGlnLysMet-167 |
| SEQ. ID. NO. 11458 | 175-ThrSerAsnHisSerArgGlyGlyIle-183 |
| SEQ. ID. NO. 11459 | 196-GlnLysGlnAsnGly-200 |
| SEQ. ID. NO. 11460 | 203-ProIleArgLysAlaArgPhe-209 |
| SEQ. ID. NO. 11461 | 219-AspTyrAlaAspValLeuGln-225 |
| SEQ. ID. NO. 11462 | 234-AlaAspGlyLysThrTyrAsn-240 |
| SEQ. ID. NO. 11463 | 247-ValHisAspLysAspPheVal-253 |
| SEQ. ID. NO. 11464 | 265-AsnAspThrThrGlnGlyThrCys-272 |

TABLE 1-continued

| SEQ. ID. NO. 11465 | 286-ValProLysAlaGlyThrLysGluPheAspAspTyrVal-298 |
| SEQ. ID. NO. 11466 | 304-ValGluTyrAspAlaGlnGlyLysProIleAsnLysSerLysProIleLeu-320 |
| SEQ. ID. NO. 11467 | 322-GluProAsnLysThrLysAspAsnGluLysTyrGluLysGluAlaPhe-337 |

752-2
AMPHI Regions - AMPHI
| SEQ. ID. NO. 11468 | 6-GluArgMetThrGlnIleAlaLysLeuLeuAsnSerSer-18 |
| SEQ. ID. NO. 11469 | 29-PheLeuThrGluIleLysAspTyrSerGluPhe-39 |
| SEQ. ID. NO. 11470 | 51-TrpAspLysPheArgArgIle-57 |
| SEQ. ID. NO. 11471 | 69-ValLysGluSerArgLysLysIleGlnLysProIleAsp-81 |
| SEQ. ID. NO. 11472 | 105-LysSerCysGlySerSerIleGly-112 |
| SEQ. ID. NO. 11473 | 114-SerSerLeuGlyGlyPheGly-120 |
| SEQ. ID. NO. 11474 | 145-GlyAlaAlaThrThrArgLysValAlaLysAspMetLeuLysSerGln-160 |
| SEQ. ID. NO. 11475 | 194-IleLeuAspLeuHisArgIleAlaThrSer-203 |
| SEQ. ID. NO. 11476 | 233-GlnProProProHisGly-238 |
| SEQ. ID. NO. 11477 | 240-ValHisThrLeuMetGluGluVal-247 |
| SEQ. ID. NO. 11478 | 254-ThrTyrAspGlyValGluAsnProPheIleHisProValValGlnAlaIle-270 |
| SEQ. ID. NO. 11479 | 272-LeuHisPheLeuIleGlyTyrIleHisPro-281 |
| SEQ. ID. NO. 11480 | 309-IleSerIleSerArgLeuLeuLysAsnAlaProAlaGlnTyr-322 |
| SEQ. ID. NO. 11481 | 347-IleLysArgAlaValAlaAspLeuGluHis-356 |
| SEQ. ID. NO. 11482 | 371-AlaIleAlaGlnTyrThrGluLysIleGlyLysLeu-382 |
| SEQ. ID. NO. 11483 | 390-LeuGlnLysAlaValGluGluSerGly-398 |
| SEQ. ID. NO. 11484 | 422-SerLysLeuGlyGluTyrArgPhe-429 |
| SEQ. ID. NO. 11485 | 435-SerGlyAsnAlaLeuGluTyrValAlaPro-444 |

Antigenic Index - Jameson-Wolf
| SEQ. ID. NO. 11486 | 4-LeuThrGluArgMetThrGln-10 |
| SEQ. ID. NO. 11487 | 15-LeuAsnSerSerAlaAsnAsnProAspIleAspIleProAspPheLeuThrGluIleLysAspTyrSerGlu-38 |
| SEQ. ID. NO. 11488 | 40-SerValThrAspGluAsnGlyThr-47 |
| SEQ. ID. NO. 11489 | 52-AspLysPheArgArgIleHisThrGluAspThrArgMetLysTrpArgAlaValLysGluSerArgLysLysIleGlnLysProIleAsp-81 |
| SEQ. ID. NO. 11490 | 92-IleProAspSerLeuGln-97 |
| SEQ. ID. NO. 11491 | 102-LeuIleAspLysSerCysGlySerSerIleGly-112 |
| SEQ. ID. NO. 11492 | 117-GlyGlyPheGlyArgSerGluGlnAsnArgPheLeu-128 |
| SEQ. ID. NO. 11493 | 147-AlaThrThrArgLysValAlaLysAspMetLeuLysSerGlnArgLysProLysThrLysAspGluIle-169 |
| SEQ. ID. NO. 11494 | 179-LysLysAlaValGluLeuLysAsnThr-187 |
| SEQ. ID. NO. 11495 | 204-AsnAlaIleGluAsnLysAlaGluProGlyGlnPheArgGlnAspAspGluIlePhe-222 |
| SEQ. ID. NO. 11496 | 226-IleAsnGlyAsnSerLeuTyrGlnProProProHisGly-238 |
| SEQ. ID. NO. 11497 | 253-AsnThrTyrAspGlyValGluAsnProPhe-262 |
| SEQ. ID. NO. 11498 | 280-HisProPheGlyAspGlyAsnGlyArgThrAlaArg-291 |
| SEQ. ID. NO. 11499 | 313-ArgLeuLeuLysAsnAlaPro-319 |
| SEQ. ID. NO. 11500 | 330-GluThrAspAspLeuAsp-335 |
| SEQ. ID. NO. 11501 | 342-TyrGlnCysAspIleIleLys-348 |
| SEQ. ID. NO. 11502 | 358-IleSerAspLysGlnLysHisGlnGlnGluPheLysAla-370 |
| SEQ. ID. NO. 11503 | 375-TyrThrGluLysIleGlyLysLeuAsnGlnArgGln-386 |
| SEQ. ID. NO. 11504 | 392-LysAlaValGluGluSerGlyLys-399 |
| SEQ. ID. NO. 11505 | 415-AsnThrAlaArgSerAspLeuSerLysLeuGlyGluTyrArgPhe-429 |
| SEQ. ID. NO. 11506 | 433-PheLysSerGlyAsnAlaLeu-439 |
| SEQ. ID. NO. 11507 | 445-GlnAspLeuLeuGluArgLeuGluLysLys-454 |

Hydrophilic Regions - Hopp-Woods
| SEQ. ID. NO. 11508 | 4-LeuThrGluArgMetThrGln-10 |
| SEQ. ID. NO. 11509 | 19-AlaAsnAsnProAspIleAspIle-26 |
| SEQ. ID. NO. 11510 | 31-ThrGluIleLysAspTyrSerGlu-38 |
| SEQ. ID. NO. 11511 | 40-SerValThrAspGluAsnGly-46 |
| SEQ. ID. NO. 11512 | 52-AspLysPheArgArgIleHisThrGluAspThrArgMetLysTrpArgAlaValLysGluSerArgLysLysIleGlnLysProIle-80 |
| SEQ. ID. NO. 11513 | 102-LeuIleAspLysSerCysGly-108 |
| SEQ. ID. NO. 11514 | 120-GlyArgSerGluGlnAsnArgPheLeu-128 |
| SEQ. ID. NO. 11515 | 147-AlaThrThrArgLysValAlaLysAspMetLeuLysSerGlnArgLysProLysThrLysAspGluIle-169 |
| SEQ. ID. NO. 11516 | 179-LysLysAlaValGluLeuLysAsn-186 |
| SEQ. ID. NO. 11517 | 204-AsnAlaIleGluAsnLysAlaGluProGlyGlnPheArgGlnAspAspGluIlePhe-222 |
| SEQ. ID. NO. 11518 | 283-GlyAspGlyAsnGlyArgThrAlaArg-291 |
| SEQ. ID. NO. 11519 | 330-GluThrAspAspLeuAsp-335 |
| SEQ. ID. NO. 11520 | 358-IleSerAspLysGlnLysHisGlnGlnGluPheLysAla-370 |
| SEQ. ID. NO. 11521 | 375-TyrThrGluLysIleGlyLysLeuAsnGlnArgGln-386 |
| SEQ. ID. NO. 11522 | 392-LysAlaValGluGluSerGlyLys-399 |
| SEQ. ID. NO. 11523 | 416-ThrAlaArgSerAspLeuSerLysLeuGlyGlu-426 |
| SEQ. ID. NO. 11524 | 446-AspLeuLeuGluArgLeuGluLysLys-454 |

753
AMPHI Regions - AMPHI
| SEQ. ID. NO. 11525 | 44-IleValGluMetMetThrTyrIleLeu-52 |
| SEQ. ID. NO. 11526 | 75-TrpAlaTyrPheAspGluValAlaGln-83 |
| SEQ. ID. NO. 11527 | 109-GlnTrpPheAlaProLeu-114 |
| SEQ. ID. NO. 11528 | 121-ArgSerAlaValArgGlnLeu-127 |
| SEQ. ID. NO. 11529 | 129-ProSerThrThrValArgAla-135 |

Antigenic Index - Jameson-Wolf
| SEQ. ID. NO. 11530 | 13-LysLeuTyrProAsnGluGlnTrpAsnGluSerGluAla-25 |
| SEQ. ID. NO. 11531 | 34-TyrGlnSerProThrHisArgGln-41 |
| SEQ. ID. NO. 11532 | 55-LeuLysAsnGlyGln-59 |
| SEQ. ID. NO. 11533 | 64-CysLysGlyThrGlnProIleGly-71 |
| SEQ. ID. NO. 11534 | 85-HisTyrLeuGluSerAspArgHisLeuArgAspAsnSerAspTrpAsnCysGlyAspAsnIle-105 |
| SEQ. ID. NO. 11535 | 112-AlaProLeuGlyHisSerHisGlnMetArgSerAlaVal-124 |
| SEQ. ID. NO. 11536 | 136-LeuTyrHisLysGlySerAspLysGlyLeuArg-146 |

TABLE 1-continued

Hydrophilic Regions - Hopp-Woods
SEQ. ID. NO. 11537    19-GlnTrpAsnGluSerGluAla-25
SEQ. ID. NO. 11538    87-LeuGluSerAspArgHisLeuArgAspAsnSerAsp-98
SEQ. ID. NO. 11539    139-LysGlySerAspLysGlyLeuArg-146
754
AMPHI Regions - AMPHI
SEQ. ID. NO. 11540    29-ArgIleGlyThrLeuGluLysGlyAlaMet-38
SEQ. ID. NO. 11541    67-MetProHisIlePheAlaGlnTyrPheProGluGlyPheLeuAsp-81
SEQ. ID. NO. 11542    108-ArgGluThrLeuGlyArg-113
SEQ. ID. NO. 11543    121-ProLeuPheAsnGluTrpIleAspGlyLeuGlu-131
SEQ. ID. NO. 11544    152-PheGlnGlnTyrMetAlaGluIle-159
SEQ. ID. NO. 11545    161-HisHisGlyArgPheValSerValSer-169
SEQ. ID. NO. 11546    181-ArgArgAsnThrLys-185
SEQ. ID. NO. 11547    189-SerTyrIleAlaLysGly-194
SEQ. ID. NO. 11548    249-MetGluAspPheThrSerLeuArgGln-257
SEQ. ID. NO. 11549    269-AlaAlaIleAlaGlnIleIleArgGlnIleSerGlyArgProAsp-283
SEQ. ID. NO. 11550    288-HisPhePheAsnGlnLeuAlaAla-295
SEQ. ID. NO. 11551    324-ValTyrAspValLeuAspThr-330
SEQ. ID. NO. 11552    336-GlyThrGlnGlyIlePheAspAlaTyrAsp-345
SEQ. ID. NO. 11553    399-TyrSerAspValLeu-403
Antigenic Index - Jameson-Wolf
SEQ. ID. NO. 11554    8-ValSerGlyAsnArgMetArgLysProArg-17
SEQ. ID. NO. 11555    25-AlaAsnAspGluArgIleGlyThrLeuGluLysGlyAla-37
SEQ. ID. NO. 11556    43-TyrAspAsnProAsnSerSerLeu-50
SEQ. ID. NO. 11557    54-HisTyrGlnAspArgSerLysVal-61
SEQ. ID. NO. 11558    75-PheProGluGlyPheLeu-80
SEQ. ID. NO. 11559    93-AlaProPheGluAspAsnGluMetLeu-101
SEQ. ID. NO. 11560    114-IleHisValArgCysAsnAspProLeuPhe-123
SEQ. ID. NO. 11561    130-LeuGluMetLysAsnProArgIleLeuThrGluArgAspLeuLeu-144
SEQ. ID. NO. 11562    163-GlyArgPheValSer-167
SEQ. ID. NO. 11563    170-GlyIleGlnGlnLysMetSerLeuAspAlaIleArgArgAsnThrLysGlnThrAla-188
SEQ. ID. NO. 11564    194-GlyPheAspAlaSerGluTyrProCys-202
SEQ. ID. NO. 11565    224-ThrSerLeuSerGluAspSerSer-231
SEQ. ID. NO. 11566    236-ArgArgPheAspValSerGluGlnGlyTyr-245
SEQ. ID. NO. 11567    250-GluAspPheThrSer-254
SEQ. ID. NO. 11568    256-ArgGlnTyrSerValGluAspLysTyrLysGlySerTyr-268
SEQ. ID. NO. 11569    278-IleSerGlyArgProAspGluAspLeu-286
SEQ. ID. NO. 11570    299-LeuLysAsnGlyAspAlaHisLeu-306
SEQ. ID. NO. 11571    315-AspGluTyrAspVal-319
SEQ. ID. NO. 11572    343-AlaTyrAspAspThrLeu-348
SEQ. ID. NO. 11573    352-LeuThrAsnHisGlyLysLysThrTyrProSerLysAsnThr-365
SEQ. ID. NO. 11574    369-PheAlaGluLysTyrCysAspLeuGlyArgGluAspAlaSerPhe-383
SEQ. ID. NO. 11575    389-ValGlnAlaLysGluGlnVal-395
SEQ. ID. NO. 11576    399-TyrSerAspValLeuArgGluAsnGluTrpLeu-409
SEQ. ID. NO. 11577    415-PheIleProAspGluAsnGluGluGlyLeu-424
Hydrophilic Regions - Hopp-Woods
SEQ. ID. NO. 11578    10-GlyAsnArgMetArgLysProArg-17
SEQ. ID. NO. 11579    25-AlaAsnAspGluArgIleGlyThrLeuGluLysGlyAla-37
SEQ. ID. NO. 11580    55-TyrGlnAspArgSerLysVal-61
SEQ. ID. NO. 11581    93-AlaProPheGluAspAsnGluMetLeu-101
SEQ. ID. NO. 11582    114-IleHisValArgCysAsnAsp-120
SEQ. ID. NO. 11583    130-LeuGluMetLysAsnProArgIleLeuThrGluArgAspLeuLeu-144
SEQ. ID. NO. 11584    175-MetSerLeuAspAlaIleArgArgAsnThrLysGln-186
SEQ. ID. NO. 11585    194-GlyPheAspAlaSerGlu-199
SEQ. ID. NO. 11586    225-SerLeuSerGluAspSerSer-231
SEQ. ID. NO. 11587    236-ArgArgPheAspValSerGlu-242
SEQ. ID. NO. 11588    250-GluAspPheThrSer-254
SEQ. ID. NO. 11589    258-TyrSerValGluAspLysTyrLysGly-266
SEQ. ID. NO. 11590    278-IleSerGlyArgProAspGluAspLeu-286
SEQ. ID. NO. 11591    300-LysAsnGlyAspAlaHisLeu-306
SEQ. ID. NO. 11592    315-AspGluTyrAspVal-319
SEQ. ID. NO. 11593    354-AsnHisGlyLysLysThrTyrProSer-362
SEQ. ID. NO. 11594    369-PheAlaGluLysTyrCysAspLeuGlyArgGluAspAlaSerPhe-383
SEQ. ID. NO. 11595    389-ValGlnAlaLysGluGlnVal-395
SEQ. ID. NO. 11596    401-AspValLeuArgGluAsnGluTrpLeu-409
SEQ. ID. NO. 11597    417-ProAspGluAsnGluGluGlyLeu-424
755
AMPHI Regions - AMPHI
SEQ. ID. NO. 11598    22-AsnAsnTyrThrAsnAlaTyrSerAspIleLysThrIle-34
SEQ. ID. NO. 11599    38-HisGlyPheGluAsnIleGlnGly-45
SEQ. ID. NO. 11600    75-SerCysIleSerAsnIleLysPhe-82
SEQ. ID. NO. 11601    124-GluGlnIleAsnGlnValLeu-130
Antigenic Index - Jameson-Wolf
SEQ. ID. NO. 11602    10-MetAspThrAsnCysLeuLysAspAsnTyrHisGlyAsnAsnTyrThrAsnAlaTyrSerAsp-30
SEQ. ID. NO. 11603    42-AsnIleGlnGlySer-46
SEQ. ID. NO. 11604    48-TyrLeuGlyArgGluGlyIleSerGluAlaHis-58
SEQ. ID. NO. 11605    83-TyrArgLeuGluSerAspLeu-89
SEQ. ID. NO. 11606    108-ArgValGluGlnLeuArg-113
SEQ. ID. NO. 11607    120-GlyLeuSerAspGluGlnIle-126
SEQ. ID. NO. 11608    129-ValLeuGluLysGlnLysPheGluLeuGluSerProAsnLeuLys-143

TABLE 1-continued

Hydrophilic Regions - Hopp-Woods
SEQ. ID. NO. 11609  10-MetAspThrAsnCysLeuLysAspAsnTyrHis-20
SEQ. ID. NO. 11610  49-LeuGlyArgGluGlyIleSerGluAlaHis-58
SEQ. ID. NO. 11611  83-TyrArgLeuGluSerAspLeu-89
SEQ. ID. NO. 11612  108-ArgValGluGlnLeuArg-113
SEQ. ID. NO. 11613  120-GlyLeuSerAspGluGlnIle-126
SEQ. ID. NO. 11614  129-ValLeuGluLysGlnLysPheGluLeuGluSerProAsnLeu-142
756
AMPHI Regions - AMPHI
SEQ. ID. NO. 11615  6-AlaGlnThrLeuValGluIleGlnAspSerLeuTyrArgValValSerThrVal-23
SEQ. ID. NO. 11616  29-AsnLeuLysArgLeuThr-34
SEQ. ID. NO. 11617  57-AspPheLysGluThrLeuValArgPheGlyArgAspMetLeuGlnAspMetPro-74
SEQ. ID. NO. 11618  98-TyrLeuGluTyrLeuLysGlnValAlaSer-107
SEQ. ID. NO. 11619  113-GluArgLeuTyrAsnAlaValAspArgLeuAlaGluSerGlnGluArg-128
SEQ. ID. NO. 11620  130-ThrSerAlaIleLeu-134
SEQ. ID. NO. 11621  136-GlyAlaArgGlyAlaAspPhe-142
Antigenic Index - Jameson-Wolf
SEQ. ID. NO. 11622  11-GluIleGlnAspSerLeuTyr-17
SEQ. ID. NO. 11623  24-GlnTyrGlyAspAspAsnLeuLysArgLeuThrAlaAspLysArgLysGlnTyr-41
SEQ. ID. NO. 11624  45-PheLysIleSerGluGlySerThrArgValGluSerAspPheLysGluThrLeu-62
SEQ. ID. NO. 11625  65-PheGlyArgAspMetLeuGlnAspMetProProLysIleArgSer-79
SEQ. ID. NO. 11626  105-ValAlaSerGluGlyTyrGlnThrGluArgLeuTyrAsnAlaValAspArgLeuAlaGluSerGlnGluArgIleThr-130
SEQ. ID. NO. 11627  135-LysGlyAlaArgGlyAlaAsp-141
SEQ. ID. NO. 11628  44-GlnIleGlyArgArgSerTyrSerArgGluAspIleSerGluAlaAsnArgArgAlaGluArgValProTyr-167
SEQ. ID. NO. 11629  171-LeuValSerAspGlyAsn-176
SEQ. ID. NO. 11630  182-SerAspIleGlyAsp-186
Hydrophilic Regions - Hopp-Woods
SEQ. ID. NO. 11631  11-GluIleGlnAspSerLeu-16
SEQ. ID. NO. 11632  25-TyrGlyAspAspAsnLeuLysArgLeuThrAlaAspLysArgLysGlnTyr-41
SEQ. ID. NO. 11633  45-PheLysIleSerGluGlySerThrArgValGluSerAspPheLysGluThrLeu-62
SEQ. ID. NO. 11634  65-PheGlyArgAspMetLeuGln-71
SEQ. ID. NO. 11635  73-MetProProLysIleArgSer-79
SEQ. ID. NO. 11636  114-ArgLeuTyrAsnAlaValAspArgLeuAlaGluSerGlnGluArgIleThr-130
SEQ. ID. NO. 11637  135-LysGlyAlaArgGlyAlaAsp-141
SEQ. ID. NO. 11638  144-GlnIleGlyArgArgSerTyrSerArgGluAspIleSerGluAlaAsnArgArgAlaGluArgValProTyr-167
757
AMPHI Regions - AMPHI
SEQ. ID. NO. 11639  47-AspTyrGlnSerAlaAlaAsnLys-54
SEQ. ID. NO. 11640  79-AsnLeuLeuHisAspPheSerAspGlyLeu-88
SEQ. ID. NO. 11641  97-LysAlaAspLysIleThr-102
SEQ. ID. NO. 11642  115-GlnLysAlaGluLysLeuSerLysAlaAla-124
SEQ. ID. NO. 11643  140-ArgAspThrGlyAsp-144
SEQ. ID. NO. 11644  154-AsnAlaGlnLysGluProThrArgGluTrpAla-164
Antigenic Index - Jameson-Wolf
SEQ. ID. NO. 11645  16-AlaCysGlySerGlnSerGluGluGlnProAlaSerAlaGlnProGlnGluGlnAlaGlnSerGluLeuLysThrMetPro-42
SEQ. ID. NO. 11646  46-ThrAspTyrGlnSerAlaAlaAsnLysGlyLeuAsnAspGlnLysThrGlyLeuThrLeu-65
SEQ. ID. NO. 11647  73-AspAsnAlaGluGlyLysAsnLeuLeuHisAspPheSerAspGlyLeu-88
SEQ. ID. NO. 11648  93-ValAspThrAspLysAlaAspLysIleThrAla-103
SEQ. ID. NO. 11649  108-TrpAsnThrAspAlaMetProGlnLysAlaGluLysLeuSerLys-122
SEQ. ID. NO. 11650  132-AlaProGluAspArgThrMetLeuArgAspThrGlyAspGlnIleGluMetAlaIleAspSerHisAsnAlaGlnLysGluProThrArgGluTrpAlaArgGlyGlyIle-168
Hydrophilic Regions - Hopp-Woods
SEQ. ID. NO. 11651  19-SerGlnSerGluGluGlnProAla-26
SEQ. ID. NO. 11652  29-GlnProGlnGluGlnAlaGlnSerGluLeuLysThr-40
SEQ. ID. NO. 11653  50-SerAlaAlaAsnLysGlyLeuAsnAspGlnLysThr-61
SEQ. ID. NO. 11654  73-AspAsnAlaGluGlyLysAsnLeu-80
SEQ. ID. NO. 11655  93-ValAspThrAspLysAlaAspLysIleThrAla-103
SEQ. ID. NO. 11656  112-AlaMetProGlnLysAlaGluLysLeuSerLys-122
SEQ. ID. NO. 11657  132-AlaProGluAspArgThrMetLeuArgAspThrGlyAspGlnIleGluMetAlaIle-150
SEQ. ID. NO. 11658  152-SerHisAsnAlaGlnLysGluProThrArgGluTrpAlaArg-165
758
AMPHI Regions - AMPHI
SEQ. ID. NO. 11659  15-AlaThrLeuAlaAspGluLeuGlnTyrVal-24
SEQ. ID. NO. 11660  53-AlaGluValAlaAla-57
SEQ. ID. NO. 11661  60-GlnThrValIleSerGluIleValArgArgHisThr-71
SEQ. ID. NO. 11662  87-ProTyrLeuGlyGlyLeuProGluAlaLeuHisThr-98
SEQ. ID. NO. 11663  125-PheAlaSerProGlyGlyTrpGlnIleIleGly-135
Antigenic Index - Jameson-Wolf
SEQ. ID. NO. 11664  9-ArgPheAspThrAspLeu-14
SEQ. ID. NO. 11665  32-AspHisGlnGlyLysLeuVal-38
SEQ. ID. NO. 11666  44-TyrGlyGlyGluTyrGlyProAspLeuAlaGlu-54
SEQ. ID. NO. 11667  66-IleValArgArgHisThrAla-72
SEQ. ID. NO. 11668  96-LeuHisThrProArgArgAlaValProArgThrSerValPro-109
SEQ. ID. NO. 11669  115-IleGlyGlySerGln-119
SEQ. ID. NO. 11670  145-AspLeuAsnProPro-149
SEQ. ID. NO. 11671  154-AlaGlyAspGlnValArgPheValAlaGluArgIleGluPro-167
Hydrophilic Regions - Hopp-Woods
SEQ. ID. NO. 11672  10-PheAspThrAspLeu-14
SEQ. ID. NO. 11673  32-AspHisGlnGlyLysLeuVal-38

TABLE 1-continued

| | |
|---|---|
| SEQ. ID. NO. 11674 | 48-TyrGlyProAspLeuAlaGlu-54 |
| SEQ. ID. NO. 11675 | 66-IleValArgArgHisThr-71 |
| SEQ. ID. NO. 11676 | 97-HisThrProArgArgAlaValPro-104 |
| SEQ. ID. NO. 11677 | 156-AspGlnValArgPheValAlaGluArgIleGluPro-167 |

759
AMPHI Regions - AMPHI

| | |
|---|---|
| SEQ. ID. NO. 11678 | 8-ProPheCysSerValLeuSerThrLeuGlyLeu-18 |
| SEQ. ID. NO. 11679 | 35-TyrGlnTyrPheArgAspPheAlaGlu-43 |
| SEQ. ID. NO. 11680 | 63-LysIleLeuGlyArgValLeuAsnGlyIlePro-73 |
| SEQ. ID. NO. 11681 | 94-TyrValAsnSerVal-98 |
| SEQ. ID. NO. 11682 | 140-ArgLeuAsnLysLeuValThrGluIle-148 |
| SEQ. ID. NO. 11683 | 185-ThrGlnGlnValArgLysAlaAsp-192 |
| SEQ. ID. NO. 11684 | 207-GlyGlyThrProLeu-211 |
| SEQ. ID. NO. 11685 | 261-LeuSerThrTyrAlaGlyPheAspAsnPhePheAsnLys-273 |
| SEQ. ID. NO. 11686 | 282-IleArgSerThrIle-286 |
| SEQ. ID. NO. 11687 | 313-ThrLeuGlnGlyLeu-317 |
| SEQ. ID. NO. 11688 | 408-LysGlyAspArgLeuSerLysLeuGlyAla-417 |
| SEQ. ID. NO. 11689 | 446-AlaSerAspGlySerLysGlnAla-453 |
| SEQ. ID. NO. 11690 | 548-ValTyrGluTyrIle-552 |
| SEQ. ID. NO. 11691 | 597-GluGlnValAlaGlnAlaGlu-603 |
| SEQ. ID. NO. 11692 | 764-LysThrProGluCysTyrArgSerTyrHisSer-774 |
| SEQ. ID. NO. 11693 | 788-GluAsnTyrArgAlaLeu-793 |
| SEQ. ID. NO. 11694 | 820-SerIleArgAlaGlyLys-825 |
| SEQ. ID. NO. 11695 | 878-ThrLeuAspGlyPheGlyThrPheArgPheLeuThrGlyIle-891 |
| SEQ. ID. NO. 11696 | 921-ProGlnThrThrGlu-925 |
| SEQ. ID. NO. 11697 | 948-TyrAlaAspLeuGlyAlaTyr-954 |
| SEQ. ID. NO. 11698 | 967-LeuTyrAsnProLeuLys-972 |
| SEQ. ID. NO. 11699 | 992-TyrAsnGlnLeuGlnAlaThrAspIleSerArgGlnValGln-1005 |
| SEQ. ID. NO. 11700 | 1013-GlnAlaLeuGlnAlaTrpGlnAsnSerGln-1022 |
| SEQ. ID. NO. 11701 | 1040-LysGlnThrAspProLeuThrGlyIleLeuThr-1050 |
| SEQ. ID. NO. 11702 | 1062-SerAlaAspIleCysArgGlnValAlaLysAlaAlaAspThr-1075 |
| SEQ. ID. NO. 11703 | 1084-GluLeuAspThrTyr-1088 |
| SEQ. ID. NO. 11704 | 1102-AlaArgGlnGlyGlyAspAlaGlnAlaValGluThrAlaArgHisAlaTyrLeuAsnAlaLeuAsnArgLeuSerArgGlnIleHisSerLeu-1132 |
| SEQ. ID. NO. 11705 | 1139-IleArgMetProAsnLeuAlaGluLeuIleSerArgSerAlaAsnThrAla-1155 |
| SEQ. ID. NO. 11706 | 1168-GlnAlaGlyArgArgIleAspArgHisLeuThrAspPro-1180 |
| SEQ. ID. NO. 11707 | 1199-GlyThrHisArgProTyrGlnGlnThrThrAsn-1209 |
| SEQ. ID. NO. 11708 | 1234-ThrAsnAsnArgPheAspGlu-1240 |
| SEQ. ID. NO. 11709 | 1328-GluIleAsnSerProAlaGlnIle-1335 |
| SEQ. ID. NO. 11710 | 1346-AspLysThrValGlu-1350 |
| SEQ. ID. NO. 11711 | 1385-GlnAlaAlaHisGlyThrLeu-1391 |

Antigenic Index - Jameson-Wolf

| | |
|---|---|
| SEQ. ID. NO. 11712 | 29-ValArgAsnAspValAspTyrGlnTyr-37 |
| SEQ. ID. NO. 11713 | 40-AspPheAlaGluAsnLysGlyAla-47 |
| SEQ. ID. NO. 11714 | 56-SerIleGlnAspLysGlnGlyLysIleLeu-65 |
| SEQ. ID. NO. 11715 | 73-ProMetProAspPheArgValSerAsnArgGlnThrAla-85 |
| SEQ. ID. NO. 11716 | 110-GlyAsnAspThrGlnAsnProGluGluGlnAlaTyr-121 |
| SEQ. ID. NO. 11717 | 125-LeuValSerArgAsnProHisProAspTyrAspTyrHisLeuProArgLeuAsnLysLeuValThr-146 |
| SEQ. ID. NO. 11718 | 148-IleSerProThrAla-152 |
| SEQ. ID. NO. 11719 | 160-GlyAsnGlyGlnProLysAla-166 |
| SEQ. ID. NO. 11720 | 168-AlaTyrLeuAspThrArgPhePro-176 |
| SEQ. ID. NO. 11721 | 181-LeuGlySerGlyThrGlnGlnValArgLysAlaAspGlyThrArgThrArgThrAlaPro-200 |
| SEQ. ID. NO. 11722 | 206-ThrGlyGlyThrProLeuLys-212 |
| SEQ. ID. NO. 11723 | 226-SerLeuThrAspGlnProLeuAsn-233 |
| SEQ. ID. NO. 11724 | 238-AlaGlyAspSerGlySerPro-244 |
| SEQ. ID. NO. 11725 | 249-AspLysHisGluAsnArg-254 |
| SEQ. ID. NO. 11726 | 285-ThrIleArgGlnTyrGluThrArgLeuAspVal-295 |
| SEQ. ID. NO. 11727 | 303-IleTrpArgAspAsnGlyAsnGlyAsnSerThr-313 |
| SEQ. ID. NO. 11728 | 316-GlyLeuAsnGluArgIleThr-322 |
| SEQ. ID. NO. 11729 | 327-AsnProSerLeuAlaProGlnAsnAspSerArgHisMetProSerGluAspAlaGlyLys-346 |
| SEQ. ID. NO. 11730 | 350-LeuSerSerArgPheAspAsnLysThr-358 |
| SEQ. ID. NO. 11731 | 364-AsnIleAsnGlnGlyAla-369 |
| SEQ. ID. NO. 11732 | 382-GlyLysAsnHisThr-386 |
| SEQ. ID. NO. 11733 | 394-ValAlaAspGlyLysArgValPhe-401 |
| SEQ. ID. NO. 11734 | 404-ValSerAsnProLysGlyAspArgLeuSerLysLeuGlyAla-417 |
| SEQ. ID. NO. 11735 | 424-GlyGlnGlyIleAsnGlnGlyAspIleSerIleGlyGluGlyThr-438 |
| SEQ. ID. NO. 11736 | 444-LysAlaAlaSerAspGlySerLysGlnAla-453 |
| SEQ. ID. NO. 11737 | 459-IleThrSerGlyArgGlyThr-465 |
| SEQ. ID. NO. 11738 | 469-AlaAspSerGlnGlnIleLysProGluAsn-478 |
| SEQ. ID. NO. 11739 | 483-PheArgGlyGlyArgLeuAspLeuAsnGlyAsnAsnLeu-495 |
| SEQ. ID. NO. 11740 | 501-ArgHisAlaAspGlyGlyAla-507 |
| SEQ. ID. NO. 11741 | 512-HisAsnProAspGlnAlaAla-518 |
| SEQ. ID. NO. 11742 | 528-LeuSerProGluHisValGlu-534 |
| SEQ. ID. NO. 11743 | 538-TrpGlyAsnArgProGlnGlyAsn-545 |
| SEQ. ID. NO. 11744 | 553-AsnProHisArgAsnArgArgThrAsp-561 |
| SEQ. ID. NO. 11745 | 566-LysProGlyGlyAsnProArgGlu-573 |
| SEQ. ID. NO. 11746 | 577-LeuAsnMetLysAsnSerThrSer-584 |
| SEQ. ID. NO. 11747 | 589-GlyAsnAsnArgGlnGlnAlaAlaGluGlnValAlaGlnAlaGluAsnAlaArgProAspLeu-609 |
| SEQ. ID. NO. 11748 | 614-GlyTyrLeuGlyGluAsnAlaGlnThrGlyLysAlaAlaProSerTyrSerLysThrAsnGluAlaAlaIleGluLysThrArgHis-642 |
| SEQ. ID. NO. 11749 | 650-GlyArgProGluTyrArgTyrAsnGly-658 |
| SEQ. ID. NO. 11750 | 664-TyrArgProLysArgThrAspSer-671 |

TABLE 1-continued

| | |
|---|---|
| SEQ. ID. NO. 11751 | 677-GlyGlyMetAsnLeuAsnGly-683 |
| SEQ. ID. NO. 11752 | 694-ValSerGlyArgProValProHisAlaTyrAspHisGlnAlaLysArgGluProValLeuGluAsnGluTrpThrAspGlySerPheLysAla-724 |
| SEQ. ID. NO. 11753 | 726-ArgPheThrLeuArgLeuAsnHisAla-733 |
| SEQ. ID. NO. 11754 | 736-ThrAlaGlyArgAsnThrAlaHisLeuAspGlyAspIleThr-749 |
| SEQ. ID. NO. 11755 | 761-ThrGlnGlyLysThrProGluCysTyrArgSerTyrHisSerGlySerThrHis-778 |
| SEQ. ID. NO. 11756 | 785-LeuLysAlaGluAsnTyrArg-791 |
| SEQ. ID. NO. 11757 | 796-ThrGlnValArgGlyAspIleThrLeuAsnAspArgSerGluLeuArgLeuGlyLys-814 |
| SEQ. ID. NO. 11758 | 820-SerIleArgAlaGlyLysAspThrAlaValArgMetGluAlaAspSerAsnTrpThr-838 |
| SEQ. ID. NO. 11759 | 840-SerGlnSerSerHisThrGly-846 |
| SEQ. ID. NO. 11760 | 859-ProAspPheAlaAsnAsnThrHisAsnAsnArgPheAsn-871 |
| SEQ. ID. NO. 11761 | 877-GlyThrLeuAspGly-881 |
| SEQ. ID. NO. 11762 | 891-IleValArgLysGlnAsnAlaProProLeuLysLeuGluGlyAspSerArgGlyAla-909 |
| SEQ. ID. NO. 11763 | 914-ValLysAsnThrGlyGlnGluProGlnThrThrGluSer-926 |
| SEQ. ID. NO. 11764 | 932-LeuAsnProLysHisSerHisGln-939 |
| SEQ. ID. NO. 11765 | 957-IleLeuArgLysAsnAsnAsnGlyTyr-965 |
| SEQ. ID. NO. 11766 | 969-AsnProLeuLysGluAlaGluLeuGlnIleGluAlaThrArgAlaGluHisGluArgAsnGlnGlnAla-991 |
| SEQ. ID. NO. 11767 | 999-AspIleSerArgGlnValGlnHisAspSerAspAlaThrArgGlnAla-1014 |
| SEQ. ID. NO. 11768 | 1018-TrpGlnAsnSerGlnThrGluLeuAlaArgIleAspSerGln-1031 |
| SEQ. ID. NO. 11769 | 1039-LeuLysGlnThrAspProLeuThr-1046 |
| SEQ. ID. NO. 11770 | 1064-AspIleCysArgGlnValAlaLysAlaAlaAspThrAsnAsp-1077 |
| SEQ. ID. NO. 11771 | 1083-ThrGluLeuAspThrTyrIleGluArgValGluMetAlaGluSerGluLeuAspLysAlaArgGlnGlyGlyAspAlaGlnAla-1110 |
| SEQ. ID. NO. 11772 | 1123-AsnArgLeuSerArg-1127 |
| SEQ. ID. NO. 11773 | 1147-LeuIleSerArgSerAlaAsnThrAlaValSerGlu-1158 |
| SEQ. ID. NO. 11774 | 1160-AlaAlaTyrAsnThrGlyArgGlnGlnAlaGlyArgArgIleAspArgHisLeuThrAspProGlnGlnGlnAsn-1184 |
| SEQ. ID. NO. 11775 | 1188-GluThrGlyThrGlnGlnThrAspTyrHisSerGlyThrHisArgProTyrGlnGlnThrThrAsn-1209 |
| SEQ. ID. NO. 11776 | 1219-IleThrAspArgLeuSer-1224 |
| SEQ. ID. NO. 11777 | 1229-LeuThrAspGluArgThrAsnAsnArgPheAspGluGlyValSerAlaArgAsnArgSerAsnGly-1250 |
| SEQ. ID. NO. 11778 | 1255-ValLysGlyGluAsnGlyAla-1261 |
| SEQ. ID. NO. 11779 | 1269-GlyTyrSerAsnSerArgThrArgPheThrAspTyrAspGlyAlaAlaValArg-1286 |
| SEQ. ID. NO. 11780 | 1288-HisAlaTrpAspAlaGlyIleAsnThrGlyIleLeuLysIleAspThrGlyIle-1304 |
| SEQ. ID. NO. 11781 | 1313-ArgIleAsnArgSerAsnGlyAsnArgTyrVal-1323 |
| SEQ. ID. NO. 11782 | 1326-GlyAlaGluIleAsnSerProAlaGlnIleGln-1336 |
| SEQ. ID. NO. 11783 | 1343-IleArgLeuAspLysThrValGlu-1350 |
| SEQ. ID. NO. 11784 | 1360-PheSerSerAspTyrTyrHisThrArgGlnAsnSerGlySerAla-1374 |
| SEQ. ID. NO. 11785 | 1376-SerValAsnAspArgThrLeu-1382 |
| SEQ. ID. NO. 11786 | 1398-AlaGlyTyrLysGlyTrpAsn-1404 |
| SEQ. ID. NO. 11787 | 1411-TyrGlyLysAspSerAsnThrAlaArgHisLysGlnAlaGly-1424 |
| Hydrophilic Regions - Hopp-Woods | |
| SEQ. ID. NO. 11788 | 29-ValArgAsnAspValAsp-34 |
| SEQ. ID. NO. 11789 | 40-AspPheAlaGluAsnLysGly-46 |
| SEQ. ID. NO. 11790 | 56-SerIleGlnAspLysGlnGlyLysIleLeu-65 |
| SEQ. ID. NO. 11791 | 75-ProAspPheArgValSerAsnArgGlnThr-84 |
| SEQ. ID. NO. 11792 | 111-AsnAspThrGlnAsnProGluGluGlnAlaTyr-121 |
| SEQ. ID. NO. 11793 | 129-AsnProHisProAspTyr-134 |
| SEQ. ID. NO. 11794 | 140-ArgLeuAsnLysLeuValThr-146 |
| SEQ. ID. NO. 11795 | 162-GlyGlnProLysAla-166 |
| SEQ. ID. NO. 11796 | 170-LeuAspThrAspArg-174 |
| SEQ. ID. NO. 11797 | 186-GlnGlnValArgLysAlaAspGlyThrArgThrArgThr-198 |
| SEQ. ID. NO. 11798 | 249-AspLysHisGluAsn-253 |
| SEQ. ID. NO. 11799 | 285-ThrIleArgGlnTyrGluThrArgLeuAspVal-295 |
| SEQ. ID. NO. 11800 | 306-AspAsnGlyAsnGly-310 |
| SEQ. ID. NO. 11801 | 317-LeuAsnGluArgIleThr-322 |
| SEQ. ID. NO. 11802 | 332-ProGlnAsnAspSerArgHisMetProSerGluAspAlaGlyLys-346 |
| SEQ. ID. NO. 11803 | 352-SerArgPheAspAsnLysThr-358 |
| SEQ. ID. NO. 11804 | 395-AlaAspGlyLysArg-399 |
| SEQ. ID. NO. 11805 | 406-AsnProLysGlyAspArgLeuSerLys-414 |
| SEQ. ID. NO. 11806 | 444-LysAlaAlaSerAspGlySerLysGlnAla-453 |
| SEQ. ID. NO. 11807 | 472-GlnGlnIleLysProGlu-477 |
| SEQ. ID. NO. 11808 | 484-ArgGlyGlyArgLeuAspLeuAsnGly-492 |
| SEQ. ID. NO. 11809 | 501-ArgHisAlaAspGlyGly-506 |
| SEQ. ID. NO. 11810 | 555-HisArgAsnArgArgThrAsp-561 |
| SEQ. ID. NO. 11811 | 568-GlyGlyAsnProArgGlu-573 |
| SEQ. ID. NO. 11812 | 591-AsnArgGlnGlnAlaAlaGluGlnValAlaGlnAlaGluAsnAlaArgProAsp-608 |
| SEQ. ID. NO. 11813 | 619-AsnAlaGlnThrGlyLysAlaAlaProSerTyrSerLysThrAsnGluAlaAlaIleGluLysThrArgHis-642 |
| SEQ. ID. NO. 11814 | 652-ProGluTyrArgTyr-656 |
| SEQ. ID. NO. 11815 | 664-TyrArgProLysArgThrAspSer-671 |
| SEQ. ID. NO. 11816 | 705-HisGlnAlaLysArgGluProValLeu-713 |
| SEQ. ID. NO. 11817 | 736-ThrAlaGlyArgAsn-740 |
| SEQ. ID. NO. 11818 | 744-LeuAspGlyAspIleThr-749 |
| SEQ. ID. NO. 11819 | 764-LysThrProGluCysTyrArg-770 |
| SEQ. ID. NO. 11820 | 785-LeuLysAlaGluAsnTyrArg-791 |
| SEQ. ID. NO. 11821 | 797-GlnValArgGlyAspIleThrLeuAsnAspArgSerGluLeuArgLeuGlyLys-814 |
| SEQ. ID. NO. 11822 | 822-ArgAlaGlyLysAspThrAlaValArgMetGluAlaAspSer-835 |
| SEQ. ID. NO. 11823 | 891-IleValArgLysGlnAsnAlaPro-898 |
| SEQ. ID. NO. 11824 | 900-LeuLysLeuGluGlyAspSerArgGly-908 |
| SEQ. ID. NO. 11825 | 916-AsnThrGlyGlnGluProGlnThrThrGlu-925 |
| SEQ. ID. NO. 11826 | 934-ProLysHisSerHis-938 |
| SEQ. ID. NO. 11827 | 957-IleLeuArgLysAsnAsnAsn-963 |
| SEQ. ID. NO. 11828 | 970-ProLeuLysGluAlaGluLeuGlnIleGluAlaThrArgAlaGluHisGluArgAsnGlnGln-990 |
| SEQ. ID. NO. 11829 | 1004-ValGlnHisAspSerAspAlaThrArgGlnAla-1014 |

TABLE 1-continued

| SEQ. ID. NO. 11830 | 1021-SerGlnThrGluLeuAlaArgIleAspSer-1030 |
| SEQ. ID. NO. 11831 | 1039-LeuLysGlnThrAspPro-1044 |
| SEQ. ID. NO. 11832 | 1064-AspIleCysArgGlnValAlaLysAlaAlaAspThrAsnAsp-1077 |
| SEQ. ID. NO. 11833 | 1087-ThrTyrIleGluArgValGluMetAlaGluSerGluLeuAspLysAlaArgGlnGlyGlyAspAlaGlnAla-1110 |
| SEQ. ID. NO. 11834 | 1164-ThrGlyArgGlnGlnAlaGlyArgArgIleAspArgHisLeuThrAspProGlnGln-1182 |
| SEQ. ID. NO. 11835 | 1200-ThrHisArgProTyrGln-1205 |
| SEQ. ID. NO. 11836 | 1219-IleThrAspArgLeuSer-1224 |
| SEQ. ID. NO. 11837 | 1229-LeuThrAspGluArgThrAsnAsnArgPheAspGluGlyValSerAlaArgAsnArgSerAsnGly-1250 |
| SEQ. ID. NO. 11838 | 1272-AsnSerArgThrArgPheThrAspTyrAspGlyAlaAlaValArg-1286 |
| SEQ. ID. NO. 11839 | 1298-IleLysIleAspThr-1302 |
| SEQ. ID. NO. 11840 | 1313-ArgIleAsnArgSerAsnGly-1319 |
| SEQ. ID. NO. 11841 | 1326-GlyAlaGluIleAsnSer-1331 |
| SEQ. ID. NO. 11842 | 1343-IleArgLeuAspLysThrValGlu-1350 |
| SEQ. ID. NO. 11843 | 1376-SerValAsnAspArgThrLeu-1382 |
| SEQ. ID. NO. 11844 | 1411-TyrGlyLysAspSerAsnThrAlaArgHisLysGlnAlaGly-1424 |

760
AMPHIRegions - AMPHI

| SEQ. ID. NO. 11845 | 16-ThrValLeuAlaAlaLeuSerSer-23 |
| SEQ. ID. NO. 11846 | 29-GlnThrGluGlyLeu-33 |
| SEQ. ID. NO. 11847 | 40-GlyGlnArgSerTyr-44 |
| SEQ. ID. NO. 11848 | 58-PheAlaAlaThrValGlyThrLys-65 |
| SEQ. ID. NO. 11849 | 67-ProAlaSerLeuArgGluIleProGlnSerVal-77 |
| SEQ. ID. NO. 11850 | 88-ArgAsnValAspThrPheAspGlnLeuAlaArg-98 |
| SEQ. ID. NO. 11851 | 131-ProAlaGlnMetGlnSerIleAsnGlyThrLeuProAsnLeuPheAlaPheAspArgValGluValMetArgGlyProSerGlyLeuPheAspSerSerGlyGluMetGlyGlyIleValAsnLeuValArgLysArgProThrLysAlaPheGlnGlyHisAlaAlaAla-187 |
| SEQ. ID. NO. 11852 | 190-GlyThrHisLysGln-194 |
| SEQ. ID. NO. 11853 | 277-SerLeuProGlnHis-281 |
| SEQ. ID. NO. 11854 | 296-HisAspValPheAlaAspLeuLysHis-304 |
| SEQ. ID. NO. 11855 | 334-LeuAsnAsnThrGlyGlnAla-340 |
| SEQ. ID. NO. 11856 | 381-ArgLeuArgSerThr |
| SEQ. ID. NO. 11857 | 385AsnGluGlnGlyArgSerThr-392 |
| SEQ. ID. NO. 11858 | 398-AlaLeuAspGlyPheArgAlaLeuPro-406 |
| SEQ. ID. NO. 11859 | 419-LysGlyPheAsnHisSer-424 |
| SEQ. ID. NO. 11860 | 438-LysThrValPheArgProLeuGlyLeuSerLeuIleAlaGly-452 |
| SEQ. ID. NO. 11861 | 465-GlyLysThrLeuHisLysAlaSerLys-473 |
| SEQ. ID. NO. 11862 | 515-ProArgGluGlyAsnGln-520 |
| SEQ. ID. NO. 11863 | 565-GlyLysArgValMetGluGlyValGlu-573 |
| SEQ. ID. NO. 11864 | 617-AlaAsnLeuTrpThrThrTyr-623 |
| SEQ. ID. NO. 11865 | 635-ValAsnAlaMetSerGlyIleThrSerSer-644 |
| SEQ. ID. NO. 11866 | 650-GlyGlyTyrAlaThrPheAspAlaMetAlaAla-660 |

Antigenic Index - Jameson-Wolf

| SEQ. ID. NO. 11867 | 29-GlnThrGluGlyLeuGlu-34 |
| SEQ. ID. NO. 11868 | 37-HisIleLysGlyGlnArgSerTyrAsn-45 |
| SEQ. ID. NO. 11869 | 48-AlaThrGluLysAsnGlyAspTyrSerSer-57 |
| SEQ. ID. NO. 11870 | 68-AlaSerLeuArgGluIleProGln-75 |
| SEQ. ID. NO. 11871 | 83-GlnGlnValLysAspArgAsnValAspThrPheAspGlnLeuAlaArgLysThrProGlyLeuArgValLeuSerAsnAspAspGlyArgSer-113 |
| SEQ. ID. NO. 11872 | 118-ArgGlyTyrGluTyrSerGluTyrAsnIleAspGlyLeu-130 |
| SEQ. ID. NO. 11873 | 148-AspArgValGluValMetArgGlyProSerGlyLeuPheAspSerSerGlyGluMetGlyGly-168 |
| SEQ. ID. NO. 11874 | 173-ValArgLysArgProThrLysAlaPhe-181 |
| SEQ. ID. NO. 11875 | 190-GlyThrHisLysGlnTyrLysAlaGluAlaAspValSerGlySerLeuAsnSerAspGlySerValArgGlyArgVal-215 |
| SEQ. ID. NO. 11876 | 221-GlyAlaSerProArgProAlaGluLysAsnAsnArgArgGluThr-235 |
| SEQ. ID. NO. 11877 | 242-TrpAspIleAsnProAspThrValLeu-250 |
| SEQ. ID. NO. 11878 | 257-GlnGlnArgArgLeuAlaProTyrAsn-265 |
| SEQ. ID. NO. 11879 | 268-ProAlaAspAlaAsnAsnLysLeuProSerLeu-278 |
| SEQ. ID. NO. 11880 | 306-PheGlyAsnGlyGlyTyrGly-312 |
| SEQ. ID. NO. 11881 | 314-ValGlyMetArgTyrSerAspArgLysAlaAspSerAsnTyr-327 |
| SEQ. ID. NO. 11882 | 330-AlaGlySerLysLeuAsnAsnThrGlyGlnAlaAsp-341 |
| SEQ. ID. NO. 11883 | 346-GlyThrAspIleLysGlnLysAlaPheAlaValAspAlaSerTyrSerArgProPhe-364 |
| SEQ. ID. NO. 11884 | 378-AspTyrAsnArgLeuArgSerThrAsnGluGlnGlyArgSerThrLeuSerLysSerValAla-398 |
| SEQ. ID. NO. 11885 | 413-AsnAlaArgAlaGlyAsnLysGlyPheAsn-422 |
| SEQ. ID. NO. 11886 | 424-SerValThrGluGluAsnLeuAspGluThrGlyLeu-435 |
| SEQ. ID. NO. 11887 | 451-AlaGlyGlyArgValGlyHisHisLysIleGluSerGlyAspGlyLysThrLeuHisLysAlaSerLysThrLysPhe-476 |
| SEQ. ID. NO. 11888 | 485-AspIleAspGlySerAsnSerLeu-492 |
| SEQ. ID. NO. 11889 | 501-ThrProGlnThrSerIleGlyThrAspGlyLysLeuLeuLysProArgGluGlyAsnGln-520 |
| SEQ. ID. NO. 11890 | 524-GlyTyrLysGlySerTyrMetAspAspArgLeuAsnThr-536 |
| SEQ. ID. NO. 11891 | 542-ArgMetLysAspLysAsnAla-548 |
| SEQ. ID. NO. 11892 | 551-ProLeuAspSerAsnAsnLysLysThrArgTyr-561 |
| SEQ. ID. NO. 11893 | 563-AlaLeuGlyLlGluThrGluIle-576 |
| SEQ. ID. NO. 11894 | 596-GlnIleLysThrAlaSerAsnSerArgAspGluGlyIle-608 |
| SEQ. ID. NO. 11895 | 614-LysHisSerAlaAsnLeu-619 |
| SEQ. ID. NO. 11896 | 663-PheThrProLysLeuLysLeu-669 |
| SEQ. ID. NO. 11897 | 671-IleAsnAlaAspAsnIlePhe-677 |
| SEQ. ID. NO. 11898 | 685-ValGlySerGluSerThrPheAsnIleProGlySerGluArgSerLeu-700 |

Hydrophilic Regions - Hopp-Woods

| SEQ. ID. NO. 11899 | 39-LysGlyGlnArgSer-43 |
| SEQ. ID. NO. 11900 | 48-AlaThrGluLysAsnGlyAsp-54 |
| SEQ. ID. NO. 11901 | 68-AlaSerLeuArgGluIleProGln-75 |
| SEQ. ID. NO. 11902 | 84-GlnValLysAspArgAsnValAspThr-92 |
| SEQ. ID. NO. 11903 | 94-AspGlnLeuAlaArgLysThrProGly-102 |
| SEQ. ID. NO. 11904 | 106-LeuSerAsnAspAspGlyArgSer-113 |

| | |
|---|---|
| SEQ. ID. NO. 11905 | 148-AspArgValGluValMetArgGlyPro-156 |
| SEQ. ID. NO. 11906 | 162-SerSerGlyGluMet-166 |
| SEQ. ID. NO. 11907 | 173-ValArgLysArgProThrLys-179 |
| SEQ. ID. NO. 11908 | 193-LysGlnTyrLysAlaGluAlaAspVal-201 |
| SEQ. ID. NO. 11909 | 205-LeuAsnSerAspGlySerValArgGlyArgVal-215 |
| SEQ. ID. NO. 11910 | 222-AlaSerProArgProAlaGluLysAsnAsnArgArgGluThr-235 |
| SEQ. ID. NO. 11911 | 242-TrpAspIleAsnPro-246 |
| SEQ. ID. NO. 11912 | 257-GlnGlnArgArgLeuAla-262 |
| SEQ. ID. NO. 11913 | 268-ProAlaAspAlaAsnAsnLysLeu-275 |
| SEQ. ID. NO. 11914 | 314-ValGlyMetArgTyrSerAspArgLysAlaAspSer-325 |
| SEQ. ID. NO. 11915 | 247-ThrAspIleLysGlnLysAlaPheAla-355 |
| SEQ. ID. NO. 11916 | 378-AspTyrAsnArgLeuArgSerThrAsnGluGlnGlyArgSerThrLeuSer-394 |
| SEQ. ID. NO. 11917 | 414-AlaArgAlaGlyAsnLysGlyPhe-421 |
| SEQ. ID. NO. 11918 | 425-ValThrGluGluAsnLeuAspGlu-432 |
| SEQ. ID. NO. 11919 | 454-ArgValGlyHisHisLysIleGluSerGlyAspGlyLysThrLeuHisLysAlaSerLysThrLysPhe-476 |
| SEQ. ID. NO. 11920 | 506-IleGlyThrAspGlyLysLeuLeuLysProArgGluGlyAsnGln-520 |
| SEQ. ID. NO. 11921 | 528-SerTyrMetAspAspArgLeuAsnThr-536 |
| SEQ. ID. NO. 11922 | 542-ArgMetLysAspLysAsnAla-548 |
| SEQ. ID. NO. 11923 | 551-ProLeuAspSerAsnAsnLysLysThrArgTyr-561 |
| SEQ. ID. NO. 11924 | 563-AlaLeuGlyLysArgValMetGluGlyValGluThrGluIle-576 |
| SEQ. ID. NO. 11925 | 597-IleLysThrAlaSerAsnSerArgAspGluGly-607 |
| SEQ. ID. NO. 11926 | 695-GlySerGluArgSerLeu-700 |
| 761 | |
| AMPHI Regions - AMPHI | |
| SEQ. ID. NO. 11927 | 51-LysGlyTyrIleAsn-55 |
| SEQ. ID. NO. 11928 | 70-GluThrProGlnThrIleAspThrLeuAsnIle-80 |
| SEQ. ID. NO. 11929 | 89-AsnAspLeuSerSerIleLeuGlu-96 |
| SEQ. ID. NO. 11930 | 125-TyrArgAspGlyValArg-130 |
| SEQ. ID. NO. 11931 | 137-ArgSerThrAlaAsn-141 |
| SEQ. ID. NO. 11932 | 143-GluArgValGluIleLeuLysGlyProSer-152 |
| SEQ. ID. NO. 11933 | 164-ValIleAsnMetValSerLysTyrAlaAsnPheLysGlnSerArgAsnIleGlyAlaValTyrGlySerTrpAla-188 |
| SEQ. ID. NO. 11934 | 249-TyrAspAsnValGluArgThrProAspArgSerProThrLysSerVal-264 |
| SEQ. ID. NO. 11935 | 316-AspPheAspHisPheTyrAla-322 |
| SEQ. ID. NO. 11936 | 388-IleAsnProTyrAspArg-393 |
| SEQ. ID. NO. 11937 | 452-SerSerArgGlnTyr-456 |
| SEQ. ID. NO. 11938 | 475-HisThrLeuTyrAlaSerTyrAsnLysGlyPhe-485 |
| SEQ. ID. NO. 11939 | 511-TyrThrArgGlnTyrGlu-516 |
| SEQ. ID. NO. 11940 | 526-AspArgLeuSerThrThr-531 |
| SEQ. ID. NO. 11941 | 568-LeuSerAlaIleGlyGlnIleIle-575 |
| SEQ. ID. NO. 11942 | 608-AsnThrSerAsnVal-612 |
| SEQ. ID. NO. 11943 | 651-LeuProGlyPheAlaArgValAspAlaMet-660 |
| Antigenic Index - Jameson-Wolf | |
| SEQ. ID. NO. 11944 | 23-AlaAspThrGlnAspAsnGlyGluHis-31 |
| SEQ. ID. NO. 11945 | 43-GlyGlnSerAspThrSerValLeu-50 |
| SEQ. ID. NO. 11946 | 54-IleAsnTyrAspGluAlaAlaValThrArgAsnGlyGlnLeuIleLysGluThrProGlnThrIle-75 |
| SEQ. ID. NO. 11947 | 79-AsnIleGlnLysAsnLysAsnTyrGlyThrAsnAsp-90 |
| SEQ. ID. NO. 11948 | 97-GlyAsnAlaGlyIle-101 |
| SEQ. ID. NO. 11949 | 103-AlaAlaTyrAspMetArgGlyGluSerIlePhe-113 |
| SEQ. ID. NO. 11950 | 117-PheGlnAlaAspAlaSerAspIleTyrArgAspGlyValArgGluSerGlyGlnValArgArgSerThrAlaAsnIleGluArgValGluIleLeuLysGlyProSerSer-153 |
| SEQ. ID. NO. 11951 | 157-GlyArgThrAsnGlyGlyGly-163 |
| SEQ. ID. NO. 11952 | 172-AlaAsnPheLysGlnSerArgAsnIleGly-181 |
| SEQ. ID. NO. 11953 | 187-TrpAlaAsnArgSerLeuAsnMetAspIle-196 |
| SEQ. ID. NO. 11954 | 198-GluValLeuAsnLysAsnValAlaIle-206 |
| SEQ. ID. NO. 11955 | 208-LeuThrGlyGluValGlyArgAlaAsnSerPheArgSerGlyIleAspSerLysAsnVal-227 |
| SEQ. ID. NO. 11956 | 235-ValLysLeuAspAsnGlyLeuLysTrpThrGlyGlnTyrThrTyrAspAsnValGluArgThrProAspArgSerProThrLysSerValTyrAspArgPheGlyLeuProTyr-272 |
| SEQ. ID. NO. 11957 | 276-PheAlaHisArgAsnAspPheValLysAspLysLeuGln-288 |
| SEQ. ID. NO. 11958 | 290-TrpArgSerAspLeuGluTyrAlaPheAsnAspLysTrpArgAlaGlnTrp-306 |
| SEQ. ID. NO. 11959 | 312-ThrAlaAlaGlnAspPhe-317 |
| SEQ. ID. NO. 11960 | 322-AlaGlySerGluAsnGlyAsnLeuIleLysArgAsnTyrAlaTrpGlnGlnThrAspAsnLysThrLeuSer-345 |
| SEQ. ID. NO. 11961 | 366-GlyMetAspTyrSerArgGluHisArgAsnProThrLeu-378 |
| SEQ. ID. NO. 11962 | 389-AsnProTyrAspArgAlaSerTrpProAlaSerGlyArgLeuGlnPro-404 |
| SEQ. ID. NO. 11963 | 407-ThrGlnAsnArgHisLysAlaAspSer-415 |
| SEQ. ID. NO. 11964 | 425-SerAlaThrProAspLeuLysPheValLeuGlyGlyArgTyrAspLysTyrThrPheAsnSerGluAsnLysLeuThrGlySerSerArgGlnTyrSerGlyHisSerPheSerProAsn-464 |
| SEQ. ID. NO. 11965 | 481-TyrAsnLysGlyPheAlaProTyrGlyGlyArgGlyGly-493 |
| SEQ. ID. NO. 11966 | 506-AsnAlaAspProGluTyrThrArgGlnTyrGluThrGlyValLysSerSerTrpLeuAspAspArgLeuSerThr-530 |
| SEQ. ID. NO. 11967 | 539-ArgPheAsnIleArgTyrArgProAspProLysAsnAsnPro-552 |
| SEQ. ID. NO. 11968 | 557-ValSerGlyLysHisArgSerArgGlyValGlu-567 |
| SEQ. ID. NO. 11969 | 575-IleProLysLysLeuTyrLeu-581 |
| SEQ. ID. NO. 11970 | 591-LysValValGluAspLysGluAsnProAspArgValGly-603 |
| SEQ. ID. NO. 11971 | 607-AsnAsnThrSerAsnVal-612 |
| SEQ. ID. NO. 11972 | 619-ArgTyrThrProThrGluAsnLeuTyr-627 |
| SEQ. ID. NO. 11973 | 634-GlyThrGlyLysArgTyrGlyTyrAsnSerArgAsnLysGluValThrThr-650 |
| SEQ. ID. NO. 11974 | 663-TrpAsnHisLysAsn-667 |
| SEQ. ID. NO. 11975 | 678-LeuAsnGlnLysTyrTrpArgSerAspSerMetProGlyAsnProArgGlyTyrThrAla-697 |
| Hydrophilic Regions - Hopp-Woods | |
| SEQ. ID. NO. 11976 | 24-AspThrGlnAspAsnGlyGlu-30 |
| SEQ. ID. NO. 11977 | 43-GlyGlnSerAspThrSerVal-49 |

TABLE 1-continued

| | |
|---|---|
| SEQ. ID. NO. 11978 | 57-AspGluAlaAlaValThrArg-63 |
| SEQ. ID. NO. 11979 | 66-GlnLeuIleLysGluThrProGlnThr-74 |
| SEQ. ID. NO. 11980 | 81-GlnLysAsnLysAsnTyrGly-87 |
| SEQ. ID. NO. 11981 | 105-TyrAspMetArgGlyGluSerIlePhe-113 |
| SEQ. ID. NO. 11982 | 117-PheGlnAlaAspAlaSerAspIleTyrArgAspGlyValArgGluSerGlyGlnValArgArgSerThrAlaAsnIleGluArgValGluIleLeuLys glyProSer-152 |
| SEQ. ID. NO. 11983 | 175-LysGlnSerArgAsn-179 |
| SEQ. ID. NO. 11984 | 208-LeuThrGlyGluValGlyArg-214 |
| SEQ. ID. NO. 11985 | 220-SerGlyIleAspSerLysAsn-226 |
| SEQ. ID. NO. 11986 | 235-ValLysLeuAspAsn-239 |
| SEQ. ID. NO. 11987 | 251-AsnValGluArgThrProAspArgSerProThr-261 |
| SEQ. ID. NO. 11988 | 278-HisArgAsnAspPheValLysAspLysLeuGln-288 |
| SEQ. ID. NO. 11989 | 312-ThrAlaAlaGlnAspPhe-317 |
| SEQ. ID. NO. 11990 | 324-SerGluAsnGlyAsnLeuIleLys-331 |
| SEQ. ID. NO. 11991 | 339-ThrAspAsnLysThrLeu-344 |
| SEQ. ID. NO. 11992 | 368-AspTyrSerArgGluHisArgAsnPro-376 |
| SEQ. ID. NO. 11993 | 390-ProTyrAspArgAlaSer-395 |
| SEQ. ID. NO. 11994 | 409-AsnArgHisLysAlaAspSer-415 |
| SEQ. ID. NO. 11995 | 436-GlyArgTyrAspLys-440 |
| SEQ. ID. NO. 11996 | 445-SerGluAsnLysLeuThrGlySerSerArgGlnTyrSer-457 |
| SEQ. ID. NO. 11997 | 507-AlaAspProGluTyrThrArgGlnTyrGluThrGlyVal-519 |
| SEQ. ID. NO. 11998 | 523-TrpLeuAspArgLeuSer-529 |
| SEQ. ID. NO. 11999 | 544-TyrArgProAspProLysAsn-550 |
| SEQ. ID. NO. 12000 | 559-GlyLysHisArgSerArgGlyValGlu-567 |
| SEQ. ID. NO. 12001 | 591-LysValValGluAspLysGluAsnProAspArgValGly-603 |
| SEQ. ID. NO. 12002 | 634-GlyThrGlyLysArgTyrGlyTyr-641 |
| SEQ. ID. NO. 12003 | 643-SerArgAsnLysGluValThr-649 |
| SEQ. ID. NO. 12004 | 686-AspSerMetProGlyAsnProArgGlyTyrThr-696 |

762
AMPHI Regions - AMPHI
SEQ. ID. NO. 12005   1-MetLysTrpLeuLeuAsnMetIleMetArgProIleLysPheSerMetValAsnThrLeuLeuPheIleValIleCysSerSerPhePheAspLeuLeuVal
GlnLeuCysThrIleLeuPheHisSerGlnLysIleTyrPheIleThrLeuPheLeuLeuPheIlePheAsnPheValThrLysSerIleTyrMetAlaIleIle
TyrProIleLeuTyrPhePheThrIleLysLysTyrTyrProTyrSerArgLysValIleIleLeuLeuSerLeuAlaLeuSerIleTyrPheSerPheMetAsp
PheTyrPhePheSerIleTyrSerAspAsnLeuSerTyrGluThrGluProLeuHisLeuTyrIleProIleIleIleAsnPhePheSerLeuLeuValSerAsn
PheIleLeuSerPheIleAsnLys-147
Antigenic Index - Jameson-Wolf (SEQ. ID. NO. 12005)
1-MetLysTrpLeuLeuAsnMetIleMetArgProIleLysPheSerMetValAsnThrLeuLeuPheIleVal
IleCysSerSerPhePheAspLeuLeuValGlnLeuCysThrIleLeuPheHisSerGlnLysIleTyrPheIleThr
LeuPheLeuLeuPheIlePheAsnPheValThrLysSerIleTyrMetAlaIleIleTyrProIleLeuTyrPhe
PheThrIleLysLysTyrTyrProTyrSerArgLysValIleIleLeuLeuSerLeuAlaLeuSerIleTyrPhe
SerPheMetAspPheTyrPhePheSerIleTyrSerAspAsnLeuSerTyrGluThrGluProLeuHisLeuTyrIle
ProIleIleIleAsnPhePheSerLeuLeuValSerAsnPheIleLeuSerPheIleAsnLys-147
Hydrophilic Regions - Hopp-Woods (SEQ. ID. NO. 12005)
1-MetLysTrpLeuLeuAsnMetIleMetArgProIleLysPheSerMetValAsnThrLeuLeuPheIleVal
IleCysSerSerPhePheAspLeuLeuValGlnLeuCysThrIleLeuPheHisSerGlnLysIleTyrPheIleThr
LeuPheLeuLeuPheIlePheAsnPheValThrLysSerIleTyrMetAlaIleIleTyrProIleLeuTyrPhe
PheThrIleLysLysTyrTyrProTyrSerArgLysValIleIleLeuLeuSerLeuAlaLeuSerIleTyrPhe
SerPheMetAspPheTyrPhePheSerIleTyrSerAspAsnLeuSerTyrGluThrGluProLeuHisLeuTyrIle
ProIleIleIleAsnPhePheSerLeuLeuValSerAsnPheIleLeuSerPheIleAsnLys-147
763
AMPHI Regions - AMPHI
SEQ. ID. NO. 12006   1-MetThrLeuLeuAsnLeuMetIleMetGlnAspTyrGlyIleSerValCysLeuThrLeuThrProTyrLeuGlnHisGluLeuPheSerAlaMetLysSer
TyrPheSerLysTyrIleLeuProValSerLeuPheThrLeuProLeuSerLeuSerProSerValSerAlaPheThrLeuProGluAlaTrpArgAlaAlaGln
GlnHisSerAlaAspPheGlnAlaSerHisTyrGlnArgAspAlaValArgAlaArgGlnGlnGlnAlaLysAlaAlaPheLeuProHisValSerAlaAsnAla
SerTyrGlnArgGlnProProSerIleSerSerThrArgGluThrGlnGlyTrpSerValGlnValGlyGlnThrLeuPheAspAlaAlaLysPheAlaGlnTyr
ArgGlnSerArgPheAspThrGlnAlaAlaGluGlnArgPheAspAlaAlaArgGluGluLeuLeuLeuLysValAlaGluSerTyrPheAsnValLeuLeuSer
ArgAspThrValAlaAlaHisAlaAlaGluLysGluAlaTyrAlaGlnGlnValArgGlnAlaGlnAlaLeuPheAsnLysGlyAlaAlaThrAlaLeuAspIle
HisGluAlaLysAlaGlyTyrAspAsnAlaLeuAlaGlnGluIleAlaValAlaLysAlaGlyLysGlnThrTyrGluAsnGlnLeuAsnAspTyrThrAspLeuAsp
SerLysGlnIleGluAlaIleAspThrAlaAsnLeuLeuAlaArgTyrLeuProLysLeuGluArgTyrSerLeuAspGluTrpGlnArgIleAlaLeuSerAsn
AsnHisGluTyrArgMetGlnGlnLeuAlaLeuGlnSerSerGlyGlnAlaLeuArgAlaAlaGlnAsnSerArgTyrProThrValSerAlaHisValGlyTyr
GlnAsnAsnLeuTyrThrSerSerAlaGlnAsnAsnAspTyrHisTyrArgGlyLysGlyMetSerValGlyValGlnLeuAsnLeuProLeuTyrThrGlyGly
GluLeuSerGlyLysIleHisGluAlaGluAlaAlaGlnTyrGlyAlaAlaAlaGluAlaGlnLeuThrAlaThrGluArgHisIleLysLeuAlaValArgGlnAlaTyr
ThrGluSerGlyAlaAlaArgTyrGlnIleMetAlaGlnGluArgValLeuGluSerSerArgLeuLysLeuLysSerThrGluThrGlyGlnGlnTyrGlyIle
ArgAsnArgLeuGlnValIleArgAlaArgGlnGluValAlaGlnAlaGluGlnLysLeuAlaGlnAlaArgTyrLysPheMetLeuAlaTyrLeuArgLeuVal
LysGluSerGlyLeuGlyLeuGluThrValPheAlaGlu-467
Antigenic Index - Jameson-Wolf (SEQ. NO. ID. 12006)
1-MetThrLeuLeuAsnLeuMetIleMetGlnAspTyrGlyIleSerValCysLeuThrLeuThrProTyrLeuGln
nHisGluLeuPheSerAlaMetLysSerTyrPheSerLysTyrIleLeuProValSerLeuPheThrLeuProLeu
SerLeuSerProSerValSerAlaPheThrLeuProGluAlaTrpArgAlaAlaGlnGlnHisSerAlaAspPhe
GlnAlaSerHisTyrGlnArgAspAlaValArgAlaArgGlnGlnGlnAlaLysAlaAlaPheLeuProHisValSer
AlaAsnAlaSerTyrGlnArgGlnProProSerIleSerSerThrArgGluThrGlnGlyTrpSerValGlnVal
GlyGlnThrLeuPheAspAlaAlaLysPheAlaGlnTyrArgGlnSerArgPheAspThrGlnAlaAlaGluGln
ArgPheAspAlaAlaArgGluGluLeuLeuLeuLysValAlaGluSerTyrPheAsnValLeuLeuSerArgAspThr
ValAlaAlaHisAlaAlaGluLysGluAlaTyrAlaGlnGlnValArgGlnAlaGlnAlaLeuPheAsnLysGly
AlaAlaThrAlaLeuAspIleHisGluAlaLysAlaGlyTyrAspAsnAlaLeuAlaGlnGluIleAlaValAlaLeu
AlaGluLysGlnThrTyrGluAsnGlnLeuAsnAspTyrThrAspLeuAspSerLysGlnIleGluAlaIleAspThr
AlaAsnLeuLeuAlaArgTyrLeuProLysLeuGluArgTyrSerLeuAspGluTrpGlnArgIleAlaLeuSer
AsnAsnHisGluTyrArgMetGlnGlnLeuAlaLeuGlnSerSerGlyGlnAlaLeuArgAlaAlaGlnAsnSer
ArgTyrProThrValSerAlaHisValGlyTyrGlnAsnAsnLeuTyrThrSerSerAlaGlnAsnAsnAspTyrHis
TyrArgGlyLysGlyMetSerValGlyValGlnLeuAsnLeuProLeuTyrThrGlyGlyGluLeuSerGlyLys TABLE 1-continued IleHisGluAlaGluAlaGlnTyrGlyAlaAlaGluAlaGlnLeuThrAlaThrGluArgHisIleLysLeuAla
ValArgGlnAlaTyrThrGluSerGlyAlaAlaArgTyrGlnIleMetAlaGlnGluArgValLeuGluSerSerArg
LeuLysLeuLysSerThrGluThrGlyGlnGlnTyrGlyIleArgAsnArgLeuGluValIleArgAlaArgGln
GluValAlaGlnAlaGluGlnLysLeuAlaGlnAlaArgTyrLysPheMetLeuAlaTyrLeuArgLeuValLys
GluSerGlyLeuGlyLeuGluThrValPheAlaGlu-467
Hydrophilic Regions - Hopp-Woods (SEQ. NO. ID. 12006)
1-MetThrLeuLeuAsnLeuMetIleMetMetGlnAspTyrGlyIleSerValCysLeuThrLeuThrProTyrLeuGlnHisGluLeuPheSerAlaMet
LysSerTyrPheSerLysTyrIleLeuProValSerLeuPheThrLeuProLeuSerLeuSerProSerValSerAlaPheThrLeuProGluAlaTrp
ArgAlaAlaGlnGlnHisSerAlaAspPheGlnAlaSerHisTyrGlnArgAspAlaValArgAlaArgGlnGlnGlnAlaLysAlaAlaPheLeuPro
HisValSerAlaAsnAlaSerTyrGlnArgGlnProProSerIleSerSerThrArgGluThrGlnGlyTrpSerValGlnValGlyGlnThrLeuPhe
AspAlaAlaLysPheAlaGlnTyrArgGlnSerArgPheAspThrGlnAlaAlaGluGlnArgPheAspAlaAlaArgGluGluLeuLeuLeuLysVal
AlaGluSerTyrPheAsnValLeuLeuSerArgAspThrValAlaAlaHisAlaAlaGluLysGluAlaTyrAlaGlnGlnValArgGlnAlaGlnAla
LeuPheAsnLysGlyAlaAlaThrAlaLeuAspIleHisGluAlaLysAlaGlyTyrAspAsnAlaLeuAlaGlnGluIleAlaValLeuAlaGluLys
GlnThrTyrGluAsnGlnLeuAsnAspTyrThrAspLeuAspSerLysGlnIleGluAlaIleAspThrAlaAsnLeuLeuAlaArgTyrLeuProLys
LeuGluArgTyrSerLeuAspGluTrpGlnArgIleAlaLeuSerAsnAsnHisGluTyrArgMetGlnGlnLeuAlaLeuGlnSerSerGlyGlnAla
LeuArgAlaAlaGlnAsnSerArgTyrProThrValSerAlaHisValGlyTyrGlnAsnAsnLeuTyrThrSerSerAlaGlnAsnAsnAspTyrHis
TyrArgGlyLysGlyMetSerValGlyValGlnLeuAsnLeuProLeuTyrThrGlyGlyGluLeuSerGlyLysIleHisGluAlaGluAlaGlnTyr
GlyAlaAlaGluAlaGlnLeuThrAlaThrGluArgHisIleLysLeuAlaValArgGlnAlaTyrThrGluSerGlyAlaAlaArgTyrGlnIleMet
AlaGlnGluArgValLeuGluSerSerArgLeuLysLeuLysSerThrGluThrGlyGlnGlnTyrGlyIleArgAsnArgLeuGluValIleArgAla
ArgGlnGluValAlaGlnAlaGluGlnLysLeuAlaGlnAlaArgTyrLysPheMetLeuAlaTyrLeuArgLeuValLysGluSerGlyLeuGlyLeu
GluThrValPheAlaGlu-467
764
AMPHI Regions - AMPHI
SEQ. ID. NO. 12007    1-MetPhePheSerAlaLeuLysSerPheLeuSerArgTyrIleThrValTrpArgAsnValTrpAlaValArgAspGlnLeuLysProProLysArgThrAla
GluGluGlnAlaPheLeuProAlaHisLeuGluLeuThrAspThrProValSerAlaAlaProLysTrpAlaAlaArgPheIleMetAlaPheAlaLeuLeu
AlaLeuLeuTrpSerTrpPheGlyLysIleAspIleValAlaAlaAlaSerGlyLysThrValSerGlyGlyArgSerLysThrIleGlnProLeuGluThr
AlaValValLysAlaValHisValArgAspGlyGlnHisValLysGlnGlyGluThrLeuAlaGluLeuGluAlaValGlyThrAspSerAspValValGln
SerGluGlnAlaLeuGlnAlaAlaGlnLeuSerLysLeuArgTyrGluAlaValLeuAlaAlaLeuGluSerArgThrValProHisIleAspMetAlaGln
AlaArgSerLeuGlyLeuSerAspAlaAspValGlnSerAlaGlnValLeuAlaGlnHisGlnTyrGlnAlaTrpAlaAlaGlnAspAlaGlnLeuGlnSer
AlaLeuArgGlyHisGlnAlaGluLeuGlnSerAlaLysAlaGlnGluGlnLysLeuValSerValGlyAlaIleGluGlnGlnLysThrAlaAspTyrArg
ArgLeuArgAlaAspAsnPheIleSerGluHisAlaPheLeuGluGlnGlnSerLysSerValSerAsnTrpAsnAspLeuGluSerThrArgGlyGlnMet
ArgGlnIleGlnAlaAlaIleAlaGlnAlaGluGlnAsnArgValLeuAsnThrGlnAsnLeuLysArgAspThrLeuAspAlaLeuArgGlnAlaAsnGlu
GlnIleAspGlnTyrArgGlyGlnThrAspLysAlaLysGlnArgGlnGlnLeuMetThrIleGlnSerProAlaAspGlyThrValGlnGluLeuAlaThr
TyrThrValGlyGlyValValGlnAlaAlaGlnLysMetMetValIleAlaProAspAspAspLysMetAspValGluValLeuValLeuAsnLysAspIle
GlyPheValGluGlnGlyGlnAspAlaValValLysIleGluSerPheProTyrThrArgTyrGlyTyrLeuThrGlyLysValLysSerValSerHisAsp
AlaValSerHisGluGlnLeuGlyLeuValTyrThrAlaValValSerLeuAspLysHisThrLeuAsnIleAspGlyLysAlaValAsnLeuThrAlaGly
MetAsnValThrAlaGluIleLysThrGlyLysArgArgValLeuAspTyrLeuLeuSerProLeuGlnThrLysLeuAspGluSerPheArgGluArg-475
Antigenic Index - Jameson-Wolf (SEQ. ID. NO. 12007)
1-MetPhePheSerAlaLeuLysSerPheLeuSerArgTyrIleThrValTrpArgAsnValTrpAlaValArgAsp
GlnLeuLysProProLysArgThrAlaGluGluGlnAlaPheLeuProAlaHisLeuGluLeuThrAspThrPro
ValSerAlaAlaProLysTrpAlaAlaArgPheIleMetAlaPheAlaLeuLeuAlaLeuLeuTrpSerTrpPheGly
LysIleAspIleValAlaAlaAlaSerGlyLysThrValSerGlyGlyArgSerLysThrIleGlnProLeuGlu
ThrAlaValValLysAlaValHisValArgAspGlyGlnHisValLysGlnGlyGluThrLeuAlaGluLeuGlu
AlaValGlyThrAspSerAspValValGlnSerGluGlnAlaLeuGlnAlaAlaGlnLeuSerLysLeuArgTyrGlu
AlaValLeuAlaAlaLeuGluSerArgThrValProHisIleAspMetAlaGlnAlaArgSerLeuGlyLeuSer
AspAlaAspValGlnSerAlaGlnValLeuAlaGlnHisGlnTyrGlnAlaTrpAlaAlaGlnAspAlaGlnLeu
GlnSerAlaLeuArgGlyHisGlnAlaGluLeuGlnSerAlaLysAlaGlnGluGlnLysLeuValSerValGly
AlaIleGluGlnGlnLysThrAlaAspTyrArgArgLeuArgAlaAspAsnPheIleSerGluHisAlaPheLeuGlu
GlnGlnSerLysSerValSerAsnTrpAsnAspLeuGluSerThrArgGlyGlnMetArgGlnIleGlnAlaAla
IleAlaGlnAlaGluGlnAsnArgValLeuAsnThrGlnAsnLeuLysArgAspThrLeuAspAlaLeuArgGln
AlaAsnGluGlnIleAspGlnTyrArgGlyGlnThrAspLysAlaLysGlnArgGlnGlnLeuMetThrIleGln
SerProAlaAspGlyThrValGlnGluLeuAlaThrTyrThrValGlyGlyValValGlnAlaAlaGlnLysMetMet
ValIleAlaProAspAspAspLysMetAspValGluValLeuValLeuAsnLysAspIleGlyPheValGluGln
GlyGlnAspAlaValValLysIleGluSerPheProTyrThrArgTyrGlyTyrLeuThrGlyLysValLysSer
ValSerHisAspAlaValSerHisGluGlnLeuGlyLeuValTyrThrAlaValValSerLeuAspLysHisThrLeu
AsnIleAspGlyLysAlaValAsnLeuThrAlaGlyMetAsnValThrAlaGluIleLysThrGlyLysArgArg
ValLeuAspTyrLeuLeuSerProLeuGlnThrLysLeuAspGluSerPheArgGluArg-475
Hydrophilic Regions - Hopp-Woods (SEQ. ID. NO. 12007)
1-MetPhePheSerAlaLeuLysSerPheLeuSerArgTyrIleThrValTrpArgAsnValTrpAlaValArgAsp
GlnLeuLysProProLysArgThrAlaGluGluGlnAlaPheLeuProAlaHisLeuGluLeuThrAspThrPro
ValSerAlaAlaProLysTrpAlaAlaArgPheIleMetAlaPheAlaLeuLeuAlaLeuLeuTrpSerTrpPhe
GlyLysIleAspIleValAlaAlaAlaSerGlyLysThrValSerGlyGlyArgSerLysThrIleGlnProLeuGlu
ThrAlaValValLysAlaValHisValArgAspGlyGlnHisValLysGlnGlyGluThrLeuAlaGluLeuGlu
AlaValGlyThrAspSerAspValValGlnSerGluGlnAlaLeuGlnAlaAlaGlnLeuSerLysLeuArgTyr
GluAlaValLeuAlaAlaLeuGluSerArgThrValProHisIleAspMetAlaGlnAlaArgSerLeuGlyLeuSer
AspAlaAspValGlnSerAlaGlnValLeuAlaGlnHisGlnTyrGlnAlaTrpAlaAlaGlnAspAlaGlnLeu
GlnSerAlaLeuArgGlyHisGlnAlaGluLeuGlnSerAlaLysAlaGlnGluGlnLysLeuValSerValGly
AlaIleGluGlnGlnLysThrAlaAspTyrArgArgLeuArgAlaAspAsnPheIleSerGluHisAlaPheLeuGlu
GlnGlnSerLysSerValSerAsnTrpAsnAspLeuGluSerThrArgGlyGlnMetArgGlnIleGlnAlaAla
IleAlaGlnAlaGluGlnAsnArgValLeuAsnThrGlnAsnLeuLysArgAspThrLeuAspAlaLeuArgGln
AlaAsnGluGlnIleAspGlnTyrArgGlyGlnThrAspLysAlaLysGlnArgGlnGlnLeuMetThrIleGlnSer
ProAlaAspGlyThrValGlnGluLeuAlaThrTyrThrValGlyGlyValValGlnAlaAlaGlnLysMetMet
ValIleAlaProAspAspAspLysMetAspValGluValLeuValLeuAsnLysAspIleGlyPheValGluGln
GlyGlnAspAlaValValLysIleGluSerPheProTyrThrArgTyrGlyTyrLeuThrGlyLysValLysSerVal
SerHisAspAlaValSerHisGluGlnLeuGlyLeuValTyrThrAlaValValSerLeuAspLysHisThrLeu TABLE 1-continued AsnIleAspGlyLysAlaValAsnLeuThrAlaGlyMetAsnValThrAlaGluIleLysThrGlyLysArgArg
ValLeuAspTyrLeuLeuSerProLeuGlnThrLysLeuAspGluSerPheArgGluArg-475
765
AMPHI Regions - AMPHI
SEQ. ID. NO. 12008     36-SerAlaIleSerSerPheCys-42
SEQ. ID. NO. 12009     45-LysIleIleHisThrTyr-50
SEQ. ID. NO. 12010     59-ValIleGlyIleIleAsnGly-65
SEQ. ID. NO. 12011     105-ArgPheLeuAsnArgGly-110
SEQ. ID. NO. 12012     147-PheGlyLeuCysTyrPro-152
Antigenic Index - Jameson-Wolf
SEQ. ID. NO. 12013     10-GlyAsnPheLysLysIleAlaThr-17
SEQ. ID. NO. 12014     19-GlnGlyLeuAspArgLysTyr-25
SEQ. ID. NO. 12015     76-ValLysAsnLysGlnLysPheLeu-83
SEQ. ID. NO. 12016     106-PheLeuAsnArgGlyMetLys-112
SEQ. ID. NO. 12017     132-LeuAsnGluGluGlyGlyTrpMet-139
SEQ. ID. NO. 12018     160-LeuSerArgAspTyrLysHisIle-167
Hydrophilic Regions - Hopp-Woods
SEQ. ID. NO. 12019     11-AsnPheLysLysIleAlaThr-17
SEQ. ID. NO. 12020     19-GlnGlyLeuAspArgLys-24
SEQ. ID. NO. 12021     76-ValLysAsnLysGlnLysPheLeu-83
SEQ. ID. NO. 12022     133-AsnGluGluGlyGly-137
SEQ. ID. NO. 12023     162-ArgAspTyrLysHis-166
767
AMPHI Regions - AMPHI
SEQ. ID. NO. 12024     1-MetLysLeuLysHisLeuLeuProLeuLeuLeuSerAlaValLeuSerAlaGlnAlaTyrAlaLeuThrGluGlyGluAspTyrLeuValLeuAspLysPro
IleProGlnGluGlnSerGlyLysIleGluValLeuGluPhePheGlyTyrPheCysValHisCysHisHisPheAspProLeuLeuLeuLysLeuGlyLysAla
LeuProSerAspAlaTyrLeuArgThrGluHisValValTrpGlnProGluMetLeuGlyLeuAlaArgMetAlaAlaAlaValAsnLeuSerGlyLeuLysTyr
GlnAlaAsnProAlaValPheLysAlaValTyrGluGlnLysIleArgLeuGluAsnArgSerValAlaGlyLysTrpAlaLeuSerGlnLysGlyPheAsp
GlyLysLysLeuMetArgAlaTyrAspSerProGluAlaAlaAlaAlaAlaLeuLysMetGlnLysLeuThrGluGlnTyrArgIleAspSerThrProThrVal
IleValGlyGlyLysTyrArgValIlePheAsnAsnGlyPheAspGlyGlyValHisThrIleLysGluLeuValAlaLysValArgGluGluArgLysArgGln
ThrProAlaValGlnLys-214
Antigenic Index - Jameson-Wolf (SEQ. ID. NO. 12024)
1-MetLysLeuLysHisLeuLeuProLeuLeuLeuSerAlaValLeuSerAlaGlnAlaTyrAlaLeuThrGluGlyGluAspTyrLeuValLeuAspLysProIle
GlnGluGlnGlnGluGlnSerGlyLysIleGluValLeuGluPhePheGlyTyrPheCysValHisCysHisHisPheAspProLeuLeuLeuLysLeuGlyLys
AlaLeuProSerAspAlaTyrLeuArgThrGluHisValValTrpGlnProGluMetLeuGlyLeuAlaArgMetAlaAlaAlaValAsnLeuSerGlyLeuLys
TyrGlnAlaAsnProAlaValPheLysAlaValTyrGluGlnLysIleArgLeuGluAsnArgSerValAlaGlyLysTrpAlaLeuSerGlnLysGlyPheAsp
GlyLysLysLeuMetArgAlaTyrAspSerProGluAlaAlaAlaAlaAlaLeuLysMetGlnLysLeuThrGluGlnTyrArgIleAspSerThrProThrVal
IleValGlyGlyLysTyrArgValIlePheAsnAsnGlyPheAspGlyGlyValHisThrIleLysGluLeuValAlaLysValArgGluGluArgLysArgGln
ThrProAlaValGlnLys-214
Hydrophilic Regions - Hopp-Woods (SEQ. ID. NO. 12024)
1-MetLysLeuLysHisLeuLeuProLeuLeuLeuSerAlaValLeuSerAlaGlnAlaTyrAlaLeuThrGluGlyGluAspTyrLeuValLeuAspLysProIle
ProGlnGluGlnSerGlyLysIleGluValLeuGluPhePheGlyTyrPheCysValHisCysHisHisPheAspProLeuLeuLeuLysLeuGlyLysAlaLeu
ProSerAspAlaTyrLeuArgThrGluHisValValTrpGlnProGluMetLeuGlyLeuAlaArgMetAlaAlaAlaValAsnLeuSerGlyLeuLysTyrGln
AlaAsnProAlaValPheLysAlaValTyrGluGlnLysIleArgLeuGluAsnArgSerValAlaGlyLysTrpAlaLeuSerGlnLysGlyPheAspGlyLys
LysLeuMetArgAlaTyrAspSerProGluAlaAlaAlaAlaAlaLeuLysMetGlnLysLeuThrGluGlnTyrArgIleAspSerThrProThrValIleVal
GlyGlyLysTyrArgValIlePheAsnAsnGlyPheAspGlyGlyValHisThrIleLysGluLeuValAlaLysValArgGluGluArgLysArgGlnThrPro
AlaValGlnLys-214
768
AMPHI Regions - AMPHI
SEQ. ID. NO. 12025     23-ProGlnLysProValSerAlaAlaGlnThr-32
SEQ. ID. NO. 12026     60-ProValAspGlnIleValArgArgIleHisGluAlaAla-72
SEQ. ID. NO. 12027     93-LeuGlnGluLeuLysLysAlaGlyTyrThrAsnValAlaAsnHisGly-108
Antigenic Index - Jameson-Wolf
SEQ. ID. NO. 12028     21-AlaAlaProGlnLysProValSer-28
SEQ. ID. NO. 12029     42-ValArgSerGluGlnGluPheSerGluGlyHis-52
SEQ. ID. NO. 12030     63-GlnIleValArgArgIleHisGluAlaAlaProAspLysAspThrPro-78
SEQ. ID. NO. 12031     82-TyrCysArgSerGlyArgArgAlaGluAlaAlaLeuGlnGluLeuLysLysAlaGlyTyr-101
SEQ. ID. NO. 12032     106-AsnHisGlyGlyTyrGluAspLeuLeuLysLysGlyMetLys-119
Hydrophilic Regions - Hopp-Woods
SEQ. ID. NO. 12033     22-AlaProGlnLysProValSer-28
SEQ. ID. NO. 12034     42-ValArgSerGluGlnGluPheSerGlu-50
SEQ. ID. NO. 12035     63-GlnIleValArgArgIleHisGluAlaAlaProAspLysAspThrPro-78
SEQ. ID. NO. 12036     84-ArgSerGlyArgArgAlaGluAlaAlaLeuGlnGluLeuLysLysAlaGly-100
SEQ. ID. NO. 12037     109-GlyTyrGluAspLeuLeuLysLysGlyMetLys-119
769
AMPHI Regions - AMPHI
SEQ. ID. NO. 12038     1-LeuIleMetValIlePheTyrPheCysGlyLysThrPheMetProAlaArgAsnArgTrpMetLeuLeuLeuProLeuLeuAlaSerAlaAlaTyrAlaGlu
GluThrProArgGluProAspLeuArgSerArgProGluPheArgLeuHisGluAlaGluValLysProIleAspArgGluLysValProGlyGlnValArgGlu
LysGlyLysValLeuGlnIleAspGlyGluThrLeuLeuLysAsnProGluLeuLeuSerArgAlaMetTyrSerAlaValValSerAsnAsnIleAlaGlyIle
ArgValIleLeuProIleTyrLeuGlnGlnAlaGlnGlnAspLysMetLeuAlaLeuTyrAlaGlnGlyIleLeuAlaGlnAlaAspGlyArgValLysGlu
AlaIleSerHisTyrArgGluLeuIleAlaAlaGlnProAspAlaProAlaValArgMetArgLeuAlaAlaAlaLeuPheGluAsnArgGlnAsnGluAlaAla
AlaAspGlnPheAspArgLeuLysAlaGluAsnLeuProProGlnLeuMetGluGlnValGluLeuTyrArgLysAlaLeuArgGluArgAspAlaTrpLysVal
AsnGlyGlyPheSerValThrArgGluHisAsnIleAsnGlnAlaProLysArgGlnGlnTyrGlyLysTrpThrPheProLysGlnValAspGlyThrAla
ValAsnTyrArgLeuGlyAlaGluLysLysTrpSerLeuLysAsnGlyTrpTyrThrThrAlaGlyGlyAspValSerGlyArgValTyrProGlyAsnLysLys
PheAsnAspMetThrAlaGlyValSerGlyGlyIleGlyPheAlaAspArgArgLysAspAlaGlyLeuAlaValPheHisGluArgArgThrTyrGlyAsnAsp
AlaTyrSerTyrThrAsnGlyAlaArgLeuTyrPheAsnArgTrpGlnThrProLysTrpGlnThrLeuSerSerAlaGluTrpGlyArgLeuLysAsnThr
ArgArgAlaArgSerAspAsnThrHisLeuGlnIleSerAsnSerLeuValPheTyrArgAsnAlaArgGlnTyrTrpMetGlyGlyLeuAspPheTyrArgGlu
ArgAsnProAlaAspArgGlyAspAsnPheAsnArgTyrGlyLeuArgPheAlaTrpGlyGlnGluTrpGlyGlySerGlyLeuSerSerLeuLeuArgLeuGly
AlaAlaLysArgHisTyrGluLysProGlyPhePheSerGlyPheLysGlyGluArgArgArgAspLysGluLeuAsnThrSerLeuSerLeuTrpHisArg TABLE 1-continued AlaLeuHisPheLysGlyIleThrProArgLeuThrLeuSerHisArgGluThrArgSerAsnAspValPheAsnGluTyrGluLysAsnArgAlaPheValGlu
PheAsnLysThrPhe-490

Antigenic Index - Jameson-Wolf (SEQ. ID. NO. 12038)
1-LeuIleMetValIlePheTyrPheCysGlyLysThrPheMetProAlaArgAsnArgTrpMetLeuLeuLeuProLeuLeuAlaSerAlaAlaTyrAlaGluGlu
ThrProArgGluProAspLeuArgSerArgProGluPheArgLeuHisGluAlaGluValLysProIleAspArgGluLysValProGlyGlnValArgGluLys
GlyLysValLeuGlnIleAspGlyGluThrLeuLeuLysAsnProGluLeuLeuSerArgAlaMetTyrSerAlaValValSerAsnAsnIleAlaGlyIleArg
ValIleLeuProIleTyrLeuGlnGlnAlaGlnGlnAspLysMetLeuAlaLeuTyrAlaGlnGlyIleLeuAlaGlnAlaAspGlyArgValLysGluAlaIle
SerHisTyrArgGluLeuIleAlaAlaGlnProAspAlaProAlaValArgMetArgLeuAlaAlaAlaLeuPheGluAsnArgGlnAsnGluAlaAlaAlaAsp
GlnPheAspArgLeuLysAlaGluAsnLeuProProGlnLeuMetGluGlnValGluLeuTyrArgLysAlaLeuArgGluArgAspAlaTrpLysValAsnGly
GlyPheSerValThrArgGluHisAsnIleAsnGlnAlaProLysArgGlnGlnTyrGlyLysTrpThrPheProLysGlnValAspGlyThrAlaValAsnTyr
ArgLeuGlyAlaGluLysLysTrpSerLeuLysAsnGlyTrpTyrThrThrAlaGlyGlyAspValSerGlyArgValTyrProGlyAsnLysLysPheAsnAsp
MetThrAlaGlyValSerGlyGlyIleGlyPheAlaAspArgArgLysAspAlaGlyLeuAlaValPheHisGluArgArgThrTyrGlyAsnAspAlaTyrSer
TyrThrAsnGlyAlaArgLeuTyrPheAsnArgTrpGlnThrProLysTrpGlnThrLeuSerSerAlaGluTrpGlyArgLeuLysAsnThrArgArgAlaArg
SerAspAsnThrHisLeuGlnIleSerAsnSerLeuValPheTyrArgAsnAlaArgGlnTyrTrpMetGlyGlyLeuAspPheTyrArgGluArgAsnProAla
AspArgGlyAspAsnPheAsnArgTyrGlyLeuArgPheAlaTrpGlyGlnGluTrpGlyGlySerGlyLeuSerSerLeuLeuArgLeuGlyAlaAlaLysArg
HisTyrGluLysProGlyPhePheSerGlyPheLysGlyGluArgArgArgAspLysGluLeuAsnThrSerLeuSerLeuTrpHisArgAlaLeuHisPheLys
GlyIleThrProArgLeuThrLeuSerHisArgGluThrArgSerAsnAspValPheAsnGluTyrGluLysAsnArgAlaPheValGluPheAsnLysThr
Phe-490

Hydrophilic Regions - Hopp-Woods (SEQ. ID. NO. 12038)
1-LeuIleMetValIlePheTyrPheCysGlyLysThrPheMetProAlaArgAsnArgTrpMetLeuLeuLeuProLeuLeuAlaSerAlaAlaTyrAlaGluGlu
ThrProArgGluProAspLeuArgSerArgProGluPheArgLeuHisGluAlaGluValLysProIleAspArgGluLysValProGlyGlnValArgGluLys
GlyLysValLeuGlnIleAspGlyGluThrLeuLeuLysAsnProGluLeuLeuSerArgAlaMetTyrSerAlaValValSerAsnAsnIleAlaGlyIleArg
ValIleLeuProIleTyrLeuGlnGlnAlaGlnGlnAspLysMetLeuAlaLeuTyrAlaGlnGlyIleLeuAlaGlnAlaAspGlyArgValLysGluAlaIle
SerHisTyrArgGluLeuIleAlaAlaGlnProAspAlaProAlaValArgMetArgLeuAlaAlaAlaLeuPheGluAsnArgGlnAsnGluAlaAlaAlaAsp
GlnPheAspArgLeuLysAlaGluAsnLeuProProGlnLeuMetGluGlnValGluLeuTyrArgLysAlaLeuArgGluArgAspAlaTrpLysValAsnGly
GlyPheSerValThrArgGluHisAsnIleAsnGlnAlaProLysArgGlnGlnTyrGlyLysTrpThrPheProLysGlnValAspGlyThrAlaValAsnTyr
ArgLeuGlyAlaGluLysLysTrpSerLeuLysAsnGlyTrpTyrThrThrAlaGlyGlyAspValSerGlyArgValTyrProGlyAsnLysLysPheAsnAsp
MetThrAlaGlyValSerGlyGlyIleGlyPheAlaAspArgArgLysAspAlaGlyLeuAlaValPheHisGluArgArgThrTyrGlyAsnAspAlaTyrSer
TyrThrAsnGlyAlaArgLeuTyrPheAsnArgTrpGlnThrProLysTrpGlnThrLeuSerSerAlaGluTrpGlyArgLeuLysAsnThrArgArgAlaArg
SerAspAsnThrHisLeuGlnIleSerAsnSerLeuValPheTyrArgAsnAlaArgGlnTyrTrpMetGlyGlyLeuAspPheTyrArgGluArgAsnProAla
AspArgGlyAspAsnPheAsnArgTyrGlyLeuArgPheAlaTrpGlyGlnGluTrpGlyGlySerGlyLeuSerSerLeuLeuArgLeuGlyAlaAlaLysArg
HisTyrGluLysProGlyPhePheSerGlyPheLysGlyGluArgArgArgAspLysGluLeuAsnThrSerLeuSerLeuTrpHisArgAlaLeuHisPheLys
GlyIleThrProArgLeuThrLeuSerHisArgGluThrArgSerAsnAspValPheAsnGluTyrGluLysAsnArgAlaPheValGluPheAsnLysThr
Phe-490
770

AMPHI Regions - AMPHI
SEQ. ID. NO. 12039    1-MetAsnArgLeuLeuLeuLeuSerAlaAlaValLeuLeuThrAlaCysGlySerGlyGluThrAspLysIleGlyArgAlaSerThrValPheAsnIleLeu
GlyLysAsnArgIleGluValGluGlyPheAspAspProAspValGlnGlyValAlaCysTyrIleSerTyrAlaLysLysGlyGlyLeuLysGluMet
ValAsnLeuGluGluAspAlaSerAspAlaSerValSerCysValGlnThrAlaSerSerIleSerPheAspGluThrAlaValArgLysProLysGluVal
PheLysHisGlyAlaSerPheAlaPheLysSerArgGlnIleValArgTyrTyrAspProLysArgLysThrPheAlaTyrLeuValTyrSerAspLysIle
IleGlnGlySerProLysAsnSerLeuSerAlaValSerCysPheGlyGlyGlyIleProGlnThrAspGlyValGlnAlaAspThrSerGlyAsnLeuLeu
AlaGlyAlaCysMetIleSerAsnProIleGluAsnLeuAspLysArg-186

Antigenic Index - Jameson-Wolf (SEQ. ID. NO. 12039)
1-MetAsnArgLeuLeuLeuLeuSerAlaAlaValLeuLeuThrAlaCysGlySerGlyGluThrAspLysIleGlyArgAlaSerThrValPheAsnIleLeuGly
LysAsnAspArgIleGluValGluGlyPheAspAspProAspValGlnGlyValAlaCysTyrIleSerTyrAlaLysLysGlyGlyLeuLysGluMetValAsn
LeuGluGluAspAlaSerAspAlaSerValSerCysValGlnThrAlaSerSerIleSerPheAspGluThrAlaValArgLysProLysGluValPheLysHis
GlyAlaSerPheAlaPheLysSerArgGlnIleValArgTyrTyrAspProLysArgLysThrPheAlaTyrLeuValTyrSerAspLysIleIleGlnGlySer
ProLysAsnSerLeuSerAlaValSerCysPheGlyGlyGlyIleProGlnThrAspGlyValGlnAlaAspThrSerGlyAsnLeuLeuAlaGlyAlaCysMet
IleSerAsnProIleGluAsnLeuAspLysArg-186

Hydrophilic Regions - Hopp-Woods (SEQ. ID. NO. 12039)
1-MetAsnArgLeuLeuLeuLeuSerAlaAlaValLeuLeuThrAlaCysGlySerGlyGluThrAspLysIleGlyArgAlaSerThrValPheAsnIleLeuGly
LysAsnAspArgIleGluValGluGlyPheAspAspProAspValGlnGlyValAlaCysTyrIleSerTyrAlaLysLysGlyGlyLeuLysGluMetValAsn
LeuGluGluAspAlaSerAspAlaSerValSerCysValGlnThrAlaSerSerIleSerPheAspGluThrAlaValArgLysProLysGluValPheLysHis
GlyAlaSerPheAlaPheLysSerArgGlnIleValArgTyrTyrAspProLysArgLysThrPheAlaTyrLeuValTyrSerAspLysIleIleGlnGlySer
ProLysAsnSerLeuSerAlaValSerCysPheGlyGlyGlyIleProGlnThrAspGlyValGlnAlaAspThrSerGlyAsnLeuLeuAlaGlyAlaCysMet
IleSerAsnProIleGluAsnLeuAspLysArg-186
771

AMPHI Regions - AMPHI
SEQ. ID. NO. 12040    1-MetAspLeuLeuSerValPheHisLysTyrArgLeuLysTyrAlaValAlaValLeuThrIleLeuLeuLeuAlaAlaValGlyLeuHisAlaSerValTyr
ArgThrPheThrProGluAsnIleArgSerArgLeuGlnGlnSerIleAlaHisThrHisArgLysIleSerPheAspAlaAspIleGlnArgArgLeuLeuPro
ArgProThrValIleLeuLysAsnLeuThrIleThrGluProGlyGlyAspGlnThrAlaValSerValGlnGluThrLysIleGlyLeuSerTrpLysAsnLeu
TrpSerAspGlnIleGlnIleGluLysTrpValValSerSerAlaGluLeuAlaLeuThrArgAspGlyLysGlyValTrpAsnIleGlnAspLeuIleAsp
SerGlnLysArgGlnAlaSerValAsnArgIleIleValGluAsnSerThrValArgLeuAsnPheLeuGlnGluGlnLeuIleLeuLysGluIleAsnLeuAsn
LeuGlnSerProAspSerSerGlyGlnProPheGluSerSerGlyIleLeuValTrpGlyLysLeuSerValProTrpLysSerArgGlyLeuPheLeuSerAsn
GlyIleGlyProProGluIleSerProPheHisPheGluAlaSerThrSerLeuAspGlyHisGlyIleThrIleSerThrThrGlySerProSerValArg
PheAsnAlaGlyGlyAlaAspAlaAlaGlyLeuGlyLeuArgAlaAspThrSerPheArgAsnLeuHisLeuThrAlaGlnIleProAlaLeuAlaLeuArgAsn
AsnSerIleLysIleGluThrValAsnGlyAlaPheThrAlaGlyGlyGluTyrAlaArgTrpAspGlySerPheLysLeuAspLysAlaAsnLeuHisSer
GlyIleAlaAsnIleGlyAsnAlaGluIleSerGlySerPheLysThrProAlaHisIleThrAsnPheSerLeuAsnSerProLeuValTrpThrGluAsnLys
GlyLeuAspAlaProArgLeuTyrValSerThrLeuGlnAspThrValAsnArgLeuProGlnProArgPheIleSerArgLeuAspGlySerLeuSerValPro
AsnLeuGlnAsnTrpAsnAlaGluLeuAsnGlyThrPheAspArgGlnThrValAlaAlaLysPheArgTyrThrHisGluAspAlaProHisLeuGluAla
AlaValAlaLeuGlnLysLeuAsnLeuThrProTyrLeuAspAspValArgGlnGlnAsnGlyLysIlePheProAspThrLeuAlaLysLeuSerGlyAspIle
GluAlaHisLeuLysIleGlyLysValGlnLeuProGlyLeuGlnLeuAspAspMetGluThrTyrLeuHisAlaAspLysGlyHisIleAlaLeuSerArgPhe
LysSerGlyLeuTyrGlyGlyHisThrGluGlyGlyIleSerIleAlaAsnThrArgProAlaThrTyrArgLeuGluGlnAsnAlaSerAsnIleGlnIle
GlnProLeuLeuAspLeuPheGlyPheHisSerPheSerGlyAsnGlyAspAlaValIleAspLeuThrAlaGlyGlyGluThrArgLysGluLeuIleArg
SerLeuGlnGlySerLeuSerLeuAsnIleSerAsnGlyAlaTrpHisGlyIleAspMetAspAsnIleLeuLysAsnGlyIleSerGlyLysThrAlaAspAsn
AlaAlaProSerThrProPheHisArgPheThrLeuAsnSerGluIleSerAspGlyIleSerArgHisIleAspThrGluLeuPheSerAspSerLeuTyr
ValThrSerAsnGlyTyrThrAsnLeuAspThrGlnGluLeuSerGluAspValLeuIleArgAsnAlaValHisProLysAsnLysProIleProLeuLysIle
ThrGlyThrValAspLysProSerIleThrValAspTyrGlyArgLeuThrGlyGlyIleAsnSerArgLysGluLysGlnLysIleLeuGluAspThrLeuLeu
GluGlnTrpGlnTrpLeuLysProLysGluProAla-705

TABLE 1-continued

Antigenic Index - Jameson-Wolf (SEQ. ID. NO. 12040)
1-MetAspLeuLeuSerValPheHisLysTyrArgLeuLysTyrAlaValAlaValLeuThrIleLeuLeuLeuAla
AlaValGlyLeuHisAlaSerValTyrArgThrPheThrProGluAsnIleArgSerArgLeuGlnGlnSerIle
AlaHisThrHisArgLysIleSerPheAspAlaAspIleGlnArgArgLeuLeuProArgProThrValIleLeuLys
AsnLeuThrIleThrGluProGlyGlyAspGlnThrAlaValSerValGlnGluThrLysIleGlyLeuSerTrp
LysAsnLeuTrpSerAspGlnIleGlnIleGluLysTrpValValSerSerAlaGluLeuAlaLeuThrArgAsp
GlyLysGlyValTrpAsnIleGlnAspLeuIleAspSerGlnLysArgGlnAlaSerValAsnArgIleIleVal
GluAsnSerThrValArgLeuAsnPheLeuGlnGluGlnLeuIleLeuLysGluIleAsnLeuAsnLeuGlnSer
ProAspSerSerGlyGlnProPheGluSerSerGlyIleLeuValTrpGlyLysLeuSerValProTrpLysSerArg
GlyLeuPheLeuSerAsnGlyIleGlyProProGluIleSerProPheHisPheGluAlaSerThrSerLeuAspGly
HisGlyIleThrIleSerThrThrGlySerProSerValArgPheAsnAlaGlyGlyAlaAspAlaAlaGlyLeu
GlyLeuArgAlaAspThrSerPheArgAsnLeuHisLeuThrAlaGlnIleProAlaLeuAlaLeuArgAsnAsn
SerIleLysIleGluThrValAsnGlyAlaPheThrAlaGlyGlyGluTyrAlaArgTrpAspGlySerPheLys
LeuAspLysAlaAsnLeuHisSerGlyIleAlaAsnIleGlyAsnAlaGluIleSerGlySerPheLysThrProArg
HisGlnThrAsnPheSerLeuAsnSerProLeuValTrpThrGluAsnLysGlyLeuAspAlaProArgLeuTyr
ValSerThrLeuGlnAspThrValAsnArgLeuProGlnProArgPheIleSerArgLeuAspGlySerLeuSer
ValProAsnLeuGlnAsnTrpAsnAlaGluLeuAsnGlyThrPheAspArgGlnThrValAlaAlaLysPheArg
TyrThrHisGluAspAlaProHisLeuGluAlaAlaValAlaLeuGlnLysLeuAsnLeuThrProTyrLeuAspAsp
ValArgGlnGlnAsnGlyLysIlePheProAspThrLeuAlaLysLeuSerGlyAspIleGluAlaHisLeuLys
IleGlyLysValGlnLeuProGlyLeuGlnLeuAspAspMetGluThrTyrLeuHisAlaAspLysGlyHisIleAla
LeuSerArgPheLysSerGlyLeuTyrGlyGlyHisThrGluGlyGlyIleSerIleAlaAsnThrArgProAla
ThrTyrArgLeuGlnGlnAsnAlaSerAsnIleGlnIleGlnProLeuLeuGlnAspLeuPheGlyPheHisSer
PheSerGlyAsnGlyAspAlaValIleAspLeuThrAlaGlyGlyGluThrArgLysGluLeuIleArgSerLeuGln
GlySerLeuSerLeuAsnIleSerAsnGlyAlaTrpHisGlyIleAspMetAspAsnIleLeuLysAsnGlyIle
SerGlyLysThrAlaAspAsnAlaAlaProSerThrProPheHisArgPheThrLeuAsnSerGluIleSerAspGly
IleSerArgHisIleAspThrGluLeuPheSerAspSerLeuTyrValThrSerAsnGlyTyrThrAsnLeuAsp
ThrGlnGluLeuSerGluAspValLeuIleArgAsnAlaValHisProLysAsnLysProIleProLeuLysIle
ThrGlyThrValAspLysProSerIleThrValAspTyrGlyArgLeuThrGlyGlyIleAsnSerArgLysGlu
LysGlnLysIleLeuGluAspThrLeuLeuGluGlnTrpGlnTrpLeuLysProLysGluProAla-705
Hydrophilic Regions - Hopp-Woods (SEQ. ID. NO. 12040)
1-MetAspLeuLeuSerValPheHisLysTyrArgLeuLysTyrAlaValAlaValLeuThrIleLeuLeuLeuAla
AlaValGlyLeuHisAlaSerValTyrArgThrPheThrProGluAsnIleArgSerArgLeuGlnGlnSerIle
AlaHisThrHisArgLysIleSerPheAspAlaAspIleGlnArgArgLeuLeuProArgProThrValIleLeu
LysAsnLeuThrIleThrGluProGlyGlyAspGlnThrAlaValSerValGlnGluThrLysIleGlyLeuSer
TrpLysAsnLeuTrpSerAspGlnIleGlnIleGluLysTrpValValSerSerAlaGluLeuAlaLeuThrArgAsp
GlyLysGlyValTrpAsnIleGlnAspLeuIleAspSerGlnLysArgGlnAlaSerValAsnArgIleIleVal
GluAsnSerThrValArgLeuAsnPheLeuGlnGluGlnLeuIleLeuLysGluIleAsnLeuAsnLeuGlnSerPro
AspSerSerGlyGlnProPheGluSerSerGlyIleLeuValTrpGlyLysLeuSerValProTrpLysSerArg
GlyLeuPheLeuSerAsnGlyIleGlyProProGluIleSerProPheHisPheGluAlaSerThrSerLeuAspGly
HisGlyIleThrIleSerThrThrGlySerProSerValArgPheAsnAlaGlyGlyAlaAspAlaAlaGlyLeu
GlyLeuArgAlaAspThrSerPheArgAsnLeuHisLeuThrAlaGlnIleProAlaLeuAlaLeuArgAsnAsn
SerIleLysIleGluThrValAsnGlyAlaPheThrAlaGlyGlyGluTyrAlaArgTrpAspGlySerPheLysLeu
AspLysAlaAsnLeuHisSerGlyIleAlaAsnIleGlyAsnAlaGluIleSerGlySerPheLysThrProArg
HisGlnThrAsnPheSerLeuAsnSerProLeuValTrpThrGluAsnLysGlyLeuAspAlaProArgLeuTyr
ValSerThrLeuGlnAspThrValAsnArgLeuProGlnProArgPheIleSerArgLeuAspGlySerLeuSerVal
ProAsnLeuGlnAsnTrpAsnAlaGluLeuAsnGlyThrPheAspArgGlnThrValAlaAlaLysPheArgTyr
ThrHisGluAspAlaProHisLeuGluAlaAlaValAlaLeuGlnLysLeuAsnLeuThrProTyrLeuAspAsp
ValArgGlnGlnAsnGlyLysIlePheProAspThrLeuAlaLysLeuSerGlyAspIleGluAlaHisLeuLysIle
GlyLysValGlnLeuProGlyLeuGlnLeuAspAspMetGluThrTyrLeuHisAlaAspLysGlyHisIleAla
LeuSerArgPheLysSerGlyLeuTyrGlyGlyHisThrGluGlyGlyIleSerIleAlaAsnThrArgProAla
ThrTyrArgLeuGlnGlnAsnAlaSerAsnIleGlnIleGlnProLeuLeuGlnAspLeuPheGlyPheHisSer
PheSerGlyAsnGlyAspAlaValIleAspLeuThrAlaGlyGlyGluThrArgLysGluLeuIleArgSerLeuGln
GlySerLeuSerLeuAsnIleSerAsnGlyAlaTrpHisGlyIleAspMetAspAsnIleLeuLysAsnGlyIle
SerGlyLysThrAlaAspAsnAlaAlaProSerThrProPheHisArgPheThrLeuAsnSerGluIleSerAsp
GlyIleSerArgHisIleAspThrGluLeuPheSerAspSerLeuTyrValThrSerAsnGlyTyrThrAsnLeuAsp
ThrGlnGluLeuSerGluAspValLeuIleArgAsnAlaValHisProLysAsnLysProIleProLeuLysIle
ThrGlyThrValAspLysProSerIleThrValAspTyrGlyArgLeuThrGlyGlyIleAsnSerArgLysGlu
LysGlnLysIleLeuGluAspThrLeuLeuGluGlnTrpGlnTrpLeuLysProLysGluProAla-705
772
AMPHI Regions - AMPHI
SEQ. ID. NO. 12041    1-MetPheGlyAlaValLeuArgIleAspAlaAspCysLeuGlnIleIleValAlaCysLysLeuPheGlnIleValAlaTyrGlyPheAlaAlaLeuValGlu
GlyGluPheHisGluPheGlyLysMetLeuGluIleValArgLeuAlaAspAlaValPheHisArgAsnHisThrAspAspGlyGlyIleHisPheArgArg
ArgValGluArgPheGlyArgTyrValAsnGlnHisPheHisIleGluLysIleLeuGlnHisHisAlaGlnAlaAlaValValAlaPheArgArgGly
AsnHisThrLeuAspHisPhePheLeuGlnHisLysValHisIleAspAspIleValArgHisLeuArgGlnLeuGluGlnLysArgCysGlyAsnValVal
ArgGluValAlaAspAspPheLeuPheAlaCysAspAlaValGluIleLysLeuGlnTyrIleAlaPheValAsnHisGlnPheIleArgLysArgGlnArg
PheGlnThrAlaTyrAspValAlaValAspPheAspAsnValGlnAlaValGlnLeuPheArgGlnArgPheGlyAsnArgArgGlnThrArgAlaAspPhe
AsnHisAspIleIleArgLeuArgAlaHisGlyValAspAsnIleAlaAspAsnProArgValLeuGlnLysIleLeuProGluThrLeuAlaGlyPheVal
PhePheHisArgValSerPheSerValGluThrProProPheAlaValGluSerAspSerIleTrpGluGlyArgAsnSerPheGlnIleArgMetAla
HisArgAlaValLeuTyrValSerSerCysValLeuLysHisLysCysValTyrSerIleArgLeuMetSerAlaLeu-298
Antigenic Index - Jameson-Wolf (SEQ. ID. NO. 12041)
1-MetPheGlyAlaValLeuArgIleAspAlaAspCysLeuGlnIleIleValAlaCysLysLeuPheGlnIleVal
AlaTyrGlyPheAlaAlaLeuValGluGlyGluPheHisGluPheGlyLysMetLeuGluIleValArgLeuAla
AspAlaValPheHisArgAsnHisThrAspAspGlyGlyIleHisPheArgArgArgValGluArgPheGlyArg
TyrValAsnGlnHisPheHisIleGluLysIleLeuGlnHisHisAlaGlnAlaAlaValValValAlaPheArgArg
GlyAsnHisThrLeuAspHisPhePheLeuGlnHisLysValHisIleAspAspIleValArgHisLeuArgGln
LeuGluGlnLysArgCysGlyAsnValValArgGluValAlaAspAspPheLeuPheAlaCysAspAlaValGlu
IleLysLeuGlnTyrIleAlaPheValAsnHisGlnPheIleArgLysArgGlnArgPheGlnThrAlaTyrAspVal
AlaValAspPheAspAsnValGlnAlaValGlnLeuPheArgGlnArgPheGlyAsnArgArgGlnThrArgAla
AspPheAsnHisAspIleIleArgLeuArgAlaHisGlyValAspAsnIleAlaAspAsnProArgValLeuGln
LysIleLeuProGluThrLeuAlaGlyPheValPhePheHisArgValSerPheSerValGluThrProProPheArg TABLE 1-continued AlaValGluSerAspSerIleTrpGluGlyArgAsnSerPheGlnIleArgMetAlaHisArgAlaValLeuTyr
ValSerSerCysValLeuLysHisLysCysValTyrSerIleArgLeuMetSerAlaLeu-298
Hydrophilic Regions - Hopp-Woods (SEQ. ID. NO. 12041)
1-MetPheGlyAlaValLeuArgIleAspAlaAspCysLeuGlnIleIleValAlaCysLysLeuPheGlnIleVal
AlaTyrGlyPheAlaAlaLeuValGluGlyGluPheHisGluPheGlyLysMetLeuGluIleValArgLeuAla
AspAlaValPheHisArgAsnHisThrAspAspGlyGlyIleHisPheArgArgArgValGluArgPheGlyArgTyr
ValAsnGlnHisPheHisIleGluLysIleLeuGlnHisHisAlaGlnAlaAlaValValAlaPheArgArg
GlyAsnHisThrLeuAspHisPhePheLeuGlnHisLysValHisIleAspAspIleValArgHisLeuArgGln
LeuGluGlnLysArgCysGlyAsnValValArgGluValAlaAspAspPheLeuPheAlaCysAspAlaValGluIle
LysLeuGlnTyrIleAlaPheValAsnHisGlnPheIleArgLysArgGlnArgPheGlnThrAlaTyrAspVal
AlaValAspPheAspAsnValGlnAlaValGlnLeuPheArgGlnArgPheGlyAsnArgArgGlnThrArgAla
AspPheAsnHisAspIleIleArgLeuArgAlaHisGlyValAspAsnIleAlaAspAsnProArgValLeuGln
LysIleLeuProGluThrLeuAlaGlyPheValPhePheHisArgValSerPheSerValGluThrProProPheArg
AlaValGluSerAspSerIleTrpGluGlyArgAsnSerPheGlnIleArgMetAlaHisArgAlaValLeuTyr
ValSerSerCysValLeuLysHisLysCysValTyrSerIleArgLeuMetSerAlaLeu-298
773
AMPHI Regions - AMPHI
SEQ. ID. NO. 12042  1-MetGlyLeuGlyAlaThrThrPheValGlySerGlyAlaIleGlyGlyGlyLeuCysSerThrGlyIleGlyCysAlaAlaGlyGlyLeuIleAlaThrAla
GlyMetThrGlyGlyTyrThrGlnAlaSerGluGlySerArgGlnLeuPheGlyThrTyrGlnSerAspPheGlyLysLysValValLeuSerLeuGlyThr
ProIleGluTyrGluSerProLeuValSerAspAlaLysAsnLeuAlaValTrpGlyLeuGluThrLeuIleThrArgLysLeuGlyAsnLeuAlaThrGly
ValLysThrSerLeuThrProLysThrAlaAspValGlnArgAsnIleLeuSerGlnSerGluValGlyIleLysTrpGlyLysGlyIleGluGlyGlnGly
MetProTrpGluAspTyrValGlyLysGlyLeuSerAlaAsnAlaArgLeuProLysAsnPheLysThrPheAspTyrPheAspArgGlyThrGlyThrAla
IleSerAlaLysThrLeuAspThrGlnThrThrAlaArgLeuSerLysProGluGlnLeuTyrSerThrMetLysGlyTyrIleAspLysThrAlaAsnPhe
LysSerTyrGluLeuSerGluValProLeuArgAlaAspMetIleLysGlnArgGluIleHisLeuAlaIleProAlaGlnThrAsnLysGluGlnArgLeu
GlnLeuGlnArgValValGluTyrGlyLysSerGlnAsnIleThrValLysIleThrGluIleGlu-260
Antigenic Index - Jameson-Wolf (SEQ. ID. NO. 12042)
1-MetGlyLeuGlyAlaThrThrPheValGlySerGlyAlaIleGlyGlyGlyLeuCysSerThrGlyIleGlyCys
AlaAlaGlyGlyLeuIleAlaThrAlaGlyMetThrGlyGlyTyrThrGlnAlaSerGluGlySerArgGlnLeu
PheGlyThrTyrGlnSerAspPheGlyLysLysValValLeuSerLeuGlyThrProIleGluTyrGluSerPro
LeuValSerAspAlaLysAsnLeuAlaValTrpGlyLeuGluThrLeuIleThrArgLysLeuGlyAsnLeuAlaThr
GlyValLysThrSerLeuThrProLysThrAlaAspValGlnArgAsnIleLeuSerGlnSerGluValGlyIle
LysTrpGlyLysGlyIleGluGlyGlnGlyMetProTrpGluAspTyrValGlyLysGlyLeuSerAlaAsnAlaA
ArgLeuProLysAsnPheLysThrPheAspTyrPheAspArgGlyThrGlyThrAlaIleSerAlaLysThrLeuAsp
ThrGlnThrThrAlaArgLeuSerLysProGluGlnLeuTyrSerThrMetLysGlyTyrIleAspLysThrAla
AsnPheLysSerTyrGluLeuSerGluValProLeuArgAlaAspMetIleLysGlnArgGluIleHisLeuAla
IleProAlaGlnThrAsnLysGluGlnArgLeuGlnLeuGlnArgValValGluTyrGlyLysSerGlnAsnIleThrValLysIleThrGluIleGlu-260
Hydrophilic Regions - Hopp-Woods (SEQ. ID. NO. 12042)
1-MetGlyLeuGlyAlaThrThrPheValGlySerGlyAlaIleGlyGlyGlyLeuCysSerThrGlyIleGlyCys
AlaAlaGlyGlyLeuIleAlaThrAlaGlyMetThrGlyGlyTyrThrGlnAlaSerGluGlySerArgGlnLeu
PheGlyThrTyrGlnSerAspPheGlyLysLysValValLeuSerLeuGlyThrProIleGluTyrGluSerPro
LeuValSerAspAlaLysAsnLeuAlaValTrpGlyLeuGluThrLeuIleThrArgLysLeuGlyAsnLeuAlaThr
GlyValLysThrSerLeuThrProLysThrAlaAspValGlnArgAsnIleLeuSerGlnSerGluValGlyIle
LysTrpGlyLysGlyIleGluGlyGlnGlyMetProTrpGluAspTyrValGlyLysGlyLeuSerAlaAsnAla
ArgLeuProLysAsnPheLysThrPheAspTyrPheAspArgGlyThrGlyThrAlaIleSerAlaLysThrLeuAsp
ThrGlnThrThrAlaArgLeuSerLysProGluGlnLeuTyrSerThrMetLysGlyTyrIleAspLysThrAla
AsnPheLysSerTyrGluLeuSerGluValProLeuArgAlaAspMetIleLysGlnArgGluIleHisLeuAla
IleProAlaGlnThrAsnLysGluGlnArgLeuGlnLeuGlnArgValValGluTyrGlyLysSerGlnAsnIleThrValLysIleThrGluIleGlu-260
774
AMPHI Regions - AMPHI
SEQ. ID. NO. 12043  1-MetLysIleLysLeuProLeuPheIleIleTrpLeuSerValSerAlaSerCysAlaSerValSerProValProAlaGlySerGlnThrGluMetSerThr
ArgGluAsnAlaSerAspGlyIleProTyrProValProThrLeuGlnAspArgLeuAspTyrLeuGluGlyLysIleValArgLeuSerAsnGluValGlu
ThrLeuAsnGlyLysValLysAlaLeuGluHisAlaLysThrHisSerSerGlyArgAlaTyrValGlnLysLeuAspAspArgLysLeuLysGluHisTyr
LeuAsnThrGluGlyGlySerAlaSerAlaHisThrValGluThrAlaGlnAsnLeuTyrAsnGlnAlaLeuLysHisTyrLysSerGlyLysPheSerAla
AlaAlaSerLeuLeuLysGlyAlaAspGlyGlySerIleAlaGlnArgSerMetTyrLeuLeuLeuGlnSerArgAlaArgMetGlyAsnCys
GluSerValIleGluIleGlyGlyArgTyrAlaAsnArgPheLysAspSerProThrAlaProGluAlaMetPheLysIleGlyGluCysGlnTyrArgLeu
GlnGlnLysAspIleAlaArgAlaThrTrpArgSerLeuIleGlnThrTyrProGlySerProAlaAlaLysArgAlaAlaAlaValArgLysArg-237
Antigenic Index - Jameson-Wolf (SEQ. ID. NO. 12043)
1-MetLysIleLysLeuProLeuPheIleIleTrpLeuSerValSerAlaSerCysAlaSerValSerProValPro
AlaGlySerGlnThrGluMetSerThrArgGluAsnAlaSerAspGlyIleProTyrProValProThrLeuGln
AspArgLeuAspTyrLeuGluGlyLysIleValArgLeuSerAsnGluValGluThrLeuAsnGlyLysValLys
AlaLeuGluHisAlaLysThrHisSerSerGlyArgAlaTyrValGlnLysLeuAspAspArgLysLeuLysGluHis
TyrLeuAsnThrGluGlyGlySerAlaSerAlaHisThrValGluThrAlaGlnAsnLeuTyrAsnGlnAlaLeu
LysHisTyrLysSerGlyLysPheSerAlaAlaAlaSerLeuLeuLysGlyAlaAspGlyGlyAspGlyGlySer
IleAlaGlnArgSerMetTyrLeuLeuLeuGlnSerArgAlaArgMetGlyAsnCysGluSerValIleGluIleGly
GlyArgTyrAlaAsnArgPheLysAspSerProThrAlaProGluAlaMetPheLysIleGlyGluCysGlnTyr
ArgLeuGlnGlnLysAspIleAlaArgAlaThrTrpArgSerLeuIleGlnThrTyrProGlySerProAlaAlaLysArgAlaAlaAlaValArgLysArg-237
Hydrophilic Regions - Hopp-Woods (SEQ. ID. NO. 12043)
1-MetLysIleLysLeuProLeuPheIleI-
leTrpLeuSerValSerAlaSerCysAlaSerValSerProValProAlaGlySerGlnThrGluMetSerThrArgGluAsnAlaSerAspGlyIleProTyrPro
ValProThrLeuGlnAspArgLeuAspTyrLeuGluGlyLysIleValArgLeuSerAsnGluValGluThrLeuAsnGly
LysValLysAlaLeuGluHisAlaLysThrHisSerSerGlyArgAlaTyrValGlnLysLeuAspAspArgLysLeuLys
GluHisTyrLeuAsnThrGluGlyGlySerAlaSerAlaHisThrValGluThrAlaGlnAsnLeuTyrAsnGlnAlaLeu
LysHisTyrLysSerGlyLysPheSerAlaAlaAlaSerLeuLeuLysGlyAlaAspGlyGlyAspGlyGlySerIleAla
GlnArgSerMetTyrLeuLeuLeuGlnSerArgAlaArgMetGlyAsnCysGluSerValIleGluIleGlyGlyArgTyr TABLE 1-continued AlaAsnArgPheLysAspSerProThrAlaProGluAlaMetPheLysIleGlyGluCysGlnTyrArgLeuGlnGlnLys
AspIleAlaArgAlaThrTrpArgSerLeuIleGlnThrTyrProGlySerProAlaAlaLysArgAlaAlaAlaAlaVal
ArgLysArg-237
790
AMPHI Regions - AMPHI
SEQ. ID. NO. 12044    10-GluAlaAlaAlaGluVal-15
SEQ. ID. NO. 12045    44-GlyAsnGlnThrCysSerArgTyrSerAsn-53
SEQ. ID. NO. 12046    89-LysGlnAlaValThr-93
SEQ. ID. NO. 12047    103-ThrGlnAlaTyrAsnGluMetThrLysSerVal-113
SEQ. ID. NO. 12048    166-PheAlaArgThrGlyLysLeu-172
SEQ. ID. NO. 12049    174-GlySerPheAspLeuPheAlaSerVal-182
SEQ. ID. NO. 12050    253-ProSerGluAlaPheAspLeuProGluGlySerThr-264
SEQ. ID. NO. 12051    320-PheLeuArgPheTrpGlnAlaThrArgGlyIle-330
Antigenic Index - Jameson-Wolf
SEQ. ID. NO. 12052    1-MetAlaArgArgSerLysThrPheGluGluAlaAlaAlaGluValGluGluArgPheGlyHisArgGlyIleLys-25
SEQ. ID. NO. 12053    30-GluGlyThrAlaLysProCysVal-37
SEQ. ID. NO. 12054    39-AsnCysProLysHisGlyAsnGlnThrCysSerArgTyrSer-52
SEQ. ID. NO. 12055    57-GlySerSerTrpGlyCysProSerCysGlyAsnGluGlnAlaAla-71
SEQ. ID. NO. 12056    77-ThrLeuArgLysAsnHisIle-83
SEQ. ID. NO. 12057    95-MetThrLysGlnGluArgIleThr-102
SEQ. ID. NO. 12058    123-AspValGlnGlyAspThrThrIle-130
SEQ. ID. NO. 12059    134-HisThrHisThrHisAsnHisSerAspAlaAspGlyLysAlaLeuSer-149
SEQ. ID. NO. 12060    152-LeuThrProArgProLeuLeuSerAspArgGlnAla-163
SEQ. ID. NO. 12061    167-AlaArgThrGlyLysLeuThrGly-174
SEQ. ID. NO. 12062    194-MetProAspThrSerMet-199
SEQ. ID. NO. 12063    201-ProValIleGluLysGlyAsp-207
SEQ. ID. NO. 12064    213-ProArgMetCysProAlaAspGluAspIleAla-223
SEQ. ID. NO. 12065    226-GluLeuSerAspLysArgLeuVal-233
SEQ. ID. NO. 12066    248-TyrGlnThrGlyArgProSerGluAlaPheAspLeuProGluGlySerThr-264
SEQ. ID. NO. 12067    270-LeuGluSerLysAsnGlyLeuCysProProHisArgGlnGluGlyVal-285
SEQ. ID. NO. 12068    301-SerAlaSerLysThrSerCysThrArgProThrAlaAlaArgLysSerAla-317
SEQ. ID. NO. 12069    326-AlaThrArgGlyIleProLysThrArgSerTrpArgAsnProAsnAsnAla-342
Hydrophilic Regions - Hopp-Woods
SEQ. ID. NO. 12070    1-MetAlaArgArgSerLysThrPheGluGluAlaAlaAlaGluValGluGluArgPheGlyHisArgGlyIleLys-25
SEQ. ID. NO. 12071    65-CysGlyAsnGluGlnAlaAla-71
SEQ. ID. NO. 12072    77-ThrLeuArgLysAsnHisIle-83
SEQ. ID. NO. 12073    96-ThrLysGlnGluArgIleThr-102
SEQ. ID. NO. 12074    139-AsnHisSerAspAlaAspGlyLysAlaLeuSer-149
SEQ. ID. NO. 12075    157-LeuLeuSerAspArgGlnAla-163
SEQ. ID. NO. 12076    168-ArgThrGlyLysLeu-172
SEQ. ID. NO. 12077    202-ValIleGluLysGlyAsp-207
SEQ. ID. NO. 12078    213-ProArgMetCysProAlaAspGluAspIleAla-223
SEQ. ID. NO. 12079    226-GluLeuSerAspLysArgLeuVal-233
SEQ. ID. NO. 12080    251-GlyArgProSerGluAlaPheAspLeuProGlu-261
SEQ. ID. NO. 12081    270-LeuGluSerLysAsnGlyLeu-276
SEQ. ID. NO. 12082    280-HisArgGlnGluGlyVal-285
SEQ. ID. NO. 12083    303-SerLysThrSerCysThrArgProThrAlaAlaArgLysSerAla-317
SEQ. ID. NO. 12084    328-ArgGlyIleProLysThrArgSerTrpArgAsn-338
900-2
AMPHI Regions - AMPHI
SEQ. ID. NO. 12085    9-ValValAlaPheAlaArgPhe-15
SEQ. ID. NO. 12086    36-ValGlyLysHisPheArgLysPheHisArgPheArgArgArgGlyGlu-51
SEQ. ID. NO. 12087    53-PheValAspPheLysGlnTrpAlaPheValGlyLeuPheArgLeuAlaArgLeuPheHisIleGlyAspAspPheValAspArgPheLeuGlyPhePhe-85
SEQ. ID. NO. 12088    121-GlyGluGluPheProGluAlaValValGluAlaAlaGlyAspValAlaArgHisPheAspValLeuAspLeuVal-145
SEQ. ID. NO. 12089    161-SerHisGlnAsnArgIle-166
SEQ. ID. NO. 12090    198-HisGlnThrLeuGlySerAspAlaGly-206
SEQ. ID. NO. 12091    210-ValGlnPheHisHisPheGly-216
SEQ. ID. NO. 12092    233-GlyLysProSerGlyGlyAsnGlyLeuGlyGlyLeuValAsnHisLeuArgLeuValAla-252
SEQ. ID. NO. 12093    268-IleGluValLeuArgArgAlaAspGlyGly-277
SEQ. ID. NO. 12094    279-AspGlyAlaAspValValAlaGlnMet-287
Antigenic Index - Jameson-Wolf
SEQ. ID. NO. 12095    1-LeuArgArgValGlyGlyGln-7
SEQ. ID. NO. 12096    19-GlyValAspPheArgArgGlnLysPhePheGlyPheThrProArgGlnAlaVal-36
SEQ. ID. NO. 12097    38-LysHisPheArgLysPheHisArgPheArgArgArgGlyGluGly-52
SEQ. ID. NO. 12098    74-GlyAspAspPheValAspArg-80
SEQ. ID. NO. 12099    88-PheProLysArgAsnGlyValAla-95
SEQ. ID. NO. 12100    103-SerValGlnThrAspGlnGluPhe-110
SEQ. ID. NO. 12101    118-PheGlyGlnGlyGluGluPheProGlu-126
SEQ. ID. NO. 12102    131-AlaAlaGlyAspValAlaArg-137
SEQ. ID. NO. 12103    145-ValAlaProAspGly-149
SEQ. ID. NO. 12104    157-GlnAsnIleGlySerHisGlnAsnArgIleThrGluGlnThrHisPhe-172
SEQ. ID. NO. 12105    201-LeuGlySerAspAlaGlyGlnAsnProVal-210
SEQ. ID. NO. 12106    230-GluSerAlaGlyLysProSerGlyGlyAsnGly-240
SEQ. ID. NO. 12107    252-AlaPheAspAspThrValValIleGlyGluGluGluGluGlyPheGly-267
SEQ. ID. NO. 12108    270-ValLeuArgArgAlaAspGlyGlyAlaAspGlyAlaAsp-282
SEQ. ID. NO. 12109    285-AlaGlnMetArgAspAlaGlyGlyGlyTyrAlaGly-296
SEQ. ID. NO. 12110    311-MetProSerGluArgGluLysAspValProIle-321
SEQ. ID. NO. 12111    323-ProAspLeuProProThrSerSerArgGlnGlnThr-334

TABLE 1-continued

Hydrophilic Regions - Hopp-Woods
SEQ. ID. NO. 12112   1-LeuArgArgValGly-5
SEQ. ID. NO. 12113   20-ValAspPheArgArgGlnLys-26
SEQ. ID. NO. 12114   38-LysHisPheArgLysPheHisArgPheArgArgArgGlyGluGly-52
SEQ. ID. NO. 12115   89-ProLysArgAsnGly-93
SEQ. ID. NO. 12116   105-GlnThrAspGlnGluPhe-110
SEQ. ID. NO. 12117   120-GlnGlyGluGluPhePro-125
SEQ. ID. NO. 12118   131-AlaAlaGlyAspValAlaArg-137
SEQ. ID. NO. 12119   162-HisGlnAsnArgIleThrGlu-168
SEQ. ID. NO. 12120   201-LeuGlySerAspAlaGlyGln-207
SEQ. ID. NO. 12121   231-SerAlaGlyLysProSerGly-237
SEQ. ID. NO. 12122   257-ValValIleGlyGluGluGluGluGlyPheGly-267
SEQ. ID. NO. 12123   270-ValLeuArgArgAlaAspGlyGlyAlaAspGlyAlaAsp-282
SEQ. ID. NO. 12124   285-AlaGlnMetArgAspAlaGly-291
SEQ. ID. NO. 12125   311-MetProSerGluArgGluLysAspValProIle-321
SEQ. ID. NO. 12126   326-ProProThrSerSerArgGlnGln-333
901-2
AMPHI Regions - AMPHI
SEQ. ID. NO. 12127   20-GlyLeuPheThrValLeuGly-26
SEQ. ID. NO. 12128   55-ValSerLeuThrGluIlePheSerLysSer-64
SEQ. ID. NO. 12129   66-GluAlaPheAlaGluIleTyrAsp-73
SEQ. ID. NO. 12130   84-AlaPheLeuAlaGlyMetGlyGlyIleAlaLeuIle-95
SEQ. ID. NO. 12131   97-ArgLeuValProAsnProHisGluThrLeuAsp-107
SEQ. ID. NO. 12132   124-ValGlyMetMetAlaAlaPhe-130
SEQ. ID. NO. 12133   136-AsnPheProGluGlyLeuAlaThrPhePheAlaThrLeuGlu-149
SEQ. ID. NO. 12134   164-HisAsnIleProGluGlyIleSer-171
SEQ. ID. NO. 12135   190-CysLeuLeuSerGlyLeuAlaGluProLeuGlyAlaAla-202
SEQ. ID. NO. 12136   217-PheGlySerValPheGlyValIleAlaGlyValMet-228
SEQ. ID. NO. 12137   143-TyrSerAspGlyHisGlu-248
Antigenic Index - Jameson-Wolf
SEQ. ID. NO. 12138   1-MetProAspPheSerMet-6
SEQ. ID. NO. 12139   33-SerLysThrProAsnProArgVal-40
SEQ. ID. NO. 12140   61-PheSerLysSerSerGluAlaPhe-68
SEQ. ID. NO. 12141   71-IleTyrAspLysAspHisAla-77
SEQ. ID. NO. 12142   98-LeuValProAsnProHisGluThrLeuAspAlaGlnAspProSerPheGlnGluSerLysArgArgHisIleAla-122
SEQ. ID. NO. 12143   136-AsnPheProGluGly-140
SEQ. ID. NO. 12144   179-AlaThrArgSerArgLysLysThr-186
SEQ. ID. NO. 12145   193-SerGlyLeuAlaGluProLeuGly-200
SEQ. ID. NO. 12146   235-GluLeuLeuProAlaAlaLysArgTyrSerAspGlyHisGluThr-249
Hydrophilic Regions - Hopp-Woods
SEQ. ID. NO. 12147   61-PheSerLysSerSerGluAlaPhe-68
SEQ. ID. NO. 12148   71-IleTyrAspLysAspHisAla-77
SEQ. ID. NO. 12149   102-ProHisGluThrLeuAspAlaGlnAspProSerPheGlnGluSerLysArgArgHisIleAla-122
SEQ. ID. NO. 12150   180-ThrArgSerArgLysLysThr-186
SEQ. ID. NO. 12151   235-GluLeuLeuProAlaAlaLysArgTyrSerAspGlyHisGlu-248
902
AMPHI Regions - AMPHI
SEQ. ID. NO. 12152   1-LeuHisPheGlnArgIleIleLysCysSerGluGlyIleTrpAlaValGlyAlaArgProThrValGlyPhePheGlyLysSerPheLysIleThrCysLys
HisValValLeuArgArgArgThrValGlnAlaValAspPheThrThrCysLeuPheAlaValGlyHisPheValAspValProAlaTyrValPheAlaCysAsp
AlaHisThrGlyGlyValAlaValLysArgValTyrGlyAlaAspValValGlnAsnSerGlyGlyAlaPheCysGlnThrGlnGlyArgArgGlnAsnThr
ValPheGlyIleMetPheGlnIleAlaGluGluProArgProAlaLeuArgAlaAlaProTyrHisAsnAlaValGlyGlyGlyLeuPheGluAspGlyLeuGly
PheLeuArgArgSerAsnValAlaValAspProAspArgAspValGlnThrAlaPheGlyPheGlyAspGluPheValThrArgPheAlaPheValHisLeu
ArgThrArgAlaSerValAspGlyLysGlyGlyAspAlaAlaIlePheGlyAspPheGlyAspAspGlyGlnValLeuMetValValValProThrGlnThrGly
PheGluGlyAsnGlyTyrAlaCysArgThrAspAspGlyPheGlnAsnGlyGlyAsnGlnArgLeuValLeuHisGlnArgAlaThrGlyLeuAspIleAla
AspPhePheSerGlyThrAlaHisValAspValAspLysLeuArgProLysAlaAspValValThrArgGlyIleArgHisLeuLeuArgIleAlaSerGlyAsn
LeuHisGlyAsnAsnAlaAlaPheIleGlyLysIleAlaAlaValGlnGlyPheSerSerIleSerGluArgArgValAlaGlyGlnHisPheAlaHisArgPro
ThrCysAlaLysIleSerAlaLysSerAlaGluArgPheValGlyAsnAlaArgHisArgArgLysCysAspGlyValValAspLysIleAlaAlaAspValHis
AsnGlySerAlaPheGlnLysSerThrProLeuTyrIlePhe-360
Antigenic Index - Jameson-Wolf (SEQ. ID. NO. 12153)
1-LeuHisPheGlnArgIleIleLysCysSerGluGlyIleTrpAlaValGlyAlaArgProThrValGlyPhePhe
GlyLysSerPheLysIleThrCysLysHisValValLeuArgArgArgThrValGlnAlaValAspPheThrThr
CysLeuPheAlaValGlyHisPheValAspValProAlaTyrValPheAlaCysAspAlaHisThrGlyGlyVal
AlaValLysArgValTyrGlyAlaAspValValGlnAsnSerGlyGlyAlaPheCysGlnThrGlnGlyArgArgGln
AsnThrValPheGlyIleMetPheGlnIleAlaGluGluProArgProAlaLeuArgAlaAlaProTyrHisAsn
AlaValGlyGlyGlyLeuPheGluAspGlyLeuGlyPheLeuArgArgSerAsnValAlaValAspProAspArgAsp
ValGlnThrAlaPheGlyPheGlyAspGluPheValThrArgPheAlaPheValHisLeuArgThrArgAlaSer
ValAspGlyLysGlyGlyAspAlaAlaIlePheGlyAspPheGlyAspAspGlyGlnValLeuMetValValVal
ProThrGlnThrGlyPheGluGlyAsnGlyTyrAlaCysArgThrAspAspGlyPheGlnAsnGlyGlyAsnGlnArg
LeuValLeuHisGlnArgAlaThrGlyLeuAspIleAlaAspPhePheSerGlyThrAlaHisValAspValAsp
LysLeuArgProLysAlaAspValValThrArgGlyIleArgHisLeuLeuArgIleAlaSerGlyAsnLeuHis
GlyAsnAsnAlaAlaPheIleGlyLysIleAlaAlaValGlnGlyPheSerSerIleSerGluArgArgValAla
GlyGlnHisPheAlaHisArgProThrCysAlaLysIleSerAlaLysSerAlaGluArgPheValGlyAsnAlaArg
HisArgArgLysCysAspGlyValValAspLysIleAlaAlaAspValHisAsnGlySerAlaPheGlnLysSerThrProLeuTyrIlePhe-360
Hydrophilic Regions - Hopp-Woods (SEQ. ID. NO. 12153)
1-LeuHisPheGlnArgIleIleLysCysSerGluGlyIleTrpAlaValGlyAlaArgProThrValGlyPhePhe
GlyLysSerPheLysIleThrCysLysHisValValLeuArgArgArgThrValGlnAlaValAspPheThrThr
CysLeuPheAlaValGlyHisPheValAspValProAlaTyrValPheAlaCysAspAlaHisThrGlyGlyVal
AlaValLysArgValTyrGlyAlaAspValValGlnAsnSerGlyGlyAlaPheCysGlnThrGlnGlyArgArgGln
AsnThrValPheGlyIleMetPheGlnIleAlaGluGluProArgProAlaLeuArgAlaAlaProTyrHisAsn TABLE 1-continued

```
AlaValGlyGlyGlyLeuPheGluAspGlyLeuGlyPheLeuArgArgSerAsnValAlaValAspProAspArg
AspValGlnThrAlaPheGlyPheGlyAspGluPheValThrArgPheAlaPheValHisLeuArgThrArgAlaSer
ValAspGlyLysGlyGlyAspAlaAlaIlePheGlyAspPheGlyAspAspGlyGlnValLeuMetValValVal
ProThrGlnThrGlyPheGluGlyAsnGlyTyrAlaCysArgThrAspAspGlyPheGlnAsnGlyGlyAsnGln
ArgLeuValLeuHisGlnArgAlaThrGlyLeuAspIleAlaAspPhePheSerGlyThrAlaHisValAspValAsp
LysLeuArgProLysAlaAspValValThrArgGlyIleArgHisLeuLeuArgIleAlaSerGlyAsnLeuHis
GlyAsnAsnAlaAlaPheIleGlyLysIleAlaAlaValGlnGlyPheSerSerIleSerGluArgArgValAla
GlyGlnHisPheAlaHisArgProThrCysAlaLysIleSerAlaLysSerAlaGluArgPheValGlyAsnAlaArg
HisArgArgLysCysAspGlyValValAspLysIleAlaAlaAspValHisAsnGlySerAlaPheGlnLysSerThrProLeuTyrIlePhe-360
```

903-2
AMPHI Regions - AMPHI
SEQ. ID. NO. 12153    29-GluLeuIleArgSerMetGlnArgGln-37
SEQ. ID. NO. 12154    109-AsnLeuSerArgLeuGlnLysAla-116
SEQ. ID. NO. 12155    191-GluGlnGlyLeuGluAsnLeuArgArgLeuProSerVal-203
SEQ. ID. NO. 12156    240-GlyGlyLysThrThrGlyLysTyr-247
SEQ. ID. NO. 12157    262-SerAspLeuPheTyr-266
SEQ. ID. NO. 12158    315-ArgTyrHisGluAlaThrGlu-321
SEQ. ID. NO. 12159    360-ThrArgGlnThrTyrLysTyrIleAspAsp-369
SEQ. ID. NO. 12160    560-HisLysProLysGlyPheGlnThrThrAsnThr-570
Antigenic Index - Jameson-Wolf
SEQ. ID. NO. 12161    21-LeuAlaAlaAspGluAsnAspAlaGluLeuIleArgSerMetGlnArgGlnGlnHisIleAsp-41
SEQ. ID. NO. 12162    48-AlaAsnValArgPheGluGlnProLeuGluLysAsnAsnTyrValLeuSerGluAspGluThrProCysThrArg-72
SEQ. ID. NO. 12163    77-SerLeuAspAspLysThrValArg-84
SEQ. ID. NO. 12164    106-GlySerAsnAsnLeuSerArgLeuGlnLysAlaAla-117
SEQ. ID. NO. 12165    135-ProGlnAsnMetAspSerGlyIleLeu-143
SEQ. ID. NO. 12166    146-ArgValSerAlaGlyGluIleGlyAspIleArgTyrGluGluLysArgAspGlyLysSerAlaGluGlySerIle-170
SEQ. ID. NO. 12167    178-ProLeuTyrArgAsnLysIleLeuAsn-186
SEQ. ID. NO. 12168    188-ArgAspValGluGlnGlyLeuGluAsnLeuArgArgLeuProSerValLysThrAspIle-207
SEQ. ID. NO. 12169    210-IleProSerGluGluGluGlyLysSerAspLeu-220
SEQ. ID. NO. 12170    223-LysTrpGlnGlnAsnLysProIleArg-231
SEQ. ID. NO. 12171    234-IleGlyIleAspAspAlaGlyGlyLysThrThrGlyLysTyrGlnGly-249
SEQ. ID. NO. 12172    256-AspAsnProLeuGly-260
SEQ. ID. NO. 12173    269-TyrGlyArgGlyLeuAlaHisLysThrAspLeuThrAspAlaThrGlyThrGluThrGluSerGlySerArgSerTyr-294
SEQ. ID. NO. 12174    309-PheAsnHisAsnGlyHisArgTyrHisGluAlaThrGluGlyTyrSerValAsnTyrAspTyrAsnGlyLysGlnTyrGln-335
SEQ. ID. NO. 12175    343-MetLeuTrpArgAsnArgLeuHisLysThrSerVal-354
SEQ. ID. NO. 12176    362-GlnThrTyrLysTyrIleAspAspAlaGluIleGluValGlnArgArgArgSerAlaGlyTrpGluAlaGluLeuArgHis-388
SEQ. ID. NO. 12177    395-TrpGlnLeuAspGlyLysLeuSerTyrLysArgGlyThrGlyMetArgGlnSerMetProAlaProGluGluAsnGlyGlyAspIleLeuProGlyThrSerArgMetLysIle-432
SEQ. ID. NO. 12178    459-GlnTrpAsnLysThrPro-464
SEQ. ID. NO. 12179    467-AlaGlnAspLysLeuSerIleGlySerArgTyrThrValArgGlyPheAspGlyGluGlnSerLeuPheGlyGluArgGlyPheTyrTrpGlnAsnThr-499
SEQ. ID. NO. 12180    514-AlaAspTyrGlyArgValSerGlyGluSerAla-524
SEQ. ID. NO. 12181    527-ValSerGlyLysGln-531
SEQ. ID. NO. 12182    539-PheArgGlyGlyHisLysValGly-546
SEQ. ID. NO. 12183    557-LysProLeuHisLysProLysGlyPheGln-566
Hydrophilic Regions - Hopp-Woods
SEQ. ID. NO. 12184    21-LeuAlaAlaAspGluAsnAspAlaGluLeuIleArgSerMetGlnArgGlnGlnHisIleAsp-41
SEQ. ID. NO. 12185    48-AlaAsnValArgPheGluGlnProLeuGluLysAsnAsn-60
SEQ. ID. NO. 12186    63-LeuSerGluAspGluThrProCys-70
SEQ. ID. NO. 12187    77-SerLeuAspAspLysThrValArg-84
SEQ. ID. NO. 12188    109-AsnLeuSerArgLeuGlnLysAlaAla-117
SEQ. ID. NO. 12189    151-GluIleGlyAspIleArgTyrGluGluLysArgAspGlyLysSerAlaGluGlySer-169
SEQ. ID. NO. 12190    188-ArgAspValGluGlnGlyLeuGluAsnLeuArgArgLeuProSerValLysThrAspIle-207
SEQ. ID. NO. 12191    211-ProSerGluGluGluGlyLysSerAspLeu-220
SEQ. ID. NO. 12192    234-IleGlyIleAspAspAlaGlyGlyLysThrThrGlyLysTyr-247
SEQ. ID. NO. 12193    273-LeuAlaHisLysThrAspLeuThrAsp-281
SEQ. ID. NO. 12194    283-ThrGlyThrGluThrGluSerGlySerArgSer-293
SEQ. ID. NO. 12195    315-ArgTyrHisGluAlaThrGlu-321
SEQ. ID. NO. 12196    366-TyrIleAspAspAlaGluIleGluValGlnArgArgArgSerAlaGlyTrp-382
SEQ. ID. NO. 12197    384-AlaGluLeuArgHis-388
SEQ. ID. NO. 12198    399-GlyLysLeuSerTyrLysArgGlyThrGlyMetArgGlnSerMetProAlaProGluGluAsnGlyGly-421
SEQ. ID. NO. 12199    428-SerArgMetLysIle-432
SEQ. ID. NO. 12200    467-AlaGlnAspLysLeuSerIle-473
SEQ. ID. NO. 12201    481-GlyPheAspGlyGluGln-486
SEQ. ID. NO. 12202    515-AspTyrGlyArgValSerGlyGluSer-523
SEQ. ID. NO. 12203    558-ProLeuHisLysProLysGly-564
904-2
AMPHI Regions - AMPHI
SEQ. ID. NO. 12204    23-AspPhePheAsnProPheGlnIleCysPheGlyValPheGlyGlnCysAla-39
SEQ. ID. NO. 12205    55-PheValAsnArgLeuAlaGlyPheHisArgIleGly-66
SEQ. ID. NO. 12206    89-PheAsnAlaValHisTyrIleGluPhe-97
SEQ. ID. NO. 12207    131-GluPheValSerAlaPheCysGlnThrTyr-140
SEQ. ID. NO. 12208    164-AlaGlnAsnIleIleGlnHisLeuArgThrTyrAlaArgAlaCysArgSerCysAlaArgGln-184
SEQ. ID. NO. 12209    193-IleSerAlaValValAspVal-199
SEQ. ID. NO. 12210    202-ArgThrLeuArgAlaPhe-207
SEQ. ID. NO. 12211    250-GlyIleValGlnMetLeu-255
SEQ. ID. NO. 12212    267-GlnPhePheThrGlnPhePheArgMetGlnGlnIleGlyGlyAlaAsn-282
SEQ. ID. NO. 12213    308-ArgCysPheAlaGlyLeuValGlu-315
SEQ. ID. NO. 12214    332-ThrAlaPheAspValPheHisAlaCys-340
SEQ. ID. NO. 12215    364-ValGlnThrPheMetGlnAspAla-371

TABLE 1-continued

| | |
|---|---|
| SEQ. ID. NO. 12216 | 390-ArgIleValAlaAlaLeu-395 |
| SEQ. ID. NO. 12217 | 402-GlyPhePheArgGlnProValAsn-409 |
| SEQ. ID. NO. 12218 | 418-ProLeuCysAlaAspTyrTyrAsnIlePheSerHis-429 |

Antigenic Index - Jameson-Wolf

| | |
|---|---|
| SEQ. ID. NO. 12219 | 11-GlyAlaGlyGlyAspAspGlyAspArgArgAlaAlaAsp-23 |
| SEQ. ID. NO. 12220 | 66-GlyThrAlaArgGlnAspVal-72 |
| SEQ. ID. NO. 12221 | 84-AlaAspIleAspGly-88 |
| SEQ. ID. NO. 12222 | 98-SerAsnThrHisThrGlyAsn-104 |
| SEQ. ID. NO. 12223 | 106-ValAspLeuAspGly-110 |
| SEQ. ID. NO. 12224 | 114-GlyGlyGlyIleLys-118 |
| SEQ. ID. NO. 12225 | 126-SerGlyTyrArgThrGluPhe-132 |
| SEQ. ID. NO. 12226 | 147-PheGlyArgGluArgAlaArgThrAspAlaArgGlyIleGlyPheAspAspAlaGln-165 |
| SEQ. ID. NO. 12227 | 173-ThrTyrAlaArgAlaCysArgSerCysAlaArgGlnThrValGlyArgGlyAsnGluGlyIle-193 |
| SEQ. ID. NO. 12228 | 199-ValGlnGlnArgThrLeuArgAlaPheLys-208 |
| SEQ. ID. NO. 12229 | 224-HisValGlyAsnHisArgArgAsnAlaArgArgAspPhePheAspAsnArgHisHis-242 |
| SEQ. ID. NO. 12230 | 261-IleGlyLysAspGlyIle-266 |
| SEQ. ID. NO. 12231 | 279-GlyGlyAlaAsnGly-283 |
| SEQ. ID. NO. 12232 | 293-ArgAlaAspAlaAlaAlaGlyArgAla-301 |
| SEQ. ID. NO. 12233 | 314-ValGluArgAspValValArgGlnAspGlnArgAlaGlyArgArgAspPheGlnThr-332 |
| SEQ. ID. NO. 12234 | 351-GlyPheGlyGlyAspAspAsnAlaArgThrAspGluAlaVal-364 |
| SEQ. ID. NO. 12235 | 370-AspAlaAlaArgAsnGlnAlaGlnAsnGly-379 |
| SEQ. ID. NO. 12236 | 384-AspAsnGlnGlyMet-388 |
| SEQ. ID. NO. 12237 | 407-ProValAsnAspPhe-411 |

Hydrophilic Regions - Hopp-Woods

| | |
|---|---|
| SEQ. ID. NO. 12238 | 12-AlaGlyGlyAspAspGlyAspArgArgAlaAlaAsp-23 |
| SEQ. ID. NO. 12239 | 66-GlyThrAlaArgGlnAspVal-72 |
| SEQ. ID. NO. 12240 | 84-AlaAspIleAspGly-88 |
| SEQ. ID. NO. 12241 | 147-PheGlyArgGluArgAlaArgThrAspAlaArgGlyIleGlyPheAspAspAlaGln-165 |
| SEQ. ID. NO. 12242 | 173-ThrTyrAlaArgAlaCysArgSerCysAlaArg-183 |
| SEQ. ID. NO. 12243 | 185-ThrValGlyArgGlyAsnGluGly-192 |
| SEQ. ID. NO. 12244 | 199-ValGlnGlnArgThrLeuArgAlaPheLys-208 |
| SEQ. ID. NO. 12245 | 226-GlyAsnHisArgArgAsnAlaArgArgAspPhePheAspAsnArgHisHis-242 |
| SEQ. ID. NO. 12246 | 261-IleGlyLysAspGly-265 |
| SEQ. ID. NO. 12247 | 293-ArgAlaAspAlaAlaAlaGlyArgAla-301 |
| SEQ. ID. NO. 12248 | 314-ValGluArgAspValValArgGlnAspGlnArgAlaGlyArgArgAspPheGlnThr-332 |
| SEQ. ID. NO. 12249 | 352-PheGlyGlyAspAspAsnAlaArgThrAspGluAlaVal-364 |
| SEQ. ID. NO. 12250 | 370-AspAlaAlaArgAsnGlnAla-376 |

907-2
AMPHI Regions - AMPHI

| | |
|---|---|
| SEQ. ID. NO. 12251 | 42-AspAspValAlaSerValMetArgSer-50 |
| SEQ. ID. NO. 12252 | 66-LysGluGlyGluArgTrpLeuSerAlaMetSer-76 |
| SEQ. ID. NO. 12253 | 78-ArgLeuAlaArgPheVal-83 |
| SEQ. ID. NO. 12254 | 129-GlyAlaArgGlyLeu-133 |
| SEQ. ID. NO. 12255 | 142-AsnTyrIleGlyLysProAlaHis-149 |
| SEQ. ID. NO. 12256 | 165-LeuArgHisTyrArgAsnLeuGluLysGlyAsn-175 |
| SEQ. ID. NO. 12257 | 177-ValArgAlaLeuAlaArgPheAsnGly-185 |

Antigenic Index - Jameson-Wolf

| | |
|---|---|
| SEQ. ID. NO. 12258 | 1-MetArgLysProThrAspThrLeuPro-9 |
| SEQ. ID. NO. 12259 | 12-LeuGlnArgArgArgLeuLeu-18 |
| SEQ. ID. NO. 12260 | 33-GlyAlaGlnArgGluGluThrLeuAlaAspAspValAlaSer-46 |
| SEQ. ID. NO. 12261 | 51-SerValGlySerValAsnProProArgLeuValPheAspAsnProLysGluGlyGluArgTrp-71 |
| SEQ. ID. NO. 12262 | 83-ValProGluGluGluGluArgArgArgLeu-92 |
| SEQ. ID. NO. 12263 | 97-GlnTyrGluSerSerArgAlaGlyLeu-105 |
| SEQ. ID. NO. 12264 | 115-GluValGluSerAlaPhe-120 |
| SEQ. ID. NO. 12265 | 142-AsnTyrIleGlyLysProAlaHisAsn-150 |
| SEQ. ID. NO. 12266 | 155-ArgThrAsnLeuArgTyrGly-161 |
| SEQ. ID. NO. 12267 | 168-TyrArgAsnLeuGluLysGlyAsnIle-176 |
| SEQ. ID. NO. 12268 | 184-AsnGlySerLeuGlySerAsnLysTyrProAsnAla-195 |
| SEQ. ID. NO. 12269 | 200-TrpArgAsnArgTrpGlnTrp-206 |

Hydrophilic Regions - Hopp-Woods

| | |
|---|---|
| SEQ. ID. NO. 12270 | 1-MetArgLysProThrAsp-6 |
| SEQ. ID. NO. 12271 | 12-LeuGlnArgArgArgLeuLeu-18 |
| SEQ. ID. NO. 12272 | 33-GlyAlaGlnArgGluGluThrLeuAlaAspAspValAlaSer-46 |
| SEQ. ID. NO. 12273 | 60-LeuValPheAspAsnProLysGluGlyGluArgTrp-71 |
| SEQ. ID. NO. 12274 | 83-ValProGluGluGluGluArgArgArgLeu-92 |
| SEQ. ID. NO. 12275 | 99-GluSerSerArgAlaGlyLeu-105 |
| SEQ. ID. NO. 12276 | 115-GluValGluSerAlaPhe-120 |
| SEQ. ID. NO. 12277 | 169-ArgAsnLeuGluLysGlyAsnIle-176 |

908-2
AMPHI Regions - AMPHI

| | |
|---|---|
| SEQ. ID. NO. 12278 | 9-TyrLysGlnAsnLys-13 |
| SEQ. ID. NO. 12279 | 26-ThrAlaAlaGluLeu-30 |
| SEQ. ID. NO. 12280 | 127-ThrAspCysTyrArgSerTyrAspValLeuAspValArgGluPheSerHisPheSer-145 |

Antigenic Index - Jameson-Wolf

| | |
|---|---|
| SEQ. ID. NO. 12281 | 1-MetArgLysSerArgLeuSerArgTyrLysGlnAsnLysLeu-14 |
| SEQ. ID. NO. 12282 | 51-GlnAsnSerProHis-55 |
| SEQ. ID. NO. 12283 | 59-PheAspGlyGluValGluAlaAspGluSerTyrPheGlyGlyGlnArgLysGlyLysArgGlyArgGlyAlaAlaGly-84 |
| SEQ. ID. NO. 12284 | 91-LeuLeuLysArgAsnGlyLysVal-98 |
| SEQ. ID. NO. 12285 | 115-IleArgGluGlnValLysProAspSerIleVal-125 |
| SEQ. ID. NO. 12286 | 127-ThrAspCysTyrArgSerTyrAsp-134 |

TABLE 1-continued

```
SEQ. ID. NO. 12287    136-LeuAspValArgGlu-140
SEQ. ID. NO. 12288    161-ArgThrThrLysProTyr-166
Hydrophilic Regions - Hopp-Woods
SEQ. ID. NO. 12289    1-MetArgLysSerArgLeuSerArgTyrLysGlnAsnLysLeu-14
SEQ. ID. NO. 12290    59-PheAspGlyGluValGluAlaAspGluSerTyr-69
SEQ. ID. NO. 12291    72-GlyGlnArgLysGlyLysArgGlyArgGlyAlaAlaGly-84
SEQ. ID. NO. 12292    92-LeuLysArgAsnGlyLys-97
SEQ. ID. NO. 12293    115-IleArgGluGlnValLysProAspSer-123
SEQ. ID. NO. 12294    136-LeuAspValArgGlu-140
909
AMPHI Regions - AMPHI
SEQ. ID. NO. 12295    71-GlyAsnAsnAlaAspGlu-76
Antigenic Index - Jameson-Wolf
SEQ. ID. NO. 12296    22-ThrTyrGlnAspGlyAsnGlyLysThrAlaValArgGlnLysTyrProAlaGly-39
SEQ. ID. NO. 12297    45-GlnAspGlySerTyrSerLysAsnMetAsnTyrAsnGlnTyrArgProGluArgHisAla-64
SEQ. ID. NO. 12298    68-AsnGlnThrGlyAsnAsnAlaAspGluGluHisArgGlnHisTrpGlnLysProLysPheGlnAsnArg-90
Hydrophilic Regions - Hopp-Woods
SEQ. ID. NO. 12299    23-TyrGlnAspGlyAsnGlyLysThrAlaValArgGlnLysTyr-36
SEQ. ID. NO. 12300    58-TyrArgProGluArgHisAla-64
SEQ. ID. NO. 12301    72-AsnAsnAlaAspGluGluHisArgGlnHisTrpGln-83
SEQ. ID. NO. 12302    85-ProLysPheGlnAsnArg-90
910
AMPHI Regions - AMPHI
SEQ. ID. NO. 12303    10-ValSerLeuSerAlaAla-15
SEQ. ID. NO. 12304    22-SerAlaGluArgGlnIle-27
SEQ. ID. NO. 12305    39-LysAlaValLysMetLeuGlu-45
SEQ. ID. NO. 12306    58-AspHisTrpGlyLysPro-63
SEQ. ID. NO. 12307    69-AlaTyrLysAspGlyArg-74
Antigenic Index - Jameson-Wolf
SEQ. ID. NO. 12308    19-AlaGlyAspSerAlaGluArgGlnIleTyrGlyAspProHisPheGluGlnAsnArgThrLysAlaValLysMetLeuGluGlnArgGlyTyrGln-50
SEQ. ID. NO. 12309    53-AspValAspAlaAspAspHisTrpGlyLysProValLeuGlu-66
SEQ. ID. NO. 12310    68-GluAlaTyrLysAspGlyArgGluTyrAsp-77
SEQ. ID. NO. 12311    83-ProAspLeuLysIleIleLysGluGlnLeuAspArg-94
Hydrophilic Regions - Hopp-Woods
SEQ. ID. NO. 12312    21-AspSerAlaGluArgGlnIleTyr-28
SEQ. ID. NO. 12313    31-ProHisPheGluGlnAsnArgThrLysAlaValLysMetLeuGluGlnArgGly-48
SEQ. ID. NO. 12314    53-AspValAspAlaAspAspHisTrpGly-61
SEQ. ID. NO. 12315    68-GluAlaTyrLysAspGlyArgGluTyrAsp-77
SEQ. ID. NO. 12316    86-LysIleIleLysGluGlnLeuAspArg-94
911
AMPHI Regions - AMPHI
SEQ. ID. NO. 12317    6-LeuGluPheTrpValGlyLeuPhe-13
SEQ. ID. NO. 12318    43-ValTyrAlaAspPheGlyAspIleGly-51
SEQ. ID. NO. 12319    97-ValSerAlaGlnIle-101
SEQ. ID. NO. 12320    118-GlyAspThrGluAsnLeuAla-124
SEQ. ID. NO. 12321    140-AsnLeuIleGlyLysPheMetThrSerPhe-149
Antigenic Index - Jameson-Wolf
SEQ. ID. NO. 12322    1-MetLysLysAsnIle-5
SEQ. ID. NO. 12323    35-GlyGlySerAspLysThrTyr-41
SEQ. ID. NO. 12324    48-GlyAspIleGlyGlyLeuLysValAsnAlaProValLys-60
SEQ. ID. NO. 12325    74-LeuAspProLysSerTyrGlnAlaArgValArgLeuAspLeuAspGlyLysTyrGlnPheSerSerAspVal-97
SEQ. ID. NO. 12326    103-ThrSerGlyLeuLeuGly-108
SEQ. ID. NO. 12327    115-GlnGlnGlyGlyAspThrGluAsn-122
SEQ. ID. NO. 12328    149-PheAlaGluLysAsnAlaAspGlyGlyAsnAlaGluLysAlaAlaGlu-164
Hydrophilic Regions - Hopp-Woods
SEQ. ID. NO. 12329    1-MetLysLysAsnIle-5
SEQ. ID. NO. 12330    36-GlySerAspLysThr-40
SEQ. ID. NO. 12331    74-LeuAspProLysSerTyrGlnAlaArgValArgLeuAspLeuAspGly-89
SEQ. ID. NO. 12332    116-GlnGlyGlyAspThrGluAsn-122
SEQ. ID. NO. 12333    149-PheAlaGluLysAsnAlaAspGlyGlyAsnAlaGluLysAlaAlaGlu-164
912
AMPHI Regions - AMPHI
SEQ. ID. NO. 12334    24-ProAlaAspAlaValSerGlnIle-31
SEQ. ID. NO. 12335    62-PheAspPheGlnArgMetThrAlaLeuAlaValGlyAsnProTrpArgThrAlaSerAspAlaGlnLys-84
SEQ. ID. NO. 12336    89-LysGluPheGlnThrLeu-94
SEQ. ID. NO. 12337    169-TyrArgAsnGlnPheGlyGluIleIleLysAlaLys-180
Antigenic Index - Jameson-Wolf
SEQ. ID. NO. 12338    1-MetLysLysSerSer-5
SEQ. ID. NO. 12339    29-SerGlnIleArgGlnAsnAlaThrGln-37
SEQ. ID. NO. 12340    42-LeuLysAsnGlyAspAlaAsnThrAlaArgGlnLysAlaGluAla-56
SEQ. ID. NO. 12341    74-AsnProTrpArgThrAlaSerAspAlaGlnLysGlnAlaLeuAlaLysGluPhe-91
SEQ. ID. NO. 12342    104-LeuLysLeuLysAsnAlaAsnValAsnValLysAspAsnProIleValAsnLysGlyGlyLysGluIleIleVal-128
SEQ. ID. NO. 12343    130-AlaGluValGlyValProGlyGlnLysProValAsn-141
SEQ. ID. NO. 12344    146-ThrTyrGlnSerGlyGlyLysTyrArgThr-155
SEQ. ID. NO. 12345    169-TyrArgAsnGlnPhe-173
SEQ. ID. NO. 12346    177-IleLysAlaLysGlyValAspGlyLeuIleAla-187
SEQ. ID. NO. 12347    189-LeuLysAlaLysAsnGlyGlyLys-196
Hydrophilic Regions - Hopp-Woods
SEQ. ID. NO. 12348    1-MetLysLysSerSer-5
SEQ. ID. NO. 12349    31-IleArgGlnAsnAla-35
```

| | |
|---|---|
| SEQ. ID. NO. 12350 | 43-LysAsnGlyAspAlaAsnThrAlaArgGlnLysAlaGluAla-56 |
| SEQ. ID. NO. 12351 | 78-ThrAlaSerAspAlaGlnLysGlnAlaLeuAlaLysGluPhe-91 |
| SEQ. ID. NO. 12352 | 104-LeuLysLeuLysAsn-108 |
| SEQ. ID. NO. 12353 | 110-AsnValAsnValLysAspAsnProIleVal-119 |
| SEQ. ID. NO. 12354 | 121-LysGlyGlyLysGluIleIleVal-128 |
| SEQ. ID. NO. 12355 | 134-ValProGlyGlnLysProValAsn-141 |
| SEQ. ID. NO. 12356 | 177-IleLysAlaLysGlyValAsp-183 |
| SEQ. ID. NO. 12357 | 189-LeuLysAlaLysAsnGlyGlyLys-196 |

913
AMPHI Regions - AMPHI

| | |
|---|---|
| SEQ. ID. NO. 12358 | 22-GluThrArgProAlaAspProTyrGluGlyTyrAsnArg-34 |
| SEQ. ID. NO. 12359 | 53-ArgGlyTyrArgLysValAlaProLys-61 |
| SEQ. ID. NO. 12360 | 66-GlyValSerAsnPhePheAsnAsnLeuCysAspValValSer-79 |
| SEQ. ID. NO. 12361 | 107-LeuGlyGlyLeuIleAspIleAlaGlyAla-116 |
| SEQ. ID. NO. 12362 | 151-ValArgAspAlaLeuGlyThrGlyIleThrSerValTyrSer-164 |
| SEQ. ID. NO. 12363 | 193-AspLeuThrAspSerLeuAspGluAlaAla-202 |
| SEQ. ID. NO. 12364 | 238-LeuValGluSerAla-242 |
| SEQ. ID. NO. 12365 | 257-SerGluThrGlnAla-261 |

Antigenic Index - Jameson-Wolf

| | |
|---|---|
| SEQ. ID. NO. 12366 | 21-AlaGluThrArgProAlaAspProTyrGluGlyTyrAsn-33 |
| SEQ. ID. NO. 12367 | 39-PheAsnAspGlnAlaAspArgTyr-46 |
| SEQ. ID. NO. 12368 | 51-AlaAlaArgGlyTyrArgLysValAlaProLysProValArgAla-65 |
| SEQ. ID. NO. 12369 | 81-GlySerAsnIleLeu-85 |
| SEQ. ID. NO. 12370 | 87-LeuAspIleLysArgAlaSerGluAspLeuVal-97 |
| SEQ. ID. NO. 12371 | 117-GlyGlyIleProAspAsnLysAsnThrLeuGlyAsp-128 |
| SEQ. ID. NO. 12372 | 132-SerTrpGlyTrpLysAsnSerAsn-139 |
| SEQ. ID. NO. 12373 | 149-SerThrValArgAspAlaLeu-155 |
| SEQ. ID. NO. 12374 | 163-TyrSerProLysAsnIle-168 |
| SEQ. ID. NO. 12375 | 172-ThrProValGlyArgTrpGly-178 |
| SEQ. ID. NO. 12376 | 185-ValSerThrArgGluGlyLeuLeuAspLeuThrAspSerLeuAspGluAlaAlaIleAspLysTyrSerTyrThrArgAspLeuTyrMet-214 |
| SEQ. ID. NO. 12377 | 216-ValArgAlaArgGlnThrGlyAlaThrProAlaGluGlyThrGluAspAsnIleAspIleAspGluLeuValGluSerAlaGluThrGlyAlaAla-247 |
| SEQ. ID. NO. 12378 | 250-AlaValGlnGluAspSerValSerGluThrGlnAlaGluAlaAlaGlyGluAlaGluThrGlnProGlyThrGlnPro-275 |

Hydrophilic Regions - Hopp-Woods

| | |
|---|---|
| SEQ. ID. NO. 12379 | 21-AlaGluThrArgProAlaAspProTyrGluGlyTyrAsn-33 |
| SEQ. ID. NO. 12380 | 40-AsnAspGlnAlaAsp-44 |
| SEQ. ID. NO. 12381 | 53-ArgGlyTyrArgLysValAlaProLysProValArg-64 |
| SEQ. ID. NO. 12382 | 87-LeuAspIleLysArgAlaSerGluAspLeuVal-97 |
| SEQ. ID. NO. 12383 | 118-GlyIleProAspAsnLysAsnThrLeu-126 |
| SEQ. ID. NO. 12384 | 150-ThrValArgAspAlaLeu-155 |
| SEQ. ID. NO. 12385 | 186-SerThrArgGluGlyLeuLeuAspLeuThrAspSerLeuAspGluAlaAlaIleAsp-204 |
| SEQ. ID. NO. 12386 | 216-ValArgAlaArgGlnThrGly-222 |
| SEQ. ID. NO. 12387 | 224-ThrProAlaGluGlyThrGluAspAsnIleAspIleAspGluLeuValGluSerAlaGluThrGlyAlaAla-247 |
| SEQ. ID. NO. 12388 | 250-AlaValGlnGluAspSerValSerGluThrGlnAlaGluAlaAlaGlyGluAlaGluThrGlnPro-271 |

914-2
AMPHI Regions - AMPHI

| | |
|---|---|
| SEQ. ID. NO. 12389 | 6-LeuGlyIleLeuThrAlaCysAlaAlaMet-15 |
| SEQ. ID. NO. 12390 | 17-AlaPheAlaAspArgIleGlyAspLeu-25 |
| SEQ. ID. NO. 12391 | 65-PheGlnLysThrPheGlu-70 |
| SEQ. ID. NO. 12392 | 81-GlnLysValArgGlnAlaCys-87 |

Antigenic Index - Jameson-Wolf

| | |
|---|---|
| SEQ. ID. NO. 12393 | 18-PheAlaAspArgIleGlyAspLeuGluAlaArgLeuAlaGlnLeuGluHisArgValAlaValLeuGluSerGlyGlyAsnThrValLys-47 |
| SEQ. ID. NO. 12394 | 50-LeuPheGlySerAsnSer-55 |
| SEQ. ID. NO. 12395 | 64-ProPheGlnLysThrPheGluAlaSerAspArgAsnGluGlyValAlaArgGlnLysValArgGlnAlaCysAsnArgGluThrSerAla-93 |
| SEQ. ID. NO. 12396 | 95-PheCysGluAspGluAlaIleArgCysArgLysPheAsp-107 |

Hydrophilic Regions - Hopp-Woods

| | |
|---|---|
| SEQ. ID. NO. 12397 | 18-PheAlaAspArgIleGlyAspLeuGluAlaArgLeuAlaGlnLeuGluHisArgValAlaVal-38 |
| SEQ. ID. NO. 12398 | 67-LysThrPheGluAlaSerAspArgAsnGluGlyValAlaArgGlnLysValArgGlnAlaCysAsnArgGluThrSer-92 |
| SEQ. ID. NO. 12399 | 95-PheCysGluAspGluAlaIleArgCysArgLysPheAsp-107 |

915-2
AMPHI Regions - AMPHI

| | |
|---|---|
| SEQ. ID. NO. 12400 | 9-ValAlaValSerAlaLeuSerAlaCysArgGlnAla-20 |
| SEQ. ID. NO. 12401 | 31-IleSerAspArgSerVal-36 |
| SEQ. ID. NO. 12402 | 67-SerThrIleLysGlnMetPheGlyTyrThrLysLeuProGluGluProLysGlyIleArgValIleTyrValThrAspMetGlyAsnValThrAspTrpThr-100 |
| SEQ. ID. NO. 12403 | 139-GlnAlaGluLysPhe-143 |

Antigenic Index - Jameson-Wolf

| | |
|---|---|
| SEQ. ID. NO. 12404 | 15-SerAlaCysArgGlnAlaGluGluGlyProProProLeuProArgGlnIleSerAspArgSerValGlyHis-38 |
| SEQ. ID. NO. 12405 | 43-AsnLeuThrGluHisAsnGlyProLysAla-52 |
| SEQ. ID. NO. 12406 | 57-AsnGlyLysProAspGlnProVal-64 |
| SEQ. ID. NO. 12407 | 75-TyrThrLysLeuProGluGluProLysGlyIle-85 |
| SEQ. ID. NO. 12408 | 97-ThrAspTrpThrAsnProAsnAlaAspThrGluTrpMetAspAlaLysLys-113 |
| SEQ. ID. NO. 12409 | 125-GlyMetGlyAlaGluAspAlaLeuProPheGlyAsnLysGluGlnAlaGluLysPheAlaLysAspLysGlyGlyLysValValGlyPheAspAspMetProAspThrTyr-161 |

Hydrophilic Regions - Hopp-Woods

| | |
|---|---|
| SEQ. ID. NO. 12410 | 18-ArgGlnAlaGluGluGlyProProProLeu-27 |
| SEQ. ID. NO. 12411 | 30-GlnIleSerAspArgSerVal-36 |
| SEQ. ID. NO. 12412 | 46-GluHisAsnGlyProLys-51 |
| SEQ. ID. NO. 12413 | 58-GlyLysProAspGln-62 |
| SEQ. ID. NO. 12414 | 77-LysLeuProGluGluProLysGlyIle-85 |
| SEQ. ID. NO. 12415 | 103-AsnAlaAspThrGluTrpMetAspAlaLysLys-113 |

TABLE 1-continued

| | |
|---|---|
| SEQ. ID. NO. 12416 | 127-GlyAlaGluAspAlaLeu-132 |
| SEQ. ID. NO. 12417 | 135-GlyAsnLysGluGlnAlaGluLysPheAlaLysAspLysGlyGlyLys-150 |
| SEQ. ID. NO. 12418 | 155-AspAspMetProAsp-159 |

917
AMPHI Regions - AMPHI

| | |
|---|---|
| SEQ. ID. NO. 12419 | 6-ProLeuAlaValLeuThrAlaLeuLeuLeu-15 |
| SEQ. ID. NO. 12420 | 35-GlnAsnValLeuLysIleTyrAsnTrpSerGluTyrValAspProGluThrValAlaAsp-54 |
| SEQ. ID. NO. 12421 | 99-IleLysAlaGlyAlaTyrGlnLysIleAspLysSerLeu-111 |
| SEQ. ID. NO. 12422 | 124-ArgLeuMetAspGlyValAspPro-131 |
| SEQ. ID. NO. 12423 | 152-ArgValLysLysAlaLeu-157 |
| SEQ. ID. NO. 12424 | 188-AspSerAlaAlaGlu-192 |
| SEQ. ID. NO. 12425 | 206-AsnSerSerAsnThrGluAspIleArgGluAlaThr-217 |
| SEQ. ID. NO. 12426 | 292-AlaLysAsnValAlaAsnAlaHisLysTyrIleAsnAspPheLeuAsp-307 |
| SEQ. ID. NO. 12427 | 325-LysProAlaArgGluLeuMetGluAsp-333 |

Antigenic Index - Jameson-Wolf

| | |
|---|---|
| SEQ. ID. NO. 12428 | 18-CysGlyGlySerAspLysProProAlaGluLysProAlaProAlaGluAsnGlnAsnVal-37 |
| SEQ. ID. NO. 12429 | 44-SerGluTyrValAspProGluThrValAlaAspPheGluLysLysAsnGlyIleLysValThr-64 |
| SEQ. ID. NO. 12430 | 68-TyrAspSerAspGluThrLeuGluSerLysValLeuThrGlyLysSerGlyTyrAsp-86 |
| SEQ. ID. NO. 12431 | 102-GlyAlaTyrGlnLysIleAspLysSerLeuIleProAsnTyrLysHisLeuAsnProGluMetMetArgLeuMetAspGlyValAspProGlyHisGluTyr-135 |
| SEQ. ID. NO. 12432 | 149-AsnThrGluArgValLysLysAlaLeuGlyThrAspLysLeuProAspAsnGln-166 |
| SEQ. ID. NO. 12433 | 171-PheAspProGluTyrThrSerLysLeuLysGlnCysGly-183 |
| SEQ. ID. NO. 12434 | 201-LeuGlyLysAsnProAsnSerSerAsnThrGluAspIleArgGluAlaThrAlaLeuLeuLysLysAsnArgProAsnIleLysArgPheThrSerSerGlyPheIle-236 |
| SEQ. ID. NO. 12435 | 238-AspLeuAlaArgGlyAspThr-244 |
| SEQ. ID. NO. 12436 | 255-AsnIleAlaLysArgArgAlaGluGluAlaGlyGlyLysGluLysIleArgValMetMetProLysGluGlyValGly-280 |
| SEQ. ID. NO. 12437 | 287-ValIleProLysAspAlaLysAsnValAlaAsn-297 |
| SEQ. ID. NO. 12438 | 305-PheLeuAspProGluValSerAlaLysAsnGlyAsn-316 |
| SEQ. ID. NO. 12439 | 320-TyrAlaProSerSerLysProAlaArgGluLeuMetGluAspGluPheLysAsnAspAsnThrIlePheProThrGluGluAspLeuLysAsn-350 |
| SEQ. ID. NO. 12440 | 368-GlnTrpGlnAspValLysAlaGlyLys-376 |

Hydrophilic Regions - Hopp-Woods

| | |
|---|---|
| SEQ. ID. NO. 12441 | 19-GlyGlySerAspLysProProAlaGluLysProAlaProAlaGluAsn-34 |
| SEQ. ID. NO. 12442 | 47-ValAspProGluThrValAlaAspPheGluLysLysAsnGlyIle-61 |
| SEQ. ID. NO. 12443 | 68-TyrAspSerAspGluThrLeuGluSerLysValLeuThr-80 |
| SEQ. ID. NO. 12444 | 105-GlnLysIleAspLysSerLeu-111 |
| SEQ. ID. NO. 12445 | 121-GluMetMetArgLeuMetAspGlyValAspProGlyHis-133 |
| SEQ. ID. NO. 12446 | 149-AsnThrGluArgValLysLysAlaLeuGlyThrAspLysLeuProAspAsnGln-166 |
| SEQ. ID. NO. 12447 | 174-GluTyrThrSerLysLeuLysGln-181 |
| SEQ. ID. NO. 12448 | 204-AsnProAsnSerSerAsnThrGluAspIleArgGluAlaThrAlaLeuLeuLysLysAsnArgProAsnIleLysArgPheThr-231 |
| SEQ. ID. NO. 12449 | 238-AspLeuAlaArgGlyAspThr-244 |
| SEQ. ID. NO. 12450 | 255-AsnIleAlaLysArgArgAlaGluGluAlaGlyGlyLysGluLysIleArgValMetMetProLysGluGly-278 |
| SEQ. ID. NO. 12451 | 290-LysAspAlaLysAsnValAlaAsn-297 |
| SEQ. ID. NO. 12452 | 305-PheLeuAspProGluValSerAlaLysAsn-314 |
| SEQ. ID. NO. 12453 | 322-ProSerSerLysProAlaArgGluLeuMetGluAspGluPheLysAsnAspAsn-339 |
| SEQ. ID. NO. 12454 | 343-ProThrGluGluAspLeuLysAsn-350 |
| SEQ. ID. NO. 12455 | 370-GlnAspValLysAlaGlyLys-376 |

919
AMPHI Regions - AMPHI

| | |
|---|---|
| SEQ. ID. NO. 12456 | 12-GlyIleAlaAlaAlaAlaIleLeu-18 |
| SEQ. ID. NO. 12457 | 24-LysSerIleGlnThrPheProGln-31 |
| SEQ. ID. NO. 12458 | 37-IleAsnGlyProAspArgProValGlyIleProAsp-48 |
| SEQ. ID. NO. 12459 | 76-AspPheAlaLysSerLeuGln-82 |
| SEQ. ID. NO. 12460 | 98-GlnAspValCysAlaGlnAlaPheGlnThrProVal-109 |
| SEQ. ID. NO. 12461 | 119-GluArgTyrPheThr-123 |
| SEQ. ID. NO. 12462 | 133-LeuAlaGlyThrValThrGlyTyrTyrGlu-142 |
| SEQ. ID. NO. 12463 | 161-GlyIleProAspAspPheIleSerValPro-170 |
| SEQ. ID. NO. 12464 | 176-ArgSerGlyLysAlaLeuValArgIleArgGln-186 |
| SEQ. ID. NO. 12465 | 191-SerGlyThrIleAspAsnThrGlyGlyThr-200 |
| SEQ. ID. NO. 12466 | 307-MetGlnGlyIleLysSerTyrMetArgGlnAsnProGlnArgLeuAlaGluValLeu-325 |
| SEQ. ID. NO. 12467 | 348-AlaLeuGlyThrProLeuMetGlyGluTyrAlaGlyAlaVal-361 |
| SEQ. ID. NO. 12468 | 382-ArgLysAlaLeuAsnArg-387 |

Antigenic Index - Jameson-Wolf

| | |
|---|---|
| SEQ. ID. NO. 12469 | 21-CysGlnSerLysSerIleGlnThr-28 |
| SEQ. ID. NO. 12470 | 30-ProGlnProAspThr-34 |
| SEQ. ID. NO. 12471 | 36-ValIleAsnGlyProAspArgProValGlyIleProAspProAlaGlyThr-52 |
| SEQ. ID. NO. 12472 | 54-ValGlyGlyGlyGly-58 |
| SEQ. ID. NO. 12473 | 76-AspPheAlaLysSerLeuGln-82 |
| SEQ. ID. NO. 12474 | 87-GlyCysAlaAsnLeuLysAsnArgGlnGlyTrpGln-98 |
| SEQ. ID. NO. 12475 | 121-TyrPheThrProTrp-125 |
| SEQ. ID. NO. 12476 | 143-ProValLeuLysGlyAspAspArgArgThrAlaGln-154 |
| SEQ. ID. NO. 12477 | 162-IleProAspAspPheIle-167 |
| SEQ. ID. NO. 12478 | 173-AlaGlyLeuArgSerGlyLysAlaLeuValArgIleArgGlnThrGlyLysAsnSerGlyThrIleAspAsnThrGlyGlyThrHis-201 |
| SEQ. ID. NO. 12479 | 215-ThrAlaIleLysGlyArgPheGluGlySerArgPheLeuProTyrHisThrArgAsnGlnIleAsnGlyGlyAlaLeuAspGlyLysAlaPro-245 |
| SEQ. ID. NO. 12480 | 250-AlaGluAspProValGlu-255 |
| SEQ. ID. NO. 12481 | 262-GlnGlySerGlyArgLeuLysThrProSerGlyLysTyrIleArg-276 |
| SEQ. ID. NO. 12482 | 278-GlyTyrAlaAspLysAsnGluHisPro-286 |
| SEQ. ID. NO. 12483 | 293-TyrMetAlaAspLysGlyTyrLeuLysLeuGlyGln-304 |
| SEQ. ID. NO. 12484 | 308-GlnGlyIleLysSerTyrMetArgGlnAsnProGlnArgLeuAlaGlu-323 |
| SEQ. ID. NO. 12485 | 326-GlyGlnAsnProSer-330 |
| SEQ. ID. NO. 12486 | 337-LeuAlaGlySerSerAsnAspGlyProVal-346 |

TABLE 1-continued

| | |
|---|---|
| SEQ. ID. NO. 12487 | 359-GlyAlaValAspArgHisTyr-365 |
| SEQ. ID. NO. 12488 | 379-ProValThrArgLysAlaLeuAsn-386 |
| SEQ. ID. NO. 12489 | 393-AspThrGlySerAlaIleLysGlyAlaValArg-403 |
| SEQ. ID. NO. 12490 | 409-GlyTyrGlyAspGluAlaGlyGluLeuAlaGlyLysGlnLysThrThr-424 |
| SEQ. ID. NO. 12491 | 431-LeuProAsnGlyMetLysProGluTyrArgPro-441 |

Hydrophilic Regions - Hopp-Woods

| | |
|---|---|
| SEQ. ID. NO. 12492 | 38-AsnGlyProAspArgProValGly-45 |
| SEQ. ID. NO. 12493 | 90-AsnLeuLysAsnArgGlnGlyTrp-97 |
| SEQ. ID. NO. 12494 | 144-ValLeuLysGlyAspAspArgArgThrAlaGln-154 |
| SEQ. ID. NO. 12495 | 175-LeuArgSerGlyLysAlaLeuValArgIleArgGlnThrGlyLysAsnSerGlyThrIleAspAsnThrGly-198 |
| SEQ. ID. NO. 12496 | 215-ThrAlaIleLysGlyArgPheGluGly-223 |
| SEQ. ID. NO. 12497 | 239-AlaLeuAspGlyLysAla-244 |
| SEQ. ID. NO. 12498 | 250-AlaGluAspProVal-254 |
| SEQ. ID. NO. 12499 | 265-GlyArgLeuLysThrProSer-271 |
| SEQ. ID. NO. 12500 | 279-TyrAlaAspLysAsnGluHis-285 |
| SEQ. ID. NO. 12501 | 317-AsnProGlnArgLeuAlaGlu-323 |
| SEQ. ID. NO. 12502 | 337-LeuAlaGlySerSerAsnAspGlyPro-345 |
| SEQ. ID. NO. 12503 | 380-ValThrArgLysAlaLeuAsn-386 |
| SEQ. ID. NO. 12504 | 393-AspThrGlySerAlaIle-398 |
| SEQ. ID. NO. 12505 | 412-AspGluAlaGlyGluLeuAlaGlyLysGlnLysThr-423 |
| SEQ. ID. NO. 12506 | 434-GlyMetLysProGluTyrArgPro-441 |

920-2
AMPHI Regions - AMPHI

| | |
|---|---|
| SEQ. ID. NO. 12507 | 43-GlyGluPheProGluLeuGluProIleAla-52 |
| SEQ. ID. NO. 12508 | 117-GlyIleLysGluMetProAsp-123 |
| SEQ. ID. NO. 12509 | 135-LysAsnIleValAsnVal-140 |
| SEQ. ID. NO. 12510 | 163-LeuAspAsnProAlaAsn-168 |
| SEQ. ID. NO. 12511 | 190-ThrValThrAlaThrPheAspGlyPheAspThrSerAspArgSerLys-205 |
| SEQ. ID. NO. 12512 | 212-GlnAlaPheSerAspSerThr-218 |

Antigenic Index - Jameson-Wolf

| | |
|---|---|
| SEQ. ID. NO. 12513 | 40-LeuGlyTyrGlyGluPheProGlu-47 |
| SEQ. ID. NO. 12514 | 49-GluProIleAlaLysAspArgLeu-56 |
| SEQ. ID. NO. 12515 | 66-ValThrGluLysGlyLysGluAsnMetIle-75 |
| SEQ. ID. NO. 12516 | 77-ArgGlyThrTyrAsnTyrGlnTyrArgSerAsnArgProValLysAspGlySerTyr-95 |
| SEQ. ID. NO. 12517 | 104-ThrPheTrpSerLysAsnLysAlaGlyTrp-113 |
| SEQ. ID. NO. 12518 | 116-AlaGlyIleLysGluMetProAspAlaSerTyrCysGluGlnThrArgMetPheGlyLysAsnIleValAsnValGlyHisGluSerAlaAspThr-147 |
| SEQ. ID. NO. 12519 | 152-LysProValGlyGlnAsnLeuGlu-159 |
| SEQ. ID. NO. 12520 | 162-ProLeuAspAsnProAla-167 |
| SEQ. ID. NO. 12521 | 173-GluArgPheLysVal-177 |
| SEQ. ID. NO. 12522 | 181-PheArgGlyGluProLeuProAsnAla-189 |
| SEQ. ID. NO. 12523 | 194-ThrPheAspGlyPheAspThrSerAspArgSerLysThrHisLysThrGluAla-211 |
| SEQ. ID. NO. 12524 | 213-AlaPheSerAspSerThrAspAspLysGlyGluValAsp-225 |
| SEQ. ID. NO. 12525 | 237-AsnValGluHisLysThrAspPheProAspGlnSerValCysGlnLysGlnAlaAsnTyrSer-257 |

Hydrophilic Regions - Hopp-Woods

| | |
|---|---|
| SEQ. ID. NO. 12526 | 49-GluProIleAlaLysAspArgLeu-56 |
| SEQ. ID. NO. 12527 | 66-ValThrGluLysGlyLysGluAsnMetIle-75 |
| SEQ. ID. NO. 12528 | 85-ArgSerAsnArgProValLysAspGlySer-94 |
| SEQ. ID. NO. 12529 | 107-SerLysAsnLysAlaGlyTrp-113 |
| SEQ. ID. NO. 12530 | 116-AlaGlyIleLysGluMetProAsp-123 |
| SEQ. ID. NO. 12531 | 128-GluGlnThrArgMetPheGly-134 |
| SEQ. ID. NO. 12532 | 142-HisGluSerAlaAsp-146 |
| SEQ. ID. NO. 12533 | 173-GluArgPheLysVal-177 |
| SEQ. ID. NO. 12534 | 196-AspGlyPheAspThrSerAspArgSerLysThrHisLysThrGluAla-211 |
| SEQ. ID. NO. 12535 | 213-AlaPheSerAspSerThrAspAspLysGlyGluValAsp-225 |
| SEQ. ID. NO. 12536 | 237-AsnValGluHisLysThrAspPheProAsp-246 |
| SEQ. ID. NO. 12537 | 248-SerValCysGlnLys-252 |

921
AMPHI Regions - AMPHI

| | |
|---|---|
| SEQ. ID. NO. 12538 | 12-AlaValLeuSerGlyCysGlnSerIleTyrValProThrLeuThrGluIleProValAsn-31 |
| SEQ. ID. NO. 12539 | 33-IleAsnThrValLysThr-38 |
| SEQ. ID. NO. 12540 | 51-HisTrpThrAspValAlaLysIleSerAspGlu-61 |
| SEQ. ID. NO. 12541 | 72-GlyLysMetThrLysValGlnAlaAlaGlnTyrLeuAsnAsnPheArgLys-88 |
| SEQ. ID. NO. 12542 | 98-AspSerMetTyrGluIleTyrLeuArg-106 |
| SEQ. ID. NO. 12543 | 126-GlnAsnAlaLeuArgGlyTrpGlnGlnArg-135 |

Antigenic Index - Jameson-Wolf

| | |
|---|---|
| SEQ. ID. NO. 12544 | 36-ValLysThrGluAlaProAlaLysGlyPheArg-46 |
| SEQ. ID. NO. 12545 | 56-AlaLysIleSerAspGluAlaThrArg-64 |
| SEQ. ID. NO. 12546 | 72-GlyLysMetThrLys-76 |
| SEQ. ID. NO. 12547 | 84-AsnAsnPheArgLysArgLeuValGlyArgAsnAlaValAspAspSerMet-100 |
| SEQ. ID. NO. 12548 | 108-AlaIleAspSerGlnArgGlyAlaIleAsnThrGluGlnSerLys-122 |
| SEQ. ID. NO. 12549 | 128-AlaLeuArgGlyTrpGlnGlnArgTrpLysAsnMetAspValLysProAsnAsnProAla-147 |

Hydrophilic Regions - Hopp-Woods

| | |
|---|---|
| SEQ. ID. NO. 12550 | 36-ValLysThrGluAlaProAlaLysGlyPheArg-46 |
| SEQ. ID. NO. 12551 | 56-AlaLysIleSerAspGluAlaThrArg-64 |
| SEQ. ID. NO. 12552 | 86-PheArgLysArgLeuValGly-92 |
| SEQ. ID. NO. 12553 | 94-AsnAlaValAspAspSerMet-100 |

TABLE 1-continued

| | |
|---|---|
| SEQ. ID. NO. 12554 | 108-AlaIleAspSerGlnArgGlyAlaIleAsnThrGluGlnSerLys-122 |
| SEQ. ID. NO. 12555 | 136-TrpLysAsnMetAspValLysProAsnAsn-145 |

922
AMPHI Regions - AMPHI

| | |
|---|---|
| SEQ. ID. NO. 12556 | 16-LeuSerAlaCysThr-20 |
| SEQ. ID. NO. 12557 | 28-ArgAlaAsnGluAlaGlnAlaPro-35 |
| SEQ. ID. NO. 12558 | 37-AlaValGluMetLysLys-42 |
| SEQ. ID. NO. 12559 | 72-ValArgArgPheValAspAsp-78 |
| SEQ. ID. NO. 12560 | 89-GluTrpGlnAspPhePheAspLys-96 |
| SEQ. ID. NO. 12561 | 104-ValLysIleMetHis-108 |
| SEQ. ID. NO. 12562 | 144-AspAspValAlaGln-148 |
| SEQ. ID. NO. 12563 | 172-GlySerPheArgValAlaAspAlaLeu-180 |
| SEQ. ID. NO. 12564 | 196-LysGluLeuValGluLeuLeuLysLeuAla-205 |
| SEQ. ID. NO. 12565 | 222-AlaMetGlyMetPro-226 |
| SEQ. ID. NO. 12566 | 245-HisArgAspIleTrpGlyAsnValGlyAspValAlaAlaSerValAlaAsnTyrMetLysGlnHis-266 |
| SEQ. ID. NO. 12567 | 298-ArgThrValAlaAspLeuLysAlaTyr-306 |
| SEQ. ID. NO. 12568 | 335-TyrLeuGlyLeuAsnAsnPheTyrThr-343 |

Antigenic Index - Jameson-Wolf

| | |
|---|---|
| SEQ. ID. NO. 12569 | 1-MetLysLysArgLysIleLeu-7 |
| SEQ. ID. NO. 12570 | 22-MetGluAlaArgProProArgAlaAsnGluAlaGlnAlaProArgAlaValGluMetLysLysGluSerArgProAlaPhe-48 |
| SEQ. ID. NO. 12571 | 61-ValSerAspSerGlyPhe-66 |
| SEQ. ID. NO. 12572 | 70-AlaAsnValArgArgPheValAspAspGluValGlyLysGlyAspPheSerArgAlaGluTrp-90 |
| SEQ. ID. NO. 12573 | 107-MetHisArgProSerThrSerArgPro-115 |
| SEQ. ID. NO. 12574 | 120-ArgThrGlyAsnSerGlyLysAlaLysPheArgGlyAlaArgArgPheTyrAlaGluAsnArgAlaLeuIle-143 |
| SEQ. ID. NO. 12575 | 145-AspValAlaGlnLysTyrGlyVal-152 |
| SEQ. ID. NO. 12576 | 163-IleGluThrAsnTyrGlyLysAsnThrGlySer-173 |
| SEQ. ID. NO. 12577 | 186-AspTyrProArgArgAlaGlyPhePhe-194 |
| SEQ. ID. NO. 12578 | 203-LysLeuAlaLysGluGluGlyGlyAsp-211 |
| SEQ. ID. NO. 12579 | 229-MetProSerSerTyrArgLysTrpAlaValAspTyrAspGlyAspGlyHisArgAspIle-248 |
| SEQ. ID. NO. 12580 | 266-HisGlyTrpArgThrGlyLysMet-274 |
| SEQ. ID. NO. 12581 | 281-AlaProGlyAlaAsp-285 |
| SEQ. ID. NO. 12582 | 290-IleGlyGluLysThrAlaLeu-296 |
| SEQ. ID. NO. 12583 | 310-ProGlyGluGluLeuAlaAspAspGluLysAlaVal-321 |
| SEQ. ID. NO. 12584 | 326-GluThrAlaProGly-330 |
| SEQ. ID. NO. 12585 | 357-ValArgAspIleAlaAsnSerLeuGlyGlyProGlyLeu-369 |

Hydrophilic Regions - Hopp-Woods

| | |
|---|---|
| SEQ. ID. NO. 12586 | 1-MetLysLysArgLysIleLeu-7 |
| SEQ. ID. NO. 12587 | 22-MetGluAlaArgProProArgAlaAsnGluAlaGlnAlaProArgAlaValGluMetLysLysGluSerArgProAlaPhe-48 |
| SEQ. ID. NO. 12588 | 70-AlaAsnValArgArgPheValAspAspGluValGlyLysGlyAspPheSerArgAlaGluTrp-90 |
| SEQ. ID. NO. 12589 | 122-GlyAsnSerGlyLysAlaLysPheArgGlyAlaArgArgPheTyrAlaGluAsnArgAlaLeuIle-143 |
| SEQ. ID. NO. 12590 | 166-AsnTyrGlyLysAsnThrGly-172 |
| SEQ. ID. NO. 12591 | 187-TyrProArgArgAlaGlyPhePhe-194 |
| SEQ. ID. NO. 12592 | 203-LysLeuAlaLysGluGluGlyGlyAsp-211 |
| SEQ. ID. NO. 12593 | 240-TyrAspGlyAspGlyHisArgAspIle-248 |
| SEQ. ID. NO. 12594 | 290-IleGlyGluLysThrAlaLeu-296 |
| SEQ. ID. NO. 12595 | 310-ProGlyGluGluLeuAlaAspAspGluLysAlaVal-321 |
| SEQ. ID. NO. 12596 | 357-ValArgAspIleAla-361 |

923-2
AMPHI Regions - AMPHI

| | |
|---|---|
| SEQ. ID. NO. 12597 | 9-LeuMetAlaCysAlaAlaPheLeu-16 |
| SEQ. ID. NO. 12598 | 26-LeuGlyAlaCysTyrAlaIleLeuSerLeuTyrAla-37 |
| SEQ. ID. NO. 12599 | 63-ProAlaLeuLeuGlyGlyTrpValGlyAlaTyr-73 |
| SEQ. ID. NO. 12600 | 117-GlyValAlaSerProCysArgThrIleCysThrValCysGlyPheValAlaLeu-134 |

Antigenic Index - Jameson-Wolf

| | |
|---|---|
| SEQ. ID. NO. 12601 | 43-IleAspLysArgCysAlaIleArgGlyGlnArgArgIleProGluHisArgLeu-60 |
| SEQ. ID. NO. 12602 | 79-PheLysHisLysThrAlaLysLysArgPhe-88 |

Hydrophilic Regions - Hopp-Woods

| | |
|---|---|
| SEQ. ID. NO. 12603 | 43-IleAspLysArgCysAlaIleArgGlyGlnArgArgIleProGluHisArgLeu-60 |
| SEQ. ID. NO. 12604 | 79-PheLysHisLysThrAlaLysLysArgPhe-88 |

925-1
AMPHI Regions - AMPHI

| | |
|---|---|
| SEQ. ID. NO. 12605 | 8-ValGlyValValAlaValLeu-14 |
| SEQ. ID. NO. 12606 | 116-LysCysGlyGlnThrAlaGlnAlaTyrArgAspAla-127 |
| SEQ. ID. NO. 12607 | 139-GlnHisLeuAlaAlaIleGluGlnLeuLys-148 |
| SEQ. ID. NO. 12608 | 155-PheAspGluLeuGlu-159 |

Antigenic Index - Jameson-Wolf

| | |
|---|---|
| SEQ. ID. NO. 12609 | 15-AlaGlyCysGlyLysAspAlaGlyGlyTyrGluGlyTyrTrpArgGluLysSerAspLysLysGluGlyMetIleAlaValLysLysGluLysGlyAsn-47 |
| SEQ. ID. NO. 12610 | 57-ThrGlyLysGluGluSerLeuLeuLeuSerGluLysAspGlyAla-71 |
| SEQ. ID. NO. 12611 | 75-AsnThrGlyIleGly-79 |
| SEQ. ID. NO. 12612 | 81-IleProIleLysLeuSerAspAspGlyLysGluLeuTyrValGluArgArgGlnTyrValLysThrAspAlaAlaMetLysAspLysIleIleAlaHisGlnLysLysCysGlyGlnThr-120 |
| SEQ. ID. NO. 12613 | 123-AlaTyrArgAspAlaArgAsnAlaLeuProSerProAsnGlnThrTyr-137 |
| SEQ. ID. NO. 12614 | 145-GluGlnLeuLysArgArgPheGluAlaGluPheAspGluLeuGluLysGluIleLysCysAsnGlyArgSerProAla-170 |

Hydrophilic Regions - Hopp-Woods

| | |
|---|---|
| SEQ. ID. NO. 12615 | 17-CysGlyLysAspAlaGlyGly-23 |
| SEQ. ID. NO. 12616 | 27-TyrTrpArgGluLysSerAspLysLysGluGlyMetIleAlaValLysLysGluLysGly-46 |
| SEQ. ID. NO. 12617 | 57-ThrGlyLysGluGluSerLeuLeuLeuSerGluLysAspGlyAla-71 |
| SEQ. ID. NO. 12618 | 81-IleProIleLysLeuSerAspAspGlyLysGluLeuTyrValGluArgArgGlnTyrValLysThrAspAlaAlaMetLysAspLysIleIleAlaHisGlnLysLysCysGlyGln-119 |

TABLE 1-continued

| | |
|---|---|
| SEQ. ID. NO. 12619 | 123-AlaTyrArgAspAlaArgAsnAlaLeu-131 |
| SEQ. ID. NO. 12620 | 145-GluGlnLeuLysArgArgPheGluAlaGluPheAspGluLeuGluLysGluIleLysCysAsnGlyArgSer-168 |

926
AMPHI Regions - AMPHI

| | |
|---|---|
| SEQ. ID. NO. 12621 | 29-ProSerGluHisIleSerSerPhe-36 |
| SEQ. ID. NO. 12622 | 72-LeuGlySerThrLeuGlyGln-78 |
| SEQ. ID. NO. 12623 | 98-AlaGluSerAlaGluGluLeuSerArgGln-107 |
| SEQ. ID. NO. 12624 | 128-AlaGlyAlaProTyrArgIleLeuProAspGlyIle-139 |
| SEQ. ID. NO. 12625 | 151-AlaAspSerGlyGlyGlnVal-157 |

Antigenic Index - Jameson-Wolf

| | |
|---|---|
| SEQ. ID. NO. 12626 | 19-LeuProGlnAsnAsnGluAsnLeuTrpGlnProSerGluHisIleSer-34 |
| SEQ. ID. NO. 12627 | 37-AlaAlaGluGlyArgLeuAlaValLysAlaGluGlyLysGlySerTyrAla-53 |
| SEQ. ID. NO. 12628 | 70-ThrProLeuGlySer-74 |
| SEQ. ID. NO. 12629 | 79-LeuCysGlnAspArgAspGlyAlaLeu-87 |
| SEQ. ID. NO. 12630 | 89-ValAspGlyLysGlyAsnValTyr-96 |
| SEQ. ID. NO. 12631 | 99-GluSerAlaGluGluLeuSerArg-106 |
| SEQ. ID. NO. 12632 | 121-TrpAlaAspGlyArgArgValAla-128 |
| SEQ. ID. NO. 12633 | 134-IleLeuProAspGlyIleLeu-140 |
| SEQ. ID. NO. 12634 | 148-GlyArgThrAlaAspSerGlyGlyGln-156 |
| SEQ. ID. NO. 12635 | 177-GlyMetProSerGluThrGluThrProGluArgCysAlaAlaArgThrArg-193 |

Hydrophilic Regions - Hopp-Woods

| | |
|---|---|
| SEQ. ID. NO. 12636 | 37-AlaAlaGluGlyArgLeuAlaValLysAlaGluGlyLysGlySer-51 |
| SEQ. ID. NO. 12637 | 80-CysGlnAspArgAspGlyAlaLeu-87 |
| SEQ. ID. NO. 12638 | 89-ValAspGlyLysGly-93 |
| SEQ. ID. NO. 12639 | 99-GluSerAlaGluGluLeuSerArg-106 |
| SEQ. ID. NO. 12640 | 123-AspGlyArgArgValAla-128 |
| SEQ. ID. NO. 12641 | 149-ArgThrAlaAspSerGlyGlyGln-156 |
| SEQ. ID. NO. 12642 | 180-SerGluThrGluThrProGluArgCysAlaAlaArgThrArg-193 |

927-2
AMPHI Regions - AMPHI

| | |
|---|---|
| SEQ. ID. NO. 12643 | 13-LeuLeuThrAlaCys-17 |
| SEQ. ID. NO. 12644 | 48-SerTyrAspValAlaArgAspPheTyrLysGlu-58 |
| SEQ. ID. NO. 12645 | 120-LysGlyTrpGlnGlnAlaLeuPro-127 |
| SEQ. ID. NO. 12646 | 145-AsnProLysGlnIleArgAspTrpAsnAspLeuAlaLysAspGly-159 |
| SEQ. ID. NO. 12647 | 197-LysLeuValAlaSerIleLeu-203 |
| SEQ. ID. NO. 12648 | 223-ArgAsnIleGlyAspValLeu-229 |
| SEQ. ID. NO. 12649 | 275-ThrGlnLysThrAlaArgAla-281 |
| SEQ. ID. NO. 12650 | 283-LeuGluTyrLeuTrpSerGluProAlaGlnGluLeu-294 |
| SEQ. ID. NO. 12651 | 325-LysLysPheGlyGlyTrpAspAsnIleMetLysThr-336 |

Antigenic Index - Jameson-Wolf

| | |
|---|---|
| SEQ. ID. NO. 12652 | 18-SerProAlaAlaAspSerAsnHisProSerGlyGlnAsnAlaProAlaAsnThrGluSerAspGlyLysAsnIleThr-43 |
| SEQ. ID. NO. 12653 | 48-SerTyrAspValAlaArgAspPheTyrLysGluTyrAsnPro-61 |
| SEQ. ID. NO. 12654 | 67-TyrGlnSerGluHisProGlyThrSer-75 |
| SEQ. ID. NO. 12655 | 79-GlnGlnSerHisGlyGlySerSerLysGlnAla-89 |
| SEQ. ID. NO. 12656 | 104-AsnGlnSerSerAspIleAspLeuLeuGluLysLysGlyLeuVal-118 |
| SEQ. ID. NO. 12657 | 125-AlaLeuProAspHisAlaAlaProTyrThr-134 |
| SEQ. ID. NO. 12658 | 142-ArgLysAsnAsnProLysGlnIleArgAspTrpAsnAspLeuAlaLysAspGlyVal-160 |
| SEQ. ID. NO. 12659 | 166-AsnProLysThrSerGlyAsnGlyArg-174 |
| SEQ. ID. NO. 12660 | 185-LeuLysThrThrAsnGlyAsnGluGlnGluAlaGlnLys-197 |
| SEQ. ID. NO. 12661 | 203-LeuLysAsnThrProValPheGluAsnGlyGlyArgAlaAlaThr-217 |
| SEQ. ID. NO. 12662 | 220-PheThrGlnArgAsnIleGlyAsp-227 |
| SEQ. ID. NO. 12663 | 238-TyrValSerLysLysLeuThrGlnGlyGln-247 |
| SEQ. ID. NO. 12664 | 270-ValAlaLysLysGlyThrGlnLysThrAlaArgAla-281 |
| SEQ. ID. NO. 12665 | 300-LeuArgProArgAsnProGluValLeuAlaArgHisLysAlaAspPheProAspLeuAspThrPheSerProGluLysLysPheGlyGlyTrp-330 |
| SEQ. ID. NO. 12666 | 337-TyrPheAlaAspGlyGlyIle-343 |
| SEQ. ID. NO. 12667 | 347-LeuThrAlaGlnLys-351 |

Hydrophilic Regions - Hopp-Woods

| | |
|---|---|
| SEQ. ID. NO. 12668 | 19-ProAlaAlaAspSerAsnHisProSer-27 |
| SEQ. ID. NO. 12669 | 33-AlaAsnThrGluSerAspGlyLysAsn-41 |
| SEQ. ID. NO. 12670 | 50-AspValAlaArgAspPheTyrLys-57 |
| SEQ. ID. NO. 12671 | 67-TyrGlnSerGluHisProGly-73 |
| SEQ. ID. NO. 12672 | 82-HisGlyGlySerSerLysGlnAla-89 |
| SEQ. ID. NO. 12673 | 105-GlnSerSerAspIleAspLeuLeuGluLysLysGlyLeuVal-118 |
| SEQ. ID. NO. 12674 | 142-ArgLysAsnAsnProLysGlnIleArgAspTrpAsnAspLeuAlaLysAspGlyVal-160 |
| SEQ. ID. NO. 12675 | 167-ProLysThrSerGlyAsnGly-173 |
| SEQ. ID. NO. 12676 | 187-ThrThrAsnGlyAsnGluGlnGluAlaGlnLys-197 |
| SEQ. ID. NO. 12677 | 211-AsnGlyGlyArgAlaAla-216 |
| SEQ. ID. NO. 12678 | 238-TyrValSerLysLysLeuThr-244 |
| SEQ. ID. NO. 12679 | 270-ValAlaLysLysGlyThrGlnLysThrAlaArgAla-281 |
| SEQ. ID. NO. 12680 | 300-LeuArgProArgAsnProGluValLeuAlaArgHisLysAlaAspPheProAsp-317 |
| SEQ. ID. NO. 12681 | 319-AspThrPheSerProGluLysLysPheGlyGly-329 |
| SEQ. ID. NO. 12682 | 347-LeuThrAlaGlnLys-351 |

929-2
AMPHI Regions - AMPHI

| | |
|---|---|
| SEQ. ID. NO. 12683 | 25-ValProAspGlyValLys-30 |
| SEQ. ID. NO. 12684 | 34-TrpThrLeuLeuAlaMetPheValGlyValIleAlaAlaIleIle-48 |
| SEQ. ID. NO. 12685 | 76-GlyAlaAlaMetSerAspAlaLeuSerAlaPhe-86 |
| SEQ. ID. NO. 12686 | 155-HisProIleMetGlnSerIleAlaGlySerTyrGlySerAsnProAlaLys-171 |
| SEQ. ID. NO. 12687 | 180-TyrLeuAlaLeuVal-184 |
| SEQ. ID. NO. 12688 | 204-ProLeuIleValAsnLeuIleAlaGluAsnLeuGly-215 |

TABLE 1-continued

| | |
|---|---|
| SEQ. ID. NO. 12689 | 233-GlyValIleAlaPhePhe-238 |
| SEQ. ID. NO. 12690 | 265-ArgLeuArgGluMetGlyLysMetSer-273 |
| SEQ. ID. NO. 12691 | 280-AlaValIlePheGlyIle-285 |
| SEQ. ID. NO. 12692 | 355-LeuGlyLeuIleLysTrpPheSerGlyValLeuAlaGluSerValGlyGlyLeu-372 |
| SEQ. ID. NO. 12693 | 398-ThrAlaHisIleThrAlaMetPheGlyAlaPhePheAla-410 |
| SEQ. ID. NO. 12694 | 452-TyrThrThrMetGlyGluTrpTrp-459 |
| Antigenic Index - Jameson-Wolf | |
| SEQ. ID. NO. 12695 | 25-ValProAspGlyValLysProGln-32 |
| SEQ. ID. NO. 12696 | 71-ThrAlaAspLysProGlyAlaAlaMet-79 |
| SEQ. ID. NO. 12697 | 122-GlyArgLysThrLeuGlyIle-128 |
| SEQ. ID. NO. 12698 | 143-ThrProSerAsnThrAlaArgGlyGlyGly-152 |
| SEQ. ID. NO. 12699 | 163-GlySerTyrGlySerAsnProAlaLysGlyThrGluGlyLysMetGlyLys-179 |
| SEQ. ID. NO. 12700 | 187-HisSerAsnProIleSer-192 |
| SEQ. ID. NO. 12701 | 213-AsnLeuGlySerSerPhe-218 |
| SEQ. ID. NO. 12702 | 248-TyrProProGluIleLysGluThrProAsn-257 |
| SEQ. ID. NO. 12703 | 261-PheAlaLysAspArgLeuArgGluMetGlyLysMetSerAlaAspGluIle-277 |
| SEQ. ID. NO. 12704 | 328-AspValLeuLysGluLysSerAlaTrp-336 |
| Hydrophilic Regions - Hopp-Woods | |
| SEQ. ID. NO. 12705 | 71-ThrAlaAspLysProGlyAlaAlaMet-79 |
| SEQ. ID. NO. 12706 | 146-AsnThrAlaArgGly-150 |
| SEQ. ID. NO. 12707 | 168-AsnProAlaLysGlyThrGluGlyLysMetGlyLys-179 |
| SEQ. ID. NO. 12708 | 250-ProGluIleLysGluThrProAsn-257 |
| SEQ. ID. NO. 12709 | 261-PheAlaLysAspArgLeuArgGluMetGlyLysMetSerAlaAspGluIle-277 |
| SEQ. ID. NO. 12710 | 328-AspValLeuLysGluLysSerAlaTrp-336 |
| 930-1 | |
| AMPHI Regions - AMPHI | |
| SEQ. ID. NO. 12711 | 8-LeuProAsnIleArg-12 |
| SEQ. ID. NO. 12712 | 69-AsnThrGlyGluThrValAsnGlnLeuMetGly-79 |
| SEQ. ID. NO. 12713 | 121-LeuHisAlaGlyAsnIleAsnGlnIleMetSerLeu-132 |
| SEQ. ID. NO. 12714 | 147-IleLeuAlaAlaPro-151 |
| SEQ. ID. NO. 12715 | 165-ProSerTyrLeuArgSerIleArgIle-173 |
| SEQ. ID. NO. 12716 | 199-AspLeuLeuAsnLeuArgAsp-205 |
| SEQ. ID. NO. 12717 | 207-GluGlnGlyLeuGluAsnLeuLysArgLeuProThr-218 |
| SEQ. ID. NO. 12718 | 280-SerAspMetPheTyr-284 |
| SEQ. ID. NO. 12719 | 288-GlyArgSerIleGlyGlyThrProAsp-296 |
| SEQ. ID. NO. 12720 | 333-ArgTyrHisGlnAlaValSerGlyLeuSerGluValTyrAsp-346 |
| SEQ. ID. NO. 12721 | 400-TrpLeuAlaGluLeu-404 |
| SEQ. ID. NO. 12722 | 427-MetLysAspAlaLeuArgAlaProGluGluAlaPheGlyGluGly-441 |
| SEQ. ID. NO. 12723 | 472-HisAlaGlnTrpAsnLys-477 |
| Antigenic Index - Jameson-Wolf | |
| SEQ. ID. NO. 12724 | 32-SerProAsnProAlaGluIleArgMetGlnGlnAspIleGlnGlnArgGlnArgGluGluGlnLeuArgGlnThrMetGlnProGluSerAsp<br>ValArgLeuHisGlnLysAsnThrGlyGluThr-73 |
| SEQ. ID. NO. 12725 | 77-LeuMetGlyAspAspSerSerGln-84 |
| SEQ. ID. NO. 12726 | 93-ValLeuGluGlyGluHisHisAla-100 |
| SEQ. ID. NO. 12727 | 108-ArgAlaLeuArgGluThrGly-114 |
| SEQ. ID. NO. 12728 | 118-GlyLysCysLeuHisAlaGlyAsn-125 |
| SEQ. ID. NO. 12729 | 151-ProGlnAspLeuAsnSerGlyLysLeu-159 |
| SEQ. ID. NO. 12730 | 171-IleArgIleAspArgSerAsnAspAspGlnThrHis-182 |
| SEQ. ID. NO. 12731 | 191-AsnLysPheProThrArgSerAsnAspLeuLeuAsn-202 |
| SEQ. ID. NO. 12732 | 204-ArgAspLeuGluGlnGlyLeuGluAsnLeuLysArgLeuProThrAlaGluAlaAspLeu-223 |
| SEQ. ID. NO. 12733 | 228-ValGluGlyGluProAsnGlnSerAspVal-237 |
| SEQ. ID. NO. 12734 | 242-ArgGlnArgLeuLeuPro-247 |
| SEQ. ID. NO. 12735 | 252-ValGlyMetAspAsnSerGlySerGluAlaThrGlyLysTyrGlnGly-267 |
| SEQ. ID. NO. 12736 | 273-AlaAspAsnProLeuGlyLeu-279 |
| SEQ. ID. NO. 12737 | 287-TyrGlyArgSerIleGlyGlyThrProAspGluGluSerPheAspGlyHisArgLysGluGlyGlySerAsn-310 |
| SEQ. ID. NO. 12738 | 329-HisAsnGlyTyrArg-333 |
| SEQ. ID. NO. 12739 | 343-GluValTyrAspTyrAsnGlyLysSerTyrAsnThrAspPheGlyPhe-358 |
| SEQ. ID. NO. 12740 | 362-LeuTyrArgAspAlaLysArgLysThr-370 |
| SEQ. ID. NO. 12741 | 377-TrpMetArgGluThrLysSerTyrIleAspAspAlaGluLeuThrValGlnArgArgLysThrAla-398 |
| SEQ. ID. NO. 12742 | 408-GluTyrIleGlyArgSerThrAlaAspPheLysLeuLysTyrLysArgGlyThrGlyMetLysAspAlaLeuArgAlaProGluGluAlaPhe<br>GlyGluGlyThrSerArg-444 |
| SEQ. ID. NO. 12743 | 451-SerAlaAspValAsnThrPro-457 |
| SEQ. ID. NO. 12744 | 474-GlnTrpAsnLysThrProLeuThrSerGlnAspLysLeuAla-487 |
| SEQ. ID. NO. 12745 | 492-HisThrValArgGlyPheAspGlyGluMet-501 |
| SEQ. ID. NO. 12746 | 503-LeuSerAlaGluArgGlyTrpTyrTrpArgAsnAspLeuSerTrpGlnPheLysProGlyHis-523 |
| SEQ. ID. NO. 12747 | 535-SerGlyGlnSerAlaLys-540 |
| SEQ. ID. NO. 12748 | 572-ArgAlaLeuLysLysProGluPhePheGlnSerArgLysTrpAlaSerGly-588 |
| Hydrophilic Regions - Hopp-Woods | |
| SEQ. ID. NO. 12749 | 34-AsnProAlaGluIleArgMetGlnGlnAspIleGlnGlnArgGlnArgGluGluGlnLeuArgGln-55 |
| SEQ. ID. NO. 12750 | 57-MetGlnProGluSerAspValArgLeuHisGlnLysAsnThrGlyGluThr-73 |
| SEQ. ID. NO. 12751 | 78-MetGlyAspAspSerSerGln-84 |
| SEQ. ID. NO. 12752 | 93-ValLeuGluGlyGluHisHisAla-100 |
| SEQ. ID. NO. 12753 | 108-ArgAlaLeuArgGluThrGly-114 |
| SEQ. ID. NO. 12754 | 152-GlnAspLeuAsnSerGlyLys-158 |
| SEQ. ID. NO. 12755 | 171-IleArgIleAspArgSerAsnAspAspGlnThrHis-182 |
| SEQ. ID. NO. 12756 | 193-PheProThrArgSerAsnAsp-199 |
| SEQ. ID. NO. 12757 | 204-ArgAspLeuGluGlnGlyLeuGluAsnLeuLysArgLeuProThrAlaGluAlaAspLeu-223 |
| SEQ. ID. NO. 12758 | 228-ValGluGlyGluProAsnGlnSer-235 |
| SEQ. ID. NO. 12759 | 254-MetAspAsnSerGlySerGluAlaThrGly-263 |
| SEQ. ID. NO. 12760 | 291-IleGlyGlyThrProAspGluGluSerPheAspGlyHisArgLysGluGlyGlySer-309 |

TABLE 1-continued

| | |
|---|---|
| SEQ. ID. NO. 12761 | 345-TyrAspTyrAsnGly-349 |
| SEQ. ID. NO. 12762 | 362-LeuTyrArgAspAlaLysArgLysThr-370 |
| SEQ. ID. NO. 12763 | 377-TrpMetArgGluThrLysSerTyrIleAspAspAlaGluLeuThrValGlnArgArgLysThr-397 |
| SEQ. ID. NO. 12764 | 413-SerThrAlaAspPheLysLeuLysTyrLysArgGlyThrGlyMetLysAspAlaLeuArgAlaProGluGluAlaPheGly-439 |
| SEQ. ID. NO. 12765 | 479-ProLeuThrSerGlnAspLysLeuAla-487 |
| SEQ. ID. NO. 12766 | 495-ArgGlyPheAspGlyGluMet-501 |
| SEQ. ID. NO. 12767 | 503-LeuSerAlaGluArg-507 |
| SEQ. ID. NO. 12768 | 572-ArgAlaLeuLysLysProGluPhePheGln-581 |

931-2
AMPHI Regions - AMPHI

| | |
|---|---|
| SEQ. ID. NO. 12769 | 43-LysAlaProLysThrValAlaAsnPheValArgTyrAlaArgLys-57 |
| SEQ. ID. NO. 12770 | 65-PheHisArgValIleAspGly-71 |
| SEQ. ID. NO. 12771 | 81-GluAspLeuAlaGlnLysAlaSerAspLys-90 |
| SEQ. ID. NO. 12772 | 94-AsnGluSerGlyAsnGlyLeuLysAsnThr-103 |
| SEQ. ID. NO. 12773 | 142-ThrValPheGlyArgValGluSerGlyMetAsnThrValSerLysIleAlaArgValLysThrAlaThrArgGlyPhe-167 |

Antigenic Index - Jameson-Wolf

| | |
|---|---|
| SEQ. ID. NO. 12774 | 1-MetLysProLysPhe-5 |
| SEQ. ID. NO. 12775 | 30-ThrAspMetGlyAsn-34 |
| SEQ. ID. NO. 12776 | 38-ValLeuAspGluSerLysAlaProLysThr-47 |
| SEQ. ID. NO. 12777 | 53-ArgTyrAlaArgLysGlyPheTyrAspAspThrValPhe-65 |
| SEQ. ID. NO. 12778 | 76-GlyGlyGlyLeuThrGluAspLeuAlaGlnLysAlaSerAspLysAlaValAlaAsnGluSerGlyAsnGlyLeuLysAsnThrAla-104 |
| SEQ. ID. NO. 12779 | 110-AlaArgThrThrAlaProAspSerAlaThr-119 |
| SEQ. ID. NO. 12780 | 128-AspAsnAlaSerLeuAspTyrLysAsnGlyGlnTyr-139 |
| SEQ. ID. NO. 12781 | 145-GlyArgValGluSerGlyMetAsnThrVal-154 |
| SEQ. ID. NO. 12782 | 156-LysIleAlaArgValLysThrAlaThrArgGlyPhe-167 |
| SEQ. ID. NO. 12783 | 176-ValLysIleArgArg-180 |

Hydrophilic Regions - Hopp-Woods

| | |
|---|---|
| SEQ. ID. NO. 12784 | 1-MetLysProLysPhe-5 |
| SEQ. ID. NO. 12785 | 30-ThrAspMetGlyAsn-34 |
| SEQ. ID. NO. 12786 | 38-ValLeuAspGluSerLysAlaProLysThr-47 |
| SEQ. ID. NO. 12787 | 78-GlyLeuThrGluAspLeuAlaGlnLysAlaSerAspLysAlaValAlaAsnGluSerGlyAsnGlyLeuLysAsnThrAla-104 |
| SEQ. ID. NO. 12788 | 113-ThrAlaProAspSerAlaThr-119 |
| SEQ. ID. NO. 12789 | 130-AlaSerLeuAspTyrLysAsn-136 |
| SEQ. ID. NO. 12790 | 145-GlyArgValGluSerGlyMet-151 |
| SEQ. ID. NO. 12791 | 156-LysIleAlaArgValLysThrAlaThr-164 |
| SEQ. ID. NO. 12792 | 176-ValLysIleArgArg-180 |

932
AMPHI Regions - AMPHI

| | |
|---|---|
| SEQ. ID. NO. 12793 | 27-AspAlaAlaSerPheTrpGluLeuLysAsn-36 |
| SEQ. ID. NO. 12794 | 38-AlaAsnProTyrPro-42 |
| SEQ. ID. NO. 12795 | 46-SerAlaAlaLeuAspGlnTyrProSer-54 |
| SEQ. ID. NO. 12796 | 60-GlnLeuLysAspMetGlnGluCys-67 |

Antigenic Index - Jameson-Wolf

| | |
|---|---|
| SEQ. ID. NO. 12797 | 18-PheGlyGlyPheLysProAsnProTrpAsp-27 |
| SEQ. ID. NO. 12798 | 34-LeuLysAsnTyrAlaAsnProTyrProGlySer-44 |
| SEQ. ID. NO. 12799 | 50-AspGlnTyrProSerLysAlaArgArgArgGlnLeuLysAspMetGlnGluCysGlyTyrAspProIleAspGlyGlyLysSerGluAlaAsp AlaCysLeuArgLysLysGlyTrpCysArgLysGlyPheAspProTyrProGluAsnLysLysTyrGluTrpPro ArgGluGluGlyLysThrLys-112 |

Hydrophilic Regions - Hopp-Woods

| | |
|---|---|
| SEQ. ID. NO. 12800 | 52-TyrProSerLysAlaArgArgArgGlnLeuLysAspMetGlnGluCysGlyTyrAspProIleAspGlyGlyLysSerGluAlaAspAlaCysLeuArg LysLysGlyTrpCys-89 |
| SEQ. ID. NO. 12801 | 91-LysGlyPheAspProTyrProGluAsnLysLysTyrGluTrpProArgGluGluGlyLysThrLys-112 |

933
AMPHI Regions - AMPHI

| | |
|---|---|
| SEQ. ID. NO. 12802 | 6-LysThrSerGluTyr-10 |
| SEQ. ID. NO. 12803 | 37-GlnPheGluAsnIleAsnAsnSerLysLys-46 |
| SEQ. ID. NO. 12804 | 61-GlyPheAlaArgGlyLeu-66 |
| SEQ. ID. NO. 12805 | 75-ThrGluGluGlnIleArgLysTyrPheLysGluCysPheAsn-88 |
| SEQ. ID. NO. 12806 | 94-ArgAspTyrSerThrCysSerGlyAla-101 |
| SEQ. ID. NO. 12807 | 133-SerValGlyAsnTyrThrGluTrpAlaAsnGlnValIleHisHisGluGlyAsnTyrValSerPheAlaAlaHisLeuTyrSerGlyLeuAspPro PheHisTyrIleGluVal-170 |
| SEQ. ID. NO. 12808 | 261-GluAsnProIleAspAspAspLeuLysSerLeuAspGlyHisGlnIleIleLysValAsn-279 |
| SEQ. ID. NO. 12809 | 308-GlyPhePheThrLys-312 |
| SEQ. ID. NO. 12810 | 355-TrpLeuArgValIleAspGlyHisSerAsn-364 |
| SEQ. ID. NO. 12811 | 373-ProValGluGlyTyrArgLysGly-380 |
| SEQ. ID. NO. 12812 | 430-AlaGlyValTyrAlaThrTrpHis-437 |
| SEQ. ID. NO. 12813 | 451-TrpMetGlnTyrGln-455 |
| SEQ. ID. NO. 12814 | 466-GlyThrGluArgPheThr-471 |
| SEQ. ID. NO. 12815 | 473-LysGlyIleThrAlaSer-478 |
| SEQ. ID. NO. 12816 | 482-GlyTyrAsnAlaLeuLeuAla-488 |
| SEQ. ID. NO. 12817 | 547-LeuTyrLysAsnIleAlaIleGlu-554 |
| SEQ. ID. NO. 12818 | 556-PheAlaAlaValAsn-560 |
| SEQ. ID. NO. 12819 | 605-PheAsnArgGlnThrGly-610 |

Antigenic Index - Jameson-Wolf

| | |
|---|---|
| SEQ. ID. NO. 12820 | 1-LysLysLeuArgAspLysThrSerGluTyrTrpLysLysGluThr-15 |
| SEQ. ID. NO. 12821 | 19-ThrGluAspAsnProLysValProPro-27 |
| SEQ. ID. NO. 12822 | 32-TyrProArgThrTyrGln-37 |
| SEQ. ID. NO. 12823 | 39-GluAsnIleAsnAsnSerLysLysIleSer-48 |
| SEQ. ID. NO. 12824 | 50-TyrAspGlnGluTyrThrGluGlyTyr-58 |
| SEQ. ID. NO. 12825 | 67-GlyValAlaLysArgAsnGlyAspThrGluGluGlnIleArgLysTyrPheLys-84 |

TABLE 1-continued

| | |
|---|---|
| SEQ. ID. NO. 12826 | 86-CysPheAsnSerAsnThrLysIleArgAspTyrSerThrCysGlnAlaGluLysPheGlySerHisPro-108 |
| SEQ. ID. NO. 12827 | 118-LeuGlyProLysIleLysAsnSerHisIleAsnSerGluIle-131 |
| SEQ. ID. NO. 12828 | 159-TyrSerGlyLeuAspPro-164 |
| SEQ. ID. NO. 12829 | 169-GluValThrAspAsnSerHis-175 |
| SEQ. ID. NO. 12830 | 184-AspGluPheArgLeuGluAsnSerLeuTrpGluProArgTrpAspSerAsnValGlyLysLeuLysThrThrAsnAlaAspIleArgPheAsnThrLysSerGluSerLeuLeuValLysGluAspTyrAlaGlyGlyAlaArgPheArgPheAlaTyrAspProLysGluAlaLysAsn-243 |
| SEQ. ID. NO. 12831 | 249-GluLysAsnValThrGlyThrSer-256 |
| SEQ. ID. NO. 12832 | 259-IlePheGluAsnProIleAspAspLeuLysSerLeuAspGlyHisGlnIleIle-276 |
| SEQ. ID. NO. 12833 | 278-ValAsnGlyThrAlaAspLysHisAlaPheArgLeuSerGlyLysHisGlnLysGly-296 |
| SEQ. ID. NO. 12834 | 302-LeuGlnGlnArgProGluGlyPhe-309 |
| SEQ. ID. NO. 12835 | 312-LysValGlnGluArgAspAspMet-319 |
| SEQ. ID. NO. 12836 | 336-ArgLeuAsnAsnLysAsnSerAspIlePheAspArgThrLeuProArgLysGlyLeu-354 |
| SEQ. ID. NO. 12837 | 359-IleAspGlyHisSerAsnGlnTrpValGlnGlyLysThrAlaProValGluGlyTyrArgLysGlyVal-381 |
| SEQ. ID. NO. 12838 | 391-GlnAsnGluSerAsnGlnLeu-397 |
| SEQ. ID. NO. 12839 | 402-MetGlyGlyGlnAlaGluGlnArgSerThrPheHisAsnProAspThrAspAsnLeuThr-421 |
| SEQ. ID. NO. 12840 | 423-GlyAsnValLysGly-427 |
| SEQ. ID. NO. 12841 | 439-LeuGlnAspLysGlnThrGlyAlaTyrAlaAspSer-450 |
| SEQ. ID. NO. 12842 | 455-GlnArgPheArgHisArgIleAsnThrGluAspGlyThrGluArgPheThrSerLysGlyIleThrAla-477 |
| SEQ. ID. NO. 12843 | 490-HisPheThrLysLysGlyAsnSerLeu-498 |
| SEQ. ID. NO. 12844 | 513-ValAsnGlyLysPheSerAspSerGluAsnAla-523 |
| SEQ. ID. NO. 12845 | 528-LeuGlySerArgGlnLeuGlnThr-535 |
| SEQ. ID. NO. 12846 | 566-LysProPheGlyValGluMetAspGlyGluArgArgValIleAsnAsnLysThrAlaIleGluSer-587 |
| SEQ. ID. NO. 12847 | 593-ValLysIleLysSer-597 |
| SEQ. ID. NO. 12848 | 604-ThrPheAsnArgGlnThrGlyLysHisHisGlnAlaLysGlnGly-618 |
| Hydrophilic Regions - Hopp-Woods | |
| SEQ. ID. NO. 12849 | 1-LysLysLeuArgAspLysThrSerGluTyrTrpLysLysGluThr-15 |
| SEQ. ID. NO. 12850 | 20-GluAspAsnProLys-24 |
| SEQ. ID. NO. 12851 | 42-AsnAsnSerLysLysIleSer-48 |
| SEQ. ID. NO. 12852 | 67-GlyValAlaLysArgAsnGlyAspThrGluGluGlnIleArgLysTyrPheLys-84 |
| SEQ. ID. NO. 12853 | 91-ThrLysIleArgAspTyrSer-97 |
| SEQ. ID. NO. 12854 | 100-GlnAlaGluLysPheGly-105 |
| SEQ. ID. NO. 12855 | 120-ProLysIleLysAsn-124 |
| SEQ. ID. NO. 12856 | 184-AspGluPheArgLeuGlu-189 |
| SEQ. ID. NO. 12857 | 195-ProArgTrpAspSerAsnValGlyLysLeuLysThrThrAsnAlaAspIleArgPheAsnThrLysSerGluSerLeuLeuValLysGluAspTyrAlaGly-228 |
| SEQ. ID. NO. 12858 | 236-TyrAspProLysGluAlaLysAsn-243 |
| SEQ. ID. NO. 12859 | 250-LysAsnValThrGly-254 |
| SEQ. ID. NO. 12860 | 262-AsnProIleAspAspLeuLysSerLeuAsp-271 |
| SEQ. ID. NO. 12861 | 280-GlyThrAlaAspLysHisAlaPhe-287 |
| SEQ. ID. NO. 12862 | 289-LeuSerGlyLysHisGlnLys-295 |
| SEQ. ID. NO. 12863 | 303-GlnGlnArgProGluGlyPhe-309 |
| SEQ. ID. NO. 12864 | 313-ValGlnGluArgAspAspMet-319 |
| SEQ. ID. NO. 12865 | 337-LeuAsnAsnLysAsnSerAspIlePheAsp-346 |
| SEQ. ID. NO. 12866 | 375-GluGlyTyrArgLysGlyVal-381 |
| SEQ. ID. NO. 12867 | 392-AsnGluSerAsnGln-396 |
| SEQ. ID. NO. 12868 | 405-GlnAlaGluGlnArgSerThrPheHis-413 |
| SEQ. ID. NO. 12869 | 415-ProAspThrAspAsnLeuThr-421 |
| SEQ. ID. NO. 12870 | 439-LeuGlnAspLysGlnThr-444 |
| SEQ. ID. NO. 12871 | 455-GlnArgPheArgHisArgIleAsnThrGluAspGlyThrGluArgPheThrSer-472 |
| SEQ. ID. NO. 12872 | 490-HisPheThrLysLysGlyAsnSer-497 |
| SEQ. ID. NO. 12873 | 516-LysPheSerAspSerGluAsnAla-523 |
| SEQ. ID. NO. 12874 | 568-PheGlyValGluMetAspGlyGluArgArgValIleAsn-580 |
| SEQ. ID. NO. 12875 | 593-ValLysIleLysSer-597 |
| SEQ. ID. NO. 12876 | 607-ArgGlnThrGlyLysHisHisGlnAlaLysGlnGly-618 |
| 935 | |
| AMPHI Regions - AMPHI | |
| SEQ. ID. NO. 12877 | 41-ValSerAspLysTrpAla-46 |
| SEQ. ID. NO. 12878 | 56-AlaProArgValVal-60 |
| SEQ. ID. NO. 12879 | 72-LeuGluHisSerLeuArgAsp-78 |
| SEQ. ID. NO. 12880 | 87-LeuIleAlaSerLeuAlaAspLeuTyrAlaLysLeu-98 |
| SEQ. ID. NO. 12881 | 111-AlaLeuLeuAlaLysLeuAlaGlyArgProAlaGluAlaValAlaArgTyrArgGlu-129 |
| SEQ. ID. NO. 12882 | 158-GluArgHisPheAlaGlu-163 |
| SEQ. ID. NO. 12883 | 172-ProValLeuGluAsnValGlyArgPheArgLysLysThrGlu-185 |
| SEQ. ID. NO. 12884 | 375-LysArgLeuGlyGluSerAlaThrValPheGlyGlyTrpGlnPheVal-390 |
| SEQ. ID. NO. 12885 | 415-AlaGlyTrpAlaGlnGluTrpArgGlnLeuGlyGlyLeu-427 |
| SEQ. ID. NO. 12886 | 435-TyrAlaArgArgAsnTyrLysGlyIleAlaAlaPhe-446 |
| Antigenic Index - Jameson-Wolf | |
| SEQ. ID. NO. 12887 | 27-AlaIleLeuAspAspLysAlaLeu-34 |
| SEQ. ID. NO. 12888 | 39-ArgSerValSerAspLysTrpAlaGluSerAspTrpLysValGluAsnAspAlaProArgValValAspGlyAspPhe-64 |
| SEQ. ID. NO. 12889 | 70-LysMetLeuGluHisSerLeuArgAspAlaLeuAsnGlyAsnGln-84 |
| SEQ. ID. NO. 12890 | 97-LysLeuProAspTyrAspAla-103 |
| SEQ. ID. NO. 12891 | 108-ArgAlaArgAlaLeu-112 |
| SEQ. ID. NO. 12892 | 116-LeuAlaGlyArgProAlaGluAlaValAlaArgTyrArgGluLeuHisGlyGluAsnAlaAlaAspGluArgIleLeu-141 |
| SEQ. ID. NO. 12893 | 145-AlaAlaAlaGluPheAspAspPheArgLeuLysSerAlaGluArgHisPheAlaGluAlaAlaLysLeuAspLeu-169 |
| SEQ. ID. NO. 12894 | 176-AsnValGlyArgPheArgLysLysThrGluGly-186 |
| SEQ. ID. NO. 12895 | 192-PheSerGlyGlyIle-196 |
| SEQ. ID. NO. 12896 | 199-AlaValAsnArgAsnAlaAsnAsnAlaAla-208 |
| SEQ. ID. NO. 12897 | 210-GlnTyrCysArgGlnAsnGlyGlyArgGln-219 |
| SEQ. ID. NO. 12898 | 224-SerArgAlaGluArgAlaAla-230 |
| SEQ. ID. NO. 12899 | 236-IleGluAlaGluLysLeuThrProLeuAlaAsp-246 |

TABLE 1-continued

| | |
|---|---|
| SEQ. ID. NO. 12900 | 253-ArgSerAsnIleGlyGlyThrSerTyr-261 |
| SEQ. ID. NO. 12901 | 263-PheSerLysLysSerAlaTyrAspAspGlyPheGlyArg-275 |
| SEQ. ID. NO. 12902 | 279-GlyTrpGlnTyrLysAsnAlaArgGlnThr-288 |
| SEQ. ID. NO. 12903 | 300-SerGlySerAspGlyPheAspAlaLysThrLysArgValAsnAsnArgArgLeuProProTyr-320 |
| SEQ. ID. NO. 12904 | 332-HisThrTyrArgProAsnProGlyTrp-340 |
| SEQ. ID. NO. 12905 | 347-GluHisTyrArgGlnArgTyrArgGluGlnAspArgAlaGluTyrAsnAsnGlyArgGlnAspGlyPheTyr-370 |
| SEQ. ID. NO. 12906 | 373-SerAlaLysArgLeuGlyGlu-379 |
| SEQ. ID. NO. 12907 | 392-PheValProLysArgGluThrVal-399 |
| SEQ. ID. NO. 12908 | 406-AlaAlaTyrArgArgAsnGlyValTyrAlaGly-416 |
| SEQ. ID. NO. 12909 | 425-GlyGlyLeuAsnSerArgValSerAlaSerTyrAlaArgArgAsnTyrLysGly-442 |
| SEQ. ID. NO. 12910 | 448-ThrGluAlaGlnArgAsnArgGluTrpAsn-457 |
| SEQ. ID. NO. 12911 | 463-SerHisAspLysLeuSerTyrLysGly-471 |
| SEQ. ID. NO. 12912 | 480-PheGlyArgThrGluSerAsnValProTyrAlaLysArgArgAsnSerGlu-496 |
| SEQ. ID. NO. 12913 | 501-AlaAspTrpArgPhe-505 |
| Hydrophilic Regions - Hopp-Woods | |
| SEQ. ID. NO. 12914 | 27-AlaIleLeuAspAspLysAlaLeu-34 |
| SEQ. ID. NO. 12915 | 39-ArgSerValSerAspLysTrpAlaGluSerAspTrpLysValGluAsnAspAlaProArgValValAsp-61 |
| SEQ. ID. NO. 12916 | 70-LysMetLeuGluHisSerLeuArgAspAlaLeuAsn-81 |
| SEQ. ID. NO. 12917 | 108-ArgAlaArgAlaLeu-112 |
| SEQ. ID. NO. 12918 | 116LeuAlaGlyArgProAlaGluAlaValAlaArgTyrArgGluLeuHisGly-132 |
| SEQ. ID. NO. 12919 | 134-AsnAlaAlaAspGluArgIleLeu-141 |
| SEQ. ID. NO. 12920 | 145-AlaAlaAlaGluPheAspAspPheArgLeuLysSerAlaGluArgHisPheAlaGluAlaAlaLysLeuAspLeu-169 |
| SEQ. ID. NO. 12921 | 176-AsnValGlyArgPheArgLysLysThrGluGly-186 |
| SEQ. ID. NO. 12922 | 200-ValAsnArgAsnAlaAsn-205 |
| SEQ. ID. NO. 12923 | 212-CysArgGlnAsnGlyGlyArgGln-219 |
| SEQ. ID. NO. 12924 | 224-SerArgAlaGluArgAlaAla-230 |
| SEQ. ID. NO. 12925 | 236-IleGluAlaGluLysLeuThrPro-243 |
| SEQ. ID. NO. 12926 | 265-LysLysSerAlaTyrAspAspGlyPheGly-274 |
| SEQ. ID. NO. 12927 | 283-LysAsnAlaArgGlnThr-288 |
| SEQ. ID. NO. 12928 | 303-AspGlyPheAspAlaLysThrLysArgValAsnAsnArgArgLeuPro-318 |
| SEQ. ID. NO. 12929 | 348-HisTyrArgGlnArgTyrArgGluGlnAspArgAlaGluTyrAsnAsnGlyArgGlnAsp-367 |
| SEQ. ID. NO. 12930 | 373-SerAlaLysArgLeuGlyGlu-379 |
| SEQ. ID. NO. 12931 | 393-ValProLysArgGluThrVal-399 |
| SEQ. ID. NO. 12932 | 407-AlaTyrArgArgAsnGly-412 |
| SEQ. ID. NO. 12933 | 435-TyrAlaArgArgAsnTyrLys-441 |
| SEQ. ID. NO. 12934 | 449-GluAlaGlnArgAsnArgGluTrp-456 |
| SEQ. ID. NO. 12935 | 463-SerHisAspLysLeuSerTyr-469 |
| SEQ. ID. NO. 12936 | 480-PheGlyArgThrGluSer-485 |
| SEQ. ID. NO. 12937 | 489-TyrAlaLysArgArgAsnSerGlu-496 |
| 936-1 | |
| AMPHI Regions - AMPHI | |
| SEQ. ID. NO. 12938 | 10-ThrLeuIleAlaAlaIle-15 |
| SEQ. ID. NO. 12939 | 22-GlyCysValSerAlaVal-27 |
| SEQ. ID. NO. 12940 | 100-GlnPheValGlyGlnIle-105 |
| SEQ. ID. NO. 12941 | 112-AlaGluGlyValTyrAsnTyrIleThrValAlaSerLeuProArgThrAlaGlyAspIleAlaGlyAsp-134 |
| Antigenic Index - Jameson-Wolf | |
| SEQ. ID. NO. 12942 | 1-MetLysProLysProHisThrVal-8 |
| SEQ. ID. NO. 12943 | 33-ValGlyAlaLysSerAlaValAspArgArgThrThrGlyAlaGlnThrAspAspAsnValMet-53 |
| SEQ. ID. NO. 12944 | 56-ArgIleGluThrThrAlaArgSerTyrLeuArgGlnAsnAsnGlnThrLysGlyTyr-74 |
| SEQ. ID. NO. 12945 | 94-AlaThrGluGlyGluLysGlnPhe-101 |
| SEQ. ID. NO. 12946 | 106-AlaArgSerGluGlnAlaAla-112 |
| SEQ. ID. NO. 12947 | 124-LeuProArgThrAlaGlyAspIleAlaGlyAspThrTrpAsnThrSerLysValArgAla-143 |
| SEQ. ID. NO. 12948 | 149-SerProAlaThrGlnAlaArgValLys-157 |
| SEQ. ID. NO. 12949 | 172-ThrProGluGluGlnAlaGlnIleThr-180 |
| Hydrophilic Regions - Hopp-Woods | |
| SEQ. ID. NO. 12950 | 1-MetLysProLysProHisThr-7 |
| SEQ. ID. NO. 12951 | 37-SerAlaValAspArgArgThrThrGlyAlaGlnThrAspAspAsnValMet-53 |
| SEQ. ID. NO. 12952 | 56-ArgIleGluThrThrAla-61 |
| SEQ. ID. NO. 12953 | 68-AsnAsnGlnThrLysGlyTyr-74 |
| SEQ. ID. NO. 12954 | 94-AlaThrGluGlyGluLysGlnPhe-101 |
| SEQ. ID. NO. 12955 | 106-AlaArgSerGluGlnAlaAla-112 |
| SEQ. ID. NO. 12956 | 125-ProArgThrAlaGly-129 |
| SEQ. ID. NO. 12957 | 152-ThrGlnAlaArgValLys-157 |
| SEQ. ID. NO. 12958 | 172-ThrProGluGluGlnAlaGlnIle-179 |
| 937 | |
| AMPHI Regions - AMPHI | |
| SEQ. ID. NO. 12959 | 6-LeuProAlaLeuProAlaIleLeuProLeuSerThr-17 |
| SEQ. ID. NO. 12960 | 190-AsnGlySerLysThrLeuSer-196 |
| Antigenic Index - Jameson-Wolf | |
| SEQ. ID. NO. 12961 | 27-AspIleMetThrAspLysGlyLysTrpLysLeuGluThr-39 |
| SEQ. ID. NO. 12962 | 44-LeuAsnSerGluAsnAsnArgAlaGluLeu-53 |
| SEQ. ID. NO. 12963 | 72-GluIleGlnGluAsnGlySerAsnThrAsp-81 |
| SEQ. ID. NO. 12964 | 95-GlyAsnThrAspIleTyrGlySerGlySer-104 |
| SEQ. ID. NO. 12965 | 108-HisGluGluArgLysLeuAspGlyAsnSerLysThrArgAsnLysArgMetSerAsp-126 |
| SEQ. ID. NO. 12966 | 135-PheLeuLysAspAspLysAsnProAla-143 |
| SEQ. ID. NO. 12967 | 151-ThrValTyrGluLysSerArgAsnLysAlaSerSerGlyLysSer-165 |
| SEQ. ID. NO. 12968 | 187-TyrArgIleAsnGlySerLysThrLeuSerAspGlyIleArgTyrLysSerGlyAsnTyr-206 |
| SEQ. ID. NO. 12969 | 217-AlaAsnAspArgIleSerLeuThrGlyGly-226 |
| SEQ. ID. NO. 12970 | 231-GlyArgGlnProAspArgThrAspGlyLysArgGluSerSerArgAsnThrSerThr-249 |
| SEQ. ID. NO. 12971 | 273-ValSerGlyGlnSerSerSerGluLeuLysPhe-283 |

TABLE 1-continued

Hydrophilic Regions - Hopp-Woods
SEQ. ID. NO. 12972   27-AspIleMetThrAspLysGlyLysTrpLysLeu-37
SEQ. ID. NO. 12973   47-GluAsnAsnArgAlaGluLeu-53
SEQ. ID. NO. 12974   72-GluIleGlnGluAsnGlySerAsnThr-80
SEQ. ID. NO. 12975   108-HisGluGluArgLysLeuAspGlyAsnSerLysThrArgAsnLysArgMetSerAsp-126
SEQ. ID. NO. 12976   135-PheLeuLysAspAspLysAsnPro-142
SEQ. ID. NO. 12977   151-ThrValTyrGluLysSerArgAsnLysAlaSerSer-162
SEQ. ID. NO. 12978   193-LysThrLeuSerAspGlyIleArgTyrLysSer-203
SEQ. ID. NO. 12979   217-AlaAsnAspArgIleSer-222
SEQ. ID. NO. 12980   232-ArgGlnProAspArgThrAspGlyLysArgGluSerSerArgAsnThr-247
SEQ. ID. NO. 12981   277-SerSerSerGluLeuLysPhe-283
939-2
AMPHI Regions - AMPHI
SEQ. ID. NO. 12982   32-AlaThrValCysAla-36
SEQ. ID. NO. 12983   90-AspGlnAspIleLeu-94
SEQ. ID. NO. 12984   121-LysIleTyrArgGly-125
SEQ. ID. NO. 12985   135-CysMetSerCysHisGly-140
SEQ. ID. NO. 12986   151-SerGluIleGlnAlaTyrProArgLeuGlyGly-161
SEQ. ID. NO. 12987   169-GluGlnMetAsnAlaTyrLys-175
SEQ. ID. NO. 12988   185-GluAspIleAlaAsnArgMetSer-192
Antigenic Index - Jameson-Wolf
SEQ. ID. NO. 12989   18-AlaSerProLysAlaAspValGluLysGlyLysGlnVal-30
SEQ. ID. NO. 12990   40-AlaAlaAspGlyAsnSerGlyIle-47
SEQ. ID. NO. 12991   66-IleGlyIleArgAspGlyLysArgThrHisGlySerAlaAlaVal-80
SEQ. ID. NO. 12992   88-LeuSerAspGlnAspIle-93
SEQ. ID. NO. 12993   102-LysGlnGlnProLysSerGlyGluAlaAsnProLysGluAsnProGluLeuGly-119
SEQ. ID. NO. 12994   122-IleTyrArgGlyGlyLeuSerAspLysLysValPro-133
SEQ. ID. NO. 12995   139-HisGlyProSerGlyAlaGlyMetProGlyGlyGlySerGluIleGlnAla-155
SEQ. ID. NO. 12996   157-ProArgLeuGlyGlyGlnHisGln-164
SEQ. ID. NO. 12997   172-AsnAlaTyrLysSerGlyGlnArgLysAsnThrIleMetGluAspIleAlaAsnArgMetSerGluGluAspLeuLysAla-198
Hydrophilic Regions - Hopp-Woods
SEQ. ID. NO. 12998   18-AlaSerProLysAlaAspValGluLysGlyLysGlnVal-30
SEQ. ID. NO. 12999   40-AlaAlaAspGlyAsnSer-45
SEQ. ID. NO. 13000   67-GlyIleArgAspGlyLysArgThrHisGly-76
SEQ. ID. NO. 13001   89-SerAspGlnAspIle-93
SEQ. ID. NO. 13002   103-GlnGlnProLysSerGlyGluAlaAsnProLysGluAsnProGluLeuGly-119
SEQ. ID. NO. 13003   126-GlyLeuSerAspLysLysValPro-133
SEQ. ID. NO. 13004   175-LysSerGlyGlnArgLysAsnThrIleMetGluAspIleAlaAsnArgMetSerGluGluAspLeuLysAla-198
950
AMPHI Regions - AMPHI
SEQ. ID. NO. 13005   33-GlyValHisLysSerAlaHisGly-40
SEQ. ID. NO. 13006   71-AlaThrValLysLysThrHisLysHisThrLysAla-82
Antigenic Index - Jameson-Wolf
SEQ. ID. NO. 13007   1-MetAsnLysAsnIle-5
SEQ. ID. NO. 13008   23-AlaAlaAsnLysProAlaSerAsnAlaThrGlyValHisLysSerAlaHisGlySerCysGlyAlaSerLysSerAlaGluGlySerCysGlyAla
                     AlaGlySerLysAlaGlyGluGlyLysCysGlyGluGlyLysCysGlyAlaThrValLysLysThrHisLysHisThrLysAlaSerLysAlaLysAlaLys
                     SerAlaGluGlyLysCysGlyGluGlyLysCysGlySerLys-102
Hydrophilic Regions - Hopp-Woods
SEQ. ID. NO. 13009   23-AlaAlaAsnLysProAlaSer-29
SEQ. ID. NO. 13010   33-GlyValHisLysSerAlaHis-39
SEQ. ID. NO. 13011   43-GlyAlaSerLysSerAlaGluGlySerCys-52
SEQ. ID. NO. 13012   55-AlaGlySerLysAlaGlyGluGlyLysCysGlyGluGlyLysCys-69
SEQ. ID. NO. 13013   71-AlaThrValLysLysThrHisLysHisThrLysAlaSerLysAlaLysAlaLysSerAlaGluGlyLysCysGlyGluGlyLysCysGlySerLys-102
951
AMPHI Regions - AMPHI
SEQ. ID. NO. 13014   9-LysMetLeuThrValLeuThrAla-16
SEQ. ID. NO. 13015   32-AspMetLysGlnProLysGluValGlyLysValPheArgLysGlnGlnArgTyr-49
SEQ. ID. NO. 13016   64-ValGlyGluArgValAsn-69
SEQ. ID. NO. 13017   129-TrpArgGlnIleGluProIleProGlyLys-138
SEQ. ID. NO. 13018   157-HisLeuAspGlyLeuGluGluValLeuAla-166
SEQ. ID. NO. 13019   191-AlaGlnLysAlaSerLysAlaValArgArg-200
SEQ. ID. NO. 13020   206-GluHisLeuProGluAlaAla-212
SEQ. ID. NO. 13021   230-GlyAlaLeuGlnArgLeuAlaLysLeu-238
SEQ. ID. NO. 13022   256-LysTyrProGluIleLeuAspGlyPhePheGlu-266
SEQ. ID. NO. 13023   280-MetGluIleMetAsnLeuValSerLeuHisArgLeuAspAspAla-294
SEQ. ID. NO. 13024   327-ValIleAspGlyTyrAlaGluLys-334
SEQ. ID. NO. 13025   336-TyrGlyArgGlyThrGlu-341
SEQ. ID. NO. 13026   364-ValArgGlnTrpLeuLys-369
SEQ. ID. NO. 13027   397-AlaLeuArgGlnIleGlyArgValArgLysLeuProGluGlnGln-411
SEQ. ID. NO. 13028   418-AspAsnLeuSerLysIle-423
SEQ. ID. NO. 13029   425-MetLeuAlaLeuSer-429
SEQ. ID. NO. 13030   436-GluAlaLeuArgGlyLeuAspLysIleIleGluLys-447
SEQ. ID. NO. 13031   479-SerAspLeuGluArgAlaPheArg-486
SEQ. ID. NO. 13032   497-AsnLeuGlyTyrSer-501
SEQ. ID. NO. 13033   565-HisLeuGlyGluVal-569
SEQ. ID. NO. 13034   581-AspValTrpThrGlnAla-586
SEQ. ID. NO. 13035   596-TrpArgGluThrLeu-600

TABLE 1-continued

Antigenic Index - Jameson-Wolf
SEQ. ID. NO. 13036    25-AlaAlaGlyGlyGlyAlaGlyAspMetLysGlnProLysGluValGlyLysValPheArgLysGlnGlnArgTyrSerGluGluGluIleLys
AsnGluArgAlaArgLeu-61
SEQ. ID. NO. 13037    63-AlaValGlyGluArgValAsn-69
SEQ. ID. NO. 13038    79-ThrAlaLeuGlnLysGlyGlnAla-86
SEQ. ID. NO. 13039    98-GluArgThrLysSerProGluValAlaGluArgAlaLeuGlu-111
SEQ. ID. NO. 13040    128-LysTrpArgGlnIleGluProIleProGlyLysAlaGlnLysArgAlaGlyTrpLeuArgAsnValLeuArgGluArgGlyAsnGlnHisLeuAsp
GlyLeuGluGluValLeuAlaGlnAlaAspGluGlyGlnAsnArgArg-175
SEQ. ID. NO. 13041    185-ValGlnGlnAspGlyLeuAlaGlnLysAlaSerLysAlaValArgArgAlaAlaLeuLys-204
SEQ. ID. NO. 13042    221-GlnGlyArgGluLysGluLysAlaIle-229
SEQ. ID. NO. 13043    234-ArgLeuAlaLysLeuAspThrGluIleLeuPro-244
SEQ. ID. NO. 13044    252-LeuThrAlaArgLysTyrProGluIleLeuAspGlyPhePheGluGlnThrAspThrGlnAsn-272
SEQ. ID. NO. 13045    289-HisArgLeuAspAspAlaTyrAla-296
SEQ. ID. NO. 13046    302-LeuGluArgAsnProAsnAlaAsp-309
SEQ. ID. NO. 13047    319-AlaAsnArgLysGlyGlyAlaSer-326
SEQ. ID. NO. 13048    330-GlyTyrAlaGluLysAlaTyrGlyArgGlyThrGluGluGlnArgSerArgAla-347
SEQ. ID. NO. 13049    355-TyrAlaAspArgArgAspTyrAlaLys-363
SEQ. ID. NO. 13050    366-GlnTrpLeuLysLysValSerAla-373
SEQ. ID. NO. 13051    377-LeuPheAspLysGlyVal-382
SEQ. ID. NO. 13052    389-ValGluLeuAspGlyGlyArgAlaAlaLeu-398
SEQ. ID. NO. 13053    400-GlnIleGlyArgValArgLysLeuProGluGlnGlnGlyArgTyrPheThr-416
SEQ. ID. NO. 13054    430-LysLeuProAspLysArgGluAlaLeuArgGlyLeuAspLysIleIleGluLysProProAlaGlySerAsnThrGluLeuGlnAla-458
SEQ. ID. NO. 13055    470-ArgLeuGlyLysArgLysLysMetIleSerAspLeuGluArgAlaPheArgLeuAlaProAspAsn-491
SEQ. ID. NO. 13056    504-ThrAspSerLysArgLeuAspGluGlyPhe-513
SEQ. ID. NO. 13057    522-IleAsnProAspAspThrAlaValAsnAspSerIle-533
SEQ. ID. NO. 13058    539-LeuLysGlyAspAlaGluSerAla-546
SEQ. ID. NO. 13059    551-ArgTyrSerPheGluAsnAspProGluProGluVal-562
SEQ. ID. NO. 13060    574-GlyGluArgAspGlnAla-579
SEQ. ID. NO. 13061    588-HisLeuThrGlyAspLysLysIleTrpArgGluThrLeuLysArgHisGlyIleAlaLeuProGlnProSerArgLysProArgLys-616
Hydrophilic Regions - Hopp-Woods
SEQ. ID. NO. 13062    29-GlyAlaGlyAspMetLysGlnProLysGluValGlyLysValPheArgysGlnGlnArgTyrSerGluGluGluIleLysAsnGluArgAlaArgLeu-61
SEQ. ID. NO. 13063    63-AlaValGlyGluArgValAsn-69
SEQ. ID. NO. 13064    79-ThrAlaLeuGlnLysGlyGlnAla-86
SEQ. ID. NO. 13065    98-GluArgThrLysSerProGluValAlaGluArgAlaLeuGlu-111
SEQ. ID. NO. 13066    135-IleProGlyLysAlaGlnLysArgAlaGlyTrp-145
SEQ. ID. NO. 13067    149-ValLeuArgGluArgGlyAsnGlnHis-157
SEQ. ID. NO. 13068    159-AspGlyLeuGluGluValLeuAlaGlnAlaAspGluGlyGlnAsnArgArg-175
SEQ. ID. NO. 13069    189-GlyLeuAlaGlnLysAlaSerLysAlaValArgArgAlaAlaLeuLys-204
SEQ. ID. NO. 13070    221-GlnGlyArgGluLysGluLysAlaIle-229
SEQ. ID. NO. 13071    234-ArgLeuAlaLysLeuAspThrGluIle-242
SEQ. ID. NO. 13072    252-LeuThrAlaArgLysTyrProGluIle-260
SEQ. ID. NO. 13073    265-PheGluGlnThrAspThrGlnAsn-272
SEQ. ID. NO. 13074    289-HisArgLeuAspAspAlaTyrAla-296
SEQ. ID. NO. 13075    302-LeuGluArgAsnProAsn-307
SEQ. ID. NO. 13076    319-AlaAsnArgLysGlyGlyAlaSer-326
SEQ. ID. NO. 13077    331-TyrAlaGluLysAlaTyrGlyArgGlyThrGluGluGlnArgSerArgAla-347
SEQ. ID. NO. 13078    355-TyrAlaAspArgArgAspTyrAlaLys-363
SEQ. ID. NO. 13079    389-ValGluLeuAspGlyGlyArgAlaAlaLeu-398
SEQ. ID. NO. 13080    400-GlnIleGlyArgValArgLysLeuProGluGlnGlnGly-412
SEQ. ID. NO. 13081    430-LysLeuProAspLysArgGluAlaLeuArgGlyLeuAspLysIleIleGluLysProProAla-450
SEQ. ID. NO. 13082    452-SerAsnThrGluLeuGlnAla-458
SEQ. ID. NO. 13083    470-ArgLeuGlyLysArgLysLysMetIleSerAspLeuGluArgAlaPheArgLeuAlaProAspAsn-491
SEQ. ID. NO. 13084    504-ThrAspSerLysArgLeuAspGlu-511
SEQ. ID. NO. 13085    523-AsnProAspAspThrAlaVal-529
SEQ. ID. NO. 13086    541-GlyAspAlaGluSer-545
SEQ. ID. NO. 13087    554-PheGluAsnAspProGluProGluVal-562
SEQ. ID. NO. 13088    574-GlyGluArgAspGlnAla-579
SEQ. ID. NO. 13089    590-ThrGlyAspLysLysIleTrpArgGluThrLeuLysArgHisGly-604
SEQ. ID. NO. 13090    609-GlnProSerArgLysProArgLys-616
952
AMPHI Regions - AMPHI
SEQ. ID. NO. 13091    63-SerValAlaThrLeuLeuAsnAsnPheTyrGlyGln-74
SEQ. ID. NO. 13092    81-ValLeuLysLysLeuAsp-86
SEQ. ID. NO. 13093    94-PheGluAspMetArgArgIle-100
SEQ. ID. NO. 13094    116-GluGlnLeuAlaGlnLeu-121
SEQ. ID. NO. 13095    138-SerValLeuArgGlyIleAsp-144
SEQ. ID. NO. 13096    163-AlaGlnPheLeuAspAla-168
SEQ. ID. NO. 13097    179-LysIleLeuAlaVal-183
Antigenic Index - Jameson-Wolf
SEQ. ID. NO. 13098    40-GlnSerTrpLysAlaArgArgAspPheAsnIleValLysGlnAspLeuAspPheSerCys-59
SEQ. ID. NO. 13099    70-AsnPheTyrGlyGlnThrLeuThrGluGluGluValLeuLysLysLeuAspLysGluGlnMetArgAlaSerPheGluAspMetArgArgIle
MetPro-102
SEQ. ID. NO. 13100    104-LeuGlyPheGluAlaLysGlyTyr-111
SEQ. ID. NO. 13101    129-LeuLysTyrArgLysAspAspHisPheSer-138
SEQ. ID. NO. 13102    141-ArgGlyIleAspGlyAsnThr-147
SEQ. ID. NO. 13103    169-TrpGlnThrArgGluGlyAsnLeuAla-177
SEQ. ID. NO. 13104    184-IleProLysLysAlaGluThrIleSer-192
SEQ. ID. NO. 13105    199-GlnHisProLysArgGlnThrGlu-206
SEQ. ID. NO. 13106    213-ArgGlnAlaArgAlaGlu-218

TABLE 1-continued

Hydrophilic Regions - Hopp-Woods
SEQ. ID. NO. 13107   41-SerTrpLysAlaArgArgAspPheAsnIleValLysGlnAspLeuAspPhe-57
SEQ. ID. NO. 13108   76-LeuThrGluGluGluValLeuLysLysLeuAspLysGluGlnMetArgAlaSerPheGluAspMetArgArgIleMetPro-102
SEQ. ID. NO. 13109   104-LeuGlyPheGluAlaLysGly-110
SEQ. ID. NO. 13110   130-LysTyrArgLysAspAspHisPheSer-138
SEQ. ID. NO. 13111   169-TrpGlnThrArgGluGlyAsnLeu-176
SEQ. ID. NO. 13112   184-IleProLysLysAlaGluThrIleSer-192
SEQ. ID. NO. 13113   200-HisProLysArgGlnThrGlu-206
SEQ. ID. NO. 13114   213-ArgGlnAlaArgAlaGlu-218
953
AMPHI Regions - AMPHI
SEQ. ID. NO. 13115   39-AsnThrSerThrAsnValGlyGlyPheTyrGlyLeuThr-51
SEQ. ID. NO. 13116   75-GlnSerGlySerGlnHisPheThrAspHisLeuLysSerAlaAspIlePheAspAlaAlaGln-95
SEQ. ID. NO. 13117   151-GlyAspPheSerThrThr-156
Antigenic Index - Jameson-Wolf
SEQ. ID. NO. 13118   22-TyrLysValAspGluTyrHisAla-29
SEQ. ID. NO. 13119   38-PheAsnThrSerThrAsnVal-44
SEQ. ID. NO. 13120   54-ValGluPheAspGlnAlaLysArgAspGlyLysIleAspIle-67
SEQ. ID. NO. 13121   83-AspHisLeuLysSer-87
SEQ. ID. NO. 13122   95-GlnTyrProAspIleArgPheValSer-103
SEQ. ID. NO. 13123   105-LysPheAsnPheAsnGlyLysLysLeuValSer-115
SEQ. ID. NO. 13124   122-MetHisGlyLysThrAlaProValLysLeuLysAlaGluLys-135
SEQ. ID. NO. 13125   137-AsnCysTyrGlnSerProMetGluLysThrGluValCysGlyGlyAsp-152
SEQ. ID. NO. 13126   154-SerThrThrIleAspArgThrLysTrpGly-163
SEQ. ID. NO. 13127   174-LysSerValArgIle-17
SEQ. ID. NO. 13128   180-IleGlnIleGluAlaAlaLysGln-187
Hydrophilic Regions - Hopp-Woods
SEQ. ID. NO. 13129   22-TyrLysValAspGluTyrHisAla-29
SEQ. ID. NO. 13130   54-ValGluPheAspGlnAlaLysArgAspGlyLysIleAspIle-67
SEQ. ID. NO. 13131   83-AspHisLeuLysSer-87
SEQ. ID. NO. 13132   108-PheAsnGlyLysLysLeuValSer-115
SEQ. ID. NO. 13133   125-LysThrAlaProValLysLeuLysAlaGluLys-135
SEQ. ID. NO. 13134   142-ProMetGluLysThrGluValCysGly-150
SEQ. ID. NO. 13135   155-ThrThrIleAspArgThrLysTrp-162
SEQ. ID. NO. 13136   174-LysSerValArgIle-178
SEQ. ID. NO. 13137   180-IleGlnIleGluAlaAlaLysGln-187
954
AMPHI Regions - AMPHI
SEQ. ID. NO. 13138   48-ArgAlaAlaArgPheArg-53
SEQ. ID. NO. 13139   57-GlnGlyLeuGlyGlyAspPheGluArgPheLeuLysGly-69
SEQ. ID. NO. 13140   74-GlnGluAsnLeuAlaLysTyrArgGluAsnIle-84
SEQ. ID. NO. 13141   100-ProTyrArgValCysLysGlnAla-107
SEQ. ID. NO. 13142   134-TyrGlnAsnTyrArgLysSerMetGlnGluCysArgLysThrIleThr-149
Antigenic Index - Jameson-Wolf
SEQ. ID. NO. 13143   17-GlyGlnGluGlnSerGlnLysAlaAspAlaGlu-27
SEQ. ID. NO. 13144   35-TyrGlnPheAlaAspGluLysGln-42
SEQ. ID. NO. 13145   58-GlyLeuGlyGlyAspPheGluArgPheLeuLysGlyGluIleProAsnGlnGluAsnLeuAlaLysTyrArgGluAsnIle-84
SEQ. ID. NO. 13146   92-AlaAspThrAsnGlyAspAspAspProTyrArgValCysLys-105
SEQ. ID. NO. 13147   107-AlaAlaGlnAspAlaGluIleLeuMet-115
SEQ. ID. NO. 13148   119-ValThrSerGlyGlyGlyGlyThrThrAspLeuAspLysGluSerTyrGlnAsnTyrArgLysSerMetGlnGluCysArgLysThrIleThrGlu
                     AlaGluAlaAsnLeuProLysLys-158
Hydrophilic Regions - Hopp-Woods
SEQ. ID. NO. 13149   17-GlyGlnGluGlnSerGlnLysAlaAspAlaGlu-27
SEQ. ID. NO. 13150   36-GlnPheAlaAspGluLysGln-42
SEQ. ID. NO. 13151   61-GlyAspPheGluArgPheLeuLys-68
SEQ. ID. NO. 13152   70-GluIleProAsnGlnGluAsnLeuAlaLysTyrArgGluAsnIle-84
SEQ. ID. NO. 13153   94-ThrAsnGlyAspAspAspProTyrArgValCysLys-105
SEQ. ID. NO. 13154   107-AlaAlaGlnAspAlaGluIleLeuMet-115
SEQ. ID. NO. 13155   125-GlyThrThrAspLeuAspLysGluSerTyrGlnAsnTyrArgLysSerMetGlnGluCysArgLysThrIleThrGluAlaGluAlaAsnLeuProLys
                     Lys-158
957
AMPHI Regions - AMPHI
SEQ. ID. NO. 13156   11-SerPhePheAlaLeuValPheAla-18
SEQ. ID. NO. 13157   39-AlaThrGluValProLysAsnPro-46
SEQ. ID. NO. 13158   48-AlaPheValAlaLysLeuAlaArgLeuPheArgAsnAla-60
SEQ. ID. NO. 13159   76-AsnLeuAlaGlyThrValAspAsp-83
SEQ. ID. NO. 13160   198-GluAspValTyrGluHisCysLeuGlyCysTyrGlnMet-210
SEQ. ID. NO. 13161   218-TyrArgAspValAlaAsnAspGlu-225
SEQ. ID. NO. 13162   235-SerAsnArgIleAlaSer-240
SEQ. ID. NO. 13163   249-GlnAsnMetArgGluLeuMetProArg-257
SEQ. ID. NO. 13164   335-GluLysGluValArgArgTyrAlaGluAlaAlaAlaArg-367
Antigenic Index - Jameson-Wolf
SEQ. ID. NO. 13165   29-IleAsnProArgTrp-33
SEQ. ID. NO. 13166   35-LeuSerAspThrAlaThrGluValProLysAsnProAsn-47
SEQ. ID. NO. 13167   57-PheArgAsnAlaAspArgAla-63
SEQ. ID. NO. 13168   69-GluSerIleArgThrGluGluAsnLeuAlaGlyThrValAspAspGlyProLeuGlnSerGluLysAspTyr-92
SEQ. ID. NO. 13169   98-ArgLeuSerArgLeuLysGluLysAlaLys-107
SEQ. ID. NO. 13170   112-ThrGluGlnGluHisGlyLys-118
SEQ. ID. NO. 13171   125-HisIleGlyGluGlyGly-130
SEQ. ID. NO. 13172   136-LeuSerGlnArgSerProGluAlaPheVal-145

TABLE 1-continued

| | |
|---|---|
| SEQ. ID. NO. 13173 | 149-TyrLeuTyrArgAsnAspArgProPheSer-158 |
| SEQ. ID. NO. 13174 | 166-ValHisGlyGluAsnTyrGluThrThrGlyGluTyrArgVal-179 |
| SEQ. ID. NO. 13175 | 182-GlnProAspGlySerVal-187 |
| SEQ. ID. NO. 13176 | 190-AlaAlaGlyArgGlyLysIleGlyGluAspValTyr-201 |
| SEQ. ID. NO. 13177 | 217-LysTyrArgAspValAlaAsnAspGluGlnLysValTrpAspPheArgLysGluSerAsnArgIleAlaSerAspSerArgAsnSerValPheTyrGlnAsnMetArgGluLeuMetProArgGlyMetLysAlaAsnSer-263 |
| SEQ. ID. NO. 13178 | 267-GlyTyrAspAlaAspGlyLeuProGlnLys-276 |
| SEQ. ID. NO. 13179 | 280-SerPheAspAsnGlyLysLysArgGlnSerPheGluTyrTyrLeuLysAsnGlyAsn-298 |
| SEQ. ID. NO. 13180 | 309-LeuLysAlaAspGlyValThr-315 |
| SEQ. ID. NO. 13181 | 329-LeuAspGlyGlyArgIleValArgGluGluLysGlnGlyAspArgLeuProAspPhe-347 |
| SEQ. ID. NO. 13182 | 352-GluAsnLeuGluLysGluValArgArgTyrAlaGluAlaAlaAlaArgArgSerGlyGlyArgArgAspLeuSerHis-377 Hydrophilic Regions - Hopp-Woods |
| SEQ. ID. NO. 13183 | 38-ThrAlaThrGluValProLysAsnPro-46 |
| SEQ. ID. NO. 13184 | 57-PheArgAsnAlaAspArgAla-63 |
| SEQ. ID. NO. 13185 | 69-GluSerIleArgThrGluGluAsnLeu-77 |
| SEQ. ID. NO. 13186 | 80-ThrValAspAspGlyProLeuGlnSerGluLysAspTyr-92 |
| SEQ. ID. NO. 13187 | 98-ArgLeuSerArgLeuLysGluLysAlaLys-107 |
| SEQ. ID. NO. 13188 | 112-ThrGluGlnGluHisGlyLys-118 |
| SEQ. ID. NO. 13189 | 136-LeuSerGlnArgSerProGlu-142 |
| SEQ. ID. NO. 13190 | 151-TyrArgAsnAspArgProPhe-157 |
| SEQ. ID. NO. 13191 | 169-GluAsnTyrGluThrThrGlyGluTyr-177 |
| SEQ. ID. NO. 13192 | 190-AlaAlaGlyArgGlyLysIleGlyGluAspValTyr-201 |
| SEQ. ID. NO. 13193 | 217-LysTyrArgAspValAlaAsnAspGluGlnLysValTrpAspPheArgLysGluSerAsnArgIleAlaSerAspSerArgAsn-244 |
| SEQ. ID. NO. 13194 | 250-AsnMetArgGluLeuMetProArgGlyMetLys-260 |
| SEQ. ID. NO. 13195 | 268-TyrAspAlaAspGlyLeuPro-274 |
| SEQ. ID. NO. 13196 | 282-AspAsnGlyLysLysArgGlnSer-289 |
| SEQ. ID. NO. 13197 | 309-LeuLysAlaAspGlyValThr-315 |
| SEQ. ID. NO. 13198 | 331-GlyGlyArgIleValArgGluGluLysGlnGlyAspArgLeuPro-345 |
| SEQ. ID. NO. 13199 | 352-GluAsnLeuGluLysGluValArgArgTyrAlaGluAlaAlaAlaArgArgSerGlyGlyArgArgAspLeuSerHis-377 |
| 958 AMPHI Regions - AMPHI | |
| SEQ. ID. NO. 13200 | 34-AspAsnProThrAlaGlyGluSerValArgSerValSerGluProIleGln-50 |
| SEQ. ID. NO. 13201 | 86-ProGluAspTyrThrArgIleValAlaAsp-95 |
| SEQ. ID. NO. 13202 | 127-TyrAspGlnSerGlyAsp-132 |
| SEQ. ID. NO. 13203 | 176-GlyArgArgLeuGlnSerValSerArgThrAlaGluMet-188 |
| SEQ. ID. NO. 13204 | 343-IleSerAspThrLeuGln-348 |
| SEQ. ID. NO. 13205 | 483-TyrTyrSerLeuAsnArgPhe-489 |
| SEQ. ID. NO. 13206 | 491-SerGlnGluAlaArgArgVal-497 |
| SEQ. ID. NO. 13207 | 500-ThrLeuProIleVal-504 |
| SEQ. ID. NO. 13208 | 521-GlyGluValLeuGlnThrLeuGluProArgLeu-531 |
| SEQ. ID. NO. 13209 | 541-GlnAsnAspLeuProAsnPheAsp-548 |
| SEQ. ID. NO. 13210 | 572-AsnThrAlaAsnSerLeuSerAlaAlaValGlnSer-583 |
| SEQ. ID. NO. 13211 | 616-ValGlyLysLysPro-620 |
| SEQ. ID. NO. 13212 | 693-AspLysLeuSerGln-697 |
| SEQ. ID. NO. 13213 | 723-LysLysProIleGlu-727 |
| SEQ. ID. NO. 13214 | 769-AspLeuSerSerValGlyArgAsnPro-777 |
| Antigenic Index - Jameson-Wolf | |
| SEQ. ID. NO. 13215 | 28-ValAlaAlaGluGluThrAspAsnProThrAlaGlyGluSerValArgSerValSerGluProIleGln-50 |
| SEQ. ID. NO. 13216 | 55-SerLeuGlySerThr-59 |
| SEQ. ID. NO. 13217 | 63-CysSerAsnGluSerGlySerProGluArgThrGluAlaAlaValGlnGlySerGlyGluAlaSerIleProGluAspTyrThrArgIleValAlaAspArgMetGluGlyGlnSerGlnValGlnValArgAlaGluGly-109 |
| SEQ. ID. NO. 13218 | 111-ValValValGluArgAsnArgThrThrLeuAsn-121 |
| SEQ. ID. NO. 13219 | 123-AspTrpAlaAspTyrAspGlnSerGlyAspThrValThrAlaGlyAspArgPheAlaLeuGlnGlnAspGlyThrLeuIleArgGlyGluThrLeu-154 |
| SEQ. ID. NO. 13220 | 158-LeuGluGlnGlnThrGlyGluAlaHisAsnValArgMetGluIleGluGlnGlyGlyArgArgLeuGlnSerValSerArgThrAlaGluMetLeuGlyGlyGlyHisTyrLysLeuThrGluThrGlnPheAsnThrCysSerAlaGlyAspAlaGlyTrp-211 |
| SEQ. ID. NO. 13221 | 216-AlaSerValGluAlaAspArgGluLysGlyIleGly-227 |
| SEQ. ID. NO. 13222 | 249-PheProLeuAspGlyAsnArgLysSerGlyLeu-259 |
| SEQ. ID. NO. 13223 | 265-SerAlaGlySerAspGlyVal-271 |
| SEQ. ID. NO. 13224 | 293-ValIleGlyGluArgGlyAlaValPheAspGlyGlnValArgTyrLeuArgProAspTyrAlaGlyGlnSerAsp-317 |
| SEQ. ID. NO. 13225 | 321-LeuProHisAspLysLysSerGlyArgAsnAsnArgTyrGlnAla-335 |
| SEQ. ID. NO. 13226 | 337-TrpGlnHisArgHisAspIleSerAspThrLeu-347 |
| SEQ. ID. NO. 13227 | 352-AspPheAsnGlnValSerAspSerGlyTyrTyrArgAspPheTyrGlyAsnLysGluIleAlaGlyAsnValAsnLeuAsnArgArgValTrp-382 |
| SEQ. ID. NO. 13228 | 384-AspTyrGlyGlyArgAlaAlaGlyGlySerLeu-394 |
| SEQ. ID. NO. 13229 | 407-AlaAsnGlnSerGlyTyrLysAspLysProTyr-417 |
| SEQ. ID. NO. 13230 | 425-ValGluTrpArgLysAsnThrGlyArgAla-434 |
| SEQ. ID. NO. 13231 | 444-ArgPheSerHisAspSerArgGlnAspGlySerArg-455 |
| SEQ. ID. NO. 13232 | 460-ProAspIleLysTrpAspPheSerAsnSerTrpGly-471 |
| SEQ. ID. NO. 13233 | 487-AsnArgPheGlySerGlnAlaArgArgValSerArg-499 |
| SEQ. ID. NO. 13234 | 507-AspSerGlyAlaThrPheGluArgAsnThrArgMetPheGly-520 |
| SEQ. ID. NO. 13235 | 538-AlaLysSerGlnAsnAspLeuProAsnPheAspSerSerGluSerSerPheGly-555 |
| SEQ. ID. NO. 13236 | 560-PheArgGluAsnLeuTyrTyrGlyAsnAspArgIleAsnThrAlaAsnSer-576 |
| SEQ. ID. NO. 13237 | 581-ValGlnSerArgIleLeuAspGlyAlaThrGlyGluGluArgPheArgAlaGlyIleGlyGlnLysPheTyrPheLysAspAspAlaValMetLeuAspGlySerValGlyLysLysProArgAsnArgSerAspTrp-626 |
| SEQ. ID. NO. 13238 | 631-SerGlySerIleGlySer-636 |
| SEQ. ID. NO. 13239 | 642-SerSerIleHisTyrAsnGlnAsnAspLysArgAlaGluAsn-655 |
| SEQ. ID. NO. 13240 | 660-AlaSerTyrArgProAlaGlnGlyLysValLeuAsnAlaArgTyrLysTyrGlyArgAsnGluLysIleTyrLeuLysSerAspGlySerTyrPhe-691 |
| SEQ. ID. NO. 13241 | 693-AspLysLeuSerGln-697 |
| SEQ. ID. NO. 13242 | 718-TyrGlyPheGluAlaLysLysProIleGlu-727 |
| SEQ. ID. NO. 13243 | 732-AlaGluTyrLysSerSerCysGlyCysTrp-741 |
| SEQ. ID. NO. 13244 | 751-ValThrGlyGluAsnThrTyrLysAsn-759 |

TABLE 1-continued

| | |
|---|---|
| SEQ. ID. NO. 13245 | 766-GlnLeuLysAspLeuSerSerValGlyArgAsnProAlaAspArgMetAspVal-783 |
| SEQ. ID. NO. 13246 | 794-LeuSerAlaGlyArgAsnLysArgPro-802 |

Hydrophilic Regions - Hopp-Woods

| | |
|---|---|
| SEQ. ID. NO. 13247 | 28-ValAlaAlaGluGluThrAspAsnProThrAlaGlyGluSerValArgSerValSerGluProIleGln-50 |
| SEQ. ID. NO. 13248 | 65-AsnGluSerGlySerProGluArgThrGluAlaAlaVal-77 |
| SEQ. ID. NO. 13249 | 79-GlySerGlyGluAlaSerIleProGluAspTyrThr-90 |
| SEQ. ID. NO. 13250 | 93-ValAlaAspArgMetGluGlyGlnSer-101 |
| SEQ. ID. NO. 13251 | 103-ValGlnValArgAlaGluGly-109 |
| SEQ. ID. NO. 13252 | 111-ValValValGlyArgAsnArgThrThrLeu-120 |
| SEQ. ID. NO. 13253 | 125-AlaAspTyrAspGlnSerGlyAspThrValThrAlaGlyAspArgPheAlaLeu-142 |
| SEQ. ID. NO. 13254 | 147-ThrLeuIleArgGlyGluThr-153 |
| SEQ. ID. NO. 13255 | 160-GlnGlnThrGlyGluAlaHisAsnValArgMetGluIleGluGlnGlyGlyArgArgLeuGlnSerValSerArgThrAlaGluMetLeuGly-190 |
| SEQ. ID. NO. 13256 | 192-GlyHisTyrLysLeuThrGlu-198 |
| SEQ. ID. NO. 13257 | 216-AlaSerValGluAlaAspArgGluLysGlyIleGly-227 |
| SEQ. ID. NO. 13258 | 250-ProLeuAspGlyAsnArgLysSerGly-258 |
| SEQ. ID. NO. 13259 | 266-AlaGlySerAspGlyVal-271 |
| SEQ. ID. NO. 13260 | 294-IleGlyGluArgGlyAlaVal-300 |
| SEQ. ID. NO. 13261 | 305-ValArgTyrLeuArg-309 |
| SEQ. ID. NO. 13262 | 323-HisAspLysLysSerGlyArgAsnAsnArgTyrGlnAla-335 |
| SEQ. ID. NO. 13263 | 337-TrpGlnHisArgHisAspIleSerAsp-345 |
| SEQ. ID. NO. 13264 | 410-SerGlyTyrLysAspLysProTyr-417 |
| SEQ. ID. NO. 13265 | 425-ValGluTrpLysAsnThrGlyArgAla-434 |
| SEQ. ID. NO. 13266 | 445-PheSerHisAspSerArgGlnAspGlySerArg-455 |
| SEQ. ID. NO. 13267 | 490-GlySerGlnGluAlaArgArgValSerArg-499 |
| SEQ. ID. NO. 13268 | 510-AlaThrPheGluArgAsnThrArg-517 |
| SEQ. ID. NO. 13269 | 539-LysSerGlnAsnAsp-543 |
| SEQ. ID. NO. 13270 | 548-AspSerSerGluSer-552 |
| SEQ. ID. NO. 13271 | 569-AspArgIleAsnThr-573 |
| SEQ. ID. NO. 13272 | 589-AlaThrGlyGluGluArgPheArgAla-597 |
| SEQ. ID. NO. 13273 | 604-TyrPheLysAspAspAlaValMet-611 |
| SEQ. ID. NO. 13274 | 615-SerValGlyLysLysProArgAsnArgSerAsp-625 |
| SEQ. ID. NO. 13275 | 648-GlnAsnAspLysArgAlaGluAsn-655 |
| SEQ. ID. NO. 13276 | 662-TyrArgProAlaGln-666 |
| SEQ. ID. NO. 13277 | 674-TyrLysTyrGlyArgAsnGluLysIleTyrLeuLysSerAspGly-688 |
| SEQ. ID. NO. 13278 | 720-PheGluAlaLysLysProIleGlu-727 |
| SEQ. ID. NO. 13279 | 732-AlaGluTyrLysSer-736 |
| SEQ. ID. NO. 13280 | 766-GlnLeuLysAspLeuSerSerValGlyArgAsnProAlaAspArgMetAspVal-783 |
| SEQ. ID. NO. 13281 | 795-SerAlaGlyArgAsnLysArgPro-802 |

959
AMPHI Regions - AMPHI

| | |
|---|---|
| SEQ. ID. NO. 13282 | 56-AlaAlaLeuAlaArgValGlyGly-63 |

Antigenic Index - Jameson-Wolf

| | |
|---|---|
| SEQ. ID. NO. 13283 | 24-AlaHisHisAspGlyHisGlyAspAspAspHisGlyHis-36 |
| SEQ. ID. NO. 13284 | 38-AlaHisGlnHisAsnLysGlnAspLysIleIleSer-49 |
| SEQ. ID. NO. 13285 | 51-AlaGlnAlaGluLysAlaAlaLeu-58 |
| SEQ. ID. NO. 13286 | 60-ArgValGlyGlyLysIleThrAspIleAspLeuGluHisAspAsnGlyArgProHisTyrAspValGluIleValLysAsnGlyGlnGluTyr-90 |
| SEQ. ID. NO. 13287 | 94-ValAspAlaArgThrGlyArgValIleSerSerArgArgAspAsp-108 |

Hydrophilic Regions - Hopp-Woods

| | |
|---|---|
| SEQ. ID. NO. 13288 | 27-AspGlyHisGlyAspAspAspHisGlyHis-36 |
| SEQ. ID. NO. 13289 | 40-GlnHisAsnLysGlnAspLysIleIleSer-49 |
| SEQ. ID. NO. 13290 | 51-AlaGlnAlaGluLysAlaAlaLeu-58 |
| SEQ. ID. NO. 13291 | 61-ValGlyGlyLysIleThrAspIleAspLeuGluHisAspAsnGlyArgProHisTyr-79 |
| SEQ. ID. NO. 13292 | 82-GluIleValLysAsnGlyGlnGluTyr-90 |
| SEQ. ID. NO. 13293 | 94-ValAspAlaArgThrGlyArg-100 |
| SEQ. ID. NO. 13294 | 102-IleSerSerArgArgAspAsp-108 |

960
AMPHI Regions - AMPHI

| | |
|---|---|
| SEQ. ID. NO. 13295 | 24-AlaProArgLeuLeuProSerPheThrAspPro-34 |
| SEQ. ID. NO. 13296 | 39-LeuSerAlaProGlyGlyTyrIleVal-47 |
| SEQ. ID. NO. 13297 | 58-IleGluLysLeuAlaLysGlnProGluTyrAlaTyrLeuLysGlnLeuGlnValAlaLysAsnValAsn-80 |
| SEQ. ID. NO. 13298 | 137-PheAlaSerLeuAlaSer-142 |
| SEQ. ID. NO. 13299 | 154-AspValGlyLysThrLeuLysGluLeuGlyArgSerArgThr-167 |
| SEQ. ID. NO. 13300 | 189-LeuAlaThrTrpSerGlu-194 |
| SEQ. ID. NO. 13301 | 230-AsnIleLeuAlaAlaLeuValAsnThrAla-239 |
| SEQ. ID. NO. 13302 | 245-SerLysIleLysGly-249 |
| SEQ. ID. NO. 13303 | 257-HisLysIleAlaHisAlaValAlaGlyCysAla-267 |
| SEQ. ID. NO. 13304 | 280-AlaIleGlyAlaAlaValGlyGluIleValGlyGlu-291 |
| SEQ. ID. NO. 13305 | 314-IleThrAlaTyrAlaLys-319 |
| SEQ. ID. NO. 13306 | 338-GlnThrAlaGlnAsnAla-343 |
| SEQ. ID. NO. 13307 | 345-GluAsnAsnAlaValLysAlaValValThr-354 |
| SEQ. ID. NO. 13308 | 359-ValTyrLysValAlaArgLysGly-366 |
| SEQ. ID. NO. 13309 | 387-AsnLeuAlaAspAsnLeuThrThrLeuPheAsp-397 |
| SEQ. ID. NO. 13310 | 418-AsnArgAlaAsnLysGlyGluAlaAlaGlnLysLysGluValLeu-433 |
| SEQ. ID. NO. 13311 | 460-LysGlnLeuAlaGlnIle-465 |

Antigenic Index - Jameson-Wolf

| | |
|---|---|
| SEQ. ID. NO. 13312 | 11-LeuTyrArgArgGlySerValLysProProLeu-21 |
| SEQ. ID. NO. 13313 | 23-GluAlaProArgLeuLeuProSerPheThrAsp-33 |
| SEQ. ID. NO. 13314 | 35-ValValProLysLeuSerAlaProGly-43 |
| SEQ. ID. NO. 13315 | 48-AspIleProLysGlyAsnLeuLysThrGluIleGluLysLeuAlaLysGlnProGlu-66 |
| SEQ. ID. NO. 13316 | 77-LysAsnValAsnTrp-81 |

TABLE 1-continued

| | |
|---|---|
| SEQ. ID. NO. 13317 | 87-AlaTyrAspLysTrpAspTyrLysGlnGluGlyLeuThr-99 |
| SEQ. ID. NO. 13318 | 150-AsnAsnLysGlyAspValGlyLysThrLeuLysGluLeuGlyArgSerArgThrValLys-169 |
| SEQ. ID. NO. 13319 | 180-ValSerAsnLysLeuGlyAla-186 |
| SEQ. ID. NO. 13320 | 193-SerGluThrProTrp-197 |
| SEQ. ID. NO. 13321 | 218-ValAsnGlyGlySerLeuLysAspAsnLeuGlu-228 |
| SEQ. ID. NO. 13322 | 239-AlaHisGlyGluAlaAlaSerLysIleLysGlyLeuAsp-251 |
| SEQ. ID. NO. 13323 | 270-AlaAlaAsnLysGlyLysCysGlnAspGlyAla-280 |
| SEQ. ID. NO. 13324 | 292-AlaLeuValLysAsnThrAspPheSerAspMetThrProGluGlnLeuAspLeuGluValLysLys-313 |
| SEQ. ID. NO. 13325 | 329-ThrGlyGlyAspValAsnThr-335 |
| SEQ. ID. NO. 13326 | 362-ValAlaArgLysGlyLeuLysAsnGlyLysIleAsnValArgAspLeuLysGlnThrLeuLysAspGluGlyTyrAsnLeu-388 |
| SEQ. ID. NO. 13327 | 398-GluThrLeuAspTrpAsnAspAlaLysAla-407 |
| SEQ. ID. NO. 13328 | 415-ThrGluLeuAsnArgAlaAsnLysGlyGluAlaAlaGlnLysValLysGluValLeuGluLysAsnArgProTyrIleProAsnLysGlyAlaValPro-447 |
| SEQ. ID. NO. 13329 | 451-ThrTyrMetLysAsnAsnProPheGlyLysGln-461 |
| SEQ. ID. NO. 13330 | 465-IleSerGluLysThrThrLeuProThrGlnGlnGlyGlnSer-478 |
| SEQ. ID. NO. 13331 | 483-LysArgAsnGlnGlyLeuLeuLysThrGlyAspArgPheTyrLeuAspGlyGlnHisLysAsnHisLeu-505 |
| SEQ. ID. NO. 13332 | 507-ValPheAspLysAsnGlyAsnPheLys-515 |
| SEQ. ID. NO. 13333 | 520-MetAspGlySerLeuAsnGlnMetLysThrGlyAlaAlaLysGlyArgLysLeuAsnLeu-539 |
| Hydrophilic Regions - Hopp-Woods | |
| SEQ. ID. NO. 13334 | 13-ArgArgGlySerValLys-18 |
| SEQ. ID. NO. 13335 | 49-IleProLysGlyAsnLeuLysThrGluIleGluLysLeuAlaLysGlnProGlu-66 |
| SEQ. ID. NO. 13336 | 89-AspLysTrpAspTyrLysGlnGluGlyLeuThr-99 |
| SEQ. ID. NO. 13337 | 150-AsnAsnLysGlyAspValGlyLysThrLeuLysGluLeuGlyArgSerArgThrValLys-169 |
| SEQ. ID. NO. 13338 | 221-GlySerLeuLysAspAsnLeuGlu-228 |
| SEQ. ID. NO. 13339 | 239-AlaHisGlyGluAlaAlaSerLysIleLysGlyLeuAsp-251 |
| SEQ. ID. NO. 13340 | 270-AlaAlaAsnLysGlyLysCysGlnAsp-278 |
| SEQ. ID. NO. 13341 | 292-AlaLeuValLysAsnThrAspPheSerAspMetThrProGluGlnLeuAspLeuGluValLysLys-313 |
| SEQ. ID. NO. 13342 | 362-ValAlaArgLysGlyLeuLysAsnGlyLysIleAsnValArgAspLeuLysGlnThrLeuLysAspGluGlyTyrAsn-387 |
| SEQ. ID. NO. 13343 | 398-GluThrLeuAspTrpAsnAspAlaLysAla-407 |
| SEQ. ID. NO. 13344 | 416-GluLeuAsnArgAlaAsnLysGlyGluAlaAlaGlnLysValLysGluValLeuGluLysAsnArgPro-438 |
| SEQ. ID. NO. 13345 | 465-IleSerGluLysThrThrLeu-471 |
| SEQ. ID. NO. 13346 | 483-LysArgAsnGlnGly-487 |
| SEQ. ID. NO. 13347 | 499-GlyGlnHisLysAsnHis-504 |
| SEQ. ID. NO. 13348 | 507-ValPheAspLysAsnGlyAsn-513 |
| SEQ. ID. NO. 13349 | 522-GlySerLeuAsnGln-526 |
| SEQ. ID. NO. 13350 | 528-LysThrGlyAlaAlaLysGlyArgLysLeuAsnLeu-539 |
| 961-2 | |
| AMPHI Regions - AMPHI | |
| SEQ. ID. NO. 13351 | 6-PheProSerLysVal-10 |
| SEQ. ID. NO. 13352 | 13-ThrAlaIleLeuAlaThrPheCysSerGly-22 |
| SEQ. ID. NO. 13353 | 46-AsnGlyGlnGluIleAsnGlyPheLysAlaGlyGluThrIleTyrAspIle-62 |
| SEQ. ID. NO. 13354 | 90-LysValValThrAsnLeuThrLysThrVal-99 |
| SEQ. ID. NO. 13355 | 118-GluLysLeuThrThr-122 |
| SEQ. ID. NO. 13356 | 138-LeuAspGluThrThrAsnAlaLeuAsnLysLeuGlyGluAsnIleThrThrPheAla-156 |
| SEQ. ID. NO. 13357 | 170-LeuGluAlaValAlaAspThrValAspLysHisAlaGluAlaPheAsnAspIleAlaAspSerLeuAsp-192 |
| SEQ. ID. NO. 13358 | 200-GluAlaValLysThrAlaAsnGluAlaLysGlnThrAlaGlu-213 |
| SEQ. ID. NO. 13359 | 273-AlaArgIleAspSerLeuAspLysAsnValAlaAsnLeuArgLysGluThrArgGlnGlyLeu-293 |
| SEQ. ID. NO. 13360 | 300-SerGlyLeuPheGlnProTyrAsnVal-308 |
| Antigenic Index - Jameson-Wolf | |
| SEQ. ID. NO. 13361 | 27-ThrSerAspAspAspValLysLysAlaAla-36 |
| SEQ. ID. NO. 13362 | 45-AsnAsnGlyGlnGluIleAsnGlyPheLysAlaGlyGluThr-58 |
| SEQ. ID. NO. 13363 | 60-TyrAspIleGlyGluAspGlyThrIleThrGlnLysAspAlaThrAlaAlaAspValGluAlaAspAspPheLys-84 |
| SEQ. ID. NO. 13364 | 98-ThrValAsnGluAsnLysGlnAsnValAspAlaLysValLysAlaAlaGluSerGluIleGluLysLeuThrThrLysLeuAlaAspThrAspAlaAlaLeuAlaAspThrAspAlaAlaLeuAspGluThrThrAsnAlaLeuAsnLysLeuGlyGluAsnIleThr-153 |
| SEQ. ID. NO. 13365 | 155-PheAlaGluGluThrLysThrAsnIleValLysIleAspGluLysLeuGluAlaValAlaAspThrValAspLysHisAlaGluAlaPheAsnAspIleAlaAspSerLeuAspGluThrAsnThrLysAlaAspGluAlaValLysThrAlaAsnGluAlaLysGlnThrAlaGluGluThrLysGlnAsnValAspAlaLysValLysAlaAlaGluThrAlaAlaGlyLysAlaGluAlaAlaAla-237 |
| SEQ. ID. NO. 13366 | 239-ThrAlaAsnThrAlaAlaAspLysAlaGluAlaValAla-251 |
| SEQ. ID. NO. 13367 | 253-LysValThrAspIleLysAlaAspIleAlaThrAsnLysAlaAspIleAlaLysAsnSerAlaArgIleAspSerLeuAspLysAsnValAlaAsnLeuArgLysGluThrArgGlnGlyLeuAla-294 |
| SEQ. ID. NO. 13368 | 317-ValGlyGlyTyrLysSerGluSer-324 |
| SEQ. ID. NO. 13369 | 330-ThrGlyPheArgPhe-334 |
| SEQ. ID. NO. 13370 | 348-ThrSerSerGlySerSerAla-354 |
| Hydrophilic Regions - Hopp-Woods | |
| SEQ. ID. NO. 13371 | 27-ThrSerAspAspAspValLysLysAlaAla-36 |
| SEQ. ID. NO. 13372 | 54-LysAlaGlyGluThr-58 |
| SEQ. ID. NO. 13373 | 62-IleGlyGluAspGlyThrIleThrGlnLysAspAlaThrAlaAlaAspValGluAlaAspAspPheLys-84 |
| SEQ. ID. NO. 13374 | 98-ThrValAsnGluAsnLysGlnAsnValAspAlaLysValLysAlaAlaGluSerGluIleGluLysLeuThrThrLysLeuAlaAspThrAspAlaAlaLeuAlaAspThrAspAlaAlaLeuAspGluThrThrAsnAla-144 |
| SEQ. ID. NO. 37765 | 155-PheAlaGluGluThrLysThrAsnIleValLysIleAspGluLysLeuGluAlaValAlaAspThrValAspLysHisAlaGluAlaPheAsnAspIleAlaAspSerLeuAspGluThrAsnThrLysAlaAspGluAlaValLysThrAlaAsnGluAlaLysGlnThrAlaGluGluThrLysGlnAsnValAspAlaLysValLysAlaAlaGluThrAlaAlaGlyLysAlaGluAlaAlaAla-237 |
| SEQ. ID. NO. 13375 | 242-ThrAlaAlaAspLysAlaGluAlaValAla-251 |
| SEQ. ID. NO. 13376 | 253-LysValThrAspIleLysAlaAspIleAlaThrAsnLysAlaAspIleAlaLysAsnSerAlaArgIleAspSerLeuAspLysAsnValAlaAsnLeuArgLysGluThrArgGlnGlyLeuAla-294 |
| SEQ. ID. NO. 13377 | 320-TyrLysSerGluSer-324 |
| 972-2 | |
| AMPHI Regions - AMPHI | |
| SEQ. ID. NO. 13378 | 15-SerSerGluArgMetSerGluValGluTyrPheSerHis-27 |
| SEQ. ID. NO. 13379 | 83-ArgLysLeuGluGluIleLeuGly-90 |
| SEQ. ID. NO. 13380 | 100-ArgGlyAsnLysPheTyrGluSerMetTyrArgLeu-111 |

TABLE 1-continued

| | |
|---|---|
| SEQ. ID. NO. 13381 | 154-LeuAspAspSerIleArg-159 |
| SEQ. ID. NO. 13382 | 226-PheValArgValTyrGluLysGly-233 |
| SEQ. ID. NO. 13383 | 275-IleCysArgLysPheLysAsnMetProValPro-285 |
| SEQ. ID. NO. 13384 | 308-AsnAlaValGlyLysLeuValAsnPhe-316 |
| SEQ. ID. NO. 13385 | 326-GluIleValGluSerLeuLysAla-333 |
| SEQ. ID. NO. 13386 | 336-GlyPheProLysGlyLeuGlu-342 |
| SEQ. ID. NO. 13387 | 348-LeuGluMetLeuArgAspGlyLeuLys-356 |
| SEQ. ID. NO. 13388 | 382-AsnSerAspLysPheAspArg-388 |
| Antigenic Index - Jameson-Wolf | |
| SEQ. ID. NO. 13389 | 1-LeuThrAsnArgGlyGlyAlaLysLeuLysThrAsnSerLysSerSerGluArgMetSerGlu-21 |
| SEQ. ID. NO. 13390 | 29-IleSerAspGlyLysGlyLysLeuLeuGluIleProGlnArgArgGlyLysGlnAspGlyVal-49 |
| SEQ. ID. NO. 13391 | 62-ThrLeuLeuLysValSerGly-68 |
| SEQ. ID. NO. 13392 | 83-ArgLysLeuGluGlu-87 |
| SEQ. ID. NO. 13393 | 93-IleThrArgLysCysLysSerArgGlyAsnLysPheTyrGlu-106 |
| SEQ. ID. NO. 13394 | 108-MetTyrArgLeuGlySerAspAspValAspTyrGly-119 |
| SEQ. ID. NO. 13395 | 122-HisPheGlyGlyGlnArgAsnThrVal-130 |
| SEQ. ID. NO. 13396 | 134-LeuLysGlyThrGlyCys-139 |
| SEQ. ID. NO. 13397 | 152-GlnPheLeuAspAspSerIleArgThrArgIleThrArg-164 |
| SEQ. ID. NO. 13398 | 172-PheAspGlyGluTyrThrProAspGlnAlaLeuLeuAspHisAspAsnGlyPhePheAspAsnSerAsnGlnArgProLysSerGluThrIleGly-203 |
| SEQ. ID. NO. 13399 | 205-AlaTrpArgAsnGluAspGlySerGlyLys-214 |
| SEQ. ID. NO. 13400 | 217-TyrValGlyArgLysLysAsnSerArgPhe-226 |
| SEQ. ID. NO. 13401 | 228-ArgValTyrGluLysGlyArgGlnLeuGlyAspLysGluSerLysTrpVal-244 |
| SEQ. ID. NO. 13402 | 251-AsnTyrGlyAspIleGluIle-257 |
| SEQ. ID. NO. 13403 | 263-IleAsnGlnGlySer-267 |
| SEQ. ID. NO. 13404 | 275-IleCysArgLysPheLysAsnMetProValProGluArgPheAspGlnArgLysLysLysLeu-295 |
| SEQ. ID. NO. 13405 | 321-GlyPheAspAsnSerGluIleValGluSerLeuLysAlaAspSerGlyPheProLysGlyLeuGluProGluLysTyrAla-347 |
| SEQ. ID. NO. 13406 | 350-MetLeuArgAspGlyLeuLys-356 |
| SEQ. ID. NO. 13407 | 361-HisGluGlnProAspIleAspLeuGluIleGluLeuAspGlu-374 |
| SEQ. ID. NO. 13408 | 380-PheLysAsnSerAspLysPheAspArgGluLysArgLeuPheSerProAspTyrAspValGluLysGluArgLysTyrGlnGluTyrLeu-409 |
| SEQ. ID. NO. 13409 | 417-ValAspTyrAspTyrPhe-422 |
| Hydrophilic Regions - Hopp-Woods | |
| SEQ. ID. NO. 13410 | 1-LeuThrAsnArgGlyGlyAlaLysLeuLysThrAsnSerLysSerSerGluArgMetSerGlu-21 |
| SEQ. ID. NO. 13411 | 30-SerAspGlyLysGlyLysLeuLeuGluIleProGlnArgArgGlyLysGlnAspGlyVal-49 |
| SEQ. ID. NO. 13412 | 83-ArgLysLeuGluGlu-87 |
| SEQ. ID. NO. 13413 | 93-IleThrArgLysCysLysSerArgGlyAsnLysPheTyr-105 |
| SEQ. ID. NO. 13414 | 111-LeuGlySerAspAspValAspTyrGly-119 |
| SEQ. ID. NO. 13415 | 134-LeuLysGlyThrGly-138 |
| SEQ. ID. NO. 13416 | 152-GlnPheLeuAspAspSerIleArgThrArgIleThrArg-164 |
| SEQ. ID. NO. 13417 | 181-AlaLeuLeuAspHisAspAsnGlyPhe-189 |
| SEQ. ID. NO. 13418 | 193-SerAsnGlnArgProLysSerGluThrIle-202 |
| SEQ. ID. NO. 13419 | 206-TrpArgAsnGluAspGlySerGly-213 |
| SEQ. ID. NO. 13420 | 219-GlyArgLysLysAsnSerArgPhe-226 |
| SEQ. ID. NO. 13421 | 228-ArgValTyrGluLysGlyArgGlnLeuGlyAspLysGluSerLysTrpVal-244 |
| SEQ. ID. NO. 13422 | 277-ArgLysPheLysAsn-281 |
| SEQ. ID. NO. 13423 | 283-ProValProGluArgPheAspGlnArgLysLysLysLeu-295 |
| SEQ. ID. NO. 13424 | 321-GlyPheAspAsnSerGluIleValGluSerLeuLysAlaAspSerGlyPhe-337 |
| SEQ. ID. NO. 13425 | 339-LysGlyLeuGluProGluLysTyrAla-347 |
| SEQ. ID. NO. 13426 | 350-MetLeuArgAspGlyLeuLys-356 |
| SEQ. ID. NO. 13427 | 362-GluGlnProAspIleAspLeuGluIleGluLeuAspGlu-374 |
| SEQ. ID. NO. 13428 | 381-LysAsnSerAspLysPheAspArgGluLysArgLeuPhe-393 |
| SEQ. ID. NO. 13429 | 396-AspTyrAspValGluLysGluArgLysTyrGlnGluTyrLeu-409 |
| 973-2 | |
| AMPHI Regions - AMPHI | |
| SEQ. ID. NO. 13430 | 12-GluArgLeuIleAlaArgLeuAlaArgGluProAspSerAlaGluAspValLeuAsnLeuLeuArgGlnAla-35 |
| SEQ. ID. NO. 13431 | 44-AspThrLeuLeuArgLeuGluLysValLeuAspPhe-55 |
| SEQ. ID. NO. 13432 | 77-AspSerIleGluArgIleThrAlaTyr-85 |
| SEQ. ID. NO. 13433 | 112-AspLeuLeuLysTyrMet-117 |
| SEQ. ID. NO. 13434 | 143-AlaLeuLeuLysGluPheArgGluGln-151 |
| SEQ. ID. NO. 13435 | 171-PheGluAspIleIleGluGlnIleValGlyGluIleGluAsp-184 |
| SEQ. ID. NO. 13436 | 194-AsnIleHisAlaVal-198 |
| SEQ. ID. NO. 13437 | 208-AlaThrGluIleGluAspIleAsnThrPhe-217 |
| SEQ. ID. NO. 13438 | 235-IleGlnGluLeuGly-239 |
| Antigenic Index - Jameson-Wolf | |
| SEQ. ID. NO. 13439 | 1-MetAspGlyAlaGlnProLysThrAsnPhe-10 |
| SEQ. ID. NO. 13440 | 18-LeuAlaArgGluProAspSerAlaGluAspVal-28 |
| SEQ. ID. NO. 13441 | 34-GlnAlaHisGluGlnGluValPheAspAlaAspThr-45 |
| SEQ. ID. NO. 13442 | 47-LeuArgLeuGluLysValLeuAsp-54 |
| SEQ. ID. NO. 13443 | 56-SerAspLeuGluValArgAspAlaMetIleThrArgSerArgMetAsnValLeuLysGluAsnAspSerIleGluArg-81 |
| SEQ. ID. NO. 13444 | 96-ValIleGlyGluAspLysAspGluVal-104 |
| SEQ. ID. NO. 13445 | 118-PheAsnProGluGlnPheHis-124 |
| SEQ. ID. NO. 13446 | 136-ProGluGlyLysSer-140 |
| SEQ. ID. NO. 13447 | 146-LysGluPheArgGluGlnArgAsnHis-154 |
| SEQ. ID. NO. 13448 | 159-IleAspGluTyrGlyGlyThrSerGly-167 |
| SEQ. ID. NO. 13449 | 178-IleValGlyGluIleGluAspGluPheAspGluAspSerAlaAspAsn-194 |
| SEQ. ID. NO. 13450 | 199-SerSerGluArgTrpArg-204 |
| SEQ. ID. NO. 13451 | 209-ThrGluIleGluAspIleAsn-215 |
| SEQ. ID. NO. 13452 | 218-PheGlyThrGluTyrSerSerGluGluAlaAspThr-229 |
| SEQ. ID. NO. 13453 | 239-GlyHisLeuProValArgGlyGluLysValLeu-249 |
| SEQ. ID. NO. 13454 | 258-AlaArgAlaAspAsnArgArgLeuHis-266 |

TABLE 1-continued

Hydrophilic Regions - Hopp-Woods
SEQ. ID. NO. 13455  1-MetAspGlyAlaGlnProLys-7
SEQ. ID. NO. 13456  18-LeuAlaArgGluProAspSerAlaGluAspVal-28
SEQ. ID. NO. 13457  34-GlnAlaHisGluGlnGluValPheAsp-42
SEQ. ID. NO. 13458  47-LeuArgLeuGluLysValLeuAsp-54
SEQ. ID. NO. 13459  56-SerAspLeuGluValArgAspAlaMetIleThrArgSerArgMetAsnValLeuLysGluAsnAspSerIleGluArg-81
SEQ. ID. NO. 13460  96-ValIleGlyGluAspLysAspGluVal-104
SEQ. ID. NO. 13461  136-ProGluGlyLysSer-140
SEQ. ID. NO. 13462  146-LysGluPheArgGluGlnArgAsn-153
SEQ. ID. NO. 13463  178-IleValGlyGluIleGluAspGluPheAspGluAspAspSerAlaAspAsn-194
SEQ. ID. NO. 13464  199-SerSerGluArgTrpArg-204
SEQ. ID. NO. 13465  209-ThrGluIleGluAsp-213
SEQ. ID. NO. 13466  222-TyrSerSerGluGluAlaAspThr-229
SEQ. ID. NO. 13467  243-ValArgGlyGluLysValLeu-249
SEQ. ID. NO. 13468  258-AlaArgAlaAspAsnArgArgLeuHis-266
981-2
AMPHI Regions - AMPHI
SEQ. ID. NO. 13469  33-AlaAsnProAspLysValTyrArgValAlaSer-43
SEQ. ID. NO. 13470  48-AlaProPheGluSerLeuAsp-54
SEQ. ID. NO. 13471  68-AsnAlaMetAlaLys-72
SEQ. ID. NO. 13472  134-LysValSerSerSerGluAspLeuLysAsnMetAsnLysValGlyValVal-150
SEQ. ID. NO. 13473  169-LysIleAlaArgPheGlu-174
SEQ. ID. NO. 13474  183-LeuGluAsnGlyGlyLeuAspSerValVal-192
SEQ. ID. NO. 13475  199-AlaAsnTyrValLysAsnAsnPro-206
SEQ. ID. NO. 13476  209-GlyMetAspPheValThrLeuPro-216
SEQ. ID. NO. 13477  235-ValLysMetLeuAsnAspAlaLeuGluLysValArgGluSerGlyGluTyr-251
Antigenic Index - Jameson-Wolf
SEQ. ID. NO. 13478  21-CysGlyGlyGlnGlyLysAspThrAlaAla-30
SEQ. ID. NO. 13479  33-AlaAsnProAspLysValTyrArg-40
SEQ. ID. NO. 13480  51-GluSerLeuAspSerLysGlyAsnValGluGlyPheAsp-63
SEQ. ID. NO. 13481  78-IleGluPheLysHisGlnProTrpAspSer-87
SEQ. ID. NO. 13482  92-LeuAsnAsnGlyAspAlaAspVal-99
SEQ. ID. NO. 13483  106-IleThrAspAspArgLysGlnSerMetAspPheSerAspProTyrPhe-121
SEQ. ID. NO. 13484  129-ValProLysGlyLysLysValSerSerSerGluAspLeuLysAsnMetAsnLys-146
SEQ. ID. NO. 13485  162-LeuLeuGlyAsnAspAsnProLysIleAlaArg-172
SEQ. ID. NO. 13486  181-LysGluLeuGluAsnGlyGlyLeuAspSerValValSerAspSerAla-196
SEQ. ID. NO. 13487  203-LysAsnAsnProAlaLysGlyMetAspPhe-212
SEQ. ID. NO. 13488  216-ProAspPheThrThr-220
SEQ. ID. NO. 13489  227-ValArgLysGlyAspGluAlaThrVal-235
SEQ. ID. NO. 13490  237-MetLeuAsnAspAlaLeuGluLysValArgGluSerGlyGluTyrAspLysIleTyr-255
SEQ. ID. NO. 13491  259-PheAlaLysGluAspGlyGlnAlaAlaLys-268
Hydrophilic Regions - Hopp-Woods
SEQ. ID. NO. 13492  23-GlyGlnGlyLysAspThrAlaAla-30
SEQ. ID. NO. 13493  33-AlaAsnProAspLysValTyrArg-40
SEQ. ID. NO. 13494  51-GluSerLeuAspSerLysGlyAsnValGluGlyPheAsp-63
SEQ. ID. NO. 13495  93-AsnAsnGlyAspAlaAspVal-99
SEQ. ID. NO. 13496  106-IleThrAspAspArgLysGlnSerMetAspPheSer-117
SEQ. ID. NO. 13497  130-ProLysGlyLysLysValSerSerSerGluAspLeuLysAsnMetAsn-145
SEQ. ID. NO. 13498  166-AspAsnProLysIleAlaArg-172
SEQ. ID. NO. 13499  181-LysGluLeuGluAsnGlyGlyLeu-188
SEQ. ID. NO. 13500  205-AsnProAlaLysGlyMetAsp-211
SEQ. ID. NO. 13501  227-ValArgLysGlyAspGluAlaThrVal-235
SEQ. ID. NO. 13502  237-MetLeuAsnAspAlaLeuGluLysValArgGluSerGlyGluTyrAspLysIleTyr-255
SEQ. ID. NO. 13503  259-PheAlaLysGluAspGlyGlnAlaAlaLys-268
982
AMPHI Regions - AMPHI
SEQ. ID. NO. 13504  12-ValArgGlnLysMetValAsnGlyValAsnIleLeuAlaAsnAlaVal-27
SEQ. ID. NO. 13505  71-AlaGlnMetValLysGluValAlaSerLysThr-81
SEQ. ID. NO. 13506  100-ValAlaGluGlyMetLysTyr-106
SEQ. ID. NO. 13507  115-AspLeuLysArgGlyIleAspLysAlaValAlaAlaLeuValAspGlu
             LeuLysAsnIleAlaLysProCysAspThrSerLysGluIleAlaGlnValGlySer-149
SEQ. ID. NO. 13508  160-AlaIleIleAlaGluAlaMetGluLysValGly-170
SEQ. ID. NO. 13509  185-AsnGluLeuAspValValGluGlyMet-193
SEQ. ID. NO. 13510  209-GluLysGlnIleAlaAla-214
SEQ. ID. NO. 13511  227-IleSerAsnIleArgAspLeuLeuProValLeuGluGlnValAlaLysAla-243
SEQ. ID. NO. 13512  265-AsnAsnIleArgGlyIleLeuLysThrValAla-275
SEQ. ID. NO. 13513  313-ThrLeuAspAspLeuGlyGlnAlaLysArgIle-323
SEQ. ID. NO. 13514  331-ThrIleIleAspGlyPheGlyAspAlaAla-340
SEQ. ID. NO. 13515  367-GluArgValAlaLysLeuAlaGlyGlyVal-376
SEQ. ID. NO. 13516  426-LeuGluAsnLeuHisThr-431
SEQ. ID. NO. 13517  444-LeuArgAlaValGluSerProLeuArgGlnIleValAlaAsnAla-458
SEQ. ID. NO. 13518  484-GluTyrGlyAspMetIleGluMet-491
SEQ. ID. NO. 13519  500-ThrArgSerAlaLeu-504
Antigenic Index - Jameson-Wolf
SEQ. ID. NO. 13520  1-MetAlaAlaLysAspValGlnPhe-8
SEQ. ID. NO. 13521  10-AsnGluValArgGlnLysMetValAsn-18
SEQ. ID. NO. 13522  30-ThrLeuGlyProLysGlyArgAsnValValVal-40
SEQ. ID. NO. 13523  43-AlaPheGlyGlyProHisIleThrLysAspGlyValThrValAlaLysGluIleGluLeuLysAspLysPheGluAsnMetGly-70
SEQ. ID. NO. 13524  73-MetValLysGluValAlaSerLysThrAsnAspValAlaGlyAspGlyThrThr-90
SEQ. ID. NO. 13525  112-AsnProThrAspLeuLysArgGlyIleAspLysAlaVal-124

TABLE 1-continued

| SEQ. ID. NO. | Sequence |
|---|---|
| SEQ. ID. NO. 13526 | 129-AspGluLeuLysAsnIleAlaLysProCysAspThrSerLysGluIleAla-145 |
| SEQ. ID. NO. 13527 | 150-IleSerAlaAsnSerAspGluGlnVal-158 |
| SEQ. ID. NO. 13528 | 164-GluAlaMetGluLysValGlyLysGluGlyValIleThrValGluAspGlyLysSerLeuGluAsnGluLeuAspVal-189 |
| SEQ. ID. NO. 13529 | 193-MetGlnPheAspArgGlyTyr-199 |
| SEQ. ID. NO. 13530 | 207-AspAlaGluLysGlnIleAla-213 |
| SEQ. ID. NO. 13531 | 223-PheAspLysLysIleSerAsnIleArgAsp-232 |
| SEQ. ID. NO. 13532 | 239-GlnValAlaLysAlaSerArg-245 |
| SEQ. ID. NO. 13533 | 252-GluAspValGluGlyGluAla-258 |
| SEQ. ID. NO. 13534 | 266-AsnIleArgGlyIleLeu-271 |
| SEQ. ID. NO. 13535 | 278-AlaProGlyPheGlyAspArgArgLysAlaMetLeu-289 |
| SEQ. ID. NO. 13536 | 303-GluGluValGlyLeuSerLeuGluLysAlaThrLeuAspAspLeuGlyGlnAlaLysArgIleGluIleGlyLysGluAsnThrThr-331 |
| SEQ. ID. NO. 13537 | 334-AspGlyPheGlyAspAlaAlaGlnIleGluAlaArgValAlaGluIleArgGlnGlnIleGluThrAlaThrSerAspTyrAspLysGluLysLeuGlnGluArgValAlaLysLeuAlaGly-374 |
| SEQ. ID. NO. 13538 | 385-ThrGluValGluMetLysGluLysLysAspArgValGluAspAlaLeuHis-401 |
| SEQ. ID. NO. 13539 | 405-AlaAlaValGluGluGlyVal-411 |
| SEQ. ID. NO. 13540 | 421-ArgAlaArgAlaAlaLeu-426 |
| SEQ. ID. NO. 13541 | 430-HisThrGlyAsnAlaAspGlnAspAlaGlyVal-440 |
| SEQ. ID. NO. 13542 | 446-AlaValGluSerProLeuArg-452 |
| SEQ. ID. NO. 13543 | 455-ValAlaAsnAlaGlyGlyGluProSerVal-464 |
| SEQ. ID. NO. 13544 | 469-ValLeuGluGlyLysGlyAsnTyrGlyTyr-478 |
| SEQ. ID. NO. 13545 | 480-AlaGlySerGlyGluTyrGlyAspMetIleGlu-490 |
| SEQ. ID. NO. 13546 | 495-AspProAlaLysValThrArgSerAlaLeu-504 |
| SEQ. ID. NO. 13547 | 523-GluIleProGluAspLysProAlaValProAspMetGlyGly-536 |
| Hydrophilic Regions - Hopp-Woods | |
| SEQ. ID. NO. 13548 | 1-MetAlaAlaLysAspValGlnPhe-8 |
| SEQ. ID. NO. 13549 | 10-AsnGluValArgGlnLysMet-16 |
| SEQ. ID. NO. 13550 | 33-ProLysGlyArgAsnValValVal-40 |
| SEQ. ID. NO. 13551 | 48-HisIleThrLysAspGlyValThrValAlaLysGluIleGluLeuLysAspLysPheGluAsn-68 |
| SEQ. ID. NO. 13552 | 73-MetValLysGluValAlaSerLysThrAsnAspValAlaGlyAspGlyThrThr-90 |
| SEQ. ID. NO. 13553 | 114-ThrAspLeuLysArgGlyIleAspLysAlaVal-124 |
| SEQ. ID. NO. 13554 | 129-AspGluLeuLysAsnIleAlaLysProCysAspThrSerLysGluIleAla-145 |
| SEQ. ID. NO. 13555 | 152-AlaAsnSerAspGluGlnVal-158 |
| SEQ. ID. NO. 13556 | 164-GluAlaMetGluLysValGlyLysGluGlyValIleThrValGluAspGlyLysSerLeuGluAsnGluLeuAspVal-189 |
| SEQ. ID. NO. 13557 | 207-AspAlaGluLysGlnIleAla-213 |
| SEQ. ID. NO. 13558 | 223-PheAspLysLysIleSerAsnIleArgAsp-232 |
| SEQ. ID. NO. 13559 | 239-GlnValAlaLysAlaSerArg-245 |
| SEQ. ID. NO. 13560 | 252-GluAspValGluGlyGluAla-258 |
| SEQ. ID. NO. 13561 | 280-GlyPheGlyAspArgArgLysAlaMetLeu-289 |
| SEQ. ID. NO. 13562 | 303-GluGluValGlyLeuSerLeuGluLysAlaThrLeuAspAspLeuGlyGlnAlaLysArgIleGluIleGlyLysGluAsnThrThr-331 |
| SEQ. ID. NO. 13563 | 340-AlaGlnIleGluAlaArgValAlaGluIleArgGlnGlnIleGluThrAlaThrSerAspTyrAspLysGluLysLeuGlnGluArgValAlaLys-371 |
| SEQ. ID. NO. 13564 | 385-ThrGluValGluMetLysGluLysLysAspArgValGluAspAlaLeuHis-401 |
| SEQ. ID. NO. 13565 | 405-AlaAlaValGluGluGlyVal-411 |
| SEQ. ID. NO. 13566 | 421-ArgAlaArgAlaAlaLeu-426 |
| SEQ. ID. NO. 13567 | 433-AsnAlaAspGlnAspAla-438 |
| SEQ. ID. NO. 13568 | 446-AlaValGluSerProLeu-451 |
| SEQ. ID. NO. 13569 | 458-AlaGlyGlyGluPro-462 |
| SEQ. ID. NO. 13570 | 469-ValLeuGluGlyLysGly-474 |
| SEQ. ID. NO. 13571 | 481-GlySerGlyGluTyrGlyAsp-487 |
| SEQ. ID. NO. 13572 | 495-AspProAlaLysValThrArg-501 |
| SEQ. ID. NO. 13573 | 523-GluIleProGluAspLysProAlaVal-531 |
| 986-2 | |
| AMPHI Regions - AMPHI | |
| SEQ. ID. NO. 13574 | 6-GlnTyrLeuAlaLeuAla-11 |
| SEQ. ID. NO. 13575 | 18-LeuAlaGlyCysAspLysGluAlaGly-25 |
| SEQ. ID. NO. 13576 | 36-SerPheValGluArgIleGluHis-43 |
| SEQ. ID. NO. 13577 | 55-ProAspPheAlaGlnLeuValGln-62 |
| SEQ. ID. NO. 13578 | 99-PheTyrGluPhePheLysArgLeuValProAsnMetProGluIleProGln-115 |
| SEQ. ID. NO. 13579 | 145-ThrGlyMetGlySerIle-150 |
| SEQ. ID. NO. 13580 | 162-AlaLysLeuIleGlySerAspVal-169 |
| SEQ. ID. NO. 13581 | 189-IleGlyAsnProLysAspLeuLysProGly-198 |
| SEQ. ID. NO. 13582 | 200-TrpValAlaAlaIleGly-205 |
| SEQ. ID. NO. 13583 | 287-AlaGluGlnLeuLysAsnThrGlyLysVal-296 |
| SEQ. ID. NO. 13584 | 393-AlaAlaGluHisIleGlyAlaSer-400 |
| SEQ. ID. NO. 13585 | 471-ArgLysAlaMetAspLysAla-477 |
| Antigenic Index - Jameson-Wolf | |
| SEQ. ID. NO. 13586 | 1-ValPheLysLysTyr-5 |
| SEQ. ID. NO. 13587 | 20-GlyCysAspLysAlaGly-25 |
| SEQ. ID. NO. 13588 | 29-GlyAlaAspLysLysGluAlaSerPheValGluArgIleGluHisThrLysAspAspGlySerVal-50 |
| SEQ. ID. NO. 13589 | 61-ValGlnSerGluGlyProAla-67 |
| SEQ. ID. NO. 13590 | 75-ProAlaProArgThrGlnAsnGlySerGlyAsnAlaGluAsnAspSerAspProIleAlaAspAsnAspProPhe-99 |
| SEQ. ID. NO. 13591 | 104-LysArgLeuValProAsnMetProGluIleProGlnGluGluAlaAspAspGlyGlyLeu-123 |
| SEQ. ID. NO. 13592 | 130-IleIleSerLysAspGlyTyr-136 |
| SEQ. ID. NO. 13593 | 154-LeuAsnAspLysArgGluTyrThr-161 |
| SEQ. ID. NO. 13594 | 165-IleGlySerAspValGlnSerAspValAla-174 |
| SEQ. ID. NO. 13595 | 179-AspAlaThrGluGluLeuPro-185 |
| SEQ. ID. NO. 13596 | 189-IleGlyAsnProLysAspLeuLysProGlyGlu-199 |

TABLE 1-continued

| | |
|---|---|
| SEQ. ID. NO. 13597 | 208-PheGlyPheAspAsnSerVal-214 |
| SEQ. ID. NO. 13598 | 219-ValSerAlaLysGlyArgSerLeuProAsnGluSerTyr-231 |
| SEQ. ID. NO. 13599 | 242-AsnProGlyAspAsnSerGlyGlyPro-249 |
| SEQ. ID. NO. 13600 | 265-TyrSerArgSerGlyGly-270 |
| SEQ. ID. NO. 13601 | 288-GluGlnLeuLysAsnThrGlyLysValGlnArgGlyGlnLeu-301 |
| SEQ. ID. NO. 13602 | 316-PheGlyLeuAspLysAlaGlyGly-323 |
| SEQ. ID. NO. 13603 | 330-LeuProGlySerProAlaGluArgAlaGlyLeuGlnAlaGlyAsp-344 |
| SEQ. ID. NO. 13604 | 349-LeuAspGlyGlyGluIleArgSerSerGlyAspLeu-360 |
| SEQ. ID. NO. 13605 | 368-ThrProGlyLysGluValSer-374 |
| SEQ. ID. NO. 13606 | 378-TrpArgLysGlyGluGluIleThrIle-386 |
| SEQ. ID. NO. 13607 | 397-IleGlyAlaSerSerLysThrAspGluAlaProTyrThrGluGlnGlnSerGlyThrPhe-416 |
| SEQ. ID. NO. 13608 | 427-ThrHisThrAspSerSerGlyGly-434 |
| SEQ. ID. NO. 13609 | 440-ArgValSerAspAlaAlaGluArgAlaGlyLeuArgArgGlyAspGluIleLeu-457 |
| SEQ. ID. NO. 13610 | 463-ProValAsnAspGluAlaGlyPheArgLysAlaMetAspLysAlaGlyLysAsnVal-481 |
| SEQ. ID. NO. 13611 | 486-MetArgArgGlyAsnThr-491 |
| Hydrophilic Regions - Hopp-Woods | |
| SEQ. ID. NO. 13612 | 20-GlyCysAspLysAlaGly-25 |
| SEQ. ID. NO. 13613 | 29-GlyAlaAspLysLysGluAlaSerPheValGluArgIleGluHisThrLysAspAspGlySer-49 |
| SEQ. ID. NO. 13614 | 75-ProAlaProArgThrGlnAsnGlySerGlyAsnAlaGluAsnAspSerAspProIleAlaAspAsnAspPro-98 |
| SEQ. ID. NO. 13615 | 111-ProGluIleProGlnGluGluAlaAspAspGlyGly-122 |
| SEQ. ID. NO. 13616 | 131-IleSerLysAspGly-135 |
| SEQ. ID. NO. 13617 | 154-LeuAsnAspLysArgGluTyrThr-161 |
| SEQ. ID. NO. 13618 | 179-AspAlaThrGluGluLeuPro-185 |
| SEQ. ID. NO. 13619 | 190-GlyAsnProLysAspLeuLysPro-197 |
| SEQ. ID. NO. 13620 | 221-AlaLysGlyArgSerLeuPro-227 |
| SEQ. ID. NO. 13621 | 288-GluGlnLeuLysAsnThrGlyLysValGlnArgGlyGln-300 |
| SEQ. ID. NO. 13622 | 317-GlyLeuAspLysAlaGly-322 |
| SEQ. ID. NO. 13623 | 333-SerProAlaGluArgAlaGlyLeuGln-341 |
| SEQ. ID. NO. 13624 | 350-AspGlyGlyGluIleArgSerSerGlyAsp-359 |
| SEQ. ID. NO. 13625 | 368-ThrProGlyLysGluValSer-374 |
| SEQ. ID. NO. 13626 | 379-ArgLysGlyGluGluIleThrIle-386 |
| SEQ. ID. NO. 13627 | 397-IleGlyAlaSerSerLysThrAspGluAlaProTyrThrGluGlnGlnSer-413 |
| SEQ. ID. NO. 13628 | 428-HisThrAspSerSerGly-433 |
| SEQ. ID. NO. 13629 | 440-ArgValSerAspAlaAlaGluArgAlaGlyLeuArgArgGlyAspGluIleLeu-457 |
| SEQ. ID. NO. 13630 | 463-ProValAsnAspGluAlaGlyPheArgLysAlaMetAspLysAlaGlyLys-479 |
| 987 | |
| AMPHI Regions - AMPHI | |
| SEQ. ID. NO. 13631 | 17-CysSerSerTrpLeu-21 |
| SEQ. ID. NO. 13632 | 33-PheAsnThrSerLysProValArgLeuAspAsnIleLeuGlnIle-47 |
| SEQ. ID. NO. 13633 | 65-ProHisGluAlaPhe-69 |
| SEQ. ID. NO. 13634 | 144-AsnProPheValLeuArgLysTrpArgAlaLeuGlyTyrLeuThrAspPheProArgLeuAsnArg-165 |
| SEQ. ID. NO. 13635 | 187-GlyAspIleLeuAlaThr-207 |
| SEQ. ID. NO. 13636 | 202-LeuAspIleLeuAlaThr-207 |
| SEQ. ID. NO. 13637 | 211-ValGlyGluValSerHisAspPheAspArgTyrTrpAla-223 |
| SEQ. ID. NO. 13638 | 230-AlaThrArgIleIleArgSerGlyAspIleGlyLysGlyLeuGlnAla-245 |
| SEQ. ID. NO. 13639 | 290-AspAspProAlaLysGlyLeuAspArg-298 |
| SEQ. ID. NO. 13640 | 307-GlyArgLeuGlnAspAlaLeuLysGlnPro-316 |
| SEQ. ID. NO. 13641 | 333-GlyThrAspAlaLeuAlaLysLeuValGlnAsp-343 |
| SEQ. ID. NO. 13642 | 355-GlnAlaThrAspValAlaAla-361 |
| SEQ. ID. NO. 13643 | 443-LysIleAlaGluGlnMetGluArgThrLeu-452 |
| SEQ. ID. NO. 13644 | 486-ProGluAlaLysLeuTrpLysArgIleAlaAlaLysIleLeuSerLeuLeuProIleGluGlyLeu-507 |
| Antigenic Index - Jameson-Wolf | |
| SEQ. ID. NO. 13645 | 1-MetLysThrArgSer-5 |
| SEQ. ID. NO. 13646 | 23-ProLeuGluGluArgThrGluSerArgHisPheAsnThrSerLysProValArgLeu-41 |
| SEQ. ID. NO. 13647 | 49-HisThrProHisThrAsnGlyLeuSer-57 |
| SEQ. ID. NO. 13648 | 77-GluSerAlaGluHisSerLeu-83 |
| SEQ. ID. NO. 13649 | 90-TrpArgAsnAspIleSerGlyArgLeu-98 |
| SEQ. ID. NO. 13650 | 107-AlaGluArgGlyValArg-112 |
| SEQ. ID. NO. 13651 | 115-LeuLeuLeuAspAspAsnAsnThrArgGlyLeuAsp-126 |
| SEQ. ID. NO. 13652 | 134-SerHisProAsnIleGluValArgLeu-142 |
| SEQ. ID. NO. 13653 | 159-AspPheProArgLeuAsnArgArgMetHisAsnLysSerPheThrAlaAspAsnArgAla-178 |
| SEQ. ID. NO. 13654 | 182-GlyGlyArgAsnIleGlyAspGluTyrPheLysValGlyGluAspThrVal-198 |
| SEQ. ID. NO. 13655 | 214-ValSerHisAspPheAspArgTyrTrp-222 |
| SEQ. ID. NO. 13656 | 225-HisSerAlaHisAsn-229 |
| SEQ. ID. NO. 13657 | 232-ArgIleIleArgSerGlyAspIleGlyLysGlyLeu-243 |
| SEQ. ID. NO. 13658 | 247-GlyTyrAsnAspGluThrSerArg-254 |
| SEQ. ID. NO. 13659 | 259-ArgTyrArgGluThrValGlu-265 |
| SEQ. ID. NO. 13660 | 267-SerProLeuTyrGln-271 |
| SEQ. ID. NO. 13661 | 282-SerValArgThrArgLeuIleSerAspAspProAlaLysGlyLeuAspArgAspArgArgLysProProIle-305 |
| SEQ. ID. NO. 13662 | 308-ArgLeuGlnAspAlaLeuLysGlnProGluLysSer-319 |
| SEQ. ID. NO. 13663 | 328-ValProThrLysSerGlyThrAspAlaLeu-337 |
| SEQ. ID. NO. 13664 | 340-LeuValGlnAspGlyIleAsp-346 |
| SEQ. ID. NO. 13665 | 367-ValLysTyrArgLysProLeuLeu-374 |
| SEQ. ID. NO. 13666 | 391-AlaThrLysAspLysGlyLeuThrGlySerSer-401 |
| SEQ. ID. NO. 13667 | 412-ValAspGlyLysArgIlePhe-418 |
| SEQ. ID. NO. 13668 | 422-PheAsnLeuAspProArgSerAlaArgLeuAsnThr-433 |
| SEQ. ID. NO. 13669 | 440-GluSerProLysIleAlaGluGlnMetGluArgThrLeuAlaAspThrThrPro-457 |
| SEQ. ID. NO. 13670 | 463-ValThrLeuAspArgHisAsnArgLeuGlnTrpHisAspProAlaThrArgLysThrTyrProAsnGluProGluAlaLysLeuTrpLys-492 |

TABLE 1-continued

Hydrophilic Regions - Hopp-Woods
SEQ. ID. NO. 13671  1-MetLysThrArgSer-5
SEQ. ID. NO. 13672  24-LeuGluGluArgThrGluSerArgHisPheAsnThr-35
SEQ. ID. NO. 13673  37-LysProValArgLeu-41
SEQ. ID. NO. 13674  77-GluSerAlaGluHisSerLeu-83
SEQ. ID. NO. 13675  107-AlaGluArgGlyValArg-112
SEQ. ID. NO. 13676  115-LeuLeuLeuAspAspAsnAsnThrArgGlyLeuAsp-126
SEQ. ID. NO. 13677  161-ProArgLeuAsnArgArgMetHisAsn-169
SEQ. ID. NO. 13678  172-PheThrAlaAspAsnArgAla-178
SEQ. ID. NO. 13679  189-GluTyrPheLysValGlyGluAspThrVal-198
SEQ. ID. NO. 13680  214-ValSerHisAspPheAspArg-220
SEQ. ID. NO. 13681  232-ArgIleIleArgSerGlyAspIleGlyLys-241
SEQ. ID. NO. 13682  248-TyrAsnAspGluThrSerArg-254
SEQ. ID. NO. 13683  259-ArgTyrArgGluThrValGlu-265
SEQ. ID. NO. 13684  282-SerValArgThrArgLeuIleSerAspAspProAlaLysGlyLeuAspArgAspArgArgLysProProIle-305
SEQ. ID. NO. 13685  308-ArgLeuGlnAspAlaLeuLysGlnProGluLysSer-319
SEQ. ID. NO. 13686  331-LysSerGlyThrAspAlaLeu-337
SEQ. ID. NO. 13687  340-LeuValGlnAspGlyIleAsp-346
SEQ. ID. NO. 13688  367-ValLysTyrArgLysProLeuLeu-374
SEQ. ID. NO. 13689  391-AlaThrLysAspLysGlyLeuThr-398
SEQ. ID. NO. 13690  424-LeuAspProArgSerAlaArgLeuAsnThr-433
SEQ. ID. NO. 13691  440-GluSerProLysIleAlaGluGlnMetGluArgThrLeuAla-453
SEQ. ID. NO. 13692  464-ThrLeuAspArgHisAsnArg-470
SEQ. ID. NO. 13693  476-ProAlaThrArgLysThrTyrProAsnGluProGluAlaLysLeuTrpLys-492
988-2
AMPHI Regions - AMPHI
SEQ. ID. NO. 13694  45-SerLysIleGluSerLeuAlaArg-52
SEQ. ID. NO. 13695  125-GlnMetArgGlyIle-129
SEQ. ID. NO. 13696  154-AspIleValGluArgAlaGlnSerLysVal-163
SEQ. ID. NO. 13697  221-AlaLysIleIleGluValLeuGlyAspTyrAlaAsp-232
SEQ. ID. NO. 13698  248-HisGlnPheSerGluAlaCysAlaLysAlaAlaLysLysIle-261
SEQ. ID. NO. 13699  288-ThrAlaArgAspPheAspAsp-294
SEQ. ID. NO. 13700  299-GluLysValGlyArgAsnTyr-305
SEQ. ID. NO. 13701  310-AlaIleAlaAspValSerHisTyrValArgProAspAspValIleAsp-325
SEQ. ID. NO. 13702  348-AsnLeuSerAsnGly-352
SEQ. ID. NO. 13703  396-AsnGlnValTrpLysTrpIleSerAspGlyIleAspHisPro-409
SEQ. ID. NO. 13704  411-LysAlaGlnIleAspThrLeuTyrLysLeuPheLysIleLeuGlnLys-426
SEQ. ID. NO. 13705  494-LeuGlyProThrProGluLysLeuAlaThrLeu-504
SEQ. ID. NO. 13706  526-TyrAlaAlaLeuValGluGlnPheLys-534
SEQ. ID. NO. 13707  544-ValMetMetLeuArgSerMetGlnGlnAla-553
SEQ. ID. NO. 13708  569-AlaTyrAlaHisPheThrSerProIleArgArgTyrProAspLeuThrValHisArgAlaIleLysAlaValLeu-593
SEQ. ID. NO. 13709  619-AspAspAlaSerArgAspValGluAsnTrpLeuLys-630
SEQ. ID. NO. 13710  646-IleSerGlyMetThrSerPheGlyIlePheValThrLeu-658
SEQ. ID. NO. 13711  662-HisIleAspGlyLeuValHisIleSerAspLeuGlyGlu-674
Antigenic Index - Jameson-Wolf
SEQ. ID. NO. 13712  1-MetAsnLysAsnIleLys-6
SEQ. ID. NO. 13713  8-LeuAsnLeuArgGluLysAspProPheLeuSerArgGluLysGlnArgTyrGluHisProLeuProSerArgGluTrpIle-34
SEQ. ID. NO. 13714  37-LeuLeuGluArgLysGlyValProSerLysIleGluSerLeuAlaArgGluLeuSerIleThrGluAspGluTyrValPhePheGluArgArg
                    LeuLysAlaMetAlaArgAspGlyGln-76
SEQ. ID. NO. 13715  79-IleAsnArgArgGlyAlaVal-85
SEQ. ID. NO. 13716  87-AlaAlaAspLysLeuAspLeuValLysCysArgValGluAlaHisLysAspGlyPhe-105
SEQ. ID. NO. 13717  111-LeuThrProAlaLysAspGlyAsp-118
SEQ. ID. NO. 13718  124-ArgGlnMetArgGly-128
SEQ. ID. NO. 13719  138-ArgProAlaGlyMetAspArgArgGlyArgArgGluGlyThrVal-152
SEQ. ID. NO. 13720  155-IleValGluArgAlaGlnSerLysValVal-164
SEQ. ID. NO. 13721  168-TyrMetAspArgGlyValAla-174
SEQ. ID. NO. 13722  176-LeuGluProGluAspLysArgLeuAsnGln-185
SEQ. ID. NO. 13723  189-LeuGluProAspGlyValAlaArgPheLysProGluSerGlyGln-203
SEQ. ID. NO. 13724  210-GluValTyrProGlnAsnArgProAlaVal-220
SEQ. ID. NO. 13725  227-LeuGlyAspTyrAlaAspSerGlyMetGluIle-237
SEQ. ID. NO. 13726  239-IleAlaValArgLysHisHisLeu-246
SEQ. ID. NO. 13727  253-AlaCysAlaLysAlaAlaLysLysIleProValHisValArgLysSerAspLeuLysGlyArgValAspLeuArgAsp-278
SEQ. ID. NO. 13728  283-ThrIleAspGlyGluThrAlaArgAspPheAspAsp-294
SEQ. ID. NO. 13729  299-GluLysValGlyArgAsnTyrArg-306
SEQ. ID. NO. 13730  316-HisTyrValArgProAspAspValIleAspAlaAspAlaGlnGluArgSerThrSer-334
SEQ. ID. NO. 13731  337-PheProArgArgVal-341
SEQ. ID. NO. 13732  345-LeuProGluAsnLeuSerAsnGly-352
SEQ. ID. NO. 13733  356-LeuAsnProAspValGluArgLeu-363
SEQ. ID. NO. 13734  374-AlaGlyAsnIleLysGluTyrArgPhe-382
SEQ. ID. NO. 13735  402-IleSerAspGlyIleAspHisProTyrLysAlaGlnIle-414
SEQ. ID. NO. 13736  424-LeuGlnLysLysArgPheGluArgGlyAlaValGluPheGluSerValGlu-440
SEQ. ID. NO. 13737  443-MetIlePheAspAspAsnGlyLysIleGluLys-453
SEQ. ID. NO. 13738  458-ValArgAsnAspAlaHisLysLeuIleGlu-467
SEQ. ID. NO. 13739  482-LeuLysAsnLysHisThrAla-488
SEQ. ID. NO. 13740  493-HisLeuGlyProThrProGluLysLeuAlaThrLeuArgGluGlnLeu-508
SEQ. ID. NO. 13741  516-GlyGlyGlyAspAsnProSerProLysAspTyr-526
SEQ. ID. NO. 13742  532-GlnPheLysGlyArgProAspAlaGluLeu-541
SEQ. ID. NO. 13743  556-GluProHisCysAspGlyHis-562
SEQ. ID. NO. 13744  575-SerProIleArgArgTyrProAspLeuThrVal-585
SEQ. ID. NO. 13745  597-ThrTyrThrProLysLysSerTrp-604

TABLE 1-continued

| | |
|---|---|
| SEQ. ID. NO. 13746 | 613-PheCysGluArgArgAlaAspAspAlaSerArgAspValGluAsn-627 |
| SEQ. ID. NO. 13747 | 633-TyrMetArgAspLysValGlyGluValPheGluGlyLysIleSerGly-648 |
| SEQ. ID. NO. 13748 | 670-SerAspLeuGlyGluAspTyrPheAsnPheArgPro-681 |
| SEQ. ID. NO. 13749 | 683-IleMetAlaIleGluGlyGluArgSerGlyIleArgPheAsnMetGlyAspArgValAlaValArgValAlaArgAlaAspLeuAspAspGlyLysIle-715 |
| SEQ. ID. NO. 13750 | 722-GlyGlySerGlyArgGlyArgLysValLysSerSerAlaSerAlaLysProAlaGlyThrAlaGlyLysGlyLysProLysThrAlaAlaGluLysLysThrAlaArgGlyGlyLysValArgGlyArgGlyAlaSerAlaAlaAlaGluSerArgLysLysAlaLysLysProValProIleLysValLysLysArgLysGlyLysSer-791 |
| Hydrophilic Regions - Hopp-Woods | |
| SEQ. ID. NO. 13751 | 1-MetAsnLysAsnIleLys-6 |
| SEQ. ID. NO. 13752 | 8-LeuAsnLeuArgGluLysAspProPheLeuSerArgGluLysGlnArgTyrGluHis-26 |
| SEQ. ID. NO. 13753 | 37-LeuLeuGluArgLysGlyValProSerLysIleGluSerLeuAlaArgGluLeuSerIleThrGluAspGluTyrValPhePheGluArgArgLeuLysAlaMetAlaArgAspGlyGln-76 |
| SEQ. ID. NO. 13754 | 79-IleAsnArgArgGlyAla-84 |
| SEQ. ID. NO. 13755 | 87-AlaAlaAspLysLeuAspLeuValLysCysArgValGluAlaHisLysAspGlyPhe-105 |
| SEQ. ID. NO. 13756 | 113-ProAlaLysAspGlyAsp-118 |
| SEQ. ID. NO. 13757 | 140-AlaGlyMetAspArgArgGlyArgArgGluGlyThrVal-152 |
| SEQ. ID. NO. 13758 | 155-IleValGluArgAlaGlnSerLysValVal-164 |
| SEQ. ID. NO. 13759 | 176-LeuGluProGluAspLysArgLeuAsn-184 |
| SEQ. ID. NO. 13760 | 189-LeuGluProAspGlyValAlaArgPheLysProGluSerGly-202 |
| SEQ. ID. NO. 13761 | 210-GluValTyrProGluGlnAsnArgProAlaVal-220 |
| SEQ. ID. NO. 13762 | 230-TyrAlaAspSerGlyMetGluIle-237 |
| SEQ. ID. NO. 13763 | 239-IleAlaValArgLysHisHis-245 |
| SEQ. ID. NO. 13764 | 253-AlaCysAlaLysAlaAlaLysLysIleProValHisValArgLysSerAspLeuLysGlyArgValAspLeuArgAsp-278 |
| SEQ. ID. NO. 13765 | 284-IleAspGlyGluThrAlaArgAspPheAspAsp-294 |
| SEQ. ID. NO. 13766 | 299-GluLysValGlyArgAsnTyr-305 |
| SEQ. ID. NO. 13767 | 318-ValArgProAspAspValIleAspAlaAspAlaGlnGluArgSerThr-333 |
| SEQ. ID. NO. 13768 | 358-ProAspValGluArg-362 |
| SEQ. ID. NO. 13769 | 376-AsnIleLysGluTyrArg-381 |
| SEQ. ID. NO. 13770 | 405-GlyIleGluAspHisProTyr-410 |
| SEQ. ID. NO. 13771 | 424-LeuGlnLysLysArgPheGluArgGlyAlaValGluPheGluSerValGlu-440 |
| SEQ. ID. NO. 13772 | 443-MetIlePheAspAspAsnGlyLysIleGluLys-453 |
| SEQ. ID. NO. 13773 | 458-ValArgAsnAspAlaHisLysLeuIleGlu-467 |
| SEQ. ID. NO. 13774 | 496-ProThrProGlyLeuLeuAlaThrLeuArgGluGlnLeu-508 |
| SEQ. ID. NO. 13775 | 517-GlyGlyAspAsnProSerProLysAspTyr-526 |
| SEQ. ID. NO. 13776 | 532-GlnPheLysGlyArgProAspAlaGluLeu-541 |
| SEQ. ID. NO. 13777 | 576-ProIleArgArgTyrProAsp-582 |
| SEQ. ID. NO. 13778 | 598-TyrThrProLysLysSerTrp-604 |
| SEQ. ID. NO. 13779 | 613-PheCysGluArgArgAlaAspAspAlaSerArgAspValGluAsn-627 |
| SEQ. ID. NO. 13780 | 633-TyrMetArgAspLysValGlyGluValPheGluGlyLysIle-646 |
| SEQ. ID. NO. 13781 | 683-IleMetAlaIleGluGlyGluArgSerGlyIle-693 |
| SEQ. ID. NO. 13782 | 696-AsnMetGlyAspArgValAlaValArgValAlaArgAlaAspLeuAspAspGlyLysIle-715 |
| SEQ. ID. NO. 13783 | 723-GlySerGlyArgGlyArgLysValLysSerSerAlaSerAlaLysProAlaGlyThrAlaGlyLysGlyLysProLysThrAlaAlaGluLysLysThrAlaArgGlyGlyLysValArgGlyArgGlyAlaSerAlaAlaAlaGluSerArggLysLysAlaLysLysProValProIleLysValLysLysArgLysGlyLys Ser-791 989 |
| AMPHI Regions - AMPHI | |
| SEQ. ID. NO. 13784 | 58-AlaGlyLeuThrLysLeu-63 |
| SEQ. ID. NO. 13785 | 85-SerAlaThrAspPhe-89 |
| SEQ. ID. NO. 13786 | 98-LysSerGlyLysIleThr-103 |
| SEQ. ID. NO. 13787 | 109-ProHisIleTyrGlyAla-114 |
| SEQ. ID. NO. 13788 | 183-GluLeuArgLysTyrAlaAsp-189 |
| SEQ. ID. NO. 13789 | 205-LysProAsnGlyValAlaGluAla-212 |
| SEQ. ID. NO. 13790 | 273-AlaMetTrpSerThr-277 |
| SEQ. ID. NO. 13791 | 301-SerValHisGlyMetTyrLysValSer-309 |
| SEQ. ID. NO. 13792 | 320-TrpThrArgHisSerArg-325 |
| SEQ. ID. NO. 13793 | 364-SerTyrGlnIleSerGluProLeu-371 |
| SEQ. ID. NO. 13794 | 450-PheLysAsnHisAlaAsp-455 |
| Antigenic Index - Jameson-Wolf | |
| SEQ. ID. NO. 13795 | 46-GluAlaAlaAspAlaSer-51 |
| SEQ. ID. NO. 13796 | 57-ProAlaGlyLeuThrLysLeuAspSerSerGlnIle-68 |
| SEQ. ID. NO. 13797 | 81-TyrGluAlaAspSerAlaThrAspPheThr-90 |
| SEQ. ID. NO. 13798 | 95-GlnGlySerLysSerGlyLysIleThrLysThrThr-106 |
| SEQ. ID. NO. 13799 | 116-LysValAsnAspAsnLeuThr-122 |
| SEQ. ID. NO. 13800 | 132-GlySerAlaThrGluTyrGluLysAspSerValLeu-143 |
| SEQ. ID. NO. 13801 | 146-AsnIleAsnLysLeuGly-151 |
| SEQ. ID. NO. 13802 | 164-LysLeuAsnAspArgHisSerPheGly-172 |
| SEQ. ID. NO. 13803 | 180-ThrSerAlaAlaGluLeuArgLysTyrAla-188 |
| SEQ. ID. NO. 13804 | 191-GlyIleLysSerLysAlaGluIleLeuThrAlaLysProProLysProAsnGlyValAlaGluAlaAlaLysIleGlnAlaAspGlyHisAlaAspValLysGlySerAspTrpGly-229 |
| SEQ. ID. NO. 13805 | 239-AspIleAsnAspArgAlaArgValGlyValAsnTyrArgSerLysValSerHisThrLeuLysGlyAspAlaGluTrpAlaAla-266 |
| SEQ. ID. NO. 13806 | 285-ThrAlaAsnGluLysAlaArgValLysIleValThrProGluSer-299 |
| SEQ. ID. NO. 13807 | 306-TyrLysValSerAspLysAlaAspLeu-314 |
| SEQ. ID. NO. 13808 | 319-ThrTrpThrArgHisSerArgPheAspLysAlaGluLeuValPheGluLysGluLysThrValValLysGlyLysSerAspArgThrThrIle-349 |
| SEQ. ID. NO. 13809 | 351-ProAsnTrpArgAsnThrTyrLys-358 |
| SEQ. ID. NO. 13810 | 363-GlySerTyrGlnIleSerGlu-369 |
| SEQ. ID. NO. 13811 | 377-IleAlaPheAspLysSerProValArgAsnAlaAspTyrArgMetAsnSerLeuProAspGlyAsn-398 |
| SEQ. ID. NO. 13812 | 409-HisIleGlyLysAsnHisVal-415 |
| SEQ. ID. NO. 13813 | 426-AsnAspThrSerTyrArgThrAlaLysAlaSerGlyAsnAspValAspSerLysGlyAlaSerSerAlaArgPheLysAsnHisAla-454 |

TABLE 1-continued

Hydrophilic Regions - Hopp-Woods
SEQ. ID. NO. 13814   61-ThrLysLeuAspSerSerGln-67
SEQ. ID. NO. 13815   81-TyrGluAlaAspSerAlaThr-87
SEQ. ID. NO. 13816   95-GlnGlySerLysSerGlyLysIleThrLys-104
SEQ. ID. NO. 13817   135-ThrGluTyrGluLysAspSerValLeu-143
SEQ. ID. NO. 13818   164-LysLeuAsnAspArgHisSer-170
SEQ. ID. NO. 13819   180-ThrSerAlaGluLeuArgLysTyrAla-188
SEQ. ID. NO. 13820   191-GlyIleLysSerLysAlaGluIleLeuThr-200
SEQ. ID. NO. 13821   202-LysProProLysProAsnGlyValAlaGluAlaAlaLysIleGlnAla-217
SEQ. ID. NO. 13822   219-GlyHisAlaAspValLysGlySerAsp-227
SEQ. ID. NO. 13823   240-IleAsnAspArgAlaArgVal-246
SEQ. ID. NO. 13824   250-TyrArgSerLysVal-254
SEQ. ID. NO. 13825   258-LeuLysGlyAspAlaGluTrpAlaAla-266
SEQ. ID. NO. 13826   285-ThrAlaAsnGluLysAlaArgValLysIleValThr-296
SEQ. ID. NO. 13827   307-LysValSerAspLysAlaAspLeu-314
SEQ. ID. NO. 13828   324-SerArgPheAspLysAlaGluLeuValPheGluLysGluLysThrValValLysGlyLysSerAspArgThrThrIle-349
SEQ. ID. NO. 13829   377-IleAlaPheAspLysSerProValArgAsnAlaAspTyrArgMet-391
SEQ. ID. NO. 13830   393-SerLeuProAspGlyAsn-398
SEQ. ID. NO. 13831   428-ThrSerTyrArgThrAlaLysAlaSerGlyAsnAspValAspSerLysGlyAlaSerSerAlaArgPheLysAsnHisAla-454
990
AMPHI Regions - AMPHI
SEQ. ID. NO. 13832   89-LysSerGlnLeuGlnAspLeuTyrLys-97
SEQ. ID. NO. 13833   128-ThrMetProAspLeuIleAsnLysLeuVal-137
SEQ. ID. NO. 13834   151-ThrSerLeuAsnAsnIlePhe-157
SEQ. ID. NO. 13835   191-ArgArgHisSerAspIleHisThrLeuGluThrSerAsp-203
SEQ. ID. NO. 13836   260-ProGluAsnLeuLysThrLeuAspGly-268
SEQ. ID. NO. 13837   293-TyrGluLeuLeuLeuLysGlnCys-300
SEQ. ID. NO. 13838   372-AlaAspGlyTrpArgLysGlyVal-379
SEQ. ID. NO. 13839   423-GlyTyrGlyGlyGlyValTyrAlaAlaTrp-432
SEQ. ID. NO. 13840   442-AlaTyrLeuAspGlyTrpLeuGlnTyr-450
SEQ. ID. NO. 13841   472-ThrAlaSerValGluGlyGlyTyrAsnAlaLeu-482
SEQ. ID. NO. 13842   550-GlnProPheAlaAlaPheAsnValLeuHisArg-560
Antigenic Index - Jameson-Wolf
SEQ. ID. NO. 13843   6-LeuGlySerAsnThrArgSerThrLysIleGlyAspAspAlaAspPheSerPheSerAspLysProLysProGlyThr-31
SEQ. ID. NO. 13844   35-PheSerSerGlyLysThrAspGlnAsnSerSerGluTyrGlyTyrAspGluIleAsnIleGlnGlyLysAsnTyrAsnSerGlyIle-63
SEQ. ID. NO. 13845   75-TyrIleThrGluLysTyrGlyAlaAspLeuLysGlnAlaVal-88
SEQ. ID. NO. 13846   90-SerGlnLeuGlnAspLeuTyrLysThrArgProGluAlaTrpAlaGluAsnLysLysArgThrGluGluAlaTyr-114
SEQ. ID. NO. 13847   120-ThrLysPheSerThrLeuLysGlnThrMetPro-130
SEQ. ID. NO. 13848   145-HisSerAsnThrSerGlnThrSer-152
SEQ. ID. NO. 13849   157-PheAsnLysLysLeuHisValLysIleGluAsnLysSerHisVal-171
SEQ. ID. NO. 13850   179-ThrLysMetThrLeuLysAspSerLeuTrpGluProArgArgHisSerAspIleHisThrLeuGluThrSerAspAsnAlaArgIleArgLeu
AsnThrLysAspGluLysLeuThrValHisLysAspTyrAlaGlyValAsp-227
SEQ. ID. NO. 13851   232-TyrAspValArgGluSerAspGluProAlaLeuThrPheGluAspLysValSerGlyGlnSerGlyValValLeuGluArgArgProGluAsn
LeuLysThrLeuAspGlyArgLysLeuIleAla-273
SEQ. ID. NO. 13852   275-LysThrAlaAspSerGlySerPheAlaPheLysGlnAsnTyrArgGlnGlyLeu-292
SEQ. ID. NO. 13853   298-LysGlnCysGluGlyGlyPhe-304
SEQ. ID. NO. 13854   312-AlaIleProGluAlaGlu-317
SEQ. ID. NO. 13855   335-ArgAlaAlaAspArgGlyAspAspValTyrAlaAlaAspProSerArgGlnLysLeu-353
SEQ. ID. NO. 13856   358-IleGlyGlyArgSerHisGlnAsnIleArgGlyGlyAlaAlaAlaAspGlyTrpArgLysGlyVal-379
SEQ. ID. NO. 13857   385-ValPheValArgGlnAsnGluGlySerArgLeuAla-396
SEQ. ID. NO. 13858   400-MetGlyGlyArgAlaGlyGln-406
SEQ. ID. NO. 13859   408-AlaSerValAsnGlyLysGlyGlyAlaAlaGlySerAspLeu-421
SEQ. ID. NO. 13860   435-LeuArgAspLysGlnThrGlyAlaTyr-443
SEQ. ID. NO. 13861   452-ArgPheLysHisArgIleAsnAspGluAsnArgAlaGluArgTyrLysThrLysGlyTrpThr-472
SEQ. ID. NO. 13862   475-ValGluGlyGlyTyr-479
SEQ. ID. NO. 13863   487-IleValGlyLysGlyAsnAsnValArg-495
SEQ. ID. NO. 13864   510-AsnGlyGlyPheThrAspSerGluGlyThrAla-520
SEQ. ID. NO. 13865   525-GlySerGlyGlnTrpGlnSerArgAlaGlyIleArgLysThrArgPheAlaLeuArgAsnGlyValAsn-548
SEQ. ID. NO. 13866   559-HisArgSerLysSerPheGlyValGluMetAspGlyGluLysGlnThrLeuAla-576
SEQ. ID. NO. 13867   579-ThrAlaLeuGluGlyArgPheGlyIle-587
SEQ. ID. NO. 13868   589-AlaGlyTrpLysGlyHisMet-595
SEQ. ID. NO. 13869   600-GlyTyrGlyLysArgThrAspGlyAspLysGluAlaAlaLeu-613
Hydrophilic Regions - Hopp-Woods
SEQ. ID. NO. 13870   8-SerAsnThrArgSerThrLysIleGlyAspAspAlaAspPheSerPheSerAspLysProLysProGlyThr-31
SEQ. ID. NO. 13871   38-GlyLysThrAspGlnAsnSerSer-45
SEQ. ID. NO. 13872   79-LysTyrGlyAlaAspLeuLysGlnAlaVal-88
SEQ. ID. NO. 13873   96-TyrLysThrArgProGluAlaTrpAlaGluAsnLysLysArgThrGluGluAlaTyr-114
SEQ. ID. NO. 13874   161-LeuHisValLysIleGluAsnLysSerHisVal-171
SEQ. ID. NO. 13875   179-ThrLysMetThrLeuLys-184
SEQ. ID. NO. 13876   186-SerLeuTrpGluProArgArgHisSerAsp-195
SEQ. ID. NO. 13877   200-GluThrSerAspAsnAlaArgIleArgLeuAsnThrLysAspGluLysLeuThrVal-218
SEQ. ID. NO. 13878   220-LysAspTyrAlaGly-224
SEQ. ID. NO. 13879   233-AspValArgGluSerAspGluProAlaLeuThrPheGluAspLysValSerGly-250
SEQ. ID. NO. 13880   255-ValLeuGluArgArgProGluAsnLeuLysThrLeuAspGlyArgLysLeuIleAla-273
SEQ. ID. NO. 13881   275-LysThrAlaAspSerGly-280
SEQ. ID. NO. 13882   312-AlaIleProGluAlaGlu-317
SEQ. ID. NO. 13883   335-ArgAlaAlaAspArgGlyAspAspValTyrAlaAla-345
SEQ. ID. NO. 13884   347-AspProSerArgGln-351
SEQ. ID. NO. 13885   361-ArgSerHisGlnAsnIleArgGly-368
SEQ. ID. NO. 13886   373-AspGlyTrpArgLys-377

TABLE 1-continued

| | |
|---|---|
| SEQ. ID. NO. 13887 | 385-ValPheValArgGlnAsnGluGlySerArg-394 |
| SEQ. ID. NO. 13888 | 410-ValAsnGlyLysGlyGlyAlaAlaGly-418 |
| SEQ. ID. NO. 13889 | 435-LeuArgAspLysGlnThr-440 |
| SEQ. ID. NO. 13890 | 452-ArgPheLysHisArgIleAsnAspGluAsnArgAlaGluArgTyrLysThr-468 |
| SEQ. ID. NO. 13891 | 513-PheThrAspSerGluGlyThr-519 |
| SEQ. ID. NO. 13892 | 533-AlaGlyIleArgAlaLysThrArgPheAlaLeu-543 |
| SEQ. ID. NO. 13893 | 559-HisArgSerLysSerPheGlyValGluMetAspGlyGluLysGlnThrLeuAla-576 |
| SEQ. ID. NO. 13894 | 579-ThrAlaLeuGluGly-583 |
| SEQ. ID. NO. 13895 | 600-GlyTyrGlyLysArgThrAspGlyAspLysGluAlaAlaLeu-613 |

992
AMPHI Regions - AMPHI

| | |
|---|---|
| SEQ. ID. NO. 13896 | 6-ArgHisLeuLysAsnMetGlnIleLysLysIleMetLysTrp-19 |
| SEQ. ID. NO. 13897 | 24-LeuSerLeuLeuGlyAlaLeuGlyTyr-32 |
| SEQ. ID. NO. 13898 | 45-AlaValLeuAspValLeuGlyAlaAla-53 |
| SEQ. ID. NO. 13899 | 72-HisArgTyrThrGlyThrValSerLysValTyr-82 |
| SEQ. ID. NO. 13900 | 158-GlnValGlnAspGly-162 |
| SEQ. ID. NO. 13901 | 179-AspPheAlaAspTyr-183 |

Antigenic Index - Jameson-Wolf

| | |
|---|---|
| SEQ. ID. NO. 13902 | 1-MetPheArgArgHisArgHisLeuLys-9 |
| SEQ. ID. NO. 13903 | 34-GlyTyrGlySerGluAlaValArg-41 |
| SEQ. ID. NO. 13904 | 52-AlaAlaGlyAspAlaGlySerAspAlaProAlaArgArgArgAlaSerAlaLysSerGlyHisArgTyrThr-75 |
| SEQ. ID. NO. 13905 | 79-SerLysValTyrAspGlyAspThr-86 |
| SEQ. ID. NO. 13906 | 90-IleAspGlyAspGlyAlaLysHisLysIle-99 |
| SEQ. ID. NO. 13907 | 105-AspAlaProGluMetLysGlnAlaTyrGlyThrArgSerArgAspAsnLeuArgAlaAlaAlaGluGlyArgLysValSer-131 |
| SEQ. ID. NO. 13908 | 134-ValPheAspThrAspArgTyrGlnArgGluValAla-145 |
| SEQ. ID. NO. 13909 | 148-SerValGlyLysThrAspLeuAsn-155 |
| SEQ. ID. NO. 13910 | 168-LysSerTyrAlaLysGluGlnGlnAspLysAlaAspPhe-180 |
| SEQ. ID. NO. 13911 | 187-GlnIleGlnAlaGluArgGluArgLysGlyLeuTrpLysAlaLysAsnProGlnAlaPro-206 |
| SEQ. ID. NO. 13912 | 208-AlaTyrArgArgAlaGlyArgSerGlyGlyGlyAsnLysAspTrpMetAsp-224 |

Hydrophilic Regions - Hopp-Woods

| | |
|---|---|
| SEQ. ID. NO. 13913 | 1-MetPheArgArgHisArgHisLeuLys-9 |
| SEQ. ID. NO. 13914 | 54-GlyAspAlaGlySerAspAlaProAlaArgArgArgAlaSerAlaLysSerGlyHisArg-73 |
| SEQ. ID. NO. 13915 | 90-IleAspGlyAspGlyAlaLysHisLysIle-99 |
| SEQ. ID. NO. 13916 | 105-AspAlaProGluMetLysGln-111 |
| SEQ. ID. NO. 13917 | 113-TyrGlyThrArgSerArgAspAsnLeuArgAlaAlaAlaGluGlyArgLysValSer-131 |
| SEQ. ID. NO. 13918 | 134-ValPheAspThrAspArgTyrGlnArgGluValAla-145 |
| SEQ. ID. NO. 13919 | 148-SerValGlyLysThrAspLeu-154 |
| SEQ. ID. NO. 13920 | 169-SerTyrAlaLysGluGlnGlnAspLysAlaAspPhe-180 |
| SEQ. ID. NO. 13921 | 187-GlnIleGlnAlaGluArgGluArgLysGlyLeuTrpLysAlaLysAsnPro-203 |
| SEQ. ID. NO. 13922 | 211-ArgAlaGlyArgSerGlyGlyGlyAsnLysAspTrpMet-223 |

993
AMPHI Regions - AMPHI

| | |
|---|---|
| SEQ. ID. NO. 13923 | 6-GlySerPheGlnGlyProLeuAspLeuLeuLeu-16 |
| SEQ. ID. NO. 13924 | 35-ThrGluGlnTyrLeuHisTyrIleAlaGlnIle-45 |
| SEQ. ID. NO. 13925 | 105-GlyLeuAspAlaLeuProArgAla-112 |
| SEQ. ID. NO. 13926 | 136-IleThrAspLeuThrGlnAlaTrpLeuGly-145 |
| SEQ. ID. NO. 13927 | 152-HisThrArgSerHisGluValIle-159 |
| SEQ. ID. NO. 13928 | 169-MetThrAlaIleLeuArgArgLeuAsnGlyHisGlyIleCysArgPheHisAspLeuPheAsn-189 |
| SEQ. ID. NO. 13929 | 199-ValAsnPheIleAlaLeuLeu-205 |
| SEQ. ID. NO. 13930 | 211-GlyLeuValArgIleValGln-217 |

Antigenic Index - Jameson-Wolf

| | |
|---|---|
| SEQ. ID. NO. 13931 | 20-ArgLysGlnAsnIleAsp-25 |
| SEQ. ID. NO. 13932 | 70-LeuLeuLeuProArgThrGluThrValGluAspGluGluAlaAspProArgAlaGluLeuValArg-91 |
| SEQ. ID. NO. 13933 | 108-AlaLeuProArgAlaGlyArgAspPhe-116 |
| SEQ. ID. NO. 13934 | 148-SerArgAlaLysHisThrArgSerHisGluValIleLysGluThrIleSer-164 |
| SEQ. ID. NO. 13935 | 172-IleLeuArgArgLeuAsnGlyHisGlyIle-181 |
| SEQ. ID. NO. 13936 | 186-AspLeuPheAsnProLysGlnGlyAla-194 |
| SEQ. ID. NO. 13937 | 207-LeuAlaLysGluGlyLeu-212 |
| SEQ. ID. NO. 13938 | 216-ValGlnGluAspGlyPheGlyGluIleArgIle-226 |
| SEQ. ID. NO. 13939 | 228-LeuAsnHisGluGlyAlaHisSerAspGlyIleSerGlyThrArgGlyGlyArgAspValPhe-248 |

Hydrophilic Regions - Hopp-Woods

| | |
|---|---|
| SEQ. ID. NO. 13940 | 20-ArgLysGlnAsnIleAsp-25 |
| SEQ. ID. NO. 13941 | 70-LeuLeuLeuProArgThrGluThrValGluAspGluGluAlaAspProArgAlaGluLeuValArg-91 |
| SEQ. ID. NO. 13942 | 108-AlaLeuProArgAlaGlyArg-114 |
| SEQ. ID. NO. 13943 | 148-SerArgAlaLysHisThrArgSerHisGluValIleLysGluThrIleSer-164 |
| SEQ. ID. NO. 13944 | 207-LeuAlaLysGluGlyLeu-212 |
| SEQ. ID. NO. 13945 | 216-ValGlnGluAspGlyPheGly-222 |
| SEQ. ID. NO. 13946 | 232-GlyAlaHisSerAspGlyIleSerGlyThrArgGlyGlyArgAspValPhe-248 |

996
AMPHI Regions - AMPHI

| | |
|---|---|
| SEQ. ID. NO. 13947 | 21-LysSerAlaArgThrHisAlaLysIlePro-30 |
| SEQ. ID. NO. 13948 | 50-ProGlyGluSerTyrProAlaGlnLeuGlnLysLeuThrGlyTrpAsn-65 |
| SEQ. ID. NO. 13949 | 75-ThrSerAlaGlnAlaLeuSerArgLeuProAla-85 |
| SEQ. ID. NO. 13950 | 104-LeuArgLysValProLysGlu-110 |
| SEQ. ID. NO. 13951 | 115-AsnIleAlaLysIleIleGluThrValGlnLys-125 |
| SEQ. ID. NO. 13952 | 140-LeuGlyAlaLeuPheGlyHisLeuSerAsp-149 |
| SEQ. ID. NO. 13953 | 167-GlyAlaTrpAlaGlu-171 |
| SEQ. ID. NO. 13954 | 186-AsnGlyLysGlyTyrArgLysPheAlaGluAspLeuAsnGlnPheLeuArgLysGlnGlyPhe-206 |

TABLE 1-continued

Antigenic Index - Jameson-Wolf
SEQ. ID. NO. 13955  1-MetAsnArgArgThrPhe-6
SEQ. ID. NO. 13956  18-CysGlyArgLysSerAlaArgThrHisAlaLysIleProGluGlySerThr-34
SEQ. ID. NO. 13957  46-TyrGlyAlaAsnProGlyGluSerTyrPro-55
SEQ. ID. NO. 13958  69-GlyGlyValSerGlyAspThrSerAla-77
SEQ. ID. NO. 13959  87-LeuAlaArgLysProLys-92
SEQ. ID. NO. 13960  99-GlyGlyAsnAspPheLeuArgLysValProLysGluGlnThrArgAlaAsnIle-116
SEQ. ID. NO. 13961  121-GluThrValGlnLysGluAsnIlePro-129
SEQ. ID. NO. 13962  148-SerAspHisProLeuTyrGluAspLeuSerGluGluTyrGly-161
SEQ. ID. NO. 13963  173-LeuGlyAspAsnAsnLeuLysSerAspGlnIleHisAlaAsnGlyLysGlyTyrArgLysPheAlaGluAspLeuAsnGlnPheLeuArgLysGlnGlyPheArg-207
Hydrophilic Regions - Hopp-Woods
SEQ. ID. NO. 13964  18-CysGlyArgLysSerAlaArgThrHisAlaLysIleProGlu-31
SEQ. ID. NO. 13965  49-AsnProGlyGluSerTyr-54
SEQ. ID. NO. 13966  71-ValSerGlyAspThrSerAla-77
SEQ. ID. NO. 13967  87-LeuAlaArgLysProLys-92
SEQ. ID. NO. 13968  102-AspPheLeuArgLysValProLysGluGlnThrArgAlaAsnIle-116
SEQ. ID. NO. 13969  121-GluThrValGlnLysGluAsnIle-128
SEQ. ID. NO. 13970  154-GluAspLeuSerGluGluTyrGly-161
SEQ. ID. NO. 13971  176-AsnAsnLeuLysSerAspGlnIleHisAlaAsn-186
SEQ. ID. NO. 13972  188-LysGlyTyrArgLysPheAlaGluAspLeuAsnGlnPheLeuArg-202
997
AMPHI Regions - AMPHI
SEQ. ID. NO. 13973  18-TrpAlaGlyLeuSerAlaAlaVal-25
SEQ. ID. NO. 13974  70-TyrArgGlyValLeuArgLeuMetLysThrIleGly-81
SEQ. ID. NO. 13975  107-ProLeuProAlaProLeuHisIle-114
SEQ. ID. NO. 13976  132-LeuLeuAlaAspMetSerAspLeuGlnLysSerAlaArgLeuGly-146
SEQ. ID. NO. 13977  164-AlaAlaValMetGlnPheTrpGlnProLeuValTrpGly-176
SEQ. ID. NO. 13978  189-ValLeuCysAsnValLeuSerAsp-196
SEQ. ID. NO. 13979  222-AlaLeuAlaAspLeuGlnArg-228
SEQ. ID. NO. 13980  241-ArgLeuAsnThrLeuPro-246
SEQ. ID. NO. 13981  275-GluGlyThrProGluHisValGlnThrAla-284
SEQ. ID. NO. 13982  300-TyrAlaGluProValArgLeuProAlaProLeuThrGlyLeuAlaAspGly-316
SEQ. ID. NO. 13983  355-LysAlaHisAlaAspLeuLysArgIleLeuProHisLeu-367
SEQ. ID. NO. 13984  369-GluProGluAlaVal-373
Antigenic Index - Jameson-Wolf
SEQ. ID. NO. 13985  3-AsnThrProHisProArgProLysIle-11
SEQ. ID. NO. 13986  37-GluAlaGlyArgGlnAlaGlyGlyArgAlaArgThrLeuAlaGlyAsnThrAspGlyPheGly-57
SEQ. ID. NO. 13987  78-LysThrIleGlySerAspProArgAlaAla-87
SEQ. ID. NO. 13988  122-ArgArgAlaProThr-126
SEQ. ID. NO. 13989  132-LeuLeuAlaAspMetSerAspLeuGlnLysSerAlaArgLeuGlyGlnProAspThrThr-151
SEQ. ID. NO. 13990  156-LeuLysGlnArgAsnValProArg-163
SEQ. ID. NO. 13991  180-ThrProLeuGluThrAlaSer-186
SEQ. ID. NO. 13992  197-GlyValLeuThrLysLysSerGlySerAspTyrLeuLeuProLysGlnAspLeu-214
SEQ. ID. NO. 13993  225-AspLeuGlnArgLeuGlyAlaAspIleArgLeuGluThrArgValCysArg-241
SEQ. ID. NO. 13994  243-AsnThrLeuProAspGlyLysVal-250
SEQ. ID. NO. 13995  273-LeuProGluGlyThrProGluHisVal-281
SEQ. ID. NO. 13996  312-GlyLeuAlaAspGlyThr-317
SEQ. ID. NO. 13997  323-CysArgGlyArgLeuGlyLeuProGluAsnGluVal-334
SEQ. ID. NO. 13998  340-ValSerAspArgValGlyAla-346
SEQ. ID. NO. 13999  351-AlaTrpAlaAspLysAlaHisAlaAspLeuLysArgIleLeu-364
SEQ. ID. NO. 14000  367-LeuGlyGluProGluAlaValArgValIleThrGluLysArgAlaThrThrAlaAlaAspAlaProProAspLeu-392
SEQ. ID. NO. 14001  402-ProAlaGlyAspTyrLeuHisProAspTyrProAla-413
Hydrophilic Regions - Hopp-Woods
SEQ. ID. NO. 14002  5-ProHisProArgProLysIle-11
SEQ. ID. NO. 14003  37-GluAlaGlyArgGlnAlaGlyGlyArgAlaArgThrLeuAlaGlyAsn-52
SEQ. ID. NO. 14004  80-IleGlySerAspProArgAlaAla-87
SEQ. ID. NO. 14005  122-ArgArgAlaProThr-126
SEQ. ID. NO. 14006  132-LeuLeuAlaAspMetSerAspLeuGlnLysSerAlaArgLeuGlyGlnProAspThrThr-151
SEQ. ID. NO. 14007  198-ValLeuThrLysLysSerGlySer-205
SEQ. ID. NO. 14008  208-LeuLeuProLysGlnAspLeu-214
SEQ. ID. NO. 14009  225-AspLeuGlnArgLeuGlyAlaAspIleArgLeuGluThrArgValCysArg-241
SEQ. ID. NO. 14010  246-ProAspGlyLysVal-250
SEQ. ID. NO. 14011  276-GlyThrProGluHisVal-281
SEQ. ID. NO. 14012  325-GlyArgLeuGlyLeuProGluAsnGluVal-334
SEQ. ID. NO. 14013  340-ValSerAspArgValGly-345
SEQ. ID. NO. 14014  351-AlaTrpAlaAspLysAlaHisAlaAspLeuLysArgIleLeu-364
SEQ. ID. NO. 14015  368-GlyGluProGluAlaValArgValIleThrGluLysArgAlaThrThrAlaAlaAspAlaProProPro-390
999
AMPHI Regions - AMPHI
SEQ. ID. NO. 14016  6-LeuIleSerAlaIleCysValSerIle-14
SEQ. ID. NO. 14017  30-GluProValGlnSerIleGlnAlaAla-38
SEQ. ID. NO. 14018  117-GlyGlnAsnLeuValAsnAsnAlaIleAsnGlyLeuHisSerIleGlnAlaValLeuSer-136
SEQ. ID. NO. 14019  138-ThrThrThrAspLys-142
SEQ. ID. NO. 14020  151-GlnLeuPheThrAlaLeuThrGluValValLysGluSer-163
Antigenic Index - Jameson-Wolf
SEQ. ID. NO. 14021  1-MetAsnMetLysLysLeuIle-7
SEQ. ID. NO. 14022  18-AlaCysAsnGlnGlnSerLysThrAlaGlnAlaGluGluProValGln-33
SEQ. ID. NO. 14023  42-AlaProMetAspIleThrVal-48
SEQ. ID. NO. 14024  57-GlnAlaPheLysThrGlnAsnValSer-65

TABLE 1-continued

| | |
|---|---|
| SEQ. ID. NO. 14025 | 67-LysIleHisAsnLysAsnIleValLysThrAspCysGlyTyr-80 |
| SEQ. ID. NO. 14026 | 94-LysLeuAspGluGlnGlnLysIleArgAla-103 |
| SEQ. ID. NO. 14027 | 111-LysThrAspGlyGluLysGlyGlnAsnLeu-120 |
| SEQ. ID. NO. 14028 | 138-ThrThrThrAspLysLeuGlyGluSerGluAlaGlyLys-150 |
| SEQ. ID. NO. 14029 | 158-GluValValLysGluSerAsnGlnThrGly-167 |
| SEQ. ID. NO. 14030 | 169-ThrAlaGlnLysAspValProAlaAspGly-178 |
| SEQ. ID. NO. 14031 | 185-PheGluLysGluThrAsnThr-191 |
| SEQ. ID. NO. 14032 | 195-IleGlyArgLysGlnPro-200 |

Hydrophilic Regions - Hopp-Woods

| | |
|---|---|
| SEQ. ID. NO. 14033 | 1-MetAsnMetLysLysLeuIle-7 |
| SEQ. ID. NO. 14034 | 21-GlnGlnSerLysThrAlaGlnAlaGluGluProValGln-33 |
| SEQ. ID. NO. 14035 | 72-AsnIleValLysThrAspCysGlyTyr-80 |
| SEQ. ID. NO. 14036 | 94-LysLeuAspGluGlnGlnLysIleArgAla-103 |
| SEQ. ID. NO. 14037 | 112-ThrAspGlyGluLysGlyGlnAsn-119 |
| SEQ. ID. NO. 14038 | 139-ThrThrAspLysLeuGlyGluSerGluAlaGlyLys-150 |
| SEQ. ID. NO. 14039 | 158-GluValValLysGluSerAsnGln-165 |
| SEQ. ID. NO. 14040 | 169-ThrAlaGlnLysAspValProAla-176 |
| SEQ. ID. NO. 14041 | 185-PheGluLysGluThrAsn-190 |
| SEQ. ID. NO. 14042 | 195-IleGlyArgLysGlnPro-200 | a001
AMPHI Regions - AMPHI

| | |
|---|---|
| SEQ. ID. NO. 14043 | 7-AlaAlaArgArgMet-11 |
| SEQ. ID. NO. 14044 | 69-PhePheGlySerAlaCysAsnSerAlaAla-78 |

Antigenic Index - Jameson-Wolf

| | |
|---|---|
| SEQ. ID. NO. 14045 | 3-ProGlnGlyLysAlaAlaArgArgMetSerAlaAsnGluValCys-17 |
| SEQ. ID. NO. 14046 | 31-ThrLeuProLysArgAspThrLeuAsnGlySerGlyThr-43 |
| SEQ. ID. NO. 14047 | 53-ProArgSerLeuArgSerLysSerThr-61 |
| SEQ. ID. NO. 14048 | 68-ArgPhePheGlySerAlaCysAsnSerAlaAlaArgArgSerSerCysProSerProLysIleGly-89 |
| SEQ. ID. NO. 14049 | 100-ValProSerGluProIleLeuArgLysSerSerGlyGluLysHisSerVal-116 |
| SEQ. ID. NO. 14050 | 118-AlaAspCysProCysAlaSerGlyArgTrpAspLysThrAla-131 |

Hydrophilic Regions - Hopp-Woods

| | |
|---|---|
| SEQ. ID. NO. 14051 | 5-GlyLysAlaAlaArgArgMetSerAla-13 |
| SEQ. ID. NO. 14052 | 32-LeuProLysArgAspThrLeuAsn-39 |
| SEQ. ID. NO. 14053 | 54-ArgSerLeuArgSerLysSer-60 |
| SEQ. ID. NO. 14054 | 76-SerAlaAlaArgArgSerSerCysProSerProLys-87 |
| SEQ. ID. NO. 14055 | 104-ProIleLeuArgLysSerSerGlyGluLysHisSerVal-116 |
| SEQ. ID. NO. 14056 | 125-GlyArgTrpAspLysThrAla-131 | a003
AMPHI Regions - AMPHI

| | |
|---|---|
| SEQ. ID. NO. 14057 | 72-AsnGlnValValLeu-76 |
| SEQ. ID. NO. 14058 | 82-IleValGluValPheGlnArg-88 |
| SEQ. ID. NO. 14059 | 138-ArgIleAsnAspAlaGluGluIleLeuGlnAspValValAlaGluPheValGlyIleValGlyHisPheAspGlyPheGlyVal-165 |
| SEQ. ID. NO. 14060 | 174-PheIleAlaArgIlePheArgVal-181 |

Antigenic Index - Jameson-Wolf

| | |
|---|---|
| SEQ. ID. NO. 14061 | 91-PheAsnAsnGluGlyGln-96 |
| SEQ. ID. NO. 14062 | 104-PheGluGlyGlyGlyAspAspGlyPhe-112 |
| SEQ. ID. NO. 14063 | 137-GlyArgIleAsnAspAlaGluGluIleLeu-146 |
| SEQ. ID. NO. 14064 | 204-ProGluAlaAlaAlaGlyGluValAspGlyAlaArgValHisAsp-218 |

Hydrophilic Regions - Hopp-Woods

| | |
|---|---|
| SEQ. ID. NO. 14065 | 106-GlyGlyGlyAspAspGlyPhe-112 |
| SEQ. ID. NO. 14066 | 137-GlyArgIleAsnAspAlaGluGluIleLeu-146 |
| SEQ. ID. NO. 14067 | 205-GluAlaAlaAlaGlyGluValAspGlyAlaArgValHisAsp-218 | a005
AMPHI Regions - AMPHI

| | |
|---|---|
| SEQ. ID. NO. 14068 | 14-IleGlnSerMetTrpLysGlu-20 |
| SEQ. ID. NO. 14069 | 30-LeuGluLeuLeuThrValPheGlyAlaIleAla-40 |
| SEQ. ID. NO. 14070 | 60-LeuThrAspPheSerGluAsnTyr-67 |
| SEQ. ID. NO. 14071 | 105-ArgLeuLysGluGlyGlyGlyGluLysSerSerGlu-115 |
| SEQ. ID. NO. 14072 | 175-GlnLeuArgArgLeuArg-180 |
| SEQ. ID. NO. 14073 | 214-AlaIleValGlySerValGlyValValAlaGluValProAsnIleHisArgLeuLeuLysLys-234 |
| SEQ. ID. NO. 14074 | 247-PheLysArgThrVal-251 |
| SEQ. ID. NO. 14075 | 272-ThrHisGlnLeuPheLysGln-278 |
| SEQ. ID. NO. 14076 | 306-LeuAsnLeuIleAspGluIleSerThr-314 |
| SEQ. ID. NO. 14077 | 318-LeuLeuLeuLysAlaPhe-323 |

Antigenic Index - Jameson-Wolf

| | |
|---|---|
| SEQ. ID. NO. 14078 | 8-MetProGluGlnGluGluIleGlnSerMetTrp-18 |
| SEQ. ID. NO. 14079 | 48-GlnSerLysLysGlnSerGluSerGlySer-57 |
| SEQ. ID. NO. 14080 | 62-AspPheSerGluAsnTyrLysLysGlnArgGlnSerPhe-74 |
| SEQ. ID. NO. 14081 | 80-SerGlyGluGluAlaLysHisGlnGluLysGluGluLysLysLysGluLys AlaGluAlaLysAlaGluLysLysArgLeuLysGluGlyGlyGluLysSerSerGluThrGlnLysSerArg-120 |
| SEQ. ID. NO. 14082 | 136-GluSerLeuArgHisGluIle-142 |
| SEQ. ID. NO. 14083 | 149-AlaLysProAspGluValLeuLeu-157 |
| SEQ. ID. NO. 14084 | 159-LeuGluSerProGlyGlyVal-165 |
| SEQ. ID. NO. 14085 | 175-GlnLeuArgArgLeuArgGluArgAsnIle-184 |
| SEQ. ID. NO. 14086 | 189-AlaValAspLysValAlaAla-195 |
| SEQ. ID. NO. 14087 | 230-ArgLeuLeuLysLysHisAspIleAspVal-239 |
| SEQ. ID. NO. 14088 | 245-GlyGluPheLysArgThr-250 |
| SEQ. ID. NO. 14089 | 256-GluAsnThrGluLysGlyLysGlnLysPheArgGlnGluLeuGluGluThrHisGln-274 |
| SEQ. ID. NO. 14090 | 279-PheValSerGluAsnArgProGlnLeuAspIleGluGluValAlaThr-294 |
| SEQ. ID. NO. 14091 | 310-AspGluIleSerThrSerAspAspLeuLeu-319 |

TABLE 1-continued

| | |
|---|---|
| SEQ. ID. NO. 14092 | 323-PheGluAsnLysGlnValIle-329 |
| SEQ. ID. NO. 14093 | 332-LysTyrGlnGluLysGlnSerLeu-339 |
| SEQ. ID. NO. 14094 | 349-AlaSerValGluLysLeuPhe-355 |
| SEQ. ID. NO. 14095 | 359-ValAsnArgArgAlaAspVal-365 |
| Hydrophilic Regions - Hopp-Woods | |
| SEQ. ID. NO. 14096 | 8-MetProGluGlnGluGluIleGlnSerMetTrp-18 |
| SEQ. ID. NO. 14097 | 48-GlnSerLysLysGlnSerGluSerGly-56 |
| SEQ. ID. NO. 14098 | 62-AspPheSerGluAsnTyrLysLysGlnArgGlnSerPhe-74 |
| SEQ. ID. NO. 14099 | 81-GlyGluGluAlaLysHisGlnGluLysGluGluLysLysGluLysAlaGluAlaLysAlaGluLysLysArgLeuLysGluGlyGly GluLysSerSerGluThrGlnLysSerArg-120 |
| SEQ. ID. NO. 14100 | 136-GluSerLeuArgHisGluIle-142 |
| SEQ. ID. NO. 14101 | 149-AlaLysProGluAspGluValLeuLeu-157 |
| SEQ. ID. NO. 14102 | 159-LeuGluSerProGly-163 |
| SEQ. ID. NO. 14103 | 175-GlnLeuArgArgLeuArgGluArgAsnIle-184 |
| SEQ. ID. NO. 14104 | 189-AlaValAspLysValAlaAla-195 |
| SEQ. ID. NO. 14105 | 230-ArgLeuLeuLysLysHisAspIleAspVal-239 |
| SEQ. ID. NO. 14106 | 245-GlyGluPheLysArg-249 |
| SEQ. ID. NO. 14107 | 256-GluAsnThrGluLysGlyLysGlnLysPheArgGlnGluLeuGluGluThrHisGln-274 |
| SEQ. ID. NO. 14108 | 279-PheValSerGluAsnArgProGlnLeuAspIleGluGluValAlaThr-294 |
| SEQ. ID. NO. 14109 | 310-AspGluIleSerThrSerAspAspLeuLeu-319 |
| SEQ. ID. NO. 14110 | 323-PheGluAsnLysGlnValIle-329 |
| SEQ. ID. NO. 14111 | 332-LysTyrGlnGluLysGlnSerLeu-339 |
| SEQ. ID. NO. 14112 | 349-AlaSerValGluLysLeuPhe-355 |
| SEQ. ID. NO. 14113 | 359-ValAsnArgArgAlaAspVal-365 |
| a006-1 | |
| AMPHI Regions - AMPHI | |
| SEQ. ID. NO. 14114 | 40-GlnAlaTrpGlnAlaLeuLeuTyrAlaLeuValValLeu-52 |
| SEQ. ID. NO. 14115 | 61-ArgArgIleAlaAspThrArgThrPheThrArgIleTyrThrGlu-75 |
| SEQ. ID. NO. 14116 | 103-GluPheValSerPhePheGlu-109 |
| SEQ. ID. NO. 14117 | 117-ThrSerValValSerIlePheGlyAlaCysIleMetLeuLeu-130 |
| SEQ. ID. NO. 14118 | 179-GlyAspGluArgGlnLeu-184 |
| SEQ. ID. NO. 14119 | 186-ArgHisTyrGlyLeuLeuAlaArgLeu-194 |
| SEQ. ID. NO. 14120 | 228-GlyTyrSerSerAlaGlyHisValTyrSer-237 |
| SEQ. ID. NO. 14121 | 249-LeuAspAspValProArgLeuValGluGlnTyrSerAsnLeuLysAspIle-265 |
| Antigenic Index - Jameson-Wolf | |
| SEQ. ID. NO. 14122 | 1-SerGlnAsnHisArgLysArgLeu-8 |
| SEQ. ID. NO. 14123 | 59-AlaAlaArgArgIleAlaAspThrArgThrPheThr-70 |
| SEQ. ID. NO. 14124 | 82-LeuGluGlnArgGlnArgGlnValProHisSer-92 |
| SEQ. ID. NO. 14125 | 163-PheArgLeuLysAsnSerLeuGluArgAspAsnHisPheIleArgLysGlyAspGluArgGlnLeuAspArgHisTyr-188 |
| SEQ. ID. NO. 14126 | 198-IleSerAsnArgGluAlaPhe-204 |
| SEQ. ID. NO. 14127 | 227-LysGlyTyrSerSer-231 |
| SEQ. ID. NO. 14128 | 249-LeuAspAspValProArgLeuValGluGlnTyrSerAsnLeuLysAspIleGlyGln-267 |
| SEQ. ID. NO. 14129 | 269-IleGluTrpSerLysArgAsnIleLysAlaGlyThr-280 |
| Hydrophilic Regions - Hopp-Woods | |
| SEQ. ID. NO. 14130 | 1-SerGlnAsnHisArgLysArgLeu-8 |
| SEQ. ID. NO. 14131 | 59-AlaAlaArgArgIleAlaAspThrArgThrPhe-69 |
| SEQ. ID. NO. 14132 | 82-LeuGluGlnArgGlnArgGlnValPro-90 |
| SEQ. ID. NO. 14133 | 166-LysAsnSerLeuGluArgAspAsnHisPheIleArgLysGlyAspGluArgGlnLeuAspArg-186 |
| SEQ. ID. NO. 14134 | 198-IleSerAsnArgGluAla-203 |
| SEQ. ID. NO. 14135 | 249-LeuAspAspValProArgLeuValGlu-257 |
| SEQ. ID. NO. 14136 | 260-SerAsnLeuLysAspIleGlyGln-267 |
| SEQ. ID. NO. 14137 | 269-IleGluTrpSerLysArgAsnIleLysAlaGlyThr-280 |
| a007-1 | |
| AMPHI Regions - AMPHI | |
| SEQ. ID. NO. 14138 | 71-HisSerMetValLysGlyIleAsn-78 |
| SEQ. ID. NO. 14139 | 105-ValAlaThrTyrIleMetAsnAlaPheAspAsnGlyGlyGly-118 |
| Antigenic Index - Jameson-Wolf | |
| SEQ. ID. NO. 14140 | 1-MetAsnThrThrArgLeu-6 |
| SEQ. ID. NO. 14141 | 20-SerAlaAlaAspAsnSerIleMetThrLysGlyGlnLysValTyrGluSerAsnCys-38 |
| SEQ. ID. NO. 14142 | 41-CysHisGlyLysLysGlyGluGlyArgGlyThr-51 |
| SEQ. ID. NO. 14143 | 55-ProLeuTyrArgSerAspPheIleMetLysLysProGln-67 |
| SEQ. ID. NO. 14144 | 83-ValAsnGlyLysThrTyrAsnGly-90 |
| SEQ. ID. NO. 14145 | 98-SerAspAlaAspIle-102 |
| SEQ. ID. NO. 14146 | 112-AlaPheAspAsnGlyGlyGlySerValThrGluLysAspValLysGlnAlaLysAsnLysLys-132 |
| Hydrophilic Regions - Hopp-Woods | |
| SEQ. ID. NO. 14147 | 26-IleMetThrLysGlyGlnLysValTyrGlu-35 |
| SEQ. ID. NO. 14148 | 42-HisGlyLysLysGlyGluGlyArgGly-50 |
| SEQ. ID. NO. 14149 | 61-PheIleMetLysLysProGln-67 |
| SEQ. ID. NO. 14150 | 98-SerAspAlaAspIle-102 |
| SEQ. ID. NO. 14151 | 119-SerValThrGluLysAspValLysGlnAlaLysAsnLysLys-132 |
| a008 | |
| AMPHI Regions - AMPHI | |
| SEQ. ID. NO. 14152 | 15-LeuGluAsnProAlaGlnGlnValArgAlaAlaLeuAspThrLeuSer-30 |
| SEQ. ID. NO. 14153 | 54-GlnProAspPheValAsnAlaVal-61 |
| SEQ. ID. NO. 14154 | 69-AspGlyIleAlaLeuLeuAlaGluLeuAsnArg-79 |
| SEQ. ID. NO. 14155 | 90-PheArgAsnAlaPro-94 |
| SEQ. ID. NO. 14156 | 129-ArgProLeuAlaGluIleLeuProAsp-137 |
| SEQ. ID. NO. 14157 | 144-GlyLysValAlaGluLeuSerLysArgLeuGly-154 |

TABLE 1-continued

Antigenic Index - Jameson-Wolf
SEQ. ID. NO. 14158   1-MetAsnAsnArgHis-5
SEQ. ID. NO. 14159   12-GlySerAsnLeuGluAsnProAlaGlnGlnVal-22
SEQ. ID. NO. 14160   29-LeuSerSerHisProAspIleArgLeuLysGlnAlaSerSer-42
SEQ. ID. NO. 14161   49-ValGlyTyrAspAsnGlnProAspPhe-57
SEQ. ID. NO. 14162   76-GluLeuAsnArgIleGluAlaAspPheGlyArgGluArgSerPheArgAsnAlaProArgThrLeuAspLeuAspIleIleAspPheAsp
                     GlyIleSerSerAspAspProArgLeuThrLeuProHisProArgAlaHisGluArgSerPheVal-127
SEQ. ID. NO. 14163   140-LeuGlyLysHisGlyLysValAlaGluLeuSerLysArgLeuGlyAsnGlnGlyIle-158
SEQ. ID. NO. 14164   160-LeuLeuProAspLys-164
Hydrophilic Regions - Hopp-Woods
SEQ. ID. NO. 14165   14-AsnLeuGluAsnProAlaGlnGlnVal-22
SEQ. ID. NO. 14166   33-ProAspIleArgLeuLysGln-39
SEQ. ID. NO. 14167   76-GluLeuAsnArgIleGluAlaAspPheGlyArgGluArgSerPheArgAsnAlaProArgThrLeuAsp-98
SEQ. ID. NO. 14168   105-AspGlyIleSerSerAspAspProArgLeu-114
SEQ. ID. NO. 14169   120-ArgAlaHisGluArgSerPheVal-127
SEQ. ID. NO. 14170   142-LysHisGlyLysValAlaGluLeuSerLysArgLeuGly-154
SEQ. ID. NO. 14171   160-LeuLeuProAspLys-164
a009
Antigenic Index - Jameson-Wolf
SEQ. ID. NO. 14172   6-ValAlaPheGluArgHisHisHisLysSerLysAlaGluGlnAsnThrHisArgArgAlaAspAlaGluIleAlaGlu-31
SEQ. ID. NO. 14173   37-AsnGlnHisThrGlnAlaArgLysGlnSer-46
SEQ. ID. NO. 14174   57-PheSerAspLysVal-61
SEQ. ID. NO. 14175   77-AlaAspGlyGlyLysThrTrpGlnLysPro-86
Hydrophilic Regions - Hopp-Woods
SEQ. ID. NO. 14176   6-ValAlaPheGluArgHisHisHisLysSerLysAlaGluGlnAsnThrHisArgArgAlaAspAlaGluIleAlaGlu-31
SEQ. ID. NO. 14177   40-ThrGlnAlaArgLysGlnSer-46
SEQ. ID. NO. 14178   78-AspGlyGlyLysThrTrpGln-84
a010-1
AMPHI Regions - AMPHI
SEQ. ID. NO. 14179   54-SerAlaSerLeuGly-58
SEQ. ID. NO. 14180   70-TyrAspThrValLysGly-75
SEQ. ID. NO. 14181   115-TyrGlnArgProPheGlyGlyHis-122
SEQ. ID. NO. 14182   125-GluHisGlyLysArgAlaVal-131
SEQ. ID. NO. 14183   146-LeuHisThrLeuTyrGln-151
SEQ. ID. NO. 14184   210-AlaSerSerThrAsn-214
SEQ. ID. NO. 14185   216-TyrMetAsnThrGlyAspGly-222
SEQ. ID. NO. 14186   275-ArgTyrAlaProThrValLys-281
SEQ. ID. NO. 14187   322-IleMetGluLysLeuProGlyIleArg-330
SEQ. ID. NO. 14188   338-GlyIleAspProIleLysAspProIlePro-347
SEQ. ID. NO. 14189   357-GlyGlyIleProThrAsnTyrHis-364
SEQ. ID. NO. 14190   413-AlaAlaGlyAspSerMetIleLysPheIleLysGluGlnSerAspTrp-428
SEQ. ID. NO. 14191   446-LeuAspAsnGlnThrAsp-451
SEQ. ID. NO. 14192   453-GluAsnValAspAlaLeuArgArgGluLeu-462
SEQ. ID. NO. 14193   479-LeuSerLysGlyValArgGluValMetAlaIleAlaGlu-491
SEQ. ID. NO. 14194   505-TrpAsnThrAlaArg-509
SEQ. ID. NO. 14195   514-GluLeuAspAsnLeuIleGluValAlaLys-523
Antigenic Index - Jameson-Wolf
SEQ. ID. NO. 14196   14-GlyGlyGlyGlyAlaGlyLeu-20
SEQ. ID. NO. 14197   26-LeuSerLysSerGlyLeu-31
SEQ. ID. NO. 14198   40-PheProThrArgSerHisThr-46
SEQ. ID. NO. 14199   59-AsnValGlnGluAspArgTrpAsp-66
SEQ. ID. NO. 14200   71-AspThrValLysGlySerTrpSerTrpLeuGlyAspGlnAspAlaIle-85
SEQ. ID. NO. 14201   104-MetProPheAspArgValGluSerGlyLysIleTyrGlnArgProPheGly-120
SEQ. ID. NO. 14202   123-ThrAlaGluHisGlyLysArgAlaValGluArgAlaCysAlaValAlaAspArgThrGly-142
SEQ. ID. NO. 14203   152-GlnAsnValArgAlaAsnThrGln-159
SEQ. ID. NO. 14204   168-AspLeuIleArgAspGluAsnGlyAspVal-177
SEQ. ID. NO. 14205   183-MetGluMetThrGlyGlu-189
SEQ. ID. NO. 14206   202-ThrGlyGlyGlyArgIle-208
SEQ. ID. NO. 14207   211-SerSerThrAsnAla-215
SEQ. ID. NO. 14208   218-AsnThrGlyAspGlyLeu-223
SEQ. ID. NO. 14209   231-IleProLeuGluAspMetGlu-237
SEQ. ID. NO. 14210   255-GluGlyValArgGlyGlyGlyIle-263
SEQ. ID. NO. 14211   266-AsnAlaAspGlyGluArgPheMetGlu-274
SEQ. ID. NO. 14212   276-TyrAlaProThrValLysAspLeuAlaSerArgAspValValSer-290
SEQ. ID. NO. 14213   297-IleTyrGluGlyArgGlyCysGlyLysAsnLysAspHisVal-310
SEQ. ID. NO. 14214   315-AspHisIleGlyAlaGluLysIleMetGluLysLeuProGlyIleArgGluIleSer-333
SEQ. ID. NO. 14215   338-GlyIleAspProIleLysAspProIle-346
SEQ. ID. NO. 14216   368-ValValProGlnGlyAspGluTyrGluValProVal-379
SEQ. ID. NO. 14217   395-GlyAlaAsnArgLeuGlyThrAsnSerLeu-404
SEQ. ID. NO. 14218   413-AlaAlaGlyAspSerMet-418
SEQ. ID. NO. 14219   421-PheIleLysGluGlnSerAspTrpLysProLeuProAlaAsnAlaGlyGluLeuThrArgGlnArgIleGluArgLeuAspAsnGlnThr
                     AspGlyGluAsnValAspAlaLeuArgArgGluLeuGlnArgSer-465
SEQ. ID. NO. 14220   473-PheArgThrAspGluIleLeuSerLysGlyValArgGlu-485
SEQ. ID. NO. 14221   487-MetAlaIleAlaGluArgValLysArgThrGluIleLysAspLysSerLysVal-504
SEQ. ID. NO. 14222   508-AlaArgIleGluAlaLeuGluLeu-515
SEQ. ID. NO. 14223   529-AlaGluAlaArgLysGluSerArgGlyAlaHisAlaSerAspAspHisProGluArgAspAspGluAsnTrpMet-553
SEQ. ID. NO. 14224   558-TyrHisSerAspAlaAsnThrLeuSerTyrLysProValHisThrLysProLeuSer-576
SEQ. ID. NO. 14225   581-LysProAlaLysArgValTyr-587

TABLE 1-continued

Hydrophilic Regions - Hopp-Woods
SEQ. ID. NO. 14226   26-LeuSerLysSerGlyLeu-31
SEQ. ID. NO. 14227   59-AsnValGlnGluAspArgTrpAsp-66
SEQ. ID. NO. 14228   71-AspThrValLysGly-75
SEQ. ID. NO. 14229   77-AspTrpLeuGlyGlnAspAlaIle-85
SEQ. ID. NO. 14230   105-ProPheAspArgValGluSerGlyLysIleTyr-115
SEQ. ID. NO. 14231   123-ThrAlaGluHisGlyLysArgAlaValGluArgAlaCysAlaValAlaAspArgThrGly-142
SEQ. ID. NO. 14232   168-AspLeuIleArgAspGluAsnGlyAsp-176
SEQ. ID. NO. 14233   183-MetGluMetGluThrGlyGlu-189
SEQ. ID. NO. 14234   231-IleProLeuGluAspMetGlu-237
SEQ. ID. NO. 14235   255-GluGlyValArgGlyGluGly-261
SEQ. ID. NO. 14236   267-AlaAspGlyGluArgPheMetGlu-274
SEQ. ID. NO. 14237   276-TyrAlaProThrValLysAspLeuAlaSerArgAspValValSer-290
SEQ. ID. NO. 14238   297-IleTyrGluGlyArgGlyCysGlyLysAsnLysAspHisVal-310
SEQ. ID. NO. 14239   315-AspHisIleGlyAlaGluLysIleMetGluLysLeuProGlyIleArgGluIleSer-333
SEQ. ID. NO. 14240   340-AspProIleLysAspProIle-346
SEQ. ID. NO. 14241   371-GlnGlyAspGluTyrGluValProVal-379
SEQ. ID. NO. 14242   421-PheIleLysGluGlnSerAspTrpLysPro-430
SEQ. ID. NO. 14243   434-AsnAlaGlyGluLeuThrArgGlnArgIleGluArgLeuAspAsnGlnThrAspGlyGluAsnValAspAlaLeuArgArgGluLeuGlnArg-464
SEQ. ID. NO. 14244   473-PheArgThrAspGluIleLeuSerLysGlyValArgGlu-485
SEQ. ID. NO. 14245   487-MetAlaIleAlaGluArgValLysArgThrGluIleLysAspLysSerLysVal-504
SEQ. ID. NO. 14246   508-AlaArgIleGluAlaLeuGluLeu-515
SEQ. ID. NO. 14247   529-AlaGluAlaArgLysGluSerArgGlyAlaHisAlaSerAspAspHisProGluArgAspAspGluAsnTrpMet-553
SEQ. ID. NO. 14248   581-LysProAlaLysArgValTyr-587
a011
AMPHI Regions - AMPHI
SEQ. ID. NO. 14249   58-IleArgLeuIleAsnAlaAla-64
SEQ. ID. NO. 14250   83-AlaIleLeuThrLys-87
SEQ. ID. NO. 14251   116-GluValLeuHisArgTyrLeuProGlnMetLeuSerAlaGly-129
SEQ. ID. NO. 14252   147-MetAlaXxxMetGlyLysValMetGlyVal-156
Antigenic Index - Jameson-Wolf
SEQ. ID. NO. 14253   1-MetArgThrHisArgLysThrCysSer-9
SEQ. ID. NO. 14254   17-ThrAlaSerLysProAlaValSerIleArgHisProSerGluAsnIleMet-33
SEQ. ID. NO. 14255   37-IleArgLeuThrGluAspMetLysThrAlaMetArgAlaLysAspGlnVal-53
SEQ. ID. NO. 14256   66-LysGlnPheGluValAspGluArgThrGluAlaAspAspAlaLysIle-81
SEQ. ID. NO. 14257   88-MetValLysGlnArgLysAspSerValLysIle-98
SEQ. ID. NO. 14258   100-ThrGluAlaGlyArgGlnAspLeuAlaAspLysGluAsnAlaGluIle-115
SEQ. ID. NO. 14259   127-SerAlaGlyGluIleArgThrAlaVal-135
SEQ. ID. NO. 14260   157-XxxLysThrArgLeuAlaGlyLysAlaAspMetGlyGluValAsnLysIleLeu-174
Hydrophilic Regions - Hopp-Woods
SEQ. ID. NO. 14261   1-MetArgThrHisArgLysThrCys-8
SEQ. ID. NO. 14262   37-IleArgLeuThrGluAspMetLysThrAlaMetArgAlaLysAspGlnVal-53
SEQ. ID. NO. 14263   66-LysGlnPheGluValAspGluArgThrGluAlaAspAspAlaLysIle-81
SEQ. ID. NO. 14264   88-MetValLysGlnArgLysAspSerValLysIle-98
SEQ. ID. NO. 14265   100-ThrGluAlaGlyArgGlnAspLeuAlaAspLysGluAsnAlaGluIle-115
SEQ. ID. NO. 14266   129-GlyGluIleArgThrAlaVal-135
SEQ. ID. NO. 14267   157-XxxLysThrArgLeuAlaGlyLysAlaAspMetGlyGluValAsnLysIleLeu-174
a012-1
AMPHI Regions - AMPHI
SEQ. ID. NO. 14268   19-LysLeuLeuGluGlnLeuMetArgPheLeuGlnPheLeuSerGluPheLeuPheAlaLeuPheArgIle-41
SEQ. ID. NO. 14269   48-ArgAlaLeuLysPheAlaArgArg-55
SEQ. ID. NO. 14270   89-AsnAsnPheIleArgHisThr-95
SEQ. ID. NO. 14271   160-GlnGlyPheTyrGlyVal-165
SEQ. ID. NO. 14272   179-GlyPheLeuArgPheGlyArgPheLeuProThrLeuLeuGlnThrLeu-194
Antigenic Index - Jameson-Wolf
SEQ. ID. NO. 14273   42-PheThrHisLysSerAsnArgAlaLeuLysPheAlaArgArgHisHis-57
SEQ. ID. NO. 14274   72-ArgTyrPheArgTyrAsnThrHisArgThrAspAsnArgLysArgSerGlyAsnAsnPhe-91
SEQ. ID. NO. 14275   93-ArgHisThrArgHisHis-98
SEQ. ID. NO. 14276   101-ThrAlaArgArgHisLeuIleAspGlyAspGlyGlnArgAsn-114
SEQ. ID. NO. 14277   119-GlnThrProLysLeuArgSerArgGln-127
SEQ. ID. NO. 14278   137-ThrPheGlnSerLysGlnAsnLeu-144
SEQ. ID. NO. 14279   147-ArgLeuGlyAsnGlnLysHisArgArgAsnLeuMetThrGln-160
SEQ. ID. NO. 14280   173-IleGlnHisLysLysAlaGly-179
Hydrophilic Regions - Hopp-Woods
SEQ. ID. NO. 14281   45-LysSerAsnArgAlaLeuLysPheAlaArgArgHisHis-57
SEQ. ID. NO. 14282   77-AsnThrHisArgThrAspAsnArgLysArgSerGly-88
SEQ. ID. NO. 14283   101-ThrAlaArgArgHisLeuIleAspGlyAspGlyGlnArg-113
SEQ. ID. NO. 14284   121-ProLysLeuArgSerArgGln-127
SEQ. ID. NO. 14285   149-GlyAsnGlnLysHisArgArgAsnLeu-157
SEQ. ID. NO. 14286   173-IleGlnHisLysLysAlaGly-179
a015
AMPHI Regions - AMPHI
SEQ. ID. NO. 14287   25-ValPheXxxLeuTrpLysAsnProGluLysProLeuAlaGlyPheTrpLysAlaLeuProHis-45
SEQ. ID. NO. 14288   107-MetCysCysLeuThrCys-112
Antigenic Index - Jameson-Wolf
SEQ. ID. NO. 14289   29-TrpLysAsnProGluLysProLeu-36
SEQ. ID. NO. 14290   90-MetArgAlaArgProArgSerThrLys-98

TABLE 1-continued

Hydrophilic Regions - Hopp-Woods
SEQ. ID. NO. 14291 30-LysAsnProGluLysProLeu-36
SEQ. ID. NO. 14292 90-MetArgAlaArgProArgSerThrLys-98
a018-2
AMPHI Regions - AMPHI
SEQ. ID. NO. 14293 6-IleGlnHisLeuArg-10
SEQ. ID. NO. 14294 100-AspGlyAlaAlaAlaAla-104
SEQ. ID. NO. 14295 152-ArgIleGlyAsnGlyTyr-157
Antigenic Index - Jameson-Wolf
SEQ. ID. NO. 14296 1-MetValGluArgHisIleGln-7
SEQ. ID. NO. 14297 9-LeuArgAsnGlyHis-13
SEQ. ID. NO. 14298 19-ProSerGlnGlnValArg-24
SEQ. ID. NO. 14299 27-PheGlyGlyArgThrTyrAspPheCysAlaAspGluAlaAla-40
SEQ. ID. NO. 14300 67-TyrPheAlaAspAspLysPhe-73
SEQ. ID. NO. 14301 78-LeuArgGlyAsnLeuArg-83
SEQ. ID. NO. 14302 85-PheGlnThrAspLysAlaAspLeuArgThrGlyGluHisTyrAlaAspGlyAlaAla-103
SEQ. ID. NO. 14303 108-AlaAspIleArgVal-112
SEQ. ID. NO. 14304 136-ArgValAlaArgAsnLysAspMetArgAsnThrGlyLeuHisSerGlnArgIleGlyAsnGlyTyr-157
Hydrophilic Regions - Hopp-Woods
SEQ. ID. NO. 14305 1-MetValGluArgHisIleGln-7
SEQ. ID. NO. 14306 35-CysAlaAspGluAlaAla-40
SEQ. ID. NO. 14307 67-TyrPheAlaAspAspLysPhe-73
SEQ. ID. NO. 14308 85-PheGlnThrAspLysAlaAspLeuArgThrGlyGluHisTyrAla-99
SEQ. ID. NO. 14309 108-AlaAspIleArgVal-112
SEQ. ID. NO. 14310 136-ArgValAlaArgAsnLysAspMetArgAsn-145
a019-2
AMPHI Regions - AMPHI
SEQ. ID. NO. 14311 33-ProAlaAspAsnIleGlu-38
SEQ. ID. NO. 14312 55-GlyLysThrLeuAlaAspTyrGlyGlyTyrProSerAlaLeuAspAla-70
SEQ. ID. NO. 14313 80-AlaAlaTyrLeuGluAsnAlaGlyAsp-88
SEQ. ID. NO. 14314 90-AlaMetAlaGluAsnValArgAsnGluTrpLeuLysSer-102
SEQ. ID. NO. 14315 142-AlaAlaGluLeuValLysAsnThrGlyLysLeuProSerGlyCysThrLysLeuLeuGluGlnAlaAlaAlaSer-166
SEQ. ID. NO. 14316 173-AspAlaTrpArgArgValArg-179
SEQ. ID. NO. 14317 193-LeuAlaAlaAlaLeuGlySerProPheAspGlyGlyThrGlnGly-207
SEQ. ID. NO. 14318 215-AsnValIleGlyLysGluAlaArgLysSer-224
SEQ. ID. NO. 14319 229-AlaLeuLeuSerGluMet-234
SEQ. ID. NO. 14320 259-AsnValProAlaAlaLeuAspTyrTyrGly-268
SEQ. ID. NO. 14321 292-ArgArgTrpAspGluLeuAlaSerValIleSerHisMetProGluLysLeuGlnLys-310
SEQ. ID. NO. 14322 329-GlnGluAlaGluLysLeuTyrLysGlnAla-338
SEQ. ID. NO. 14323 451-ArgTyrIleSerPro-455
SEQ. ID. NO. 14324 495-GlnGlyLeuMetGlnValMet-501
SEQ. ID. NO. 14325 582-ArgAspTyrValLysLysValMet-589
Antigenic Index - Jameson-Wolf
SEQ. ID. NO. 14326 3-ProProSerLeuLys-7
SEQ. ID. NO. 14327 22-SerSerThrAsnThrLeuSerAlaAspLysThrProAlaAspAsnIleGluThrAlaAspLeuSerAlaSerValProThrArgProAlaGlu
ProGluGlyLysThrLeuAlaAspTyrGlyGlyTyrProSerAla-67
SEQ. ID. NO. 14328 69-AspAlaValLysGlnLysAsnAspAla-77
SEQ. ID. NO. 14329 85-AsnAlaGlyAspSerAlaMet-91
SEQ. ID. NO. 14330 103-LeuGlyAlaArgArgGln-108
SEQ. ID. NO. 14331 115-GluTyrAlaLysLeuGluProAlaGlyArgAlaGlnGluValGluCysTyrAlaAspSerSerArgAsnAspTyrThrArgAlaAlaGluLeu
ValLysAsnThrGlyLysLeuProSerGlyCys-156
SEQ. ID. NO. 14332 167-GlyLeuLeuAspGlyAsnAspAlaTrpArgArgValArgGly-180
SEQ. ID. NO. 14333 182-LeuAlaGlyArgGlnThrThrAspAlaArgAsn-192
SEQ. ID. NO. 14334 199-SerProPheAspGlyGlyThrGlnGlySerArgGluTyr-211
SEQ. ID. NO. 14335 217-IleGlyLysGluAlaArgLysSerProAsn-226
SEQ. ID. NO. 14336 232-SerGluMetGluSerGlyLeuSerLeuGluGlnArgSer-244
SEQ. ID. NO. 14337 254-GlnSerGlnAsnLeu-258
SEQ. ID. NO. 14338 266-TyrTyrGlyLysValAlaAspArgArgGlnLeuThrAspAspGlnIle-281
SEQ. ID. NO. 14339 287-AlaAlaLeuArgAlaArgArgTrpAspGlu-296
SEQ. ID. NO. 14340 304-MetProGluLysLeuGlnLysSerProThr-313
SEQ. ID. NO. 14341 320-ArgSerArgAlaAlaThrGlyAsnThrGlnGluAlaGluLysLeuTyrLys-336
SEQ. ID. NO. 14342 339-AlaAlaThrGlyArgAsn-344
SEQ. ID. NO. 14343 350-AlaGlyGluGluLeuGlyArgLysIleAspThrArgAsnAsnValProAspAlaGlyLysAsnSerVal-372
SEQ. ID. NO. 14344 374-ArgMetAlaGluAspGlyAlaIleLys-382
SEQ. ID. NO. 14345 389-ArgAsnSerArgThrAlaGlyAspAlaLysMetArgGlnAlaGlnAla-405
SEQ. ID. NO. 14346 409-PheAlaThrArgGlyPheAspGluAspLysLeuLeu-420
SEQ. ID. NO. 14347 438-SerArgGluArgThrAspArgLysLeuAsnTyr-448
SEQ. ID. NO. 14348 454-SerProPheLysAspThrValIle-461
SEQ. ID. NO. 14349 464-AlaGlnAsnValAsnValAspProAla-472
SEQ. ID. NO. 14350 478-IleArgGlnGluSerArgPhe-484
SEQ. ID. NO. 14351 488-AlaGlnSerArgValGlyAla-494
SEQ. ID. NO. 14352 504-ThrAlaArgGluIleAlaGly-510
SEQ. ID. NO. 14353 520-TyrThrAlaAspGlyAsnIleArgMetGly-529
SEQ. ID. NO. 14354 535-AspThrLysArgArgLeuGlnAsnAsnGluVal-545
SEQ. ID. NO. 14355 550-GlyTyrAsnAlaGlyProGlyArgAlaArgArgTrpGlnAlaAspThrProLeuGlu-568
SEQ. ID. NO. 14356 579-SerGluThrArgAspTyrValLys-586
SEQ. ID. NO. 14357 606-LeuLysGlnArgMet-610
Hydrophilic Regions - Hopp-Woods
SEQ. ID. NO. 14358 27-LeuSerAlaAspLysThrProAlaAspAsnIleGluThrAlaAspLeu-42
SEQ. ID. NO. 14359 46-ValProThrArgProAlaGluProGluGlyLysThrLeuAla-59

TABLE 1-continued

| SEQ. ID. NO. 14360 | 69-AspAlaValLysGlnLysAsnAspAla-77 |
| SEQ. ID. NO. 14361 | 85-AsnAlaGlyAspSerAlaMet-91 |
| SEQ. ID. NO. 14362 | 103-LeuGlyAlaArgArgGln-108 |
| SEQ. ID. NO. 14363 | 115-GluTyrAlaLysLeuGluProAlaGlyArgAlaGlnGluValGluCysTyrAlaAspSerSerArgAsnAspTyrThrArgAlaAlaGlu LeuValLysAsnThrGlyLysLeuProSerGlyCys-156 |
| SEQ. ID. NO. 14364 | 170-AspGlyAsnAspAlaTrpArgArgValArgGly-180 |
| SEQ. ID. NO. 14365 | 185-ArgGlnThrThrAspAlaArgAsn-192 |
| SEQ. ID. NO. 14366 | 201-PheAspGlyGlyThrGlnGlySerArgGlu-210 |
| SEQ. ID. NO. 14367 | 217-IleGlyLysGluAlaArgLysSerProAsn-226 |
| SEQ. ID. NO. 14368 | 232-SerGluMetGluSer-236 |
| SEQ. ID. NO. 14369 | 238-LeuSerLeuGluGlnArgSer-244 |
| SEQ. ID. NO. 14370 | 270-ValAlaAspArgArgGlnLeuThrAspAspGlnIle-281 |
| SEQ. ID. NO. 14371 | 287-AlaAlaLeuArgAlaArgArgTrpAspGlu-296 |
| SEQ. ID. NO. 14372 | 304-MetProGluLysLeuGlnLys-310 |
| SEQ. ID. NO. 14373 | 320-ArgSerArgAlaAlaThr-325 |
| SEQ. ID. NO. 14374 | 327-AsnThrGlnGluAlaGluLysLeuTyrLys-336 |
| SEQ. ID. NO. 14375 | 350-AlaGlyGluGluLeuGlyArgLysIleAspThrArgAsnAsnValProAspAlaGlyLys-369 |
| SEQ. ID. NO. 14376 | 374-ArgMetAlaGluAspGlyAlaIleLys-382 |
| SEQ. ID. NO. 14377 | 389-ArgAsnSerArgThrAlaGlyAspAlaLysMetArgArgGlnAlaGlnAla-405 |
| SEQ. ID. NO. 14378 | 411-ThrArgGlyPheAspGluAspLysLeuLeu-420 |
| SEQ. ID. NO. 14379 | 438-SerAlaGluArgThrAspArgLysLeu-446 |
| SEQ. ID. NO. 14380 | 478-IleArgGlnGluSerArgPhe-484 |
| SEQ. ID. NO. 14381 | 488-AlaGlnSerArgValGly-493 |
| SEQ. ID. NO. 14382 | 504-ThrAlaArgGluIleAlaGly-510 |
| SEQ. ID. NO. 14383 | 535-AspThrLysArgArgLeuGlnAsn-542 |
| SEQ. ID. NO. 14384 | 554-GlyProGlyArgAlaArgArgTrpGlnAla-563 |
| SEQ. ID. NO. 14385 | 579-SerGluThrArgAspTyrValLys-586 |
| SEQ. ID. NO. 14386 | 606-LeuLysGlnArgMet-610 | a023
AMPHI Regions - AMPHI

| SEQ. ID. NO. 14387 | 42-LysGluTyrSerAlaTrpGlnAlaPhePheSerGlnThrTrpValLys ValPheThrGlnValSerPheIleAlaValPheLeuHisAlaTrpValGly-74 |
| SEQ. ID. NO. 14388 | 82-TyrXxxLysProPhe-86 |

Antigenic Index - Jameson-Wolf

| SEQ. ID. NO. 14389 | 1-MetValGluArgLysLeuThr-7 |
| SEQ. ID. NO. 14390 | 41-ProLysGluTyrSer-45 |
| SEQ. ID. NO. 14391 | 81-AspTyrXxxLysProPheGlyVal-88 |

Hydrophilic Regions - Hopp-Woods

| SEQ. ID. NO. 14392 | 1-MetValGluArgLysLeuThr-7 | a025
AMPHI Regions - AMPHI

| SEQ. ID. NO. 14393 | 15-AlaAlaGlnLeuGlyGlyCysProThrGlnHis-25 |
| SEQ. ID. NO. 14394 | 36-MetGlnThrValProSerAlaProValTyrAsnProTyrGlyAlaThrProTyr-53 |
| SEQ. ID. NO. 14395 | 111-AspThrValTyrLysIleSerLysCysTyrHisIle-122 |
| SEQ. ID. NO. 14396 | 126-AspPheArgAlaTrpAsnGlyMetThrAsp-135 |
| SEQ. ID. NO. 14397 | 140-IleGlyGlnIleValLysVal-146 |
| SEQ. ID. NO. 14398 | 206-AspPheArgAlaTrpAsnGlyMetThrAsp-215 |
| SEQ. ID. NO. 14399 | 220-IleGlyGlnIleValLysVal-226 |
| SEQ. ID. NO. 14400 | 248-AlaValGlnThrProValLysProAlaAla-257 |
| SEQ. ID. NO. 14401 | 261-ValGlnSerAlaProGlnPro-267 |
| SEQ. ID. NO. 14402 | 290-SerGlyThrArgSer-294 |
| SEQ. ID. NO. 14403 | 307-LysValValAlaAspPhe-312 |
| SEQ. ID. NO. 14404 | 343-GlyLeuArgGlyTyrGlyAsn-349 |

Antigenic Index - Jameson-Wolf

| SEQ. ID. NO. 14405 | 22-ProThrGlnHisPro-26 |
| SEQ. ID. NO. 14406 | 33-AsnSerGlyMetGlnThr-38 |
| SEQ. ID. NO. 14407 | 58-AlaAlaAsnAspAlaPro-63 |
| SEQ. ID. NO. 14408 | 108-ValArgGlyAspThrValTyrLysIleSerLys-118 |
| SEQ. ID. NO. 14409 | 120-TyrHisIleSerGlnAspAspPheArgAla-129 |
| SEQ. ID. NO. 14410 | 131-AsnGlyMetThrAspAsnThrLeu-138 |
| SEQ. ID. NO. 14411 | 144-ValLysValLysProAlaGly-150 |
| SEQ. ID. NO. 14412 | 157-AlaAlaValLysSerArgProAla-164 |
| SEQ. ID. NO. 14413 | 188-ValArgGlyAspThr-192 |
| SEQ. ID. NO. 14414 | 195-AsnIleSerLysArgTyrHisIleSerGlnAspAspPheArgAla-209 |
| SEQ. ID. NO. 14415 | 211-AsnGlyMetThrAspAsnThrLeu-218 |
| SEQ. ID. NO. 14416 | 224-ValLysValLysProAlaGly-230 |
| SEQ. ID. NO. 14417 | 237-AlaAlaValLysSerArgProAla-244 |
| SEQ. ID. NO. 14418 | 252-ProValLysProAlaAlaGlnProProValGlnSerAlaProGlnPro-267 |
| SEQ. ID. NO. 14419 | 270-ProAlaAlaGluAsnLysAlaVal-277 |
| SEQ. ID. NO. 14420 | 280-ProAlaProGlnSerProAlaAlaSerProSerGlyThrArgSerValGly-296 |
| SEQ. ID. NO. 14421 | 302-ArgProThrGlnGlyLysValValAlaAspPheGlyGlyAsnAsnLysGlyValAsp-320 |
| SEQ. ID. NO. 14422 | 333-AlaAspGlyLysVal-337 |
| SEQ. ID. NO. 14423 | 342-SerGlyLeuArgGlyTyrGly-348 |
| SEQ. ID. NO. 14424 | 363-TyrGlyHisAsnGln-367 |
| SEQ. ID. NO. 14425 | 370-LeuValGlyGluGlyGlnGlnValLysArgGlyGlnGln-382 |
| SEQ. ID. NO. 14426 | 387-GlyAsnThrGluAlaSerArgThrGlnLeu-396 |
| SEQ. ID. NO. 14427 | 398-PheGluValArgGlnAsnGlyLysProValAsnProAsnSer-411 |

Hydrophilic Regions - Hopp-Woods

| SEQ. ID. NO. 14428 | 108-ValArgGlyAspThr-112 |
| SEQ. ID. NO. 14429 | 123-SerGlnAspAspPheArg-128 |

TABLE 1-continued

| SEQ. ID. NO. 14430 | 144-ValLysValLysPro-148 |
| --- | --- |
| SEQ. ID. NO. 14431 | 157-AlaAlaValLysSerArgProAla-164 |
| SEQ. ID. NO. 14432 | 188-ValArgGlyAspThr-192 |
| SEQ. ID. NO. 14433 | 200-TyrHisIleSerGlnAspAspPheArg-208 |
| SEQ. ID. NO. 14434 | 224-ValLysValLysPro-228 |
| SEQ. ID. NO. 14435 | 237-AlaAlaValLysSerArgProAla-244 |
| SEQ. ID. NO. 14436 | 253-ValLysProAlaAla-257 |
| SEQ. ID. NO. 14437 | 270-ProAlaAlaGluAsnLysAlaVal-277 |
| SEQ. ID. NO. 14438 | 290-SerGlyThrArgSer-294 |
| SEQ. ID. NO. 14439 | 313-GlyGlyAsnAsnLysGlyValAsp-320 |
| SEQ. ID. NO. 14440 | 333-AlaAspGlyLysVal-337 |
| SEQ. ID. NO. 14441 | 373-GluGlyGlnGlnValLysArgGlyGln-381 |
| SEQ. ID. NO. 14442 | 389-ThrGluAlaSerArgThr-394 |
| SEQ. ID. NO. 14443 | 400-ValArgGlnAsnGlyLysProValAsn-408 | a032
AMPHI Regions - AMPHI

| SEQ. ID. NO. 14444 | 11-LeuArgArgProLeuArgGln-17 |
| --- | --- |
| SEQ. ID. NO. 14445 | 67-SerPheAlaGlyAsnValTyrProArgLeu-76 |
| SEQ. ID. NO. 14446 | 114-ValHisGlyGlnIleGlnHisProValGlnProPheLeuArg-127 |
| SEQ. ID. NO. 14447 | 134-LeuGlyLeuLeuArgArgPheAspVal-142 |

Antigenic Index - Jameson-Wolf

| SEQ. ID. NO. 14448 | 1-MetArgArgAsnVal-5 |
| --- | --- |
| SEQ. ID. NO. 14449 | 10-ValLeuArgArgProLeuArg-16 |
| SEQ. ID. NO. 14450 | 28-ArgAlaValProAlaGlyLysGlnGlyPhe-37 |
| SEQ. ID. NO. 14451 | 41-CysArgLeuThrGlnArgGln-47 |
| SEQ. ID. NO. 14452 | 57-AlaGlyGlnArgAsnLeuPro-63 |
| SEQ. ID. NO. 14453 | 104-ValIleAlaHisArgGlnArgVal-111 |
| SEQ. ID. NO. 14454 | 138-ArgArgPheAspValGlyGlyArgValGlyMet-148 |
| SEQ. ID. NO. 14455 | 151-ThrAlaPheAspGlnProGlyAla-158 |
| SEQ. ID. NO. 14456 | 160-LeuProProArgArgGlnLeuAlaArgGlnArgProArgIleGlnThrAlaLeuArgGlnProProGlnArgArgArgLysIleAlaLeu-189 |
| SEQ. ID. NO. 14457 | 203-HisLeuCysGlnGlnArgLysGln-210 |
| SEQ. ID. NO. 14458 | 236-ValLysMetArgArgLysProValGlnAsnHisAsnArgProThrGlnIleSerLysLysGln-256 |

Hydrophilic Regions - Hopp-Woods

| SEQ. ID. NO. 14459 | 1-MetArgArgAsnVal-5 |
| --- | --- |
| SEQ. ID. NO. 14460 | 10-ValLeuArgArgProLeuArg-16 |
| SEQ. ID. NO. 14461 | 28-ArgAlaValProAlaGlyLys-34 |
| SEQ. ID. NO. 14462 | 41-CysArgLeuThrGln-45 |
| SEQ. ID. NO. 14463 | 104-ValIleAlaHisArgGlnArgVal-111 |
| SEQ. ID. NO. 14464 | 138-ArgArgPheAspValGlyGly-144 |
| SEQ. ID. NO. 14465 | 161-ProProArgArgGlnLeuAlaArgGlnArgProArgIle-173 |
| SEQ. ID. NO. 14466 | 177-LeuArgGlnProProGlnArgArgArgLysIleAlaLeu-189 |
| SEQ. ID. NO. 14467 | 203-HisLeuCysGlnGlnArgLysGln-210 |
| SEQ. ID. NO. 14468 | 236-ValLysMetArgArgLysProValGlnAsnHisAsnArgProThrGlnIleSerLysLysGln-256 | a033-2
AMPHI Regions - AMPHI

| SEQ. ID. NO. 14469 | 6-GlnTyrGlyGlyLeuAlaGlyPheProLysArgCysGluSerGlu-20 |
| --- | --- |
| SEQ. ID. NO. 14470 | 64-GlyGlnAlaPheGluAlaLeuAsnCys-72 |
| SEQ. ID. NO. 14471 | 95-ValGlyAlaLeuProLysTyrLeuAlaSerAsnValValArgAspMetHisGlyLeuLeuSerThrVal-117 |
| SEQ. ID. NO. 14472 | 120-GlnThrGlyLysValLeuAspLysIleProGlyAlaMetGlu-133 |
| SEQ. ID. NO. 14473 | 142-IleLysThrLeuAlaGlu-147 |
| SEQ. ID. NO. 14474 | 157-SerLeuPheGluAsnPhe-162 |
| SEQ. ID. NO. 14475 | 168-GlyProValAspGlyHisAsnValGluAsnLeuValAspValLeuGluAspLeuArgGlyArg-188 |
| SEQ. ID. NO. 14476 | 207-AlaGluAsnAspPro-211 |
| SEQ. ID. NO. 14477 | 213-LysTyrHisAlaValAlaAsnLeuProLysGluSerAlaAla-226 |
| SEQ. ID. NO. 14478 | 242-TyrThrGlnValPheGlyLys-248 |
| SEQ. ID. NO. 14479 | 280-PheProAspArgTyrPheAspVal-287 |
| SEQ. ID. NO. 14480 | 307-LysProValValAlaIleTyrSer-314 |
| SEQ. ID. NO. 14481 | 316-PheLeuGlnArgAlaTyrAspGlnLeu-324 |
| SEQ. ID. NO. 14482 | 357-AspLeuSerPheLeuArgCysIleProAsnMetIleVal-369 |
| SEQ. ID. NO. 14483 | 390-AlaProAlaAlaValArgTyrProArg-398 |
| SEQ. ID. NO. 14484 | 407-SerAspGlyMetGluThrValGlu-414 |
| SEQ. ID. NO. 14485 | 419-IleIleArgArgGlu-423 |
| SEQ. ID. NO. 14486 | 432-PheGlySerMetValAla-437 |
| SEQ. ID. NO. 14487 | 453-MetArgPheValLysProIleAspGluGlu-462 |
| SEQ. ID. NO. 14488 | 469-ArgSerHisAspArgIle-474 |
| SEQ. ID. NO. 14489 | 489-AlaValLeuGluValLeu-494 |
| SEQ. ID. NO. 14490 | 510-AspThrValThrGlyHisGly-516 |
| SEQ. ID. NO. 14491 | 518-ProLysLysLeuLeu-522 |

Antigenic Index - Jameson-Wolf

| SEQ. ID. NO. 14492 | 11-AlaGlyPheProLysArgCysGluSerGluTyrAspAla-23 |
| --- | --- |
| SEQ. ID. NO. 14493 | 28-HisSerSerThrSerIle-33 |
| SEQ. ID. NO. 14494 | 41-AlaAlaAspLysGlnLeuGlySerAspArgArgSerVal-53 |
| SEQ. ID. NO. 14495 | 57-GlyAspGlyAlaMetThr-62 |
| SEQ. ID. NO. 14496 | 72-CysAlaGlyAspMetAspVal-78 |
| SEQ. ID. NO. 14497 | 85-AsnAspAsnGluMetSerIle-91 |
| SEQ. ID. NO. 14498 | 105-AsnValValArgAspMetHisGly-112 |
| SEQ. ID. NO. 14499 | 117-ValLysAlaGlnThrGlyLysValLeuAspLysIleProGly-130 |
| SEQ. ID. NO. 14500 | 134-PheAlaGlnLysValGluHisLysIleLysThrLeuAlaGluGluAlaGluHisAlaLysGln-154 |
| SEQ. ID. NO. 14501 | 166-TyrThrGlyProValAspGlyHisAsn-174 |
| SEQ. ID. NO. 14502 | 181-ValLeuGluAspLeuArgGlyArgLysGlyPro-191 |

TABLE 1-continued

| SEQ. ID. NO. 14503 | 197-IleThrLysLysGlyAsnGlyTyrLysLeuAlaGluAsnAspProValLys-213 |
| SEQ. ID. NO. 14504 | 220-LeuProLysGluSerAlaAla-226 |
| SEQ. ID. NO. 14505 | 228-MetProSerGluLysGluProLysProAlaAlaLysProThrTyr-242 |
| SEQ. ID. NO. 14506 | 253-ArgAlaAlaAlaAspSerArgLeu-260 |
| SEQ. ID. NO. 14507 | 266-AlaMetArgGluGlySerGlyLeuValGluPheGluGlnArgPheProAspArgTyrPhe-285 |
| SEQ. ID. NO. 14508 | 345-ValGlyAlaAspGlyProThrHis-352 |
| SEQ. ID. NO. 14509 | 370-AlaAlaProSerAspGluAsnGluCysArg-379 |
| SEQ. ID. NO. 14510 | 395-ArgTyrProArgGlyThrGlyThr-402 |
| SEQ. ID. NO. 14511 | 406-ValSerAspGlyMetGluThrValGluIleGlyLysGlyIleIleArgArgGluGlyGluLysThrAla-428 |
| SEQ. ID. NO. 14512 | 457-LysProIleAspGluGluLeuIle-464 |
| SEQ. ID. NO. 14513 | 467-LeuAlaArgSerHisAspArgIleValThrLeuGluGluAsnAlaGluGlnGlyGlyAlaGly-487 |
| SEQ. ID. NO. 14514 | 512-ValThrGlyHisGlyAspProLysLysLeuLeuAspAspLeuGlyLeu-527 |
| SEQ. ID. NO. 14515 | 530-GluAlaValGluArgArgValArg-537 |
| SEQ. ID. NO. 14516 | 540-LeuSerAspArgAspAlaAlaAsn-547 |
| Hydrophilic Regions - Hopp-Woods | |
| SEQ. ID. NO. 14517 | 13-PheProLysArgCysGluSerGluTyrAsp-22 |
| SEQ. ID. NO. 14518 | 41-AlaAlaAspLysGlnLeuGlySerAspArgArgSerVal-53 |
| SEQ. ID. NO. 14519 | 74-GlyAspMetAspVal-78 |
| SEQ. ID. NO. 14520 | 85-AsnAspAsnGluMetSerIle-91 |
| SEQ. ID. NO. 14521 | 106-ValValArgAspMetHis-111 |
| SEQ. ID. NO. 14522 | 123-LysValLeuAspLysIleProGly-130 |
| SEQ. ID. NO. 14523 | 134-PheAlaGlnLysValGluHisLysIleLysThrLeuAlaGluGluAlaGluHisAlaLysGln-154 |
| SEQ. ID. NO. 14524 | 181-ValLeuGluAspLeuArgGlyArgLysGlyPro-191 |
| SEQ. ID. NO. 14525 | 197-IleThrLysLysGlyAsnGly-203 |
| SEQ. ID. NO. 14526 | 205-LysLeuAlaGluAsnAspProValLys-213 |
| SEQ. ID. NO. 14527 | 220-LeuProLysGluSerAlaAla-226 |
| SEQ. ID. NO. 14528 | 228-MetProSerGluLysGluProLysProAlaAla-238 |
| SEQ. ID. NO. 14529 | 253-ArgAlaAlaAlaAspSerArgLeu-260 |
| SEQ. ID. NO. 14530 | 266-AlaMetArgGluGlySerGly-272 |
| SEQ. ID. NO. 14531 | 274-ValGluPheGluGlnArgPheProAspArgTyrPhe-285 |
| SEQ. ID. NO. 14532 | 372-ProSerAspGluAsnGluCys-378 |
| SEQ. ID. NO. 14533 | 408-AspGlyMetGluThrValGluIleGlyLysGlyIleIleArgArgGluGlyGluLysThrAla-428 |
| SEQ. ID. NO. 14534 | 457-LysProIleAspGluGluLeuIle-464 |
| SEQ. ID. NO. 14535 | 467-LeuAlaArgSerHisAspArgIleValThrLeuGluGluAsnAlaGluGlnGlyGly-485 |
| SEQ. ID. NO. 14536 | 513-ThrGlyHisGlyAspProLysLysLeuLeuAsp-523 |
| SEQ. ID. NO. 14537 | 530-GluAlaValGluArgArgValArg-537 |
| SEQ. ID. NO. 14538 | 540-LeuSerAspArgAspAlaAlaAsn-547 |
| a034 | |
| AMPHI Regions - AMPHI | |
| SEQ. ID. NO. 14539 | 35-LeuAspHisAlaAla-39 |
| SEQ. ID. NO. 14540 | 52-AsnLeuGluGlnMetArgAlaIleMetGluAlaAlaAspGln-65 |
| SEQ. ID. NO. 14541 | 94-AlaValGluGluPheProHisIlePro-102 |
| SEQ. ID. NO. 14542 | 152-ThrValValAsnPheSer-157 |
| SEQ. ID. NO. 14543 | 168-IleGlyValLeuGlyAsnLeuGluThrGly-177 |
| SEQ. ID. NO. 14544 | 186-GlyAlaValGlyLysLeuSer-192 |
| SEQ. ID. NO. 14545 | 197-LeuThrSerValGluAspAlaValArgPheValLysAspThrGly-211 |
| SEQ. ID. NO. 14546 | 226-TyrLysPheThrArgProProThrGly-234 |
| SEQ. ID. NO. 14547 | 236-ValLeuArgIleAspArgIleLysGluIleHisGlnAlaLeu-249 |
| SEQ. ID. NO. 14548 | 261-SerValProGlnGluTrpLeuLysValIleAsnGluTyrGlyGlyAsn IleGlyGluThrTyrGlyValProValGluGluIleValGluGlyIleLysHisGly-295 |
| SEQ. ID. NO. 14549 | 314-ArgArgTyrLeuAlaGluAsn-320 |
| SEQ. ID. NO. 14550 | 330-LeuSerLysThrIleGluAlaMetLys-338 |
| SEQ. ID. NO. 14551 | 360-ValSerLeuGluLysMetAlaAsnArgTyrAlaLysGlyGluLeuAsnGlnIleVal-378 |
| Antigenic Index - Jameson-Wolf | |
| SEQ. ID. NO. 14552 | 20-LeuProLysGluThrGln-25 |
| SEQ. ID. NO. 14553 | 37-HisAlaAlaGluAsnSerTyrGly-44 |
| SEQ. ID. NO. 14554 | 54-GluGlnMetArgAlaIleMetGluAlaAlaAspGlnVal-66 |
| SEQ. ID. NO. 14555 | 75-SerAlaGlyAlaArgLysTyrAla-82 |
| SEQ. ID. NO. 14556 | 106-HisGlnAspHisGlyAlaSerProAspValCysGlnArgSerIle-120 |
| SEQ. ID. NO. 14557 | 129-MetAspGlySerLeuMetGluAspGlyLysThrProSerSerTyrGluTyr-145 |
| SEQ. ID. NO. 14558 | 164-ValGluGlyGluIle-168 |
| SEQ. ID. NO. 14559 | 173AsnLeuGluThrGlyGluAlaGlyGluGluAspGlyVal-185 |
| SEQ. ID. NO. 14560 | 191-LeuSerHisAspGln-195 |
| SEQ. ID. NO. 14561 | 199-SerValGluAspAlaValArgPheValLysAspThrGlyValAsp-213 |
| SEQ. ID. NO. 14562 | 221-ThrSerHisGlyAla-225 |
| SEQ. ID. NO. 14563 | 227-LysPheThrArgProProThrGlyAspValLeuArgIleAspArgIleLysGluIleHis-246 |
| SEQ. ID. NO. 14564 | 258-GlySerSerSerValPro-263 |
| SEQ. ID. NO. 14565 | 271-AsnGluTyrGlyGlyAsnIleGlyGlu-279 |
| SEQ. ID. NO. 14566 | 287-GluIleValGluGlyIleLysHisGlyValArgLysValAsnIleAspThrAspLeuArgLeuAlaSerThrGlyAlaVal-313 |
| SEQ. ID. NO. 14567 | 316-TyrLeuAlaGluAsnProSerAspPheAspProArgLysTyrLeuSerLysThrIleGluAlaMetLys-338 |
| SEQ. ID. NO. 14568 | 350-CysGluGlyGlnAlaGlyLysIleLysProValSerLeuGluLysMetAlaAsnArgTyrAlaLysGlyGluLeu-374 |
| Hydrophilic Regions - Hopp-Woods | |
| SEQ. ID. NO. 14569 | 54-GluGlnMetArgAlaIleMetGluAlaAlaAspGlnVal-66 |
| SEQ. ID. NO. 14570 | 76-AlaGlyAlaArgLysTyrAla-82 |
| SEQ. ID. NO. 14571 | 108-AspHisGlyAlaSerProAspValCysGln-117 |
| SEQ. ID. NO. 14572 | 132-SerLeuMetGluAspGlyLysThrProSer-141 |
| SEQ. ID. NO. 14573 | 164-ValGluGlyGluIle-168 |
| SEQ. ID. NO. 14574 | 175-GluThrGlyGluAlaGlyGluGluAspGlyVal-185 |
| SEQ. ID. NO. 14575 | 199-SerValGluAspAlaValArgPheValLysAspThrGlyVal-212 |
| SEQ. ID. NO. 14576 | 235-AspValLeuArgIleAspArgIleLysGluIleHis-246 |

TABLE 1-continued

| | |
|---|---|
| SEQ. ID. NO. 14577 | 287-GluIleValGluGlyIleLysHisGlyValArgLysValAsnIleAspThrAspLeuArgLeu-307 |
| SEQ. ID. NO. 14578 | 320-AsnProSerAspPheAspProArgLysTyrLeuSerLysThrIleGluAlaMetLys-338 |
| SEQ. ID. NO. 14579 | 352-GlyGlnAlaGlyLysIleLysProValSerLeuGluLysMetAlaAsnArgTyrAlaLysGlyGluLeu-374 | a036
AMPHI Regions - AMPHI

| | |
|---|---|
| SEQ. ID. NO. 14580 | 6-AlaValTyrSerAlaCysAlaAla-13 |
| SEQ. ID. NO. 14581 | 29-GlyArgCysValAsnGlnTyr-35 |
| SEQ. ID. NO. 14582 | 59-SerSerGlyArgPheCysGlnThrIleLys-68 |
| SEQ. ID. NO. 14583 | 106-AlaAlaSerAlaAlaGlnSer-112 |
| SEQ. ID. NO. 14584 | 213-SerAlaCysArgThrMetHisLysThrLeuArgProTyrVal-226 |
| SEQ. ID. NO. 14585 | 250-ArgLeuLysGluTyr-254 |

Antigenic Index - Jameson-Wolf

| | |
|---|---|
| SEQ. ID. NO. 14586 | 16-ProAlaArgThrSerSerSerArgArgCysValSerSerGlyArgCysValAsnGlnTyrSerSerArgAlaAspAla-41 |
| SEQ. ID. NO. 14587 | 43-ProTrpArgArgHisSerGlyAla-50 |
| SEQ. ID. NO. 14588 | 55-CysSerSerAspSerSerGlyArgPhe-63 |
| SEQ. ID. NO. 14589 | 73-ProSerPheSerAlaArgLysThrCysSerAspGlyGluThrSerAlaAspSerAsnTrpArg-93 |
| SEQ. ID. NO. 14590 | 96-HisAlaAspGlyLeuGlnThrAlaSerSer-105 |
| SEQ. ID. NO. 14591 | 112-SerAlaXxxThrAlaArgArgMetPheThr-121 |
| SEQ. ID. NO. 14592 | 132-GlnSerArgArgPheCysCysGlyArgArgAlaAlaArgArgValProGlnArgArgArgGluAsnArgLeuGlnProProAspXxxGly<br>SerArgArgArgSerAlaTyrArgValCysLeuArgArgAlaAspGlyPheProAlaArgThrHisCysArgCysArgLeuLysArgArgIleLeu-193 |
| SEQ. ID. NO. 14593 | 199-LeuProProAspArgProAspAsnArgSerAsnGlyGlyGlySerAlaCysArgThrMetHisLysThrLeuArgProTyrValArgProGlnArgGln<br>GlyCys-233 |
| SEQ. ID. NO. 14594 | 239-AlaAlaArgArgArgHisArgAlaArgValArgArgLeuLysGluTyrGlnThr-256 |
| SEQ. ID. NO. 14595 | 260-AsnLeuAlaProArgArgCysArgTyrAla-269 |

Hydrophilic Regions - Hopp-Woods

| | |
|---|---|
| SEQ. ID. NO. 14596 | 18-ArgThrSerSerSerArgArgCysValSerSer-28 |
| SEQ. ID. NO. 14597 | 35-TyrSerSerArgAlaAsp-40 |
| SEQ. ID. NO. 14598 | 45-ArgArgHisSerGly-49 |
| SEQ. ID. NO. 14599 | 55-CysSerSerAspSerSerGlyArg-62 |
| SEQ. ID. NO. 14600 | 75-PheSerAlaArgLysThrCysSerAspGlyGluThrSerAla-88 |
| SEQ. ID. NO. 14601 | 114-XxxThrAlaArgArgMetPhe-120 |
| SEQ. ID. NO. 14602 | 135-ArgPheCysCysGlyArgArgAlaAlaArgValProGlnArgArg<br>ArgGluAsnArgLeuGlnProProAspXxxGlySerArgArgArgSerAlaTyr-168 |
| SEQ. ID. NO. 14603 | 171-CysLeuArgArgAlaAspGlyPhePro-179 |
| SEQ. ID. NO. 14604 | 182-ThrHisCysArgCysArgLeuLysArgArgIleLeu-193 |
| SEQ. ID. NO. 14605 | 200-ProProAspArgProAspAsnArgSerAsnGlyGly-211 |
| SEQ. ID. NO. 14606 | 217-ThrMetHisLysThrLeuArgProTyrValArgProGlnArgGlnGly-232 |
| SEQ. ID. NO. 14607 | 239-AlaAlaArgArgArgHisArgAlaArgValArgArgLeuLysGluTyrGln-255 |
| SEQ. ID. NO. 14608 | 262-AlaProArgArgCysArgTyr-268 | a038
AMPHI Regions - AMPHI

| | |
|---|---|
| SEQ. ID. NO. 14609 | 100-GluAlaLysAspHis-104 |
| SEQ. ID. NO. 14610 | 157-GluLysGlyThrGlyGluLeuSerAlaValGlnGluValGluLys-171 |
| SEQ. ID. NO. 14611 | 178-AlaProIleAlaSerLeuAsn-184 |
| SEQ. ID. NO. 14612 | 195-GluPheGlyGlnPheLeuGluProValArgAlaTyrArgArgGlnTyrGlyVal-212 |

Antigenic Index - Jameson-Wolf

| | |
|---|---|
| SEQ. ID. NO. 14613 | 2-ThrAspPheArgGlnAspPhe-8 |
| SEQ. ID. NO. 14614 | 22-GluPheThrThrLysAlaGlyArgArgSerPro-32 |
| SEQ. ID. NO. 14615 | 38-GlyLeuPheAsnAspGlyLeu-44 |
| SEQ. ID. NO. 14616 | 58-IleGluSerGlyIleArg-63 |
| SEQ. ID. NO. 14617 | 85-LeuAlaGluLysGlyVal-90 |
| SEQ. ID. NO. 14618 | 96-TyrAsnArgLysGluAlaLysAspHisGlyGluGlyGly-108 |
| SEQ. ID. NO. 14619 | 125-ValIleSerAlaGlyThrSerValArgGluSerIleLysLeuIleGluAlaGluGlyAlaThr-145 |
| SEQ. ID. NO. 14620 | 153-LeuAspArgMetGluLysGlyThrGlyGlu-162 |
| SEQ. ID. NO. 14621 | 167-GlnGluValGluLysGlnTyrGlyLeu-175 |
| SEQ. ID. NO. 14622 | 191-GlnAsnAsnProGluPheGlyGln-198 |
| SEQ. ID. NO. 14623 | 203-ValArgAlaTyrArgArgGlnTyrGlyValGlu-213 |

Hydrophilic Regions - Hopp-Woods

| | |
|---|---|
| SEQ. ID. NO. 14624 | 2-ThrAspPheArgGlnAs/pPhe-8 |
| SEQ. ID. NO. 14625 | 22-GluPheThrThrLysAlaGlyArgArgSer-31 |
| SEQ. ID. NO. 14626 | 85-LeuAlaGluLysGlyVal-90 |
| SEQ. ID. NO. 14627 | 96-TyrAsnArgLysGluAlaLysAspHisGlyGlu-106 |
| SEQ. ID. NO. 14628 | 130-ThrSerValArgGluSerIleLysLeuIleGluAlaGluGlyAlaThr-145 |
| SEQ. ID. NO. 14629 | 153-LeuAspArgMetGluLysGlyThrGlyGlu-162 |
| SEQ. ID. NO. 14630 | 167-GlnGluValGluLysGlnTyr-173 |
| SEQ. ID. NO. 14631 | 204-ArgAlaTyrArgArgGlnTyrGly-211 | a040
AMPHI Regions - AMPHI

| | |
|---|---|
| SEQ. ID. NO. 14632 | 14-AlaAlaProTyrIle-18 |
| SEQ. ID. NO. 14633 | 28-AlaGlyIleAspAsp-32 |
| SEQ. ID. NO. 14634 | 38-AspThrLeuAsnLysPhe-43 |
| SEQ. ID. NO. 14635 | 78-ProHisTyrCysArgGlyLeuArgValThrAspGlu-89 |
| SEQ. ID. NO. 14636 | 92-LeuGluGlnAlaGlnGlnPheAlaGly-100 |
| SEQ. ID. NO. 14637 | 113-SerValSerGlyPheAlaArgAlaPro-121 |
| SEQ. ID. NO. 14638 | 134-ArgProIleGlyValIleAspGly-141 |
| SEQ. ID. NO. 14639 | 146-TyrAlaGlyValIleArg-151 |
| SEQ. ID. NO. 14640 | 207-LeuSerAspGlyIleSerArgProAsp-215 |
| SEQ. ID. NO. 14641 | 226-GluAlaGlnSerLeuAlaGluHisAla-234 |
| SEQ. ID. NO. 14642 | 244-SerAlaValAlaAlaLeuGluGly-251 |
| SEQ. ID. NO. 14643 | 277-IleGlyThrSerIle-281 |

TABLE 1-continued

| | |
|---|---|
| SEQ. ID. NO. 14644 | 289-IleArgGlnAlaHisSerGlyAspIleProHisIleAlaAlaLeuIleArgProLeuGlu-308 |
| SEQ. ID. NO. 14645 | 320-TyrLeuGluAsnHisIleSerGluPheSerIle-330 |
| SEQ. ID. NO. 14646 | 338-TyrGlyCysAlaAlaAlaLeuLysThrPheAlaGluAlaAsp-350 |
| SEQ. ID. NO. 14647 | 371-ArgLeuLeuAlaHisIle-376 |
| SEQ. ID. NO. 14648 | 386-SerArgLeuPheAla-390 |

Antigenic Index - Jameson-Wolf

| | |
|---|---|
| SEQ. ID. NO. 14649 | 11-PheArgGluAlaAlaProTyrIleArgGlnMetArgGlyLysThrLeu-26 |
| SEQ. ID. NO. 14650 | 29-GlyIleAspAspArgLeuLeuGluGlyAspThrLeuAsn-41 |
| SEQ. ID. NO. 14651 | 65-HisPheLeuAspArgHisAlaAlaAlaGlnGlyArgThrProHisTyrCysArgGlyLeuArgValThrAspGluThrSerLeuGluGlnAlaGln-96 |
| SEQ. ID. NO. 14652 | 101-ThrValArgSerArgPheGlu-107 |
| SEQ. ID. NO. 14653 | 119-ArgAlaProSerVal-123 |
| SEQ. ID. NO. 14654 | 140-AspGlyThrAspMetGluTyr-146 |
| SEQ. ID. NO. 14655 | 150-IleArgLysThrAspThrAlaAla-157 |
| SEQ. ID. NO. 14656 | 173-LeuGlyHisSerTyrSerGlyLysThrPhe-182 |
| SEQ. ID. NO. 14657 | 208-SerAspGlyIleSerArgProAspGlyThrLeu-218 |
| SEQ. ID. NO. 14658 | 224-AlaGlnGluAlaGlnSerLeuAlaGluHisAlaGlyGlyGluThrArgArgLeuIle-242 |
| SEQ. ID. NO. 14659 | 249-LeuGluGlyGlyVal-253 |
| SEQ. ID. NO. 14660 | 261-GlyAlaAlaAspGlySerLeuLeu-268 |
| SEQ. ID. NO. 14661 | 272-PheThrArgAsnGlyIleGlyThrSerIleAlaLysGluAlaPheVal-287 |
| SEQ. ID. NO. 14662 | 289-IleArgGlnAlaHisSerGlyAspIle-297 |
| SEQ. ID. NO. 14663 | 305-ArgProLeuGluGluGlnGly-311 |
| SEQ. ID. NO. 14664 | 313-LeuLeuHisArgSerArgGluTyrLeu-321 |
| SEQ. ID. NO. 14665 | 331-LeuGluHisAspGlyAsnLeuTyr-338 |
| SEQ. ID. NO. 14666 | 345-ThrPheAlaGluAlaAspCysGlyGlu-353 |
| SEQ. ID. NO. 14667 | 361-ProGlnAlaGlnAspGlyGlyTyrGlyGluArgLeu-372 |
| SEQ. ID. NO. 14668 | 377-IleAspLysAlaArgGly-382 |
| SEQ. ID. NO. 14669 | 393-ThrAsnThrGlyGlu-397 |
| SEQ. ID. NO. 14670 | 402-ArgGlyPheGlnThrAlaSerGluAspGluLeuProGluThrArgArgLysAspTyrArgSerAsnGlyArgAsnSerHisIleLeu-430 |

Hydrophilic Regions - Hopp-Woods

| | |
|---|---|
| SEQ. ID. NO. 14671 | 11-PheArgGluAlaAlaPro-16 |
| SEQ. ID. NO. 14672 | 19-ArgGlnMetArgGlyLysThr-25 |
| SEQ. ID. NO. 14673 | 29-GlyIleAspAspArgLeuLeuGluGlyAspThrLeuAsn-41 |
| SEQ. ID. NO. 14674 | 65-HisPheLeuAspArgHisAlaAlaAlaGlnGlyArgThr-77 |
| SEQ. ID. NO. 14675 | 84-LeuArgValThrAspGluThrSerLeuGluGln-94 |
| SEQ. ID. NO. 14676 | 102-ValArgSerArgPheGlu-107 |
| SEQ. ID. NO. 14677 | 140-AspGlyThrAspMetGluTyr-146 |
| SEQ. ID. NO. 14678 | 150-IleArgLysThrAspThrAlaAla-157 |
| SEQ. ID. NO. 14679 | 210-GlyIleSerArgProAspGly-216 |
| SEQ. ID. NO. 14680 | 224-AlaGlnGluAlaGlnSerLeuAlaGlu-232 |
| SEQ. ID. NO. 14681 | 234-AlaGlyGlyGluThrArgArgLeuIle-242 |
| SEQ. ID. NO. 14682 | 291-GlnAlaHisSerGlyAsp-296 |
| SEQ. ID. NO. 14683 | 305-ArgProLeuGluGluGlnGly-311 |
| SEQ. ID. NO. 14684 | 315-HisArgSerArgGluTyrLeu-321 |
| SEQ. ID. NO. 14685 | 345-ThrPheAlaGluAlaAspCysGlyGlu-353 |
| SEQ. ID. NO. 14686 | 362-GlnAlaGlnAspGlyGlyTyrGlyGlu-370 |
| SEQ. ID. NO. 14687 | 377-IleAspLysAlaArgGly-382 |
| SEQ. ID. NO. 14688 | 402-ArgGlyPheGlnThrAlaSerGluAspGluLeuProGluThrArgArg LysAspTyrArgSerAsnGlyArgAsn-426 | a041-1
AMPHI Regions - AMPHI

| | |
|---|---|
| SEQ. ID. NO. 14689 | 6-AspProTyrArgHisPheGluAsnLeuAspSerAlaGluThr-19 |
| SEQ. ID. NO. 14690 | 45-AspGlyIleLeuAla-49 |
| SEQ. ID. NO. 14691 | 78-LysGlyValTyrArgValCysThrAlaAla-87 |
| SEQ. ID. NO. 14692 | 102-ValAlaAspPheAspGluLeuLeu-109 |
| SEQ. ID. NO. 14693 | 117-GlyValSerHisLeuValGlnGlnProAsn-126 |
| SEQ. ID. NO. 14694 | 218-MetValAsnAlaTrpArgTyrLeuAsp-226 |
| SEQ. ID. NO. 14695 | 232-IleAspLeuIleGluAlaSer-238 |
| SEQ. ID. NO. 14696 | 258-LeuAsnLeuProAsnAspCysAspValValGlyTyrLeu-270 |
| SEQ. ID. NO. 14697 | 317-GlnAlaLeuGluSerValGluThr-324 |
| SEQ. ID. NO. 14698 | 331-AlaSerLeuLeuGluAsnValGlnGlyArg-340 |
| SEQ. ID. NO. 14699 | 354-ThrGluLeuProArgLeuProSer-361 |
| SEQ. ID. NO. 14700 | 382-AspPheThrThrProLeu-387 |
| SEQ. ID. NO. 14701 | 405-GlnProGlnGlnPhe-409 |
| SEQ. ID. NO. 14702 | 451-GlyPheGlyIleProGluLeuProHisTyrLeuGlySerIleGlyLys-466 |
| SEQ. ID. NO. 14703 | 493-AlaAlaGlnGlyIleSerLysHisLysSerValAspAspLeuLeuAlaValValSer-511 |
| SEQ. ID. NO. 14704 | 519-SerSerProGluHis-523 |
| SEQ. ID. NO. 14705 | 541-ValArgGluProGlnSer-546 |
| SEQ. ID. NO. 14706 | 556-LeuThrAspMetIleArgTyr-562 |
| SEQ. ID. NO. 14707 | 571-TrpThrAspGluTyrGlyAsnProGlnLysTyrGlu-582 |
| SEQ. ID. NO. 14708 | 591-LeuSerProTyrHisAsnLeuSerAspGlyIleAspTyrProPro-605 |
| SEQ. ID. NO. 14709 | 620-AlaHisAlaLeuLys-624 |
| SEQ. ID. NO. 14710 | 645-GlyHisThrGlyAsnGlyThrGlnArgGluAla-655 |

Antigenic Index - Jameson-Wolf

| | |
|---|---|
| SEQ. ID. NO. 14711 | 1-MetLysSerTyrProAspProTyrArgHisPheGluAsnLeuAspSerAlaGluThrGln-20 |
| SEQ. ID. NO. 14712 | 26-AlaAsnAlaGluThrArgAlaArgPheLeuAsnAsnAspLysAlaArgAlaLeuSerAspGly-46 |
| SEQ. ID. NO. 14713 | 51-LeuGlnAspThrArgGlnIleProPhe-59 |
| SEQ. ID. NO. 14714 | 61-GlnGluHisArgAlaArg-66 |
| SEQ. ID. NO. 14715 | 72-GlnAspAlaGluTyrProLysGlyVal-80 |
| SEQ. ID. NO. 14716 | 89-TyrArgSerGlyTyrProGluTrp-96 |
| SEQ. ID. NO. 14717 | 104-AspPheAspGluLeuLeuGlyAspAspValTyr-114 |
| SEQ. ID. NO. 14718 | 123-GluGlnProAsnArg-127 |

TABLE 1-continued

| | |
|---|---|
| SEQ. ID. NO. 14719 | 132-LeuSerLysSerGlyGlyAspThr-139 |
| SEQ. ID. NO. 14720 | 145-ValAspLeuGluAlaGlyGluLeuValGlu-154 |
| SEQ. ID. NO. 14721 | 161-AlaGlyLysAsnHisValSerTrpArgAspGluAsnSerVal-174 |
| SEQ. ID. NO. 14722 | 178-ProAlaTrpAspGluArgGlnLeuThrGlySerGlyTyrProArgGluValTrpLeuValGluArgGlyLysSerPheGluGluSerLeu-207 |
| SEQ. ID. NO. 14723 | 212-IleAlaGluAspGlyMet-217 |
| SEQ. ID. NO. 14724 | 223-ArgTyrLeuAspProGlnGlySerProIleAspLeuIleGluAlaSerAspGlyPheTyr-242 |
| SEQ. ID. NO. 14725 | 250-SerAlaGluGlyGluAlaLysProLeuAsnLeuProAsnAspCysAspVal-266 |
| SEQ. ID. NO. 14726 | 278-LeuArgLysAspTrpHisArgAlaAsnGlnSerTyrProSer-291 |
| SEQ. ID. NO. 14727 | 298-LysLeuAsnArgGlyGluLeuGly-305 |
| SEQ. ID. NO. 14728 | 312-AlaProAsnGluThrGlnAla-318 |
| SEQ. ID. NO. 14729 | 320-GluSerValGluThrThrLys-326 |
| SEQ. ID. NO. 14730 | 337-ValGlnGlyArgLeuLysAla-343 |
| SEQ. ID. NO. 14731 | 345-ArgPheThrAspGlyLysTrpGlnGluThrGluLeuProArgLeuProSerGly-362 |
| SEQ. ID. NO. 14732 | 365-GluMetThrAspGlnProTrpGlyGly-373 |
| SEQ. ID. NO. 14733 | 401-ValMetArgArgGlnProGlnGlnPheAspSerAspGlyIleAsn-415 |
| SEQ. ID. NO. 14734 | 422-ThrSerAlaAspGlyGluArgIle-429 |
| SEQ. ID. NO. 14735 | 435-GlyLysAsnAlaAlaProAspMet-442 |
| SEQ. ID. NO. 14736 | 479-AsnIleArgGlyGlyGlyGluPheGlyProArgTrpHis-491 |
| SEQ. ID. NO. 14737 | 496-GlyIleSerLysHisLysSerValAspAsp-505 |
| SEQ. ID. NO. 14738 | 512-AspLeuSerGluArgGlyIleSerSerProGluHis-523 |
| SEQ. ID. NO. 14739 | 528-GlyGlySerAsnGly-532 |
| SEQ. ID. NO. 14740 | 540-PheValArgGluProGlnSerIleGlyAla-549 |
| SEQ. ID. NO. 14741 | 568-GlySerSerTrpThrAspGluTyrGlyAsnProGlnLysTyrGluValCysLysArgArgLeuGlyGluLeuSerProTyr-594 |
| SEQ. ID. NO. 14742 | 596-AsnLeuSerAspGlyIleAspTyrPro-604 |
| SEQ. ID. NO. 14743 | 610-ThrSerLeuSerAspAspArgValHis-618 |
| SEQ. ID. NO. 14744 | 627-AlaLysLeuArgGluThrSerProGlnSer-636 |
| SEQ. ID. NO. 14745 | 639-TyrSerProAspGlyGlyGlyHisThrGlyAsnGlyThrGlnArgGluAlaAlaAspGluLeu-659 |
| Hydrophilic Regions - Hopp-Woods | |
| SEQ. ID. NO. 14746 | 3-SerTyrProAspProTyrArgHis-10 |
| SEQ. ID. NO. 14747 | 12-GluAsnLeuAspSerAlaGluThr-19 |
| SEQ. ID. NO. 14748 | 26-AlaAsnAlaGluThrArgAlaArgPheLeuAsnAsnAspLysAlaArgAlaLeuSer-44 |
| SEQ. ID. NO. 14749 | 52-GlnAspThrArgGln-56 |
| SEQ. ID. NO. 14750 | 61-GlnGluHisArgAlaArg-66 |
| SEQ. ID. NO. 14751 | 72-GlnAspAlaGluTyrPro-77 |
| SEQ. ID. NO. 14752 | 104-AspPheAspGluLeuLeuGly-110 |
| SEQ. ID. NO. 14753 | 134-LysSerGlyGlyAsp-138 |
| SEQ. ID. NO. 14754 | 145-ValAspLeuGluAlaGlyGluLeuValGlu-154 |
| SEQ. ID. NO. 14755 | 166-ValSerTrpArgAspGluAsnSer-173 |
| SEQ. ID. NO. 14756 | 180-TrpAspGluArgGlnLeuThr-186 |
| SEQ. ID. NO. 14757 | 198-GluArgGlyLysSerPheGluGluSerLeu-207 |
| SEQ. ID. NO. 14758 | 212-IleAlaGluAspGlyMet-217 |
| SEQ. ID. NO. 14759 | 233-AspLeuIleGluAlaSerAsp-239 |
| SEQ. ID. NO. 14760 | 251-AlaGluGlyGluAlaLysPro-257 |
| SEQ. ID. NO. 14761 | 278-LeuArgLysAspTrpHisArg-284 |
| SEQ. ID. NO. 14762 | 298-LysLeuAsnArgGlyGluLeuGly-305 |
| SEQ. ID. NO. 14763 | 320-GluSerValGluThrThrLys-326 |
| SEQ. ID. NO. 14764 | 337-ValGlnGlyArgLeuLysAla-343 |
| SEQ. ID. NO. 14765 | 350-LysTrpGlnGluThrGluLeuProArg-358 |
| SEQ. ID. NO. 14766 | 401-ValMetArgArgGlnProGlnGlnPheAspSerAspGlyIleAsn-415 |
| SEQ. ID. NO. 14767 | 424-AlaAspGlyGluArg-428 |
| SEQ. ID. NO. 14768 | 436-LysAsnAlaAlaProAsp-441 |
| SEQ. ID. NO. 14769 | 481-ArgGlyGlyGlyGluPheGly-487 |
| SEQ. ID. NO. 14770 | 496-GlyIleSerLysHisLysSerValAspAsp-505 |
| SEQ. ID. NO. 14771 | 512-AspLeuSerGluArgGlyIleSerSer-520 |
| SEQ. ID. NO. 14772 | 540-PheValArgGluProGlnSer-546 |
| SEQ. ID. NO. 14773 | 571-TrpThrAspGluTyrGlyAsn-577 |
| SEQ. ID. NO. 14774 | 579-GlnLysTyrGluValCysLysArgArgLeuGlyGlu-590 |
| SEQ. ID. NO. 14775 | 612-LeuSerAspAspArgValHis-618 |
| SEQ. ID. NO. 14776 | 627-AlaLysLeuArgGluThrSer-633 |
| SEQ. ID. NO. 14777 | 650-GlyThrGlnArgGluAlaAlaAspGluLeu-659 |
| a042-1 | |
| AMPHI Regions - AMPHI | |
| SEQ. ID. NO. 14778 | 17-AlaLeuSerAsnThrSerThr-23 |
| SEQ. ID. NO. 14779 | 33-AlaValArgSerMetMetLysIle-40 |
| SEQ. ID. NO. 14780 | 138-SerProLeuValArgIleLeuProLeuSer-147 |
| SEQ. ID. NO. 14781 | 151-SerMetValValAlaPhePheAlaAsn-159 |
| Antigenic Index - Jameson-Wolf | |
| SEQ. ID. NO. 14782 | 14-ArgThrSerAlaLeuSerAsnThrSerThrAlaAlaGlyProSerCys-29 |
| SEQ. ID. NO. 14783 | 49-TyrSerLysGluThrGlyCysProCysProSerLeuArgLysAspSerSerThrGlyGlyArgProMetSerProCys-74 |
| SEQ. ID. NO. 14784 | 77-LeuAlaAsnArgAspCysValProLysAlaAspThr-88 |
| SEQ. ID. NO. 14785 | 93-ThrAspSerThrSerProArgProLeu-101 |
| SEQ. ID. NO. 14786 | 122-AlaArgAlaSerLeuProLysIleArgAlaLysVal-133 |
| SEQ. ID. NO. 14787 | 160-CysSerTyrAlaSerAlaProGlyPro-168 |
| Hydrophilic Regions - Hopp-Woods | |
| SEQ. ID. NO. 14788 | 49-TyrSerLysGluThrGlyCys-55 |
| SEQ. ID. NO. 14789 | 59-SerLeuArgLysAspSerSerThrGlyGlyArgProMet-71 |
| SEQ. ID. NO. 14790 | 78-AlaAsnArgAspCysValProLysAlaAspThr-88 |

TABLE 1-continued

| | |
|---|---|
| SEQ. ID. NO. 14791 | 94-AspSerThrSerProArg-99 |
| SEQ. ID. NO. 14792 | 125-SerLeuProLysIleArgAlaLysVal-133 | a043-2
AMPHI Regions - AMPHI

| | |
|---|---|
| SEQ. ID. NO. 14793 | 24-ValGluProSerArg-28 |
| SEQ. ID. NO. 14794 | 36-HisGlyGlyLeuAspGlyAlaAlaGlyPheAspGluGlyGluArg-50 |
| SEQ. ID. NO. 14795 | 59-AlaSerGlyAspGlyPhe-64 |
| SEQ. ID. NO. 14796 | 83-AlaGlyAspPheGlyAspGlyGlnArg-91 |

Antigenic Index - Jameson-Wolf

| | |
|---|---|
| SEQ. ID. NO. 14797 | 1-MetProProAlaPro-5 |
| SEQ. ID. NO. 14798 | 11-IleArgArgGlnLysSerValMetProSerGluArgPheValGluProSerArg-28 |
| SEQ. ID. NO. 14799 | 35-ValHisGlyGlyLeuAspGlyAlaAlaGlyPheAspGluGlyGluArgValPhe-52 |
| SEQ. ID. NO. 14800 | 56-AlaAlaGlnAlaSerGlyAspGlyPheAla-65 |
| SEQ. ID. NO. 14801 | 79-GlnSerAspAlaAlaGlyAspPheGlyAspGlyGlnArgThrGlyGlu-94 |
| SEQ. ID. NO. 14802 | 96-ValLeuGlnAspValGlyGly-102 |
| SEQ. ID. NO. 14803 | 116-AlaGluGlyGluAlaGln-121 |

Hydrophilic Regions - Hopp-Woods

| | |
|---|---|
| SEQ. ID. NO. 14804 | 11-IleArgArgGlnLysSerValMetProSerGluArgPheValGluProSerArg-28 |
| SEQ. ID. NO. 14805 | 43-AlaGlyPheAspGluGlyGluArgValPhe-52 |
| SEQ. ID. NO. 14806 | 81-AspAlaAlaGlyAspPheGlyAspGlyGlnArgThrGly-93 |
| SEQ. ID. NO. 14807 | 116-AlaGluGlyGluAlaGln-121 | a046
AMPHI Regions - AMPHI

| | |
|---|---|
| SEQ. ID. NO. 14808 | 6-ArgProThrSerSerPro-11 |
| SEQ. ID. NO. 14809 | 46-ThrSerCysSerGlyLeuMetValSer-54 |
| SEQ. ID. NO. 14810 | 64-PheSerLeuPheSerSer-69 |
| SEQ. ID. NO. 14811 | 113-LysSerAlaSerSer-117 |
| SEQ. ID. NO. 14812 | 143-SerCysAsnAlaPheSerSer-149 |
| SEQ. ID. NO. 14813 | 155-ThrSerLeuLeuGlyMetAlaAlaArgPheCysAlaThrVal-168 |

Antigenic Index - Jameson-Wolf

| | |
|---|---|
| SEQ. ID. NO. 14814 | 6-ArgProThrSerSerProProArgArgAlaCys-16 |
| SEQ. ID. NO. 14815 | 20-IleArgThrArgSerSerAlaLysArgLysThrCysAsnAlaProGlyGlnSerIleArgProAlaSerCysSer-44 |
| SEQ. ID. NO. 14816 | 57-ProAsnMetGluArgLeuPro-63 |
| SEQ. ID. NO. 14817 | 75-SerArgTyrSerLeuGluArgThrArgAlaMetArgProGlyMetLeuAsnArgSerAlaAla-95 |
| SEQ. ID. NO. 14818 | 105-SerLeuArgGluSerAlaSerSerLysSerAlaSerSerAlaProAlaArgSerAsnValLysGlyAspAlaProLeuProLysThrValTrpThrSerArgArgLeuProVal-142 |
| SEQ. ID. NO. 14819 | 169-GluProThrCysProLeuProLys-176 |

Hydrophilic Regions - Hopp-Woods

| | |
|---|---|
| SEQ. ID. NO. 14820 | 7-ProThrSerSerProProArgArgAlaCys-16 |
| SEQ. ID. NO. 14821 | 20-IleArgThrArgSerSerAlaLysArgLysThrCysAsn-32 |
| SEQ. ID. NO. 14822 | 36-GlnSerIleArgProAlaSer-42 |
| SEQ. ID. NO. 14823 | 58-AsnMetGluArgLeuPro-63 |
| SEQ. ID. NO. 14824 | 75-SerArgTyrSerLeuGluArgThrArgAlaMetArg-86 |
| SEQ. ID. NO. 14825 | 105-SerLeuArgGluSerAlaSerSerLysSerAlaSer-116 |
| SEQ. ID. NO. 14826 | 118-AlaProAlaArgSerAsnValLysGlyAspAlaProLeu-130 | a047
AMPHI Regions - AMPHI

| | |
|---|---|
| SEQ. ID. NO. 14827 | 17-IleAlaAspIleAlaGlnAspLeuProAspGlyAla-28 |
| SEQ. ID. NO. 14828 | 62-AlaGluAsnIleGlyAlaVal-68 |
| SEQ. ID. NO. 14829 | 93-ArgLeuAlaLysGlnLeuGlu-99 |
| SEQ. ID. NO. 14830 | 141-TyrIleAspGluIleAspValPhe-148 |
| SEQ. ID. NO. 14831 | 161-SerAlaLeuLeuAla-165 |
| SEQ. ID. NO. 14832 | 185-LeuLeuGluGlyAsn-189 |
| SEQ. ID. NO. 14833 | 202-IleGlySerIleLeuAla-207 |
| SEQ. ID. NO. 14834 | 247-SerGlyIleLysTrpProGluGlyCys-255 |
| SEQ. ID. NO. 14835 | 257-IleAlaAlaValValArgAlaGlyThrGly-266 |
| SEQ. ID. NO. 14836 | 293-IleLeuAsnGluLeuGluLysLeuIle-301 |

Antigenic Index - Jameson-Wolf

| | |
|---|---|
| SEQ. ID. NO. 14837 | 5-GlnAlaArgArgGlyGlyLeuLeu-12 |
| SEQ. ID. NO. 14838 | 20-IleAlaGlnAspLeuProAspGlyAlaAsp-29 |
| SEQ. ID. NO. 14839 | 36-TyrArgAsnAsnArgLeu-41 |
| SEQ. ID. NO. 14840 | 51-IleGluGlyGlyGlu-55 |
| SEQ. ID. NO. 14841 | 70-ProGluLeuArgProLysGluThrSerThrArgArgIleMet-83 |
| SEQ. ID. NO. 14842 | 86-GlyGlyGlyAsnIle-90 |
| SEQ. ID. NO. 14843 | 96-LysGlnLeuGluHis-100 |
| SEQ. ID. NO. 14844 | 106-IleIleGlyCysArgProArgArgAlaGluTrpIle-117 |
| SEQ. ID. NO. 14845 | 119-GluAsnLeuAspAsnThrLeu-125 |
| SEQ. ID. NO. 14846 | 130-SerAlaThrAspGluThrLeuLeuAspAsnGluTyrIleAspGluIleAsp-146 |
| SEQ. ID. NO. 14847 | 152-ThrAsnAspAspGluSerAsnIle-159 |
| SEQ. ID. NO. 14848 | 168-LeuGlyAlaLysArgVal-173 |
| SEQ. ID. NO. 14849 | 178-AsnArgSerSerTyr-182 |
| SEQ. ID. NO. 14850 | 186-LeuGluGlyAsnLysIle-191 |
| SEQ. ID. NO. 14851 | 208-HisIleArgArgGlyAspIleVal-215 |
| SEQ. ID. NO. 14852 | 219-ProIleArgArgGlyThrAlaGluAlaIleGlu-229 |
| SEQ. ID. NO. 14853 | 232-AlaHisGlyAspLysLysThrSer-239 |
| SEQ. ID. NO. 14854 | 242-IleGlyArgArgIleSerGlyIleLysTrpProGluGlyCysHis-256 |
| SEQ. ID. NO. 14855 | 262-ArgAlaGlyThrGlyGluThr-268 |
| SEQ. ID. NO. 14856 | 277-ValIleGlnAspGlyAspHis-283 |
| SEQ. ID. NO. 14857 | 288-ValSerArgArgArgIleLeuAsnGluLeuGluLys-299 |

TABLE 1-continued

Hydrophilic Regions - Hopp-Woods
SEQ. ID. NO. 14858    5-GlnAlaArgArgGlyGly-10
SEQ. ID. NO. 14859    20-IleAlaGlnAspLeuProAspGlyAlaAsp-29
SEQ. ID. NO. 14860    51-IleGluGlyAspGlu-55
SEQ. ID. NO. 14861    70-ProGluLeuArgProLysGluThrSerThrArgArgIleMet-83
SEQ. ID. NO. 14862    106-IleIleGluCysArgProArgArgAlaGluTrpIle-117
SEQ. ID. NO. 14863    130-SerAlaThrAspGluThrLeuLeu-137
SEQ. ID. NO. 14864    140-GluTyrIleAspGluIleAsp-146
SEQ. ID. NO. 14865    152-ThrAsnAspAspGluSerAsnIle-159
SEQ. ID. NO. 14866    168-LeuGlyAlaLysArgVal-173
SEQ. ID. NO. 14867    186-LeuGluGlyAsnLysIle-191
SEQ. ID. NO. 14868    209-IleArgArgGlyAspIle-214
SEQ. ID. NO. 14869    219-ProIleArgArgGlyThrAlaGluAlaIleGlu-229
SEQ. ID. NO. 14870    232-AlaHisGlyAspLysLysThrSer-239
SEQ. ID. NO. 14871    242-IleGlyArgArgIleSer-247
SEQ. ID. NO. 14872    277-ValIleGlnAspGlyAsp-282
SEQ. ID. NO. 14873    289-SerArgArgArgIleLeuAsnGluLeuGluLys-299
a049-2
AMPHI Regions - AMPHI
SEQ. ID. NO. 14874    15-GlnHisLeuLeuGlu-19
SEQ. ID. NO. 14875    33-ThrAspAspThrValAspGlyIleGlyGlnMet-43
SEQ. ID. NO. 14876    50-GlnProPheGlyGln-54
SEQ. ID. NO. 14877    61-GluHisPheAlaProValAspGlyPheArg-70
SEQ. ID. NO. 14878    79-HisGlnArgPhePhe-83
SEQ. ID. NO. 14879    103-IleGlyValPheProAlaPhe-109
SEQ. ID. NO. 14880    202-ArgGlyAlaGlyGlnArgArgValSerArgHisCys-213
SEQ. ID. NO. 14881    217-AlaArgLeuThrGlnValPheGlnThrPhePhe-227
Antigenic Index - Jameson-Wolf
SEQ. ID. NO. 14882    6-PheAspTyrArgThrArgLeu-12
SEQ. ID. NO. 14883    20-LeuIleGlyLysAsnArgHis-26
SEQ. ID. NO. 14884    29-LeuHisArgArgThrAspAspThrValAspGly-39
SEQ. ID. NO. 14885    49-AspGlnProPheGly-53
SEQ. ID. NO. 14886    64-AlaProValAspGlyPheArgValGlnAsnIleAspLeuAspGlyHisGlnArgPhePhe-83
SEQ. ID. NO. 14887    90-PheArgAsnProValCysArgArgThrArgPheCys-101
SEQ. ID. NO. 14888    122-GlyIleLysProAspSerProProArgPhe-131
SEQ. ID. NO. 14889    135-PheArgAsnArgHisLeuGlnGlySerLeuArgVal-146
SEQ. ID. NO. 14890    150-PheLeuLysAspAspHisArgValGly-158
SEQ. ID. NO. 14891    182-GlnHisThrGlySer-186
SEQ. ID. NO. 14892    193-ArgHisArgArgValArgSerGlyPheArgGlyAlaGlyGlnArgArgValSerArgHisCys-213
SEQ. ID. NO. 14893    246-ArgGlnThrAsnProArgProLysArgGlyLeu-256
Hydrophilic Regions - Hopp-Woods
SEQ. ID. NO. 14894    21-IleGlyLysAsnArgHis-26
SEQ. ID. NO. 14895    31-ArgArgThrAspAspThrValAsp-38
SEQ. ID. NO. 14896    72-GlnAsnIleAspLeuAspGlyHisGlnArgPhePhe-83
SEQ. ID. NO. 14897    93-ProValCysArgArgThrArgPheCys-101
SEQ. ID. NO. 14898    124-LysProAspSerProProArg-130
SEQ. ID. NO. 14899    150-PheLeuLysAspAspHisArgVal-157
SEQ. ID. NO. 14900    193-ArgHisArgArgValArgSerGlyPheArgGlyAlaGlyGlnArgArgValSerArg-211
SEQ. ID. NO. 14901    246-ArgGlnThrAsnProArgProLysArgGlyLeu-256
a050-1
AMPHI Regions - AMPHI
SEQ. ID. NO. 14902    10-IleGlnSerIleCysAspAlaPheGlnPheIleSerTyrTyr-23
SEQ. ID. NO. 14903    25-ProLysAspTyrIleAspAlaLeuTyrLysAlaTrpGlnLys-38
SEQ. ID. NO. 14904    94-ValAsnGluGlyVal-98
SEQ. ID. NO. 14905    163-AsnProSerAspAsnIleValAspTrpValLeuLys-174
SEQ. ID. NO. 14906    177-ProThrMetGlyAla-181
SEQ. ID. NO. 14907    235-LeuGluLeuPheGluLysValAsnAla-243
SEQ. ID. NO. 14908    250-GlyLeuGlyGlyLeuThrThr-256
SEQ. ID. NO. 14909    275-AlaMetIleProAsn-279
SEQ. ID. NO. 14910    302-ArgValGluAspTrpProAspLeuThr-310
SEQ. ID. NO. 14911    315-AsnGlyLysArgValAspValAsp-322
SEQ. ID. NO. 14912    353-LysArgLeuValAspMetLeuAspLys-361
SEQ. ID. NO. 14913    367-ValAspPheThrAsnArgLeu-373
SEQ. ID. NO. 14914    379-ProValAspProValGlyAspGlu-386
SEQ. ID. NO. 14915    396-AlaThrArgMetAspLysPheThrArgGlnMet-406
SEQ. ID. NO. 14916    410-ThrAspLeuLeuGlyMet-415
SEQ. ID. NO. 14917    452-LysSerSerLysValLeuAlaPhe-459
Antigenic Index - Jameson-Wolf
SEQ. ID. NO. 14918    4-IleLysGlnGluAspPheIle-10
SEQ. ID. NO. 14919    23-TyrHisProLysAspTyrIleAspAlaLeu-32
SEQ. ID. NO. 14920    36-TrpGlnLysGluGluAsnProAlaAlaLysAspAlaMet-48
SEQ. ID. NO. 14921    55-SerArgMetCysAlaGluAsnAsnArgProIleCysGlnAspThrGly-70
SEQ. ID. NO. 14922    88-MetSerValGluGluMetValAsnGluGlyValArgArgAlaTyrThrTrpGluGlyAsnThrLeuArgAlaSerVal-113
SEQ. ID. NO. 14923    116-AspProAlaGlyLysArgGlnAsnThrLysAspAsnThr-128
SEQ. ID. NO. 14924    137-ValProGlyAspLysValGluVal-144
SEQ. ID. NO. 14925    146-CysAlaAlaLysGlyGlyGlySerGluAsnLysSerLysLeu-159
SEQ. ID. NO. 14926    163-AsnProSerAspAsnIle-168
SEQ. ID. NO. 14927    192-GlyIleGlyGlyThrProGluLysAlaValLeuMetAlaLysGluSerLeu-208
SEQ. ID. NO. 14928    213-AspIleGlnGluLeuGlnGluLysAlaAlaSerGlyAlaGluLeuSerThr-229

TABLE 1-continued

| | |
|---|---|
| SEQ. ID. NO. 14929 | 284-ArgHisValGluPheGluLeuAspGlySerGlyProValGluLeuThrProProArgValGluAspTrpProAspLeuThrTyrSerProAsp AsnGlyLysArgValAspValAspLysLeuThrLysGluGluValAlaSer-331 |
| SEQ. ID. NO. 14930 | 345-LeuThrGlyArgAspAlaAlaHisLysArgLeuValAspMetLeuAspLysGlyGluGluLeuPro-366 |
| SEQ. ID. NO. 14931 | 379-ProValAspProValGlyAspGluIleValGlyProAlaGlyProThrThrAlaThrArgMetAspLysPheThrArgGlnMetLeuGluGln ThrAsp-411 |
| SEQ. ID. NO. 14932 | 417-GlyLysSerGluArgGlyAlaAlaThr-425 |
| SEQ. ID. NO. 14933 | 428-AlaIleAlaAspAsnLysAla-434 |
| SEQ. ID. NO. 14934 | 450-AlaIleLysSerSerLys-455 |
| SEQ. ID. NO. 14935 | 470-PheGluValLysAspMetPro-476 |
| SEQ. ID. NO. 14936 | 481-ValAspSerLysGlyGluSerIle-488 |
| SEQ. ID. NO. 14937 | 492-AlaProProGlnTrpGln-497 |
| Hydrophilic Regions - Hopp-Woods | |
| SEQ. ID. NO. 14938 | 4-IleLysGlnGluAspPheIle-10 |
| SEQ. ID. NO. 14939 | 36-TrpGlnLysGluGluAsnProAlaAlaLysAspAlaMet-48 |
| SEQ. ID. NO. 14940 | 57-MetCysAlaGluAsnAsnArgProIleCys-66 |
| SEQ. ID. NO. 14941 | 88-MetSerValGluGluMetValAsnGluGlyValArgArg-100 |
| SEQ. ID. NO. 14942 | 117-ProAlaGlyLysArgGlnAsnThrLysAspAsnThr-128 |
| SEQ. ID. NO. 14943 | 138-ProGlyAspLysValGluVal-144 |
| SEQ. ID. NO. 14944 | 148-AlaLysGlyGlyGlySerGluAsnLysSerLysLeu-159 |
| SEQ. ID. NO. 14945 | 195-GlyThrProGluLysAlaValLeuMetAlaLysGluSerLeu-208 |
| SEQ. ID. NO. 14946 | 213-AspIleGlnGluLeuGlnGluLysAlaAlaSer-223 |
| SEQ. ID. NO. 14947 | 225-AlaGluLeuSerThr-229 |
| SEQ. ID. NO. 14948 | 284-ArgHisValGluPheGluLeuAspGly-292 |
| SEQ. ID. NO. 14949 | 299-ThrProProArgValGluAspTrpPro-307 |
| SEQ. ID. NO. 14950 | 313-ProAspAsnGlyLysArgValAspValAspLysLeuThrLysGluGluValAlaSer-331 |
| SEQ. ID. NO. 14951 | 345-LeuThrGlyArgAspAlaAlaHisLysArgLeuValAspMetLeuAspLysGlyGluGluLeuPro-366 |
| SEQ. ID. NO. 14952 | 382-ProValGlyAspGluIleVal-388 |
| SEQ. ID. NO. 14953 | 397-ThrArgMetAspLysPheThrArgGlnMetLeuGluGlnThrAsp-411 |
| SEQ. ID. NO. 14954 | 417-GlyLysSerGluArgGlyAlaAlaThr-425 |
| SEQ. ID. NO. 14955 | 428-AlaIleAlaAspAsnLysAla-434 |
| SEQ. ID. NO. 14956 | 450-AlaIleLysSerSerLys-455 |
| SEQ. ID. NO. 14957 | 470-PheGluValLysAspMetPro-476 |
| SEQ. ID. NO. 14958 | 481-ValAspSerLysGlyGluSerIle-488 |
| a052 | |
| AMPHI Regions - AMPHI | |
| SEQ. ID. NO. 14959 | 40-AlaLysAlaSerLysSerAlaThrSerProLysGlyLeuAspGlyValSerLys-57 |
| SEQ. ID. NO. 14960 | 66-ThrAlaAlaPheHisSerPheIleSerValGlyAspThrLeuThrSerMetProAsnLeuValThrMetLeu-89 |
| Antigenic Index - Jameson-Wolf | |
| SEQ. ID. NO. 14961 | 4-ValAlaGluGluThrGluIle-10 |
| SEQ. ID. NO. 14962 | 14-CysPheLysGlyGluProThrGlyAspSerArgLeuLeuSerThrThrLysSerAlaPro-33 |
| SEQ. ID. NO. 14963 | 36-CysAlaAsnSerAlaLysAlaSerLysSerAlaThrSerProLysGlyLeuAspGlyValSerLysAsnSerSer-60 |
| SEQ. ID. NO. 14964 | 95-ValValProAsnArgLeuArgLeu-102 |
| SEQ. ID. NO. 14965 | 108-ProAlaCysLysLysValLysAsnAlaAla-117 |
| Hydrophilic Regions - Hopp-Woods | |
| SEQ. ID. NO. 14966 | 4-ValAlaGluGluThrGluIle-10 |
| SEQ. ID. NO. 14967 | 15-PheLysGlyGluProThrGlyAspSerArgLeu-25 |
| SEQ. ID. NO. 14968 | 29-ThrLysSerAlaPro-33 |
| SEQ. ID. NO. 14969 | 38-AsnSerAlaLysAlaSerLysSerAlaThrSerProLysGlyLeuAspGlyValSerLysAsnSer-59 |
| SEQ. ID. NO. 14970 | 98-AsnArgLeuArgLeu-102 |
| SEQ. ID. NO. 14971 | 109-AlaCysLysLysValLysAsnAlaAla-117 |
| a075 | |
| AMPHI Regions - AMPHI | |
| SEQ. ID. NO. 14972 | 19-LysThrProThrThrIleGlnProAlaSerIleProSer-31 |
| SEQ. ID. NO. 14973 | 65-AlaProTyrLeuArgGlnValLeu-72 |
| SEQ. ID. NO. 14974 | 80-PheLysLysCysLeuAla-85 |
| SEQ. ID. NO. 14975 | 116-AspPhePheGlnThrCysValAsnArgPhePheGluValValGluIleIleGlyIleGly-135 |
| Antigenic Index - Jameson-Wolf | |
| SEQ. ID. NO. 14976 | 10-ThrMetGluLysThrLysSerAlaAlaLysThrProThr-22 |
| SEQ. ID. NO. 14977 | 25-GlnProAlaSerIlePro-30 |
| SEQ. ID. NO. 14978 | 52-AlaLysAlaArgGly-56 |
| SEQ. ID. NO. 14979 | 91-PhePheArgArgProProAsnIleArgLysSerValPheGlnLysSerGluTyrAspLys-110 |
| Hydrophilic Regions - Hopp-Woods | |
| SEQ. ID. NO. 14980 | 10-ThrMetGluLysThrLysSerAlaAlaLysThr-20 |
| SEQ. ID. NO. 14981 | 52-AlaLysAlaArgGly-56 |
| SEQ. ID. NO. 14982 | 91-PhePheArgArgProProAsnIleArgLysSerValPheGlnLysSerGuTyrAspLys-110 |
| a080 | |
| AMPHI Regions - AMPHI | |
| SEQ. ID. NO. 14983 | 6-GluAlaMetGluArgLeuThrArg-13 |
| SEQ. ID. NO. 14984 | 95-PheProAspThrValGlu-100 |
| SEQ. ID. NO. 14985 | 108-ProValAlaArgTrpGlyAspHis-115 |
| SEQ. ID. NO. 14986 | 144-SerAlaGluMetLeuArgArgTyrAspGluPheSerThrValLeu-158 |
| SEQ. ID. NO. 14987 | 195-LysArgLeuArgLeuPheThrGluAlaTrpGlnHis-206 |
| Antigenic Index - Jameson-Wolf | |
| SEQ. ID. NO. 14988 | 1-MetTrpAspAsnAlaGluAlaMetGluArgLeuThr-12 |
| SEQ. ID. NO. 14989 | 33-AsnSerAsnHisLeuPro-38 |
| SEQ. ID. NO. 14990 | 42-ValSerLeuLysGly-46 |
| SEQ. ID. NO. 14991 | 50-TyrSerAspLysLysAlaLeu-56 |
| SEQ. ID. NO. 14992 | 67-AsnIleLeuArgThrAspIleAsnGlyAlaGlnGluAlaTyrArg-81 |
| SEQ. ID. NO. 14993 | 90-MetValArgArgArgPheProAspThrValGlu-100 |
| SEQ. ID. NO. 14994 | 103-LeuThrGluArgLysProValAlaArgTrpGly-113 |

TABLE 1-continued

| | |
|---|---|
| SEQ. ID. NO. 14995 | 116-AlaLeuValAspGlyGluGlyAsnValPhe-125 |
| SEQ. ID. NO. 14996 | 127-AlaArgLeuAspArgProGlyMetPro-135 |
| SEQ. ID. NO. 14997 | 138-ArgGlyAlaGluGlyThrSer-144 |
| SEQ. ID. NO. 14998 | 146-GluMetLeuArgArgTyrAspGlu-153 |
| SEQ. ID. NO. 14999 | 163-LeuGlyIleLysGlu-167 |
| SEQ. ID. NO. 15000 | 187-ArgLeuGlyArgGluAsnGluMetLysArgLeuArgLeu-199 |
| SEQ. ID. NO. 15001 | 207-LeuLeuArgLysAsnLysAsnArgLeuSer-216 |
| SEQ. ID. NO. 15002 | 220-MetArgTyrLysAspGlyPheSer-227 |
| SEQ. ID. NO. 15003 | 230-TyrAlaProAspGlyLeuProGluLysGluSerGluGlu-242 |
| Hydrophilic Regions - Hopp-Woods | |
| SEQ. ID. NO. 15004 | 3-AspAsnAlaGluAlaMetGluArgLeuThr-12 |
| SEQ. ID. NO. 15005 | 50-TyrSerAspLysLysAlaLeu-56 |
| SEQ. ID. NO. 15006 | 69-LeuArgThrAspIleAsnGlyAlaGlnGluAlaTyrArg-81 |
| SEQ. ID. NO. 15007 | 90-MetValArgArgArgPheProAspThrVal-99 |
| SEQ. ID. NO. 15008 | 103-LeuThrGluArgLysProValAlaArgTrpGly-113 |
| SEQ. ID. NO. 15009 | 116-AlaLeuValAspGlyGluGlyAsnValPhe-125 |
| SEQ. ID. NO. 15010 | 127-AlaArgLeuAspArgProGly-133 |
| SEQ. ID. NO. 15011 | 138-ArgGlyAlaGluGlyThrSer-144 |
| SEQ. ID. NO. 15012 | 146-GluMetLeuArgArgTyrAspGlu-153 |
| SEQ. ID. NO. 15013 | 163-LeuGlyIleLysGlu-167 |
| SEQ. ID. NO. 15014 | 187-ArgLeuGlyArgGluAsnGluMetLysArgLeuArgLeu-199 |
| SEQ. ID. NO. 15015 | 208-LeuArgLysAsnLysAsnArgLeuSer-216 |
| SEQ. ID. NO. 15016 | 220-MetArgTyrLysAspGlyPheSer-227 |
| SEQ. ID. NO. 15017 | 234-GlyLeuProGluLysGluSerGluGlu-242 |
| a081 | |
| AMPHI Regions - AMPHI | |
| SEQ. ID. NO. 15018 | 22-LysProValSerArgIleValThrAspSer-31 |
| SEQ. ID. NO. 15019 | 86-ThrAlaLeuGlnMetLeuAlaLysAlaTrpArgGluAsn-98 |
| SEQ. ID. NO. 15020 | 116-LysGluMetLeuAlaAlaValLeuArgArg-125 |
| SEQ. ID. NO. 15021 | 135-ThrAlaGlyAsnPhe-139 |
| SEQ. ID. NO. 15022 | 165-MetAsnHisPheGlyGluLeuAlaValLeuThrGlnIleAlaLys-179 |
| SEQ. ID. NO. 15023 | 185-ValAsnAsnAlaMetArg-190 |
| SEQ. ID. NO. 15024 | 198-AspGlyValGlyAspIleAlaLysAla-206 |
| SEQ. ID. NO. 15025 | 303-LeuAsnAspValAlaGluGlyLeuLysGlyPheSerAsnIle-316 |
| SEQ. ID. NO. 15026 | 345-AlaAlaValAspValLeuAlaArgMetPro-354 |
| SEQ. ID. NO. 15027 | 360-ValMetGlyAspMetGlyGluLeuGlyGlu-369 |
| SEQ. ID. NO. 15028 | 399-ValGluAlaAlaGlu-403 |
| Antigenic Index - Jameson-Wolf | |
| SEQ. ID. NO. 15029 | 16-ProMetProSerGluSerLysProValSer-25 |
| SEQ. ID. NO. 15030 | 27-IleValThrAspSerArgAspIleArgAlaGlyAsp-38 |
| SEQ. ID. NO. 15031 | 44-AlaGlyGlyArgPheAspAla-50 |
| SEQ. ID. NO. 15032 | 67-ValSerArgGluAspCysValAla-74 |
| SEQ. ID. NO. 15033 | 77-GlyAlaLeuLysValAspAspThrLeu-85 |
| SEQ. ID. NO. 15034 | 94-AlaTrpArgGluAsnValAsnProPhe-102 |
| SEQ. ID. NO. 15035 | 108-GlySerGlyGlyLysThrThrValLysGluMetLeu-119 |
| SEQ. ID. NO. 15036 | 123-LeuArgArgArgPheGlyAspAsnAlaVal-132 |
| SEQ. ID. NO. 15037 | 138-AsnPheAsnAsnHisIle-143 |
| SEQ. ID. NO. 15038 | 151-LysLeuAsnGluLysHisArg-157 |
| SEQ. ID. NO. 15039 | 178-AlaLysProAspAla-182 |
| SEQ. ID. NO. 15040 | 194-GlyCysGlyPheAspGlyValGlyAspIleAlaLysAlaLysSerGluIle-210 |
| SEQ. ID. NO. 15041 | 213-GlyLeuCysSerAspGly-218 |
| SEQ. ID. NO. 15042 | 223-ProGlnGluAspAlaAsn-228 |
| SEQ. ID. NO. 15043 | 239-LeuAsnThrArgThrPheGlyIleAspSerGlyAspValHisAla-253 |
| SEQ. ID. NO. 15044 | 280-ValProGlyArgHisAsnVal-286 |
| SEQ. ID. NO. 15045 | 305-AspValAlaGluGlyLeuLys-311 |
| SEQ. ID. NO. 15046 | 313-PheSerAsnIleLysGlyArgLeuAsnValLysSerGlyIleLysGly-328 |
| SEQ. ID. NO. 15047 | 330-ThrLeuIleAspAspThrTyrAsnAlaAsnProAspSerMetLysAlaAlaVal-347 |
| SEQ. ID. NO. 15048 | 363-AspMetGlyGluLeuGlyGluAspGluAlaAla-373 |
| SEQ. ID. NO. 15049 | 381-AlaTyrAlaArgAspGlnGlyIle-388 |
| SEQ. ID. NO. 15050 | 395-GlyAspAsnSerValGluAlaAlaGluLysPheGlyAla-407 |
| SEQ. ID. NO. 15051 | 422-LeuArgHisAspLeuProGluArgAlaThrVal-432 |
| SEQ. ID. NO. 15052 | 434-ValLysGlySerArg-438 |
| SEQ. ID. NO. 15053 | 443-GluGluValValGluAlaLeuGluAspLys-452 |
| Hydrophilic Regions - Hopp-Woods | |
| SEQ. ID. NO. 15054 | 17-MetProSerGluSerLysProValSer-25 |
| SEQ. ID. NO. 15055 | 27-IleValThrAspSerArgAspIleArgAla-36 |
| SEQ. ID. NO. 15056 | 46-GlyArgPheAspAla-50 |
| SEQ. ID. NO. 15057 | 67-ValSerArgGluAspCysValAla-74 |
| SEQ. ID. NO. 15058 | 77-GlyAlaLeuLysValAspAspThrLeu-85 |
| SEQ. ID. NO. 15059 | 94-AlaTrpArgGluAsnVal-99 |
| SEQ. ID. NO. 15060 | 109-SerGlyGlyLysThrThrValLysGluMetLeu-119 |
| SEQ. ID. NO. 15061 | 123-LeuArgArgArgPheGlyAsp-129 |
| SEQ. ID. NO. 15062 | 151-LysLeuAsnGluLysHisArg-157 |
| SEQ. ID. NO. 15063 | 178-AlaLysProAspAla-182 |
| SEQ. ID. NO. 15064 | 199-GlyValGlyAspIleAlaLysAlaLysSerGluIle-210 |
| SEQ. ID. NO. 15065 | 223-ProGlnGluAspAlaAsn-228 |
| SEQ. ID. NO. 15066 | 247-AspSerGlyAspValHisAla-253 |
| SEQ. ID. NO. 15067 | 305-AspValAlaGluGlyLeuLys-311 |
| SEQ. ID. NO. 15068 | 316-IleLysGlyArgLeuAsnVal-322 |
| SEQ. ID. NO. 15069 | 335-ThrTyrAsnAlaAsnProAspSerMetLysAlaAlaVal-347 |

TABLE 1-continued

| | |
|---|---|
| SEQ. ID. NO. 15070 | 363-AspMetGlyGluLeuGlyGluAspGluAlaAla-373 |
| SEQ. ID. NO. 15071 | 381-AlaTyrAlaArgAspGlnGlyIle-388 |
| SEQ. ID. NO. 15072 | 397-AsnSerValGluAlaAlaGluLysPheGlyAla-407 |
| SEQ. ID. NO. 15073 | 422-LeuArgHisAspLeuProGluArgAlaThrVal-432 |
| SEQ. ID. NO. 15074 | 443-GluGluValValGluAlaLeuGluAspLys-452 | a084-2
AMPHI Regions - AMPHI

| | |
|---|---|
| SEQ. ID. NO. 15075 | 6-ArgIleLysAsnMetAspGlnThrLeuLysAsnThrLeuGly-19 |
| SEQ. ID. NO. 15076 | 21-CysAlaLeuLeuAla-25 |
| SEQ. ID. NO. 15077 | 48-AlaValGlyAlaLeuAla-53 |
| SEQ. ID. NO. 15078 | 65-PheProArgValSer-69 |
| SEQ. ID. NO. 15079 | 96-GlnIleValGlySerIleLeuGluSer-104 |
| SEQ. ID. NO. 15080 | 111-GluPheValGlyAsnLeuProGly-118 |

Antigenic Index - Jameson-Wolf

| | |
|---|---|
| SEQ. ID. NO. 15081 | 1-MetLysGlnSerAlaArgIleLysAsnMetAspGlnThrLeuLysAsnThr-17 |
| SEQ. ID. NO. 15082 | 40-TyrGluTyrGlyTyrArgTyrSer-47 |
| SEQ. ID. NO. 15083 | 102-LeuGluSerAsnProAlaGluAlaArgGluPheValGly-114 |
| SEQ. ID. NO. 15084 | 139-ValSerGlyGlyGly-143 |

Hydrophilic Regions - Hopp-Woods

| | |
|---|---|
| SEQ. ID. NO. 15085 | 1-MetLysGlnSerAlaArgIleLysAsnMetAspGlnThrLeu-14 |
| SEQ. ID. NO. 15086 | 105-AsnProAlaGluAlaArgGluPheVal-113 | a085-2
AMPHI Regions - AMPHI

| | |
|---|---|
| SEQ. ID. NO. 15087 | 41-GluArgValSerGlnIleGlyLysMetPheAspGlyLeu-53 |
| SEQ. ID. NO. 15088 | 60-LeuLysAspAlaLeuSerAsnGlyPheAsp-69 |
| SEQ. ID. NO. 15089 | 89-ArgAsnGlyGlyArgValLeuGlyAspIleGluLeuLeuAlaAspIle-104 |
| SEQ. ID. NO. 15090 | 125-ThrSerLeuValGlyTyr-130 |
| SEQ. ID. NO. 15091 | 141-IleAlaGlyAsnIleGlyAla-147 |
| SEQ. ID. NO. 15092 | 174-GluAsnThrGluSerLeu-179 |
| SEQ. ID. NO. 15093 | 193-HisLeuAspArgTyrAspAspLeuLeuAspTyr-203 |
| SEQ. ID. NO. 15094 | 212-ArgGlyAspGlyValGln-217 |
| SEQ. ID. NO. 15095 | 225-PheCysArgAlaMetLysArgAla-232 |
| SEQ. ID. NO. 15096 | 275-HisAsnAlaThrAsnValMetAlaAlaValAlaLeuCysGluAla-289 |
| SEQ. ID. NO. 15097 | 300-HisValLysThrPheGlnGlyLeuProHisArgValGluLysIleGly-315 |
| SEQ. ID. NO. 15098 | 336-AlaAlaIleAlaGlyLeu-341 |
| SEQ. ID. NO. 15099 | 353-GlyLysGlyGlnAspPheThr-359 |
| SEQ. ID. NO. 15100 | 395-AspCysAlaThrLeuGluGluAlaValGlnLysAla-406 |
| SEQ. ID. NO. 15101 | 424-SerPheAspMetPheLysGlyTyr-431 |

Antigenic Index - Jameson-Wolf

| | |
|---|---|
| SEQ. ID. NO. 15102 | 4-GlnAsnLysLysIleLeu-9 |
| SEQ. ID. NO. 15103 | 23-TyrLeuArgLysAsnGlyAlaGluValAlaAlaTyrAspAlaGluLeuLysProGluArgValSerGlnIleGlyLysMetPheAsp-51 |
| SEQ. ID. NO. 15104 | 58-GlyArgLeuLysAspAlaLeuSerAsnGly-67 |
| SEQ. ID. NO. 15105 | 74-SerProGlyIleSerGluArgGlnProAspIleGluAlaPheLysArgAsnGlyGlyArgValLeuGly-96 |
| SEQ. ID. NO. 15106 | 104-IleValAsnArgArgGlyAspLysValIle-113 |
| SEQ. ID. NO. 15107 | 116-ThrGlySerAsnGlyLysThrThr-123 |
| SEQ. ID. NO. 15108 | 150-LeuGluAlaGluLeuGlnAsnArgGluGlyLysLysAlaAsp-162 |
| SEQ. ID. NO. 15109 | 169-SerSerPheGlnLeuGluAsnThrGluSerLeuArgProThrAla-183 |
| SEQ. ID. NO. 15110 | 189-IleSerGluAspHisLeuAspArgTyrAspAspLeuLeu-201 |
| SEQ. ID. NO. 15111 | 204-AlaHisThrLysAlaLysIlePheArgGlyAspGlyVal-216 |
| SEQ. ID. NO. 15112 | 220-AsnAlaAspAspAlaPheCysArgAlaMetLysArgAlaGlyArgGluValLys-237 |
| SEQ. ID. NO. 15113 | 247-PheTrpLeuGluArgGluThrGlyArgLeuLysGlnGlyAsnGluAspLeuIleAla-265 |
| SEQ. ID. NO. 15114 | 291-GlyLeuProArgGluAlaLeu-297 |
| SEQ. ID. NO. 15115 | 307-LeuProHisArgValGluLysIleGlyGluLysAsnGly-319 |
| SEQ. ID. NO. 15116 | 322-PheIleAspAspSerLysGlyThrAsnVal-331 |
| SEQ. ID. NO. 15117 | 351-GlyMetGlyLysGlyGlnAspPheThrProLeuArgAspAlaLeuAlaGlyLysAlaLys-370 |
| SEQ. ID. NO. 15118 | 378-AspAlaProGlnIleArgArgAspLeuAspGlyCysAspLeuAsnMetThrAspCysAlaThrLeuGluGluAlaValGln-404 |
| SEQ. ID. NO. 15119 | 431-TyrAlaHisArgSer-435 |

Hydrophilic Regions - Hopp-Woods

| | |
|---|---|
| SEQ. ID. NO. 15120 | 4-GlnAsnLysLysIleLeu-9 |
| SEQ. ID. NO. 15121 | 25-ArgLysAsnGlyAlaGlu-30 |
| SEQ. ID. NO. 15122 | 32-AlaAlaTyrAspAlaGluLeuLysProGluArgValSerGln-45 |
| SEQ. ID. NO. 15123 | 59-ArgLeuLysAspAlaLeu-64 |
| SEQ. ID. NO. 15124 | 76-GlyIleSerGluArgGlnProAspIleGluAlaPheLysArgAsnGlyGly-92 |
| SEQ. ID. NO. 15125 | 104-IleValAsnArgArgGlyAspLysValIle-113 |
| SEQ. ID. NO. 15126 | 118-SerAsnGlyLysThrThr-123 |
| SEQ. ID. NO. 15127 | 150-LeuGluAlaGluLeuGlnAsnArgGluGlyLysLysAlaAsp-162 |
| SEQ. ID. NO. 15128 | 174-GluAsnThrGluSerLeuArgPro-181 |
| SEQ. ID. NO. 15129 | 189-IleSerGluAspHisLeuAspArgTyrAspAspLeuLeu-201 |
| SEQ. ID. NO. 15130 | 204-AlaHisThrLysAlaLysIlePheArgGlyAspGly-215 |
| SEQ. ID. NO. 15131 | 220-AsnAlaAspAspAlaPheCysArgAlaMetLysArgAlaGlyArgGluValLys-237 |
| SEQ. ID. NO. 15132 | 247-PheTrpLeuGluArgGluThrGlyArgLeuLysGlnGlyAsnGluAspLeuIleAla-265 |
| SEQ. ID. NO. 15133 | 291-GlyLeuProArgGluAlaLeu-297 |
| SEQ. ID. NO. 15134 | 309-HisArgValGluLysIleGlyGluLysAsnGly-319 |
| SEQ. ID. NO. 15135 | 324-AspAspSerLysGlyThrAsn-330 |
| SEQ. ID. NO. 15136 | 353-GlyLysGlyGlnAsp-357 |
| SEQ. ID. NO. 15137 | 359-ThrProLeuArgAspAlaLeuAlaGlyLysAlaLys-370 |
| SEQ. ID. NO. 15138 | 380-ProGlnIleArgArgAspLeuAspGlyCysAsp-390 |

TABLE 1-continued

| | |
|---|---|
| SEQ. ID. NO. 15139 | 397-AlaThrLeuGluGluAlaValGln-404 |
| SEQ. ID. NO. 15140 | 431-TyrAlaHisArgSer-435 |
| a086 | |
| AMPHI Regions - AMPHI | |
| SEQ. ID. NO. 15141 | 55-MetArgThrTrpArgArgLeuValPro-63 |
| SEQ. ID. NO. 15142 | 83-IleAsnGlyAlaThrArg-88 |
| SEQ. ID. NO. 15143 | 99-ProThrGluLeuPheLysLeuAlaVal-107 |
| SEQ. ID. NO. 15144 | 120-GluValLeuArgSerMetGluSerLeuGlyTrpGlnSerIleTrpArgGlyThrAlaAsn-139 |
| SEQ. ID. NO. 15145 | 155-GluMetTyrGlyArgPhe-160 |
| SEQ. ID. NO. 15146 | 185-SerPheValValIle-189 |
| SEQ. ID. NO. 15147 | 228-ArgValGlnArgValValAlaPheLeuAspProTrpLysAspProGln-243 |
| SEQ. ID. NO. 15148 | 293-GlyPhePheGlyMetCys-298 |
| SEQ. ID. NO. 15149 | 336-TrpIleGlyIleGlnSerPhe-342 |
| Antigenic Index - Jameson-Wolf | |
| SEQ. ID. NO. 15150 | 20-LeuAlaSerLysGluGlyGlyAsp-27 |
| SEQ. ID. NO. 15151 | 55-MetArgThrTrpArgArg-60 |
| SEQ. ID. NO. 15152 | 79-AlaGlyArgGluIleAsnGlyAlaThr-87 |
| SEQ. ID. NO. 15153 | 115-PheThrArgArgGluGluValLeuArgSerMetGlu-126 |
| SEQ. ID. NO. 15154 | 134-TrpArgGlyThrAla-138 |
| SEQ. ID. NO. 15155 | 144-AlaThrAsnProGlnAlaArgArgGluThrLeuGluMet-156 |
| SEQ. ID. NO. 15156 | 225-AlaProTyrArgVal-229 |
| SEQ. ID. NO. 15157 | 236-LeuAspProTrpLysAspProGlnGlyAla-245 |
| SEQ. ID. NO. 15158 | 265-GlyLeuGlyAlaSerLeuSerLysArgGlyPheLeu-276 |
| SEQ. ID. NO. 15159 | 313-SerIleGlyLysGlnSerArgAspLeuGly-322 |
| SEQ. ID. NO. 15160 | 352-LeuProThrLysGlyLeu-357 |
| SEQ. ID. NO. 15161 | 382-IleAspTyrGluAsnArgArgLysMetArgGlyTyrArgValGlu-396 |
| Hydrophilic Regions - Hopp-Woods | |
| SEQ. ID. NO. 15162 | 21-AlaSerLysGluGlyGlyAsp-27 |
| SEQ. ID. NO. 15163 | 79-AlaGlyArgGluIleAsnGly-85 |
| SEQ. ID. NO. 15164 | 115-PheThrArgArgGluGluValLeuArgSerMetGlu-126 |
| SEQ. ID. NO. 15165 | 147-ProGlnAlaArgArgGluThrLeuGluMet-156 |
| SEQ. ID. NO. 15166 | 238-ProTrpLysAspProGlnGly-244 |
| SEQ. ID. NO. 15167 | 270-LeuSerLysArgGlyPheLeu-276 |
| SEQ. ID. NO. 15168 | 316-LysGlnSerArgAspLeu-321 |
| SEQ. ID. NO. 15169 | 382-IleAspTyrGluAsnArgArgLysMetArgGlyTyrArgValGlu-396 |
| a087 | |
| AMPHI Regions - AMPHI | |
| SEQ. ID. NO. 15170 | 23-ValAlaAspSerLeuArg-28 |
| SEQ. ID. NO. 15171 | 80-GlnThrValArgGluAlaGlnGlnIle-88 |
| SEQ. ID. NO. 15172 | 99-GlyPheGlyGlyPheValThrPheProGlyGlyLeuAlaAlaLysLeuLeu-115 |
| SEQ. ID. NO. 15173 | 129-GlyLeuSerAsnArgHisLeuSerArgTrpAlaLysArgValLeuTyrAlaPheProLys-148 |
| SEQ. ID. NO. 15174 | 157-ValGlyAsnProValArg-162 |
| SEQ. ID. NO. 15175 | 192-GlyAlaAspValLeuAsnLysThrVal-200 |
| SEQ. ID. NO. 15176 | 239-GluCysValGluPheIleThrAspMetValSerAlaTyr-251 |
| SEQ. ID. NO. 15177 | 313-GluLysLeuAlaGluIleLeuGly-320 |
| SEQ. ID. NO. 15178 | 330-TrpAlaGluAsnAla-334 |
| Antigenic Index - Jameson-Wolf | |
| SEQ. ID. NO. 15179 | 25-AspSerLeuArgAlaArgGly-31 |
| SEQ. ID. NO. 15180 | 37-LeuGlySerLysAspSerMetGluGluArgIleValPro-49 |
| SEQ. ID. NO. 15181 | 61-LysGlyValArgGlyAsnGlyIleLysArgLysLeu-72 |
| SEQ. ID. NO. 15182 | 81-ThrValArgGluAlaGlnGlnIleIleArgLysHisArgVal-94 |
| SEQ. ID. NO. 15183 | 130-LeuSerAsnArgHisLeuSerArgTrpAlaLys-140 |
| SEQ. ID. NO. 15184 | 150-PheSerHisGluGlyGlyLeu-156 |
| SEQ. ID. NO. 15185 | 159-AsnProValArgAlaAspIleSer-166 |
| SEQ. ID. NO. 15186 | 171-ProAlaGluArgPheGlnGlyArgGluGlyArgLeu-182 |
| SEQ. ID. NO. 15187 | 195-ValLeuAsnLysThrVal-200 |
| SEQ. ID. NO. 15188 | 207-LeuProAspAsnAlaArgProGlnMetTyrHisGlnSerGlyArgGlyLysLeuGly-225 |
| SEQ. ID. NO. 15189 | 229-AlaAspTyrAspAla-233 |
| SEQ. ID. NO. 15190 | 249-SerAlaTyrArgAspAlaAsp-255 |
| SEQ. ID. NO. 15191 | 284-AlaValAspAspHisGlnThrAla-291 |
| SEQ. ID. NO. 15192 | 309-GlnLeuThrAlaGluLysLeuAlaGlu-317 |
| SEQ. ID. NO. 15193 | 321-GlyLeuAsnArgGluLysCysLeuLys-329 |
| SEQ. ID. NO. 15194 | 331-AlaGluAsnAlaArgThr-336 |
| SEQ. ID. NO. 15195 | 341-HisSerAlaAspAspValAlaGlu-348 |
| Hydrophilic Regions - Hopp-Woods | |
| SEQ. ID. NO. 15196 | 25-AspSerLeuArgAlaArgGly-31 |
| SEQ. ID. NO. 15197 | 39-SerLysAspSerMetGluGluArgIleValPro-49 |
| SEQ. ID. NO. 15198 | 66-AsnGlyIleLysArgLysLeu-72 |
| SEQ. ID. NO. 15199 | 81-ThrValArgGluAlaGlnGlnIleIleArgLysHisArgVal-94 |
| SEQ. ID. NO. 15200 | 134-HisLeuSerArgTrpAlaLys-140 |
| SEQ. ID. NO. 15201 | 161-ValArgAlaAspIle-165 |
| SEQ. ID. NO. 15202 | 171-ProAlaGluArgPheGlnGlyArgGluGlyArgLeu-182 |
| SEQ. ID. NO. 15203 | 219-SerGlyArgGlyLysLeu-224 |
| SEQ. ID. NO. 15204 | 249-SerAlaTyrArgAspAlaAsp-255 |
| SEQ. ID. NO. 15205 | 284-AlaValAspAspHisGlnThrAla-291 |
| SEQ. ID. NO. 15206 | 310-LeuThrAlaGluLysLeuAlaGlu-317 |
| SEQ. ID. NO. 15207 | 322-LeuAsnArgGluLysCysLeuLys-329 |

TABLE 1-continued

| | |
|---|---|
| SEQ. ID. NO. 15208 | 331-AlaGluAsnAlaArg-335 |
| SEQ. ID. NO. 15209 | 341-HisSerAlaAspAspValAlaGlu-348 | a088-2
AMPHI Regions - AMPHI

| | |
|---|---|
| SEQ. ID. NO. 15210 | 7-HisPheSerAsnTrpLeuThrGlyLeuAsnIlePheGlnTyrThrThr-22 |
| SEQ. ID. NO. 15211 | 24-ArgAlaValMetAlaAlaLeu-30 |
| SEQ. ID. NO. 15212 | 43-ThrIleArgArgLeuThrAlaLeuLysCysGlyGln-54 |
| SEQ. ID. NO. 15213 | 88-LeuTrpGlyAsnTrpAlaAsn-94 |
| SEQ. ID. NO. 15214 | 111-GlyPheTyrAspAspTrpArgLysValValTyr-121 |
| SEQ. ID. NO. 15215 | 140-AlaIleIleAlaGlyLeuAlaLeu-147 |
| SEQ. ID. NO. 15216 | 175-GlyPheLeuValLeuSerTyrLeuThrIle-184 |
| SEQ. ID. NO. 15217 | 187-ThrSerAsnAlaValAsnLeuThrAspGlyLeuAspGlyLeuAlaThr-202 |
| SEQ. ID. NO. 15218 | 221-HisSerGlnPheAlaGlnTyrLeuGlnLeuProTyr-232 |
| SEQ. ID. NO. 15219 | 245-AlaMetCysGlyAlaCysLeuGlyPhe-253 |

Antigenic Index - Jameson-Wolf

| | |
|---|---|
| SEQ. ID. NO. 15220 | 48-ThrAlaLeuLysCysGlyGlnAlaValArgThrAspGlyProGln-62 |
| SEQ. ID. NO. 15221 | 66-ValLysAsnGlyThrProThrMet-73 |
| SEQ. ID. NO. 15222 | 114-AspAspTrpArgLysValValTyrLysAspProAsnGlyValSerAlaLysPhe-131 |
| SEQ. ID. NO. 15223 | 193-LeuThrAspGlyLeuAsp-198 |
| SEQ. ID. NO. 15224 | 312-LysLysThrLysLysArgIle-318 |
| SEQ. ID. NO. 15225 | 328-TyrGluGlnLysGlyTrpLysGluThrGlnVal-338 |

Hydrophilic Regions - Hopp-Woods

| | |
|---|---|
| SEQ. ID. NO. 15226 | 56-ValArgThrAspGlyProGln-62 |
| SEQ. ID. NO. 15227 | 114-AspAspTrpArgLysValValTyrLysAspProAsnGlyVal-127 |
| SEQ. ID. NO. 15228 | 312-LysLysThrLysLysArgIle-318 |
| SEQ. ID. NO. 15229 | 331-LysGlyTrpLysGlu-335 | a089
AMPHI Regions - AMPHI

| | |
|---|---|
| SEQ. ID. NO. 15230 | 44-CysGlyArgProXxxLysVal-50 |
| SEQ. ID. NO. 15231 | 73-ThrLeuValAlaLeuCysLysProCysSerGlyIle-84 |
| SEQ. ID. NO. 15232 | 118-SerArgProAlaArgPhe-123 |

Antigenic Index - Jameson-Wolf

| | |
|---|---|
| SEQ. ID. NO. 15233 | 1-MetProProLysIleThrLysSerGlyPhe-10 |
| SEQ. ID. NO. 15234 | 40-PheSerThrArgCysGlyArgProXxxLys-49 |
| SEQ. ID. NO. 15235 | 54-SerSerAsnAlaSerArgGlyLysProThrAlaSerHisLysAla-68 |
| SEQ. ID. NO. 15236 | 80-ProCysSerGlyIle-84 |
| SEQ. ID. NO. 15237 | 95-CysPheArgArgProValSerArgSerAsnGlnLysSerAlaSerTyrSerAsnGlu AsnHisPheThrSerArgProAlaArgPheIleAlaArgGlnAsnAlaSerSerAlaPheLysThrCysThrProSerProArgLysIleLeu-144 |

Hydrophilic Regions - Hopp-Woods

| | |
|---|---|
| SEQ. ID. NO. 15238 | 43-ArgCysGlyArgProXxxLys-49 |
| SEQ. ID. NO. 15239 | 56-AsnAlaSerArgGlyLysProThrAlaSerHisLysAla-68 |
| SEQ. ID. NO. 15240 | 95-CysPheArgArgProValSerArgSerAsnGlnLysSerAlaSerTyrSerAsn-112 |
| SEQ. ID. NO. 15241 | 119-ArgProAlaArgPheIleAla-125 |
| SEQ. ID. NO. 15242 | 137-ThrProSerProArgLysIle-143 | a090-1
AMPHI Regions - AMPHI

| | |
|---|---|
| SEQ. ID. NO. 15243 | 10-SerGlnSerLeuLysArgProAspLysHisPheArg-21 |
| SEQ. ID. NO. 15244 | 142-AspPhePheHisAlaValArgGlnAlaLeuLysGlyPheAspValPheGluGlnCysPheAla-162 |
| SEQ. ID. NO. 15245 | 164-GlnThrAspGlyPhe-168 |
| SEQ. ID. NO. 15246 | 177-ValSerGlyValValGlnAlaLeuGlnArg-186 |
| SEQ. ID. NO. 15247 | 226-LeuHisArgThrThrGluArgIleValArgIleGlnAsnLeuHisThrVal-242 |
| SEQ. ID. NO. 15248 | 253-ValValGluGlnVal-257 |
| SEQ. ID. NO. 15249 | 268-ValGlnHisCysArgArgSerArg-275 |
| SEQ. ID. NO. 15250 | 381-GlyAlaGluCysGlnAsnIleGluThrValGlyGluArg-393 |
| SEQ. ID. NO. 15251 | 404-ProValLysHisLeuThrAspLeuArg-412 |
| SEQ. ID. NO. 15252 | 425-AsnLeuArgAlaValPheAlaGlnValGlyAsnHisGlyAsnThrArgAlaAlaLysSer-444 |

Antigenic Index - Jameson-Wolf

| | |
|---|---|
| SEQ. ID. NO. 15253 | 9-ValSerGlnSerLeuLysArgProAspLysHisPheArg-21 |
| SEQ. ID. NO. 15254 | 29-HisIleGluThrArgAlaGlyGlyAlaGluGlnHisAspIleAla-43 |
| SEQ. ID. NO. 15255 | 56-PheGlnSerGlyAla-60 |
| SEQ. ID. NO. 15256 | 73-AlaAspLeuArgArgIleAspThrAspGlnGluHis-84 |
| SEQ. ID. NO. 15257 | 89-AlaGlyLysArgValAlaGlnGlyArgGluVal-99 |
| SEQ. ID. NO. 15258 | 107-XxxAsnHisGluGluArgIleLeuGlnThrGlyAsnArgGlyGlyGlyArgThrAspValArg-127 |
| SEQ. ID. NO. 15259 | 149-GlnAlaLeuLysGlyPheAsp-155 |
| SEQ. ID. NO. 15260 | 161-PheAlaArgGlnThrAspGlyPheAlaGlnGlyAsnGlySerHisHisValSer-178 |
| SEQ. ID. NO. 15261 | 187-AsnIleLeuArgGlyAsnGln-193 |
| SEQ. ID. NO. 15262 | 215-GlnArgLysProPheHisLeuAla-222 |
| SEQ. ID. NO. 15263 | 228-ArgThrThrGluArgIleValArg-235 |
| SEQ. ID. NO. 15264 | 269-GlnHisCysArgArgSerArgAlaGln-277 |
| SEQ. ID. NO. 15265 | 285-GluThrGlyLysLeuGlnHis-291 |
| SEQ. ID. NO. 15266 | 305-LeuGlnAsnArgArgAlaAspIleAlaArgAspAsnGlyIle-318 |
| SEQ. ID. NO. 15267 | 320-ProThrLeuAspAlaGluIleAlaAspGlnAlaArgTyrArgGly-334 |
| SEQ. ID. NO. 15268 | 339-AlaGlyAsnArgAsnHis-344 |
| SEQ. ID. NO. 15269 | 353-ValArgGlnGlnPhe-357 |
| SEQ. ID. NO. 15270 | 369-LysGlyLeuAspIle-373 |
| SEQ. ID. NO. 15271 | 380-AlaGlyAlaGluCysGlnAsn-386 |
| SEQ. ID. NO. 15272 | 398-AlaArgValLysHisGlnProVal-405 |
| SEQ. ID. NO. 15273 | 407-HisLeuThrAspLeuArgHis-413 |
| SEQ. ID. NO. 15274 | 421-IleIleArgSerAsnLeuArg-427 |
| SEQ. ID. NO. 15275 | 434-GlyAsnHisGlyAsnThrArgAlaAlaLysSerGlyAspGluAspPhePhe-450 |

TABLE 1-continued

Hydrophilic Regions - Hopp-Woods
SEQ. ID. NO. 15276    11-GlnSerLeuLysArgProAspLysHisPheArg-21
SEQ. ID. NO. 15277    29-HisIleGluThrArgAlaGlyGlyAlaGluGlnHisAspIleAla-43
SEQ. ID. NO. 15278    73-AlaAspLeuArgArgIleAspThrAspGlnGluHis-84
SEQ. ID. NO. 15279    89-AlaGlyLysArgValAlaGlnGlyArgGluVal-99
SEQ. ID. NO. 15280    107-XxxAsnHisGluGluArgIleLeu-114
SEQ. ID. NO. 15281    117-GlyAsnArgGlyGlyGlyArgThrAspValArg-127
SEQ. ID. NO. 15282    228-ArgThrThrGluArgIleValArg-235
SEQ. ID. NO. 15283    269-GlnHisCysArgArgSerArgAla-276
SEQ. ID. NO. 15284    285-GluThrGlyLysLeuGln-290
SEQ. ID. NO. 15285    305-LeuGlnAsnArgArgAlaAspIleAlaArgAspAsnGlyIle-318
SEQ. ID. NO. 15286    322-LeuAspAlaGluIleAlaAspGlnAlaArgTyrArg-333
SEQ. ID. NO. 15287    369-LysGlyLeuAspIle-373
SEQ. ID. NO. 15288    380-AlaGlyAlaGluCysGlnAsn-386
SEQ. ID. NO. 15289    398-AlaArgValLysHisGlnPro-404
SEQ. ID. NO. 15290    409-ThrAspLeuArgHis-413
SEQ. ID. NO. 15291    421-IleIleArgSerAsnLeu-426
SEQ. ID. NO. 15292    437-GlyAsnThrArgAlaAlaLysSerGlyAspGluAspPhePhe-450
a091
AMPHI Regions - AMPHI
SEQ. ID. NO. 15293    39-ProLeuSerAspGlyIleAlaSerCys-47
SEQ. ID. NO. 15294    49-IleThrArgPheGlnAlaLeuVal-56
SEQ. ID. NO. 15295    61-ValLeuValSerValLeuThrSerLeuAlaLys-71
Antigenic Index - Jameson-Wolf
SEQ. ID. NO. 15296    5-ValProProSerProAlaThr-11
SEQ. ID. NO. 15297    38-LysProLeuSerAspGlyIleAla-45
a092
AMPHI Regions - AMPHI
SEQ. ID. NO. 15298    55-GlyMetSerGlyIleAlaGluValLeuHis-64
SEQ. ID. NO. 15299    76-AlaArgAsnAlaAlaThrGluHisLeu-84
SEQ. ID. NO. 15300    95-HisThrAlaGluHisValAsnGly-102
SEQ. ID. NO. 15301    120-ValAlaAlaLeuGlu-124
SEQ. ID. NO. 15302    137-AlaGluLeuMetArgPheArgAsp-144
SEQ. ID. NO. 15303    209-LeuThrProIleMetSerValValThrAsnIleAsp-220
SEQ. ID. NO. 15304    226-ThrTyrGlyHisSerValGluLysLeuHisGlnAlaPheIleAspPheIleHisArg-244
SEQ. ID. NO. 15305    259-HisValArgAlaIleLeuProLysValSerLysProTyr-271
SEQ. ID. NO. 15306    273-ThrTyrGlyLeuAspAspThrAla-280
SEQ. ID. NO. 15307    321-AsnValLeuAsnAlaLeuAlaAlaIle-329
SEQ. ID. NO. 15308    339-ValGluAlaIleGlnLysGly-345
SEQ. ID. NO. 15309    353-GlyArgArgPheGlnLysTyrGlyAspIleLys-363
SEQ. ID. NO. 15310    407-ArgTyrThrArgThrArgAspLeuPheGluAspPheThrLysValLeuAsnThrValAspAlaLeu-428
SEQ. ID. NO. 15311    449-LeuAlaArgAlaIleArgValLeuGlyLysLeu-459
SEQ. ID. NO. 15312    464-CysGluAsnValAlaAspLeuProGluMetLeuLeuAsn-476
Antigenic Index - Jameson-Wolf
SEQ. ID. NO. 15313    14-LeuTrpArgAlaAsnGlyGlnProPheLys-23
SEQ. ID. NO. 15314    25-ThrProLeuArgIleGluAsnProProGluArgAsnIleMetMetLysAsnArgVal-43
SEQ. ID. NO. 15315    70-ValSerGlySerAspGlnAlaArgAsnAlaAla-80
SEQ. ID. NO. 15316    111-AlaValLysLysGluAsnProGluVal-119
SEQ. ID. NO. 15317    140-MetArgPheArgAspGlyIle-146
SEQ. ID. NO. 15318    150-GlyThrHisGlyLysThrThrThr-157
SEQ. ID. NO. 15319    184-GlyThrAsnAlaArgLeuGlyLysGlyGluTyr-194
SEQ. ID. NO. 15320    198-GluAlaAspGluSerAspAla-204
SEQ. ID. NO. 15321    218-AsnIleAspGluAspHisMetAspThrTyrGly-228
SEQ. ID. NO. 15322    230-SerValGluLysLeuHis-235
SEQ. ID. NO. 15323    255-IleAspSerGluHisVal-260
SEQ. ID. NO. 15324    263-IleLeuProLysValSerLysProTyrAla-272
SEQ. ID. NO. 15325    275-GlyLeuAspAspThrAlaAsp-281
SEQ. ID. NO. 15326    286-AspIleGluAsnValGlyAla-292
SEQ. ID. NO. 15327    302-MetLysGlyHisGluGlnGlySerPhe-310
SEQ. ID. NO. 15328    351-GlyValGlyArgArgPheGlnLysTyrGlyAspIleLysLeuProAsnGlyGly-368
SEQ. ID. NO. 15329    374-AspAspTyrGlyHisHisPro-380
SEQ. ID. NO. 15330    393-AlaTyrProGluLysArgLeu-399
SEQ. ID. NO. 15331    404-GlnProHisArgTyrThrArgThrArgAspLeuPheGluAspPheThrLys-420
SEQ. ID. NO. 15332    435-AlaAlaGlyGluGluProIleAlaAlaAlaAspSerArgAlaLeuAlaArg-451
SEQ. ID. NO. 15333    466-AsnValAlaAspLeuPro-471
SEQ. ID. NO. 15334    478-LeuGlnAspGlyAspIle-483
SEQ. ID. NO. 15335    488-GlyAlaGlySerIleAsn-493
Hydrophilic Regions - Hopp-Woods
SEQ. ID. NO. 15336    26-ProLeuArgIleGluAsnProProGluArgAsnIleMetMetLysAsnArgVal-43
SEQ. ID. NO. 15337    71-SerGlySerAspGlnAlaArgAsnAlaAla-80
SEQ. ID. NO. 15338    111-AlaValLysLysGluAsnProGlu-118
SEQ. ID. NO. 15339    140-MetArgPheArgAsp-144
SEQ. ID. NO. 15340    152-HisGlyLysThrThr-156
SEQ. ID. NO. 15341    187-AlaArgLeuGlyLysGlyGlu-193
SEQ. ID. NO. 15342    198-GluAlaAspGluSerAspAla-204
SEQ. ID. NO. 15343    218-AsnIleAspGluAspHisMetAsp-225
SEQ. ID. NO. 15344    230-SerValGluLysLeuHis-235
SEQ. ID. NO. 15345    256-AspSerGluHisVal-260
SEQ. ID. NO. 15346    275-GlyLeuAspAspThrAlaAsp-281
SEQ. ID. NO. 15347    303-LysGlyHisGluGlnGlySer-309

TABLE 1-continued

| SEQ. ID. NO. 15348 | 351-GlyValGlyArgArgPheGlnLys-358 |
| SEQ. ID. NO. 15349 | 360-GlyAspIleLysLeu-364 |
| SEQ. ID. NO. 15350 | 393-AlaTyrProGluLysArgLeu-399 |
| SEQ. ID. NO. 15351 | 407-ArgTyrThrArgThrArgAspLeuPheGluAspPheThrLys-420 |
| SEQ. ID. NO. 15352 | 435-AlaAlaGlyGluGluProIleAlaAlaAlaAspSerArgAlaLeuAlaArg-451 |
| SEQ. ID. NO. 15353 | 466-AsnValAlaAspLeuPro-471 |
| SEQ. ID. NO. 15354 | 479-GlnAspGlyAspIle-483 | a093-2
AMPHI Regions - AMPHI
SEQ. ID. NO. 15355    26-ThrAlaIleLeuAsn-30
SEQ. ID. NO. 15356    59-ThrAlaPheAsnIleLeuHisGly-66
SEQ. ID. NO. 15357    159-LysSerValTyrGluGluLeuLysHisPhe-168
SEQ. ID. NO. 15358    196-IleHisIleIleProAlaThrGluPhe-204
SEQ. ID. NO. 15359    254-PheLeuLysAspThr-258
SEQ. ID. NO. 15360    267-IleAsnThrLeuProGlyMetThrGly-275
Antigenic Index - Jameson-Wolf
SEQ. ID. NO. 15361    12-GlyGlyPheSerSerGluArgGluIleSerLeuAspSerGlyThr-26
SEQ. ID. NO. 15362    32-LeuLysSerLysGlyIleAsp-38
SEQ. ID. NO. 15363    41-AlaPheAspProLysGluThrProLeuSerGluLeuLysAlaGlnGly-56
SEQ. ID. NO. 15364    66-GlyThrTyrGlyGluAspGlyAlaVal-74
SEQ. ID. NO. 15365    96-GlyMetAspLysTyrArgCys-102
SEQ. ID. NO. 15366    120-HisAspAspThrAspPheAspAlaValGluGluLysLeuGly-133
SEQ. ID. NO. 15367    140-ProAlaAlaGluGlySerSer-146
SEQ. ID. NO. 15368    151-LysValLysGlyLysGlyArgLeuLysSerValTyrGluGluLeuLysHisPheGln-169
SEQ. ID. NO. 15369    176-ArgPheIleGlyGlyGlyGluTyrSer-184
SEQ. ID. NO. 15370    189-AsnGlyLysGlyLeuPro-194
SEQ. ID. NO. 15371    203-GluPheTyrAspTyrGluAlaLysTyrAsnArgAsnAspThr-216
SEQ. ID. NO. 15372    218-TyrGlnCysProSerGluAspLeuThrGluAlaGluGluSerLeuMetArg-234
SEQ. ID. NO. 15373    245-GlyAlaGluGlyCysVal-250
SEQ. ID. NO. 15374    253-AspPheLeuLysAspThrAspGly-260
SEQ. ID. NO. 15375    269-ThrLeuProGlyMetThr-274
Hydrophilic Regions - Hopp-Woods
SEQ. ID. NO. 15376    15-SerSerGluArgGluIleSerLeu-22
SEQ. ID. NO. 15377    32-LeuLysSerLysGlyIleAsp-38
SEQ. ID. NO. 15378    41-AlaPheAspProLysGluThrProLeuSerGluLeuLysAla-54
SEQ. ID. NO. 15379    68-TyrGlyGluAspGlyAlaVal-74
SEQ. ID. NO. 15380    96-GlyMetAspLysTyrArgCys-102
SEQ. ID. NO. 15381    120-HisAspAspThrAspPheAspAlaValGluGluLysLeuGly-133
SEQ. ID. NO. 15382    140-ProAlaAlaGluGlySerSer-146
SEQ. ID. NO. 15383    151-LysValLysGlyLysGlyArgLeuLysSerValTyrGluGluLeuLysHisPheGln-169
SEQ. ID. NO. 15384    205-TyrAspTyrGluAlaLysTyrAsnArgAsnAspThr-216
SEQ. ID. NO. 15385    221-ProSerGluAspLeuThrGluAlaGluGluSerLeuMetArg-234
SEQ. ID. NO. 15386    253-AspPheLeuLysAspThrAspGly-260
a094
AMPHI Regions - AMPHI
SEQ. ID. NO. 15387    17-LeuProProIleThrLysValGlySer-25
SEQ. ID. NO. 15388    80-PheSerPheLeuThrAlaVal-86
Antigenic Index - Jameson-Wolf
SEQ. ID. NO. 15389    3-SerProLeuProLysArgAlaLeu-10
SEQ. ID. NO. 15390    24-GlySerSerProAlaAlaProArgMetGluAla-34
SEQ. ID. NO. 15391    50-MetProSerArgLysArgIleAsnSerAlaAsnIleArgAlaArgGlyIleThr-67
Hydrophilic Regions - Hopp-Woods
SEQ. ID. NO. 15392    5-LeuProLysArgAlaLeu-10
SEQ. ID. NO. 15393    28-AlaAlaProArgMetGluAla-34
SEQ. ID. NO. 15394    51-ProSerArgLysArgIleAsn-57
SEQ. ID. NO. 15395    60-AsnIleArgAlaArgGly-65
a095-2
AMPHI Regions - AMPHI
SEQ. ID. NO. 15396    9-CysAlaSerAsnLeuPheArgGlnPheGlnGlnArgGlyGlyAspAlaValAsp-26
SEQ. ID. NO. 15397    38-ValLeuGlnAsnValGlnGlnHisPheGlyGlnIleGlyAsnValPheAlaVal-55
SEQ. ID. NO. 15398    86-PheGlyGlnHisGlnArgValAsnGlyIleGluAspPheGlyLysValPheLysGlnIleAlaArg-107
SEQ. ID. NO. 15399    132-GlyArgArgHisPheAspGlyValValSer-141
SEQ. ID. NO. 15400    174-PheLeuAspArgPheAsnArgCysAlaAspPheGlnArgHisAlaAspGlyCysGlnCysValGlnHisVal-197
SEQ. ID. NO. 15401    204-GlnHisAspPheLys-208
SEQ. ID. NO. 15402    236-AspValGlyGlyIleValGlnThrValSerSerIle-247
SEQ. ID. NO. 15403    274-ThrValAspGluIleAspLysArgLeuMetGlnLeuLeuAsnThrVal-289
SEQ. ID. NO. 15404    313-GlyCysIleArgLeuValGly-319
SEQ. ID. NO. 15405    370-AsnGlyAspAlaValThrGluAlaHisGlnLeuArgGlnHisGlnGlyAla-386
SEQ. ID. NO. 15406    417-ValAsnValPheCysGly-422
SEQ. ID. NO. 15407    435-MetLeuGlySerGlyIleSerArgLeuIleArgThrGly-447
SEQ. ID. NO. 15408    451-ThrGlnIleValGlnAspPheGlyAspThrAlaHisAla-463
Antigenic Index - Jameson-Wolf
SEQ. ID. NO. 15409    6-SerGlyGlyCysAlaSerAsnLeu-13
SEQ. ID. NO. 15410    17-PheGlnGlnArgGlyGlyAspAlaValAspAlaSerArgThrHisIle-32
SEQ. ID. NO. 15411    62-GlnHisAlaAspGlyAlaGlyLysSerAlaGlyIleSerGlyAsnArgLeuPhe-80
SEQ. ID. NO. 15412    88-GlnHisGlnArgValAsnGlyIleGluAspPheGlyLys-100
SEQ. ID. NO. 15413    112ValArgLeuGluGlyGluTyr-118
SEQ. ID. NO. 15414    126-AlaAlaCysGlyGlyLysGlyArgArgHisPheAspGly-138
SEQ. ID. NO. 15415    144-ValHisGlnGluArgGlySerThr-151
SEQ. ID. NO. 15416    163-AlaAlaAlaAspThrPheLysAlaGluGlnAlaPhe-174

TABLE 1-continued

| | |
|---|---|
| SEQ. ID. NO. 15417 | 176-AspArgPheAsnArgCysAlaAspPheGlnArgHisAlaAspGlyCysGln-192 |
| SEQ. ID. NO. 15418 | 205-HisAspPheLysArg-209 |
| SEQ. ID. NO. 15419 | 253-GlyGlnAsnArgAlaAspVal-259 |
| SEQ. ID. NO. 15420 | 263-AsnThrGlnLysGlyPheAlaVal-270 |
| SEQ. ID. NO. 15421 | 273-HisThrValAspGluIleAspLysArgLeu-282 |
| SEQ. ID. NO. 15422 | 300-IleGlyAsnAspGlyHisAsnArgCysGlnValGlnLysGlyCys-314 |
| SEQ. ID. NO. 15423 | 339-PheAlaAlaAspAsnGluSerArgValLysSerCysArgAlaGluAsp GlyGlyGlyGlnAlaGlyGlyArgGlyPheAlaValArgAlaGlyAsnGlyAspAlaValThr-375 |
| SEQ. ID. NO. 15424 | 378-HisGlnLeuArgGlnHisGlnGlyAlaArgAsnAsnGlyAsn-391 |
| SEQ. ID. NO. 15425 | 394-LeuGlnArgSerAspAsnPheGly-401 |
| SEQ. ID. NO. 15426 | 405-PheAspGlyGlyArgGlyAsnAspAspIleArgThr-416 |
| SEQ. ID. NO. 15427 | 442-ArgLeuIleArgThrGlyAsnPheLysThr-451 |
| SEQ. ID. NO. 15428 | 455-GlnAspPheGlyAspThrAlaHisAlaAspAlaAlaAspThrAspLysMetAspVal-473 |
| Hydrophilic Regions - Hopp-Woods | |
| SEQ. ID. NO. 15429 | 17-PheGlnGlnArgGlyGlyAspAlaValAspAlaSerArgThrHisIle-32 |
| SEQ. ID. NO. 15430 | 64-AlaAspGlyAlaGlyLysSerAlaGly-72 |
| SEQ. ID. NO. 15431 | 93-AsnGlyIleGluAspPheGlyLys-100 |
| SEQ. ID. NO. 15432 | 112-ValArgLeuGluGlyGluTyr-118 |
| SEQ. ID. NO. 15433 | 128-CysGlyGlyLysGlyArgArgHisPhe-136 |
| SEQ. ID. NO. 15434 | 145-HisGlnGluArgGlySer-150 |
| SEQ. ID. NO. 15435 | 163-AlaAlaAlaAspThrPheLysAlaGluGlnAlaPhe-174 |
| SEQ. ID. NO. 15436 | 182-AlaAspPheGlnArgHisAlaAspGly-190 |
| SEQ. ID. NO. 15437 | 205-HisAspPheLysArg-209 |
| SEQ. ID. NO. 15438 | 273-HisThrValAspGluIleAspLysArgLeu-282 |
| SEQ. ID. NO. 15439 | 300-IleGlyAsnAspGlyHisAsnArgCysGlnVal-310 |
| SEQ. ID. NO. 15440 | 339-PheAlaAlaAspAsnGluSerArgValLysSerCysArgAlaGluAspGlyGlyGly-357 |
| SEQ. ID. NO. 15441 | 368-AlaGlyAsnGlyAspAlaValThr-375 |
| SEQ. ID. NO. 15442 | 378-HisGlnLeuArgGlnHisGlnGlyAlaArgAsnAsnGly-390 |
| SEQ. ID. NO. 15443 | 395-GlnArgSerAspAsn-399 |
| SEQ. ID. NO. 15444 | 407-GlyGlyArgGlyAsnAspAspIleArgThr-416 |
| SEQ. ID. NO. 15445 | 461-AlaHisAlaAspAlaAlaAspThrAspLysMetAspVal-473 |
| a096-2 | |
| AMPHI Regions - AMPHI | |
| SEQ. ID. NO. 15446 | 19-GlyIlePheGluGluIleAspAlaHis-27 |
| SEQ. ID. NO. 15447 | 37-AlaAlaAsnArgGln-41 |
| SEQ. ID. NO. 15448 | 61-GlyValValAlaVal-65 |
| SEQ. ID. NO. 15449 | 112-GlnPhePheValAsnAlaPheGln-119 |
| SEQ. ID. NO. 15450 | 129-AlaTyrAlaAlaAlaPheGlyArg-136 |
| SEQ. ID. NO. 15451 | 172-AsnGlnPheAlaAla-176 |
| SEQ. ID. NO. 15452 | 187-AspThrAlaAlaGlyIleGlyAsnAlaGln-196 |
| SEQ. ID. NO. 15453 | 228-GlnTrpGlyPheLeu-232 |
| Antigenic Index - Jameson-Wolf | |
| SEQ. ID. NO. 15454 | 4-HisThrGlyGlnGly-8 |
| SEQ. ID. NO. 15455 | 22-GluGluIleAspAla-26 |
| SEQ. ID. NO. 15456 | 30-PheArgThrAspCysLeuArgAlaAlaAsn-39 |
| SEQ. ID. NO. 15457 | 73-LysLeuGlyArgGlyAspAspValTyrAla-82 |
| SEQ. ID. NO. 15458 | 97-AlaAlaAspLysProPheGlyAsnAspPhe-106 |
| SEQ. ID. NO. 15459 | 137-ArgPheHisLysHisArgGln-143 |
| SEQ. ID. NO. 15460 | 157-ValGlnAspGlyGluLeuGlyAsnGlyGlnSerGlnCysLeu-170 |
| SEQ. ID. NO. 15461 | 181-AlaAspGlyGlyCysGlyAspThr-188 |
| SEQ. ID. NO. 15462 | 211-ThrValLysAspValGluCysArgLeu-219 |
| Hydrophilic Regions - Hopp-Woods | |
| SEQ. ID. NO. 15463 | 22-GluGluIleAspAla-26 |
| SEQ. ID. NO. 15464 | 33-AspCysLeuArgAlaAlaAsn-39 |
| SEQ. ID. NO. 15465 | 74-LeuGlyArgGlyAspAspValTyr-81 |
| SEQ. ID. NO. 15466 | 97-AlaAlaAspLysProPheGly-103 |
| SEQ. ID. NO. 15467 | 137-ArgPheHisLysHisArgGln-143 |
| SEQ. ID. NO. 15468 | 158-GlnAspGlyGluLeuGlyAsn-164 |
| SEQ. ID. NO. 15469 | 183-GlyGlyCysGlyAspThr-188 |
| SEQ. ID. NO. 15470 | 211-ThrValLysAspValGluCysArgLeu-219 |
| a097 | |
| AMPHI Regions - AMPHI | |
| SEQ. ID. NO. 15471 | 28-AlaGlyLeuThrThrPheLeuThrMetCysTyrIleVal-40 |
| SEQ. ID. NO. 15472 | 72-MetGlyPheValGly-76 |
| SEQ. ID. NO. 15473 | 166-AlaThrLeuValGlyLeuGlyAspIleHisGlnProSerAlaLeuLeuAlaLeuPheGly-185 |
| SEQ. ID. NO. 15474 | 207-ThrIleThrValIleAlaSerLeuMetGlyLeuAsnGluPheHisGlyIleIleGlyGluValProSerIle-230 |
| SEQ. ID. NO. 15475 | 242-LeuPheThrValSer-246 |
| SEQ. ID. NO. 15476 | 260-PheAspSerThrGlyThr-265 |
| SEQ. ID. NO. 15477 | 342-LeuAlaLysSerValProAlaPheAlaThr-351 |
| SEQ. ID. NO. 15478 | 362-MetLeuArgSerAlaArgAspIle-369 |
| Antigenic Index - Jameson-Wolf | |
| SEQ. ID. NO. 15479 | 1-MetAspThrSerLysGlnThrLeu-8 |
| SEQ. ID. NO. 15480 | 13-PheLysLeuLysAlaAsnGlyThrThrValArgThrGluLeu-26 |
| SEQ. ID. NO. 15481 | 125-LysValArgGluMetLeu-130 |
| SEQ. ID. NO. 15482 | 260-PheAspSerThrGly-264 |
| SEQ. ID. NO. 15483 | 277-ValAspGlyLysLeuProArgProLeuLysArg-286 |
| SEQ. ID. NO. 15484 | 317-SerAlaGlyGlyArgThrGly-323 |
| SEQ. ID. NO. 15485 | 364-ArgSerAlaArgAspIleAspTrpAspAspMetThrGlu-376 |
| SEQ. ID. NO. 15486 | 410-LeuCysArgArgThrLysAspValProPro-419 |

TABLE 1-continued

Hydrophilic Regions - Hopp-Woods
SEQ. ID. NO. 15487   1-MetAspThrSerLys-5
SEQ. ID. NO. 15488   16-LysAlaAsnGlyThrThrValArgThrGluLeu-26
SEQ. ID. NO. 15489   125-LysValArgGluMetLeu-130
SEQ. ID. NO. 15490   279-GlyLysLeuProArgLeuLysArg-286
SEQ. ID. NO. 15491   318-AlaGlyGlyArgThr-322
SEQ. ID. NO. 15492   364-ArgSerAlaArgAspIleAspTrpAspAspMetThrGlu-376
SEQ. ID. NO. 15493   410-LeuCysArgArgThrLysAspValPro-418
a098-2
AMPHI Regions - AMPHI
SEQ. ID. NO. 15494   28-AlaAlaGluAlaGlyGluGlnPheValGlyAsp-38
SEQ. ID. NO. 15495   110-ValGlyAspPhePheLysLeuAlaPhe-118
SEQ. ID. NO. 15496   120-CysGlnIleGlnAsnValValThrAlaIleAlaGlnIleValAla-134
SEQ. ID. NO. 15497   163-LeuSerSerPheSerHisGly-169
Antigenic Index - Jameson-Wolf
SEQ. ID. NO. 15498   24-ValGlnGluAspAlaAlaGluAlaGlyGlu-33
SEQ. ID. NO. 15499   68-MetGlyMetCysArg-72
SEQ. ID. NO. 15500   78-PheAsnHisThrAspArgGlnAlaAla-86
SEQ. ID. NO. 15501   136-ThrAlaAsnGlyThrGlnSerGlyIleThrGlyArgAsnAlaArgLysArgAsnGlyPhe-155
SEQ. ID. NO. 15502   158-PheGluGlyArgGlyLeuSerSerPheSerHisGlyIle-170
SEQ. ID. NO. 15503   180-ValPheArgArgProMetArgIleCys-188
Hydrophilic Regions - Hopp-Woods
SEQ. ID. NO. 15504   24-ValGlnGluAspAlaAlaGluAlaGlyGlu-33
SEQ. ID. NO. 15505   79-AsnHisThrAspArgGlnAla-85
SEQ. ID. NO. 15506   144-IleThrGlyArgAsnAlaArgLysArgAsnGly-154
SEQ. ID. NO. 15507   158-PheGluGlyArgGly-162
SEQ. ID. NO. 15508   180-ValPheArgArgProMetArg-186
a099
AMPHI Regions - AMPHI
SEQ. ID. NO. 15509   6-SerMetMetArgLeuProAspIle-13
SEQ. ID. NO. 15510   47-AlaPheValGluPhePheGlyGluGly-55
SEQ. ID. NO. 15511   102-LysLeuValGluThrTyrAlaLysThr-110
SEQ. ID. NO. 15512   114-TrpAlaAspAlaLeuLysThrAla-121
SEQ. ID. NO. 15513   135-ThrArgAsnMetAlaGlyProSerAsn-143
SEQ. ID. NO. 15514   154-AlaGlyLysGlyLeuAlaLysProTyrGluGluProSerAspGlyGln-169
SEQ. ID. NO. 15515   178-AlaAlaIleThrSerCysThrAsnThrSerAsnProArgAsnVal-192
SEQ. ID. NO. 15516   251-ThrCysAsnGlyMetSer-256
SEQ. ID. NO. 15517   341-IleAspAlaIleValAlaGluTyr-348
SEQ. ID. NO. 15518   350-LysProGlnGlnPheArgAspVal-357
SEQ. ID. NO. 15519   371-ProSerProLeuTyrAspTrpArg-378
SEQ. ID. NO. 15520   381-SerThrTyrIleArg-385
SEQ. ID. NO. 15521   400-LeuSerGlyMetArgProLeu-406
SEQ. ID. NO. 15522   443-AspPheAsnSerTyrAlaThr-449
SEQ. ID. NO. 15523   468-PheAsnGluMetValArg-473
SEQ. ID. NO. 15524   494-MetArgMetTrpGluAlaIleGluThrTyrMet-504
SEQ. ID. NO. 15525   532-ArgLeuAlaGlyVal-536
SEQ. ID. NO. 15526   539-IleValAlaGluGlyPheGluArgIleHisArgThrAsn-551
SEQ. ID. NO. 15527   575-GlyThrGluThrTyr-579
Antigenic Index - Jameson-Wolf
SEQ. ID. NO. 15528   18-LeuAsnGlyLysArgLysAlaGly-25
SEQ. ID. NO. 15529   38-PheLeuArgLysGluArgValVal-45
SEQ. ID. NO. 15530   53-GlyGluGlyAlaArgSer-58
SEQ. ID. NO. 15531   60-SerIleGlyAspArgAlaThr-66
SEQ. ID. NO. 15532   70-MetThrProGluPhe-74
SEQ. ID. NO. 15533   83-IleAspGluGlnThr-87
SEQ. ID. NO. 15534   94-ThrGlyArgAspAspAlaGlnValLysLeu-103
SEQ. ID. NO. 15535   133-SerValThrArgAsnMetAlaGlyProSerAsnProHis-145
SEQ. ID. NO. 15536   153-LeuAlaGlyLysGlyLeuAlaLysProTyrGluGluProSerAspGlyGlnMetProAspGlyAla-174
SEQ. ID. NO. 15537   183-CysThrAsnThrSerAsnProArgAsnVal-192
SEQ. ID. NO. 15538   206-GlyLeuGlnArgLysProTrpValLysSerSerPheAlaProGlySerLysValAla-224
SEQ. ID. NO. 15539   227-TyrLeuLysGluAlaAspLeuLeuProGluMetGluLysLeu-240
SEQ. ID. NO. 15540   251-ThrCysAsnGlyMetSerGlyAlaLeuAspProLysIleGlnLysGluIleIleAspArgAspLeuTyr-273
SEQ. ID. NO. 15541   279-SerGlyAsnArgAsnPheAspGlyArgIleHisProTyrAlaLys-293
SEQ. ID. NO. 15542   312-IleArgPheAspIleGluAsnAspVal-320
SEQ. ID. NO. 15543   322-GlyValAlaAspGlyLysGluIleArgLeuLysAspIleTrpProThrAspGluGluIleAsp-342
SEQ. ID. NO. 15544   348-TyrValLysProGlnGlnPheArgAsp-356
SEQ. ID. NO. 15545   363-AspThrGlyThrAlaGlnLysAlaProSerProLeuTyrAspTrpArgProMetSerThrTyrIleArgArgProProTyrTrp-390
SEQ. ID. NO. 15546   394-LeuAlaGlyGluArgThrLeuSerGlyMetArg-404
SEQ. ID. NO. 15547   409-LeuProAspAsnIleThrThrAspHisLeuSerProSerAsn-422
SEQ. ID. NO. 15548   438-GlyLeuProGluGluAspPheAsnSerTyrAlaThrHisArgGlyAspHisLeuThr-456
SEQ. ID. NO. 15549   463-AlaAsnProLysLeuPhe-468
SEQ. ID. NO. 15550   471-MetValArgAsnGluAspGlySerValArgGlnGlySerLeuAlaArgValGluProGluGlyGlnThr-493
SEQ. ID. NO. 15551   503-TyrMetAsnArgLysGlnPro-509
SEQ. ID. NO. 15552   516-AlaAspTyrGlyGlnGlySerSerArgAspTrpAlaAlaLysGlyValArg-532
SEQ. ID. NO. 15553   543-GlyPheGluArgIleHisArgThrAsnLeu-552
SEQ. ID. NO. 15554   562-PheLysProGlyThrAsnArgHisThrLeuGlnLeuAspGlyThrGluThrTyrAspValValGlyGluArgThrProArgCysAspLeu-591
SEQ. ID. NO. 15555   595-IleHisArgLysAsnGlyGluThrValGlu-604
SEQ. ID. NO. 15556   609-CysArgLeuAspThrAlaGluGlu-616

TABLE 1-continued

Hydrophilic Regions - Hopp-Woods
SEQ. ID. NO. 15557   18-LeuAsnGlyLysArgLysAlaGly-25
SEQ. ID. NO. 15558   38-PheLeuArgLysGluArgValVal-45
SEQ. ID. NO. 15559   53-GlyGluGlyAlaArg-57
SEQ. ID. NO. 15560   60-SerIleGlyAspArgAlaThr-66
SEQ. ID. NO. 15561   83-IleAspGluGlnThr-87
SEQ. ID. NO. 15562   94-ThrGlyArgAspAspAlaGlnValLysLeu-103
SEQ. ID. NO. 15563   157-GlyLeuAlaLysProTyrGluGluProSerAspGlyGlnMetPro-171
SEQ. ID. NO. 15564   227-TyrLeuLysGluAlaAlaAspLeuLeuProGluMetGluLysLeu-240
SEQ. ID. NO. 15565   259-LeuAspProLysIleGlnLysGluIleIleAspArgAspLeuTyr-273
SEQ. ID. NO. 15566   282-ArgAsnPheAspGlyArgIle-288
SEQ. ID. NO. 15567   312-IleArgPheAspIleGluAsnAspVal-320
SEQ. ID. NO. 15568   324-AlaAspGlyLysGluIleArgLeuLysAsp-333
SEQ. ID. NO. 15569   335-TrpProThrAspGluGluIleAsp-342
SEQ. ID. NO. 15570   366-ThrAlaGlnLysAlaPro-371
SEQ. ID. NO. 15571   394-LeuAlaGlyGluArgThrLeuSer-401
SEQ. ID. NO. 15572   438-GlyLeuProGluGluAspPheAsn-445
SEQ. ID. NO. 15573   450-HisArgGlyAspHisLeuThr-456
SEQ. ID. NO. 15574   471-MetValArgAsnGluAspGlySerValArgGln-481
SEQ. ID. NO. 15575   485-AlaArgValGluProGluGlyGlnThr-493
SEQ. ID. NO. 15576   503-TyrMetAsnArgLysGlnPro-509
SEQ. ID. NO. 15577   518-TyrGlyGlnGlySerSerArgAspTrpAlaAlaLysGlyValArg-532
SEQ. ID. NO. 15578   543-GlyPheGluArgIleHisArg-549
SEQ. ID. NO. 15579   564-ProGlyThrAsnArgHis-569
SEQ. ID. NO. 15580   574-AspGlyThrGluThr-578
SEQ. ID. NO. 15581   580-AspValValGlyGluArgThrProArgCysAsp-590
SEQ. ID. NO. 15582   595-IleHisArgLysAsnGlyGluThrValGlu-604
SEQ. ID. NO. 15583   609-CysArgLeuAspThrAlaGluGlu-616
a102
AMPHI Regions - AMPHI
SEQ. ID. NO. 15584   42-ValLeuLeuTyrThrTrpPheSerMetLeu-51
SEQ. ID. NO. 15585   67-GlyAlaXxxPheAspThrMetValLysAspLeuLeuGlyArgSerTrpAsnIleIleAsnGlyIleAla-89
SEQ. ID. NO. 15586   109-ThrAlaLysGlyLeuGlySerAlaAla-117
SEQ. ID. NO. 15587   128-LeuValPhePheGlyIleLeuAlaPheCys-137
SEQ. ID. NO. 15588   144-LeuValAspArgPheThrSerValLeu-152
SEQ. ID. NO. 15589   155-GlyMetValLeuThr-159
SEQ. ID. NO. 15590   207-AsnValSerSerLeuLeuLysTyrPheLys-216
SEQ. ID. NO. 15591   221-LysValAlaLysSerIle-226
SEQ. ID. NO. 15592   267-IleGluThrLeuSerLysPheAlaGlnThrGlyAsnMetAspLysIleLeuSerLeuPheSerTyrMetAla-290
SEQ. ID. NO. 15593   303-PheAspTyrIleAlaAspIlePheLysTrpAsnAsp-314
SEQ. ID. NO. 15594   341-PheValThrAlaIleGlyTyr-347
SEQ. ID. NO. 15595   352-AlaThrValTrpThrGlyIleIlePro-360
SEQ. ID. NO. 15596   374-GlyLysThrTyrLysVal-379
Antigenic Index - Jameson-Wolf
SEQ. ID. NO. 15597   1-MetProThrLysThrProSerLeu-8
SEQ. ID. NO. 15598   77-LeuLeuGlyArgSer-81
SEQ. ID. NO. 15599   107-AspLeuThrAlaLysGlyLeuGlySerAlaAlaGlyGly-119
SEQ. ID. NO. 15600   143-ArgLeuValAspArgPheThr-149
SEQ. ID. NO. 15601   179-ThrGlnAlaProThrGlyThrAsn-186
SEQ. ID. NO. 15602   214-TyrPheLysGlyAspAlaProLysValAla-223
SEQ. ID. NO. 15603   246-XxxAsnLeuProArgAsnGluPhe-253
SEQ. ID. NO. 15604   274-AlaGlnThrGlyAsnMetAspLysIle-282
SEQ. ID. NO. 15605   311-LysTrpAsnAspSerValSerGlyArgThrLysThr-322
SEQ. ID. NO. 15606   364-LeuTyrArgSerArgLysLysPheGlyAlaGlyLysThrTyrLysVal-379
Hydrophilic Regions - Hopp-Woods
SEQ. ID. NO. 15607   1-MetProThrLysThr-5
SEQ. ID. NO. 15608   143-ArgLeuValAspArgPheThr-149
SEQ. ID. NO. 15609   215-PheLysGlyAspAlaProLysValAla-223
SEQ. ID. NO. 15610   248-LeuProArgAsnGluPhe-253
SEQ. ID. NO. 15611   277-GlyAsnMetAspLys-281
SEQ. ID. NO. 15612   316-ValSerGlyArgThrLysThr-322
SEQ. ID. NO. 15613   366-ArgSerArgLysLysPheGlyAla-373
a105
AMPHI Regions - AMPHI
SEQ. ID. NO. 15614   11-TrpIleGlyLeuGly-15
SEQ. ID. NO. 15615   22-ValThrArgLeuLeuAsp-27
SEQ. ID. NO. 15616   51-LysValTyrGlyAsnThrAlaGluLeu-59
SEQ. ID. NO. 15617   74-AlaAlaValCysAspIleLeuAsnGlyValArgAspGlyLeu-87
SEQ. ID. NO. 15618   97-ThrIleSerProThr-101
SEQ. ID. NO. 15619   110-ValGluAlaAlaGlyGlyGlnPheAlaGluAlaProVal-122
SEQ. ID. NO. 15620   143-AlaValLeuAsnProLeuGlnLysIlePheSer-153
SEQ. ID. NO. 15621   162-PheGlyAspValGlyLysGlySer-169
SEQ. ID. NO. 15622   176-AsnSerLeuLeuGlyIlePheGlyGluAlaTyr-186
SEQ. ID. NO. 15623   203-IleValGluAlaIleGlyGlySerAla-211
SEQ. ID. NO. 15624   249-LeuGluGlnAlaGlyValAsnThrLeuProAlaValGlu-260
SEQ. ID. NO. 15625   263-AlaAlaSerTyrArgLysAlaValGluAla-272
Antigenic Index - Jameson-Wolf
SEQ. ID. NO. 15626   2-SerAlaAsnGluTyrThr-7
SEQ. ID. NO. 15627   25-LeuLeuAspGlyGlyIleGlu-31
SEQ. ID. NO. 15628   34-ValTyrAsnArgSerProAspLysThrAlaProIleSerAlaLysGlyAlaLysValTyrGlyAsnThr-56

TABLE 1-continued

| | |
|---|---|
| SEQ. ID. NO. 15629 | 81-AsnGlyValArgAspGlyLeuAla-88 |
| SEQ. ID. NO. 15630 | 96-SerThrIleSerProThrGluAsnLeuAla-105 |
| SEQ. ID. NO. 15631 | 121-ProValSerGlySerValGlyProAlaThr-130 |
| SEQ. ID. NO. 15632 | 139-GlyGlySerGluAla-143 |
| SEQ. ID. NO. 15633 | 155-ValGlyLysLysThrPheHisPheGlyAspValGlyLysGlySerGly-170 |
| SEQ. ID. NO. 15634 | 196-PheGlyIleAspThrAspThrIleVal-204 |
| SEQ. ID. NO. 15635 | 210-SerAlaMetAspSerProMetPheGlnThrLysLysSerLeuTrpAlaAsnArgGluPheProPro-231 |
| SEQ. ID. NO. 15636 | 237-HisAlaSerLysAspLeuAsnLeuAlaValLysGluLeuGluGlnAlaGlyAsnThrLeuPro-257 |
| SEQ. ID. NO. 15637 | 264-AlaSerTyrArgLysAlaValGluAlaGlyTyrGlyGluGlnAspValSerGly-281 |

Hydrophilic Regions - Hopp-Woods

| | |
|---|---|
| SEQ. ID. NO. 15638 | 25-LeuLeuAspGlyGlyIle-30 |
| SEQ. ID. NO. 15639 | 37-ArgSerProAspLysThrAlaProIleSerAlaLysGlyAlaLys-51 |
| SEQ. ID. NO. 15640 | 81-AsnGlyValArgAspGlyLeuAla-88 |
| SEQ. ID. NO. 15641 | 164-AspValGlyLysGlySerGly-170 |
| SEQ. ID. NO. 15642 | 196-PheGlyIleAspThrAspThrIle-203 |
| SEQ. ID. NO. 15643 | 218-GlnThrLysLysSerLeuTrpAla-225 |
| SEQ. ID. NO. 15644 | 237-HisAlaSerLysAspLeuAsnLeuAlaValLysGluLeuGluGlnAlaGly-253 |
| SEQ. ID. NO. 15645 | 265-SerTyrArgLysAlaValGlu-271 |
| SEQ. ID. NO. 15646 | 273-GlyTyrGlyGluGlnAspVal-279 | a109-2
AMPHI Regions - AMPHI

| | |
|---|---|
| SEQ. ID. NO. 15647 | 6-GlyThrTyrArgAspLeuHisArgProAlaSerGlu-17 |
| SEQ. ID. NO. 15648 | 53-LeuIleProAlaMetAlaGlyThrIleGly-62 |
| SEQ. ID. NO. 15649 | 69-AlaValAlaAlaAlaPhe-74 |
| SEQ. ID. NO. 15650 | 145-GlyLeuMetAla-149 |
| SEQ. ID. NO. 15651 | 156-IleMetAlaLysLeuThrSer-162 |
| SEQ. ID. NO. 15652 | 177-GlyThrThrGlyGlnValLysLysLeuPheSerTrpAlaGly-190 |
| SEQ. ID. NO. 15653 | 207-ValMetTyrAlaLeuLeuGluHisTrpLysLysArgTrpLeu-220 |
| SEQ. ID. NO. 15654 | 222-ValProLeuGlyCys-226 |
| SEQ. ID. NO. 15655 | 294-HisGlnValPheGlnLysIle-300 |
| SEQ. ID. NO. 15656 | 326-ValGlySerIleLeuGly-331 |
| SEQ. ID. NO. 15657 | 336-ThrSerSerTrpGlyThr-341 |
| SEQ. ID. NO. 15658 | 471-AlaValGlyMetLeuProGlyIleProProPheLeuGluHisPheLysSerLeu-488 |

Antigenic Index - Jameson-Wolf

| | |
|---|---|
| SEQ. ID. NO. 15659 | 1-MetGluLysHisAsnGlyThrTyrArgAspLeuHisArgProAlaSer-16 |
| SEQ. ID. NO. 15660 | 18-PheAlaThrArgAspGluTyrLeuGlu-26 |
| SEQ. ID. NO. 15661 | 32-MetGlnProLysArgTrpArgProAsnLeuProPheArgAspTyrArgPheGluTrp-50 |
| SEQ. ID. NO. 15662 | 78-LeuGlyLeuProAsp-82 |
| SEQ. ID. NO. 15663 | 109-ProGlyAlaAsnLeuProGlyThrHis-117 |
| SEQ. ID. NO. 15664 | 160-LeuThrSerAsnGlyVal-165 |
| SEQ. ID. NO. 15665 | 179-ThrGlyGlnValLysLys-184 |
| SEQ. ID. NO. 15666 | 245-AlaProGlyLeuProPro-250 |
| SEQ. ID. NO. 15667 | 259-GluAsnSerGlyTrp-263 |
| SEQ. ID. NO. 15668 | 301-SerTyrProGluLysThrAspLysVal-309 |
| SEQ. ID. NO. 15669 | 312-AsnIleAspAspThrMetThr-318 |
| SEQ. ID. NO. 15670 | 348-IleAlaLysArgProIleProGlyGly-356 |
| SEQ. ID. NO. 15671 | 398-AlaGlyMetGluMetThrArgLysGlyLysThrThrGlnSer-411 |
| SEQ. ID. NO. 15672 | 441-GlyCysLysGluArgSerAla-447 |

Hydrophilic Regions - Hopp-Woods

| | |
|---|---|
| SEQ. ID. NO. 15673 | 1-MetGluLysHisAsnGlyThrTyrArgAspLeuHisArgProAlaSer-16 |
| SEQ. ID. NO. 15674 | 18-PheAlaThrArgAspGluTyrLeuGlu-26 |
| SEQ. ID. NO. 15675 | 35-LysArgTrpArgPro-39 |
| SEQ. ID. NO. 15676 | 44-ArgAspTyrArgPheGluTrp-50 |
| SEQ. ID. NO. 15677 | 180-GlyGlnValLysLys-184 |
| SEQ. ID. NO. 15678 | 301-SerTyrProGluLysThrAspLysVal-309 |
| SEQ. ID. NO. 15679 | 313-IleAspAspThrMetThr-318 |
| SEQ. ID. NO. 15680 | 348-IleAlaLysArgProIlePro-354 |
| SEQ. ID. NO. 15681 | 398-AlaGlyMetGluMetThrArgLysGlyLysThrThrGln-410 |
| SEQ. ID. NO. 15682 | 441-GlyCysLysGluArgSerAla-447 | a111
AMPHI Regions - AMPHI

| | |
|---|---|
| SEQ. ID. NO. 15683 | 6-ArgLeuProAsnPheIleArgThrLeu-14 |
| SEQ. ID. NO. 15684 | 58-ProSerProAlaGluIleGlnLysArgIleAspAspAlaLeuLysGluValAsnArgGlnMetSer-79 |
| SEQ. ID. NO. 15685 | 90-PheAsnGlnHisThrAlaGly-96 |
| SEQ. ID. NO. 15686 | 128-GlyProLeuValAsnLeuTrp-134 |
| SEQ. ID. NO. 15687 | 151-IleLysGlnAlaAlaSerTyrThrGly-159 |
| SEQ. ID. NO. 15688 | 170-AspTyrAlaSerLeu-174 |
| SEQ. ID. NO. 15689 | 183-LeuAspLeuSerSerIleAlaLys-190 |
| SEQ. ID. NO. 15690 | 209-TyrLeuValGluIleGlyGly-215 |
| SEQ. ID. NO. 15691 | 314-GluThrGluAlaLeu-318 |

Antigenic Index - Jameson-Wolf

| | |
|---|---|
| SEQ. ID. NO. 15692 | 1-MetProSerGluThrArgLeuProAsnPhe-10 |
| SEQ. ID. NO. 15693 | 26-CysSerGluGlnThrAla-31 |
| SEQ. ID. NO. 15694 | 37-GlnGlyGluThrMetGly-42 |
| SEQ. ID. NO. 15695 | 49-TyrLeuSerAsnAsnArgAspLysAspLeuProSerProAlaGluIleGlnLysArgIleAspAspAlaLeuLysGluValAsnArgGlnMetSerThrTyrGlnProAspSerGluIleSerArgPheAsnGlnHisThrAlaGlyLysProLeuArgIleSerSerAspPhe-105 |
| SEQ. ID. NO. 15696 | 135-GlyPheGlyProAspLysSerValThrArgGluProSerProGluGlnIleLysGln-153 |
| SEQ. ID. NO. 15697 | 163-IleIleLeuLysGlnGlyLysAspTyrAlaSerLeuSerLysThrHisProLysAla-181 |
| SEQ. ID. NO. 15698 | 192-PheGlyValAspLysValAlaGlyGluLeuGluLysTyrGly-205 |
| SEQ. ID. NO. 15699 | 213-IleGlyGlyGluLeuHisGlyLysGlyLysAsnAlaArgGlyGluProTrpArgIleGlyIleGluGlnProAsnIle-238 |

TABLE 1-continued

| | |
|---|---|
| SEQ. ID. NO. 15700 | 250-LeuAsnAsnArgSerLeuAlaThrSerGlyAspTyrArg-262 |
| SEQ. ID. NO. 15701 | 264-PheHisValAspLysSerGlyLysArgLeuSer-274 |
| SEQ. ID. NO. 15702 | 277-IleAsnProAsnAsnLysArgProIleSer-286 |
| SEQ. ID. NO. 15703 | 299-AlaMetThrAlaAspGlyLeuSer-306 |
| SEQ. ID. NO. 15704 | 314-GluThrGluAlaLeuLysLeuAlaGluArgGluLysLeu-326 |
| SEQ. ID. NO. 15705 | 332-ValArgAspLysGlyGlyTyrArg-339 |
| SEQ. ID. NO. 15706 | 342-MetSerSerGluPheGluLysLeuLeuArg-351 |

Hydrophilic Regions - Hopp-Woods

| | |
|---|---|
| SEQ. ID. NO. 15707 | 1-MetProSerGluThrArgLeu-7 |
| SEQ. ID. NO. 15708 | 26-CysSerGluGlnThrAla-31 |
| SEQ. ID. NO. 15709 | 51-SerAsnAsnArgAspLysLeuProSer-59 |
| SEQ. ID. NO. 15710 | 61-AlaGluIleGlnLysArgIleAspAspAlaLeuLysGluValAsnArgGln-77 |
| SEQ. ID. NO. 15711 | 82-GlnProAspSerGluIleSerArg-89 |
| SEQ. ID. NO. 15712 | 97-LysProLeuArgIleSerSer-103 |
| SEQ. ID. NO. 15713 | 137-GlyProAspLysSerValThrArgGluProSerProGluGlnIleLysGln-153 |
| SEQ. ID. NO. 15714 | 163-IleIleLeuLysGlnGlyLysAspTyrAlaSer-173 |
| SEQ. ID. NO. 15715 | 175-SerLysThrHisPro-179 |
| SEQ. ID. NO. 15716 | 192-PheGlyValAspLysValAlaGlyGluLeuGluLysTyrGly-205 |
| SEQ. ID. NO. 15717 | 217-LeuHisGlyLysGlyLysAsnAlaArgGlyGluProTrp-229 |
| SEQ. ID. NO. 15718 | 265-HisValAspLysSerGlyLysArgLeuSer-274 |
| SEQ. ID. NO. 15719 | 279-ProAsnAsnLysArgProIle-285 |
| SEQ. ID. NO. 15720 | 314-GluThrGluAlaLeuLysLeuAlaGluArgGluLysLeu-326 |
| SEQ. ID. NO. 15721 | 332-ValArgAspLysGlyGlyTyr-338 |
| SEQ. ID. NO. 15722 | 344-SerGluPheGluLysLeuLeuArg-351 | a117-1
AMPHI Regions - AMPHI

| | |
|---|---|
| SEQ. ID. NO. 15723 | 6-ProIleGlnAspThrGlnSerAla-13 |
| SEQ. ID. NO. 15724 | 15-LeuGlnGluLeuArgGluTrpPheAspSerTyrCysThr-27 |
| SEQ. ID. NO. 15725 | 57-GlyGluProLeuProAspHis-63 |
| SEQ. ID. NO. 15726 | 72-HisGluLeuAspLeuLeu-77 |
| SEQ. ID. NO. 15727 | 79-AspAlaValAlaAlaThrLeuLeuAlaAspIleGlyArgTyr-92 |
| SEQ. ID. NO. 15728 | 104-CysAsnSerThrValAlaGluLeuValLysGlyValAspGluValGlnLysLeuThrHisPheAlaArgValAspSerLeu-130 |
| SEQ. ID. NO. 15729 | 145-LysMetLeuLeuAlaMet-150 |
| SEQ. ID. NO. 15730 | 170-PheLeuSerAsnAlaProAspSerProGluLys-180 |
| SEQ. ID. NO. 15731 | 216-GluProGluLysTyrArg-221 |
| SEQ. ID. NO. 15732 | 234-ArgLeuGluTyrIleGluAsnPheLeuAsnIleLeuArg-246 |
| SEQ. ID. NO. 15733 | 260-GlyArgProLysHisIleTyrSerIleTyrLys-270 |
| SEQ. ID. NO. 15734 | 282-LeuPheAspIleArg-286 |
| SEQ. ID. NO. 15735 | 290-IleLeuValAspThrValProGluCysTyrThrThrLeuGlyIleVal HisSerLeuTrpGlnProIleProGlyGluPheAspAspTyrIleAla-321 |
| SEQ. ID. NO. 15736 | 327-GlyTyrLysSerLeuHisThr-333 |
| SEQ. ID. NO. 15737 | 351-AspMetHisGlnPheAsnGluPheGlyValAla-361 |
| SEQ. ID. NO. 15738 | 385-GlnLeuLeuAspTrp-389 |
| SEQ. ID. NO. 15739 | 440-HisSerSerIleGlyAspArg-446 |
| SEQ. ID. NO. 15740 | 493-LysAlaIleGlyLysIleArgAlaTyr-501 |
| SEQ. ID. NO. 15741 | 504-GlnGlnAsnAlaAsp-508 |
| SEQ. ID. NO. 15742 | 521-GlnLeuAlaLysLeu-525 |
| SEQ. ID. NO. 15743 | 532-GlnGluLeuAlaGlu-536 |
| SEQ. ID. NO. 15744 | 539-GlyTyrLysLysProGluAspLeuTyrThr-548 |
| SEQ. ID. NO. 15745 | 557-AsnArgAlaIleGlnLysAlaCysSerGlyThrLeuAsnGluProPro-571 |
| SEQ. ID. NO. 15746 | 585-LysIleLysLysGlyGly-590 |
| SEQ. ID. NO. 15747 | 603-MetThrThrLeuAlaLysCysCysLysProAla-613 |
| SEQ. ID. NO. 15748 | 616-AspAspIleValGly-620 |
| SEQ. ID. NO. 15749 | 637-SerPheArgHisLeuAlaGluHisAlaProGluLysValLeuAspAla-652 |
| SEQ. ID. NO. 15750 | 679-ArgAspValSerAspAla-684 |
| SEQ. ID. NO. 15751 | 714-GlnValThrAspLeuProArgValLeuAlaSerLeuGlyAspValLysGlyValLeuSerValThrArg-736 |

Antigenic Index - Jameson-Wolf

| | |
|---|---|
| SEQ. ID. NO. 15752 | 5-SerProIleGlnAspThrGlnSerAlaThr-14 |
| SEQ. ID. NO. 15753 | 16-GlnGluLeuArgGluTrpPheAspSerTyrCysThrAlaLeuProAsnAsnAspLysLysLeu-36 |
| SEQ. ID. NO. 15754 | 52-AlaAlaThrProTyrGlyGluProLeuProAspHisPhe-64 |
| SEQ. ID. NO. 15755 | 88-AspIleGlyArgTyrValProAspTrp-96 |
| SEQ. ID. NO. 15756 | 100-ValSerGluArgCysAsnSerThrVal-108 |
| SEQ. ID. NO. 15757 | 110-GluLeuValLysGlyValAspGluValGlnLys-120 |
| SEQ. ID. NO. 15758 | 125-AlaArgValAspSerLeuAlaThrProGluGluArgAlaGlnGlnAlaGluThrMetArg-144 |
| SEQ. ID. NO. 15759 | 162-AlaMetArgThrArgThr-167 |
| SEQ. ID. NO. 15760 | 173-AsnAlaProAspSerProGluLysArgAlaValAlaLysGluThrLeu-188 |
| SEQ. ID. NO. 15761 | 209-AspLeuGlyPheArgHisGlnGluProGluLysTyrArgGlu-222 |
| SEQ. ID. NO. 15762 | 227-LeuAspGluLysArgThrGluArgLeuGluTyr-237 |
| SEQ. ID. NO. 15763 | 245-LeuArgThrGluLeuLysLys-251 |
| SEQ. ID. NO. 15764 | 258-ValAlaGlyArgProLysHis-264 |
| SEQ. ID. NO. 15765 | 271-LysMetValLysLysLysLeuSerPhe-279 |
| SEQ. ID. NO. 15766 | 294-ThrValProGluCysTyr-299 |
| SEQ. ID. NO. 15767 | 311-ProIleProGlyGluPheAspAspTyrIleAlaAsnProLysGlyAsnGlyTyrLysSer-330 |
| SEQ. ID. NO. 15768 | 335-IleValGlyProGluAspLysGlyValGluValGlnIleArgThr-349 |
| SEQ. ID. NO. 15769 | 364-TrpArgTyrLysGluGlyGlyLysGlyAspSerAlaTyrGluGlnLys-379 |
| SEQ. ID. NO. 15770 | 387-LeuAspTrpArgGluAsnMetAlaGluSerGlyLysGluAspLeuAlaAla-403 |
| SEQ. ID. NO. 15771 | 418-ThrProHisGlyLys-422 |
| SEQ. ID. NO. 15772 | 440-HisSerSerIleGlyAspArgCysArgGlyAlaLysValGluGly-454 |
| SEQ. ID. NO. 15773 | 461-ThrProLeuGluAsnGlyGlnArgValGluIleIleThrAlaLysGluGlyHisProSerValAsn-482 |
| SEQ. ID. NO. 15774 | 487-GlyTrpValLysSerAsnLysAlaIleGlyLys-497 |

TABLE 1-continued

| | |
|---|---|
| SEQ. ID. NO. 15775 | 502-IleArgGlnGlnAsnAlaAspThrValArgGluGluGlyArgValGlnLeuAspLysGlnLeuAla-523 |
| SEQ. ID. NO. 15776 | 525-LeuThrProLysProAsnLeuGlnGluLeuAlaGlu-536 |
| SEQ. ID. NO. 15777 | 538-LeuGlyTyrLysLysProGluAspLeu-546 |
| SEQ. ID. NO. 15778 | 551-GlyGlnGlyGluIleSerAsnArgAlaIleGlnLysAlaCysGlyThrLeuAsnGluProProProValPro-574 |
| SEQ. ID. NO. 15779 | 582-LysGlnSerLysIleLysLysGlyGlyLysAsnGlyVal-594 |
| SEQ. ID. NO. 15780 | 596-IleAspGlyGluAspGlyLeu-602 |
| SEQ. ID. NO. 15781 | 608-LysCysCysLysProAlaProProAspAspIleVal-619 |
| SEQ. ID. NO. 15782 | 622-ValThrArgAspArgGlyIleSerValHisArgLysThrCysProSerPhe-638 |
| SEQ. ID. NO. 15783 | 644-HisAlaProGluLysValLeuAsp-651 |
| SEQ. ID. NO. 15784 | 667-IleGluIleArgAlaGlnAspArgSerGlyLeuLeuArgAspValSerAspAlaLeuAlaArgHisLysLeu-690 |
| SEQ. ID. NO. 15785 | 696-GlnThrGlnSerArgAspLeuGluAlaSerMet-706 |
| SEQ. ID. NO. 15786 | 710-LeuGluValLysGlnValThrAspLeuProArg-720 |
| SEQ. ID. NO. 15787 | 726-GlyAspValLysGly-730 |
| Hydrophilic Regions - Hopp-Woods | |
| SEQ. ID. NO. 15788 | 8-GlnAspThrGlnSer-12 |
| SEQ. ID. NO. 15789 | 16-GlnGluLeuArgGluTrpPhe-22 |
| SEQ. ID. NO. 15790 | 30-ProAsnAsnAspLysLysLeu-36 |
| SEQ. ID. NO. 15791 | 100-ValSerGluArgCysAsnSerThr-107 |
| SEQ. ID. NO. 15792 | 110-GluLeuValLysGlyValAspGluValGlnLys-120 |
| SEQ. ID. NO. 15793 | 125-AlaArgValAspSer-129 |
| SEQ. ID. NO. 15794 | 131-AlaThrProGluGluArgAlaGlnGlnAlaGluThrMetArg-144 |
| SEQ. ID. NO. 15795 | 162-AlaMetArgThrArgThr-167 |
| SEQ. ID. NO. 15796 | 174-AlaProAspSerProGluLysArgAlaValAlaLysGluThrLeu-188 |
| SEQ. ID. NO. 15797 | 209-AspLeuGlyPheArgHisGlnGluProGluLysTyrArgGlu-222 |
| SEQ. ID. NO. 15798 | 227-LeuAspGluLysArgThrGluArgLeuGluTyr-237 |
| SEQ. ID. NO. 15799 | 245-LeuArgThrGluLeuLysLys-251 |
| SEQ. ID. NO. 15800 | 258-ValAlaGlyArgProLysHis-264 |
| SEQ. ID. NO. 15801 | 271-LysMetValLysLysLysLeuSerPhe-279 |
| SEQ. ID. NO. 15802 | 314-GlyGluPheAspAsp-318 |
| SEQ. ID. NO. 15803 | 323-ProLysGlyAsnGly-327 |
| SEQ. ID. NO. 15804 | 337-GlyProGluAspLysGlyValGluValGlnIleArgThr-349 |
| SEQ. ID. NO. 15805 | 365-ArgTyrLysGluGlyGlyLysGlyAspSerAlaTyrGluGln-378 |
| SEQ. ID. NO. 15806 | 387-LeuAspTrpArgGluAsnMetAlaGluSerGlyLysGluAspLeuAlaAla-403 |
| SEQ. ID. NO. 15807 | 443-IleGlyAspArgCysArgGlyAlaLysValGluGly-454 |
| SEQ. ID. NO. 15808 | 463-LeuGluAsnGlyGlnArgValGluIleIleThrAlaLysGluGlyHisPro-479 |
| SEQ. ID. NO. 15809 | 489-ValLysSerAsnLysAlaIleGlyLys-497 |
| SEQ. ID. NO. 15810 | 505-GlnAsnAlaAspThrValArgGluGluGlyArgValGlnLeuAspLysGlnLeuAla-523 |
| SEQ. ID. NO. 15811 | 538-LeuGlyTyrLysLysProGluAspLeu-546 |
| SEQ. ID. NO. 15812 | 553-GlyGluIleSerAsn-557 |
| SEQ. ID. NO. 15813 | 582-LysGlnSerLysIleLysLysGlyGlyLys-591 |
| SEQ. ID. NO. 15814 | 596-IleAspGlyGluAspGlyLeu-602 |
| SEQ. ID. NO. 15815 | 608-LysCysCysLysProAlaProProAspAspIle-618 |
| SEQ. ID. NO. 15816 | 622-ValThrArgAspArgGlyIleSerValHisArgLysThrCysPro-636 |
| SEQ. ID. NO. 15817 | 644-HisAlaProGluLysValLeu-650 |
| SEQ. ID. NO. 15818 | 667-IleGluIleArgAlaGlnAspArgSerGlyLeuLeuArgAspValSerAspAlaLeuAlaArgHisLysLeu-690 |
| SEQ. ID. NO. 15819 | 697-ThrGlnSerArgAspLeuGluAlaSerMet-706 |
| SEQ. ID. NO. 15820 | 710-LeuGluValLysGlnValThrAspLeuProArg-720 |
| SEQ. ID. NO. 15821 | 726-GlyAspValLysGly-730 |
| a118 | |
| AMPHI Regions - AMPHI | |
| SEQ. ID. NO. 15822 | 24-GlyLysTrpTyrAsp-28 |
| SEQ. ID. NO. 15823 | 57-IleProArgAspIle-61 |
| SEQ. ID. NO. 15824 | 65-IleGlyThrIleIleAspPheLeuMetValProAsn-76 |
| SEQ. ID. NO. 15825 | 94-IleHisGluArgTyrGluArgPheThrThrMetLeuArg-106 |
| Antigenic Index - Jameson-Wolf | |
| SEQ. ID. NO. 15826 | 2-CysGluPheLysAspPheArgArgAsnIleProCys-13 |
| SEQ. ID. NO. 15827 | 15-GluGluTyrAspGluAsnSerPhe-22 |
| SEQ. ID. NO. 15828 | 24-GlyLysTrpTyrAspAspGlyValTrpAspAspGluGluTyrTrpLys LeuGluAsnAspLeuIleGluValArgLysLysTyrProTyrProMetAspIleProArgAspIle-61 |
| SEQ. ID. NO. 15829 | 86-ProTrpLeuProAspSer-91 |
| SEQ. ID. NO. 15830 | 93-GlyIleHisGluArgTyrGluArg-100 |
| SEQ. ID. NO. 15831 | 109-PheThrGluLysAspIleVal-115 |
| SEQ. ID. NO. 15832 | 119-PheAspTyrTyrAsnLysLys-125 |
| Hydrophilic Regions - Hopp-Woods | |
| SEQ. ID. NO. 15833 | 2-CysGluPheLysAspPheArgArgAsnIleProCys-13 |
| SEQ. ID. NO. 15834 | 15-GluGluTyrAspGlu-19 |
| SEQ. ID. NO. 15835 | 30-GlyValTrpAspAspGluGluTyrTrpLysLeuGluAsnAspLeuIleGluValArgLysLysTyrProTyr-53 |
| SEQ. ID. NO. 15836 | 96-GluArgTyrGluArg-100 |
| SEQ. ID. NO. 15837 | 109-PheThrGluLysAspIleVal-115 |
| SEQ. ID. NO. 15838 | 121-TyrTyrAsnLysLys-125 |
| a120 | |
| AMPHI Regions - AMPHI | |
| SEQ. ID. NO. 15839 | 6-LysAsnIlePheSerAla-11 |
| SEQ. ID. NO. 15840 | 49-SerGlyAsnAlaTyrLysIleValSerThrIleLys-60 |
| SEQ. ID. NO. 15841 | 77-AsnThrLeuHisProThrTyrTyrArgAspIleArgArg-89 |
| SEQ. ID. NO. 15842 | 142-IleThrAsnGlyLysLysLeuTyrSerValGlyGlyLeuAsnLysAlaGly-158 |
| SEQ. ID. NO. 15843 | 189-ProSerLeuAsnAsnIleProAla-196 |
| Antigenic Index - Jameson-Wolf | |
| SEQ. ID. NO. 15844 | 35-SerGlySerTyrGly-39 |
| SEQ. ID. NO. 15845 | 45-ThrPheGluArgSerGlyAsnAlaTyrLys-54 |

TABLE 1-continued

| SEQ. ID. NO. | Sequence |
|---|---|
| SEQ. ID. NO. 15846 | 68-PheGluSerGlyGlyThrValVal-75 |
| SEQ. ID. NO. 15847 | 85-ArgAspIleArgArgGlyLysLeuTyrAlaGlu-95 |
| SEQ. ID. NO. 15848 | 97-LysPheAlaAspGlySerValThrTyrGlyLysAlaGlyGluSerLysThrGluGlnSerProLysAla-119 |
| SEQ. ID. NO. 15849 | 131-AlaAsnAspAlaLysLeuProProGlyLeuLysIleThrAsnGlyLysLysLeuTyrSer-150 |
| SEQ. ID. NO. 15850 | 153-GlyLeuAsnLysAlaGlyThrGlyLysTyrSerIleGlyGlyValGluThrGluValValLysTyrArgValArgArgGlyAspAspAlaVal-183 |
| SEQ. ID. NO. 15851 | 199-GlyTyrThrAspAspGlyLysThrTyr-207 |
| SEQ. ID. NO. 15852 | 218-GlyGlnAlaAlaLysPro-223 |

Hydrophilic Regions - Hopp-Woods

| SEQ. ID. NO. | Sequence |
|---|---|
| SEQ. ID. NO. 15853 | 45-ThrPheGluArgSerGlyAsn-51 |
| SEQ. ID. NO. 15854 | 85-ArgAspIleArgArgGlyLysLeuTyrAla-94 |
| SEQ. ID. NO. 15855 | 107-LysAlaGlyGluSerLysThrGluGlnSerProLysAla-119 |
| SEQ. ID. NO. 15856 | 131-AlaAsnAspAlaLysLeu-136 |
| SEQ. ID. NO. 15857 | 143-ThrAsnGlyLysLysLeuTyr-149 |
| SEQ. ID. NO. 15858 | 155-AsnLysAlaGlyThrGly-160 |
| SEQ. ID. NO. 15859 | 167-ValGluThrGluValValLysTyrArgValArgArgGlyAspAspAla-182 |
| SEQ. ID. NO. 15860 | 200-TyrThrAspAspGlyLysThrTyr-207 |
| SEQ. ID. NO. 15861 | 219-GlnAlaAlaLysPro-223 | a121-1
AMPHI Regions - AMPHI

| SEQ. ID. NO. | Sequence |
|---|---|
| SEQ. ID. NO. 15862 | 68-GlnGluLeuSerArgLeuTyrAlaGlnThr-77 |
| SEQ. ID. NO. 15863 | 101-ThrValArgHisAlaPro-106 |
| SEQ. ID. NO. 15864 | 148-ProAlaPheHisGlu-152 |
| SEQ. ID. NO. 15865 | 165-LeuAsnIleGlyGlyIleAlaAsnIle-173 |
| SEQ. ID. NO. 15866 | 189-ProGlyAsnMetLeuMetAspAlaTrpMetGlnAla-200 |
| SEQ. ID. NO. 15867 | 216-GlyAsnIleLeuProGlnLeuLeuAspArgLeuLeu-227 |
| SEQ. ID. NO. 15868 | 237-ProLysSerThrGly-241 |
| SEQ. ID. NO. 15869 | 251-GluThrTyrLeuAsp-255 |
| SEQ. ID. NO. 15870 | 262-AspValLeuArgThrLeuSerArgPheThrAlaGlnThrValPheAspAlaValSerHis-281 |
| SEQ. ID. NO. 15871 | 303-AlaAspLeuAlaGluCysPhe-309 |
| SEQ. ID. NO. 15872 | 341-ValAsnArgIleProGlySerPro-348 |

Antigenic Index - Jameson-Wolf

| SEQ. ID. NO. | Sequence |
|---|---|
| SEQ. ID. NO. 15873 | 13-ThrSerMetAspGlyAlaAsp-19 |
| SEQ. ID. NO. 15874 | 23-IleArgMetAspGlyLysTrpLeuGly-32 |
| SEQ. ID. NO. 15875 | 40-ProTyrProGlyArgLeuArgArgLysLeuLeuLeuAspLeuGlnAspThrGlyAlaAspGluLeuHisArgSerArgMetLeuSer-67 |
| SEQ. ID. NO. 15876 | 86-AsnLeuAlaProSerAspIleThrAla-94 |
| SEQ. ID. NO. 15877 | 97-CysHisGlyGlnThrValArgHisAlaProGluHisSerTyrSer-111 |
| SEQ. ID. NO. 15878 | 119-LeuLeuAlaGluArgThrGln-125 |
| SEQ. ID. NO. 15879 | 129-ValGlyAspPheArgSerArgAspLeuAlaAlaGlyGlyGlnGly-143 |
| SEQ. ID. NO. 15880 | 154-LeuPheArgAspAspArgGluThrArgAla-163 |
| SEQ. ID. NO. 15881 | 177-ProProAspAlaPro-181 |
| SEQ. ID. NO. 15882 | 184-GlyPheAspThrGlyProGlyAsn-191 |
| SEQ. ID. NO. 15883 | 205-ProTyrAspLysAsnGlyAlaLysAlaAlaGlnGlyAsn-217 |
| SEQ. ID. NO. 15884 | 235-ProHisProLysSerThrGlyArgGlu-243 |
| SEQ. ID. NO. 15885 | 253-TyrLeuAspGlyGlyGluAsnArgTyrAspValLeuArgThrLeuSer-268 |
| SEQ. ID. NO. 15886 | 283-AlaAlaAspAlaArgGln-288 |
| SEQ. ID. NO. 15887 | 293-GlyGlyGlyIleArgAsnProValLeu-301 |
| SEQ. ID. NO. 15888 | 344-IleProGlySerProHisLysAlaThrGlyAlaSerLysProCysIle-359 |

Hydrophilic Regions - Hopp-Woods

| SEQ. ID. NO. | Sequence |
|---|---|
| SEQ. ID. NO. 15889 | 13-ThrSerMetAspGlyAlaAsp-19 |
| SEQ. ID. NO. 15890 | 43-GlyArgLeuArgArgLysLeuLeuLeuAspLeuGlnAspThrGlyAlaAspGluLeuHisArgSerArgMetLeuSer-67 |
| SEQ. ID. NO. 15891 | 101-ThrValArgHisAlaPro-106 |
| SEQ. ID. NO. 15892 | 119-LeuLeuAlaGluArgThrGln-125 |
| SEQ. ID. NO. 15893 | 131-AspPheArgSerArgAspLeuAlaAla-139 |
| SEQ. ID. NO. 15894 | 154-LeuPheArgAspAspArgGluThrArgAla-163 |
| SEQ. ID. NO. 15895 | 206-TyrAspLysAsnGlyAlaLysAlaAlaGln-215 |
| SEQ. ID. NO. 15896 | 236-HisProLysSerThrGlyArgGlu-243 |
| SEQ. ID. NO. 15897 | 254-LeuAspGlyGlyGluAsnArgTyrAspVal-263 |
| SEQ. ID. NO. 15898 | 283-AlaAlaAspAlaArgGln-288 |
| SEQ. ID. NO. 15899 | 344-IleProGlySerProHisLysAlaThrGlyAlaSer-355 | a122-1
AMPHI Regions - AMPHI

| SEQ. ID. NO. | Sequence |
|---|---|
| SEQ. ID. NO. 15900 | 6-AsnIleHisLysThrPhe-11 |
| SEQ. ID. NO. 15901 | 42-ThrPheLeuArgCysLeuAsnAlaLeuGluMetProGlu-54 |
| SEQ. ID. NO. 15902 | 102-LeuGluAsnValMetGlu-107 |
| SEQ. ID. NO. 15903 | 126-LysLeuLeuGluLys-130 |
| SEQ. ID. NO. 15904 | 176-ProGluLeuValGlnAspValLeuAsnAlaMetLysGluLeuAlaArgGluGly-193 |
| SEQ. ID. NO. 15905 | 227-ProLysGluLeuPheAspHisPro-234 |

Antigenic Index - Jameson-Wolf

| SEQ. ID. NO. | Sequence |
|---|---|
| SEQ. ID. NO. 15906 | 5-ArgAsnIleHisLysThrPheGlyLysAsnThrIle-16 |
| SEQ. ID. NO. 15907 | 23-AspValCysLysGlyGln-28 |
| SEQ. ID. NO. 15908 | 34-GlyProSerGlySerGlyLysThrThr-42 |
| SEQ. ID. NO. 15909 | 51-GluMetProGluAspGlyGlnIleGluPheAspAsnGluArgProLeuLys IleAspPheSerLysLysProSerLysHisAspIle-79 |
| SEQ. ID. NO. 15910 | 81-AlaLeuArgArgLysSerGlyMet-88 |
| SEQ. ID. NO. 15911 | 96-PheProHisLysThrAlaLeu-102 |
| SEQ. ID. NO. 15912 | 114-GlyLysProAlaAlaGlnAlaArgGluGluAlaLeuLysLeuLeuGlu-129 |
| SEQ. ID. NO. 15913 | 131-ValGlyLeuGlyAspLysValAspLeu-139 |
| SEQ. ID. NO. 15914 | 145-SerGlyGlyGlnGlnGlnArgValGlyIle-154 |
| SEQ. ID. NO. 15915 | 168-AspGluProThrSerAlaLeuAspProGluLeuVal-179 |

TABLE 1-continued

SEQ. ID. NO. 15916   184-AsnAlaMetLysGluLeuAlaArgGluGlyTrp-194
SEQ. ID. NO. 15917   222-ValGluGlnGlySerProLysGluLeuPheAspHisProLysHisGluArgThrArgArgPheLeuSer-244
Hydrophilic Regions - Hopp-Woods
SEQ. ID. NO. 15918   51-GluMetProGluAspGlyGlnIleGluPheAspAsnGluArgProLeuLysIleAspPheSerLysLysProSerLysHisAsp-78
SEQ. ID. NO. 15919   81-AlaLeuArgArgLysSerGly-87
SEQ. ID. NO. 15920   114-GlyLysProAlaAlaGlnAlaArgGluGluAlaLeuLysLeuLeuGlu-129
SEQ. ID. NO. 15921   131-ValGlyLeuGlyAspLysValAsp-138
SEQ. ID. NO. 15922   168-AspGluProThrSerAlaLeuAspProGluLeuVal-179
SEQ. ID. NO. 15923   184-AsnAlaMetLysGluLeuAlaArg-191
SEQ. ID. NO. 15924   224-GlnGlySerProLysGluLeuPheAspHisProLysHisGluArgThrArgArgPheLeu-243
a126-1
AMPHI Regions - AMPHI
SEQ. ID. NO. 15925   26-LeuLysGlnSerValArg-31
SEQ. ID. NO. 15926   73-GlyCysGlnSerValGlnGluAla-80
SEQ. ID. NO. 15927   112-PheGlnLeuValGluAla-117
SEQ. ID. NO. 15928   143-LeuAspAlaGlyCysGln-148
SEQ. ID. NO. 15929   150-LeuMetProTrpAlaAlaProIleGlyThrGlyLeuGlyAlaVal-164
SEQ. ID. NO. 15930   213-SerGlyAspProValAsnMetAlaArgAlaPhe-223
Antigenic Index - Jameson-Wolf
SEQ. ID. NO. 15931   7-GluThrPheProSerArgLeu-13
SEQ. ID. NO. 15932   24-GluIleLeuLysGlnSerValArgThrAlaArg-34
SEQ. ID. NO. 15933   41-SerLeuArgArgAlaGlyCysGlyGlyGluAlaHisGlyGlnGlyPhe-56
SEQ. ID. NO. 15934   85-GlnMetAlaArgGluValPheGlu-92
SEQ. ID. NO. 15935   99-GluLeuIleGlyAspAspAspThrLeuGln-108
SEQ. ID. NO. 15936   121-LeuIleLysAspGlyPheLysValLeu-129
SEQ. ID. NO. 15937   141-ArgLeuLeuAspAlaGlyCys-147
SEQ. ID. NO. 15938   171-ValLeuArgGluArgLeuProAspThrProLeu-181
SEQ. ID. NO. 15939   209-AlaValSerArgSerGlyAspProValAsn-218
SEQ. ID. NO. 15940   228-GluSerGlyArgLeuAlaPhe-234
SEQ. ID. NO. 15941   237-GlyProValGluAlaArgAspLysAlaGlnAlaSerThrProThrVal-252
Hydrophilic Regions - Hopp-Woods
SEQ. ID. NO. 15942   24-GluIleLeuLysGlnSerValArgThrAlaArg-34
SEQ. ID. NO. 15943   41-SerLeuArgArgAlaGlyCysGlyGlyGluAlaHis-52
SEQ. ID. NO. 15944   85-GlnMetAlaArgGluValPheGlu-92
SEQ. ID. NO. 15945   100-LeuIleGlyAspAspAspThrLeuGln-108
SEQ. ID. NO. 15946   171-ValLeuArgGluArgLeuProAsp-178
SEQ. ID. NO. 15947   210-ValSerArgSerGlyAspPro-216
SEQ. ID. NO. 15948   228-GluSerGlyArgLeuAlaPhe-234
SEQ. ID. NO. 15949   237-GlyProValGluAlaArgAspLysAlaGlnAla-247
a127
AMPHI Regions - AMPHI
SEQ. ID. NO. 15950   6-MetLeuAspThrTrpLeuGlyAla-13
SEQ. ID. NO. 15951   22-GluSerValAlaVal-26
SEQ. ID. NO. 15952   119-ValGlyAspTyrIleGluIle-125
SEQ. ID. NO. 15953   135-IleAsnLeuLeuAsnThrLeuMet-142
SEQ. ID. NO. 15954   147-ProAsnProLeuValGlyLeuLeuAla-155
SEQ. ID. NO. 15955   206-LeuGluProLeuCysAlaPro-212
SEQ. ID. NO. 15956   214-IleProAlaIleGlnArgHisLeuGluAsnValGln-225
SEQ. ID. NO. 15957   250-ArgIleIleValArgPheAlaSerProVal-259
SEQ. ID. NO. 15958   268-AlaValMetAspGluPheLeuArgVal-276
Antigenic Index - Jameson-Wolf
SEQ. ID. NO. 15959   16-IleArgAlaGluAlaValGlu-22
SEQ. ID. NO. 15960   41-HisPheLysArgHisProAspPheGlyIleGluSerLysArgArgPheLeuVal-58
SEQ. ID. NO. 15961   112-SerAlaThrGlnGlnTyrSerVal-119
SEQ. ID. NO. 15962   126-AsnGlyLeuArgGlyArgValValAsp-134
SEQ. ID. NO. 15963   169-HisProValArgArgAspAsnIleLeu-177
SEQ. ID. NO. 15964   193-LeuAspSerAspGluAlaValCysArg-201
SEQ. ID. NO. 15965   233-ProAlaAlaLysProArgValThrArgValProTyrAspAspLysAlaTyr-249
SEQ. ID. NO. 15966   257-SerProValSerLysArgLeuGluIle-265
SEQ. ID. NO. 15967   283-TyrProAlaGlySerGluThrLeu-290
Hydrophilic Regions - Hopp-Woods
SEQ. ID. NO. 15968   16-IleArgAlaGluAlaValGlu-22
SEQ. ID. NO. 15969   42-PheLysArgHisProAspPheGlyIleGluSerLysArgArgPheLeuVal-58
SEQ. ID. NO. 15970   126-AsnGlyLeuArgGlyArgValVal-133
SEQ. ID. NO. 15971   170-ProValArgArgAspAsnIleLeu-177
SEQ. ID. NO. 15972   193-LeuAspSerAspGluAlaValCysArg-201
SEQ. ID. NO. 15973   235-AlaLysProArgValThrArgValProTyrAspAspLysAlaTyr-249
SEQ. ID. NO. 15974   259-ValSerLysArgLeuGluIle-265
SEQ. ID. NO. 15975   285-AlaGlySerGluThrLeu-290
a128-1
AMPHI Regions - AMPHI
SEQ. ID. NO. 15976   43-AlaGlnThrHisThrGlyTrpAlaAsnThrValGluProLeuThrGlyIleThrGlu
                     ArgValGlyArgIleTrpGlyValValSerHisLeuAsnSerValThrAspThrProGlu-81
SEQ. ID. NO. 15977   85-AlaTyrAsnGluLeuMetProGluIle-93
SEQ. ID. NO. 15978   102-GlnAspIleGluLeuTyrAsnArgPheLysThrIleLysAsnSerProGluPheAsp-120
SEQ. ID. NO. 15979   166-PheSerGlnAsnValLeuAspAlaThrAsp-175
SEQ. ID. NO. 15980   189-GlyIleProGluAspAla-194
SEQ. ID. NO. 15981   2118-HisTyrLeuAlaVal-222
SEQ. ID. NO. 15982   231-LeuArgGluGlnIleTyr-236
SEQ. ID. NO. 15983   245-GluLeuSerAspAspGlyLysPheAspAsnThrAlaAsnIleAspArgThrLeuGluAsnAlaLeu-266

TABLE 1-continued

| | |
|---|---|
| SEQ. ID. NO. 15984 | 269-AlaLysLeuLeuGlyPheLysAsnTyrAlaGlu-279 |
| SEQ. ID. NO. 15985 | 286-MetAlaAspThrProGluGlnValLeuAsnPheLeuHisAspLeuAlaArgArgAla-304 |
| SEQ. ID. NO. 15986 | 313-AlaGluValLysAlaPhe-318 |
| SEQ. ID. NO. 15987 | 359-GlyLysValLeuAsnGlyLeuPheAlaGlnIleLysLysLeuTyrGly-374 |
| SEQ. ID. NO. 15988 | 425-GlyArgArgArgPhe-429 |
| SEQ. ID. NO. 15989 | 472-LeuHisHisLeuLeuThrGlnValAspGluLeu-482 |
| SEQ. ID. NO. 15990 | 496-GluLeuProSerGlnPhe-501 |
| SEQ. ID. NO. 15991 | 565-GlyArgLeuLysAsnTrpGlnGlnValLeuAspSerVal-577 |
| SEQ. ID. NO. 15992 | 584-ValArgProProGluTyrAsnArgPheAlaAsnSerPheGlyHisIlePheAlaGlyGly-603 |
| SEQ. ID. NO. 15993 | 610-SerTyrAlaTrpAlaGlu-615 |
| SEQ. ID. NO. 15994 | 623-AlaAlaPheGluGluSerAspAsp-630 |
| SEQ. ID. NO. 15995 | 636-LysArgPheTrpGlnGluIleLeuAla-644 |
| SEQ. ID. NO. 15996 | 651-AlaAlaGluSerPheLysAlaPheArg-659 |
| Antigenic Index - Jameson-Wolf | |
| SEQ. ID. NO. 15997 | 9-LeuGlyGluGluProArgPheAspGlnIleLysThrGluAspIleLysProAlaLeu-27 |
| SEQ. ID. NO. 15998 | 32-AlaGluAlaArgGluGlnIleAla-39 |
| SEQ. ID. NO. 15999 | 43-AlaGlnThrHisThrGlyTrp-49 |
| SEQ. ID. NO. 16000 | 51-AsnThrValGluProLeuThr-57 |
| SEQ. ID. NO. 16001 | 59-IleThrGluArgValGlyArgIleTrp-67 |
| SEQ. ID. NO. 16002 | 75-SerValThrAspThrProGluLeuArgAlaAlaTyr-86 |
| SEQ. ID. NO. 16003 | 100-IleGlyGlnAspIleGluLeuTyrAsnArgPheLysThrIleLysAsnSerProGluPheAspThr-121 |
| SEQ. ID. NO. 16004 | 123-SerHisAlaGlnLysThrLysLeuAsnHisAspLeuArgAsp-136 |
| SEQ. ID. NO. 16005 | 140-SerGlyAlaGluLeuProProGluGlnGlnAlaGluLeuAlaLysLeuGlnThrGluGlyAlaGlnLeu-162 |
| SEQ. ID. NO. 16006 | 165-LysPheSerGlnAsnVal-170 |
| SEQ. ID. NO. 16007 | 172-AspAlaThrAspAla-176 |
| SEQ. ID. NO. 16008 | 190-IleProGluAspAla-194 |
| SEQ. ID. NO. 16009 | 202-AlaGlnSerGluGlyLysThrGlyTyrLys-211 |
| SEQ. ID. NO. 16010 | 226-AlaAspAsnArgLysLeuArgGluGlnIle-235 |
| SEQ. ID. NO. 16011 | 240-ValThrArgAlaSerGluLeuSerAspAspGlyLysPheAspAsnThrAlaAsnIleAspArgThrLeuGlu-263 |
| SEQ. ID. NO. 16012 | 285-LysMetAlaAspThrProGluGln-292 |
| SEQ. ID. NO. 16013 | 300-LeuAlaArgArgAlaLysProTyrAlaGluLysAspLeuAlaGlu-314 |
| SEQ. ID. NO. 16014 | 316-LysAlaPheAlaArgGluSerLeuGly-324 |
| SEQ. ID. NO. 16015 | 335-TyrAlaGlyGluLysLeuArgGluAlaLysTyrAlaPheSerGluThrGluValLysLys-354 |
| SEQ. ID. NO. 16016 | 376-GlyPheThrGluLysThrVal-382 |
| SEQ. ID. NO. 16017 | 387-LysAspValArgTyrPheGluLeuGlnGlnAsnGlyGluThrIle-401 |
| SEQ. ID. NO. 16018 | 409-TyrAlaArgGluGlyLysArgGlyGlyAla-418 |
| SEQ. ID. NO. 16019 | 420-MetAsnAspTyrLysGlyArgArgPheSerAspGlyThrLeu-434 |
| SEQ. ID. NO. 16020 | 446-ThrProProValGlyGlyLysGluAlaArgLeuSerHisAspGlu-460 |
| SEQ. ID. NO. 16021 | 478-GlnValAspGluLeuGlyVal-484 |
| SEQ. ID. NO. 16022 | 496-GluLeuProSerGln-500 |
| SEQ. ID. NO. 16023 | 516-SerAlaHisGluGluThrGlyVal-523 |
| SEQ. ID. NO. 16024 | 560-SerGluAspAspGluGlyArgLeuLysAsn-569 |
| SEQ. ID. NO. 16025 | 575-AspSerValArgLysGluValAlaValValArgProProGluTyrAsnArgPhe-592 |
| SEQ. ID. NO. 16026 | 605-SerAlaGlyTyrTyrSerTyr-611 |
| SEQ. ID. NO. 16027 | 625-PheGluGluSerAspAspValAlaAlaThrGlyLysArgPheTrp-639 |
| SEQ. ID. NO. 16028 | 646-GlyGlySerArgSerAlaAlaGluSerPheLysAlaPheArgGlyArgGluProSerIle-665 |
| SEQ. ID. NO. 16029 | 669-LeuArgHisSerGlyPheAspAsnAlaAla-678 |
| Hydrophilic Regions - Hopp-Woods | |
| SEQ. ID. NO. 16030 | 9-LeuGlyGluGluProArgPheAspGlnIleLysThrGluAspIleLysPro-25 |
| SEQ. ID. NO. 16031 | 32-AlaGluAlaArgGluGlnIleAla-39 |
| SEQ. ID. NO. 16032 | 59-IleThrGluArgValGly-64 |
| SEQ. ID. NO. 16033 | 77-ThrAspThrProGluLeuArgAlaAlaTyr-86 |
| SEQ. ID. NO. 16034 | 100-IleGlyGlnAspIleGluLeu-106 |
| SEQ. ID. NO. 16035 | 111-LysThrIleLysAsnSerProGluPheAspThr-121 |
| SEQ. ID. NO. 16036 | 123-SerHisAlaGlnLysThrLysLeuAsnHisAspLeuArgAsp-136 |
| SEQ. ID. NO. 16037 | 143-GluLeuProProGluGlnGlnAlaGluLeuAlaLysLeuGlnThrGluGlyAlaGlnLeu-162 |
| SEQ. ID. NO. 16038 | 190-IleProGluAspAla-194 |
| SEQ. ID. NO. 16039 | 202-AlaGlnSerGluGlyLysThrGlyTyr-210 |
| SEQ. ID. NO. 16040 | 226-AlaAspAsnArgLysLeuArgGluGlnIle-235 |
| SEQ. ID. NO. 16041 | 242-ArgAlaSerGluLeuSerAspAspGlyLysPheAspAsn-254 |
| SEQ. ID. NO. 16042 | 256-AlaAsnIleAspArgThrLeuGlu-263 |
| SEQ. ID. NO. 16043 | 285-LysMetAlaAspThrProGlu-291 |
| SEQ. ID. NO. 16044 | 300-LeuAlaArgArgAlaLysProTyrAlaGluLysAspLeuAlaGlu-314 |
| SEQ. ID. NO. 16045 | 316-LysAlaPheAlaArgGluSerLeuGly-324 |
| SEQ. ID. NO. 16046 | 335-TyrAlaGlyGluLysLeuArgGluAlaLysTyrAlaPheSerGluThrGluValLysLys-354 |
| SEQ. ID. NO. 16047 | 377-PheThrGluLysThr-381 |
| SEQ. ID. NO. 16048 | 387-LysAspValArgTyr-391 |
| SEQ. ID. NO. 16049 | 396-GlnAsnGlyGluThr-400 |
| SEQ. ID. NO. 16050 | 409-TyrAlaArgGluGlyLysArgGlyGly-417 |
| SEQ. ID. NO. 16051 | 423-TyrLysGlyArgArgArgPheSerAsp-431 |
| SEQ. ID. NO. 16052 | 449-ValGlyGlyLysGluAlaArgLeuSerHisAspGlu-460 |
| SEQ. ID. NO. 16053 | 478-GlnValAspGluLeuGly-483 |
| SEQ. ID. NO. 16054 | 516-SerAlaHisGluGluThrGly-522 |
| SEQ. ID. NO. 16055 | 560-SerGluAspAspGluGlyArgLeuLysAsn-569 |
| SEQ. ID. NO. 16056 | 575-AspSerValArgLysGluValAlaVal-583 |

TABLE 1-continued

| | |
|---|---|
| SEQ. ID. NO. 16057 | 585-ArgProProGluTyrAsnArg-591 |
| SEQ. ID. NO. 16058 | 625-PheGluGluSerAspAspValAlaAlaThrGly-635 |
| SEQ. ID. NO. 16059 | 647-GlySerArgSerAlaAlaGluSerPheLysAlaPheArgGlyArgGluProSerIle-665 | a130
AMPHI Regions - AMPHI

| | |
|---|---|
| SEQ. ID. NO. 16060 | 16-ThrLeuValSerGlyIle-21 |
| SEQ. ID. NO. 16061 | 36-GlySerGlySerPheGly-41 |
| SEQ. ID. NO. 16062 | 56-GlnProValGlyGlnLeu-61 |
| SEQ. ID. NO. 16063 | 91-AsnValProAsnAlaPro-96 |
| SEQ. ID. NO. 16064 | 110-GlnGlyPheAspThrLeuPheGlnHisAlaLeuAsnGlyPheAsnAlaMet-126 |
| SEQ. ID. NO. 16065 | 171-ThrAlaSerAlaPro-175 |
| SEQ. ID. NO. 16066 | 204-PheGluAlaThrCysGln-209 |
| SEQ. ID. NO. 16067 | 211-CysHisGlyGlySerIleProGlyIlePro-220 |
| SEQ. ID. NO. 16068 | 234-LysGlyLysGluThr-238 |
| SEQ. ID. NO. 16069 | 245-GluGlyPheAsnAlaMet-250 |

Antigenic Index - Jameson-Wolf

| | |
|---|---|
| SEQ. ID. NO. 16070 | 1-MetLysGlnLeuArgAspAsnLysAlaGlnGlySer-12 |
| SEQ. ID. NO. 16071 | 35-AlaGlySerGlySerPheGlyAspValAspAlaThrThrGluAlaAlaThrGlnThrArgIleGlnProValGly-59 |
| SEQ. ID. NO. 16072 | 63-MetGlyAspGlyIleProValGlyGluArgGlnGlyGlu-75 |
| SEQ. ID. NO. 16073 | 87-AlaAlaAspSerAsnValProAsnAlaProLysLeuGluHisAsnGlyAspTrpAla-105 |
| SEQ. ID. NO. 16074 | 108-IleAlaGlnGlyPhe-112 |
| SEQ. ID. NO. 16075 | 126-MetProAlaLysGlyGlyAla-132 |
| SEQ. ID. NO. 16076 | 134-AspLeuThrAspGlnGluLeuLysArg-142 |
| SEQ. ID. NO. 16077 | 148-AlaAsnLysSerGlyGlySerPheProAsnProAspGluAlaAlaProAlaAspAsnAlaAla SerGlyThrAlaSerAlaProAlaAspSerAlaAlaProAlaGluAlaLysAlaGluAspLysGlyAlaAla-192 |
| SEQ. ID. NO. 16078 | 197-GlyValAspGlyLysLysValPheGlu-205 |
| SEQ. ID. NO. 16079 | 221-GlyIleGlyLysLysAspAspTrpAlaProArgIleLysLysGlyLysGluThrLeuHis-240 |
| SEQ. ID. NO. 16080 | 251-ProAlaLysGlyGlyAsnAlaGlyLeuSerAspAspGluValLysAla-266 |
| SEQ. ID. NO. 16081 | 274-GlnSerGlyAlaLys-278 |

Hydrophilic Regions - Hopp-Woods

| | |
|---|---|
| SEQ. ID. NO. 16082 | 1-MetLysGlnLeuArgAspAsnLysAlaGlnGly-11 |
| SEQ. ID. NO. 16083 | 41-GlyAspValAspAlaThrThrGluAlaAlaThr-51 |
| SEQ. ID. NO. 16084 | 68-ProValGlyGluArgGlnGlyGlu-75 |
| SEQ. ID. NO. 16085 | 87-AlaAlaAspSerAsnVal-92 |
| SEQ. ID. NO. 16086 | 96-ProLysLeuGluHisAsnGly-102 |
| SEQ. ID. NO. 16087 | 127-ProAlaLysGlyGlyAla-132 |
| SEQ. ID. NO. 16088 | 134-AspLeuThrAspGlnGluLeuLysArg-142 |
| SEQ. ID. NO. 16089 | 156-ProAsnProAspGluAlaAlaProAlaAspAsnAlaAla-168 |
| SEQ. ID. NO. 16090 | 174-AlaProAlaAspSerAlaAlaProAlaGluAlaLysAlaGluAspLysGlyAlaAla-192 |
| SEQ. ID. NO. 16091 | 198-ValAspGlyLysLysValPheGlu-205 |
| SEQ. ID. NO. 16092 | 222-IleGlyLysLysAspAspTrpAlaProArgIleLysLysGlyLysGluThrLeuHis-240 |
| SEQ. ID. NO. 16093 | 251-ProAlaLysGlyGlyAsn-256 |
| SEQ. ID. NO. 16094 | 258-GlyLeuSerAspAspGluValLysAla-266 | a132-2
AMPHI Regions - AMPHI

| | |
|---|---|
| SEQ. ID. NO. 16095 | 13-IleIleSerAlaLeuAlaVal-19 |
| SEQ. ID. NO. 16096 | 70-AlaThrCysMetAlaMetVal-76 |
| SEQ. ID. NO. 16097 | 92-ValGlnGlnThrGlnGlnAlaProLysProValSerAsnThr-105 |

Antigenic Index - Jameson-Wolf

| | |
|---|---|
| SEQ. ID. NO. 16098 | 26-GlnHisGlyLysGlyAlaAspAla-33 |
| SEQ. ID. NO. 16099 | 38-GlySerGlySerGlySerAla-44 |
| SEQ. ID. NO. 16100 | 81-HisThrThrLysHisGlyLeuAspPhe-89 |
| SEQ. ID. NO. 16101 | 91-AsnValGlnGlnThrGlnGlnAlaProLysProValSerAsnThrGluProSerAlaProValProGlnGlnGlnLys-116 |

Hydrophilic Regions - Hopp-Woods

| | |
|---|---|
| SEQ. ID. NO. 16102 | 28-GlyLysGlyAlaAspAla-33 |
| SEQ. ID. NO. 16103 | 97-GlnAlaProLysProValSerAsnThrGluProSerAla-109 | a134
AMPHI Regions - AMPHI

| | |
|---|---|
| SEQ. ID. NO. 16104 | 39-IleGlnSerAlaGlyThrVal-45 |
| SEQ. ID. NO. 16105 | 47-GlyLysLysThrGly-51 |
| SEQ. ID. NO. 16106 | 56-SerAspTrpMetAspIleGluLysGlnArg-65 |
| SEQ. ID. NO. 16107 | 83-ValAsnLeuLeuAspThrProGlyHis-91 |
| SEQ. ID. NO. 16108 | 97-AspThrTyrArgValLeuThrAlaVal-105 |
| SEQ. ID. NO. 16109 | 114-AlaAlaLysGlyValGlu-119 |
| SEQ. ID. NO. 16110 | 123-IleLysLeuLeuAsnValCysArg-130 |
| SEQ. ID. NO. 16111 | 142-LysTyrAspArgGluVal-147 |
| SEQ. ID. NO. 16112 | 149-AspSerLeuGluLeuLeuAspGluValAsnIleLeuGln-162 |
| SEQ. ID. NO. 16113 | 176-LysAsnPheLysGlyValTyrHisIleLeu-185 |
| SEQ. ID. NO. 16114 | 201-HisGluPheAspIleIleLysGlyIleAspAsn-211 |
| SEQ. ID. NO. 16115 | 254-PheGlySerAlaIle-258 |
| SEQ. ID. NO. 16116 | 265-GluIleLeuAsnSerLeuIleGluTrpAla-274 |
| SEQ. ID. NO. 16117 | 322-LysPheGluArgGlyMetLys-328 |
| SEQ. ID. NO. 16118 | 361-AspIleIleGlyIleProAsnHis-368 |
| SEQ. ID. NO. 16119 | 377-PheSerGluGlyGlu-381 |
| SEQ. ID. NO. 16120 | 395-LeuPheArgSerValArgIleLys-402 |
| SEQ. ID. NO. 16121 | 404-ProLeuLysIleLysGln-409 |
| SEQ. ID. NO. 16122 | 411-GlnLysGlyLeuGlnGlnLeuGlyGlu-419 |
| SEQ. ID. NO. 16123 | 423-ValGlnValPheLysProMetSer-430 |
| SEQ. ID. NO. 16124 | 449-SerArgLeuAlaAsnGluTyr-455 |

TABLE 1-continued

| | |
|---|---|
| SEQ. ID. NO. 16125 | 481-AlaGluPheGluLysAlaAsn-487 |
| SEQ. ID. NO. 16126 | 515-ArgTrpProAspIle-519 |

Antigenic Index - Jameson-Wolf

| | |
|---|---|
| SEQ. ID. NO. 16127 | 4-GluIleLeuAspGlnValArgArgArgArgThrPhe-15 |
| SEQ. ID. NO. 16128 | 19-SerHisProAspAlaGlyLysThrThrLeuThr-29 |
| SEQ. ID. NO. 16129 | 43-GlyThrValLysGlyLysLysThrGlyLysPheAlaThr-55 |
| SEQ. ID. NO. 16130 | 57-AspTrpMetAspIleGluLysGlnArgGly-66 |
| SEQ. ID. NO. 16131 | 76-PheAspTyrLysAspHisThrVal-83 |
| SEQ. ID. NO. 16132 | 85-LeuLeuAspThrProGlyHisGlnAspPheSerGluAspThrTyrArg-100 |
| SEQ. ID. NO. 16133 | 113-AspAlaAlaLysGlyValGlu-119 |
| SEQ. ID. NO. 16134 | 129-CysArgLeuArgAsnThrPro-135 |
| SEQ. ID. NO. 16135 | 140-MetAsnLysTyrAspArgGluValArgAspSerLeuGluLeuLeuAspGluValGluAsn-159 |
| SEQ. ID. NO. 16136 | 173-GlyMetGlyLysAsnPheLys-179 |
| SEQ. ID. NO. 16137 | 194-AlaGlyGlyGluArgLeuProHis-201 |
| SEQ. ID. NO. 16138 | 207-LysGlyIleAspAsnProGluLeuGluGlnArgPheProLeu-220 |
| SEQ. ID. NO. 16139 | 223-GlnGlnLeuArgAspGluIleGluLeu-231 |
| SEQ. ID. NO. 16140 | 235-AlaSerAsnGluPheAsnLeu-241 |
| SEQ. ID. NO. 16141 | 275-ProAlaProLysProArgAspAlaThrValArgMetValGluProAspGluProLysPhe-294 |
| SEQ. ID. NO. 16142 | 302-GlnAlaAsnMetAspProLysHisArgAspArgIleAla-314 |
| SEQ. ID. NO. 16143 | 317-ArgValCysSerGlyLysPheGluArgGlyMetLysMetLysHisLeuArgIleAsnArgGluIleAla-339 |
| SEQ. ID. NO. 16144 | 348-SerHisAspArgGluLeuValGlu-355 |
| SEQ. ID. NO. 16145 | 365-IleProAsnHisGly-369 |
| SEQ. ID. NO. 16146 | 373-IleGlyAspSerPheSerGluGlyGluGln-382 |
| SEQ. ID. NO. 16147 | 399-ValArgIleLysAsnProLeuLysIleLysGlnLeuGlnLysGlyLeuGlnGlnLeuGlyGluGluGlyAla-422 |
| SEQ. ID. NO. 16148 | 450-ArgLeuAlaAsnGluTyrGlyVal-457 |
| SEQ. ID. NO. 16149 | 473-SerCysAspAspLysLysLysLeuAlaGluPheGluLysAlaAsnAla-488 |
| SEQ. ID. NO. 16150 | 503-AlaProAsnArgValAsnLeu-509 |
| SEQ. ID. NO. 16151 | 511-LeuThrGlnGluArgTrpProAspIleVal-520 |
| SEQ. ID. NO. 16152 | 523-GluThrArgGluHisSerVal-529 |

Hydrophilic Regions - Hopp-Woods

| | |
|---|---|
| SEQ. ID. NO. 16153 | 4-GluIleLeuAspGlnValArgArgArgArgThr-14 |
| SEQ. ID. NO. 16154 | 21-ProAspAlaGlyLys-25 |
| SEQ. ID. NO. 16155 | 43-GlyThrValLysGlyLysLysThrGlyLys-52 |
| SEQ. ID. NO. 16156 | 59-MetAspIleGluLysGlnArgGly-66 |
| SEQ. ID. NO. 16157 | 77-AspTyrLysAspHisThr-82 |
| SEQ. ID. NO. 16158 | 92-GlnAspPheSerGluAspThrTyr-99 |
| SEQ. ID. NO. 16159 | 113-AspAlaAlaLysGlyValGlu-119 |
| SEQ. ID. NO. 16160 | 129-CysArgLeuArgAsn-133 |
| SEQ. ID. NO. 16161 | 142-LysTyrAspArgGluValArgAspSerLeuGluLeuLeuAspGluValGluAsn-159 |
| SEQ. ID. NO. 16162 | 194-AlaGlyGlyGluArgLeuProHis-201 |
| SEQ. ID. NO. 16163 | 207-LysGlyIleAspAsnProGluLeuGluGlnArgPheProLeu-220 |
| SEQ. ID. NO. 16164 | 223-GlnGlnLeuArgAspGluIleGluLeu-231 |
| SEQ. ID. NO. 16165 | 277-ProLysProArgAspAlaThrValArgMetValGluProAspGluProLysPhe-294 |
| SEQ. ID. NO. 16166 | 305-MetAspProLysHisArgAspArgIleAla-314 |
| SEQ. ID. NO. 16167 | 319-CysSerGlyLysPheGluArgGlyMetLysMetLysHisLeuArgIleAsnArgGluIleAla-339 |
| SEQ. ID. NO. 16168 | 348-SerHisAspArgGluLeuValGlu-355 |
| SEQ. ID. NO. 16169 | 376-SerPheSerGluGlyGluGln-382 |
| SEQ. ID. NO. 16170 | 399-ValArgIleLysAsnProLeuLysIleLysGlnLeuGlnLysGlyLeu-414 |
| SEQ. ID. NO. 16171 | 417-LeuGlyGluGluGlyAla-422 |
| SEQ. ID. NO. 16172 | 473-SerCysAspAspLysLysLysLeuAlaGluPheGluLysAlaAsnAla-488 |
| SEQ. ID. NO. 16173 | 512-ThrGlnGluArgTrpPro-517 |
| SEQ. ID. NO. 16174 | 523-GluThrArgGluHisSerVal-529 | a135
AMPHI Regions - AMPHI

| | |
|---|---|
| SEQ. ID. NO. 16175 | 29-ThrIleThrArgGlnLeuAlaAlaAlaLeu-37 |
| SEQ. ID. NO. 16176 | 85-GluTyrThrAlaAsnLeu-90 |
| SEQ. ID. NO. 16177 | 169-AspIleAspGlyLeuTyrThr-175 |
| SEQ. ID. NO. 16178 | 185-ValArgLeuAspLysIleGluHis-192 |
| SEQ. ID. NO. 16179 | 212-GlyMetLeuThrLysIle-217 |
| SEQ. ID. NO. 16180 | 236-LeuLysProAspAla-240 |
| SEQ. ID. NO. 16181 | 242-AlaGluAlaAlaAspAsnGln-248 |
| SEQ. ID. NO. 16182 | 284-AlaGluHisAlaLeuSer-289 |
| SEQ. ID. NO. 16183 | 300-IleAlaGlyIleGluGly-305 |
| SEQ. ID. NO. 16184 | 308-SerArgMetAspThrValThrValTyr-316 |
| SEQ. ID. NO. 16185 | 318-LysAlaThrLysGlnPro-323 |
| SEQ. ID. NO. 16186 | 335-AlaAlaGluAspLeuLeuLysLeuArg-343 |

Antigenic Index - Jameson-Wolf

| | |
|---|---|
| SEQ. ID. NO. 16187 | 1-MetLysTyrLysArgIleVal-7 |
| SEQ. ID. NO. 16188 | 11-GlyThrSerSerIleThrHisSerAspGlySerLeuSerArgGlyLysIle-27 |
| SEQ. ID. NO. 16189 | 60-GlyPheLysLysArgProValLysIleAlaAspLysGlnAlaSer-74 |
| SEQ. ID. NO. 16190 | 90-LeuSerSerAspGlyIle-95 |
| SEQ. ID. NO. 16191 | 105-AlaAspPheAlaAspLysArgArgTyrGlnAsnAlaGlyGly-118 |
| SEQ. ID. NO. 16192 | 124-LeuGlnArgArgAlaVal-129 |
| SEQ. ID. NO. 16193 | 132-IleAsnGluAsnAspThrValSerValGluGluLeuLysIleGlyAspAsnAspThrLeu-151 |
| SEQ. ID. NO. 16194 | 176-GlyAsnProAsnSerAsnProAspAlaValArgLeuAspLysIleGluHisIleAsn-194 |
| SEQ. ID. NO. 16195 | 202-GlyGlySerGlySerAlaAsnGlyThrGly-211 |
| SEQ. ID. NO. 16196 | 215-ThrLysIleLysAla-219 |
| SEQ. ID. NO. 16197 | 224-ThrGluSerGlyVal-228 |
| SEQ. ID. NO. 16198 | 233-CysSerSerLeuLysProAspAlaLeuAlaGluAlaAlaAspAsnGlnAlaAspGly-251 |
| SEQ. ID. NO. 16199 | 257-ArgAlaLysGlyLeuArgThrGlnLysGln-266 |

TABLE 1-continued

| | |
|---|---|
| SEQ. ID. NO. 16200 | 271-TyrSerGluSerArgGlyGlyValTyrValAspGluGlyAlaGluHisAlaLeuSerGluGlnGlyLysSerLeuLeu-296 |
| SEQ. ID. NO. 16201 | 305-GlyHisPheSerArgMetAspThr-312 |
| SEQ. ID. NO. 16202 | 317-SerLysAlaThrLysGlnProLeuGlyLysGlyArgVal-329 |
| SEQ. ID. NO. 16203 | 335-AlaAlaGluAspLeuLeuLysLeuArgLysAlaLys-346 |
| SEQ. ID. NO. 16204 | 350-IleHisArgAspAspTrpIleSer-357 |
| Hydrophilic Regions - Hopp-Woods | |
| SEQ. ID. NO. 16205 | 1-MetLysTyrLysArgIleVal-7 |
| SEQ. ID. NO. 16206 | 16-ThrHisSerAspGlySerLeuSerArgGlyLysIle-27 |
| SEQ. ID. NO. 16207 | 60-GlyPheLysLysArgProValLysIleAlaAspLysGlnAlaSer-74 |
| SEQ. ID. NO. 16208 | 105-AlaAspPheAlaAspLysArgArgTyrGlnAsn-115 |
| SEQ. ID. NO. 16209 | 124-LeuGlnArgArgAlaVal-129 |
| SEQ. ID. NO. 16210 | 133-AsnGluAsnAspThrValSerValGluGluLeuLysIleGlyAspAsnAspThrLeu-151 |
| SEQ. ID. NO. 16211 | 178-ProAsnSerAsnProAspAlaValArgLeuAspLysIleGluHisIleAsn-194 |
| SEQ. ID. NO. 16212 | 215-ThrLysIleLysAla-219 |
| SEQ. ID. NO. 16213 | 236-LeuLysProAspAlaLeuAlaGluAlaAlaAspAsnGlnAlaAsp-250 |
| SEQ. ID. NO. 16214 | 257-ArgAlaLysGlyLeuArgThrGlnLys-265 |
| SEQ. ID. NO. 16215 | 272-SerGluSerArgGly-276 |
| SEQ. ID. NO. 16216 | 278-ValTyrValAspGluGlyAlaGluHisAlaLeuSerGluGlnGlyLys-293 |
| SEQ. ID. NO. 16217 | 306-HisPheSerArgMetAspThr-312 |
| SEQ. ID. NO. 16218 | 318-LysAlaThrLysGlnProLeuGlyLysGlyArgVal-329 |
| SEQ. ID. NO. 16219 | 335-AlaAlaGluAspLeuLeuLysLeuArgLysAlaLys-346 |
| SEQ. ID. NO. 16220 | 351-HisArgAspAspTrp-355 |
| a136 | |
| AMPHI Regions - AMPHI | |
| SEQ. ID. NO. 16221 | 50-IleArgGlnCysIleArgGln-56 |
| SEQ. ID. NO. 16222 | 84-GlnCysHisAspGlyIleLysGlnLeuPheLysArgPheIleIleAspGlyPheLysProIleGlyArgHis-107 |
| SEQ. ID. NO. 16223 | 119-CysValLysIleAla-123 |
| SEQ. ID. NO. 16224 | 148-ArgHisCysGlnAsn-152 |
| SEQ. ID. NO. 16225 | 170-GlnHisPheGlyGlnPro-175 |
| SEQ. ID. NO. 16226 | 177-GluArgCysGlnPheVal-182 |
| SEQ. ID. NO. 16227 | 194-AsnLeuValAlaThr-198 |
| SEQ. ID. NO. 16228 | 210-GlnPheAlaGlnPro-214 |
| SEQ. ID. NO. 16229 | 216-PheGlyCysPheGlyLysPheSerGlyIleHisHisPhe-228 |
| SEQ. ID. NO. 16230 | 247-LysAlaThrLysProGlnThrValGlnIleValArg-258 |
| Antigenic Index - Jameson-Wolf | |
| SEQ. ID. NO. 16231 | 1-MetGluThrAsnAla-5 |
| SEQ. ID. NO. 16232 | 34-AlaAspGlyLeuArgLeuValAspAspArgLeuProVal-46 |
| SEQ. ID. NO. 16233 | 48-ValAspIleArgGlnCysIle-54 |
| SEQ. ID. NO. 16234 | 69-LeuGlnThrAspSer-73 |
| SEQ. ID. NO. 16235 | 84-GlnCysHisAspGlyIleLysGlnLeuPhe-93 |
| SEQ. ID. NO. 16236 | 99-AspGlyPheLysProIleGlyArgHisAsnIle-109 |
| SEQ. ID. NO. 16237 | 139-IleArgHisArgGlyGlyCysPheHisArgHisCysGlnAsnGlnProPheAsp-156 |
| SEQ. ID. NO. 16238 | 159-ThrPheGlyGlyGlyLysLeuArg-166 |
| SEQ. ID. NO. 16239 | 171-HisPheGlyGlnProValGluArg-178 |
| SEQ. ID. NO. 16240 | 184-ProAlaGlnGlnArgArgHisLysThr-192 |
| SEQ. ID. NO. 16241 | 214-ProProPheGlyCysPheGlyLysPheSerGly-224 |
| SEQ. ID. NO. 16242 | 242-AsnLeuAsnGlnAspLysAlaThrLysProGln-252 |
| SEQ. ID. NO. 16243 | 257-ValArgGlnGlyGluAlaThrProTyr-265 |
| SEQ. ID. NO. 16244 | 270-AsnProLeuTyrArgArgAsnAlaVal-278 |
| Hydrophilic Regions - Hopp-Woods | |
| SEQ. ID. NO. 16245 | 35-AspGlyLeuArgLeuValAspAspArgLeuProVal-46 |
| SEQ. ID. NO. 16246 | 48-ValAspIleArgGlnCysIle-54 |
| SEQ. ID. NO. 16247 | 87-AspGlyIleLysGlnLeuPhe-93 |
| SEQ. ID. NO. 16248 | 185-AlaGlnGlnArgArgHisLysThr-192 |
| SEQ. ID. NO. 16249 | 244-AsnGlnAspLysAlaThrLysProGln-252 |
| SEQ. ID. NO. 16250 | 273-TyrArgArgAsnAlaVal-278 |
| a137 | |
| AMPHI Regions - AMPHI | |
| SEQ. ID. NO. 16251 | 24-LeuSerTyrIleLeuGlyPhe-30 |
| SEQ. ID. NO. 16252 | 49-ThrLysGluSerLeu-53 |
| SEQ. ID. NO. 16253 | 55-AspPheLeuThrTrpGly-60 |
| SEQ. ID. NO. 16254 | 78-PheSerAspTyrLeuAlaHisProLeuAspIlePheLysValTrpGluGlyGly-95 |
| SEQ. ID. NO. 16255 | 101-GlyPheLeuGlyValValIle-107 |
| SEQ. ID. NO. 16256 | 120-PheLeuLysLeuMetAspThrValAlaProLeuValPro-132 |
| SEQ. ID. NO. 16257 | 139-ArgIleGlyAsnPheIle-144 |
| SEQ. ID. NO. 16258 | 149-TrpGlyArgValThrAspIleAsnAlaPhe-158 |
| SEQ. ID. NO. 16259 | 178-ProLeuTrpAlaGluTrpLeuGlnGlnTyr-187 |
| SEQ. ID. NO. 16260 | 190-LeuProArgHisProSerGlnLeu-197 |
| SEQ. ID. NO. 16261 | 232-TyrGlyIlePheArgPheIleAlaGluPheAlaArgGlnProAspAspTyrLeuGly-250 |
| Antigenic Index - Jameson-Wolf | |
| SEQ. ID. NO. 16262 | 36-LeuGlyArgArgArgIleAlaGln-43 |
| SEQ. ID. NO. 16263 | 48-PheThrLysGluSerLeuAspAsp-55 |
| SEQ. ID. NO. 16264 | 92-TrpGluGlyGlyMet-96 |
| SEQ. ID. NO. 16265 | 113-GlyArgLysHisGlyIle-118 |
| SEQ. ID. NO. 16266 | 136-AlaSerGlyArgIle-140 |
| SEQ. ID. NO. 16267 | 164-ProGlnAlaArgTyrGluAspLeuGluAla-173 |
| SEQ. ID. NO. 16268 | 191-ProArgHisProSerGlnLeu-197 |
| SEQ. ID. NO. 16269 | 214-PheSerLysLysGlnArgProThrGly-222 |
| SEQ. ID. NO. 16270 | 241-PheAlaArgGlnProAspAspTyrLeu-249 |
| SEQ. ID. NO. 16271 | 277-PheGlyMetLysLysGlnHis-283 |

TABLE 1-continued

Hydrophilic Regions - Hopp-Woods
SEQ. ID. NO. 16272   37-GlyArgArgArgIleAla-42
SEQ. ID. NO. 16273   48-PheThrLysGluSerLeuAsp-54
SEQ. ID. NO. 16274   166-AlaArgTyrGluAspLeuGluAla-173
SEQ. ID. NO. 16275   216-LysLysGlnArgProThrGly-222
SEQ. ID. NO. 16276   241-PheAlaArgGlnProAspAspTyr-248
SEQ. ID. NO. 16277   278-GlyMetLysLysGlnHis-283
a138
AMPHI Regions - AMPHI
SEQ. ID. NO. 16278   21-ProTyrIleArgArgPheSerGlySer-29
SEQ. ID. NO. 16279   74-AsnAlaMetLeuGluLysVal-80
SEQ. ID. NO. 16280   85-GluPheValGlnGlyMet-90
SEQ. ID. NO. 16281   109-ValAsnLysGluIleValSerMetIleAsnThrTyrGly-121
SEQ. ID. NO. 16282   152-IleGlyGlnValGlyThrValGluSerIle-161
SEQ. ID. NO. 16283   163-ThrGlyLeuValLysGlyLeu-169
SEQ. ID. NO. 16284   199-GlyLysLeuAlaGluGluLeu-205
SEQ. ID. NO. 16285   213-MetThrAsnIleAlaGlyValMetAspLysThrGlyAsnLeuLeuThrLysLeuThr-231
SEQ. ID. NO. 16286   234-ArgIleAspGluLeuIle-239
SEQ. ID. NO. 16287   247-GlyMetLeuProLysIleAlaSerAlaValGluAlaAlaValAsn-261
SEQ. ID. NO. 16288   276-AlaLeuLeuLeuGluIlePheThrAspAla-285
Antigenic Index - Jameson-Wolf
SEQ. ID. NO. 16289   1-MetGluSerGluAsnIle-6
SEQ. ID. NO. 16290   9-AlaAlaAspLysAlaArgIleLeu-16
SEQ. ID. NO. 16291   23-IleArgArgPheSerGlySer-29
SEQ. ID. NO. 16292   35-TyrGlyGlyAsnAlaMetThr-41
SEQ. ID. NO. 16293   43-ProAlaLeuLysGluGlyPheAla-50
SEQ. ID. NO. 16294   68-GlyGlyGlyProGln-72
SEQ. ID. NO. 16295   76-MetLeuGluLysValGlyLysLysGlyGluPhe-86
SEQ. ID. NO. 16296   91-ArgValThrAspLysGluAlaMetAsp-99
SEQ. ID. NO. 16297   109-ValAsnLysGluIle-113
SEQ. ID. NO. 16298   128-SerGlyArgAspAspHisPheIleLysAlaLysLysLeuLeuIleAspThrProGluGlnAsnGlyValAspIleGlyGln-154
SEQ. ID. NO. 16299   159-GluSerIleAspThrGlyLeu-165
SEQ. ID. NO. 16300   169-LeuIleGluArgGlyCysIle-175
SEQ. ID. NO. 16301   182-GlyValGlyGluLysGlyGluAla-189
SEQ. ID. NO. 16302   200-LysLeuAlaGluGluLeuAsnAlaGluLys-209
SEQ. ID. NO. 16303   219-ValMetAspLysThrGlyAsnLeuLeuThrLysLeuThrProLysArgIleAspGluLeuIleAla-240
SEQ. ID. NO. 16304   259-AlaValAsnGlyValLys-264
SEQ. ID. NO. 16305   269-IleAspGlyArgValProAsnAla-276
SEQ. ID. NO. 16306   292-LeuGlyGlyGlyGluAspAla-298
Hydrophilic Regions - Hopp-Woods
SEQ. ID. NO. 16307   1-MetGluSerGluAsn-5
SEQ. ID. NO. 16308   9-AlaAlaAspLysAlaArgIleLeu-16
SEQ. ID. NO. 16309   43-ProAlaLeuLysGluGlyPheAla-50
SEQ. ID. NO. 16310   76-MetLeuGluLysValGlyLysLysGlyGluPhe-86
SEQ. ID. NO. 16311   91-ArgValThrAspLysGluAlaMetAsp-99
SEQ. ID. NO. 16312   109-ValAsnLysGluIle-113
SEQ. ID. NO. 16313   128-SerGlyArgAspAspHisPheIleLysAlaLysLysLeuLeuIleAspThrProGluGlnAsnGlyValAsp-151
SEQ. ID. NO. 16314   183-ValGlyGluLysGlyGluAla-189
SEQ. ID. NO. 16315   200-LysLeuAlaGluGluLeuAsnAlaGluLys-209
SEQ. ID. NO. 16316   219-ValMetAspLysThrGly-224
SEQ. ID. NO. 16317   230-LeuThrProLysArgIleAspGluLeuIleAla-240
SEQ. ID. NO. 16318   269-IleAspGlyArgVal-273
SEQ. ID. NO. 16319   294-GlyGlyGluAspAla-298
a140
AMPHI Regions - AMPHI
SEQ. ID. NO. 16320   10-TyrLeuAsnArgThr-14
SEQ. ID. NO. 16321   26-IleGlyArgAspTyrSerPhePhe-33
SEQ. ID. NO. 16322   45-SerLeuAspSerValGluLysThrAlaGly-54
SEQ. ID. NO. 16323   68-AsnAlaAlaArgThrAlaSer-74
SEQ. ID. NO. 16324   108-SerAlaThrProGluThrValGluThrAlaAla-118
SEQ. ID. NO. 16325   135-ArgAlaAlaAlaAlaValGlnHisAlaAsnAlaAlaAspGlyValArgIlePheAsnAsnLeuAlaAlaThrVal-159
SEQ. ID. NO. 16326   175-LeuLysAlaValSerAspGlyLeuAsp-183
SEQ. ID. NO. 16327   189-LeuArgValIleAlaGln-194
SEQ. ID. NO. 16328   254-SerLeuPheAlaGly-258
SEQ. ID. NO. 16329   266-IleGlyTyrLeuLysGlyLeuPheSerTyr-275
SEQ. ID. NO. 16330   290-GluHisAlaGluGlySer-295
SEQ. ID. NO. 16331   303-LeuGlyAlaLeuGly-307
SEQ. ID. NO. 16332   352-GlyThrLeuValGlyLeu-357
SEQ. ID. NO. 16333   391-GlyGlyPheThrGlyAlaThr-397
SEQ. ID. NO. 16334   412-ArgLeuValAlaGlyLeu-417
SEQ. ID. NO. 16335   425-AsnGlyTrpAsnGlyLeuAlaArg-432
Antigenic Index - Jameson-Wolf
SEQ. ID. NO. 16336   2-SerAlaGlyGlyLysGlyAlaGlyTyrLeuAsnArgThrGlyGlnArgValPro-19
SEQ. ID. NO. 16337   25-LysIleGlyArgAspTyrSer-31
SEQ. ID. NO. 16338   35-AsnIleGluThrAspGlyGlyLeu-42
SEQ. ID. NO. 16339   47-AspSerValGluLysThrAlaGlySerGluGlyAspThrLeu-60
SEQ. ID. NO. 16340   63-TyrValArgArgGlyAsnAlaAlaArgThrAlaSer-74
SEQ. ID. NO. 16341   86-HisAlaValGluGlnGlyGlySerAsnLeuGlu-96
SEQ. ID. NO. 16342   102-LeuAspAlaSerGluSerSerAlaThrProGluThrValGlu-115
SEQ. ID. NO. 16343   117-AlaAlaAlaAspArgThrAspMetProGlyIleArgProTyrGly-131

TABLE 1-continued

| | |
|---|---|
| SEQ. ID. NO. 16344 | 144-AsnAlaAlaAspGly-148 |
| SEQ. ID. NO. 16345 | 160-TyrAlaAspSerThrAlaAla-166 |
| SEQ. ID. NO. 16346 | 169-AspMetGlnGlyArgArgLeuLysAlaValSerAspGlyLeuAspHisAsnAlaThrGly-188 |
| SEQ. ID. NO. 16347 | 195-ThrGlnGlnAspGlyGlyThrTrpGluGlnGlyGlyValGluGlyLysMetArgGlySerThrGln-216 |
| SEQ. ID. NO. 16348 | 221-AlaAlaLysThrGlyGluAsnThrThr-229 |
| SEQ. ID. NO. 16349 | 240-ThrTrpSerGluAsnSerAlaAsnAlaLysThrAspSer-252 |
| SEQ. ID. NO. 16350 | 259-IleArgHisAspAlaGlyAsp-265 |
| SEQ. ID. NO. 16351 | 274-SerTyrGlyArgTyrLysAsnSerIleSerArgSerThrGlyAlaAspGluHisAlaGluGlySerValAsn-297 |
| SEQ. ID. NO. 16352 | 315-AlaThrGlyAspLeuThrValGluGlyGlyLeuArg-326 |
| SEQ. ID. NO. 16353 | 333-AspAlaPheAlaGluLysGlySerAlaLeuGlyTrpSerGlyAsnSerIleThrGluGlyThr-353 |
| SEQ. ID. NO. 16354 | 362-LeuSerGlnProLeuSerAspLysAla-370 |
| SEQ. ID. NO. 16355 | 377-GlyValGluArgAspLeuAsnGlyArgAspTyrThrVal-389 |
| SEQ. ID. NO. 16356 | 399-AlaThrGlyLysThrGlyAlaArgAsnMetProHisThr-411 |
| SEQ. ID. NO. 16357 | 421-ValGluPheGlyAsnGlyTrp-427 |
| SEQ. ID. NO. 16358 | 434-SerTyrAlaGlySerLysGlnTyrGlyAsnHisSerGlyArgValGlyVal-450 |
| Hydrophilic Regions - Hopp-Woods | |
| SEQ. ID. NO. 16359 | 3-AlaGlyGlyLysGly-7 |
| SEQ. ID. NO. 16360 | 36-IleGluThrAspGly-40 |
| SEQ. ID. NO. 16361 | 47-AspSerValGluLysThrAlaGlySerGluGlyAspThr-59 |
| SEQ. ID. NO. 16362 | 64-ValArgArgGlyAsnAlaAlaArgThrAlaSer-74 |
| SEQ. ID. NO. 16363 | 86-HisAlaValGluGlnGlyGlySerAsnLeu-95 |
| SEQ. ID. NO. 16364 | 102-LeuAspAlaSerGluSerSerAlaThrProGluThrValGlu-115 |
| SEQ. ID. NO. 16365 | 117-AlaAlaAlaAspArgThrAspMetProGly-126 |
| SEQ. ID. NO. 16366 | 144-AsnAlaAlaAspGly-148 |
| SEQ. ID. NO. 16367 | 169-AspMetGlnGlyArgArgLeuLysAlaValSerAspGlyLeuAspHisAsnAlaThr-187 |
| SEQ. ID. NO. 16368 | 205-GlyGlyValGluGlyLysMetArgGlySerThr-215 |
| SEQ. ID. NO. 16369 | 223-LysThrGlyGluAsnThrThr-229 |
| SEQ. ID. NO. 16370 | 244-AsnSerAlaAsnAlaLysThrAspSer-252 |
| SEQ. ID. NO. 16371 | 259-IleArgHisAspAlaGlyAsp-265 |
| SEQ. ID. NO. 16372 | 277-ArgTyrLysAsnSerIleSerArgSerThrGlyAlaAspGluHisAlaGluGlySerVal-296 |
| SEQ. ID. NO. 16373 | 333-AspAlaPheAlaGluLysGlySer-340 |
| SEQ. ID. NO. 16374 | 364-GlnProLeuSerAspLysAla-370 |
| SEQ. ID. NO. 16375 | 377-GlyValGluArgAspLeuAsnGlyArgAspTyrThr-388 |
| SEQ. ID. NO. 16376 | 399-AlaThrGlyLysThrGlyAlaArgAsnMetPro-409 |
| a141 | |
| AMPHI Regions - AMPHI | |
| SEQ. ID. NO. 16377 | 11-GlnSerSerThrMetArgProIleGlyGluIle-21 |
| SEQ. ID. NO. 16378 | 32-IleGluProTyrGly-36 |
| SEQ. ID. NO. 16379 | 44-ProAlaGluAlaPheLysLeuPro-51 |
| SEQ. ID. NO. 16380 | 80-AlaAspAlaLeuArgHisIle-86 |
| SEQ. ID. NO. 16381 | 131-PheHisAlaIleGlyAla-136 |
| SEQ. ID. NO. 16382 | 139-AsnLeuLeuAlaAlaMetLeuAspAsn-147 |
| SEQ. ID. NO. 16383 | 174-GlnLeuArgAsnIleIleAspGlyMetGlyLysProValAspGlyValMetArgPro-192 |
| SEQ. ID. NO. 16384 | 212-AspIleSerAspLeuLysGluArgLeuGly-221 |
| SEQ. ID. NO. 16385 | 245-MetAlaAlaLeuLeuLysAspAlaIleLysProAsnLeu-257 |
| SEQ. ID. NO. 16386 | 259-GlnThrIleGluGlyThrPro-265 |
| SEQ. ID. NO. 16387 | 272-ProPheAlaAsnIleAlaHisGlyCysAsnSerValThrAlaThrArgLeuAlaLysHisLeuAlaAspTyrAla-296 |
| SEQ. ID. NO. 16388 | 330-AlaThrValArgAla-334 |
| SEQ. ID. NO. 16389 | 351-LeuAspAlaLeuGluLysGlyLeuProAsnLeuLeuLysHisIleSerAsnLeuLysAsnValPheGly-373 |
| SEQ. ID. NO. 16390 | 406-SerLeuThrGluValTrpGlyLys-413 |
| SEQ. ID. NO. 16391 | 420-AspLeuAlaArgLysValValAsnAlaIleGluSerGln-432 |
| SEQ. ID. NO. 16392 | 473-IleAlaSerLeuGluLys-478 |
| SEQ. ID. NO. 16393 | 525-ValAlaLeuCysGlyAsnMetMetLysMetProGlyLeuProLysValProAlaAla-543 |
| Antigenic Index - Jameson-Wolf | |
| SEQ. ID. NO. 16394 | 3-PheLysThrAspAlaGluIleAlaGlnSerSerThrMetArgProIleGly-19 |
| SEQ. ID. NO. 16395 | 27-LeuAsnValAspAsnIleGluProTyrGly-36 |
| SEQ. ID. NO. 16396 | 38-TyrLysAlaLysIleAsnProAlaGluAlaPheLysLeuProGlnLysGlnGlyArg-56 |
| SEQ. ID. NO. 16397 | 64-AsnProThrProAlaGlyGluGlyLysThrThr-74 |
| SEQ. ID. NO. 16398 | 81-AspAlaLeuArgHisIleGlyLysAspSerValIleAlaLeuArgGluProSerLeuGlyPro-101 |
| SEQ. ID. NO. 16399 | 105-ValLysGlyGlyAlaAlaGlyGlyGly-113 |
| SEQ. ID. NO. 16400 | 151-GlnGlyAsnGluLeuAsnIleAspProLysArgValLeuTrp-164 |
| SEQ. ID. NO. 16401 | 166-ArgValValAspMetAsnAspArgGlnLeuArgAsnIleIleAspGlyMetGlyLysProValAspGlyValMetArgProAspGlyPheAspIle-197 |
| SEQ. ID. NO. 16402 | 211-LysAspIleSerAspLeuLysGluArgLeuGly-221 |
| SEQ. ID. NO. 16403 | 227-TyrAlaLysAspGlySerProValTyr-235 |
| SEQ. ID. NO. 16404 | 237-LysAspLeuLysAlaAsnGly-243 |
| SEQ. ID. NO. 16405 | 251-AspAlaIleLysProAsnLeu-257 |
| SEQ. ID. NO. 16406 | 287-ArgLeuAlaLysHisLeuAla-293 |
| SEQ. ID. NO. 16407 | 306-LeuGlyAlaAlaGluLysPheCysAspIleLysCysArgLeuAlaGlyLeuLysProAspAla-325 |
| SEQ. ID. NO. 16408 | 335-LeuLysTyrAsnGlyGlyValGluArgAlaAsnLeuGlyGluGluAsnLeuAspAlaLeuGluLysGlyLeuProAsnLeu-361 |
| SEQ. ID. NO. 16409 | 383-PheValSerAspSerAspAlaGluLeuAlaMetIleGluLysAlaCysAla-399 |
| SEQ. ID. NO. 16410 | 411-TrpGlyLysGlyGlyAlaGlyGlyAlaAspLeuAlaArgLysValValAsn-427 |
| SEQ. ID. NO. 16411 | 429-IleGluSerGlnThrAsnAsnPheGly-437 |
| SEQ. ID. NO. 16412 | 444-LeuGlyIleLysAspLysIleArgAlaIleAla-454 |
| SEQ. ID. NO. 16413 | 458-TyrValAlaGluAspValAspPheSerAla-467 |
| SEQ. ID. NO. 16414 | 474-AlaSerLeuGluLysLeuGlyLeuAspLysMetPro-485 |
| SEQ. ID. NO. 16415 | 494-SerLeuSerAspAsnAlaLysLeu-501 |
| SEQ. ID. NO. 16416 | 503-GlyCysProGluAspPheArgIle-510 |
| SEQ. ID. NO. 16417 | 534-MetProGlyLeuPro-538 |
| SEQ. ID. NO. 16418 | 541-ProAlaAlaGluLysIleAspValAspAlaGluGly-552 |

TABLE 1-continued

Hydrophilic Regions - Hopp-Woods
SEQ. ID. NO. 16419    3-PheLysThrAspAlaGluIleAlaGln-11
SEQ. ID. NO. 16420    38-TyrLysAlaLysIleAsnPro-44
SEQ. ID. NO. 16421    46-GluAlaPheLysLeuProGlnLysGlnGlyArg-56
SEQ. ID. NO. 16422    67-ProAlaGlyGluGlyLysThr-73
SEQ. ID. NO. 16423    81-AspAlaLeuArgHisIleGlyLysAspSerValIleAlaLeuArgGluProSer-98
SEQ. ID. NO. 16424    155-LeuAsnIleAspProLysArgValLeuTrp-164
SEQ. ID. NO. 16425    166-ArgValValAspMetAsnAspArgGlnLeuArgAsnIleIle-179
SEQ. ID. NO. 16426    181-GlyMetGlyLysProValArgGlyValMetArgProAspGlyPhe-195
SEQ. ID. NO. 16427    211-LysAspIleSerAspLeuLysGluArgLeuGly-221
SEQ. ID. NO. 16428    228-AlaLysAspGlySer-232
SEQ. ID. NO. 16429    237-LysAspLeuLysAla-241
SEQ. ID. NO. 16430    287-ArgLeuAlaLysHisLeuAla-293
SEQ. ID. NO. 16431    306-LeuGlyAlaGluLysPheCysAspIleLysCysArgLeuAlaGlyLeuLysProAspAla-325
SEQ. ID. NO. 16432    339-GlyGlyValGluArgAlaAsnLeuGlyGluGluAsnLeuAspAlaLeuGluLysGlyLeu-358
SEQ. ID. NO. 16433    383-PheValSerAspSerAspAlaGluLeuAlaMetIleGluLysAlaCysAla-399
SEQ. ID. NO. 16434    420-AspLeuAlaArgLysValValAsn-427
SEQ. ID. NO. 16435    444-LeuGlyIleLysAspLysIleArgAlaIleAla-454
SEQ. ID. NO. 16436    458-TyrGlyAlaGluAspValAspPheSerAla-467
SEQ. ID. NO. 16437    474-AlaSerLeuGluLysLeuGlyLeuAspLysMetPro-485
SEQ. ID. NO. 16438    503-GlyCysProGluAspPheArgIle-510
SEQ. ID. NO. 16439    541-ProAlaAlaGluLysIleAspValAspAlaGluGly-552
a142
AMPHI Regions - AMPHI
SEQ. ID. NO. 16440    26-ArgPheAlaAlaMetProAspValValGlyLys-36
SEQ. ID. NO. 16441    44-GlyGlnProGlyLysMetPhe-50
SEQ. ID. NO. 16442    100-AlaValThrProCysArg-105
SEQ. ID. NO. 16443    107-ValCysArgAspAspMetAsn-113
SEQ. ID. NO. 16444    118-GlyCysHisArgIleThrGluArgSerLeuLysSerPheLeuGlnIleArgHisPheSerProLeu-139
SEQ. ID. NO. 16445    174-LeuArgValGlnArgIleLeuAspPheGlyLysPheCysGlnGlnVal-189
SEQ. ID. NO. 16446    202-LeuAspSerValValThrLeuValHisPhePheAlaAspPheLeuIle-217
SEQ. ID. NO. 16447    239-AlaAspAsnGlnThrArgPhePheLysAlaGly-249
SEQ. ID. NO. 16448    259-AsnAlaArgLeuIleArgGlnIleLeuLys-268
Antigenic Index - Jameson-Wolf
SEQ. ID. NO. 16449    31-ProAspValValGly-35
SEQ. ID. NO. 16450    38-LeuPheGlyArgGlnAlaGlyGlnProGlyLysMet-49
SEQ. ID. NO. 16451    59-GlnArgIleAspAlaGluAlaAlaValPheArgGlnAspArgAsnAspSerArgThrProValAspAlaGlnHisHisGlyArgArgLeuVal
                      ArgAsnArgArgAsnArgArgHisCysAsnAla-100
SEQ. ID. NO. 16452    102-ThrProCysArgThrValCysArgAspAspMetAsnAlaCysArgThrGlyCysHisArgIleThrGluArgSerLeuLys-128
SEQ. ID. NO. 16453    147-AlaAlaHisLysAla-151
SEQ. ID. NO. 16454    153-ProMetCysSerSerSerAspSerLysSerArgArgSerAspIleSerAlaArgTyr-171
SEQ. ID. NO. 16455    180-LeuAspPheGlyLysPheCys-186
SEQ. ID. NO. 16456    225-GlnLeuGlnLysAsnThrSer-231
SEQ. ID. NO. 16457    237-PheGlnAlaAspAsnGlnThrArgPhePheLysAlaGlyGlnAspThrGlyGlnAlaGlyAlaGlnAsn-259
SEQ. ID. NO. 16458    267-LeuLysValGlnArgAlaValPheArgGlnLysThrAspAsnProPro-282
SEQ. ID. NO. 16459    291-IleGlnAsnArgProGluLeuGlyHisGlnGly-301
SEQ. ID. NO. 16460    307-GlnThrAspIleAspArgArgMetPhe-315
Hydrophilic Regions - Hopp-Woods
SEQ. ID. NO. 16461    42-GlnAlaGlyGlnPro-46
SEQ. ID. NO. 16462    59-GlnArgIleAspAlaGluAlaAlaValPheArgGlnAspArgAsnAspSerArgThrProValAspAlaGlnHisHisGlyArgArgLeuVal
                      ArgAsnArgArgAsnArgArgHisCys-98
SEQ. ID. NO. 16463    106-ThrValCysArgAspAspMetAsnAlaCysArg-116
SEQ. ID. NO. 16464    121-ArgIleThrGluArgSerLeuLys-128
SEQ. ID. NO. 16465    147-AlaAlaHisLysAla-151
SEQ. ID. NO. 16466    156-SerSerSerAspSerLysSerArgArgSerAspIleSerAla-169
SEQ. ID. NO. 16467    237-PheGlnAlaAspAsnGlnThrArgPhePheLysAlaGlyGlnAspThrGlyGln-254
SEQ. ID. NO. 16468    267-LeuLysValGlnArgAlaValPheArgGlnLysThrAspAsn-280
SEQ. ID. NO. 16469    291-IleGlnAsnArgProGluLeuGly-298
SEQ. ID. NO. 16470    309-AspIleAspArgArgMetPhe-315
a144
AMPHI Regions - AMPHI
SEQ. ID. NO. 16471    36-LeuGlyGlyIleValGlnGluPhe-43
SEQ. ID. NO. 16472    45-ValLeuAlaAspGlyValArg-51
SEQ. ID. NO. 16473    71-IleAsnLysGlnIleGlyArgValAlaGlyArg-81
SEQ. ID. NO. 16474    136-ValGlyArgArgLeu-140
SEQ. ID. NO. 16475    159-TyrArgTyrLeuSerArgHis-165
SEQ. ID. NO. 16476    185-GlyProAlaArgCysGlySerAlaTyrSerAlaGly-196
SEQ. ID. NO. 16477    200-SerGlyArgCysArgLysThrAlaArgLeuAsnGlyPheArgArgProArgSer-217
Antigenic Index - Jameson-Wolf
SEQ. ID. NO. 16478    1-MetSerAspThrProAlaThrArgAspPheGlyLeuIleAspGlyArgAla-17
SEQ. ID. NO. 16479    23-LeuSerAsnArgArgGlyThrArg-30
SEQ. ID. NO. 16480    48-AspGlyValArgGlu-52
SEQ. ID. NO. 16481    58-PheAspAspAlaAlaSerTyrAlaAspAsnProPheGlnIleAsn-72
SEQ. ID. NO. 16482    78-ValAlaGlyArgIleArgGlyAlaAla-86
SEQ. ID. NO. 16483    88-AspIleAsnGlyArgThrTyrArgValGluAlaAsnGluGlyArgAsnAlaLeuHisGlyGlySerHis-110
SEQ. ID. NO. 16484    121-AlaAlaAspGlyArgSerValValLeu-129
SEQ. ID. NO. 16485    135-ThrValGlyArgArgLeuSerGlnArgPheGly-145
SEQ. ID. NO. 16486    151-ProLeuGlyArgGlyArgProAlaTyr-159

TABLE 1-continued

| | |
|---|---|
| SEQ. ID. NO. 16487 | 161-TyrLeuSerArgHisArgAlaArgArgHisGlyValArgProAspAlaAlaHis-178 |
| SEQ. ID. NO. 16488 | 182-AlaGlyArgGlyProAlaArgCysGlySer-191 |
| SEQ. ID. NO. 16489 | 194-SerAlaGlyArgThrTyrSerGlyArgCysArgLysThrAlaArgLeuAsnGlyPheArgArgProArgSerIle-218 |

Hydrophilic Regions - Hopp-Woods

| | |
|---|---|
| SEQ. ID. NO. 16490 | 1-MetSerAspThrProAlaThrArgAsp-9 |
| SEQ. ID. NO. 16491 | 24-SerAsnArgArgGlyThrArg-30 |
| SEQ. ID. NO. 16492 | 48-AspGlyValArgGlu-52 |
| SEQ. ID. NO. 16493 | 58-PheAspAspAlaAlaSer-63 |
| SEQ. ID. NO. 16494 | 78-ValAlaGlyArgIleArgGlyAlaAla-86 |
| SEQ. ID. NO. 16495 | 89-IleAsnGlyArgThrTyrArgValGluAlaAsnGluGlyArgAsnAlaLeu-105 |
| SEQ. ID. NO. 16496 | 121-AlaAlaAspGlyArgSerValValLeu-129 |
| SEQ. ID. NO. 16497 | 135-ThrValGlyArgArgLeuSerGln-142 |
| SEQ. ID. NO. 16498 | 153-GlyArgGlyArgProAla-158 |
| SEQ. ID. NO. 16499 | 163-SerArgHisArgAlaArgArgHisGlyValArgProAspAla-176 |
| SEQ. ID. NO. 16500 | 183-GlyArgGlyProAlaArgCys-189 |
| SEQ. ID. NO. 16501 | 197-ArgThrTyrSerGlyArgCysArgLysThrAlaArg-208 |
| SEQ. ID. NO. 16502 | 210-AsnGlyPheArgArgProArgSerIle-218 | a146
AMPHI Regions - AMPHI

| | |
|---|---|
| SEQ. ID. NO. 16503 | 19-GluGlnTyrGlyLeuPheAspPheMetProCys-29 |
| SEQ. ID. NO. 16504 | 34-ProLeuAspAsnPheProThrVal-41 |
| SEQ. ID. NO. 16505 | 64-GlyPheGlyGlnArgIleSerAsnLeuSerArg-74 |
| SEQ. ID. NO. 16506 | 95-LeuArgAlaCysAla-99 |
| SEQ. ID. NO. 16507 | 105-HisValArgValPheGlnLys-111 |
| SEQ. ID. NO. 16508 | 140-ThrArgArgValArg-144 |
| SEQ. ID. NO. 16509 | 158-ArgHisGlnArgGlyPheAlaArg-165 |

Antigenic Index - Jameson-Wolf

| | |
|---|---|
| SEQ. ID. NO. 16510 | 6-LeuArgProArgGlnValIleIleAspHisAspLysIleGluGln-20 |
| SEQ. ID. NO. 16511 | 29-CysLeuArgGlnProProLeuAspAsn-37 |
| SEQ. ID. NO. 16512 | 41-ValArgProAlaSerValGluThrArgSerLysHisIleGluArgArgArgGlnAspLysAspAlaAspGlyPheGlyGlnArgIleSerAsnLeuSer-73 |
| SEQ. ID. NO. 16513 | 86-ThrCysArgArgGlnArgIleHisThr-94 |
| SEQ. ID. NO. 16514 | 112-SerLeuLeuArgAspLysArgLeuLys-120 |
| SEQ. ID. NO. 16515 | 138-ArgArgThrArgArgValArgHisGlyAsnAlaGln-149 |
| SEQ. ID. NO. 16516 | 155-GlnGlnProArgHisGlnArgGlyPheAla-164 |
| SEQ. ID. NO. 16517 | 166-AlaGlySerGlyArgAsnAspLysAspValAlaPheSerIle-179 |
| SEQ. ID. NO. 16518 | 195-GlnArgThrProGlyPhe-200 |

Hydrophilic Regions - Hopp-Woods

| | |
|---|---|
| SEQ. ID. NO. 16519 | 6-LeuArgProArgGlnValIleIleAspHisAspLysIleGluGln-20 |
| SEQ. ID. NO. 16520 | 44-AlaSerValGluThrArgSerLysHisIleGluArgArgArgGlnAspLysAspAlaAspGlyPheGly-66 |
| SEQ. ID. NO. 16521 | 86-ThrCysArgArgGlnArgIleHisThr-94 |
| SEQ. ID. NO. 16522 | 112-SerLeuLeuArgAspLysArgLeuLys-120 |
| SEQ. ID. NO. 16523 | 138-ArgArgThrArgArgValArgHisGlyAsn-147 |
| SEQ. ID. NO. 16524 | 156-GlnProArgHisGlnArgGlyPheAla-164 |
| SEQ. ID. NO. 16525 | 167-GlySerGlyArgAsnAspLysAspValAla-176 | a148
AMPHI Regions - AMPHI

| | |
|---|---|
| SEQ. ID. NO. 16526 | 25-AlaAspLysIleArgLysIleGluAsnTrpPro-35 |
| SEQ. ID. NO. 16527 | 49-GlnSerAlaGluTyrPheArgLeuLeuValAspLeu-60 |
| SEQ. ID. NO. 16528 | 150-AlaGlyLeuGluLeuIleArgLysLeuGlyGlyGluIle-162 |
| SEQ. ID. NO. 16529 | 165-AlaAlaAlaIleLeuGluPheThrAspLeuGlnGlyGlyLysAsnIleArg-181 |

Antigenic Index - Jameson-Wolf

| | |
|---|---|
| SEQ. ID. NO. 16530 | 4-LysThrSerAsnLeu-8 |
| SEQ. ID. NO. 16531 | 24-LeuAlaAspLysIleArgLysIleGluAsnTrpProGlnLysGly-38 |
| SEQ. ID. NO. 16532 | 66-MetAspGlnLysIleAspIle-72 |
| SEQ. ID. NO. 16533 | 76-LeuAspAlaArgGly-80 |
| SEQ. ID. NO. 16534 | 97-ProIleArgLysLysGlyLysLeuPro-105 |
| SEQ. ID. NO. 16535 | 117-TyrGlyGluAlaAlaVal-122 |
| SEQ. ID. NO. 16536 | 124-IleHisThrAspAlaValLysLeuGlySer-133 |
| SEQ. ID. NO. 16537 | 153-GluLeuIleArgLysLeuGlyGlyGluIleValGlu-164 |
| SEQ. ID. NO. 16538 | 172-ThrAspLeuGlnGlyGlyLysAsnIleArgAlaSerGlyAlaPro-186 |
| SEQ. ID. NO. 16539 | 192-GlnAsnGluGlyCysMetLysGly-199 |

Hydrophilic Regions - Hopp-Woods

| | |
|---|---|
| SEQ. ID. NO. 16540 | 24-LeuAlaAspLysIleArgLysIleGluAsnTrpPro-35 |
| SEQ. ID. NO. 16541 | 66-MetAspGlnLysIleAspIle-72 |
| SEQ. ID. NO. 16542 | 97-ProIleArgLysLysGlyLysLeuPro-105 |
| SEQ. ID. NO. 16543 | 117-TyrGlyGluAlaAlaVal-122 |
| SEQ. ID. NO. 16544 | 124-IleHisThrAspAlaValLysLeuGlySer-133 |
| SEQ. ID. NO. 16545 | 153-GluLeuIleArgLysLeuGlyGlyGluIleValGlu-164 |
| SEQ. ID. NO. 16546 | 178-LysAsnIleArgAlaSerGly-184 |
| SEQ. ID. NO. 16547 | 195-GlyCysMetLysGly-199 | a149
AMPHI Regions - AMPHI

| | |
|---|---|
| SEQ. ID. NO. 16548 | 72-AsnLeuGlyAspAlaLeuAspGlyValProGlyIle-83 |
| SEQ. ID. NO. 16549 | 101-ThrGlyArgArgIleLysValLeuAsnHisHisGlyGluThrGlyAspMet-117 |
| SEQ. ID. NO. 16550 | 135-GlnValGluIleGluLeuArgGlyProValThr-144 |
| SEQ. ID. NO. 16551 | 152-ValAlaGlyLeuValAsp-157 |
| SEQ. ID. NO. 16552 | 164-ProGluLysMetProGluAsnGlyVal-172 |
| SEQ. ID. NO. 16553 | 184-AsnLeuGluLysLeu-188 |
| SEQ. ID. NO. 16554 | 220-TyrArgAsnLeuLysArgLeuProAspSerHis-230 |

TABLE 1-continued

| SEQ. ID. NO. 16555 | 345-PheProGlyPheGlu-349 |
|---|---|
| SEQ. ID. NO. 16556 | 366-AlaGlyAspAlaValGluAsnPhePheAsnAsn-376 |
| SEQ. ID. NO. 16557 | 389-ProIleGlyArgLeuLys-394 |
| SEQ. ID. NO. 16558 | 411-AlaThrSerGluAla-415 |
| SEQ. ID. NO. 16559 | 565-ArgPheGlyAsnTyrIleTyrAlaGln-573 |
| SEQ. ID. NO. 16560 | 576-AsnAspGlyArgGlyProLysSerIleGluAsp-586 |
| SEQ. ID. NO. 16561 | 627-ArgGlyArgLeuLysAsnLeuProSer-635 |
| Antigenic Index - Jameson-Wolf | |
| SEQ. ID. NO. 16562 | 23-GlnAlaHisGlyThrGluGlnSerVal-31 |
| SEQ. ID. NO. 16563 | 40-GlyLysSerArgProArgAlaThrSerGly-49 |
| SEQ. ID. NO. 16564 | 55-ThrAlaSerAspLysIleIleSerGlyAspThrLeuArgGlnLysAla-70 |
| SEQ. ID. NO. 16565 | 97-IleArgGlyGlnThrGlyArgArgIleLysVal-107 |
| SEQ. ID. NO. 16566 | 109-AsnHisHisGlyGluThrGlyAspMetAlaAspPheSerProAspHis-124 |
| SEQ. ID. NO. 16567 | 137-GluIleLeuArgGlyPro-142 |
| SEQ. ID. NO. 16568 | 157-AspValAlaAspGlyLysIleProGluLysMetProGluAsnGlyValSerGlyGluLeuGlyLeu-178 |
| SEQ. ID. NO. 16569 | 180-LeuSerSerGlyAsnLeuGluLysLeuThrSerGlyGly-192 |
| SEQ. ID. NO. 16570 | 207-GlyLeuTyrArgLysSerGlyAspTyrAlaValProArgTyrArgAsnLeuLysArgLeuProAspSerHisAlaAspSerGlnThrGly-236 |
| SEQ. ID. NO. 16571 | 244-GlyGluLysGlyPhe-248 |
| SEQ. ID. NO. 16572 | 252-AlaTyrSerAspArgArgAspGlnTyrGly-261 |
| SEQ. ID. NO. 16573 | 263-ProAlaHisSerHisGluTyrAspAspCysHisAla-274 |
| SEQ. ID. NO. 16574 | 281-SerLeuIleAsnLysArgTyrLeu-288 |
| SEQ. ID. NO. 16575 | 295-LeuThrGluGluAspIleAspTyrAspAsnProGlyLeu-307 |
| SEQ. ID. NO. 16576 | 310-GlyPheHisAspAspAspAspAlaHis-318 |
| SEQ. ID. NO. 16577 | 321-AlaHisAsnGlyLysProTrpIleAspLeuArgAsnLysArgTyrGluLeuArgAlaGluTrpLysGlnProPheProGly-347 |
| SEQ. ID. NO. 16578 | 354-HisLeuAsnArgAsnAspTyrArgHisAspGluLysAlaGlyAspAlaVal-370 |
| SEQ. ID. NO. 16579 | 374-PheAsnAsnGlnThrGlnAsnAlaArgIleGluLeuArgHisGlnProIleGlyArgLeuLysGlySerTrp-397 |
| SEQ. ID. NO. 16580 | 402-LeuGlyGlnLysSerSerAlaLeu-409 |
| SEQ. ID. NO. 16581 | 411-AlaThrSerGluAlaValLys-417 |
| SEQ. ID. NO. 16582 | 422-LeuAspAsnLysVal-426 |
| SEQ. ID. NO. 16583 | 437-AlaAsnTrpAspAsnPheThrLeuGluGlyGlyValArgValGluLys GlnLysAlaSerIleArgTyrAspLysAlaLeuIleAspArgGluAsnTyrTyrAsnHisProLeuProAsp-476 |
| SEQ. ID. NO. 16584 | 478-GlyAlaHisArgGlnThrAla-484 |
| SEQ. ID. NO. 16585 | 506-SerHisGlnGluArgLeuProSerThrGlnGluLeuTyrAlaHisGly-521 |
| SEQ. ID. NO. 16586 | 531-ValGlyAsnLysHisLeuAsnLysGluArgSerAsnAsnIle-544 |
| SEQ. ID. NO. 16587 | 550-TyrGluGlyAspArgTrpGln-556 |
| SEQ. ID. NO. 16588 | 562-TyrArgAsnArgPheGlyAsn-568 |
| SEQ. ID. NO. 16589 | 574-ThrLeuAsnAspGlyArgGlyProLysSerIleGluAspAspSerGluMetLysLeu-592 |
| SEQ. ID. NO. 16590 | 594-ArgTyrArgAsnGlnSerGlyAlaAspPheTyrGlyAlaGluGly-607 |
| SEQ. ID. NO. 16591 | 609-IleTyrPheLysProThrProArgTyrArgIle-619 |
| SEQ. ID. NO. 16592 | 621-ValSerGlyAspTyrValArgGlyArgLeuLysAsnLeuProSerLeuProGlyArgGluAspAlaTyrGlyAsnArg-646 |
| SEQ. ID. NO. 16593 | 651-GlnAlaAspGlnAsnAlaProArgValProAla-661 |
| SEQ. ID. NO. 16594 | 671-SerLeuThrAspArgIleAspAla-678 |
| SEQ. ID. NO. 16595 | 689-AsnLysLeuAlaArgTyrGluThrArgThrProGlyHis-701 |
| SEQ. ID. NO. 16596 | 707-GlyAlaAsnTyrArgArgAsnThrArgTyrGlyGluTrp-719 |
| SEQ. ID. NO. 16597 | 725-AlaAspAsnLeuLeu-729 |
| SEQ. ID. NO. 16598 | 739-PheLeuSerAspThrProGlnMetGlyArgSerPheThrGlyGlyVal-754 |
| Hydrophilic Regions - Hopp-Woods | |
| SEQ. ID. NO. 16599 | 25-HisGlyThrGluGln-29 |
| SEQ. ID. NO. 16600 | 40-GlyLysSerArgProArgAlaThr-47 |
| SEQ. ID. NO. 16601 | 55-ThrAlaSerAspLysIleIleSer-62 |
| SEQ. ID. NO. 16602 | 64-AspThrLeuArgGlnLysAla-70 |
| SEQ. ID. NO. 16603 | 100-GlnThrGlyArgArgIleLysVal-107 |
| SEQ. ID. NO. 16604 | 112-GlyGluThrGlyAspMetAlaAspPheSerPro-122 |
| SEQ. ID. NO. 16605 | 157-AspValAlaAspGlyLysIleProGluLysMetProGluAsnGlyValSer-173 |
| SEQ. ID. NO. 16606 | 181-SerSerGlyAsnLeuGluLysLeuThr-189 |
| SEQ. ID. NO. 16607 | 207-GlyLeuTyrArgLysSerGlyAsp-214 |
| SEQ. ID. NO. 16608 | 219-ArgTyrArgAsnLeuLysArgLeuProAspSerHisAlaAspSerGlnThr-235 |
| SEQ. ID. NO. 16609 | 253-TyrSerAspArgArgAspGlnTyr-260 |
| SEQ. ID. NO. 16610 | 267-HisGluTyrAspAspCysHisAla-274 |
| SEQ. ID. NO. 16611 | 295-LeuThrGluGluAspIleAspTyrAspAsn-304 |
| SEQ. ID. NO. 16612 | 311-PheHisAspAspAspAspAlaHis-318 |
| SEQ. ID. NO. 16613 | 330-LeuArgAsnLysArgTyrGluLeuArgAlaGluTrp-341 |
| SEQ. ID. NO. 16614 | 354-HisLeuAsnArgAsnAspTyrArgHisAspGluLysAlaGlyAspAlaVal-370 |
| SEQ. ID. NO. 16615 | 378-ThrGlnAsnAlaArgIleGluLeuArgHis-387 |
| SEQ. ID. NO. 16616 | 391-GlyArgLeuLysGly-395 |
| SEQ. ID. NO. 16617 | 411-AlaThrSerGluAlaValLys-417 |
| SEQ. ID. NO. 16618 | 446-GlyGlyValArgValGluLysGlnLysAlaSerIleArgTyrAspLysAlaLeuIleAspArgGluAsnTyr-469 |
| SEQ. ID. NO. 16619 | 478-GlyAlaHisArgGlnThrAla-484 |
| SEQ. ID. NO. 16620 | 506-SerHisGlnGluArgLeuProSer-513 |
| SEQ. ID. NO. 16621 | 535-HisLeuAsnLysGluArgSerAsnAsn-543 |
| SEQ. ID. NO. 16622 | 550-TyrGluGlyAspArgTrp-555 |
| SEQ. ID. NO. 16623 | 575-LeuAsnAspGlyArgGlyProLysSerIleGluAspAspSerGluMetLysLeu-592 |
| SEQ. ID. NO. 16624 | 603-TyrGlyAlaGluGly-607 |
| SEQ. ID. NO. 16625 | 613-ProThrProArgTyrArgIle-619 |
| SEQ. ID. NO. 16626 | 624-AspTyrValArgGlyArgLeuLysAsn-632 |
| SEQ. ID. NO. 16627 | 637-ProGlyArgGluAspAlaTyrGly-644 |
| SEQ. ID. NO. 16628 | 652-AlaAspGlnAsnAlaProArgValProAla-661 |
| SEQ. ID. NO. 16629 | 671-SerLeuThrAspArgIleAspAla-678 |

TABLE 1-continued

SEQ. ID. NO. 16630 690-LysLeuAlaArgTyrGluThrArgThrProGly-700
SEQ. ID. NO. 16631 709-AsnTyrArgArgAsnThrArgTyrGly-717
a150
AMPHI Regions - AMPHI
SEQ. ID. NO. 16632 1-MetGlnAsnThrAsnProProLeuProProMetProProGluIleThrGlnLeuLeuSerGlyLeuAspAlaAlaGlnTrpAlaTrpLeuSerGlyTyrAlaTrpAlaLysAlaGlyAsnGlyAlaSerAlaGlyLeuProAlaLeuGlnThrAlaLeuProThrAlaGluProPheSerValThrValLeuSerAlaSerGlnThrGlyAsnAlaLysSerValAlaAspLysAlaAlaAspSerLeuGluAlaAlaGlyIleGlnValSerArgAlaGluLeuLysAspTyrLysAlaLysAsnIleAlaGlyGluArgArgLeuLeuLeuValThrSerThrGlnGlyGluGlyGluProProGluGluAlaValValLeuHisLysLeuLeuAsnGlyLysLysAlaProLysLeuAspLysLeuGlnPheAlaValLeuGlyLeuGlyAspSerSerTyrProAsnPheCysArgAlaGlyLysAspPheAspLysArgPheGluGluLeuGlyAlaLysArgLeuLeuGluArgValAspAlaAspLeuAspPheAlaAlaAlaAlaAspGlyTrpThrAspAsnIleAlaAlaLeuLeuLysGluGluAlaAlaLysAsnArgAlaThrProAlaProGlnThrThrProProAlaGlyLeuGlnThrAlaProAspGlyArgTyrCysLysAlaAspProPheProAlaAlaLeuLeuAlaAsnGlnLysIleThrAlaArgGlnSerAspLysAspValArgHisIleGluIleAspLeuSerGlySerAspLeuHisTyrLeuProGlyAspAlaLeuGlyValTrpPheAspAsnAspProAlaLeuValArgGluIleLeuAspLeuLeuGlyIleAspGlnAlaThrGluIleGlnAlaGlyGlyLysThrLeuProValAlaSerAlaLeuLeuSerHisPheGluLeuThrGlnAsnThrProAlaPheValLysGlyTyrAlaProPheAlaAspAspAspGluLeuAspArgIleAlaAlaAspAsnAlaValLeuGlnGlyPheValGlnSerThrProIleAlaAspValLeuHisArgPheProAlaLysLeuThrAlaGluGlnPheAlaGlyLeuLeuArgProLeuAlaProArgLeuTyrSerIleSerSerSerGlnAlaGluValGlyAspGluValHisLeuThrValGlyAlaValArgPheGluHisGluGlyArgAlaArgAlaGlyGlyAlaSerGlyPheLeuAlaAspArgLeuGluAspGlyThrValArgValPheValGluArgAsnAspGlyPheArgLeuProGluAspSerArgLysProIleValMetIleGlySerGlyThrGlyValAlaProPheArgAlaPheValGlnGlnArgAlaAlaGluAsnAlaGluGlyLysAsnTrpLeuPhePheGlyAsnProHisPheAlaArgAspPheLeuTyrGlnThrGluTrpGlnGlnPheAlaLysAspGlyPheLeuHisArgTyrAspPheAlaTrpSerArgAspGlnGluGluLysIleTyrValGlnAspLysIleArgGluGlnAlaGluGlyLeuTrpGlnTrpLeuGlnGluGlyAlaHisIleTyrValCysGlyAspAlaAlaLysMetAlaLysAspValGluAlaAlaLeuLeuAspValIleIleGlyAlaGlyHisLeuAspGluGluGlyAlaGluTyrLeuAspMetLeuArgGluGluLysArgTyrGlnArgAspValTyr-599

Antigenic Index - Jameson-Wolf (SEQ. ID. NO. 16633)
1-MetGlnAsnThrAsnProProLeuProProMetProProGluIleThrGlnLeuLeuSerGlyLeuAspAlaAlaGlnTrpAlaTrpLeuSerGlyTyrAlaTrpAlaLysAlaGlyAsnGlyAlaSerAlaGlyLeuProAlaLeuGlnThrAlaLeuProThrAlaGluProPheSerValThrValLeuSerAlaSerGlnThrGlyAsnAlaLysSerValAlaAspLysAlaAlaAspSerLeuGluAlaAlaGlyIleGlnValSerArgAlaGluLeuLysAspTyrLysAlaLysAsnIleAlaGlyGluArgArgLeuLeuLeuValThrSerThrGlnGlyGluGlyGluProProGluGluAlaValValLeuHisLysLeuLeuAsnGlyLysLysAlaProLysLeuAspLysLeuGlnPheAlaValLeuGlyLeuGlyAspSerSerTyrProAsnPheCysArgAlaGlyLysAspPheAspLysArgPheGluGluLeuGlyAlaLysArgLeuLeuGluArgValAspAlaAspLeuAspPheAlaAlaAlaAlaAspGlyTrpThrAspAsnIleAlaAlaLeuLeuLysGluGluAlaAlaLysAsnArgAlaThrProAlaProGlnThrThrProProAlaGlyLeuGlnThrAlaProAspGlyArgTyrCysLysAlaAspProPheProAlaAlaLeuLeuAlaAsnGlnLysIleThrAlaArgGlnSerAspLysAspValArgHisIleGluIleAspLeuSerGlySerAspLeuHisTyrLeuProGlyAspAlaLeuGlyValTrpPheAspAsnAspProAlaLeuValArgGluIleLeuAspLeuLeuGlyIleAspGlnAlaThrGluIleGlnAlaGlyGlyLysThrLeuProValAlaSerAlaLeuLeuSerHisPheGluLeuThrGlnAsnThrProAlaPheValLysGlyTyrAlaProPheAlaAspAspAspGluLeuAspArgIleAlaAlaAspAsnAlaValLeuGlnGlyPheValGlnSerThrProIleAlaAspValLeuHisArgPheProAlaLysLeuThrAlaGluGlnPheAlaGlyLeuLeuArgProLeuAlaProArgLeuTyrSerIleSerSerSerGlnAlaGluValGlyAspGluValHisLeuThrValGlyAlaValArgPheGluHisGluGlyArgAlaArgAlaGlyGlyAlaSerGlyPheLeuAlaAspArgLeuGluGluAspGlyThrValArgValPheValGluArgAsnAspGlyPheArgLeuProGluAspSerArgLysProIleValMetIleGlySerGlyThrGlyValAlaProPheArgAlaPheValGlnGlnArgAlaAlaGluAsnAlaGluGlyLysAsnTrpLeuPhePheGlyAsnProHisPheAlaArgAspPheLeuTyrGlnThrGluTrpGlnGlnPheAlaLysAspGlyPheLeuHisArgTyrAspPheAlaTrpSerArgAspGlnGluGluLysIleTyrValGlnAspLysIleArgGluGlnAlaGluGlyLeuTrpGlnTrpLeuGlnGluGlyAlaHisIleTyrValCysGlyAspAlaAlaLysMetAlaLysAspValGluAlaAlaLeuLeuAspValIleIleGlyAlaGlyHisLeuAspGluGluGlyAlaGluGlyTyrLeuAspMetLeuArgGluGluLysArgTyrGlnArgAspValTyr-599

Hydrophilic Regions - Hopp-Woods (SEQ. ID. NO. 16633)
1-MetGlnAsnThrAsnProProLeuProProMetProProGluIleThrGlnLeuLeuSerGlyLeuAspAlaAlaGlnTrpAlaTrpLeuSerGlyTyrAlaTrpAlaLysAlaGlyAsnGlyAlaSerAlaGlyLeuProAlaLeuGlnThrAlaLeuProThrAlaGluProPheSerValThrValLeuSerAlaSerGlnThrGlyAsnAlaLysSerValAlaAspLysAlaAlaAspSerLeuGluAlaAlaGlyIleGlnValSerArgAlaGluLeuLysAspTyrLysAlaLysAsnIleAlaGlyGluArgArgLeuLeuLeuValThrSerThrGlnGlyGluGlyGluProProGluGluAlaValValLeuHisLysLeuLeuAsnGlyLysLysAlaProLysLeuAspLysLeuGlnPheAlaValLeuGlyLeuGlyAspSerSerTyrProAsnPheCysArgAlaGlyLysAspPheAspLysArgPheGluGluLeuGlyAlaLysArgLeuLeuGluArgValAspAlaAspLeuAspPheAlaAlaAlaAlaAspGlyTrpThrAspAsnIleAlaAlaLeuLeuLysGluGluAlaAlaLysAsnArgAlaThrProAlaProGlnThrThrProProAlaGlyLeuGlnThrAlaProAspGlyArgTyrCysLysAlaAspProPheProAlaAlaLeuLeuAlaAsnGlnLysIleThrAlaArgGlnSerAspLysAspValArgHisIleGluIleAspLeuSerGlySerAspLeuHisTyrLeuProGlyAspAlaLeuGlyValTrpPheAspAsnAspProAlaLeuValArgGluIleLeuAspLeuLeuGlyIleAspGlnAlaThrGluIleGlnAlaGlyGlyLysThrLeuProValAlaSerAlaLeuLeuSerHisPheGluLeuThrGlnAsnThrProAlaPheValLysGlyTyrAlaProPheAlaAspAspAspGluLeuAspArgIleAlaAlaAspAsnAlaValLeuGlnGlyPheValGlnSerThrProIleAlaAspValLeuHisArgPheProAlaLysLeuThrAlaGluGlnPheAlaGlyLeuLeuArgProLeuAlaProArgLeuTyrSerIleSerSerSerGlnAlaGluValGlyAspGluValHisLeuThrValGlyAlaValArgPheGluHisGluGlyArgAlaArgAlaGlyGlyAlaSerGlyPheLeuAlaAspArgLeuGluGluAspGlyThrValArgValPheValGluArgAsnAspGlyPheArgLeuProGluAspSerArgLysProIleValMetIleGlySerGlyThrGlyValAlaProPheArgAlaPheValGlnGlnArgAlaAlaGluAsnAlaGluGlyLysAsnTrpLeuPhePheGlyAsnProHisPheAlaArgAspPheLeuTyrGlnThrGluTrpGlnGlnPheAlaLysAspGlyPheLeuHisArgTyrAspPheAlaTrpSerArgAspGlnGluGluLysIleTyrValGlnAspLysIleArgGluGlnAlaGluGlyLeuTrpGlnTrpLeuGlnGluGlyAlaHisIleTyrValCysGlyAspAlaAlaLysMetAlaLysAspValGluAlaAlaLeuLeuAspValIleIleGlyAlaGlyHisLeuAspGluGluGlyAlaGluGlyTyrLeuAspMetLeuArgGluGluLysArgTyrGlnArgAspValTyr-599 a151
AMPHI Regions - AMPHI
SEQ. ID. NO. 16633 6-AsnIleAlaIleIleAla-11
SEQ. ID. NO. 16634 22-AspGlnLeuLeuArg-26
SEQ. ID. NO. 16635 72-ValAspThrProGlyHis-77
SEQ. ID. NO. 16636 81-GlyGlyGluValGluArgValLeuGlyMetValAspCysVal-94
SEQ. ID. NO. 16637 128-LysIleAspLysPro-132
SEQ. ID. NO. 16638 144-PheGluLeuPheAspAsnLeuGlyAlaThr-153

| | |
|---|---|
| SEQ. ID. NO. 16639 | 165-SerGlyLeuSerGlyPheAlaLysLeuGluGluThrAspGluSerAsn-180 |
| SEQ. ID. NO. 16640 | 184-ProLeuPheAspThrIleLeuLysTyrThr-193 |
| SEQ. ID. NO. 16641 | 248-GlyArgIleAsnGlnLeuLeuGlyPheLysGlyLeuGluArgVal-262 |
| SEQ. ID. NO. 16642 | 273-ValIleIleSerGlyIleGlu-279 |
| SEQ. ID. NO. 16643 | 330-IleArgAspArgLeuGlnLysGluLeu-338 |
| SEQ. ID. NO. 16644 | 348-AspThrAlaAspAla-352 |
| SEQ. ID. NO. 16645 | 396-CysGluProTyrGluAsnLeuThrValAsp-405 |
| SEQ. ID. NO. 16646 | 457-LeuThrArgGlyValGly-462 |
| SEQ. ID. NO. 16647 | 464-MetSerHisValPheAsp-469 |
| SEQ. ID. NO. 16648 | 537-LysGlyLysLysLeuThrAsnIle-544 |
| SEQ. ID. NO. 16649 | 551-GluAlaValArgLeuThrThr-557 |
| Antigenic Index - Jameson-Wolf | |
| SEQ. ID. NO. 16650 | 1-MetLysGlnIleArg-5 |
| SEQ. ID. NO. 16651 | 13-ValAspHisGlyLysThrThrLeu-20 |
| SEQ. ID. NO. 16652 | 24-LeuLeuArgGlnSerGlyThrPheArgAlaAsnGlnGlnValAspGluArgValMetAspSerAsnAspLeuGluLysGluArgGlyIle-53 |
| SEQ. ID. NO. 16653 | 59-AsnThrAlaIleAspTyrGluGlyTyr-67 |
| SEQ. ID. NO. 16654 | 72-ValAspThrProGlyHisAlaAspPheGlyGlyGluValGluArg-86 |
| SEQ. ID. NO. 16655 | 99-AspAlaGlnGluGlyProMetProGlnThrArgPheValThr-112 |
| SEQ. ID. NO. 16656 | 128-LysIleAspLysProSerAlaArgProSerTrp-138 |
| SEQ. ID. NO. 16657 | 151-GlyAlaThrAspGluGlnLeuAsp-158 |
| SEQ. ID. NO. 16658 | 171-AlaLysLeuGluGluThrAspGluSerAsnAspMetArgProLeu-185 |
| SEQ. ID. NO. 16659 | 193-ThrProAlaProSerGlySerAlaAspGluThrLeu-204 |
| SEQ. ID. NO. 16660 | 211-LeuAspTyrAspAsnTyrThrGly-218 |
| SEQ. ID. NO. 16661 | 226-LeuAsnGlyArgIleLysProGlyGln-234 |
| SEQ. ID. NO. 16662 | 240-AsnHisAspGlnGlnIleAla-246 |
| SEQ. ID. NO. 16663 | 257-LysGlyLeuGluArgValProLeuGluGluAlaGluAlaGlyAsp-271 |
| SEQ. ID. NO. 16664 | 277-GlyIleGluAspIleGly-282 |
| SEQ. ID. NO. 16665 | 287-IleThrAspLysAspAsnProLysGlyLeuPro-297 |
| SEQ. ID. NO. 16666 | 300-SerValAspGluProThrLeu-306 |
| SEQ. ID. NO. 16667 | 314-ThrSerProLeuAlaGlyThrGluGlyLysPheValThrSerArgGlnIleArgAspArgLeuGlnLysGluLeuLeu-339 |
| SEQ. ID. NO. 16668 | 344-LeuArgValGluAspThrAlaAspAlaAspValPheArgValSerGlyArgGlyGluLeu-363 |
| SEQ. ID. NO. 16669 | 371-AsnMetArgArgGluGlyTyr-377 |
| SEQ. ID. NO. 16670 | 381-ValGlyLysProArgValValTyrArgAspIleAspGlyGlnLysCysGluProTyrGluAsnLeuThrValAspValProAspAspAsnGln GlyAlaValMetGluGluLeuGlyArgArgArgGlyGluLeuThrAsnMetGluSerAspGlyAsnGlyArgThrArgLeuGluTyr-440 |
| SEQ. ID. NO. 16671 | 467-ValPheAspAspTyrAlaProValLysProAspMetProGlyArgHisAsnGly-484 |
| SEQ. ID. NO. 16672 | 489-GlnGluGlnGlyGlu-493 |
| SEQ. ID. NO. 16673 | 501-AsnLeuGluArgGlyArgMetPheValSerProAsnAspLysIleTyr-517 |
| SEQ. ID. NO. 16674 | 524-IleHisSerArgAspAsnAspLeu-531 |
| SEQ. ID. NO. 16675 | 535-ProLeuLysGlyLysLysLeuThrAsnIleArgAlaSerGlyThrAspGluAlaValArg-554 |
| SEQ. ID. NO. 16676 | 569-PheIleAspAspAspGluLeuValGlu-577 |
| SEQ. ID. NO. 16677 | 579-ThrProGlnSerIleArgLeuArgLysArgTyrLeuSerGluLeuGluArgArgHisPheLysLysLeuAsp-603 |
| Hydrophilic Regions - Hopp-Woods | |
| SEQ. ID. NO. 16678 | 1-MetLysGlnIleArg-5 |
| SEQ. ID. NO. 16679 | 29-GlyThrPheArgAla-33 |
| SEQ. ID. NO. 16680 | 35-GlnGlnValAspGluArgValMetAspSerAsnAspLeuGluLysGluArgGlyIle-53 |
| SEQ. ID. NO. 16681 | 80-PheGlyGlyGluValGluArg-86 |
| SEQ. ID. NO. 16682 | 99-AspAlaGlnGluGlyProMetPro-106 |
| SEQ. ID. NO. 16683 | 128-LysIleAspLysProSerAla-134 |
| SEQ. ID. NO. 16684 | 151-GlyAlaThrAspGluGlnLeuAsp-158 |
| SEQ. ID. NO. 16685 | 171-AlaLysLeuGluGluThrAspGluSerAsnAspMetArgProLeu-185 |
| SEQ. ID. NO. 16686 | 198-GlySerAlaAspGluThrLeu-204 |
| SEQ. ID. NO. 16687 | 226-LeuAsnGlyArgIleLysPro-232 |
| SEQ. ID. NO. 16688 | 241-HisAspGlnGlnIleAla-246 |
| SEQ. ID. NO. 16689 | 258-GlyLeuGluArgValProLeuGluGluAlaGluAlaGlyAsp-271 |
| SEQ. ID. NO. 16690 | 277-GlyIleGluAspIleGly-282 |
| SEQ. ID. NO. 16691 | 287-IleThrAspLysAspAsnProLysGly-295 |
| SEQ. ID. NO. 16692 | 300-SerValAspGluProThrLeu-306 |
| SEQ. ID. NO. 16693 | 318-AlaGlyThrGluGlyLysPheValThr-326 |
| SEQ. ID. NO. 16694 | 328-ArgGlnIleArgAspArgLeuGlnLysGluLeuLeu-339 |
| SEQ. ID. NO. 16695 | 344-LeuArgValGluAspThrAlaAspAlaAspValPheArgValSerGlyArgGlyGluLeu-363 |
| SEQ. ID. NO. 16696 | 371-AsnMetArgArgGluGlyTyr-377 |
| SEQ. ID. NO. 16697 | 381-ValGlyLysProArgValValTyrArgAspIleAspGlyGlnLysCysGluProTyrGlu-400 |
| SEQ. ID. NO. 16698 | 405-AspValProAspAspAsnGlnGlyAlaValMetGluGluLeuGlyArgArgArgGlyGluLeuThrAsnMetGluSerAspGlyAsnGlyArg ThrArgLeu-438 |
| SEQ. ID. NO. 16699 | 472-AlaProValLysProAspMetProGlyArgHis-482 |
| SEQ. ID. NO. 16700 | 489-GlnGluGlnGlyGlu-493 |
| SEQ. ID. NO. 16701 | 502-LeuGluAspArgGlyArgMet-508 |
| SEQ. ID. NO. 16702 | 512-ProAsnAspLysIleTyr-517 |
| SEQ. ID. NO. 16703 | 525-HisSerArgAspAsnAspLeu-531 |
| SEQ. ID. NO. 16704 | 536-LeuLysGlyLysLysLeuThrAsn-543 |
| SEQ. ID. NO. 16705 | 545-ArgAlaSerGlyThrAspGluAlaValArg-554 |
| SEQ. ID. NO. 16706 | 569-PheIleAspAspAspGluLeuValGlu-577 |
| SEQ. ID. NO. 16707 | 583-IleArgLeuArgLysArgTyrLeuSerGluLeuGluArgArgHisPheLysLysLeuAsp-603 |
| a152 | |
| AMPHI Regions - AMPHI | |
| SEQ. ID. NO. 16708 | 10-PheProThrArgLeuPhe-15 |
| SEQ. ID. NO. 16709 | 66-ArgPheSerArgPheValArgGlyTrpSerGlyIleArgGluTyrMetLysAsnGlyIleProGluHisValGlnProGlyHisAsnProLeu-96 |
| SEQ. ID. NO. 16710 | 103-AlaLeuLeuAlaAla-107 |
| SEQ. ID. NO. 16711 | 130-LeuAsnHisLeuValSerGluHisThrGlySerLeu-141 |
| SEQ. ID. NO. 16712 | 150-PheLysLeuLeuAlaValPheSerAlaValHisIleAlaXxxValAlaAlaTyr-167 |

TABLE 1-continued

Antigenic Index - Jameson-Wolf
SEQ. ID. NO. 16713   1-MetLysAsnLysThrLysValTrp-8
SEQ. ID. NO. 16714   28-TyrSerAlaLysThrGlyGlyAsp-35
SEQ. ID. NO. 16715   61-GlySerAspThrAlaArgPhe-67
SEQ. ID. NO. 16716   74-TrpSerGlyIleArgGluTyrMetLysAsnGlyIleProGluHisValGlnProGlyHisAsnProLeu-96
SEQ. ID. NO. 16717   125-SerThrAsnGlyTyr-129
SEQ. ID. NO. 16718   137-HisThrGlySerLeuMetArg-143
SEQ. ID. NO. 16719   169-ValPheLysLysLysAsnLeu-175
SEQ. ID. NO. 16720   186-IleGluGlyLysThrSerIle-192
Hydrophilic Regions - Hopp-Woods
SEQ. ID. NO. 16721   1-MetLysAsnLysThrLysVal-7
SEQ. ID. NO. 16722   63-AspThrAlaArgPhe-67
SEQ. ID. NO. 16723   78-ArgGluTyrMetLys-82
SEQ. ID. NO. 16724   169-ValPheLysLysLysAsnLeu-175
SEQ. ID. NO. 16725   186-IleGluGlyLysThrSerIle-192
a153
AMPHI Regions - AMPHI
SEQ. ID. NO. 16726   17-AlaAlaSerValLeuSerLeuProGluMetMetArgLeuMetValPhe-32
SEQ. ID. NO. 16727   96-ThrLeuValAlaTyrIleLysLeuSerSerValAlaGlu-108
SEQ. ID. NO. 16728   130-ValSerValProGlnHisTrp-136
SEQ. ID. NO. 16729   222-ValAsnThrIleLeuAsnGlyIleAlaTyr-231
SEQ. ID. NO. 16730   274-AlaLysLysLeuSerHisLeuTyrArgIleThrGluAlaValGlyArgTrpSerMetIleAspIlePheValIle-298
Antigenic Index - Jameson-Wolf
SEQ. ID. NO. 16731   65-IleArgLysGlnAla-69
SEQ. ID. NO. 16732   81-ValArgLeuArgGln-85
SEQ. ID. NO. 16733   107-AlaGluValArgPhe-111
SEQ. ID. NO. 16734   143-ArgLeuThrGlyAspAsnAlaValGlnThrAlaSerGluGlyLysThrCysCysSer-161
SEQ. ID. NO. 16735   165-TyrPheArgAspSerAlaGluSerProCysGly-175
SEQ. ID. NO. 16736   180-GluLeuTyrArgArgArgProLysSerLeuSer-190
SEQ. ID. NO. 16737   215-SerAsnProAlaAlaThr-220
SEQ. ID. NO. 16738   234-AspGluGlyAspArgLeu-239
SEQ. ID. NO. 16739   272-ThrGlyAlaLysLysLeu-277
SEQ. ID. NO. 16740   339-LeuLeuTrpAspLysArgAlaSerAspGlyIleAla-350
SEQ. ID. NO. 16741   352-AsnGluThrGluLysHisAsp-358
Hydrophilic Regions - Hopp-Woods
SEQ. ID. NO. 16742   81-ValArgLeuArgGln-85
SEQ. ID. NO. 16743   107-AlaGluValArgPhe-111
SEQ. ID. NO. 16744   152-ThrAlaSerGluGlyLysThrCysCys-160
SEQ. ID. NO. 16745   168-AspSerAlaGluSerPro-173
SEQ. ID. NO. 16746   180-GluLeuTyrArgArgArgProLysSerLeuSer-190
SEQ. ID. NO. 16747   234-AspGluGlyAspArgLeu-239
SEQ. ID. NO. 16748   273-GlyAlaLysLysLeu-277
SEQ. ID. NO. 16749   339-LeuLeuTrpAspLysArgAlaSerAsp-347
SEQ. ID. NO. 16750   352-AsnGluThrGluLysHisAsp-358
a154
AMPHI Regions - AMPHI
SEQ. ID. NO. 16751   122-GlyValThrGlyLeuGlyThrLeuLeu-130
SEQ. ID. NO. 16752   152-GlnAspIleProProValThr-158
SEQ. ID. NO. 16753   262-ThrLysAsnSerLysAsnValLysSer-270
SEQ. ID. NO. 16754   298-PheLysGlnSerVal-302
SEQ. ID. NO. 16755   360-SerLysGluHisTrpLysGlnGlnPheGlnThrAlaLeuAsnLysGlyLeuThrAla-378
SEQ. ID. NO. 16756   389-SerLysMetIleGluLeuAsnAsp-396
SEQ. ID. NO. 16757   429-LysLeuAlaAspLeuLeuAspLysPheAspLysLeuPro-441
SEQ. ID. NO. 16758   446-ValAlaGluLeuAsnGly-451
SEQ. ID. NO. 16759   467-LeuSerSerIleAspLysLeuValGlyLysProGlnThrGlnAsnIleProAsnGluLeuAsnGlnThrLeuLysGluLeuArgThrThr-496
SEQ. ID. NO. 16760   506-IleTyrGlyAspValGlnAsnThrLeuGlnSerLeuAspLysThrLeuLysAspValGlnProValIleAsnThrLeuLysGluLys-534
Antigenic Index - Jameson-Wolf
SEQ. ID. NO. 16761   1-MetThrAspAsnSerProProProAsnGlyHisAlaGlnAlaArgValArgLysAsnAsnThr-21
SEQ. ID. NO. 16762   43-LysGluIleArgAsnArgGlyProVal-51
SEQ. ID. NO. 16763   57-AspSerAlaGluGlyIleGluValAsnAsnThr-67
SEQ. ID. NO. 16764   75-AspValGlyArgValThrArgIleLysLeuArgAspAspGlnLysGlyValGlu-92
SEQ. ID. NO. 16765   100-AspValSerGlyLeuIleArgSerAspThrGln-110
SEQ. ID. NO. 16766   114-ValLysProArgIleAspGlnSerGly-122
SEQ. ID. NO. 16767   138-ThrProGlyLysSerAspGluAlaLysAspValPheGln-150
SEQ. ID. NO. 16768   169-LeuIleGlyLysAsnAspArgIleLeuAsn-178
SEQ. ID. NO. 16769   196-AlaHisPheAspProSerAspGlnSer-204
SEQ. ID. NO. 16770   212-GlnSerProAsnAspLysLeuIle-219
SEQ. ID. NO. 16771   228-GluSerGlyIleAsnIleGluThrThrGlySerGlyIleLysLeuAsnSer-244
SEQ. ID. NO. 16772   256-SerPheAspSerProLysThrLysAsnSerLysAsnValLysSerGluAspSer-273
SEQ. ID. NO. 16773   275-ThrLeuTyrAspSerArgSerGluValAlaAsnLeuProAspAspArgSerLeu-292
SEQ. ID. NO. 16774   300-GlnSerValArgGlyLeu-305
SEQ. ID. NO. 16775   311-ValGluTyrLysGlyLeuAsn-317
SEQ. ID. NO. 16776   325-ProTyrPheAspArgAsnAspSer-332
SEQ. ID. NO. 16777   345-IleArgIleGluProSerArgLeuGluIleAsnAsnAspGluGlnSerLysGluHisTrpLysGlnGlnPhe-368
SEQ. ID. NO. 16778   371-AlaLeuAsnLysGlyLeu-376
SEQ. ID. NO. 16779   386-LeuThrGlySerLysSerMetIleGluLeuAsnAspGlnProSerAlaSerProLysLeuArgPro-406
SEQ. ID. NO. 16780   419-GlnGlyGlyGlyLeuAspAspLeuGlnValLysLeu-430
SEQ. ID. NO. 16781   432-AspLeuLeuAspLysPheAspLysLeuProLeuAspLysThrValAla-447
SEQ. ID. NO. 16782   450-AsnGlySerLeuAlaGluLeuLysSerThrLeuLysSerAlaAsn-464
SEQ. ID. NO. 16783   469-SerIleAspLysLeuValGlyLysProGlnThrGlnAsnIleProAsnGluLeuAsnGlnThrLeuLysGluLeuArgThrThr-496

TABLE 1-continued

| | |
|---|---|
| SEQ. ID. NO. 16784 | 500-ValSerProGlnSer-504 |
| SEQ. ID. NO. 16785 | 516-SerLeuAspLysThrLeuLysAspValGln-525 |
| SEQ. ID. NO. 16786 | 530-ThrLeuLysGluLysProAsn-536 |
| SEQ. ID. NO. 16787 | 541-AsnSerSerSerLysAspProIleProLysGlySerArg-553 |
| Hydrophilic Regions - Hopp-Woods | |
| SEQ. ID. NO. 16788 | 1-MetThrAspAsnSerProProPro-8 |
| SEQ. ID. NO. 16789 | 12-AlaGlnAlaArgValArgLysAsnAsn-20 |
| SEQ. ID. NO. 16790 | 43-LysGluIleArgAsnArgGly-49 |
| SEQ. ID. NO. 16791 | 57-AspSerAlaGluGlyIleGlu-63 |
| SEQ. ID. NO. 16792 | 75-AspValGlyArgValThrArgIleLysLeuArgAspAspGlnLysGlyValGlu-92 |
| SEQ. ID. NO. 16793 | 105-IleArgSerAspThr-109 |
| SEQ. ID. NO. 16794 | 116-ProArgIleAspGln-120 |
| SEQ. ID. NO. 16795 | 140-GlyLysSerAspGluAlaLysAspValPheGln-150 |
| SEQ. ID. NO. 16796 | 171-GlyLysAsnAspArgIleLeu-177 |
| SEQ. ID. NO. 16797 | 196-AlaHisPheAspProSerAspGln-203 |
| SEQ. ID. NO. 16798 | 214-ProAsnAspLysLeuIle-219 |
| SEQ. ID. NO. 16799 | 258-AspSerProLysThrLysAsnSerLysAsnValLysSerGluAspSer-273 |
| SEQ. ID. NO. 16800 | 278-AspSerArgSerGluVal-283 |
| SEQ. ID. NO. 16801 | 285-AsnLeuProAspAspArgSer-291 |
| SEQ. ID. NO. 16802 | 311-ValGluTyrLysGly-315 |
| SEQ. ID. NO. 16803 | 328-AspArgAsnAspSer-332 |
| SEQ. ID. NO. 16804 | 345-IleArgIleGluProSerArgLeuGluIleAsnAlaAspGluGlnSerLysGluHisTrpLys-365 |
| SEQ. ID. NO. 16805 | 390-LysMetIleGluLeuAsnAspGlnProSerAlaSerProLysLeuArgPro-406 |
| SEQ. ID. NO. 16806 | 421-GlyGlyLeuAspAspLeuGlnValLysLeu-430 |
| SEQ. ID. NO. 16807 | 432-AspLeuLeuAspLysPheAspLysLeuProLeuAspLysThrValAla-447 |
| SEQ. ID. NO. 16808 | 454-AlaGluLeuLysSerThrLeuLysSerAlaAsn-464 |
| SEQ. ID. NO. 16809 | 469-SerIleAspLysLeuValGly-475 |
| SEQ. ID. NO. 16810 | 482-1IeProAsnGluLeu-486 |
| SEQ. ID. NO. 16811 | 488-GlnThrLeuLysGluLeuArgThr-495 |
| SEQ. ID. NO. 16812 | 516-SerLeuAspLysThrLeuLysAspValGln-525 |
| SEQ. ID. NO. 16813 | 530-ThrLeuLysGluLysProAsn-536 |
| SEQ. ID. NO. 16814 | 543-SerSerLysAspProIleProLysGlySerArg-553 |
| a155 | |
| AMPHI Regions - AMPHI | |
| SEQ. ID. NO. 16815 | 28-LysLeuGlyPheGlu-32 |
| SEQ. ID. NO. 16816 | 42-AlaAlaSerLeuAsp-46 |
| SEQ. ID. NO. 16817 | 105-LeuArgAlaLysLysVal-110 |
| SEQ. ID. NO. 16818 | 118-ValProArgIleSerArgAlaGlnAlaLeuAspXxxLeuSerXxxMetAlaAsnIleSerGlyTyrArgAlaValIleGluAlaAlaAsn AlaPheGlyArgXxxPheThrGlyGlnIleThrAlaAlaGly-161 |
| SEQ. ID. NO. 16819 | 175-ValAlaGlyLeuAlaAlaIleGlyThrAlaAsnSerLeuGlyAlaValValArgValPhe-194 |
| SEQ. ID. NO. 16820 | 201-AlaGluGlnLeuGluSerMetGlyGly-209 |
| SEQ. ID. NO. 16821 | 225-AspGlyTyrAlaLysValMet-231 |
| SEQ. ID. NO. 16822 | 264-AlaProLysXxxXxxXxxLysGluMetValGluSerMetLys-277 |
| SEQ. ID. NO. 16823 | 281-ValIleValAspLeu-285 |
| SEQ. ID. NO. 16824 | 307-GlyValLysIleIleGlyTyrThrAspMetAlaAsnArgLeuAlaGlyGln-323 |
| SEQ. ID. NO. 16825 | 330-ThrAsnLeuValAsnLeuThrLysLeuLeuSer-340 |
| SEQ. ID. NO. 16826 | 404-LysLeuAlaProAlaXxxIle-410 |
| SEQ. ID. NO. 16827 | 428-AsnHisPheIleVal-432 |
| SEQ. ID. NO. 16828 | 451-LeuHisThrProLeuMetSerValThrAsnAlaIleSerGlyIleIle-466 |
| SEQ. ID. NO. 16829 | 469-GlyAlaLeuLeuGln-473 |
| SEQ. ID. NO. 16830 | 478-AsnGlyPheValSerLeuLeuSerPheValAla-488 |
| SEQ. ID. NO. 16831 | 494-IleAsnIlePheGlyGly-499 |
| Antigenic Index - Jameson-Wolf | |
| SEQ. ID. NO. 16832 | 4-GlyIleProArgGluSerLeuSerGlyGluThrArgVal-16 |
| SEQ. ID. NO. 16833 | 44-SerLeuAspAspAlaAla-49 |
| SEQ. ID. NO. 16834 | 72-ValAsnAlaProSerGluAspGluLeuProLeuLeuLysGluGlyGln-87 |
| SEQ. ID. NO. 16835 | 94-TrpProArgGlnAsnGluAlaLeu-101 |
| SEQ. ID. NO. 16836 | 105-LeuArgAlaLysLysValAsn-111 |
| SEQ. ID. NO. 16837 | 117-MetValProArgIleSerArg-123 |
| SEQ. ID. NO. 16838 | 159-AlaAlaGlyLysValProProAla-166 |
| SEQ. ID. NO. 16839 | 202-GluGlnLeuGluSerMetGlyGlyLys-210 |
| SEQ. ID. NO. 16840 | 215-AspPheProGlnGluSerGlyGlySerGlyAspGlyTyrAlaLysValMetSer-232 |
| SEQ. ID. NO. 16841 | 242-LeuPheAlaGluGlnAlaLysGluValAsp-251 |
| SEQ. ID. NO. 16842 | 259-IleProGlyLysProAlaProLysXxxXxxXxxLysGluMetValGluSerMetLysProGlySer-280 |
| SEQ. ID. NO. 16843 | 290-GlyGlyAsnCysGluLeuThrLysGlnGlyGlu-300 |
| SEQ. ID. NO. 16844 | 320-LeuAlaGlyGlnSerSer-325 |
| SEQ. ID. NO. 16845 | 338-LeuLeuSerProAsnLysAspGlyGluIle-347 |
| SEQ. ID. NO. 16846 | 349-LeuAspPheGluAspValIle-355 |
| SEQ. ID. NO. 16847 | 360-ThrValThrArgAspGlyGluIleThrPhePro-370 |
| SEQ. ID. NO. 16848 | 378-AlaGlnProGlnGlnThrProSerGluLysAlaAlaProAlaAlaLysProGluProLysPro-398 |
| SEQ. ID. NO. 16849 | 509-MetPheArgLysGly-513 |
| Hydrophilic Regions - Hopp-Woods | |
| SEQ. ID. NO. 16850 | 4-GlyIleProArgGluSerLeuSerGlyGluThrArgVal-16 |
| SEQ. ID. NO. 16851 | 44-SerLeuAspAspAlaAla-49 |
| SEQ. ID. NO. 16852 | 74-AlaProSerGluAspGluLeuProLeuLeuLysGluGlyGln-87 |
| SEQ. ID. NO. 16853 | 96-ArgGlnAsnGluAlaLeu-101 |
| SEQ. ID. NO. 16854 | 105-LeuArgAlaLysLysValAsn-111 |
| SEQ. ID. NO. 16855 | 117-MetValProArgIleSerArg-123 |
| SEQ. ID. NO. 16856 | 202-GluGlnLeuGluSerMetGly-208 |
| SEQ. ID. NO. 16857 | 215-AspPheProGlnGluSerGlyGlySerGlyAspGlyTyrAla-228 |

TABLE 1-continued

| SEQ. ID. NO. 16858 | 242-LeuPheAlaGluGlnAlaLysGluValAsp-251 |
| SEQ. ID. NO. 16859 | 260-ProGlyLysProAlaProLysXxxXxxXxxLysGluMetValGluSerMetLysPro-278 |
| SEQ. ID. NO. 16860 | 291-GlyAsnCysGluLeuThrLysGlnGlyGlu-300 |
| SEQ. ID. NO. 16861 | 340-SerProAsnLysAspGlyGluIle-347 |
| SEQ. ID. NO. 16862 | 349-LeuAspPheGluAspValIle-355 |
| SEQ. ID. NO. 16863 | 360-ThrValThrArgAspGlyGluIle-367 |
| SEQ. ID. NO. 16864 | 382-GlnThrProSerGluLysAlaAlaProAlaAlaLysProGluProLysPro-398 | a156
AMPHI Regions - AMPHI
SEQ. ID. NO. 16865    56-AsnGlyPheGluAlaPheAlaProPhe-64
SEQ. ID. NO. 16866    80-AlaThrValAsnThr-84
Antigenic Index - Jameson-Wolf
SEQ. ID. NO. 16867    21-TyrAlaLysLysAlaGlyGlyPheArgPheLysAspAsnHisAsnProArgAspPheLeuAlaArgThrGlnGlyThrAlaAlaArgAla
                      HisAlaAlaGlnGlnAsnGlyPheGlu-59
SEQ. ID. NO. 16868    73-AlaThrGlyAsnAlaGlyGln-79
SEQ. ID. NO. 16869    103-AspLysAlaAlaLeu-107
Hydrophilic Regions - Hopp-Woods
SEQ. ID. NO. 16870    21-TyrAlaLysLysAlaGlyGlyPheArgPheLysAspAsnHisAsnProArgAspPheLeuAla-41
SEQ. ID. NO. 16871    43-ThrGlnGlyThrAlaAlaArgAlaHisAla-52
SEQ. ID. NO. 16872    103-AspLysAlaAlaLeu-107 a157
AMPHI Regions - AMPHI
SEQ. ID. NO. 16873    10-ArgArgGluLeuArgArgAla-16
SEQ. ID. NO. 16874    32-IleAsnArgLeuLeuLysArgTyrIleLysArgGly-43
SEQ. ID. NO. 16875    61-PheValArgAlaAlaGln-66
SEQ. ID. NO. 16876    137-LeuGlyGlnAlaGlyGlyGly-142
SEQ. ID. NO. 16877    167-GlnPheValAspArgLeuProArgGluProHisAspLeuLeuLeuAspGly-183
Antigenic Index - Jameson-Wolf
SEQ. ID. NO. 16878    1-MetArgAsnGluGluLysHisAlaLeuArgArgGluLeuArgArgAlaArgAlaGlnMetGlyHisGlnGlyArgLeuAlaAla-28
SEQ. ID. NO. 16879    34-ArgLeuLeuLysArgTyrIleLysArgGlyArgLysIle-46
SEQ. ID. NO. 16880    51-ProMetGlyLysGluLeuArgLeuAspGlyPheVal-62
SEQ. ID. NO. 16881    64-AlaAlaGlnLysArgGlyAlaLysLeu-72
SEQ. ID. NO. 16882    77-IleGluProArgSerArgArgMetTrp-85
SEQ. ID. NO. 16883    88-ProTyrProGluSerGlyMetGluArgGluArgIleArgGlyArgAlaLysLeuAsnVal-107
SEQ. ID. NO. 16884    110-PheAlaGlyArgLysIleArgVal-117
SEQ. ID. NO. 16885    129-GlyIleAspArgGluGlyTyrArgLeuGlyGln-139
SEQ. ID. NO. 16886    153-TyrArgLeuGlnAla-157
SEQ. ID. NO. 16887    168-PheValAspArgLeuProArgGluProHisAspLeuLeuLeu-181
Hydrophilic Regions - Hopp-Woods
SEQ. ID. NO. 16888    1-MetArgAsnGluGluLysHisAlaLeuArgArgGluLeuArgArgAlaArgAlaGlnMet-20
SEQ. ID. NO. 16889    34-ArgLeuLeuLysArgTyrIleLysArgGlyArgLysIle-46
SEQ. ID. NO. 16890    54-LysGluLeuArgLeu-58
SEQ. ID. NO. 16891    64-AlaAlaGlnLysArgGlyAla-70
SEQ. ID. NO. 16892    77-IleGluProArgSerArgArg-83
SEQ. ID. NO. 16893    92-SerGlyMetGluArgGluArgIleArgGlyArgAlaLysLeu-105
SEQ. ID. NO. 16894    111-AlaGlyArgLysIleArgVal-117
SEQ. ID. NO. 16895    129-GlyIleAspArgGluGlyTyrArg-136
SEQ. ID. NO. 16896    153-TyrArgLeuGlnAla-157
SEQ. ID. NO. 16897    170-AspArgLeuProArgGluProHisAspLeuLeu-180 a158
AMPHI Regions - AMPHI
SEQ. ID. NO. 16898    20-PheSerArgAlaAlaGluGlnLeu-27
SEQ. ID. NO. 16899    33-AlaValSerArgIleValLysArgLeuGlu-42
SEQ. ID. NO. 16900    46-GlyValAsnLeuLeuAsnArgThr-53
SEQ. ID. NO. 16901    63-GlyAlaGlnTyrPheArgArgAlaGlnArgIleLeuGlnGlu-76
SEQ. ID. NO. 16902    85-LeuAlaValHisGluIleProGln-92
SEQ. ID. NO. 16903    166-ValIleAlaSerPro-170
SEQ. ID. NO. 16904    178-ThrProGlnSerThrGluGluLeu-185
SEQ. ID. NO. 16905    188-HisGlnCysLeuGlyPheThrGluProGlySerLeuAsnThrTrpAlaVal-204
Antigenic Index - Jameson-Wolf
SEQ. ID. NO. 16906    1-MetLysThrAsnSerGluGluLeu-8
SEQ. ID. NO. 16907    16-GluSerGlySerPheSerArgAlaAlaGlu-25
SEQ. ID. NO. 16908    36-ArgIleValLysArgLeuGluGluLysLeuGly-46
SEQ. ID. NO. 16909    49-LeuLeuAsnArgThrThrArgGlnLeuSerLeuThrGluGluGlyAlaGlnTyrPheArgArgAlaGlnArgIleLeuGln-75
SEQ. ID. NO. 16910    78-AlaAlaAlaGluThrGluMet-84
SEQ. ID. NO. 16911    90-IleProGlnGlyValLeuArgValAspSer-99
SEQ. ID. NO. 16912    114-LysPheAsnGluArgTyrProHisIleArg-123
SEQ. ID. NO. 16913    136-IleGluArgLysValAspIle-142
SEQ. ID. NO. 16914    144-LeuArgAlaGlyGluLeuAspAspSerGlyLeuArgAla-156
SEQ. ID. NO. 16915    158-HisLeuPheAspSerArgPheArgVal-166
SEQ. ID. NO. 16916    168-AlaSerProGluTyrLeuAlaLysHisGlyThrProGlnSerThrGluGluLeuAla-186
SEQ. ID. NO. 16917    192-GlyPheThrGluProGlySerLeuAsn-200
SEQ. ID. NO. 16918    207-AlaGlnGlyAsnProTyrLysIle-214
SEQ. ID. NO. 16919    216-ProHisPheThrAlaSerSerGlyGluIleLeu-226
SEQ. ID. NO. 16920    229-LeuCysLeuSerGlyCysGly-235
SEQ. ID. NO. 16921    243-LeuValAspAsnAspIleAlaGluGlyLysLeu-253
SEQ. ID. NO. 16922    258-AlaGluGlnThrSerAsnLysThrHisProPhe-268

TABLE 1-continued

| SEQ. ID. NO. 16923 | 273-TyrSerAspLysAlaValAsnLeu-280 |
| SEQ. ID. NO. 16924 | 292-GluLeuGlyAsnAsnLeuCysGly-299 |

Hydrophilic Regions - Hopp-Woods
| SEQ. ID. NO. 16925 | 1-MetLysThrAsnSerGluGluLeu-8 |
| SEQ. ID. NO. 16926 | 19-SerPheSerArgAlaAlaGlu-25 |
| SEQ. ID. NO. 16927 | 36-ArgIleValLysArgLeuGluGluLysLeuGly-46 |
| SEQ. ID. NO. 16928 | 58-SerLeuThrGluGluGlyAlaGlnTyrPheArgArgAlaGlnArgIleLeuGln-75 |
| SEQ. ID. NO. 16929 | 78-AlaAlaAlaGluThrGluMet-84 |
| SEQ. ID. NO. 16930 | 95-LeuArgValAspSer-99 |
| SEQ. ID. NO. 16931 | 114-LysPheAsnGluArgTyrPro-120 |
| SEQ. ID. NO. 16932 | 136-IleGluArgLysValAspIle-142 |
| SEQ. ID. NO. 16933 | 144-LeuArgAlaGlyGluLeuAspAspSerGlyLeuArgAla-156 |
| SEQ. ID. NO. 16934 | 162-SerArgPheArgVal-166 |
| SEQ. ID. NO. 16935 | 180-GlnSerThrGluGluLeuAla-186 |
| SEQ. ID. NO. 16936 | 246-AsnAspIleAlaGluGlyLysLeu-253 |
| SEQ. ID. NO. 16937 | 260-GlnThrSerAsnLysThrHis-266 |
| SEQ. ID. NO. 16938 | 276-LysAlaValAsnLeu-280 | a160
AMPHI Regions - AMPHI
| SEQ. ID. NO. 16939 | 6-LysLeuValAspPheAlaGlnLeuThrGly-15 |
| SEQ. ID. NO. 16940 | 72-GlyLeuGlyHisVal-76 |
| SEQ. ID. NO. 16941 | 121-AlaAspLeuMetAsnGlyLeuProGluThr-130 |
| SEQ. ID. NO. 16942 | 157-GlyThrValSerMetValAsnAlaLeuSerSer-167 |
| SEQ. ID. NO. 16943 | 186-LeuSerGlyValLeuLysGlyTrpGlnAspLysArg-197 |
| SEQ. ID. NO. 16944 | 200-HisLeuIleGlnLysValIleAspLysProGlu-210 |
| SEQ. ID. NO. 16945 | 218-MetValAlaAlaAlaAsn-223 |
| SEQ. ID. NO. 16946 | 229-LeuMetArgArgPhe-233 |
| SEQ. ID. NO. 16947 | 242-HisAlaPheValAsnHisIleArg-249 |
| SEQ. ID. NO. 16948 | 279-PheGlyLysAlaPheLys-284 |

Antigenic Index - Jameson-Wolf
| SEQ. ID. NO. 16949 | 2-AspIleLeuAspLysLeuVal-8 |
| SEQ. ID. NO. 16950 | 28-SerValArgHisGluThrLeuGlnArgGluGlyLeu-39 |
| SEQ. ID. NO. 16951 | 51-CysIleAspGlyGluThrSerProArgProValSerThrGlyAsp-65 |
| SEQ. ID. NO. 16952 | 77-LeuSerHisAspGlyLysCysGlyGluSerLeuGlnProAspMetArgGlnHisGly-95 |
| SEQ. ID. NO. 16953 | 101-GlnCysGlyAsnGlyGlnAspMet-108 |
| SEQ. ID. NO. 16954 | 115-PheArgTyrAspThrHisAla-121 |
| SEQ. ID. NO. 16955 | 123-LeuMetAsnGlyLeu-127 |
| SEQ. ID. NO. 16956 | 149-LeuGluSerLysLysProLeu-155 |
| SEQ. ID. NO. 16957 | 178-LeuGluGlnAspLysAspValGluLeu-186 |
| SEQ. ID. NO. 16958 | 192-GlyTrpGlnAspLysArgLeuGly-199 |
| SEQ. ID. NO. 16959 | 205-ValIleAspLysProGluAspGluTrpAsnValAspLysMetVal-219 |
| SEQ. ID. NO. 16960 | 228-GlnLeuMetArgArgPheLysSerArgValGlyLeuSerProHis-242 |
| SEQ. ID. NO. 16961 | 255-LeuLeuLeuLysLysAsnProAspSerVal-264 |
| SEQ. ID. NO. 16962 | 274-GlnSerGluThrHisPhe-279 |
| SEQ. ID. NO. 16963 | 281-LysAlaPheLysArg-285 |
| SEQ. ID. NO. 16964 | 290-SerProGlyGlnTyrArgLysGluGlyGlyGlnLys-301 |

Hydrophilic Regions - Hopp-Woods
| SEQ. ID. NO. 16965 | 2-AspIleLeuAspLysLeuVal-8 |
| SEQ. ID. NO. 16966 | 29-ValArgHisGluThrLeuGlnArgGluGlyLeu-39 |
| SEQ. ID. NO. 16967 | 53-AspGlyGluThrSerProArgProValSer-62 |
| SEQ. ID. NO. 16968 | 79-HisAspGlyLysCysGlyGluSerLeuGlnProAspMetArgGln-93 |
| SEQ. ID. NO. 16969 | 101-GlnCysGlyAsnGlyGlnAsp-107 |
| SEQ. ID. NO. 16970 | 149-LeuGluSerLysLysProLeu-155 |
| SEQ. ID. NO. 16971 | 178-LeuGluGlnAspLysAspValGluLeu-186 |
| SEQ. ID. NO. 16972 | 193-TrpGlnAspLysArgLeuGly-199 |
| SEQ. ID. NO. 16973 | 205-ValIleAspLysProGluAspGluTrpAsnVal-215 |
| SEQ. ID. NO. 16974 | 228-GlnLeuMetArgArgPheLysSerArgValGly-238 |
| SEQ. ID. NO. 16975 | 255-LeuLeuLeuLysLysAsnProAspSer-263 |
| SEQ. ID. NO. 16976 | 281-LysAlaPheLysArg-285 |
| SEQ. ID. NO. 16977 | 293-GlnTyrArgLysGluGlyGlyGlnLys-301 | a163
AMPHI Regions - AMPHI
| SEQ. ID. NO. 16978 | 60-SerSerLeuGlyAsnIle-65 |
| SEQ. ID. NO. 16979 | 67-LeuGlyArgAspGluAsp-72 |
| SEQ. ID. NO. 16980 | 76-PheGlyPheLeuSerTrpLeuAlaMetLeuPhe-86 |
| SEQ. ID. NO. 16981 | 100-AlaGluProLeuMetHisTyrPheSerAspIleThrAla-112 |
| SEQ. ID. NO. 16982 | 170-IleSerGlyArgPheGlyAspAlaIleAspIleMetAlaLeuLeuAlaThrPhePheGlyIleIleThrThr-193 |
| SEQ. ID. NO. 16983 | 227-MetSerLeuAlaValValSerAlaIleSerGlyValGlyLysGlyValLysValLeuSer-246 |
| SEQ. ID. NO. 16984 | 272-AlaPheGlyAspAsnIleGlyAsnTyrLeuGlyAsnLeuValArg-286 |
| SEQ. ID. NO. 16985 | 313-TrpCysSerTrpAlaProPheValGlyLeuPheIleAla-325 |
| SEQ. ID. NO. 16986 | 346-LeuPheGlyValLeuTrpPhe-352 |
| SEQ. ID. NO. 16987 | 367-AlaGlyGlyValLeuGluLysMetThrSerSer-377 |
| SEQ. ID. NO. 16988 | 380-ThrLeuLeuPheLysPhePheAsnTyrLeuProLeuProGluLeuThrSerIleValSerLeuLeu-401 |
| SEQ. ID. NO. 16989 | 438-TrpGlyValLeuMetSerAla-444 |
| SEQ. ID. NO. 16990 | 454-GlyLeuGlyAsnLeuGlnSerMetThrLeu-463 |
| SEQ. ID. NO. 16991 | 520-GluGlnAspIleLeuLysPheLeuLysHisThrAla-531 |
| SEQ. ID. NO. 16992 | 535-MetHisGluLeuGlnArgGluLeu-542 |
| SEQ. ID. NO. 16993 | 574-AspPheMetTyrGlyIle-579 |
| SEQ. ID. NO. 16994 | 583-GlyGlnAspValSerAspGlnLeu-590 |
| SEQ. ID. NO. 16995 | 630-AlaAspIleLeuLysAsnTyr-636 |

TABLE 1-continued

Antigenic Index - Jameson-Wolf
SEQ. ID. NO. 16996  29-AspArgAlaLysGlu-33
SEQ. ID. NO. 16997  65-IleArgLeuGlyArgAspGluAspValPro-74
SEQ. ID. NO. 16998  111-ThrAlaGlyThrProGluHisArgGlnGln-120
SEQ. ID. NO. 16999  166-LeuLysGluLysIleSerGlyArgPheGlyAspAlaIleAsp-179
SEQ. ID. NO. 17000  200-GlnLeuGlyAlaGlyLeu-205
SEQ. ID. NO. 17001  237-GlyValGlyLysGlyValLysVal-244
SEQ. ID. NO. 17002  293-AlaTyrGluArgGluHisLysProTrpPhe-302
SEQ. ID. NO. 17003  326-ArgIleSerLysGlyArgThrIleArg-334
SEQ. ID. NO. 17004  370-ValLeuGluLysMetThrSerSerProGluThr-380
SEQ. ID. NO. 17005  409-ThrSerAlaAspSerGlyIle-415
SEQ. ID. NO. 17006  421-IleThrSerArgAspLysGlyLeuSerAlaProArgTrp-433
SEQ. ID. NO. 17007  451-ArgSerGlyGlyLeuGlyAsn-457
SEQ. ID. NO. 17008  484-LeuSerAlaAspLysLysTyrPheGluThrArgValAsnProThrSer-499
SEQ. ID. NO. 17009  503-ThrGlyGlyLysTrpLysGluArgLeu-511
SEQ. ID. NO. 17010  516-SerGlnThrGlnGluGlnAspIle-523
SEQ. ID. NO. 17011  537-GluLeuGlnArgGluLeuSerGluGluTyrGlyLeu-548
SEQ. ID. NO. 17012  550-ValArgValAspLysMetPheHisGlnAspGluProAla-562
SEQ. ID. NO. 17013  566-ValIleArgLysGluThrMetArg-573
SEQ. ID. NO. 17014  581-SerValGlyGlnAspValSerAspGlnLeuIleAsnAspGlyLysLeuProHisIleArgHisGlnThrThrTyrLysProTyr-608
SEQ. ID. NO. 17015  612-PheAspGlyArgValGlyTyr-618
SEQ. ID. NO. 17016  622-TyrMetAsnLysAspGluLeuIle-629
SEQ. ID. NO. 17017  632-IleLeuLysAsnTyrGlu-637
SEQ. ID. NO. 17018  654-GluGlnValGluLeuAlaGlu-660
Hydrophilic Regions - Hopp-Woods
SEQ. ID. NO. 17019  29-AspArgAlaLysGlu-33
SEQ. ID. NO. 17020  66-ArgLeuGlyArgAspGluAspValPro-74
SEQ. ID. NO. 17021  114-ThrProGluHisArgGlnGln-120
SEQ. ID. NO. 17022  166-LeuLysGluLysIleSerGlyArgPheGlyAsp-176
SEQ. ID. NO. 17023  238-ValGlyLysGlyValLysVal-244
SEQ. ID. NO. 17024  293-AlaTyrGluArgGluHisLysPro-300
SEQ. ID. NO. 17025  327-IleSerLysGlyArgThrIleArg-334
SEQ. ID. NO. 17026  370-ValLeuGluLysMetThrSerSerPro-378
SEQ. ID. NO. 17027  422-ThrSerArgAspLysGlyLeuSer-429
SEQ. ID. NO. 17028  484-LeuSerAlaAspLysLysTyrPheGlu-492
SEQ. ID. NO. 17029  506-LysTrpLysGluArgLeu-511
SEQ. ID. NO. 17030  517-GlnThrGlnGluGlnAspIle-523
SEQ. ID. NO. 17031  537-GluLeuGlnArgGluLeuSerGluGluTyrGlyLeu-548
SEQ. ID. NO. 17032  550-ValArgValAspLysMetPheHisGlnAspGluProAla-562
SEQ. ID. NO. 17033  566-ValIleArgLysGluThrMetArg-573
SEQ. ID. NO. 17034  581-SerValGlyGlnAspValSerAsp-588
SEQ. ID. NO. 17035  590-LeuIleAsnAspGlyLysLeuProHis-598
SEQ. ID. NO. 17036  622-TyrMetAsnLysAspGluLeuIle-629
SEQ. ID. NO. 17037  654-GluGlnValGluLeuAlaGlu-660
a164
AMPHI Regions - AMPHI
SEQ. ID. NO. 17038  6-AlaAsnPheTyrGluMetLeuThrAlaAla-15
SEQ. ID. NO. 17039  33-AlaTyrArgAlaLeuLysGlnGlu-40
SEQ. ID. NO. 17040  75-AlaValSerAlaIleGlyAlaVal-82
SEQ. ID. NO. 17041  97-TyrIleLeuAsnAspCys-102
SEQ. ID. NO. 17042  113-LeuSerLysGluLeuAlaGlyLeuLysAla-122
SEQ. ID. NO. 17043  148-PheGluAspValArgPheProGlu-156
SEQ. ID. NO. 17044  160-LeuGlyArgGlnProArgIleAsnAspLeuAlaHis-171
SEQ. ID. NO. 17045  189-TyrAlaAsnLeuPheAlaAsnLeuAsnGlyIleGluArgIlePheLys-204
SEQ. ID. NO. 17046  264-ValProAlaIleTyrThr-269
SEQ. ID. NO. 17047  282-TrpPheAsnArgIle-286
SEQ. ID. NO. 17048  311-AlaLysLeuLeuGluGlyTyrGlyLeuSer-320
SEQ. ID. NO. 17049  362-GluValGlyGluLeuIle-367
SEQ. ID. NO. 17050  374-MetArgGlyTyrLeuAsn-379
SEQ. ID. NO. 17051  387-ThrIleValAsnGlyTrpLeuLys-394
SEQ. ID. NO. 17052  424-ValTyrProArgGluIleGluGluGlu-432
SEQ. ID. NO. 17053  459-PheValGlnLeuLysGluGlyMet-466
SEQ. ID. NO. 17054  472-GluIleArgArgHisLeuArgThrVal-480
SEQ. ID. NO. 17055  484-PheLysIleProLysGln-489
SEQ. ID. NO. 17056  499-AsnAlaThrGlyLysValLeuLysArgValLeuLysGluGlnPheAspGlyAsn-516
Antigenic Index - Jameson-Wolf
SEQ. ID. NO. 17057  1-MetAsnArgThrTyr-5
SEQ. ID. NO. 17058  15-AlaCysArgLysAsnGlyAsnGly-22
SEQ. ID. NO. 17059  26-PheAspGlyLysGluLysThrAlaTyrArgAlaLeuLysGlnGluAlaGluAla-43
SEQ. ID. NO. 17060  63-ValSerAsnSerThrGlu-68
SEQ. ID. NO. 17061  88-ThrPheLeuLysAsnSerGlu-94
SEQ. ID. NO. 17062  100-AsnAspCysLysAla-104
SEQ. ID. NO. 17063  112-GlyLeuSerLysGluLeuAlaGly-119
SEQ. ID. NO. 17064  121-LysAlaGlnThrProValGlu-127
SEQ. ID. NO. 17065  133-GlyGlnSerArgProAspGlyGluMetAlaGluGlyAspAlaPhePheGluAspValArgArgPheProGluLysProAspLeuGlyArgGlnProArgIleAsnAsp-168
SEQ. ID. NO. 17066  176-SerGlyThrThrGlyHisProLysGlyAla-185
SEQ. ID. NO. 17067  196-LeuAsnGlyIleGluArgIlePheLysIleSerLysArgAspArgPhe-211
SEQ. ID. NO. 17068  270-AlaMetSerLysThrLysIle-276
SEQ. ID. NO. 17069  291-SerGlyGlyAlaProLeuAla-297

TABLE 1-continued

| SEQ. ID. NO. 17070 | 304-PheLysAlaLysPheProArg-310 |
| --- | --- |
| SEQ. ID. NO. 17071 | 317-TyrGlyLeuSerGluAlaSer-323 |
| SEQ. ID. NO. 17072 | 330-ThrProGluArgGlnLysAlaArgSer-338 |
| SEQ. ID. NO. 17073 | 343-LeuProGlyLeuGluValLysAlaValAspGluGluLeuValGluValProArgGlyGluValGly-364 |
| SEQ. ID. NO. 17074 | 367-IleValArgGlyGlySerValMet-374 |
| SEQ. ID. NO. 17075 | 382-AlaAlaThrAspGluThrIle-388 |
| SEQ. ID. NO. 17076 | 393-LeuLysThrGlyAsp-397 |
| SEQ. ID. NO. 17077 | 400-ThrIleAspGluAspGly-405 |
| SEQ. ID. NO. 17078 | 410-ValAspArgLysLysAspLeuIleIleSerLysGlyGlnAsnValTyrProArgGluIleGluGluGluIleTyrLys-435 |
| SEQ. ID. NO. 17079 | 446-GlyValLysAspArgTyrAlaAspGluGluIle-456 |
| SEQ. ID. NO. 17080 | 462-LeuLysGluGlyMetAspLeuGlyGluAsnGluIleArgArgHisLeuArg-478 |
| SEQ. ID. NO. 17081 | 490-IleHisPheLysAspGlyLeuProArgAsnAlaThrGlyLysValLeuLysArgValLeuLysGluGlnPheAspGlyAsnLys-517 |

Hydrophilic Regions - Hopp-Woods

| SEQ. ID. NO. 17082 | 15-AlaCysArgLysAsnGlyAsn-21 |
| --- | --- |
| SEQ. ID. NO. 17083 | 26-PheAspGlyLysGluLysThrAlaTyrArgAlaLeuLysGlnGluAlaGluAla-43 |
| SEQ. ID. NO. 17084 | 112-GlyLeuSerLysGluLeuAlaGly-119 |
| SEQ. ID. NO. 17085 | 135-SerArgProAspGlyGluMetAlaGluGlyAspAlaPhePheGluAspValArgArgPheProGluLysProAspLeuGlyArgGln ProArgIleAsnAsp-168 |
| SEQ. ID. NO. 17086 | 198-GlyIleGluArgIlePheLysIleSerLysArgAspArgPhe-211 |
| SEQ. ID. NO. 17087 | 304-PheLysAlaLysPheProArg-310 |
| SEQ. ID. NO. 17088 | 330-ThrProGluArgGlnLysAlaArgSer-338 |
| SEQ. ID. NO. 17089 | 346-LeuGluValLysAlaValAspGluGluLeuValGluValProArgGlyGluValGly-364 |
| SEQ. ID. NO. 17090 | 382-AlaAlaThrAspGluThrIle-388 |
| SEQ. ID. NO. 17091 | 400-ThrIleAspGluAspGly-405 |
| SEQ. ID. NO. 17092 | 410-ValAspArgLysLysAspLeuIleIle-418 |
| SEQ. ID. NO. 17093 | 425-TyrProArgGluIleGluGluGluIleTyrLys-435 |
| SEQ. ID. NO. 17094 | 446-GlyValLysAspArgTyrAlaAspGluGluIle-456 |
| SEQ. ID. NO. 17095 | 462-LeuLysGluGlyMetAspLeuGlyGluAsnGluIleArgArgHisLeuArg-478 |
| SEQ. ID. NO. 17096 | 494-AspGlyLeuProArgAsnAlaThr-501 |
| SEQ. ID. NO. 17097 | 503-LysValLeuLysArgValLeuLysGluGlnPheAspGlyAsnLys-517 | a165-1
AMPHI Regions - AMPHI

| SEQ. ID. NO. 17098 | 17-AlaThrLeuGlyValLeuLeuLysGluLeu-26 |
| --- | --- |
| SEQ. ID. NO. 17099 | 33-ThrLeuIleGluArgLeuGluAsp-40 |
| SEQ. ID. NO. 17100 | 72-IleIleAspProAlaArgAlaLeuAsnIleAla-82 |
| SEQ. ID. NO. 17101 | 90-GlnPheTrpAlaThr-94 |
| SEQ. ID. NO. 17102 | 108-AsnAlaValProHis-112 |
| SEQ. ID. NO. 17103 | 125-LeuGlnLysArgTyrAspAlaPheLysThrGlnLysLeuPheGluAsnMet-141 |
| SEQ. ID. NO. 17104 | 182-ArgLeuThrArgGlnMetValLysTyrLeuGlnGly-193 |
| SEQ. ID. NO. 17105 | 198-ThrGluPheAsnArgHisValGluAspIleLysArgGlu-210 |
| SEQ. ID. NO. 17106 | 364-LysThrLysGluGlu-368 |
| SEQ. ID. NO. 17107 | 371-AlaSerLeuLeuGluTyrTyr-377 |
| SEQ. ID. NO. 17108 | 456-ArgLeuLysGluLeu-460 |

Antigenic Index - Jameson-Wolf

| SEQ. ID. NO. 17109 | 1-MetAlaGluAlaThrAsp-6 |
| --- | --- |
| SEQ. ID. NO. 17110 | 24-LysGluLeuGluProSerTrp-30 |
| SEQ. ID. NO. 17111 | 36-GluArgLeuGluAspValAlaLeuGluSerSerAsnAlaTrpAsnAsnAlaGlyThrGly-55 |
| SEQ. ID. NO. 17112 | 97-AlaGluGlyLysLeuGluAspAsnSer-105 |
| SEQ. ID. NO. 17113 | 117-MetAsnGluAspHisCysSerTyrLeuGlnLysArgTyrAspAlaPheLysThrGlnLysLeuPheGlu-139 |
| SEQ. ID. NO. 17114 | 141-MetGluPheSerThrAspArgAsnLysIleSerAsp-152 |
| SEQ. ID. NO. 17115 | 157-MetMetArgGlyArgAspGluAsnGlnPro-166 |
| SEQ. ID. NO. 17116 | 169-AlaAsnTyrSerAlaGluGlyThrAspValAspPheGlyArgLeuThrArgGlnMet-187 |
| SEQ. ID. NO. 17117 | 191-LeuGlnGlyLysGlyValLysThrGluPheAsnArgHisValGluAspIleLysArgGluSerAspGly-213 |
| SEQ. ID. NO. 17118 | 219-ThrAlaAspThrArgAsnProAspGlyGlnLeu-229 |
| SEQ. ID. NO. 17119 | 249-GlnLysSerGlyIleProGluGlyLysGlyTyrGly-260 |
| SEQ. ID. NO. 17120 | 269-PheArgAsnSerAsnProGluThrAlaGluGlnHisAsn-281 |
| SEQ. ID. NO. 17121 | 300-LeuAspThrArgAsnValAspGlyLysArgHisLeu-311 |
| SEQ. ID. NO. 17122 | 322-AsnPheLeuLysGlnGlySerLeuMet-330 |
| SEQ. ID. NO. 17123 | 361-GluLeuArgLysThrLysGluGluArgPhe-370 |
| SEQ. ID. NO. 17124 | 377-TyrProGluAlaAsnProAspAspTrpGlu-386 |
| SEQ. ID. NO. 17125 | 395-GlnIleIleLysLysAspSerGluLysGlyGly-405 |
| SEQ. ID. NO. 17126 | 415-AlaHisAlaAspGlySer-420 |
| SEQ. ID. NO. 17127 | 428-SerProGlyAlaSerThr-433 |
| SEQ. ID. NO. 17128 | 446-PheProGluArgThrProSerTrpGluGlyArgLeuLysGluLeuValProGlyTyr-464 |
| SEQ. ID. NO. 17129 | 467-LysLeuAsnGluAsnProGluArgAlaAspGlu-477 |

Hydrophilic Regions - Hopp-Woods

| SEQ. ID. NO. 17130 | 1-MetAlaGluAlaThrAsp-6 |
| --- | --- |
| SEQ. ID. NO. 17131 | 24-LysGluLeuGluPro-28 |
| SEQ. ID. NO. 17132 | 36-GluArgLeuGluAspValAlaLeuGluSer-45 |
| SEQ. ID. NO. 17133 | 97-AlaGluGlyLysLeuGluAspAsnSer-105 |
| SEQ. ID. NO. 17134 | 117-MetAsnGluAspHisCys-122 |
| SEQ. ID. NO. 17135 | 125-LeuGlnLysArgTyrAspAlaPheLysThr-134 |
| SEQ. ID. NO. 17136 | 141-MetGluPheSerThrAspArgAsnLysIleSerAsp-152 |
| SEQ. ID. NO. 17137 | 158-MetArgGlyArgAspGluAsnGlnPro-166 |
| SEQ. ID. NO. 17138 | 172-SerAlaGluGlyThrAspValAspPhe-180 |
| SEQ. ID. NO. 17139 | 182-ArgLeuThrArgGlnMet-187 |
| SEQ. ID. NO. 17140 | 194-LysGlyValLysThrGluPheAsnArgHisValGluAspIleLysArgGluSerAspGly-213 |
| SEQ. ID. NO. 17141 | 219-ThrAlaAspThrArgAsnProAspGly-227 |
| SEQ. ID. NO. 17142 | 252-GlyIleProGluGlyLysGly-258 |
| SEQ. ID. NO. 17143 | 272-SerAsnProGluThrAlaGluGlnHisAsn-281 |

TABLE 1-continued

| | |
|---|---|
| SEQ. ID. NO. 17144 | 300-LeuAspThrArgAsnValAspGlyLysArg-309 |
| SEQ. ID. NO. 17145 | 361-GluLeuArgLysThrLysGluGluArgPhe-370 |
| SEQ. ID. NO. 17146 | 380-AlaAsnProAspAspTrpGlu-386 |
| SEQ. ID. NO. 17147 | 395-GlnIleIleLysLysAspSerGluLysGlyGly-405 |
| SEQ. ID. NO. 17148 | 446-PheProGluArgThrProSerTrpGluGlyArgLeuLysGluLeuVal-461 |
| SEQ. ID. NO. 17149 | 467-LysLeuAsnGluAsnProGluArgAlaAspGlu-477 | a205-1
AMPHI Regions - AMPHI

| | |
|---|---|
| SEQ. ID. NO. 17150 | 6-ProGluGlnAsnValValArgLeuThrGlyLysHisProAsnAspLeuGluAlaValValGlyLys-27 |
| SEQ. ID. NO. 17151 | 46-CysHisThrLeuPheAlaLysLeuValGlyAsnIleAlaGluAspGlyGlyLys-63 |
| SEQ. ID. NO. 17152 | 75-GlnProTyrGlnAla-79 |

Antigenic Index - Jameson-Wolf

| | |
|---|---|
| SEQ. ID. NO. 17153 | 1-ProLeuLysGlyLeuProGluGlnAsnVal-10 |
| SEQ. ID. NO. 17154 | 13-LeuThrGlyLysHisProAsnAspLeuGluAlaValVal-25 |
| SEQ. ID. NO. 17155 | 27-LysCysMetGluThrAspGlyLysGlyAlaProSerGly-39 |
| SEQ. ID. NO. 17156 | 57-IleAlaGluAspGlyGlyLysLeuThr-65 |
| SEQ. ID. NO. 17157 | 77-TyrGlnAlaGlyLysSerGlyTyr-84 |
| SEQ. ID. NO. 17158 | 96-IleAspSerGluGly-100 |
| SEQ. ID. NO. 17159 | 103-TyrPheArgArgArgHisTyr-109 |

Hydrophilic Regions - Hopp-Woods

| | |
|---|---|
| SEQ. ID. NO. 17160 | 13-LeuThrGlyLysHisProAsnAspLeuGluAlaValVal-25 |
| SEQ. ID. NO. 17161 | 27-LysCysMetGluThrAspGlyLysGlyAla-36 |
| SEQ. ID. NO. 17162 | 57-IleAlaGluAspGlyGlyLysLeu-64 |
| SEQ. ID. NO. 17163 | 78-GlnAlaGlyLysSerGly-83 |
| SEQ. ID. NO. 17164 | 96-IleAspSerGluGly-100 |
| SEQ. ID. NO. 17165 | 104-PheArgArgArgHisTyr-109 | a206
AMPHI Regions - AMPHI

| | |
|---|---|
| SEQ. ID. NO. 17166 | 32-ProLysGlnThrValArgGlnIleGlnAlaVal-42 |
| SEQ. ID. NO. 17167 | 44-IleSerHisIleAspArgThrGlnGly-52 |
| SEQ. ID. NO. 17168 | 81-CysSerGlyMetIleGln-86 |
| SEQ. ID. NO. 17169 | 99-ArgThrAlaArgAspMet-104 |
| SEQ. ID. NO. 17170 | 150-SerGlyLysThrIleLysThrGlu-157 |

Antigenic Index - Jameson-Wolf

| | |
|---|---|
| SEQ. ID. NO. 17171 | 2-PheProProAspLysThrLeu-8 |
| SEQ. ID. NO. 17172 | 21-GlyThrThrSerGlyLysHisArgGlnProLysProLysGlnThrValArg-37 |
| SEQ. ID. NO. 17173 | 45-SerHisIleAspArgThrGlnGlySerGln-54 |
| SEQ. ID. NO. 17174 | 66-ThrProTyrLysTrpGlyGlySerSerThr-75 |
| SEQ. ID. NO. 17175 | 96-LysLeuProArgThrAlaArgAspMetAlaAlaAlaSerArgLysIleProAspSerArgLeuLysAlaGly-119 |
| SEQ. ID. NO. 17176 | 126-ThrGlyGlyAlaHisArgTyrSer-133 |
| SEQ. ID. NO. 17177 | 148-ProSerSerGlyLysThrIleLysThrGluLysLeuSer-160 |

Hydrophilic Regions - Hopp-Woods

| | |
|---|---|
| SEQ. ID. NO. 17178 | 23-ThrSerGlyLysHisArgGlnProLysProLysGlnThrVal-36 |
| SEQ. ID. NO. 17179 | 45-SerHisIleAspArgThrGlnGlySerGln-54 |
| SEQ. ID. NO. 17180 | 96-LysLeuProArgThrAlaArgAspMetAlaAlaAlaSerArgLysIleProAspSerArgLeuLysAlaGly-119 |
| SEQ. ID. NO. 17181 | 149-SerSerGlyLysThrIleLysThrGluLysLeuSer-160 | a211
AMPHI Regions - AMPHI

| | |
|---|---|
| SEQ. ID. NO. 17182 | 18-ValGlyAsnGlyValAspGluPheGlyArgGlyAla-29 |
| SEQ. ID. NO. 17183 | 57-GlnPheGluArgAla-61 |
| SEQ. ID. NO. 17184 | 98-IleGluGlyPheAspLysIleAsnProAla-107 |

Antigenic Index - Jameson-Wolf

| | |
|---|---|
| SEQ. ID. NO. 17185 | 8-AsnGlnLeuGlyGlyArgAsnGlyThrAlaValGlyAsnGlyValAspGluPheGlyArgGlyAlaAspAsnGlnValGluPheLeuGlu-37 |
| SEQ. ID. NO. 17186 | 44-GlyAlaSerGlyArgAlaAla-50 |
| SEQ. ID. NO. 17187 | 73-GlyGluAspAspValVal-78 |
| SEQ. ID. NO. 17188 | 100-GlyPheAspLysIleAsnProAlaVal-108 |
| SEQ. ID. NO. 17189 | 141-ArgTyrHisProLysLeuHisAspGlyAsnGlnAsnGlyLysArgHisGlyLysLeuHisHisArgAla-163 |
| SEQ. ID. NO. 17190 | 169-CysGlnSerAlaGly-173 |

Hydrophilic Regions - Hopp-Woods

| | |
|---|---|
| SEQ. ID. NO. 17191 | 10-LeuGlyGlyArgAsnGlyThr-16 |
| SEQ. ID. NO. 17192 | 21-GlyValAspGluPheGlyArgGlyAlaAspAsnGlnValGluPheLeuGlu-37 |
| SEQ. ID. NO. 17193 | 73-GlyGluAspAspValVal-78 |
| SEQ. ID. NO. 17194 | 100-GlyPheAspLysIleAsn-105 |
| SEQ. ID. NO. 17195 | 142-TyrHisProLysLeuHisAspGlyAsnGlnAsnGlyLysArgHisGlyLysLeuHisHis-161 | a212
AMPHI Regions - AMPHI

| | |
|---|---|
| SEQ. ID. NO. 17196 | 6-TrpAsnGlyIleProAspIleArgThr-14 |
| SEQ. ID. NO. 17197 | 16-AspGlnThrIleArgLysHisAlaHis-24 |
| SEQ. ID. NO. 17198 | 40-PheGlnThrAlaGlnAsp-45 |
| SEQ. ID. NO. 17199 | 63-CysLeuGlnPheAspSerIleAsnLeuIleGluHisIle-75 |
| SEQ. ID. NO. 17200 | 89-ThrArgArgLeuHisGluHis-95 |
| SEQ. ID. NO. 17201 | 199-ArgLeuLeuGlyHis-203 |
| SEQ. ID. NO. 17202 | 238-HisAsnHisLeuTyrArgSerIleThrGlnAlaGluAlaGluLysIle-253 |
| SEQ. ID. NO. 17203 | 262-TyrAlaGluProLeuCysGlyLeu-269 |
| SEQ. ID. NO. 17204 | 397-TrpAsnGluAlaGluGluAla-403 |
| SEQ. ID. NO. 17205 | 439-AspSerProAspHis-443 |
| SEQ. ID. NO. 17206 | 445-ProLeuValGlyAlaLeuGlyAspIleAlaAlaMetGlnGlnThr-459 |
| SEQ. ID. NO. 17207 | 481-AlaTyrAlaAsnThrAlaHisGlyThrArgGlyLeu-492 |
| SEQ. ID. NO. 17208 | 506-IleLeuGlyLeuPro-510 |
| SEQ. ID. NO. 17209 | 512-ProLeuSerLysArgLeuArg-518 |

TABLE 1-continued

```
Antigenic Index - Jameson-Wolf
SEQ. ID. NO. 17210    10-ProAspIleArgThrLeuAspGlnThrIleArgLysHisAlaHisProLeu-26
SEQ. ID. NO. 17211    33-ProAspAsnGlnIleProAsnPhe-40
SEQ. ID. NO. 17212    42-ThrAlaGlnAspAlaSerAspAlaGluCysArgLeuLysHisArgLeuAspGln-59
SEQ. ID. NO. 17213    85-ProProSerArgThrArgArgLeuHisGlu-94
SEQ. ID. NO. 17214    105-AlaIleProGlnThrGluSerLysProAspLysProTrp-117
SEQ. ID. NO. 17215    120-LeuProGlnThrSerGluArgGlnLysProGluHis-131
SEQ. ID. NO. 17216    158-LeuGluAlaArgLysAlaAlaGln-165
SEQ. ID. NO. 17217    168-SerGlyAsnArgGlnGly-173
SEQ. ID. NO. 17218    178-LysIleSerProHisAspThrGluGlnThrGlu-188
SEQ. ID. NO. 17219    193-GlyTyrGlyTyrThrLys-198
SEQ. ID. NO. 17220    205-LeuProGluSerGluThrTrpGlyGlyAsnGly-215
SEQ. ID. NO. 17221    220-AsnTyrSerArgThrGluGlnGlnArgAsnHisGluLeuGlyLeu-234
SEQ. ID. NO. 17222    236-LysHisHisAsnHisLeu-241
SEQ. ID. NO. 17223    245-IleThrGlnAlaGluAlaGluLysIleAla-254
SEQ. ID. NO. 17224    258-LeuAsnThrProTyrAla-263
SEQ. ID. NO. 17225    294-LeuHisGluAspThrProLeu-300
SEQ. ID. NO. 17226    302-AspIleSerHisAspGlyGluLysTrpIle-311
SEQ. ID. NO. 17227    328-ThrGlyAlaAsnSerProTyrLeuPro-336
SEQ. ID. NO. 17228    346-ArgGlnIleArgGlyGlnThrGlyLeuThrProSerThrProPheSerGluGlnLeuArg-365
SEQ. ID. NO. 17229    376-ProSerTrpHisGly-380
SEQ. ID. NO. 17230    391-AsnSerSerHisThrGlyTrpAsnGluAlaGluGluAlaSerAsnArgGlnAla-408
SEQ. ID. NO. 17231    424-AsnProAsnProGlnLysHisGlnGly-432
SEQ. ID. NO. 17232    436-IleArgCysAspSerProAspHisLeuPro-445
SEQ. ID. NO. 17233    464-AlaLeuAspLysAsnTyrArgIleAspAla-473
SEQ. ID. NO. 17234    486-AlaHisGlyThrArgGlyLeuAla-493
SEQ. ID. NO. 17235    511-HisProLeuSerLysArgLeuArgHis-519
SEQ. ID. NO. 17236    522-HisProAsnArgAlaIle-527
SEQ. ID. NO. 17237    531-IleValArgArgLysAspLeuThrPro-539
Hydrophilic Regions - Hopp-Woods
SEQ. ID. NO. 17238    10-ProAspIleArgThrLeuAspGlnThrIleArgLysHisAla-23
SEQ. ID. NO. 17239    44-GlnAspAlaSerAspAlaGluCysArgLeuLysHisArgLeuAspGln-59
SEQ. ID. NO. 17240    87-SerArgThrArgArgLeuHisGlu-94
SEQ. ID. NO. 17241    105-AlaIleProGlnThrGluSerLysProAspLys-115
SEQ. ID. NO. 17242    122-GlnThrSerGluArgGlnLysProGluHis-131
SEQ. ID. NO. 17243    158-LeuGluAlaArgLysAlaAlaGln-165
SEQ. ID. NO. 17244    180-SerProHisAspThrGluGlnThrGlu-188
SEQ. ID. NO. 17245    206-ProGluSerGluThr-210
SEQ. ID. NO. 17246    222-SerArgThrGluGlnGlnArgAsnHisGlu-231
SEQ. ID. NO. 17247    246-ThrGlnAlaGluAlaGluLysIleAla-254
SEQ. ID. NO. 17248    294-LeuHisGluAspThrProLeu-300
SEQ. ID. NO. 17249    303-IleSerHisAspGlyGluLysTrpIle-311
SEQ. ID. NO. 17250    346-ArgGlnIleArgGly-350
SEQ. ID. NO. 17251    398-AsnGluAlaGluGluAlaSerAsnArgGlnAla-408
SEQ. ID. NO. 17252    426-AsnProGlnLysHisGlnGly-432
SEQ. ID. NO. 17253    436-IleArgCysAspSerProAsp-442
SEQ. ID. NO. 17254    467-LysAsnTyrArgIleAspAla-473
SEQ. ID. NO. 17255    513-LeuSerLysArgLeuArgHis-519
SEQ. ID. NO. 17256    531-IleValArgArgLysAspLeuThrPro-539
a214-1
AMPHI Regions - AMPHI
SEQ. ID. NO. 17257    6-CysLysLeuPheValLeuIle-12
SEQ. ID. NO. 17258    69-ValThrArgGlyGlyLysGlyGlyGluSerVal-79
SEQ. ID. NO. 17259    88-PheSerGlnThrLeuAsp-93
SEQ. ID. NO. 17260    122-LysValGlnArgGlyGlyAspVal-129
SEQ. ID. NO. 17261    150-ThrLysSerGlyAlaLysSerAlaSerLys-159
Antigenic Index - Jameson-Wolf
SEQ. ID. NO. 17262    23-LeuGlnSerAspSerArgGlnProIle-31
SEQ. ID. NO. 17263    33-IleGluAlaAspGlnGlySerLeuAspGlnAlaAsnGlnSerThrThrPheSerGlyAsn-52
SEQ. ID. NO. 17264    71-ArgGlyGlyLysGlyGlyGluSerValArgAlaGluGlySerProValArgPheSerGlnThrLeuAspGlyGlyLysGlyThrValArg
                      GlyGlnAlaAsnAsn-105
SEQ. ID. NO. 17265    119-GlyAsnAlaLysValGlnArgGlyGlyAspValAlaGlu-131
SEQ. ID. NO. 17266    137-TyrAsnThrLysThrGluVal-143
SEQ. ID. NO. 17267    148-GlySerThrLysSerGlyAlaLysSerAlaSerLysSerGlyArgValSerVal-165
SEQ. ID. NO. 17268    168-GlnProSerSerThrGlnLysSerGlu-176
Hydrophilic Regions - Hopp-Woods
SEQ. ID. NO. 17269    25-SerAspSerArgGlnProIle-31
SEQ. ID. NO. 17270    33-IleGluAlaAspGlnGlySerLeuAspGlnAlaAsn-44
SEQ. ID. NO. 17271    71-ArgGlyGlyLysGlyGlyGluSerValArgAlaGluGlySerPro-85
SEQ. ID. NO. 17272    92-LeuAspGlyGlyLysGlyThrValArgGlyGlnAla-103
SEQ. ID. NO. 17273    121-AlaLysValGlnArgGlyGlyAspValAlaGlu-131
SEQ. ID. NO. 17274    148-GlySerThrLysSerGlyAlaLysSerAlaSerLysSerGlyArg-162
SEQ. ID. NO. 17275    171-SerThrGlnLysSerGlu-176
a215
AMPHI Regions - AMPHI
SEQ. ID. NO. 17276    21-SerLeuSerAlaTrpLeuGlyArgIle-29
SEQ. ID. NO. 17277    67-SerSerLysGlyAlaLysGlnPheProGlu-76
```

TABLE 1-continued

Antigenic Index - Jameson-Wolf
SEQ. ID. NO. 17278   3-ValArgTrpArgTyrGly-8
SEQ. ID. NO. 17279   28-ArgIleSerGluValGluIleGluGluValArgLeuAsnProAspGluProGlnTyrThrMetAspGlyLeuAspGlyArgArgPhe
                     AspGluGlnGlyTyrLeuLys-63
SEQ. ID. NO. 17280   65-HisLeuSerSerLysGlyAlaLysGlnPheProGluSerSerAspIleHisPheAspSerProHisLeu-87
SEQ. ID. NO. 17281   99-ValGlySerAspGluAlaValTyrHisThrGluAsnLysGlnValLeuPhe-115
SEQ. ID. NO. 17282   123-LysThrAlaAspGlyLysArgGlnAlaGlyLysValGluAlaGluLysLeuHisValAspThrGluSerGlnTyrAlaGlnThrAspThrProVal-154
SEQ. ID. NO. 17283   160-AlaSerHisGlyGlnAlaGlyGlyMetThrTyrAspHisLysThrGly-175
SEQ. ID. NO. 17284   179-PheSerSerLysValLys-184
SEQ. ID. NO. 17285   187-IleTyrAspThrLysAspMet-193
Hydrophilic Regions - Hopp-Woods
SEQ. ID. NO. 17286   29-IleSerGluValGluIleGluGluValArgLeuAsnProAspGluProGlnTyr-46
SEQ. ID. NO. 17287   49-AspGlyLeuAspGlyArgArgPheAspGlu-58
SEQ. ID. NO. 17288   65-HisLeuSerSerLysGlyAlaLysGlnPheProGluSerSerAspIleHisPhe-82
SEQ. ID. NO. 17289   99-ValGlySerAspGluAlaValTyr-106
SEQ. ID. NO. 17290   108-ThrGluAsnLysGlnValLeu-114
SEQ. ID. NO. 17291   123-LysThrAlaAspGlyLysArgGlnAlaGlyLysValGluAlaGluLysLeuHisValAspThrGluSerGlnTyrAla-148
SEQ. ID. NO. 17292   170-TyrAspHisLysThr-174
SEQ. ID. NO. 17293   187-IleTyrAspThrLysAspMet-193
a216
AMPHI Regions - AMPHI
SEQ. ID. NO. 17294   21-AlaGluGlyLeuArgGluIleAlaAlaAspLeu-31
SEQ. ID. NO. 17295   62-ArgLysMetAlaAla-66
SEQ. ID. NO. 17296   167-LeuGlyAspAlaLeuAlaVal-173
SEQ. ID. NO. 17297   203-ValAlaAspIleMetHis-208
SEQ. ID. NO. 17298   218-LeuGlyThrProLeuLysGlu-224
SEQ. ID. NO. 17299   244-GlyArgLeuLysGlyVal-249
SEQ. ID. NO. 17300   253-GlyAspLeuArgArgLeuPheGlnGluCysAspAsnPheThrGlyLeuSerIle-270
SEQ. ID. NO. 17301   274-MetHisThrHisProLysThrIleSerAla-283
SEQ. ID. NO. 17302   292-LysValMetGlnAlaAsn-297
Antigenic Index - Jameson-Wolf
SEQ. ID. NO. 17303   4-AlaGlyAsnGluLysTyrLeuAspTrpAlaArg-14
SEQ. ID. NO. 17304   16-ValLeuHisThrGluAlaGluGlyLeuArgGluIleAlaAlaAspLeuAspGlu-33
SEQ. ID. NO. 17305   45-CysLysGlyArgVal-49
SEQ. ID. NO. 17306   53-GlyMetGlyLysSerGlyHisIleGlyArgLysMetAla-65
SEQ. ID. NO. 17307   82-GluAlaAlaHisGlyAspLeu-88
SEQ. ID. NO. 17308   92-ValAspAsnAspVal-96
SEQ. ID. NO. 17309   101-SerAsnSerGlyGluSerAspGluIle-109
SEQ. ID. NO. 17310   115-AlaLeuLysArgLysAspIle-121
SEQ. ID. NO. 17311   127-ThrAlaArgProAspSerThrMetAlaArgHisAlaAsp-139
SEQ. ID. NO. 17312   146-ValSerLysGluAlaCysPro-152
SEQ. ID. NO. 17313   179-ArgAlaPheThrProAspAspPheAla-187
SEQ. ID. NO. 17314   190-HisProAlaGlySerLeuGlyLys-197
SEQ. ID. NO. 17315   205-AspIleMetHisLysGlyGlyGlyLeuProAla-215
SEQ. ID. NO. 17316   218-LeuGlyThrProLeuLysGluAlaIle-226
SEQ. ID. NO. 17317   229-MetSerGluLysGlyGlyLeu-234
SEQ. ID. NO. 17318   239-ValThrAspGlyGlnGlyArgLeuLysGly-248
SEQ. ID. NO. 17319   250-PheThrAspGlyAspLeuArgArgLeuPheGlnGluCysAspAsnPheThr-266
SEQ. ID. NO. 17320   277-HisProLysThrIleSerAlaGluArgLeuAlaThrGluAlaLeuLys-292
SEQ. ID. NO. 17321   305-ThrAspAlaAspGly-309
Hydrophilic Regions - Hopp-Woods
SEQ. ID. NO. 17322   5-GlyAsnGluLysTyrLeuAspTrpAlaArg-14
SEQ. ID. NO. 17323   16-ValLeuHisThrGluAlaGluGlyLeuArgGluIleAlaAlaAspLeuAspGlu-33
SEQ. ID. NO. 17324   45-CysLysGlyArgVal-49
SEQ. ID. NO. 17325   58-GlyHisIleGlyArgLysMetAla-65
SEQ. ID. NO. 17326   102-AsnSerGlyGluSerAspGluIle-109
SEQ. ID. NO. 17327   115-AlaLeuLysArgLysAspIle-121
SEQ. ID. NO. 17328   128-AlaArgProAspSerThrMetAlaArgHisAlaAsp-139
SEQ. ID. NO. 17329   146-ValSerLysGluAlaCys-151
SEQ. ID. NO. 17330   179-ArgAlaPheThrProAspAspPheAla-187
SEQ. ID. NO. 17331   220-ThrProLeuLysGluAlaIle-226
SEQ. ID. NO. 17332   229-MetSerGluLysGlyGlyLeu-234
SEQ. ID. NO. 17333   241-AspGlyGlnGlyArgLeuLys-247
SEQ. ID. NO. 17334   253-GlyAspLeuArgArgLeuPheGlnGluCysAspAsn-264
SEQ. ID. NO. 17335   279-LysThrIleSerAlaGluArgLeuAlaThrGluAlaLeuLys-292
SEQ. ID. NO. 17336   305-ThrAspAlaAspGly-309
a218
AMPHI Regions - AMPHI
SEQ. ID. NO. 17337   9-AlaLysValValSerThrMet-15
SEQ. ID. NO. 17338   24-AlaMetAspGluIleHisSer-30
SEQ. ID. NO. 17339   78-AlaArgSerTrpTrpArgAsnLeuHisGlyAlaPheGlyThrTrpValSerLeuIleLeu-97
SEQ. ID. NO. 17340   111-TrpGlyGlyLysPheValGlnAlaTrpSerGlnPhePro-123
SEQ. ID. NO. 17341   176-AspGluProMetThrLeuGluThrValAspArgPheAlaArgXxxAsnArgPheGlnArgAlaLeuSerAla-199
Antigenic Index - Jameson-Wolf
SEQ. ID. NO. 17342   13-SerThrMetProArgAsnGlnGlyTrp-21
SEQ. ID. NO. 17343   35-GlySerThrGlyAsp-39
SEQ. ID. NO. 17344   62-ValLysArgArgGlyIleLysAla-69
SEQ. ID. NO. 17345   71-LeuLeuProProLysGlyArgAlaArgSerTrpTrp-82
SEQ. ID. NO. 17346   86-HisGlyAlaPheGly-90
SEQ. ID. NO. 17347   123-ProAlaGlyLysTrpGlyValGluProAsnProVal-134

TABLE 1-continued

| | |
|---|---|
| SEQ. ID. NO. 17348 | 143-ValLeuAsnAspGlyLysValLysGlu-151 |
| SEQ. ID. NO. 17349 | 167-ThrValGlyLysAspGlyIleAsnProAspGluProMetThr-180 |
| SEQ. ID. NO. 17350 | 182-GluThrValAspArgPheAlaArgXxxAsnArgPheGlnArg-195 |
| SEQ. ID. NO. 17351 | 201-PheAlaGlnArgArgGlyArgArgMetAspPhe-211 |

Hydrophilic Regions - Hopp-Woods
SEQ. ID. NO. 17352  63-LysArgArgGlyIleLys-68
SEQ. ID. NO. 17353  74-ProLysGlyArgAla-78
SEQ. ID. NO. 17354  143-ValLeuAsnAspGlyLysValLysGlu-151
SEQ. ID. NO. 17355  167-ThrValGlyLysAspGlyIleAsnProAspGluProMetThr-180
SEQ. ID. NO. 17356  182-GluThrValAspArgPheAlaArgXxxAsnArgPheGlnArg-195
SEQ. ID. NO. 17357  201-PheAlaGlnArgArgGlyArgArgMetAspPhe-211
a225-1
AMPHI Regions - AMPHI
SEQ. ID. NO. 17358  23-LeuAlaAspGluLeuThrAsn-29
SEQ. ID. NO. 17359  37-IleLeuArgGlnPhe-41
SEQ. ID. NO. 17360  155-AsnAlaMetGlyLeu-159
SEQ. ID. NO. 17361  180-PheMetGlnHisIlePheLys-186
SEQ. ID. NO. 17362  215-GlyAspMetValXxxPheArgThrLeuGlyGlySerArg-227
SEQ. ID. NO. 17363  246-ThrGlyLysAsnIle-250
Antigenic Index - Jameson-Wolf
SEQ. ID. NO. 17364  22-AlaLeuAlaAspGluLeuThr-28
SEQ. ID. NO. 17365  32-SerSerArgGluGlnIleLeu-38
SEQ. ID. NO. 17366  41-PheAlaGluAspGluGlnProVal-48
SEQ. ID. NO. 17367  52-AsnArgXxxProAlaArgArgAlaGlyAsnAlaAspGluLeuIle-66
SEQ. ID. NO. 17368  71-GlyLeuAsnGluGlnProVal-77
SEQ. ID. NO. 17369  81-AsnArgXxxProAlaArgArgAlaGlyAsnAlaAspXxx-93
SEQ. ID. NO. 17370  100-GlyLeuAsnGluGlnProVal-106
SEQ. ID. NO. 17371  110-AsnArgValProAlaArgArgAlaGlyAsnAlaAspGluLeuIle-124
SEQ. ID. NO. 17372  129-GlyLeuAsnGluGlnProVal-135
SEQ. ID. NO. 17373  137-ProValAsnArgAlaProAlaArgArgAlaGlyAsnAlaAspGluLeuIle-153
SEQ. ID. NO. 17374  173-ThrGlyPheAspCysSerGly-179
SEQ. ID. NO. 17375  193-LeuProArgThrSerAlaGluGlnAlaArgMet-203
SEQ. ID. NO. 17376  205-ThrProValAlaArgSerGluLeuGlnProGlyAspMetValXxx-219
SEQ. ID. NO. 17377  222-ThrLeuGlyGlySerArgIle-228
SEQ. ID. NO. 17378  242-HisAlaProArgThrGlyLysAsnIleGlu-251
SEQ. ID. NO. 17379  254-SerLeuSerHisLysTyrTrpSerGlyLys-263
SEQ. ID. NO. 17380  268-ArgArgValLysLysAsnAspProSerArgPhe-278
Hydrophilic Regions - Hopp-Woods
SEQ. ID. NO. 17381  22-AlaLeuAlaAspGluLeuThr-28
SEQ. ID. NO. 17382  32-SerSerArgGluGlnIleLeu-38
SEQ. ID. NO. 17383  41-PheAlaGluAspGluGlnPro-47
SEQ. ID. NO. 17384  53-ArgXxxProAlaArgArgAlaGlyAsnAlaAspGluLeuIle-66
SEQ. ID. NO. 17385  82-ArgXxxProAlaArgArgAlaGlyAsnAla-91
SEQ. ID. NO. 17386  112-ValProAlaArgArgAlaGlyAsnAlaAspGluLeuIle-124
SEQ. ID. NO. 17387  140-ArgAlaProAlaArgArgAlaGlyAsnAlaAspGluLeuIle-153
SEQ. ID. NO. 17388  195-ArgThrSerAlaGluGlnAlaArgMet-203
SEQ. ID. NO. 17389  207-ValAlaArgSerGluLeuGlnPro-214
SEQ. ID. NO. 17390  245-ArgThrGlyLysAsnIleGlu-251
SEQ. ID. NO. 17391  268-ArgArgValLysLysAsnAspProSerArg-277
a226
AMPHI Regions - AMPHI
SEQ. ID. NO. 17392  44-LeuIleAlaTyrLeuLys-49
SEQ. ID. NO. 17393  61-AlaAlaGlnPheIleAspPheTrpLeu-69
SEQ. ID. NO. 17394  98-GlnLeuAlaGlySerValThrGlyIleValThr-108
SEQ. ID. NO. 17395  141-ArgSerIleGlyGlyIleProAlaIleThr-150
SEQ. ID. NO. 17396  157-AlaGlyLeuValGlyGlnIleAlaGlyTyrLys-167
SEQ. ID. NO. 17397  197-GluArgSerArgArg-201
Antigenic Index - Jameson-Wolf
SEQ. ID. NO. 17398  3-GluIleLeuArgGlnProSer-9
SEQ. ID. NO. 17399  25-ValArgThrArgThrGlyAsnIle-32
SEQ. ID. NO. 17400  81-TyrGlnAsnArgArgLysIle-87
SEQ. ID. NO. 17401  117-GlyAlaGluArgGluVal-122
SEQ. ID. NO. 17402  128-SerLysSerValThrAsn-133
SEQ. ID. NO. 17403  139-IleThrArgSerIleGlyGly-145
SEQ. ID. NO. 17404  167-LysMetLeuLysAsnThrVal-173
SEQ. ID. NO. 17405  195-SerLeuGluArgSerArgArgMetAla-203
Hydrophilic Regions - Hopp-Woods
SEQ. ID. NO. 17406  25-ValArgThrArgThr-29
SEQ. ID. NO. 17407  82-GlnAsnArgArgLysIle-87
SEQ. ID. NO. 17408  117-GlyAlaGluArgGluVal-122
SEQ. ID. NO. 17409  195-SerLeuGluArgSerArgArgMetAla-203
a227
AMPHI Regions - AMPHI
SEQ. ID. NO. 17410  36-GlyValLeuPheAlaLeuLeuGlnAla-44
SEQ. ID. NO. 17411  52-LeuGlnGlnLeuThrAspAlaLeu-59
SEQ. ID. NO. 17412  74-ValIleSerTyrLeuAspLeuIleAlaAspAspTrpPheSer-87
a228

TABLE 1-continued

AMPHI Regions - AMPHI
SEQ. ID. NO. 17413  24-GluValLysGluAlaValGlnAlaValGlu-33
SEQ. ID. NO. 17414  40-AlaAlaSerAlaAlaGluSerAlaAlaSerAlaValGluGluAlaLysAspGlnValLysAspAla-61
SEQ. ID. NO. 17415  78-GluAlaValThrGluAlaAlaLysAspThrLeuAsnLysAlaAlaAspAlaThrGlnGluAlaAlaAspLysMetLysAspAlaAla-106
Antigenic Index - Jameson-Wolf
SEQ. ID. NO. 17416  18-SerGlnGluAlaLysGlnGluValLysGluAlaValGln-30
SEQ. ID. NO. 17417  32-ValGluSerAspValLysAspThrAlaAlaSerAlaAlaGluSerAlaAlaSerAlaValGluGluAlaLysAspGlnValLysAspAla
AlaAlaAspAlaLysAlaSerAlaGluGluAlaValThrGluAlaLysGluAlaValThrGlu
AlaAlaLysAspThrLeuAsnLysAlaAlaAspAlaThrGlnGluAlaAlaAspLysMetLysAspAlaAlaLys-107
Hydrophilic Regions - Hopp-Woods
(SEQ. ID. NO. 17416)  18-SerGlnGluAlaLysGlnGluValLysGluAlaValGln-30
(SEQ. ID. NO. 17417)  32-ValGluSerAspValLysAspThrAlaAlaSerAlaAlaGluSerAlaAlaSerAlaValGluGluAlaLysAspGlnVal
LysAspAlaAlaAlaAspAlaLysAlaSerAlaGluGluAlaValThrGluAlaLysGluAlaValThrGluAlaAlaLysAspThrLeuAsnLysAlaAla
AspAlaThrGlnGluAlaAlaAspLysMetLysAspAlaAlaLys-107
a230-1
AMPHI Regions - AMPHI
SEQ. ID. NO. 17418  6-GluLysTyrArgThr-10
SEQ. ID. NO. 17419  49-AspHisSerIleAsnAsn-54
SEQ. ID. NO. 17420  56-IleGlnAsnGluGln-60
SEQ. ID. NO. 17421  73-GlnSerLeuLeuGln-77
SEQ. ID. NO. 17422  81-LeuLysGlnGlyAlaLys-86
SEQ. ID. NO. 17423  96-GlnIleLysGlnIleIle-101
SEQ. ID. NO. 17424  133-PheValGluGluIleArgAspGlnPhe-141
SEQ. ID. NO. 17425  144-GlnAsnLeuValAsnLeuVal-150
SEQ. ID. NO. 17426  161-AlaGluGlnLeuIleArgLeuThrGlnValAsnArgThrIleArg-175
SEQ. ID. NO. 17427  184-PheIleAlaGlnVal-188
SEQ. ID. NO. 17428  194-AspLeuGlnLysPheTyrAsn-200
SEQ. ID. NO. 17429  234-GluValLysAsnAlaPheGluGluArgValAlaArgLeu-246
SEQ. ID. NO. 17430  272-ValAlaAspPheAsnLys-277
SEQ. ID. NO. 17431  284-AspAspAlaPheAsnHisProSerSerLeuAlaGluAla-296
SEQ. ID. NO. 17432  319-SerGlyMetProGluAsnLeuIleAsnAlaVal-329
SEQ. ID. NO. 17433  398-LeuAsnGlyGlyLys-402
SEQ. ID. NO. 17434  426-GluAlaTyrAlaGluLeu-431
SEQ. ID. NO. 17435  444-ValArgLeuIleGlyLeuProAlaPro-452
SEQ. ID. NO. 17436  456-GluValGlnAlaValThrProProAspAspIleAla-467
SEQ. ID. NO. 17437  488-LeuLeuIleArgTyrPheAsn-494
Antigenic Index - Jameson-Wolf
SEQ. ID. NO. 17438  4-SerIleGluLysTyrArgThrProAla-12
SEQ. ID. NO. 17439  32-SerHisProGlyAlaAsp-37
SEQ. ID. NO. 17440  42-ValGlyAspGluLysIleSerAspHisSerIle-52
SEQ. ID. NO. 17441  56-IleGlnAsnGluGlnAlaAspGlyGlyGlyProSerArgAspAlaVal-71
SEQ. ID. NO. 17442  80-TyrLeuLysGlnGlyAla-85
SEQ. ID. NO. 17443  92-ValSerSerGluGlnIleLys-98
SEQ. ID. NO. 17444  101-IleValAspAspProAsnPheHisAspAlaAsnGlyLysPheAsp-115
SEQ. ID. NO. 17445  122-TyrLeuSerGlnArgHisMetSerGluAspGlnPheValGluGluIleArgAsp-139
SEQ. ID. NO. 17446  169-GlnValAsnArgThrIleArgSerHisThrPheAsnProAspGluPhe-184
SEQ. ID. NO. 17447  189-LysValSerGluAlaAspLeu-195
SEQ. ID. NO. 17448  199-TyrAsnAlaAsnLysLysAspTyrLeu-207
SEQ. ID. NO. 17449  223-AspPheAlaAspLysGlnThrValSerGluThrGluValLysAsnAlaPheGluGluArgValAlaArg-245
SEQ. ID. NO. 17450  247-ProAlaAsnGluAlaLysProSerPheGluGlnGluLysAlaAlaValGluAsnGluLeuLysMetLysLysAlaValAlaAspPheAsn
LysAlaLysGluLysLeuGlyAspAspAlaPheAsnHisProSerSerLeuAlaGluAlaAl
aLysAsnSerGlyLeuLysValGluThrGlnGluThrTrpLeuSerArgGlnAspAlaGlnMetSerGlyMetProGluAsn-324
SEQ. ID. NO. 17451  330-PheSerAspAspValLeuLysLysLysHisAsnSerGlu-342
SEQ. ID. NO. 17452  355-ArgAlaLysGluValArgGluGluLysThrLeuPro-366
SEQ. ID. NO. 17453  368-AlaGluAlaLysAspAlaValArg-375
SEQ. ID. NO. 17454  377-AlaTyrIleArgThrGluAlaAlaLysLeuAlaGluAsnLysAlaLysAspValLeu-395
SEQ. ID. NO. 17455  399-AsnGlyGlyLysAlaValAsp-405
SEQ. ID. NO. 17456  417-GlnGlnAlaArgGlnSerMetProProGluAlaTyr-428
SEQ. ID. NO. 17457  432-LeuLysAlaLysProAlaAsnGlyLysProAla-442
SEQ. ID. NO. 17458  459-AlaValThrProProAspAspIleAla-467
SEQ. ID. NO. 17459  476-AlaLeuAlaGlnGlnGlnSerAlaAsnThrPhe-486
SEQ. ID. NO. 17460  493-PheAsnGlyLysIleLysGlnThrLysGlyAlaGlnSerValAspAsnGlyAspGlyGln-512
Hydrophilic Regions - Hopp-Woods
SEQ. ID. NO. 17461  6-GluLysTyrArgThr-10
SEQ. ID. NO. 17462  42-ValGlyAspGluLysIleSerAsp-49
SEQ. ID. NO. 17463  56-IleGlnAsnGluGlnAlaAspGlyGlyGlyProSerArgAspAlaVal-71
SEQ. ID. NO. 17464  92-ValSerSerGluGlnIleLys-98
SEQ. ID. NO. 17465  101-IleValAspAspProAsnPhe-107
SEQ. ID. NO. 17466  110-AlaAsnGlyLysPheAsp-115
SEQ. ID. NO. 17467  126-ArgHisMetSerGluAspGlnPheValGluGluIleArgAsp-139
SEQ. ID. NO. 17468  189-LysValSerGluAlaAspLeu-195
SEQ. ID. NO. 17469  200-AsnAlaAsnLysLysAspTyrLeu-207
SEQ. ID. NO. 17470  223-AspPheAlaAspLysGlnThrValSerGluThrGluValLysAsnAlaPheGluGluArgValAlaArg-245
SEQ. ID. NO. 17471  247-ProAlaAsnGluAlaLysProSerPheGluGlnGluLysAlaAlaValGluAsnGluLeuLysMetLysLysAlaValAlaAspPheAsn
LysAlaLysGluLysLeuGlyAspAspAlaPheAsn-288
SEQ. ID. NO. 17472  292-SerLeuAlaGluAlaAlaLysAsnSerGlyLeuLysValGluThrGlnGlu-308
SEQ. ID. NO. 17473  310-TrpLeuSerArgGlnAspAlaGlnMet-318
SEQ. ID. NO. 17474  333-AspValLeuLysLysLysHisAsnSer-341
SEQ. ID. NO. 17475  355-ArgAlaLysGluValArgGluGluLysThrLeuPro-366
SEQ. ID. NO. 17476  368-AlaGluAlaLysAspAlaValArg-375

TABLE 1-continued

| | |
|---|---|
| SEQ. ID. NO. 17477 | 377-AlaTyrIleArgThrGluAlaAlaLysLeuAlaGluAsnLysAlaLysAspValLeu-395 |
| SEQ. ID. NO. 17478 | 417-GlnGlnAlaArgGlnSerMetPro-424 |
| SEQ. ID. NO. 17479 | 432-LeuLysAlaLysProAlaAsnGly-439 |
| SEQ. ID. NO. 17480 | 461-ThrProProAspAspIleAla-467 |
| SEQ. ID. NO. 17481 | 496-LysIleLysGlnThrLysGlyAlaGlnSerValAspAsnGlyAspGlyGln-512 | a231-1
AMPHI Regions - AMPHI

| | |
|---|---|
| SEQ. ID. NO. 17482 | 7-IleAsnArgProTyrGlnLysProAlaGluLeu-17 |
| SEQ. ID. NO. 17483 | 98-ArgIlePheSerPheProGln-104 |
| SEQ. ID. NO. 17484 | 209-AlaValAspAsnValLysGlyValAlaVal-218 |
| SEQ. ID. NO. 17485 | 228-AlaValAlaGlyPheArgArgCysSerAlaAla-238 |
| SEQ. ID. NO. 17486 | 263-LeuAlaAlaValProArgIleThrGln-271 |
| SEQ. ID. NO. 17487 | 281-LysProPheHisAspPhePheAsnLeu-289 |

Antigenic Index - Jameson-Wolf

| | |
|---|---|
| SEQ. ID. NO. 17488 | 1-MetSerLysArgLysSerIleAsnArgProTyrGlnLysProAlaGlu-16 |
| SEQ. ID. NO. 17489 | 18-ProProLeuGlnAsnAsnProProPheTyrArgLysAsnArgArgLeuAsn-34 |
| SEQ. ID. NO. 17490 | 39-AlaAspGlyGlyCysAlaSerProGlnLysCysArgAlaArgGlyPheGln-55 |
| SEQ. ID. NO. 17491 | 90-ProAlaValArgProArgArgLeuArg-98 |
| SEQ. ID. NO. 17492 | 135-MetProArgArgProVal-140 |
| SEQ. ID. NO. 17493 | 150-PheAlaAspArgAsnLeuArg-156 |
| SEQ. ID. NO. 17494 | 166-GluHisAlaAspAlaAsp-171 |
| SEQ. ID. NO. 17495 | 174-AlaPheArgArgArgAlaGlnVal-181 |
| SEQ. ID. NO. 17496 | 183-AlaArgThrArgAla-187 |
| SEQ. ID. NO. 17497 | 194-ArgArgValAspIleArgHisProAspPhe-203 |
| SEQ. ID. NO. 17498 | 211-AspAsnValLysGly-215 |
| SEQ. ID. NO. 17499 | 231-GlyPheArgArgCysSerAlaAlaGlyGlyArgValGlyThr-244 |
| SEQ. ID. NO. 17500 | 246-ValProCysArgAlaGluTyrValGluTyrGlyAsnArgArgProHisArgLeuAlaAla-265 |
| SEQ. ID. NO. 17501 | 269-IleThrGlnArgThrGlnLysArgGlnGlyAspGlyLysProPhe-283 |
| SEQ. ID. NO. 17502 | 294-MetProMetProSerGluHis-300 |

Hydrophilic Regions - Hopp-Woods

| | |
|---|---|
| SEQ. ID. NO. 17503 | 1-MetSerLysArgLysSerIleAsn-8 |
| SEQ. ID. NO. 17504 | 10-ProTyrGlnLysProAlaGlu-16 |
| SEQ. ID. NO. 17505 | 26-PheTyrArgLysAsnArgArg-32 |
| SEQ. ID. NO. 17506 | 45-SerProGlnLysCysArgAlaArgGly-53 |
| SEQ. ID. NO. 17507 | 92-ValArgProArgArgLeuArg-98 |
| SEQ. ID. NO. 17508 | 136-ProArgArgProVal-140 |
| SEQ. ID. NO. 17509 | 150-PheAlaAspArgAsnLeuArg-156 |
| SEQ. ID. NO. 17510 | 166-GluHisAlaAspAlaAsp-171 |
| SEQ. ID. NO. 17511 | 174-AlaPheArgArgArgAlaGlnVal-181 |
| SEQ. ID. NO. 17512 | 183-AlaArgThrArgAla-187 |
| SEQ. ID. NO. 17513 | 194-ArgArgValAspIleArgHis-200 |
| SEQ. ID. NO. 17514 | 231-GlyPheArgArgCysSerAlaAlaGlyGlyArgValGlyThr-244 |
| SEQ. ID. NO. 17515 | 246-ValProCysArgAlaGluTyr-252 |
| SEQ. ID. NO. 17516 | 254-GluTyrGlyAsnArgArgProHisArg-262 |
| SEQ. ID. NO. 17517 | 269-IleThrGlnArgThrGlnLysArgGlnGlyAspGlyLysProPhe-283 | a232
AMPHI Regions - AMPHI

| | |
|---|---|
| SEQ. ID. NO. 17518 | 23-GlnPheLeuGlyAlaPheAsnAspAsnVal-32 |
| SEQ. ID. NO. 17519 | 55-GlyGlnMetLeuAsn-59 |
| SEQ. ID. NO. 17520 | 74-SerLeuSerGlyGlnLeuGlyAsnLysPheAspLysAlaValLeuAlaArgTrpAlaLysValLeuGluMetIleIleMet-100 |
| SEQ. ID. NO. 17521 | 127-ThrLeuPheGlyProLeuLysTyr-134 |
| SEQ. ID. NO. 17522 | 160-AlaIleLeuPheGly-164 |
| SEQ. ID. NO. 17523 | 167-LeuGlyThrAlaValAlaGlyValProProTyrIleValGlyIleLeuVal-183 |
| SEQ. ID. NO. 17524 | 214-ValArgGlyThrLysSerLeuLeuArgGlu-223 |
| SEQ. ID. NO. 17525 | 251-LeuProThrPheThrGln-256 |
| SEQ. ID. NO. 17526 | 319-ArgPheGluGlyLeuAsn-324 |
| SEQ. ID. NO. 17527 | 340-AlaValMetThrLeuIleGlyPhePheGlyGlyPhePheSerValProLeuTyrThrTrpLeu-360 |

Antigenic Index - Jameson-Wolf

| | |
|---|---|
| SEQ. ID. NO. 17528 | 1-MetTyrAlaLysLysGlyGlyLeuGlyLeuValLysSerArgArgPhe-16 |
| SEQ. ID. NO. 17529 | 75-LeuSerGlyGlnLeuGlyAsnLysPheAspLys-85 |
| SEQ. ID. NO. 17530 | 139-AspTyrLeuAspAspLysGluLeuMetMet-148 |
| SEQ. ID. NO. 17531 | 200-ValProAlaLysAlaAlaAspThrGlnIle-209 |
| SEQ. ID. NO. 17532 | 215-ArgGlyThrLysSerLeuLeuArgGluThrValArgHisLysPro-229 |
| SEQ. ID. NO. 17533 | 258-HisLeuGlyGlyAsnAspAsnVal-265 |
| SEQ. ID. NO. 17534 | 286-LysPheSerArgGluArgLeuArg-293 |
| SEQ. ID. NO. 17535 | 316-HisGlyHisArgPheGluGly-322 |
| SEQ. ID. NO. 17536 | 363-AlaSerSerGluThrPheArgAlaArgAla-372 |
| SEQ. ID. NO. 17537 | 420-IleLysArgGluArgArgPheLeu-427 |
| SEQ. ID. NO. 17538 | 431-AlaIleArgLysLysPro-436 |

Hydrophilic Regions - Hopp-Woods

| | |
|---|---|
| SEQ. ID. NO. 17539 | 2-TyrAlaLysLysGlyGly-7 |
| SEQ. ID. NO. 17540 | 11-ValLysSerArgArgPhe-16 |
| SEQ. ID. NO. 17541 | 81-AsnLysPheAspLys-85 |
| SEQ. ID. NO. 17542 | 140-TyrLeuAspAspLysGluLeuMet-147 |
| SEQ. ID. NO. 17543 | 201-ProAlaLysAlaAlaAspThrGlnIle-209 |
| SEQ. ID. NO. 17544 | 215-ArgGlyThrLysSerLeuLeuArgGluThrValArgHis-227 |
| SEQ. ID. NO. 17545 | 286-LysPheSerArgGluArgLeuArg-293 |
| SEQ. ID. NO. 17546 | 318-HisArgPheGluGly-322 |

TABLE 1-continued

| | |
|---|---|
| SEQ. ID. NO. 17547 | 366-GluThrPheArgAlaArgAla-372 |
| SEQ. ID. NO. 17548 | 420-IleLysArgGluArgArgPheLeu-427 |
| SEQ. ID. NO. 17549 | 431-AlaIleArgLysLysPro-436 | a233
AMPHI Regions - AMPHI

| | |
|---|---|
| SEQ. ID. NO. 17550 | 61-PheAlaAspLysValGlnThr-67 |
| SEQ. ID. NO. 17551 | 71-GlnValArgValTrpLysAsn-77 |
| SEQ. ID. NO. 17552 | 88-AsnGlyValAlaLysLeuLeuGluThr-96 |
| SEQ. ID. NO. 17553 | 119-AlaLeuThrArgLeuIleGluGlnAlaGlyAsnAla-130 |
| SEQ. ID. NO. 17554 | 139-ProValAlaAspThrLeuLysCysAlaAspGlyGlyAsn-151 |
| SEQ. ID. NO. 17555 | 180-AlaAlaGluAsnLeuAspGlyIleThrAsp-189 |

Antigenic Index - Jameson-Wolf

| | |
|---|---|
| SEQ. ID. NO. 17556 | 1-MetLysArgLysAsnIle-6 |
| SEQ. ID. NO. 17557 | 16-AlaArgPheGlyAlaAspLysProLysGlnTyrValGluIleGlySerLysThrValLeu-35 |
| SEQ. ID. NO. 17558 | 43-GluArgHisGluAlaValAsp-49 |
| SEQ. ID. NO. 17559 | 56-SerProGluAspThrPheAlaAspLysValGln-66 |
| SEQ. ID. NO. 17560 | 75-TrpLysAsnGlyGlyGlnThrArgAlaGluThrValArgAsnGlyVal-90 |
| SEQ. ID. NO. 17561 | 100-AlaGluThrAspAsn-104 |
| SEQ. ID. NO. 17562 | 109-AspAlaAlaArgCys-113 |
| SEQ. ID. NO. 17563 | 115-LeuProSerGluAlaLeu-120 |
| SEQ. ID. NO. 17564 | 123-LeuIleGluGlnAlaGlyAsnAlaAlaGluGlyGly-134 |
| SEQ. ID. NO. 17565 | 142-AspThrLeuLysCysAlaAspGlyGlyAsnIle-152 |
| SEQ. ID. NO. 17566 | 155-ThrValGluArgThrSerLeu-161 |
| SEQ. ID. NO. 17567 | 182-GluAsnLeuAspGlyIleThrAspGluAlaSerAlaValGluLysLeuGlyIle-199 |
| SEQ. ID. NO. 17568 | 206-GlyAspAlaArgAsnLeuLysLeuThrGlnProGlnAspAlaTyr-220 |

Hydrophilic Regions - Hopp-Woods

| | |
|---|---|
| SEQ. ID. NO. 17569 | 1-MetLysArgLysAsnIle-6 |
| SEQ. ID. NO. 17570 | 18-PheGlyAlaAspLysProLysGlnTyrVal-27 |
| SEQ. ID. NO. 17571 | 43-GluArgHisGluAlaValAsp-49 |
| SEQ. ID. NO. 17572 | 56-SerProGluAspThrPheAlaAspLysValGln-66 |
| SEQ. ID. NO. 17573 | 79-GlyGlnThrArgAlaGluThrValArg-87 |
| SEQ. ID. NO. 17574 | 100-AlaGluThrAspAsn-104 |
| SEQ. ID. NO. 17575 | 127-AlaGlyAsnAlaAlaGlu-132 |
| SEQ. ID. NO. 17576 | 142-AspThrLeuLysCysAlaAsp-148 |
| SEQ. ID. NO. 17577 | 182-GluAsnLeuAspGlyIleThrAspGluAlaSerAlaValGluLysLeuGlyIle-199 |
| SEQ. ID. NO. 17578 | 206-GlyAspAlaArgAsnLeuLys-212 | a234-2
AMPHI Regions - AMPHI

| | |
|---|---|
| SEQ. ID. NO. 17579 | 26-ArgSerLeuGluValGluLysValAlaSer-35 |
| SEQ. ID. NO. 17580 | 68-AspArgLeuGlySerGln-73 |
| SEQ. ID. NO. 17581 | 83-GlnGlnThrAsnArgPheAsnValLeuAsnArgThrAsn-95 |
| SEQ. ID. NO. 17582 | 121-GlyAspValThrGluPhe-126 |
| SEQ. ID. NO. 17583 | 206-AlaValAsnSerLeuValGlnAlaValAsp-215 |

Antigenic Index - Jameson-Wolf

| | |
|---|---|
| SEQ. ID. NO. 17584 | 21-AlaThrGluSerSerArgSerLeuGluValGluLysValAlaSer-35 |
| SEQ. ID. NO. 17585 | 51-ThrPheAspAsnArgSerSerPhe-58 |
| SEQ. ID. NO. 17586 | 62-IlePheSerAspGlyGluAspArgLeuGlySerGlnAla-74 |
| SEQ. ID. NO. 17587 | 83-GlnGlnThrAsnArgPheAsnValLeuAsnArgThrAsn-95 |
| SEQ. ID. NO. 17588 | 99-LeuLysGlnGluSerGlyIleSerGlyLysAlaHisAsnLeuLysGlyAlaAspTyr-117 |
| SEQ. ID. NO. 17589 | 121-GlyAspValThrGluPheGlyArgArgAspValGlyAsp-133 |
| SEQ. ID. NO. 17590 | 140-LeuGlyArgGlyLysSerGlnIle-147 |
| SEQ. ID. NO. 17591 | 160-AsnThrSerGluIle-164 |
| SEQ. ID. NO. 17592 | 169-GlnGlyAlaGlyGlu-173 |
| SEQ. ID. NO. 17593 | 175-AlaLeuSerAsnArgGluIle-181 |
| SEQ. ID. NO. 17594 | 185-GlyGlyThrSerGlyTyrAspAlaThrLeuAsnGlyLysValLeu-199 |
| SEQ. ID. NO. 17595 | 214-ValAspAsnGlyAlaTrpGlnProAsnArg-223 |

Hydrophilic Regions - Hopp-Woods

| | |
|---|---|
| SEQ. ID. NO. 17596 | 21-AlaThrGluSerSerArgSerLeuGluValGluLysValAla-34 |
| SEQ. ID. NO. 17597 | 52-PheAspAsnArgSerSerPhe-58 |
| SEQ. ID. NO. 17598 | 62-IlePheSerAspGlyGluAspArgLeuGlySerGlnAla-74 |
| SEQ. ID. NO. 17599 | 99-LeuLysGlnGluSerGlyIleSerGlyLysAlaHisAsn-111 |
| SEQ. ID. NO. 17600 | 122-AspValThrGluPheGlyArgArgAspValGlyAsp-133 |
| SEQ. ID. NO. 17601 | 141-GlyArgGlyLysSer-145 |
| SEQ. ID. NO. 17602 | 176-LeuSerAsnArgGluIle-181 | a235
AMPHI Regions - AMPHI

| | |
|---|---|
| SEQ. ID. NO. 17603 | 8-LeuAlaAlaValLeuAlaLeu-14 |
| SEQ. ID. NO. 17604 | 18-GlnValGlnLysAlaProAsp-24 |
| SEQ. ID. NO. 17605 | 86-LeuThrAsnAlaAlaAspIle-92 |
| SEQ. ID. NO. 17606 | 95-ValArgProGluLysLeuHisGlnIlePhe-104 |
| SEQ. ID. NO. 17607 | 120-SerTyrGlnIleLeuAspSerValThrThr-129 |
| SEQ. ID. NO. 17608 | 165-GlyAlaLeuValSerAlaValValAsnGlnIleAlaAsnSerLeuThr-180 |
| SEQ. ID. NO. 17609 | 187-SerLysThrAlaAlaTyrAsnLeuLeuSerProTyr-198 |

Antigenic Index - Jameson-Wolf

| | |
|---|---|
| SEQ. ID. NO. 17610 | 20-GlnLysAlaProAspPheAspTyrThrSerPheLysGluSerLysProAla-36 |
| SEQ. ID. NO. 17611 | 43-ProLeuAsnGluSerProAspValAsnGlyThr-53 |
| SEQ. ID. NO. 17612 | 62-AlaProLeuSerGlu-66 |
| SEQ. ID. NO. 17613 | 79-GluThrPheLysGlnAsnGlyLeuThrAsn-88 |
| SEQ. ID. NO. 17614 | 93-HisAlaValArgProGluLysLeu-100 |
| SEQ. ID. NO. 17615 | 131-SerAlaLysAlaArgLeuValAspSerArgAsnGlyLysGluLeuTrpSerGlySerAlaSerIleArgGluGlySerAsnAsnSerAsnSer-161 |

TABLE 1-continued

| | |
|---|---|
| SEQ. ID. NO. 17616 | 178-SerLeuThrAspArgGlyTyrGlnValSerLysThrAla-190 |
| SEQ. ID. NO. 17617 | 202-GlyIleLeuLysGlyProArgPheValGluGluGlnProLys-215 |

Hydrophilic Regions - Hopp-Woods

| | |
|---|---|
| SEQ. ID. NO. 17618 | 20-GlnLysAlaProAspPheAsp-26 |
| SEQ. ID. NO. 17619 | 29-SerPheLysGluSerLysPro-35 |
| SEQ. ID. NO. 17620 | 44-LeuAsnGluSerProAspVal-50 |
| SEQ. ID. NO. 17621 | 93-HisAlaValArgProGluLysLeu-100 |
| SEQ. ID. NO. 17622 | 131-SerAlaLysAlaArgLeuValAlaSerArgAsnGlyLysGluLeuTrp-146 |
| SEQ. ID. NO. 17623 | 150-AlaSerIleArgGluGlySerAsnAsnSer-159 |
| SEQ. ID. NO. 17624 | 179-LeuThrAspArgGlyTyrGln-185 |
| SEQ. ID. NO. 17625 | 207-ProArgPheValGluGluGlnProLys-215 | a236
AMPHI Regions - AMPHI

| | |
|---|---|
| SEQ. ID. NO. 17626 | 11-LeuCysThrAlaPheAlaAspGlyPhe-19 |
| SEQ. ID. NO. 17627 | 107-PheAlaGlyPheAlaAspCysArgProPhe-116 |
| SEQ. ID. NO. 17628 | 145-AlaAspAspValProArgPhePheAlaGlyGlu-155 |
| SEQ. ID. NO. 17629 | 168-ArgAspValValGlnGlyGlyLeu-175 |
| SEQ. ID. NO. 17630 | 215-ValGluGlyIleThrArgIle-221 |
| SEQ. ID. NO. 17631 | 245-IleArgLeuLeuHisGlyIlePheAsnArgIleGluValAla-258 |
| SEQ. ID. NO. 17632 | 316-ValAlaAspGlyPheArgHisPhe-323 |

Antigenic Index - Jameson-Wolf

| | |
|---|---|
| SEQ. ID. NO. 17633 | 42-GlyPheSerGlyAsnGlyLysPhe-49 |
| SEQ. ID. NO. 17634 | 58-ArgHisGlnGlnSerLysAlaGln-65 |
| SEQ. ID. NO. 17635 | 77-PhePheArgArgGlyAsnPheGlyPheGlyLeuGlnGlyArgThrAspGlyPhe-94 |
| SEQ. ID. NO. 17636 | 98-GlnArgLeuAspGlyGlyGlyTyr-105 |
| SEQ. ID. NO. 17637 | 109-GlyPheAlaAspCysArgProPhe-116 |
| SEQ. ID. NO. 17638 | 126-ValAspGlyArgGluLeuValProSerMetGluLys-137 |
| SEQ. ID. NO. 17639 | 144-AlaAlaAspAspValPro-149 |
| SEQ. ID. NO. 17640 | 155-GluAlaGlnAsnArgCysAsnGlnGluAsnGlnAlaAlaArgAspValValGlnGlyGlyLeu-175 |
| SEQ. ID. NO. 17641 | 195-IleGluValGluArgAlaGlnValPheArgAlaGluArgAsnHis-209 |
| SEQ. ID. NO. 17642 | 213-GlyLysValGluGlyIleThrArg-220 |
| SEQ. ID. NO. 17643 | 222-LysIleThrGlyAsnAlaPheLeu-229 |
| SEQ. ID. NO. 17644 | 261-GlyLysGlnLysAlaGlnGly-267 |
| SEQ. ID. NO. 17645 | 292-IleGlyGlyCysArgProGlnAlaGlnAspValArgAla-304 |
| SEQ. ID. NO. 17646 | 310-PheLeuArgArgAspAspValAlaAspGly-319 |

Hydrophilic Regions - Hopp-Woods

| | |
|---|---|
| SEQ. ID. NO. 17647 | 89-GlyArgThrAspGly-93 |
| SEQ. ID. NO. 17648 | 98-GlnArgLeuAspGlyGlyGly-104 |
| SEQ. ID. NO. 17649 | 127-AspGlyArgGluLeuValProSerMetGluLys-137 |
| SEQ. ID. NO. 17650 | 144-AlaAlaAspAspValPro-149 |
| SEQ. ID. NO. 17651 | 156-AlaGlnAsnArgCysAsnGlnGluAsnGlnAlaAlaArgAspValVal-171 |
| SEQ. ID. NO. 17652 | 195-IleGluValGluArgAlaGlnValPheArgAlaGluArgAsnHis-209 |
| SEQ. ID. NO. 17653 | 214-LysValGluGlyIleThrArg-220 |
| SEQ. ID. NO. 17654 | 261-GlyLysGlnLysAlaGlnGly-267 |
| SEQ. ID. NO. 17655 | 295-CysArgProGlnAlaGlnAspValArgAla-304 |
| SEQ. ID. NO. 17656 | 311-LeuArgArgAspAspValAlaAspGly-319 | a239
AMPHI Regions - AMPHI

| | |
|---|---|
| SEQ. ID. NO. 17657 | 49-PheArgLeuIleGlnSerCys-55 |
| SEQ. ID. NO. 17658 | 72-AsnAlaHisArgLysGln-77 |
| SEQ. ID. NO. 17659 | 123-ProGlyPheAsnAlaLeuProAlaIlePhe-132 |
| SEQ. ID. NO. 17660 | 165-SerSerAsnGluTrp-169 |
| SEQ. ID. NO. 17661 | 221-PheCysAlaThrIleCysAlaSerLeuArg-230 |

Antigenic Index - Jameson-Wolf

| | |
|---|---|
| SEQ. ID. NO. 17662 | 6-GlyIleAlaArgAsnArgArgMetGlu-14 |
| SEQ. ID. NO. 17663 | 19-CysArgArgProAspArgPheValValArgGlnThrArgLeuLeu-33 |
| SEQ. ID. NO. 17664 | 52-IleGlnSerCysGluValGluPro-59 |
| SEQ. ID. NO. 17665 | 66-HisAsnGlyLysSerGlyAsnAlaHisArgLysGlnGlnLysGluIle-81 |
| SEQ. ID. NO. 17666 | 100-ProAlaValArgSerAlaThrArgLysThrAla-110 |
| SEQ. ID. NO. 17667 | 132-PheArgGlyGlySerGlyLysSerAlaSer-141 |
| SEQ. ID. NO. 17668 | 144-AlaAlaGlnArgGlyArgGlyAlaCys-152 |
| SEQ. ID. NO. 17669 | 164-ArgSerSerAsnGluTrpLys-170 |
| SEQ. ID. NO. 17670 | 173-ThrAlaLysArgProProSerPheArgArgHisMetThrCysGlyAsnThrAlaProThrSerSerSerSerArgLeuIleLys-200 |
| SEQ. ID. NO. 17671 | 209-ValAlaGlySerCysProArgSerArgValArgThr-220 |
| SEQ. ID. NO. 17672 | 248-TrpArgLeuAsnGlySerSerPro-255 |

Hydrophilic Regions - Hopp-Woods

| | |
|---|---|
| SEQ. ID. NO. 17673 | 6-GlyIleAlaArgAsnArgArgMetGlu14 |
| SEQ. ID. NO. 17674 | 20-ArgArgProAspArgPheValValArgGlnThrArg-31 |
| SEQ. ID. NO. 17675 | 67-AsnGlyLysSerGlyAsnAlaHisArgLysGlnGlnLysGluIle-81 |
| SEQ. ID. NO. 17676 | 102-ValArgSerAlaThrArgLysThrAla-110 |
| SEQ. ID. NO. 17677 | 135-GlySerGlyLysSerAlaSer-141 |
| SEQ. ID. NO. 17678 | 146-GlnArgGlyArgGlyAlaCys-152 |
| SEQ. ID. NO. 17679 | 165-SerSerAsnGluTrpLys-170 |
| SEQ. ID. NO. 17680 | 173-ThrAlaLysArgProProSerPheArgArgHisMet-184 |
| SEQ. ID. NO. 17681 | 193-SerSerSerSerArgLeuIleLys-200 |
| SEQ. ID. NO. 17682 | 211-GlySerCysProArgSerArgValArgThr-220 |
| SEQ. ID. NO. 17683 | 251-AsnArgSerSerPro-255 | a240

TABLE 1-continued

AMPHI Regions - AMPHI
SEQ. ID. NO. 17684    19-AlaAspValGlyArgPheLeuHis-26
SEQ. ID. NO. 17685    63-IleGlnCysLeuArgAsnHis-69
SEQ. ID. NO. 17686    87-AlaProLeuPheAlaValCysPro-94
SEQ. ID. NO. 17687    107-GlnGlyGluAspPheProArgAlaGlyIleGlnAsnHis-119
SEQ. ID. NO. 17688    154-ValPheArgGlyPheIleAlaArgGlyValGlnAlaValHisAsn-168
SEQ. ID. NO. 17689    188-PheLysArgLysPheGln-193
Antigenic Index - Jameson-Wolf
SEQ. ID. NO. 17690    9-GlyThrGluThrArgArgGlnPheAla-17
SEQ. ID. NO. 17691    39-IleAlaHisGlyArgArgSerAspPheIleArg-49
SEQ. ID. NO. 17692    67-ArgAsnHisLysArgPheAspCysArgThrGlyPheAsp-79
SEQ. ID. NO. 17693    101-ValGlyGlyArgIleGlyGlnGlyGluAspPheProArgAlaGlyIleGlnAsnHisHisArgSerGly-123
SEQ. ID. NO. 17694    139-GlnGlyLeuAsnProLeuIleGluGlyLysAspAspVal-151
SEQ. ID. NO. 17695    173-ValProGlnAsnAspPheArg-179
SEQ. ID. NO. 17696    187-ValPheLysArgLysPhe-192
SEQ. ID. NO. 17697    201-AsnIleGlyLysSerAspAspValCysLys-210
Hydrophilic Regions - Hopp-Woods
SEQ. ID. NO. 17698    10-ThrGluThrArgArgGlnPheAla-17
SEQ. ID. NO. 17699    41-HisGlyArgArgSerAspPheIleArg-49
SEQ. ID. NO. 17700    67-ArgAsnHisLysArgPheAspCys-74
SEQ. ID. NO. 17701    105-IleGlyGlnGlyGluAspPheProArg-113
SEQ. ID. NO. 17702    145-IleGluGlyLysAspAspVal-151
SEQ. ID. NO. 17703    187-ValPheLysArgLysPhe-192
SEQ. ID. NO. 17704    203-GlyLysSerAspAspValCysLys-210
a241-1
AMPHI Regions - AMPHI
SEQ. ID. NO. 17705    6-ThrArgAlaAlaLysHis-11
SEQ. ID. NO. 17706    35-ThrHisThrProHisGluProAlaSerSer-44
SEQ. ID. NO. 17707    71-LysMetProSerGluMetGluGlnThrLeu-80
SEQ. ID. NO. 17708    109-PheLeuIleGlyCysIleAlaHisThrPheAsnArgSerLeuLys-123
SEQ. ID. NO. 17709    126-PheHisAlaCysGlnArgMetValAlaVal-135
SEQ. ID. NO. 17710    195-HisIleAspArgIleAlaGlyIleLeuThrValGln-206
SEQ. ID. NO. 17711    229-PheValGlnLysLeuIleValGlyIleIleHis-239
Antigenic Index - Jameson-Wolf
SEQ. ID. NO. 17712    1-MetProThrArgProThrArgAlaAlaLysHisProThrProProThrTrp-17
SEQ. ID. NO. 17713    23-CysProArgProProTyrArgProProSerValGlnThrHisThrProHisGluProAlaSerSerThrCysAlaAlaLysSer
                      AlaAsnArgArgGluAsnPheHis-58
SEQ. ID. NO. 17714    68-ProSerAsnLysMetProSerGluMetGluGlnThrLeuPheArgArgHisGlnIleProProSerCysArgGlnSer-93
SEQ. ID. NO. 17715    119-AsnArgSerLeuLysAlaAspPhe-126
SEQ. ID. NO. 17716    147-ThrIleAspAspAsnIleAla-153
SEQ. ID. NO. 17717    166-PheAspPheAsnArgGluHisAlaArg-174
SEQ. ID. NO. 17718    176-PheAsnThrAspGlnLeu181
SEQ. ID. NO. 17719    188-ArgIleValGlyArgLysArgHisIleAspArgIleAla-200
SEQ. ID. NO. 17720    209-PheHisGlnArgGluAsnAla-215
SEQ. ID. NO. 17721    244-ArgAsnHisGlyIle-248
SEQ. ID. NO. 17722    251-AspSerHisIleCysProPheArgAsnSerArgLeuIle-263
Hydrophilic Regions - Hopp-Woods
SEQ. ID. NO. 17723    1-MetProThrArgProThrArgAlaAlaLysHisProThr-13
SEQ. ID. NO. 17724    37-ThrProHisGluProAlaSer-43
SEQ. ID. NO. 17725    46-CysAlaAlaLysSerAlaAsnArgArgGluAsnPheHis-58
SEQ. ID. NO. 17726    70-AsnLysMetProSerGluMetGluGlnThrLeuPheArg-82
SEQ. ID. NO. 17727    120-ArgSerLeuLysAlaAspPhe-126
SEQ. ID. NO. 17728    166-PheAspPheAsnArgGluHisAlaArg-174
SEQ. ID. NO. 17729    188-ArgIleValGlyArgLysArgHisIleAspArgIleAla-200
SEQ. ID. NO. 17730    209-PheHisGlnArgGluAsnAla-215
a242
AMPHI Regions - AMPHI
SEQ. ID. NO. 17731    23-ProGluValAlaXxxGlnPheValAspPheValGlu-34
SEQ. ID. NO. 17732    43-GlyPheCysHisIleLeuGlnAsnLeuThrGly-53
SEQ. ID. NO. 17733    122-AsnProPhePheAspPhePheGlnAlaValVal-132
SEQ. ID. NO. 17734    137-HisGlnSerGlyPheGlyAspValPhe-145
SEQ. ID. NO. 17735    156-PheGluGlnGlyVal-160
SEQ. ID. NO. 17736    191-PheGlyHisThrArgLeuPheAspIleCys-200
SEQ. ID. NO. 17737    262-HisProPheAlaAspPheGlyAsnPheGlnAsnLeuLeuAlaLeu-276
Antigenic Index - Jameson-Wolf
SEQ. ID. NO. 17738    13-HisPheGluGlnArgAlaGlyGlyIleAla-22
SEQ. ID. NO. 17739    52-ThrGlyHisGlyAla-56
SEQ. ID. NO. 17740    75-SerHisAlaAspIlePheProProArgCysPheGlyAspGlyPheAlaGlnArgGlyPhe-94
SEQ. ID. NO. 17741    98-TrpArgAlaAspGlnAlaGlnAsnArgAla-107
SEQ. ID. NO. 17742    137-HisGlnSerGlyPhe-141
SEQ. ID. NO. 17743    152-LeuProArgGlnPheGluGlnGlyVal-160
SEQ. ID. NO. 17744    164-AlaTyrAspGlyGlyPheGlyArgHisArgArgHisHis-176
SEQ. ID. NO. 17745    283-MetArgCysAspArgIleGly-289
Hydrophilic Regions - Hopp-Woods
SEQ. ID. NO. 17746    13-HisPheGluGlnArgAlaGlyGlyIle-21
SEQ. ID. NO. 17747    98-TrpArgAlaAspGlnAlaGlnAsnArgAla-107
SEQ. ID. NO. 17748    155-GlnPheGluGlnGlyVal-160

TABLE 1-continued

| | |
|---|---|
| SEQ. ID. NO. 17749 | 168-GlyPheGlyArgHisArgArgHisHis-176 |
| SEQ. ID. NO. 17750 | 283-MetArgCysAspArgIleGly-289 | a243
AMPHI Regions - AMPHI

| | |
|---|---|
| SEQ. ID. NO. 17751 | 25-IlePheSerMetLeu-29 |
| SEQ. ID. NO. 17752 | 35-IleThrArgLeuAlaArgLysAlaValGlnArgLeuThrAlaSerHisIleGlnArgPheLeu-55 |
| SEQ. ID. NO. 17753 | 80-AspSerSerArgIleThrSerThrIleSerSer-90 |

Antigenic Index - Jameson-Wolf

| | |
|---|---|
| SEQ. ID. NO. 17754 | 29-LeuProSerAsnAlaPro-34 |
| SEQ. ID. NO. 17755 | 37-ArgLeuAlaArgLysAlaValGln-44 |
| SEQ. ID. NO. 17756 | 55-LeuThrGluSerLysThrGlyAlaAsnLysSerSerSerSerCysLysPro-71 |
| SEQ. ID. NO. 17757 | 77-SerAlaSerAspSerSerArgIle-84 |
| SEQ. ID. NO. 17758 | 102-SerThrThrGlyAlaValThrLysSer-110 |

Hydrophilic Regions - Hopp-Woods

| | |
|---|---|
| SEQ. ID. NO. 17759 | 37-ArgLeuAlaArgLysAlaValGln-44 |
| SEQ. ID. NO. 17760 | 55-LeuThrGluSerLysThrGlyAlaAsnLysSerSerSerSerCysLys-70 |
| SEQ. ID. NO. 17761 | 78-AlaSerAspSerSerArgIle-84 | a244-1
AMPHI Regions - AMPHI

| | |
|---|---|
| SEQ. ID. NO. 17762 | 13-IleAlaAlaLeuLeuArg-18 |
| SEQ. ID. NO. 17763 | 24-AsnAlaLeuGlnGluIleAsnGlnIleIleProGlnThr-36 |
| SEQ. ID. NO. 17764 | 72-PheAlaCysHisArgLeuHisArgLeu-80 |
| SEQ. ID. NO. 17765 | 102-LysCysPheLeuGlnLeuValGln-109 |
| SEQ. ID. NO. 17766 | 111-HisLeuHisAlaHis-115 |
| SEQ. ID. NO. 17767 | 189-IleSerArgLeuCysGlySerLeuPhe-197 |
| SEQ. ID. NO. 17768 | 206-CysLeuAspGlyPheHisArgLeuHis-214 |
| SEQ. ID. NO. 17769 | 217-AsnArgPhePheThr-221 |
| SEQ. ID. NO. 17770 | 245-TyrProArgLysIleArgThrPheSerArgAsnPheLysGlnArg-259 |

Antigenic Index - Jameson-Wolf

| | |
|---|---|
| SEQ. ID. NO. 17771 | 1-MetProSerGluAlaArgGlnAlaGlySerAspGly-12 |
| SEQ. ID. NO. 17772 | 20-ValTyrThrGlnAsnAla-25 |
| SEQ. ID. NO. 17773 | 35-GlnThrProSerGly-39 |
| SEQ. ID. NO. 17774 | 44-HisArgAsnHisSerArgAlaGlnHis-52 |
| SEQ. ID. NO. 17775 | 81-MetAspIleArgIle-85 |
| SEQ. ID. NO. 17776 | 91-PheArgIleAspPheLeuAsp-97 |
| SEQ. ID. NO. 17777 | 125-IleGlnLysArgHis-129 |
| SEQ. ID. NO. 17778 | 134-LeuAspArgGlnHisPheHisGlyLysLeuLeuSerGlyGluLeuValArg-150 |
| SEQ. ID. NO. 17779 | 179-GlnLeuGlyAsnProArgLeu-185 |
| SEQ. ID. NO. 17780 | 234-LeuLysThrAsnTrpLysSerLysSerSerTyrTyrProArgLysIleArgThrPheSerArgAsnPheLysGlnArgGlnArgIleSerAsnSerPheSerAsnProLeuProLysLys-273 |

Hydrophilic Regions - Hopp-Woods

| | |
|---|---|
| SEQ. ID. NO. 17781 | 1-MetProSerGluAlaArgGlnAlaGlySerAspGly-12 |
| SEQ. ID. NO. 17782 | 46-AsnHisSerArgAlaGlnHis-52 |
| SEQ. ID. NO. 17783 | 81-MetAspIleArgIle-85 |
| SEQ. ID. NO. 17784 | 91-PheArgIleAspPheLeuAsp-97 |
| SEQ. ID. NO. 17785 | 236-ThrAsnTrpLysSerLysSer-242 |
| SEQ. ID. NO. 17786 | 247-ArgLysIleArgThrPheSerArgAsnPheLysGlnArgGlnArgIle-262 | a246-2
AMPHI Regions - AMPHI

| | |
|---|---|
| SEQ. ID. NO. 17787 | 39-AlaValAsnIleAlaGlnCysPheThr-47 |
| SEQ. ID. NO. 17788 | 60-ArgCysAlaGluValLeuValGluGlnPheAlaAsnLeuPhePhe-74 |
| SEQ. ID. NO. 17789 | 83-AspMetGlyArgPhe-87 |
| SEQ. ID. NO. 17790 | 132-PheGlyCysAspAspValValAspAspPheAlaGlyPheGlyArgCysPheArgProVal-151 |
| SEQ. ID. NO. 17791 | 156-GlnLeuGlyGlnValPhePheGln-163 |

Antigenic Index - Jameson-Wolf

| | |
|---|---|
| SEQ. ID. NO. 17792 | 1-MetHisGlyArgAsnGlyGlyThrGln-9 |
| SEQ. ID. NO. 17793 | 18-GlnThrGlnArgThrCysPheSerAsnGlyGluValHisAlaThrGlnThrAspIleGlySer-38 |
| SEQ. ID. NO. 17794 | 78-AspCysGlyHisHisAspMetGlyArg-86 |
| SEQ. ID. NO. 17795 | 92-LeuAspAspGluLeuAla-97 |
| SEQ. ID. NO. 17796 | 133-GlyCysAspAspValValAspAspPheAlaGlyPheGlyArgCysPheArg-149 |
| SEQ. ID. NO. 17797 | 166-GlnGlnGlyArgGlnPheArgGln-173 |

Hydrophilic Regions - Hopp-Woods

| | |
|---|---|
| SEQ. ID. NO. 17798 | 1-MetHisGlyArgAsnGlyGly-7 |
| SEQ. ID. NO. 17799 | 92-LeuAspAspGluLeuAla-97 |
| SEQ. ID. NO. 17800 | 136-AspValValAspAsp-140 |
| SEQ. ID. NO. 17801 | 169-ArgGlnPheArgGln-173 | a247-1
AMPHI Regions - AMPHI

| | |
|---|---|
| SEQ. ID. NO. 17802 | 44-ValValSerSerCysSerLysIleAlaLysProGlyLysLysIleSerThrLeuGlnGlu-63 |
| SEQ. ID. NO. 17803 | 153-PheAspSerSerThr-157 |

Antigenic Index - Jameson-Wolf

| | |
|---|---|
| SEQ. ID. NO. 17804 | 11-GluSerThrAspIleLysTyrProGly-19 |
| SEQ. ID. NO. 17805 | 33-IleAspAspLeuAlaSerAla-40 |
| SEQ. ID. NO. 17806 | 47-SerCysSerLysIleAlaLysProGlyLysLysIleSerThrLeuGlnGluAlaLysSer-66 |
| SEQ. ID. NO. 17807 | 70-IleThrAsnAspAspLysGlnAsnGlyAsnIleThrArgGlnArgHis-85 |
| SEQ. ID. NO. 17808 | 95-IleAlaGlyGluGluGlyLeu-101 |
| SEQ. ID. NO. 17809 | 104-PheGlnLeuAspAspLysGlyLysTrpGlyAsn-114 |
| SEQ. ID. NO. 17810 | 120-LysLysIleArgHisMetLys-126 |

TABLE 1-continued

| | |
|---|---|
| SEQ. ID. NO. 17811 | 133-SerAspCysProGluAspAspAspAlaGlyLysGluGluLysPheLysTyrThrGlyThrPheAspSerSerThrAsnAla-159 |
| SEQ. ID. NO. 17812 | 171-SerGlyThrAspThrLysIleAlaAlaSerSerAspAsnHis-184 |
| SEQ. ID. NO. 17813 | 192-AlaThrIleArgGlyGlyAsnValCysAlaAsnArgThrLeu-205 |
| Hydrophilic Regions - Hopp-Woods | |
| SEQ. ID. NO. 17814 | 11-GluSerThrAspIleLys-16 |
| SEQ. ID. NO. 17815 | 33-IleAspAspLeuAspAlaSerAla-40 |
| SEQ. ID. NO. 17816 | 49-SerLysIleAlaLysProGlyLysLysIleSerThr-60 |
| SEQ. ID. NO. 17817 | 62-GlnGluAlaLysSer-66 |
| SEQ. ID. NO. 17818 | 71-ThrAsnAspAspLysGlnAsnGlyAsnIleThrArgGlnArgHis-85 |
| SEQ. ID. NO. 17819 | 95-IleAlaGlyGluGluGlyLeu-101 |
| SEQ. ID. NO. 17820 | 105-GlnLeuAspAspLysGlyLysTrpGly-113 |
| SEQ. ID. NO. 17821 | 120-LysLysIleArgHisMetLys-126 |
| SEQ. ID. NO. 17822 | 134-AspCysProGluAspAspAspAlaGlyLysGluGluLysPheLysTyr-149 |
| SEQ. ID. NO. 17823 | 153-PheAspSerSerThr-157 |
| SEQ. ID. NO. 17824 | 172-GlyThrAspThrLysIleAlaAlaSerSerAsp-182 |
| a248-1 | |
| AMPHI Regions - AMPHI | |
| SEQ. ID. NO. 17825 | 88-GluAsnCysGlyLysGlyLeu-94 |
| SEQ. ID. NO. 17826 | 121-ValGluAlaValLysArg-126 |
| SEQ. ID. NO. 17827 | 148-ThrGlnSerValSerLysMetProArgTyrIleIleGlu-160 |
| SEQ. ID. NO. 17828 | 168-GluAsnValTyrArgValThrAlaLysAlaTrpGlyLysAsn-181 |
| Antigenic Index - Jameson-Wolf | |
| SEQ. ID. NO. 17829 | 1-MetArgLysGlnAsnThrLeuThr-8 |
| SEQ. ID. NO. 17830 | 11-ProThrSerAspGlyGlnArgGly-18 |
| SEQ. ID. NO. 17831 | 40-GlnSerTyrAsnThrGluGlnArgIleSerAlaAsnGluSerAspArgLysLeuAla-58 |
| SEQ. ID. NO. 17832 | 64-AlaAlaLeuArgGluGlyGluLeuGln-72 |
| SEQ. ID. NO. 17833 | 76-LeuGluTyrAspThrAspSerLysValThrPheSerGluAsnCysGlyLysGlyLeu-94 |
| SEQ. ID. NO. 17834 | 99-AsnValArgThrAsnAsnAspAsnGluGluAlaPhe-110 |
| SEQ. ID. NO. 17835 | 116-GlnGlyLysProThrValGluAlaValLysArgSerCysThrAlaLysSerThrGlyLeu-135 |
| SEQ. ID. NO. 17836 | 137-IleAspAsnLysGlyMetGluTyrLysLysGlyThrGlnSerValSerLysMetProArgTyr-157 |
| SEQ. ID. NO. 17837 | 162-LeuGlyValLysAsnGlyGluAsnValTyr-171 |
| SEQ. ID. NO. 17838 | 177-AlaTrpGlyLysAsnAlaAsnThr-184 |
| SEQ. ID. NO. 17839 | 192-ValSerAsnAsnAspGlu-197 |
| Hydrophilic Regions - Hopp-Woods | |
| SEQ. ID. NO. 17840 | 1-MetArgLysGlnAsnThr-6 |
| SEQ. ID. NO. 17841 | 11-ProThrSerAspGlyGlnArg-17 |
| SEQ. ID. NO. 17842 | 42-TyrAsnThrGluGlnArgIleSerAlaAsnGluSerAspArgLysLeuAla-58 |
| SEQ. ID. NO. 17843 | 64-AlaAlaLeuArgGluGlyGluLeuGln-72 |
| SEQ. ID. NO. 17844 | 76-LeuGluTyrAspThrAspSerLysValThrPhe-86 |
| SEQ. ID. NO. 17845 | 101-ArgThrAsnAsnAspAsnGluGluAlaPhe-110 |
| SEQ. ID. NO. 17846 | 119-ProThrValGluAlaValLysArgSerCysThrAlaLysSer-132 |
| SEQ. ID. NO. 17847 | 137-IleAspAsnLysGlyMetGluTyrLysLysGlyThrGlnSerValSerLysMetPro-155 |
| SEQ. ID. NO. 17848 | 165-LysAsnGlyGluAsnValTyr-171 |
| SEQ. ID. NO. 17849 | 193-SerAsnAsnAspGlu-197 |
| a249-1 | |
| AMPHI Regions - AMPHI | |
| SEQ. ID. NO. 17850 | 6-CysPheArgLeuLys-10 |
| SEQ. ID. NO. 17851 | 15-GlyMetAlaLeuIleGluValLeuVal-23 |
| SEQ. ID. NO. 17852 | 42-ThrValAlaSerValArgGluAla-49 |
| SEQ. ID. NO. 17853 | 53-ThrIleValSerGlnIleThrGlnAsnLeuMetGluGlyMet-66 |
| Antigenic Index - Jameson-Wolf | |
| SEQ. ID. NO. 17854 | 1-MetLysAsnAsnAspCysPheArgLeuLysAsnProGlnSerGly-15 |
| SEQ. ID. NO. 17855 | 44-AlaSerValArgGluAlaGluThr-51 |
| SEQ. ID. NO. 17856 | 70-ProThrIleAspSerAspSerAsnLysLysAsnTyr-81 |
| SEQ. ID. NO. 17857 | 94-ValAspGlyAspPheGln-99 |
| SEQ. ID. NO. 17858 | 102-AlaIleLysThrLysThrGlnLeuAla-110 |
| SEQ. ID. NO. 17859 | 135-ValCysLysAspSerSerGlyValAla-143 |
| SEQ. ID. NO. 17860 | 154-SerAsnCysAspGlySerAlaAsnGlyAspThrLeu-165 |
| SEQ. ID. NO. 17861 | 173-AspSerAlaGlyAspSerAspIleAlaArgThrAsnLeuGluThrAsnGlyAsnAsn-191 |
| SEQ. ID. NO. 17862 | 198-AlaArgValGlyGlyArgGlu-204 |
| Hydrophilic Regions - Hopp-Woods | |
| SEQ. ID. NO. 17863 | 1-MetLysAsnAsnAspCysPheArgLeuLysAsnProGln-13 |
| SEQ. ID. NO. 17864 | 44-AlaSerValArgGluAlaGluThr-51 |
| SEQ. ID. NO. 17865 | 72-IleAspSerAspSerAsnLysLysAsn-80 |
| SEQ. ID. NO. 17866 | 94-ValAspGlyAspPheGln-99 |
| SEQ. ID. NO. 17867 | 102-AlaIleLysThrLysThrGlnLeuAla-110 |
| SEQ. ID. NO. 17868 | 135-ValCysLysAspSerSerGly-141 |
| SEQ. ID. NO. 17869 | 155-AsnCysAspGlySerAlaAsnGly-162 |
| SEQ. ID. NO. 17870 | 174-SerAlaGlyAspSerAspIleAlaArgThrAsnLeuGluThrAsnGly-189 |
| SEQ. ID. NO. 17871 | 200-ValGlyGlyArgGlu-204 |
| a250 | |
| AMPHI Regions - AMPHI | |
| SEQ. ID. NO. 17872 | 8-ArgAsnGluPheIleArgGlyIleLysGlu-17 |
| SEQ. ID. NO. 17873 | 54-PheAlaGlyGlySerGlu-59 |
| SEQ. ID. NO. 17874 | 61-AlaThrValAsnLeuTrpAlaGluPro-69 |
| Antigenic Index - Jameson-Wolf | |
| SEQ. ID. NO. 17875 | 5-SerSerProArgAsnGluPheIleArgGlyIleLysGluSerSer-19 |
| SEQ. ID. NO. 17876 | 34-MetGlnGlyGlyGlnLysGlyMetSer-42 |
| SEQ. ID. NO. 17877 | 54-PheAlaGlyGlySerGlu-59 |
| SEQ. ID. NO. 17878 | 90-GlyXxxGlyThrCysProAlaProGluArgAsnThrAlaGluLysSerArgAlaArg-108 |

TABLE 1-continued

Hydrophilic Regions - Hopp-Woods
SEQ. ID. NO. 17879   5-SerSerProArgAsnGluPheIleArgGlyIleLysGluSerSer-19
SEQ. ID. NO. 17880   95-ProAlaProGluArgAsnThrAlaGluLysSerArgAlaArg-108
a251
AMPHI Regions - AMPHI
SEQ. ID. NO. 17881   47-GlnAlaAlaAspLeuProArgAsnHisIleSerProAlaTyr-60
SEQ. ID. NO. 17882   81-ArgArgIleGlyAla-85
SEQ. ID. NO. 17883   110-GlnValValAlaAspPheGlyGlyIleGluGlyPhe-121
SEQ. ID. NO. 17884   156-ArgThrValGlyArgThrValArgLeuLeuLysMetIle-168
SEQ. ID. NO. 17885   211-AlaArgThrValPheArgAlaHis-218
SEQ. ID. NO. 17886   255-LeuGlyGlnGluCysArg-260
SEQ. ID. NO. 17887   262-ArgHisIleAlaArgValGluSerLeuLeuArgValPheGluTyrAlaAlaAsp-279
Antigenic Index - Jameson-Wolf
SEQ. ID. NO. 17888   9-GlnProArgAlaAspIleArgProProAlaGlnThrAspIleValProAsnCys-26
SEQ. ID. NO. 17889   34-AspAlaAlaArgArgAlaValArg-41
SEQ. ID. NO. 17890   50-AspLeuProArgAsnHisIleSer-57
SEQ. ID. NO. 17891   74-GlyGlyPheArgGlyArgPheArgArg-82
SEQ. ID. NO. 17892   98-IleArgValLysAlaValLysThrGluIle-107
SEQ. ID. NO. 17893   145-ArgLeuValGlyThr-149
SEQ. ID. NO. 17894   157-ThrValGlyArgThrValArg-163
SEQ. ID. NO. 17895   175-ProValValArgGluAlaGly-181
SEQ. ID. NO. 17896   208-ValLysHisAlaArgThrValPhe-215
SEQ. ID. NO. 17897   251-IleLysAsnArgLeuGlyGlnGluCysArgAsnArgHisIleAlaArgValGluSer-269
SEQ. ID. NO. 17898   286-LysThrLysThrArgAlaGluGlnProArgSerAla-297
Hydrophilic Regions - Hopp-Woods
SEQ. ID. NO. 17899   10-ProArgAlaAspIleArgProProAlaGln-19
SEQ. ID. NO. 17900   34-AspAlaAlaArgArgAlaValArg-41
SEQ. ID. NO. 17901   76-PheArgGlyArgPheArgArg-82
SEQ. ID. NO. 17902   98-IleArgValLysAlaValLysThrGluIle-107
SEQ. ID. NO. 17903   157-ThrValGlyArgThrValArg-163
SEQ. ID. NO. 17904   175-ProValValArgGluAlaGly-181
SEQ. ID. NO. 17905   208-ValLysHisAlaArgThrValPhe-215
SEQ. ID. NO. 17906   253-AsnArgLeuGlyGlnGluCysArgAsnArgHisIleAlaArgValGluSer-269
SEQ. ID. NO. 17907   287-ThrLysThrArgAlaGluGlnProArg-295
a254
AMPHI Regions - AMPHI
SEQ. ID. NO. 17908   6-ArgPheAsnThrTyrSerHis-12
SEQ. ID. NO. 17909   32-GlyHisGlyAspGlyTyrArg-38
SEQ. ID. NO. 17910   66-LysLeuLysSerIleLeuLys-72
SEQ. ID. NO. 17911   142-ValLeuAlaValMetLysSerLeuThrAlaSer-152
Antigenic Index - Jameson-Wolf
SEQ. ID. NO. 17912   2-TyrThrGlyGluArgPheAsnThrTyrSer-11
SEQ. ID. NO. 17913   32-GlyHisGlyAspGlyTyrArg-38
SEQ. ID. NO. 17914   65-GlyLysLeuLysSerIleLeuLysLysThrAspHis-76
SEQ. ID. NO. 17915   94-SerLeuArgAsnGlyProGly-100
SEQ. ID. NO. 17916   120-ThrIleGlyArgLysSerGluLysArgLeuLeu-130
SEQ. ID. NO. 17917   177-AsnAspGluLysIleArgHisGlyHisGly-186
Hydrophilic Regions - Hopp-Woods
SEQ. ID. NO. 17918   65-GlyLysLeuLysSerIleLeuLysLysThrAspHis-76
SEQ. ID. NO. 17919   120-ThrIleGlyArgLysSerGluLysArgLeuLeu-130
SEQ. ID. NO. 17920   177-AsnAspGluLysIleArgHis-183
a255
AMPHI Regions - AMPHI
SEQ. ID. NO. 17921   23-ValLysThrCysAlaAspPheHisAlaPheAspGlyValAspAlaHisHisGly-40
SEQ. ID. NO. 17922   71-GlyIleGlnGlyPheAlaHis-77
SEQ. ID. NO. 17923   139-AlaGlyGlyGlyPhe-143
Antigenic Index - Jameson-Wolf
SEQ. ID. NO. 17924   40-GlyValGlyAspPheGly-45
SEQ. ID. NO. 17925   54-AlaGlnAlaAspGlyAspValGlyGly-62
SEQ. ID. NO. 17926   67-LeuArgAlaAspGlyIleGln-73
SEQ. ID. NO. 17927   91-ValGlyGlyLysLysArgIleLeu-98
SEQ. ID. NO. 17928   115-GlyAsnValGlyGlyAspPheArgAla-123
SEQ. ID. NO. 17929   130-PhePheGlyAsnGlySerGlyGlyAsnAlaGly-140
SEQ. ID. NO. 17930   145-GlyGlyThrProAla-149
Hydrophilic Regions - Hopp-Woods
SEQ. ID. NO. 17931   56-AlaAspGlyAspVal-60
SEQ. ID. NO. 17932   67-LeuArgAlaAspGly-71
SEQ. ID. NO. 17933   92-GlyGlyLysLysArgIleLeu-98
SEQ. ID. NO. 17934   119-GlyAspPheArgAla-123
a256-1
AMPHI Regions - AMPHI
SEQ. ID. NO. 17935   90-GlyValValValHisPheArgSerCysGlyGlyValAla-102
SEQ. ID. NO. 17936   127-ArgTyrArgGluIleTyrAlaVal-134
SEQ. ID. NO. 17937   141-AsnAlaLeuAlaLysTyrLeuGlyGluGln-150
SEQ. ID. NO. 17938   174-ArgPheAspSerGlyIleThrArgLeuLeu-183
SEQ. ID. NO. 17939   197-ArgSerLeuGlnGlyPheGlnThrAla-205

TABLE 1-continued

| | |
|---|---|
| SEQ. ID. NO. 17940 | 207-AlaAlaGlyCysLysThrLeuGlyGluPheAspAspArgPheThrAlaProLeuHisGly-226 |
| SEQ. ID. NO. 17941 | 233-TyrTyrArgGlnThrSerCysLysProLeuLeuLysHisValAla-247 |
| SEQ. ID. NO. 17942 | 267-ProArgAlaAspGluValSer-273 |
| Antigenic Index - Jameson-Wolf | |
| SEQ. ID. NO. 17943 | 4-ThrProProAspThrProPhe-10 |
| SEQ. ID. NO. 17944 | 12-LeuArgAsnGlyAsnAlaAspThrIleAla-21 |
| SEQ. ID. NO. 17945 | 24-PheLeuGlnArgSerAlaProAlaTyrArgArgGluLeuLeuProAspSerThrGlyLysThrLysThrAlaTyrAspPheSerAspGlyIleSerProAspAla-58 |
| SEQ. ID. NO. 17946 | 67-LeuGluGlyGlySerGlySer-73 |
| SEQ. ID. NO. 17947 | 82-AlaValArgAspArgGlyTrpAsn-89 |
| SEQ. ID. NO. 17948 | 97-SerCysGlyGlyValAlaAsn-103 |
| SEQ. ID. NO. 17949 | 112-GlyAspThrAlaGlu-116 |
| SEQ. ID. NO. 17950 | 124-LeuAlaAlaArgTyrArgGlu-130 |
| SEQ. ID. NO. 17951 | 147-LeuGlyGluGlnGlyGluAsnAlaLeu-155 |
| SEQ. ID. NO. 17952 | 166-ValAspAlaGluAlaAlaGlyAsnArgPheAspSerGlyIle-179 |
| SEQ. ID. NO. 17953 | 192-LeuIleProLysAlaArgSerLeuGln-200 |
| SEQ. ID. NO. 17954 | 212-ThrLeuGlyGluPheAspAspArgPheThr-221 |
| SEQ. ID. NO. 17955 | 227-PheAlaAspArgHisAspTyrTyrArgGlnThrSerCysLysProLeuLeu-243 |
| SEQ. ID. NO. 17956 | 259-ProPheLeuProProGluAlaLeuProArgAlaAspGluValSerGlu-274 |
| SEQ. ID. NO. 17957 | 292-SerThrGlyGlyArgLeu-297 |
| SEQ. ID. NO. 17958 | 311-AspSerPheArgThrAsnArgArg-318 |
| Hydrophilic Regions - Hopp-Woods | |
| SEQ. ID. NO. 17959 | 28-SerAlaProAlaTyrArgArgGluLeuLeuPro-38 |
| SEQ. ID. NO. 17960 | 40-SerThrGlyLysThrLysThr-46 |
| SEQ. ID. NO. 17961 | 83-ValArgAspArgGlyTrp-88 |
| SEQ. ID. NO. 17962 | 124-LeuAlaAlaArgTyrArgGlu-130 |
| SEQ. ID. NO. 17963 | 147-LeuGlyGluGlnGlyGluAsnAlaLeu-155 |
| SEQ. ID. NO. 17964 | 166-ValAspAlaGluAlaAlaGlyAsnArgPheAspSerGlyIle-179 |
| SEQ. ID. NO. 17965 | 192-LeuIleProLysAlaArgSer-198 |
| SEQ. ID. NO. 17966 | 212-ThrLeuGlyGluPheAspAspArgPheThr-221 |
| SEQ. ID. NO. 17967 | 227-PheAlaAspArgHisAspTyrTyrArg-235 |
| SEQ. ID. NO. 17968 | 265-AlaLeuProArgAlaAspGluValSerGlu-274 |
| SEQ. ID. NO. 17969 | 313-PheArgThrAsnArgArg-318 |
| a257 | |
| AMPHI Regions - AMPHI | |
| SEQ. ID. NO. 17970 | 24-SerPheLeuProAsn-28 |
| SEQ. ID. NO. 17971 | 73-AspLeuValAsnLysValLeuAlaGluValAlaArgLeuGluLysMetPhe-89 |
| SEQ. ID. NO. 17972 | 109-SerProProAlaAspPheLeuGluLeuLeuSerLeuAlaValIlePheThr-125 |
| Antigenic Index - Jameson-Wolf | |
| SEQ. ID. NO. 17973 | 1-MetGlyArgHisPheGlyArgArgArgPhe-10 |
| SEQ. ID. NO. 17974 | 31-AlaAlaAspAspGluLysArgAsnLysAspGluLysArgAsnGluAsn-46 |
| SEQ. ID. NO. 17975 | 56-GlySerGlyAlaGlu-60 |
| SEQ. ID. NO. 17976 | 65-GlyValAspAspArgArgAlaAlaAspLeuVal-75 |
| SEQ. ID. NO. 17977 | 83-AlaArgLeuGluLys-87 |
| SEQ. ID. NO. 17978 | 92-TyrArgGluAspSerLeuIleSerArgLeuAsnArgAspGlyTyrLeuThrSerProProAlaAspPhe-114 |
| Hydrophilic Regions - Hopp-Woods | |
| SEQ. ID. NO. 17979 | 4-HisPheGlyArgArgArgPhe-10 |
| SEQ. ID. NO. 17980 | 31-AlaAlaAspAspGluLysArgAsnLysAspGluLysArgAsnGlu-45 |
| SEQ. ID. NO. 17981 | 65-GlyValAspAspArgArgAlaAlaAspLeuVal-75 |
| SEQ. ID. NO. 17982 | 83-AlaArgLeuGluLys-87 |
| SEQ. ID. NO. 17983 | 92-TyrArgGluAspSerLeuIle-98 |
| SEQ. ID. NO. 17984 | 100-ArgLeuAsnArgAspGlyTyr-106 |
| a259-1 | |
| AMPHI Regions - AMPHI | |
| SEQ. ID. NO. 17985 | 154-TyrGlyArgValPheAlaAspIlePheGluLeuSer-165 |
| SEQ. ID. NO. 17986 | 172-AlaPheLysGlyMetLeuLysLeuThrAlaGluTyrLysAsnIlePheGlyAspAlaCysArg-192 |
| SEQ. ID. NO. 17987 | 203-AsnGlnAlaLeuGlnGluIleSerLysThrSerGlu-214 |
| Antigenic Index - Jameson-Wolf | |
| SEQ. ID. NO. 17988 | 34-LysAlaTyrThrGluGluLeuProPro-42 |
| SEQ. ID. NO. 17989 | 61-SerAlaArgSerLysAlaLysAlaGluLysPheTyrArgGluLysMetIleGln-78 |
| SEQ. ID. NO. 17990 | 93-LeuGluHisLysPro-97 |
| SEQ. ID. NO. 17991 | 105-LysAsnHisGlyLysGlyMetAlaGluGlnValArgPheLysAla-119 |
| SEQ. ID. NO. 17992 | 121-ValLeuProAspAspGluAspAlaArgThrIleAla-132 |
| SEQ. ID. NO. 17993 | 144-GlyThrAspAlaValAlaSerGlyGluThrTyrGlyArgVal-157 |
| SEQ. ID. NO. 17994 | 168-LeuGluGlyArgAlaPhe-173 |
| SEQ. ID. NO. 17995 | 189-AspAlaCysArgSerGluThrAlaLeu-197 |
| SEQ. ID. NO. 17996 | 208-GluIleSerLysThrSerGluLysSerLysArg-218 |
| Hydrophilic Regions - Hopp-Woods | |
| SEQ. ID. NO. 17997 | 35-AlaTyrThrGluGluLeuPro-41 |
| SEQ. ID. NO. 17998 | 62-AlaArgSerLysAlaLysAlaGluLysPheTyrArgGluLysMetIleGln-78 |
| SEQ. ID. NO. 17999 | 93-LeuGluHisLysPro-97 |
| SEQ. ID. NO. 18000 | 106-AsnHisGlyLysGlyMetAlaGluGlnValArgPheLysAla-119 |
| SEQ. ID. NO. 18001 | 121-ValLeuProAspAspGluAspAlaArgThrIleAla-132 |
| SEQ. ID. NO. 18002 | 168-LeuGluGlyArgAlaPhe-173 |
| SEQ. ID. NO. 18003 | 189-AspAlaCysArgSerGluThrAlaLeu-197 |
| SEQ. ID. NO. 18004 | 208-GluIleSerLysThrSerGluLysSerLysArg-218 |
| a260 | |
| AMPHI Regions - AMPHI | |
| SEQ. ID. NO. 18005 | 12-ProPheSerSerLeuPheArgAlaLeuPhe-21 |
| SEQ. ID. NO. 18006 | 53-PheIleAspSerValGlyGlnValAlaAlaArgLeuPheGlnAlaPhe-68 |

TABLE 1-continued

| | |
|---|---|
| SEQ. ID. NO. 18007 | 154-ValGlnIleAsnGlnValGlyIleValAspLeuIlePro-166 |
| SEQ. ID. NO. 18008 | 176-AlaThrGlyCysThrGlyIleCysProLysCysProThrGlyCysArgPro-192 |
| Antigenic Index - Jameson-Wolf | |
| SEQ. ID. NO. 18009 | 20-LeuPheGluAspArgValGlyIle-27 |
| SEQ. ID. NO. 18010 | 30-GlyAlaHisAspAlaAlaGlu-36 |
| SEQ. ID. NO. 18011 | 38-AspPheLeuProGluGluPheThrArg-46 |
| SEQ. ID. NO. 18012 | 80-ProAlaPheArgAlaArgGluGlnAlaArgArgGlySerGly-93 |
| SEQ. ID. NO. 18013 | 96-AlaGlyAsnAspLeuArgValProHisLysAspAlaValGluValAspIleAspGlyGlyAsnThrVal-118 |
| SEQ. ID. NO. 18014 | 126-ThrHisPheAspAspGlyAspAla-133 |
| SEQ. ID. NO. 18015 | 139-AlaGluAlaArgPhe-143 |
| SEQ. ID. NO. 18016 | 184-ProLysCysProThrGlyCysArgProVal-193 |
| Hydrophilic Regions - Hopp-Woods | |
| SEQ. ID. NO. 18017 | 20-LeuPheGluAspArgValGlyIle-27 |
| SEQ. ID. NO. 18018 | 30-GlyAlaHisAspAlaAlaGlu-36 |
| SEQ. ID. NO. 18019 | 82-PheArgAlaArgGluGlnAlaArgArgGlySer-92 |
| SEQ. ID. NO. 18020 | 98-AsnAspLeuArgValProHisLysAspAlaValGluValAspIleAspGly-114 |
| SEQ. ID. NO. 18021 | 127-HisPheAspAspGlyAspAla-133 |
| SEQ. ID. NO. 18022 | 139-AlaGluAlaArgPhe-143 |
| SEQ. ID. NO. 18023 | 186-CysProThrGlyCysArgProVal-193 |
| a261 | |
| AMPHI Regions - AMPHI | |
| SEQ. ID. NO. 18024 | 22-GlnIlePheArgGln-26 |
| SEQ. ID. NO. 18025 | 32-AspThrAlaArgAlaPheAlaAlaAla-40 |
| SEQ. ID. NO. 18026 | 50-GlyLeuLeuAlaAspIleVal-56 |
| SEQ. ID. NO. 18027 | 92-ValHisGlyPheAspLysHis-98 |
| SEQ. ID. NO. 18028 | 137-AlaValTyrLysGlyIleArgAsnAlaValPhe-147 |
| SEQ. ID. NO. 18029 | 158-GlnGlyIleValArgAsnLeu-164 |
| SEQ. ID. NO. 18030 | 203-AspValPheAlaProVal-208 |
| SEQ. ID. NO. 18031 | 212-CysLeuAsnGlnAlaGlyGly-218 |
| Antigenic Index - Jameson-Wolf | |
| SEQ. ID. NO. 18032 | 40-AlaAlaAspAspAlaVal-45 |
| SEQ. ID. NO. 18033 | 60-HisPheValArgGlnArgProSerLeuArgLeu-70 |
| SEQ. ID. NO. 18034 | 74-HisGlnArgArgValAspLeu-80 |
| SEQ. ID. NO. 18035 | 86-ArgGlnIleLysGlyAsnValHisGlyPheAspLysHisVal-99 |
| SEQ. ID. NO. 18036 | 111-AlaHisAlaArgAspAspValProTyr-119 |
| SEQ. ID. NO. 18037 | 126-AsnArgGlyIleGluGlnGluLysArgVal-135 |
| SEQ. ID. NO. 18038 | 149-SerPheAspGlyGlyGly-154 |
| SEQ. ID. NO. 18039 | 181-ArgAsnProAlaGly-185 |
| SEQ. ID. NO. 18040 | 197-LeuGluSerAsnGlyLeuAsp-203 |
| SEQ. ID. NO. 18041 | 214-AsnGlnAlaGlyGlyArgIleLeuThrAlaArgLysAspAspGlnGlyPhe-230 |
| Hydrophilic Regions - Hopp-Woods | |
| SEQ. ID. NO. 18042 | 40-AlaAlaAspAspAlaVal-45 |
| SEQ. ID. NO. 18043 | 60-HisPheValArgGlnArgProSerLeu-68 |
| SEQ. ID. NO. 18044 | 74-HisGlnArgArgValAspLeu-80 |
| SEQ. ID. NO. 18045 | 94-GlyPheAspLysHisVal-99 |
| SEQ. ID. NO. 18046 | 112-HisAlaArgAspAspValPro-118 |
| SEQ. ID. NO. 18047 | 127-ArgGlyIleGluGlnGluLysArgVal-135 |
| SEQ. ID. NO. 18048 | 221-LeuThrAlaArgLysAspAspGlnGly-229 |
| a263 | |
| AMPHI Regions - AMPHI | |
| SEQ. ID. NO. 18049 | 32-AsnLeuIleGlyValLeuSerAsnAla-40 |
| SEQ. ID. NO. 18050 | 42-GluAlaLeuAlaPheTyrGlnGluValGlyLysLeuAsnAlaAlaAsnSerLeuThr-60 |
| SEQ. ID. NO. 18051 | 86-LysLeuAlaThrLeuLysLys-92 |
| SEQ. ID. NO. 18052 | 100-LysAlaAlaArgAlaLeuAlaAlaGlyGlu-109 |
| SEQ. ID. NO. 18053 | 115-LeuGlyAlaLeuAlaAlaPheThrGln-123 |
| SEQ. ID. NO. 18054 | 135-GluGluLeuLysAlaPhePheAspAla-143 |
| SEQ. ID. NO. 18055 | 157-ValAlaLeuAlaThrLeuCysAsnTyrValAsnAsnLeuGly-170 |
| Antigenic Index - Jameson-Wolf | |
| SEQ. ID. NO. 18056 | 10-GluThrAlaProGluAlaAlaLysAlaArgValGluAla-22 |
| SEQ. ID. NO. 18057 | 37-LeuSerAsnAlaPro-41 |
| SEQ. ID. NO. 18058 | 72-AlaArgThrAsnGlnCysGly-78 |
| SEQ. ID. NO. 18059 | 97-GlnSerValLysAlaAlaArg-103 |
| SEQ. ID. NO. 18060 | 108-GlyGluPheAspAspAlaLysLeu-115 |
| SEQ. ID. NO. 18061 | 126-MetAlaLysLysGlyAlaValSerAspGluGluLeuLysAla-139 |
| SEQ. ID. NO. 18062 | 170-GlyGlnThrGluIleAsnProGluLeu-178 |
| Hydrophilic Regions - Hopp-Woods | |
| SEQ. ID. NO. 18063 | 11-ThrAlaProGluAlaAlaLysAlaArgValGluAla-22 |
| SEQ. ID. NO. 18064 | 97-GlnSerValLysAlaAlaArg-103 |
| SEQ. ID. NO. 18065 | 108-GlyGluPheAspAspAlaLysLeu-115 |
| SEQ. ID. NO. 18066 | 126-MetAlaLysLysGlyAlaValSerAspGluGluLeuLysAla-139 |
| a264 | |
| AMPHI Regions - AMPHI | |
| SEQ. ID. NO. 18067 | 55-ValAlaGluPheThrGlnThrGly-62 |
| SEQ. ID. NO. 18068 | 96-IleProSerTyrValArgValThrAsnThrLys-106 |
| SEQ. ID. NO. 18069 | 124-AsnArgIleIleAspValSer-130 |
| SEQ. ID. NO. 18070 | 183-LeuAsnGlnAlaAlaGlnAsnLeuAlaSerSer-193 |
| Antigenic Index - Jameson-Wolf | |
| SEQ. ID. NO. 18071 | 27-AlaValValArgAlaGluLysLeuHisAlaSerAlaAsnArgSerTyrLysValAlaGlyLysArgTyrThrProLysAsnGlnVal-55 |
| SEQ. ID. NO. 18072 | 57-GluPheThrGlnThrGlyAsnAlaSerTrp-66 |

TABLE 1-continued

| | |
|---|---|
| SEQ. ID. NO. 18073 | 68-GlyGlyArgPheHisGlyArgLysThrSerGlyGlyGluArgTyrAsp-83 |
| SEQ. ID. NO. 18074 | 103-ThrAsnThrLysAsnGlyLysSerVal-111 |
| SEQ. ID. NO. 18075 | 114-ArgValAsnAspArgGlyProPheHisGlyAsnArgIleIleAspValSerLysAlaAlaAla-134 |
| SEQ. ID. NO. 18076 | 153-ValProGlyGlnSerAlaProValAlaGluAsnLysAspIlePheIle-168 |
| SEQ. ID. NO. 18077 | 170-LeuLysSerPheGlyThrGluHisGluAla-179 |
| SEQ. ID. NO. 18078 | 192-SerSerAlaSerAsnProAsnLeuSerValGluLysArgArgTyrGluTyr-208 |
| SEQ. ID. NO. 18079 | 216-AlaSerGlnGluArgAlaAlaGluAlaGluAlaGlnAla-228 |

Hydrophilic Regions - Hopp-Woods

| | |
|---|---|
| SEQ. ID. NO. 18080 | 27-AlaValValArgAlaGluLysLeuHisAlaSerAlaAsnArgSerTyrLysValAlaGlyLysArgTyrThrPro-51 |
| SEQ. ID. NO. 18081 | 71-PheHisGlyArgLysThrSerGlyGlyGluArgTyrAsp-83 |
| SEQ. ID. NO. 18082 | 103-ThrAsnThrLysAsnGlyLys-109 |
| SEQ. ID. NO. 18083 | 115-ValAsnAspArgGlyProPheHis-122 |
| SEQ. ID. NO. 18084 | 125-ArgIleIleAspValSerLysAlaAlaAla-134 |
| SEQ. ID. NO. 18085 | 159-ProValAlaGluAsnLysAspIlePheIle-168 |
| SEQ. ID. NO. 18086 | 171-LysSerPheGlyThrGluHisGluAla-179 |
| SEQ. ID. NO. 18087 | 199-LeuSerValGluLysArgArgTyrGluTyr-208 |
| SEQ. ID. NO. 18088 | 216-AlaSerGlnGluArgAlaAlaGluAlaGluAlaGlnAla-228 | a266
Antigenic Index - Jameson-Wolf

| | |
|---|---|
| SEQ. ID. NO. 18089 | 5-AsnAlaPheArgArgHisArgArgArgGlnCysProAsnArgLysProAlaMet-22 |
| SEQ. ID. NO. 18090 | 51-ProLeuLysArgLysHisPhe-57 |
| SEQ. ID. NO. 18091 | 80-SerArgAlaGlyAlaValHisAspGlnGlyTrpGlu-91 |
| SEQ. ID. NO. 18092 | 114-TrpHisThrArgAsnArgGlu-120 |

Hydrophilic Regions - Hopp-Woods

| | |
|---|---|
| SEQ. ID. NO. 18093 | 5-AsnAlaPheArgArgHisArgArgArgGlnCysProAsnArgLysProAlaMet-22 |
| SEQ. ID. NO. 18094 | 51-ProLeuLysArgLysHisPhe-57 |
| SEQ. ID. NO. 18095 | 80-SerArgAlaGlyAlaValHis-86 | a268-1
AMPHI Regions - AMPHI

| | |
|---|---|
| SEQ. ID. NO. 18096 | 6-AspGlyLeuHisLysPheLysHisIleCysSerAlaAla-18 |
| SEQ. ID. NO. 18097 | 22-IleLysGluProLeuAspLys-28 |
| SEQ. ID. NO. 18098 | 52-GlnGluValAspArgValSerGluTrp-60 |
| SEQ. ID. NO. 18099 | 70-GluPheGluGlnPheTrpLysGlyLeuProGlnThrValGlnAsn-84 |
| SEQ. ID. NO. 18100 | 89-SerGlnLysThrTrpLysSerGlyMetAspLys-99 |
| SEQ. ID. NO. 18101 | 110-GluThrProAsnGlyIleLys-116 |

Antigenic Index - Jameson-Wolf

| | |
|---|---|
| SEQ. ID. NO. 18102 | 1-ValGlnSerArgTyrAspGly-7 |
| SEQ. ID. NO. 18103 | 21-LeuIleLysGluProLeuAspLysAlaLysGlnArgAsnGluGluLeuGluAlaAlaGluGluAlaAlaAla-44 |
| SEQ. ID. NO. 18104 | 47-AlaLeuGlyArgGluGlnGluValAspArgValSerGluTrpGluGluArgTyrLysLeuSerArgSerGluPhe-71 |
| SEQ. ID. NO. 18105 | 82-ValGlnAsnLysLeuGlnAlaSerGlnLysThrTrpLysSerGlyMetAspLysIleCysAlaAsnAsnAlaLysAlaGluGlyGluThrProAsnGly-114 |
| SEQ. ID. NO. 18106 | 119-GluLeuAlaCysLysThrAlaGluThrGluAlaArgLeuGluGluLeuHisAsnArgLysLysAlaLeuLeuAspGluMetAlaArgGluAlaAspLysLysGluLeuProLysArgLeu-158 |

Hydrophilic Regions - Hopp-Woods

| | |
|---|---|
| SEQ. ID. NO. 18107 | 3-SerArgTyrAspGly-7 |
| SEQ. ID. NO. 18108 | 21-LeuIleLysGluProLeuAspLysAlaLysGlnArgAsnGluGluLeuGluAlaAlaGluGluAlaAlaAla-44 |
| SEQ. ID. NO. 18109 | 47-AlaLeuGlyArgGluGlnGluValAspArgValSerGluTrpGluGluArgTyrLysLeuSerArgSerGluPhe-71 |
| SEQ. ID. NO. 18110 | 91-LysThrTrpLysSerGlyMetAspLysIleCys-101 |
| SEQ. ID. NO. 18111 | 104-AsnAlaLysAlaGluGlyGluThrProAsn-113 |
| SEQ. ID. NO. 18112 | 119-GluLeuAlaCysLysThrAlaGluThrGluAlaArgLeuGluGluLeuHisAsnArgLysLysAlaLeuLeuAspGluMetAlaArgGluAlaAspLysLysGluLeuProLysArgLeu-158 | a269
AMPHI Regions - AMPHI

| | |
|---|---|
| SEQ. ID. NO. 18113 | 54-TrpAspPheIleGlnAsnThr-60 |
| SEQ. ID. NO. 18114 | 73-PheLysThrArgAlaLeuGlyArgPheSerSerPro-84 |

Antigenic Index - Jameson-Wolf

| | |
|---|---|
| SEQ. ID. NO. 18115 | 42-ProAlaSerSerAla-46 |
| SEQ. ID. NO. 18116 | 60-ThrAlaSerProLysValSer-66 |
| SEQ. ID. NO. 18117 | 73-PheLysThrArgAlaLeuGlyArgPheSerSerPro-84 |
| SEQ. ID. NO. 18118 | 90-LeuSerGlyArgGlyValLysLysProLeu-99 |
| SEQ. ID. NO. 18119 | 107-GlnValAspThrSerAla-112 |

Hydrophilic Regions - Hopp-Woods

| | |
|---|---|
| SEQ. ID. NO. 18120 | 61-AlaSerProLysVal-65 |
| SEQ. ID. NO. 18121 | 73-PheLysThrArgAlaLeuGly-79 |
| SEQ. ID. NO. 18122 | 93-ArgGlyValLysLysProLeu-99 | a270
AMPHI Regions - AMPHI

| | |
|---|---|
| SEQ. ID. NO. 18123 | 41-AspLeuThrGluGlyCys-46 |
| SEQ. ID. NO. 18124 | 49-ProAspGlySerArg-53 |
| SEQ. ID. NO. 18125 | 100-GlnProSerGlyThrTrp-105 |

Antigenic Index - Jameson-Wolf

| | |
|---|---|
| SEQ. ID. NO. 18126 | 1-MetAsnLysAsnArgLysLeu-7 |
| SEQ. ID. NO. 18127 | 41-AspLeuThrGluGlyCysThrLeuProAspGlySerArgValArgAlaAlaAlaValSerThrLysLysProPhe-65 |
| SEQ. ID. NO. 18128 | 71-HisAlaProAlaGlyThrGlu-77 |
| SEQ. ID. NO. 18129 | 86-LysAsnMetAspMetGlyPhe-92 |
| SEQ. ID. NO. 18130 | 95-TyrMetPheGluArgGlnProSerGlyThr-104 |
| SEQ. ID. NO. 18131 | 116-ValGluGlyArgArgAspPheThrAla-124 |
| SEQ. ID. NO. 18132 | 128-IleGlySerArgThrPhe-133 |

TABLE 1-continued

Hydrophilic Regions - Hopp-Woods
SEQ. ID. NO. 18133    1-MetAsnLysAsnArgLysLeu-7
SEQ. ID. NO. 18134    49-ProAspGlySerArgValArgAla-56
SEQ. ID. NO. 18135    60-SerThrLysLysProPhe-65
SEQ. ID. NO. 18136    73-ProAlaGlyThrGlu-77
SEQ. ID. NO. 18137    96-MetPheGluArgGlnPro-101
SEQ. ID. NO. 18138    116-ValGluGlyArgArgAspPheThrAla-124
a271-2
AMPHI Regions - AMPHI
SEQ. ID. NO. 18139    6-MetAlaArgIleTrp-10
SEQ. ID. NO. 18140    20-SerProCysProAla-24
SEQ. ID. NO. 18141    29-ProLysSerLeuAlaLysCysAla-36
Antigenic Index - Jameson-Wolf
SEQ. ID. NO. 18142    26-ThrThrLysProLysSerLeuAlaLys-34
SEQ. ID. NO. 18143    41-ArgSerAsnCysLeu-45
SEQ. ID. NO. 18144    60-CysSerSerThrThrGlyAlaProThrSerArg-70
SEQ. ID. NO. 18145    78-SerAlaSerIleAsnLysAspThrArgMetProAlaSerVal-91
SEQ. ID. NO. 18146    102-CysCysAlaAsnThrSerLysProProSer-111
Hydrophilic Regions - Hopp-Woods
SEQ. ID. NO. 18147    27-ThrLysProLysSerLeuAla-33
SEQ. ID. NO. 18148    80-SerIleAsnLysAspThrArgMet-87
SEQ. ID. NO. 18149    105-AsnThrSerLysProPro-110
a272-2
AMPHI Regions - AMPHI
SEQ. ID. NO. 18150    44-IleThrArgIleThrAspGlu-50
SEQ. ID. NO. 18151    70-AlaGluGluPheSerSerThrAsn-77
SEQ. ID. NO. 18152    106-PheArgAlaIleThrSer-111
SEQ. ID. NO. 18153    165-IleIleThrIleGluAspProIleGlu-173
SEQ. ID. NO. 18154    194-AsnTrpMetAlaAlaLeuLysAsnThrLeuArgGlnAla-206
SEQ. ID. NO. 18155    244-AsnGlnAlaLeuAspArgIleIleAsn-252
SEQ. ID. NO. 18156    307-GlyAsnIleHisGluIleLysGluValMetLys-317
SEQ. ID. NO. 18157    328-AspGlnHisLeuTyrGln-333
SEQ. ID. NO. 18158    343-GlnAspAlaLeuLysAsnAlaAspSer-351
Antigenic Index - Jameson-Wolf
SEQ. ID. NO. 18159    2-PheThrAspGluAsnMetThrAlaLysGluGluLeu-13
SEQ. ID. NO. 18160    19-HisMetAsnLysAsnLysGlySerAsp-27
SEQ. ID. NO. 18161    38-MetLysLeuAspGlyLysIleThrArgIleThrAspGluProLeuThrAlaGluLysCysMet-58
SEQ. ID. NO. 18162    68-LysGlnAlaGluGluPheSerSerThrAsnGlu-78
SEQ. ID. NO. 18163    85-LeuProAspThrSerArgPheArgVal-93
SEQ. ID. NO. 18164    109-IleThrSerLysIleProLysPheGluSerLeuAsn-120
SEQ. ID. NO. 18165    128-ValAlaLeuLysLysArgGly-134
SEQ. ID. NO. 18166    142-ThrGlySerGlyLysSerThrSerLeu-150
SEQ. ID. NO. 18167    154-IleAspTyrArgAsnGluAsnSerPheGly-163
SEQ. ID. NO. 18168    168-IleGluAspProIle-172
SEQ. ID. NO. 18169    176-HisGluHisLysAsnCys-181
SEQ. ID. NO. 18170    184-ThrGlnArgGluValGlyValAspThrGluAsn-194
SEQ. ID. NO. 18171    199-LeuLysAsnThrLeuArgGlnAlaProAsp-208
SEQ. ID. NO. 18172    214-GluIleArgAspArgGluThrMet-221
SEQ. ID. NO. 18173    241-AsnSerThrAsnGlnAlaLeuAspArg-249
SEQ. ID. NO. 18174    254-PheProGluGluArgArgGluGlnLeuLeu-263
SEQ. ID. NO. 18175    278-LeuValProArgAspGlyGlyLysGlyArgValAlaAla-290
SEQ. ID. NO. 18176    310-HisGluIleLysGluValMetLysLysSerThr-320
SEQ. ID. NO. 18177    336-GluLysGlyGluIleSerLeu-342
SEQ. ID. NO. 18178    344-AspAlaLeuLysAsnAlaAspSerAlaHisAspLeu-355
SEQ. ID. NO. 18179    361-LeuArgSerArgGlnAlaGlnSerSerGlyProAspLeuGluLeuLeu-376
Hydrophilic Regions - Hopp-Woods
SEQ. ID. NO. 18180    2-PheThrAspGluAsnMetThrAlaLysGluGluLeu-13
SEQ. ID. NO. 18181    20-MetAsnLysAsnLysGlySerAsp-27
SEQ. ID. NO. 18182    38-MetLysLeuAspGlyLysIleThrArgIleThrAspGluProLeuThrAlaGluLysCysMet-58
SEQ. ID. NO. 18183    68-LysGlnAlaGluGluPheSerSer-75
SEQ. ID. NO. 18184    87-AspThrSerArgPheArgVal-93
SEQ. ID. NO. 18185    112-LysIleProLysPheGluSer-118
SEQ. ID. NO. 18186    128-ValAlaLeuLysLysArgGly-134
SEQ. ID. NO. 18187    143-GlySerGlyLysSerThrSer-149
SEQ. ID. NO. 18188    155-AspTyrArgAsnGluAsnSer-161
SEQ. ID. NO. 18189    168-IleGluAspProIle-172
SEQ. ID. NO. 18190    176-HisGluHisLysAsn-180
SEQ. ID. NO. 18191    184-ThrGlnArgGluValGlyValAspThr-192
SEQ. ID. NO. 18192    201-AsnThrLeuArgGlnAlaPro-207
SEQ. ID. NO. 18193    214-GluIleArgAspArgGluThrMet-221
SEQ. ID. NO. 18194    245-GlnAlaLeuAspArg-249
SEQ. ID. NO. 18195    255-ProGluGluArgArgGluGlnLeuLeu-263
SEQ. ID. NO. 18196    278-LeuValProArgAspGlyGlyLysGlyArgValAlaAla-290
SEQ. ID. NO. 18197    310-HisGluIleLysGluValMetLysLysSerThr-320
SEQ. ID. NO. 18198    336-GluLysGlyGluIleSerLeu-342

TABLE 1-continued

| | |
|---|---|
| SEQ. ID. NO. 18199 | 344-AspAlaLeuLysAsnAlaAspSerAlaHisAspLeu-355 |
| SEQ. ID. NO. 18200 | 361-LeuArgSerArgGlnAlaGlnSerGlyProAspLeuGluLeu-375 | a274
AMPHI Regions - AMPHI

| | |
|---|---|
| SEQ. ID. NO. 18201 | 31-TyrLysAspGlyLys-35 |
| SEQ. ID. NO. 18202 | 111-GluAlaValPheLysThrLeuSerPro-119 |

Antigenic Index - Jameson-Wolf

| | |
|---|---|
| SEQ. ID. NO. 18203 | 25-LeuValThrAspAspTyrTyrLysAspGlyLysHisIleAsp-38 |
| SEQ. ID. NO. 18204 | 40-GlnLeuHisArgAspGluGluAlaValArgArgHisIle-52 |
| SEQ. ID. NO. 18205 | 60-ProAspMetAsnAla-64 |
| SEQ. ID. NO. 18206 | 71-GlyGluPheAspGlyLysGlnPro-78 |
| SEQ. ID. NO. 18207 | 85-HisProThrArgLysAlaAspAspGlnThrVal-95 |
| SEQ. ID. NO. 18208 | 99-ProValGlySerAlaGlnAsnGlyArgAlaGluTyr-110 |
| SEQ. ID. NO. 18209 | 117-LeuSerProThrAsnHis-122 |
| SEQ. ID. NO. 18210 | 126-ArgValGluAspAlaAlaGly-132 |
| SEQ. ID. NO. 18211 | 136-ValGluAsnLysTrpIleThrSerGlnGlyAsnAlaValAspLeuThrProMetAspLysLeuPheAsnAsnThrGluSerLys-163 |

Hydrophilic Regions - Hopp-Woods

| | |
|---|---|
| SEQ. ID. NO. 18212 | 29-AspTyrTyrLysAspGlyLysHisIleAsp-38 |
| SEQ. ID. NO. 18213 | 40-GlnLeuHisArgAspGluGluAlaValArgArgHisIle-52 |
| SEQ. ID. NO. 18214 | 72-GluPheAspGlyLysGln-77 |
| SEQ. ID. NO. 18215 | 86-ProThrArgLysAlaAspAspGlnThrVal-95 |
| SEQ. ID. NO. 18216 | 104-GlnAsnGlyArgAlaGluTyr-110 |
| SEQ. ID. NO. 18217 | 126-ArgValGluAspAlaAlaGly-132 |
| SEQ. ID. NO. 18218 | 151-ThrProMetAspLysLeuPheAsn-158 | a276
AMPHI Regions - AMPHI

| | |
|---|---|
| SEQ. ID. NO. 18219 | 9-MetMetArgSerAlaProSerMetValValArgArgTrpAlaThrMetMet-25 |
| SEQ. ID. NO. 18220 | 60-SerPheLysMetAlaArg-65 |
| SEQ. ID. NO. 18221 | 80-ProPheAspProMetGlyTrp-86 |
| SEQ. ID. NO. 18222 | 115-GlyArgLeuTyrArgThrPheSerAsn-123 |
| SEQ. ID. NO. 18223 | 164-ThrLysArgGlySerArgLeu-170 |
| SEQ. ID. NO. 18224 | 207-SerThrSerThrLeuArgLysLeuMetArgProSerThr-219 |

Antigenic Index - Jameson-Wolf

| | |
|---|---|
| SEQ. ID. NO. 18225 | 10-MetArgSerAlaProSerMetVal-17 |
| SEQ. ID. NO. 18226 | 29-PheSerIleArgArgSerSerAlaCysTrpThrArgArgSerAspSerLeuSer-46 |
| SEQ. ID. NO. 18227 | 52-SerSerAsnAsnAsnIle-57 |
| SEQ. ID. NO. 18228 | 67-MetAlaThrArgCysArgCysProProAspLysLeuLeuPro-80 |
| SEQ. ID. NO. 18229 | 82-AspProMetGlyTrp-86 |
| SEQ. ID. NO. 18230 | 88-SerProSerGlyAspAlaSerIleArg-96 |
| SEQ. ID. NO. 18231 | 103-TrpArgAlaAspArgThrSerAlaSerProAlaSerGlyArgLeuTyr-118 |
| SEQ. ID. NO. 18232 | 121-PheSerAsnArgValSerSerAsnArgAsnThrSerTrpGluThrArgAlaAsnTrpAlaArgArgGlnSerSerLeu-146 |
| SEQ. ID. NO. 18233 | 158-LeuProAlaAspGlySerThrLysArgGlySerArgLeuThrThr-172 |
| SEQ. ID. NO. 18234 | 176-ProLeuProGluArgProThrArgAlaThrArgSerProCysLeuMetSerArgLeuLysProSerArgAlaLeuMetProSerGluArgTyrSerThrSerThrLeuArgLysLeuMetArgProSerThrArgCysGlyAla-223 |
| SEQ. ID. NO. 18235 | 229-CysSerGlyGlyValSerArgAsnAlaHisThrProSerAlaAlaArgAsn-245 |

Hydrophilic Regions - Hopp-Woods

| | |
|---|---|
| SEQ. ID. NO. 18236 | 29-PheSerIleArgArgSerSer-35 |
| SEQ. ID. NO. 18237 | 38-TrpThrArgArgSerAspSerLeu-45 |
| SEQ. ID. NO. 18238 | 67-MetAlaThrArgCysArgCysProProAspLys-77 |
| SEQ. ID. NO. 18239 | 90-SerGlyAspAlaSerIleArg-96 |
| SEQ. ID. NO. 18240 | 104-ArgAlaAspArgThrSerAla-110 |
| SEQ. ID. NO. 18241 | 124-ArgValSerSerAsnArgAsnThrSerTrpGluThr-135 |
| SEQ. ID. NO. 18242 | 137-AlaAsnTrpAlaArgArgGlnSerSer-145 |
| SEQ. ID. NO. 18243 | 161-AspGlySerThrLysArgGlySerArg-169 |
| SEQ. ID. NO. 18244 | 176-ProLeuProGluArgProThrArgAlaThrArg-186 |
| SEQ. ID. NO. 18245 | 192-SerArgLeuLysProSerArg-198 |
| SEQ. ID. NO. 18246 | 200-LeuMetProSerGluArgTyrSer-207 |
| SEQ. ID. NO. 18247 | 210-ThrLeuArgLysLeuMetArgProSerThrArgCys-221 |
| SEQ. ID. NO. 18248 | 232-GlyValSerArgAsnAlaHis-238 | a277
AMPHI Regions - AMPHI

| | |
|---|---|
| SEQ. ID. NO. 18249 | 43-PheGluValValGlyGlyLeuPheAspPheValLeu-54 |
| SEQ. ID. NO. 18250 | 70-CysProAsnGluValIleAspValPheHisAlaLeuGln-82 |
| SEQ. ID. NO. 18251 | 87-AlaPheAspAlaValGlyAspPheAlaGluTyrGlyGlyAlaValAspAlaAlaAspLeuLeuGluIleGlyGluLeuGlyTyrPheHis-116 |
| SEQ. ID. NO. 18252 | 180-AlaValGlyValValAlaValAla-187 |

Antigenic Index - Jameson-Wolf

| | |
|---|---|
| SEQ. ID. NO. 18253 | 2-ProArgPheGluAspLysLeuValGlyArgGlnGlyGluGlyGlyVal-17 |
| SEQ. ID. NO. 18254 | 69-PheCysProAsnGluVal-74 |
| SEQ. ID. NO. 18255 | 95-AlaGluTyrGlyGly-99 |
| SEQ. ID. NO. 18256 | 118-ValGluProAspPheProAlaGlnThrProArgAlaGluGlyGly-132 |
| SEQ. ID. NO. 18257 | 138-PheAspLysAlaAsp-142 |
| SEQ. ID. NO. 18258 | 162-AspIleGlyGlySerGlyLeuGluGlyAspLeu-172 |
| SEQ. ID. NO. 18259 | 196-LeuAspValGlyGlyLysProArgLeuGlyAla-206 |
| SEQ. ID. NO. 18260 | 208-CysAlaGlnThrGlyGlyGlyMetGly-216 |
| SEQ. ID. NO. 18261 | 219-GlyThrAspPheHis-223 |
| SEQ. ID. NO. 18262 | 226-GlyLeuAspAspGlyAla-231 |
| SEQ. ID. NO. 18263 | 239-LeuGlnPheGluAspAspLeuLeuGluGlyLysHisGlyLeu-252 |

Hydrophilic Regions - Hopp-Woods

| | |
|---|---|
| SEQ. ID. NO. 18264 | 2-ProArgPheGluAspLysLeuValGlyArgGlnGlyGlu-14 |
| SEQ. ID. NO. 18265 | 118-ValGluProAspPhe-122 |

TABLE 1-continued

| | |
|---|---|
| SEQ. ID. NO. 18266 | 126-ThrProArgAlaGluGly-131 |
| SEQ. ID. NO. 18267 | 138-PheAspLysAlaAsp-142 |
| SEQ. ID. NO. 18268 | 167-GlyLeuGluGlyAspLeu-172 |
| SEQ. ID. NO. 18269 | 198-ValGlyGlyLysProArgLeuGlyAla-206 |
| SEQ. ID. NO. 18270 | 226-GlyLeuAspAspGlyAla-231 |
| SEQ. ID. NO. 18271 | 239-LeuGlnPheGluAspAspLeuLeuGluGlyLysHisGlyLeu-252 | a278
AMPHI Regions - AMPHI

| | |
|---|---|
| SEQ. ID. NO. 18272 | 7-GlyAlaIlePheSerIleGly-13 |
| SEQ. ID. NO. 18273 | 20-IleGlyProLeuProSerIleGlyArg-28 |
| SEQ. ID. NO. 18274 | 42-ThrGlyThrSerLys-46 |
| SEQ. ID. NO. 18275 | 101-ArgThrIleProSerValThrGluIle-109 |
| SEQ. ID. NO. 18276 | 123-PheSerIleLeuAlaLeuIleLysSerLeuIleSer-134 |
| SEQ. ID. NO. 18277 | 157-LeuTyrArgGlnIleGlnAsnLeuIleThrHisPheAsnPheTyrAlaAla-173 |
| SEQ. ID. NO. 18278 | 189-GluThrLeuIleGlnHisLeuArgGlnLeuAlaAsp-200 |

Antigenic Index - Jameson-Wolf

| | |
|---|---|
| SEQ. ID. NO. 18279 | 25-SerIleGlyArgProAsnAlaSerThrThrArgProThrSerSerArgProThrGlyThrSerLysIleArgPro-49 |
| SEQ. ID. NO. 18280 | 63-SerProAsnThrThrAlaProThrGluSerArgSerArgPheIleAla-78 |
| SEQ. ID. NO. 18281 | 80-ProLysValLeuProGlyAsnSerSerIle-89 |
| SEQ. ID. NO. 18282 | 93-IleAlaSerAspLysProTrpMetArg-101 |
| SEQ. ID. NO. 18283 | 110-ThrValProArgValArgThrSerAlaPheThrAspArgPheSer-124 |
| SEQ. ID. NO. 18284 | 146-ArgHisSerArgValGlnGlyThr-153 |
| SEQ. ID. NO. 18285 | 178-PheAspPheAspArgAspPhe-184 |
| SEQ. ID. NO. 18286 | 209-ThrValAsnAspGlyArgPheAspMetValGlu-219 |

Hydrophilic Regions - Hopp-Woods

| | |
|---|---|
| SEQ. ID. NO. 18287 | 27-GlyArgProAsnAlaSerThrThrArgProThrSerSerArgProThrGlyThrSerLysIleArgPro-49 |
| SEQ. ID. NO. 18288 | 68-AlaProThrGluSerArgSerArgPheIleAla-78 |
| SEQ. ID. NO. 18289 | 93-IleAlaSerAspLysProTrp-99 |
| SEQ. ID. NO. 18290 | 110-ThrValProArgValArgThr-116 |
| SEQ. ID. NO. 18291 | 146-ArgHisSerArgValGln-151 |
| SEQ. ID. NO. 18292 | 178-PheAspPheAspArgAspPhe-184 |
| SEQ. ID. NO. 18293 | 211-AsnAspGlyArgPheAspMetValGlu-219 | a279
AMPHI Regions - AMPHI

| | |
|---|---|
| SEQ. ID. NO. 18294 | 6-GlyCysLeuIleSer-10 |
| SEQ. ID. NO. 18295 | 47-AlaAlaSerIleAlaArgSerThrAla-55 |
| SEQ. ID. NO. 18296 | 58-LeuProAlaIleThrThr-63 |
| SEQ. ID. NO. 18297 | 74-ThrThrSerSerCysAlaAsp-80 |

Antigenic Index - Jameson-Wolf

| | |
|---|---|
| SEQ. ID. NO. 18298 | 13-XxxArgAlaSerAla-17 |
| SEQ. ID. NO. 18299 | 29-TrpGluGlyThrAspThrGlySerGlyArgAlaArgLeuAla-42 |
| SEQ. ID. NO. 18300 | 64-CysProGlyGluLeuLysLeuThr-71 |
| SEQ. ID. NO. 18301 | 74-ThrThrSerSerCysAlaAspSer-81 |
| SEQ. ID. NO. 18302 | 88-CysSerSerSerLysProArgIle-95 |
| SEQ. ID. NO. 18303 | 101-ThrProCysGlyThrAlaAspCysIleSerSerAlaArgXxxArgThrSerLeu-118 |
| SEQ. ID. NO. 18304 | 120-AlaSerAlaLysSerAsnAlaProAla-128 |
| SEQ. ID. NO. 18305 | 148-ProProAlaSerGlu-152 |

Hydrophilic Regions - Hopp-Woods

| | |
|---|---|
| SEQ. ID. NO. 18306 | 13-XxxArgAlaSerAla-17 |
| SEQ. ID. NO. 18307 | 29-TrpGluGlyThrAspThrGlySerGlyArgAlaArgLeuAla-42 |
| SEQ. ID. NO. 18308 | 66-GlyGluLeuLysLeu-70 |
| SEQ. ID. NO. 18309 | 89-SerSerSerLysProArgIle-95 |
| SEQ. ID. NO. 18310 | 110-SerSerAlaArgXxxArgThrSerLeu-118 |
| SEQ. ID. NO. 18311 | 120-AlaSerAlaLysSerAsnAla-126 | a280
AMPHI Regions - AMPHI

| | |
|---|---|
| SEQ. ID. NO. 18312 | 27-SerPheSerIleLeuGlyAspValAlaLys-36 |
| SEQ. ID. NO. 18313 | 64-AspIleLysLysIleArgSerAla-71 |
| SEQ. ID. NO. 18314 | 85-AspIleGlnArgAlaValLys-91 |
| SEQ. ID. NO. 18315 | 97-TyrAlaGluAlaThrLysGlyIleGlnProLeuLys-108 |
| SEQ. ID. NO. 18316 | 150-AlaTyrAlaGlnAsnValAlaGluAlaLeuIleLys-161 |
| SEQ. ID. NO. 18317 | 237-ValAlaAlaIleIleArgGlnIleLys-245 |
| SEQ. ID. NO. 18318 | 247-GluGlyIleLysAlaValPheThrGlu-255 |
| SEQ. ID. NO. 18319 | 258-LysAspThrArgMetValAspArgIleAlaLysGluThr-270 |
| SEQ. ID. NO. 18320 | 278-LeuTyrSerAspAlaLeuGlyAsnAlaProAlaAspThrTyrIle-292 |

Antigenic Index - Jameson-Wolf

| | |
|---|---|
| SEQ. ID. NO. 18321 | 1-MetLysHisProLys-5 |
| SEQ. ID. NO. 18322 | 38-IleGlyGlyGluArgValSer-44 |
| SEQ. ID. NO. 18323 | 51-AlaAsnGlnAspThrHis-56 |
| SEQ. ID. NO. 18324 | 61-ThrSerGlyAspIleLysLysIleArgSerAlaLys-72 |
| SEQ. ID. NO. 18325 | 82-GluAlaAlaAspIleGlnArgAlaValLysGlnSerLysValSerTyrAlaGluAlaThrLysGlyIleGln-105 |
| SEQ. ID. NO. 18326 | 107-LeuLysAlaGluGluGluGlyGlyHisHisHisAspHisAspHisAspHisAspHisGluGlyHisHisHisAspHisGlyGluTyrAsp ProHisValTrpAsnAspPro-145 |
| SEQ. ID. NO. 18327 | 159-LeuIleLysAlaAspProGluGlyLysValTyrTyr-170 |
| SEQ. ID. NO. 18328 | 180-GlnLeuLysLysLeuHisSerAspAla-188 |
| SEQ. ID. NO. 18329 | 196-ProAlaAlaLysArgLysValLeuThr-204 |
| SEQ. ID. NO. 18330 | 212-MetGlyLysArgTyrHis-217 |
| SEQ. ID. NO. 18331 | 222-AlaProGlnGlyValSerSerGluAlaGluProSerAlaLysGln-236 |
| SEQ. ID. NO. 18332 | 242-ArgGlnIleLysArgGluGlyIle-249 |
| SEQ. ID. NO. 18333 | 255-GluAsnIleLysAspThrArgMetValAspArgIleAlaLysGluThrGlyVal-272 |

TABLE 1-continued

| | |
|---|---|
| SEQ. ID. NO. 18334 | 274-ValSerGlyLysLeuTyrSer-280 |
| SEQ. ID. NO. 18335 | 286-AlaProAlaAspThr-290 |
| SEQ. ID. NO. 18336 | 295-TyrArgHisAsnIle-299 |

Hydrophilic Regions - Hopp-Woods

| | |
|---|---|
| SEQ. ID. NO. 18337 | 1-MetLysHisProLys-5 |
| SEQ. ID. NO. 18338 | 38-IleGlyGlyGluArgValSer-44 |
| SEQ. ID. NO. 18339 | 63-GlyAspIleLysLysIleArgSerAlaLys-72 |
| SEQ. ID. NO. 18340 | 82-GluAlaAlaAspIleGlnArgAlaValLysGlnSerLys-94 |
| SEQ. ID. NO. 18341 | 99-GluAlaThrLysGly-103 |
| SEQ. ID. NO. 18342 | 107-LeuLysAlaGluGluGluGlyGlyHisHisHisAspHisAspHisAspHisAspHisAspHisGluGlyHisHisHisAspHisGlyGluTyrAsp-138 |
| SEQ. ID. NO. 18343 | 159-LeuIleLysAlaAspProGluGly-166 |
| SEQ. ID. NO. 18344 | 180-GlnLeuLysLysLeuHisSerAspAla-188 |
| SEQ. ID. NO. 18345 | 196-ProAlaAlaLysArgLysValLeuThr-204 |
| SEQ. ID. NO. 18346 | 226-ValSerSerGluAlaGluProSerAlaLysGln-236 |
| SEQ. ID. NO. 18347 | 242-ArgGlnIleLysArgGluGlyIle-249 |
| SEQ. ID. NO. 18348 | 255-GluAsnIleLysAspThrArgMetValAspArgIleAlaLysGluThrGlyVal-272 | a281
AMPHI Regions - AMPHI

| | |
|---|---|
| SEQ. ID. NO. 18349 | 62-AlaAlaGlyMetLeuMetAlaLeuLeuAlaGlyLeuValSerArgPhe-77 |
| SEQ. ID. NO. 18350 | 126-LeuGlnLeuIleAlaAlaValSerThrLeuThr-136 |
| SEQ. ID. NO. 18351 | 140-LeuAlaValIleTyrArg-145 |
| SEQ. ID. NO. 18352 | 179-LeuValSerGlyPheGlnAlaLeuGlyThrLeuMetSerVal-192 |
| SEQ. ID. NO. 18353 | 205-TrpAlaLysHisMet-209 |
| SEQ. ID. NO. 18354 | 216-SerValLeuThrAlaLeuLeuCysGly-224 |

Antigenic Index - Jameson-Wolf

| | |
|---|---|
| SEQ. ID. NO. 18355 | 25-ArgArgMetSerLeu-29 |
| SEQ. ID. NO. 18356 | 78-ThrThrLeuLysGluAspAlaAsn-85 |
| SEQ. ID. NO. 18357 | 102-SerLysAsnGlySerSerVal-108 |
| SEQ. ID. NO. 18358 | 159-SerValGlyGlyLysGlyGly-165 |
| SEQ. ID. NO. 18359 | 236-IleProSerGlyPro-240 |
| SEQ. ID. NO. 18360 | 256-LeuGlyLysGluGlyGlyIle-262 |
| SEQ. ID. NO. 18361 | 266-TrpLeuLysAsnHisArgHisHisThrThr-275 |

Hydrophilic Regions - Hopp-Woods

| | |
|---|---|
| SEQ. ID. NO. 18362 | 25-ArgArgMetSerLeu-29 |
| SEQ. ID. NO. 18363 | 78-ThrThrLeuLysGluAspAlaAsn-85 |
| SEQ. ID. NO. 18364 | 103-LysAsnGlySerSer-107 |
| SEQ. ID. NO. 18365 | 256-LeuGlyLysGluGlyGlyIle-262 |
| SEQ. ID. NO. 18366 | 267-LeuLysAsnHisArgHisHisThr-274 | a282
AMPHI Regions - AMPHI

| | |
|---|---|
| SEQ. ID. NO. 18367 | 10-LeuIleValAlaPheLeuValLeuIleAsnProPheSerAlaLeu-24 |
| SEQ. ID. NO. 18368 | 50-ValPheAlaValIleAlaValPheAlaLeuIleGlyGlyThrLeu-64 |
| SEQ. ID. NO. 18369 | 111-ValArgProAlaArgAsn-116 |
| SEQ. ID. NO. 18370 | 176-ValSerArgLeuLeu-180 |
| SEQ. ID. NO. 18371 | 186-ThrIleLeuAsnArgIleMetGlyMet-194 |

Antigenic Index - Jameson-Wolf

| | |
|---|---|
| SEQ. ID. NO. 18372 | 31-ThrAsnGlyHisSerThrLysGluArgArgLysValAlaArg-44 |
| SEQ. ID. NO. 18373 | 92-AsnGlyAsnAspAsnProAlaLysGlnAsnLeuGlyAlaGlnProGluThrGlyGlnValArgProAlaArgAsnAlaGlyAla-119 |

Hydrophilic Regions - Hopp-Woods

| | |
|---|---|
| SEQ. ID. NO. 18374 | 34-HisSerThrLysGluArgArgLysValAlaArg-44 |
| SEQ. ID. NO. 18375 | 92-AsnGlyAsnAspAsnProAlaLysGlnAsnLeu-102 |
| SEQ. ID. NO. 18376 | 104-AlaGlnProGluThrGlyGlnValArgProAlaArgAsn-116 | a283
AMPHI Regions - AMPHI

| | |
|---|---|
| SEQ. ID. NO. 18377 | 11-ThrLeuAlaSerPheLeuPro-17 |
| SEQ. ID. NO. 18378 | 32-GlyGlyAsnSerTyrSerAspValProLysGlnLeuHis-44 |
| SEQ. ID. NO. 18379 | 67-AlaAspAlaGlyLysArgThr-73 |

Antigenic Index - Jameson-Wolf

| | |
|---|---|
| SEQ. ID. NO. 18380 | 28-TrpLysAspGlyGlyGlyAsnSerTyrSerAspValProLysGlnLeuHisProAspGlnSerGln-49 |
| SEQ. ID. NO. 18381 | 53-LeuArgThrArgGlnThrLysProAlaValLysProAlaGlnAlaAspAlaGlyLysArgThrAspGlyAlaAlaGlnGluAsnAsnProAspThrAlaGlu LysAsnArgGlnLeuGluGluGluLysLysArgIleAlaGluThrGluArgGlnAsnLysGluGluAsnCysArgIleSerLysMetAsnLeu-117 |
| SEQ. ID. NO. 18382 | 121-GlyAsnSerAsnAlaLysAsnLysAspAspLeuIleArgLysTyrAsnAsnAlaValAsnLysTyrCysArg-144 |

Hydrophilic Regions - Hopp-Woods

| | |
|---|---|
| SEQ. ID. NO. 18383 | 35-SerTyrSerAspValProLys-41 |
| SEQ. ID. NO. 18384 | 43-LeuHisProAspGlnSerGln-49 |

(SEQ. ID. NO. 18381)
53-LeuArgThrArgGlnThrLysProAlaValLysProAlaGlnAlaAspAlaGlyLysArgThrAspGlyAlaAlaGlnGluAsnAsnProAspThrAlaGl
uLysAsnArgGlnLeuGluGluGluLysLysArgIleAlaGluThrGluArgGlnAsnLysGluGluAsnCysArgIleSerLysMetAsnLeu-117

| | |
|---|---|
| SEQ. ID. NO. 18385 | 123-SerAsnAlaLysAsnLysAspAspLeuIleArgLysTyrAsn-136 | a284
AMPHI Regions - AMPHI

| | |
|---|---|
| SEQ. ID. NO. 18386 | 43-GluAlaPheAlaGlyPhePheGluThrVal-52 |
| SEQ. ID. NO. 18387 | 61-ThrPheAlaAlaArgPhe-66 |
| SEQ. ID. NO. 18388 | 125-ValAspPheAspValPhe-130 |
| SEQ. ID. NO. 18389 | 154-ValValPheArgLeuPheArgGlnValValValAsp-165 |
| SEQ. ID. NO. 18390 | 174-AspThrAlaCysGlyAsnValGlyGly-182 |
| SEQ. ID. NO. 18391 | 187-AlaAlaAlaPheAlaGlnIleHisGln-195 |
| SEQ. ID. NO. 18392 | 216-PheValGlnPheIleArgAspAspPheGlyHisGly-227 |
| SEQ. ID. NO. 18393 | 277-PheArgValPheGlyGlnPheAlaArgGlnPheAla-288 |
| SEQ. ID. NO. 18394 | 304-PheArgArgGlyPheAspAspGlyPheAspValValAspLys-317 |

TABLE 1-continued

| | |
|---|---|
| SEQ. ID. NO. 18395 | 340-AlaAlaLeuHisGlnValHisGlnThrAla-349 |
| SEQ. ID. NO. 18396 | 352-GlyAspAsnGlnIleAspArgPheAlaGln-361 |
| SEQ. ID. NO. 18397 | 407-AlaArgAlaPheAlaArgPhePheAlaAlaPheGlyGlnSerLeuGlnSer-423 |

Antigenic Index - Jameson-Wolf

| | |
|---|---|
| SEQ. ID. NO. 18398 | 1-MetProSerGluThrArgAsnArgPhe-9 |
| SEQ. ID. NO. 18399 | 109-PheAspGlyGlnPhe-113 |
| SEQ. ID. NO. 18400 | 132-HisPheGlyLysArgAsnArgAsnThrArgAla-142 |
| SEQ. ID. NO. 18401 | 147-GlyAlaProAspAlaVal-152 |
| SEQ. ID. NO. 18402 | 166-AsnValGlyAsnGlyArgTyrValAspThrAlaCysGlyAsnValGlyGlyAsnGlnAsn-185 |
| SEQ. ID. NO. 18403 | 209-AlaValGlyGlyGlu-213 |
| SEQ. ID. NO. 18404 | 219-PheIleArgAspAspPheGlyHisGlyPheGlyGlyArgGluAsnHisAla-235 |
| SEQ. ID. NO. 18405 | 273-AspPheAspAspPheArg-278 |
| SEQ. ID. NO. 18406 | 286-GlnPheAlaAspArgAlaValProSerGlyGlyGluGlnGlnSer-300 |
| SEQ. ID. NO. 18407 | 303-ValPheArgArgGlyPheAspAspGlyPheAspValValAspLysAlaHis-319 |
| SEQ. ID. NO. 18408 | 347-GlnThrAlaArgArgGlyAspAsnGlnIleAspArgPheAla-360 |
| SEQ. ID. NO. 18409 | 362-GlyAlaGlyLeuValAlaGluArgCysThrThrAspAspAlaAspGlyThrGluProThr-381 |
| SEQ. ID. NO. 18410 | 398-PheAlaGlyArgArgGlnHisGlnArgAlaArgAla-409 |
| SEQ. ID. NO. 18411 | 419-GlnSerLeuGlnSerArg-424 |

Hydrophilic Regions - Hopp-Woods

| | |
|---|---|
| SEQ. ID. NO. 18412 | 1-MetProSerGluThrArgAsnArgPhe-9 |
| SEQ. ID. NO. 18413 | 134-GlyLysArgAsnArgAsnThrArgAla-142 |
| SEQ. ID. NO. 18414 | 220-IleArgAspAspPheGly-225 |
| SEQ. ID. NO. 18415 | 229-GlyArgGluAsnHisAla-235 |
| SEQ. ID. NO. 18416 | 286-GlnPheAlaAspArgAlaValProSerGlyGlyGluGlnGln-299 |
| SEQ. ID. NO. 18417 | 306-ArgGlyPheAspAspGlyPheAspValValAspLysAlaHis-319 |
| SEQ. ID. NO. 18418 | 347-GlnThrAlaArgArgGlyAspAsnGlnIleAspArgPheAla-360 |
| SEQ. ID. NO. 18419 | 366-ValAlaGluArgCysThrThrAspAspAlaAspGlyThrGlu-379 |
| SEQ. ID. NO. 18420 | 398-PheAlaGlyArgArgGlnHisGlnArgAlaArgAla-409 | a285-1

AMPHI Regions - AMPHI

| | |
|---|---|
| SEQ. ID. NO. 18421 | 15-ValCysPheLeuGly-19 |
| SEQ. ID. NO. 18422 | 34-GlnIleProSerTrp-38 |
| SEQ. ID. NO. 18423 | 50-GlyThrLeuLeuAspGlyPheAsp-57 |
| SEQ. ID. NO. 18424 | 116-SerLeuProAspSerIleAspLeuPro-124 |
| SEQ. ID. NO. 18425 | 208-HisSerThrAlaArg-212 |
| SEQ. ID. NO. 18426 | 240-HisProPheAlaGluSerLeuAspLysThrLeuGluGluValLeu-254 |
| SEQ. ID. NO. 18427 | 266-ValProSerLeuPro-270 |
| SEQ. ID. NO. 18428 | 280-AlaIleProSerPheSerAsp-286 |
| SEQ. ID. NO. 18429 | 313-GlnValLeuGlySer-317 |
| SEQ. ID. NO. 18430 | 592-IleGlyLysAlaAlaAspIle-598 |
| SEQ. ID. NO. 18431 | 609-ProAspThrSerArg-613 |
| SEQ. ID. NO. 18432 | 629-GlyAlaGluValValAsp-634 |
| SEQ. ID. NO. 18433 | 671-GlyIleAsnArgGluLeuThrArgTrp-679 |
| SEQ. ID. NO. 18434 | 747-IleAlaGluLeuHisAsnPhePheLysProProPhe-758 |
| SEQ. ID. NO. 18435 | 776-AlaArgGlyTyrLeu-780 |
| SEQ. ID. NO. 18436 | 836-PheGlyGlyAsnMetAlaAsn-842 |
| SEQ. ID. NO. 18437 | 848-ArgIleThrAlaSerLeuProAspLeuGlyThrLeu-859 |
| SEQ. ID. NO. 18438 | 868-GlnAsnIleThrGlySerLeuAsnAlaAla-877 |
| SEQ. ID. NO. 18439 | 955-GlySerIleAlaAsp-959 |
| SEQ. ID. NO. 18440 | 1008-ThrAlaGluLeuSer-1012 |
| SEQ. ID. NO. 18441 | 1061-ValThrGlyMetIleLys-1066 |
| SEQ. ID. NO. 18442 | 1135-SerGlyGlySerValArgGlyValGlyThrValArg-1146 |
| SEQ. ID. NO. 18443 | 1165-ThrValSerPheValGlyProLeuAsn-1173 |
| SEQ. ID. NO. 18444 | 1190-AlaGlyValGluIleLeuGlySerLeuAsn-1199 |
| SEQ. ID. NO. 18445 | 1244-LeuAlaGlyGlnIle-1248 |
| SEQ. ID. NO. 18446 | 1305-ValLysLeuIleTyrArgLeuThrArgAlaIleGlnAlaValAlaArgIleGlySer-1323 |

Antigenic Index - Jameson-Wolf

| | |
|---|---|
| SEQ. ID. NO. 18447 | 43-IleSerSerGlnAsnLeuLysGlyThrLeuLeuAspGlyPheAspGlyAspAsnTrpSerIleGluThrGluGlyAlaAspLeuLysIleSerArg-74 |
| SEQ. ID. NO. 18448 | 80-LysProSerGluLeuMetArgArgSerLeuHis-90 |
| SEQ. ID. NO. 18449 | 104-LysProThrProProLysGluGluArgProProLeuSerLeuProAspSerIleAsp-122 |
| SEQ. ID. NO. 18450 | 130-AspArgPheGluThrGlyLysIleSerMetGlyLysAlaPheAspLysGlnThrValTyr-149 |
| SEQ. ID. NO. 18451 | 151-GluArgLeuAspAlaSerTyrArgTyrAspArgLysGlyHisArgLeuAspLeuLysAlaAlaAspThrProTrpSerSerSerSerGlySerAla-182 |
| SEQ. ID. NO. 18452 | 185-GlyLeuLysLysProPheAla-191 |
| SEQ. ID. NO. 18453 | 198-ThrLysGlyGlyLeuGluGlyLysThrIle-207 |
| SEQ. ID. NO. 18454 | 209-SerThrAlaArgLeuSerGlySerLeuLysAspValArgAla-222 |
| SEQ. ID. NO. 18455 | 224-LeuAlaIleAspGlyGlyAsnIleArgLeuSerGlyLysSer-237 |
| SEQ. ID. NO. 18456 | 244-GluSerLeuAspLysThrLeuGlu-251 |
| SEQ. ID. NO. 18457 | 268-SerLeuProAspAla-272 |
| SEQ. ID. NO. 18458 | 292-GlySerLeuAspLeuGluAsnThrLys-300 |
| SEQ. ID. NO. 18459 | 302-GlyPheAlaAspArgAsnGlyIleProVal-311 |
| SEQ. ID. NO. 18460 | 320-IleArgGlnAspGlyThrValHis-327 |
| SEQ. ID. NO. 18461 | 337-GlyArgGlyGlyIleArgLeuSerGlyLysIleAspThrGluLysAspIleLeu-354 |
| SEQ. ID. NO. 18462 | 362-SerValGlyAlaGluAspValLeu-369 |
| SEQ. ID. NO. 18463 | 372-AlaPheLysGlyArgLeuAspGlySerIle-381 |
| SEQ. ID. NO. 18464 | 387-ThrAlaSerProLysIle-392 |
| SEQ. ID. NO. 18465 | 400-ThrAlaArgThrAspGlySerLeu-407 |
| SEQ. ID. NO. 18466 | 411-SerAspProAlaAsnGlyGlnArgLysLeuVal-421 |
| SEQ. ID. NO. 18467 | 430-GlyGlnGlySerLeuThr-435 |
| SEQ. ID. NO. 18468 | 442-LeuPheLysAspArgLeuLeuLysLeuAspIleArgSerArgAlaPheAspProSerArgIleAspProGlnLeu-466 |
| SEQ. ID. NO. 18469 | 480-GluLeuAlaLysGluLysPheThrGlyLys-489 |

TABLE 1-continued

| | |
|---|---|
| SEQ. ID. NO. 18470 | 508-IleValTyrGluSerArgHisLeuProArgAlaAlaVal-520 |
| SEQ. ID. NO. 18471 | 522-LeuArgLeuGlyArgAsnIleIleLysThrAspGlyGlyPheGlyLysLysGlyAspArgLeuAsn-543 |
| SEQ. ID. NO. 18472 | 548-AlaProAspLeuSerArgPheGly-555 |
| SEQ. ID. NO. 18473 | 563-AsnValArgGlyHisLeuSerGlyAspLeuAspGlyGlyIleArgThrPheGluThrAspLeuSerGlyAlaAla-587 |
| SEQ. ID. NO. 18474 | 594-LysAlaAlaAspIleArgSer-600 |
| SEQ. ID. NO. 18475 | 605-LeuLysGlySerProAspThrSerArgProIleArgAlaAspIleLysGlySerArgLeuSerLeuSerGlyGlyAlaGluValValAspThrAlaAspLeuMetLeuAspGlyThrGlyVal-645 |
| SEQ. ID. NO. 18476 | 647-HisArgIleArgThr-651 |
| SEQ. ID. NO. 18477 | 656-ThrLeuAspGlyLysProPheLysPheAspLeuAspAlaSerGlyGlyIleAsnArgGluLeuThrArgTrpLysGlySerIle-683 |
| SEQ. ID. NO. 18478 | 696-LeuGlnAsnArgMetThrLeu-702 |
| SEQ. ID. NO. 18479 | 704-AlaGlyAlaGluArgValAla-710 |
| SEQ. ID. NO. 18480 | 729-SerTrpAspLysLysThrGlyIleSerAlaLysGlyGlyAla-742 |
| SEQ. ID. NO. 18481 | 764-LeuAsnGlyAspTrp-768 |
| SEQ. ID. NO. 18482 | 772-TyrGlyArgAsnAlaArgGly-778 |
| SEQ. ID. NO. 18483 | 782-IleSerArgGlnSerGlyAspAlaValLeu-791 |
| SEQ. ID. NO. 18484 | 803-SerLeuLysThrArgPheGlnAsnAspArgIleGly-814 |
| SEQ. ID. NO. 18485 | 817-LeuAspGlyGlyAlaArgPheGlyArgIleAsnAlaAspLeuAspIle-832 |
| SEQ. ID. NO. 18486 | 844-ProLeuGlyGlyArgIleThr-850 |
| SEQ. ID. NO. 18487 | 882-GlyArgValGlySerProSerVal-889 |
| SEQ. ID. NO. 18488 | 893-ValAsnGlySerSerAsnTyrGlyLysIleAsnGly-904 |
| SEQ. ID. NO. 18489 | 908-ValGlyGlnSerArgSerPheAspThrAlaProLeuGlyGlyArgLeuAsn-924 |
| SEQ. ID. NO. 18490 | 941-GlnThrValLysGlySerLeu-947 |
| SEQ. ID. NO. 18491 | 956-SerIleAlaAspProHisLeuGlyGly-964 |
| SEQ. ID. NO. 18492 | 966-IleAsnGlyAspLysLeuTyrTyrArgAsnGlnThr-977 |
| SEQ. ID. NO. 18493 | 982-LeuAspAsnGlySerLeuArg-988 |
| SEQ. ID. NO. 18494 | 991-IleAlaGlyArgLysTrpVal-997 |
| SEQ. ID. NO. 18495 | 1001-LeuLysPheArgHisGluGlyThrAlaGluLeuSerGly-1013 |
| SEQ. ID. NO. 18496 | 1015-ValGlyMetGluAsnSerGlyProAspValAspIle-1026 |
| SEQ. ID. NO. 18497 | 1031-AspLysTyrArgIleLeuSerArgProAsnArgArgLeuThr-1044 |
| SEQ. ID. NO. 18498 | 1047-GlyAsnThrArgLeuArgTyrSerProGlnLysGlyIle-1059 |
| SEQ. ID. NO. 18499 | 1065-IleLysThrAspGlnGlyLeuPheGlySerGlnLysSerSerMetProSerValGlyAspAspVal-1086 |
| SEQ. ID. NO. 18500 | 1091-GluValLysLysGluAlaAla-1097 |
| SEQ. ID. NO. 18501 | 1109-AspLeuAsnAspGlyIleArg-1115 |
| SEQ. ID. NO. 18502 | 1134-GlnSerGlyGlySerValArgGlyValGly-1143 |
| SEQ. ID. NO. 18503 | 1146-ArgValIleLysGlyArgTyrLysAlaTyrGlyGlnAspLeuAspIleThrLysGlyThr-1165 |
| SEQ. ID. NO. 18504 | 1171-ProLeuAsnAspProAsnLeuAsnIleArgAlaGluArgArgLeuSerProValGly-1189 |
| SEQ. ID. NO. 18505 | 1197-SerLeuAsnSerProArgIle-1203 |
| SEQ. ID. NO. 18506 | 1207-AlaAsnGluProMetSerGluLysAspLeu-1217 |
| SEQ. ID. NO. 18507 | 1225-AlaGlySerGlySerSerGlyAspAsnAlaAla-1235 |
| SEQ. ID. NO. 18508 | 1246-GlyGlnIleAsnAspArgIleGlyLeu-1254 |
| SEQ. ID. NO. 18509 | 1256-AspAspLeuGlyPheThrSerLysArgSerArgAsnAlaGlnThrGlyGluLeuAsnProAlaGlu-1277 |
| SEQ. ID. NO. 18510 | 1283-GlyLysGlnLeuThrGlyLys-1289 |
| SEQ. ID. NO. 18511 | 1299-SerSerAlaGluGlnSerVal-1305 |
| SEQ. ID. NO. 18512 | 1321-IleGlySerArgSerSerGlyGlyGluLeu-1330 |
| SEQ. ID. NO. 18513 | 1335-ArgPheAspArgPheSerGlySerAspLysLysAspSerAlaGlyAsnSerLysGlyLys-1354 |
| Hydrophilic Regions - Hopp-Woods | |
| SEQ. ID. NO. 18514 | 56-PheAspGlyAspAsnTrpSerIleGluThrGluGlyAlaAspLeuLysIleSerArg-74 |
| SEQ. ID. NO. 18515 | 83-GluLeuMetArgArgSerLeuHis-90 |
| SEQ. ID. NO. 18516 | 105-ProThrProProLysGluGluArgProPro-114 |
| SEQ. ID. NO. 18517 | 130-AspArgPheGluThrGlyLys-136 |
| SEQ. ID. NO. 18518 | 141-LysAlaPheAspLys-145 |
| SEQ. ID. NO. 18519 | 151-GluArgLeuAspAla-155 |
| SEQ. ID. NO. 18520 | 157-TyrArgTyrAspArgLysGlyHisArgLeuAspLeuLysAlaAlaAsp-172 |
| SEQ. ID. NO. 18521 | 200-GlyGlyLeuGluGlyLysThrIle-207 |
| SEQ. ID. NO. 18522 | 215-GlySerLeuLysAspValArgAla-222 |
| SEQ. ID. NO. 18523 | 244-GluSerLeuAspLysThrLeuGlu-251 |
| SEQ. ID. NO. 18524 | 292-GlySerLeuAspLeuGluAsnThrLys-300 |
| SEQ. ID. NO. 18525 | 302-GlyPheAlaAlaArgAsnGlyIlePro-310 |
| SEQ. ID. NO. 18526 | 320-IleArgGlnAspGly-324 |
| SEQ. ID. NO. 18527 | 343-LeuSerGlyLysIleAspThrGluLysAspIleLeu-354 |
| SEQ. ID. NO. 18528 | 364-GlyAlaGluAspValLeu-369 |
| SEQ. ID. NO. 18529 | 373-PheLysGlyArgLeuAspGly-379 |
| SEQ. ID. NO. 18530 | 401-AlaArgThrAspGly-405 |
| SEQ. ID. NO. 18531 | 412-AspProAlaAsnGlyGlnArgLysLeuVal-421 |
| SEQ. ID. NO. 18532 | 442-LeuPheLysAspArgLeuLeuLysLeuAspIleArgSerArgAlaPheAspProSerArgIleAspPro-464 |
| SEQ. ID. NO. 18533 | 480-GluLeuAlaLysGluLysPheThrGly-488 |
| SEQ. ID. NO. 18534 | 508-IleValTyrGluSerArgHisLeuPro-516 |
| SEQ. ID. NO. 18535 | 522-LeuArgLeuGlyArgAsnIleIleLysThrAspGlyGlyPheGlyLysLysGlyAspArgLeuAsn-543 |
| SEQ. ID. NO. 18536 | 570-GlyAspLeuAspGlyGlyIleArgThrPheGluThrAspLeuSerGlyAlaAla-587 |
| SEQ. ID. NO. 18537 | 594-LysAlaAlaAspIleArgSer-600 |
| SEQ. ID. NO. 18538 | 607-GlySerProAspThrSerArgProIleArgAlaAspIleLysGlySerArgLeuSerLeu-626 |
| SEQ. ID. NO. 18539 | 631-GluValValAspThrAlaAspLeuMetLeu-640 |
| SEQ. ID. NO. 18540 | 647-HisArgIleArgThr-651 |
| SEQ. ID. NO. 18541 | 657-LeuAspGlyLysProPheLysPheAspLeuAspAla-668 |
| SEQ. ID. NO. 18542 | 670-GlyGlyIleAsnArgGluLeuThrArgTrpLysGly-681 |
| SEQ. ID. NO. 18543 | 704-AlaGlyAlaGluArgValAla-710 |
| SEQ. ID. NO. 18544 | 729-SerTrpAspLysLysThrGlyIleSerAlaLysGlyGlyAla-742 |
| SEQ. ID. NO. 18545 | 783-SerArgGlnSerGly-787 |
| SEQ. ID. NO. 18546 | 806-ThrArgPheGlnAsnAspArgIle-813 |
| SEQ. ID. NO. 18547 | 819-GlyGlyAlaArgPheGlyArgIleAsnAlaAspLeuAspIle-832 |

TABLE 1-continued

| SEQ. ID. NO. | Sequence |
|---|---|
| SEQ. ID. NO. 18548 | 1001-LeuLysPheArgHisGluGlyThrAlaGluLeu-1011 |
| SEQ. ID. NO. 18549 | 1017-MetGluAsnSerGlyProAspValAspIle-1026 |
| SEQ. ID. NO. 18550 | 1031-AspLysTyrArgIleLeuSerArgProAsnArgLeuThr-1044 |
| SEQ. ID. NO. 18551 | 1049-ThrArgLeuArgTyrSerPro-1055 |
| SEQ. ID. NO. 18552 | 1065-IleLysThrAspGln-1069 |
| SEQ. ID. NO. 18553 | 1075-GlnLysSerSerMet-1079 |
| SEQ. ID. NO. 18554 | 1091-GluValLysLysGluAlaAla-1097 |
| SEQ. ID. NO. 18555 | 1109-AspLeuAsnAspGlyIleArg-1115 |
| SEQ. ID. NO. 18556 | 1146-ArgValIleLysGlyArgTyrLysAlaTyrGlyGlnAspLeuAspIleThrLys-1163 |
| SEQ. ID. NO. 18557 | 1179-IleArgAlaGluArgArgLeuSer-1186 |
| SEQ. ID. NO. 18558 | 1209-GluProMetSerGluLysAspLysLeu-1217 |
| SEQ. ID. NO. 18559 | 1225-AlaGlySerGlySerSerGlyAspAsnAlaAla-1235 |
| SEQ. ID. NO. 18560 | 1248-IleAsnAspArgIleGlyLeu-1254 |
| SEQ. ID. NO. 18561 | 1259-GlyPheThrSerLysArgSerArgAsnAlaGlnThrGlyGluLeuAsnPro-1275 |
| SEQ. ID. NO. 18562 | 1300-SerAlaGluGlnSerVal-1305 |
| SEQ. ID. NO. 18563 | 1321-IleGlySerArgSerSerGlyGly-1328 |
| SEQ. ID. NO. 18564 | 1335-ArgPheAspArgPheSerGlySerAspLysLysAspSerAlaGlyAsnSerLysGlyLys-1354 | a286
AMPHI Regions - AMPHI

| SEQ. ID. NO. | Sequence |
|---|---|
| SEQ. ID. NO. 18565 | 69-GluIleLysAspMetVal-74 |
| SEQ. ID. NO. 18566 | 102-ProAspAsnValLysThr-107 |
| SEQ. ID. NO. 18567 | 145-ValAlaIleLeuGlyAsp-150 |
| SEQ. ID. NO. 18568 | 157-LeuAlaGluTyrTyrArgAsnAlaLeuGluAsnTrpGlnGlnProValGlySer-174 |
| SEQ. ID. NO. 18569 | 198-ProLeuAlaLysLeuGlyAsn-204 |
| SEQ. ID. NO. 18570 | 238-ThrGlnArgTyrProGluGlnIleValSerGlyLeuAlaArgPheGlnProGlyThr-256 |
| SEQ. ID. NO. 18571 | 326-AspTyrTyrAsnLeuPheAsnLys-333 |
| SEQ. ID. NO. 18572 | 354-11eSerGlnProArg-358 |
| SEQ. ID. NO. 18573 | 375-ThrThrGlnAsnLeu-379 |
| SEQ. ID. NO. 18574 | 428-ThrAlaSerTrpLysArgGlnLeuLeu-436 |
| SEQ. ID. NO. 18575 | 455-ThrLeuGlyAlaPhe-459 |
| SEQ. ID. NO. 18576 | 513-GlyAlaSerSerVal-517 |
| SEQ. ID. NO. 18577 | 555-LeuSerGlyAlaValPheHisAspMetGlyAspAlaAlaAlaAsn-569 |
| SEQ. ID. NO. 18578 | 584-ArgTrpPheSerProLeu-589 |

Antigenic Index - Jameson-Wolf

| SEQ. ID. NO. | Sequence |
|---|---|
| SEQ. ID. NO. 18579 | 1-MetHisAspThrArgThrMetMet-8 |
| SEQ. ID. NO. 18580 | 30-AlaAspLeuSerGluAsnLysAla-37 |
| SEQ. ID. NO. 18581 | 43-PheLysAsnLysSerProAspThrGluSerValLysLeuLysProLysPheProVal-61 |
| SEQ. ID. NO. 18582 | 63-IleAspThrGlnAspSerGluIleLysAspMetValGluGluHisLeu-78 |
| SEQ. ID. NO. 18583 | 83-GlnGlnGlnGluGluValLeuAspLysGluGlnThr-94 |
| SEQ. ID. NO. 18584 | 97-LeuAlaGluGluAlaProAspAsnValLysThrMetLeuArgSerLysGlyTyrPheSerSerLysValSerLeuThrGluLysAspGlyAla-127 |
| SEQ. ID. NO. 18585 | 133-ThrProGlyProArgThrLysIle-140 |
| SEQ. ID. NO. 18586 | 151-IleLeuSerAspGlyAsnLeuAlaGluTyrTyrArgAsnAlaLeuGluAsnTrpGln-169 |
| SEQ. ID. NO. 18587 | 172-ValGlySerAspPheAspGlnAspSerTrpGluAsnSerLysThrSerVal-188 |
| SEQ. ID. NO. 18588 | 192-ValThrArgLysAlaTyrPro-198 |
| SEQ. ID. NO. 18589 | 201-LysLeuGlyAsnThrArgAlaAlaValAsnProAspThrAlaThrAla-216 |
| SEQ. ID. NO. 18590 | 223-AspSerGlyArgProIleAla-229 |
| SEQ. ID. NO. 18591 | 234-GluIleThrGlyThrGlnArgTyrProGluGlnIle-245 |
| SEQ. ID. NO. 18592 | 252-PheGlnProGlyThrProTyrAspLeu-260 |
| SEQ. ID. NO. 18593 | 270-LeuGluGlnAsnGlyHisTyrSerGly-278 |
| SEQ. ID. NO. 18594 | 283-AlaAspPheAspArgLeuGlnGlyAspArgValProVal-295 |
| SEQ. ID. NO. 18595 | 298-SerValThrGluValLysArgHisLysLeuGluThrGlyIleArgLeuAspSerGluTyrGlyLeuGlyGly-321 |
| SEQ. ID. NO. 18596 | 342-AspMetAspLysTyrGluThr-348 |
| SEQ. ID. NO. 18597 | 355-SerGlnProArgAsnTyrArgGlyAsnTyrTrp-365 |
| SEQ. ID. NO. 18598 | 368-AsnValSerTyrAsnArgSerThrThrGlnAsnLeuGluLysArgAlaPheSerGlyGly-387 |
| SEQ. ID. NO. 18599 | 391-ValArgAspArgAlaGlyIleAspAlaArgLeuGly-402 |
| SEQ. ID. NO. 18600 | 405-PheLeuAlaGluGlyArgLysIleProGlySerAspIleAspLeuGlyAsnSerHisAla-424 |
| SEQ. ID. NO. 18601 | 430-SerTrpLysArgGlnLeu-435 |
| SEQ. ID. NO. 18602 | 441-HisProGluAsnGlyHisTyrLeuAspGlyLysIle-452 |
| SEQ. ID. NO. 18603 | 468-ThrSerAlaArgAlaGly-473 |
| SEQ. ID. NO. 18604 | 476-PheThrProGluAsnLysLysLeu-483 |
| SEQ. ID. NO. 18605 | 496-ValAlaArgAspAsnAlaAsnValPro-504 |
| SEQ. ID. NO. 18606 | 509-PheArgSerGlyGlyAlaSerSerValArgGlyTyrGluLeuAspSer-524 |
| SEQ. ID. NO. 18607 | 534-ValLeuProGluArgAlaLeu-540 |
| SEQ. ID. NO. 18608 | 562-AspMetGlyAspAla-566 |
| SEQ. ID. NO. 18609 | 568-AlaAsnPheLysArgMetLysLeuLysHisGlySerGlyLeu-581 |
| SEQ. ID. NO. 18610 | 598-TyrGlyHisSerAspLysLysIleArg-606 |

Hydrophilic Regions - Hopp-Woods

| SEQ. ID. NO. | Sequence |
|---|---|
| SEQ. ID. NO. 18611 | 1-MetHisAspThrArgThrMetMet-8 |
| SEQ. ID. NO. 18612 | 30-AlaAspLeuSerGluAsnLysAla-37 |
| SEQ. ID. NO. 18613 | 44-LysAsnLysSerProAspThrGluSerValLysLeuLysProLysPheProVal-61 |
| SEQ. ID. NO. 18614 | 63-IleAspThrGlnAspSerGluIleLysAspMetValGluGluHisLeu-78 |
| SEQ. ID. NO. 18615 | 84-GlnGlnGluGluValLeuAspLysGluGlnThr-94 |
| SEQ. ID. NO. 18616 | 97-LeuAlaGluGluAlaProAspAsnValLysThrMetLeuArgSer-111 |
| SEQ. ID. NO. 18617 | 119-ValSerLeuThrGluLysAspGlyAla-127 |
| SEQ. ID. NO. 18618 | 134-ProGlyProArgThrLysIle-140 |
| SEQ. ID. NO. 18619 | 174-SerAspPheAspGlnAspSerTrpGluAsnSerLysThr-186 |
| SEQ. ID. NO. 18620 | 192-ValThrArgLysAlaTyrPro-198 |
| SEQ. ID. NO. 18621 | 206-ArgAlaAlaValAsnProAspThrAlaThr-215 |
| SEQ. ID. NO. 18622 | 239-GlnArgTyrProGlu-243 |
| SEQ. ID. NO. 18623 | 283-AlaAspPheAspArgLeuGlnGlyAspArgValProVal-295 |

TABLE 1-continued

| | |
|---|---|
| SEQ. ID. NO. 18624 | 298-SerValThrGluValLysArgHisLysLeuGluThrGlyIleArgLeuAspSerGluTyr-317 |
| SEQ. ID. NO. 18625 | 342-AspMetAspLysTyrGluThr-348 |
| SEQ. ID. NO. 18626 | 373-ArgSerThrThrGlnAsnLeuGluLysArgAlaPhe-384 |
| SEQ. ID. NO. 18627 | 392-ArgAspArgAlaGlyIleAspAlaArgLeuGly-402 |
| SEQ. ID. NO. 18628 | 405-PheLeuAlaGluGlyArgLysIleProGlySerAspIleAspLeu-419 |
| SEQ. ID. NO. 18629 | 478-ProGluAsnLysLysLeu-483 |
| SEQ. ID. NO. 18630 | 496-ValAlaArgAspAsnAlaAsn-502 |
| SEQ. ID. NO. 18631 | 518-ArgGlyTyrGluLeuAspSer-524 |
| SEQ. ID. NO. 18632 | 534-ValLeuProGluArgAlaLeu-540 |
| SEQ. ID. NO. 18633 | 562-AspMetGlyAspAla-566 |
| SEQ. ID. NO. 18634 | 568-AlaAsnPheLysArgMetLysLeuLysHis-577 |
| SEQ. ID. NO. 18635 | 600-HisSerAspLysLysIleArg-606 | a287
AMPHI Regions - AMPHI

| | |
|---|---|
| SEQ. ID. NO. 18636 | 29-LysSerAlaAspThrLeuSerLysProAlaAla-39 |
| SEQ. ID. NO. 18637 | 77-GlyGlyGlnAspMet-81 |
| SEQ. ID. NO. 18638 | 109-AsnAspMetProGlnAsn-114 |
| SEQ. ID. NO. 18639 | 131-MetProThrArgAspMetGlyAsnGlnAlaProAspAlaGlyGluSerAlaGlnProAlaAsnGlnProAspMetAlaAsnAlaAlaAspGlyMet-162 |
| SEQ. ID. NO. 18640 | 171-GluAsnAlaGlyAsnThrAlaAspGlnAlaAlaAsnGlnAlaGluAsn-186 |
| SEQ. ID. NO. 18641 | 192-SerGlnAsnProAla-196 |
| SEQ. ID. NO. 18642 | 206-GlyGlySerAspPhe-210 |
| SEQ. ID. NO. 18643 | 213-IleAsnValAlaAsnGly-218 |
| SEQ. ID. NO. 18644 | 256-LeuSerAspGluGluLysIleAsnLysTyrLysLys-267 |
| SEQ. ID. NO. 18645 | 306-PheArgArgSerAlaArg-311 |
| SEQ. ID. NO. 18646 | 419-LysSerValAspGlyIleIleAspSer-427 |
| SEQ. ID. NO. 18647 | 447-PheLysGlyThrTrpThr-452 |
| SEQ. ID. NO. 18648 | 459-ValSerGlyArgPheTyr-464 |

Antigenic Index - Jameson-Wolf

| | |
|---|---|
| SEQ. ID. NO. 18649 | 17-AlaCysGlyGlyGlyGlyGlyGlySerProAspValLysSerAlaAspThrLeuSerLysProAla-38 |
| SEQ. ID. NO. 18650 | 42-ValThrGluAspValGlyGluGluValLeuProLysGluLysLysAspGluGluAlaValSerGlyAlaProGlnAlaAspThrGlnAspAlaThrAla GlyLysGlyGlyGlnAspMet-81 |
| SEQ. ID. NO. 18651 | 85-SerAlaGluAsnThrGlyAsnGlyGlyAlaAlaThrThrAspAsnProGluAsnLysAspGluGlyProGlnAsnAspMetProGlnAsnAlaAlaAsp ThrAspSerSerThrProAsnHisThrProAlaProAsnMetProThrArgAspMetGlyAsnGlnAlaProAspAlaGlyGluSerAlaGlnProAlaAsn GlnProAspMetAlaAsnAlaAlaAspGlyMetGlnGlyAspAspProSerAlaGlyGluAsnAlaGlyAsnThrAlaAspGlnAlaAlaAsnGlnAlaGlu AsnAsnGlnValGlyGlySerGlnAsnProAlaSerSerThrAsnProAsnAlaThrAsnGlyGlySerAspPheGlyArg-212 |
| SEQ. ID. NO. 18652 | 214-AsnValAlaAsnGlyIleLysLeuAspSerGlySerGluAsnVal-228 |
| SEQ. ID. NO. 18653 | 232-HisCysLysAspLysValCysAspArgAspPheLeuAspGluGluAlaProProLysSerGluPheGluLysLeuSerAspGluGluLysIleAsnLys TyrLysLysAspGluGlnArgGluAsnPhe-274 |
| SEQ. ID. NO. 18654 | 278-ValAlaAspArgValGluLysAsnGlyThrAsnLys-289 |
| SEQ. ID. NO. 18655 | 293-IleTyrLysAspLysSerAlaSerSerSerSerAlaArgPheArgArgSerAlaArgSerArgArgSerLeuProAla-318 |
| SEQ. ID. NO. 18656 | 332-IleValAspGlyGluAla-337 |
| SEQ. ID. NO. 18657 | 342-GlyHisSerGlyAsn-346 |
| SEQ. ID. NO. 18658 | 349-AlaProGluGlyAsnTyrArgTyrLeu-357 |
| SEQ. ID. NO. 18659 | 360-GlyAlaGluLysLeuSerGlyGlySer-368 |
| SEQ. ID. NO. 18660 | 374-GlnGlyGluProAlaLysGlyGluMet-382 |
| SEQ. ID. NO. 18661 | 397-HisMetGluAsnGlyArgProSerProSerGlyGlyArgPheAlaAla-412 |
| SEQ. ID. NO. 18662 | 414-ValAspPheGlySerLysSerValAspGlyIleIleAspSerGlyAspAspLeuHisMetGlyThrGlnLysPhe-438 |
| SEQ. ID. NO. 18663 | 442-IleAspGlyAsnGlyPheLysGlyThrTrpThrGluAsnGlyGlyGlyAspValSerGly-461 |
| SEQ. ID. NO. 18664 | 463-PheTyrGlyProAlaGlyGluGluValAlaGlyLysTyrSerTyrArgProThrAspAlaGluLysGlyGlyPhe-487 |
| SEQ. ID. NO. 18665 | 491-AlaGlyLysLysGluGlnAsp-497 |

Hydrophilic Regions - Hopp-Woods

| | |
|---|---|
| SEQ. ID. NO. 18666 | 22-GlyGlySerProAspValLysSerAlaAspThrLeuSerLysProAla-38 |
| SEQ. ID. NO. 18667 | 42-ValThrGluAspValGlyGluGluValLeuProLysGluLysLysAspGluGluAlaValSer-62 |
| SEQ. ID. NO. 18668 | 65-ProGlnAlaAspThrGlnAspAlaThrAlaGlyLysGlyGlyGlnAsp-80 |
| SEQ. ID. NO. 18669 | 85-SerAlaGluAsnThrGly-90 |
| SEQ. ID. NO. 18670 | 95-AlaThrThrAspAsnProGluAsnLysAspGluGlyProGlnAsnAspMetProGlnAsnAlaAlaAspThrAspSerSerThr-122 |
| SEQ. ID. NO. 18671 | 131-MetProThrArgAspMetGlyAsnGlnAlaProAspAlaGlyGluSerAlaGln-148 |
| SEQ. ID. NO. 18672 | 151-AsnGlnProAspMetAlaAsnAlaAlaAspGlyMetGlnGlyAspAspProSerAlaGlyGluAsnAlaGlyAsnThrAlaAspGlnAlaAlaAsnGln AlaGluAsnAsnGln-188 |
| SEQ. ID. NO. 18673 | 193-GlnAsnProAlaSer-197 |
| SEQ. ID. NO. 18674 | 206-GlyGlySerAspPheGlyArg-212 |
| SEQ. ID. NO. 18675 | 219-IleLysLeuAspSerGlySerGlu-226 |
| SEQ. ID. NO. 18676 | 232-HisCysLysAspLysValCysAspArgAspPheLeuAspGluGluAlaProProLysSerGluPheGluLysLeuSerAspGluGluLysIleAsnLys TyrLysLysAspGluGlnArgGluAsnPhe-274 |
| SEQ. ID. NO. 18677 | 278-ValAlaAspArgValGluLysAsnGlyThr-287 |
| SEQ. ID. NO. 18678 | 294-TyrLysAspLysSerAlaSerSerSerSerAlaArgPheArgArgSerAlaArgSerArgArgSerLeuPro-317 |
| SEQ. ID. NO. 18679 | 332-IleValAspGlyGluAla-337 |
| SEQ. ID. NO. 18680 | 360-GlyAlaGluLysLeuSer-365 |
| SEQ. ID. NO. 18681 | 374-GlnGlyGluProAlaLysGlyGluMet-382 |
| SEQ. ID. NO. 18682 | 399-GluAsnGlyArgProSerProSerGlyGly-408 |
| SEQ. ID. NO. 18683 | 414-ValAspPheGlySerLysSerValAspGlyIleIleAspSerGlyAspAspLeuHis-432 |
| SEQ. ID. NO. 18684 | 455-GlyGlyGlyAspValSer-460 |
| SEQ. ID. NO. 18685 | 467-AlaGlyGluGluValAlaGly-473 |
| SEQ. ID. NO. 18686 | 475-TyrSerTyrArgProThrAspAlaGluLysGlyGly-486 |
| SEQ. ID. NO. 18687 | 491-AlaGlyLysLysGluGlnAsp-497 | a288
AMPHI Regions - AMPHI

| | |
|---|---|
| SEQ. ID. NO. 18688 | 7-ValSerArgValLeu-11 |
| SEQ. ID. NO. 18689 | 54-IleValThrLysCysAla-59 |
| SEQ. ID. NO. 18690 | 61-ArgProTyrArgThrPheSerProLeuProVal-71 |

TABLE 1-continued

| SEQ. ID. NO. 18691 | 97-HisSerThrLeuArg-101 |
| SEQ. ID. NO. 18692 | 150-AlaLeuPheGlnAlaGlyPheAspLysAlaValGln-161 |

Antigenic Index - Jameson-Wolf

| SEQ. ID. NO. 18693 | 2-HisThrGlyGlnAla-6 |
| SEQ. ID. NO. 18694 | 28-AsnLeuProGluArgSerAlaGlySer-36 |
| SEQ. ID. NO. 18695 | 58-CysAlaValArgProTyrArgThrPheSerPro-68 |
| SEQ. ID. NO. 18696 | 72-LeuProLysGlnProSerAla-78 |
| SEQ. ID. NO. 18697 | 89-LeuProArgProAlaValAsnArgHisSerThrLeuArgSerProAspPheProProArgMet-109 |
| SEQ. ID. NO. 18698 | 113-IleArgGlyAspCysLeuPro-119 |
| SEQ. ID. NO. 18699 | 126-IleIleThrArgAsnAlaLysMetProSerGluThrValGlnValSerAspGlyIleGlnProLys-147 |
| SEQ. ID. NO. 18700 | 155-GlyPheAspLysAlaVal-160 |

Hydrophilic Regions - Hopp-Woods

| SEQ. ID. NO. 18701 | 28-AsnLeuProGluArgSerAla-34 |
| SEQ. ID. NO. 18702 | 58-CysAlaValArgPro-62 |
| SEQ. ID. NO. 18703 | 98-SerThrLeuArgSerProAspPheProPro-107 |
| SEQ. ID. NO. 18704 | 113-IleArgGlyAspCys-117 |
| SEQ. ID. NO. 18705 | 126-IleIleThrArgAsnAlaLysMetProSerGluThrValGlnVal-140 |
| SEQ. ID. NO. 18706 | 155-GlyPheAspLysAlaVal-160 | a292
AMPHI Regions - AMPHI

| SEQ. ID. NO. 18707 | 7-LysIleLeuThrProPheThrValLeuProLeu-17 |
| SEQ. ID. NO. 18708 | 40-GlyLysSerValAla-44 |
| SEQ. ID. NO. 18709 | 62-ValLeuSerValSerGlu-67 |
| SEQ. ID. NO. 18710 | 69-ProValLysGlyIleTyrGlu-75 |
| SEQ. ID. NO. 18711 | 110-GluArgAlaAlaAspLeu-115 |
| SEQ. ID. NO. 18712 | 124-ProLeuAspLysAlaIleLysGluValArgGly-134 |
| SEQ. ID. NO. 18713 | 150-PheCysLysArgLeuGluHisGluPheGluLysMetThrAspValThr-165 |
| SEQ. ID. NO. 18714 | 195-LysAlaTrpThrAspTrpMetArg-202 |
| SEQ. ID. NO. 18715 | 212-IleCysAspAsnProVal-217 |

Antigenic Index - Jameson-Wolf

| SEQ. ID. NO. 18716 | 1-MetLysThrLysLeu-5 |
| SEQ. ID. NO. 18717 | 23-ThrProValSerAsnAlaAsnAlaGluProAlaValLysAlaGluSerAlaGlyLysSerVal-43 |
| SEQ. ID. NO. 18718 | 47-LeuLysAlaArgLeuGluLysThrTyrSerAlaGlnAspLeuLys-61 |
| SEQ. ID. NO. 18719 | 66-SerGluThrProValLysGlyIle-73 |
| SEQ. ID. NO. 18720 | 85-TyrThrAspAlaGluGlyGlyTyr-92 |
| SEQ. ID. NO. 18721 | 99-IleAsnIleAspThrArgLysAsnLeuThrGluGluArgAlaAlaAspLeuAsnLys-117 |
| SEQ. ID. NO. 18722 | 124-ProLeuAspLysAlaIleLysGluValArgGlyAsnGlyLysLeuLysVal-140 |
| SEQ. ID. NO. 18723 | 142-ValPheSerAspProAspCysProPhe-150 |
| SEQ. ID. NO. 18724 | 152-LysArgLeuGluHisGluPheGluLysMetThrAsp-163 |
| SEQ. ID. NO. 18725 | 177-HisProAspAlaAlaArgLysAla-184 |
| SEQ. ID. NO. 18726 | 189-CysGlnProAspArgAlaLysAla-196 |
| SEQ. ID. NO. 18727 | 200-TrpMetArgLysGlyLysPheProVal-208 |
| SEQ. ID. NO. 18728 | 210-GlySerIleCysAspAsnProValAlaGluThrThrSerLeuGlyGlu-225 |
| SEQ. ID. NO. 18729 | 237-PheProAsnGlyArgSerGlnSerGlyTyrSerPro-248 |
| SEQ. ID. NO. 18730 | 250-ProGlnLeuGluGluIleIleArgLysAsnGln-260 |

Hydrophilic Regions - Hopp-Woods

| SEQ. ID. NO. 18731 | 1-MetLysThrLysLeu-5 |
| SEQ. ID. NO. 18732 | 28-AlaAsnAlaGluProAlaValLysAlaGluSerAlaGlyLysSerVal-43 |
| SEQ. ID. NO. 18733 | 47-LeuLysAlaArgLeuGluLysThrTyrSer-56 |
| SEQ. ID. NO. 18734 | 99-IleAsnIleAspThrArgLysAsnLeuThrGluGluArgAlaAlaAspLeuAsnLys-117 |
| SEQ. ID. NO. 18735 | 124-ProLeuAspLysAlaIleLysGluValArgGlyAsnGlyLysLeuLys-139 |
| SEQ. ID. NO. 18736 | 144-SerAspProAspCysProPhe-150 |
| SEQ. ID. NO. 18737 | 152-LysArgLeuGluHisGluPheGluLysMetThrAsp-163 |
| SEQ. ID. NO. 18738 | 179-AspAlaAlaArgLysAla-184 |
| SEQ. ID. NO. 18739 | 190-GlnProAspArgAlaLysAla-196 |
| SEQ. ID. NO. 18740 | 200-TrpMetArgLysGlyLysPhe-206 |
| SEQ. ID. NO. 18741 | 240-GlyArgSerGlnSer-244 |
| SEQ. ID. NO. 18742 | 250-ProGlnLeuGluGluIleIleArgLysAsnGln-260 | a294
AMPHI Regions - AMPHI

| SEQ. ID. NO. 18743 | 27-ArgPheProAlaAlaPheArgArgTyrSer-36 |
| SEQ. ID. NO. 18744 | 45-LysProAlaGlyThr-49 |
| SEQ. ID. NO. 18745 | 51-TrpHisArgValArgArgPheLysSerAsnArgArgThr-63 |
| SEQ. ID. NO. 18746 | 65-GlyGlyLysProLeuLysLysThrTyrArg-74 |
| SEQ. ID. NO. 18747 | 92-AsnIleAlaGluArgAlaArgGluSerProArgArgTyrGlyLysArgTyrAlaAspIleGlyAspAsp-114 |
| SEQ. ID. NO. 18748 | 133-AlaValAlaHisIleValHisLeu-140 |
| SEQ. ID. NO. 18749 | 176-AlaMetSerTyrArg-180 |
| SEQ. ID. NO. 18750 | 206-SerIleLeuGlyGluProPheAlaThrSerPheGly-217 |
| SEQ. ID. NO. 18751 | 227-AlaPheSerValLeuAlaHisPhe-234 |
| SEQ. ID. NO. 18752 | 247-ThrValGlyTrpSerLysTyrIleHisThrVal-257 |

Antigenic Index - Jameson-Wolf

| SEQ. ID. NO. 18753 | 20-AlaValArgThrSerSerAsnArgPhe-28 |
| SEQ. ID. NO. 18754 | 32-PheArgArgTyrSerAlaPheArg-39 |
| SEQ. ID. NO. 18755 | 44-ProLysProAlaGlyThrProTrpHisArgValArgArgPheLysSerAsnArgArgThrArgGlyGlyLysProLeuLysLysThrTyrArgProArgArgAlaGluCysArgCysArgArgAlaArgThr-87 |
| SEQ. ID. NO. 18756 | 93-IleAlaGluArgAlaArgGluSerProArgArgTyrGlyLysArgTyrAlaAspIleGlyAspAspSerAspThrIleArg-119 |
| SEQ. ID. NO. 18757 | 121-ArgValPheArgLeuGluTyr-127 |
| SEQ. ID. NO. 18758 | 161-HisThrGlyArgValSerCysGluAlaArgArgGluValGluLysAlaMetSer-178 |
| SEQ. ID. NO. 18759 | 240-LysMetAlaArgSer-244 |

TABLE 1-continued

Hydrophilic Regions - Hopp-Woods
SEQ. ID. NO. 18760   20-AlaValArgThrSerSerAsnArg-27
SEQ. ID. NO. 18761   52-HisArgValArgArgPheLysSerAsnArgArgThrArgGlyGlyLysProLeuLysLysThrTyrArgProArgArgAlaGluCysArgCysArgArg
                     AlaArgThr-87
SEQ. ID. NO. 18762   93-IleAlaGluArgAlaArgGluSerProArgArgTyrGlyLysArgTyrAlaAspIleGlyAspAspSerAspThrIleArg-119
SEQ. ID. NO. 18763   121-ArgValPheArgLeuGluTyr-127
SEQ. ID. NO. 18764   165-ValSerCysGluAlaArgArgGluValGluLysAlaMetSer-178
a295
AMPHI Regions - AMPHI
SEQ. ID. NO. 18765   79-PheArgGlnProArg-83
SEQ. ID. NO. 18766   112-ArgPhePheArgGlnPro-117
SEQ. ID. NO. 18767   130-AlaPheLeuHisGlnIle-135
SEQ. ID. NO. 18768   175-AsnLeuArgGlyPhePro-180
SEQ. ID. NO. 18769   188-HisGlnGlnArgArgIleGlyLysThrLeuProGlnLeu-200
SEQ. ID. NO. 18770   232-ThrLeuAlaProMetArgProIleCysArgGlyThrSerGly-245
SEQ. ID. NO. 18771   262-TyrIleIleLysProLeuGluHis-269
Antigenic Index - Jameson-Wolf
SEQ. ID. NO. 18772   4-MetAlaArgHisAspAspGlnGlnGly-12
SEQ. ID. NO. 18773   18-LeuProArgArgGlnGln-23
SEQ. ID. NO. 18774   49-PheLysLeuProArgGlnArgPheHisLeu-58
SEQ. ID. NO. 18775   73-HisGlyCysArgAlaGlnPheArgGlnProArgArgIleArgLeu-87
SEQ. ID. NO. 18776   91-GlnThrAlaArgGlnArgSerGlyGlyArgThrAspGlnAlaAla-105
SEQ. ID. NO. 18777   114-PheArgGlnProArgIleArgGlnLysGlnArgHisThrArg-127
SEQ. ID. NO. 18778   136-GlyProAspPheGly-140
SEQ. ID. NO. 18779   143-GlnAsnAlaGluHisArgAla-149
SEQ. ID. NO. 18780   170-CysIleArgLysGlnAsnLeuArgGlyPheProSerArgArgGlyHisLeuArgHisGlnGlnArgArgIleGlyLysThrLeu-197
SEQ. ID. NO. 18781   205-LeuGlyGlyThrArgPheProAspArgAsnGlyValTyrProAsnArgAlaGlyAsnGlyIleArgIleArgLeu-229
SEQ. ID. NO. 18782   238-ProIleCysArgGlyThrSerGly-245
SEQ. ID. NO. 18783   252-ProTyrProTyrArgArgLysGlnProGlnTyr-262
SEQ. ID. NO. 18784   273-SerCysLysThrAsnAlaValArgThrValArgThrAlaPheArgGlnArgAsnGlnIleSer-293
Hydrophilic Regions - Hopp-Woods
SEQ. ID. NO. 18785   5-AlaArgHisAspAspGlnGlnGly-12
SEQ. ID. NO. 18786   18-LeuProArgArgGlnGln-23
SEQ. ID. NO. 18787   77-AlaGlnPheArgGlnProArgArgIleArgLeu-87
SEQ. ID. NO. 18788   93-AlaArgGlnArgSerGlyGlyArgThrAspGlnAlaAla-105
SEQ. ID. NO. 18789   117-ProArgIleArgGlnLysGlnArgHisThrArg-127
SEQ. ID. NO. 18790   145-AlaGluHisArgAla-149
SEQ. ID. NO. 18791   170-CysIleArgLysGlnAsnLeu-176
SEQ. ID. NO. 18792   179-PheProSerArgArgGlyHisLeuArgHisGlnGlnArgArgIleGlyLys-195
SEQ. ID. NO. 18793   209-ArgPheProAspArgAsnGly-215
SEQ. ID. NO. 18794   225-IleArgIleArgLeu-229
SEQ. ID. NO. 18795   238-ProIleCysArgGlyThr-243
SEQ. ID. NO. 18796   254-ProTyrArgArgLysGlnPro-260
SEQ. ID. NO. 18797   280-ArgThrValArgThrAlaPheArgGlnArgAsnGlnIle-292
a297
AMPHI Regions - AMPHI
SEQ. ID. NO. 18798   35-ArgThrGluArgVal-39
SEQ. ID. NO. 18799   69-GlnProGlyAspSerLeuAlaAspValLeuAla-79
SEQ. ID. NO. 18800   86-AspGluIleAlaArgIleThrGluLysTyr-95
SEQ. ID. NO. 18801   157-LeuProThrLeuArg-161
SEQ. ID. NO. 18802   199-LeuLysGluGlyAspAla-204
SEQ. ID. NO. 18803   272-LeuValTyrThrArgIleSerSer-279
SEQ. ID. NO. 18804   333-HisAlaAsnGlyValGluThrLeuTyrAlaHisLeuSerAlaPheSer-348
Antigenic Index - Jameson-Wolf
SEQ. ID. NO. 18805   8-AlaLysHisArgLysTyrAla-14
SEQ. ID. NO. 18806   32-SerThrGluArgThrGluArgValArgProGlnArgValGluGlnLysLeuPro-49
SEQ. ID. NO. 18807   52-SerTrpGlyGlySerGly-57
SEQ. ID. NO. 18808   67-AlaValGlnProGlyAspSerLeuAla-75
SEQ. ID. NO. 18809   78-LeuAlaArgSerGlyMetAlaArgAspGluIleAlaArgIleThrGluLysTyrGlyGlyGluAlaAspLeuArgHisLeuArgAlaAspGln
                     SerVal-110
SEQ. ID. NO. 18810   115-GlyGlyAspGlyGlyAlaArgGluVal-123
SEQ. ID. NO. 18811   127-ThrAspGluAspGlyGluArgAsnLeuValAlaLeuGluLysLysGlyGlyIleTrpArgArgSerAlaSerGluAlaAspMetLysVal-156
SEQ. ID. NO. 18812   167-ThrSerAlaArgGlySerLeuAlaArgAlaGluValProValGluIleArgGluSerLeuSer-187
SEQ. ID. NO. 18813   194-PheSerLeuAspGlyLeuLysGluGlyAspAlaVal-205
SEQ. ID. NO. 18814   228-GluValValLysGlyGlyThrArgHis-236
SEQ. ID. NO. 18815   240-TyrTyrArgSerAspLysGluGlyGlyGlyGlyGlyAsnTyrTyrAspGluAspGlyArgValLeuGlnGluLysGlyGlyPheAsn-268
SEQ. ID. NO. 18816   276-ArgIleSerSerProPheGlyTyr-283
SEQ. ID. NO. 18817   295-HisThrGlyIleAspTyrAla-301
SEQ. ID. NO. 18818   303-ProGlnGlyThrProValArgAlaSerAlaAspGly-314
SEQ. ID. NO. 18819   318-PheLysGlyArgLysGlyGlyTyrGly-326
SEQ. ID. NO. 18820   333-HisAlaAsnGlyValGlu-338
SEQ. ID. NO. 18821   350-AlaGluGlyAsnValArgGlyGlyGlu-358
SEQ. ID. NO. 18822   365-SerThrGlyArgSerThrGlyProHisLeu-374
SEQ. ID. NO. 18823   376-TyrGluAlaArgIleAsnGlyGlnProValAsn-386
SEQ. ID. NO. 18824   393-ProThrProGluLeuThrGlnAlaAspLysAlaAla-404
SEQ. ID. NO. 18825   408-GlnLysGlnLysAlaAspAlaLeu-415
SEQ. ID. NO. 18826   426-ValSerGlnSerAsp-430
Hydrophilic Regions - Hopp-Woods
SEQ. ID. NO. 18827   8-AlaLysHisArgLysTyrAla-14
SEQ. ID. NO. 18828   32-SerThrGluArgThrGluArgValArgProGlnArgValGluGlnLysLeu-48

TABLE 1-continued

| SEQ. ID. NO. 18829 | 68-ValGlnProGlyAspSerLeuAla-75 |
| --- | --- |
| SEQ. ID. NO. 18830 | 82-GlyMetAlaArgAspGluIleAlaArgIleThrGluLysTyrGlyGlyGluAlaAspLeuArgHisLeuArgAlaAspGln-108 |
| SEQ. ID. NO. 18831 | 117-AspGlyGlyAlaArgGlu-122 |
| SEQ. ID. NO. 18832 | 127-ThrAspGluAspGlyGluArgAsnLeuValAlaLeuGluLysLysGlyGlyIleTrpArgArgSerAlaSerGluAlaAspMetLysVal-156 |
| SEQ. ID. NO. 18833 | 167-ThrSerAlaArgGlySerLeuAlaArgAlaGluValProValGluIleArgGluSerLeu-186 |
| SEQ. ID. NO. 18834 | 194-PheSerLeuAspGlyLeuLysGluGlyAspAlaVal-205 |
| SEQ. ID. NO. 18835 | 228-GluValValLysGlyGlyThrArg-235 |
| SEQ. ID. NO. 18836 | 242-ArgSerAspLysGluGlyGlyGly-249 |
| SEQ. ID. NO. 18837 | 253-TyrTyrAspGluAspGlyArgValLeuGlnGluLysGlyGlyPhe-267 |
| SEQ. ID. NO. 18838 | 306-ThrProValArgAlaSerAla-312 |
| SEQ. ID. NO. 18839 | 319-LysGlyArgLysGlyGlyTyr-325 |
| SEQ. ID. NO. 18840 | 350-AlaGluGlyAsnValArgGlyGlyGlu-358 |
| SEQ. ID. NO. 18841 | 366-ThrGlyArgSerThrGly-371 |
| SEQ. ID. NO. 18842 | 378-AlaArgIleAsnGly-382 |
| SEQ. ID. NO. 18843 | 396-GluLeuThrGlnAlaAspLysAlaAla-404 |
| SEQ. ID. NO. 18844 | 408-GlnLysGlnLysAlaAspAlaLeu-415 | a298
AMPHI Regions - AMPHI

| SEQ. ID. NO. 18845 | 6-SerLeuPheAlaSerIleLeuMetSerAlaLeuIleAla-18 |
| --- | --- |
| SEQ. ID. NO. 18846 | 26-IleAsnAlaTyrTrpGlnGln-32 |
| SEQ. ID. NO. 18847 | 42-ProLeuAlaAlaTyr-46 |
| SEQ. ID. NO. 18848 | 62-LeuSerAspGlyIleLysAlaPhe-69 |
| SEQ. ID. NO. 18849 | 82-GlySerAlaAspMetPro-87 |
| SEQ. ID. NO. 18850 | 134-ValGlnLysSerLeuLys-139 |
| SEQ. ID. NO. 18851 | 157-SerTyrProSerPhePheAspTrpProLysThrIleGluGluThrLeuLysLysHisProGlu-177 |
| SEQ. ID. NO. 18852 | 188-AsnAspProTrpAsp-192 |
| SEQ. ID. NO. 18853 | 208-AlaGlnGluTyrLeuLysArgValAspArgIleLeuGluAlaAlaHis-223 |
| SEQ. ID. NO. 18854 | 245-GlnMetArgTyrLeuAspLysLeuLeuSerGluTyrLeu-257 |
| SEQ. ID. NO. 18855 | 276-ArgTyrThrAspSer-280 |
| SEQ. ID. NO. 18856 | 308-AlaLysIleMetGluLys-313 |

Antigenic Index - Jameson-Wolf

| SEQ. ID. NO. 18857 | 22-SerGlnAsnProIleAsnAlaTyr-29 |
| --- | --- |
| SEQ. ID. NO. 18858 | 34-TyrHisArgAsnSerProLeuGluPro-42 |
| SEQ. ID. NO. 18859 | 47-GlyTrpArgSerGlyAlaAlaLeuGlnGlu-57 |
| SEQ. ID. NO. 18860 | 70-LeuSerGlyGluThrProProThrAlaGlnAspGlyGlySerAlaAspMetProSerGluAlaAlaAlaProGluThrAlaProGlnThrGlyGluThrGluTrpLysGlnAsnThrGlu-109 |
| SEQ. ID. NO. 18861 | 114-ArgThrGlyAspLys-118 |
| SEQ. ID. NO. 18862 | 136-LysSerLeuLysGlnGlnTyrGlyIleGluSerValAsnLeuSerLysGlnSerThrGly-155 |
| SEQ. ID. NO. 18863 | 162-PheAspTrpProLysThrIleGluGluThrLeuLysLysHisProGlu-177 |
| SEQ. ID. NO. 18864 | 186-GlyProAsnAspProTrp-191 |
| SEQ. ID. NO. 18865 | 194-ProValGlyLysArgTyrLeu-200 |
| SEQ. ID. NO. 18866 | 203-AlaSerAspGluTrpAla-208 |
| SEQ. ID. NO. 18867 | 211-TyrLeuLysArgValAspArgIleLeuGlu-220 |
| SEQ. ID. NO. 18868 | 236-TyrMetLysLysAlaLysLeuAspGlyGlnMetArgTyrLeuAsp-250 |
| SEQ. ID. NO. 18869 | 270-LeuSerGlyGlyLysAspArgTyrThrAspSerValAsnValAsnGlyLysProValArgTyrArgSerLysAspGlyIle-296 |
| SEQ. ID. NO. 18870 | 318-ProSerThrGlnProSerSerThrGlnPro-327 |

Hydrophilic Regions - Hopp-Woods

| SEQ. ID. NO. 18871 | 73-GluThrProProThrAlaGlnAspGlyGlySerAlaAspMetProSerGluAlaAlaAlaProGluThrAlaProGlnThrGlyGluThrGluTrpLysGlnAsnThrGlu-109 |
| --- | --- |
| SEQ. ID. NO. 18872 | 148-AsnLeuSerLysGlnSerThr-154 |
| SEQ. ID. NO. 18873 | 166-LysThrIleGluGluThrLeuLysLysHisProGlu-177 |
| SEQ. ID. NO. 18874 | 211-TyrLeuLysArgValAspArgIleLeuGlu-220 |
| SEQ. ID. NO. 18875 | 236-TyrMetLysLysAlaLysLeuAspGlyGlnMetArgTyrLeuAsp-250 |
| SEQ. ID. NO. 18876 | 271-SerGlyGlyLysAspArgTyrThrAsp-279 |
| SEQ. ID. NO. 18877 | 281-ValAsnValAsnGlyLysProValArgTyrArgSerLysAspGlyIle-296 |
| SEQ. ID. NO. 18878 | 319-SerThrGlnProSerSerThrGlnPro-327 | a299
AMPHI Regions - AMPHI

| SEQ. ID. NO. 18879 | 54-AlaSerProTrpMetLysLysLeuGlnSerValAlaGlnGlySer-68 |
| --- | --- |
| SEQ. ID. NO. 18880 | 71-ThrPheArgIleLeuGlnIleGly-78 |
| SEQ. ID. NO. 18881 | 85-AspPhePheThrAspSerLeuArgLysArgLeuGlnLysThrTrpGly-100 |
| SEQ. ID. NO. 18882 | 238-GlnLeuThrGlnTrpSerLysTrp-245 |
| SEQ. ID. NO. 18883 | 247-AlaAspArgMetAsnAspLeuAlaGlnThr-256 |
| SEQ. ID. NO. 18884 | 281-GluGlnLysTrpLeuAspThrValArgGlnIleArgAspSerLeu-295 |
| SEQ. ID. NO. 18885 | 307-GluSerLeuLysAsnThrLeu-313 |
| SEQ. ID. NO. 18886 | 322-ArgLeuThrGluValGlnGlnMetGlnArgArgIleAlaArgGln-336 |
| SEQ. ID. NO. 18887 | 375-TyrGlnArgSerAlaGluMetLeuAlaAspSerLeuGluGluLeuValArgSerAlaAlaIleArg-396 |

Antigenic Index - Jameson-Wolf

| SEQ. ID. NO. 18888 | 1-MetAsnProLysHis-5 |
| --- | --- |
| SEQ. ID. NO. 18889 | 35-ProSerAlaProTyrThrAspThrAsnGlyLeu-45 |
| SEQ. ID. NO. 18890 | 48-AspTyrGlyAsnAlaSerAlaSerProTrpMetLysLysLeuGln-62 |
| SEQ. ID. NO. 18891 | 65-AlaGlnGlySerGlyGluThr-71 |
| SEQ. ID. NO. 18892 | 78-GlyAspSerHisThrAlaGlyAspPhePheThrAspSerLeuArgLysArgLeuGlnLysThrTrpGlyAspGlyGly-103 |
| SEQ. ID. NO. 18893 | 110-AlaAsnValLysGlyGlnArg-116 |
| SEQ. ID. NO. 18894 | 121-ArgHisAsnGlyAsnTrpGlnSerLeuThrSerArgAsnAsnThrGlyAspPheProLeu-140 |
| SEQ. ID. NO. 18895 | 157-AlaSerAspGlyIleAlaSerLysGlnArgVal-167 |
| SEQ. ID. NO. 18896 | 184-GlyAsnThrValSerAlaAsnGlyGlyGly-193 |
| SEQ. ID. NO. 18897 | 221-GluAsnProAlaGlyGly-226 |
| SEQ. ID. NO. 18898 | 241-GlnTrpSerLysTrpArgAlaAspArgMetAsnAspLeuAlaGlnThrGlyAla-258 |
| SEQ. ID. NO. 18899 | 266-GlyThrAsnGluAlaPheGlyAspAsnIleAspIleAlaAspThrGluGlnLysTrp-284 |

TABLE 1-continued

| | |
|---|---|
| SEQ. ID. NO. 18900 | 286-AspThrValArgGlnIleArgAspSerLeuPro-296 |
| SEQ. ID. NO. 18901 | 305-AlaProGluSerLeuLysAsnThr-312 |
| SEQ. ID. NO. 18902 | 319-ArgProValArgLeuThrGluValGlnGlnMetGlnArgArgIleAlaArgGlnGlyGlnThr-339 |
| SEQ. ID. NO. 18903 | 361-GlyTrpAlaAlaLysAspGlyVal-368 |
| SEQ. ID. NO. 18904 | 371-SerAlaLysGlyTyrGlnArgSerAlaGluMetLeuAlaAspSerLeuGluGluLeuValArg-391 |
| SEQ. ID. NO. 18905 | 393-AlaAlaIleArgGln-397 |

Hydrophilic Regions - Hopp-Woods

| | |
|---|---|
| SEQ. ID. NO. 18906 | 67-GlySerGlyGluThr-71 |
| SEQ. ID. NO. 18907 | 90-SerLeuArgLysArgLeuGlnLysThrTrpGly-100 |
| SEQ. ID. NO. 18908 | 112-ValLysGlyGlnArg-116 |
| SEQ. ID. NO. 18909 | 130-ThrSerArgAsnAsnThrGly-136 |
| SEQ. ID. NO. 18910 | 159-AspGlyIleAlaSerLysGlnArgVal-167 |
| SEQ. ID. NO. 18911 | 245-TrpArgAlaAspArgMetAsnAsp-252 |
| SEQ. ID. NO. 18912 | 270-AlaPheGlyAspAsnIleAspIleAlaAspThrGluGlnLysTrp-284 |
| SEQ. ID. NO. 18913 | 288-ValArgGlnIleArgAspSerLeuPro-296 |
| SEQ. ID. NO. 18914 | 319-ArgProValArgLeuThrGlu-325 |
| SEQ. ID. NO. 18915 | 327-GlnGlnMetGlnArgArgIleAlaArgGlnGly-337 |
| SEQ. ID. NO. 18916 | 363-AlaAlaLysAspGlyVal-368 |
| SEQ. ID. NO. 18917 | 374-GlyTyrGlnArgSerAlaGluMetLeuAlaAspSerLeuGluGluLeuValArg-391 |
| SEQ. ID. NO. 18918 | 393-AlaAlaIleArgGln-397 | a302
AMPHI Regions - AMPHI

| | |
|---|---|
| SEQ. ID. NO. 18919 | 20-AspGlyArgPheLeuArgThrValGluTrpLeuGlyAsnMetLeuProHisPro-37 |
| SEQ. ID. NO. 18920 | 81-ValValSerLeuLeuAspAlaAspGlyLeuIleLysIleLeuThrHisThrValLysAsnPheThrGlyPheAlaProLeuGlyThrValLeuValSerLeu-114 |
| SEQ. ID. NO. 18921 | 127-SerAlaLeuMetArg-131 |
| SEQ. ID. NO. 18922 | 176-GlyArgHisProLeuAlaGlyLeuAlaAlaAlaPheAlaGlyValSerGly-192 |
| SEQ. ID. NO. 18923 | 201-GlyThrIleAspProLeuLeuAlaGlyIleThrGlnGlnAla-214 |
| SEQ. ID. NO. 18924 | 239-ValIleAlaLeuIleGly-244 |
| SEQ. ID. NO. 18925 | 271-ArgHisSerAsnGluIle-276 |
| SEQ. ID. NO. 18926 | 294-LeuSerAlaLeuLeuAlaTrp-300 |
| SEQ. ID. NO. 18927 | 308-IleLeuArgHisProGluThrGly-315 |
| SEQ. ID. NO. 18928 | 341-TyrGlyArgValThrArgSerLeuArgGlyGluGlnGluValValAsnAlaMetAlaGluSerMetSer-363 |
| SEQ. ID. NO. 18929 | 378-PheValAlaPhePheAsnTrpThrAsnIleGlyGlnTyrIle-391 |
| SEQ. ID. NO. 18930 | 448-AlaProGluValIleGlnAlaAlaTyrArgIleGlyAspSerValThrAsnIleIleThrProMetMetSerTyrPheGlyLeuIleMetAla-478 |
| SEQ. ID. NO. 18931 | 505-IleAlaTrpIleAlaLeuPheCysIle-513 |

Antigenic Index - Jameson-Wolf

| | |
|---|---|
| SEQ. ID. NO. 18932 | 8-LysGluLysGlnMetSerGlnThrAspThrGlnArgAspGlyArgPhe-23 |
| SEQ. ID. NO. 18933 | 61-SerValProAspProArgProValGlyAlaLysGlyArgAlaAspAspGlyLeu-78 |
| SEQ. ID. NO. 18934 | 85-LeuAspAlaAspGlyLeu-90 |
| SEQ. ID. NO. 18935 | 119-IleAlaGluLysSerGly-124 |
| SEQ. ID. NO. 18936 | 134-LeuThrLysSerProArgLysLeuThr-142 |
| SEQ. ID. NO. 18937 | 152-LeuSerAsnThrAlaSerGlu-158 |
| SEQ. ID. NO. 18938 | 175-LeuGlyArgHisProLeu-180 |
| SEQ. ID. NO. 18939 | 250-LysIleValGluProGlnLeuGlyProTyrGlnSerAspLeuSerGlnGluGluLysAspIleArgHisSerAsnGluIleThrProLeuGluTyrLys-282 |
| SEQ. ID. NO. 18940 | 304-ProAlaAspGlyIleLeuArgHisProGluThrGlyLeuValSer-318 |
| SEQ. ID. NO. 18941 | 343-ArgValThrArgSerLeuArgGlyGluGlnGluVal-354 |
| SEQ. ID. NO. 18942 | 402-ValGlyLeuGlyGly-406 |
| SEQ. ID. NO. 18943 | 482-LysTyrLysLysAspAlaGlyVal-489 |

Hydrophilic Regions - Hopp-Woods

| | |
|---|---|
| SEQ. ID. NO. 18944 | 8-LysGluLysGlnMetSerGlnThrAspThrGlnArgAspGlyArgPhe-23 |
| SEQ. ID. NO. 18945 | 63-ProAspProArgProValGlyAlaLysGlyArgAlaAspAspGlyLeu-78 |
| SEQ. ID. NO. 18946 | 85-LeuAspAlaAspGlyLeu-90 |
| SEQ. ID. NO. 18947 | 119-IleAlaGluLysSerGly-124 |
| SEQ. ID. NO. 18948 | 136-LysSerProArgLysLeu-141 |
| SEQ. ID. NO. 18949 | 263-LeuSerGlnGluGluLysAspIleArgHisSerAsnGlu-275 |
| SEQ. ID. NO. 18950 | 307-GlyIleLeuArgHisProGlu-313 |
| SEQ. ID. NO. 18951 | 343-ArgValThrArgSerLeuArgGlyGluGlnGluVal-354 |
| SEQ. ID. NO. 18952 | 482-LysTyrLysLysAspAlaGly-488 | a305
AMPHI Regions - AMPHI

| | |
|---|---|
| SEQ. ID. NO. 18953 | 10-LeuMetMetGlyLeuValGluGlyPheThrGluPheLeuPro-23 |
| SEQ. ID. NO. 18954 | 33-PheGlyAsnLeuIleAspPheHisSer-41 |
| SEQ. ID. NO. 18955 | 66-PheSerAsnValLeuHis-71 |
| SEQ. ID. NO. 18956 | 93-AlaAlaValMetGly-97 |
| SEQ. ID. NO. 18957 | 99-LeuPheGlyLysGlnIleLysGluTyrLeuPhe-109 |
| SEQ. ID. NO. 18958 | 141-AspValAspAlaLeuArgProIleAspAla-150 |
| SEQ. ID. NO. 18959 | 155-ValAlaGlnValPheAla-160 |
| SEQ. ID. NO. 18960 | 202-AlaTyrAspValLeuLysHisTyrArgPhePheThrLeuHis-215 |
| SEQ. ID. NO. 18961 | 222-IleGlyPheValAlaAlaPheValSer-230 |
| SEQ. ID. NO. 18962 | 235-ValLysAlaLeuLeuArg-240 |

Antigenic Index - Jameson-Wolf

| | |
|---|---|
| SEQ. ID. NO. 18963 | 40-HisSerAsnHisLys-44 |
| SEQ. ID. NO. 18964 | 61-GluTyrArgGlnArgPheSerAsn-68 |
| SEQ. ID. NO. 18965 | 72-GlyValGlyLysAspArgLysAlaAsn-80 |
| SEQ. ID. NO. 18966 | 128-ValGluLysArgGlnSerArgAlaGluProLysIleValAsp-141 |
| SEQ. ID. NO. 18967 | 143-AspAlaLeuArgProIleAsp-149 |
| SEQ. ID. NO. 18968 | 163-ProGlyThrSerArgSerGlySer-170 |

TABLE 1-continued

SEQ. ID. NO. 18969    180-IleGluArgLysThrAlaThr-186
SEQ. ID. NO. 18970    241-PheValSerLysLysAsnTyr-247
Hydrophilic Regions - Hopp-Woods
SEQ. ID. NO. 18971    62-TyrArgGlnArgPhe-66
SEQ. ID. NO. 18972    73-ValGlyLysAspArgLysAlaAsn-80
SEQ. ID. NO. 18973    128-ValGluLysArgGlnSerArgAlaGluProLysIleValAsp-141
SEQ. ID. NO. 18974    143-AspAlaLeuArgProIleAsp-149
SEQ. ID. NO. 18975    165-ThrSerArgSerGlySer-170
SEQ. ID. NO. 18976    180-IleGluArgLysThrAlaThr-186
SEQ. ID. NO. 18977    242-ValSerLysLysAsn-246
a308-2
AMPHI Regions - AMPHI
SEQ. ID. NO. 18978    6-PheTyrArgIleLeuGlyValAlaAspAsnLeuTyrProTyrLeu-20
SEQ. ID. NO. 18979    27-ThrIleIleAlaGlyLeu-32
SEQ. ID. NO. 18980    64-AlaLeuGluLeuLeuArgAlaGlnAsp-72
SEQ. ID. NO. 18981    83-AlaGluMetAlaArgAlaSerGlu-90
SEQ. ID. NO. 18982    101-LeuAlaAspPheValHisProIleGlyAsnIleGlyAlaCys-114
SEQ. ID. NO. 18983    131-SerMetArgThrLeuAlaSerValValHisGlyPheGlyAsp-144
SEQ. ID. NO. 18984    172-LeuAlaHisLeuAspAsnMetLysArgValThrGlu-183
Antigenic Index - Jameson-Wolf
SEQ. ID. NO. 18985    39-TrpGluArgArgMetMetVal-45
SEQ. ID. NO. 18986    68-LeuArgAlaGlnAspIleGluThr-75
SEQ. ID. NO. 18987    80-SerLysGlyAlaGluMetAlaArgAlaSerGluThrAlaTyrAlaArgAspGluVal-98
SEQ. ID. NO. 18988    118-GlyThrPheLysThrAspGlyMet-125
SEQ. ID. NO. 18989    142-PheGlyAspAsnLeuLeu-147
SEQ. ID. NO. 18990    149-ArgAlaAlaAspValValLeuLysGluArgArgArgLeu-161
SEQ. ID. NO. 18991    166-ArgGluThrProLeu-170
SEQ. ID. NO. 18992    176-AspAsnMetLysArgValThrGluMetGly-185
SEQ. ID. NO. 18993    195-MetTyrArgLysProGlnThrAlaAspAspIleVal-206
SEQ. ID. NO. 18994    219-IleAspThrProAspSerAlaGlu-226
Hydrophilic Regions - Hopp-Woods
SEQ. ID. NO. 18995    39-TrpGluArgArgMetMetVal-45
SEQ. ID. NO. 18996    68-LeuArgAlaGlnAspIleGluThr-75
SEQ. ID. NO. 18997    81-LysGlyAlaGluMetAlaArgAlaSerGlu-90
SEQ. ID. NO. 18998    92-AlaTyrAlaArgAspGluVal-98
SEQ. ID. NO. 18999    120-PheLysThrAspGly-124
SEQ. ID. NO. 19000    149-ArgAlaAlaAspValValLeuLysGluArgArgArgLeu-161
SEQ. ID. NO. 19001    176-AspAsnMetLysArgValThrGlu-183
SEQ. ID. NO. 19002    195-MetTyrArgLysProGlnThrAlaAspAspIleVal-206
SEQ. ID. NO. 19003    220-AspThrProAspSerAlaGlu-226
a311-1
AMPHI Regions - AMPHI
SEQ. ID. NO. 19004    7-SerHisTrpArgValLeuAlaGluLeuAlaAspGlyLeuProGlnHisValSerGlnLeuAlaArgMetAlaAsp-31
SEQ. ID. NO. 19005    37-LeuAsnGlyPheTrpGlnGlnMetProAlaHisIleArgGlyLeuLeuArg-53
SEQ. ID. NO. 19006    55-HisAspGlyTyrTrpArgLeuValArgProLeuAlaValPheAspAlaGluGlyLeuArgGluLeuGly-77
SEQ. ID. NO. 19007    124-ArgGlnGlyArgLysTrpSerHisArgLeu-133
SEQ. ID. NO. 19008    165-ArgAlaLeuSerArgLeu-170
SEQ. ID. NO. 19009    219-ValGluAsnAlaAlaSerValGlnSerLeuPheGln-230
SEQ. ID. NO. 19010    245-GluThrLeuLeuAlaGlu-250
SEQ. ID. NO. 19011    291-PheGluGlyThrValLysGlyValAspGlyGlnGlyVal-303
SEQ. ID. NO. 19012    362-ThrValGlySerAlaProTyrArgAspLeuSerProLeu-374
SEQ. ID. NO. 19013    376-AlaGluTrpAlaGluLysVal-382
SEQ. ID. NO. 19014    391-CysAlaValCysGlyGluPheLysLys-399
SEQ. ID. NO. 19015    426-TyrArgHisProGluHisGlySerAspArgTrpPheAsnAlaLeuGlySer-443
SEQ. ID. NO. 19016    493-AsnLeuAsnArgHisAla-498
SEQ. ID. NO. 19017    511-AlaValAlaSerGlyMetMetAspAlaValCys-521
SEQ. ID. NO. 19018    550-AlaAlaLysValAlaGluAlaLeuProPro-559
SEQ. ID. NO. 19019    576-HisGlyLeuLeuAsnLeu-581
Antigenic Index - Jameson-Wolf
SEQ. ID. NO. 19020    28-ArgMetAlaAspMetLysProGlnGln-36
SEQ. ID. NO. 19021    50-GlyLeuLeuArgGlnHisAspGlyTyr-58
SEQ. ID. NO. 19022    71-GluGlyLeuArgGluLeuGlyGluArgSerGlyPhe-82
SEQ. ID. NO. 19023    86-LeuLysHisGluCysAlaSerSerAsnAspGluIleLeuGlu-99
SEQ. ID. NO. 19024    102-ArgIleAlaProAspLysAlaHisLys-110
SEQ. ID. NO. 19025    116-HisLeuGlnSerLysGlyArgGlyArgGlnGlyArgLysTrpSerHisArgLeuGlyGlu-135
SEQ. ID. NO. 19026    145-PheAspArgProGlnTyrGluLeuGlySer-154
SEQ. ID. NO. 19027    162-AlaCysArgArgAlaLeuSer-168
SEQ. ID. NO. 19028    174-ThrGlnIleLysTrpProAsn-180
SEQ. ID. NO. 19029    182-LeuValValGlyArgAspLysLeuGly-190
SEQ. ID. NO. 19030    196-ThrValArgThrGlyGlyLysThrVal-204
SEQ. ID. NO. 19031    215-LeuProLysGluValGluAsn-221
SEQ. ID. NO. 19032    231-ThrAlaSerArgArgGlyAsnAlaAsp-239
SEQ. ID. NO. 19033    258-TyrAlaArgAspGlyPheAla-264
SEQ. ID. NO. 19034    272-AlaAlaAsnArgAspHisGlyLys-279
SEQ. ID. NO. 19035    284-LeuArgAspGlyGluThrValPhe-291
SEQ. ID. NO. 19036    293-GlyThrValLysGlyValAspGlyGlnGly-302
SEQ. ID. NO. 19037    307-GluThrAlaGluGlyLysGlnThrValValSerGlyGluIleSerLeuArgSerAspAspArgProValSerValProLysArgArgAspSerGluArg-339
SEQ. ID. NO. 19038    344-AspGlyGlyAsnSerArgLeu-350
SEQ. ID. NO. 19039    364-GlySerAlaProTyrArgAspLeuSerProLeuGly-375

TABLE 1-continued

| | |
|---|---|
| SEQ. ID. NO. 19040 | 378-TrpAlaGluLysValAspGlyAsnValArgIle-388 |
| SEQ. ID. NO. 19041 | 395-GlyGluPheLysLysAlaGlnValGln-403 |
| SEQ. ID. NO. 19042 | 405-GlnLeuAlaArgLysIleGlu-411 |
| SEQ. ID. NO. 19043 | 424-AsnHisTyrArgHisProGluHisGlySerAspArgTrp-437 |
| SEQ. ID. NO. 19044 | 440-AlaLeuGlySerArgArgPheSerArgAsnAla-450 |
| SEQ. ID. NO. 19045 | 464-AlaLeuThrAspAspGlyHisTyrLeuGly-473 |
| SEQ. ID. NO. 19046 | 483-MetLysGluSerLeuAla-488 |
| SEQ. ID. NO. 19047 | 492-AlaAsnLeuAsnArgHisAlaGlyLysArgTyrPro-503 |
| SEQ. ID. NO. 19048 | 529-GlyArgLeuLysGluLysThrGlyAlaGlyLysProVal-541 |
| SEQ. ID. NO. 19049 | 547-GlyGlyGlyAlaAlaLysValAlaGlu-555 |
| SEQ. ID. NO. 19050 | 565-AsnThrValArgValAlaAsp-571 |
| SEQ. ID. NO. 19051 | 584-AlaGluGlyGlyGluSerGluHisThr-592 |
| Hydrophilic Regions - Hopp-Woods | |
| SEQ. ID. NO. 19052 | 28-ArgMetAlaAspMetLysProGlnGln-36 |
| SEQ. ID. NO. 19053 | 50-GlyLeuLeuArgGlnHis-55 |
| SEQ. ID. NO. 19054 | 71-GluGlyLeuArgGluLeuGlyGluArgSerGlyPhe-82 |
| SEQ. ID. NO. 19055 | 86-LeuLysHisGluCysAlaSerSerAsnAspGluIleLeuGlu-99 |
| SEQ. ID. NO. 19056 | 102-ArgIleAlaProAspLysAlaHisLys-110 |
| SEQ. ID. NO. 19057 | 118-GlnSerLysGlyArgGlyArgGlnGlyArgLysTrpSerHisArgLeuGlyGlu-135 |
| SEQ. ID. NO. 19058 | 162-AlaCysArgArgAlaLeuSer-168 |
| SEQ. ID. NO. 19059 | 183-ValValGlyArgAspLysLeuGly-190 |
| SEQ. ID. NO. 19060 | 196-ThrValArgThrGlyGlyLys-202 |
| SEQ. ID. NO. 19061 | 217-LysGluValGluAsn-221 |
| SEQ. ID. NO. 19062 | 232-AlaSerArgArgGlyAsnAlaAsp-239 |
| SEQ. ID. NO. 19063 | 259-AlaArgAspGlyPhe-263 |
| SEQ. ID. NO. 19064 | 272-AlaAlaAsnArgAspHisGlyLys-279 |
| SEQ. ID. NO. 19065 | 285-ArgAspGlyGluThrValPhe-291 |
| SEQ. ID. NO. 19066 | 293-GlyThrValLysGlyValAspGly-300 |
| SEQ. ID. NO. 19067 | 307-GluThrAlaGluGlyLysGlnThrValVal-316 |
| SEQ. ID. NO. 19068 | 320-IleSerLeuArgSerAspAspArgProValSerValProLysArgArgAspSerGluArg-339 |
| SEQ. ID. NO. 19069 | 346-GlyAsnSerArgLeu-350 |
| SEQ. ID. NO. 19070 | 367-ProTyrArgAspLeuSer-372 |
| SEQ. ID. NO. 19071 | 378-TrpAlaGluLysValAspGlyAsnVal-386 |
| SEQ. ID. NO. 19072 | 395-GlyGluPheLysLysAlaGlnVal-402 |
| SEQ. ID. NO. 19073 | 405-GlnLeuAlaArgLysIleGlu-411 |
| SEQ. ID. NO. 19074 | 424-AsnHisTyrArgHisProGluGluHisGlySer-434 |
| SEQ. ID. NO. 19075 | 442-GlySerArgArgPheSerArg-448 |
| SEQ. ID. NO. 19076 | 464-AlaLeuThrAspAspGlyHis-470 |
| SEQ. ID. NO. 19077 | 483-MetLysGluSerLeuAla-488 |
| SEQ. ID. NO. 19078 | 493-AsnLeuAsnArgHisAlaGlyLysArgTyrPro-503 |
| SEQ. ID. NO. 19079 | 529-GlyArgLeuLysGluLysThrGlyAlaGlyLysProVal-541 |
| SEQ. ID. NO. 19080 | 549-GlyAlaAlaLysValAlaGlu-555 |
| SEQ. ID. NO. 19081 | 565-AsnThrValArgValAlaAsp-571 |
| SEQ. ID. NO. 19082 | 585-GluGlyGlyGluSerGluHisThr-592 |
| a312 | |
| AMPHI Regions - AMPHI | |
| SEQ. ID. NO. 19083 | 6-GlyGluIleLeuGluThrValLysMetValAla-16 |
| SEQ. ID. NO. 19084 | 44-GlnAsnIleTyrAsnLysIleThrThrValGlyLys-55 |
| SEQ. ID. NO. 19085 | 82-IleAlaGlnIleAlaAlaAlaThr-89 |
| SEQ. ID. NO. 19086 | 95-ValSerValAlaGlnThrLeuAspLysAlaAlaLys-106 |
| SEQ. ID. NO. 19087 | 109-GlyValSerPheIleGlyGlyPheSerAlaLeuValGln-121 |
| SEQ. ID. NO. 19088 | 133-ArgSerIleProGluAlaMetLysThr-141 |
| SEQ. ID. NO. 19089 | 167-GlyGluThrIleLysArgThr-173 |
| SEQ. ID. NO. 19090 | 182-GlyCysAlaLysIleValValPheCys-190 |
| SEQ. ID. NO. 19091 | 230-SerAspAlaThrThrLeuThrGluValAlaGluValValLysLys-244 |
| SEQ. ID. NO. 19092 | 249-IleThrArgValGlyGluLeuIleGlyArgGluAlaSerLys-262 |
| SEQ. ID. NO. 19093 | 281-ValGlyAspSerValAlaArgIleLeuGluGluMetGly-293 |
| SEQ. ID. NO. 19094 | 309-LeuAsnAspAlaVal-313 |
| SEQ. ID. NO. 19095 | 322-SerAlaValGlyGlyLeuSerGly-329 |
| SEQ. ID. NO. 19096 | 349-LeuThrLeuAspLysLeuGluAlaMetThrAla-359 |
| SEQ. ID. NO. 19097 | 374-ThrProAlaHisThrIleSerGlyIleIle-383 |
| SEQ. ID. NO. 19098 | 409-ValGlyAspSerValGluPheGlyGlyLeuLeuGly-420 |
| Antigenic Index - Jameson-Wolf | |
| SEQ. ID. NO. 19099 | 4-GlnSerGlyGluIleLeuGlu-10 |
| SEQ. ID. NO. 19100 | 13-LysMetValAlaAspGlnAsnPheAspVal-22 |
| SEQ. ID. NO. 19101 | 35-IleSerThrAspIleAspVal-41 |
| SEQ. ID. NO. 19102 | 52-ThrValGlyLysAspLeuValAla-59 |
| SEQ. ID. NO. 19103 | 89-ThrHisAlaAspSer-93 |
| SEQ. ID. NO. 19104 | 100-ThrLeuAspLysAlaAlaLys-106 |
| SEQ. ID. NO. 19105 | 121-GlnLysGlyMetSerProSerAspGluValLeu-131 |
| SEQ. ID. NO. 19106 | 134-SerIleProGluAlaMetLysThrThrAsp-143 |
| SEQ. ID. NO. 19107 | 152-GlySerThrArgAla-156 |
| SEQ. ID. NO. 19108 | 161-AspAlaValArgLeuAlaGlyGluThrIleLysArgThrAlaGluIleThr-177 |
| SEQ. ID. NO. 19109 | 192-AlaValGluAspAsnProPhe-198 |
| SEQ. ID. NO. 19110 | 204-HisGlySerGlyGluAlaAspAla-211 |
| SEQ. ID. NO. 19111 | 225-AlaAlaLeuGluAsnSerAspAla-232 |
| SEQ. ID. NO. 19112 | 237-GluValAlaGluValValLys-243 |
| SEQ. ID. NO. 19113 | 251-ArgValGlyGluLeuIleGlyArgGluAlaSerLys-262 |
| SEQ. ID. NO. 19114 | 280-AlaValGlyAspSerValAlaArgIleLeuGlu-290 |
| SEQ. ID. NO. 19115 | 311-AspAlaValLysLysGlyGlyMet-318 |

TABLE 1-continued

| | |
|---|---|
| SEQ. ID. NO. 19116 | 334-ValSerGluAspGluGlyMet-340 |
| SEQ. ID. NO. 19117 | 352-AspLysLeuGluAla-356 |
| SEQ. ID. NO. 19118 | 370-ValProGlyAspThrProAla-376 |
| SEQ. ID. NO. 19119 | 383-IleAlaAspGluAlaAla-388 |
| SEQ. ID. NO. 19120 | 392-IleAsnSerLysThrThrAla-398 |
| SEQ. ID. NO. 19121 | 405-ThrGlyLysThrValGlyAspSerValGlu-414 |
| SEQ. ID. NO. 19122 | 426-ProValLysGluGlySerCys-432 |
| SEQ. ID. NO. 19123 | 435-PheValAsnArgGlyGlyArgIle-442 |
| SEQ. ID. NO. 19124 | 447-GlnSerMetLysAsn-451 |
| Hydrophilic Regions - Hopp-Woods | |
| SEQ. ID. NO. 19125 | 18-GlnAsnPheAspVal-22 |
| SEQ. ID. NO. 19126 | 35-IleSerThrAspIleAspVal-41 |
| SEQ. ID. NO. 19127 | 52-ThrValGlyLysAspLeuValAla-59 |
| SEQ. ID. NO. 19128 | 100-ThrLeuAspLysAlaAlaLys-106 |
| SEQ. ID. NO. 19129 | 123-GlyMetSerProSerAspGluValLeu-131 |
| SEQ. ID. NO. 19130 | 134-SerIleProGluAlaMetLysThrThrAsp-143 |
| SEQ. ID. NO. 19131 | 161-AspAlaValArgLeuAlaGlyGluThrIleLysArgThrAlaGluIleThr-177 |
| SEQ. ID. NO. 19132 | 192-AlaValGluAspAsnPro-197 |
| SEQ. ID. NO. 19133 | 207-GlyGluAlaAspAla-211 |
| SEQ. ID. NO. 19134 | 225-AlaAlaLeuGluAsnSerAspAla-232 |
| SEQ. ID. NO. 19135 | 237-GluValAlaGluValValLys-243 |
| SEQ. ID. NO. 19136 | 251-ArgValGlyGluLeuIleGlyArgGluAlaSerLys-262 |
| SEQ. ID. NO. 19137 | 284-SerValAlaArgIleLeuGlu-290 |
| SEQ. ID. NO. 19138 | 311-AspAlaValLysLysGlyGlyMet-318 |
| SEQ. ID. NO. 19139 | 334-ValSerGluAspGluGlyMet-340 |
| SEQ. ID. NO. 19140 | 352-AspLysLeuGluAla-356 |
| SEQ. ID. NO. 19141 | 383-IleAlaAspGluAlaAla-388 |
| SEQ. ID. NO. 19142 | 408-ThrValGlyAspSerValGlu-414 |
| SEQ. ID. NO. 19143 | 426-ProValLysGluGlySerCys-432 |
| SEQ. ID. NO. 19144 | 438-ArgGlyGlyArgIle-442 |
| SEQ. ID. NO. 19145 | 447-GlnSerMetLysAsn-451 |
| a313-2 | |
| AMPHI Regions - AMPHI | |
| SEQ. ID. NO. 19146 | 27-GlyMetAspAspProArgThrTyrGlySerGly-37 |
| SEQ. ID. NO. 19147 | 41-AlaThrAsnValLeu-45 |
| SEQ. ID. NO. 19148 | 60-AspAlaAlaLysGly-64 |
| SEQ. ID. NO. 19149 | 66-ValAlaValLeuLeuAlaArgValLeuGlnGluPro-77 |
| SEQ. ID. NO. 19150 | 88-ValAlaLeuAlaAlaLeuValGlyHisMetTrpPro-99 |
| SEQ. ID. NO. 19151 | 143-SerLeuAlaAlaLeuThrAlaThrIleAlaAlaProLeuAlaAla-157 |
| Antigenic Index - Jameson-Wolf | |
| SEQ. ID. NO. 19152 | 26-TyrGlyMetAspAspProArgThrTyrGlySerGlyAsnProGlyAla-41 |
| SEQ. ID. NO. 19153 | 46-ArgSerGlyLysLysLysAlaAla-53 |
| SEQ. ID. NO. 19154 | 73-ValLeuGlnGluProLeuGlyLeuSerAspSerAla-84 |
| SEQ. ID. NO. 19155 | 104-PheLysGlyGlyLysGlyVal-110 |
| SEQ. ID. NO. 19156 | 180-ArgHisLysSerAsn-184 |
| SEQ. ID. NO. 19157 | 189-IleLysGlyLysGluSerLysIleGlyGluLysArg-200 |
| Hydrophilic Regions - Hopp-Woods | |
| SEQ. ID. NO. 19158 | 26-TyrGlyMetAspAspProArgThrTyrGly-35 |
| SEQ. ID. NO. 19159 | 46-ArgSerGlyLysLysLysAlaAla-53 |
| SEQ. ID. NO. 19160 | 105-LysGlyGlyLysGlyVal-110 |
| SEQ. ID. NO. 19161 | 189-IleLysGlyLysGluSerLysIleGlyGluLysArg-200 |
| a401 | |
| AMPHI Regions - AMPHI | |
| SEQ. ID. NO. 19162 | 44-SerGlyValLysProTyrAsnAlaLeu-52 |
| SEQ. ID. NO. 19163 | 65-CysTyrAsnCysHisSerGlnMetIleArgProPheArg-77 |
| SEQ. ID. NO. 19164 | 112-ValGlyGlyArgTyrSerAspGluTrpHisArgIle-123 |
| SEQ. ID. NO. 19165 | 157-MetLysAlaLeuArgLysValGlyThr-165 |
| SEQ. ID. NO. 19166 | 172-IleAlaLysAlaProGluAlaLeu-179 |
| Antigenic Index - Jameson-Wolf | |
| SEQ. ID. NO. 19167 | 5-GlnLeuAlaGluGluLysIle-11 |
| SEQ. ID. NO. 19168 | 38-AlaAlaThrGlnProAlaSerGlyValLysProTyrAsn-50 |
| SEQ. ID. NO. 19169 | 55-AlaGlyArgAspIleTyrIleArgGluGlyCysTyrAsnCysHis-69 |
| SEQ. ID. NO. 19170 | 74-ArgProPheArgAlaGluThrGluArgTyrGlyHis-85 |
| SEQ. ID. NO. 19171 | 90-GlyGluSerValTyr-94 |
| SEQ. ID. NO. 19172 | 98-PheGlnTrpGlySerLysArgThrGlyProAspLeuAlaArgValGlyGlyArgTyrSerAspGluTrpHis-121 |
| SEQ. ID. NO. 19173 | 125-LeuLeuAsnProArgAspValValProGluSerAsnMetPro-138 |
| SEQ. ID. NO. 19174 | 146-AsnLysValAspValAspAla-152 |
| SEQ. ID. NO. 19175 | 158-LysAlaLeuArgLysValGlyThrProTyrSerAspGluGluIleAlaLysAlaProGlu-177 |
| SEQ. ID. NO. 19176 | 179-LeuAlaAsnLysSerGluLeuAspAla-187 |
| Hydrophilic Regions - Hopp-Woods | |
| SEQ. ID. NO. 19177 | 5-GlnLeuAlaGluGluLysIle-11 |
| SEQ. ID. NO. 19178 | 76-PheArgAlaGluThrGluArgTyrGly-84 |
| SEQ. ID. NO. 19179 | 101-GlySerLysArgThrGlyProAspLeuAlaArgValGlyGlyArgTyrSerAspGluTrpHis-121 |
| SEQ. ID. NO. 19180 | 127-AsnProArgAspValValPro-133 |
| SEQ. ID. NO. 19181 | 146-AsnLysValAspValAspAla-152 |
| SEQ. ID. NO. 19182 | 158-LysAlaLeuArgLysValGly-164 |

TABLE 1-continued

| | |
|---|---|
| SEQ. ID. NO. 19183 | 167-TyrSerAspGluGluIleAlaLysAlaProGlu-177 |
| SEQ. ID. NO. 19184 | 179-LeuAlaAsnLysSerGluLeuAspAla-187 | a402
AMPHI Regions - AMPHI

| | |
|---|---|
| SEQ. ID. NO. 19185 | 18-PheLeuSerGlyLeu-22 |
| SEQ. ID. NO. 19186 | 85-AlaGlyIleAlaAspPhe-90 |
| SEQ. ID. NO. 19187 | 100-ThrGlyPheSerGlyPheValHis-107 |
| SEQ. ID. NO. 19188 | 117-AlaValValArgGlyLeu-122 |
| SEQ. ID. NO. 19189 | 136-LysSerGlyArgGln-140 |
| SEQ. ID. NO. 19190 | 146-PheAlaAsnValAlaGly-151 |
| SEQ. ID. NO. 19191 | 218-ValPheGlnAsnIleAlaAspArgProAspArgLeuIle-230 |
| SEQ. ID. NO. 19192 | 261-AspValPheAsnSerValAsnGlyIleGlu-270 |
| SEQ. ID. NO. 19193 | 279-LysSerGlyIleArg-283 |
| SEQ. ID. NO. 19194 | 294-SerTrpAlaArgValLeuSerAlaIleProGluMetGln-306 |
| SEQ. ID. NO. 19195 | 344-ArgLysTrpLeuArgArgHisPro-351 |
| SEQ. ID. NO. 19196 | 376-AlaGluPheLeuLysGlnValGlnSerHisLeu-386 |
| SEQ. ID. NO. 19197 | 398-HisSerProHisAlaPheAlaThrAlaValHisSerIlePro-411 |
| SEQ. ID. NO. 19198 | 437-GlnArgLeuSerArgLeu-442 |
| SEQ. ID. NO. 19199 | 460-AlaAlaGlnLysVal-464 |

Antigenic Index - Jameson-Wolf

| | |
|---|---|
| SEQ. ID. NO. 19200 | 4-ValAsnThrLysProAsnThrSer-11 |
| SEQ. ID. NO. 19201 | 66-ArgIleCysArgSerArgPheValAsp-74 |
| SEQ. ID. NO. 19202 | 130-ValGlyThrAspGlyAsnLysSerGlyArgGlnValSer-142 |
| SEQ. ID. NO. 19203 | 222-IleAlaAspArgProAspArgLeuIleGluAsnLysHisGly-235 |
| SEQ. ID. NO. 19204 | 240-TyrHisArgAspGlyAspLysValVal-248 |
| SEQ. ID. NO. 19205 | 264-AsnSerValAsnGlyIleGluArg-271 |
| SEQ. ID. NO. 19206 | 277-SerLeuLysSerGlyIleArgArg-284 |
| SEQ. ID. NO. 19207 | 321-IleAlaAspGluProGln-326 |
| SEQ. ID. NO. 19208 | 331-LeuGlnAspLysArgValGluIleValLeuAspAspGlyArgLysTrpLeuArgArgHisProAspGluLysPheAsp-356 |
| SEQ. ID. NO. 19209 | 385-HisLeuThrProAspGly-390 |
| SEQ. ID. NO. 19210 | 429-PheProAsnLysGluLeuLeuLysGlnArgLeuSer-440 |
| SEQ. ID. NO. 19211 | 444-TrpProGluSerGlyArgHisValPheAspSerSerThrVal-457 |
| SEQ. ID. NO. 19212 | 472-MetThrGluProSerAlaGly-478 |
| SEQ. ID. NO. 19213 | 481-ValIleThrAspAspAsnMet-487 |
| SEQ. ID. NO. 19214 | 489-ValGluTyrLysTyrGlyArgGlyIle-497 |

Hydrophilic Regions - Hopp-Woods

| | |
|---|---|
| SEQ. ID. NO. 19215 | 131-GlyThrAspGlyAsnLysSerGlyArgGlnVal-141 |
| SEQ. ID. NO. 19216 | 222-IleAlaAspArgProAspArgLeuIleGluAsnLysHis-234 |
| SEQ. ID. NO. 19217 | 241-HisArgAspGlyAspLysValVal-248 |
| SEQ. ID. NO. 19218 | 278-LeuLysSerGlyIleArg-283 |
| SEQ. ID. NO. 19219 | 321-IleAlaAspGluProGln-326 |
| SEQ. ID. NO. 19220 | 331-LeuGlnAspLysArgValGluIleValLeuAspAspGlyArgLysTrpLeuArgArgHisProAspGluLysPheAsp-356 |
| SEQ. ID. NO. 19221 | 430-ProAsnLysGluLeuLeuLysGlnArgLeuSer-440 |
| SEQ. ID. NO. 19222 | 446-GluSerGlyArgHisValPhe-452 |
| SEQ. ID. NO. 19223 | 473-ThrGluProSerAlaGly-478 |
| SEQ. ID. NO. 19224 | 481-ValIleThrAspAspAsnMet-487 | a501
AMPHI Regions - AMPHI

| | |
|---|---|
| SEQ. ID. NO. 19225 | 63-ValGluValLeuGlnGluLeuPheArgGlnTyrArgValAlaArgGlnLeu-79 |
| SEQ. ID. NO. 19226 | 88-ValPheAlaAlaPheGlnAlaVal-95 |
| SEQ. ID. NO. 19227 | 97-PheGlnGlyPheAspAsnGlyPhe-104 |
| SEQ. ID. NO. 19228 | 126-AlaAspAlaPheGlnGly-131 |
| SEQ. ID. NO. 19229 | 139-ValPheGluValValGlyAspIleThrArgArgThrThrGluAla-153 |
| SEQ. ID. NO. 19230 | 183-AspGlyPheThrArgIleAsnArgCysGlyGlnCys-194 |
| SEQ. ID. NO. 19231 | 196-HisAlaPheGlyAspPheIleAsp-203 |
| SEQ. ID. NO. 19232 | 252-AlaPheAlaGlyGlnVal-257 |
| SEQ. ID. NO. 19233 | 270-HisHisAspPheTyrArgCysPheArgHisValValGlnSerAsnIleGlyAsnLeu-288 |
| SEQ. ID. NO. 19234 | 306-TyrGlyAsnPheLeuThrValPheGlnGlnPheGlyCys-318 |
| SEQ. ID. NO. 19235 | 364-GlyAsnGlnTyrValAlaGlyPhe-371 |
| SEQ. ID. NO. 19236 | 438-AlaSerProPheAsp-442 |
| SEQ. ID. NO. 19237 | 458-ArgGlnLeuGlyAspPhe-463 |
| SEQ. ID. NO. 19238 | 511-PheGlnArgGlyPheGluHisIleGlu-519 |
| SEQ. ID. NO. 19239 | 528-TyrAspValPheAlaGln-533 |

Antigenic Index - Jameson-Wolf

| | |
|---|---|
| SEQ. ID. NO. 19240 | 6-LeuThrAlaAspAla-10 |
| SEQ. ID. NO. 19241 | 17-AlaAlaGlyGlyAspGlyLysVal-24 |
| SEQ. ID. NO. 19242 | 26-HisHisPheAspGly-30 |
| SEQ. ID. NO. 19243 | 46-ValGluThrGluGlyGln-51 |
| SEQ. ID. NO. 19244 | 56-ValArgAlaAspGlyGluAlaValGluVal-65 |
| SEQ. ID. NO. 19245 | 100-PheAspAsnGlyPhe-104 |
| SEQ. ID. NO. 19246 | 108-GlnSerAlaAspGluArgAsnHisAspPheAsnValGlyGln-121 |
| SEQ. ID. NO. 19247 | 144-GlyAspIleThrArgArgThrThrGluAlaGlnHis-155 |
| SEQ. ID. NO. 19248 | 179-GlyHisThrAspAspGlyPheThrArgIleAsnArgCysGlyGlnCys-194 |
| SEQ. ID. NO. 19249 | 202-IleAspValGluValAspArgGlyArgValThrGlyAspThrAlaGlyAsnPhe-219 |
| SEQ. ID. NO. 19250 | 230-GlnGlnGlyPheGlyValAspThrAspLeuAlaValAspAspLysPheHisThrArgGlnAlaAsp-251 |
| SEQ. ID. NO. 19251 | 257-ValGlyGluAlaGluCysGluPheGly-265 |
| SEQ. ID. NO. 19252 | 269-ValHisHisAspPheTyrArgCys-276 |
| SEQ. ID. NO. 19253 | 294-GlyValAspGluAlaGly-299 |
| SEQ. ID. NO. 19254 | 320-AlaAlaAlaAspAsnGlyArgAsnThrGlnPheAlaArgAspAspGlyGlyValAlaGlyThrSerAlaProValGlyHisAspGlyGlySer-350 |
| SEQ. ID. NO. 19255 | 405-ValAspArgLysAlaAla-410 |

TABLE 1-continued

| SEQ. ID. NO. 19256 | 420-PheAspGlyPheGlyThrGlyLeuGlnAsp-429 |
|---|---|
| SEQ. ID. NO. 19257 | 439-SerProPheAspValHisArg-445 |
| SEQ. ID. NO. 19258 | 477-AspIleAspValGlyTyr-482 |
| SEQ. ID. NO. 19259 | 490-ValGlyLysAsnHisPheAsp-496 |
| SEQ. ID. NO. 19260 | 502-PheAlaGlnAspGlyArgPhe-508 |
| SEQ. ID. NO. 19261 | 512-GlnArgGlyPheGluHis-517 |
| SEQ. ID. NO. 19262 | 535-ValGlySerAspLysAspAspLeuVal-543 |
| SEQ. ID. NO. 19263 | 548-GlyIleGluGlyGluHisHisThr-555 |

Hydrophilic Regions - Hopp-Woods

| SEQ. ID. NO. 19264 | 6-LeuThrAlaAspAla-10 |
|---|---|
| SEQ. ID. NO. 19265 | 19-GlyGlyAspGlyLysVal-24 |
| SEQ. ID. NO. 19266 | 46-ValGluThrGluGlyGln-51 |
| SEQ. ID. NO. 19267 | 56-ValArgAlaAspGlyGluAlaValGluVal-65 |
| SEQ. ID. NO. 19268 | 108-GlnSerAlaAspGluArgAsnHisAsp-116 |
| SEQ. ID. NO. 19269 | 144-GlyAspIleThrArgArgThrThrGluAlaGlnHis-155 |
| SEQ. ID. NO. 19270 | 179-GlyHisThrAspAspGlyPheThrArgIleAsnArg-190 |
| SEQ. ID. NO. 19271 | 202-IleAspValGluValAspArgGlyArgValThrGlyAspThr-215 |
| SEQ. ID. NO. 19272 | 237-ThrAspLeuAlaValAspAspLysPheHisThrArgGlnAlaAsp-251 |
| SEQ. ID. NO. 19273 | 257-ValGlyGluAlaGluCysGluPheGly-265 |
| SEQ. ID. NO. 19274 | 294-GlyValAspGluAlaGly-299 |
| SEQ. ID. NO. 19275 | 323-AspAsnGlyArgAsnThrGlnPheAlaArgAspAspGlyGlyVal-337 |
| SEQ. ID. NO. 19276 | 344-ValGlyHisAspGly-348 |
| SEQ. ID. NO. 19277 | 405-ValAspArgLysAlaAla-410 |
| SEQ. ID. NO. 19278 | 535-ValGlySerAspLysAspAspLeuVal-543 |
| SEQ. ID. NO. 19279 | 549-IleGluGlyGluHisHisThr-555 | a502-1
AMPHI Regions - AMPHI

| SEQ. ID. NO. 19280 | 6-AsnLeuPheGlnPheLeuAlaVal-13 |
|---|---|
| SEQ. ID. NO. 19281 | 26-GlyAlaValAspAlaLeuLysGlnPheAsnAsnAspAlaAspGlyIleSerGlySerPheThrGln-47 |
| SEQ. ID. NO. 19282 | 98-GlnValThrLysSerSerGlnAsp-105 |

Antigenic Index - Jameson-Wolf

| SEQ. ID. NO. 19283 | 32-LysGlnPheAsnAsnAspAlaAspGlyIleSerGlySer-44 |
|---|---|
| SEQ. ID. NO. 19284 | 48-ThrValGlnSerLysLysLysThrGlnThrAlaHisGlyThr-61 |
| SEQ. ID. NO. 19285 | 74-TyrThrSerProTyrLysGlnThrIle-82 |
| SEQ. ID. NO. 19286 | 98-GlnValThrLysSerSerGlnAspGlnAlaIleGlyGlySerPro-112 |
| SEQ. ID. NO. 19287 | 116-LeuSerAsnLysThrAlaLeuGluSerSerTyrThrLeuLysGluAspGlySerSerAsnGly-136 |
| SEQ. ID. NO. 19288 | 142-AlaThrProLysArgAsnAsnAlaGly-150 |
| SEQ. ID. NO. 19289 | 158-PheLysGlyGlyAsn-162 |
| SEQ. ID. NO. 19290 | 167-GlnLeuLysAspSerPheGlyAsnGlnThr-176 |
| SEQ. ID. NO. 19291 | 184-AsnThrAsnProGlnLeuSerArgGlyAlaPhe-194 |
| SEQ. ID. NO. 19292 | 196-PheThrProProLysGlyValAspVal-204 |

Hydrophilic Regions - Hopp-Woods

| SEQ. ID. NO. 19293 | 34-PheAsnAsnAspAlaAspGlyIle-41 |
|---|---|
| SEQ. ID. NO. 19294 | 49-ValGlnSerLysLysLysThrGlnThr-57 |
| SEQ. ID. NO. 19295 | 100-ThrLysSerSerGlnAspGlnAlaIle-108 |
| SEQ. ID. NO. 19296 | 126-TyrThrLeuLysGluAspGlySerSerAsn-135 |
| SEQ. ID. NO. 19297 | 143-ThrProLysArgAsnAsnAla-149 |
| SEQ. ID. NO. 19298 | 167-GlnLeuLysAspSerPheGly-173 | a503-1
AMPHI Regions - AMPHI

| SEQ. ID. NO. 19299 | 6-TyrArgGluAlaAsnThrTrp-12 |
|---|---|
| SEQ. ID. NO. 19300 | 96-SerSerThrSerAsnPheAlaSerAlaAlaGluMetArgSerLeu-110 |

Antigenic Index - Jameson-Wolf

| SEQ. ID. NO. 19301 | 4-SerLeuTyrArgGluAlaAsnThr-11 |
|---|---|
| SEQ. ID. NO. 19302 | 26-ArgLysValSerCys-30 |
| SEQ. ID. NO. 19303 | 32-ProAlaAsnAspAlaSerGlyArgSerSerAlaValAlaGluGluArgThrAlaThrGluMetSerAlaProProAla-57 |
| SEQ. ID. NO. 19304 | 69-SerAlaSerSerCysSerGlyLysGlyValSer-79 |
| SEQ. ID. NO. 19305 | 87-LeuProThrArgAlaSerSerAlaThrSerSerThrSerAsn-100 |
| SEQ. ID. NO. 19306 | 105-AlaGluMetArgSerLeuArg-111 |
| SEQ. ID. NO. 19307 | 113-LeuCysAlaArgAsnAlaArg-119 |

Hydrophilic Regions - Hopp-Woods

| SEQ. ID. NO. 19308 | 4-SerLeuTyrArgGlu-8 |
|---|---|
| SEQ. ID. NO. 19309 | 35-AspAlaSerGlyArgSerSerAlaValAlaGluGluArgThrAlaThrGluMetSerAla-54 |
| SEQ. ID. NO. 19310 | 73-CysSerGlyLysGlyValSer-79 |
| SEQ. ID. NO. 19311 | 89-ThrArgAlaSerSer-93 |
| SEQ. ID. NO. 19312 | 105-AlaGluMetArgSerLeuArg-111 | a505
AMPHI Regions - AMPHI

| SEQ. ID. NO. 19313 | 20-LeuThrAlaLeuLeuLysCysLeuSerLeuLeuProLeuSerCysLeu-35 |
|---|---|
| SEQ. ID. NO. 19314 | 37-ThrLeuGlyAsnArg-41 |
| SEQ. ID. NO. 19315 | 89-ProAlaPhePheArgLysProGluAspIleGluThrMetPheLysAlaValHisGlyTrpGluHisValGlnGlnAlaLeuAsp-116 |
| SEQ. ID. NO. 19316 | 148-AlaMetTyrLysProProLysIleLysAlaIleAspLysIleMetGlnAlaGly-165 |
| SEQ. ID. NO. 19317 | 178-IleGlnGlyValLysGlnIleIleLysAlaLeuArg-189 |
| SEQ. ID. NO. 19318 | 210-GlyValTrpValAspPhePheGlyLysPro-219 |

Antigenic Index - Jameson-Wolf

| SEQ. ID. NO. 19319 | 38-LeuGlyAsnArgLeuGly-43 |
|---|---|
| SEQ. ID. NO. 19320 | 50-LeuLysGluAspArgAlaArgIle-57 |
| SEQ. ID. NO. 19321 | 62-ArgGlnAlaGlyMetAsnProAspProLysThrVal-73 |
| SEQ. ID. NO. 19322 | 79-GluThrAlaLysGlyGlyLeu-85 |
| SEQ. ID. NO. 19323 | 92-PheArgLysProGluAspIleGluThr-100 |

TABLE 1-continued

| | |
|---|---|
| SEQ. ID. NO. 19324 | 114-AlaLeuAspLysHisGlu-119 |
| SEQ. ID. NO. 19325 | 129-GlySerTyrAspLeuGlyGlyArgTyrIleSer-139 |
| SEQ. ID. NO. 19326 | 142-LeuProPheProLeu-146 |
| SEQ. ID. NO. 19327 | 150-TyrLysProProLysIleLysAlaIleAspLysIleMetGln-163 |
| SEQ. ID. NO. 19328 | 165-GlyArgValArgGlyLysGlyLysThrAlaProThrSer-177 |
| SEQ. ID. NO. 19329 | 183-GlnIleIleLysAlaLeuArgSerGlyGluAlaThr-194 |
| SEQ. ID. NO. 19330 | 198-ProAspHisValProSerProGlnGluGlyGlyGluGlyVal-211 |
| SEQ. ID. NO. 19331 | 242-CysGluArgLeuProGlyGlyGlnGly-250 |
| SEQ. ID. NO. 19332 | 257-ProValGlnGlyGluLeuAsnGlyAspLysAlaHisAsp-269 |
| SEQ. ID. NO. 19333 | 292-TyrAsnArgTyrLysMetPro-298 |

Hydrophilic Regions - Hopp-Woods

| | |
|---|---|
| SEQ. ID. NO. 19334 | 50-LeuLysGluAspArgAlaArgIle-57 |
| SEQ. ID. NO. 19335 | 62-ArgGlnAlaGlyMetAsnProAspProLysThrVal-73 |
| SEQ. ID. NO. 19336 | 79-GluThrAlaLysGlyGlyLeu-85 |
| SEQ. ID. NO. 19337 | 92-PheArgLysProGluAspIleGluThr-100 |
| SEQ. ID. NO. 19338 | 114-AlaLeuAspLysHisGlu-119 |
| SEQ. ID. NO. 19339 | 151-LysProProLysIleLysAlaIleAspLysIleMetGln-163 |
| SEQ. ID. NO. 19340 | 165-GlyArgValArgGlyLysGlyLysThrAlaPro-175 |
| SEQ. ID. NO. 19341 | 183-GlnIleIleLysAlaLeuArgSerGlyGlu-192 |
| SEQ. ID. NO. 19342 | 201-ValProSerProGlnGluGlyGlyGlu-209 |
| SEQ. ID. NO. 19343 | 258-ValGlnGlyGluLeuAsnGlyAspLysAlaHisAsp-269 | a506
AMPHI Regions - AMPHI

| | |
|---|---|
| SEQ. ID. NO. 19344 | 6-GluValGlyArgValAlaHisCysGlyGlyGlyVal-17 |
| SEQ. ID. NO. 19345 | 25-ArgValValHisGlnValGluGlnGlyAlaArg-35 |
| SEQ. ID. NO. 19346 | 53-AlaValAspPheGlnArgArgPhe-60 |
| SEQ. ID. NO. 19347 | 99-AlaThrArgThrValAspArgAspLeuAlaGluVal-110 |
| SEQ. ID. NO. 19348 | 138-GlyAsnGluValAlaArgCys-144 |
| SEQ. ID. NO. 19349 | 180-GlnValLysArgMetIleArgHisPhePheArg-190 |
| SEQ. ID. NO. 19350 | 199-ValHisArgProPheArgLysLeuAlaAlaLeuAspGlyPheValGlnVal-215 |
| SEQ. ID. NO. 19351 | 224-GlyAspAspPheGlyGlyPhePheValGlyGlnValPheAsnAlaLeuLeu-240 |
| SEQ. ID. NO. 19352 | 313-PheValGlnValGlyGluLeuThrArgValAlaGlnGluGlu-326 |
| SEQ. ID. NO. 19353 | 372-GlyPhePheAlaAspPheAlaGluAspPheGlyAlaGlyValPheGlyAspValValArgTyrGlyLysArgThr-396 |
| SEQ. ID. NO. 19354 | 408-PheGlyAspAspPheAlaHisGluValGlyGlu-418 |
| SEQ. ID. NO. 19355 | 427-ArgGlnGlnArgAlaAlaArgThr-434 |

Antigenic Index - Jameson-Wolf

| | |
|---|---|
| SEQ. ID. NO. 19356 | 13-CysGlyGlyGlyValAla-18 |
| SEQ. ID. NO. 19357 | 31-GluGlnGlyAlaArgLeu-36 |
| SEQ. ID. NO. 19358 | 48-ProValArgArgValAlaValAspPheGlnArgArgPheGlyGluVal-63 |
| SEQ. ID. NO. 19359 | 98-ArgAlaThrArgThrValAspArgAspLeuAlaGlu-109 |
| SEQ. ID. NO. 19360 | 134-GlyAlaAspThrGlyAsnGluValAlaArgCysGluGly-146 |
| SEQ. ID. NO. 19361 | 176-ProAsnPheGlyGlnValLysArgMetIle-185 |
| SEQ. ID. NO. 19362 | 192-GlyPheArgHisAspLeuAspValHisArgProPheArgLys-205 |
| SEQ. ID. NO. 19363 | 223-ValGlyAspAspPheGlyGly-229 |
| SEQ. ID. NO. 19364 | 244-MetGluPheHisProLysThr-250 |
| SEQ. ID. NO. 19365 | 259-ValGlyMetArgThrGluAla-265 |
| SEQ. ID. NO. 19366 | 289-GlyGlnGlnArgProGluValProVal-297 |
| SEQ. ID. NO. 19367 | 318-GluLeuThrArgValAlaGlnGluGluHisGlyArgValValAla-332 |
| SEQ. ID. NO. 19368 | 343-GluLeuGlnArgLysThrAlaAsp-350 |
| SEQ. ID. NO. 19369 | 362-CysHisGlyGlyGluThrGlyGlu-369 |
| SEQ. ID. NO. 19370 | 377-PheAlaGluAspPheGly-382 |
| SEQ. ID. NO. 19371 | 389-ValValArgTyrGlyLysArgThrGluArgAlaArgThr-401 |
| SEQ. ID. NO. 19372 | 408-PheGlyAspAspPheAlaHisGluVal-416 |
| SEQ. ID. NO. 19373 | 424-GlnIleLeuArgGlnGlnArgAlaAlaArgThrGlyGlyGln-437 |
| SEQ. ID. NO. 19374 | 442-ValGlyAsnArgArgAlaVal-448 |
| SEQ. ID. NO. 19375 | 458-PheGlyGlyXxxHisArgSerCysSer-466 |
| SEQ. ID. NO. 19376 | 471-GlyGlnXxxGlyGlyLysArgLeuThrValArgPheGlyGlyLysArgIleArgAsnArgPheLeuAspCysAsnLysPheLeuGlu-499 |
| SEQ. ID. NO. 19377 | 510-MetAspAlaThrIleArgGlnAspPheArgTyr-520 |

Hydrophilic Regions - Hopp-Woods

| | |
|---|---|
| SEQ. ID. NO. 19378 | 31-GluGlnGlyAlaArgLeu-36 |
| SEQ. ID. NO. 19379 | 48-ProValArgArgValAlaValAspPheGlnArgArgPheGlyGlu-62 |
| SEQ. ID. NO. 19380 | 98-ArgAlaThrArgThrValAspArgAspLeuAlaGlu-109 |
| SEQ. ID. NO. 19381 | 136-AspThrGlyAsnGluValAlaArgCysGluGly-146 |
| SEQ. ID. NO. 19382 | 180-GlnValLysArgMetIle-185 |
| SEQ. ID. NO. 19383 | 195-HisAspLeuAspVal-199 |
| SEQ. ID. NO. 19384 | 201-ArgProPheArgLys-205 |
| SEQ. ID. NO. 19385 | 223-ValGlyAspAspPhe-227 |
| SEQ. ID. NO. 19386 | 244-MetGluPheHisPro-248 |
| SEQ. ID. NO. 19387 | 259-ValGlyMetArgThrGluAla-265 |
| SEQ. ID. NO. 19388 | 291-GlnArgProGluVal-295 |
| SEQ. ID. NO. 19389 | 318-GluLeuThrArgValAlaGlnGluGluHisGlyArgValValAla-332 |
| SEQ. ID. NO. 19390 | 343-GluLeuGlnArgLysThrAlaAsp-350 |
| SEQ. ID. NO. 19391 | 364-GlyGlyGluThrGlyGlu-369 |
| SEQ. ID. NO. 19392 | 377-PheAlaGluAspPheGly-382 |
| SEQ. ID. NO. 19393 | 390-ValArgTyrGlyLysArgThrGluArgAlaArgThr-401 |
| SEQ. ID. NO. 19394 | 408-PheGlyAspAspPheAlaHisGluVal-416 |
| SEQ. ID. NO. 19395 | 425-IleLeuArgGlnGlnArgAlaAlaArgThrGlyGly-436 |
| SEQ. ID. NO. 19396 | 443-GlyAsnArgArgAlaVal-448 |
| SEQ. ID. NO. 19397 | 473-XxxGlyGlyLysArgLeuThr-479 |
| SEQ. ID. NO. 19398 | 482-PheGlyGlyLysArgIleArgAsnArgPheLeuAsp-493 |

TABLE 1-continued

| SEQ. ID. NO. 19399 | 510-MetAspAlaThrIleArgGlnAspPheArgTyr-520 | a513
AMPHI Regions - AMPHI

| SEQ. ID. NO. 19400 | 6-ThrGluTrpLeuHisGlyTrpValGlyAlaIleAsnAspProMetTrp-21 |
| SEQ. ID. NO. 19401 | 23-TyrLeuValTyrXxxLeu-28 |
| SEQ. ID. NO. 19402 | 48-GlyArgSerIleLysGlu-53 |
| SEQ. ID. NO. 19403 | 66-GlyIleThrProPheGlnAlaPheValThrGlyLeuAla-78 |
| SEQ. ID. NO. 19404 | 119-SerSerLeuAlaGlnLeuPheLysValArgAsp-129 |
| SEQ. ID. NO. 19405 | 146-GlyLeuGlyGlnLysTrpLeuGlyVal-154 |
| SEQ. ID. NO. 19406 | 176-IleAlaAspThrVal-180 |
| SEQ. ID. NO. 19407 | 205-GlyGlyIleArgArgIleSerLysAlaAla-214 |
| SEQ. ID. NO. 19408 | 243-ValPheGlyGlnIlePheSer-249 |
| SEQ. ID. NO. 19409 | 259-GlyGlyLeuLeuGlyGlyLeuIle-266 |
| SEQ. ID. NO. 19410 | 288-AlaProAsnAlaAlaAlaAlaAla-295 |
| SEQ. ID. NO. 19411 | 303-GlnGlyMetIleGlnMetLeuGlyValPheValAsp-314 |
| SEQ. ID. NO. 19412 | 332-ProTyrGlyAspLeu-336 |
| SEQ. ID. NO. 19413 | 347-ValSerGlnValGlyGlnTrp-353 |
| SEQ. ID. NO. 19414 | 391-ThrAlaValPheArgMet-396 |
| SEQ. ID. NO. 19415 | 403-TyrPheGlyAlaValAla-408 |
| SEQ. ID. NO. 19416 | 423-IleMetAlaTrpIleAsnLeuValAlaIleLeuLeuLeuSer-436 |

Antigenic Index - Jameson-Wolf

| SEQ. ID. NO. 19417 | 1-MetAsnGluAsnPhe-5 |
| SEQ. ID. NO. 19418 | 48-GlyArgSerIleLysGluMetLeuGlyGlyArgLysGlnGlyAspAspProHisGly-66 |
| SEQ. ID. NO. 19419 | 126-LysValArgAspTyrAspAsnHisHisPheArgGlyGlyProAla-140 |
| SEQ. ID. NO. 19420 | 208-ArgArgIleSerLysAlaAlaGlu-215 |
| SEQ. ID. NO. 19421 | 273-GlyIleLysArgGlyLeuTyrSerAsnGluAlaGlyMetGlySerAlaProAsnAla-291 |
| SEQ. ID. NO. 19422 | 295-AlaGluValLysHisProVal-301 |
| SEQ. ID. NO. 19423 | 331-GlnProTyrGlyAspLeuSerGly |
| SEQ. ID. NO. 19424 | 375-AlaTyrAlaGluSerAsnVal-381 |
| SEQ. ID. NO. 19425 | 444-ArgAspTyrThrAlaLysLeuLysMetGlyLysAspProGluPheLysLeuSerGluHisProGlyLeuLysArgArgIleLysSerAspValTrp-475 |

Hydrophilic Regions - Hopp-Woods

| SEQ. ID. NO. 19426 | 48-GlyArgSerIleLysGluMetLeuGlyGlyArgLysGlnGlyAspAspProHisGly-66 |
| SEQ. ID. NO. 19427 | 126-LysValArgAspTyrAspAsnHisHis-134 |
| SEQ. ID. NO. 19428 | 208-ArgArgIleSerLysAlaAlaGlu-215 |
| SEQ. ID. NO. 19429 | 273-GlyIleLysArgGlyLeuTyr-279 |
| SEQ. ID. NO. 19430 | 295-AlaGluValLysHis-299 |
| SEQ. ID. NO. 19431 | 450-LeuLysMetGlyLysAspProGluPheLysLeuSerGlu-462 |
| SEQ. ID. NO. 19432 | 464-ProGlyLeuLysArgArgIleLysSer-472 | a515-1
AMPHI Regions - AMPHI

| SEQ. ID. NO. 19433 | 8-ArgAlaAlaGlyValAlaArgGlyLeuHisSerGluPheAlaArg-22 |
| SEQ. ID. NO. 19434 | 59-AspValArgPheAlaGlnValGluGluIleGlyGlnAspPheAlaAspAla-77 |
| SEQ. ID. NO. 19435 | 90-AlaGlyGluCysAlaAspGluValSerAspLysThr-101 |
| SEQ. ID. NO. 19436 | 122-GluSerAlaGlnSerAlaAlaGlyGlyGlyLeuThrAspGlyPheGly-137 |
| SEQ. ID. NO. 19437 | 176-CysGlyLysThrValGlyVal-182 |
| SEQ. ID. NO. 19438 | 198-GlyValPheAspAla-202 |
| SEQ. ID. NO. 19439 | 233-ValAlaAspValLeuArg-238 |
| SEQ. ID. NO. 19440 | 251-PheGlyGlyValAlaGlyAspValGlyGlyGlyAlaAspGlyValAlaGlnGlyLeuPheGlyGluIleGlyGlyAla-276 |

Antigenic Index - Jameson-Wolf

| SEQ. ID. NO. 19441 | 24-ValThrAlaGluGluIleAlaPhe-31 |
| SEQ. ID. NO. 19442 | 38-HisGluAlaArgCysGlyGlyAsn-45 |
| SEQ. ID. NO. 19443 | 51-IleAlaAlaAlaGluArgAlaGlyAsp-59 |
| SEQ. ID. NO. 19444 | 67-GluGluIleGlyGln-71 |
| SEQ. ID. NO. 19445 | 77-AlaValAspGlnGluThr-82 |
| SEQ. ID. NO. 19446 | 84-LeuAlaValGluArgSerAlaGlyGluCysAlaAspGluValSerAspLysThrAlaArgAsnGlyGlyIleGluGluAspGlyValValAlaCysArgAspAlaAlaAlaAlaGluSerAlaGln-125 |
| SEQ. ID. NO. 19447 | 128-AlaGlyGlyGlyLeuThrAspGly-135 |
| SEQ. ID. NO. 19448 | 160-GlyGlyAsnAspAlaAlaGlyAsn-167 |
| SEQ. ID. NO. 19449 | 192-LeuHisArgArgAla-196 |
| SEQ. ID. NO. 19450 | 217-AlaAspGlyGlyPheArg-222 |
| SEQ. ID. NO. 19451 | 242-GlyValGlyLysSerGlyAla-248 |
| SEQ. ID. NO. 19452 | 257-AspValGlyGlyGlyAlaAspGlyVal-265 |
| SEQ. ID. NO. 19453 | 284-AspValAsnGlyAsnValGln-290 |

Hydrophilic Regions - Hopp-Woods

| SEQ. ID. NO. 19454 | 24-ValThrAlaGluGluIleAlaPhe-31 |
| SEQ. ID. NO. 19455 | 38-HisGluAlaArgCysGly-43 |
| SEQ. ID. NO. 19456 | 51-IleAlaAlaAlaGluArgAlaGlyAsp-59 |
| SEQ. ID. NO. 19457 | 77-AlaValAspGlnGluThr-82 |
| SEQ. ID. NO. 19458 | 84-LeuAlaValGluArgSerAlaGlyGluCysAlaAspGluValSerAspLysThrAlaArgAsnGlyGlyIleGluGluAspGlyValValAlaCysArgAspAlaAlaAlaAlaGluSerAlaGln-125 |
| SEQ. ID. NO. 19459 | 162-AsnAspAlaAlaGly-166 |
| SEQ. ID. NO. 19460 | 192-LeuHisArgArgAla-196 |
| SEQ. ID. NO. 19461 | 258-ValGlyGlyGlyAlaAspGlyVal-265 | a519-1
AMPHI Regions - AMPHI

| SEQ. ID. NO. 19462 | 29-ValValGluArgLeuGlyArgPheHisArgAlaLeuThrAlaGly-43 |
| SEQ. ID. NO. 19463 | 105-MetAlaIleThrGlnLeuAlaGlnThrThrLeuArgSerVal-118 |
| SEQ. ID. NO. 19464 | 139-ValSerAlaLeuAspGluAlaAla-146 |
| SEQ. ID. NO. 19465 | 166-GluIleLeuArgSerMetGlnAla-173 |
| SEQ. ID. NO. 19466 | 192-LysIleGluGlnIle-196 |

TABLE 1-continued

| | |
|---|---|
| SEQ. ID. NO. 19467 | 221-SerAsnAlaGluLysIleAlaArgIleAsn-230 |
| SEQ. ID. NO. 19468 | 249-AlaIleArgGlnIleAlaAlaAla-256 |
| SEQ. ID. NO. 19469 | 273-GlnTyrValAlaAlaPheAsnAsnLeuAlaLys-283 |
| SEQ. ID. NO. 19470 | 292-AlaAsnValAlaAspIleGlySerLeuIleSerAlaGlyMetLysIleIleAspSerSerLysThrAla-314 |
| Antigenic Index - Jameson-Wolf | |
| SEQ. ID. NO. 19471 | 31-GluArgLeuGlyArgPheHisArg-38 |
| SEQ. ID. NO. 19472 | 58-HisSerLeuLysGluIleProLeuAspValProSerGln-70 |
| SEQ. ID. NO. 19473 | 72-CysIleThrArgAspAsnThrGlnLeuThrVal-82 |
| SEQ. ID. NO. 19474 | 91-ThrAspProLysLeuAlaSer-97 |
| SEQ. ID. NO. 19475 | 122-MetGluLeuAspLysThrPheGluGluArgAspGluIleAsn-135 |
| SEQ. ID. NO. 19476 | 141-AlaLeuAspGluAlaAlaGly-147 |
| SEQ. ID. NO. 19477 | 154-LeuArgTyrGluIleLysAspLeuValPro-163 |
| SEQ. ID. NO. 19478 | 175-IleThrAlaGluArgGluLysArgAlaArgIleAlaGluSerGluGlyArgLysIleGluGln-195 |
| SEQ. ID. NO. 19479 | 197-AsnLeuAlaSerGlyGlnArgGluAlaGluIleGlnGlnSerGluGlyGluAlaGlnAla-216 |
| SEQ. ID. NO. 19480 | 219-AsnAlaSerAsnAlaGluLysIleAlaArgIleAsnArgAlaLysGlyGluAlaGluSerLeuArgLeu-241 |
| SEQ. ID. NO. 19481 | 245-AlaAsnAlaGluAlaIleArg-251 |
| SEQ. ID. NO. 19482 | 258-GlnThrGlnGlyGlyAlaAspAlaValAsn-267 |
| SEQ. ID. NO. 19483 | 281-LeuAlaLysGluSerAsnThr-287 |
| SEQ. ID. NO. 19484 | 303-AlaGlyMetLysIleIleAspSerSerLysThrAlaLys-315 |
| Hydrophilic Regions - Hopp-Woods | |
| SEQ. ID. NO. 19485 | 31-GluArgLeuGlyArgPheHisArg-38 |
| SEQ. ID. NO. 19486 | 58-HisSerLeuLysGluIleProLeu-65 |
| SEQ. ID. NO. 19487 | 73-IleThrArgAspAsnThr-78 |
| SEQ. ID. NO. 19488 | 91-ThrAspProLysLeu-95 |
| SEQ. ID. NO. 19489 | 122-MetGluLeuAspLysThrPheGluGluArgAspGluIleAsn-135 |
| SEQ. ID. NO. 19490 | 141-AlaLeuAspGluAlaAla-146 |
| SEQ. ID. NO. 19491 | 154-LeuArgTyrGluIleLysAspLeuValPro-163 |
| SEQ. ID. NO. 19492 | 175-IleThrAlaGluArgGluLysArgAlaArgIleAlaGluSerGluGlyArgLysIleGluGln-195 |
| SEQ. ID. NO. 19493 | 200-SerGlyGlnArgGluAlaGluIleGlnGlnSerGluGlyGluAlaGlnAla-216 |
| SEQ. ID. NO. 19494 | 221-SerAsnAlaGluLysIleAlaArgIleAsnArgAlaLysGlyGluAlaGluSerLeuArgLeu-241 |
| SEQ. ID. NO. 19495 | 245-AlaAsnAlaGluAlaIleArg-251 |
| SEQ. ID. NO. 19496 | 281-LeuAlaLysGluSerAsn-286 |
| SEQ. ID. NO. 19497 | 306-LysIleIleAspSerSerLysThrAlaLys-315 |
| a520-1 | |
| AMPHI Regions - AMPHI | |
| SEQ. ID. NO. 19498 | 104-LeuThrLysAlaAlaAspGlyGlnValCysArgAlaPheSerSerLeu-119 |
| Antigenic Index - Jameson-Wolf | |
| SEQ. ID. NO. 19499 | 20-LysProSerArgArgAlaLeu-26 |
| SEQ. ID. NO. 19500 | 47-AlaSerGlyLysIleSerLeuPro-54 |
| SEQ. ID. NO. 19501 | 84-ProProAsnAsnSerThrThrThrSerThrSerSerArgAlaThrSerSerAsnGlySerLeuThrLysAlaAlaAspGlyGlnVal-112 |
| SEQ. ID. NO. 19502 | 117-SerSerLeuLysSerHisThrAlaGluIleArgIleSerArgProLysArgArgGluIleSerSerAlaLeuSerArgAsnThrAlaAla-146 |
| SEQ. ID. NO. 19503 | 150-ProThrValProLysProLysArgProMet-159 |
| SEQ. ID. NO. 19504 | 166-SerProCysLysProThrGluMet-173 |
| Hydrophilic Regions - Hopp-Woods | |
| SEQ. ID. NO. 19505 | 20-LysProSerArgArgAlaLeu-26 |
| SEQ. ID. NO. 19506 | 93-ThrSerSerArgAlaThrSerSer-100 |
| SEQ. ID. NO. 19507 | 103-SerLeuThrLysAlaAlaAsp-109 |
| SEQ. ID. NO. 19508 | 120-LysSerHisThrAlaGluIleArgIleSerArgProLysArgArgGluIleSer-137 |
| SEQ. ID. NO. 19509 | 140-LeuSerArgAsnThrAla-145 |
| SEQ. ID. NO. 19510 | 151-ThrValProLysProLysArgProMet-159 |
| SEQ. ID. NO. 19511 | 168-CysLysProThrGluMet-173 |
| a521 | |
| AMPHI Regions - AMPHI | |
| SEQ. ID. NO. 19512 | 86-ValLysThrValSerLysProAlaLys-94 |
| SEQ. ID. NO. 19513 | 133-GlnAlaArgLeuAlaLysGlyGlyAsn-141 |
| SEQ. ID. NO. 19514 | 147-IleAsnAlaLeuGlnSerValLeuAsp-155 |
| Antigenic Index - Jameson-Wolf | |
| SEQ. ID. NO. 19515 | 1-MetLysSerLysLeu-5 |
| SEQ. ID. NO. 19516 | 36-ValTyrThrThrLysProSerLysSerCysLeuSerThrAspLeuProProIle-53 |
| SEQ. ID. NO. 19517 | 55-AsnTyrSerSerGluArgTyrIleProProGlnThrSerGluProThrProSerProSerAsnGlyGlyGln-78 |
| SEQ. ID. NO. 19518 | 80-ValLysTyrLysAlaProVal-86 |
| SEQ. ID. NO. 19519 | 88-ThrValSerLysProAlaLysSerAsnThrProProProGlnGlnAlaProSerAsnAsnSerArgArgSerIleLeuGluThrGluLeuSerAsnGlu ArgLysAlaLeuValGluAlaGlnLysMetLeuSer-132 |
| SEQ. ID. NO. 19520 | 135-ArgLeuAlaLysGlyGlyAsnIleAsn-143 |
| SEQ. ID. NO. 19521 | 153-ValLeuAspArgGlnGlnAsn-159 |
| SEQ. ID. NO. 19522 | 163-LeuGlnArgGluLeuGlyArg-169 |
| Hydrophilic Regions - Hopp-Woods | |
| SEQ. ID. NO. 19523 | 1-MetLysSerLysLeu-5 |
| SEQ. ID. NO. 19524 | 40-LysProSerLysSerCysLeu-46 |
| SEQ. ID. NO. 19525 | 57-SerSerGluArgTyrIle-62 |
| SEQ. ID. NO. 19526 | 65-GlnThrSerGluProThrProSerProSerAsnGly-76 |
| SEQ. ID. NO. 19527 | 80-ValLysTyrLysAlaProVal-86 |
| SEQ. ID. NO. 19528 | 88-ThrValSerLysProAlaLysSerAsnThrProPro-99 |
| SEQ. ID. NO. 19529 | 102-GlnAlaProSerAsnAsnSerArgArgSerIleLeuGluThrGluLeuSerAsnGluArgLysAlaLeuValGluAlaGlnLysMetLeuSer-132 |
| SEQ. ID. NO. 19530 | 153-ValLeuAspArgGlnGlnAsn-159 |
| SEQ. ID. NO. 19531 | 163-LeuGlnArgGluLeuGlyArg-169 |
| a522 | |
| AMPHI Regions - AMPHI | |
| SEQ. ID. NO. 19532 | 57-LysIleValGluSerCysValLys-64 |
| SEQ. ID. NO. 19533 | 96-MetTrpGluGlnProLeuAspArgLeuSerGluLysGlnIleSerSerPheGlyLysLeuGlyAlaGlnGluGlnLeuAspLeuLeuGlyGlyAla-127 |

TABLE 1-continued

Antigenic Index - Jameson-Wolf
SEQ. ID. NO. 19534  1-MetThrGluProLysHisGluMetProThrGluGluGlnValAlaAlaArgLysLysAlaLysAlaLysIleArgThr-26
SEQ. ID. NO. 19535  48-AlaMetSerLysProGlnAlaLysGlnLysIleValGluSerCysValLys-64
SEQ. ID. NO. 19536  71-LysTrpGlnAsnAspLeuArgAlaArgGlyLeuAspSerAsnThrArgLeuThr-89
SEQ. ID. NO. 19537  99-GlnProLeuAspArgLeuSerGluLysGlnIleSerSerPheGlyLysLeuGlyAla-117
SEQ. ID. NO. 19538  128-AsnAlaPheGluThrArgAspLysGlnCysValAlaAspLeuLysSerGlu-144
Hydrophilic Regions - Hopp-Woods
SEQ. ID. NO. 19539  1-MetThrGluProLysHisGluMetProThrGluGluGlnValAlaAlaArgLysLysAlaLysAlaLysIleArgThr-26
SEQ. ID. NO. 19540  48-AlaMetSerLysProGlnAlaLysGlnLysIleValGluSerCysVal-63
SEQ. ID. NO. 19541  72-TrpGlnAsnAspLeuArgAlaArgGlyLeuAspSerAsnAsnThr-86
SEQ. ID. NO. 19542  100-ProLeuAspArgLeuSerGluLysGlnIle-109
SEQ. ID. NO. 19543  130-PheGluThrArgAspLysGlnCysValAlaAspLeuLysSerGlu-144
a525-1
AMPHI Regions - AMPHI
SEQ. ID. NO. 19544  59-GluPheAlaGluPheValAsnSerHisProGln-69
SEQ. ID. NO. 19545  86-LysHisTrpMetLysAsnGly-92
SEQ. ID. NO. 19546  125-ArgLeuProThrIleAspGluTrpGluPhe-134
SEQ. ID. NO. 19547  166-AspLeuHisAspValGly-171
SEQ. ID. NO. 19548  178-TrpGlyValTyrAsp-182
SEQ. ID. NO. 19549  188-TrpGluTrpThrGlu-192
Antigenic Index - Jameson-Wolf
SEQ. ID. NO. 19550  24-ValGlnIleGluGlyGlySerTyrArgProLeuTyrLeuLysLysAspThrGlyLeuIleLys-44
SEQ. ID. NO. 19551  46-LysProPheLysLeuAspLysTyrProValThr-56
SEQ. ID. NO. 19552  67-HisProGlnTrpGlnLysGlyArgIleGlySerLysGlnAlaGlu-81
SEQ. ID. NO. 19553  88-TrpMetLysAsnGlySerArgSerTyrAlaProLysAlaGlyAspLeuLysGlnPro-106
SEQ. ID. NO. 19554  122-GlnGlyLysArgLeuProThrIleAspGluTrpGlu-133
SEQ. ID. NO. 19555  140-AlaThrGlnLysAsnGlySerAsnGluProGlyTyrAsnArgThr-154
SEQ. ID. NO. 19556  159-TyrAlaAspGlyAspArgLysAspLeuHisAspValGlyLysGlyArgProAsnTyr-177
SEQ. ID. NO. 19557  190-TrpThrGluAspPheAsnSerSerLeuLeuSerSerGlyAsnAla-204
SEQ. ID. NO. 19558  213-AlaSerIleGlySerSerAspSerSerAsnTyr-223
SEQ. ID. NO. 19559  234-SerLeuGlnSerLysTyr-239
Hydrophilic Regions - Hopp-Woods
SEQ. ID. NO. 19560  35-TyrLeuLysLysAspThrGlyLeuIleLys-44
SEQ. ID. NO. 19561  46-LysProPheLysLeuAspLysTyrPro-54
SEQ. ID. NO. 19562  71-GlnLysGlyArgIleGlySerLysGlnAlaGlu-81
SEQ. ID. NO. 19563  91-AsnGlySerArgSerTyrAla-97
SEQ. ID. NO. 19564  99-LysAlaGlyAspLeuLysGln-105
SEQ. ID. NO. 19565  122-GlnGlyLysArgLeuProThr-128
SEQ. ID. NO. 19566  140-AlaThrGlnLysAsnGlySerAsnGluProGlyTyr-151
SEQ. ID. NO. 19567  160-AlaAspGlyAspArgLysAspLeuHisAspValGlyLysGlyArgPro-175
SEQ. ID. NO. 19568  216-GlySerSerAspSerSerAsn-222
a527
AMPHI Regions - AMPHI
SEQ. ID. NO. 19569  7-PhePheGlnProValGln-12
SEQ. ID. NO. 19570  28-SerAspAlaAlaGluLeuValGluLeuPheAlaLeuPhePro-41
SEQ. ID. NO. 19571  73-GlyLysGlyIleGluArgGlnValAspAsnIleAlaAspValTyrGlyPhe-89
Antigenic Index - Jameson-Wolf
SEQ. ID. NO. 19572  26-GlyGlySerAspAlaAlaGlu-32
SEQ. ID. NO. 19573  52-GlnLysProArgLeuGlyCys-58
SEQ. ID. NO. 19574  71-PheIleGlyLysGlyIleGluArgGlnValAspAsnIleAla-84
SEQ. ID. NO. 19575  107-LeuLeuArgLysGlyThrGlyLeuGluLysThrCysArgProLysProPheValGlnProHisGlyGlyArg-130
Hydrophilic Regions - Hopp-Woods
SEQ. ID. NO. 19576  27-GlySerAspAlaAlaGlu-32
SEQ. ID. NO. 19577  52-GlnLysProArgLeuGlyCys-58
SEQ. ID. NO. 19578  75-GlyIleGluArgGlnValAspAsnIleAla-84
SEQ. ID. NO. 19579  107-LeuLeuArgLysGlyThrGlyLeuGluLysThrCysArgProLysPro-122
a528
AMPHI Regions - AMPHI
SEQ. ID. NO. 19580  7-LysTyrThrAlaMetAlaAlaLeuLeuAlaPhe-17
SEQ. ID. NO. 19581  23-ArgLeuAlaGlyTrpTyrGluCysSerSerLeuSerGlyTrpCysLysProArgLysProAlaAlaIle-45
SEQ. ID. NO. 19582  69-AsnArgSerValArg-73
SEQ. ID. NO. 19583  86-TyrArgLysIleGlyLysPhe-92
SEQ. ID. NO. 19584  106-ProLeuIleGluThrPheLys-112
Antigenic Index - Jameson-Wolf
SEQ. ID. NO. 19585  1-MetGluIleArgAla-5
SEQ. ID. NO. 19586  29-GluCysSerSerLeuSerGlyTrpCysLysProArgLysProAlaAla-44
SEQ. ID. NO. 19587  49-AspIleGlyGlyGluSerProProSerLeuGluAspTyrGluIleProLeuSerAspGlyAsnArgSerValArgAlaAsnGluTyrGluSerAlaGln GlnSer-83
SEQ. ID. NO. 19588  88-LysIleGlyLysPheGluAlaCysGlyLeuAspTrpArgThrArgAspGlyLysProLeu-107
SEQ. ID. NO. 19589  110-ThrPheLysGlnGluGlyPheAspCysLeuLysLysGlnGlyLeuArgArgAsnGlyLeuSerGluValArgTrp-135
Hydrophilic Regions - Hopp-Woods
SEQ. ID. NO. 19590  1-MetGluIleArgAla-5
SEQ. ID. NO. 19591  37-CysLysProArgLysProAlaAla-44
SEQ. ID. NO. 19592  51-GlyGlyGluSerProProSerLeuGluAspTyrGluIleProLeu-65
SEQ. ID. NO. 19593  67-AspGlyAsnArgSerValArgAlaAsnGluTyrGluSerAlaGln-81
SEQ. ID. NO. 19594  88-LysIleGlyLysPheGluAlaCys-95

TABLE 1-continued

| | |
|---|---|
| SEQ. ID. NO. 19595 | 99-TrpArgThrArgAspGlyLysProLeu-107 |
| SEQ. ID. NO. 19596 | 111-PheLysGlnGluGlyPheAspCysLeuLysLysGlnGlyLeuArgArgAsnGlyLeuSerGluArgValArgTrp-135 | a529
AMPHI Regions - AMPHI

| | |
|---|---|
| SEQ. ID. NO. 19597 | 11-LeuAlaLeuIleGlyLeuAlaAlaCysSer-20 |
| SEQ. ID. NO. 19598 | 35-SerHisArgLeuIle-39 |
| SEQ. ID. NO. 19599 | 49-AsnProAspGlnGlyAsnLeuTyrArgLeuProAla-60 |
| SEQ. ID. NO. 19600 | 79-GlnGlnProAlaAspAlaGluValLeuLysSerValLysGlyValArg-94 |
| SEQ. ID. NO. 19601 | 152-GlnAspSerLeuArgArgLeuPheAsp-160 |
| SEQ. ID. NO. 19602 | 162-ValGlyLeuGlyGlyIleTyr-168 |
| SEQ. ID. NO. 19603 | 196-AlaMetLysGluVal-200 |
| SEQ. ID. NO. 19604 | 223-AlaPheLeuThrArgPheMetGlnTyrLeu-232 |
| SEQ. ID. NO. 19605 | 252-AlaAsnGluMetAla-256 |
| SEQ. ID. NO. 19606 | 270-GlyArgAsnTrpArg-274 |

Antigenic Index - Jameson-Wolf

| | |
|---|---|
| SEQ. ID. NO. 19607 | 19-CysSerGlySerLysThrGluGlnProLysLeuAspTyrGlnSerArgSerHisArgLeuIleLys-40 |
| SEQ. ID. NO. 19608 | 42-GluValProProAspLeuAsnAsnProAspGlnGlyAsnLeuTyr-56 |
| SEQ. ID. NO. 19609 | 60-AlaGlySerGlyAlaValArgAlaSerAspLeuGluLysArgArgThrProAlaVal-78 |
| SEQ. ID. NO. 19610 | 80-GlnProAlaAspAlaGluValLeuLysSerValLysGlyValArgLeuGluArgAspGlySerGln-101 |
| SEQ. ID. NO. 19611 | 105-ValValAspGlyLysSerHisAla-112 |
| SEQ. ID. NO. 19612 | 123-GlnGluAsnGlyPheAspIleLysSerGluGluProAla-135 |
| SEQ. ID. NO. 19613 | 139-MetGluThrGluTrpAlaGluAsnArgAlaLysIleProGlnAspSerLeuArgArgLeuPhe-159 |
| SEQ. ID. NO. 19614 | 169-SerThrGlyGluArgAspLysPheIleValArgIleGluGlnGlyLysAsnGlyValSer-188 |
| SEQ. ID. NO. 19615 | 195-LysAlaMetLysGluValTyrGlyGlyLysAspLysAspThrThr-209 |
| SEQ. ID. NO. 19616 | 212-GlnProSerProSerAspProAsnLeu-220 |
| SEQ. ID. NO. 19617 | 233-GlyValAspGlyGlnGlnAlaGluAsnAlaSerAlaLysLysProThrLeu-249 |
| SEQ. ID. NO. 19618 | 253-AsnGluMetAlaArgIleGluGlyLysSer-262 |
| SEQ. ID. NO. 19619 | 268-AspTyrGlyArgAsnTrpArgArgThrAlaLeuAla-279 |
| SEQ. ID. NO. 19620 | 289-GlyGlnAsnThrGluArgHisAla-296 |
| SEQ. ID. NO. 19621 | 300-GlnLysAlaProAsnGluSerAsnAlaValThrGluGlnLysProGlyLeu-316 |
| SEQ. ID. NO. 19622 | 320-LeuLeuGlyLysGlyLysAlaGluLysProAlaGluGlnProGlu-334 |
| SEQ. ID. NO. 19623 | 342-ValAlaAsnGlySerArg-347 |
| SEQ. ID. NO. 19624 | 350-LeuLeuAsnLysAspGlySerAlaTyrAlaGlyLysAspAlaSer-364 |
| SEQ. ID. NO. 19625 | 370-LeuHisSerGluLeuArg-375 |

Hydrophilic Regions - Hopp-Woods

| | |
|---|---|
| SEQ. ID. NO. 19626 | 20-SerGlySerLysThrGluGlnProLysLeuAspTyrGlnSerArgSerHisArgLeuIleLys-40 |
| SEQ. ID. NO. 19627 | 42-GluValProProAspLeuAsnAsnProAspGln-52 |
| SEQ. ID. NO. 19628 | 63-GlyAlaValArgAlaSerAspLeuGluLysArgArgThrProAla-77 |
| SEQ. ID. NO. 19629 | 80-GlnProAlaAspAlaGluValLeuLysSerValLysGlyValArgLeuGluArgAspGlySerGln-101 |
| SEQ. ID. NO. 19630 | 107-AspGlyLysSerHisAla-112 |
| SEQ. ID. NO. 19631 | 125-AsnGlyPheAspIleLysSerGluGluProAla-135 |
| SEQ. ID. NO. 19632 | 139-MetGluThrGluTrpAlaGluAsnArgAlaLysIleProGlnAspSerLeuArgArgLeuPhe-159 |
| SEQ. ID. NO. 19633 | 170-ThrGlyGluArgAspLysPheIleVal-178 |
| SEQ. ID. NO. 19634 | 180-IleGluGlnGlyLysAsnGlyVal-187 |
| SEQ. ID. NO. 19635 | 195-LysAlaMetLysGluValTyrGlyGlyLysAspLysAspThrThr-209 |
| SEQ. ID. NO. 19636 | 214-SerProSerAspProAsnLeu-220 |
| SEQ. ID. NO. 19637 | 235-AspGlyGlnGlnAlaGluAsnAlaSerAlaLysLysProThr-248 |
| SEQ. ID. NO. 19638 | 253-AsnGluMetAlaArgIleGluGlyLysSer-262 |
| SEQ. ID. NO. 19639 | 269-TyrGlyArgAsnTrpArgArg-275 |
| SEQ. ID. NO. 19640 | 291-AsnThrGluArgHis-295 |
| SEQ. ID. NO. 19641 | 302-AlaProAsnGluSerAsnAlaValThrGluGlnLysProGlyLeu-316 |
| SEQ. ID. NO. 19642 | 320-LeuLeuGlyLysGlyLysAlaGluLysProAlaGluGlnProGlu-334 |
| SEQ. ID. NO. 19643 | 352-AsnLysAspGlySer-356 |
| SEQ. ID. NO. 19644 | 359-AlaGlyLysAspAlaSer-364 |
| SEQ. ID. NO. 19645 | 370-LeuHisSerGluLeuArg-375 | a531
AMPHI Regions - AMPHI

| | |
|---|---|
| SEQ. ID. NO. 19646 | 59-SerLeuAlaGlyIleLeuAlaAspTyrValAlaGlyIleTrpGlyThr-74 |
| SEQ. ID. NO. 19647 | 90-GlySerIleIleGlyIlePhePheSerLeuProGlyLeuIleLeuGly-105 |
| SEQ. ID. NO. 19648 | 108-IleGlyAlaAlaAlaGly-113 |
| SEQ. ID. NO. 19649 | 131-ThrLeuLeuGlyLeuIleVal-137 |

Antigenic Index - Jameson-Wolf

| | |
|---|---|
| SEQ. ID. NO. 19650 | 74-ThrLysTyrThrGlyAlaGlyLysLeuAlaVal-84 |
| SEQ. ID. NO. 19651 | 114-GluLeuIleGluArgArgAsnMet-121 |

Hydrophilic Regions - Hopp-Woods

| | |
|---|---|
| SEQ. ID. NO. 19652 | 114-GluLeuIleGluArgArgAsnMet-121 | a532
AMPHI Regions - AMPHI

| | |
|---|---|
| SEQ. ID. NO. 19653 | 6-GlyLysGlyAlaAsp-10 |
| SEQ. ID. NO. 19654 | 27-AlaLeuLeuSerAlaValThrHisLeuLeuAlaIlePheValProMetIleThr-44 |
| SEQ. ID. NO. 19655 | 76-TyrLeuGlnValAsnArgPheGlyPro-84 |
| SEQ. ID. NO. 19656 | 122-SerThrLeuLeuGly-126 |
| SEQ. ID. NO. 19657 | 147-LysValIleThrProThrVal-153 |
| SEQ. ID. NO. 19658 | 184-ThrPheGlySerMetGluAsnLeuGly-192 |
| SEQ. ID. NO. 19659 | 206-CysMetLysAsnPro-210 |
| SEQ. ID. NO. 19660 | 224-GlyTyrIleValAlaLeu-229 |
| SEQ. ID. NO. 19661 | 236-PheSerAlaLeuGlnAsnLeuPro-243 |
| SEQ. ID. NO. 19662 | 271-LeuSerValPheGluAlaValGlyAspLeuThrAla-282 |
| SEQ. ID. NO. 19663 | 297-ThrLysArgLeuArgGlyGlyVal-304 |
| SEQ. ID. NO. 19664 | 307-AspGlyLeuValSerValIleAlaThrAlaLeuGly-318 |

TABLE 1-continued

| | |
|---|---|
| SEQ. ID. NO. 19665 | 338-AlaSerArgHisValGlyLysTyr-345 |
| SEQ. ID. NO. 19666 | 361-ArgAlaPheThrThrIleProSerProVal-370 |
| Antigenic Index - Jameson-Wolf | |
| SEQ. ID. NO. 19667 | 1-MetSerGlyGlnLeuGlyLysGlyAlaAspAlaPro-12 |
| SEQ. ID. NO. 19668 | 18-LeuGluAspArgProProPheGlyAsn-26 |
| SEQ. ID. NO. 19669 | 80-AsnArgPheGlyPro-84 |
| SEQ. ID. NO. 19670 | 108-AlaGlyMetLysGluGlyGlyLeuThrLysAspAlaMet-120 |
| SEQ. ID. NO. 19671 | 177-PheGlyAlaLysAlaAspGlyThrPheGlySer-187 |
| SEQ. ID. NO. 19672 | 207-MetLysAsnProLeuLeuArg-213 |
| SEQ. ID. NO. 19673 | 286-ValSerAspGlnProIleGluGlyGluGluTyrThrLysArgLeuArgGlyGlyValLeu-305 |
| SEQ. ID. NO. 19674 | 391-ValSerHisGlyIleArgArgArgGluAlaVal-401 |
| SEQ. ID. NO. 19675 | 445-LeuProGluAspLysThrGluAlaAlaValLysPheAspThrAspHisLeuGluHis-463 |
| Hydrophilic Regions - Hopp-Woods | |
| SEQ. ID. NO. 19676 | 4-GlnLeuGlyLysGlyAlaAspAlaPro-12 |
| SEQ. ID. NO. 19677 | 18-LeuGluAspArgProProPhe-24 |
| SEQ. ID. NO. 19678 | 109-GlyMetLysGluGlyGlyLeuThrLysAspAlaMet-120 |
| SEQ. ID. NO. 19679 | 179-AlaLysAlaAspGly-183 |
| SEQ. ID. NO. 19680 | 289-GlnProIleGluGlyGluGluTyrThrLysArgLeuArgGly-302 |
| SEQ. ID. NO. 19681 | 394-GlyIleArgArgArgGluAlaVal-401 |
| SEQ. ID. NO. 19682 | 445-LeuProGluAspLysThrGluAlaAlaValLysPheAspThrAspHisLeuGluHis-463 |
| a537 | |
| AMPHI Regions - AMPHI | |
| SEQ. ID. NO. 19683 | 38-GlnIleArgAspGlyGlyAspAlaLeuHisTyrLeuAsnArgIle-52 |
| SEQ. ID. NO. 19684 | 86-HisGlyGluHisHis-90 |
| SEQ. ID. NO. 19685 | 109-GlyTyrLeuTyrAsnGlyValHisGlu-117 |
| SEQ. ID. NO. 19686 | 138-ArgGlnValAspGlyLeuMetSerAlaIleTyr-148 |
| SEQ. ID. NO. 19687 | 182-ArgPheGluArgHisCys-187 |
| SEQ. ID. NO. 19688 | 194-ProGluAlaGlyArgLysTyrTyrArgAsnAla-204 |
| SEQ. ID. NO. 19689 | 281-ArgProValArgValLeuThrAlaGly-289 |
| SEQ. ID. NO. 19690 | 315-TyrThrAlaValPheAspTyrValArgAsnGlyArgArgAla-328 |
| Antigenic Index - Jameson-Wolf | |
| SEQ. ID. NO. 19691 | 21-ThrGlnAsnGlnSerLeuProAlaGly-29 |
| SEQ. ID. NO. 19692 | 32-ValTyrProSerAlaProGlnIleArgAspGlyGlyAspAla-45 |
| SEQ. ID. NO. 19693 | 69-AsnSerAlaArgArgHisAlaArg-76 |
| SEQ. ID. NO. 19694 | 80-LeuAsnProGluAspGlyHisGlyGluHisHisProAspAsnProHis-95 |
| SEQ. ID. NO. 19695 | 99-GlnLysLeuThrGluArgThrArgLeu-107 |
| SEQ. ID. NO. 19696 | 115-ValHisGluAsnIleSerThrGluGluGluAlaAlaGluSerSerAspSerAspIleArgThrGlnGlnArgGlnValAspGlyLeu-143 |
| SEQ. ID. NO. 19697 | 152-SerLeuLeuAspArgHisThrAspGluAlaGly-162 |
| SEQ. ID. NO. 19698 | 165-PheValArgGluAsnGlyLysThr-172 |
| SEQ. ID. NO. 19699 | 178-GlnGlyAsnGlyArgPheGluArgHisCysAlaGlnGlyArgAsnGlnProGluAlaGlyArgLysTyrTyrArgAsnAlaCysHisAsnGly-208 |
| SEQ. ID. NO. 19700 | 212-TyrThrAspGluAlaMetPro-218 |
| SEQ. ID. NO. 19701 | 237-PheHisGlyGluArgProAspProValProGluTyrGluIleThrGlyAsnProAlaSer-256 |
| SEQ. ID. NO. 19702 | 258-AspPheSerGluAlaAlaGly-264 |
| SEQ. ID. NO. 19703 | 266-IleThrMetLysSer-270 |
| SEQ. ID. NO. 19704 | 274-TyrGlnGlyLysAsnGluIleArgPro-282 |
| SEQ. ID. NO. 19705 | 287-ThrAlaGlyAsnAspProAsnGlyArgLeuThr-297 |
| SEQ. ID. NO. 19706 | 320-AspTyrValArgAsnGlyArgArgAlaGlnAla-330 |
| SEQ. ID. NO. 19707 | 334-PheArgThrArgLysProAspTyrProTyr-343 |
| SEQ. ID. NO. 19708 | 345-GluValAsnGlyGlyGluThrLeuAlaValArgLysGlyGluLys-359 |
| SEQ. ID. NO. 19709 | 364-TrpArgGlyArgTrpCysLeu-370 |
| SEQ. ID. NO. 19710 | 376-TyrThrTyrArgGlnArgProGlySerArgLeuSerIleGlyArgHisLysAlaGlyGly-395 |
| SEQ. ID. NO. 19711 | 401-AspGlyMetAlaGlySer-406 |
| SEQ. ID. NO. 19712 | 408-IleThrLeuAlaProGluGlyGluThrGluArgGly-419 |
| Hydrophilic Regions - Hopp-Woods | |
| SEQ. ID. NO. 19713 | 37-ProGlnIleArgAspGlyGlyAsp-44 |
| SEQ. ID. NO. 19714 | 69-AsnSerAlaArgArgHisAlaArg-76 |
| SEQ. ID. NO. 19715 | 81-AsnProGluAspGlyHisGlyGluHisHisProAsp-92 |
| SEQ. ID. NO. 19716 | 100-LysLeuThrGluArgThrArgLeu-107 |
| SEQ. ID. NO. 19717 | 119-IleSerThrGluGluGluAlaAlaGluSerSerAspSerAspIleArgThrGlnGlnArgGlnValAsp-141 |
| SEQ. ID. NO. 19718 | 152-SerLeuLeuAspArgHisThrAspGluAlaGly-162 |
| SEQ. ID. NO. 19719 | 165-PheValArgGluAsnGlyLys-171 |
| SEQ. ID. NO. 19720 | 179-GlyAsnGlyArgPheGluArgHisCysAlaGlnGlyArgAsnGlnProGluAlaGlyArgLysTyrTyrArg-202 |
| SEQ. ID. NO. 19721 | 238-HisGlyGluArgProAspProValProGlu-247 |
| SEQ. ID. NO. 19722 | 258-AspPheSerGluAlaAlaGly-264 |
| SEQ. ID. NO. 19723 | 266-IleThrMetLysSer-270 |
| SEQ. ID. NO. 19724 | 275-GlnGlyLysAsnGluIleArgPro-282 |
| SEQ. ID. NO. 19725 | 289-GlyAsnAspProAsnGlyArg-295 |
| SEQ. ID. NO. 19726 | 323-ArgAsnGlyArgArgAlaGlnAla-330 |
| SEQ. ID. NO. 19727 | 334-PheArgThrArgLysProAsp-340 |
| SEQ. ID. NO. 19728 | 352-LeuAlaValArgLysGlyGluLys-359 |
| SEQ. ID. NO. 19729 | 377-ThrTyrArgGlnArgProGlySer-384 |
| SEQ. ID. NO. 19730 | 387-SerIleGlyArgHisLysAla-393 |
| SEQ. ID. NO. 19731 | 412-ProGluGlyGluThrGluArgGly-419 |
| a538 | |
| AMPHI Regions - AMPHI | |
| SEQ. ID. NO. 19732 | 42-ThrAlaLeuAlaGluAlaValGluLeuValLysAlaAlaGly-55 |
| SEQ. ID. NO. 19733 | 79-LysAlaAlaGluLeuSerGluAlaValAla-88 |
| SEQ. ID. NO. 19734 | 105-GlnGluArgAsnLeuGluLysIleLeuGlnCysArgValLeuAspArgVal-121 |
| SEQ. ID. NO. 19735 | 145-GlnLeuSerHisLeuAlaGlyArgLeuIleArgGlyTyrGlyHisLeuGln-161 |
| SEQ. ID. NO. 19736 | 188-IleAsnAlaLeuLysLysGlnLeuAla-196 |

TABLE 1-continued

| | |
|---|---|
| SEQ. ID. NO. 19737 | 211-SerGlyThrIleLysThrPheAlaLeuValGlyTyrThrAsn-224 |
| SEQ. ID. NO. 19738 | 231-PheAsnArgLeuThrLys-236 |
| SEQ. ID. NO. 19739 | 271-GlyPheValSerAspLeuProHisLysLeuIleSerAlaPheSerAlaThrLeuGlu-289 |
| SEQ. ID. NO. 19740 | 307-AsnSerGlyGlnGlnIleGluAspValGluAsnValLeuGlnGluIleHis-323 |
| SEQ. ID. NO. 19741 | 365-GluAsnThrGlyIleAspAlaLeuArgGluAlaIleAlaGluTyrCysAla-381 |

Antigenic Index - Jameson-Wolf

| | |
|---|---|
| SEQ. ID. NO. 19742 | 1-MetThrGlyArgThrGlyArgAsnGlySerThrGlnAlaGlnProGluArgVal-18 |
| SEQ. ID. NO. 19743 | 24-MetLeuAspLysAspGlyThrGlySerSerAlaThrArgLeuAsnGly-39 |
| SEQ. ID. NO. 19744 | 48-ValGluLeuValLys-52 |
| SEQ. ID. NO. 19745 | 54-AlaGlyGlyAspSerValArgValGluThrAlaLysArgAspArgProHisThr-71 |
| SEQ. ID. NO. 19746 | 77-ThrGlyLysAlaAlaGluLeuSerGlu-85 |
| SEQ. ID. NO. 19747 | 100-GluLeuThrProThrGlnGluArgAsnLeuGluLys-111 |
| SEQ. ID. NO. 19748 | 129-AlaArgArgAlaArgThrGlnGluGlyArgLeuGlnVal-141 |
| SEQ. ID. NO. 19749 | 161-GlnSerGlnArgGlyGlyIleGlyMetLysGlyProGlyGluThrLysLeuGluThrAspArgArgLeuIle-184 |
| SEQ. ID. NO. 19750 | 189-AsnAlaLeuLysLysGlnLeuAlaAsnLeuLysLysGlnArgAlaLeuArgArgLysSerArgGluSerGlyThrIleLysThr-216 |
| SEQ. ID. NO. 19751 | 224-AsnValGlyLysSerSerLeu-230 |
| SEQ. ID. NO. 19752 | 233-ArgLeuThrLysSerGlyIleTyrAla-241 |
| SEQ. ID. NO. 19753 | 257-TyrIleSerProGluCys-262 |
| SEQ. ID. NO. 19754 | 287-ThrLeuGluGluThrAlaGln-293 |
| SEQ. ID. NO. 19755 | 304-AlaAlaProAsnSerGlyGlnGlnIleGluAspValGluAsnValLeu-319 |
| SEQ. ID. NO. 19756 | 323-HisAlaGlyAspIlePro-328 |
| SEQ. ID. NO. 19757 | 333-TyrAsnLysThrAspLeuLeuProSerGluGluGlnAsnThrGlyIle-348 |
| SEQ. ID. NO. 19758 | 365-GluAsnThrGlyIleAspAlaLeuArgGluAlaIle-376 |
| SEQ. ID. NO. 19759 | 381-AlaAlaAlaProAsnThrAspGluThrGluMetPro-392 |

Hydrophilic Regions - Hopp-Woods

| | |
|---|---|
| SEQ. ID. NO. 19760 | 1-MetThrGlyArgThrGlyArgAsnGlySerThr-11 |
| SEQ. ID. NO. 19761 | 13-AlaGlnProGluArg-17 |
| SEQ. ID. NO. 19762 | 25-LeuAspLysAspGlyThrGly-31 |
| SEQ. ID. NO. 19763 | 48-ValGluLeuValLys-52 |
| SEQ. ID. NO. 19764 | 54-AlaGlyGlyAspSerValArgValGluThrAlaLysArgAspArgProHis-70 |
| SEQ. ID. NO. 19765 | 78-GlyLysAlaAlaGluLeuSerGlu-85 |
| SEQ. ID. NO. 19766 | 101-LeuThrProThrGlnGluArgAsnLeuGluLys-111 |
| SEQ. ID. NO. 19767 | 129-AlaArgArgAlaArgThrGlnGluGlyArgLeuGlnVal-141 |
| SEQ. ID. NO. 19768 | 161-GlnSerGlnArgGlyGlyIle-167 |
| SEQ. ID. NO. 19769 | 171-GlyProGlyGluThrLysLeuGluThrAspArgArgLeuIle-184 |
| SEQ. ID. NO. 19770 | 189-AsnAlaLeuLysLysGlnLeuAlaAsnLeuLysLysGlnArgAlaLeuArgArgLysSerArgGluSerGlyThr-213 |
| SEQ. ID. NO. 19771 | 287-ThrLeuGluGluThrAlaGln-293 |
| SEQ. ID. NO. 19772 | 310-GlnGlnIleGluAspValGluAsnValLeu-319 |
| SEQ. ID. NO. 19773 | 337-AspLeuLeuProSerGluGluGlnAsn-345 |
| SEQ. ID. NO. 19774 | 370-AspAlaLeuArgGluAlaIle-376 |
| SEQ. ID. NO. 19775 | 384-ProAsnThrAspGluThrGluMetPro-392 | a539-2
AMPHI Regions - AMPHI

| | |
|---|---|
| SEQ. ID. NO. 19776 | 18-ArgGlnArgGluHisHisArgLeu-25 |
| SEQ. ID. NO. 19777 | 44-LeuValGlyGlyPheAspPheLeuArgValIleGlyCysGlyGlyValAlaTyrLeuProAspPheGlnGln-67 |

Antigenic Index - Jameson-Wolf

| | |
|---|---|
| SEQ. ID. NO. 19778 | 1-MetGluAspLeuGlnGluIleGly-8 |
| SEQ. ID. NO. 19779 | 15-LysValGlyArgGlnArgGluHisHisArgLeuHisHisProGlnProGlyAsnGlyGluAlaAspAsp-37 |
| SEQ. ID. NO. 19780 | 63-ProAspPheGlnGlnAsnValGlyLysAlaAsp-73 |
| SEQ. ID. NO. 19781 | 77-ValProAspAspAlaAlaAla-83 |
| SEQ. ID. NO. 19782 | 88-IleGluValAspAlaAspAspAlaValCys-97 |
| SEQ. ID. NO. 19783 | 102-LeuPheAspGlnProAspAlaGlyGlyAlaGlyAspAlaAlaGluHis-117 |

Hydrophilic Regions - Hopp-Woods

| | |
|---|---|
| SEQ. ID. NO. 19784 | 1-MetGluAspLeuGlnGluIleGly-8 |
| SEQ. ID. NO. 19785 | 15-LysValGlyArgGlnArgGluHisHisArg-24 |
| SEQ. ID. NO. 19786 | 31-GlyAsnGlyGluAlaAspAsp-37 |
| SEQ. ID. NO. 19787 | 69-ValGlyLysAlaAsp-73 |
| SEQ. ID. NO. 19788 | 78-ProAspAspAlaAlaAla-83 |
| SEQ. ID. NO. 19789 | 88-IleGluValAspAlaAspAspAlaValCys-97 |
| SEQ. ID. NO. 19790 | 102-LeuPheAspGlnProAspAlaGlyGlyAlaGlyAspAlaAlaGluHis-117 | a542
AMPHI Regions - AMPHI

| | |
|---|---|
| SEQ. ID. NO. 19791 | 6-ArgIleArgArgCysSerVal-12 |

Antigenic Index - Jameson-Wolf

| | |
|---|---|
| SEQ. ID. NO. 19792 | 1-MetProLysTrpSerArgIleArgArgCysSerVal-12 |
| SEQ. ID. NO. 19793 | 20-SerAlaSerArgLeuThrCys-26 |
| SEQ. ID. NO. 19794 | 36-MetArgLeuLysSerSerAspGlyIleAlaSer-46 |
| SEQ. ID. NO. 19795 | 55-GlyProMetProSerGluThrValSerHisLysSerAspSerSerArgAsnThrSerAlaSerArgArgAsnValSerProLysCysProPhe-85 |
| SEQ. ID. NO. 19796 | 89-PheArgGlnAspAlaAlaLysProArgArgPheGlyGlyLys-102 |
| SEQ. ID. NO. 19797 | 106-LeuThrGlySerArg-110 |

Hydrophilic Regions - Hopp-Woods

| | |
|---|---|
| SEQ. ID. NO. 19798 | 5-SerArgIleArgArgCysSer-11 |
| SEQ. ID. NO. 19799 | 36-MetArgLeuLysSerSerAspGlyIleAla-45 |
| SEQ. ID. NO. 19800 | 57-MetProSerGluThrValSerHisLysSerAspSerSerArgAsnThrSerAlaSerArgArgAsnValSerPro-81 |
| SEQ. ID. NO. 19801 | 89-PheArgGlnAspAlaAlaLysProArgArgPheGlyGly-101 | a544-2
AMPHI Regions - AMPHI

| | |
|---|---|
| SEQ. ID. NO. 19802 | 11-AlaLeuIleGlyIleLeu-16 |
| SEQ. ID. NO. 19803 | 55-PheTrpPheProSerCysProGlyCysValSerGluMetProLysIleIleLysThrAla-74 |

TABLE 1-continued

SEQ. ID. NO. 19804    85-LeuAlaValAlaGlnProIleAspProIleGluSerValArgGlnTyrVal-101
SEQ. ID. NO. 19805    116-LysAlaValGlyGlnAlaPhe-122
Antigenic Index - Jameson-Wolf
SEQ. ID. NO. 19806    1-MetLysLysIleLeu-5
SEQ. ID. NO. 19807    22-IleProAspSerLysThrAlaPro-29
SEQ. ID. NO. 19808    35-AspLeuHisGlyLysThrValSerAsnAlaAspLeuGlnGly-48
SEQ. ID. NO. 19809    59-SerCysProGlyCys-63
SEQ. ID. NO. 19810    66-GluMetProLysIleIleLysThrAlaAsnAspTyrLysAsnLysAsnPhe-82
SEQ. ID. NO. 19811    90-ProIleAspProIleGluSerValArgGlnTyrValLysAspTyrGly-105
SEQ. ID. NO. 19812    113-AspAlaAspLysAlaVal-118
SEQ. ID. NO. 19813    133-IleGlyLysLysGlyGluIleLeu-140
SEQ. ID. NO. 19814    144-ValGlyGluProAspPheGlyLysLeuTyrGlnGluIleAspThr-158
Hydrophilic Regions - Hopp-Woods
SEQ. ID. NO. 19815    1-MetLysLysIleLeu-5
SEQ. ID. NO. 19816    23-ProAspSerLysThr-27
SEQ. ID. NO. 19817    66-GluMetProLysIleIleLysThrAlaAsnAspTyrLysAsnLysAsn-81
SEQ. ID. NO. 19818    92-AspProIleGluSerValArgGlnTyrValLys-102
SEQ. ID. NO. 19819    113-AspAlaAspLysAlaVal-118
SEQ. ID. NO. 19820    133-IleGlyLysLysGlyGluIle-139
a547
AMPHI Regions - AMPHI
SEQ. ID. NO. 19821    7-PheAsnLysThrValAlaSerPheAlaGlnIleValGluThrPheAspVal-23
SEQ. ID. NO. 19822    62-AsnArgSerPheLys-66
SEQ. ID. NO. 19823    105-LeuHisIlePheThrAsnIleLys-112
Antigenic Index - Jameson-Wolf
SEQ. ID. NO. 19824    3-ValAspAsnGlyPheAsnLysThrVal-11
SEQ. ID. NO. 19825    35-GlnMetLysGlnArgCysGlyTrp-42
SEQ. ID. NO. 19826    53-PheProArgCysGlyPheGluIleProAsnArgSerPheLysGlu-67
SEQ. ID. NO. 19827    76-LeuSerGluArgPheArgThrAsnAlaGluValGluIle-88
Hydrophilic Regions - Hopp-Woods
SEQ. ID. NO. 19828    36-MetLysGlnArgCys-40
SEQ. ID. NO. 19829    60-IleProAsnArgSerPheLysGlu-67
SEQ. ID. NO. 19830    76-LeuSerGluArgPheArgThrAsnAlaGluValGluIle-88
a548
AMPHI Regions - AMPHI
SEQ. ID. NO. 19831    14-ValLeuAlaAlaLeuAlaAlaCysLys-22
SEQ. ID. NO. 19832    39-SerAlaAlaGluAsnAlaAlaLysPro-47
SEQ. ID. NO. 19833    89-PheThrHisCysProAspValCysProThr-98
SEQ. ID. NO. 19834    103-TyrSerAspThrLeuLysGlnLeuGlyGlyGln-113
SEQ. ID. NO. 19835    132-GluIleIleGlyLysTyrAlaLys-139
Antigenic Index - Jameson-Wolf
SEQ. ID. NO. 19836    21-CysLysProGlnAspAsnSerAlaAla-29
SEQ. ID. NO. 19837    39-SerAlaAlaGluAsnAlaAlaLysProGlnThrArgGlyThrAspMetArgLysGluAspIleGlyGlyAspPheThrLeuThrAspGlyGluGlyLys
                      ProPheAsn-74
SEQ. ID. NO. 19838    76-SerAspLeuLysGly-80
SEQ. ID. NO. 19839    91-HisCysProAspValCysPro-97
SEQ. ID. NO. 19840    104-SerAspThrLeuLysGlnLeuGlyGlyGlnAlaLysAspValLys-118
SEQ. ID. NO. 19841    124-IleAspProGluArgAspThrProGluIleIleGlyLysTyrAlaLysGlnPheAsnProAspPhe-145
SEQ. ID. NO. 19842    150-AlaThrGlyAspGlnAsnLeu-156
SEQ. ID. NO. 19843    169-LysValAsnGlnLysAspAspSerGluAsnTyrLeu-180
SEQ. ID. NO. 19844    189-LeuIleAspLysAsnGlyGlu-195
SEQ. ID. NO. 19845    200-SerProTyrGlySerGluProGluThrIleAlaAlaAspVal-213
Hydrophilic Regions - Hopp-Woods
SEQ. ID. NO. 19846    22-LysProGlnAspAsnSerAla-28
SEQ. ID. NO. 19847    39-SerAlaAlaGluAsnAlaAlaLysProGlnThrArgGlyThrAspMetArgLysGluAspIleGlyGly-61
SEQ. ID. NO. 19848    64-ThrLeuThrAspGlyGluGlyLysPro-72
SEQ. ID. NO. 19849    76-SerAspLeuLysGly-80
SEQ. ID. NO. 19850    111-GlyGlyGlnAlaLysAspValLys-118
SEQ. ID. NO. 19851    124-IleAspProGluArgAspThrProGluIleIle-134
SEQ. ID. NO. 19852    151-ThrGlyAspGlnAsn-155
SEQ. ID. NO. 19853    169-LysValAsnGlnLysAspAspSerGluAsnTyrLeu-180
SEQ. ID. NO. 19854    191-AspLysAsnGlyGlu-195
SEQ. ID. NO. 19855    203-GlySerGluProGluThrIleAlaAlaAspVal-213
a552-1
AMPHI Regions - AMPHI
SEQ. ID. NO. 19856    18-CysThrAsnAlaPheAlaAlaPro-25
SEQ. ID. NO. 19857    29-AlaSerLeuAlaArgTrpLeuAspThr-37
SEQ. ID. NO. 19858    41-AspArgAspIleGluLysAsnMetIleGluGlyPheAsnAlaGlyPheLysProTyrAlaAspLysAlaLeuAlaGluMet-67
SEQ. ID. NO. 19859    75-AlaAlaGluAlaPheAsnArgTyrArgGluAsnVal-86
SEQ. ID. NO. 19860    89-AspLeuIleThrProGluValLys-96
SEQ. ID. NO. 19861    116-IleAspGlyMetIleAla-121
SEQ. ID. NO. 19862    139-IleLysLysSerMetSerGluIle-146
SEQ. ID. NO. 19863    154-SerGlyLysIleAlaGlnHisHisLeuProGluPheThrGluGluLeuArgArg-171
Antigenic Index - Jameson-Wolf
SEQ. ID. NO. 19864    25-ProProSerAspAlaSerLeu-31
SEQ. ID. NO. 19865    35-LeuAspThrGlnAsnPheAspArgAspIleGluLysAsnMetIle-49
SEQ. ID. NO. 19866    53-AsnAlaGlyPheLysProTyrAlaAspLysAlaLeuAlaGluMetProGluAlaLysLysAspGlnAlaAla-76
SEQ. ID. NO. 19867    78-AlaPheAsnArgTyrArgGluAsnValLeu-87
SEQ. ID. NO. 19868    90-LeuIleThrProGluValLysGlnAlaVal-99
SEQ. ID. NO. 19869    105-LysAsnAlaArgGluIleTyrThrGlnGluGluIleAspGly-118

TABLE 1-continued

| SEQ. ID. NO. 19870 | 131-ValValAlaLysAsnProArgLeuIleLysLysSerMetSer-144 |

SEQ. ID. NO. 19871    153-LeuSerGlyLysIle-157
SEQ. ID. NO. 19872    164-GluPheThrGluGluLeuArgArg-171
SEQ. ID. NO. 19873    173-IleCysGlyGlyLysAsnProAspAlaGlyCysLysGlnAlaGlyGlnValGlyLysArgHisGlnLys-195
Hydrophilic Regions - Hopp-Woods
SEQ. ID. NO. 19874    26-ProSerAspAlaSerLeu-31
SEQ. ID. NO. 19875    38-GlnAsnPheAspArgAspIleGluLysAsnMetIle-49
SEQ. ID. NO. 19876    58-ProTyrAlaAspLysAlaLeuAlaGluMetProGluAlaLysLysAspGlnAlaAla-76
SEQ. ID. NO. 19877    78-AlaPheAsnArgTyrArgGluAsnValLeu-87
SEQ. ID. NO. 19878    90-LeuIleThrProGluValLysGlnAlaVal-99
SEQ. ID. NO. 19879    105-LysAsnAlaArgGluIleTyrThr-112
SEQ. ID. NO. 19880    114-GluGluIleAspGly-118
SEQ. ID. NO. 19881    131-ValValAlaLysAsnProArgLeuIleLysLysSerMetSer-144
SEQ. ID. NO. 19882    164-GluPheThrGluGluLeuArgArg-171
SEQ. ID. NO. 19883    176-GlyLysAsnProAspAlaGlyCysLysGlnAlaGlyGlnValGlyLysArgHisGlnLys-195
a554
AMPHI Regions - AMPHI
SEQ. ID. NO. 19884    38-PheGlnThrProGluThrLeu-44
SEQ. ID. NO. 19885    71-AlaAlaLeuThrGlnLeuMet-77
SEQ. ID. NO. 19886    110-ArgMetPheValArgProGlyAspThrVal-119
SEQ. ID. NO. 19887    124-LeuLeuLysGlyMet-128
SEQ. ID. NO. 19888    148-SerIleGluAsnPheValGlnGlnMetAsnLysGlu-159
SEQ. ID. NO. 19889    185-AlaLysAspLeuAlaGlnLeuSerGluAlaLeuMetArgAspPheProGluTyrTyrProLeuPheSer-207
SEQ. ID. NO. 19890    296-ThrValAlaGlnIle-300
SEQ. ID. NO. 19891    331-GluGlnIleLeuGluThrIleGlnProIleProAla-342
Antigenic Index - Jameson-Wolf
SEQ. ID. NO. 19892    23-AlaSerProAlaProAsnArgProThrAla-32
SEQ. ID. NO. 19893    37-ThrPheGlnThrProGluThr-43
SEQ. ID. NO. 19894    53-LeuGlnSerLysGln-57
SEQ. ID. NO. 19895    61-AlaLysAsnIleAsnThrProValGlu-69
SEQ. ID. NO. 19896    84-LysAsnMetLysSerGlyAsnIleArgSerGluGluAsnLeuLysIleProGlu-101
SEQ. ID. NO. 19897    104-TrpAlaSerGluGlySerArgMetPheValArgProGlyAspThrValSerThrAspLysLeuLeu-125
SEQ. ID. NO. 19898    143-ArgLeuGlyAsnGlySerIleGluAsnPhe-152
SEQ. ID. NO. 19899    156-MetAsnLysGluAlaAlaArgArgLeuGlyMetLysAsnThrValPheLysAsnProThrGlyLeuSerArgGluGlyGlnValSerThrAlaLysAspLeu
                      AlaGln-190
SEQ. ID. NO. 19900    194-AlaLeuMetArgAspPheProGluTyrTyr-203
SEQ. ID. NO. 19901    214-LysAsnIleGluGlnAsnAsnArgAsnIleLeu-224
SEQ. ID. NO. 19902    226-TyrArgAspAsnAsnValAsnGlyLeuLysAlaGlyHisThrGluSerGlyGlyTyrAsn-245
SEQ. ID. NO. 19903    250-TyrSerGlyAsnGlyArgHis-256
SEQ. ID. NO. 19904    262-LeuGlySerGluSerAlaGluThrArgAlaSerAspAsnSerLys-276
SEQ. ID. NO. 19905    285-PheAspThrProLysIleTyrProLysGlyLysThr-296
SEQ. ID. NO. 19906    302-IleSerGlyGlySerLysLysThrValArg-311
SEQ. ID. NO. 19907    323-ProHisLysGluAlaLysMetAlaGluGlnIleLeu-334
SEQ. ID. NO. 19908    342-AlaProValLysLysGlyGlnIleLeuGlyLysIleLysIleArgGlnAsnGlyTyr-360
SEQ. ID. NO. 19909    362-IleAlaGluLysGluIleValAla-369
SEQ. ID. NO. 19910    371-GluAsnValLysLysArgSerArgTrpGlnArg-381
Hydrophilic Regions - Hopp-Woods
SEQ. ID. NO. 19911    26-AlaProAsnArgProThrAla-32
SEQ. ID. NO. 19912    85-AsnMetLysSerGlyAsnIleArgSerGluGluAsnLeuLysIleProGlu-101
SEQ. ID. NO. 19913    107-GluGlySerArgMetPheValArgProGlyAspThrValSerThrAspLysLeuLeu-125
SEQ. ID. NO. 19914    156-MetAsnLysGluAlaArgArgLeuGlyMet-165
SEQ. ID. NO. 19915    174-ThrGlyLeuSerArgGluGlyGlnValSerThrAlaLysAspLeuAlaGln-190
SEQ. ID. NO. 19916    214-LysAsnIleGluGlnAsnAsnArg-221
SEQ. ID. NO. 19917    227-ArgAspAsnAsnValAsn-232
SEQ. ID. NO. 19918    237-GlyHisThrGluSerGly-242
SEQ. ID. NO. 19919    264-SerGluSerAlaGluThrArgAlaSerAspAsnSerLys-276
SEQ. ID. NO. 19920    289-LysIleTyrProLysGlyLysThr-296
SEQ. ID. NO. 19921    304-GlyGlySerLysLysThrValArg-311
SEQ. ID. NO. 19922    323-ProHisLysGluAlaLysMetAlaGluGlnIleLeu-334
SEQ. ID. NO. 19923    343-ProValLysLysGlyGlnIle-349
SEQ. ID. NO. 19924    353-IleLysIleArgGln-357
SEQ. ID. NO. 19925    362-IleAlaGluLysGluIleValAla-369
SEQ. ID. NO. 19926    371-GluAsnValLysLysArgSerArgTrp-379
a556
AMPHI Regions - AMPHI
SEQ. ID. NO. 19927    61-IleGluArgLeuLys-65
Antigenic Index - Jameson-Wolf
SEQ. ID. NO. 19928    1-MetAspAsnLysThrLysLeuArgLeu-9
SEQ. ID. NO. 19929    52-ThrSerArgArgGlnGlnArgGlnPheIleGluArgLeuLysLysPheAspIleAspProGluLysGlyArgIleAsnGluAlaAsnLeuArgArgMet
                      TyrHisSerGlyGlyGlnHisGlnLysAspAla-95
SEQ. ID. NO. 19930    102-SerGlnLysCysSerValAspGluAlaHisAlaMetPheLysLysArgProThrArgGlnGluIleAsn-124
SEQ. ID. NO. 19931    127-AlaAlaLysGlnSerArgGlyGlnLysArgProHisArg-139
Hydrophilic Regions - Hopp-Woods
SEQ. ID. NO. 19932    1-MetAspAsnLysThrLysLeuArgLeu-9
SEQ. ID. NO. 19933    53-SerArgArgGlnGlnArgGlnPheIleGluArgLeuLysLysPheAspIleAspProGluLysGlyArgIleAsnGluAlaAsnLeuArgArgMetTyr-85
SEQ. ID. NO. 19934    90-GlnHisGlnLysAspAla-95

TABLE 1-continued

| | |
|---|---|
| SEQ. ID. NO. 19935 | 105-CysSerValAspGluAlaHisAlaMetPheLysLysArgProThrArgGlnGluIleAsn-124 |
| SEQ. ID. NO. 19936 | 127-AlaAlaLysGlnSerArgGlyGlnLysArgProHisArg-139 | a557
AMPHI Regions - AMPHI

| | |
|---|---|
| SEQ. ID. NO. 19937 | 22-GlyAlaAspGlyIle-26 |
| SEQ. ID. NO. 19938 | 55-SerGlyArgValAspAspAlaAla-62 |

Antigenic Index - Jameson-Wolf

| | |
|---|---|
| SEQ. ID. NO. 19939 | 20-LeuLysGlyAlaAspGlyIleSerProProLeuThrTyrArgSerTrpHisIleGluGlyGlyGlnAlaLeu-43 |
| SEQ. ID. NO. 19940 | 54-AlaSerGlyArgValAspAspAlaAlaGly-63 |
| SEQ. ID. NO. 19941 | 68-LeuArgIleAspSerValSerGlnAsnLysGluThrTyrThr-81 |
| SEQ. ID. NO. 19942 | 100-GlnValLeuLysArgGlyGluProValGlyLysProMet-112 |
| SEQ. ID. NO. 19943 | 123-AlaAspAsnGluIleLeuGlyLysGlnGluGluGluAla-135 |
| SEQ. ID. NO. 19944 | 141-MetArgGlnAspAlaAlaGluGlnIleValArg-151 |

Hydrophilic Regions - Hopp-Woods

| | |
|---|---|
| SEQ. ID. NO. 19945 | 21-LysGlyAlaAspGlyIle-26 |
| SEQ. ID. NO. 19946 | 56-GlyArgValAspAspAlaAlaGly-63 |
| SEQ. ID. NO. 19947 | 68-LeuArgIleAspSerValSerGlnAsnLysGluThrTyrThr-81 |
| SEQ. ID. NO. 19948 | 100-GlnValLeuLysArgGlyGluProValGly-109 |
| SEQ. ID. NO. 19949 | 126-GluIleLeuGlyLysGlnGluGluGluAla-135 |
| SEQ. ID. NO. 19950 | 141-MetArgGlnAspAlaAlaGluGlnIleValArg-151 | a560
AMPHI Regions - AMPHI

| | |
|---|---|
| SEQ. ID. NO. 19951 | 30-PheArgAspGlyAlaHisLysMetAlaArgValTrpValLysIleLeu-45 |
| SEQ. ID. NO. 19952 | 167-ArgMetAlaLysMetPhe-172 |
| SEQ. ID. NO. 19953 | 192-PheLeuLysTyrProGlyGlu-198 |
| SEQ. ID. NO. 19954 | 218-MetGlyLysCysGluHisLeuIleGlu-226 |

Antigenic Index - Jameson-Wolf

| | |
|---|---|
| SEQ. ID. NO. 19955 | 29-ProPheArgAspGlyAlaHisLysMet-37 |
| SEQ. ID. NO. 19956 | 61-GlyAlaGluAsnIleProAspArgProAla-70 |
| SEQ. ID. NO. 19957 | 76-HisGlnSerGlyTrpGlu-81 |
| SEQ. ID. NO. 19958 | 95-ValAlaLysArgGluLeuPhe-101 |
| SEQ. ID. NO. 19959 | 116-IleGlyIleAspArgAsnAsnArgArgGluAlaAsnGluGlnLeuIle-131 |
| SEQ. ID. NO. 19960 | 134-GlyLeuAlaArgLysAsnGluGlyTyr-142 |
| SEQ. ID. NO. 19961 | 148-ProGluGlyThrArgLeuAlaProGlyLysArgGlyLysTyrLysLeuGlyGly-165 |
| SEQ. ID. NO. 19962 | 182-AsnSerGlyGluPheTrpProLysAsnSerPheLeuLysTyrProGlyGluIle-199 |
| SEQ. ID. NO. 19963 | 209-HisAlaSerGlySerGluAlaGluLeuMetGlyLysCysGluHisLeuIle-225 |
| SEQ. ID. NO. 19964 | 242-MetProSerGluThrAla-247 |

Hydrophilic Regions - Hopp-Woods

| | |
|---|---|
| SEQ. ID. NO. 19965 | 29-ProPheArgAspGlyAlaHisLysMet-37 |
| SEQ. ID. NO. 19966 | 64-AsnIleProAspArgProAla-70 |
| SEQ. ID. NO. 19967 | 95-ValAlaLysArgGluLeuPhe-101 |
| SEQ. ID. NO. 19968 | 116-IleGlyIleAspArgAsnAsnArgArgGluAlaAsnGluGlnLeuIle-131 |
| SEQ. ID. NO. 19969 | 134-GlyLeuAlaArgLysAsnGlu-140 |
| SEQ. ID. NO. 19970 | 149-GluGlyThrArgLeuAlaProGlyLysArgGlyLysTyrLysLeuGlyGly-165 |
| SEQ. ID. NO. 19971 | 211-SerGlySerGluAlaGluLeuMetGlyLysCysGluHisLeuIle-225 |
| SEQ. ID. NO. 19972 | 242-MetProSerGluThrAla-247 | a561
AMPHI Regions - AMPHI

| | |
|---|---|
| SEQ. ID. NO. 19973 | 22-GlyLeuTrpValGlyLeuAlaAla-29 |
| SEQ. ID. NO. 19974 | 46-AlaSerValIleGluGluAlaGlyAsn-54 |
| SEQ. ID. NO. 19975 | 79-ValAlaGluPheGluLysSerLeuLysArgIleAlaGln-91 |
| SEQ. ID. NO. 19976 | 128-SerTyrArgArgProThrGlnVal-135 |
| SEQ. ID. NO. 19977 | 172-MetThrLeuValSerSer-177 |
| SEQ. ID. NO. 19978 | 188-ValIleArgProLeuGlnAlaLeuArgGluGlyAlaGluArgIleGlyArgArgCysPheAspIle-209 |
| SEQ. ID. NO. 19979 | 219-PheLysGlnValGlyArgCysPheAsnGlnMet-229 |
| SEQ. ID. NO. 19980 | 238-AspAspLeuGluGlyGlnValAlaGluGlnThrArgSerLeuGluLysGln-254 |
| SEQ. ID. NO. 19981 | 265-ThrArgAspLeuHisGlnSer-271 |
| SEQ. ID. NO. 19982 | 275-GlnGlnAlaAlaGluHisPhe-281 |
| SEQ. ID. NO. 19983 | 283-AsnArgIleLeuPro-287 |
| SEQ. ID. NO. 19984 | 317-AlaSerAspLeuGlyLysTyrHisGlu-325 |
| SEQ. ID. NO. 19985 | 339-ArgLeuLeuLeuSerPheProAsnGly-347 |
| SEQ. ID. NO. 19986 | 358-LeuGlnThrLeuGlyArgGlnLeuGly-366 |
| SEQ. ID. NO. 19987 | 392-GlnGlyLeuHisAspSerIleAlaGlnAlaLeuThr-403 |
| SEQ. ID. NO. 19988 | 434-GlyValGlnGluCysTyrGluAspValArgGluLeu-445 |
| SEQ. ID. NO. 19989 | 456-LysGluPheProGluAlaValAlaAspLeuPheSerArgPheThrGlnGlnThrGly-474 |
| SEQ. ID. NO. 19990 | 504-LeuSerAsnIleArgLysHisAla-511 |
| SEQ. ID. NO. 19991 | 540-ThrGluAsnIleGlyGluProSer-547 |

Antigenic Index - Jameson-Wolf

| | |
|---|---|
| SEQ. ID. NO. 19992 | 6-ArgPheSerAspGlyIleSer-12 |
| SEQ. ID. NO. 19993 | 48-ValIleGluGluAlaGlyAsn-54 |
| SEQ. ID. NO. 19994 | 66-AlaGlyGluGlySerProArgAlaGlnIleAspAsnGlnValAlaGluPheGluLysSerLeuLysArgIleAlaGlnSerAspAlaIleHisPro-97 |
| SEQ. ID. NO. 19995 | 99-IleProSerAspThrProLeu-105 |
| SEQ. ID. NO. 19996 | 124-ProProLeuGlnSerTyrArgArgProThrGlnValAspLeu-137 |
| SEQ. ID. NO. 19997 | 152-GluAsnAlaAsnGluLysAsnThr-159 |
| SEQ. ID. NO. 19998 | 193-GlnAlaLeuArgGluGlyAlaGluArgIleGlyArgArgCysPheAsp-208 |
| SEQ. ID. NO. 19999 | 210-ProValProGluGlyGlyThrProGluPheLysGlnValGlyArgCysPheAsnGlnMetGlyGlyArgLeuLysIleLeuTyrAspAspLeuGluGly GlnValAlaGluGlnThrArgSerLeuGluLysGlnAsnGlnAsnLeu-258 |
| SEQ. ID. NO. 20000 | 263-GlnThrThrArgAspLeuHisGlnSerTyrIle-273 |
| SEQ. ID. NO. 20001 | 289-ValGlyAlaAspSerGlyArgValCysLeuAspGlyGlySerAsp-303 |
| SEQ. ID. NO. 20002 | 310-HisAlaAspCysGlyThrAlaAlaSerAspLeuGlyLysTyrHisGlu-325 |

TABLE 1-continued

| SEQ. ID. NO. 20003 | 332-TyrGlnAsnGluThrLeuGly-338 |
| SEQ. ID. NO. 20004 | 344-PheProAsnGlyIleSerLeuAspGluAspAspArgIleLeu-357 |
| SEQ. ID. NO. 20005 | 360-ThrLeuGlyArgGlnLeu-365 |
| SEQ. ID. NO. 20006 | 371-GlyAlaLysGlnGluGluGluLysArgLeu-380 |
| SEQ. ID. NO. 20007 | 384-LeuGlnGluArgAsnLeu-389 |
| SEQ. ID. NO. 20008 | 394-LeuHisAspSerIle-398 |
| SEQ. ID. NO. 20009 | 415-AlaPheAlaGluAsnLysArgGluGluAlaAlaGlu-426 |
| SEQ. ID. NO. 20010 | 434-GlyValGlnGluCysTyrGluAspValArgGlu-444 |
| SEQ. ID. NO. 20011 | 450-ArgThrLysIleSerAsnLysGluPheProGluAlaVal-462 |
| SEQ. ID. NO. 20012 | 468-ArgPheThrGlnGlnThrGlyThrThrVal-477 |
| SEQ. ID. NO. 20013 | 480-AlaTrpGluAsnGlyThrHisLeuProThrGlnAspGluGlnLeu-494 |
| SEQ. ID. NO. 20014 | 503-SerLeuSerAsnIleArgLysHisAlaHis-512 |
| SEQ. ID. NO. 20015 | 519-ArgLeuLeuLysGlnAspGlySerPheThr-528 |
| SEQ. ID. NO. 20016 | 531-IleGlnAspAsnGlyGlnGlyPheAspThrGluAsnIleGlyGluProSerGlySerHis-550 |
| SEQ. ID. NO. 20017 | 556-MetGlnGluArgAlaLysArgIle-563 |
| SEQ. ID. NO. 20018 | 568-GluIleArgSerGlnAlaGlnGlnGlyThrThr-578 |
| SEQ. ID. NO. 20019 | 584-AlaSerGluGluSerLeuLys-590 |
| Hydrophilic Regions - Hopp-Woods | |
| SEQ. ID. NO. 20020 | 48-ValIleGluGluAlaGlyAsn-54 |
| SEQ. ID. NO. 20021 | 68-GluGlySerProArgAlaGlnIle-75 |
| SEQ. ID. NO. 20022 | 78-GlnValAlaGluPheGluLysSerLeuLysArgIleAlaGln-91 |
| SEQ. ID. NO. 20023 | 128-SerTyrArgArgProThrGln-134 |
| SEQ. ID. NO. 20024 | 152-GluAsnAlaAsnGluLys-157 |
| SEQ. ID. NO. 20025 | 193-GlnAlaLeuArgGluGlyAlaGluArgIleGlyArgArgCysPhe-207 |
| SEQ. ID. NO. 20026 | 213-GluGlyGlyThrProGluPheLysGlnValGly-223 |
| SEQ. ID. NO. 20027 | 235-IleLeuTyrAspAspLeuGluGlyGlnValAlaGluGlnThrArgSerLeuGluLysGlnAsnGln-256 |
| SEQ. ID. NO. 20028 | 264-ThrThrArgAspLeuHis-269 |
| SEQ. ID. NO. 20029 | 290-GlyAlaAspSerGlyArgValCysLeu-298 |
| SEQ. ID. NO. 20030 | 312-AspCysGlyThrAlaAlaSerAspLeuGlyLysTyrHisGlu-325 |
| SEQ. ID. NO. 20031 | 349-SerLeuAspGluAspAspArgIleLeu-357 |
| SEQ. ID. NO. 20032 | 371-GlyAlaLysGlnGluGluGluLysArgLeu-380 |
| SEQ. ID. NO. 20033 | 384-LeuGlnGluArgAsnLeu-389 |
| SEQ. ID. NO. 20034 | 415-AlaPheAlaGluAsnLysArgGluGluAlaAlaGlu-426 |
| SEQ. ID. NO. 20035 | 437-GluCysTyrGluAspValArgGlu-444 |
| SEQ. ID. NO. 20036 | 451-ThrLysIleSerAsnLysGluPheProGluAlaVal-462 |
| SEQ. ID. NO. 20037 | 488-ProThrGlnAspGluGlnLeu-494 |
| SEQ. ID. NO. 20038 | 503-SerLeuSerAsnIleArgLysHisAlaHis-512 |
| SEQ. ID. NO. 20039 | 519-ArgLeuLeuLysGlnAspGly-525 |
| SEQ. ID. NO. 20040 | 533-AspAsnGlyGlnGlyPheAspThrGluAsnIleGlyGluProSerGly-548 |
| SEQ. ID. NO. 20041 | 556-MetGlnGluArgAlaLysArgIle-563 |
| SEQ. ID. NO. 20042 | 568-GluIleArgSerGlnAlaGln-574 |
| SEQ. ID. NO. 20043 | 584-AlaSerGluGluSerLeuLys-590 |
| a562 | |
| AMPHI Regions - AMPHI | |
| SEQ. ID. NO. 20044 | 48-TrpSerLeuValSerAlaTrpMetValValIle-58 |
| SEQ. ID. NO. 20045 | 84-LeuGluThrThrVal-88 |
| SEQ. ID. NO. 20046 | 90-SerAlaValArgMetLeu-95 |
| SEQ. ID. NO. 20047 | 97-PheThrProTyrThrThrValAlaSerThrSer-107 |
| SEQ. ID. NO. 20048 | 116-ThrPhePheAlaProLeuSerArgThrLeu-125 |
| SEQ. ID. NO. 20049 | 132-AsnAlaProValHisSerMetThrLysSerThrProSerSerPheHis-147 |
| SEQ. ID. NO. 20050 | 183-ValSerAsnLeuValArgTrpAlaLeu-191 |
| Antigenic Index - Jameson-Wolf | |
| SEQ. ID. NO. 20051 | 10-AsnSerGlySerThrLysProThr-17 |
| SEQ. ID. NO. 20052 | 32-ProLeuArgAlaArgArgArgSerLeuTrpArg-42 |
| SEQ. ID. NO. 20053 | 72-AlaThrGlyGluArgGlnLeuVal-79 |
| SEQ. ID. NO. 20054 | 105-SerThrSerSerProProGlyAlaGluMet-114 |
| SEQ. ID. NO. 20055 | 138-MetThrLysSerThrProSerSerPheHisGlySerSerAla-151 |
| SEQ. ID. NO. 20056 | 154-ArgValXxxLysXxxGlyIle-160 |
| SEQ. ID. NO. 20057 | 167-ArgLeuProProSerTrpAspThrSerAlaSerLysArgProCysThr-182 |
| Hydrophilic Regions - Hopp-Woods | |
| SEQ. ID. NO. 20058 | 33-LeuArgAlaArgArgArgSerLeuTrp-41 |
| SEQ. ID. NO. 20059 | 72-AlaThrGlyGluArgGlnLeuVal-79 |
| SEQ. ID. NO. 20060 | 110-ProGlyAlaGluMet-114 |
| SEQ. ID. NO. 20061 | 139-ThrLysSerThrPro-143 |
| SEQ. ID. NO. 20062 | 175-SerAlaSerLysArgProCysThr-182 |
| a565 | |
| AMPHI Regions - AMPHI | |
| SEQ. ID. NO. 20063 | 50-AlaThrCysThrArgAlaMetSerLysSer-59 |
| SEQ. ID. NO. 20064 | 66-SerSerTrpAlaArg-70 |
| SEQ. ID. NO. 20065 | 84-IleSerThrTrpSerAspLeu-90 |
| SEQ. ID. NO. 20066 | 103-AspPheMetSerGlnLeuAspLeuThr-111 |
| SEQ. ID. NO. 20067 | 140-SerHisSerSerGluThrIleSerSerCysProAlaMetAlaSerIleThrLysProAsn-159 |
| SEQ. ID. NO. 20068 | 184-AlaAsnThrThrSerAlaPhe-190 |
| Antigenic Index - Jameson-Wolf | |
| SEQ. ID. NO. 20069 | 1-MetAspSerThrLeuSerLysThrCys-9 |
| SEQ. ID. NO. 20070 | 23-PheAlaArgProArgProAlaAlaSerAsnThrSerLeu-35 |
| SEQ. ID. NO. 20071 | 37-PheAlaSerProAsnAspThrGlySer-45 |
| SEQ. ID. NO. 20072 | 55-AlaMetSerLysSerSerAlaLysTyrGly-64 |
| SEQ. ID. NO. 20073 | 67-SerTrpAlaArgThrArgProThrValCysProProLeuProLysProThrIle-84 |
| SEQ. ID. NO. 20074 | 99-CysArgSerSerAspPheMetSer-106 |

TABLE 1-continued

| | |
|---|---|
| SEQ. ID. NO. 20075 | 109-AspLeuThrLysArgProThrSerAlaSerLeuProProLysArgLysGlyAlaIle-127 |
| SEQ. ID. NO. 20076 | 129-IleAspSerArgThrAlaAla-135 |
| SEQ. ID. NO. 20077 | 140-SerHisSerSerGluThrIleSerSerCysProAla-151 |
| SEQ. ID. NO. 20078 | 155-IleThrLysProAsnSerProProCysAlaArgTyr-166 |
| SEQ. ID. NO. 20079 | 170-LeuArgLeuSerProThrGlu-176 |
| SEQ. ID. NO. 20080 | 194-SerIleAlaAsnSerIleAsnThrCysArgGlnProPro-206 |
| Hydrophilic Regions - Hopp-Woods | |
| SEQ. ID. NO. 20081 | 24-AlaArgProArgProAlaAla-30 |
| SEQ. ID. NO. 20082 | 39-SerProAsnAspThrGlySer-45 |
| SEQ. ID. NO. 20083 | 55-AlaMetSerLysSerSerAla-61 |
| SEQ. ID. NO. 20084 | 69-AlaArgThrArgPro-73 |
| SEQ. ID. NO. 20085 | 100-ArgSerSerAspPhe-104 |
| SEQ. ID. NO. 20086 | 109-AspLeuThrLysArgProThrSer-116 |
| SEQ. ID. NO. 20087 | 119-LeuProProLysArgLysGlyAlaIle-127 |
| SEQ. ID. NO. 20088 | 129-IleAspSerArgThr-133 |
| SEQ. ID. NO. 20089 | 141-HisSerSerGluThrIleSer-147 |
| SEQ. ID. NO. 20090 | 156-ThrLysProAsnSer-160 |
| a566 | |
| Antigenic Index - Jameson-Wolf | |
| SEQ. ID. NO. 20091 | 35-TyrProAsnCysGlyAlaAspGlyAlaGlyGlyLysGlyHis-48 |
| SEQ. ID. NO. 20092 | 61-AlaValGlyGlyGluGluGlyGlyValValAlaAspAspValAlaArgAlaAspGlyGlyLysAlaAspGlyGlyArgIleAlaArg-89 |
| SEQ. ID. NO. 20093 | 105-SerAlaGluArgAlaGlyAspAspPheAla-114 |
| Hydrophilic Regions - Hopp-Woods | |
| SEQ. ID. NO. 20094 | 39-GlyAlaAspGlyAlaGlyGlyLysGlyHis-48 |
| SEQ. ID. NO. 20095 | 63-GlyGlyGluGluGlyGlyValValAlaAspAspValAlaArgAlaAspGlyGlyLysAlaAspGlyGlyArgIleAlaArg-89 |
| SEQ. ID. NO. 20096 | 105-SerAlaGluArgAlaGlyAspAspPheAla-114 |
| a567 | |
| AMPHI Regions - AMPHI | |
| SEQ. ID. NO. 20097 | 60-GlyValTyrGlnVal-64 |
| SEQ. ID. NO. 20098 | 98-GluLeuValGlnGluIleAlaArgGluVal-107 |
| SEQ. ID. NO. 20099 | 112-AlaLeuLysAlaVal-116 |
| SEQ. ID. NO. 20100 | 154-TyrAlaLeuGluGlyIleSerAspLeuIleAlaThrValArgLysIleArgGln-171 |
| SEQ. ID. NO. 20101 | 180-ThrGlyIleValArg-184 |
| SEQ. ID. NO. 20102 | 195-AlaGluValSerGluGlnLeuArgSerHisPheGlyAspLeuLeu-209 |
| Antigenic Index - Jameson-Wolf | |
| SEQ. ID. NO. 20103 | 10-AsnGlnLysGlyGlyValGlyLysThrThrThr-20 |
| SEQ. ID. NO. 20104 | 28-LeuAlaSerArgGlyLysArg-34 |
| SEQ. ID. NO. 20105 | 38-ValAspLeuAspProGlnGlyAsnAlaThrThrGlySerGlyIleAspLysAlaSerLeuGlnSerGly-60 |
| SEQ. ID. NO. 20106 | 67-GlyAspAlaAspValLysSerAlaAlaValArgSerLysGluGlyGlyTyr-83 |
| SEQ. ID. NO. 20107 | 95-AlaGluIleGluLeu-99 |
| SEQ. ID. NO. 20108 | 101-GlnGluIleAlaArgGluValArgLeuLysAsnAlaLeu-113 |
| SEQ. ID. NO. 20109 | 115-AlaValAlaGluAspTyrAsp-121 |
| SEQ. ID. NO. 20110 | 127-CysProProSerLeu-131 |
| SEQ. ID. NO. 20111 | 164-AlaThrValArgLysIleArgGlnAlaValAsnProAspLeuAspIle-179 |
| SEQ. ID. NO. 20112 | 185-ThrMetTyrAspSerArgSerArgLeuValAlaGluValSerGluGlnLeuArgSerHisPheGlyAspLeu-208 |
| SEQ. ID. NO. 20113 | 214-IleProArgAsnIleArgLeuAlaGluAlaProSerHisGly-227 |
| SEQ. ID. NO. 20114 | 235-AlaGlnAlaLysGlyAlaLys-241 |
| SEQ. ID. NO. 20115 | 248-AspGluLeuMetAla-252 |
| Hydrophilic Regions - Hopp-Woods | |
| SEQ. ID. NO. 20116 | 10-AsnGlnLysGlyGlyValGlyLys-17 |
| SEQ. ID. NO. 20117 | 28-LeuAlaSerArgGlyLysArg-34 |
| SEQ. ID. NO. 20118 | 40-LeuAspProGlnGly-44 |
| SEQ. ID. NO. 20119 | 50-SerGlyIleAspLysAlaSerLeu-57 |
| SEQ. ID. NO. 20120 | 67-GlyAspAlaAspValLysSerAlaAlaValArgSerLysGluGlyGly-82 |
| SEQ. ID. NO. 20121 | 95-AlaGluIleGluLeu-99 |
| SEQ. ID. NO. 20122 | 101-GlnGluIleAlaArgGluValArgLeuLysAsnAlaLeu-113 |
| SEQ. ID. NO. 20123 | 115-AlaValAlaGluAspTyrAsp-121 |
| SEQ. ID. NO. 20124 | 164-AlaThrValArgLysIleArgGln-171 |
| SEQ. ID. NO. 20125 | 175-ProAspLeuAspIle-179 |
| SEQ. ID. NO. 20126 | 186-MetTyrAspSerArgSerArgLeuValAlaGluValSerGluGlnLeuArg-202 |
| SEQ. ID. NO. 20127 | 216-ArgAsnIleArgLeuAlaGluAlaProSer-225 |
| SEQ. ID. NO. 20128 | 235-AlaGlnAlaLysGlyAlaLys-241 |
| SEQ. ID. NO. 20129 | 248-AspGluLeuMetAla-252 |
| a568 | |
| AMPHI Regions - AMPHI | |
| SEQ. ID. NO. 20130 | 31-SerIlePheArgArg-35 |
| SEQ. ID. NO. 20131 | 48-LysAlaCysLysAsn-52 |
| SEQ. ID. NO. 20132 | 70-GluLysAlaAsnThrValArgTyr-77 |
| SEQ. ID. NO. 20133 | 81-SerLeuAlaGlnCysPheThr-87 |
| SEQ. ID. NO. 20134 | 111-ArgProLeuProSerIleIleThrAla-119 |
| SEQ. ID. NO. 20135 | 168-GluPheValGlyPheGlyAsnValPheValGlyGlnPheLeuAsnArgPhePhe-185 |
| SEQ. ID. NO. 20136 | 199-GluGluPhePheAspValValVal-206 |
| SEQ. ID. NO. 20137 | 227-PheAsnGlnValPheAlaAlaPheLeu-235 |
| SEQ. ID. NO. 20138 | 240-HisArgHisAlaAspGlnValAlaAspSerCysArgValGlnSerGln-255 |
| Antigenic Index - Jameson-Wolf | |
| SEQ. ID. NO. 20139 | 22-IleArgLeuLysArgSerArgLeuProSerIlePhe-33 |
| SEQ. ID. NO. 20140 | 38-PheSerCysArgArgArgThrCysPheCysLysAlaCysLysAsnSerProIleArgAsnGluThrSerSerSerGlyArgArgGlnPheSerValGluLysAlaAsnThr-74 |
| SEQ. ID. NO. 20141 | 90-SerAsnAlaSerLysProArgLeu-97 |
| SEQ. ID. NO. 20142 | 99-ProIleMetArgGlyArgLysArgPhePheAla-109 |

TABLE 1-continued

| | |
|---|---|
| SEQ. ID. NO. 20143 | 140-PheArgGlySerAlaPheLysCysArgLeuAsnAlaGluProCysArg-155 |
| SEQ. ID. NO. 20144 | 213-AlaAspGlyAspAla-217 |
| SEQ. ID. NO. 20145 | 236-GlyGlnHisGlyHisArgHisAlaAspGlnValAlaAspSerCysArgValGlnSerGln-255 |

Hydrophilic Regions - Hopp-Woods

| | |
|---|---|
| SEQ. ID. NO. 20146 | 22-IleArgLeuLysArgSerArgLeu-29 |
| SEQ. ID. NO. 20147 | 40-CysArgArgArgThrCysPhe-46 |
| SEQ. ID. NO. 20148 | 48-LysAlaCysLysAsnSerProIleArgAsnGluThrSerSerSerGlyArgArgGlnPheSerValGluLysAlaAsnThr-74 |
| SEQ. ID. NO. 20149 | 92-AlaSerLysProArgLeu-97 |
| SEQ. ID. NO. 20150 | 101-MetArgGlyArgLysArgPhePheAla-109 |
| SEQ. ID. NO. 20151 | 143-SerAlaPheLysCysArgLeuAsnAlaGluProCysArg-155 |
| SEQ. ID. NO. 20152 | 238-HisGlyHisArgHisAlaAspGlnValAlaAspSerCysArgVal-252 | a569-2
AMPHI Regions - AMPHI

| | |
|---|---|
| SEQ. ID. NO. 20153 | 29-AlaAlaPheCysGlyLeuIleAlaLeuThrAlaLeuTrpGluTyrAlaArgMetAlaGlyLeuCysLys-51 |
| SEQ. ID. NO. 20154 | 86-PheTrpLeuAlaValMetPro-92 |
| SEQ. ID. NO. 20155 | 161-IleAlaArgAlaIleSerProGlyLysSerTrpGluGlyAlaIle-175 |
| SEQ. ID. NO. 20156 | 203-ThrValLeuIleGlyLeu-208 |
| SEQ. ID. NO. 20157 | 210-LeuThrValValSerValCysGlyAspLeuLeuGluSerTrpLeuLys-225 |

Antigenic Index - Jameson-Wolf

| | |
|---|---|
| SEQ. ID. NO. 20158 | 50-CysLysThrGluThrAsnHis-56 |
| SEQ. ID. NO. 20159 | 98-LysTrpArgLeuAsnGlyGlyTrp-105 |
| SEQ. ID. NO. 20160 | 124-SerLeuArgProHisProAspAspAlaLeu-133 |
| SEQ. ID. NO. 20161 | 154-LysAlaLeuGlyLysHisLysIleAlaArg-163 |
| SEQ. ID. NO. 20162 | 165-IleSerProGlyLysSerTrpGlu-172 |
| SEQ. ID. NO. 20163 | 227-AlaAlaGlyIleLysAspSerSerAsnLeuLeuProGlyHis-240 |
| SEQ. ID. NO. 20164 | 242-GlyValPheAspArgThrAspSer-249 |

Hydrophilic Regions - Hopp-Woods

| | |
|---|---|
| SEQ. ID. NO. 20165 | 50-CysLysThrGluThr-54 |
| SEQ. ID. NO. 20166 | 127-ProHisProAspAspAlaLeu-133 |
| SEQ. ID. NO. 20167 | 155-AlaLeuGlyLysHisLysIleAlaArg-163 |
| SEQ. ID. NO. 20168 | 227-AlaAlaGlyIleLysAspSerSerAsn-235 |
| SEQ. ID. NO. 20169 | 243-ValPheAspArgThrAspSer-249 | a570
AMPHI Regions - AMPHI

| | |
|---|---|
| SEQ. ID. NO. 20170 | 6-ArgAlaPheAlaAlaAlaLeuIleGlyLeu-15 |
| SEQ. ID. NO. 20171 | 22-HisAlaAspThrPheGlnLysIleGlyPheIleAsn-33 |
| SEQ. ID. NO. 20172 | 43-GlnAlaArgLysIleGlnLysThrLeuAspSer-53 |
| SEQ. ID. NO. 20173 | 60-AspGluLeuGlnLysLeuGln-66 |
| SEQ. ID. NO. 20174 | 81-LeuLysAspAlaLysLys-86 |
| SEQ. ID. NO. 20175 | 122-LeuGlnGlnAsnAlaAsnArgValIleValLysIle-133 |

Antigenic Index - Jameson-Wolf

| | |
|---|---|
| SEQ. ID. NO. 20176 | 33-AsnThrGluArgIleTyrLeuGluSerLysGlnAlaArgLysIleGlnLysThrLeuAspSerGluPheSerAlaArgGlnAspGluLeuGlnLysLeu GlnArgGluGlyLeuAspLeuGluArgGlnLeuAlaGluGlyLysLeuLysAspAlaLysLysAlaGlnAlaGluGluLysTrp-93 |
| SEQ. ID. NO. 20177 | 100-PheArgLysLysGlnAlaGlnPheGluGluAspTyrAsnLeuArgArgAsnGluGluPheAla-120 |
| SEQ. ID. NO. 20178 | 123-GlnGlnAsnAlaAsnArgVal-129 |
| SEQ. ID. NO. 20179 | 133-IleAlaLysGlnGluGlyTyrAspValIle-142 |
| SEQ. ID. NO. 20180 | 150-AsnThrGlnTyrAspValThrAspSerValIleLysGluMetAsnAlaArg-166 |

Hydrophilic Regions - Hopp-Woods

| | |
|---|---|
| SEQ. ID. NO. 20181 | 37-IleTyrLeuGluSerLysGlnAlaArgLysIleGlnLysThrLeuAspSerGluPheSerAlaArgGlnAspGluLeuGlnLysLeuGlnArgGluGly LeuAspLeuGluArgGlnLeuAlaGluGlyLysLeuLysAspAlaLysLysAlaGlnAlaGluGluLysTrp-93 |
| SEQ. ID. NO. 20182 | 100-PheArgLysLysGlnAlaGlnPheGluGluAspTyrAsnLeuArgArgAsnGluGluPheAla-120 |
| SEQ. ID. NO. 20183 | 133-IleAlaLysGlnGluGlyTyr-139 |
| SEQ. ID. NO. 20184 | 154-AspValThrAspSerValIleLysGluMetAsnAlaArg-166 | a571
AMPHI Regions - AMPHI

| | |
|---|---|
| SEQ. ID. NO. 20185 | 6-AlaValAsnValLeu-10 |
| SEQ. ID. NO. 20186 | 40-AspGlyAlaArgValPheArgAlaGly-48 |
| SEQ. ID. NO. 20187 | 63-AlaAlaValAlaAspPhePheAlaVal-71 |
| SEQ. ID. NO. 20188 | 94-ValGluValPheLysGlu-99 |

Antigenic Index - Jameson-Wolf

| | |
|---|---|
| SEQ. ID. NO. 20189 | 13-AlaAlaGlyArgGlyThr-18 |
| SEQ. ID. NO. 20190 | 35-LysGlnAlaGlnAlaAspGlyAlaArgValPheArgAlaGlyHisArgGluGluGlnLeuGlyGlyAspVal-58 |
| SEQ. ID. NO. 20191 | 77-ArgThrGluArgAlaAla-82 |
| SEQ. ID. NO. 20192 | 96-ValPheLysGluGlyAspPhe-102 |
| SEQ. ID. NO. 20193 | 110-ArgAsnAlaAspPheAlaAlaGluHisGlnArgGluGlyPheAlaGlyGluGluProGlyLeuValValGly-133 |
| SEQ. ID. NO. 20194 | 143-GlyGlnGlyAspPheGlyVal-149 |
| SEQ. ID. NO. 20195 | 154-ValAlaAlaArgArgPro-159 |

Hydrophilic Regions - Hopp-Woods

| | |
|---|---|
| SEQ. ID. NO. 20196 | 13-AlaAlaGlyArgGly-17 |
| SEQ. ID. NO. 20197 | 35-LysGlnAlaGlnAlaAspGlyAlaArgValPheArgAlaGlyHisArgGluGluGlnLeuGly-55 |
| SEQ. ID. NO. 20198 | 77-ArgThrGluArgAlaAla-82 |
| SEQ. ID. NO. 20199 | 96-ValPheLysGluGlyAspPhe-102 |
| SEQ. ID. NO. 20200 | 110-ArgAsnAlaAspPheAlaAlaGluHisGlnArgGluGlyPheAlaGlyGluGluProGly-129 |
| SEQ. ID. NO. 20201 | 154-ValAlaAlaArgArgPro-159 | a572
AMPHI Regions - AMPHI

| | |
|---|---|
| SEQ. ID. NO. 20202 | 6-GlyAlaValGlyLeuProSerAlaLeuAla-15 |
| SEQ. ID. NO. 20203 | 61-GlnValLeuProArgAspTyrThrGlyArg-70 |
| SEQ. ID. NO. 20204 | 94-AsnThrPheAspSerIle-99 |
| SEQ. ID. NO. 20205 | 126-LysGlyLeuGluLeu-130 |

TABLE 1-continued

| | |
|---|---|
| SEQ. ID. NO. 20206 | 154-IleHisSerMetValArg-159 |
| SEQ. ID. NO. 20207 | 183-GlyLeuProGluArgIleAspSerGly-191 |
| SEQ. ID. NO. 20208 | 200-LeuSerAlaLeuThr-204 |
| SEQ. ID. NO. 20209 | 241-ValAlaAlaPheLeu-245 |
| SEQ. ID. NO. 20210 | 251-PheThrAspIleAlaLysThrValAlaHisCysLeuSerGlnAspPheSerAspGlyIleGlyAspIleGlyGly-275 |

Antigenic Index - Jameson-Wolf

| | |
|---|---|
| SEQ. ID. NO. 20211 | 18-GlnLysGlyLysThr-22 |
| SEQ. ID. NO. 20212 | 26-AlaAsnLysGluThrLeu-31 |
| SEQ. ID. NO. 20213 | 41-ThrAlaArgAlaAsnGly-46 |
| SEQ. ID. NO. 20214 | 51-ProValAspSerGluHis-56 |
| SEQ. ID. NO. 20215 | 63-LeuProArgAspTyrThrGlyArgLeuAsnGluHisGly-75 |
| SEQ. ID. NO. 20216 | 94-AsnThrPheAspSerIleThrProAspGlnAlaValLysHisProAsnTrpArgMetGlyArgLysIleSerValAspSer-120 |
| SEQ. ID. NO. 20217 | 125-AsnLysGlyLeuGluLeu-130 |
| SEQ. ID. NO. 20218 | 138-AsnCysProProAspLysLeuGluVal-146 |
| SEQ. ID. NO. 20219 | 158-ValArgTyrArgAspGlySerVal-165 |
| SEQ. ID. NO. 20220 | 170-GlyAsnProAspMetArgThr-176 |
| SEQ. ID. NO. 20221 | 184-LeuProGluArgIleAspSerGlyValGlyAspLeuAspPhe-197 |
| SEQ. ID. NO. 20222 | 204-ThrPheGlnLysProAspPheAspArg-212 |
| SEQ. ID. NO. 20223 | 263-SerGlnAspPheSerAspGlyIleGlyAspIleGly-274 |
| SEQ. ID. NO. 20224 | 279-GlnAspAlaArgThrArgAlaGlnAla-287 |

Hydrophilic Regions - Hopp-Woods

| | |
|---|---|
| SEQ. ID. NO. 20225 | 27-AsnLysGluThrLeu-31 |
| SEQ. ID. NO. 20226 | 41-ThrAlaArgAlaAsnGly-46 |
| SEQ. ID. NO. 20227 | 52-ValAspSerGluHis-56 |
| SEQ. ID. NO. 20228 | 66-AspTyrThrGlyArgLeuAsnGlu-73 |
| SEQ. ID. NO. 20229 | 111-ArgMetGlyArgLysIleSerVal-118 |
| SEQ. ID. NO. 20230 | 126-LysGlyLeuGluLeu-130 |
| SEQ. ID. NO. 20231 | 140-ProProAspLysLeuGlu-145 |
| SEQ. ID. NO. 20232 | 158-ValArgTyrArgAspGlySer-164 |
| SEQ. ID. NO. 20233 | 170-GlyAsnProAspMetArgThr-176 |
| SEQ. ID. NO. 20234 | 184-LeuProGluArgIleAspSerGlyValGlyAspLeuAspPhe-197 |
| SEQ. ID. NO. 20235 | 206-GlnLysProAspPheAspArg-212 |
| SEQ. ID. NO. 20236 | 265-AspPheSerAspGlyIleGly-271 |
| SEQ. ID. NO. 20237 | 279-GlnAspAlaArgThrArgAlaGlnAla-287 | a574
AMPHI Regions - AMPHI

| | |
|---|---|
| SEQ. ID. NO. 20238 | 6-ProAsnSerLeuGluLys-11 |
| SEQ. ID. NO. 20239 | 47-LeuLysGlnAlaLysSerIleProSerGlyPheTyrLysSerLeuAspAlaLeuValAspArgAsnSerGlyArgAlaAlaArgGluLeuAlaGluVal ValAsp-81 |
| SEQ. ID. NO. 20240 | 94-GlyLysLeuTyrArgGln-99 |
| SEQ. ID. NO. 20241 | 110-HisGlnThrLeuLeuAspSerProAspThrThrGly-121 |
| SEQ. ID. NO. 20242 | 175-GluLysAlaValGluThrAlaArgLeu-183 |
| SEQ. ID. NO. 20243 | 218-AsnValGlyLysAlaLeuGluAlaAsnLysLysCys-229 |
| SEQ. ID. NO. 20244 | 246-PheProAlaAlaValGluAlaTyrAlaAlaIleGlu-257 |
| SEQ. ID. NO. 20245 | 266-MetValGlyGluLysLeuTyrGluAlaTyrAla-276 |
| SEQ. ID. NO. 20246 | 281-ProGluGluGlyLeuAsnArgLeuThrGlyTyrMetGlnThrPheProGluLeuAspLeu-300 |
| SEQ. ID. NO. 20247 | 332-AsnGlyValTyrArg-336 |
| SEQ. ID. NO. 20248 | 357-ArgSerValIleGlyArgGlnLeuGlnArgSer-367 |

Antigenic Index - Jameson-Wolf

| | |
|---|---|
| SEQ. ID. NO. 20249 | 1-MetArgProAsnLeuProAsnSerLeuGluLysAlaAspMetAspAsn-16 |
| SEQ. ID. NO. 20250 | 45-ThrValLeuLysGlnAlaLysSerIleProSerGlyPheTyrLysSerLeuAspAlaLeuValAspArgAsnSerGlyArgAlaAlaArgGluLeuAla GluValValAspGlyArgProGlnSerTyrAsp-88 |
| SEQ. ID. NO. 20251 | 96-LeuTyrArgGlnArgGlyGluAsnAspLysAlaIle-107 |
| SEQ. ID. NO. 20252 | 113-LeuLeuAspSerProAspThrThrGlyAlaLysArgAlaArgVal-127 |
| SEQ. ID. NO. 20253 | 135-TyrGlnSerAlaGlyLeuValAspArgAlaGlu-145 |
| SEQ. ID. NO. 20254 | 151-LeuGlnAspGlyGluMetAlaArgGluAlaArgGln-162 |
| SEQ. ID. NO. 20255 | 168-TyrGlnGlnAspArgAspTrpGluLysAlaValGluThr-180 |
| SEQ. ID. NO. 20256 | 182-ArgLeuLeuSerHisAspAspGlnThrTyr-191 |
| SEQ. ID. NO. 20257 | 210-SerAsnPheAspAlaAlaArg-216 |
| SEQ. ID. NO. 20258 | 221-LysAlaLeuGluAlaAsnLysLysCysThrArg-231 |
| SEQ. ID. NO. 20259 | 238-AspIleGluHisArgGlnGlyAsn-245 |
| SEQ. ID. NO. 20260 | 277-AlaGlnGlyLysProGluGluGlyLeuAsnArgLeuThrGlyTyr-291 |
| SEQ. ID. NO. 20261 | 312-LysCysGluLysGluAlaAla-318 |
| SEQ. ID. NO. 20262 | 323-GluLeuValArgLysProAspLeuAsnGly-333 |
| SEQ. ID. NO. 20263 | 341-LysLeuSerAspLeuAspProAlaTrpLysAlaAspAlaAspMetMetArg-357 |
| SEQ. ID. NO. 20264 | 368-ValMetTyrArgCysArgAsnCysHisPheLys-378 |
| SEQ. ID. NO. 20265 | 386-CysProAlaCysAsnLysTrpGlnThrPheThrProAsnLysIleGluVal-402 |

Hydrophilic Regions - Hopp-Woods

| | |
|---|---|
| SEQ. ID. NO. 20266 | 1-MetArgProAsnLeu-5 |
| SEQ. ID. NO. 20267 | 7-AsnSerLeuGluLysAlaAspMetAspAsn-16 |
| SEQ. ID. NO. 20268 | 45-ThrValLeuLysGlnAlaLysSerIle-53 |
| SEQ. ID. NO. 20269 | 62-AspAlaLeuValAspArgAsnSerGlyArgAlaAlaArgGluLeuAlaGluValValAspGlyArgProGlnSer-86 |
| SEQ. ID. NO. 20270 | 96-LeuTyrArgGlnArgGlyGluAsnAspLysAlaIle-107 |
| SEQ. ID. NO. 20271 | 115-AspSerProAspThrThrGlyAlaLysArgAlaArgVal-127 |
| SEQ. ID. NO. 20272 | 140-LeuValAspArgAlaGlu-145 |
| SEQ. ID. NO. 20273 | 152-GlnAspGlyGluMetAlaArgGluAlaArgGln-162 |
| SEQ. ID. NO. 20274 | 169-GlnGlnAspArgAspTrpGluLysAlaValGluThr-180 |
| SEQ. ID. NO. 20275 | 184-LeuSerHisAspAspGlnThrTyr-191 |
| SEQ. ID. NO. 20276 | 211-AsnPheAspAlaAlaArg-216 |
| SEQ. ID. NO. 20277 | 221-LysAlaLeuGluAlaAsnLysLysCysThrArg-231 |

TABLE 1-continued

| | |
|---|---|
| SEQ. ID. NO. 20278 | 238-AspIleGluHisArgGlnGlyAsn-245 |
| SEQ. ID. NO. 20279 | 279-GlyLysProGluGluGlyLeuAsn-286 |
| SEQ. ID. NO. 20280 | 312-LysCysGluLysGluAlaAla-318 |
| SEQ. ID. NO. 20281 | 323-GluLeuValArgArgLysProAspLeu-331 |
| SEQ. ID. NO. 20282 | 341-LysLeuSerAspLeuAspPro-347 |
| SEQ. ID. NO. 20283 | 349-TrpLysAlaAspAlaAspMetMetArg-357 |
| SEQ. ID. NO. 20284 | 368-ValMetTyrArgCysArgAsnCysHis-376 |
| SEQ. ID. NO. 20285 | 398-AsnLysIleGluVal-402 | a575
AMPHI Regions - AMPHI

| | |
|---|---|
| SEQ. ID. NO. 20286 | 8-PheArgLysProAlaSer-13 |
| SEQ. ID. NO. 20287 | 20-PheAlaGluAlaVal-24 |
| SEQ. ID. NO. 20288 | 42-SerThrValSerGlyLeuPheSerAla-50 |
| SEQ. ID. NO. 20289 | 114-LeuSerLysSerLysSer-119 |
| SEQ. ID. NO. 20290 | 139-SerSerAspSerPro-143 |
| SEQ. ID. NO. 20291 | 150-PheThrSerPhePheGly-155 |
| SEQ. ID. NO. 20292 | 163-ValSerThrSerAlaLysValIleSerMetPro-173 |
| SEQ. ID. NO. 20293 | 217-SerLysValTyrGluProProAsn-224 |
| SEQ. ID. NO. 20294 | 233-AlaGluThrCysSerThr-238 |
| SEQ. ID. NO. 20295 | 283-AlaGlyPheSerAlaPheAlaSerGlyAla-292 |
| SEQ. ID. NO. 20296 | 294-ThrPheAlaSerGlyPheSerThrGly-302 |
| SEQ. ID. NO. 20297 | 304-SerThrValAlaCys-308 |
| SEQ. ID. NO. 20298 | 311-GlySerAspGlyMetAspAlaValSerAlaLeu-321 |

Antigenic Index - Jameson-Wolf

| | |
|---|---|
| SEQ. ID. NO. 20299 | 2-ValSerGlyGluGluAlaPheArgLysProAlaSerProGluGlyGluAlaGlyPhe-20 |
| SEQ. ID. NO. 20300 | 34-GlyArgLeuSerGluLysSerValSer-42 |
| SEQ. ID. NO. 20301 | 54-ThrAspSerGlySerGlyVal-60 |
| SEQ. ID. NO. 20302 | 96-SerSerSerCysValSerAlaProAspLysMetProPhe-108 |
| SEQ. ID. NO. 20303 | 113-ArgLeuSerLysSerLysSerMetArgLeuGluGly-124 |
| SEQ. ID. NO. 20304 | 134-PheAlaAspAsnSerSerSerAspSerProSerLysAlaSerVal-148 |
| SEQ. ID. NO. 20305 | 155-GlyAlaGlySerGly-159 |
| SEQ. ID. NO. 20306 | 173-ProSerSerAlaAlaSerSerArgSerGlySerSerSerGlyThrAspSerSerValArgArgAlaArgLeuAspTrpAlaArgArgLysSerSerSerArgAlaIle-208 |
| SEQ. ID. NO. 20307 | 211-AlaProProAlaSer-216 |
| SEQ. ID. NO. 20308 | 218-LysValTyrGluProProAsnSerProLeu-227 |
| SEQ. ID. NO. 20309 | 230-SerSerSerAlaGluThrCysSerThrGlySerGluThr-242 |
| SEQ. ID. NO. 20310 | 261-GlyAlaAspSerAlaAlaVal-267 |
| SEQ. ID. NO. 20311 | 276-GlyThrGlySerGlyArgThrAla-283 |
| SEQ. ID. NO. 20312 | 299-PheSerThrGlyPhe-303 |
| SEQ. ID. NO. 20313 | 309-LeuAspGlySerAspGlyMetAsp-316 |

Hydrophilic Regions - Hopp-Woods

| | |
|---|---|
| SEQ. ID. NO. 20314 | 2-ValSerGlyGluGluAlaPheArgLysProAlaSerProGluGlyGluAlaGlyPhe-20 |
| SEQ. ID. NO. 20315 | 34-GlyArgLeuSerGluLysSerValSer-42 |
| SEQ. ID. NO. 20316 | 101-SerAlaProAspLysMetPro-107 |
| SEQ. ID. NO. 20317 | 113-ArgLeuSerLysSerLysSerMetArgLeuGluGly-124 |
| SEQ. ID. NO. 20318 | 137-AsnSerSerAspSerProSerLysAla-146 |
| SEQ. ID. NO. 20319 | 176-AlaAlaSerSerArgSerGlySerSerSerGlyThrAspSerSerValArgArgAlaArgLeuAspTrpAlaArgArgLysSerSerSerArgAlaIle-208 |
| SEQ. ID. NO. 20320 | 231-SerSerAlaGluThrCysSerThrGlySerGluThr-242 |
| SEQ. ID. NO. 20321 | 310-AspGlySerAspGlyMetAsp-316 | a576-1
AMPHI Regions - AMPHI

| | |
|---|---|
| SEQ. ID. NO. 20322 | 31-AlaSerGluProAlaAlaAla-37 |
| SEQ. ID. NO. 20323 | 46-SerIleGlySerThr-50 |
| SEQ. ID. NO. 20324 | 63-GlyArgSerLeuLysGlnMetLys-70 |
| SEQ. ID. NO. 20325 | 82-ThrGluAlaMetGln-86 |
| SEQ. ID. NO. 20326 | 102-GlnGluValMetMetLysPheLeuGlnGluGlnGlnAlaLysAlaValGluLysHis-120 |
| SEQ. ID. NO. 20327 | 140-AlaLysAspGlyValLysThrThr-147 |
| SEQ. ID. NO. 20328 | 202-IleLeuGlyTrpThrGluGlyVal-209 |

Antigenic Index - Jameson-Wolf

| | |
|---|---|
| SEQ. ID. NO. 20329 | 20-AlaCysGlyLysLysGluAlaAlaPro-28 |
| SEQ. ID. NO. 20330 | 30-SerAlaSerGluProAlaAla-36 |
| SEQ. ID. NO. 20331 | 38-SerSerAlaGlnGlyAspThrSerSerIleGly-48 |
| SEQ. ID. NO. 20332 | 61-AspIleGlyArgSerLeuLysGlnMetLysGluGlnGlyAlaGluIleAspLeu-78 |
| SEQ. ID. NO. 20333 | 89-TyrAspGlyLysGluIleLysMetThrGluGluGlnAlaGln-102 |
| SEQ. ID. NO. 20334 | 109-LeuGlnGluGlnGlnAlaLysAlaValGluLysHisLysAlaAspAlaLysAlaAsnLysGluLysGlyGluAlaPheLeuLysGluAsnAlaAlaLysAspGlyValLysThrThrAlaSerGlyLeu-151 |
| SEQ. ID. NO. 20335 | 154-LysIleThrLysGlnGlyGluGlyLysGlnProThrLysAspAspIleVal-170 |
| SEQ. ID. NO. 20336 | 173-GluTyrGluGlyArgLeuIleAsp-180 |
| SEQ. ID. NO. 20337 | 183-ValPheAspSerSerLysAlaAsnGlyGly-192 |
| SEQ. ID. NO. 20338 | 210-GlnLeuLeuLysGluGlyGlyGlu-217 |
| SEQ. ID. NO. 20339 | 224-SerAsnLeuAlaTyrArgGluGlnGlyAlaGlyAspLysIleGlyProAsnAla-241 |
| SEQ. ID. NO. 20340 | 253-GlyAlaProGluAsnAlaProAlaLysGlnProAla-264 |
| SEQ. ID. NO. 20341 | 266-ValAspIleLysLysValAsn-272 |

Hydrophilic Regions - Hopp-Woods

| | |
|---|---|
| SEQ. ID. NO. 20342 | 21-CysGlyLysLysGluAlaAlaPro-28 |
| SEQ. ID. NO. 20343 | 30-SerAlaSerGluProAlaAla-36 |
| SEQ. ID. NO. 20344 | 40-AlaGlnGlyAspThrSerSer-46 |
| SEQ. ID. NO. 20345 | 61-AspIleGlyArgSerLeuLysGlnMetLysGluGlnGlyAlaGluIleAspLeu-78 |
| SEQ. ID. NO. 20346 | 89-TyrAspGlyLysGluIleLysMetThrGluGluGlnAlaGln-102 |

TABLE 1-continued

| | |
|---|---|
| SEQ. ID. NO. 20347 | 112-GlnGlnAlaLysAlaValGluLysHisLysAlaAspAlaLysAlaAsnLysGluLysGlyGluAlaPheLeuLysGluAsnAlaAlaLysAspGlyVal LysThrThrAla-148 |
| SEQ. ID. NO. 20348 | 155-IleThrLysGlnGlyGluGlyLysGlnProThrLysAspAspIleVal-170 |
| SEQ. ID. NO. 20349 | 173-GluTyrGluGlyArgLeuIleAsp-180 |
| SEQ. ID. NO. 20350 | 185-AspSerSerLysAlaAsnGly-191 |
| SEQ. ID. NO. 20351 | 210-GlnLeuLeuLysGluGlyGlyGlu-217 |
| SEQ. ID. NO. 20352 | 227-AlaTyrArgGluGlnGlyAlaGlyAspLysIleGlyPro-239 |
| SEQ. ID. NO. 20353 | 253-GlyAlaProGluAsnAlaProAlaLysGlnProAla-264 |
| SEQ. ID. NO. 20354 | 266-ValAspIleLysLysValAsn-272 | a577
AMPHI Regions - AMPHI

| | |
|---|---|
| SEQ. ID. NO. 20355 | 8-GlyLysIleValGlyAsn-13 |
| SEQ. ID. NO. 20356 | 24-AlaAlaSerTyrProLysProCysLysSerPheLysLeuAla-37 |
| SEQ. ID. NO. 20357 | 62-ThrValIleLysIleIle-67 |
| SEQ. ID. NO. 20358 | 104-AlaPheValValGlyIle-109 |
| SEQ. ID. NO. 20359 | 112-GlyMetPheAlaLeuPheGlyArg-119 |
| SEQ. ID. NO. 20360 | 144-GluLeuThrAlaProProAlaGln-151 |

Antigenic Index - Jameson-Wolf

| | |
|---|---|
| SEQ. ID. NO. 20361 | 1-MetGluArgAsnGlyVal-6 |
| SEQ. ID. NO. 20362 | 14-ArgIleLeuArgMetSerSerGluHisAla-23 |
| SEQ. ID. NO. 20363 | 26-SerTyrProLysProCysLysSerPheLys-35 |
| SEQ. ID. NO. 20364 | 44-ArgSerCysProGlyGly-49 |
| SEQ. ID. NO. 20365 | 88-LeuProGlyGlnLysPheAspLeu-95 |
| SEQ. ID. NO. 20366 | 121-LeuSerLeuArgGlyGluAsnGlyArgLeuArgAlaGluValLysLysAsnAlaArgLeuThrGlyLysGluLeuThrAlaProProAlaGlnAsnAla ProGluSerAlaLysGlnPro-160 |

Hydrophilic Regions - Hopp-Woods

| | |
|---|---|
| SEQ. ID. NO. 20367 | 1-MetGluArgAsnGlyVal-6 |
| SEQ. ID. NO. 20368 | 14-ArgIleLeuArgMetSerSerGluHisAla-23 |
| SEQ. ID. NO. 20369 | 29-LysProCysLysSerPheLys-35 |
| SEQ. ID. NO. 20370 | 121-LeuSerLeuArgGlyGluAsnGlyArgLeuArgAlaGluValLysLysAsnAlaArgLeuThrGlyLysGluLeuThr-146 |
| SEQ. ID. NO. 20371 | 152-AsnAlaProGluSerAlaLysGlnPro-160 | a578
AMPHI Regions - AMPHI

| | |
|---|---|
| SEQ. ID. NO. 20372 | 10-PheAlaAspPhePheLysAspPheAlaProGlnPheGlyGlyPheGlnAsn-26 |
| SEQ. ID. NO. 20373 | 34-AspPhePheAlaAlaPheLeuGlyGlyLeuGlu-44 |
| SEQ. ID. NO. 20374 | 71-AsnThrAspAlaAlaArgPhe-77 |

Antigenic Index - Jameson-Wolf

| | |
|---|---|
| SEQ. ID. NO. 20375 | 2-GlyLysLeuAspIle-6 |
| SEQ. ID. NO. 20376 | 13-PhePheLysAspPheAlaProGlnPheGlyGly-23 |
| SEQ. ID. NO. 20377 | 43-LeuGluGlyAspValGlyAsnThrAla-51 |
| SEQ. ID. NO. 20378 | 71-AsnThrAspAlaAlaArgPheAla-78 |
| SEQ. ID. NO. 20379 | 88-HisAsnGlnAsnIleGlnThrArgAsnAspPheArgLeuGluArgGlyGlyValGly-106 |

Hydrophilic Regions - Hopp-Woods

| | |
|---|---|
| SEQ. ID. NO. 20380 | 2-GlyLysLeuAspIle-6 |
| SEQ. ID. NO. 20381 | 43-LeuGluGlyAspValGlyAsn-49 |
| SEQ. ID. NO. 20382 | 73-AspAlaAlaArgPheAla-78 |
| SEQ. ID. NO. 20383 | 92-IleGlnThrArgAsnAspPheArgLeuGluArgGlyGlyVal-105 | a579
AMPHI Regions - AMPHI

| | |
|---|---|
| SEQ. ID. NO. 20384 | 6-PheAspPheLeuHisLeuIleSerAlaSerGlyTrpGluHisLeuAlaGlu-22 |
| SEQ. ID. NO. 20385 | 49-ValAlaValMetArg-53 |
| SEQ. ID. NO. 20386 | 66-IleSerPheLeuCysAsn-71 |
| SEQ. ID. NO. 20387 | 115-LeuSerAsnPheAla-119 |
| SEQ. ID. NO. 20388 | 129-ProPheLysValGlyAspPheIleArgValGlyGlyPheGluGlyTyrValArgGluIleLys-149 |
| SEQ. ID. NO. 20389 | 258-GlnValValGluAsnLeuArg-264 |

Antigenic Index - Jameson-Wolf

| | |
|---|---|
| SEQ. ID. NO. 20390 | 110-SerLeuLysAspGlnLeuSer-116 |
| SEQ. ID. NO. 20391 | 128-ArgProPheLysVal-132 |
| SEQ. ID. NO. 20392 | 136-IleArgValGlyGlyPheGluGlyTyrValArgGluIleLysMet-150 |
| SEQ. ID. NO. 20393 | 154-SerLeuArgThrThrAspAsnGluGluValVal Leu-165 |
| SEQ. ID. NO. 20394 | 175-IleValAsnArgSerThrLeu-181 |
| SEQ. ID. NO. 20395 | 198-LeuLysValAlaLysGluAlaValLeu-206 |
| SEQ. ID. NO. 20396 | 216-ValGlnAsnGluGluArgGlnAla-223 |
| SEQ. ID. NO. 20397 | 231-GlyAspAsnAlaIle-235 |
| SEQ. ID. NO. 20398 | 244-AsnGluAlaAspArgTrpThrLeu-251 |
| SEQ. ID. NO. 20399 | 253-CysAspLeuAsnGluGlnValValGluAsnLeuArgLysValAsn-267 |
| SEQ. ID. NO. 20400 | 271-ProPheProGlnArgAspIleHis-278 |

Hydrophilic Regions - Hopp-Woods

| | |
|---|---|
| SEQ. ID. NO. 20401 | 110-SerLeuLysAspGlnLeu-115 |
| SEQ. ID. NO. 20402 | 144-TyrValArgGluIleLysMet-150 |
| SEQ. ID. NO. 20403 | 155-LeuArgThrThrAspAsnGluGluValVal-164 |
| SEQ. ID. NO. 20404 | 198-LeuLysValAlaLysGluAlaValLeu-206 |
| SEQ. ID. NO. 20405 | 216-ValGlnAsnGluGluArgGlnAla-223 |
| SEQ. ID. NO. 20406 | 244-AsnGluAlaAspArgTrp-249 |
| SEQ. ID. NO. 20407 | 254-AspLeuAsnGluGlnValValGluAsnLeuArgLysValAsn-267 |
| SEQ. ID. NO. 20408 | 273-ProGlnArgAspIleHis-278 | a580
AMPHI Regions - AMPHI

| | |
|---|---|
| SEQ. ID. NO. 20409 | 47-ProValSerAlaSerLys-52 |
| SEQ. ID. NO. 20410 | 54-SerLeuValLysProLeuSerGlnProLeuAla-64 |

TABLE 1-continued

Antigenic Index - Jameson-Wolf
SEQ. ID. NO. 20411  1-MetAspSerProLysValGlyCysGly-9
SEQ. ID. NO. 20412  48-ValSerAlaSerLys-52
SEQ. ID. NO. 20413  66-AlaArgProGluAlaAlaHis-72
SEQ. ID. NO. 20414  81-ArgProGluAlaLeuAlaAspAsnSerValSerProThrHisAlaThrSerGlyGluVal-100
Hydrophilic Regions - Hopp-Woods
SEQ. ID. NO. 20415  1-MetAspSerProLysVal-6
SEQ. ID. NO. 20416  66-AlaArgProGluAlaAlaHis-72
SEQ. ID. NO. 20417  81-ArgProGluAlaLeuAla-86
SEQ. ID. NO. 20418  96-ThrSerGlyGluVal-100
a581
AMPHI Regions - AMPHI
SEQ. ID. NO. 20419  43-SerHisPheIleSerLeu-48
SEQ. ID. NO. 20420  56-ArgGluCysPheValGlyPhe-62
SEQ. ID. NO. 20421  76-AlaThrAlaPheGlyArgIleAsnGln-84
SEQ. ID. NO. 20422  91-ValHisGlyPheLeuThrThrPheAla-99
Antigenic Index - Jameson-Wolf
SEQ. ID. NO. 20423  8-GlyGlnThrGlyIleGluGlnAsnThrPheCysArgArgGlyPheThrArgIleAspMetGlyGlyAsnThrAspVal-33
SEQ. ID. NO. 20424  35-ValGlnAlaAspArgGlyLeuThrSer-43
SEQ. ID. NO. 20425  49-SerLysLeuGluThrGluValArgGluCysPhe-59
SEQ. ID. NO. 20426  98-PheAlaGlyArgIleAsnProAlaHisCysGlnSerGlnThrAla-112
Hydrophilic Regions - Hopp-Woods
SEQ. ID. NO. 20427  35-ValGlnAlaAspArgGlyLeu-41
SEQ. ID. NO. 20428  49-SerLysLeuGluThrGluValArgGlu-57
a582
AMPHI Regions - AMPHI
SEQ. ID. NO. 20429  27-ThrAspAsnValThrArgLeuAla-34
SEQ. ID. NO. 20430  65-ValArgSerSerLeu-69
SEQ. ID. NO. 20431  91-GlyGluThrAlaAspIleTyrThrProLeuSer-101
SEQ. ID. NO. 20432  139-GlySerProThrArg-143
SEQ. ID. NO. 20433  169-IleAlaGluAspLeuPhe-174
SEQ. ID. NO. 20434  246-SerArgSerTrpAsnArgIleTyrAlaMet-255
SEQ. ID. NO. 20435  263-LeuThrValIleProArgValTrpValArgAlaPheAspGlnSer-277
SEQ. ID. NO. 20436  286-IleAlaAspTyrMetGlyTyr-292
SEQ. ID. NO. 20437  334-LeuLysGlyValArgGlyPheHisGlyTyrGlyGlu-346
Antigenic Index - Jameson-Wolf
SEQ. ID. NO. 20438  26-LeuThrAspAsnValThr-31
SEQ. ID. NO. 20439  34-AlaCysTyrAspArg-38
SEQ. ID. NO. 20440  44-LeuProSerSerAlaGlyGlnGluGlyGlnGluSerLysAla-57
SEQ. ID. NO. 20441  63-GluThrValArgSerSerLeuAspLysGlyGluAla-74
SEQ. ID. NO. 20442  77-ValValGluLysGlyGlyAspAlaLeuProAlaAspSerAlaGlyGluThrAlaAsp-95
SEQ. ID. NO. 20443  105-AspLeuAspLysAsnAspLeuArgGly-113
SEQ. ID. NO. 20444  115-LeuGlyValArgGluHisAsnProMetTyr-124
SEQ. ID. NO. 20445  131-AsnAsnSerProAsnTyrAlaProGlySerProThrArgGlyThrThrValGlnGluLysPheGlyGlnGlnLysArgAlaGluThrLysLeu-161
SEQ. ID. NO. 20446  165-PheLysSerLysIleAlaGluAspLeuPheLysThrArgAla-178
SEQ. ID. NO. 20447  183-GlyTyrThrGlnArgSerAspTrpGlnIleTyrAsnGlnGlyArgLysSerAlaProPheArgAsnThrAspTyrLysPro-209
SEQ. ID. NO. 20448  216-ProValLysAlaAspLeuProPheGlyGlyArgLeuArgMet-229
SEQ. ID. NO. 20449  237-GlnSerAsnGlyGlnSerArgProGluSerArgSerTrpAsn-250
SEQ. ID. NO. 20450  273-AlaPheAspGlnSerGlyAspLysAsnAspAsnProAspIleAlaAsp-288
SEQ. ID. NO. 20451  291-GlyTyrGlyAspValLysLeuGlnTyrArgLeuAsnAspArgGlnAsnVal-307
SEQ. ID. NO. 20452  312-ArgTyrAsnProLysThrGlyTyr-319
SEQ. ID. NO. 20453  330-IleLysGlyLysLeuLysGlyValVal-338
SEQ. ID. NO. 20454  342-HisGlyTyrGlyGluSerLeuIleAspTyrAsnHisLysGlnAsnGly-357
SEQ. ID. NO. 20455  365-AsnAspLeuAspGlyIle-370
Hydrophilic Regions - Hopp-Woods
SEQ. ID. NO. 20456  48-AlaGlyGlnGluGlyGlnGluSerLysAla-57
SEQ. ID. NO. 20457  63-GluThrValArgSerSerLeuAspLysGlyGluAla-74
SEQ. ID. NO. 20458  79-GluLysGlyGlyAspAlaLeuPro-86
SEQ. ID. NO. 20459  88-AspSerAlaGlyGluThrAlaAsp-95
SEQ. ID. NO. 20460  105-AspLeuAspLysAsnAspLeuArgGly-113
SEQ. ID. NO. 20461  115-LeuGlyValArgGluHisAsn-121
SEQ. ID. NO. 20462  140-SerProThrArgGlyThrThrValGlnGluLysPheGlyGlnGlnLysArgAlaGluThrLysLeu-161
SEQ. ID. NO. 20463  165-PheLysSerLysIleAlaGluAspLeuPheLysThrArgAla-178
SEQ. ID. NO. 20464  195-GlnGlyArgLysSerAlaProPheArgAsnThrAspTyrLysPro-209
SEQ. ID. NO. 20465  225-GlyArgLeuArgMet-229
SEQ. ID. NO. 20466  239-AsnGlyGlnSerArgProGluSerArgSerTrp-249
SEQ. ID. NO. 20467  274-PheAspGlnSerGlyAspLysAsnAspAsnProAspIleAlaAsp-288
SEQ. ID. NO. 20468  293-GlyAspValLysLeu-297
SEQ. ID. NO. 20469  299-TyrArgLeuAsnAspArgGlnAsn-306
SEQ. ID. NO. 20470  332-GlyLysLeuLysGlyValVal-338
SEQ. ID. NO. 20471  352-AsnHisLysGlnAsn-356
a583
AMPHI Regions - AMPHI
SEQ. ID. NO. 20472  11-HisLeuAlaPheCysAlaPheCysGlyIle-20
SEQ. ID. NO. 20473  28-ArgLeuHisAsnArgMetTyrAsnAlaAlaAlaAlaArg-40
SEQ. ID. NO. 20474  58-ValThrAspAlaGln-62
SEQ. ID. NO. 20475  66-SerLysAsnGlyAspLysGlnIle-73
SEQ. ID. NO. 20476  75-AspThrHisProGlnPro-80
SEQ. ID. NO. 20477  117-GlyTyrAlaGlyTyrCysAspGln-124

TABLE 1-continued

| | |
|---|---|
| SEQ. ID. NO. 20478 | 140-AspAsnGlyGlyAsnHisThrAsp-147 |
| SEQ. ID. NO. 20479 | 162-GlyTyrGlyGlnCysGlnAsnGlnGlyAla-171 |
| Antigenic Index - Jameson-Wolf | |
| SEQ. ID. NO. 20480 | 24-ThrAlaGlyAsnArgLeuHisAsnArgMetTyr-34 |
| SEQ. ID. NO. 20481 | 41-GlyIleGlyArgGlyAsnGlySerGlnGlnGlnPheGlyLysSerGluThrValThrAspAlaGlnArgPheSerSerLysAsnGlyAspLysGlnIle SerAspThrHisProGlnProCysPheGluGlnThrAlaArgAsnHisAsnCysAspGlyAsnGlnProAsnGlnArgIleGly GluArgThrGlnArgIleAlaHisArgArgThrArgPheValGlyGlyTyrAlaGlyTyrCysAspGlnProAspGlyAsnAsn ArgGlnArgThrGlnArgHisGlyLeuAlaAspAsnGlyGlyAsnHisThrAspLysHisGlyGlnGlnArgProSerLeuArg LeuAspProValGlyTyrGlyGlnCysGlnAsnGlnGlyAlaGlnTyrCysGlyAsnGlyGluGlyTyrArgPhe-182 |
| SEQ. ID. NO. 20482 | 190-AspLeuArgLysLysAspArgProGluLysSerGluLys-202 |
| Hydrophilic Regions - Hopp-Woods | |
| SEQ. ID. NO. 20483 | 27-AsnArgLeuHisAsn-31 |
| SEQ. ID. NO. 20484 | 41-GlyIleGlyArgGlyAsnGlySer-48 |
| SEQ. ID. NO. 20485 | 51-GlnPheGlyLysSerGluThrValThrAspAlaGlnArgPheSerSerLysAsnGlyAspLysGlnIleSerAspThrHisPro-78 |
| SEQ. ID. NO. 20486 | 84-GlnThrAlaArgAsnHisAsnCysAspGlyAsnGlnProAsnGlnArgIleGlyGluArgThrGlnArgIleAlaHisArgArgThrArgPhe-114 |
| SEQ. ID. NO. 20487 | 123-AspGlnProAspGlyAsnAsnArgGlnArgThrGlnArg-135 |
| SEQ. ID. NO. 20488 | 137-GlyLeuAlaAspAsnGlyGlyAsnHisThrAspLysHisGlyGlnGlnArgProSerLeuArgLeuAspPro-160 |
| SEQ. ID. NO. 20489 | 178-GluGlyTyrArgPhe-182 |
| SEQ. ID. NO. 20490 | 190-AspLeuArgLysLysAspArgProGluLysSerGluLys-202 |
| a584-2 | |
| AMPHI Regions - AMPHI | |
| SEQ. ID. NO. 20491 | 28-GluPheSerGluSerAlaGlyValGluAlaValGlnAspThrMet-42 |
| SEQ. ID. NO. 20492 | 60-AlaGluPheValLysLysPheAsnAsnPheThrArgLys-72 |
| SEQ. ID. NO. 20493 | 116-PheAspAlaLeuAsnArgPheIleAlaAspVal-126 |
| SEQ. ID. NO. 20494 | 148-IleAspGlnValSerLysAsp-154 |
| SEQ. ID. NO. 20495 | 166-LeuAlaGlyValLeuGly-171 |
| SEQ. ID. NO. 20496 | 186-GlySerHisIleAla-190 |
| SEQ. ID. NO. 20497 | 196-GlnAlaLysMetLeuArgAlaMet-203 |
| Antigenic Index - Jameson-Wolf | |
| SEQ. ID. NO. 20498 | 50-AlaGluGlyArgAspLysAsnAlaVal-58 |
| SEQ. ID. NO. 20499 | 61-GluPheValLysLysPheAsnAsnPheThrArgLysSerLysAsnGlySerPheLysThrGluLeuValSerArgSerAlaMetProArgTyrGlnTyr ThrAsnGlyArgArgIleGlnThrGlyTrpGluGluArgAlaGluPheLysValGluGlyArgAsnPheAspAla-118 |
| SEQ. ID. NO. 20500 | 138-HisValSerArgGluArgArgAsnGluValIleAspGlnValSerLysAspAlaValLeu-157 |
| SEQ. ID. NO. 20501 | 159-PheLysAlaArgAlaGluLysLeuAla-167 |
| SEQ. ID. NO. 20502 | 189-IleAlaGlyGlyGly-193 |
| SEQ. ID. NO. 20503 | 210-AsnMetGluGlyAlaAspSerAlaAlaProGlyValGluGluIleSer-225 |
| Hydrophilic Regions - Hopp-Woods | |
| SEQ. ID. NO. 20504 | 50-AlaGluGlyArgAspLysAsnAlaVal-58 |
| SEQ. ID. NO. 20505 | 67-AsnAsnPheThrArgLysSerLysAsnGlySerPheLysThrGluLeuValSer-84 |
| SEQ. ID. NO. 20506 | 95-AsnGlyArgArgIleGlnThrGlyTrpGluGluArgAlaGluPheLysValGluGlyArgAsnPheAspAla-118 |
| SEQ. ID. NO. 20507 | 138-HisValSerArgGluArgArgAsnGluValIleAspGlnValSerLysAspAlaValLeu-157 |
| SEQ. ID. NO. 20508 | 159-PheLysAlaArgAlaGluLysLeuAla-167 |
| SEQ. ID. NO. 20509 | 210-AsnMetGluGlyAlaAspSerAlaAlaProGlyValGluGluIleSer-225 |
| a585 | |
| AMPHI Regions - AMPHI | |
| SEQ. ID. NO. 20510 | 6-ArgIlePheAlaThrPheCysAlaValIleValCys-17 |
| SEQ. ID. NO. 20511 | 46-ThrThrLeuMetGlySerIleIleSer-54 |
| SEQ. ID. NO. 20512 | 65-ArgGluIleLeuThrGluTrpLysAsp-73 |
| SEQ. ID. NO. 20513 | 93-HisArgTyrIleAspSer-98 |
| SEQ. ID. NO. 20514 | 133-LysAspTrpAspLysLeuGlnAlaArgArg-142 |
| SEQ. ID. NO. 20515 | 153-ProLeuAlaProIleTrp-158 |
| SEQ. ID. NO. 20516 | 178-LeuAlaGlyAsnIleAlaLysProIleArgIleLeuGlyAsnGlyMetAspArgValAla-197 |
| SEQ. ID. NO. 20517 | 223-PheAspLysMetValGluLysLeuGluLysLeuVal-234 |
| SEQ. ID. NO. 20518 | 247-GluMetArgSerPro-251 |
| SEQ. ID. NO. 20519 | 255-MetGlnAlaIleValGlyLeuIle-262 |
| SEQ. ID. NO. 20520 | 273-LeuLysArgLeuGluGly-278 |
| SEQ. ID. NO. 20521 | 353-LeuTyrArgAlaPheAspAsnValIleArgAsnAlaValAsn-366 |
| SEQ. ID. NO. 20522 | 430-IleIleGluGlnHisCysGlyLysIleIleAlaGlu-441 |
| Antigenic Index - Jameson-Wolf | |
| SEQ. ID. NO. 20523 | 36-AsnGlnPheAsnGlnArgArgThrIleGlu-45 |
| SEQ. ID. NO. 20524 | 56-PheArgAlaArgGlyAspAlaGlyAlaArgGluIleLeuThrGluTrpLysAspSerProValSer-77 |
| SEQ. ID. NO. 20525 | 84-GlnGlyAspGluLysLysAspIleLeu-92 |
| SEQ. ID. NO. 20526 | 97-AspSerTyrThrIleGluArgAlaArgLeu-106 |
| SEQ. ID. NO. 20527 | 120-GluTyrAspArgPheGlyGlu-126 |
| SEQ. ID. NO. 20528 | 133-LysAspTrpAspLysLeuGlnAlaArgArgLeuProSerPro-146 |
| SEQ. ID. NO. 20529 | 189-LeuGlyAsnGlyMetAspArgValAlaAsnGlyGluLeuGluThrArgIle-205 |
| SEQ. ID. NO. 20530 | 207-GlnGlnValAspArgAspAspGluLeuSer-217 |
| SEQ. ID. NO. 20531 | 225-LysMetValGluLysLeuGluLysLeuValAlaLysGluArgHisLeu-240 |
| SEQ. ID. NO. 20532 | 246-HisGluMetArgSerProLeuAla-253 |
| SEQ. ID. NO. 20533 | 264-AlaGlnProGlnLysGlnGluGlnTyrLeuLysArgLeuGluGlyGluLeuThrArgMetAspThrLeuAla-287 |
| SEQ. ID. NO. 20534 | 294-SerArgLeuGluThrSerAsnMetAlaLeuGluLysGluSerLeuLys-309 |
| SEQ. ID. NO. 20535 | 317-LeuValGluAspAsnGlnSerIleAlaGlnLysAsnGlyGln-330 |
| SEQ. ID. NO. 20536 | 335-SerAlaAspGlyLysIleProGluAsnThr-344 |
| SEQ. ID. NO. 20537 | 367-TyrSerProGluGlySerThr-373 |
| SEQ. ID. NO. 20538 | 377-AsnIleGlyGlnAspHisLysHis-384 |
| SEQ. ID. NO. 20539 | 388-AspValThrAspAsnGlyProGlyValAspGluMetGln-400 |
| SEQ. ID. NO. 20540 | 409-TyrArgAlaAspSerSerAlaAsnLysProGlyThrGly-421 |

TABLE 1-continued

| SEQ. ID. NO. 20541 | 432-GluGlnHisCysGlyLysIleIleAlaGluAsnIleLysProAsnGlyLeuArg-449 |

SEQ. ID. NO. 20542     453-IleLeuProLysLysLysThrGlySerLysThrGluLysSerAlaAsn-468
Hydrophilic Regions - Hopp-Woods
SEQ. ID. NO. 20543     37-GlnPheAsnGlnArgArgThrIleGlu-45
SEQ. ID. NO. 20544     56-PheArgAlaArgGlyAspAlaGlyAlaArgGluIleLeuThrGluTrpLysAspSerProVal-76
SEQ. ID. NO. 20545     84-GlnGlyAspGluLysLysAspIleLeu-92
SEQ. ID. NO. 20546     100-ThrIleGluArgAlaArgLeu-106
SEQ. ID. NO. 20547     120-GluTyrAspArgPheGlyGlu-126
SEQ. ID. NO. 20548     133-LysAspTrpAspLysLeuGlnAlaArgArgLeuPro-144
SEQ. ID. NO. 20549     192-GlyMetAspArgValAlaAsnGlyGluLeuGluThrArgIle-205
SEQ. ID. NO. 20550     207-GlnGlnValAspAspArgAspAspGluLeuSer-217
SEQ. ID. NO. 20551     225-LysMetValGluLysLeuGluLysLeuValAlaLysGluArgHisLeu-240
SEQ. ID. NO. 20552     246-HisGluMetArgSerProLeu-252
SEQ. ID. NO. 20553     265-GlnProGlnLysGlnGluGlnTyrLeuLysArgLeuGluGlyGluLeuThrArgMetAspThrLeuAla-287
SEQ. ID. NO. 20554     294-SerArgLeuGluThr-298
SEQ. ID. NO. 20555     302-AlaLeuGluLysGluSerLeuLys-309
SEQ. ID. NO. 20556     317-LeuValGluAspAsnGlnSerIleAlaGlnLysAsnGlyGln-330
SEQ. ID. NO. 20557     336-AlaAspGlyLysIleProGlu-342
SEQ. ID. NO. 20558     389-ValThrAspAsnGlyProGlyValAspGluMetGln-400
SEQ. ID. NO. 20559     410-ArgAlaAspSerSerAlaAsnLysProGlyThr-420
SEQ. ID. NO. 20560     438-IleIleAlaGluAsnIleLys-444
SEQ. ID. NO. 20561     454-LeuProLysLysLysThrGlySerLysThrGluLysSerAlaAsn-468
a586
AMPHI Regions - AMPHI
SEQ. ID. NO. 20562     12-AspAsnPheLysTyrPheTrpLysThr-20
SEQ. ID. NO. 20563     30-IleLeuAlaAlaLeuGly-35
SEQ. ID. NO. 20564     56-ValLeuAlaAsnIleValGluLysAlaGlnAsnLysAlaPro-69
SEQ. ID. NO. 20565     80-LeuGlnGlnSerTyrProHisSerIleSer-89
SEQ. ID. NO. 20566     177-SerGlnAlaAlaLeuLysAsnTyrGlyGlnAlaLeuGluLysMetProGlnAspSerValGlyArg-198
Antigenic Index - Jameson-Wolf
SEQ. ID. NO. 20567     4-HisLeuGluGluGlnGlnGluLeuAspAsn-13
SEQ. ID. NO. 20568     43-GlnAsnArgAlaAlaSerGlnAsnGlnGluAla-53
SEQ. ID. NO. 20569     60-IleValGluLysAlaGlnAsnLysAlaProGlnSerGluIleAsnAlaGluLeuAlaLysLeuGlnGln-82
SEQ. ID. NO. 20570     100-ThrGluPheAspAlaGlnArgTyrAspValAlaGluGly-112
SEQ. ID. NO. 20571     118-LeuSerAsnGlnLysAspSerLeu-125
SEQ. ID. NO. 20572     140-GlnGlnLysLysTyrAspAla-146
SEQ. ID. NO. 20573     153-ThrProValGluAlaAspPhe-159
SEQ. ID. NO. 20574     164-MetGluThrLysGlyAspVal-170
SEQ. ID. NO. 20575     173-AlaGlnGlyLysSerGlnGluAlaLeuLysAsnTyrGlyGlnAlaLeuGluLysMetProGlnAspSerValGlyArgGluLeuVal-201
SEQ. ID. NO. 20576     204-LysLeuAspSerLeuLys-209
Hydrophilic Regions - Hopp-Woods
SEQ. ID. NO. 20577     4-HisLeuGluGluGlnGlnGluLeuAspAsn-13
SEQ. ID. NO. 20578     45-ArgAlaAlaSerGlnAsnGlnGluAla-53
SEQ. ID. NO. 20579     60-IleValGluLysAlaGlnAsnLysAlaProGlnSerGluIleAsnAlaGluLeuAlaLys-79
SEQ. ID. NO. 20580     100-ThrGluPheAspAlaGlnArgTyrAspValAlaGluGly-112
SEQ. ID. NO. 20581     120-AsnGlnLysAspSerLeu-125
SEQ. ID. NO. 20582     140-GlnGlnLysLysTyrAspAla-146
SEQ. ID. NO. 20583     153-ThrProValGluAlaAspPhe-159
SEQ. ID. NO. 20584     164-MetGluThrLysGlyAspVal-170
SEQ. ID. NO. 20585     174-GlnGlyLysSerGlnGluAlaLeuLys-182
SEQ. ID. NO. 20586     187-AlaLeuGluLysMetProGlnAspSerValGlyArgGluLeuVal-201
SEQ. ID. NO. 20587     204-LysLeuAspSerLeuLys-209
a587
AMPHI Regions - AMPHI
SEQ. ID. NO. 20588     6-LeuProAlaLeuProAlaIleLeuProLeuSerAla-17
SEQ. ID. NO. 20589     232-LysGlnProAspArgLeuAsp-238
Antigenic Index - Jameson-Wolf
SEQ. ID. NO. 20590     27-AspIleMetThrAspLysGlyLysTrpLysLeuGluThr-39
SEQ. ID. NO. 20591     44-LeuAsnSerGluAsnAsnArgAlaGluLeu-53
SEQ. ID. NO. 20592     71-ThrGluIleGlnGluAsnGlySerAsnThr-80
SEQ. ID. NO. 20593     95-GlyAsnThrAspIleTyrGlySerGlySer-104
SEQ. ID. NO. 20594     108-HisGluGluArgLysLeuAspGlyAsnGlyLysThrArgAsnLysArgMetSerAsp-126
SEQ. ID. NO. 20595     135-PheLeuLysAspAspLysAsnProAla-143
SEQ. ID. NO. 20596     151-ThrValTyrGluLysSerArgAsnLysAlaSerSerGlyLysSer-165
SEQ. ID. NO. 20597     187-TyrArgIleAsnGlySerLysThrLeuSerSerAsnThrLysTyrLysAlaGly-204
SEQ. ID. NO. 20598     217-AlaAsnAspArgIleSerLeuThrGlyGly-226
SEQ. ID. NO. 20599     231-GlyLysGlnProAspArgLeuAspGlyLysLysGluSerAlaArgAsnThrSerThr-249
SEQ. ID. NO. 20600     273-ValSerGlyGlnSerSerSerGluLeuLysPhe-283
Hydrophilic Regions - Hopp-Woods
SEQ. ID. NO. 20601     27-AspIleMetThrAspLysGlyLysTrpLysLeu-37
SEQ. ID. NO. 20602     47-GluAsnAsnArgAlaGluLeu-53
SEQ. ID. NO. 20603     72-GluIleGlnGluAsnGlySerAsn-79
SEQ. ID. NO. 20604     108-HisGluGluArgLysLeuAspGlyAsnGlyLysThrArgAsnLysArgMetSerAsp-126
SEQ. ID. NO. 20605     135-PheLeuLysAspAspLysAsnPro-142
SEQ. ID. NO. 20606     151-ThrValTyrGluLysSerArgAsnLysAlaSerSerGly-163
SEQ. ID. NO. 20607     193-LysThrLeuSerSer-197
SEQ. ID. NO. 20608     199-ThrLysTyrLysAla-203
SEQ. ID. NO. 20609     217-AlaAsnAspArgIleSer-222

TABLE 1-continued

| SEQ. ID. NO. 20610 | 232-LysGlnProAspArgLeuAspGlyLysLysGluSerAlaArgAsn-246 |
| SEQ. ID. NO. 20611 | 277-SerSerSerGluLeuLysPhe-283 | a588
AMPHI Regions - AMPHI
| SEQ. ID. NO. 20612 | 52-GlnAspGlyArgAsnTyrThrGlySerPhe-61 |
| SEQ. ID. NO. 20613 | 99-GlyThrPheLysLys-103 |

Antigenic Index - Jameson-Wolf
| SEQ. ID. NO. 20614 | 25-SerTyrGlnGluProGlyCysThrTyrGluGlyAspValGlyLysAspGlyLysProAlaGlyLysGlyThrTrpArgCysGlnAspGlyArgAsn TyrThrGlySerPheLysAsnGlyLysPheAspGlyGlnGly-70 |
| SEQ. ID. NO. 20615 | 80-IlePheIleGluProPheAsnSerAspSerThrLysPheArg-93 |
| SEQ. ID. NO. 20616 | 100-ThrPheLysLysGlyLeuAlaHisGlyArgPheThrValSerGlnAsnGlyGluThr-118 |
| SEQ. ID. NO. 20617 | 124-CysGluAsnGlyMetIleLysGluValLysLeuProLysAsnLys-138 |

Hydrophilic Regions - Hopp-Woods
| SEQ. ID. NO. 20618 | 33-TyrGluGlyAspValGlyLysAspGlyLysProAlaGly-45 |
| SEQ. ID. NO. 20619 | 47-GlyThrTrpArgCysGlnAspGlyArgAsnTyr-57 |
| SEQ. ID. NO. 20620 | 61-PheLysAsnGlyLysPheAspGly-68 |
| SEQ. ID. NO. 20621 | 85-PheAsnSerAspSerThrLysPheArg-93 |
| SEQ. ID. NO. 20622 | 100-ThrPheLysLysGlyLeuAla-106 |
| SEQ. ID. NO. 20623 | 124-CysGluAsnGlyMetIleLysGluValLysLeuProLysAsnLys-138 | a589
AMPHI Regions - AMPHI
| SEQ. ID. NO. 20624 | 18-AlaSerArgIleGluLysValLeu-25 |
| SEQ. ID. NO. 20625 | 54-ValAlaAspIleAlaLysIleIleGluLys-63 |
| SEQ. ID. NO. 20626 | 103-MetValGlyMetMet-107 |
| SEQ. ID. NO. 20627 | 128-LeuAlaSerValValGlnLeuTrp-135 |
| SEQ. ID. NO. 20628 | 155-MetAspValLeuValThrIle-161 |
| SEQ. ID. NO. 20629 | 198-PheValSerLeuGlyLysPheLeuGluHisArg-208 |
| SEQ. ID. NO. 20630 | 230-ValGlnArgAspGlyGlu-235 |
| SEQ. ID. NO. 20631 | 245-GlnIleGlyAspLeuIleArg-251 |
| SEQ. ID. NO. 20632 | 315-LeuGlyAspMetMetAsnAlaLeuSerGluAlaGln-326 |
| SEQ. ID. NO. 20633 | 330-AlaProIleAlaArgValAlaAspLys-338 |
| SEQ. ID. NO. 20634 | 349-GlyIleAlaLeuLeuThrPheIleAlaThr-358 |
| SEQ. ID. NO. 20635 | 396-MetGlyLysAlaVal-400 |
| SEQ. ID. NO. 20636 | 471-IleValSerAlaAlaGln-476 |
| SEQ. ID. NO. 20637 | 482-IleProThrAlaGln-486 |
| SEQ. ID. NO. 20638 | 502-GlyAlaGlyLeuValLys-507 |
| SEQ. ID. NO. 20639 | 539-LysProIleGlyAlaPheAlaLeuAlaAspAlaLeuLys-551 |
| SEQ. ID. NO. 20640 | 553-AspThrAlaGluAlaIleGlyArgLeu-561 |
| SEQ. ID. NO. 20641 | 603-GluValGlnLysLeuLysAlaAla-610 |
| SEQ. ID. NO. 20642 | 617-ValGlyAspGlyIleAsnAspAlaPro-625 |
| SEQ. ID. NO. 20643 | 640-AlaAspValAlaGluHisThr-646 |
| SEQ. ID. NO. 20644 | 653-GlnHisSerValAsnGlnLeuAlaAspAlaLeuSer-664 |
| SEQ. ID. NO. 20645 | 680-AlaPhePheTyrAsnIleLeu-686 |

Antigenic Index - Jameson-Wolf
| SEQ. ID. NO. 20646 | 1-MetGlnGlnLysValArgPheGlnIleGluGlyMetThr-13 |
| SEQ. ID. NO. 20647 | 17-CysAlaSerArgIleGluLysValLeuAsnLysLysAspPheValGluSer-33 |
| SEQ. ID. NO. 20648 | 39-AlaSerGluGluAlaGlnValValPheAspAspSerLysThrSerVal-54 |
| SEQ. ID. NO. 20649 | 59-LysIleIleGluLysThrGlyTyrGlyAlaLysGluLysThrGluAspThrLeuProGlnProGluAlaGluHis-83 |
| SEQ. ID. NO. 20650 | 114-ThrArgHisAspTrp-118 |
| SEQ. ID. NO. 20651 | 148-IleLysGlyGlyLeu-152 |
| SEQ. ID. NO. 20652 | 205-LeuGluHisArgThrLysLysSerSerLeuAsn-215 |
| SEQ. ID. NO. 20653 | 228-ValAsnValGlnArgAspGlyGluTrpArg-237 |
| SEQ. ID. NO. 20654 | 253-AsnHisGlyGluArgIleAlaAla-260 |
| SEQ. ID. NO. 20655 | 262-GlyIleIleGluSerGlySerGlyTrpAlaAspGluSerHisLeuThrGlyGluSerAsnProGluGluLysLysAlaGlyGly-289 |
| SEQ. ID. NO. 20656 | 298-ThrGluGlySerVal-302 |
| SEQ. ID. NO. 20657 | 323-SerGluAlaGlnGlySerLysAlaProIle-332 |
| SEQ. ID. NO. 20658 | 334-ArgValAlaAspLysAlaAla-340 |
| SEQ. ID. NO. 20659 | 361-IleLysGlyAspTrp-365 |
| SEQ. ID. NO. 20660 | 396-MetGlyLysAlaValLys-401 |
| SEQ. ID. NO. 20661 | 409-AlaAlaAlaMetGluGluAlaAlaHis-417 |
| SEQ. ID. NO. 20662 | 422-ValLeuAspLysThrGlyThrLeuThrGluGlyLysProGlnVal-436 |
| SEQ. ID. NO. 20663 | 443-ProAspSerGlyPheAspGluAspAlaLeu-452 |
| SEQ. ID. NO. 20664 | 459-ValGluGlnAsnAla-463 |
| SEQ. ID. NO. 20665 | 498-AlaGluValLysGlyAlaGlyLeu-505 |
| SEQ. ID. NO. 20666 | 507-LysAlaGlyLysAlaGluPheAla-514 |
| SEQ. ID. NO. 20667 | 520-LysPheSerAspGlyVal-525 |
| SEQ. ID. NO. 20668 | 535-SerValAsnGlyLysProIle-541 |
| SEQ. ID. NO. 20669 | 548-AspAlaLeuLysAlaAspThrAlaGluAlaIleGlyArgLeuLysLysHisAsnIle-566 |
| SEQ. ID. NO. 20670 | 572-SerGlyAspAsnGlnAsnGlyThrValGluTyrValAla-583 |
| SEQ. ID. NO. 20671 | 593-GlyAsnMetSerProArgAspLysAlaAlaGluValGlnLysLeuLysAlaAlaGly-611 |
| SEQ. ID. NO. 20672 | 617-ValGlyAspGlyIleAsnAspAla-624 |
| SEQ. ID. NO. 20673 | 636-MetLysGlyGlyAlaAspValAlaGlu-644 |
| SEQ. ID. NO. 20674 | 668-AlaThrLeuLysAsnIleLys-674 |
| SEQ. ID. NO. 20675 | 715-AsnAlaLeuArgLeuLysArgValLysIleAsp-725 |

Hydrophilic Regions - Hopp-Woods
| SEQ. ID. NO. 20676 | 1-MetGlnGlnLysValArgPheGlnIle-9 |
| SEQ. ID. NO. 20677 | 19-SerArgIleGluLysValLeuAsnLysLysAspPheValGlu-32 |
| SEQ. ID. NO. 20678 | 39-AlaSerGluGluAlaGlnValValPheAspAspSerLysThrSerVal-54 |
| SEQ. ID. NO. 20679 | 64-ThrGlyTyrGlyAlaLysGluLysThrGluAspThrLeuProGlnProGluAlaGluHis-83 |
| SEQ. ID. NO. 20680 | 205-LeuGluHisArgThrLysLysSerSerLeu-214 |

TABLE 1-continued

| | |
|---|---|
| SEQ. ID. NO. 20681 | 229-AsnValGlnArgAspGlyGluTrpArg-237 |
| SEQ. ID. NO. 20682 | 253-AsnHisGlyGluArgIleAlaAla-260 |
| SEQ. ID. NO. 20683 | 262-GlyIleIleGluSer-266 |
| SEQ. ID. NO. 20684 | 270-TrpAlaAspGluSerHisLeuThrGlyGluSerAsnProGluGluLysLysAlaGlyGly-289 |
| SEQ. ID. NO. 20685 | 323-SerGluAlaGlnGlySerLysAlaProIle-332 |
| SEQ. ID. NO. 20686 | 334-ArgValAlaAspLysAlaAla-340 |
| SEQ. ID. NO. 20687 | 409-AlaAlaAlaMetGluGluAlaAlaHis-417 |
| SEQ. ID. NO. 20688 | 422-ValLeuAspLysThrGlyThr-428 |
| SEQ. ID. NO. 20689 | 430-ThrGluGlyLysProGln-435 |
| SEQ. ID. NO. 20690 | 445-SerGlyPheAspGluAspAlaLeu-452 |
| SEQ. ID. NO. 20691 | 459-ValGluGlnAsnAla-463 |
| SEQ. ID. NO. 20692 | 498-AlaGluValLysGly-502 |
| SEQ. ID. NO. 20693 | 507-LysAlaGlyLysAlaGluPheAla-514 |
| SEQ. ID. NO. 20694 | 548-AspAlaLeuLysAlaAspThrAlaGluAlaIleGlyArgLeuLysLysHisAsnIle-566 |
| SEQ. ID. NO. 20695 | 573-GlyAspAsnGlnGly-577 |
| SEQ. ID. NO. 20696 | 596-SerProArgAspLysAlaAlaGluValGlnLysLeuLysAlaAlaGly-611 |
| SEQ. ID. NO. 20697 | 638-GlyGlyAlaAspValAlaGlu-644 |
| SEQ. ID. NO. 20698 | 668-AlaThrLeuLysAsnIleLys-674 |
| SEQ. ID. NO. 20699 | 717-LeuArgLeuLysArgValLysIleAsp-725 | a590
AMPHI Regions - AMPHI

| | |
|---|---|
| SEQ. ID. NO. 20700 | 77-TyrLeuProAspAsnLeuLysThrValLeuGluGlnProValThrLeuValAsnHisIleThrHis-98 |
| SEQ. ID. NO. 20701 | 100-ProPheAlaGlyGlyPhe-105 |
| SEQ. ID. NO. 20702 | 123-LysValLeuGluArgPhePhe-129 |
| SEQ. ID. NO. 20703 | 132-GlnValProValSerLeu-137 |
| SEQ. ID. NO. 20704 | 177-TyrGlnLysGlyPheLysSerTyrArgAsnGly-187 |
| SEQ. ID. NO. 20705 | 214-ThrSerAspGlyIleAsnProLeu-221 |
| SEQ. ID. NO. 20706 | 248-AsnGluLeuValAsnLeuVal-254 |
| SEQ. ID. NO. 20707 | 331-LysArgLysPheAlaArgIle-337 |
| SEQ. ID. NO. 20708 | 420-LysMetLeuGluAsp-424 |
| SEQ. ID. NO. 20709 | 450-AspIleAsnGluThrLeuArgLeuMet-458 |
| SEQ. ID. NO. 20710 | 460-AspSerThrValGln-464 |

Antigenic Index - Jameson-Wolf

| | |
|---|---|
| SEQ. ID. NO. 20711 | 1-MetLysLysProLeu-5 |
| SEQ. ID. NO. 20712 | 26-LysAlaGluGluSerLeuThrGlnGlnGlnLysIleLeuGln-39 |
| SEQ. ID. NO. 20713 | 48-SerHisGlnTyrGluArgGlyTrpPheThrSerThrGluThrThrValIleArgLeuLysProGluLeu-70 |
| SEQ. ID. NO. 20714 | 75-GlnLysTyrLeuProAspAsnLeuLysThrValLeu-86 |
| SEQ. ID. NO. 20715 | 113-ThrGluPheLysTyrAlaProGluThrGluLysValLeuGlu-126 |
| SEQ. ID. NO. 20716 | 128-PhePheGlyLysGlnVal-133 |
| SEQ. ID. NO. 20717 | 144-AsnGlySerGlyLysMetGluVal-151 |
| SEQ. ID. NO. 20718 | 157-AspTyrGluGluLeuSerGly-163 |
| SEQ. ID. NO. 20719 | 175-ThrValTyrGlnLysGlyPheLysSerTyrArgAsnGlyTyrAspAlaPro-191 |
| SEQ. ID. NO. 20720 | 196-LysLeuAlaAspLysGlyAspAlaAlaPheGlu-206 |
| SEQ. ID. NO. 20721 | 208-ValHisPheAspSerGluThrSerAspGlyIleAsn-219 |
| SEQ. ID. NO. 20722 | 233-PheSerLeuGluTrpLysGluGlyValAspTyr-243 |
| SEQ. ID. NO. 20723 | 264-AsnProAsnGlySerIleAlaProSerLysIleGluValGly-277 |
| SEQ. ID. NO. 20724 | 281-PheSerThrLysThrGlyGluSerGlyAla-290 |
| SEQ. ID. NO. 20725 | 292-IleAspSerGluGlyGlnPheArgPhe-300 |
| SEQ. ID. NO. 20726 | 305-TyrGlyAspGluLysTyrGlyPro-312 |
| SEQ. ID. NO. 20727 | 330-LeuLysArgLysPheAlaArgIleSerAlaLysLysMetThrGluGluGlnIleArgAsnAspLeu-351 |
| SEQ. ID. NO. 20728 | 355-ValLysGlyGluAlaSerGly-361 |
| SEQ. ID. NO. 20729 | 366-AsnProValLeuAsp-370 |
| SEQ. ID. NO. 20730 | 378-LeuProSerGlyLysIleAspValGlyGly-387 |
| SEQ. ID. NO. 20731 | 389-IleMetPheLysAspMetLysLysGluAspLeuAsnGln-401 |
| SEQ. ID. NO. 20732 | 406-LeuLysLysThrGluAlaAspIleArgMet-415 |
| SEQ. ID. NO. 20733 | 437-AsnAlaGluAspGluAlaGluGlyArgAlaSerLeuAspAspIleAsnGluThrLeu-455 |
| SEQ. ID. NO. 20734 | 466-MetAlaArgGluLysTyr-471 |
| SEQ. ID. NO. 20735 | 475-AsnGlyAspGlnIleAsp-480 |
| SEQ. ID. NO. 20736 | 485-LeuLysAsnAsnGlnLeuLysLeuAsnGlyLysThrLeuGlnAsnGluProGluProAspPheAspGluGlyGlyMetValSerGluProGlnGln-516 |

Hydrophilic Regions - Hopp-Woods

| | |
|---|---|
| SEQ. ID. NO. 20737 | 1-MetLysLysProLeu-5 |
| SEQ. ID. NO. 20738 | 26-LysAlaGluGluSerLeuThrGln-33 |
| SEQ. ID. NO. 20739 | 62-ThrValIleArgLeuLysProGluLeu-70 |
| SEQ. ID. NO. 20740 | 77-TyrLeuProAspAsnLeuLysThrValLeu-86 |
| SEQ. ID. NO. 20741 | 113-ThrGluPheLysTyrAlaProGluThrGluLysValLeuGlu-126 |
| SEQ. ID. NO. 20742 | 147-GlyLysMetGluVal-151 |
| SEQ. ID. NO. 20743 | 157-AspTyrGluGluLeuSerGly-163 |
| SEQ. ID. NO. 20744 | 180-GlyPheLysSerTyrArgAsnGlyTyr-188 |
| SEQ. ID. NO. 20745 | 196-LysLeuAlaAspLysGlyAspAlaAlaPheGlu-206 |
| SEQ. ID. NO. 20746 | 208-ValHisPheAspSerGluThrSerAspGly-217 |
| SEQ. ID. NO. 20747 | 233-PheSerLeuGluTrpLysGluGlyValAspTyr-243 |
| SEQ. ID. NO. 20748 | 272-SerLysIleGluValGly-277 |
| SEQ. ID. NO. 20749 | 292-IleAspSerGluGlyGlnPhe-298 |
| SEQ. ID. NO. 20750 | 306-GlyAspGluLysTyrGlyPro-312 |
| SEQ. ID. NO. 20751 | 330-LeuLysArgLysPheAlaArgIleSerAlaLysLysMetThrGluGluGlnIleArgAsnAspLeu-351 |
| SEQ. ID. NO. 20752 | 355-ValLysGlyGluAla-359 |
| SEQ. ID. NO. 20753 | 381-GlyLysIleAspValGlyGly-387 |
| SEQ. ID. NO. 20754 | 389-IleMetPheLysAspMetLysLysGluAspLeuAsn-400 |
| SEQ. ID. NO. 20755 | 406-LeuLysLysThrGluAlaAspIleArgMet-415 |
| SEQ. ID. NO. 20756 | 437-AsnAlaGluAspGluAlaGluGlyArgAlaSerLeuAspAspIleAsnGluThrLeu-455 |

TABLE 1-continued

| SEQ. ID. NO. 20757 | 466-MetAlaArgGluLysTyr-471 |
| SEQ. ID. NO. 20758 | 486-LysAsnAsnGlnLeuLysLeuAsnGly-494 |
| SEQ. ID. NO. 20759 | 496-ThrLeuGlnAsnGluProGluProAspPheAspGluGlyGlyMetValSerGluProGlnGln-516 | a591
AMPHI Regions - AMPHI

| SEQ. ID. NO. 20760 | 6-AlaPheIlePheAla-10 |
| SEQ. ID. NO. 20761 | 17-LeuHisGluPheGlyHisTyrIleValAla-26 |
| SEQ. ID. NO. 20762 | 61-LeuGlyGlyTyrValLysMetValAsp-69 |
| SEQ. ID. NO. 20763 | 143-GlyAspLysIleGlnSerValAsnGlyThrProValAlaAspTrp-157 |
| SEQ. ID. NO. 20764 | 181-SerGlyAlaGlnThrValArgThrIleAspAlaAlaGlyThrProGluAlaGlyLysIleAlaLys-202 |
| SEQ. ID. NO. 20765 | 218-AlaGlyGlyValGluLys-223 |
| SEQ. ID. NO. 20766 | 234-ProGlyAspArgLeu-238 |
| SEQ. ID. NO. 20767 | 245-ProIleAlaSerTrpGlnGluTrpAlaAsnLeuThrArg-257 |
| SEQ. ID. NO. 20768 | 304-AlaTrpAspAlaGlnIleArg-310 |
| SEQ. ID. NO. 20769 | 313-TyrArgProSerValValArgAlaPheGly-322 |
| SEQ. ID. NO. 20770 | 324-GlyTrpGluLysThrValSerHis-331 |
| SEQ. ID. NO. 20771 | 335-ThrLeuLysPhePheGlyLysLeuIle-343 |
| SEQ. ID. NO. 20772 | 351-HisIleSerGlyProLeuThrIleAla-359 |
| SEQ. ID. NO. 20773 | 373-TyrLeuGluPheLeuAlaLeu-379 |

Antigenic Index - Jameson-Wolf

| SEQ. ID. NO. 20774 | 44-PhePheThrArgLysArgGlyAspThrGlu-53 |
| SEQ. ID. NO. 20775 | 68-ValAspThrArgGluGlyGluValSerGluAlaAspLeu-80 |
| SEQ. ID. NO. 20776 | 84-PheAspLysGlnHisProAlaLysArg-92 |
| SEQ. ID. NO. 20777 | 129-ValGluProAspThrIleAla-135 |
| SEQ. ID. NO. 20778 | 139-GlyPheGlnSerGlyAspLysIleGlnSer-148 |
| SEQ. ID. NO. 20779 | 157-TrpGlySerAlaGln-161 |
| SEQ. ID. NO. 20780 | 187-ArgThrIleAspAlaAlaGlyThrProGluAlaGlyLysIleAlaLysAsnGlnGly-205 |
| SEQ. ID. NO. 20781 | 219-GlyGlyValGluLysGlySerProAlaGluLysAlaGlyLeuLysProGlyAspArgLeuThrAlaAlaAspGlyLysProIle-246 |
| SEQ. ID. NO. 20782 | 254-AsnLeuThrArgGlnSerProGlyLysLysIle-264 |
| SEQ. ID. NO. 20783 | 268-TyrGluArgAlaGlyGlnThrHisThrAlaAspIleArgProAspThrValGluGlnProAspHisThrLeu-291 |
| SEQ. ID. NO. 20784 | 295-ValGlyLeuArgProGlnProAspArgAlaTrp-305 |
| SEQ. ID. NO. 20785 | 307-AlaGlnIleArgArgSerTyrArgProSerVal-317 |
| SEQ. ID. NO. 20786 | 327-LysThrValSerHisSer-332 |
| SEQ. ID. NO. 20787 | 343-IleSerGlyAsnAla-347 |
| SEQ. ID. NO. 20788 | 362-AlaGlyGlnSerAla-366 |
| SEQ. ID. NO. 20789 | 408-IleArgGlyLysProLeuGlyGluArgValGln-418 |

Hydrophilic Regions - Hopp-Woods

| SEQ. ID. NO. 20790 | 44-PhePheThrArgLysArgGlyAspThr-52 |
| SEQ. ID. NO. 20791 | 68-ValAspThrArgGluGlyGluValSerGluAlaAspLeu-80 |
| SEQ. ID. NO. 20792 | 84-PheAspLysGlnHisProAlaLysArg-92 |
| SEQ. ID. NO. 20793 | 129-ValGluProAspThrIleAla-135 |
| SEQ. ID. NO. 20794 | 139-GlyPheGlnSerGlyAspLysIleGlnSer-148 |
| SEQ. ID. NO. 20795 | 193-GlyThrProGluAlaGlyLysIleAlaLys-202 |
| SEQ. ID. NO. 20796 | 220-GlyValGluLysGlySerProAlaGluLysAlaGlyLeuLysProGlyAspArgLeuThrAlaAlaAspGlyLysPro-245 |
| SEQ. ID. NO. 20797 | 256-ThrArgGlnSerProGlyLysLysIle-264 |
| SEQ. ID. NO. 20798 | 268-TyrGluArgAlaGlyGln-273 |
| SEQ. ID. NO. 20799 | 277-AlaAspIleArgProAspThrValGluGlnProAsp-288 |
| SEQ. ID. NO. 20800 | 299-ProGlnProAspArgAlaTrp-305 |
| SEQ. ID. NO. 20801 | 308-GlnIleArgArgSerTyrArg-314 |
| SEQ. ID. NO. 20802 | 362-AlaGlyGlnSerAla-366 |
| SEQ. ID. NO. 20803 | 411-LysProLeuGlyGluArgValGln-418 | a592
AMPHI Regions - AMPHI

| SEQ. ID. NO. 20804 | 6-PheGlyGlnIlePheSer-11 |
| SEQ. ID. NO. 20805 | 21-GlyGlyLeuLeuGlyGlyLeuIle-28 |
| SEQ. ID. NO. 20806 | 50-AlaProAsnAlaAlaAlaAlaAla-57 |
| SEQ. ID. NO. 20807 | 65-GlnGlyMetIleGlnMetLeuGlyValPheValAsp-76 |
| SEQ. ID. NO. 20808 | 94-ProTyrGlyAspLeu-98 |
| SEQ. ID. NO. 20809 | 109-ValSerGlnValGlyGlnTrp-115 |
| SEQ. ID. NO. 20810 | 153-ThrAlaValPheArgMet-158 |
| SEQ. ID. NO. 20811 | 165-TyrPheGlyAlaValAla-170 |
| SEQ. ID. NO. 20812 | 185-IleMetAlaTrpIleAsnLeuValAlaIleLeuLeuLeuSer-198 |

Antigenic Index - Jameson-Wolf

| SEQ. ID. NO. 20813 | 35-GlyIleLysArgGlyLeuTyrSerAsnGluAlaGlyMetGlySerAlaProAsnAla-53 |
| SEQ. ID. NO. 20814 | 57-AlaGluValLysHisProValSer-64 |
| SEQ. ID. NO. 20815 | 93-GlnProTyrGlyAspLeuSerGly-100 |
| SEQ. ID. NO. 20816 | 137-AlaTyrAlaGluSerAsnVal-143 |
| SEQ. ID. NO. 20817 | 206-ArgAspTyrThrAlaLysLeuLysMetGlyLysAspProGluPheLysLeuSerGluHisProGlyLeuLysArgArgIleLysSerAspValTrp-237 |

Hydrophilic Regions - Hopp-Woods

| SEQ. ID. NO. 20818 | 35-GlyIleLysArgGlyLeuTyr-41 |
| SEQ. ID. NO. 20819 | 57-AlaGluValLysHisProVal-63 |
| SEQ. ID. NO. 20820 | 212-LeuLysMetGlyLysAspProGluPheLysLeuSerGlu-224 |
| SEQ. ID. NO. 20821 | 226-ProGlyLeuLysArgArgIleLysSer-234 | a593
AMPHI Regions - AMPHI

| SEQ. ID. NO. 20822 | 6-GlyLeuCysLysArgPheGlyGlyLysThr-15 |
| SEQ. ID. NO. 20823 | 41-SerThrLeuLeuAsnMetIleAlaGlyIleValArg-52 |
| SEQ. ID. NO. 20824 | 87-HisMetSerAlaLeuGlu-92 |
| SEQ. ID. NO. 20825 | 102-LysMetProLysAla-106 |
| SEQ. ID. NO. 20826 | 125-AlaHisArgLysProXxxLysLeuSerGlyGlyGlu-136 |

TABLE 1-continued

| | |
|---|---|
| SEQ. ID. NO. 20827 | 159-PheSerSerLeuAsp-163 |
| SEQ. ID. NO. 20828 | 165-HisLeuArgAspArgLeuArgArgMet-173 |
| SEQ. ID. NO. 20829 | 213-CysGlyThrProGluThrLeuValGlnThrProAlaGlyValGlnValAlaHisLeuMetGly-233 |

Antigenic Index - Jameson-Wolf

| | |
|---|---|
| SEQ. ID. NO. 20830 | 6-GlyLeuCysLysArgPheGlyGlyLysThrValAlaAsp-18 |
| SEQ. ID. NO. 20831 | 24-ValGlyArgGlyLysIle-29 |
| SEQ. ID. NO. 20832 | 33-LeuGlyArgSerGlyCysGlyLysSerThr-42 |
| SEQ. ID. NO. 20833 | 50-IleValArgProAspGlyGlyGlu-57 |
| SEQ. ID. NO. 20834 | 61-AsnGlyGluAsnIleThrArgMetProProGluLysArgArgIle-75 |
| SEQ. ID. NO. 20835 | 99-LysMetGlnLysMetProLysAlaGluAlaGluSer-110 |
| SEQ. ID. NO. 20836 | 119-ValGlyLeuGluAsnGluAlaHisArgLysProXxxLysLeuSerGlyGlyGluLysGlnArgLeuAlaLeu-142 |
| SEQ. ID. NO. 20837 | 157-GluSerPheSerSerLeu-162 |
| SEQ. ID. NO. 20838 | 164-ThrHisLeuArgAspArgLeuArgArgMetThrAlaGluArgIleArgLysGlyGlyIle-183 |
| SEQ. ID. NO. 20839 | 190-HisSerProGluGluAlaCysThrAlaAlaAspGluIleAlaVal-204 |
| SEQ. ID. NO. 20840 | 206-HisGluGlyLysIleLeuGlnCysGlyThrProGluThrLeu-219 |
| SEQ. ID. NO. 20841 | 233-GlyLeuProAsnThrAspAspAspArgHisIle-243 |
| SEQ. ID. NO. 20842 | 248-ValArgPheAspGlnAspGlyMetGluCysArgValLeuSer-261 |
| SEQ. ID. NO. 20843 | 263-ThrCysLeuProGluSer-268 |
| SEQ. ID. NO. 20844 | 291-GlyGluIleSerGlyAsnAspThrValArgIleHisIleGluAspArgGluIleValArgPheArg-312 |

Hydrophilic Regions - Hopp-Woods

| | |
|---|---|
| SEQ. ID. NO. 20845 | 6-GlyLeuCysLysArgPheGlyGly-13 |
| SEQ. ID. NO. 20846 | 25-GlyArgGlyLysIle-29 |
| SEQ. ID. NO. 20847 | 36-SerGlyCysGlyLys-40 |
| SEQ. ID. NO. 20848 | 51-ValArgProAspGlyGly-56 |
| SEQ. ID. NO. 20849 | 68-MetProProGluLysArgArgIle-75 |
| SEQ. ID. NO. 20850 | 99-LysMetGlnLysMetProLysAlaGluAlaGluSer-110 |
| SEQ. ID. NO. 20851 | 119-ValGlyLeuGluAsnGluAlaHisArgLysProXxxLysLeuSerGlyGlyGluLysGlnArgLeuAlaLeu-142 |
| SEQ. ID. NO. 20852 | 164-ThrHisLeuArgAspArgLeuArgArgMetThrAlaGluArgIleArgLysGlyGly-182 |
| SEQ. ID. NO. 20853 | 191-SerProGluGluAlaCysThrAlaAlaAspGluIleAlaVal-204 |
| SEQ. ID. NO. 20854 | 206-HisGluGlyLysIle-210 |
| SEQ. ID. NO. 20855 | 236-AsnThrAspAspAspArgHisIle-243 |
| SEQ. ID. NO. 20856 | 248-ValArgPheAspGlnAspGlyMetGluCysArgValLeuSer-261 |
| SEQ. ID. NO. 20857 | 291-GlyGluIleSerGly-295 |
| SEQ. ID. NO. 20858 | 297-AspThrValArgIleHisIleGluAspArgGluIleValArgPheArga594-312 |

AMPHI Regions - AMPHI

| | |
|---|---|
| SEQ. ID. NO. 20859 | 21-SerIleLeuArgLeu-25 |
| SEQ. ID. NO. 20860 | 108-AlaGlyArgGluCysGlnGluThrAlaAlaAla-118 |
| SEQ. ID. NO. 20861 | 138-AlaIleLysArgCysAsn-143 |

Antigenic Index - Jameson-Wolf

| | |
|---|---|
| SEQ. ID. NO. 20862 | 1-MetGlyAlaAspThrAspGlyAspLysAspValArgLeuAsnArgThr-16 |
| SEQ. ID. NO. 20863 | 51-ValGluHisProAsnArgPhe-57 |
| SEQ. ID. NO. 20864 | 75-HisLeuAspGlySerThrGlyGly-82 |
| SEQ. ID. NO. 20865 | 86-PheArgArgGluLysThrGlyHisLysArgArgCysHisThrGlnCys-101 |
| SEQ. ID. NO. 20866 | 103-HisSerAlaArgAlaAlaGlyArgGluCysGlnGluThr-115 |
| SEQ. ID. NO. 20867 | 137-ArgAlaIleLysArgCysAsn-143 |

Hydrophilic Regions - Hopp-Woods

| | |
|---|---|
| SEQ. ID. NO. 20868 | 1-MetGlyAlaAspThrAspGlyAspLysAspValArgLeuAsnArg-15 |
| SEQ. ID. NO. 20869 | 86-PheArgArgGluLysThrGlyHisLysArgArgCysHis-98 |
| SEQ. ID. NO. 20870 | 105-AlaArgAlaAlaGlyArgGluCysGlnGluThr-115 |
| SEQ. ID. NO. 20871 | 137-ArgAlaIleLysArgCysAsn-143 | a595
AMPHI Regions - AMPHI

| | |
|---|---|
| SEQ. ID. NO. 20872 | 20-CysGlnProProGluAla-25 |
| SEQ. ID. NO. 20873 | 140-AlaAspLeuGluLysLeuSerGlnProLeuAla-150 |
| SEQ. ID. NO. 20874 | 157-GlnGlyGluValLysGluLeuVal-164 |
| SEQ. ID. NO. 20875 | 169-ThrPheThrGluAlaValLysAlaGlyAspIleGluLysAla-182 |
| SEQ. ID. NO. 20876 | 196-IleGluProIleAlaGluLeuPheSerGluLeuAspPro-208 |
| SEQ. ID. NO. 20877 | 224-AlaGlyPheThrGlyPheHisArg-231 |
| SEQ. ID. NO. 20878 | 243-SerGlyValLysGluIleAlaAlaLysLeuMetThrAspValGluAlaLeuGlnLysGluIleAsp-264 |
| SEQ. ID. NO. 20879 | 274-ValGlyGlyAlaSerGluLeuIleGluGluValAlaGly-286 |
| SEQ. ID. NO. 20880 | 309-AspGlySerLysLysIleValAspLeuPheArgProLeu-321 |
| SEQ. ID. NO. 20881 | 337-PheLysGlnValAsnGluIleLeuAlaLys-346 |
| SEQ. ID. NO. 20882 | 351-AspGlyPheGluThrTyrAspLysLeuGlyGlu-361 |
| SEQ. ID. NO. 20883 | 366-AlaLeuGlnAlaSerIleAsnAlaLeuAlaGluAspLeuAlaGlnLeuArgGlyIleLeuGlyLeu-387 |

Antigenic Index - Jameson-Wolf

| | |
|---|---|
| SEQ. ID. NO. 20884 | 1-MetArgLysPheAsn-5 |
| SEQ. ID. NO. 20885 | 21-GlnProProGluAlaGluLysAlaAlaPro-30 |
| SEQ. ID. NO. 20886 | 32-AlaSerGlyGluAlaGlnThrAlaAsnGluGlyGlySer-44 |
| SEQ. ID. NO. 20887 | 50-AsnAspAsnAlaCysGluProMetGlu-58 |
| SEQ. ID. NO. 20888 | 70-IleLysAsnAsnSerGlyArgLysLeuGluTrpGluIle-82 |
| SEQ. ID. NO. 20889 | 87-MetValValAspGluArgGluAsnIleAla-96 |
| SEQ. ID. NO. 20890 | 98-GlyLeuSerAspLysMetThr-104 |
| SEQ. ID. NO. 20891 | 108-LeuProGlyGluTyrGluMet-114 |
| SEQ. ID. NO. 20892 | 120-ThrAsnProArgGlyLysLeuValValThrAspSerGlyPheLysAspThrAlaAsnGluAlaAspLeuGluLysLeuSer-146 |
| SEQ. ID. NO. 20893 | 158-GlyGluValLysGluLeuValAlaLysThrLysThrPheThrGluAlaValLysAlaGlyAspIleGluLysAlaLysSerLeuPheAla-187 |
| SEQ. ID. NO. 20894 | 189-ThrArgValHisTyrGluArgIleGluProIle-199 |
| SEQ. ID. NO. 20895 | 204-SerGluLeuAspProValIleAspAlaArgGluAspAspPheLysAspGlyAlaLysAspAlaGly-225 |
| SEQ. ID. NO. 20896 | 238-ValGluLysAspValSerGlyValLysGluIleAlaAla-250 |
| SEQ. ID. NO. 20897 | 252-LeuMetThrAspValGluAlaLeuGlnLysGluIleAsp-264 |
| SEQ. ID. NO. 20898 | 269-ProProGlyLysValValGlyGlyAla-277 |

TABLE 1-continued

| | |
|---|---|
| SEQ. ID. NO. 20899 | 279-GluLeuIleGluGluValAlaGlySerLysIleSerGlyGluGluAspArgTyrSerHisThrAspLeuSerAspPheGlnAlaAsnValAspGlySer LysLysIleValAsp-316 |
| SEQ. ID. NO. 20900 | 322-IleGluThrLysAsnLysAlaLeuLeuGluLysThrAspThrAsnPheLysGlnValAsn-341 |
| SEQ. ID. NO. 20901 | 345-AlaLysTyrArgThrLysAspGlyPheGluThrTyrAspLysLeuGlyGluAlaAspArgLysAlaLeu-367 |
| SEQ. ID. NO. 20902 | 374-LeuAlaGluAspLeuAlaGln-380 |

Hydrophilic Regions - Hopp-Woods

| | |
|---|---|
| SEQ. ID. NO. 20903 | 1-MetArgLysPheAsn-5 |
| SEQ. ID. NO. 20904 | 21-GlnProProGluAlaGluLysAlaAlaPro-30 |
| SEQ. ID. NO. 20905 | 32-AlaSerGlyGluAlaGlnThrAlaAsnGluGlyGlySer-44 |
| SEQ. ID. NO. 20906 | 52-AsnAlaCysGluProMetGlu-58 |
| SEQ. ID. NO. 20907 | 72-AsnAsnSerGlyArgLysLeuGluTrpGluIle-82 |
| SEQ. ID. NO. 20908 | 87-MetValValAspGluArgGluAsnIle-95 |
| SEQ. ID. NO. 20909 | 99-LeuSerAspLysMetThr-104 |
| SEQ. ID. NO. 20910 | 110-GlyGluTyrGluMet-114 |
| SEQ. ID. NO. 20911 | 122-ProArgGlyLysLeuValVal-128 |
| SEQ. ID. NO. 20912 | 131-SerGlyPheLysAspThrAlaAsnGluAlaAspLeuGluLysLeuSer-146 |
| SEQ. ID. NO. 20913 | 158-GlyGluValLysGluLeuValAlaLysThrLysThrPheThrGluAlaValLysAlaGlyAspIleGluLysAlaLysSerLeuPheAla-187 |
| SEQ. ID. NO. 20914 | 189-ThrArgValHisTyrGluArgIleGluProIle-199 |
| SEQ. ID. NO. 20915 | 204-SerGluLeuAspProValIleAspAlaArgGluAspAspPheLysAspGlyAlaLysAspAlaGly-225 |
| SEQ. ID. NO. 20916 | 238-ValGluLysAspValSerGlyValLysGluIleAlaAla-250 |
| SEQ. ID. NO. 20917 | 252-LeuMetThrAspValGluAlaLeuGlnLysGluIleAsp-264 |
| SEQ. ID. NO. 20918 | 279-GluLeuIleGluGluValAlaGly-286 |
| SEQ. ID. NO. 20919 | 288-LysIleSerGlyGluGluAspArgTyrSerHis-298 |
| SEQ. ID. NO. 20920 | 308-ValAspGlySerLysLysIleValAsp-316 |
| SEQ. ID. NO. 20921 | 322-IleGluThrLysAsnLysAlaLeuLeuGluLysThrAspThrAsnPhe-337 |
| SEQ. ID. NO. 20922 | 347-TyrArgThrLysAspGlyPheGluThrTyrAspLysLeuGlyGluAlaAspArgLysAlaLeu-367 |
| SEQ. ID. NO. 20923 | 374-LeuAlaGluAspLeuAlaGln-380 | a596
AMPHI Regions - AMPHI

| | |
|---|---|
| SEQ. ID. NO. 20924 | 9-MetLeuArgValSerLysValVal-16 |
| SEQ. ID. NO. 20925 | 50-LeuArgIleMetAlaGlyValAspLys-58 |
| SEQ. ID. NO. 20926 | 87-ValArgGluGluValGluSerGlyLeuGlyGluValAlaAlaAlaGlnLysArgLeuGluGluValTyrAlaGluTyr-112 |
| SEQ. ID. NO. 20927 | 192-ProThrAsnHisLeuAsp-197 |
| SEQ. ID. NO. 20928 | 202-GluTrpLeuGluGlnPheLeuValArgPheProGly-213 |
| SEQ. ID. NO. 20929 | 295-AlaArgPheGluGluMetSerAsnTyr-303 |
| SEQ. ID. NO. 20930 | 322-LeuGlyAsnGluValIleGluPheValAsnValSerLysSerPhe-336 |
| SEQ. ID. NO. 20931 | 366-SerThrLeuPheLysMet-371 |
| SEQ. ID. NO. 20932 | 409-AspAsnIleAlaGlu-413 |
| SEQ. ID. NO. 20933 | 444-IleThrGlyGlnLeuSer-449 |
| SEQ. ID. NO. 20934 | 483-LeuArgAlaLeuGluAspAlaLeuLeuGluPheAla-494 |

Antigenic Index - Jameson-Wolf

| | |
|---|---|
| SEQ. ID. NO. 20935 | 16-ValProProGlnLysThrIleIleLysAspIleSer-27 |
| SEQ. ID. NO. 20936 | 41-LeuAsnGlyAlaGlyLysSerThrVal-49 |
| SEQ. ID. NO. 20937 | 54-AlaGlyValAspLysGluPheGluGlyGluAla-64 |
| SEQ. ID. NO. 20938 | 75-LeuProGlnGluProGluLeuAspProGluLysThrValArgGluGluValGluSerGlyLeu-95 |
| SEQ. ID. NO. 20939 | 99-AlaAlaAlaGlnLysArgLeuGluGluValTyr-109 |
| SEQ. ID. NO. 20940 | 112-TyrAlaAsnProAspAlaAspPheAspAlaLeuAlaGluGluGlnGlyArgLeuGlu-130 |
| SEQ. ID. NO. 20941 | 136-GlySerSerThrGlyGlyGlyAlaGluHisGluLeuGluIleAlaAlaAspAlaLeuArg-155 |
| SEQ. ID. NO. 20942 | 157-ProGluTrpAspAlaLysIleAspAsnLeuSerGlyGlyGluLysArgArgValAla-175 |
| SEQ. ID. NO. 20943 | 181-LeuSerLysProAspMet-186 |
| SEQ. ID. NO. 20944 | 190-AspGluProThrAsnHisLeuAspAlaGluSer-200 |
| SEQ. ID. NO. 20945 | 219-ThrHisAspArgTyrPhe-224 |
| SEQ. ID. NO. 20946 | 233-LeuGluLeuAspArgGlyHisGlyIleProTrpLysGlyAsnTyrSerSer-249 |
| SEQ. ID. NO. 20947 | 251-LeuGluGlnLysGluLysArgLeuGluAsnGluAlaLysSerGluAlaAlaArgValLysAlaMetLysGlnGluLeuGluTrp-278 |
| SEQ. ID. NO. 20948 | 280-ArgGlnAsnAlaLysGlyArgGlnAlaLysSerLysAlaArgLeuAlaArgPheGluGluMetSerAsnTyrGluTyrGlnLysArgAsnGluThrGln Glu-313 |
| SEQ. ID. NO. 20949 | 319-AlaGluArgLeuGlyAsnGluVal-326 |
| SEQ. ID. NO. 20950 | 333-SerLysSerPheGlyAsp-338 |
| SEQ. ID. NO. 20951 | 359-GlyProAsnGlyAlaGlyLysSerThrLeu-368 |
| SEQ. ID. NO. 20952 | 373-AlaGlyLysGluGlnProAspSerGlyGluValLysIle-385 |
| SEQ. ID. NO. 20953 | 395-AspGlnSerArgGluGlyLeuGlnAsnAspLysThrValPhe-408 |
| SEQ. ID. NO. 20954 | 411-IleAlaGluGlyArgAspIleLeu-418 |
| SEQ. ID. NO. 20955 | 421-GlyGlnPheGluIleProAlaArgGlnTyrLeuGlyArgPheAsnPheLysGlySerAspGlnSerLysIle-444 |
| SEQ. ID. NO. 20956 | 446-GlyGlnLeuSerGlyGlyGluArgGlyArgLeuHisLeu-458 |
| SEQ. ID. NO. 20957 | 462-LeuLeuGlyGlyGlyAsn-467 |
| SEQ. ID. NO. 20958 | 471-LeuAspGluProSerAsnAspLeuAspValGluThr-482 |
| SEQ. ID. NO. 20959 | 501-SerHisAspArgTrpPhe-506 |
| SEQ. ID. NO. 20960 | 516-AlaCysGluGlyAspSerLysTrp-523 |
| SEQ. ID. NO. 20961 | 526-PheAspGlyAsnTyrGlnGluTyrGluAlaAspLysLysArgArgLeuGlyGluGluGlyThrLysProLysArgIleLysTyrLysProValThr Arg-558 |

Hydrophilic Regions - Hopp-Woods

| | |
|---|---|
| SEQ. ID. NO. 20962 | 54-AlaGlyValAspLysGluPheGluGlyGluAla-64 |
| SEQ. ID. NO. 20963 | 77-GlnGluProGluLeuAspProGluLysThrValArgGluGluValGluSerGlyLeu-95 |
| SEQ. ID. NO. 20964 | 99-AlaAlaAlaGlnLysArgLeuGluGluValTyr-109 |
| SEQ. ID. NO. 20965 | 113-AlaAsnProAlaAspPheAspAlaLeuAlaGluGluGlnGlyArgLeuGlu-130 |
| SEQ. ID. NO. 20966 | 141-GlyGlyAlaGluHisGluLeuGluIleAlaAlaAspAlaLeuArg-155 |
| SEQ. ID. NO. 20967 | 157-ProGluTrpAspAlaLysIleAspAsn-165 |
| SEQ. ID. NO. 20968 | 167-SerGlyGlyGluLysArgArgValAla-175 |
| SEQ. ID. NO. 20969 | 181-LeuSerLysProAsp-185 |
| SEQ. ID. NO. 20970 | 190-AspGluProThrAsnHisLeuAspAlaGluSer-200 |

TABLE 1-continued

| SEQ. ID. NO. | Sequence |
|---|---|
| SEQ. ID. NO. 20971 | 233-LeuGluLeuAspArgGlyHis-239 |
| SEQ. ID. NO. 20972 | 251-LeuGluGlnLysGluLysArgLeuGluAsnGluAlaLysSerGluAlaAlaArgValLysAlaMetLysGlnGluLeuGluTrp-278 |
| SEQ. ID. NO. 20973 | 280-ArgGlnAsnAlaLysGlyArgGlnAlaLysSerLysAlaArgLeuAlaArgPheGluGluMetSerAsn-302 |
| SEQ. ID. NO. 20974 | 304-GluTyrGlnLysArgAsnGluThrGln-312 |
| SEQ. ID. NO. 20975 | 319-AlaGluArgLeuGlyAsnGluVal-326 |
| SEQ. ID. NO. 20976 | 373-AlaGlyLysGluGlnProAspSerGlyGluValLysIle-385 |
| SEQ. ID. NO. 20977 | 395-AspGlnSerArgGluGlyLeuGlnAsnAspLysThrValPhe-408 |
| SEQ. ID. NO. 20978 | 411-IleAlaGluGlyArgAspIleLeu-418 |
| SEQ. ID. NO. 20979 | 435-AsnPheLysGlySerAspGlnSerLysIle-444 |
| SEQ. ID. NO. 20980 | 449-SerGlyGlyGluArgGlyArgLeuHisLeu-458 |
| SEQ. ID. NO. 20981 | 472-AspGluProSerAsnAspLeuAspValGluThr-482 |
| SEQ. ID. NO. 20982 | 517-CysGluGlyAspSer-521 |
| SEQ. ID. NO. 20983 | 529-AsnTyrGlnGluTyrGluAlaAspLysLysArgArgLeuGlyGluGluGlyThrLysProLysArgIleLysTyr-553 | a597
AMPHI Regions - AMPHI

| SEQ. ID. NO. | Sequence |
|---|---|
| SEQ. ID. NO. 20984 | 6-SerAsnSerLeuLysGlnLeuGlnGlu-14 |
| SEQ. ID. NO. 20985 | 45-TrpAspLysPheGlnLysLeu-51 |
| SEQ. ID. NO. 20986 | 68-GlnIleSerArgPheValSerGly-75 |
| SEQ. ID. NO. 20987 | 101-LeuArgTyrThrArgTyrValAsnAla-109 |
| SEQ. ID. NO. 20988 | 111-AsnArgGluValValLysAspLeuGluLysGlnGln-122 |
| SEQ. ID. NO. 20989 | 132-IleAsnAsnGluLeuAlaArgLeuLysLysLys-141 |
| SEQ. ID. NO. 20990 | 144-AlaAsnValGlnSerLeu-149 |
| SEQ. ID. NO. 20991 | 157-AspAlaAlaGluGlnThrGlu-163 |
| SEQ. ID. NO. 20992 | 169-AlaLysIleAlaLysAspAlaArg-176 |
| SEQ. ID. NO. 20993 | 189-AsnLysLeuLeuSer-193 |
| SEQ. ID. NO. 20994 | 253-ProSerValMetGlyIleGlySerAlaAspGlyPheSerArgMetGlnGlyArgLeuLysLysProValAspGlyValProThrGly-281 |
| SEQ. ID. NO. 20995 | 302-ProAlThrValGluSerIleAla-309 |
| SEQ. ID. NO. 20996 | 314-SerTyrAlaAspGluLeuAspGlyTyrGlyLys-324 |
| SEQ. ID. NO. 20997 | 336-SerIleTyrAlaAlaGlyLeu-341 |

Antigenic Index - Jameson-Wolf

| SEQ. ID. NO. | Sequence |
|---|---|
| SEQ. ID. NO. 20998 | 7-AsnSerLeuLysGlnLeuGlnGluGluArgIleArgGlnGluArgIleArgGlnGluArgIleArgGlnAlaArgGlyAsnLeu-34 |
| SEQ. ID. NO. 20999 | 36-SerValAsnArgLysGlnArgGluAlaTrpAspLysPheGlnLysLeuAsnThrGluLeuAsnArgLeuLysThrGluValAlaAla-64 |
| SEQ. ID. NO. 21000 | 74-SerGlyAsnTyrLysAsnSerGlnProAsn-83 |
| SEQ. ID. NO. 21001 | 91-AsnAlaGluProGlyGlnLysAsnArgPhe-100 |
| SEQ. ID. NO. 21002 | 107-ValAsnAlaSerAsnArgGluValValLysAspLeuGluLysGlnGlnLys-123 |
| SEQ. ID. NO. 21003 | 128-GlnGluGlnLysIleAsnAsnGluLeuAlaArgLeuLysLysIleGln-143 |
| SEQ. ID. NO. 21004 | 149-LeuLeuLysLysGlnGlyValThrAspAlaAlaGluGlnThrGluSerArgArgGlnAsnAlaLysIleAlaLysAspAlaArgLysLeuLeuGluGlnLysGlyAsnGluGlnGlnLeu-188 |
| SEQ. ID. NO. 21005 | 191-LeuLeuSerAsnLeuGluLysLysLysAlaGluHisArgIleGlnAspAlaGluAlaLysArgLysLeuAlaGluAlaArgLeuAlaAlaAlaGluLysAlaArgLysGluAlaAlaGlnGlnLysAlaGluAlaArgArgAlaGluMetSerAsnLeuThrAlaGluAspArgAsnIleGlnAlaProSer-254 |
| SEQ. ID. NO. 21006 | 259-GlySerAlaAspGlyPheSerArgMetGlnGlyArgLeuLysLysProValAspGlyValProThr-280 |
| SEQ. ID. NO. 21007 | 284-GlyGlnAsnArgSerGlyGlyAspVal-292 |
| SEQ. ID. NO. 21008 | 314-SerTyrAlaAspGluLeuAspGlyTyrGly-323 |
| SEQ. ID. NO. 21009 | 329-AspHisGlyGluAsnTyr-334 |
| SEQ. ID. NO. 21010 | 345-SerValGlyLysGlyTyr-350 |
| SEQ. ID. NO. 21011 | 354-AlaGlySerLysIleGlySerSerGlySerLeuProAspGlyGluGluGlyLeu-371 |
| SEQ. ID. NO. 21012 | 381-ValLeuAsnProSerSerTrp-387 |

Hydrophilic Regions - Hopp-Woods

| SEQ. ID. NO. | Sequence |
|---|---|
| SEQ. ID. NO. 21013 | 7-AsnSerLeuLysGlnLeuGlnGluGluArgIleArgGlnGluArgIleArgGlnGluArgIleArgGlnAlaArgGlyAsn-33 |
| SEQ. ID. NO. 21014 | 37-ValAsnArgLysGlnArgGluAlaTrpAspLysPheGlnLysLeuAsnThrGluLeuAsnArgLeuLysThrGluValAlaAla-64 |
| SEQ. ID. NO. 21015 | 77-TyrLysAsnSerGln-81 |
| SEQ. ID. NO. 21016 | 91-AsnAlaGluProGlyGlnLysAsnArgPhe-100 |
| SEQ. ID. NO. 21017 | 110-SerAsnArgGluValValLysAspLeuGluLysGlnGlnLys-123 |
| SEQ. ID. NO. 21018 | 128-GlnGluGlnLysIleAsnAsnGluLeuAlaArgLeuLysLysIleGln-143 |
| SEQ. ID. NO. 21019 | 149-LeuLeuLysLysGlnGlyValThrAspAlaAlaGluGlnThrGluSerArgArgGlnAsnAlaLysIleAlaLysAspAlaArgLysLeuLeuGluGlnLysGlyAsnGluGlnGlnLeu-188 |
| SEQ. ID. NO. 21020 | 193-SerAsnLeuGluLysLysLysAlaGluHisArgIleGlnAspAlaGluAlaLysArgLysLeuAlaGluAlaArgLeuAlaAlaAlaGluLysAlaArgLysGluAlaAlaGlnGlnLysAlaGluAlaArgArgAlaGluMet-240 |
| SEQ. ID. NO. 21021 | 244-ThrAlaGluAspArgAsnIleGln-251 |
| SEQ. ID. NO. 21022 | 267-MetGlnGlyArgLeuLysLysProValAsp-276 |
| SEQ. ID. NO. 21023 | 286-AsnArgSerGlyGlyAspVal-292 |
| SEQ. ID. NO. 21024 | 315-TyrAlaAspGluLeuAspGlyTyrGly-323 |
| SEQ. ID. NO. 21025 | 356-SerLysIleGlySer-360 |
| SEQ. ID. NO. 21026 | 363-SerLeuProAspGlyGluGluGlyLeu-371 | a601
AMPHI Regions - AMPHI

| SEQ. ID. NO. | Sequence |
|---|---|
| SEQ. ID. NO. 21027 | 7-LeuValAspGluIleAspValProAsnIleGlyArg-18 |
| SEQ. ID. NO. 21028 | 26-AlaGlyIleProThrValPhe-32 |
| SEQ. ID. NO. 21029 | 42-GlyLysGluLeuGlnAspAspIleAsnAsnAspAlaAlaAlaLeuGluLysPheGluLysIleArgAlaTyrGlyAlaLeu-68 |
| SEQ. ID. NO. 21030 | 70-MetGlyLeuIleSerAspValSerGluAlaAla-80 |
| SEQ. ID. NO. 21031 | 100-SerSerGlyLysThrValAsn-106 |
| SEQ. ID. NO. 21032 | 137-AlaAlaAlaValProGlyThrLeuValAsnLeuAlaAla-149 |
| SEQ. ID. NO. 21033 | 169-GlyAlaAlaAlaGlu-173 |

Antigenic Index - Jameson-Wolf

| SEQ. ID. NO. | Sequence |
|---|---|
| SEQ. ID. NO. 21034 | 3-ProThrGlyAsnLeuValAspGluIleAspValProAsnIleGlyArgLeuLys-20 |
| SEQ. ID. NO. 21035 | 39-GlyTyrThrGlyLysGluLeuGlnAspAspIleAsnAsnAspAlaAlaAlaLeuGluLysPheGluLysIleArgAla-64 |
| SEQ. ID. NO. 21036 | 75-AspValSerGluAlaAlaAlaArgAlaHisThrPro-86 |
| SEQ. ID. NO. 21037 | 97-TyrThrAlaSerSerGlyLysThrValAsn-106 |
| SEQ. ID. NO. 21038 | 149-AlaGlyGlyGlyThrArgLysGluValArgPheGlyHisProSerGlyThrLeuArg-167 |
| SEQ. ID. NO. 21039 | 172-AlaGluCysGlnAspGlyGln-178 |

TABLE 1-continued

SEQ. ID. NO. 21040    185-ValMetSerArgSerAlaArgValMet-193
SEQ. ID. NO. 21041    198-ValArgValProGluAspCysPhe-205
Hydrophilic Regions - Hopp-Woods
SEQ. ID. NO. 21042    7-LeuValAspGluIleAspVal-13
SEQ. ID. NO. 21043    40-TyrThrGlyLysGluLeuGlnAspAspIleAsnAsnAspAlaAlaAlaLeuGluLysPheGluLysIleArgAla-64
SEQ. ID. NO. 21044    75-AspValSerGluAlaAlaAlaArgAlaHisThr-85
SEQ. ID. NO. 21045    99-AlaSerSerGlyLysThrValAsn-106
SEQ. ID. NO. 21046    151-GlyGlyThrArgLysGluValArgPhe-159
SEQ. ID. NO. 21047    172-AlaGluCysGlnAsp-176
SEQ. ID. NO. 21048    188-ArgSerAlaArgValMet-193
SEQ. ID. NO. 21049    200-ValProGluAspCysPhe-205
a602
AMPHI Regions - AMPHI
SEQ. ID. NO. 21050    7-AspLysAlaArgHis-11
SEQ. ID. NO. 21051    21-ValAsnArgHisGlyGln-26
SEQ. ID. NO. 21052    54-ArgGlnIleAlaGlnIle-59
SEQ. ID. NO. 21053    61-AlaGlyLeuHisValCysAsnSerVal-69
SEQ. ID. NO. 21054    78-HisValIleValGluMetCysAlaTrpTyr-87
Antigenic Index - Jameson-Wolf
SEQ. ID. NO. 21055    5-GlnCysAspLysAlaArgHisMetArg-13
SEQ. ID. NO. 21056    20-GlnValAsnArgHisGlyGlnThrGlyAsnCysGly-31
SEQ. ID. NO. 21057    36-CysSerLeuGlnGlyAsnArgLysAlaGlnValPheAspThrAspLeuIleAspArgGlnIle-56
SEQ. ID. NO. 21058    90-SerThrGlyGluTyr-94
SEQ. ID. NO. 21059    99-GlnMetArgAspTyrIle-104
Hydrophilic Regions - Hopp-Woods
SEQ. ID. NO. 21060    5-GlnCysAspLysAlaArgHisMetArg-13
SEQ. ID. NO. 21061    20-GlnValAsnArgHisGlyGln-26
SEQ. ID. NO. 21062    39-GlnGlyAsnArgLysAlaGlnValPheAsp-48
SEQ. ID. NO. 21063    50-AspLeuIleAspArgGlnIle-56
a603
AMPHI Regions - AMPHI
SEQ. ID. NO. 21064    158-ValMetAspGluLeuAsnAlaCysIlePro-167
SEQ. ID. NO. 21065    172-HisAsnProAlaAsnIleSerGlyIleLeuAla-182
SEQ. ID. NO. 21066    186-HisPheProGlyLeuProAsnValGly-194
SEQ. ID. NO. 21067    199-SerPheHisGlnThrMetPro-205
SEQ. ID. NO. 21068    212-AlaValProArgGluLeu-217
SEQ. ID. NO. 21069    245-GlyLysProLeuGluAspIleArgMetIleIleAlaHis-257
SEQ. ID. NO. 21070    260-AsnGlyAlaSerIleThrAlaIleLysAsnGlyLysSerVal-273
SEQ. ID. NO. 21071    280-ThrProIleGluGly-284
SEQ. ID. NO. 21072    299-TyrSerTyrLeuThrSer-304
SEQ. ID. NO. 21073    324-LeuGlyIleSerGlu-328
SEQ. ID. NO. 21074    330-SerAsnAspCysArg-334
SEQ. ID. NO. 21075    357-ArgLeuAlaLysTyrIleAlaSerMet-365
SEQ. ID. NO. 21076    393-ValSerTyrLeuAsp-397
Antigenic Index - Jameson-Wolf
SEQ. ID. NO. 21077    1-LeuSerSerArgArgArgGlyArgAsnAsnAspArgLysCysGlyIle-16
SEQ. ID. NO. 21078    18-PheAlaGlnArgGlyArgLeuLysHisThrProProAsnAlaHisProPheSerAspAspProThrXxxLysLysGlnProGlnThrThrArgArgAsn
                      IleMetSer-53
SEQ. ID. NO. 21079    63-GlySerSerSerLeuLysGlyAlaValIleAspArgLysSerGlySer-78
SEQ. ID. NO. 21080    84-LeuGlyGluArgLeuThrThrProGluAla-93
SEQ. ID. NO. 21081    96-ThrPheSerLysAspGlyAsnLysArgGlnValProLeuSerGlyArgAsnCysHis-114
SEQ. ID. NO. 21082    124-GluLeuGluLysHisGluLeuHisAspArgIleGln-135
SEQ. ID. NO. 21083    142-AlaHisGlyGlyGluLysTyrSerGlu-150
SEQ. ID. NO. 21084    157-AlaValMetAspGluLeuAsn-163
SEQ. ID. NO. 21085    203-ThrMetProGluArgAlaTyr-209
SEQ. ID. NO. 21086    215-ArgGluLeuArgLysLysTyrAlaPheArgArgTyrGlyPheHisGlyThrSerMetArg-234
SEQ. ID. NO. 21087    246-LysProLeuGluAspIleArg-252
SEQ. ID. NO. 21088    258-LeuGlyAsnGlyAla-262
SEQ. ID. NO. 21089    265-ThrAlaIleLysAsnGlyLysSerValAspThrSerMetGly-278
SEQ. ID. NO. 21090    289-ThrArgCysGlyAspIleAspProGlyVal-298
SEQ. ID. NO. 21091    311-AlaGlnValAspGluMetLeuAsnLysLysSerGly-322
SEQ. ID. NO. 21092    327-SerGluLeuSerAsnAspCysArgThrLeuGluIleAlaAlaAspGluGlyHisGluGlyAlaArgLeu-349
SEQ. ID. NO. 21093    380-GlyIleGlyGluAsnSerArgAsnIleArgAlaLysThr-392
SEQ. ID. NO. 21094    403-IleAspThrLysAlaAsnMetGluLysArgTyrGlyAsnSerGlyIle-418
SEQ. ID. NO. 21095    420-SerProThrAspSerSerPro-426
SEQ. ID. NO. 21096    432-ProThrAsnGluGluLeu-437
Hydrophilic Regions - Hopp-Woods
SEQ. ID. NO. 21097    1-LeuSerSerArgArgArgGlyArgAsnAsnAspArgLysCysGlyIle-16
SEQ. ID. NO. 21098    18-PheAlaGlnArgGlyArgLeuLysHisThrPro-28
SEQ. ID. NO. 21099    34-PheSerAspAspProThrXxxLysLysGlnProGlnThrThrArgArgAsnIleMet-52
SEQ. ID. NO. 21100    70-AlaValIleAspArgLysSerGly-77
SEQ. ID. NO. 21101    84-LeuGlyGluArgLeuThrThr-90
SEQ. ID. NO. 21102    97-PheSerLysAspGlyAsnLysArgGlnValProLeuSerGlyArgAsnCysHis-114
SEQ. ID. NO. 21103    124-GluLeuGluLysHisGluLeuHisAspArgIleGln-135
SEQ. ID. NO. 21104    143-HisGlyGlyGluLysTyrSerGlu-150
SEQ. ID. NO. 21105    157-AlaValMetAspGluLeuAsn-163
SEQ. ID. NO. 21106    204-MetProGluArgAlaTyr-209
SEQ. ID. NO. 21107    215-ArgGluLeuArgLysLysTyrAlaPhe-223
SEQ. ID. NO. 21108    246-LysProLeuGluAspIleArg-252
SEQ. ID. NO. 21109    268-LysAsnGlyLysSerValAspThr-275

TABLE 1-continued

| | |
|---|---|
| SEQ. ID. NO. 21110 | 290-ArgCysGlyAspIleAspPro-296 |
| SEQ. ID. NO. 21111 | 311-AlaGlnValAspGluMetLeuAsnLysLysSerGly-322 |
| SEQ. ID. NO. 21112 | 328-GluLeuSerAsnAspCysArgThrLeuGluIleAlaAlaAspGluGlyHisGluGlyAlaArgLeu-349 |
| SEQ. ID. NO. 21113 | 381-IleGlyGluAsnSerArgAsnIleArgAlaLysThr-392 |
| SEQ. ID. NO. 21114 | 403-IleAspThrLysAlaAsnMetGluLysArgTyrGly-414 |
| SEQ. ID. NO. 21115 | 433-ThrAsnGluGluLeu-437 | a604
AMPHI Regions - AMPHI

| | |
|---|---|
| SEQ. ID. NO. 21116 | 36-HisArgValValGlnPheAla-42 |
| SEQ. ID. NO. 21117 | 53-ValGlyGlyIleHisGlyPheAlaThr-61 |
| SEQ. ID. NO. 21118 | 78-ValArgAlaGlyGlySerPhe-84 |
| SEQ. ID. NO. 21119 | 95-ArgThrValSerAlaAspPheLeuGluPhePheGlnSerCysGlyIle-110 |
| SEQ. ID. NO. 21120 | 114-ValValLeuGlnLeuPheAlaArgValAlaGlnValGlyGlyIleGlnGluAsn-131 |
| SEQ. ID. NO. 21121 | 148-ArgHisIleAsnPheIleAspGlnIleAlaGlyTrpGlu-160 |
| SEQ. ID. NO. 21122 | 166-ValGlyTrpIleLysLysPheAsp-173 |
| SEQ. ID. NO. 21123 | 191-PheGlnAsnCysAlaValLeuHisArg-199 |

Antigenic Index - Jameson-Wolf

| | |
|---|---|
| SEQ. ID. NO. 21124 | 11-AlaAlaCysGlyLysValAspGlnArgThrGlyHisGlyGlyGlyGlyArgAsnGlyAsnArgGlyGlyThrHis-35 |
| SEQ. ID. NO. 21125 | 67-GlyGlyGlyArgAspGluGlyAspPheArgArgValArgAlaGlyGlySerPhe-84 |
| SEQ. ID. NO. 21126 | 127-GlyIleGlnGluAsnGlyArgAsnAlaArgValAspGluArgGlyPheGln-143 |
| SEQ. ID. NO. 21127 | 175-TyrPheGlyCysArgGluArgTyrAlaVal-184 |
| SEQ. ID. NO. 21128 | 201-MetGlyAsnAsnGly-205 |
| SEQ. ID. NO. 21129 | 211-LeuProAspPheAspCysAlaAsp-218 |

Hydrophilic Regions - Hopp-Woods

| | |
|---|---|
| SEQ. ID. NO. 21130 | 14-GlyLysValAspGlnArgThrGlyHis-22 |
| SEQ. ID. NO. 21131 | 24-GlyGlyGlyArgAsnGlyAsnArgGlyGlyThrHis-35 |
| SEQ. ID. NO. 21132 | 68-GlyGlyArgAspGluGlyAspPheArgArgValArgAla-80 |
| SEQ. ID. NO. 21133 | 127-GlyIleGlnGluAsnGlyArgAsnAlaArgValAspGluArgGlyPhe-142 |
| SEQ. ID. NO. 21134 | 178-CysArgGluArgTyrAlaVal-184 |
| SEQ. ID. NO. 21135 | 214-PheAspCysAlaAsp-218 | a605
AMPHI Regions - AMPHI

| | |
|---|---|
| SEQ. ID. NO. 21136 | 13-ArgGlnIleTrpLysIleAlaAsp-20 |
| SEQ. ID. NO. 21137 | 38-ThrLeuPheTyrArgPheIleSerGluAsnPheThrAspTyrMetGln-53 |
| SEQ. ID. NO. 21138 | 107-LysLeuLysGluIlePheThrAlaIle-115 |
| SEQ. ID. NO. 21139 | 128-IleLysGlyLeuPheAspAspPheAsp-136 |
| SEQ. ID. NO. 21140 | 141-ArgLeuGlySerThr-145 |
| SEQ. ID. NO. 21141 | 155-AlaValLeuLysGlyValAlaGluLeu-163 |
| SEQ. ID. NO. 21142 | 173-IleAspLeuPheGlyAspAlaTyrGluTyrLeuIleSerAsn-186 |
| SEQ. ID. NO. 21143 | 188-AlaAlaAsnAlaGlyLys-193 |
| SEQ. ID. NO. 21144 | 204-ValSerLysLeuIleAlaArg-210 |
| SEQ. ID. NO. 21145 | 217-GluLysValAsnLysIleTyrAspPro-225 |
| SEQ. ID. NO. 21146 | 240-PheAspGluHisIle-244 |
| SEQ. ID. NO. 21147 | 291-AspSerLysProPheAspAlaValValSerAsn-301 |
| SEQ. ID. NO. 21148 | 341-HisAlaLeuAsnTyr-345 |
| SEQ. ID. NO. 21149 | 355-ValSerPheProGly-359 |
| SEQ. ID. NO. 21150 | 433-GluHisIleAlaGluIleValLysLeuPheAla-443 |
| SEQ. ID. NO. 21151 | 452-AlaGlnAsnAlaAlaGlnGlnThr-459 |
| SEQ. ID. NO. 21152 | 471-SerTyrValGluProGlu-476 |
| SEQ. ID. NO. 21153 | 478-ThrArgGluIleIleAspIle-484 |
| SEQ. ID. NO. 21154 | 489-AlaGluIleSerGluThrValAlaLysIleGluArgLeuArgArgGluIleAspGluValIleAlaGluIleGlu-513 |

Antigenic Index - Jameson-Wolf

| | |
|---|---|
| SEQ. ID. NO. 21155 | 5-IleGlnGlnArgAlaGlnLeu-11 |
| SEQ. ID. NO. 21156 | 18-IleAlaAspGluValArgGlyAlaValAspGlyTrpAsp-30 |
| SEQ. ID. NO. 21157 | 44-IleSerGluAsnPheThrAspTyrMetGlnAlaGlyAspSerSerIleAsp-60 |
| SEQ. ID. NO. 21158 | 63-AlaMetProAspSer-67 |
| SEQ. ID. NO. 21159 | 71-ProGluIleLysAspAspAlaValLysVal-80 |
| SEQ. ID. NO. 21160 | 98-AlaHisGlnAsnGluGluLeuAsnThrLysLeuGlu-110 |
| SEQ. ID. NO. 21161 | 116-GluSerSerAlaSerGlyTyrProSerGluGlnAspIleLysGlyLeuPheAspAspPheAspThrThrSerSerArgLeu-142 |
| SEQ. ID. NO. 21162 | 146-ValAlaAspLysAsnLysArgLeu-153 |
| SEQ. ID. NO. 21163 | 164-AspPheGlySerPheGluAspHisHis-172 |
| SEQ. ID. NO. 21164 | 190-AsnAlaGlyLysSerGlyGlyGluPhePheThr-200 |
| SEQ. ID. NO. 21165 | 215-GlyGlnGluLysValAsnLysIleTyrAspProAlaCysGlySerGlySer-231 |
| SEQ. ID. NO. 21166 | 235-GlnAlaLysLysGlnPheAsp-241 |
| SEQ. ID. NO. 21167 | 253-GluIleAsnHisThrThrTyrAsn-260 |
| SEQ. ID. NO. 21168 | 280-LeuGlyAspThrLeuThrAsnProLysLeuLysAspSerLysProPheAspAla-297 |
| SEQ. ID. NO. 21169 | 310-GlySerGlyAspProThrLeuIleAsnAspAspArgPheAlaPro-324 |
| SEQ. ID. NO. 21170 | 330-ProLysSerLysAlaAsp-335 |
| SEQ. ID. NO. 21171 | 345-TyrLeuSerLeuGlyArgGlyArgAlaAla-353 |
| SEQ. ID. NO. 21172 | 362-TyrArgGlyGlyAlaGluGlnLysIleArg-371 |
| SEQ. ID. NO. 21173 | 403-LeuSerLysHisLysAspAsnThrAsp-411 |
| SEQ. ID. NO. 21174 | 418-GlyGlyPhePheLysLysGluThrAsnAsnAsnValLeuThrGluGluHisIle-435 |
| SEQ. ID. NO. 21175 | 442-PheAlaAspLysAlaAspVal-448 |
| SEQ. ID. NO. 21176 | 458-GlnThrValLysAspAsnGlyTyr-465 |
| SEQ. ID. NO. 21177 | 473-ValGluProGluAspThrArgGluIleIleAsp-483 |
| SEQ. ID. NO. 21178 | 490-GluIleSerGluThrValAlaLysIleGluArgLeuArgArgGluIleAspGluValIleAla-510 |

Hydrophilic Regions - Hopp-Woods

| | |
|---|---|
| SEQ. ID. NO. 21179 | 18-IleAlaAspGluValArgGlyAlaValAsp-27 |
| SEQ. ID. NO. 21180 | 55-GlyAspSerSerIle-59 |
| SEQ. ID. NO. 21181 | 71-ProGluIleLysAspAspAlaValLysVal-80 |

TABLE 1-continued

| SEQ. ID. NO. 21182 | 98-AlaHisGlnAsnGluGluLeuAsnThrLysLeuLysGlu-110 |
| --- | --- |
| SEQ. ID. NO. 21183 | 122-TyrProSerGluGlnAspIleLysGlyLeuPheAspAspPheAspThrThrSerSerArgLeu-142 |
| SEQ. ID. NO. 21184 | 146-ValAlaAspLysAsnLysArgLeu-153 |
| SEQ. ID. NO. 21185 | 167-SerPheGluAspHisHis-172 |
| SEQ. ID. NO. 21186 | 191-AlaGlyLysSerGlyGly-196 |
| SEQ. ID. NO. 21187 | 215-GlyGlnGluLysValAsnLysIleTyrAsp-224 |
| SEQ. ID. NO. 21188 | 235-GlnAlaLysLysGlnPheAsp-241 |
| SEQ. ID. NO. 21189 | 287-ProLysLeuLysAspSerLysProPhe-295 |
| SEQ. ID. NO. 21190 | 316-LeuIleAsnAspAspArgPheAla-323 |
| SEQ. ID. NO. 21191 | 330-ProLysSerLysAlaAsp-335 |
| SEQ. ID. NO. 21192 | 348-GlyArgGlyArgAla-352 |
| SEQ. ID. NO. 21193 | 364-GlyGlyAlaGluGlnLysIleArg-371 |
| SEQ. ID. NO. 21194 | 404-SerLysHisLysAspAsnThrAsp-411 |
| SEQ. ID. NO. 21195 | 419-GlyPhePheLysLysGluThrAsn-426 |
| SEQ. ID. NO. 21196 | 430-LeuThrGluGluHisIle-435 |
| SEQ. ID. NO. 21197 | 442-PheAlaAspLysAlaAspVal-448 |
| SEQ. ID. NO. 21198 | 458-GlnThrValLysAspAsnGly-464 |
| SEQ. ID. NO. 21199 | 473-ValGluProGluAspThrArgGluIleIleAsp-483 |
| SEQ. ID. NO. 21200 | 490-GluIleSerGluThrValAlaLysIleGluArgLeuArgArgGluIleAspGluValIleAla-510 | a606
AMPHI Regions - AMPHI

| SEQ. ID. NO. 21201 | 72-LeuLeuAspHisMetThrArgAspGlu-80 |
| --- | --- |
| SEQ. ID. NO. 21202 | 90-AlaHisValGlyAsnGlyAsp-96 |
| SEQ. ID. NO. 21203 | 100-LeuThrLeuIleGlnGlyValValAsnThrPhe-110 |
| SEQ. ID. NO. 21204 | 116-ArgIleIleAlaAsn-120 |
| SEQ. ID. NO. 21205 | 139-SerMetValPheGlnIleLeuPheGlyPheLeuAlaSerLeuIleVal-154 |
| SEQ. ID. NO. 21206 | 171-LysLeuValGlyAlaProLysMetIleSerAlaLeuGlnArg-184 |
| SEQ. ID. NO. 21207 | 191-AspLeuProGluGluMetAsnAla-198 |

Antigenic Index - Jameson-Wolf

| SEQ. ID. NO. 21208 | 13-GluValIleAspThrProArgThrGluGluGluAla-24 |
| --- | --- |
| SEQ. ID. NO. 21209 | 31-GluAlaGlnAlaArgGlnTrpAsnLeuLysThrProGlu-43 |
| SEQ. ID. NO. 21210 | 48-HisSerProGluProAsnAla-54 |
| SEQ. ID. NO. 21211 | 57-ThrGlyAlaSerArgAsnSerSer-64 |
| SEQ. ID. NO. 21212 | 75-HisMetThrArgAspGluValGluAla-83 |
| SEQ. ID. NO. 21213 | 92-ValGlyAsnGlyAsp-96 |
| SEQ. ID. NO. 21214 | 122-IleAlaArgAsnAsnAspGlySerGlnSerGlnGlyThr-134 |
| SEQ. ID. NO. 21215 | 159-ArgGlnArgGluTyrArgAlaAspAlaGlyAla-169 |
| SEQ. ID. NO. 21216 | 182-LeuGlnArgLeuLysGlyAsnProValAspLeuProGluGluMetAsn-197 |
| SEQ. ID. NO. 21217 | 203-GlyAspThrArgAspSerLeuLeuSerThrHisProSerLeuAspAsnArgIleAlaArgLeuLysSer-225 |

Hydrophilic Regions - Hopp-Woods

| SEQ. ID. NO. 21218 | 13-GluValIleAspThrProArgThrGluGluGluAla-24 |
| --- | --- |
| SEQ. ID. NO. 21219 | 59-AlaSerArgAsnSer-63 |
| SEQ. ID. NO. 21220 | 75-HisMetThrArgAspGluValGluAla-83 |
| SEQ. ID. NO. 21221 | 124-ArgAsnAsnAspGlySerGlnSer-131 |
| SEQ. ID. NO. 21222 | 159-ArgGlnArgGluTyrArgAlaAspAlaGlyAla-169 |
| SEQ. ID. NO. 21223 | 183-GlnArgLeuLysGlyAsnPro-189 |
| SEQ. ID. NO. 21224 | 191-AspLeuProGluGluMetAsn-197 |
| SEQ. ID. NO. 21225 | 203-GlyAspThrArgAspSerLeu-209 |
| SEQ. ID. NO. 21226 | 214-ProSerLeuAspAsnArgIleAlaArgLeuLysSer-225 | a607
AMPHI Regions - AMPHI

| SEQ. ID. NO. 21227 | 18-ArgLeuLeuThrAlaLeuAlaLeu-25 |
| --- | --- |
| SEQ. ID. NO. 21228 | 70-PheMetGlyIleMetAlaAlaLeuAsnProMetIleAlaGln-83 |
| SEQ. ID. NO. 21229 | 90-ThrAspGluValGlyGluThr-96 |
| SEQ. ID. NO. 21230 | 104-GlyLeuPheLeuGlyValPheGlyMetValLeuMetTrpAlaAlaIleThrProPheArgAsnTrpLeuThrLeuSerAspTyrValGluGlyThrMet-136 |
| SEQ. ID. NO. 21231 | 151-MetValHisArgAlaLeuHisAlaTyrAlaSerSer-162 |
| SEQ. ID. NO. 21232 | 226-PhePheArgProPheGly-231 |
| SEQ. ID. NO. 21233 | 244-PheLysGlnIleTrpLysIleGlyAla-252 |
| SEQ. ID. NO. 21234 | 320-AlaArgTyrIleSerGlyValSerLeu-328 |
| SEQ. ID. NO. 21235 | 337-IleThrValLeuSerLeuVal-343 |
| SEQ. ID. NO. 21236 | 373-PheGlnProAlaAspPheThrGlnCysIleAlaSerTyrAla-386 |
| SEQ. ID. NO. 21237 | 424-TyrGlyPheTrpThrAlaLeuIleAla-432 |

Antigenic Index - Jameson-Wolf

| SEQ. ID. NO. 21238 | 15-LysGluValArgLeu-19 |
| --- | --- |
| SEQ. ID. NO. 21239 | 47-GlyAlaGlyLysGluAspLeuAla-54 |
| SEQ. ID. NO. 21240 | 86-GlyAlaGlyLysThrAspGluValGlyGluThrGlyArgGlnGlyIle-101 |
| SEQ. ID. NO. 21241 | 121-ProPheArgAsnTrp-125 |
| SEQ. ID. NO. 21242 | 128-LeuSerAspTyrValGluGlyThr-135 |
| SEQ. ID. NO. 21243 | 160-AlaSerSerLeuAsnArgProArgLeu-168 |
| SEQ. ID. NO. 21244 | 234-AlaLysPheGlyLysProAspTrp-241 |
| SEQ. ID. NO. 21245 | 311-SerLeuGlyArgArgGluPheSerArgAlaArgTyrIleSer-324 |
| SEQ. ID. NO. 21246 | 353-TyrAsnAsnAspPro-357 |
| SEQ. ID. NO. 21247 | 388-ArgGlyTyrLysValThrLys-394 |
| SEQ. ID. NO. 21248 | 447-LeuCysSerArgGluMetValArgSerHisLysAlaVal-459 |

Hydrophilic Regions - Hopp-Woods

| SEQ. ID. NO. 21249 | 15-LysGluValArgLeu-19 |
| --- | --- |
| SEQ. ID. NO. 21250 | 47-GlyAlaGlyLysGluAspLeuAla-54 |
| SEQ. ID. NO. 21251 | 88-GlyLysThrAspGluValGlyGluThrGlyArg-98 |
| SEQ. ID. NO. 21252 | 163-LeuAsnArgProArg-167 |

TABLE 1-continued

| | |
|---|---|
| SEQ. ID. NO. 21253 | 312-LeuGlyArgArgGluPheSerArg-319 |
| SEQ. ID. NO. 21254 | 390-TyrLysValThrLys-394 |
| SEQ. ID. NO. 21255 | 447-LeuCysSerArgGluMetValArgSerHisLysAlaVal-459 | a608
AMPHI Regions - AMPHI

| | |
|---|---|
| SEQ. ID. NO. 21256 | 66-AlaValGlnLysIleLeuGln-72 |
| SEQ. ID. NO. 21257 | 93-ValLeuSerLeuLeu-97 |
| SEQ. ID. NO. 21258 | 103-ArgAlaSerAspGluLeuAlaArgIlePheGlyThrGln-115 |
| SEQ. ID. NO. 21259 | 124-AspIleGlyHisGlyIleLysGlnIleGlyArgAsnIleAlaGluGlnIleGlyArgPheSerArgGluProGluSerAla-150 |
| SEQ. ID. NO. 21260 | 154-AsnGluAlaLeuAlaAspCysLeuAspGluIleSerArgLeuArgAspGlyValGluArgLeuAsnGluArgLeuAspArgLeu-181 |

Antigenic Index - Jameson-Wolf

| | |
|---|---|
| SEQ. ID. NO. 21261 | 13-LeuGlnSerProAspSerArgSerGluLeu-22 |
| SEQ. ID. NO. 21262 | 39-LeuAlaGlyArgIleThrGluAspGlyLeuLeuSerAlaGlyAsnGlyPheAlaAspThrGluIleThrPheArgAsnSerAla-66 |
| SEQ. ID. NO. 21263 | 71-LeuGlnGlyGlyGluProGlyAlaGlyAspIleGlyLeuGluGly-85 |
| SEQ. ID. NO. 21264 | 98-GlySerLeuArgSerArgAlaSerAspGluLeuAla-109 |
| SEQ. ID. NO. 21265 | 114-ThrGlnAlaAspIleGlySerArgAlaAlaAsp-124 |
| SEQ. ID. NO. 21266 | 131-GlnIleGlyArgAsnIleAla-137 |
| SEQ. ID. NO. 21267 | 139-GlnIleGlyArgPheSerArgGluProGluSerAlaAsnIleGlyAsn-154 |
| SEQ. ID. NO. 21268 | 156-AlaLeuAlaAspCysLeuAspGluIleSerArgLeuArgAspGlyValGluArgLeuAsnGluArgLeuAspArgLeuGluAspIleTrp-186 |

Hydrophilic Regions - Hopp-Woods

| | |
|---|---|
| SEQ. ID. NO. 21269 | 15-SerProAspSerArgSerGluLeu-22 |
| SEQ. ID. NO. 21270 | 39-LeuAlaGlyArgIleThrGluAspGlyLeu-48 |
| SEQ. ID. NO. 21271 | 56-AlaAspThrGluIleThrPhe-62 |
| SEQ. ID. NO. 21272 | 74-GlyGluProGlyAlaGly-79 |
| SEQ. ID. NO. 21273 | 81-IleGlyLeuGluGly-85 |
| SEQ. ID. NO. 21274 | 100-LeuArgSerArgAlaSerAspGluLeuAla-109 |
| SEQ. ID. NO. 21275 | 116-AlaAspIleGlySerArgAlaAlaAsp-124 |
| SEQ. ID. NO. 21276 | 139-GlnIleGlyArgPheSerArgGluProGluSerAlaAsnIleGly-153 |
| SEQ. ID. NO. 21277 | 156-AlaLeuAlaAspCysLeuAspGluIleSerArgLeuArgAspGlyValGluArgLeuAsnGluArgLeuAspArgLeuGluAspIleTrp-186 | a609
AMPHI Regions - AMPHI

| | |
|---|---|
| SEQ. ID. NO. 21278 | 15-ThrLeuAspAlaPheVal-20 |
| SEQ. ID. NO. 21279 | 30-HisHisIlePheHisGluPheArgValPheValGlyPhePhe-43 |
| SEQ. ID. NO. 21280 | 52-PheGluGlnAlaValGlu-57 |
| SEQ. ID. NO. 21281 | 67-IleAspAspPheLeu-71 |
| SEQ. ID. NO. 21282 | 114-ValAlaValCysThrVal-119 |

Antigenic Index - Jameson-Wolf

| | |
|---|---|
| SEQ. ID. NO. 21283 | 10-AlaLeuAspAspGluThrLeu-16 |
| SEQ. ID. NO. 21284 | 20-ValGlyAsnGlnArgSerSerAspIleAla-29 |
| SEQ. ID. NO. 21285 | 69-AspPheLeuAspThrAspPheGlyIle-77 |
| SEQ. ID. NO. 21286 | 79-SerGlnAlaAspGlyAsnValArg-86 |
| SEQ. ID. NO. 21287 | 99-GlyThrArgAlaLysArgGlyTyrGlyAsnHisAspLeu-111 |
| SEQ. ID. NO. 21288 | 124-ArgGluAlaAspIle-128 |

Hydrophilic Regions - Hopp-Woods

| | |
|---|---|
| SEQ. ID. NO. 21289 | 10-AlaLeuAspAspGluThrLeu-16 |
| SEQ. ID. NO. 21290 | 23-GlnArgSerSerAspIle-28 |
| SEQ. ID. NO. 21291 | 79-SerGlnAlaAspGlyAsnVal-85 |
| SEQ. ID. NO. 21292 | 100-ThrArgAlaLysArgGlyTyrGly-107 |
| SEQ. ID. NO. 21293 | 124-ArgGluAlaAspIle-128 | a610
AMPHI Regions - AMPHI

| | |
|---|---|
| SEQ. ID. NO. 21294 | 6-MetGlnPheProTyr-10 |
| SEQ. ID. NO. 21295 | 14-SerAlaSerArgMetArgArgMetArgArg-23 |
| SEQ. ID. NO. 21296 | 98-GluArgAlaGlnGluAlaTyr-104 |
| SEQ. ID. NO. 21297 | 111-ProSerThrValArgAlaLeuArgGluArg-120 |
| SEQ. ID. NO. 21298 | 187-IleArgGluAlaLeuGlu-192 |
| SEQ. ID. NO. 21299 | 208-TyrAlaSerAlaPheTyrGlyProPheArgAsp-218 |
| SEQ. ID. NO. 21300 | 223-SerGlyAsnLeuGlyLysAlaAsp-230 |
| SEQ. ID. NO. 21301 | 268-LeuAspValValArgArgValLysAspGlu-277 |
| SEQ. ID. NO. 21302 | 296-AlaAlaValAlaAsn-300 |

Antigenic Index - Jameson-Wolf

| | |
|---|---|
| SEQ. ID. NO. 21303 | 11-ArgAsnValSerAlaSerArgMetArgArgMetArgArgAspAspPheSerArgArgLeuMetArgGluHisThrLeuThrAlaAspAsp-40 |
| SEQ. ID. NO. 21304 | 50-GlySerAlaArgGluGluAspValProSerMetProGlyValLysArgGlnSerLeuAsp-69 |
| SEQ. ID. NO. 21305 | 75-AlaGluGluAlaValLys-80 |
| SEQ. ID. NO. 21306 | 94-AlaAsnLysThrGluArgAlaGlnGluAlaTyrAsnProGluGlyLeuVal-110 |
| SEQ. ID. NO. 21307 | 115-ArgAlaLeuArgGluArgPhePro-122 |
| SEQ. ID. NO. 21308 | 139-GlyGlnAspGlyLeuThrAspGluAsnGlyTyrValMetAsnAspGluThrVal-156 |
| SEQ. ID. NO. 21309 | 175-AlaProSerAspMetMetAspGlyArgIleGlyAlaIleArgGluAlaLeuGluAspAlaGlyHis-196 |
| SEQ. ID. NO. 21310 | 215-ProPheArgAspAlaValGlySerSerGlyAsnLeuGlyLysAlaAspLysLysThrTyrGlnMetAspProAlaAsnThrAspGluAlaLeuHis-246 |
| SEQ. ID. NO. 21311 | 250-LeuAspIleGlnGluGlyAlaAsp-257 |
| SEQ. ID. NO. 21312 | 270-ValValArgArgValLysAspGluPheGlyVal-280 |
| SEQ. ID. NO. 21313 | 302-TrpLeuAspGlyGlyLysValVal-309 |
| SEQ. ID. NO. 21314 | 317-LysArgAlaGlyAlaAspGly-323 |
| SEQ. ID. NO. 21315 | 331-GluAlaAlaLysMetLeuLysArg-338 |

Hydrophilic Regions - Hopp-Woods

| | |
|---|---|
| SEQ. ID. NO. 21316 | 14-SerAlaSerArgMetArgArgMetArgArgAspAspPheSerArgArgLeuMetArgGluHisThrLeuThrAla-38 |
| SEQ. ID. NO. 21317 | 50-GlySerAlaArgGluGluAspValProSer-59 |
| SEQ. ID. NO. 21318 | 61-ProGlyValLysArgGlnSerLeuAsp-69 |
| SEQ. ID. NO. 21319 | 75-AlaGluGluAlaValLys-80 |
| SEQ. ID. NO. 21320 | 95-AsnLysThrGluArgAlaGlnGluAlaTyrAsn-105 |

TABLE 1-continued

| SEQ. ID. NO. 21321 | 115-ArgAlaLeuArgGluArgPhePro-122 |
| --- | --- |
| SEQ. ID. NO. 21322 | 141-AspGlyLeuThrAspGluAsnGly-148 |
| SEQ. ID. NO. 21323 | 151-MetAsnAspGluThrVal-156 |
| SEQ. ID. NO. 21324 | 178-AspMetMetAspGlyArgIleGlyAlaIleArgGluAlaLeuGluAspAlaGly-195 |
| SEQ. ID. NO. 21325 | 216-PheArgAspAlaValGly-221 |
| SEQ. ID. NO. 21326 | 225-AsnLeuGlyLysAlaAspLysLysThrTyrGln-235 |
| SEQ. ID. NO. 21327 | 238-ProAlaAsnThrAspGluAlaLeuHis-246 |
| SEQ. ID. NO. 21328 | 250-LeuAspIleGlnGluGlyAlaAsp-257 |
| SEQ. ID. NO. 21329 | 270-ValValArgArgValLysAspGluPheGly-279 |
| SEQ. ID. NO. 21330 | 317-LysAlaGlyAla-321 |
| SEQ. ID. NO. 21331 | 331-GluAlaAlaLysMetLeuLysArg-338 | a611
AMPHI Regions - AMPHI

| SEQ. ID. NO. 21332 | 15-CysArgLeuPheGlyLysLeuSerLeu-23 |
| --- | --- |
| SEQ. ID. NO. 21333 | 26-ArgLeuLeuLeuGlyLeu-31 |
| SEQ. ID. NO. 21334 | 48-ArgSerValArgArgValIle-54 |
| SEQ. ID. NO. 21335 | 63-GlnValValAlaVal-67 |
| SEQ. ID. NO. 21336 | 104-ValPheIleGluAspPheVal-110 |
| SEQ. ID. NO. 21337 | 129-LeuGlyPheLeuGlyAsnValLeuArgThr-138 |

Antigenic Index - Jameson-Wolf

| SEQ. ID. NO. 21338 | 1-MetProSerGluAsnArgMetGlyLysArgGlnLeuAla-13 |
| --- | --- |
| SEQ. ID. NO. 21339 | 32-CysArgSerGlyValCysArgGlyArgCys-41 |
| SEQ. ID. NO. 21340 | 45-PheProSerArgSerValArgArgValIlePheArgArgValArgIle-60 |
| SEQ. ID. NO. 21341 | 119-AsnProAlaAspPheArgIle-125 |
| SEQ. ID. NO. 21342 | 142-AlaSerGlnGluAsp-146 |

Hydrophilic Regions - Hopp-Woods

| SEQ. ID. NO. 21343 | 1-MetProSerGluAsnArgMetGlyLysArgGlnLeuAla-13 |
| --- | --- |
| SEQ. ID. NO. 21344 | 35-GlyValCysArgGlyArgCys-41 |
| SEQ. ID. NO. 21345 | 53-ValIlePheArgArgValArgIle-60 |
| SEQ. ID. NO. 21346 | 121-AlaAspPheArgIle-125 |
| SEQ. ID. NO. 21347 | 142-AlaSerGlnGluAsp-146 | a612
AMPHI Regions - AMPHI

| SEQ. ID. NO. 21348 | 6-AsnIleAlaLysLysLeuAlaGlyVal-14 |
| --- | --- |
| SEQ. ID. NO. 21349 | 55-AlaAspLysAlaValGluLysCysAlaGluAsnValLeu-67 |
| SEQ. ID. NO. 21350 | 81-GlyAsnPheProAsn-85 |
| SEQ. ID. NO. 21351 | 101-AsnProTyrXxxLysLeuAsnLysSerLysLysSerProAspIlePheArgArgPhePheXxxGlyHisSer-123 |

Antigenic Index - Jameson-Wolf

| SEQ. ID. NO. 21352 | 7-IleAlaLysLysLeuAlaGlyValAsp-15 |
| --- | --- |
| SEQ. ID. NO. 21353 | 17-IleAlaPheAspPheAspGly-23 |
| SEQ. ID. NO. 21354 | 27-AspPheGlyArgAspAspAlaValArgHisSerGlyVal-39 |
| SEQ. ID. NO. 21355 | 57-LysAlaValGluLysCysAlaGlu-64 |
| SEQ. ID. NO. 21356 | 97-GlyHisHisArgAsnProTyrXxxLysLeuAsnLysSerLysSerProAspIlePheArg-116 |

Hydrophilic Regions - Hopp-Woods

| SEQ. ID. NO. 21357 | 7-IleAlaLysLysLeuAlaGlyValAsp-15 |
| --- | --- |
| SEQ. ID. NO. 21358 | 28-PheGlyArgAspAspAlaValArg-35 |
| SEQ. ID. NO. 21359 | 57-LysAlaValGluLysCysAlaGlu-64 |
| SEQ. ID. NO. 21360 | 105-LysLeuAsnLysSerLysSerProAspIlePhe-115 | a613
AMPHI Regions - AMPHI

| SEQ. ID. NO. 21361 | 7-SerArgArgSerLeu-11 |
| --- | --- |
| SEQ. ID. NO. 21362 | 95-MetProArgMetArgSer-100 |
| SEQ. ID. NO. 21363 | 103-SerProMetSerProAla-108 |
| SEQ. ID. NO. 21364 | 115-ArgIlePheCysThrAlaLeuLeuArgLys-124 |
| SEQ. ID. NO. 21365 | 140-SerSerValMetArgPro-145 |
| SEQ. ID. NO. 21366 | 168-LeuSerGlyLeuCysArgIle-174 |

Antigenic Index - Jameson-Wolf

| SEQ. ID. NO. 21367 | 1-MetSerArgSerSerArgSerArgArgSerLeuArgArgSerThrProSerArg-18 |
| --- | --- |
| SEQ. ID. NO. 21368 | 23-SerSerArgGlnSerAlaArgAla-30 |
| SEQ. ID. NO. 21369 | 35-PheAlaAspSerGlySerArgGluAsnLeu-44 |
| SEQ. ID. NO. 21370 | 73-ProLysIleArgAlaAsnSerSerAspAlaArgGluArgArgLeuProSerArgAspSerThrAla-94 |
| SEQ. ID. NO. 21371 | 96-ProArgMetArgSerProSerSerProMetSerProAlaProGlySerProProTrp-114 |
| SEQ. ID. NO. 21372 | 130-AlaLysProPheProAlaGluSerLysProSerSerValMetArgProAlaSer-147 |
| SEQ. ID. NO. 21373 | 161-LysAlaAlaSerSerGluArgLeuSerGlyLeuCysArgIleArgArg-176 |
| SEQ. ID. NO. 21374 | 178-MetMetGlyArgArgAlaAspIlePheSerAspArgGlyGlyGlu-192 |

Hydrophilic Regions - Hopp-Woods

| SEQ. ID. NO. 21375 | 1-MetSerArgSerSerArgSerArgArgSerLeuArgArgSerThrProSer-17 |
| --- | --- |
| SEQ. ID. NO. 21376 | 24-SerArgGlnSerAlaArgAla-30 |
| SEQ. ID. NO. 21377 | 38-SerGlySerArgGluAsnLeu-44 |
| SEQ. ID. NO. 21378 | 73-ProLysIleArgAlaAsnSerSerAspAlaArgGluArgArgLeuProSerArgAspSerThrAla-94 |
| SEQ. ID. NO. 21379 | 96-ProArgMetArgSerProSer-102 |
| SEQ. ID. NO. 21380 | 133-PheProAlaGluSerLysProSerSerValMetArg-144 |
| SEQ. ID. NO. 21381 | 161-LysAlaAlaSerSerGluArgLeuSerGly-170 |
| SEQ. ID. NO. 21382 | 172-CysArgIleArgArg-176 |
| SEQ. ID. NO. 21383 | 178-MetMetGlyArgArgAlaAspIlePheSerAspArgGlyGlyGlu-192 | a614
AMPHI Regions - AMPHI

| SEQ. ID. NO. 21384 | 20-SerGlnPheIleGlnGlnVal-26 |
| --- | --- |
| SEQ. ID. NO. 21385 | 65-AsnLeuIleLysThrLeuLeuAsp-72 |
| SEQ. ID. NO. 21386 | 90-AlaLeuPheTyrSerLeuLeuProValLeu-99 |

TABLE 1-continued

| | |
|---|---|
| SEQ. ID. NO. 21387 | 144-ValAlaGlyCysAspGluAlaLysGluGluValGlnGluIleValAspTyrLeuLysAlaProAsnArgTyrGlnSerLeu-170 |
| SEQ. ID. NO. 21388 | 210-AspPheValGluMetPheVal-216 |
| SEQ. ID. NO. 21389 | 222-ArgValArgAspMetPheGluGln-229 |
| SEQ. ID. NO. 21390 | 242-GluIleAspAlaValGlyArg-248 |
| SEQ. ID. NO. 21391 | 295-ProAlaLeuGlnArgProGlyArgPheAsp-304 |
| SEQ. ID. NO. 21392 | 333-SerValAspLeuLeuSerLeuAla-340 |
| SEQ. ID. NO. 21393 | 349-AlaAspLeuAlaAsnLeuValAsn-356 |
| Antigenic Index - Jameson-Wolf | |
| SEQ. ID. NO. 21394 | 7-LeuAspGlyLysLysGluAspAsnGlyGlnIleGlu-18 |
| SEQ. ID. NO. 21395 | 26-ValAsnAsnGlyGluValSerGly-33 |
| SEQ. ID. NO. 21396 | 45-LeuIleLysGlyGluArgThrAspLysSerThrPhe-56 |
| SEQ. ID. NO. 21397 | 60-AlaProLeuAspAspAsnLeuIle-67 |
| SEQ. ID. NO. 21398 | 70-LeuLeuAspLysAsnValArgValLysValThrProGluGluLysProSerAla-87 |
| SEQ. ID. NO. 21399 | 111-MetGlnThrGlyGlyGlyGlyLysGlyGly-120 |
| SEQ. ID. NO. 21400 | 123-SerPheGlyLysSerArgAlaArgLeuLeuAspLysAspAlaAsnLys-138 |
| SEQ. ID. NO. 21401 | 145-AlaGlyCysAspGluAlaLysGluGluValGlnGlu-156 |
| SEQ. ID. NO. 21402 | 161-LeuLysAlaProAsnArgTyrGlnSerLeuGlyValArgValProArgGly-177 |
| SEQ. ID. NO. 21403 | 182-GlySerProGlyThrGlyLysThrLeuLeu-191 |
| SEQ. ID. NO. 21404 | 207-SerGlySerAspPhe-211 |
| SEQ. ID. NO. 21405 | 219-GlyAlaSerArgValArgAspMetPheGluGlnAlaLysLysAsnAla-234 |
| SEQ. ID. NO. 21406 | 241-AspGluIleAspAlaValGlyArgGlnArgGlyAlaGlyLeuGlyGlyGlyAsnAspGluArgGluGlnThrLeu-265 |
| SEQ. ID. NO. 21407 | 272-MetAspGlyPheGluSerAsnGln-279 |
| SEQ. ID. NO. 21408 | 287-ThrAsnArgProAspValLeuAspProAlaLeuGlnArgProGlyArgPheAspArg-305 |
| SEQ. ID. NO. 21409 | 311-LeuProAspIleArgGlyArgGluGlnIle-320 |
| SEQ. ID. NO. 21410 | 323-ValHisSerLysLysValProLeuAspLysSerValAsp-335 |
| SEQ. ID. NO. 21411 | 341-ArgGlyThrProGlyPheSerGly-348 |
| SEQ. ID. NO. 21412 | 362-AlaGlyArgArgAsnLysValLysValAspGlnSerAspLeuLysThrProLysThrLysSer-382 |
| Hydrophilic Regions - Hopp-Woods | |
| SEQ. ID. NO. 21413 | 7-LeuAspGlyLysLysGluAspAsnGlyGln-16 |
| SEQ. ID. NO. 21414 | 27-AsnAsnGlyGluValSer-32 |
| SEQ. ID. NO. 21415 | 46-IleLysGlyGluArgThrAspLysSerThr-55 |
| SEQ. ID. NO. 21416 | 61-ProLeuAspAspAsnLeuIle-67 |
| SEQ. ID. NO. 21417 | 70-LeuLeuAspLysAsnValArgValLysValThrProGluGluLysProSer-86 |
| SEQ. ID. NO. 21418 | 125-GlyLysSerArgAlaArgLeuLeuAspLysAspAlaAsnLys-138 |
| SEQ. ID. NO. 21419 | 145-AlaGlyCysAspGluAlaLysGluGluValGlnGlu-156 |
| SEQ. ID. NO. 21420 | 162-LysAlaProAsnArg-166 |
| SEQ. ID. NO. 21421 | 171-GlyGlyArgValProArg-176 |
| SEQ. ID. NO. 21422 | 221-SerArgValArgAspMetPheGluGlnAlaLysLysAsnAla-234 |
| SEQ. ID. NO. 21423 | 241-AspGluIleAspAlaValGlyArgGlnArgGlyAlaGly-253 |
| SEQ. ID. NO. 21424 | 256-GlyGlyAsnAspGluArgGluGlnThr-264 |
| SEQ. ID. NO. 21425 | 273-AspGlyPheGluSer-277 |
| SEQ. ID. NO. 21426 | 287-ThrAsnArgProAspValLeuAsp-294 |
| SEQ. ID. NO. 21427 | 296-AlaLeuGlnArgProGlyArgPheAspArg-305 |
| SEQ. ID. NO. 21428 | 312-ProAspIleArgGlyArgGluGlnIle-320 |
| SEQ. ID. NO. 21429 | 324-HisSerLysLysValProLeuAspLysSerValAsp-335 |
| SEQ. ID. NO. 21430 | 362-AlaGlyArgArgAsnLysValLysValAspGlnSerAspLeuLysThrProLysThrLys-381 |
| a616 | |
| AMPHI Regions - AMPHI | |
| SEQ. ID. NO. 21431 | 6-LysMetValValGlyLeu-11 |
| SEQ. ID. NO. 21432 | 13-AsnProGlyLysGluTyrGlu-19 |
| SEQ. ID. NO. 21433 | 48-PheGlyGluValAlaArgAla-54 |
| SEQ. ID. NO. 21434 | 77-ValAlaAlaLeuAlaGlnPheTyrLys-85 |
| SEQ. ID. NO. 21435 | 115-GlyHisAsnGlyLeuLysAspIle-122 |
| SEQ. ID. NO. 21436 | 161-ProThrAspArgCysArgArgGlnIlePro-170 |
| SEQ. ID. NO. 21437 | 174-ThrArgHisProCysArgGlnMetArgGly-183 |
| SEQ. ID. NO. 21438 | 201-ThrAlaCysSerArgPheProTyr-208 |
| SEQ. ID. NO. 21439 | 265-AlaProValGlnAsnLeuProAsnValAla-274 |
| SEQ. ID. NO. 21440 | 297-GlyGlyIleTyrSerLeuLeuPhe-304 |
| SEQ. ID. NO. 21441 | 317-PheAspLysAlaAla-321 |
| SEQ. ID. NO. 21442 | 355-CysPheAlaLeuPheSerGluCysAlaGlnAlaPhe-366 |
| SEQ. ID. NO. 21443 | 368-AlaThrArgThrGlySerLeuGlyAspValLeuAlaAspMetAlaGlyThrValLeu-386 |
| Antigenic Index - Jameson-Wolf | |
| SEQ. ID. NO. 21444 | 11-LeuGlyAsnProGlyLysGluTyrGluGlnThrArgHisAsnAlaGlyPhe-27 |
| SEQ. ID. NO. 21445 | 39-AlaSerPheLysGluGluLysLysPhePhe-48 |
| SEQ. ID. NO. 21446 | 51-ValAlaArgAlaThrLeuProAspGlyAsp-60 |
| SEQ. ID. NO. 21447 | 65-LysProThrThrPheMetAsnArgSerGlyGlnAla-76 |
| SEQ. ID. NO. 21448 | 86-IleLysProGluGlu-90 |
| SEQ. ID. NO. 21449 | 96-AspGluLeuAspIleProCysGlyArgIleLysPhe-107 |
| SEQ. ID. NO. 21450 | 109-LeuGlyGlyGlyAsnGlyHisAsnGlyLeuLysAspIleGlnAla-124 |
| SEQ. ID. NO. 21451 | 127-GlyThrAlaAspTyrTyrArg-133 |
| SEQ. ID. NO. 21452 | 138-IleGlyHisProGlyAspArgAsnLeu-146 |
| SEQ. ID. NO. 21453 | 152-LeuAsnLysProSerThrGluXxxProProThrAspArgCysArgArgGlnIleProAlaSerHisThrArgHisProCysArgGlnMetArgGlyAsnProLeuPro-187 |
| SEQ. ID. NO. 21454 | 190-GlnMetThrArgCysArgLeuLysProPheGlnThrAlaCysSerArgPheProTyrProAsnSerHisAspArgThrGlnAla-217 |
| SEQ. ID. NO. 21455 | 219-TyrProAsnArgIleHisProArgHisArgArgAsnProArgPheProAla-235 |
| SEQ. ID. NO. 21456 | 238-MetGlnHisArgArgThrIleArgArgArgSerGlyThrMetAlaArgHisThrCysArgThrArgArgGlnIlePro-264 |
| SEQ. ID. NO. 21457 | 266-ProValGlnAsnLeuProAsnValAlaGlyArgGlyGlyGlyMetLysLeuProArgAsnArgPheSer-288 |
| SEQ. ID. NO. 21458 | 306-AlaAlaAspThrAlaProProProPheProHisPheAspLysAlaAla-321 |
| SEQ. ID. NO. 21459 | 336-AlaPheLysThrGlyLysLeuProIle-344 |

TABLE 1-continued

| SEQ. ID. NO. 21460 | 368-AlaThrArgThrGlySerLeuGly-375 |

| SEQ. ID. NO. 21461 | 392-ArgAlaAlaAspArgProAsp-398 |

Hydrophilic Regions - Hopp-Woods

| SEQ. ID. NO. 21462 | 13-AsnProGlyLysGluTyrGluGlnThrArgHis-23 |
| SEQ. ID. NO. 21463 | 39-AlaSerPheLysGluGluLysLysPhePhe-48 |
| SEQ. ID. NO. 21464 | 86-IleLysProGluGlu-90 |
| SEQ. ID. NO. 21465 | 96-AspGluLeuAspIleProCysGlyArgIleLysPhe-107 |
| SEQ. ID. NO. 21466 | 117-AsnGlyLeuLysAspIleGlnAla-124 |
| SEQ. ID. NO. 21467 | 140-HisProGlyAspArgAsnLeu-146 |
| SEQ. ID. NO. 21468 | 155-ProSerThrGluXxxProProThrAspArgCysArgArgGlnIlePro-170 |
| SEQ. ID. NO. 21469 | 172-SerHisThrArgHisProCysArgGlnMetArgGlyAsnPro-185 |
| SEQ. ID. NO. 21470 | 190-GlnMetThrArgCysArgLeuLysPro-198 |
| SEQ. ID. NO. 21471 | 210-AsnSerHisAspArgThrGln-216 |
| SEQ. ID. NO. 21472 | 223-IleHisProArgHisArgArgAsnProArg-232 |
| SEQ. ID. NO. 21473 | 238-MetGlnHisArgArgArgThrIleArgArgArgSerGlyThrMet-252 |
| SEQ. ID. NO. 21474 | 255-HisThrCysArgThrArgArgGlnIle-263 |
| SEQ. ID. NO. 21475 | 274-AlaGlyArgGlyGlyGly-279 |
| SEQ. ID. NO. 21476 | 281-LysLeuProArgAsnArgPhe-287 |
| SEQ. ID. NO. 21477 | 306-AlaAlaAspThrAla-310 |
| SEQ. ID. NO. 21478 | 316-HisPheAspLysAlaAla-321 |
| SEQ. ID. NO. 21479 | 336-AlaPheLysThrGlyLys-341 |
| SEQ. ID. NO. 21480 | 392-ArgAlaAlaAspArgProAsp-398 | a619
AMPHI Regions - AMPHI

| SEQ. ID. NO. 21481 | 50-LysLeuAlaAlaLeuLeu-55 |
| SEQ. ID. NO. 21482 | 66-GlnLeuPheGlnThrLeuThrAsn-73 |
| SEQ. ID. NO. 21483 | 134-GlnGlyGlyArgAspLeu-139 |
| SEQ. ID. NO. 21484 | 146-GlyValIlePheGlyIleLeuPheArgSerLeuSerSerLeuLeuSerArg-162 |
| SEQ. ID. NO. 21485 | 165-AspProGluGluPhe-169 |
| SEQ. ID. NO. 21486 | 175-AsnMetPheAlaGlyPheAsnThrValHisSer-185 |
| SEQ. ID. NO. 21487 | 246-AlaValValGlyProValSerPhePheGlyLeuLeuAlaAlaSerLeuAlaAsnHisPheSer-266 |
| SEQ. ID. NO. 21488 | 303-LeuSerValValValGluPhe-309 |

Antigenic Index - Jameson-Wolf

| SEQ. ID. NO. 21489 | 1-MetProSerGluLysAsnIle-7 |
| SEQ. ID. NO. 21490 | 11-AlaGlySerSerArgPro-16 |
| SEQ. ID. NO. 21491 | 35-AsnValLysGlyAspTrpAsp-41 |
| SEQ. ID. NO. 21492 | 132-IleLysGlnGlyGlyArgAspLeuPro-140 |
| SEQ. ID. NO. 21493 | 163-MetIleAspProGluGluPheThr-170 |
| SEQ. ID. NO. 21494 | 203-TrpArgGluArgTyrArgLeu-209 |
| SEQ. ID. NO. 21495 | 213-LeuLeuGlyArgAspGlnAla-219 |
| SEQ. ID. NO. 21496 | 265-PheSerProSerValLysHisSerVal-273 |

Hydrophilic Regions - Hopp-Woods

| SEQ. ID. NO. 21497 | 1-MetProSerGluLysAsnIle-7 |
| SEQ. ID. NO. 21498 | 134-GlnGlyGlyArgAspLeuPro-140 |
| SEQ. ID. NO. 21499 | 163-MetIleAspProGluGluPheThr-170 |
| SEQ. ID. NO. 21500 | 203-TrpArgGluArgTyrArgLeu-209 |
| SEQ. ID. NO. 21501 | 213-LeuLeuGlyArgAspGlnAla-219 |
| SEQ. ID. NO. 21502 | 269-ValLysHisSerVal-273 | a620
AMPHI Regions - AMPHI

| SEQ. ID. NO. 21503 | 9-ValAlaValSerAlaLeuSerAlaCysArgGlnAla-20 |
| SEQ. ID. NO. 21504 | 31-IleSerAspArgSerVal-36 |
| SEQ. ID. NO. 21505 | 67-SerThrIleLysGlnMetPheGlyTyrThrLysLeuProGluGluProLysGlyIleArgValIleTyrValThrAspMetGlyAsnValThrAspTrpThr-100 |
| SEQ. ID. NO. 21506 | 139-GlnAlaGluLysPhe-143 |

Antigenic Index - Jameson-Wolf

| SEQ. ID. NO. 21507 | 15-SerAlaCysArgGlnAlaGluGluGlyProProProLeuProArgGlnIleSerAspArgSerValGlyHis-38 |
| SEQ. ID. NO. 21508 | 43-AsnLeuThrGluHisAsnGlyProLysAla-52 |
| SEQ. ID. NO. 21509 | 57-AsnGlyLysProAspGlnProVal-64 |
| SEQ. ID. NO. 21510 | 75-TyrThrLysLeuProGluGluProLysGlyIle-85 |
| SEQ. ID. NO. 21511 | 97-ThrAspTrpThrAsnProAsnAlaAspThrGluTrpMetAspAlaLysLys-113 |
| SEQ. ID. NO. 21512 | 125-GlyMetGlyAlaGluAspAlaLeuProPheGlyAsnLysGluGlnAlaGluLysPheAlaLysAspLysGlyGlyLysValValGlyPheAspAspMetProAspThrTyr-161 |

Hydrophilic Regions - Hopp-Woods

| SEQ. ID. NO. 21513 | 18-ArgGlnAlaGluGluGlyProProProLeu-27 |
| SEQ. ID. NO. 21514 | 30-GlnIleSerAspArgSerVal-36 |
| SEQ. ID. NO. 21515 | 46-GluHisAsnGlyProLys-51 |
| SEQ. ID. NO. 21516 | 58-GlyLysProAspGln-62 |
| SEQ. ID. NO. 21517 | 77-LysLeuProGluGluProLysGlyIle-85 |
| SEQ. ID. NO. 21518 | 103-AsnAlaAspThrGluTrpMetAspAlaLysLys-113 |
| SEQ. ID. NO. 21519 | 127-GlyAlaGluAspAlaLeu-132 |
| SEQ. ID. NO. 21520 | 135-GlyAsnLysGluGlnAlaGluLysPheAlaLysAspLysGlyGlyLys-150 |
| SEQ. ID. NO. 21521 | 155-AspAspMetProAsp-159 | a622
AMPHI Regions - AMPHI

| SEQ. ID. NO. 21522 | 28-LeuProGluAlaValArgAsnLeuAlaArg-37 |
| SEQ. ID. NO. 21523 | 62-GluGluIleIleArgTrpLeuAlaAsp-70 |
| SEQ. ID. NO. 21524 | 112-IleLeuGlyGlnIleLysAspAlaValArgValAlaGln-124 |
| SEQ. ID. NO. 21525 | 131-LysLysLeuAsnAlaLeuPheGlnLys-139 |
| SEQ. ID. NO. 21526 | 142-SerValAlaLysGluVal-147 |

TABLE 1-continued

| | |
|---|---|
| SEQ. ID. NO. 21527 | 169-GluGlnIlePheProAspIleGlyAsp-177 |
| SEQ. ID. NO. 21528 | 187-GluMetIleGluLeuValAla-193 |
| SEQ. ID. NO. 21529 | 214-AlaGlnGluLeuCysAspLys-220 |
| SEQ. ID. NO. 21530 | 232-AspLeuProAlaIleLeuHis-238 |
| SEQ. ID. NO. 21531 | 288-AspLeuAsnAspAla-292 |
| SEQ. ID. NO. 21532 | 297-ValAspAspMetValAsnIleValGlnSerGly-307 |
| SEQ. ID. NO. 21533 | 324-GluLysValAlaGluPheValArgGlnGln-333 |
| SEQ. ID. NO. 21534 | 345-LeuArgAspGluGlyGluLys-351 |
| SEQ. ID. NO. 21535 | 354-LysGlnValLeuGluAsnAlaMetLysGlnLeuAlaLys-366 |
| SEQ. ID. NO. 21536 | 384-LysLeuLeuHisSerProThrGlnThrLeuAsnLysAlaGlyGlu-398 |
| Antigenic Index - Jameson-Wolf | |
| SEQ. ID. NO. 21537 | 16-SerIleArgGluLysLeuAla-22 |
| SEQ. ID. NO. 21538 | 30-GluAlaValArgAsnLeuAlaArgSerAsnAlaAla-41 |
| SEQ. ID. NO. 21539 | 49-ThrCysAsnArgThrGlu-54 |
| SEQ. ID. NO. 21540 | 57-CysValGlyAspSerGluGluIleIle-65 |
| SEQ. ID. NO. 21541 | 75-ProIleGluGluIleSerProTyrLeu-83 |
| SEQ. ID. NO. 21542 | 90-GluThrValArgHis-94 |
| SEQ. ID. NO. 21543 | 115-GlnIleLysAspAlaValArgValAlaGlnGluGlnGluSerMetGlyLysLysLeu-133 |
| SEQ. ID. NO. 21544 | 142-SerValAlaLysGluValArgThrAspThrAlaValGlyGluAsnSerVal-158 |
| SEQ. ID. NO. 21545 | 174-AspIleGlyAspLeuAsn-179 |
| SEQ. ID. NO. 21546 | 199-LysSerProArgLeu-203 |
| SEQ. ID. NO. 21547 | 210-ThrLeuAlaArgAlaGlnGluLeuCysAspLysLeuGlyValAsnAlaGlu-226 |
| SEQ. ID. NO. 21548 | 257-GlyMetValGluArgAlaLeuLysGlnArgGlnSer-268 |
| SEQ. ID. NO. 21549 | 277-AlaValProArgAspIleGluAlaGluValGlyAspLeuAsnAsp-291 |
| SEQ. ID. NO. 21550 | 305-GlnSerGlyLysGluAlaArgGlnLysAlaAlaAlaAla-317 |
| SEQ. ID. NO. 21551 | 321-LeuValSerGluLysValAlaGluPheValArgGlnGlnGlnGlyArgGlnSerVal-339 |
| SEQ. ID. NO. 21552 | 343-ArgAlaLeuArgAspGluGlyGluLysAlaArgLysGlnValLeu-357 |
| SEQ. ID. NO. 21553 | 368-AlaThrAlaGluGluValLeuGlu-375 |
| SEQ. ID. NO. 21554 | 381-LeuThrAsnLysLeuLeuHisSerProThrGlnThrLeuAsnLysAlaGlyGluGluAspLysAspLeuVal-404 |
| Hydrophilic Regions - Hopp-Woods | |
| SEQ. ID. NO. 21555 | 16-SerIleArgGluLysLeuAla-22 |
| SEQ. ID. NO. 21556 | 30-GluAlaValArgAsnLeuAlaArgSerAsnAlaAla-41 |
| SEQ. ID. NO. 21557 | 59-GlyAspSerGluGluIleIle-65 |
| SEQ. ID. NO. 21558 | 75-ProIleGluGluIleSer-80 |
| SEQ. ID. NO. 21559 | 90-GluThrValArgHis-94 |
| SEQ. ID. NO. 21560 | 115-GlnIleLysAspAlaValArgValAlaGlnGluGlnGluSerMetGlyLysLysLeu-133 |
| SEQ. ID. NO. 21561 | 142-SerValAlaLysGluValArgThrAspThrAlaValGlyGluAsnSerVal-158 |
| SEQ. ID. NO. 21562 | 210-ThrLeuAlaArgAlaGlnGluLeuCysAsp-219 |
| SEQ. ID. NO. 21563 | 257-GlyMetValGluArgAlaLeuLysGlnArgGlnSer-268 |
| SEQ. ID. NO. 21564 | 277-AlaValProArgAspIleGluAlaGluValGlyAspLeuAsn-290 |
| SEQ. ID. NO. 21565 | 305-GlnSerGlyLysGluAlaArgGlnLysAlaAlaAlaAla-317 |
| SEQ. ID. NO. 21566 | 321-LeuValSerGluLysValAlaGluPheValArg-331 |
| SEQ. ID. NO. 21567 | 333-GlnGlnGlyArgGlnSer-338 |
| SEQ. ID. NO. 21568 | 343-ArgAlaLeuArgAspGluGlyGluLysAlaArgLysGlnValLeu-357 |
| SEQ. ID. NO. 21569 | 368-AlaThrAlaGluGluValLeuGlu-375 |
| SEQ. ID. NO. 21570 | 392-ThrLeuAsnLysAlaGlyGluGluAspLysAspLeuVal-404 |
| a624 | |
| AMPHI Regions - AMPHI | |
| SEQ. ID. NO. 21571 | 14-LeuLeuLeuGlyIleIleGlyIlePheLeuPro-24 |
| SEQ. ID. NO. 21572 | 45-ArgPheHisArgTrpLeuHis-51 |
| SEQ. ID. NO. 21573 | 58-ProMetValHisAsn-62 |
| SEQ. ID. NO. 21574 | 92-PheProGlnArgTrpTrpValGlyAla-100 |
| SEQ. ID. NO. 21575 | 102-SerSerValPheCysSerLeuValAlaIle-111 |
| Antigenic Index - Jameson-Wolf | |
| SEQ. ID. NO. 21576 | 41-LysAlaSerProArgPheHisArgTrp-49 |
| SEQ. ID. NO. 21577 | 51-HisArgHisArgTyrPheGlyProMet-59 |
| SEQ. ID. NO. 21578 | 63-TrpGluGlnAsnGlyAlaValProArgLysAlaLys-74 |
| SEQ. ID. NO. 21579 | 115-ArgArgProGluSer-119 |
| Hydrophilic Regions - Hopp-Woods | |
| SEQ. ID. NO. 21580 | 67-GlyAlaValProArgLysAlaLys-74 |
| SEQ. ID. NO. 21581 | 115-ArgArgProGluSer-119 |
| a625 | |
| AMPHI Regions - AMPHI | |
| SEQ. ID. NO. 21582 | 25-SerGlyArgIleIleSerIleAlaAla-33 |
| SEQ. ID. NO. 21583 | 64-LysMetProProGluMetValTyrArgAla-73 |
| Antigenic Index - Jameson-Wolf | |
| SEQ. ID. NO. 21584 | 5-ArgLysMetLysLysMetThrMetCysThrArgArgVal-17 |
| SEQ. ID. NO. 21585 | 57-ProPheLysSerProGlnThrLysMetProPro-67 |
| SEQ. ID. NO. 21586 | 73-AlaSerSerSerArgMetLysGly-80 |
| SEQ. ID. NO. 21587 | 96-AspAlaProLysThrLysLeuAsnGlyMetArgLysSerAsnValGln-111 |
| Hydrophilic Regions - Hopp-Woods | |
| SEQ. ID. NO. 21588 | 5-ArgLysMetLysLysMetThrMetCysThrArgArgVal-17 |
| SEQ. ID. NO. 21589 | 60-SerProGlnThrLysMetProPro-67 |
| SEQ. ID. NO. 21590 | 74-SerSerSerArgMetLysGly-80 |
| SEQ. ID. NO. 21591 | 96-AspAlaProLysThrLysLeuAsnGlyMetArgLysSerAsnValGln-111 |
| a627 | |
| AMPHI Regions - AMPHI | |
| SEQ. ID. NO. 21592 | 21-LeuGlnAsnLeuVal-25 |
| SEQ. ID. NO. 21593 | 56-IleAlaGluValGlyLysLeuPheLeuGlyIlePheIleThrIlePheProValLeuSerIleLeuLysAlaGlyGluAlaGlyAlaLeuGlyGlyVal<br>ValSerLeuValHisAspThrAlaGlyHisProIle-100 |

TABLE 1-continued

| | |
|---|---|
| SEQ. ID. NO. 21594 | 109-GlyIleLeuSerAlaPheLeuAspAsnAla-118 |
| SEQ. ID. NO. 21595 | 141-PheHisSerLeuLeuAlaValSer-148 |
| SEQ. ID. NO. 21596 | 153-PheMetGlyAlaLeuThrTyrIleGlyAsnAlaProAsnPheMetValLys-169 |
| SEQ. ID. NO. 21597 | 181-ThrPhePheGlyTyr-185 |

Antigenic Index - Jameson-Wolf

| | |
|---|---|
| SEQ. ID. NO. 21598 | 3-GlyLeuTrpLysProGluHisProGlyPhe-12 |
| SEQ. ID. NO. 21599 | 41-ThrProLysGlnValArgAlaGlyAsnGluPheAsnPhe-53 |
| SEQ. ID. NO. 21600 | 94-AspThrAlaGlyHis-98 |
| SEQ. ID. NO. 21601 | 128-AlaGlyGlyAspAla-132 |
| SEQ. ID. NO. 21602 | 170-AlaIleAlaGluGlnArgGlyValPro-178 |

Hydrophilic Regions - Hopp-Woods

| | |
|---|---|
| SEQ. ID. NO. 21603 | 5-TrpLysProGluHisProGly-11 |
| SEQ. ID. NO. 21604 | 43-LysGlnValArgAlaGlyAsn-49 |
| SEQ. ID. NO. 21605 | 170-AlaIleAlaGluGlnArgGlyVal-177 | a628
AMPHI Regions - AMPHI

| | |
|---|---|
| SEQ. ID. NO. 21606 | 10-CysGlyProProAsnSerCysValSerMetLeuAlaAlaPheSerAspGlyThrSerAlaProAlaAla-32 |
| SEQ. ID. NO. 21607 | 34-HisThrTrpIleLeuArgSer-40 |

Antigenic Index - Jameson-Wolf

| | |
|---|---|
| SEQ. ID. NO. 21608 | 6-LysProAlaGlyCysGlyProProAsnSer-15 |
| SEQ. ID. NO. 21609 | 23-PheSerAspGlyThrSerAla-29 |
| SEQ. ID. NO. 21610 | 40-SerValLysArgLeuAsnThrSerLysProArgLeuLysSerSerAla-55 |
| SEQ. ID. NO. 21611 | 77-MetAlaAsnGlySerAlaSerThr-84 |
| SEQ. ID. NO. 21612 | 91-GlyArgValArgSerAlaValHisLysProAspTrpIleArgLeuArgArgThrSerSerProLeuLys-113 |
| SEQ. ID. NO. 21613 | 116-AsnAlaSerGlyAla-120 |

Hydrophilic Regions - Hopp-Woods

| | |
|---|---|
| SEQ. ID. NO. 21614 | 40-SerValLysArgLeuAsnThrSerLysProArgLeuLysSerSerAla-55 |
| SEQ. ID. NO. 21615 | 91-GlyArgValArgSerAlaValHisLys-99 |
| SEQ. ID. NO. 21616 | 101-AspTrpIleArgLeuArgArgThrSerSer-110 | a629
AMPHI Regions - AMPHI

| | |
|---|---|
| SEQ. ID. NO. 21617 | 32-ArgTrpSerAspValPheSer-38 |
| SEQ. ID. NO. 21618 | 48-IleSerArgLeuProArgThrPhe-55 |
| SEQ. ID. NO. 21619 | 116-ValAlaAlaLeuIleGlyMetLeuValPhe-125 |
| SEQ. ID. NO. 21620 | 146-IlePheGlyGlyValValGluAlaValAlaThr-156 |
| SEQ. ID. NO. 21621 | 167-MetLeuGlyValTrpGlnGlnGlyAsp-175 |
| SEQ. ID. NO. 21622 | 191-GlyIleLeuAlaLeuPheAla-197 |
| SEQ. ID. NO. 21623 | 205-ThrIleLeuGlyLeuGlyGlu-211 |
| SEQ. ID. NO. 21624 | 252-ValValProAsnIleIleSerArgLeuIleGlyAspArgLeuArgGlnSer-268 |
| SEQ. ID. NO. 21625 | 285-IleIleGlyArgVal-289 |
| SEQ. ID. NO. 21626 | 300-ThrValPheGlyValLeu-305 |

Antigenic Index - Jameson-Wolf

| | |
|---|---|
| SEQ. ID. NO. 21627 | 38-SerLeuSerAspSerGln-43 |
| SEQ. ID. NO. 21628 | 50-ArgLeuProArgThr-54 |
| SEQ. ID. NO. 21629 | 77-AsnArgPheValGluProSerMetAlaGlyAlaGlyGln-89 |
| SEQ. ID. NO. 21630 | 131-ArgLeuProProThrAla-136 |
| SEQ. ID. NO. 21631 | 174-GlyAspPheSerGly-178 |
| SEQ. ID. NO. 21632 | 260-LeuIleGlyAspArgLeuArgGlnSer-268 |
| SEQ. ID. NO. 21633 | 316-ArgLysProAlaHis-320 |

Hydrophilic Regions - Hopp-Woods

| | |
|---|---|
| SEQ. ID. NO. 21634 | 260-LeuIleGlyAspArgLeuArgGln-267 |
| SEQ. ID. NO. 21635 | 316-ArgLysProAlaHis-320 | a630
AMPHI Regions - AMPHI

| | |
|---|---|
| SEQ. ID. NO. 21636 | 9-LeuPheProAlaMetPheTyrGlyMetTyrAsn-19 |
| SEQ. ID. NO. 21637 | 30-ProAspLeuLeuGlnGlnSerIleAlaAsnAspTrpHisTyrAlaLeu-45 |
| SEQ. ID. NO. 21638 | 81-GlyGlyPheTrpGluValLeuPheAla-89 |
| SEQ. ID. NO. 21639 | 135-PheGlyGlyThrGlyLysAsnPhe-142 |
| SEQ. ID. NO. 21640 | 169-AlaValArgGlyTyrSerGlyAlaThrAlaLeuAlaGlnTrp-182 |
| SEQ. ID. NO. 21641 | 187-AlaAspGlyLeuLysAsnAlaIle-194 |
| SEQ. ID. NO. 21642 | 203-AspAlaPheIleGlyLysLeuProGlySerIleGlyGluValSer-217 |
| SEQ. ID. NO. 21643 | 230-PheAlaArgIleAlaSerTrpArgIleIleAlaGlyValMet-243 |
| SEQ. ID. NO. 21644 | 247-IleAlaMetSerSerLeuPheAsnPhe-255 |
| SEQ. ID. NO. 21645 | 289-ValSerAlaSerPheThrAsnValGlyLysTrpTrpTyrGlyAlaLeuIleGlyValMetCysValLeuIleArgVal-314 |
| SEQ. ID. NO. 21646 | 327-IleLeuPheAlaAsnLeuPheAlaProIlePheAspTyrPhe-340 |

Antigenic Index - Jameson-Wolf

| | |
|---|---|
| SEQ. ID. NO. 21647 | 91-ValArgLysHisGluIleAsnGlu-98 |
| SEQ. ID. NO. 21648 | 133-GluValPheGlyGlyThrGlyLysAsnPheMet-143 |
| SEQ. ID. NO. 21649 | 157-TyrProAlaAsnLeuSerGlyAspAla-165 |
| SEQ. ID. NO. 21650 | 186-GlyAlaAspGlyLeuLys-191 |
| SEQ. ID. NO. 21651 | 209-LeuProGlySerIleGly-214 |
| SEQ. ID. NO. 21652 | 257-GlySerAspThrAsnAla-262 |
| SEQ. ID. NO. 21653 | 345-AsnIleLysArgArgLysAlaArgSerAsnGly-355 |

Hydrophilic Regions - Hopp-Woods

| | |
|---|---|
| SEQ. ID. NO. 21654 | 91-ValArgLysHisGluIleAsn-97 |
| SEQ. ID. NO. 21655 | 345-AsnIleLysArgArgLysAlaArgSerAsnGly-355 | a638
AMPHI Regions - AMPHI

| | |
|---|---|
| SEQ. ID. NO. 21656 | 17-LeuAlaArgPheValAspAsnVal-24 |
| SEQ. ID. NO. 21657 | 30-IleValAspIleValGluHis-36 |

TABLE 1-continued

SEQ. ID. NO. 21658  46-AspIleValLysHisPheGluProLeuGlyLys-56
SEQ. ID. NO. 21659  118-ArgAlaGlyArgValPro-123
SEQ. ID. NO. 21660  149-IleGlyArgThrMetGln-154
SEQ. ID. NO. 21661  198-GluArgTyrValArgArgValTyrGlyTyrGlyThrPro-210
SEQ. ID. NO. 21662  212-ProValSerPheAspGlyCysArgThrValGlyArgPro-224
SEQ. ID. NO. 21663  242-SerGlnPheGluArgIleAlaArgProGly-251
Antigenic Index - Jameson-Wolf
SEQ. ID. NO. 21664  13-GlyLysAsnAlaLeu-17
SEQ. ID. NO. 21665  43-AlaAspGlyAspIle-47
SEQ. ID. NO. 21666  52-GluProLeuGlyLysHisGln-58
SEQ. ID. NO. 21667  81-ValAspGlyGluThrGlnIle-87
SEQ. ID. NO. 21668  99-AlaGlyIleGlyLysAsnAlaVal-106
SEQ. ID. NO. 21669  113-ValAlaAspAspLeuArgAlaGlyArgValProAsnGlyAsn-126
SEQ. ID. NO. 21670  135-GlnSerArgValAlaAsp-140
SEQ. ID. NO. 21671  153-MetGlnIleAspAlaAspArgIleIle-161
SEQ. ID. NO. 21672  168-AsnGlnGlyAlaArgGlySerPhe-175
SEQ. ID. NO. 21673  178-IleAsnThrGlyIleHis-183
SEQ. ID. NO. 21674  188-HisThrGlyThrGlyAsnGlyGlnValAlaGluArgTyrValArg-202
SEQ. ID. NO. 21675  213-ValSerPheAspGlyCysArgThrValGlyArgProPheAsnArgAsnArgPheValAsp-232
SEQ. ID. NO. 21676  240-AlaGlySerGlnPheGluArgIleAlaArgProGlyAlaGlyLysCysGly-256
Hydrophilic Regions - Hopp-Woods
SEQ. ID. NO. 21677  43-AlaAspGlyAspIle-47
SEQ. ID. NO. 21678  52-GluProLeuGlyLys-56
SEQ. ID. NO. 21679  81-ValAspGlyGluThrGlnIle-87
SEQ. ID. NO. 21680  113-ValAlaAspAspLeuArgAlaGlyArgValProAsn-124
SEQ. ID. NO. 21681  136-SerArgValAlaAsp-140
SEQ. ID. NO. 21682  153-MetGlnIleAspAlaAspArgIleIle-161
SEQ. ID. NO. 21683  195-GlnValAlaGluArgTyrValArg-202
SEQ. ID. NO. 21684  216-AspGlyCysArgThrValGly-222
SEQ. ID. NO. 21685  243-GlnPheGluArgIleAlaArgProGlyAlaGly-253
a639-1
AMPHI Regions - AMPHI
SEQ. ID. NO. 21686  95-TyrLysAsnAsnArg-99
SEQ. ID. NO. 21687  137-LeuLysValPheAspAsnIle-143
SEQ. ID. NO. 21688  157-ValAsnTyrSerAspIleHisAspAsnIleIleAsnLysAla-170
SEQ. ID. NO. 21689  269-AlaProValSerArg-273
SEQ. ID. NO. 21690  290-GlnPheProAlaValLeuProGly-297
SEQ. ID. NO. 21691  322-AspGlyLeuLeuLysLysValGlu-329
Antigenic Index - Jameson-Wolf
SEQ. ID. NO. 21692  13-GluGluThrAlaPro-17
SEQ. ID. NO. 21693  23-HisAsnAsnIleLeuAspAsnSer-30
SEQ. ID. NO. 21694  41-AlaMetValArgGluAsnLysIleValGly-50
SEQ. ID. NO. 21695  52-AlaThrLeuArgValAsnGluArgGlyAsnGly-62
SEQ. ID. NO. 21696  75-GlyAsnAspIleSerLysGlyArgAspGlyIlePheSerAsnThrSerThrHisAsnThrTyrLysAsnAsnArgPheSerAsp-102
SEQ. ID. NO. 21697  111-TyrThrAsnAspSerGluIleSerGly-119
SEQ. ID. NO. 21698  121-IleSerValGlyAsnAsn-126
SEQ. ID. NO. 21699  135-GluArgLeuLysVal-139
SEQ. ID. NO. 21700  145-ValGlySerArgAspGlnGlyIle-152
SEQ. ID. NO. 21701  160-SerAspIleHisAspAsnIleIleAsnLysAlaGlyLys-172
SEQ. ID. NO. 21702  179-AlaAsnTyrAspLysLeuSerAlaAsnHis-188
SEQ. ID. NO. 21703  203-GluGlyThrSerLeuHisAspAsnSerPheIleAsnAsnGluSerGlnValLysTyrVal-222
SEQ. ID. NO. 21704  228-AspTrpSerGluGlyGlyHisGlyAsnTyrTrpSerAspAsnSerAla-243
SEQ. ID. NO. 21705  246-LeuAsnGlyAspGlyPheGlyAspSerAlaTyrArgProAsnGlyIleIle-262
SEQ. ID. NO. 21706  297-GlyGlyValValArgSerLysProLeuMetLysProTyrAlaProLysIleGlnThr-315
SEQ. ID. NO. 21707  318-GlnAlaMetLysAspGlyLeuLeuLysLysValGluThrArgGlnLeuGluTrpGlyArgAlaGluAsnGlySerLeuAsn-344
Hydrophilic Regions - Hopp-Woods
SEQ. ID. NO. 21708  41-AlaMetValArgGluAsnLysIleValGly-50
SEQ. ID. NO. 21709  52-AlaThrLeuArgValAsnGluArgGlyAsn-61
SEQ. ID. NO. 21710  77-AspIleSerLysGlyArgAspGlyIle-85
SEQ. ID. NO. 21711  95-TyrLysAsnAsnArgPheSerAsp-102
SEQ. ID. NO. 21712  113-AsnAspSerGluIleSerGly-119
SEQ. ID. NO. 21713  135-GluArgLeuLysVal-139
SEQ. ID. NO. 21714  146-GlySerArgAspGlnGly-151
SEQ. ID. NO. 21715  180-AsnTyrAspLysLeuSer-185
SEQ. ID. NO. 21716  299-ValValAspSerLysProLeuMet-306
SEQ. ID. NO. 21717  318-GlnAlaMetLysAspGlyLeuLeuLysLysValGluThrArgGlnLeuGluTrpGlyArgAlaGluAsnGlySer-342
a640
AMPHI Regions - AMPHI
SEQ. ID. NO. 21718  6-SerIleLeuLysSerIleGlyIle-13
SEQ. ID. NO. 21719  22-SerIleLysArgMetSer-27
SEQ. ID. NO. 21720  47-LeuProAlaTyrAlaGluArgLeuProAspPheLeuAlaLysIleGlnPro-63
SEQ. ID. NO. 21721  72-ArgTyrSerLysPro-76
SEQ. ID. NO. 21722  109-SerLysProIleAspThrLeuMetAla-117
SEQ. ID. NO. 21723  127-AlaLysLeuValAspHis-132
Antigenic Index - Jameson-Wolf
SEQ. ID. NO. 21724  24-LysArgMetSerAlaPheArgAlaArgIle-33
SEQ. ID. NO. 21725  50-TyrAlaGluArgLeuProAspPheLeuAlaLysIleGlnProSerGluIleValProGlyAlaAspArgTyrSerLysProGluGlyLysProMetVal-82
SEQ. ID. NO. 21726  85-ValTyrLysGlyAspGluGlnLeu-92
SEQ. ID. NO. 21727  101-AlaValAsnThrArgGlyTyrSerSerLysProIleAsp-113

TABLE 1-continued

| | |
|---|---|
| SEQ. ID. NO. 21728 | 118-LeuAlaLysAspGlyThr-123 |
| SEQ. ID. NO. 21729 | 128-LysLeuValAspHisHisGlu-134 |

Hydrophilic Regions - Hopp-Woods

| | |
|---|---|
| SEQ. ID. NO. 21730 | 24-LysArgMetSerAlaPheArgAlaArgIle-33 |
| SEQ. ID. NO. 21731 | 50-TyrAlaGluArgLeuPro-55 |
| SEQ. ID. NO. 21732 | 68-ProGlyAlaAspArgTyrSerLysProGluGlyLysProMetVal-82 |
| SEQ. ID. NO. 21733 | 85-ValTyrLysGlyAspGluGlnLeu-92 |
| SEQ. ID. NO. 21734 | 118-LeuAlaLysAspGlyThr-123 |
| SEQ. ID. NO. 21735 | 128-LysLeuValAspHisHisGlu-134 | a642

AMPHI Regions - AMPHI

| | |
|---|---|
| SEQ. ID. NO. 21736 | 6-CysProLeuSerAlaIleSerAlaVal-14 |
| SEQ. ID. NO. 21737 | 116-IleLysHisIleValArgAlaPhe-123 |
| SEQ. ID. NO. 21738 | 138-GlyValSerAlaPheLysThrLeuArgAlaGlnGluPheLeuGlnHisLeuArgGlyGlyVal-158 |
| SEQ. ID. NO. 21739 | 161-PheArgGlyGluGly-165 |
| SEQ. ID. NO. 21740 | 167-AspAspValArgLeu-171 |
| SEQ. ID. NO. 21741 | 186-AlaAspValAlaValLysAsnLeuGlyAsnLeuMetAlaAlaProAsp-201 |
| SEQ. ID. NO. 21742 | 220-ValPheLysGlyValPheHisAsnAlaValArgHisAlaAspGlnLeuGln-236 |
| SEQ. ID. NO. 21743 | 270-ValAspGlyValThrAspGlyAla-277 |
| SEQ. ID. NO. 21744 | 296-GlnValAspAspPheGlyGluPheAlaValPhe-306 |
| SEQ. ID. NO. 21745 | 325-PheArgGlyValAsp-329 |
| SEQ. ID. NO. 21746 | 378-AlaGluLeuLeuGlnTrpLeuGlnHisGlnArgAlaPheAspAlaGlyThr-394 |

Antigenic Index - Jameson-Wolf

| | |
|---|---|
| SEQ. ID. NO. 21747 | 1-AlaCysArgArgIleCysPro-7 |
| SEQ. ID. NO. 21748 | 22-ValGlnGlnGluGlyCysGly-28 |
| SEQ. ID. NO. 21749 | 34-LeuTyrGluAspLysGluSerGlyAspAspPheAlaAspLysAspPheLeuGln-51 |
| SEQ. ID. NO. 21750 | 73-ValAlaGlyAspGlyGlyLysAlaGly-81 |
| SEQ. ID. NO. 21751 | 103-PheGlyGlyGlyAlaAspLysLeu-110 |
| SEQ. ID. NO. 21752 | 123-PheLysAsnArgGluGlyAlaAspValAspSerAspIleAla-136 |
| SEQ. ID. NO. 21753 | 143-LysThrLeuArgAla-147 |
| SEQ. ID. NO. 21754 | 161-PheArgGlyGluGlyPheAspAspValArgLeu-171 |
| SEQ. ID. NO. 21755 | 175-MetGlyAspGlyCysAsnGlyArgAsnGlyMet-185 |
| SEQ. ID. NO. 21756 | 208-AspGluSerAspValValAla-214 |
| SEQ. ID. NO. 21757 | 230-ArgHisAlaAspGlnLeuGlnAlaAlaAlaAspLysAspValLeuGluArgAlaGlnThrGly-250 |
| SEQ. ID. NO. 21758 | 259-HisGlyGlyCysArg-263 |
| SEQ. ID. NO. 21759 | 265-PheGlyIleAspAlaValAspGlyValThrAspGly-276 |
| SEQ. ID. NO. 21760 | 290-CysPheGlyAspGluGlnGlnValAspAspPheGly-301 |
| SEQ. ID. NO. 21761 | 309-PheGlyGlyAsnGluGluGluValAlaLeu-318 |
| SEQ. ID. NO. 21762 | 328-ValAspValAsnGly-332 |
| SEQ. ID. NO. 21763 | 344-PheSerGlyAsnArgArgAlaGlyGly-352 |
| SEQ. ID. NO. 21764 | 388-ArgAlaPheAspAlaGlyThrGlnArgAsnGly-398 |
| SEQ. ID. NO. 21765 | 401-ValMetProArgAsnPro-406 |

Hydrophilic Regions - Hopp-Woods

| | |
|---|---|
| SEQ. ID. NO. 21766 | 1-AlaCysArgArgIleCys-6 |
| SEQ. ID. NO. 21767 | 34-LeuTyrGluAspLysGluSerGlyAspAspPheAlaAspLysAspPheLeu-50 |
| SEQ. ID. NO. 21768 | 76-AspGlyGlyLysAla-80 |
| SEQ. ID. NO. 21769 | 106-GlyAlaAspLysLeu-110 |
| SEQ. ID. NO. 21770 | 123-PheLysAsnArgGluGlyAlaAspValAspSerAspIle-135 |
| SEQ. ID. NO. 21771 | 143-LysThrLeuArgAla-147 |
| SEQ. ID. NO. 21772 | 164-GluGlyPheAspAspValArgLeu-171 |
| SEQ. ID. NO. 21773 | 178-GlyCysAsnGlyArgAsnGlyMet-185 |
| SEQ. ID. NO. 21774 | 208-AspGluSerAspValValAla-214 |
| SEQ. ID. NO. 21775 | 230-ArgHisAlaAspGlnLeuGlnAlaAlaAlaAspLysAspValLeuGluArgAlaGlnThr-249 |
| SEQ. ID. NO. 21776 | 269-AlaValAspGlyValThrAspGly-276 |
| SEQ. ID. NO. 21777 | 290-CysPheGlyAspGluGlnGlnValAspAspPheGly-301 |
| SEQ. ID. NO. 21778 | 311-GlyAsnGluGluGluValAlaLeu-318 |
| SEQ. ID. NO. 21779 | 346-GlyAsnArgArgAlaGly-351 |
| SEQ. ID. NO. 21780 | 393-GlyThrGlnArgAsnGly-398 | a644

AMPHI Regions - AMPHI

| | |
|---|---|
| SEQ. ID. NO. 21781 | 25-CysGlyArgArgPheAspArgPro-32 |
| SEQ. ID. NO. 21782 | 55-MetAspThrAlaAlaPheLeuLysHisIleGluSerAlaPheArgArgIlePheAlaAspGlyIleAspLeuMetArgTyrLeu-82 |
| SEQ. ID. NO. 21783 | 111-GlnPheGluIleGlnGluPheGlyAsp-148 |
| SEQ. ID. NO. 21784 | 141-GlnProLeuGlnGluPheGlyAsp-148 |
| SEQ. ID. NO. 21785 | 181-ArgGluMetGlnSerTyrTyrGluTyrThrAsp-191 |
| SEQ. ID. NO. 21786 | 202-TyrTrpGlnGlyAsn-206 |
| SEQ. ID. NO. 21787 | 224-LeuAlaLysValIleAspLeuLeu-231 |
| SEQ. ID. NO. 21788 | 276-AlaGlyLeuArgAlaPheGlnAsn-283 |
| SEQ. ID. NO. 21789 | 304-LeuGluAsnLeuGluArgTyrValArgAsn-313 |
| SEQ. ID. NO. 21790 | 333-GluIleLeuTyrArgTyrValCysHis-341 |
| SEQ. ID. NO. 21791 | 343-ValSerProValAlaProValAlaHis-351 |
| SEQ. ID. NO. 21792 | 356-AlaAsnIleValLysThrLeuAla-363 |
| SEQ. ID. NO. 21793 | 372-GlnMetLeuGlnLys-376 |
| SEQ. ID. NO. 21794 | 399-PheThrIlePheGluGlyProAsn-406 |
| SEQ. ID. NO. 21795 | 408-MetLeuTyrAlaGluIleTyrAspGlnPheValArgAla-420 |
| SEQ. ID. NO. 21796 | 439-AspArgLeuGlnThr-443 |
| SEQ. ID. NO. 21797 | 456-LeuProGluAspIleArgSerPhe-463 |
| SEQ. ID. NO. 21798 | 481-GlyLysIleIleAlaArgLeu-487 |

TABLE 1-continued

Antigenic Index - Jameson-Wolf
SEQ. ID. NO. 21799 1-MetProSerGluArgSerAlaAspCysCysPro-11
SEQ. ID. NO. 21800 16-ValLysPheArgLysSerThrLeuAsnCysGlyArgArgPheAspArgProProIleAsnGlyAsnArgGlnArgLysProMetIleHisThrGluPro
SerAlaGlnProSerThrMetAsp-56
SEQ. ID. NO. 21801 64-IleGluSerAlaPhe-68
SEQ. ID. NO. 21802 71-IlePheAlaAspGlyIleAsp-77
SEQ. ID. NO. 21803 82-LeuProGluAspLysTrpLeu-88
SEQ. ID. NO. 21804 99-PheLeuAspLysLysTyrGlyGlyArgLysGlySerGlnPheGluIle-114
SEQ. ID. NO. 21805 132-XxxXxxXxxGluGly-136
SEQ. ID. NO. 21806 145-GluPheGlyAspGluAlaGlnIle-152
SEQ. ID. NO. 21807 159-ValPheLysGlyGluGlyGlyGlyLeu-167
SEQ. ID. NO. 21808 170-ThrGluProGluThrSerGly-176
SEQ. ID. NO. 21809 178-AlaIleAlaArgGluMetGlnSerTyrTyrGluTyrThrAspGlyGlnThr-194
SEQ. ID. NO. 21810 202-TyrTrpGlnGlyAsnSerGlnSerAspPhe-211
SEQ. ID. NO. 21811 216-AlaLysGluArgLysAsnGlyLysLeuAlaLys-226
SEQ. ID. NO. 21812 235-LysThrTyrIleArg-239
SEQ. ID. NO. 21813 241-GluThrLeuAlaSerGluGlyLeuArg-249
SEQ. ID. NO. 21814 254-AlaValAsnArgIleAspAlaGluMet-262
SEQ. ID. NO. 21815 270-LeuSerGlnSerAspAlaAlaGly-277
SEQ. ID. NO. 21816 306-AsnLeuGluArgTyrValArgAsnAspIleArgPheValAspTyrGluArgArgGluIleArgArgArgHisGlnVal-331
SEQ. ID. NO. 21817 381-LysGlyPheGluArgGlyHisThrAlaGlyAsn-391
SEQ. ID. NO. 21818 403-GluGlyProAsnAspMetLeu-409
SEQ. ID. NO. 21819 420-AlaThrAlaGluGluLysGluAlaGlyMetLysLeuAspLysAsnGlnThrLeuLeuAspArgLeuGlnThrAspAlaArgPhe-447
SEQ. ID. NO. 21820 449-AlaValAlaArgAspTyrThrLeuProGluAspIleArgSerPheLeu-464
SEQ. ID. NO. 21821 493-AlaGluHisGluAspThrAla-499
SEQ. ID. NO. 21822 505-AspIleArgLysAspIleLeuAspCysArgTyrCysGly-517
Hydrophilic Regions - Hopp-Woods
SEQ. ID. NO. 21823 1-MetProSerGluArgSerAlaAspCys-9
SEQ. ID. NO. 21824 17-LysPheArgLysSerThrLeuAsnCysGlyArgArgPheAspArgProProIleAsnGlyAsnArgGlnArgLysProMetIle-44
SEQ. ID. NO. 21825 64-IleGluSerAlaPhe-68
SEQ. ID. NO. 21826 82-LeuProGluAspLysTrpLeu-88
SEQ. ID. NO. 21827 100-LeuAspLysLysTyrGlyGlyArgLysGlySerGln-111
SEQ. ID. NO. 21828 145-GluPheGlyAspGluAlaGlnIle-152
SEQ. ID. NO. 21829 160-PheLysGlyGluGlyGlyGly-165
SEQ. ID. NO. 21830 170-ThrGluProGluThrSerGly-176
SEQ. ID. NO. 21831 178-AlaIleAlaArgGluMetGlnSer-185
SEQ. ID. NO. 21832 216-AlaLysGluArgLysAsnGlyLysLeuAlaLys-226
SEQ. ID. NO. 21833 254-AlaValAsnArgIleAspAlaGluMet-262
SEQ. ID. NO. 21834 271-SerGlnSerAspAlaAlaGly-277
SEQ. ID. NO. 21835 306-AsnLeuGluArgTyrValArgAsnAspIleArgPheValAspTyrGluArgArgGluIleArgArgArgHisGlnVal-331
SEQ. ID. NO. 21836 381-LysGlyPheGluArgGlyHisThr-388
SEQ. ID. NO. 21837 420-AlaThrAlaGluGluLysGluAlaGlyMetLysLeuAspLysAsnGlnThrLeuLeuAspArgLeuGlnThrAspAlaArgPhe-447
SEQ. ID. NO. 21838 458-GluAspIleArgSerPheLeu-464
SEQ. ID. NO. 21839 493-AlaGluHisGluAspThrAla-499
SEQ. ID. NO. 21840 505-AspIleArgLysAspIleLeuAsp-512
a645
AMPHI Regions - AMPHI
SEQ. ID. NO. 21841 21-AsnThrLeuAsnArgCysCysLys-28
SEQ. ID. NO. 21842 87-ArgThrLeuProSerLeuAsnGlyLeuThrLys-97
SEQ. ID. NO. 21843 149-ThrProLysArgCysSerSerSerIle-157
SEQ. ID. NO. 21844 163-PheLeuAsnPheMetSerSerCysThrSerLeu-173
SEQ. ID. NO. 21845 210-SerAlaLysArgSer-214
SEQ. ID. NO. 21846 249-SerValLeuProLysPro-254
Antigenic Index - Jameson-Wolf
SEQ. ID. NO. 21847 18-GluGlnSerAsnThrLeuAsnArgCysCysLysLysSerArgMetThrCysSerSerSerArgSerArgSerCysProCys-44
SEQ. ID. NO. 21848 47-ProMetArgAlaSerGlySerArgValSerSerArgSerArgMet-61
SEQ. ID. NO. 21849 68-SerLeuCysArgLysAsnThrCysProProArgLeuSerSerArgAsnThrAlaSerArgThrLeuProSer-91
SEQ. ID. NO. 21850 99-LeuThrAlaArgArgArgLeuGly-106
SEQ. ID. NO. 21851 110-IleSerGluLysSerArgSerProSerSer-119
SEQ. ID. NO. 21852 137-ThrLeuAlaArgArgArgLeuSerCysSerPheArgThrProLysArgCysSerSer-155
SEQ. ID. NO. 21853 184-SerAlaMetProSer-188
SEQ. ID. NO. 21854 198-LeuLysArgGluArgLeuAla-204
SEQ. ID. NO. 21855 207-ThrGlyLysSerAlaLysArgSerAlaLys-216
SEQ. ID. NO. 21856 221-CysSerThrArgSerValValGlyAla-229
SEQ. ID. NO. 21857 242-AsnAlaAlaArgArgAlaThr-248
SEQ. ID. NO. 21858 250-ValLeuProLysProThrSerProHisThrArgArgSerIle-263
Hydrophilic Regions - Hopp-Woods
SEQ. ID. NO. 21859 19-GlnSerAsnThrLeu-23
SEQ. ID. NO. 21860 25-ArgCysCysLysLysSerArgMetThrCysSerSerSerArgSerArgSerCysPro-43
SEQ. ID. NO. 21861 48-MetArgAlaSerGlySerArgValSerSerArgSerArgMet-61
SEQ. ID. NO. 21862 69-LeuCysArgLysAsnThrCysProProArgLeuSerSerArgAsnThrAlaSerArgThr-88
SEQ. ID. NO. 21863 99-LeuThrAlaArgArgArgLeuGly-106
SEQ. ID. NO. 21864 110-IleSerGluLysSerArgSerProSer-118
SEQ. ID. NO. 21865 137-ThrLeuAlaArgArgArgLeuSerCys-145
SEQ. ID. NO. 21866 148-ArgThrProLysArgCysSer-154
SEQ. ID. NO. 21867 198-LeuLysArgGluArgLeuAla-204
SEQ. ID. NO. 21868 209-LysSerAlaLysArgSerAlaLys-216

TABLE 1-continued

SEQ. ID. NO. 21869  242-AsnAlaAlaArgArgAlaThr-248
SEQ. ID. NO. 21870  254-ProThrSerProHisThrArgArgSerIle-263
a647
AMPHI Regions - AMPHI
SEQ. ID. NO. 21871  38-GlyLysValCysArgCysPheGluGlnVal-47
SEQ. ID. NO. 21872  69-ThrValPheArgGlnIleIleArgIleValAspHisAla-81
Antigenic Index - Jameson-Wolf
SEQ. ID. NO. 21873  26-GlyLeuValLysGluArgAlaArg-33
SEQ. ID. NO. 21874  39-LysValCysArgCysPhe-44
SEQ. ID. NO. 21875  54-GlyThrValGlyGlnThrGluArgGlyAla-63
SEQ. ID. NO. 21876  79-AspHisAlaAspThrGluArgThrAlaAlaHisSerGlyGlyThrArgGly-95
Hydrophilic Regions - Hopp-Woods
SEQ. ID. NO. 21877  26-GlyLeuValLysGluArgAlaArg-33
SEQ. ID. NO. 21878  40-ValCysArgCysPhe-44
SEQ. ID. NO. 21879  56-ValGlyGlnThrGluArgGlyAla-63
SEQ. ID. NO. 21880  79-AspHisAlaAspThrGluArgThrAlaAla-88
a648
AMPHI Regions - AMPHI
SEQ. ID. NO. 21881  7-ArgIleGluArgAlaValArg-13
SEQ. ID. NO. 21882  15-AlaValIleAspValLeuAsnValAsp-23
SEQ. ID. NO. 21883  44-AlaLeuAlaAspIleArgValLeu-51
SEQ. ID. NO. 21884  94-AlaValAspLeuHisAlaValIleLysLeuThrAspThrVal-107
SEQ. ID. NO. 21885  127-GlnGlyValGluGlnGly-132
SEQ. ID. NO. 21886  152-PheLysGluGlyAsn-156
SEQ. ID. NO. 21887  182-AlaArgThrLeuGlyAsnValPheHis-190
SEQ. ID. NO. 21888  194-GlySerGlyValAspGlyIleGlnAlaValValAlaPheAspGlnTyrAla-210
Antigenic Index - Jameson-Wolf
SEQ. ID. NO. 21889  1-MetAsnArgArgAsnAlaArgIleGluArgAlaValArg-13
SEQ. ID. NO. 21890  23-AspAlaProGlySerGlyThrLeuLeuHisGlnArgGlyLysGlnValGlySerArgAsnAspAlaLeuAla-46
SEQ. ID. NO. 21891  65-GlyLysLysArgPheValGlnSerArgAsnLeuValGlyArgLysGlnArgAsn-82
SEQ. ID. NO. 21892  125-MetProGlnGlyValGluGlnGlyCysArg-134
SEQ. ID. NO. 21893  142-ArgThrGlyPheAspCysArgLeuLysHisPheLysGluGlyAsnAla-157
SEQ. ID. NO. 21894  172-SerAlaAspThrSerGlyIleAspAlaAspAlaArgThr-184
SEQ. ID. NO. 21895  191-AsnArgAlaGlySerGlyValAspGly-199
Hydrophilic Regions - Hopp-Woods
SEQ. ID. NO. 21896  1-MetAsnArgArgAsnAlaArgIleGluArgAlaValArg-13
SEQ. ID. NO. 21897  33-GlnArgGlyLysGlnValGlySerArgAsnAspAlaLeuAla-46
SEQ. ID. NO. 21898  65-GlyLysLysArgPheValGln-71
SEQ. ID. NO. 21899  74-AsnLeuValGlyArgLysGlnArgAsn-82
SEQ. ID. NO. 21900  127-GlnGlyValGluGlnGlyCysArg-134
SEQ. ID. NO. 21901  143-ThrGlyPheAspCysArgLeuLysHisPheLysGluGlyAsnAla-157
SEQ. ID. NO. 21902  172-SerAlaAspThrSerGlyIleAspAlaAspAlaArgThr-184
a649
AMPHI Regions - AMPHI
SEQ. ID. NO. 21903  6-LeuSerAlaIleLeuGlyLeuVal-13
SEQ. ID. NO. 21904  27-ArgAspThrLysHisIleArgLysAlaAsn-36
SEQ. ID. NO. 21905  57-SerGlnGlyAsnVal-61
SEQ. ID. NO. 21906  63-GluLeuArgGluAsnLys-68
SEQ. ID. NO. 21907  71-ArgLysAlaPheArgSerLeu-77
Antigenic Index - Jameson-Wolf
SEQ. ID. NO. 21908  20-GlyThrSerGluProAlaHisArgAspThrLysHisIleArgLysAlaAsnLys-37
SEQ. ID. NO. 21909  40-LeuHisProGluCysArgLysTyrLeuGluArgArgAlaAla-53
SEQ. ID. NO. 21910  56-ArgSerGlnGlyAsnValGlnGluLeuArgGluAsnLysLysAlaArgLysAlaPheArgSerLeuProTyrLysGluGlnLysThrGlnCys-86
SEQ. ID. NO. 21911  92-AlaPheAspAspPheAspGlySerArgPheArgArg-103
Hydrophilic Regions - Hopp-Woods
SEQ. ID. NO. 21912  20-GlyThrSerGluProAlaHisArgAspThrLysHisIleArgLysAlaAsnLys-37
SEQ. ID. NO. 21913  42-ProGluCysArgLysTyrLeuGluArgArgAlaAla-53
SEQ. ID. NO. 21914  59-GlyAsnValGlnGluLeuArgGluAsnLysLysAlaArgLysAlaPheArg-75
SEQ. ID. NO. 21915  78-ProTyrLysGluGlnLysThrGlnCys-86
SEQ. ID. NO. 21916  92-AlaPheAspAspPheAspGlySerArgPheArgArg-103
a650
AMPHI Regions - AMPHI
SEQ. ID. NO. 21917  15-SerValCysProGly-19
SEQ. ID. NO. 21918  57-LeuTrpSerGluLeuArgGln-63
SEQ. ID. NO. 21919  72-ProGluLeuValArgArgHisGlu-79
SEQ. ID. NO. 21920  89-PheAsnArgValIleAsn-94
SEQ. ID. NO. 21921  137-SerGlyLeuTrpGln-141
SEQ. ID. NO. 21922  173-AsnTyrLeuGlnTyrLeuTyrGlyLeuPheGlyAspTrpPro-186
SEQ. ID. NO. 21923  198-AsnValGlyArgAlaIleAsnArgAlaArg-207
SEQ. ID. NO. 21924  218-LeuArgMetProAsnGluThr-224
SEQ. ID. NO. 21925  269-GluAlaIleAlaArgLeuAlaGlyIleThrGlnSer-280
SEQ. ID. NO. 21926  314-SerAsnTyrLeuAsnAlaAlaProAsp-322
SEQ. ID. NO. 21927  341-IleSerThrAlaThrGlyMet-347
SEQ. ID. NO. 21928  349-IleAlaAspIleLysArgLeuAsnAsnLeu-358
SEQ. ID. NO. 21929  376-LysThrLeuGlnThrAlaSerGlu-383
SEQ. ID. NO. 21930  433-ValArgThrXxxThr-437
Antigenic Index - Jameson-Wolf
SEQ. ID. NO. 21931  1-MetSerLysLeuLys-5
SEQ. ID. NO. 21932  24-GlnAsnThrSerSerHis-29
SEQ. ID. NO. 21933  38-LeuAsnSerSerIleLeuAspLeuProProThrLysGlnTyrPhe-52

TABLE 1-continued

| | |
|---|---|
| SEQ. ID. NO. 21934 | 59-SerGluLeuArgGlnGlyPheArgMetGlyGluValAsnProGluLeuValArgArgHisGluSerLysPheIle-83 |
| SEQ. ID. NO. 21935 | 92-ValIleAsnArgSerArgProTyr-99 |
| SEQ. ID. NO. 21936 | 105-AsnGluValLysLysArgAsnMetProAla-114 |
| SEQ. ID. NO. 21937 | 128-ThrLysAlaLysSerHisValGlyAlaSerGly-138 |
| SEQ. ID. NO. 21938 | 145-AlaThrGlyArgHisTyrGlyLeuGluLysThrProValTyrAspGlyArgHisAspIle-164 |
| SEQ. ID. NO. 21939 | 192-TyrAsnTrpGlyGluGlyAsnValGlyArgAlaIleAsnArgAlaArgAlaGlnGlyLeuGluProThrTyrGluAsnLeuArgMetProAsnGluThrArgAsnTyrVal-228 |
| SEQ. ID. NO. 21940 | 247-AsnIleSerAspIleAspAsnLysProTyr-256 |
| SEQ. ID. NO. 21941 | 259-AlaValGluProAspArgProLeuAspAsnGluAlaIleAla-272 |
| SEQ. ID. NO. 21942 | 294-PheIleProLysSerLysArgLysLeu-302 |
| SEQ. ID. NO. 21943 | 318-AsnAlaAlaProAspSer-323 |
| SEQ. ID. NO. 21944 | 332-ProAlaAlaLysThrSerLeuSerAspIleSerThr-343 |
| SEQ. ID. NO. 21945 | 350-AlaAspIleLysArgLeuAsnAsnLeuAsnGly-360 |
| SEQ. ID. NO. 21946 | 370-LeuValAlaLysAsnGlyLysThrLeuGlnThrAlaSer-382 |
| SEQ. ID. NO. 21947 | 388-IleAspIleAspAsnThrProAsnThrTyrArgSerAsnMetProAlaGlyThr-405 |
| SEQ. ID. NO. 21948 | 411-AlaArgIleArgProAlaAla-417 |
| SEQ. ID. NO. 21949 | 428-LeuProGlnLysThrValArgThrXxxThrArgSerProCysProTyrCys-444 |
| SEQ. ID. NO. 21950 | 446-ThrCysProCysAspSerArgSerAlaThrSerAsnArgLysThrAspArgHisAlaVal-465 |
| Hydrophilic Regions - Hopp-Woods | |
| SEQ. ID. NO. 21951 | 1-MetSerLysLeuLys-5 |
| SEQ. ID. NO. 21952 | 61-LeuArgGlnGlyPheArgMetGlyGluValAsnProGluLeuValArgArgHisGluSerLysPhe-82 |
| SEQ. ID. NO. 21953 | 92-ValIleAsnArgSerArgPro-98 |
| SEQ. ID. NO. 21954 | 105-AsnGluValLysLysArgAsnMetProAla-114 |
| SEQ. ID. NO. 21955 | 128-ThrLysAlaLysSerHisVal-134 |
| SEQ. ID. NO. 21956 | 150-TyrGlyLeuGluLysThrProValTyrAspGlyArgHisAspIle-164 |
| SEQ. ID. NO. 21957 | 202-AlaIleAsnArgAlaArgAlaGlnGlyLeu-211 |
| SEQ. ID. NO. 21958 | 213-ProThrTyrGluAsnLeuArgMetProAsnGluThrArgAsnTyrVal-228 |
| SEQ. ID. NO. 21959 | 249-SerAspIleAspAsn-253 |
| SEQ. ID. NO. 21960 | 260-ValGluProAspArgProLeuAspAsnGluAlaIleAla-272 |
| SEQ. ID. NO. 21961 | 296-ProLysSerLysArgLysLeu-302 |
| SEQ. ID. NO. 21962 | 334-AlaLysThrSerLeu-338 |
| SEQ. ID. NO. 21963 | 350-AlaAspIleLysArgLeuAsn-356 |
| SEQ. ID. NO. 21964 | 373-LysAsnGlyLysThrLeuGlnThrAlaSer-382 |
| SEQ. ID. NO. 21965 | 389-AspIleAspAsnThrProAsnThrTyr-397 |
| SEQ. ID. NO. 21966 | 411-AlaArgIleArgPro-415 |
| SEQ. ID. NO. 21967 | 431-LysThrValArgThrXxxThrArgSer-439 |
| SEQ. ID. NO. 21968 | 447-CysProCysAspSerArgSerAlaThrSerAsnArgLysThrAspArgHisAlaVal-465 |
| a652-1 | |
| AMPHI Regions - AMPHI | |
| SEQ. ID. NO. 21969 | 6-AspIlePheAlaArg-10 |
| SEQ. ID. NO. 21970 | 52-ArgAspGlyAspLys-56 |
| SEQ. ID. NO. 21971 | 62-LysGlyValLeuLysAlaValGluHisValAsnAsnGlnIleAlaGlnAla-78 |
| SEQ. ID. NO. 21972 | 130-LeuTyrArgTyrLeuGlyGlyAlaGlyPro-39 |
| SEQ. ID. NO. 21973 | 149-ValIleAsnGlyGly-153 |
| SEQ. ID. NO. 21974 | 173-LysSerPheArgGluAlaLeuArgCys-181 |
| SEQ. ID. NO. 21975 | 184-GluIlePheHisAlaLeuLysLys-191 |
| SEQ. ID. NO. 21976 | 266-AlaGluPheAlaGluTyrLeuGluGlyLeuValAsn-277 |
| SEQ. ID. NO. 21977 | 323-AlaGluGlyIleGluLysGlyVal-330 |
| SEQ. ID. NO. 21978 | 338-ValAsnGlnIleGlyThrLeuSerGluThrLeuLysAlaValAspLeuAlaLys-355 |
| SEQ. ID. NO. 21979 | 377-AspLeuAlaValAla-381 |
| SEQ. ID. NO. 21980 | 391-SerLeuSerArgSerAspArgMetAlaLysTyrAsnGlnLeuLeuArgIleGluGluLeuAlaGluAlaAlaAspTyr-417 |
| Antigenic Index - Jameson-Wolf | |
| SEQ. ID. NO. 21981 | 11-GluIleLeuAspSerArgGlyAsnProThrValGlu-22 |
| SEQ. ID. NO. 21982 | 36-AlaValProSerGlyAlaSerThrGlyGlnLysGluAlaLeuGluLeuArgAspGlyAspLysSerArgTyrSerGlyLysGlyValLeuLysAlaValGluHisValAsn-72 |
| SEQ. ID. NO. 21983 | 83-AspAlaAsnGluGlnSerTyr-89 |
| SEQ. ID. NO. 21984 | 97-LeuAspGlyThrGluAsnLysGlyAsnLeuGly-107 |
| SEQ. ID. NO. 21985 | 121-AlaAlaAlaAspSerGlyLeuPro-129 |
| SEQ. ID. NO. 21986 | 135-GlyGlyAlaGlyProMet-140 |
| SEQ. ID. NO. 21987 | 151-AsnGlyGlyGluHisAlaAsnAsnSerAsn-161 |
| SEQ. ID. NO. 21988 | 173-LysSerPheArgGluAlaLeuArgCysGlyAla-183 |
| SEQ. ID. NO. 21989 | 190-LysLysLeuCysAspSerLysGlyPheProThrThrValGlyAspGluGlyGlyPhe-208 |
| SEQ. ID. NO. 21990 | 211-AsnLeuAsnSerHisLysGluAlaLeu-219 |
| SEQ. ID. NO. 21991 | 243-CysAlaSerSerGluPheTyrLysAspGlyLysTyrHisLeuGluAlaGluGlyArgSerTyrThrAsn-265 |
| SEQ. ID. NO. 21992 | 283-SerIleGluAspGlyMetAspGluAsnAspTrpGluGly-295 |
| SEQ. ID. NO. 21993 | 299-LeuThrGluLysLeuGlyGlyLys-306 |
| SEQ. ID. NO. 21994 | 309-LeuValGlyAspAspLeu-314 |
| SEQ. ID. NO. 21995 | 318-AsnProLysIleLeuAlaGluGlyIleGluLysGlyVal-330 |
| SEQ. ID. NO. 21996 | 352-AspLeuAlaLysArgAsnArgTyrAla-360 |
| SEQ. ID. NO. 21997 | 363-MetSerHisArgSerGlyGluThrGluAspSerThrIle-375 |
| SEQ. ID. NO. 21998 | 388-LysThrGlySerLeuSerArgSerAspArgMetAlaLys-400 |
| SEQ. ID. NO. 21999 | 405-LeuArgIleGluGluGluLeuAlaGluAlaAlaAspTyrProSerLys-420 |
| Hydrophilic Regions - Hopp-Woods | |
| SEQ. ID. NO. 22000 | 11-GluIleLeuAspSerArgGlyAsnProThrValGlu-22 |
| SEQ. ID. NO. 22001 | 43-ThrGlyGlnLysGluAlaLeuGluLeuArgAspGlyAspLysSerArgTyrSerGly-61 |
| SEQ. ID. NO. 22002 | 63-GlyValLeuLysAlaValGlu-69 |
| SEQ. ID. NO. 22003 | 97-LeuAspGlyThrGluAsnLysGlyAsnLeu-106 |
| SEQ. ID. NO. 22004 | 121-AlaAlaAlaGluAspSerGly-127 |
| SEQ. ID. NO. 22005 | 153-GlyGluHisAlaAsn-157 |
| SEQ. ID. NO. 22006 | 173-LysSerPheArgGluAlaLeuArgCysGlyAla-183 |

TABLE 1-continued

| SEQ. ID. NO. 22007 | 190-LysLysLeuCysAspSerLysGly-197 |
| --- | --- |
| SEQ. ID. NO. 22008 | 202-ValGlyAspGluGlyGlyPhe-208 |
| SEQ. ID. NO. 22009 | 213-AsnSerHisLysGluAlaLeu-219 |
| SEQ. ID. NO. 22010 | 247-GluPheTyrLysAspGlyLysTyrHisLeuGluAlaGluGlyArgSerTyrThr-264 |
| SEQ. ID. NO. 22011 | 283-SerIleGluAspGlyMetAspGluAsnAspTrpGluGly-295 |
| SEQ. ID. NO. 22012 | 299-LeuThrGluLysLeuGlyGly-305 |
| SEQ. ID. NO. 22013 | 321-IleLeuAlaGluGlyIleGluLysGlyVal-330 |
| SEQ. ID. NO. 22014 | 352-AspLeuAlaLysArgAsnArgTyr-359 |
| SEQ. ID. NO. 22015 | 364-SerHisArgSerGlyGluThrGluAspSerThrIle-375 |
| SEQ. ID. NO. 22016 | 391-SerLeuSerArgSerAspArgMetAlaLys-400 |
| SEQ. ID. NO. 22017 | 405-LeuArgIleGluGluGluLeuAlaGluAlaAlaAspTyrProSer-419 | a653
AMPHI Regions - AMPHI

| SEQ. ID. NO. 22018 | 6-MetArgMetProGluValThrLysGlyPheSerGlySer-18 |
| --- | --- |
| SEQ. ID. NO. 22019 | 60-ThrMetArgLysProArgLeuThr-67 |
| SEQ. ID. NO. 22020 | 75-AlaLeuIlePheThrCysPheAla-82 |
| SEQ. ID. NO. 22021 | 96-ThrAlaLeuAlaAlaIleThrCysIle-104 |
| SEQ. ID. NO. 22022 | 111-LeuGlyLysMetGluGluPheAsn-118 |

Antigenic Index - Jameson-Wolf

| SEQ. ID. NO. 22023 | 4-GluProMetArgMetProGluValThrLysGlyPheSerGlySer-18 |
| --- | --- |
| SEQ. ID. NO. 22024 | 45-GlyCysArgSerThrArgLysThr-52 |
| SEQ. ID. NO. 22025 | 56-ValArgProGluThrMetArgLysProArgLeuThrAsnSerSerAla-71 |
| SEQ. ID. NO. 22026 | 86-AsnSerGlyCysAsnAla-91 |
| SEQ. ID. NO. 22027 | 103-CysIleSerGlyProProCysArgLeuGlyLysMetGluGlu-116 |
| SEQ. ID. NO. 22028 | 125-SerArgHisLysIleThrProProArgGlyProArgArgVal-138 |
| SEQ. ID. NO. 22029 | 145-ThrLysSerGlnAsnGlyThrGly-152 |
| SEQ. ID. NO. 22030 | 154-GlyTyrSerProProAlaThrArgProAla-163 |

Hydrophilic Regions - Hopp-Woods

| SEQ. ID. NO. 22031 | 4-GluProMetArgMetProGluValThrLys-13 |
| --- | --- |
| SEQ. ID. NO. 22032 | 47-ArgSerThrArgLysThr-52 |
| SEQ. ID. NO. 22033 | 57-ArgProGluThrMetArgLysProArgLeuThrAsn-68 |
| SEQ. ID. NO. 22034 | 107-ProProCysArgLeuGlyLysMetGluGlu-116 |
| SEQ. ID. NO. 22035 | 126-ArgHisLysIleThrProProArgGlyProArg-136 |
| SEQ. ID. NO. 22036 | 158-ProAlaThrArgProAla-163 | a656
AMPHI Regions - AMPHI

| SEQ. ID. NO. 22037 | 14-MetAlaArgThrLeuGlyAlaProGlu-22 |
| --- | --- |
| SEQ. ID. NO. 22038 | 42-ArgArgProSerThr-46 |
| SEQ. ID. NO. 22039 | 92-LeuAlaSerLeuAsnLysSerCys-99 |

Antigenic Index - Jameson-Wolf

| SEQ. ID. NO. 22040 | 6-GlySerThrSerSer-10 |
| --- | --- |
| SEQ. ID. NO. 22041 | 19-GlyAlaProGluSerValProAlaGlyLysValAlaAla-31 |
| SEQ. ID. NO. 22042 | 40-SerPheArgArgProSerThrLeuGlu-48 |
| SEQ. ID. NO. 22043 | 74-ArgProThrSerLeuArgProLysSerIleAsn-84 |
| SEQ. ID. NO. 22044 | 94-SerLeuAsnLysSerCysSerLeuAlaArgSerSerAlaGlyValLeuProArgArgArgValProAla-116 |
| SEQ. ID. NO. 22045 | 120-ThrMetThrSerSerArgSerArgArgThrArgIleSerGlyGluGluProThrMetTrpLysSerProLysSer-144 |

Hydrophilic Regions - Hopp-Woods

| SEQ. ID. NO. 22046 | 40-SerPheArgArgProSerThr-46 |
| --- | --- |
| SEQ. ID. NO. 22047 | 76-ThrSerLeuArgProLysSer-82 |
| SEQ. ID. NO. 22048 | 99-CysSerLeuAlaArgSerSer-105 |
| SEQ. ID. NO. 22049 | 109-LeuProArgArgArgValProAla-116 |
| SEQ. ID. NO. 22050 | 121-MetThrSerSerArgSerArgArgThrArgIleSerGlyGluGluProThrMet-138 |
| SEQ. ID. NO. 22051 | 140-LysSerProLysSer-144 | a657
AMPHI Regions - AMPHI

| SEQ. ID. NO. 22052 | 9-ProAlaMetLeuGly-13 |
| --- | --- |
| SEQ. ID. NO. 22053 | 20-LeuGlyArgMetPheThr-25 |
| SEQ. ID. NO. 22054 | 62-ThrAlaLeuGluGluLeuAlaLysCysAlaAla-72 |
| SEQ. ID. NO. 22055 | 85-MetArgPheLeuAlaLys-90 |
| SEQ. ID. NO. 22056 | 140-PheLeuProGlyIleLeuLysThr-147 |
| SEQ. ID. NO. 22057 | 161-LysThrValAspGluLeuLysAla-168 |
| SEQ. ID. NO. 22058 | 178-CysValLeuGluLysMetValAsp-185 |
| SEQ. ID. NO. 22059 | 203-GlnThrPheAspProAlaGluAsnIle-211 |
| SEQ. ID. NO. 22060 | 232-GlnGlnAlaArgGlnMetAlaGlnArgLeuAlaAspGluLeuAsnTyrValGlyValLeu-251 |
| SEQ. ID. NO. 22061 | 279-HisThrValAspAlaCysAlaAla-286 |
| SEQ. ID. NO. 22062 | 314-AsnIleLeuGlyAsp-318 |

Antigenic Index - Jameson-Wolf

| SEQ. ID. NO. 22063 | 1-MetLysAsnIleSerLeu-6 |
| --- | --- |
| SEQ. ID. NO. 22064 | 16-GlyGlyGlyGlnLeuGlyArg-22 |
| SEQ. ID. NO. 22065 | 37-ValLeuAspProAsnProAsnAlaPro-45 |
| SEQ. ID. NO. 22066 | 57-ProPheAspAsnGlnThrAlaLeuGluGluLeuAlaLys-69 |
| SEQ. ID. NO. 22067 | 75-ThrGluPheGluAsnValAsnAlaAspAla-84 |
| SEQ. ID. NO. 22068 | 91-HisThrAsnValSerProSerGlyAsp-99 |
| SEQ. ID. NO. 22069 | 106-AsnArgIleGlnGluLysAlaTrpIle-114 |
| SEQ. ID. NO. 22070 | 128-CysLysAlaGluAspIleThrGluSerIle-138 |
| SEQ. ID. NO. 22071 | 150-LeuGlyTyrAspGlyLysGlyGlnIleArgValLysThrValAspGluLeuLysAlaAlaPheAlaGluHisArgGlyValAspCysValLeu-180 |
| SEQ. ID. NO. 22072 | 182-LysMetValAspLeuArgGlyGlyIle-190 |
| SEQ. ID. NO. 22073 | 196-ArgLeuAsnAsnAspAsnValGlnThrPheAspProAlaGluAsnIleHisGluAsnGly-215 |
| SEQ. ID. NO. 22074 | 230-IleGlnGlnGlnAlaArgGlnMetAla-238 |
| SEQ. ID. NO. 22075 | 269-IleAlaProArgProHisAsnSerGlyHisHis-279 |

TABLE 1-continued

| | |
|---|---|
| SEQ. ID. NO. 22076 | 288-GlnPheGlnGlnGlnVal-293 |
| SEQ. ID. NO. 22077 | 300-ProProAlaAspThrLysLeuLeuSer-308 |
| SEQ. ID. NO. 22078 | 319-ValTrpGlnGluAspGlyGlyGluProAspTrp-329 |
| SEQ. ID. NO. 22079 | 331-ProLeuGlnSerArgProAlaHis-339 |
| SEQ. ID. NO. 22080 | 344-GlyLysLysThrAlaHisLysGlyArgLysMetGly-355 |
| SEQ. ID. NO. 22081 | 360-LeuSerThrAspSerAspThrAlaPheGlnGluAlaLysLysLeuHis-375 |
| Hydrophilic Regions - Hopp-Woods | |
| SEQ. ID. NO. 22082 | 62-ThrAlaLeuGluGluLeuAlaLys-69 |
| SEQ. ID. NO. 22083 | 75-ThrGluPheGluAsnValAsn-81 |
| SEQ. ID. NO. 22084 | 128-CysLysAlaGluAspIleThrGluGluSerIle-138 |
| SEQ. ID. NO. 22085 | 152-TyrAspGlyLysGlyGlnIleArgValLysThrValAspGluLeuLysAlaAlaPheAlaGluHisArgGlyValAspCysValLeu-180 |
| SEQ. ID. NO. 22086 | 182-LysMetValAspLeuArgGlyGluIle-190 |
| SEQ. ID. NO. 22087 | 197-LeuAsnAsnAspAsn-201 |
| SEQ. ID. NO. 22088 | 206-AspProAlaGluAsnIleHis-212 |
| SEQ. ID. NO. 22089 | 230-IleGlnGlnGlnAlaArgGlnMetAla-238 |
| SEQ. ID. NO. 22090 | 269-IleAlaProArgProHisAsn-275 |
| SEQ. ID. NO. 22091 | 301-ProAlaAspThrLysLeu-306 |
| SEQ. ID. NO. 22092 | 320-TrpGlnGluAspGlyGlyGluProAsp-328 |
| SEQ. ID. NO. 22093 | 334-SerArgProAspAla-338 |
| SEQ. ID. NO. 22094 | 344-GlyLysLysThrAlaHisLysGlyArgLysMetGly-355 |
| SEQ. ID. NO. 22095 | 362-ThrAspSerAspThrAlaPheGlnGluAlaLysLysLeuHis-375 |
| a658 | |
| AMPHI Regions - AMPHI | |
| SEQ. ID. NO. 22096 | 28-ArgGlnTyrAlaAspValValGlnPheIleGlyGlnThrLeuArgHisLeuSerArgLeuLeuLeuAsn-50 |
| SEQ. ID. NO. 22097 | 57-TrpAspAspGlyVal-61 |
| SEQ. ID. NO. 22098 | 68-ValAsnValPheGlyArgIleGluSer-76 |
| SEQ. ID. NO. 22099 | 94-GlnValHisHisPhePheGlnAsnAlaIleHisAla-105 |
| SEQ. ID. NO. 22100 | 128-IleAlaGlnCysSerGlyPheGlnAspAlaGlyGln-139 |
| SEQ. ID. NO. 22101 | 143-AlaPhePheSerAspValPheGly-150 |
| Antigenic Index - Jameson-Wolf | |
| SEQ. ID. NO. 22102 | 6-ValArgThrArgArgAspPheValAspAspGlnPheMetArgValAlaAspAsnLysHisPhe-26 |
| SEQ. ID. NO. 22103 | 55-SerGlyTrpAspAspGlyValGlyGluAspThrVal-66 |
| SEQ. ID. NO. 22104 | 72-GlyArgIleGluSer-76 |
| SEQ. ID. NO. 22105 | 84-ThrAlaTyrAspAsnGlyAsn-90 |
| SEQ. ID. NO. 22106 | 108-PheGlyLysArgGlyPhe-113 |
| SEQ. ID. NO. 22107 | 131-CysSerGlyPheGlnAspAlaGlyGlnLys-140 |
| SEQ. ID. NO. 22108 | 155-LeuIleArgArgGlyLeuGln-161 |
| SEQ. ID. NO. 22109 | 174-ValLeuArgAspGlyAsnAla-180 |
| SEQ. ID. NO. 22110 | 189-MetPheGlyGluLysThrHisArgIleGly-198 |
| SEQ. ID. NO. 22111 | 202-PheGluLeuGlyArgAsnSerArgThr-210 |
| SEQ. ID. NO. 22112 | 216-GlnSerGlyLeuValValLysArgArgThrGln-226 |
| SEQ. ID. NO. 22113 | 230-GlyLysPheArgCysArgArgIleArgVal-239 |
| SEQ. ID. NO. 22114 | 251-PheGlySerAsnSerLysHisSerAla-259 |
| Hydrophilic Regions - Hopp-Woods | |
| SEQ. ID. NO. 22115 | 6-ValArgThrArgArgAspPheValAsp-14 |
| SEQ. ID. NO. 22116 | 16-GlnPheMetArgValAlaAspAsnLysHisPhe-26 |
| SEQ. ID. NO. 22117 | 56-GlyTrpAspAspGlyValGlyGluAspThrVal-66 |
| SEQ. ID. NO. 22118 | 72-GlyArgIleGluSer-76 |
| SEQ. ID. NO. 22119 | 135-GlnAspAlaGlyGln-139 |
| SEQ. ID. NO. 22120 | 174-ValLeuArgAspGlyAsnAla-180 |
| SEQ. ID. NO. 22121 | 190-PheGlyGluLysThrHisArgIleGly-198 |
| SEQ. ID. NO. 22122 | 203-GluLeuGlyArgAsnSerArg-209 |
| SEQ. ID. NO. 22123 | 220-ValValLysArgArgThrGln-226 |
| SEQ. ID. NO. 22124 | 230-GlyLysPheArgCysArgArgIleArgVal-239 |
| SEQ. ID. NO. 22125 | 253-SerAsnSerLysHisSerAla-259 |
| a661 | |
| AMPHI Regions - AMPHI | |
| SEQ. ID. NO. 22126 | 19-GlyIleThrAspLysProPheArgArgLeuCysArgAspPheGlyAlaGly-35 |
| SEQ. ID. NO. 22127 | 37-AlaValCysGluMetLeu-42 |
| SEQ. ID. NO. 22128 | 75-AspProGlnGlnMetAlaAspAlaAla-83 |
| SEQ. ID. NO. 22129 | 122-AlaAlaIleLeuGluAlaValValLys-130 |
| SEQ. ID. NO. 22130 | 152-ProValIleAlaLysIleAlaGlu-159 |
| SEQ. ID. NO. 22131 | 222-TyrAspArgAlaArgArg-227 |
| SEQ. ID. NO. 22132 | 235-ProArgPheGluThrLeuArgArgThrArgCys-245 |
| SEQ. ID. NO. 22133 | 248-AlaCysLeuGluPheGlyArgMetTyrArgHisTyrPheGluPro-262 |
| SEQ. ID. NO. 22134 | 267-AlaArgValLeuArgArgHis-273 |
| Antigenic Index - Jameson-Wolf | |
| SEQ. ID. NO. 22135 | 20-IleThrAspLysProPheArgArgLeuCysArgAspPheGlyAlaGly-35 |
| SEQ. ID. NO. 22136 | 42-LeuThrSerAspProThrLeuArgAsnThrArgLysThrLeuHisArgSerAspPheAlaAspGluGlyGly-65 |
| SEQ. ID. NO. 22137 | 72-AlaGlySerAspProGlnGlnMetAlaAspAlaAlaArg-84 |
| SEQ. ID. NO. 22138 | 97-AsnMetGlyCysProAlaLysLysValCys-106 |
| SEQ. ID. NO. 22139 | 143-GlyTrpHisAspAspHisGlnAsnLeu-151 |
| SEQ. ID. NO. 22140 | 157-IleAlaGluAspCysGly-162 |
| SEQ. ID. NO. 22141 | 168-XxxProArgThrHisAla-173 |
| SEQ. ID. NO. 22142 | 176-AsnValGlnArgArgSerGlyLeuArgProAspCysArgAsnGlnMetProSerGluHisProGlyLeuGlyGlnArgArgHisTyrLeuAlaAlaLysSerProSerArgProGlnThrAsnArgArgArgArgHisTyrAspArgAlaArgArgAlaArgGln-230 |

TABLE 1-continued

| | |
|---|---|
| SEQ. ID. NO. 22143 | 235-ProArgPheGluThrLeuArgArgThrArgCysPhe-246 |
| SEQ. ID. NO. 22144 | 256-TyrArgHisTyrPheGluProHisProSerHisAlaArgValLeuArgArgHisArgArgCysAlaHisArgThrGlnThrHisArgLeuValHisArgArgAsnAlaArgArgArgThrAspThrSer-298 |

Hydrophilic Regions - Hopp-Woods

| | |
|---|---|
| SEQ. ID. NO. 22145 | 20-IleThrAspLysProPheArgArgLeuCysArgAspPhe-32 |
| SEQ. ID. NO. 22146 | 46-ProThrLeuArgAsnThrArgLysThrLeuHisArgSerAspPheAlaAspGluGlyGly-65 |
| SEQ. ID. NO. 22147 | 73-GlySerAspProGlnGlnMetAlaAspAlaAlaArg-84 |
| SEQ. ID. NO. 22148 | 100-CysProAlaLysLysValCys-106 |
| SEQ. ID. NO. 22149 | 157-IleAlaGluAspCysGly-162 |
| SEQ. ID. NO. 22150 | 176-AsnValGlnArgArgSerGlyLeuArgProAspCysArgAsnGlnMetProSerGluHisProGlyLeuGlyGlnArgArgHisTyrLeu-205 |
| SEQ. ID. NO. 22151 | 208-LysSerProSerArgProGlnThrAsnArgArgArgArgHisTyrAspArgAlaArgArgAlaArgGln-230 |
| SEQ. ID. NO. 22152 | 238-GluThrLeuArgThrArgCys-245 |
| SEQ. ID. NO. 22153 | 268-ArgValLeuArgArgHisArgArgCysAlaHisArgThrGlnThr-282 |
| SEQ. ID. NO. 22154 | 285-LeuValHisArgArgAsnAlaArgArgArgThrAspThrSer-298 | a663
AMPHI Regions - AMPHI

| | |
|---|---|
| SEQ. ID. NO. 22155 | 19-ProPheAlaLeuLeuHisLysLeuAlaAspLeuThrGlyLeuLeuAlaTyr-35 |
| SEQ. ID. NO. 22156 | 66-LysGlnHisPheLysHisMetAlaLysLeu-75 |
| SEQ. ID. NO. 22157 | 87-AlaGlyArgLeuLysSerLeuValArg-95 |
| SEQ. ID. NO. 22158 | 168-GluGlyLeuArgAlaLeuValLysGlnPheArgLys-179 |
| SEQ. ID. NO. 22159 | 209-ThrIleThrGlyLeuSerArgIleAlaAlaLeuAlaAsn-221 |
| SEQ. ID. NO. 22160 | 243-ProAlaTrpGluSer-247 |
| SEQ. ID. NO. 22161 | 258-GlnArgMetAsnArgPheIleGluGluArgValArgGluHis-271 |

Antigenic Index - Jameson-Wolf

| | |
|---|---|
| SEQ. ID. NO. 22162 | 38-ValLysProArgArgArgIleGlyGlu-46 |
| SEQ. ID. NO. 22163 | 56-TrpAspGlyLysLysArgLysThrValLeu-65 |
| SEQ. ID. NO. 22164 | 87-AlaGlyArgLeuLysSer-92 |
| SEQ. ID. NO. 22165 | 94-ValArgTyrArgAsnLysHisTyrLeuAsp-103 |
| SEQ. ID. NO. 22166 | 105-AlaLeuAlaAlaGlyGluLys-111 |
| SEQ. ID. NO. 22167 | 139-TyrSerHisGlnLysAsnLysIleLeuAsp-148 |
| SEQ. ID. NO. 22168 | 150-GlnIleLeuLysGlyArgAsnArgTyr-158 |
| SEQ. ID. NO. 22169 | 166-ArgThrGluGlyLeuArgAlaLeu-173 |
| SEQ. ID. NO. 22170 | 175-LysGlnPheArgLysSerSerAla-182 |
| SEQ. ID. NO. 22171 | 188-ProAspGlnAspPheGlyArgAsnAspSerVal-198 |
| SEQ. ID. NO. 22172 | 229-ProValArgGluAlaAspAsnThr-236 |
| SEQ. ID. NO. 22173 | 243-ProAlaTrpGluSerPheProSerGluAspAlaGlnAlaAspAlaGlnArgMetAsnArgPheIleGluGluArgValArgGluHisProGlu-273 |
| SEQ. ID. NO. 22174 | 280-LysArgPheLysThrArgProGluGlySerProAspPheTyr-293 |

Hydrophilic Regions - Hopp-Woods

| | |
|---|---|
| SEQ. ID. NO. 22175 | 39-LysProArgArgArgIleGlyGlu-46 |
| SEQ. ID. NO. 22176 | 56-TrpAspGlyLysLysArgLysThrValLeu-65 |
| SEQ. ID. NO. 22177 | 88-GlyArgLeuLysSer-92 |
| SEQ. ID. NO. 22178 | 94-ValArgTyrArgAsn-98 |
| SEQ. ID. NO. 22179 | 105-AlaLeuAlaAlaGlyGluLys-111 |
| SEQ. ID. NO. 22180 | 142-GlnLysAsnLysIleLeuAsp-148 |
| SEQ. ID. NO. 22181 | 150-GlnIleLeuLysGlyArgAsnArgTyr-158 |
| SEQ. ID. NO. 22182 | 166-ArgThrGluGlyLeuArgAlaLeu-173 |
| SEQ. ID. NO. 22183 | 176-GlnPheArgLysSerSer-181 |
| SEQ. ID. NO. 22184 | 190-GlnAspPheGlyArgAsnAspSerVal-198 |
| SEQ. ID. NO. 22185 | 229-ProValArgGluAlaAspAsn-235 |
| SEQ. ID. NO. 22186 | 248-PheProSerGluAspAlaGlnAlaAspAlaGlnArgMetAsnArgPheIleGluGluArgValArgGluHisProGlu-273 |
| SEQ. ID. NO. 22187 | 280-LysArgPheLysThrArgProGluGlySerPro-290 | a664
AMPHI Regions - AMPHI

| | |
|---|---|
| SEQ. ID. NO. 22188 | 28-AlaHisArgMetCys-32 |
| SEQ. ID. NO. 22189 | 47-AlaAspValPheAspThrAlaHisGlyAlaAlaGly-58 |
| SEQ. ID. NO. 22190 | 88-AlaArgProValValGluIle-94 |

Antigenic Index - Jameson-Wolf

| | |
|---|---|
| SEQ. ID. NO. 22191 | 25-SerGlyGlyAlaHisArgMetCysGlyArg-34 |
| SEQ. ID. NO. 22192 | 48-AspValPheAspThrAlaHisGly-55 |
| SEQ. ID. NO. 22193 | 73-PheLeuGlnArgLysLeuGluPro-80 |
| SEQ. ID. NO. 22194 | 108-IleGlyGlyGlyThrAlaValGlyLysAspGluLeuGlyValLysAspValGln-125 |
| SEQ. ID. NO. 22195 | 137-AlaHisGlyAspAspHisGluAsn-144 |
| SEQ. ID. NO. 22196 | 164-AlaIleProArgGlnSerArgProTrp-172 |
| SEQ. ID. NO. 22197 | 175-ProLeuArgTrpCysLysThrArgPhe-183 |

Hydrophilic Regions - Hopp-Woods

| | |
|---|---|
| SEQ. ID. NO. 22198 | 74-LeuGlnArgLysLeuGluPro-80 |
| SEQ. ID. NO. 22199 | 113-AlaValGlyLysAspGluLeuGlyValLysAspValGln-125 |
| SEQ. ID. NO. 22200 | 137-AlaHisGlyAspAspHisGluAsn-144 |
| SEQ. ID. NO. 22201 | 166-ProArgGlnSerArg-170 | a665-1
AMPHI Regions - AMPHI

| | |
|---|---|
| SEQ. ID. NO. 22202 | 6-HisTyrLeuLysAspTyrGln-12 |
| SEQ. ID. NO. 22203 | 105-LeuTyrAlaSerAla-109 |
| SEQ. ID. NO. 22204 | 111-AsnLeuPheThrGlnCysGluProGlyPheArgLysIleThr-125 |
| SEQ. ID. NO. 22205 | 132-AspValMetSerLysPheThrThrThr-140 |
| SEQ. ID. NO. 22206 | 167-ArgHisTrpValLysTrpGluAspProPhe-176 |
| SEQ. ID. NO. 22207 | 225-SerLeuLysAsnAlaMetLys-231 |
| SEQ. ID. NO. 22208 | 286-GlyIleGluSerValVal-291 |
| SEQ. ID. NO. 22209 | 294-GluTyrPheHisAsnTrpThr-300 |
| SEQ. ID. NO. 22210 | 307-ArgAspTrpPheGlnLeuSerLeu-314 |

TABLE 1-continued

| | |
|---|---|
| SEQ. ID. NO. 22211 | 329-AspArgAlaSerArgAlaValArgArgIleGluAsnIleArgLeuLeuArgGln-346 |
| SEQ. ID. NO. 22212 | 360-ValArgProAlaArgTyrGluGluMetAsnAsnPheTyrThr-373 |
| SEQ. ID. NO. 22213 | 380-GlyAlaGluValValArgMetTyrHisThrLeu-390 |
| SEQ. ID. NO. 22214 | 396-PheGlnLysGlyMetLys-401 |
| SEQ. ID. NO. 22215 | 520-ThrGluAlaValValProSerLeuLeuArgGlyPheSerAlaPro-534 |
| SEQ. ID. NO. 22216 | 555-AspAlaPheThrArgTrpGluAlaAlaGln-564 |
| SEQ. ID. NO. 22217 | 575-LeuAlaAlaLeuSerAspGlyValGluLeuProLysHisGluLysLeuLeuAlaAlaValGlu-595 |
| SEQ. ID. NO. 22218 | 603-LeuAspAsnAlaPheLysAlaLeu-610 |
| SEQ. ID. NO. 22219 | 622-AspGlyAlaGluAsnIleAspProLeu-630 |
| SEQ. ID. NO. 22220 | 648-LeuProLysTrpHisGluLeuAsnArg-656 |
| SEQ. ID. NO. 22221 | G674-lyTrpArgThrLeuArgAsnValCysArgAla-684 |
| SEQ. ID. NO. 22222 | 696-ThrValAlaGluLysTyrAlaGluMetAlaGlnAsnMet-708 |
| SEQ. ID. NO. 22223 | 712-TrpGlyIleLeuSer-716 |
| SEQ. ID. NO. 22224 | 728-ArgLeuLeuAlaGlnPheAlaAspLysPheSer-738 |
| SEQ. ID. NO. 22225 | 758-AspThrLeuGlnGlnValGlnThrAla-766 |
| SEQ. ID. NO. 22226 | 782-SerLeuIleGlySerPheSerArgAsnVal-791 |
| SEQ. ID. NO. 22227 | 822-ArgLeuValGlnAlaPheAsnLeuCysAsnLysLeu-833 |
| Antigenic Index - Jameson-Wolf | |
| SEQ. ID. NO. 22228 | 8-LeuLysAspTyrGlnThrProAlaTyr-16 |
| SEQ. ID. NO. 22229 | 26-AspIleAsnGluPro-30 |
| SEQ. ID. NO. 22230 | 34-ValLysSerArgLeuThrValGluProLysArgValGlyGlu-47 |
| SEQ. ID. NO. 22231 | 49-LeuValLeuAspGlySerAla-55 |
| SEQ. ID. NO. 22232 | 79-AlaAspValProSerGluArgPheThrVal-88 |
| SEQ. ID. NO. 22233 | 90-ValGluThrGluIleLeuProAlaGluAsnLysSerLeu-102 |
| SEQ. ID. NO. 22234 | 114-ThrGlnCysGluProGluGlyPheArgLys-123 |
| SEQ. ID. NO. 22235 | 128-IleAspArgProAspValMetSer-135 |
| SEQ. ID. NO. 22236 | 142-ValAlaAspLysLysArgTyrPro-149 |
| SEQ. ID. NO. 22237 | 154-AsnGlyAsnLysIleAspGlyGlyGluTyrSerAspGlyArgHisTrpValLysTrpGluAspProPheAlaLysProSer-180 |
| SEQ. ID. NO. 22238 | 191-AlaValThrGluAspTyr-196 |
| SEQ. ID. NO. 22239 | 200-MetSerGlyArgAsnValLysIle-207 |
| SEQ. ID. NO. 22240 | 211-ThrThrGluAlaAspLysProLysVal-219 |
| SEQ. ID. NO. 22241 | 230-MetLysTrpAspGluThrArgPhe-237 |
| SEQ. ID. NO. 22242 | 255-AsnMetGlyAlaMetGluAsnLysGlyLeu-264 |
| SEQ. ID. NO. 22243 | 275-AspSerArgThrAlaThrAspThrAspPheGluGlyIleGlu-288 |
| SEQ. ID. NO. 22244 | 295-TyrPheHisAsnTrpThrGlyAsnArgValThrCysArgAspTrp-309 |
| SEQ. ID. NO. 22245 | 313-SerLeuLysGluGly-317 |
| SEQ. ID. NO. 22246 | 322-ArgAspGlnGluPheSerGlyAspArgAlaSerArgAlaValArgArgIleGluAsn-340 |
| SEQ. ID. NO. 22247 | 347-HisGlnPheProGluAspAlaGlyProThrAlaHisProValArgProAlaArgTyrGluGluMetAsn-369 |
| SEQ. ID. NO. 22248 | 376-ValTyrGluLysGlyAlaGluVal-383 |
| SEQ. ID. NO. 22249 | 394-GluGlyPheGlnLysGlyMet-400 |
| SEQ. ID. NO. 22250 | 404-PheGlnArgHisAspGlyGlnAlaValThrCysAspAspPheArg-418 |
| SEQ. ID. NO. 22251 | 437-SerGlnAlaGlyThrPro-442 |
| SEQ. ID. NO. 22252 | 446-AlaGlnGlyArgLeuLysAsnAsnVal-454 |
| SEQ. ID. NO. 22253 | 459-IleLysGlnThrValProProThrProAspMetAlaAspLysGlnPro-474 |
| SEQ. ID. NO. 22254 | 485-AsnCysAsnGlyGluAlaVal-491 |
| SEQ. ID. NO. 22255 | 494-AspTyrGlnGlyLysArgAlaThrGlu-502 |
| SEQ. ID. NO. 22256 | 509-GluAlaGluGlnThrPhe-514 |
| SEQ. ID. NO. 22257 | 537-LeuAsnTyrProTyrSerAspAspAspLeu-546 |
| SEQ. ID. NO. 22258 | 552-HisAspSerAspAla-556 |
| SEQ. ID. NO. 22259 | 578-LeuSerAspGlyValGluLeuProLysHisGluLysLeu-590 |
| SEQ. ID. NO. 22260 | 594-ValGluLysValIleSerAspAspLeuLeu-603 |
| SEQ. ID. NO. 22261 | 614-ValProSerGluAlaGluLeuTrpAspGlyAlaGluAsnIleAspProLeuArg-631 |
| SEQ. ID. NO. 22262 | 633-HisGlnAlaArgGluAlaLeu-639 |
| SEQ. ID. NO. 22263 | 652-HisGluLeuAsnArgGlnAlaAlaLysGlnGluAsnGlnSerTyrGluTyrSerProGluAlaAlaGly-674 |
| SEQ. ID. NO. 22264 | 677-ThrLeuArgAsnValCys-682 |
| SEQ. ID. NO. 22265 | 689-AlaAspProAlaHis-693 |
| SEQ. ID. NO. 22266 | 696-ThrValAlaGluLysTyrAlaGlu-703 |
| SEQ. ID. NO. 22267 | 719-AsnGlyAsnGluSerAspThrArgAsnArgLeu-729 |
| SEQ. ID. NO. 22268 | 733-PheAlaAspLysPheSerAspAspAlaLeuVal-743 |
| SEQ. ID. NO. 22269 | 752-GlySerSerArgArgSerAspThrLeuGln-761 |
| SEQ. ID. NO. 22270 | 768-GlnHisProLysPheSerLeuGluAsnProAsnLysAlaArgSer-782 |
| SEQ. ID. NO. 22271 | 785-GlySerPheSerArgAsnValPro-792 |
| SEQ. ID. NO. 22272 | 795-HisAlaGluAspGlySerGlyTyrArgPheIleAla-806 |
| SEQ. ID. NO. 22273 | 808-LysValIleGluIleAspArgPheAsnProGlnVal-819 |
| SEQ. ID. NO. 22274 | 831-AsnLysLeuGluProHisArgLysAsnLeuVal-841 |
| SEQ. ID. NO. 22275 | 844-AlaLeuGlnArgIleArgAlaGlnGluGlyLeuSerLysAspValGlyGluIleVal-862 |
| Hydrophilic Regions - Hopp-Woods | |
| SEQ. ID. NO. 22276 | 34-ValLysSerArgLeuThrValGluProLysArgValGlyGlu-47 |
| SEQ. ID. NO. 22277 | 81-ValProSerGluArgPheThrVal-88 |
| SEQ. ID. NO. 22278 | 90-ValGluThrGluIleLeuProAlaGluAsnLysSer-101 |
| SEQ. ID. NO. 22279 | 116-CysGluProGluGlyPheArg-122 |
| SEQ. ID. NO. 22280 | 129-AspArgProAspValMetSer-135 |
| SEQ. ID. NO. 22281 | 142-ValAlaAspLysLysArgTyr-148 |
| SEQ. ID. NO. 22282 | 154-AsnGlyAsnLysIleAspGlyGlyGluTyrSerAspGlyArgHis-168 |
| SEQ. ID. NO. 22283 | 170-ValLysTrpGluAspProPheAla-177 |
| SEQ. ID. NO. 22284 | 201-SerGlyArgAsnValLys-206 |
| SEQ. ID. NO. 22285 | 213-GluAlaAspLysProLysVal-219 |
| SEQ. ID. NO. 22286 | 230-MetLysTrpAspGluThrArgPhe-237 |
| SEQ. ID. NO. 22287 | 258-AlaMetGluAsnLysGly-263 |
| SEQ. ID. NO. 22288 | 275-AspSerArgThrAlaThrAspThrAspPheGluGlyIleGlu-288 |

TABLE 1-continued

| | |
|---|---|
| SEQ. ID. NO. 22289 | 313-SerLeuLysGluGly-317 |
| SEQ. ID. NO. 22290 | 322-ArgAspGlnGluPheSerGlyAspArgAlaSerArgAlaValArgArgIleGluAsn-340 |
| SEQ. ID. NO. 22291 | 348-GlnPheProGluAspAlaGlyPro-355 |
| SEQ. ID. NO. 22292 | 361-ArgProAlaArgTyrGluGluMetAsn-369 |
| SEQ. ID. NO. 22293 | 376-ValTyrGluLysGlyAlaGluVal-383 |
| SEQ. ID. NO. 22294 | 394-GluGlyPheGlnLysGlyMet-400 |
| SEQ. ID. NO. 22295 | 406-ArgHisAspGlyGln-410 |
| SEQ. ID. NO. 22296 | 413-ThrCysAspAspPheArg-418 |
| SEQ. ID. NO. 22297 | 446-AlaGlnGlyArgLeuLysAsnAsnVal-454 |
| SEQ. ID. NO. 22298 | 467-ProAspMetAlaAspLysGlnPro-474 |
| SEQ. ID. NO. 22299 | 495-TyrGlnGlyLysArgAlaThrGlu-502 |
| SEQ. ID. NO. 22300 | 541-TyrSerAspAspAspLeu-546 |
| SEQ. ID. NO. 22301 | 552-HisAspSerAspAla-556 |
| SEQ. ID. NO. 22302 | 580-AspGlyValGluLeuProLysHisGluLysLeu-590 |
| SEQ. ID. NO. 22303 | 594-ValGluLysValIleSer-599 |
| SEQ. ID. NO. 22304 | 616-SerGluAlaGluLeu-620 |
| SEQ. ID. NO. 22305 | 622-AspGlyAlaGluAsnIleAspPro-629 |
| SEQ. ID. NO. 22306 | 633-HisGlnAlaArgGluAlaLeu-639 |
| SEQ. ID. NO. 22307 | 652-HisGluLeuAsnArgGlnAlaAlaLysGlnGluAsnGlnSer-665 |
| SEQ. ID. NO. 22308 | 689-AlaAspProAlaHis-693 |
| SEQ. ID. NO. 22309 | 696-ThrValAlaGluLysTyrAlaGlu-703 |
| SEQ. ID. NO. 22310 | 719-AsnGlyAsnGluSerAspThrArgAsnArgLeu-729 |
| SEQ. ID. NO. 22311 | 733-PheAlaAspLysPheSerAsp-739 |
| SEQ. ID. NO. 22312 | 753-SerSerArgArgSerAspThr-759 |
| SEQ. ID. NO. 22313 | 776-AsnProAsnLysAlaArgSer-782 |
| SEQ. ID. NO. 22314 | 795-HisAlaGluAspGlySerGly-801 |
| SEQ. ID. NO. 22315 | 808-LysValIleGluIleAspArgPheAsn-816 |
| SEQ. ID. NO. 22316 | 831-AsnLysLeuGluProHisArgLysAsnLeuVal-841 |
| SEQ. ID. NO. 22317 | 844-AlaLeuGlnArgIleArgAlaGlnGluGlyLeuSerLysAspValGlyGluIleVal-862 | a666
AMPHI Regions - AMPHI

| | |
|---|---|
| SEQ. ID. NO. 22318 | 89-GlyTyrAspIleLeuLysGlnGlyGlySer-98 |
| SEQ. ID. NO. 22319 | 162-LeuLysPheMetGluAlaVal-168 |

Antigenic Index - Jameson-Wolf

| | |
|---|---|
| SEQ. ID. NO. 22320 | 5-AsnHisGlnSerAsnSerGlyGluGlyValLeu-15 |
| SEQ. ID. NO. 22321 | 40-AsnGlnGlyLysValAsnThr-46 |
| SEQ. ID. NO. 22322 | 54-AlaAspAlaHisThrProGluHisAlaThr-63 |
| SEQ. ID. NO. 22323 | 65-LeuThrGluGlnLysGln-70 |
| SEQ. ID. NO. 22324 | 92-IleLeuLysGlnGlyGlySerAlaAla-100 |
| SEQ. ID. NO. 22325 | 114-GluProGlnSerSerGlyLeuGlyGly-122 |
| SEQ. ID. NO. 22326 | 130-AspAsnThrAlaLysThr-135 |
| SEQ. ID. NO. 22327 | 137-ThrThrPheAspGlyArgGluThrAlaPro-146 |
| SEQ. ID. NO. 22328 | 154-PheLeuAspLysAspGlyGlnPro-161 |

Hydrophilic Regions - Hopp-Woods

| | |
|---|---|
| SEQ. ID. NO. 22329 | 8-SerAsnSerGlyGlu-12 |
| SEQ. ID. NO. 22330 | 40-AsnGlnGlyLysValAsnThr-46 |
| SEQ. ID. NO. 22331 | 55-AspAlaHisThrProGluHis-61 |
| SEQ. ID. NO. 22332 | 65-LeuThrGluGlnLysGln-70 |
| SEQ. ID. NO. 22333 | 96-GlyGlySerAlaAla-100 |
| SEQ. ID. NO. 22334 | 139-PheAspGlyArgGluThrAlaPro-146 |
| SEQ. ID. NO. 22335 | 154-PheLeuAspLysAspGlyGlnPro-161 | a667
AMPHI Regions - AMPHI

| | |
|---|---|
| SEQ. ID. NO. 22336 | 49-IleAlaAspPheLeuGlnProAlaArgValGluArgLeuProHisLeuAlaAla-66 |
| SEQ. ID. NO. 22337 | 74-LysThrAlaGlnPhe-78 |
| SEQ. ID. NO. 22338 | 115-IleAlaAlaValAlaGluIle-121 |
| SEQ. ID. NO. 22339 | 128-IleAlaArgGlyValAspAlaValGlnArg-137 |
| SEQ. ID. NO. 22340 | 152-ThrAspGlnLeuArgArgMetPhePheAsnGlnLeuGluLysPheGlyAspAsnHis-170 |
| SEQ. ID. NO. 22341 | 174-ValIleHisLeuAlaAspCysThrAsp-182 |
| SEQ. ID. NO. 22342 | 201-LysMetMetLeuHisLysIleProThrArgLeu-211 |

Antigenic Index - Jameson-Wolf

| | |
|---|---|
| SEQ. ID. NO. 22343 | 11-IleValSerAspProLeuAsp-17 |
| SEQ. ID. NO. 22344 | 27-SerAlaAlaAspGlnThrGluThrGln-35 |
| SEQ. ID. NO. 22345 | 56-AlaArgValGluArgLeuPro-62 |
| SEQ. ID. NO. 22346 | 71-LeuAlaArgLysThrAlaGln-77 |
| SEQ. ID. NO. 22347 | 84-ArgHisIleArgProArgLeuValLysArgGluGlnIle-96 |
| SEQ. ID. NO. 22348 | 130-ArgGlyValAspAlaValGln-136 |
| SEQ. ID. NO. 22349 | 139-ValMetGlnAsnArgGlnValGlu-146 |
| SEQ. ID. NO. 22350 | 151-ProThrAspGlnLeuArg-156 |
| SEQ. ID. NO. 22351 | 163-LeuGluLysPheGlyAsp-168 |
| SEQ. ID. NO. 22352 | 179-AspCysThrAspMet-183 |
| SEQ. ID. NO. 22353 | 188-ProProThrHisAlaAlaArgAsnArgHisAsnLeu-199 |
| SEQ. ID. NO. 22354 | 207-IleProThrArgLeu-211 |
| SEQ. ID. NO. 22355 | 226-GlyGlnArgGlyArgGlnValIleGlnArgThrAspThrLeu-239 |
| SEQ. ID. NO. 22356 | 247-IleGluSerGlnAsnArgGlyHisAspSer-256 |

Hydrophilic Regions - Hopp-Woods

| | |
|---|---|
| SEQ. ID. NO. 22357 | 11-IleValSerAspProLeu-16 |
| SEQ. ID. NO. 22358 | 27-SerAlaAlaAspGlnThrGluThrGln-35 |
| SEQ. ID. NO. 22359 | 56-AlaArgValGluArgLeuPro-62 |
| SEQ. ID. NO. 22360 | 71-LeuAlaArgLysThrAlaGln-77 |

TABLE 1-continued

| | |
|---|---|
| SEQ. ID. NO. 22361 | 84-ArgHisIleArgProArgLeuValLysArgGluGlnIle-96 |
| SEQ. ID. NO. 22362 | 130-ArgGlyValAspAlaValGln-136 |
| SEQ. ID. NO. 22363 | 164-GluLysPheGlyAsp-168 |
| SEQ. ID. NO. 22364 | 191-HisAlaAlaArgAsnArgHisAsnLeu-199 |
| SEQ. ID. NO. 22365 | 227-GlnArgGlyArgGlnValIleGlnArgThrAspThr-238 |
| SEQ. ID. NO. 22366 | 249-SerGlnAsnArgGlyHisAsp-255 | a669
AMPHI Regions - AMPHI

| | |
|---|---|
| SEQ. ID. NO. 22367 | 24-LysLeuHisArgAlaPhe-29 |
| SEQ. ID. NO. 22368 | 59-GlnIlePheArgHisValGlnSer-66 |
| SEQ. ID. NO. 22369 | 79-LysProProAsnThrAla-84 |

Antigenic Index - Jameson-Wolf

| | |
|---|---|
| SEQ. ID. NO. 22370 | 1-MetArgArgIleIleLysLysHisGlnProValAsn-12 |
| SEQ. ID. NO. 22371 | 33-GlyArgLysArgProHisHisHisAspArgSerLeuArgArgGlnHisGlyIle-50 |
| SEQ. ID. NO. 22372 | 64-ValGlnSerSerAsnArgGlnAsnGlyArgGlnProValCysThrLysProProAsnThrAlaSer-85 |
| SEQ. ID. NO. 22373 | 100-AlaAspIleLysArgIleLeu-106 |

Hydrophilic Regions - Hopp-Woods

| | |
|---|---|
| SEQ. ID. NO. 22374 | 1-MetArgArgIleIleLysLysHisGlnPro-10 |
| SEQ. ID. NO. 22375 | 33-GlyArgLysArgProHisHisHisAspArgSerLeuArgArgGlnHisGly-49 |
| SEQ. ID. NO. 22376 | 65-GlnSerSerAsnArgGlnAsnGlyArgGlnProValCysThrLysProProAsn-82 |
| SEQ. ID. NO. 22377 | 100-AlaAspIleLysArgIleLeu-106 | a670
AMPHI Regions - AMPHI

| | |
|---|---|
| SEQ. ID. NO. 22378 | 10-ArgSerCysPheGly-14 |
| SEQ. ID. NO. 22379 | 16-ValLysAsnAlaSerGlyValSer-23 |
| SEQ. ID. NO. 22380 | 34-IleThrArgSerAla-38 |
| SEQ. ID. NO. 22381 | 77-ValGlySerSerAsnAsnIle-83 |
| SEQ. ID. NO. 22382 | 126-PheSerAlaCysSer-130 |

Antigenic Index - Jameson-Wolf

| | |
|---|---|
| SEQ. ID. NO. 22383 | 4-CysArgAsnCysLeuAlaArgSerCys-12 |
| SEQ. ID. NO. 22384 | 18-AsnAlaSerGlyValSerSerSerArgIleCysProLeuSer-31 |
| SEQ. ID. NO. 22385 | 33-LysIleThrArgSerAlaThrSerArgAlaAsnProIle-45 |
| SEQ. ID. NO. 22386 | 65-AsnThrSerProThrIleSerGlySerSerAlaGluValGlySerSerAsnAsnIleThrArgGlySerIleAlaLysProArgAlaIleAla-95 |
| SEQ. ID. NO. 22387 | 98-CysCysTrpProProGluSerTrpGluGlyLysAla-109 |
| SEQ. ID. NO. 22388 | 114-AlaSerProThrArgSerLysSerSer-122 |
| SEQ. ID. NO. 22389 | 145-AsnThrValArgCysGly-150 |

Hydrophilic Regions - Hopp-Woods

| | |
|---|---|
| SEQ. ID. NO. 22390 | 33-LysIleThrArgSerAlaThrSerArgAlaAsn-43 |
| SEQ. ID. NO. 22391 | 73-SerSerAlaGluValGlySer-79 |
| SEQ. ID. NO. 22392 | 87-SerIleAlaLysProArgAlaIleAla-95 |
| SEQ. ID. NO. 22393 | 116-ProThrArgSerLysSer-121 | a671
AMPHI Regions - AMPHI

| | |
|---|---|
| SEQ. ID. NO. 22394 | 96-ThrProArgIleAla-100 |
| SEQ. ID. NO. 22395 | 119-ArgLeuPheIleArgTyr-124 |

Antigenic Index - Jameson-Wolf

| | |
|---|---|
| SEQ. ID. NO. 22396 | 11-PheAsnAlaProAsnThrProProLysMetArgLeuAlaLysProLysProThrAlaGluThrAlaProValSerSerGluArg-38 |
| SEQ. ID. NO. 22397 | 45-GlnAlaMetThrAsnArgGluMetAsnAspArgAlaAsnAlaAsnArgArgGlyTrpAsnAspAlaLysAlaMetSerAlaLysGlyAlaAlaLysSerLeuAlaLysLysLysAlaThrThr-85 |
| SEQ. ID. NO. 22398 | 98-ArgIleAlaAspSerThrMet-104 |
| SEQ. ID. NO. 22399 | 110-AlaGluThrArgArgSerAlaThrGlyArgLeu-120 |
| SEQ. ID. NO. 22400 | 125-LeuThrGlyAspThr-129 |

Hydrophilic Regions - Hopp-Woods

| | |
|---|---|
| SEQ. ID. NO. 22401 | 16-ThrProProLysMetArgLeuAlaLysProLysProThrAlaGlu-30 |
| SEQ. ID. NO. 22402 | 32-AlaProValSerSerGluArg-38 |
| SEQ. ID. NO. 22403 | 47-MetThrAsnArgGluMetAsnAspArgAlaAsnAlaAsnArgArgGlyTrpAsnAspAlaLysAlaMetSerAlaLysGlyAlaAlaLysSerLeuAlaLysLysLysAlaThrThr-85 |
| SEQ. ID. NO. 22404 | 110-AlaGluThrArgArgSerAlaThr-117 | a672
AMPHI Regions - AMPHI

| | |
|---|---|
| SEQ. ID. NO. 22405 | 38-ArgAlaValAspIleIleLysAlaGlnLys-47 |
| SEQ. ID. NO. 22406 | 50-AlaAlaLeuProProPheValSerValVal-59 |
| SEQ. ID. NO. 22407 | 67-AlaGlnAsnIleArgArgIleLeuAlaGluValPro-78 |
| SEQ. ID. NO. 22408 | 91-AlaPheCysArgGlnPheHisArgProTyr-100 |
| SEQ. ID. NO. 22409 | 105-ArgValGlnThrAlaSerAspIleArgAsnAlaAlaAspArgPhe-119 |
| SEQ. ID. NO. 22410 | 131-HisProSerGluTyrGly-136 |
| SEQ. ID. NO. 22411 | 165-AsnValAspGluAlaIle-170 |
| SEQ. ID. NO. 22412 | 173-ThrGlyAlaGluAla-177 |

Antigenic Index - Jameson-Wolf

| | |
|---|---|
| SEQ. ID. NO. 22413 | 1-MetArgLysIleArgThrLysIleCysGlyIleThrThrProGluAspAlaLeu-18 |
| SEQ. ID. NO. 22414 | 34-ProGlnSerProArgAlaValAspIleIleLysAlaGlnLys-47 |
| SEQ. ID. NO. 22415 | 65-GluSerAlaGlnAsnIleArgArgIleLeuAla-75 |
| SEQ. ID. NO. 22416 | 84-PheHisGlyAspGluAspAspAlaPhe-92 |
| SEQ. ID. NO. 22417 | 107-GlnThrAlaSerAspIleArgAsnAlaAlaAspArgPheProAspAla-122 |
| SEQ. ID. NO. 22418 | 130-TyrHisProSerGluTyrGlyGlyThrGlyHisArgPheAsp-143 |
| SEQ. ID. NO. 22419 | 149-GluTyrSerGlyLysPro-154 |

TABLE 1-continued

| | |
|---|---|
| SEQ. ID. NO. 22420 | 159-GlyGlyLeuThrProGluAsnValAspGluAlaIleArg-171 |
| SEQ. ID. NO. 22421 | 176-GluAlaValAspValSerGlyGlyValGluAlaSerLysGlyLysLysAspProAlaLys-195 |
| SEQ. ID. NO. 22422 | 202-ThrAlaAsnArgLeuSerArg-208 |

Hydrophilic Regions - Hopp-Woods

| | |
|---|---|
| SEQ. ID. NO. 22423 | 1-MetArgLysIleArgThrLysIle-8 |
| SEQ. ID. NO. 22424 | 13-ThrProGluAspAlaLeu-18 |
| SEQ. ID. NO. 22425 | 36-SerProArgAlaValAsp-41 |
| SEQ. ID. NO. 22426 | 43-IleLysAlaGlnLys-47 |
| SEQ. ID. NO. 22427 | 66-SerAlaGlnAsnIleArgArgIleLeuAla-75 |
| SEQ. ID. NO. 22428 | 85-HisGlyAspGluAspAspAlaPhe-92 |
| SEQ. ID. NO. 22429 | 110-SerAspIleArgAsnAlaAlaAspArgPheProAsp-121 |
| SEQ. ID. NO. 22430 | 164-GluAsnValAspGluAlaIleArg-171 |
| SEQ. ID. NO. 22431 | 184-ValGluAlaSerLysGlyLysLysAspProAlaLys-195 |
| SEQ. ID. NO. 22432 | 204-AsnArgLeuSerArg-208 | a673
AMPHI Regions - AMPHI

| | |
|---|---|
| SEQ. ID. NO. 22433 | 84-LeuAsnAspArgLeuAsnGlnAsnValThrGluAlaLeuGlyGlyValAspVal-101 |
| SEQ. ID. NO. 22434 | 110-ArgPheThrAspAla-114 |
| SEQ. ID. NO. 22435 | 117-ValValLeuLysGlnLeuProLys-124 |
| SEQ. ID. NO. 22436 | 172-ArgIleAlaAsnLeuLeuGluLeuIleLysProTyrLeu-184 |
| SEQ. ID. NO. 22437 | 212-LysLeuPheArgTyrLeuGlyGluGlu-220 |
| SEQ. ID. NO. 22438 | 261-GlyGluArgLeuLysLysIleSerThr-269 |
| SEQ. ID. NO. 22439 | 275-MetGluLysLeuPhe-279 |
| SEQ. ID. NO. 22440 | 285-LeuLysValTrpValLysValLys-292 |

Antigenic Index - Jameson-Wolf

| | |
|---|---|
| SEQ. ID. NO. 22441 | 7-LeuAlaGlyGluArgAlaAlaAspGlyTyrArg-17 |
| SEQ. ID. NO. 22442 | 24-ValGlyArgProAsnValGlyLysSerThr-33 |
| SEQ. ID. NO. 22443 | 44-SerIleThrSerLysLysAlaGlnThrThrArgAsnArgValThr-58 |
| SEQ. ID. NO. 22444 | 61-TyrThrAspAspThrAla-66 |
| SEQ. ID. NO. 22445 | 73-ThrProGlyPheGlnThrAspHisArgAsnAlaLeuAsnAspArgLeuAsnGlnAsnValThrGlu-94 |
| SEQ. ID. NO. 22446 | 110-ArgPheThrAspAlaAspArgValVal-118 |
| SEQ. ID. NO. 22447 | 121-GlnLeuProLysHisThr-126 |
| SEQ. ID. NO. 22448 | 134-LysIleAspLysAspLysAlaLysAspArgTyrAla-145 |
| SEQ. ID. NO. 22449 | 153-ValArgAlaGluPhe-157 |
| SEQ. ID. NO. 22450 | 180-IleLysProTyrLeuProGluSerVal-188 |
| SEQ. ID. NO. 22451 | 190-MetTyrProGluAspMetValThrAspLysSerAlaArg-202 |
| SEQ. ID. NO. 22452 | 208-IleValArgGluLysLeuPhe-214 |
| SEQ. ID. NO. 22453 | 217-LeuGlyGluGluLeuPro-222 |
| SEQ. ID. NO. 22454 | 227-ValGluValGluGlnPheGluGluGluAspGlyLeuAsn-239 |
| SEQ. ID. NO. 22455 | 247-ValAspLysGluSerGlnLys-253 |
| SEQ. ID. NO. 22456 | 258-GlyLysGlyGlyGluArgLeuLysLysIleSerThrGluAlaArgLeuAspMetGluLysLeuPheAsp-280 |
| SEQ. ID. NO. 22457 | 291-ValLysSerGlyTrpAlaAspAspIleArgPheLeuArg-303 |

Hydrophilic Regions - Hopp-Woods

| | |
|---|---|
| SEQ. ID. NO. 22458 | 7-LeuAlaGlyGluArgAlaAlaAspGlyTyrArg-17 |
| SEQ. ID. NO. 22459 | 45-IleThrSerLysLysAlaGlnThrThrArgAsnArgVal-57 |
| SEQ. ID. NO. 22460 | 61-TyrThrAspAspThrAla-66 |
| SEQ. ID. NO. 22461 | 78-ThrAspHisArgAsnAlaLeuAsnAspArgLeuAsn-89 |
| SEQ. ID. NO. 22462 | 110-ArgPheThrAspAlaAspArgValVal-118 |
| SEQ. ID. NO. 22463 | 134-LysIleAspLysAspLysAlaLysAspArgTyrAla-145 |
| SEQ. ID. NO. 22464 | 153-ValArgAlaGluPhe-157 |
| SEQ. ID. NO. 22465 | 194-AspMetValThrAspLysSerAlaArg-202 |
| SEQ. ID. NO. 22466 | 208-IleValArgGluLysLeuPhe-214 |
| SEQ. ID. NO. 22467 | 217-LeuGlyGluGluLeuPro-222 |
| SEQ. ID. NO. 22468 | 227-ValGluValGluGlnPheGluGluGluAspGlyLeuAsn-239 |
| SEQ. ID. NO. 22469 | 247-ValAspLysGluSerGlnLys-253 |
| SEQ. ID. NO. 22470 | 259-LysGlyGlyGluArgLeuLysLysIleSerThrGluAlaArgLeuAspMetGluLysLeuPheAsp-280 |
| SEQ. ID. NO. 22471 | 293-SerGlyTrpAlaAspAspIleArgPheLeuArg-303 | a674
AMPHI Regions - AMPHI

| | |
|---|---|
| SEQ. ID. NO. 22472 | 16-ValTyrGlnSerLeuIle-21 |
| SEQ. ID. NO. 22473 | 24-ThrAlaAlaProGluIleAlaLysAsnIleArgGluMetProAspPheAlaLys-41 |
| SEQ. ID. NO. 22474 | 58-AlaAlaGluTyrIleArgGlnIleArgPro-67 |
| SEQ. ID. NO. 22475 | 86-ThrAlaCysHisGluLeuSerAlaMetProGluThr-97 |
| SEQ. ID. NO. 22476 | 107-IleGluValThrLysThrPheGlyGlyThrAspGlyHisLysPheValAsnGlyIleLeuAspLysLeuAla-130 |

Antigenic Index - Jameson-Wolf

| | |
|---|---|
| SEQ. ID. NO. 22477 | 1-MetLysThrAlaArgArgArgSerArgGluLeuAla-12 |
| SEQ. ID. NO. 22478 | 28-GluIleAlaLysAsnIleArgGluMetProAspPheAlaLysAlaAspGluGluLeuPhe-47 |
| SEQ. ID. NO. 22479 | 54-ThrGlnThrAsnAla-58 |
| SEQ. ID. NO. 22480 | 63-ArgGlnIleArgProLeuLeuAspArgAspGluLysAspLeuAsnProIleGluArg-81 |
| SEQ. ID. NO. 22481 | 93-AlaMetProGluThrProTyr-99 |
| SEQ. ID. NO. 22482 | 105-GluAlaIleGluValThrLysThrPheGlyGlyThrAspGlyHisLysPhe-121 |
| SEQ. ID. NO. 22483 | 129-LeuAlaAlaGlnIleArgProAspGluProLysArgArg-141 |

Hydrophilic Regions - Hopp-Woods

| | |
|---|---|
| SEQ. ID. NO. 22484 | 1-MetLysThrAlaArgArgArgSerArgGluLeuAla-12 |
| SEQ. ID. NO. 22485 | 28-GluIleAlaLysAsnIleArgGluMetProAspPheAlaLysAlaAspGluGluLeuPhe-47 |

TABLE 1-continued

SEQ. ID. NO. 22486   63-ArgGlnIleArgProLeuLeuAspArgAspGluLysAspLeuAsnProIleGluArg-81
SEQ. ID. NO. 22487   105-GluAlaIleGluVal-109
SEQ. ID. NO. 22488   133-IleArgProAspGluProLysArgArg-141
a675
AMPHI Regions - AMPHI
SEQ. ID. NO. 22489   21-ArgPheThrAsnGluIleGlySerGluMetLeuLysValCysCysArgThrLeuGlnGluLeuGly-42
SEQ. ID. NO. 22490   74-AlaLeuIleAlaIle-78
SEQ. ID. NO. 22491   123-GlnAlaIleGluArgIleGluGluLysAlaSerAsp-134
SEQ. ID. NO. 22492   141-GluCysAlaAsnLeuValAsnLeuLeuLeuGlu-151
Antigenic Index - Jameson-Wolf
SEQ. ID. NO. 22493   6-ProAsnLeuAspGlyLysHisLeuArg-14
SEQ. ID. NO. 22494   26-IleGlySerGluMetLeu-31
SEQ. ID. NO. 22495   42-GlyValAlaAspGluAsnIle-48
SEQ. ID. NO. 22496   68-SerSerGluLysPheAsp-73
SEQ. ID. NO. 22497   82IleArgGlyGluThrTyr-87
SEQ. ID. NO. 22498   92-ValSerAsnGluSerGlyAlaGlyVal-100
SEQ. ID. NO. 22499   118-ThrGluAsnAspAlaGlnAlaIleGluArgIleGluGluLysAlaSerAspAlaAlaLysValAlaVal-140
SEQ. ID. NO. 22500   152-GluGlnPheGluAspGluGlu-158
Hydrophilic Regions - Hopp-Woods
SEQ. ID. NO. 22501   8-LeuAspGlyLysHisLeuArg-14
SEQ. ID. NO. 22502   26-IleGlySerGluMetLeu-31
SEQ. ID. NO. 22503   42-GlyValAlaAspGluAsnIle-48
SEQ. ID. NO. 22504   68-SerSerGluLysPheAsp-73
SEQ. ID. NO. 22505   82-IleArgGlyGluThrTyr-87
SEQ. ID. NO. 22506   92-ValSerAsnGluSerGlyAlaGly-99
SEQ. ID. NO. 22507   118-ThrGluAsnAspAlaGlnAlaIleGluArgIleGluGluLysAlaSerAspAlaAlaLysValAlaVal-140
SEQ. ID. NO. 22508   152-GluGlnPheGluAspGluGlu-158
a677
AMPHI Regions - AMPHI
SEQ. ID. NO. 22509   20-AlaArgLeuCysArgPheArgArg-27
SEQ. ID. NO. 22510   45-LeuThrProPheArgArgValAsnHisPheValAlaPheThrArgPheAsnGln-62
SEQ. ID. NO. 22511   78-IleAspPheIleAspAlaAsp-84
SEQ. ID. NO. 22512   86-PheAspGlyLeuLeuAla-91
SEQ. ID. NO. 22513   105-HisLeuValGlyArgPhe-110
SEQ. ID. NO. 22514   154-CysArgProValAspAspLeuAspAsp-162
SEQ. ID. NO. 22515   165-AlaPhePheIleAsnGlnLeuIleLysLeuValPheGlnCys-178
Antigenic Index - Jameson-Wolf
SEQ. ID. NO. 22516   23-CysArgPheArgArgHisSerArgSerValAsp-33
SEQ. ID. NO. 22517   35-AspValPheAspArgLysAspPheAsn-43
SEQ. ID. NO. 22518   59-ArgPheAsnGlnThrThrSerGlnArgArgAsnProArgAsnPheVal-74
SEQ. ID. NO. 22519   81-IleAspAlaAspAspPheAspGly-88
SEQ. ID. NO. 22520   96-GlnGlnThrAspGlyArgAlaGluLysHisLeu-106
SEQ. ID. NO. 22521   114-GlyIleAsnAspAspGlyGlyPhe-121
SEQ. ID. NO. 22522   124-LeuGlyGlnGluThrAspAlaAlaVal-132
SEQ. ID. NO. 22523   155-ArgProValAspAspLeuAspAspPheGly-164
SEQ. ID. NO. 22524   180-ProSerGlyGlyArgAsn-185
Hydrophilic Regions - Hopp-Woods
SEQ. ID. NO. 22525   23-CysArgPheArgArgHisSerArgSerValAsp-33
SEQ. ID. NO. 22526   35-AspValPheAspArgLysAspPhe-42
SEQ. ID. NO. 22527   64-ThrSerGlnArgArgAsnProArg-71
SEQ. ID. NO. 22528   81-IleAspAlaAspAspPheAsp-87
SEQ. ID. NO. 22529   96-GlnGlnThrAspGlyArgAlaGluLysHisLeu-106
SEQ. ID. NO. 22530   115-IleAsnAspAspGlyGly-120
SEQ. ID. NO. 22531   125-GlyGlnGluThrAspAlaAlaVal-132
SEQ. ID. NO. 22532   155-ArgProValAspAspLeuAspAsp-162
a678
AMPHI Regions - AMPHI
SEQ. ID. NO. 22533   10-LeuValSerAlaIleIle-15
SEQ. ID. NO. 22534   24-MetArgGlyValIle-28
SEQ. ID. NO. 22535   47-PheAlaAlaProPhe-51
SEQ. ID. NO. 22536   79-LeuIleGlnLysIleLeuArgSerLeuLeuThrGlyAla-91
SEQ. ID. NO. 22537   102-ArgIleLeuGlyGlyValPheGlyAlaLeuLysGlyIleLeu-115
SEQ. ID. NO. 22538   130-ProAspThrGluGlu-134
Antigenic Index - Jameson-Wolf
SEQ. ID. NO. 22539   125-SerLysThrAspLeuProAspThrGluGluTrpArgGlnSerTyrThr-140
SEQ. ID. NO. 22540   154-HisSerGlyGlyThrAlaGluThrProGluAspAsp-165
Hydrophilic Regions - Hopp-Woods
SEQ. ID. NO. 22541   125-SerLysThrAspLeuProAspThrGluGluTrpArgGln-137
SEQ. ID. NO. 22542   157-GlyThrAlaGluThrProGluAspAsp-165
a681
AMPHI Regions - AMPHI
SEQ. ID. NO. 22543   12-PheSerGluGluAlaLysPheIleSerAlaMet-22
SEQ. ID. NO. 22544   102-LeuProValGlyAsp-106
SEQ. ID. NO. 22545   122-ArgLeuGlyGluGlnCys-127
SEQ. ID. NO. 22546   137-IleGlyGluAlaAspAspAlaGluValValArgValValGlyValPheValGly-154
SEQ. ID. NO. 22547   202-LysCysValHisCysGly-207
SEQ. ID. NO. 22548   210-XxxGlyGlyLysLeuAlaAspPheThrThrIle-220
SEQ. ID. NO. 22549   234-CysAlaProPheAlaAlaLeuArgCysPheCysIlePheGlyValTrpLysArgIleArgAlaValPheCysGlyArg-259

TABLE 1-continued

Antigenic Index - Jameson-Wolf
SEQ. ID. NO. 22550   11-AsnPheSerGluGluAlaLysPhe-18
SEQ. ID. NO. 22551   39-AlaThrProAsnSerTrpArgValArgGlnGln-49
SEQ. ID. NO. 22552   59-LeuValLysArgAlaCys-64
SEQ. ID. NO. 22553   67-ProMetArgArgCysLeuProSerArgLeu-76
SEQ. ID. NO. 22554   89-GlyGlyPheGlyMetProSerGluGlySerVal-99
SEQ. ID. NO. 22555   103-ProValGlyAspGlyLeuGlu-109
SEQ. ID. NO. 22556   120-AlaPheArgLeuGlyGluGlnCysGlyGlyPhe-130
SEQ. ID. NO. 22557   136-AspIleGlyGluAlaAspAspAlaGluVal-145
SEQ. ID. NO. 22558   157-AlaAlaGluGluThrPro-162
SEQ. ID. NO. 22559   167-PheLysAsnGlyGly-171
SEQ. ID. NO. 22560   173-AlaValGluGluAlaAspGly-179
SEQ. ID. NO. 22561   185-AspGlyValGlyGlyAspAlaAlaValGluCysArgGlyLysCysLeuCys-201
SEQ. ID. NO. 22562   207-GlyAsnThrXxxGlyGlyLysLeuAlaAsp-216
SEQ. ID. NO. 22563   224-SerAlaAspGlyGlyGly-229
SEQ. ID. NO. 22564   256-PheCysGlyArgArg-260
Hydrophilic Regions - Hopp-Woods
SEQ. ID. NO. 22565   11-AsnPheSerGluGluAlaLysPhe-18
SEQ. ID. NO. 22566   44-TrpArgValArgGln-48
SEQ. ID. NO. 22567   59-LeuValLysArgAlaCys-64
SEQ. ID. NO. 22568   67-ProMetArgArgCysLeuPro-73
SEQ. ID. NO. 22569   95-SerGluGlySerVal-99
SEQ. ID. NO. 22570   120-AlaPheArgLeuGlyGluGln-126
SEQ. ID. NO. 22571   136-AspIleGlyGluAlaAspAspAlaGluVal-145
SEQ. ID. NO. 22572   157-AlaAlaGluGluThrPro-162
SEQ. ID. NO. 22573   173-AlaValGluGluAlaAspGly-179
SEQ. ID. NO. 22574   191-AlaAlaValGluCysArgGlyLysCysLeu-200
SEQ. ID. NO. 22575   210-XxxGlyGlyLysLeuAlaAsp-216
SEQ. ID. NO. 22576   256-PheCysGlyArgArg-260
a682
AMPHI Regions - AMPHI
SEQ. ID. NO. 22577   33-ArgLeuArgLysCysGlyArgIleLeuSerGlyIleCysGluProPhe-48
Antigenic Index - Jameson-Wolf
SEQ. ID. NO. 22578   9-SerTyrGlyLysTrpArgLysAsnTrpAspIle-19
SEQ. ID. NO. 22579   30-SerSerThrArgLeuArgLysCysGlyArg-39
SEQ. ID. NO. 22580   95-ArgPheProThrAspArgProIleLeu-103
SEQ. ID. NO. 22581   112-IleSerProArgThrGlyPheArgTyrProThrArgSerLeuProLysSerLysLysAlaTyrGly-133
Hydrophilic Regions - Hopp-Woods
SEQ. ID. NO. 22582   12-LysTrpArgLysAsnTrpAsp-18
SEQ. ID. NO. 22583   32-ThrArgLeuArgLysCysGlyArg-39
SEQ. ID. NO. 22584   97-ProThrAspArgProIleLeu-103
SEQ. ID. NO. 22585   124-SerLeuProLysSerLysLysAlaTyrGly-133
a683
AMPHI Regions - AMPHI
SEQ. ID. NO. 22586   26-ThrProAspLysSerAlaArgTrpGluAsnIleGlyThrIleSerAsn-41
SEQ. ID. NO. 22587   101-SerSerLeuGlnLeuPhe-106
SEQ. ID. NO. 22588   124-ArgProMetSerIleLeuSerGly-131
Antigenic Index - Jameson-Wolf
SEQ. ID. NO. 22589   24-CysSerThrProAspLysSerAlaArgTrpGluAsn-35
SEQ. ID. NO. 22590   37-GlyThrIleSerAsnGly-42
SEQ. ID. NO. 22591   48-IleAsnLysAspSerValArgLysAsnGlyAsn-58
SEQ. ID. NO. 22592   63-XxxAspLysLysValValThrAsnLeuLysGlnGluArgPheAla-77
SEQ. ID. NO. 22593   93-CysAsnAsnLysThrTyrArgLeu-100
SEQ. ID. NO. 22594   106-PheAspThrLysAsnThrGluIleSerThr-115
SEQ. ID. NO. 22595   119-ThrAlaSerSerLeuArgPro-125
SEQ. ID. NO. 22596   131-GlyThrLeuThrGluLysGlnTyrGlu-139
SEQ. ID. NO. 22597   141-ValCysGlyLysLysLeu-146
Hydrophilic Regions - Hopp-Woods
SEQ. ID. NO. 22598   25-SerThrProAspLysSerAlaArgTrpGluAsn-35
SEQ. ID. NO. 22599   48-IleAsnLysAspSerValArgLysAsnGly-57
SEQ. ID. NO. 22600   63-XxxAspLysLysValValThr-69
SEQ. ID. NO. 22601   71-LeuLysGlnGluArgPheAla-77
SEQ. ID. NO. 22602   107-AspThrLysAsnThrGluIleSer-114
SEQ. ID. NO. 22603   133-LeuThrGluLysGlnTyrGlu-139
SEQ. ID. NO. 22604   141-ValCysGlyLysLysLeu-146
a684
AMPHI Regions - AMPHI
SEQ. ID. NO. 22605   13-AlaAlaCysGlyThrValGln-19
SEQ. ID. NO. 22606   47-LeuAlaGluProLeu-51
SEQ. ID. NO. 22607   73-TrpAlaAspThrLeuAspAspMetLeuGluAlaAlaLeuSerAsnAlaPheAsnArgLeuAspSerThr-95
SEQ. ID. NO. 22608   110-TrpThrValTyrIleAspAlaPheGlnGlySerTyr-121
SEQ. ID. NO. 22609   154-AlaMetThrAlaAlaLeuGluGlnGlyLeuLysGlnAlaAlaGlnGlnMetVal-171
Antigenic Index - Jameson-Wolf
SEQ. ID. NO. 22610   26-LeuProAspSerArgTyrIleArgProAlaThrGlnGlyGlyGluThrAlaValGluValArgLeuAlaGluProLeuLysArgGlyGlyLeu-56
SEQ. ID. NO. 22611   60-ThrAspProTyrArgLeuAsnThrAlaGln-69
SEQ. ID. NO. 22612   76-ThrLeuAspAspMetLeuGlu-82
SEQ. ID. NO. 22613   90-AsnArgLeuAspSerThrArg-96
SEQ. ID. NO. 22614   101-AlaSerArgSerGlySerThrGluLys-109
SEQ. ID. NO. 22615   117-PheGlnGlySerTyrThrGlyLysThrLeu-126

TABLE 1-continued

| | |
|---|---|
| SEQ. ID. NO. 22616 | 133-LeuProAspGlyThrAsnArgProPheHisIleGluThrGluGlnGlnGlyAspGlyTyrAla-153 |
| SEQ. ID. NO. 22617 | 161-GlnGlyLeuLysGlnAlaAla-167 |

Hydrophilic Regions - Hopp-Woods

| | |
|---|---|
| SEQ. ID. NO. 22618 | 27-ProAspSerArgTyrIleArg-33 |
| SEQ. ID. NO. 22619 | 35-AlaThrGlnGlyGlyGluThrAlaValGluValArgLeuAlaGluProLeuLysArgGlyGly-55 |
| SEQ. ID. NO. 22620 | 76-ThrLeuAspAspMetLeuGlu-82 |
| SEQ. ID. NO. 22621 | 90-AsnArgLeuAspSer-94 |
| SEQ. ID. NO. 22622 | 102-SerArgSerGlySerThrGluLys-109 |
| SEQ. ID. NO. 22623 | 141-PheHisIleGluThrGluGlnGlnGlyAsp-150 |
| SEQ. ID. NO. 22624 | 161-GlnGlyLeuLysGlnAlaAla-167 | a685
AMPHI Regions - AMPHI

| | |
|---|---|
| SEQ. ID. NO. 22625 | 7-AsnPheAlaPheCysGlyValVal-14 |
| SEQ. ID. NO. 22626 | 44-CysAlaValLeuLeu-48 |
| SEQ. ID. NO. 22627 | 94-TrpAlaAlaLeuAspThrLeuThrGluLeu-103 |
| SEQ. ID. NO. 22628 | 137-TyrGluAlaLeuHisArgTyr-143 |
| SEQ. ID. NO. 22629 | 154-GlyAlaGluAlaTyrGluGlnLeuAlaAlaLysAsn-164 |
| SEQ. ID. NO. 22630 | 182-GluLysGlnMetGluThrLeuAlaArgIlePheGlyLysGlu-195 |
| SEQ. ID. NO. 22631 | 206-AspAlaLeuPheAla-210 |
| SEQ. ID. NO. 22632 | 296-AlaValGluValLeuAspAsnAlaLeuVal-305 |
| SEQ. ID. NO. 22633 | 336-AlaAlaGluGlnLeuLysGluAlaPhe-344 |

Antigenic Index - Jameson-Wolf

| | |
|---|---|
| SEQ. ID. NO. 22634 | 20-LeuAsnAsnLysHisSerTyrSerTyrAlaLysGluProHisThrValLysProArgPhe-39 |
| SEQ. ID. NO. 22635 | 52-SerProGluProAlaAlaGluLysThrValSer-62 |
| SEQ. ID. NO. 22636 | 74-ProThrAlaArgGlyAspAlaValValProLysAsnProGluArgValAla-90 |
| SEQ. ID. NO. 22637 | 122-AlaPheAspLysAlaAla-127 |
| SEQ. ID. NO. 22638 | 133-PheGluProAspTyrGluAlaLeuHisArgTyrAsn-144 |
| SEQ. ID. NO. 22639 | 151-GlyGlyProGlyAlaGluAlaTyrGluGlnLeuAlaLysAsnAlaThr-166 |
| SEQ. ID. NO. 22640 | 170-LeuThrValAspAsnGlyAsnIleArgThrSerGlyGluLysGlnMetGluThrLeu-188 |
| SEQ. ID. NO. 22641 | 192-PheGlyLysGluAlaArgAlaAlaGluLeuLysAlaGlnIle-205 |
| SEQ. ID. NO. 22642 | 211-GlnThrArgGluAlaAlaLysGlyLysGlyArgGlyLeu-223 |
| SEQ. ID. NO. 22643 | 227-ValThrGlyAsnLysValSerAlaPheGlyThrGlnSerArgLeu-241 |
| SEQ. ID. NO. 22644 | 247-GlyAspIleGlyLeuProProValAspGluSerLeuArgAsnGluGlyHisGlyGln-265 |
| SEQ. ID. NO. 22645 | 271-TyrIleLysGluLysAsnProAspTrpIle-280 |
| SEQ. ID. NO. 22646 | 285-ArgThrAlaAlaIleGlyGlnGluGlyProAla-295 |
| SEQ. ID. NO. 22647 | 307-GlyThrAsnAlaTrpLysArgLysGln-315 |
| SEQ. ID. NO. 22648 | 328-GlyGlySerArgGlnLeu-333 |
| SEQ. ID. NO. 22649 | 338-GluGlnLeuLysGluAlaPheGluLysAlaGluPro-349 |
| SEQ. ID. NO. 22650 | 351-AlaAlaGlyLysGlu-355 |

Hydrophilic Regions - Hopp-Woods

| | |
|---|---|
| SEQ. ID. NO. 22651 | 28-TyrAlaLysGluProHisThrValLys-36 |
| SEQ. ID. NO. 22652 | 52-SerProGluProAlaAlaGluLysThrValSer-62 |
| SEQ. ID. NO. 22653 | 75-ThrAlaArgGlyAspAlaValVal-82 |
| SEQ. ID. NO. 22654 | 84-LysAsnProGluArgValAla-90 |
| SEQ. ID. NO. 22655 | 122-AlaPheAspLysAlaAla-127 |
| SEQ. ID. NO. 22656 | 135-ProAspTyrGluAla-139 |
| SEQ. ID. NO. 22657 | 156-GluAlaTyrGluGlnLeuAlaLys-163 |
| SEQ. ID. NO. 22658 | 175-GlyAsnIleArgThrSerGlyGluLysGlnMetGluThrLeu-188 |
| SEQ. ID. NO. 22659 | 192-PheGlyLysGluAlaArgAlaAlaGluLeuLysAlaGlnIle-205 |
| SEQ. ID. NO. 22660 | 211-GlnThrArgGluAlaAlaLysGlyLysGlyArgGly-222 |
| SEQ. ID. NO. 22661 | 253-ProValAspGluSerLeuArgAsnGluGlyHisGly-264 |
| SEQ. ID. NO. 22662 | 271-TyrIleLysGluLysAsnPro-277 |
| SEQ. ID. NO. 22663 | 290-GlyGlnGluGlyProAla-295 |
| SEQ. ID. NO. 22664 | 309-AsnAlaTrpLysArgLysGln-315 |
| SEQ. ID. NO. 22665 | 338-GluGlnLeuLysGluAlaPheGluLysAlaGluPro-349 |
| SEQ. ID. NO. 22666 | 351-AlaAlaGlyLysGlu-355 | a686
AMPHI Regions - AMPHI

| | |
|---|---|
| SEQ. ID. NO. 22667 | 10-AspValPheAspAspIleCysSerAlaValGluSerPheGlyGlyIleAlaArgSerValGlnLeu-31 |
| SEQ. ID. NO. 22668 | 50-ThrThrGlyIleValGluThrValAspLysProLeu-61 |
| SEQ. ID. NO. 22669 | 70-ValGluAlaAspIle-74 |
| SEQ. ID. NO. 22670 | 86-IleProArgAlaPheGlySerGlyIleAlaAlaAlaLeu-98 |

Antigenic Index - Jameson-Wolf

| | |
|---|---|
| SEQ. ID. NO. 22671 | 1-TerTerAsnPheSerCysArgAlaAspAspValPheAsp-13 |
| SEQ. ID. NO. 22672 | 46-LeuArgGlnHisThrThrGlyIle-53 |
| SEQ. ID. NO. 22673 | 55-GluThrValAspLysProLeuSerGlyAla-64 |
| SEQ. ID. NO. 22674 | 70-ValGluAlaAspIle-74 |
| SEQ. ID. NO. 22675 | 115-AspAlaValLysAlaGluSerValAsnGlyThrThrGly-127 |

Hydrophilic Regions - Hopp-Woods

| | |
|---|---|
| SEQ. ID. NO. 22676 | 6-CysArgAlaAspAspValPheAsp-13 |
| SEQ. ID. NO. 22677 | 55-GluThrValAspLysProLeuSer-62 |
| SEQ. ID. NO. 22678 | 70-ValGluAlaAspIle-74 |
| SEQ. ID. NO. 22679 | 115-AspAlaValLysAlaGluSerValAsn-123 | a687
AMPHI Regions - AMPHI

| | |
|---|---|
| SEQ. ID. NO. 22680 | 11-AlaAlaLeuPheAlaLeu-16 |
| SEQ. ID. NO. 22681 | 64-LysValGluValLeuGluPhePheGlyTyrPheCysPro-76 |
| SEQ. ID. NO. 22682 | 78-CysAlaHisLeuGluProValLeuSerLysHisAlaLysSerPhe-92 |
| SEQ. ID. NO. 22683 | 112-LeuAlaArgLeuAlaAlaAla-118 |
| SEQ. ID. NO. 22684 | 135-PheAspAlaMetVal-139 |

TABLE 1-continued

| SEQ. ID. NO. 22685 | 148-ProGluValLeuLysLysTrpLeu-155 |
| SEQ. ID. NO. 22686 | 176-GlnAlaArgAlaAspLysMetGlnGluLeuThrGluThrPhe-189 |

Antigenic Index - Jameson-Wolf
| SEQ. ID. NO. 22687 | 1-MetLysSerLysHis-5 |
| SEQ. ID. NO. 22688 | 19-CysAspSerLysValGlnThrSerValProAlaAspSerAlaPro-33 |
| SEQ. ID. NO. 22689 | 43-GlyLeuValGluGlyGlnAsnTyr-50 |
| SEQ. ID. NO. 22690 | 56-ProIleProGlnGlnGlnAlaGlyLysValGluVal-67 |
| SEQ. ID. NO. 22691 | 87-LysHisAlaLysSerPheLysAspAspMetTyrLeu-98 |
| SEQ. ID. NO. 22692 | 122-AlaAlaAlaAspSerLysAspValAlaAsn-131 |
| SEQ. ID. NO. 22693 | 141-GlnLysIleLysLeuGlnGluProGluValLeuLys-152 |
| SEQ. ID. NO. 22694 | 159-ThrAlaPheAspGlyLysLysVal-166 |
| SEQ. ID. NO. 22695 | 171-GluSerProGluSerGlnAlaArgAlaAspLysMetGlnGluLeuThrGlu-187 |
| SEQ. ID. NO. 22696 | 189-PheGlnIleAspGlyThrPro-195 |
| SEQ. ID. NO. 22697 | 199-ValGlyGlyLysTyrLysValGluPheAlaAsp-209 |
| SEQ. ID. NO. 22698 | 211-GluSerGlyMetAsnThr-216 |
| SEQ. ID. NO. 22699 | 220-LeuAlaAspLysValArgGluGluGlnLysAlaAlaHis-232 |

Hydrophilic Regions - Hopp-Woods
| SEQ. ID. NO. 22700 | 1-MetLysSerLysHis-5 |
| SEQ. ID. NO. 22701 | 19-CysAspSerLysValGlnThr-25 |
| SEQ. ID. NO. 22702 | 27-ValProAlaAspSerAlaPro-33 |
| SEQ. ID. NO. 22703 | 61-GlnAlaGlyLysValGluVal-67 |
| SEQ. ID. NO. 22704 | 87-LysHisAlaLysSerPheLysAspAspMetTyrLeu-98 |
| SEQ. ID. NO. 22705 | 122-AlaAlaAlaAspSerLysAspValAla-130 |
| SEQ. ID. NO. 22706 | 141-GlnLysIleLysLeuGlnGluProGluValLeuLys-152 |
| SEQ. ID. NO. 22707 | 159-ThrAlaPheAspGlyLysLysVal-166 |
| SEQ. ID. NO. 22708 | 171-GluSerProGluSerGlnAlaArgAlaAspLysMetGlnGluLeuThrGlu-187 |
| SEQ. ID. NO. 22709 | 201-GlyLysTyrLysValGluPheAlaAsp-209 |
| SEQ. ID. NO. 22710 | 220-LeuAlaAspLysValArgGluGluGlnLysAlaAlaHis-232 | a688
AMPHI Regions - AMPHI
| SEQ. ID. NO. 22711 | 23-LeuSerAlaLeuLeuGlyLeu-29 |
| SEQ. ID. NO. 22712 | 120-GlyAsnAlaLeuGlnAsnAlaAla-127 |

Antigenic Index - Jameson-Wolf
| SEQ. ID. NO. 22713 | 4-TyrProSerArgPheAlaGln-10 |
| SEQ. ID. NO. 22714 | 13-IleSerValAsnLys-17 |
| SEQ. ID. NO. 22715 | 47-IleIleGlnGlyAsnGluLeuGluProArgAla-57 |
| SEQ. ID. NO. 22716 | 61-LeuArgProGlyMetThrLysAspGln-69 |
| SEQ. ID. NO. 22717 | 82-AlaPheHisThrAspArgTrpAspTyr-90 |
| SEQ. ID. NO. 22718 | 93-AsnThrSerArgAsnGlyIleIleLysAspArgSerAsn-105 |
| SEQ. ID. NO. 22719 | 116-ValArgThrGluGlyAsnAla-122 |
| SEQ. ID. NO. 22720 | 125-AsnAlaAlaGluAlaLeuArgValLysGlnAsnAlaAspLysGln-139 |

Hydrophilic Regions - Hopp-Woods
| SEQ. ID. NO. 22721 | 51-AsnGluLeuGluProArgAla-57 |
| SEQ. ID. NO. 22722 | 64-GlyMetThrLysAspGln-69 |
| SEQ. ID. NO. 22723 | 98-GlyIleIleLysAspArgSerAsn-105 |
| SEQ. ID. NO. 22724 | 116-ValArgThrGluGlyAsnAla-122 |
| SEQ. ID. NO. 22725 | 125-AsnAlaAlaGluAlaLeuArgValLysGlnAsnAlaAspLysGln-139 | a689
AMPHI Regions - AMPHI
| SEQ. ID. NO. 22726 | 55-TyrProGluMetSerGluLysLeuMet-63 |
| SEQ. ID. NO. 22727 | 65-ValLeuMetAlaMetLeuValThrLeu-73 |
| SEQ. ID. NO. 22728 | 82-LeuProAlaIleProGluMetAlaGln-90 |
| SEQ. ID. NO. 22729 | 111-AlaPheGlyGlnValValGlyGly-118 |
| SEQ. ID. NO. 22730 | 123-IleLysGlyArgLys-127 |
| SEQ. ID. NO. 22731 | 154-LeuAsnLeuArgValValGlnAlaPheGlyAlaGly-165 |
| SEQ. ID. NO. 22732 | 188-PheAlaLeuIleGlyIleIleLeu-195 |
| SEQ. ID. NO. 22733 | 203-ProMetValGlyAlaLeuLeuGlnGlyLeuGlyGlyTrpGlnAlaIlePheVal-220 |
| SEQ. ID. NO. 22734 | 230-LeuGlyLeuValGlnTyrPhe-236 |
| SEQ. ID. NO. 22735 | 245-LysIleGlyArgAspVal-250 |
| SEQ. ID. NO. 22736 | 257-ArgPheLysArgValLeu-262 |
| SEQ. ID. NO. 22737 | 277-SerPheGlySerMetPheAla-283 |
| SEQ. ID. NO. 22738 | 314-MetMetPhePheAsnArgIleThr-321 |
| SEQ. ID. NO. 22739 | 344-AlaAlaAsnLeuSerGlnLeuAlaAlaValLeuPhe-355 |
| SEQ. ID. NO. 22740 | 400-ValLeuGlyValPheGlnSerLeuIleGly-409 |

Antigenic Index - Jameson-Wolf
| SEQ. ID. NO. 22741 | 36-PheArgArgArgAlaVal-41 |
| SEQ. ID. NO. 22742 | 45-IleGlyArgGluPheMetProSer-52 |
| SEQ. ID. NO. 22743 | 57-GluMetSerGluLysLeu-62 |
| SEQ. ID. NO. 22744 | 95-AspValHisArgIleGluGln-101 |
| SEQ. ID. NO. 22745 | 119-SerValSerAspIleLysGlyArgLysProVal-129 |
| SEQ. ID. NO. 22746 | 174-MetValArgAspTyrTyrSerGlyArgLysAlaAla-185 |
| SEQ. ID. NO. 22747 | 238-ProLysProAlaValGlyGlyLysIleGlyArgAspValPhe-251 |
| SEQ. ID. NO. 22748 | 257-ArgPheLysArgValLeuLysThrArgAla-266 |
| SEQ. ID. NO. 22749 | 325-LeuLysThrGlyValHis-330 |
| SEQ. ID. NO. 22750 | 390-PheLysGluGluGlyGlySer-396 |
| SEQ. ID. NO. 22751 | 448-ArgAlaTrpLysGluAsnGlyGlnSerGluTyrLeu-459 |

Hydrophilic Regions - Hopp-Woods
| SEQ. ID. NO. 22752 | 36-PheArgArgArgAlaVal-41 |
| SEQ. ID. NO. 22753 | 45-IleGlyArgGluPheMet-50 |
| SEQ. ID. NO. 22754 | 57-GluMetSerGluLysLeu-62 |

TABLE 1-continued

SEQ. ID. NO. 22755   95-AspValHisArgIleGluGln-101
SEQ. ID. NO. 22756   119-SerValSerAspIleLysGlyArgLysProVal-129
SEQ. ID. NO. 22757   178-TyrTyrSerGlyArgLysAlaAla-185
SEQ. ID. NO. 22758   245-LysIleGlyArgAspVal-250
SEQ. ID. NO. 22759   257-ArgPheLysArgValLeuLysThrArgAla-266
SEQ. ID. NO. 22760   390-PheLysGluGluGlyGlySer-396
SEQ. ID. NO. 22761   448-ArgAlaTrpLysGluAsnGlyGln-455
a690
AMPHI Regions - AMPHI
SEQ. ID. NO. 22762   36-AlaSerSerThrAlaSerAla-42
SEQ. ID. NO. 22763   57-SerAlaProAspAsnValLysGlnAlaGlu-66
SEQ. ID. NO. 22764   68-ValProProSerAsnCysThrAspLeuHisProAlaThrGlyIleAspAspLeuMetGlnGlnIleAlaGluHisIle-93
SEQ. ID. NO. 22765   116-GlyTyrAspAsnIleGlnArgLeu-123
SEQ. ID. NO. 22766   151-ArgThrIleSerArgGlnAlaGlnAspAla-160
SEQ. ID. NO. 22767   189-ProLysArgThrArgTyrPhe-195
SEQ. ID. NO. 22768   213-GlyAsnPheGlnTyrIleGlyGlnLeuProGlyTyrLeuLys-226
Antigenic Index - Jameson-Wolf
SEQ. ID. NO. 22769   1-MetLysAsnLysThrSer-6
SEQ. ID. NO. 22770   21-SerProSerLysGluAspLysThrLysGluAsnGlyAla-33
SEQ. ID. NO. 22771   43-AlaSerSerSerAlaProGlnThrAspLeu-52
SEQ. ID. NO. 22772   57-SerAlaProAspAsnValLysGlnAlaGluSerValProProSerAsnCysThrAspLeuHisProAlaThrGlyIleAspAspLeuMet-86
SEQ. ID. NO. 22773   91-GluHisIleAspSerAspCys-97
SEQ. ID. NO. 22774   104-HisGluLeuGluThrArgPhe-110
SEQ. ID. NO. 22775   112-LeuProGlyGlyGlyTyrAspAsnIleGln-121
SEQ. ID. NO. 22776   126-ProAspIleArgProGluAspProAspTyrHisGln-137
SEQ. ID. NO. 22777   144-GluAspLeuArgTyrGlyLysArgThrIleSerArgGlnAlaGln-158
SEQ. ID. NO. 22778   160-AlaLeuMetGluGlnGluArgArgLeuArgGlu-170
SEQ. ID. NO. 22779   177-GlnGlySerGlnGluThrArgGlyGlnGlyGluGluProLysArgThrArgTyr-194
SEQ. ID. NO. 22780   198-SerAlaThrProAlaTyrSerSerArgHisAsnAsnGlyLeuGlyGlyAsn-214
SEQ. ID. NO. 22781   228-HisGlyGluMetLeuGluAsnGlnSerLeu-237
SEQ. ID. NO. 22782   239-ArgLeuSerAsnArgGluArgAsnProAspLysProPheLeu-252
SEQ. ID. NO. 22783   255-HisPheAspGluAsnGlyLysIleThr-263
SEQ. ID. NO. 22784   267-ValTyrGluLysAsnIleTyrPheAsnProAsnLeuGlyArgArg-281
Hydrophilic Regions - Hopp-Woods
SEQ. ID. NO. 22785   1-MetLysAsnLysThr-5
SEQ. ID. NO. 22786   21-SerProSerLysGluAspLysThrLysGluAsnGlyAla-33
SEQ. ID. NO. 22787   46-SerAlaProGlnThrAspLeu-52
SEQ. ID. NO. 22788   57-SerAlaProAspAsnValLysGlnAlaGluSerValPro-69
SEQ. ID. NO. 22789   81-GlyIleAspAspLeuMet-86
SEQ. ID. NO. 22790   91-GluHisIleAspSer-95
SEQ. ID. NO. 22791   104-HisGluLeuGluThr-108
SEQ. ID. NO. 22792   128-IleArgProGluAspProAspTyrHis-136
SEQ. ID. NO. 22793   144-GluAspLeuArgTyrGlyLysArgThrIleSerArgGlnAlaGln-158
SEQ. ID. NO. 22794   160-AlaLeuMetGluGlnGluArgArgLeuArgGlu-170
SEQ. ID. NO. 22795   178-GlySerGlnGluThrArgGlyGlnGlyGluGluProLysArgThrArgTyr-194
SEQ. ID. NO. 22796   203-TyrSerSerArgHisAsnAsn-209
SEQ. ID. NO. 22797   228-HisGlyGluMetLeuGlu-233
SEQ. ID. NO. 22798   240-LeuSerAsnArgGluArgAsnProAspLysProPhe-251
SEQ. ID. NO. 22799   255-HisPheAspGluAsnGlyLysIleThr-263
a691
AMPHI Regions - AMPHI
SEQ. ID. NO. 22800   11-LysProAlaAlaSer-15
SEQ. ID. NO. 22801   55-HisAsnGluLeuArgLysIleArgAla-63
SEQ. ID. NO. 22802   108-ArgTyrLeuSerGly-112
Antigenic Index - Jameson-Wolf
SEQ. ID. NO. 22803   7-CysArgPheAlaLys-11
SEQ. ID. NO. 22804   36-LeuAsnAspPheGlnProAsnCysAspIleArgArgLeuGlyLeuThrGlnGlyGlnHisAsnGluLeuArgLysIleArgAla-63
SEQ. ID. NO. 22805   67-MetAlaGlyAspArgAlaArgLeuLysValMetHis-78
SEQ. ID. NO. 22806   80-GluHisSerArgArgArgSerVal-87
SEQ. ID. NO. 22807   91-IleSerSerAspValPheAsnArgAsnGluAlaArgAspTyrValGluSerArgTyrLeuSerGlyMetAspPheAlaValAspGluLeuGluIle-122
SEQ. ID. NO. 22808   131-ThrProGlnGlnGlnGln-136
SEQ. ID. NO. 22809   140-SerSerCysLeuLys-144
Hydrophilic Regions - Hopp-Woods
SEQ. ID. NO. 22810   43-CysAspIleArgArgLeuGly-49
SEQ. ID. NO. 22811   54-GlnHisAsnGluLeuArgLysIleArgAla-63
SEQ. ID. NO. 22812   67-MetAlaGlyAspArgAlaArgLeuLysValMetHis-78
SEQ. ID. NO. 22813   80-GluHisSerArgArgArgSerVal-87
SEQ. ID. NO. 22814   95-ValPheAsnArgAsnGluAlaArgAspTyrValGlu-106
SEQ. ID. NO. 22815   115-PheAlaValAspGluLeuGluIle-122
a692
AMPHI Regions - AMPHI
SEQ. ID. NO. 22816   6-CysArgCysSerGluSerIleArgArgIleArgArgAsn-18
SEQ. ID. NO. 22817   77-LeuGlyTyrValPheLysProLeuAlaValPheVal-88
SEQ. ID. NO. 22818   106-GlnGlyPheGlyGlnLeuHis-112
SEQ. ID. NO. 22819   132-ThrArgGlnLeuArgGlyPheLys-139
SEQ. ID. NO. 22820   143-PheAspValPheGlnValPheGlyAsn-151
SEQ. ID. NO. 22821   170-GlnPheValGluHisHis-175
SEQ. ID. NO. 22822   177-AspAlaGlyGluValGlyArgValValGlyArgGlyTyrGlyAlaAlaValPheAspPhePheGlnArgPheGlnLeu-202
SEQ. ID. NO. 22823   205-ValGlnSerGlnArgArgGlyArgHisLeuGluAspPheGlyAsp-219

TABLE 1-continued

| | |
|---|---|
| SEQ. ID. NO. 22824 | 254-ValGlyLysLeuAspGlnPheAspGlyVal-263 |
| SEQ. ID. NO. 22825 | 275-PheAspHisIleAlaGluValAlaAsp-283 |
| Antigenic Index - Jameson-Wolf | |
| SEQ. ID. NO. 22826 | 6-CysArgCysSerGluSerIleArgArgIleArgArgAsnGlyArgGluTrpArgIleLysGlyGlnLysCysArgLeuAsnThrAspThrValGln-37 |
| SEQ. ID. NO. 22827 | 89-GlyGlyPheAspGlyArgProValAspIleGlyLysAlaArgPheLeu-104 |
| SEQ. ID. NO. 22828 | 120-AlaValAspAspGlyLysIle-126 |
| SEQ. ID. NO. 22829 | 131-AlaThrArgGlnLeuArgGlyPheLysLeuAspAspPheAspVal-145 |
| SEQ. ID. NO. 22830 | 153-ArgPheGlyCysGlyGlnArgIleAspAla-162 |
| SEQ. ID. NO. 22831 | 174-HisHisGlnAspAlaGlyGluValGlyArgValValGlyArgGlyTyr-189 |
| SEQ. ID. NO. 22832 | 204-ArgValGlnSerGlnArgArgGlyArgHisLeuGluAspPheGlyAsp-219 |
| SEQ. ID. NO. 22833 | 236-GluAspValAspVal-240 |
| SEQ. ID. NO. 22834 | 255-GlyLysLeuAspGlnPheAspGly-262 |
| SEQ. ID. NO. 22835 | 279-AlaGluValAlaAspGlyArgAlaGluAspAspPhePhePhe-292 |
| SEQ. ID. NO. 22836 | 295-AlaValValGlyGlyGlyArgSerGlyCysGlyGlyArg-307 |
| SEQ. ID. NO. 22837 | 313-AlaAlaGlyGlyGluAspGluArgGluCysGlyGlyGlyLysGlyPheGluGlu-330 |
| Hydrophilic Regions - Hopp-Woods | |
| SEQ. ID. NO. 22838 | 7-ArgCysSerGluSerIleArgArgIleArgArgAsnGlyArgGluTrpArgIleLysGlyGlnLysCysArgLeuAsnThr-33 |
| SEQ. ID. NO. 22839 | 91-PheAspGlyArgProValAspIleGlyLys-100 |
| SEQ. ID. NO. 22840 | 120-AlaValAspAspGlyLysIle-126 |
| SEQ. ID. NO. 22841 | 131-AlaThrArgGlnLeuArgGlyPheLysLeuAspAspPheAsp-144 |
| SEQ. ID. NO. 22842 | 174-HisHisGlnAspAlaGlyGluValGlyArgValValGly-186 |
| SEQ. ID. NO. 22843 | 206-GlnSerGlnArgArgGlyArgHisLeuGluAspPheGlyAsp-219 |
| SEQ. ID. NO. 22844 | 236-GluAspValAspVal-240 |
| SEQ. ID. NO. 22845 | 255-GlyLysLeuAspGlnPheAsp-261 |
| SEQ. ID. NO. 22846 | 279-AlaGluValAlaAspGlyArgAlaGluAspAspPhePhePhe-292 |
| SEQ. ID. NO. 22847 | 299-GlyGlyArgSerGlyCysGly-305 |
| SEQ. ID. NO. 22848 | 315-GlyGlyGluAspGluArgGluCysGlyGly-324 |
| SEQ. ID. NO. 22849 | 326-LysGlyPheGluGlu-330 |
| a694 | |
| AMPHI Regions - AMPHI | |
| SEQ. ID. NO. 22850 | 82-ArgGlyArgAlaCysArg-87 |
| SEQ. ID. NO. 22851 | 116-CysArgHisPheAlaGln-121 |
| SEQ. ID. NO. 22852 | 123-ValAlaValGlyArgIleGly-129 |
| SEQ. ID. NO. 22853 | 140-PheCysGlnLeuPheAsp-145 |
| SEQ. ID. NO. 22854 | 156-AspIlePheLeuVal-160 |
| SEQ. ID. NO. 22855 | 162-IleAlaAspIleGlyGlu-167 |
| SEQ. ID. NO. 22856 | 184-ArgGlyLeuAlaAspIleGlyGluPheValGlyValSerAsp-197 |
| SEQ. ID. NO. 22857 | 251-HisGlnArgAlaSerArgIleLys-258 |
| SEQ. ID. NO. 22858 | 283-ArgAlaArgHisPheArgGlnValPheAsn-293 |
| SEQ. ID. NO. 22859 | 311-AspPheValAlaHisIle-316 |
| SEQ. ID. NO. 22860 | 340-AlaAlaArgIleGly-344 |
| Antigenic Index - Jameson-Wolf | |
| SEQ. ID. NO. 22861 | 3-SerAlaSerGlyThrArgGlnLysCysArgLeuLysProVal-16 |
| SEQ. ID. NO. 22862 | 23-ProLysHisSerThrProAlaSer-30 |
| SEQ. ID. NO. 22863 | 47-GlyGlnAspGluHisAsnAla-53 |
| SEQ. ID. NO. 22864 | 66-ProProSerAlaTyrGly-71 |
| SEQ. ID. NO. 22865 | 79-HisPheGlyArgGlyArgAlaCysArgTyr-88 |
| SEQ. ID. NO. 22866 | 110-ArgIleAspSerAlaArgCysArgHis-118 |
| SEQ. ID. NO. 22867 | 127-ArgIleGlyArgThrAspHisAsnHisAsp-136 |
| SEQ. ID. NO. 22868 | 144-PheAspGlyGlyLeuProValGlyArgArgIleAla-155 |
| SEQ. ID. NO. 22869 | 163-AlaAspIleGlyGluThrArgValGlnArgGlyAspAspValPhe-177 |
| SEQ. ID. NO. 22870 | 180-IleAspArgGluArgGlyLeuAlaAsp-188 |
| SEQ. ID. NO. 22871 | 202-HisIleSerAspArgPheAspGlnLysHisPheAlaArgArgLysLeuProHisArgSerPheAspLeu-224 |
| SEQ. ID. NO. 22872 | 228-LeuMetProAspHisAspAspPheThr-236 |
| SEQ. ID. NO. 22873 | 250-ArgHisGlnArgAlaSerArgIleLysHisAlaGluThrAlaLeu-264 |
| SEQ. ID. NO. 22874 | 268-LeuProHisArgLeuArgTyrAla-275 |
| SEQ. ID. NO. 22875 | 280-AsnGlnCysArgAlaArgArgHisPhe-288 |
| SEQ. ID. NO. 22876 | 291-ValPheAsnLysHisArgThr-297 |
| SEQ. ID. NO. 22877 | 316-IleAsnArgArgAlaGluLeu-322 |
| SEQ. ID. NO. 22878 | 326-ThrPheAspAsnThrAspCysPro-333 |
| SEQ. ID. NO. 22879 | 336-ThrSerAlaGluAlaAlaArgIleGlyLysAspAspGlyPhe-349 |
| SEQ. ID. NO. 22880 | 370-TyrGlyGlyArgCysCysProThrProProThrProHisArgArgArg-385 |
| Hydrophilic Regions - Hopp-Woods | |
| SEQ. ID. NO. 22881 | 5-SerGlyThrArgGlnLysCysArgLeuLysPro-15 |
| SEQ. ID. NO. 22882 | 47-GlyGlnAspGluHisAsnAla-53 |
| SEQ. ID. NO. 22883 | 81-GlyArgGlyArgAlaCysArg-87 |
| SEQ. ID. NO. 22884 | 110-ArgIleAspSerAlaArgCysArgHis-118 |
| SEQ. ID. NO. 22885 | 127-ArgIleGlyArgThrAspHisAsnHis-135 |
| SEQ. ID. NO. 22886 | 150-ValGlyArgArgIleAla-155 |
| SEQ. ID. NO. 22887 | 163-AlaAspIleGlyGluThrArgValGlnArgGlyAspAsp-175 |
| SEQ. ID. NO. 22888 | 180-IleAspArgGluArgGlyLeuAlaAsp-188 |
| SEQ. ID. NO. 22889 | 202-HisIleSerAspArgPheAspGlnLysHisPheAlaArgArgLysLeuProHisArgSerPheAspLeu-224 |
| SEQ. ID. NO. 22890 | 230-ProAspHisAspAsp-234 |
| SEQ. ID. NO. 22891 | 250-ArgHisGlnArgAlaSerArgIleLysHisAlaGluThrAlaLeu-264 |
| SEQ. ID. NO. 22892 | 280-AsnGlnCysArgAlaArgArgHisPhe-288 |
| SEQ. ID. NO. 22893 | 292-PheAsnLysHisArg-296 |
| SEQ. ID. NO. 22894 | 316-IleAsnArgArgAlaGluLeu-322 |
| SEQ. ID. NO. 22895 | 327-PheAspAsnThrAsp-331 |

TABLE 1-continued

| SEQ. ID. NO. 22896 | 338-AlaGluAlaAlaArgIleGlyLysAspAspGly-348 |
| SEQ. ID. NO. 22897 | 380-ThrProHisArgArgArg-385 | a695
AMPHI Regions - AMPHI
SEQ. ID. NO. 22898  36-HisProGlnArgPheSerLysProAlaGluArgTyrAlaAspCysProHis-52
SEQ. ID. NO. 22899  85-CysSerSerProValSerArgAsn-92
SEQ. ID. NO. 22900  119-AspArgLeuAspTyr-123
SEQ. ID. NO. 22901  129-ValArgLeuSerAsnGluValGlu-136
SEQ. ID. NO. 22902  144-AlaLeuGluHisAla-148
SEQ. ID. NO. 22903  158-ValGlnLysLeuAsp-162
SEQ. ID. NO. 22904  183-ValGluThrAlaGlnAsnLeuTyrAsnGlnAlaLeuLysHisTyrLysSerGly-200
SEQ. ID. NO. 22905  205-AlaAlaSerLeuLeuLysGlyAla-212
SEQ. ID. NO. 22906  238-CysGluSerValIleGluIle-244
SEQ. ID. NO. 22907  248-TyrAlaAsnArgPheLysAspSer-255
SEQ. ID. NO. 22908  278-AlaArgAlaThrTrpArgSerLeuIleGlnThrTyrProGly-291
Antigenic Index - Jameson-Wolf
SEQ. ID. NO. 22909  5-CysProAlaArgArgHisHisCysHis-13
SEQ. ID. NO. 22910  17-PheValGluArgLysGlyAspAlaArgSerGlyPhe-28
SEQ. ID. NO. 22911  31-AlaAlaGlnArgArgHisProGlnArgPheSerLysProAlaGluArgTyrAlaAspCysProHisHisProAlaArgArgArgArgPheAspProAla
                    SerGluLysIleMetLysThrLys-71
SEQ. ID. NO. 22912  87-SerProValSerArgAsnIleGlnAspMetArgLeuGluProGlnAlaGluAlaGlySerSerAspAlaIleProTyr-112
SEQ. ID. NO. 22913  117-LeuGlnAspArgLeuAspTyr-123
SEQ. ID. NO. 22914  131-LeuSerAsnGluValGluThrLeuAsnGlyLysValLysAlaLeuGluHisAlaLysThrHisProSerSerArgAlaTyrValGlnLysLeuAspAsp
                    ArgLysLeuLysGlu-168
SEQ. ID. NO. 22915  170-TyrLeuAsnThrGluGlyGlySerAla-178
SEQ. ID. NO. 22916  193-AlaLeuLysHisTyrLysSerGlyArgPhe-202
SEQ. ID. NO. 22917  210-LysGlyAlaAspGlyGlyAspGlyGlySerIleAlaGln-222
SEQ. ID. NO. 22918  230-GlnSerArgAlaArgMetGlyAsnCys-238
SEQ. ID. NO. 22919  244-IleGlyGlyArgTyrAlaAsnArgPheLysAspSerProThrAlaPro-259
SEQ. ID. NO. 22920  266-GlyGluCysGlnTyr-270
SEQ. ID. NO. 22921  272-LeuGlnGlnLysAspIleAla-278
SEQ. ID. NO. 22922  289-TyrProGlySerProAlaAlaAlaLysArgAlaAlaAlaAlaValArgLysArg-305
Hydrophilic Regions - Hopp-Woods
SEQ. ID. NO. 22923  5-CysProAlaArgArgHisHisCys-12
SEQ. ID. NO. 22924  17-PheValGluArgLysGlyAspAlaArgSerGlyPhe-28
SEQ. ID. NO. 22925  31-AlaAlaGlnArgArgHisProGlnArgPheSerLysProAlaGluArgTyrAlaAsp-49
SEQ. ID. NO. 22926  51-ProHisHisProAlaArgArgArgArgPheAspProAlaSerGluLysIleMetLysThrLys71
SEQ. ID. NO. 22927  88-ProValSerArgAsnIleGlnAspMetArgLeuGluProGlnAlaGluAlaGlySerSerAsp-108
SEQ. ID. NO. 22928  117-LeuGlnAspArgLeuAspTyr-123
SEQ. ID. NO. 22929  131-LeuSerAsnGluValGluThrLeuAsnGlyLysValLysAlaLeuGluHisAlaLysThrHisProSerSer-154
SEQ. ID. NO. 22930  157-TyrValGlnLysLeuAspAspArgLysLeuLysGlu-168
SEQ. ID. NO. 22931  195-LysHisTyrLysSerGlyArgPhe-202
SEQ. ID. NO. 22932  210-LysGlyAlaAspGlyGlyAspGlyGlySerIleAlaGln-222
SEQ. ID. NO. 22933  231-SerArgAlaArgMetGlyAsn-237
SEQ. ID. NO. 22934  248-TyrAlaAsnArgPheLysAspSerProThrAlaPro-259
SEQ. ID. NO. 22935  266-GlyGluCysGlnTyr-270
SEQ. ID. NO. 22936  272-LeuGlnGlnLysAspIleAla-278
SEQ. ID. NO. 22937  293-ProAlaAlaLysArgAlaAlaAlaAlaValArgLysArg-305
a696
AMPHI Regions - AMPHI
SEQ. ID. NO. 22938  18-PheGlyGlyIlePheHisPheValCysArgPheLeuSerArgValGlySerPheValGlnSerIlePheSerCysPheSer-44
SEQ. ID. NO. 22939  65-IlePheAspLeuValPhe-70
SEQ. ID. NO. 22940  94-GlyLeuAsnArgPheLeuAsnLeuLeuPheGlyPheLeuArg-107
Antigenic Index - Jameson-Wolf
SEQ. ID. NO. 22941  12-CysGlnGlyAsnLysLeu-17
SEQ. ID. NO. 22942  73-PheAspGlyArgSerGlyArgLeuGlyGlyArgSerArgSer-86
SEQ. ID. NO. 22943  108-ThrSerCysGlnGlySerArgHisHisCysGlyAsnGln-120
Hydrophilic Regions - Hopp-Woods
SEQ. ID. NO. 22944  73-PheAspGlyArgSerGlyArgLeuGlyGlyArgSerArgSer-86
SEQ. ID. NO. 22945  109-SerCysGlnGlySerArgHisHisCys-117
a700
AMPHI Regions - AMPHI
SEQ. ID. NO. 22946  6-ThrLeuLeuSerValLeuIleProMetPheAlaGlyPhePheIleArgValProLys-24
SEQ. ID. NO. 22947  27-LeuProAlaLeuAspLysValLeuSerValLeu-37
SEQ. ID. NO. 22948  51-ArgValGluAspLeuGlySerArg-58
SEQ. ID. NO. 22949  80-AlaLeuAlaValLeuGlyLysLeu-87
SEQ. ID. NO. 22950  191-SerTrpValLysGlyLeu-196
SEQ. ID. NO. 22951  204-TrpTyrSerLeuSerGlyLeuVal-211
SEQ. ID. NO. 22952  216-TyrGlyAlaValTrpGlySerIleAlaLeuLeuAsnAspLeuAlaArgGluLeu-233
SEQ. ID. NO. 22953  267-ArgGlyAlaGlyGlyLeu-272
Antigenic Index - Jameson-Wolf
SEQ. ID. NO. 22954  21-ArgValProLysProTyrLeu-27
SEQ. ID. NO. 22955  50-SerArgValGluAspLeuGlySerArgLeuAspAspMetAla-63
SEQ. ID. NO. 22956  90-TrpArgIleLysGlyLysGlyLysGlyVal-99
SEQ. ID. NO. 22957  118-AlaSerGlyLysLeuMetArg-124
SEQ. ID. NO. 22958  128-MetProSerGluAsnAlaGlyMet-135
SEQ. ID. NO. 22959  149-LeuLysSerSerGlyValSerLeu-156
SEQ. ID. NO. 22960  160-LeuValAsnArgArgGlyIleArgLeu-168
SEQ. ID. NO. 22961  245-ArgPheProAspAla-249
SEQ. ID. NO. 22962  268-GlyAlaGlyGlyLeuGluAla-274

TABLE 1-continued

```
Hydrophilic Regions - Hopp-Woods
SEQ. ID. NO. 22963    50-SerArgValGluAspLeuGlySerArgLeuAspAspMetAla-63
SEQ. ID. NO. 22964    92-IleLysGlyLysGlyLysGlyVal-99
SEQ. ID. NO. 22965    149-LeuLysSerSerGlyValSer-155
SEQ. ID. NO. 22966    160-LeuValAsnArgArgGlyIleArg-167
a701
AMPHI Regions - AMPHI
SEQ. ID. NO. 22967    6-PheGlnValAlaGly-10
SEQ. ID. NO. 22968    45-ProAsnSerPheAlaSerPheLysArgPheSerSerIle-57
Antigenic Index - Jameson-Wolf
SEQ. ID. NO. 22969    18-GlnSerThrProSerSerProThr-25
SEQ. ID. NO. 22970    33-ThrSerProGluAlaGly-38
SEQ. ID. NO. 22971    52LysArgPheSerSerIleSer-58
SEQ. ID. NO. 22972    72-GlyLysAlaAspIleProThr-78
SEQ. ID. NO. 22973    105-LysAlaSerLeuAsnAsnArgAlaThrSerSer-115
SEQ. ID. NO. 22974    119-SerGlySerGlyThrArgLeu-125
Hydrophilic Regions - Hopp-Woods
SEQ. ID. NO. 22975    72-GlyLysAlaAspIle-76
SEQ. ID. NO. 22976    107-SerLeuAsnAsnArgAlaThrSer-114
a702
AMPHI Regions - AMPHI
SEQ. ID. NO. 22977    51-CysSerGlyLeuValThrVal-57
SEQ. ID. NO. 22978    118-LysIleSerArgGly-122
Antigenic Index - Jameson-Wolf
SEQ. ID. NO. 22979    1-MetProCysSerLysAlaSer-7
SEQ. ID. NO. 22980    28-LeuAlaArgAspSerCysSerProGlyLeu-37
SEQ. ID. NO. 22981    41-ThrAlaProAlaSerSer-46
SEQ. ID. NO. 22982    68-LeuAlaIleArgArgMetAlaSerArgProThrGlyValArgArgValIleSer-85
SEQ. ID. NO. 22983    88-GlyMetProProSerThrArgAlaTrpAspLysSerMetAla-101
SEQ. ID. NO. 22984    118-LysIleSerArgGlyValSer-124
SEQ. ID. NO. 22985    139-ArgTrpAspArgLeu-143
Hydrophilic Regions - Hopp-Woods
SEQ. ID. NO. 22986    29-AlaArgAspSerCysSer-34
SEQ. ID. NO. 22987    69-AlaIleArgArgMetAlaSerArgProThrGlyValArgArgValIleSer-85
SEQ. ID. NO. 22988    94-ArgAlaTrpAspLys-98
SEQ. ID. NO. 22989    139-ArgTrpAspArgLeu-143
a703
AMPHI Regions - AMPHI
SEQ. ID. NO. 22990    21-GlnThrLeuAlaThrValAsnGly-28
SEQ. ID. NO. 22991    64-GluValValAsnThrValValAlaGlnGlu-73
SEQ. ID. NO. 22992    79-LeuAspArgSerAlaGlu-84
SEQ. ID. NO. 22993    140-AlaAlaTyrAspAsnIleSerGlyPheTyrLysGly-151
SEQ. ID. NO. 22994    181-PheAspAlaValLeu-185
SEQ. ID. NO. 22995    204-ValProLeuLysAspLeuGluGlnGlyValProProLeuTyrGlnAlaIleLysAspLeuLysLys-225
SEQ. ID. NO. 22996    252-ValProSerPheAsp-256
SEQ. ID. NO. 22997    270-ArgIleAspArgAlaValGlyAlaLeu-278
Antigenic Index - Jameson-Wolf
SEQ. ID. NO. 22998    1-MetLysAlaLysIle-5
SEQ. ID. NO. 22999    26-ValAsnGlyGlnLysIleAspSerSerVal-35
SEQ. ID. NO. 23000    43-PheArgAlaGluAsnSerArgAlaGluAspThrProGlnLeuArg-57
SEQ. ID. NO. 23001    72-GlnGluValLysArgLeuLysLeuAspArgSerAlaGluPheLysAsnAlaLeuAlaLysLeuArgAlaGluAlaLysLysSerGlyAspAspLysLys
                      ProSerPheLysThr-109
SEQ. ID. NO. 23002    129-LysThrGlnProValSerGluGlnGluValLysAlaAlaTyr-142
SEQ. ID. NO. 23003    144-AsnIleSerGlyPheTyrLysGlyThrGlnGluValGlnLeu-157
SEQ. ID. NO. 23004    160-IleLeuThrAspLysGluGluAsnAlaLysLysAlaValAlaAspLeuLysAlaLysLysGlyPhe-181
SEQ. ID. NO. 23005    188-TyrSerLeuAsnAspArgThrLysGlnThrGlyAlaProValGly-202
SEQ. ID. NO. 23006    207-LysAspLeuGluGlnGlyValProPro-215
SEQ. ID. NO. 23007    221-LysAspLeuLysLysGlyGluPheThrAlaThrProLeuLysAsnGlyAspPhe-238
SEQ. ID. NO. 23008    243-TyrValAsnAspSerArgGluValLysValProSerPheAspGluMetLysGly-260
SEQ. ID. NO. 23009    266-LeuGlnAlaGluArgIleAspArgAlaVal-275
SEQ. ID. NO. 23010    282-AlaAsnIleLysProAlaLys-288
Hydrophilic Regions - Hopp-Woods
SEQ. ID. NO. 23011    1-MetLysAlaLysIle-5
SEQ. ID. NO. 23012    29-GlnLysIleAspSerSerVal-35
SEQ. ID. NO. 23013    43-PheArgAlaGluAsnSerArgAlaGluAspThrProGlnLeuArg-57
SEQ. ID. NO. 23014    72-GlnGluValLysArgLeuLysLeuAspArgSerAlaGluPheLysAsnAlaLeuAlaLysLeuArgAlaGluAlaLysLysSerGlyAspAspLysLys
                      ProSerPhe-107
SEQ. ID. NO. 23015    131-GlnProValSerGluGlnGluValLysAlaAlaTyr-142
SEQ. ID. NO. 23016    160-IleLeuThrAspLysGluGluAsnAlaLysLysAlaValAlaAspLeuLysAlaLysLysGlyPhe-181
SEQ. ID. NO. 23017    189-SerLeuAsnAspArgThrLysGlnThrGly-198
SEQ. ID. NO. 23018    207-LysAspLeuGluGln-211
SEQ. ID. NO. 23019    221-LysAspLeuLysLysGlyGluPhe-228
SEQ. ID. NO. 23020    245-AsnAspSerArgGluValLysValProSerPheAspGluMetLysGly-260
SEQ. ID. NO. 23021    266-LeuGlnAlaGluArgIleAspArgAlaVal-275
SEQ. ID. NO. 23022    282-AlaAsnIleLysProAlaLys-288
a704
AMPHI Regions - AMPHI
SEQ. ID. NO. 23023    33-GlyCysGlnAlaValAlaGlnSerIleIleAspAlaGlyLeuGly-47
SEQ. ID. NO. 23024    65-GlnGluIleLeuAspGlnIleArgLeuTyrAspLeuProGluValGlnSerAspPheValGluThrHis-87
SEQ. ID. NO. 23025    184-LeuGlyMetMetGln-188
```

TABLE 1-continued

| SEQ. ID. NO. | Sequence |
|---|---|
| SEQ. ID. NO. 23026 | 208-LeuGlnIleLeuHisTrpGlyGlyPheLeuMetValLeuPro-221 |
| SEQ. ID. NO. 23027 | 232-GlnGlyAlaLeuArgAspLeuLys-239 |
| SEQ. ID. NO. 23028 | 252-AlaIleIleMetThrPheIleAlaGlyValTyrSer-263 |
| SEQ. ID. NO. 23029 | 289-PheMetGluHisIleAlaArg-295 |
| SEQ. ID. NO. 23030 | 298-AlaGlyAspAlaAlaGluArgLeuValLysLeuIleProAlaPheCysHisHisMetProAspTyrProAspThrGlnGluThr-325 |
| SEQ. ID. NO. 23031 | 400-GlyGlyThrArgLeuSerHisIleValArgLeuLeuAspArgAlaLeuAla-416 |
| SEQ. ID. NO. 23032 | 423-GluLeuAlaGluGlnTyr-428 |
| SEQ. ID. NO. 23033 | 499-AlaIleGluThrLeuAlaGln-505 |
| SEQ. ID. NO. 23034 | 527-IleSerLeuLeuArg-531 |
| SEQ. ID. NO. 23035 | 576-LeuAsnArgIleGlyGluGlyValGly-584 |
| SEQ. ID. NO. 23036 | 639-LeuLysAspSerAlaAlaGluAlaValArgGlnLeuAla-651 |
| SEQ. ID. NO. 23037 | 670-GluThrAlaArgAlaAlaLeuGlyVal-677 |
| SEQ. ID. NO. 23038 | 691-GluTyrValLysAlaLeuGlnLysGlu-699 |
| SEQ. ID. NO. 23039 | 744-AspLeuArgThrValAlaHisLeuLeuAsp-753 |
| SEQ. ID. NO. 23040 | 780-AlaValLeuGlyTyrValGlnProTrpIleAlaAla-791 |
| SEQ. ID. NO. 23041 | 799-LeuAlaValLeuGly-803 |
| SEQ. ID. NO. 23042 | 805-AlaLeuArgLeuHisLysArg-811 |
| Antigenic Index - Jameson-Wolf | |
| SEQ. ID. NO. 23043 | 1-MetLysLysThrCys-5 |
| SEQ. ID. NO. 23044 | 9-GlyLeuAspValProGluAsn-15 |
| SEQ. ID. NO. 23045 | 21-ArgTyrGluAsnGluAspArgGluThrCysCys-31 |
| SEQ. ID. NO. 23046 | 46-LeuGlySerTyrTyrLysGlnArgThrAlaAspAlaGlnLysThrGluLeuProProGlnGluIleLeuAsp-69 |
| SEQ. ID. NO. 23047 | 77-ProGluValGlnSerAspPheValGluThrHisGlyGlyThrArgGluAla-93 |
| SEQ. ID. NO. 23048 | 112-GlnLeuLeuArgThrAspGlyIleVal-120 |
| SEQ. ID. NO. 23049 | 124-LeuAsnTyrSerThrHisArgCys-131 |
| SEQ. ID. NO. 23050 | 133-ValValTrpAspAspGlyLysIleArgLeu-142 |
| SEQ. ID. NO. 23051 | 158-ProTyrAspAlaGlnLysIleGluAlaAlaAsnGlnLysGluArgLysGlnTyr-175 |
| SEQ. ID. NO. 23052 | 199-TyrGlyGlyAspIleGluProAspPhe-207 |
| SEQ. ID. NO. 23053 | 234-AlaLeuArgAspLeuLysAsnArgArgValGlyMetAspThrProIle-249 |
| SEQ. ID. NO. 23054 | 293-IleAlaArgArgLysAlaGlyAspAlaAlaGluArgLeuVal-306 |
| SEQ. ID. NO. 23055 | 316-MetProAspTyrProAspThrGlnGluThrCysGlu-327 |
| SEQ. ID. NO. 23056 | 329-AlaValValLysLeuLysAlaGlyAsp-337 |
| SEQ. ID. NO. 23057 | 342-LysProGlyGluThrIleProValAspGlyThrVal-353 |
| SEQ. ID. NO. 23058 | 356-GlySerSerAlaValAsnGluSer-363 |
| SEQ. ID. NO. 23059 | 365-LeuThrGlyGluSer-369 |
| SEQ. ID. NO. 23060 | 374-LysMetProSerGluLysValThrAla-382 |
| SEQ. ID. NO. 23061 | 393-IleArgThrAspArgThrGlyGlyGlyThrArg-403 |
| SEQ. ID. NO. 23062 | 414-AlaLeuAlaGlnLysProArgThrAlaGluLeuAlaGlu-426 |
| SEQ. ID. NO. 23063 | 486-ThrLeuAlaArgGluGlyIle-492 |
| SEQ. ID. NO. 23064 | 495-GlyGlyLysGlnAlaIle-500 |
| SEQ. ID. NO. 23065 | 510-IlePheAspLysThrGlyThrLeuThrGlnGlyLysProAlaValArgArg-526 |
| SEQ. ID. NO. 23066 | 528-SerLeuLeuArgGlyThrAspGluAlaPhe-537 |
| SEQ. ID. NO. 23067 | 545-LeuGluGlnGlnSerGluHisProLeu-553 |
| SEQ. ID. NO. 23068 | 560-CysArgIleSerAspGlySerValPro-568 |
| SEQ. ID. NO. 23069 | 570-IleAlaIleLysGlnArgLeuAsnArgIleGlyGluGlyVal-583 |
| SEQ. ID. NO. 23070 | 589-ValAsnGlyGluThrGln-594 |
| SEQ. ID. NO. 23071 | 605-AlaGluIleSerGlyLysGluProGlnThrGluGlyGlyGlySer-619 |
| SEQ. ID. NO. 23072 | 635-LeuGlnAspProLeuLysAspSerAlaAlaGluAlaValArg-648 |
| SEQ. ID. NO. 23073 | 650-LeuAlaGlyLysAsnLeu-655 |
| SEQ. ID. NO. 23074 | 659-IleLeuSerGlyAspArgGluThrAlaVal-668 |
| SEQ. ID. NO. 23075 | 684-AlaMetProGluAspLysLeuGluTyr-692 |
| SEQ. ID. NO. 23076 | 694-LysAlaLeuGlnLysGluGlyLysLys-702 |
| SEQ. ID. NO. 23077 | 707-GlyAspGlyIleAsnAspAla-713 |
| SEQ. ID. NO. 23078 | 725-AlaAlaGlyGlyThrAspIleAlaArgAspGlyAlaAsp-737 |
| SEQ. ID. NO. 23079 | 743-GluAspLeuArgThr-747 |
| SEQ. ID. NO. 23080 | 753-AspGlnAlaArgArgThrArgHisIleIle-762 |
| SEQ. ID. NO. 23081 | 807-ArgLeuHisLysArgGlyLysMetGlnSerGluLysMetProSerGluGln-823 |
| Hydrophilic Regions - Hopp-Woods | |
| SEQ. ID. NO. 23082 | 1-MetLysLysThrCys-5 |
| SEQ. ID. NO. 23083 | 21-ArgTyrGluAsnGluAspArgGluThrCys-30 |
| SEQ. ID. NO. 23084 | 50-TyrLysGlnArgThrAlaAspAlaGlnLysThrGluLeuProPro-64 |
| SEQ. ID. NO. 23085 | 77-ProGluValGlnSerAspPheValGlu-85 |
| SEQ. ID. NO. 23086 | 87-HisGlyGlyThrArgGluAla-93 |
| SEQ. ID. NO. 23087 | 112-GlnLeuLeuArgThrAspGlyIleVal-120 |
| SEQ. ID. NO. 23088 | 133-ValValTrpAspAspGlyLysIleArgLeu-142 |
| SEQ. ID. NO. 23089 | 160-AspAlaGlnLysIleGluAlaAlaAsnGlnLysGluArgLysGlnTyr-175 |
| SEQ. ID. NO. 23090 | 201-GlyAspIleGluProAspPhe-207 |
| SEQ. ID. NO. 23091 | 234-AlaLeuArgAspLeuLysAsnArgArgValGlyMet-245 |
| SEQ. ID. NO. 23092 | 293-IleAlaArgArgLysAlaGlyAspAlaAlaGluArgLeuVal-306 |
| SEQ. ID. NO. 23093 | 318-AspTyrProAspThrGlnGluThrCysGlu-327 |
| SEQ. ID. NO. 23094 | 329-AlaValValLysLeuLysAlaGlyAsp-337 |
| SEQ. ID. NO. 23095 | 375-MetProSerGluLysValThr-381 |
| SEQ. ID. NO. 23096 | 393-IleArgThrAspArgThrGlyGlyGlyThrArg-403 |
| SEQ. ID. NO. 23097 | 414-AlaLeuAlaGlnLysProArgThrAlaGluLeuAlaGlu-426 |
| SEQ. ID. NO. 23098 | 486-ThrLeuAlaArgGluGlyIle-492 |
| SEQ. ID. NO. 23099 | 518-ThrGlnGlyLysProAlaValArgArg-526 |
| SEQ. ID. NO. 23100 | 531-ArgGlyThrAspGlu-535 |
| SEQ. ID. NO. 23101 | 545-LeuGluGlnGlnSerGluHisProLeu-553 |
| SEQ. ID. NO. 23102 | 561-ArgIleSerAspGlySerVal-567 |
| SEQ. ID. NO. 23103 | 570-IleAlaIleLysGlnArgLeuAsnArgIleGlyGlu-581 |

TABLE 1-continued

| | |
|---|---|
| SEQ. ID. NO. 23104 | 607-IleSerGlyLysGluProGlnThrGluGlyGlyGly-618 |
| SEQ. ID. NO. 23105 | 637-AspProLeuLysAspSerAlaAlaGluAlaValArg-648 |
| SEQ. ID. NO. 23106 | 661-SerGlyAspArgGluThrAlaVal-668 |
| SEQ. ID. NO. 23107 | 684-AlaMetProGluAspLysLeuGluTyr-692 |
| SEQ. ID. NO. 23108 | 694-LysAlaLeuGlnLysGluGlyLysLys-702 |
| SEQ. ID. NO. 23109 | 730-AspIleAlaArgAspGlyAlaAsp-737 |
| SEQ. ID. NO. 23110 | 743-GluAspLeuArgThr-747 |
| SEQ. ID. NO. 23111 | 753-AspGlnAlaArgArgThrArgHisIleIle-762 |
| SEQ. ID. NO. 23112 | 807-ArgLeuHisLysArgGlyLysMetGlnSerGluLysMetProSerGluGln-823 | a705
AMPHI Regions - AMPHI

| | |
|---|---|
| SEQ. ID. NO. 23113 | 67-LysIleLeuLeuLysLeu-72 |
| SEQ. ID. NO. 23114 | 104-AspProIleProAla-108 |
| SEQ. ID. NO. 23115 | 147-TyrMetGlnThrPheArgArgIleValAlaProGln-158 |
| SEQ. ID. NO. 23116 | 169-AsnGluPheIleGlyLeuPheLysAsn-177 |
| SEQ. ID. NO. 23117 | 183-ValValThrValThrGluLeuPheArgValAlaGln-194 |
| SEQ. ID. NO. 23118 | 196-ThrAlaAsnArgThr-200 |

Antigenic Index - Jameson-Wolf

| | |
|---|---|
| SEQ. ID. NO. 23119 | 13-ThrGluThrArgAlaAspMet-19 |
| SEQ. ID. NO. 23120 | 132-ValProLysGlyGlnTrpGlu-138 |
| SEQ. ID. NO. 23121 | 165-ProProLeuSerAsnGlu-170 |
| SEQ. ID. NO. 23122 | 193-AlaGlnGluThrAlaAsnArgThrTyrAsp-202 |
| SEQ. ID. NO. 23123 | 226-AlaArgLeuGluLysArgPheAspArgTyrValAla-237 |

Hydrophilic Regions - Hopp-Woods

| | |
|---|---|
| SEQ. ID. NO. 23124 | 13-ThrGluThrArgAlaAspMet-19 |
| SEQ. ID. NO. 23125 | 193-AlaGlnGluThrAlaAsnArgThr-200 |
| SEQ. ID. NO. 23126 | 226-AlaArgLeuGluLysArgPheAspArgTyrValAla-237 | a706
AMPHI Regions - AMPHI

| | |
|---|---|
| SEQ. ID. NO. 23127 | 9-LeuValSerArgTrpLeuAsnSerTyr-17 |
| SEQ. ID. NO. 23128 | 24-ArgLeuIleHisAlaValArg-30 |
| SEQ. ID. NO. 23129 | 70-IleTyrSerLysAlaValGluArgMetLeuGlyThrValIleGly-84 |
| SEQ. ID. NO. 23130 | 111-ThrAlaSerAlaLeuAlaGlyTrpAlaAla-120 |
| SEQ. ID. NO. 23131 | 153-ArgAlaMetAsnValLeu-158 |
| SEQ. ID. NO. 23132 | 183-LeuAlaAspAsnLeuThrAspCysSerLysMetIleAlaGluIleSerAsnGlyArg-201 |
| SEQ. ID. NO. 23133 | 204-ThrArgGluArgLeuGluGluAsn-211 |
| SEQ. ID. NO. 23134 | 243-MetGluAlaMetGlnHisAlaHisArgLysIleVal-254 |
| SEQ. ID. NO. 23135 | 318-AlaLeuAlaGluHisLeuHis-324 |

Antigenic Index - Jameson-Wolf

| | |
|---|---|
| SEQ. ID. NO. 23136 | 1-MetAsnThrSerGlnArgAsnArgLeu-9 |
| SEQ. ID. NO. 23137 | 11-SerArgTrpLeuAsnSerTyrGluArgTyrArgTyrArgArg-24 |
| SEQ. ID. NO. 23138 | 73-LysAlaValGluArgMetLeu-79 |
| SEQ. ID. NO. 23139 | 97-HisTyrPheHisGlyAsnLeu-103 |
| SEQ. ID. NO. 23140 | 122-GlyLysAsnGlyTyrVal-127 |
| SEQ. ID. NO. 23141 | 140-GlyAspAsnGlySerGluTrpPheAsp-148 |
| SEQ. ID. NO. 23142 | 186-AsnLeuThrAspCysSerLysMetIleAlaGluIleSerAsnGlyArgArgMetThrArgGluArgLeuGluGluAsnMetAlaLysMetArgGlnIleAsn-219 |
| SEQ. ID. NO. 23143 | 221-ArgMetValLysSerArgSerHisLeuAlaAlaThrSerGlyGluSerArgIleSer-239 |
| SEQ. ID. NO. 23144 | 249-AlaHisArgLysIleValAsn-255 |
| SEQ. ID. NO. 23145 | 266-LysLeuGlnSerProLysLeuAsnGlySerGluIleArgLeuLeuAsp-281 |
| SEQ. ID. NO. 23146 | 300-GlyArgHisAlaArgArgIleArgIleAspThrAlaIleAsnProGluLeuGluAlaLeuAla-320 |
| SEQ. ID. NO. 23147 | 334-SerThrAsnMetArgGlnGluIle-341 |
| SEQ. ID. NO. 23148 | 349-GlnArgThrArgArgLysTrpLeuAspAlaHisGluArgGlnHisLeu-364 |
| SEQ. ID. NO. 23149 | 367-SerLeuLeuGluThrArgGluHisSer-375 |

Hydrophilic Regions - Hopp-Woods

| | |
|---|---|
| SEQ. ID. NO. 23150 | 3-ThrSerGlnArgAsnArgLeu-9 |
| SEQ. ID. NO. 23151 | 17-TyrGluArgTyrArgTyrArgArg-24 |
| SEQ. ID. NO. 23152 | 73-LysAlaValGluArgMetLeu-79 |
| SEQ. ID. NO. 23153 | 142-AsnGlySerGluTrpPhe-147 |
| SEQ. ID. NO. 23154 | 186-AsnLeuThrAspCysSerLysMetIleAla-195 |
| SEQ. ID. NO. 23155 | 198-SerAsnGlyArgArgMetThrArgGluArgLeuGluGluAsnMetAlaLysMetArgGlnIleAsn-219 |
| SEQ. ID. NO. 23156 | 221-ArgMetValLysSerArgSerHis-228 |
| SEQ. ID. NO. 23157 | 232-ThrSerGlyGluSerArgIle-238 |
| SEQ. ID. NO. 23158 | 249-AlaHisArgLysIleValAsn-255 |
| SEQ. ID. NO. 23159 | 266-LysLeuGlnSerProLysLeuAsnGlySerGluIleArgLeuLeuAsp-281 |
| SEQ. ID. NO. 23160 | 301-ArgHisAlaArgArgIleArgIle-308 |
| SEQ. ID. NO. 23161 | 314-ProGluLeuGluAlaLeuAla-320 |
| SEQ. ID. NO. 23162 | 336-AsnMetArgGlnGluIle-341 |
| SEQ. ID. NO. 23163 | 349-GlnArgThrArgArgLysTrpLeuAspAlaHisGluArgGlnHisLeu-364 |
| SEQ. ID. NO. 23164 | 367-SerLeuLeuGluThrArgGluHisSer-375 | a707
AMPHI Regions - AMPHI

| | |
|---|---|
| SEQ. ID. NO. 23165 | 16-AsnLeuSerArgLeuGlnLysAla-23 |
| SEQ. ID. NO. 23166 | 98-GluGlnGlyLeuGluAsnLeuArgArgLeuProSerVal-110 |
| SEQ. ID. NO. 23167 | 147-GlyGlyLysThrThrGlyLysTyr-154 |
| SEQ. ID. NO. 23168 | 222-ArgTyrHisGluAlaThrGlu-228 |
| SEQ. ID. NO. 23169 | 267-ThrArgGlnThrTyrLysTyrIleAspAsp-276 |
| SEQ. ID. NO. 23170 | 467-HisLysProLysGlyPheGlnThrThrAsnThr-477 |

TABLE 1-continued

Antigenic Index - Jameson-Wolf
SEQ. ID. NO. 23171   1-XxxLysGluThrAlaPhe-6
SEQ. ID. NO. 23172   13-GlySerAsnAsnLeuSerArgLeuGlnLysAlaAla-24
SEQ. ID. NO. 23173   42-ProGlnAsnMetAspSerGlyIleLeu-50
SEQ. ID. NO. 23174   53-ArgValSerAlaGlyGluIleGlyAspIleArgTyrGluGluLysArgAspXxxLysSerAlaGluGlySerIle-77
SEQ. ID. NO. 23175   79-AlaPheAsnAsnLysXxxProLeuTyrArgAsnLysIleLeuAsn-93
SEQ. ID. NO. 23176   95-ArgAspValGluGlnGlyLeuGluAsnLeuArgArgLeuProSerValLysThrAspIle-114
SEQ. ID. NO. 23177   117-IleProSerGluGluGluGlyLysSerAspLeu-127
SEQ. ID. NO. 23178   130-LysTrpGlnGlnAsnLysProIleArg-138
SEQ. ID. NO. 23179   141-IleGlyIleAspAspAlaGlyGlyLysThrThrGlyLysTyrGlnGly-156
SEQ. ID. NO. 23180   162-XxxAspAsnProLeuGlyLeuSer-169
SEQ. ID. NO. 23181   180-LeuValHisLysThrAspLeuThrXxxAlaThrGlyThrGluThrGluSerGlySerArgSerTyr-201
SEQ. ID. NO. 23182   216-PheAsnHisAsnGlyHisArgTyrHisGluAlaThrGluGlyTyrSerValAsnTyrAspTyrAsnGlyLysGlnTyrGln-242
SEQ. ID. NO. 23183   269-GlnThrTyrLysTyrIleAspAspAlaGluIleGluValGlnArgArgArgSerAlaGlyTrpGluAlaGluLeuArgHis-295
SEQ. ID. NO. 23184   303-GlnLeuAspGlyLysLeuSerTyrLysArgGlyThrGlyMetArgGlnSerMetProAlaProGluGluAsnGlyGlyGlyThrIleProXxxXxxSer
                     ArgMetLysIle-339
SEQ. ID. NO. 23185   366-GlnTrpAsnLysThrPro-371
SEQ. ID. NO. 23186   374-AlaGlnAspLysLeuSerIleGlySerArgTyrThrValArgGlyPheAspGlyGluGlnSerLeuPheGlyGluArgGlyPheTyrTrpGln
                     AsnThr-406
SEQ. ID. NO. 23187   421-AlaAspTyrGlyArgValSerGlyGluSerAla-431
SEQ. ID. NO. 23188   434-ValSerGlyLysGln-438
SEQ. ID. NO. 23189   446-PheArgGlyGlyHisLysValGlyGly-454
SEQ. ID. NO. 23190   464-LysProLeuHisLysProLysGlyPheGln-473
Hydrophilic Regions - Hopp-Woods
SEQ. ID. NO. 23191   1-XxxLysGluThrAlaPhe-6
SEQ. ID. NO. 23192   16-AsnLeuSerArgLeuGlnLysAlaAla-24
SEQ. ID. NO. 23193   58-GluIleGlyAspIleArgTyrGluGluLysArgAspXxxLysSerAlaGluGlySer-76
SEQ. ID. NO. 23194   95-ArgAspValGluGlnGlyLeuGluAsnLeuArgArgLeuProSerValLysThrAspIle-114
SEQ. ID. NO. 23195   118-ProSerGluGluGluGlyLysSerAspLeu-127
SEQ. ID. NO. 23196   141-IleGlyIleAspAspAlaGlyGlyLysThrThrGlyLysTyr-154
SEQ. ID. NO. 23197   180-LeuValHisLysThrAspLeu-186
SEQ. ID. NO. 23198   190-ThrGlyThrGluThrGluSerGlySerArgSer-200
SEQ. ID. NO. 23199   222-ArgTyrHisGluAlaThrGlu-228
SEQ. ID. NO. 23200   273-TyrIleAspAspAlaGluIleGluValGlnArgArgArgSerAlaGlyTrp-289
SEQ. ID. NO. 23201   291-AlaGluLeuArgHis-295
SEQ. ID. NO. 23202   306-GlyLysLeuSerTyrLysArgGlyThrGlyMetArgGlnSerMetProAlaProGluGluAsnGlyGly-328
SEQ. ID. NO. 23203   333-XxxXxxSerArgMetLysIle-339
SEQ. ID. NO. 23204   374-AlaGlnAspLysLeuSerIle-380
SEQ. ID. NO. 23205   388-GlyPheAspGlyGluGln-393
SEQ. ID. NO. 23206   422-AspTyrGlyArgValSerGlyGluSer-430
SEQ. ID. NO. 23207   465-ProLeuHisLysProLysGly-471
a708
AMPHI Regions - AMPHI
SEQ. ID. NO. 23208   26-ProSerArgAlaGluLysAlaAsnGlnValSerAsnIle-38
SEQ. ID. NO. 23209   57-AlaSerIleGluAspAlaLeuLysSerAspPro-67
SEQ. ID. NO. 23210   79-IleTyrGlnTyrLeuLys-84
SEQ. ID. NO. 23211   89-AlaGlnGluSerPhe-93
SEQ. ID. NO. 23212   119-AsnArgProAlaGluSerMetAla-126
SEQ. ID. NO. 23213   128-PheAspLysAlaLeu-132
SEQ. ID. NO. 23214   142-IleAlaAsnLeuAsnLys-147
SEQ. ID. NO. 23215   176-ProAlaPheLysGluLeuAlaArg-183
SEQ. ID. NO. 23216   221-LysAlaLeuGlyAsnAlaGln-227
Antigenic Index - Jameson-Wolf
SEQ. ID. NO. 23217   2-ProPheLysProSerLysArgIleSer-10
SEQ. ID. NO. 23218   19-AlaCysSerThrSerTyrArgProSerArgAlaGluLysAlaAsnGln-34
SEQ. ID. NO. 23219   46-TyrMetArgGlyGlnAspTyrArgGlnXxxThrAlaSerIleGluAspAlaLeuLysSerAspProLysAsnGlu-70
SEQ. ID. NO. 23220   84-LysValAsnAspLysAlaGlnGluSerPheArg-94
SEQ. ID. NO. 23221   97-LeuSerIleLysProAspSerAlaGluIleAsnAsnAsnTyr-110
SEQ. ID. NO. 23222   115-CysGlyArgLeuAsnArgProAlaGlu-123
SEQ. ID. NO. 23223   131-AlaLeuAlaAspProThrTyrProXxx-139
SEQ. ID. NO. 23224   146-AsnLysGlyIleCysSerAlaLysGlnGlyGln-156
SEQ. ID. NO. 23225   176-ProAlaPheLysGluLeuAlaArgThrLysMet-186
SEQ. ID. NO. 23226   191-LeuGlyAspAlaAspTyrTyrPheLysLysTyrGlnSerArgValGluValLeuGlnAlaAspAspLeu-213
SEQ. ID. NO. 23227   240-PheProTyrSerGluGluLeuGln-247
Hydrophilic Regions - Hopp-Woods
SEQ. ID. NO. 23228   4-LysProSerLysArgIle-9
SEQ. ID. NO. 23229   24-TyrArgProSerArgAlaGluLysAlaAsnGln-34
SEQ. ID. NO. 23230   46-TyrMetArgGlyGlnAspTyrArgGlnXxxThrAlaSerIleGluAspAlaLeuLysSerAspProLysAsnGlu-70
SEQ. ID. NO. 23231   84-LysValAsnAspLysAlaGlnGluSerPheArg-94
SEQ. ID. NO. 23232   99-IleLysProAspSerAlaGluIle-106
SEQ. ID. NO. 23233   117-ArgLeuAsnArgProAlaGlu-123
SEQ. ID. NO. 23234   149-IleCysSerAlaLysGlnGly-155
SEQ. ID. NO. 23235   177-AlaPheLysGluLeuAlaArgThrLysMet-186
SEQ. ID. NO. 23236   201-TyrGlnSerArgValGluValLeuGlnAlaAspAspLeu-213
a709
AMPHI Regions - AMPHI
SEQ. ID. NO. 23237   6-SerLeuLeuAspMetProArgGlyGlu-14
SEQ. ID. NO. 23238   18-ValValValAlaLeuIleAlaAlaMetGly-27
SEQ. ID. NO. 23239   37-ProHisMetSerIleIleAlaAlaIleValValLeu-48
SEQ. ID. NO. 23240   54-AlaArgGlyLeuLysTyrAsn-60

TABLE 1-continued

| | |
|---|---|
| SEQ. ID. NO. 23241 | 64-GlnGlyMetIleGlyAlaLeuAsnGlnGly-73 |
| SEQ. ID. NO. 23242 | 115-SerAlaPheAlaLeuCysSerVal-122 |
| SEQ. ID. NO. 23243 | 130-SerLeuThrThrCysAlaThrVal-137 |
| SEQ. ID. NO. 23244 | 168-LysMetSerProLeuSerAspThrXxx-176 |
| SEQ. ID. NO. 23245 | 185-IleAspLeuPheGluHisIleLysAsnMetMetTyrThrThr-198 |
| SEQ. ID. NO. 23246 | 209-MetLeuXxxLeuLeuPro-214 |
| SEQ. ID. NO. 23247 | 221-LeuAsnSerValGluSerPheArg-228 |
| SEQ. ID. NO. 23248 | 234-ThrGlyLeuValHisCysTyrSerLeuIleProPheAlaLeuLeuValValLeu-251 |
| SEQ. ID. NO. 23249 | 261-AlaMetLeuPheThrValIleAlaAlaValAlaValThrTyr-274 |
| SEQ. ID. NO. 23250 | 278-ThrProAspLeuArgGlnLeuGlyAlaTrpPhe-288 |
| SEQ. ID. NO. 23251 | 299-XxxXxxAspIleAlaLysLeuIleSerArgGlyGly-310 |
| SEQ. ID. NO. 23252 | 334-LeuGlyAlaIleProSerLeuLeuAspAlaValArgSerPheLeuThr-349 |
| SEQ. ID. NO. 23253 | 382-ThrPheLysProVal-386 |
| SEQ. ID. NO. 23254 | 395-ArgAsnLeuSerArgThrLeuGluAspAlaGlyThrValIleAsnProLeuValProTrpSerValCysGlyValPheIleXxxHis-423 |

Antigenic Index - Jameson-Wolf

| | |
|---|---|
| SEQ. ID. NO. 23255 | 9-AspMetProArgGlyGluAla-15 |
| SEQ. ID. NO. 23256 | 55-ArgGlyLeuLysTyrAsnAspMetGln-63 |
| SEQ. ID. NO. 23257 | 164-XxxXxxGlyXxxLysMetSerProLeuSerAspThrXxxGlyXxxSer-179 |
| SEQ. ID. NO. 23258 | 222-AsnSerValGluSerPheArgSerGlnLeuGlu-232 |
| SEQ. ID. NO. 23259 | 277-SerThrProAspLeuArgGln-283 |
| SEQ. ID. NO. 23260 | 290-GlyGlyTyrLysLeuGluGlyGluAlaXxxXxxAspIleAlaLysLeuIleSerArgGlyGlyLeuGlu-312 |
| SEQ. ID. NO. 23261 | 349-ThrAsnAlaGlyArgXxxThr-355 |
| SEQ. ID. NO. 23262 | 378-LeuSerGlyGluThrPheLysProValTyrAspLysLeuGlyLeuHisSerArgAsnLeuSerArgThrLeuGluAspAlaGlyThr-406 |

Hydrophilic Regions - Hopp-Woods

| | |
|---|---|
| SEQ. ID. NO. 23263 | 9-AspMetProArgGlyGluAla-15 |
| SEQ. ID. NO. 23264 | 57-LeuLysTyrAsnAspMetGln-63 |
| SEQ. ID. NO. 23265 | 165-XxxGlyXxxLysMetSerProLeuSerAspThrXxxGly-177 |
| SEQ. ID. NO. 23266 | 225-GluSerPheArgSerGlnLeuGlu-232 |
| SEQ. ID. NO. 23267 | 279-ProAspLeuArgGln-283 |
| SEQ. ID. NO. 23268 | 293-LysLeuGluGlyGluAlaXxxXxxAspIleAlaLysLeuIleSer-307 |
| SEQ. ID. NO. 23269 | 396-AsnLeuSerArgThrLeuGluAspAlaGly-405 | a710
AMPHI Regions - AMPHI

| | |
|---|---|
| SEQ. ID. NO. 23270 | 6-LysIleArgLeuMetArgGluLeuAsnLysTrpSerGln-18 |
| SEQ. ID. NO. 23271 | 31-GlyTyrAlaLysIleGlu-36 |
| SEQ. ID. NO. 23272 | 45-ProArgLeuGluGlnLeuAlaGlnIlePheLysIleAspMetTrpAspLeuLeuLys-63 |
| SEQ. ID. NO. 23273 | 105-CysLysGluMetLeuGlu-110 |

Antigenic Index - Jameson-Wolf

| | |
|---|---|
| SEQ. ID. NO. 23274 | 1-MetGluThrHisGluLysIleArgLeuMetArgGluLeuAsnLysTrpSerGlnGluAspMetAlaGluLysLeuAla-26 |
| SEQ. ID. NO. 23275 | 33-AlaLysIleGluArgGlyGluThrGlnLeuAsnIleProArgLeuGluGln-49 |
| SEQ. ID. NO. 23276 | 62-LeuLysSerGlyGlyGlyGly-68 |
| SEQ. ID. NO. 23277 | 74-AsnAspValAspThrAsnSerGlyLys-82 |
| SEQ. ID. NO. 23278 | 88-AlaGlnAspAlaSerGlyLys-94 |
| SEQ. ID. NO. 23279 | 100-MetGluLeuLysHisCysLysGluMetLeuGluHisLysAspLysGluIleGluLeuLeuArgLysLeuThrGlu-124 |

Hydrophilic Regions - Hopp-Woods

| | |
|---|---|
| SEQ. ID. NO. 23280 | 1-MetGluThrHisGluLysIleArgLeuMetArgGluLeuAsnLysTrpSerGlnGluAspMetAlaGluLysLeuAla-26 |
| SEQ. ID. NO. 23281 | 33-AlaLysIleGluArgGlyGluThr-40 |
| SEQ. ID. NO. 23282 | 45-ProArgLeuGluGln-49 |
| SEQ. ID. NO. 23283 | 74-AsnAspValAspThrAsnSerGly-81 |
| SEQ. ID. NO. 23284 | 100-MetGluLeuLysHisCysLysGluMetLeuGluHisLysAspLysGluIleGluLeuLeuArgLysLeuThrGlu-124 | a711
AMPHI Regions - AMPHI

| | |
|---|---|
| SEQ. ID. NO. 23285 | 28-AlaGluSerTyrArgAsnLeuThrAlaSerGluIleAlaLysValTyrThrIleAlaArgMetThr-49 |
| SEQ. ID. NO. 23286 | AspLeuAspMetLeuAsnAspIleLys-58 |
| SEQ. ID. NO. 23287 | 67-SerGlyGlnSerPheAspAspTrpArgLysGlyIleLeu-79 |
| SEQ. ID. NO. 23288 | 95-GlyLysAspIleIleAspProAlaThrGlyGluValPheGlySerProArgArgLeuGluThrIleTyrArgThrAsnMet-121 |
| SEQ. ID. NO. 23289 | 128-GlyGlnTyrGlnGlyTyrMet-134 |
| SEQ. ID. NO. 23290 | 158-SerAlaIleAspGly-162 |
| SEQ. ID. NO. 23291 | 195-ValGluArgGlnGly-199 |
| SEQ. ID. NO. 23292 | 207-SerAspAsnLeuValGluThrHis-214 |
| SEQ. ID. NO. 23293 | 258-LysTyrAspArgAlaLeuAlaHisGlnPheAla-268 |
| SEQ. ID. NO. 23294 | 281-PheLysGlnLeuGluLysGluPheTyr-289 |
| SEQ. ID. NO. 23295 | 329-GlnGluLeuAlaGlyMetThr-335 |
| SEQ. ID. NO. 23296 | 352-SerArgGluGlyGlnAsnPhe-358 |
| SEQ. ID. NO. 23297 | 360-AspSerTyrTyrAlaPheLeuProAspMetLeuGlnAsnProGlu-374 |
| SEQ. ID. NO. 23298 | 395-TrpAlaValLeuLysTyrIleLysGluValAspGluIle-407 |
| SEQ. ID. NO. 23299 | 413-ArgIleSerAsnAspLysGluIleAlaLys-422 |

Antigenic Index - Jameson-Wolf

| | |
|---|---|
| SEQ. ID. NO. 23300 | 11-SerLeuProProLysLysAlaIleGlu-19 |
| SEQ. ID. NO. 23301 | 21-LeuGluSerLysLysValThrAlaGluSerTyrArgAsnLeuThr-35 |
| SEQ. ID. NO. 23302 | 55-AsnAspIleLysThrSerMet-61 |
| SEQ. ID. NO. 23303 | 63-GluSerAlaLysSerGlyGlnSerPheAspAspTrpArgLysGlyIle-78 |
| SEQ. ID. NO. 23304 | 82-LeuSerAsnLysGlyTrpLeuHisProAsnGlyHisAsnGlyLysAspIleIleAspProAlaThrGlyGluValPheGlySerProArgArgLeuGluThrIleTyrArgThrAsnMet-121 |
| SEQ. ID. NO. 23305 | 126-AsnAlaGlyGlnTyrGlnGlyGly-132 |
| SEQ. ID. NO. 23306 | 135-AlaAsnIleAspAlaArgProTyrTrp-143 |
| SEQ. ID. NO. 23307 | 147-AlaValGlyAspSerArgThrArgProAlaHisSerAla-159 |
| SEQ. ID. NO. 23308 | 165-TyrArgTyrAspAspProPheTrp-172 |
| SEQ. ID. NO. 23309 | 177-ProProAsnGlyTyrAsnCysArgCysSer-186 |
| SEQ. ID. NO. 23310 | 190-LeuSerGluArgAspValGluArgGlnGlyArgIleValGlyGlnSerThrSerAspAsnLeuValGlu-212 |

TABLE 1-continued

| | |
|---|---|
| SEQ. ID. NO. 23311 | 215-LysIleTyrAsnLysLysGlyAspThr-223 |
| SEQ. ID. NO. 23312 | 229-TyrLysAlaProAspGlySerLeuTyrThrThrAspArgGlyPheAspTyrAsnAlaGlyArgMetAsnTyrArgProAspLeuAspLysTyrAsp ArgAlaLeu-263 |
| SEQ. ID. NO. 23313 | 268-AlaLysAlaGluMetGlyGlyAlaAspPheLysThrSerPheLysGlnLeuGluLysGluPheTyrGluValLysGlnArgLeuAspIleAspGly LysProAspLysGluGlnLysIleLysIleArgAsnAlaLeu-313 |
| SEQ. ID. NO. 23314 | 324-LeuSerLysGluThrGlnGlu-330 |
| SEQ. ID. NO. 23315 | 342-SerAspAspThrLeuValLysGlnValAspSerArgGluGlyGlnAsnPheAspAspSerTyrTyr-363 |
| SEQ. ID. NO. 23316 | 370-LeuGlnAsnProGluHisValIleArgAspAsnArgGlu-382 |
| SEQ. ID. NO. 23317 | 387-AlaArgTyrLysGlySer-392 |
| SEQ. ID. NO. 23318 | 400-TyrIleLysGluValAspGlu-406 |
| SEQ. ID. NO. 23319 | 411-SerTyrArgIleSerAsnAspLysGluIleAla-421 |
| SEQ. ID. NO. 23320 | 424-MetAlaLysLysLysValLeuLys-431 |
| Hydrophilic Regions - Hopp-Woods | |
| SEQ. ID. NO. 23321 | 13-ProProLysLysAlaIleGlu-19 |
| SEQ. ID. NO. 23322 | 21-LeuGluSerLysLysValThrAlaGluSerTyrArg-32 |
| SEQ. ID. NO. 23323 | 55-AsnAspIleLysThrSerMet-61 |
| SEQ. ID. NO. 23324 | 63-GluSerAlaLysSerGlyGlnSerPheAspAspTrpArgLys-76 |
| SEQ. ID. NO. 23325 | 93-HisAsnGlyLysAspIleIleAsp-100 |
| SEQ. ID. NO. 23326 | 108-GlySerProArgArgLeuGluThr-115 |
| SEQ. ID. NO. 23327 | 147-AlaValGlyAspSerArgThrArgProAla-156 |
| SEQ. ID. NO. 23328 | 190-LeuSerGluArgAspValGlyArgGlnGlyArgIleVal-202 |
| SEQ. ID. NO. 23329 | 205-SerThrSerAspAsnLeuValGlu-212 |
| SEQ. ID. NO. 23330 | 215-LysIleTyrAsnLysLysGlyAspThr-223 |
| SEQ. ID. NO. 23331 | 238-ThrThrAspArgGlyPheAsp-244 |
| SEQ. ID. NO. 23332 | 250-MetAsnTyrArgProAspLeuAspLysTyrAspArgAlaLeu-263 |
| SEQ. ID. NO. 23333 | 268-AlaLysAlaGluMetGlyGlyAlaAspPheLysThrSerPheLysGlnLeuGluLysGluPheTyrGluValLysGlnArgLeuAspIleAspGly LysProAspLysGluGlnLysIleLysIleArgAsnAlaLeu-313 |
| SEQ. ID. NO. 23334 | 324-LeuSerLysGluThrGlnGlu-330 |
| SEQ. ID. NO. 23335 | 344-AspThrLeuValLysGlnValAspSerArgGluGlyGlnAsnPheAsp-359 |
| SEQ. ID. NO. 23336 | 375-HisValIleArgAspAsnArgGlu-382 |
| SEQ. ID. NO. 23337 | 400-TyrIleLysGluValAspGlu-406 |
| SEQ. ID. NO. 23338 | 414-IleSerAsnAspLysGluIleAla-421 |
| SEQ. ID. NO. 23339 | 424-MetAlaLysLysLysValLeuLys-431 |
| a713 | |
| AMPHI Regions - AMPHI | |
| SEQ. ID. NO. 23340 | 18-GluHisArgHisTrpGlu-23 |
| SEQ. ID. NO. 23341 | 115-AspAlaAlaLysLysLeuAlaAlaProTrpProGlnIle-127 |
| SEQ. ID. NO. 23342 | 150-ThrValTrpGlnAlaLeuThrHisIleAlaAsnSerVal-162 |
| SEQ. ID. NO. 23343 | 257-AspAsnLeuAlaAlaLeuGln-263 |
| SEQ. ID. NO. 23344 | 265-GlnAlaLysLysGln-269 |
| Antigenic Index - Jameson-Wolf | |
| SEQ. ID. NO. 23345 | 1-MetGlnAsnAsnSerTyrGly-7 |
| SEQ. ID. NO. 23346 | 13-ArgValGlyGlyLysGluHisArgHisTrpGluArgTyrAspIleAspSerAspPhe-31 |
| SEQ. ID. NO. 23347 | 44-ArgLeuGlyProGluAlaAlaIleProAspLeuSerGlyGluSerCysGluValValIle-63 |
| SEQ. ID. NO. 23348 | 74-GlySerGlnArgHisGlyLysSerLysGlyGlyArgGluLeuSerLeuSerGlyArgAspLeu-94 |
| SEQ. ID. NO. 23349 | 106-LeuAsnValLysGly-110 |
| SEQ. ID. NO. 23350 | 115-AspAlaAlaLysLysLeu-120 |
| SEQ. ID. NO. 23351 | 134-ValGluAsnAsnProAlaLeuAspLysIleAspIleGluProGlyGluThrVal-151 |
| SEQ. ID. NO. 23352 | 167-TrpLeuGluProAspGlyThrLeu-174 |
| SEQ. ID. NO. 23353 | 192-SerArgThrAspSerArgArgAsnIleGluArgMetAspIleGluTrpAspThrAspAsnArgPheSerGlu-215 |
| SEQ. ID. NO. 23354 | 222-SerHisGlyArgSerGlyAspSerAlaLysHisAspLeu-234 |
| SEQ. ID. NO. 23355 | 236-TrpValTyrLysAspProThrMetThrLeuHisArgProLysThrValVal-252 |
| SEQ. ID. NO. 23356 | 254-SerAspAlaAspAsn-258 |
| SEQ. ID. NO. 23357 | 263-GlnLysGlnAlaLysLysGlnLeuAla-271 |
| SEQ. ID. NO. 23358 | 284-ValGlyGlyHisLysThrArgAspGly-292 |
| SEQ. ID. NO. 23359 | 302-HisValIleAspAspGluHisGlyIle-310 |
| SEQ. ID. NO. 23360 | 321-PheMetLeuSerArgMetAspGlyThrGlnThrGluLeuArgLeuLysGluAspGlyIleTrpThrProAspAlaTyrProLysLysAlaGlu AlaAlaArgLysArgLysGlyLysArgLysGlyValSerHisLysGlyLysLysGlyGlyLysLysGlnAlaGlu-376 |
| Hydrophilic Regions - Hopp-Woods | |
| SEQ. ID. NO. 23361 | 14-ValGlyGlyLysGluHisArgHisTrpGluArgTyrAspIleAspSer-29 |
| SEQ. ID. NO. 23362 | 54-LeuSerGlyGluSerCysGluValValIle-63 |
| SEQ. ID. NO. 23363 | 76-GlnArgHisGlyLysSerLysGlyGlyArgGluLeuSerLeuSerGlyArgAspLeu-94 |
| SEQ. ID. NO. 23364 | 115-AspAlaAlaLysLysLeu-120 |
| SEQ. ID. NO. 23365 | 138-ProAlaLeuAspLysIleAspIleGluProGlyGlu-149 |
| SEQ. ID. NO. 23366 | 168-LeuGluProAspGly-172 |
| SEQ. ID. NO. 23367 | 193-ArgThrAspSerArgArgAsnIleGluArgMetAspIleGluTrpAspThrAspAsnArgPheSer-214 |
| SEQ. ID. NO. 23368 | 222-SerHisGlyArgSerGlyAspSerAlaLysHisAspLeu-234 |
| SEQ. ID. NO. 23369 | 246-HisArgProLysThr-250 |
| SEQ. ID. NO. 23370 | 254-SerAspAlaAspAsn-258 |
| SEQ. ID. NO. 23371 | 263-GlnLysGlnAlaLysLysGlnLeuAla-271 |
| SEQ. ID. NO. 23372 | 286-GlyHisLysThrArgAsp-291 |
| SEQ. ID. NO. 23373 | 302-HisValIleAspAspGluHisGlyIle-310 |
| SEQ. ID. NO. 23374 | 325-ArgMetAspGlyThrGlnThrGluLeuArgLeuLysGluAspGlyIleTrp-341 |
| SEQ. ID. NO. 23375 | 345-AlaTyrProLysLysAlaGluAlaAlaArgLysArgLysGlyLysArgLysGlyValSerHisLysGlyLysLysGlyGlyLysLysGlnAlaGlu-376 |
| a714 | |
| AMPHI Regions - AMPHI | |
| SEQ. ID. NO. 23376 | 6-IleLeuArgGlyLeuLeuPro-12 |
| SEQ. ID. NO. 23377 | 34-LeuAspAlaValAlaGluSerAlaGlnSerValAlaAspAlaValAspProSer-51 |
| SEQ. ID. NO. 23378 | 55-GlnMetLeuAlaAspTrpGluArgValLeuGlyLeu-66 |
| SEQ. ID. NO. 23379 | 79-AlaValMetAlaLysLeuAsnGluThrGly-88 |

TABLE 1-continued

| SEQ. ID. NO. 23380 | 98-LeuAlaGluAlaAla-102 |
| SEQ. ID. NO. 23381 | 110-GluProGlnProPhe-114 |
| SEQ. ID. NO. 23382 | 116-AlaGlyValAsnArgAlaGlyAspArgLeu-125 |
| SEQ. ID. NO. 23383 | 155-AlaGlyAspArgLeuThrAspTyrSerAspAlaValIleGluSerLeuPheAsnArgLeuLys-175 |

Antigenic Index - Jameson-Wolf

| SEQ. ID. NO. 23384 | 15-SerTyrAlaArgAsnAlaProArgValArgAlaGlnAlaGluIleAspGlyAlaAla-33 |
| SEQ. ID. NO. 23385 | 36-AlaValAlaGluSerAlaGlnSerVal-44 |
| SEQ. ID. NO. 23386 | 46-AspAlaValAspProSerSerAlaGly-54 |
| SEQ. ID. NO. 23387 | 64-LeuGlyLeuAspGlyThrGlyLysAsnArgGlnArgArgVal-77 |
| SEQ. ID. NO. 23388 | 83-LysLeuAsnGluThrGlyGlyLeu-90 |
| SEQ. ID. NO. 23389 | 107-GlnIleAspGluProGlnProPheArgAlaGlyValAsnArgAlaGlyAspArgLeuAlaPro-127 |
| SEQ. ID. NO. 23390 | 138-ValArgGlyGlyAsnAsnArgIleThrArgPheArgAlaGlyIle-152 |
| SEQ. ID. NO. 23391 | 154-AlaAlaGlyAspArgLeuThrAspTyrSerAspAlaValIle-167 |
| SEQ. ID. NO. 23392 | 170-LeuPheAsnArgLeuLysPro-176 |

Hydrophilic Regions - Hopp-Woods

| SEQ. ID. NO. 23393 | 18-ArgAsnAlaProArgValArgAlaGlnAlaGluIleAspGlyAlaAla-33 |
| SEQ. ID. NO. 23394 | 36-AlaValAlaGluSerAlaGlnSerVal-44 |
| SEQ. ID. NO. 23395 | 46-AspAlaValAspProSerSer-52 |
| SEQ. ID. NO. 23396 | 68-GlyThrGlyLysAsnArgGlnArgArgVal-77 |
| SEQ. ID. NO. 23397 | 107-GlnIleAspGluProGlnProPhe-114 |
| SEQ. ID. NO. 23398 | 117-GlyValAsnArgAlaGlyAspArgLeuAlaPro-127 |
| SEQ. ID. NO. 23399 | 139-ArgGlyGlyAsnAsnArgIleThrArgPheArgAla-150 |
| SEQ. ID. NO. 23400 | 154-AlaAlaGlyAspArgLeuThrAspTyrSerAspAlaValIle-167 |
| SEQ. ID. NO. 23401 | 170-LeuPheAsnArgLeuLysPro-176 | a715
AMPHI Regions - AMPHI

| SEQ. ID. NO. 23402 | 15-GlnIleGluArgLeuGlyAsnGlyIle-23 |
| SEQ. ID. NO. 23403 | 31-ArgArgLeuSerGluThrMetHis-38 |
| SEQ. ID. NO. 23404 | 64-LeuSerAspSerGlyArgLeuLysAspSerPheSer-75 |
| SEQ. ID. NO. 23405 | 94-IleHisAsnPheGlyGly-99 |

Antigenic Index - Jameson-Wolf

| SEQ. ID. NO. 23406 | 15-GlnIleGluArgLeuGlyAsnGlyIleGluAsnArgTyrLeuLeu-29 |
| SEQ. ID. NO. 23407 | 47-TyrAlaGlyArgProLysTrpLeuGlyLeuLysTyrArgAspGlyLysProLeuSerAspSerGlyArgLeuLysAspSerPheSerThrLeuSerAspAsnAspThrAla-83 |
| SEQ. ID. NO. 23408 | 98-GlyGlyMetAlaGlyArgAsnArgLysValArgIleProGlnArgGluPhe-114 |
| SEQ. ID. NO. 23409 | 118-ThrAspAspAspLysGlnAlaLeuMetAspAspValGlnAsp-131 |

Hydrophilic Regions - Hopp-Woods

| SEQ. ID. NO. 23410 | 15-GlnIleGluArgLeuGlyAsn-21 |
| SEQ. ID. NO. 23411 | 57-LysTyrArgAspGlyLysProLeuSerAspSerGlyArgLeuLysAspSerPhe-74 |
| SEQ. ID. NO. 23412 | 78-SerAspAsnAspThr-82 |
| SEQ. ID. NO. 23413 | 101-AlaGlyArgAsnArgLysValArgIleProGlnArgGlu-113 |
| SEQ. ID. NO. 23414 | 118-ThrAspAspAspLysGlnAlaLeuMetAspAspValGlnAsp-131 | a716
AMPHI Regions - AMPHI

| SEQ. ID. NO. 23415 | 33-GlyValHisLysSerAlaHisGly-40 |
| SEQ. ID. NO. 23416 | 71-AlaThrValLysLysThrHisLysHisThrLysAla-82 |

Antigenic Index - Jameson-Wolf

| SEQ. ID. NO. 23417 | 1-MetAsnLysAsnIle-5 |
| SEQ. ID. NO. 23418 | 23-AlaAlaAsnLysProAlaSerAsnAlaThrGlyValHisLysSerAlaHisGlySerCysGlyAlaSerLysSerAlaGluGlySerCysGlyAlaAlaGlySerLysAlaGlyGluGlyLysCysGlyGluGlyLysCysGlyAlaThrValLysLysThrHisLysHisThrLysAlaSerLysAlaLysAlaLysSerAlaGluGlyLysCysGlyGluGlyLysCysGlySerLys-102 |

Hydrophilic Regions - Hopp-Woods

| SEQ. ID. NO. 23419 | 23-AlaAlaAsnLysProAlaSer-29 |
| SEQ. ID. NO. 23420 | 33-GlyValHisLysSerAlaHis-39 |
| SEQ. ID. NO. 23421 | 43-GlyAlaSerLysSerAlaGluGlySerCys-52 |
| SEQ. ID. NO. 23422 | 55-AlaGlySerLysAlaGlyGluGlyLysCysGlyGluGlyLysCys-69 |
| SEQ. ID. NO. 23423 | 71-AlaThrValLysLysThrHisLysHisThrLysAlaSerLysAlaLysAlaLysSerAlaGluGlyLysCysGlyGluGlyLysCysGlySerLys-102 | a717
AMPHI Regions - AMPHI

| SEQ. ID. NO. 23424 | 175-AlaValTyrAlaLeuAlaAsn-181 |
| SEQ. ID. NO. 23425 | 209-LeuHisArgGlyLeu-213 |
| SEQ. ID. NO. 23426 | 223-SerIleAlaTyrTrp-227 |
| SEQ. ID. NO. 23427 | 241-AlaGlyLeuGluGlnLeuGly-247 |
| SEQ. ID. NO. 23428 | 263-GlnSerIlePheSerThrValTrpThrProTyrIlePheArgAlaIleGluAla-280 |
| SEQ. ID. NO. 23429 | 305-ThrGlyIlePheSerProLeuAlaSer-313 |
| SEQ. ID. NO. 23430 | 347-LeuAsnValValArgLysThr-353 |
| SEQ. ID. NO. 23431 | 358-LeuAlaThrLeuGlyAlaLeuAla-365 |
| SEQ. ID. NO. 23432 | 401-SerSerCysArgLeuTrpGlnProLeuLysArgLeu-412 |
| SEQ. ID. NO. 23433 | 430-CysPheGlyThrPro-434 |
| SEQ. ID. NO. 23434 | 442-GlyValTrpAlaValTyrLeuAla-449 |
| SEQ. ID. NO. 23435 | 457-LysAspLeuHisLysLeuPheHisTyr-465 |

Antigenic Index - Jameson-Wolf

| SEQ. ID. NO. 23436 | 1-MetAspThrLysGlu-5 |
| SEQ. ID. NO. 23437 | 32-ProAlaAspAspIleGlyArg-38 |
| SEQ. ID. NO. 23438 | 69-AlaAspLysAspThrLeu-74 |
| SEQ. ID. NO. 23439 | 95-SerArgProSerLeuProSerGluIle-103 |
| SEQ. ID. NO. 23440 | 135-MetGluGlyArgAla-139 |
| SEQ. ID. NO. 23441 | 192-AsnArgCysArgLeuLysAlaValArgArgAlaProPheSerSer-206 |
| SEQ. ID. NO. 23442 | 231-SerAlaAspArgLeuPheLeu-237 |
| SEQ. ID. NO. 23443 | 278-IleGluAlaAsnAlaProProAlaArgLeu-287 |

TABLE 1-continued

| | |
|---|---|
| SEQ. ID. NO. 23444 | 289-AlaThrAlaGluSer-293 |
| SEQ. ID. NO. 23445 | 317-ProGluAsnTyrAla-321 |
| SEQ. ID. NO. 23446 | 349-ValValArgLysThrArgProIleAla-357 |
| SEQ. ID. NO. 23447 | 376-ProSerGlyGlyAlaArgGly-382 |
| SEQ. ID. NO. 23448 | 398-LysThrGluSerSerCysArgLeu-405 |
| SEQ. ID. NO. 23449 | 453-LeuArgHisArgLysAspLeuHis-460 |

Hydrophilic Regions - Hopp-Woods

| | |
|---|---|
| SEQ. ID. NO. 23450 | 1-MetAspThrLysGlu-5 |
| SEQ. ID. NO. 23451 | 69-AlaAspLysAspThrLeu-74 |
| SEQ. ID. NO. 23452 | 135-MetGluGlyArgAla-139 |
| SEQ. ID. NO. 23453 | 192-AsnArgCysArgLeuLysAlaValArgArgAlaProPhe-204 |
| SEQ. ID. NO. 23454 | 281-AsnAlaProProAlaArgLeu-287 |
| SEQ. ID. NO. 23455 | 289-AlaThrAlaGluSer-293 |
| SEQ. ID. NO. 23456 | 349-ValValArgLysThrArgPro-355 |
| SEQ. ID. NO. 23457 | 378-GlyGlyAlaArgGly-382 |
| SEQ. ID. NO. 23458 | 399-ThrGluSerSerCys-403 |
| SEQ. ID. NO. 23459 | 453-LeuArgHisArgLysAspLeuHis-460 | a718-1
AMPHI Regions - AMPHI

| | |
|---|---|
| SEQ. ID. NO. 23460 | 28-IleThrAlaThrGlyArgValIleAlaGluHisProSerAsnPheIleThrProGln-46 |
| SEQ. ID. NO. 23461 | 49-ArgAlaLeuPheGlu-53 |
| SEQ. ID. NO. 23462 | 110-AspGlnAlaTyrGluMetMetAspSerLeuProThr-121 |
| SEQ. ID. NO. 23463 | 124-AspLeuIleMetAspLeuMetAspAlaValGlyHisGly-136 |
| SEQ. ID. NO. 23464 | 160-ProGlnSerTrpPheLys-165 |
| SEQ. ID. NO. 23465 | 198-ArgSerValGlnGln-202 |
| SEQ. ID. NO. 23466 | 210-ThrLeuSerTrpLeuTyrMetPhe-217 |
| SEQ. ID. NO. 23467 | 219-HisTyrAlaValHisAspPheAlaGluPheLeuGluLeu-231 |
| SEQ. ID. NO. 23468 | 255-ArgAlaValAlaGluIle-260 |
| SEQ. ID. NO. 23469 | 279-AlaAlaAsnGlyMetThrSer-285 |
| SEQ. ID. NO. 23470 | 320-ThrAsnAlaLeuGlyAsnIleHisAsnGluIleArg-331 |
| SEQ. ID. NO. 23471 | 341-GlnValAlaGlnThrIleThrSerGlnIleIleGlyProPhe-354 |
| SEQ. ID. NO. 23472 | 363-AspProAsnArgVal-367 |
| SEQ. ID. NO. 23473 | 376-GluProLysAspIleAlaValPheAlaAspAlaIleProLysLeuValAsp-392 |
| SEQ. ID. NO. 23474 | 395-ValGlnIleProGlu-399 |
| SEQ. ID. NO. 23475 | 420-ArgGlnValProAspAsnPro-426 |
| SEQ. ID. NO. 23476 | 448-HisGlnGluIleLeuAspGlyAlaLeuAspAsp-458 |
| SEQ. ID. NO. 23477 | 469-LeuAsnProMetValArgGlnAlaValAlaAlaLeuAsnAlaCysAsnSerTyrGlu-487 |

Antigenic Index - Jameson-Wolf

| | |
|---|---|
| SEQ. ID. NO. 23478 | 4-IleMetAlaLysLysAsnAsnLysThrLysIleGlnLysProGluAlaAlaLeu-21 |
| SEQ. ID. NO. 23479 | 30-AlaThrGlyArgValIleAla-36 |
| SEQ. ID. NO. 23480 | 38-HisProSerAsnPhe-42 |
| SEQ. ID. NO. 23481 | 44-ThrProGlnLysMetArgAlaLeuPheGluAspAlaGluSerGlyAspIleArgAlaGlnHis-64 |
| SEQ. ID. NO. 23482 | 68-AlaAspIleGluGluArgAspSerAspIle-77 |
| SEQ. ID. NO. 23483 | 81-MetGlyThrArgLysArgAla-87 |
| SEQ. ID. NO. 23484 | 95-ValAlaProProArgAsnAlaThrProGluGluGluLysLeuSerAspGlnAlaTyrGluMet-115 |
| SEQ. ID. NO. 23485 | 119-LeuProThrLeuGlu-123 |
| SEQ. ID. NO. 23486 | 148-AspGlyLeuTyrLeuProArgAsnPheIleHisArgProGlnSerTrpPheLysTrpAspLysAspAsnGlyLeu-172 |
| SEQ. ID. NO. 23487 | 174-LeuArgThrArgGluAsnProGluGlyGluAla-184 |
| SEQ. ID. NO. 23488 | 193-HisThrGlnLysSerArgSerValGlnGlnAlaArgAsnGlyLeuPhe-208 |
| SEQ. ID. NO. 23489 | 237-ArgIleGlyLysTyrGlyAlaGlyAlaThrLysGluGluLysAsnThrLeu-253 |
| SEQ. ID. NO. 23490 | 268-MetProGluGlyMetGluIleGluLeu-276 |
| SEQ. ID. NO. 23491 | 280-AlaAsnGlyMetThrSerAla-286 |
| SEQ. ID. NO. 23492 | 295-AspTrpCysGluLysSerAlaAla-302 |
| SEQ. ID. NO. 23493 | 310-LeuThrSerGlyAlaAspGlyLysSerSerThrAsnAlaLeuGly-324 |
| SEQ. ID. NO. 23494 | 328-AsnGluIleArgArgAspLeuLeuValSerAspAlaLysGlnVal-342 |
| SEQ. ID. NO. 23495 | 359-TyrProHisAlaAspProAsnArgValProLysPheGluPheAspThrArgGluProLysAspIle-380 |
| SEQ. ID. NO. 23496 | 397-IleProGluSerTrpValArgAspLysLeuVal-407 |
| SEQ. ID. NO. 23497 | 410-AspValGlnGluGlyGluAlaValLeu-418 |
| SEQ. ID. NO. 23498 | 420-ArgGlnValProAspAsnProValAsnArg-429 |
| SEQ. ID. NO. 23499 | 440-ValProSerLysAlaThrGlyArgHisGlnGluIleLeuAspGlyAlaLeuAsp-457 |
| SEQ. ID. NO. 23500 | 459-AlaLeuValGluProAspPheAsnSerGlnLeu-469 |
| SEQ. ID. NO. 23501 | 484-AsnSerTyrGluGluAlaAspAla-491 |
| SEQ. ID. NO. 23502 | 499-AsnLeuAspAsnAlaLysLeuArgThr-507 |
| SEQ. ID. NO. 23503 | 519-LeuGlyGlnAspHisAlaArgAla-526 |

Hydrophilic Regions - Hopp-Woods

| | |
|---|---|
| SEQ. ID. NO. 23504 | 4-IleMetAlaLysLysAsnAsnLysThrLysIleGlnLysProGluAlaAlaLeu-21 |
| SEQ. ID. NO. 23505 | 46-GlnLysMetArgAlaLeuPheGluAspAlaGluSerGlyAspIleArgAlaGlnHis-64 |
| SEQ. ID. NO. 23506 | 68-AlaAspIleGluGluArgAspSerAspIle-77 |
| SEQ. ID. NO. 23507 | 81-MetGlyThrArgLysArgAla-87 |
| SEQ. ID. NO. 23508 | 96-AlaProProArgAsnAlaThrProGluGluGluLysLeuSerAspGlnAlaTyrGluMet-115 |
| SEQ. ID. NO. 23509 | 165-LysTrpAspLysAspAsnGlyLeu-172 |
| SEQ. ID. NO. 23510 | 174-LeuArgThrArgGluAsnProGluGlyGluAla-184 |
| SEQ. ID. NO. 23511 | 195-GlnLysSerArgSerValGlnGlnAlaArg-204 |
| SEQ. ID. NO. 23512 | 245-AlaThrLysGluGluLysAsnThrLeu-253 |
| SEQ. ID. NO. 23513 | 270-GluGlyMetGluIleGluLeu-276 |
| SEQ. ID. NO. 23514 | 295-AspTrpCysGluLysSerAlaAla-302 |
| SEQ. ID. NO. 23515 | 312-SerGlyAlaAspGlyLysSerSerThr-320 |
| SEQ. ID. NO. 23516 | 328-AsnGluIleArgArgAspLeuLeuValSerAspAlaLysGlnVal-342 |
| SEQ. ID. NO. 23517 | 363-AspProAsnArgValProLysPheGluPheAspThrArgGluProLysAsp-379 |
| SEQ. ID. NO. 23518 | 401-TrpValArgAspLysLeuVal-407 |

TABLE 1-continued

| | |
|---|---|
| SEQ. ID. NO. 23519 | 410-AspValGlnGluGlyGluAlaValLeu-418 |
| SEQ. ID. NO. 23520 | 421-GlnValProAspAsnProValAsn-428 |
| SEQ. ID. NO. 23521 | 440-ValProSerLysAlaThrGlyArgHisGlnGluIleLeuAspGlyAlaLeuAsp-457 |
| SEQ. ID. NO. 23522 | 485-SerTyrGluGluAlaAspAla-491 |
| SEQ. ID. NO. 23523 | 501-AspAsnAlaLysLeu-505 |
| SEQ. ID. NO. 23524 | 522-AspHisAlaArgAla-526 | a720
AMPHI Regions - AMPHI

| | |
|---|---|
| SEQ. ID. NO. 23525 | 19-GlnAlaValArgLeuLeuSerThrSer-27 |
| SEQ. ID. NO. 23526 | 46-AlaProAspLeuIleGluValAsn-53 |
| SEQ. ID. NO. 23527 | 66-AlaLeuArgAlaValGlnThrAla-73 |
| SEQ. ID. NO. 23528 | 91-GlnThrAlaGluSerLeu-96 |
| SEQ. ID. NO. 23529 | 102-ArgLeuAsnAlaLeuValAla-108 |
| SEQ. ID. NO. 23530 | 126-GlyThrIleHisGlnIleAlaHisGluPheTyrGlyAspIleAlaArgAlaAlaGluLeuVal-146 |

Antigenic Index - Jameson-Wolf

| | |
|---|---|
| SEQ. ID. NO. 23531 | 1-GlyLeuGlnAsnArgLeuAsnArgLeuThrAlaLysGlnVal-14 |
| SEQ. ID. NO. 23532 | 39-AlaHisGlyGluGluMetThrAla-46 |
| SEQ. ID. NO. 23533 | 48-AspLeuIleGluValAsnArgAlaMetArgArgArgMetGlnAla-62 |
| SEQ. ID. NO. 23534 | 74-AlaAlaGluSerGlyGlyLeuThrAla-82 |
| SEQ. ID. NO. 23535 | 91-GlnThrAlaGluSerLeuArgAlaAlaAla-100 |
| SEQ. ID. NO. 23536 | 112-AsnGlnLysProProLeu-117 |
| SEQ. ID. NO. 23537 | 121-GlnAlaProIleAspGlyThr-127 |
| SEQ. ID. NO. 23538 | 139-IleAlaArgAlaAlaGlu-144 |
| SEQ. ID. NO. 23539 | 157-PheIleLysArgGlyThrLeuValAsnSerTyrAlaLys-169 |

Hydrophilic Regions - Hopp-Woods

| | |
|---|---|
| SEQ. ID. NO. 23540 | 4-AsnArgLeuAsnArgLeuThrAla-11 |
| SEQ. ID. NO. 23541 | 39-AlaHisGlyGluGluMetThrAla-46 |
| SEQ. ID. NO. 23542 | 48-AspLeuIleGluValAsnArgAlaMetArgArgArgMetGlnAla-62 |
| SEQ. ID. NO. 23543 | 74-AlaAlaGluSerGlyGly-79 |
| SEQ. ID. NO. 23544 | 94-GluSerLeuArgAlaAlaAla-100 |
| SEQ. ID. NO. 23545 | 139-IleAlaArgAlaAlaGlu-144 | a721
AMPHI Regions - AMPHI

| | |
|---|---|
| SEQ. ID. NO. 23546 | 86-AlaGlyTrpMetArgTrpLeuGlu-93 |
| SEQ. ID. NO. 23547 | 119-ArgTyrIleSerAlaVal-124 |
| SEQ. ID. NO. 23548 | 134-SerLysIlePheHisAlaAlaLeuThrAsnPheProAlaLeuAspGlyMetAspGluValLeuAla-155 |
| SEQ. ID. NO. 23549 | 169-AsnProMetLysGluLeuLeuGlnGlnLeuPheGlyLeu-181 |
| SEQ. ID. NO. 23550 | 209-AspValPheAlaGln-213 |
| SEQ. ID. NO. 23551 | 235-LysTyrAlaProIleSerValValGlnGluLeuGln-246 |
| SEQ. ID. NO. 23552 | 281-TrpAlaGluGlyValLeuLysGlnProGlyGly-291 |
| SEQ. ID. NO. 23553 | 293-AlaPheLeuThrGlyPheIleGlu-300 |

Antigenic Index - Jameson-Wolf

| | |
|---|---|
| SEQ. ID. NO. 23554 | 1-MetSerLysAsnAlaGln-6 |
| SEQ. ID. NO. 23555 | 16-GluValGlnProLysAspGlyArgIle-24 |
| SEQ. ID. NO. 23556 | 27-LeuProTyrGlyGlu-31 |
| SEQ. ID. NO. 23557 | 33-ArgAlaValAspGlyArgProThrAspValProAla-44 |
| SEQ. ID. NO. 23558 | 48-ThrGluGluAsnGlyHisAsp-54 |
| SEQ. ID. NO. 23559 | 58-LeuAlaAsnSerSerArgAsnGlnLeu-66 |
| SEQ. ID. NO. 23560 | 74-LeuTyrLysGluLysAsnGlyGlnProAlaPro-84 |
| SEQ. ID. NO. 23561 | 93-GluPheThrProLysGlyMetPheAla-101 |
| SEQ. ID. NO. 23562 | 104-GluTrpThrAspLysAlaAla-110 |
| SEQ. ID. NO. 23563 | 114-AlaAlaLysGluTyrArg-119 |
| SEQ. ID. NO. 23564 | 125-PheSerTyrAspThrLysGlyTyrVal-133 |
| SEQ. ID. NO. 23565 | 148-AspGlyMetAspGluValLeu-154 |
| SEQ. ID. NO. 23566 | 160-GlnIleLeuLysProGluThrGluGlnAsnProMetLysGluLeuLeu-175 |
| SEQ. ID. NO. 23567 | 182-ProAspAlaGlyGluGluGluLeuLysAla-191 |
| SEQ. ID. NO. 23568 | 197-ValGluAlaLysProLysAspValAlaLeu-206 |
| SEQ. ID. NO. 23569 | 214-LeuAlaGluLysAspSerArgIle-221 |
| SEQ. ID. NO. 23570 | 227-GlnThrAlaLysProAspLeuThrLysTyrAla-237 |
| SEQ. ID. NO. 23571 | 254-AlaLysGlnGluAlaAspLysGlyAsnGlu-263 |
| SEQ. ID. NO. 23572 | 276-ProAlaGlnLysGluTrpAla-282 |
| SEQ. ID. NO. 23573 | 285-ValLeuLysGlnProGlyGly-291 |
| SEQ. ID. NO. 23574 | 310-GlySerGlnThrGlyGlyLysAlaProGluArgValAla-323 |
| SEQ. ID. NO. 23575 | 326-ThrAlaGluGluAlaAlaAla-332 |
| SEQ. ID. NO. 23576 | 337-GlyMetSerGlyGluGluPheValLysIleLysGluSerGluGlyLys-352 |

Hydrophilic Regions - Hopp-Woods

| | |
|---|---|
| SEQ. ID. NO. 23577 | 1-MetSerLysAsnAlaGln-6 |
| SEQ. ID. NO. 23578 | 17-ValGlnProLysAspGlyArgIle-24 |
| SEQ. ID. NO. 23579 | 33-ArgAlaValAspGlyArgProThrAsp-41 |
| SEQ. ID. NO. 23580 | 49-GluGluAsnGlyHis-53 |
| SEQ. ID. NO. 23581 | 74-LeuTyrLysGluLysAsnGlyGln-81 |
| SEQ. ID. NO. 23582 | 104-GluTrpThrAspLysAlaAla-110 |
| SEQ. ID. NO. 23583 | 114-AlaAlaLysGluTyrArg-119 |
| SEQ. ID. NO. 23584 | 148-AspGlyMetAspGluValLeu-154 |
| SEQ. ID. NO. 23585 | 162-LeuLysProGluThrGluGlnAsnProMetLysGluLeuLeu-175 |
| SEQ. ID. NO. 23586 | 183-AspAlaGlyGluGluGluLeuLysAla-191 |
| SEQ. ID. NO. 23587 | 197-ValGluAlaLysProLysAspValAlaLeu-206 |
| SEQ. ID. NO. 23588 | 214-LeuAlaGluLysAspSerArgIle-221 |
| SEQ. ID. NO. 23589 | 228-ThrAlaLysProAspLeuThrLys-235 |
| SEQ. ID. NO. 23590 | 254-AlaLysGlnGluAlaAspLysGlyAsnGlu-263 |

TABLE 1-continued

| | |
|---|---|
| SEQ. ID. NO. 23591 | 276-ProAlaGlnLysGluTrpAla-282 |
| SEQ. ID. NO. 23592 | 313-ThrGlyGlyLysAlaProAspGluArgValAla-323 |
| SEQ. ID. NO. 23593 | 326-ThrAlaGluGluAlaAlaAla-332 |
| SEQ. ID. NO. 23594 | 339-SerGlyGluGluPheValLysIleLysGluSerGluGlyLys-352 | a724
AMPHI Regions - AMPHI

| | |
|---|---|
| SEQ. ID. NO. 23595 | 6-LeuAlaLysLysThr-10 |
| SEQ. ID. NO. 23596 | 12-GlnThrAlaLysAsnIleGlyGluThrLeuArg-22 |
| SEQ. ID. NO. 23597 | 40-ArgValGlnLeuSer-44 |
| SEQ. ID. NO. 23598 | 47-AlaAspGluThrLeuGlnAspLeuGluHisLeuGlnGlu-59 |

Antigenic Index - Jameson-Wolf

| | |
|---|---|
| SEQ. ID. NO. 23599 | 5-LysLeuAlaLysLysThrAlaGlnThrAlaLysAsnIleGlyGluThrLeuArgAlaAlaPheArgGlyLysIle-29 |
| SEQ. ID. NO. 23600 | 34-SerSerGluProIleGlnArgValGlnLeuSerGlyLeuAlaAspGluThrLeuGlnAspLeuGluHis-56 |
| SEQ. ID. NO. 23601 | 60-TyrGlyPheAlaSerHisProProAspGlySerGluAla-72 |
| SEQ. ID. NO. 23602 | 77-LeuGlyGlyAsnThrSer-82 |
| SEQ. ID. NO. 23603 | 90-GlnHisGlySerTyrArgIleLysAsnLeuLysProGlyGluThr-104 |
| SEQ. ID. NO. 23604 | 108-AsnHisGluGlyAlaLysIleValIleLysGlnGlyLysIleIleGluAlaAspCysAspVal-128 |
| SEQ. ID. NO. 23605 | 130-ArgValAsnCysLysGlnTyrGlu-137 |
| SEQ. ID. NO. 23606 | 142-ThrAspAlaLysPhe-146 |
| SEQ. ID. NO. 23607 | 162-GlnIleAsnGlyAsnGly-167 |
| SEQ. ID. NO. 23608 | 170-AlaValGluGlyGlyAspGlyAlaThrPheSerGlyAspValAsnGlnThrGlyGlySerPheAsnThrAspGlyAspValValAla-198 |
| SEQ. ID. NO. 23609 | 205-GlnHisProHisThrAspSerIleGlyGlyLysThrLeuProAlaGluProAla-222 |

Hydrophilic Regions - Hopp-Woods

| | |
|---|---|
| SEQ. ID. NO. 23610 | 5-LysLeuAlaLysLysThrAlaGlnThrAlaLysAsnIleGlyGluThrLeuArgAlaAlaPheArgGly-27 |
| SEQ. ID. NO. 23611 | 46-LeuAlaAspGluThrLeuGlnAspLeuGluHis-56 |
| SEQ. ID. NO. 23612 | 66-ProProAspGlySerGlu-71 |
| SEQ. ID. NO. 23613 | 94-TyrArgIleLysAsnLeuLysProGlyGlu-103 |
| SEQ. ID. NO. 23614 | 110-GluGlyAlaLysIleValIleLysGlnGlyLysIleIleGluAlaAspCysAspVal-128 |
| SEQ. ID. NO. 23615 | 132-AsnCysLysGlnTyrGlu-137 |
| SEQ. ID. NO. 23616 | 142-ThrAspAlaLysPhe-146 |
| SEQ. ID. NO. 23617 | 190-PheAsnThrAspGlyAspVal-196 |
| SEQ. ID. NO. 23618 | 207-ProHisThrAspSerIleGly-213 | a726
AMPHI Regions - AMPHI

| | |
|---|---|
| SEQ. ID. NO. 23619 | 12-AspThrLeuGlySerIleProGlu-19 |
| SEQ. ID. NO. 23620 | 55-ProArgProSerGluTyrHisGlu-62 |
| SEQ. ID. NO. 23621 | 74-AlaAlaAlaAlaArg-78 |
| SEQ. ID. NO. 23622 | 110-IleAspSerPheTyrArg-115 |
| SEQ. ID. NO. 23623 | 122-AlaArgGlnAlaAsp-126 |
| SEQ. ID. NO. 23624 | 137-IleAlaAlaAlaArg-141 |
| SEQ. ID. NO. 23625 | 180-IleGluThrAlaProGlyLeuAspAlaLeuGluLysGluIleGlu-194 |

Antigenic Index - Jameson-Wolf

| | |
|---|---|
| SEQ. ID. NO. 23626 | 5-PheLysAsnGlyPheTyrAspAspThrLeuGlySerIleProGluGly-20 |
| SEQ. ID. NO. 23627 | 24-ValArgAlaGluGluTyr-29 |
| SEQ. ID. NO. 23628 | 37-AlaGlnGlyGlyGlnIleAlaAlaAspSerAspGlyArgProValLeuThrProProArgProSerGluTyrHisGluTrpAspGlyLysLysTrpGluIle-70 |
| SEQ. ID. NO. 23629 | 78-ArgPheAlaGluGlnLysThr-84 |
| SEQ. ID. NO. 23630 | 90-LeuAlaAlaLysAlaAspGluLeuLysAsnSer-100 |
| SEQ. ID. NO. 23631 | 106-ProGlnValGlyIleAspSerPheTyrArgGlnGluLysGluAlaLeuAlaArgGlnAlaAspAsnAsnAlaProThr-131 |
| SEQ. ID. NO. 23632 | 151-LysValValGluLysSerAlaArg-158 |
| SEQ. ID. NO. 23633 | 167-IleGlyLysArgGlnGlnLeuGluAspLysLeuAsnThr-179 |
| SEQ. ID. NO. 23634 | 181-GluThrAlaProGlyLeuAspAlaLeuGluLysGluIleGluGlu-195 |

Hydrophilic Regions - Hopp-Woods

| | |
|---|---|
| SEQ. ID. NO. 23635 | 24-ValArgAlaGluGluTyr-29 |
| SEQ. ID. NO. 23636 | 42-IleAlaAlaAspSerAspGlyArgPro-50 |
| SEQ. ID. NO. 23637 | 55-ProArgProSerGluTyrHisGluTrpAspGlyLysLysTrpGluIle-70 |
| SEQ. ID. NO. 23638 | 78-ArgPheAlaGluGlnLysThr-84 |
| SEQ. ID. NO. 23639 | 90-LeuAlaAlaLysAlaAspGluLeuLysAsn-99 |
| SEQ. ID. NO. 23640 | 114-TyrArgGlnGluLysGluAlaLeuAlaArgGlnAlaAspAsnAsnAla-129 |
| SEQ. ID. NO. 23641 | 151-LysValValGluLysSerAlaArg-158 |
| SEQ. ID. NO. 23642 | 167-IleGlyLysArgGlnGlnLeuGluAspLysLeuAsnThr-179 |
| SEQ. ID. NO. 23643 | 187-AspAlaLeuGluLysGluIleGluGlu-195 | a727
AMPHI Regions - AMPHI

| | |
|---|---|
| SEQ. ID. NO. 23644 | 6-LeuLeuAlaAsnAsn-10 |
| SEQ. ID. NO. 23645 | 12-GlnProIleAlaIleIleAla-18 |
| SEQ. ID. NO. 23646 | 61-TyrAlaArgGluLeuGlu-66 |
| SEQ. ID. NO. 23647 | 118-GlyCysIleAspGlyPheGly-124 |

Antigenic Index - Jameson-Wolf

| | |
|---|---|
| SEQ. ID. NO. 23648 | 28-HisHisGlnGlyTyrLysSerAlaPheAlaLysGln-39 |
| SEQ. ID. NO. 23649 | 41-AlaValIleGluLysMetLysArgAspLysAlaGln-52 |
| SEQ. ID. NO. 23650 | 60-AsnTyrAlaArgGluLeuGluGlnAlaArgAlaGluAlaLysLysTyrGluValLysAla-79 |
| SEQ. ID. NO. 23651 | 86-LeuAlaLysLysGlnAlaGluValSerArgLeuLysThrGluAsnLysLysGluIleGluAsn-106 |
| SEQ. ID. NO. 23652 | 108-LeuThrGlnAspArgLysAsnAlaGlyGlyGlyCysIleAspGlyPheGly-124 |
| SEQ. ID. NO. 23653 | 135-LeuGlyTyrGlyAsn-139 |

TABLE 1-continued

Hydrophilic Regions - Hopp-Woods
SEQ. ID. NO. 23654  41-AlaValIleGluLysMetLysArgAspLysAlaGln-52
SEQ. ID. NO. 23655  60-AsnTyrAlaArgGluLeuGluGlnAlaArgAlaGluAlaLysLysTyrGluValLysAla-79
SEQ. ID. NO. 23656  86-LeuAlaLysLysGlnAlaGluValSerArgLeuLysThrGluAsnLysLysGluIleGluAsn-106
SEQ. ID. NO. 23657  108-LeuThrGlnAspArgLysAsnAlaGly-116
a728
AMPHI Regions - AMPHI
SEQ. ID. NO. 23658  11-SerPhePheAlaLeuValPheAla-18
SEQ. ID. NO. 23659  39-AlaThrGluValProLysAsnPro-46
SEQ. ID. NO. 23660  48-AlaPheValAlaLysLeuAlaArgLeuPheArgAsnAla-60
SEQ. ID. NO. 23661  76-AsnLeuAlaGlyThrValAspAsp-83
SEQ. ID. NO. 23662  198-GluAspValTyrGluHisCysLeuGlyCysTyrGlnMet-210
SEQ. ID. NO. 23663  218-TyrArgAspValAlaAsnAspGlu-225
SEQ. ID. NO. 23664  235-SerAsnArgIleAlaSer-240
SEQ. ID. NO. 23665  249-GlnAsnMetArgGluLeuMetProArg-257
SEQ. ID. NO. 23666  355-GluLysGluValArgArgTyrAlaGluAlaAlaAlaArg-367
Antigenic Index - Jameson-Wolf
SEQ. ID. NO. 23667  29-IleAsnProArgTrp-33
SEQ. ID. NO. 23668  35-LeuSerAspThrAlaThrGluValProLysAsnProAsn-47
SEQ. ID. NO. 23669  57-PheArgAsnAlaAspArgAla-63
SEQ. ID. NO. 23670  69-GluSerIleArgThrGluGluAsnLeuAlaGlyThrValAspAspGlyProLeuGlnSerGluLysAspTyr-92
SEQ. ID. NO. 23671  98-ArgLeuSerArgLeuLysGluLysAlaLys-107
SEQ. ID. NO. 23672  112-ThrGluGlnGluHisGlyLys-118
SEQ. ID. NO. 23673  125-HisIleGlyGluGlyGly-130
SEQ. ID. NO. 23674  136-LeuSerGlnArgSerProGluAlaPheVal-145
SEQ. ID. NO. 23675  149-TyrLeuTyrArgAsnAspArgProPheSer-158
SEQ. ID. NO. 23676  166-ValHisGlyGluAsnTyrGluThrThrGlyGluTyrArgVal-179
SEQ. ID. NO. 23677  182-GlnProAspGlySerVal-187
SEQ. ID. NO. 23678  190-AlaAlaGlyArgGlyLysIleGlyGluAspValTyr-201
SEQ. ID. NO. 23679  217-LysTyrArgAspValAlaAsnAspGluGlnLysValTrpAspPheArgLysGluSerAsnArgIleAlaSerAspSerArgAsnSerValPheTyrGln
                    AsnMetArgGluLeuMetProArgGlyMetLysAlaAsnSer-263
SEQ. ID. NO. 23680  267-GlyTyrAspAlaAspGlyLeuProGlnLys-276
SEQ. ID. NO. 23681  280-SerPheAspAsnGlyLysLysArgGlnSerPheGluTyrTyrLeuLysAsnGlyAsn-298
SEQ. ID. NO. 23682  309-LeuLysAlaAspGlyValThr-315
SEQ. ID. NO. 23683  329-LeuAspGlyGlyArgIleValArgGluGluLysGlnGlyAspArgLeuProAspPhe-347
SEQ. ID. NO. 23684  352-GluAsnLeuGluLysGluValArgArgTyrAlaGluAlaAlaAlaArgArgSerGlyGlyArgArgAspLeuSerHis-377
Hydrophilic Regions - Hopp-Woods
SEQ. ID. NO. 23685  38-ThrAlaThrGluValProLysAsnPro-46
SEQ. ID. NO. 23686  57-PheArgAsnAlaAspArgAla-63
SEQ. ID. NO. 23687  69-GluSerIleArgThrGluGluAsnLeu-77
SEQ. ID. NO. 23688  80-ThrValAspAspGlyProLeuGlnSerGluLysAspTyr-92
SEQ. ID. NO. 23689  98-ArgLeuSerArgLeuLysGluLysAlaLys-107
SEQ. ID. NO. 23690  112-ThrGluGlnGluHisGlyLys-118
SEQ. ID. NO. 23691  136-LeuSerGlnArgSerProGlu-142
SEQ. ID. NO. 23692  151-TyrArgAsnAspArgProPhe-157
SEQ. ID. NO. 23693  169-GluAsnTyrGluThrThrGlyGluTyr-177
SEQ. ID. NO. 23694  190-AlaAlaGlyArgGlyLysIleGlyGluAspValTyr-201
SEQ. ID. NO. 23695  217-LysTyrArgAspValAlaAsnAspGluGlnLysValTrpAspPheArgLysGluSerAsnArgIleAlaSerAspSerArgAsn-244
SEQ. ID. NO. 23696  250-AsnMetArgGluLeuMetProArgGlyMetLys-260
SEQ. ID. NO. 23697  268-TyrAspAlaAspGlyLeuPro-274
SEQ. ID. NO. 23698  282-AspAsnGlyLysLysArgGlnSer-289
SEQ. ID. NO. 23699  309-LeuLysAlaAspGlyValThr-315
SEQ. ID. NO. 23700  331-GlyGlyArgIleValArgGluGluLysGlnGlyAspArgLeuPro-345
SEQ. ID. NO. 23701  352-GluAsnLeuGluLysGluValArgArgTyrAlaGluAlaAlaAlaArgArgSerGlyGlyArgArgAspLeuSerHis-377
a729
AMPHI Regions - AMPHI
SEQ. ID. NO. 23702  21-CysThrMetIleProGlnTyr-27
SEQ. ID. NO. 23703  33-GluValAlaGluThrPheLysAsnAspThr-42
SEQ. ID. NO. 23704  55-HisAspTyrPheAla-59
SEQ. ID. NO. 23705  61-ProArgLeuGlnLysLeuIleAspIle-69
SEQ. ID. NO. 23706  149-GlnGlyTyrPheAla-153
SEQ. ID. NO. 23707  164-SerLeuIleAlaThrValAlaLys-171
SEQ. ID. NO. 23708  242-LeuAlaThrLeuIleAsn-247
SEQ. ID. NO. 23709  268-LysLeuProAlaGlyLeu-273
SEQ. ID. NO. 23710  322-LeuGlyGlyLeuPheLysSer-328
SEQ. ID. NO. 23711  371-ValGlnSerAlaPheGlnAspValAlaAsnAla-381
SEQ. ID. NO. 23712  388-LeuAspLysAlaTyrAspAlaLeuSerLysGlnSerArg-400
SEQ. ID. NO. 23713  419-GlyAlaLeuAspLeuLeuAspAla-426
SEQ. ID. NO. 23714  442-LeuThrArgAlaGluAsnLeuAlaAspLeuTyrLysAlaLeuGlyGlyGlyLeuLys-460
Antigenic Index - Jameson-Wolf
SEQ. ID. NO. 23715  25-ProGlnTyrGluGlnProLysValGluVal-34
SEQ. ID. NO. 23716  36-GluThrPheLysAsnAspThrAlaAspSerGlyIleArgAlaValAsp-51
SEQ. ID. NO. 23717  53-GlyTrpHisAspTyrPheAlaAspProArgLeuGlnLys-65
SEQ. ID. NO. 23718  70-AlaLeuGluArgAsnThrSerLeuArgThr-79
SEQ. ID. NO. 23719  85-GluIleTyrArgLysGlnTyrMetIleGluArgAsnAsnLeuLeuPro-100
SEQ. ID. NO. 23720  105-AsnAlaAsnAspSerArgGlnGlySerLeuSerGlyGlyAsnValSerSerSerTyrLysVal-125
SEQ. ID. NO. 23721  138-GlyArgValArgSerSerSerGluAlaAla-147
SEQ. ID. NO. 23722  155-ThrAlaAsnArgAspAlaAla-161
SEQ. ID. NO. 23723  173-TyrPheAsnGluArgTyrAlaGluGluAlaMet-183
SEQ. ID. NO. 23724  188-ArgValLeuLysThrArgGluGluThrTyrLysLeuSerGluLeuArgTyr-204

TABLE 1-continued

| | |
|---|---|
| SEQ. ID. NO. 23725 | 215-ArgGlnGlnGluAlaLeuIleGluSerAlaLysAlaAspTyr-228 |
| SEQ. ID. NO. 23726 | 232-AlaArgSerArgGluGlnAlaArgAsn-240 |
| SEQ. ID. NO. 23727 | 248-GlnProIleProAspAspLeuProAla-256 |
| SEQ. ID. NO. 23728 | 277-ValLeuLeuAspArgProAspIleArgAlaAlaGluHisAlaLeuLysGlnAlaAsnAla-296 |
| SEQ. ID. NO. 23729 | 310-ArgLeuThrGlySerValAspThrHisSerAlaGlu-321 |
| SEQ. ID. NO. 23730 | 325-LeuPheLysSerGlyThr-330 |
| SEQ. ID. NO. 23731 | 347-GlyThrAsnLysAlaAsnLeuAspValAlaLysLeuArgGlnGln-361 |
| SEQ. ID. NO. 23732 | 383-ThrAlaArgGluGlnLeuAspLysAlaTyrAspAlaLeuSerLysGlnSerArgAlaSerLysGluAlaLeuArg-407 |
| SEQ. ID. NO. 23733 | 411-LeuArgTyrLysHisGlyValSer-418 |
| SEQ. ID. NO. 23734 | 424-LeuAspAlaGluArgSerSerTyrSerAla-433 |
| SEQ. ID. NO. 23735 | 442-LeuThrArgAlaGluAsnLeu-448 |
| SEQ. ID. NO. 23736 | 455-LeuGlyGlyGlyLeuLysArgAspThrGlnThrAspLys-467 |
| Hydrophilic Regions - Hopp-Woods | |
| SEQ. ID. NO. 23737 | 28-GluGlnProLysValGluVal-34 |
| SEQ. ID. NO. 23738 | 36-GluThrPheLysAsnAspThrAlaAspSerGlyIleArgAlaVal-50 |
| SEQ. ID. NO. 23739 | 61-ProArgLeuGlnLys-65 |
| SEQ. ID. NO. 23740 | 70-AlaLeuGluArgAsnThrSerLeu-77 |
| SEQ. ID. NO. 23741 | 91-TyrMetIleGluArgAsnAsn-97 |
| SEQ. ID. NO. 23742 | 105-AsnAlaAsnAspSerArgGlnGlySer-113 |
| SEQ. ID. NO. 23743 | 138-GlyArgValArgSerSerSerGluAlaAla-147 |
| SEQ. ID. NO. 23744 | 156-AlaAsnArgAspAlaAla-161 |
| SEQ. ID. NO. 23745 | 177-ArgTyrAlaGluGluAlaMet-183 |
| SEQ. ID. NO. 23746 | 188-ArgValLeuLysThrArgGluGluThrTyrLysLeuSerGluLeuArgTyr-204 |
| SEQ. ID. NO. 23747 | 215-ArgGlnGlnGluAlaLeuIleGluSerAlaLysAlaAspTyr-228 |
| SEQ. ID. NO. 23748 | 232-AlaArgSerArgGluGlnAlaArgAsn-240 |
| SEQ. ID. NO. 23749 | 250-IleProAspAspLeuPro-255 |
| SEQ. ID. NO. 23750 | 277-ValLeuLeuAspArgProAspIleArgAlaAlaGluHisAlaLeuLysGlnAlaAsn-295 |
| SEQ. ID. NO. 23751 | 315-ValAspThrHisSerAlaGlu-321 |
| SEQ. ID. NO. 23752 | 350-LysAlaAsnLeuAspValAlaLysLeuArgGln-360 |
| SEQ. ID. NO. 23753 | 383-ThrAlaArgGluGlnLeuAspLysAlaTyrAspAlaLeuSerLysGlnSerArgAlaSerLysGluAlaLeuArg-407 |
| SEQ. ID. NO. 23754 | 424-LeuAspAlaGluArgSerSerTyrSerAla-433 |
| SEQ. ID. NO. 23755 | 442-LeuThrArgAlaGluAsnLeu-448 |
| SEQ. ID. NO. 23756 | 458-GlyLeuLysArgAspThrGlnThrAspLys-467 |
| a730 | |
| AMPHIRegions - AMPHI | |
| SEQ. ID. NO. 23757 | 6-ArgLeuIleLysLeuLeuAlaAlaCys-14 |
| SEQ. ID. NO. 23758 | 26-LeuAlaAlaAspLeu-30 |
| SEQ. ID. NO. 23759 | 67-GlnIleAsnValIleGlnAspTyrThrHisArg-77 |
| SEQ. ID. NO. 23760 | 111-AsnHisAlaAlaAsp-115 |
| SEQ. ID. NO. 23761 | 141-HisProAlaAspAlaTyrAspGlyProLysGlyGlyAsnTyrProLysProThr-158 |
| SEQ. ID. NO. 23762 | 187-GlnArgIleSerAspAsnTyrSerAsnLeuGlySerAsnPheSerAspArgAlaAspGlu-206 |
| SEQ. ID. NO. 23763 | 214-HisAsnAlaLysLeu-218 |
| SEQ. ID. NO. 23764 | 220-ArgTrpGlyAsnSerMetGluPheIleAsnGlyValAla-232 |
| SEQ. ID. NO. 23765 | 234-GlyAlaLeuAsnProPheIleSer-241 |
| SEQ. ID. NO. 23766 | 262-AlaAlaMetArgAsnIleAla-268 |
| SEQ. ID. NO. 23767 | 277-AlaValIleGlyGlyLeuGlySerValAlaGlyPheGluLysAsnThrArgGluAlaValAspArgTrpIleGlnGlu-302 |
| SEQ. ID. NO. 23768 | 305-AsnAlaAlaGluThrValGluAlaLeuValAsnValLeuProPheAlaLysValLysAsnLeuThrLysAlaAlaLysPro-331 |
| SEQ. ID. NO. 23769 | 347-ArgThrThrArgLysValThr-353 |
| SEQ. ID. NO. 23770 | 355-GluThrGluGlyLeuAsnArgIleArgGln-364 |
| SEQ. ID. NO. 23771 | 384-IleAsnValLeuSerGlyAsnSerIleGlnHis-394 |
| SEQ. ID. NO. 23772 | 426-ThrHisGluIleSerAspIleValThr-434 |
| SEQ. ID. NO. 23773 | 475-GluProAlaThrGlyLysValValThrAlaPheProAsp-487 |
| Antigenic Index - Jameson-Wolf | |
| SEQ. ID. NO. 23774 | 2-LysProLeuArgArgLeuIle-8 |
| SEQ. ID. NO. 23775 | 35-PheIleThrAspAsnAlaGlnArgGlnHisTyrGluProGlyGlyLys-50 |
| SEQ. ID. NO. 23776 | 55-GlyAspProArgGlySerValSerAspArgThrGlyGlnIle-68 |
| SEQ. ID. NO. 23777 | 74-TyrThrHisArgMetGly-79 |
| SEQ. ID. NO. 23778 | 97-ArgPheSerGlyHisGlyTyrGluGluHisAlaProPheAsp-110 |
| SEQ. ID. NO. 23779 | 112-HisAlaAlaAspSerAlaSerGluGluLysGlyAsnValAspGluGlyPhe-128 |
| SEQ. ID. NO. 23780 | 133-LeuAsnTrpGluGlyHisGluHisHisProAlaAspAlaTyrAspGlyProLysGlyGlyAsnTyrProLysProThrGlyAlaArgAspGluTyrThrTyrHisVal-168 |
| SEQ. ID. NO. 23781 | 170-GlyThrAlaArgSerIleLysLeuAsnProThrAspThrArgSerIleArgGlnArgIleSerAspAsnTyrSerAsn-195 |
| SEQ. ID. NO. 23782 | 197-GlySerAsnPheSerAspArgAlaAspGluAlaAsnArgLysMetPheGluHisAsnAlaLysLeuAspArgTrpGlyAsnSer-224 |
| SEQ. ID. NO. 23783 | 257-TyrAlaIleAspLysAlaAlaMet-264 |
| SEQ. ID. NO. 23784 | 271-ProAlaGluGlyLys-275 |
| SEQ. ID. NO. 23785 | 287-GlyPheGluLysAsnThrArgGluAlaValAsp-297 |
| SEQ. ID. NO. 23786 | 299-TrpIleGlnGluAsnProAsnAlaAlaGluThrValGlu-311 |
| SEQ. ID. NO. 23787 | 323-LysAsnLeuThrLysAlaAlaLysProGlyLysAlaAlaValSerGlyAspPhe-340 |
| SEQ. ID. NO. 23788 | 344-TyrAsnThrArgThrThrArgLysValThrThrGluThrGluGlyLeuAsnArgIleArgGlnAsnGlnLysAsnSerAsnIleHisGluLysAsnTyrGlyArgAspAsnProAsnHisIle-384 |
| SEQ. ID. NO. 23789 | 397-TyrGlyAspGluAlaGlyGlyGly-404 |
| SEQ. ID. NO. 23790 | 407-PheProGlyLysProGlyLysThrThrPhePro-417 |
| SEQ. ID. NO. 23791 | 419-HisTrpSerAlaSerLysIleThrHisGluIleSerAsp-431 |
| SEQ. ID. NO. 23792 | 433-ValThrSerProLysThrGln-439 |
| SEQ. ID. NO. 23793 | 450-TyrIleAlaLysGlyArgProAlaArg-458 |
| SEQ. ID. NO. 23794 | 461-SerTyrGluThrArgAspGlyIleArgIle-470 |
| SEQ. ID. NO. 23795 | 472-ThrValTyrGluProAlaThrGlyLys-480 |
| SEQ. ID. NO. 23796 | 485-PheProAspArgThrSerAsnProLysTyrAsnProValLys-498 |

TABLE 1-continued

Hydrophilic Regions - Hopp-Woods
SEQ. ID. NO. 23797   2-LysProLeuArgArgLeuIle-8
SEQ. ID. NO. 23798   39-AsnAlaGlnArgGlnHisTyrGluProGlyGly-49
SEQ. ID. NO. 23799   55-GlyAspProArgGlySerValSerAspArgThrGly-66
SEQ. ID. NO. 23800   102-GlyTyrGluGluHisAlaPro-108
SEQ. ID. NO. 23801   112-HisAlaAlaAspSerAlaSerGluGluLysGlyAsnValAspGluGly-127
SEQ. ID. NO. 23802   135-TrpGluGlyHisGluHisHisPro-142
SEQ. ID. NO. 23803   144-AspAlaTyrAspGlyProLysGlyGlyAsnTyrProLys-156
SEQ. ID. NO. 23804   158-ThrGlyAlaArgAspGluTyr-164
SEQ. ID. NO. 23805   170-GlyThrAlaArgSerIleLys-176
SEQ. ID. NO. 23806   178-AsnProThrAspThrArgSerIleArgGlnArgIleSerAsp-191
SEQ. ID. NO. 23807   200-PheSerAspArgAlaAspGluAlaAsnArgLysMetPheGluHisAsnAlaLysLeuAspArgTrpGlyAsn-223
SEQ. ID. NO. 23808   257-TyrAlaIleAspLysAlaAlaMet-264
SEQ. ID. NO. 23809   271-ProAlaGluGlyLys-275
SEQ. ID. NO. 23810   287-GlyPheGluLysAsnThrArgGluAlaValAsp-297
SEQ. ID. NO. 23811   303-AsnProAsnAlaAlaGluThrValGlu-311
SEQ. ID. NO. 23812   323-LysAsnLeuThrLysAlaAlaLysProGlyLysAlaAlaVal-336
SEQ. ID. NO. 23813   347-ArgThrThrArgLysValThrThrGluThrGluGlyLeuAsnArgIleArgGlnAsnGlnLysAsnSerAsnIleHisGluLysAsnTyrGlyArg
         AspAsnProAsn-382
SEQ. ID. NO. 23814   399-AspGluAlaGlyGly-403
SEQ. ID. NO. 23815   424-LysIleThrHisGluIleSerAsp-431
SEQ. ID. NO. 23816   450-TyrIleAlaLysGlyArgProAlaArg-458
SEQ. ID. NO. 23817   463-GluThrArgAspGlyIleArgIle-470
SEQ. ID. NO. 23818   485-PheProAspArgThrSerAsnProLys-493
a731
AMPHI Regions - AMPHI
SEQ. ID. NO. 23819   17-AlaCysAlaValPro-21
Antigenic Index - Jameson-Wolf
SEQ. ID. NO. 23820   22-GluAlaTyrAspAspGlyGlyArgGlyHis-31
SEQ. ID. NO. 23821   34-ProValGlnAsnGlnAlaGlyThrAlaAsp-43
SEQ. ID. NO. 23822   45-ArgAlaPheSerCysGluAsnGly-52
SEQ. ID. NO. 23823   56-HisValArgArgLeuAspGlyGlyArgIleAlaLeuArgLeuAspGlyArgArgAlaValLeuSerSerAspValAlaAlaSerGlyGluArgTyr
         ThrAla-89
SEQ. ID. NO. 23824   92-GlyLeuPheGlyAsnGlyThrGluTrpHisGlnLysGlyGlyGluAla-107
SEQ. ID. NO. 23825   113-AspAlaTyrGlyAsnSerValGluThrSerCysArgAlaArg-126
Hydrophilic Regions - Hopp-Woods
SEQ. ID. NO. 23826   22-GluAlaTyrAspAspGlyGlyArgGlyHis-31
SEQ. ID. NO. 23827   56-HisValArgArgLeuAspGlyGlyArgIleAlaLeuArgLeuAspGlyArgArgAlaValLeu-76
SEQ. ID. NO. 23828   80-ValAlaAlaSerGlyGluArgTyrThrAla-89
SEQ. ID. NO. 23829   100-TrpHisGlnLysGlyGlyGlu-106
SEQ. ID. NO. 23830   119-ValGluThrSerCysArgAlaArg-126
a732
AMPHI Regions - AMPHI
SEQ. ID. NO. 23831   14-LeuGlyAlaIleSer-18
SEQ. ID. NO. 23832   43-ValGlnSerIleArgThrMetAlaGluValTyrGly-54
SEQ. ID. NO. 23833   66-AspAlaAspLeuPheGluGlyAlaMetLysGlyMetVal-78
SEQ. ID. NO. 23834   95-GluIleLysGluSerThrSerGly-102
SEQ. ID. NO. 23835   115-AspGlyPheValLysValValValSerProIleGluAsp-126
SEQ. ID. NO. 23836   155-GluAlaValLysLysMet-160
SEQ. ID. NO. 23837   183-ValAsnLeuThrArg-187
SEQ. ID. NO. 23838   214-GluArgThrValGluSerValAsnThrAlaAlaLys-225
SEQ. ID. NO. 23839   283-LysAlaValProGluAspTyrValTyr-291
SEQ. ID. NO. 23840   297-SerLeuAlaGlyIleProAlaGluLeu-305
SEQ. ID. NO. 23841   322-SerGluIleValAlaGly-327
SEQ. ID. NO. 23842   400-LeuValGlyHisIleGlyAsn-406
SEQ. ID. NO. 23843   446-ArgArgIleProAsnProAlaLysAsp-454
SEQ. ID. NO. 23844   459-LysAlaLeuAspLeuValLysSerProGluGlnTrpGlnLysSerLeu-474
Antigenic Index - Jameson-Wolf
SEQ. ID. NO. 23845   30-AlaAlaGluLysAspArgArgAspAsnGluVal-40
SEQ. ID. NO. 23846   59-AsnTyrTyrGlnAspLysProAspAlaAspLeuPhe-70
SEQ. ID. NO. 23847   82-AspProHisSerGluTyrMetAspLysLysGlyTyrAlaGluIleLysGluSerThrSerGlyGluPheGlyGly-106
SEQ. ID. NO. 23848   111-IleGlyGlnGluAspGlyPhe-117
SEQ. ID. NO. 23849   122-SerProIleGluAspThrProAlaGluArgAlaGlyValLysSerGlyAspPhe-139
SEQ. ID. NO. 23850   144-AspAsnValSerThrArgGlyMetThr-152
SEQ. ID. NO. 23851   155-GluAlaValLysLysMetArgGlyLysProGlyThrLysIle-168
SEQ. ID. NO. 23852   172-LeuSerArgLysAsnAlaAspLysProIle-181
SEQ. ID. NO. 23853   199-LeuIleGluProAspTyrGlyTyr-206
SEQ. ID. NO. 23854   211-GlnPheGlnGluArgThrValGlu-218
SEQ. ID. NO. 23855   221-AsnThrAlaAlaLysGluLeuValLysGluAsnLysGlyLysProLeuLys-237
SEQ. ID. NO. 23856   242-AspLeuArgAspAspProGlyGlyLeu-250
SEQ. ID. NO. 23857   269-ValSerThrLysGlyArgAspGlyLysAspArgMetVal-281
SEQ. ID. NO. 23858   284-AlaValProGluAspTyrVal-290
SEQ. ID. NO. 23859   293-MetGlyGlyAspSerLeuAla-299
SEQ. ID. NO. 23860   303-AlaGluLeuLysThr-307
SEQ. ID. NO. 23861   316-SerGlySerAlaSerAla-321
SEQ. ID. NO. 23862   330-GlnAspHisLysArgAlaVal-336
SEQ. ID. NO. 23863   340-ThrGlnSerPheGlyLysGlySerVal-348
SEQ. ID. NO. 23864   354-LeuSerAsnGlySer-358
SEQ. ID. NO. 23865   368-TyrThrProAsnAspArgSerIleGln-376
SEQ. ID. NO. 23866   384-ValGluValLysAspLysGluArgIlePheGluSerArgGluAlaAspLeu-400

TABLE 1-continued

| | |
|---|---|
| SEQ. ID. NO. 23867 | 405-GlyAsnProLeuGlyGlyGluAspValAsnSerGlu-416 |
| SEQ. ID. NO. 23868 | 421-ProLeuGluLysAspAlaAspLysProAlaValLysGluLysGlyLysLysLysLysAspGluAspLeuSerSerArgArgIleProAsnProAla LysAspAspGlnLeuArgLysAlaLeuAspLeuValLysSerProGluGlnTrpGlnLys-472 |
| SEQ. ID. NO. 23869 | 477-AlaAlaLysLysProValSerAsnLysAspLysLysAspLysLysAspLysLys-494 |

Hydrophilic Regions - Hopp-Woods

| | |
|---|---|
| SEQ. ID. NO. 23870 | 30-AlaAlaGluLysAspArgArgAspAsnGluVal-40 |
| SEQ. ID. NO. 23871 | 60-TyrTyrGlnAspLysProAspAlaAspLeuPhe-70 |
| SEQ. ID. NO. 23872 | 82-AspProHisSerGluTyrMetAspLysLysGlyTyrAlaGluIleLysGluSerThrSerGlyGlu-103 |
| SEQ. ID. NO. 23873 | 111-IleGlyGlnGluAspGlyPhe-117 |
| SEQ. ID. NO. 23874 | 122-SerProIleGluAspThrProAlaGluArgAlaGlyValLysSerGlyAspPhe-139 |
| SEQ. ID. NO. 23875 | 144-AspAsnValSerThr-148 |
| SEQ. ID. NO. 23876 | 155-GluAlaValLysLysMetArgGlyLysProGlyThr-166 |
| SEQ. ID. NO. 23877 | 172-LeuSerArgLysAsnAlaAspLysProIle-181 |
| SEQ. ID. NO. 23878 | 211-GlnPheGlnGluArgThrValGlu-218 |
| SEQ. ID. NO. 23879 | 221-AsnThrAlaAlaLysGluLeuValLysGluAsnLysGlyLysProLeuLys-237 |
| SEQ. ID. NO. 23880 | 242-AspLeuArgAspAspProGly-248 |
| SEQ. ID. NO. 23881 | 271-ThrLysGlyArgAspGlyLysAspArgMetVal-281 |
| SEQ. ID. NO. 23882 | 303-AlaGluLeuLysThr-307 |
| SEQ. ID. NO. 23883 | 330-GlnAspHisLysArgAlaVal-336 |
| SEQ. ID. NO. 23884 | 370-ProAsnAspArgSerIleGln-376 |
| SEQ. ID. NO. 23885 | 384-ValGluValLysAspLysGluArgIlePheGluSerArgGluAlaAspLeu-400 |
| SEQ. ID. NO. 23886 | 408-LeuGlyGlyGluAspValAsnSer-415 |
| SEQ. ID. NO. 23887 | 421-ProLeuGluLysAspAlaAspLysProAlaValLysGluLysGlyLysLysLysLysAspGluAspLeuSerSerArgArgIleProAsnProAla LysAspAspGlnLeuArgLysAlaLeuAspLeuValLysSerProGluGlnTrpGln-471 |
| SEQ. ID. NO. 23888 | 477-AlaAlaLysLysProValSerAsnLysAspLysLysAspLysLysAspLysLys-494 | a733
AMPHI Regions - AMPHI

| | |
|---|---|
| SEQ. ID. NO. 23889 | 6-ThrLeuSerArgLeuSer-11 |
| SEQ. ID. NO. 23890 | 33-TyrGlyGlyTyrProAspThrValTyrGluGly-43 |
| SEQ. ID. NO. 23891 | 53-LysGlnThrGluLysMetGluLysTyrPheVal-63 |
| SEQ. ID. NO. 23892 | 92-GlyAlaPheArgGlnPheGluGlu-99 |

Antigenic Index - Jameson-Wolf

| | |
|---|---|
| SEQ. ID. NO. 23893 | 2-MetAsnProLysThrLeuSer-8 |
| SEQ. ID. NO. 23894 | 22-CysGlyGlyAsnGlyGlnLysSer-29 |
| SEQ. ID. NO. 23895 | 33-TyrGlyGlyTyrProAspThrValTyrGluGlyLeuLysAsnAspAspThrSerLeuGlyLysGlnThrGluLysMetGluLysTyrPhe-62 |
| SEQ. ID. NO. 23896 | 65-AlaGlyAsnLysLysMetAsnAlaAlaProGlyAla-76 |
| SEQ. ID. NO. 23897 | 84-LeuSerArgSerGlyAspLysGluGlyAlaPheArgGlnPheGluGluGluLysArgLeuPheProGlu-106 |
| SEQ. ID. NO. 23898 | 115-MetLysThrGlyLysGlyGlyLysArg-123 |

Hydrophilic Regions - Hopp-Woods

| | |
|---|---|
| SEQ. ID. NO. 23899 | 40-ValTyrGluGlyLeuLysAsnAspAspThrSerLeuGlyLysGlnThrGluLysMetGluLysTyrPhe-62 |
| SEQ. ID. NO. 23900 | 65-AlaGlyAsnLysLysMetAsnAla-72 |
| SEQ. ID. NO. 23901 | 86-ArgSerGlyAspLysGluGlyAlaPheArgGlnPheGluGluGluLysArgLeuPhePro-105 |
| SEQ. ID. NO. 23902 | 115-MetLysThrGlyLysGlyGlyLysArg-123 | a734
AMPHI Regions - AMPHI

| | |
|---|---|
| SEQ. ID. NO. 23903 | 19-ArgAlaAlaAspThrTyr-24 |
| SEQ. ID. NO. 23904 | 26-TyrLeuAlaValTrpGlnAsnProGlnAsnAlaAsnAspValLeuGlnVal-42 |
| SEQ. ID. NO. 23905 | 53-GluAlaPheAlaGluLeuGluAlaPheCysLys-63 |
| SEQ. ID. NO. 23906 | 77-ThrGlyCysArgSerValValSer-84 |
| SEQ. ID. NO. 23907 | 92-LeuAlaTyrProLysAlaLeuGlyAlaMetArg-102 |
| SEQ. ID. NO. 23908 | 113-ArgPheThrSerVal-117 |
| SEQ. ID. NO. 23909 | 119-GlnValAlaLeuAsnGlnCysIleLysLys-128 |

Antigenic Index - Jameson-Wolf

| | |
|---|---|
| SEQ. ID. NO. 23910 | 18-AlaArgAlaAlaAsp-22 |
| SEQ. ID. NO. 23911 | 31-GlnAsnProGlnAsnAlaAsnAsp-38 |
| SEQ. ID. NO. 23912 | 43-LysThrThrLysGluAspSerThrLysSerGluAlaPheAlaGlu-57 |
| SEQ. ID. NO. 23913 | 60-AlaPheCysLysGlyGlnAspThr-67 |
| SEQ. ID. NO. 23914 | 71-IleAlaGluAspGluProThrGlyCysArgSer-81 |
| SEQ. ID. NO. 23915 | 101-MetArgValGluAsn-105 |
| SEQ. ID. NO. 23916 | 125-CysIleLysLysTyrGlyAlaGlnGly-133 |
| SEQ. ID. NO. 23917 | 145-SerSerTyrTyrGly-149 |

Hydrophilic Regions - Hopp-Woods

| | |
|---|---|
| SEQ. ID. NO. 23918 | 18-AlaArgAlaAlaAsp-22 |
| SEQ. ID. NO. 23919 | 43-LysThrThrLysGluAspSerThrLysSerGluAlaPheAlaGlu-57 |
| SEQ. ID. NO. 23920 | 60-AlaPheCysLysGlyGlnAspThr-67 |
| SEQ. ID. NO. 23921 | 71-IleAlaGluAspGluProThrGlyCys-79 |
| SEQ. ID. NO. 23922 | 101-MetArgValGluAsn-105 |
| SEQ. ID. NO. 23923 | 125-CysIleLysLysTyrGlyAla-131 | a735
AMPHI Regions - AMPHI

| | |
|---|---|
| SEQ. ID. NO. 23924 | 6-LeuLeuAlaAsnAsn-10 |
| SEQ. ID. NO. 23925 | 12-GlnProIleAlaIleIleAla-18 |
| SEQ. ID. NO. 23926 | 61-TyrAlaArgGluLeuGlu-66 |
| SEQ. ID. NO. 23927 | 118-GlyCysIleAspGlyPheGly-124 |

Antigenic Index - Jameson-Wolf

| | |
|---|---|
| SEQ. ID. NO. 23928 | 28-HisHisGlnGlyTyrLysSerAlaPheAlaLysGln-39 |
| SEQ. ID. NO. 23929 | 41-AlaValIleGluLysMetLysArgAspLysAlaGln-52 |
| SEQ. ID. NO. 23930 | 60-AsnTyrAlaArgGluLeuGluGlnAlaArgAlaGluAlaLysTyrGluValLysAla-79 |
| SEQ. ID. NO. 23931 | 86-LeuAlaLysLysGlnAlaGluValSerArgLeuLysThrGluAsnLysLysGluIleGluAsn-106 |

TABLE 1-continued

| | |
|---|---|
| SEQ. ID. NO. 23932 | 108-LeuThrGlnAspArgLysAsnAlaGlyGlyGlyCysIleAspGlyPheGly-124 |
| SEQ. ID. NO. 23933 | 135-LeuGlyTyrGlyAsn-139 |

Hydrophilic Regions - Hopp-Woods

| | |
|---|---|
| SEQ. ID. NO. 23934 | 41-AlaValIleGluLysMetLysArgAspLysAlaGln-52 |
| SEQ. ID. NO. 23935 | 60-AsnTyrAlaArgGluLeuGluGlnAlaArgAlaGluAlaLysLysTyrGluValLysAla-79 |
| SEQ. ID. NO. 23936 | 86-LeuAlaLysLysGlnAlaGluValSerArgLeuLysThrGluAsnLysLysGluIleGluAsn-106 |
| SEQ. ID. NO. 23937 | 108-LeuThrGlnAspArgLysAsnAlaGly-116 | a736
AMPHI Regions - AMPHI

| | |
|---|---|
| SEQ. ID. NO. 23938 | 13-GlyLeuIleGlnSerLeuGlySer-20 |
| SEQ. ID. NO. 23939 | 50-GlyValLeuSerVal-54 |
| SEQ. ID. NO. 23940 | 61-GlyLeuPheValGly-65 |
| SEQ. ID. NO. 23941 | 70-LeuGlnGlyTyrThrGlnLeuSerLysPheLysSerAlaAspIle-84 |
| SEQ. ID. NO. 23942 | 93-LeuLeuArgGluLeuGlyProVal-100 |
| SEQ. ID. NO. 23943 | 120-LeuMetLysThrThrGluGlnLeuGluAlaMetAsnValMet-133 |
| SEQ. ID. NO. 23944 | 135-ValAsnProValAlaArgValVal-142 |
| SEQ. ID. NO. 23945 | 144-ProArgPheTrpAlaGlyValPheSerMetPro-154 |
| SEQ. ID. NO. 23946 | 156-LeuAlaSerIlePheAsnValAlaGlyIlePheGlyAla-168 |
| SEQ. ID. NO. 23947 | 196-AspValIleAsnGlyLeu-201 |
| SEQ. ID. NO. 23948 | 230-LeuArgAlaSerThrArgThr-236 |

Antigenic Index - Jameson-Wolf

| | |
|---|---|
| SEQ. ID. NO. 23949 | 37-ValArgProArgLeuSerVal-43 |
| SEQ. ID. NO. 23950 | 77-SerLysPheLysSer-81 |
| SEQ. ID. NO. 23951 | 93-LeuLeuArgGluLeuGly-98 |
| SEQ. ID. NO. 23952 | 109-SerAlaGlyGlyAlaMetThrSer-116 |
| SEQ. ID. NO. 23953 | 122-LysThrThrGluGlnLeuGlu-128 |
| SEQ. ID. NO. 23954 | 186-GlnMetGlnAsnAsn-190 |
| SEQ. ID. NO. 23955 | 224-ProThrSerGluGlyIleLeuArgAlaSerThr-234 |

Hydrophilic Regions - Hopp-Woods

| | |
|---|---|
| SEQ. ID. NO. 23956 | 39-ProArgLeuSerVal-43 |
| SEQ. ID. NO. 23957 | 77-SerLysPheLysSer-81 |
| SEQ. ID. NO. 23958 | 93-LeuLeuArgGluLeuGly-98 |
| SEQ. ID. NO. 23959 | 122-LysThrThrGluGlnLeuGlu-128 | a737
AMPHI Regions - AMPHI

| | |
|---|---|
| SEQ. ID. NO. 23960 | 56-AlaAlaLeuAlaArgValGlyGly-63 |

Antigenic Index - Jameson-Wolf

| | |
|---|---|
| SEQ. ID. NO. 23961 | 24-AlaHisHisAspGlyHisGlyAspAspAspHisGlyHis-36 |
| SEQ. ID. NO. 23962 | 40-GlnHisSerLysGlnAspLysIleIleSer-49 |
| SEQ. ID. NO. 23963 | 51-AlaGlnAlaGluLysAlaAlaLeu-58 |
| SEQ. ID. NO. 23964 | 60-ArgValGlyGlyLysIleThrAspIleAspLeuGluHisAspAsnGlyArgProHisTyrAspValGluIleValLysAsnGlyGlnGluTyr-90 |
| SEQ. ID. NO. 23965 | 94-ValAspAlaArgThrGlyArgValIleSerSerArgArgAspAsp-108 |

Hydrophilic Regions - Hopp-Woods

| | |
|---|---|
| SEQ. ID. NO. 23966 | 27-AspGlyHisGlyAspAspAspHisGlyHis-36 |
| SEQ. ID. NO. 23967 | 40-GlnHisSerLysGlnAspLysIleIleSer-49 |
| SEQ. ID. NO. 23968 | 51-AlaGlnAlaGluLysAlaAlaLeu-58 |
| SEQ. ID. NO. 23969 | 61-ValGlyGlyLysIleThrAspIleAspLeuGluHisAspAsnGlyArgProHisTyr-79 |
| SEQ. ID. NO. 23970 | 82-GluIleValLysAsnGlyGlnGluTyr-90 |
| SEQ. ID. NO. 23971 | 94-ValAspAlaArgThrGlyArg-100 |
| SEQ. ID. NO. 23972 | 102-IleSerSerArgArgAspAsp-108 | a738
AMPHI Regions - AMPHI

| | |
|---|---|
| SEQ. ID. NO. 23973 | 91-LeuMetAsnLeuIleTyrProGlyMetAsnAsp-101 |
| SEQ. ID. NO. 23974 | 139-IleGlySerLeuLeuGlnSerCysIle-147 |
| SEQ. ID. NO. 23975 | 228-ThrTyrIleAlaAlaIleAlaLeuIle-236 |
| SEQ. ID. NO. 23976 | 271-ThrIleLeuGluThrPheThrGlyIle-279 |
| SEQ. ID. NO. 23977 | 285-ValGluArgValAlaAsnGlyGlyPheThrAspLeuProArgGlnIle-300 |
| SEQ. ID. NO. 23978 | 306-LeuAlaAlaPheGlnSer-311 |
| SEQ. ID. NO. 23979 | 316-GlyHisGlyTrpAsnSerPheAla-323 |
| SEQ. ID. NO. 23980 | 338-AspAsnLeuLeuSerAsnLeuPheThr-346 |
| SEQ. ID. NO. 23981 | 371-LeuLeuThrGlyIleAlaGlyLeuLeuLysArg-381 |
| SEQ. ID. NO. 23982 | 398-MetCysHisSerMetLeu-403 |
| SEQ. ID. NO. 23983 | 461-ArgMetValAsnAlaPheSerPro-468 |
| SEQ. ID. NO. 23984 | 472-AspSerAlaLysThrLeuAsnArgLys-480 |
| SEQ. ID. NO. 23985 | 482-AsnGluLeuArgTyrIleSer-488 |
| SEQ. ID. NO. 23986 | 507-LeuProGluTyrProGluThr-513 |
| SEQ. ID. NO. 23987 | 549-AlaLysGlnTrpMetArgAlaThr-556 |
| SEQ. ID. NO. 23988 | 567-TyrAlaAspGluIleArgLysLeuProVal-576 |
| SEQ. ID. NO. 23989 | 579-ProLeuLeuProGluLeuLeuLysAspCysLysAlaPheAlaAlaAlaAlaPro-595 |

Antigenic Index - Jameson-Wolf

| | |
|---|---|
| SEQ. ID. NO. 23990 | 38-LeuGlnProSerProAspPheTyrHis-46 |
| SEQ. ID. NO. 23991 | 62-AlaGlyLysLysLeuPheAsp-68 |
| SEQ. ID. NO. 23992 | 123-HisTyrGlyGlnGluArgIle-129 |
| SEQ. ID. NO. 23993 | 154-GlyTrpGluAspThrProLeu-160 |
| SEQ. ID. NO. 23994 | 177-GlyGlnArgAsnAsnLeuGly-183 |
| SEQ. ID. NO. 23995 | 196-LeuAsnGlyGlnArgLysIleProPro-204 |
| SEQ. ID. NO. 23996 | 242-PheArgSerAspLysSerAsnArgArgThrIle-252 |
| SEQ. ID. NO. 23997 | 283-ThrAlaValGluArgValAlaAsnGlyGlyPheThrAspLeuProArgGlnIleGluTrpArgLys-304 |
| SEQ. ID. NO. 23998 | 316-GlyHisGlyTrpAsnSerPheAla-323 |
| SEQ. ID. NO. 23999 | 332-GluGlnHisAsnIleHisAspAsnLeuLeu-341 |

TABLE 1-continued

| SEQ. ID. NO. 24000 | 378-LeuLeuLysArgProLeuThr-384 |
|---|---|
| SEQ. ID. NO. 24001 | 424-ProAlaGluAlaSerAspGlyIleAlaPheLysLysAlaAla-437 |
| SEQ. ID. NO. 24002 | 468-ProAlaThrAspAspSerAlaLysThrLeuAsnArgLysIleAsnGlu-483 |
| SEQ. ID. NO. 24003 | 508-ProGluTyrProGluThrGlnThrTrpAlaGlu-518 |
| SEQ. ID. NO. 24004 | 520-AlaThrLeuLysSerLeuLysTyrArgProHisSerAla-532 |
| SEQ. ID. NO. 24005 | 542-ArgGlnGlyLysValAlaGluAlaLysGlnTrpMet-553 |
| SEQ. ID. NO. 24006 | 555-AlaThrGlnSerTyr-559 |
| SEQ. ID. NO. 24007 | 566-ArgTyrAlaAspGluIleArgLys-573 |
| SEQ. ID. NO. 24008 | 584-LeuLeuLysAspCysLysAla-590 |
| SEQ. ID. NO. 24009 | 595-ProGlyHisProGluAlaLysProCysLys-604 |
| Hydrophilic Regions - Hopp-Woods | |
| SEQ. ID. NO. 24010 | 62-AlaGlyLysLysLeuPheAsp-68 |
| SEQ. ID. NO. 24011 | 125-GlyGlnGluArgIle-129 |
| SEQ. ID. NO. 24012 | 198-GlyGlnArgLysIlePro-203 |
| SEQ. ID. NO. 24013 | 243-ArgSerAspLysSerAsnArgArgThrIle-252 |
| SEQ. ID. NO. 24014 | 283-ThrAlaValGluArgValAla-289 |
| SEQ. ID. NO. 24015 | 300-IleGluTrpArgLys-304 |
| SEQ. ID. NO. 24016 | 332-GluGlnHisAsnIle-336 |
| SEQ. ID. NO. 24017 | 378-LeuLeuLysArgProLeuThr-384 |
| SEQ. ID. NO. 24018 | 425-AlaGluAlaSerAsp-429 |
| SEQ. ID. NO. 24019 | 431-IleAlaPheLysLysAlaAla-437 |
| SEQ. ID. NO. 24020 | 469-AlaThrAspAspSerAlaLysThrLeuAsnArgLysIleAsnGlu-483 |
| SEQ. ID. NO. 24021 | 525-LeuLysTyrArgPro-529 |
| SEQ. ID. NO. 24022 | 542-ArgGlnGlyLysValAlaGluAlaLysGlnTrpMet-553 |
| SEQ. ID. NO. 24023 | 566-ArgTyrAlaAspGluIleArgLys-573 |
| SEQ. ID. NO. 24024 | 584-LeuLeuLysAspCysLysAla-590 |
| SEQ. ID. NO. 24025 | 596-GlyHisProGluAlaLysProCysLys-604 |
| a739 | |
| AMPHI Regions - AMPHI | |
| SEQ. ID. NO. 24026 | 6-AsnLysProPheArgLeu-11 |
| SEQ. ID. NO. 24027 | 53-HisThrAspSerPro-57 |
| SEQ. ID. NO. 24028 | 86-ProAlaGlnProAspGlyThrAsp-93 |
| SEQ. ID. NO. 24029 | 120-ThrAspArgGlnProAspAspAlaGlyAla-129 |
| SEQ. ID. NO. 24030 | 131-AlaGluAsnThrLeu-135 |
| Antigenic Index - Jameson-Wolf | |
| SEQ. ID. NO. 24031 | 1-MetAlaLysLysProAsnLysProPheArgLeuThrPro-13 |
| SEQ. ID. NO. 24032 | 39-PheAsnProAsnGlyAspLysThrLeuGlnThrGluProGlnHisThrAspSerProArgGluThrGluPhe-62 |
| SEQ. ID. NO. 24033 | 64-LeuProAsnGlyValValGlyGlnAspAlaAlaGlnProGluHisHisHisAlaSerSerSerAlaProAlaGlnProAspGlyThrAspGluSer<br>GlySerGlyLeuProSerProAlaAlaProLysLysAsnArgValLysProGlnProAlaAspThrAlaGlnThrAspArgGlnProAspAspAlaGlyAla<br>GlnAlaGluAsnThrLeuLysGluThrProValLeuProThrAsnValProArgProGluProArgLysGluThrProGluLysGlnAlaGlnProLysGlu<br>ThrProLysGluLysGluThrProLysGluAsnHisThrLysProAspThrProLysAsnThrProProLysProHisLysGluIleLeu-193 |
| Hydrophilic Regions - Hopp-Woods | |
| SEQ. ID. NO. 24034 | 1-MetAlaLysLysProAsnLysProPheArgLeu-11 |
| SEQ. ID. NO. 24035 | 41-ProAsnGlyAspLysThrLeuGlnThrGluProGlnHisThrAspSerProArgGluThrGlu-61 |
| SEQ. ID. NO. 24036 | 72-AspAlaAlaGlnProGluHisHisHis-80 |
| SEQ. ID. NO. 24037 | 87-AlaGlnProAspGlyThrAspGluSerGlySer-97 |
| SEQ. ID. NO. 24038 | 103-AlaAlaProLysLysAsnArgValLysProGlnProAlaAspThrAlaGlnThrAspArgGlnProAspAspAlaGlyAlaGlnAlaGluAsnThrLeu<br>LysGluThrPro-139 |
| SEQ. ID. NO. 24039 | 145-ValProArgProGluProArgLysGluThrProGluLysGlnAlaGlnProLysGluThrProLysGluLysGluThrProLysGluAsnHisThrLys<br>ProAspThrProLysAsnThrProProLysProHisLysGluIleLeu-193 |
| a740 | |
| Antigenic Index - Jameson-Wolf | |
| SEQ. ID. NO. 24040 | 25-AlaAsnProProGluAspLysProGln-33 |
| SEQ. ID. NO. 24041 | 57-IleLysHisHisLeuLysGlnGluPheAspLeuLysArgGlnThr-71 |
| Hydrophilic Regions - Hopp-Woods | |
| SEQ. ID. NO. 24042 | 27-ProProGluAspLysProGln-33 |
| SEQ. ID. NO. 24043 | 57-IleLysHisHisLeuLysGlnGluPheAspLeuLysArgGlnThr-71 |
| a741 | |
| AMPHI Regions - AMPHI | |
| SEQ. ID. NO. 24044 | 30-AspIleGlyAlaValLeuAlaAspAlaLeuThrAla-41 |
| SEQ. ID. NO. 24045 | 93-SerArgPheAspPheIleArgGlnIleGlu-102 |
| SEQ. ID. NO. 24046 | 158-ThrSerPheAspLysLeuProGluGlyGlyArg-168 |
| SEQ. ID. NO. 24047 | 200-IleGluHisLeuLys-204 |
| SEQ. ID. NO. 24048 | 251-GlnGluValAlaGlySerAlaGlu-258 |
| Antigenic Index - Jameson-Wolf | |
| SEQ. ID. NO. 24049 | 21-SerSerGlyGlyGly-25 |
| SEQ. ID. NO. 24050 | 43-LeuAspHisLysAspLysSerLeu-50 |
| SEQ. ID. NO. 24051 | 56-AspGlnSerValArgLysAsnGluLysLeuLysLeu-67 |
| SEQ. ID. NO. 24052 | 71-GlyAlaGluLysThrTyrGlyAsnGlyAspSerLeuAsnThrGlyLysLeuLysAsnAspLysValSerArgPheAspPhe-97 |
| SEQ. ID. NO. 24053 | 101-IleGluValAspGlyGlnLeu-107 |
| SEQ. ID. NO. 24054 | 117-ValTyrLysGlnSerHisSerAla-124 |
| SEQ. ID. NO. 24055 | 129-GlnThrGluGlnValGlnAspSerGlu-<br>HisSerGlyLysMetValAlaLysArgGlnPheArgIleGlyAspIleAlaGlyGluHisThrSerPheAspLysLeuProGluGlyGlyArgAlaThrTyrArg-172 |
| SEQ. ID. NO. 24056 | 174-ThrAlaPheGlySerAspAspAlaSerGlyLysLeu-185 |
| SEQ. ID. NO. 24057 | 191-PheAlaAlaLysGlnGlyHisGlyLysIleGluHisLeuLysSerProGluLeuAsnVal-210 |
| SEQ. ID. NO. 24058 | 213-AlaAlaSerAspIleLysProAspLysLysArgHisAla-225 |
| SEQ. ID. NO. 24059 | 234-AsnGlnAlaGluLysGlySerTyrSer-242 |
| SEQ. ID. NO. 24060 | 247-GlyGlyGlnAlaGlnGluValAlaGly-255 |
| SEQ. ID. NO. 24061 | 257-AlaGluValGluThrAlaAsnGly-264 |

TABLE 1-continued

Hydrophilic Regions - Hopp-Woods
SEQ. ID. NO. 24062    43-LeuAspHisLysAspLysSerLeu-50
SEQ. ID. NO. 24063    57-GlnSerValArgLysAsnGluLysLeuLysLeu-67
SEQ. ID. NO. 24064    71-GlyAlaGluLysThrTyrGlyAsn-78
SEQ. ID. NO. 24065    85-GlyLysLeuLysAsnAspLysValSerArg-94
SEQ. ID. NO. 24066    101-IleGluValAspGly-105
SEQ. ID. NO. 24067    132-GlnValGlnAspSerGluHisSerGly-140
SEQ. ID. NO. 24068    142-MetValAlaLysArgGlnPheArgIle-150
SEQ. ID. NO. 24069    152-AspIleAlaGlyGlu-156
SEQ. ID. NO. 24070    158-ThrSerPheAspLysLeuProGluGlyGlyArgAlaThrTyr-171
SEQ. ID. NO. 24071    177-GlySerAspAspAlaSerGly-183
SEQ. ID. NO. 24072    195-GlnGlyHisGlyLysIleGluHisLeuLysSerProGluLeuAsnVal-210
SEQ. ID. NO. 24073    213-AlaAlaSerAspIleLysProAspLysLysArgHisAla-225
SEQ. ID. NO. 24074    235-GlnAlaGluLysGlySer-240
SEQ. ID. NO. 24075    249-GlnAlaGlnGluValAlaGly-255
SEQ. ID. NO. 24076    257-AlaGluValGluThr-261
a742
AMPHI Regions - AMPHI
SEQ. ID. NO. 24077    26-ArgGluValProAsp-30
SEQ. ID. NO. 24078    53-AsnArgProLeuGln-57
SEQ. ID. NO. 24079    66-GluAspTrpSerArgLeu-71
SEQ. ID. NO. 24080    77-AsnLeuPheSerGlyPheLysHisValPheAsp-87
SEQ. ID. NO. 24081    143-LysAlaLeuGluLysLeuLysAla-150
SEQ. ID. NO. 24082    153-AspGluThrAlaLysGluTyrArg-160
SEQ. ID. NO. 24083    234-AsnAlaAlaGlnArgPheProAsnSerLeuTyrAsp-245
SEQ. ID. NO. 24084    326-ValTyrAlaGlySer-330
SEQ. ID. NO. 24085    340-SerSerProLeuVal-344
SEQ. ID. NO. 24086    369-ArgAsnAlaLysLysIle-374
SEQ. ID. NO. 24087    422-ThrProAlaPheThrGlyPheSerGlyThrValProValTrpLysThrValLys-439
SEQ. ID. NO. 24088    448-LeuTyrAsnTyrAlaLysTyrLeuAsnThrAsn-458
SEQ. ID. NO. 24089    475-LeuHisLeuLeuGlyGlyLeuHisTyr-483
SEQ. ID. NO. 24090    505-PheGlnThrAlaSerSer-510
SEQ. ID. NO. 24091    543-IleTyrGlySerTyrThrLysIlePheLysGlnGlnAspAsn-556
SEQ. ID. NO. 24092    616-GlySerPheGlnThrValAlaLysProIleGlyLysValValSerArg-631
SEQ. ID. NO. 24093    643-GluAspTrpLysValPheAlaGly-650
SEQ. ID. NO. 24094    657-ArgTyrLysAsnAla-661
SEQ. ID. NO. 24095    670-AlaLysAsnThrGly-674
SEQ. ID. NO. 24096    677-ProTyrAsnPheSerAsnPheThrProValHisIle-688
SEQ. ID. NO. 24097    714-ThrSerSerLeuTyrAsnIle-720
SEQ. ID. NO. 24098    725-TyrGlyLeuIleAspGlyPheValArgTyr-734
SEQ. ID. NO. 24099    736-LeuGlyLysHisAlaLysLeu-742
SEQ. ID. NO. 24100    759-TyrAsnArgThrArgGlyAlaAsnAsnPheTyrGlyGluPro-772
Antigenic Index - Jameson-Wolf
SEQ. ID. NO. 24101    6-AlaGluAlaAspAlaGlyAsp-12
SEQ. ID. NO. 24102    21-MetTyrGlnLysSerArgGluValProAspPheSerGly-33
SEQ. ID. NO. 24103    37-SerCysGluAsnGlnLysThrAlaProPheSerSerThrProAlaCysAsnArgProLeuGlnLeuProArgAsnThrTyrLeuGlyGluAspTrpSer
                      ArgLeuSerAlaAspLysTyrAsn-77
SEQ. ID. NO. 24104    86-PheAspAsnGlyTrp-90
SEQ. ID. NO. 24105    97-SerTyrThrLysAsnGluSerAspAlaLysVal-107
SEQ. ID. NO. 24106    120-LeuSerAspGluAspAla-125
SEQ. ID. NO. 24107    130-ThrGluLysAsnGluValIleProPheGluProLysAspLysAlaLeuGluLysLeuLysAlaTyrArgAspGluThrAlaLysGluTyrArgGlu
                      ArgLysAspAspPheValLysAsnArgPheAspAsnThrAla-175
SEQ. ID. NO. 24108    177-GluGlnTyrArgSerArgArgAlaAlaGluArgLysAlaGlyPheAspGluCysMet-195
SEQ. ID. NO. 24109    205-CysGlnGlySerTrpGlyAspProGlyValAspAlaAspLysSerGluPheValAsp-223
SEQ. ID. NO. 24110    235-AlaAlaGlnArgPheProAsnSerLeuTyrAspSerSerPheAsnArgLysAlaThrAlaAsnArgArgTyrSerTyrMetPro-262
SEQ. ID. NO. 24111    264-ArgHisThrLysAspAspArgGlnTrp-272
SEQ. ID. NO. 24112    286-GlyArgGluHisAsp-290
SEQ. ID. NO. 24113    295-TyrAlaTyrGlyAspGluLysIleArgSerGluTyr-306
SEQ. ID. NO. 24114    308-GluIleTyrGluArgArgHisArgValArgProAsnThrGlyAla-322
SEQ. ID. NO. 24115    331-CysGlnGlyGluProAspGlyAspLeuSer-340
SEQ. ID. NO. 24116    345-ArgGlyHisLysGluProAspTrpGlnAlaTyrAspGluLysGlyAsnArgThrValTyrAlaGluGluCysArgAsnAlaLysLysIleLysThrGlu
                      ProLysLeuAspAlaGluGlyLysGln-386
SEQ. ID. NO. 24117    389-TyrTyrAspGluTyrSerGlySerArgThr-398
SEQ. ID. NO. 24118    405-TyrGluLeuAspGluLysGlyAsnLysIleGlnGluThrAsnProAspGlyThrPro-423
SEQ. ID. NO. 24119    439-LysValAlaAspAspHisVal-445
SEQ. ID. NO. 24120    454-TyrLeuAsnThrAsnLysThrHis-461
SEQ. ID. NO. 24121    485-ArgTyrGluThrSerGlnThrLysAspMetProValArgTyrGlyGlnProAlaSerAspPheGlnThr-507
SEQ. ID. NO. 24122    509-SerSerIleLysAlaAspGlnAspHisTyrThr-519
SEQ. ID. NO. 24123    521-LysMetGlnGlyHisLysLeuThrPro-529
SEQ. ID. NO. 24124    545-GlySerTyrThrLys-549
SEQ. ID. NO. 24125    551-PheLysGlnGlnAspAsnValAspValSerAla-561
SEQ. ID. NO. 24126    584-GlyArgLeuAsnAla-588
SEQ. ID. NO. 24127    595-LeuGluGlnLysAsnArgThrValVal-603
SEQ. ID. NO. 24128    610-GlyAlaGlyGlyLysGlnGlySer-617
SEQ. ID. NO. 24129    628-ValValSerArgGlyAlaGluPheGluLeuSerGlyGluLeuAsnGluAspTrpLys-646
SEQ. ID. NO. 24130    652-ThrTyrAsnLysSerArgTyrLysAsnAlaAlaGluValAsnAlaGluArgLeuAlaLysAsnThrGlyAlaAspProTyrAsnPheSerAsn-682
SEQ. ID. NO. 24131    708-ValSerAlaGlnSerGlyThrSerSerLeuTyrAsnIleArgGlnGlyGly-724
SEQ. ID. NO. 24132    735-GluLeuGlyLysHisAlaLys-741
SEQ. ID. NO. 24133    746-GlyThrAsnLeuAsnGlyArgThrTyrPheGluAsnAsnTyrAsnArgThrArgGlyAlaAsnAsnPheTyrGlyGluProArgThrValSerMet-777

TABLE 1-continued

Hydrophilic Regions - Hopp-Woods
SEQ. ID. NO. 24134    6-AlaGluAlaAspAlaGlyAsp-12
SEQ. ID. NO. 24135    23-GlnLysSerArgGluValProAsp-30
SEQ. ID. NO. 24136    67-AspTrpSerArgLeuSerAlaAspLys-75
SEQ. ID. NO. 24137    97-SerTyrThrLysAsnGluSerAspAlaLysVal-107
SEQ. ID. NO. 24138    120-LeuSerAspGluAspAla-125
SEQ. ID. NO. 24139    130-ThrGluLysAsnGluValIleProPheGluProLysAspLysAlaLeuGluLysLeuLysAlaTyrArgAspGluThrAlaLysGluTyrArgGlu
                       ArgLysAspAspPheValLysAsnArgPheAspAsnThrAla-175
SEQ. ID. NO. 24140    177-GluGlnTyrArgSerArgArgAlaAlaGluArgLysAlaGlyPheAspGluCysMet-195
SEQ. ID. NO. 24141    212-ProGlyValAspAlaAspLysSerGluPheValAsp-223
SEQ. ID. NO. 24142    247-SerPheAsnArgLysAlaThrAlaAsnArgArgTyrSer-259
SEQ. ID. NO. 24143    264-ArgHisThrLysAspAspArgGlnTrp-272
SEQ. ID. NO. 24144    286-GlyArgGluHisAsp-290
SEQ. ID. NO. 24145    297-TyrGlyAspGluLysIleArgSerGluTyr-306
SEQ. ID. NO. 24146    308-GluIleTyrGluArgArgHisArgValArgProAsnThr-320
SEQ. ID. NO. 24147    331-CysGlnGlyGluProAspGlyAspLeu-339
SEQ. ID. NO. 24148    345-ArgGlyHisLysGluProAsp-351
SEQ. ID. NO. 24149    354-AlaTyrAspGluLysGlyAsnArg-361
SEQ. ID. NO. 24150    363-ValTyrAlaGluGluCysArgAsnAlaLysLysIleLysThrGluProLysLeuAspAlaGluGlyLysGln-386
SEQ. ID. NO. 24151    393-TyrSerGlySerArg-397
SEQ. ID. NO. 24152    405-TyrGluLeuAspGluLysGlyAsnLysIleGlnGluThrAsnProAspGly-421
SEQ. ID. NO. 24153    439-LysValAlaAspAspHisVal-445
SEQ. ID. NO. 24154    485-ArgTyrGluThrSerGlnThrLysAspMetProVal-496
SEQ. ID. NO. 24155    500-GlnProAlaSerAsp-504
SEQ. ID. NO. 24156    509-SerSerIleLysAlaAspGlnAspHisTyrThr-519
SEQ. ID. NO. 24157    551-PheLysGlnGlnAspAsnValAspValSerAla-561
SEQ. ID. NO. 24158    597-GlnLysAsnArgThrValVal-603
SEQ. ID. NO. 24159    611-AlaGlyGlyLysGlnGlySer-617
SEQ. ID. NO. 24160    628-ValValSerArgGlyAlaGluPheGluLeuSerGlyGluLeuAsnGluAspTrpLys-646
SEQ. ID. NO. 24161    654-AsnLysSerArgTyrLysAsnAlaAlaGluValAsnAlaGluArgLeuAlaLys-671
SEQ. ID. NO. 24162    735-GluLeuGlyLysHisAlaLys-741
SEQ. ID. NO. 24163    758-AsnTyrAsnArgThrArgGly-764
SEQ. ID. NO. 24164    770-GlyGluProArgThrValSerMet-777
a743
AMPHI Regions - AMPHI
SEQ. ID. NO. 24165    19-TyrGlyGlySerPhe-23
SEQ. ID. NO. 24166    58-SerTyrThrIleAsp-62
SEQ. ID. NO. 24167    64-MetSerThrAlaThrGly-69
SEQ. ID. NO. 24168    96-ThrLeuGluGluAlaMetLysAsnThrThrGlyValAsnValValArgAsp-112
SEQ. ID. NO. 24169    158-ValTyrAspHisIleGluValValArgGlyAlaThrGly-170
Antigenic Index - Jameson-Wolf
SEQ. ID. NO. 24170    1-MetAsnGlnAsnHis-5
SEQ. ID. NO. 24171    30-ValSerAspGlyAsnThrVal-36
SEQ. ID. NO. 24172    41-ValAsnValArgGlySerHisAlaLeuSerGlyLysThrGluLysThrArgSerTyrThrIleAspArgMetSerThr-66
SEQ. ID. NO. 24173    72-IleAlaGlyLysAspThrProGlnSer-80
SEQ. ID. NO. 24174    85-ThrArgSerArgLeuAspAspLysAlaValHisThrLeuGluGluAlaMetLysAsnThrThrGly-106
SEQ. ID. NO. 24175    109-ValValArgAspSerGlyLeuGlnThrArgPheLeuSerArgGlyPhe-124
SEQ. ID. NO. 24176    128-GlnIleGlyGluAspGlyIle-134
SEQ. ID. NO. 24177    140-GlyArgSerGlyTyrThrAlaLysIleAspValSerProSerThrAsp-155
SEQ. ID. NO. 24178    163-GluValValArgGlyAlaThrGlyLeuThrGlnSerAsnSerGluProGlyGly-180
SEQ. ID. NO. 24179    184-LeuIleArgLysArg-188
Hydrophilic Regions - Hopp-Woods
SEQ. ID. NO. 24180    49-LeuSerGlyLysThrGluLysThrArgSerTyrThrIleAspArgMetSerThr-66
SEQ. ID. NO. 24181    72-IleAlaGlyLysAspThrProGln-79
SEQ. ID. NO. 24182    85-ThrArgSerArgLeuAspAspLysAlaValHisThrLeuGluGluAlaMetLysAsn-103
SEQ. ID. NO. 24183    109-ValValArgAspSerGlyLeu-115
SEQ. ID. NO. 24184    128-GlnIleGlyGluAspGlyIle-134
SEQ. ID. NO. 24185    174-SerAsnSerGluProGlyGly-180
SEQ. ID. NO. 24186    184-LeuIleArgLysArg-188
a746
AMPHI Regions - AMPHI
SEQ. ID. NO. 24187    10-LeuSerGlyTyrGluGlnLeuLys-17
SEQ. ID. NO. 24188    42-LeuSerSerGlyProAlaGluGlnThrAla-51
SEQ. ID. NO. 24189    72-SerAlaAlaAspLysProGlnAsp-79
SEQ. ID. NO. 24190    94-SerGluProGluAsn-98
SEQ. ID. NO. 24191    118-LeuGluAlaSerGluLysLeuGlnGlnAlaGluThrAlaLysThrAlaPro-134
SEQ. ID. NO. 24192    153-AspThrValAlaValGlu-158
SEQ. ID. NO. 24193    160-ProLysArgThrAlaGluThr-166
SEQ. ID. NO. 24194    170-LysAlaGluArgThr-174
SEQ. ID. NO. 24195    184-ThrLysThrAlaGluLysValAlaAspLysProLys-195
SEQ. ID. NO. 24196    210-SerAlaValLysGluAlaLysLysAlaAspLysAlaGluSer-223
SEQ. ID. NO. 24197    238-GluThrAlaGlnLysThrAspLysAlaAspLysThrLysThrAlaGluLys-254
SEQ. ID. NO. 24198    287-SerThrIleThrGluIleMetThr-294
SEQ. ID. NO. 24199    307-TyrLysAsnAlaArgAspAlaGluArgAspLeu-317
Antigenic Index - Jameson-Wolf
SEQ. ID. NO. 24200    1-MetSerGluAsnLysGlnAsnGluValLeuSerGlyTyrGluGlnLeuLysArgArgAsnArgArgLeuValThr-26
SEQ. ID. NO. 24201    43-SerSerGlyProAlaGluGlnThrAlaGlyGluThrSerGlyValGluAsnLysAlaAlaGly-63
SEQ. ID. NO. 24202    72-SerAlaAlaAspLysProGlnAspLeuAlaGlyGluAspLysProSerAlaAlaAspSerGluIleSerGluProGluAsnVal-99
SEQ. ID. NO. 24203    107-AsnAspArgLeuGluAspSerAsnIleLysGlyLeuGluAlaSerGluLysLeuGlnGlnAlaGluThrAlaLysThrAlaProLysGlnAlaLys
                       GlnArgAlaAlaGluLysValProAlaThrAlaAspSerThrAspThrValAlaValGluLysProLysArgThrAlaGluThrLysProGlnLysAla TABLE 1-continued

|  |  |
|---|---|
|  | GluArgThrAlaLysAlaLysProLysAlaLysGluThrLysThrAlaGluLysValAlaAspLysProLysThrAlaAlaGluLysThrLysProAsp ThrAlaLysSerAspSerAlaValLysGluAlaLysLysAlaAspLysAlaGluSerLysLysThrAlaGluLysAspArgSerAspGlyLysLysHis GluThrAlaGlnLysThrAspLysAlaAspLysThrLysThrAlaGluLysGluLysSerGlyLysLysAlaAla-262 |
| SEQ. ID. NO. 24204 | 266-GlyTyrAlaGluLysGluArgAlaLeuSerLeuGlnArgLysMetLysAlaAlaGlyIle-285 |
| SEQ. ID. NO. 24205 | 292-IleMetThrAspAsnGlyLysValTyrArgValLysSerSerAsnTyrLysAsnAlaArgAspAlaGluArgAspLeuAsnLysLeuArgVal-322 |
| Hydrophilic Regions - Hopp-Woods |  |
| SEQ. ID. NO. 24206 | 1-MetSerGluAsnLysGlnAsnGluVal-9 |
| SEQ. ID. NO. 24207 | 14-GluGlnLeuLysArgArgAsnArgArgLeuVal-25 |
| SEQ. ID. NO. 24208 | 45-GlyProAlaGluGlnThrAlaGlyGluThrSerGlyValGluAsnLysAlaAlaGly-63 |
| SEQ. ID. NO. 24209 | 72-SerAlaAlaAspLysProGlnAspLeuAlaGlyGluAspLysProSerAlaAlaAspSerGluIleSerGluProGluAsnVal-99 |
| SEQ. ID. NO. 24210 | 108-AspArgLeuGluAspSerAsnIleLysGlyLeuGluAlaSerGluLysLeuGlnGlnAlaGluThrAlaLysThrAlaProLysGlnAlaLysGln ArgAlaAlaGluLysValProAlaThrAlaAspSerThrAsp-153 |
| SEQ. ID. NO. 24211 | 155-ValAlaValGluLysProLysArgThrAlaLysAlaLysProGlnLysAlaGluArgThrAlaLysAlaLysProLysAlaLysGluThrLysThr AlaGluLysValAlaAspLysProLysThrAlaAlaGluLysThrLysProAspThrAlaLysSerAspSerAlaValLysGluAlaLysLysAlaAspLys AlaGluSerLysLysThrAlaGluLysAspArgSerAspGlyLysLysHisGluThrAlaGlnLysThrAspLysAlaAspLysThrLysThrAlaGluLys GluLysSerGlyLysLysAlaAla-262 |
| SEQ. ID. NO. 24212 | 267-TyrAlaGluLysGluArgAlaLeuSerLeuGlnArgLysMetLysAlaAlaGlyIle-285 |
| SEQ. ID. NO. 24213 | 292-IleMetThrAspAsnGlyLysValTyrArgValLysSerSerAsnTyrLysAsnAlaArgAspAlaGluArgAspLeuAsnLysLeuArgVal-322 |
| a747 |  |
| AMPHI Regions - AMPHI |  |
| SEQ. ID. NO. 24214 | 28-ValSerLysSerAlaLysGlyTrp-35 |
| Antigenic Index - Jameson-Wolf |  |
| SEQ. ID. NO. 24215 | 8-TyrAlaAspLeuArgGlyLysThrLysVal-17 |
| SEQ. ID. NO. 24216 | 23-CysAlaSerArgAspValSerLysSerAlaLysGlyTrp-35 |
| SEQ. ID. NO. 24217 | 42-AsnValGlyLysGlnLeuThrAspSerValGlyLeuGluPheAspProTyrTyrArgHisLysThrIleCysLysProArgGluIleValLeuAsp GlyAspLysThrLysMetGlyArgSerLysSerAsnGluTyrGly-88 |
| SEQ. ID. NO. 24218 | 97-SerGlnLeuLysSerLys-102 |
| Hydrophilic Regions - Hopp-Woods |  |
| SEQ. ID. NO. 24219 | 8-TyrAlaAspLeuArgGlyLysThrLysVal-17 |
| SEQ. ID. NO. 24220 | 23-CysAlaSerArgAspValSerLysSerAlaLys-33 |
| SEQ. ID. NO. 24221 | 63-ThrIleCysLysProArgGluIleValLeuAspGlyAspLysThrLysMetGlyArgSerLysSerAsnGluTyr-87 |
| a748 |  |
| AMPHI Regions - AMPHI |  |
| SEQ. ID. NO. 24222 | 22-GlyAlaValGlyAlaIleGlyGly-29 |
| SEQ. ID. NO. 24223 | 40-AlaGluArgThrAlaGluSerGlnHis-48 |
| SEQ. ID. NO. 24224 | 82-SerAlaLysGlnLeuGluAsnLeuPheArgThrLeu-93 |
| SEQ. ID. NO. 24225 | 155-LeuGlnGluMetArgAspPheSerAsnAspLysLeuGlnLysSerTrp-170 |
| SEQ. ID. NO. 24226 | 188-GlnAlaAlaLeuArgAspIleIleLysHisThrValGln-200 |
| SEQ. ID. NO. 24227 | 250-GlyValAlaAlaAsnSer-255 |
| SEQ. ID. NO. 24228 | 257-AspGluProGluTrp-261 |
| SEQ. ID. NO. 24229 | 268-GlnAlaValArgLeuIleArgHisPheValGluPheTrpAspArg-282 |
| SEQ. ID. NO. 24230 | 310-GlnProAspPheAlaLys-315 |
| SEQ. ID. NO. 24231 | 334-ArgAspProGluPheLeu-339 |
| SEQ. ID. NO. 24232 | 390-LeuGluGluTyrIleSerProPhe-397 |
| Antigenic Index - Jameson-Wolf |  |
| SEQ. ID. NO. 24233 | 1-MetSerLysAsnGlnProAlaGlnProThrArgArgThrLeuPhe-15 |
| SEQ. ID. NO. 24234 | 29-GlyTyrLeuGlyGlyLysLysArgGlyGluThrAlaGluArgThrAlaGluSerGlnHisSerProGlnAla-52 |
| SEQ. ID. NO. 24235 | 80-AlaGlnSerAlaLysGlnLeuGluAsn-88 |
| SEQ. ID. NO. 24236 | 101-ThrGlnGlyGlyGluTyrGlnAspGlyAspAspLysLeuProProAlaGlySerGly-119 |
| SEQ. ID. NO. 24237 | 125-PheAsnProAspGlyLeuThr-131 |
| SEQ. ID. NO. 24238 | 139-SerLeuPheAspGlyArgPheGlyLeuLysAspLysLysProIleHis-154 |
| SEQ. ID. NO. 24239 | 156-GlnGluMetArgAspPheSerAsnAspLysLeuGlnLysSerTrpCysAspGlyAspLeuSer-176 |
| SEQ. ID. NO. 24240 | 183-ThrProGluThrCys-187 |
| SEQ. ID. NO. 24241 | 208-IleAspGlyTrpGlnProLysSerGluProGlyAlaMetAla-221 |
| SEQ. ID. NO. 24242 | 226-LeuGlyPheArgAspGlyThrGlyAsnProLysValSerAspProLysThrAlaAspGlu-245 |
| SEQ. ID. NO. 24243 | 255-SerLeuAspGluProGluTrpAlaLysAsnGlySerTyrGlnAla-269 |
| SEQ. ID. NO. 24244 | 279-PheTrpAspArgThrProLeuGlnGluGlnThrAspIlePheGlyArgArgLysTyrSerGlyAlaProMetAspGlyLysLysGluAlaAspGln ProAspPheAlaLysAspProGluGlyAsnThrThrProLysAspSerHisIleArgLeuAlaAsnProArgAspProGluPheLeuLysLysHis ArgLeuPheArg-346 |
| SEQ. ID. NO. 24245 | 348-AlaTyrSerTyrSerArgGlyLeuAlaSerSerGlyGlnLeu-361 |
| SEQ. ID. NO. 24246 | 385-LeuAsnGlyGluProLeuGluGluTyr-393 |
| SEQ. ID. NO. 24247 | 406-ProGlyValGluLysGlyGlyPhe-413 |
| Hydrophilic Regions - Hopp-Woods |  |
| SEQ. ID. NO. 24248 | 1-MetSerLysAsnGlnPro-6 |
| SEQ. ID. NO. 24249 | 8-GlnProThrArgArgThrLeuPhe-15 |
| SEQ. ID. NO. 24250 | 32-GlyGlyLysLysArgGlyGluThrAlaGluArgThrAlaGluSerGlnHis-48 |
| SEQ. ID. NO. 24251 | 80-AlaGlnSerAlaLysGlnLeuGluAsn-88 |
| SEQ. ID. NO. 24252 | 104-GlyGluTyrGlnAspGlyAspAspLysLeuProPro-115 |
| SEQ. ID. NO. 24253 | 145-PheGlyLeuLysAspLysLysProIleHis-154 |
| SEQ. ID. NO. 24254 | 156-GlnGluMetArgAspPheSerAsnAspLysLeuGlnLysSerTrpCysAspGlyAspLeu-175 |
| SEQ. ID. NO. 24255 | 211-TrpGlnProLysSerGluProGlyAlaMetAla-221 |
| SEQ. ID. NO. 24256 | 229-ArgAspGlyThrGlyAsnProLysValSerAspProLysThrAlaAsp-244 |
| SEQ. ID. NO. 24257 | 255-SerLeuAspGluProGluTrpAlaLys-263 |
| SEQ. ID. NO. 24258 | 283-ThrProLeuGlnGluGlnThrAspIlePheGlyArgArgLysTyrSer-298 |
| SEQ. ID. NO. 24259 | 301-ProMetAspGlyLysLysGluAlaAspGlnProAspPheAlaLysAspProGluGlyAsnThrThrProLysAspSerHisIle-328 |
| SEQ. ID. NO. 24260 | 331-AlaAsnProArgAspProGluPheLeuLysLysHisArgLeuPheArg-346 |

TABLE 1-continued

SEQ. ID. NO. 24261 388-GluProLeuGluGluTyr-393
SEQ. ID. NO. 24262 407-GlyValGluLysGlyGly-412
a749
AMPHI Regions - AMPHI
SEQ. ID. NO. 24263 1-MetArgLysPheAsnLeuThrAlaLeuSerValMetLeuAlaLeuGlyLeuThrAlaCysGlnProProGluAlaGluLysAlaAlaProAlaAla
SerGlyGluAlaGlnThrAlaAsnGluGlyGlySerValSerIleAlaValAsnAspAsnAlaCysGluProMetGluLeuThrValProSerGlyGlnVal
ValPheAsnIleLysAsnAsnSerGlyArgLysLeuGluTrpGluIleLeuLysGlyValMetValValAspGluArgGluAsnIleAlaProGlyLeuSer
AspLysMetThrValThrLeuLeuProGlyGluTyrGluMetThrCysGlyLeuLeuThrAsnProArgGlyLysLeuValValThrAspSerGlyPheLys
AspThrAlaAsnGluAlaAspLeuGluLysLeuSerGlnProLeuAlaAspTyrLysAlaTyrValGlnGlyGluValLysGluLeuValAlaLysThrLys
ThrPheThrGluAlaValLysAlaGlyAspIleGluLysAlaLysSerLeuPheAlaAspThrArgValHisTyrGluArgIleGluProIleAlaGluLeu
PheSerGluLeuAspProValIleAspAlaArgGluAspAspPheLysAspGlyAlaLysAspAlaGlyPheThrGlyPheHisArgIleGluTyrAlaLeu
TrpValGluLysAspValSerGlyValLysGluIleAlaAlaLysLeuMetThrAspValGluAlaLeuGlnLysGluIleAspAlaLeuAlaPheProPro
GlyLysValValGlyGlyAlaSerGluLeuIleGluGluValAlaGlySerLysIleSerGlyGluGluAspArgTyrSerHisThrAspLeuSerAspPhe
GlnAlaAsnValAspGlySerLysLysIleValAspLeuPheArgProLeuIleGluThrLysAsnLysAlaLeuLeuGluLysThrAspThrAsnPheLys
GlnValAsnGluIleLeuAlaLysTyrArgThrLysAspGlyPheGluThrTyrAspLysLeuGlyGluAlaAspArgLysAlaLeuGlnAlaSerIleAsn
AlaLeuAlaGluAspLeuAlaGlnLeuArgGlyIleLeuGlyLeuLys-388
Antigenic Index - Jameson-Wolf (SEQ. ID. NO. 24263)
1-MetArgLysPheAsnLeuThrAlaLeuSerValMetLeuAlaLeuGlyLeuThrAlaCysGlnProProGluAlaGluLysAlaAlaProAlaAlaSerGlyGluAlaGlnThrAlaAsnGlu
GlyGlySerValSerIleAlaValAsnAspAsnAlaCysGluProMetGluLeuThrValProSerGlyGlnValValPheAsnIleLysAsnAsnSerGlyArgLysLeuGluTrpGluIle
LeuLysGlyValMetValValAspGluArgGluAsnIleAlaProGlyLeuSerAspLysMetThrValThrLeuLeuProGlyGluTyrGluMetThrCysGlyLeuLeuThrAsnProArg
GlyLysLeuValValThrAspSerGlyPheLysAspThrAlaAsnGluAlaAspLeuGluLysLeuSerGlnProLeuAlaAspTyrLysAlaTyrValGlnGlyGluValLysGluLeuVal
AlaLysThrLysThrPheThrGluAlaValLysAlaGlyAspIleGluLysAlaLysSerLeuPheAlaAspThrArgValHisTyrGluArgIleGluProIleAlaGluLeuPheSerGlu
LeuAspProValIleAspAlaArgGluAspAspPheLysAspGlyAlaLysAspAlaGlyPheThrGlyPheHisArgIleGluTyrAlaLeuTrpValGluLysAspValSerGlyValLys
GluIleAlaAlaLysLeuMetThrAspValGluAlaLeuGlnLysGluIleAspAlaLeuAlaPheProProGlyLysValValGlyGlyAlaSerGluLeuIleGluGluValAlaGlySer
LysIleSerGlyGluGluAspArgTyrSerHisThrAspLeuSerAspPheGlnAlaAsnValAspGlySerLysLysIleValAspLeuPheArgProLeuIleGluThrLysAsnLysAla
LeuLeuGluLysThrAspThrAsnPheLysGlnValAsnGluIleLeuAlaLysTyrArgThrLysAspGlyPheGluThrTyrAspLysLeuGlyGluAlaAspArgLysAlaLeuGlnAla
SerIleAsnAlaLeuAlaGluAspLeuAlaGlnLeuArgGlyIleLeuGlyLeuLys-388
Hydrophilic Regions - Hopp-Woods (SEQ. ID. NO. 24263)
1-MetArgLysPheAsnLeuThrAlaLeuSerValMetLeuAlaLeuGlyLeuThrAlaCysGlnProProGluAlaGluLysAlaAlaProAlaAlaSerGlyGluAlaGlnThrAlaAsnGlu
GlyGlySerValSerIleAlaValAsnAspAsnAlaCysGluProMetGluLeuThrValProSerGlyGlnValValPheAsnIleLysAsnAsnSerGlyArgLysLeuGluTrpGluIle
LeuLysGlyValMetValValAspGluArgGluAsnIleAlaProGlyLeuSerAspLysMetThrValThrLeuLeuProGlyGluTyrGluMetThrCysGlyLeuLeuThrAsnProArg
GlyLysLeuValValThrAspSerGlyPheLysAspThrAlaAsnGluAlaAspLeuGluLysLeuSerGlnProLeuAlaAspTyrLysAlaTyrValGlnGlyGluValLysGluLeuVal
AlaLysThrLysThrPheThrGluAlaValLysAlaGlyAspIleGluLysAlaLysSerLeuPheAlaAspThrArgValHisTyrGluArgIleGluProIleAlaGluLeuPheSerGlu
LeuAspProValIleAspAlaArgGluAspAspPheLysAspGlyAlaLysAspAlaGlyPheThrGlyPheHisArgIleGluTyrAlaLeuTrpValGluLysAspValSerGlyValLys
GluIleAlaAlaLysLeuMetThrAspValGluAlaLeuGlnLysGluIleAspAlaLeuAlaPheProProGlyLysValValGlyGlyAlaSerGluLeuIleGluGluValAlaGlySer
LysIleSerGlyGluGluAspArgTyrSerHisThrAspLeuSerAspPheGlnAlaAsnValAspGlySerLysLysIleValAspLeuPheArgProLeuIleGluThrLysAsnLysAla
LeuLeuGluLysThrAspThrAsnPheLysGlnValAsnGluIleLeuAlaLysTyrArgThrLysAspGlyPheGluThrTyrAspLysLeuGlyGluAlaAspArgLysAlaLeuGlnAla
SerIleAsnAlaLeuAlaGluAspLeuAlaGlnLeuArgGlyIleLeuGlyLeuLys-388
a750
AMPHI Regions - AMPHI
SEQ. ID. NO. 24264 1-ValLysProArgPheTyrTrpAlaAlaCysAlaValLeuLeuThrAlaCysSerProGluProAlaAlaGluLysThrValSerAlaAlaSerAla
SerAlaAlaThrLeuThrValProThrAlaArgGlyAspAlaValValProLysAsnProGluArgValAlaValTyrAspTrpAla
AlaLeuAspThrLeuThrGluLeuGlyValAsnValGlyAlaThrThrAlaProValArgValAspTyrLeuGln
ProAlaPheAspLysAlaAlaThrValGlyThrLeuPheGluProAspTyrGlu
AlaLeuHisArgTyrAsnProGlnLeuValIleThrGlyGlyProGlyAlaGlu
AlaTyrGluGlnLeuAlaLysAsnAlaThrThrIleAspLeuThrValAlaAspAsn
GlyAsnIleArgThrSerGlyGluLysGlnMetGluThrLeuAlaArgIlePhe
GlyLysGluAlaArgAlaAlaGluLeuLysAlaGlnIleAspAlaLeuPheAla
GlnThrArgGluAlaAlaLysGlyLysGlyArgGlyLeuValLeuSerValThr
GlyAsnLysValSerAlaPheGlyThrGlnSerArgLeuAlaSerTrpIleHis
GlyAspIleGlyLeuProProValAspGluSerLeuArgAsnGluGlyHisGly
GlnProValSerPheGluTyrIleLysGluLysAsnProAspTrpIlePheIle
IleAspArgThrAlaAlaIleGlyGlnGluGlyProAlaAlaValGluValLeu
AspAsnAlaLeuValArgGlyThrAsnAlaTrpLysArgLysGlnIleIleVal
MetProAlaAlaAsnTyrIleValAlaGlyGlySerArgGlnLeuIleGlnAla
AlaGluGlnLeuLysGluAlaPheGluLysAlaGluProValAlaAlaGlyLysGlu-321
Antigenic Index - Jameson-Wolf (SEQ. ID. NO. 24264)
1-ValLysProArgPheTyrTrpAlaAlaCysAlaValLeuLeuThrAlaCysSerProGluProAlaAlaGluLys
ThrValSerAlaAlaSerAlaAlaThrLeuThrValProThrAlaArgGlyAspAlaValValProLys
AsnProGluArgValAlaValTyrAspTrpAlaAlaLeuAspThrLeuThrGluLeuGlyValAsnValGlyAlaThr
ThrAlaProValArgValAspTyrLeuGlnProAlaPheAspLysAlaAlaThrValGlyThrLeuPheGluPro
AspTyrGluAlaLeuHisArgTyrAsnProGlnLeuValIleThrGlyGlyProGlyAlaGluAlaTyrGluGln
LeuAlaLysAsnAlaThrThrIleAspLeuThrValAlaAspAsnGlyAsnIleArgThrSerGlyGluLysGlnMetGlu
ThrLeuAlaArgIlePheGlyLysGluAlaArgAlaAlaGluLeuLysAlaGlnIleAspAlaLeuPheAlaGln
ThrArgGluAlaAlaLysGlyLysGlyArgGlyLeuValLeuSerValThrGlyAsnLysValSerAlaPheGly
ThrGlnSerArgLeuAlaSerTrpIleHisGlyAspIleGlyLeuProProValAspGluSerLeuArgAsnGluGly
HisGlyGlnProValSerPheGluTyrIleLysGluLysAsnProAspTrpIlePheIleIleAspArgThrAla
AlaIleGlyGlnGluGlyProAlaAlaValGluValLeuAspAsnAlaLeuValArgGlyThrAsnAlaTrpLys
ArgLysGlnIleIleValMetProAlaA-
laAsnTyrIleValAlaGlyGlySerArgGlnLeuIleGlnAlaAlaGluGlnLeuLysGluAlaPheGluLysAlaGluProValAlaAlaGlyLysGlu-321
Hydrophilic Regions - Hopp-Woods (SEQ. ID. NO. 24264)
1-ValLysProArgPheTyrTrpAlaAlaCysAlaValLeuLeuThrAlaCysSerProGluProAlaAlaGluLys
ThrValSerAlaAlaSerAlaAlaThrLeuThrValProThrAlaArgGlyAspAlaValValProLys
AsnProGluArgValAlaValTyrAspTrpAlaAlaLeuAspThrLeuThrGluLeuGlyValAsnValGlyAlaThr
ThrAlaProValArgValAspTyrLeuGlnProAlaPheAspLysAlaAlaThrValGlyThrLeuPheGluPro
AspTyrGluAlaLeuHisArgTyrAsnProGlnLeuValIleThrGlyGlyProGlyAlaGluAlaTyrGluGln
LeuAlaLysAsnAlaThrThrIleAspLeuThrValAspAsnGlyAsnIleArgThrSerGlyGluLysGlnMetGlu
ThrLeuAlaArgIlePheGlyLysGluAlaArgAlaAlaGluLeuLysAlaGlnIleAspAlaLeuPheAlaGln
ThrArgGluAlaAlaLysGlyLysGlyArgGlyLeuValLeuSerValThrGlyAsnLysValSerAlaPheGly
ThrGlnSerArgLeuAlaSerTrpIleHisGlyAspIleGlyLeuProProValAspGluSerLeuArgAsnGluGly TABLE 1-continued HisGlyGlnProValSerPheGluTyrIleLysGluLysAsnProAspTrpIlePheIleIleAspArgThrAla
AlaIleGlyGlnGluGlyProAlaAlaValGluValLeuAspAsnAlaLeuValArgGlyThrAsnAlaTrpLys
ArgLysGlnIleIleValMetProAlaA-
laAsnTyrIleValAlaGlyGlySerArgGlnLeuIleGlnAlaAlaGluluGlnLeuLysGluAlaPheGluLysAlaGluProValAlaAlaGlyLysGlu-321
a756
AMPHI Regions - AMPHI
SEQ. ID. NO. 24265    1-MetThrAlaAsnPheAlaGlnThrLeuValGluIleGlnAspSerLeuXxxArgValValSerThrValGlnTyrGlyAspAspAsnLeuLysArg
LeuThrAlaAspLysArgLysGlnTyrGluLeuAsnPheLysIleSerGluGlySerThrArgValGluSerAspPheLysGluThrLeuValArgPheGly
ArgAspMetLeuGlnAspMetProProLysIleArgSerAlaThrLeuValAlaLeuThrThrLeuLeuValGlyGlyAlaLeuGlyTyrGlyTyrLeuGlu
TyrLeuLysGlnValAlaSerGluGlyTyrGlnThrGluArgLeuTyrAsnAlaValAspArgLeuAlaGluSerGlnGluArgIleThrSerAlaIleLeu
LysGlyAlaArgGlyAlaAspPheValGlnIleGlyArgArgSerTyrSerArgGluAspIleSerGluAlaAsnArgArgAlaGluArgValProTyrGly
AlaGluLeuValSerAspGlyAsnPheThrAlaValLeuSerAspIleGlyAsp-186
Antigenic Index - Jameson-Wolf (SEQ. ID. NO. 24265)
1-MetThrAlaAsnPheAlaGlnThrLeuValGluIleGlnAspSerLeuXxxArgValValSerThrValGlnTy
rGlyAspAspAsnLeuLysArgLeuThrAlaAspLysArgLysGlnTyrGluLeuAsnPheLysIleSerGluGly
SerThrArgValGluSerAspPheLysGluThrLeuValArgPheGlyArgAspMetLeuGlnAspMetProProL
ysIleArgSerAlaThrLeuValAlaLeuThrThrLeuLeuValGlyGlyAlaLeuGlyTyrGlyTyrLeuGluTy
rLeuLysGlnValAlaSerGluGlyTyrGlnThrGluArgLeuTyrAsnAlaValAspArgLeuAlaGluSerGln
GluArgIleThrSerAlaIleLeuLysGlyAlaArgGlyAlaAspPheValGlnIleGlyArgArgSerTyrSerA
rgGluAspIleSerGluAlaAsnArgArgAlaGluArgValProTyrGlyAlaGluLeuValSerAspGlyAsnPh
eThrAlaValLeuSerAspIleGlyAsp-186
Hydrophilic Regions - Hopp-Woods (SEQ. ID. NO. 24265)
1-MetThrAlaAsnPheAlaGlnThrLeuValGluIleGlnAspSerLeuXxxArgValValSerThrValGlnTy
rGlyAspAspAsnLeuLysArgLeuThrAlaAspLysArgLysGlnTyrGluLeuAsnPheLysIleSerGluGly
SerThrArgValGluSerAspPheLysGluThrLeuValArgPheGlyArgAspMetLeuGlnAspMetProProL
ysIleArgSerAlaThrLeuValAlaLeuThrThrLeuLeuValGlyGlyAlaLeuGlyTyrGlyTyrLeuGluTy
rLeuLysGlnValAlaSerGluGlyTyrGlnThrGluArgLeuTyrAsnAlaValAspArgLeuAlaGluSerGln
GluArgIleThrSerAlaIleLeuLysGlyAlaArgGlyAlaAspPheValGlnIleGlyArgArgSerTyrSerA
rgGluAspIleSerGluAlaAsnArgArgAlaGluArgValProTyrGlyAlaGluLeuValSerAspGlyAsnPh
eThrAlaValLeuSerAspIleGlyAsp-186
a758
AMPHI Regions - AMPHI
SEQ. ID. NO. 24266    1-MetAsnAsnLeuThrValPheThrArgPheAspThrAspLeuAlaThrLeuAlaAspGluLeuGlnTyrValTrpGluHisThrAlaValThr
AspHisGlnGlyLysLeuValGluIleProValCysTyrGlyGlyGluTyrGlyProAspLeuAlaGluValAlaAlaPheHisGlnThrValIleSerGlu
IleValArgArgHisThrAlaGlnThrTyrThrValPheMetMetGlyPheGlnProGlyPheProTyrLeuGlyGlyLeuProGluAlaLeuHisThrPro
ArgArgAlaValProArgThrSerValProAlaGlySerValGlyIleGlyGlySerGlnThrGlyValTyrProPheAlaSerProGlyGlyTrpGlnIle
IleGlyArgThrGluLeuProLeuPheArgAlaAspLeuAsnProProThrLeuLeuAlaAlaGlyAspGlnValArgPheValAlaGluArgIleGlu
Pro-167
Antigenic Index - Jameson-Wolf (SEQ. ID. NO. 24266)
1-MetAsnAsnLeuThrValPheThrArgPheAspThrAspLeuAlaThrLeuAlaAspGluLeuGlnTyrValTr
pGluHisThrAlaValThrAspHisGlnGlyLysLeuValGluIleProValCysTyrGlyGlyGluTyrGlyPro
AspLeuAlaGluValAlaAlaPheHisGlnThrValIleSerGluIleValArgArgHisThrAlaGlnThrTyrT
hrValPheMetMetGlyPheGlnProGlyPheProTyrLeuGlyGlyLeuProGluAlaLeuHisThrProArgAr
gAlaValProArgThrSerValProAlaGlySerValGlyIleGlyGlySerGlnThrGlyValTyrProPheAla
SerProGlyGlyTrpGlnIleIleGlyArgThrGluLeuProLeuPheArgAlaAspLeuAsnProProThrLeuL
euAlaAlaGlyAspGlnValArgPheValAlaGluArgIleGluPro-167
Hydrophilic Regions - Hopp-Woods (SEQ. ID. NO. 24266)
1-MetAsnAsnLeuThrValPheThrArgPheAspThrAspLeuAlaThrLeuAlaAspGluLeuGlnTyrValTr
pGluHisThrAlaValThrAspHisGlnGlyLysLeuValGluIleProValCysTyrGlyGlyGluTyrGlyPro
AspLeuAlaGluValAlaAlaPheHisGlnThrValIleSerGluIleValArgArgHisThrAlaGlnThrTyrT
hrValPheMetMetGlyPheGlnProGlyPheProTyrLeuGlyGlyLeuProGluAlaLeuHisThrProArgAr
gAlaValProArgThrSerValProAlaGlySerValGlyIleGlyGlySerGlnThrGlyValTyrProPheAla
SerProGlyGlyTrpGlnIleIleGlyArgThrGluLeuProLeuPheArgAlaAspLeuAsnProProThrLeuL
euAlaAlaGlyAspGlnValArgPheValAlaGluArgIleGluPro-167
a761
AMPHI Regions - AMPHI
SEQ. ID. NO. 24267    1-MetLysIleSerPheHisLeuAlaLeuLeuProThrLeuIleIleAlaSe
rPheProValAlaAlaAlaAspThrGlnAspAsnGlyGluHisTyrThrAlaThrLeuProThrValSerValValGlyGlnSerAspThrSerValLeuLysG
lyTyrIleAsnTyrAspGluAlaAlaValThrArgAsnGlyGlnLeuIleLysGluThrProGlnThrIleAspThrLeuAsnIleGlnLysAsnLysAsnTyr
GlyThrAsnAspLeuSerSerIleLeuGluGlyAsnAlaGlyIleAspAlaAlaTyrAspMetArgGlyGluSerIlePheLeuArgGlyPheGlnAlaAspAl
aSerAspIleTyrArgAspGlyValArgGluSerGlyGlnValArgArgSerThrAlaAsnIleGluArgValGluIleLeuLysGlyProSerSerValLeuT
yrGlyArgThrArgAsnGlyGlyGlyValIleAsnMetValSerLysTyrAlaAsnPheLysGlnSerArgAsnIleGlyThrValTyrGlySerTrpAlaAsnArg
SerLeuAsnMetAspIleAsnGluValLeuAsnLysAsnValAlaIleArgLeuThrGlyGluValGlyArgAlaAsnSerPheArgSerGlyIleAspSerLy
sAsnValMetValSerProSerIleThrValLysLeuAspAsnGlyLeuLysTrpThrGlyGlnTyrThrTyrAspAsnValGluArgThrProAspArgSerP
roThrLysSerValTyrAspArgPheGlyLeuProTyrArgMetGlyPheAlaHisArgAsnAspPheValLysAspLysLeuGlnValTrpArgSerAspLeu
GluTyrAlaPheAsnAspLysTrpArgAlaGlnTrpGlnLeuAlaHisArgThrAlaGlnAlaAspPheAspHisPheTyrAlaGlySerGluAsnGlyAsnLe
uIleLysArgAsnTyrAlaTrpGlnGlnThrAspAsnLysThrLeuSerSerAsnLeuThrLeuAsnGlyAspTyrThrIleGlyArgPheGluAsnHisLeuT
hrValGlyMetAspTyrSerArgGluHisArgAsnProThrLeuGlyPheSerSerAlaPheSerAlaSerIleAsnProTyrAspArgAlaSerTrpProAla
SerGlyArgLeuGlnProIleLeuThrGlnAsnArgHisLysAlaAspSerTyrGlyIlePheValGlnAsnIlePheSerAlaThrProAspLeuLysPheVa
lLeuGlyGlyArgTyrAspLysTyrThrPheAsnSerGluAsnLysLeuThrGlySerSerArgGlnTyrSerGlyHisSerPheSerProAsnIleGlyAlaV
alTrpAsnIleAsnProValHisThrLeuTyrAlaSerTyrAsnLysGlyPheAlaProTyrGlyGlyArgGlyGlyTyrLeuSerIleAspThrLeuSerSer
AlaValPheAsnAlaAspProGluTyrThrArgGlnTyrGluThrGlyValLysSerSerTrpLeuAspAspArgLeuSerThrThrLeuSerAlaTyrGlnIl
eGluArgPheAsnIleArgTyrArgProAspProLysAsnAsnProTyrIleTyrAlaValSerGlyLysHisArgSerArgGlyValGluLeuSerAlaIleG
lyGlnIleIleProLysLysLeuTyrLeuArgGlySerLeuGlyValMetGlnAlaLysValValGluAspLysGluAsnProAspArgValGlyIleHisLeu
AsnAsnThrSerAsnValThrGlyAsnLeuPhePheArgTyrThrProThrGluAsnLeuTyrGlyGluIleGlyValThrGlyTyrGlyLysArgTyrGlyTy
rAspSerArgAsnLysGluValThrThrLeuProGlyPheAlaArgValAspAlaMetLeuGlyTrpAsnHisLysAsnValAsnValThrPheAlaAlaAlaA
snLeuPheAsnGlnLysTyrTrpArgSerAspSerMetProGlyAsnProArgGlyTyrThrAlaArgValAsnTyrArgPhe-703
Antigenic Index - Jameson-Wolf (SEQ. ID. NO. 24267)
1-MetLysIleSerPheHisLeuAlaLeuLeuProThrLeuIleIleAlaSerPheProValAlaAlaAlaAspTh
rGlnAspAsnGlyGluHisTyrThrAlaThrLeuProThrValSerValValGlyGlnSerAspThrSerValLeu TABLE 1-continued LysGlyTyrIleAsnTyrAspGluAlaAlaValThrArgAsnGlyGlnLeuIleLysGluThrProGlnThrIleA
spThrLeuAsnIleGlnLysAsnLysAsnTyrGlyThrAsnAspLeuSerSerIleLeuGluGlyAsnAlaGlyIl
eAspAlaAlaTyrAspMetArgGlyGluSerIlePheLeuArgGlyPheGlnAlaAspAlaSerAspIleTyrArg
AspGlyValArgGluSerGlyGlnValArgArgSerThrAlaAsnIleGluArgValGluIleLeuLysGlyProS
erSerValLeuTyrGlyArgThrAsnGlyGlyGlyValIleAsnMetValSerLysTyrAlaAsnPheLysGlnSe
rArgAsnIleGlyThrValTyrGlySerTrpAlaAsnArgSerLeuAsnMetAspIleAsnGluValLeuAsnLys
AsnValAlaIleArgLeuThrGlyGluValGlyArgAlaAsnSerPheArgSerGlyIleAspSerLysAsnValM
etValSerProSerIleThrValLysLeuAspAsnGlyLeuLysTrpThrGlyGlnTyrThrTyrAspAsnValGl
uArgThrProAspArgSerProThrLysSerValTyrAspArgPheGlyLeuProTyrArgMetGlyPheAlaHis
ArgAsnAspPheValLysAspLysLeuGlnValTrpArgSerAspLeuGluTyrAlaPheAsnAspLysTrpArgA
laGlnTrpGlnLeuAlaHisArgThrAlaAlaGlnAspPheAspHisPheTyrAlaGlySerGluAsnGlyAsnLe
uIleLysArgAsnTyrAlaTrpGlnGlnThrAspAsnLysThrLeuSerSerAsnLeuThrLeuAsnGlyAspTyr
ThrIleGlyArgPheGluAsnHisLeuThrValGlyMetAspTyrSerArgGluHisArgAsnProThrLeuGlyP
heSerSerAlaPheSerAlaSerIleAsnProTyrAspArgAlaSerTrpProAlaSerGlyArgLeuGlnProIl
eLeuThrGlnAsnArgHisLysAlaAspSerTyrGlyIlePheValGlnAsnIlePheSerAlaThrProAspLeu
LysPheValLeuGlyGlyArgTyrAspLysTyrThrPheAsnSerGluAsnLysLeuThrGlySerSerArgGlnT
yrSerGlyHisSerPheSerProAsnIleGlyAlaValTrpAsnIleAsnProValHisThrLeuTyrAlaSerTy
rAsnLysGlyPheAlaProTyrGlyGlyArgGlyGlyTyrLeuSerIleAspThrLeuSerSerAlaValPheAsn
AlaAspProGluTyrThrArgGlnTyrGluThrGlyValLysSerSerTrpLeuAspAspArgLeuSerThrThrL
euSerAlaTyrGlnIleGluArgPheAsnIleArgTyrArgProAspProLysAsnAsnProTyrIleTyrAlaVa
lSerGlyLysHisArgSerArgGlyValGluLeuSerAlaIleGlyGlnIleIleProLysLysLeuTyrLeuArg
GlySerLeuGlyValMetGlnAlaLysValValGluAspLysGluAsnProAspArgValGlyIleHisLeuAsnA
snThrSerAsnValThrGlyAsnLeuPhePheArgTyrThrProThrGluAsnLeuTyrGlyGluIleGlyValTh
rGlyThrGlyLysArgTyrGlyTyrAspSerArgAsnLysGluValThrThrLeuProGlyPheAlaArgValAsp
AlaMetLeuGlyTrpAsnHisLysAsnValAsnValThrPheAlaAlaAlaAsnLeuPheAsnGlnLysTyrTrpA
rgSerAspSerMetProGlyAsnProArgGlyTyrThrAlaArgValAsnTyrArgPhe-703
Hydrophilic Regions - Hopp-Woods (SEQ. ID. NO. 24267)
1-MetLysIleSerPheHisLeuAlaLeuLeuProThrLeuIleIleAlaSerPheProValAlaAlaAlaAspTh
rGlnAspAsnGlyGluHisTyrThrAlaThrLeuProThrValSerValValGlyGlnSerAspThrSerValLeu
LysGlyTyrIleAsnTyrAspGluAlaAlaValThrArgAsnGlyGlnLeuIleLysGluThrProGlnThrIleA
spThrLeuAsnIleGlnLysAsnLysAsnTyrGlyThrAsnAspLeuSerSerIleLeuGluGlyAsnAlaGlyIl
eAspAlaAlaTyrAspMetArgGlyGluSerIlePheLeuArgGlyPheGlnAlaAspAlaSerAspIleTyrArg
AspGlyValArgGluSerGlyGlnValArgArgSerThrAlaAsnIleGluArgValGluIleLeuLysGlyProS
erSerValLeuTyrGlyArgThrAsnGlyGlyGlyValIleAsnMetValSerLysTyrAlaAsnPheLysGlnSe
rArgAsnIleGlyThrValTyrGlySerTrpAlaAsnArgSerLeuAsnMetAspIleAsnGluValLeuAsnLys
AsnValAlaIleArgLeuThrGlyGluValGlyArgAlaAsnSerPheArgSerGlyIleAspSerLysAsnValM
etValSerProSerIleThrValLysLeuAspAsnGlyLeuLysTrpThrGlyGlnTyrThrTyrAspAsnValGl
uArgThrProAspArgSerProThrLysSerValTyrAspArgPheGlyLeuProTyrArgMetGlyPheAlaHis
ArgAsnAspPheValLysAspLysLeuGlnValTrpArgSerAspLeuGluTyrAlaPheAsnAspLysTrpArgA
laGlnTrpGlnLeuAlaHisArgThrAlaAlaGlnAspPheAspHisPheTyrAlaGlySerGluAsnGlyAsnLe
uIleLysArgAsnTyrAlaTrpGlnGlnThrAspAsnLysThrLeuSerSerAsnLeuThrLeuAsnGlyAspTyr
ThrIleGlyArgPheGluAsnHisLeuThrValGlyMetAspTyrSerArgGluHisArgAsnProThrLeuGlyP
heSerSerAlaPheSerAlaSerIleAsnProTyrAspArgAlaSerTrpProAlaSerGlyArgLeuGlnProIl
eLeuThrGlnAsnArgHisLysAlaAspSerTyrGlyIlePheValGlnAsnIlePheSerAlaThrProAspLeu
LysPheValLeuGlyGlyArgTyrAspLysTyrThrPheAsnSerGluAsnLysLeuThrGlySerSerArgGlnT
yrSerGlyHisSerPheSerProAsnIleGlyAlaValTrpAsnIleAsnProValHisThrLeuTyrAlaSerTy
rAsnLysGlyPheAlaProTyrGlyGlyArgGlyGlyTyrLeuSerIleAspThrLeuSerSerAlaValPheAsn
AlaAspProGluTyrThrArgGlnTyrGluThrGlyValLysSerSerTrpLeuAspAspArgLeuSerThrThrL
euSerAlaTyrGlnIleGluArgPheAsnIleArgTyrArgProAspProLysAsnAsnProTyrIleTyrAlaVa
lSerGlyLysHisArgSerArgGlyValGluLeuSerAlaIleGlyGlnIleIleProLysLysLeuTyrLeuArg
GlySerLeuGlyValMetGlnAlaLysValValGluAspLysGluAsnProAspArgValGlyIleHisLeuAsnA
snThrSerAsnValThrGlyAsnLeuPhePheArgTyrThrProThrGluAsnLeuTyrGlyGluIleGlyValTh
rGlyThrGlyLysArgTyrGlyTyrAspSerArgAsnLysGluValThrThrLeuProGlyPheAlaArgValAsp
AlaMetLeuGlyTrpAsnHisLysAsnValAsnValThrPheAlaAlaAlaAsnLeuPheAsnGlnLysTyrTrpA
rgSerAspSerMetProGlyAsnProArgGlyTyrThrAlaArgValAsnTyrArgPhe-703
a762
AMPHI Regions - AMPHI
SEQ. ID. NO. 24268    1-MetLysTrpLeuLeuAsnMetIleMetArgProIleLysPheSerMetVa
lAsnThrLeuLeuPheIleValIleCysSerSerPhePheAspLeuLeuValGlnLeuCysThrIleLeuPheHisSerGlnLysIleTyrPheIleThrLeuP
heLeuLeuPheIlePheAsnPheValThrLysSerIleTyrMetAlaIleIleTyrProIleLeuTyrPhePheThrIleLysLysTyrTyrProTyrSerArg
LysValIleIleLeuLeuSerLeuAlaLeuSerIleTyrPheSerPheMetAspPheTyrPhePheSerIleTyrSerAspAsnLeuSerTyrGluThrGluPr
oLeuHisLeuTyrIleProIleIleIleAsnPhePheSerLeuLeuValSerAsnPheIleLeuSerPheIleAsnLys-147
Antigenic Index - Jameson-Wolf (SEQ. ID. NO. 24268)
1-MetLysTrpLeuLeuAsnMetIleMetArgProIleLysPheSerMetValAsnThrLeuLeuPheIleValIl
eCysSerSerPhePheAspLeuLeuValGlnLeuCysThrIleLeuPheHisSerGlnLysIleTyrPheIleThr
LeuPheLeuLeuPheIlePheAsnPheValThrLysSerIleTyrMetAlaIleIleTyrProIleLeuTyrPheP
heThrIleLysLysTyrTyrProTyrSerArgLysValIleIleLeuLeuSerLeuAlaLeuSerIleTyrPheSe
rPheMetAspPheTyrPhePheSerIleTyrSerAspAsnLeuSerTyrGluThrGluProLeuHisLeuTyrIle
ProIleIleIleAsnPhePheSerLeuLeuValSerAsnPheIleLeuSerPheIleAsnLys-147
Hydrophilic Regions - Hopp-Woods (SEQ. ID. NO. 24268)
1-MetLysTrpLeuLeuAsnMetIleMetArgProIleLysPheSerMetValAsnThrLeuLeuPheIleValIl
eCysSerSerPhePheAspLeuLeuValGlnLeuCysThrIleLeuPheHisSerGlnLysIleTyrPheIleThr
LeuPheLeuLeuPheIlePheAsnPheValThrLysSerIleTyrMetAlaIleIleTyrProIleLeuTyrPheP
heThrIleLysLysTyrTyrProTyrSerArgLysValIleIleLeuLeuSerLeuAlaLeuSerIleTyrPheSe
rPheMetAspPheTyrPhePheSerIleTyrSerAspAsnLeuSerTyrGluThrGluProLeuHisLeuTyrIle
ProIleIleIleAsnPhePheSerLeuLeuValSerAsnPheIleLeuSerPheIleAsnLys-147
a763
AMPHI Regions - AMPHI
SEQ. ID. NO. 24269    1-MetThrLeuLeuAsnLeuMetIleMetGlnAspTyrGlyIleSerValCy
sLeuThrLeuThrProTyrLeuGlnHisGluLeuPheSerAlaMetLysSerTyrPheSerLysTyrIleLeuProValSerLeuPheThrLeuProLeuSerL TABLE 1-continued euSerProSerValSerAlaPheThrLeuProGluAlaTrpArgAlaAlaGlnGlnHisSerAlaAspPheGlnAlaSerHisTyrGlnArgAspAlaValArg
AlaArgGlnGlnGlnAlaLysAlaAlaPheLeuProHisValSerAlaAsnAlaSerTyrGlnArgGlnProProSerIleSerSerThrArgGluThrGlnGl
yTrpSerValGlnValGlyGlnThrLeuPheAspAlaAlaLysPheAlaGlnTyrArgGlnSerArgPheAspThrGlnAlaAlaGluGlnArgPheAspAlaA
laArgGluGluLeuLeuLeuLysValAlaGluSerTyrPheAsnValLeuLeuSerArgAspThrValAlaAlaHisAlaAlaGluLysGluAlaTyrAlaGln
GlnValArgGlnAlaGlnAlaLeuPheAsnLysGlyAlaAlaThrAlaLeuAspIleHisGluAlaLysAlaGlyTyrAspAsnAlaLeuAlaGlnGluIleAl
aValLeuAlaGluLysGlnThrTyrGluAsnGlnLeuAsnAspTyrThrGlyLeuAspSerLysGlnIleGluAlaIleAspThrAlaAsnLeuLeuAlaArgT
yrLeuProLysLeuGluArgTyrSerLeuAspGluTrpGlnArgIleAlaLeuSerAsnAsnHisGluTyrArgMetGlnGlnLeuAlaLeuGlnSerSerGly
GlnAlaLeuArgAlaAlaGlnAsnSerArgTyrProThrValSerAlaHisValGlyTyrGlnAsnAsnLeuTyrThrSerSerAlaGlnAsnAsnAspTyrHi
sTyrArgGlyLysGlyMetSerValGlyValGlnLeuAsnLeuProLeuTyrThrGlyGlyGluLeuSerGlyLysIleHisGluAlaGluAlaGlnTyrGlyA
laAlaGluAlaGlnLeuThrAlaThrGluArgHisIleLysLeuAlaValArgGlnAlaTyrThrGluSerGlyAlaAlaArgTyrGlnIleMetAlaGlnGlu
ArgValLeuGluSerSerArgLeuLysLeuLysSerThrGluThrGlyGlnGlnTyrGlyIleArgAsnArgLeuGluValIleArgAlaArgGlnGluValAl
aGlnAlaGluGlnLysLeuAlaGlnAlaArgTyrLysPheMetLeuAlaTyrLeuArgLeuValLysGluSerGlyLeuGlyLeuGluThrValPheAlaGlu-
467

Antigenic Index - Jameson-Wolf (SEQ. ID. NO. 24269)
1-MetThrLeuLeuAsnLeuMetIleMetGlnAspTyrGlyIleSerValCysLeuThrLeuThrProTyrLeuGl
nHisGluLeuPheSerAlaMetLysSerTyrPheSerLysTyrIleLeuProValSerLeuPheThrLeuProLeu
SerLeuSerProSerValSerAlaPheThrLeuProGluAlaTrpArgAlaAlaGlnGlnHisSerAlaAspPheG
lnAlaSerHisTyrGlnArgAspAlaValArgAlaArgGlnGlnGlnAlaLysAlaAlaPheLeuProHisValSe
rAlaAsnAlaSerTyrGlnArgGlnProProSerIleSerSerThrArgGluThrGlnGlyTrpSerValGlnVal
GlyGlnThrLeuPheAspAlaAlaLysPheAlaGlnTyrArgGlnSerArgPheAspThrGlnAlaAlaGluGlnA
rgPheAspAlaAlaArgGluGluLeuLeuLeuLysValAlaGluSerTyrPheAsnValLeuLeuSerArgAspTh
rValAlaAlaHisAlaAlaGluLysGluAlaTyrAlaGlnGlnValArgGlnAlaGlnAlaLeuPheAsnLysGly
AlaAlaThrAlaLeuAspIleHisGluAlaLysAlaGlyTyrAspAsnAlaLeuAlaGlnGluIleAlaValLeuA
laGluLysGlnThrTyrGluAsnGlnLeuAsnAspTyrThrGlyLeuAspSerLysGlnIleGluAlaIleAspTh
rAlaAsnLeuLeuAlaArgTyrLeuProLysLeuGluArgTyrSerLeuAspGluTrpGlnArgIleAlaLeuSer
AsnAsnHisGluTyrArgMetGlnGlnLeuAlaLeuGlnSerSerGlyGlnAlaLeuArgAlaAlaGlnAsnSerA
rgTyrProThrValSerAlaHisValGlyTyrGlnAsnAsnLeuTyrThrSerSerAlaGlnAsnAsnAspTyrHi
sTyrArgGlyLysGlyMetSerValGlyValGlnLeuAsnLeuProLeuTyrThrGlyGlyGluLeuSerGlyLys
IleHisGluAlaGluAlaGlnTyrGlyAlaAlaGluAlaGlnLeuThrAlaThrGluArgHisIleLysLeuAlaV
alArgGlnAlaTyrThrGluSerGlyAlaAlaArgTyrGlnIleMetAlaGlnGluArgValLeuGluSerSerAr
gLeuLysLeuLysSerThrGluThrGlyGlnGlnTyrGlyIleArgAsnArgLeuGluValIleArgAlaArgGln
GluValAlaGlnAlaGluGlnLysLeuAlaGlnAlaArgTyrLysPheMetLeuAlaTyrLeuArgLeuValLysG
luSerGlyLeuGlyLeuGluThrValPheAlaGlu-467

Hydrophilic Regions - Hopp-Woods (SEQ. ID. NO. 24269)
1-MetThrLeuLeuAsnLeuMetIleMetGlnAspTyrGlyIleSerValCysLeuThrLeuThrProTyrLeuGl
nHisGluLeuPheSerAlaMetLysSerTyrPheSerLysTyrIleLeuProValSerLeuPheThrLeuProLeu
SerLeuSerProSerValSerAlaPheThrLeuProGluAlaTrpArgAlaAlaGlnGlnHisSerAlaAspPheG
lnAlaSerHisTyrGlnArgAspAlaValArgAlaArgGlnGlnGlnAlaLysAlaAlaPheLeuProHisValSe
rAlaAsnAlaSerTyrGlnArgGlnProProSerIleSerSerThrArgGluThrGlnGlyTrpSerValGlnVal
GlyGlnThrLeuPheAspAlaAlaLysPheAlaGlnTyrArgGlnSerArgPheAspThrGlnAlaAlaGluGlnA
rgPheAspAlaAlaArgGluGluLeuLeuLeuLysValAlaGluSerTyrPheAsnValLeuLeuSerArgAspTh
rValAlaAlaHisAlaAlaGluLysGluAlaTyrAlaGlnGlnValArgGlnAlaGlnAlaLeuPheAsnLysGly
AlaAlaThrAlaLeuAspIleHisGluAlaLysAlaGlyTyrAspAsnAlaLeuAlaGlnGluIleAlaValLeuA
laGluLysGlnThrTyrGluAsnGlnLeuAsnAspTyrThrGlyLeuAspSerLysGlnIleGluAlaIleAspTh
rAlaAsnLeuLeuAlaArgTyrLeuProLysLeuGluArgTyrSerLeuAspGluTrpGlnArgIleAlaLeuSer
AsnAsnHisGluTyrArgMetGlnGlnLeuAlaLeuGlnSerSerGlyGlnAlaLeuArgAlaAlaGlnAsnSerA
rgTyrProThrValSerAlaHisValGlyTyrGlnAsnAsnLeuTyrThrSerSerAlaGlnAsnAsnAspTyrHi
sTyrArgGlyLysGlyMetSerValGlyValGlnLeuAsnLeuProLeuTyrThrGlyGlyGluLeuSerGlyLys
IleHisGluAlaGluAlaGlnTyrGlyAlaAlaGluAlaGlnLeuThrAlaThrGluArgHisIleLysLeuAlaV
alArgGlnAlaTyrThrGluSerGlyAlaAlaArgTyrGlnIleMetAlaGlnGluArgValLeuGluSerSerAr
gLeuLysLeuLysSerThrGluThrGlyGlnGlnTyrGlyIleArgAsnArgLeuGluValIleArgAlaArgGln
GluValAlaGlnAlaGluGlnLysLeuAlaGlnAlaArgTyrLysPheMetLeuAlaTyrLeuArgLeuValLysG
luSerGlyLeuGlyLeuGluThrValPheAlaGlu-467
a764

AMPHI Regions - AMPHI
SEQ. ID. NO. 24270     1-MetPhePheSerAlaLeuLysSerPheLeuSerArgTyrIleThrValTr
pArgAsnValTrpAlaValArgAspGlnLeuGluProProLysArgThrAlaGluGluGlnAlaPheLeuProAlaHisLeuGluLeuThrAspThrProValS
erAlaAlaProLysTrpAlaAlaArgPheIleMetAlaPheAlaLeuLeuAlaLeuLeuTrpSerTrpPheGlyLysIleAspIleValAlaAlaAlaSerGly
LysThrValSerGlyGlyArgSerLysThrIleGlnProLeuGluThrValValValLysAlaValHisValArgAspGlyGlnHisValLysGlnGlyGluTh
rLeuAlaGluLeuGluAlaValGlyThrAspSerAspValValGlnSerGluGlnAlaLeuGlnAlaAlaGlnLeuSerLysLeuArgTyrGluAlaValLeuA
laAlaLeuGluSerArgThrValProHisIleAspMetAlaGlnAlaArgSerLeuGlyLeuSerAspAlaAspValGlnSerAlaGlnValLeuAlaGlnHis
GlnTyrGlnAlaTrpAlaAlaGlnAspAlaGlnLeuGlnSerAlaLeuArgGlyHisGlnAlaGluLeuGlnSerAlaLysAlaGlnGluGlnLysLeuValSe
rValGlyAlaIleGluGlnGlnLysThrAlaAspTyrArgArgLeuArgAlaAspAsnPheIleSerGluHisAlaPheLeuGluGlnGlnSerLysSerValS
erAsnTrpAsnAspLeuGluSerThrArgGlyGlnMetArgGlnIleGlnAlaAlaIleAlaGlnAlaGluGlnAsnArgValLeuAsnThrGlnAsnLeuLys
ArgAspThrLeuAspAlaLeuArgGlnAlaAsnGluGlnIleAspGlnTyrArgGlyGlnThrAspLysAlaLysGlnArgGlnGlnLeuMetThrIleGlnSe
rProAlaAspGlyThrValGlnGluLeuAlaThrTyrThrValGlyGlyValValGlnAlaAlaGlnLysMetMetValValAlaProAspAspAspLysMetA
spValGluValLeuValLeuAsnLysAspIleGlyPheValGluGlnGlyGlnAspAlaValValLysIleGluSerPheProTyrThrArgTyrGlyTyrLeu
ThrGlyLysValSerValSerHisAspAlaValSerHisGluGlnLeuGlyLeuValTyrThrAlaValValSerLeuAspLysHisThrLeuAsnIleAs
pGlyLys-435

Antigenic Index - Jameson-Wolf (SEQ. ID. NO. 24270)
1-MetPhePheSerAlaLeuLysSerPheLeuSerArgTyrIleThrValTrpArgAsnValTrpAlaValArgAs
pGlnLeuGluProProLysArgThrAlaGluGluGlnAlaPheLeuProAlaHisLeuGluLeuThrAspThrPro
ValSerAlaAlaProLysTrpAlaAlaArgPheIleMetAlaPheAlaLeuLeuAlaLeuLeuTrpSerTrpPheG
lyLysIleAspIleValAlaAlaAlaSerGlyLysThrValSerGlyGlyArgSerLysThrIleGlnProLeuGl
uThrValValValLysAlaValHisValArgAspGlyGlnHisValLysGlnGlyGluThrLeuAlaGluLeuGlu
AlaValGlyThrAspSerAspValValGlnSerGluGlnAlaLeuGlnAlaAlaGlnLeuSerLysLeuArgTyrG
luAlaValLeuAlaAlaLeuGluSerArgThrValProHisIleAspMetAlaGlnAlaArgSerLeuGlyLeuSe
rAspAlaAspValGlnSerAlaGlnValLeuAlaGlnHisGlnTyrGlnAlaTrpAlaAlaGlnAspAlaGlnLeu
GlnSerAlaLeuArgGlyHisGlnAlaGluLeuGlnSerAlaLysAlaGlnGluGlnLysLeuValSerValGlyA
laIleGluGlnGlnLysThrAlaAspTyrArgArgLeuArgAlaAspAsnPheIleSerGluHisAlaPheLeuGl TABLE 1-continued uGlnGlnSerLysSerValSerAsnTrpAsnAspLeuGluSerThrArgGlyGlnMetArgGlnIleGlnAlaAla
IleAlaGlnAlaGluGlnAsnArgValLeuAsnThrGlnAsnLeuLysArgAspThrLeuAspAlaLeuArgGlnA
laAsnGluGlnIleAspGlnTyrArgGlyGlnThrAspLysAlaLysGlnArgGlnGlnLeuMetThrIleGlnSe
rProAlaAspGlyThrValGlnGluLeuAlaThrTyrThrValGlyGlyValValGlnAlaAlaGlnLysMetMet
ValValAlaProAspAspAspLysMetAspValGluValLeuValLeuAsnLysAspIleGlyPheValGluGlnG
lyGlnAspAlaValValLysIleGluSerPheProTyrThrArgTyrGlyTyrLeuThrGlyLysValLysSerVa
1SerHisAspAlaValSerHisGluGlnLeuGlyLeuValTyrThrAlaValValSerLeuAspLysHisThrLeu
AsnIleAspGlyLys-435
Hydrophilic Regions - Hopp-Woods (SEQ. ID. NO. 24270)
1-MetPhePheSerAlaLeuLysSerPheLeuSerArgTyrIleThrValTrpArgAsnValTrpAlaValArgAs
pGlnLeuGluProProLysArgThrAlaGluGluGlnAlaPheLeuProAlaHisLeuGluLeuThrAspThrPro
ValSerAlaAlaProLysTrpAlaAlaArgPheIleMetAlaPheAlaLeuLeuAlaLeuLeuTrpSerTrpPheG
lyLysIleAspIleValAlaAlaAlaSerGlyLysThrValSerGlyGlyArgSerLysThrIleGlnProLeuGl
uThrValValValLysAlaValHisValArgAspGlyGlnHisValLysGlnGlyGluThrLeuAlaGluLeuGlu
AlaValGlyThrAspSerAspValValGlnSerGluGlnAlaLeuGlnAlaAlaGlnLeuSerLysLeuArgTyrG
luAlaValLeuAlaAlaLeuGluSerArgThrValProHisIleAspMetAlaGlnAlaArgSerLeuGlyLeuSe
rAspAlaAspValGlnSerAlaGlnValLeuAlaGlnHisGlnTyrGlnAlaTrpAlaAlaGlnAspAlaGlnLeu
GlnSerAlaLeuArgGlyHisGlnAlaGluLeuGlnSerAlaLysAlaGlnGluGlnLysLeuValSerValGlyA
laIleGluGlnGlnLysThrAlaAspTyrArgArgLeuArgAlaAspAsnPheIleSerGluHisAlaPheLeuGl
uGlnGlnSerLysSerValSerAsnTrpAsnAspLeuGluSerThrArgGlyGlnMetArgGlnIleGlnAlaAla
IleAlaGlnAlaGluGlnAsnArgValLeuAsnThrGlnAsnLeuLysArgAspThrLeuAspAlaLeuArgGlnA
laAsnGluGlnIleAspGlnTyrArgGlyGlnThrAspLysAlaLysGlnArgGlnGlnLeuMetThrIleGlnSe
rProAlaAspGlyThrValGlnGluLeuAlaThrTyrThrValGlyGlyValValGlnAlaAlaGlnLysMetMet
ValValAlaProAspAspAspLysMetAspValGluValLeuValLeuAsnLysAspIleGlyPheValGluGlnG
lyGlnAspAlaValValLysIleGluSerPheProTyrThrArgTyrGlyTyrLeuThrGlyLysValLysSerVa
1SerHisAspAlaValSerHisGluGlnLeuGlyLeuValTyrThrAlaValValSerLeuAspLysHisThrLeu
AsnIleAspGlyLys-435
a765
AMPHI Regions - AMPHI
SEQ. ID. NO. 24271    36-SerAlaIleSerSerPheCys-42
SEQ. ID. NO. 24272    45-LysIleIleHisThrTyr-50
SEQ. ID. NO. 24273    59-ValIleGlyIleIleAsnGly-65
SEQ. ID. NO. 24274    105-ArgPheLeuAsnArgGly-110
SEQ. ID. NO. 24275    147-PheGlyLeuCysTyrPro-152
Antigenic Index - Jameson-Wolf
SEQ. ID. NO. 24276    10-GlyAsnPheLysLysIleAlaThr-17
SEQ. ID. NO. 24277    19-GlnGlyLeuAspArgLysTyr-25
SEQ. ID. NO. 24278    76-ValLysAsnLysGlnLysPheLeu-83
SEQ. ID. NO. 24279    106-PheLeuAsnArgGlyMetLys-112
SEQ. ID. NO. 24280    132-LeuAsnGluGluGlyGlyTrpMet-139
SEQ. ID. NO. 24281    160-LeuSerArgAspTyrLysHisIle-167
Hydrophilic Regions - Hopp-Woods
SEQ. ID. NO. 24282    11-AsnPheLysLysIleAlaThr-17
SEQ. ID. NO. 24283    19-GlnGlyLeuAspArgLys-24
SEQ. ID. NO. 24284    76-ValLysAsnLysGlnLysPheLeu-83
SEQ. ID. NO. 24285    133-AsnGluGluGlyGly-137
SEQ. ID. NO. 24286    162-ArgAspTyrLysHis-166
a767
AMPHI Regions - AMPHI
SEQ. ID. NO. 24287    42-LysIleGluValLeuGluPhePheGlyTyrPheCysVal-54
SEQ. ID. NO. 24288    89-GlyLeuAlaArgMetAlaAlaAlaValLys-98
SEQ. ID. NO. 24289    140-LysLysLeuMetArgAlaTyrAspSerProAlaAla-151
SEQ. ID. NO. 24290    156-SerLysMetGlnGlnLeuThrGluGlnTyrArg-166
SEQ. ID. NO. 24291    187-PheAspGlyGlyValHisThrIleLysGluLeuValAla-199
Antigenic Index - Jameson-Wolf
SEQ. ID. NO. 24292    23-ThrGluGlyGluAspTyrLeuVal-30
SEQ. ID. NO. 24293    33-LysProIleProGlnLysGlnSerGlyLysIleGluVal-45
SEQ. ID. NO. 24294    70-LeuProSerAspAlaTyrLeuArg-77
SEQ. ID. NO. 24295    99-LeuSerGlyLeuLysTyrGlnAla-106
SEQ. ID. NO. 24296    115-TyrGluGlnLysIleArgLeuGluAsnArgSerValAlaGlu-128
SEQ. ID. NO. 24297    130-TrpAlaLeuSerGlnLysGlyPheAspGlyLysLysLeuMetArgAlaTyrAspSerProAla-150
SEQ. ID. NO. 24298    156-SerLysMetGlnGlnLeuThrGluGlnTyrArgIleAspSerThrProThr-172
SEQ. ID. NO. 24299    175-ValGlyGlyLysTyrArgVal-181
SEQ. ID. NO. 24300    183-PheAsnAsnGlyPheAspGlyGly-190
SEQ. ID. NO. 24301    197-LeuValAlaLysValArgGluGluArgLysArgGlnThrProAlaValGlnLys-214
Hydrophilic Regions - Hopp-Woods
SEQ. ID. NO. 24302    23-ThrGluGlyGluAsp-27
SEQ. ID. NO. 24303    33-LysProIleProGlnLysGlnSerGlyLysIleGluVal-45
SEQ. ID. NO. 24304    115-TyrGluGlnLysIleArgLeuGluAsnArgSerValAlaGlu-128
SEQ. ID. NO. 24305    135-LysGlyPheAspGlyLysLysLeuMetArgAlaTyrAsp-147
SEQ. ID. NO. 24306    156-SerLysMetGlnGlnLeu-161
SEQ. ID. NO. 24307    165-TyrArgIleAspSer-169
SEQ. ID. NO. 24308    197-LeuValAlaLysValArgGluGluArgLysArgGlnThrProAlaValGlnLys-214
a768
AMPHI Regions - AMPHI
SEQ. ID. NO. 24309    1-MetAsnIleLysHisLeuIleThrAlaAlaLeuIleAlaSerAlaAlaPheAlaAlaGlnAlaAlaProGlnLysProValSerAlaAlaGln
                      ThrAlaGlnHisSerAlaValTrpIleAspValArgSerGluGlnGluPheSerGluGlyHisLeuHisAsnAlaValAsnIleProValAspGlnIleValArgArg
                      IleHisGluAlaAlaProAspLysAspThrProValAsnLeuTyrCysArgSerGlyArgArgAlaGluAlaAlaLeuGlnGluLeuLysLysAlaGlyTyrThrAsn
                      ValAlaAsnHisGlyGlyTyrGluAspLeuLeuLysLysGlyMetLys TABLE 1-continued Antigenic Index - Jameson-Wolf (SEQ. ID. NO. 24309)
1-MetAsnIleLysHisLeuIleThrAlaAlaLeuIleAlaSerAlaAlaPheAlaAlaGlnAlaAlaProGlnLy
sProValSerAlaAlaGlnThrAlaGlnHisSerAlaValTrpIleAspValArgSerGluGlnGluPheSerGlu
GlyHisLeuHisAsnAlaValAsnIleProValAspGlnIleValArgArgIleHisGluAlaAlaProAspLysA
spThrProValAsnLeuTyrCysArgSerGlyArgArgAlaGluAlaAlaLeuGlnGluLeuLysLysAlaGlyTy
rThrAsnValAlaAsnHisGlyGlyTyrGluAspLeuLeuLysLysGlyMetLys
Hydrophilic Regions - Hopp-Woods (SEQ. ID. NO. 24309)
1-MetAsnIleLysHisLeuIleThrAlaAlaLeuIleAlaSerAlaAlaPheAlaAlaGlnAlaAlaProGlnLy
sProValSerAlaAlaGlnThrAlaGlnHisSerAlaValTrpIleAspValArgSerGluGlnGluPheSerGlu
GlyHisLeuHisAsnAlaValAsnIleProValAspGlnIleValArgArgIleHisGluAlaAlaProAspLysA
spThrProValAsnLeuTyrCysArgSerGlyArgArgAlaGluAlaAlaLeuGlnGluLeuLysLysAlaGlyTy
rThrAsnValAlaAsnHisGlyGlyTyrGluAspLeuLeuLysLysGlyMetLys-119
a769
AMPHI Regions - AMPHI
SEQ. ID. NO. 24310 1-LeuIleMetValIlePheTyrPheCysGlyLysThrPheMetProAlaAr
gAsnArgTrpMetLeuLeuLeuProLeuLeuAlaSerAlaAlaTyrAlaGluGluThrProArgGluProAspLeuArgSerArgProGluPheArgLeuHisG
luAlaGluValLysProIleAspArgGluLysValProGlyGlnValArgGluLysGlyLysValLeuGlnIleAspGlyGluThrLeuLeuLysAsnProGlu
LeuLeuSerArgAlaMetTyrSerAlaValValSerAsnAsnIleAlaGlyIleArgValIleLeuProIleTyrLeuGlnGlnAlaGlnGlnAspLysMetLe
uAlaLeuTyrAlaGlnGlyIleLeuAlaGlnAlaAspGlyArgValLysGluAlaIleSerHisTyrArgGluLeuIleValAlaGlnProAspAlaProAlaV
alArgMetArgLeuAlaAlaAlaLeuPheGluAsnArgGlnAsnGluAlaAlaAlaAspGlnPheAspArgLeuLysAlaGluAsnLeuProProGlnLeuMet
GluGlnValGluLeuTyrArgLysAlaLeuArgGluArgAspAlaTrpLysValAsnGlyGlyPheSerValThrArgGluHisAsnIleAsnGlnAlaProLy
sArgGlnGlnTyrGlyLysTrpThrPheProLysGlnValAspGlyThrAlaValAsnTyrArgLeuGlyAlaGluLysLysTrpSerLeuLysAsnGlyTrpT
yrThrThrAlaGlyGlyAspValSerGlyArgValTyrProGlyAsnLysLysPheAsnAspMetThrAlaGlyValSerGlyGlyIleGlyPheAlaAspArg
ArgLysAspAlaGlyLeuAlaValPheHisGluArgArgThrTyrGlyAsnAspAlaTyrSerTyrThrAsnGlyAlaArgLeuTyrPheAsnArgTrpGlnTh
rProLysTrpGlnThrLeuSerSerAlaGluTrpGlyArgLeuLysAsnThrArgArgAlaArgSerAspAsnThrHisLeuGlnIleSerAsnSerLeuValPh
eTyrArgAsnAlaArgGlnTyrTrpMetGlyGlyLeuAspPheTyrArgGluArgAsnProAlaAspArgGlyAspAsnPheAsnArgTyrGlyLeuArgPhe
AlaTrpGlyGlnGluTrpGlyGlySerGlyLeuSerSerLeuLeuArgLeuGlyAlaAlaLysArgHisTyrGluLysProGlyPhePheSerGlyPheLysGl
yGluArgArgArgAspLysGluLeuAsnThrSerLeuSerLeuTrpHisArgAlaLeuHisPheLysGlyIleThrProArgLeuThrLeuSerHisArgGluT
hrArgSerAsnAspValPheAsnGluTyrGluLysAsnArgAlaPheValGluPheAsnLysThrPhe-490
Antigenic Index - Jameson-Wolf (SEQ. ID. NO. 24310)
1-LeuIleMetValIlePheTyrPheCysGlyLysThrPheMetProAlaArgAsnArgTrpMetLeuLeuLeuPr
oLeuLeuAlaSerAlaAlaTyrAlaGluGluThrProArgGluProAspLeuArgSerArgProGluPheArgLeu
HisGluAlaGluValLysProIleAspArgGluLysValProGlyGlnValArgGluLysGlyLysValLeuGlnI
leAspGlyGluThrLeuLeuLysAsnProGluLeuLeuSerArgAlaMetTyrSerAlaValValSerAsnAsnI1
eAlaGlyIleArgValIleLeuProIleTyrLeuGlnGlnAlaGlnGlnAspLysMetLeuAlaLeuTyrAlaGln
GlyIleLeuAlaGlnAlaAspGlyArgValLysGluAlaIleSerHisTyrArgGluLeuIleValAlaGlnProA
spAlaProAlaValArgMetArgLeuAlaAlaAlaLeuPheGluAsnArgGlnAsnGluAlaAlaAlaAspGlnPh
eAspArgLeuLysAlaGluAsnLeuProProGlnLeuMetGluGlnValGluLeuTyrArgLysAlaLeuArgGlu
ArgAspAlaTrpLysValAsnGlyGlyPheSerValThrArgGluHisAsnIleAsnGlnAlaProLysArgGlnG
lnTyrGlyLysTrpThrPheProLysGlnValAspGlyThrAlaValAsnTyrArgLeuGlyAlaGluLysLysTr
pSerLeuLysAsnGlyTrpTyrThrThrAlaGlyGlyAspValSerGlyArgValTyrProGlyAsnLysLysPhe
AsnAspMetThrAlaGlyValSerGlyGlyIleGlyPheAlaAspArgArgLysAspAlaGlyLeuAlaValPheH
isGluArgArgThrTyrGlyAsnAspAlaTyrSerTyrThrAsnGlyAlaArgLeuTyrPheAsnArgTrpGlnTh
rProLysTrpGlnThrLeuSerSerAlaGluTrpGlyArgLeuLysAsnThrArgArgAlaArgSerAspAsnThr
HisLeuGlnIleSerAsnSerLeuValPheTyrArgAsnAlaArgGlnTyrTrpMetGlyGlyLeuAspPheTyrA
rgGluArgAsnProAlaAspArgGlyAspAsnPheAsnArgTyrGlyLeuArgPheAlaTrpGlyGlnGluTrpGl
yGlySerGlyLeuSerSerLeuLeuArgLeuGlyAlaAlaLysArgHisTyrGluLysProGlyPhePheSerGly
PheLysGlyGluArgArgArgAspLysGluLeuAsnThrSerLeuSerLeuTrpHisArgAlaLeuHisPheLysG
lyIleThrProArgLeuThrLeuSerHisArgGluThrArgSerAsnAspValPheAsnGluTyrGluLysAsnAr
gAlaPheValGluPheAsnLysThrPhe-490
Hydrophilic Regions - Hopp-Woods (SEQ. ID. NO. 24310)
1-LeuIleMetValIlePheTyrPheCysGlyLysThrPheMetProAlaArgAsnArgTrpMetLeuLeuLeuPr
oLeuLeuAlaSerAlaAlaTyrAlaGluGluThrProArgGluProAspLeuArgSerArgProGluPheArgLeu
HisGluAlaGluValLysProIleAspArgGluLysValProGlyGlnValArgGluLysGlyLysValLeuGlnI
leAspGlyGluThrLeuLeuLysAsnProGluLeuLeuSerArgAlaMetTyrSerAlaValValSerAsnAsnI1
eAlaGlyIleArgValIleLeuProIleTyrLeuGlnGlnAlaGlnGlnAspLysMetLeuAlaLeuTyrAlaGln
GlyIleLeuAlaGlnAlaAspGlyArgValLysGluAlaIleSerHisTyrArgGluLeuIleValAlaGlnProA
spAlaProAlaValArgMetArgLeuAlaAlaAlaLeuPheGluAsnArgGlnAsnGluAlaAlaAlaAspGlnPh
eAspArgLeuLysAlaGluAsnLeuProProGlnLeuMetGluGlnValGluLeuTyrArgLysAlaLeuArgGlu
ArgAspAlaTrpLysValAsnGlyGlyPheSerValThrArgGluHisAsnIleAsnGlnAlaProLysArgGlnG
lnTyrGlyLysTrpThrPheProLysGlnValAspGlyThrAlaValAsnTyrArgLeuGlyAlaGluLysLysTr
pSerLeuLysAsnGlyTrpTyrThrThrAlaGlyGlyAspValSerGlyArgValTyrProGlyAsnLysLysPhe
AsnAspMetThrAlaGlyValSerGlyGlyIleGlyPheAlaAspArgArgLysAspAlaGlyLeuAlaValPheH
isGluArgArgThrTyrGlyAsnAspAlaTyrSerTyrThrAsnGlyAlaArgLeuTyrPheAsnArgTrpGlnTh
rProLysTrpGlnThrLeuSerSerAlaGluTrpGlyArgLeuLysAsnThrArgArgAlaArgSerAspAsnThr
HisLeuGlnIleSerAsnSerLeuValPheTyrArgAsnAlaArgGlnTyrTrpMetGlyGlyLeuAspPheTyrA
rgGluArgAsnProAlaAspArgGlyAspAsnPheAsnArgTyrGlyLeuArgPheAlaTrpGlyGlnGluTrpGl
yGlySerGlyLeuSerSerLeuLeuArgLeuGlyAlaAlaLysArgHisTyrGluLysProGlyPhePheSerGly
PheLysGlyGluArgArgArgAspLysGluLeuAsnThrSerLeuSerLeuTrpHisArgAlaLeuHisPheLysG
lyIleThrProArgLeuThrLeuSerHisArgGluThrArgSerAsnAspValPheAsnGluTyrGluLysAsnAr
gAlaPheValGluPheAsnLysThrPhe-490
a770
AMPHI Regions - AMPHI
SEQ. ID. NO. 24311 1-MetAsnArgLeuLeuLeuLeuSerAlaAlaValLeuLeuThrAlaCysGl
ySerGlyGluThrAspLysIleGlyArgAlaSerThrValPheAsnIleLeuGlyLysAsnAspArgIleGluValGluGlyPheAspAspProAspValGlnG
lyValAlaCysTyrIleSerTyrAlaLysLysGlyGlyLeuLysGluMetValAsnLeuGluGluAspAlaSerAspAlaSerValSerCysValGlnThrAla
SerSerIleSerPheAspGluThrAlaValArgLysProLysGluValPheLysHisGlyAlaSerPheAlaPheLysSerArgGlnIleValArgTyrTyrAs
pProLysArgLysThrPheAlaTyrLeuValTyrSerAspLysIleIleGlnGlySerProLysAsnSerLeuSerAlaValSerCysPheGlyGlyGlyIleP
roGlnThrAspGlyValGlnAlaAspThrSerGlyAsnLeuLeuAlaGlyAlaCysMetIleSerAsnProIleGluAsnProAspLysArg-186

TABLE 1-continued

Antigenic Index - Jameson-Wolf (SEQ. ID. NO. 24311)
1-MetAsnArgLeuLeuLeuLeuSerAlaAlaValLeuLeuThrAlaCysGlySerGlyGluThrAspLysIleGl
yArgAlaSerThrValPheAsnIleLeuGlyLysAsnAspArgIleGluValGluGlyPheAspAspProAspVal
GlnGlyValAlaCysTyrIleSerTyrAlaLysLysGlyGlyLeuLysGluMetValAsnLeuGluGluAspAlaS
erAspAlaSerValSerCysValGlnThrAlaSerSerIleSerPheAspGluThrAlaValArgLysProLysGl
uValPheLysHisGlyAlaSerPheAlaPheLysSerArgGlnIleValArgTyrTyrAspProLysArgLysThr
PheAlaTyrLeuValTyrSerAspLysIleIleGlnGlySerProLysAsnSerLeuSerAlaValSerCysPheG
lyGlyGlyIleProGlnThrAspGlyValGlnAlaAspThrSerGlyAsnLeuLeuAlaGlyAlaCysMetIleSe
rAsnProIleGluAsnProAspLysArg-186
Hydrophilic Regions - Hopp-Woods (SEQ. ID. NO. 24311)
1-MetAsnArgLeuLeuLeuLeuSerAlaAlaValLeuLeuThrAlaCysGlySerGlyGluThrAspLysIleGl
yArgAlaSerThrValPheAsnIleLeuGlyLysAsnAspArgIleGluValGluGlyPheAspAspProAspVal
GlnGlyValAlaCysTyrIleSerTyrAlaLysLysGlyGlyLeuLysGluMetValAsnLeuGluGluAspAlaS
erAspAlaSerValSerCysValGlnThrAlaSerSerIleSerPheAspGluThrAlaValArgLysProLysGl
uValPheLysHisGlyAlaSerPheAlaPheLysSerArgGlnIleValArgTyrTyrAspProLysArgLysThr
PheAlaTyrLeuValTyrSerAspLysIleIleGlnGlySerProLysAsnSerLeuSerAlaValSerCysPheG
lyGlyGlyIleProGlnThrAspGlyValGlnAlaAspThrSerGlyAsnLeuLeuAlaGlyAlaCysMetIleSe
rAsnProIleGluAsnProAspLysArg-186
a771
AMPHI Regions - AMPHI
SEQ. ID. NO. 24312    1-MetAspLeuLeuSerValPheHisLysTyrArgLeuLysTyrAlaValAl
aValLeuThrIleLeuLeuLeuAlaAlaIleGlyLeuHisAlaSerValTyrArgIlePheThrProGluAsnIleArgSerArgLeuGlnGlnSerIleAlaH
isThrHisArgLysIleSerPheAspAlaAspIleGlnArgArgLeuLeuProArgProThrValIleLeuLysAsnLeuThrIleThrGluProGlyGlyAsp
ArgThrAlaValSerValGlnGluThrLysIleGlyLeuSerTrpLysAsnLeuTrpSerAspGlnIleGlnIleGluLysTrpValValSerSerAlaGluLe
uAlaLeuThrArgAspGlyLysGlyValTrpAsnIleGlnAspLeuIleAspSerGlnLysArgGlnAlaSerValAsnArgIleIleValGluAsnSerThrV
alArgLeuAsnPheLeuGlnGluGlnLeuIleLeuLysGluIleAsnLeuAsnLeuGlnSerProAspSerSerGlyGlnProPheGluSerSerGlyIleLeu
ValTrpGlyLysLeuSerValProTrpLysSerArgGlyLeuPheLeuSerAspGlyIleGlyThrProLysIleSerProPheHisPheGluAlaSerThrSe
rLeuAspGlyHisGlyIleThrIleSerThrThrGlySerProSerValArgPheAsnAlaGlyGlyAlaAspAlaAlaGlyLeuGlyLeuArgAlaAspThrS
erPheArgAsnLeuHisLeuThrAlaGlnIleProThrLeuAlaLeuArgAsnAsnSerIleLysIleGluThrValAsnGlyAlaPheThrAlaGlyGlyGlu
TyrAlaGlnTrpAspGlySerPheLysLeuAspLysAlaAsnLeuHisSerGlyIleAlaAsnIleGlyAsnAlaGluIleSerGlySerPheLysThrProAr
gHisGlnThrAsnPheSerLeuAsnSerProLeuValTrpThrGluAsnLysGlyLeuAspAlaProArgLeuTyrValSerThrLeuGlnAspThrValAsnA
rgLeuProGlnProArgPheIleSerArgLeuAspGlySerLeuSerValProAsnLeuGlnAsnTrpAsnAlaGluLeuAsnGlyThrPheAspArgGlnThr
ValAlaAlaLysPheArgTyrThrHisGluAspAlaProHisLeuGluAlaAlaValAlaLeuGlnLysLeuAsnLeuThrProTyrLeuAspAspValArgGl
nGlnAsnGlyLysIlePheProAspThrLeuAlaLysLeuSerGlyAspIleGluAlaHisLeuLysIleGlyLysValGlnLeuProGlyLeuGlnLeuAspA
spMetGluThrTyrLeuHisAlaAspLysGlyHisIleAlaLeuSerArgPheLysSerGlyLeuTyrGlyGlyHisThrGluGlyGlyIleSerIleAlaAsn
ThrArgProAlaThrTyrArgLeuGlnGlnAsnAlaSerAsnIleGlnIleGlnProLeuLeuGlnAspLeuPheGlyPheHisSerPheSerGlyAsnGlyAs
pAlaValIleAspLeuThrAlaGlyGlyGluThrArgLysGluLeuIleArgSerLeuGlnGlySerLeuSerLeuAsnIleSerAsnGlyAlaTrpHisGlyI
leAspMetAspAsnIleLeuLysAsnGlyIleSerGlyLysThrAlaAspAsnAlaAlaProSerThrProPheHisArgPheThrLeuAsnSerGluIleSer
AspGlyIleSerArgHisIleAspThrGluLeuPheSerAspSerLeuTyrValThrSerAsnGlyTyrThrAsnLeuAspThrGlnGluLeuSerGluAspVa
lLeuIleArgAsnAlaValHisProLysAsnLysProIleProLeuLysIleThrGlyThrValAspLysProSerIleThrValAspTyrGlyArgLeuThrG
lyGlyIleAsnSerArgLysGluLysGlnLysIleLeuGluAspThrLeuLeuGluGlnTrpGlnTrpLeuLysProLysGluPro-704
Antigenic Index - Jameson-Wolf (SEQ. ID. NO. 24312)
1-MetAspLeuLeuSerValPheHisLysTyrArgLeuLysTyrAlaValAlaValLeuThrIleLeuLeuLeuAl
aAlaIleGlyLeuHisAlaSerValTyrArgIlePheThrProGluAsnIleArgSerArgLeuGlnGlnSerIle
AlaHisThrHisArgLysIleSerPheAspAlaAspIleGlnArgArgLeuLeuProArgProThrValIleLeuL
ysAsnLeuThrIleThrGluProGlyGlyAspArgThrAlaValSerValGlnGluThrLysIleGlyLeuSerTr
pLysAsnLeuTrpSerAspGlnIleGlnIleGluLysTrpValValSerSerAlaGluLeuAlaLeuThrArgAsp
GlyLysGlyValTrpAsnIleGlnAspLeuIleAspSerGlnLysArgGlnAlaSerValAsnArgIleIleValG
luAsnSerThrValArgLeuAsnPheLeuGlnGluGlnLeuIleLeuLysGluIleAsnLeuAsnLeuGlnSerPr
oAspSerSerGlyGlnProPheGluSerSerGlyIleLeuValTrpGlyLysLeuSerValProTrpLysSerArg
GlyLeuPheLeuSerAspGlyIleGlyThrProLysIleSerProPheHisPheGluAlaSerThrSerLeuAspG
lyHisGlyIleThrIleSerThrThrGlySerProSerValArgPheAsnAlaGlyGlyAlaAspAlaAlaGlyLe
uGlyLeuArgAlaAspThrSerPheArgAsnLeuHisLeuThrAlaGlnIleProThrLeuAlaLeuArgAsnAsn
SerIleLysIleGluThrValAsnGlyAlaPheThrAlaGlyGlyGluTyrAlaGlnTrpAspGlySerPheLysL
euAspLysAlaAsnLeuHisSerGlyIleAlaAsnIleGlyAsnAlaGluIleSerGlySerPheLysThrProAr
gHisGlnThrAsnPheSerLeuAsnSerProLeuValTrpThrGluAsnLysGlyLeuAspAlaProArgLeuTyr
ValSerThrLeuGlnAspThrValAsnArgLeuProGlnProArgPheIleSerArgLeuAspGlySerLeuSerV
alProAsnLeuGlnAsnTrpAsnAlaGluLeuAsnGlyThrPheAspArgGlnThrValAlaAlaLysPheArgTy
rThrHisGluAspAlaProHisLeuGluAlaAlaValAlaLeuGlnLysLeuAsnLeuThrProTyrLeuAspAsp
ValArgGlnGlnAsnGlyLysIlePheProAspThrLeuAlaLysLeuSerGlyAspIleGluAlaHisLeuLysI
leGlyLysValGlnLeuProGlyLeuGlnLeuAspAspMetGluThrTyrLeuHisAlaAspLysGlyHisIleAl
aLeuSerArgPheLysSerGlyLeuTyrGlyGlyHisThrGluGlyGlyIleSerIleAlaAsnThrArgProAla
ThrTyrArgLeuGlnGlnAsnAlaSerAsnIleGlnIleGlnProLeuLeuGlnAspLeuPheGlyPheHisSerP
heSerGlyAsnGlyAspAlaValIleAspLeuThrAlaGlyGlyGluThrArgLysGluLeuIleArgSerLeuGl
nGlySerLeuSerLeuAsnIleSerAsnGlyAlaTrpHisGlyIleAspMetAspAsnIleLeuLysAsnGlyIle
SerGlyLysThrAlaAspAsnAlaAlaProSerThrProPheHisArgPheThrLeuAsnSerGluIleSerAspG
lyIleSerArgHisIleAspThrGluLeuPheSerAspSerLeuTyrValThrSerAsnGlyTyrThrAsnLeuAs
pThrGlnGluLeuSerGluAspValLeuIleArgAsnAlaValHisProLysAsnLysProIleProLeuLysIle
ThrGlyThrValAspLysProSerIleThrValAspTyrGlyArgLeuThrGlyGlyIleAsnSerArgLysGluL
ysGlnLysIleLeuGluAspThrLeuLeuGluGlnTrpGlnTrpLeuLysProLysGluPro-704
Hydrophilic Regions - Hopp-Woods (SEQ. ID. NO. 24312)
1-MetAspLeuLeuSerValPheHisLysTyrArgLeuLysTyrAlaValAlaValLeuThrIleLeuLeuLeuAl
aAlaIleGlyLeuHisAlaSerValTyrArgIlePheThrProGluAsnIleArgSerArgLeuGlnGlnSerIle
AlaHisThrHisArgLysIleSerPheAspAlaAspIleGlnArgArgLeuLeuProArgProThrValIleLeuL
ysAsnLeuThrIleThrGluProGlyGlyAspArgThrAlaValSerValGlnGluThrLysIleGlyLeuSerTr
pLysAsnLeuTrpSerAspGlnIleGlnIleGluLysTrpValValSerSerAlaGluLeuAlaLeuThrArgAsp
GlyLysGlyValTrpAsnIleGlnAspLeuIleAspSerGlnLysArgGlnAlaSerValAsnArgIleIleValG
luAsnSerThrValArgLeuAsnPheLeuGlnGluGlnLeuIleLeuLysGluIleAsnLeuAsnLeuGlnSerPr
oAspSerSerGlyGlnProPheGluSerSerGlyIleLeuValTrpGlyLysLeuSerValProTrpLysSerArg
GlyLeuPheLeuSerAspGlyIleGlyThrProLysIleSerProPheHisPheGluAlaSerThrSerLeuAspG TABLE 1-continued lyHisGlyIleThrIleSerThrThrGlySerProSerValArgPheAsnAlaGlyGlyAlaAspAlaAlaGlyLe
uGlyLeuArgAlaAspThrSerPheArgAsnLeuHisLeuThrAlaGlnIleProThrLeuAlaLeuArgAsnAsn
SerIleLysIleGluThrValAsnGlyAlaPheThrAlaGlyGlyGluTyrAlaGlnTrpAspGlySerPheLysL
euAspLysAlaAsnLeuHisSerGlyIleAlaAsnIleGlyAsnAlaGluIleSerGlySerPheLysThrProAr
gHisGlnThrAsnPheSerLeuAsnSerProLeuValTrpThrGluAsnLysGlyLeuAspAlaProArgLeuTyr
ValSerThrLeuGlnAspThrValAsnArgLeuProGlnProArgPheIleSerArgLeuAspGlySerLeuSerV
alProAsnLeuGlnAsnTrpAsnAlaGluLeuAsnGlyThrPheAspArgGlnThrValAlaAlaLysPheArgTy
rThrHisGluAspAlaProHisLeuGluAlaAlaValAlaLeuGlnLysLeuAsnLeuThrProTyrLeuAspAsp
ValArgGlnGlnAsnGlyLysIlePheProAspThrLeuAlaLysLeuSerGlyAspIleGluAlaHisLeuLysI
leGlyLysValGlnLeuProGlyLeuGlnLeuAspAspMetGluThrTyrLeuHisAlaAspLysGlyHisIleAl
aLeuSerArgPheLysSerGlyLeuTyrGlyGlyHisThrGluGlyGlyIleSerIleAlaAsnThrArgProAla
ThrTyrArgLeuGlnGlnAsnAlaSerAsnIleGlnIleGlnProLeuLeuGlnAspLeuPheGlyPheHisSerP
heSerGlyAsnGlyAspAlaValIleAspLeuThrAlaGlyGlyGluThrArgLysGluLeuIleArgSerLeuGl
nGlySerLeuSerLeuAsnIleSerAsnGlyAlaTrpHisGlyIleAspMetAspAsnIleLeuLysAsnGlyIle
SerGlyLysThrAlaAspAsnAlaAlaProSerThrProPheHisArgPheThrLeuAsnSerGluIleSerAspG
lyIleSerArgHisIleAspThrGluLeuPheSerAspSerLeuTyrValThrSerAsnGlyTyrThrAsnLeuAs
pThrGlnGluLeuSerGluAspValLeuIleArgAsnAlaValHisProLysAsnLysProIleProLeuLysIle
ThrGlyThrValAspLysProSerIleThrValAspTyrGlyArgLeuThrGlyGlyIleAsnSerArgLysGluL
ysGlnLysIleLeuGluAspThrLeuLeuGluGlnTrpGlnTrpLeuLysProLysGluPro-704
a772
AMPHI Regions - AMPHI
SEQ. ID. NO. 24313  1-MetPheGlyAlaValLeuArgIleAspAlaAspCysLeuGlnIleIleVa
lAlaCysLysLeuPheGlnIleValAlaTyrGlyPheAlaAlaLeuValGluGlyGluPheHisGluPheGlyGluMetLeuGluIleValArgLeuAlaAspT
hrValPheHisArgAsnHisAlaAspAspGlyArgIleHisPheArgArgGlyValGluArgPheGlyArgHisValAsnGlnHisPheHisIleGluGluIle
LeuGlnHisHisAlaGlnAlaAlaValValValAlaPheArgArgGlyAsnHisThrIleAspHisPhePheLeuGlnHisLysValHisIleAspAspIleVa
lArgHisLeuArgGlnLeuGluGlnLysArgArgGlyAsnValValGlyGlnValAlaAspAspPheLeuPheAlaCysAspAlaValGluIleLysLeuGlnT
yrIleAlaPheValAsnHisGlnPheIleArgLysArgGlnArgPheGlnThrAlaTyrAspValAlaValAspPheAspAsnValGlnAlaValGlnLeuPhe
ArgGlnArgPheGlyAsnArgArgGlnThrArgThrAspPheAsnHisAspIleIleArgLeuArgAlaHisGlyValAspAsnIleAlaAspAsnProArgVa
lLeuGlnLysIleLeuProGluThrLeuAlaGlyPheValPhePheHisArgValSerPheSerValGluThrProProPheArgAlaValGluSerAspSerI
leTrpGluGlyArgAsnSerPheGlnIleArgThrAlaHisArgAlaValLeuTyrValSerSerCysValLeuLysHisLysCysValTyrSerIleArgLeu
MetSerAlaLeu-298
Antigenic Index - Jameson-Wolf (SEQ. ID. NO. 24313)
1-MetPheGlyAlaValLeuArgIleAspAlaAspCysLeuGlnIleIleValAlaCysLysLeuPheGlnIleVa
lAlaTyrGlyPheAlaAlaLeuValGluGlyGluPheHisGluPheGlyGluMetLeuGluIleValArgLeuAla
AspThrValPheHisArgAsnHisAlaAspAspGlyArgIleHisPheArgArgGlyValGluArgPheGlyArgH
isValAsnGlnHisPheHisIleGluGluIleLeuGlnHisHisAlaGlnAlaAlaValValValAlaPheArgAr
gGlyAsnHisThrIleAspHisPhePheLeuGlnHisLysValHisIleAspAspIleValArgHisLeuArgGln
LeuGluGlnLysArgArgGlyAsnValValGlyGlnValAlaAspAspPheLeuPheAlaCysAspAlaValGluI
leLysLeuGlnTyrIleAlaPheValAsnHisGlnPheIleArgLysArgGlnArgPheGlnThrAlaTyrAspVa
lAlaValAspPheAspAsnValGlnAlaValGlnLeuPheArgGlnArgPheGlyAsnArgArgGlnThrArgThr
AspPheAsnHisAspIleIleArgLeuArgAlaHisGlyValAspAsnIleAlaAspAsnProArgValLeuGlnL
ysIleLeuProGluThrLeuAlaGlyPheValPhePheHisArgValSerPheSerValGluThrProProPheAr
gAlaValGluSerAspSerIleTrpGluGlyArgAsnSerPheGlnIleArgThrAlaHisArgAlaValLeuTyr
ValSerSerCysValLeuLysHisLysCysValTyrSerIleArgLeuMetSerAlaLeu-298

Hydrophilic Regions - Hopp-Woods (SEQ. ID. NO. 24313)

1-MetPheGlyAlaValLeuArgIleAspAlaAspCysLeuGlnIleIleValAlaCysLysLeuPheGlnIleVa
lAlaTyrGlyPheAlaAlaLeuValGluGlyGluPheHisGluPheGlyGluMetLeuGluIleValArgLeuAla
AspThrValPheHisArgAsnHisAlaAspAspGlyArgIleHisPheArgArgGlyValGluArgPheGlyArgH
isValAsnGlnHisPheHisIleGluGluIleLeuGlnHisHisAlaGlnAlaAlaValValValAlaPheArgAr
gGlyAsnHisThrIleAspHisPhePheLeuGlnHisLysValHisIleAspAspIleValArgHisLeuArgGln
LeuGluGlnLysArgArgGlyAsnValValGlyGlnValAlaAspAspPheLeuPheAlaCysAspAlaValGluI
leLysLeuGlnTyrIleAlaPheValAsnHisGlnPheIleArgLysArgGlnArgPheGlnThrAlaTyrAspVa
lAlaValAspPheAspAsnValGlnAlaValGlnLeuPheArgGlnArgPheGlyAsnArgArgGlnThrArgThr
AspPheAsnHisAspIleIleArgLeuArgAlaHisGlyValAspAsnIleAlaAspAsnProArgValLeuGlnL
ysIleLeuProGluThrLeuAlaGlyPheValPhePheHisArgValSerPheSerValGluThrProProPheAr
gAlaValGluSerAspSerIleTrpGluGlyArgAsnSerPheGlnIleArgThrAlaHisArgAlaValLeuTyr
ValSerSerCysValLeuLysHisLysCysValTyrSerIleArgLeuMetSerAlaLeu-298 a774

AMPHI Regions - AMPHI

SEQ. ID. NO. 24314 1-MetLysThrLysLeuProLeuPheIleIleTrpLeuSerValSerAlaAl
aCysSerSerProValSerArgAsnIleGlnAspMetArgLeuGluProGlnAlaGluAlaGlySerSerAspAlaIleProTyrProValProThrLeuGlnA
spArgLeuAspTyrLeuGluGlyThrLeuValArgLeuSerAsnGluValGluThrLeuAsnGlyLysValLysAlaLeuGluHisAlaLysThrHisProSer
SerArgAlaTyrValGlnLysLeuAspAspArgLysLeuLysGluHisTyrLeuAsnThrGluGlyGlySerAlaSerAlaHisThrValGluThrAlaGlnAs
nLeuTyrAsnGlnAlaLeuLysHisTyrLysSerGlyArgPheSerAlaAlaAlaSerLeuLeuLysGlyAlaAspGlyGlyAspGlyGlySerIleAlaGlnA
rgSerMetTyrLeuLeuLeuGlnSerArgAlaArgMetGlyAsnCysGluSerValIleGluIleGlyGlyArgTyrAlaAsnArgPheLysAspSerProThr
AlaProGluAlaMetPheLysIleGlyGluCysGlnTyrArgLeuGlnGlnLysAspIleAlaArgAlaThrTrpArgSerLeuIleGlnThrTyrProGlySe
rProAlaAlaLysArgAlaAlaAlaAlaValArgLysArg-238

Antigenic Index - Jameson-Wolf (SEQ. ID. NO. 24314)

1-MetLysThrLysLeuProLeuPheIleIleTrpLeuSerValSerAlaAlaCysSerSerProValSerArgAs
nIleGlnAspMetArgLeuGluProGlnAlaGluAlaGlySerSerAspAlaIleProTyrProValProThrLeu
GlnAspArgLeuAspTyrLeuGluGlyThrLeuValArgLeuSerAsnGluValGluThrLeuAsnGlyLysValL
ysAlaLeuGluHisAlaLysThrHisProSerSerArgAlaTyrValGlnLysLeuAspAspArgLysLeuLysGl
uHisTyrLeuAsnThrGluGlyGlySerAlaSerAlaHisThrValGluThrAlaGlnAsnLeuTyrAsnGlnAla
LeuLysHisTyrLysSerGlyArgPheSerAlaAlaAlaSerLeuLeuLysGlyAlaAspGlyGlyAspGlyGlyS
erIleAlaGlnArgSerMetTyrLeuLeuLeuGlnSerArgAlaArgMetGlyAsnCysGluSerValIleGluIl
eGlyGlyArgTyrAlaAsnArgPheLysAspSerProThrAlaProGluAlaMetPheLysIleGlyGluCysGln
TyrArgLeuGlnGlnLysAspIleAlaArgAlaThrTrpArgSerLeuIleGlnThrTyrProGlySerProAlaA
laLysArgAlaAlaAlaAlaValArgLysArg-238

TABLE 1-continued Hydrophilic Regions - Hopp-Woods (SEQ. ID. NO. 24314)
1-MetLysThrLysLeuProLeuPheIleIleTrpLeuSerValSerAlaAlaCysSerSerProValSerArgAs
nIleGlnAspMetArgLeuGluProGlnAlaGluAlaGlySerSerAspAlaIleProTyrProValProThrLeu
GlnAspArgLeuAspTyrLeuGluGlyThrLeuValArgLeuSerAsnGluValGluThrLeuAsnGlyLysValL
ysAlaLeuGluHisAlaLysThrHisProSerSerArgAlaTyrValGlnLysLeuAspAspArgLysLeuLysGl
uHisTyrLeuAsnThrGluGlyGlySerAlaSerAlaHisThrValGluThrAlaGlnAsnLeuTyrAsnGlnAla
LeuLysHisTyrLysSerGlyArgPheSerAlaAlaAlaSerLeuLeuLysGlyAlaAspGlyGlyAspGlyGlyS
erIleAlaGlnArgSerMetTyrLeuLeuLeuGlnSerArgAlaArgMetGlyAsnCysGluSerValIleGluIl
eGlyGlyArgTyrAlaAsnArgPheLysAspSerProThrAlaProGluAlaMetPheLysIleGlyGluCysGln
TyrArgLeuGlnGlnLysAspIleAlaArgAlaThrTrpArgSerLeuIleGlnThrTyrProGlySerProAlaA
laLysArgAlaAlaAlaAlaValArgLysArg-238
a790
AMPHI Regions - AMPHI
SEQ. ID. NO. 24315    10-GluAlaAlaAlaGluVal-15
SEQ. ID. NO. 24316    44-GlyAsnGlnThrCysSerArgTyrSerAsn-53
SEQ. ID. NO. 24317    89-LysGlnAlaValThr-93
SEQ. ID. NO. 24318    103-ThrGlnAlaTyrAsnGluMetThrLysSerVal-113
SEQ. ID. NO. 24319    166-PheAlaArgThrGlyLysLeu-172
SEQ. ID. NO. 24320    174-GlySerPheAspLeuPheAlaSerVal-182
SEQ. ID. NO. 24321    253-ProSerGluAlaLeuAsp-258
SEQ. ID. NO. 24322    290-ThrAlaProAspValTrpThrVal-297
SEQ. ID. NO. 24323    320-PheLeuArgPheTrpGlnAlaThrArgGlyIle-330
Antigenic Index - Jameson-Wolf
SEQ. ID. NO. 24324    1-MetAlaArgArgSerLysThrPheGluGluAlaAlaAlaGluValGluGluArgPheGlyHisArgGlyIleLys-25
SEQ. ID. NO. 24325    30-GluGlyThrAlaLysProCysVal-37
SEQ. ID. NO. 24326    39-AsnCysProLysHisGlyAsnGlnThrCysSerArgTyrSer-52
SEQ. ID. NO. 24327    57-GlySerSerTrpGlyCysProSerCysGlyAsnGluGlnAlaAla-71
SEQ. ID. NO. 24328    77-ThrLeuArgLysAsnHisIle-83
SEQ. ID. NO. 24329    95-MetThrLysGlnGluArgIleThr-102
SEQ. ID. NO. 24330    123-AspValGlnGlyAspThrThrIle-130
SEQ. ID. NO. 24331    134-HisThrHisThrHisAsnHisSerAspAlaAspGlyLysAlaLeuSer-149
SEQ. ID. NO. 24332    152-LeuThrProArgProLeuLeuSerAspArgGlnAla-163
SEQ. ID. NO. 24333    167-AlaArgThrGlyLysLeuThrGly-174
SEQ. ID. NO. 24334    194-MetProAspThrSerMet-199
SEQ. ID. NO. 24335    201-ProValIleGluLysGlyAsp-207
SEQ. ID. NO. 24336    213-ProArgMetArgProAlaAspGluAspIleVal-223
SEQ. ID. NO. 24337    227-LeuSerAspLysArgLeuVal-233
SEQ. ID. NO. 24338    248-TyrGlnThrGlyArgProSerGluAlaLeuAspLeuProGluGly-262
SEQ. ID. NO. 24339    270-LeuGluSerLysAsnGlyLeuCysProProHisArgGlnGluGlyVal-285
SEQ. ID. NO. 24340    301-SerAlaSerLysThrSerCysThrArgProThrAlaAlaArgLysSerAla-317
SEQ. ID. NO. 24341    326-AlaThrArgGlyIleProLysThrArgSerTrpArgAsnProAsnAsnAlaCys-343
Hydrophilic Regions - Hopp-Woods
SEQ. ID. NO. 24342    1-MetAlaArgArgSerLysThrPheGluGluAlaAlaAlaGluValGluGluArgPheGlyHisArgGlyIleLys-25
SEQ. ID. NO. 24343    65-CysGlyAsnGluGlnAlaAla-71
SEQ. ID. NO. 24344    77-ThrLeuArgLysAsnHisIle-83
SEQ. ID. NO. 24345    96-ThrLysGlnGluArgIleThr-102
SEQ. ID. NO. 24346    139-AsnHisSerAspAlaAspGlyLysAlaLeuSer-149
SEQ. ID. NO. 24347    157-LeuLeuSerAspArgGlnAla-163
SEQ. ID. NO. 24348    168-ArgThrGlyLysLeu-172
SEQ. ID. NO. 24349    202-ValIleGluLysGlyAsp-207
SEQ. ID. NO. 24350    213-ProArgMetArgProAlaAspGluAspIleVal-223
SEQ. ID. NO. 24351    227-LeuSerAspLysArgLeuVal-233
SEQ. ID. NO. 24352    251-GlyArgProSerGluAlaLeuAspLeuProGlu-261
SEQ. ID. NO. 24353    270-LeuGluSerLysAsnGlyLeu-276
SEQ. ID. NO. 24354    280-HisArgGlnGluGlyVal-285
SEQ. ID. NO. 24355    301-SerAlaSerLysThrSerCysThrArgProThrAlaAlaArgLysSerAla-317
SEQ. ID. NO. 24356    328-ArgGlyIleProLysThrArgSerTrpArgAsn-338
a900-2
AMPHI Regions - AMPHI
SEQ. ID. NO. 24357    9-ValValAlaPheAlaArgPhe-15
SEQ. ID. NO. 24358    36-ValGlyLysHisPheArgLysPheCysArgPheArg-47
SEQ. ID. NO. 24359    62-ValGlyLeuLeuArgLeuAlaArgLeuPheHisIleGlyAspAspPheValAspArgPheLeuGlyPhePhe-85
SEQ. ID. NO. 24360    120-GlnCysGluGluPheProGluAlaValValGluAla-131
SEQ. ID. NO. 24361    198-HisGlnThrLeuGlyGlyAspAlaGly-206
SEQ. ID. NO. 24362    210-ValGlnPheHisHisPheGly-216
SEQ. ID. NO. 24363    233-GlyLysProSerGlyGlyAsnGlyLeuGlyGlyLeuValAsnHisLeuArgLeuValAla-252
SEQ. ID. NO. 24364    268-IleArgValLeuArgAlaArgAlaAspGlyGly-277
SEQ. ID. NO. 24365    279-AspSerThrAspValValAlaGlnMet-287
Antigenic Index - Jameson-Wolf
SEQ. ID. NO. 24366    1-LeuArgArgValGlyGlyGln-7
SEQ. ID. NO. 24367    20-ValAspPheArgArgGlnLys-26
SEQ. ID. NO. 24368    38-LysHisPheArgLysPheCysArgPheArgArgArgGlyGluSer-52
SEQ. ID. NO. 24369    56-PheLysGlnArgAla-60
SEQ. ID. NO. 24370    74-GlyAspAspPheValAspArg-80
SEQ. ID. NO. 24371    88-PheProLysArgAsnGlyValAla-95
SEQ. ID. NO. 24372    105-GlnThrAsnGlnGlu-109
SEQ. ID. NO. 24373    118-PheGlyGlnCysGluGluPhePro-125
SEQ. ID. NO. 24374    155-GluHisGluAsnValGlySerHisGluAspArgValAla-167
SEQ. ID. NO. 24375    201-LeuGlyGlyAspAlaGlyGlnAsnPro-209
SEQ. ID. NO. 24376    229-ValGluSerAlaGlyLysProSerGlyGlyAsnGly-240

TABLE 1-continued

| | |
|---|---|
| SEQ. ID. NO. 24377 | 252-AlaPheAspAspThrValValIleGlyGluGluGluGluGlyPheGly-267 |
| SEQ. ID. NO. 24378 | 270-ValLeuArgArgAlaAspGlyGlyAlaAspSerThrAsp-282 |
| SEQ. ID. NO. 24379 | 285-AlaGlnMetArgAspAlaGlyGly-292 |
| SEQ. ID. NO. 24380 | 311-MetProSerGluArgGluLysAspAlaProIle-321 |
| SEQ. ID. NO. 24381 | 323-ProAspLeuProProThrSerSerArgGlnGlnThr-334 |

Hydrophilic Regions - Hopp-Woods

| | |
|---|---|
| SEQ. ID. NO. 24382 | 1-LeuArgArgValGly-5 |
| SEQ. ID. NO. 24383 | 20-ValAspPheArgArgGlnLys-26 |
| SEQ. ID. NO. 24384 | 38-LysHisPheArgLysPheCysArgPheArgArgArgGlyGluSer-52 |
| SEQ. ID. NO. 24385 | 89-ProLysArgAsnGly-93 |
| SEQ. ID. NO. 24386 | 120-GlnCysGluGluPhePro-125 |
| SEQ. ID. NO. 24387 | 155-GluHisGluAsnValGlySerHisGluAspArgValAla-167 |
| SEQ. ID. NO. 24388 | 201-LeuGlyGlyAspAlaGlyGln-207 |
| SEQ. ID. NO. 24389 | 231-SerAlaGlyLysProSerGly-237 |
| SEQ. ID. NO. 24390 | 257-ValValIleGlyGluGluGluGluGlyPheGly-267 |
| SEQ. ID. NO. 24391 | 270-ValLeuArgArgAlaAspGlyGlyAlaAspSerThrAsp-282 |
| SEQ. ID. NO. 24392 | 285-AlaGlnMetArgAspAlaGly-291 |
| SEQ. ID. NO. 24393 | 311-MetProSerGluArgGluLysAspAlaProIle-321 |
| SEQ. ID. NO. 24394 | 326-ProProThrSerSerArgGlnGln-333 | a901
AMPHI Regions - AMPHI

| | |
|---|---|
| SEQ. ID. NO. 24395 | 20-GlyLeuPheThrValLeuGly-26 |
| SEQ. ID. NO. 24396 | 55-ValSerLeuThrGluIlePheSerLysSer-64 |
| SEQ. ID. NO. 24397 | 66-GluAlaPheAlaGluIleTyrAsp-73 |
| SEQ. ID. NO. 24398 | 84-AlaPheLeuAlaGlyMetGlyGlyIleAlaLeuIle-95 |
| SEQ. ID. NO. 24399 | 97-ArgLeuValProAsnProHisGluThrLeuAsp-107 |
| SEQ. ID. NO. 24400 | 124-ValGlyMetMetAlaAlaPhe-130 |
| SEQ. ID. NO. 24401 | 136-AsnPheProGluGlyLeuAlaThrPhePheAlaThrLeuGlu-149 |
| SEQ. ID. NO. 24402 | 164-HisAsnIleProGluGlyIleSer-171 |
| SEQ. ID. NO. 24403 | 190-CysLeuLeuSerGlyLeuAlaGluProLeuGlyAlaAla-202 |
| SEQ. ID. NO. 24404 | 217-PheGlySerValPheGlyValIleAlaGlyValMet-228 |
| SEQ. ID. NO. 24405 | 243-TyrSerAspGlyHisGlu-248 |

Antigenic Index - Jameson-Wolf

| | |
|---|---|
| SEQ. ID. NO. 24406 | 1-MetProAspPheSerMet-6 |
| SEQ. ID. NO. 24407 | 33-SerLysThrProAsnProArgVal-40 |
| SEQ. ID. NO. 24408 | 61-PheSerLysSerSerGluAlaPhe-68 |
| SEQ. ID. NO. 24409 | 71-IleTyrAspLysAspHisAla-77 |
| SEQ. ID. NO. 24410 | 98-LeuValProAsnProHisGluThrLeuAspAlaGlnAspProSerPheGlnGluSerLysArgArgHisIleAla-122 |
| SEQ. ID. NO. 24411 | 136-AsnPheProGluGly-140 |
| SEQ. ID. NO. 24412 | 179-AlaThrArgSerArgLysLysThr-186 |
| SEQ. ID. NO. 24413 | 193-SerGlyLeuAlaGluProLeuGly-200 |
| SEQ. ID. NO. 24414 | 235-GluLeuLeuProAlaAlaLysArgTyrSerAspGlyHisGluThr-249 |

Hydrophilic Regions - Hopp-Woods

| | |
|---|---|
| SEQ. ID. NO. 24415 | 61-PheSerLysSerSerGluAlaPhe-68 |
| SEQ. ID. NO. 24416 | 71-IleTyrAspLysAspHisAla-77 |
| SEQ. ID. NO. 24417 | 102-ProHisGluThrLeuAspAlaGlnAspProSerPheGlnGluSerLysArgArgHisIleAla-122 |
| SEQ. ID. NO. 24418 | 180-ThrArgSerArgLysLysThr-186 |
| SEQ. ID. NO. 24419 | 235-GluLeuLeuProAlaAlaLysArgTyrSerAspGlyHisGlu-248 | a902
AMPHI Regions - AMPHI

| | |
|---|---|
| SEQ. ID. NO. 24420 | 1-LeuHisPheGlnArgIleIleLysCysSerGluGlyIleTrpAlaValGlyAlaArgProThrValGlyPhePheGlyLysSerPheLysIleThrCysLysHisValValLeuArgArgArgThrValGlnAlaValAspPheThrThrCysLeuPheAlaValGlyHisPheValAspValProAlaTyrValPheAlaCysAspAlaHisThrGlyGlyValAlaValLysArgValHisGlySerAspValValGlnAsnSerGlyGlyThrPheCysGlnThrGlnGlyArgArgAsnThrValPheGlyValMetPheGlnIleAlaGluGluProArgSerAlaLeuArgAlaAlaProTyrHisAsnAlaValCysGlyGlyLeuPheGluAspGlyLeuGlyPheLeuArgArgGlyAsnValAlaValAspProAspArgAspValGlnThrAlaPheGlyPheGlyAsnGlnValValSerArgPheAlaPheValHisLeuArgAlaArgAlaSerValAspGlyLysGlyGlyAsnAlaAlaIlePheGlyAspPheGlyAspAspGlyGlnValLeuMetValValValProThrGlnThrGlyPheGluGlyAsnGlyTyrAlaArgArgPheAspHisArgLeuGlnAsnGlyGlyAsnGlnArgLeuValLeuHisGlnArgAlaThrGlyLeuAspIleAlaAspPhePheSerGlyThrAlaHisValAspValAspLysLeuArgProLysAlaAspValValThrArgGlyIleArgHisLeuLeuArgIleAlaSerGlyAsnLeuHisGlyAsnAsnAlaAlaPheIleGlyLysIleAlaAlaValGlnGlyPheSerSerIleSerGluArgArgValAlaGlyGlnHisPheAlaHisArgProThrCysAlaLysIleSerAlaLysSerAlaGluArgPheValGlyAsnAlaArgHisArgArgLysCysAspGlyValValAspLysIleAlaAlaAspValHisAsnGlySerAlaPheGlnLysSerThrProLeuTyrIlePhe-359 |

Antigenic Index - Jameson-Wolf (SEQ. ID. NO. 24420)
1-LeuHisPheGlnArgIleIleLysCysSerGluGlyIleTrpAlaValGlyAlaArgProThrValGlyPhePheGlyLysSerPheLysIleThrCysLysHisValValLeuArgArgArgThrValGlnAlaValAspPheThrThrCysLeuPheAlaValGlyHisPheValAspValProAlaTyrValPheAlaCysAspAlaHisThrGlyGlyValAlaValLysArgValHisGlySerAspValValGlnAsnSerGlyGlyThrPheCysGlnThrGlnGlyArgArgAsnThrValPheGlyValMetPheGlnIleAlaGluGluProArgSerAlaLeuArgAlaAlaProTyrHisAsnAlaValCysGlyGlyLeuPheGluAspGlyLeuGlyPheLeuArgArgGlyAsnValAlaValAspProAspArgAspValGlnThrAlaPheGlyPheGlyAsnGlnValValSerArgPheAlaPheValHisLeuArgAlaArgAlaSerValAspGlyLysGlyGlyAsnAlaAlaIlePheGlyAspPheGlyAspAspGlyGlnValLeuMetValValValProThrGlnThrGlyPheGluGlyAsnGlyTyrAlaArgArgPheAspHisArgLeuGlnAsnGlyGlyAsnGlnArgLeuValLeuHisGlnArgAlaThrGlyLeuAspIleAlaAspPhePheSerGlyThrAlaHisValAspValAspLysLeuArgProLysAlaAspValValThrArgGlyIleArgHisLeuLeuArgIleAlaSerGlyAsnLeuHisGlyAsnAsnAlaAlaPheIleGlyLysIleAlaAlaValGlnGlyPheSerSerIleSerGluArgArgValAlaGlyGlnHisPheAlaHisArgProThrCysAlaLysIleSerAlaLysSerAlaGluArgPheValGlyAsnAlaArgHisArgArgLysCysAspGlyValValAspLysIleAlaAlaAspValHisAsnGlySerAlaPheGlnLysSerThrProLeuTyrIlePhe-359

TABLE 1-continued

Hydrophilic Regions - Hopp-Woods (SEQ. ID. NO. 24420)
1-LeuHisPheGlnArgIleIleLysCysSerGluGlyIleTrpAlaValGlyAlaArgProThrValGlyPhePh
eGlyLysSerPheLysIleThrCysLysHisValValLeuArgArgArgThrValGlnAlaValAspPheThrThr
CysLeuPheAlaValGlyHisPheValAspValProAlaTyrValPheAlaCysAspAlaHisThrGlyGlyValA
laValLysArgValHisGlySerAspValValGlnAsnSerGlyGlyThrPheCysGlnThrGlnGlyArgArgAs
nThrValPheGlyValMetPheGlnIleAlaGluGluProArgSerAlaLeuArgAlaAlaProTyrHisAsnAla
ValCysGlyGlyLeuPheGluAspGlyLeuGlyPheLeuArgArgGlyAsnValAlaValAspProAspArgAspV
alGlnThrAlaPheGlyPheGlyAsnGlnValValSerArgPheAlaPheValHisLeuArgAlaArgAlaSerVa
lAspGlyLysGlyGlyAsnAlaAlaIlePheGlyAspPheGlyAspAspGlyGlnValLeuMetValValValPro
ThrGlnThrGlyPheGluGlyAsnGlyTyrAlaArgArgPheAspHisArgLeuGlnAsnGlyGlyAsnGlnArgL
euValLeuHisGlnArgAlaThrGlyLeuAspIleAlaAspPhePheSerGlyThrAlaHisValAspValAspLy
sLeuArgProLysAlaAspValValThrArgGlyIleArgHisLeuLeuArgIleAlaSerGlyAsnLeuHisGly
AsnAsnAlaAlaPheIleGlyLysIleAlaAlaValGlnGlyPheSerSerIleSerGluArgArgValAlaGlyG
lnHisPheAlaHisArgProThrCysAlaLysIleSerAlaLysSerAlaGluArgPheValGlyAsnAlaArgHi
sArgArgLysCysAspGlyValValAspLysIleAlaAlaAspValHisAsnGlySerAlaPheGlnLysSerThr
ProLeuTyrIlePhe-359
a903-1
AMPHI Regions - AMPHI
SEQ. ID. NO. 24421    1-MetLysPhePheProAlaProCysLeuLeuValIleLeuAlaValIlePr
oLeuLysThrLeuAlaAlaAspGluAsnAspAlaGluLeuIleArgSerMetGlnArgGlnGlnHisIleAspAlaGluLeuLeuThrAspAlaAsnValArgP
heGluGlnProLeuGluLysAsnAsnTyrValLeuSerGluAspGluThrProCysThrArgValAsnTyrIleSerLeuAspAspLysThrAlaArgLysPhe
SerPheLeuProSerValLeuMetLysGluThrAlaPheLysThrGlyMetCysLeuGlySerAsnAsnLeuSerArgLeuGlnLysAlaAlaGlnGlnIleLe
uIleValArgGlyTyrLeuThrSerGlnAlaIleIleGlnProGlnAsnMetAspSerGlyIleLeuLysLeuArgValSerAlaGlyGluIleGlyAspIleA
rgTyrGluGluLysArgAspGlyLysSerAlaGluGlySerIleSerAlaPheAsnAsnLysPheProLeuTyrArgAsnLysIleLeuAsnLeuArgAspVal
GluGlnGlyLeuGluAsnLeuArgArgLeuProSerValLysThrAspIleGlnIleIleProSerGluGluGluGlyLysSerAspLeuGlnIleLysTrpGl
nGlnAsnLysProIleArgPheSerIleGlyIleAspAspAlaGlyGlyLysThrThrGlyLysTyrGlnGlyAsnValAlaLeuSerPheAspAsnProLeuG
lyLeuSerAspLeuPheTyrValSerTyrGlyArgGlyLeuValHisLysThrAspLeuThrAspAlaThrGlyThrGluThrGluSerGlySerArgSerTyr
SerValHisTyrSerValProValLysLysTrpLeuPheSerPheAsnHisAsnGlyHisArgTyrHisGluAlaThrGluGlyTyrSerValAsnTyrAspTy
rAsnGlyLysGlnTyrGlnSerSerLeuAlaAlaGluArgMetLeuTrpArgAsnArgPheHisLysThrSerValGlyMetLysLeuTrpThrArgGlnThrT
yrLysTyrIleAspAspAlaGluIleGluValGlnArgArgArgSerAlaGlyTrpGluAlaGluLeuArgHisArgAlaTyrLeuAsnArgTrpGlnLeuAsp
GlyLysLeuSerTyrLysArgGlyThrGlyMetArgGlnSerMetProAlaProGluGluAsnGlyGlyGlyThrIleProGlyThrSerArgMetLysIleIl
eThrAlaGlyLeuAspAlaAlaAlaProPheMetLeuGlyLysGlnGlnPhePheTyrAlaThrAlaIleGlnAlaGlnTrpAsnLysThrProLeuValAlaG
lnAspLysLeuSerIleGlySerArgTyrThrValArgGlyPheAspGlyGluGlnSerLeuPheGlyGluArgGlyPheTyrTrpGlnAsnThrLeuThrTrp
TyrPheHisProAsnHisGlnPheTyrLeuGlyAlaAspTyrGlyArgValSerGlyGluSerAlaGlnTyrValSerGlyLysGlnLeuMetGlyAlaValVa
lGlyPheArgGlyGlyHisLysValGlyGlyMetPheAlaTyrAspLeuPheAlaGlyLysProLeuHisLysProLysGlyPheGlnThrThrAsnThrVal
TyrGlyPheAsnLeuAsnTyrSerPhe-580
Antigenic Index - Jameson-Wolf (SEQ. ID. NO. 24421)
1-MetLysPhePheProAlaProCysLeuLeuValIleLeuAlaValIleProLeuLysThrLeuAlaAlaAspGl
uAsnAspAlaGluLeuIleArgSerMetGlnArgGlnGlnHisIleAspAlaGluLeuLeuThrAspAlaAsnVal
ArgPheGluGlnProLeuGluLysAsnAsnTyrValLeuSerGluAspGluThrProCysThrArgValAsnTyrI
leSerLeuAspAspLysThrAlaArgLysPheSerPheLeuProSerValLeuMetLysGluThrAlaPheLysTh
rGlyMetCysLeuGlySerAsnAsnLeuSerArgLeuGlnLysAlaAlaGlnGlnIleLeuIleValArgGlyTyr
LeuThrSerGlnAlaIleIleGlnProGlnAsnMetAspSerGlyIleLeuLysLeuArgValSerAlaGlyGluI
leGlyAspIleArgTyrGluGluLysArgAspGlyLysSerAlaGluGlySerIleSerAlaPheAsnAsnLysPh
eProLeuTyrArgAsnLysIleLeuAsnLeuArgAspValGluGlnGlyLeuGluAsnLeuArgArgLeuProSer
ValLysThrAspIleGlnIleIleProSerGluGluGluGlyLysSerAspLeuGlnIleLysTrpGlnGlnAsnL
ysProIleArgPheSerIleGlyIleAspAspAlaGlyGlyLysThrThrGlyLysTyrGlnGlyAsnValAlaLe
uSerPheAspAsnProLeuGlyLeuSerAspLeuPheTyrValSerTyrGlyArgGlyLeuValHisLysThrAsp
LeuThrAspAlaThrGlyThrGluThrGluSerGlySerArgSerTyrSerValHisTyrSerValProValLysL
ysTrpLeuPheSerPheAsnHisAsnGlyHisArgTyrHisGluAlaThrGluGlyTyrSerValAsnTyrAspTy
rAsnGlyLysGlnTyrGlnSerSerLeuAlaAlaGluArgMetLeuTrpArgAsnArgPheHisLysThrSerVal
GlyMetLysLeuTrpThrArgGlnThrTyrLysTyrIleAspAspAlaGluIleGluValGlnArgArgArgSerA
laGlyTrpGluAlaGluLeuArgHisArgAlaTyrLeuAsnArgTrpGlnLeuAspGlyLysLeuSerTyrLysAr
gGlyThrGlyMetArgGlnSerMetProAlaProGluGluAsnGlyGlyGlyThrIleProGlyThrSerArgMet
LysIleIleThrAlaGlyLeuAspAlaAlaAlaProPheMetLeuGlyLysGlnGlnPhePheTyrAlaThrAlaI
leGlnAlaGlnTrpAsnLysThrProLeuValAlaGlnAspLysLeuSerIleGlySerArgTyrThrValArgGl
yPheAspGlyGluGlnSerLeuPheGlyGluArgGlyPheTyrTrpGlnAsnThrLeuThrTrpTyrPheHisPro
AsnHisGlnPheTyrLeuGlyAlaAspTyrGlyArgValSerGlyGluSerAlaGlnTyrValSerGlyLysGlnL
euMetGlyAlaValValGlyPheArgGlyGlyHisLysValGlyGlyMetPheAlaTyrAspLeuPheAlaGlyLy
sProLeuHisLysProLysGlyPheGlnThrThrAsnThrValTyrGlyPheAsnLeuAsnTyrSerPhe-580
Hydrophilic Regions - Hopp-Woods (SEQ. ID. NO. 24421)
1-MetLysPhePheProAlaProCysLeuLeuValIleLeuAlaValIleProLeuLysThrLeuAlaAlaAspGl
uAsnAspAlaGluLeuIleArgSerMetGlnArgGlnGlnHisIleAspAlaGluLeuLeuThrAspAlaAsnVal
ArgPheGluGlnProLeuGluLysAsnAsnTyrValLeuSerGluAspGluThrProCysThrArgValAsnTyrI
leSerLeuAspAspLysThrAlaArgLysPheSerPheLeuProSerValLeuMetLysGluThrAlaPheLysTh
rGlyMetCysLeuGlySerAsnAsnLeuSerArgLeuGlnLysAlaAlaGlnGlnIleLeuIleValArgGlyTyr
LeuThrSerGlnAlaIleIleGlnProGlnAsnMetAspSerGlyIleLeuLysLeuArgValSerAlaGlyGluI
leGlyAspIleArgTyrGluGluLysArgAspGlyLysSerAlaGluGlySerIleSerAlaPheAsnAsnLysPh
eProLeuTyrArgAsnLysIleLeuAsnLeuArgAspValGluGlnGlyLeuGluAsnLeuArgArgLeuProSer
ValLysThrAspIleGlnIleIleProSerGluGluGluGlyLysSerAspLeuGlnIleLysTrpGlnGlnAsnL
ysProIleArgPheSerIleGlyIleAspAspAlaGlyGlyLysThrThrGlyLysTyrGlnGlyAsnValAlaLe
uSerPheAspAsnProLeuGlyLeuSerAspLeuPheTyrValSerTyrGlyArgGlyLeuValHisLysThrAsp
LeuThrAspAlaThrGlyThrGluThrGluSerGlySerArgSerTyrSerValHisTyrSerValProValLysL
ysTrpLeuPheSerPheAsnHisAsnGlyHisArgTyrHisGluAlaThrGluGlyTyrSerValAsnTyrAspTy
rAsnGlyLysGlnTyrGlnSerSerLeuAlaAlaGluArgMetLeuTrpArgAsnArgPheHisLysThrSerVal
GlyMetLysLeuTrpThrArgGlnThrTyrLysTyrIleAspAspAlaGluIleGluValGlnArgArgArgSerA
laGlyTrpGluAlaGluLeuArgHisArgAlaTyrLeuAsnArgTrpGlnLeuAspGlyLysLeuSerTyrLysAr
gGlyThrGlyMetArgGlnSerMetProAlaProGluGluAsnGlyGlyGlyThrIleProGlyThrSerArgMet
LysIleIleThrAlaGlyLeuAspAlaAlaAlaProPheMetLeuGlyLysGlnGlnPhePheTyrAlaThrAlaI
leGlnAlaGlnTrpAsnLysThrProLeuValAlaGlnAspLysLeuSerIleGlySerArgTyrThrValArgGl TABLE 1-continued yPheAspGlyGluGlnSerLeuPheGlyGluArgGlyPheTyrTrpGlnAsnThrLeuThrTrpTyrPheHisPro
AsnHisGlnPheTyrLeuGlyAlaAspTyrGlyArgValSerGlyGluSerAlaGlnTyrValSerGlyLysGlnL
euMetGlyAlaValValGlyPheArgGlyGlyHisLysValGlyGlyMetPheAlaTyrAspLeuPheAlaGlyLy
sProLeuHisLysProLysGlyPheGlnThrThrAsnThrValTyrGlyPheAsnLeuAsnTyrSerPhe-580
a904
AMPHI Regions - AMPHI
SEQ. ID. NO. 24422     1-MetMetGlnHisAsnArgPhePheAlaValGlyAlaGlyGlyAspAspGl
yAspArgArgThrAlaAspPhePheAsnProPheGlnIleCysPheGlyIleGlyArgCysValValAlaPheHisAlaGluSerGlyPheAlaProThrGlyH
isGlyPheValAsnArgLeuAlaGlyPheTyrArgIleArgAlaAlaArgGlnAspValGlyPheAlaAlaValGlyGlnPheValAlaAspAlaAspIleAsp
GlyPheAsnAlaValHisTyrIleGluPheGlyAsnThrHisThrGlyAsnAlaValAspLeuAspGlyAlaPheGlnGlyGlyGlyIleLysProAlaAlaAl
aAlaCysAlaSerGlyTyrArgThrGluPheValSerAlaPheCysGlnThrCysSerAspPheValGluGlnPheGlyArgGluArgAlaArgThrAspAlaA
rgGlyIleGlyPheAspAspAlaGlnAsnIleIleGlnHisLeuArgAlaTyrAlaArgAlaCysArgSerArgAlaGlyGluAlaValGlyArgSerAsnGlu
GlyValSerAlaValValAspValGlnGlnArgThrLeuArgAlaPheLysGlnGlnPhePheAlaValPheValPhePheValGlnHisAlaGlyHisValGl
yAsnHisArgArgAsnAlaArgArgAspPhePheAspAsnArgHisHisValPheArgPheHisArgLeuGlyIleValGlnMetLeuGlnLeuAspValValI
leSerLysAspGlyIleGlnPhePheThrGlnPhePheArgMetGlnGlnIleGlyGlyAlaAsnGlyAlaAlaCysHisPheValPheValGlyArgAlaAsp
AlaAlaAlaGlyArgAlaAspPheAlaPheAlaAlaArgCysPheSerGlyLeuValGluArgAspValIleArgGlnAspGlnArgAlaGlyArgArgAspPh
eGlnThrAlaPheAspValPheHisAlaCysArgValGlnLeuValAspPheAlaGlnGlnGlyPheGlyGlyAspAspAsnAlaArgThrAspGluAlaValG
lnThrPheMetGlnAspAlaAlaArgAsnGlnAlaGlnAsnGlyPhePheAlaAlaAspAsnGlnGlyMetThrArgIleValAlaAlaLeuGluAlaHisHis
AlaSerGlyPhePheArgGlnProValAsnAspPheThrPheThrLeuValAlaProLeuCysAlaAspTyrTyrAsnIlePheSerHisSerHisIleThr
XxxArgTyr-435
Antigenic Index - Jameson-Wolf (SEQ. ID. NO. 24422)
1-MetMetGlnHisAsnArgPhePheAlaValGlyAlaGlyGlyAspAspGlyAspArgArgThrAlaAspPhePh
eAsnProPheGlnIleCysPheGlyIleGlyArgCysValValAlaPheHisAlaGluSerGlyPheAlaProThr
GlyHisGlyPheValAsnArgLeuAlaGlyPheTyrArgIleArgAlaAlaArgGlnAspValGlyPheAlaAlaV
alGlyGlnPheValAlaAspAlaAspIleAspGlyPheAsnAlaValHisTyrIleGluPheGlyAsnThrHisTh
rGlyAsnAlaValAspLeuAspGlyAlaPheGlnGlyGlyGlyIleLysProAlaAlaAlaAlaCysAlaSerGly
TyrArgThrGluPheValSerAlaPheCysGlnThrCysSerAspPheValGluGlnPheGlyArgGluArgAlaA
rgThrAspAlaArgGlyIleGlyPheAspAspAlaGlnAsnIleIleGlnHisLeuArgAlaTyrAlaArgAlaCy
sArgSerArgAlaGlyGluAlaValGlyArgSerAsnGluGlyValSerAlaValValAspValGlnGlnArgThr
LeuArgAlaPheLysGlnGlnPhePheAlaValPheValPhePheValGlnHisAlaGlyHisValGlyAsnHisA
rgArgAsnAlaArgArgAspPhePheAspAsnArgHisHisValPheArgPheHisArgLeuGlyIleValGlnMe
tLeuGlnLeuAspValValIleSerLysAspGlyIleGlnPhePheThrGlnPhePheArgMetGlnGlnIleGly
GlyAlaAsnGlyAlaAlaCysHisPheValPheValGlyArgAlaAspAlaAlaAlaGlyArgAlaAspPheAlaP
heAlaAlaArgCysPheSerGlyLeuValGluArgAspValIleArgGlnAspGlnArgAlaGlyArgArgAspPh
eGlnThrAlaPheAspValPheHisAlaCysArgValGlnLeuValAspPheAlaGlnGlnGlyPheGlyGlyAsp
AspAsnAlaArgThrAspGluAlaValGlnThrPheMetGlnAspAlaAlaArgAsnGlnAlaGlnAsnGlyPheP
heAlaAlaAspAsnGlnGlyMetThrArgIleValAlaAlaLeuGluAlaHisHisAlaSerGlyPhePheArgGl
nProValAsnAspPheThrPheThrLeuValAlaProLeuCysAlaAspTyrTyrAsnIlePheSerHisSerHis
IleThrXxxArgTyr-435
Hydrophilic Regions - Hopp-Woods (SEQ. ID. NO. 24422)
1-MetMetGlnHisAsnArgPhePheAlaValGlyAlaGlyGlyAspAspGlyAspArgArgThrAlaAspPhePh
eAsnProPheGlnIleCysPheGlyIleGlyArgCysValValAlaPheHisAlaGluSerGlyPheAlaProThr
GlyHisGlyPheValAsnArgLeuAlaGlyPheTyrArgIleArgAlaAlaArgGlnAspValGlyPheAlaAlaV
alGlyGlnPheValAlaAspAlaAspIleAspGlyPheAsnAlaValHisTyrIleGluPheGlyAsnThrHisTh
rGlyAsnAlaValAspLeuAspGlyAlaPheGlnGlyGlyGlyIleLysProAlaAlaAlaAlaCysAlaSerGly
TyrArgThrGluPheValSerAlaPheCysGlnThrCysSerAspPheValGluGlnPheGlyArgGluArgAlaA
rgThrAspAlaArgGlyIleGlyPheAspAspAlaGlnAsnIleIleGlnHisLeuArgAlaTyrAlaArgAlaCy
sArgSerArgAlaGlyGluAlaValGlyArgSerAsnGluGlyValSerAlaValValAspValGlnGlnArgThr
LeuArgAlaPheLysGlnGlnPhePheAlaValPheValPhePheValGlnHisAlaGlyHisValGlyAsnHisA
rgArgAsnAlaArgArgAspPhePheAspAsnArgHisHisValPheArgPheHisArgLeuGlyIleValGlnMe
tLeuGlnLeuAspValValIleSerLysAspGlyIleGlnPhePheThrGlnPhePheArgMetGlnGlnIleGly
GlyAlaAsnGlyAlaAlaCysHisPheValPheValGlyArgAlaAspAlaAlaAlaGlyArgAlaAspPheAlaP
heAlaAlaArgCysPheSerGlyLeuValGluArgAspValIleArgGlnAspGlnArgAlaGlyArgArgAspPh
eGlnThrAlaPheAspValPheHisAlaCysArgValGlnLeuValAspPheAlaGlnGlnGlyPheGlyGlyAsp
AspAsnAlaArgThrAspGluAlaValGlnThrPheMetGlnAspAlaAlaArgAsnGlnAlaGlnAsnGlyPheP
heAlaAlaAspAsnGlnGlyMetThrArgIleValAlaAlaLeuGluAlaHisHisAlaSerGlyPhePheArgGl
nProValAsnAspPheThrPheThrLeuValAlaProLeuCysAlaAspTyrTyrAsnIlePheSerHisSerHis
IleThrXxxArgTyr-435
a907
AMPHI Regions - AMPHI
SEQ. ID. NO. 24423     1-MetLysLysProThrAspThrLeuProValAsnLeuGlnArgArgArgLe
uLeuCysAlaAlaGlyAlaLeuLeuLeuSerProLeuAlaGlnAlaGlyAlaGlnArgGluGluThrLeuAlaAspAspValAlaSerValMetArgSerSerV
a1GlySerIleAsnProProArgLeuValPheAspAsnProLysGluGlyGluArgTrpLeuSerAlaMetSerAlaArgLeuAlaArgPheValProAspGlu
GluGluArgArgArgLeuLeuValAsnIleGlnTyrGluSerSerArgAlaGlyLeuAspThrGlnIleValLeuGlyLeuIleGluValGluSerAlaPheAr
gGlnTyrAlaIleSerGlyValGlyAlaArgGlyLeuMetGlnValMetProPheTrpLysAsnTyrIleGlyLysProAlaHisAsnLeuPheAspIleArgT
hrAsnLeuArgTyrGlyCysThrIleLeuArgHisTyrArgAsnLeuGluLysGlyAsnIleValArgAlaLeuAlaArgPheAsnGlySerLeuGlySerAsn
LysTyrProAsnAlaValLeuGlyAlaTrpArgAsnArgTrpGlnTrpArg-207
Antigenic Index - Jameson-Wolf (SEQ. ID. NO. 24423)
1-MetLysLysProThrAspThrLeuProValAsnLeuGlnArgArgArgLeuLeuCysAlaAlaGlyAlaLeuLe
uLeuSerProLeuAlaGlnAlaGlyAlaGlnArgGluGluThrLeuAlaAspAspValAlaSerValMetArgSer
SerValGlySerIleAsnProProArgLeuValPheAspAsnProLysGluGlyGluArgTrpLeuSerAlaMetS
erAlaArgLeuAlaArgPheValProAspGluGluGluArgArgArgLeuLeuValAsnIleGlnTyrGluSerSe
rArgAlaGlyLeuAspThrGlnIleValLeuGlyLeuIleGluValGluSerAlaPheArgGlnTyrAlaIleSer
GlyValGlyAlaArgGlyLeuMetGlnValMetProPheTrpLysAsnTyrIleGlyLysProAlaHisAsnLeuP
heAspIleArgThrAsnLeuArgTyrGlyCysThrIleLeuArgHisTyrArgAsnLeuGluLysGlyAsnIleVa
lArgAlaLeuAlaArgPheAsnGlySerLeuGlySerAsnLysTyrProAsnAlaValLeuGlyAlaTrpArgAsn
ArgTrpGlnTrpArg-207
Hydrophilic Regions - Hopp-Woods (SEQ. ID. NO. 24423)
1-MetLysLysProThrAspThrLeuProValAsnLeuGlnArgArgArgLeuLeuCysAlaAlaGlyAlaLeuLe
uLeuSerProLeuAlaGlnAlaGlyAlaGlnArgGluGluThrLeuAlaAspAspValAlaSerValMetArgSer TABLE 1-continued SerValGlySerIleAsnProProArgLeuValPheAspAsnProLysGluGlyGluArgTrpLeuSerAlaMetSerAlaArgLeuAlaArgPheValProAspGluGluGluArgArgArgLeuLeuValAsnIleGlnTyrGluSerSerArgAlaGlyLeuAspThrGlnIleValLeuGlyLeuIleGluValGluSerAlaPheArgGlnTyrAlaIleSerGlyValGlyAlaArgGlyLeuMetGlnValMetProPheTrpLysAsnTyrIleGlyLysProAlaHisAsnLeuPheAspIleArgThrAsnLeuArgTyrGlyCysThrIleLeuArgHisTyrArgAsnLeuGluLysGlyAsnIleValArgAlaLeuAlaArgPheAsnGlySerLeuGlySerAsnLysTyrProAsnAlaValLeuGlyAlaTrpArgAsnArgTrpGlnTrpArg-207 a908
AMPHI Regions - AMPHI
SEQ. ID. NO. 24424   1-MetArgLysSerArgLeuSerGlnTyrLysGlnAsnLysLeuIleGluLeuPheValAlaGlyValThrAlaArgThrAlaAlaGluLeuValGlyValAsnLysAsnThrAlaAlaTyrTyrPheHisArgLeuArgLeuLeuIleTyrGlnAsnSerProHisLeuGluMetPheAspGlyGluValGluAlaAspGluSerTyrPheGlyGlyGlnArgLysGlyLysArgGlyArgGlyAlaAlaGlyLysValAlaValPheGlyLeuLeuLysArgAsnGlyLysValTyrThrValThrValProAsnThrGlnThrAlaThrLeuPheProIleIleArgGluGlnValLysProAspSerIleValTyrThrAspCysTyrArgSerTyrAspValLeuAspValArgGluPheSerHisPheSerPheAlaGluThrSerPheSerTyrGlnSerGlnHisThrPheCysArgThrThrLysProTyr-166
Antigenic Index - Jameson-Wolf (SEQ. ID. NO. 24424)
1-MetArgLysSerArgLeuSerGlnTyrLysGlnAsnLysLeuIleGluLeuPheValAlaGlyValThrAlaArgThrAlaAlaGluLeuValGlyValAsnLysAsnThrAlaAlaTyrTyrPheHisArgLeuArgLeuLeuIleTyrGlnAsnSerProHisLeuGluMetPheAspGlyGluValGluAlaAspGluSerTyrPheGlyGlyGlnArgLysGlyLysArgGlyArgGlyAlaAlaGlyLysValAlaValPheGlyLeuLeuLysArgAsnGlyLysValTyrThrValThrValProAsnThrGlnThrAlaThrLeuPheProIleIleArgGluGlnValLysProAspSerIleValTyrThrAspCysTyrArgSerTyrAspValLeuAspValArgGluPheSerHisPheSerPheAlaGluThrSerPheSerTyrGlnSerGlnHisThrPheCysArgThrThrLysProTyr-166
Hydrophilic Regions - Hopp-Woods (SEQ. ID. NO. 24424)
1-MetArgLysSerArgLeuSerGlnTyrLysGlnAsnLysLeuIleGluLeuPheValAlaGlyValThrAlaArgThrAlaAlaGluLeuValGlyValAsnLysAsnThrAlaAlaTyrTyrPheHisArgLeuArgLeuLeuIleTyrGlnAsnSerProHisLeuGluMetPheAspGlyGluValGluAlaAspGluSerTyrPheGlyGlyGlnArgLysGlyLysArgGlyArgGlyAlaAlaGlyLysValAlaValPheGlyLeuLeuLysArgAsnGlyLysValTyrThrValThrValProAsnThrGlnThrAlaThrLeuPheProIleIleArgGluGlnValLysProAspSerIleValTyrThrAspCysTyrArgSerTyrAspValLeuAspValArgGluPheSerHisPheSerPheAlaGluThrSerPheSerTyrGlnSerGlnHisThrPheCysArgThrThrLysProTyr-166
a909
AMPHI Regions - AMPHI
SEQ. ID. NO. 24425   71-GlyAsnAsnAlaAspGlu-76
Antigenic Index - Jameson-Wolf
SEQ. ID. NO. 24426   22-ThrTyrGlnAspGlyAsnGlyLysThrAlaValArgGlnLysTyrProAlaGly-39
SEQ. ID. NO. 24427   45-GlnAspGlySerTyrSerLysAsnMetAsnTyrAsnGlnTyrArgProGluArgHisAla-64
SEQ. ID. NO. 24428   68-AsnGlnThrGlyAsnAsnAlaAspGluGluHisArgGlnHisTrpGlnLysProLysPheGlnAsnArg-90
Hydrophilic Regions - Hopp-Woods
SEQ. ID. NO. 24429   23-TyrGlnAspGlyAsnGlyLysThrAlaValArgGlnLysTyr-36
SEQ. ID. NO. 24430   58-TyrArgProGluArgHisAla-64
SEQ. ID. NO. 24431   72-AsnAsnAlaAspGluGluHisArgGlnHisTrpGln-83
SEQ. ID. NO. 24432   85-ProLysPheGlnAsnArg-90
a910
AMPHI Regions - AMPHI
SEQ. ID. NO. 24433   22-SerAlaGluArgGlnIle-27
SEQ. ID. NO. 24434   39-LysAlaValLysMetLeuGlu-45
SEQ. ID. NO. 24435   58-AspHisTrpGlyLysPro-63
SEQ. ID. NO. 24436   69-AlaTyrLysAspGlyArg-74
Antigenic Index - Jameson-Wolf
SEQ. ID. NO. 24437   19-AlaGlyAspSerAlaGluArgGlnIleTyr-28
SEQ. ID. NO. 24438   30-AspProTyrPheGluGlnAsnArgThrLysAlaValLysMetLeuGluGlnArgGlyTyrGln-50
SEQ. ID. NO. 24439   52-HisAspValAspAlaAspAspHisTrpGly-61
SEQ. ID. NO. 24440   68-GluAlaTyrLysAspGlyArgGluTyrAsp-77
SEQ. ID. NO. 24441   83-ProAspLeuLysIleIleLysGluGlnLeuAspArg-94
Hydrophilic Regions - Hopp-Woods
SEQ. ID. NO. 24442   21-AspSerAlaGluArgGlnIleTyr-28
SEQ. ID. NO. 24443   32-TyrPheGluGlnAsnArgThrLysAlaValLysMetLeuGluGlnArgGly-48
SEQ. ID. NO. 24444   52-HisAspValAspAlaAspAspHisTrpGly-61
SEQ. ID. NO. 24445   68-GluAlaTyrLysAspGlyArgGluTyrAsp-77
SEQ. ID. NO. 24446   86-LysIleIleLysGluGlnLeuAspArg-94
a911
AMPHI Regions - AMPHI
SEQ. ID. NO. 24447   6-LeuGluPheTrpValGlyLeuPhe-13
SEQ. ID. NO. 24448   43-ValTyrAlaAspPheGlyAspIleGly-51
SEQ. ID. NO. 24449   97-ValSerAlaGlnIle-101
SEQ. ID. NO. 24450   118-GlyAspThrGluAsnLeuAla-124
SEQ. ID. NO. 24451   140-AsnLeuIleGlyLysPheMetThrSerPhe-149
Antigenic Index - Jameson-Wolf
SEQ. ID. NO. 24452   1-MetLysLysAsnIle-5
SEQ. ID. NO. 24453   35-GlyGlySerAspLysThrTyr-41
SEQ. ID. NO. 24454   48-GlyAspIleGlyGlyLeuLysValAsnAlaProValLys-60
SEQ. ID. NO. 24455   74-LeuAspProLysSerTyrGlnAlaArgValArgLeuAspLeuAspGlyLysTyrGlnPheSerSerAspVal-97
SEQ. ID. NO. 24456   103-ThrSerGlyLeuLeuGly-108
SEQ. ID. NO. 24457   115-GlnGlnGlyGlyAspThrGluAsn-122
SEQ. ID. NO. 24458   149-PheAlaGluLysAsnAlaAspGlyGlyAsnAlaGluLysAlaAlaGlu-164
Hydrophilic Regions - Hopp-Woods
SEQ. ID. NO. 24459   1-MetLysLysAsnIle-5
SEQ. ID. NO. 24460   36-GlySerAspLysThr-40
SEQ. ID. NO. 24461   74-LeuAspProLysSerTyrGlnAlaArgValArgLeuAspLeuAspGly-89

TABLE 1-continued

| | |
|---|---|
| SEQ. ID. NO. 24462 | 116-GlnGlyGlyAspThrGluAsn-122 |
| SEQ. ID. NO. 24463 | 149-PheAlaGluLysAsnAlaAspGlyGlyAsnAlaGluLysAlaAlaGlu-164 | a912
AMPHI Regions - AMPHI

| | |
|---|---|
| SEQ. ID. NO. 24464 | 24-ProAlaAspAlaValAsnGlnIle-31 |
| SEQ. ID. NO. 24465 | 38-ValLeuSerIleLeu-42 |
| SEQ. ID. NO. 24466 | 62-PheAspPheGlnArgMetThrAlaLeuAlaValGlyAsnProTrpArgThrAlaSerAspAlaGlnLys-84 |
| SEQ. ID. NO. 24467 | 89-LysGluPheGlnThrLeu-94 |
| SEQ. ID. NO. 24468 | 169-TyrArgAsnGlnPheGlyGluIleIleLysAlaLys-180 |

Antigenic Index - Jameson-Wolf

| | |
|---|---|
| SEQ. ID. NO. 24469 | 1-MetLysLysSerSer-5 |
| SEQ. ID. NO. 24470 | 29-AsnGlnIleArgGlnAsnAlaThrGln-37 |
| SEQ. ID. NO. 24471 | 42-LeuLysSerGlyAspAlaAsnThrAlaArgGlnLysAlaGluAla-56 |
| SEQ. ID. NO. 24472 | 74-AsnProTrpArgThrAlaSerAspAlaGlnLysGlnAlaLeuAlaLysGluPhe-91 |
| SEQ. ID. NO. 24473 | 104-LeuLysLeuLysAsnAlaAsnValAsnValLysAspAsnProIleValAsnLysGlyGlyLysGluIleIleVal-128 |
| SEQ. ID. NO. 24474 | 130-AlaGluValGlyValProGlyGlnLysProValAsn-141 |
| SEQ. ID. NO. 24475 | 146-ThrTyrGlnSerGlyGlyLysTyrArgThr-155 |
| SEQ. ID. NO. 24476 | 169-TyrArgAsnGlnPhe-173 |
| SEQ. ID. NO. 24477 | 177-IleLysAlaLysGlyValAspGlyLeuIleAla-187 |
| SEQ. ID. NO. 24478 | 189-LeuLysAlaLysAsnGlySerLys-196 |

Hydrophilic Regions - Hopp-Woods

| | |
|---|---|
| SEQ. ID. NO. 24479 | 1-MetLysLysSerSer-5 |
| SEQ. ID. NO. 24480 | 31-IleArgGlnAsnAla-35 |
| SEQ. ID. NO. 24481 | 43-LysSerGlyAspAlaAsnThrAlaArgGlnLysAlaGluAla-56 |
| SEQ. ID. NO. 24482 | 78-ThrAlaSerAspAlaGlnLysGlnAlaLeuAlaLysGluPhe-91 |
| SEQ. ID. NO. 24483 | 104-LeuLysLeuLysAsn-108 |
| SEQ. ID. NO. 24484 | 110-AsnValAsnValLysAspAsnProIleVal-119 |
| SEQ. ID. NO. 24485 | 121-LysGlyGlyLysGluIleIleVal-128 |
| SEQ. ID. NO. 24486 | 134-ValProGlyGlnLysProValAsn-141 |
| SEQ. ID. NO. 24487 | 177-IleLysAlaLysGlyValAsp-183 |
| SEQ. ID. NO. 24488 | 189-LeuLysAlaLysAsnGlySerLys-196 | a913
AMPHI Regions - AMPHI

| | |
|---|---|
| SEQ. ID. NO. 24489 | 22-GluThrArgProAlaAspProTyrGluGlyTyrAsnArg-34 |
| SEQ. ID. NO. 24490 | 53-ArgGlyTyrArgLysValAlaProLys-61 |
| SEQ. ID. NO. 24491 | 66-GlyValSerAsnPhePheAsnAsnLeuCysAspValValSer-79 |
| SEQ. ID. NO. 24492 | 107-LeuGlyGlyLeuIleAspIleAlaGlyAla-116 |
| SEQ. ID. NO. 24493 | 151-ValArgAspAlaLeuGlyThrGlyIleThrSerValTyrSer-164 |
| SEQ. ID. NO. 24494 | 193-AspLeuThrAspSerLeuAspGluAlaAla-202 |
| SEQ. ID. NO. 24495 | 238-LeuValGluSerAla-242 |
| SEQ. ID. NO. 24496 | 257-SerGluThrGlnAla-261 |

Antigenic Index - Jameson-Wolf

| | |
|---|---|
| SEQ. ID. NO. 24497 | 21-AlaGluThrArgProAlaAspProTyrGluGlyTyrAsn-33 |
| SEQ. ID. NO. 24498 | 39-PheAsnAspGlnAlaAspArgTyr-46 |
| SEQ. ID. NO. 24499 | 51-AlaAlaArgGlyTyrArgLysValAlaProLysProValArgAla-65 |
| SEQ. ID. NO. 24500 | 81-GlySerAsnIleLeu-85 |
| SEQ. ID. NO. 24501 | 87-LeuAspIleLysArgAlaSerGluAspLeuVal-97 |
| SEQ. ID. NO. 24502 | 117-GlyGlyIleProAspAsnLysAsnThrLeuGlyAsp-128 |
| SEQ. ID. NO. 24503 | 132-SerTrpGlyTrpLysAsnSerAsn-139 |
| SEQ. ID. NO. 24504 | 149-SerThrValArgAspAlaLeu-155 |
| SEQ. ID. NO. 24505 | 163-TyrSerProLysAsnIle-168 |
| SEQ. ID. NO. 24506 | 172-ThrProValGlyArgTrpGly-178 |
| SEQ. ID. NO. 24507 | 185-ValSerThrArgGluGlyLeuLeuAspLeuThrAspSerLeuAspGluAlaAlaIleAspLysTyrSerTyrThrArgAspLeuTyrMet-214 |
| SEQ. ID. NO. 24508 | 216-ValArgAlaArgGlnThrGlyAlaThrProAlaGluGlyThrGluAspAsnIleAspIleAspGluLeuValGluSerAlaGluThrGlyAlaAla-247 |
| SEQ. ID. NO. 24509 | 250-AlaValGlnGluAspSerValSerGluThrGlnAlaGluAlaAlaGlyGluAlaGluThrGlnProGlyThrGlnProGlyThrGlnPro-279 |

Hydrophilic Regions - Hopp-Woods

| | |
|---|---|
| SEQ. ID. NO. 24510 | 21-AlaGluThrArgProAlaAspProTyrGluGlyTyrAsn-33 |
| SEQ. ID. NO. 24511 | 40-AsnAspGlnAlaAsp-44 |
| SEQ. ID. NO. 24512 | 53-ArgGlyTyrArgLysValAlaProLysProValArg-64 |
| SEQ. ID. NO. 24513 | 87-LeuAspIleLysArgAlaSerGluAspLeuVal-97 |
| SEQ. ID. NO. 24514 | 118-GlyIleProAspAsnLysAsnThrLeu-126 |
| SEQ. ID. NO. 24515 | 150-ThrValArgAspAlaLeu-155 |
| SEQ. ID. NO. 24516 | 186-SerThrArgGluGlyLeuLeuAspLeuThrAspSerLeuAspGluAlaAlaIleAsp-204 |
| SEQ. ID. NO. 24517 | 216-ValArgAlaArgGlnThrGly-222 |
| SEQ. ID. NO. 24518 | 224-ThrProAlaGluGlyThrGluAspAsnIleAspIleAspGluLeuValGluSerAlaGluThrGlyAlaAla-247 |
| SEQ. ID. NO. 24519 | 250-AlaValGlnGluAspSerValSerGluThrGlnAlaGluAlaAlaGlyGluAlaGluThrGlnPro-271 | a914-2
AMPHI Regions - AMPHI

| | |
|---|---|
| SEQ. ID. NO. 24520 | 6-LeuGlyIleLeuThrAlaCysAlaAlaMet-15 |
| SEQ. ID. NO. 24521 | 17-AlaPheAlaAspArgIleGlyAspLeu-25 |
| SEQ. ID. NO. 24522 | 65-PheGlnLysThrPheGlu-70 |
| SEQ. ID. NO. 24523 | 81-GlnLysValArgGlnAlaCys-87 |

Antigenic Index - Jameson-Wolf

| | |
|---|---|
| SEQ. ID. NO. 24524 | 18-PheAlaAspArgIleGlyAspLeuGluAlaArgLeuAlaGlnLeuGluHisArgValAlaVal-38 |
| SEQ. ID. NO. 24525 | 40-GluSerGlySerAsnThrValLys-47 |
| SEQ. ID. NO. 24526 | 50-LeuPheGlySerAsnSer-55 |
| SEQ. ID. NO. 24527 | 64-ProPheGlnLysThrPheGluAlaSerAspArgAsnGluGlyValAlaArgGlnLysValArgGlnAlaCysAsnArgGluThrSerAla-93 |
| SEQ. ID. NO. 24528 | 95-PheCysGluAspGluAlaIleArgCysArgLysPheAsp-107 |

Hydrophilic Regions - Hopp-Woods

| | |
|---|---|
| SEQ. ID. NO. 24529 | 18-PheAlaAspArgIleGlyAspLeuGluAlaArgLeuAlaGlnLeuGluHisArgValAlaVal-38 |

TABLE 1-continued

| | |
|---|---|
| SEQ. ID. NO. 24530 | 67-LysThrPheGluAlaSerAspArgAsnGluGlyValAlaArgGlnLysValArgGlnAlaCysAsnArgGluThrSer-92 |
| SEQ. ID. NO. 24531 | 95-PheCysGluAspGluAlaIleArgCysArgLysPheAsp-107 | a915
AMPHI Regions - AMPHI

| | |
|---|---|
| SEQ. ID. NO. 24532 | 9-ValAlaValSerAlaLeuSerAlaCysArgGlnAla-20 |
| SEQ. ID. NO. 24533 | 31-IleSerAspArgSerVal-36 |
| SEQ. ID. NO. 24534 | 67-SerThrIleLysGlnMetPheGlyTyrThrLysLeuProGluGluProLysGlyIleArgValIleTyrValThrAspMetGlyAsnValThrAspTrpThr-100 |
| SEQ. ID. NO. 24535 | 139-GlnAlaGluLysPhe-143 |

Antigenic Index - Jameson-Wolf

| | |
|---|---|
| SEQ. ID. NO. 24536 | 15-SerAlaCysArgGlnAlaGluGluGlyProProProLeuProArgGlnIleSerAspArgSerValGlyHis-38 |
| SEQ. ID. NO. 24537 | 43-AsnLeuThrGluHisAsnGlyProLysAla-52 |
| SEQ. ID. NO. 24538 | 57-AsnGlyLysProAspGlnProVal-64 |
| SEQ. ID. NO. 24539 | 75-TyrThrLysLeuProGluGluProLysGlyIle-85 |
| SEQ. ID. NO. 24540 | 97-ThrAspTrpThrAsnProAsnAlaAspThrGluTrpMetAspAlaLysLys-113 |
| SEQ. ID. NO. 24541 | 125-GlyMetGlyAlaGluAspAlaLeuProPheGlyAsnLysGluGlnAlaGluLysPheAlaLysAspLysGlyGlyLysValValGlyPheAspAspMetProAspThrTyr-161 |

Hydrophilic Regions - Hopp-Woods

| | |
|---|---|
| SEQ. ID. NO. 24542 | 18-ArgGlnAlaGluGluGlyProProProLeu-27 |
| SEQ. ID. NO. 24543 | 30-GlnIleSerAspArgSerVal-36 |
| SEQ. ID. NO. 24544 | 46-GluHisAsnGlyProLys-51 |
| SEQ. ID. NO. 24545 | 58-GlyLysProAspGln-62 |
| SEQ. ID. NO. 24546 | 77-LysLeuProGluGluProLysGlyIle-85 |
| SEQ. ID. NO. 24547 | 103-AsnAlaAspThrGluTrpMetAspAlaLysLys-113 |
| SEQ. ID. NO. 24548 | 127-GlyAlaGluAspAlaLeu-132 |
| SEQ. ID. NO. 24549 | 135-GlyAsnLysGluGlnAlaGluLysPheAlaLysAspLysGlyGlyLys-150 |
| SEQ. ID. NO. 24550 | 155-AspAspMetProAsp-159 | a917
AMPHI Regions - AMPHI

| | |
|---|---|
| SEQ. ID. NO. 24551 | 6-ProLeuAlaValLeuThrAlaLeuLeuLeu-15 |
| SEQ. ID. NO. 24552 | 37-ValLeuLysIleTyrAsnTrpSerGluTyrValAspProGluThrValAlaAsp-54 |
| SEQ. ID. NO. 24553 | 99-IleLysAlaGlyAlaTyrGlnLysIleAspLysSerLeu-111 |
| SEQ. ID. NO. 24554 | 124-ArgLeuMetAspGlyValAspPro-131 |
| SEQ. ID. NO. 24555 | 152-ArgValLysLysAlaLeu-157 |
| SEQ. ID. NO. 24556 | 188-AspSerAlaAlaGlu-192 |
| SEQ. ID. NO. 24557 | 206-AsnSerSerAsnThrGluAspIleArgGluAlaThr-217 |
| SEQ. ID. NO. 24558 | 292-AlaLysAsnValAlaAsnAlaHisLysTyrIleAsnAspPheLeuAsp-307 |
| SEQ. ID. NO. 24559 | 325-LysProAlaArgGluLeuMetGluAsp-333 |

Antigenic Index - Jameson-Wolf

| | |
|---|---|
| SEQ. ID. NO. 24560 | 18-CysGlyGlySerAspLysProProAlaGluLysProAlaProAlaGluAsnArgAsnVal-37 |
| SEQ. ID. NO. 24561 | 44-SerGluTyrValAspProGluThrValAlaAspPheGluLysLysAsnGlyIleLysValThr-64 |
| SEQ. ID. NO. 24562 | 68-TyrAspSerAspGluThrLeuGluSerLysValLeuThrGlyLysSerGlyTyrAsp-86 |
| SEQ. ID. NO. 24563 | 102-GlyAlaTyrGlnLysIleAspLysSerLeuIleProAsnTyrLysHisLeuAsnProGluMetMetArgLeuMetAspGlyValAspProGlyHisGluTyr-135 |
| SEQ. ID. NO. 24564 | 149-AsnThrGluArgValLysLysAlaLeuGlyThrAspLysLeuProAspAsnGln-166 |
| SEQ. ID. NO. 24565 | 171-PheAspProGluTyrThrSerLysLeuLysGlnCysGly-183 |
| SEQ. ID. NO. 24566 | 201-LeuGlyLysAsnProAsnSerSerAsnThrGluAspIleArgGluAlaThrAlaLeuLeuLysLysAsnArgProAsnIleLysArgPheThrSerSerGlyPheIle-236 |
| SEQ. ID. NO. 24567 | 238-AspLeuAlaArgGlyAspThr-244 |
| SEQ. ID. NO. 24568 | 255-AsnIleAlaLysArgArgAlaGluGluAlaGlyGlyLysGluLysIleArgValMetMetProLysGluGlyValGly-280 |
| SEQ. ID. NO. 24569 | 287-ValIleProLysAspAlaLysAsnValAlaAsn-297 |
| SEQ. ID. NO. 24570 | 305-PheLeuAspProGluValSerAlaLysAsnGlyAsn-316 |
| SEQ. ID. NO. 24571 | 320-TyrAlaProSerSerLysProAlaArgGluLeuMetGluAspGluPheLysAsnAspAsnThrIlePheProThrGluGluAspLeuLysAsn-350 |
| SEQ. ID. NO. 24572 | 368-GlnTrpGlnAspValLysAlaGlyLys-376 |

Hydrophilic Regions - Hopp-Woods

| | |
|---|---|
| SEQ. ID. NO. 24573 | 19-GlyGlySerAspLysProProAlaGluLysProAlaProAlaGluAsnArgAsnVal-37 |
| SEQ. ID. NO. 24574 | 47-ValAspProGluThrValAlaAspPheGluLysLysAsnGlyIle-61 |
| SEQ. ID. NO. 24575 | 68-TyrAspSerAspGluThrLeuGluSerLysValLeuThr-80 |
| SEQ. ID. NO. 24576 | 105-GlnLysIleAspLysSerLeu-111 |
| SEQ. ID. NO. 24577 | 121-GluMetMetArgLeuMetAspGlyValAspProGlyHis-133 |
| SEQ. ID. NO. 24578 | 149-AsnThrGluArgValLysLysAlaLeuGlyThrAspLysLeuProAspAsnGln-166 |
| SEQ. ID. NO. 24579 | 174-GluTyrThrSerLysLeuLysGln-181 |
| SEQ. ID. NO. 24580 | 204-AsnProAsnSerSerAsnThrGluAspIleArgGluAlaThrAlaLeuLeuLysLysAsnArgProAsnIleLysArgPheThr-231 |
| SEQ. ID. NO. 24581 | 238-AspLeuAlaArgGlyAspThr-244 |
| SEQ. ID. NO. 24582 | 255-AsnIleAlaLysArgArgAlaGluGluAlaGlyGlyLysGluLysIleArgValMetMetProLysGluGly-278 |
| SEQ. ID. NO. 24583 | 290-LysAspAlaLysAsnValAlaAsn-297 |
| SEQ. ID. NO. 24584 | 305-PheLeuAspProGluValSerAlaLysAsn-314 |
| SEQ. ID. NO. 24585 | 322-ProSerSerLysProAlaArgGluLeuMetGluAspGluPheLysAsnAspAsn-339 |
| SEQ. ID. NO. 24586 | 343-ProThrGluGluAspLeuLysAsn-350 |
| SEQ. ID. NO. 24587 | 370-GlnAspValLysAlaGlyLys-376 | a919
AMPHI Regions - AMPHI

| | |
|---|---|
| SEQ. ID. NO. 24588 | 13-IleAlaAlaAlaAlaIleLeu-18 |
| SEQ. ID. NO. 24589 | 24-LysSerIleGlnThrPheProGln-31 |
| SEQ. ID. NO. 24590 | 37-IleAsnGlyProAspArgProValGlyIleProAsp-48 |
| SEQ. ID. NO. 24591 | 76-AspPheAlaLysSerLeuGln-82 |
| SEQ. ID. NO. 24592 | 98-GlnAspValCysAlaGlnAlaPheGlnThrProVal-109 |
| SEQ. ID. NO. 24593 | 119-GluArgTyrPheThr-123 |
| SEQ. ID. NO. 24594 | 133-LeuAlaGlyThrValThrGlyTyrTyrGlu-142 |
| SEQ. ID. NO. 24595 | 161-GlyIleProAspAspPheIleSerValPro-170 |

TABLE 1-continued

| | |
|---|---|
| SEQ. ID. NO. 24596 | 176-ArgSerGlyLysAlaLeuValArgIleArgGln-186 |
| SEQ. ID. NO. 24597 | 191-SerGlyThrIleAspAsnThrGlyGlyThr-200 |
| SEQ. ID. NO. 24598 | 308-GlnGlyIleLysAlaTyrMetGlnGlnAsnProGlnArgLeuAlaGluValLeu-325 |
| SEQ. ID. NO. 24599 | 348-AlaLeuGlyThrProLeuMetGlyGluTyrAlaGlyAlaVal-361 |
| SEQ. ID. NO. 24600 | 382-ArgLysAlaLeuAsnArg-387 |

Antigenic Index - Jameson-Wolf

| | |
|---|---|
| SEQ. ID. NO. 24601 | 21-CysGlnSerLysSerIleGlnThr-28 |
| SEQ. ID. NO. 24602 | 30-ProGlnProAspThr-34 |
| SEQ. ID. NO. 24603 | 36-ValIleAsnGlyProAspArgProValGlyIleProAspProAlaGlyThr-52 |
| SEQ. ID. NO. 24604 | 54-ValGlyGlyGlyGly-58 |
| SEQ. ID. NO. 24605 | 76-AspPheAlaLysSerLeuGln-82 |
| SEQ. ID. NO. 24606 | 87-GlyCysAlaAsnLeuLysAsnArgGlnGlyTrpGln-98 |
| SEQ. ID. NO. 24607 | 121-TyrPheThrProTrp-125 |
| SEQ. ID. NO. 24608 | 143-ProValLeuLysGlyAspAspArgArgThrAlaGln-154 |
| SEQ. ID. NO. 24609 | 162-IleProAspAspPheIle-167 |
| SEQ. ID. NO. 24610 | 173-AlaGlyLeuArgSerGlyLysAlaLeuValArgIleArgGlnThrGlyLysAsnSerGlyThrIleAspAsnThrGlyGlyThrHis-201 |
| SEQ. ID. NO. 24611 | 215-ThrAlaIleLysGlyArgPheGluGlySerArgPheLeuProTyrHisThrArgAsnGlnIleAsnGlyGlyAlaLeuAspGlyLysAlaPro-245 |
| SEQ. ID. NO. 24612 | 250-AlaGluAspProValGlu-255 |
| SEQ. ID. NO. 24613 | 262-GlnGlySerGlyArgLeuLysThrProSerGlyLysTyrIleArg-276 |
| SEQ. ID. NO. 24614 | 278-GlyTyrAlaAspLysAsnGluHisPro-286 |
| SEQ. ID. NO. 24615 | 293-TyrMetAlaAspLysGlyTyrLeuLysLeuGlyGln-304 |
| SEQ. ID. NO. 24616 | 316-GlnAsnProGlnArgLeuAlaGlu-323 |
| SEQ. ID. NO. 24617 | 326-GlyGlnAsnProSer-330 |
| SEQ. ID. NO. 24618 | 337-LeuThrGlySerSerAsnAspGlyProVal-346 |
| SEQ. ID. NO. 24619 | 359-GlyAlaValAspArgHisTyr-365 |
| SEQ. ID. NO. 24620 | 379-ProValThrArgLysAlaLeuAsn-386 |
| SEQ. ID. NO. 24621 | 393-AspThrGlySerAlaIleLysGlyAlaValArg-403 |
| SEQ. ID. NO. 24622 | 409-GlyTyrGlyAspGluAlaGlyGluLeuAlaGlyLysGlnLysThrThr-424 |
| SEQ. ID. NO. 24623 | 431-LeuProAsnGlyMetLysProGluTyrArgPro-441 |

Hydrophilic Regions - Hopp-Woods

| | |
|---|---|
| SEQ. ID. NO. 24624 | 38-AsnGlyProAspArgProValGly-45 |
| SEQ. ID. NO. 24625 | 90-AsnLeuLysAsnArgGlnGlyTrp-97 |
| SEQ. ID. NO. 24626 | 144-ValLeuLysGlyAspAspArgArgThrAlaGln-154 |
| SEQ. ID. NO. 24627 | 175-LeuArgSerGlyLysAlaLeuValArgIleArgGlnThrGlyLysAsnSerGlyThrIleAspAsnThrGly-198 |
| SEQ. ID. NO. 24628 | 215-ThrAlaIleLysGlyArgPheGluGly-223 |
| SEQ. ID. NO. 24629 | 239-AlaLeuAspGlyLysAla-244 |
| SEQ. ID. NO. 24630 | 250-AlaGluAspProVal-254 |
| SEQ. ID. NO. 24631 | 265-GlyArgLeuLysThrProSer-271 |
| SEQ. ID. NO. 24632 | 279-TyrAlaAspLysAsnGluHis-285 |
| SEQ. ID. NO. 24633 | 317-AsnProGlnArgLeuAlaGlu-323 |
| SEQ. ID. NO. 24634 | 337-LeuThrGlySerSerAsnAspGlyPro-345 |
| SEQ. ID. NO. 24635 | 380-ValThrArgLysAlaLeuAsn-386 |
| SEQ. ID. NO. 24636 | 393-AspThrGlySerAlaIle-398 |
| SEQ. ID. NO. 24637 | 412-AspGluAlaGlyGluLeuAlaGlyLysGlnLysThr-423 |
| SEQ. ID. NO. 24638 | 434-GlyMetLysProGluTyrArgPro-441 | a919
AMPHI Regions - AMPHI

| | |
|---|---|
| SEQ. ID. NO. 24639 | 13-IleAlaAlaAlaIleLeu-18 |
| SEQ. ID. NO. 24640 | 24-LysSerIleGlnThrPheProGln-31 |
| SEQ. ID. NO. 24641 | 37-IleAsnGlyProAspArgProValGlyIleProAsp-48 |
| SEQ. ID. NO. 24642 | 76-AspPheAlaLysSerLeuGln-82 |
| SEQ. ID. NO. 24643 | 98-GlnAspValCysAlaGlnAlaPheGlnThrProVal-109 |
| SEQ. ID. NO. 24644 | 119-GluArgTyrPheThr-123 |
| SEQ. ID. NO. 24645 | 133-LeuAlaGlyThrValThrGlyTyrTyrGlu-142 |
| SEQ. ID. NO. 24646 | 161-GlyIleProAspAspPheIleSerValPro-170 |
| SEQ. ID. NO. 24647 | 176-ArgSerGlyLysAlaLeuValArgIleArgGln-186 |
| SEQ. ID. NO. 24648 | 191-SerGlyThrIleAspAsnThrGlyGlyThr-200 |
| SEQ. ID. NO. 24649 | 308-GlnGlyIleLysAlaTyrMetGlnGlnAsnProGlnArgLeuAlaGluValLeu-325 |
| SEQ. ID. NO. 24650 | 348-AlaLeuGlyThrProLeuMetGlyGluTyrAlaGlyAlaVal-361 |
| SEQ. ID. NO. 24651 | 382-ArgLysAlaLeuAsnArg-387 |

Antigenic Index - Jameson-Wolf

| | |
|---|---|
| SEQ. ID. NO. 24652 | 21-CysGlnSerLysSerIleGlnThr-28 |
| SEQ. ID. NO. 24653 | 30-ProGlnProAspThr-34 |
| SEQ. ID. NO. 24654 | 36-ValIleAsnGlyProAspArgProValGlyIleProAspProAlaGlyThr-52 |
| SEQ. ID. NO. 24655 | 54-ValGlyGlyGlyGly-58 |
| SEQ. ID. NO. 24656 | 76-AspPheAlaLysSerLeuGln-82 |
| SEQ. ID. NO. 24657 | 87-GlyCysAlaAsnLeuLysAsnArgGlnGlyTrpGln-98 |
| SEQ. ID. NO. 24658 | 121-TyrPheThrProTrp-125 |
| SEQ. ID. NO. 24659 | 143-ProValLeuLysGlyAspAspArgArgThrAlaGln-154 |
| SEQ. ID. NO. 24660 | 162-IleProAspAspPheIle-167 |
| SEQ. ID. NO. 24661 | 173-AlaGlyLeuArgSerGlyLysAlaLeuValArgIleArgGlnThrGlyLysAsnSerGlyThrIleAspAsnThrGlyGlyThrHis-201 |
| SEQ. ID. NO. 24662 | 215-ThrAlaIleLysGlyArgPheGluGlySerArgPheLeuProTyrHisThrArgAsnGlnIleAsnGlyGlyAlaLeuAspGlyLysAlaPro-245 |
| SEQ. ID. NO. 24663 | 250-AlaGluAspProValGlu-255 |
| SEQ. ID. NO. 24664 | 262-GlnGlySerGlyArgLeuLysThrProSerGlyLysTyrIleArg-276 |
| SEQ. ID. NO. 24665 | 278-GlyTyrAlaAspLysAsnGluHisPro-286 |
| SEQ. ID. NO. 24666 | 293-TyrMetAlaAspLysGlyTyrLeuLysLeuGlyGln-304 |
| SEQ. ID. NO. 24667 | 316-GlnAsnProGlnArgLeuAlaGlu-323 |
| SEQ. ID. NO. 24668 | 326-GlyGlnAsnProSer-330 |
| SEQ. ID. NO. 24669 | 337-LeuThrGlySerSerAsnAspGlyProVal-346 |
| SEQ. ID. NO. 24670 | 359-GlyAlaValAspArgHisTyr-365 |

TABLE 1-continued

| | |
|---|---|
| SEQ. ID. NO. 24671 | 379-ProValThrArgLysAlaLeuAsn-386 |
| SEQ. ID. NO. 24672 | 393-AspThrGlySerAlaIleLysGlyAlaValArg-403 |
| SEQ. ID. NO. 24673 | 409-GlyTyrGlyAspGluAlaGlyGluLeuAlaGlyLysGlnLysThrThr-424 |
| SEQ. ID. NO. 24674 | 431-LeuProAsnGlyMetLysProGluTyrArgPro-441 |

Hydrophilic Regions - Hopp-Woods

| | |
|---|---|
| SEQ. ID. NO. 24675 | 38-AsnGlyProAspArgProValGly-45 |
| SEQ. ID. NO. 24676 | 90-AsnLeuLysAsnArgGlnGlyTrp-97 |
| SEQ. ID. NO. 24677 | 144-ValLeuLysGlyAspAspArgArgThrAlaGln-154 |
| SEQ. ID. NO. 24678 | 175-LeuArgSerGlyLysAlaLeuValArgIleArgGlnThrGlyLysAsnSerGlyThrIleAspAsnThrGly-198 |
| SEQ. ID. NO. 24679 | 215-ThrAlaIleLysGlyArgPheGluGly-223 |
| SEQ. ID. NO. 24680 | 239-AlaLeuAspGlyLysAla-244 |
| SEQ. ID. NO. 24681 | 250-AlaGluAspProVal-254 |
| SEQ. ID. NO. 24682 | 265-GlyArgLeuLysThrProSer-271 |
| SEQ. ID. NO. 24683 | 279-TyrAlaAspLysAsnGluHis-285 |
| SEQ. ID. NO. 24684 | 317-AsnProGlnArgLeuAlaGlu-323 |
| SEQ. ID. NO. 24685 | 337-LeuThrGlySerSerAsnAspGlyPro-345 |
| SEQ. ID. NO. 24686 | 380-ValThrArgLysAlaLeuAsn-386 |
| SEQ. ID. NO. 24687 | 393-AspThrGlySerAlaIle-398 |
| SEQ. ID. NO. 24688 | 412-AspGluAlaGlyGluLeuAlaGlyLysGlnLysThr-423 |
| SEQ. ID. NO. 24689 | 434-GlyMetLysProGluTyrArgPro-441 | a920-2
AMPHI Regions - AMPHI

| | |
|---|---|
| SEQ. ID. NO. 24690 | 43-GlyGluPheProGluLeuGluProIleAla-52 |
| SEQ. ID. NO. 24691 | 118-IleLysGlnMetProAsp-123 |
| SEQ. ID. NO. 24692 | 135-LysAsnIleValAsnVal-140 |
| SEQ. ID. NO. 24693 | 163-LeuAspAsnProAlaAsn-168 |
| SEQ. ID. NO. 24694 | 190-ThrValThrAlaThrPheAspGlyPheAspThrSerAspArgSerLys-205 |
| SEQ. ID. NO. 24695 | 212-GlnAlaPheSerAspSerThr-218 |

Antigenic Index - Jameson-Wolf

| | |
|---|---|
| SEQ. ID. NO. 24696 | 40-LeuGlyTyrGlyGlu-44 |
| SEQ. ID. NO. 24697 | 49-GluProIleAlaLysAspArgLeu-56 |
| SEQ. ID. NO. 24698 | 66-ValThrGluLysGlyLysGluAsnMetIle-75 |
| SEQ. ID. NO. 24699 | 82-TyrGlnTyrArgSerAsnArgProValLysAspGlySerTyr-95 |
| SEQ. ID. NO. 24700 | 104-ThrPheTrpSerLysAsnLysAlaGlyTrp-113 |
| SEQ. ID. NO. 24701 | 120-GlnMetProAspAlaSerTyrCysGluGlnThrArgMetPheGlyLysAsnIleValAsnValGlyHisGluSerAlaAspThr-147 |
| SEQ. ID. NO. 24702 | 152-LysProValGlyGlnAsnLeuGlu-159 |
| SEQ. ID. NO. 24703 | 162-ProLeuAspAsnProAla-167 |
| SEQ. ID. NO. 24704 | 173-GluArgPheLysVal-177 |
| SEQ. ID. NO. 24705 | 181-PheArgGlyGluProLeuProAsnAla-189 |
| SEQ. ID. NO. 24706 | 194-ThrPheAspGlyPheAspThrSerAspArgSerLysThrHisLysThrGluAla-211 |
| SEQ. ID. NO. 24707 | 213-AlaPheSerAspSerThrAspAspLysGlyGluValAsp-225 |
| SEQ. ID. NO. 24708 | 237-AsnValGluHisLysAlaAspPheProAspGlnSerValCysGlnLysGlnAlaAsnTyrSer-257 |

Hydrophilic Regions - Hopp-Woods

| | |
|---|---|
| SEQ. ID. NO. 24709 | 49-GluProIleAlaLysAspArgLeu-56 |
| SEQ. ID. NO. 24710 | 66-ValThrGluLysGlyLysGluAsnMetIle-75 |
| SEQ. ID. NO. 24711 | 85-ArgSerAsnArgProValLysAspGlySer-94 |
| SEQ. ID. NO. 24712 | 107-SerLysAsnLysAlaGlyTrp-113 |
| SEQ. ID. NO. 24713 | 128-GluGlnThrArgMetPheGly-134 |
| SEQ. ID. NO. 24714 | 142-HisGluSerAlaAsp-146 |
| SEQ. ID. NO. 24715 | 173-GluArgPheLysVal-177 |
| SEQ. ID. NO. 24716 | 196-AspGlyPheAspThrSerAspArgSerLysThrHisLysThrGluAla-211 |
| SEQ. ID. NO. 24717 | 213-AlaPheSerAspSerThrAspAspLysGlyGluValAsp-225 |
| SEQ. ID. NO. 24718 | 237-AsnValGluHisLysAlaAspPheProAsp-246 |
| SEQ. ID. NO. 24719 | 248-SerValCysGlnLys-252 | a921
AMPHI Regions - AMPHI

| | |
|---|---|
| SEQ. ID. NO. 24720 | 10-IleValAlaValLeuSerGlyCysGlnSerIleTyrValProThrLeuThrGluIleProValAsn-31 |
| SEQ. ID. NO. 24721 | 33-IleAsnThrValLysThr-38 |
| SEQ. ID. NO. 24722 | 51-HisTrpThrAspValAlaLysIleSerAspGlu-61 |
| SEQ. ID. NO. 24723 | 72-GlyLysMetThrLysValGlnAlaAlaGlnTyrLeuAsnAsnPheArgLys-88 |
| SEQ. ID. NO. 24724 | 98-AspSerMetTyrGluIleTyrLeuArg-106 |
| SEQ. ID. NO. 24725 | 126-GlnAsnAlaLeuArgGlyTrpGlnGlnArg-135 |

Antigenic Index - Jameson-Wolf

| | |
|---|---|
| SEQ. ID. NO. 24726 | 36-ValLysThrGluAlaProAlaLysGlyPheArg-46 |
| SEQ. ID. NO. 24727 | 56-AlaLysIleSerAspGluAlaThrArg-64 |
| SEQ. ID. NO. 24728 | 72-GlyLysMetThrLys-76 |
| SEQ. ID. NO. 24729 | 84-AsnAsnPheArgLysArgLeuValGlyArgAsnAlaValAspAspSerMet-100 |
| SEQ. ID. NO. 24730 | 108-AlaIleAspSerGlnArgGlyAlaIleAsnThrGluGlnSerLys-122 |
| SEQ. ID. NO. 24731 | 128-AlaLeuArgGlyTrpGlnGlnArgTrpLysAsnMetAspValLysProAsnAsnProAla-147 |

Hydrophilic Regions - Hopp-Woods

| | |
|---|---|
| SEQ. ID. NO. 24732 | 36-ValLysThrGluAlaProAlaLysGlyPheArg-46 |
| SEQ. ID. NO. 24733 | 56-AlaLysIleSerAspGluAlaThrArg-64 |
| SEQ. ID. NO. 24734 | 86-PheArgLysArgLeuValGly-92 |
| SEQ. ID. NO. 24735 | 94-AsnAlaValAspAspSerMet-100 |
| SEQ. ID. NO. 24736 | 108-AlaIleAspSerGlnArgGlyAlaIleAsnThrGluGlnSerLys-122 |
| SEQ. ID. NO. 24737 | 136-TrpLysAsnMetAspValLysProAsnAsn-145 | a922
AMPHI Regions - AMPHI

| | |
|---|---|
| SEQ. ID. NO. 24738 | 16-LeuSerAlaCysThr-20 |
| SEQ. ID. NO. 24739 | 28-ArgAlaAsnGluAlaGlnAlaPro-35 |

TABLE 1-continued

| | |
|---|---|
| SEQ. ID. NO. 24740 | 72-ValArgArgPheValAspAsp-78 |
| SEQ. ID. NO. 24741 | 89-GluTrpGlnAspPhePheAspLys-96 |
| SEQ. ID. NO. 24742 | 104-ValLysIleMetHis-108 |
| SEQ. ID. NO. 24743 | 144-AspAspValAlaGln-148 |
| SEQ. ID. NO. 24744 | 172-GlySerPheArgValAlaAspAlaLeu-180 |
| SEQ. ID. NO. 24745 | 196-LysGluLeuValGluLeuLeuLysLeuAla-205 |
| SEQ. ID. NO. 24746 | 222-AlaMetGlyMetPro-226 |
| SEQ. ID. NO. 24747 | 245-HisArgAspIleTrpGlyAsnValGlyAspValAlaAlaSerIleAlaAsnTyrMetLysGlnHis-266 |
| SEQ. ID. NO. 24748 | 298-ArgThrValAlaAspLeuLysAlaTyr-306 |
| SEQ. ID. NO. 24749 | 335-TyrLeuGlyLeuAsnAsnPheTyrThr-343 |
| Antigenic Index - Jameson-Wolf | |
| SEQ. ID. NO. 24750 | 1-MetLysAsnArgLysIleLeu-7 |
| SEQ. ID. NO. 24751 | 22-MetGluAlaArgProProArgAlaAsnGluAlaGlnAlaProArgAlaAspGluMetLysLysGluSerArgProAlaPhe-48 |
| SEQ. ID. NO. 24752 | 61-ValSerAspSerGlyPhe-66 |
| SEQ. ID. NO. 24753 | 70-AlaAsnValArgArgPheValAspAspGluValGlyLysGlyAspPheSerArgAlaGluTrp-90 |
| SEQ. ID. NO. 24754 | 107-MetHisArgProSerThrSerArgPro-115 |
| SEQ. ID. NO. 24755 | 120-ArgThrGlyAsnSerGlyLysAlaLysPheArgGlyAlaArgArgPheTyrAlaGluAsnArgAlaLeuIle-143 |
| SEQ. ID. NO. 24756 | 145-AspValAlaGlnLysTyrGlyVal-152 |
| SEQ. ID. NO. 24757 | 163-IleGluThrAsnTyrGlyLysAsnThrGlySer-173 |
| SEQ. ID. NO. 24758 | 186-AspTyrProArgArgAlaGlyPhePhe-194 |
| SEQ. ID. NO. 24759 | 203-LysLeuAlaLysGluGluGlyGlyAsp-211 |
| SEQ. ID. NO. 24760 | 229-MetProSerSerTyrArgLysTrpAlaValAspTyrAspGlyAspGlyHisArgAspIle-248 |
| SEQ. ID. NO. 24761 | 266-HisGlyTrpArgThrGlyGlyLys-273 |
| SEQ. ID. NO. 24762 | 281-AlaProGlyAlaAsp-285 |
| SEQ. ID. NO. 24763 | 290-IleGlyGluLysThrAlaLeu-296 |
| SEQ. ID. NO. 24764 | 310-ProGlyGluGluLeuAlaAspAspGluLysAlaVal-321 |
| SEQ. ID. NO. 24765 | 326-GluThrAlaProGly-330 |
| SEQ. ID. NO. 24766 | 357-ValArgAspIleAlaAsnSerLeuGlyGlyProGlyLeu-369 |
| Hydrophilic Regions - Hopp-Woods | |
| SEQ. ID. NO. 24767 | 1-MetLysAsnArgLysIleLeu-7 |
| SEQ. ID. NO. 24768 | 22-MetGluAlaArgProProArgAlaAsnGluAlaGlnAlaProArgAlaAspGluMetLysLysGluSerArgProAlaPhe-48 |
| SEQ. ID. NO. 24769 | 70-AlaAsnValArgArgPheValAspAspGluValGlyLysGlyAspPheSerArgAlaGluTrp-90 |
| SEQ. ID. NO. 24770 | 122-GlyAsnSerGlyLysAlaLysPheArgGlyAlaArgArgPheTyrAlaGluAsnArgAlaLeuIle-143 |
| SEQ. ID. NO. 24771 | 166-AsnTyrGlyLysAsnThrGly-172 |
| SEQ. ID. NO. 24772 | 187-TyrProArgArgAlaGlyPhePhe-194 |
| SEQ. ID. NO. 24773 | 203-LysLeuAlaLysGluGluGlyGlyAsp-211 |
| SEQ. ID. NO. 24774 | 240-TyrAspGlyAspGlyHisArgAspIle-248 |
| SEQ. ID. NO. 24775 | 290-IleGlyGluLysThrAlaLeu-296 |
| SEQ. ID. NO. 24776 | 310-ProGlyGluGluLeuAlaAspAspGluLysAlaVal-321 |
| SEQ. ID. NO. 24777 | 357-ValArgAspIleAla-361 |
| a923-2 | |
| AMPHI Regions - AMPHI | |
| SEQ. ID. NO. 24778 | 9-LeuMetAlaCysAlaAlaPheLeu-16 |
| SEQ. ID. NO. 24779 | 26-LeuGlyAlaCysTyrAlaIleLeuSerLeuTyrAla-37 |
| SEQ. ID. NO. 24780 | 63-ProAlaLeuPheGlyGlyTrpAlaGly-71 |
| Antigenic Index - Jameson-Wolf | |
| SEQ. ID. NO. 24781 | 43-IleAspLysArgArgAlaValArgGlyLysArgArgIleProGluHisArgLeu-60 |
| SEQ. ID. NO. 24782 | 77-ArgIlePheArgHisLysThrAlaLysLysArgPhe-88 |
| Hydrophilic Regions - Hopp-Woods | |
| SEQ. ID. NO. 24783 | 43-IleAspLysArgArgAlaValArgGlyLysArgArgIleProGluHisArgLeu-60 |
| SEQ. ID. NO. 24784 | 77-ArgIlePheArgHisLysThrAlaLysLysArgPhe-88 |
| a925-1 | |
| AMPHI Regions - AMPHI | |
| SEQ. ID. NO. 24785 | 66-LysCysGlyGlnThrAlaGln-72 |
| SEQ. ID. NO. 24786 | 90-HisGlnAlaAlaIleGluGlnLeuLys-98 |
| SEQ. ID. NO. 24787 | 105-PheAspGluLeuGlu-109 |
| Antigenic Index - Jameson-Wolf | |
| SEQ. ID. NO. 24788 | 6-PheThrGlyLysGluGluSerMetLeuLeuSerGluLysAspGlyAla-21 |
| SEQ. ID. NO. 24789 | 25-AsnThrGlyIleGly-29 |
| SEQ. ID. NO. 24790 | 31-IleProIleLysLeuSerAspAspGlyLysGluLeuTyrValGluArgArgGlnTyrValLysThrAspAlaAlaMetLysAspLysIleIleAlaHisGlnLysLysCysGlyGlnThr-70 |
| SEQ. ID. NO. 24791 | 75-LeuAspAlaArgAsnAlaLeuProSerAsnGlnThrTyrGln-88 |
| SEQ. ID. NO. 24792 | 95-GluGlnLeuLysArgArgPheGluAlaGluPheAspGluLeuGluLysGluIleLysCysAsnGlyLysProThr-119 |
| Hydrophilic Regions - Hopp-Woods | |
| SEQ. ID. NO. 24793 | 7-ThrGlyLysGluGluSerMetLeuLeuSerGluLysAspGlyAla-21 |
| SEQ. ID. NO. 24794 | 31-IleProIleLysLeuSerAspAspGlyLysGluLeuTyrValGluArgArgGlnTyrValLysThrAspAlaAlaMetLysAspLysIleIleAlaHisGlnLysLysCysGlyGln-69 |
| SEQ. ID. NO. 24795 | 75-LeuAspAlaArgAsnAlaLeu-81 |
| SEQ. ID. NO. 24796 | 95-GluGlnLeuLysArgArgPheGluAlaGluPheAspGluLeuGluLysGluIleLysCysAsnGlyLys-117 |
| a926 | |
| AMPHI Regions - AMPHI | |
| SEQ. ID. NO. 24797 | 32-HisThrArgSerPhe-36 |
| SEQ. ID. NO. 24798 | 72-LeuGlySerThrLeuGlyGln-78 |
| SEQ. ID. NO. 24799 | 98-AlaGluSerAlaGluGluLeuSerArgGln-107 |
| SEQ. ID. NO. 24800 | 129-GlyAlaProTyrArgIleLeuProAspGlyIle-139 |
| SEQ. ID. NO. 24801 | 151-AlaAspSerGlyGlyGlnVal-157 |
| Antigenic Index - Jameson-Wolf | |
| SEQ. ID. NO. 24802 | 19-LeuProGlnAsnAsnGluAsnLeuTrpGlnProSerGluHisThrArgSerPheThrAlaGluGlyArgLeuAlaValLysAlaGluGlyLysGlySerTyrAla-53 |

TABLE 1-continued

| | |
|---|---|
| SEQ. ID. NO. 24803 | 70-ThrProLeuGlySer-74 |
| SEQ. ID. NO. 24804 | 79-LeuCysGlnAspArgAspGlyAlaLeu-87 |
| SEQ. ID. NO. 24805 | 89-ValAspGlyLysGlyAsnValTyr-96 |
| SEQ. ID. NO. 24806 | 99-GluSerAlaGluGluLeuSerArg-106 |
| SEQ. ID. NO. 24807 | 122-AlaAspGlyArgProValAlaGlyAlaPro-131 |
| SEQ. ID. NO. 24808 | 134-IleLeuProAspGlyIleLeu-140 |
| SEQ. ID. NO. 24809 | 148-GlyArgThrAlaAspSerGlyGlyGln-156 |
| SEQ. ID. NO. 24810 | 177-GlyMetProSerGluThrGluThrGlnGluGlnCysAla-189 |

Hydrophilic Regions - Hopp-Woods

| | |
|---|---|
| SEQ. ID. NO. 24811 | 36-PheThrAlaGluGlyArgLeuAlaValLysAlaGluGlyLysGlySer-51 |
| SEQ. ID. NO. 24812 | 80-CysGlnAspArgAspGlyAlaLeu-87 |
| SEQ. ID. NO. 24813 | 89-ValAspGlyLysGly-93 |
| SEQ. ID. NO. 24814 | 99-GluSerAlaGluGluLeuSerArg-106 |
| SEQ. ID. NO. 24815 | 123-AspGlyArgProValAla-128 |
| SEQ. ID. NO. 24816 | 149-ArgThrAlaAspSerGlyGlyGln-156 |
| SEQ. ID. NO. 24817 | 180-SerGluThrGluThrGlnGluGlnCysAla-189 | a927
AMPHI Regions - AMPHI

| | |
|---|---|
| SEQ. ID. NO. 24818 | 13-LeuLeuSerAlaCysSer-18 |
| SEQ. ID. NO. 24819 | 48-SerTyrAspValAlaArgAspPheTyrLysGlu-58 |
| SEQ. ID. NO. 24820 | 120-LysGlyTrpGlnGlnAlaLeuPro-127 |
| SEQ. ID. NO. 24821 | 145-AsnProLysGlnIleArgAspTrpAsnAspLeuAlaLysAspGly-159 |
| SEQ. ID. NO. 24822 | 197-LysLeuValAlaSerIleLeu-203 |

Antigenic Index - Jameson-Wolf

| | |
|---|---|
| SEQ. ID. NO. 24823 | 18-SerProAlaAlaAspSerAsnHisProSerGlyGlnAsnAlaProAlaAsnThrGluSerAspGlyLysAsnIleThr-43 |
| SEQ. ID. NO. 24824 | 48-SerTyrAspValAlaArgAspPheTyrLysGluTyrAsnPro-61 |
| SEQ. ID. NO. 24825 | 67-TyrGlnSerGluHisProGlyThrSer-75 |
| SEQ. ID. NO. 24826 | 80-GlnSerHisGlyGlySerSerLysGln-88 |
| SEQ. ID. NO. 24827 | 104-AsnGlnSerSerAspIleAspLeuLeuGluLysLysGlyLeuVal-118 |
| SEQ. ID. NO. 24828 | 126-LeuProAspHisAlaAlaProTyrThr-134 |
| SEQ. ID. NO. 24829 | 142-ArgLysAsnAsnProLysGlnIleArgAspTrpAsnAspLeuAlaLysAspGlyVal-160 |
| SEQ. ID. NO. 24830 | 166-AsnProLysThrSerGlyAsnGlyArg-174 |
| SEQ. ID. NO. 24831 | 185-LeuLysThrThrAsnGlyAsnGluGlnGluAlaGlnLys-197 |
| SEQ. ID. NO. 24832 | 203-LeuLysAsnThrProValPheGluAsnGlyGlyArgAlaProPrProProSerHisAsnAlaThrSer-225 |
| SEQ. ID. NO. 24833 | 230-SerLeuLeuLysThrLysProThrThrSerAlaLysAsn-242 |

Hydrophilic Regions - Hopp-Woods

| | |
|---|---|
| SEQ. ID. NO. 24834 | 19-ProAlaAlaAspSerAsnHisProSer-27 |
| SEQ. ID. NO. 24835 | 33-AlaAsnThrGluSerAspGlyLysAsn-41 |
| SEQ. ID. NO. 24836 | 50-AspValAlaArgAspPheTyrLys-57 |
| SEQ. ID. NO. 24837 | 67-TyrGlnSerGluHisProGly-73 |
| SEQ. ID. NO. 24838 | 82-HisGlyGlySerSerLysGln-88 |
| SEQ. ID. NO. 24839 | 105-GlnSerSerAspIleAspLeuLeuGluLysLysGlyLeuVal-118 |
| SEQ. ID. NO. 24840 | 142-ArgLysAsnAsnProLysGlnIleArgAspTrpAsnAspLeuAlaLysAspGlyVal-160 |
| SEQ. ID. NO. 24841 | 167-ProLysThrSerGlyAsnGly-173 |
| SEQ. ID. NO. 24842 | 187-ThrThrAsnGlyAsnGluGlnGluAlaGlnLys-197 |
| SEQ. ID. NO. 24843 | 211-AsnGlyGlyArgAlaProPro-217 |
| SEQ. ID. NO. 24844 | 232-LeuLysThrLysProThrThrSerAlaLysAsn-242 | a929
AMPHI Regions - AMPHI

| | |
|---|---|
| SEQ. ID. NO. 24845 | 25-ValProAspGlyValLys-30 |
| SEQ. ID. NO. 24846 | 34-TrpThrLeuLeuAlaMetPheIleGlyValIleAlaAlaIleIle-48 |
| SEQ. ID. NO. 24847 | 76-GlyAlaAlaMetSerAspAlaLeuSerAlaPhe-86 |
| SEQ. ID. NO. 24848 | 155-HisProIleMetGlnSerIleAlaGlySerTyrGlySerAsnProAlaLys-171 |
| SEQ. ID. NO. 24849 | 180-TyrLeuAlaLeuVal-184 |
| SEQ. ID. NO. 24850 | 204-ProLeuIleValAsnLeuIleAlaGluAsnLeuGly-215 |
| SEQ. ID. NO. 24851 | 233-GlyValIleAlaPhePhe-238 |
| SEQ. ID. NO. 24852 | 265-ArgLeuArgGluMetGlyLysMetSer-273 |
| SEQ. ID. NO. 24853 | 280-AlaValIlePheGlyIle-285 |
| SEQ. ID. NO. 24854 | 355-LeuGlyLeuIleLysTrpPheSerGlyValLeuAlaGluSerValGlyGlyLeu-372 |
| SEQ. ID. NO. 24855 | 398-ThrAlaHisIleThrAlaMetPheGlyAlaPhePheAla-410 |
| SEQ. ID. NO. 24856 | 452-TyrThrThrMetGlyGluTrpTrp-459 |

Antigenic Index - Jameson-Wolf

| | |
|---|---|
| SEQ. ID. NO. 24857 | 25-ValProAspGlyValLysProGln-32 |
| SEQ. ID. NO. 24858 | 71-ThrAlaAspLysProGlyAlaAlaMet-79 |
| SEQ. ID. NO. 24859 | 122-GlyArgLysThrLeuGlyIle-128 |
| SEQ. ID. NO. 24860 | 143-ThrProSerAsnThrAlaArgGlyGlyGly-152 |
| SEQ. ID. NO. 24861 | 163-GlySerTyrGlySerAsnProAlaLysGlyThrGluGlyLysMetGlyLys-179 |
| SEQ. ID. NO. 24862 | 187-HisSerAsnProIleSer-192 |
| SEQ. ID. NO. 24863 | 213-AsnLeuGlySerSerPhe-218 |
| SEQ. ID. NO. 24864 | 248-TyrProProGluIleLysGluThrProAsn-257 |
| SEQ. ID. NO. 24865 | 261-PheAlaLysAspArgLeuArgGluMetGlyLysMetSerAlaAspGluIle-277 |
| SEQ. ID. NO. 24866 | 328-AspValLeuLysGluLysSerAlaTrp-336 |

Hydrophilic Regions - Hopp-Woods

| | |
|---|---|
| SEQ. ID. NO. 24867 | 71-ThrAlaAspLysProGlyAlaAlaMet-79 |
| SEQ. ID. NO. 24868 | 146-AsnThrAlaArgGly-150 |
| SEQ. ID. NO. 24869 | 168-AsnProAlaLysGlyThrGluGlyLysMetGlyLys-179 |
| SEQ. ID. NO. 24870 | 250-ProGluIleLysGluThrProAsn-257 |

TABLE 1-continued

| | |
|---|---|
| SEQ. ID. NO. 24871 | 261-PheAlaLysAspArgLeuArgGluMetGlyLysMetSerAlaAspGluIle-277 |
| SEQ. ID. NO. 24872 | 328-AspValLeuLysGluLysSerAlaTrp-336 | a931
AMPHI Regions - AMPHI

| | |
|---|---|
| SEQ. ID. NO. 24873 | 43-LysAlaProLysThrValAlaAsnPheValArgTyrAlaArgLys-57 |
| SEQ. ID. NO. 24874 | 67-ArgValIleGlyGly-71 |
| SEQ. ID. NO. 24875 | 81-GluAspLeuAlaGlnLysAlaSerAspLys-90 |
| SEQ. ID. NO. 24876 | 94-AsnGluSerGlyAsnGlyLeuLysAsnThrValGly-105 |
| SEQ. ID. NO. 24877 | 107-IleAlaMetAlaArgThrAlaAspProAsp-116 |
| SEQ. ID. NO. 24878 | 120-SerGlnPhePheIle-124 |
| SEQ. ID. NO. 24879 | 142-ThrValPheGlyArgValGluSerGlyMetAsnThrValSerLysIleAlaArgValLysThrAlaThrArgGlyPhe-167 |

Antigenic Index - Jameson-Wolf

| | |
|---|---|
| SEQ. ID. NO. 24880 | 1-MetLysProLysPhe-5 |
| SEQ. ID. NO. 24881 | 30-ThrAspMetGlyAsn-34 |
| SEQ. ID. NO. 24882 | 38-ValLeuAspGluSerLysAlaProLysThr-47 |
| SEQ. ID. NO. 24883 | 53-ArgTyrAlaArgLysGlyPheTyrAspAsnThrIle-64 |
| SEQ. ID. NO. 24884 | 76-GlyGlyGlyLeuThrGluAspLeuAlaGlnLysAlaSerAspLysAlaValAlaAsnGluSerGlyAsnGlyLeuLysAsnThrVal-104 |
| SEQ. ID. NO. 24885 | 111-ArgThrAlaAspProAspSerAlaThr-119 |
| SEQ. ID. NO. 24886 | 127-ValAspAsnAspSerLeuAsnTyrLysAsnGlyGln-138 |
| SEQ. ID. NO. 24887 | 145-GlyArgValGluSerGlyMetAsnThrVal-154 |
| SEQ. ID. NO. 24888 | 156-LysIleAlaArgValLysThrAlaThrArgGlyPhe-167 |
| SEQ. ID. NO. 24889 | 176-ValLysIleArgArg-180 |

Hydrophilic Regions - Hopp-Woods

| | |
|---|---|
| SEQ. ID. NO. 24890 | 1-MetLysProLysPhe-5 |
| SEQ. ID. NO. 24891 | 30-ThrAspMetGlyAsn-34 |
| SEQ. ID. NO. 24892 | 38-ValLeuAspGluSerLysAlaProLysThr-47 |
| SEQ. ID. NO. 24893 | 78-GlyLeuThrGluAspLeuAlaGlnLysAlaSerAspLysAlaValAlaAsnGluSerGlyAsnGlyLeu-100 |
| SEQ. ID. NO. 24894 | 111-ArgThrAlaAspProAspSerAlaThr-119 |
| SEQ. ID. NO. 24895 | 127-ValAspAsnAspSerLeuAsn-133 |
| SEQ. ID. NO. 24896 | 145-GlyArgValGluSerGlyMet-151 |
| SEQ. ID. NO. 24897 | 156-LysIleAlaArgValLysThrAlaThr-164 |
| SEQ. ID. NO. 24898 | 176-ValLysIleArgArg-180 | a933
AMPHI Regions - AMPHI

| | |
|---|---|
| SEQ. ID. NO. 24899 | 27-AsnIleProAlaLeuPheProLysHisProPheAspProPheGluAsnIleAsnAsnSerLysArg-48 |
| SEQ. ID. NO. 24900 | 63-GlyPheAlaGlnGlyLeu-68 |
| SEQ. ID. NO. 24901 | 78-GluLysProIleArgGlnTyrPheLysGluCysLeuAsnThrGly-92 |
| SEQ. ID. NO. 24902 | 95-SerAspAspThrCys-99 |
| SEQ. ID. NO. 24903 | 131-ValGlyAsnTyrIleGluTrpLeu-138 |
| SEQ. ID. NO. 24904 | 155-AspValAspProPheHisTyrIleGluVal-164 |
| SEQ. ID. NO. 24905 | 257-GluAsnProIleAspAspLeuLysSerLeuAspGlyHisGlnIleIleLysValAsn-275 |
| SEQ. ID. NO. 24906 | 304-GlyPhePheThrLys-308 |
| SEQ. ID. NO. 24907 | 351-TrpLeuArgValIleAspGlyHisSerAsn-360 |
| SEQ. ID. NO. 24908 | 426-AlaGlyIleTyrAlaThrTrpHis-433 |
| SEQ. ID. NO. 24909 | 447-TrpValGlnTyrGln-451 |
| SEQ. ID. NO. 24910 | 462-AlaThrGluArgPheThr-467 |
| SEQ. ID. NO. 24911 | 469-LysGlyIleThrAlaSer-474 |
| SEQ. ID. NO. 24912 | 478-GlyTyrAsnAlaLeuLeuAla-484 |
| SEQ. ID. NO. 24913 | 543-LeuTyrLysAsnIleAlaIleGlu-550 |
| SEQ. ID. NO. 24914 | 552-PheAlaAlaValAsn-556 |
| SEQ. ID. NO. 24915 | 601-PheAsnArgGlnThrGly-606 |

Antigenic Index - Jameson-Wolf

| | |
|---|---|
| SEQ. ID. NO. 24916 | 1-LysLysLeuArgAspArgAsnSerGluTyrTrpLysGluGluThrTyrHisIleLysSerAsnAsnArgValTyrPro-26 |
| SEQ. ID. NO. 24917 | 33-ProLysHisProPheAspProPheGluAsnIleAsnAsnSerLysArgIleSerPheTyrAspLysGluTyrThrGluAspTyr-60 |
| SEQ. ID. NO. 24918 | 69-GlyValAlaLysArgAsnGlyGluThrGluLysProIleArg-82 |
| SEQ. ID. NO. 24919 | 88-CysLeuAsnThrGlyLysTyrSerAspAspThrCysLysSerGlnGlnSer-104 |
| SEQ. ID. NO. 24920 | 108-ValArgSerAspIle-112 |
| SEQ. ID. NO. 24921 | 117-ThrLysIleLysAsnSerHisIleAsnSerGluIle-128 |
| SEQ. ID. NO. 24922 | 145-LeuSerSerSerGlnGluHisLeuTyrSerAspValAspProPheHis-160 |
| SEQ. ID. NO. 24923 | 163-GluValThrAspAsnSerHis-169 |
| SEQ. ID. NO. 24924 | 178-AspGluPheArgLeuGluAsnSerLeuTrpGluProArgTrpAspSerAspValGlyGluLeuLysThrThrAsnAlaAspIleArgPheAsnThrLysSerGluSerLeuLeuValLysGluAspTyrAlaGlyGlyAlaArgPhe-226 |
| SEQ. ID. NO. 24925 | 231-GlyLeuLysAspLysValProGluThrPro-240 |
| SEQ. ID. NO. 24926 | 244-PheGluLysAsnIleThrGlyThrSer-252 |
| SEQ. ID. NO. 24927 | 255-IlePheGluAsnProIleAspAspLeuLysSerLeuAspGlyHisGlnIleIle-272 |
| SEQ. ID. NO. 24928 | 274-ValAsnGlyThrAlaAspLysHisAlaPheArgLeuSerGlyLysHisGlnLysGly-292 |
| SEQ. ID. NO. 24929 | 298-LeuValGlnGlnArgProGluGlyPhe-305 |
| SEQ. ID. NO. 24930 | 308-LysValGlnGluArgAspAspIleSer-316 |
| SEQ. ID. NO. 24931 | 332-ArgLeuAsnAspLysAsnSerAspIlePheAspArgThrLeuProArgLysGlyLeu-350 |
| SEQ. ID. NO. 24932 | 355-IleAspGlyHisSerAsnGlnTrpValGlnGlyLysThrAlaProValGluSerAsnArgLysGlyVal-377 |
| SEQ. ID. NO. 24933 | 387-GlnAsnGluSerAsnGlnLeu-393 |
| SEQ. ID. NO. 24934 | 399-SerGlyGlnAlaGluGlnArgSerThrPheArgAsnProAspThrAspAsnLeuThrThrGlyAsnValLysGlyPheGly-425 |
| SEQ. ID. NO. 24935 | 435-LeuGlnAspLysGlnThrGlyAlaTyrAlaAspSer-446 |
| SEQ. ID. NO. 24936 | 451-GlnArgPheArgHisArgIleAsnThrGluAspAlaThrGluArgPheThrSerLysGlyIle-471 |
| SEQ. ID. NO. 24937 | 486-HisPheThrLysLysGlyAsnArgVal-494 |
| SEQ. ID. NO. 24938 | 509-ValAsnGlyLysPheSerArgSerGluAsnAla-519 |
| SEQ. ID. NO. 24939 | 524-LeuGlySerArgGlnLeuGlnSer-531 |
| SEQ. ID. NO. 24940 | 562-LysProPheGlyValGluMetAspGlyGluArgArgMetIleAsnAsnLysThrAlaIleGluSer-583 |
| SEQ. ID. NO. 24941 | 589-ValLysIleLysSer-593 |
| SEQ. ID. NO. 24942 | 600-ThrPheAsnArgGlnThrGlyLysHisHisGlnAlaLysGlnGly-614 |

TABLE 1-continued

Hydrophilic Regions - Hopp-Woods
SEQ. ID. NO. 24943  1-LysLysLeuArgAspArgAsnSerGluTyrTrpLysGluGluThrTyrHis-17
SEQ. ID. NO. 24944  35-HisProPheAspPro-39
SEQ. ID. NO. 24945  44-AsnAsnSerLysArgIleSerPheTyrAspLysGluTyrThrGlu-58
SEQ. ID. NO. 24946  70-ValAlaLysArgAsnGlyGluThrGluLysProIle-81
SEQ. ID. NO. 24947  93-LysTyrSerAspAspThrCysLysSerGlnGln-103
SEQ. ID. NO. 24948  117-ThrLysIleLysAsn-121
SEQ. ID. NO. 24949  152-LeuTyrSerAspValAsp-157
SEQ. ID. NO. 24950  178-AspGluPheArgLeuGlu-183
SEQ. ID. NO. 24951  189-ProArgTrpAspSerAspValGlyGluLeuLysThrThrAsnAlaAspIleArgPheAsnThrLysSerGluSerLeuLeuValLysGluAsp
TyrAlaGly-222
SEQ. ID. NO. 24952  232-LeuLysAspLysValProGlu-238
SEQ. ID. NO. 24953  246-LysAsnIleThrGly-250
SEQ. ID. NO. 24954  258-AsnProIleAspAspLeuLysSerLeuAsp-267
SEQ. ID. NO. 24955  276-GlyThrAlaAspLysHisAlaPhe-283
SEQ. ID. NO. 24956  285-LeuSerGlyLysHisGlnLys-291
SEQ. ID. NO. 24957  299-GlnGlnArgProGluGlyPhe-305
SEQ. ID. NO. 24958  309-ValGlnGluArgAspAspIle-315
SEQ. ID. NO. 24959  333-LeuAsnAspLysAsnSerAspIlePheAsp-342
SEQ. ID. NO. 24960  366-LysThrAlaProValGluSerAsnArgLysGlyVal-377
SEQ. ID. NO. 24961  388-AsnGluSerAsnGln-392
SEQ. ID. NO. 24962  401-GlnAlaGluGlnArgSerThrPheArgAsnProAspThrAspAsnLeuThr-417
SEQ. ID. NO. 24963  435-LeuGlnAspLysGlnThr-440
SEQ. ID. NO. 24964  451-GlnArgPheArgHisArgIleAsnThrGluAspAlaThrGluArgPheThrSer-468
SEQ. ID. NO. 24965  486-HisPheThrLysLysGlyAsnArg-493
SEQ. ID. NO. 24966  512-LysPheSerAspSerGluAsnAla-519
SEQ. ID. NO. 24967  527-ArgGlnLeuGlnSer-531
SEQ. ID. NO. 24968  564-PheGlyValGluMetAspGlyGluArgArgMetIleAsn-576
SEQ. ID. NO. 24969  589-ValLysIleLysSer-593
SEQ. ID. NO. 24970  603-ArgGlnThrGlyLysHisHisGlnAlaLysGlnGly-614
a935
AMPHI Regions - AMPHI
SEQ. ID. NO. 24971  41-ValSerAspLysTrpAla-46
SEQ. ID. NO. 24972  56-AlaProArgValVal-60
SEQ. ID. NO. 24973  72-LeuGluHisSerLeuArgAsp-78
SEQ. ID. NO. 24974  87-LeuIleAlaSerLeuAlaAspLeuTyrAlaLysLeu-98
SEQ. ID. NO. 24975  111-AlaLeuLeuAlaLysLeuAlaGlyArgProAlaGluAlaValAlaArgTyrArgGlu-129
SEQ. ID. NO. 24976  172-ProValLeuGluAsnValGlyArgPheArgLysLysAlaGlu-185
SEQ. ID. NO. 24977  375-LysArgLeuGlyGluSerAlaThrValPheGlyGlyTrpGlnPheVal-390
SEQ. ID. NO. 24978  415-AlaGlyTrpAlaGlnGluTrpArgGlnLeuGlyGlyLeu-427
SEQ. ID. NO. 24979  435-TyrAlaArgArgAsnTyr-440
Antigenic Index - Jameson-Wolf
SEQ. ID. NO. 24980  27-AlaIleLeuAspAspLysAlaLeu-34
SEQ. ID. NO. 24981  39-ArgSerValSerAspLysTrpAlaGluSerAspTrpLysValAspAsnAspAlaProArgValValAspGlyAspPhe-64
SEQ. ID. NO. 24982  70-LysMetLeuGluHisSerLeuArgAspValLeuAsnGlyAsnGlnAlaAsp-86
SEQ. ID. NO. 24983  97-LysLeuProAspTyrAspAla-103
SEQ. ID. NO. 24984  108-ArgAlaArgAlaLeu-112
SEQ. ID. NO. 24985  116-LeuAlaGlyArgProAlaGluAlaValAlaArgTyrArgGluLeuHisGlyGluAsnAlaAlaAspGluArgIleLeu-141
SEQ. ID. NO. 24986  145-AlaAlaAlaGluPheAspAspPheArgLeuLysSerAlaGluArgHisPheAlaGluAlaGluLysLeuAspLeu-169
SEQ. ID. NO. 24987  176-AsnValGlyArgPheArgLysLysAlaGluGlyLeuThrGly-189
SEQ. ID. NO. 24988  192-PheSerGlyGlyIle-196
SEQ. ID. NO. 24989  199-AlaValAsnArgAsnAlaAsnAsnAlaAla-208
SEQ. ID. NO. 24990  210-GlnTyrCysArgGlnAsnGlyGlyArgGln-219
SEQ. ID. NO. 24991  224-SerArgAlaGluArgAlaAla-230
SEQ. ID. NO. 24992  236-IleGluAlaGluLysLeuThrAla-243
SEQ. ID. NO. 24993  253-ArgSerAsnIleGlyGlyThrSerTyr-261
SEQ. ID. NO. 24994  263-PheSerLysLysSerAlaTyrAspAspGlyPheGlyArg-275
SEQ. ID. NO. 24995  279-GlyTrpGlnTyrLysAsnAlaArgGlnThr-288
SEQ. ID. NO. 24996  300-SerGlySerAspGlyPheAspAlaLysThrLysArgValAsnAsnArgArgLeuProProTyr-320
SEQ. ID. NO. 24997  332-HisThrTyrArgProAsnProGlyTrp-340
SEQ. ID. NO. 24998  347-GluHisTyrArgGlnArgTyrArgGluGlnAspArgAlaGluTyrAsnAsnGlyArgGlnAspGlyPheTyr-370
SEQ. ID. NO. 24999  373-SerAlaLysArgLeuGlyGlu-379
SEQ. ID. NO. 25000  392-PheValProLysArgGluThrVal-399
SEQ. ID. NO. 25001  406-AlaAlaTyrArgArgAsnGlyValTyrAlaGly-416
SEQ. ID. NO. 25002  425-GlyGlyLeuAsnSerArgValSerAlaSerTyrAlaArgArgAsnTyrLysGly-442
SEQ. ID. NO. 25003  448-ThrGluAlaGlnArgAsnArgGluTrpAsn-457
SEQ. ID. NO. 25004  463-SerHisAspLysLeuSerTyrLysGly-471
SEQ. ID. NO. 25005  480-PheGlyArgThrGluSerAsnValProTyrAlaLysArgArgAsnSerGlu-496
SEQ. ID. NO. 25006  501-AlaAspTrpArgPhe-505
Hydrophilic Regions - Hopp-Woods
SEQ. ID. NO. 25007  27-AlaIleLeuAspAspLysAlaLeu-34
SEQ. ID. NO. 25008  39-ArgSerValSerAspLysTrpAlaGluSerAspTrpLysValAspAsnAspAlaProArgValValAsp-61
SEQ. ID. NO. 25009  70-LysMetLeuGluHisSerLeuArgAspValLeuAsn-81
SEQ. ID. NO. 25010  108-ArgAlaArgAlaLeu-112
SEQ. ID. NO. 25011  116-LeuAlaGlyArgProAlaGluAlaValAlaArgTyrArgGluLeuHisGly-132
SEQ. ID. NO. 25012  134-AsnAlaAlaAspGluArgIleLeu-141
SEQ. ID. NO. 25013  145-AlaAlaAlaGluPheAspAspPheArgLeuLysSerAlaGluArgHisPheAlaGluAlaGluLysLeuAspLeu-169
SEQ. ID. NO. 25014  176-AsnValGlyArgPheArgLysLysAlaGluGly-186
SEQ. ID. NO. 25015  200-ValAsnArgAsnAlaAsnAsn-205
SEQ. ID. NO. 25016  212-CysArgGlnAsnGlyGlyArgGln-219

TABLE 1-continued

| | |
|---|---|
| SEQ. ID. NO. 25017 | 224-SerArgAlaGluArgAlaAla-230 |
| SEQ. ID. NO. 25018 | 236-IleGluAlaGluLysLeuThrAla-243 |
| SEQ. ID. NO. 25019 | 265-LysLysSerAlaTyrAspAspGlyPheGly-274 |
| SEQ. ID. NO. 25020 | 283-LysAsnAlaArgGlnThr-288 |
| SEQ. ID. NO. 25021 | 303-AspGlyPheAspAlaLysThrLysArgValAsnAsnArgArgLeuPro-318 |
| SEQ. ID. NO. 25022 | 348-HisTyrArgGlnArgTyrArgGluGlnAspArgAlaGluTyrAsnAsnGlyArgGlnAsp-367 |
| SEQ. ID. NO. 25023 | 373-SerAlaLysArgLeuGlyGlu-379 |
| SEQ. ID. NO. 25024 | 393-ValProLysArgGluThrVal-399 |
| SEQ. ID. NO. 25025 | 407-AlaTyrArgArgAsnGly-412 |
| SEQ. ID. NO. 25026 | 435-TyrAlaArgArgAsnTyrLys-441 |
| SEQ. ID. NO. 25027 | 449-GluAlaGlnArgAsnArgGluTrp-456 |
| SEQ. ID. NO. 25028 | 463-SerHisAspLysLeuSerTyr-469 |
| SEQ. ID. NO. 25029 | 480-PheGlyArgThrGluSer-485 |
| SEQ. ID. NO. 25030 | 489-TyrAlaLysArgArgAsnSerGlu-496 | a936-1
AMPHI Regions - AMPHI

| | |
|---|---|
| SEQ. ID. NO. 25031 | 8-ValArgThrLeuThrAla-13 |
| SEQ. ID. NO. 25032 | 22-GlyCysValSerAlaVal-27 |
| SEQ. ID. NO. 25033 | 100-GlnPheValGlyGlnIle-105 |
| SEQ. ID. NO. 25034 | 112-AlaGluGlyValTyrAsnTyrIleThrValAlaSerLeuProArgThrAlaGlyAspIleAlaGlyAsp-134 |

Antigenic Index - Jameson-Wolf

| | |
|---|---|
| SEQ. ID. NO. 25035 | 1-MetLysProLysProHisThrValArg-9 |
| SEQ. ID. NO. 25036 | 33-ValGlyAlaLysSerAlaValAspArgArgThrThrGlyAlaGlnThrAspAspAsnValMet-53 |
| SEQ. ID. NO. 25037 | 56-ArgIleGluThrThrAlaArgSerTyrLeuArgGlnAsnAsnGlnThrLysGlyTyr-74 |
| SEQ. ID. NO. 25038 | 94-AlaThrGluGlyGluLysGlnPhe-101 |
| SEQ. ID. NO. 25039 | 106-AlaArgSerGluGlnAlaAla-112 |
| SEQ. ID. NO. 25040 | 124-LeuProArgThrAlaGlyAspIleAlaGlyAspThrTrpAsnThrSerLysValArgAla-143 |
| SEQ. ID. NO. 25041 | 149-SerProAlaThrGlnAlaArgValLys-157 |
| SEQ. ID. NO. 25042 | 172-ThrProGluGluGlnAlaGlnIleThr-180 |

Hydrophilic Regions - Hopp-Woods

| | |
|---|---|
| SEQ. ID. NO. 25043 | 1-MetLysProLysProHisThr-7 |
| SEQ. ID. NO. 25044 | 37-SerAlaValAspArgArgThrThrGlyAlaGlnThrAspAspAsnValMet-53 |
| SEQ. ID. NO. 25045 | 56-ArgIleGluThrThrAla-61 |
| SEQ. ID. NO. 25046 | 68-AsnAsnGlnThrLysGlyTyr-74 |
| SEQ. ID. NO. 25047 | 94-AlaThrGluGlyGluLysGlnPhe-101 |
| SEQ. ID. NO. 25048 | 106-AlaArgSerGluGlnAlaAla-112 |
| SEQ. ID. NO. 25049 | 125-ProArgThrAlaGly-129 |
| SEQ. ID. NO. 25050 | 152-ThrGlnAlaArgValLys-157 |
| SEQ. ID. NO. 25051 | 172-ThrProGluGluGlnAlaGlnIle-179 | a937
AMPHI Regions - AMPHI

| | |
|---|---|
| SEQ. ID. NO. 25052 | 6-LeuProAlaLeuProAlaIleLeuProLeuSerAla-17 |
| SEQ. ID. NO. 25053 | 232-LysGlnProAspArgLeuAsp-238 |

Antigenic Index - Jameson-Wolf

| | |
|---|---|
| SEQ. ID. NO. 25054 | 27-AspIleMetThrAspLysGlyLysTrpLysLeuGluThr-39 |
| SEQ. ID. NO. 25055 | 44-LeuAsnSerGluAsnAsnArgAlaGluLeu-53 |
| SEQ. ID. NO. 25056 | 71-ThrGluIleGlnGluAsnGlySerAsnThr-80 |
| SEQ. ID. NO. 25057 | 95-GlyAsnThrAspIleTyrGlySerGlySer-104 |
| SEQ. ID. NO. 25058 | 108-HisGluGluArgLysLeuAspGlyAsnGlyLysThrArgAsnLysArgMetSerAsp-126 |
| SEQ. ID. NO. 25059 | 135-PheLeuLysAspAspLysAsnProAla-143 |
| SEQ. ID. NO. 25060 | 151-ThrValTyrGluLysSerArgAsnLysAlaSerSerGlyLysSer-165 |
| SEQ. ID. NO. 25061 | 187-TyrArgIleAsnGlySerLysThrLeuSerSerAsnThrLysTyrLysAlaGly-204 |
| SEQ. ID. NO. 25062 | 217-AlaAsnAspArgIleSerLeuThrGlyGly-226 |
| SEQ. ID. NO. 25063 | 231-GlyLysGlnProAspArgLeuAspGlyLysLysGluSerAlaArgAsnThrSerThr-249 |
| SEQ. ID. NO. 25064 | 273-ValSerGlyGlnSerSerSerGluLeuLysPhe-283 |

Hydrophilic Regions - Hopp-Woods

| | |
|---|---|
| SEQ. ID. NO. 25065 | 27-AspIleMetThrAspLysGlyLysTrpLysLeu-37 |
| SEQ. ID. NO. 25066 | 47-GluAsnAsnArgAlaGluLeu-53 |
| SEQ. ID. NO. 25067 | 72-GluIleGlnGluAsnGlySerAsn-79 |
| SEQ. ID. NO. 25068 | 108-HisGluGluArgLysLeuAspGlyAsnGlyLysThrArgAsnLysArgMetSerAsp-126 |
| SEQ. ID. NO. 25069 | 135-PheLeuLysAspAspLysAsnPro-142 |
| SEQ. ID. NO. 25070 | 151-ThrValTyrGluLysSerArgAsnLysAlaSerSer-162 |
| SEQ. ID. NO. 25071 | 193-LysThrLeuSerSer-197 |
| SEQ. ID. NO. 25072 | 199-ThrLysTyrLysAla-203 |
| SEQ. ID. NO. 25073 | 217-AlaAsnAspArgIleSer-222 |
| SEQ. ID. NO. 25074 | 232-LysGlnProAspArgLeuAspGlyLysLysGluSerAlaArgAsn-246 |
| SEQ. ID. NO. 25075 | 277-SerSerSerGluLeuLysPhe-283 | a939
AMPHI Regions - AMPHI

| | |
|---|---|
| SEQ. ID. NO. 25076 | 32-AlaThrValCysAla-36 |
| SEQ. ID. NO. 25077 | 90-AspGlnAspIleLeu-94 |
| SEQ. ID. NO. 25078 | 121-LysIleTyrArgGly-125 |
| SEQ. ID. NO. 25079 | 135-CysMetSerCysHisGly-140 |
| SEQ. ID. NO. 25080 | 151-SerGluIleGlnAlaTyrProArgLeuGlyGly-161 |
| SEQ. ID. NO. 25081 | 169-GluGlnMetAsnAlaTyrLys-175 |
| SEQ. ID. NO. 25082 | 185-GluAspIleAlaAsnArgMetSer-192 |

Antigenic Index - Jameson-Wolf

| | |
|---|---|
| SEQ. ID. NO. 25083 | 18-AlaSerProLysAlaAspValGluLysGlyLysGlnVal-30 |
| SEQ. ID. NO. 25084 | 40-AlaAlaAspGlyAsnSerGlyIle-47 |
| SEQ. ID. NO. 25085 | 66-IleGlyIleArgAspGlyLysArgThrHisGlySerAlaAlaVal-80 |

TABLE 1-continued

| | |
|---|---|
| SEQ. ID. NO. 25086 | 88-LeuSerAspGlnAspIle-93 |
| SEQ. ID. NO. 25087 | 102-LysGlnGlnProLysSerGlyGluAlaAsnProLysGluAsnProGluLeuGly-119 |
| SEQ. ID. NO. 25088 | 122-IleTyrArgGlyGlyLeuSerAspLysLysValPro-133 |
| SEQ. ID. NO. 25089 | 139-HisGlyProSerGlyAlaGlyMetProGlyGlyGlySerGluIleGlnAla-155 |
| SEQ. ID. NO. 25090 | 157-ProArgLeuGlyGlyGlnHisGln-164 |
| SEQ. ID. NO. 25091 | 172-AsnAlaTyrLysSerGlyGlnArgLysAsnThrIleMetGluAspIleAlaAsnArgMetSerGluGluAspLeuLysAla-198 |
| Hydrophilic Regions - Hopp-Woods | |
| SEQ. ID. NO. 25092 | 18-AlaSerProLysAlaAspValGluLysGlyLysGlnVal-30 |
| SEQ. ID. NO. 25093 | 40-AlaAlaAspGlyAsnSer-45 |
| SEQ. ID. NO. 25094 | 67-GlyIleArgAspGlyLysArgThrHisGly-76 |
| SEQ. ID. NO. 25095 | 89-SerAspGlnAspIle-93 |
| SEQ. ID. NO. 25096 | 103-GlnGlnProLysSerGlyGluAlaAsnProLysGluAsnProGluLeuGly-119 |
| SEQ. ID. NO. 25097 | 126-GlyLeuSerAspLysLysValPro-133 |
| SEQ. ID. NO. 25098 | 175-LysSerGlyGlnArgLysAsnThrIleMetGluAspIleAlaAsnArgMetSerGluGluAspLeuLysAla-198 |
| a950 | |
| AMPHI Regions - AMPHI | |
| SEQ. ID. NO. 25099 | 33-GlyValHisLysSerAlaHisGly-40 |
| SEQ. ID. NO. 25100 | 71-AlaThrValLysLysThrHisLysHisThrLysAla-82 |
| Antigenic Index - Jameson-Wolf | |
| SEQ. ID. NO. 25101 | 1-MetAsnLysAsnIle-5 |
| SEQ. ID. NO. 25102 | 23-AlaAlaAsnLysProAlaSerAsnAlaThrGlyValHisLysSerAlaHisGlySerCysGlyAlaSerLysSerAlaGluGlySerCysGlyAla AlaGlySerLysAlaGlyGluGlyLysCysGlyGluGlyLysCysGlyAlaThrValLysLysThrHisLysHisThrLysAlaSerLysAlaLysAlaLysSer AlaGluGlyLysCysGlyGluGlyLysCysGlySerLys-102 |
| Hydrophilic Regions - Hopp-Woods | |
| SEQ. ID. NO. 25103 | 23-AlaAlaAsnLysProAlaSer-29 |
| SEQ. ID. NO. 25104 | 33-GlyValHisLysSerAlaHis-39 |
| SEQ. ID. NO. 25105 | 43-GlyAlaSerLysSerAlaGluGlySerCys-52 |
| SEQ. ID. NO. 25106 | 55-AlaGlySerLysAlaGlyGluGlyLysCysGlyGluGlyLysCys-69 |
| SEQ. ID. NO. 25107 | 71-AlaThrValLysLysThrHisLysHisThrLysAlaSerLysAlaLysAlaLysSerAlaGluGlyLysCysGlyGluGlyLysCysGlySerLys-102 |
| a951 | |
| AMPHI Regions - AMPHI | |
| SEQ. ID. NO. 25108 | 7-ThrIleLeuSerValLeuAlaAla-14 |
| SEQ. ID. NO. 25109 | 28-AspAlaLysProProLysGluValGlyLysValPheArgLysGlnGlnArgTyr-45 |
| SEQ. ID. NO. 25110 | 60-ValGlyGluArgValAsn-65 |
| SEQ. ID. NO. 25111 | 125-TrpArgGlnIleGluProIleProGlyLys-134 |
| SEQ. ID. NO. 25112 | 153-HisLeuAspGlyLeuGluGluValLeuAla-162 |
| SEQ. ID. NO. 25113 | 187-AlaGlnLysAlaSerLysAlaValArgArg-196 |
| SEQ. ID. NO. 25114 | 202-GluHisLeuProGluAlaAla-208 |
| SEQ. ID. NO. 25115 | 226-GlyAlaLeuGlnArgLeuAlaLysLeu-234 |
| SEQ. ID. NO. 25116 | 252-LysTyrProGluIleLeuAspGlyPhePheGlu-262 |
| SEQ. ID. NO. 25117 | 276-MetGluIleMetAsnLeuValSerLeuHisArgLeuAspAspAla-290 |
| SEQ. ID. NO. 25118 | 323-ValIleAspGlyTyrAlaGluLys-330 |
| SEQ. ID. NO. 25119 | 360-ValArgGlnTrpLeuLys-365 |
| SEQ. ID. NO. 25120 | 393-AlaLeuArgGlnIleGlyArgValArgLysLeuProGluGlnGln-407 |
| SEQ. ID. NO. 25121 | 414-AspAsnLeuSerLysIle-419 |
| SEQ. ID. NO. 25122 | 421-MetPheAlaLeuSer-425 |
| SEQ. ID. NO. 25123 | 432-GluAlaLeuArgGlyLeuAspLysIleIleGluLys-443 |
| SEQ. ID. NO. 25124 | 475-SerAspLeuGluArgAlaPheArg-482 |
| SEQ. ID. NO. 25125 | 493-AsnLeuGlyTyrSer-497 |
| SEQ. ID. NO. 25126 | 501-AspSerLysArgLeu-505 |
| SEQ. ID. NO. 25127 | 561-HisLeuGlyGluVal-565 |
| SEQ. ID. NO. 25128 | 577-AspValTrpThrGlnAla-582 |
| SEQ. ID. NO. 25129 | 592-TrpArgGluThrLeu-596 |
| Antigenic Index - Jameson-Wolf | |
| SEQ. ID. NO. 25130 | 26-AlaAlaAspAlaLysProProLysGluValGlyLysValPheArgLysGlnGlnArgTyrSerGluGluGluIleLysAsnGluArgAlaArgLeu-57 |
| SEQ. ID. NO. 25131 | 59-AlaValGlyGluArgValAsn-65 |
| SEQ. ID. NO. 25132 | 75-ThrAlaLeuGlnLysGlyGlnAla-82 |
| SEQ. ID. NO. 25133 | 94-GluArgThrLysSerProGluValAlaGluArgAlaLeuGlu-107 |
| SEQ. ID. NO. 25134 | 124-LysTrpArgGlnIleGluProIleProGlyLysAlaGlnLysArgAlaGlyTrpLeuArgAsnValLeuArgGluArgGlyAsnGlnHisLeuAsp GlyLeuGluGluValLeuAlaGlnAlaAspGluGlyGlnAsnArgArg-171 |
| SEQ. ID. NO. 25135 | 181-ValGlnGlnAspGlyLeuAlaGlnLysAlaSerLysAlaValArgArgAlaAlaLeuArg-200 |
| SEQ. ID. NO. 25136 | 217-GlnGlyArgGluLysGluLysAlaIle-225 |
| SEQ. ID. NO. 25137 | 230-ArgLeuAlaLysLeuAspThrGluIleLeuPro-240 |
| SEQ. ID. NO. 25138 | 248-LeuThrAlaArgLysTyrProGluIleLeuAspGlyPhePheGluGlnThrAspThrGlnAsn-268 |
| SEQ. ID. NO. 25139 | 285-HisArgLeuAspAspAlaTyrAla-292 |
| SEQ. ID. NO. 25140 | 298-LeuGluArgAsnProAsnAlaAsp-305 |
| SEQ. ID. NO. 25141 | 315-AlaAsnArgLysGluGlyAlaSer-322 |
| SEQ. ID. NO. 25142 | 326-GlyTyrAlaGluLysAlaTyrGlyArgGlyThrGlyGluGlnArgGlyArgAla-343 |
| SEQ. ID. NO. 25143 | 352-AlaAspArgArgAspTyrThrLysValArgGlnTrpLeuLysLysValSerAlaPro-370 |
| SEQ. ID. NO. 25144 | 373-LeuPheAspLysGlyVal-378 |
| SEQ. ID. NO. 25145 | 385-ValGluLeuAspGlyGlyArgAlaAlaLeu-394 |
| SEQ. ID. NO. 25146 | 396-GlnIleGlyArgValArgLysLeuProGluGlnGlnGlyArgTyrPheThr-412 |
| SEQ. ID. NO. 25147 | 426-LysLeuProAspLysArgGluAlaLeuArgGlyLeuAspLysIleIleGluLysProProAlaGlySerAsnThrGluLeuGlnAla-454 |
| SEQ. ID. NO. 25148 | 466-ArgLeuGlyLysArgLysLysMetIleSerAspLeuGluArgAlaPheArgLeuAlaProAspAsn-487 |
| SEQ. ID. NO. 25149 | 499-LeuSerAspSerLysArgLeuAspGluGlyPhe-509 |
| SEQ. ID. NO. 25150 | 518-IleAsnProAspAspThrAlaValAsnAspSerIle-529 |
| SEQ. ID. NO. 25151 | 535-LeuSerGlyAspAlaGlnSerAla-542 |
| SEQ. ID. NO. 25152 | 547-ArgTyrSerPheGluAsnAspProGluProGluVal-558 |
| SEQ. ID. NO. 25153 | 570-GlyGluArgAspGlnAla-575 |
| SEQ. ID. NO. 25154 | 584-HisLeuThrGlyAspLysLysIleTrpArgGluThrLeuLysArgHisGlyIleAlaLeuProGlnProSerArgLysProArgLys-612 |

TABLE 1-continued

Hydrophilic Regions - Hopp-Woods
SEQ. ID. NO. 25155    26-AlaAlaAspAlaLysProProLysGluValGlyLysValPheArgLysGlnGlnArgTyrSerGluGluGluIleLysAsnGluArgAlaArgLeu-57
SEQ. ID. NO. 25156    59-AlaValGlyGluArgValAsn-65
SEQ. ID. NO. 25157    75-ThrAlaLeuGlnLysGlyGlnAla-82
SEQ. ID. NO. 25158    94-GluArgThrLysSerProGluValAlaGluArgAlaLeuGlu-107
SEQ. ID. NO. 25159    131-IleProGlyLysAlaGlnLysArgAlaGlyTrp-141
SEQ. ID. NO. 25160    145-ValLeuArgGluArgGlyAsnGlnHis-153
SEQ. ID. NO. 25161    155-AspGlyLeuGluGluValLeuAlaGlnAlaAspGluGlyGlnAsnArgArg-171
SEQ. ID. NO. 25162    185-GlyLeuAlaGlnLysAlaSerLysAlaValArgArgAlaAlaLeuArg-200
SEQ. ID. NO. 25163    217-GlnGlyArgGluLysGluLysAlaIle-225
SEQ. ID. NO. 25164    230-ArgLeuAlaLysLeuAspThrGluIle-238
SEQ. ID. NO. 25165    248-LeuThrAlaArgLysTyrProGluIle-256
SEQ. ID. NO. 25166    261-PheGluGlnThrAspThrGlnAsn-268
SEQ. ID. NO. 25167    285-HisArgLeuAspAspAlaTyrAla-292
SEQ. ID. NO. 25168    298-LeuGluArgAsnProAsn-303
SEQ. ID. NO. 25169    315-AlaAsnArgLysGluGlyAlaSer-322
SEQ. ID. NO. 25170    327-TyrAlaGluLysAlaTyrGly-333
SEQ. ID. NO. 25171    335-GlyThrGlyGluGlnArgGlyArgAla-343
SEQ. ID. NO. 25172    352-AlaAspArgArgAspTyrThrLys-359
SEQ. ID. NO. 25173    385-ValGluLeuAspGlyGlyArgAlaAlaLeu-394
SEQ. ID. NO. 25174    396-GlnIleGlyArgValArgLysLeuProGluGlnGlnGly-408
SEQ. ID. NO. 25175    426-LysLeuProAspLysArgGluAlaLeuArgGlyLeuAspLysIleIleGluLysProProAla-446
SEQ. ID. NO. 25176    448-SerAsnThrGluLeuGlnAla-454
SEQ. ID. NO. 25177    466-ArgLeuGlyLysArgLysLysMetIleSerAspLeuGluArgAlaPheArgLeuAlaProAspAsn-487
SEQ. ID. NO. 25178    500-SerAspSerLysArgLeuAspGlu-507
SEQ. ID. NO. 25179    519-AsnProAspAspThrAlaVal-525
SEQ. ID. NO. 25180    537-GlyAspAlaGluSer-541
SEQ. ID. NO. 25181    550-PheGluAsnAspProGluProGluVal-558
SEQ. ID. NO. 25182    570-GlyGluArgAspGlnAla-575
SEQ. ID. NO. 25183    586-ThrGlyAspLysLysIleTrpArgGluThrLeuLysArgHisGly-600
SEQ. ID. NO. 25184    605-GlnProSerArgLysProArgLys-612
a952
AMPHI Regions - AMPHI
SEQ. ID. NO. 25185    63-SerValAlaThrLeuLeuAsnAsnPheTyrGlyGln-74
SEQ. ID. NO. 25186    81-ValLeuLysLysLeuAsp-86
SEQ. ID. NO. 25187    94-PheGluAspMetArgArgIle-100
SEQ. ID. NO. 25188    116-GluGlnLeuAlaGlnLeu-121
SEQ. ID. NO. 25189    138-SerValLeuArgGlyIleAsp-144
Antigenic Index - Jameson-Wolf
SEQ. ID. NO. 25190    40-GlnSerTrpLysGluArgArgAspPheAsnIleValLysGlnAspLeuAspPheSerCys-59
SEQ. ID. NO. 25191    70-AsnPheTyrGlyGlnThrLeuThrGluGluGluValLeuLysLysLeuAspLysGluGlnMetArgAlaSerPheGluAspMetArgArgIle
                      MetPro-102
SEQ. ID. NO. 25192    104-LeuGlyPheGluAlaLysGlyTyr-111
SEQ. ID. NO. 25193    129-LeuLysTyrArgLysAspAspHisPheSer-138
SEQ. ID. NO. 25194    141-ArgGlyIleAspGlyAsnThr-147
SEQ. ID. NO. 25195    169-TrpGlnThrArgGluGlyAsnLeuAla-177
SEQ. ID. NO. 25196    184-ValProLysLysAlaGluThrIleSer-192
SEQ. ID. NO. 25197    199-HisHisProLysArgGlnThrGlu-206
SEQ. ID. NO. 25198    213-ArgGlnAlaArgAlaGlu-218
Hydrophilic Regions - Hopp-Woods
SEQ. ID. NO. 25199    41-SerTrpLysGluArgArgAspPheAsnIleValLysGlnAspLeuAspPhe-57
SEQ. ID. NO. 25200    76-LeuThrGluGluGluValLeuLysLysLeuAspLysGluGlnMetArgAlaSerPheGluAspMetArgArgIleMetPro-102
SEQ. ID. NO. 25201    104-LeuGlyPheGluAlaLysGly-110
SEQ. ID. NO. 25202    130-LysTyrArgLysAspAspHisPheSer-138
SEQ. ID. NO. 25203    169-TrpGlnThrArgGluGlyAsnLeu-176
SEQ. ID. NO. 25204    184-ValProLysLysAlaGluThrIleSer-192
SEQ. ID. NO. 25205    200-HisProLysArgGlnThrGlu-206
SEQ. ID. NO. 25206    213-ArgGlnAlaArgAlaGlu-218
a953
AMPHI Regions - AMPHI
SEQ. ID. NO. 25207    39-AsnThrSerThrAsnValGlyGlyPheTyrGlyLeuThr-51
SEQ. ID. NO. 25208    75-GlnSerGlySerGlnHisPheThrAspHisLeuLysSerAlaAspIlePheAspAlaAlaGln-95
SEQ. ID. NO. 25209    151-GlyAspPheSerThrThr-156
Antigenic Index - Jameson-Wolf
SEQ. ID. NO. 25210    22-TyrLysValAspGluTyrHisAla-29
SEQ. ID. NO. 25211    38-PheAsnThrSerThrAsnVal-44
SEQ. ID. NO. 25212    54-ValGluPheAspGlnAlaLysArgAspGlyLysIleAspIle-67
SEQ. ID. NO. 25213    83-AspHisLeuLysSer-87
SEQ. ID. NO. 25214    95-GlnTyrProAspIleArgPheValSer-103
SEQ. ID. NO. 25215    105-LysPheAsnPheAsnGlyLysLysLeuValSer-115
SEQ. ID. NO. 25216    122-MetHisGlyLysThrAlaProValLysLeuLysAlaGluLys-135
SEQ. ID. NO. 25217    137-AsnCysTyrGlnSerProMetLeuLys-145
SEQ. ID. NO. 25218    147-GluValCysGlyGlyAsp-152
SEQ. ID. NO. 25219    154-SerThrThrIleAspArgThrLysTrpGly-163
SEQ. ID. NO. 25220    174-LysSerValArgIle-178
SEQ. ID. NO. 25221    180-IleGlnIleGluAlaAlaLysGln-187
Hydrophilic Regions - Hopp-Woods
SEQ. ID. NO. 25222    22-TyrLysValAspGluTyrHisAla-29
SEQ. ID. NO. 25223    54-ValGluPheAspGlnAlaLysArgAspGlyLysIleAspIle-67
SEQ. ID. NO. 25224    83-AspHisLeuLysSer-87

TABLE 1-continued

| | |
|---|---|
| SEQ. ID. NO. 25225 | 108-PheAsnGlyLysLysLeuValSer-115 |
| SEQ. ID. NO. 25226 | 125-LysThrAlaProValLysLeuLysAlaGluLys-135 |
| SEQ. ID. NO. 25227 | 155-ThrThrIleAspArgThrLysTrp-162 |
| SEQ. ID. NO. 25228 | 174-LysSerValArgIle-178 |
| SEQ. ID. NO. 25229 | 180-IleGlnIleGluAlaAlaLysGln-187 | a957
AMPHI Regions - AMPHI

| | |
|---|---|
| SEQ. ID. NO. 25230 | 11-SerPhePheAlaLeuValPheAla-18 |
| SEQ. ID. NO. 25231 | 45-AlaPheValAlaLysLeuAlaArgLeuPheArgAsnAla-57 |
| SEQ. ID. NO. 25232 | 71-GluGluSerLeuAlaGlyAlaValAspAsp-80 |
| SEQ. ID. NO. 25233 | 195-GluAspValTyrGluHisCysLeuGlyCysTyrGlnMet-207 |
| SEQ. ID. NO. 25234 | 215-TyrArgAspValAlaAsnAspGlu-222 |
| SEQ. ID. NO. 25235 | 232-SerAsnArgIleAlaSer-237 |
| SEQ. ID. NO. 25236 | 246-GlnAsnMetArgGluLeuMetProArg-254 |
| SEQ. ID. NO. 25237 | 352-GluLysGluValSerArgTyrAlaGluAlaAlaAlaArg-364 |

Antigenic Index - Jameson-Wolf

| | |
|---|---|
| SEQ. ID. NO. 25238 | 29-IleAsnProArgTrp-33 |
| SEQ. ID. NO. 25239 | 35-LeuSerAspThrAlaThrGluAsnProAsn-44 |
| SEQ. ID. NO. 25240 | 54-PheArgAsnAlaAspArgAla-60 |
| SEQ. ID. NO. 25241 | 64-ValLysGluSerMetArgThrGluGluSerLeu-74 |
| SEQ. ID. NO. 25242 | 77-AlaValAspAspGlyProLeuGlnSerGluLysAspTyr-89 |
| SEQ. ID. NO. 25243 | 95-ArgLeuSerArgLeuLysGluLysAlaLys-104 |
| SEQ. ID. NO. 25244 | 109-ThrGluGlnGluHisGlyGlu-115 |
| SEQ. ID. NO. 25245 | 122-TyrIleGlyGluGlyGly-127 |
| SEQ. ID. NO. 25246 | 133-LeuSerGlnArgSerProGluAlaPheVal-142 |
| SEQ. ID. NO. 25247 | 146-TyrLeuTyrArgAsnAspArgProPheSer-155 |
| SEQ. ID. NO. 25248 | 163-ValHisGlyGluAsnTyrGluThrThrGlyGluTyrArgVal-176 |
| SEQ. ID. NO. 25249 | 179-GlnProAspGlySerValPheAspAlaSerGlyArgGlyLysIleGlyGluAspValTyr-198 |
| SEQ. ID. NO. 25250 | 214-LysTyrArgAspValAlaAsnAspGluGlnLysValTrpAspPheArgGluGluSerAsnArgIleAlaSerAspSerArgAspSerValPhe-244 |
| SEQ. ID. NO. 25251 | 247-AsnMetArgGluLeuMetProArgGlyMetLysAlaAsnSer-260 |
| SEQ. ID. NO. 25252 | 265-TyrAspAlaAspGlyLeuProGln-272 |
| SEQ. ID. NO. 25253 | 277-SerPheAspAsnGlyLysLysArgGlnSerPheGluTyrTyrLeuLysAsnGlyAsn-295 |
| SEQ. ID. NO. 25254 | 306-LeuLysAlaAspGlyValThr-312 |
| SEQ. ID. NO. 25255 | 326-LeuAspGlyGlyArgIleValArgGluGluLysGlnGlyAspArgLeuProAspPhe-344 |
| SEQ. ID. NO. 25256 | 346-LeuAsnLeuGluAspLeuGluLysGluValSerArgTyrAlaGluAlaAlaAlaArgArgSerGlyGlyArgArgAspLeuSerHis-374 |

Hydrophilic Regions - Hopp-Woods

| | |
|---|---|
| SEQ. ID. NO. 25257 | 38-ThrAlaThrGluAsnPro-43 |
| SEQ. ID. NO. 25258 | 54-PheArgAsnAlaAspArgAla-60 |
| SEQ. ID. NO. 25259 | 64-ValLysGluSerMetArgThrGluGluSerLeu-74 |
| SEQ. ID. NO. 25260 | 77-AlaValAspAspGlyProLeuGlnSerGluLysAspTyr-89 |
| SEQ. ID. NO. 25261 | 95-ArgLeuSerArgLeuLysGluLysAlaLys-104 |
| SEQ. ID. NO. 25262 | 109-ThrGluGlnGluHisGlyGlu-115 |
| SEQ. ID. NO. 25263 | 133-LeuSerGlnArgSerProGlu-139 |
| SEQ. ID. NO. 25264 | 148-TyrArgAsnAspArgProPhe-154 |
| SEQ. ID. NO. 25265 | 166-GluAsnTyrGluThrThrGlyGluTyr-174 |
| SEQ. ID. NO. 25266 | 187-AlaSerGlyArgGlyLysIleGlyGluAspValTyr-198 |
| SEQ. ID. NO. 25267 | 214-LysTyrArgAspValAlaAsnAspGluGlnLysValTrpAspPheArgGluGluSerAsnArgIleAlaSerAspSerArgAspSerVal-243 |
| SEQ. ID. NO. 25268 | 247-AsnMetArgGluLeuMetProArgGlyMetLys-257 |
| SEQ. ID. NO. 25269 | 265-TyrAspAlaAspGlyLeuPro-271 |
| SEQ. ID. NO. 25270 | 279-AspAsnGlyLysLysArgGlnSer-286 |
| SEQ. ID. NO. 25271 | 306-LeuLysAlaAspGlyValThr-312 |
| SEQ. ID. NO. 25272 | 328-GlyGlyArgIleValArgGluGluLysGlnGlyAspArgLeuPro-342 |
| SEQ. ID. NO. 25273 | 346-LeuAsnLeuGluAspLeuGluLysGluValSerArgTyrAlaGluAlaAlaAlaArgArgSerGlyGlyArgArgAspLeuSerHis-374 | a958
AMPHI Regions - AMPHI

| | |
|---|---|
| SEQ. ID. NO. 25274 | 39-GlyGlySerValArgSerValSerGluProIleGln-50 |
| SEQ. ID. NO. 25275 | 86-ProGluAspTyrThrArgIleValAlaAsp-95 |
| SEQ. ID. NO. 25276 | 127-TyrGlnSerGlyAsp-132 |
| SEQ. ID. NO. 25277 | 177-ArgArgLeuGlnSerValSerArgThrAlaGluMet-188 |
| SEQ. ID. NO. 25278 | 343-IleSerAspThrLeuGln-348 |
| SEQ. ID. NO. 25279 | 483-TyrTyrSerLeuAsnArgPhe-489 |
| SEQ. ID. NO. 25280 | 491-SerGlnGluAlaArgArgVal-497 |
| SEQ. ID. NO. 25281 | 500-ThrLeuProIleVal-504 |
| SEQ. ID. NO. 25282 | 541-GlnAsnAspLeuProAsnPheAsp-548 |
| SEQ. ID. NO. 25283 | 572-AsnThrAlaAsnSerLeuSerAlaAlaValGlnSer-583 |
| SEQ. ID. NO. 25284 | 693-AspLysLeuSerGln-697 |
| SEQ. ID. NO. 25285 | 723-LysLysProIleGlu-727 |
| SEQ. ID. NO. 25286 | 769-AspLeuSerSerValGlyArgAsnPro-777 |

Antigenic Index - Jameson-Wolf

| | |
|---|---|
| SEQ. ID. NO. 25287 | 18-PheGlyThrHisCys-22 |
| SEQ. ID. NO. 25288 | 28-ValAlaAlaGluGluThrAspAsnProThrAlaGlyGlySerValArgSerValSerGluProIleGln-50 |
| SEQ. ID. NO. 25289 | 55-SerLeuGlySerThr-59 |
| SEQ. ID. NO. 25290 | 63-CysSerAsnGluSerGlySerProGluArgThrGluAlaAlaValGlnGlySerGlyGluAlaSerIleProGluAspTyrThrArgIleValAlaAspArgMetGluGlyGlnSerGlnValGlnValArgAlaGluGly-109 |
| SEQ. ID. NO. 25291 | 111-ValValValGluArgAsnArgThrThrLeuAsn-121 |
| SEQ. ID. NO. 25292 | 123-AspTrpAlaAspTyrAspGlnSerGlyAspThrValThrAlaGlyAspArgPheAlaLeuGlnGlnAspGlyThrLeuIleArgGlyGluThrLeu-154 |
| SEQ. ID. NO. 25293 | 158-LeuGluGlnGlnThrGlyLeuAlaHisAsnValArgMetGluThrGluHisGlyGlyArgArgLeuGlnSerValSerArgThrAlaGluMetLeuGlyGluGlyHisTyrLysLeuThrGluThrGlnPheAsnThrCysSerAlaGlyAspAlaGlyTrp-211 |
| SEQ. ID. NO. 25294 | 216-AlaSerValGluAlaAspArgGluLysGlyIleGly-227 |
| SEQ. ID. NO. 25295 | 249-PheProLeuAspGlyAsnArgLysSerGlyLeu-259 |

TABLE 1-continued

| SEQ. ID. NO. 25296 | 265-SerAlaGlySerAspGlyVal-271 |
| SEQ. ID. NO. 25297 | 292-GlyValIleGlyGluArgGlyAlaValPheAspGlyGlnValArgTyrLeuArgProAspTyrAlaGlyGlnSerAsp-317 |
| SEQ. ID. NO. 25298 | 321-LeuProHisAspLysLysSerGlyArgAsnAsnArgTyrGlnAla-335 |
| SEQ. ID. NO. 25299 | 337-TrpGlnHisArgHisAspIleSerAspThrLeu-347 |
| SEQ. ID. NO. 25300 | 352-AspPheAsnGlnValSerAspSerGlyTyrTyrArgAspPheTyrGlyAsnLysGluIleAlaGlyAsnValAsnLeuAsnArgArgValTrp-382 |
| SEQ. ID. NO. 25301 | 384-AspTyrGlyGlyArgAlaAlaGlyGlySerLeu-394 |
| SEQ. ID. NO. 25302 | 407-AlaAsnGlnSerGlyTyrLysAspLysProTyr-417 |
| SEQ. ID. NO. 25303 | 422-ArgLeuSerAlaAspTrpArgLysAsnThrGlyArgAla-434 |
| SEQ. ID. NO. 25304 | 444-ArgPheSerHisAspSerArgGlnAspGlySerArg-455 |
| SEQ. ID. NO. 25305 | 460-ProAspIleLysTrpAspPheSerAsnSerTrpGly-471 |
| SEQ. ID. NO. 25306 | 487-AsnArgPheGlySerGlnGluAlaArgArgValSerArg-499 |
| SEQ. ID. NO. 25307 | 507-AspSerGlyMetThrPheGluArgAsnThrArgMetPheGlyGlyGly-522 |
| SEQ. ID. NO. 25308 | 525-GlnThrLeuGluProArg-530 |
| SEQ. ID. NO. 25309 | 538-AlaLysSerGlnAsnAspLeuProAsnPheAspSerSerGluSerSerPheGly-555 |
| SEQ. ID. NO. 25310 | 560-PheArgGluAsnLeuTyrTyrGlyAsnAspArgIleAsnThrAlaAsnSer-576 |
| SEQ. ID. NO. 25311 | 581-ValGlnSerArgIleLeuAspGlyAlaThrGlyGluGluArgPheArgAlaGlyIleGlyGlnLysPheTyrPheLysAsnAspAlaValMetLeuAspGlySerValGlyLysLysProArgSerArgSerAspTrp-626 |
| SEQ. ID. NO. 25312 | 631-SerSerGlyIleGlySerArgPheIleLeuAspSerSerIleHisTyrAsnGlnAsnAspLysArgAlaGluAsn-655 |
| SEQ. ID. NO. 25313 | 660-AlaSerTyrArgProAlaGlnGlyLysValLeuAsnAlaArgTyrLysTyrGlyArgAsnGluLysIleTyrLeuLysSerAspGlySerTyrPhe-691 |
| SEQ. ID. NO. 25314 | 693-AspLysLeuSerGln-697 |
| SEQ. ID. NO. 25315 | 718-TyrGlyPheGluAlaLysLysProIleGlu-727 |
| SEQ. ID. NO. 25316 | 732-AlaGluTyrLysSerSerCysGlyCysTrp-741 |
| SEQ. ID. NO. 25317 | 751-ValThrGlyGluAsnThrTyrLysAsn-759 |
| SEQ. ID. NO. 25318 | 766-GlnLeuLysAspLeuSerSerValGlyArgAsnProAlaAspArgMetAspVal-783 |

Hydrophilic Regions - Hopp-Woods
| SEQ. ID. NO. 25319 | 28-ValAlaAlaGluGluThrAspAsnProThr-37 |
| SEQ. ID. NO. 25320 | 40-GlySerValArgSerValSerGluProIleGln-50 |
| SEQ. ID. NO. 25321 | 65-AsnGluSerGlySerProGluArgThrGluAlaAlaVal-77 |
| SEQ. ID. NO. 25322 | 79-GlySerGlyGluAlaSerIleProGluAspTyrThr-90 |
| SEQ. ID. NO. 25323 | 93-ValAlaAspArgMetGluGlyGlnSer-101 |
| SEQ. ID. NO. 25324 | 103-ValGlnValArgAlaGluGly-109 |
| SEQ. ID. NO. 25325 | 111-ValValValGluArgAsnArgThrThrLeu-120 |
| SEQ. ID. NO. 25326 | 125-AlaAspTyrAspGlnSerGlyAspThrValThrAlaGlyAspArgPheAlaLeu-142 |
| SEQ. ID. NO. 25327 | 147-ThrLeuIleArgGlyGluThr-153 |
| SEQ. ID. NO. 25328 | 160-GlnGlnThrGlyGluAlaHisAsnValArgMetGluThrGluHisGlyGlyArgArgLeuGlnSerValSerArgThrAlaGluMetLeuGly-190 |
| SEQ. ID. NO. 25329 | 192-GlyHisTyrLysLeuThrGlu-198 |
| SEQ. ID. NO. 25330 | 216-AlaSerValGluAlaAspArgGluLysGlyIleGly-227 |
| SEQ. ID. NO. 25331 | 250-ProLeuAspGlyAsnArgLysSerGly-258 |
| SEQ. ID. NO. 25332 | 266-AlaGlySerAspGlyVal-271 |
| SEQ. ID. NO. 25333 | 294-IleGlyGluArgGlyAlaVal-300 |
| SEQ. ID. NO. 25334 | 305-ValArgTyrLeuArg-309 |
| SEQ. ID. NO. 25335 | 323-HisAspLysLysSerGlyArgAsnAsnArgTyrGlnAla-335 |
| SEQ. ID. NO. 25336 | 337-TrpGlnHisArgHisAspIleSerAsp-345 |
| SEQ. ID. NO. 25337 | 410-SerGlyTyrLysAspLysProTyr-417 |
| SEQ. ID. NO. 25338 | 423-LeuSerAlaAspTrpArgLysAsnThrGlyArgAla-434 |
| SEQ. ID. NO. 25339 | 445-PheSerHisAspSerArgGlnAspGlySerArg-455 |
| SEQ. ID. NO. 25340 | 490-GlySerGlnGluAlaArgArgValSerArg-499 |
| SEQ. ID. NO. 25341 | 510-MetThrPheGluArgAsnThrArg-517 |
| SEQ. ID. NO. 25342 | 539-LysSerGlnAsnAsp-543 |
| SEQ. ID. NO. 25343 | 548-AspSerSerGluSer-552 |
| SEQ. ID. NO. 25344 | 569-AspArgIleAsnThr-573 |
| SEQ. ID. NO. 25345 | 589-AlaThrGlyGluGluArgPheArgAla-597 |
| SEQ. ID. NO. 25346 | 615-SerValGlyLysLysProArgSerArgSerAsp-625 |
| SEQ. ID. NO. 25347 | 648-GlnAsnAspLysArgAlaGluAsn-655 |
| SEQ. ID. NO. 25348 | 662-TyrArgProAlaGln-666 |
| SEQ. ID. NO. 25349 | 674-TyrLysTyrGlyArgAsnGluLysIleTyrLeuLysSerAspGly-688 |
| SEQ. ID. NO. 25350 | 720-PheGluAlaLysLysProIleGlu-727 |
| SEQ. ID. NO. 25351 | 732-AlaGluTyrLysSer-736 |
| SEQ. ID. NO. 25352 | 766-GlnLeuLysAspLeuSerSerValGlyArgAsnProAlaAspArgMetAspVal-783 | a959
AMPHI Regions - AMPHI
| SEQ. ID. NO. 25353 | 56-AlaAlaLeuAlaArgValGlyGly-63 |

Antigenic Index - Jameson-Wolf
| SEQ. ID. NO. 25354 | 24-AlaHisHisAspGlyHisGlyAspAspAspHisGlyHis-36 |
| SEQ. ID. NO. 25355 | 40-GlnHisSerLysGlnAspLysIleIleSer-49 |
| SEQ. ID. NO. 25356 | 51-AlaGlnAlaGluLysAlaAlaLeu-58 |
| SEQ. ID. NO. 25357 | 60-ArgValGlyGlyLysIleThrAspIleAspLeuGluHisAspAsnGlyArgProHisTyrAspValGluIleValLysAsnGlyGlnGluTyr-90 |
| SEQ. ID. NO. 25358 | 94-ValAspAlaArgThrGlyArgValIleSerSerArgArgAspAsp-108 |

Hydrophilic Regions - Hopp-Woods
| SEQ. ID. NO. 25359 | 27-AspGlyHisGlyAspAspAspHisGlyHis-36 |
| SEQ. ID. NO. 25360 | 40-GlnHisSerLysGlnAspLysIleIleSer-49 |
| SEQ. ID. NO. 25361 | 51-AlaGlnAlaGluLysAlaAlaLeu-58 |
| SEQ. ID. NO. 25362 | 61-ValGlyGlyLysIleThrAspIleAspLeuGluHisAspAsnGlyArgProHisTyr-79 |
| SEQ. ID. NO. 25363 | 82-GluIleValLysAsnGlyGlnGluTyr-90 |
| SEQ. ID. NO. 25364 | 94-ValAspAlaArgThrGlyArg-100 |
| SEQ. ID. NO. 25365 | 102-IleSerSerArgArgAspAsp-108 | a972
AMPHI Regions - AMPHI
| SEQ. ID. NO. 25366 | 15-SerSerGluArgMetSerGluValGluTyrPheSerHis-27 |
| SEQ. ID. NO. 25367 | 83-ArgLysLeuGluGluIleLeuGly-90 |

TABLE 1-continued

| SEQ. ID. NO. | Sequence |
|---|---|
| SEQ. ID. NO. 25368 | 100-ArgGlyAsnLysPheTyrGluSerMetTyrArgLeu-111 |
| SEQ. ID. NO. 25369 | 154-LeuAspAspSerIleArg-159 |
| SEQ. ID. NO. 25370 | 226-PheValArgValTyrGluLysGly-233 |
| SEQ. ID. NO. 25371 | 275-IleCysArgLysPheLysAsnMetProValPro-285 |
| SEQ. ID. NO. 25372 | 308-AsnAlaValGlyLysLeuValAsnPhe-316 |
| SEQ. ID. NO. 25373 | 326-GluIleValGluSerLeuLysAla-333 |
| SEQ. ID. NO. 25374 | 336-GlyPheProLysGlyLeuGlu-342 |
| SEQ. ID. NO. 25375 | 348-LeuGluMetLeuArgAspGlyLeuLys-356 |
| SEQ. ID. NO. 25376 | 382-AsnSerAspLysPheAspArg-388 |

Antigenic Index - Jameson-Wolf

| SEQ. ID. NO. | Sequence |
|---|---|
| SEQ. ID. NO. 25377 | 1-LeuThrAsnArgGlyGlyAlaLysLeuLysThrAsnSerLysSerSerGluArgMetSerGlu-21 |
| SEQ. ID. NO. 25378 | 29-IleSerAspGlyLysGlyLysLeuLeuGluIleProGlnArgArgGlyLysGlnAspGlyVal-49 |
| SEQ. ID. NO. 25379 | 62-ThrLeuLeuLysValSerGly-68 |
| SEQ. ID. NO. 25380 | 83-ArgLysLeuGluGlu-87 |
| SEQ. ID. NO. 25381 | 93-IleThrArgLysCysLysSerArgGlyAsnLysPheTyrGlu-106 |
| SEQ. ID. NO. 25382 | 108-MetTyrArgLeuGlySerAspAspValAspTyrGly-119 |
| SEQ. ID. NO. 25383 | 122-HisPheGlyGlyGlnArgAsnThrVal-130 |
| SEQ. ID. NO. 25384 | 134-LeuLysGlyThrGlyCys-139 |
| SEQ. ID. NO. 25385 | 152-GlnPheLeuAspAspSerIleArgThrArgIleThrArg-164 |
| SEQ. ID. NO. 25386 | 172-PheAspGlyGluTyrThrProArgGlnAlaLeuLeuAspHisAspAsnGlyPhePheAspAsnSerAsnGlnArgProLysSerGluThrIleGly-203 |
| SEQ. ID. NO. 25387 | 205-AlaTrpArgAsnGluAspGlySerGlyLys-214 |
| SEQ. ID. NO. 25388 | 217-TyrValGlyArgLysLysAsnSerArgPhe-226 |
| SEQ. ID. NO. 25389 | 228-ArgValTyrGluLysGlyArgGlnLeuGlyAspLysGluSerLysTrpVal-244 |
| SEQ. ID. NO. 25390 | 251-AsnTyrGlyAspIleGluIle-257 |
| SEQ. ID. NO. 25391 | 263-IleAsnGlnGlySer-267 |
| SEQ. ID. NO. 25392 | 275-IleCysArgLysPheLysAsnMetProValProGluArgPheAspGlnArgLysLysThrLeu-295 |
| SEQ. ID. NO. 25393 | 321-GlyPheAspAsnSerGluIleValGluSerLeuLysAlaAspSerGlyPheProLysGlyLeuGluProGluLysTyrAla-347 |
| SEQ. ID. NO. 25394 | 350-MetLeuArgAspGlyLeuLys-356 |
| SEQ. ID. NO. 25395 | 361-HisGluGlnProAspIleAspLeuGluIleGluLeuAspGlu-374 |
| SEQ. ID. NO. 25396 | 380-PheLysAsnSerAspLysPheAspArgGluLysArgLeuPheSerProAspTyrAspValGluLysGluArgLysTyrGlnGluTyrLeu-409 |
| SEQ. ID. NO. 25397 | 417-ValAspTyrAspTyrPhe-422 |

Hydrophilic Regions - Hopp-Woods

| SEQ. ID. NO. | Sequence |
|---|---|
| SEQ. ID. NO. 25398 | 1-LeuThrAsnArgGlyGlyAlaLysLeuLysThrAsnSerLysSerSerGluArgMetSerGlu-21 |
| SEQ. ID. NO. 25399 | 30-SerAspGlyLysGlyLysLeuLeuGluIleProGlnArgArgGlyLysGlnAspGlyVal-49 |
| SEQ. ID. NO. 25400 | 83-ArgLysLeuGluGlu-87 |
| SEQ. ID. NO. 25401 | 93-IleThrArgLysCysLysSerArgGlyAsnLysPheTyr-105 |
| SEQ. ID. NO. 25402 | 111-LeuGlySerAspAspValAspTyrGly-119 |
| SEQ. ID. NO. 25403 | 134-LeuLysGlyThrGly-138 |
| SEQ. ID. NO. 25404 | 152-GlnPheLeuAspAspSerIleArgThrArgIleThrArg-164 |
| SEQ. ID. NO. 25405 | 181-AlaLeuLeuAspHisAspAsnGlyPhe-189 |
| SEQ. ID. NO. 25406 | 193-SerAsnGlnArgProLysSerGluThrIle-202 |
| SEQ. ID. NO. 25407 | 206-TrpArgAsnGluAspGlySerGly-213 |
| SEQ. ID. NO. 25408 | 219-GlyArgLysLysAsnSerArgPhe-226 |
| SEQ. ID. NO. 25409 | 228-ArgValTyrGluLysGlyArgGlnLeuGlyAspLysGluSerLysTrpVal-244 |
| SEQ. ID. NO. 25410 | 277-ArgLysPheLysAsn-281 |
| SEQ. ID. NO. 25411 | 283-ProValProGluArgPheAspGlnArgLysLysThrLeu-295 |
| SEQ. ID. NO. 25412 | 321-GlyPheAspAsnSerGluIleValGluSerLeuLysAlaAspSerGlyPhe-337 |
| SEQ. ID. NO. 25413 | 339-LysGlyLeuGluProGluLysTyrAla-347 |
| SEQ. ID. NO. 25414 | 350-MetLeuArgAspGlyLeuLys-356 |
| SEQ. ID. NO. 25415 | 362-GluGlnProAspIleAspLeuGluIleGluLeuAspGlu-374 |
| SEQ. ID. NO. 25416 | 381-LysAsnSerAspLysPheAspArgGluLysArgLeuPhe-393 |
| SEQ. ID. NO. 25417 | 396-AspTyrAspValGluLysGluArgLysTyrGlnGluTyrLeu-409 | a973

AMPHI Regions - AMPHI

| SEQ. ID. NO. | Sequence |
|---|---|
| SEQ. ID. NO. 25418 | 12-GluArgLeuIleAlaArgLeuAlaArgGluProAspSerAla-25 |
| SEQ. ID. NO. 25419 | 44-AspThrLeuLeuArgLeuGluLysValLeuAspPhe-55 |
| SEQ. ID. NO. 25420 | 77-AspSerIleGluArgIleThrAlaTyr-85 |
| SEQ. ID. NO. 25421 | 112-AspLeuLeuLysTyrMet-117 |
| SEQ. ID. NO. 25422 | 143-AlaLeuLeuLysGluPheArgGluGln-151 |
| SEQ. ID. NO. 25423 | 171-PheGluAspIleIleGluGlnIleValGlyAspIleGluAsp-184 |
| SEQ. ID. NO. 25424 | 208-AlaThrGluIleGluAspIleAsnAlaPhe-217 |
| SEQ. ID. NO. 25425 | 235-IleGlnGluLeuGly-239 |

Antigenic Index - Jameson-Wolf

| SEQ. ID. NO. | Sequence |
|---|---|
| SEQ. ID. NO. 25426 | 1-MetAspGlyAlaGlnProLysThrAsnPhe-10 |
| SEQ. ID. NO. 25427 | 18-LeuAlaArgGluProAspSerAlaGluAsp-27 |
| SEQ. ID. NO. 25428 | 34-GlnAlaHisGluGlnGluValPheAspAlaAspThr-45 |
| SEQ. ID. NO. 25429 | 47-LeuArgLeuGluLysValLeuAsp-54 |
| SEQ. ID. NO. 25430 | 56-SerAspLeuGluValArgAspAlaMetIleThrArgSerArgMetAsnValLeuLysGluAsnAspSerIleGluArg-81 |
| SEQ. ID. NO. 25431 | 96-ValIleGlyGluAspLysAspGluVal-104 |
| SEQ. ID. NO. 25432 | 118-PheAsnProGluGlnPheHis-124 |
| SEQ. ID. NO. 25433 | 136-ProGluGlyLysSer-140 |
| SEQ. ID. NO. 25434 | 146-LysGluPheArgGluGlnArgAsnHis-154 |
| SEQ. ID. NO. 25435 | 159-IleAspGluTyrGlyGlyThrSerGly-167 |
| SEQ. ID. NO. 25436 | 178-IleValGlyAspIleGluAspGluPheAspGluAspGluSerAlaAspAsn-194 |
| SEQ. ID. NO. 25437 | 199-SerAlaGluArgTrpArg-204 |
| SEQ. ID. NO. 25438 | 209-ThrGluIleGluAsp-213 |
| SEQ. ID. NO. 25439 | 219-GlyThrGluTyrSerSerGluGluAlaAspThr-229 |
| SEQ. ID. NO. 25440 | 239-GlyHisLeuProValArgGlyGluLysValLeu-249 |
| SEQ. ID. NO. 25441 | 258-AlaArgAlaAspAsnArgArgLeuHis-266 |

TABLE 1-continued

Hydrophilic Regions - Hopp-Woods
SEQ. ID. NO. 25442    1-MetAspGlyAlaGlnProLys-7
SEQ. ID. NO. 25443    18-LeuAlaArgGluProAspSerAlaGluAsp-27
SEQ. ID. NO. 25444    34-GlnAlaHisGluGlnGluValPheAsp-42
SEQ. ID. NO. 25445    47-LeuArgLeuGluLysValLeuAsp-54
SEQ. ID. NO. 25446    56-SerAspLeuGluValArgAspAlaMetIleThrArgSerArgMetAsnValLeuLysGluAsnAspSerIleGluArg-81
SEQ. ID. NO. 25447    96-ValIleGlyGluAspLysAspGluVal-104
SEQ. ID. NO. 25448    136-ProGluGlyLysSer-140
SEQ. ID. NO. 25449    146-LysGluPheArgGluGlnArgAsn-153
SEQ. ID. NO. 25450    178-IleValGlyAspIleGluAspGluPheAspGluAspGluSerAlaAspAsn-194
SEQ. ID. NO. 25451    199-SerAlaGluArgTrpArg-204
SEQ. ID. NO. 25452    209-ThrGluIleGluAsp-213
SEQ. ID. NO. 25453    222-TyrSerSerGluGluAlaAspThr-229
SEQ. ID. NO. 25454    243-ValArgGlyGluLysValLeu-249
SEQ. ID. NO. 25455    258-AlaArgAlaAspAsnArgArgLeuHis-266
a981
AMPHI Regions - AMPHI
SEQ. ID. NO. 25456    31-AlaAsnProAspLysValTyrArgValAlaSer-41
SEQ. ID. NO. 25457    46-AlaProPheGluSerLeuAsp-52
SEQ. ID. NO. 25458    66-AsnAlaMetAlaLys-70
SEQ. ID. NO. 25459    132-LysIleSerSerSerGluAspLeuLysAsnMetAsnLysValGlyValVal-148
SEQ. ID. NO. 25460    167-LysIleAlaArgPheGlu-172
SEQ. ID. NO. 25461    181-LeuGluAsnGlyGlyLeuAspSerValVal-190
SEQ. ID. NO. 25462    197-AlaAsnTyrValLysAsnAsnPro-204
SEQ. ID. NO. 25463    207-GlyMetAspPheValThrLeuPro-214
SEQ. ID. NO. 25464    233-ValLysMetLeuAsnAspAlaLeuLysLysValArgGluSerGlyGluTyr-249
Antigenic Index - Jameson-Wolf
SEQ. ID. NO. 25465    19-CysGlyGlyGlnGlyLysAspAlaAlaAla-28
SEQ. ID. NO. 25466    31-AlaAsnProAspLysValTyrArg-38
SEQ. ID. NO. 25467    49-GluSerLeuAspSerLysGlyAsnValGluGlyPheAsp-61
SEQ. ID. NO. 25468    76-IleGluPheLysHisGlnProTrpAspSer-85
SEQ. ID. NO. 25469    90-LeuAsnAsnGlyAspAlaAspVal-97
SEQ. ID. NO. 25470    104-IleThrAspAspArgLysGlnSerMetAspPheSerAspProTyrPhe-119
SEQ. ID. NO. 25471    127-ValProLysGlyLysLysIleSerSerSerGluAspLeuLysAsnMetAsnLys-144
SEQ. ID. NO. 25472    160-LeuLeuGlyAsnAspAsnProLysIleAlaArg-170
SEQ. ID. NO. 25473    179-LysGluLeuGluAsnGlyGlyLeuAspSerValValSerAspSerAla-194
SEQ. ID. NO. 25474    201-LysAsnAsnProThrLysGlyMetAspPhe-210
SEQ. ID. NO. 25475    214-ProAspPheThrThr-218
SEQ. ID. NO. 25476    225-ValArgLysGlyAspGluAlaThrVal-233
SEQ. ID. NO. 25477    235-MetLeuAsnAspAlaLeuLysLysValArgGluSerGlyGluTyrAspLysIleTyr-253
SEQ. ID. NO. 25478    257-PheAlaLysGluAspGlyGlnAlaAlaLys-266
Hydrophilic Regions - Hopp-Woods
SEQ. ID. NO. 25479    21-GlyGlnGlyLysAspAlaAlaAla-28
SEQ. ID. NO. 25480    31-AlaAsnProAspLysValTyrArg-38
SEQ. ID. NO. 25481    49-GluSerLeuAspSerLysGlyAsnValGluGlyPheAsp-61
SEQ. ID. NO. 25482    91-AsnAsnGlyAspAlaAspVal-97
SEQ. ID. NO. 25483    104-IleThrAspAspArgLysGlnSerMetAspPheSer-115
SEQ. ID. NO. 25484    128-ProLysGlyLysLysIleSerSerSerGluAspLeuLysAsnMetAsn-143
SEQ. ID. NO. 25485    164-AspAsnProLysIleAlaArg-170
SEQ. ID. NO. 25486    179-LysGluLeuGluAsnGlyGlyLeu-186
SEQ. ID. NO. 25487    203-AsnProThrLysGlyMetAsp-209
SEQ. ID. NO. 25488    225-ValArgLysGlyAspGluAlaThrVal-233
SEQ. ID. NO. 25489    235-MetLeuAsnAspAlaLeuLysLysValArgGluSerGlyGluTyrAspLysIleTyr-253
SEQ. ID. NO. 25490    257-PheAlaLysGluAspGlyGlnAlaAlaLys-266
a982
AMPHI Regions - AMPHI
SEQ. ID. NO. 25491    12-ValArgGlnLysMetValAsnGlyValAsnIleLeuAlaAsnAlaVal-27
SEQ. ID. NO. 25492    71-AlaGlnMetValLysGluValAlaSerLysThr-81
SEQ. ID. NO. 25493    100-ValAlaGluGlyMetLysTyr-106
SEQ. ID. NO. 25494    115-AspLeuLysArgGlyIleAspLysAlaValAlaAlaLeuValGluGluLeuLysAsnIleAlaLysProCysAspThrSerLysGluIleAlaGln
                      ValGlySer-149
SEQ. ID. NO. 25495    160-AlaIleIleAlaGluAlaMetGluLysValGly-170
SEQ. ID. NO. 25496    185-AsnGluLeuAspValValGluGlyMet-193
SEQ. ID. NO. 25497    209-GluLysGlnIleAlaGlyLeuAsp-216
SEQ. ID. NO. 25498    227-IleSerAsnIleArgAspLeuLeuProValLeuGluGlnValAlaLysAla-243
SEQ. ID. NO. 25499    265-AsnAsnIleArgGlyIleLeuLysThrValAla-275
SEQ. ID. NO. 25500    313-ThrLeuAspAspLeuGlyGlnAlaLysArgIle-323
SEQ. ID. NO. 25501    331-ThrIleIleAspGlyPheGlyAspAlaAla-340
SEQ. ID. NO. 25502    367-GluArgValAlaLysLeuAlaGlyGlyVal-376
SEQ. ID. NO. 25503    426-LeuGluAsnLeuHisThr-431
SEQ. ID. NO. 25504    444-LeuArgAlaValGluSerProLeuArgGlnIleValAlaAsnAla-458
SEQ. ID. NO. 25505    484-GluTyrGlyAspMetIleGluMet-491
SEQ. ID. NO. 25506    500-ThrArgSerAlaLeu-504
Antigenic Index - Jameson-Wolf
SEQ. ID. NO. 25507    1-MetAlaAlaLysAspValGlnPhe-8
SEQ. ID. NO. 25508    10-AsnGluValArgGlnLysMetValAsn-18
SEQ. ID. NO. 25509    30-ThrLeuGlyProLysGlyArgAsnValValVal-40
SEQ. ID. NO. 25510    43-AlaPheGlyGlyProHisIleThrLysAspGlyValThrValAlaLysGluIleGluLeuLysAspLysPheGluAsnMetGly-70
SEQ. ID. NO. 25511    73-MetValLysGluValAlaSerLysThrAsnAspValAlaGlyAspGlyThrThr-90
SEQ. ID. NO. 25512    112-AsnProThrAspLeuLysArgGlyIleAspLysAlaVal-124

TABLE 1-continued

| | |
|---|---|
| SEQ. ID. NO. 25513 | 129-GluGluLeuLysAsnIleAlaLysProCysAspThrSerLysGluIleAla-145 |
| SEQ. ID. NO. 25514 | 150-IleSerAlaAsnSerAspGluGlnVal-158 |
| SEQ. ID. NO. 25515 | 164-GluAlaMetGluLysValGlyLysGluGlyValIleThrValGluAspGlyLysSerLeuGluAsnGluLeuAspVal-189 |
| SEQ. ID. NO. 25516 | 193-MetGlnPheAspArgGlyTyr-199 |
| SEQ. ID. NO. 25517 | 207-AspAlaGluLysGlnIleAla-213 |
| SEQ. ID. NO. 25518 | 223-PheAspLysLysIleSerAsnIleArgAsp-232 |
| SEQ. ID. NO. 25519 | 239-GlnValAlaLysAlaSerArg-245 |
| SEQ. ID. NO. 25520 | 252-GluAspValGluGlyGluAla-258 |
| SEQ. ID. NO. 25521 | 266-AsnIleArgGlyIleLeu-271 |
| SEQ. ID. NO. 25522 | 278-AlaProGlyPheGlyAspArgArgLysAlaMetLeu-289 |
| SEQ. ID. NO. 25523 | 301-IleSerGluGluValGlyLeuSerLeuGluLysAlaThrLeuAspAspLeuGlyGlnAlaLysArgIleGluIleGlyLysGluAsnThrThr-331 |
| SEQ. ID. NO. 25524 | 334-AspGlyPheGlyAspAlaAlaAlaGlnIleGluAlaArgValAlaGluIleArgGlnGlnIleGluThrAlaThrSerAspTyrAspLysGluLysLeu GlnGluArgValAlaLysLeuAlaGly-374 |
| SEQ. ID. NO. 25525 | 385-ThrGluValGluMetLysGluLysLysAspArgValGluAspAlaLeuHis-401 |
| SEQ. ID. NO. 25526 | 405-AlaAlaValGluGluGlyVal-411 |
| SEQ. ID. NO. 25527 | 421-ArgAlaArgAlaAlaLeu-426 |
| SEQ. ID. NO. 25528 | 429-LeuHisThrGlyAsnAlaAspGlnAspAlaGlyVal-440 |
| SEQ. ID. NO. 25529 | 446-AlaValGluSerProLeuArg-452 |
| SEQ. ID. NO. 25530 | 457-AsnAlaGlyGlyGluProSerVal-464 |
| SEQ. ID. NO. 25531 | 469-ValLeuGluGlyLysGlyAsnTyrGlyTyr-478 |
| SEQ. ID. NO. 25532 | 480-AlaGlySerGlyGluTyrGlyAspMetIleGlu-490 |
| SEQ. ID. NO. 25533 | 495-AspProAlaLysValThrArgSerAlaLeu-504 |
| SEQ. ID. NO. 25534 | 523-GluIleProGluAspLysProAlaMetProAspMetGlyGly-536 |
| Hydrophilic Regions - Hopp-Woods | |
| SEQ. ID. NO. 25535 | 1-MetAlaAlaLysAspValGlnPhe-8 |
| SEQ. ID. NO. 25536 | 10-AsnGluValArgGlnLysMet-16 |
| SEQ. ID. NO. 25537 | 33-ProLysGlyArgAsnValValVal-40 |
| SEQ. ID. NO. 25538 | 48-HisIleThrLysAspGlyValThrValAlaLysGluIleGluLeuLysAspLysPheGluAsn-68 |
| SEQ. ID. NO. 25539 | 73-MetValLysGluValAlaSerLysThrAsnAspValAlaGlyAspGlyThrThr-90 |
| SEQ. ID. NO. 25540 | 114-ThrAspLeuLysArgGlyIleAspLysAlaVal-124 |
| SEQ. ID. NO. 25541 | 129-GluGluLeuLysAsnIleAlaLysProCysAspThrSerLysGluIleAla-145 |
| SEQ. ID. NO. 25542 | 152-AlaAsnSerAspGluGlnVal-158 |
| SEQ. ID. NO. 25543 | 164-GluAlaMetGluLysValGlyLysGluGlyValIleThrValGluAspGlyLysSerLeuGluAsnGluLeuAspVal-189 |
| SEQ. ID. NO. 25544 | 207-AspAlaGluLysGlnIleAla-213 |
| SEQ. ID. NO. 25545 | 223-PheAspLysLysIleSerAsnIleArgAsp-232 |
| SEQ. ID. NO. 25546 | 239-GlnValAlaLysAlaSerArg-245 |
| SEQ. ID. NO. 25547 | 252-GluAspValGluGlyGluAla-258 |
| SEQ. ID. NO. 25548 | 280-GlyPheGlyAspArgArgLysAlaMetLeu-289 |
| SEQ. ID. NO. 25549 | 301-IleSerGluGluValGlyLeuSerLeuGluLysAlaThrLeuAspAspLeuGlyGlnAlaLysArgIleGluIleGlyLysGluAsnThrThr-331 |
| SEQ. ID. NO. 25550 | 340-AlaGlnIleGluAlaArgValAlaGluIleArgGlnGlnIleGluThrAlaThrSerAspTyrAspLysGluLysLeuGlnGluArgValAlaLys-371 |
| SEQ. ID. NO. 25551 | 385-ThrGluValGluMetLysGluLysLysAspArgValGluAspAlaLeuHis-401 |
| SEQ. ID. NO. 25552 | 405-AlaAlaValGluGluGlyVal-411 |
| SEQ. ID. NO. 25553 | 421-ArgAlaArgAlaAlaLeu-426 |
| SEQ. ID. NO. 25554 | 432-GlyAsnAlaAspGlnAspAla-438 |
| SEQ. ID. NO. 25555 | 446-AlaValGluSerProLeu-451 |
| SEQ. ID. NO. 25556 | 458-AlaGlyGlyGluPro-462 |
| SEQ. ID. NO. 25557 | 469-ValLeuGluGlyLysGly-474 |
| SEQ. ID. NO. 25558 | 481-GlySerGlyGluTyrGlyAsp-487 |
| SEQ. ID. NO. 25559 | 495-AspProAlaLysValThrArg-501 |
| SEQ. ID. NO. 25560 | 523-GluIleProGluAspLysProAlaMet-531 |
| a986 | |
| AMPHI Regions - AMPHI | |
| SEQ. ID. NO. 25561 | 6-GlnTyrLeuAlaLeuAla-11 |
| SEQ. ID. NO. 25562 | 18-LeuAlaGlyCysAspLysAlaGly-25 |
| SEQ. ID. NO. 25563 | 36-SerPheValGluArgIleLysHis-43 |
| SEQ. ID. NO. 25564 | 52-MetLeuLeuProAspPheValGlnLeuVal-61 |
| SEQ. ID. NO. 25565 | 97-AspProPheTyrGluPhePheLysArgLeuValProAsnMetProGluIleProGln-115 |
| SEQ. ID. NO. 25566 | 145-ThrGlyMetGlySerIle-150 |
| SEQ. ID. NO. 25567 | 162-AlaLysLeuIleGlySerAspVal-169 |
| SEQ. ID. NO. 25568 | 189-IleGlyAsnProLysAspLeuLysProGly-198 |
| SEQ. ID. NO. 25569 | 200-TrpValAlaAlaIleGly-205 |
| SEQ. ID. NO. 25570 | 287-AlaGluGlnLeuLysAsnThrGlyLysVal-296 |
| SEQ. ID. NO. 25571 | 393-AlaAlaGluHisIleGlyAlaSer-400 |
| SEQ. ID. NO. 25572 | 471-ArgLysAlaMetAspLysAla-477 |
| Antigenic Index - Jameson-Wolf | |
| SEQ. ID. NO. 25573 | 1-ValPheLysLysTyr-5 |
| SEQ. ID. NO. 25574 | 20-GlyCysAspLysAlaGly-25 |
| SEQ. ID. NO. 25575 | 29-GlyAlaAspLysLysGluAlaSerPheValGluArgIleLysHisThrLysAspAspGlySerVal-50 |
| SEQ. ID. NO. 25576 | 61-ValGlnSerGluGlyProAla-67 |
| SEQ. ID. NO. 25577 | 75-ProAlaProArgThrGlnAsnGlySerSerAsnAlaGluThrAspSerAspProLeuAlaAspSerAspProPhe-99 |
| SEQ. ID. NO. 25578 | 104-LysArgLeuValProAsnMetProGluIleProGlnGluGluAlaAspAspGlyGlyLeu-123 |
| SEQ. ID. NO. 25579 | 130-IleIleSerLysAspGlyTyr-136 |
| SEQ. ID. NO. 25580 | 154-LeuAsnAspLysArgGluTyrThr-161 |
| SEQ. ID. NO. 25581 | 165-IleGlySerAspValGlnSerAspValAla-174 |
| SEQ. ID. NO. 25582 | 179-AspAlaThrGluGluLeuPro-185 |
| SEQ. ID. NO. 25583 | 189-IleGlyAsnProLysAspLeuLysProGlyGlu-199 |
| SEQ. ID. NO. 25584 | 208-PheGlyPheAspAsnSerValThr-215 |
| SEQ. ID. NO. 25585 | 218-XxxValSerAlaLysGlyArgSerLeuProAsnGluSerTyr-231 |
| SEQ. ID. NO. 25586 | 242-AsnProGlyAsnGlyGlyPro-249 |
| SEQ. ID. NO. 25587 | 265-TyrSerArgSerGlyGly-270 |

TABLE 1-continued

| | |
|---|---|
| SEQ. ID. NO. 25588 | 288-GluGlnLeuLysAsnThrGlyLysValGlnArgGlyGlnLeu-301 |
| SEQ. ID. NO. 25589 | 316-PheGlyLeuAspLysAlaGlyGly-323 |
| SEQ. ID. NO. 25590 | 330-LeuProGlySerProAlaGluArgAlaGlyLeuArgAlaGlyAsp-344 |
| SEQ. ID. NO. 25591 | 349-LeuAspGlyGlyGluIleArgSerSerGlyAspLeu-360 |
| SEQ. ID. NO. 25592 | 368-ThrProGlyLysGluValSer-374 |
| SEQ. ID. NO. 25593 | 378-TrpArgLysGlyGluGluIleThrIle-386 |
| SEQ. ID. NO. 25594 | 397-IleGlyAlaSerSerLysThrAspGluAlaProTyrThrGluGlnGlnSerGlyThrPhe-416 |
| SEQ. ID. NO. 25595 | 427-ThrHisThrAspSerSerGlyGly-434 |
| SEQ. ID. NO. 25596 | 440-ArgValSerAspAlaAlaGluArgAlaGlyLeuArgArgGlyAspGluIleLeu-457 |
| SEQ. ID. NO. 25597 | 463-ProValAsnAspGluAlaGlyPheArgLysAlaMetAspLysAlaGlyLysAsnVal-481 |
| SEQ. ID. NO. 25598 | 486-MetArgArgGlyAsnThr-491 |
| Hydrophilic Regions - Hopp-Woods | |
| SEQ. ID. NO. 25599 | 20-GlyCysAspLysAlaGly-25 |
| SEQ. ID. NO. 25600 | 29-GlyAlaAspLysLysGluAlaSerPheValGluArgIleLysHisThrLysAspAspGlySer-49 |
| SEQ. ID. NO. 25601 | 75-ProAlaProArgThrGlnAsnGlySerSerAsnAlaGluThrAspSerAspProLeuAlaAspSerAspPro-98 |
| SEQ. ID. NO. 25602 | 111-ProGluIleProGlnGluGluAlaAspAspGlyGly-122 |
| SEQ. ID. NO. 25603 | 131-IleSerLysAspGly-135 |
| SEQ. ID. NO. 25604 | 154-LeuAsnAspLysArgGluTyrThr-161 |
| SEQ. ID. NO. 25605 | 179-AspAlaThrGluGluLeuPro-185 |
| SEQ. ID. NO. 25606 | 190-GlyAsnProLysAspLeuLysPro-197 |
| SEQ. ID. NO. 25607 | 219-ValSerAlaLysGlyArgSerLeuPro-227 |
| SEQ. ID. NO. 25608 | 288-GluGlnLeuLysAsnThrGlyLysValGlnArgGlyGln-300 |
| SEQ. ID. NO. 25609 | 317-GlyLeuAspLysAlaGly-322 |
| SEQ. ID. NO. 25610 | 333-SerProAlaGluArgAlaGlyLeuArgAlaGlyAsp-344 |
| SEQ. ID. NO. 25611 | 350-AspGlyGlyGluIleArgSerSerGlyAsp-359 |
| SEQ. ID. NO. 25612 | 368-ThrProGlyLysGluValSer-374 |
| SEQ. ID. NO. 25613 | 379-ArgLysGlyGluGluIleThrIle-386 |
| SEQ. ID. NO. 25614 | 397-IleGlyAlaSerSerLysThrAspGluAlaProTyrThrGluGlnGlnSer-413 |
| SEQ. ID. NO. 25615 | 428-HisThrAspSerSerGly-433 |
| SEQ. ID. NO. 25616 | 440-ArgValSerAspAlaAlaGluArgAlaGlyLeuArgArgGlyAspGluIleLeu-457 |
| SEQ. ID. NO. 25617 | 463-ProValAsnAspGluAlaGlyPheArgLysAlaMetAspLysAlaGlyLys-479 |
| a987 | |
| AMPHI Regions - AMPHI | |
| SEQ. ID. NO. 25618 | 17-CysSerSerTrpLeu-21 |
| SEQ. ID. NO. 25619 | 33-PheAsnThrSerLysProValArgLeuAspAsnIleLeuGlnIle-47 |
| SEQ. ID. NO. 25620 | 65-ProHisGluAlaPhe-69 |
| SEQ. ID. NO. 25621 | 144-AsnProPheValLeuArgLysTrpArgAlaLeuGlyTyrLeuThrAspPheProArgLeuAsnArg-165 |
| SEQ. ID. NO. 25622 | 187-GlyAspGluTyrPheLysVal-193 |
| SEQ. ID. NO. 25623 | 202-LeuAspIleLeuAlaThr-207 |
| SEQ. ID. NO. 25624 | 211-ValGlyGluValSerHisAspPheAspArgTyrTrpAla-223 |
| SEQ. ID. NO. 25625 | 230-AlaThrArgIleIleArgSerGly-237 |
| SEQ. ID. NO. 25626 | 239-IleGlyLysGlyLeuGlnAla-245 |
| SEQ. ID. NO. 25627 | 289-SerAspAspProAlaLysGlyLeuAspArg-298 |
| SEQ. ID. NO. 25628 | 307-GlyArgLeuGlnAspAlaLeuLysGlnPro-316 |
| SEQ. ID. NO. 25629 | 333-GlyThrAspAlaLeuAlaLysLeuValGlnAsp-343 |
| SEQ. ID. NO. 25630 | 355-GlnAlaThrAspValAlaAla-361 |
| SEQ. ID. NO. 25631 | 443-LysIleAlaGluGlnMetGluArgThrLeuAlaAspThr-455 |
| SEQ. ID. NO. 25632 | 486-ProGluAlaLysLeuTrpLysArgIleAlaAlaLysIleLeuSerLeuLeuProIleGluSerLeu-507 |
| Antigenic Index - Jameson-Wolf | |
| SEQ. ID. NO. 25633 | 1-MetLysThrArgSer-5 |
| SEQ. ID. NO. 25634 | 23-ProLeuGluGluArgThrGluSerArgHisPheAsnThrSerLysProValArgLeu-41 |
| SEQ. ID. NO. 25635 | 49-HisThrProHisThrAsnGlyLeuSer-57 |
| SEQ. ID. NO. 25636 | 77-GluSerAlaGluHisSerLeu-83 |
| SEQ. ID. NO. 25637 | 90-TrpArgAsnAspIleSerGlyArgLeu-98 |
| SEQ. ID. NO. 25638 | 107-AlaGluArgGlyValArg-112 |
| SEQ. ID. NO. 25639 | 115-LeuLeuLeuAspAspAsnAsnThrArgGlyLeuAsp-126 |
| SEQ. ID. NO. 25640 | 134-SerHisProAsnIleGluValArgLeu-142 |
| SEQ. ID. NO. 25641 | 159-AspPheProArgLeuAsnArgArgMetHisAsnLysSerPheThrAlaAspAsnArgAla-178 |
| SEQ. ID. NO. 25642 | 182-GlyGlyArgAlaAsnIleGlyAspGluTyrPheLysValGlyGluAspThrVal-198 |
| SEQ. ID. NO. 25643 | 214-ValSerHisAspPheAspArgTyrTrp-222 |
| SEQ. ID. NO. 25644 | 225-HisSerAlaHisAsn-229 |
| SEQ. ID. NO. 25645 | 232-ArgIleIleArgSerGlyAsnIleGlyLysGlyLeu-243 |
| SEQ. ID. NO. 25646 | 247-GlyTyrAsnAspGluThrSerArg-254 |
| SEQ. ID. NO. 25647 | 259-ArgTyrArgGluThrValGlu-265 |
| SEQ. ID. NO. 25648 | 267-SerProLeuTyrGln-271 |
| SEQ. ID. NO. 25649 | 273-IleGlnThrGlyArgIleAsp-279 |
| SEQ. ID. NO. 25650 | 287-LeuIleSerAspAspProAlaLysGlyLeuAspArgAspArgArgLysProProIle-305 |
| SEQ. ID. NO. 25651 | 308-ArgLeuGlnAspAlaLeuLysGlnProGluLysSer-319 |
| SEQ. ID. NO. 25652 | 328-ValProThrLysSerGlyThrAspAlaLeu-337 |
| SEQ. ID. NO. 25653 | 340-LeuValGlnAspGlyIleAsp-346 |
| SEQ. ID. NO. 25654 | 367-ValLysTyrArgLysProLeuLeu-374 |
| SEQ. ID. NO. 25655 | 391-AlaThrLysAspLysGlyLeuThrGlySerSer-401 |
| SEQ. ID. NO. 25656 | 412-ValAspGlyLysArgIlePhe-418 |
| SEQ. ID. NO. 25657 | 422-PheAsnLeuAspProArgSerAlaArgLeuAsnThr-433 |
| SEQ. ID. NO. 25658 | 440-GluSerProLysIleAlaGluGlnMetGluArgThrLeuAlaAspThrSerProGluTyrAla-460 |
| SEQ. ID. NO. 25659 | 463-ValThrLeuAspArgHisAsnArgLeuGlnTrpHisAspProAlaThrArgLysThrTyrProAsnGluProGluAlaLysLeuTrpLys-492 |
| Hydrophilic Regions - Hopp-Woods | |
| SEQ. ID. NO. 25660 | 1-MetLysThrArgSer-5 |
| SEQ. ID. NO. 25661 | 24-LeuGluGluArgThrGluSerArgHisPheAsnThr-35 |
| SEQ. ID. NO. 25662 | 37-LysProValArgLeu-41 |

TABLE 1-continued

| | |
|---|---|
| SEQ. ID. NO. 25663 | 77-GluSerAlaGluHisSerLeu-83 |
| SEQ. ID. NO. 25664 | 107-AlaGluArgGlyValArg-112 |
| SEQ. ID. NO. 25665 | 115-LeuLeuLeuAspAspAsnAsnThrArgGlyLeuAsp-126 |
| SEQ. ID. NO. 25666 | 161-ProArgLeuAsnArgArgMetHisAsn-169 |
| SEQ. ID. NO. 25667 | 172-PheThrAlaAspAsnArgAla-178 |
| SEQ. ID. NO. 25668 | 189-GluTyrPheLysValGlyGluAspThrVal-198 |
| SEQ. ID. NO. 25669 | 214-ValSerHisAspPheAspArg-220 |
| SEQ. ID. NO. 25670 | 248-TyrAsnAspGluThrSerArg-254 |
| SEQ. ID. NO. 25671 | 259-ArgTyrArgGluThrValGlu-265 |
| SEQ. ID. NO. 25672 | 274-GlnThrGlyArgIleAsp-279 |
| SEQ. ID. NO. 25673 | 287-LeuIleSerAspAspProAlaLysGlyLeuAspArgAspArgArgLysProProIle-305 |
| SEQ. ID. NO. 25674 | 308-ArgLeuGlnAspAlaLeuLysGlnProGluLysSer-319 |
| SEQ. ID. NO. 25675 | 331-LysSerGlyThrAspAlaLeu-337 |
| SEQ. ID. NO. 25676 | 340-LeuValGlnAspGlyIleAsp-346 |
| SEQ. ID. NO. 25677 | 367-ValLysTyrArgLysProLeuLeu-374 |
| SEQ. ID. NO. 25678 | 391-AlaThrLysAspLysGlyLeuThr-398 |
| SEQ. ID. NO. 25679 | 424-LeuAspProArgSerAlaArgLeuAsnThr-433 |
| SEQ. ID. NO. 25680 | 440-GluSerProLysIleAlaGluGlnMetGluArgThrLeuAlaAspThrSerPro-457 |
| SEQ. ID. NO. 25681 | 464-ThrLeuAspArgHisAsnArg-470 |
| SEQ. ID. NO. 25682 | 476-ProAlaThrArgLysThrTyrProAsnGluProGluAlaLysLeuTrpLys-492 |
| a988 | |
| AMPHI Regions - AMPHI | |
| SEQ. ID. NO. 25683 | 45-SerLysIleGluAlaLeu-50 |
| SEQ. ID. NO. 25684 | 66-ArgArgLeuLysAlaMet-71 |
| SEQ. ID. NO. 25685 | 125-GlnMetArgGlyIle-129 |
| SEQ. ID. NO. 25686 | 154-AspIleValGluArgAlaGlnSerLysVal-163 |
| SEQ. ID. NO. 25687 | 221-AlaLysIleIleGluValLeuGlyAspTyrAlaAsp-232 |
| SEQ. ID. NO. 25688 | 248-HisGlnPheSerGluAlaCysAlaLysAlaAlaLysLysIleProAspHisValArgLys-267 |
| SEQ. ID. NO. 25689 | 288-ThrAlaArgAspPheAspAsp-294 |
| SEQ. ID. NO. 25690 | 299-GluLysIleGlyArgAsnTyrArg-306 |
| SEQ. ID. NO. 25691 | 310-AlaIleAlaAspValSerHisTyrValArgProAspAsp-322 |
| SEQ. ID. NO. 25692 | 348-AsnLeuSerAsnGly-352 |
| SEQ. ID. NO. 25693 | 396-AsnGlnValTrpLysTrpLeuSer-403 |
| SEQ. ID. NO. 25694 | 405-GlyIleGluHisPro-409 |
| SEQ. ID. NO. 25695 | 411-LysThrGlnIleAspThrLeuTyrLysLeuPheLysIleLeuGlnLys-426 |
| SEQ. ID. NO. 25696 | 494-LeuGlyProThrProGluLysLeuAlaAlaLeu-504 |
| SEQ. ID. NO. 25697 | 524-LysAspTyrAlaAlaLeuAla-530 |
| SEQ. ID. NO. 25698 | 544-ValMetMetLeuArgSerMetGlnGlnAla-553 |
| SEQ. ID. NO. 25699 | 569-AlaTyrAlaHisPheThrSerProIleArgArgTyrProAspLeuThrValHisArgAlaIleLysAlaValLeu-593 |
| SEQ. ID. NO. 25700 | 619-AspAspAlaSerArgAspValGluAsnTrpLeuLys-630 |
| SEQ. ID. NO. 25701 | 646-IleSerGlyMetThrSerPheGlyIlePheValThrLeu-658 |
| SEQ. ID. NO. 25702 | 662-HisIleAspGlyLeuValHisIleSerAspLeuGlyGlu-674 |
| Antigenic Index - Jameson-Wolf | |
| SEQ. ID. NO. 25703 | 1-MetAsnLysAsnIleLys-6 |
| SEQ. ID. NO. 25704 | 8-LeuAsnLeuArgGluLysAspProPheLeuSerArgGluLysGlnArgTyrGluHisProLeuProSerArgGluTrpIle-34 |
| SEQ. ID. NO. 25705 | 37-LeuLeuGluArgLysGlyValProSerLysIleGluAlaLeuValArg-52 |
| SEQ. ID. NO. 25706 | 54-LeuSerIleLysGluGluGluTyrGluPhePheGluArgArgLeuLysAlaMetAlaArgAspGlyGln-76 |
| SEQ. ID. NO. 25707 | 79-IleAsnArgArgGlyAlaVal-85 |
| SEQ. ID. NO. 25708 | 87-AlaAlaAspLysLeuAspLeuValLysCysArgValLysAlaHisLysAspArgPheGlyPhe-107 |
| SEQ. ID. NO. 25709 | 111-LeuThrProAlaLysAspGlyAsp-118 |
| SEQ. ID. NO. 25710 | 124-ArgGlnMetArgGly-128 |
| SEQ. ID. NO. 25711 | 140-AlaGlyMetAspGlyArgGlyArgArgGluGlyThrVal-152 |
| SEQ. ID. NO. 25712 | 155-IleValGluArgAlaGlnSerLysValValGly-165 |
| SEQ. ID. NO. 25713 | 167-PheXxxMetAspArgGlyValAla-174 |
| SEQ. ID. NO. 25714 | 176-LeuGluProGluAspLysArgLeuAsnGln-185 |
| SEQ. ID. NO. 25715 | 189-LeuGluProAspGlyValAlaArgPheLysProGluSerGlyGln-203 |
| SEQ. ID. NO. 25716 | 210-GluValTyrProGluGlnAsnArgProAlaVal-220 |
| SEQ. ID. NO. 25717 | 227-LeuGlyAspTyrAlaAspSerGlyMetGluIle-237 |
| SEQ. ID. NO. 25718 | 239-IleAlaValArgLysHisHisLeu-246 |
| SEQ. ID. NO. 25719 | 253-AlaCysAlaLysAlaAlaLysLysIleProAspHisValArgLysSerAspLeuLysGlyArgValAspLeuArgAsp-278 |
| SEQ. ID. NO. 25720 | 283-ThrIleAspGlyGluThrAlaArgAspPheAspAsp-294 |
| SEQ. ID. NO. 25721 | 299-GluLysIleGlyArgAsnTyrArg-306 |
| SEQ. ID. NO. 25722 | 316-HisTyrValArgProAspAspAlaIleAspThrAspAlaGlnGluArgSerThrSerVal-335 |
| SEQ. ID. NO. 25723 | 337-PheProArgArgVal-341 |
| SEQ. ID. NO. 25724 | 345-LeuProGluAsnLeuSerAsnGly-352 |
| SEQ. ID. NO. 25725 | 374-AlaGlyAsnIleLysGluTyrArgPhe-382 |
| SEQ. ID. NO. 25726 | 402-LeuSerGlyGlyIleGluHisProPheLysThrGlnIle-414 |
| SEQ. ID. NO. 25727 | 424-LeuGlnLysLysArgPheGluArgGlyAlaValGluPheAspSerIleGlu-440 |
| SEQ. ID. NO. 25728 | 443-MetLeuPheAspAspAsnGlyLysIleGluLys-453 |
| SEQ. ID. NO. 25729 | 458-ValArgAsnAspAlaHisLysLeuIleGlu-467 |
| SEQ. ID. NO. 25730 | 482-LeuLysAsnLysHisThrAla-488 |
| SEQ. ID. NO. 25731 | 493-HisLeuGlyProThrProGluLysLeuAlaAlaLeuArgGluGlnLeu-508 |
| SEQ. ID. NO. 25732 | 516-GlyGlyGlyAspAsnProSerProLysAspTyrAla-527 |
| SEQ. ID. NO. 25733 | 532-GlnPheLysGlyArgProAspAlaGluLeu-541 |
| SEQ. ID. NO. 25734 | 556-GluProHisCysAspGlyHis-562 |
| SEQ. ID. NO. 25735 | 575-SerProIleArgArgTyrProAspLeuThrVal-585 |
| SEQ. ID. NO. 25736 | 597-ThrTyrThrProLysLysSerTrp-604 |
| SEQ. ID. NO. 25737 | 613-PheCysGluArgArgAlaAspAspAlaSerArgAspValGluAsn-627 |
| SEQ. ID. NO. 25738 | 633-TyrMetArgAspLysValGlyGluValPheGluGlyLysIleSerGly-648 |
| SEQ. ID. NO. 25739 | 670-SerAspLeuGlyGluAspTyrPheAsnPheArgPro-681 |

TABLE 1-continued

| | |
|---|---|
| SEQ. ID. NO. 25740 | 683-IleMetAlaIleGluGlyGluArgSerGlyIleArgPheAsnMetGlyAspArgValAlaValArgValAlaArgAlaAspLeuAspAspGly LysIle-715 |
| SEQ. ID. NO. 25741 | 722-GlyGlySerGlyArgGlyArgLysValLysSerSerAlaSerAlaLysProAlaGlyThrAlaGlyLysGlyLysProLysThrAlaAlaGluLys LysThrAlaArgGlyGlyLysValArgGlyArgGlyAlaSerAlaAlaAlaGluSerArgLysLysAlaLysLysProValProIleLysValLysLysArgLys GlyLysSer-791 |
| Hydrophilic Regions - Hopp-Woods | |
| SEQ. ID. NO. 25742 | 1-MetAsnLysAsnIleLys-6 |
| SEQ. ID. NO. 25743 | 8-LeuAsnLeuArgGluLysAspProPheLeuSerArgGluLysGlnArgTyrGluHis-26 |
| SEQ. ID. NO. 25744 | 37-LeuLeuGluArgLysGlyValProSerLysIleGluAlaLeuValArg-52 |
| SEQ. ID. NO. 25745 | 54-LeuSerIleLysGluGluGluTyrGluPhePheGluArgArgLeuLysAlaMetAlaArgAspGlyGln-76 |
| SEQ. ID. NO. 25746 | 79-IleAsnArgArgGlyAla-84 |
| SEQ. ID. NO. 25747 | 87-AlaAlaAspLysLeuAspLeuValLysCysArgValLysAlaHisLysAspArgPhe-105 |
| SEQ. ID. NO. 25748 | 113-ProAlaLysAspGlyAsp-118 |
| SEQ. ID. NO. 25749 | 140-AlaGlyMetAspGlyArgGlyArgArgGluGlyThrVal-152 |
| SEQ. ID. NO. 25750 | 155-IleValGluArgAlaGlnSerLysValValGly-165 |
| SEQ. ID. NO. 25751 | 167-PheXxxMetAspArgGlyValAla-174 |
| SEQ. ID. NO. 25752 | 176-LeuGluProGluAspLysArgLeuAsn-184 |
| SEQ. ID. NO. 25753 | 189-LeuGluProAspGlyValAlaArgPheLysProGluSerGly-202 |
| SEQ. ID. NO. 25754 | 210-GluValTyrProGluGlnAsnArgProAlaVal-220 |
| SEQ. ID. NO. 25755 | 230-TyrAlaAspSerGlyMetGluIle-237 |
| SEQ. ID. NO. 25756 | 239-IleAlaValArgLysHisHis-245 |
| SEQ. ID. NO. 25757 | 253-AlaCysAlaLysAlaLysLysIleProAspHisValArgLysSerAspLeuLysGlyArgValAspLeuArgAsp-278 |
| SEQ. ID. NO. 25758 | 284-IleAspGlyGluThrAlaArgAspPheAspAsp-294 |
| SEQ. ID. NO. 25759 | 300-LysIleGlyArgAsnTyr-305 |
| SEQ. ID. NO. 25760 | 318-ValArgProAspAspAlaIleAspThrAspAlaGlnGluArgSerThr-333 |
| SEQ. ID. NO. 25761 | 376-AsnIleLysGluTyrArg-381 |
| SEQ. ID. NO. 25762 | 424-LeuGlnLysLysArgPheGluArgGlyAlaValGluPheAspSerIleGlu-440 |
| SEQ. ID. NO. 25763 | 443-MetLeuPheAspAspAsnGlyLysIleGluLys-453 |
| SEQ. ID. NO. 25764 | 458-ValArgAsnAspAlaHisLysLeuIleGlu-467 |
| SEQ. ID. NO. 25765 | 496-ProThrProGluLysLeuAlaAlaAlaLeuArgGluGlnLeu-508 |
| SEQ. ID. NO. 25766 | 517-GlyGlyAspAsnProSerProLysAspTyrAla-527 |
| SEQ. ID. NO. 25767 | 533-PheLysGlyArgProAspAlaGluLeu-541 |
| SEQ. ID. NO. 25768 | 576-ProIleArgArgTyrProAsp-582 |
| SEQ. ID. NO. 25769 | 598-TyrThrProLysLysSerTrp-604 |
| SEQ. ID. NO. 25770 | 613-PheCysGluArgArgAlaAspAspAlaSerArgAspValGluAsn-627 |
| SEQ. ID. NO. 25771 | 633-TyrMetArgAspLysValGlyGluValPheGluGlyLysIle-646 |
| SEQ. ID. NO. 25772 | 683-IleMetAlaIleGluGlyGluArgSerGlyIle-693 |
| SEQ. ID. NO. 25773 | 696-AsnMetGlyAspArgValAlaValArgValAlaArgAlaAspLeuAspAspGlyLysIle-715 |
| SEQ. ID. NO. 25774 | 723-GlySerGlyArgGlyArgLysValLysSerSerAlaSerAlaLysProAlaGlyThrAlaGlyLysGlyLysProLysThrAlaAlaGluLys LysThrAlaArgGlyGlyLysValArgGlyArgGlyAlaSerAlaAlaAlaGluSerArgLysLysAlaLysLysProValProIleLysValLysLysArgLys GlyLysSer-791 |
| a989 | |
| AMPHIRegions - AMPHI | |
| SEQ. ID. NO. 25775 | 58-AlaGlyLeuThrLysLeu-63 |
| SEQ. ID. NO. 25776 | 85-SerAlaThrAspPhe-89 |
| SEQ. ID. NO. 25777 | 98-LysSerGlyLysIleThr-103 |
| SEQ. ID. NO. 25778 | 109-ProHisIleTyrGlyAla-114 |
| SEQ. ID. NO. 25779 | 183-GluLeuArgLysTyrAlaAspTrpGlyIleMetGluLysAlaLysAlaLeu-199 |
| SEQ. ID. NO. 25780 | 201-GluThrProProAsnProThrLysAla-209 |
| SEQ. ID. NO. 25781 | 299-SerValHisGlyMetTyrLysValSer-307 |
| SEQ. ID. NO. 25782 | 318-TrpThrArgHisSerArg-323 |
| SEQ. ID. NO. 25783 | 362-SerTyrGlnIleSerGluProLeu-369 |
| SEQ. ID. NO. 25784 | 448-PheLysAsnHisAlaAsp-453 |
| Antigenic Index - Jameson-Wolf | |
| SEQ. ID. NO. 25785 | 43-AlaAlaAlaGluAlaAlaAspAlaSer-51 |
| SEQ. ID. NO. 25786 | 57-ProAlaGlyLeuThrLysLeuAspSerSerGlnIleSer-69 |
| SEQ. ID. NO. 25787 | 81-TyrGluAlaAspSerAlaThrAspPheThr-90 |
| SEQ. ID. NO. 25788 | 94-ValGlnGlySerLysSerGlyLysIleThrLysThrThr-106 |
| SEQ. ID. NO. 25789 | 116-LysValAsnAspAsnLeuThr-122 |
| SEQ. ID. NO. 25790 | 132-GlySerAlaThrGluTyrGluLysAspSerValLeu-143 |
| SEQ. ID. NO. 25791 | 146-AsnIleAsnLysLeuGly-151 |
| SEQ. ID. NO. 25792 | 164-LysLeuAsnGluArgHisSerPheGly-172 |
| SEQ. ID. NO. 25793 | 180-ThrSerAlaGluLeuArgLysTyrAla-188 |
| SEQ. ID. NO. 25794 | 194-GluLysAlaLysAlaLeuLysGluThrProProAsnProThrLysAlaAlaGlnIleLysAlaAspGlyHisAlaAspValLysGlySerAspTrpGly-226 |
| SEQ. ID. NO. 25795 | 236-AspIleAsnAspArgAlaArgValGlyValAsnTyrArgSerLysValSerHisThrLeuLysGlyAspAlaGluTrpAlaAla-263 |
| SEQ. ID. NO. 25796 | 272-TrpAspAlaAsnLys-276 |
| SEQ. ID. NO. 25797 | 283-ThrProSerGluLysAlaArgValLysIleValThrProGluSer-297 |
| SEQ. ID. NO. 25798 | 304-TyrLysValSerAspLysAlaAspLeu-312 |
| SEQ. ID. NO. 25799 | 317-ThrTrpThrArgHisSerArgPheAspLysAlaGluLeuValPheGluLysGluLysThrIleValAsnGlyLysSerAspArgThrThrIle-347 |
| SEQ. ID. NO. 25800 | 349-ProAsnTrpArgAsnThrTyrLysValGlyPhe-359 |
| SEQ. ID. NO. 25801 | 361-GlySerTyrGlnIleSerGluLeuGln-370 |
| SEQ. ID. NO. 25802 | 375-IleAlaPheAspLysSerProValArgAsnAlaAspTyrArgMetAsnSerLeuProAspGlyAsn-396 |
| SEQ. ID. NO. 25803 | 407-HisIleGlyLysAsnHisVal-413 |
| SEQ. ID. NO. 25804 | 424-AsnAspThrSerTyrArgThrAlaLysAlaSerGlyAsnAspValAspSerLysGlyAlaSerSerAlaArgPheLysAsnHisAla-452 |
| Hydrophilic Regions - Hopp-Woods | |
| SEQ. ID. NO. 25805 | 43-AlaAlaAlaGluAlaAlaAsp-49 |
| SEQ. ID. NO. 25806 | 61-ThrLysLeuAspSerSerGln-67 |
| SEQ. ID. NO. 25807 | 81-TyrGluAlaAspSerAlaThr-87 |
| SEQ. ID. NO. 25808 | 95-GlnGlySerLysSerGlyLysIleThrLys-104 |
| SEQ. ID. NO. 25809 | 135-ThrGluTyrGluLysAspSerValLeu-143 |

TABLE 1-continued

| | |
|---|---|
| SEQ. ID. NO. 25810 | 164-LysLeuAsnGluArgHisSer-170 |
| SEQ. ID. NO. 25811 | 180-ThrSerAlaGluLeuArgLysTyrAla-188 |
| SEQ. ID. NO. 25812 | 194-GluLysAlaLysAlaLeuLysGluThrProProAsnProThrLysAlaAlaGlnIleLysAlaAspGlyHisAlaAspValLysGlySerAsp-224 |
| SEQ. ID. NO. 25813 | 237-IleAsnAspArgAlaArgVal-243 |
| SEQ. ID. NO. 25814 | 247-TyrArgSerLysVal-251 |
| SEQ. ID. NO. 25815 | 255-LeuLysGlyAspAlaGluTrpAlaAla-263 |
| SEQ. ID. NO. 25816 | 284-ProSerGluLysAlaArgValLysIleValThr-294 |
| SEQ. ID. NO. 25817 | 305-LysValSerAspLysAlaAspLeu-312 |
| SEQ. ID. NO. 25818 | 322-SerArgPheAspLysAlaGluLeuValPheGluLysGluLysThrIleVal-338 |
| SEQ. ID. NO. 25819 | 340-GlyLysSerAspArgThrThrIle-347 |
| SEQ. ID. NO. 25820 | 375-IleAlaPheAspLysSerProValArgAsnAlaAspTyrArgMet-389 |
| SEQ. ID. NO. 25821 | 391-SerLeuProAspGlyAsn-396 |
| SEQ. ID. NO. 25822 | 426-ThrSerTyrArgThrAlaLysAlaSerGlyAsnAspValAspSerLysGlyAlaSerSerAlaArgPheLysAsnHisAla-452 |
| a990 | |
| AMPHI Regions - AMPHI | |
| SEQ. ID. NO. 25823 | 76-IleThrAspThrTyrGlyAspAsnLeuLysAspAlaValLysLysGlnLeuGlnAspLeuTyrLys-97 |
| SEQ. ID. NO. 25824 | 131-AspLeuIleAsnLysLeuVal-137 |
| SEQ. ID. NO. 25825 | 151-ThrSerLeuAsnAsnIlePhe-157 |
| SEQ. ID. NO. 25826 | 195-AspIleHisMetLeu-199 |
| SEQ. ID. NO. 25827 | 260-ProGluAsnLeuLysThrLeuAspGly-268 |
| SEQ. ID. NO. 25828 | 293-TyrGluLeuLeuLeuLysGlnCys-300 |
| SEQ. ID. NO. 25829 | 419-SerTyrLeuHisGlyTyrGlyGlyGlyValTyrAlaAlaTrp-432 |
| SEQ. ID. NO. 25830 | 442-AlaTyrLeuAspGlyTrpLeuGlnTyr-450 |
| SEQ. ID. NO. 25831 | 472-ThrAlaSerValGluGlyGlyTyrAsnAlaLeu-482 |
| SEQ. ID. NO. 25832 | 550-GlnProPheAlaAlaPheAsnValLeuHisArg-560 |
| Antigenic Index - Jameson-Wolf | |
| SEQ. ID. NO. 25833 | 6-LeuGlySerAsnThrArgSerThrLysIleGlyAspAspAlaAspPheSerPheSerAspLysProLysProGlyThr-31 |
| SEQ. ID. NO. 25834 | 35-PheSerSerGlyLysThrAspGlnAsnSerSerGluTyrGlyTyrAspGluIleAsnIleGlnGlyLysAsnTyrAsnSerGlyIle-63 |
| SEQ. ID. NO. 25835 | 75-TyrIleThrAspThrTyrGlyAspAsnLeuLysAspAlaValLysLysGlnLeuGlnAspLeuTyrLysThrArgProGluAlaTrpGluGluAsnLysLysArgThrGluGluAlaTyr-114 |
| SEQ. ID. NO. 25836 | 123-SerIleLeuLysGlnLysAsnProAspLeuIle-133 |
| SEQ. ID. NO. 25837 | 145-HisSerAsnThrSerGlnThrSer-152 |
| SEQ. ID. NO. 25838 | 157-PheAsnLysLysLeuHisValLysIleGluAsnLysSerHisVal-171 |
| SEQ. ID. NO. 25839 | 179-ThrLysMetThrLeuLysAspSerLeuTrpGluProArgArgHisSerAspIleHisMet-198 |
| SEQ. ID. NO. 25840 | 200-GluThrSerAspAsnAlaArgIleArgLeuAsnThrLysAspGluLysLeuThrVal-218 |
| SEQ. ID. NO. 25841 | 222-TyrGlnGlyGlyAla-226 |
| SEQ. ID. NO. 25842 | 233-AspValArgGluSerAspLysProAlaLeuThrPheGluGluLysValSerGlyGlnSerGlyValValLeuGluArgArgProGluAsnLeuLysThrLeuAspGlyArgLysLeuIleAlaAlaGluLysAlaAspSerAsnSerPheAlaPheLysGlnAsnTyrArgGlnGlyLeu-292 |
| SEQ. ID. NO. 25843 | 298-LysGlnCysGluGlyGlyPhe-304 |
| SEQ. ID. NO. 25844 | 312-AlaIleProGluAlaGlu-317 |
| SEQ. ID. NO. 25845 | 335-ArgAlaAlaAspArgGlyAspAspValTyrAlaAlaAspProSerArgGlnLysLeu-353 |
| SEQ. ID. NO. 25846 | 358-IleGlyGlyArgSerHisGlnAsnIleArgGlyGlyAlaAlaAlaAspGlyArgArgLysGlyVal-379 |
| SEQ. ID. NO. 25847 | 385-ValPheValArgGlnAsnGluGlySerArgLeuAla-396 |
| SEQ. ID. NO. 25848 | 400-MetGlyGlyArgAlaGlyGln-406 |
| SEQ. ID. NO. 25849 | 408-AlaSerValAsnGlyLysGlyGlyAla-416 |
| SEQ. ID. NO. 25850 | 435-LeuArgAspLysGlnThrGlyAlaTyr-443 |
| SEQ. ID. NO. 25851 | 452-ArgPheLysHisArgIleAsnAspGluAsnArgAlaGluArgTyrLysThrLysGlyTrpThr-472 |
| SEQ. ID. NO. 25852 | 475-ValGluGlyGlyTyr-479 |
| SEQ. ID. NO. 25853 | 487-ValValGlyLysGlyAsnAsnValArg-495 |
| SEQ. ID. NO. 25854 | 510-AsnGlyGlyPheThrAspSerGluGlyThrAla-520 |
| SEQ. ID. NO. 25855 | 525-GlySerGlyGlnTrpGlnSerArgAlaGlyIleArgAlaLysThrArgPheAlaLeuArgAsnGlyValAsn-548 |
| SEQ. ID. NO. 25856 | 559-HisArgSerLysSerPheGlyValGluMetAspGlyGluLysGlnThrLeuAla-576 |
| SEQ. ID. NO. 25857 | 579-ThrAlaLeuGluGlyArgPheGlyIle-587 |
| SEQ. ID. NO. 25858 | 589-AlaGlyTrpLysGlyHisMet-595 |
| SEQ. ID. NO. 25859 | 600-GlyTyrGlyLysArgThrAspGlyAspLysGluAlaAlaLeu-613 |
| Hydrophilic Regions - Hopp-Woods | |
| SEQ. ID. NO. 25860 | 8-SerAsnThrArgSerThrLysIleGlyAspAspAlaAspPheSerPheSerAspLysProLysProGlyThr-31 |
| SEQ. ID. NO. 25861 | 38-GlyLysThrAspGlnAsnSerSer-45 |
| SEQ. ID. NO. 25862 | 79-ThrTyrGlyAspAsnLeuLysAspAlaValLysLysGlnLeuGlnAsp-94 |
| SEQ. ID. NO. 25863 | 96-TyrLysThrArgProGluAlaTrpGluGluAsnLysLysArgThrGluGluAlaTyr-114 |
| SEQ. ID. NO. 25864 | 123-SerIleLeuLysGlnLysAsnProAspLeuIle-133 |
| SEQ. ID. NO. 25865 | 161-LeuHisValLysIleGluAsnLysSerHisVal-171 |
| SEQ. ID. NO. 25866 | 179-ThrLysMetThrLeuLys-184 |
| SEQ. ID. NO. 25867 | 186-SerLeuTrpGluProArgArgHisSerAsp-195 |
| SEQ. ID. NO. 25868 | 200-GluThrSerAspAsnAlaArgIleArgLeuAsnThrLysAspGluLysLeuThrVal-218 |
| SEQ. ID. NO. 25869 | 233-AspValArgGluSerAspLysProAlaLeuThrPheGluGluLysValSerGly-250 |
| SEQ. ID. NO. 25870 | 255-ValLeuGluArgArgProGluAsnLeuLysThrLeuAspGlyArgLysLeuIleAlaAlaGluLysAlaAspSerAsn-280 |
| SEQ. ID. NO. 25871 | 312-AlaIleProGluAlaGlu-317 |
| SEQ. ID. NO. 25872 | 335-ArgAlaAlaAspArgGlyAspAspValTyrAla-345 |
| SEQ. ID. NO. 25873 | 347-AspProSerArgGln-351 |
| SEQ. ID. NO. 25874 | 361-ArgSerHisGlnAsnIleArgGly-368 |
| SEQ. ID. NO. 25875 | 370-AlaAlaAlaAspGlyArgArgLysGlyVal-379 |
| SEQ. ID. NO. 25876 | 385-ValPheValArgGlnAsnGluGlySerArg-394 |
| SEQ. ID. NO. 25877 | 410-ValAsnGlyLysGlyGlyAla-416 |
| SEQ. ID. NO. 25878 | 435-LeuArgAspLysGlnThr-440 |
| SEQ. ID. NO. 25879 | 452-ArgPheLysHisArgIleAsnAspGluAsnArgAlaGluArgTyrLysThr-468 |
| SEQ. ID. NO. 25880 | 487-ValValGlyLysGlyAsnAsn-493 |
| SEQ. ID. NO. 25881 | 513-PheThrAspSerGluGlyThr-519 |
| SEQ. ID. NO. 25882 | 533-AlaGlyIleArgAlaLysThrArgPheAlaLeu-543 |
| SEQ. ID. NO. 25883 | 559-HisArgSerLysSerPheGlyValGluMetAspGlyGluLysGlnThrLeuAla-576 |

TABLE 1-continued

| | |
|---|---|
| SEQ. ID. NO. 25884 | 579-ThrAlaLeuGluGly-583 |
| SEQ. ID. NO. 25885 | 600-GlyTyrGlyLysArgThrAspGlyAspLysGluAlaAlaLeu-613 | a990
AMPHI Regions - AMPHI

| | |
|---|---|
| SEQ. ID. NO. 25886 | 76-IleThrAspThrTyrGlyAspAsnLeuLysAspAlaValLysLysGlnLeuGlnAspLeuTyrLys-97 |
| SEQ. ID. NO. 25887 | 131-AspLeuIleAsnLysLeuVal-137 |
| SEQ. ID. NO. 25888 | 151-ThrSerLeuAsnAsnIlePhe-157 |
| SEQ. ID. NO. 25889 | 195-AspIleHisMetLeu-199 |
| SEQ. ID. NO. 25890 | 260-ProGluAsnLeuLysThrLeuAspGly-268 |
| SEQ. ID. NO. 25891 | 293-TyrGluLeuLeuLeuLysGlnCys-300 |
| SEQ. ID. NO. 25892 | 419-SerTyrLeuHisGlyTyrGlyGlyGlyValTyrAlaAlaTrp-432 |
| SEQ. ID. NO. 25893 | 442-AlaTyrLeuAspGlyTrpLeuGlnTyr-450 |
| SEQ. ID. NO. 25894 | 472-ThrAlaSerValGluGlyGlyTyrAsnValLeuArg-482 |
| SEQ. ID. NO. 25895 | 550-GlnProPheAlaAlaPheAsnValLeuHisArg-560 |

Antigenic Index - Jameson-Wolf

| | |
|---|---|
| SEQ. ID. NO. 25896 | 6-LeuGlySerAsnThrArgSerThrLysIleGlyAspAspAlaAspPheSerPheSerAspLysProLysProGlyThr-31 |
| SEQ. ID. NO. 25897 | 35-PheSerSerGlyLysThrAspGlnAsnSerSerGluTyrGlyTyrAspGluIleAsnIleGlnGlyLysAsnTyrAsnSerGlyIle-63 |
| SEQ. ID. NO. 25898 | 75-TyrIleThrAspThrTyrGlyAspAsnLeuLysAspAlaValLysLysGlnLeuGlnAspLeuTyrLysThrArgProGluAlaTrpGluGluAsnLysLysArgThrGluGluAlaTyr-114 |
| SEQ. ID. NO. 25899 | 123-SerIleLeuLysGlnLysAsnProAspLeuIle-133 |
| SEQ. ID. NO. 25900 | 145-HisSerAsnThrSerGlnThrSer-152 |
| SEQ. ID. NO. 25901 | 157-PheAsnLysLysLeuHisValLysIleGluAsnLysSerHisVal-171 |
| SEQ. ID. NO. 25902 | 179-ThrLysMetThrLeuLysAspSerLeuTrpGluProArgArgHisSerAspIleHisMet-198 |
| SEQ. ID. NO. 25903 | 200-GluThrSerAspAsnAlaArgIleArgLeuAsnThrLysAspGluLysLeuThrVal-218 |
| SEQ. ID. NO. 25904 | 222-TyrGlnGlyGlyAla-226 |
| SEQ. ID. NO. 25905 | 233-AspValArgGluSerAspLysProAlaLeuThrPheGluGluLysValSerGlyGlnSerGlyValValLeuGluArgArgProGluAsnLeuLysThrLeuAspGlyArgLysLeuIleAlaAlaGluLysAlaAspSerAsnSerPheAlaPheLysGlnAsnTyrArgGlnGlyLeu-292 |
| SEQ. ID. NO. 25906 | 298-LysGlnCysGluGlyGlyGlyPhe-304 |
| SEQ. ID. NO. 25907 | 312-AlaIleProGluAlaGlu-317 |
| SEQ. ID. NO. 25908 | 335-ArgAlaAlaAspArgGlyAspAspValTyrAlaAlaAspProSerArgGlnLysLeu-353 |
| SEQ. ID. NO. 25909 | 358-IleGlyGlyArgSerHisGlnAsnIleArgGlyGlyAlaAlaAlaAspGlyArgArgLysGlyVal-379 |
| SEQ. ID. NO. 25910 | 385-ValPheValArgGlnAsnGluGlySerArgLeuAla-396 |
| SEQ. ID. NO. 25911 | 400-MetGlyGlyArgAlaGlyGln-406 |
| SEQ. ID. NO. 25912 | 408-AlaSerValAsnGlyLysGlyGlyAla-416 |
| SEQ. ID. NO. 25913 | 435-LeuArgAspLysGlnThrGlyAlaTyr-443 |
| SEQ. ID. NO. 25914 | 452-ArgPheLysHisArgIleAsnAspGluAsnArgAlaGluArgTyrLysThrLysGlyTrpThr-472 |
| SEQ. ID. NO. 25915 | 475-ValGluGlyGlyTyr-479 |
| SEQ. ID. NO. 25916 | 487-ValValGlyLysGlyAsnAsnValArg-495 |
| SEQ. ID. NO. 25917 | 510-AsnGlyGlyPheThrAspSerGluGlyThrAla-520 |
| SEQ. ID. NO. 25918 | 525-GlySerGlyGlnTrpGlnSerArgAlaGlyIleArgAlaLysThrArgPheAlaLeuArgAsnGlyValAsn-548 |
| SEQ. ID. NO. 25919 | 559-HisArgSerLysSerPheGlyValGluMetAspGlyGluLysGlnThrLeuAla-576 |
| SEQ. ID. NO. 25920 | 579-ThrAlaLeuGluGlyArgPheGlyIle-587 |
| SEQ. ID. NO. 25921 | 589-AlaGlyTrpLysGlyHisMet-595 |
| SEQ. ID. NO. 25922 | 600-GlyTyrGlyLysArgThrAspGlyAspLysGluAlaAlaLeu-613 |

Hydrophilic Regions - Hopp-Woods

| | |
|---|---|
| SEQ. ID. NO. 25923 | 8-SerAsnThrArgSerThrLysIleGlyAspAspAlaAspPheSerPheSerAspLysProLysProGlyThr-31 |
| SEQ. ID. NO. 25924 | 38-GlyLysThrAspGlnAsnSerSer-45 |
| SEQ. ID. NO. 25925 | 79-ThrTyrGlyAspAsnLeuLysAspAlaValLysLysGlnLeuGlnAsp-94 |
| SEQ. ID. NO. 25926 | 96-TyrLysThrArgProGluAlaTrpGluGluAsnLysLysArgThrGluGluAlaTyr-114 |
| SEQ. ID. NO. 25927 | 123-SerIleLeuLysGlnLysAsnProAspLeuIle-133 |
| SEQ. ID. NO. 25928 | 161-LeuHisValLysIleGluAsnLysSerHisVal-171 |
| SEQ. ID. NO. 25929 | 179-ThrLysMetThrLeuLys-184 |
| SEQ. ID. NO. 25930 | 186-SerLeuTrpGluProArgArgHisSerAsp-195 |
| SEQ. ID. NO. 25931 | 200-GluThrSerAspAsnAlaArgIleArgLeuAsnThrLysAspGluLysLeuThrVal-218 |
| SEQ. ID. NO. 25932 | 233-AspValArgGluSerAspLysProAlaLeuThrPheGluGluLysValSerGly-250 |
| SEQ. ID. NO. 25933 | 255-ValLeuGluArgArgProGluAsnLeuLysThrLeuAspGlyArgLysLeuIleAlaAlaGluLysAlaAspSerAsn-280 |
| SEQ. ID. NO. 25934 | 312-AlaIleProGluAlaGlu-317 |
| SEQ. ID. NO. 25935 | 335-ArgAlaAlaAspArgGlyAspAspValTyrAla-345 |
| SEQ. ID. NO. 25936 | 347-AspProSerArgGln-351 |
| SEQ. ID. NO. 25937 | 361-ArgSerHisGlnAsnIleArgGly-368 |
| SEQ. ID. NO. 25938 | 370-AlaAlaAlaAspGlyArgArgLysGlyVal-379 |
| SEQ. ID. NO. 25939 | 385-ValPheValArgGlnAsnGluGlySerArg-394 |
| SEQ. ID. NO. 25940 | 410-ValAsnGlyLysGlyGlyAla-416 |
| SEQ. ID. NO. 25941 | 435-LeuArgAspLysGlnThr-440 |
| SEQ. ID. NO. 25942 | 452-ArgPheLysHisArgIleAsnAspGluAsnArgAlaGluArgTyrLysThr-468 |
| SEQ. ID. NO. 25943 | 487-ValValGlyLysGlyAsnAsn-493 |
| SEQ. ID. NO. 25944 | 513-PheThrAspSerGluGlyThr-519 |
| SEQ. ID. NO. 25945 | 533-AlaGlyIleArgAlaLysThrArgPheAlaLeu-543 |
| SEQ. ID. NO. 25946 | 559-HisArgSerLysSerPheGlyValGluMetAspGlyGluLysGlnThrLeuAla-576 |
| SEQ. ID. NO. 25947 | 579-ThrAlaLeuGluGly-583 |
| SEQ. ID. NO. 25948 | 600-GlyTyrGlyLysArgThrAspGlyAspLysGluAlaAlaLeu-613 | a992
AMPHI Regions - AMPHI

| | |
|---|---|
| SEQ. ID. NO. 25949 | 6-ArgHisLeuLysAsnMetGlnIleLysLysIleMetLysTrp-19 |
| SEQ. ID. NO. 25950 | 24-LeuSerLeuLeuGlyAlaLeuGlyTyr-32 |
| SEQ. ID. NO. 25951 | 45-AlaValLeuAspValLeuGlyAlaAla-53 |
| SEQ. ID. NO. 25952 | 72-HisArgTyrThrGlyThrValSerLysValTyr-82 |
| SEQ. ID. NO. 25953 | 158-GlnValGlnAspGly-162 |
| SEQ. ID. NO. 25954 | 179-AspPheAlaAspTyr-183 |

TABLE 1-continued

Antigenic Index - Jameson-Wolf
SEQ. ID. NO. 25955  1-MetPheArgArgHisArgHisLeuLys-9
SEQ. ID. NO. 25956  34-GlyTyrGlySerGluAlaValArg-41
SEQ. ID. NO. 25957  52-AlaAlaGlyAspAlaGlySerAspAlaProAlaArgArgArgAlaSerAlaLysSerGlyHisArgTyrThr-75
SEQ. ID. NO. 25958  79-SerLysValTyrAspGlyAspThr-86
SEQ. ID. NO. 25959  90-IleAspGlyAspGlyAlaLysHisLysIle-99
SEQ. ID. NO. 25960  105-AspAlaProGluMetLysGlnAlaTyrGlyThrArgSerArgAspAsnLeuArgAlaAlaAlaGluGlyArgLysValSer-131
SEQ. ID. NO. 25961  134-ValPheAspThrAspArgTyrGlnArgGluValAla-145
SEQ. ID. NO. 25962  148-SerValGlyLysThrAspLeuAsn-155
SEQ. ID. NO. 25963  168-LysSerTyrAlaLysGluGlnGlnAspLysAlaAspPhe-180
SEQ. ID. NO. 25964  187-GlnIleGlnAlaGluArgGluArgLysGlyLeuTrpLysAlaLysAsnProGlnAlaPro-206
SEQ. ID. NO. 25965  208-AlaTyrArgArgAlaGlyArgSerGlyGlyGlyAsnLysAspTrpMetAsp-224
Hydrophilic Regions - Hopp-Woods
SEQ. ID. NO. 25966  1-MetPheArgArgHisArgHisLeuLys-9
SEQ. ID. NO. 25967  54-GlyAspAlaGlySerAspAlaProAlaArgArgArgAlaSerAlaLysSerGlyHisArg-73
SEQ. ID. NO. 25968  90-IleAspGlyAspGlyAlaLysHisLysIle-99
SEQ. ID. NO. 25969  105-AspAlaProGluMetLysGln-111
SEQ. ID. NO. 25970  113-TyrGlyThrArgSerArgAspAsnLeuArgAlaAlaAlaGluGlyArgLysValSer-131
SEQ. ID. NO. 25971  134-ValPheAspThrAspArgTyrGlnArgGluValAla-145
SEQ. ID. NO. 25972  148-SerValGlyLysThrAspLeu-154
SEQ. ID. NO. 25973  169-SerTyrAlaLysGluGlnGlnAspLysAlaAspPhe-180
SEQ. ID. NO. 25974  187-GlnIleGlnAlaGluArgGluArgLysGlyLeuTrpLysAlaLysAsnPro-203
SEQ. ID. NO. 25975  211-ArgAlaGlyArgSerGlyGlyGlyAsnLysAspTrpMet-223
a993
AMPHI Regions - AMPHI
SEQ. ID. NO. 25976  6-SerSerPheGlnGlyProLeuAspLeuLeuLeu-16
SEQ. ID. NO. 25977  35-ThrGluGlnTyrLeuHisTyrIleAlaGlnIle-45
SEQ. ID. NO. 25978  105-GlyLeuAspAlaLeuProArgAla-112
SEQ. ID. NO. 25979  136-IleThrAspLeuThrGlnAlaTrpLeuSer-145
SEQ. ID. NO. 25980  152-HisThrArgSerHisGluValIle-159
SEQ. ID. NO. 25981  169-MetThrAlaIleLeuArgArgLeuAsnLysHisGlyIleCysArgPheHisAspLeuPheAsnProGlu-191
SEQ. ID. NO. 25982  199-ValAsnPheIleAlaLeuLeu-205
Antigenic Index - Jameson-Wolf
SEQ. ID. NO. 25983  7-SerPheGlnGlyProLeu-12
SEQ. ID. NO. 25984  20-ArgLysGlnAsnIleAsp-25
SEQ. ID. NO. 25985  70-LeuLeuLeuProArgThrGluThrValGluAspGluGluAlaAspProArgAlaGluLeuValArg-91
SEQ. ID. NO. 25986  108-AlaLeuProArgAlaGlyArgAspPhe-116
SEQ. ID. NO. 25987  148-SerArgAlaLysHisThrArgSerHisGluValIleLysGluThrIleSer-164
SEQ. ID. NO. 25988  174-ArgArgLeuAsnLysHisGlyIle-181
SEQ. ID. NO. 25989  188-PheAsnProGluGlnGly-193
SEQ. ID. NO. 25990  207-LeuAlaLysGluGlyLeu-212
SEQ. ID. NO. 25991  228-LeuAsnHisGluGlyAlaHisSerAspGlyIleSerGlyThrArgGlyGlyArgAspValPhe-248
Hydrophilic Regions - Hopp-Woods
SEQ. ID. NO. 25992  20-ArgLysGlnAsnIleAsp-25
SEQ. ID. NO. 25993  70-LeuLeuLeuProArgThrGluThrValGluAspGluGluAlaAspProArgAlaGluLeuValArg-91
SEQ. ID. NO. 25994  108-AlaLeuProArgAlaGlyArg-114
SEQ. ID. NO. 25995  148-SerArgAlaLysHisThrArgSerHisGluValIleLysGluThrIleSer-164
SEQ. ID. NO. 25996  174-ArgArgLeuAsnLys-178
SEQ. ID. NO. 25997  207-LeuAlaLysGluGlyLeu-212
SEQ. ID. NO. 25998  232-GlyAlaHisSerAspGlyIleSerGlyThrArgGlyGlyArgAspValPhe-248
a996
AMPHI Regions - AMPHI
SEQ. ID. NO. 25999  21-LysSerAlaArgThrHisAlaLysIlePro-30
SEQ. ID. NO. 26000  50-ProGlyGluSerTyrProAlaGlnLeuGlnLysLeuThrGlyTrpAsn-65
SEQ. ID. NO. 26001  75-ThrSerAlaGlnAlaLeuSerArgLeuProAla-85
SEQ. ID. NO. 26002  104-LeuArgLysValProLysGlu-110
SEQ. ID. NO. 26003  115-AsnIleAlaLysIleIleGluThrValGlnLys-125
SEQ. ID. NO. 26004  140-LeuGlyAlaLeuPheGlyHisLeuSerAsp-149
SEQ. ID. NO. 26005  167-GlyAlaTrpAlaGlu-171
SEQ. ID. NO. 26006  186-AsnGlyLysGlyTyrArgLysPheAlaGluAspLeuAsnGlnPheLeuArgLysGlnGlyPhe-206
Antigenic Index - Jameson-Wolf
SEQ. ID. NO. 26007  1-MetAsnArgArgThrPhe-6
SEQ. ID. NO. 26008  18-CysGlyArgLysSerAlaArgThrHisAlaLysIleProGluGlySerThr-34
SEQ. ID. NO. 26009  46-TyrGlyAlaAsnProGlyGluSerTyrPro-55
SEQ. ID. NO. 26010  69-GlyGlyValSerGlyAspThrSerAla-77
SEQ. ID. NO. 26011  87-LeuAlaArgLysProLys-92
SEQ. ID. NO. 26012  99-GlyGlyAsnAspPheLeuArgLysValProLysGluGlnThrArgAlaAsnIle-116
SEQ. ID. NO. 26013  121-GluThrValGlnLysGluAsnIlePro-129
SEQ. ID. NO. 26014  148-SerAspHisProLeuTyrAspLeuSerGluGluTyrGly-161
SEQ. ID. NO. 26015  173-LeuGlyAspAsnAsnLeuLysSerAspGlnIleHisAlaAsnGlyLysGlyTyrArgLysPheAlaGluAspLeuAsnGlnPheLeuArgLysGlnGlyPheArg-207
Hydrophilic Regions - Hopp-Woods
SEQ. ID. NO. 26016  18-CysGlyArgLysSerAlaArgThrHisAlaLysIleProGlu-31
SEQ. ID. NO. 26017  49-AsnProGlyGluSerTyr-54
SEQ. ID. NO. 26018  71-ValSerGlyAspThrSerAla-77
SEQ. ID. NO. 26019  87-LeuAlaArgLysProLys-92
SEQ. ID. NO. 26020  102-AspPheLeuArgLysValProLysGluGlnThrArgAlaAsnIle-116
SEQ. ID. NO. 26021  121-GluThrValGlnLysGluAsnIle-128
SEQ. ID. NO. 26022  154-GluAspLeuSerGluGluTyrGly-161

TABLE 1-continued

| | |
|---|---|
| SEQ. ID. NO. 26023 | 176-AsnAsnLeuLysSerAspGlnIleHisAlaAsn-186 |
| SEQ. ID. NO. 26024 | 188-LysGlyTyrArgLysPheAlaGluAspLeuAsnGlnPheLeuArg-202 | a997
AMPHI Regions - AMPHI

| | |
|---|---|
| SEQ. ID. NO. 26025 | 18-TrpAlaGlyLeuSerAlaAlaVal-25 |
| SEQ. ID. NO. 26026 | 70-TyrArgGlyValLeuArgLeuMetLysThrIleGlySerAsp-83 |
| SEQ. ID. NO. 26027 | 107-ProLeuProAlaProLeuHisIle-114 |
| SEQ. ID. NO. 26028 | 123-ArgValProSerAlaPheLysAlaLysLeuLeuAlaAspMetSerAspLeuGlnLysSerAlaArgLeuGly-146 |
| SEQ. ID. NO. 26029 | 164-AlaAlaValMetGlnPheTrpGlnProLeuValTrpGly-176 |
| SEQ. ID. NO. 26030 | 189-ValLeuCysAsnValLeuSerAsp-196 |
| SEQ. ID. NO. 26031 | 222-AlaLeuAlaGluLeuGlnArg-228 |
| SEQ. ID. NO. 26032 | 241-ArgLeuAsnThrLeuPro-246 |
| SEQ. ID. NO. 26033 | 275-GluGlyThrProGluHisValGlnThrAla-284 |
| SEQ. ID. NO. 26034 | 300-TyrAlaGluProValArgLeuProAlaProLeuThrGlyLeuAlaAspGly-316 |
| SEQ. ID. NO. 26035 | 354-AspLysValHisAlaAspLeuLysArgIleLeuProHisLeu-367 |
| SEQ. ID. NO. 26036 | 369-GluProGluAlaVal-373 |

Antigenic Index - Jameson-Wolf

| | |
|---|---|
| SEQ. ID. NO. 26037 | 3-AsnThrProHisProArgProLysIle-11 |
| SEQ. ID. NO. 26038 | 37-GluAlaGlyArgGlnAlaGlyGlyArgAlaArgAla-48 |
| SEQ. ID. NO. 26039 | 50-AlaGlyAsnThrAspGlyPheGly-57 |
| SEQ. ID. NO. 26040 | 78-LysThrIleGlySerAspProHisAla-86 |
| SEQ. ID. NO. 26041 | 122-ArgArgValProSerAlaPheLys-129 |
| SEQ. ID. NO. 26042 | 132-LeuLeuAlaAspMetSerAspLeuGlnLysSerAlaArgLeuGlyGlnProAspThrThr-151 |
| SEQ. ID. NO. 26043 | 156-LeuLysGlnArgAsnValProArg-163 |
| SEQ. ID. NO. 26044 | 180-ThrProLeuGluThrAlaSer-186 |
| SEQ. ID. NO. 26045 | 197-GlyValLeuThrLysLysSerGlySerAspTyrLeuLeuProLysGlnAspLeu-214 |
| SEQ. ID. NO. 26046 | 225-GluLeuGlnArgLeuGlyAlaAspIleArgLeuGluThrArgIleCysArg-241 |
| SEQ. ID. NO. 26047 | 243-AsnThrLeuProAspGlyLysVal-250 |
| SEQ. ID. NO. 26048 | 273-LeuProGluGlyThrProGluHisVal-281 |
| SEQ. ID. NO. 26049 | 312-GlyLeuAlaAspGlyThr-317 |
| SEQ. ID. NO. 26050 | 323-CysArgGlyArgLeuGlyLeuProGluAsnGluVal-334 |
| SEQ. ID. NO. 26051 | 340-ValSerAspArgValGlyAla-346 |
| SEQ. ID. NO. 26052 | 356-ValHisAlaAspLeuLysArgIleLeu-364 |
| SEQ. ID. NO. 26053 | 367-LeuGlyGluProGluAlaValArgValIleThrGluLysArgAlaThrThrAlaAlaAspAlaProProProAspLeu-392 |
| SEQ. ID. NO. 26054 | 402-ProAlaGlyAspTyrLeuHisProAspTyrProAla-413 |

Hydrophilic Regions - Hopp-Woods

| | |
|---|---|
| SEQ. ID. NO. 26055 | 5-ProHisProArgProLysIle-11 |
| SEQ. ID. NO. 26056 | 37-GluAlaGlyArgGlnAlaGlyGlyArgAlaArgAla-48 |
| SEQ. ID. NO. 26057 | 80-IleGlySerAspPro-84 |
| SEQ. ID. NO. 26058 | 122-ArgArgValProSer-126 |
| SEQ. ID. NO. 26059 | 132-LeuLeuAlaAspMetSerAspLeuGlnLysSerAlaArgLeuGlyGlnProAspThrThr-151 |
| SEQ. ID. NO. 26060 | 198-ValLeuThrLysLysSerGlySer-205 |
| SEQ. ID. NO. 26061 | 208-LeuLeuProLysGlnAspLeu-214 |
| SEQ. ID. NO. 26062 | 225-GluLeuGlnArgLeuGlyAlaAspIleArgLeuGluThrArgIleCysArg-241 |
| SEQ. ID. NO. 26063 | 246-ProAspGlyLysVal-250 |
| SEQ. ID. NO. 26064 | 276-GlyThrProGluHisVal-281 |
| SEQ. ID. NO. 26065 | 325-GlyArgLeuGlyLeuProGluAsnGluVal-334 |
| SEQ. ID. NO. 26066 | 340-ValSerAspArgValGly-345 |
| SEQ. ID. NO. 26067 | 356-ValHisAlaAspLeuLysArgIleLeu-364 |
| SEQ. ID. NO. 26068 | 368-GlyGluProGluAlaValArgValIleThrGluLysArgAlaThrThrAlaAlaAspAlaProProPro-390 | g001
AMPHI Regions - AMPHI

| | |
|---|---|
| SEQ. ID. NO. 26069 | 7-AlaAlaArgArgValSer-12 |
| SEQ. ID. NO. 26070 | 17-SerGlyArgAlaCys-21 |
| SEQ. ID. NO. 26071 | 67-AlaArgPhePheGlySerValCysAsnSerAla-77 |

Antigenic Index - Jameson-Wolf

| | |
|---|---|
| SEQ. ID. NO. 26072 | 3-ProGlnGlyLysAlaAlaArgArgValSerAlaAsnGluValSerGlyArAlaCysAla-22 |
| SEQ. ID. NO. 26073 | 31-ThrLeuProLysArgAspThrLeuAsnGlySerGlyThr-43 |
| SEQ. ID. NO. 26074 | 53-ProArgSerLeuArgSerLysSerThr-61 |
| SEQ. ID. NO. 26075 | 68-ArgPhePheGlySer-72 |
| SEQ. ID. NO. 26076 | 74-CysAsnSerAlaAlaArgArgSerSerCysProSerProLysIleGly-89 |
| SEQ. ID. NO. 26077 | 100-ValProSerGluAlaMetLeuArgLysSerSerGlyGluLysHisSerVal-116 |
| SEQ. ID. NO. 26078 | 119-AspCysProAlaSerSerGlyArgTrpAspAsnThrAla-131 |

Hydrophilic Regions - Hopp-Woods

| | |
|---|---|
| SEQ. ID. NO. 26079 | 5-GlyLysAlaAlaArgArgValSerAlaAsnGluValSerGly-18 |
| SEQ. ID. NO. 26080 | 32-LeuProLysArgAspThrLeuAsn-39 |
| SEQ. ID. NO. 26081 | 54-ArgSerLeuArgSerLysSer-60 |
| SEQ. ID. NO. 26082 | 77-AlaAlaArgArgSerSerCysProSerProLys-87 |
| SEQ. ID. NO. 26083 | 104-AlaMetLeuArgLysSerSerGlyGluLysHisSerVal-116 |
| SEQ. ID. NO. 26084 | 125-GlyArgTrpAspAsn-129 | g003
AMPHI Regions - AMPHI

| | |
|---|---|
| SEQ. ID. NO. 26085 | 72-AsnGlnValValLeu-76 |
| SEQ. ID. NO. 26086 | 82-ValValGluValPheGlnArg-88 |
| SEQ. ID. NO. 26087 | 150-ValGlnAlaGluPheValGlyIleValGlyHisPheAspGlyLeuGlyMet-166 |
| SEQ. ID. NO. 26088 | 173-HisPhePheValArgValPheArg-180 |

Antigenic Index - Jameson-Wolf

| | |
|---|---|
| SEQ. ID. NO. 26089 | 104-PheGluGlyGlyGlyAspAspGlyPhe-112 |
| SEQ. ID. NO. 26090 | 137-GlyArgIleAsnAspAlaGluIleIle-145 |

TABLE 1-continued

| | |
|---|---|
| SEQ. ID. NO. 26091 | 204-ProLysAlaAlaAlaGlyGluValAsnGly-213 |
| SEQ. ID. NO. 26092 | 215-ArgValHisAspCys-219 |
| Hydrophilic Regions - Hopp-Woods | |
| SEQ. ID. NO. 26093 | 106-GlyGlyGlyAspAspGlyPhe-112 |
| SEQ. ID. NO. 26094 | 137-GlyArgIleAsnAspAlaGluIleIle-145 |
| SEQ. ID. NO. 26095 | 205-LysAlaAlaAlaGlyGluValAsnGly-213 |
| SEQ. ID. NO. 26096 | 215-ArgValHisAspCys-219 |
| g005 | |
| AMPHI Regions - AMPHI | |
| SEQ. ID. NO. 26097 | 16-IleGlnSerMetTrpLysGlu-22 |
| SEQ. ID. NO. 26098 | 32-LeuGluLeuLeuThrValPheGlyAlaIleAla-42 |
| SEQ. ID. NO. 26099 | 62-LeuThrAspPheSerGluAsnTyr-69 |
| SEQ. ID. NO. 26100 | 107-ArgLeuLysGluGlyGlyGluLysSerAlaGlu-117 |
| SEQ. ID. NO. 26101 | 177-GlnLeuArgArgLeuArg-182 |
| SEQ. ID. NO. 26102 | 213-AlaProPheAlaValIleGlySerValGlyValValAlaGluValProAsnIleHisArgLeuLeuLysLys-236 |
| SEQ. ID. NO. 26103 | 249-PheLysArgThrVal-253 |
| SEQ. ID. NO. 26104 | 274-ThrHisGlnLeuPheLysGln-280 |
| SEQ. ID. NO. 26105 | 308-LeuAsnLeuIleAspGluIleSerThr-316 |
| SEQ. ID. NO. 26106 | 320-LeuLeuLeuLysAlaPhe-325 |
| Antigenic Index - Jameson-Wolf | |
| SEQ. ID. NO. 26107 | 1-MetGlyMetAspAsn-5 |
| SEQ. ID. NO. 26108 | 10-MetProGluGlnGluGluIleGlnSerMetTrp-20 |
| SEQ. ID. NO. 26109 | 50-GlnSerLysLysGlnSerGluSerGlySer-59 |
| SEQ. ID. NO. 26110 | 64-AspPheSerGluAsnTyrLysLysGlnArgGlnSerPhe-76 |
| SEQ. ID. NO. 26111 | 82-SerGluGluGluThrLysHisGlnGluLysLysGluLysLysLysGluAlaGluAlaLysAlaGluLysLysArgLeuLysGluGly GlyGluLysSerAlaGluThrGlnLysSerArg-122 |
| SEQ. ID. NO. 26112 | 138-GluSerLeuArgHisGluIle-144 |
| SEQ. ID. NO. 26113 | 151-AlaLysProGluAspGluValLeuLeu-159 |
| SEQ. ID. NO. 26114 | 161-LeuGluSerProGlyGlyVal-167 |
| SEQ. ID. NO. 26115 | 177-GlnLeuArgArgLeuArgGluArgAsnIle-186 |
| SEQ. ID. NO. 26116 | 191-AlaValAspLysValAlaAla-197 |
| SEQ. ID. NO. 26117 | 232-ArgLeuLeuLysLysHisAspIleAspVal-241 |
| SEQ. ID. NO. 26118 | 247-GlyGluPheLysArgThr-252 |
| SEQ. ID. NO. 26119 | 258-GluAsnThrGluLysGlyLysGlnLysPheArgGlnGluLeuGluGluThrHisGln-276 |
| SEQ. ID. NO. 26120 | 281-PheValSerGluAsnArgProGlyLeuAspIleGluLysIleAlaThr-296 |
| SEQ. ID. NO. 26121 | 312-AspGluIleSerThrSerAspAspLeuLeu-321 |
| SEQ. ID. NO. 26122 | 325-PheGluAsnLysGlnValIle-331 |
| SEQ. ID. NO. 26123 | 334-LysTyrGlnGluLysArgSerLeuIle-342 |
| SEQ. ID. NO. 26124 | 351-AlaSerValGluLysLeuPhe-357 |
| SEQ. ID. NO. 26125 | 361-ValAsnArgArgAlaAspVal-367 |
| Hydrophilic Regions - Hopp-Woods | |
| SEQ. ID. NO. 26126 | 10-MetProGluGlnGluGluIleGlnSerMetTrp-20 |
| SEQ. ID. NO. 26127 | 50-GlnSerLysLysGlnSerGluSerGly-58 |
| SEQ. ID. NO. 26128 | 64-AspPheSerGluAsnTyrLysLysGlnArgGlnSerPhe-76 |
| SEQ. ID. NO. 26129 | 82-SerGluGluGluThrLysHisGlnGluLysLysGluLysLysLysGluAlaGluAlaLysAlaGluLysLysArgLeuLysGluGlyGlyGlu LysSerAlaGluThrGlnLysSerArg-122 |
| SEQ. ID. NO. 26130 | 138-GluSerLeuArgHisGluIle-144 |
| SEQ. ID. NO. 26131 | 151-AlaLysProGluAspGluValLeuLeu-159 |
| SEQ. ID. NO. 26132 | 161-LeuGluSerProGly-165 |
| SEQ. ID. NO. 26133 | 177-GlnLeuArgArgLeuArgGluArgAsnIle-186 |
| SEQ. ID. NO. 26134 | 191-AlaValAspLysValAlaAla-197 |
| SEQ. ID. NO. 26135 | 232-ArgLeuLeuLysLysHisAspIleAspVal-241 |
| SEQ. ID. NO. 26136 | 247-GlyGluPheLysArg-251 |
| SEQ. ID. NO. 26137 | 258-GluAsnThrGluLysGlyLysGlnLysPheArgGlnGluLeuGluGluThrHisGln-276 |
| SEQ. ID. NO. 26138 | 281-PheValSerGluAsnArgProGlyLeuAspIleGluLysIleAlaThr-296 |
| SEQ. ID. NO. 26139 | 312-AspGluIleSerThrSerAspAspLeuLeu-321 |
| SEQ. ID. NO. 26140 | 325-PheGluAsnLysGlnValIle-331 |
| SEQ. ID. NO. 26141 | 334-LysTyrGlnGluLysArgSerLeuIle-342 |
| SEQ. ID. NO. 26142 | 351-AlaSerValGluLysLeuPhe-357 |
| SEQ. ID. NO. 26143 | 361-ValAsnArgArgAlaAspVal-367 |
| g006-1 | |
| AMPHI Regions - AMPHI | |
| SEQ. ID. NO. 26144 | 6-LysHisIleAlaLysThrHisArgLysArg-15 |
| SEQ. ID. NO. 26145 | 19-ThrPheSerProValGlyLeuGluAsnLeuLeu-29 |
| SEQ. ID. NO. 26146 | 48-ArgValTrpGlnAlaLeuLeuTyrAlaLeuValValPhe-60 |
| SEQ. ID. NO. 26147 | 69-ArgArgIleAlaAspThrArgThrPheThrArgIleTyrThrGlu-83 |
| SEQ. ID. NO. 26148 | 111-GluPheValSerPhePheGlu-117 |
| SEQ. ID. NO. 26149 | 125-ThrSerValValSerIlePheGlyAlaCysIleMetLeuLeu-138 |
| SEQ. ID. NO. 26150 | 195-HisTyrGlyLeuValSerArgLeu-202 |
| SEQ. ID. NO. 26151 | 236-GlyTyrGlySerAlaGlyHisIleTyrSer-245 |
| SEQ. ID. NO. 26152 | 257-LeuAspAspValProArgLeuValGluGlnTyrSerAsnLeuLysAspIle-273 |
| Antigenic Index - Jameson-Wolf | |
| SEQ. ID. NO. 26153 | 6-LysHisIleAlaLysThrHisArgLysArgLeu-16 |
| SEQ. ID. NO. 26154 | 67-AlaAlaArgArgIleAlaAspThrArgThrPheThr-78 |
| SEQ. ID. NO. 26155 | 90-LeuGluGlnArgGlnArgGlnValProHisSer-100 |
| SEQ. ID. NO. 26156 | 173-LeuAsnAsnSerLeuGluArgAspAsnHisPheIleArgLysGlyAspGluArgGlnLeuTyr-193 |
| SEQ. ID. NO. 26157 | 206-IleSerAsnArgGluAlaPhe-212 |
| SEQ. ID. NO. 26158 | 256-SerLeuAspAspValProArgLeuValGluGlnTyrSerAsnLeuLysAspIleGlyGlnArgIleGluTrpSerGluArgAsnIleLysAla GlyThr-288 |

TABLE 1-continued

Hydrophilic Regions - Hopp-Woods
SEQ. ID. NO. 26159  6-LysHisIleAlaLysThrHisArgLysArgLeu-16
SEQ. ID. NO. 26160  67-AlaAlaArgArgIleAlaAspThrArgThrPhe-77
SEQ. ID. NO. 26161  90-LeuGluGlnArgGlnArgGlnValPro-98
SEQ. ID. NO. 26162  175-AsnSerLeuGluArgAspAsnHisPheIleArgLysGlyAspGluArgGlnLeu-192
SEQ. ID. NO. 26163  206-IleSerAsnArgGluAla-211
SEQ. ID. NO. 26164  256-SerLeuAspAspValProArgLeuValGlu-265
SEQ. ID. NO. 26165  268-SerAsnLeuLysAspIleGlyGln-275
SEQ. ID. NO. 26166  277-IleGluTrpSerGluArgAsnIleLysAlaGlyThr-288
g007-1
AMPHI Regions - AMPHI
SEQ. ID. NO. 26167  71-HisSerMetValLysGlyIleAsn-78
SEQ. ID. NO. 26168  105-ValAlaThrTyrIleMetAsnAlaPheAspAsnGlyGlyGly-118
Antigenic Index - Jameson-Wolf
SEQ. ID. NO. 26169  1-MetAsnThrThrArgLeuProThr-8
SEQ. ID. NO. 26170  20-SerAlaAlaAspAsnSerIleMetThrLysGlyGlnLysValTyrGluSerAsnCys-38
SEQ. ID. NO. 26171  41-CysHisGlyLysLysGlyGluGlyArgGlyThrAlaPhePro-54
SEQ. ID. NO. 26172  56-LeuPheArgSerAspTyrIleMetAsnLysPro-66
SEQ. ID. NO. 26173  81-IleLysValAsnGlyLysThrTyrAsnGly-90
SEQ. ID. NO. 26174  98-SerAspAlaAspIle-102
SEQ. ID. NO. 26175  112-AlaPheAspAsnGlyGlyGlySerValThrGluLysAspValLysGlnAlaLysGlyLysLysAsn-133
Hydrophilic Regions - Hopp-Woods
SEQ. ID. NO. 26176  26-IleMetThrLysGlyGlnLysValTyrGlu-35
SEQ. ID. NO. 26177  42-HisGlyLysLysGlyGluGlyArgGly-50
SEQ. ID. NO. 26178  98-SerAspAlaAspIle-102
SEQ. ID. NO. 26179  119-SerValThrGluLysAspValLysGlnAlaLysGlyLysLyAsn-133
g008
AMPHI Regions - AMPHI
SEQ. ID. NO. 26180  15-LeuAspAsnProAlaGlnGlnIleArgGlyAlaLeuAspAlaLeuSer-30
SEQ. ID. NO. 26181  54-GlnProAspPheIleAsnAlaVal-61
SEQ. ID. NO. 26182  63-ThrValSerThrThr-67
SEQ. ID. NO. 26183  69-AspGlyIleAlaLeuLeuAlaGluLeuAsnArg-79
SEQ. ID. NO. 26184  90-PheArgAsnAlaPro-94
SEQ. ID. NO. 26185  129-ArgProLeuAlaGluIleLeuProAsp-137
SEQ. ID. NO. 26186  140-LeuGlyLysTyrGlyLysValValGluLeuSerLysArgLeuGly-154
Antigenic Index - Jameson-Wolf
SEQ. ID. NO. 26187  1-MetAsnAsnArgHis-5
SEQ. ID. NO. 26188  12-GlySerAsnLeuAspAsnProAlaGlnGlnIleArgGlyAlaLeu-26
SEQ. ID. NO. 26189  29-LeuSerSerHisProAspIleArgLeuGluGln-39
SEQ. ID. NO. 26190  49-ValGlyTyrAspAsnGlnPrAspPhe-57
SEQ. ID. NO. 26191  76-GluLeuAsnArgIleGluAlaAspPheGlyArgGluArgSerPheArgAsnAlaProArgThrLeuAspLeuAspIleIleAspPheAspGly
                    IleSerSerAspAspProArgLeuThrLeuProHisProArgAlaHisGluArgSerPheVal-127
SEQ. ID. NO. 26192  139-IleLeuGlyLysTyrGlyLysValValGluLeuSerLysArgLeuGlyAsnGlnGlyIle-158
SEQ. ID. NO. 26193  160-LeuLeuProAspArg-164
Hydrophilic Regions - Hopp-Woods
SEQ. ID. NO. 26194  14-AsnLeuAspAsnProAlaGlnGlnIle-22
SEQ. ID. NO. 26195  33-ProAspIleArgLeuGluGln-39
SEQ. ID. NO. 26196  76-GluLeuAsnArgIleGluAlaAspPheGlyArgGluArgSerPheArgAsnAlaProArgThrLeuAsp-98
SEQ. ID. NO. 26197  105-AspGlyIleSerSerAspAspProArgLeu-114
SEQ. ID. NO. 26198  120-ArgAlaHisGluArgSerPheVal-127
SEQ. ID. NO. 26199  147-ValGluLeuSerLysArgLeuGly-154
SEQ. ID. NO. 26200  160-LeuLeuProAspArg-164
g009
Antigenic Index - Jameson-Wolf
SEQ. ID. NO. 26201  6-ValAlaPheGluArgHisHisHisLysSerLysAlaGluGlnAsnThrHisArgArgAlaAspAlaGluIleAlaGlu-31
SEQ. ID. NO. 26202  37-AsnGlnHisThrGlnAlaArgAsnGlnSerVal-47
SEQ. ID. NO. 26203  57-PheSerAspLysVal-61
SEQ. ID. NO. 26204  77-AlaAspGlyGlyLysThrTrpGlnLysPro-86
Hydrophilic Regions - Hopp-Woods
SEQ. ID. NO. 26205  6-ValAlaPheGluArgHisHisHisLysSerLysAlaGluGlnAsnThrHisArgArgAlaAspAlaGluIleAlaGlu-31
SEQ. ID. NO. 26206  40-ThrGlnAlaArgAsnGlnSer-46
SEQ. ID. NO. 26207  78-AspGlyGlyLysThrTrpGln-84
g010-1
AMPHI Regions - AMPHI
SEQ. ID. NO. 26208  54-SerAlaSerLeuGly-58
SEQ. ID. NO. 26209  70-TyrAspThrValLysGly-75
SEQ. ID. NO. 26210  115-TyrGlnArgProPheGlyGlyHis-122
SEQ. ID. NO. 26211  125-GluHisGlyLysArgAlaVal-131
SEQ. ID. NO. 26212  146-LeuHisThrLeuTyrGln-151
SEQ. ID. NO. 26213  210-AlaSerSerThrAsn-214
SEQ. ID. NO. 26214  216-TyrMetAsnThrGlyAspGly-222
SEQ. ID. NO. 26215  275-ArgTyrAlaProThrValLys-281
SEQ. ID. NO. 26216  322-IleMetGluLysLeuProGlyIleArg-330
SEQ. ID. NO. 26217  338-GlyIleAspProIleLysAspProIlePro-347
SEQ. ID. NO. 26218  357-GlyGlyIleProThrAsnTyrHis-364
Antigenic Index - Jameson-Wolf
SEQ. ID. NO. 26219  15-GlyGlyGlyAlaGly-19
SEQ. ID. NO. 26220  26-LeuSerLysSerGlyLeu-31
SEQ. ID. NO. 26221  40-PheProThrArgSerHis-45
SEQ. ID. NO. 26222  59-AsnValGlnGluAspArgTrpAsp-66

TABLE 1-continued

| | |
|---|---|
| SEQ. ID. NO. 26223 | 71-AspThrValLysGlySerAspTrpLeuGlyAspGlnAspAlaIle-85 |
| SEQ. ID. NO. 26224 | 104-MetProPheAspArgValGluSerGlyLysIleTyrGlnArgProPheGly-120 |
| SEQ. ID. NO. 26225 | 123-ThrAlaGluHisGlyLysArgAlaValGluArgAlaCysAlaValAlaAspArgThrGly-142 |
| SEQ. ID. NO. 26226 | 152-GlnAsnValArgAlaAsnThr-158 |
| SEQ. ID. NO. 26227 | 168-AspLeuIleArgAspGluAsnGlyAspVal-177 |
| SEQ. ID. NO. 26228 | 183-MetGluMetGluThrGlyGlu-189 |
| SEQ. ID. NO. 26229 | 202-ThrGlyGlyGlyGlyArgIle-208 |
| SEQ. ID. NO. 26230 | 218-AsnThrGlyAspGly-222 |
| SEQ. ID. NO. 26231 | 231-IleProLeuGluAspMetGlu-237 |
| SEQ. ID. NO. 26232 | 255-GluGlyValArgGlyGluGlyGlyIle-263 |
| SEQ. ID. NO. 26233 | 266-AsnAlaAspGlyGluArgPheMetGlu-274 |
| SEQ. ID. NO. 26234 | 276-TyrAlaProThrValLysAspLeuAlaSerArgAspValValSer-290 |
| SEQ. ID. NO. 26235 | 297-IleTyrGluGlyArgGlyCysGlyLysAsnLysAspHisVal-310 |
| SEQ. ID. NO. 26236 | 315-AspHisIleGlyAlaGluLysIleMetGluLysLeuProGlyIleArgGluIleSer-333 |
| SEQ. ID. NO. 26237 | 338-GlyIleAspProIleLysAspProIle-346 |
| SEQ. ID. NO. 26238 | 368-ValValProGlnGlyAspGluTyrGluValProVal-379 |
| SEQ. ID. NO. 26239 | 395-GlyAlaAsnArgLeuGlyThrAsnSerLeu-404 |
| SEQ. ID. NO. 26240 | 411-ArgProThrProArg-415 |
| Hydrophilic Regions - Hopp-Woods | |
| SEQ. ID. NO. 26241 | 27-SerLysSerGlyLeu-31 |
| SEQ. ID. NO. 26242 | 59-AsnValGlnGluAspArgTrpAsp-66 |
| SEQ. ID. NO. 26243 | 71-AspThrValLysGly-75 |
| SEQ. ID. NO. 26244 | 77-AspTrpLeuGlyAspGlnAspAlaIle-85 |
| SEQ. ID. NO. 26245 | 105-ProPheAspArgValGluSerGlyLysIleTyr-115 |
| SEQ. ID. NO. 26246 | 123-ThrAlaGluHisGlyLysArgAlaValGluArgAlaCysAlaValAlaAspArgThrGly-142 |
| SEQ. ID. NO. 26247 | 168-AspLeuIleArgAspGluAsnGlyAsp-176 |
| SEQ. ID. NO. 26248 | 183-MetGluMetGluThrGlyGlu-189 |
| SEQ. ID. NO. 26249 | 231-IleProLeuGluAspMetGlu-237 |
| SEQ. ID. NO. 26250 | 255-GluGlyValArgGlyGluGly-261 |
| SEQ. ID. NO. 26251 | 267-AlaAspGlyGluArgPheMetGlu-274 |
| SEQ. ID. NO. 26252 | 276-TyrAlaProThrValLysAspLeuAlaSerArgAspValValSer-290 |
| SEQ. ID. NO. 26253 | 297-IleTyrGluGlyArgGlyCysGlyLysAsnLysAspHisVal-310 |
| SEQ. ID. NO. 26254 | 315-AspHisIleGlyAlaGluLysIleMetGluLysLeuProGlyIleArgGluIleSer-333 |
| SEQ. ID. NO. 26255 | 340-AspProIleLysAspProIle-346 |
| SEQ. ID. NO. 26256 | 371-GlnGlyAspGluTyrGluValProVal-379 |
| g011 | |
| AMPHI Regions - AMPHI | |
| SEQ. ID. NO. 26257 | 58-IleArgLeuIleAsnAlaAla-64 |
| SEQ. ID. NO. 26258 | 83-AlaIleLeuThrLys-87 |
| SEQ. ID. NO. 26259 | 116-AspValLeuHisArgTyrLeuProGlnMetLeuSerAlaGly-129 |
| SEQ. ID. NO. 26260 | 142-ThrGlyAlaAlaGlyMetAlaAspMetGlyLysValMet-154 |
| Antigenic Index - Jameson-Wolf | |
| SEQ. ID. NO. 26261 | 1-MetLysThrHisArgLysThrCysSer-9 |
| SEQ. ID. NO. 26262 | 17-ThrAlaSerLysProAlaValSerIleArgHisProSerGluAspIleMetSerLeuLysThrArgLeuThrGluAspMetLysThrAlaMetArgAlaLysAspGlnVal-53 |
| SEQ. ID. NO. 26263 | 66-LysGlnPheGluValAspGluArgThrGluAlaAspAspAlaLysIle-81 |
| SEQ. ID. NO. 26264 | 88-MetValLysGlnArgLysAspGlyAlaLysIleTyrThrGluAlaGlyArgGlnAspLeuAlaAspLysGluAsnAlaGluIle-115 |
| SEQ. ID. NO. 26265 | 127-SerAlaGlyGluIleArgThrAlaVal-135 |
| SEQ. ID. NO. 26266 | 159-ThrArgLeuAlaGlyLysAlaAspMetGlyGluValAsnLysIleLeu-174 |
| Hydrophilic Regions - Hopp-Woods | |
| SEQ. ID. NO. 26267 | 1-MetLysThrHisArgLysThrCys-8 |
| SEQ. ID. NO. 26268 | 27-HisProSerGluAspIleMetSerLeuLysThrArgLeuThrGluAspMetLysThrAlaMetArgAlaLysAspGlnVal-53 |
| SEQ. ID. NO. 26269 | 66-LysGlnPheGluValAspGluArgThrGluAlaAspAspAlaLysIle-81 |
| SEQ. ID. NO. 26270 | 88-MetValLysGlnArgLysAspGlyAlaLysIleTyrThrGluAlaGlyArgGlnAspLeuAlaAspLysGluAsnAlaGluIle-115 |
| SEQ. ID. NO. 26271 | 129-GlyGluIleArgThrAlaVal-135 |
| SEQ. ID. NO. 26272 | 159-ThrArgLeuAlaGlyLysAlaAspMetGlyGluValAsnLysIleLeu-174 |
| g012-1 | |
| AMPHI Regions - AMPHI | |
| SEQ. ID. NO. 26273 | 18-AspLysLeuLeuGluGlnLeuMetArgPheLeuGlnPheLeuProGluPheLeuPheAlaLeuPheArgIle-41 |
| SEQ. ID. NO. 26274 | 48-ArgAlaLeuLysPheAlaArgArg-55 |
| SEQ. ID. NO. 26275 | 89-AsnAsnPheIleArgHisThr-95 |
| SEQ. ID. NO. 26276 | 100-AlaAlaAlaCysArgAsp-105 |
| SEQ. ID. NO. 26277 | 133-HisAlaAlaArgThrPhe-138 |
| SEQ. ID. NO. 26278 | 160-GlnGlyPheTyrGlyVal-165 |
| SEQ. ID. NO. 26279 | 179-GlyPheLeuArgPheGlyArgPheLeuProAlaLeuLeuGlnThrLeu-194 |
| Antigenic Index - Jameson-Wolf | |
| SEQ. ID. NO. 26280 | 42-PheThrHisLysSerAsnArgAlaLeuLysPheAlaArgArgHisHis-57 |
| SEQ. ID. NO. 26281 | 72-ArgHisPheArgHisHisThrHisArgThrAspAspArgLysArgSerGlyAsnAsnPheIleArgHisThrArg-96 |
| SEQ. ID. NO. 26282 | 102-AlaCysArgAspLeuIleAspGlyAspGlyGlnArgAsn-114 |
| SEQ. ID. NO. 26283 | 119-GlnThrProLysLeuArgSerArgGln-127 |
| SEQ. ID. NO. 26284 | 137-ThrPheGlnSerGluGlnAsnLeu-144 |
| SEQ. ID. NO. 26285 | 147-ArgLeuGlyAsnGlnLysHisArgArgAsnLeuMetThrGln-160 |
| SEQ. ID. NO. 26286 | 173-IleGlnHisLysLysAlaGly-179 |
| Hydrophilic Regions - Hopp-Woods | |
| SEQ. ID. NO. 26287 | 45-LysSerAsnArgAlaLeuLysPheAlaArgArgHisHis-57 |
| SEQ. ID. NO. 26288 | 77-HisThrHisArgThrAspAspArgLysArgSerGly-88 |
| SEQ. ID. NO. 26289 | 102-AlaCysArgAspLeuIleAspGlyAspGlyGlnArg-113 |
| SEQ. ID. NO. 26290 | 121-ProLysLeuArgSerArgGln-127 |

TABLE 1-continued

SEQ. ID. NO. 26291 149-GlyAsnGlnLysHisArgArgAsnLeu-157
SEQ. ID. NO. 26292 173-IleGlnHisLysLysAlaGly-179
g015
AMPHI Regions - AMPHI
SEQ. ID. NO. 26293 36-LeuValGlyPheTrpLysAlaLeuProHis-45
SEQ. ID. NO. 26294 107-MetCysCysIleAlaCys-112
Antigenic Index - Jameson-Wolf
SEQ. ID. NO. 26295 29-TrpLysAsnProGluLysProLeu-36
SEQ. ID. NO. 26296 90-MetArgAlaArgProArgSerThrLys-98
Hydrophilic Regions - Hopp-Woods
SEQ. ID. NO. 26297 31-AsnProGluLysProLeu-36
SEQ. ID. NO. 26298 90-MetArgAlaArgProArgSerThrLys-98
g018-2
AMPHI Regions - AMPHI
SEQ. ID. NO. 26299 6-IleGlnHisLeuArg-10
SEQ. ID. NO. 26300 15-HisLeuMetArgProCysGlnGlnValSerGlnMetPheGly-28
SEQ. ID. NO. 26301 152-ArgIleGlyAsnGlyTyr-157
Antigenic Index - Jameson-Wolf
SEQ. ID. NO. 26302 1-MetValGluArgHisIleGln-7
SEQ. ID. NO. 26303 9-LeuArgAsnGlyHisLeu-14
SEQ. ID. NO. 26304 27-PheGlyGlyArgAlaTyrAspPheArgAlaAspLysAlaAlaGly-41
SEQ. ID. NO. 26305 67-TyrPheAlaAspAspLysPhe-73
SEQ. ID. NO. 26306 78-LeuArgGlyAsnLeuArg-83
SEQ. ID. NO. 26307 85-PheGlnThrAspLysAlaAspLeuArgThrGlyLysHisHisAlaAsnGly-101
SEQ. ID. NO. 26308 108-AlaAspIleArgValAlaAla-114
SEQ. ID. NO. 26309 136-ArgValAlaArgAsnLysAspMetArgAsnAlaGlyLeuHis-149
SEQ. ID. NO. 26310 152-ArgIleGlyAsnGlyTyr-157
SEQ. ID. NO. 26311 176-ArgThrAlaThrTyr-180
SEQ. ID. NO. 26312 223-SerGluHisGlyPheArg-228
Hydrophilic Regions - Hopp-Woods
SEQ. ID. NO. 26313 1-MetValGluArgHisIleGln-7
SEQ. ID. NO. 26314 30-ArgAlaTyrAspPheArgAlaAspLysAlaAla-40
SEQ. ID. NO. 26315 67-TyrPheAlaAspAspLysPhe-73
SEQ. ID. NO. 26316 85-PheGlnThrAspLysAlaAspLeuArgThrGlyLysHisHisAla-99
SEQ. ID. NO. 26317 108-AlaAspIleArgValAlaAla-114
SEQ. ID. NO. 26318 136-ArgValAlaArgAsnLysAspMetArgAsn-145
g019-2
AMPHI Regions - AMPHI
SEQ. ID. NO. 26319 33-ProAlaAspAsnIleGlu-38
SEQ. ID. NO. 26320 55-GlyLysThrLeuAlaAspTyrGlyGlyTyrProSerAlaLeuAspAlaValLysGln-73
SEQ. ID. NO. 26321 83-LeuGluAsnThrGlyAsp-88
SEQ. ID. NO. 26322 90-AlaMetAlaGluLeuValXxxAsnThrGlyLysGluTrpLeuLysSer-102
SEQ. ID. NO. 26323 142-AlaAlaGluLeuValXxxAsnThrGlyLysLeuProSerGlyCysThrLysLeuLeuGluGlnAla-163
SEQ. ID. NO. 26324 173-AspAlaTrpArgGlyValArgGlyLeu-181
SEQ. ID. NO. 26325 195-AlaAlaLeuGlySerProPheAspGlyGlyThrGlnGly-207
SEQ. ID. NO. 26326 215-AsnValIleGlyLysGluAlaArgLysSer-224
SEQ. ID. NO. 26327 229-AlaLeuLeuSerGluMetGlu-235
SEQ. ID. NO. 26328 259-AsnValProAlaAlaLeuAspTyrTyrGly-268
SEQ. ID. NO. 26329 292-ArgArgTrpAspGluLeuAlaSerValIleSerHisMetProGluLysLeuGlnLys-310
SEQ. ID. NO. 26330 329-GlnGluAlaGluLysLeuTyrLysGlnAla-338
SEQ. ID. NO. 26331 451-ArgTyrIleSerPro-455
SEQ. ID. NO. 26332 495-GlnGlyLeuMetGlnValMet-501
SEQ. ID. NO. 26333 582-ArgAspTyrValLysLysValMet-589
Antigenic Index - Jameson-Wolf
SEQ. ID. NO. 26334 22-SerSerThrAsnThr-26
SEQ. ID. NO. 26335 28-ProAlaGlyLysThrProAlaAspAsnIleGluThrAlaAspLeuSerAlaSerValProThrArgProAlaGluProGluGlyLysThrLeu
 AlaAspTyrGlyGlyTyrProSerAla-67
SEQ. ID. NO. 26336 69-AspAlaValLysGlnAsnAsnAspAlaAla-78
SEQ. ID. NO. 26337 84-GluAsnThrGlyAspSerAlaMet-91
SEQ. ID. NO. 26338 93-GluAsnValArgLysGluTrpLeu-100
SEQ. ID. NO. 26339 103-LeuGlyAlaArgArgGln-108
SEQ. ID. NO. 26340 115-GluTyrAlaLysLeuLysProGluGlyGlyAlaGlnGluValGluCysTyrAlaAspSerSerArgAsnAspTyrThrArgAlaAlaGlu-144
SEQ. ID. NO. 26341 147-XxxAsnThrGlyLysLeuProSerGlyCys-156
SEQ. ID. NO. 26342 170-GlyGlyAsnAspAlaTrpArgGlyValArg-179
SEQ. ID. NO. 26343 182-LeuAlaGlyArgProThrThrAspGlyArgAsn-192
SEQ. ID. NO. 26344 199-SerProPheAspGlyGlyThrGlnGlySerArgGluTyr-211
SEQ. ID. NO. 26345 217-IleGlyLysGluAlaArgLysSerProAsnAla-227
SEQ. ID. NO. 26346 232-SerGluMetGluSerGlyLeuSerProGluGlnArgSer-244
SEQ. ID. NO. 26347 254-GlnSerGlnSerLeu-258
SEQ. ID. NO. 26348 266-TyrTyrGlyLysValAlaAspArgArgGlnLeuThrAspAspGlnIle-281
SEQ. ID. NO. 26349 287-AlaAlaLeuArgAlaArgTrpAspGlu-296
SEQ. ID. NO. 26350 304-MetProGluLysLeuGlnLysSerProThr-313
SEQ. ID. NO. 26351 320-ArgSerArgAlaAlaThrGlyAsnThrGlnGluAlaGluLysLeuTyrLys-336
SEQ. ID. NO. 26352 339-AlaAlaThrGlyArgAsn-344
SEQ. ID. NO. 26353 350-AlaGlyGluGluLeuGlyArgLysIleAspThrArgAsnAsnValProAspAlaGlyLysAsnSerVal-372
SEQ. ID. NO. 26354 374-ArgMetAlaGluAspGlyAlaIleLys-382
SEQ. ID. NO. 26355 389-ArgAsnSerArgThrAlaGlyAspAlaLysMetArgArgGlnAlaGlnAla-405
SEQ. ID. NO. 26356 409-PheAlaThrArgGlyPheAspGluAspLysLeuLeu-420
SEQ. ID. NO. 26357 438-SerAlaGluArgThrAspArgLysLeuAsnTyr-448
SEQ. ID. NO. 26358 454-SerProPheLysAspThrValIle-461

TABLE 1-continued

| SEQ. ID. NO. 26359 | 464-AlaGlnAsnValAsnValAspProAla-472 |
| SEQ. ID. NO. 26360 | 478-IleArgGlnGluSerArgPhe-484 |
| SEQ. ID. NO. 26361 | 488-AlaGlnSerArgValGlyAla-494 |
| SEQ. ID. NO. 26362 | 504-ThrAlaArgGluIleAlaGly-510 |
| SEQ. ID. NO. 26363 | 520-TyrThrAlaAspGlyAsnIleArgMetGly-529 |
| SEQ. ID. NO. 26364 | 535-AspThrLysArgArgLeuGlnAsnAsnGluIle-545 |
| SEQ. ID. NO. 26365 | 550-GlyTyrAsnAlaGlyProGlyArgAlaArgArgTrpGlnAlaAspThrProLeuGlu-568 |
| SEQ. ID. NO. 26366 | 579-SerGluThrArgAspTyrValLys-586 |
| SEQ. ID. NO. 26367 | 605-ProLeuLysGlnArgMetGlyThrValProAlaArg-616 |

Hydrophilic Regions - Hopp-Woods

| SEQ. ID. NO. 26368 | 30-GlyLysThrProAlaAspAsnIleGluThrAlaAspLeu-42 |
| SEQ. ID. NO. 26369 | 46-ValProThrArgProAlaGluProGluGlyLysThrLeuAla-59 |
| SEQ. ID. NO. 26370 | 69-AspAlaValLysGlnAsnAsnAspAlaAla-78 |
| SEQ. ID. NO. 26371 | 85-AsnThrGlyAspSerAlaMet-91 |
| SEQ. ID. NO. 26372 | 93-GluAsnValArgLysGluTrpLeu-100 |
| SEQ. ID. NO. 26373 | 103-LeuGlyAlaAlaArgArgGln-108 |
| SEQ. ID. NO. 26374 | 115-GluTyrAlaLysLeuLysProGluGlyGlyAlaGlnGluValGluCysTyrAlaAspSerSerArgAsnAspTyrThrArgAlaAlaGlu-144 |
| SEQ. ID. NO. 26375 | 150-GlyLysLeuProSerGlyCys-156 |
| SEQ. ID. NO. 26376 | 173-AspAlaTrpArgGly-177 |
| SEQ. ID. NO. 26377 | 186-ProThrThrAspGlyArgAsn-192 |
| SEQ. ID. NO. 26378 | 201-PheAspGlyGlyThrGlnGlySerArgGlu-210 |
| SEQ. ID. NO. 26379 | 217-IleGlyLysGluAlaArgLysSerProAsn-226 |
| SEQ. ID. NO. 26380 | 232-SerGluMetGluSerGlyLeuSerProGluGlnArgSer-244 |
| SEQ. ID. NO. 26381 | 270-ValAlaAspArgArgGlnLeuThrAspAspGlnIle-281 |
| SEQ. ID. NO. 26382 | 287-AlaAlaLeuArgAlaAlaArgTrpAspGlu-296 |
| SEQ. ID. NO. 26383 | 304-MetProGluLysLeuGlnLys-310 |
| SEQ. ID. NO. 26384 | 320-ArgSerArgAlaAlaThr-325 |
| SEQ. ID. NO. 26385 | 327-AsnThrGlnGluAlaGluLysLeuTyrLys-336 |
| SEQ. ID. NO. 26386 | 350-AlaGlyGluGluLeuGlyArgLysIleAspThrArgAsnAsnValProAspAlaGlyLys-369 |
| SEQ. ID. NO. 26387 | 374-ArgMetAlaGluAspGlyAlaIleLys-382 |
| SEQ. ID. NO. 26388 | 389-ArgAsnSerArgThrAlaGlyAspAlaLysMetArgArgGlnAlaGlnAla-405 |
| SEQ. ID. NO. 26389 | 411-ThrArgGlyPheAspGluAspLysLeuLeu-420 |
| SEQ. ID. NO. 26390 | 438-SerAlaGluArgThrAspArgLysLeu-446 |
| SEQ. ID. NO. 26391 | 478-IleArgGlnGluSerArgPhe-484 |
| SEQ. ID. NO. 26392 | 504-ThrAlaArgGluIleAlaGly-510 |
| SEQ. ID. NO. 26393 | 535-AspThrLysArgArgLeuGlnAsn-542 |
| SEQ. ID. NO. 26394 | 554-GlyProGlyArgAlaArgArgTrpGlnAla-563 |
| SEQ. ID. NO. 26395 | 579-SerGluThrArgAspTyrValLys-586 |
| SEQ. ID. NO. 26396 | 606-LeuLysGlnArgMetGly-611 | g023
AMPHI Regions - AMPHI

| SEQ. ID. NO. 26397 | 43-GluTyrProAlaTrpGlnAlaPhePheSerGlnAlaTrpValLysValPheThrGlnValSerPheIleAlaValPheLeuHisAlaTrpValGly-74 |
| SEQ. ID. NO. 26398 | 77-AspLeuTrpMetAspTyrIleLys-84 |

Antigenic Index - Jameson-Wolf

| SEQ. ID. NO. 26399 | 1-MetValGluArgLysLeuThr-7 |
| SEQ. ID. NO. 26400 | 40-LeuProLysGluTyrProAlaTrp-47 |

Hydrophilic Regions - Hopp-Woods

| SEQ. ID. NO. 26401 | 1-MetValGluArgLysLeuThr-7 | g025
AMPHI Regions - AMPHI

| SEQ. ID. NO. 26402 | 9-AlaAlaCysThrAlaValAlaAlaLeuLeuGlyGlyCysAla-22 |
| SEQ. ID. NO. 26403 | 35-GlyMetGlnThrValSerSer-41 |
| SEQ. ID. NO. 26404 | 46-AsnProTyrGlyAlaThrProTyr-53 |
| SEQ. ID. NO. 26405 | 126-AspPheArgAlaTrpAsnGlyMetThrAsp-135 |
| SEQ. ID. NO. 26406 | 140-IleGlyGlnIleValLysVal-146 |
| SEQ. ID. NO. 26407 | 173-ValLysProAlaAla-177 |
| SEQ. ID. NO. 26408 | 181-ValGlnSerAlaProGlnPro-187 |
| SEQ. ID. NO. 26409 | 212-SerGlyThrArgSer-216 |
| SEQ. ID. NO. 26410 | 229-LysValValAlaAspPhe-234 |
| SEQ. ID. NO. 26411 | 265-GlyLeuArgGlyTyrGlyAsn-271 |

Antigenic Index - Jameson-Wolf

| SEQ. ID. NO. 26412 | 22-AlaThrGlnGlnPro-26 |
| SEQ. ID. NO. 26413 | 108-ValArgGlyAspThr-112 |
| SEQ. ID. NO. 26414 | 115-AsnIleSerLysArgTyrHisIleSerGlnAspAspPheArgAla-129 |
| SEQ. ID. NO. 26415 | 131-AsnGlyMetThrAspAsnThrLeu-138 |
| SEQ. ID. NO. 26416 | 144-ValLysValLysProAlaGly-150 |
| SEQ. ID. NO. 26417 | 152-AlaAlaProLysThrAlaAlaValGluSerArgProAlaValPro-166 |
| SEQ. ID. NO. 26418 | 171-ThrProValLysProAlaAlaGlnProProValGlnSerAlaProGlnPro-187 |
| SEQ. ID. NO. 26419 | 190-ProAlaAlaGluAsnLysAlaValPro-198 |
| SEQ. ID. NO. 26420 | 202-ProAlaProGlnSerProAlaAlaSerProSerGlyThrArgSerValGly-218 |
| SEQ. ID. NO. 26421 | 224-ArgProThrGlnGlyLysValValAlaAspPheGlyGlyGlyAsnLysGlyValAsp-242 |
| SEQ. ID. NO. 26422 | 255-AlaAspGlyLysVal-259 |
| SEQ. ID. NO. 26423 | 264-SerGlyLeuArgGlyTyrGly-270 |
| SEQ. ID. NO. 26424 | 285-TyrGlyHisAsnGln-289 |
| SEQ. ID. NO. 26425 | 292-LeuValGlyGluGlyGlnGlnValLysArgGlyGlnGln-304 |
| SEQ. ID. NO. 26426 | 309-GlyAsnThrAspAlaSerArgThrGlnLeu-318 |
| SEQ. ID. NO. 26427 | 320-PheGluValArgGlnAsnGlyLysProValAsnProAsnSer-333 |

TABLE 1-continued

Hydrophilic Regions - Hopp-Woods
SEQ. ID. NO. 26428    108-ValArgGlyAspThr-112
SEQ. ID. NO. 26429    120-TyrHisIleSerGlnAspAspPheArg-128
SEQ. ID. NO. 26430    144-ValLysValLysPro-148
SEQ. ID. NO. 26431    157-AlaAlaValGluSerArgProAla-164
SEQ. ID. NO. 26432    171-ThrProValLysProAlaAla-177
SEQ. ID. NO. 26433    190-ProAlaAlaGluAsnLysAlaValPro-198
SEQ. ID. NO. 26434    212-SerGlyThrArgSer
SEQ. ID. NO. 26435    235-GlyGlyGlyAsnLysGlyValAsp-242
SEQ. ID. NO. 26436    255-AlaAspGlyLysVal-259
SEQ. ID. NO. 26437    295-GluGlyGlnGlnValLysArgGlyGln-303
SEQ. ID. NO. 26438    311-ThrAspAlaSerArgThr-316
SEQ. ID. NO. 26439    322-ValArgGlnAsnGlyLysProValAsn-330
g032
AMPHI Regions - AMPHI
SEQ. ID. NO. 26440    9-AlaValLeuArgArgProArgPheGlu-17
SEQ. ID. NO. 26441    67-ProPheAlaGlyAsnValTyrProArgPheValGlnIle-79
SEQ. ID. NO. 26442    114-ValHisGlyGlnIleGlnHisProValGlnProPheLeuArg-127
SEQ. ID. NO. 26443    134-LeuGlyLeuLeuArgArgPheAspVal-142
SEQ. ID. NO. 26444    174-GlnThrAlaLeuArg-178
SEQ. ID. NO. 26445    204-LeuCysGlnGlnCysLysGlnPhePheGlnIleAla-215
Antigenic Index - Jameson-Wolf
SEQ. ID. NO. 26446    1-MetArgArgAsnVal-5
SEQ. ID. NO. 26447    10-ValLeuArgArgProArgPhe-16
SEQ. ID. NO. 26448    28-ArgAlaValProAlaGlyLysGlnGlyPhe-37
SEQ. ID. NO. 26449    41-CysArgLeuThrGlnArg-46
SEQ. ID. NO. 26450    58-GlyGlnArgAsnLeu-62
SEQ. ID. NO. 26451    100-LeuGluGlnArgValValAlaHisArgGlnArgVal-111
SEQ. ID. NO. 26452    138-ArgArgPheAspValGlyGlyArgValGlyAla-148
SEQ. ID. NO. 26453    151-ProAlaPheAspGlnProGlyAla-158
SEQ. ID. NO. 26454    160-LeuProProArgArgGlnLeuAlaArgGlnArgProThrVal-173
SEQ. ID. NO. 26455    176-AlaLeuArgGlnProProGlnArgArgArgLysIleAlaProArgGlnValLeu-193
SEQ. ID. NO. 26456    202-ArgHisLeuCysGlnGlnCysLys-209
SEQ. ID. NO. 26457    216-ProValCysArgAsnArgValLeuArg-224
SEQ. ID. NO. 26458    236-ValLysIleArgArgLysProValGlnAsnHisAsnArgProThrGlnIleSerLysAsnGln-256
Hydrophilic Regions - Hopp-Woods
SEQ. ID. NO. 26459    1-MetArgArgAsnVal-5
SEQ. ID. NO. 26460    10-ValLeuArgArgProArgPhe-16
SEQ. ID. NO. 26461    41-CysArgLeuThrGln-45
SEQ. ID. NO. 26462    100-LeuGluGlnArgValValAlaHisArgGlnArgVal-111
SEQ. ID. NO. 26463    138-ArgArgPheAspValGlyGly-144
SEQ. ID. NO. 26464    161-ProProArgArgGlnLeuAlaArgGlnArgProThrVal-173
SEQ. ID. NO. 26465    177-LeuArgGlnProProGlnArgArgArgLysIleAlaPro-189
SEQ. ID. NO. 26466    218-CysArgAsnArgValLeu-223
SEQ. ID. NO. 26467    236-ValLysIleArgArgLysProValGlnAsnHisAsnArgProThrGlnIleSerLysAsnGln-256
g033-2
AMPHI Regions - AMPHI
SEQ. ID. NO. 26468    6-GlnTyrGlyGlyLeuAlaGlyPheProLysArgCysGluSerGlu-20
SEQ. ID. NO. 26469    64-GlyGlnAlaPheGluAlaLeuAsnCys-72
SEQ. ID. NO. 26470    95-ValGlyAlaLeuProLysTyrLeuAlaSerAsnValValArgAspMetHisGlyLeuLeuSerThrVal-117
SEQ. ID. NO. 26471    120-GlnThrGlyLysValLeuAspLysIleProGlyAlaMetGlu-133
SEQ. ID. NO. 26472    142-IleLysThrLeuAlaGlu-147
SEQ. ID. NO. 26473    157-SerLeu
PheGluAsnPhe-162
SEQ. ID. NO. 26474
SEQ. ID. NO. 26475    168-GlyProValAspGlyHisAsnValGluAsnLeuValAspValLeuLysAspLeuArgSerArg-188
SEQ. ID. NO. 26476    207-AlaGluAsnAspPro-211
SEQ. ID. NO. 26477    213-LysTyrHisAlaValAlaAsnLeuProLysGluGlyGlyAla-226
SEQ. ID. NO. 26478    242-TyrThrGlnValPheGlyLys-248
SEQ. ID. NO. 26479    280-PheProAspArgTyrPheAspVal-287
SEQ. ID. NO. 26480    307-LysProValValAlaIleTyrSer-314
SEQ. ID. NO. 26481    316-PheLeuGlnArgAlaTyrAspGlnLeu-324
SEQ. ID. NO. 26482    363-CysValProAsnMet-367
SEQ. ID. NO. 26483    390-AlaProAlaAlaValArgTyrProArgGlyThr-400
SEQ. ID. NO. 26484    406-ValSerAspGlyMetGluThrValGlu-414
SEQ. ID. NO. 26485    419-IleIleArgArgGlu-423
SEQ. ID. NO. 26486    453-MetArgPheValLysProIleAspGluGlu-462
SEQ. ID. NO. 26487    469-ArgSerHisAspArgIle-474
SEQ. ID. NO. 26488    489-AlaValLeuGluValLeu-494
SEQ. ID. NO. 26489    510-AspThrValThrGluHisGlyAspProLysLysLeuLeu-522
Antigenic Index - Jameson-Wolf
SEQ. ID. NO. 26490    11-AlaGlyPheProLysArgCysGluSerGluTyrAspAla-23
SEQ. ID. NO. 26491    28-HisSerSerThrSerIle-33
SEQ. ID. NO. 26492    41-AlaAlaAspLysLeuLeuGlyGlyAspArgArgSerVal-53
SEQ. ID. NO. 26493    57-GlyAspGlyAlaMetThr-62
SEQ. ID. NO. 26494    72-CysAlaGlyAspMetAspVal-78
SEQ. ID. NO. 26495    85-AsnAspAsnGluMetSerIle-91
SEQ. ID. NO. 26496    105-AsnValValArgAspMetHisGly-112
SEQ. ID. NO. 26497    117-ValLysAlaGlnThrGlyLysValLeuAspLysIleProGly-130
SEQ. ID. NO. 26498    134-PheAlaGlnLysValGluHisLysIleLysThrLeuAlaGluGluAlaGluHisAlaLysGln-154
SEQ. ID. NO. 26499    166-TyrThrGlyProValAspGlyHisAsn-174

TABLE 1-continued

| SEQ. ID. NO. 26500 | 181-ValLeuLysAspLeuArgSerArgLysGlyProGln-192 |
| SEQ. ID. NO. 26501 | 197-IleThrLysLysGlyAsnGlyTyrLysLeuAlaGluAsnAspProValLys-213 |
| SEQ. ID. NO. 26502 | 219-AsnLeuProLysGluGlyGlyAlaGlnMetProSerGluLysGluProLysProAlaAlaLysProThrTyr-242 |
| SEQ. ID. NO. 26503 | 253-ArgAlaAlaAlaAspSerArgLeu-260 |
| SEQ. ID. NO. 26504 | 266-AlaMetArgGluGlySerGlyLeuValGluPheGluGlnArgPheProAspArgTyrPhe-285 |
| SEQ. ID. NO. 26505 | 345-ValGlyAlaAspGlyProThrHis-352 |
| SEQ. ID. NO. 26506 | 370-AlaAlaProSerAspGluAsnGluCysArg-379 |
| SEQ. ID. NO. 26507 | 395-ArgTyrProArgGlyThrGlyThrGlyAlaProValSerAspGlyMetGluThrValGluIleGlyLysGlyIleIleArgArgGluGlyGlu LysThrAla-428 |
| SEQ. ID. NO. 26508 | 457-LysProIleAspGluGluLeuIle-464 |
| SEQ. ID. NO. 26509 | 467-LeuAlaArgSerHisAspArgIleValThrLeuGluGluAsnAlaGluGlnGlyGlyAlaGlyGly-488 |
| SEQ. ID. NO. 26510 | 511-ThrValThrGluHisGlyAspProLysLysLeuLeuAspAspLeuGlyLeu-527 |
| SEQ. ID. NO. 26511 | 530-GluAlaValGluArgArgValArgGluTrpLeuProAspArgAspAlaAlaAsn-547 |
| Hydrophilic Regions - Hopp-Woods | |
| SEQ. ID. NO. 26512 | 13-PheProLysArgCysGluSerGluTyrAsp-22 |
| SEQ. ID. NO. 26513 | 41-AlaAlaAspLysLeuLeuGlyGlyAspArgArgSerVal-53 |
| SEQ. ID. NO. 26514 | 74-GlyAspMetAspVal-78 |
| SEQ. ID. NO. 26515 | 85-AsnAspAsnGluMetSerIle-91 |
| SEQ. ID. NO. 26516 | 106-ValValArgAspMetHis-111 |
| SEQ. ID. NO. 26517 | 123-LysValLeuAspLysIleProGly-130 |
| SEQ. ID. NO. 26518 | 134-PheAlaGlnLysValGluHisLysIleLysThrLeuAlaGluGluAlaGluHisAlaLysGln-154 |
| SEQ. ID. NO. 26519 | 181-ValLeuLysAspLeuArgSerArgLysGlyPro-191 |
| SEQ. ID. NO. 26520 | 197-IleThrLysLysGlyAsnGly-203 |
| | 205-LysLeuAlaGluAsnAspProValLys-213 |
| SEQ. ID. NO. 26521 | 220-LeuProLysGluGlyGlyAla-226 |
| SEQ. ID. NO. 26522 | 228-MetProSerGluLysGluProLysProAlaAla-238 |
| SEQ. ID. NO. 26523 | 253-ArgAlaAlaAlaAspSerArgLeu-260 |
| SEQ. ID. NO. 26524 | 266-AlaMetArgGluGlySerGly-272 |
| SEQ. ID. NO. 26525 | 274-ValGluPheGluGlnArgPheProAspArgTyrPhe-285 |
| SEQ. ID. NO. 26526 | 372-ProSerAspGluAsnGluCys-378 |
| SEQ. ID. NO. 26527 | 405-ProValSerAspGlyMetGluThrValGluIleGlyLysGlyIleIleArgArgGluGlyGluLysThrAla-428 |
| SEQ. ID. NO. 26528 | 457-LysProIleAspGluGluLeuIle-464 |
| SEQ. ID. NO. 26529 | 467-LeuAlaArgSerHisAspArgIleValThrLeuGluGluAsnAlaGluGlnGlyGly-485 |
| SEQ. ID. NO. 26530 | 511-ThrValThrGluHisGlyAspProLysLysLeuLeuAsp-523 |
| SEQ. ID. NO. 26531 | 530-GluAlaValGluArgArgValArgGluTrpLeuProAspArgAspAlaAlaAsn-547 |
| g034 | |
| AMPHI Regions - AMPHI | |
| SEQ. ID. NO. 26532 | 35-LeuAspHisAlaAla-39 |
| SEQ. ID. NO. 26533 | 52-AsnLeuGluGlnMetArgAlaIleMetGluAlaAlaAspGln-65 |
| SEQ. ID. NO. 26534 | 94-AlaValGluGluPheProHisIlePro-102 |
| SEQ. ID. NO. 26535 | 152-ThrValValAsnPheSer-157 |
| SEQ. ID. NO. 26536 | 168-IleGlyValLeuGlyAsnLeuGluThrGly-177 |
| SEQ. ID. NO. 26537 | 197-LeuThrSerValGluAspAlaValArgPheValLysAspThrGly-211 |
| SEQ. ID. NO. 26538 | 226-TyrLysPheThrArgProProThrGly-234 |
| SEQ. ID. NO. 26539 | 236-ValLeuArgIleAspArgIleLysGluIleHisGlnAlaLeu-249 |
| SEQ. ID. NO. 26540 | 261-SerValProGlnGluTrpLeuLysValIleAsnGluTyrGlyGlyAsnIleGlyGluThrTyrGlyValProValGluGluIleValGluGly IleLysHisGly-295 |
| SEQ. ID. NO. 26541 | 314-ArgArgTyrLeuAlaGluAsn-320 |
| SEQ. ID. NO. 26542 | 330-LeuGlyLysThrIleGluAlaMetLys-338 |
| Antigenic Index - Jameson-Wolf | |
| SEQ. ID. NO. 26543 | 20-LeuProLysGluThrGln-25 |
| SEQ. ID. NO. 26544 | 37-HisAlaAlaGluAsnSerTyrGly-44 |
| SEQ. ID. NO. 26545 | 54-GluGlnMetArgAlaIleMetGluAlaAlaAspGlnVal-66 |
| SEQ. ID. NO. 26546 | 75-SerAlaGlyAlaArgLysTyrAla-82 |
| SEQ. ID. NO. 26547 | 106-HisGlnAspHisGlyAlaSerProAspValCysGlnArgSerIle-120 |
| SEQ. ID. NO. 26548 | 132-SerLeuLeuGluAspGlyLysThrProSerSerTyrGluTyr-145 |
| SEQ. ID. NO. 26549 | 164-ValGluGlyGluIle-168 |
| SEQ. ID. NO. 26550 | 173-AsnLeuGluThrGlyGluAlaGlyGluGluAspGlyValGlyAla-187 |
| SEQ. ID. NO. 26551 | 191-LeuSerHisAspGln-195 |
| SEQ. ID. NO. 26552 | 199-SerValGluAspAlaValArgPheValLysAspThrGlyValAsp-213 |
| SEQ. ID. NO. 26553 | 221-ThrSerHisGlyAla-225 |
| SEQ. ID. NO. 26554 | 227-LysPheThrArgProProThrGlyAspValLeuArgIleAspArgIleLysGluIleHis-246 |
| SEQ. ID. NO. 26555 | 258-GlySerSerSerValPro-263 |
| SEQ. ID. NO. 26556 | 271-AsnGluTyrGlyGlyAsnIleGlyGlu-279 |
| SEQ. ID. NO. 26557 | 287-GluIleValGluGlyIleLysHisGlyValArgLysValAsnIleAspThrAspLeuArgLeuAlaSerThrGlyAlaVal-313 |
| SEQ. ID. NO. 26558 | 316-TyrLeuAlaGluAsnProSerAspPheAspProArgLysTyrLeuGlyLysThrIleGluAlaMetLys-338 |
| SEQ. ID. NO. 26559 | 350-CysGluGlyGlnAlaGlyLysIleLysProValSerLeuGluLysMetAlaSerArgTyrAlaLysGlyGluLeu-374 |
| Hydrophilic Regions - Hopp-Woods | |
| SEQ. ID. NO. 26560 | 54-GluGlnMetArgAlaIleMetGluAlaAlaAspGlnVal-66 |
| SEQ. ID. NO. 26561 | 76-AlaGlyAlaArgLysTyrAla-82 |
| SEQ. ID. NO. 26562 | 108-AspHisGlyAlaSerProAspValCysGln-117 |
| SEQ. ID. NO. 26563 | 132-SerLeuLeuGluAspGlyLysThrProSer-141 |
| SEQ. ID. NO. 26564 | 164-ValGluGlyGluIle-168 |
| SEQ. ID. NO. 26565 | 175-GluThrGlyGluAlaGlyGluGluAspGlyValGlyAla-187 |
| SEQ. ID. NO. 26566 | 199-SerValGluAspAlaValArgPheValLysAspThrGlyVal-212 |
| SEQ. ID. NO. 26567 | 235-AspValLeuArgIleAspArgIleLysGluIleHis-246 |
| SEQ. ID. NO. 26568 | 287-GluIleValGluGlyIleLysHisGlyValArgLysValAsnIleAspThrAspLeuArgLeu-307 |
| SEQ. ID. NO. 26569 | 320-AsnProSerAspPheAspProArgLysTyrLeu-330 |

TABLE 1-continued

| | |
|---|---|
| SEQ. ID. NO. 26570 | 333-ThrIleGluAlaMetLys-338 |
| SEQ. ID. NO. 26571 | 352-GlyGlnAlaGlyLysIleLysProValSerLeuGluLysMetAlaSerArgTyrAlaLysGlyGluLeu-374 | g036
AMPHI Regions - AMPHI

| | |
|---|---|
| SEQ. ID. NO. 26572 | 59-SerSerGlyArgPheCysGlnThrIleLysAlaAla-70 |
| SEQ. ID. NO. 26573 | 97-AlaAspGlyLeuGlnThrValSerSerAlaAla-107 |
| SEQ. ID. NO. 26574 | 142-AlaValArgArgValProArgGlnLeuArgAspSerArg-154 |
| SEQ. ID. NO. 26575 | 215-CysArgThrThrHisLysThrLeuArgProTyrAlaArgProGlnArgArg-231 |

Antigenic Index - Jameson-Wolf

| | |
|---|---|
| SEQ. ID. NO. 26576 | 16-ProAlaArgThrSerSerSerArgArgCysValProSerGlyArgCys-31 |
| SEQ. ID. NO. 26577 | 35-TyrSerSerArgAlaAspAlaThrProArgArgArgHisSerGlyAlaVal-51 |
| SEQ. ID. NO. 26578 | 55-CysSerSerAspSerSerGlyArgPhe-63 |
| SEQ. ID. NO. 26579 | 74-SerPheSerAlaArgLysThrCysSerAspGlyGluThrSerAlaAspSerAsnTrpArg-93 |
| SEQ. ID. NO. 26580 | 109-AlaAlaGlnSerAspGlyGluAlaGlyArg-118 |
| SEQ. ID. NO. 26581 | 133-SerGlyArgPheCysCysGlyArgArgAlaValArgArgValProArgGlnLeuArgAspSerArgArgArgGlyArgAlaArgGluAsnArgArgArgSerAlaTyr-168 |
| SEQ. ID. NO. 26582 | 171-CysLeuArgArgAlaAspGlyPheProVal-180 |
| SEQ. ID. NO. 26583 | 182-ThrHisCysArgCysArgLeuLysArgArgThrProArgGlyGlyGlnCys-198 |
| SEQ. ID. NO. 26584 | 200-ProProTyrArgLeuAspAsnArgSerAsnGlyGlyGlySerAlaCysArgThrThrHisLysThrLeuArgProTyrAlaArgProGlnArgArgValCysSer-234 |
| SEQ. ID. NO. 26585 | 239-AlaAlaArgArgArgHisArgAlaTrpGlyCysArgLeuLysAlaCysArg-255 |
| SEQ. ID. NO. 26586 | 258-LeuProAsnLeuAlaProArgArgCysArgTyrAlaVal-270 |

Hydrophilic Regions - Hopp-Woods

| | |
|---|---|
| SEQ. ID. NO. 26587 | 17-AlaArgThrSerSerSerArgArgCysValPro-27 |
| SEQ. ID. NO. 26588 | 37-SerArgAlaAspAlaThrProArgArgArgHisSerGly-49 |
| SEQ. ID. NO. 26589 | 55-CysSerSerAspSerSerGlyArg-62 |
| SEQ. ID. NO. 26590 | 76-SerAlaArgLysThrCysSerAspGlyGluThrSerAla-88 |
| SEQ. ID. NO. 26591 | 110-AlaGlnSerAspGlyGluAlaGlyArg-118 |
| SEQ. ID. NO. 26592 | 137-CysCysGlyArgArgAlaValArgArgValProArgGlnLeuArgAspSerArgArgArgGlyArgAlaArgGluAsnArgArgArgSerAlaTyr-168 |
| SEQ. ID. NO. 26593 | 171-CysLeuArgArgAlaAspGlyPhePro-179 |
| SEQ. ID. NO. 26594 | 182-ThrHisCysArgCysArgLeuLysArgArgThrProArgGlyGlyGln-197 |
| SEQ. ID. NO. 26595 | 202-TyrArgLeuAspAsnArgSerAsnGlyGly-211 |
| SEQ. ID. NO. 26596 | 213-SerAlaCysArgThrThrHisLysThrLeuArgProTyrAlaArgProGlnArgArgValCys-233 |
| SEQ. ID. NO. 26597 | 239-AlaAlaArgArgArgHisArgAlaTrp-247 |
| SEQ. ID. NO. 26598 | 251-LeuLysAlaCysArg-255 |
| SEQ. ID. NO. 26599 | 262-AlaProArgArgCysArgTyrAlaVal-270 | g038
AMPHI Regions - AMPHI

| | |
|---|---|
| SEQ. ID. NO. 26600 | 161-GlyLysLeuSerAlaValGlnGluValGluLys-171 |
| SEQ. ID. NO. 26601 | 178-AlaProIleAlaSerLeuAsn-184 |
| SEQ. ID. NO. 26602 | 195-GluPheGlyGlnPheLeuGluProValArgThrTyrArgArgGlnTyrGlyVal-212 |

Antigenic Index - Jameson-Wolf

| | |
|---|---|
| SEQ. ID. NO. 26603 | 2-ThrAspPheArgGlnAspPhe-8 |
| SEQ. ID. NO. 26604 | 22-GluPheThrThrLysAlaGlyArgArgSerPro-32 |
| SEQ. ID. NO. 26605 | 38-GlyLeuPheAsnAspGlyAlaSer-45 |
| SEQ. ID. NO. 26606 | 58-IleGluSerGlyIleArg-63 |
| SEQ. ID. NO. 26607 | 85-LeuAlaGluLysGlyVal-90 |
| SEQ. ID. NO. 26608 | 96-TyrAsnArgLysGluAlaLysAspArgGlyGluGlyGlyVal-109 |
| SEQ. ID. NO. 26609 | 125-ValIleSerAlaGlyThrSerValArgGluSerIleLysLeuIleGluAlaGluGlyAlaThr-145 |
| SEQ. ID. NO. 26610 | 153-LeuAspArgMetGluLysGlyThrGlyLysLeuSerAla-165 |
| SEQ. ID. NO. 26611 | 167-GlnGluValGluLysGlnTyrGlyLeu-175 |
| SEQ. ID. NO. 26612 | 191-GlnAsnAsnProGluPheGlyGln-198 |
| SEQ. ID. NO. 26613 | 201-GluProValArgThrTyrArgArgGlnTyrGlyValGlu-213 |

Hydrophilic Regions - Hopp-Woods

| | |
|---|---|
| SEQ. ID. NO. 26614 | 2-ThrAspPheArgGlnAspPhe-8 |
| SEQ. ID. NO. 26615 | 22-GluPheThrThrLysAlaGlyArgArgSer-31 |
| SEQ. ID. NO. 26616 | 85-LeuAlaGluLysGlyVal-90 |
| SEQ. ID. NO. 26617 | 96-TyrAsnArgLysGluAlaLysAspArgGlyGluGly-107 |
| SEQ. ID. NO. 26618 | 130-ThrSerValArgGluSerIleLysLeuIleGluAlaGluGlyAlaThr-145 |
| SEQ. ID. NO. 26619 | 153-LeuAspArgMetGluLysGlyThrGlyLys-162 |
| SEQ. ID. NO. 26620 | 167-GlnGluValGluLysGlnTyr-173 |
| SEQ. ID. NO. 26621 | 204-ArgThrTyrArgArgGlnTyrGly-211 | g040
AMPHI Regions - AMPHI

| | |
|---|---|
| SEQ. ID. NO. 26622 | 6-SerPheValAlaHisPhe-11 |
| SEQ. ID. NO. 26623 | 14-AlaAlaProTyrIleArgGlnMetArgGlyThr-24 |
| SEQ. ID. NO. 26624 | 38-GlyThrLeuAsnLysLeu-43 |
| SEQ. ID. NO. 26625 | 65-HisPheLeuAspArg-69 |
| SEQ. ID. NO. 26626 | 78-ProHisTyrCysArgGlyLeuArgValThrAspGluThr-90 |
| SEQ. ID. NO. 26627 | 95-AlaGlnGlnPheAlaGly-100 |
| SEQ. ID. NO. 26628 | 113-SerValSerGlyPheAlaArgAlaPro-121 |
| SEQ. ID. NO. 26629 | 136-MetGlyValIleAsp-140 |
| SEQ. ID. NO. 26630 | 146-TyrAlaGlyValIleArg-151 |
| SEQ. ID. NO. 26631 | 207-LeuSerAspGlyIleSerArgProAspGlyThrLeuAlaGlu-220 |
| SEQ. ID. NO. 26632 | 223-SerAlaGlnAlaGlnSerLeuAlaGluHisAla-234 |
| SEQ. ID. NO. 26633 | 244-SerAlaValAlaAlaLeuGluGly-251 |
| SEQ. ID. NO. 26634 | 277-IleGlyThrSerIle-281 |
| SEQ. ID. NO. 26635 | 289-IleArgGlnAlaHisSerGlyAspIleProHisIleAlaAlaLeuIleArgProLeuGlu-308 |
| SEQ. ID. NO. 26636 | 320-TyrLeuGluAsnHisIleSerGluPheSerIle-330 |
| SEQ. ID. NO. 26637 | 338-TyrGlyCysAlaAlaLeuLysThrPheAlaGluAlaAsp-350 |

TABLE 1-continued

| | |
|---|---|
| SEQ. ID. NO. 26638 | 371-ArgLeuLeuAlaHisIle-376 |
| SEQ. ID. NO. 26639 | 386-SerArgLeuPheAla-390 |

Antigenic Index - Jameson-Wolf

| | |
|---|---|
| SEQ. ID. NO. 26640 | 2-AsnAlaProAspSer-6 |
| SEQ. ID. NO. 26641 | 11-PheArgGluAlaAlaProTyrIleArgGlnMetArgGlyThrThr-25 |
| SEQ. ID. NO. 26642 | 29-GlyIleAspGlyArgLeuLeuGluGlyGlyThr-39 |
| SEQ. ID. NO. 26643 | 74-GlnGlyArgThrProHisTyrCysArgGlyLeuArgValThrAspGluThrSerLeuGlyGln-94 |
| SEQ. ID. NO. 26644 | 101-ThrValArgSerArgPheGlu-107 |
| SEQ. ID. NO. 26645 | 119-ArgAlaProSerVal-123 |
| SEQ. ID. NO. 26646 | 134-ArgProMetGlyVal-138 |
| SEQ. ID. NO. 26647 | 140-AspGlyThrAspMetGluTyr-146 |
| SEQ. ID. NO. 26648 | 150-IleArgLysThrAspThrAlaAla-157 |
| SEQ. ID. NO. 26649 | 162-LeuAspAlaGlyAsn-166 |
| SEQ. ID. NO. 26650 | 173-LeuGlyHisSerTyrGlyGlyLysThrPheAsn-183 |
| SEQ. ID. NO. 26651 | 208-SerAspGlyIleSerArgProAspGlyThrLeuAla-219 |
| SEQ. ID. NO. 26652 | 222-LeuSerAlaGlnGluAlaGlnSerLeuAla-231 |
| SEQ. ID. NO. 26653 | 234-AlaAlaSerGluThrArgArgLeuIle-242 |
| SEQ. ID. NO. 26654 | 249-LeuGluGlyGlyVal-253 |
| SEQ. ID. NO. 26655 | 261-GlyAlaAlaAspGlySerLeuLeu-268 |
| SEQ. ID. NO. 26656 | 272-PheThrArgAsnGlyIleGlyThrSerIleAlaLysGluAla-285 |
| SEQ. ID. NO. 26657 | 290-ArgGlnAlaHisSerGlyAspIle-297 |
| SEQ. ID. NO. 26658 | 305-ArgProLeuGluGluGlnGly-311 |
| SEQ. ID. NO. 26659 | 315-HisArgSerArgGluTyrLeu-321 |
| SEQ. ID. NO. 26660 | 329-SerIleLeuGluHisAspGlyAspLeuTyr-338 |
| SEQ. ID. NO. 26661 | 345-ThrPheAlaGluAlaAspCysGlyGlu-353 |
| SEQ. ID. NO. 26662 | 361-ProGlnAlaGlnAspGlyGlyTyrGlyGluArgLeu-372 |
| SEQ. ID. NO. 26663 | 377-IleAspLysAlaArgGly-382 |
| SEQ. ID. NO. 26664 | 393-ThrAsnThrGlyGlu-397 |
| SEQ. ID. NO. 26665 | 402-ArgGlyPheGlnThrAlaSerGluAspGluLeuProGluThrArgArgLysAspTyrArgSerAsnGlyArgAsnProHisIleLeu-430 |

Hydrophilic Regions - Hopp-Woods

| | |
|---|---|
| SEQ. ID. NO. 26666 | 11-PheArgGluAlaAlaPro-16 |
| SEQ. ID. NO. 26667 | 30-IleAspGlyArgLeuLeuGlu-36 |
| SEQ. ID. NO. 26668 | 84-LeuArgValThrAspGluThrSerLeu-92 |
| SEQ. ID. NO. 26669 | 102-ValArgSerArgPheGlu-107 |
| SEQ. ID. NO. 26670 | 140-AspGlyThrAspMetGluTyr-146 |
| SEQ. ID. NO. 26671 | 150-IleArgLysThrAspThrAlaAla-157 |
| SEQ. ID. NO. 26672 | 210-GlyIleSerArgProAspGlyThrLeu-218 |
| SEQ. ID. NO. 26673 | 222-LeuSerAlaGlnGluAlaGlnSerLeuAla-231 |
| SEQ. ID. NO. 26674 | 234-AlaAlaSerGluThrArgArgLeuIle-242 |
| SEQ. ID. NO. 26675 | 291-GlnAlaHisSerGlyAsp-296 |
| SEQ. ID. NO. 26676 | 305-ArgProLeuGluGluGlnGly-311 |
| SEQ. ID. NO. 26677 | 315-HisArgSerArgGluTyrLeu-321 |
| SEQ. ID. NO. 26678 | 332-GluHisAspGlyAspLeu-337 |
| SEQ. ID. NO. 26679 | 345-ThrPheAlaGluAlaAspCysGlyGlu-353 |
| SEQ. ID. NO. 26680 | 362-GlnAlaGlnAspGlyGlyTyrGlyGlu-370 |
| SEQ. ID. NO. 26681 | 377-IleAspLysAlaArgGly-382 |
| SEQ. ID. NO. 26682 | 402-ArgGlyPheGlnThrAlaSerGluAspGluLeuProGluThrArgArgLysAspTyrArgSerAsnGlyArgAsn-426 | g041-1
AMPHI Regions - AMPHI

| | |
|---|---|
| SEQ. ID. NO. 26683 | 6-AspProTyrArgHisPheGluAsnLeuAspSerAlaGluThr-19 |
| SEQ. ID. NO. 26684 | 45-AspGlyIleLeuAsnGlnMetGlnAsp-53 |
| SEQ. ID. NO. 26685 | 77-ProLysGlyValTyrArgMetCysThrAlaAla-87 |
| SEQ. ID. NO. 26686 | 102-ValAlaAspPheAspGluLeuLeu-109 |
| SEQ. ID. NO. 26687 | 117-GlyValSerHisLeuValGlnProAsn-126 |
| SEQ. ID. NO. 26688 | 218-MetValAsnAlaTrpArgTyrLeuAsp-226 |
| SEQ. ID. NO. 26689 | 232-IleAspLeuIleGluAlaSer-238 |
| SEQ. ID. NO. 26690 | 257-ProLeuAsnLeuProAsnAspCysAspValValGlyTyrLeu-270 |
| SEQ. ID. NO. 26691 | 317-GlnAlaLeuGluSerValGluThr-324 |
| SEQ. ID. NO. 26692 | 331-AlaSerLeuLeuGluAsnValGlnGlyArg-340 |
| SEQ. ID. NO. 26693 | 382-AspPheThrThrProLeu-387 |
| SEQ. ID. NO. 26694 | 451-GlyPheGlyIleProGluLeuProHisTyrLeuGlySerValGlyLys-466 |
| SEQ. ID. NO. 26695 | 493-AlaAlaGlnGlyIleSerLysHisLysSerValAspAspLeuLeuAlaValValArgAspLeuSerGluArg-516 |
| SEQ. ID. NO. 26696 | 519-SerSerProLysHis-523 |
| SEQ. ID. NO. 26697 | 541-ValArgGluProGlnSer-546 |
| SEQ. ID. NO. 26698 | 556-LeuThrAspMetIleArgTyr-562 |
| SEQ. ID. NO. 26699 | 571-TrpThrAspGluTyrGlyAsnProGlnLysTyrGluAlaCysLysArgArgLeuGly-589 |
| SEQ. ID. NO. 26700 | 591-LeuSerProTyrHisAsnLeuSerAspGlyIleAspTyrProPro-605 |
| SEQ. ID. NO. 26701 | 620-AlaHisAlaLeuLys-624 |
| SEQ. ID. NO. 26702 | 645-GlyHisThrGlyAsn-649 |
| SEQ. ID. NO. 26703 | 651-ThrGlnArgGluSer-655 |

Antigenic Index - Jameson-Wolf

| | |
|---|---|
| SEQ. ID. NO. 26704 | 1-MetLysSerTyrProAspProTyrArgHisPheGluAsnLeuAspSerAlaGluThrGln-20 |
| SEQ. ID. NO. 26705 | 26-AlaAsnAlaGluThrArgAlaArgPheLeuAsnAsnAspLysAlaArgAlaLeuSerAspGlyIle-47 |
| SEQ. ID. NO. 26706 | 51-MetGlnAspThrArgGlnIleProPhe-59 |
| SEQ. ID. NO. 26707 | 61-GlnGluHisArgAlaArg-66 |
| SEQ. ID. NO. 26708 | 72-GlnAsnAlaGluTyrProLysGlyVal-80 |
| SEQ. ID. NO. 26709 | 89-TyrArgSerGlyTyrProGluTrp-96 |
| SEQ. ID. NO. 26710 | 104-AspPheAspGluLeuLeuGlyAspAspValTyr-114 |
| SEQ. ID. NO. 26711 | 123-GluGlnProAsnArg-127 |
| SEQ. ID. NO. 26712 | 132-LeuAsnLysSerGlyGlyAspThr-139 |

TABLE 1-continued

| SEQ. ID. NO. 26713 | 145-ValAspLeuGluAlaGlyGluLeuValGlu-154 |
| SEQ. ID. NO. 26714 | 161-AlaGlyLysAsnHisValSerTrpArgAspGluAsnSerVal-174 |
| SEQ. ID. NO. 26715 | 178-ProAlaTrpAspGluArgGlnLeuThrGluSerGlyTyrProArgGluValTrpLeuValGluArgGlyLysSerPheGluGluSerLeuPro-208 |
| SEQ. ID. NO. 26716 | 211-GlnIleAspLysGlyAla-216 |
| SEQ. ID. NO. 26717 | 223-ArgTyrLeuAspProGlnGlySerProIleAspLeuIleGluAlaSerAspGlyPheTyr-242 |
| SEQ. ID. NO. 26718 | 249-ValSerSerGluGlyGlyAlaLysProLeuAsnLeuProAsnAspCysAspVal-266 |
| SEQ. ID. NO. 26719 | 278-LeuArgLysAspTrpHisArgAlaAsnGlnSerTyrProSer-291 |
| SEQ. ID. NO. 26720 | 298-LysLeuAsnArgGlyGluLeuGly-305 |
| SEQ. ID. NO. 26721 | 313-ProAspGluThrGlnAla-318 |
| SEQ. ID. NO. 26722 | 320-GluSerValGluThrThrLys-326 |
| SEQ. ID. NO. 26723 | 337-ValGlnGlyArgLeuLysAla-343 |
| SEQ. ID. NO. 26724 | 345-ArgPheAlaAspSerLysTrpGlnGluAlaGluLeuProHisLeuProSerGly-362 |
| SEQ. ID. NO. 26725 | 365-GluMetThrAspGlnProTrpGlyGly-373 |
| SEQ. ID. NO. 26726 | 405-GlnProGlnGlnPheValSerAspGlyIleGluVal-416 |
| SEQ. ID. NO. 26727 | 422-ValSerSerAspGlyGluArgIle-429 |
| SEQ. ID. NO. 26728 | 435-GlyLysAsnAlaAlaProAspThr-442 |
| SEQ. ID. NO. 26729 | 479-AsnIleArgGlyGlyGlyGluPheGlyProArgTrpHis-491 |
| SEQ. ID. NO. 26730 | 496-GlyIleSerLysHisLysSerValAspAsp-505 |
| SEQ. ID. NO. 26731 | 511-ArgAspLeuSerGluArgGlyMetSerSerProLysHis-523 |
| SEQ. ID. NO. 26732 | 528-GlyGlySerAsnGly-532 |
| SEQ. ID. NO. 26733 | 540-PheValArgGluProGlnSerIleGlyAla-549 |
| SEQ. ID. NO. 26734 | 568-GlySerSerTrpThrAspGluTyrGlyAsnProGlnLysTyrGluAlaCysLysArgArgLeuGlyGluLeuSerProTyr-594 |
| SEQ. ID. NO. 26735 | 596-AsnLeuSerAspGlyIleAspTyrPro-604 |
| SEQ. ID. NO. 26736 | 610-ThrSerLeuSerAspAspArgValHis-618 |
| SEQ. ID. NO. 26737 | 627-AlaLysLeuArgGluThrSerProGlnSer-636 |
| SEQ. ID. NO. 26738 | 639-TyrSerProAspGlyGlyGlyHisThrGlyAsnGlyThrGlnArgGluSerAlaAspLysLeu-659 |

Hydrophilic Regions - Hopp-Woods

| SEQ. ID. NO. 26739 | 3-SerTyrProAspProTyrArgHis-10 |
| SEQ. ID. NO. 26740 | 12-GluAsnLeuAspSerAlaGluThr-19 |
| SEQ. ID. NO. 26741 | 26-AlaAsnAlaGluThrArgAlaArgPheLeuAsnAsnAspLysAlaArgAlaLeuSer-44 |
| SEQ. ID. NO. 26742 | 51-MetGlnAspThrArgGln-56 |
| SEQ. ID. NO. 26743 | 61-GlnGluHisArgAlaArg-66 |
| SEQ. ID. NO. 26744 | 104-AspPheAspGluLeuLeuGly-110 |
| SEQ. ID. NO. 26745 | 134-LysSerGlyGlyAsp-138 |
| SEQ. ID. NO. 26746 | 145-ValAspLeuGluAlaGlyGluLeuValGlu-154 |
| SEQ. ID. NO. 26747 | 166-ValSerTrpArgAspGluAsnSer-173 |
| SEQ. ID. NO. 26748 | 180-TrpAspGluArgGlnLeuThr-186 |
| SEQ. ID. NO. 26749 | 198-GluArgGlyLysSerPheGluGluSerLeu-207 |
| SEQ. ID. NO. 26750 | 211-GlnIleAspLysGlyAla-216 |
| SEQ. ID. NO. 26751 | 233-AspLeuIleGluAlaSerAsp-239 |
| SEQ. ID. NO. 26752 | 250-SerSerGluGlyGlyAlaLys-256 |
| SEQ. ID. NO. 26753 | 278-LeuArgLysAspTrpHisArg-284 |
| SEQ. ID. NO. 26754 | 298-LysLeuAsnArgGlyGluLeuGly-305 |
| SEQ. ID. NO. 26755 | 313-ProAspGluThrGlnAla-318 |
| SEQ. ID. NO. 26756 | 320-GluSerValGluThrThrLys-326 |
| SEQ. ID. NO. 26757 | 337-ValGlnGlyArgLeuLysAla-343 |
| SEQ. ID. NO. 26758 | 347-AlaAspSerLysTrpGlnGluAlaGluLeu-356 |
| SEQ. ID. NO. 26759 | 412-AspGlyIleGluVal-416 |
| SEQ. ID. NO. 26760 | 424-SerAspGlyGluArg-428 |
| SEQ. ID. NO. 26761 | 436-LysAsnAlaAlaProAsp-441 |
| SEQ. ID. NO. 26762 | 481-ArgGlyGlyGlyGluPheGly-487 |
| SEQ. ID. NO. 26763 | 496-GlyIleSerLysHisLysSerValAspAsp-505 |
| SEQ. ID. NO. 26764 | 511-ArgAspLeuSerGluArgGlyMetSerSer-520 |
| SEQ. ID. NO. 26765 | 540-PheValArgGluProGlnSer-546 |
| SEQ. ID. NO. 26766 | 571-TrpThrAspGluTyrGlyAsn-577 |
| SEQ. ID. NO. 26767 | 579-GlnLysTyrGluAlaCysLysArgArgLeuGlyGlu-590 |
| SEQ. ID. NO. 26768 | 612-LeuSerAspAspArgValHis-618 |
| SEQ. ID. NO. 26769 | 627-AlaLysLeuArgGluThrSer-633 |
| SEQ. ID. NO. 26770 | 650-GlyThrGlnArgGluSerAlaAspLysLeu-659 | g042
AMPHI Regions - AMPHI

| SEQ. ID. NO. 26771 | 18-LeuSerAsnThrSerThr-23 |
| SEQ. ID. NO. 26772 | 33-AlaValArgSerMet-37 |
| SEQ. ID. NO. 26773 | 138-SerProLeuValArgIleLeuProLeuSer-147 |
| SEQ. ID. NO. 26774 | 151-SerMetValValAlaPhePheAlaAsn-159 |

Antigenic Index - Jameson-Wolf

| SEQ. ID. NO. 26775 | 16-SerAlaLeuSerAsnThrSerThrAlaAlaGlyProSerCys-29 |
| SEQ. ID. NO. 26776 | 49-TyrSerLysGluThrGlyCysProCysProSerLeuArgLysAspSerSerThrGlyGlyArgProMetSerProCys-74 |
| SEQ. ID. NO. 26777 | 77-LeuAlaAsnArgAspCysValProLysAlaAspThr-88 |
| SEQ. ID. NO. 26778 | 93-ThrAspSerThrSerProArgProLeu-101 |
| SEQ. ID. NO. 26779 | 109-TrpAlaAsnSerAlaSer-114 |
| SEQ. ID. NO. 26780 | 120-SerAlaThrArgAlaSerLeuProLysIleArgAspArgVal-133 |
| SEQ. ID. NO. 26781 | 160-CysSerTyrAlaSerAlaProGlyPro-168 |
| SEQ. ID. NO. 26782 | 175-GlyLeuTrpArgCysArgAspSerGlnSerGlySerAsnSer-188 |
| SEQ. ID. NO. 26783 | 197-AsnAlaGlyCysLys-201 |

Hydrophilic Regions - Hopp-Woods

| SEQ. ID. NO. 26784 | 49-TyrSerLysGluThrGlyCys-55 |
| SEQ. ID. NO. 26785 | 59-SerLeuArgLysAspSerSerThrGlyGlyArgProMet-71 |
| SEQ. ID. NO. 26786 | 78-AlaAsnArgAspCysValProLysAlaAspThr-88 |
| SEQ. ID. NO. 26787 | 94-AspSerThrSerProArg-99 |

TABLE 1-continued

| SEQ. ID. NO. 26788 | 122-ThrArgAlaSerLeuProLysIleArgAspArgVal-133 |
| SEQ. ID. NO. 26789 | 178-ArgCysArgAspSerGlnSerGly-185 | g043-2
AMPHI Regions - AMPHI
SEQ. ID. NO. 26790  21-GluArgPheValGluProSerArg-28
SEQ. ID. NO. 26791  34-LysValHisArgGlyLeuAspGlyAlaAlaArgPheAspGluGlyGluArg-50
SEQ. ID. NO. 26792  59-AlaSerGlyAspGlyPhe-64
SEQ. ID. NO. 26793  81-AspAlaAlaGlyAspPheGlyAspGlyGlnArg-91
SEQ. ID. NO. 26794  98-GlnAsnIleGlyGlyPheValTyr-105
Antigenic Index - Jameson-Wolf
SEQ. ID. NO. 26795  1-MetProSerAlaPro-5
SEQ. ID. NO. 26796  12-ArgArgGlnLysSerValMetProProGluArgPheValGluProSerArg-28
SEQ. ID. NO. 26797  34-LysValHisArgGlyLeuAspGlyAlaAlaArgPheAspGluGlyGluArgValPhe-52
SEQ. ID. NO. 26798  56-AlaAlaGlnAlaSerGlyAspGlyPheAla-65
SEQ. ID. NO. 26799  79-GlnProAspAlaAlaGlyAspPheGlyAspGlyGlnArgAlaGlyGlu-94
SEQ. ID. NO. 26800  116-AlaGluGlyGluAla-120
Hydrophilic Regions - Hopp-Woods
SEQ. ID. NO. 26801  12-ArgArgGlnLysSerValMetProProGluArgPheValGluProSerArg-28
SEQ. ID. NO. 26802  34-LysValHisArgGlyLeuAspGlyAlaAlaArgPheAspGluGlyGluArgValPhe-52
SEQ. ID. NO. 26803  81-AspAlaAlaGlyAspPheGlyAspGlyGlnArgAlaGlyGlu-94
SEQ. ID. NO. 26804  116-AlaGluGlyGluAla-120 g046
AMPHI Regions - AMPHI
SEQ. ID. NO. 26805  6-ArgProThrSerSerPro-11
SEQ. ID. NO. 26806  46-ThrSerCysSerGlyLeuMetValSer-54
SEQ. ID. NO. 26807  64-PheSerLeuPheSerSer-69
SEQ. ID. NO. 26808  113-LysSerAlaSerSer-117
SEQ. ID. NO. 26809  143-SerCysAsnAlaPheSerSer-149
Antigenic Index - Jameson-Wolf
SEQ. ID. NO. 26810  6-ArgProThrSerSerProProArgProArgAlaCys-16
SEQ. ID. NO. 26811  20-IleArgThrArgSerSerAlaLysArgLysThrCysAsnAlaProGlyGlnSerIleArgProAlaSerCysSer-44
SEQ. ID. NO. 26812  57-ProAsnMetGluArgLeuPro-63
SEQ. ID. NO. 26813  75-SerArgTyrSerLeuGluArgThrArgAlaMetArgProGlyMetLeuAsnArgSerAlaAla-95
SEQ. ID. NO. 26814  105-SerLeuArgGluSerAlaSerSerLysSerAlaSerSerAlaProAlaArgTyrAsnValLysGlyAspAlaProLeuPro-131
SEQ. ID. NO. 26815  133-ThrValTrpThrSerArgArgLeuProVal-142
SEQ. ID. NO. 26816  169-GluProThrCysProLeuProLys-176
Hydrophilic Regions - Hopp-Woods
SEQ. ID. NO. 26817  7-ProThrSerSerProProArgProArgAlaCys-16
SEQ. ID. NO. 26818  20-IleArgThrArgSerSerAlaLysArgLysThrCysAsn-32
SEQ. ID. NO. 26819  36-GlnSerIleArgProAlaSer-42
SEQ. ID. NO. 26820  58-AsnMetGluArgLeuPro-63
SEQ. ID. NO. 26821  75-SerArgTyrSerLeuGluArgThrArgAlaMetArg-86
SEQ. ID. NO. 26822  105-SerLeuArgGluSerAlaSerSerLysSerAlaSer-116
SEQ. ID. NO. 26823  122-TyrAsnValLysGlyAspAlaProLeu-130 g047
AMPHI Regions - AMPHI
SEQ. ID. NO. 26824  17-IleAlaAspIleAlaGlnAspLeuProAspGlyAla-28
SEQ. ID. NO. 26825  62-AlaGluAsnIleGlyAlaVal-68
SEQ. ID. NO. 26826  89-AsnIleCysTyrArgLeuAlaLysGlnLeuGlu-99
SEQ. ID. NO. 26827  141-TyrIleAspGluIleAspValPhe-148
SEQ. ID. NO. 26828  161-SerAlaLeuLeuAla-165
SEQ. ID. NO. 26829  185-LeuLeuGluGlyAsn-189
SEQ. ID. NO. 26830  202-IleGlySerIleLeuAla-207
SEQ. ID. NO. 26831  247-SerGlyIleLysTrpProGluGlyCys-255
SEQ. ID. NO. 26832  257-IleAlaAlaValValArgAlaGlyThrGly-266
SEQ. ID. NO. 26833  293-IleLeuAsnGluLeuGluLysLeuIle-301
Antigenic Index - Jameson-Wolf
SEQ. ID. NO. 26834  5-GlnAlaArgArgGlyGlyLeuLeu-12
SEQ. ID. NO. 26835  20-IleAlaGlnAspLeuProAspGlyAlaAsp-29
SEQ. ID. NO. 26836  36-TyrArgAsnAsnArgLeu-41
SEQ. ID. NO. 26837  51-IleGluGlyAspGlu-55
SEQ. ID. NO. 26838  70-ProGluLeuArgProLysGluThrSerThrArgArgIleMet-83
SEQ. ID. NO. 26839  96-LysGlnLeuGluHis-100
SEQ. ID. NO. 26840  106-IleIleGluCysArgProArgArgAlaGluTrpIle-117
SEQ. ID. NO. 26841  119-GluAsnLeuAspAsnThrLeu-125
SEQ. ID. NO. 26842  130-SerAlaThrAspGluThrLeuLeuAspAsnGluTyrIleAspGluIleAsp-146
SEQ. ID. NO. 26843  152-ThrAsnAspAspGluSerAsnIle-159
SEQ. ID. NO. 26844  168-LeuGlyAlaLysArgVal-173
SEQ. ID. NO. 26845  178-AsnArgSerSerTyr-182
SEQ. ID. NO. 26846  186-LeuGluGlyAsnLysIle-191
SEQ. ID. NO. 26847  208-HisIleArgArgGlyAspIleVal-215
SEQ. ID. NO. 26848  219-ProIleArgArgGlyThrAlaGluAlaIleGlu-229
SEQ. ID. NO. 26849  232-AlaHisGlyAspLysLysThrSer-239
SEQ. ID. NO. 26850  242-IleGlyArgArgIleSerGlyIleLysTrpProGluGlyCysHis-256
SEQ. ID. NO. 26851  262-ArgAlaGlyThrGlyGluThr-268
SEQ. ID. NO. 26852  277-ValIleGlnAspGlyAspHis-283
SEQ. ID. NO. 26853  288-ValSerArgArgArgIleLeuAsnGluLeuGluLys-299
Hydrophilic Regions - Hopp-Woods
SEQ. ID. NO. 26854  5-GlnAlaArgArgGlyGly-10
SEQ. ID. NO. 26855  20-IleAlaGlnAspLeuProAspGlyAlaAsp-29

TABLE 1-continued

| | |
|---|---|
| SEQ. ID. NO. 26856 | 51-IleGluGlyAspGlu-55 |
| SEQ. ID. NO. 26857 | 70-ProGluLeuArgProLysGluThrSerThrArgArgIleMet-83 |
| SEQ. ID. NO. 26858 | 106-IleIleGluCysArgProArgArgAlaGluTrpIle-117 |
| SEQ. ID. NO. 26859 | 130-SerAlaThrAspGluThrLeuLeu-137 |
| SEQ. ID. NO. 26860 | 140-GluTyrIleAspGluIleAsp-146 |
| SEQ. ID. NO. 26861 | 152-ThrAsnAspAspGluSerAsnIle-159 |
| SEQ. ID. NO. 26862 | 168-LeuGlyAlaLysArgVal-173 |
| SEQ. ID. NO. 26863 | 186-LeuGluGlyAsnLysIle-191 |
| SEQ. ID. NO. 26864 | 209-IleArgArgGlyAspIle-214 |
| SEQ. ID. NO. 26865 | 219-ProIleArgArgGlyThrAlaGluAlaIleGlu-229 |
| SEQ. ID. NO. 26866 | 232-AlaHisGlyAspLysLysThrSer-239 |
| SEQ. ID. NO. 26867 | 242-IleGlyArgArgIleSer-247 |
| SEQ. ID. NO. 26868 | 277-ValIleGlnAspGlyAsp-282 |
| SEQ. ID. NO. 26869 | 289-SerArgArgArgIleLeuAsnGluLeuGluLys-299 |
| g049-2 | |
| AMPHI Regions - AMPHI | |
| SEQ. ID. NO. 26870 | 15-GlnHisLeuLeuGlu-19 |
| SEQ. ID. NO. 26871 | 34-AspHisAlaValAspGlyIleGlyGlnMet-43 |
| SEQ. ID. NO. 26872 | 50-GlnProPheGlyGln-54 |
| SEQ. ID. NO. 26873 | 61-GluHisPheAlaProValAspGlyPheArg-70 |
| SEQ. ID. NO. 26874 | 103-IleGlyValPheProAlaLeu-109 |
| SEQ. ID. NO. 26875 | 199-SerAspPheArgArg-203 |
| SEQ. ID. NO. 26876 | 217-AlaArgLeuThrGlnValPheGlnAlaPhePhe-227 |
| SEQ. ID. NO. 26877 | 241-ValLeuAsnLeuCysArgArgAla-248 |
| Antigenic Index - Jameson-Wolf | |
| SEQ. ID. NO. 26878 | 6-PheAspTyrArgThrArgLeu-12 |
| SEQ. ID. NO. 26879 | 21-IleSerLysGluArgHis-26 |
| SEQ. ID. NO. 26880 | 31-ArgArgThrAspHisAlaValAspGly-39 |
| SEQ. ID. NO. 26881 | 49-AspGlnProPheGly-53 |
| SEQ. ID. NO. 26882 | 64-AlaProValAspGlyPheArgValGlnAspIleAspLeuAspGlyHisGlnArgLeuPhe-83 |
| SEQ. ID. NO. 26883 | 90-PheArgAsnProValCysArgArgThrGlyPhe-100 |
| SEQ. ID. NO. 26884 | 122-GlyIleGluProAspSerProProArgPhe-131 |
| SEQ. ID. NO. 26885 | 135-PheArgAsnArgHisLeuGlnGlySerLeuArgVal-146 |
| SEQ. ID. NO. 26886 | 150-PheLeuLysAspAspHisArgValGly-158 |
| SEQ. ID. NO. 26887 | 199-SerAspPheArgArgPheGlyGlnArgHisIleGlyArgArgGlyIleHis-215 |
| SEQ. ID. NO. 26888 | 244-LeuCysArgArgAlaAsnProArgProLysArgSerLeu-256 |
| Hydrophilic Regions - Hopp-Woods | |
| SEQ. ID. NO. 26889 | 21-IleSerLysGluArgHis-26 |
| SEQ. ID. NO. 26890 | 31-ArgArgThrAspHisAlaVal-37 |
| SEQ. ID. NO. 26891 | 67-AspGlyPheArgValGlnAspIleAspLeuAspGlyHisGlnArgLeuPhe-83 |
| SEQ. ID. NO. 26892 | 93-ProValCysArgArgThrGlyPhe-100 |
| SEQ. ID. NO. 26893 | 124-GluProAspSerProProArg-130 |
| SEQ. ID. NO. 26894 | 150-PheLeuLysAspAspHisArgVal-157 |
| SEQ. ID. NO. 26895 | 200-AspPheArgArgPheGlyGln-206 |
| SEQ. ID. NO. 26896 | 208-HisIleGlyArgArgGlyIleHis-215 |
| SEQ. ID. NO. 26897 | 244-LeuCysArgArgAlaAsnProArgProLysArgSerLeu-256 |
| g050-1 | |
| AMPHI Regions - AMPHI | |
| SEQ. ID. NO. 26898 | 10-IleGlnSerIleCysAspAlaPheGlnPheIleSerTyrTyr-23 |
| SEQ. ID. NO. 26899 | 25-ProLysAspTyrIleAspAlaLeuTyrLysAlaTrpGlnLys-38 |
| SEQ. ID. NO. 26900 | 94-ValAsnGluGlyVal-98 |
| SEQ. ID. NO. 26901 | 163-AsnProSerAspAsnIleValAspTrpValLeuLys-174 |
| SEQ. ID. NO. 26902 | 177-ProThrMetGlyAla-181 |
| SEQ. ID. NO. 26903 | 235-LeuGluLeuPheGluLysValAsnAla-243 |
| SEQ. ID. NO. 26904 | 250-GlyLeuGlyGlyLeuThrThr-256 |
| SEQ. ID. NO. 26905 | 275-AlaMetIleProAsn-279 |
| SEQ. ID. NO. 26906 | 315-AsnGlyLysArgValAspValAsp-322 |
| SEQ. ID. NO. 26907 | 353-LysArgLeuValAsMetLeuAspLys-361 |
| SEQ. ID. NO. 26908 | 367-ValAspPheThrAsnArgLeu-373 |
| SEQ. ID. NO. 26909 | 379-ProValAspProValGlyAspGlu-386 |
| SEQ. ID. NO. 26910 | 396-AlaThrArgMetAspLysPheThrArgGlnMet-406 |
| SEQ. ID. NO. 26911 | 452-LysSerSerLysValLeuAlaPhe-459 |
| SEQ. ID. NO. 26912 | 490-AlaThrAlaProArgLysTrp-496 |
| Antigenic Index - Jameson-Wolf | |
| SEQ. ID. NO. 26913 | 4-IleLysGlnGluAspPheIle-10 |
| SEQ. ID. NO. 26914 | 23-TyrHisProLysAspTyrIleAspAlaLeu-32 |
| SEQ. ID. NO. 26915 | 36-TrpGlnLysGluGluAsnProAlaAlaLysAspAlaMet-48 |
| SEQ. ID. NO. 26916 | 55-SerArgMetCysAlaGluAsnAsnArgProIleCysGlnAspThrGly-70 |
| SEQ. ID. NO. 26917 | 88-MetSerValGluLysMetValAsnGluGlyValArgArgAlaTyrThrTrpGluGlyAsnThrLeuArgAlaSerVal-113 |
| SEQ. ID. NO. 26918 | 116-AspProAlaGlyLysArgGlnAsnThrLysAspAsnThr-128 |
| SEQ. ID. NO. 26919 | 138-ProGlyGlyLysValGluVal-144 |
| SEQ. ID. NO. 26920 | 148-AlaLysGlyGlyGlySerGlyAsnLysSerLysLeu-159 |
| SEQ. ID. NO. 26921 | 163-AsnProSerAspAsnIle-168 |
| SEQ. ID. NO. 26922 | 192-GlyIleGlyGlyThrProGluLysAlaValLeuMetAlaLysGluSerLeu-208 |
| SEQ. ID. NO. 26923 | 213-AspIleGlnGluLeuGlnGluLysAlaAlaSerGlyAlaGluLeuSerThr-229 |
| SEQ. ID. NO. 26924 | 284-ArgHisValGluPheGluLeuAspGlySerGlyProValGluLeuThrProProArgValGluAspXxxProAspLeuThrTyrSerProAsp<br>AsnGlyLysArgValAspValAspLysLeuThrLysGluGluValAlaSer |
| SEQ. ID. NO. 26925 | LysThrGlyAsp-336 |
| SEQ. ID. NO. 26926 | 345-LeuThrGlyArgAspAlaAlaHisLysArgLeu-355 |
| SEQ. ID. NO. 26927 | 359-LeuAspLysGlyGluGluLeuPro-366 |

TABLE 1-continued

| | |
|---|---|
| SEQ. ID. NO. 26928 | 379-ProValAspProValGlyAspGluValValGlyProAlaGlyProThrThrAlaThrArgMetAspLysPheThrArgGlnMetLeu-407 |
| SEQ. ID. NO. 26929 | 416-IleGlyLysSerGluArgGlyAlaAlaThr-425 |
| SEQ. ID. NO. 26930 | 428-AlaIleAlaAspAsnLysAla-434 |
| SEQ. ID. NO. 26931 | 450-AlaIleLysSerSerLys-455 |
| SEQ. ID. NO. 26932 | 470-PheGluValLysAspMetPro-476 |
| SEQ. ID. NO. 26933 | 481-ValAspSerLysGlyGluSerIle-488 |
| SEQ. ID. NO. 26934 | 492-AlaProArgLysTrpGlnAla-498 |

Hydrophilic Regions - Hopp-Woods

| | |
|---|---|
| SEQ. ID. NO. 26935 | 4-IleLysGlnGluAspPheIle-10 |
| SEQ. ID. NO. 26936 | 36-TrpGlnLysGluGluAsnProAlaAlaLysAspAlaMet-48 |
| SEQ. ID. NO. 26937 | 57-MetCysAlaGluAsnAsnArgProIleCys-66 |
| SEQ. ID. NO. 26938 | 88-MetSerValGluLysMetValAsnGluGlyValArgArg-100 |
| SEQ. ID. NO. 26939 | 117-ProAlaGlyLysArgGlnAsnThrLysAspAsnThr-128 |
| SEQ. ID. NO. 26940 | 140-GlyLysValGluVal-144 |
| SEQ. ID. NO. 26941 | 148-AlaLysGlyGlyGlySerGluAsnLysSerLysLeu-159 |
| SEQ. ID. NO. 26942 | 195-GlyThrProGluLysAlaValLeuMetAlaLysGluSerLeu-208 |
| SEQ. ID. NO. 26943 | 213-AspIleGlnGluLeuGlnGluLysAlaAlaSer-223 |
| SEQ. ID. NO. 26944 | 225-AlaGluLeuSerThr-229 |
| SEQ. ID. NO. 26945 | 284-ArgHisValGluPheGluLeuAspGly-292 |
| SEQ. ID. NO. 26946 | 299-ThrProProArgValGluAspXxxProAsp-308 |
| SEQ. ID. NO. 26947 | 313-ProAspAsnGlyLysArgValAspValAspLysLeuThrLysGluGluValAlaSer-331 |
| SEQ. ID. NO. 26948 | 345-LeuThrGlyArgAspAlaAlaHisLysArgLeu-355 |
| SEQ. ID. NO. 26949 | 359-LeuAspLysGlyGluGluLeuPro-366 |
| SEQ. ID. NO. 26950 | 382-ProValGlyAspGluValVal-388 |
| SEQ. ID. NO. 26951 | 397-ThrArgMetAspLysPheThrArgGlnMetLeu-407 |
| SEQ. ID. NO. 26952 | 417-GlyLysSerGluArgGlyAlaAlaThr-425 |
| SEQ. ID. NO. 26953 | 428-AlaIleAlaAspAsnLysAla-434 |
| SEQ. ID. NO. 26954 | 450-AlaIleLysSerSerLys-455 |
| SEQ. ID. NO. 26955 | 470-PheGluValLysAspMetPro-476 |
| SEQ. ID. NO. 26956 | 481-ValAspSerLysGlyGluSerIle-488 |
| SEQ. ID. NO. 26957 | 492-AlaProArgLysTrpGlnAla-498 | g052
AMPHI Regions - AMPHI

| | |
|---|---|
| SEQ. ID. NO. 26958 | 12-AlaProCysPheLysGlyCysGluProThrGlyAsp-23 |
| SEQ. ID. NO. 26959 | 41-AlaLysAlaSerLysSerAlaThrSerProLysGlyLeuAspGlyValSerLys-58 |
| SEQ. ID. NO. 26960 | 67-ThrAlaAlaPheHisSerPheIleSer-75 |
| SEQ. ID. NO. 26961 | 84-MetProAsnLeuValThrMetLeu-91 |

Antigenic Index - Jameson-Wolf

| | |
|---|---|
| SEQ. ID. NO. 26962 | 4-ValAlaGluGluThrGluIle-10 |
| SEQ. ID. NO. 26963 | 14-CysPheLysGlyCysGluProThrGlyAspSerArgLeuLeuSerThrThrLysSerAlaPro-34 |
| SEQ. ID. NO. 26964 | 37-CysAlaAsnSerAlaLysAlaSerLysSerAlaThrSerProLysGlyLeuAspGlyValSerLysAsnSerSer-61 |
| SEQ. ID. NO. 26965 | 75-SerValGlyAspThrArgLeuThrProMet-84 |
| SEQ. ID. NO. 26966 | 97-ValValProAsnArgLeuArgLeuGluThrThrTrpSerProAlaCysArgLysValLysAsnAlaAla-119 |

Hydrophilic Regions - Hopp-Woods

| | |
|---|---|
| SEQ. ID. NO. 26967 | 4-ValAlaGluGluThrGluIle-10 |
| SEQ. ID. NO. 26968 | 16-LysGlyCysGluProThrGlyAspSerArgLeu-26 |
| SEQ. ID. NO. 26969 | 30-ThrLysSerAlaPro-34 |
| SEQ. ID. NO. 26970 | 39-AsnSerAlaLysAlaSerLysSerAlaThrSerProLysGlyLeuAspGlyValSerLysAsnSer-60 |
| SEQ. ID. NO. 26971 | 77-GlyAspThrArgLeu-81 |
| SEQ. ID. NO. 26972 | 100-AsnArgLeuArgLeu-104 |
| SEQ. ID. NO. 26973 | 111-AlaCysArgLysValLysAsnAlaAla-119 | g075-2
AMPHI Regions - AMPHI

| | |
|---|---|
| SEQ. ID. NO. 26974 | 15-LysSerAlaAlaLysThrProThrThrIleGlnProAlaSerIleProSer-31 |
| SEQ. ID. NO. 26975 | 65-AlaProTyrLeuArgGlnValLeu-72 |
| SEQ. ID. NO. 26976 | 80-PheLysLysCysLeuAla-85 |
| SEQ. ID. NO. 26977 | 92-PheArgArgProProAsn-97 |
| SEQ. ID. NO. 26978 | 114-ValAlaAspPhePheGlnThrCysValAsnArgPhePheGluValValGluIleIleGlyIleGly-135 |

Antigenic Index - Jameson-Wolf

| | |
|---|---|
| SEQ. ID. NO. 26979 | 12-GluAsnThrLysSerAlaAlaLysThrProThr-22 |
| SEQ. ID. NO. 26980 | 25-GlnProAlaSerIlePro-30 |
| SEQ. ID. NO. 26981 | 52-AlaLysAlaSerGly-56 |
| SEQ. ID. NO. 26982 | 90-GluPhePheArgArgProProAsnIleArgLysSerValPheGlnLysSerGluTyrAspLys-110 |

Hydrophilic Regions - Hopp-Woods

| | |
|---|---|
| SEQ. ID. NO. 26983 | 12-GluAsnThrLysSerAlaAlaLysThr-20 |
| SEQ. ID. NO. 26984 | 52-AlaLysAlaSerGly-56 |
| SEQ. ID. NO. 26985 | 90-GluPhePheArgArgProProAsnIleArgLysSerValPheGlnLysSerGluTyrAspLys-110 | g080-2
AMPHI Regions - AMPHI

| | |
|---|---|
| SEQ. ID. NO. 26986 | 6-GluAlaMetGluArgLeuThrArg-13 |
| SEQ. ID. NO. 26987 | 95-PheProAspThrValGlu-100 |
| SEQ. ID. NO. 26988 | 108-ProValAlaArgTrpGlyAspHis-115 |
| SEQ. ID. NO. 26989 | 144-SerAlaGluMetLeuArgArgTyrAspGluPheSerThrValLeu-158 |
| SEQ. ID. NO. 26990 | 195-LysArgLeuArgLeuPheThrGluAlaTrpGlnHis-206 |

Antigenic Index - Jameson-Wolf

| | |
|---|---|
| SEQ. ID. NO. 26991 | 1-MetTrpAspAsnAlaGluAlaMetGluArgLeuThr-12 |
| SEQ. ID. NO. 26992 | 33-AsnSerAsnHisLeuPro-38 |
| SEQ. ID. NO. 26993 | 42-ValSerLeuLysGly-46 |
| SEQ. ID. NO. 26994 | 50-TyrSerAspLysLysAlaLeu-56 |
| SEQ. ID. NO. 26995 | 67-AsnIleLeuArgThrAspIleAsnGlyAlaGlnGluAlaTyrArg-81 |

TABLE 1-continued

| SEQ. ID. NO. 26996 | 90-MetValArgArgArgPheProAspThrValGlu-100 |
| --- | --- |
| SEQ. ID. NO. 26997 | 103-LeuThrGluArgLysProValAlaArgTrpGly-113 |
| SEQ. ID. NO. 26998 | 116-AlaLeuValAspGlyGluGlyAsnValPhe-125 |
| SEQ. ID. NO. 26999 | 127-AlaArgLeuAspArgProGlyMetPro-135 |
| SEQ. ID. NO. 27000 | 138-ArgGlyAlaGluGlyThrSer-144 |
| SEQ. ID. NO. 27001 | 146-GluMetLeuArgArgTyrAspGlu-153 |
| SEQ. ID. NO. 27002 | 163-LeuGlyIleLysGlu-167 |
| SEQ. ID. NO. 27003 | 180-LeuAspAsnGlyIle-184 |
| SEQ. ID. NO. 27004 | 187-ArgLeuGlyArgGluAsnGluMetLysArgLeuArgLeu-199 |
| SEQ. ID. NO. 27005 | 207-LeuLeuArgLysAsnLysAsnArgLeuSer-216 |
| SEQ. ID. NO. 27006 | 220-MetArgTyrLysAspGlyPheSerVal-228 |
| SEQ. ID. NO. 27007 | 230-HisAlaProAspGlyLeuProGluLysGluSerGluGlu-242 |
| Hydrophilic Regions - Hopp-Woods | |
| SEQ. ID. NO. 27008 | 3-AspAsnAlaGluAlaMetGluArgLeuThr-12 |
| SEQ. ID. NO. 27009 | 50-TyrSerAspLysLysAlaLeu-56 |
| SEQ. ID. NO. 27010 | 69-LeuArgThrAspIleAsnGlyAlaGlnGluAlaTyrArg-81 |
| SEQ. ID. NO. 27011 | 90-MetValArgArgArgPheProAspThrVal-99 |
| SEQ. ID. NO. 27012 | 103-LeuThrGluArgLysProValAlaArgTrpGly-113 |
| SEQ. ID. NO. 27013 | 116-AlaLeuValAspGlyGluGlyAsnValPhe-125 |
| SEQ. ID. NO. 27014 | 127-AlaArgLeuAspArgProGly-133 |
| SEQ. ID. NO. 27015 | 138-ArgGlyAlaGluGlyThrSer-144 |
| SEQ. ID. NO. 27016 | 146-GluMetLeuArgArgTyrAspGlu-153 |
| SEQ. ID. NO. 27017 | 163-LeuGlyIleLysGlu-167 |
| SEQ. ID. NO. 27018 | 187-ArgLeuGlyArgGluAsnGluMetLysArgLeuArgLeu-199 |
| SEQ. ID. NO. 27019 | 208-LeuArgLysAsnLysAsnArgLeuSer-216 |
| SEQ. ID. NO. 27020 | 220-MetArgTyrLysAspGlyPheSer-227 |
| SEQ. ID. NO. 27021 | 230-HisAlaProAspGlyLeuProGluLysGluSerGluGlu-242 |
| g081 | |
| AMPHI Regions - AMPHI | |
| SEQ. ID. NO. 27022 | 22-LysProValSerArgIleValThrAspSerArgAspIleArg-35 |
| SEQ. ID. NO. 27023 | 54-ValGlyGlyValLeuSer-59 |
| SEQ. ID. NO. 27024 | 78-AlaLeuLysValAspAsp-83 |
| SEQ. ID. NO. 27025 | 85-LeuAlaAlaAlaLeuGlnThrLeuAlaLysAlaTrpArgAspAsn-98 |
| SEQ. ID. NO. 27026 | 116-LysGluMetLeuAlaAlaValLeuArg-124 |
| SEQ. ID. NO. 27027 | 130-AspAlaValSerAla-134 |
| SEQ. ID. NO. 27028 | 165-MetAsnHisPheGlyGluLeuAlaValLeuThrGlnIleAlaLys-179 |
| SEQ. ID. NO. 27029 | 186-AsnAsnAlaLeuArg-190 |
| SEQ. ID. NO. 27030 | 198-AspGlyValGlyAspIleAlaLysAla-206 |
| SEQ. ID. NO. 27031 | 303-LeuAsnAspValAlaGluGlyLeuGlnGlyPheSerAsn-315 |
| SEQ. ID. NO. 27032 | 345-AlaAlaValAspValLeuAlaArgMetPro-354 |
| SEQ. ID. NO. 27033 | 360-ValMetGlyAspMetGlyGluLeuGlyGlu-369 |
| SEQ. ID. NO. 27034 | 399-ValGluAlaAlaAlaGlu-403 |
| Antigenic Index - Jameson-Wolf | |
| SEQ. ID. NO. 27035 | 15-LeuProMetProSerGluAsnLysProValSer-25 |
| SEQ. ID. NO. 27036 | 27-IleValThrAspSerArgAspIleArgGluGlyAsp-38 |
| SEQ. ID. NO. 27037 | 44-AlaGlyGlyArgPheAspAla-50 |
| SEQ. ID. NO. 27038 | 67-ValSerArgGluAspCysAla-73 |
| SEQ. ID. NO. 27039 | 79-LeuLysValAspAspThrLeu-85 |
| SEQ. ID. NO. 27040 | 94-AlaTrpArgAspAsnValAsnProPhe-102 |
| SEQ. ID. NO. 27041 | 102-GlySerGlyGlyLysThrThrValLysGluMetLeu-119 |
| SEQ. ID. NO. 27042 | 123-LeuArgArgArgPheGlyAspAspAlaVal-132 |
| SEQ. ID. NO. 27043 | 138-AsnPheAsnAsnHisIle-143 |
| SEQ. ID. NO. 27044 | 151-LysLeuAsnGluLysHisArg-157 |
| SEQ. ID. NO. 27045 | 178-AlaLysProAspAla-182 |
| SEQ. ID. NO. 27046 | 194-GlyCysGlyPheAspGlyValGlyAspIleAlaLysAlaLysSerGluIle-210 |
| SEQ. ID. NO. 27047 | 223-ProGlnGluAspAlaAsn-228 |
| SEQ. ID. NO. 27048 | 245-GlyValAspSerGlyAspValArgAlaGluAsnIleVal-257 |
| SEQ. ID. NO. 27049 | 269-CysGlyAspGluArgThrAla-275 |
| SEQ. ID. NO. 27050 | 280-ValProGlyArgHisAsnVal-286 |
| SEQ. ID. NO. 27051 | 314-SerAsnIleLysGlyArgLeuAsnVal-322 |
| SEQ. ID. NO. 27052 | 330-ThrLeuIleAspAspThrTyrAsnAlaAsnProAspSerMetLysAlaAlaVal-347 |
| SEQ. ID. NO. 27053 | 363-AspMetGlyGluLeuGlyGluAspAlaAla-373 |
| SEQ. ID. NO. 27054 | 381-AlaTyrAlaArgAspGlnGlyIle-388 |
| SEQ. ID. NO. 27055 | 395-GlyAspAsnSerValGluAlaAlaGluLysPheGlyAla-407 |
| SEQ. ID. NO. 27056 | 425-AspLeuProGluArgAlaThrVal-432 |
| SEQ. ID. NO. 27057 | 434-ValLysGlySerArg-438 |
| SEQ. ID. NO. 27058 | 443-GluGluValValGluAlaLeuGluAspLys-452 |
| Hydrophilic Regions - Hopp-Woods | |
| SEQ. ID. NO. 27059 | 17-MetProSerGluAsnLysProValSer-25 |
| SEQ. ID. NO. 27060 | 27-IleValThrAspSerArgAspIleArgGluGlyAsp-38 |
| SEQ. ID. NO. 27061 | 46-GlyArgPheAspAla-50 |
| SEQ. ID. NO. 27062 | 67-ValSerArgGluAspCysAla-73 |
| SEQ. ID. NO. 27063 | 79-LeuLysValAspAspThrLeu-85 |
| SEQ. ID. NO. 27064 | 94-AlaTrpArgAspAsnVal-99 |
| SEQ. ID. NO. 27065 | 109-SerGlyGlyLysThrThrValLysGluMetLeu-119 |
| SEQ. ID. NO. 27066 | 123-LeuArgArgArgPheGlyAspAspAlaVal-132 |
| SEQ. ID. NO. 27067 | 151-LysLeuAsnGluLysHisArg-157 |
| SEQ. ID. NO. 27068 | 178-AlaLysProAspAla-182 |
| SEQ. ID. NO. 27069 | 199-GlyValGlyAspIleAlaLysAlaLysSerGluIle-210 |
| SEQ. ID. NO. 27070 | 223-ProGlnGluAspAlaAsn-228 |

TABLE 1-continued

| SEQ. ID. NO. 27071 | 247-AspSerGlyAspValArgAlaGluAsnIleVal-257 |
| SEQ. ID. NO. 27072 | 269-CysGlyAspGluArgThrAla-275 |
| SEQ. ID. NO. 27073 | 316-IleLysGlyArgLeuAsnVal-322 |
| SEQ. ID. NO. 27074 | 335-ThrTyrAsnAlaAsnProAspSerMetLysAlaAlaVal-347 |
| SEQ. ID. NO. 27075 | 363-AspMetGlyGluLeuGlyGluAspGluAlaAla-373 |
| SEQ. ID. NO. 27076 | 381-AlaTyrAlaArgAspGlnGlyIle-388 |
| SEQ. ID. NO. 27077 | 397-AsnSerValGluAlaAlaGluLysPheGlyAla-407 |
| SEQ. ID. NO. 27078 | 425-AspLeuProGluArgAlaThrVal-432 |
| SEQ. ID. NO. 27079 | 443-GluGluValValGluAlaLeuGluAspLys-452 | g084-2
AMPHI Regions - AMPHI

| SEQ. ID. NO. 27080 | 6-ArgIleLysAsnMetAspGlnThrLeuLysAsnThrLeuGly-19 |
| SEQ. ID. NO. 27081 | 21-CysAlaLeuLeuAla-25 |
| SEQ. ID. NO. 27082 | 48-AlaValGlyAlaLeuAla-53 |
| SEQ. ID. NO. 27083 | 65-PheProArgValSer-69 |
| SEQ. ID. NO. 27084 | 96-GlnIleValGlySerIleLeuGluSer-104 |
| SEQ. ID. NO. 27085 | 111-GluPheValGlyAsnLeuProGly-118 |

Antigenic Index - Jameson-Wolf

| SEQ. ID. NO. 27086 | 1-MetLysGlnSerAlaArgIleLysAsnMetAspGlnThrLeuLysAsnThr-17 |
| SEQ. ID. NO. 27087 | 40-TyrGluTyrGlyTyrArgTyrSer-47 |
| SEQ. ID. NO. 27088 | 102-LeuGluSerAsnProAlaGluAlaArgGluPheValGly-114 |

Hydrophilic Regions - Hopp-Woods

| SEQ. ID. NO. 27089 | 1-MetLysGlnSerAlaArgIleLysAsnMetAspGlnThrLeu-14 |
| SEQ. ID. NO. 27090 | 105-AsnProAlaGluAlaArgGluPheVal-113 | g085-2
AMPHI Regions - AMPHI

| SEQ. ID. NO. 27091 | 41-GluArgValAlaGlnIleGlyLysMetPheAspGlyLeu-53 |
| SEQ. ID. NO. 27092 | 60-LeuLysAspAlaLeuAspAsnGlyPheAsp-69 |
| SEQ. ID. NO. 27093 | 90-AsnGlyGlyArgValLeuGlyAspIleGluLeuLeuAlaAspIle-104 |
| SEQ. ID. NO. 27094 | 125-ThrSerLeuValGlyTyr-130 |
| SEQ. ID. NO. 27095 | 141-IleAlaGlyAsnIleGlyThr-147 |
| SEQ. ID. NO. 27096 | 174-GluAsnThrGluSerLeu-179 |
| SEQ. ID. NO. 27097 | 191-GluAspHisLeuAspArgTyrAspAspLeuLeuAspTyr-203 |
| SEQ. ID. NO. 27098 | 213-GlyAspGlyValGln-217 |
| SEQ. ID. NO. 27099 | 225-PheCysArgAlaMetLysArgAlaGlyArgGluVal-236 |
| SEQ. ID. NO. 27100 | 275-HisAsnAlaAlaAsnValMetAlaAlaValAlaLeuCysGluAla-289 |
| SEQ. ID. NO. 27101 | 300-HisValLysThrPheGlnGlyLeuProHisArgValGluLysIleGly-315 |
| SEQ. ID. NO. 27102 | 336-AlaAlaIleAlaGlyLeu-341 |
| SEQ. ID. NO. 27103 | 353-GlyLysGlyGlnAspPheThr-359 |
| SEQ. ID. NO. 27104 | 394-ThrAspCysValThrLeuGluGluAlaValGlnThr-405 |
| SEQ. ID. NO. 27105 | 424-SerPheAspMetPheLysGlyTyr-431 |

Antigenic Index - Jameson-Wolf

| SEQ. ID. NO. 27106 | 4-GlnAsnLysLysIleLeu-9 |
| SEQ. ID. NO. 27107 | 23-TyrLeuArgLysAsnGlyAlaGluValAlaAlaTyrAspAlaGluLeuLysAlaGluArgValAlaGln-45 |
| SEQ. ID. NO. 27108 | 58-GlyArgLeuLysAspAlaLeuAspAsnGlyPhe-68 |
| SEQ. ID. NO. 27109 | 74-SerProGlyIleSerGluArgGlnProAspIleGluAlaPheLysGlnAsnGlyGlyArgValLeuGly-96 |
| SEQ. ID. NO. 27110 | 104-IleValAsnArgArgGlyAspLysVal-112 |
| SEQ. ID. NO. 27111 | 116-ThrGlySerAsnGlyLysThrThr-123 |
| SEQ. ID. NO. 27112 | 150-LeuGluAlaAlaGluLeuGlnArgGluGlyLysLysAlaAsp-162 |
| SEQ. ID. NO. 27113 | 169-SerSerPheGlnLeuGluAsnThrGluSerLeuArgProThrAla-183 |
| SEQ. ID. NO. 27114 | 189-IleSerGluAspHisLeuAspArgTyrAspAspLeuLeu-201 |
| SEQ. ID. NO. 27115 | 204-AlaHisThrLysAlaGluIlePheArgGlyAspGlyVal-216 |
| SEQ. ID. NO. 27116 | 220-AsnAlaAspAspValPhe-225 |
| SEQ. ID. NO. 27117 | 228-AlaMetLysArgAlaGlyArgGluValLysArgPheSerLeuGluHisGluAla-245 |
| SEQ. ID. NO. 27118 | 251-ArgGlyThrGlyCysLeuLysGlnGlyAsnGluAspLeuIleSerThrGlnAspIlePro-270 |
| SEQ. ID. NO. 27119 | 291-GlyLeuProArgGluAlaLeu-297 |
| SEQ. ID. NO. 27120 | 307-LeuProHisArgValGluLysIleGlyGluLysAsnGly-319 |
| SEQ. ID. NO. 27121 | 322-PheIleAspAspSerLysGlyThrAsnVal-331 |
| SEQ. ID. NO. 27122 | 351-GlyMetGlyLysGlyGlnAspPheThrProLeuArgAspAlaLeuLysAspLysAlaLys-370 |
| SEQ. ID. NO. 27123 | 378-AspAlaProGlnIleArgArgAspLeuAspGlyCysGly-390 |
| SEQ. ID. NO. 27124 | 397-ValThrLeuGluGluAlaVal-403 |
| SEQ. ID. NO. 27125 | 431-TyrAlaHisArgSer-435 |

Hydrophilic Regions - Hopp-Woods

| SEQ. ID. NO. 27126 | 4-GlnAsnLysLysIleLeu-9 |
| SEQ. ID. NO. 27127 | 25-ArgLysAsnGlyAlaGlu-30 |
| SEQ. ID. NO. 27128 | 32-AlaAlaTyrAspAlaGluLeuLysAlaGluArgValAlaGln-45 |
| SEQ. ID. NO. 27129 | 59-ArgLeuLysAspAlaLeuAspAsnGlyPhe-68 |
| SEQ. ID. NO. 27130 | 77-IleSerGluArgGlnProAspIleGluAlaPheLysGlnAsnGlyGly-92 |
| SEQ. ID. NO. 27131 | 104-IleValAsnArgArgGlyAspLysVal-112 |
| SEQ. ID. NO. 27132 | 118-SerAsnGlyLysThrThr-123 |
| SEQ. ID. NO. 27133 | 150-LeuGluAlaAlaGluLeuGlnArgGluGlyLysLysAlaAsp-162 |
| SEQ. ID. NO. 27134 | 174-GluAsnThrGluSerLeuArgPro-181 |
| SEQ. ID. NO. 27135 | 189-IleSerGluAspHisLeuAspArgTyrAspAspLeuLeu-201 |
| SEQ. ID. NO. 27136 | 204-AlaHisThrLysAlaGluIlePheArgGlyAspGly-215 |
| SEQ. ID. NO. 27137 | 228-AlaMetLysArgAlaGlyArgGluValLysArgPheSerLeuGluHisGluAla-245 |
| SEQ. ID. NO. 27138 | 251-ArgGlyThrGlyCysLeuLysGlnGlyAsnGluAspLeuIleSer-265 |
| SEQ. ID. NO. 27139 | 291-GlyLeuProArgGluAlaLeu-297 |
| SEQ. ID. NO. 27140 | 309-HisArgValGluLysIleGlyGluLysAsnGly-319 |
| SEQ. ID. NO. 27141 | 324-AspAspSerLysGlyThrAsn-330 |
| SEQ. ID. NO. 27142 | 353-GlyLysGlyGlnAsp-357 |

TABLE 1-continued

| SEQ. ID. NO. 27143 | 359-ThrProLeuArgAspAlaLeuLysAspLysAlaLys-370 |
| SEQ. ID. NO. 27144 | 380-ProGlnIleArgArgAspLeuAspGly-388 |
| SEQ. ID. NO. 27145 | 397-ValThrLeuGluGluAlaVal-403 |
| SEQ. ID. NO. 27146 | 431-TyrAlaHisArgSer-435 | g086
AMPHI Regions - AMPHI
| SEQ. ID. NO. 27147 | 55-MetArgThrTrpArgArgLeuValPro-63 |
| SEQ. ID. NO. 27148 | 83-IleAsnGlyAlaThrArg-88 |
| SEQ. ID. NO. 27149 | 99-ProThrGluLeuPheLysLeuAlaVal-107 |
| SEQ. ID. NO. 27150 | 120-GluValLeuArgSerMetGluSerLeuGlyTrpGlnSerIleTrpArgGlyThrAlaAsn-139 |
| SEQ. ID. NO. 27151 | 155-GluMetTyrGlyArgPhe-160 |
| SEQ. ID. NO. 27152 | 185-SerPheValValIle-189 |
| SEQ. ID. NO. 27153 | 228-ArgValGlnArgValAlaPheLeuAspProTrpLysAspProGln-243 |
| SEQ. ID. NO. 27154 | 293-GlyPhePheGlyMetCys-298 |
| SEQ. ID. NO. 27155 | 336-TrpIleGlyIleGlnSerPhe-342 |

Antigenic Index - Jameson-Wolf
| SEQ. ID. NO. 27156 | 20-LeuAlaSerLysGluGlyGlyAsp-27 |
| SEQ. ID. NO. 27157 | 54-ArgMetArgThrTrpArgArg-60 |
| SEQ. ID. NO. 27158 | 79-AlaGlyArgGluIleAsnGlyAla-86 |
| SEQ. ID. NO. 27159 | 115-PheThrArgArgGluGluValLeuArgSerMetGlu-126 |
| SEQ. ID. NO. 27160 | 134-TrpArgGlyThrAla-138 |
| SEQ. ID. NO. 27161 | 144-AlaThrAsnProGlnAlaArgArgGluThrLeuGluMet-156 |
| SEQ. ID. NO. 27162 | 225-AlaProTyrArgVal-229 |
| SEQ. ID. NO. 27163 | 236-LeuAspProTrpLysAspProGlnGlyAla-245 |
| SEQ. ID. NO. 27164 | 265-GlyLeuGlyAlaSerLeuSerLysArgGlyPheLeu-276 |
| SEQ. ID. NO. 27165 | 313-SerIleGlyLysGlnSerArgAspLeuGly-322 |
| SEQ. ID. NO. 27166 | 352-LeuProThrLysGlyLeu-357 |
| SEQ. ID. NO. 27167 | 382-IleAspTyrGluAsnArgGlnLysMetArgGlyTyrArgValGlu-396 |

Hydrophilic Regions - Hopp-Woods
| SEQ. ID. NO. 27168 | 21-AlaSerLysGluGlyGlyAsp-27 |
| SEQ. ID. NO. 27169 | 79-AlaGlyArgGluIleAsnGly-85 |
| SEQ. ID. NO. 27170 | 115-PheThrArgArgGluGluValLeuArgSerMetGlu-126 |
| SEQ. ID. NO. 27171 | 147-ProGlnAlaArgArgGluThrLeuGluMet-156 |
| SEQ. ID. NO. 27172 | 238-ProTrpLysAspProGlnGly-244 |
| SEQ. ID. NO. 27173 | 270-LeuSerLysArgGlyPheLeu-276 |
| SEQ. ID. NO. 27174 | 316-LysGlnSerArgAspLeu-321 |
| SEQ. ID. NO. 27175 | 382-IleAspTyrGluAsnArgGlnLysMetArgGlyTyrArgValGlu-396 | g087
AMPHI Regions - AMPHI
| SEQ. ID. NO. 27176 | 80-LysThrValArgGluAlaGlnArgIleIle-89 |
| SEQ. ID. NO. 27177 | 99-GlyPheGlyGlyPheValThrPheProGlyGlyLeuAlaAlaLysLeuLeu-115 |
| SEQ. ID. NO. 27178 | 129-GlyLeuSerAsnArgHisLeuSerArgTrpAlaLysArgValLeuTyrAlaPheProLys-148 |
| SEQ. ID. NO. 27179 | 157-ValGlyAsnProValArg-162 |
| SEQ. ID. NO. 27180 | 192-GlyAlaAspValLeuAsnLysThrVal-200 |
| SEQ. ID. NO. 27181 | 241-ValGluPheIleThrAspMetValSerAlaTyr-251 |
| SEQ. ID. NO. 27182 | 313-GluLysLeuAlaGluIleLeuGly-320 |
| SEQ. ID. NO. 27183 | 330-TrpAlaGluAsnAla-334 |

Antigenic Index - Jameson-Wolf
| SEQ. ID. NO. 27184 | 25-AspSerLeuArgValArgGly-31 |
| SEQ. ID. NO. 27185 | 37-LeuGlySerLysAspSerMetGluGluArgIleValProGlnTyrGlyIle-53 |
| SEQ. ID. NO. 27186 | 61-LysGlyIleArgGlyAsnGlyIleLysArgLysLeu-72 |
| SEQ. ID. NO. 27187 | 80-LysThrValArgGluAlaGlnArgIleIleArgLysHisArgVal-94 |
| SEQ. ID. NO. 27188 | 130-LeuSerAsnArgHisLeuSerArgTrpAlaLys-140 |
| SEQ. ID. NO. 27189 | 150-PheSerHisGluGlyGlyLeu-156 |
| SEQ. ID. NO. 27190 | 159-AsnProValArgAlaAspIleSer-166 |
| SEQ. ID. NO. 27191 | 171-ProAlaGluArgPheGlnGlyArgGluGlyArgLeu-182 |
| SEQ. ID. NO. 27192 | 195-ValLeuAsnLysThrVal-200 |
| SEQ. ID. NO. 27193 | 207-LeuProGluGluValArgProGlnMetTyrHisGlnSerGlyArgAsnLysLeuGly-225 |
| SEQ. ID. NO. 27194 | 229-AlaAspTyrAspAla-233 |
| SEQ. ID. NO. 27195 | 235-GlyValLysAlaGluCys-240 |
| SEQ. ID. NO. 27196 | 249-SerAlaTyrArgAspAlaAsp-255 |
| SEQ. ID. NO. 27197 | 284-AlaValAspAspHisGlnThrAla-291 |
| SEQ. ID. NO. 27198 | 309-GlnLeuThrAlaGluLysLeuAlaGlu-317 |
| SEQ. ID. NO. 27199 | 321-SerLeuAsnArgGluLysCysLeuLys-329 |
| SEQ. ID. NO. 27200 | 332-GluAsnAlaArgThr-336 |
| SEQ. ID. NO. 27201 | 341-HisSerAlaAspAspValAlaGlu-348 |

Hydrophilic Regions - Hopp-Woods
| SEQ. ID. NO. 27202 | 25-AspSerLeuArgValArgGly-31 |
| SEQ. ID. NO. 27203 | 39-SerLysAspSerMetGluGluArgIleVal-48 |
| SEQ. ID. NO. 27204 | 66-AsnGlyIleLysArgLysLeu-72 |
| SEQ. ID. NO. 27205 | 81-ThrValArgGluAlaGlnArgIleIleArgLysHisArgVal-94 |
| SEQ. ID. NO. 27206 | 134-HisLeuSerArgTrpAlaLys-140 |
| SEQ. ID. NO. 27207 | 161-ValArgAlaAspIle-165 |
| SEQ. ID. NO. 27208 | 171-ProAlaGluArgPheGlnGlyArgGluGlyArgLeu-182 |
| SEQ. ID. NO. 27209 | 207-LeuProGluGluValArgPro-213 |
| SEQ. ID. NO. 27210 | 219-SerGlyArgAsnLysLeu-224 |
| SEQ. ID. NO. 27211 | 235-GlyValLysAlaGluCys-240 |
| SEQ. ID. NO. 27212 | 249-SerAlaTyrArgAspAlaAsp-255 |
| SEQ. ID. NO. 27213 | 284-AlaValAspAspHisGlnThrAla-291 |
| SEQ. ID. NO. 27214 | 310-LeuThrAlaGluLysLeuAlaGlu-317 |

TABLE 1-continued

| | |
|---|---|
| SEQ. ID. NO. 27215 | 322-LeuAsnArgGluLysCysLeuLys-329 |
| SEQ. ID. NO. 27216 | 341-HisSerAlaAspAspValAlaGlu-348 | g088-2
AMPHI Regions - AMPHI

| | |
|---|---|
| SEQ. ID. NO. 27217 | 7-HisPheSerAsnTrpLeuThrGlyLeuAsnIlePheGlnTyrThrThr-22 |
| SEQ. ID. NO. 27218 | 24-ArgAlaValMetAlaAlaLeu-30 |
| SEQ. ID. NO. 27219 | 43-ThrIleArgArgLeuThrAlaLeuLysCysGlyGln-54 |
| SEQ. ID. NO. 27220 | 88-LeuTrpGlyAsnTrpAlaAsn-94 |
| SEQ. ID. NO. 27221 | 111-GlyPheTyrAspAspTrpArgLysValValTyr-121 |
| SEQ. ID. NO. 27222 | 140-AlaValIleAlaGlyLeuAlaLeu-147 |
| SEQ. ID. NO. 27223 | 175-GlyPheLeuValLeuSerTyrLeuThrIle-184 |
| SEQ. ID. NO. 27224 | 187-ThrSerAsnAlaValAsnLeuThrAspGlyLeuAspGlyLeuAlaAla-202 |
| SEQ. ID. NO. 27225 | 221-HisTyrGlnPheSerGlnTyrLeuGlnLeuProTyr-232 |
| SEQ. ID. NO. 27226 | 244-ThrAlaMetCysGlyAlaCysLeuGlyPhe-253 |

Antigenic Index - Jameson-Wolf

| | |
|---|---|
| SEQ. ID. NO. 27227 | 48-ThrAlaLeuLysCysGlyGlnAlaValArgThrAspGlyProGln-62 |
| SEQ. ID. NO. 27228 | 66-ValLysAsnGlyThrProThrMet-73 |
| SEQ. ID. NO. 27229 | 114-AspAspTrpArgLysValValTyrLysAspProAsnGlyValSerAlaLysPhe-131 |
| SEQ. ID. NO. 27230 | 193-LeuThrAspGlyLeuAsp-198 |
| SEQ. ID. NO. 27231 | 312-LysLysThrLysLysArgIle-318 |
| SEQ. ID. NO. 27232 | 328-TyrGluGlnLysGlyTrpLysGluThrGlnVal-338 |

Hydrophilic Regions - Hopp-Woods

| | |
|---|---|
| SEQ. ID. NO. 27233 | 56-ValArgThrAspGlyProGln-62 |
| SEQ. ID. NO. 27234 | 114-AspAspTrpArgLysValValTyrLysAspProAsnGlyVal-127 |
| SEQ. ID. NO. 27235 | 312-LysLysThrLysLysArgIle-318 |
| SEQ. ID. NO. 27236 | 331-LysGlyTrpLysGlu-335 | g089
AMPHI Regions - AMPHI

| | |
|---|---|
| SEQ. ID. NO. 27237 | 40-PheSerThrArgCysGlyLysProTrpLysValLeu-51 |
| SEQ. ID. NO. 27238 | 74-LeuAlaAlaLeuCysLysProCysSerGlyMetSerCys-86 |
| SEQ. ID. NO. 27239 | 119-ArgProAlaArgPhe-123 |

Antigenic Index - Jameson-Wolf

| | |
|---|---|
| SEQ. ID. NO. 27240 | 1-MetProProLysIleThrLysSerGlyPhe-10 |
| SEQ. ID. NO. 27241 | 40-PheSerThrArgCysGlyLysProTrpLys-49 |
| SEQ. ID. NO. 27242 | 53-CysSerSerAsnAlaSerArgGlyLysProThrAlaSerHisLysAla-68 |
| SEQ. ID. NO. 27243 | 77-LeuCysLysProCysSerGlyMetSer-85 |
| SEQ. ID. NO. 27244 | 87-ValGluIleLysSerSerLeuProCysPheLysGlnProValProArgSerAsnGlnLysSerAlaSerCysSerLysGluAsnArgPheThrSerArgProAlaArgPheMetAlaArgGlnAsnThrSerSerAlaPheLysThrCysThrProSerProArgLysIleSer-144 |

Hydrophilic Regions - Hopp-Woods

| | |
|---|---|
| SEQ. ID. NO. 27245 | 43-ArgCysGlyLysPro-47 |
| SEQ. ID. NO. 27246 | 56-AsnAlaSerArgGlyLysProThrAlaSerHisLysAla-68 |
| SEQ. ID. NO. 27247 | 87-ValGluIleLysSer-91 |
| SEQ. ID. NO. 27248 | 99-ProValProArgSerAsnGlnLysSerAlaSerCysSerLysGluAsnArgPheThrSerArgProAlaArgPheMetAla-125 |
| SEQ. ID. NO. 27249 | 137-ThrProSerProArgLysIleSer-144 | g090-1
AMPHI Regions - AMPHI

| | |
|---|---|
| SEQ. ID. NO. 27250 | 10-SerGlnSerLeuLysArgPheAspLysHisPheArg-21 |
| SEQ. ID. NO. 27251 | 51-ArgLeuAsnArgLeuPhe-56 |
| SEQ. ID. NO. 27252 | 59-AspAlaValGlyGlnVal-64 |
| SEQ. ID. NO. 27253 | 129-PheAlaValValAspGlu-134 |
| SEQ. ID. NO. 27254 | 141-AlaAspPhePheHisThrValArgGlnAla-150 |
| SEQ. ID. NO. 27255 | 152-GluGlyPheAspValPheGlnGlnCysPheAla-162 |
| SEQ. ID. NO. 27256 | 164-GlnThrAspGlyLeuAlaGln-170 |
| SEQ. ID. NO. 27257 | 177-ValGlyGlyValValGlnThrLeuGlnArg-186 |
| SEQ. ID. NO. 27258 | 233-ValValArgIleGlnAsnLeuHisSerIle-242 |
| SEQ. ID. NO. 27259 | 253-ValValGluGlnIle-257 |
| SEQ. ID. NO. 27260 | 388-GluThrValValGlnArgIlePheGlnThrThr-398 |
| SEQ. ID. NO. 27261 | 404-ProValLysHisLeuThrAspLeuArg-412 |
| SEQ. ID. NO. 27262 | 425-AsnLeuArgAlaValPheAlaGlnIleGlyAsnHisGlyAsnThrArgAlaAlaLysSer-444 |

Antigenic Index - Jameson-Wolf

| | |
|---|---|
| SEQ. ID. NO. 27263 | 8-ThrAlaSerGlnSerLeuLysArgPheAspLysHisPheArg-21 |
| SEQ. ID. NO. 27264 | 29-HisIleGluThrArgAlaGlyGlyAlaGluGlnAspAsnIleAla-43 |
| SEQ. ID. NO. 27265 | 51-ArgLeuAsnArgLeuPheGlnSerAspAlaVal-61 |
| SEQ. ID. NO. 27266 | 73-AlaAspLeuArgArgIleAspAlaAspGlnGluHis-84 |
| SEQ. ID. NO. 27267 | 94-AlaGlnGlyArgGluVal-99 |
| SEQ. ID. NO. 27268 | 107-GlnAsnHisGluGluArgValLeuGlnThrGlyAsnArgGlyGlyGlyArgAlaAspIleArg-127 |
| SEQ. ID. NO. 27269 | 149-GlnAlaLeuGluGlyPhe-154 |
| SEQ. ID. NO. 27270 | 161-PheAlaArgGlnThrAspGlyLeuAlaGlnSerHisGlySerHisAsnValGlyGly-179 |
| SEQ. ID. NO. 27271 | 183-ThrLeuGlnArgAspValLeuArgArgAsnGln-193 |
| SEQ. ID. NO. 27272 | 201-ThrAlaArgProAlaPheGlnPro-208 |
| SEQ. ID. NO. 27273 | 214-PheGlnGlyLysProPheHisPheThrProCysPro-225 |
| SEQ. ID. NO. 27274 | 268-ValHisHisArgArgArgSerArgAlaGln-277 |
| SEQ. ID. NO. 27275 | 285-GluAlaGlyLysLeuGln-290 |
| SEQ. ID. NO. 27276 | 305-LeuGlnAsnArgArgThrAspIleAlaArgAsnAspGlyIleGlnPro-320 |
| SEQ. ID. NO. 27277 | 322-LeuAspAlaGluIleAlaAspGlnAlaArgTyrArgGly-334 |
| SEQ. ID. NO. 27278 | 339-AlaGlyAsnArgAsnHis-344 |
| SEQ. ID. NO. 27279 | 353-ValArgGlnGlnPhe-357 |
| SEQ. ID. NO. 27280 | 369-GluArgLeuAspIle-373 |
| SEQ. ID. NO. 27281 | 379-AspAlaGlyThrGluArgGlnAsnIle-387 |
| SEQ. ID. NO. 27282 | 396-GlnThrThrArgValLysHisGlnProVal-405 |

TABLE 1-continued

| | |
|---|---|
| SEQ. ID. NO. 27283 | 407-HisLeuThrAspLeuArgHis-413 |
| SEQ. ID. NO. 27284 | 422-IleSerGlyAsnLeu-426 |
| SEQ. ID. NO. 27285 | 435-AsnHisGlyAsnThrArgAlaAlaLysSerGlyAspGluAspPhePhe-450 |

Hydrophilic Regions - Hopp-Woods

| | |
|---|---|
| SEQ. ID. NO. 27286 | 9-AlaSerGlnSerLeuLysArgPheAspLysHisPheArg-21 |
| SEQ. ID. NO. 27287 | 29-HisIleGluThrArgAlaGlyGlyAlaGluGlnAspAsnIleAla-43 |
| SEQ. ID. NO. 27288 | 73-AlaAspLeuArgArgIleAspAlaAspGlnGluHis-84 |
| SEQ. ID. NO. 27289 | 94-AlaGlnGlyArgGluVal-99 |
| SEQ. ID. NO. 27290 | 107-GlnAsnHisGluGluArgValLeu-114 |
| SEQ. ID. NO. 27291 | 117-GlyAsnArgGlyGlyGlyArgAlaAspIleArg-127 |
| SEQ. ID. NO. 27292 | 163-ArgGlnThrAspGlyLeuAla-169 |
| SEQ. ID. NO. 27293 | 184-LeuGlnArgAspValLeuArgArgAsnGln-193 |
| SEQ. ID. NO. 27294 | 269-HisHisArgArgArgSerArgAla-276 |
| SEQ. ID. NO. 27295 | 285-GluAlaGlyLysLeuGln-290 |
| SEQ. ID. NO. 27296 | 306-GlnAsnArgArgThrAspIleAlaArgAsnAspGlyIle-318 |
| SEQ. ID. NO. 27297 | 322-LeuAspAlaGluIleAlaAspGlnAlaArgTyrArg-333 |
| SEQ. ID. NO. 27298 | 369-GluArgLeuAspIle-373 |
| SEQ. ID. NO. 27299 | 380-AlaGlyThrGluArgGlnAsnIle-387 |
| SEQ. ID. NO. 27300 | 398-ThrArgValLysHisGlnPro-404 |
| SEQ. ID. NO. 27301 | 409-ThrAspLeuArgHis-413 |
| SEQ. ID. NO. 27302 | 437-GlyAsnThrArgAlaAlaLysSerGlyAspGluAspPhePhe-450 | g091
AMPHI Regions - AMPHI

| | |
|---|---|
| SEQ. ID. NO. 27303 | 38-LysProLeuSerAspGlyIleAlaSerArgLeuIleThrArgLeu-52 |
| SEQ. ID. NO. 27304 | 61-ValLeuValSerValLeuThrSerLeuAlaLys-71 |

Antigenic Index - Jameson-Wolf

| | |
|---|---|
| SEQ. ID. NO. 27305 | 5-ValProProSerProAlaThr-11 |
| SEQ. ID. NO. 27306 | 28-IleLeuGlyArgArgArgProProLeuProLysProLeuSerAspGlyIleAla-45 |
| SEQ. ID. NO. 27307 | 73-LeuLeuSerGluArgLysValLeu-80 |

Hydrophilic Regions - Hopp-Woods

| | |
|---|---|
| SEQ. ID. NO. 27308 | 28-IleLeuGlyArgArgArgProProLeu-36 |
| SEQ. ID. NO. 27309 | 73-LeuLeuSerGluArgLysValLeu-80 | g092
AMPHI Regions - AMPHI

| | |
|---|---|
| SEQ. ID. NO. 27310 | 55-GlyMetSerGlyIleAlaGluValLeuHis-64 |
| SEQ. ID. NO. 27311 | 76-AlaArgAsnAlaAlaThrGluHisLeu-84 |
| SEQ. ID. NO. 27312 | 95-HisThrAlaGluHisValAsnGly-102 |
| SEQ. ID. NO. 27313 | 122-AlaLeuGluArgGln-126 |
| SEQ. ID. NO. 27314 | 137-AlaGluLeuMetArgPheArgAsp-144 |
| SEQ. ID. NO. 27315 | 209-LeuThrProIleMetSerValValThrAsnIleAsp-220 |
| SEQ. ID. NO. 27316 | 226-ThrTyrGlyHisSerValGluLysLeuHisGlnAlaPheIleAspPheIleHisArg-244 |
| SEQ. ID. NO. 27317 | 260-ValArgAlaIleLeuProLysValSerLysProTyr-271 |
| SEQ. ID. NO. 27318 | 273-ThrTyrGlyLeuAspAspThrAla-280 |
| SEQ. ID. NO. 27319 | 321-AsnValLeuAsnAlaLeuAlaAlaIle-329 |
| SEQ. ID. NO. 27320 | 339-ValGluAlaIleGlnLysGly-345 |
| SEQ. ID. NO. 27321 | 353-GlyArgArgPheGlnLysTyrGlyAspIleLys-363 |
| SEQ. ID. NO. 27322 | 407-ArgTyrThrArgThrArgAspLeuPheGluAspPheThrLysValLeuAsnThrValAspAlaLeu-428 |
| SEQ. ID. NO. 27323 | 449-LeuAlaArgAlaIleArgValLeuGlyLysLeu-459 |
| SEQ. ID. NO. 27324 | 464-CysGluAsnValAlaAspLeuProGlnMetLeuMetAsn-476 |

Antigenic Index - Jameson-Wolf

| | |
|---|---|
| SEQ. ID. NO. 27325 | 17-AlaAsnGlyGlnThrPhe-22 |
| SEQ. ID. NO. 27326 | 25-ThrProLeuArgThrLysAsnGlnProGluArgAsnIleMetMetLysAsnArgVal-43 |
| SEQ. ID. NO. 27327 | 70-ValSerGlySerAspGlnAlaArgAsnAlaAla-80 |
| SEQ. ID. NO. 27328 | 111-AlaValLysLysGluAsnProGluVal-119 |
| SEQ. ID. NO. 27329 | 121-AlaAlaLeuGluArgGlnIle-127 |
| SEQ. ID. NO. 27330 | 140-MetArgPheArgAspGlyIle-146 |
| SEQ. ID. NO. 27331 | 150-GlyThrHisGlyLysThrThrThr-157 |
| SEQ. ID. NO. 27332 | 184-GlyThrAsnAlaArgLeuGlyLysGlyGluTyr-194 |
| SEQ. ID. NO. 27333 | 198-GluAlaAspGluSerAspAla-204 |
| SEQ. ID. NO. 27334 | 218-AsnIleAspGluAspHisMetAspThrTyrGly-228 |
| SEQ. ID. NO. 27335 | 230-SerValGluLysLeuHis-235 |
| SEQ. ID. NO. 27336 | 255-ValAspSerGluHisVal-260 |
| SEQ. ID. NO. 27337 | 263-IleLeuProLysValSerLysProTyrAla-272 |
| SEQ. ID. NO. 27338 | 275-GlyLeuAspAspThrAlaAsp-281 |
| SEQ. ID. NO. 27339 | 286-AspIleGluAsnValGlyAla-292 |
| SEQ. ID. NO. 27340 | 302-MetLysGlyHisGluGlnGlySerPhe-310 |
| SEQ. ID. NO. 27341 | 351-GlyValGlyArgArgPheGlnLysTyrGlyAspIleLysLeuProAsnGlyGly-368 |
| SEQ. ID. NO. 27342 | 374-AspAspTyrGlyHisHisPro-380 |
| SEQ. ID. NO. 27343 | 393-AlaTyrProGluLysArgLeu-399 |
| SEQ. ID. NO. 27344 | 404-GlnProHisArgTyrThrArgThrArgAspLeuPheGluAspPheThrLys-420 |
| SEQ. ID. NO. 27345 | 435-AlaAlaGlyGluGluProValAlaAlaAlaAspSerArgAlaLeuAlaArg-451 |
| SEQ. ID. NO. 27346 | 478-LeuGlnAspGlyAspVal-483 |
| SEQ. ID. NO. 27347 | 488-GlyAlaGlySerIleAsnArgValProSerAla-498 |

Hydrophilic Regions - Hopp-Woods

| | |
|---|---|
| SEQ. ID. NO. 27348 | 26-ProLeuArgThrLysAsnGlnProGluArgAsnIleMetMetLysAsnArgVal-43 |
| SEQ. ID. NO. 27349 | 71-SerGlySerAspGlnAlaArgAsnAlaAla-80 |
| SEQ. ID. NO. 27350 | 111-AlaValLysLysGluAsnProGlu-118 |
| SEQ. ID. NO. 27351 | 121-AlaAlaLeuGluArgGlnIle-127 |
| SEQ. ID. NO. 27352 | 140-MetArgPheArgAsp-144 |
| SEQ. ID. NO. 27353 | 152-HisGlyLysThrThr-156 |

TABLE 1-continued

| SEQ. ID. NO. | Sequence |
|---|---|
| SEQ. ID. NO. 27354 | 187-AlaArgLeuGlyLysGlyGlu-193 |
| SEQ. ID. NO. 27355 | 198-GluAlaAspGluSerAspAla-204 |
| SEQ. ID. NO. 27356 | 218-AsnIleAspGluAspHisMetAsp-225 |
| SEQ. ID. NO. 27357 | 230-SerValGluLysLeuHis-235 |
| SEQ. ID. NO. 27358 | 256-AspSerGluHisVal-260 |
| SEQ. ID. NO. 27359 | 275-GlyLeuAspAspThrAlaAsp-281 |
| SEQ. ID. NO. 27360 | 303-LysGlyHisGluGlnGlySer-309 |
| SEQ. ID. NO. 27361 | 351-GlyValGlyArgArgPheGlnLys-358 |
| SEQ. ID. NO. 27362 | 360-GlyAspIleLysLeu-364 |
| SEQ. ID. NO. 27363 | 393-AlaTyrProGluLysArgLeu-399 |
| SEQ. ID. NO. 27364 | 407-ArgTyrThrArgThrArgAspLeuPheGluAspPheThrLys-420 |
| SEQ. ID. NO. 27365 | 435-AlaAlaGlyGluGluProValAlaAlaAlaAspSerArgAlaLeuAlaArg-451 |
| SEQ. ID. NO. 27366 | 479-GlnAspGlyAspVal-483 | g093-2
AMPHI Regions - AMPHI

| SEQ. ID. NO. | Sequence |
|---|---|
| SEQ. ID. NO. 27367 | 26-ThrAlaIleLeuAsn-30 |
| SEQ. ID. NO. 27368 | 59-ThrAlaPheAsnIleLeuHisGly-66 |
| SEQ. ID. NO. 27369 | 156-GlyArgLeuLysSerValTyrGluGluLeuLysHisLeu-168 |
| SEQ. ID. NO. 27370 | 196-IleHisIleIleProAlaThrGluPhe-204 |
| SEQ. ID. NO. 27371 | 254-PheLeuLysAspThr-258 |
| SEQ. ID. NO. 27372 | 267-IleAsnThrLeuProGlyMetThrGly-275 |

Antigenic Index - Jameson-Wolf

| SEQ. ID. NO. | Sequence |
|---|---|
| SEQ. ID. NO. 27373 | 12-GlyGlyPheSerSerGluArgGluIleSerLeuAspSerGlyThr-26 |
| SEQ. ID. NO. 27374 | 32-LeuLysSerLysGlyIleAsp-38 |
| SEQ. ID. NO. 27375 | 41-AlaPheAspProLysGluThrProLeuSerGluLeuLysGluArgGlyPhe-57 |
| SEQ. ID. NO. 27376 | 66-GlyThrTyrGlyGluAspGlyAlaVal-74 |
| SEQ. ID. NO. 27377 | 96-GlyMetAspLysTyrArgCys-102 |
| SEQ. ID. NO. 27378 | 121-AspAspThrAspPheAspAlaValGluGluLysLeuGly-133 |
| SEQ. ID. NO. 27379 | 140-ProAlaAlaGluGlySerSer-146 |
| SEQ. ID. NO. 27380 | 151-LysValLysGluLysGlyArgLeuLysSerValTyrGluGluLeuLysHisLeuGln-169 |
| SEQ. ID. NO. 27381 | 176-ArgPheIleGlyGlyGlyGluTyrSer-184 |
| SEQ. ID. NO. 27382 | 189-AsnGlyLysGlyLeuPro-194 |
| SEQ. ID. NO. 27383 | 203-GluPheTyrAspTyrGluAlaLysTyrAsnArgAspAspThrIleTyrGlnCysProSerGluAspLeuThrGluAlaGluGluSerLeuMetArg-234 |
| SEQ. ID. NO. 27384 | 245-GlyAlaGluGlyCysVal-250 |
| SEQ. ID. NO. 27385 | 253-AspPheLeuLysAspThrAspGly-260 |
| SEQ. ID. NO. 27386 | 269-ThrLeuProGlyMetThr-274 |
| SEQ. ID. NO. 27387 | 279-ValProLysSerAlaAla-284 |

Hydrophilic Regions - Hopp-Woods

| SEQ. ID. NO. | Sequence |
|---|---|
| SEQ. ID. NO. 27388 | 15-SerSerGluArgGluIleSerLeu-22 |
| SEQ. ID. NO. 27389 | 32-LeuLysSerLysGlyIleAsp-38 |
| SEQ. ID. NO. 27390 | 41-AlaPheAspProLysGluThrProLeuSerGluLeuLysGluArgGlyPhe-57 |
| SEQ. ID. NO. 27391 | 68-TyrGlyGluAspGlyAlaVal-74 |
| SEQ. ID. NO. 27392 | 96-GlyMetAspLysTyrArgCys-102 |
| SEQ. ID. NO. 27393 | 121-AspAspThrAspPheAspAlaValGluGluLysLeuGly-133 |
| SEQ. ID. NO. 27394 | 140-ProAlaAlaGluGlySerSer-146 |
| SEQ. ID. NO. 27395 | 151-LysValLysGluLysGlyArgLeuLysSerValTyrGluGluLeuLysHisLeuGln-169 |
| SEQ. ID. NO. 27396 | 205-TyrAspTyrGluAlaLysTyrAsnArgAspAspThrIle-217 |
| SEQ. ID. NO. 27397 | 221-ProSerGluAspLeuThrGluAlaGluGluSerLeuMetArg-234 |
| SEQ. ID. NO. 27398 | 253-AspPheLeuLysAspThrAspGly-260 | g094
AMPHI Regions - AMPHI

| SEQ. ID. NO. | Sequence |
|---|---|
| SEQ. ID. NO. 27399 | 17-LeuProProIleThrLysValGlySer-25 |
| SEQ. ID. NO. 27400 | 64-ArgGlyIleThrGlyIleCysArg-71 |
| SEQ. ID. NO. 27401 | 80-PheSerPheLeuThrAlaVal-86 |

Antigenic Index - Jameson-Wolf

| SEQ. ID. NO. | Sequence |
|---|---|
| SEQ. ID. NO. 27402 | 4-ProLeuProLysArgAlaLeu-10 |
| SEQ. ID. NO. 27403 | 24-GlySerSerProAlaAlaProArgMetGluAla-34 |
| SEQ. ID. NO. 27404 | 50-MetProSerArgLysArgIleSer-57 |
| SEQ. ID. NO. 27405 | 60-SerIleLysAlaArgGly-65 |
| SEQ. ID. NO. 27406 | 70-CysArgSerAsnAlaAlaThrThrSer-78 |

Hydrophilic Regions - Hopp-Woods

| SEQ. ID. NO. | Sequence |
|---|---|
| SEQ. ID. NO. 27407 | 5-LeuProLysArgAlaLeu-10 |
| SEQ. ID. NO. 27408 | 28-AlaAlaProArgMetGluAla-34 |
| SEQ. ID. NO. 27409 | 51-ProSerArgLysArgIleSer-57 |
| SEQ. ID. NO. 27410 | 60-SerIleLysAlaArgGly-65 | g095-2
AMPHI Regions - AMPHI

| SEQ. ID. NO. | Sequence |
|---|---|
| SEQ. ID. NO. 27411 | 7-GlyGlyCysIleSerAsnLeuPheArgGlnPheGlnGlnArgGlyGlyAsnAlaValAsp-26 |
| SEQ. ID. NO. 27412 | 38-IleLeuXxxAsnIleHisGlnHisLeuArgGlnValGlyAspValPheAlaVal-55 |
| SEQ. ID. NO. 27413 | 63-TyrAlaAspSerThr-67 |
| SEQ. ID. NO. 27414 | 86-PheGlyGlnTyrGlnArgIleAsnGlyIleGluTyrPheGlyLysValPheLysGlnIleAlaArg-107 |
| SEQ. ID. NO. 27415 | 131-LysGlyCysArgHisPheAspGlyValValSer-141 |
| SEQ. ID. NO. 27416 | 174-PheLeuAspArgPheAsnArgCysAlaAspPheGlnArgHisAlaAspGlyCysGlnCysValGlnHisVal-197 |
| SEQ. ID. NO. 27417 | 204-GlnHisAspPheLys-208 |
| SEQ. ID. NO. 27418 | 236-AspValGlyGlyIleValGlnThrValSerSerIle-247 |
| SEQ. ID. NO. 27419 | 274-ThrValAspGluIleAspLysArgLeuMetGlnPhePheAspAlaVal-289 |
| SEQ. ID. NO. 27420 | 370-AsnGlyAspAlaValThrGluAlaHis-378 |
| SEQ. ID. NO. 27421 | 417-ValAsnValPheCysGly-422 |
| SEQ. ID. NO. 27422 | 435-MetLeuGlySerGlyIleSerArgLeuIleArgThrGly-447 |
| SEQ. ID. NO. 27423 | 451-AlaGlnIleValGlnAspPheGlyAspThrAlaHisAla-463 |

TABLE 1-continued

Antigenic Index - Jameson-Wolf
SEQ. ID. NO. 27424     17-PheGlnGlnArgGlyGlyAsnAlaValAspAlaSerArgThrHisIle-32
SEQ. ID. NO. 27425     62-GlnTyrAlaAspSerThrArgGlnGlyAlaGlyValGlyGlyGlyAsnArg-78
SEQ. ID. NO. 27426     112-ValArgLeuGluGlyGluHisGlnThr-120
SEQ. ID. NO. 27427     126-AlaAlaCysSerGlyLysGlyCysArgHisPheAspGly-138
SEQ. ID. NO. 27428     163-AlaAlaAlaAspAlaPheLysAlaGluGlnAlaPhe-174
SEQ. ID. NO. 27429     176-AspArgPheAsnArgCysAlaAspPheGlnArgHisAlaAspGlyCysGln-192
SEQ. ID. NO. 27430     205-HisAspPheLysArg-209
SEQ. ID. NO. 27431     253-GlyGlnAsnArgAlaAspVal-259
SEQ. ID. NO. 27432     263-AsnThrGlnLysGlyPheAlaVal-270
SEQ. ID. NO. 27433     273-HisThrValAspGluIleAspLysArgLeu-282
SEQ. ID. NO. 27434     299-AspIleGlyAsnAspGlyHisAsnArgGlyGlnMetXxxGluArgGlyIle-315
SEQ. ID. NO. 27435     339-PheAlaAlaAspAsnGluSerGlyValGluSerCysArgAlaGluAspGlyGlyGlyGlnAlaGlyGlyArg-362
SEQ. ID. NO. 27436     364-PheAlaValArgThrGlyAsnGlyAspAlaValThr-375
SEQ. ID. NO. 27437     384-GlnGlyAlaArgAsnAsnGlyAsnLeuProLeuGlnArgSerAspAsnPheGly-401
SEQ. ID. NO. 27438     405-LeuAspGlyGlyArgGlyAsnAspAspIleArgThr-416
SEQ. ID. NO. 27439     442-ArgLeuIleArgThrGlyAsnPheLys-450
SEQ. ID. NO. 27440     455-GlnAspPheGlyAspThrAlaHisAlaAspAlaAlaAspThrAspLysMetAspVal-473
Hydrophilic Regions - Hopp-Woods
SEQ. ID. NO. 27441     17-PheGlnGlnArgGlyGlyAsnAlaValAspAlaSerArgThrHisIle-32
SEQ. ID. NO. 27442     65-AspSerThrArgGlnGlyAla-71
SEQ. ID. NO. 27443     112-ValArgLeuGluGlyGluHis-118
SEQ. ID. NO. 27444     128-CysSerGlyLysGlyCysArgHisPheAsp-137
SEQ. ID. NO. 27445     163-AlaAlaAlaAspAlaPheLysAlaGluGlnAlaPhe-174
SEQ. ID. NO. 27446     182-AlaAspPheGlnArgHisAlaAspGly-190
SEQ. ID. NO. 27447     205-HisAspPheLysArg-209
SEQ. ID. NO. 27448     273-HisThrValAspGluIleAspLysArgLeu-282
SEQ. ID. NO. 27449     300-IleGlyAsnAspGlyHisAsnArgGlyGlnMetXxxGluArgGlyIle-315
SEQ. ID. NO. 27450     339-PheAlaAlaAspAsnGluSerGlyValGluSerCysArgAlaGluAspGlyGlyGly-357
SEQ. ID. NO. 27451     368-ThrGlyAsnGlyAspAlaValThr-375
SEQ. ID. NO. 27452     384-GlnGlyAlaArgAsnAsnGly-390
SEQ. ID. NO. 27453     394-LeuGlnArgSerAspAsn-399
SEQ. ID. NO. 27454     407-GlyGlyArgGlyAsnAspAspIleArgThr-416
SEQ. ID. NO. 27455     461-AlaHisAlaAspAlaAlaAspThrAspLysMetAspVal-473
g096-2
AMPHI Regions - AMPHI
SEQ. ID. NO. 27456     19-GlyIlePheGluGluIleAspAlaHis-27
SEQ. ID. NO. 27457     59-IleAsnGlyValValSerVal-65
SEQ. ID. NO. 27458     112-GlnPhePheValAsnAlaPheGlnThrAlaPhePhePheAsp-125
SEQ. ID. NO. 27459     161-GluLeuGlyAsnGlyXxx-166
SEQ. ID. NO. 27460     172-AsnGlnPheAlaAla-176
SEQ. ID. NO. 27461     188-ThrAlaAlaGlyIleGlyAsnAlaGln-196
SEQ. ID. NO. 27462     228-XxxArgArgPheLeu-232
Antigenic Index - Jameson-Wolf
SEQ. ID. NO. 27463     4-HisThrGlyGlnGly-8
SEQ. ID. NO. 27464     22-GluGluIleAspAla-26
SEQ. ID. NO. 27465     30-PheArgThrAspCys-34
SEQ. ID. NO. 27466     74-LeuGlyCysGlyAspAspValTyrAla-82
SEQ. ID. NO. 27467     88-ValGlnAspGlyAla-92
SEQ. ID. NO. 27468     97-AlaAlaAspLysThrPheGlyAsn-104
SEQ. ID. NO. 27469     133-AlaPheGlyArgArgLeuHisLysHisArgGlnThr-144
SEQ. ID. NO. 27470     161-GluLeuGlyAsnGlyXxxSerGlnCysLeu-170
SEQ. ID. NO. 27471     181-AlaAspGlyGlyGlyGlyAspThr-188
SEQ. ID. NO. 27472     211-ThrValLysAspValGluCysArgLeuLysAla-221
Hydrophilic Regions - Hopp-Woods
SEQ. ID. NO. 27473     22-GluGluIleAspAla-26
SEQ. ID. NO. 27474     75-GlyCysGlyAspAspValTyr-81
SEQ. ID. NO. 27475     97-AlaAlaAspLysThrPheGly-103
SEQ. ID. NO. 27476     133-AlaPheGlyArgArgLeuHisLysHisArgGln-143
SEQ. ID. NO. 27477     182-AspGlyGlyGlyGlyAspThr-188
SEQ. ID. NO. 27478     211-ThrValLysAspValGluCysArgLeuLysAla-221
g097
AMPHI Regions - AMPHI
SEQ. ID. NO. 27479     28-AlaGlyLeuThrThrPheLeuThrMetCysTyrIleVal-40
SEQ. ID. NO. 27480     166-AlaThrLeuValGlyLeuGlyAspIleHisGlnProSerAlaLeuLeuAlaLeuPheGlyPheValMetValValValLeu-192
SEQ. ID. NO. 27481     207-ThrIleThrValIleAlaSerLeuMetGlyLeuAsnGluPheHisGlyValValGlyGluValProGlyIle-230
SEQ. ID. NO. 27482     242-LeuPheThrValSer-246
SEQ. ID. NO. 27483     260-PheAspSerThrGlyThr-265
SEQ. ID. NO. 27484     362-MetLeuArgSerAlaArgAspIle-369
Antigenic Index - Jameson-Wolf
SEQ. ID. NO. 27485     1-MetAspIleSerLysGlThrLeuLeu-9
SEQ. ID. NO. 27486     16-LysAlaAsnGlyThrThrValArgThrGluLeu-26
SEQ. ID. NO. 27487     125-LysValArgGluMetLeu-130
SEQ. ID. NO. 27488     260-PheAspSerThrGly-264
SEQ. ID. NO. 27489     277-ValAspGlyLysLeuProArgLeuLysArg-286
SEQ. ID. NO. 27490     317-SerAlaGlyGlyArgThrGly-323
SEQ. ID. NO. 27491     364-ArgSerAlaArgAspIleAspTrpAspAspMetThrGlu-376
SEQ. ID. NO. 27492     410-LeuCysArgArgThrGlyAspValPro-418

TABLE 1-continued

Hydrophilic Regions - Hopp-Woods
SEQ. ID. NO. 27493    1-MetAspIleSerLys-5
SEQ. ID. NO. 27494    17-AlaAsnGlyThrThrValArgThrGluLeu-26
SEQ. ID. NO. 27495    125-LysValArgGluMetLeu-130
SEQ. ID. NO. 27496    279-GlyLysLeuProArgLeuLysArg-286
SEQ. ID. NO. 27497    318-AlaGlyGlyArgThr-322
SEQ. ID. NO. 27498    364-ArgSerAlaArgAspIleAspTrpAspAspMetThrGlu-376
SEQ. ID. NO. 27499    410-LeuCysArgArgThrGlyAsp-416
g098
AMPHI Regions - AMPHI
SEQ. ID. NO. 27500    33-AspGlnPheValGlyAspValAlaArg-41
SEQ. ID. NO. 27501    62-ThrHisHisValHisArgMetGly-69
Antigenic Index - Jameson-Wolf
SEQ. ID. NO. 27502    25-GlnGlnAspAlaAlaGlnAlaGlyAspGlnPheVal-36
SEQ. ID. NO. 27503    53-AsnAlaAlaGluHisGlyHisAlaGly-61
SEQ. ID. NO. 27504    67-ArgMetGlyMetCysArg-72
SEQ. ID. NO. 27505    79-AsnHisThrAspArgGlnAla-85
Hydrophilic Regions - Hopp-Woods
SEQ. ID. NO. 27506    26-GlnAspAlaAlaGlnAla-31
SEQ. ID. NO. 27507    54-AlaAlaGluHisGlyHis-59
SEQ. ID. NO. 27508    79-AsnHisThrAspArgGlnAla-85
g099
AMPHI Regions - AMPHI
SEQ. ID. NO. 27509    6-SerMetMetArgLeuProAspIleVal-14
SEQ. ID. NO. 27510    47-AlaPheValGluPhePheGlyGluGly-55
SEQ. ID. NO. 27511    102-LysLeuValGluThrTyrAlaLysThr-110
SEQ. ID. NO. 27512    114-TrpAlaGlyGlyLeuLys-119
SEQ. ID. NO. 27513    135-ThrArgAsnMetAlaGlyProSerAsn-143
SEQ. ID. NO. 27514    154-AlaAlaLysGlyLeuAlaLysProTyrGluGluProSerAspGlyGln-169
SEQ. ID. NO. 27515    178-AlaAlaIleThrSerCysThrAsnThrSerAsnProArgAsnVal-192
SEQ. ID. NO. 27516    251-ThrCysAsnGlyMetSer-256
SEQ. ID. NO. 27517    341-IleAspAlaIleValAlaGluTyr-348
SEQ. ID. NO. 27518    350-LysProGlnGlnPheArgAspIle-357
SEQ. ID. NO. 27519    371-ProSerProLeuTyrAspTrpArg-378
SEQ. ID. NO. 27520    381-SerThrTyrIleArg-385
SEQ. ID. NO. 27521    398-ArgThrLeuArgGlyMetArgProPro-406
SEQ. ID. NO. 27522    443-AspPheAsnSerTyrAlaThr-449
SEQ. ID. NO. 27523    468-PheAsnGluMetValArg-473
SEQ. ID. NO. 27524    494-MetArgMetTrpGluAlaIleGluThrTyrMet-504
SEQ. ID. NO. 27525    532-ArgLeuAlaGlyValGluAlaIle-539
SEQ. ID. NO. 27526    541-AlaGluGlyPheGluArgIleHisArgThrAsn-551
SEQ. ID. NO. 27527    575-GlyThrGluThrTyr-579
Antigenic Index - Jameson-Wolf
SEQ. ID. NO. 27528    18-LeuThrGlyLysArgGlnAla-24
SEQ. ID. NO. 27529    38-PheLeuArgLysGluArgValVal-45
SEQ. ID. NO. 27530    53-GlyGluGlyAlaArgSer-58
SEQ. ID. NO. 27531    60-SerIleGlyAspArgAlaThr-66
SEQ. ID. NO. 27532    70-MetThrProGluPhe-74
SEQ. ID. NO. 27533    94-ThrGlyArgAspAspAlaGlnValLysLeu-103
SEQ. ID. NO. 27534    133-SerValThrArgAsnMetAlaGlyProSerAsnProHis-145
SEQ. ID. NO. 27535    157-GlyLeuAlaLysProTyrGluGluProSerAspGlyGlnMetProAspGly-173
SEQ. ID. NO. 27536    183-CysThrAsnThrSerAsnProArgAsnVal-192
SEQ. ID. NO. 27537    201-AsnAlaAsnArgLeuGlyLeuLysArgLysProTrpVal-213
SEQ. ID. NO. 27538    216-SerPheAlaProGlySerLysValAla-224
SEQ. ID. NO. 27539    235-ProGluMetGluLysLeu-240
SEQ. ID. NO. 27540    251-ThrCysAsnGlyMetSerGlyAlaLeuAspProLysIleGlnGlnGluIleIleAspArgAspLeuTyr-273
SEQ. ID. NO. 27541    279-SerGlyAsnArgAsnPheAspGlyArgIleHisProTyrAlaLys-293
SEQ. ID. NO. 27542    312-IleArgPheAspIleGluAsnAspVal-320
SEQ. ID. NO. 27543    322-GlyValAlaAspGlyArgGluIleArgLeuLysAspIleTrpProThrAspGluGluIleAsp-342
SEQ. ID. NO. 27544    348-TyrValLysProGlnGlnPheArgAsp-356
SEQ. ID. NO. 27545    361-MetSerAspThrGlyThrAlaGlnLysAlaProSerProLeuTyrAspTrpArgProMetSerThrTyrIleArgArgProProTyrTrp-390
SEQ. ID. NO. 27546    394-LeuAlaGlyGluArgThrLeuArgGlyMetArgProProAlaIleLeuProAspAsnIleThrThrAspHisIleSerProSerAsn-422
SEQ. ID. NO. 27547    438-GlyLeuProGluGluAspPheAsnSerTyrAlaThrHisArgGlyAspHisLeuThr-456
SEQ. ID. NO. 27548    463-AlaAsnProLysLeuPhe-468
SEQ. ID. NO. 27549    471-MetValArgAsnGluAspGlySerValArgGlnGlySerLeuAlaArgValGluProGluGlyGlnThr-493
SEQ. ID. NO. 27550    503-TyrMetAsnArgLysGlnPro-509
SEQ. ID. NO. 27551    516-AlaAspTyrGlyGlnGlySerSerArgAspTrpAlaAlaLysGlyValArg-532
SEQ. ID. NO. 27552    542-GluGlyPheGluArgIleHisArgThrAsnLeu-552
SEQ. ID. NO. 27553    562-PheLysProGlyThrAsnArgHisThrLeuGlnLeuArgGlyThrGluThrTyrAspValValGlyGluArgThrProArgCysGly-590
SEQ. ID. NO. 27554    595-IleHisArgLysAsnGlyGluThrValGlu-604
SEQ. ID. NO. 27555    607-ValThrCysArgProAspThrAlaGluGlu-616
Hydrophilic Regions - Hopp-Woods
SEQ. ID. NO. 27556    18-LeuThrGlyLysArgGlnAla-24
SEQ. ID. NO. 27557    38-PheLeuArgLysGluArgValVal-45
SEQ. ID. NO. 27558    53-GlyGluGlyAlaArg-57
SEQ. ID. NO. 27559    60-SerIleGlyAspArgAlaThr-66
SEQ. ID. NO. 27560    94-ThrGlyArgAspAspAlaGlnValLysLeu-103
SEQ. ID. NO. 27561    157-GlyLeuAlaLysProTyrGluGluProSerAspGlyGlnMetPro-171
SEQ. ID. NO. 27562    205-LeuGlyLeuLysArgLysProTrpVal-213
SEQ. ID. NO. 27563    235-ProGluMetGluLysLeu-240

TABLE 1-continued

| | |
|---|---|
| SEQ. ID. NO. 27564 | 259-LeuAspProLysIleGlnGlnGluIleIleAspArgAspLeuTyr-273 |
| SEQ. ID. NO. 27565 | 282-ArgAsnPheAspGlyArgIle-288 |
| SEQ. ID. NO. 27566 | 312-IleArgPheAspIleGluAsnAspVal-320 |
| SEQ. ID. NO. 27567 | 324-AlaAspGlyArgGluIleArgLeuLysAsp-333 |
| SEQ. ID. NO. 27568 | 335-TrpProThrAspGlyGluIleAsp-342 |
| SEQ. ID. NO. 27569 | 363-AspThrGlyThrAlaGlnLysAlaPro-371 |
| SEQ. ID. NO. 27570 | 394-LeuAlaGlyGluArgThrLeuArgGlyMetArg-404 |
| SEQ. ID. NO. 27571 | 438-GlyLeuProGluGluAspPheAsn-445 |
| SEQ. ID. NO. 27572 | 450-HisArgGlyAspHis-454 |
| SEQ. ID. NO. 27573 | 471-MetValArgAsnGluAspGlySerValArgGln-481 |
| SEQ. ID. NO. 27574 | 485-AlaArgValGluProGluGlyGlnThr-493 |
| SEQ. ID. NO. 27575 | 503-TyrMetAsnArgLysGlnPro-509 |
| SEQ. ID. NO. 27576 | 518-TyrGlyGlnGlySerSerArgAspTrpAlaAlaLysGlyValArg-532 |
| SEQ. ID. NO. 27577 | 542-GluGlyPheGluArgIleHisArg-549 |
| SEQ. ID. NO. 27578 | 564-ProGlyThrAsnArgHis-569 |
| SEQ. ID. NO. 27579 | 574-AspGlyThrGluThr-578 |
| SEQ. ID. NO. 27580 | 580-AspValValGlyGluArgThrProArg-588 |
| SEQ. ID. NO. 27581 | 596-HisArgLysAsnGlyGluThrValGlu-604 |
| SEQ. ID. NO. 27582 | 609-CysArgProAspThrAlaGluGlu-616 | g102
AMPHI Regions - AMPHI

| | |
|---|---|
| SEQ. ID. NO. 27583 | 26-ProAsnProThrAlaAsnLeuGlyAspGlyLeu-36 |
| SEQ. ID. NO. 27584 | 70-PheAspThrMetValLysAspLeuLeuGlyArgGlyTrpAsnIleIleAsnGlyIleAla-89 |
| SEQ. ID. NO. 27585 | 109-ThrAlaLysGlyIleGlySerAlaVal-117 |
| SEQ. ID. NO. 27586 | 128-LeuValPhePheGlyIleLeuAlaPheCys-137 |
| SEQ. ID. NO. 27587 | 144-LeuValAspArgPheThrGlyValLeu-152 |
| SEQ. ID. NO. 27588 | 155-GlyMetValLeuThr-159 |
| SEQ. ID. NO. 27589 | 207-AsnValSerSerLeuLeuLysTyrPheLys-216 |
| SEQ. ID. NO. 27590 | 221-LysValAlaLysSerIle-226 |
| SEQ. ID. NO. 27591 | 266-LeuAsnGluThrLeuSerLysPheAlaGlnThrGlyAspMetAspLysIleLeuSerLeuPheProTyr-288 |
| SEQ. ID. NO. 27592 | 300-LeuGlyLeuPheAspAsnIleAlaAspIlePheLysTrpAsnAsp-314 |
| SEQ. ID. NO. 27593 | 316-MetSerGlyArgGly-320 |
| SEQ. ID. NO. 27594 | 342-PhePheThrAlaIleGlyAla-348 |
| SEQ. ID. NO. 27595 | 374-GlyAlaGlyLysThrTyrLysVal-381 |

Antigenic Index - Jameson-Wolf

| | |
|---|---|
| SEQ. ID. NO. 27596 | 1-MetSerAlaLysThrProSerLeu-8 |
| SEQ. ID. NO. 27597 | 26-ProAsnProThrAlaAsnLeuGlyAspGlyLeu-36 |
| SEQ. ID. NO. 27598 | 62-ThrHisAsnProArgGlyAlaSer-69 |
| SEQ. ID. NO. 27599 | 77-LeuLeuGlyArgGly-81 |
| SEQ. ID. NO. 27600 | 106-GlyAspLeuThrAla-110 |
| SEQ. ID. NO. 27601 | 169-AlaAspAlaLysPro-173 |
| SEQ. ID. NO. 27602 | 179-ThrGlnAlaProValGlyThr-185 |
| SEQ. ID. NO. 27603 | 214-TyrPheLysGlyAspAlaProLysValAla-223 |
| SEQ. ID. NO. 27604 | 246-SerAsnLeuProArgAsnGluPhe-253 |
| SEQ. ID. NO. 27605 | 258-AlaAlaGluArgGlnLeu-263 |
| SEQ. ID. NO. 27606 | 274-AlaGlnThrGlyAspMetAspLys-281 |
| SEQ. ID. NO. 27607 | 311-LysTrpAsnAspSerMetSerGlyArgGlyThrLys-322 |
| SEQ. ID. NO. 27608 | 369-SerProGlnLysIleGlyAlaGlyLysThrTyr-379 |

Hydrophilic Regions - Hopp-Woods

| | |
|---|---|
| SEQ. ID. NO. 27609 | 1-MetSerAlaLysThr-5 |
| SEQ. ID. NO. 27610 | 62-ThrHisAsnProArgGlyAlaSer-69 |
| SEQ. ID. NO. 27611 | 169-AlaAspAlaLysPro-173 |
| SEQ. ID. NO. 27612 | 215-PheLysGlyAspAlaProLysValAla-223 |
| SEQ. ID. NO. 27613 | 247-AsnLeuProArgAsnGluPhe-253 |
| SEQ. ID. NO. 27614 | 258-AlaAlaGluArgGlnLeu-263 |
| SEQ. ID. NO. 27615 | 277-GlyAspMetAspLys-281 |
| SEQ. ID. NO. 27616 | 316-MetSerGlyArgGlyThrLys-322 |
| SEQ. ID. NO. 27617 | 371-GlnLysIleGlyAla-375 | g105
AMPHI Regions - AMPHI

| | |
|---|---|
| SEQ. ID. NO. 27618 | 11-TrpValGlyLeuGly-15 |
| SEQ. ID. NO. 27619 | 22-ValThrArgLeuLeuAsp-27 |
| SEQ. ID. NO. 27620 | 51-LysValTyrGlySerThrAlaGluLeuValArgAlaCys-63 |
| SEQ. ID. NO. 27621 | 74-AlaAlaValCysAspIleLeuAsnGlyValArgAspGlyLeu-87 |
| SEQ. ID. NO. 27622 | 97-ThrIleSerProThr-101 |
| SEQ. ID. NO. 27623 | 110-ValGluAlaAlaGlyGlyGlnPheAlaGluAlaProVal-122 |
| SEQ. ID. NO. 27624 | 143-AlaValLeuAsnProLeuGlnLysIlePheSer-153 |
| SEQ. ID. NO. 27625 | 162-PheGlyAspValGlyLysGlySer-169 |
| SEQ. ID. NO. 27626 | 176-AsnSerLeuLeuGlyIlePheGlyGluAlaTyr-186 |
| SEQ. ID. NO. 27627 | 203-IleValGluAlaIleGlyGlySerAla-211 |
| SEQ. ID. NO. 27628 | 249-LeuGluGlnAlaGlyAsnThrLeuProAlaValGlu-260 |
| SEQ. ID. NO. 27629 | 263-AlaAlaSerTyrArgLysAlaValGluAla-272 |

Antigenic Index - Jameson-Wolf

| | |
|---|---|
| SEQ. ID. NO. 27630 | 25-LeuLeuAspGlyGlyIleGlu-31 |
| SEQ. ID. NO. 27631 | 34-ValTyrAsnArgSerProAspLysThrAlaProIleSerAlaLysGlyAlaLysValTyrGlySer-55 |
| SEQ. ID. NO. 27632 | 81-AsnGlyValArgAspGlyLeuAla-88 |
| SEQ. ID. NO. 27633 | 96-SerThrIleSerProThrGluAsnLeuAla-105 |
| SEQ. ID. NO. 27634 | 121-ProValSerGlySerValGlyProAlaThr-130 |
| SEQ. ID. NO. 27635 | 139-GlyGlySerGluAla-143 |
| SEQ. ID. NO. 27636 | 155-ValGlyLysLysThrPheHisPheGlyAspValGlyLysGlySerGly-170 |

TABLE 1-continued

| | |
|---|---|
| SEQ. ID. NO. 27637 | 196-PheGlyIleAspThrAspThrIleVal-204 |
| SEQ. ID. NO. 27638 | 210-SerAlaMetAspSerProMetPheGlnThrLysLysSerLeuTrpAlaAsnArgGluPheProPro-231 |
| SEQ. ID. NO. 27639 | 237-HisAlaSerLysAspLeuAsnLeuAlaValLysGluLeuGluGlnAlaGlyAsnThrLeuPro-257 |
| SEQ. ID. NO. 27640 | 264-AlaSerTyrArgLysAlaValGluAlaGlyTyrGlyGluGlnAspValSerGly-281 |
| Hydrophilic Regions - Hopp-Woods | |
| SEQ. ID. NO. 27641 | 25-LeuLeuAspGlyGlyIle-30 |
| SEQ. ID. NO. 27642 | 37-ArgSerProAspLysThrAlaProIleSerAlaLysGlyAlaLys-51 |
| SEQ. ID. NO. 27643 | 81-AsnGlyValArgAspGlyLeuAla-88 |
| SEQ. ID. NO. 27644 | 164-AspValGlyLysGlySerGly-170 |
| SEQ. ID. NO. 27645 | 196-PheGlyIleAspThrAspThrIle-203 |
| SEQ. ID. NO. 27646 | 218-GlnThrLysLysSerLeuTrpAla-225 |
| SEQ. ID. NO. 27647 | 237-HisAlaSerLysAspLeuAsnLeuAlaValLysGluLeuGluGlnAlaGly-253 |
| SEQ. ID. NO. 27648 | 265-SerTyrArgLysAlaValGlu-271 |
| SEQ. ID. NO. 27649 | 273-GlyTyrGlyGluGlnAspVal-279 |
| g109-2 | |
| AMPHI Regions - AMPHI | |
| SEQ. ID. NO. 27650 | 6-GlyThrTyrArgAspLeuHisArgProAlaSerGlu-17 |
| SEQ. ID. NO. 27651 | 53-LeuIleProAlaMetAlaGlyThrIleGly-62 |
| SEQ. ID. NO. 27652 | 143-GlyLeuLeuMetAla-147 |
| SEQ. ID. NO. 27653 | 154-IleMetAlaLysLeuThrSer-160 |
| SEQ. ID. NO. 27654 | 175-GlyThrThrGlyGlnValLysLysLeuPheSerTrpAlaGly-188 |
| SEQ. ID. NO. 27655 | 205-ValMetTyrAlaLeuLeuGluHisTrpLysLysArgTrpLeu-218 |
| SEQ. ID. NO. 27656 | 220-ValProLeuGlyCys-224 |
| SEQ. ID. NO. 27657 | 292-HisGlnValPheGlnLysIle-298 |
| SEQ. ID. NO. 27658 | 324-ValGlySerIleLeuGly-329 |
| SEQ. ID. NO. 27659 | 334-ThrSerSerTrpGlyThr-339 |
| SEQ. ID. NO. 27660 | 465-AlaValGlyMetLeuProGlyIleProProPheLeuGluGlnPheLysSerLeu-482 |
| Antigenic Index - Jameson-Wolf | |
| SEQ. ID. NO. 27661 | 1-MetGluLysHisAsnGlyThrTyrArgAspLeuHisArgProAlaSer-16 |
| SEQ. ID. NO. 27662 | 18-PheAlaThrArgAspGluTyrLeuGlu-26 |
| SEQ. ID. NO. 27663 | 32-MetGlnProLysArgTrpArgProAsnLeuProPheArgAspTyrArgPheGluTrp-50 |
| SEQ. ID. NO. 27664 | 76-LeuGlyLeuProAsp-80 |
| SEQ. ID. NO. 27665 | 107-ProGlyAlaAsnLeuProGlyThrHis-115 |
| SEQ. ID. NO. 27666 | 158-LeuThrSerAsnGlyVal-163 |
| SEQ. ID. NO. 27667 | 177-ThrGlyGlnValLysLys-182 |
| SEQ. ID. NO. 27668 | 243-AlaProGlyLeuProPro-248 |
| SEQ. ID. NO. 27669 | 254-TrpXxxGlyGluAsnSerGlyTrpHis-262 |
| SEQ. ID. NO. 27670 | 299-SerTyrProGluLysThrAspLysVal-307 |
| SEQ. ID. NO. 27671 | 310-AsnIleAspAspThrMetThr-316 |
| SEQ. ID. NO. 27672 | 350-ProIleProGlyGly-354 |
| SEQ. ID. NO. 27673 | 392-AlaGlyMetGluMetThrArgLysGlyLysThrThrGln-404 |
| SEQ. ID. NO. 27674 | 435-GlyCysLysGluArgSerAla-441 |
| Hydrophilic Regions - Hopp-Woods | |
| SEQ. ID. NO. 27675 | 1-MetGluLysHisAsnGlyThrTyrArgAspLeuHisArgProAlaSer-16 |
| SEQ. ID. NO. 27676 | 18-PheAlaThrArgAspGluTyrLeuGlu-26 |
| SEQ. ID. NO. 27677 | 35-LysArgTrpArgPro-39 |
| SEQ. ID. NO. 27678 | 44-ArgAspTyrArgPheGluTrp-50 |
| SEQ. ID. NO. 27679 | 178-GlyGlnValLysLys-182 |
| SEQ. ID. NO. 27680 | 299-SerTyrProGluLysThrAspLysVal-307 |
| SEQ. ID. NO. 27681 | 311-IleAspAspThrMetThr-316 |
| SEQ. ID. NO. 27682 | 392-AlaGlyMetGluMetThrArgLysGlyLysThrThrGln-404 |
| SEQ. ID. NO. 27683 | 435-GlyCysLysGluArgSerAla-441 |
| g111-2 | |
| AMPHI Regions - AMPHI | |
| SEQ. ID. NO. 27684 | 6-ArgLeuProAsnLeuIleArgAlaLeu-14 |
| SEQ. ID. NO. 27685 | 58-ProSerProAlaLysIleGlnLysArgIleAspAspAlaLeuLysGluValAsnArgGlnMetSer-79 |
| SEQ. ID. NO. 27686 | 90-PheAsnGlnHisThrAlaGly-96 |
| SEQ. ID. NO. 27687 | 128-GlyProLeuValAsnLeuTrp-134 |
| SEQ. ID. NO. 27688 | 151-IleLysGlnAlaAlaSerTyrThrGly-159 |
| SEQ. ID. NO. 27689 | 170-AspTyrAlaSerLeu-174 |
| SEQ. ID. NO. 27690 | 183-LeuAspLeuSerSerIleAlaLys-190 |
| SEQ. ID. NO. 27691 | 209-TyrLeuValGluIleGlyGly-215 |
| SEQ. ID. NO. 27692 | 314-GluThrGluAlaLeu-318 |
| SEQ. ID. NO. 27693 | 320-LeuAlaGluGlnGlu-324 |
| Antigenic Index - Jameson-Wolf | |
| SEQ. ID. NO. 27694 | 1-MetProSerGluThrArgLeuProAsnLeu-10 |
| SEQ. ID. NO. 27695 | 26-CysSerGluGlnThrAla-31 |
| SEQ. ID. NO. 27696 | 37-GlnGlyGluThrMetGly-42 |
| SEQ. ID. NO. 27697 | 49-TyrLeuSerAsnAsnArgAspLysLeuProSerProAlaLysIleGlnLysArgIleAspAspAlaLeuLysGluValAsnArgGlnMetSer-79 |
| SEQ. ID. NO. 27698 | 81-TyrGlnThrAspSerGluIleSerArgPheAsnGlnHisThrAlaGlyLysProLeuArgIleSerSerAspPhe-105 |
| SEQ. ID. NO. 27699 | 111-GluAlaValArgLeuAsnArg-117 |
| SEQ. ID. NO. 27700 | 135-GlyPheGlyProAspLysSerValThrArgGluProSerProGluGlnIleLysGln-153 |
| SEQ. ID. NO. 27701 | 164-IleLeuGlnGlnGlyLysAspTyrAlaSerLeuSerLysThrHisProLysAla-181 |
| SEQ. ID. NO. 27702 | 192-PheGlyValAspLysValAlaGlyGluLeuGluLysTyrGly-205 |
| SEQ. ID. NO. 27703 | 213-IleGlyGlyGluLeuHisGlyLysGlyLysAsnAlaHisGlyGluProTrpArgIleGlyIleGluGlnProAsn-237 |
| SEQ. ID. NO. 27704 | 250-LeuAsnAsnArgSerLeuAlaThrSerGlyAspTyrArg-262 |
| SEQ. ID. NO. 27705 | 264-PheHisValAspLysAsnGlyLysArgLeuSer-274 |
| SEQ. ID. NO. 27706 | 277-IleAsnProAsnAsnLysArgProIleSer-286 |
| SEQ. ID. NO. 27707 | 295-ValSerAspSerAlaMetThrAlaAspGlyLeuSer-306 |
| SEQ. ID. NO. 27708 | 314-GluThrGluAlaLeuArgLeuAlaGluGlnGluLys-325 |

TABLE 1-continued

| SEQ. ID. NO. 27709 | 332-ValArgAspLysAspGlyTyrArg-339 |
| SEQ. ID. NO. 27710 | 342-MetSerSerGluPhe-346 |

Hydrophilic Regions - Hopp-Woods

| SEQ. ID. NO. 27711 | 1-MetProSerGluThrArgLeu-7 |
| SEQ. ID. NO. 27712 | 26-CysSerGluGlnThrAla-31 |
| SEQ. ID. NO. 27713 | 51-SerAsnAsnArgAspLysLeuProSer-59 |
| SEQ. ID. NO. 27714 | 61-AlaLysIleGlnLysArgIleAspAspAlaLeuLysGluValAsnArgGln-77 |
| SEQ. ID. NO. 27715 | 82-GlnThrAspSerGluIleSerArg-89 |
| SEQ. ID. NO. 27716 | 97-LysProLeuArgIleSerSer-103 |
| SEQ. ID. NO. 27717 | 111-GluAlaValArgLeuAsnArg-117 |
| SEQ. ID. NO. 27718 | 137-GlyProAspLysSerValThrArgGluProSerProGluGlnIleLysGln-153 |
| SEQ. ID. NO. 27719 | 167-GlnGlyLysAspTyrAlaSer-173 |
| SEQ. ID. NO. 27720 | 175-SerLysThrHisPro-179 |
| SEQ. ID. NO. 27721 | 192-PheGlyValAspLysValAlaGlyGluLeuGluLysTyrGly-205 |
| SEQ. ID. NO. 27722 | 217-LeuHisGlyLysGlyLysAsnAlaHis-225 |
| SEQ. ID. NO. 27723 | 267-AspLysAsnGlyLysArgLeuSer-274 |
| SEQ. ID. NO. 27724 | 279-ProAsnAsnLysArgProIle-285 |
| SEQ. ID. NO. 27725 | 314-GluThrGluAlaLeuArgLeuAlaGluGlnGluLys-325 |
| SEQ. ID. NO. 27726 | 332-ValArgAspLysAspGlyTyrArg-339 | g117-1
AMPHI Regions - AMPHI

| SEQ. ID. NO. 27727 | 6-ProIleGlnAspThrGlnSerAla-13 |
| SEQ. ID. NO. 27728 | 15-LeuGlnGluLeuArgGluTrpPheAspSerTyrCysAla-27 |
| SEQ. ID. NO. 27729 | 57-GlyGluProLeuProAspHis-63 |
| SEQ. ID. NO. 27730 | 69-GlnMetValAspGluLeuAspLeuLeu-77 |
| SEQ. ID. NO. 27731 | 79-AspAlaValAlaAlaThrLeuLeuAlaAspIleGlyArgTyr-92 |
| SEQ. ID. NO. 27732 | 104-CysAsnSerThrValAlaGluLeuValLysGlyValAspGluValGlnLysLeuThrHisPheAlaArgValAspSerLeu-130 |
| SEQ. ID. NO. 27733 | 145-LysMetLeuLeuAlaMet-150 |
| SEQ. ID. NO. 27734 | 170-PheLeuSerAsnAlaProAspSerProGluLys-180 |
| SEQ. ID. NO. 27735 | 216-GluProGluLysTyrArg-221 |
| SEQ. ID. NO. 27736 | 234-ArgLeuGluTyrIleGluAsnPheLeuAspIleLeuArg-246 |
| SEQ. ID. NO. 27737 | 260-GlyArgProLysHisIleTyrSerIleTyrLys-270 |
| SEQ. ID. NO. 27738 | 282-LeuPheAspIleArg-286 |
| SEQ. ID. NO. 27739 | 290-IleLeuValAspThrValProGluCysTyrThrThrLeuGlyIleValHisSerLeuTrpGlnProIleProGlyGluPheAspAspTyrIleAla-321 |
| SEQ. ID. NO. 27740 | 327-GlyTyrLysSerLeuHisThr-333 |
| SEQ. ID. NO. 27741 | 351-AspMetHisGlnPheAsnGluPheGlyValAla-361 |
| SEQ. ID. NO. 27742 | 385-GlnLeuLeuAspTrp-389 |
| SEQ. ID. NO. 27743 | 440-HisSerSerIleGlyAspArg-446 |
| SEQ. ID. NO. 27744 | 489-ValLysSerGlyLysAlaIleGlyLysIleArgAlaTyr-501 |
| SEQ. ID. NO. 27745 | 504-GlnGlnAsnAlaAsp-508 |
| SEQ. ID. NO. 27746 | 521-GlnLeuAlaLysLeu-525 |
| SEQ. ID. NO. 27747 | 532-GlnGluLeuAlaGlu-536 |
| SEQ. ID. NO. 27748 | 539-GlyTyrLysLysProGluAspLeuTyrThr-548 |
| SEQ. ID. NO. 27749 | 557-AsnArgAlaIleGlnLysAlaCysGlyThrLeuAsnGluProPro-571 |
| SEQ. ID. NO. 27750 | 585-LysIleLysLysGlyGly-590 |
| SEQ. ID. NO. 27751 | 603-MetThrThrLeuAlaLysCysCysLysProAlaProProAspAspIleAlaGly-620 |
| SEQ. ID. NO. 27752 | 637-SerPheArgHisLeuAlaGluHisAlaProGluLysValLeuAspAla-652 |
| SEQ. ID. NO. 27753 | 679-ArgAspValSerAspAla-684 |
| SEQ. ID. NO. 27754 | 714-GlnValAsnAspLeuProArgValLeuAlaGlyLeuGlyAspValLysGlyValLeuSerValThrArg-736 |

Antigenic I Index - Jameson-Wolf

| SEQ. ID. NO. 27755 | 5-SerProIleGlnAspThrGlnSerAlaThr-14 |
| SEQ. ID. NO. 27756 | 16-GlnGluLeuArgGluTrpPheAspSerTyrCysAlaAlaLeuProAspAsnAspLysAsnLeu-36 |
| SEQ. ID. NO. 27757 | 46-GluHisTyrProAla-50 |
| SEQ. ID. NO. 27758 | 52-AlaAlaThrProTyrGlyGluProLeuProAspHisPhe-64 |
| SEQ. ID. NO. 27759 | 70-MetValAspGluLeuAspLeuLeuPro-78 |
| SEQ. ID. NO. 27760 | 88-AspIleGlyArgTyrValProAspTrp-96 |
| SEQ. ID. NO. 27761 | 100-ValSerGluArgCysAsnSerThrVal-108 |
| SEQ. ID. NO. 27762 | 110-GluLeuValLysGlyValAspGluValGlnLys-120 |
| SEQ. ID. NO. 27763 | 125-AlaArgValAspSerLeuAlaThrProGluGluArgAlaGlnGlnAlaGluThrMetArg-144 |
| SEQ. ID. NO. 27764 | 162-AlaMetArgThrArgThr-167 |
| SEQ. ID. NO. 27765 | 173-AsnAlaProAspSerProGluLysArgAlaValAlaLysGluThrLeu-188 |
| SEQ. ID. NO. 27766 | 209-AspLeuGlyPheArgHisGlnGluProGluLysTyrArgGlu-222 |
| SEQ. ID. NO. 27767 | 227-LeuAspGluLysArgThrArgLeuGluTyr-237 |
| SEQ. ID. NO. 27768 | 245-LeuArgThrGluLeuLysLys-251 |
| SEQ. ID. NO. 27769 | 258-ValAlaGlyArgProLysHis-264 |
| SEQ. ID. NO. 27770 | 271-LysMetValLysLysLysLeuSerPhe-279 |
| SEQ. ID. NO. 27771 | 294-ThrValProGluCysTyr-299 |
| SEQ. ID. NO. 27772 | 311-ProIleProGlyGluPheAspAspTyrIleAlaAsnProLysGlyAsnGlyTyrLysSer-330 |
| SEQ. ID. NO. 27773 | 335-IleValGlyProGluGluLysGlyValGluValGlnIleArgThr-349 |
| SEQ. ID. NO. 27774 | 364-TrpArgTyrLysGluGlyGlyLysGlyAspSerAlaTyrGluGlnLys-379 |
| SEQ. ID. NO. 27775 | 387-LeuAspTrpArgGluAsnMetAlaGluSerGlyLysGluAspLeuAlaAla-403 |
| SEQ. ID. NO. 27776 | 418-ThrProHisGlyLys-422 |
| SEQ. ID. NO. 27777 | 440-HisSerSerIleGlyAspArgCysArgGlyAlaLysValGluGly-454 |
| SEQ. ID. NO. 27778 | 461-ThrProLeuGluAsnGlyGlnArgValGluIleIleThrAlaLysGluGlyHisProSerValAsn-482 |
| SEQ. ID. NO. 27779 | 487-GlyTrpValLysSerGlyLysAlaIleGlyLys-497 |
| SEQ. ID. NO. 27780 | 502-IleArgGlnGlnAsnAlaAspThrValArgGluGluGlyArgValGlnLeuAspLysGlnLeuAla-523 |
| SEQ. ID. NO. 27781 | 525-LeuThrProLysProAsnLeuGlnGluLeuAlaGlu-536 |
| SEQ. ID. NO. 27782 | 538-LeuGlyTyrLysLysProGluAspLeu-546 |
| SEQ. ID. NO. 27783 | 551-GlyGlnGlyGluIleSerAsnArgAlaIleGlnLysAlaCysGlyThrLeuAsnGluProProProVal-573 |
| SEQ. ID. NO. 27784 | 582-LysGlnSerLysIleLysLysGlyGlyLysThr-592 |

TABLE 1-continued

| | |
|---|---|
| SEQ. ID. NO. 27785 | 596-IleAspGlyGluAspGlyLeu-602 |
| SEQ. ID. NO. 27786 | 608-LysCysCysLysProAlaProProAspAspIleAla-619 |
| SEQ. ID. NO. 27787 | 622-ValThrArgGluArgGlyIleSerValHisArgLysThrCysProSerPhe-638 |
| SEQ. ID. NO. 27788 | 644-HisAlaProGluLysValLeuAsp-651 |
| SEQ. ID. NO. 27789 | 667-IleGluIleArgAlaGlnAspArgSerGlyLeuLeuArgAspValSerAspAlaLeuAlaArgHisLysLeu-690 |
| SEQ. ID. NO. 27790 | 696-GlnThrGlnSerArgAspLeuGluAlaSerMet-706 |
| SEQ. ID. NO. 27791 | 710-LeuGluValLysGlnValAsnAspLeuProArg-720 |
| SEQ. ID. NO. 27792 | 726-GlyAspValLysGly-730 |

Hydrophilic Regions - Hopp-Woods

| | |
|---|---|
| SEQ. ID. NO. 27793 | 8-GlnAspThrGlnSer-12 |
| SEQ. ID. NO. 27794 | 16-GlnGluLeuArgGluTrpPhe-22 |
| SEQ. ID. NO. 27795 | 30-ProAspAsnAspLysAsnLeu-36 |
| SEQ. ID. NO. 27796 | 70-MetValAspGluLeuAspLeuLeuPro-78 |
| SEQ. ID. NO. 27797 | 100-ValSerGluArgCysAsnSerThr-107 |
| SEQ. ID. NO. 27798 | 110-GluLeuValLysGlyValAspGluValGlnLys-120 |
| SEQ. ID. NO. 27799 | 125-AlaArgValAspSer-129 |
| SEQ. ID. NO. 27800 | 131-AlaThrProGluGluArgAlaGlnGlnAlaGluThrMetArg-144 |
| SEQ. ID. NO. 27801 | 162-AlaMetArgThrArgThr-167 |
| SEQ. ID. NO. 27802 | 174-AlaProAspSerProGluLysArgAlaValAlaLysGluThrLeu-188 |
| SEQ. ID. NO. 27803 | 209-AspLeuGlyPheArgHisGlnGluProGluLysTyrArgGlu-222 |
| SEQ. ID. NO. 27804 | 227-LeuArgGluLysArgThrGluArgLeuGluTyr-237 |
| SEQ. ID. NO. 27805 | 245-LeuArgThrGluLeuLysLys-251 |
| SEQ. ID. NO. 27806 | 258-ValAlaGlyArgProLysHis-264 |
| SEQ. ID. NO. 27807 | 271-LysMetValLysLysLysLeuSerPhe-279 |
| SEQ. ID. NO. 27808 | 314-GlyGluPheAspAsp-318 |
| SEQ. ID. NO. 27809 | 323-ProLysGlyAsnGly-327 |
| SEQ. ID. NO. 27810 | 337-GlyProGluGluLysGlyValGluValGlnIleArgThr-349 |
| SEQ. ID. NO. 27811 | 365-ArgTyrLysGluGlyGlyLysGlyAspSerAlaTyrGluGln-378 |
| SEQ. ID. NO. 27812 | 387-LeuAspTrpArgGluAsnMetAlaGluSerGlyLysGluAspLeuAlaAla-403 |
| SEQ. ID. NO. 27813 | 443-IleGlyAspArgCysArgGlyAlaLysValGluGly-454 |
| SEQ. ID. NO. 27814 | 463-LeuGluAsnGlyGlnArgValGluIleIleThrAlaLysGluGlyHisPro-479 |
| SEQ. ID. NO. 27815 | 489-ValLysSerGlyLysAlaIleGlyLys-497 |
| SEQ. ID. NO. 27816 | 505-GlnAsnAlaAspThrValArgGluGluGlyArgValGlnLeuAspLysGlnLeuAla-523 |
| SEQ. ID. NO. 27817 | 538-LeuGlyTyrLysLysProGluAspLeu-546 |
| SEQ. ID. NO. 27818 | 553-GlyGluIleSerAsn-557 |
| SEQ. ID. NO. 27819 | 582-LysGlnSerLysIleLysLysGlyGlyLys-591 |
| SEQ. ID. NO. 27820 | 596-IleAspGlyGluAspGlyLeu-602 |
| SEQ. ID. NO. 27821 | 608-LysCysCysLysProAlaProProAspAspIle-618 |
| SEQ. ID. NO. 27822 | 622-ValThrArgGluArgGlyIleSerValHisArgLysThrCysPro-636 |
| SEQ. ID. NO. 27823 | 644-HisAlaProGluLysValLeu-650 |
| SEQ. ID. NO. 27824 | 667-IleGluIleArgAlaGlnAspArgSerGlyLeuLeuArgAspValSerAspAlaLeuAlaArgHisLysLeu-690 |
| SEQ. ID. NO. 27825 | 697-ThrGlnSerArgAspLeuGluAlaSerMet-706 |
| SEQ. ID. NO. 27826 | 710-LeuGluValLysGlnValAsnAspLeuProArg-720 |
| SEQ. ID. NO. 27827 | 726-GlyAspValLysGly-730 | g118
AMPHI Regions - AMPHI

| | |
|---|---|
| SEQ. ID. NO. 27828 | 24-GlyLysTrpTyrAsp-28 |
| SEQ. ID. NO. 27829 | 57-IleProArgAspIle-61 |
| SEQ. ID. NO. 27830 | 65-IleGlyThrIleIleAspPheLeuMetValProAsn-76 |
| SEQ. ID. NO. 27831 | 94-IleHisGluArgTyrGluArgPheThrThrMetLeuArg-106 |

Antigenic Index - Jameson-Wolf

| | |
|---|---|
| SEQ. ID. NO. 27832 | 2-CysGluPheLysAspPheArgArgAsnIleProCys-13 |
| SEQ. ID. NO. 27833 | 15-GluGluTyrAspGluAsnSerPhe-22 |
| SEQ. ID. NO. 27834 | 24-GlyLysTrpTyrAspAspGlyValTrpAspAspGluGluTyrTrpLysLeuGluAsnAspLeuIleGluValArgArgLysTyrProTyrPro<br>MetAspIleProArgAspIle-61 |
| SEQ. ID. NO. 27835 | 86-ProTrpLeuProAspSerValGlyIleHisGluArgTyrGluArg-100 |
| SEQ. ID. NO. 27836 | 109-PheThrGluLysAspIleVal-115 |
| SEQ. ID. NO. 27837 | 119-PheAspTyrTyrAsnLysLys-125 |

Hydrophilic Regions - Hopp-Woods

| | |
|---|---|
| SEQ. ID. NO. 27838 | 2-CysGluPheLysAspPheArgArgAsnIleProCys-13 |
| SEQ. ID. NO. 27839 | 15-GluGluTyrAspGlu-19 |
| SEQ. ID. NO. 27840 | 30-GlyValTrpAspAspGluGluTyrTrpLysLeuGluAsnAspLeuIleGluValArgArgLysTyrProTyr-53 |
| SEQ. ID. NO. 27841 | 96-GluArgTyrGluArg-100 |
| SEQ. ID. NO. 27842 | 109-PheThrGluLysAspIleVal-115 |
| SEQ. ID. NO. 27843 | 121-TyrTyrAsnLysLys-125 | g120
AMPHI Regions - AMPHI

| | |
|---|---|
| SEQ. ID. NO. 27844 | 6-LysAsnIlePheSerAla-11 |
| SEQ. ID. NO. 27845 | 49-SerGlyAsnAlaTyrLysIleValSerThrIleLys-60 |
| SEQ. ID. NO. 27846 | 77-AsnThrLeuHisProAlaTyrTyrLysAspIleArgArg-89 |
| SEQ. ID. NO. 27847 | 142-IleThrAsnGlyLysLysLeuTyrSerValGlyGlyLeuAsnLysAlaGly-158 |
| SEQ. ID. NO. 27848 | 188-AlaProSerLeuAsnAsnIleProAla-196 |

Antigenic Index - Jameson-Wolf

| | |
|---|---|
| SEQ. ID. NO. 27849 | 35-SerGlySerTyrGly-39 |
| SEQ. ID. NO. 27850 | 45-ThrPheGluArgSerGlyAsnAlaTyrLys-54 |
| SEQ. ID. NO. 27851 | 68-PheGluSerGlyGlyThrValVal-75 |
| SEQ. ID. NO. 27852 | 83-TyrTyrLysAspIleArgArgGlyLysLeuTyrAla-94 |
| SEQ. ID. NO. 27853 | 97-LysPheAlaAspGlySerValThrTyrGlyLysAlaGlyGluSerLysThrGluGlnSerProLysAla-119 |
| SEQ. ID. NO. 27854 | 131-AlaAsnAspAlaLysLeuProProGlyLeuLysIleThrAsnGlyLysLysLeuTyrSer-150 |
| SEQ. ID. NO. 27855 | 153-GlyLeuAsnLysAlaGlyThrGlyLysTyrSerIleGlyGlyValGluThrGluValLysTyrArgValArgArgGlyAspAspThrVal-183 |

TABLE 1-continued

| | |
|---|---|
| SEQ. ID. NO. 27856 | 199-GlyTyrThrAspAspGlyLysThrTyr-207 |
| SEQ. ID. NO. 27857 | 218-GlyGlnAlaAlaLysPro-223 |
| Hydrophilic Regions - Hopp-Woods | |
| SEQ. ID. NO. 27858 | 45-ThrPheGluArgSerGlyAsn-51 |
| SEQ. ID. NO. 27859 | 85-LysAspIleArgArgGlyLysLeuTyrAla-94 |
| SEQ. ID. NO. 27860 | 107-LysAlaGlyGluSerLysThrGluGlnSerProLysAla-119 |
| SEQ. ID. NO. 27861 | 131-AlaAsnAspAlaLysLeu-136 |
| SEQ. ID. NO. 27862 | 143-ThrAsnGlyLysLysLeuTyr-149 |
| SEQ. ID. NO. 27863 | 155-AsnLysAlaGlyThrGly-160 |
| SEQ. ID. NO. 27864 | 167-ValGluThrGluValValLysTyrArgValArgArgGlyAspAspThr-182 |
| SEQ. ID. NO. 27865 | 200-TyrThrAspAspGlyLysThrTyr-207 |
| SEQ. ID. NO. 27866 | 219-GlnAlaAlaLysPro-223 |
| g121-1 | |
| AMPHI Regions - AMPHI | |
| SEQ. ID. NO. 27867 | 40-ProTyrProAspArgLeuArgArgLysLeu-49 |
| SEQ. ID. NO. 27868 | 68-GlnGluLeuSerArgLeuTyrAlaGlnThr-77 |
| SEQ. ID. NO. 27869 | 101-ThrValArgHisAlaPro-106 |
| SEQ. ID. NO. 27870 | 117-LeuProLeuLeuAlaGluLeuThrArgIlePheThrValGly-130 |
| SEQ. ID. NO. 27871 | 148-ProAlaPheHisGlu-152 |
| SEQ. ID. NO. 27872 | 167-IleGlyGlyIleAlaAsnIleSerVal-175 |
| SEQ. ID. NO. 27873 | 189-ProGlyAsnMetLeuMetAspAlaTrpThr-198 |
| SEQ. ID. NO. 27874 | 216-GlyAsnIleLeuProGlnLeuLeuGlyArgLeuLeuAlaHisPro-230 |
| SEQ. ID. NO. 27875 | 236-HisProLysSerThrGly-241 |
| SEQ. ID. NO. 27876 | 251-GluThrTyrLeuAsp-255 |
| SEQ. ID. NO. 27877 | 262-AspValLeuArgThrLeuSerArgPheThrAlaGlnThrValTrpAspAlaValSerHis-281 |
| SEQ. ID. NO. 27878 | 303-AlaAspLeuAlaGluCysPhe-309 |
| SEQ. ID. NO. 27879 | 341-IleAsnArgIleProGlySerPro-348 |
| Antigenic Index - Jameson-Wolf | |
| SEQ. ID. NO. 27880 | 13-ThrSerMetAspGlyAlaAsp-19 |
| SEQ. ID. NO. 27881 | 23-ValArgMetAspGlyGlyLysTrpLeuGly-32 |
| SEQ. ID. NO. 27882 | 40-ProTyrProAspArgLeuArgArgLysLeuLeuAspLeuGlnAspThrGlyThrAspGluLeuHisArgSerArgMetLeuSer-67 |
| SEQ. ID. NO. 27883 | 85-GlnAsnLeuAlaProCysAsp-91 |
| SEQ. ID. NO. 27884 | 97-CysHisGlyGlnThrValArgHisAlaProGluHisGlyTyrSer-111 |
| SEQ. ID. NO. 27885 | 128-ThrValGlyAspPheArgSerArgAspLeuAlaAlaGlyGlyGlnGly-143 |
| SEQ. ID. NO. 27886 | 154-LeuPheArgAspAspArgGluThrArgVal-163 |
| SEQ. ID. NO. 27887 | 186-AspThrGlyProGlyAsnMet-192 |
| SEQ. ID. NO. 27888 | 205-ProTyrAspLysAsnGlyAlaLysAlaAlaGlnGlyAsn-217 |
| SEQ. ID. NO. 27889 | 235-ProHisProLysSerThrGlyArgGlu-243 |
| SEQ. ID. NO. 27890 | 253-TyrLeuAspGlyGlyGluAsnArgTyrAspValLeuArgThrLeuSer-268 |
| SEQ. ID. NO. 27891 | 283-AlaAlaAspAlaArgGln-288 |
| SEQ. ID. NO. 27892 | 293-GlyGlyGlyIleArgAsnProValLeu-301 |
| SEQ. ID. NO. 27893 | 344-IleProGlySerProHisLysAlaThrGlyAlaSerLysProCysIle-359 |
| Hydrophilic Regions - Hopp-Woods | |
| SEQ. ID. NO. 27894 | 13-ThrSerMetAspGlyAlaAsp-19 |
| SEQ. ID. NO. 27895 | 41-TyrProAspArgLeuArgArgLysLeuLeuAspLeuGlnAspThrGlyThrAspGluLeuHisArgSerArgMetLeuSer-67 |
| SEQ. ID. NO. 27896 | 101-ThrValArgHisAlaPro-106 |
| SEQ. ID. NO. 27897 | 131-AspPheArgSerArgAspLeuAlaAla-139 |
| SEQ. ID. NO. 27898 | 154-LeuPheArgAspAspArgGluThrArgVal-163 |
| SEQ. ID. NO. 27899 | 206-TyrAspLysAsnGlyAlaLysAlaAlaGln-215 |
| SEQ. ID. NO. 27900 | 235-ProHisProLysSerThrGlyArgGlu-243 |
| SEQ. ID. NO. 27901 | 254-LeuAspGlyGlyGluAsnArgTyrAspVal-263 |
| SEQ. ID. NO. 27902 | 283-AlaAlaAspAlaArgGln-288 |
| SEQ. ID. NO. 27903 | 345-ProGlySerProHisLysAlaThrGlyAlaSerLys-356 |
| g122-1 | |
| AMPHI Regions - AMPHI | |
| SEQ. ID. NO. 27904 | 6-AsnIleHisLysThrPhe-11 |
| SEQ. ID. NO. 27905 | 42-ThrPheLeuArgCysLeuAsnAlaLeuGluMetProGlu-54 |
| SEQ. ID. NO. 27906 | 102-LeuGluAsnValMetGlu-107 |
| SEQ. ID. NO. 27907 | 126-LysLeuLeuGluLys-130 |
| SEQ. ID. NO. 27908 | 176-ProGluLeuValGlnAspValLeuAspAlaMetLysGluLeuAlaArgGluGly-193 |
| SEQ. ID. NO. 27909 | 227-ProLysGluLeuPheAspHisLeuLysHisGlu-237 |
| Antigenic Index - Jameson-Wolf | |
| SEQ. ID. NO. 27910 | 5-ArgAsnIleHisLysThrPheGlyGluAsnThrIle-16 |
| SEQ. ID. NO. 27911 | 20-IleAspLeuAspValGlyLysGlyGln-28 |
| SEQ. ID. NO. 27912 | 34-GlyProSerGlySerGlyLysThrThr-42 |
| SEQ. ID. NO. 27913 | 51-GluMetProGluAspGlyGlnIleGluPheAspAsnAlaArgProLeuArgIleAspPheSerLysLysThrSerLysHisAsp-78 |
| SEQ. ID. NO. 27914 | 81-AlaLeuArgArgLysSerGlyMet-88 |
| SEQ. ID. NO. 27915 | 96-PheProHisLysThrValLeu-102 |
| SEQ. ID. NO. 27916 | 114-GlyLysProAlaAlaGlnAlaArgGluGluAlaLeuLysLeuLeuGlu-129 |
| SEQ. ID. NO. 27917 | 131-ValGlyLeuGlyAspLysValAspLeuTyr-140 |
| SEQ. ID. NO. 27918 | 142-TyrGlnLeuSerGlyGlyGlnGlnArgValGlyIle-154 |
| SEQ. ID. NO. 27919 | 168-AspGluProThrSerAlaLeuAspProGluLeuVal-179 |
| SEQ. ID. NO. 27920 | 182-ValLeuAspAlaMetLysGluLeuAlaArgGluGlyTrp-194 |
| SEQ. ID. NO. 27921 | 216-MetAspGlyGlyVal-220 |
| SEQ. ID. NO. 27922 | 222-ValGluGlnGlSerProLysGluLeuPheAsp-232 |
| SEQ. ID. NO. 27923 | 234-LeuLysHisGluArgThrArgArgPheLeu-243 |
| Hydrophilic Regions - Hopp-Woods | |
| SEQ. ID. NO. 27924 | 20-IleAspLeuAspValGlyLys-26 |
| SEQ. ID. NO. 27925 | 51-GluMetProGluAspGlyGlnIleGluPheAspAsnAlaArgProLeuArgIleAspPheSerLysLysThrSerLysHisAsp-78 |
| SEQ. ID. NO. 27926 | 81-AlaLeuArgArgLysSerGly-87 |

TABLE 1-continued

| | |
|---|---|
| SEQ. ID. NO. 27927 | 114-GlyLysProAlaAlaGlnAlaArgGluGluAlaLeuLysLeuLeuGlu-129 |
| SEQ. ID. NO. 27928 | 131-ValGlyLeuGlyAspLysValAsp-138 |
| SEQ. ID. NO. 27929 | 168-AspGluProThrSerAlaLeuAspProGluLeuVal-179 |
| SEQ. ID. NO. 27930 | 182-ValLeuAspAlaMetLysGluLeuAlaArg-191 |
| SEQ. ID. NO. 27931 | 224-GlnGlySerProLysGluLeuPheAsp-232 |
| SEQ. ID. NO. 27932 | 234-LeuLysHisGluArgThrArgArgPheLeu-243 | g126-1
AMPHI Regions - AMPHI

| | |
|---|---|
| SEQ. ID. NO. 27933 | 26-LeuLysGlnSerValArg-31 |
| SEQ. ID. NO. 27934 | 73-GlyCysGlnSerValGlnGluAla-80 |
| SEQ. ID. NO. 27935 | 112-PheGlnLeuValGluAla-117 |
| SEQ. ID. NO. 27936 | 143-LeuAspAlaGlyCysGln-148 |
| SEQ. ID. NO. 27937 | 150-LeuMetProTrpAlaAlaProIleGlyThrGlyLeuGlyAlaVal-164 |
| SEQ. ID. NO. 27938 | 213-SerGlyAspProValAsnMetAlaArgAlaPhe-223 |

Antigenic Index - Jameson-Wolf

| | |
|---|---|
| SEQ. ID. NO. 27939 | 7-GluThrPheProSerArgLeu-13 |
| SEQ. ID. NO. 27940 | 24-GluIleLeuLysGlnSerValArgThrAlaArg-34 |
| SEQ. ID. NO. 27941 | 41-SerLeuArgArgThrGlyCysGlyGlyGluAlaHisGlyGlnGlyPhe-56 |
| SEQ. ID. NO. 27942 | 85-GlnMetAlaArgGluValPheGlu-92 |
| SEQ. ID. NO. 27943 | 99-GluLeuIleGlyAspAspAspThrLeuGln-108 |
| SEQ. ID. NO. 27944 | 121-LeuIleLysAspGlyPheLysValLeu-129 |
| SEQ. ID. NO. 27945 | 141-ArgLeuLeuAspAlaGlyCys-147 |
| SEQ. ID. NO. 27946 | 171-IleLeuArgGluArgLeuProAspThrProLeu-181 |
| SEQ. ID. NO. 27947 | 209-AlaValSerArgSerGlyAspProValAsn-218 |
| SEQ. ID. NO. 27948 | 228-GluSerGlyArgLeuAlaPhe-234 |
| SEQ. ID. NO. 27949 | 237-GlyProValGluAlaArghrLysAlaGlnAlaSerThrProThrVal-252 |

Hydrophilic Regions - Hopp-Woods

| | |
|---|---|
| SEQ. ID. NO. 27950 | 24-GluIleLeuLysGlnSerValArgThrAlaArg-34 |
| SEQ. ID. NO. 27951 | 41-SerLeuArgArgThrGlyCysGlyGlyGluAlaHis-52 |
| SEQ. ID. NO. 27952 | 85-GlnMetAlaArgGluValPheGlu-92 |
| SEQ. ID. NO. 27953 | 100-LeuIleGlyAspAspAspThrLeuGln-108 |
| SEQ. ID. NO. 27954 | 171-IleLeuArgGluArgLeuProAsp-178 |
| SEQ. ID. NO. 27955 | 210-ValSerArgSerGlyAspPro-216 |
| SEQ. ID. NO. 27956 | 228-GluSerGlyArgLeuAlaPhe-234 |
| SEQ. ID. NO. 27957 | 237-GlyProValGluAlaArgThrLysAlaGlnAla-247 | g127
AMPHI Regions - AMPHI

| | |
|---|---|
| SEQ. ID. NO. 27958 | 6-MetLeuAsnThrTrpProAsp-12 |
| SEQ. ID. NO. 27959 | 22-GluSerValAlaAla-26 |
| SEQ. ID. NO. 27960 | 119-ValGlyAspTyrIleGluIle-125 |
| SEQ. ID. NO. 27961 | 135-IleAsnLeuLeuAsnThrLeuMet-142 |
| SEQ. ID. NO. 27962 | 147-ProAsnProLeuValGlyGlnLeuAla-155 |
| SEQ. ID. NO. 27963 | 206-LeuGluProLeuCysAlaPro-212 |
| SEQ. ID. NO. 27964 | 214-IleProAlaIleGlnArgTyrLeuGluAsnValGln-225 |
| SEQ. ID. NO. 27965 | 250-ArgIleIleValArgPheAlaSerProVal-259 |
| SEQ. ID. NO. 27966 | 268-AlaValMetAspGluPheLeuArgVal-276 |

Antigenic Index - Jameson-Wolf

| | |
|---|---|
| SEQ. ID. NO. 27967 | 14-ValProIleArgAlaGluAlaAlaGlu-22 |
| SEQ. ID. NO. 27968 | 41-HisPheArgArgHisProAspPheGlyIleGluSerLysArgArgPheLeuVal-58 |
| SEQ. ID. NO. 27969 | 112-SerAlaThrGlnGlnTyrSerVal-119 |
| SEQ. ID. NO. 27970 | 126-AsnGlyLeuArgGlyArgValValAsp-134 |
| SEQ. ID. NO. 27971 | 169-HisProValArgArgAspAsnIleLeu-177 |
| SEQ. ID. NO. 27972 | 193-LeuAspSerAspGluAlaValCysArg-201 |
| SEQ. ID. NO. 27973 | 234-AlaAlaArgProArgValThrArgValProTyrAspAspLysAlaTyr-249 |
| SEQ. ID. NO. 27974 | 257-SerProValSerLysArgLeuGluIle-265 |
| SEQ. ID. NO. 27975 | 282-AsnHisProAlaGlySerGluThrLeu-290 |

Hydrophilic Regions - Hopp-Woods

| | |
|---|---|
| SEQ. ID. NO. 27976 | 14-ValProIleArgAlaGluAlaAlaGlu-22 |
| SEQ. ID. NO. 27977 | 42-PheArgArgHisProAspPheGlyIleGluSerLysArgArgPheLeuVal-58 |
| SEQ. ID. NO. 27978 | 126-AsnGlyLeuArgGlyArgValVal-133 |
| SEQ. ID. NO. 27979 | 170-ProValArgArgAspAsnIleLeu-177 |
| SEQ. ID. NO. 27980 | 193-LeuAspSerAspGluAlaValCysArg-201 |
| SEQ. ID. NO. 27981 | 235-AlaArgProArgValThrArgValProTyrAspAspLysAlaTyr-249 |
| SEQ. ID. NO. 27982 | 259-ValSerLysArgLeuGluIle-265 |
| SEQ. ID. NO. 27983 | 285-AlaGlySerGluThrLeu-290 | g128-2
AMPHI Regions - AMPHI

| | |
|---|---|
| SEQ. ID. NO. 27984 | 43-AlaGlnThrHisThrGlyTrpAlaAsnThrValGluArgLeuThrGlyIleThrGluArgValGlyArgIleTrpGlyValValSerHisLeuAsnSerValVal-77 |
| SEQ. ID. NO. 27985 | 85-ValTyrAsnGluLeuMetProGluIle-93 |
| SEQ. ID. NO. 27986 | 102-GlnAspIleGluLeuTyrAsnArgPheLysThrIleLysAsnSerProGlu-118 |
| SEQ. ID. NO. 27987 | 166-PheSerGlnAsnValLeuAspAlaThrAsp-175 |
| SEQ. ID. NO. 27988 | 189-GlyIleProGluAspAla-194 |
| SEQ. ID. NO. 27989 | 218-HisTyrLeuAlaVal-222 |
| SEQ. ID. NO. 27990 | 231-LeuArgGluGlnIleTyr-236 |
| SEQ. ID. NO. 27991 | 245-GluLeuSerAsnAspGlyLysPheAspAsnThrAlaAsnIleAspArgThrLeuGluAsnAlaLeuLysThrAlaLysLeuLeuGlyPheLysAsnTyrAlaGlu-279 |
| SEQ. ID. NO. 27992 | 286-MetAlaAspThrProGluGlnValLeuAsnPheLeuHisAspLeuAlaArgArgAla-304 |
| SEQ. ID. NO. 27993 | 313-AlaGluValLysAlaPhe-318 |
| SEQ. ID. NO. 27994 | 360-LysValLeuAlaGlyLeuPheAlaGlnIleLysLysLeuTyrGly-374 |

TABLE 1-continued

| SEQ. ID. NO. | Sequence |
|---|---|
| SEQ. ID. NO. 27995 | 472-LeuHisHisLeuLeuThrGlnValAspGluLeu-482 |
| SEQ. ID. NO. 27996 | 496-GluLeuProSerGlnPhe-501 |
| SEQ. ID. NO. 27997 | 522-GlyGluProLeuProLysGluLeuPheAspLys-532 |
| SEQ. ID. NO. 27998 | 570-TrpGlnGlnValLeuAspSerVal-577 |
| SEQ. ID. NO. 27999 | 584-IleGlnProProGluTyrAsnArgPheAlaAsnSerPheGlyHisIlePheAlaGlyGly-603 |
| SEQ. ID. NO. 28000 | 610-SerTyrAlaTrpAlaGlu-615 |
| SEQ. ID. NO. 28001 | 623-AlaAlaPheGluGluSerAspAsp-630 |
| SEQ. ID. NO. 28002 | 636-LysArgPheTrpGlnGluIleLeuAla-644 |
| SEQ. ID. NO. 28003 | 651-AlaAlaGluSerPheLysAlaPheArg-659 |

Antigenic Index - Jameson-Wolf

| SEQ. ID. NO. | Sequence |
|---|---|
| SEQ. ID. NO. 28004 | 9-LeuGlyGluGluProArgPheAsnGlnIleLysThrGluAspIleLysProAlaVal-27 |
| SEQ. ID. NO. 28005 | 32-AlaGluAlaArgGly-36 |
| SEQ. ID. NO. 28006 | 43-AlaGlnThrHisThrGlyTrp-49 |
| SEQ. ID. NO. 28007 | 52-ThrValGluArgLeuThrGlyIleThrGluArgValGlyArgIleTrp-67 |
| SEQ. ID. NO. 28008 | 77-ValAspThrProGluLeu-82 |
| SEQ. ID. NO. 28009 | 100-IleGlyGlnAspIleGluLeuTyrAsnArgPheLysThrIleLysAsnSerProGluPhe-119 |
| SEQ. ID. NO. 28010 | 123-SerProAlaGlnLysThrLysLeuAspHisAspLeuArgAsp-136 |
| SEQ. ID. NO. 28011 | 140-SerGlyAlaGluLeuProProGluArgGlnAlaGluLeuAlaLysLeuGlnThrGluGlyAlaGlnLeu-162 |
| SEQ. ID. NO. 28012 | 165-LysPheSerGlnAsnVal-170 |
| SEQ. ID. NO. 28013 | 172-AspAlaThrAspAla-176 |
| SEQ. ID. NO. 28014 | 190-IleProGluAspAla-194 |
| SEQ. ID. NO. 28015 | 202-AlaGlnSerGluGlyLysThrGlyTyrLys-211 |
| SEQ. ID. NO. 28016 | 225-TyrAlaGlyAsnArgGluLeuArgGluGlnIle-235 |
| SEQ. ID. NO. 28017 | 242-ArgAlaSerGluLeuSerAsnAspGlyLysPheAspAsnThrAlaAsnIleAspArgThrLeuGluAsnAlaLeuLysThr-268 |
| SEQ. ID. NO. 28018 | 285-LysMetAlaAspThrProGluGln-292 |
| SEQ. ID. NO. 28019 | 300-LeuAlaArgArgAlaLysProTyrAlaGluLysAspLeuAlaGlu-314 |
| SEQ. ID. NO. 28020 | 316-LysAlaPheAlaArgGluHisLeuGlyLeuAlaAspProGlnProTrpAspLeu-333 |
| SEQ. ID. NO. 28021 | 335-TyrAlaGlyGluLysLeuArgGluAlaLysTyrAlaPheSerGluThrGluValLysLys-354 |
| SEQ. ID. NO. 28022 | 377-PheAlaGluLysThr-381 |
| SEQ. ID. NO. 28023 | 387-LysAspValArgTyrPheGluLeuGlnGlnAsnGlyLysThrIle-401 |
| SEQ. ID. NO. 28024 | 409-TyrAlaArgGluGlyLysArgGlyGlyAla-418 |
| SEQ. ID. NO. 28025 | 420-MetAsnAspTyrLysGlyArgArgArgPheAlaAspGlyThrLeu-434 |
| SEQ. ID. NO. 28026 | 447-ProProValGlyGlyLysGluAlaArgLeuSerHisAspGlu-460 |
| SEQ. ID. NO. 28027 | 478-GlnValAspGluLeuGlyVal-484 |
| SEQ. ID. NO. 28028 | 496-GluLeuProSerGln-500 |
| SEQ. ID. NO. 28029 | 516-SerAlaHisGluGluThrGlyGluProLeuPro-526 |
| SEQ. ID. NO. 28030 | 560-SerGluSerAspGluCysArgLeuLysAsn-569 |
| SEQ. ID. NO. 28031 | 575-AspSerValArgLysGluValAla-582 |
| SEQ. ID. NO. 28032 | 585-GlnProProGluTyrAsnArgPheAlaAsnSerPheGly-597 |
| SEQ. ID. NO. 28033 | 605-SerAlaGlyTyrTyrSerTyr-611 |
| SEQ. ID. NO. 28034 | 625-PheGluGluSerAspAspValAlaAlaThrGlyLysArgPheTrp-639 |
| SEQ. ID. NO. 28035 | 646-GlyGlySerArgSerAlaAlaGluSerPheLysAlaPheArgGlyArgGluProSerIle-665 |
| SEQ. ID. NO. 28036 | 669-LeuArgHisSerGlyPheAspAsnAlaAla-678 |

Hydrophilic Regions - Hopp-Woods

| SEQ. ID. NO. | Sequence |
|---|---|
| SEQ. ID. NO. 28037 | 9-LeuGlyGluGluProArgPheAsnGlnIleLysThrGluAspIleLysPro-25 |
| SEQ. ID. NO. 28038 | 32-AlaGluAlaArgGly-36 |
| SEQ. ID. NO. 28039 | 52-ThrValGluArgLeuThrGlyIleThrGluArgValGly-64 |
| SEQ. ID. NO. 28040 | 77-ValAspThrProGluLeu-82 |
| SEQ. ID. NO. 28041 | 100-IleGlyGlnAspIleGluLeu-106 |
| SEQ. ID. NO. 28042 | 111-LysThrIleLysAsnSerProGlu-118 |
| SEQ. ID. NO. 28043 | 124-ProAlaGlnLysThrLysLeuAspHisAspLeuArgAsp-136 |
| SEQ. ID. NO. 28044 | 143-GluLeuProProGluArgGlnAlaGluLeuAlaLysLeuGlnThrGluGlyAlaGlnLeu-162 |
| SEQ. ID. NO. 28045 | 190-IleProGluAspAla-194 |
| SEQ. ID. NO. 28046 | 202-AlaGlnSerGluGlyLysThrGlyTyr-210 |
| SEQ. ID. NO. 28047 | 227-GlyAsnArgGluLeuArgGluGlnIle-235 |
| SEQ. ID. NO. 28048 | 242-ArgAlaSerGluLeuSerAsnAspGlyLysPheAspAsn-254 |
| SEQ. ID. NO. 28049 | 256-AlaAsnIleAspArgThrLeuGluAsnAlaLeuLysThr-268 |
| SEQ. ID. NO. 28050 | 285-LysMetAlaAspThrProGlu-291 |
| SEQ. ID. NO. 28051 | 300-LeuAlaArgArgAlaLysProTyrAlaGluLysAspLeuAlaGlu-314 |
| SEQ. ID. NO. 28052 | 316-LysAlaPheAlaArgGluHisLeuGly-324 |
| SEQ. ID. NO. 28053 | 335-TyrAlaGlyGluLysLeuArgGluAlaLysTyrAlaPheSerGluThrGluValLysLys-354 |
| SEQ. ID. NO. 28054 | 377-PheAlaGluLysThr-381 |
| SEQ. ID. NO. 28055 | 387-LysAspValArgTyr-391 |
| SEQ. ID. NO. 28056 | 396-GlnAsnGlyLysThr-400 |
| SEQ. ID. NO. 28057 | 409-TyrAlaArgGluGlyLysArgGlyGly-417 |
| SEQ. ID. NO. 28058 | 423-TyrLysGlyArgArgArgPheAlaAsp-431 |
| SEQ. ID. NO. 28059 | 449-ValGlyGlyLysGluAlaArgLeuSerHisAspGlu-460 |
| SEQ. ID. NO. 28060 | 478-GlnValAspGluLeuGly-483 |
| SEQ. ID. NO. 28061 | 516-SerAlaHisGluGluThrGlyGluProLeuPro-526 |
| SEQ. ID. NO. 28062 | 560-SerGluSerAspGluCysArgLeuLysAsn-569 |
| SEQ. ID. NO. 28063 | 575-AspSerValArgLysGluValAla-582 |
| SEQ. ID. NO. 28064 | 625-PheGluGluSerAspAspValAlaAlaThrGly-635 |
| SEQ. ID. NO. 28065 | 647-GlySerArgSerAlaAlaGluSerPheLysAlaPheArgGlyArgGluProSerIle-665 | g130
AMPHI Regions - AMPHI

| SEQ. ID. NO. | Sequence |
|---|---|
| SEQ. ID. NO. 28066 | 16-ThrLeuValSerGlyIle-21 |
| SEQ. ID. NO. 28067 | 36-GlySerGlySerPheGly-41 |
| SEQ. ID. NO. 28068 | 56-GlnProValGlyGlnLeu-61 |
| SEQ. ID. NO. 28069 | 91-AsnValProAsnAlaPro-96 |
| SEQ. ID. NO. 28070 | 110-GlnGlyPheAspThrLeuPheGlnHisAlaLeuAsnGlyPheAsnAlaMet-126 |

TABLE 1-continued

| SEQ. ID. NO. 28071 | 171-ThrAlaSerAlaPro-175 |
| SEQ. ID. NO. 28072 | 204-PheGluAlaThrCysGln-209 |
| SEQ. ID. NO. 28073 | 211-CysHisGlyGlySerIleProGlyIlePro-220 |
| SEQ. ID. NO. 28074 | 234-LysGlyLysGluThr-238 |
| SEQ. ID. NO. 28075 | 245-GluGlyPheAsnAlaMet-250 |

Antigenic Index - Jameson-Wolf

| SEQ. ID. NO. 28076 | 1-MetLysGlnLeuArgAspAsnLysAlaGlnGlySer-12 |
| SEQ. ID. NO. 28077 | 35-AlaGlySerGlySerPheGlyAspValAspAlaThrThrGluAlaAlaThrGlnThrArgIleGlnProValGly-59 |
| SEQ. ID. NO. 28078 | 63-MetGlyAspGlyIleProValGlyGluArgGlnGlyGlu-75 |
| SEQ. ID. NO. 28079 | 87-AlaAlaAspSerAsnValProAsnAlaProLysLeuGluHisAsnGlyAspTrpAla-105 |
| SEQ. ID. NO. 28080 | 108-IleAlaGlnGlyPhe-112 |
| SEQ. ID. NO. 28081 | 126-MetProAlaLysGlyGlyAla-132 |
| SEQ. ID. NO. 28082 | 134-AspLeuThrAspGlnGluLeuLysArg-142 |
| SEQ. ID. NO. 28083 | 148-AlaAsnLysSerGlyGlySerPheProAsnProAspGluAlaAlaProAlaAspAsnAlaAlaSerGlyThrAlaSerAlaProAlaAspSerAlaAlaProAlaGluAlaLysAlaGluAspLysGlyAlaAla-192 |
| SEQ. ID. NO. 28084 | 197-GlyValAspGlyLysLysValPheGlu-205 |
| SEQ. ID. NO. 28085 | 221-GlyIleGlyLysLysAspAspTrpAlaProArgIleLysLysGlyLysGluThrLeuHis-240 |
| SEQ. ID. NO. 28086 | 251-ProAlaLysGlyGlyAsnAlaGlyLeuSerAspAspGluValLysAla-266 |
| SEQ. ID. NO. 28087 | 274-GlnSerGlyAlaLys-278 |

Hydrophilic Regions - Hopp-Woods

| SEQ. ID. NO. 28088 | 1-MetLysGlnLeuArgAspAsnLysAlaGlnGly-11 |
| SEQ. ID. NO. 28089 | 41-GlyAspValAspAlaThrThrGluAlaAlaThr-51 |
| SEQ. ID. NO. 28090 | 68-ProValGlyGluArgGlnGlyGlu-75 |
| SEQ. ID. NO. 28091 | 87-AlaAlaAspSerAsnVal-92 |
| SEQ. ID. NO. 28092 | 96-ProLysLeuGluHisAsnGly-102 |
| SEQ. ID. NO. 28093 | 127-ProAlaLysGlyGlyAla-132 |
| SEQ. ID. NO. 28094 | 134-AspLeuThrAspGlnGluLeuLysArg-142 |
| SEQ. ID. NO. 28095 | 156-ProAsnProAspGluAlaAlaProAlaAspAsnAlaAla-168 |
| SEQ. ID. NO. 28096 | 174-AlaProAlaAspSerAlaAlaProAlaGluAlaLysAlaGluAspLysGlyAlaAla-192 |
| SEQ. ID. NO. 28097 | 198-ValAspGlyLysLysValPheGlu-205 |
| SEQ. ID. NO. 28098 | 222-IleGlyLysLysAspAspTrpAlaProArgIleLysLysGlyLysGluThrLeuHis-240 |
| SEQ. ID. NO. 28099 | 251-ProAlaLysGlyGlyAsn-256 |
| SEQ. ID. NO. 28100 | 258-GlyLeuSerAspAspGluValLysAla-266 | g132-2
AMPHI Regions - AMPHI

| SEQ. ID. NO. 28101 | 13-IleIleSerAlaLeuAlaVal-19 |
| SEQ. ID. NO. 28102 | 70-AlaThrCysMetAlaMetVal-76 |
| SEQ. ID. NO. 28103 | 92-IleArgGlnThrGlnGlnAlaProLysProValSerAsnThr-105 |

Antigenic Index - Jameson-Wolf

| SEQ. ID. NO. 28104 | 26-GlnHisGlyLysGlyAlaAspAla-33 |
| SEQ. ID. NO. 28105 | 38-GlySerGlySerGlySerAla-44 |
| SEQ. ID. NO. 28106 | 81-HisThrThrLysHisGlyLeuAspPheSerAsnIleArgGlnThrGlnGlnAlaProLysProValSerAsnThrGluProSerAlaProValProGlnGlnGlnLys-116 |

Hydrophilic Regions - Hopp-Woods

| SEQ. ID. NO. 28107 | 28-GlyLysGlyAlaAspAla-33 |
| SEQ. ID. NO. 28108 | 93-ArgGlnThrGlnGlnAlaProLysProValSerAsnThrGluProSerAla-109 | g134
AMPHI Regions - AMPHI

| SEQ. ID. NO. 28109 | 39-IleGlnSerAlaGlyThrVal-45 |
| SEQ. ID. NO. 28110 | 47-GlyLysLysThrGly-51 |
| SEQ. ID. NO. 28111 | 56-SerAspTrpMetAspIleGluLysGlnArg-65 |
| SEQ. ID. NO. 28112 | 83-ValAsnLeuLeuAspThrProGlyHis-91 |
| SEQ. ID. NO. 28113 | 97-AspThrTyrArgValLeuThrAlaVal-105 |
| SEQ. ID. NO. 28114 | 114-AlaAlaLysGlyValGlu-119 |
| SEQ. ID. NO. 28115 | 123-IleLysLeuLeuAsnValCysArg-130 |
| SEQ. ID. NO. 28116 | 142-LysTyrAspArgGluVal-147 |
| SEQ. ID. NO. 28117 | 149-AspSerLeuGluLeuLeuAspGluValGluAspIleLeuGln-162 |
| SEQ. ID. NO. 28118 | 176-LysAsnPheLysGlyValTyrHisIleLeu-185 |
| SEQ. ID. NO. 28119 | 201-HisGluPheAspIleIleLysGlyIleAsnAsn-211 |
| SEQ. ID. NO. 28120 | 254-PheGlySerAlaIle-258 |
| SEQ. ID. NO. 28121 | 265-GluIleLeuAsnSerLeuIleAspTrpAlaPro-275 |
| SEQ. ID. NO. 28122 | 322-LysPheGluArgGlyMetLys-328 |
| SEQ. ID. NO. 28123 | 361-AspIleIleGlyIleProAsnHis-368 |
| SEQ. ID. NO. 28124 | 395-LeuPheArgSerValArgIleLys-402 |
| SEQ. ID. NO. 28125 | 404-ProLeuLysIleLysGln-409 |
| SEQ. ID. NO. 28126 | 411-GlnLysGlyLeuGlnGlnLeuGlyGlu-419 |
| SEQ. ID. NO. 28127 | 423-ValGlnValPheLysProMetSer-430 |
| SEQ. ID. NO. 28128 | 449-SerArgLeuAlaAsnGluTyr-455 |
| SEQ. ID. NO. 28129 | 481-AlaGluPheGluLysAlaAsn-487 |
| SEQ. ID. NO. 28130 | 515-ArgTrpProAspIle-519 |

Antigenic Index - Jameson-Wolf

| SEQ. ID. NO. 28131 | 4-GluIleLeuAspGlnValArgArgArgArgThrPhe-15 |
| SEQ. ID. NO. 28132 | 19-SerHisProAspAlaGlyLysThrThrLeuThr-29 |
| SEQ. ID. NO. 28133 | 43-GlyThrValLysGlyLysLysThrGlyLysPheAlaThr-55 |
| SEQ. ID. NO. 28134 | 57-AspTrpMetAspIleGluLysGlnArgGly-66 |
| SEQ. ID. NO. 28135 | 76-PheAspTyrLysAspHisThrVal-83 |
| SEQ. ID. NO. 28136 | 85-LeuLeuAspThrProGlyHisGlnAspPheSerGluAspThrTyrArg-100 |
| SEQ. ID. NO. 28137 | 113-AspAlaAlaLysGlyValGlu-119 |
| SEQ. ID. NO. 28138 | 129-CysArgLeuArgAspThrPro-135 |
| SEQ. ID. NO. 28139 | 140-MetAsnLysTyrAspArgGluValArgAspSerLeuGluLeuLeuAspGluValGluAsp-159 |

TABLE 1-continued

| | |
|---|---|
| SEQ. ID. NO. 28140 | 173-GlyMetGlyLysAsnPheLys-179 |
| SEQ. ID. NO. 28141 | 194-AlaGlyGlyGluArgLeuProHis-201 |
| SEQ. ID. NO. 28142 | 207-LysGlyIleAsnAsnProGluLeuGluGlnArgPheProLeu-220 |
| SEQ. ID. NO. 28143 | 223-GlnGlnLeuArgAspGluIleGluLeu-231 |
| SEQ. ID. NO. 28144 | 235-AlaSerAsnGluPheAsnLeu-241 |
| SEQ. ID. NO. 28145 | 274-AlaProAlaProLysProArgAspAlaThrMet-284 |
| SEQ. ID. NO. 28146 | 286-MetValGlyProAspGluProLysPhe-294 |
| SEQ. ID. NO. 28147 | 302-GlnAlaAsnMetAspProLysHisArgAspArgIleAla-314 |
| SEQ. ID. NO. 28148 | 317-ArgValCysSerGlyLysPheGluArgGlyMetLysMetLysHisLeuArgIleAsnArgGluIleAla-339 |
| SEQ. ID. NO. 28149 | 348-SerHisAspArgGluLeuAlaGluGluAlaTyrAla-359 |
| SEQ. ID. NO. 28150 | 365-IleProAsnHisGly-369 |
| SEQ. ID. NO. 28151 | 373-IleGlyAspSerPheSerGluGlyGluGln-382 |
| SEQ. ID. NO. 28152 | 399-ValArgIleLysAsnProLeuLysIleLysGlnLeuGlnLysGlyLeuGlnGlnLeuGlyGluGluGlyAla-422 |
| SEQ. ID. NO. 28153 | 450-ArgLeuAlaAsnGluTyrGlyVal-457 |
| SEQ. ID. NO. 28154 | 459-AlaValPheAspSer-463 |
| SEQ. ID. NO. 28155 | 473-SerCysAspAspLysLysLysLeuAlaGluPheGluLysAlaAsnAla-488 |
| SEQ. ID. NO. 28156 | 503-AlaProAsnArgValAsnLeu-509 |
| SEQ. ID. NO. 28157 | 511-LeuThrGlnGluArgTrpProAspIleVal-520 |
| SEQ. ID. NO. 28158 | 523-GluThrArgGluHisSerVal-529 |
| Hydrophilic Regions - Hopp-Woods | |
| SEQ. ID. NO. 28159 | 4-GluIleLeuAspGlnValArgArgArgArgThr-14 |
| SEQ. ID. NO. 28160 | 21-ProAspAlaGlyLys-25 |
| SEQ. ID. NO. 28161 | 43-GlyThrValLysGlyLysLysThrGlyLys-52 |
| SEQ. ID. NO. 28162 | 59-MetAspIleGluLysGlnArgGly-66 |
| SEQ. ID. NO. 28163 | 77-AspTyrLysAspHisThr-82 |
| SEQ. ID. NO. 28164 | 92-GlnAspPheSerGluAspThrTyr-99 |
| SEQ. ID. NO. 28165 | 113-AspAlaAlaLysGlyValGlu-119 |
| SEQ. ID. NO. 28166 | 129-CysArgLeuArgAspThrPro-135 |
| SEQ. ID. NO. 28167 | 142-LysTyrAspArgGluValArgAspSerLeuGluLeuLeuAspGluValGluAsp-159 |
| SEQ. ID. NO. 28168 | 194-AlaGlyGlyGluArgLeuProHis-201 |
| SEQ. ID. NO. 28169 | 212-ProGluLeuGluGlnArgPheProLeu-220 |
| SEQ. ID. NO. 28170 | 223-GlnGlnLeuArgAspGluIleGluLeu-231 |
| SEQ. ID. NO. 28171 | 277-ProLysProArgAspAlaThrMet-284 |
| SEQ. ID. NO. 28172 | 287-ValGlyProAspGluProLysPhe-294 |
| SEQ. ID. NO. 28173 | 305-MetAspProLysHisArgAspArgIleAla-314 |
| SEQ. ID. NO. 28174 | 319-CysSerGlyLysPheGluArgGlyMetLysMetLysHisLeuArgIleAsnArgGluIleAla-339 |
| SEQ. ID. NO. 28175 | 348-SerHisAspArgGluLeuAlaGluGluAlaTyrAla-359 |
| SEQ. ID. NO. 28176 | 376-SerPheSerGluGlyGluGln-382 |
| SEQ. ID. NO. 28177 | 399-ValArgIleLysAsnProLeuLysIleLysGlnLeuGln-411 |
| SEQ. ID. NO. 28178 | 417-LeuGlyGluGluGlyAla-422 |
| SEQ. ID. NO. 28179 | 473-SerCysAspAspLysLysLysLeuAlaGluPheGluLysAlaAsnAla-488 |
| SEQ. ID. NO. 28180 | 512-ThrGlnGluArgTrpPro-517 |
| SEQ. ID. NO. 28181 | 523-GluThrArgGluHisSerVal-529 |
| g135-2 | |
| AMPHI Regions - AMPHI | |
| SEQ. ID. NO. 28182 | 29-ThrIleThrArgGlnLeuAlaAlaLeu-37 |
| SEQ. ID. NO. 28183 | 85-GluTyrThrAlaAsnLeu-90 |
| SEQ. ID. NO. 28184 | 169-AspIleAspGlyLeuTyrThr-175 |
| SEQ. ID. NO. 28185 | 185-ValArgLeuAspLysIleGluHis-192 |
| SEQ. ID. NO. 28186 | 212-GlyMetLeuThrLysIle-217 |
| SEQ. ID. NO. 28187 | 236-LeuLysProAspSerLeuAlaGluAlaAlaGlu-246 |
| SEQ. ID. NO. 28188 | 284-AlaGluHisAlaLeuSer-289 |
| SEQ. ID. NO. 28189 | 300-IleAlaGlyIleGluGly-305 |
| SEQ. ID. NO. 28190 | 308-SerArgMetAspThrValThrValTyr-316 |
| SEQ. ID. NO. 28191 | 318-LysAlaThrLysGlnPro-323 |
| Antigenic Index - Jameson-Wolf | |
| SEQ. ID. NO. 28192 | 1-MetLysTyrLysArgIleVal-7 |
| SEQ. ID. NO. 28193 | 14-SerIleThrArgSerAspGlySerLeuSerArgGlyLysIleGlnThrIle-30 |
| SEQ. ID. NO. 28194 | 60-GlyPheLysLysArgProValLysIleAlaAspLysGlnAlaSer-74 |
| SEQ. ID. NO. 28195 | 90-LeuSerSerAspGlyIle-95 |
| SEQ. ID. NO. 28196 | 105-AlaAspPheAlaAspLysArgArgTyrGlnAsnAlaGlyGly-118 |
| SEQ. ID. NO. 28197 | 124-LeuGlnArgArgAlaIle-129 |
| SEQ. ID. NO. 28198 | 132-IleAsnGluAsnAspThrValSerValGluGluLeuLysIleGlyAspAsnAspThrLeu-151 |
| SEQ. ID. NO. 28199 | 176-GlyAsnProAsnSerAsnProAspAlaValArgLeuAspLysIleGluHisIleAsn-194 |
| SEQ. ID. NO. 28200 | 202-GlyGlySerGlySerAlaAsnGlyThrGly-211 |
| SEQ. ID. NO. 28201 | 215-ThrLysIleLysAla-219 |
| SEQ. ID. NO. 28202 | 224-AlaGluSerGlyVal-228 |
| SEQ. ID. NO. 28203 | 233-CysSerSerLeuLysProAspSerLeuAlaGluAlaAlaGluHisGlnAlaAspGly-251 |
| SEQ. ID. NO. 28204 | 257-ArgAlaLysGlyLeuArgThrGlnLysGln-266 |
| SEQ. ID. NO. 28205 | 271-TyrSerGluSerArgGlySerValTyrValAspGluGlyAlaGluHisAlaLeuSerGluGlnGlyLysSerLeuLeu-296 |
| SEQ. ID. NO. 28206 | 305-GlyHisPheSerArgMetAspThr-312 |
| SEQ. ID. NO. 28207 | 317-SerLysAlaThrLysGlnProLeuGlyLysGlyArgVal-329 |
| SEQ. ID. NO. 28208 | 335-AlaAlaGluAspLeuLeuSerArgLysAlaLys-346 |
| SEQ. ID. NO. 28209 | 350-IleHisArgAspAspTrpIleSer-357 |
| Hydrophilic Regions - Hopp-Woods | |
| SEQ. ID. NO. 28210 | 1-MetLysTyrLysArgIleVal-7 |
| SEQ. ID. NO. 28211 | 14-SerIleThrArgSerAspGlySerLeuSerArgGlyLysIle-27 |
| SEQ. ID. NO. 28212 | 60-GlyPheLysLysArgProValLysIleAlaAspLysGlnAlaSer-74 |
| SEQ. ID. NO. 28213 | 105-AlaAspPheAlaAspLysArgArgTyrGlnAsn-115 |
| SEQ. ID. NO. 28214 | 124-LeuGlnArgArgAlaIle-129 |

TABLE 1-continued

| | |
|---|---|
| SEQ. ID. NO. 28215 | 133-AsnGluAsnAspThrValSerValGluGluLeuLysIleGlyAspAsnAspThrLeu-151 |
| SEQ. ID. NO. 28216 | 178-ProAsnSerAsnProAspAlaValArgLeuAspLysIleGluHisIleAsn-194 |
| SEQ. ID. NO. 28217 | 215-ThrLysIleLysAla-219 |
| SEQ. ID. NO. 28218 | 236-LeuLysProAspSerLeuAlaGluAlaAlaGluHisGlnAlaAsp-250 |
| SEQ. ID. NO. 28219 | 257-ArgAlaLysGlyLeuArgThrGlnLys-265 |
| SEQ. ID. NO. 28220 | 272-SerGluSerArgGly-276 |
| SEQ. ID. NO. 28221 | 278-ValTyrValAspGluGlyAlaGluHisAlaLeuSerGluGlnGlyLys-293 |
| SEQ. ID. NO. 28222 | 306-HisPheSerArgMetAspThr-312 |
| SEQ. ID. NO. 28223 | 318-LysAlaThrLysGlnProLeuGlyLysGlyArgVal-329 |
| SEQ. ID. NO. 28224 | 335-AlaAlaGluAspLeuLeuLysSerArgLysAlaLys-346 |
| SEQ. ID. NO. 28225 | 351-HisArgAspAspTrp-355 | g136
AMPHI Regions - AMPHI

| | |
|---|---|
| SEQ. ID. NO. 28226 | 61-AlaValAspValCysGlnArgValArgGlnPheGlyArgLysPheArgGlnLeuAlaPhe-80 |
| SEQ. ID. NO. 28227 | 100-HisHisGlyValLysGlnLeuPheLysArgPheIleIle-112 |
| SEQ. ID. NO. 28228 | 114-GlyPheLysProIleGlyArgHis-121 |
| SEQ. ID. NO. 28229 | 162-ArgHisCysGlnAsn-166 |
| SEQ. ID. NO. 28230 | 184-GlnHisPheGlyGlnPro-189 |
| SEQ. ID. NO. 28231 | 191-GluArgCysGlnPheVal-196 |

Antigenic Index - Jameson-Wolf

| | |
|---|---|
| SEQ. ID. NO. 28232 | 1-MetGluIleArgPhe-5 |
| SEQ. ID. NO. 28233 | 52-ArgPheValAspAspArgLeuProVal-60 |
| SEQ. ID. NO. 28234 | 64-ValCysGlnArgValArgGlnPheGlyArgLysPheArg-76 |
| SEQ. ID. NO. 28235 | 83-LeuGlnAlaAspAsn-87 |
| SEQ. ID. NO. 28236 | 113-GlyGlyPheLysProIleGlyArgHisAsnValGln-124 |
| SEQ. ID. NO. 28237 | 153-IleArgHisArgGlyGlyCysPheHisArgHisCysGlnAsnGlnProPheAsp-170 |
| SEQ. ID. NO. 28238 | 173-ThrPheGlyGlyGlyLysLeuArg-180 |
| SEQ. ID. NO. 28239 | 185-HisPheGlyGlnProValGluArg-192 |
| SEQ. ID. NO. 28240 | 198-ProAlaGlnGlnArgArgHisLysThr-206 |

Hydrophilic Regions - Hopp-Woods

| | |
|---|---|
| SEQ. ID. NO. 28241 | 1-MetGluIleArgPhe-5 |
| SEQ. ID. NO. 28242 | 52-ArgPheValAspAspArgLeuProVal-60 |
| SEQ. ID. NO. 28243 | 64-ValCysGlnArgValArgGlnPheGlyArgLysPheArg-76 |
| SEQ. ID. NO. 28244 | 199-AlaGlnGlnArgArgHisLysThr-206 | g137
AMPHI Regions - AMPHI

| | |
|---|---|
| SEQ. ID. NO. 28245 | 24-LeuSerTyrIleLeuGlyPhe-30 |
| SEQ. ID. NO. 28246 | 49-ThrLysGluSerLeu-53 |
| SEQ. ID. NO. 28247 | 55-AspPheLeuThrTrpGly-60 |
| SEQ. ID. NO. 28248 | 78-PheSerAspTyrLeuAlaHisProLeuAspIlePheLysValTrpGluGlyGly-95 |
| SEQ. ID. NO. 28249 | 101-GlyPheLeuGlyValValIle-107 |
| SEQ. ID. NO. 28250 | 120-PheLeuLysLeuMetAspThrValAlaProLeuValPro-132 |
| SEQ. ID. NO. 28251 | 139-ArgIleGlyAsnPheIle-144 |
| SEQ. ID. NO. 28252 | 149-TrpGlyArgIleThrAspIleAsnAlaPhe-158 |
| SEQ. ID. NO. 28253 | 178-ProLeuTrpAlaGluTrpLeuGlnGlnTyr-187 |
| SEQ. ID. NO. 28254 | 190-LeuProArgHisProSerGlnLeu-197 |
| SEQ. ID. NO. 28255 | 232-TyrGlyValPheArgPheIleAlaGluPheAlaArgGlnProAspAspTyrLeuGly-250 |

Antigenic Index - Jameson-Wolf

| | |
|---|---|
| SEQ. ID. NO. 28256 | 36-LeuGlyArgArgArgIleAlaGln-43 |
| SEQ. ID. NO. 28257 | 48-PheThrLysGluSerLeuAspAsp-55 |
| SEQ. ID. NO. 28258 | 92-TrpGluGlyGlyMet-96 |
| SEQ. ID. NO. 28259 | 113-SerArgLysHisGlyIle-118 |
| SEQ. ID. NO. 28260 | 136-AlaSerGlyArgIle-140 |
| SEQ. ID. NO. 28261 | 166-AlaHisTyrGluAspAlaGluAlaAlaAla-175 |
| SEQ. ID. NO. 28262 | 191-ProArgHisProSerGlnLeu-197 |
| SEQ. ID. NO. 28263 | 215-SerLysLysProArgProThrGlyGln-223 |
| SEQ. ID. NO. 28264 | 241-PheAlaArgGlnProAspAspTyrLeu-249 |
| SEQ. ID. NO. 28265 | 277-PheGlyMetLysLysGlnHis-283 |

Hydrophilic Regions - Hopp-Woods

| | |
|---|---|
| SEQ. ID. NO. 28266 | 37-GlyArgArgArgIleAla-42 |
| SEQ. ID. NO. 28267 | 48-PheThrLysGluSerLeuAsp-54 |
| SEQ. ID. NO. 28268 | 167-HisTyrGluAspAlaGluAlaAlaAla-175 |
| SEQ. ID. NO. 28269 | 216-LysLysProArgProThrGly-222 |
| SEQ. ID. NO. 28270 | 241-PheAlaArgGlnProAspAspTyr-248 |
| SEQ. ID. NO. 28271 | 278-GlyMetLysLysGlnHis-283 | g138
AMPHI Regions - AMPHI

| | |
|---|---|
| SEQ. ID. NO. 28272 | 21-ProTyrIleArgArgPheSerGlySer-29 |
| SEQ. ID. NO. 28273 | 74-AsnAlaMetLeuGluLysVal-80 |
| SEQ. ID. NO. 28274 | 85-GluPheValGlnGlyMet-90 |
| SEQ. ID. NO. 28275 | 109-ValAsnLysGluIleValSerMetIleAsnThrTyrGly-121 |
| SEQ. ID. NO. 28276 | 152-IleGlyGlnValGlyThrValGluSerIle-161 |
| SEQ. ID. NO. 28277 | 163-ThrGlyLeuValLysGlyLeu-169 |
| SEQ. ID. NO. 28278 | 199-GlyLysLeuAlaGluGluLeu-205 |
| SEQ. ID. NO. 28279 | 213-MetThrAsnIleAlaGlyValMetAspLysThrGlyAsnLeuLeuThrLysLeuThr-231 |
| SEQ. ID. NO. 28280 | 234-ArgIleAspGlyLeu-238 |
| SEQ. ID. NO. 28281 | 247-GlyMetLeuProLysProIleAlaSerAlaValGluAlaAlaValAsn-261 |
| SEQ. ID. NO. 28282 | 276-AlaLeuLeuLeuGluIlePheThrAspAla-285 |

TABLE 1-continued

Antigenic Index - Jameson-Wolf
SEQ. ID. NO. 28283  9-AlaAlaAspLysAlaArgIleLeu-16
SEQ. ID. NO. 28284  23-IleArgArgPheSerGlySer-29
SEQ. ID. NO. 28285  35-TyrGlyGlyAsnAlaMetThr-41
SEQ. ID. NO. 28286  43-ProAlaLeuLysGluGlyPheAla-50
SEQ. ID. NO. 28287  68-GlyGlyGlyProGln-72
SEQ. ID. NO. 28288  76-MetLeuGluLysValGlyLysLysGlyGluPhe-86
SEQ. ID. NO. 28289  91-ArgValThrAspLysGluThrMetAsp-99
SEQ. ID. NO. 28290  109-ValAsnLysGluIle-113
SEQ. ID. NO. 28291  128-SerGlyArgAspAspHisPheIleLysAlaLysLysLeuLeuValAspThrProGluGlnAsnSerValAspIleGlyGln-154
SEQ. ID. NO. 28292  159-GluSerIleAspThrGlyLeu-165
SEQ. ID. NO. 28293  169-LeuIleGluArgGlyCysIle-175
SEQ. ID. NO. 28294  182-GlyValGlyGluLysGlyGluAla-189
SEQ. ID. NO. 28295  200-LysLeuAlaGluGluLeuAsnAlaGluLys-209
SEQ. ID. NO. 28296  219-ValMetAspLysThrGlyAsnLeuLeuThrLysLeuThrProLysArgIleAspGlyLeuIleAla-240
SEQ. ID. NO. 28297  259-AlaValAsnGlyValLys-264
SEQ. ID. NO. 28298  269-IleAspGlyArgLeuProAsnAla-276
SEQ. ID. NO. 28299  291-IleLeuArgGlyGluAspAla-298
Hydrophilic Regions - Hopp-Woods
SEQ. ID. NO. 28300  9-AlaAlaAspLysAlaArgIleLeu-16
SEQ. ID. NO. 28301  43-ProAlaLeuLysGluGlyPheAla-50
SEQ. ID. NO. 28302  76-MetLeuGluLysValGlyLysLysGlyGluPhe-86
SEQ. ID. NO. 28303  91-ArgValThrAspLysGluThrMetAsp-99
SEQ. ID. NO. 28304  109-ValAsnLysGluIle-113
SEQ. ID. NO. 28305  128-SerGlyArgAspAspHisPheIleLysAlaLysLysLeuLeuValAspThrProGluGlnAsnSerValAsp-151
SEQ. ID. NO. 28306  183-ValGlyGluLysGlyGluAla-189
SEQ. ID. NO. 28307  200-LysLeuAlaGluGluLeuAsnAlaGluLys-209
SEQ. ID. NO. 28308  219-ValMetAspLysThrGly-224
SEQ. ID. NO. 28309  230-LeuThrProLysArgIleAspGlyLeuIle-239
SEQ. ID. NO. 28310  269-IleAspGlyArgLeu-273
SEQ. ID. NO. 28311  293-GlyArgGlyGluAspAla-298
g140
AMPHI Regions - AMPHI
SEQ. ID. NO. 28312  10-TyrLeuAsnSerThr-14
SEQ. ID. NO. 28313  32-PhePheLysAsnIleLysThr-38
SEQ. ID. NO. 28314  45-SerLeuAspSerValGluLysThrAlaGly-54
SEQ. ID. NO. 28315  68-AsnAlaAlaArgThrAlaSer-74
SEQ. ID. NO. 28316  108-SerAlaThrProGluThrValGluThrValAla-118
SEQ. ID. NO. 28317  137-AlaAlaAlaValGlnHisAlaAsnThrAlaAspGlyValArgIlePheAsnSerLeuAlaAlaThr-158
SEQ. ID. NO. 28318  175-LeuLysAlaValSerAspGlyLeuAsp-183
SEQ. ID. NO. 28319  189-LeuArgValIleAlaGln-194
SEQ. ID. NO. 28320  266-IleGlyTyrLeuLysGlyLeuPheSerTyr-275
SEQ. ID. NO. 28321  290-GluTyrAlaGluGlySer-295
SEQ. ID. NO. 28322  303-LeuGlyAlaLeuGly-307
SEQ. ID. NO. 28323  352-GlyThrLeuValGlyLeu-357
SEQ. ID. NO. 28324  391-GlyGlyPheThrGlyAlaAla-397
SEQ. ID. NO. 28325  425-AsnGlyTrpAsnGlyLeuAlaArg-432
Antigenic Index - Jameson-Wolf
SEQ. ID. NO. 28326  1-MetSerAlaArgGlyLysGlyAlaGly-9
SEQ. ID. NO. 28327  12-AsnSerThrGlyArgHisVal-18
SEQ. ID. NO. 28328  25-LysIleGlyGlnAspTyrSerPhe-32
SEQ. ID. NO. 28329  34-LysAsnIleLysThrAspGlyGlyLeu-42
SEQ. ID. NO. 28330  47-AspSerValGluLysThrAlaGlySerGluGlyAspThrProSer-61
SEQ. ID. NO. 28331  63-TyrValArgArgGlyAsnAlaAlaArgThrAlaSer-74
SEQ. ID. NO. 28332  86-HisAlaValGluGlnGlyGlySerAsnLeuGlu-96
SEQ. ID. NO. 28333  102-LeuAspAlaSerGluSerSerAlaThrProGluThrValGlu-115
SEQ. ID. NO. 28334  117-AlaValAlaAspArgThrAspMetProGlyIleArgLeuArgArgThrThrPhe-134
SEQ. ID. NO. 28335  144-AsnThrAlaAspGlyValArg-150
SEQ. ID. NO. 28336  160-TyrAlaAspSerAlaAlaAla-166
SEQ. ID. NO. 28337  169-AspMetGlnGlyArgArgLeuLysAlaValSerAspGlyLeuAspHisAsnGlyThrGlyLeu-189
SEQ. ID. NO. 28338  195-ThrGlnGlnAspGlyGlyThrTrpGluGlnGlyGlyValGluGlyLysMetArgGlySerThr-215
SEQ. ID. NO. 28339  221-AlaAlaLysThrGlyGluAsnThrThr-229
SEQ. ID. NO. 28340  236-IleGlyArgSerThrTrpSerGluAsnSerAlaAsnAlaLysThrAspSerIle-253
SEQ. ID. NO. 28341  259-IleArgHisAspValGlyAsp-265
SEQ. ID. NO. 28342  274-SerTyrGlyArgTyrLysAsnSerIleSerArgSerThrGlyAlaAspGluTyrAlaGlu-293
SEQ. ID. NO. 28343  315-AlaThrGlyAspLeuThrValGluGlyGlyLeuArgHisAspLeuLeuLys-331
SEQ. ID. NO. 28344  333-AspAlaPheAlaGluLysGlySerAlaLeuGlyTrpSerGlyAsnSerLeuThrGluGlyThr-353
SEQ. ID. NO. 28345  362-LeuSerGlnProLeuSerAspLysAlaVal-371
SEQ. ID. NO. 28346  376-AlaGlyValGluArgAspLeuAsnGlyArgAspTyrAla-388
SEQ. ID. NO. 28347  399-AlaThrGlyLysThrGlyAlaArgAsnMetProHisThrArgArgValAla-415
SEQ. ID. NO. 28348  421-ValGluPheGlyAsnGlyTrp-427
SEQ. ID. NO. 28349  434-SerTyrThrGlySerLysGlnTyrGlyAsnHisSerGly-446
Hydrophilic Regions - Hopp-Woods
SEQ. ID. NO. 28350  1-MetSerAlaArgGlyLysGly-7
SEQ. ID. NO. 28351  36-IleLysThrAspGly-40
SEQ. ID. NO. 28352  47-AspSerValGluLysThrAlaGlySerGluGlyAspThr-59
SEQ. ID. NO. 28353  63-TyrValArgArgGlyAsnAlaAlaArgThrAlaSer-74
SEQ. ID. NO. 28354  86-HisAlaValGluGlnGlyGlySerAsnLeu-95
SEQ. ID. NO. 28355  102-LeuAspAlaSerGluSerSerAlaThrProGluThrValGlu-115
SEQ. ID. NO. 28356  117-AlaValAlaAspArgThrAspMetProGlyIleArgLeuArgArgThrThrPhe-134

TABLE 1-continued

| | |
|---|---|
| SEQ. ID. NO. 28357 | 144-AsnThrAlaAspGly-148 |
| SEQ. ID. NO. 28358 | 169-AspMetGlnGlyArgArgLeuLysAlaValSerAspGlyLeuAspHisAsnGlyThr-187 |
| SEQ. ID. NO. 28359 | 205-GlyGlyValGluGlyLysMetArgGlySerThr-215 |
| SEQ. ID. NO. 28360 | 223-LysThrGlyGluAsnThrThr-229 |
| SEQ. ID. NO. 28361 | 244-AsnSerAlaAsnAlaLysThrAspSer-252 |
| SEQ. ID. NO. 28362 | 259-IleArgHisAspValGlyAsp-265 |
| SEQ. ID. NO. 28363 | 277-ArgTyrLysAsnSerIleSerArgSerThrGlyAlaAspGluTyrAlaGlu-293 |
| SEQ. ID. NO. 28364 | 323-GlyGlyLeuArgHisAspLeuLeuLys-331 |
| SEQ. ID. NO. 28365 | 333-AspAlaPheAlaGluLysGlySer-340 |
| SEQ. ID. NO. 28366 | 364-GlnProLeuSerAspLysAlaVal-371 |
| SEQ. ID. NO. 28367 | 376-AlaGlyValGluArgAspLeuAsnGlyArgAspTyrAla-388 |
| SEQ. ID. NO. 28368 | 399-AlaThrGlyLysThrGlyAlaArgAsnMetProHisThrArgArgValAla-415 |
| g141 | |
| AMPHI Regions - AMPHI | |
| SEQ. ID. NO. 28369 | 12-SerSerThrMetArgProIleGlyGluIle-21 |
| SEQ. ID. NO. 28370 | 32-IleGluProTyrGly-36 |
| SEQ. ID. NO. 28371 | 44-ProAlaGluAlaPheLysLeuPro-51 |
| SEQ. ID. NO. 28372 | 80-AlaAspAlaLeuArgHisIle-86 |
| SEQ. ID. NO. 28373 | 131-PheHisAlaIleGlyAla-136 |
| SEQ. ID. NO. 28374 | 139-AsnLeuLeuAlaAlaMetLeuAspAsn-147 |
| SEQ. ID. NO. 28375 | 174-GlnLeuArgAsnIleIleAspGlyMetGlyLysProValAspGlyValMetArgPro-192 |
| SEQ. ID. NO. 28376 | 212-AspIleSerAspLeuLysGluArgPheGly-221 |
| SEQ. ID. NO. 28377 | 244-AlaMetAlaAlaLeuLeuLysAspAlaIleLysProAsnLeu-257 |
| SEQ. ID. NO. 28378 | 259-GlnThrIleGluGlyThrPro-265 |
| SEQ. ID. NO. 28379 | 272-ProPheAlaAsnIleAlaHisGlyCysAsnSerValThrAlaThrArgLeuAlaLysHisLeuAlaAspTyrAla-296 |
| SEQ. ID. NO. 28380 | 330-AlaThrValArgAla-334 |
| SEQ. ID. NO. 28381 | 351-LeuGluAlaLeuAlaLysGlyLeuProAsnLeuLeuLysHisIleSerAsnLeuLysAsnValPheGly-373 |
| SEQ. ID. NO. 28382 | 406-SerLeuThrGluValTrpGlyLys-413 |
| SEQ. ID. NO. 28383 | 420-AspLeuAlaArgLysValValAsnAlaIleAspAsnGln-432 |
| SEQ. ID. NO. 28384 | 473-IleAlaSerLeuGluLys-478 |
| SEQ. ID. NO. 28385 | 502-LeuGlyCysProGluGly-507 |
| SEQ. ID. NO. 28386 | 525-ValAlaLeuCysGlyAsnMetMetLysMetProGlyLeuProLysValProAlaAla-543 |
| Antigenic Index - Jameson-Wolf | |
| SEQ. ID. NO. 28387 | 3-PheLysThrAspAlaGluThrAlaGlnSerSerThrMetArgProIleGly-19 |
| SEQ. ID. NO. 28388 | 27-LeuAsnValAspAsnIleGluProTyrGly-36 |
| SEQ. ID. NO. 28389 | 38-TyrLysAlaLysIleAsnProAlaGluAlaPheLysLeuProGlnLysGlnGlyArg-56 |
| SEQ. ID. NO. 28390 | 64-AsnProThrProAlaGlyGluGlyLysThrThr-74 |
| SEQ. ID. NO. 28391 | 81-AspAlaLeuArgHisIleGlyLysAspSerValIleAlaLeuArgGluProSerLeuGlyPro-101 |
| SEQ. ID. NO. 28392 | 105-ValLysGlyGlyAlaAlaGlyGlyGly-113 |
| SEQ. ID. NO. 28393 | 151-GlnGlyAsnGluLeuAsnIleAspProLysArgValLeuTrp-164 |
| SEQ. ID. NO. 28394 | 166-ArgValValAspMetAsnAspArgGlnLeuArgAsnIleIleAspGlyMetGlyLysProValAspGlyValMetArgProAspGlyPheAspIle-197 |
| SEQ. ID. NO. 28395 | 211-LysAspIleSerAspLeuLysGluArgPheGly-221 |
| SEQ. ID. NO. 28396 | 227-TyrAlaLysAspGlySerProValTyr-235 |
| SEQ. ID. NO. 28397 | 237-LysAspLeuLysAla-241 |
| SEQ. ID. NO. 28398 | 251-AspAlaIleLysProAsnLeu-257 |
| SEQ. ID. NO. 28399 | 287-ArgLeuAlaLysHisLeuAla-293 |
| SEQ. ID. NO. 28400 | 306-LeuGlyAlaGluLysPheCysAspIleLysCysArgLeuAlaGlyLeuLysProAspAla-325 |
| SEQ. ID. NO. 28401 | 335-LeuLysTyrAsnGlyGlyValGluArgAlaAsnLeuGlyGluGluAsnLeuGluAlaLeuAla-355 |
| SEQ. ID. NO. 28402 | 383-PheValSerAspSerAspAlaGluLeuAlaMetIleGluLysAlaCysAla-399 |
| SEQ. ID. NO. 28403 | 411-TrpGlyLysGlyGlyAlaGlyGlyAlaAspLeuAlaArgLysValValAsn-427 |
| SEQ. ID. NO. 28404 | 429-IleAspAsnGlnProAsnAsnPhe-436 |
| SEQ. ID. NO. 28405 | 444-LeuGlyIleLysAspLysIleArgAlaIleAla-454 |
| SEQ. ID. NO. 28406 | 458-TyrGlyAlaGluAspValAspPheSerAla-467 |
| SEQ. ID. NO. 28407 | 474-AlaSerLeuGluLysLeuGlyLeuAspLysMetPro-485 |
| SEQ. ID. NO. 28408 | 494-SerLeuSerAspAsnAlaLysLeu-501 |
| SEQ. ID. NO. 28409 | 503-GlyCysProGluGlyPhe-508 |
| SEQ. ID. NO. 28410 | 534-MetProGlyLeuPro-538 |
| SEQ. ID. NO. 28411 | 541-ProAlaAlaGluLysIleAspValAspGluHisGly-552 |
| Hydrophilic Regions - Hopp-Woods | |
| SEQ. ID. NO. 28412 | 3-PheLysThrAspAlaGluThrAlaGln-11 |
| SEQ. ID. NO. 28413 | 38-TyrLysAlaLysIleAsnPro-44 |
| SEQ. ID. NO. 28414 | 46-GluAlaPheLysLeuProGlnLysGlnGlyArg-56 |
| SEQ. ID. NO. 28415 | 67-ProAlaGlyGluGlyLysThr-73 |
| SEQ. ID. NO. 28416 | 81-AspAlaLeuArgHisIleGlyLysAspSerValIleAlaLeuArgGluProSer-98 |
| SEQ. ID. NO. 28417 | 155-LeuAsnIleAspProLysArgValLeuTrp-164 |
| SEQ. ID. NO. 28418 | 166-ArgValValAspMetAsnAspArgGlnLeuArgAsnIleIle-179 |
| SEQ. ID. NO. 28419 | 181-GlyMetGlyLysProValAspGlyValMetArgProAspGlyPhe-195 |
| SEQ. ID. NO. 28420 | 211-LysAspIleSerAspLeuLysGluArgPheGly-221 |
| SEQ. ID. NO. 28421 | 228-AlaLysAspGlySer-232 |
| SEQ. ID. NO. 28422 | 237-LysAspLeuLysAla-241 |
| SEQ. ID. NO. 28423 | 287-ArgLeuAlaLysHisLeuAla-293 |
| SEQ. ID. NO. 28424 | 306-LeuGlyAlaGluLysPheCysAspIleLysCysArgLeuAlaGlyLeuLysProAspAla-325 |
| SEQ. ID. NO. 28425 | 339-GlyGlyValGluArgAlaAsnLeuGlyGluGluAsnLeuGluAlaLeuAla-355 |
| SEQ. ID. NO. 28426 | 383-PheValSerAspSerAspAlaGluLeuAlaMetIleGluLysAlaCysAla-399 |
| SEQ. ID. NO. 28427 | 420-AspLeuAlaArgLysValValAsn-427 |
| SEQ. ID. NO. 28428 | 444-LeuGlyIleLysAspLysIleArgAlaIleAla-454 |
| SEQ. ID. NO. 28429 | 458-TyrGlyAlaGluAspValAspPheSerAla-467 |

TABLE 1-continued

| SEQ. ID. NO. 28430 | 474-AlaSerLeuGluLysLeuGlyLeuAspLysMetPro-485 |
| SEQ. ID. NO. 28431 | 541-ProAlaAlaGluLysIleAspValAspGluHisGly-552 | g142
AMPHI Regions - AMPHI
| SEQ. ID. NO. 28432 | 26-ArgPheAlaAlaMetProAsnMetValGlyLys-36 |
| SEQ. ID. NO. 28433 | 44-GlyGlnProGlyLysMetPhe-50 |
| SEQ. ID. NO. 28434 | 100-AlaValThrProCysArg-105 |
| SEQ. ID. NO. 28435 | 107-ValCysArgAspAspMetAsn-113 |
| SEQ. ID. NO. 28436 | 118-GlyCysHisArgIleThrGluArgSerLeuLysSerPheLeuGlnIleArgHisPheSerProLeuAsnArg-141 |

Antigenic Index - Jameson-Wolf
| SEQ. ID. NO. 28437 | 37-ProLeuPheGlyArgGlnAlaGlyGlnProGlyLysMet-49 |
| SEQ. ID. NO. 28438 | 60-HisIleAspAlaGluAlaAlaValPheArgGlnAspArgAsnAspSerArgThrPro-78 |
| SEQ. ID. NO. 28439 | 83-HisHisGlyArgArgLeuValGlyAsnArgArgAsnArgArgHisCysAsnAlaValThrProCysArgThrValCysArgAspAspMetAsnAlaCysArgThrGlyCysHisArgIleThrGluArgSerLeuLys-128 |
| SEQ. ID. NO. 28440 | 137-SerProLeuAsnArgProLeuTyrLysAsnAlaAlaHisLysAlaSerProHis-154 |

Hydrophilic Regions - Hopp-Woods
| SEQ. ID. NO. 28441 | 42-GlnAlaGlyGlnPro-46 |
| SEQ. ID. NO. 28442 | 60-HisIleAspAlaGluAlaAlaValPheArgGlnAspArgAsnAspSerArgThr-77 |
| SEQ. ID. NO. 28443 | 84-HisGlyArgArgLeuValGlyAsnArgArgAsnArgArgHisCys-98 |
| SEQ. ID. NO. 28444 | 106-ThrValCysArgAspAspMetAsnAlaCysArg-116 |
| SEQ. ID. NO. 28445 | 121-ArgIleThrGluArgSerLeuLys-128 |
| SEQ. ID. NO. 28446 | 147-AlaAlaHisLysAlaSerPro-153 | g144
AMPHI Regions - AMPHI
| SEQ. ID. NO. 28447 | 36-LeuGlyGlyIleValGlnGluPhe-43 |
| SEQ. ID. NO. 28448 | 45-ValLeuAlaAspGlyVal-50 |
| SEQ. ID. NO. 28449 | 58-PheAspAspAlaAlaSer-63 |
| SEQ. ID. NO. 28450 | 71-IleAsnLysGlnIleGlyArgValAlaGlyArg-81 |
| SEQ. ID. NO. 28451 | 144-TyrArgTyrLeuSerArgHis-150 |
| SEQ. ID. NO. 28452 | 170-GlyProAlaArgCysGlySerAlaTyrSerAlaGly-181 |
| SEQ. ID. NO. 28453 | 185-SerGlyArgCysArgLysThrAlaArgLeuAsnGlyPheArgArgProArgSer-202 |

Antigenic Index - Jameson-Wolf
| SEQ. ID. NO. 28454 | 1-MetSerAspThrProAlaThrArgAspPheGlyLeuIleAspGlyArgAla-17 |
| SEQ. ID. NO. 28455 | 23-LeuSerAsnArgArgGlyThr-29 |
| SEQ. ID. NO. 28456 | 47-AlaAspGlyValArgGluAsnPro-54 |
| SEQ. ID. NO. 28457 | 57-SerPheAspAspAlaAlaSerTyrAlaAspAsnProPheGlnIleAsnLysGlnIleGly-76 |
| SEQ. ID. NO. 28458 | 78-ValAlaGlyArgIleArgGlyAlaAla-86 |
| SEQ. ID. NO. 28459 | 88-AspIleAsnGlyArgThrTyrArgValGluAlaAsnGluGlyArgAsnAlaLeuHisGlyGlySerHis-110 |
| SEQ. ID. NO. 28460 | 120-ValAlaAlaAspGlyArgArgLeuSerGlnArg-130 |
| SEQ. ID. NO. 28461 | 136-ProLeuGlyArgGlyArgProAlaTyr-144 |
| SEQ. ID. NO. 28462 | 146-TyrLeuSerArgHisArgAlaArgArgHisGlyValArgProAspAlaAlaHis-163 |
| SEQ. ID. NO. 28463 | 167-AlaGlyArgGlyProAlaArgCysGlySer-176 |
| SEQ. ID. NO. 28464 | 179-SerAlaGlyArgThrTyrSerGlyArgCysArgLysThrAlaArgLeuAsnGlyPheArgArgProArgSerIle-203 |

Hydrophilic Regions - Hopp-Woods
| SEQ. ID. NO. 28465 | 1-MetSerAspThrProAlaThrArgAsp-9 |
| SEQ. ID. NO. 28466 | 24-SerAsnArgArgGlyThr-29 |
| SEQ. ID. NO. 28467 | 48-AspGlyValArgGluAsnPro-54 |
| SEQ. ID. NO. 28468 | 57-SerPheAspAspAlaAlaSer-63 |
| SEQ. ID. NO. 28469 | 78-ValAlaGlyArgIleArgGlyAlaAla-86 |
| SEQ. ID. NO. 28470 | 89-IleAsnGlyArgThrTyrArgValGluAlaAsnGluGlyArgAsnAlaLeu-105 |
| SEQ. ID. NO. 28471 | 121-AlaAlaAspGlyArgArgLeuSerGln-129 |
| SEQ. ID. NO. 28472 | 138-GlyArgGlyArgProAla-143 |
| SEQ. ID. NO. 28473 | 148-SerArgHisArgAlaArgArgHisGlyValArgProAspAla-161 |
| SEQ. ID. NO. 28474 | 168-GlyArgGlyProAlaArgCys-174 |
| SEQ. ID. NO. 28475 | 182-ArgThrTyrSerGlyArgCysArgLysThrAlaArg-193 |
| SEQ. ID. NO. 28476 | 195-AsnGlyPheArgArgProArgSerIle-203 | g146
AMPHI Regions - AMPHI
| SEQ. ID. NO. 28477 | 20-GlnTyrGlyLeuPheAspPheMetProCys-29 |
| SEQ. ID. NO. 28478 | 34-ProLeuAspAsnPheProThrVal-41 |
| SEQ. ID. NO. 28479 | 95-LeuArgAlaCysAlaValIle-101 |
| SEQ. ID. NO. 28480 | 140-AlaArgArgMetArg-144 |
| SEQ. ID. NO. 28481 | 158-ArgHisGlnArgGlyPheAlaArg-165 |

Antigenic Index - Jameson-Wolf
| SEQ. ID. NO. 28482 | 13-IleAspHisAspLysValGluGln-20 |
| SEQ. ID. NO. 28483 | 29-CysLeuArgGlnProProLeuAspAsn-37 |
| SEQ. ID. NO. 28484 | 41-ValArgProAlaProPheGluAlaArgGlyLysHisValGluArgArgArgGlnAspLysAspThrAspSerPheArgGlnArgValAlaAsnLeuArgArgAlaLeu-76 |
| SEQ. ID. NO. 28485 | 86-AlaCysArgArgGlnArgIleHisAla-94 |
| SEQ. ID. NO. 28486 | 112-SerLeuLeuArgAspLysArgPhe-119 |
| SEQ. ID. NO. 28487 | 138-ArgArgAlaArgArgMetArgHisGlyAsnAla-148 |
| SEQ. ID. NO. 28488 | 155-GlnGlnProArgHisGlnArgGlyPheAla-164 |
| SEQ. ID. NO. 28489 | 166-AlaGlySerGlyArgAsnAspLysAspValAlaPheSerIle-179 |
| SEQ. ID. NO. 28490 | 193-ValSerGlnArgThr-197 |

Hydrophilic Regions - Hopp-Woods
| SEQ. ID. NO. 28491 | 13-IleAspHisAspLysValGluGln-20 |
| SEQ. ID. NO. 28492 | 44-AlaProPheGluAlaArgGlyLysHisValGluArgArgArgGlnAspLysAspThrAspSerPheArgGlnArgValAlaAsnLeuArgArgAlaLeu-76 |
| SEQ. ID. NO. 28493 | 86-AlaCysArgArgGlnArgIleHisAla-94 |
| SEQ. ID. NO. 28494 | 112-SerLeuLeuArgAspLysArgPhe-119 |
| SEQ. ID. NO. 28495 | 138-ArgArgAlaArgArgMetArgHisGlyAsn-147 |

TABLE 1-continued

| | |
|---|---|
| SEQ. ID. NO. 28496 | 156-GlnProArgHisGlnArgGlyPheAla-164 |
| SEQ. ID. NO. 28497 | 167-GlySerGlyArgAsnAspLysAspValAla-176 | g148
AMPHI Regions - AMPHI

| | |
|---|---|
| SEQ. ID. NO. 28498 | 25-AlaAspLysIleArgLysIleGluAsnTrpPro-35 |
| SEQ. ID. NO. 28499 | 49-GlnSerAlaGluTyrPheArgLeuLeuValAspLeu-60 |
| SEQ. ID. NO. 28500 | 150-AlaGlyLeuGluLeuIleArgLysLeuGlyGlyGluIle-162 |
| SEQ. ID. NO. 28501 | 165-AlaAlaAlaIleLeuGluPheThrAspLeuGlnGlyGlyLysAsnIleArg-181 |

Antigenic Index - Jameson-Wolf

| | |
|---|---|
| SEQ. ID. NO. 28502 | 4-LysThrSerAsnLeu-8 |
| SEQ. ID. NO. 28503 | 24-LeuAlaAspLysIleArgLysIleGluAsnTrpProGlnLysGly-38 |
| SEQ. ID. NO. 28504 | 66-MetAspGlnLysIleAspIle-72 |
| SEQ. ID. NO. 28505 | 76-LeuAspAlaArgGly-80 |
| SEQ. ID. NO. 28506 | 97-ProIleArgLysLysGlyLysLeuPro-105 |
| SEQ. ID. NO. 28507 | 117-TyrGlyGluAlaAlaVal-122 |
| SEQ. ID. NO. 28508 | 124-IleHisThrAspAlaValLysProGlySerArg-134 |
| SEQ. ID. NO. 28509 | 153-GluLeuIleArgLysLeuGlyGlyGluIleValGlu-164 |
| SEQ. ID. NO. 28510 | 172-ThrAspLeuGlnGlyGlyLysAsnIleArgAlaSerGlyAlaPro-186 |
| SEQ. ID. NO. 28511 | 192-GlnAsnGluGlyCysMetLysGly-199 |

Hydrophilic Regions - Hopp-Woods

| | |
|---|---|
| SEQ. ID. NO. 28512 | 24-LeuAlaAspLysIleArgLysIleGluAsnTrpPro-35 |
| SEQ. ID. NO. 28513 | 66-MetAspGlnLysIleAspIle-72 |
| SEQ. ID. NO. 28514 | 97-ProIleArgLysLysGlyLysLeuPro-105 |
| SEQ. ID. NO. 28515 | 117-TyrGlyGluAlaAlaVal-122 |
| SEQ. ID. NO. 28516 | 124-IleHisThrAspAlaValLysProGlySer-133 |
| SEQ. ID. NO. 28517 | 153-GluLeuIleArgLysLeuGlyGlyGluIleValGlu-164 |
| SEQ. ID. NO. 28518 | 178-LysAsnIleArgAlaSerGly-184 |
| SEQ. ID. NO. 28519 | 195-GlyCysMetLysGly-199 | g149
AMPHI Regions - AMPHI

| | |
|---|---|
| SEQ. ID. NO. 28520 | 72-AsnLeuGlyAspAlaLeuAspGlyValProGlyIle-83 |
| SEQ. ID. NO. 28521 | 101-ThrGlyArgArgIleLysValLeuAsnHisHisGlyGluThrGlyAspMet-117 |
| SEQ. ID. NO. 28522 | 135-GlnValGluIleLeuArgGlyProValThr-144 |
| SEQ. ID. NO. 28523 | 152-ValAlaGlyLeuValAsp-157 |
| SEQ. ID. NO. 28524 | 164-ProGluLysMetProGluAsn-170 |
| SEQ. ID. NO. 28525 | 184-AsnLeuGluLysLeu-188 |
| SEQ. ID. NO. 28526 | 220-TyrArgAsnLeuLysArgLeuProAspSerHis-230 |
| SEQ. ID. NO. 28527 | 345-PheProGlyPheGlu-349 |
| SEQ. ID. NO. 28528 | 366-AlaGlyAspAlaValGluAsnPhePheAsnAsn-376 |
| SEQ. ID. NO. 28529 | 389-ProIleGlyArgLeuLys-394 |
| SEQ. ID. NO. 28530 | 411-AlaIleProGluThrVal-416 |
| SEQ. ID. NO. 28531 | 472-GlnProLeuProAspLeuGlyAla-479 |
| SEQ. ID. NO. 28532 | 565-ArgPheGlyAsnTyrIleTyrAlaGln-573 |
| SEQ. ID. NO. 28533 | 576-AsnAspGlyArgGlyProLysSerIleGluAsp-586 |
| SEQ. ID. NO. 28534 | 627-ArgGlyArgLeuLysAsnLeuProSer-635 |
| SEQ. ID. NO. 28535 | 672-LeuThrAspArgIle-676 |

Antigenic Index - Jameson-Wolf

| | |
|---|---|
| SEQ. ID. NO. 28536 | 25-HisGluThrGluGln-29 |
| SEQ. ID. NO. 28537 | 40-GlyLysSerArgProArgAlaThrSerGly-49 |
| SEQ. ID. NO. 28538 | 55-ThrAlaSerAspLysIleIleSerGlyAspThrLeuArgGlnLysAla-70 |
| SEQ. ID. NO. 28539 | 97-IleArgGlyGlnThrGlyArgArgIleLysVal-107 |
| SEQ. ID. NO. 28540 | 109-AsnHisHisGlyGluThrGlyAspMetAlaAspPheSerProAspHis-124 |
| SEQ. ID. NO. 28541 | 137-GluIleLeuArgGlyPro-142 |
| SEQ. ID. NO. 28542 | 157-AspValAlaAspGlyLysIleProGluLysMetProGluAsnGlyValSerGlyGluAlaGlyLeu-178 |
| SEQ. ID. NO. 28543 | 180-LeuSerSerGlyAsnLeuGluLysLeuThrSer-190 |
| SEQ. ID. NO. 28544 | 207-GlyLeuTyrArgLysSerGlyAspTyrAlaValProArgTyrArgAsnLeuLysArgLeuProAspSerHisAlaAspSerGlnThrGly-236 |
| SEQ. ID. NO. 28545 | 244-GlyGluLysGlyPhe-248 |
| SEQ. ID. NO. 28546 | 252-AlaTyrSerAspArgArgAspArgTyrGlyLeuProAlaHisSerHisGluTyrAspAspCysHisAla-274 |
| SEQ. ID. NO. 28547 | 281-SerLeuIleAsnLysArgTyrLeu-288 |
| SEQ. ID. NO. 28548 | 295-LeuThrGluGluAspIleAspTyrAspAsnProGlyLeu-307 |
| SEQ. ID. NO. 28549 | 309-CysGlyPheHisAspGlyAspGlyAlaHis-318 |
| SEQ. ID. NO. 28550 | 320-HisThrHisAsnGlyLysProTrpIleAspLeuArgAsnLysArgTyrGluLeuArgAlaGluTrpLysGlnProPheProGly-347 |
| SEQ. ID. NO. 28551 | 354-HisLeuAsnArgAsnAspTyrHisHisAspGluLysAlaGlyAlaGlyAlaVal-370 |
| SEQ. ID. NO. 28552 | 374-PheAsnAsnLysThrHisAsnAlaArgIleGluLeuArgHisGlnProIleGlyArgLeuLysGlySerTrp-397 |
| SEQ. ID. NO. 28553 | 402-LeuGlyGlnLysSerSerAla-408 |
| SEQ. ID. NO. 28554 | 413-ProGluThrValGln-417 |
| SEQ. ID. NO. 28555 | 421-LeuIleAspAsnAsnValArg-427 |
| SEQ. ID. NO. 28556 | 437-AlaAsnTrpAspAsnPheThrLeuGluGlyGlyValArgValGluLysGlnLysAlaSerIleArgTyrAspLysAlaLeuIleAspArgGluAsnTyrTyrAsnGlnProLeuProAsp-476 |
| SEQ. ID. NO. 28557 | 506-SerHisGlnGluArgLeuProSerThrGlnGluLeuTyrAlaHisGly-521 |
| SEQ. ID. NO. 28558 | 531-ValGlyAsnLysHisLeuAsnGlyArgSerAsnAsnIle-544 |
| SEQ. ID. NO. 28559 | 549-GlyTyrGluGlyAspArgTrpGln-556 |
| SEQ. ID. NO. 28560 | 562-TyrArgAsnArgPheGlyAsn-568 |
| SEQ. ID. NO. 28561 | 574-ThrLeuAsnAspGlyArgGlyProLysSerIleGluAspAspSerGluMetLysLeu-592 |
| SEQ. ID. NO. 28562 | 594-ArgTyrAsnGlnSerGlyAlaAspPheTyrGlyAlaGluGly-607 |
| SEQ. ID. NO. 28563 | 609-IleTyrPheLysProThrProArgTyrArgIle-619 |
| SEQ. ID. NO. 28564 | 621-ValSerGlyAspTyrValArgGlyArgLeuLysAsnLeuProSerLeuProGlyArgGluAspProTyrGlyLysArgProPhe-648 |
| SEQ. ID. NO. 28565 | 651-GlnAlaAspGlnAsnAlaProArgIleProAla-661 |
| SEQ. ID. NO. 28566 | 670-ThrSerLeuThrAspArgIleAspAlaAsnLeuAspTyr-682 |
| SEQ. ID. NO. 28567 | 689-AsnLysLeuAlaArgTyrGluThrArgThrProGlyHis-701 |

TABLE 1-continued

| | |
|---|---|
| SEQ. ID. NO. 28568 | 707-GlyAlaAsnTyrArgArgAsnThrArgTyrGlyGluTrp-719 |
| SEQ. ID. NO. 28569 | 725-AlaAspAsnLeuLeu-729 |
| SEQ. ID. NO. 28570 | 739-PheLeuSerAspThrProGlnMetGlyArgSerPheThrGlyGlyVal-754 |

Hydrophilic Regions - Hopp-Woods

| | |
|---|---|
| SEQ. ID. NO. 28571 | 25-HisGluThrGluGln-29 |
| SEQ. ID. NO. 28572 | 40-GlyLysSerArgProArgAlaThr-47 |
| SEQ. ID. NO. 28573 | 55-ThrAlaSerAspLysIleIleSer-62 |
| SEQ. ID. NO. 28574 | 64-AspThrLeuArgGlnLysAla-70 |
| SEQ. ID. NO. 28575 | 100-GlnThrGlyArgArgIleLysVal-107 |
| SEQ. ID. NO. 28576 | 112-GlyGluThrGlyAspMetAlaAspPheSerPro-122 |
| SEQ. ID. NO. 28577 | 157-AspValAlaAspGlyLysIleProGluLysMetProGluAsnGlyValSerGly-174 |
| SEQ. ID. NO. 28578 | 181-SerSerGlyAsnLeuGluLysLeuThr-189 |
| SEQ. ID. NO. 28579 | 207-GlyLeuTyrArgLysSerGlyAsp-214 |
| SEQ. ID. NO. 28580 | 219-ArgTyrArgAsnLeuLysArgLeuProAspSerHisAlaAspSerGlnThr-235 |
| SEQ. ID. NO. 28581 | 253-TyrSerAspArgArgAspArgTyrGly-261 |
| SEQ. ID. NO. 28582 | 267-HisGluTyrAspAspCysHisAla-274 |
| SEQ. ID. NO. 28583 | 295-LeuThrGluGluAspIleAspTyrAspAsn-304 |
| SEQ. ID. NO. 28584 | 312-HisAspGlyAspGlyAlaHis-318 |
| SEQ. ID. NO. 28585 | 330-LeuArgAsnLysArgTyrGluLeuArgAlaGluTrp-341 |
| SEQ. ID. NO. 28586 | 354-HisLeuAsnArgAsnAspTyrHisHisAspGluLysAlaGlyAspAlaVal-370 |
| SEQ. ID. NO. 28587 | 377-LysThrHisAsnAlaArgIleGluLeuArgHis-387 |
| SEQ. ID. NO. 28588 | 391-GlyArgLeuLysGly-395 |
| SEQ. ID. NO. 28589 | 446-GlyGlyValArgValGluLysGlnLysAlaSerIleArgTyrAspLysAlaLeuIleAspArgGluAsnTyr-469 |
| SEQ. ID. NO. 28590 | 506-SerHisGlnGluArgLeuProSer-513 |
| SEQ. ID. NO. 28591 | 535-HisLeuAsnLysGluArgSerAsnAsn-543 |
| SEQ. ID. NO. 28592 | 550-TyrGluGlyArgArgTrp-555 |
| SEQ. ID. NO. 28593 | 562-TyrArgAsnArgPhe-566 |
| SEQ. ID. NO. 28594 | 575-LeuAsnAspGlyArgGlyProLysSerIleGluAspAspSerGluMetLysLeu-592 |
| SEQ. ID. NO. 28595 | 603-TyrGlyAlaGluGly-607 |
| SEQ. ID. NO. 28596 | 613-ProThrProArgTyrArgIle-619 |
| SEQ. ID. NO. 28597 | 624-AspTyrValArgGlyArgLeuLysAsn-632 |
| SEQ. ID. NO. 28598 | 637-ProGlyArgGluAspProTyrGlyLys-645 |
| SEQ. ID. NO. 28599 | 652-AlaAspGlnAsnAlaProArg-658 |
| SEQ. ID. NO. 28600 | 671-SerLeuThrAspArgIleAspAla-678 |
| SEQ. ID. NO. 28601 | 690-LysLeuAlaArgTyrGluThrArgThrProGly-700 |
| SEQ. ID. NO. 28602 | 709-AsnTyrArgArgAsnThrArgTyrGly-717 | g150

AMPHI Regions - AMPHI

| | |
|---|---|
| SEQ. ID. NO. 28603 | 60-GlyGluIleLeuAspLeuLeu-66 |
| SEQ. ID. NO. 28604 | 87-LeuLeuSerHisPheGlu-92 |
| SEQ. ID. NO. 28605 | 100-PheValLysGlyTyrAla-105 |
| SEQ. ID. NO. 28606 | 132-IleAlaGlyValLeuHisArgPheProAlaLysLeuThrAla-145 |
| SEQ. ID. NO. 28607 | 147-GlnPheAlaGlyLeuLeuArgProLeuAla-156 |
| SEQ. ID. NO. 28608 | 235-GlyValAlaProPheArg-240 |
| SEQ. ID. NO. 28609 | 272-ThrGluTrpGlnGlnPheAlaLys-279 |
| SEQ. ID. NO. 28610 | 304-IleArgGluGlnAla-308 |
| SEQ. ID. NO. 28611 | 327-AlaAlaLysMetAlaLysGluValGluAlaAlaLeuLeuAspValIleIleGly-344 |

Antigenic Index - Jameson-Wolf

| | |
|---|---|
| SEQ. ID. NO. 28612 | 2-TerTyrCysLysAlaAspProPhePro-10 |
| SEQ. ID. NO. 28613 | 17-GlnLysIleThrAlaArgGlnSerAspLysAspValArgHisIleGluIleAspLeuSerGlySerAspLeu-40 |
| SEQ. ID. NO. 28614 | 43-LeuProGlyAspAla-47 |
| SEQ. ID. NO. 28615 | 52-PheAspAsnAspProAlaLeuVal-59 |
| SEQ. ID. NO. 28616 | 69-AsnProAlaThrGluIleGlnAlaGlyGlyLysThrLeu-81 |
| SEQ. ID. NO. 28617 | 93-LeuThrGlnAsnThrProAlaPhe-100 |
| SEQ. ID. NO. 28618 | 108-AlaAspAsnAspGluLeuAspArgIleAlaAla-118 |
| SEQ. ID. NO. 28619 | 163-SerSerSerGlnAlaGluAlaGlyAspGluValHis-174 |
| SEQ. ID. NO. 28620 | 181-ArgPheGluHisGluGlyArgAlaArgAlaGlyGlyAlaSerGlyPhePhe-197 |
| SEQ. ID. NO. 28621 | 199-AspArgLeuGluGluAspGlyThrVal-207 |
| SEQ. ID. NO. 28622 | 210-PheAlaGluArgAsnAspGlyPheArgLeuProGluAspSerArgLysPro-226 |
| SEQ. ID. NO. 28623 | 231-GlySerGlyThrGly-235 |
| SEQ. ID. NO. 28624 | 245-GlnArgAlaAlaGluAsnAlaGluGlyArgAsn-255 |
| SEQ. ID. NO. 28625 | 276-GlnPheAlaLysAspGlyPheLeuHisArgTyrAspPheAlaTrpSerArgAspGlnGluGluLysIleTyrVal-300 |
| SEQ. ID. NO. 28626 | 302-AspLysIleArgGluGlnAlaGlu-309 |
| SEQ. ID. NO. 28627 | 326-AspAlaAlaLysMetAlaLysGluValGlu-335 |
| SEQ. ID. NO. 28628 | 345-AlaGlyHisSerAspGluAspGlyAlaGluGlyTyr-356 |
| SEQ. ID. NO. 28629 | 359-MetLeuArgGluGluLysArgTyrGlnArgAspValTyr-371 |

Hydrophilic Regions - Hopp-Woods

| | |
|---|---|
| SEQ. ID. NO. 28630 | 18-LysIleThrAlaArgGlnSerAspLysAspValArgHisIleGluIleAspLeuSerGly-37 |
| SEQ. ID. NO. 28631 | 72-ThrGluIleGlnAlaGlyGlyLys-79 |
| SEQ. ID. NO. 28632 | 108-AlaAspAsnAspGluLeuAspArgIleAlaAla-118 |
| SEQ. ID. NO. 28633 | 165-SerGlnAlaGluAlaGlyAspGluValHis-174 |
| SEQ. ID. NO. 28634 | 181-ArgPheGluHisGluGlyArgAlaArgAlaGlyGly-192 |
| SEQ. ID. NO. 28635 | 199-AspArgLeuGluGluAspGlyThrVal-207 |
| SEQ. ID. NO. 28636 | 210-PheAlaGluArgAsnAspGlyPheArgLeuProGluAspSerArgLysPro-226 |
| SEQ. ID. NO. 28637 | 246-ArgAlaAlaGluAsnAlaGluGlyArg-254 |
| SEQ. ID. NO. 28638 | 290-TrpSerArgAspGlnGluGluLysIleTyrVal-300 |
| SEQ. ID. NO. 28639 | 302-AspLysIleArgGluGlnAlaGlu-309 |
| SEQ. ID. NO. 28640 | 326-AspAlaAlaLysMetAlaLysGluValGlu-335 |

TABLE 1-continued

| | |
|---|---|
| SEQ. ID. NO. 28641 | 346-GlyHisSerAspGluAspGlyAlaGluGlyTyr-356 |
| SEQ. ID. NO. 28642 | 359-MetLeuArgGluGluLysArgTyrGlnArgAspValTyr-371 | g151
AMPHI Regions - AMPHI

| | |
|---|---|
| SEQ. ID. NO. 28643 | 6-AsnIleAlaIleIleAla-11 |
| SEQ. ID. NO. 28644 | 22-AspGlnLeuLeuArg-26 |
| SEQ. ID. NO. 28645 | 73-AspThrProGlyHis-77 |
| SEQ. ID. NO. 28646 | 81-GlyGlyGluValGluArgValLeuGlyMetValAspCysVal-94 |
| SEQ. ID. NO. 28647 | 128-LysIleAspLysPro-132 |
| SEQ. ID. NO. 28648 | 144-PheGluLeuPheAspAsnLeuGlyAlaThr-153 |
| SEQ. ID. NO. 28649 | 165-SerGlyLeuSerGlyPheAlaLysLeuGluGluThrAspGlu-178 |
| SEQ. ID. NO. 28650 | 182-MetArgProLeuPheAspThrIleLeuLysTyrThr-193 |
| SEQ. ID. NO. 28651 | 248-GlyArgIleAsnGlnLeuLeuGlyPheLysGlyLeuGluArgVal-262 |
| SEQ. ID. NO. 28652 | 273-ValIleIleSerGlyIleGlu-279 |
| SEQ. ID. NO. 28653 | 330-IleArgAspArgLeuGlnLysGluLeu-338 |
| SEQ. ID. NO. 28654 | 348-AspThrAlaAspAla-352 |
| SEQ. ID. NO. 28655 | 396-CysGluProTyrGluAsnLeuThrValAsp-405 |
| SEQ. ID. NO. 28656 | 457-LeuThrArgGlyValGly-462 |
| SEQ. ID. NO. 28657 | 464-MetSerHisValPheAsp-469 |
| SEQ. ID. NO. 28658 | 537-LysGlyLysLysLeuThrAsnIle-544 |
| SEQ. ID. NO. 28659 | 551-GluAlaValArgLeuThrThr-557 |

Antigenic Index - Jameson-Wolf

| | |
|---|---|
| SEQ. ID. NO. 28660 | 1-MetLysGlnIleArg-5 |
| SEQ. ID. NO. 28661 | 13-ValAspHisGlyLysThrThrLeu-20 |
| SEQ. ID. NO. 28662 | 24-LeuLeuArgGlnSerGlyThrPheArgAlaAsnGlnGlnValAspGluArgValMetAspSerAsnAspLeuGluLysGluArgGlyIle-53 |
| SEQ. ID. NO. 28663 | 59-AsnThrAlaIleAspTyrGluGlyCysHis-68 |
| SEQ. ID. NO. 28664 | 72-ValAspThrProGlyHisAlaAspPheGlyGlyGluValGluArg-86 |
| SEQ. ID. NO. 28665 | 99-AspAlaGlnGluGlyProMetProGlnThrArgPheValThr-112 |
| SEQ. ID. NO. 28666 | 128-LysIleAspLysProSerAlaArgProSerTrp-138 |
| SEQ. ID. NO. 28667 | 151-GlyAlaThrAspGluGlnLeuAsp-158 |
| SEQ. ID. NO. 28668 | 171-AlaLysLeuGluGluThrAspGluSerSerAspMetArgProLeu-185 |
| SEQ. ID. NO. 28669 | 193-ThrProAlaProSerGlySerAlaAspGluProLeu-204 |
| SEQ. ID. NO. 28670 | 211-LeuAspTyrAspAsnTyrThrGly-218 |
| SEQ. ID. NO. 28671 | 226-LeuAsnGlyArgIleLysProGlyGln-234 |
| SEQ. ID. NO. 28672 | 241-HisGluGlnGlnIleAla-246 |
| SEQ. ID. NO. 28673 | 257-LysGlyLeuGluArgValProLeuGluGluAlaGluAlaGlyAsp-271 |
| SEQ. ID. NO. 28674 | 277-GlyIleGluAspIleGly-282 |
| SEQ. ID. NO. 28675 | 287-IleThrAspLysAspAsnProLysGlyLeuPro-297 |
| SEQ. ID. NO. 28676 | 300-SerValAspGluProThrLeu-306 |
| SEQ. ID. NO. 28677 | 314-ThrSerProLeuAlaGlyThrGluGlyLysPheValThrSerArgGlnIleArgAspArgLeuGlnLysGluLeuLeu-339 |
| SEQ. ID. NO. 28678 | 344-LeuArgValGluAspThrAlaAspAlaAspValPheArgValSerGlyArgGlyGluLeu-363 |
| SEQ. ID. NO. 28679 | 371-AsnMetArgArgGluGlyTyr-377 |
| SEQ. ID. NO. 28680 | 381-ValGlyLysProArgValValTyrArgAspIleAspGlyGlnLysCysGluProTyrGluAsnLeuThrValAspValProAspAspAsnGlnGly AlaValMetGluGluLeuGlyArgArgArgGlyGluLeuThrAsnMetGluSerAspGlyAsnGlyArgThrArgLeuGluTyr-440 |
| SEQ. ID. NO. 28681 | 467-ValPheAspAspTyrAlaProValLysProAspMetProGlyArgHisAsnGly-484 |
| SEQ. ID. NO. 28682 | 489-GlnGluGlnGlyGlu-493 |
| SEQ. ID. NO. 28683 | 501-AsnLeuGluAspArgGlyArgMetPheValSerProAsnAspLysIleTyr-517 |
| SEQ. ID. NO. 28684 | 524-IleHisSerArgAspAsnAspLeu-531 |
| SEQ. ID. NO. 28685 | 535-ProLeuLysGlyLysLysLeuThrAsnIleArgAlaSerGlyThrAspGluAlaValArg-554 |
| SEQ. ID. NO. 28686 | 569-PheIleAspAspAspGluLeuValGlu-577 |
| SEQ. ID. NO. 28687 | 579-ThrProGlnSerIleArgLeuArgMet-587 |
| SEQ. ID. NO. 28688 | 591-SerGluLeuGluArgArgHisPheLysLysLeuAsp-603 |

Hydrophilic Regions - Hopp-Woods

| | |
|---|---|
| SEQ. ID. NO. 28689 | 1-MetLysGlnIleArg-5 |
| SEQ. ID. NO. 28690 | 29-GlyThrPheArgAla-33 |
| SEQ. ID. NO. 28691 | 35-GlnGlnValAspGluArgValMetAspSerAsnAspLeuGluLysGluArgGlyIle-53 |
| SEQ. ID. NO. 28692 | 60-ThrAlaIleAspTyrGluGly-66 |
| SEQ. ID. NO. 28693 | 80-PheGlyGlyGluValGluArg-86 |
| SEQ. ID. NO. 28694 | 99-AspAlaGlnGluGlyProMetPro-106 |
| SEQ. ID. NO. 28695 | 128-LysIleAspLysProSerAla-134 |
| SEQ. ID. NO. 28696 | 151-GlyAlaThrAspGluGlnLeuAsp-158 |
| SEQ. ID. NO. 28697 | 171-AlaLysLeuGluGluThrAspGluSerSerAspMetArgProLeu-185 |
| SEQ. ID. NO. 28698 | 198-GlySerAlaAspGluProLeu-204 |
| SEQ. ID. NO. 28699 | 226-LeuAsnGlyArgIleLysPro-232 |
| SEQ. ID. NO. 28700 | 241-HisGluGlnGlnIleAla-246 |
| SEQ. ID. NO. 28701 | 258-GlyLeuGluArgValProLeuGluGluAlaGluAlaGlyAsp-271 |
| SEQ. ID. NO. 28702 | 277-GlyIleGluAspIleGly-282 |
| SEQ. ID. NO. 28703 | 287-IleThrAspLysAspAsnProLysGly-295 |
| SEQ. ID. NO. 28704 | 300-SerValAspGluProThrLeu-306 |
| SEQ. ID. NO. 28705 | 318-AlaGlyThrGluGlyLysPheValThr-326 |
| SEQ. ID. NO. 28706 | 328-ArgGlnIleArgAspArgLeuGlnLysGluLeuLeu-339 |
| SEQ. ID. NO. 28707 | 344-LeuArgValGluAspThrAlaAspAlaAspValPheArgValSerGlyArgGlyGluLeu-363 |
| SEQ. ID. NO. 28708 | 371-AsnMetArgArgGluGlyTyr-377 |
| SEQ. ID. NO. 28709 | 381-ValGlyLysProArgValValTyrArgAspIleAspGlyGlnLysCysGluProTyrGlu-400 |
| SEQ. ID. NO. 28710 | 405-AspValProAspAspAsnGlnGlyAlaValMetGluGluLeuGlyArgArgArgGlyGluLeuThrAsnMetGluSerAspGlyAsnGlyArg ThrArgLeu-438 |
| SEQ. ID. NO. 28711 | 472-AlaProValLysProAspMetProGlyArgHis-482 |
| SEQ. ID. NO. 28712 | 489-GlnGluGlnGlyGlu-493 |
| SEQ. ID. NO. 28713 | 502-LeuGluAspArgGlyArgMet-508 |
| SEQ. ID. NO. 28714 | 512-ProAsnAspLysIleTyr-517 |

TABLE 1-continued

| | | |
|---|---|---|
| SEQ. ID. NO. 28715 | 525-HisSerArgAspAsnAspLeu-531 | |
| SEQ. ID. NO. 28716 | 536-LeuLysGlyLysLysLeuThrAsn-543 | |
| SEQ. ID. NO. 28717 | 545-ArgAlaSerGlyThrAspGluAlaValArg-554 | |
| SEQ. ID. NO. 28718 | 569-PheIleAspAspAspGluLeuValGlu-577 | |
| SEQ. ID. NO. 28719 | 583-IleArgLeuArgMet-587 | |
| SEQ. ID. NO. 28720 | 591-SerGluLeuGluArgArgArgHisPheLysLysLeuAsp-603 | | g152
AMPHI Regions - AMPHI

| | |
|---|---|
| SEQ. ID. NO. 28721 | 10-PheProThrArgLeuPhe-15 |
| SEQ. ID. NO. 28722 | 66-ArgPheSerArgPheValArgGlyTrpAlaGlyIleArgGlyTyrLeuLysAsnGlyIleProGluHisIleGlnProGlyHisAsnProLeu-96 |
| SEQ. ID. NO. 28723 | 103-AlaLeuLeuAlaAla-107 |
| SEQ. ID. NO. 28724 | 130-LeuAsnHisLeuValSerGluHisThrGlySerLeu-141 |
| SEQ. ID. NO. 28725 | 150-PheLysLeuLeuAlaValPheSerAlaValHisIleAlaAlaValAlaAlaTyr-167 |
| SEQ. ID. NO. 28726 | 177-ArgProMetIleThr-181 |

Antigenic Index - Jameson-Wolf

| | |
|---|---|
| SEQ. ID. NO. 28727 | 1-MetLysAsnLysThrLysValTrp-8 |
| SEQ. ID. NO. 28728 | 29-SerAlaLysAlaGlyGlyAsp-35 |
| SEQ. ID. NO. 28729 | 61-GlySerAspThrAlaArgPhe-67 |
| SEQ. ID. NO. 28730 | 79-GlyTyrLeuLysAsnGlyIleProGluHisIleGlnProGlyHisAsnProLeu-96 |
| SEQ. ID. NO. 28731 | 119-AlaAsnGluAsnThrPheSerThrAsnGlyTyr-129 |
| SEQ. ID. NO. 28732 | 137-HisThrGlySerLeuIleArg-143 |
| SEQ. ID. NO. 28733 | 169-IlePheLysLysLysAsnLeuVal-176 |
| SEQ. ID. NO. 28734 | 186-IleGluGlyLysThrSerIle-192 |

Hydrophilic Regions - Hopp-Woods

| | |
|---|---|
| SEQ. ID. NO. 28735 | 1-MetLysAsnLysThrLysVal-7 |
| SEQ. ID. NO. 28736 | 63-AspThrAlaArgPhe-67 |
| SEQ. ID. NO. 28737 | 169-IlePheLysLysLysAsnLeuVal-176 |
| SEQ. ID. NO. 28738 | 186-IleGluGlyLysThrSerIle-192 | g153
AMPHI Regions - AMPHI

| | |
|---|---|
| SEQ. ID. NO. 28739 | 17-AlaAlaSerValLeuSerLeuProGluMetMetArgLeuMetValPhe-32 |
| SEQ. ID. NO. 28740 | 96-ThrLeuValAlaTyrIleLysLeuSerSerValAlaLys-108 |
| SEQ. ID. NO. 28741 | 130-ValSerValProGlnHisTrp-136 |
| SEQ. ID. NO. 28742 | 224-ThrIlePheSerGlyIleAlaTyr-231 |
| SEQ. ID. NO. 28743 | 274-AlaLysLysLeuSerHisLeuTyrArgIleThrGluAlaValGlyArgTrpSerMetIleAspIlePheValIle-298 |

Antigenic Index - Jameson-Wolf

| | |
|---|---|
| SEQ. ID. NO. 28744 | 65-IleArgLysGlnAla-69 |
| SEQ. ID. NO. 28745 | 81-ValArgLeuArgGln-85 |
| SEQ. ID. NO. 28746 | 143-ArgLeuThrGlyAsnAsnAla-149 |
| SEQ. ID. NO. 28747 | 151-GlnThrAlaSerGluGlyLysThrCysCysSer-161 |
| SEQ. ID. NO. 28748 | 165-TyrPheArgAspSerAlaGluSerProCysGly-175 |
| SEQ. ID. NO. 28749 | 181-LeuTyrGlyGlyArgProLysSerLeuSer-190 |
| SEQ. ID. NO. 28750 | 215-SerAsnProAlaAlaThrGlu-221 |
| SEQ. ID. NO. 28751 | 234-AspGluGlyAspArgLeu-239 |
| SEQ. ID. NO. 28752 | 272-AlaGlyAlaLysLysLeu-277 |
| SEQ. ID. NO. 28753 | 339-LeuLeuTrpAspLysArgAlaSerAspGlyIleAla-350 |
| SEQ. ID. NO. 28754 | 352-AsnGluThrGluLysTyrAsp-358 |

Hydrophilic Regions - Hopp-Woods

| | |
|---|---|
| SEQ. ID. NO. 28755 | 81-ValArgLeuArgGln-85 |
| SEQ. ID. NO. 28756 | 152-ThrAlaSerGluGlyLysThrCysCys-160 |
| SEQ. ID. NO. 28757 | 168-AspSerAlaGluSerPro-173 |
| SEQ. ID. NO. 28758 | 182-TyrGlyGlyArgProLysSerLeuSer-190 |
| SEQ. ID. NO. 28759 | 234-AspGluGlyAspArgLeu-239 |
| SEQ. ID. NO. 28760 | 273-GlyAlaLysLysLeu-277 |
| SEQ. ID. NO. 28761 | 339-LeuLeuTrpAspLysArgAlaSerAsp-347 |
| SEQ. ID. NO. 28762 | 352-AsnGluThrGluLysTyrAsp-358 | g154
AMPHI Regions - AMPHI

| | |
|---|---|
| SEQ. ID. NO. 28763 | 122-GlyValThrGlyLeuGlyThrLeuLeu-130 |
| SEQ. ID. NO. 28764 | 152-GlnAspIleProProValThr-158 |
| SEQ. ID. NO. 28765 | 262-ThrLysAsnSerLysAsnValLysSer-270 |
| SEQ. ID. NO. 28766 | 298-PheLysGlnSerVal-302 |
| SEQ. ID. NO. 28767 | 360-SerLysGluHisTrpLysGlnGlnPheGlnThrAlaLeuAsnLysGlyLeuThrAla-378 |
| SEQ. ID. NO. 28768 | 389-GlyLysMetIleGluLeuAsnAsp-396 |
| SEQ. ID. NO. 28769 | 429-LysLeuAlaAspLeuLeuAspLysPheAsnAsnLeuPro-441 |
| SEQ. ID. NO. 28770 | 446-ValAlaGluLeuAsnGly-451 |
| SEQ. ID. NO. 28771 | 467-LeuSerSerIleAspLysLeuValGlyAsnProGlnThrGlnAsnIleProAsnGluLeuAsnGlnThr-489 |
| SEQ. ID. NO. 28772 | 506-IleTyrGlyAspValGlnAsnThrLeuGlnSerLeuAspLysThrLeuLysAspValGlnProValIleAsnThrLeuLysGluLys-534 |

Antigenic Index - Jameson-Wolf

| | |
|---|---|
| SEQ. ID. NO. 28773 | 1-MetThrAspAsnSerProProProAsnGlyHisAlaGlnAlaArgValArgLysAsnAsnThr-21 |
| SEQ. ID. NO. 28774 | 43-LysGluIleArgAsnArgGlyProVal-51 |
| SEQ. ID. NO. 28775 | 57-AspSerAlaGluGlyIleGluValAsnAsnThr-67 |
| SEQ. ID. NO. 28776 | 75-AspValGlyArgValThrArgIleLysLeuArgAspAspGlnLysGlyValGlu-92 |
| SEQ. ID. NO. 28777 | 100-AspValSerGlyLeuIleArgSerAspThrGln-110 |
| SEQ. ID. NO. 28778 | 114-ValLysProArgIleAspGlnSerGly-122 |
| SEQ. ID. NO. 28779 | 138-ThrProGlyLysSerGlyGluAlaLysAspValPheGln-150 |
| SEQ. ID. NO. 28780 | 169-LeuIleGlyLysAsnAspArgIleLeuAsn-178 |
| SEQ. ID. NO. 28781 | 196-AlaHisPheAspProSerAspGlnSer-204 |
| SEQ. ID. NO. 28782 | 212-GlnSerProAsnAspLysLeuIle-219 |
| SEQ. ID. NO. 28783 | 227-LeuGluSerGlyIleAsnIleGluThrThrGlySerGlyIleLysLeuAsnSer-244 |

TABLE 1-continued

| | |
|---|---|
| SEQ. ID. NO. 28784 | 256-SerPheAspSerProLysThrLysAsnSerLysAsnValLysSerGluAspSer-273 |
| SEQ. ID. NO. 28785 | 275-ThrLeuTyrAspSerArgSerGluIleAlaAsnLeuProAspAspArgSerLeu-292 |
| SEQ. ID. NO. 28786 | 300-GlnSerValArgGlyLeu-305 |
| SEQ. ID. NO. 28787 | 311-ValGluTyrLysGlyLeuAsnVal-318 |
| SEQ. ID. NO. 28788 | 325-ProTyrPheAspArgAsnAspSer-332 |
| SEQ. ID. NO. 28789 | 345-IleArgIleGluProSerArgLeuGluIleAsnAlaAspGluGlnSerLysGluHisTrpLysGlnGlnPhe-368 |
| SEQ. ID. NO. 28790 | 371-AlaLeuAsnLysGlyLeu-376 |
| SEQ. ID. NO. 28791 | 386-LeuThrGlyGlyLysMetIleGluLeuAsnAspGlnProSerAlaSerProLysLeuArgPro-406 |
| SEQ. ID. NO. 28792 | 416-IleAlaThrArgGlyGlyGlyLeuAspAspLeuGlnValLysLeu-430 |
| SEQ. ID. NO. 28793 | 432-AspLeuLeuAspLysPheAsnAsnLeuProLeuAspLysThrValAla-447 |
| SEQ. ID. NO. 28794 | 450-AsnGlySerLeuAlaGluLeuLysSerAlaLeuLysSerAlaAsn-464 |
| SEQ. ID. NO. 28795 | 469-SerIleAspLysLeuValGlyAsnProGlnThrGlnAsnIleProAsnGluLeuAsnGlnThrLeuLysGluLeuArgIle-495 |
| SEQ. ID. NO. 28796 | 500-ValSerProGlnSer-504 |
| SEQ. ID. NO. 28797 | 516-SerLeuLysThrLeuLysAspValGln-525 |
| SEQ. ID. NO. 28798 | 530-ThrLeuLysGluLysProAsnAla-537 |
| SEQ. ID. NO. 28799 | 541-AsnAsnSerSerLysAspProIleProLysGlySerArg-553 |
| Hydrophilic Regions - Hopp-Woods | |
| SEQ. ID. NO. 28800 | 1-MetThrAspAsnSerProProPro-8 |
| SEQ. ID. NO. 28801 | 12-AlaGlnAlaArgValArgLysAsnAsn-20 |
| SEQ. ID. NO. 28802 | 43-LysGluIleArgAsnArgGly-49 |
| SEQ. ID. NO. 28803 | 57-AspSerAlaGluGlyIleGlu-63 |
| SEQ. ID. NO. 28804 | 75-AspValGlyArgValThrArgIleLysLeuArgAspAspGlnLysGlyValGlu-92 |
| SEQ. ID. NO. 28805 | 105-IleArgSerAspThr-109 |
| SEQ. ID. NO. 28806 | 116-ProArgIleAspGln-120 |
| SEQ. ID. NO. 28807 | 140-GlyLysSerGlyGluAlaLysAspValPheGln-150 |
| SEQ. ID. NO. 28808 | 171-GlyLysAsnAspArgIleLeu-177 |
| SEQ. ID. NO. 28809 | 196-AlaHisPheAspProSerAspGln-203 |
| SEQ. ID. NO. 28810 | 214-ProAsnAspLysLeuIle-219 |
| SEQ. ID. NO. 28811 | 258-AspSerProLysThrLysAsnSerLysAsnValLysSerGluAspSer-273 |
| SEQ. ID. NO. 28812 | 278-AspSerArgSerGluIle-283 |
| SEQ. ID. NO. 28813 | 285-AsnLeuProAspAspArgSer-291 |
| SEQ. ID. NO. 28814 | 311-ValGluTyrLysGly-315 |
| SEQ. ID. NO. 28815 | 328-AspArgAsnAspSer-332 |
| SEQ. ID. NO. 28816 | 345-IleArgIleGluProSerArgLeuGluIleAsnAlaAspGluGlnSerLysGluHisTrpLys-365 |
| SEQ. ID. NO. 28817 | 390-LysMetIleGluLeuAsnAspGlnProSerAlaSerProLysLeuArgPro-406 |
| SEQ. ID. NO. 28818 | 419-ArgGlyGlyGlyLeuAspAspLeuGlnValLysLeu-430 |
| SEQ. ID. NO. 28819 | 432-AspLeuLeuAspLysPheAsn-438 |
| SEQ. ID. NO. 28820 | 441-ProLeuAspLysThrValAla-447 |
| SEQ. ID. NO. 28821 | 454-AlaGluLeuLysSerAlaLeuLysSerAlaAsn-464 |
| SEQ. ID. NO. 28822 | 469-SerIleAspLysLeuValGly-475 |
| SEQ. ID. NO. 28823 | 482-IleProAsnGluLeu-486 |
| SEQ. ID. NO. 28824 | 488-GlnThrLeuLysGluLeuArgIle-495 |
| SEQ. ID. NO. 28825 | 516-SerLeuLysThrLeuLysAspValGln-525 |
| SEQ. ID. NO. 28826 | 530-ThrLeuLysGluLysProAsn-536 |
| SEQ. ID. NO. 28827 | 543-SerSerLysAspProIleProLysGlySerArg-553 |
| g155 | |
| AMPHI Regions - AMPHI | |
| SEQ. ID. NO. 28828 | 28-LysLeuGlyPheGlu-32 |
| SEQ. ID. NO. 28829 | 42-AlaAlaSerLeuAsp-46 |
| SEQ. ID. NO. 28830 | 105-LeuArgAlaLysLysVal-110 |
| SEQ. ID. NO. 28831 | 118-ValProArgIleSerArgAlaGlnAlaLeuAspAlaLeuSerSerMetAlaAsnIleSerGlyTyrArgAlaValIleGluAlaAlaAsnAlaPheGlyArgPhePheThrGly-155 |
| SEQ. ID. NO. 28832 | 175-ValAlaGlyLeuAlaAlaIleGlyThrAlaAsnSerLeuGlyAlaValValArgAlaPhe-194 |
| SEQ. ID. NO. 28833 | 201-AlaGluGlnIleGluSerMetGlyGly-209 |
| SEQ. ID. NO. 28834 | 225-AspGlyTyrAlaLysValMet-231 |
| SEQ. ID. NO. 28835 | 262-LysProAlaProLysLeuIleThrLysGluMetValGluSerMetLys-277 |
| SEQ. ID. NO. 28836 | 294-LeuThrArgProGlyGlu-299 |
| SEQ. ID. NO. 28837 | 307-ValLysIleIleGlyTyrThrAspMetAlaAsnArgLeuAlaGlyGln-322 |
| SEQ. ID. NO. 28838 | 329-ThrAsnLeuValAsnLeuThrLysLeuLeuSer-339 |
| SEQ. ID. NO. 28839 | 403-LysLeuAlaProAlaAlaIle-409 |
| SEQ. ID. NO. 28840 | 427-AsnHisPheIleVal-431 |
| SEQ. ID. NO. 28841 | 450-LeuHisThrProLeuMetSerValThrAsnAlaIleSerGlyIleMet-465 |
| SEQ. ID. NO. 28842 | 468-GlyAlaLeuLeuGln-472 |
| SEQ. ID. NO. 28843 | 477-AsnGlyPheValSerLeuLeuSerPheValAla-487 |
| SEQ. ID. NO. 28844 | 493-IleAsnIlePheGlyGly-498 |
| Antigenic Index - Jameson-Wolf | |
| SEQ. ID. NO. 28845 | 4-GlyIleProArgGluSerLeuSerGlyGluThrArgVal-16 |
| SEQ. ID. NO. 28846 | 44-SerLeuAspAspAlaAla-49 |
| SEQ. ID. NO. 28847 | 72-ValAsnAlaProSerGluGlyGluLeuProLeuLeuLysGluGlyGln-87 |
| SEQ. ID. NO. 28848 | 94-TrpProArgGlnAsnGluAlaLeu-101 |
| SEQ. ID. NO. 28849 | 105-LeuArgAlaLysLysValAsn-111 |
| SEQ. ID. NO. 28850 | 117-MetValProArgIleSerArg-123 |
| SEQ. ID. NO. 28851 | 159-AlaAlaGlyLysValProProAla-166 |
| SEQ. ID. NO. 28852 | 194-PheAspThrArgLeuGluValAlaGluGlnIleGluSerMetGlyGlyLys-210 |
| SEQ. ID. NO. 28853 | 216-PheLeuGlnGluSerGlyGlySerGlyAspGlyTyrAla-228 |
| SEQ. ID. NO. 28854 | 242-LeuPheAlaGluGlnAlaLysGluValAsp-251 |
| SEQ. ID. NO. 28855 | 259-IleProGlyLysProAlaProLysLeuIleThr-269 |
| SEQ. ID. NO. 28856 | 271-GluMetValGluSerMetLysSerGlySer-280 |
| SEQ. ID. NO. 28857 | 289-GlyGlyAsnCysGluLeuThrArgProGlyGluLeuSerVal-302 |
| SEQ. ID. NO. 28858 | 319-LeuAlaGlyGlnSerSer-324 |

TABLE 1-continued

| SEQ. ID. NO. 28859 | 337-LeuLeuSerProAsnLysAspGlyGluIle-346 |
| SEQ. ID. NO. 28860 | 348-LeuAspPheGluAspValIle-354 |
| SEQ. ID. NO. 28861 | 359-ThrValThrArgAspGlyGluIleThrPhePro-369 |
| SEQ. ID. NO. 28862 | 376-SerAlaArgProGlnGlnThrProSerGluLysAlaAlaProAlaAlaLysProGluProLysPro-397 |

Hydrophilic Regions - Hopp-Woods

| SEQ. ID. NO. 28863 | 4-GlyIleProArgGluSerLeuSerGlyGluThrArgVal-16 |
| SEQ. ID. NO. 28864 | 44-SerLeuAspAspAlaAla-49 |
| SEQ. ID. NO. 28865 | 74-AlaProSerGluGlyGluLeuProLeuLeuLysGluGlyGln-87 |
| SEQ. ID. NO. 28866 | 96-ArgGlnAsnGluAlaLeu-101 |
| SEQ. ID. NO. 28867 | 105-LeuArgAlaLysLysValAsn-111 |
| SEQ. ID. NO. 28868 | 117-MetValProArgIleSerArg-123 |
| SEQ. ID. NO. 28869 | 194-PheAspThrArgLeuGluValAlaGluGlnIleGluSerMetGly-208 |
| SEQ. ID. NO. 28870 | 220-SerGlyGlySerGlyAspGlyTyrAla-228 |
| SEQ. ID. NO. 28871 | 242-LeuPheAlaGluGlnAlaLysGluValAsp-251 |
| SEQ. ID. NO. 28872 | 260-ProGlyLysProAlaPro-265 |
| SEQ. ID. NO. 28873 | 271-GluMetValGluSerMetLysSer-278 |
| SEQ. ID. NO. 28874 | 290-GlyAsnCysGluLeuThrArgProGlyGlu-299 |
| SEQ. ID. NO. 28875 | 339-SerProAsnLysAspGlyGluIle-346 |
| SEQ. ID. NO. 28876 | 348-LeuAspPheGluAspValIle-354 |
| SEQ. ID. NO. 28877 | 359-ThrValThrArgAspGlyGluIle-366 |
| SEQ. ID. NO. 28878 | 377-AlaArgProGlnGlnThrProSerGluLysAlaAlaProAlaAlaLysProGluProLysPro-397 | g156
AMPHI Regions - AMPHI

| SEQ. ID. NO. 28879 | 56-AsnGlyPheGluAlaPheAlaProPhe-64 |
| SEQ. ID. NO. 28880 | 80-AlaThrValAsnThr-84 |

Antigenic Index - Jameson-Wolf

| SEQ. ID. NO. 28881 | 21-TyrAlaLysLysAlaGlyGlyPheArgPheLysAspAsnHisAsnProArgGly-38 |
| SEQ. ID. NO. 28882 | 44-GlnGlyAlaAlaAlaAla-48 |
| SEQ. ID. NO. 28883 | 51-HisAlaAlaGlnGlnAsnGlyPheGlu-59 |
| SEQ. ID. NO. 28884 | 73-AlaThrGlyAsnAlaGlyGln-79 |
| SEQ. ID. NO. 28885 | 103-AspLysAlaAlaLeu-107 |

Hydrophilic Regions - Hopp-Woods

| SEQ. ID. NO. 28886 | 21-TyrAlaLysLysAlaGlyGlyPheArgPheLysAspAsnHisAsnPro-36 |
| SEQ. ID. NO. 28887 | 103-AspLysAlaAlaLeu-107 | g157
AMPHI Regions - AMPHI

| SEQ. ID. NO. 28888 | 21-GlyArgAspValArgAlaAla-27 |
| SEQ. ID. NO. 28889 | 29-AlaIleLysIleAsnArgLeuLeuLysArgTyrIleLysArgGly-43 |
| SEQ. ID. NO. 28890 | 57-ArgLeuGlyGlyPheValArgAlaAlaGln-66 |
| SEQ. ID. NO. 28891 | 137-LeuGlyGlnAlaGlyGly-142 |
| SEQ. ID. NO. 28892 | 167-GlnLeuValAspArgLeuProArgGluAla-176 |

Antigenic Index - Jameson-Wolf

| SEQ. ID. NO. 28893 | 1-MetArgAsnGluGluLysArgAlaLeuArgArgGluLeuArgGlyArgArgSerGlnMetGlyArgAspValArgAla-26 |
| SEQ. ID. NO. 28894 | 34-ArgLeuLeuLysArgTyrIleLysArgGlyArgLysIle-46 |
| SEQ. ID. NO. 28895 | 51-ProMetGlyLysGluLeuArg-57 |
| SEQ. ID. NO. 28896 | 64-AlaAlaGlnLysArgGlyAlaLysLeu-72 |
| SEQ. ID. NO. 28897 | 77-IleGluProHisThrArgArgMetTrp-85 |
| SEQ. ID. NO. 28898 | 87-ThrProTyrProGluArgGlyMetGluArgGluArgLysArgGlyArgAlaLysLeu-105 |
| SEQ. ID. NO. 28899 | 110-PheAlaGlyArgLysIleArgVal-117 |
| SEQ. ID. NO. 28900 | 129-GlyIleAspArgGluGlyTyrArgLeuGlyGln-139 |
| SEQ. ID. NO. 28901 | 151-MetLysTyrArgLeuGlnAla-157 |
| SEQ. ID. NO. 28902 | 168-LeuValAspArgLeuProArgGluAlaHisAspLeuProLeu-181 |

Hydrophilic Regions - Hopp-Woods

| SEQ. ID. NO. 28903 | 1-MetArgAsnGluGluLysArgAlaLeuArgArgGluLeuArgGlyArgArgSerGlnMetGlyArgAspValArgAla-26 |
| SEQ. ID. NO. 28904 | 34-ArgLeuLeuLysArgTyrIleLysArgGlyArgLysIle-46 |
| SEQ. ID. NO. 28905 | 64-AlaAlaGlnLysArgGlyAla-70 |
| SEQ. ID. NO. 28906 | 89-TyrProGluArgGlyMetGluArgGluArgLysArgGlyArgAlaLysLeu-105 |
| SEQ. ID. NO. 28907 | 111-AlaGlyArgLysIleArgVal-117 |
| SEQ. ID. NO. 28908 | 129-GlyIleAspArgGluGlyTyrArg-136 |
| SEQ. ID. NO. 28909 | 151-MetLysTyrArgLeuGlnAla-157 |
| SEQ. ID. NO. 28910 | 168-LeuValAspArgLeuProArgGluAlaHisAspLeuPro-180 | g158
AMPHI Regions - AMPHI

| SEQ. ID. NO. 28911 | 20-PheSerArgAlaAlaGluGlnLeuGlu-28 |
| SEQ. ID. NO. 28912 | 33-AlaValSerArgIleValLysArgLeuGlu-42 |
| SEQ. ID. NO. 28913 | 46-GlyValAsnLeuLeuAsnArgThrThrArgGlnLeuAsn-58 |
| SEQ. ID. NO. 28914 | 63-GlyAlaGlnTyrPheArgArgAlaGlnArgIleLeuGlnGlu-76 |
| SEQ. ID. NO. 28915 | 85-LeuAlaValHisGluValProGln-92 |
| SEQ. ID. NO. 28916 | 160-PheAspSerHisPheArgValValAlaSerPro-170 |
| SEQ. ID. NO. 28917 | 178-ThrProGlnSerAlaGluAspLeu-185 |
| SEQ. ID. NO. 28918 | 188-HisGlnCysLeuGlyPheThrGluProGlySerLeuAsnThrTrpAlaVal-204 |
| SEQ. ID. NO. 28919 | 287-AspPheLeuValLysGluLeuGlyLysAsnMetAsnArgThrAsnThr-302 |

Antigenic Index - Jameson-Wolf

| SEQ. ID. NO. 28920 | 1-MetLysThrAsnSerGluGluLeu-8 |
| SEQ. ID. NO. 28921 | 16-GluSerGlySerPheSerArgAlaAlaGluGlnLeuGluMetAlaAsn-31 |
| SEQ. ID. NO. 28922 | 36-ArgIleValLysArgLeuGluGluLysLeuGly-46 |
| SEQ. ID. NO. 28923 | 49-LeuLeuAsnArgThrThrArgGlnLeuAsnLeuThrGluGluGlyAlaGlnTyrPheArgArgAlaGlnArgIleLeuGln-75 |
| SEQ. ID. NO. 28924 | 78-AlaAlaAlaGluThrGluMet-84 |
| SEQ. ID. NO. 28925 | 95-LeuArgValAspSer-99 |
| SEQ. ID. NO. 28926 | 114-LysPheAsnGluArgTyrProHisIleArg-123 |

TABLE 1-continued

| | |
|---|---|
| SEQ. ID. NO. 28927 | 136-IleGluArgLysValAspIle-142 |
| SEQ. ID. NO. 28928 | 144-LeuArgAlaGlyGluLeuAspAspSerGlyLeuArgAla-156 |
| SEQ. ID. NO. 28929 | 168-AlaSerProGluTyrLeuAla-174 |
| SEQ. ID. NO. 28930 | 176-HisGlyThrProGlnSerAlaGluAspLeuAla-186 |
| SEQ. ID. NO. 28931 | 192-GlyPheThrGluProGlySerLeuAsn-200 |
| SEQ. ID. NO. 28932 | 207-AlaGlnGlyAsnProTyrLysIle-214 |
| SEQ. ID. NO. 28933 | 216-ProHisPheThrAlaSerSerGlyGluIleLeu-226 |
| SEQ. ID. NO. 28934 | 229-LeuCysLeuSerSerCysGly-235 |
| SEQ. ID. NO. 28935 | 243-LeuValAspAsnAspIleThrGluGlyLysLeu-253 |
| SEQ. ID. NO. 28936 | 258-AlaGluGlnThrSerAsnLysThrHisProPhe-268 |
| SEQ. ID. NO. 28937 | 273-TyrSerAspLysAlaValAsnLeu-280 |
| SEQ. ID. NO. 28938 | 292-GluLeuGlyLysAsnMetAsnArgThrAsnThrLys-303 |
| Hydrophilic Regions - Hopp-Woods | |
| SEQ. ID. NO. 28939 | 1-MetLysThrAsnSerGluGluLeu-8 |
| SEQ. ID. NO. 28940 | 19-SerPheSerArgAlaAlaGluGlnLeuGluMet-29 |
| SEQ. ID. NO. 28941 | 36-ArgIleValLysArgLeuGluGluLysLeuGly-46 |
| SEQ. ID. NO. 28942 | 58-AsnLeuThrGluGluGlyAlaGlnTyrPheArgArgAlaGlnArgIleLeuGln-75 |
| SEQ. ID. NO. 28943 | 78-AlaAlaAlaGluThrGluMet-84 |
| SEQ. ID. NO. 28944 | 95-LeuArgValAspSer-99 |
| SEQ. ID. NO. 28945 | 114-LysPheAsnGluArgTyrPro-120 |
| SEQ. ID. NO. 28946 | 136-IleGluArgLysValAspIle-142 |
| SEQ. ID. NO. 28947 | 144-LeuArgAlaGlyGluLeuAspAspSerGlyLeuArgAla-156 |
| SEQ. ID. NO. 28948 | 180-GlnSerAlaGluAspLeuAla-186 |
| SEQ. ID. NO. 28949 | 246-AsnAspIleThrGluGlyLysLeu-253 |
| SEQ. ID. NO. 28950 | 260-GlnThrSerAsnLysThrHis-266 |
| SEQ. ID. NO. 28951 | 276-LysAlaValAsnLeu-280 |
| SEQ. ID. NO. 28952 | 292-GluLeuGlyLysAsnMetAsnArgThrAsnThrLys-303 |
| g160 | |
| AMPHI Regions - AMPHI | |
| SEQ. ID. NO. 28953 | 6-LysLeuValAspLeuAlaGlnLeuThrGly-15 |
| SEQ. ID. NO. 28954 | 27-TrpHisGluThrLeu-31 |
| SEQ. ID. NO. 28955 | 69-GlyLeuGlyHisVal-73 |
| SEQ. ID. NO. 28956 | 97-LysGlnCysGlyAsn-101 |
| SEQ. ID. NO. 28957 | 118-AlaAspLeuMetAsnGlyLeuProGluThr-127 |
| SEQ. ID. NO. 28958 | 154-GlyThrValSerValValAsnAlaLeuProSer-164 |
| SEQ. ID. NO. 28959 | 183-LeuSerGlyValLeuLysGlyTrpGlnAspLysArg-194 |
| SEQ. ID. NO. 28960 | 197-HisLeuIleGlnLysValIleAspLysProGlu-207 |
| SEQ. ID. NO. 28961 | 216-ValAlaAlaAlaAsn-220 |
| SEQ. ID. NO. 28962 | 226-LeuMetArgArgPheLysSer-232 |
| SEQ. ID. NO. 28963 | 239-HisAlaPheValAsnHisIleArg-246 |
| SEQ. ID. NO. 28964 | 276-PheGlyLysAlaPheLys-281 |
| Antigenic Index - Jameson-Wolf | |
| SEQ. ID. NO. 28965 | 2-AspIleLeuAspLysLeuValAsp-9 |
| SEQ. ID. NO. 28966 | 13-LeuThrGlySerAlaAspVal-19 |
| SEQ. ID. NO. 28967 | 30-ThrLeuGlnArgGluGlyLeu-36 |
| SEQ. ID. NO. 28968 | 49-IleAspGlyGluThrSerProArgProValGlyThrGlyAsp-62 |
| SEQ. ID. NO. 28969 | 74-LeuSerHisAspGlyLysTyrGlyGluSerLeuGlnProAspIleArgGlnAsnGlyThrPhe-94 |
| SEQ. ID. NO. 28970 | 98-GlnCysGlyAsnGlyLeu-103 |
| SEQ. ID. NO. 28971 | 112-PheArgTyrAspThrHisAla-118 |
| SEQ. ID. NO. 28972 | 120-LeuMetAsnGlyLeu-124 |
| SEQ. ID. NO. 28973 | 146-LeuGluSerGluLysProLeu-152 |
| SEQ. ID. NO. 28974 | 175-LeuGluGlnAspLysAspValGluLeu-183 |
| SEQ. ID. NO. 28975 | 189-GlyTrpGlnAspLysArgLeuGly-196 |
| SEQ. ID. NO. 28976 | 202-ValIleAspLysProGluAspGluTrpAsnIleAspLysMetVal-216 |
| SEQ. ID. NO. 28977 | 225-GlnLeuMetArgArgPheLysSerGlnVal-234 |
| SEQ. ID. NO. 28978 | 252-LeuLeuLeuLysLysThrProAspSerValLeu-262 |
| SEQ. ID. NO. 28979 | 271-GlnSerGluThrHisPhe-276 |
| SEQ. ID. NO. 28980 | 278-LysAlaPheLysArg-282 |
| SEQ. ID. NO. 28981 | 287-SerProGlyGlnTyrArgLysGluGlyGlyGlnLys-298 |
| Hydrophilic Regions - Hopp-Woods | |
| SEQ. ID. NO. 28982 | 2-AspIleLeuAspLysLeuValAsp-9 |
| SEQ. ID. NO. 28983 | 30-ThrLeuGlnArgGluGlyLeu-36 |
| SEQ. ID. NO. 28984 | 50-AspGlyGluThrSerProArgProValGly-59 |
| SEQ. ID. NO. 28985 | 76-HisAspGlyLysTyrGlyGlu-82 |
| SEQ. ID. NO. 28986 | 84-LeuGlnProAspIleArgGln-90 |
| SEQ. ID. NO. 28987 | 146-LeuGluSerGluLysProLeu-152 |
| SEQ. ID. NO. 28988 | 175-LeuGluGlnAspLysAspValGluLeu-183 |
| SEQ. ID. NO. 28989 | 190-TrpGlnAspLysArgLeuGly-196 |
| SEQ. ID. NO. 28990 | 202-ValIleAspLysProGluAspGluTrpAsnIle-212 |
| SEQ. ID. NO. 28991 | 225-GlnLeuMetArgArgPheLysSer-232 |
| SEQ. ID. NO. 28992 | 255-LysLysThrProAspSerValLeu-262 |
| SEQ. ID. NO. 28993 | 278-LysAlaPheLysArg-282 |
| SEQ. ID. NO. 28994 | 290-GlnTyrArgLysGluGlyGlyGlnLys-298 |
| g163 | |
| AMPHI Regions - AMPHI | |
| SEQ. ID. NO. 28995 | 60-SerGlyLeuGlyAsnIle-65 |
| SEQ. ID. NO. 28996 | 67-LeuGlyArgAspGluAsp-72 |
| SEQ. ID. NO. 28997 | 76-PheGlyPheLeuSerTrpLeuAlaMetLeuPhe-86 |
| SEQ. ID. NO. 28998 | 100-AlaGluProLeuMetHisTyrPheSerAspIle-110 |
| SEQ. ID. NO. 28999 | 170-IleSerGlyArgPheGlyAspAlaIleAspIleMetAlaLeuLeuAlaThrPhePheGlyIleIleThrThr-193 |

TABLE 1-continued

| | |
|---|---|
| SEQ. ID. NO. 29000 | 227-MetSerLeuAlaValValSerAlaIleSerGlyValGlyLysGlyValLysValLeuSer-246 |
| SEQ. ID. NO. 29001 | 272-AlaPheGlyAspAsnIleGlyAsnTyrLeuGlyAsnLeuValArg-286 |
| SEQ. ID. NO. 29002 | 313-TrpCysSerTrpAlaProPheValGlyLeuPheIleAla-325 |
| SEQ. ID. NO. 29003 | 346-LeuPheGlyValLeuTrpPhe-352 |
| SEQ. ID. NO. 29004 | 367-AlaGlyGlyMetLeuGluLysMetThrSerSer-377 |
| SEQ. ID. NO. 29005 | 380-ThrLeuLeuPheLysPhePheAsnTyrLeuProLeuProGluLeuThrSerIleValSerLeuLeu-401 |
| SEQ. ID. NO. 29006 | 438-TrpGlyValLeuMetSerAla-444 |
| SEQ. ID. NO. 29007 | 454-GlyLeuGlyAsnLeuGlnSerMetThrLeu-463 |
| SEQ. ID. NO. 29008 | 510-ArgLeuValArgIleMetSer-516 |
| SEQ. ID. NO. 29009 | 520-GluGlnAspIleLeuLysPheLeuLysHisThrAla-531 |
| SEQ. ID. NO. 29010 | 535-MetHisGluLeuGlnArgGluLeu-542 |
| SEQ. ID. NO. 29011 | 574-AspPheMetTyrGlyIle-579 |
| SEQ. ID. NO. 29012 | 583-GlyGlnAspValSerAspGlnLeu-590 |
| SEQ. ID. NO. 29013 | 630-AlaAspIleLeuLysAsnTyr-636 |
| Antigenic Index - Jameson-Wolf | |
| SEQ. ID. NO. 29014 | 29-AspArgAlaLysGlu-33 |
| SEQ. ID. NO. 29015 | 65-IleArgLeuGlyArgAspGluAspValPro-74 |
| SEQ. ID. NO. 29016 | 114-AlaProGluHisArgGlnGln-120 |
| SEQ. ID. NO. 29017 | 166-LeuLysGluLysIleSerGlyArgPheGlyAspAlaIleAsp-179 |
| SEQ. ID. NO. 29018 | 200-GlnLeuGlyAlaGlyLeu-205 |
| SEQ. ID. NO. 29019 | 237-GlyValGlyLysGlyValLysVal-244 |
| SEQ. ID. NO. 29020 | 293-AlaTyrGluArgGluHisLysProTrpPhe-302 |
| SEQ. ID. NO. 29021 | 326-ArgIleSerLysGlyArgThrIleArg-334 |
| SEQ. ID. NO. 29022 | 370-MetLeuGluLysMetThrSerSerProGlu-379 |
| SEQ. ID. NO. 29023 | 409-ThrSerAlaAspSerGlyIle-415 |
| SEQ. ID. NO. 29024 | 421-IleThrSerArgAspLysGlyLeuSerAlaProArgTrp-433 |
| SEQ. ID. NO. 29025 | 451-ArgSerGlyGlyLeuGlyAsn-457 |
| SEQ. ID. NO. 29026 | 484-LeuSerAlaAspLysLysTyrPheGluThrArgValAsnProThrSer-499 |
| SEQ. ID. NO. 29027 | 503-ThrGlyGlyLysTrpLysGluArgLeuVal-512 |
| SEQ. ID. NO. 29028 | 516-SerGlnThrGlnGluGlnAspIle-523 |
| SEQ. ID. NO. 29029 | 537-GluLeuGlnArgGluLeuSerGluGluTyrGlyLeu-548 |
| SEQ. ID. NO. 29030 | 550-ValArgValAspLysMetPheHisGlnAspGluProAla-562 |
| SEQ. ID. NO. 29031 | 566-ValIleArgLysGluThrMetArg-573 |
| SEQ. ID. NO. 29032 | 581-SerValGlyGlnAspValSerAspGlnLeuIleAsnAspGlyLysLeuProHisIleArgHisGlnThrThrTyrLysProTyr-608 |
| SEQ. ID. NO. 29033 | 612-PheAspGlyArgValGlyTyr-618 |
| SEQ. ID. NO. 29034 | 622-TyrMetAsnLysAspGluLeuIle-629 |
| SEQ. ID. NO. 29035 | 632-IleLeuLysAsnTyrGlu-637 |
| SEQ. ID. NO. 29036 | 654-GluGlnValGluLeuAlaGlu-660 |
| Hydrophilic Regions - Hopp-Woods | |
| SEQ. ID. NO. 29037 | 29-AspArgAlaLysGlu-33 |
| SEQ. ID. NO. 29038 | 66-ArgLeuGlyArgAspGluAspValPro-74 |
| SEQ. ID. NO. 29039 | 114-AlaProGluHisArgGlnGln-120 |
| SEQ. ID. NO. 29040 | 166-LeuLysGluLysIleSerGlyArgPheGlyAsp-176 |
| SEQ. ID. NO. 29041 | 238-ValGlyLysGlyValLysVal-244 |
| SEQ. ID. NO. 29042 | 293-AlaTyrGluArgGluHisLysPro-300 |
| SEQ. ID. NO. 29043 | 327-IleSerLysGlyArgThrIleArg-334 |
| SEQ. ID. NO. 29044 | 370-MetLeuGluLysMetThrSerSerPro-378 |
| SEQ. ID. NO. 29045 | 422-ThrSerArgAspLysGlyLeuSer-429 |
| SEQ. ID. NO. 29046 | 484-LeuSerAlaAspLysLysTyrPheGlu-492 |
| SEQ. ID. NO. 29047 | 506-LysTrpLysGluArgLeuVal-512 |
| SEQ. ID. NO. 29048 | 516-SerGlnThrGlnGluGlnAspIle-523 |
| SEQ. ID. NO. 29049 | 537-GluLeuGlnArgGluLeuSerGluGluTyrGlyLeu-548 |
| SEQ. ID. NO. 29050 | 550-ValArgValAspLysMetPheHisGlnAspGluProAla-562 |
| SEQ. ID. NO. 29051 | 566-ValIleArgLysGluThrMetArg-573 |
| SEQ. ID. NO. 29052 | 581-SerValGlyGlnAspValSerAsp-588 |
| SEQ. ID. NO. 29053 | 590-LeuIleAsnAspGlyLysLeuProHis-598 |
| SEQ. ID. NO. 29054 | 622-TyrMetAsnLysAspGluLeuIle-629 |
| SEQ. ID. NO. 29055 | 654-GluGlnValGluLeuAlaGlu-660 |
| g164 | |
| AMPHI Regions - AMPHI | |
| SEQ. ID. NO. 29056 | 12-TyrIleLeuAsnAspCys-17 |
| SEQ. ID. NO. 29057 | 28-LeuSerLysGluLeuAlaGlyLeuLysAla-37 |
| SEQ. ID. NO. 29058 | 62-PhePheGluAsnValArgArgPheProGlu-71 |
| SEQ. ID. NO. 29059 | 75-LeuGlyArgGlnProArgIleAsnAspLeuAlaHis-86 |
| SEQ. ID. NO. 29060 | 104-TyrAlaAsnLeuPheAlaAsnLeuAsnGlyIleGluArgIlePheLys-119 |
| SEQ. ID. NO. 29061 | 179-ValProAlaIleTyrThr-184 |
| SEQ. ID. NO. 29062 | 197-TrpPheAsnArgIle-201 |
| SEQ. ID. NO. 29063 | 226-AlaLysLeuLeuGluGlyTyrGlyLeuSer-235 |
| SEQ. ID. NO. 29064 | 277-GluValGlyGluLeuIle-282 |
| SEQ. ID. NO. 29065 | 289-MetArgGlyTyrLeuAsn-294 |
| SEQ. ID. NO. 29066 | 302-ThrIleValAsnGlyTrpLeuLys-309 |
| SEQ. ID. NO. 29067 | 339-ValTyrProArgGluIleGluGluGlu-347 |
| SEQ. ID. NO. 29068 | 349-HisLysLeuAspAlaValGluAlaAlaAla-358 |
| SEQ. ID. NO. 29069 | 374-PheValGlnLeuLysGluGlyMet-381 |
| SEQ. ID. NO. 29070 | 387-GluIleArgArgHisLeuArgThrVal-395 |
| SEQ. ID. NO. 29071 | 399-PheLysIleProLysGln-404 |
| SEQ. ID. NO. 29072 | 414-AsnAlaThrGlyLysValLeuLysArgValLeuLysGluGlnPheGluGlyAsn-431 |
| Antigenic Index - Jameson-Wolf | |
| SEQ. ID. NO. 29073 | 5-LeuLysAsnSerGlu-9 |
| SEQ. ID. NO. 29074 | 15-AsnAspCysLysAla-19 |

TABLE 1-continued

| | |
|---|---|
| SEQ. ID. NO. 29075 | 27-GlyLeuSerLysGluLeuAlaGly-34 |
| SEQ. ID. NO. 29076 | 37-AlaGlnThrProValGlu-42 |
| SEQ. ID. NO. 29077 | 45-IleTrpThrAspLysSerArgProAlaGlyGluThrAlaGluGly-59 |
| SEQ. ID. NO. 29078 | 65-AsnValArgArgPheProGluLysProAspLeuGlyArgGlnProArgIleAsnAsp-83 |
| SEQ. ID. NO. 29079 | 90-ThrSerGlyThrThrGlyHisProLysGlyAla-100 |
| SEQ. ID. NO. 29080 | 112-AsnGlyIleGluArgIlePheLysIleSerLysArgAspArgPhe-126 |
| SEQ. ID. NO. 29081 | 205-IleSerGlyGlyAlaProLeuAla-212 |
| SEQ. ID. NO. 29082 | 219-PheLysAlaLysPheProArg-225 |
| SEQ. ID. NO. 29083 | 230-GluGlyTyrGlyLeuSerGlyAlaSer-238 |
| SEQ. ID. NO. 29084 | 245-ThrProGluArgGlnLysAlaArgSerVal-254 |
| SEQ. ID. NO. 29085 | 258-LeuProGlyLeuGluAlaLysAlaValAspGluGluLeuValGluValProArgGlyGluValGly-279 |
| SEQ. ID. NO. 29086 | 282-IleValArgGlyGlySerValMet-289 |
| SEQ. ID. NO. 29087 | 297-AlaAlaThrAspGluThrIle-303 |
| SEQ. ID. NO. 29088 | 306-GlyTrpLeuLysThrGlyAsp-312 |
| SEQ. ID. NO. 29089 | 315-ThrIleAspGluAspGly-320 |
| SEQ. ID. NO. 29090 | 325-ValAspArgLysLysAspLeuIleIleSerLysGlyGlnAsnValTyrProArgGluIleGluGluGluIleHisLys-350 |
| SEQ. ID. NO. 29091 | 361-GlyValLysAspArgTyrAlaAspGluGluIle-371 |
| SEQ. ID. NO. 29092 | 377-LeuLysGluGlyMetAspLeuGlyGluAspGluIleArgArgHisLeu-392 |
| SEQ. ID. NO. 29093 | 405-IleHisPheLysAspGlyLeuProArgAsnAlaThrGlyLysValLeuLysArgValLeuLysGluGlnPheGluGlyAsnLys-432 |
| Hydrophilic Regions - Hopp-Woods | |
| SEQ. ID. NO. 29094 | 27-GlyLeuSerLysGluLeuAlaGly-34 |
| SEQ. ID. NO. 29095 | 48-AspLysSerArgProAlaGlyGluThrAlaGluGly-59 |
| SEQ. ID. NO. 29096 | 65-AsnValArgArgPheProGluLysProAspLeuGlyArgGlnProArgIleAsnAsp-83 |
| SEQ. ID. NO. 29097 | 113-GlyIleGluArgIlePheLysIleSerLysArgAspArgPhe-126 |
| SEQ. ID. NO. 29098 | 219-PheLysAlaLysPheProArg-225 |
| SEQ. ID. NO. 29099 | 245-ThrProGluArgGlnLysAlaArgSer-253 |
| SEQ. ID. NO. 29100 | 261-LeuGluAlaLysAlaValAspGluGluLeuValGluValProArgGlyGluValGly-279 |
| SEQ. ID. NO. 29101 | 297-AlaAlaThrAspGluThrIle-303 |
| SEQ. ID. NO. 29102 | 315-ThrIleAspGluAspGly-320 |
| SEQ. ID. NO. 29103 | 325-ValAspArgLysLysAspLeuIleIle-333 |
| SEQ. ID. NO. 29104 | 340-TyrProArgGluIleGluGluGluIleHisLys-350 |
| SEQ. ID. NO. 29105 | 361-GlyValLysAspArgTyrAlaAspGluGluIle-371 |
| SEQ. ID. NO. 29106 | 377-LeuLysGluGlyMetAspLeuGlyGluAspGluIleArgArgHisLeu-392 |
| SEQ. ID. NO. 29107 | 409-AspGlyLeuProArgAsnAlaThr-416 |
| SEQ. ID. NO. 29108 | 418-LysValLeuLysArgValLeuLysGluGlnPheGluGlyAsnLys-432 |
| g165-1 | |
| AMPHI Regions - AMPHI | |
| SEQ. ID. NO. 29109 | 17-AlaThrLeuGlyValLeuLeuLysGluLeu-26 |
| SEQ. ID. NO. 29110 | 33-ThrLeuIleGluArgLeuGluAsp-40 |
| SEQ. ID. NO. 29111 | 73-IleAsnProAlaArgAlaLeuAsnIleAla-82 |
| SEQ. ID. NO. 29112 | 90-GlnPheTrpAlaThr-94 |
| SEQ. ID. NO. 29113 | 108-AsnAlaValProHis-112 |
| SEQ. ID. NO. 29114 | 121-HisCysArgTyrLeuGlnLysArg-128 |
| SEQ. ID. NO. 29115 | 130-AspValPheLysThrGlnLysLeuPheGluAsnMet-141 |
| SEQ. ID. NO. 29116 | 182-ArgLeuThrArgGlnMetValLysTyrLeuGlnGly-193 |
| SEQ. ID. NO. 29117 | 198-ThrGluPheAsnArgHisValGluAspIleLysArgGlu-210 |
| SEQ. ID. NO. 29118 | 364-LysThrLysGluGlu-368 |
| SEQ. ID. NO. 29119 | 371-AlaSerLeuLeuGluTyrTyrProArgGln-380 |
| Antigenic Index - Jameson-Wolf | |
| SEQ. ID. NO. 29120 | 1-MetAlaGluAlaThrAsp-6 |
| SEQ. ID. NO. 29121 | 24-LysGluLeuGluProSerTrp-30 |
| SEQ. ID. NO. 29122 | 36-GluArgLeuGluAspValAlaLeuGluSerSerAsnAlaTrpAsnAsnAlaGlyThrGly-55 |
| SEQ. ID. NO. 29123 | 97-AlaGluGlyLysLeuGluAspAsnSer-105 |
| SEQ. ID. NO. 29124 | 117-MetAsnGluAspHisCysArgTyrLeuGlnLysArgTyrAspValPheLysThrGlnLysLeuPheGlu-139 |
| SEQ. ID. NO. 29125 | 141-MetGluPheSerThrAspArgAsnLysIleSerAsp-152 |
| SEQ. ID. NO. 29126 | 157-IleMetArgGlyArgAspGluAsnGlnPro-166 |
| SEQ. ID. NO. 29127 | 169-AlaAsnTyrSerAlaGluGlyThrAspValAspPheGlyArgLeuThrArgGlnMet-187 |
| SEQ. ID. NO. 29128 | 191-LeuGlnGlyLysGlyValLysThrGluPheAsnArgHisValGluAspIleLysArgGluSerAspGly-213 |
| SEQ. ID. NO. 29129 | 219-ThrAlaAspThrArgAsnProAspTrp-227 |
| SEQ. ID. NO. 29130 | 249-GlnLysSerGlyIleProGluGlyLysGlyTyrGlyGly-261 |
| SEQ. ID. NO. 29131 | 269-PheArgAsnSerAsnProGluThrAlaGluGlnHisAsn-281 |
| SEQ. ID. NO. 29132 | 300-LeuAspThrArgAsnValAspGlyLysArgHisLeu-311 |
| SEQ. ID. NO. 29133 | 322-AsnPheLeuLysGlnLysGlySerPheMet-330 |
| SEQ. ID. NO. 29134 | 361-GluLeuArgLysThrLysGluGluArgPhe-370 |
| SEQ. ID. NO. 29135 | 375-GluTyrTyrProArgGlnThrArgArg-383 |
| SEQ. ID. NO. 29136 | 395-IleXxxTyrAspSerLysLeuArgVal-403 |
| SEQ. ID. NO. 29137 | 410-ValProArgAspAlaArgSerArgIleLeuGluArgArgGlyAlaSerArg-426 |
| SEQ. ID. NO. 29138 | 430-IleSerAlaAspAspThrAlaProSer-438 |
| Hydrophilic Regions - Hopp-Woods | |
| SEQ. ID. NO. 29139 | 1-MetAlaGluAlaThrAsp-6 |
| SEQ. ID. NO. 29140 | 24-LysGluLeuGluPro-28 |
| SEQ. ID. NO. 29141 | 36-GluArgLeuGluAspValAlaLeuGluSer-45 |
| SEQ. ID. NO. 29142 | 97-AlaGluGlyLysLeuGluAspAsnSer-105 |
| SEQ. ID. NO. 29143 | 117-MetAsnGluAspHisCysArgTyrLeuGlnLysArgTyrAspVal-131 |
| SEQ. ID. NO. 29144 | 141-MetGluPheSerThrAspArgAsnLysIleSerAsp-152 |
| SEQ. ID. NO. 29145 | 158-MetArgGlyArgAspGluAsnGlnPro-166 |
| SEQ. ID. NO. 29146 | 172-SerAlaGluGlyThrAspValAspPhe-180 |
| SEQ. ID. NO. 29147 | 182-ArgLeuThrArgGlnMet-187 |
| SEQ. ID. NO. 29148 | 194-LysGlyValLysThrGluPheAsnArgHisValGluAspIleLysArgGluSerAspGly-213 |
| SEQ. ID. NO. 29149 | 219-ThrAlaAspThrArgAsnProAsp-226 |

TABLE 1-continued

| SEQ. ID. NO. 29150 | 252-GlyIleProGluGlyLysGly-258 |
| SEQ. ID. NO. 29151 | 272-SerAsnProGluThrAlaGluGlnHisAsn-281 |
| SEQ. ID. NO. 29152 | 300-LeuAspThrArgAsnValAspGlyLysArg-309 |
| SEQ. ID. NO. 29153 | 361-GluLeuArgLysThrLysGluGluArgPhe-370 |
| SEQ. ID. NO. 29154 | 378-ProArgGlnThrArgArg-383 |
| SEQ. ID. NO. 29155 | 397-TyrAspSerLysLeuArg-402 |
| SEQ. ID. NO. 29156 | 410-ValProArgAspAlaArgSerArgIleLeuGluArgArgGlyAlaSerArg-426 |
| SEQ. ID. NO. 29157 | 431-SerAlaAspAspThrAlaPro-437 | g204
AMPHI Regions - AMPHI
| SEQ. ID. NO. 29158 | 16-HisIleAlaSerValLeuHisGlyGly-24 |
| SEQ. ID. NO. 29159 | 45-GlnPheAlaAlaValPheGlyAspIleAlaHisGlnPheGly-58 |
| SEQ. ID. NO. 29160 | 89-ValValGlyMetLeuSerGlyGln-96 |
| SEQ. ID. NO. 29161 | 104-GlnAlaPheAsnArgIleThrAspLeuPhePhe-114 |
| SEQ. ID. NO. 29162 | 132-ArgArgIleValAspValPheAsp-139 |
| SEQ. ID. NO. 29163 | 144-PheArgArgAlaLeuCysArgIleLeuArgLeuPheArgArgIlePheGly-160 |
| SEQ. ID. NO. 29164 | 229-ArgAlaPheCysAla-233 |

Antigenic Index - Jameson-Wolf
| SEQ. ID. NO. 29165 | 4-AlaGluIleLysArgProLeu-10 |
| SEQ. ID. NO. 29166 | 34-LeuGlnGlyGlyMetArgAsnGlnVal-42 |
| SEQ. ID. NO. 29167 | 55-HisGlnPheGlyLys-59 |
| SEQ. ID. NO. 29168 | 68-ArgProAlaArgArgArgValLeu-75 |
| SEQ. ID. NO. 29169 | 82-PheAlaAspAspGlyPheGln-88 |
| SEQ. ID. NO. 29170 | 93-LeuSerGlyGlnProAspGlyValLeu-101 |
| SEQ. ID. NO. 29171 | 125-SerGlnSerGlnThrGlyAsnArgArgIleValAsp-136 |
| SEQ. ID. NO. 29172 | 138-PheAspPheGluAsnArgPheArgArgAlaLeu-148 |
| SEQ. ID. NO. 29173 | 162-AlaAlaGlyGlyLysGlnGlnAla-169 |
| SEQ. ID. NO. 29174 | 172-GlnHisGlyLysArgTyrPhe-178 |
| SEQ. ID. NO. 29175 | 187-SerLysCysArgLeuLysCysArgLeuLysArgGlyArgArgArgPheGlyArgHisTrp-206 |
| SEQ. ID. NO. 29176 | 209-PheAsnGlyArgMetProThrAlaSerArgThrLeuSerAsnAsnSerArgAlaSerLeu-228 |

Hydrophilic Regions - Hopp-Woods
| SEQ. ID. NO. 29177 | 4-AlaGluIleLysArgProLeu-10 |
| SEQ. ID. NO. 29178 | 68-ArgProAlaArgArgArgValLeu-75 |
| SEQ. ID. NO. 29179 | 83-AlaAspAspGlyPhe-87 |
| SEQ. ID. NO. 29180 | 128-GlnThrGlyAsnArgArgIleValAsp-136 |
| SEQ. ID. NO. 29181 | 138-PheAspPheGluAsnArgPheArgArgAlaLeu-148 |
| SEQ. ID. NO. 29182 | 165-GlyLysGlnGlnAla-169 |
| SEQ. ID. NO. 29183 | 172-GlnHisGlyLysArgTyrPhe-178 |
| SEQ. ID. NO. 29184 | 187-SerLysCysArgLeuLysCysArgLeuLysArgGlyArgArgArgPheGly-203 |
| SEQ. ID. NO. 29185 | 213-MetProThrAlaSerArgThrLeuSerAsnAsnSerArgAlaSerLeu-228 | g205-1
AMPHI Regions - AMPHI
| SEQ. ID. NO. 29186 | 6-PheAlaValLeuGlyGly-11 |
| SEQ. ID. NO. 29187 | 21-SerGluAsnThrAlaGluGlnProGlnAsnAlaAlaGlnSer-34 |
| SEQ. ID. NO. 29188 | 87-GlyLysHisProAsnAspLeuGluAlaValValGlyLys-99 |
| SEQ. ID. NO. 29189 | 119-HisThrLeuPheAlaLysLeuValLeuGlyAsnIleAlaGluAspGlyGlyLys-135 |
| SEQ. ID. NO. 29190 | 147-GlnProTyrGlnAla-151 |

Antigenic Index - Jameson-Wolf
| SEQ. ID. NO. 29191 | 18-CysGlyLysSerGluAsnThrAlaGluGlnProGlnAsnAlaAlaGlnSerAlaProLysProValPhe-40 |
| SEQ. ID. NO. 29192 | 56-GlyGlnSerSerGluGlyLysThrAsnAspGlyLysLysGlnIle-70 |
| SEQ. ID. NO. 29193 | 73-ProIleLysGlyLeuProGluGlnAsnAla-82 |
| SEQ. ID. NO. 29194 | 85-LeuThrGlyLysHisProAsnAspLeuGluAlaValVal-97 |
| SEQ. ID. NO. 29195 | 99-LysCysMetGluThrAspGlyLysAspAlaProSerGlyTrpAlaGluAsnGly-116 |
| SEQ. ID. NO. 29196 | 129-IleAlaGluAspGlyGlyLysLeuThr-137 |
| SEQ. ID. NO. 29197 | 149-TyrGlnAlaGlyLysSerGlyTyr-156 |
| SEQ. ID. NO. 29198 | 168-IleAspSerGluGlyAlaPhe-174 |

Hydrophilic Regions - Hopp-Woods
| SEQ. ID. NO. 29199 | 19-GlyLysSerGluAsnThrAlaGluGlnProGln-29 |
| SEQ. ID. NO. 29200 | 57-GlnSerSerGluGlyLysThrAsnAspGlyLysLysGlnIle-70 |
| SEQ. ID. NO. 29201 | 85-LeuThrGlyLysHisProAsnAspLeuGluAlaValVal-97 |
| SEQ. ID. NO. 29202 | 99-LysCysMetGluThrAspGlyLysAspAlaPro-109 |
| SEQ. ID. NO. 29203 | 129-IleAlaGluAspGlyGlyLysLeu-136 |
| SEQ. ID. NO. 29204 | 150-GlnAlaGlyLysSerGly-155 |
| SEQ. ID. NO. 29205 | 168-IleAspSerGluGlyAlaPhe-174 | g206
AMPHI Regions - AMPHI
| SEQ. ID. NO. 29206 | 32-ProLysGlnThrValArgGlnIleGlnAlaVal-42 |
| SEQ. ID. NO. 29207 | 44-IleSerHisIleGlyArgThrGln-51 |
| SEQ. ID. NO. 29208 | 81-CysSerGlyMetIleGln-86 |
| SEQ. ID. NO. 29209 | 99-ArgThrAlaArgAspMet-104 |
| SEQ. ID. NO. 29210 | 150-SerGlyLysThrIleLysThrGlu-157 |

Antigenic Index - Jameson-Wolf
| SEQ. ID. NO. 29211 | 2-PheSerProAspLysThrLeu-8 |
| SEQ. ID. NO. 29212 | 21-GlyThrThrSerGlyLysHisArgGlnProLysProLysGlnThrValArg-37 |
| SEQ. ID. NO. 29213 | 48-GlyArgThrGlnGlySerGlnGluLeu-56 |
| SEQ. ID. NO. 29214 | 66-ThrProTyrLysTrpGlyGlySerSerThr-75 |
| SEQ. ID. NO. 29215 | 96-LysLeuProArgThrAlaArgAspMetAlaAlaAlaSerArgLysIleProAspSerArgLeuLysAlaGly-119 |
| SEQ. ID. NO. 29216 | 126-ThrGlyGlyAlaHisArgTyrSer-133 |
| SEQ. ID. NO. 29217 | 146-HisAlaProGlySerGlyLysThrIleLysThrGluLysLeuSer-160 |

TABLE 1-continued

Hydrophilic Regions - Hopp-Woods
SEQ. ID. NO. 29218    23-ThrSerGlyLysHisArgGlnProLysProLysGlnThrVal-36
SEQ. ID. NO. 29219    48-GlyArgThrGlnGlySerGln-54
SEQ. ID. NO. 29220    96-LysLeuProArgThrAlaArgAspMetAlaAlaAlaSerArgLysIleProAspSerArgLeuLysAlaGly-119
SEQ. ID. NO. 29221    149-GlySerGlyLysThrIleLysThrGluLysLeuSer-160
g211
AMPHI Regions - AMPHI
SEQ. ID. NO. 29222    18-ValGlyAsnGlyValAspLysPheGlyArgGlyAla-29
SEQ. ID. NO. 29223    57-GlnPheGluArgAla-61
SEQ. ID. NO. 29224    99-LysGlyPheAspGluIleAsnProAla-107
SEQ. ID. NO. 29225    109-AlaLeuAlaGlnValIleGluLeu-116
SEQ. ID. NO. 29226    153-AspGlyLysArgHisGlyLysLeuHis-161
Antigenic Index - Jameson-Wolf
SEQ. ID. NO. 29227    8-AsnGlnLeuGlyGlyArgAsnGlyAlaAlaVal-18
SEQ. ID. NO. 29228    20-AsnGlyValAspLysPheGlyArgGlyAlaAspAsnGlnValGluPheLeuGlu-37
SEQ. ID. NO. 29229    44-GlyAlaSerGlyArgAlaAla-50
SEQ. ID. NO. 29230    73-GlyGluAspAspValVal-78
SEQ. ID. NO. 29231    99-LysGlyPheAspGluIleAsnPro-106
SEQ. ID. NO. 29232    140-CysProArgTyrHisProLysLeuHisAspGlyAsnGlnAspGlyLysArgHisGlyLysLeuHisAspGlyAlaTyr-165
SEQ. ID. NO. 29233    169-GlnArgGlnSerAlaGly-174
Hydrophilic Regions - Hopp-Woods
SEQ. ID. NO. 29234    10-LeuGlyGlyArgAsnGlyAla-16
SEQ. ID. NO. 29235    21-GlyValAspLysPheGlyArgGlyAlaAspAsnGlnValGluPheLeuGlu-37
SEQ. ID. NO. 29236    73-GlyGluAspAspValVal-78
SEQ. ID. NO. 29237    100-GlyPheAspGluIleAsn-105
SEQ. ID. NO. 29238    143-TyrHisProLysLeuHisAspGlyAsnGlnAspGlyLysArgHisGlyLysLeuHisAsp-162
g212
AMPHI Regions - AMPHI
SEQ. ID. NO. 29239    6-TrpAspGlyIleProAspIleArgThr-14
SEQ. ID. NO. 29240    16-AspGlnThrIleArgLysHisAlaHis-24
SEQ. ID. NO. 29241    40-PheGlnThrAlaGln-44
SEQ. ID. NO. 29242    63-CysLeuGlnPheAspSerIleAsnLeuIleGluHisIle-75
SEQ. ID. NO. 29243    89-ThrArgArgLeuHisGluHis-95
SEQ. ID. NO. 29244    142-AlaSerThrAlaHis-146
SEQ. ID. NO. 29245    199-ArgLeuLeuGlyHis-203
SEQ. ID. NO. 29246    238-HisAsnHisLeuTyrArgSerIleThrSerAlaGluAlaGluLysIle-253
SEQ. ID. NO. 29247    262-TyrAlaGluProLeuCysGlyLeu-269
SEQ. ID. NO. 29248    288-SerHisProLeuIleGluLeu-294
SEQ. ID. NO. 29249    296-GluAsnThrThrLeu-300
SEQ. ID. NO. 29250    397-TrpAsnGluAlaGluGluAla-403
Antigenic Index - Jameson-Wolf
SEQ. ID. NO. 29251    8-GlyIleProAspIleArgThrLeuAspGlnThrIleArgLysHisAlaHisProLeu-26
SEQ. ID. NO. 29252    33-ProAspAsnGlnIleProAspPheGlnThrAlaGlnAspAlaSerAspSerGluCysArgLeuLysHisArgLeuAspGln-59
SEQ. ID. NO. 29253    85-ProProSerArgThrArgArgLeuHisGlu-94
SEQ. ID. NO. 29254    105-AlaIleProGlnThrGluSerLysSerAspLysProTrp-117
SEQ. ID. NO. 29255    122-GlnThrSerGluArgLysLysProGluHis-131
SEQ. ID. NO. 29256    158-LeuGluAlaArgLysAlaAlaGln-165
SEQ. ID. NO. 29257    168-SerGlyAsnArgGlnGly-173
SEQ. ID. NO. 29258    180-SerProHisAspThrGlyGlnThrGlu-188
SEQ. ID. NO. 29259    193-GlyTyrGlyTyrThrLysArgLeuLeu-201
SEQ. ID. NO. 29260    205-LeuProAspSerAspThrTrpGlyGlyAsn-214
SEQ. ID. NO. 29261    220-AsnTyrSerArgThrGluGlnGlnArgAsnHisGluLeuGlyLeu-234
SEQ. ID. NO. 29262    246-ThrSerAlaGluAlaGluLysIleAla-254
SEQ. ID. NO. 29263    258-LeuAsnThrProTyrAlaGluProLeu-266
SEQ. ID. NO. 29264    303-IleSerHisAspGlyGluLysTrpIle-311
SEQ. ID. NO. 29265    328-ThrGlyAlaHisSerProCysLeuPro-336
SEQ. ID. NO. 29266    346-ArgGlnIleArgGlyGlnThrGlyLeuThrProSerThrProPheSerGluGlnLeuArg-365
SEQ. ID. NO. 29267    376-ProSerTrpHisGly-380
SEQ. ID. NO. 29268    391-AsnSerSerAsnThrGlyTrpAsnGluAlaGluGluAlaSerAsnArgGlnAla-408
Hydrophilic Regions - Hopp-Woods
SEQ. ID. NO. 29269    10-ProAspIleArgThrLeuAspGlnThrIleArgLysHisAla-23
SEQ. ID. NO. 29270    44-GlnAspAlaSerAspSerGluCysArgLeuLysHisArgLeuAspGln-59
SEQ. ID. NO. 29271    87-SerArgThrArgArgLeuHisGlu-94
SEQ. ID. NO. 29272    105-AlaIleProGlnThrGluSerLysSerAspLys-115
SEQ. ID. NO. 29273    122-GlnThrSerGluArgLysLysProGluHis-131
SEQ. ID. NO. 29274    158-LeuGluAlaArgLysAlaAlaGln-165
SEQ. ID. NO. 29275    180-SerProHisAspThrGlyGln-186
SEQ. ID. NO. 29276    206-ProAspSerAspThr-210
SEQ. ID. NO. 29277    222-SerArgThrGluGlnGlnArgAsnHisGlu-231
SEQ. ID. NO. 29278    246-ThrSerAlaGluAlaGluLysIleAla-254
SEQ. ID. NO. 29279    304-SerHisAspGlyGluLysTrpIle-311
SEQ. ID. NO. 29280    346-ArgGlnIleArgGly-350
SEQ. ID. NO. 29281    398-AsnGluAlaGluGluAlaSerAsnArgGlnAla-408
g214-1
Hydrophilic Regions - Hopp-Woods
SEQ. ID. NO. 29282    10-ProAspIleArgThrLeuAspGlnThrIleArgLysHisAla-23
SEQ. ID. NO. 29283    44-GlnAspAlaSerAspSerGluCysArgLeuLysHisArgLeuAspGln-59
SEQ. ID. NO. 29284    87-SerArgThrArgArgLeuHisGlu-94
SEQ. ID. NO. 29285    105-AlaIleProGlnThrGluSerLysSerAspLys-115
SEQ. ID. NO. 29286    122-GlnThrSerGluArgLysLysProGluHis-131

TABLE 1-continued

| SEQ. ID. NO. 29287 | 158-LeuGluAlaArgLysAlaAlaGln-165 |
| --- | --- |
| SEQ. ID. NO. 29288 | 180-SerProHisAspThrGlyGln-186 |
| SEQ. ID. NO. 29289 | 206-ProAspSerAspThr-210 |
| SEQ. ID. NO. 29290 | 222-SerArgThrGluGlnGlnArgAsnHisGlu-231 |
| SEQ. ID. NO. 29291 | 246-ThrSerAlaGluAlaGluLysIleAla-254 |
| SEQ. ID. NO. 29292 | 304-SerHisAspGlyGluLysTrpIle-311 |
| SEQ. ID. NO. 29293 | 346-ArgGlnIleArgGly-350 |
| SEQ. ID. NO. 29294 | 398-AsnGluAlaGluGluAlaSerAsnArgGlnAla-408 |
| Antigenic Index - Jameson-Wolf | |
| SEQ. ID. NO. 29295 | 23-LeuGlnSerAspSerArgArgProIleGlnIleGluAlaAspGlnGlySerLeuAspGlnAlaAsnGlnSerThrThrPheSerGlyAsn-52 |
| SEQ. ID. NO. 29296 | 71-ArgGlyGlyLysGlyGlyGluSerValArgAlaGluGlySerProValArgPheSerGlnThrLeuAspGlyGlyLysGlyThrValArgGly GlnAlaAsnAsnVal-106 |
| SEQ. ID. NO. 29297 | 119-GlyAsnAlaLysValGlnArgGlyGlyAspValAlaGlu-131 |
| SEQ. ID. NO. 29298 | 138-AsnThrLysThrGluVal-143 |
| SEQ. ID. NO. 29299 | 148-GlySerThrLysSerGlyAlaLysSerAlaSerLysThrGlyArgVal-163 |
| SEQ. ID. NO. 29300 | 169-ProSerSerThrGlnLysThrGlu-176 |
| Hydrophilic Regions - Hopp-Woods | |
| SEQ. ID. NO. 29301 | 25-SerAspSerArgArgProIleGlnIleGluAlaAspGlnGlySerLeuAspGlnAlaAsn-44 |
| SEQ. ID. NO. 29302 | 71-ArgGlyGlyLysGlyGlyGluSerValArgAlaGluGlySerPro-85 |
| SEQ. ID. NO. 29303 | 92-LeuAspGlyGlyLysGlyThrValArgGlyGlnAla-103 |
| SEQ. ID. NO. 29304 | 121-AlaLysValGlnArgGlyGlyAspValAlaGlu-131 |
| SEQ. ID. NO. 29305 | 148-GlySerThrLysSerGlyAlaLysSerAlaSerLysThrGlyArg-162 |
| SEQ. ID. NO. 29306 | 171-SerThrGlnLysThrGlu-176 |
| g215 | |
| AMPHI Regions - AMPHI | |
| SEQ. ID. NO. 29307 | 21-SerLeuSerAlaTrpLeuGlyArgIle-29 |
| SEQ. ID. NO. 29308 | 67-SerAlaLysGlyAlaLysGlnPhe-74 |
| Antigenic Index - Jameson-Wolf | |
| SEQ. ID. NO. 29309 | 3-ValArgTrpArgTyrGly-8 |
| SEQ. ID. NO. 29310 | 28-ArgIleSerGluValGluIleGluGluValArgLeuAsnProAspGluProGlnTyrThrMetAspGlyLeuAspGlyArgArgPheAspGlu GlnGlyTyrLeuLys-63 |
| SEQ. ID. NO. 29311 | 65-HisLeuSerAlaLysGlyAlaLysGlnPheProGluAsnSerAspIleHisPheAspSerProHisLeu-87 |
| SEQ. ID. NO. 29312 | 99-ValGlySerAspGluAlaValTyrHisThrGluAsnLysGlnValLeuPhe-115 |
| SEQ. ID. NO. 29313 | 123-LysThrAlaAspGlyArgArgGlnAlaGlyLysValGluThrGluLysLeuHisValAspThrGluSerGlnTyrAlaGlnThrAspThrProVal-154 |
| SEQ. ID. NO. 29314 | 160-AlaSerHisGlyGlnAlaGlyGly-167 |
| SEQ. ID. NO. 29315 | 170-TyrAsnHisLysThrGly-175 |
| SEQ. ID. NO. 29316 | 179-PheSerSerLysValLys-184 |
| SEQ. ID. NO. 29317 | 187-IleTyrAspThrLysAspMet-193 |
| Hydrophilic Regions - Hopp-Woods | |
| SEQ. ID. NO. 29318 | 29-IleSerGluValGluIleGluGluValArgLeuAsnProAspGluProGlnTyr-46 |
| SEQ. ID. NO. 29319 | 49-AspGlyLeuAspGlyArgArgPheAspGlu-58 |
| SEQ. ID. NO. 29320 | 65-HisLeuSerAlaLysGlyAlaLysGlnPheProGluAsnSerAspIleHisPhe-82 |
| SEQ. ID. NO. 29321 | 99-ValGlySerAspGluAlaValTyr-106 |
| SEQ. ID. NO. 29322 | 108-ThrGluAsnLysGlnValLeu-114 |
| SEQ. ID. NO. 29323 | 123-LysThrAlaAspGlyArgArgGlnAlaGlyLysValGluThrGluLysLeuHisValAspThrGluSerGlnTyrAla-148 |
| SEQ. ID. NO. 29324 | 187-IleTyrAspThrLysAspMet-193 |
| g216-2 | |
| AMPHI Regions - AMPHI | |
| SEQ. ID. NO. 29325 | 19-AlaGluGlyLeuArgGluIleAlaAlaGluLeu-29 |
| SEQ. ID. NO. 29326 | 60-ArgLysMetAlaAla-64 |
| SEQ. ID. NO. 29327 | 165-LeuGlyAspAlaLeuAlaVal-171 |
| SEQ. ID. NO. 29328 | 201-ValAlaAspIleMetHis-206 |
| SEQ. ID. NO. 29329 | 251-GlyAspLeuArgArgLeuPheGlnGluCysAspAsnPheThrGlyLeuSerIle-268 |
| SEQ. ID. NO. 29330 | 272-MetHisThrHisProLysThrIleSerAla-281 |
| SEQ. ID. NO. 29331 | 290-LysValMetGlnAlaAsn-295 |
| Antigenic Index - Jameson-Wolf | |
| SEQ. ID. NO. 29332 | 1-MetAlaGluAsnGluLysTyrLeuAspTrpAlaArg-12 |
| SEQ. ID. NO. 29333 | 14-ValLeuHisThrGluAlaGluGlyLeuArgGluIleAlaAlaGluLeuAspGlu-31 |
| SEQ. ID. NO. 29334 | 43-CysLysGlyArgVal-47 |
| SEQ. ID. NO. 29335 | 51-GlyMetGlyLysSerGlyHisIleGlyArgLysMetAla-63 |
| SEQ. ID. NO. 29336 | 80-GluAlaAlaHisGlyAspLeu-86 |
| SEQ. ID. NO. 29337 | 90-ValAspAsnAspVal-94 |
| SEQ. ID. NO. 29338 | 99-SerAsnSerGlyGluSerAspGluIle-107 |
| SEQ. ID. NO. 29339 | 113-AlaLeuLysArgLysAspIle-119 |
| SEQ. ID. NO. 29340 | 125-ThrAlaArgProAspSerThrMetAlaArgHisAlaAsp-137 |
| SEQ. ID. NO. 29341 | 144-ValSerGlnGluAlaCysProLeu-151 |
| SEQ. ID. NO. 29342 | 177-ArgAlaPheThrProAspSerPheAla-185 |
| SEQ. ID. NO. 29343 | 190-AlaGlySerLeuGlyLys-195 |
| SEQ. ID. NO. 29344 | 203-AspIleMetHisLysGlyGlyGlyLeuProAla-213 |
| SEQ. ID. NO. 29345 | 227-MetSerGluLysGlyGlyLeu-232 |
| SEQ. ID. NO. 29346 | 238-ThrAspGlyGlnGlyCysLeu-244 |
| SEQ. ID. NO. 29347 | 248-PheThrAspGlyAspLeuArgArgLeuPheGlnGluCysAspAsnPheThr-264 |
| SEQ. ID. NO. 29348 | 275-HisProLysThrIleSerAlaGluArgLeuAlaThrGluAlaLeuLys-290 |
| Hydrophilic Regions - Hopp-Woods | |
| SEQ. ID. NO. 29349 | 1-MetAlaGluAsnGluLysTyrLeuAspTrpAlaArg-12 |
| SEQ. ID. NO. 29350 | 14-ValLeuHisThrGluAlaGluGlyLeuArgGluIleAlaAlaGluLeuAspGlu-31 |
| SEQ. ID. NO. 29351 | 43-CysLysGlyArgVal-47 |
| SEQ. ID. NO. 29352 | 56-GlyHisIleGlyArgLysMetAla-63 |
| SEQ. ID. NO. 29353 | 100-AsnSerGlyGluSerAspGluIle-107 |
| SEQ. ID. NO. 29354 | 113-AlaLeuLysArgLysAspIle-119 |

TABLE 1-continued

| SEQ. ID. NO. 29355 | 126-AlaArgProAspSerThrMetAlaArgHisAlaAsp-137 |

SEQ. ID. NO. 29356 144-ValSerGlnGluAla-148
SEQ. ID. NO. 29357 177-ArgAlaPheThrProAspAsp-183
SEQ. ID. NO. 29358 227-MetSerGluLysGlyLeu-232
SEQ. ID. NO. 29359 251-GlyAspLeuArgArgLeuPheGlnGluCysAspAsn-262
SEQ. ID. NO. 29360 277-LysThrIleSerAlaGluArgLeuAlaThrGluAlaLeuLys-290
g218
AMPHI Regions - AMPHI
SEQ. ID. NO. 29361 9-AlaLysValValAsnThrMet-15
SEQ. ID. NO. 29362 23-HisThrMetAspGluIleHisGly-30
SEQ. ID. NO. 29363 78-AlaArgSerTrpTrpArgAsnLeuHisGlyAlaPheGlyThrTrpValSerLeuIleLeu-97
SEQ. ID. NO. 29364 111-TrpGlyGlyLysPheValGlnAlaTrpAsnGlnPhePro-123
SEQ. ID. NO. 29365 176-ThrGluProAsnAsnIle-181
SEQ. ID. NO. 29366 187-PheArgAlaGlyAsnArgPheGlnArgAlaLeuSerVal-199
Antigenic Index - Jameson-Wolf
SEQ. ID. NO. 29367 14-ThrMetProArgAsnGlnGlyTrp-21
SEQ. ID. NO. 29368 26-AspGluIleHisGly-30
SEQ. ID. NO. 29369 62-AlaLysGlnArgGlyIleLys-68
SEQ. ID. NO. 29370 71-LeuLeuProProLysSerArgAlaArgSerTrpTrp-82
SEQ. ID. NO. 29371 86-HisGlyAlaPheGly-90
SEQ. ID. NO. 29372 123-ProAlaGlyLysTrpGlyValGluProAsnProVal-134
SEQ. ID. NO. 29373 143-ValLeuAsnAspGlyLysValLysGlu-151
SEQ. ID. NO. 29374 167-ThrValGlyGluAsnGlyIleAsnProThrGluProAsnAsnIleGlyAsnArgArgProPheArgAlaGlyAsnArgPheGlnArg-195
SEQ. ID. NO. 29375 201-PheAlaGlnArgArgGlyArgGlyMetAspPhe-211
Hydrophilic Regions - Hopp-Woods
SEQ. ID. NO. 29376 26-AspGluIleHisGly-30
SEQ. ID. NO. 29377 64-GlnArgGlyIleLys-68
SEQ. ID. NO. 29378 74-ProLysSerArgAla-78
SEQ. ID. NO. 29379 143-ValLeuAsnAspGlyLysValLysGlu-151
SEQ. ID. NO. 29380 171-AsnGlyIleAsnProThrGluProAsnAsnIleGlyAsnArgArgProPheArgAlaGlyAsnArgPheGlnArg-195
SEQ. ID. NO. 29381 201-PheAlaGlnArgArgGlyArgGlyMetAsp-210
g225-1
AMPHI Regions - AMPHI
SEQ. ID. NO. 29382 23-LeuAlaAspGluLeuThrAsn-29
SEQ. ID. NO. 29383 37-IleLeuArgGlnPhe-41
SEQ. ID. NO. 29384 92-AspLysLeuIleGlySerAlaMetArg-100
SEQ. ID. NO. 29385 122-PheMetGlnHisIlePheLys-128
SEQ. ID. NO. 29386 188-ThrGlyLysAsnIle-192
Antigenic Index - Jameson-Wolf
SEQ. ID. NO. 29387 22-AlaLeuAlaAspGluLeuThr-28
SEQ. ID. NO. 29388 32-SerSerArgGluGlnIleLeu-38
SEQ. ID. NO. 29389 41-PheAlaGluAspGluGlnProVal-48
SEQ. ID. NO. 29390 50-ProValAsnArgAlaProAlaArgArgAlaGlyAsnAlaAspGluLeuIle-66
SEQ. ID. NO. 29391 79-ArgValAsnArgAlaXxxAlaArgArgAlaGlyAsnAlaAspLysLeuIle-95
SEQ. ID. NO. 29392 115-ThrGlyPheAspCysSerGly-121
SEQ. ID. NO. 29393 135-LeuProArgThrSerAlaGluGlnAlaArgMet-145
SEQ. ID. NO. 29394 147-AlaProValAlaArgSerGluLeuGlnProGlyAsp-158
SEQ. ID. NO. 29395 165-LeuGlyGlySerArgIleSer-171
SEQ. ID. NO. 29396 184-HisAlaProArgThrGlyLysAsnIleGlu-193
SEQ. ID. NO. 29397 196-SerLeuSerHisLysTyrTrpSerGlyLys-205
SEQ. ID. NO. 29398 210-ArgArgValLysLysAsnAspProSerArgPhe-220
Hydrophilic Regions - Hopp-Woods
SEQ. ID. NO. 29399 22-AlaLeuAlaAspGluLeuThr-28
SEQ. ID. NO. 29400 32-SerSerArgGluGlnIleLeu-38
SEQ. ID. NO. 29401 41-PheAlaGluAspGluGlnPro-47
SEQ. ID. NO. 29402 53-ArgAlaProAlaArgArgAlaGlyAsnAlaAspGluLeuIle-66
SEQ. ID. NO. 29403 79-ArgValAsnArgAlaXxxAlaArgArgAlaGlyAsnAlaAspLysLeuIle-95
SEQ. ID. NO. 29404 137-ArgThrSerAlaGluGlnAlaArgMet-145
SEQ. ID. NO. 29405 149-ValAlaArgSerGluLeuGlnPro-156
SEQ. ID. NO. 29406 187-ArgThrGlyLysAsnIleGlu-193
SEQ. ID. NO. 29407 210-ArgArgValLysLysAsnAspProSerArg-219
g226
AMPHI Regions - AMPHI
SEQ. ID. NO. 29408 44-LeuIleAlaTyrLeuLys-49
SEQ. ID. NO. 29409 98-GlnLeuAlaGlySerValThrGlyIleValThr-108
SEQ. ID. NO. 29410 142-ThrLeuTyrAlaArgValLeuProPro-150
SEQ. ID. NO. 29411 165-ThrLeuArgArgPhe-169
SEQ. ID. NO. 29412 174-LysLysLeuArgProPheLysProLeuLeuProVal-185
Antigenic Index - Jameson-Wolf
SEQ. ID. NO. 29413 3-GluIleLeuArgGlnProSer-9
SEQ. ID. NO. 29414 25-ValArgThrArgThrGlyAsnIle-32
SEQ. ID. NO. 29415 67-PheArgLeuLysPro-71
SEQ. ID. NO. 29416 81-TyrGlnAsnArgArgLysIle-87
SEQ. ID. NO. 29417 117-GlyProAspThrGlnPhe-122
SEQ. ID. NO. 29418 124-PheProProArgLeu-128
SEQ. ID. NO. 29419 155-ProProLeuLeuProArgLeuGlyProHisThrLeuArgArg-168
SEQ. ID. NO. 29420 171-IleLeuProLysLysLeuArgProPheLys-180

TABLE 1-continued

Hydrophilic Regions - Hopp-Woods
SEQ. ID. NO. 29421    25-ValArgThrArgThr-29
SEQ. ID. NO. 29422    82-GlnAsnArgArgLysIle-87
SEQ. ID. NO. 29423    173-ProLysLysLeuArgPro-178
g227
AMPHI Regions - AMPHI
SEQ. ID. NO. 29424    36-GlyValLeuPheAlaLeuLeuGlnAla-44
SEQ. ID. NO. 29425    51-TrpLeuGlnGlnLeuThrAspAlaLeu-59
SEQ. ID. NO. 29426    74-ValIleSerTyrLeuAspLeuIleAlaAspAspTrpPheSer-87
g230-1
AMPHI Regions - AMPHI
SEQ. ID. NO. 29427    6-GluLysTyrArgThr-10
SEQ. ID. NO. 29428    49-GluHisSerIleAsnAsn-54
SEQ. ID. NO. 29429    56-MetGlnAsnGluGln-60
SEQ. ID. NO. 29430    69-AspAlaValPheGlnSerLeuLeuGln-77
SEQ. ID. NO. 29431    81-LeuLysGlnGlyAlaLys-86
SEQ. ID. NO. 29432    96-GlnIleLysGlnMetIle-101
SEQ. ID. NO. 29433    115-SerHisAlaLeuLeuSer-120
SEQ. ID. NO. 29434    133-PheValGluGluIleArgAspGlnPhe-141
SEQ. ID. NO. 29435    144-GlnAsnLeuValSerLeu-149
SEQ. ID. NO. 29436    161-AlaGluGlnLeuIleArgLeuThrGlnValAsnArgThrIleArg-175
SEQ. ID. NO. 29437    184-PheIleAlaGlnVal-188
SEQ. ID. NO. 29438    194-AspLeuGlnLysPheTyrAsn-200
SEQ. ID. NO. 29439    234-GluValLysAsnAlaPheGluGluArgValAlaArgLeu-246
SEQ. ID. NO. 29440    272-ValAlaAspPheAsnLys-277
SEQ. ID. NO. 29441    284-AspAspAlaPheAsnHisProSerSerLeuAlaGluAla-296
SEQ. ID. NO. 29442    319-SerGlyMetProGluAsnLeuIleAsnAlaVal-329
SEQ. ID. NO. 29443    398-LeuAsnGlyGlyLys-402
SEQ. ID. NO. 29444    426-GluAlaTyrAlaGluLeu-431
SEQ. ID. NO. 29445    461-ThrProProGluAspIleAlaAla-468
SEQ. ID. NO. 29446    488-LeuLeuIleArgTyrPheAsn-494
Antigenic Index - Jameson-Wolf
SEQ. ID. NO. 29447    4-SerIleGluLysTyrArgThrProAla-12
SEQ. ID. NO. 29448    32-SerHisProGlyAlaAsp-37
SEQ. ID. NO. 29449    42-ValGlyAspGluLysIleSerGluHisSerIle-52
SEQ. ID. NO. 29450    56-MetGlnAsnGluGlnAlaAspGlyGlySerProTrpArg-68
SEQ. ID. NO. 29451    80-TyrLeuLysGlnGlyAla-85
SEQ. ID. NO. 29452    92-ValSerSerGluGlnIleLys-98
SEQ. ID. NO. 29453    101-IleValAspAspProAsnPheHisAspAlaAsnGlyLysPhe-114
SEQ. ID. NO. 29454    123-LeuSerGlnArgHisMetSerGluAspGlnPheValGluGluIleArgAsp-139
SEQ. ID. NO. 29455    169-GlnValAsnArgThrIleArgSerHisThrPheAsnProAspGluPhe-184
SEQ. ID. NO. 29456    189-LysAlaSerGluAlaAspLeu-195
SEQ. ID. NO. 29457    199-TyrAsnAlaAsnLysLysAspTyrLeu-207
SEQ. ID. NO. 29458    223-AspPheAlaAspLysGlnThrValSerGluThrGluValLysAsnAlaPheGluGluArgValAlaArg-245
SEQ. ID. NO. 29459    247-ProAlaHisGluAlaLysProSerPheGluGlnGluLysAlaAlaValGluAsnGluLeuLysMetLysLysAlaValAlaAspPheAsnLys
                      AlaLysGluLysLeuGlyAspAspAlaPheAsnHisProSerSerLeuAlaGluAlaAlaLysAsnSerGlyLeuLysValGluThrGln
                      GluThrTrpLeuSerArgGlnAspAlaGlnMetSerGlyMetProGluAsn-324
SEQ. ID. NO. 29460    330-PheSerAspAspValLeuLysLysLysHisAsnSerGlu-342
SEQ. ID. NO. 29461    355-ArgAlaLysGluValArgGluGluLysAsnLeuLeu-366
SEQ. ID. NO. 29462    368-GluGluAlaLysAspAlaValArg-375
SEQ. ID. NO. 29463    377-AlaTyrIleArgThrGluAlaAlaLysLeuAlaGluAsnLysAlaLysGluValLeu-395
SEQ. ID. NO. 29464    399-AsnGlyGlyLysAlaValAsp-405
SEQ. ID. NO. 29465    417-GlnGlnAlaArgGlnSerMetProGluAlaTyr-428
SEQ. ID. NO. 29466    432-LeuLysAlaLysProAlaAsnGlyLysProAla-442
SEQ. ID. NO. 29467    459-AlaValThrProProGluAspIleAla-467
SEQ. ID. NO. 29468    476-AlaLeuAlaGlnGlnGlnSerAlaAsnThrPhe-486
SEQ. ID. NO. 29469    493-PheAsnGlyLysIleLysGlnThrLysGlyAlaGlnSerValAspAsnGlyAspGlyGln-512
Hydrophilic Regions - Hopp-Woods
SEQ. ID. NO. 29470    6-GluLysTyrArgThr-10
SEQ. ID. NO. 29471    42-ValGlyAspGluLysIleSerGlu-49
SEQ. ID. NO. 29472    56-MetGlnAsnGluGlnAlaAspGly-63
SEQ. ID. NO. 29473    92-ValSerSerGluGlnIleLys-98
SEQ. ID. NO. 29474    101-IleValAspAspProAsnPhe-107
SEQ. ID. NO. 29475    110-AlaAsnGlyLysPhe-114
SEQ. ID. NO. 29476    126-ArgHisMetSerGluAspGlnPheValGluGluIleArgAsp-139
SEQ. ID. NO. 29477    189-LysAlaSerGluAlaAspLeu-195
SEQ. ID. NO. 29478    200-AsnAlaAsnLysLysAspTyrLeu-207
SEQ. ID. NO. 29479    223-AspPheAlaAspLysGlnThrValSerGluThrGluValLysAsnAlaPheGluGluArgValAlaArg-245
SEQ. ID. NO. 29480    247-ProAlaHisGluAlaLysProSerPheGluGlnGluLysAlaAlaValGluAsnGluLeuLysMetLysLysAlaValAlaAspPheAsnLys
                      AlaLysGluLysLeuGlyAspAspAlaPheAsn-288
SEQ. ID. NO. 29481    292-SerLeuAlaGluAlaAlaLysAsnSerGlyLeuLysValGluThrGlnGlu-308
SEQ. ID. NO. 29482    310-TrpLeuSerArgGlnAspAlaGlnMet-318
SEQ. ID. NO. 29483    333-AspValLeuLysLysLysHisAsnSer-341
SEQ. ID. NO. 29484    355-ArgAlaLysGluValArgGluGluLysAsnLeuLeu-366
SEQ. ID. NO. 29485    368-GluGluAlaLysAspAlaValArg-375
SEQ. ID. NO. 29486    377-AlaTyrIleArgThrGluAlaAlaLysLeuAlaGluAsnLysAlaLysGluValLeu-395
SEQ. ID. NO. 29487    417-GlnGlnAlaArgGlnSerMetPro-424
SEQ. ID. NO. 29488    432-LeuLysAlaLysProAlaAsnGly-439

TABLE 1-continued

SEQ. ID. NO. 29489 461-ThrProProGluAspIleAla-467
SEQ. ID. NO. 29490 496-LysIleLysGlnThrLysGlyAlaGlnSerValAspAsnGlyAspGlyGln-512
g231-1
AMPHI Regions - AMPHI
SEQ. ID. NO. 29491 7-IleAsnArgProTyrGlnLysProAlaGluLeu-17
SEQ. ID. NO. 29492 98-ArgIlePheSerPheProGln-104
SEQ. ID. NO. 29493 169-TyrAsnGluPheArgThrLeuArgArg-177
SEQ. ID. NO. 29494 209-AlaValAspAspValLysGlyIleAlaVal-218
Antigenic Index - Jameson-Wolf
SEQ. ID. NO. 29495 1-MetSerLysArgLysSerIleAsnArgProTyrGlnLysProAlaGlu-16
SEQ. ID. NO. 29496 18-ProProLeuGlnAsnAsnProProPheTyrArgLysAsnArgArgLeuAsn-34
SEQ. ID. NO. 29497 39-AlaAspGlyGlyCysAlaSerProGlnLysCysArgAlaArgGlyPheGln-55
SEQ. ID. NO. 29498 90-ProAlaValArgProArgArgLeuArg-98
SEQ. ID. NO. 29499 135-MetProArgArgProVal-140
SEQ. ID. NO. 29500 167-HisThrTyrAsnGluPheArgThrLeuArgArgArgAlaGlnVal-181
SEQ. ID. NO. 29501 196-ValAspIleArgHisProAsn-202
SEQ. ID. NO. 29502 209-AlaValAspAspValLysGly-215
Hydrophilic Regions - Hopp-Woods
SEQ. ID. NO. 29503 1-MetSerLysArgLysSerIleAsn-8
SEQ. ID. NO. 29504 10-ProTyrGlnLysProAlaGlu-16
SEQ. ID. NO. 29505 26-PheTyrArgLysAsnArgArg-32
SEQ. ID. NO. 29506 45-SerProGlnLysCysArgAlaArgGly-53
SEQ. ID. NO. 29507 92-ValArgProArgArgLeuArg-98
SEQ. ID. NO. 29508 136-ProArgArgProVal-140
SEQ. ID. NO. 29509 173-ArgThrLeuArgArgArgAlaGlnVal-181
SEQ. ID. NO. 29510 196-ValAspIleArgHis-200
SEQ. ID. NO. 29511 209-AlaValAspAspValLysGly-215
g232
AMPHI Regions - AMPHI
SEQ. ID. NO. 29512 14-AlaIleLeuPheGly-18
SEQ. ID. NO. 29513 21-LeuGlyThrAlaVal-25
SEQ. ID. NO. 29514 68-ValArgGlyThrLysSerLeuLeuArgGluThrVal-79
SEQ. ID. NO. 29515 105-LeuProThrPheThrGln-110
SEQ. ID. NO. 29516 151-ValThrValGlyAlaLeuGlySerThrValCys-161
SEQ. ID. NO. 29517 173-ArgPheGluGlyLeuAsn-178
SEQ. ID. NO. 29518 194-AlaValMetThrLeuIleGlyPhePheGlyGlyPhePheSerValProLeuTyrThrTrpLeu-214
Antigenic Index - Jameson-Wolf
SEQ. ID. NO. 29519 54-ValProAlaLysAlaAlaAspThrGlnIle-63
SEQ. ID. NO. 29520 69-ArgGlyThrLysSerLeuLeuArgGluThrValArgHisAsnProVal-84
SEQ. ID. NO. 29521 112-HisLeuGlyGlyAsnAspAsnVal-119
SEQ. ID. NO. 29522 140-LysPheGlyArgGluArgLeu-146
SEQ. ID. NO. 29523 170-HisGlyHisArgPheGluGly-176
SEQ. ID. NO. 29524 217-AlaSerSerGluThrPheArgAlaArgAla-226
SEQ. ID. NO. 29525 274-IleLysArgGluArgArgPheLeu-281
SEQ. ID. NO. 29526 285-AlaIleArgLysLysPro-290
Hydrophilic Regions - Hopp-Woods
SEQ. ID. NO. 29527 55-ProAlaLysAlaAlaAspThrGlnIle-63
SEQ. ID. NO. 29528 69-ArgGlyThrLysSerLeuLeuArgGluThrValArg-80
SEQ. ID. NO. 29529 140-LysPheGlyArgGluArgLeu-146
SEQ. ID. NO. 29530 172-HisArgPheGluGly-176
SEQ. ID. NO. 29531 220-GluThrPheArgAlaArgAla-226
SEQ. ID. NO. 29532 274-IleLysArgGluArgArgPheLeu-281
SEQ. ID. NO. 29533 285-AlaIleArgLysLysPro-290
g233
AMPHI Regions - AMPHI
SEQ. ID. NO. 29534 36-GluHisValLeuGly-40
SEQ. ID. NO. 29535 61-PheAlaAspLysValGlnThr-67
SEQ. ID. NO. 29536 71-GlnValArgValTrpLysAsn-77
SEQ. ID. NO. 29537 88-AsnGlyValAlaLysLeuLeuGluThr-96
SEQ. ID. NO. 29538 119-AlaLeuAlaArgLeuIleGluGlnAlaGlyAsnAla-130
SEQ. ID. NO. 29539 138-ValProValAlaAspThrLeuLysArgAlaGluSer-149
SEQ. ID. NO. 29540 182-GluAsnLeuGlyGlyIleThrAsp-189
Antigenic Index - Jameson-Wolf
SEQ. ID. NO. 29541 1-MetLysArgLysAsnIle-6
SEQ. ID. NO. 29542 17-ArgPheGlyAlaAspLysProLysGlnTyrValGluIleGlySerLysThrValLeu-35
SEQ. ID. NO. 29543 43-GluArgHisGluAlaValAsp-49
SEQ. ID. NO. 29544 56-SerProGluAspThrPheAlaAspLysValGln-66
SEQ. ID. NO. 29545 75-TrpLysAsnGlyGlyGlnThrArgAlaGluThrValArgAsnGlyVal-90
SEQ. ID. NO. 29546 100-AlaGluThrAspAsn-104
SEQ. ID. NO. 29547 109-AspAlaAlaArgCys-113
SEQ. ID. NO. 29548 115-LeuProSerGluAlaLeu-120
SEQ. ID. NO. 29549 123-LeuIleGluGlnAlaGlyAsnAlaAlaGluGlyGly-134
SEQ. ID. NO. 29550 142-AspThrLeuLysArgAlaGluSerGlyGln-151
SEQ. ID. NO. 29551 155-ThrValAspArgSerGlyLeu-161
SEQ. ID. NO. 29552 183-AsnLeuGlyGlyIleThrAspGluAlaSerAlaValGluLysLeuGlyVal-199
SEQ. ID. NO. 29553 206-GlyAspAlaArgAsnLeuLysLeuThrGlnProGlnAspAlaTyr-220
Hydrophilic Regions - Hopp-Woods
SEQ. ID. NO. 29554 1-MetLysArgLysAsnIle-6
SEQ. ID. NO. 29555 18-PheGlyAlaAspLysProLysGlnTyrVal-27
SEQ. ID. NO. 29556 43-GluArgHisGluAlaValAsp-49

TABLE 1-continued

SEQ. ID. NO. 29557  56-SerProGluAspThrPheAlaAspLysValGln-66
SEQ. ID. NO. 29558  79-GlyGlnThrArgAlaGluThrValArg-87
SEQ. ID. NO. 29559  100-AlaGluThrAspAsn-104
SEQ. ID. NO. 29560  127-AlaGlyAsnAlaAlaGlu-132
SEQ. ID. NO. 29561  142-AspThrLeuLysArgAlaGluSerGlyGln-151
SEQ. ID. NO. 29562  187-IleThrAspGluAlaSerAlaValGluLysLeuGlyVal-199
SEQ. ID. NO. 29563  206-GlyAspAlaArgAsnLeuLys-212
g234
AMPHI Regions - AMPHI
SEQ. ID. NO. 29564  26-ArgSerLeuGluValAlaLysValAla-34
SEQ. ID. NO. 29565  68-AspArgLeuGlySerGln-73
SEQ. ID. NO. 29566  83-GlnGlnThrAsnArgPheAsnValLeuAsnArgThrAsn-95
SEQ. ID. NO. 29567  121-GlyAspValThrGluPhe-126
SEQ. ID. NO. 29568  205-GluAlaValAspAsnLeuValGlnAlaValAspAsn-216
Antigenic Index - Jameson-Wolf
SEQ. ID. NO. 29569  21-AlaThrGluSerSerArgSerLeuGluValAlaLys-32
SEQ. ID. NO. 29570  51-ThrPheAspAsnArgSerSerPhe-58
SEQ. ID. NO. 29571  62-IlePheSerAspSerGluAspArgLeuGlySerGlnAla-74
SEQ. ID. NO. 29572  83-GlnGlnThrAsnArgPheAsnValLeuAsnArgThrAsn-95
SEQ. ID. NO. 29573  99-LeuLysGlnGluSerGlyIleSerGlyLysAlaGlnAsnLeuLysGlyAlaAspTyr-117
SEQ. ID. NO. 29574  121-GlyAspValThrGluPheGlyArgArgAspValGlyAsp-133
SEQ. ID. NO. 29575  140-LeuGlyArgGlyLysSerGlnIle-147
SEQ. ID. NO. 29576  169-GlnGlyAlaGlyGlu-173
SEQ. ID. NO. 29577  175-AlaLeuSerAsnArgGluIle-181
SEQ. ID. NO. 29578  185-GlyGlyThrSerGlyTyrAspAlaThrLeuAsnGlyLysValLeu-199
SEQ. ID. NO. 29579  214-ValAspAsnGlyAlaTrpGlnSerAsnArg-223
Hydrophilic Regions - Hopp-Woods
SEQ. ID. NO. 29580  21-AlaThrGluSerSerArgSerLeuGluValAlaLys-32
SEQ. ID. NO. 29581  52-PheAspAsnArgSerSerPhe-58
SEQ. ID. NO. 29582  62-IlePheSerAspSerGluAspArgLeuGlySerGlnAla-74
SEQ. ID. NO. 29583  99-LeuLysGlnGluSerGlyIleSerGlyLysAlaGlnAsnLeuLysGly-114
SEQ. ID. NO. 29584  122-AspValThrGluPheGlyArgArgAspValGlyAsp-133
SEQ. ID. NO. 29585  141-GlyArgGlyLysSer-145
SEQ. ID. NO. 29586  176-LeuSerAsnArgGluIle-181
g235
AMPHI Regions - AMPHI
SEQ. ID. NO. 29587  8-LeuAlaAlaValLeuAlaLeu-14
SEQ. ID. NO. 29588  18-GlnValArgLysAlaProAsp-24
SEQ. ID. NO. 29589  88-AsnAlaAlaAspIle-92
SEQ. ID. NO. 29590  95-ValArgProGluLysLeuHisGlnIlePhe-104
SEQ. ID. NO. 29591  120-SerTyrGlnIleLeuAspSerValThrThr-129
SEQ. ID. NO. 29592  165-GlyAlaLeuValGlyAlaValValAsnGlnIleAlaAsnSerLeuThr-180
SEQ. ID. NO. 29593  187-SerLysThrAlaAlaTyrAsnLeuLeu-195
Antigenic Index - Jameson-Wolf
SEQ. ID. NO. 29594  17-CysGlnValArgLysAlaProAspLeuAspTyrThrSerPheLysGluSerLysProAla-36
SEQ. ID. NO. 29595  43-ProLeuAsnGluSerProAspValAsnGlyThr-53
SEQ. ID. NO. 29596  79-GluThrPheLysGluAsnGlyLeu-86
SEQ. ID. NO. 29597  93-HisAlaValArgProGluLysLeu-100
SEQ. ID. NO. 29598  131-SerAlaLysAlaArgLeuValAspSerArgAsnGlyLysGluLeuTrpSerGlySerAlaSerIleArgGluGlySerAsnAsnSerAsnSer-161
SEQ. ID. NO. 29599  178-SerLeuThrAspArgGlyTyrGlnValSerLysThrAla-190
SEQ. ID. NO. 29600  197-ProTyrSerArgAsnGlyIleLeuLysGlyProArgPheValGluGluGlnProLys-215
Hydrophilic Regions - Hopp-Woods
SEQ. ID. NO. 29601  18-GlnValArgLysAlaProAspLeuAsp-26
SEQ. ID. NO. 29602  29-SerPheLysGluSerLysPro-35
SEQ. ID. NO. 29603  44-LeuAsnGluSerProAspVal-50
SEQ. ID. NO. 29604  79-GluThrPheLysGluAsnGlyLeu-86
SEQ. ID. NO. 29605  93-HisAlaValArgProGluLysLeu-100
SEQ. ID. NO. 29606  131-SerAlaLysAlaArgLeuValAspSerArgAsnGlyLysGluLeuTrp-146
SEQ. ID. NO. 29607  150-AlaSerIleArgGluGlySerAsnAsnSer-159
SEQ. ID. NO. 29608  179-LeuThrAspArgGlyTyrGln-185
SEQ. ID. NO. 29609  207-ProArgPheValGluGluGlnProLys-215
g236
AMPHI Regions - AMPHI
SEQ. ID. NO. 29610  10-IleLeuArgThrAlaPhe-15
SEQ. ID. NO. 29611  107-PheAlaArgPheAlaAspCysArgProPhe-116
SEQ. ID. NO. 29612  146-AspAspValProArgPhePheAlaGlyGlu-155
SEQ. ID. NO. 29613  168-ArgArgValGlnGlyLysLeu-175
SEQ. ID. NO. 29614  213-GlyGluValGluGlyIleAlaArgIleValThrAlaCysGlnThrLeuLeuGlnProProArgGlnTyrGln-236
SEQ. ID. NO. 29615  245-IleArgLeuLeuHisGlyIlePheAsnArgIleLysValAla-258
SEQ. ID. NO. 29616  275-PheGlyAsnAlaPheGluAspPhe-282
SEQ. ID. NO. 29617  316-ValAlaAspGlyPheArgHisPheAlaAla-325
Antigenic Index - Jameson-Wolf
SEQ. ID. NO. 29618  43-PheGlyGlyAsnGlyLysPheIleThr-51
SEQ. ID. NO. 29619  58-ArgHisGlnGlnGlyLysAla-64
SEQ. ID. NO. 29620  77-PhePheArgArgGlyAsnPheGlyPheArgLeuGlnGlyArgThrAspSerPhe-94
SEQ. ID. NO. 29621  98-GlnArgLeuAspSerGlyGlyTyr-105
SEQ. ID. NO. 29622  111-AlaAspCysArgProPhe-116
SEQ. ID. NO. 29623  126-ValAspGlyArgGluLeuValProSerMetGluGluAspAla-139
SEQ. ID. NO. 29624  145-AlaAspAspValPro-149
SEQ. ID. NO. 29625  152-PheAlaGlyGluAlaGlnAsnArgCysAsnGlnGluAsnGlnAlaAlaArgAspValValGlnGlyGlyLeu-175

TABLE 1-continued

| | |
|---|---|
| SEQ. ID. NO. 29626 | 195-ValGluValGluArgAlaGlnValPheArgAlaGluArgAsnAsnValPhe-211 |
| SEQ. ID. NO. 29627 | 213-GlyGluValGluGlyIleAla-219 |
| SEQ. ID. NO. 29628 | 230-GlnProProArgGlnTyrGln-236 |
| SEQ. ID. NO. 29629 | 261-GlyLysGlnGluAlaGlnGly-267 |
| SEQ. ID. NO. 29630 | 292-IleGlyGlyCysArgProGlnAlaGlnAspValArgAla-304 |
| SEQ. ID. NO. 29631 | 310-PheLeuArgArgAspAspValAlaAspGly-319 |
| SEQ. ID. NO. 29632 | 341-CysAlaSerHisGly-345 |
| Hydrophilic Regions - Hopp-Woods | |
| SEQ. ID. NO. 29633 | 87-LeuGlnGlyArgThrAspSer-93 |
| SEQ. ID. NO. 29634 | 98-GlnArgLeuAspSer-102 |
| SEQ. ID. NO. 29635 | 127-AspGlyArgGluLeuValProSerMetGluGluAspAla-139 |
| SEQ. ID. NO. 29636 | 145-AlaAspAspValPro-149 |
| SEQ. ID. NO. 29637 | 156-AlaGlnAsnArgCysAsnGlnGluAsnGlnAlaAlaArgAspValVal-171 |
| SEQ. ID. NO. 29638 | 195-ValGluValGluArgAlaGlnValPheArgAlaGluArgAsnAsn-209 |
| SEQ. ID. NO. 29639 | 213-GlyGluValGluGlyIleAla-219 |
| SEQ. ID. NO. 29640 | 261-GlyLysGlnGluAlaGlnGly-267 |
| SEQ. ID. NO. 29641 | 295-CysArgProGlnAlaGlnAspValArgAla-304 |
| SEQ. ID. NO. 29642 | 310-PheLeuArgArgAspAspValAlaAspGly-319 |
| g238 | |
| AMPHI Regions - AMPHI | |
| SEQ. ID. NO. 29643 | 103-ValHisSerProPheAsp-108 |
| SEQ. ID. NO. 29644 | 115-ThrSerAspPheSerGlyGlyVal-122 |
| SEQ. ID. NO. 29645 | 129-TyrGlnLeuHisArgThrGlySer-136 |
| SEQ. ID. NO. 29646 | 140-ProAlaAspGlyTyrAspGlyProGlnGlyGlyGlyTyrProGluProGlnGlyAlaArgAspIleTyrSerTyr-164 |
| SEQ. ID. NO. 29647 | 221-AsnArgMetAspAspIleArgGlyIleValGlnGlyAlaValAsnProPheLeuThrGlyPheGlnGlyVal-244 |
| SEQ. ID. NO. 29648 | 246-IleGlyAlaIleThrAspSerAlaValSerProValThrAspThrAlaAlaGlnGlnThrLeuGlnGlyIleAsnAspLeuGlyAsn-274 |
| SEQ. ID. NO. 29649 | 298-IleAsnSerAlaArgGlnTrpAlaAspAla-307 |
| SEQ. ID. NO. 29650 | 342-AspTrpValLysAsn-346 |
| SEQ. ID. NO. 29651 | 351-LysProAlaAlaArgHisMetGlnThrVal-360 |
| SEQ. ID. NO. 29652 | 367-GlyAsnArgProProLysSerIleThrSer-376 |
| SEQ. ID. NO. 29653 | 383-AlaThrTyrProLysLeuValAsnGlnLeuAsnGluGlnAsnLeu-397 |
| SEQ. ID. NO. 29654 | 426-GluGluAlaAspArgLeuGlyLysIleTrpVal-436 |
| SEQ. ID. NO. 29655 | 454-ThrArgGlnTyrArg-458 |
| Antigenic Index - Jameson-Wolf | |
| SEQ. ID. NO. 29656 | 25-HisAlaAsnGlyLeuAspAlaArgLeuArgAspAspMetGlnAlaLysHisTyrGluProGlyGlyLys-47 |
| SEQ. ID. NO. 29657 | 53-AsnAlaArgGlySerValLysAsnArgVal-62 |
| SEQ. ID. NO. 29658 | 80-ThrHisGluArgThrGlyPheGluGly-88 |
| SEQ. ID. NO. 29659 | 96-PheSerGlyHisGlyHisGluVal-103 |
| SEQ. ID. NO. 29660 | 105-SerProPheAspAsnHisAspSerLysSerThrSerSerAspPheSerGlyGlyValAspGlyGly-125 |
| SEQ. ID. NO. 29661 | 131-LeuHisArgThrGlySerGluIleHisProAlaAspGlyTyrAspGlyProGlnGlyGlyGlyTyrProGluProGlnGlyAlaArgAspIleTyr-162 |
| SEQ. ID. NO. 29662 | 166-IleLysGlyThrSerThrLysThrLysIle-175 |
| SEQ. ID. NO. 29663 | 182-ProPheSerAspArgTrpLeuLysGluAsnAlaGlyAla-194 |
| SEQ. ID. NO. 29664 | 200-SerArgAlaAspGluAlaGly-206 |
| SEQ. ID. NO. 29665 | 210-TrpGluAsnAspProAspLysAsnTrpArgAlaAsnArgMetAspAspIleArgGlyIle-229 |
| SEQ. ID. NO. 29666 | 268-GlyIleAsnAspLeuGlyAsnLeuSerProGluAla-279 |
| SEQ. ID. NO. 29667 | 292-PheAlaValLysAspGlyIleAsnSerAlaArgGlnTrpAlaAspAlaHisProAsnIle-311 |
| SEQ. ID. NO. 29668 | 328-ValTrpArgGlyLysLysValGluLeuAsnProThrLysTrpAspTrpValLysAsnThrGlyTyrLysLysProAlaAlaArg-355 |
| SEQ. ID. NO. 29669 | 358-GlnThrValAspGlyGluMetAlaGlyGlyAsnArgProProLysSerIleThrSerGluGlyLysAlaAsn-381 |
| SEQ. ID. NO. 29670 | 391-GlnLeuAsnGluGlnAsnLeu-397 |
| SEQ. ID. NO. 29671 | 401-AlaAlaGlnAspProArgLeu-407 |
| SEQ. ID. NO. 29672 | 411-IleHisGluGlyLysLysAsnPhePro-419 |
| SEQ. ID. NO. 29673 | 423-AlaThrTyrGluGluAlaAspArgLeuGly-432 |
| SEQ. ID. NO. 29674 | 438-GluGlyAlaArgGlnThrSerGlyGlyGlyTrpLeuSerArgAspGlyThrArgGlnTyrArgProProThrGluLysLysSerGln-466 |
| SEQ. ID. NO. 29675 | 480-ThrIleAspSerAsnGluLysArgAsnLysIleLysAsnGly-493 |
| Hydrophilic Regions - Hopp-Woods | |
| SEQ. ID. NO. 29676 | 29-LeuAspAlaArgLeuArgAspAspMetGlnAlaLysHisTyrGluProGlyGly-46 |
| SEQ. ID. NO. 29677 | 54-AlaArgGlySerValLysAsnArgVal-62 |
| SEQ. ID. NO. 29678 | 80-ThrHisGluArgThrGlyPhe-86 |
| SEQ. ID. NO. 29679 | 107-PheAspAsnHisAspSerLysSerThrSerAspPhe-118 |
| SEQ. ID. NO. 29680 | 133-ArgThrGlySerGluIleHisPro-140 |
| SEQ. ID. NO. 29681 | 142-AspGlyTyrAspGlyProGln-148 |
| SEQ. ID. NO. 29682 | 151-GlyTyrProGluProGlnGlyAlaArgAsp-160 |
| SEQ. ID. NO. 29683 | 168-GlyThrSerThrLysThrLysIle-175 |
| SEQ. ID. NO. 29684 | 186-ArgTrpLeuLysGluAsnAlaGly-193 |
| SEQ. ID. NO. 29685 | 200-SerArgAlaAspGluAlaGly-206 |
| SEQ. ID. NO. 29686 | 212-AsnAspProAspLysAsnTrpArgAlaAsnArgMetAspAspIleArgGly-228 |
| SEQ. ID. NO. 29687 | 296-AspGlyIleAsnSer-300 |
| SEQ. ID. NO. 29688 | 329-TrpArgGlyLysLysValGluLeuAsnProThr-339 |
| SEQ. ID. NO. 29689 | 347-ThrGlyTyrLysLysProAlaAlaArg-355 |
| SEQ. ID. NO. 29690 | 360-ValAspGlyGluMetAlaGlyGlyAsnArgProProLysSerIleThrSerGluGlyLysAlaAsn-381 |
| SEQ. ID. NO. 29691 | 392-LeuAsnGluGlnAsnLeu-397 |
| SEQ. ID. NO. 29692 | 401-AlaAlaGlnAspProArgLeu-407 |
| SEQ. ID. NO. 29693 | 412-HisGluGlyLysLysAsnPhe-418 |
| SEQ. ID. NO. 29694 | 424-ThrTyrGluGluAlaAspArgLeuGly-432 |
| SEQ. ID. NO. 29695 | 438-GluGlyAlaArgGlnThrSer-444 |
| SEQ. ID. NO. 29696 | 449-LeuSerArgAspGlyThrArgGlnTyrArgProProThrGluLysLysSerGln-466 |
| SEQ. ID. NO. 29697 | 482-AspSerAsnGluLysArgAsnLysIleLysAsn-492 |
| g239 | |

TABLE 1-continued

AMPHI Regions - AMPHI
SEQ. ID. NO. 29698    49-PheArgLeuValGlnSerCys-55
SEQ. ID. NO. 29699    72-AsnAlaHisArgLysGln-77
SEQ. ID. NO. 29700    123-ProGlyPheAsnAlaLeuProThrIlePhe-132
SEQ. ID. NO. 29701    154-GluTyrPheLeuThr-158
SEQ. ID. NO. 29702    165-SerSerAsnGluTrp-169
SEQ. ID. NO. 29703    221-PheCysAlaThrIleCysAlaSerLeuArg-230
Antigenic Index - Jameson-Wolf
SEQ. ID. NO. 29704    6-GlyIleAlaArgAsnArgArgMetGlu-14
SEQ. ID. NO. 29705    19-CysArgArgProAspArgPheVal-26
SEQ. ID. NO. 29706    28-ArgGlnThrArgLeuLeu-33
SEQ. ID. NO. 29707    53-GlnSerCysGluValGluPro-59
SEQ. ID. NO. 29708    66-HisAsnGlyLysSerGlyAsnAlaHisArgLysGlnGlnLysGluIleArg-82
SEQ. ID. NO. 29709    84-ValHisCysArgSerAspVal-90
SEQ. ID. NO. 29710    100-ProAlaValArgSerAlaThrArgLysThrAla-110
SEQ. ID. NO. 29711    132-PheArgGlyGlySerGlyLysSerAlaSer-141
SEQ. ID. NO. 29712    147-LeuGlyArgGlySerCysCysGluTyr-155
SEQ. ID. NO. 29713    164-ArgSerSerAsnGluTrpLys-170
SEQ. ID. NO. 29714    173-ThrAlaLysArgProProSerPheArgArgHisMetThrCysGlyAsnThrAlaProThrSerSerSerSerArgLeuIleLys-200
SEQ. ID. NO. 29715    209-ValAlaGlySerCysProArgSerArgValArgThr-220
SEQ. ID. NO. 29716    248-TrpArgLeuAsnArgSerSerPro-255
Hydrophilic Regions - Hopp-Woods
SEQ. ID. NO. 29717    6-GlyIleAlaArgAsnArgArgMetGlu-14
SEQ. ID. NO. 29718    20-ArgArgProAspArgPheVal-26
SEQ. ID. NO. 29719    67-AsnGlyLysSerGlyAsnAlaHisArgLysGlnGlnLysGluIleArg-82
SEQ. ID. NO. 29720    102-ValArgSerAlaThrArgLysThrAla-110
SEQ. ID. NO. 29721    135-GlySerGlyLysSerAlaSer-141
SEQ. ID. NO. 29722    165-SerSerAsnGluTrpLys-170
SEQ. ID. NO. 29723    173-ThrAlaLysArgProProSerPheArgArgHisMet-184
SEQ. ID. NO. 29724    193-SerSerSerArgLeuIleLys-200
SEQ. ID. NO. 29725    211-GlySerCysProArgSerArgValArgThr-220
SEQ. ID. NO. 29726    251-AsnArgSerSerPro-255
g240
AMPHI Regions - AMPHI
SEQ. ID. NO. 29727    19-AlaAspValGlyArgPheLeuHis-26
SEQ. ID. NO. 29728    64-IleGlnCysLeuArgAsnHis-70
SEQ. ID. NO. 29729    88-AlaProLeuPheAla-92
SEQ. ID. NO. 29730    108-GlnGlyGluAspPheProArgAlaGlyIleGlnAsnHis-120
SEQ. ID. NO. 29731    164-ValGlnAlaValHisAsn-169
SEQ. ID. NO. 29732    178-AsnPheArgAlaValPheAlaIle-185
SEQ. ID. NO. 29733    189-PheLysArgLysPheGln-194
Antigenic Index - Jameson-Wolf
SEQ. ID. NO. 29734    10-AlaGluThrArgArgGlnPheAla-17
SEQ. ID. NO. 29735    41-AlaHisGlyArgArgSerAspPheIleArg-50
SEQ. ID. NO. 29736    68-ArgAsnHisGluArgPheAspCysArgThrArgPheAsp-80
SEQ. ID. NO. 29737    102-ValGlyGlyArgIleGlyGlnGlyGluAspPheProArgAlaGlyIleGlnAsnHisHisArgSerGly-124
SEQ. ID. NO. 29738    140-GlnGlyLeuAsnProLeuIleGluGlyLysAspAspVal-152
SEQ. ID. NO. 29739    189-PheLysArgLysPhe-193
SEQ. ID. NO. 29740    202-AsnIleGlyLysSerAspAspValCysLys-211
Hydrophilic Regions - Hopp-Woods
SEQ. ID. NO. 29741    10-AlaGluThrArgArgGlnPheAla-17
SEQ. ID. NO. 29742    42-HisGlyArgArgSerAspPheIleArg-50
SEQ. ID. NO. 29743    68-ArgAsnHisGluArgPheAspCysArgThrArgPheAsp-80
SEQ. ID. NO. 29744    106-IleGlyGlnGlyGluAspPheProArg-114
SEQ. ID. NO. 29745    146-IleGluGlyLysAspAspVal-152
SEQ. ID. NO. 29746    189-PheLysArgLysPhe-193
SEQ. ID. NO. 29747    204-GlyLysSerAspAspValCysLys-211
g241-1
AMPHI Regions - AMPHI
SEQ. ID. NO. 29748    6-ThrArgAlaAlaAsnProPro-12
SEQ. ID. NO. 29749    35-ThrHisThrProHisGluProAlaSerSer-44
SEQ. ID. NO. 29750    109-PheLeuIleGlyCysIleAlaHisAlaPheAsnArgSerPheLys-123
SEQ. ID. NO. 29751    126-PheHisAlaCysGlnArgMetValAlaVal-135
SEQ. ID. NO. 29752    195-HisPheAspArgIleAlaGlyIleLeuThrValIn-206
SEQ. ID. NO. 29753    228-GlyPheIleGlnLysLeuIleValGlyIleIleHis-239
Antigenic Index - Jameson-Wolf
SEQ. ID. NO. 29754    1-MetProThrArgProThrArgAlaAlaAsnProProThrPro-14
SEQ. ID. NO. 29755    22-TyrCysProArgProProTyrArgProProSerValGlnThrHisThrProHisGluProAlaSerSerThrCysAlaAlaLysSerAla
                      AsnArgArgGluAsnSerHisAsnAlaGlnPro-62
SEQ. ID. NO. 29756    68-ProSerAsnLysMetProSerGluThrGluGlnThrLeuPheArgArgHisGlnIleProProSerCysArgGlnSer-93
SEQ. ID. NO. 29757    119-AsnArgSerPheLysAla-124
SEQ. ID. NO. 29758    147-ThrIleAspAspAsnIleAla-153
SEQ. ID. NO. 29759    161-LysHisHisThrAspLeuAspPheAsnArgGluArgAlaArgIlePheAsnThrAspGlnLeu-181
SEQ. ID. NO. 29760    188-ArgIleValGlyArgLysArgHisPheAspArg-198
SEQ. ID. NO. 29761    209-PheHisGlnArgGluAsnAla-215
SEQ. ID. NO. 29762    244-ArgAsnHisGlyIlePheCysAsnSerHis-253
SEQ. ID. NO. 29763    255-CysProPheArgAsnSerArgLeuIle-263
Hydrophilic Regions - Hopp-Woods
SEQ. ID. NO. 29764    1-MetProThrArgProThrArgAlaAlaAsn-10
SEQ. ID. NO. 29765    37-ThrProHisGluProAlaSer-43

TABLE 1-continued

| | |
|---|---|
| SEQ. ID. NO. 29766 | 46-CysAlaAlaLysSerAlaAsnArgArgGluAsnSerHis-58 |
| SEQ. ID. NO. 29767 | 70-AsnLysMetProSerGluThrGluGlnThrLeuPheArg-82 |
| SEQ. ID. NO. 29768 | 120-ArgSerPheLysAla-124 |
| SEQ. ID. NO. 29769 | 161-LysHisHisThrAspLeuAspPheAsnArgGluArgAlaArgIlePheAsn-177 |
| SEQ. ID. NO. 29770 | 188-ArgIleValGlyArgLysArgHisPheAspArg-198 |
| SEQ. ID. NO. 29771 | 209-PheHisGlnArgGluAsnAla-215 | g242
AMPHI Regions - AMPHI

| | |
|---|---|
| SEQ. ID. NO. 29772 | 25-ValAlaAlaGlnPheValAspPheValGluGln-35 |
| SEQ. ID. NO. 29773 | 46-HisIleLeuGlnAsn-50 |
| SEQ. ID. NO. 29774 | 100-AlaAspGlnThrGln-104 |
| SEQ. ID. NO. 29775 | 122-AsnProPhePheAspPhePheGlnAlaValVal-132 |
| SEQ. ID. NO. 29776 | 137-HisGlnSerGlyPheGlyAspValPhe-145 |
| SEQ. ID. NO. 29777 | 191-PheGlyHisThrArg-195 |
| SEQ. ID. NO. 29778 | 197-PheAspAlaCysLeu-201 |
| SEQ. ID. NO. 29779 | 262-HisProPheAlaAspPheGlyAsnLeuGlnAsnLeuLeuAlaLeu-276 |

Antigenic Index - Jameson-Wolf

| | |
|---|---|
| SEQ. ID. NO. 29780 | 14-PheLysGlnArgAlaGlyGlyIleAla-22 |
| SEQ. ID. NO. 29781 | 33-ValGluGlnGluGlnArgValSer-40 |
| SEQ. ID. NO. 29782 | 54-HisArgAlaAspIleGlyThrAlaValProAla-64 |
| SEQ. ID. NO. 29783 | 73-AlaGlnGlyHisThrAspIlePheProProArgCysPheGlyAspGlyPheAlaGlnArgGlyPheAlaHisAlaArgArgAlaAspGlnThrGlnAsnArgThrPhe-108 |
| SEQ. ID. NO. 29784 | 137-HisGlnSerGlyPhe-141 |
| SEQ. ID. NO. 29785 | 152-LeuProArgGlnSerGluGlnGlyVal-160 |
| SEQ. ID. NO. 29786 | 164-AlaTyrAspGlyGlyPheGlyArgHisArgArgHisHis-176 |
| SEQ. ID. NO. 29787 | 283-MetArgCysAspArgIleGly-289 |

Hydrophilic Regions - Hopp-Woods

| | |
|---|---|
| SEQ. ID. NO. 29788 | 14-PheLysGlnArgAlaGlyGlyIle-21 |
| SEQ. ID. NO. 29789 | 33-ValGluGlnGluGlnArgVal-39 |
| SEQ. ID. NO. 29790 | 54-HisArgAlaAspIle-58 |
| SEQ. ID. NO. 29791 | 95-AlaHisAlaArgArgAlaAspGlnThrGlnAsnArgThrPhe-108 |
| SEQ. ID. NO. 29792 | 154-ArgGlnSerGluGlnGlyVal-160 |
| SEQ. ID. NO. 29793 | 168-GlyPheGlyArgHisArgArgHisHis-176 |
| SEQ. ID. NO. 29794 | 283-MetArgCysAspArgIleGly-289 | g243
AMPHI Regions - AMPHI

| | |
|---|---|
| SEQ. ID. NO. 29795 | 35-MetThrArgLeuAlaArgLysAlaValGlnArgLeuThrAlaSerHisIleGlnArgPheLeu-55 |
| SEQ. ID. NO. 29796 | 80-AspSerSerArgIleThrSerThrIle-88 |

Antigenic Index - Jameson-Wolf

| | |
|---|---|
| SEQ. ID. NO. 29797 | 30-ProSerAsnAlaPro-34 |
| SEQ. ID. NO. 29798 | 37-ArgLeuAlaArgLysAlaValGln-44 |
| SEQ. ID. NO. 29799 | 55-LeuThrGluSerLysThrGlyAlaAsnArgSerSerSerSerCysLysPro-71 |
| SEQ. ID. NO. 29800 | 77-SerAlaSerAspSerSerArgIle-84 |
| SEQ. ID. NO. 29801 | 102-SerThrThrGlyAlaValThrLysSer-110 |

Hydrophilic Regions - Hopp-Woods

| | |
|---|---|
| SEQ. ID. NO. 29802 | 37-ArgLeuAlaArgLysAlaValGln-44 |
| SEQ. ID. NO. 29803 | 55-LeuThrGluSerLysThrGlyAlaAsnArgSerSerSerSerCysLys-70 |
| SEQ. ID. NO. 29804 | 78-AlaSerAspSerSerArgIle-84 | g244-1
AMPHI Regions - AMPHI

| | |
|---|---|
| SEQ. ID. NO. 29805 | 13-IleAlaAlaLeuLeuArg-18 |
| SEQ. ID. NO. 29806 | 24-AsnAlaLeuGlnGluIleAsnGlnIleIleProGlnThr-36 |
| SEQ. ID. NO. 29807 | 76-ArgLeuHisArgLeu-80 |
| SEQ. ID. NO. 29808 | 98-LeuArgGlyIleLysArgLeuLeuGlnLeuIleGlnSerHisLeuHisThrHis-115 |
| SEQ. ID. NO. 29809 | 150-ArgIleGlyAsnPhe-154 |
| SEQ. ID. NO. 29810 | 206-CysLeuAspGlyPheHisArgLeuHis-214 |
| SEQ. ID. NO. 29811 | 217-AsnArgPhePheThr-221 |
| SEQ. ID. NO. 29812 | 249-IleArgThrPheSerArgAsnPheLysGln-258 |

Antigenic Index - Jameson-Wolf

| | |
|---|---|
| SEQ. ID. NO. 29813 | 1-MetProProGluAlaArgProAlaGlySerAspGly-12 |
| SEQ. ID. NO. 29814 | 20-ValTyrThrGlnAsnAla-25 |
| SEQ. ID. NO. 29815 | 35-GlnThrProSerGly-39 |
| SEQ. ID. NO. 29816 | 43-CysHisArgAsnHisSerArgAlaGlnHis-52 |
| SEQ. ID. NO. 29817 | 81-MetAspIleArgIle-85 |
| SEQ. ID. NO. 29818 | 91-PheArgIleAspPheLeuAsp-97 |
| SEQ. ID. NO. 29819 | 99-ArgGlyIleLysArg-103 |
| SEQ. ID. NO. 29820 | 125-IleGlnLysArgHis-129 |
| SEQ. ID. NO. 29821 | 134-LeuAspArgGlnHisPheHisGlyLysLeuLeuSerGlyGluLeuValArg-150 |
| SEQ. ID. NO. 29822 | 178-PheGlnLeuGlyAsnProArgLeu-185 |
| SEQ. ID. NO. 29823 | 191-ArgLeuGlyGlySer-195 |
| SEQ. ID. NO. 29824 | 234-LeuLysThrAsnTrpLysSerLysSerGlyTyrTyrProSerLysIleArgThrPheSerArgAsnPheLysGlnArgGlnGluIleSerHisProProProAsnThrLeuProGlnLysProTyrLysArg-277 |

Hydrophilic Regions - Hopp-Woods

| | |
|---|---|
| SEQ. ID. NO. 29825 | 1-MetProProGluAlaArgProAlaGlySerAspGly-12 |
| SEQ. ID. NO. 29826 | 45-ArgAsnHisSerArgAlaGlnHis-52 |
| SEQ. ID. NO. 29827 | 81-MetAspIleArgIle-85 |
| SEQ. ID. NO. 29828 | 91-PheArgIleAspPheLeuAsp-97 |
| SEQ. ID. NO. 29829 | 99-ArgGlyIleLysArg-103 |
| SEQ. ID. NO. 29830 | 236-ThrAsnTrpLysSerLysSer-242 |

TABLE 1-continued

| | |
|---|---|
| SEQ. ID. NO. 29831 | 248-LysIleArgThrPheSerArgAsnPheLysGlnArgGlnGluIleSerHis-264 |
| SEQ. ID. NO. 29832 | 273-LysProTyrLysArg-277 | g246
AMPHI Regions - AMPHI

| | |
|---|---|
| SEQ. ID. NO. 29833 | 39-AlaValAsnIleAla-43 |
| SEQ. ID. NO. 29834 | 55-HisValValCysLysArgCysAlaGluValLeuValGluGlnPheAlaAspLeuPhePhe-74 |
| SEQ. ID. NO. 29835 | 83-AspMetGlyArgPhe-87 |
| SEQ. ID. NO. 29836 | 132-PheGlyCysAspAspValValAspAsnLeuAlaGlyPheGlyArgGlyPheArgPro-150 |

Antigenic Index - Jameson-Wolf

| | |
|---|---|
| SEQ. ID. NO. 29837 | 1-MetTyrGlyArgAsnGlySerThrGln-9 |
| SEQ. ID. NO. 29838 | 17-AspGlnThrGlnArgAlaArgPheGlyAsnGlyGluVal-29 |
| SEQ. ID. NO. 29839 | 46-PheAlaGlyGluSerGlyGln-52 |
| SEQ. ID. NO. 29840 | 57-ValCysLysArgCysAla-62 |
| SEQ. ID. NO. 29841 | 78-AspCysGlyHisHisAspMetGlyArg-86 |
| SEQ. ID. NO. 29842 | 92-LeuAspAspLysLeuAla-97 |
| SEQ. ID. NO. 29843 | 133-GlyCysAspAspValValAsp-139 |
| SEQ. ID. NO. 29844 | 143-GlyPheGlyArgGlyPheArgProVal-151 |
| SEQ. ID. NO. 29845 | 165-LeuGlnGlnArgGly-169 |

Hydrophilic Regions - Hopp-Woods

| | |
|---|---|
| SEQ. ID. NO. 29846 | 18-GlnThrGlnArgAlaArgPheGlyAsn-26 |
| SEQ. ID. NO. 29847 | 47-AlaGlyGluSerGly-51 |
| SEQ. ID. NO. 29848 | 57-ValCysLysArgCysAla-62 |
| SEQ. ID. NO. 29849 | 92-LeuAspAspLysLeuAla-97 | g247-1
AMPHI Regions - AMPHI

| | |
|---|---|
| SEQ. ID. NO. 29850 | 34-GlyPheIleGlnArgLeu-39 |
| SEQ. ID. NO. 29851 | 59-ValValSerSerCysSerLysIleAlaLysProGlyLysLysIleSerThrLeuGlnGlu-78 |
| SEQ. ID. NO. 29852 | 105-TyrAlaValGlyArgPheGlyAsn-112 |
| SEQ. ID. NO. 29853 | 164-ArgTyrThrAsnLysPheAspLysSerLys-173 |

Antigenic Index - Jameson-Wolf

| | |
|---|---|
| SEQ. ID. NO. 29854 | 1-ProGlyAlaLysGlnGluAsnProLeuPheSerLeuLysArgSerGlyMetAspLysGlnLeu-21 |
| SEQ. ID. NO. 29855 | 26-GluSerIleAspIleLysTyr-32 |
| SEQ. ID. NO. 29856 | 48-IleAspAspLeuAspAlaSerAla-55 |
| SEQ. ID. NO. 29857 | 62-SerCysSerLysIleAlaLysProGlyLysLysIleSerThrLeuGlnGluAlaLysSer-81 |
| SEQ. ID. NO. 29858 | 85-IleThrAsnAspAspLysGlnAsnGlyAsnIleThrArgGlnLysHis-100 |
| SEQ. ID. NO. 29859 | 109-ArgPheGlyAsnAsnGluGluSerLeu-117 |
| SEQ. ID. NO. 29860 | 120-PheGlnLeuAspAspLysGlyLysTrpGlyAsn-130 |
| SEQ. ID. NO. 29861 | 136-LysLysValLysArgMetAspVal-143 |
| SEQ. ID. NO. 29862 | 149-SerGlyCysProGluAspGluAspAlaGlyLysGluGluLysPheArgTyrThrAsnLysPheAspLysSerLysAsnAlaValThr-177 |
| SEQ. ID. NO. 29863 | 193-IleAlaAlaSerSerAspAsnSer-200 |
| SEQ. ID. NO. 29864 | 210-IleArgGlyGlyAsnValCysAlaAsnArgThrLeu-221 |

Hydrophilic Regions - Hopp-Woods

| | |
|---|---|
| SEQ. ID. NO. 29865 | 1-ProGlyAlaLysGlnGluAsn-7 |
| SEQ. ID. NO. 29866 | 11-SerLeuLysArgSerGlyMetAspLysGlnLeu-21 |
| SEQ. ID. NO. 29867 | 26-GluSerIleAspIleLys-31 |
| SEQ. ID. NO. 29868 | 48-IleAspAspLeuAspAlaSerAla-55 |
| SEQ. ID. NO. 29869 | 64-SerLysIleAlaLysProGlyLysLysIleSerThr-75 |
| SEQ. ID. NO. 29870 | 77-GlnGluAlaLysSer-81 |
| SEQ. ID. NO. 29871 | 86-ThrAsnAspAspLysGlnAsnGlyAsnIleThrArgGlnLysHis-100 |
| SEQ. ID. NO. 29872 | 111-GlyAsnAsnGluGluSerLeu-117 |
| SEQ. ID. NO. 29873 | 121-GlnLeuAspAspLysGlyLysTrpGly-129 |
| SEQ. ID. NO. 29874 | 136-LysLysValLysArgMetAspVal-143 |
| SEQ. ID. NO. 29875 | 151-CysProGluAspGluAspAlaGlyLysGluGluLysPheArgTyr-165 |
| SEQ. ID. NO. 29876 | 167-AsnLysPheAspLysSerLysAsnAlaVal-176 |
| SEQ. ID. NO. 29877 | 193-IleAlaAlaSerSerAspAsn-199 | g248-1
AMPHI Regions - AMPHI

| | |
|---|---|
| SEQ. ID. NO. 29878 | 87-SerGluAsnCysGluLysGlyLeu-94 |
| SEQ. ID. NO. 29879 | 109-GluAlaPheGlyAsn-113 |
| SEQ. ID. NO. 29880 | 122-ValGluAlaValLysArg-127 |
| SEQ. ID. NO. 29881 | 153-AlaAlaGlyValSerLysMetProArgTyrIleIleGlu-165 |
| SEQ. ID. NO. 29882 | 173-GlnAsnValTyrArgValThrAlaLysAlaTrpGlyLysAsn-186 |

Antigenic Index - Jameson-Wolf

| | |
|---|---|
| SEQ. ID. NO. 29883 | 1-MetArgLysGlnAsnThrLeuThr-8 |
| SEQ. ID. NO. 29884 | 11-ProThrSerAspGlyGlnArgGlySer-19 |
| SEQ. ID. NO. 29885 | 40-GlnSerTyrAsnThrGluGlnArgIleSerAlaAsnGluSerAspArgLysLeuAla-58 |
| SEQ. ID. NO. 29886 | 64-AlaAlaLeuArgGluGlyGluPheGln-72 |
| SEQ. ID. NO. 29887 | 78-TyrAlaAlaAspSerLysValThrPheSerGluAsnCysGluLysGlyLeu-94 |
| SEQ. ID. NO. 29888 | 101-ArgThrAsnAsnAsnGlySerGluGluAlaPhe-111 |
| SEQ. ID. NO. 29889 | 118-GlyLysProAlaValGluAlaValLysArgSerCysProAlaLysSerGlyLysAsnSerThr-138 |
| SEQ. ID. NO. 29890 | 140-LeuCysIleAspAsnLysGlyMetGluTyrAsnLysGlyAlaAlaGlyValSerLysMetProArgTyrIle-163 |
| SEQ. ID. NO. 29891 | 168-GlyValLysAsnGlyGlnAsnVal-175 |
| SEQ. ID. NO. 29892 | 182-AlaTrpGlyLysAsnAlaAsnThr-189 |
| SEQ. ID. NO. 29893 | 197-ValGlyAsnAsnAspGluGln-203 |

Hydrophilic Regions - Hopp-Woods

| | |
|---|---|
| SEQ. ID. NO. 29894 | 1-MetArgLysGlnAsnThr-6 |
| SEQ. ID. NO. 29895 | 11-ProThrSerAspGlyGlnArgGly-18 |
| SEQ. ID. NO. 29896 | 42-TyrAsnThrGluGlnArgIleSerAlaAsnGluSerAspArgLysLeuAla-58 |
| SEQ. ID. NO. 29897 | 64-AlaAlaLeuArgGluGlyGluPheGln-72 |
| SEQ. ID. NO. 29898 | 78-TyrAlaAlaAspSerLysValThrPhe-86 |

TABLE 1-continued

| | |
|---|---|
| SEQ. ID. NO. 29899 | 88-GluAsnCysGluLysGlyLeu-94 |
| SEQ. ID. NO. 29900 | 101-ArgThrAsnAsnAsnGlySerGluGluAlaPhe-111 |
| SEQ. ID. NO. 29901 | 120-ProAlaValGluAlaValLysArgSerCysProAlaLysSerGlyLysAsnSerThr-138 |
| SEQ. ID. NO. 29902 | 140-LeuCysIleAspAsnLysGlyMetGluTyrAsnLys-151 |
| SEQ. ID. NO. 29903 | 199-AsnAsnAspGluGln-203 | g249-1
AMPHI Regions - AMPHI

| | |
|---|---|
| SEQ. ID. NO. 29904 | 6-CysLeuArgLeuLys-10 |
| SEQ. ID. NO. 29905 | 15-GlyMetAlaLeuIleGluValLeuVal-23 |
| SEQ. ID. NO. 29906 | 42-ThrValAlaSerValArgGluAla-49 |
| SEQ. ID. NO. 29907 | 53-ThrIleValSerGlnIleThrGlnAsnLeuMetGluGlyMet-66 |
| SEQ. ID. NO. 29908 | 111-GluGlnLeuLysArgPheSerHisGluLeuLysAsnAlaLeu-124 |

Antigenic Index - Jameson-Wolf

| | |
|---|---|
| SEQ. ID. NO. 29909 | 1-MetLysAsnAsnAspCysLeuArgLeuLysAsnProGlnSerGly-15 |
| SEQ. ID. NO. 29910 | 44-AlaSerValArgGluAlaGluThr-51 |
| SEQ. ID. NO. 29911 | 70-ProThrIleAspLeuAspSerAsnLysLysAsnTyr-81 |
| SEQ. ID. NO. 29912 | 85-MetGlyLysGlnThr-89 |
| SEQ. ID. NO. 29913 | 93-ValAspGlyGluPhe-97 |
| SEQ. ID. NO. 29914 | 99-LeuAspAlaGluLysSerLysAlaGlnLeuAlaGluGluGlnLeuLysArgPheSerHisGluLeuLysAsnAlaLeu-124 |
| SEQ. ID. NO. 29915 | 134-ValCysLysAspSerSerGlyAspAlaProThrLeuSerAspSerGlyAlaPheSerSerAsnCysAspAsnLysAlaAsnGlyAspThrLeu-164 |
| SEQ. ID. NO. 29916 | 172-AspSerAlaGlyAspSerAspIleSerArgThrAsnLeuGluValSerGlyAspAsn-190 |
| SEQ. ID. NO. 29917 | 197-AlaArgValGlyGlyArgGlu-203 |

Hydrophilic Regions - Hopp-Woods

| | |
|---|---|
| SEQ. ID. NO. 29918 | 1-MetLysAsnAsnAspCysLeuArgLeuLysAsnProGln-13 |
| SEQ. ID. NO. 29919 | 44-AlaSerValArgGluAlaGluThr-51 |
| SEQ. ID. NO. 29920 | 72-IleAspLeuAspSerAsnLysLysAsnTyr-81 |
| SEQ. ID. NO. 29921 | 99-LeuAspAlaGluLysSerLysAlaGlnLeuAlaGluGluGlnLeuLysArgPheSerHisGluLeuLysAsnAlaLeu-124 |
| SEQ. ID. NO. 29922 | 134-ValCysLysAspSerSerGlyAspAlaProThrLeuSerAsp-147 |
| SEQ. ID. NO. 29923 | 154-AsnCysAspAsnLysAlaAsnGly-161 |
| SEQ. ID. NO. 29924 | 173-SerAlaGlyAspSerAspIleSerArgThrAsnLeu-184 |
| SEQ. ID. NO. 29925 | 199-ValGlyGlyArgGlu-203 | g250
AMPHI Regions - AMPHI

| | |
|---|---|
| SEQ. ID. NO. 29926 | 10-GluPheIleArgGlyIleLysGlu-17 |
| SEQ. ID. NO. 29927 | 54-PheAlaGlyGlySerGlu-59 |
| SEQ. ID. NO. 29928 | 61-AlaThrValAsnLeuTrpAlaGluPro-69 |

Antigenic Index - Jameson-Wolf

| | |
|---|---|
| SEQ. ID. NO. 29929 | 3-HisThrAlaSerProArgAspGluPheIleArgGlyIleLysGluSerSerPro-20 |
| SEQ. ID. NO. 29930 | 34-MetGlnGlyGlyGlnLysGlyMetGlyArgLeu-44 |
| SEQ. ID. NO. 29931 | 54-PheAlaGlyGlySerGlu-59 |
| SEQ. ID. NO. 29932 | 83-AsnSerArgHisIleLeuMetGlyGlyGly-92 |
| SEQ. ID. NO. 29933 | 95-HisAlaHisGluArgAsnThrAlaGluLysSerArgAlaArg-108 |

Hydrophilic Regions - Hopp-Woods

| | |
|---|---|
| SEQ. ID. NO. 29934 | 5-AlaSerProArgAspGluPheIleArgGlyIleLysGluSerSer-19 |
| SEQ. ID. NO. 29935 | 36-GlyGlyGlnLysGlyMetGlyArg-43 |
| SEQ. ID. NO. 29936 | 95-HisAlaHisGluArgAsnThrAlaGluLysSerArgAlaArg-108 | g251
AMPHI Regions - AMPHI

| | |
|---|---|
| SEQ. ID. NO. 29937 | 57-ValAlaAspPheGlyGlyIleGluGlyPhe-66 |
| SEQ. ID. NO. 29938 | 101-ArgThrValGlyGlyThrValArgLeuLeuLysMetIle-113 |
| SEQ. ID. NO. 29939 | 156-AlaArgThrValPheArgAlaHisLeuArg-165 |
| SEQ. ID. NO. 29940 | 179-AlaAlaArgValPheAlaValAla-186 |
| SEQ. ID. NO. 29941 | 200-LeuGlyGlnGluCysArg-205 |
| SEQ. ID. NO. 29942 | 207-ArgHisIleAlaArgValGluSerLeuLeuArgAlaPheGluTyrAla-222 |

Antigenic Index - Jameson-Wolf

| | |
|---|---|
| SEQ. ID. NO. 29943 | 21-LeuArgGlyArgPheGlnArg-27 |
| SEQ. ID. NO. 29944 | 48-ValValThrGluValAspAla-54 |
| SEQ. ID. NO. 29945 | 90-ArgLeuValGlyThr-94 |
| SEQ. ID. NO. 29946 | 120-ProValValArgGluAlaGlyIle-127 |
| SEQ. ID. NO. 29947 | 153-ValLysHisAlaArgThrValPhe-160 |
| SEQ. ID. NO. 29948 | 196-IleLysAsnArgLeuGlyGlnGluCysArgAsnArgHisIleAlaArgValGluSerLeu-215 |
| SEQ. ID. NO. 29949 | 231-LysThrLysThrArgAlaGluGlnProArgProAla-242 |

Hydrophilic Regions - Hopp-Woods

| | |
|---|---|
| SEQ. ID. NO. 29950 | 23-GlyArgPheGlnArg-27 |
| SEQ. ID. NO. 29951 | 48-ValValThrGluValAspAla-54 |
| SEQ. ID. NO. 29952 | 120-ProValValArgGluAlaGlyIle-127 |
| SEQ. ID. NO. 29953 | 153-ValLysHisAlaArgThrValPhe-160 |
| SEQ. ID. NO. 29954 | 198-AsnArgLeuGlyGlnGluCysArgAsnArgHisIleAlaArgValGluSerLeu-215 |
| SEQ. ID. NO. 29955 | 232-ThrLysThrArgAlaGluGlnProArg-240 | g254
AMPHI Regions - AMPHI

| | |
|---|---|
| SEQ. ID. NO. 29956 | 6-ArgPheAsnThrTyrSerHis-12 |
| SEQ. ID. NO. 29957 | 32-GlyHisGlyAspGlyTyrArg-38 |
| SEQ. ID. NO. 29958 | 66-LysLeuLysSerIleLeuLys-72 |
| SEQ. ID. NO. 29959 | 142-ValLeuAlaValMetLysSerLeuThrAlaSer-152 |

Antigenic Index - Jameson-Wolf

| | |
|---|---|
| SEQ. ID. NO. 29960 | 5-GluArgPheAsnThrTyrSer-11 |
| SEQ. ID. NO. 29961 | 32-GlyHisGlyAspGlyTyrArg-38 |
| SEQ. ID. NO. 29962 | 65-GlyLysLeuLysSerIleLeuLysLysThrAspHis-76 |
| SEQ. ID. NO. 29963 | 94-SerLeuArgAsnGlyProGly-100 |

TABLE 1-continued

SEQ. ID. NO. 29964 120-ThrIleGlyArgLysSerGluLysArgLeuLeu-130
SEQ. ID. NO. 29965 177-AsnAspGluLysIleArgHisGlyHisGly-186
Hydrophilic Regions - Hopp-Woods
SEQ. ID. NO. 29966 65-GlyLysLeuLysSerIleLeuLysLysThrAspHis-76
SEQ. ID. NO. 29967 120-ThrIleGlyArgLysSerGluLysArgLeuLeu-130
SEQ. ID. NO. 29968 177-AsnAspGluLysIleArgHis-183
g255
AMPHI Regions - AMPHI
SEQ. ID. NO. 29969 23-ValLysThrCysAlaAspPheHisAlaPheAspGlyValAspAlaHisHisArg-40
SEQ. ID. NO. 29970 71-GlyIleGlnGlyPheAlaHis-77
Antigenic Index - Jameson-Wolf
SEQ. ID. NO. 29971 33-AspGlyValAspAlaHisHisArgValGlyAspPheGlyIleGluAlaValGluAsnGlyPheAlaGlnThrAspGlyAspValGlyGly-62
SEQ. ID. NO. 29972 67-PheArgAlaAspGlyIleGlnGly-74
SEQ. ID. NO. 29973 91-ValGlyGlyLysLysArgIleLeu-98
SEQ. ID. NO. 29974 115-GlyAsnValGlyGlyAspPheArgAla-123
SEQ. ID. NO. 29975 130-PhePheGlyAsnGlySerGlyGlyAsnAlaGly-140
SEQ. ID. NO. 29976 145-GlyGlyThrProAla-149
SEQ. ID. NO. 29977 168-SerGlyAlaGluGlyGlyGlyAspVal-176
Hydrophilic Regions - Hopp-Woods
SEQ. ID. NO. 29978 33-AspGlyValAspAlaHisHisArgValGlyAspPheGly-45
SEQ. ID. NO. 29979 56-ThrAspGlyAspValGlyGly-62
SEQ. ID. NO. 29980 67-PheArgAlaAspGly-71
SEQ. ID. NO. 29981 92-GlyGlyLysLysArgIleLeu-98
SEQ. ID. NO. 29982 119-GlyAspPheArgAla-123
SEQ. ID. NO. 29983 169-GlyAlaGluGlyGlyGly-174
g256-1
AMPHI Regions - AMPHI
SEQ. ID. NO. 29984 22-AlaLysPheLeuGlnHisPro-28
SEQ. ID. NO. 29985 95-HisPheArgSerCysGlyGlyValAla-103
SEQ. ID. NO. 29986 128-ArgTyrArgGluIleTyrAlaVal-135
SEQ. ID. NO. 29987 143-AlaProAlaLysTyrLeuGlyGluGln-151
SEQ. ID. NO. 29988 179-GlyIleThrArgLeuLeu-184
SEQ. ID. NO. 29989 198-ArgSerLeuGlnGlyPheGlnThrAla-206
SEQ. ID. NO. 29990 208-AlaAlaGlyCysLysThrLeuGlyGluPheAspAspArgPheThrAlaProLeuHisGly-227
SEQ. ID. NO. 29991 234-TyrTyrArgGlnThrSerCysLysProLeuLeuLysHisValAla-248
Antigenic Index - Jameson-Wolf
SEQ. ID. NO. 29992 4-ThrProProAspThrProPhe-10
SEQ. ID. NO. 29993 12-LeuArgAsnGlyAsnAlaAspThrIleAla-21
SEQ. ID. NO. 29994 27-HisProAlaProAlaTyrArgArgGluMetLeuProAspSerThrGlyLysThrLysThrAlaTyr-48
SEQ. ID. NO. 29995 51-SerAlaGlyGlyIleSerProAspAlaPro-60
SEQ. ID. NO. 29996 68-LeuGluGlySerSerArgSerHisTyr-76
SEQ. ID. NO. 29997 84-ValArgAsnArgGlyTrpHis-90
SEQ. ID. NO. 29998 98-SerCysGlyGlyValAlaAsn-104
SEQ. ID. NO. 29999 113-GlyAspThrAlaGlu-117
SEQ. ID. NO. 30000 125-LeuThrAlaArgTyrArgGlu-131
SEQ. ID. NO. 30001 140-GlyGlyAsnAlaProAlaLysTyrLeuGlyGluGlnGlyLysLysAlaLeuPro-157
SEQ. ID. NO. 30002 167-ValAspAlaGluAlaAlaGlySerArgPheAspSerGlyIle-180
SEQ. ID. NO. 30003 193-LeuIleProLysAlaArgSerLeuGln-201
SEQ. ID. NO. 30004 213-ThrLeuGlyGluPheAspAspArgPheThr-222
SEQ. ID. NO. 30005 228-PheAlaAspArgHisAspTyrTyrArgGlnThrSerCysLysProLeuLeu-244
SEQ. ID. NO. 30006 259-AspProPheLeuProProGluAlaLeuProArgAlaAspGluAlaSerGlu-275
SEQ. ID. NO. 30007 283-AlaHisGlyGlyHis-287
SEQ. ID. NO. 30008 292-SerSerThrGlyGlyArgLeu-298
SEQ. ID. NO. 30009 312-AspSerPheArgThrAsnArgArg-319
Hydrophilic Regions - Hopp-Woods
SEQ. ID. NO. 30010 31-AlaTyrArgArgGluMetLeuPro-38
SEQ. ID. NO. 30011 40-SerThrGlyLysThrLysThr-46
SEQ. ID. NO. 30012 69-GluGlySerSerArgSer-74
SEQ. ID. NO. 30013 84-ValArgAsnArgGly-88
SEQ. ID. NO. 30014 125-LeuThrAlaArgTyrArgGlu-131
SEQ. ID. NO. 30015 147-TyrLeuGlyGluGlnGlyLysLysAlaLeuPro-157
SEQ. ID. NO. 30016 167-ValAspAlaGluAlaAlaGlySerArgPheAspSerGlyIle-180
SEQ. ID. NO. 30017 193-LeuIleProLysAlaArgSer-199
SEQ. ID. NO. 30018 213-ThrLeuGlyGluPheAspAspArgPheThr-222
SEQ. ID. NO. 30019 228-PheAlaAspArgHisAspTyrTyrArg-236
SEQ. ID. NO. 30020 266-AlaLeuProArgAlaAspGluAlaSerGlu-275
SEQ. ID. NO. 30021 314-PheArgThrAsnArgArg-319
g257
AMPHI Regions - AMPHI
SEQ. ID. NO. 30022 24-SerPheLeuProAsn-28
SEQ. ID. NO. 30023 73-AspLeuValAsnLysValLeuAlaGluValAlaArgLeuGluLysMetPhe-89
SEQ. ID. NO. 30024 109-SerProProAlaAspPheLeuGluLeuLeuSerLeuAlaAlaIlePheThr-125
Antigenic Index - Jameson-Wolf
SEQ. ID. NO. 30025 1-MetGlyArgHisPheGlyArgArgArgPheLeu-11
SEQ. ID. NO. 30026 32-AlaGlyGlyGluLysArgAsnMetAspLysLysArgAspGluAsn-46
SEQ. ID. NO. 30027 56-GlySerGlyAlaGlu-60
SEQ. ID. NO. 30028 65-GlyValAspAspArgGlnAlaAla-72
SEQ. ID. NO. 30029 83-AlaArgLeuGluLys-87
SEQ. ID. NO. 30030 92-TyrArgGluAspSerLeuIleSerArgLeuAsnArgAspGlyTyrLeuThrSerProProAlaAspPhe-114

TABLE 1-continued

Hydrophilic Regions - Hopp-Woods
SEQ. ID. NO. 30031    4-HisPheGlyArgArgArgPheLeu-11
SEQ. ID. NO. 30032    33-GlyGlyGluLysArgAsnMetAspLysLysArgAspGluAsn-46
SEQ. ID. NO. 30033    65-GlyValAspAspArgGlnAlaAla-72
SEQ. ID. NO. 30034    83-AlaArgLeuGluLys-87
SEQ. ID. NO. 30035    92-TyrArgGluAspSerLeuIle-98
SEQ. ID. NO. 30036    100-ArgLeuAsnArgAspGlyTyr-106
g259-1
Antigenic Index - Jameson-Wolf
SEQ. ID. NO. 30037    34-LysAlaTyrThrGluGluLeuProPro-42
SEQ. ID. NO. 30038    62-ValArgSerLysAlaLysAlaGluLysPheTyrArgGluLysMetIleGln-78
SEQ. ID. NO. 30039    93-LeuGluHisLysPro-97
SEQ. ID. NO. 30040    105-LysAsnHisGlyLysGlyMetAlaGluGlnValArgPheLysAla-119
SEQ. ID. NO. 30041    121-ValLeuProAspAspGluAspAlaArgThrIleAla-132
SEQ. ID. NO. 30042    144-GlyThrAspAlaValAlaSerGlyGluThrTyrGlyArgVal-157
Hydrophilic Regions - Hopp-Woods
SEQ. ID. NO. 30043    35-AlaTyrThrGluGluLeuPro-41
SEQ. ID. NO. 30044    62-ValArgSerLysAlaLysAlaGluLysPheTyrArgGluLysMetIleGln-78
SEQ. ID. NO. 30045    93-LeuGluHisLysPro-97
SEQ. ID. NO. 30046    106-AsnHisGlyLysGlyMetAlaGluGlnValArgPheLysAla-119
SEQ. ID. NO. 30047    121-ValLeuProAspAspGluAspAlaArgThrIleAla-132
g260
AMPHI Regions - AMPHI
SEQ. ID. NO. 30048    12-ProPhePheSerLeuPheArgAlaLeuPheGlu-22
SEQ. ID. NO. 30049    53-PheIleAspSerValGlyGlnIleThrAlaArgPhePheGlnAlaPhe-68
SEQ. ID. NO. 30050    151-GlnTyrLeuAlaArgIleAsnGlnValGlyIleValAspLeuIleProValArg-168
SEQ. ID. NO. 30051    177-ThrGlyCysThrGlyIleCysProLysTyrProThrGlyCysArgPro-192
Antigenic Index - Jameson-Wolf
SEQ. ID. NO. 30052    30-GlyAlaHisAspAlaAlaGlu-36
SEQ. ID. NO. 30053    80-ProAlaPheArgAlaArgGluGlnAlaArgArgGlySerGly-93
SEQ. ID. NO. 30054    97-GlyAsnAspLeuArgValLeuHisLysAspAlaValGluValAspIleAspGlyGlyAsnThrVal-118
SEQ. ID. NO. 30055    126-ThrAspPheAspAspGlyAspAla-133
SEQ. ID. NO. 30056    139-AlaGluAlaArgPhe-143
SEQ. ID. NO. 30057    166-ProValArgAlaProGlnGlyGlyThrIle-175
SEQ. ID. NO. 30058    183-CysProLysTyrProThrGlyCysArgProVal-193
Hydrophilic Regions - Hopp-Woods
SEQ. ID. NO. 30059    30-GlyAlaHisAspAlaAlaGlu-36
SEQ. ID. NO. 30060    82-PheArgAlaArgGluGlnAlaArgArgGlySer-92
SEQ. ID. NO. 30061    98-AsnAspLeuArgValLeuHisLysAspAlaValGluValAspIleAspGly-114
SEQ. ID. NO. 30062    126-ThrAspPheAspAspGlyAspAla-133
SEQ. ID. NO. 30063    139-AlaGluAlaArgPhe-143
g261
AMPHI Regions - AMPHI
SEQ. ID. NO. 30064    19-PheThrPheGlnThr-23
SEQ. ID. NO. 30065    32-AspThrAlaArgAlaPheAlaAlaAla-40
SEQ. ID. NO. 30066    50-GlyLeuPheAlaAspVal-55
SEQ. ID. NO. 30067    138-ValHisLysGlyIleGlyAsnAlaValValGlyGlyPheAsp-151
SEQ. ID. NO. 30068    164-GlyValValArgAsnLeu-169
SEQ. ID. NO. 30069    203-GluGlyAspGlyLeuAspValPheAlaProVal-213
SEQ. ID. NO. 30070    217-CysLeuAsnGlnAlaGlyGly-223
Antigenic Index - Jameson-Wolf
SEQ. ID. NO. 30071    13-AlaArgSerAspGly-17
SEQ. ID. NO. 30072    23-ThrPheArgGlnProAla-28
SEQ. ID. NO. 30073    40-AlaAlaAspAspThrLeu-45
SEQ. ID. NO. 30074    62-ValArgGlnArgProArgLeuArgLeu-70
SEQ. ID. NO. 30075    74-HisGlnArgArgValAspLeu-80
SEQ. ID. NO. 30076    86-ArgGlnIleLysGlyAsnValHisGlyPheAspGluHisAla-99
SEQ. ID. NO. 30077    111-AlaHisAlaArgAspAspValProAsp-119
SEQ. ID. NO. 30078    122-ProPheGlyLysAsnGlyGlyValLysGlnGluLysArgValThrProVal-138
SEQ. ID. NO. 30079    149-GlyPheAspGlyGlyGlyPheAspGlyGlyGly-159
SEQ. ID. NO. 30080    183-GlnIleLeuArgAspProLeuCysAla-191
SEQ. ID. NO. 30081    201-ValSerGluGlyAspGlyLeuAsp-208
SEQ. ID. NO. 30082    219-AsnGlnAlaGlyGlyArgIleLeuThrAlaArgGluAspAspGlnGlyPhe-235
Hydrophilic Regions - Hopp-Woods
SEQ. ID. NO. 30083    13-AlaArgSerAspGly-17
SEQ. ID. NO. 30084    40-AlaAlaAspAspThrLeu-45
SEQ. ID. NO. 30085    62-ValArgGlnArgProArgLeuArgLeu-70
SEQ. ID. NO. 30086    74-HisGlnArgArgValAspLeu-80
SEQ. ID. NO. 30087    94-GlyPheAspGluHisAla-99
SEQ. ID. NO. 30088    112-HisAlaArgAspAspValProAsp-119
SEQ. ID. NO. 30089    127-GlyGlyValLysGlnGluLysArgValThrPro-137
SEQ. ID. NO. 30090    202-SerGluGlyAspGlyLeu-207
SEQ. ID. NO. 30091    226-LeuThrAlaArgGluAspAspGlnGly-234
g263
AMPHI Regions - AMPHI
SEQ. ID. NO. 30092    32-AsnLeuIleGlyValLeuAlaAsnAla-40
SEQ. ID. NO. 30093    42-GluAlaLeuAlaPheTyrGlnGluValGlyLysLeuAsnAlaAlaAsnSerLeuThr-60
SEQ. ID. NO. 30094    65-GluValIleArgIle-69
SEQ. ID. NO. 30095    86-LysLeuAlaThrLeuLysLys-92
SEQ. ID. NO. 30096    100-AsnAlaAlaArgAlaLeu-105

TABLE 1-continued

| | |
|---|---|
| SEQ. ID. NO. 30097 | 115-LeuGlyAlaLeuAlaAlaPheThrGln-123 |
| SEQ. ID. NO. 30098 | 137-LeuAsnAlaPheLeuGluAla-143 |
| SEQ. ID. NO. 30099 | 157-ValAlaLeuAlaThrLeuCysAsnTyrAlaAsnAsnLeuAla-170 |

Antigenic Index - Jameson-Wolf

| | |
|---|---|
| SEQ. ID. NO. 30100 | 10-GluThrAlaProGluAlaAlaLysProArgValGluAlaValProLysAsnAsnGlyPhe-29 |
| SEQ. ID. NO. 30101 | 62-GlyGluValGluVal-66 |
| SEQ. ID. NO. 30102 | 73-ArgThrAsnGlnCysSer-78 |
| SEQ. ID. NO. 30103 | 97-GlnSerLeuAsnAla-101 |
| SEQ. ID. NO. 30104 | 108-GlyLysSerAspAspAlaLysLeu-115 |
| SEQ. ID. NO. 30105 | 126-MetAlaLysLysGlyAlaValSerAspAspGluLeu-137 |
| SEQ. ID. NO. 30106 | 144-GlyTyrAsnArgGlnGlnAla-150 |
| SEQ. ID. NO. 30107 | 172-ThrGluIleAsnProLysLeu-178 |

Hydrophilic Regions - Hopp-Woods

| | |
|---|---|
| SEQ. ID. NO. 30108 | 11-ThrAlaProGluAlaAlaLysProArgValGluAlaValProLys-25 |
| SEQ. ID. NO. 30109 | 62-GlyGluValGluVal-66 |
| SEQ. ID. NO. 30110 | 97-GlnSerLeuAsnAla-101 |
| SEQ. ID. NO. 30111 | 108-GlyLysSerAspAspAlaLysLeu-115 |
| SEQ. ID. NO. 30112 | 126-MetAlaLysLysGlyAlaValSerAspAspGluLeu-137 | g264
AMPHI Regions - AMPHI

| | |
|---|---|
| SEQ. ID. NO. 30113 | 28-ValValLysProGluLys-33 |
| SEQ. ID. NO. 30114 | 40-ArgSerTyrLysValAlaGluPheThrGlnThrGly-51 |
| SEQ. ID. NO. 30115 | 85-IleProSerHisValArgVal-91 |
| SEQ. ID. NO. 30116 | 113-AsnArgIleIleAspValSer-119 |
| SEQ. ID. NO. 30117 | 172-LeuAsnGlnAlaAlaGlnAsnPhe-179 |

Antigenic Index - Jameson-Wolf

| | |
|---|---|
| SEQ. ID. NO. 30118 | 27-AlaValValLysProGluLysLeuHisAlaSerAlaAsnArgSerTyrLys-43 |
| SEQ. ID. NO. 30119 | 48-ThrGlnThrGlyAsnAlaSerTrp-55 |
| SEQ. ID. NO. 30120 | 57-GlyGlyArgPheHisGlyArgLysThrSerGlyGlyAspArgTyrAsp-72 |
| SEQ. ID. NO. 30121 | 91-ValThrAsnThrLysAsnGlyLysSerVal-100 |
| SEQ. ID. NO. 30122 | 103-ArgValAsnAspArgGlyProPheHisGlyAsnArgIleIleAspValSerLysAlaAlaAla-123 |
| SEQ. ID. NO. 30123 | 142-ValProGlyGlnSerAlaProValAlaGluAsnLysAspIlePheIle-157 |
| SEQ. ID. NO. 30124 | 159-LeuLysSerPheGlyThrGluHisGluAla-168 |
| SEQ. ID. NO. 30125 | 181-AlaSerSerSerSerProAsnLeuSerValGluLysArgArgTyrGluTyr-197 |
| SEQ. ID. NO. 30126 | 205-AlaSerGlnGluArgAlaAlaGluAlaGluAlaGlnAla-217 |

Hydrophilic Regions - Hopp-Woods

| | |
|---|---|
| SEQ. ID. NO. 30127 | 27-AlaValValLysProGluLysLeuHisAlaSerAlaAsnArgSerTyrLys-43 |
| SEQ. ID. NO. 30128 | 60-PheHisGlyArgLysThrSerGlyGlyAspArgTyrAsp-72 |
| SEQ. ID. NO. 30129 | 92-ThrAsnThrLysAsnGlyLys-98 |
| SEQ. ID. NO. 30130 | 104-ValAsnAspArgGlyProPheHis-111 |
| SEQ. ID. NO. 30131 | 114-ArgIleIleAspValSerLysAlaAlaAla-123 |
| SEQ. ID. NO. 30132 | 148-ProValAlaGluAsnLysAspIlePheIle-157 |
| SEQ. ID. NO. 30133 | 160-LysSerPheGlyThrGluHisGluAla-168 |
| SEQ. ID. NO. 30134 | 188-LeuSerValGluLysArgArgTyrGluTyr-197 |
| SEQ. ID. NO. 30135 | 205-AlaSerGlnGluArgAlaAlaGluAlaGluAlaGlnAla-217 | g266
Antigenic Index - Jameson-Wolf

| | |
|---|---|
| SEQ. ID. NO. 30136 | 2-GlnPheArgArgHisArgArgArgGlnCysProAsnArgLysProIle-17 |
| SEQ. ID. NO. 30137 | 47-AlaLeuLysArgLysHisPhe-53 |
| SEQ. ID. NO. 30138 | 76-SerArgAlaGlyAla-80 |
| SEQ. ID. NO. 30139 | 110-TrpHisThrArgAsnArgGlu-116 |

Hydrophilic Regions - Hopp-Woods

| | |
|---|---|
| SEQ. ID. NO. 30140 | 2-GlnPheArgArgHisArgArgArgGlnCysProAsnArgLysProIle-17 |
| SEQ. ID. NO. 30141 | 47-AlaLeuLysArgLysHisPhe-53 |
| SEQ. ID. NO. 30142 | 76-SerArgAlaGlyAla-80 | g268-1
AMPHI Regions - AMPHI

| | |
|---|---|
| SEQ. ID. NO. 30143 | 42-GluIleLeuValLysLeuValArg-49 |
| SEQ. ID. NO. 30144 | 57-ValLysThrPheAspAsp-62 |
| SEQ. ID. NO. 30145 | 77-HisIleArgArgMetValGluArg-84 |
| SEQ. ID. NO. 30146 | 92-ValArgThrThrGluLysThr-98 |
| SEQ. ID. NO. 30147 | 129-IleGlyAsnSerHisLys-134 |
| SEQ. ID. NO. 30148 | 136-ThrProAspPhePheGluProTyr-143 |
| SEQ. ID. NO. 30149 | 169-PheAlaGluLeuSerGlnAlaHisAspIleIleHisProLeuSerGluLeuValSerMet-188 |
| SEQ. ID. NO. 30150 | 191-IleLysGluProLeuAspLys-197 |
| SEQ. ID. NO. 30151 | 215-AlaArgGluAlaGluGluAlaAla-222 |
| SEQ. ID. NO. 30152 | 231-GlnGluAlaAlaArgValSerGluTrp-239 |
| SEQ. ID. NO. 30153 | 249-GluPheGluGlnPheTrpLysGlyLeuProGlnThrValGlnAsn-263 |
| SEQ. ID. NO. 30154 | 268-SerGlnLysThrTrpLysSerGlyMetAspLys-278 |
| SEQ. ID. NO. 30155 | 289-GluThrProAsnGlyIleLys-295 |

Antigenic Index - Jameson-Wolf

| | |
|---|---|
| SEQ. ID. NO. 30156 | 1-MetLysLysAsnLeu-5 |
| SEQ. ID. NO. 30157 | 16-LeuSerGlyCysAspArgLeuGlyIleGlyAsnProPheSerGlyLysGluIleSerCysGlySerGluGluThrLysGluIleLeu-44 |
| SEQ. ID. NO. 30158 | 47-LeuValArgAspAsnValGluGlyGluThrValLysThrPheAspAspAspAlaPheLysAspGlnAlaPhe-70 |
| SEQ. ID. NO. 30159 | 77-HisIleArgArgMetValGlu-83 |
| SEQ. ID. NO. 30160 | 85-LeuGlyIleThrValAspGluValArgThrThrGluLysThrAspThrSerSerLysLeuLysCysGluAlaAlaLeu-110 |
| SEQ. ID. NO. 30161 | 112-LeuAspValProAspAspValVal-119 |
| SEQ. ID. NO. 30162 | 127-GlnSerIleGlyAsnSerHisLysLysThrProAspPhePhe-140 |
| SEQ. ID. NO. 30163 | 143-TyrTyrArgLysGluGlyAlaTyr-150 |
| SEQ. ID. NO. 30164 | 158-SerValGlnProThrAspAspLysSerLysIle-168 |

TABLE 1-continued

| | |
|---|---|
| SEQ. ID. NO. 30165 | 190-LeuIleLysGluProLeuAspLysAlaLysGlnArgAsnGluLysLeuGluAlaAlaGluAlaThrAlaGlnGluAlaArgGluAlaGluGluAlaAlaAla-223 |
| SEQ. ID. NO. 30166 | 226-AlaLeuGlyArgGluGlnGluAlaAlaArgValSerGluTrpGluGluArgTyrLysLeuSerArgSerGluPhe-250 |
| SEQ. ID. NO. 30167 | 261-ValGlnAsnLysLeuGlnAlaSerGlnLysThrTrpLysSerGlyMetAspLysIleCysAlaAsnAsnAlaLysAlaGluGlyGluThrProAsnGlyIleLysValSerGluLeuAlaCysLysThrAlaGluThrGluAlaArgLeuGluGluLeuHisAsnArgLysLysAlaLeuIle-321 |
| SEQ. ID. NO. 30168 | 323-GluMetValArgGluGluAspLysLysGluLeuProLysArgLeu-337 |

Hydrophilic Regions - Hopp-Woods

| | |
|---|---|
| SEQ. ID. NO. 30169 | 1-MetLysLysAsnLeu-5 |
| SEQ. ID. NO. 30170 | 18-GlyCysAspArgLeuGly-23 |
| SEQ. ID. NO. 30171 | 28-PheSerGlyLysGluIleSerCysGlySerGluGluThrLysGluIleLeu-44 |
| SEQ. ID. NO. 30172 | 47-LeuValArgAspAsnValGluGlyGluThrValLysThrPheAspAspAspAlaPheLysAspGlnAlaPhe-70 |
| SEQ. ID. NO. 30173 | 77-HisIleArgArgMetValGlu-83 |
| SEQ. ID. NO. 30174 | 85-LeuGlyIleThrValAspGluValArgThrThrGluLysThrAspThrSerSerLysLeuLysCysGluAlaAlaLeu-110 |
| SEQ. ID. NO. 30175 | 112-LeuAspValProAspAspValVal-119 |
| SEQ. ID. NO. 30176 | 131-AsnSerHisLysLysThrProAspPhe-139 |
| SEQ. ID. NO. 30177 | 143-TyrTyrArgLysGluGly-148 |
| SEQ. ID. NO. 30178 | 161-ProThrAspAspLysSerLysIle-168 |
| SEQ. ID. NO. 30179 | 190-LeuIleLysGluProLeuAspLysAlaLysGlnArgAsnGluLysLeuGluAlaAlaGluAlaThrAlaGlnGluAlaArgGluAlaGluGluAlaAlaAla-223 |
| SEQ. ID. NO. 30180 | 226-AlaLeuGlyArgGluGlnGluAlaAlaArgValSerGluTrpGluGluArgTyrLysLeuSerArgSerGluPhe-250 |
| SEQ. ID. NO. 30181 | 270-LysThrTrpLysSerGlyMetAspLysIleCys-280 |
| SEQ. ID. NO. 30182 | 283-AsnAlaLysAlaGluGlyGluThrProAsn-292 |
| SEQ. ID. NO. 30183 | 294-IleLysValSerGluLeuAlaCysLysThrAlaGluThrGluAlaArgLeuGluGluLeuHisAsnArgLysLysAlaLeuIle-321 |
| SEQ. ID. NO. 30184 | 323-GluMetValArgGluGluAspLysLysGluLeuProLysArgLeu-337 | g269
AMPHI Regions - AMPHI

| | |
|---|---|
| SEQ. ID. NO. 30185 | 36-LysProCysAlaSerLeuAspAlaSerSerAla-46 |
| SEQ. ID. NO. 30186 | 54-TrpAspPheIleArgAsnThrAlaSerPro-63 |
| SEQ. ID. NO. 30187 | 73-PheLysThrArgAlaLeuGlyArgPheSer-82 |

Antigenic Index - Jameson-Wolf

| | |
|---|---|
| SEQ. ID. NO. 30188 | 28-TrpSerArgSerAlaPheSerCysLysProCysAla-39 |
| SEQ. ID. NO. 30189 | 58-ArgAsnThrAlaSerProLysVal-65 |
| SEQ. ID. NO. 30190 | 73-PheLysThrArgAlaLeuGlyArgPheSerAla-83 |
| SEQ. ID. NO. 30191 | 90-LeuSerAsnArgGlyValLysLysProLeuSerPheLysSerProSerValGlnValAspThrSerAla-112 |
| SEQ. ID. NO. 30192 | 117-SerLeuArgSerSer-121 |

Hydrophilic Regions - Hopp-Woods

| | |
|---|---|
| SEQ. ID. NO. 30193 | 60-ThrAlaSerProLysVal-65 |
| SEQ. ID. NO. 30194 | 73-PheLysThrArgAlaLeuGly-79 |
| SEQ. ID. NO. 30195 | 93-ArgGlyValLysLysProLeuSer-100 | g270
AMPHI Regions - AMPHI

| | |
|---|---|
| SEQ. ID. NO. 30196 | 13-LeuLeuThrAlaPheAlaAlaPhe-20 |
| SEQ. ID. NO. 30197 | 41-AspLeuThrGluGlyCys-46 |
| SEQ. ID. NO. 30198 | 49-ProAspGlySerArg-53 |

Antigenic Index - Jameson-Wolf

| | |
|---|---|
| SEQ. ID. NO. 30199 | 1-MetAsnLysAsnArgLysLeu-7 |
| SEQ. ID. NO. 30200 | 41-AspLeuThrGluGlyCysThrLeuProAspGlySerArgValArgAlaAlaAlaValSerThrLysLysProPhe-65 |
| SEQ. ID. NO. 30201 | 71-HisAlaProAlaGlyThrGlu-77 |
| SEQ. ID. NO. 30202 | 86-LysAsnMetAspMetGlyPhe-92 |
| SEQ. ID. NO. 30203 | 95-TyrMetPheGluArgGlnProSerGlyThr-104 |
| SEQ. ID. NO. 30204 | 114-ValCysValGluGlyArgArgAspPheThrAla-124 |
| SEQ. ID. NO. 30205 | 128-IleGlySerArgThrPhe-133 |

Hydrophilic Regions - Hopp-Woods

| | |
|---|---|
| SEQ. ID. NO. 30206 | 1-MetAsnLysAsnArgLysLeu-7 |
| SEQ. ID. NO. 30207 | 49-ProAspGlySerArgValArgAla-56 |
| SEQ. ID. NO. 30208 | 60-SerThrLysLysProPhe-65 |
| SEQ. ID. NO. 30209 | 73-ProAlaGlyThrGlu-77 |
| SEQ. ID. NO. 30210 | 96-MetPheGluArgGlnPro-101 |
| SEQ. ID. NO. 30211 | 116-ValGluGlyArgArgAspPheThrAla-124 | g271-2
AMPHI Regions - AMPHI

| | |
|---|---|
| SEQ. ID. NO. 30212 | 6-MetAlaArgIleTrp-10 |
| SEQ. ID. NO. 30213 | 20-SerProCysProAla-24 |
| SEQ. ID. NO. 30214 | 29-ProLysSerProAla-33 |

Antigenic Index - Jameson-Wolf

| | |
|---|---|
| SEQ. ID. NO. 30215 | 2-PheSerSerArgMetAlaArg-8 |
| SEQ. ID. NO. 30216 | 25-LeuThrThrLysProLysSerProAlaLys-34 |
| SEQ. ID. NO. 30217 | 41-ArgSerAsnCysLeu-45 |
| SEQ. ID. NO. 30218 | 61-SerSerThrThrGlyAlaProThrSerArg-70 |
| SEQ. ID. NO. 30219 | 78-SerAlaSerIleAsnLysAspThrArgMetProAlaSerVal-91 |
| SEQ. ID. NO. 30220 | 102-CysCysAlaAsnThrSerLysProProSer-111 |

Hydrophilic Regions - Hopp-Woods

| | |
|---|---|
| SEQ. ID. NO. 30221 | 27-ThrLysProLysSerProAlaLys-34 |
| SEQ. ID. NO. 30222 | 80-SerIleAsnLysAspThrArgMet-87 |
| SEQ. ID. NO. 30223 | 105-AsnThrSerLysProPro-110 | g272-2
AMPHI Regions - AMPHI

| | |
|---|---|
| SEQ. ID. NO. 30224 | 44-IleThrArgIleThrAspGlu-50 |
| SEQ. ID. NO. 30225 | 70-AlaGluGluPheSerSerThrAsn-77 |
| SEQ. ID. NO. 30226 | 106-PheArgAlaIleThrSer-111 |

TABLE 1-continued

| | |
|---|---|
| SEQ. ID. NO. 30227 | 165-IleIleThrIleGluAspProIleGlu-173 |
| SEQ. ID. NO. 30228 | 194-AsnTrpMetAlaAlaLeuLysAsnThrLeuArgGlnAla-206 |
| SEQ. ID. NO. 30229 | 244-AsnGlnAlaLeuAspArgIleIleAsn-252 |
| SEQ. ID. NO. 30230 | 307-GlyAsnIleHisGluIleLysGluValMetLys-317 |
| SEQ. ID. NO. 30231 | 328-AspGlnHisLeuTyrGln-333 |
| SEQ. ID. NO. 30232 | 343-GlnAspAlaLeuLysAsnAlaAspSer-351 |

Antigenic Index - Jameson-Wolf

| | |
|---|---|
| SEQ. ID. NO. 30233 | 2-PheThrAspGluAsnMetThrAlaLysGluGluLeu-13 |
| SEQ. ID. NO. 30234 | 19-HisMetAsnLysAsnLysGlySerAsp-27 |
| SEQ. ID. NO. 30235 | 38-MetLysLeuAspGlyLysIleThrArgIleThrAspGluProLeuThrAlaGluLysCysMet-58 |
| SEQ. ID. NO. 30236 | 68-LysGlnAlaGluGluPheSerSerThrAsnGlu-78 |
| SEQ. ID. NO. 30237 | 85-LeuProAspThrSerArgPheArgVal-93 |
| SEQ. ID. NO. 30238 | 109-IleThrSerLysIleProLysPheGluSerLeuAsn-120 |
| SEQ. ID. NO. 30239 | 122-ProProAlaLeuLys-126 |
| SEQ. ID. NO. 30240 | 128-ValAlaLeuLysLysArgGly-134 |
| SEQ. ID. NO. 30241 | 142-ThrGlySerGlyLysSerThrSerLeu-150 |
| SEQ. ID. NO. 30242 | 154-IleAspTyrArgAsnGluAsnSerPheGly-163 |
| SEQ. ID. NO. 30243 | 168-IleGluAspProIle-172 |
| SEQ. ID. NO. 30244 | 176-HisGluHisLysAsnCys-181 |
| SEQ. ID. NO. 30245 | 184-ThrGlnArgGluValGlyValAspThrGluAsn-194 |
| SEQ. ID. NO. 30246 | 199-LeuLysAsnThrLeuArgGlnAlaProAsp-208 |
| SEQ. ID. NO. 30247 | 214-GluIleArgAspArgGluThrMet-221 |
| SEQ. ID. NO. 30248 | 241-AsnSerThrAsnGlnAlaLeuAspArg-249 |
| SEQ. ID. NO. 30249 | 254-PheProGluGluArgArgGluGlnLeuLeu-263 |
| SEQ. ID. NO. 30250 | 278-LeuValProArgAspGlyGlyLysGlyArgValAlaAla-290 |
| SEQ. ID. NO. 30251 | 310-HisGluIleLysGluValMetLysLysSerThr-320 |
| SEQ. ID. NO. 30252 | 336-GluLysGlyGluIleSerLeu-342 |
| SEQ. ID. NO. 30253 | 344-AspAlaLeuLysAsnAlaAspSerAlaHisAspLeu-355 |
| SEQ. ID. NO. 30254 | 361-LeuArgSerArgArgAlaGlnSerSerAspProAspLeuGluLeu-375 |

Hydrophilic Regions - Hopp-Woods

| | |
|---|---|
| SEQ. ID. NO. 30255 | 2-PheThrAspGluAsnMetThrAlaLysGluGluLeu-13 |
| SEQ. ID. NO. 30256 | 20-MetAsnLysAsnLysGlySerAsp-27 |
| SEQ. ID. NO. 30257 | 38-MetLysLeuAspGlyLysIleThrArgIleThrAspGluProLeuThrAlaGluLysCysMet-58 |
| SEQ. ID. NO. 30258 | 68-LysGlnAlaGluGluPheSerSer-75 |
| SEQ. ID. NO. 30259 | 87-AspThrSerArgPheArgVal-93 |
| SEQ. ID. NO. 30260 | 112-LysIleProLysPheGluSer-118 |
| SEQ. ID. NO. 30261 | 128-ValAlaLeuLysLysArgGly-134 |
| SEQ. ID. NO. 30262 | 143-GlySerGlyLysSerThrSer-149 |
| SEQ. ID. NO. 30263 | 155-AspTyrArgAsnGluAsnSer-161 |
| SEQ. ID. NO. 30264 | 168-IleGluAspProIle-172 |
| SEQ. ID. NO. 30265 | 176-HisGluHisLysAsn-180 |
| SEQ. ID. NO. 30266 | 184-ThrGlnArgGluValGlyValAspThr-192 |
| SEQ. ID. NO. 30267 | 201-AsnThrLeuArgGlnAlaPro-207 |
| SEQ. ID. NO. 30268 | 214-GluIleArgAspArgGluThrMet-221 |
| SEQ. ID. NO. 30269 | 245-GlnAlaLeuAspArg-249 |
| SEQ. ID. NO. 30270 | 255-ProGluGluArgArgGluGlnLeuLeu-263 |
| SEQ. ID. NO. 30271 | 278-LeuValProArgAspGlyGlyLysGlyArgValAlaAla-290 |
| SEQ. ID. NO. 30272 | 310-HisGluIleLysGluValMetLysLysSerThr-320 |
| SEQ. ID. NO. 30273 | 336-GluLysGlyGluIleSerLeu-342 |
| SEQ. ID. NO. 30274 | 344-AspAlaLeuLysAsnAlaAspSerAlaHisAspLeu-355 |
| SEQ. ID. NO. 30275 | 361-LeuArgSerArgArgAlaGlnSerSerAspProAspLeuGluLeu-375 | g274
AMPHI Regions - AMPHI

| | |
|---|---|
| SEQ. ID. NO. 30276 | 31-TyrLysAspGlyLys-35 |
| SEQ. ID. NO. 30277 | 111-GluAlaValPheLys-115 |

Antigenic Index - Jameson-Wolf

| | |
|---|---|
| SEQ. ID. NO. 30278 | 25-LeuValThrAspAspTyrTyrLysAspGlyLysHisIleAsp-38 |
| SEQ. ID. NO. 30279 | 40-GlnLeuHisArgAspGluGluAlaValArgArgHisIle-52 |
| SEQ. ID. NO. 30280 | 60-ProAspMetAsnAla-64 |
| SEQ. ID. NO. 30281 | 71-GlyGluPheAspGlyLysGlnPro-78 |
| SEQ. ID. NO. 30282 | 85-HisProThrArgLysAlaAspAspGlnThrVal-95 |
| SEQ. ID. NO. 30283 | 99-ProValGlySerAlaGlnAsnGlyArgAlaGluTyr-110 |
| SEQ. ID. NO. 30284 | 116-ThrLeuProProAlaAsnHis-122 |
| SEQ. ID. NO. 30285 | 126-ArgValGluAspAlaAlaGly-132 |
| SEQ. ID. NO. 30286 | 136-ValGluAsnLysTrpIleThrSerGlnGlyAsnAlaValAspLeuThrProMetAspLysLeuPheAsnAsnAlaGlySerLys-163 |

Hydrophilic Regions - Hopp-Woods

| | |
|---|---|
| SEQ. ID. NO. 30287 | 29-AspTyrTyrLysAspGlyLysHisIleAsp-38 |
| SEQ. ID. NO. 30288 | 40-GlnLeuHisArgAspGluGluAlaValArgArgHisIle-52 |
| SEQ. ID. NO. 30289 | 72-GluPheAspGlyLysGln-77 |
| SEQ. ID. NO. 30290 | 86-ProThrArgLysAlaAspAspGlnThrVal-95 |
| SEQ. ID. NO. 30291 | 104-GlnAsnGlyArgAlaGluTyr-110 |
| SEQ. ID. NO. 30292 | 126-ArgValGluAspAlaAlaGly-132 |
| SEQ. ID. NO. 30293 | 151-ThrProMetAspLysLeuPhe-157 | g276
AMPHI Regions - AMPHI

| | |
|---|---|
| SEQ. ID. NO. 30294 | 19-ArgArgTrpAlaThrMetMet-25 |
| SEQ. ID. NO. 30295 | 60-SerPheLysMetAlaArg-65 |
| SEQ. ID. NO. 30296 | 80-ProPheAspProMetGlyTrp-86 |
| SEQ. ID. NO. 30297 | 115-GlyArgLeuTyrArgThrPheSerAsn-123 |

TABLE 1-continued

SEQ. ID. NO. 30298 164-ThrLysArgGlyArgArgLeuThr-171
SEQ. ID. NO. 30299 207-SerThrSerThrLeuArgLysLeuMetArgProSerThr-219
Antigenic Index - Jameson-Wolf
SEQ. ID. NO. 30300 9-MetMetArgSerAlaAspSerThrVal-17
SEQ. ID. NO. 30301 29-PheSerIleArgArgSerSerAlaCysTrpThrArgArgSerAspSerLeuSer-46
SEQ. ID. NO. 30302 52-SerSerAsnAsnAsnIle-57
SEQ. ID. NO. 30303 67-MetAlaThrArgCysArgCysProProAspLysLeuLeuPro-80
SEQ. ID. NO. 30304 82-AspProMetGlyTrp-86
SEQ. ID. NO. 30305 88-SerProSerGlyAspAlaSerIleArg-96
SEQ. ID. NO. 30306 103-TrpArgAlaAspArgThrSerAlaSerProAlaSerGlyArgLeuTyr-118
SEQ. ID. NO. 30307 121-PheSerAsnArgValSerSerAsnArgAsnThrSerTrpGluThrArgAlaAsnTrpAlaArgArgGlnSerSerLeu-146
SEQ. ID. NO. 30308 158-LeuProAlaAspGlySerThrLysArgGlyArgArgLeuThrThr-172
SEQ. ID. NO. 30309 176-ProLeuProGluArgProThrArgAlaThrArgSerProCysLeu-190
SEQ. ID. NO. 30310 194-LeuLysLeuSerArg-198
SEQ. ID. NO. 30311 200-LeuMetProSerGluArgTyrSerThrSerThrLeuArgLysLeuMetArgProSerThrArgCysGlyAla-223
SEQ. ID. NO. 30312 229-CysSerGlyGlyValSerArgAsnAlaHisThrProSerAlaAlaArgAsn-245
Hydrophilic Regions - Hopp-Woods
SEQ. ID. NO. 30313 29-PheSerIleArgArgSerSer-35
SEQ. ID. NO. 30314 38-TrpThrArgArgSerAspSerLeu-45
SEQ. ID. NO. 30315 67-MetAlaThrArgCysArgCysProProAspLys-77
SEQ. ID. NO. 30316 90-SerGlyAspAlaSerIleArg-96
SEQ. ID. NO. 30317 104-ArgAlaAspArgThrSerAla-110
SEQ. ID. NO. 30318 124-ArgValSerSerAsnArgAsnThrSerTrpGluThr-135
SEQ. ID. NO. 30319 137-AlaAsnTrpAlaArgArgGlnSerSer-145
SEQ. ID. NO. 30320 161-AspGlySerThrLysArgGlyArgArgLeuThrThr-172
SEQ. ID. NO. 30321 176-ProLeuProGluArgProThrArgAlaThrArg-186
SEQ. ID. NO. 30322 194-LeuLysLeuSerArg-198
SEQ. ID. NO. 30323 200-LeuMetProSerGluArgTyrSer-207
SEQ. ID. NO. 30324 210-ThrLeuArgLysLeuMetArgProSerThrArgCys-221
SEQ. ID. NO. 30325 232-GlyValSerArgAsnAlaHis-238
g277-2
AMPHI Regions - AMPHI
SEQ. ID. NO. 30326 39-GlyIleAlaValPheGluValValGlyArgLeuLeuAspPheValLeu-54
SEQ. ID. NO. 30327 72-AsnGluValIleAspValPheHisAlaLeuGln-82
SEQ. ID. NO. 30328 87-AlaPheAspAlaValGlyAsnPheAlaGluTyrGlyArgAlaIleAspThrAlaAspLeuLeuGluIleGlyLysLeuGlyTyrPheHis-116
SEQ. ID. NO. 30329 180-AlaValGlyValValAlaValAla-187
Antigenic Index - Jameson-Wolf
SEQ. ID. NO. 30330 1-MetProArgPheGluAspGlnLeuValGlyArgXxxGlyLysAla-15
SEQ. ID. NO. 30331 68-ArgPheCysProAsnGluVal-74
SEQ. ID. NO. 30332 96-GluTyrGlyArgAlaIleAspThr-103
SEQ. ID. NO. 30333 118-ValGluProAspPheProAlaGlnThrProArgThrGluGlyGly-132
SEQ. ID. NO. 30334 138-PheAspLysAlaAspValVal-144
SEQ. ID. NO. 30335 162-AspIleGlyGlyGlyGlyPheGluGlyGlyAspLeu-172
SEQ. ID. NO. 30336 196-LeuAspValGlyGlyLysProArgLeuGlyAlaGluArgAlaGlnAlaGlyGlyGlyMetGlyCysAlaGlyThrAspPheHis-223
SEQ. ID. NO. 30337 226-GlyLeuAspAspGlyAla-231
SEQ. ID. NO. 30338 237-GluGlyLeuGlnPheGluAspAspLeuLeuGluGlyLysHisGlyLeu-252
Hydrophilic Regions - Hopp-Woods
SEQ. ID. NO. 30339 2-ProArgPheGluAspGlnLeuVal-9
SEQ. ID. NO. 30340 96-GluTyrGlyArgAlaIleAspThr-103
SEQ. ID. NO. 30341 118-ValGluProAspPhe-122
SEQ. ID. NO. 30342 126-ThrProArgThrGluGly-131
SEQ. ID. NO. 30343 138-PheAspLysAlaAspValVal-144
SEQ. ID. NO. 30344 167-GlyPheGluGlyAspLeu-172
SEQ. ID. NO. 30345 198-ValGlyGlyLysProArgLeuGlyAlaGluArgAlaGlnAla-211
SEQ. ID. NO. 30346 226-GlyLeuAspAspGlyAla-231
SEQ. ID. NO. 30347 239-LeuGlnPheGluAspAspLeuLeuGluGlyLysHisGlyLeu-252
g278-2
AMPHI Regions - AMPHI
SEQ. ID. NO. 30348 20-IleGlyProLeuProSerIleGlyArg-28
SEQ. ID. NO. 30349 42-ThrGlyThrSerLys-46
SEQ. ID. NO. 30350 101-ArgThrIleProSerValThrGluIleThrValProArgValLeuThrSerAlaPhe-119
SEQ. ID. NO. 30351 123-PheSerIleLeuAlaLeuIleArgSerLeuIleSer-134
SEQ. ID. NO. 30352 157-LeuTyrArgGlnIleGlnAsnLeuIleThrHisPheAsnPheTyrAlaAla-173
SEQ. ID. NO. 30353 189-GluThrLeuIleGlnHisLeuArgGlnLeuAlaAsp-200
Antigenic Index - Jameson-Wolf
SEQ. ID. NO. 30354 25-SerIleGlyArgProAsnAlaSerThrThrArgProThrAsnSerArgProThrGlyThrSerLysIleArgPro-49
SEQ. ID. NO. 30355 63-SerProAsnThrThrAlaProThrGluSerArgSerArgPheIleAla-78
SEQ. ID. NO. 30356 80-ProLysValLeuProGlyAsnSerSerIle-89
SEQ. ID. NO. 30357 93-IleAlaSerAspLysProTrpMetArg-101
SEQ. ID. NO. 30358 119-PheThrAspArgPheSer-124
SEQ. ID. NO. 30359 146-ArgHisSerArgValGlnSerThr-153
SEQ. ID. NO. 30360 178-PheAspPheAspArgAspPheGlnLeu-186
SEQ. ID. NO. 30361 209-ThrValAsnAspGlyArgPheAspMetValGlu-219
Hydrophilic Regions - Hopp-Woods
SEQ. ID. NO. 30362 27-GlyArgProAsnAlaSerThrThrArgProThrAsnSerArgProThrGlyThrSerLysIleArgPro-49
SEQ. ID. NO. 30363 68-AlaProThrGluSerArgSerArgPheIleAla-78
SEQ. ID. NO. 30364 93-IleAlaSerAspLysProTrp-99
SEQ. ID. NO. 30365 146-ArgHisSerArgValGln-151

TABLE 1-continued

| | |
|---|---|
| SEQ. ID. NO. 30366 | 178-PheAspPheAspArgAspPhe-184 |
| SEQ. ID. NO. 30367 | 211-AsnAspGlyArgPheAspMetValGlu-219 | g279
AMPHI Regions - AMPHI

| | |
|---|---|
| SEQ. ID. NO. 30368 | 6-GlyCysLeuIleSer-10 |
| SEQ. ID. NO. 30369 | 58-LeuProAlaIleThrThr-63 |

Antigenic Index - Jameson-Wolf

| | |
|---|---|
| SEQ. ID. NO. 30370 | 28-GlnTrpGluGlyThrAspThrGlySerGlyArgAlaArgLeuAla-42 |
| SEQ. ID. NO. 30371 | 64-CysProGlyGluLeuLysLeuThr-71 |
| SEQ. ID. NO. 30372 | 74-ThrThrSerProCysAlaAspSer-81 |
| SEQ. ID. NO. 30373 | 88-CysSerSerSerLysProLysMet-95 |
| SEQ. ID. NO. 30374 | 102-ProCysGlyThrAlaAspCysIleSerSerAlaArgArgArgThrSerLeu-118 |
| SEQ. ID. NO. 30375 | 120-AlaSerAlaLysSerAsnAlaSer-127 |
| SEQ. ID. NO. 30376 | 148-ProProThrSerLys-152 |

Hydrophilic Regions - Hopp-Woods

| | |
|---|---|
| SEQ. ID. NO. 30377 | 29-TrpGluGlyThrAspThrGlySerGlyArgAlaArgLeuAla-42 |
| SEQ. ID. NO. 30378 | 66-GlyGluLeuLysLeu-70 |
| SEQ. ID. NO. 30379 | 89-SerSerSerLysProLysMet-95 |
| SEQ. ID. NO. 30380 | 110-SerSerAlaArgArgArgThrSerLeu-118 |
| SEQ. ID. NO. 30381 | 120-AlaSerAlaLysSerAsnAla-126 | g280
AMPHI Regions - AMPHI

| | |
|---|---|
| SEQ. ID. NO. 30382 | 27-SerPheSerIleLeuGlyAspValAlaLys-36 |
| SEQ. ID. NO. 30383 | 64-AspIleLysLysIleArgSerAla-71 |
| SEQ. ID. NO. 30384 | 85-AspIleGlnArgAlaValLys-91 |
| SEQ. ID. NO. 30385 | 97-TyrAlaGluAlaThrLysGlyIleGlnProLeuLys-108 |
| SEQ. ID. NO. 30386 | 150-AspTyrAlaGlnAsnValAlaGluThrLeuIleLys-161 |
| SEQ. ID. NO. 30387 | 237-ValAlaAlaIleIleArgGlnIleLys-245 |
| SEQ. ID. NO. 30388 | 247-GluGlyIleLysAlaValPheThrGlu-255 |
| SEQ. ID. NO. 30389 | 258-LysAspThrArgMetValAspArgIleAlaLysGluThr-270 |
| SEQ. ID. NO. 30390 | 278-LeuTyrSerAspAlaLeuGlyAsnAlaProAlaAspThrTyrIle-292 |

Antigenic Index - Jameson-Wolf

| | |
|---|---|
| SEQ. ID. NO. 30391 | 38-IleGlyGlyGluArgValAla-44 |
| SEQ. ID. NO. 30392 | 51-AlaAsnGlnAspThrHis-56 |
| SEQ. ID. NO. 30393 | 61-ThrSerGlyAspIleLysLysIleArgSerAlaLys-72 |
| SEQ. ID. NO. 30394 | 82-GluAlaAlaAspIleGlnArgAlaValLysGlnSerLysValSerTyrAlaGluAlaThrLysGlyIleGln-105 |
| SEQ. ID. NO. 30395 | 107-LeuLysAlaGluGluGluGluGlyGlyHisHisHisAspHisHisHisAspHisAspHisAspHisGluGlyHisHisHisAspHisGlyGlu TyrAspProHisValTrpAsnAspProValLeu-147 |
| SEQ. ID. NO. 30396 | 158-ThrLeuIleLysAlaAspProGluGlyLysValTyrTyr-170 |
| SEQ. ID. NO. 30397 | 180-GlnLeuLysLysLeuHisSerAspAla-188 |
| SEQ. ID. NO. 30398 | 196-ProAlaAlaLysArgLysValLeuThr-204 |
| SEQ. ID. NO. 30399 | 212-MetGlyAsnArgTyr-216 |
| SEQ. ID. NO. 30400 | 224-GlnGlyValSerSerGluAlaGluProSerAlaLysGln-236 |
| SEQ. ID. NO. 30401 | 242-ArgGlnIleLysArgGluGlyIle-249 |
| SEQ. ID. NO. 30402 | 255-GluAsnIleLysAspThrArgMetValAspArgIleAlaLysGluThrGlyVal-272 |
| SEQ. ID. NO. 30403 | 274-ValSerGlyLysLeuTyrSer-280 |
| SEQ. ID. NO. 30404 | 286-AlaProAlaAspThr-290 |
| SEQ. ID. NO. 30405 | 295-TyrArgHisAsnVal-299 |

Hydrophilic Regions - Hopp-Woods

| | |
|---|---|
| SEQ. ID. NO. 30406 | 38-IleGlyGlyGluArgValAla-44 |
| SEQ. ID. NO. 30407 | 63-GlyAspIleLysLysIleArgSerAlaLys-72 |
| SEQ. ID. NO. 30408 | 82-GluAlaAlaAspIleGlnArgAlaValLysGlnSerLys-94 |
| SEQ. ID. NO. 30409 | 99-GluAlaThrLysGly-103 |
| SEQ. ID. NO. 30410 | 107-LeuLysAlaGluGluGluGlyGlyHisHisHisAspHisHisHisAspHisAspHisAspHisGluGlyHisHisHisAspHisGlyGluTyrAsp-138 |
| SEQ. ID. NO. 30411 | 158-ThrLeuIleLysAlaAspProGluGly-166 |
| SEQ. ID. NO. 30412 | 180-GlnLeuLysLysLeuHisSerAspAla-188 |
| SEQ. ID. NO. 30413 | 196-ProAlaAlaLysArgLysValLeuThr-204 |
| SEQ. ID. NO. 30414 | 226-ValSerSerGluAlaGluProSerAlaLysGln-236 |
| SEQ. ID. NO. 30415 | 242-ArgGlnIleLysArgGluGlyIle-249 |
| SEQ. ID. NO. 30416 | 255-GluAsnIleLysAspThrArgMetValAspArgIleAlaLysGluThrGlyVal-272 | g281
AMPHI Regions - AMPHI

| | |
|---|---|
| SEQ. ID. NO. 30417 | 62-AlaAlaGlyMetLeuMetAlaLeuLeuAlaGlyLeuValSerArgPhe-77 |
| SEQ. ID. NO. 30418 | 126-LeuGlnLeuIleAlaAlaValSerGlyLeuThr-136 |
| SEQ. ID. NO. 30419 | 179-LeuValSerGlyPheGlnAlaLeuGlyIleLeu-189 |
| SEQ. ID. NO. 30420 | 216-SerValLeuIleAlaLeuPheCysGlyLeuIleGlyLeu-228 |

Antigenic Index - Jameson-Wolf

| | |
|---|---|
| SEQ. ID. NO. 30421 | 25-ArgArgMetSerLeu-29 |
| SEQ. ID. NO. 30422 | 78-ThrThrLeuLysGluAspAlaAsn-85 |
| SEQ. ID. NO. 30423 | 102-SerLysAsnGlySerSerVal-108 |
| SEQ. ID. NO. 30424 | 158-LysSerValAsnGlyLysGlyGly-165 |
| SEQ. ID. NO. 30425 | 236-IleProSerGlyPro-240 |
| SEQ. ID. NO. 30426 | 256-LeuGlyLysGluGlyGlyIle-262 |
| SEQ. ID. NO. 30427 | 266-TrpPheLysAsnHisArgHisHisThrThr-275 |

Hydrophilic Regions - Hopp-Woods

| | |
|---|---|
| SEQ. ID. NO. 30428 | 25-ArgArgMetSerLeu-29 |
| SEQ. ID. NO. 30429 | 78-ThrThrLeuLysGluAspAlaAsn-85 |
| SEQ. ID. NO. 30430 | 103-LysAsnGlySerSer-107 |

TABLE 1-continued

| | |
|---|---|
| SEQ. ID. NO. 30431 | 256-LeuGlyLysGluGlyGlyIle-262 |
| SEQ. ID. NO. 30432 | 270-HisArgHisHisThr-274 | g282
AMPHI Regions - AMPHI
| | |
|---|---|
| SEQ. ID. NO. 30433 | 10-LeuIleValAlaLeuLeuValLeuIleAsnProPheSerAlaLeu-24 |
| SEQ. ID. NO. 30434 | 50-ValPheAlaValIleAlaValPheAlaLeuIleGlyGlyAlaLeu-64 |
| SEQ. ID. NO. 30435 | 112-ArgProAlaArgAsn-116 |
| SEQ. ID. NO. 30436 | 176-ValSerArgLeuLeu-180 |
| SEQ. ID. NO. 30437 | 186-ThrIleLeuAsnArgIleMetGlyMet-194 |

Antigenic Index - Jameson-Wolf
| | |
|---|---|
| SEQ. ID. NO. 30438 | 31-ThrAsnGlyHisSerThrLysGluArgArgLysValAlaArg-44 |
| SEQ. ID. NO. 30439 | 92-AsnGlyAsnAspAsnProAlaLysGlnAsnLeuGlyAlaGlnProGluThrGlyGlnAlaArgProAlaArgAsnAlaGly-118 |

Hydrophilic Regions - Hopp-Woods
| | |
|---|---|
| SEQ. ID. NO. 30440 | 34-HisSerThrLysGluArgArgLysValAlaArg-44 |
| SEQ. ID. NO. 30441 | 92-AsnGlyAsnAspAsnProAlaLysGlnAsnLeu-102 |
| SEQ. ID. NO. 30442 | 104-AlaGlnProGluThrGlyGlnAlaArgProAlaArgAsn-116 | g283
AMPHI Regions - AMPHI
| | |
|---|---|
| SEQ. ID. NO. 30443 | 32-GlyGlyAsnSerTyrSerAspValProLysGlnLeuHis-44 |
| SEQ. ID. NO. 30444 | 48-SerGlnIleLeuAsnLeu-53 |

Antigenic Index - Jameson-Wolf
| | |
|---|---|
| SEQ. ID. NO. 30445 | 28-TrpLysAspGlyGlyGlyAsnSerTyrSerAspValProLysGlnLeuHisProAspGlnSerGln-49 |
| SEQ. ID. NO. 30446 | 55-ThrLeuGlnThrLysProAlaValLysProLysProAlaValAspThrAsnAlaAspSerAlaLysGluAsnGluLysAspIleAlaGluLysAsnGlyGlnLeuGluGluGluLysLysLysIleAlaGluThrGluArgGlnAsnLysGluGluAsnCysArgIleSerLysMetAsnLeu-115 |
| SEQ. ID. NO. 30447 | 119-GlyAsnSerAsnAlaLysAsnLysAspAspLeuIleArgLysTyrAsnAsnAlaValAsnLysTyrCysArg-142 |

Hydrophilic Regions - Hopp-Woods
| | |
|---|---|
| SEQ. ID. NO. 30448 | 35-SerTyrSerAspValProLys-41 |
| SEQ. ID. NO. 30449 | 43-LeuHisProAspGlnSerGln-49 |
| SEQ. ID. NO. 30450 | 60-ProAlaValLysProLysProAlaValAspThrAsnAlaAspSerAlaLysGluAsnGluLysAspIleAlaGluLysAsnGlyGlnLeuGluGluGluLysLysLysIleAlaGluThrGluArgGlnAsnLysGluGluAsnCysArgIleSerLysMetAsnLeu-115 |
| SEQ. ID. NO. 30451 | 121-SerAsnAlaLysAsnLysAspAspLeuIleArgLysTyrAsn-134 | g284-2
AMPHI Regions - AMPHI
| | |
|---|---|
| SEQ. ID. NO. 30452 | 43-GluAlaPheAlaGlyPhePheGluThrVal-52 |
| SEQ. ID. NO. 30453 | 61-ThrPheAlaAlaArgPhe-66 |
| SEQ. ID. NO. 30454 | 125-ValAspPheAspValPhe-130 |
| SEQ. ID. NO. 30455 | 154-ValValPheArgLeuPheArgGln-161 |
| SEQ. ID. NO. 30456 | 174-AsnThrAlaCysGlyAsnValGlyGly-182 |
| SEQ. ID. NO. 30457 | 186-PheAlaAlaAlaPhe-190 |
| SEQ. ID. NO. 30458 | 216-PheValGlnPheIleArgAspAspPheGlyHisArg-227 |
| SEQ. ID. NO. 30459 | 277-PheArgValPheGlyGlnPheAlaArgGlnPheAlaAspCysAlaVal-292 |
| SEQ. ID. NO. 30460 | 310-AspGlyPheAspValValAspLys-317 |
| SEQ. ID. NO. 30461 | 342-LeuHisGlnValArgGlnThrAlaArgSerGlyAspAsnGlnIleAspArgPheAlaGln-361 |
| SEQ. ID. NO. 30462 | 381-AlaHisIlePheGly-385 |
| SEQ. ID. NO. 30463 | 387-ArgGlnCysValPhe-391 |
| SEQ. ID. NO. 30464 | 408-ArgAlaPheAlaArgPhePheAlaAlaPheGlyGlnSerLeuGlnSer-423 |

Antigenic Index - Jameson-Wolf
| | |
|---|---|
| SEQ. ID. NO. 30465 | 1-MetProSerGluThrArgAsnArgPhe-9 |
| SEQ. ID. NO. 30466 | 107-HisAlaPheAspGlyGlnPhe-113 |
| SEQ. ID. NO. 30467 | 132-HisPheGlyLysArgAsnArgAsnThrArgAla-142 |
| SEQ. ID. NO. 30468 | 147-GlyAlaProAspAlaVal-152 |
| SEQ. ID. NO. 30469 | 167-ValGlyAsnGlyArgTyrVal-173 |
| SEQ. ID. NO. 30470 | 178-GlyAsnValGlyGlyAsnGlnAsn-185 |
| SEQ. ID. NO. 30471 | 192-GlnIleArgGlnArgAlaVal-198 |
| SEQ. ID. NO. 30472 | 209-AlaValGlyGlyGlu-213 |
| SEQ. ID. NO. 30473 | 219-PheIleArgAspAspPheGlyHisArgPheGlyGlyArgGluAsnHisThr-235 |
| SEQ. ID. NO. 30474 | 292-ValProSerGlyGlyGluGlnXxxSer-300 |
| SEQ. ID. NO. 30475 | 303-ValGlyArgGlyGlyPheHisAspGlyPheAspValValAspLysAlaHis-319 |
| SEQ. ID. NO. 30476 | 346-ArgGlnThrAlaArgSerGlyAspAsnGlnIleAspArgPheAla-360 |
| SEQ. ID. NO. 30477 | 362-GlyAlaGlyLeuValAlaGluArgCysAlaAlaAspAspAlaAspGlyAlaGluPro-380 |
| SEQ. ID. NO. 30478 | 393-AspLeuArgArgGlnPheAlaGlyArgCysGlnHisGlnArgAlaArgAla-409 |
| SEQ. ID. NO. 30479 | 419-GlnSerLeuGlnSerArg-424 |

Hydrophilic Regions - Hopp-Woods
| | |
|---|---|
| SEQ. ID. NO. 30480 | 1-MetProSerGluThrArgAsnArgPhe-9 |
| SEQ. ID. NO. 30481 | 134-GlyLysArgAsnArgAsnThrArgAla-142 |
| SEQ. ID. NO. 30482 | 193-IleArgGlnArgAlaVal-198 |
| SEQ. ID. NO. 30483 | 220-IleArgAspAspPheGlyHis-226 |
| SEQ. ID. NO. 30484 | 228-PheGlyGlyArgGluAsnHisThr-235 |
| SEQ. ID. NO. 30485 | 294-SerGlyGlyGluGlnXxx-299 |
| SEQ. ID. NO. 30486 | 313-AspValValAspLysAlaHis-319 |
| SEQ. ID. NO. 30487 | 346-ArgGlnThrAlaArgSerGlyAspAsnGlnIleAspArgPheAla-360 |
| SEQ. ID. NO. 30488 | 366-ValAlaGluArgCysAlaAlaAspAspAlaAspGlyAlaGlu-379 |
| SEQ. ID. NO. 30489 | 393-AspLeuArgArgGlnPheAla-399 |
| SEQ. ID. NO. 30490 | 402-CysGlnHisGlnArgAlaArgAla-409 | g285-1
AMPHI Regions - AMPHI
| | |
|---|---|
| SEQ. ID. NO. 30491 | 15-ValCysPheLeuGly-19 |
| SEQ. ID. NO. 30492 | 34-GlnIleProSerTrp-38 |
| SEQ. ID. NO. 30493 | 50-GlyThrLeuLeuAspGlyPheAsp-57 |
| SEQ. ID. NO. 30494 | 115-GlnGlyLeuProAspSerIleAspLeuPro-124 |

TABLE 1-continued

| | |
|---|---|
| SEQ. ID. NO. 30495 | 208-HisSerThrAlaArg-212 |
| SEQ. ID. NO. 30496 | 240-HisProPheAlaGluSerLeuAspLysThrLeuGluGluValLeu-254 |
| SEQ. ID. NO. 30497 | 266-ValProSerLeuPro-270 |
| SEQ. ID. NO. 30498 | 280-AlaIleProSerPheSerAsp-286 |
| SEQ. ID. NO. 30499 | 313-GlnValLeuGlyGly-317 |
| SEQ. ID. NO. 30500 | 592-IleGlyLysAlaAlaAspIle-598 |
| SEQ. ID. NO. 30501 | 671-GlyIleAsnArgGluLeuThrArgTrp-679 |
| SEQ. ID. NO. 30502 | 745-LeuHisIleAlaGluLeuHisAsnPhePheLysProProPhe-758 |
| SEQ. ID. NO. 30503 | 836-PheGlyGlyAsnMetAlaAsn-842 |
| SEQ. ID. NO. 30504 | 848-ArgIleThrAlaSerLeu-853 |
| SEQ. ID. NO. 30505 | 855-AspLeuGlyAlaLeu-859 |
| SEQ. ID. NO. 30506 | 868-GlnAsnIleThrGlySer-873 |
| SEQ. ID. NO. 30507 | 955-GlySerIleAlaAsp-959 |
| SEQ. ID. NO. 30508 | 1008-ThrAlaGluLeuSer-1012 |
| SEQ. ID. NO. 30509 | 1061-ValThrGlyMetIleLys-1066 |
| SEQ. ID. NO. 30510 | 1137-GlyAsnValArgGlyValGlyThrValArg-1146 |
| SEQ. ID. NO. 30511 | 1165-ThrValSerPheValGlyProLeuAsn-1173 |
| SEQ. ID. NO. 30512 | 1190-AlaGlyValGluIleLeuGlySerLeuAsn-1199 |
| SEQ. ID. NO. 30513 | 1244-LeuAlaGlyGlnIle-1248 |
| SEQ. ID. NO. 30514 | 1305-ValLysLeuIleTyrArgLeuThrArgAlaIleGlnAlaValAlaArgIleGlySer-1323 |
| SEQ. ID. NO. 30515 | 1335-ArgPheAspArgLeuPheGly-1341 |
| Antigenic Index - Jameson-Wolf | |
| SEQ. ID. NO. 30516 | 43-IleSerSerGlnAsnLeuLysGlyThrLeuLeuAspGlyPheAspGlyAspAsnTrpSerIleGluThrGluGlyAlaAspLeuLysIleSerArg-74 |
| SEQ. ID. NO. 30517 | 80-LysProSerGluLeuMetArgArgSerLeuHis-90 |
| SEQ. ID. NO. 30518 | 104-LysProThrProProLysGluGluArgProProGlnGlyLeuProAspSerIleAsp-122 |
| SEQ. ID. NO. 30519 | 130-AspArgPheGluThrGlyLysIleSerMetGlyLysThrPheAspLysGlnThrValTyr-149 |
| SEQ. ID. NO. 30520 | 157-TyrArgTyrAspArgLysGlyHisArgLeuAspLeuLysAlaAlaAspThrProTrpSerSerSerSerGlySerAla-182 |
| SEQ. ID. NO. 30521 | 185-GlyLeuLysLysProPheAla-191 |
| SEQ. ID. NO. 30522 | 198-ThrLysGlyGlyPheGluGlyGluThrIle-207 |
| SEQ. ID. NO. 30523 | 209-SerThrAlaArgLeuSerGlySerLeuLysAspValArgAla-222 |
| SEQ. ID. NO. 30524 | 224-LeuThrIleAspGlyGlyAsnIleArgLeuSerGlyLysSer-237 |
| SEQ. ID. NO. 30525 | 244-GluSerLeuAspLysThrLeuGlu-251 |
| SEQ. ID. NO. 30526 | 268-SerLeuProAspAla-272 |
| SEQ. ID. NO. 30527 | 292-GlySerLeuAspLeuGluAsnThrLys-300 |
| SEQ. ID. NO. 30528 | 302-GlyPheAlaArgArgAsnGlyIleProVal-311 |
| SEQ. ID. NO. 30529 | 320-IleArgGlnAspGlyThrVal-326 |
| SEQ. ID. NO. 30530 | 337-GlyArgGlyGlyIleArgLeuSerGlyLysIleAspThrGluLysAspIleLeu-354 |
| SEQ. ID. NO. 30531 | 362-SerValGlyAlaGluAspValLeu-369 |
| SEQ. ID. NO. 30532 | 372-AlaPheLysGlyArgLeuAspGlySerIle-381 |
| SEQ. ID. NO. 30533 | 386-ThrThrAlaSerProLysIle-392 |
| SEQ. ID. NO. 30534 | 397-GlyThrGlyThrAlaArgThrAspGlySerLeu-407 |
| SEQ. ID. NO. 30535 | 411-SerAspProAlaAsnGluGlnArgLysLeuVal-421 |
| SEQ. ID. NO. 30536 | 428-SerAlaGlyGluGlySerLeuThr-435 |
| SEQ. ID. NO. 30537 | 442-LeuPheLysAspArgLeuLeuLysLeuAspIleArgSerArgAlaPheAspProSerArgIleAspProGlnPheProAlaGlyAspIleAsnGly-473 |
| SEQ. ID. NO. 30538 | 480-GluLeuAlaLysGluLysPheThrGlyLys-489 |
| SEQ. ID. NO. 30539 | 508-IleValTyrGluSerArgHisLeuProArgAlaAlaVal-520 |
| SEQ. ID. NO. 30540 | 522-LeuArgLeuGlyArgAsnIleValLysThrAspGlyGlyPheGlyLysLysGlyAspArgLeuAsn-543 |
| SEQ. ID. NO. 30541 | 548-AlaProAspLeuSerArgPheGly-555 |
| SEQ. ID. NO. 30542 | 563-AsnValArgGlyHisLeuSerGlyAspLeuAspGlyGlyIleArgThrPheGluThrAspLeuSerGlyThrAlaArg-588 |
| SEQ. ID. NO. 30543 | 594-LysAlaAlaAspIleArgSer-600 |
| SEQ. ID. NO. 30544 | 605-LeuLysGlySerProGlyThrSerArgProMetArgAlaAspIleLysGlyGlyArgLeu-624 |
| SEQ. ID. NO. 30545 | 641-GluGlyThrGlyAla-645 |
| SEQ. ID. NO. 30546 | 647-HisArgIleArgThr-651 |
| SEQ. ID. NO. 30547 | 657-LeuAspGlyLysProPheLysLeuAspLeuAspAlaSerGlyGlyIleAsnArgGluLeuThrArgTrpLysGlySerIle-683 |
| SEQ. ID. NO. 30548 | 696-LeuGlnAsnArgMetThrLeu-702 |
| SEQ. ID. NO. 30549 | 729-SerTrpAspArgLysThrGlyIleSerAlaLysGlyGlyAlaArgGly-744 |
| SEQ. ID. NO. 30550 | 764-LeuAsnGlyAspTrp-768 |
| SEQ. ID. NO. 30551 | 774-HisAsnAlaArgGly-778 |
| SEQ. ID. NO. 30552 | 782-IleSerArgGlnSerGlyAspAlaValLeu-791 |
| SEQ. ID. NO. 30553 | 803-SerLeuLysThrArgPheGlnAsnAspArgIleGly-814 |
| SEQ. ID. NO. 30554 | 817-LeuAspGlyGlyAlaArgPheGlyArgIleAsnAla-828 |
| SEQ. ID. NO. 30555 | 844-ProLeuGlyGlyArgIleThr-850 |
| SEQ. ID. NO. 30556 | 880-IleGlyGlyArgValGlySerProSerVal-889 |
| SEQ. ID. NO. 30557 | 893-ValAsnGlySerSerAsnTyrGlyLysIleAsnGly-904 |
| SEQ. ID. NO. 30558 | 908-ValGlyGlnSerArgSerPheAspThrAlaProLeuGlyGlyArg-922 |
| SEQ. ID. NO. 30559 | 928-AlaAspAlaGluAlaPhe-933 |
| SEQ. ID. NO. 30560 | 941-GlnThrValLysGlySerLeu-947 |
| SEQ. ID. NO. 30561 | 956-SerIleAlaAspProHisLeuGlyGly-964 |
| SEQ. ID. NO. 30562 | 966-IleAsnGlyAspLysLeuTyrTyrArgAsnGlnThr-977 |
| SEQ. ID. NO. 30563 | 982-LeuAspAsnGlySerLeuArg-988 |
| SEQ. ID. NO. 30564 | 991-IleAlaGlyArgLysTrpVal-997 |
| SEQ. ID. NO. 30565 | 1001-LeuLysPheArgHisGluGlyThrAlaGluLeuSerGly-1013 |
| SEQ. ID. NO. 30566 | 1015-ValSerMetGluAsnSerValProAspValAspIle-1026 |
| SEQ. ID. NO. 30567 | 1031-AspLysTyrArgIleLeuSerArgProAsnArgArgLeuThr-1044 |
| SEQ. ID. NO. 30568 | 1047-GlyAsnThrArgLeuArgTyrSerProGlnLysGlyIle-1059 |
| SEQ. ID. NO. 30569 | 1065-IleLysThrAspGlnGlyLeuPheGlySerGlnLysSerMetProSerValGlyAspAspVal-1086 |
| SEQ. ID. NO. 30570 | 1091-GluValLysLysGluAlaAlaAla-1098 |
| SEQ. ID. NO. 30571 | 1109-AspLeuAsnAspGlyIleArgPhe-1116 |
| SEQ. ID. NO. 30572 | 1134-GlnProGlyGlyAsnValArgGlyValGly-1143 |
| SEQ. ID. NO. 30573 | 1146-ArgValIleLysGlyArgTyrLysAlaTyrGlyGlnAspLeuAspIleThrLysGlyThr-1165 |

TABLE 1-continued

| | |
|---|---|
| SEQ. ID. NO. 30574 | 1171-ProLeuAsnAspProAsnLeuAsnIleArgAlaGluArgArgLeuSerProValGly-1189 |
| SEQ. ID. NO. 30575 | 1197-SerLeuAsnSerProArgIle-1203 |
| SEQ. ID. NO. 30576 | 1207-AlaAsnGluProMetSerGluLysAspLysLeu-1217 |
| SEQ. ID. NO. 30577 | 1225-AlaGlySerGlySerSerGlyAspAsnAlaAla-1235 |
| SEQ. ID. NO. 30578 | 1246-GlyGlnIleAsnAspArgIleGlyLeu-1254 |
| SEQ. ID. NO. 30579 | 1256-AspAspLeuGlyPheThrSerLysArgSerArgAsnAlaGlnThrGlyGluLeuAsnProAlaGlu-1277 |
| SEQ. ID. NO. 30580 | 1283-GlyLysGlnLeuThrGlyLys-1289 |
| SEQ. ID. NO. 30581 | 1298-IleSerSerAlaGluGlnSerVal-1305 |
| SEQ. ID. NO. 30582 | 1321-IleGlySerArgSerSerGlyGlyGluLeu-1330 |
| SEQ. ID. NO. 30583 | 1335-ArgPheAspArgLeuPheGlySerAspLysLysAspSerAlaGlyAsnGlyLysGlyLys-1354 |
| Hydrophilic Regions - Hopp-Woods | |
| SEQ. ID. NO. 30584 | 56-PheAspGlyAspAsnTrpSerIleGluThrGluGlyAlaAspLeuLysIleSerArg-74 |
| SEQ. ID. NO. 30585 | 83-GluLeuMetArgArgSerLeuHis-90 |
| SEQ. ID. NO. 30586 | 105-ProThrProProLysGluGluArgProProGlnGlyLeu-117 |
| SEQ. ID. NO. 30587 | 130-AspArgPheGluThrGlyLys-136 |
| SEQ. ID. NO. 30588 | 141-LysThrPheAspLys-145 |
| SEQ. ID. NO. 30589 | 157-TyrArgTyrAspArgLysGlyHisArgLeuAspLeuLysAlaAlaAsp-172 |
| SEQ. ID. NO. 30590 | 200-GlyGlyPheGluGlyGluThrIle-207 |
| SEQ. ID. NO. 30591 | 215-GlySerLeuLysAspValArgAla-222 |
| SEQ. ID. NO. 30592 | 244-GluSerLeuAspLysThrLeuGlu-251 |
| SEQ. ID. NO. 30593 | 292-GlySerLeuAspLeuGluAsnThrLys-300 |
| SEQ. ID. NO. 30594 | 302-GlyPheAlaAspArgAsnGlyIlePro-310 |
| SEQ. ID. NO. 30595 | 320-IleArgGlnAspGly-324 |
| SEQ. ID. NO. 30596 | 343-LeuSerGlyLysIleAspThrGluLysAspIleLeu-354 |
| SEQ. ID. NO. 30597 | 364-GlyAlaAspValLeu-369 |
| SEQ. ID. NO. 30598 | 373-PheLysGlyArgLeuAspGly-379 |
| SEQ. ID. NO. 30599 | 400-ThrAlaArgThrAspGly-405 |
| SEQ. ID. NO. 30600 | 411-SerAspProAlaAsnGluGlnArgLysLeuVal-421 |
| SEQ. ID. NO. 30601 | 429-AlaGlyGluGlySerLeu-434 |
| SEQ. ID. NO. 30602 | 442-LeuPheLysAspArgLeuLeuLysLeuAspIleArgSerArgAlaPheAspProSerArgIleAspPro-464 |
| SEQ. ID. NO. 30603 | 480-GluLeuAlaLysGluLysPheThrGly-488 |
| SEQ. ID. NO. 30604 | 508-IleValTyrGluSerArgHisLeuPro-516 |
| SEQ. ID. NO. 30605 | 522-LeuArgLeuGlyArgAsnIleValLysThrAspGlyGlyPheGlyLysLysGlyAspArgLeuAsn-543 |
| SEQ. ID. NO. 30606 | 570-GlyAspLeuAspGlyGlyIleArgThrPheGluThrAspLeuSerGlyThrAla-587 |
| SEQ. ID. NO. 30607 | 594-LysAlaAlaAspIleArgSer-600 |
| SEQ. ID. NO. 30608 | 607-GlySerProGlyThrSerArgProMetArgAlaAspIleLysGlyGlyArg-623 |
| SEQ. ID. NO. 30609 | 647-HisArgIleArgThr-651 |
| SEQ. ID. NO. 30610 | 657-LeuAspGlyLysProPheLysLeuAspLeuAspAla-668 |
| SEQ. ID. NO. 30611 | 670-GlyGlyIleAsnArgGluLeuThrArgTrpLysGly-681 |
| SEQ. ID. NO. 30612 | 729-SerTrpAspArgLysThrGlyIleSerAlaLysGlyGlyAlaArg-743 |
| SEQ. ID. NO. 30613 | 783-SerArgGlnSerGly-787 |
| SEQ. ID. NO. 30614 | 806-ThrArgPheGlnAsnAspArgIle-813 |
| SEQ. ID. NO. 30615 | 819-GlyGlyAlaArgPheGlyArgIleAsnAla-828 |
| SEQ. ID. NO. 30616 | 928-AlaAspAlaGluAlaPhe-933 |
| SEQ. ID. NO. 30617 | 1001-LeuLysPheArgHisGluGlyThrAlaGluLeu-1011 |
| SEQ. ID. NO. 30618 | 1019-AsnSerValProAspValAspIle-1026 |
| SEQ. ID. NO. 30619 | 1031-AspLysTyrArgIleLeuSerArgProAsnArgArgLeuThr-1044 |
| SEQ. ID. NO. 30620 | 1049-ThrArgLeuArgTyrSerPro-1055 |
| SEQ. ID. NO. 30621 | 1065-IleLysThrAspGln-1069 |
| SEQ. ID. NO. 30622 | 1075-GlnLysSerSerMet-1079 |
| SEQ. ID. NO. 30623 | 1091-GluValLysLysGluAlaAlaAla-1098 |
| SEQ. ID. NO. 30624 | 1109-AspLeuAsnAspGlyIleArg-1115 |
| SEQ. ID. NO. 30625 | 1146-ArgValIleLysGlyArgTyrLysAlaTyrGlyGlnAspLeuAspIleThrLys-1163 |
| SEQ. ID. NO. 30626 | 1179-IleArgAlaGluArgArgLeuSer-1186 |
| SEQ. ID. NO. 30627 | 1209-GluProMetSerGluLysAspLysLeu-1217 |
| SEQ. ID. NO. 30628 | 1225-AlaGlySerGlySerSerGlyAspAsnAlaAla-1235 |
| SEQ. ID. NO. 30629 | 1248-IleAsnAspArgIleGlyLeu-1254 |
| SEQ. ID. NO. 30630 | 1259-GlyPheThrSerLysArgSerArgAsnAlaGlnThrGlyGluLeuAsnPro-1275 |
| SEQ. ID. NO. 30631 | 1300-SerAlaGluGlnSerVal-1305 |
| SEQ. ID. NO. 30632 | 1321-IleGlySerArgSerSerGlyGly-1328 |
| SEQ. ID. NO. 30633 | 1340-PheGlySerAspLysLysAspSerAlaGlyAsnGlyLysGlyLys-1354 |
| g286-2 | |
| AMPHI Regions - AMPHI | |
| SEQ. ID. NO. 30634 | 69-GluIleLysAspMetVal-74 |
| SEQ. ID. NO. 30635 | 102-ProAspAsnValLysThr-107 |
| SEQ. ID. NO. 30636 | 145-ValAlaIleLeuGlyAsp-150 |
| SEQ. ID. NO. 30637 | 157-LeuAlaGluTyrTyrArgAsnAlaLeuGluAsnTrpGlnGlnProValGlySer-174 |
| SEQ. ID. NO. 30638 | 199-LeuAlaLysLeuGlyAsn-204 |
| SEQ. ID. NO. 30639 | 238-ThrGlnArgTyrProGluGlnThrValSerGlyLeuAlaArgPheGlnProGlyThr-256 |
| SEQ. ID. NO. 30640 | 326-AspTyrTyrAsnLeuPheAsnLys-333 |
| SEQ. ID. NO. 30641 | 354-IleSerGlnProArg-358 |
| SEQ. ID. NO. 30642 | 375-ThrThrGlnAsnLeu-379 |
| SEQ. ID. NO. 30643 | 428-ThrAlaSerTrpLysArgGlnLeuLeu-436 |
| SEQ. ID. NO. 30644 | 455-ThrLeuGlyThrPheLeu-460 |
| SEQ. ID. NO. 30645 | 513-GlyAlaSerSerVal-517 |
| SEQ. ID. NO. 30646 | 555-LeuSerGlyAlaValPheHisAspMetGlyAspAlaAlaAlaAsn-569 |
| SEQ. ID. NO. 30647 | 584-ArgTrpPheSerProLeu-589 |
| Antigenic Index - Jameson-Wolf | |
| SEQ. ID. NO. 30648 | 1-MetHisAspThrArgThrMetMet-8 |
| SEQ. ID. NO. 30649 | 30-AlaAspLeuSerGluAsnLysAla-37 |

TABLE 1-continued

| | |
|---|---|
| SEQ. ID. NO. 30650 | 43-PheLysSerLysSerProAspThrGluSerValLysLeuLysProLysPheProVal-61 |
| SEQ. ID. NO. 30651 | 63-IleAspThrGlnAspSerGluIleLysAspMetValGluGluHisLeu-78 |
| SEQ. ID. NO. 30652 | 83-GlnGlnGlnGluGluValLeuAspLysGluGlnThr-94 |
| SEQ. ID. NO. 30653 | 97-LeuAlaGluGluAlaProAspAsnValLysThrMetLeuArgSerLysGlyTyrPheSerSerLysValSerLeuThrGluLysAspGlyAla-127 |
| SEQ. ID. NO. 30654 | 133-ThrProGlyProArgThrLysIle-140 |
| SEQ. ID. NO. 30655 | 151-IleLeuSerAspGlyAsnLeuAlaGluTyrTyrArgAsnAlaLeuGluAsnTrpGln-169 |
| SEQ. ID. NO. 30656 | 172-ValGlySerAspPheAspGlnAspSerTrpGluAsnSerLysThrSerVal-188 |
| SEQ. ID. NO. 30657 | 192-ValThrArgLysGlyTyrPro-198 |
| SEQ. ID. NO. 30658 | 201-LysLeuGlyAsnThrArgAlaAlaValAsnProAspThrAlaThrAla-216 |
| SEQ. ID. NO. 30659 | 223-AspSerGlyArgProIleAla-229 |
| SEQ. ID. NO. 30660 | 234-GluIleThrGlyThrGlnArgTyrProGluGlnThrVal-246 |
| SEQ. ID. NO. 30661 | 252-PheGlnProGlyThrProTyrAspLeu-260 |
| SEQ. ID. NO. 30662 | 270-LeuGluGlnAsnGlyHisTyrSerGly-278 |
| SEQ. ID. NO. 30663 | 283-AlaAspPheAspArgLeuGlnGlyAspArgValProVal-295 |
| SEQ. ID. NO. 30664 | 298-SerValThrGluValLysArgHisLysLeuGluThrGlyIleArgLeuAspSerGluTyrGlyLeuGlyGly-321 |
| SEQ. ID. NO. 30665 | 342-AspMetAspLysTyrGluThr-348 |
| SEQ. ID. NO. 30666 | 355-SerGlnProArgAsnTyrArgGlyAsnTyrTrp-365 |
| SEQ. ID. NO. 30667 | 368-AsnValSerTyrAsnArgSerThrThrGlnAsnLeuGluLysArgAlaPheSerGlyGly-387 |
| SEQ. ID. NO. 30668 | 391-ValArgAspArgAlaGlyIleAspAlaArgLeuGly-402 |
| SEQ. ID. NO. 30669 | 405-PheLeuAlaGluGlyArgLysIleProGlySerAspValAspLeuGlyAsnSerHis-423 |
| SEQ. ID. NO. 30670 | 430-SerTrpLysArgGlnLeu-435 |
| SEQ. ID. NO. 30671 | 441-HisProGluAsnGlyHisTyrLeuAspGlyLysIle-452 |
| SEQ. ID. NO. 30672 | 468-ThrSerAlaArgAlaGly-473 |
| SEQ. ID. NO. 30673 | 476-PheThrProGluAsnLysLysLeu-483 |
| SEQ. ID. NO. 30674 | 496-ValAlaArgAspAsnAlaAspValProSer-505 |
| SEQ. ID. NO. 30675 | 509-PheArgSerGlyGlyAlaSerSerValArgGlyTyrGluLeuAspSer-524 |
| SEQ. ID. NO. 30676 | 534-ValLeuProGluArgAlaLeu-540 |
| SEQ. ID. NO. 30677 | 562-AspMetGlyAspAla-566 |
| SEQ. ID. NO. 30678 | 568-AlaAsnPheLysArgMetLysLeuLysHisGlySerGlyLeu-581 |
| SEQ. ID. NO. 30679 | 598-TyrGlyHisSerAspLysLysIleArg-606 |
| Hydrophilic Regions - Hopp-Woods | |
| SEQ. ID. NO. 30680 | 1-MetHisAspThrArgThrMetMet-8 |
| SEQ. ID. NO. 30681 | 30-AlaAspLeuSerGluAsnLysAla-37 |
| SEQ. ID. NO. 30682 | 44-LysSerLysSerProAspThrGluSerValLysLeuLysProLysPheProVal-61 |
| SEQ. ID. NO. 30683 | 63-IleAspThrGlnAspSerGluIleLysAspMetValGluGluHisLeu-78 |
| SEQ. ID. NO. 30684 | 84-GlnGlnGluGluValLeuAspLysGluGlnThr-94 |
| SEQ. ID. NO. 30685 | 97-LeuAlaGluGluAlaProAspAsnValLysThrMetLeuArgSer-111 |
| SEQ. ID. NO. 30686 | 119-ValSerLeuThrGluLysAspGlyAla-127 |
| SEQ. ID. NO. 30687 | 134-ProGlyProArgThrLysIle-140 |
| SEQ. ID. NO. 30688 | 174-SerAspPheAspGlnAspSerTrpGluAsnSerLysThr-186 |
| SEQ. ID. NO. 30689 | 192-ValThrArgLysGlyTyrPro-198 |
| SEQ. ID. NO. 30690 | 206-ArgAlaAlaValAsnProAspThrAlaThr-215 |
| SEQ. ID. NO. 30691 | 239-GlnArgTyrProGlu-243 |
| SEQ. ID. NO. 30692 | 283-AlaAspPheAspArgLeuGlnGlyAspArgValProVal-295 |
| SEQ. ID. NO. 30693 | 298-SerValThrGluValLysArgHisLysLeuGluThrGlyIleArgLeuAspSerGluTyr-317 |
| SEQ. ID. NO. 30694 | 342-AspMetAspLysTyrGluThr-348 |
| SEQ. ID. NO. 30695 | 373-ArgSerThrThrGlnAsnLeuGluLysArgAlaPhe-384 |
| SEQ. ID. NO. 30696 | 392-ArgAspArgAlaGlyIleAspAlaArgLeuGly-402 |
| SEQ. ID. NO. 30697 | 405-PheLeuAlaGluGlyArgLysIleProGlySerAspValAspLeu-419 |
| SEQ. ID. NO. 30698 | 478-ProGluAsnLysLysLeu-483 |
| SEQ. ID. NO. 30699 | 496-ValAlaArgAspAsnAlaAspVal-503 |
| SEQ. ID. NO. 30700 | 518-ArgGlyTyrGluLeuAspSer-524 |
| SEQ. ID. NO. 30701 | 534-ValLeuProGluArgAlaLeu-540 |
| SEQ. ID. NO. 30702 | 562-AspMetGlyAspAla-566 |
| SEQ. ID. NO. 30703 | 568-AlaAsnPheLysArgMetLysLeuLysHis-577 |
| SEQ. ID. NO. 30704 | 600-HisSerAspLysLysIleArg-606 |
| g287 | |
| AMPHI Regions - AMPHI | |
| SEQ. ID. NO. 30705 | 32-AspThrProSerLysPro-37 |
| SEQ. ID. NO. 30706 | 111-MetProGlnAsnAlaAlaGluSerAlaAsnGlnThrGly-123 |
| SEQ. ID. NO. 30707 | 195-LeuSerAspGluGluLysIleLysArgTyrLysLys-206 |
| SEQ. ID. NO. 30708 | 351-LysSerValAspGlyIleIleAspSer-359 |
| SEQ. ID. NO. 30709 | 378-GlyPheLysGlyThrTrpThr-384 |
| SEQ. ID. NO. 30710 | 391-ValSerGlyArgPheTyr-396 |
| Antigenic Index - Jameson-Wolf | |
| SEQ. ID. NO. 30711 | 18-CysGlyGlyGlyGlyGlyGlySerProAspValLysSerAlaAspThrProSerLysProAla-38 |
| SEQ. ID. NO. 30712 | 50-ValLeuProLysGluLysLysAspGluGluAlaAlaGlyAlaProGlnAlaAspThrGlnAspAlaThrAlaGlyGluGlySerGlnAsp-80 |
| SEQ. ID. NO. 30713 | 85-SerAlaGluAsnThrGlyAsnGlyGlyAlaAlaThrThrAspAsnProLysAsnGluAspAlaGlyAlaGlnAsnAspMetProGlnAsnAlaAlaGluSerAlaAsnGlnThrGlyAsnAsnGlnProAlaGlySerSerAspSerAlaProAlaSerAsnProAlaProAlaAsnGlyGlySerAspPheGlyArgThrAsnValGly-154 |
| SEQ. ID. NO. 30714 | 160-AspGlyProSerGlnAsn-165 |
| SEQ. ID. NO. 30715 | 169-ThrHisCysLysGlyAspSerCysAsnGlyAspAsnLeuLeuAspGluGluAlaProSerLysSerGluPheGluLysLeuSerAspGluGluLysIleLysArgTyrLysLysAspGluGlnArgGluAsnPhe-213 |
| SEQ. ID. NO. 30716 | 217-ValAlaAspArgValLysLysAspGlyThrAsnLys-228 |
| SEQ. ID. NO. 30717 | 233-TyrThrAspLysProProThrArgSerAlaArgSerArgArgSerLeuPro-249 |
| SEQ. ID. NO. 30718 | 262-ThrLeuIleValAspGlyGluAla-269 |
| SEQ. ID. NO. 30719 | 281-AlaProGluGlyAsnTyrArgTyrLeu-289 |
| SEQ. ID. NO. 30720 | 292-GlyAlaGluLysLeuProGlyGlySerTyr-301 |
| SEQ. ID. NO. 30721 | 305-ValGlnGlyGluProAlaLysGlyGluMet-314 |
| SEQ. ID. NO. 30722 | 329-HisMetGluAsnGlyArgProTyrProSerGlyGlyArgPheAlaAla-344 |

TABLE 1-continued

| | |
|---|---|
| SEQ. ID. NO. 30723 | 346-ValAspPheGlySerLysSerValAspGlyIleIleAspSerGlyAspAspLeuHisMetGlyThrGlnLysPheLysAlaAlaIleAspGlyAsn GlyPheLysGlyThrTrpThrGluAsnGlyGlyGlyAspValSerGly-393 |
| SEQ. ID. NO. 30724 | 395-PheTyrGlyProAlaGlyGluGluValAlaGlyLysTyrSerTyrArgProThrAspAlaGluLysGlyGlyPhe-419 |
| SEQ. ID. NO. 30725 | 423-AlaGlyLysLysAspArgAsp-429 |
| Hydrophilic Regions - Hopp-Woods | |
| SEQ. ID. NO. 30726 | 22-GlyGlyGlySerProAspValLysSerAlaAspThrProSerLysProAla-38 |
| SEQ. ID. NO. 30727 | 50-ValLeuProLysGluLysLysAspGluGluAlaAlaGly-62 |
| SEQ. ID. NO. 30728 | 65-ProGlnAlaAspThrGlnAspAlaThrAlaGlyGluGlySerGlnAsp-80 |
| SEQ. ID. NO. 30729 | 85-SerAlaGluAsnThrGly-90 |
| SEQ. ID. NO. 30730 | 95-AlaThrThrAspAsnProLysAsnGluAspAlaGlyAlaGlnAsnAspMetProGlnAsnAlaAlaGluSerAlaAsnGln-121 |
| SEQ. ID. NO. 30731 | 126-GlnProAlaGlySerSerAspSerAlaPro-135 |
| SEQ. ID. NO. 30732 | 144-GlyGlySerAspPheGlyArg-150 |
| SEQ. ID. NO. 30733 | 171-CysLysGlyAspSerCysAsnGly-178 |
| SEQ. ID. NO. 30734 | 180-AsnLeuLeuAspGluGluAlaProSerLysSerGlyPheGluLysLeuSerAspGluGluLysIleLysArgTyrLysLysAspGluGlnArg GluAsnPhe-213 |
| SEQ. ID. NO. 30735 | 217-ValAlaAspArgValLysLysAspGlyThrAsn-227 |
| SEQ. ID. NO. 30736 | 235-AspLysProProThrArgSerAlaArgSerArgArgSerLeuPro-249 |
| SEQ. ID. NO. 30737 | 263-LeuIleValAspGlyGluAla-269 |
| SEQ. ID. NO. 30738 | 292-GlyAlaGluLysLeuPro-297 |
| SEQ. ID. NO. 30739 | 305-ValGlnGlyGluProAlaLysGlyGluMet-314 |
| SEQ. ID. NO. 30740 | 331-GluAsnGlyArgProTyrProSer-338 |
| SEQ. ID. NO. 30741 | 346-ValAspPheGlySerLysSerValAspGlyIleIleAspSerGlyAspAspLeuHis-364 |
| SEQ. ID. NO. 30742 | 368-GlnLysPheLysAlaAlaIleAsp-375 |
| SEQ. ID. NO. 30743 | 387-GlyGlyGlyAspValSerGly-393 |
| SEQ. ID. NO. 30744 | 399-AlaGlyGluGluValAlaGly-405 |
| SEQ. ID. NO. 30745 | 407-TyrSerTyrArgProThrAspAlaGluLysGlyGly-418 |
| SEQ. ID. NO. 30746 | 423-AlaGlyLysLysAspArgAsp-429 |
| g288 | |
| AMPHI Regions - AMPHI | |
| SEQ. ID. NO. 30747 | 7-ValSerArgValLeu-11 |
| SEQ. ID. NO. 30748 | 54-IleValThrLysCysAla-59 |
| SEQ. ID. NO. 30749 | 61-ArgProTyrArgThrPheSerProLeuProVal-71 |
| SEQ. ID. NO. 30750 | 97-HisSerThrLeuArg-101 |
| SEQ. ID. NO. 30751 | 150-ThrLeuPheGlnAlaGlyPheAsp-157 |
| Antigenic Index - Jameson-Wolf | |
| SEQ. ID. NO. 30752 | 2-HisThrGlyGlnAla-6 |
| SEQ. ID. NO. 30753 | 28-AsnLeuProGluArgSerAlaGlySer-36 |
| SEQ. ID. NO. 30754 | 58-CysAlaValArgProTyrArgThrPheSerPro-68 |
| SEQ. ID. NO. 30755 | 72-LeuProLysGlnProSerAla-78 |
| SEQ. ID. NO. 30756 | 89-LeuProArgProAlaValAsnArgHisSerThrLeuArgSerProAspPheProProArgMet-109 |
| SEQ. ID. NO. 30757 | 113-IleArgGlyAspCysLeuPro-119 |
| SEQ. ID. NO. 30758 | 126-IleIleThrArgAsnAlaLysMetProSerGluThrValGlnValSerAspGlyIleGlnProLys-147 |
| SEQ. ID. NO. 30759 | 155-GlyPheAspGluAlaVal-160 |
| Hydrophilic Regions - Hopp-Woods | |
| SEQ. ID. NO. 30760 | 28-AsnLeuProGluArgSerAla-34 |
| SEQ. ID. NO. 30761 | 58-CysAlaValArgPro-62 |
| SEQ. ID. NO. 30762 | 98-SerThrLeuArgSerProAspPheProPro-107 |
| SEQ. ID. NO. 30763 | 113-IleArgGlyAspCys-117 |
| SEQ. ID. NO. 30764 | 126-IleIleThrArgAsnAlaLysMetProSerGluThrValGlnVal-140 |
| SEQ. ID. NO. 30765 | 155-GlyPheAspGluAlaVal-160 |
| g292-2 | |
| AMPHI Regions - AMPHI | |
| SEQ. ID. NO. 30766 | 7-LysIleLeuThrProPheThrValLeuProLeu-17 |
| SEQ. ID. NO. 30767 | 40-GlyLysSerValAla-44 |
| SEQ. ID. NO. 30768 | 62-ValLeuSerValSerGlu-67 |
| SEQ. ID. NO. 30769 | 69-ProValLysGlyIleTyrGlu-75 |
| SEQ. ID. NO. 30770 | 110-GluArgAlaAlaAspLeu-115 |
| SEQ. ID. NO. 30771 | 124-ProLeuAspLysAlaIleLysGluValArgGly-134 |
| SEQ. ID. NO. 30772 | 150-PheCysLysArgLeuGluHisGluPheGluLysMetThrAspValThr-165 |
| SEQ. ID. NO. 30773 | 195-LysAlaTrpThrAspTrpMetArg-202 |
| SEQ. ID. NO. 30774 | 212-IleCysAspAsnProVal-217 |
| Antigenic Index - Jameson-Wolf | |
| SEQ. ID. NO. 30775 | 1-MetLysThrLysLeu-5 |
| SEQ. ID. NO. 30776 | 23-ThrProValSerAsnAlaAsnAlaGluSerAlaValLysAlaGluSerAlaGlyLysSerVal-43 |
| SEQ. ID. NO. 30777 | 47-LeuLysAlaArgLeuGluLysThrTyrSerAlaGlnAspLeuLys-61 |
| SEQ. ID. NO. 30778 | 66-SerGluThrProValLysGlyIle-73 |
| SEQ. ID. NO. 30779 | 85-TyrThrAspAlaGluGlyGlyTyr-92 |
| SEQ. ID. NO. 30780 | 99-IleAsnIleAspThrArgLysAsnLeuThrGluGluArgAlaAlaAspLeuAsnLys-117 |
| SEQ. ID. NO. 30781 | 124-ProLeuAspLysAlaIleLysGluValArgGlyAsnGlyLysLeuLysVal-140 |
| SEQ. ID. NO. 30782 | 142-ValPheSerAspProAspCysProPhe-150 |
| SEQ. ID. NO. 30783 | 152-LysArgLeuGluHisGluPheGluLysMetThrAsp-163 |
| SEQ. ID. NO. 30784 | 177-HisProAspAlaAlaArgLysAla-184 |
| SEQ. ID. NO. 30785 | 189-CysGlnProAspArgAlaLysAla-196 |
| SEQ. ID. NO. 30786 | 200-TrpMetArgLysGlyLysPheProVal-208 |
| SEQ. ID. NO. 30787 | 210-GlySerIleCysAspAsnProValAlaGlyThrThrSerLeuGlyGlu-225 |
| SEQ. ID. NO. 30788 | 238-ProAsnGlyArgThrGlnSerGlyTyrSerPro-248 |
| SEQ. ID. NO. 30789 | 250-ProGlnLeuGluGluIleIleArgLysAsnGlnGln-261 |
| Hydrophilic Regions - Hopp-Woods | |
| SEQ. ID. NO. 30790 | 1-MetLysThrLysLeu-5 |
| SEQ. ID. NO. 30791 | 28-AlaAsnAlaGluSerAlaValLysAlaGluSerAlaGlyLysSerVal-43 |

TABLE 1-continued

| | |
|---|---|
| SEQ. ID. NO. 30792 | 47-LeuLysAlaArgLeuGluLysThrTyrSer-56 |
| SEQ. ID. NO. 30793 | 99-IleAsnIleAspThrArgLysAsnLeuThrGluGluArgAlaAlaAspLeuAsnLys-117 |
| SEQ. ID. NO. 30794 | 124-ProLeuAspLysAlaIleLysGluValArgGlyAsnGlyLysLeuLys-139 |
| SEQ. ID. NO. 30795 | 144-SerAspProAspCysProPhe-150 |
| SEQ. ID. NO. 30796 | 152-LysArgLeuGluHisGluPheGluLysMetThrAsp-163 |
| SEQ. ID. NO. 30797 | 179-AspAlaAlaArgLysAla-184 |
| SEQ. ID. NO. 30798 | 190-GlnProAspArgAlaLysAla-196 |
| SEQ. ID. NO. 30799 | 200-TrpMetArgLysGlyLysPhe-206 |
| SEQ. ID. NO. 30800 | 240-GlyArgThrGlnSer-244 |
| SEQ. ID. NO. 30801 | 250-ProGlnLeuGluGluIleIleArgLysAsnGlnGln-261 | g294-2
AMPHI Regions - AMPHI

| | |
|---|---|
| SEQ. ID. NO. 30802 | 27-ArgPheProAlaAlaLeuArgArgTyrSer-36 |
| SEQ. ID. NO. 30803 | 45-LysProAlaGlyThr-49 |
| SEQ. ID. NO. 30804 | 51-TrpHisArgValArgArgPheLysSerAsnArgArgThrArgGlyValLysProLeu-69 |
| SEQ. ID. NO. 30805 | 85-AlaTrpThrAlaLeuSerHisAsnIleAlaGluAlaAlaArgGluSerProArgArgCysGlyLysArgTyrAlaAspIleGlyGly-113 |
| SEQ. ID. NO. 30806 | 134-ValAlaHisIleIleHisLeuTyrCys-142 |
| SEQ. ID. NO. 30807 | 165-ValSerArgGluAlaArgArgGluVal-173 |
| SEQ. ID. NO. 30808 | 176-AlaMetSerTyrArg-180 |
| SEQ. ID. NO. 30809 | 212-PheAlaThrSerPheGly-217 |
| SEQ. ID. NO. 30810 | 227-AlaPheSerValLeuAlaHisPhe-234 |
| SEQ. ID. NO. 30811 | 247-ThrValGlyTrpSerLysTyrIleHisAlaVal-257 |

Antigenic Index - Jameson-Wolf

| | |
|---|---|
| SEQ. ID. NO. 30812 | 20-AlaValArgThrSerSerAsnArgPhe-28 |
| SEQ. ID. NO. 30813 | 30-AlaAlaLeuArgArgTyrSerArgAlaPheArg-39 |
| SEQ. ID. NO. 30814 | 44-ProLysProAlaGlyThrProTrpHisArgValArgArgPheLysSerAsnArgArgThrArgGlyValLysProLeuLysLysProTyrLeu-74 |
| SEQ. ID. NO. 30815 | 76-ArgGlyAlaGluCysArgCysArgArgAla-85 |
| SEQ. ID. NO. 30816 | 93-IleAlaGluArgAlaArgGluSerProArgArgCysGlyLysArgTyrAlaAspIleGlyGlyAspSerAspThrIleArgIleArgValPheArgLeuGluHisArgMet-129 |
| SEQ. ID. NO. 30817 | 161-HisThrGlyArgValSerArgGluAlaArgArgGluValGluLysAlaMetSer-178 |
| SEQ. ID. NO. 30818 | 240-LysMetAlaArgSer-244 |

Hydrophilic Regions - Hopp-Woods

| | |
|---|---|
| SEQ. ID. NO. 30819 | 20-AlaValArgThrSerSerAsnArg-27 |
| SEQ. ID. NO. 30820 | 30-AlaAlaLeuArgArg-34 |
| SEQ. ID. NO. 30821 | 52-HisArgValArgArgPheLysSerAsnArgArgThrArgGlyValLysProLeuLysLys-71 |
| SEQ. ID. NO. 30822 | 76-ArgGlyAlaGluCysArgCysArgArgAla-85 |
| SEQ. ID. NO. 30823 | 93-IleAlaGluArgAlaArgGluSerProArgArgCysGlyLysArgTyrAlaAspIleGlyGlyAspSerAspThrIleArg-119 |
| SEQ. ID. NO. 30824 | 121-ArgValPheArgLeuGluHisArgMet-129 |
| SEQ. ID. NO. 30825 | 164-ArgValSerArgGluAlaArgArgGluValGluLysAlaMetSer-178 | g295
AMPHI Regions - AMPHI

| | |
|---|---|
| SEQ. ID. NO. 30826 | 79-PheArgGlnProArg-83 |
| SEQ. ID. NO. 30827 | 111-ValGlnArgPhePheArgGlnPro-118 |
| SEQ. ID. NO. 30828 | 131-AlaPheLeuHisGlnIle-136 |
| SEQ. ID. NO. 30829 | 163-ValIleArgLysIleAlaAlaLeu-170 |
| SEQ. ID. NO. 30830 | 176-AsnLeuArgGlyPhePro-181 |
| SEQ. ID. NO. 30831 | 189-HisGlnGlnArgArgIleGlyLysThr-197 |
| SEQ. ID. NO. 30832 | 263-TyrIleIleLysProLeuGluHis-270 |

Antigenic Index - Jameson-Wolf

| | |
|---|---|
| SEQ. ID. NO. 30833 | 4-MetAlaArgHisAspGlyGlnGlnGly-12 |
| SEQ. ID. NO. 30834 | 18-LeuProArgArgGlnGln-23 |
| SEQ. ID. NO. 30835 | 36-AlaAlaAlaHisGlyAsnArgProAlaSerAspAlaPhePheLysLeuProArgGlnArgPheHisVal-58 |
| SEQ. ID. NO. 30836 | 73-HisGlyCysArgAlaGlnPheArgGlnProArgArgIleArgLeuArgLeuArgGlnThrAlaArgGlnArgSerGlyCysGlyThrAspGlnAlaAlaAsp-106 |
| SEQ. ID. NO. 30837 | 115-PheArgGlnProArgIleArgGlnLysGlnArgHisThrArgSerProAla-131 |
| SEQ. ID. NO. 30838 | 137-GlyProAspPheGly-141 |
| SEQ. ID. NO. 30839 | 144-GlnAsnAlaGluHisArgAla-150 |
| SEQ. ID. NO. 30840 | 171-ArgIleGlyLysGlnAsnLeuArgGlyPheProSerArgArgGlyHisLeuArgHisGlnGlnArgArgIleGlyLysThrProProGlnLeuAla-202 |
| SEQ. ID. NO. 30841 | 207-GlyGlyThrArgPheSerAspArgAsnGlyValTyrProAsnArgAlaGlyAsnGlyIleArgMetArgLeuAlaGlu-232 |
| SEQ. ID. NO. 30842 | 239-ProValCysArgGlyThrSerGly-246 |
| SEQ. ID. NO. 30843 | 253-ProTyrProTyrArgArgLysGlnProGlnTyr-263 |
| SEQ. ID. NO. 30844 | 274-SerCysLysThrAsnAlaValArgThrValArgThrAlaPheArgGlnArgAsnGlnIleSer-294 |

Hydrophilic Regions - Hopp-Woods

| | |
|---|---|
| SEQ. ID. NO. 30845 | 5-AlaArgHisAspGlyGlnGln-11 |
| SEQ. ID. NO. 30846 | 18-LeuProArgArgGlnGln-23 |
| SEQ. ID. NO. 30847 | 36-AlaAlaAlaHisGlyAsnArgProAlaSer-45 |
| SEQ. ID. NO. 30848 | 77-AlaGlnPheArgGlnProArgArgIleArgLeuArgLeuArgGlnThrAlaArgGlnArgSerGlyCysGlyThrAspGlnAlaAla-105 |
| SEQ. ID. NO. 30849 | 118-ProArgIleArgGlnLysGlnArgHisThrArg-128 |
| SEQ. ID. NO. 30850 | 146-AlaGluHisArgAla-150 |
| SEQ. ID. NO. 30851 | 171-ArgIleGlyLysGlnAsnLeu-177 |
| SEQ. ID. NO. 30852 | 180-PheProSerArgArgGlyHisLeuArgHisGlnGlnArgArgIleGlyLysThrProPro-199 |
| SEQ. ID. NO. 30853 | 210-ArgPheSerAspArgAsnGly-216 |
| SEQ. ID. NO. 30854 | 226-IleArgMetArgLeuAlaGlu-232 |
| SEQ. ID. NO. 30855 | 239-ProValCysArgGlyThr-244 |
| SEQ. ID. NO. 30856 | 255-ProTyrArgArgLysGlnPro-261 |
| SEQ. ID. NO. 30857 | 281-ArgThrValArgThrAlaPheArgGlnArgAsnGlnIle-293 | g297
AMPHI Regions - AMPHI

| | |
|---|---|
| SEQ. ID. NO. 30858 | 69-GlnProGlyAspSerLeuAlaAspValLeuAla-79 |
| SEQ. ID. NO. 30859 | 86-AspGluIleAlaArgIleThrGluLysTyr-95 |

| | |
|---|---|
| SEQ. ID. NO. 30860 | 157-LeuProThrLeuArg-161 |
| SEQ. ID. NO. 30861 | 199-LeuLysGluGlyAspAla-204 |
| SEQ. ID. NO. 30862 | 272-LeuValTyrThrArgIleSerSer-279 |
| SEQ. ID. NO. 30863 | 333-HisAlaAsnGlyValGluThrLeuTyrAlaHisLeuSerAlaPheSerGln-349 |
| Antigenic Index - Jameson-Wolf | |
| SEQ. ID. NO. 30864 | 8-AlaLysHisArgLysTyrAla-14 |
| SEQ. ID. NO. 30865 | 31-AlaSerThrGluGlyThrGluArgValArgProGlnArgValGluGlnLysLeuPro-49 |
| SEQ. ID. NO. 30866 | 52-SerTrpGlyGlyAsnGly-57 |
| SEQ. ID. NO. 30867 | 67-AlaValGlnProGlyAspSerLeuAla-75 |
| SEQ. ID. NO. 30868 | 78-LeuAlaArgSerGlyMetAlaArgAspGluIleAlaArgIleThrGluLysTyrGlyGlyGluAlaAspLeuArgHisLeuArgAlaAspGlnSerVal-110 |
| SEQ. ID. NO. 30869 | 115-GlyGlyAspGlySerAlaArgGlu-122 |
| SEQ. ID. NO. 30870 | 127-ThrAspGluAspGlyGluArgAsnLeuValAlaLeuGluLysLysGlyGlyIleTrpArgArgSerAlaSerAspAlaAspMetLysVal-156 |
| SEQ. ID. NO. 30871 | 167-ThrSerAlaArgGlySerLeuAlaArgAlaGluValProValGluIleArgGluSerLeuSer-187 |
| SEQ. ID. NO. 30872 | 194-PheSerLeuAspGlyLeuLysGluGlyAspAlaVal-205 |
| SEQ. ID. NO. 30873 | 228-GluValValLysGlyGlyThrThr-235 |
| SEQ. ID. NO. 30874 | 240-TyrTyrArgSerAspLysGluGlyGlyGlyGlyGlyAsnTyrTyrAspGluAspGlyArgValLeuGlnGluLysGlyGlyPheAsn-268 |
| SEQ. ID. NO. 30875 | 276-ArgIleSerSerProPheGlyTyr-283 |
| SEQ. ID. NO. 30876 | 295-HisThrGlyIleAspTyrAla-301 |
| SEQ. ID. NO. 30877 | 303-ProGlnGlyThrProValArgAlaSerAlaAspGly-314 |
| SEQ. ID. NO. 30878 | 318-PheLysGlyArgLysGlyGlyTyrGly-326 |
| SEQ. ID. NO. 30879 | 333-HisAlaAsnGlyValGlu-338 |
| SEQ. ID. NO. 30880 | 350-AlaGlnGlyAsnValArgGlyGlyGlu-358 |
| SEQ. ID. NO. 30881 | 365-SerThrGlyArgSerThrGlyProHisLeu-374 |
| SEQ. ID. NO. 30882 | 376-TyrGluAlaArgIleAsnGlyGlnProValAsn-386 |
| SEQ. ID. NO. 30883 | 393-ProThrProGluLeuThrGlnAlaAspLysAlaAla-404 |
| SEQ. ID. NO. 30884 | 408-GlnLysGlnLysAlaAspAlaLeu-415 |
| SEQ. ID. NO. 30885 | 426-ValSerGlnSerAsp-430 |
| Hydrophilic Regions - Hopp-Woods | |
| SEQ. ID. NO. 30886 | 8-AlaLysHisArgLysTyrAla-14 |
| SEQ. ID. NO. 30887 | 33-ThrGluGlyThrGluArgValArgProGlnArgValGluGlnLysLeu-48 |
| SEQ. ID. NO. 30888 | 68-ValGlnProGlyAspSerLeuAla-75 |
| SEQ. ID. NO. 30889 | 82-GlyMetAlaArgAspGluIleAlaArgIleThrGluLysTyrGlyGlyGluAlaAspLeuArgHisLeuArgAlaAspGln-108 |
| SEQ. ID. NO. 30890 | 117-AspGlySerAlaArgGlu-122 |
| SEQ. ID. NO. 30891 | 127-ThrAspGluAspGlyGluArgAsnLeuValAlaLeuGluLysLysGlyGlyIleTrpArgArgSerAlaSerAspAlaAspMetLysVal-156 |
| SEQ. ID. NO. 30892 | 167-ThrSerAlaArgGlySerLeuAlaArgAlaGluValProValGluIleArgGluSerLeu-186 |
| SEQ. ID. NO. 30893 | 194-PheSerLeuAspGlyLeuLysGluGlyAspAlaVal-205 |
| SEQ. ID. NO. 30894 | 242-ArgSerAspLysGluGlyGlyGly-249 |
| SEQ. ID. NO. 30895 | 253-TyrTyrAspGluAspGlyArgValLeuGlnGluLysGlyGlyPhe-267 |
| SEQ. ID. NO. 30896 | 306-ThrProValArgAlaSerAla-312 |
| SEQ. ID. NO. 30897 | 319-LysGlyArgLysGlyGlyTyr-325 |
| SEQ. ID. NO. 30898 | 352-GlyAsnValArgGlyGlyGlu-358 |
| SEQ. ID. NO. 30899 | 366-ThrGlyArgSerThrGly-371 |
| SEQ. ID. NO. 30900 | 378-AlaArgIleAsnGly-382 |
| SEQ. ID. NO. 30901 | 396-GluLeuThrGlnAlaAspLysAlaAla-404 |
| SEQ. ID. NO. 30902 | 408-GlnLysGlnLysAlaAspAlaLeu-415 |
| g298 | |
| AMPHI Regions - AMPHI | |
| SEQ. ID. NO. 30903 | 6-SerLeuPheAlaSerIleLeuMetSerAlaLeuIleAla-18 |
| SEQ. ID. NO. 30904 | 26-IleAsnAlaTyrTrpGlnGln-32 |
| SEQ. ID. NO. 30905 | 42-ProLeuAlaAlaTyr-46 |
| SEQ. ID. NO. 30906 | 62-LeuSerAspGlyIleLysThrPhe-69 |
| SEQ. ID. NO. 30907 | 134-ValGlnLysSerLeuLys-139 |
| SEQ. ID. NO. 30908 | 148-AsnLeuSerLysGln-152 |
| SEQ. ID. NO. 30909 | 157-SerTyrProSerPhePheAspTrpProLysThrIleGluGluThrLeuLysLysHisProGlu-177 |
| SEQ. ID. NO. 30910 | 188-AsnAspProTrpAsp-192 |
| SEQ. ID. NO. 30911 | 208-AlaGlnGluTyrLeuLysArgValAspArgIleLeuGlu-220 |
| SEQ. ID. NO. 30912 | 246-MetArgTyrLeuAspLysLeuLeuSerGluHisLeu-257 |
| SEQ. ID. NO. 30913 | 276-ArgTyrThrAspSer-280 |
| SEQ. ID. NO. 30914 | 308-GluLysIleMetGluLys-313 |
| Antigenic Index - Jameson-Wolf | |
| SEQ. ID. NO. 30915 | 22-SerGlnAsnProIleAsnAlaTyr-29 |
| SEQ. ID. NO. 30916 | 34-TyrHisArgAsnSerProLeuGluPro-42 |
| SEQ. ID. NO. 30917 | 47-GlyTrpTrpArgSerGlyAlaAlaLeuGlnGlu-57 |
| SEQ. ID. NO. 30918 | 70-LeuSerGlyGluThrProProThrAlaGlnAspGlyGlySerAlaAspMetProProGluAlaAlaAlaSerGluAlaAlaProProAlaGlyGlyThrGluTrpLysGlnGlyThrGlu-109 |
| SEQ. ID. NO. 30919 | 111-AlaAlaValArgSerGlyAspLysValPhePhe-121 |
| SEQ. ID. NO. 30920 | 136-LysSerLeuLysGlnGlnTyrGlyIleGluSerAlaAsnLeuSerLysGlnSerThr-154 |
| SEQ. ID. NO. 30921 | 162-PheAspTrpProLysThrIleGluGluThrLeuLysLysHisProGlu-177 |
| SEQ. ID. NO. 30922 | 186-GlyProAsnAspProTrp-191 |
| SEQ. ID. NO. 30923 | 194-ProValGlyLysArgTyrLeu-200 |
| SEQ. ID. NO. 30924 | 203-AlaSerAspGluTrpAla-208 |
| SEQ. ID. NO. 30925 | 211-TyrLeuLysArgValAspArgIleLeuGlu-220 |
| SEQ. ID. NO. 30926 | 238-LysLysValLysLeuAspGlyGlnMetArgTyrLeuAsp-250 |
| SEQ. ID. NO. 30927 | 252-LeuLeuSerGluHisLeuLysGly-259 |
| SEQ. ID. NO. 30928 | 269-ThrLeuSerGlyGlyLysGlyArgTyrThrAspSerValAsnValAsnGlyLysProValArgTyrArgSerLysAspGlyIle-296 |
| SEQ. ID. NO. 30929 | 301-GluGlyGlnLysLeuLeuAla-307 |
| SEQ. ID. NO. 30930 | 318-ProSerThrGlnProSerSerThrGlnPro-327 |
| Hydrophilic Regions - Hopp-Woods | |
| SEQ. ID. NO. 30931 | 73-GluThrProProThrAlaGlnAspGlyGlySerAlaAspMetProProGluAlaAlaAlaSerGluAlaAlaPro-97 |
| SEQ. ID. NO. 30932 | 102-ThrGluTrpLysGlnGlyThrGlu-109 |

TABLE 1-continued

| SEQ. ID. NO. 30933 | 111-AlaAlaValArgSerGlyAsp-117 |
| SEQ. ID. NO. 30934 | 148-AsnLeuSerLysGlnSerThr-154 |
| SEQ. ID. NO. 30935 | 166-LysThrIleGluGluThrLeuLysLysHisProGlu-177 |
| SEQ. ID. NO. 30936 | 211-TyrLeuLysArgValAspArgIleLeuGlu-220 |
| SEQ. ID. NO. 30937 | 238-LysLysValLysLeuAspGlyGlnMetArgTyrLeuAsp-250 |
| SEQ. ID. NO. 30938 | 252-LeuLeuSerGluHisLeuLysGly-259 |
| SEQ. ID. NO. 30939 | 271-SerGlyGlyLysGlyArgTyrThrAsp-279 |
| SEQ. ID. NO. 30940 | 281-ValAsnValAsnGlyLysProValArgTyrArgSerLysAspGlyIle-296 |
| SEQ. ID. NO. 30941 | 301-GluGlyGlnLysLeuLeuAla-307 |
| SEQ. ID. NO. 30942 | 319-SerThrGlnProSerSerThrGlnPro-327 | g299
AMPHI Regions - AMPHI
SEQ. ID. NO. 30943  1-MetAsnProLysHisPheIleAlaPheSerAlaLeuPheAlaAlaThrGlnAlaGluAlaLeuProValAlaSerValSerProAspThrValThrValSer
ProSerAlaProTyrThrAspThrAsnGlyLeuLeuThrAspTyrGlyAsnAlaAlaAlaSerProTrpMetLysLysLeuArgSerValAlaGlnGlySerGl
yGluAlaPheArgIleLeuGlnIleGlyAspSerHisThrAlaGlyAspPhePheThrAspAlaLeuArgLysArgLeuGlnLysThrTrpGlyAspGlyGlyI
leGlyTrpValTyrProAlaAsnValLysGlyGlnArgMetAlaAlaValArgHisSerGlyAsnTrpGlnSerPheThrSerArgAsnAsnThrGlyAspPhe
ProLeuGlyGlyIleLeuAlaGlnThrGlySerGlyGlyMetThrLeuThrAlaSerAspGlyLysThrGlyLysGlnArgValSerLeuPheAlaLysPr
oLeuLeuAlaGluGlnThrLeuThrValAsnGlyAsnThrValSerAlaAsnGlyGlyGlyTrpGlnValLeuAspThrGlyAlaAlaLeuProLeuAlaIleG
lnThrGluMetProTrpAspIleGlyPheIleAsnIleGluAsnProAlaGlyGlyIleThrValSerAlaMetGlyIleAsnGlyAlaGlnLeuThrGlnTrp
SerLysTrpArgAlaAspArgMetAsnAspLeuAlaGlnThrGlyAlaAspLeuValIleLeuSerTyrGlyThrAsnGluAlaPheAsnAsnAsnIleAspIl
eAlaAspThrGluGlnLysTrpLeuAspThrValArgGlnIleArgAspSerLeuProAlaAlaGlyIleLeuIleIleGlyAlaProGluSerLeuLysAsnT
hrLeuGlyValCysGlyThrArgProValLeuLeuThrGluValGlnGlnMetGlnArgArgValAlaArgGlnGlyGlnThrMetPheTrpSerTrpGlnAsn
AlaMetGlyGlyIleCysSerMetLysAsnTrpLeuAsnGlnGlyTrpAlaAlaLysAspGlyValHisPheSerAlaGlnGlyTyrArgArgAlaAlaGluMe
tLeuAlaAspSerLeuGluGluLeuValArgAlaAlaAlaIleArgGln-397
Antigenic Index - Jameson-Wolf (SEQ. ID. NO. 30943)
1-MetAsnProLysHisPheIleAlaPheSerAlaLeuPheAlaAlaThrGlnAlaGluAlaLeuProValAlaSe
rValSerProAspThrValThrValSerProSerAlaProTyrThrAspThrAsnGlyLeuLeuThrAspTyrGly
AsnAlaAlaAlaSerProTrpMetLysLysLeuArgSerValAlaGlnGlySerGlyGluAlaPheArgIleLeuG
lnIleGlyAspSerHisThrAlaGlyAspPhePheThrAspAlaLeuArgLysArgLeuGlnLysThrTrpGlyAs
pGlyGlyIleGlyTrpValTyrProAlaAsnValLysGlyGlnArgMetAlaAlaValArgHisSerGlyAsnTrp
GlnSerPheThrSerArgAsnAsnThrGlyAspPheProLeuGlyGlyIleLeuAlaGlnThrGlySerGlyGlyG
lyMetThrLeuThrAlaSerAspGlyLysThrGlyLysGlnArgValSerLeuPheAlaLysProLeuLeuAlaGl
uGlnThrLeuThrValAsnGlyAsnThrValSerAlaAsnGlyGlyGlyTrpGlnValLeuAspThrGlyAlaAla
LeuProLeuAlaIleGlnThrGluMetProTrpAspIleGlyPheIleAsnIleGluAsnProAlaGlyGlyIleT
hrValSerAlaMetGlyIleAsnGlyAlaGlnLeuThrGlnTrpSerLysTrpArgAlaAspArgMetAsnAspLe
uAlaGlnThrGlyAlaAspLeuValIleLeuSerTyrGlyThrAsnGluAlaPheAsnAsnAsnIleAspIleAla
AspThrGluGlnLysTrpLeuAspThrValArgGlnIleArgAspSerLeuProAlaAlaGlyIleLeuIleIleG
lyAlaProGluSerLeuLysAsnThrLeuGlyValCysGlyThrArgProValLeuLeuThrGluValGlnGlnMe
tGlnArgArgValAlaArgGlnGlyGlnThrMetPheTrpSerTrpGlnAsnAlaMetGlyGlyIleCysSerMet
LysAsnTrpLeuAsnGlnGlyTrpAlaAlaLysAspGlyValHisPheSerAlaGlnGlyTyrArgArgAlaAlaG
luMetLeuAlaAspSerLeuGluGluLeuValArgAlaAlaAlaIleArgGln-397
Hydrophilic Regions - Hopp-Woods (SEQ. ID. NO. 30943)
1-MetAsnProLysHisPheIleAlaPheSerAlaLeuPheAlaAlaThrGlnAlaGluAlaLeuProValAlaSe
rValSerProAspThrValThrValSerProSerAlaProTyrThrAspThrAsnGlyLeuLeuThrAspTyrGly
AsnAlaAlaAlaSerProTrpMetLysLysLeuArgSerValAlaGlnGlySerGlyGluAlaPheArgIleLeuG
lnIleGlyAspSerHisThrAlaGlyAspPhePheThrAspAlaLeuArgLysArgLeuGlnLysThrTrpGlyAs
pGlyGlyIleGlyTrpValTyrProAlaAsnValLysGlyGlnArgMetAlaAlaValArgHisSerGlyAsnTrp
GlnSerPheThrSerArgAsnAsnThrGlyAspPheProLeuGlyGlyIleLeuAlaGlnThrGlySerGlyGlyG
lyMetThrLeuThrAlaSerAspGlyLysThrGlyLysGlnArgValSerLeuPheAlaLysProLeuLeuAlaGl
uGlnThrLeuThrValAsnGlyAsnThrValSerAlaAsnGlyGlyGlyTrpGlnValLeuAspThrGlyAlaAla
LeuProLeuAlaIleGlnThrGluMetProTrpAspIleGlyPheIleAsnIleGluAsnProAlaGlyGlyIleT
hrValSerAlaMetGlyIleAsnGlyAlaGlnLeuThrGlnTrpSerLysTrpArgAlaAspArgMetAsnAspLe
uAlaGlnThrGlyAlaAspLeuValIleLeuSerTyrGlyThrAsnGluAlaPheAsnAsnAsnIleAspIleAla
AspThrGluGlnLysTrpLeuAspThrValArgGlnIleArgAspSerLeuProAlaAlaGlyIleLeuIleIleG
lyAlaProGluSerLeuLysAsnThrLeuGlyValCysGlyThrArgProValLeuLeuThrGluValGlnGlnMe
tGlnArgArgValAlaArgGlnGlyGlnThrMetPheTrpSerTrpGlnAsnAlaMetGlyGlyIleCysSerMet
LysAsnTrpLeuAsnGlnGlyTrpAlaAlaLysAspGlyValHisPheSerAlaGlnGlyTyrArgArgAlaAlaG
luMetLeuAlaAspSerLeuGluGluLeuValArgAlaAlaAlaIleArgGln-397 g302
AMPHI Regions - AMPHI

| SEQ. ID. NO. 30944 | 20-SerGlyArgPheLeuArgThrValGluTrpLeuGlyAsnMetLeuProHisPro-37 |
| SEQ. ID. NO. 30945 | 81-ValValSerLeuLeuAspAlaAspGlyLeuIleLysIleLeuThrHisThrValLysAsnPheThrGlyPheAlaProLeuGlyThrValLeu
ValSerLeu-114 |
| SEQ. ID. NO. 30946 | 127-SerAlaLeuMetArg-131 |
| SEQ. ID. NO. 30947 | 171-IlePheHisSerLeuGlyArgHisProLeuAlaGlyLeuAlaAlaAlaPheAlaGlyValSerGly-192 |
| SEQ. ID. NO. 30948 | 201-GlyThrIleAspProLeuLeuAlaGlyIleThrGlnGlnAla-214 |
| SEQ. ID. NO. 30949 | 240-IleAlaLeuIleGly-244 |
| SEQ. ID. NO. 30950 | 271-ArgHisSerAsnGluIle-276 |
| SEQ. ID. NO. 30951 | 294-LeuSerAlaLeuLeuAlaTrp-300 |
| SEQ. ID. NO. 30952 | 308-IleLeuArgHisProGluThr-314 |
| SEQ. ID. NO. 30953 | 341-TyrGlyArgIleThrArgSerLeuArgGly-350 |
| SEQ. ID. NO. 30954 | 352-ArgGluValValAsnAlaMetAlaGluSerMetSer-363 |
| SEQ. ID. NO. 30955 | 378-PheValAlaPhePheAsnTrpThrAsnIleGlyGlnTyrIle-391 |
| SEQ. ID. NO. 30956 | 448-AlaProGlnValIle-452 |
| SEQ. ID. NO. 30957 | 455-AlaTyrArgIleGlyAspSerValThrAsnIleIleThrProMetMetSerTyrPheGlyLeuIleMetAla-478 |
| SEQ. ID. NO. 30958 | 505-IleAlaTrpIleAlaLeuPheCysIle-513 |

Antigenic Index - Jameson-Wolf

| SEQ. ID. NO. 30959 | 8-LysGluLysGlnMetSerGlnThrAspAlaArgArgSerGlyArgPheLeuArg-25 |
| SEQ. ID. NO. 30960 | 61-SerValProAspProArgProValGlyAlaLysGlyArgAlaAspAspGlyLeu-78 |
| SEQ. ID. NO. 30961 | 85-LeuAspAlaAspGlyLeu-90 |

TABLE 1-continued

| | |
|---|---|
| SEQ. ID. NO. 30962 | 119-IleAlaGluLysSerGly-124 |
| SEQ. ID. NO. 30963 | 134-LeuThrLysSerProArgLysLeuThr-142 |
| SEQ. ID. NO. 30964 | 152-LeuSerAsnThrAlaSerGlu-158 |
| SEQ. ID. NO. 30965 | 175-LeuGlyArgHisProLeu-180 |
| SEQ. ID. NO. 30966 | 250-LysIleValGluProGlnLeuGlyProTyrGlnSerAspLeuSerGlnGluGluLysAspIleArgHisSerAsnGluIleThrProLeuGluTyrLys-282 |
| SEQ. ID. NO. 30967 | 304-ProAlaAspGlyIleLeuArgHisProGluThrGlyLeu-316 |
| SEQ. ID. NO. 30968 | 343-ArgIleThrArgSerLeuArgGlyGluArgGluValVal-355 |
| SEQ. ID. NO. 30969 | 402-ValGlyLeuGlyGly-406 |
| SEQ. ID. NO. 30970 | 482-LysTyrLysLysAspAlaGlyVal-489 |

Hydrophilic Regions - Hopp-Woods

| | |
|---|---|
| SEQ. ID. NO. 30971 | 8-LysGluLysGlnMetSerGlnThrAspAlaArgArgSerGlyArgPhe-23 |
| SEQ. ID. NO. 30972 | 63-ProAspProArgProValGlyAlaLysGlyArgAlaAspAspGlyLeu-78 |
| SEQ. ID. NO. 30973 | 85-LeuAspAlaAspGlyLeu-90 |
| SEQ. ID. NO. 30974 | 119-IleAlaGluLysSerGly-124 |
| SEQ. ID. NO. 30975 | 136-LysSerProArgLysLeu-141 |
| SEQ. ID. NO. 30976 | 263-LeuSerGlnGluGluLysAspIleArgHisSerAsnGlu-275 |
| SEQ. ID. NO. 30977 | 307-GlyIleLeuArgHisProGlu-313 |
| SEQ. ID. NO. 30978 | 344-IleThrArgSerLeuArgGlyGluArgGluValVal-355 |
| SEQ. ID. NO. 30979 | 482-LysTyrLysLysAspAlaGly-488 | g305
AMPHI Regions - AMPHI

| | |
|---|---|
| SEQ. ID. NO. 30980 | 10-LeuMetMetGlyLeuValGluGlyPheThrGluPheLeuPro-23 |
| SEQ. ID. NO. 30981 | 33-PheGlyAsnLeuIleGly-38 |
| SEQ. ID. NO. 30982 | 66-PheSerAsnValLeuHis-71 |
| SEQ. ID. NO. 30983 | 93-AlaAlaValMetGly-97 |
| SEQ. ID. NO. 30984 | 99-LeuPheAspLysGlnIleLysGluTyrLeuPhe-109 |
| SEQ. ID. NO. 30985 | 141-AspValAspAlaLeuArgProIleAspAla-150 |
| SEQ. ID. NO. 30986 | 155-ValAlaGlnValPheAla-160 |
| SEQ. ID. NO. 30987 | 202-AlaTyrAspValLeuLysHisTyrArgPhePheThrLeuHis-215 |
| SEQ. ID. NO. 30988 | 222-IleGlyPheIleAlaAlaPheValSer-230 |
| SEQ. ID. NO. 30989 | 235-ValLysAlaLeuLeuLys-240 |

Antigenic Index - Jameson-Wolf

| | |
|---|---|
| SEQ. ID. NO. 30990 | 41-SerAsnHisLysValPhe-46 |
| SEQ. ID. NO. 30991 | 61-GluTyrArgGlnArgPheSerAsn-68 |
| SEQ. ID. NO. 30992 | 72-GlyValGlyLysAspArgLysAlaAsn-80 |
| SEQ. ID. NO. 30993 | 128-ValGluLysArgGlnSerArgAlaGluProLysIleAlaAsp-141 |
| SEQ. ID. NO. 30994 | 143-AspAlaLeuArgProIleAsp-149 |
| SEQ. ID. NO. 30995 | 163-ProGlyThrSerArgSerArgGlySerThr-171 |
| SEQ. ID. NO. 30996 | 180-IleGluArgLysThrAlaThr-186 |
| SEQ. ID. NO. 30997 | 241-PheValSerLysLysAsnTyr-247 |

Hydrophilic Regions - Hopp-Woods

| | |
|---|---|
| SEQ. ID. NO. 30998 | 62-TyrArgGlnArgPhe-66 |
| SEQ. ID. NO. 30999 | 73-ValGlyLysAspArgLysAlaAsn-80 |
| SEQ. ID. NO. 31000 | 128-ValGluLysArgGlnSerArgAlaGluProLysIleAlaAsp-141 |
| SEQ. ID. NO. 31001 | 143-AspAlaLeuArgProIleAsp-149 |
| SEQ. ID. NO. 31002 | 165-ThrSerArgSerGlySer-170 |
| SEQ. ID. NO. 31003 | 180-IleGluArgLysThrAlaThr-186 |
| SEQ. ID. NO. 31004 | 242-ValSerLysLysAsn-246 | g308-1
AMPHI Regions - AMPHI

| | |
|---|---|
| SEQ. ID. NO. 31005 | 6-PheTyrArgIleLeuGlyValAlaAsp-14 |
| SEQ. ID. NO. 31006 | 27-ThrIleIleAlaGlyLeu-32 |
| SEQ. ID. NO. 31007 | 64-AlaLeuGluLeuLeuArgAlaGln-71 |
| SEQ. ID. NO. 31008 | 83-AlaGluMetAlaArgAlaSerGlu-90 |
| SEQ. ID. NO. 31009 | 101-LeuAlaAspPheValHisProIleGlyAsnIleGlyAlaCys-114 |
| SEQ. ID. NO. 31010 | 131-SerMetArgThrLeuAlaSerValAlaHisGlyPheGlyAsp-144 |
| SEQ. ID. NO. 31011 | 172-LeuAlaHisLeuAspAsnMetLysArgValThrGlu-183 |

Antigenic Index - Jameson-Wolf

| | |
|---|---|
| SEQ. ID. NO. 31012 | 39-TrpGluArgArgMetMetVal-45 |
| SEQ. ID. NO. 31013 | 68-LeuArgAlaGlnAspValGluThr-75 |
| SEQ. ID. NO. 31014 | 80-SerLysGlyAlaGluMetAlaArgAlaSerGluThrAspTyrThrLysAspGluVal-98 |
| SEQ. ID. NO. 31015 | 118-GlyThrPheLysThrAspGlyMet-125 |
| SEQ. ID. NO. 31016 | 141-GlyPheGlyAspAsnLeuLeu-147 |
| SEQ. ID. NO. 31017 | 149-ArgAlaAlaAspValValLeuLysGluArgArgArgLeu-161 |
| SEQ. ID. NO. 31018 | 166-ArgGluThrProLeu-170 |
| SEQ. ID. NO. 31019 | 176-AspAsnMetLysArgValThrGluMetGly-185 |
| SEQ. ID. NO. 31020 | 195-MetTyrArgLysProGlnThrAlaAspAspIleVal-206 |
| SEQ. ID. NO. 31021 | 220-AspThrProAspLeuAlaGlu-226 |

Hydrophilic Regions - Hopp-Woods

| | |
|---|---|
| SEQ. ID. NO. 31022 | 39-TrpGluArgArgMetMetVal-45 |
| SEQ. ID. NO. 31023 | 68-LeuArgAlaGlnAspValGluThr-75 |
| SEQ. ID. NO. 31024 | 81-LysGlyAlaGluMetAlaArgAlaSerGluThrAspTyrThrLysAspGluVal-98 |
| SEQ. ID. NO. 31025 | 120-PheLysThrAspGly-124 |
| SEQ. ID. NO. 31026 | 149-ArgAlaAlaAspValValLeuLysGluArgArgArgLeu-161 |
| SEQ. ID. NO. 31027 | 176-AspAsnMetLysArgValThrGlu-183 |
| SEQ. ID. NO. 31028 | 195-MetTyrArgLysProGlnThrAlaAspAspIleVal-206 | g311-1
AMPHI Regions - AMPHI

| | |
|---|---|
| SEQ. ID. NO. 31029 | 7-SerHisTrpArgValLeuAlaGluLeuAlaAspGlyLeuProGlnHisValSerGlnLeuAlaArg-28 |
| SEQ. ID. NO. 31030 | 37-LeuAsnGlyPheTrpGlnGlnMetProAlaHisIleArgGlyLeuLeuArg-53 |

TABLE 1-continued

| | |
|---|---|
| SEQ. ID. NO. 31031 | 55-HisAspGlyTyrTrpArgLeuValArgProLeuAlaValPheAspAlaGluGlyLeuArgAspLeuGly-77 |
| SEQ. ID. NO. 31032 | 124-ArgGlnGlyArgLysTrpSerHisArgLeu-133 |
| SEQ. ID. NO. 31033 | 155-LeuSerProValAlaAla-160 |
| SEQ. ID. NO. 31034 | 219-ValGluAsnAlaAlaSerValGlnSerLeuPheGln-230 |
| SEQ. ID. NO. 31035 | 245-GluThrLeuLeuAlaGluLeuGlyAlaValLeuGluGlnTyrAlaGluGlu-261 |
| SEQ. ID. NO. 31036 | 265-ProPheLeuAsnGlu-269 |
| SEQ. ID. NO. 31037 | 291-CysGluGlyThrVal-295 |
| SEQ. ID. NO. 31038 | 362-ThrValGlySerAlaProTyrArgAspLeuSerProLeu-374 |
| SEQ. ID. NO. 31039 | 426-TyrArgHisProGluHisGlySerAspArgTrpPheAsnAlaLeuGlySer-443 |
| SEQ. ID. NO. 31040 | 511-AlaValAlaSerGlyMetMetAspAlaValCysGly-522 |
| SEQ. ID. NO. 31041 | 550-AlaAlaLysValAlaGluAlaLeuProPro-559 |
| SEQ. ID. NO. 31042 | 576-HisGlyLeuLeuAsnLeu-581 |
| Antigenic Index - Jameson-Wolf | |
| SEQ. ID. NO. 31043 | 26-LeuAlaArgGluAlaAspMetLysProGlnGln-36 |
| SEQ. ID. NO. 31044 | 50-GlyLeuLeuArgGlnHisAspGlyTyr-58 |
| SEQ. ID. NO. 31045 | 71-GluGlyLeuArgAspLeuGlyGluArgSerGlyPheGlnThr-84 |
| SEQ. ID. NO. 31046 | 86-LeuLysHisGluCysAlaSerSerAsnAspGluIleLeuGlu-99 |
| SEQ. ID. NO. 31047 | 102-ArgIleAlaProAspLysAlaHisLys-110 |
| SEQ. ID. NO. 31048 | 116-HisLeuGlnSerLysGlyArgGlyArgGlnGlyArgLysTrpSerHisArgLeuGlyGlu-135 |
| SEQ. ID. NO. 31049 | 145-PheAspArgProGlnTyrGluLeuGlySer-154 |
| SEQ. ID. NO. 31050 | 162-AlaCysArgArgAlaLeuGly-168 |
| SEQ. ID. NO. 31051 | 174-ThrGlnIleLysTrpProAsn-180 |
| SEQ. ID. NO. 31052 | 182-LeuValValGlyArgAspLysLeuGly-190 |
| SEQ. ID. NO. 31053 | 196-ThrValArgAlaGlyGlyLysThrVal-204 |
| SEQ. ID. NO. 31054 | 215-LeuProLysGluValGluAsn-221 |
| SEQ. ID. NO. 31055 | 231-ThrAlaSerArgArgGlyAsnAlaAsp-239 |
| SEQ. ID. NO. 31056 | 257-GlnTyrAlaGluGluGlyPhe-263 |
| SEQ. ID. NO. 31057 | 269-GluTyrGluThrAlaAsnArgAspHisGlyLys-279 |
| SEQ. ID. NO. 31058 | 283-LeuLeuArgAspGlyGluThrValCysGluGlyThrValLysGlyValAspGlyArgGlyValLeu-304 |
| SEQ. ID. NO. 31059 | 307-GluThrAlaGluGlyGluGlnThrValValSerGlyGluIleSerLeuArgProAspAsnArgSerValSerValProLysArgProAspSerGluArgPheLeu-341 |
| SEQ. ID. NO. 31060 | 344-GluGlyGlyAsnSerArgLeuLys-351 |
| SEQ. ID. NO. 31061 | 364-GlySerAlaProTyrArgAspLeuSerProLeuGly-375 |
| SEQ. ID. NO. 31062 | 378-TrpAlaGluLysAlaAspGlyAsnValArgIle-388 |
| SEQ. ID. NO. 31063 | 394-CysGlyGluSerLysLysAlaGlnValLysGluGlnLeuAlaArgLysIleGlu-411 |
| SEQ. ID. NO. 31064 | 424-AsnHisTyrArgHisProGluGluHisGlySerAspArgTrp-437 |
| SEQ. ID. NO. 31065 | 440-AlaLeuGlySerArgArgPheSerArgAsnAla-450 |
| SEQ. ID. NO. 31066 | 464-AlaLeuThrAspAspGlyHisTyrLeuGly-473 |
| SEQ. ID. NO. 31067 | 483-MetLysGluSerLeuAla-488 |
| SEQ. ID. NO. 31068 | 492-AlaAsnLeuAsnArgProAlaGlyLysArgTyrPro-503 |
| SEQ. ID. NO. 31069 | 529-GlyArgLeuLysGluLysAsnGlyAlaGlyLysProVal-541 |
| SEQ. ID. NO. 31070 | 547-GlyGlyGlyAlaAlaLysValAlaGlu-555 |
| SEQ. ID. NO. 31071 | 565-AsnThrValArgValAlaAsp-571 |
| SEQ. ID. NO. 31072 | 584-AlaGluGlyGlyGluSerGluHisAla-592 |
| Hydrophilic Regions - Hopp-Woods | |
| SEQ. ID. NO. 31073 | 26-LeuAlaArgGluAlaAspMetLysProGlnGln-36 |
| SEQ. ID. NO. 31074 | 50-GlyLeuLeuArgGlnHis-55 |
| SEQ. ID. NO. 31075 | 71-GluGlyLeuArgAspLeuGlyGluArgSerGlyPhe-82 |
| SEQ. ID. NO. 31076 | 86-LeuLysHisGluCysAlaSerSerAsnAspGluIleLeuGlu-99 |
| SEQ. ID. NO. 31077 | 102-ArgIleAlaProAspLysAlaHisLys-110 |
| SEQ. ID. NO. 31078 | 118-GlnSerLysGlyArgGlyArgGlnGlyArgLysTrpSerHisArgLeuGlyGlu-135 |
| SEQ. ID. NO. 31079 | 162-AlaCysArgArgAlaLeu-167 |
| SEQ. ID. NO. 31080 | 183-ValValGlyArgAspLysLeuGly-190 |
| SEQ. ID. NO. 31081 | 196-ThrValArgAlaGlyGlyLys-202 |
| SEQ. ID. NO. 31082 | 217-LysGluValGluAsn-221 |
| SEQ. ID. NO. 31083 | 232-AlaSerArgArgGlyAsnAlaAsp-239 |
| SEQ. ID. NO. 31084 | 257-GlnTyrAlaGluGluGlyPhe-263 |
| SEQ. ID. NO. 31085 | 270-TyrGluThrAlaAsnArgAspHisGlyLys-279 |
| SEQ. ID. NO. 31086 | 285-ArgAspGlyGluThrValCys-291 |
| SEQ. ID. NO. 31087 | 293-GlyThrValLysGlyValAspGlyArgGly-302 |
| SEQ. ID. NO. 31088 | 307-GluThrAlaGluGlyGluGlnThrValVal-316 |
| SEQ. ID. NO. 31089 | 320-IleSerLeuArgProAspAsnArgSerValSerValProLysArgProAspSerGluArg-339 |
| SEQ. ID. NO. 31090 | 346-GlyAsnSerArgLeu-350 |
| SEQ. ID. NO. 31091 | 367-ProTyrArgAspLeuSer-372 |
| SEQ. ID. NO. 31092 | 378-TrpAlaGluLysAlaAspGlyAsnVal-386 |
| SEQ. ID. NO. 31093 | 395-GlyGluSerLysLysAlaGlnValLysGluGlnLeuAlaArgLysIleGlu-411 |
| SEQ. ID. NO. 31094 | 424-AsnHisTyrArgHisProGluGluHisGlySer-434 |
| SEQ. ID. NO. 31095 | 442-GlySerArgArgPheSerArg-448 |
| SEQ. ID. NO. 31096 | 464-AlaLeuThrAspAspGlyHis-470 |
| SEQ. ID. NO. 31097 | 483-MetLysGluSerLeuAla-488 |
| SEQ. ID. NO. 31098 | 493-AsnLeuAsnArgProAlaGlyLysArgTyrPro-503 |
| SEQ. ID. NO. 31099 | 529-GlyArgLeuLysGluLysAsnGlyAlaGlyLysProVal-541 |
| SEQ. ID. NO. 31100 | 549-GlyAlaAlaLysValAlaGlu-555 |
| SEQ. ID. NO. 31101 | 565-AsnThrValArgValAlaAsp-571 |
| SEQ. ID. NO. 31102 | 585-GluGlyGlyGluSerGluHisAla-592 |
| g312 | |
| AMPHI Regions - AMPHI | |
| SEQ. ID. NO. 31103 | 6-GlyGluIleLeuGluThrValLysMetValAlaAsp-17 |
| SEQ. ID. NO. 31104 | 44-GlnAsnIleTyrAsnLysIleThrThrValGlyLys-55 |
| SEQ. ID. NO. 31105 | 82-IleAlaGlnIleAlaAlaAlaThr-89 |

TABLE 1-continued

| | |
|---|---|
| SEQ. ID. NO. 31106 | 96-SerValAlaGlnThrLeuAspLysAlaAlaLys-106 |
| SEQ. ID. NO. 31107 | 109-GlyValSerPheIleGlyGlyPheSerAlaLeuValGln-121 |
| SEQ. ID. NO. 31108 | 133-ArgSerValProGluAlaMetLysThr-141 |
| SEQ. ID. NO. 31109 | 167-GlyGluThrIleLysArgThrAlaGluIle-176 |
| SEQ. ID. NO. 31110 | 182-GlyCysAlaLysIleValValPheCys-190 |
| SEQ. ID. NO. 31111 | 230-SerAspAlaValSerLeuThrGluValAlaGluValValLysLys-244 |
| SEQ. ID. NO. 31112 | 249-IleThrArgValGlyGluLeuIleGlyArgGluAlaSerLys-262 |
| SEQ. ID. NO. 31113 | 281-ValGlyAspSerValAlaArgIleLeuGluGluMetGly-293 |
| SEQ. ID. NO. 31114 | 309-LeuAsnAspAlaVal-313 |
| SEQ. ID. NO. 31115 | 322-SerAlaValGlyGlyLeuSerGly-329 |
| SEQ. ID. NO. 31116 | 349-LeuThrLeuAspLysLeuGluAlaMetThrAla-359 |
| SEQ. ID. NO. 31117 | 374-ThrProAlaHisThrIleSerGlyIleIle-383 |
| SEQ. ID. NO. 31118 | 409-ValGlyAspSerValGluPheGlyGlyLeuLeuGly-420 |
| Antigenic Index - Jameson-Wolf | |
| SEQ. ID. NO. 31119 | 4-GlnSerGlyGluIleLeuGlu-10 |
| SEQ. ID. NO. 31120 | 13-LysMetValAlaAspArgAsnPheAspVal-22 |
| SEQ. ID. NO. 31121 | 35-IleSerThrAspIleAspVal-41 |
| SEQ. ID. NO. 31122 | 52-ThrValGlyLysAspLeuValAla-59 |
| SEQ. ID. NO. 31123 | 64-LeuSerAlaLysTyr-68 |
| SEQ. ID. NO. 31124 | 89-ThrLysAlaAspSerTyrVal-95 |
| SEQ. ID. NO. 31125 | 100-ThrLeuAspLysAlaAlaLys-106 |
| SEQ. ID. NO. 31126 | 121-GlnLysGlyMetSerProSerAspGluValLeu-131 |
| SEQ. ID. NO. 31127 | 134-SerValProGluAlaMetLysThrThrAsp-143 |
| SEQ. ID. NO. 31128 | 152-GlySerThrArgAla-156 |
| SEQ. ID. NO. 31129 | 161-AspAlaValLysLeuAlaGlyGluThrIleLysArgThrAlaGluIleThrProGluGlyPheGly-182 |
| SEQ. ID. NO. 31130 | 192-AlaValGluAspAsnProPhe-198 |
| SEQ. ID. NO. 31131 | 204-HisGlySerGlyGluAlaAspAla-211 |
| SEQ. ID. NO. 31132 | 225-AlaAlaLeuGluAsnSerAspAla-232 |
| SEQ. ID. NO. 31133 | 237-GluValAlaGluValValLys-243 |
| SEQ. ID. NO. 31134 | 251-ArgValGlyGluLeuIleGlyArgGluAlaSerLys-262 |
| SEQ. ID. NO. 31135 | 280-AlaValGlyAspSerValAlaArgIleLeuGlu-290 |
| SEQ. ID. NO. 31136 | 311-AspAlaValLysLysGlyGlyMet-318 |
| SEQ. ID. NO. 31137 | 334-ValSerGluAspGluGlyMet-340 |
| SEQ. ID. NO. 31138 | 352-AspLysLeuGluAla-356 |
| SEQ. ID. NO. 31139 | 370-ValProGlyAspThrProAla-376 |
| SEQ. ID. NO. 31140 | 383-IleAlaAspGluAlaAla-388 |
| SEQ. ID. NO. 31141 | 392-IleAsnSerLysThrThrAla-398 |
| SEQ. ID. NO. 31142 | 405-ThrGlyLysThrValGlyAspSerValGlu-414 |
| SEQ. ID. NO. 31143 | 426-ProAlaLysGluGlySerCys-432 |
| SEQ. ID. NO. 31144 | 435-PheValAsnArgGlyGlyArgIle-442 |
| SEQ. ID. NO. 31145 | 447-GlnSerMetLysAsn-451 |
| Hydrophilic Regions - Hopp-Woods | |
| SEQ. ID. NO. 31146 | 13-LysMetValAlaAspArgAsnPheAspVal-22 |
| SEQ. ID. NO. 31147 | 35-IleSerThrAspIleAspVal-41 |
| SEQ. ID. NO. 31148 | 52-ThrValGlyLysAspLeuValAla-59 |
| SEQ. ID. NO. 31149 | 89-ThrLysAlaAspSer-93 |
| SEQ. ID. NO. 31150 | 100-ThrLeuAspLysAlaAlaLys-106 |
| SEQ. ID. NO. 31151 | 123-GlyMetSerProSerAspGluValLeu-131 |
| SEQ. ID. NO. 31152 | 134-SerValProGluAlaMetLysThrThrAsp-143 |
| SEQ. ID. NO. 31153 | 161-AspAlaValLysLeuAlaGlyGluThrIleLysArgThrAlaGluIleThrPro-178 |
| SEQ. ID. NO. 31154 | 192-AlaValGluAspAsnPro-197 |
| SEQ. ID. NO. 31155 | 207-GlyGluAlaAspAla-211 |
| SEQ. ID. NO. 31156 | 225-AlaAlaLeuGluAsnSerAspAla-232 |
| SEQ. ID. NO. 31157 | 237-GluValAlaGluValValLys-243 |
| SEQ. ID. NO. 31158 | 251-ArgValGlyGluLeuIleGlyArgGluAlaSerLys-262 |
| SEQ. ID. NO. 31159 | 284-SerValAlaArgIleLeuGlu-290 |
| SEQ. ID. NO. 31160 | 311-AspAlaValLysLysGlyGlyMet-318 |
| SEQ. ID. NO. 31161 | 334-ValSerGluAspGluGlyMet-340 |
| SEQ. ID. NO. 31162 | 352-AspLysLeuGluAla-356 |
| SEQ. ID. NO. 31163 | 383-IleAlaAspGluAlaAla-388 |
| SEQ. ID. NO. 31164 | 408-ThrValGlyAspSerValGlu-414 |
| SEQ. ID. NO. 31165 | 426-ProAlaLysGluGlySerCys-432 |
| SEQ. ID. NO. 31166 | 438-ArgGlyGlyArgIle-442 |
| SEQ. ID. NO. 31167 | 447-GlnSerMetLysAsn-451 |
| g313-2 | |
| AMPHI Regions - AMPHI | |
| SEQ. ID. NO. 31168 | 27-GlyMetAspAspProArgThrTyrGlySerGly-37 |
| SEQ. ID. NO. 31169 | 41-AlaThrAsnValLeu-45 |
| SEQ. ID. NO. 31170 | 60-AspAlaAlaLysGly-64 |
| SEQ. ID. NO. 31171 | 66-ValAlaValLeuLeuAlaArgValLeuGlnGluPro-77 |
| SEQ. ID. NO. 31172 | 88-ValAlaLeuAlaAlaLeuValGlyHisMetTrpPro-99 |
| SEQ. ID. NO. 31173 | 143-SerLeuAlaAlaLeuValAla-149 |
| Antigenic Index - Jameson-Wolf | |
| SEQ. ID. NO. 31174 | 26-TyrGlyMetAspAspProArgThrTyrGlySerGlyAsnProGlyAla-41 |
| SEQ. ID. NO. 31175 | 46-ArgSerGlyLysLysLysAlaAla-53 |
| SEQ. ID. NO. 31176 | 73-ValLeuGlnGluProLeuGlyLeuSerAspSerAla-84 |
| SEQ. ID. NO. 31177 | 104-PheLysGlyGlyLysGlyVal-110 |
| SEQ. ID. NO. 31178 | 180-ArgHisLysSerAsn-184 |
| SEQ. ID. NO. 31179 | 189-IleLysGlyLysGluSerLysIleGlyGluLysArg-200 |

TABLE 1-continued

Hydrophilic Regions - Hopp-Woods
SEQ. ID. NO. 31180   26-TyrGlyMetAspAspProArgThrTyrGly-35
SEQ. ID. NO. 31181   46-ArgSerGlyLysLysLysAlaAla-53
SEQ. ID. NO. 31182   105-LysGlyGlyLysGlyVal-110
SEQ. ID. NO. 31183   189-IleLysGlyLysGluSerLysIleGlyGluLysArg-200
g401
AMPHI Regions - AMPHI
SEQ. ID. NO. 31184   46-ValLysProTyrAsnAlaLeu-52
SEQ. ID. NO. 31185   65-CysTyrAsnCysHisSerGlnMetIleArgProPheArg-77
SEQ. ID. NO. 31186   112-ValGlyGlyArgTyrSerAspGluTrpHisArgIle-123
SEQ. ID. NO. 31187   157-MetLysAlaLeuArgLysValGlyThr-165
SEQ. ID. NO. 31188   172-IleAlaLysAlaProGluAlaLeu-179
Antigenic Index - Jameson-Wolf
SEQ. ID. NO. 31189   5-GlnLeuAlaGluGluLysIle-11
SEQ. ID. NO. 31190   38-AlaAlaThrGlnProAlaProGlyValLysProTyrAsn-50
SEQ. ID. NO. 31191   55-AlaGlyArgAspIleTyrIleArgGluGlyCysTyrAsnCysHis-69
SEQ. ID. NO. 31192   74-ArgProPheArgAlaGluThrGluArgTyrGlyHis-85
SEQ. ID. NO. 31193   90-GlyGluSerValTyr-94
SEQ. ID. NO. 31194   98-PheGlnTrpGlySerLysArgThrGlyProAspLeuAlaArgValGlyGlyArgTyrSerAspGluTrpHis-121
SEQ. ID. NO. 31195   125-LeuLeuAsnProArgAspValValProGluSerAsnMetPro-138
SEQ. ID. NO. 31196   146-AsnLysValAspValAspAla-152
SEQ. ID. NO. 31197   158-LysAlaLeuArgLysValGlyThrProTyrSerAspGluGluIleAlaLysAlaProGlu-177
SEQ. ID. NO. 31198   179-LeuAlaAsnLysSerGluLeuAspAla-187
Hydrophilic Regions - Hopp-Woods
SEQ. ID. NO. 31199   5-GlnLeuAlaGluGluLysIle-11
SEQ. ID. NO. 31200   76-PheArgAlaGluThrGluArgTyrGly-84
SEQ. ID. NO. 31201   101-GlySerLysArgThrGlyProAspLeuAlaArgValGlyGlyArgTyrSerAspGluTrpHis-121
SEQ. ID. NO. 31202   127-AsnProArgAspValValPro-133
SEQ. ID. NO. 31203   146-AsnLysValAspValAspAla-152
SEQ. ID. NO. 31204   158-LysAlaLeuArgLysValGly-164
SEQ. ID. NO. 31205   167-TyrSerAspGluGluIleAlaLysAlaProGlu-177
SEQ. ID. NO. 31206   179-LeuAlaAsnLysSerGluLeuAspAla-187
g402
AMPHI Regions - AMPHI
SEQ. ID. NO. 31207   13-IleAsnMetLeuSerPheLeuThrGly-21
SEQ. ID. NO. 31208   44-GlnAlaPheSerPheIle-49
SEQ. ID. NO. 31209   85-AlaGlyIleAlaAspPhe-90
SEQ. ID. NO. 31210   100-ThrGlyPheSerGlyPheValHis-107
SEQ. ID. NO. 31211   117-AlaValValArgGlyLeu-122
SEQ. ID. NO. 31212   136-LysSerGlyArgGln-140
SEQ. ID. NO. 31213   146-PheAlaAsnValAlaGly-151
SEQ. ID. NO. 31214   218-ValPheGlnAsnIleAlaGlyArgProAsp-227
SEQ. ID. NO. 31215   261-AspIlePheAsnSerValAsnGlyIleGlu-270
SEQ. ID. NO. 31216   279-LysSerGlyIleArg-283
SEQ. ID. NO. 31217   294-SerTrpAlaArgValLeuSerAlaIleProGluMetGln-306
SEQ. ID. NO. 31218   344-ArgLysTrpLeuArgArgHisPro-351
SEQ. ID. NO. 31219   376-AlaGluPheLeuLysGlnValGlnSerHisLeu-386
SEQ. ID. NO. 31220   398-HisSerProHisAlaPheAlaThrAlaValHisSerIlePro-411
SEQ. ID. NO. 31221   437-GlnArgLeuSerArgLeu-442
SEQ. ID. NO. 31222   460-AlaAlaGlnLysVal-464
SEQ. ID. NO. 31223   466-SerArgMetLeuIleArgMet-472
Antigenic Index - Jameson-Wolf
SEQ. ID. NO. 31224   4-ValAsnThrLysProAsnThrSer-11
SEQ. ID. NO. 31225   66-ArgIleCysArgSerArgPheValAsp-74
SEQ. ID. NO. 31226   130-ValGlyThrAspGlyAsnLysSerGlyArgGlnValSer-142
SEQ. ID. NO. 31227   223-AlaGlyArgProAspArgLeuIleGluAsnLysHisGly-235
SEQ. ID. NO. 31228   240-TyrHisArgAspGlyAspLysValVal-248
SEQ. ID. NO. 31229   264-AsnSerValAsnGlyIleGluArg-271
SEQ. ID. NO. 31230   277-SerLeuLysSerGlyIleArgArg-284
SEQ. ID. NO. 31231   321-IleAlaAspGluProGln-326
SEQ. ID. NO. 31232   331-LeuGlnAspLysArgValGluIleValLeuAspAspGlyArgLysTrpLeuArgArgHisProAspGluLysPheAsp-356
SEQ. ID. NO. 31233   385-HisLeuThrProAspGly-390
SEQ. ID. NO. 31234   429-PheProAsnLysGluLeuLeuLysGlnArgLeuSer-440
SEQ. ID. NO. 31235   444-TrpProGluSerGlyArgHisValPheAspSerSerThrVal-457
SEQ. ID. NO. 31236   472-MetThrGluProSerAlaGly-478
SEQ. ID. NO. 31237   481-ValIleThrAspAspAsnMet-487
SEQ. ID. NO. 31238   489-ValGluTyrLysTyrGlyArgGlyIle-497
Hydrophilic Regions - Hopp-Woods
SEQ. ID. NO. 31239   4-ValAsnThrLysProAsn-9
SEQ. ID. NO. 31240   131-GlyThrAspGlyAsnLysSerGlyArgGlnVal-141
SEQ. ID. NO. 31241   223-AlaGlyArgProAspArgLeuIleGluAsnLysHis-234
SEQ. ID. NO. 31242   241-HisArgAspGlyAspLysValVal-248
SEQ. ID. NO. 31243   278-LeuLysSerGlyIleArg-283
SEQ. ID. NO. 31244   321-IleAlaAspGluProGln-326
SEQ. ID. NO. 31245   331-LeuGlnAspLysArgValGluIleValLeuAspAspGlyArgLysTrpLeuArgArgHisProAspGluLysPheAsp-356
SEQ. ID. NO. 31246   430-ProAsnLysGluLeuLeuLysGlnArgLeuSer-440
SEQ. ID. NO. 31247   446-GluSerGlyArgHisValPhe-452
SEQ. ID. NO. 31248   472-MetThrGluProSerAlaGly-478
SEQ. ID. NO. 31249   481-ValIleThrAspAspAsnMet-487
g501

TABLE 1-continued

AMPHI Regions - AMPHI
SEQ. ID. NO. 31250  63-ValGluValLeuGlnGluLeuPheArgGlnTyrArgValAlaArgGlnLeu-79
SEQ. ID. NO. 31251  88-ValPheAlaAlaPheGlnAlaValPhePheGlnCysLeuAsnHisCysPheGly-105
SEQ. ID. NO. 31252  127-AsnAlaPheGlnGly-131
SEQ. ID. NO. 31253  139-ValPheGluAlaLeuGlyAsnIleThrArgArgThrThrGluAla-153
SEQ. ID. NO. 31254  183-AspGlyPheThrArgIleAsnArgCysGlyLysArgCysHisAlaPheGlyAspPheIleAsp-203
SEQ. ID. NO. 31255  253-AlaPheAlaGlyGlnIle-258
SEQ. ID. NO. 31256  307-TyrGlyAsnPheLeuThrValPheGlnGluPheGlyArgIleAlaAlaAlaAsp-324
SEQ. ID. NO. 31257  365-GlyAsnGlnTyrValAlaGlyPhe-372
SEQ. ID. NO. 31258  492-GlyGluAsnHisPheAspValPheArgThr-501
SEQ. ID. NO. 31259  513-PheGluArgGlyPheGluHisIleLysPheValArgValAspArgAlaLeuTyrAspValPheAlaGlnThr-536
Antigenic Index - Jameson-Wolf
SEQ. ID. NO. 31260  6-LeuThrAlaAspThrAspIle-12
SEQ. ID. NO. 31261  19-GlyGlyAspGlyLysMetGlnHisHisPheAspGly-30
SEQ. ID. NO. 31262  46-ValGluAlaGluGlyGln-51
SEQ. ID. NO. 31263  56-ValArgAlaAspGlyGluAlaValGluVal-65
SEQ. ID. NO. 31264  108-GlnSerAlaAspGluArgAsnHisAspPheAspValGlyGln-121
SEQ. ID. NO. 31265  145-AsnIleThrArgArgThrThrGluAlaGlnHis-155
SEQ. ID. NO. 31266  179-GlyHisThrAspAspGlyPheThrArgIleAsnArgCysGlyLysArgCysHisAla-197
SEQ. ID. NO. 31267  202-IleAspValGluValAspArgGlyCysValThrGlyAspAlaAlaAspAsnPhe-219
SEQ. ID. NO. 31268  231-GlnGlnGlyPheArgValAspAlaAspLeuAlaValAspAspLysPheHisThrArgGlnAlaAsp-252
SEQ. ID. NO. 31269  258-IleGlyGluAlaGluCysGluPheGly-266
SEQ. ID. NO. 31270  270-ValHisHisAspPheAspGlyCys-277
SEQ. ID. NO. 31271  283-GlnGlyAspIleGly-287
SEQ. ID. NO. 31272  295-GlyIleAspLysAlaGly-300
SEQ. ID. NO. 31273  321-AlaAlaAlaAspAspGlyArgAsnThrGlnPheAlaArgAspAspGlyGlyValAla-339
SEQ. ID. NO. 31274  345-ValGlyHisAspGlyGlySerThr-352
SEQ. ID. NO. 31275  392-LeuThrAspGlyThr-396
SEQ. ID. NO. 31276  398-PheAlaGlnAspGly-402
SEQ. ID. NO. 31277  421-PheAspGlyPheGly-425
SEQ. ID. NO. 31278  442-PheAspIleHisArg-446
SEQ. ID. NO. 31279  453-AspGlyGlnArgVal-457
SEQ. ID. NO. 31280  479-PheAspValGlyTyr-483
SEQ. ID. NO. 31281  502-HisGlyLeuAlaGlnAspGlyGly-509
SEQ. ID. NO. 31282  523-ValArgValAspArgAlaLeu-529
SEQ. ID. NO. 31283  536-ThrValArgGlyGlyAsnLysAspAspLeuVal-546
SEQ. ID. NO. 31284  552-ValGluGlyGluHisHisThr-558
Hydrophilic Regions - Hopp-Woods
SEQ. ID. NO. 31285  6-LeuThrAlaAspThr-10
SEQ. ID. NO. 31286  19-GlyGlyAspGlyLysMet-24
SEQ. ID. NO. 31287  46-ValGluAlaGluGlyGln-51
SEQ. ID. NO. 31288  56-ValArgAlaAspGlyGluAlaValGluVal-65
SEQ. ID. NO. 31289  108-GlnSerAlaAspGluArgAsnHisAspPheAspVal-119
SEQ. ID. NO. 31290  146-IleThrArgArgThrThrGluAlaGlnHis-155
SEQ. ID. NO. 31291  179-GlyHisThrAspAspGlyPheThrArgIleAsnArgCysGlyLysArgCysHisAla-197
SEQ. ID. NO. 31292  202-IleAspValGluValAspArgGlyCysVal-211
SEQ. ID. NO. 31293  214-AspAlaAlaAspAsnPhe-219
SEQ. ID. NO. 31294  234-PheArgValAspAlaAspLeuAlaValAspAspLysPheHisThrArgGlnAlaAsp-252
SEQ. ID. NO. 31295  258-IleGlyGluAlaGluCysGluPheGly-266
SEQ. ID. NO. 31296  270-ValHisHisAspPhe-274
SEQ. ID. NO. 31297  295-GlyIleAspLysAlaGly-300
SEQ. ID. NO. 31298  321-AlaAlaAlaAspAspGlyArgAsnThrGlnPheAlaArgAspAspGlyGlyVal-338
SEQ. ID. NO. 31299  345-ValGlyHisAspGly-349
SEQ. ID. NO. 31300  523-ValArgValAspArgAlaLeu-529
SEQ. ID. NO. 31301  537-ValArgGlyGlyAsnLysAspAspLeuVal-546
SEQ. ID. NO. 31302  552-ValGluGlyGluHisHisThr-558
g502-1
AMPHI Regions - AMPHI
SEQ. ID. NO. 31303  6-AsnLeuPheGlnPheLeuAlaValCys-14
SEQ. ID. NO. 31304  26-GlyAlaValAspAlaLeuLysGlnPheAsnAsnAspAlaAspGlyIleSerGlySerPheThrGln-47
SEQ. ID. NO. 31305  98-GlnValThrLysSerSerGlnAsp-105
SEQ. ID. NO. 31306  136-GlyIleAspTyrVal-140
Antigenic Index - Jameson-Wolf
SEQ. ID. NO. 31307  32-LysGlnPheAsnAsnAspAlaAspGlyIleSerGlySer-44
SEQ. ID. NO. 31308  48-ThrValGlnSerLysLysLysThrGlnThrAlaHisGlyThr-61
SEQ. ID. NO. 31309  98-GlnValThrLysSerSerGlnAspGlnAlaIleGlyGlySerPro-112
SEQ. ID. NO. 31310  116-LeuSerAsnLysThrAlaLeuGluSerSerTyrThrLeuLysGluAspGlySerSerAsnGly-136
SEQ. ID. NO. 31311  141-ArgAlaThrProLysArgAsnAsnAlaGly-150
SEQ. ID. NO. 31312  158-PheLysGlyGlyAsn-162
SEQ. ID. NO. 31313  167-GlnLeuLysAspSerPheGlyAsnGlnThr-176
SEQ. ID. NO. 31314  184-AsnThrAsnProGlnLeuSerArgGlyAlaPhe-194
SEQ. ID. NO. 31315  196-PheThrProProLysGlyValAspVal-204
Hydrophilic Regions - Hopp-Woods
SEQ. ID. NO. 31316  34-PheAsnAsnAspAlaAspGlyIle-41
SEQ. ID. NO. 31317  49-ValGlnSerLysLysLysThrGlnThr-57
SEQ. ID. NO. 31318  100-ThrLysSerSerGlnAspGlnAlaIle-108
SEQ. ID. NO. 31319  126-TyrThrLeuLysGluAspGlySerSerAsn-135
SEQ. ID. NO. 31320  141-ArgAlaThrProLysArgAsnAsnAla-149
SEQ. ID. NO. 31321  167-GlnLeuLysAspSerPheGly-173
g503-1

TABLE 1-continued

```
AMPHI Regions - AMPHI
SEQ. ID. NO. 31322    6-TyrArgGluAlaLys-10
SEQ. ID. NO. 31323    95-ThrSerSerThrSerAsnPheAlaArgAlaAlaGluMetArgSerPhe-110
Antigenic Index - Jameson-Wolf
SEQ. ID. NO. 31324    4-SerLeuTyrArgGluAlaLysThr-11
SEQ. ID. NO. 31325    32-ProAlaAsnAspAlaSerGlyArgSerSerAlaValAlaGluGluArgThrAlaThrGluMetSerAlaProSer-56
SEQ. ID. NO. 31326    69-SerAlaSerSerCysSerGlyLysGlyValSer-79
SEQ. ID. NO. 31327    87-LeuProThrArgAlaSerSerGluThrSerSerThrSerAsnPhe-101
SEQ. ID. NO. 31328    103-ArgAlaAlaGluMetArgSerPheArgProLeuCysAlaArgAsnAlaArg-119
Hydrophilic Regions - Hopp-Woods
SEQ. ID. NO. 31329    4-SerLeuTyrArgGluAlaLysThr-11
SEQ. ID. NO. 31330    35-AspAlaSerGlyArgSerSerAlaValAlaGluGluArgThrAlaThrGluMetSerAla-54
SEQ. ID. NO. 31331    73-CysSerGlyLysGlyValSer-79
SEQ. ID. NO. 31332    89-ThrArgAlaSerSerGluThrSerSer-97
SEQ. ID. NO. 31333    103-ArgAlaAlaGluMetArgSerPheArg-111
g505
AMPHI Regions - AMPHI
SEQ. ID. NO. 31334    20-LeuThrAlaLeuLeuLysCysLeuSerLeuLeuSerLeuSerCysLeu-35
SEQ. ID. NO. 31335    37-ThrLeuGlyAsnArg-41
SEQ. ID. NO. 31336    89-ProAlaPhePheLysLysProGluAspIleGluThrMetPheLysAlaValHisGlyTrpGluHisValGlnGlnAlaLeuAsp-116
SEQ. ID. NO. 31337    148-AlaMetTyrLysProProLysIleLysAlaIleAspLysIleMetGlnAlaGly-165
SEQ. ID. NO. 31338    178-IleGlnGlyValLysGlnIleIleLysAlaLeuArg-189
SEQ. ID. NO. 31339    209-GlyValTrpAlaAspPhePheGlyLysPro-218
Antigenic Index - Jameson-Wolf
SEQ. ID. NO. 31340    39-GlyAsnArgLeuGly-43
SEQ. ID. NO. 31341    50-LeuLysGluAspArgAlaArgIle-57
SEQ. ID. NO. 31342    64-AlaGlyLeuAsnProAspThrGlnThrVal-73
SEQ. ID. NO. 31343    79-GluThrAlaLysCysGlyLeu-85
SEQ. ID. NO. 31344    92-PheLysLysProGluAspIleGluThr-100
SEQ. ID. NO. 31345    114-AlaLeuAspLysGlyGluGlyLeu-121
SEQ. ID. NO. 31346    131-TyrAspLeuGlyGlyArgTyrIleSer-139
SEQ. ID. NO. 31347    151-LysProProLysIleLysAlaIleAspLysIleMetGln-163
SEQ. ID. NO. 31348    165-GlyArgValArgGlyLysGlyLysThrAlaProThrGly-177
SEQ. ID. NO. 31349    179-GlnGlyValLysGlnIleIleLys-186
SEQ. ID. NO. 31350    188-LeuArgAlaGlyGlu-192
SEQ. ID. NO. 31351    199-AspHisValProSerProGlnGluGlyGlyGlyVal-210
SEQ. ID. NO. 31352    241-CysGluArgLeuProAspGlyGlnGly-249
SEQ. ID. NO. 31353    257-ValGlnGlyGluLeuAsnGlyAsnLysAlaHisAsp-268
SEQ. ID. NO. 31354    273-AsnArgAsnThrGluTyrTrp-279
SEQ. ID. NO. 31355    292-AsnArgTyrLysThrPro-297
Hydrophilic Regions - Hopp-Woods
SEQ. ID. NO. 31356    50-LeuLysGluAspArgAlaArgIle-57
SEQ. ID. NO. 31357    65-GlyLeuAsnProAspThrGlnThr-72
SEQ. ID. NO. 31358    79-GluThrAlaLysCysGlyLeu-85
SEQ. ID. NO. 31359    92-PheLysLysProGluAspIleGluThr-100
SEQ. ID. NO. 31360    114-AlaLeuAspLysGlyGlyGlu-119
SEQ. ID. NO. 31361    151-LysProProLysIleLysAlaIleAspLysIleMetGln-163
SEQ. ID. NO. 31362    165-GlyArgValArgGlyLysGlyLysThrAla-174
SEQ. ID. NO. 31363    188-LeuArgAlaGlyGlu-192
SEQ. ID. NO. 31364    201-ValProSerProGlnGluGly-207
SEQ. ID. NO. 31365    257-ValGlnGlyGluLeuAsnGlyAsnLysAlaHisAsp-268
g506
AMPHI Regions - AMPHI
SEQ. ID. NO. 31366    6-GluValGlyArgIleAlaHisGlyCysGlyValVal-18
SEQ. ID. NO. 31367    25-ArgValValHisGlnValGluGlnGlyAlaArgLeuAla-37
SEQ. ID. NO. 31368    56-PheGlnArgArgPhe-60
SEQ. ID. NO. 31369    99-AlaThrArgThrIleAspGlyAsp-106
SEQ. ID. NO. 31370    123-GluGlnThrGlyLeuGln-128
SEQ. ID. NO. 31371    138-GlyAsnGluValAlaArgCys-144
SEQ. ID. NO. 31372    180-GlnValLysArgMetIleArgHisPhe-188
SEQ. ID. NO. 31373    199-ValHisArgProPheArgGluLeuAlaAlaLeuAspGlyPheValGlnVal-215
SEQ. ID. NO. 31374    224-GlyAspAspPheCysSerPhePheValGlyGlnValPheAsnProLeuLeu-240
SEQ. ID. NO. 31375    249-LysThrPheAlaArgPheValPro-256
SEQ. ID. NO. 31376    283-AsnLeuValGlnGlyPhe-288
SEQ. ID. NO. 31377    313-PheValGlnValGlyGluPheAlaArgValAlaGlnGluGlu-326
SEQ. ID. NO. 31378    372-GlyPhePheAlaAspPheAlaGluAsnPheGlyAlaGlyVal-385
SEQ. ID. NO. 31379    408-PheGlyAspAspPheAlaHisGluValGlyGlu-418
SEQ. ID. NO. 31380    465-CysSerPheSerGlnValGlyGlnMetGly-474
Antigenic Index - Jameson-Wolf
SEQ. ID. NO. 31381    12-HisGlyCysGlyGly-16
SEQ. ID. NO. 31382    31-GluGlnGlyAlaArgLeuAla-37
SEQ. ID. NO. 31383    54-ValAspPheGlnArgArgPheGlyGluVal-63
SEQ. ID. NO. 31384    98-ArgAlaThrArgThrIleAspGlyAspLeuAlaGlu-109
SEQ. ID. NO. 31385    131-IleArgAlaArgAlaAspThrGlyAsnGluValAlaArgCysGluGly-146
SEQ. ID. NO. 31386    176-ProAsnPheGlyGlnValLysArgMetIle-185
SEQ. ID. NO. 31387    195-HisAspLeuAspValHisArgProPheArgGlu-205
SEQ. ID. NO. 31388    224-GlyAspAspPheCysSer-229
SEQ. ID. NO. 31389    244-MetGluPheHisProLysThrPhe-251
SEQ. ID. NO. 31390    259-ValGlyMetArgThrGluAla-265
SEQ. ID. NO. 31391    279-HisHisAspGlyAsnLeu-284
```

TABLE 1-continued

| SEQ. ID. NO. 31392 | 288-PheGlyGlnGlnArgProGluValProVal-297 |
| SEQ. ID. NO. 31393 | 320-AlaArgValAlaGlnGluGluHisGlyArgValValAla-332 |
| SEQ. ID. NO. 31394 | 344-PheGlnArgLysThrAlaAspVal-351 |
| SEQ. ID. NO. 31395 | 362-CysHisGlyGlyGluThrGlyGlu-369 |
| SEQ. ID. NO. 31396 | 391-CysTyrGlyLysArgThrGluArgAlaArgThr-401 |
| SEQ. ID. NO. 31397 | 408-PheGlyAspAspPheAlaHisGluVal-416 |
| SEQ. ID. NO. 31398 | 428-GlnGlnGlyAlaAlaArgAlaGlyGlyGln-437 |
| SEQ. ID. NO. 31399 | 459-GlyGlySerHisArgSerCysSer-466 |
| SEQ. ID. NO. 31400 | 471-GlyGlnMetGlyGlyLysArgLeuThrValArgPheGlyGlyLysArgIleArgAsnArgPheLeuAspCysAsnLysPheLeuGlu-499 |
| SEQ. ID. NO. 31401 | 508-LysThrMetAspAlaIleIle-514 |
| SEQ. ID. NO. 31402 | 516-GlnAspPheArgTyr-520 |

Hydrophilic Regions - Hopp-Woods

| SEQ. ID. NO. 31403 | 31-GluGlnGlyAlaArgLeuAla-37 |
| SEQ. ID. NO. 31404 | 54-ValAspPheGlnArgArgPheGlyGlu-62 |
| SEQ. ID. NO. 31405 | 98-ArgAlaThrArgThrIleAspGlyAspLeuAlaGlu-109 |
| SEQ. ID. NO. 31406 | 131-IleArgAlaArgAlaAspThrGlyAsnGluValAlaArgCysGluGly-146 |
| SEQ. ID. NO. 31407 | 180-GlnValLysArgMetIle-185 |
| SEQ. ID. NO. 31408 | 195-HisAspLeuAspVal-199 |
| SEQ. ID. NO. 31409 | 201-ArgProPheArgGlu-205 |
| SEQ. ID. NO. 31410 | 244-MetGluPheHisPro-248 |
| SEQ. ID. NO. 31411 | 259-ValGlyMetArgThrGluAla-265 |
| SEQ. ID. NO. 31412 | 289-GlyGlnGlnArgProGluVal-295 |
| SEQ. ID. NO. 31413 | 320-AlaArgValAlaGlnGluGluHisGlyArgValValAla-332 |
| SEQ. ID. NO. 31414 | 344-PheGlnArgLysThrAlaAspVal-351 |
| SEQ. ID. NO. 31415 | 364-GlyGlyGluThrGlyGlu-369 |
| SEQ. ID. NO. 31416 | 393-GlyLysArgThrGluArgAlaArgThr-401 |
| SEQ. ID. NO. 31417 | 412-PheAlaHisGluVal-416 |
| SEQ. ID. NO. 31418 | 429-GlnGlyAlaAlaArgAlaGlyGly-436 |
| SEQ. ID. NO. 31419 | 473-MetGlyGlyLysArgLeuThr-479 |
| SEQ. ID. NO. 31420 | 482-PheGlyGlyLysArgIleArgAsnArgPheLeuAsp-493 |
| SEQ. ID. NO. 31421 | 508-LysThrMetAspAlaIleIle-514 |
| SEQ. ID. NO. 31422 | 516-GlnAspPheArgTyr-520 | g513-2
AMPHI Regions - AMPHI

| SEQ. ID. NO. 31423 | 6-ThrGluTrpLeuHisGlyTrpValGlyAlaIleAsnAspProMetTrp-21 |
| SEQ. ID. NO. 31424 | 48-GlyArgSerIleLysGlu-53 |
| SEQ. ID. NO. 31425 | 66-GlyIleThrProPheGlnAlaPheValThrGlyLeuAla-78 |
| SEQ. ID. NO. 31426 | 119-SerSerLeuAlaGlnLeuPheLysValArgAsp-129 |
| SEQ. ID. NO. 31427 | 146-GlyLeuGlyGlnLysTrpLeuGlyVal-154 |
| SEQ. ID. NO. 31428 | 176-IleAlaAspThrVal-180 |
| SEQ. ID. NO. 31429 | 205-GlyGlyIleArgArgIleSerLysAlaAla-214 |
| SEQ. ID. NO. 31430 | 243-ValPheGlyGlnIlePheSer-249 |
| SEQ. ID. NO. 31431 | 259-GlyGlyLeuLeuGlyGlyLeuIle-266 |
| SEQ. ID. NO. 31432 | 288-AlaProAsnAlaAlaAlaAlaAla-295 |
| SEQ. ID. NO. 31433 | 303-GlnGlyMetIleGlnMetLeuGlyValPheValAsp-314 |
| SEQ. ID. NO. 31434 | 332-ProTyrGlyAspLeu-336 |
| SEQ. ID. NO. 31435 | 347-ValSerGlnValGlyGlnTrp-353 |
| SEQ. ID. NO. 31436 | 391-ThrAlaValPheArgMet-396 |
| SEQ. ID. NO. 31437 | 403-TyrPheGlyAlaValAla-408 |
| SEQ. ID. NO. 31438 | 423-IleMetAlaTrpIleAsnLeuValAlaIleLeuLeuLeuSer-436 |

Antigenic Index - Jameson-Wolf

| SEQ. ID. NO. 31439 | 1-MetAsnGluAsnPhe-5 |
| SEQ. ID. NO. 31440 | 48-GlyArgSerIleLysGluMetLeuGlyGlyArgLysGlnGlyAspAspProHisGly-66 |
| SEQ. ID. NO. 31441 | 126-LysValArgAspCysAspAsnHisHisPheArgGlyGlyProAla-140 |
| SEQ. ID. NO. 31442 | 208-ArgArgIleSerLysAlaAlaGlu-215 |
| SEQ. ID. NO. 31443 | 273-GlyIleLysArgGlyLeuTyrSerAsnGluAlaGlyMetGlySerAlaProAsnAla-291 |
| SEQ. ID. NO. 31444 | 295-AlaGluValLysHisProValSer-302 |
| SEQ. ID. NO. 31445 | 331-GlnProTyrGlyAspLeuSerGly-338 |
| SEQ. ID. NO. 31446 | 375-AlaTyrAlaGluSerAsnVal-381 |
| SEQ. ID. NO. 31447 | 444-ArgAspTyrThrAlaLysLeuLysMetGlyLysAspProGluPheLysLeuSerGluHisProGlyLeuLysArgArgIleLysSerAspValTrp-475 |

Hydrophilic Regions - Hopp-Woods

| SEQ. ID. NO. 31448 | 48-GlyArgSerIleLysGluMetLeuGlyGlyArgLysGlnGlyAspAspProHisGly-66 |
| SEQ. ID. NO. 31449 | 126-LysValArgAspCysAspAsnHisHis-134 |
| SEQ. ID. NO. 31450 | 208-ArgArgIleSerLysAlaAlaGlu-215 |
| SEQ. ID. NO. 31451 | 273-GlyIleLysArgGlyLeuTyr-279 |
| SEQ. ID. NO. 31452 | 295-AlaGluValLysHisProVal-301 |
| SEQ. ID. NO. 31453 | 450-LeuLysMetGlyLysAspProGluPheLysLeuSerGlu-462 |
| SEQ. ID. NO. 31454 | 464-ProGlyLeuLysArgArgIleLysSer-472 | g515-1
AMPHI Regions - AMPHI

| SEQ. ID. NO. 31455 | 8-ArgAlaAlaGlyValAlaArgGlyLeuHisSerGluPheAlaArg-22 |
| SEQ. ID. NO. 31456 | 59-AspValArgPhePheAlaGlnValGluGluIleGlyGlnAspPhePheAlaAspAla-77 |
| SEQ. ID. NO. 31457 | 90-AlaGlyGluCysAlaAspGluValSerAspGlnPro-101 |
| SEQ. ID. NO. 31458 | 122-GluSerAlaGlnSerAlaAlaGlyGlyGlyLeuThrAspGlyPheGly-137 |
| SEQ. ID. NO. 31459 | 176-CysGlyLysThrValGlyVal-182 |
| SEQ. ID. NO. 31460 | 192-LeuHisArgArgAla-196 |
| SEQ. ID. NO. 31461 | 233-ValAlaAspValLeuArg-238 |
| SEQ. ID. NO. 31462 | 251-PheGlyGlyValAlaGlyAspValGlyGlyGlyAlaAspGlyValAlaGlnGlyLeuPheGlyGluVal-273 |
| SEQ. ID. NO. 31463 | 306-HisAlaAspAlaLeuSerGluArgPheAla-315 |
| SEQ. ID. NO. 31464 | 334-AlaAlaGluValGluGluPheGlySerGlyValValGluGln-347 |

TABLE 1-continued

Antigenic Index - Jameson-Wolf
SEQ. ID. NO. 31465  24-ValThrAlaGluGluIleAlaPhe-31
SEQ. ID. NO. 31466  38-HisGluAlaArgArgGlyGlyAsnThrPhe-47
SEQ. ID. NO. 31467  51-IleAlaAlaAlaGluArgAlaGlyAsp-59
SEQ. ID. NO. 31468  67-GluGluIleGlyGln-71
SEQ. ID. NO. 31469  77-AlaValAspGlnGluThr-82
SEQ. ID. NO. 31470  84-LeuAlaValGluArgAlaAlaGlyGluCysAlaAspGluValSerAspGlnProAlaArgAsnGlyGlyIleGluGluAspGlyValAlaAlaCys
ArgAspAlaAlaAlaAlaGluSerAlaGln-125
SEQ. ID. NO. 31471  128-AlaGlyGlyGlyLeuThrAspGly-135
SEQ. ID. NO. 31472  160-GlyGlyAsnAspAlaAlaGlyAsn-167
SEQ. ID. NO. 31473  192-LeuHisArgArgAla-196
SEQ. ID. NO. 31474  217-AlaAspGlyGlyPheArg-222
SEQ. ID. NO. 31475  242-GlyValGlyLysSerGlyAla-248
SEQ. ID. NO. 31476  257-AspValGlyGlyGlyAlaAspGlyVal-265
SEQ. ID. NO. 31477  284-AspValAsnGlyAsnValGln-290
SEQ. ID. NO. 31478  309-AlaLeuSerGluArgPheAla-315
SEQ. ID. NO. 31479  318-GlyPheGlyGlyGlyArgAlaArgCys-326
SEQ. ID. NO. 31480  328-CysGlnValGluArgAlaAlaAlaGluValGluGluPheGlySerGlyVal-344
SEQ. ID. NO. 31481  347-GlnHisAsnAsnLeu-351
Hydrophilic Regions - Hopp-Woods
SEQ. ID. NO. 31482  24-ValThrAlaGluGluIleAlaPhe-31
SEQ. ID. NO. 31483  38-HisGluAlaArgArgGlyGlyAsn-45
SEQ. ID. NO. 31484  51-IleAlaAlaAlaGluArgAlaGlyAsp-59
SEQ. ID. NO. 31485  77-AlaValAspGlnGluThr-82
SEQ. ID. NO. 31486  84-LeuAlaValGluArgAlaAlaGlyGluCysAlaAspGluValSerAspGlnProAlaArgAsnGlyGlyIleGluGluAspGlyValAlaAla
CysArgAspAlaAlaAlaAlaGluSerAlaGln-125
SEQ. ID. NO. 31487  162-AsnAspAlaAlaGly-166
SEQ. ID. NO. 31488  192-LeuHisArgArgAla-196
SEQ. ID. NO. 31489  258-ValGlyGlyGlyAlaAspGlyVal-265
SEQ. ID. NO. 31490  309-AlaLeuSerGluArgPheAla-315
SEQ. ID. NO. 31491  322-GlyArgAlaArgCys-326
SEQ. ID. NO. 31492  328-CysGlnValGluArgAlaAlaAlaGluValGluGluPheGly-341
g519-1
AMPHI Regions - AMPHI
SEQ. ID. NO. 31493  13-ValPheGlyPheLysSerPhe-19
SEQ. ID. NO. 31494  29-ValValGluArgLeuGlyArgPheHisArgAlaLeuThrAlaGly-43
SEQ. ID. NO. 31495  105-MetAlaIleThrGlnLeuAlaGlnThrThrLeuArgSerVal-118
SEQ. ID. NO. 31496  139-ValSerAlaLeuAspGluAlaAla-146
SEQ. ID. NO. 31497  165-GlnGluIleLeuArgAlaMetGln-172
SEQ. ID. NO. 31498  192-LysIleGluGlnIle-196
SEQ. ID. NO. 31499  221-SerAsnAlaGluLysIleAlaArgIleAsn-230
SEQ. ID. NO. 31500  249-AlaIleArgGlnIleAlaAlaAla-256
SEQ. ID. NO. 31501  273-GlnTyrValAlaAlaPheAsnAsnLeuAlaLys-283
SEQ. ID. NO. 31502  292-AlaAsnValAlaAspIleGlySerLeuIleSerAlaGlyMetLysIleIleAspSerSerLysThrAla-314
Antigenic Index - Jameson-Wolf
SEQ. ID. NO. 31503  31-GluArgLeuGlyArgPheHisArg-38
SEQ. ID. NO. 31504  58-HisSerLeuLysGluIleProLeuAspValProSerGln-70
SEQ. ID. NO. 31505  72-CysIleThrArgAspAsnThrGlnLeuThrVal-82
SEQ. ID. NO. 31506  91-ThrAspProLysLeuAlaSer-97
SEQ. ID. NO. 31507  122-MetGluLeuAspLysThrPheGluGluArgAspGluIleAsn-135
SEQ. ID. NO. 31508  141-AlaLeuAspGluAlaAlaGly-147
SEQ. ID. NO. 31509  154-LeuArgTyrGluIleLysAspLeuValPro-163
SEQ. ID. NO. 31510  175-IleThrAlaGluArgGluLysArgAlaArgIleAlaGluSerGluGlyArgLysIleGluGln-195
SEQ. ID. NO. 31511  197-AsnLeuAlaSerGlyGlnArgGluAlaGluIleGlnGlnSerGluGlyGluAlaGlnAla-216
SEQ. ID. NO. 31512  219-AsnAlaSerAsnAlaGluLysIleAlaArgIleAsnArgAlaLysGlyGluAlaGluSerLeuArgLeu-241
SEQ. ID. NO. 31513  245-AlaAsnAlaGluAlaIleArg-251
SEQ. ID. NO. 31514  258-GlnThrGlnGlyGlyAlaAspAlaValAsn-267
SEQ. ID. NO. 31515  281-LeuAlaLysGluSerAsnThr-287
SEQ. ID. NO. 31516  303-AlaGlyMetLysIleIleAspSerSerLysThrAlaLys-315
Hydrophilic Regions - Hopp-Woods
SEQ. ID. NO. 31517  31-GluArgLeuGlyArgPheHisArg-38
SEQ. ID. NO. 31518  58-HisSerLeuLysGluIleProLeu-65
SEQ. ID. NO. 31519  73-IleThrArgAspAsnThr-78
SEQ. ID. NO. 31520  91-ThrAspProLysLeu-95
SEQ. ID. NO. 31521  122-MetGluLeuAspLysThrPheGluGluArgAspGluIleAsn-135
SEQ. ID. NO. 31522  141-AlaLeuAspGluAlaAla-146
SEQ. ID. NO. 31523  154-LeuArgTyrGluIleLysAspLeuValPro-163
SEQ. ID. NO. 31524  175-IleThrAlaGluArgGluLysArgAlaArgIleAlaGluSerGluGlyArgLysIleGluGln-195
SEQ. ID. NO. 31525  200-SerGlyGlnArgGluAlaGluIleGlnGlnSerGluGlyGluAlaGlnAla-216
SEQ. ID. NO. 31526  221-SerAsnAlaGluLysIleAlaArgIleAsnArgAlaLysGlyGluAlaGluSerLeuArgLeu-241
SEQ. ID. NO. 31527  245-AlaAsnAlaGluAlaIleArg-251
SEQ. ID. NO. 31528  281-LeuAlaLysGluSerAsn-286
SEQ. ID. NO. 31529  306-LysIleIleAspSerSerLysThrAlaLys-315
g520-1
AMPHI Regions - AMPHI
SEQ. ID. NO. 31530  109-AspGlyGlnIleTrpArgAlaPheSerSerLeuLys-120
Antigenic Index - Jameson-Wolf
SEQ. ID. NO. 31531  20-LysProSerArgArgAlaLeu-26
SEQ. ID. NO. 31532  47-AlaSerGlyLysIleSerLeuPro-54
SEQ. ID. NO. 31533  84-ProProAsnAsnSerThrThrThrSerThrSerLeuArgAlaThrSerSerAsnGlySerLeuThrLysAlaAlaAsp-109

TABLE 1-continued

| | |
|---|---|
| SEQ. ID. NO. 31534 | 122-HisMetAlaGluIleArgIleSerArgProLysArgArgGluIleSerSerAlaLeuSerArgAsnThrAlaAlaAlaPro-148 |
| SEQ. ID. NO. 31535 | 150-ProThrValProLysProLysArgProMet-159 |
| SEQ. ID. NO. 31536 | 166-SerProCysLysProThrGluMet-173 |

Hydrophilic Regions - Hopp-Woods

| | |
|---|---|
| SEQ. ID. NO. 31537 | 20-LysProSerArgArgAlaLeu-26 |
| SEQ. ID. NO. 31538 | 93-ThrSerLeuArgAlaThrSerSer-100 |
| SEQ. ID. NO. 31539 | 103-SerLeuThrLysAlaAlaAsp-109 |
| SEQ. ID. NO. 31540 | 122-HisMetAlaGluIleArgIleSerArgProLysArgArgGluIleSer-137 |
| SEQ. ID. NO. 31541 | 140-LeuSerArgAsnThrAla-145 |
| SEQ. ID. NO. 31542 | 151-ThrValProLysProLysArgProMet-159 |
| SEQ. ID. NO. 31543 | 168-CysLysProThrGluMet-173 | g521
AMPHI Regions - AMPHI

| | |
|---|---|
| SEQ. ID. NO. 31544 | 39-ThrLysProSerLysSerCys-45 |
| SEQ. ID. NO. 31545 | 50-LeuProProIleGly-54 |
| SEQ. ID. NO. 31546 | 86-ValLysThrValSerLysProAlaLysSer-95 |
| SEQ. ID. NO. 31547 | 126-AlaGlnLysMetLeu-130 |
| SEQ. ID. NO. 31548 | 132-GlnAlaArgLeuAlaLysGlyGlyAsn-140 |
| SEQ. ID. NO. 31549 | 146-IleAsnAlaLeuSerAsnValLeuAspArgGlnGlnAsnIle-159 |

Antigenic Index - Jameson-Wolf

| | |
|---|---|
| SEQ. ID. NO. 31550 | 1-MetLysSerLysLeu-5 |
| SEQ. ID. NO. 31551 | 36-ValTyrThrThrLysProSerLysSerCysHisSerThrAspLeuProProIleGlyAsnTyrSerSerGluArgTyrIle-62 |
| SEQ. ID. NO. 31552 | 65-GlnThrProGluProAlaProSerProSerAsnGlyGlyGln-78 |
| SEQ. ID. NO. 31553 | 80-ValLysTyrLysAlaProVal-86 |
| SEQ. ID. NO. 31554 | 88-ThrValSerLysProAlaLysSerAsnThrProProGlnGlnAlaProValAsnAsnSerArgArgSerIleLeuGluAlaGluLeuSerAsnGluArgLysAlaLeuThrGluAlaGlnLysMetLeuSer-131 |
| SEQ. ID. NO. 31555 | 134-ArgLeuAlaLysGlyGlyAsnIleAsnHisGlnLys-145 |
| SEQ. ID. NO. 31556 | 152-ValLeuAspArgGlnGlnAsn-158 |
| SEQ. ID. NO. 31557 | 162-LeuGlnArgGluLeuGlyArg-168 |

Hydrophilic Regions - Hopp-Woods

| | |
|---|---|
| SEQ. ID. NO. 31558 | 1-MetLysSerLysLeu-5 |
| SEQ. ID. NO. 31559 | 40-LysProSerLysSerCysHis-46 |
| SEQ. ID. NO. 31560 | 57-SerSerGluArgTyrIle-62 |
| SEQ. ID. NO. 31561 | 66-ThrProGluProAlaProSerProSerAsnGly-76 |
| SEQ. ID. NO. 31562 | 80-ValLysTyrLysAlaProVal-86 |
| SEQ. ID. NO. 31563 | 88-ThrValSerLysProAlaLysSerAsnThrPro-98 |
| SEQ. ID. NO. 31564 | 105-AsnAsnSerArgArgSerIleLeuGluAlaGluLeuSerAsnGluArgLysAlaLeuThrGluAlaGlnLysMetLeuSer-131 |
| SEQ. ID. NO. 31565 | 152-ValLeuAspArgGlnGlnAsn-158 |
| SEQ. ID. NO. 31566 | 162-LeuGlnArgGluLeuGlyArg-168 | g522
AMPHI Regions - AMPHI

| | |
|---|---|
| SEQ. ID. NO. 31567 | 57-LysIleValGluSerCysMetLys-64 |
| SEQ. ID. NO. 31568 | 96-MetTrpGluGlnProLeuAspGlyLeuSerGluLysGlnIleSerSerPheGlyLysLeuGlyAlaGlnGluGlnLeuAspLeuLeuGlyGlyAla-127 |

Antigenic Index - Jameson-Wolf

| | |
|---|---|
| SEQ. ID. NO. 31569 | 1-MetThrGluProLysHisGluThrProThrGluGluGlnValAlaAlaArgLysLysAlaLysAlaLysIleArgThr-26 |
| SEQ. ID. NO. 31570 | 48-AlaMetSerLysProGlnAlaLysGlnLysIleValGluSerCysMetLys-64 |
| SEQ. ID. NO. 31571 | 71-LysTrpGlnAsnAspLeuLysAlaArgGlyLeuAspAlaAspAsnThrArgLeu-88 |
| SEQ. ID. NO. 31572 | 103-GlyLeuSerGluLysGlnIleSerSerPheGlyLysLeuGlyAla-117 |
| SEQ. ID. NO. 31573 | 128-AsnAlaPheGluThrArgAspLysGlnCysValAlaAspLeuLysAlaAsp-144 |

Hydrophilic Regions - Hopp-Woods

| | |
|---|---|
| SEQ. ID. NO. 31574 | 1-MetThrGluProLysHisGluThrProThrGluGluGlnValAlaAlaArgLysLysAlaLysAlaLysIleArgThr-26 |
| SEQ. ID. NO. 31575 | 48-AlaMetSerLysProGlnAlaLysGlnLysIleValGluSerCysMet-63 |
| SEQ. ID. NO. 31576 | 72-TrpGlnAsnAspLeuLysAlaArgGlyLeuAspAlaAspAsnThrArgLeu-88 |
| SEQ. ID. NO. 31577 | 103-GlyLeuSerGluLysGlnIle-109 |
| SEQ. ID. NO. 31578 | 130-PheGluThrArgAspLysGlnCysValAlaAspLeuLysAlaAsp-144 | g525-1
AMPHI Regions - AMPHI

| | |
|---|---|
| SEQ. ID. NO. 31579 | 59-GluPheAlaGluPheValAsnSerHisProGln-69 |
| SEQ. ID. NO. 31580 | 86-LysHisTrpMetLysAsnGly-92 |
| SEQ. ID. NO. 31581 | 125-ArgLeuProThrIleAspGluTrpGluPhe-134 |
| SEQ. ID. NO. 31582 | 154-ThrIleLeuAspTrpTyr-159 |
| SEQ. ID. NO. 31583 | 164-ArgLysGlyLeuHisAspValGly-171 |
| SEQ. ID. NO. 31584 | 178-TrpGlyValTyrAsp-182 |
| SEQ. ID. NO. 31585 | 188-TrpGluTrpThrGlu-192 |

Antigenic Index - Jameson-Wolf

| | |
|---|---|
| SEQ. ID. NO. 31586 | 24-ValGlnIleGluGlyGlyGlySerTyrArgProLeuTyrLeuLysLysAspThrGlyLeuIleLys-44 |
| SEQ. ID. NO. 31587 | 46-LysProPheLysLeuAspLysTyrProValThr-56 |
| SEQ. ID. NO. 31588 | 67-HisProGlnTrpGlnLysGlyArgIleGlySerLysGlnAlaGlu-81 |
| SEQ. ID. NO. 31589 | 88-TrpMetLysAsnGlySerArgSerTyrAlaProLysAlaGlyGluLeuLysGlnPro-106 |
| SEQ. ID. NO. 31590 | 122-GlnGlyLysArgLeuProThrIleAspGluTrpGlu-133 |
| SEQ. ID. NO. 31591 | 140-AlaThrGlnLysAsnGlySerAsnGluProGlyTyrAsnArgThr-154 |
| SEQ. ID. NO. 31592 | 159-TyrAlaAspGlyGlyArgLysGlyLeuHisAspValGlyLysAspArgProAsnTyr-177 |
| SEQ. ID. NO. 31593 | 190-TrpThrGluAspPheAsnSerSerLeuLeuSerSerGlyAsnAla-204 |
| SEQ. ID. NO. 31594 | 213-AlaSerValGlyAlaSerAspSerSerAsnTyr-223 |
| SEQ. ID. NO. 31595 | 234-SerLeuGlnSerLysTyr-239 |
| SEQ. ID. NO. 31596 | 245-GlyPheArgCysAlaSerArg-251 |

Hydrophilic Regions - Hopp-Woods

| | |
|---|---|
| SEQ. ID. NO. 31597 | 35-TyrLeuLysLysAspThrGlyLeuIleLys-44 |
| SEQ. ID. NO. 31598 | 46-LysProPheLysLeuAspLysTyrPro-54 |
| SEQ. ID. NO. 31599 | 71-GlnLysGlyArgIleGlySerLysGlnAlaGlu-81 |

| | |
|---|---|
| SEQ. ID. NO. 31600 | 91-AsnGlySerArgSerTyrAla-97 |
| SEQ. ID. NO. 31601 | 99-LysAlaGlyGluLeuLysGln-105 |
| SEQ. ID. NO. 31602 | 122-GlnGlyLysArgLeuProThr-128 |
| SEQ. ID. NO. 31603 | 140-AlaThrGlnLysAsnGlySerAsnGluProGlyTyr-151 |
| SEQ. ID. NO. 31604 | 162-GlyGlyArgLysGlyLeuHisAspValGlyLysAspArgProAsn-176 |
| SEQ. ID. NO. 31605 | 216-GlyAlaSerAspSerSerAsn-222 | g527
AMPHI Regions - AMPHI

| | |
|---|---|
| SEQ. ID. NO. 31606 | 7-PhePheGlnProValGln-12 |
| SEQ. ID. NO. 31607 | 29-AspAlaAlaGluLeuValGluLeuPheAlaLeuPhePro-41 |
| SEQ. ID. NO. 31608 | 73-GlyLysGlyIleGluArgGlnValAspAsnIleAlaAspValTyrGlyPhe-89 |

Antigenic Index - Jameson-Wolf

| | |
|---|---|
| SEQ. ID. NO. 31609 | 19-GlyArgSerAlaValGlyMetGlyGlySerAspAlaAlaGlu-32 |
| SEQ. ID. NO. 31610 | 52-GlnLysProArgLeuGlyCysArg-59 |
| SEQ. ID. NO. 31611 | 71-PheMetGlyLysGlyIleGluArgGlnValAspAsnIleAla-84 |
| SEQ. ID. NO. 31612 | 107-LeuLeuArgLysGlyThrGlyLeuGluLysThrCysArgProLysProPheValGlnProHisGlyGlyArg-130 |

Hydrophilic Regions - Hopp-Woods

| | |
|---|---|
| SEQ. ID. NO. 31613 | 26-GlyGlySerAspAlaAlaGlu-32 |
| SEQ. ID. NO. 31614 | 53-LysProArgLeuGlyCys-58 |
| SEQ. ID. NO. 31615 | 71-PheMetGlyLysGlyIleGluArgGlnValAspAsnIleAla-84 |
| SEQ. ID. NO. 31616 | 107-LeuLeuArgLysGlyThrGlyLeuGluLysThrCysArgProLysPro-122 | g528
AMPHI Regions - AMPHI

| | |
|---|---|
| SEQ. ID. NO. 31617 | 23-ArgLeuAlaGlyTrpTyrGluCysSerSerLeuSerGlyTrpCysLysProArgLysProAlaAlaIle-45 |
| SEQ. ID. NO. 31618 | 69-AsnArgSerValArg-73 |
| SEQ. ID. NO. 31619 | 87-ArgLysIleGlyLysPhe-92 |
| SEQ. ID. NO. 31620 | 106-ProLeuValGluArgPheLys-112 |

Antigenic Index - Jameson-Wolf

| | |
|---|---|
| SEQ. ID. NO. 31621 | 29-GluCysSerSerLeuSerGlyTrpCysLysProArgLysProAlaAla-44 |
| SEQ. ID. NO. 31622 | 49-AspIleGlyGlyGluSerProLeuSerLeuGluAspTyrGluIleProLeuSerAspGlyAsnArgSerValArgAlaAsnGluTyrGluSerAlaGlnLysSerTyrPhe-85 |
| SEQ. ID. NO. 31623 | 88-LysIleGlyLysPheGluAlaCysGlyLeuAspTrpArgThrArgAspGlyLysProLeuValGluArgPheLysGlnGluGlyPheAspCysLeuGluLysGlnGlyLeuArgArgAsnGlyLeuSerGluArgValArgTrp-135 |

Hydrophilic Regions - Hopp-Woods

| | |
|---|---|
| SEQ. ID. NO. 31624 | 37-CysLysProArgLysProAlaAla-44 |
| SEQ. ID. NO. 31625 | 54-SerProLeuSerLeuGluAspTyrGluIleProLeu-65 |
| SEQ. ID. NO. 31626 | 67-AspGlyAsnArgSerValArgAlaAsnGluTyrGluSerAlaGln-81 |
| SEQ. ID. NO. 31627 | 88-LysIleGlyLysPheGluAlaCys-95 |
| SEQ. ID. NO. 31628 | 99-TrpArgThrArgAspGlyLysProLeuValGluArgPheLysGlnGluGlyPheAspCysLeuGluLysGlnGlyLeuArgArgAsnGlyLeuSerGluArgValArgTrp-135 | g531
AMPHI Regions - AMPHI

| | |
|---|---|
| SEQ. ID. NO. 31629 | 64-LeuAlaAspTyrMetAla-69 |
| SEQ. ID. NO. 31630 | 90-GlySerIleIleGlyIlePhePheSerLeuProGlyLeuIleLeuGly-105 |
| SEQ. ID. NO. 31631 | 108-IleGlyAlaAlaAlaGly-113 |
| SEQ. ID. NO. 31632 | 132-LeuLeuGlyLeuValVal-137 |

Antigenic Index - Jameson-Wolf

| | |
|---|---|
| SEQ. ID. NO. 31633 | 77-ThrGlyAlaGlyLysLeuAlaVal-84 |
| SEQ. ID. NO. 31634 | 114-GluLeuIleAspArgArgAsnMet-121 |

Hydrophilic Regions - Hopp-Woods

| | |
|---|---|
| SEQ. ID. NO. 31635 | 114-GluLeuIleAspArgArgAsnMet-121 | g532-2
AMPHI Regions - AMPHI

| | |
|---|---|
| SEQ. ID. NO. 31636 | 6-LysLysGlnAlaAsp-10 |
| SEQ. ID. NO. 31637 | 27-AlaLeuLeuSerAlaValThrHisLeuLeuAlaIlePheValProMetIleThr-44 |
| SEQ. ID. NO. 31638 | 76-TyrLeuGlnValAsnArgPheGlySerVal-85 |
| SEQ. ID. NO. 31639 | 122-SerThrLeuLeuGlyValSerPhe-129 |
| SEQ. ID. NO. 31640 | 147-LysValIleThrProThrVal-153 |
| SEQ. ID. NO. 31641 | 184-ThrPheGlySerMetGluAsnLeuGly-192 |
| SEQ. ID. NO. 31642 | 206-CysMetLysAsnPro-210 |
| SEQ. ID. NO. 31643 | 224-GlyTyrIleValAlaLeu-229 |
| SEQ. ID. NO. 31644 | 236-PheSerAlaLeuGlnAsnLeuPro-243 |
| SEQ. ID. NO. 31645 | 271-LeuGlyValPheGluAlaValGlyAspLeuThrAla-282 |
| SEQ. ID. NO. 31646 | 297-ThrLysArgLeuArgGlyGlyVal-304 |
| SEQ. ID. NO. 31647 | 307-AspGlyLeuValSerValIleAlaThrAlaLeuGly-318 |
| SEQ. ID. NO. 31648 | 338-AlaSerArgHisValGlyLysTyr-345 |
| SEQ. ID. NO. 31649 | 361-ArgAlaPheThrThrIleProSerProVal-370 |

Antigenic Index - Jameson-Wolf

| | |
|---|---|
| SEQ. ID. NO. 31650 | 3-GluThrMetLysLysGlnAlaAspSerProAspLeu-14 |
| SEQ. ID. NO. 31651 | 16-TyrGlyLeuGluAspArgProProPhe-24 |
| SEQ. ID. NO. 31652 | 80-AsnArgPheGlySer-84 |
| SEQ. ID. NO. 31653 | 94-XxxXxxXxxXxxSerSer-99 |
| SEQ. ID. NO. 31654 | 108-AlaGlyMetLysGluGlyGlyLeuSerGluGlyAla-119 |
| SEQ. ID. NO. 31655 | 177-PheGlyAlaLysAlaAspGlyThrPheGlySer-187 |
| SEQ. ID. NO. 31656 | 207-MetLysAsnProLeuLeuArg-213 |
| SEQ. ID. NO. 31657 | 286-ValSerAspGlnProIleGluGlyGluGluTyrThrLysArgLeuArgGlyGlyValLeu-305 |
| SEQ. ID. NO. 31658 | 394-GlyIleArgArgArgGluAlaVal-401 |
| SEQ. ID. NO. 31659 | 431-IleSerGlyGlyGly-435 |
| SEQ. ID. NO. 31660 | 445-LeuProGluAspLysThrGluAlaAlaValLysPheAspThrAspHisLeuGluHis-463 |

TABLE 1-continued

Hydrophilic Regions - Hopp-Woods
SEQ. ID. NO. 31661    3-GluThrMetLysLysGlnAlaAspSerProAsp-13
SEQ. ID. NO. 31662    18-LeuGluAspArgProProPhe-24
SEQ. ID. NO. 31663    109-GlyMetLysGluGlyGlyLeuSer-116
SEQ. ID. NO. 31664    179-AlaLysAlaAspGly-183
SEQ. ID. NO. 31665    289-GlnProIleGluGlyGluGluTyrThrLysArgLeuArgGly-302
SEQ. ID. NO. 31666    394-GlyIleArgArgArgGluAlaVal-401
SEQ. ID. NO. 31667    445-LeuProGluAspLysThrGluAlaAlaValLysPheAspThrAspHisLeuGluHis-463
g537
AMPHI Regions - AMPHI
SEQ. ID. NO. 31668    38-GlnIleArgAspGlyGlyAspAlaLeuHisTyrLeuAsnArgIle-52
SEQ. ID. NO. 31669    86-HisGlyGluHisHis-90
SEQ. ID. NO. 31670    109-GlyTyrLeuTyrAsnGlyValHisGlu-117
SEQ. ID. NO. 31671    138-ArgGlnValAspAlaLeuMetSerAlaIleTyr-148
SEQ. ID. NO. 31672    180-AsnGlySerPheGluArg-185
SEQ. ID. NO. 31673    190-GlyArgArgGlnProGluAlaGlyArgLysTyrTyrArgAsnAlaCys-205
SEQ. ID. NO. 31674    281-ArgProValArgValLeuThrAlaGly-289
SEQ. ID. NO. 31675    315-TyrThrAlaValPheAspTyrValArgAsnGly-325
SEQ. ID. NO. 31676    374-ThrArgTyrThrTyr-378
Antigenic Index - Jameson-Wolf
SEQ. ID. NO. 31677    21-ThrGlnAsnGlnSerLeuProAlaGly-29
SEQ. ID. NO. 31678    32-ValTyrProSerAlaProGlnIleArgAspGlyGlyAspAla-45
SEQ. ID. NO. 31679    69-AsnSerAlaArgArgHisAlaArg-76
SEQ. ID. NO. 31680    80-LeuAsnProGluAspGlyHisGlyGluHisHisProAspAsnProHis-95
SEQ. ID. NO. 31681    99-GlnLysLeuThrGluArgThrArgLeu-107
SEQ. ID. NO. 31682    115-ValHisGluAsnIleSerThrGluGluGluAlaAlaGluSerSerAspSerAspIleArgThrGlnGlnArgGlnValAsp-141
SEQ. ID. NO. 31683    152-SerLeuLeuAspArgHisThrAspGluAlaGly-162
SEQ. ID. NO. 31684    165-PheValArgGluAsnGlyLysThr-172
SEQ. ID. NO. 31685    178-GlnGlyAsnGlySerPheGluArgAlaCysAlaLysGlyArgArgGlnProGluAlaGlyArgLysTyrTyrArgAsnAlaCysHisAsnGly-208
SEQ. ID. NO. 31686    238-TyrGlyGluArgProAspProValProGluTyrGluIleThrGlyAsnProAlaSer-256
SEQ. ID. NO. 31687    258-AspPheSerGluAlaAlaGly-264
SEQ. ID. NO. 31688    266-IleAlaMetLysSer-270
SEQ. ID. NO. 31689    274-TyrGlnGlyLysAsnGluIleArgPro-282
SEQ. ID. NO. 31690    287-ThrAlaGlyAsnAspProAsnGlyArgLeuThr-297
SEQ. ID. NO. 31691    321-TyrValArgAsnGlyArgHisAlaGln-329
SEQ. ID. NO. 31692    334-PheArgThrArgLysProAspTyrProTyr-343
SEQ. ID. NO. 31693    345-GluValAsnGlyGlyGluThrLeuAlaValArgLysGlyGluLys-359
SEQ. ID. NO. 31694    364-TrpArgGlyArgTrpCysLeu-370
SEQ. ID. NO. 31695    380-ArgGlnPheGlyAsnSer-385
SEQ. ID. NO. 31696    389-LeuArgHisGluAlaGlyGly-395
SEQ. ID. NO. 31697    402-GlyMetAlaGlySerArgIleArgLeuThrProGluAspSerProGluArgGly-419
Hydrophilic Regions - Hopp-Woods
SEQ. ID. NO. 31698    37-ProGlnIleArgAspGlyGlyAsp-44
SEQ. ID. NO. 31699    69-AsnSerAlaArgArgHisAlaArg-76
SEQ. ID. NO. 31700    81-AsnProGluAspGlyHisGlyGluHisHisProAsp-92
SEQ. ID. NO. 31701    100-LysLeuThrGluArgThrArgLeu-107
SEQ. ID. NO. 31702    119-IleSerThrGluGluGluAlaAlaGluSerSerAspSerAspIleArgThrGlnGlnArgGlnValAsp-141
SEQ. ID. NO. 31703    152-SerLeuLeuAspArgHisThrAspGluAlaGly-162
SEQ. ID. NO. 31704    165-PheValArgGluAsnGlyLys-171
SEQ. ID. NO. 31705    181-GlySerPheGluArgAlaCysAlaLysGlyArgArgGlnProGluAlaGlyArgLysTyrTyrArg-202
SEQ. ID. NO. 31706    240-GluArgProAspProValProGluTyrGluIle-250
SEQ. ID. NO. 31707    258-AspPheSerGluAlaAlaGly-264
SEQ. ID. NO. 31708    266-IleAlaMetLysSer-270
SEQ. ID. NO. 31709    275-GlnGlyLysAsnGluIleArgPro-282
SEQ. ID. NO. 31710    289-GlyAsnAspProAsnGlyArgLeuThr-297
SEQ. ID. NO. 31711    323-ArgAsnGlyArgHisAlaGln-329
SEQ. ID. NO. 31712    334-PheArgThrArgLysProAsp-340
SEQ. ID. NO. 31713    352-LeuAlaValArgLysGlyGluLys-359
SEQ. ID. NO. 31714    389-LeuArgHisGluAla-393
SEQ. ID. NO. 31715    406-SerArgIleArgLeuThrProGluAspSerProGluArgGly-419
g538
AMPHI Regions - AMPHI
SEQ. ID. NO. 31716    41-ThrAlaLeuAlaGluAlaValGluLeuValLysAlaAlaGly-54
SEQ. ID. NO. 31717    78-LysAlaAlaGluLeuSerGluAlaValAla-87
SEQ. ID. NO. 31718    104-GlnGluArgAsnLeuGluLysIleLeuGlnCysArgValLeuAspArgVal-120
SEQ. ID. NO. 31719    144-GlnLeuSerHisLeuAlaGlyArgLeuIleArgGlyTyrGlyHisLeuGln-160
SEQ. ID. NO. 31720    187-IleAsnAlaLeuLysLysGlnLeuAla-195
SEQ. ID. NO. 31721    211-GlyArgIleLysThrPheAlaLeuValGlyTyrThrAsn-223
SEQ. ID. NO. 31722    230-PheAsnArgLeuThrLys-235
SEQ. ID. NO. 31723    270-GlyPheValSerAspLeuProHisLysLeuIleSerAlaPheSerAlaThrLeuGlu-288
SEQ. ID. NO. 31724    306-AsnSerGlyGlnGlnIleGluAspValGluAsnValLeuGlnGluIleHis-322
SEQ. ID. NO. 31725    364-GluAsnThrGlyIleAspAlaLeuAlaGluAlaIleAlaGluTyrCysAla-380
Antigenic Index - Jameson-Wolf
SEQ. ID. NO. 31726    1-SerGlyArgThrGlyArgAsnSerAlaThrGlnAlaGlnProGluArgVal-17
SEQ. ID. NO. 31727    24-LeuAspLysAspAspThrGlySerAsnAlaAlaArg-35
SEQ. ID. NO. 31728    47-ValGluLeuValLys-51
SEQ. ID. NO. 31729    53-AlaGlyGlyAspSerValArgValGluThrAlaLysArgAspArgProHisThr-70
SEQ. ID. NO. 31730    76-ThrGlyLysAlaAlaGluLeuSerGlu-84
SEQ. ID. NO. 31731    99-GluLeuThrProThrGlnGluArgAsnLeuGluLys-110
SEQ. ID. NO. 31732    128-AlaArgArgAlaArgThrGlnGluGlyArgLeuGlnVal-140

TABLE 1-continued

| | |
|---|---|
| SEQ. ID. NO. 31733 | 160-GlnSerGlnArgGlyGlyIleGlyMetLysGlyProGlyGluThrLysLeuGluThrAspArgArgLeuThrAla-184 |
| SEQ. ID. NO. 31734 | 188-AsnAlaLeuLysLysGlnLeuAlaAsnLeuLysLysGlnArgAlaLeuArgArgLysSerArgGluSerGlyArgIleLysThr-215 |
| SEQ. ID. NO. 31735 | 223-AsnValGlyLysSerSerLeu-229 |
| SEQ. ID. NO. 31736 | 232-ArgLeuThrLysSerGlyIleTyrAla-240 |
| SEQ. ID. NO. 31737 | 286-ThrLeuGluGluThrValGln-292 |
| SEQ. ID. NO. 31738 | 302-AlaAlaAlaArgAsnSerGlyGlnGlnIleGluAspValGluAsnValLeu-318 |
| SEQ. ID. NO. 31739 | 332-TyrAsnLysThrAspLeuLeuProSerGluGluGlnAsnThrGlyIle-347 |
| SEQ. ID. NO. 31740 | 364-GluAsnThrGlyIleAspAlaLeuArgGluAlaIle-375 |
| SEQ. ID. NO. 31741 | 380-AlaAlaAlaProAsnThrAspGluThrGluMetPro-391 |
| Hydrophilic Regions - Hopp-Woods | |
| SEQ. ID. NO. 31742 | 1-SerGlyArgThrGlyArgAsnSerAla-9 |
| SEQ. ID. NO. 31743 | 12-AlaGlnProGluArg-16 |
| SEQ. ID. NO. 31744 | 24-LeuAspLysAspAspThrGlySerAsnAlaAlaArg-35 |
| SEQ. ID. NO. 31745 | 47-ValGluLeuValLys-51 |
| SEQ. ID. NO. 31746 | 53-AlaGlyGlyAspSerValArgValGluThrAlaLysArgAspArgProHis-69 |
| SEQ. ID. NO. 31747 | 77-GlyLysAlaAlaGluLeuSerGlu-84 |
| SEQ. ID. NO. 31748 | 100-LeuThrProThrGlnGluArgAsnLeuGluLys-110 |
| SEQ. ID. NO. 31749 | 128-AlaArgArgAlaArgThrGlnGluGlyArgLeuGlnVal-140 |
| SEQ. ID. NO. 31750 | 160-GlnSerGlnArgGlyGlyIle-166 |
| SEQ. ID. NO. 31751 | 170-GlyProGlyGluThrLysLeuGluThrAspArgArgLeuThrAla-184 |
| SEQ. ID. NO. 31752 | 188-AsnAlaLeuLysLysGlnLeuAlaAsnLeuLysLysGlnArgAlaLeuArgArgLysSerArgGluSerGlyArgIleLys-214 |
| SEQ. ID. NO. 31753 | 286-ThrLeuGluGluThrValGln-292 |
| SEQ. ID. NO. 31754 | 302-AlaAlaAlaArgAsnSerGlyGlnGlnIleGluAspValGluAsnValLeu-318 |
| SEQ. ID. NO. 31755 | 336-AspLeuLeuProSerGluGluGlnAsn-344 |
| SEQ. ID. NO. 31756 | 369-AspAlaLeuArgGluAlaIle-375 |
| SEQ. ID. NO. 31757 | 383-ProAsnThrAspGluThrGluMetPro-391 |
| g538 | |
| AMPHI Regions - AMPHI | |
| SEQ. ID. NO. 31758 | 41-ThrAlaLeuAlaGluAlaValGluLeuValLysAlaAlaGly-54 |
| SEQ. ID. NO. 31759 | 78-LysAlaAlaGluLeuSerGluAlaValAla-87 |
| SEQ. ID. NO. 31760 | 104-GlnGluArgAsnLeuGluLysIleLeuGlnCysArgValLeuAspArgVal-120 |
| SEQ. ID. NO. 31761 | 144-GlnLeuSerHisLeuAlaGlyArgLeuIleArgGlyTyrGlyHisLeuGln-160 |
| SEQ. ID. NO. 31762 | 187-IleAsnAlaLeuLysLysGlnLeuAla-195 |
| SEQ. ID. NO. 31763 | 211-GlyArgIleLysThrPheAlaLeuValGlyTyrThrAsn-223 |
| SEQ. ID. NO. 31764 | 230-PheAsnArgLeuThrLys-235 |
| SEQ. ID. NO. 31765 | 270-GlyPheValSerAspLeuProHisLysLeuIleSerAlaPheSerAlaThrLeuGlu-288 |
| SEQ. ID. NO. 31766 | 306-AsnSerGlyGlnGlnIleGluAspValGluAsnValLeuGlnGluIleHis-322 |
| SEQ. ID. NO. 31767 | 364-GluAsnThrGlyIleAspAlaLeuArgGluAlaIleAlaGluTyrCysAla-380 |
| Antigenic Index - Jameson-Wolf | |
| SEQ. ID. NO. 31768 | 1-SerGlyArgThrGlyArgAsnSerAlaThrGlnAlaGlnProGluArgVal-17 |
| SEQ. ID. NO. 31769 | 24-LeuAspLysAspAspThrGlySerAsnAlaAlaArg-35 |
| SEQ. ID. NO. 31770 | 47-ValGluLeuValLys-51 |
| SEQ. ID. NO. 31771 | 53-AlaGlyGlyAspSerValArgValGluThrAlaLysArgAspArgProHisThr-70 |
| SEQ. ID. NO. 31772 | 76-ThrGlyLysAlaAlaGluLeuSerGlu-84 |
| SEQ. ID. NO. 31773 | 99-GluLeuThrProThrGlnGluArgAsnLeuGluLys-110 |
| SEQ. ID. NO. 31774 | 128-AlaArgArgAlaArgThrGlnGluGlyArgLeuGlnVal-140 |
| SEQ. ID. NO. 31775 | 160-GlnSerGlnArgGlyGlyIleGlyMetLysGlyProGlyGluThrLysLeuGluThrAspArgArgLeuThrAla-184 |
| SEQ. ID. NO. 31776 | 188-AsnAlaLeuLysLysGlnLeuAlaAsnLeuLysLysGlnArgAlaLeuArgArgLysSerArgGluSerGlyArgIleLysThr-215 |
| SEQ. ID. NO. 31777 | 223-AsnValGlyLysSerSerLeu-229 |
| SEQ. ID. NO. 31778 | 232-ArgLeuThrLysSerGlyIleTyrAla-240 |
| SEQ. ID. NO. 31779 | 286-ThrLeuGluGluThrValGln-292 |
| SEQ. ID. NO. 31780 | 302-AlaAlaAlaArgAsnSerGlyGlnGlnIleGluAspValGluAsnValLeu-318 |
| SEQ. ID. NO. 31781 | 332-TyrAsnLysThrAspLeuLeuProSerGluGluGlnAsnThrGlyIle-347 |
| SEQ. ID. NO. 31782 | 364-GluAsnThrGlyIleAspAlaLeuArgGluAlaIle-375 |
| SEQ. ID. NO. 31783 | 380-AlaAlaAlaProAsnThrAspGluThrGluMetPro-391 |
| Hydrophilic Regions - Hopp-Woods | |
| SEQ. ID. NO. 31784 | 1-SerGlyArgThrGlyArgAsnSerAla-9 |
| SEQ. ID. NO. 31785 | 12-AlaGlnProGluArg-16 |
| SEQ. ID. NO. 31786 | 24-LeuAspLysAspAspThrGlySerAsnAlaAlaArg-35 |
| SEQ. ID. NO. 31787 | 47-ValGluLeuValLys-51 |
| SEQ. ID. NO. 31788 | 53-AlaGlyGlyAspSerValArgValGluThrAlaLysArgAspArgProHis-69 |
| SEQ. ID. NO. 31789 | 77-GlyLysAlaAlaGluLeuSerGlu-84 |
| SEQ. ID. NO. 31790 | 100-LeuThrProThrGlnGluArgAsnLeuGluLys-110 |
| SEQ. ID. NO. 31791 | 128-AlaArgArgAlaArgThrGlnGluGlyArgLeuGlnVal-140 |
| SEQ. ID. NO. 31792 | 160-GlnSerGlnArgGlyGlyIle-166 |
| SEQ. ID. NO. 31793 | 170-GlyProGlyGluThrLysLeuGluThrAspArgArgLeuThrAla-184 |
| SEQ. ID. NO. 31794 | 188-AsnAlaLeuLysLysGlnLeuAlaAsnLeuLysLysGlnArgAlaLeuArgArgLysSerArgGluSerGlyArgIleLys-214 |
| SEQ. ID. NO. 31795 | 286-ThrLeuGluGluThrValGln-292 |
| SEQ. ID. NO. 31796 | 302-AlaAlaAlaArgAsnSerGlyGlnGlnIleGluAspValGluAsnValLeu-318 |
| SEQ. ID. NO. 31797 | 336-AspLeuLeuProSerGluGluGlnAsn-344 |
| SEQ. ID. NO. 31798 | 369-AspAlaLeuArgGluAlaIle-375 |
| SEQ. ID. NO. 31799 | 383-ProAsnThrAspGluThrGluMetPro-391 |
| g539 | |
| AMPHI Regions - AMPHI | |
| SEQ. ID. NO. 31800 | 18-ArgGlnArgGluHisHisArgLeuHisHisThr-28 |
| SEQ. ID. NO. 31801 | 44-LeuValGlyGlyPheAspPheLeuArgValIleGlyCysGlyGly-58 |
| SEQ. ID. NO. 31802 | 108-AlaGlyGlyAlaGlyAsnAlaAla-115 |
| SEQ. ID. NO. 31803 | 123-ArgAlaIleMetGlyPhe-128 |
| SEQ. ID. NO. 31804 | 142-AspLeuValGluAspPheLeu-148 |
| SEQ. ID. NO. 31805 | 172-AspAlaLeuCysAspCysLeuThr-179 |

TABLE 1-continued

| | |
|---|---|
| SEQ. ID. NO. 31806 | 197-GlnValPheGlyAsnValGln-203 |
| SEQ. ID. NO. 31807 | 220-PheGlyAlaAlaAlaGlnTyr-226 |
| SEQ. ID. NO. 31808 | 328-GlyArgSerLeuThrAsnPro-334 |
| SEQ. ID. NO. 31809 | 354-ValSerArgValAlaLysSerTrpSerPheAla-364 |
| SEQ. ID. NO. 31810 | 366-MetProAspLeuValSerArgLeu-373 |

Antigenic Index - Jameson-Wolf

| | |
|---|---|
| SEQ. ID. NO. 31811 | 1-MetGluAspLeuGlnGluIleGly-8 |
| SEQ. ID. NO. 31812 | 15-LysValGlyArgGlnArgGluHisHisArg-24 |
| SEQ. ID. NO. 31813 | 26-HisHisThrGlnSerGlyAsnGlyLysAlaAspAsp-37 |
| SEQ. ID. NO. 31814 | 63-ProAspPheGlnGlnAsnValGlyGluAlaAsp-73 |
| SEQ. ID. NO. 31815 | 77-ValProAspAspAlaAlaAla-83 |
| SEQ. ID. NO. 31816 | 88-IleGluValAspAlaAspAspAlaValCys-97 |
| SEQ. ID. NO. 31817 | 102-LeuPheAspGlnProAspAlaGlyGlyAlaGlyAsnAlaAlaGluHis-117 |
| SEQ. ID. NO. 31818 | 169-GlyIleAspAspAlaLeuCys-175 |
| SEQ. ID. NO. 31819 | 229-MetAlaSerArgSerAlaSer-235 |
| SEQ. ID. NO. 31820 | 242-ThrGluMetArgThr-246 |
| SEQ. ID. NO. 31821 | 261-CysSerSerAspGlySerArgSer-268 |
| SEQ. ID. NO. 31822 | 304-ThrThrCysSerSerThrSer-310 |
| SEQ. ID. NO. 31823 | 313-ThrValSerSerLysValAlaGluLysAlaGluIle-324 |
| SEQ. ID. NO. 31824 | 326-LeuCysGlyArgSerLeuThrAsnProThrVal-336 |
| SEQ. ID. NO. 31825 | 348-TyrSerArgArgAlaValVal-354 |
| SEQ. ID. NO. 31826 | 356-ArgValAlaLysSer-360 |
| SEQ. ID. NO. 31827 | 369-LeuValSerArgLeuAsnArgLeuAspLeu-378 |

Hydrophilic Regions - Hopp-Woods

| | |
|---|---|
| SEQ. ID. NO. 31828 | 1-MetGluAspLeuGlnGluIleGly-8 |
| SEQ. ID. NO. 31829 | 15-LysValGlyArgGlnArgGluHisHisArg-24 |
| SEQ. ID. NO. 31830 | 31-GlyAsnGlyLysAlaAspAsp-37 |
| SEQ. ID. NO. 31831 | 69-ValGlyGluAlaAsp-73 |
| SEQ. ID. NO. 31832 | 78-ProAspAspAlaAlaAla-83 |
| SEQ. ID. NO. 31833 | 88-IleGluValAspAlaAspAspAlaValCys-97 |
| SEQ. ID. NO. 31834 | 102-LeuPheAspGlnProAspAlaGlyGly-110 |
| SEQ. ID. NO. 31835 | 113-AsnAlaAlaGluHis-117 |
| SEQ. ID. NO. 31836 | 169-GlyIleAspAspAlaLeu-174 |
| SEQ. ID. NO. 31837 | 230-AlaSerArgSerAla-234 |
| SEQ. ID. NO. 31838 | 242-ThrGluMetArgThr-246 |
| SEQ. ID. NO. 31839 | 263-SerAspGlySerArg-267 |
| SEQ. ID. NO. 31840 | 317-LysValAlaGluLysAlaGluIle-324 |
| SEQ. ID. NO. 31841 | 348-TyrSerArgArgAlaValVal-354 |
| SEQ. ID. NO. 31842 | 369-LeuValSerArgLeuAsnArgLeuAspLeu-378 | g542
AMPHI Regions - AMPHI

| | |
|---|---|
| SEQ. ID. NO. 31843 | 6-ArgIleArgArgCysSerVal-12 |

Antigenic Index - Jameson-Wolf

| | |
|---|---|
| SEQ. ID. NO. 31844 | 1-MetProLysTrpSerArgIleArgArgCysSerVal-12 |
| SEQ. ID. NO. 31845 | 29-ProProSerAsnAla-33 |
| SEQ. ID. NO. 31846 | 37-ValArgLeuLysSerSerAspGlyIleAlaSer-47 |
| SEQ. ID. NO. 31847 | 56-GlySerMetProSerGluThrValSerHisLysSerAspSerSerArgAsnThrSerAlaSerArgArgAsnValSerProLysCysProPheGly-87 |
| SEQ. ID. NO. 31848 | 90-CysArgGlnAspAlaAlaLysProArgArgPheGlyGlyLys-103 |
| SEQ. ID. NO. 31849 | 107-LeuThrGlySerArg-111 |

Hydrophilic Regions - Hopp-Woods

| | |
|---|---|
| SEQ. ID. NO. 31850 | 5-SerArgIleArgArgCysSer-11 |
| SEQ. ID. NO. 31851 | 37-ValArgLeuLysSerSerAspGlyIleAla-46 |
| SEQ. ID. NO. 31852 | 58-MetProSerGluThrValSerHisLysSerAspSerSerArgAsnThrSerAlaSerArgArgAsnValSerPro-82 |
| SEQ. ID. NO. 31853 | 90-CysArgGlnAspAlaAlaLysProArgArgPheGlyGly-102 | g544-2
AMPHI Regions - AMPHI

| | |
|---|---|
| SEQ. ID. NO. 31854 | 55-PheTrpPheProSerCysProGlyCysValSerGluMetProLysValThrLysThrAlaAsnAspTyrLys-78 |
| SEQ. ID. NO. 31855 | 85-LeuAlaValAlaGlnProIleAspProIleGluSerValArgGlnTyrVal-101 |
| SEQ. ID. NO. 31856 | 116-LysAlaValGlyGlnAlaPhe-122 |

Antigenic Index - Jameson-Wolf

| | |
|---|---|
| SEQ. ID. NO. 31857 | 1-MetLysLysIleLeu-5 |
| SEQ. ID. NO. 31858 | 22-IleProAspSerLysThrAlaPro-29 |
| SEQ. ID. NO. 31859 | 35-AspLeuHisGlyLysThrValSerAsnAlaAspLeuGlnGly-48 |
| SEQ. ID. NO. 31860 | 59-SerCysProGlyCys-63 |
| SEQ. ID. NO. 31861 | 66-GluMetProLysValThrLysThrAlaAsnAspTyrLysAsnLysAspPhe-82 |
| SEQ. ID. NO. 31862 | 90-ProIleAspProIleGluSerValArgGlnTyrValLysAspTyrGly-105 |
| SEQ. ID. NO. 31863 | 113-AspAlaAspLysAlaVal-118 |
| SEQ. ID. NO. 31864 | 133-IleGlyLysLysGlyGluIleLeu-140 |
| SEQ. ID. NO. 31865 | 144-ValGlyGluProAspPheGlyLysLeuTyrGlnGluIleAspThr-158 |

Hydrophilic Regions - Hopp-Woods

| | |
|---|---|
| SEQ. ID. NO. 31866 | 1-MetLysLysIleLeu-5 |
| SEQ. ID. NO. 31867 | 23-ProAspSerLysThr-27 |
| SEQ. ID. NO. 31868 | 66-GluMetProLysValThrLysThrAlaAsnAspTyrLysAsnLysAspPhe-82 |
| SEQ. ID. NO. 31869 | 92-AspProIleGluSerValArgGlnTyrValLys-102 |
| SEQ. ID. NO. 31870 | 113-AspAlaAspLysAlaVal-118 |
| SEQ. ID. NO. 31871 | 133-IleGlyLysLysGlyGluIle-139 | g547

TABLE 1-continued

```
AMPHI Regions - AMPHI
SEQ. ID. NO. 31872    7-PheAsnLysThrValAlaSerPheAlaGlnIleValGluThrPheAspVal-23
SEQ. ID. NO. 31873    62-AsnArgSerPheLys-66
SEQ. ID. NO. 31874    120-GluLeuLeuThrIleLeuValLys-127
Antigenic Index - Jameson-Wolf
SEQ. ID. NO. 31875    3-ValAspAsnGlyPheAsnLysThrVal-11
SEQ. ID. NO. 31876    35-GlnMetLysGlnArgCysGly-41
SEQ. ID. NO. 31877    56-CysGlyPheGluIleProAsnArgSerPheLysGlu-67
SEQ. ID. NO. 31878    76-LeuSerGluArgPheArgThrAsnAlaGluValGluMet-88
SEQ. ID. NO. 31879    128-AsnLeuSerProAsnGlyLysLysArgPhe-137
Hydrophilic Regions - Hopp-Woods
SEQ. ID. NO. 31880    36-MetLysGlnArgCys-40
SEQ. ID. NO. 31881    60-IleProAsnArgSerPheLysGlu-67
SEQ. ID. NO. 31882    76-LeuSerGluArgPheArgThrAsnAlaGluValGluMet-88
SEQ. ID. NO. 31883    129-LeuSerProAsnGlyLysLysArgPhe-137
g548
AMPHI Regions - AMPHI
SEQ. ID. NO. 31884    7-SerPheLeuValLeuAlaAlaLeuAlaAlaCysLys-22
SEQ. ID. NO. 31885    31-AlaAlaSerSerSer-35
SEQ. ID. NO. 31886    41-AlaGluAsnAlaAlaLysPro-47
SEQ. ID. NO. 31887    89-PheThrHisCysProAspValCysProThr-98
SEQ. ID. NO. 31888    103-TyrSerAspThrLeuLysGlnLeuGlyGlyGln-113
SEQ. ID. NO. 31889    132-GluIleIleGlyLysTyrAlaLys-139
Antigenic Index - Jameson-Wolf
SEQ. ID. NO. 31890    22-LysProGlnAspAsnSerAla-28
SEQ. ID. NO. 31891    33-SerSerSerAlaSer-37
SEQ. ID. NO. 31892    39-ProAlaAlaGluAsnAlaAlaLysProGlnThrArgGlyThrAspMetArgLysGluAspIleGlyGlyAspPheThrLeuThrAspGlyGluGly
                      LysProPheSer-74
SEQ. ID. NO. 31893    76-SerAspLeuLysGly-80
SEQ. ID. NO. 31894    93-ProAspValCysPro-97
SEQ. ID. NO. 31895    104-SerAspThrLeuLysGlnLeuGlyGlyGlnAlaLysAspValLys-118
SEQ. ID. NO. 31896    124-IleAspProGluArgAspThrProGluIleIleGlyLysTyrAlaLysGlnPheAsnProAspPhe-145
SEQ. ID. NO. 31897    150-AlaThrGlyGlyGln-154
SEQ. ID. NO. 31898    169-LysIleAsnGlnLysAspAspSerGluAsnTyrLeu-180
SEQ. ID. NO. 31899    189-LeuIleAspLysAsnGlyGlu-195
SEQ. ID. NO. 31900    200-SerProTyrGlySerGluProGluThrIleAlaAlaAspVal-213
Hydrophilic Regions - Hopp-Woods
SEQ. ID. NO. 31901    22-LysProGlnAspAsnSerAla-28
SEQ. ID. NO. 31902    39-ProAlaAlaGluAsnAlaAlaLysProGlnThrArgGlyThrAspMetArgLysGluAspIleGlyGly-61
SEQ. ID. NO. 31903    64-ThrLeuThrAspGlyGluGlyLysPro-72
SEQ. ID. NO. 31904    76-SerAspLeuLysGly-80
SEQ. ID. NO. 31905    111-GlyGlyGlnAlaLysAspValLys-118
SEQ. ID. NO. 31906    124-IleAspProGluArgAspThrProGluIleIle-134
SEQ. ID. NO. 31907    170-IleAsnGlnLysAspAspSerGluAsnTyrLeu-180
SEQ. ID. NO. 31908    191-AspLysAsnGlyGlu-195
SEQ. ID. NO. 31909    203-GlySerGluProGluThrIleAlaAlaAspVal-213
g553
AMPHI Regions - AMPHI
SEQ. ID. NO. 31910    31-LeuAlaAlaValAlaGlyPheTyrGlyPheTyrThrAspLeu-44
SEQ. ID. NO. 31911    59-AsnLeuAlaAspIleValArgPheAlaAspAsp-69
SEQ. ID. NO. 31912    83-GluLeuGlySerLeu-87
SEQ. ID. NO. 31913    99-HisPheValValLeu-103
SEQ. ID. NO. 31914    162-GlyIleSerGlyLeuGlyArgThrLeuPhe-171
SEQ. ID. NO. 31915    173-LeuLeuAlaLeuAlaAlaAlaMetGluValPheAlaPheLeu-186
SEQ. ID. NO. 31916    232-HisAspIleTyrSerLeuProProPro-240
Antigenic Index - Jameson-Wolf
SEQ. ID. NO. 31917    11-LeuThrLysLysLeu-15
SEQ. ID. NO. 31918    45-ArgAlaLeuArgSerLysTyr-51
SEQ. ID. NO. 31919    55-LeuLysGlyGluAsnLeuAlaAsp-62
SEQ. ID. NO. 31920    75-ArgAlaLeuArgLeuAspLeuAspGluLeuGlySer-86
SEQ. ID. NO. 31921    106-ValSerSerAspGly-110
SEQ. ID. NO. 31922    115-AspProAlaSerGlyArgArgLysValLysThrGluGluIleSerArgLysPheThr-133
SEQ. ID. NO. 31923    140-TrpProAsnThrArgPheGluAlaGlyGluGluLysGlnGluIleArg-155
SEQ. ID. NO. 31924    163-IleSerGlyLeuGly-167
SEQ. ID. NO. 31925    192-LysIleGlyArgGlyGluSer-198
SEQ. ID. NO. 31926    202-IleGlyArgSerGlyCysGlyLysSerThrLeu-212
SEQ. ID. NO. 31927    216-LeuSerGlyAsnLeuProProGluSerGlyLysVal-227
SEQ. ID. NO. 31928    245-PheGluCysAspGlyGlnGlyArgThr-253
SEQ. ID. NO. 31929    258-GlyLeuAsnLeuAsnArg-263
Hydrophilic Regions - Hopp-Woods
SEQ. ID. NO. 31930    11-LeuThrLysLysLeu-15
SEQ. ID. NO. 31931    45-ArgAlaLeuArgSer-49
SEQ. ID. NO. 31932    55-LeuLysGlyGluAsnLeuAlaAsp-62
SEQ. ID. NO. 31933    75-ArgAlaLeuArgLeuAspLeuAspGluLeuGlySer-86
SEQ. ID. NO. 31934    106-ValSerSerAspGly-110
SEQ. ID. NO. 31935    116-ProAlaSerGlyArgArgLysValLysThrGluGluIleSerArgLysPheThr-133
SEQ. ID. NO. 31936    144-ArgPheGluAlaGlyGluGluLysGlnGluIleArg-155
SEQ. ID. NO. 31937    192-LysIleGlyArgGlyGluSer-198
SEQ. ID. NO. 31938    205-SerGlyCysGlyLys-209
```

TABLE 1-continued

| SEQ. ID. NO. 31939 | 220-LeuProProGluSerGlyLys-226 |
| SEQ. ID. NO. 31940 | 245-PheGluCysAspGlyGlnGly-251 | g554
AMPHI Regions - AMPHI
| SEQ. ID. NO. 31941 | 35-AlaProThrLeuGlnThrProGluThrLeu-44 |
| SEQ. ID. NO. 31942 | 71-AlaAlaLeuThrGlnLeuMet-77 |
| SEQ. ID. NO. 31943 | 110-ArgMetPheValArgProGlyAspThrVal-119 |
| SEQ. ID. NO. 31944 | 124-LeuLeuLysGlyMetIleAla-130 |
| SEQ. ID. NO. 31945 | 141-AlaAspArgLeuGlyAsnGlySerIleGluAsnPheValGlnGlnMetAsnLysGlu-159 |
| SEQ. ID. NO. 31946 | 193-GluAlaLeuMetArgAspPheProGluTyrTyrProLeuPheSer-207 |
| SEQ. ID. NO. 31947 | 280-ArgAlaLeuGlnAlaPheAspThrPro-288 |
| SEQ. ID. NO. 31948 | 296-ThrValAlaGlnIle-300 |
| SEQ. ID. NO. 31949 | 331-GluGlnIleLeuGluThrIleGlnProIleProAla-342 |

Antigenic Index - Jameson-Wolf
| SEQ. ID. NO. 31950 | 24-SerProAlaProAsnArgProThr-31 |
| SEQ. ID. NO. 31951 | 37-ThrLeuGlnThrProGluThr-43 |
| SEQ. ID. NO. 31952 | 53-LeuGlnSerArgGlnThrLeuSerAlaLysAsnThrAsnThrProValGlu-69 |
| SEQ. ID. NO. 31953 | 84-LysAsnMetLysSerGlyAsnIleGlnSerGluGluAsnLeuLysIleProGlu-101 |
| SEQ. ID. NO. 31954 | 104-TrpAlaSerGluGlySerArgMetPheValArgProGlyAspThrValSerThrAspLysLeuLeu-125 |
| SEQ. ID. NO. 31955 | 142-AspArgLeuGlyAsnGlySerIleGluAsnPhe-152 |
| SEQ. ID. NO. 31956 | 156-MetAsnLysGluAlaArgArgLeuGlyMetLysAsnThrValPheLysAsnProThrGlyLeuGlyArgGluGlyGlnValSerThrAlaLysAspLeuSerLeu-190 |
| SEQ. ID. NO. 31957 | 194-AlaLeuMetArgAspPheProGluTyrTyr-203 |
| SEQ. ID. NO. 31958 | 214-GluAsnIleGluGlnAsnAsnArgAsnIleLeu-224 |
| SEQ. ID. NO. 31959 | 226-TyrArgAspAsnAsnValAsnGlyLeuLysAlaGlyHisThrGluSerGlyGlyTyr-244 |
| SEQ. ID. NO. 31960 | 250-TyrSerGlyAsnGlyArgHis-256 |
| SEQ. ID. NO. 31961 | 262-LeuGlySerGluSerAlaGluThrArgAlaSerAspAsnSerLysLeuLeuAsn-279 |
| SEQ. ID. NO. 31962 | 286-AspThrProLysIleTyrProLysGlyLysThr-296 |
| SEQ. ID. NO. 31963 | 302-IleSerGlyGlySerLysLysThrValArg-311 |
| SEQ. ID. NO. 31964 | 323-ProHisLysGluAlaLysMetAlaGluGlnIleLeu-334 |
| SEQ. ID. NO. 31965 | 342-AlaProValLysLysGlyGlnIleLeuGlyLysIleLysIleArgGlnAsnGlyHisThrIleAlaGluLysGluIleValAla-369 |
| SEQ. ID. NO. 31966 | 371-GluAsnValGluLysArgSerArgTrpGlnArgLeu-382 |

Hydrophilic Regions - Hopp-Woods
| SEQ. ID. NO. 31967 | 26-AlaProAsnArgProThr-31 |
| SEQ. ID. NO. 31968 | 57-GlnThrLeuSerAlaLysAsnThrAsnThrProValGlu-69 |
| SEQ. ID. NO. 31969 | 85-AsnMetLysSerGlyAsnIleGlnSerGluGluAsnLeuLysIleProGlu-101 |
| SEQ. ID. NO. 31970 | 107-GluGlySerArgMetPheValArgProGlyAspThrValSerThrAspLysLeuLeu-125 |
| SEQ. ID. NO. 31971 | 156-MetAsnLysGluAlaArgArgLeuGlyMet-165 |
| SEQ. ID. NO. 31972 | 174-ThrGlyLeuGlyArgGluGlyGlnValSerThrAlaLysAspLeuSerLeu-190 |
| SEQ. ID. NO. 31973 | 214-GluAsnIleGluGlnAsnAsnArg-221 |
| SEQ. ID. NO. 31974 | 227-ArgAspAsnAsnValAsn-232 |
| SEQ. ID. NO. 31975 | 237-GlyHisThrGluSerGly-242 |
| SEQ. ID. NO. 31976 | 264-SerGluSerAlaGluThrArgAlaSerAspAsnSerLysLeuLeuAsn279 |
| SEQ. ID. NO. 31977 | 289-LysIleTyrProLysGlyLysThr-296 |
| SEQ. ID. NO. 31978 | 304-GlyGlySerLysLysThrValArg-311 |
| SEQ. ID. NO. 31979 | 323-ProHisLysGluAlaLysMetAlaGluGlnIleLeu-334 |
| SEQ. ID. NO. 31980 | 343-ProValLysLysGlyGlnIle-349 |
| SEQ. ID. NO. 31981 | 353-IleLysIleArgGlnAsnGly-359 |
| SEQ. ID. NO. 31982 | 362-IleAlaGluLysGluIleValAla-369 |
| SEQ. ID. NO. 31983 | 371-GluAsnValGluLysArgSerArgTrp-379 | g556
AMPHI Regions - AMPHI
| SEQ. ID. NO. 31984 | 61-IleGluArgLeuLys-65 |

Antigenic Index - Jameson-Wolf
| SEQ. ID. NO. 31985 | 1-MetAspAsnLysThrLysLeuArgLeu-9 |
| SEQ. ID. NO. 31986 | 52-ThrSerArgArgGlnGlnArgGlnPheIleGluArgLeuLysLysPheAspIleAspProGluLysGlyArgIleAsnGluAlaAsnLeuArgArgMetTyrHisSerGlyGlyGlnHisGlnLysAspAla-95 |
| SEQ. ID. NO. 31987 | 102-SerGlnLysCysSerValAspGluAlaHisAlaMetPheLysLysArgProThrArgGlnGluIleAsn-124 |
| SEQ. ID. NO. 31988 | 127-AlaAlaLysGlnSerArgGlyGlnLysArgProHisArg-139 |

Hydrophilic Regions - Hopp-Woods
| SEQ. ID. NO. 31989 | 1-MetAspAsnLysThrLysLeuArgLeu-9 |
| SEQ. ID. NO. 31990 | 53-SerArgArgGlnGlnArgGlnPheIleGluArgLeuLysLysPheAspIleAspProGluLysGlyArgIleAsnGluAlaAsnLeuArgArgMetTyr-85 |
| SEQ. ID. NO. 31991 | 90-GlnHisGlnLysAspAla-95 |
| SEQ. ID. NO. 31992 | 105-CysSerValAspGluAlaHisAlaMetPheLysLysArgProThrArgGlnGluIleAsn-124 |
| SEQ. ID. NO. 31993 | 127-AlaAlaLysGlnSerArgGlyGlnLysArgProHisArg-139 | g557
AMPHI Regions - AMPHI
| SEQ. ID. NO. 31994 | 22-GlyAlaAspGlyIle-26 |
| SEQ. ID. NO. 31995 | 55-SerGlyArgValAspAspAlaAla-62 |
| SEQ. ID. NO. 31996 | 113-ThrValSerValArgArgIleLeuAspTyrAlaAsp-124 |
| SEQ. ID. NO. 31997 | 142-ArgGlnAspValAlaGluGlnIle-149 |

Antigenic Index - Jameson-Wolf
| SEQ. ID. NO. 31998 | 20-LeuLysGlyAlaAspGlyIleSerProProLeuThrTyrArgSerTrpHisIleGluGlyGlyGlnAlaLeu-43 |
| SEQ. ID. NO. 31999 | 54-AlaSerGlyArgValAspAspAlaAlaGly-63 |
| SEQ. ID. NO. 32000 | 68-LeuArgIleAspSerValSerGlnAsnLysGluThrTyrThr-81 |
| SEQ. ID. NO. 32001 | 100-GlnValLeuLysArgGlyGluProValGlyLysProMet-112 |
| SEQ. ID. NO. 32002 | 118-ArgIleLeuAspTyrAlaAspAsnGluIleLeuGlyLysGlnGluGluGluGluThrLeu-137 |
| SEQ. ID. NO. 32003 | 141-MetArgGlnAspValAlaGluGlnIleValArg-151 |

TABLE 1-continued

Hydrophilic Regions - Hopp-Woods
SEQ. ID. NO. 32004    21-LysGlyAlaAspGlyIle-26
SEQ. ID. NO. 32005    56-GlyArgValAspAspAlaAlaGly-63
SEQ. ID. NO. 32006    68-LeuArgIleAspSerValSerGlnAsnLysGluThrTyrThr-81
SEQ. ID. NO. 32007    100-GlnValLeuLysArgGlyGluProValGly-109
SEQ. ID. NO. 32008    126-GluIleLeuGlyLysGlnGluGluGluGluThrLeu-137
SEQ. ID. NO. 32009    141-MetArgGlnAspValAlaGluGlnIleValArg-151
g560
AMPHI Regions - AMPHI
SEQ. ID. NO. 32010    30-PheArgAspGlyAlaHisLysMetAlaArgValTrpValGly-43
SEQ. ID. NO. 32011    167-ArgMetAlaLysMetPhe-172
SEQ. ID. NO. 32012    192-PheLeuLysTyrProGlyGlu-198
SEQ. ID. NO. 32013    216-GluLeuMetGluLysCysGluHisLeuIleGlu-226
Antigenic Index - Jameson-Wolf
SEQ. ID. NO. 32014    29-ProPheArgAspGlyAlaHisLysMet-37
SEQ. ID. NO. 32015    63-GluHisIleProAspArgProSer-70
SEQ. ID. NO. 32016    75-LysHisGlnSerGlyTrpGlu-81
SEQ. ID. NO. 32017    95-ValAlaLysArgGluLeuPhe-101
SEQ. ID. NO. 32018    116-IleGlyIleAspArgAsnAsnArgArgGluAlaAsnGluGlnLeuIle-131
SEQ. ID. NO. 32019    134-GlyLeuAlaArgLysAsnGluGlyTyr-142
SEQ. ID. NO. 32020    148-ProGluGlyThrArgLeuAlaProGlyLysArgGlyLysTyrLysLeuGlyGly-165
SEQ. ID. NO. 32021    182-AsnSerGlyGluPheTrpProLysAsnSerPheLeuLysTyrProGlyGluIle-199
SEQ. ID. NO. 32022    209-HisAlaSerGlySerGluAlaGluLeuMetGluLysCysGluHisLeuIle-225
SEQ. ID. NO. 32023    242-MetProSerGluThr-246
Hydrophilic Regions - Hopp-Woods
SEQ. ID. NO. 32024    29-ProPheArgAspGlyAlaHisLysMet-37
SEQ. ID. NO. 32025    64-HisIleProAspArgProSer-70
SEQ. ID. NO. 32026    95-ValAlaLysArgGluLeuPhe-101
SEQ. ID. NO. 32027    116-IleGlyIleAspArgAsnAsnArgArgGluAlaAsnGluGlnLeuIle-131
SEQ. ID. NO. 32028    134-GlyLeuAlaArgLysAsnGlu-140
SEQ. ID. NO. 32029    149-GluGlyThrArgLeuAlaProGlyLysArgGlyLysTyrLysLeuGlyGly-165
SEQ. ID. NO. 32030    211-SerGlySerGluAlaGluLeuMetGluLysCysGluHisLeuIle-225
SEQ. ID. NO. 32031    242-MetProSerGluThr-246
g561-2
AMPHI Regions - AMPHI
SEQ. ID. NO. 32032    6-ArgPheSerAspGly-10
SEQ. ID. NO. 32033    22-GlyLeuTrpValGlyLeuAlaAla-29
SEQ. ID. NO. 32034    46-AlaSerValIleGluGluAlaGlyAsn-54
SEQ. ID. NO. 32035    74-GlnIleAspAsnGlnIleAlaGluPheGluLysSerLeuLysArgIleSerGlnSerAsp-93
SEQ. ID. NO. 32036    128-AlaTyrArgArgProThrGlnIle-135
SEQ. ID. NO. 32037    188-ValIleArgProLeuGlnAlaLeuArgGluGlyAlaGluArgIleGly-203
SEQ. ID. NO. 32038    219-PheLysGlnValGlyArgCysPheAsnGln-228
SEQ. ID. NO. 32039    237-TyrAspAspLeuGluGlyGln-243
SEQ. ID. NO. 32040    247-GlnThrHisAsnLeuGluLysGln-254
SEQ. ID. NO. 32041    263-ArgThrThrArgAspLeuHisGlnSerTyr-272
SEQ. ID. NO. 32042    276-GlnAlaAlaGluGluPheLeuAsnHisIleLeuPro-287
SEQ. ID. NO. 32043    358-GlnThrLeuIleArgGlnLeuGly-365
SEQ. ID. NO. 32044    391-GlnGlyLeuHisAspSerIleAlaGlnAlaLeuThr-402
SEQ. ID. NO. 32045    433-GlyValGlnGluCysTyrGluAspValArgGluLeu-444
SEQ. ID. NO. 32046    455-LysGluPheProGluAlaValAlaAspLeuPheAlaArgPhe-468
SEQ. ID. NO. 32047    503-LeuSerAsnIleArgLysHisAlaArg-511
SEQ. ID. NO. 32048    539-ThrGluLysIleGlyGluProThr-546
Antigenic Index - Jameson-Wolf
SEQ. ID. NO. 32049    4-ProThrArgPheSerAspGlyIlePro-12
SEQ. ID. NO. 32050    48-ValIleGluGluAlaGlyAsn-54
SEQ. ID. NO. 32051    66-AlaGlyGluGlySerProArgAlaGlnIleAspAsnGlnIleAlaGluPheGluLysSerLeuLysArgIleSerGlnSerAspAlaIleHis-96
SEQ. ID. NO. 32052    99-IleProSerAspAsnProLeuAla-106
SEQ. ID. NO. 32053    124-ProProLeuGlnAlaTyrArgArgProThrGlnIleGluLeu-137
SEQ. ID. NO. 32054    152-GluAsnAlaGlyGluLysAsnThrTrpTrp-161
SEQ. ID. NO. 32055    193-GlnAlaLeuArgGluGlyAlaGluArgIleGlyGlnArgHisPheAspIleProValProGluAspGlyThrProGluPheLysGlnValGlyArgCysPheAsn-227
SEQ. ID. NO. 32056    235-ThrLeuTyrAspAspLeuGluGlyGlnValAlaGluGlnThrHisAsnLeuGluLysGlnAsnArgAsnLeu-258
SEQ. ID. NO. 32057    263-ArgThrThrArgAspLeuHisGlnSerTyrThrProArgGlnAlaAlaGluGluPhe-281
SEQ. ID. NO. 32058    291-AlaGlnSerGlyAsn-295
SEQ. ID. NO. 32059    297-CysLeuGluAsnGlySerAspThrAspIle-306
SEQ. ID. NO. 32060    310-ThrAlaGluHisGlyLysLysProProLeuGluLysTyrHisAspGluThrPhe-327
SEQ. ID. NO. 32061    331-TyrGlnAsnGluLysLeuGly-337
SEQ. ID. NO. 32062    342-GlyPheSerAspGlyThrSerLeuThrGlyAspAspArgThrLeu-356
SEQ. ID. NO. 32063    370-GlyAlaLysGlnGluGluGluLysArgLeu-379
SEQ. ID. NO. 32064    383-LeuGlnGluArgAsnLeu-388
SEQ. ID. NO. 32065    393-LeuHisAspSerIle-397
SEQ. ID. NO. 32066    414-AlaPheAlaGluAsnLysArgGluAlaAlaGlu-425
SEQ. ID. NO. 32067    433-GlyValGlnGluCysTyrGluAspValArgGlu-443
SEQ. ID. NO. 32068    449-ArgThrLysIleSerAsnLysGluPheProGluAlaVal-461
SEQ. ID. NO. 32069    480-TrpGluAsnGlySer-484
SEQ. ID. NO. 32070    487-ProThrGlnAspGluGlnLeu-493
SEQ. ID. NO. 32071    502-SerLeuSerAsnIleArgLysHisAlaArg-511
SEQ. ID. NO. 32072    520-SerGluTyrGlyGlyArgPhe-526
SEQ. ID. NO. 32073    530-IleGlnAspAsnGlyGlnGlyPheAspThrGluLysIleGlyGluProThrGlySerHis-549
SEQ. ID. NO. 32074    555-MetGlnGluArgAlaLysArgIleArgAla-564

TABLE 1-continued

| | |
|---|---|
| SEQ. ID. NO. 32075 | 566-LeuGluIleArgSerGlnAlaGlnGlnGlyThr-576 |
| SEQ. ID. NO. 32076 | 581-ThrGlyAlaProLysGluSerLeuPro-589 |

Hydrophilic Regions - Hopp-Woods

| | |
|---|---|
| SEQ. ID. NO. 32077 | 48-ValIleGluGluAlaGlyAsn-54 |
| SEQ. ID. NO. 32078 | 68-GluGlySerProArgAlaGlnIle-75 |
| SEQ. ID. NO. 32079 | 78-GlnIleAlaGluPheGluLysSerLeuLysArgIleSerGln-91 |
| SEQ. ID. NO. 32080 | 128-AlaTyrArgArgProThrGln-134 |
| SEQ. ID. NO. 32081 | 152-GluAsnAlaGlyGluLys-157 |
| SEQ. ID. NO. 32082 | 193-GlnAlaLeuArgGluGlyAlaGluArgIleGlyGlnArgHisPhe-207 |
| SEQ. ID. NO. 32083 | 210-ProValProGluAspGlyThrProGluPheLysGlnValGly-223 |
| SEQ. ID. NO. 32084 | 235-ThrLeuTyrAspAspLeuGluGlyGlnValAlaGluGlnThrHisAsnLeuGluLysGlnAsnArg-256 |
| SEQ. ID. NO. 32085 | 264-ThrThrArgAspLeuHis-269 |
| SEQ. ID. NO. 32086 | 276-GlnAlaAlaGluGluPhe-281 |
| SEQ. ID. NO. 32087 | 300-AsnGlySerAspThrAspIle-306 |
| SEQ. ID. NO. 32088 | 312-GluHisGlyLysLysProProLeuGluLysTyrHisAspGluThrPhe-327 |
| SEQ. ID. NO. 32089 | 331-TyrGlnAsnGluLysLeuGly-337 |
| SEQ. ID. NO. 32090 | 347-ThrSerLeuThrGlyAspAspArgThrLeu-356 |
| SEQ. ID. NO. 32091 | 370-GlyAlaLysGlnGluGluGluLysArgLeu-379 |
| SEQ. ID. NO. 32092 | 383-LeuGlnGluArgAsnLeu-388 |
| SEQ. ID. NO. 32093 | 414-AlaPheAlaGluAsnLysArgGluGluAlaAlaGlu-425 |
| SEQ. ID. NO. 32094 | 436-GluCysTyrGluAspValArgGlu-443 |
| SEQ. ID. NO. 32095 | 450-ThrLysIleSerAsnLysGluPheProGluAlaVal-461 |
| SEQ. ID. NO. 32096 | 488-ThrGlnAspGluGlnLeu-493 |
| SEQ. ID. NO. 32097 | 502-SerLeuSerAsnIleArgLysHisAlaArg-511 |
| SEQ. ID. NO. 32098 | 532-AspAsnGlyGlnGlyPheAspThrGluLysIleGlyGluProThrGly-547 |
| SEQ. ID. NO. 32099 | 555-MetGlnGluArgAlaLysArgIleArgAla-564 |
| SEQ. ID. NO. 32100 | 566-LeuGluIleArgSerGlnAlaGln-573 |
| SEQ. ID. NO. 32101 | 582-GlyAlaProLysGluSerLeuPro-589 | g562
AMPHI Regions - AMPHI

| | |
|---|---|
| SEQ. ID. NO. 32102 | 48-TrpSerLeuValSerAlaTrpMetValValIle-58 |
| SEQ. ID. NO. 32103 | 84-LeuGluThrThrValMetSerAlaValArgThrLeu-95 |
| SEQ. ID. NO. 32104 | 97-PheThrProTyrThrThrValAlaSerThrSer-107 |
| SEQ. ID. NO. 32105 | 116-ThrPhePheAlaProLeuSerArgTrp-124 |
| SEQ. ID. NO. 32106 | 133-AsnAlaProValHisSerMetThrLysSerThrProSerSerPheHis-148 |
| SEQ. ID. NO. 32107 | 184-ValSerAsnLeuValArgTrpAlaLeu-192 |

Antigenic Index - Jameson-Wolf

| | |
|---|---|
| SEQ. ID. NO. 32108 | 9-PheAsnSerGlyLysThrLysPro-16 |
| SEQ. ID. NO. 32109 | 32-ProLeuArgAlaArgArgArgSerLeuTrpArg-42 |
| SEQ. ID. NO. 32110 | 72-AlaThrGlyGluArgGlnLeuVal-79 |
| SEQ. ID. NO. 32111 | 105-SerThrSerSerProProGlyAlaGluMet-114 |
| SEQ. ID. NO. 32112 | 139-MetThrLysSerThrProSerSerPheHisGlySerSerAla-152 |
| SEQ. ID. NO. 32113 | 154-LeuArgValGluLysLysGlyIleLeuSerProLeuThr-166 |
| SEQ. ID. NO. 32114 | 168-ArgLeuProProSerTrpAspThrSerAlaSerLysArgProCysThr-183 |

Hydrophilic Regions - Hopp-Woods

| | |
|---|---|
| SEQ. ID. NO. 32115 | 11-SerGlyLysThrLysPro-16 |
| SEQ. ID. NO. 32116 | 33-LeuArgAlaArgArgArgSerLeuTrp-41 |
| SEQ. ID. NO. 32117 | 72-AlaThrGlyGluArgGlnLeuVal-79 |
| SEQ. ID. NO. 32118 | 110-ProGlyAlaGluMet-114 |
| SEQ. ID. NO. 32119 | 140-ThrLysSerThrPro-144 |
| SEQ. ID. NO. 32120 | 154-LeuArgValGluLysLysGlyIle-161 |
| SEQ. ID. NO. 32121 | 176-SerAlaSerLysArgProCysThr-183 |

563g
AMPHI Regions - AMPHI

| | |
|---|---|
| SEQ. ID. NO. 32122 | 24-ThrLysArgGluGlyLysSerCys-31 |
| SEQ. ID. NO. 32123 | 115-AsnGlnTyrAlaGlnPhe-120 |
| SEQ. ID. NO. 32124 | 159-ValAsnGlnIleAsnSerSerHisProSerGlnLeuAsnGlyTyrIleGlu-175 |
| SEQ. ID. NO. 32125 | 292-AlaAlaAsnValGlnAspMetAsnAsnThrAla-302 |
| SEQ. ID. NO. 32126 | 332-IleGlnAsnThrGlyLysLeuLeuSerAlaGly-342 |
| SEQ. ID. NO. 32127 | 457-AspAsnAlaValGlnGly-462 |
| SEQ. ID. NO. 32128 | 495-GlnMetAsnAsnIleGlyThr-501 |
| SEQ. ID. NO. 32129 | 571-AlaGlnArgIleHisAsnAlaGly-578 |
| SEQ. ID. NO. 32130 | 594-LeuHisAsnThrAsnGlu-599 |
| SEQ. ID. NO. 32131 | 616-TyrGluAlaPheGlyArg-621 |
| SEQ. ID. NO. 32132 | 642-SerAspHisLeuArgThrProAspGlyValAlaHisGluAsnTrp-656 |
| SEQ. ID. NO. 32133 | 673-ThrAlaProAlaLysIle-678 |
| SEQ. ID. NO. 32134 | 729-GlyLysLeuHisAsnTyrTrpArg-736 |
| SEQ. ID. NO. 32135 | 756-GluGluIleThrArg-760 |
| SEQ. ID. NO. 32136 | 771-SerHisSerLysAlaLeu-776 |
| SEQ. ID. NO. 32137 | 809-ProAsnSerPheThrProLeuPro-816 |
| SEQ. ID. NO. 32138 | 861-LeuHisLysArgLeuGlyAspGlyTyr-869 |
| SEQ. ID. NO. 32139 | 877-GluGlnIleAlaGluLeuThrGlyHisArgArgLeuAspGlyTyrGlnAsn-893 |
| SEQ. ID. NO. 32140 | 899-LysAlaLeuMetAsp-903 |
| SEQ. ID. NO. 32141 | 1002-ThrLeuAspAsnIleGlyGly-1008 |
| SEQ. ID. NO. 32142 | 1019-AlaThrGlnAspIleAsnAsnIleGlyGlyIleLeu-1030 |
| SEQ. ID. NO. 32143 | 1051-LysSerSerGlnAsn-1055 |
| SEQ. ID. NO. 32144 | 1106-GlnAlaGlyArgAspIle-1111 |
| SEQ. ID. NO. 32145 | 1135-GlySerThrAsnGluValGlySerSer-1143 |
| SEQ. ID. NO. 32146 | 1191-ValAspAspAlaSerLysHisThrGlyArg-1200 |
| SEQ. ID. NO. 32147 | 1215-SerHisHisGluThr-1219 |

TABLE 1-continued

| | |
|---|---|
| SEQ. ID. NO. 32148 | 1254-GlnAlaGlyAsnHisVal-1259 |
| SEQ. ID. NO. 32149 | 1269-GlnSerGluThrTyrHisGln-1275 |
| SEQ. ID. NO. 32150 | 1326-TyrGluGlnThrGly-1330 |
| SEQ. ID. NO. 32151 | 1388-SerThrGlnSerSerLysGlnVal-1395 |
| SEQ. ID. NO. 32152 | 1416-TyrGlnThrGlyLysGlyAlaGlnAsnLeuAlaAsnGlyThrThrAsn-1431 |
| SEQ. ID. NO. 32153 | 1508-GluGlnSerAsnThrGluArgSerGln-1516 |
| SEQ. ID. NO. 32154 | 1542-GlyGlyAsnValGlyLysGlyTyr-1549 |
| SEQ. ID. NO. 32155 | 1692-SerAspIleGlnAsnTyrSerGln-1699 |
| SEQ. ID. NO. 32156 | 1718-LeuGlyGlnGlyAlaLys-1723 |
| SEQ. ID. NO. 32157 | 1761-IleAsnThrProLysAsnIle-1767 |
| SEQ. ID. NO. 32158 | 1796-ThrAspThrAlaGluArgHisSerGlySerLeuLysAsn-1808 |
| SEQ. ID. NO. 32159 | 1825-ValSerGlnAspPheSerLysAsnValGln-1834 |
| SEQ. ID. NO. 32160 | 1893-IleLeuAsnMetLeuAlaSerGlyLeuAlaGluProThr-1905 |
| SEQ. ID. NO. 32161 | 1925-GlyGlnHisPheLysAspLeuAlaGly-1933 |
| SEQ. ID. NO. 32162 | 1968-ProAlaGlyAlaLeu-1972 |
| SEQ. ID. NO. 32163 | 2006-SerAlaIleThrArgMetLeuGlyThrAla-2015 |
| SEQ. ID. NO. 32164 | 2032-PheGlnThrAlaSerAspPheAlaSerSerPheSerTyrProIleAsn-2047 |
| Antigenic Index - Jameson-Wolf | |
| SEQ. ID. NO. 32165 | 1-MetAsnLysThrLeu-5 |
| SEQ. ID. NO. 32166 | 9-IlePheAsnArgLysArgGlyAlaVal-17 |
| SEQ. ID. NO. 32167 | 22-GluThrThrLysArgGluGlyLysSerCysAlaAspSerGlySerGlySer-38 |
| SEQ. ID. NO. 32168 | 48-ProThrHisSerLys-52 |
| SEQ. ID. NO. 32169 | 78-IleIleThrAspLysAlaAlaProLysThrGlnGln-89 |
| SEQ. ID. NO. 32170 | 122-ValGlyAsnArgGlyAlaIleLeuAsnAsnSerArgSerAsnThrGlnThr-138 |
| SEQ. ID. NO. 32171 | 147-AsnProTrpLeuThrArgGlyGluAlaArgVal-157 |
| SEQ. ID. NO. 32172 | 162-IleAsnSerSerHisProSerGlnLeuAsnGly-172 |
| SEQ. ID. NO. 32173 | 174-IleGluValGlyGlyArgArgAlaGluVal-183 |
| SEQ. ID. NO. 32174 | 200-AsnAlaSerArgAlaThrLeu-206 |
| SEQ. ID. NO. 32175 | 208-ThrGlyGlnProGlnTyrGlnAlaGlyAspPheSerGlyPheLysIleArgGlnGlyAsnAla-228 |
| SEQ. ID. NO. 32176 | 234-GlyLeuAspAlaArgAspThrAspPhe-242 |
| SEQ. ID. NO. 32177 | 261-AlaGlyIleArgAsnGlnGlyGlnLeu-269 |
| SEQ. ID. NO. 32178 | 279-AspAlaAsnGlyArgLeuValAsn-286 |
| SEQ. ID. NO. 32179 | 296-GlnAspMetAsnAsnThrAlaGluHisLysValAsnIleArg-309 |
| SEQ. ID. NO. 32180 | 311-GlnAlaPheGluAsnSerGlyThrAlaVal-320 |
| SEQ. ID. NO. 32181 | 322-GlnGlnGlyThrGlnIleHis-328 |
| SEQ. ID. NO. 32182 | 330-GlnSerIleGlnAsnThrGlyLysLeu-338 |
| SEQ. ID. NO. 32183 | 340-SerAlaGlyThrGluAspLeuAlaVal-348 |
| SEQ. ID. NO. 32184 | 351-SerLeuAsnAsnGlnAsnGlyGluIleAlaThrAsn-362 |
| SEQ. ID. NO. 32185 | 366-IleIleHisAspGlyGlnGlnSer-373 |
| SEQ. ID. NO. 32186 | 379-AsnThrAsnGlyThrIleGlnSerGlyArgAspValAlaIle-392 |
| SEQ. ID. NO. 32187 | 395-LysSerLeuSerAsnAsnGlyThrLeuAlaAlaAspAsnLysLeuAspIleAlaLeu-413 |
| SEQ. ID. NO. 32188 | 415-AspAspPheTyrValGluArgLysIleValAlaGlyAsnGluLeu-429 |
| SEQ. ID. NO. 32189 | 431-LeuSerThrArgGlySerLeuLysAsnSerHisThr-442 |
| SEQ. ID. NO. 32190 | 444-GlnAlaGlyLysArgIleArgIleLysAlaAsnAsnLeuAspAsn-458 |
| SEQ. ID. NO. 32191 | 463-AsnIleGlnSerGlyGlyThrThrAspIleGlyThrGlnHisAsnLeuThrAsnArgGlyLeuIleAspGlyGlnGlnThrLysIleGln-492 |
| SEQ. ID. NO. 32192 | 513-AlaThrArgLeuAspAsnGlnAspGluAsnGlyThrGly-525 |
| SEQ. ID. NO. 32193 | 529-AlaAlaArgGluAsnLeu-534 |
| SEQ. ID. NO. 32194 | 540-GlnLeuAsnAsnArgGluAsnSerLeu-548 |
| SEQ. ID. NO. 32195 | 559-GlyAlaLeuAspThrAsnAspGlnAlaThrGlyLysAlaGlnArgIleHisAsnAlaGlyAla-579 |
| SEQ. ID. NO. 32196 | 583-AlaAlaGlyLysMetArgLeuGlyValGluLysLeuHisAsnThrAsnGluHisLeuLys-602 |
| SEQ. ID. NO. 32197 | 607-GluThrGlyArgGluArgIleValAsp-615 |
| SEQ. ID. NO. 32198 | 623-GluLeuLeuArgGluGlyThrGlnHis-631 |
| SEQ. ID. NO. 32199 | 638-TyrAsnAsnGluSerAspHisLeuArgThrProAspGlyValAlaHis-653 |
| SEQ. ID. NO. 32200 | 657-HisLysTyrAspTyrGluLysValThrGlnGluThrGlnVal-670 |
| SEQ. ID. NO. 32201 | 680-AlaGlySerAspLeuIleIleAspSerLysAlaValPheAsnSerAspSerArgIle-698 |
| SEQ. ID. NO. 32202 | 707-GlnThrGluLysAspGlyLeuHisAsnGluGlnThrPheGlyGluLysLysValPheSerGluAsnGlyLysLeuHisAsn-733 |
| SEQ. ID. NO. 32203 | 735-TrpArgAlaArgArgLysGlyHisAspGluThrGlyHisArgGluGlnAsnTyrThrLeuProGluGluIleThrArgAspIleSerLeu-764 |
| SEQ. ID. NO. 32204 | 770-GluSerHisSerLysAlaLeuSerArgHisAlaProSerGlnGlyThrGluLeuProGlnSerAsnArgAspAsnIleArgThrAlaLysSerAsnGlyIle-803 |
| SEQ. ID. NO. 32205 | 825-ProAlaAsnLysGlyTyrLeuValGluThrAspProArgPheAlaAsn-840 |
| SEQ. ID. NO. 32206 | 854-LeuLeuLeuAspProAsnAsnLeuHisLysArgLeuGlyAspTyrTyrGluGlnArgLeuIleAsn-876 |
| SEQ. ID. NO. 32207 | 883-ThrGlyHisArgArgLeuAspGlyTyrGlnAsnAspGluGluGlnPheLysAlaLeuMetAspAsnGlyAlaThrAlaAlaArgSerMetAsn-913 |
| SEQ. ID. NO. 32208 | 922-AlaGluGlnAlaAla-926 |
| SEQ. ID. NO. 32209 | 938-LysGluValLysLeuProAspGlyGlyThr-947 |
| SEQ. ID. NO. 32210 | 959-ValLysAsnGlyGlyIleAspGlyLysGly-968 |
| SEQ. ID. NO. 32211 | 982-GlySerLeuLysAsnSerGlyThrIleAlaGlyArgAsnAla-995 |
| SEQ. ID. NO. 32212 | 999-AsnThrAspThrLeuAspAsnIleGlyGly-1008 |
| SEQ. ID. NO. 32213 | 1010-IleHisAlaGlnLysSerAlaVal-1017 |
| SEQ. ID. NO. 32214 | 1040-AlaGlyAsnAsnIleAsnAsnGlnSerThrAlaLysSerSerGlnAsnAlaGlnGlySer-1059 |
| SEQ. ID. NO. 32215 | 1072-ThrGlyLysGluLysGlyVal-1078 |
| SEQ. ID. NO. 32216 | 1083-AlaGlyLysAspIleAsnIle-1089 |
| SEQ. ID. NO. 32217 | 1094-IleSerAsnGlnSerAspGlnGlyGlnThrArgLeuGlnAlaGlyArgAspIleAsnLeuAspThrValGlnThrGlyLysTyrGlnGluIleHisPheAspAlaAspAsnHisThrIleArgGlySerThrAsnGluValGlySerSerIleGlnThrLysGlyAspVal-1150 |
| SEQ. ID. NO. 32218 | 1155-GlyAsnAsnLeuAsnAlaLysAlaAlaGluValGlySerAlaLysGlyThr-1171 |
| SEQ. ID. NO. 32219 | 1175-TyrAlaLysAsnAspIleThrIle-1182 |
| SEQ. ID. NO. 32220 | 1190-GlnValAspAspAlaSerLysHisThrGlyArgSerGlyGlyGlyAsnLys-1206 |
| SEQ. ID. NO. 32221 | 1208-ValIleThrAspLysAlaGlnSerHisHisGluThrAlaGlnSerSerThrPheGluGlyLysGln-1229 |
| SEQ. ID. NO. 32222 | 1233-GlnAlaGlyAsnAspAlaAsn-1239 |
| SEQ. ID. NO. 32223 | 1245-ValIleSerAspAsnGlyThrArgIleGlnAla-1255 |
| SEQ. ID. NO. 32224 | 1262-GlyThrThrGlnThrGlnSerGlnSerGluThrTyrHisGlnThrGlnLysSerGlyLeu-1281 |

TABLE 1-continued

| | |
|---|---|
| SEQ. ID. NO. 32225 | 1291-GlySerLysThrAsnThrGlnGluAsnGlnSerGlnSerAsnGluHisThrGlySerThrValGlySerLeuLysGlyAspThrThrIle-1320 |
| SEQ. ID. NO. 32226 | 1324-LysHisTyrGluGlnThrGlySerAsnValSerSerProGluGlyAsnAsnLeu-1341 |
| SEQ. ID. NO. 32227 | 1354-AsnGlnLeuAsnSerLysThrThrGlnThrTyrGluGlnLysGlyLeu-1369 |
| SEQ. ID. NO. 32228 | 1379-ArgPheGlyThrThrSerAspCysArgSerThrGlnSerLysGlnValGlyGlnSerLysAsnAspArgValAsnAla-1405 |
| SEQ. ID. NO. 32229 | 1415-AlaTyrGlnThrGlyLysGlyAlaGlnAsnLeuAlaAsnGlyThrThrAsnAlaLys-1433 |
| SEQ. ID. NO. 32230 | 1441-TyrGlyGluGlnGlnAsnArgGlnThrThrGln-1451 |
| SEQ. ID. NO. 32231 | 1460-SerGlnIleGlnAlaGlyGlyLysThr-1468 |
| SEQ. ID. NO. 32232 | 1470-LeuTyrCysArgArgCysGlyGluGlnSerAsn-1480 |
| SEQ. ID. NO. 32233 | 1487-GlyValSerGlyArgAlaGlyThr-1494 |
| SEQ. ID. NO. 32234 | 1496-LeuIleAlaAspLysGlnIle-1502 |
| SEQ. ID. NO. 32235 | 1506-SerAlaGluGlnSerAsnThrGluArgSerGlnAsnLysSerAlaGlyTrpAsn-1523 |
| SEQ. ID. NO. 32236 | 1543-GlyAsnValGlyLysGlyTyrGlyTyrGlyAspSerValThrHisArgHisSerHisIleGlyAspLysGlySerGln-1568 |
| SEQ. ID. NO. 32237 | 1572-GlnSerGlyGlyAspThrIleIle-1579 |
| SEQ. ID. NO. 32238 | 1582-AlaGlnValArgGlyLysGlyValGlnValAsnAlaLysAsn-1595 |
| SEQ. ID. NO. 32239 | 1600-SerValGlnAspArgGluThrTyrGlnSerLysGlnGlnAsnAlaGlyAla-1616 |
| SEQ. ID. NO. 32240 | 1626-AlaSerAlaGlyAspTyrSerGlnSerLysIleArgAlaAspHis-1639 |
| SEQ. ID. NO. 32241 | 1641-SerValThrGluGlnSerGlyIleTyrAlaGlyGluAspGlyTyrGln-1656 |
| SEQ. ID. NO. 32242 | 1660-GlyAsnHisThrGlyLeuLysGlyGlyIle-1669 |
| SEQ. ID. NO. 32243 | 1673-SerGlnSerAlaLysAspLysGlyLysAsnArgPheSerThrGlyThrLeuAlaGlySerAspIleGlnAsnTyrSerGlnTyrGluGlyLys SerPheGly-1706 |
| SEQ. ID. NO. 32244 | 1713-ValSerGlyLysThrLeuGlyGlnGlyAlaLysAsnLysProGlnAspLysHisLeu-1731 |
| SEQ. ID. NO. 32245 | 1734-IleAlaAspLysAsnGlyAlaSerSer-1742 |
| SEQ. ID. NO. 32246 | 1745-GlyTyrGlySerAspSerAspSerGlnSerSerIleThrLysSerGlyIleAsnThrProLysAsnIleGlnIleThrAspGluAlaAlaGln-1775 |
| SEQ. ID. NO. 32247 | 1778-LeuThrGlyLysIleAlaAlaGlnThrLysAlaAspIleAspThrAsnValThrThrAspThrAlaGluArgHisSerGlySerLeuLysAsn IlePheAspLysAspArgValGlnSerAsnGluLeuAspLeuGlnArgThrValSerGlnAspPheSerLysAsnValGlnGlnThrAsnThrGluIle-1840 |
| SEQ. ID. NO. 32248 | 1842-GlnHisLeuAspLysLeuLysAlaAspLysGluAlaAlaGluThrAlaAla-1858 |
| SEQ. ID. NO. 32249 | 1863-AlaAsnGlyAspMetGluThrAlaLysArgLysAlaHisGluAlaGlnAspAlaAlaAlaLysAlaAspAsnTrpGlnGln-1889 |
| SEQ. ID. NO. 32250 | 1899-SerGlyLeuAlaGluProThrGlnSerGly-1908 |
| SEQ. ID. NO. 32251 | 1915-ThrAlaSerProAspValSer-1921 |
| SEQ. ID. NO. 32252 | 1927-HisPheLysAspLeuAlaGlyGlnAsnAlaAsnGlyLysLeuThrAlaSerGlnGluThr-1946 |
| SEQ. ID. NO. 32253 | 1963-XxxGlyAsnAsnAlaPro-1968 |
| SEQ. ID. NO. 32254 | 1973-GlyAlaGlyGlySerGluAlaAla-1980 |
| SEQ. ID. NO. 32255 | 1988-LeuTyrGlyLysGlyAspGlyGlySerLeuAsnAlaGluGluLysGluThrVal-2005 |
| SEQ. ID. NO. 32256 | 2017-GlyAlaAlaGluGlyAsnSerSerAlaAspAla-2027 |
| SEQ. ID. NO. 32257 | 2034-ThrAlaSerAspPheAlaSerSerPheSerTyr-2044 |
| Hydrophilic Regions - Hopp-Woods | |
| SEQ. ID. NO. 32258 | 10-PheAsnArgLysArgGlyAla-16 |
| SEQ. ID. NO. 32259 | 22-GluThrThrLysArgGluGlyLysSerCysAlaAspSerGlySer-36 |
| SEQ. ID. NO. 32260 | 78-IleIleThrAspLysAlaAlaProLysThrGlnGln-89 |
| SEQ. ID. NO. 32261 | 131-AsnSerArgSerAsnThr-136 |
| SEQ. ID. NO. 32262 | 153-GlyGluAlaArgVal-157 |
| SEQ. ID. NO. 32263 | 176-ValGlyGlyArgArgAlaGluVal-183 |
| SEQ. ID. NO. 32264 | 235-LeuAspAlaArgAspThrAspPhe-242 |
| SEQ. ID. NO. 32265 | 261-AlaGlyIleArgAsn-265 |
| SEQ. ID. NO. 32266 | 296-GlnAspMetAsnAsnThrAlaGluHisLysValAsnIle-308 |
| SEQ. ID. NO. 32267 | 311-GlnAlaPheGluAsnSerGly-317 |
| SEQ. ID. NO. 32268 | 342-GlyThrGluAspLeuAla-347 |
| SEQ. ID. NO. 32269 | 355-GlnAsnGlyGluIleAlaThr-361 |
| SEQ. ID. NO. 32270 | 385-GlnSerGlyArgAspValAlaIle-392 |
| SEQ. ID. NO. 32271 | 403-LeuAlaAlaAspAsnLysLeuAspIleAlaLeu-413 |
| SEQ. ID. NO. 32272 | 417-PheTyrValGluArgLysIleValAla-425 |
| SEQ. ID. NO. 32273 | 435-GlySerLeuLysAsn-439 |
| SEQ. ID. NO. 32274 | 444-GlnAlaGlyLysArgIleArgIleLysAlaAsnAsnLeu-456 |
| SEQ. ID. NO. 32275 | 468-GlyThrThrAspIleGlyThr-474 |
| SEQ. ID. NO. 32276 | 487-GlnGlnThrLysIleGln-492 |
| SEQ. ID. NO. 32277 | 514-ThrArgLeuAspAsnGlnAspGluAsnGlyThr-524 |
| SEQ. ID. NO. 32278 | 529-AlaAlaArgGluAsnLeu-534 |
| SEQ. ID. NO. 32279 | 540-GlnLeuAsnAsnArgGluAsnSer-547 |
| SEQ. ID. NO. 32280 | 561-LeuAspThrAsnAspGlnAlaThrGlyLysAlaGlnArgIleHis-575 |
| SEQ. ID. NO. 32281 | 583-AlaAlaGlyLysMetArgLeuGlyValGluLysLeuHisAsnThrAsnGluHisLeuLys-602 |
| SEQ. ID. NO. 32282 | 607-GluThrGlyArgGluArgIleValAsp-615 |
| SEQ. ID. NO. 32283 | 623-GluLeuLeuArgGluGlyThrGlnHis-631 |
| SEQ. ID. NO. 32284 | 640-AsnGluSerAspHisLeuArgThrProAspGlyValAla-652 |
| SEQ. ID. NO. 32285 | 659-TyrAspTyrGluLysValThrGln-666 |
| SEQ. ID. NO. 32286 | 684-LeuIleIleAspSerLysAla-690 |
| SEQ. ID. NO. 32287 | 694-SerAspSerArgIle-698 |
| SEQ. ID. NO. 32288 | 707-GlnThrLysAspGlyLeuHisAsn-715 |
| SEQ. ID. NO. 32289 | 717-GlnThrPheGlyGluLysLysValPheSerGluAsnGlyLys-730 |
| SEQ. ID. NO. 32290 | 736-ArgAlaArgArgLysGlyHisAspGluThrGlyHisArgGluGlnAsn-751 |
| SEQ. ID. NO. 32291 | 756-GluGluIleThrArgAspIleSer-763 |
| SEQ. ID. NO. 32292 | 771-SerHisSerLysAlaLeuSerArgHisAlaPro-781 |
| SEQ. ID. NO. 32293 | 783-GlnGlyThrGluLeuProGlnSerAsnArgAspAsnIleArgThrAlaLysSerAsnGly-802 |
| SEQ. ID. NO. 32294 | 830-TyrLeuValGluThrAspProArgPheAlaAsn-840 |
| SEQ. ID. NO. 32295 | 854-LeuLysLeuAspPro-858 |
| SEQ. ID. NO. 32296 | 860-AsnLeuHisLysArgLeuGly-866 |
| SEQ. ID. NO. 32297 | 883-ThrGlyHisArgArgLeuAspGlyTyrGlnAsnAspGluGluGlnPheLysAlaLeuMet-902 |
| SEQ. ID. NO. 32298 | 905-GlyAlaThrAlaAlaArg-910 |
| SEQ. ID. NO. 32299 | 922-AlaGluGlnAlaAla-926 |
| SEQ. ID. NO. 32300 | 938-LysGluValLysLeuProAspGlyGlyThr-947 |
| SEQ. ID. NO. 32301 | 959-ValLysAsnGlyGlyIleAspGlyLysGly-968 |

TABLE 1-continued

| | |
|---|---|
| SEQ. ID. NO. 32302 | 982-GlySerLeuLysAsn-986 |
| SEQ. ID. NO. 32303 | 1010-IleHisAlaGlnLysSerAlaVal-1017 |
| SEQ. ID. NO. 32304 | 1048-SerThrAlaLysSerSerGlnAsnAlaGlnGly-1058 |
| SEQ. ID. NO. 32305 | 1073-GlyLysGluLysGlyVal-1078 |
| SEQ. ID. NO. 32306 | 1083-AlaGlyLysAspIleAsn-1088 |
| SEQ. ID. NO. 32307 | 1096-AsnGlnSerAspGlnGlyGlnThrArgLeuGlnAlaGlyArgAspIleAsnLeu-1113 |
| SEQ. ID. NO. 32308 | 1125-HisPheAspAlaAspAsnHisThrIleArgGlySerThrAsnGluValGlySer-1142 |
| SEQ. ID. NO. 32309 | 1144-IleGlnThrLysGlyAspVal-1150 |
| SEQ. ID. NO. 32310 | 1158-LeuAsnAlaLysAlaAlaGluValGlySerAlaLysGly-1170 |
| SEQ. ID. NO. 32311 | 1176-AlaLysAsnAspIle-1180 |
| SEQ. ID. NO. 32312 | 1190-GlnValAspAspAlaSerLysHisThrGlyArgSerGlyGlyGly-1204 |
| SEQ. ID. NO. 32313 | 1208-ValIleThrAspLysAlaGlnSerHisHisGluThrAlaGln-1221 |
| SEQ. ID. NO. 32314 | 1223-SerThrPheGluGlyLysGln-1229 |
| SEQ. ID. NO. 32315 | 1249-AsnGlyThrArgIleGlnAla-1255 |
| SEQ. ID. NO. 32316 | 1267-GlnSerGlnSerGluThr-1272 |
| SEQ. ID. NO. 32317 | 1276-ThrGlnLysSerGlyLeu-1281 |
| SEQ. ID. NO. 32318 | 1292-SerLysThrAsnThrGlnGluAsnGlnSerGlnSerAsnGluHisThrGly-1308 |
| SEQ. ID. NO. 32319 | 1314-LeuLysGlyAspThr-1318 |
| SEQ. ID. NO. 32320 | 1324-LysHisTyrGluGlnThrGly-1330 |
| SEQ. ID. NO. 32321 | 1334-SerSerProGluGly-1338 |
| SEQ. ID. NO. 32322 | 1356-LeuAsnSerLysThrThrGln-1362 |
| SEQ. ID. NO. 32323 | 1364-TyrGluGlnLysGly-1368 |
| SEQ. ID. NO. 32324 | 1384-SerAspCysArgSerThrGlnSerSerLysGlnValGlyGlnSerLysAsnAspArgValAsn-1404 |
| SEQ. ID. NO. 32325 | 1417-GlnThrGlyLysGlyAlaGln-1423 |
| SEQ. ID. NO. 32326 | 1443-GluGlnGlnAsnArgGlnThrThr-1450 |
| SEQ. ID. NO. 32327 | 1474-ArgCysGlyGluGlnSerAsn-1480 |
| SEQ. ID. NO. 32328 | 1488-ValSerGlyArgAlaGly-1493 |
| SEQ. ID. NO. 32329 | 1497-IleAlaAspLysGlnIle-1502 |
| SEQ. ID. NO. 32330 | 1506-SerAlaGluGlnSerAsnThrGluArgSerGlnAsnLys-1518 |
| SEQ. ID. NO. 32331 | 1560-SerHisIleGlyAspLysGlySer-1567 |
| SEQ. ID. NO. 32332 | 1582-AlaGlnValArgGlyLysGlyVal-1589 |
| SEQ. ID. NO. 32333 | 1600-SerValGlnAspArgGluThrTyrGlnSerLysGlnGlnAsn-1613 |
| SEQ. ID. NO. 32334 | 1628-GlyAspTyrSerGlnSerLysIleArgAlaAspHis-1639 |
| SEQ. ID. NO. 32335 | 1650-AlaGlyGluAspGlyTyrGln-1656 |
| SEQ. ID. NO. 32336 | 1674-GlnSerAlaLysAspLysGlyLysAsnArgPheSer-1685 |
| SEQ. ID. NO. 32337 | 1700-TyrGluGlyLysSer-1704 |
| SEQ. ID. NO. 32338 | 1717-ThrLeuGlyGlnGlyAlaLysAsnLysProGlnAspLysHisLeu-1731 |
| SEQ. ID. NO. 32339 | 1734-IleAlaAspLysAsnGlyAla-1740 |
| SEQ. ID. NO. 32340 | 1748-SerAspSerAspSerGlnSerSerIleThr-1757 |
| SEQ. ID. NO. 32341 | 1768-GlnIleThrAspGluAlaAlaGln-1775 |
| SEQ. ID. NO. 32342 | 1786-ThrLysAlaAspIleAspThr-1792 |
| SEQ. ID. NO. 32343 | 1794-ValThrThrAspThrAlaGluArgHisSerGlySerLeu-1806 |
| SEQ. ID. NO. 32344 | 1808-AsnIlePheAspLysAspArgValGlnSerGluLeuAspLeuGlnArgThrValSer-1826 |
| SEQ. ID. NO. 32345 | 1836-ThrAsnThrGluIle-1840 |
| SEQ. ID. NO. 32346 | 1842-GlnHisLeuAspLysLeuLysAlaAspLysGluAlaAlaGluThrAlaAla-1858 |
| SEQ. ID. NO. 32347 | 1865-GlyAspMetGluThrAlaLysArgLysAlaHisGluAlaGlnAspAlaAlaAlaLysAspAsn-1886 |
| SEQ. ID. NO. 32348 | 1901-LeuAlaGluProThrGln-1906 |
| SEQ. ID. NO. 32349 | 1927-HisPheLysAspLeuAlaGly-1933 |
| SEQ. ID. NO. 32350 | 1936-AlaAsnGlyLysLeuThrAlaSerGlnGluThr-1946 |
| SEQ. ID. NO. 32351 | 1975-GlyGlySerGluAlaAla-1980 |
| SEQ. ID. NO. 32352 | 1991-LysGlyAspGlyGlySerLeuAsnAlaGluGluLysGluThrVal-2005 |
| SEQ. ID. NO. 32353 | 2017-GlyAlaAlaGluGlyAsnSerSerAla-2025 |
| g565-2 | |
| AMPHI Regions - AMPHI | |
| SEQ. ID. NO. 32354 | 50-AlaThrCysThrArgAlaMetSerLysSer-59 |
| SEQ. ID. NO. 32355 | 66-SerSerTrpAlaArg-70 |
| SEQ. ID. NO. 32356 | 103-AspPheMetSerGlnLeuAspLeuThr-111 |
| SEQ. ID. NO. 32357 | 139-CysSerAsnSerGlyGluThrIleSerSerCysProAlaMetAlaSerIleThrLysProAsn-159 |
| SEQ. ID. NO. 32358 | 184-AlaAsnThrThrAsnAlaPheAsnThr-192 |
| Antigenic Index - Jameson-Wolf | |
| SEQ. ID. NO. 32359 | 1-MetAspSerThrLeuSerLysThrCys-9 |
| SEQ. ID. NO. 32360 | 23-PheAlaArgProArgProAlaAlaSerAsnThrSerLeu-35 |
| SEQ. ID. NO. 32361 | 37-PheAlaSerProAsnAspThrGlySer-45 |
| SEQ. ID. NO. 32362 | 55-AlaMetSerLysSerSerAlaLysTyrGly-64 |
| SEQ. ID. NO. 32363 | 67-SerTrpAlaArgThrArgProThrValCysProProLeuProLysProThrIle-84 |
| SEQ. ID. NO. 32364 | 86-ThrXxxSerAspLeu-90 |
| SEQ. ID. NO. 32365 | 97-MetLeuCysArgSerSerAspPheMetSer-106 |
| SEQ. ID. NO. 32366 | 109-AspLeuThrLysArgProThrSerAlaSerLeuProProLysArgLysGlyAlaIle-127 |
| SEQ. ID. NO. 32367 | 129-IleAspSerArgThrAlaAla-135 |
| SEQ. ID. NO. 32368 | 139-CysSerAsnSerGlyGluThrIleSer-147 |
| SEQ. ID. NO. 32369 | 155-IleThrLysProAsnSerProProCysAlaArgTyr-166 |
| SEQ. ID. NO. 32370 | 170-LeuArgLeuSerProThrGlu-176 |
| SEQ. ID. NO. 32371 | 194-SerIleAlaAsnSerIleAsnThrCysArgGlnProPro-206 |
| Hydrophilic Regions - Hopp-Woods | |
| SEQ. ID. NO. 32372 | 24-AlaArgProArgProAlaAla-30 |
| SEQ. ID. NO. 32373 | 39-SerProAsnAspThrGlySer-45 |
| SEQ. ID. NO. 32374 | 55-AlaMetSerLysSerSerAla-61 |
| SEQ. ID. NO. 32375 | 69-AlaArgThrArgPro-73 |
| SEQ. ID. NO. 32376 | 100-ArgSerSerAspPhe-104 |
| SEQ. ID. NO. 32377 | 109-AspLeuThrLysArgProThrSer-116 |

TABLE 1-continued

| | |
|---|---|
| SEQ. ID. NO. 32378 | 119-LeuProProLysArgLysGlyAlaIle-127 |
| SEQ. ID. NO. 32379 | 129-IleAspSerArgThr-133 |
| SEQ. ID. NO. 32380 | 141-AsnSerGlyGluThrIleSer-147 |
| SEQ. ID. NO. 32381 | 156-ThrLysProAsnSer-160 | g566
AMPHI Regions - AMPHI

| | |
|---|---|
| SEQ. ID. NO. 32382 | 52-GlyPheValGlyAspPheHisAlaPhe-60 |

Antigenic Index - Jameson-Wolf

| | |
|---|---|
| SEQ. ID. NO. 32383 | 36-ProAsnCysGlyAlaAspGlyThrGlyGlyLysGlyHisAla-49 |
| SEQ. ID. NO. 32384 | 61-AlaValGlyGlyGluGluGlyGlyVal-69 |
| SEQ. ID. NO. 32385 | 77-AlaAspGlyGlyLysAlaAspGlyGlyArgIleAlaArg-89 |
| SEQ. ID. NO. 32386 | 105-AlaAlaGluArgAlaGlyAspAspPheAla-114 |

Hydrophilic Regions - Hopp-Woods

| | |
|---|---|
| SEQ. ID. NO. 32387 | 39-GlyAlaAspGlyThrGlyGlyLysGlyHisAla-49 |
| SEQ. ID. NO. 32388 | 63-GlyGlyGluGluGlyGlyVal-69 |
| SEQ. ID. NO. 32389 | 78-AspGlyGlyLysAlaAspGlyGlyArgIleAlaArg-89 |
| SEQ. ID. NO. 32390 | 105-AlaAlaGluArgAlaGlyAspAspPheAla-114 | g567
AMPHI Regions - AMPHI

| | |
|---|---|
| SEQ. ID. NO. 32391 | 54-GluLeuValGlnGluIleAlaArgGluVal-63 |
| SEQ. ID. NO. 32392 | 68-AlaLeuLysAlaVal-72 |
| SEQ. ID. NO. 32393 | 110-TyrAlaLeuGluGlyIleSerAspLeuIleAlaThrValArgLysIleArgGln-127 |
| SEQ. ID. NO. 32394 | 136-ThrGlyIleValArg-140 |
| SEQ. ID. NO. 32395 | 151-AlaGluValSerGluGlnLeuArgSerHisPheGlyAspLeuLeu-165 |
| SEQ. ID. NO. 32396 | 170-IleProArgAsnIleArgLeuAla-177 |

Antigenic Index - Jameson-Wolf

| | |
|---|---|
| SEQ. ID. NO. 32397 | 1-MetArgArgArgAlaAlaAlaSerThrArgArgValCysSerProAlaPhe-17 |
| SEQ. ID. NO. 32398 | 24-MetArgThrCysSerArgArgArgTyrAlaAlaLysArgAlaAspThr-39 |
| SEQ. ID. NO. 32399 | 51-AlaGluIleGluLeu-55 |
| SEQ. ID. NO. 32400 | 57-GlnGluIleAlaArgGluValArgLeuLysAsnAlaLeu-69 |
| SEQ. ID. NO. 32401 | 71-AlaValAlaGluAspTyrAsp-77 |
| SEQ. ID. NO. 32402 | 83-CysProProSerLeu-87 |
| SEQ. ID. NO. 32403 | 123-ArgLysIleArgGlnAlaValAsnProAspLeuAspIle-135 |
| SEQ. ID. NO. 32404 | 141-ThrMetTyrAspSerArgSerArgLeuValAlaGluValSerGluGlnLeuArgSerHisPheGlyAspLeu-164 |
| SEQ. ID. NO. 32405 | 169-AlaIleProArgAsnIleArgLeuAlaGluAlaProSerHisGly-183 |
| SEQ. ID. NO. 32406 | 191-AlaGlnAlaLysGlyAlaLys-197 |
| SEQ. ID. NO. 32407 | 204-AspGluLeuAlaAlaArgValSerGlyLys-213 |

Hydrophilic Regions - Hopp-Woods

| | |
|---|---|
| SEQ. ID. NO. 32408 | 1-MetArgArgArgAlaAlaAlaSerThrArgArgValCys-13 |
| SEQ. ID. NO. 32409 | 26-ThrCysSerArgArgArgTyrAlaAlaLysArgAlaAspThr-39 |
| SEQ. ID. NO. 32410 | 51-AlaGluIleGluLeu-55 |
| SEQ. ID. NO. 32411 | 57-GlnGluIleAlaArgGluValArgLeuLysAsnAlaLeu-69 |
| SEQ. ID. NO. 32412 | 71-AlaValAlaGluAspTyrAsp-77 |
| SEQ. ID. NO. 32413 | 123-ArgLysIleArgGln-127 |
| SEQ. ID. NO. 32414 | 131-ProAspLeuAspIle-135 |
| SEQ. ID. NO. 32415 | 142-MetTyrAspSerArgSerArgLeuValAlaGluValSerGluGlnLeuArg-158 |
| SEQ. ID. NO. 32416 | 172-ArgAsnIleArgLeuAlaGlu-178 |
| SEQ. ID. NO. 32417 | 191-AlaGlnAlaLysGlyAlaLys-197 |
| SEQ. ID. NO. 32418 | 204-AspGluLeuAlaAla-208 | g568-2
AMPHI Regions - AMPHI

| | |
|---|---|
| SEQ. ID. NO. 32419 | 32-AsnIlePheArgArgIle-37 |
| SEQ. ID. NO. 32420 | 49-LysAlaCysLysAsn-53 |
| SEQ. ID. NO. 32421 | 71-GluLysAlaAsnThrValArgTyr-78 |
| SEQ. ID. NO. 32422 | 82-SerLeuAlaGlnCysPheThr-88 |
| SEQ. ID. NO. 32423 | 112-ArgProLeuProSerIleIleThrAla-120 |
| SEQ. ID. NO. 32424 | 154-ProXxxAspLeuAsn-158 |
| SEQ. ID. NO. 32425 | 177-LeuValGlyGlnPheLeuAsnArgLeuPhe-186 |
| SEQ. ID. NO. 32426 | 200-GluGluPhePheAspValValVal-207 |
| SEQ. ID. NO. 32427 | 227-AspPheAsnGlnValPheAlaAlaPheLeu-236 |
| SEQ. ID. NO. 32428 | 241-HisArgHisAlaAspGlnIleAlaAspSerCysArgValGlnSerGln-256 |

Antigenic Index - Jameson-Wolf

| | |
|---|---|
| SEQ. ID. NO. 32429 | 12-LysAlaSerAlaSerSerIlePro-19 |
| SEQ. ID. NO. 32430 | 21-ArgIleCysArgLeuLysArgSerArgLeuProAsnIlePhe-34 |
| SEQ. ID. NO. 32431 | 39-PheSerCysArgArgArgThrCysPheCysLysAlaCysLysAsnSerProIleArgAsnGluThrSerSerSerGlyArgArgGlnPheSerVal GluLysAlaAsnThr-75 |
| SEQ. ID. NO. 32432 | 91-SerAsnAlaSerLysProArgLeu-98 |
| SEQ. ID. NO. 32433 | 102-IleArgGlyArgLysArgPhePheAla-110 |
| SEQ. ID. NO. 32434 | 141-PheArgGlySerAlaPheLysCysArgLeuAsnAlaAlaProXxxAspLeuAsnArg-159 |
| SEQ. ID. NO. 32435 | 166-GlySerGlnAsnLeu-170 |
| SEQ. ID. NO. 32436 | 213-ValAlaAspArgAspAlaSer-219 |
| SEQ. ID. NO. 32437 | 237-GlyGlnHisGlyHisArgHisAlaAspGlnIleAlaAspSerCysArgValGlnSerGln-256 |

Hydrophilic Regions - Hopp-Woods

| | |
|---|---|
| SEQ. ID. NO. 32438 | 21-ArgIleCysArgLeuLysArgSerArgLeu-30 |
| SEQ. ID. NO. 32439 | 41-CysArgArgArgThrCysPhe-47 |
| SEQ. ID. NO. 32440 | 49-LysAlaCysLysAsnSerProIleArgAsnGluThrSerSerSerGlyArgArgGlnPheSerValGluLysAlaAsnThr-75 |
| SEQ. ID. NO. 32441 | 93-AlaSerLysProArgLeu-98 |
| SEQ. ID. NO. 32442 | 102-IleArgGlyArgLysArgPhePheAla-110 |
| SEQ. ID. NO. 32443 | 144-SerAlaPheLysCysArgLeu-150 |
| SEQ. ID. NO. 32444 | 152-AlaAlaProXxxAspLeuAsnArg-159 |

TABLE 1-continued

| SEQ. ID. NO. 32445 | 213-ValAlaAspArgAspAlaSer-219 |
| SEQ. ID. NO. 32446 | 239-HisGlyHisArgHisAlaAspGlnIleAlaAspSerCysArgVal-253 | g569-2
AMPHI Regions - AMPHI
SEQ. ID. NO. 32447  29-AlaAlaPheCysGlyLeuIleAlaLeuThrAlaLeuTrpGluTyrAlaArgMetAlaGlyLeuCysLys-51
SEQ. ID. NO. 32448  86-PheTrpLeuAlaValMetPro-92
SEQ. ID. NO. 32449  161-IleAlaArgAlaIleSerProGlyLysSerTrpGluGlyAlaIle-175
SEQ. ID. NO. 32450  203-ThrValLeuIleGlyLeu-208
SEQ. ID. NO. 32451  210-LeuThrValValSerValCysGlyAspLeuLeuGluSerTrpLeuLys-225
Antigenic Index - Jameson-Wolf
SEQ. ID. NO. 32452  50-CysLysThrGluThrAsnHis-56
SEQ. ID. NO. 32453  98-LysTrpArgLeuAsnGlyGlyTrp-105
SEQ. ID. NO. 32454  124-SerLeuArgProHisProAspAspAlaLeu-133
SEQ. ID. NO. 32455  154-LysAlaLeuGlyLysHisLysIleAlaArg-163
SEQ. ID. NO. 32456  165-IleSerProGlyLysSerTrpGlu-172
SEQ. ID. NO. 32457  227-AlaAlaGlyIleLysAspSerSerAsnLeuLeuProGlyHis-240
SEQ. ID. NO. 32458  242-GlyValPheAspArgThrAspSer-249
Hydrophilic Regions - Hopp-Woods
SEQ. ID. NO. 32459  50-CysLysThrGluThr-54
SEQ. ID. NO. 32460  127-ProHisProAspAspAlaLeu-133
SEQ. ID. NO. 32461  155-AlaLeuGlyLysHisLysIleAlaArg-163
SEQ. ID. NO. 32462  227-AlaAlaGlyIleLysAspSerSerAsn-235
SEQ. ID. NO. 32463  243-ValPheAspArgThrAspSer-249 g570
AMPHI Regions - AMPHI
SEQ. ID. NO. 32464  6-ArgAlaPheAlaAlaAlaLeuIleGlyLeu-15
SEQ. ID. NO. 32465  22-HisAlaAspThrPheGlnLysIleGlyPheIleAsn-33
SEQ. ID. NO. 32466  43-GlnAlaArgAsnIleGlnLysThrLeuAspGly-53
SEQ. ID. NO. 32467  60-AspGluLeuGlnLysLeuGln-66
SEQ. ID. NO. 32468  81-LeuLysAspAlaLysLys-86
SEQ. ID. NO. 32469  91-GluLysTrpArgGlyLeuValGluAlaPheArg-101
SEQ. ID. NO. 32470  122-LeuGlnGlnAsnAlaAsnArgValIleValLysIle-133
Antigenic Index - Jameson-Wolf
SEQ. ID. NO. 32471  33-AsnThrGluArgIleTyrLeuGluSerLysGlnAlaArgAsnIleGlnLysThrLeuAspGlyGluPheSerAlaArgGlnAspGluLeuGln
                    LysLeuGlnArgGluGlyLeuAspLeuGluArgGlnLeuAlaGlyGlyLysLeuLysAspAlaLysLysAlaGlnAlaGluGluLysTrpArgGly-95
SEQ. ID. NO. 32472  99-AlaPheArgLysLysGlnAlaGlnPheGluGluAspTyrAsnLeuArgArgAsnGluGluPheAla-120
SEQ. ID. NO. 32473  123-GlnGlnAsnAlaAsnArgVal-129
SEQ. ID. NO. 32474  133-IleAlaLysGlnGluGlyTyrAspValIle-142
SEQ. ID. NO. 32475  150-AsnThrGlnTyrAspValThrAspSerValIleLysGluMetAsnAlaArg-166
Hydrophilic Regions - Hopp-Woods
SEQ. ID. NO. 32476  37-IleTyrLeuGluSerLysGlnAlaArgAsnIleGlnLysThrLeuAspGlyGluPheSerAlaArgGlnAspGluLeuGlnLysLeuGlnArg
                    GluGlyLeuAspLeuGluArgGlnLeuAla-77
SEQ. ID. NO. 32477  79-GlyLysLeuLysAspAlaLysLysAlaGlnAlaGluGluLysTrpArgGly-95
SEQ. ID. NO. 32478  99-AlaPheArgLysLysGlnAlaGlnPheGluGluAspTyrAsnLeuArgArgAsnGluGluPheAla-120
SEQ. ID. NO. 32479  133-IleAlaLysGlnGluGlyTyr-139
SEQ. ID. NO. 32480  154-AspValThrAspSerValIleLysGluMetAsnAlaArg-166 g571
AMPHI Regions - AMPHI
SEQ. ID. NO. 32481  10-ValValThrValPheGlyGlyGlyIleGlySerAlaVal-22
SEQ. ID. NO. 32482  58-AlaAlaValAlaAspPhePheAlaVal-66
SEQ. ID. NO. 32483  89-ValGluValPheLysGlu-94
Antigenic Index - Jameson-Wolf
SEQ. ID. NO. 32484  30-LysGlnAlaGlnAlaAspGly-36
SEQ. ID. NO. 32485  40-PheArgThrGlyHisArgGluGluGlnLeuGlyGlyAspVal-53
SEQ. ID. NO. 32486  72-ArgAlaGluArgAlaAla-77
SEQ. ID. NO. 32487  91-ValPheLysGluGlyAspPhe-97
SEQ. ID. NO. 32488  105-ArgAsnAlaAspPheAlaAlaGluHisGlnArgGluGlyPheAla-119
Hydrophilic Regions - Hopp-Woods
SEQ. ID. NO. 32489  30-LysGlnAlaGlnAlaAsp-35
SEQ. ID. NO. 32490  42-ThrGlyHisArgGluGluGlnLeuGly-50
SEQ. ID. NO. 32491  72-ArgAlaGluArgAlaAla-77
SEQ. ID. NO. 32492  91-ValPheLysGluGlyAspPhe-97
SEQ. ID. NO. 32493  105-ArgAsnAlaAspPheAlaAlaGluHisGlnArgGluGlyPheAla-119 g572
AMPHI Regions - AMPHI
SEQ. ID. NO. 32494  10-LeuProSerAlaLeuAla-15
SEQ. ID. NO. 32495  61-GlnValLeuProArgAspTyrThrAspArgLeuAsn-72
SEQ. ID. NO. 32496  94-SerThrPheAspSerIleThrPro-101
SEQ. ID. NO. 32497  154-IleHisSerMetValArg-159
SEQ. ID. NO. 32498  183-GlyLeuProGluArgIleAspSerGly-191
SEQ. ID. NO. 32499  200-LeuSerAlaLeuThr-204
Antigenic Index - Jameson-Wolf
SEQ. ID. NO. 32500  18-GlnLysGlyLysThr-22
SEQ. ID. NO. 32501  26-AlaAsnLysGluThrLeu-31
SEQ. ID. NO. 32502  41-ThrAlaArgAlaAsnGly-46
SEQ. ID. NO. 32503  51-ProValAspSerGluHis-56
SEQ. ID. NO. 32504  63-LeuProArgAspTyrThrAspArgLeuAsnGluHisGlyIleAsp-77
SEQ. ID. NO. 32505  97-AspSerIleThrProGluGlnAlaValLysHisProAsnTrpArgMetGlyArgLysIleSerValAspSer-120
SEQ. ID. NO. 32506  122-ThrMetAlaAsnLysGlyLeuGluLeu-130
SEQ. ID. NO. 32507  138-AsnCysProProAspLysLeuGluVal-146

TABLE 1-continued

| | |
|---|---|
| SEQ. ID. NO. 32508 | 158-ValArgTyrArgAspGlySerVal-165 |
| SEQ. ID. NO. 32509 | 170-GlyAsnProAspMetArgThr-176 |
| SEQ. ID. NO. 32510 | 184-LeuProGluArgIleAspSerGlyValGlyLysLeuAsp-196 |
| SEQ. ID. NO. 32511 | 205-PheGlnLysProAspPheGlyArg-212 |
| SEQ. ID. NO. 32512 | 224-AsnAlaGlyGlyAla-228 |

Hydrophilic Regions - Hopp-Woods

| | |
|---|---|
| SEQ. ID. NO. 32513 | 27-AsnLysGluThrLeu-31 |
| SEQ. ID. NO. 32514 | 41-ThrAlaArgAlaAsnGly-46 |
| SEQ. ID. NO. 32515 | 52-ValAspSerGluHis-56 |
| SEQ. ID. NO. 32516 | 66-AspTyrThrAspArgLeuAsnGluHisGlyIle-76 |
| SEQ. ID. NO. 32517 | 111-ArgMetGlyArgLysIleSerVal-118 |
| SEQ. ID. NO. 32518 | 126-LysGlyLeuGluLeu-130 |
| SEQ. ID. NO. 32519 | 140-ProProAspLysLeuGlu-145 |
| SEQ. ID. NO. 32520 | 158-ValArgTyrArgAspGlySer-164 |
| SEQ. ID. NO. 32521 | 170-GlyAsnProAspMetArgThr-176 |
| SEQ. ID. NO. 32522 | 184-LeuProGluArgIleAspSerGlyValGlyLysLeuAsp-196 |
| SEQ. ID. NO. 32523 | 206-GlnLysProAspPheGly-211 | g574
AMPHI Regions - AMPHI

| | |
|---|---|
| SEQ. ID. NO. 32524 | 6-ProAsnSerLeuLysLys-11 |
| SEQ. ID. NO. 32525 | 47-LeuLysGlnAlaLysSerIleProSerGlyPheTyrLysSerLeuAspAlaLeuValAspArgAsnSerGlyArgAlaAlaArgGluLeuAlaGluValValAsp-81 |
| SEQ. ID. NO. 32526 | 94-GlyLysLeuTyrArgGln-99 |
| SEQ. ID. NO. 32527 | 113-MetLeuAspSerProAspThr-119 |
| SEQ. ID. NO. 32528 | 175-GluLysAlaValGlu-179 |
| SEQ. ID. NO. 32529 | 218-AsnValGlyLysAlaLeuGluAlaAsnLysLysCys-229 |
| SEQ. ID. NO. 32530 | 246-PheProAlaAlaValGluAlaTyrAlaAlaIleGlu-257 |
| SEQ. ID. NO. 32531 | 266-MetValGlyGluLysLeuTyrGluAlaTyrAla-276 |
| SEQ. ID. NO. 32532 | 281-ProGluGluGlyLeuAsnArgLeuThrGlyTyrMetGlnThrPheProGluLeuAspLeu-300 |
| SEQ. ID. NO. 32533 | 332-AsnGlyValTyrArg-336 |
| SEQ. ID. NO. 32534 | 357-ArgSerValIleGlyArgGlnLeuGlnArgSer-367 |

Antigenic Index - Jameson-Wolf

| | |
|---|---|
| SEQ. ID. NO. 32535 | 7-AsnSerLeuLysLysAlaAspMetAspAsn-16 |
| SEQ. ID. NO. 32536 | 45-ThrValLeuLysGlnAlaLysSerIleProSerGlyPheTyrLysSerLeuAspAlaLeuValAspArgAsnSerGlyArgAlaAlaArgGluLeuAlaGluValValAspGlyArgProGlnSerTyrAsp-88 |
| SEQ. ID. NO. 32537 | 96-LeuTyrArgGlnArgGlyGluAsnAspLysAlaIleAsnIleHisArgThrMetLeuAspSerProAspThrValGlyLysArgAlaArgVal-127 |
| SEQ. ID. NO. 32538 | 135-TyrGlnSerAlaGlyLeuValAspArgAlaGlu-145 |
| SEQ. ID. NO. 32539 | 151-LeuGlnAspGlyGluMetAlaArgGluAlaArgGln-162 |
| SEQ. ID. NO. 32540 | 168-TyrGlnGlnAsnArgAspTrpGluLysAlaValGlu-179 |
| SEQ. ID. NO. 32541 | 185-SerHisAspGluGlnThrTyr-191 |
| SEQ. ID. NO. 32542 | 210-SerAsnPheAspAlaAlaArg-216 |
| SEQ. ID. NO. 32543 | 221-LysAlaLeuGluAlaAsnLysLysCysThrArg-231 |
| SEQ. ID. NO. 32544 | 238-AspIleGluHisArgGlnGlyAsn-245 |
| SEQ. ID. NO. 32545 | 277-AlaGlnGlyLysProGluGluGlyLeuAsnArgLeuThrGlyTyr-291 |
| SEQ. ID. NO. 32546 | 309-LeuLeuLeuLysGlyGluLysGluAlaAla-318 |
| SEQ. ID. NO. 32547 | 323-GluLeuValArgArgLysProAspLeuAsnGly-333 |
| SEQ. ID. NO. 32548 | 341-LysLeuSerAspLeuAspProAlaTrpLysAlaAspAlaAspMetMetArg-357 |
| SEQ. ID. NO. 32549 | 368-ValMetTyrArgCysArgAsnCysHisPheLys-378 |
| SEQ. ID. NO. 32550 | 386-CysProAlaCysAsnLysTrpGlnThrPheThrProAsnLysIleGluVal-402 |

Hydrophilic Regions - Hopp-Woods

| | |
|---|---|
| SEQ. ID. NO. 32551 | 7-AsnSerLeuLysLysAlaAspMetAspAsn-16 |
| SEQ. ID. NO. 32552 | 45-ThrValLeuLysGlnAlaLysSerIle-53 |
| SEQ. ID. NO. 32553 | 62-AspAlaLeuValAspArgAsnSerGlyArgAlaAlaArgGluLeuAlaGluValValAspGlyArgProGlnSer-86 |
| SEQ. ID. NO. 32554 | 96-LeuTyrArgGlnArgGlyGluAsnAspLysAlaIleAsn-108 |
| SEQ. ID. NO. 32555 | 112-ThrMetLeuAspSerProAspThrValGlyGluLysArgAlaArgVal-127 |
| SEQ. ID. NO. 32556 | 140-LeuValAspArgAlaGlu-145 |
| SEQ. ID. NO. 32557 | 152-GlnAspGlyGluMetAlaArgGluAlaArgGln-162 |
| SEQ. ID. NO. 32558 | 169-GlnGlnAsnArgAspTrpGluLysAlaValGlu-179 |
| SEQ. ID. NO. 32559 | 185-SerHisAspGluGlnThrTyr-191 |
| SEQ. ID. NO. 32560 | 211-AsnPheAspAlaAlaArg-216 |
| SEQ. ID. NO. 32561 | 221-LysAlaLeuGluAlaAsnLysLysCysThrArg-231 |
| SEQ. ID. NO. 32562 | 238-AspIleGluHisArgGlnGlyAsn-245 |
| SEQ. ID. NO. 32563 | 279-GlyLysProGluGluGlyLeuAsn-286 |
| SEQ. ID. NO. 32564 | 309-LeuLeuLeuLysGlyGluLysGluAlaAla-318 |
| SEQ. ID. NO. 32565 | 323-GluLeuValArgArgLysProAspLeu-331 |
| SEQ. ID. NO. 32566 | 341-LysLeuSerAspLeuAspPro-347 |
| SEQ. ID. NO. 32567 | 349-TrpLysAlaAspAlaAspMetMetArg-357 |
| SEQ. ID. NO. 32568 | 368-ValMetTyrArgCysArgAsnCysHis-376 |
| SEQ. ID. NO. 32569 | 398-AsnLysIleGluVal-402 | g575
AMPHI Regions - AMPHI

| | |
|---|---|
| SEQ. ID. NO. 32570 | 31-ProValArgGlnValArg-36 |
| SEQ. ID. NO. 32571 | 93-TrpArgSerValAlaGluAlaGlyValSer-102 |
| SEQ. ID. NO. 32572 | 104-ThrAlaGlyLeuGlySerGlyArgThrAlaGlyPheSerAlaPheAlaSerGlyAla-122 |
| SEQ. ID. NO. 32573 | 124-ThrPheAlaSerGlyPheSerThrGly-132 |
| SEQ. ID. NO. 32574 | 149-GlySerAspGlyMetAspAlaValSerAlaLeu-159 |

Antigenic Index - Jameson-Wolf

| | |
|---|---|
| SEQ. ID. NO. 32575 | 3-CysLeuArgArgGlnAlaAlaArgCysThrAsnArgArgThrAspArgGlnThrVal-21 |
| SEQ. ID. NO. 32576 | 27-LeuArgGlnLysProValArgGlnValArgGlnArgValArgArg-41 |
| SEQ. ID. NO. 32577 | 49-GlnGlnValArgLysArgCysTyrArgPheArgArgSerAlaCysArgTrpGlnLysArgArgLeuLeuGlyGlyAlaAspSerAlaAlaVal-79 |

TABLE 1-continued

| | |
|---|---|
| SEQ. ID. NO. 32578 | 89-ThrGlyProGlyTrp-93 |
| SEQ. ID. NO. 32579 | 100-GlyValSerAspThrAlaGlyLeuGlySerGlyArgThrAla-113 |
| SEQ. ID. NO. 32580 | 129-PheSerThrGlyPheSerThr-135 |
| SEQ. ID. NO. 32581 | 147-LeuAspGlySerAspGlyMetAsp-154 |

Hydrophilic Regions - Hopp-Woods

| | |
|---|---|
| SEQ. ID. NO. 32582 | 3-CysLeuArgArgGlnAlaAlaArgCysThrAsnArgArgThrAspArgGlnThrVal-21 |
| SEQ. ID. NO. 32583 | 27-LeuArgGlnLysProValArgGlnValArgGlnArgValArgArg-41 |
| SEQ. ID. NO. 32584 | 50-GlnValArgLysArgCysTyrArgPheArgArgSerAlaCysArgTrpGlnLysArgArgLeuLeuGly-72 |
| SEQ. ID. NO. 32585 | 74-AlaAspSerAlaAlaVal-79 |
| SEQ. ID. NO. 32586 | 148-AspGlySerAspGlyMetAsp-154 | g576-1
AMPHI Regions - AMPHI

| | |
|---|---|
| SEQ. ID. NO. 32587 | 31-AlaSerGluProAlaAlaAla-37 |
| SEQ. ID. NO. 32588 | 46-SerIleGlySerThr-50 |
| SEQ. ID. NO. 32589 | 63-GlyArgSerLeuLysGlnMetLys-70 |
| SEQ. ID. NO. 32590 | 82-ThrAspAlaMetGln-86 |
| SEQ. ID. NO. 32591 | 102-GlnGluValMetMetLysPheLeuGlnGluGlnGlnAlaLysAlaValGluLysHis-120 |
| SEQ. ID. NO. 32592 | 140-AlaLysAspGlyValLysThrThr-147 |
| SEQ. ID. NO. 32593 | 200-GlnValIleProGlyTrpThrGluGlyValArgLeuLeuLysGluGly-215 |

Antigenic Index - Jameson-Wolf

| | |
|---|---|
| SEQ. ID. NO. 32594 | 20-AlaCysGlyLysLysGluAlaAlaPro-28 |
| SEQ. ID. NO. 32595 | 30-SerAlaSerGluProAlaAla-36 |
| SEQ. ID. NO. 32596 | 40-AlaGlnGlyAspThrSerSerIleGlySerThrMetGlnGln-53 |
| SEQ. ID. NO. 32597 | 61-AspIleGlyArgSerLeuLysGlnMetLysGluGlnGlyAlaGluIleAspLeu-78 |
| SEQ. ID. NO. 32598 | 89-TyrAspGlyLysGluIleLysMetThrGluGluGlnAlaGln-102 |
| SEQ. ID. NO. 32599 | 109-LeuGlnGluGlnGlnAlaLysAlaValGluLysHisLysAlaAspAlaLysAlaAsnLysGluLysGlyGluAlaPheLeuLysGluAsnAlaAlaLysAspGlyValLysThrThrAlaSerGlyLeu-151 |
| SEQ. ID. NO. 32600 | 154-LysIleThrLysGlnGlyGluGlyLysGlnProThrLysAspAspIleVal-170 |
| SEQ. ID. NO. 32601 | 173-GluTyrGluGlyArgLeuIleAsp-180 |
| SEQ. ID. NO. 32602 | 183-ValPheAspSerSerLysAlaAsnGlyGlyPro-193 |
| SEQ. ID. NO. 32603 | 203-ProGlyTrpThrGlu-207 |
| SEQ. ID. NO. 32604 | 209-ValArgLeuLeuLysGluGlyGlyGlu-217 |
| SEQ. ID. NO. 32605 | 224-SerAsnLeuAlaTyrArgGluGlnGlyAlaGlyGluLysIleGlyPro-239 |
| SEQ. ID. NO. 32606 | 253-GlyAlaProGluAsnAlaProAlaLysGlnProAspGlnValAspIleLysLysValAsn-272 |

Hydrophilic Regions - Hopp-Woods

| | |
|---|---|
| SEQ. ID. NO. 32607 | 21-CysGlyLysLysGluAlaAlaPro-28 |
| SEQ. ID. NO. 32608 | 30-SerAlaSerGluProAlaAla-36 |
| SEQ. ID. NO. 32609 | 40-AlaGlnGlyAspThrSerSer-46 |
| SEQ. ID. NO. 32610 | 61-AspIleGlyArgSerLeuLysGlnMetLysGluGlnGlyAlaGluIleAspLeu-78 |
| SEQ. ID. NO. 32611 | 89-TyrAspGlyLysGluIleLysMetThrGluGluGlnAlaGln-102 |
| SEQ. ID. NO. 32612 | 112-GlnGlnAlaLysAlaValGluLysHisLysAlaAspAlaLysAlaAsnLysGluLysGlyGluAlaPheLeuLysGluAsnAlaAlaLysAspGlyValLysThrThrAla-148 |
| SEQ. ID. NO. 32613 | 155-IleThrLysGlnGlyGluGlyLysGlnProThrLysAspAspIleVal-170 |
| SEQ. ID. NO. 32614 | 173-GluTyrGluGlyArgLeuIleAsp-180 |
| SEQ. ID. NO. 32615 | 185-AspSerSerLysAlaAsnGly-191 |
| SEQ. ID. NO. 32616 | 209-ValArgLeuLeuLysGluGlyGlyGlu-217 |
| SEQ. ID. NO. 32617 | 227-AlaTyrArgGluGlnGlyAlaGlyGluLysIleGlyPro-239 |
| SEQ. ID. NO. 32618 | 253-GlyAlaProGluAsnAlaProAlaLysGlnProAspGlnValAspIleLysLysValAsn-272 | g577
AMPHI Regions - AMPHI

| | |
|---|---|
| SEQ. ID. NO. 32619 | 8-GlyLysIleValGlyAsnArgIleLeuArgMetProSerGluHis-22 |
| SEQ. ID. NO. 32620 | 26-PheTyrProLysProCysLysSerPheLysLeuThr-37 |
| SEQ. ID. NO. 32621 | 62-ThrValIleLysIleIle-67 |
| SEQ. ID. NO. 32622 | 104-AlaPheValValGlyIle-109 |
| SEQ. ID. NO. 32623 | 112-GlyMetPheAlaLeuPheGlyArg-119 |

Antigenic Index - Jameson-Wolf

| | |
|---|---|
| SEQ. ID. NO. 32624 | 1-MetGluArgSerGlyVal-6 |
| SEQ. ID. NO. 32625 | 14-ArgIleLeuArgMetProSerGluHis-22 |
| SEQ. ID. NO. 32626 | 28-ProLysProCysLysSerPheLysLeu-36 |
| SEQ. ID. NO. 32627 | 43-ValArgSerCysProCys-48 |
| SEQ. ID. NO. 32628 | 121-LeuSerLeuArgGlyGluAsnSerArgLeuArgAlaGluValLysLysSerAlaArgLeuSerGlyGlnLysLeuThrAla-147 |
| SEQ. ID. NO. 32629 | 152-AsnAlaAlaGluSerAlaLysGlnPro-160 |

Hydrophilic Regions - Hopp-Woods

| | |
|---|---|
| SEQ. ID. NO. 32630 | 1-MetGluArgSerGlyVal-6 |
| SEQ. ID. NO. 32631 | 14-ArgIleLeuArgMetProSerGluHis-22 |
| SEQ. ID. NO. 32632 | 29-LysProCysLysSerPheLys-35 |
| SEQ. ID. NO. 32633 | 121-LeuSerLeuArgGlyGluAsnSerArgLeuArgAlaGluValLysLysSerAlaArgLeuSerGly-142 |
| SEQ. ID. NO. 32634 | 152-AsnAlaAlaGluSerAlaLysGlnPro-160 | g578
AMPHI Regions - AMPHI

| | |
|---|---|
| SEQ. ID. NO. 32635 | 10-PheAlaAspPhePheLysAspPheAlaProGlnPheGlyGlyPheGlnAsn-26 |
| SEQ. ID. NO. 32636 | 34-AspPhePheAlaAlaPheLeuGlyGlyLeuGluGlyHisValGlyAsp-49 |
| SEQ. ID. NO. 32637 | 58-PheHisGlyValValAlaPhe-64 |
| SEQ. ID. NO. 32638 | 71-AsnThrAspAlaAlaArgPhe-77 |

Antigenic Index - Jameson-Wolf

| | |
|---|---|
| SEQ. ID. NO. 32639 | 13-PhePheLysAspPheAlaProGlnPheGlyGly-23 |
| SEQ. ID. NO. 32640 | 43-LeuGluGlyHisValGlyAspAlaAla-51 |
| SEQ. ID. NO. 32641 | 71-AsnThrAspAlaAlaArgPheAla-78 |
| SEQ. ID. NO. 32642 | 88-HisAsnGlnAsnIleGlnThrGlyAsnAspPheArgLeuGluArgGlyGlyValGly-106 |

TABLE 1-continued

Hydrophilic Regions - Hopp-Woods
SEQ. ID. NO. 32643    73-AspAlaAlaArgPheAla-78
SEQ. ID. NO. 32644    96-AsnAspPheArgLeuGluArgGlyGlyVal-105
g579
AMPHI Regions - AMPHI
SEQ. ID. NO. 32645    6-PheAspPheLeuHisLeuIleSerValSerGlyTrpGlyHisLeuAlaGlu-22
SEQ. ID. NO. 32646    49-ValAlaValMetArg-53
SEQ. ID. NO. 32647    66-IleSerPheLeuCysAsn-71
SEQ. ID. NO. 32648    115-LeuSerAsnPheAla-119
SEQ. ID. NO. 32649    129-ProPheLysValGlyAspPheIleArgValGlyGlyPheGluGlyTyrValArgGluIleLys-149
SEQ. ID. NO. 32650    206-LeuLysAlaAlaAlaAlaGlu-211
SEQ. ID. NO. 32651    258-GlnValValGluAsnLeuArg-264
Antigenic Index - Jameson-Wolf
SEQ. ID. NO. 32652    110-SerLeuLysAspGlnLeuSer-116
SEQ. ID. NO. 32653    128-ArgProPheLysVal-132
SEQ. ID. NO. 32654    136-IleArgValGlyGlyPheGluGlyTyrValArgGluIleLysMet-150
SEQ. ID. NO. 32655    154-SerLeuArgThrThrAspAsnGluGluValValLeu-165
SEQ. ID. NO. 32656    175-IleValAsnArgSerSerLeuProLeu-183
SEQ. ID. NO. 32657    198-LeuLysValAlaLysGluAlaValLeu-206
SEQ. ID. NO. 32658    216-ValGlnAsnGluGluArgGlnPro-223
SEQ. ID. NO. 32659    231-GlyAspAsnAlaIle-235
SEQ. ID. NO. 32660    244-AsnGluAlaAspArgTrpThrLeu-251
SEQ. ID. NO. 32661    253-CysAspLeuAsnGluGlnValValGluAsnLeuArgLysValAsn-267
SEQ. ID. NO. 32662    271-ProPheProGlnArgAspIleHis-278
Hydrophilic Regions - Hopp-Woods
SEQ. ID. NO. 32663    110-SerLeuLysAspGlnLeu-115
SEQ. ID. NO. 32664    144-TyrValArgGluIleLysMet-150
SEQ. ID. NO. 32665    155-LeuArgThrThrAspAsnGluGluValVal-164
SEQ. ID. NO. 32666    198-LeuLysValAlaLysGluAlaValLeu-206
SEQ. ID. NO. 32667    216-ValGlnAsnGluGluArgGlnPro-223
SEQ. ID. NO. 32668    244-AsnGluAlaAspArgTrp-249
SEQ. ID. NO. 32669    254-AspLeuAsnGluGlnValValGluAsnLeuArgLysValAsn-267
SEQ. ID. NO. 32670    273-ProGlnArgAspIleHis-278
g580
AMPHI Regions - AMPHI
SEQ. ID. NO. 32671    47-ProValSerAlaSerLys-52
SEQ. ID. NO. 32672    54-SerLeuValLysProLeuSerGlnProLeuAla-64
Antigenic Index - Jameson-Wolf
SEQ. ID. NO. 32673    1-MetAspSerProLysValGlyCysGly-9
SEQ. ID. NO. 32674    48-ValSerAlaSerLys-52
SEQ. ID. NO. 32675    66-AlaArgProGluAlaAlaHis-72
SEQ. ID. NO. 32676    81-ArgProAspAlaLeuAlaAspAsnSerValSerProThrHisAlaThrSerGlyGluVal-100
Hydrophilic Regions - Hopp-Woods
SEQ. ID. NO. 32677    1-MetAspSerProLysVal-6
SEQ. ID. NO. 32678    66-AlaArgProGluAlaAlaHis-72
SEQ. ID. NO. 32679    81-ArgProAspAlaLeuAla-86
SEQ. ID. NO. 32680    96-ThrSerGlyGluVal-100
g581
AMPHI Regions - AMPHI
SEQ. ID. NO. 32681    43-SerHisPheIleSerLeu-48
SEQ. ID. NO. 32682    56-ArgGluCysPheValGlyPhe-62
SEQ. ID. NO. 32683    76-AlaThrAlaPheGlyArgIleAsnGln-84
SEQ. ID. NO. 32684    90-GlnIleHisGlyPheLeuThrThrPheAlaGlyArgValAlaAsnProThrHisCysGlnSerGlnThr-112
Antigenic Index - Jameson-Wolf
SEQ. ID. NO. 32685    8-GlyGlnThrGlyIleGluGlnAsnThrPheCysArgArgGlyPheThrArgIleAspMetGlyGlyAsnThrAspVal-33
SEQ. ID. NO. 32686    35-ValGlnAlaAspArgGlyLeuThrSer-43
SEQ. ID. NO. 32687    49-SerLysLeuGluThrGluValArgGluCysPhe-59
SEQ. ID. NO. 32688    79-PheGlyArgIleAsnGln-84
SEQ. ID. NO. 32689    98-PheAlaGlyArgValAlaAsnProThrHisCysGlnSerGlnThrAla-113
Hydrophilic Regions - Hopp-Woods
SEQ. ID. NO. 32690    35-ValGlnAlaAspArgGlyLeu-41
SEQ. ID. NO. 32691    49-SerLysLeuGluThrGluValArgGlu-57
g582
AMPHI Regions - AMPHI
SEQ. ID. NO. 32692    27-ThrAspAsnValThrArgLeuAla-34
SEQ. ID. NO. 32693    65-ValArgSerSerLeu-69
SEQ. ID. NO. 32694    91-GlyGluThrAlaAspIleTyrThrProLeuSer-101
SEQ. ID. NO. 32695    139-SerSerProThrArg-143
SEQ. ID. NO. 32696    169-IleAlaGluAsnLeuPhe-174
SEQ. ID. NO. 32697    246-SerArgSerTrpAsnArgIleTyrAlaMet-255
SEQ. ID. NO. 32698    263-LeuThrValIleProArgValTrpValArgAlaPheAspGlnSer-277
SEQ. ID. NO. 32699    286-IleAlaAspTyrMetGlyTyr-292
SEQ. ID. NO. 32700    334-LeuLysGlyValValArgGlyPheHisGlyTyrGlyGlu-346
Antigenic Index - Jameson-Wolf
SEQ. ID. NO. 32701    26-LeuThrAspAsnValThr-31
SEQ. ID. NO. 32702    34-AlaCysTyrAspArg-38
SEQ. ID. NO. 32703    44-LeuProSerSerAlaGlyGlnGluGlyGlnGluSerLysAla-57
SEQ. ID. NO. 32704    63-GluThrValArgSerSerLeuAspLysGlyGluAla-74
SEQ. ID. NO. 32705    77-ValValGluLysGlyGlyAspAlaLeuProAlaAspSerAlaGlyGluThrAlaAsp-95
SEQ. ID. NO. 32706    105-AspLeuAspLysAsnAspLeuArgGly-113

TABLE 1-continued

| | |
|---|---|
| SEQ. ID. NO. 32707 | 115-LeuGlyValArgGluHisAsnProMetTyr-124 |
| SEQ. ID. NO. 32708 | 130-TyrAsnAsnSerProAsnTyrAlaProSerProThrArgGlyThrThrValGlnGluLysPheGlyGlnGlnLysArgAlaGluThrLysLeu-161 |
| SEQ. ID. NO. 32709 | 165-PheLysSerLysIleAla-170 |
| SEQ. ID. NO. 32710 | 173-LeuPheLysThrArgAla-178 |
| SEQ. ID. NO. 32711 | 183-GlyTyrThrGlnArgSerSerTrpGlnIleTyrAsnGlnGlyArgLysSerAlaProPheArgAsnThrAspTyrLysPro-209 |
| SEQ. ID. NO. 32712 | 216-ProValLysAlaAspLeuProPheGlyGlyArgLeuArgMet-229 |
| SEQ. ID. NO. 32713 | 237-GlnSerAsnGlyGlnSerArgProGluSerArgSerTrpAsn-250 |
| SEQ. ID. NO. 32714 | 273-AlaPheAspGlnSerGlyAspLysAsnAspAsnProAspIleAlaAsp-288 |
| SEQ. ID. NO. 32715 | 291-GlyTyrGlyAspValLysLeuGlnTyrArgLeuAsnAspArgGlnAsnVal-307 |
| SEQ. ID. NO. 32716 | 312-ArgTyrAsnProLysThrGlyTyr-319 |
| SEQ. ID. NO. 32717 | 330-IleLysGlyLysLeuLysGlyValVal-338 |
| SEQ. ID. NO. 32718 | 342-HisGlyTyrGlyGluSerLeuIleAspTyrAsnHisLysGlnAsnGly-357 |
| SEQ. ID. NO. 32719 | 365-AsnAspTrpAspGlyIle-370 |
| Hydrophilic Regions - Hopp-Woods | |
| SEQ. ID. NO. 32720 | 48-AlaGlyGlnGluGlyGlnGluSerLysAla-57 |
| SEQ. ID. NO. 32721 | 63-GluThrValArgSerSerLeuAspLysGlyGluAla-74 |
| SEQ. ID. NO. 32722 | 79-GluLysGlyGlyAspAlaLeuPro-86 |
| SEQ. ID. NO. 32723 | 88-AspSerAlaGlyGluThrAlaAsp-95 |
| SEQ. ID. NO. 32724 | 105-AspLeuAspLysAsnAspLeuArgGly-113 |
| SEQ. ID. NO. 32725 | 115-LeuGlyValArgGluHisAsn-121 |
| SEQ. ID. NO. 32726 | 140-SerProThrArgGlyThrThrValGlnGluLysPheGlyGlnGlnLysArgAlaGluThrLysLeu-161 |
| SEQ. ID. NO. 32727 | 165-PheLysSerLysIleAla-170 |
| SEQ. ID. NO. 32728 | 173-LeuPheLysThrArgAla-178 |
| SEQ. ID. NO. 32729 | 195-GlnGlyArgLysSerAlaProPheArgAsnThrAspTyrLysPro-209 |
| SEQ. ID. NO. 32730 | 225-GlyArgLeuArgMet-229 |
| SEQ. ID. NO. 32731 | 239-AsnGlyGlnSerArgProGluSerArgSerTrp-249 |
| SEQ. ID. NO. 32732 | 274-PheAspGlnSerGlyAspLysAsnAspAsnProAspIleAlaAsp-288 |
| SEQ. ID. NO. 32733 | 293-GlyAspValLysLeu-297 |
| SEQ. ID. NO. 32734 | 299-TyrArgLeuAsnAspArgGlnAsn-306 |
| SEQ. ID. NO. 32735 | 332-GlyLysLeuLysGlyValVal-338 |
| SEQ. ID. NO. 32736 | 352-AsnHisLysGlnAsn-356 |
| g583 | |
| AMPHI Regions - AMPHI | |
| SEQ. ID. NO. 32737 | 11-HisLeuAlaPheCysAlaPheCysGlyIle-20 |
| SEQ. ID. NO. 32738 | 28-ArgLeuHisAsnArgMetTyrAsnAlaAlaAlaAlaArg-40 |
| SEQ. ID. NO. 32739 | 58-ValThrAspAlaGln-62 |
| SEQ. ID. NO. 32740 | 66-SerLysAsnGlyAspLysGlnIle-73 |
| SEQ. ID. NO. 32741 | 75-AspThrHisProGlnPro-80 |
| SEQ. ID. NO. 32742 | 117-GlyTyrAlaGlyTyrCysAspGln-124 |
| SEQ. ID. NO. 32743 | 141-AsnGlyGlyAsnHisThrAsp-147 |
| SEQ. ID. NO. 32744 | 162-GlyTyrGlyGlnCysGlnAsnGlnGlyAla-171 |
| Antigenic Index - Jameson-Wolf | |
| SEQ. ID. NO. 32745 | 24-ThrAlaGlyAsnArgLeuHisAsnArgMetTyr-34 |
| SEQ. ID. NO. 32746 | 41-GlyIleGlyArgGlyAsnGlySerGlnGlnGlnPheGlyLysSerGluThrValThrAspAlaGlnArgPheSerSerLysAsnGlyAspLysGln<br>IleSerAspThrHisProGlnProCysPheGluGlnThrAlaArgAsnHisAsnCysAspGlyAsnGlnProAsnGlnArgIleGlyGluArgThrGlnArg<br>IleAlaHisArgArgAlaArgPhe-114 |
| SEQ. ID. NO. 32747 | 117-GlyTyrAlaGlyTyrCysAspGlnProAspGlyAsnAsnArgGlnArgAlaGlnArgHisAsnLeuAlaAspAsnGlyGlyAsnHisThrAspLys<br>HisSerGlnGlnArgProSerLeuArgLeuAspProValGlyTyrGlyGlnCysGlnAsnGlnGlyAlaGlnTyrCysGlyAsnGlyGluGlyTyrArg<br>Phe-182 |
| SEQ. ID. NO. 32748 | 190-AspLeuArgLysLysAspArgProGluLysSerGluLys-202 |
| Hydrophilic Regions - Hopp-Woods | |
| SEQ. ID. NO. 32749 | 27-AsnArgLeuHisAsn-31 |
| SEQ. ID. NO. 32750 | 41-GlyIleGlyArgGlyAsnGlySer-48 |
| SEQ. ID. NO. 32751 | 51-GlnPheGlyLysSerGluThrValThrAspAlaGlnArgPheSerSerLysAsnGlyAspLysGlnIleSerAspThrHisPro-78 |
| SEQ. ID. NO. 32752 | 84-GlnThrAlaArgAsnHisAsnCysAspGlyAsnGlnProAsnGlnArgIleGlyGluArgThrGlnArgIleAlaHisArgArgAlaArgPhe-114 |
| SEQ. ID. NO. 32753 | 123-AspGlnProAspGlyAsnAsnArgGlnArgAlaGlnArgHisAsnLeuAlaAspAsnGlyGlyAsnHisThrAspLysHisSerGlnGlnArgPro<br>SerLeuArgLeuAspPro-160 |
| SEQ. ID. NO. 32754 | 178-GluGlyTyrArgPhe-182 |
| SEQ. ID. NO. 32755 | 190-AspLeuArgLysLysAspArgProGluLysSerGluLys-202 |
| g584 | |
| AMPHI Regions - AMPHI | |
| SEQ. ID. NO. 32756 | 28-GluPheSerGluSerAlaGly-34 |
| SEQ. ID. NO. 32757 | 60-AlaGluPheValLysLysPheAsnAsnPheThrArgLys-72 |
| SEQ. ID. NO. 32758 | 116-PheAspAlaLeuAsnArgPheIleAlaAspVal-126 |
| SEQ. ID. NO. 32759 | 148-IleAspGlnValSerLysAsp-154 |
| SEQ. ID. NO. 32760 | 166-LeuAlaGlyValLeuGly-171 |
| Antigenic Index - Jameson-Wolf | |
| SEQ. ID. NO. 32761 | 37-ValAlaGlnAspThrMetSer-43 |
| SEQ. ID. NO. 32762 | 50-AlaGluGlyArgAspLysAsnAlaVal-58 |
| SEQ. ID. NO. 32763 | 61-GluPheValLysLysPheAsnAsnPheThrArgLysSerLysAsnGlySerPheLysThrGluLeuValSerArgSerAlaMetProArgTyrGlnTyr<br>ThrAsnGlyArgArgIleGlnThrGlyTrpGluGlnArgAlaGluPheLysAlaGluGlyArgAspPheAspAla-118 |
| SEQ. ID. NO. 32764 | 126-ValGlnThrAspAlaSerLeuGluAspThrAspPheSerValSerArgGluArgArgAsnGluValIleAspGlnValSerLysAspAlaValLeu-157 |
| SEQ. ID. NO. 32765 | 159-PheLysAlaArgAlaGluLysLeuAla-167 |
| SEQ. ID. NO. 32766 | 189-IleAlaGlyAspGlyAlaValArgAlaLysMetLeuArg-201 |
| SEQ. ID. NO. 32767 | 210-AsnMetLysGlyThrAspSerAlaAlaProGlyValGluGluIleSer-225 |
| Hydrophilic Regions - Hopp-Woods | |
| SEQ. ID. NO. 32768 | 50-AlaGluGlyArgAspLysAsnAlaVal-58 |
| SEQ. ID. NO. 32769 | 67-AsnAsnPheThrArgLysSerLysAsnGlySerPheLysThrGluLeuValSer-84 |
| SEQ. ID. NO. 32770 | 95-AsnGlyArgArgIleGlnThrGlyTrpGluGluArgAlaGluPheLysAlaGluGlyArgAspPheAspAla-118 |
| SEQ. ID. NO. 32771 | 130-AlaSerLeuGluAspThrAspPheSerValSerArgGluArgArgAsnGluValIleAspGlnValSerLysAspAlaValLeu-157 |

TABLE 1-continued

SEQ. ID. NO. 32772  159-PheLysAlaArgAlaGluLysLeuAla-167
SEQ. ID. NO. 32773  193-GlyAlaValArgAlaLysMetLeuArg-201
SEQ. ID. NO. 32774  210-AsnMetLysGlyThrAspSerAlaAlaProGlyValGluGluIleSer-225
g585
AMPHI Regions - AMPHI
SEQ. ID. NO. 32775  6-ArgIlePheAlaThrPheCysAlaValIleValCys-17
SEQ. ID. NO. 32776  46-ThrThrLeuMetGlySerIleIleSer-54
SEQ. ID. NO. 32777  65-ArgGluIleLeuThrGluTrpLys-72
SEQ. ID. NO. 32778  93-AsnArgTyrIleAsp-97
SEQ. ID. NO. 32779  136-AspAsnHisGlnAlaGlnArg-142
SEQ. ID. NO. 32780  153-ProLeuAlaProIleTrp-158
SEQ. ID. NO. 32781  178-LeuAlaGlyAsnIleAlaLysProIleArgIleLeuGlyAsnGlyMetAspArgValAlaGluArgGlu-200
Antigenic Index - Jameson-Wolf
SEQ. ID. NO. 32782  36-AsnGlnPheAsnGlnArgArgThrIleGlu-45
SEQ. ID. NO. 32783  56-PheLysThrArgGlyAspAsnGlyAlaArgGluIleLeuThrGluTrpLysAsnSerProValSer-77
SEQ. ID. NO. 32784  84-GlnGlyAspGluLysLysAspIleLeu-92
SEQ. ID. NO. 32785  99-TyrThrIleGluArgAlaArgLeu-106
SEQ. ID. NO. 32786  119-IleGluTyrAspArgPheGlyGlu-126
SEQ. ID. NO. 32787  134-GlyTrpAspAsnHisGlnAlaGlnArgLeuProSerPro-146
SEQ. ID. NO. 32788  189-LeuGlyAsnGlyMetAspArgValAlaGluArgGluLeuGluAspArgValCysGlnGlnValArgAspArgAspAspGluLeuAlaAsp-218
SEQ. ID. NO. 32789  225-ThrMetValGluLysLeuGlu-231
Hydrophilic Regions - Hopp-Woods
SEQ. ID. NO. 32790  37-GlnPheAsnGlnArgArgThrIleGlu-45
SEQ. ID. NO. 32791  56-PheLysThrArgGlyAspAsnGlyAlaArgGluIleLeuThr-69
SEQ. ID. NO. 32792  84-GlnGlyAspGluLysLysAspIleLeu-92
SEQ. ID. NO. 32793  100-ThrIleGluArgAlaArgLeu-106
SEQ. ID. NO. 32794  119-IleGluTyrAspArgPheGlyGlu-126
SEQ. ID. NO. 32795  139-GlnAlaGlnArgLeu-143
SEQ. ID. NO. 32796  192-GlyMetAspArgValAlaGluArgGluLeuGluAspArgValCysGlnGlnValArgAspArgAspAspGluLeuAlaAsp-218
SEQ. ID. NO. 32797  225-ThrMetValGluLysLeuGlu-231
g586
AMPHI Regions - AMPHI
SEQ. ID. NO. 32798  12-AspAsnPheLysTyrPheTrpLysThr-20
SEQ. ID. NO. 32799  30-IleLeuAlaAlaLeuGly-35
SEQ. ID. NO. 32800  56-ValLeuAlaAsnIleValGluLysAlaGlnAsnLysAlaPro-69
SEQ. ID. NO. 32801  80-LeuGlnGlnSerTyrProHisSerIleSer-89
SEQ. ID. NO. 32802  177-SerGlnGluAlaLeuLysAsnTyrGlyGlnAlaLeuGluLysMetProGlnAspSerValGlyArg-198
Antigenic Index - Jameson-Wolf
SEQ. ID. NO. 32803  4-HisLeuGluGluGlnGlnGluLeuAspAsn-13
SEQ. ID. NO. 32804  43-GlnAsnArgAlaAlaSerGlnAsnGlnGluAla-53
SEQ. ID. NO. 32805  60-IleValGluLysAlaGlnAsnLysAlaProGlnSerGluIleAsnAlaGluLeuSerLysLeuGlnGln-82
SEQ. ID. NO. 32806  100-ThrGluPheAspAlaGlnArgTyrAspValAlaGluGly-112
SEQ. ID. NO. 32807  118-LeuSerAsnGlnLysAspSerLeu-125
SEQ. ID. NO. 32808  140-GlnGlnLysLysTyrAspAla-146
SEQ. ID. NO. 32809  153-ThrProValGluAlaAspPhe-159
SEQ. ID. NO. 32810  164-MetGluThrLysGlyAspVal-170
SEQ. ID. NO. 32811  172-AlaAlaGlnGluLysSerGlnGluAlaLeuLysAsnTyrGlyGlnAlaLeuGluLysMetProGlnAspSerValGlyArgGluLeuLeu-201
SEQ. ID. NO. 32812  204-LysLeuAspSerLeuLys-209
Hydrophilic Regions - Hopp-Woods
SEQ. ID. NO. 32813  4-HisLeuGluGluGlnGlnGluLeuAspAsn-13
SEQ. ID. NO. 32814  45-ArgAlaAlaSerGlnAsnGlnGluAla-53
SEQ. ID. NO. 32815  60-IleValGluLysAlaGlnAsnLysAlaProGlnSerGluIleAsnAlaGluLeuSerLysLeu-80
SEQ. ID. NO. 32816  100-ThrGluPheAspAlaGlnArgTyrAspValAlaGluGly-112
SEQ. ID. NO. 32817  120-AsnGlnLysAspSerLeu-125
SEQ. ID. NO. 32818  140-GlnGlnLysLysTyrAspAla-146
SEQ. ID. NO. 32819  153-ThrProValGluAlaAspPhe-159
SEQ. ID. NO. 32820  164-MetGluThrLysGlyAspVal-170
SEQ. ID. NO. 32821  172-AlaAlaGlnGluLysSerGlnGluAlaLeuLys-182
SEQ. ID. NO. 32822  187-AlaLeuGluLysMetProGlnAspSerValGlyArgGluLeuLeu-201
SEQ. ID. NO. 32823  204-LysLeuAspSerLeuLys-209
g587
AMPHI Regions - AMPHI
SEQ. ID. NO. 32824  6-LeuProAlaLeuProAlaIleLeuProLeuSerAla-17
SEQ. ID. NO. 32825  122-LysArgMetSerAspIleSerAlaGlyIleSerHis-133
Antigenic Index - Jameson-Wolf
SEQ. ID. NO. 32826  27-AspIleMetThrAspLysGlyLysTrpLysLeuGluThr-39
SEQ. ID. NO. 32827  45-AsnSerGluAsnSerArgAla-51
SEQ. ID. NO. 32828  71-ThrGluIleGlnGluAsnGlySerAsnThr-80
SEQ. ID. NO. 32829  95-GlyAsnThrAspIleTyrGlySerGlySer-104
SEQ. ID. NO. 32830  108-HisGluGluArgLysLeuAspGlyAsnGlyLysThrArgAsnLysArgMetSerAspIle-127
SEQ. ID. NO. 32831  135-PheLeuLysAspGlyLysAsnProAla-143
SEQ. ID. NO. 32832  151-ThrValTyrGluLysSerArgAsnLysAlaSerLeuIleLysLysArgGlyLeuCys-169
Hydrophilic Regions - Hopp-Woods
SEQ. ID. NO. 32833  27-AspIleMetThrAspLysGlyLysTrpLysLeu-37
SEQ. ID. NO. 32834  47-GluAsnSerArgAla-51
SEQ. ID. NO. 32835  72-GluIleGlnGluAsnGlySerAsn-79
SEQ. ID. NO. 32836  108-HisGluGluArgLysLeuAspGlyAsnGlyLysThrArgAsnLysArgMetSerAspIle-127
SEQ. ID. NO. 32837  135-PheLeuLysAspGlyLysAsn-141
SEQ. ID. NO. 32838  151-ThrValTyrGluLysSerArgAsnLysAlaSerLeuIleLysLysArgGlyLeu-168
g588

TABLE 1-continued

AMPHI Regions - AMPHI
SEQ. ID. NO. 32839    55-ArgGlyTyrThrGlySer-60
Antigenic Index - Jameson-Wolf
SEQ. ID. NO. 32840    24-SerProTyrGlnGluThrGlyCysThrTyrGluGlyGlyIleGlyLysAspGlyLeuProSerGlyLysGlyIleTrpArgCysArgAspGly
                      ArgGlyTyrThrGlySerPheLysAsnGlyLysPheAspGlyGlnGly-70
SEQ. ID. NO. 32841    85-PheAsnSerAspSerThrLysPheArgAsn-94
SEQ. ID. NO. 32842    105-LeuAlaHisGlyArgPheAlaAlaSerGlnAsnGlyGluThr-118
SEQ. ID. NO. 32843    124-MetArgThrArgHisAsp-129
Hydrophilic Regions - Hopp-Woods
SEQ. ID. NO. 32844    36-GlyIleGlyLysAspGlyLeuProSer-44
SEQ. ID. NO. 32845    49-TrpArgCysArgAspGlyArgGlyTyr-57
SEQ. ID. NO. 32846    61-PheLysAsnGlyLysPheAspGly-68
SEQ. ID. NO. 32847    85-PheAsnSerAspSerThrLysPheArgAsn-94
SEQ. ID. NO. 32848    124-MetArgThrArgHisAsp-129
g589
AMPHI Regions - AMPHI
SEQ. ID. NO. 32849    18-AlaSerArgIleGluLysValLeu-25
SEQ. ID. NO. 32850    54-ValAlaAspIleAlaLysIleIleGluLys-63
SEQ. ID. NO. 32851    103-MetValGlyMetMet-107
SEQ. ID. NO. 32852    127-ValLeuAlaSerIleValGlnLeuTrpLeuAla-137
SEQ. ID. NO. 32853    155-MetAspValLeuValThrIle-161
SEQ. ID. NO. 32854    198-PheValSerLeuGlyLysPheLeuGluHisArg-208
SEQ. ID. NO. 32855    230-ValGlnArgAsnGlyGlu-235
SEQ. ID. NO. 32856    245-GlnIleGlyAspLeuIleArg-251
SEQ. ID. NO. 32857    315-LeuGlyAspMetMetAsnAlaLeuSerGluAlaGln-326
SEQ. ID. NO. 32858    330-AlaProIleAlaArgValAlaAspLys-338
SEQ. ID. NO. 32859    396-MetGlyLysAlaVal-400
SEQ. ID. NO. 32860    471-IleValSerAlaAlaGln-476
SEQ. ID. NO. 32861    482-IleProAlaAlaGln-486
SEQ. ID. NO. 32862    502-GlyValGlyLeuValLys-507
SEQ. ID. NO. 32863    539-LysProIleGlyAlaPheAlaLeuSerAspAlaLeuLys-551
SEQ. ID. NO. 32864    553-AspThrAlaGluAlaIleGlyArgLeu-561
SEQ. ID. NO. 32865    591-AlaPheGlyAsnMetSerProCysAspLysAlaAlaGluValGlnLysLeuLysAlaAla-610
SEQ. ID. NO. 32866    617-ValGlyAspGlyIleAsnAspAlaPro-625
SEQ. ID. NO. 32867    640-AlaAspValAlaGluHisThr-646
SEQ. ID. NO. 32868    653-GlnHisSerValAsnGlnLeu-659
SEQ. ID. NO. 32869    680-AlaPhePheTyrAsnIleLeu-686
Antigenic Index - Jameson-Wolf
SEQ. ID. NO. 32870    1-MetGlnGlnLysIleArgPhe-7
SEQ. ID. NO. 32871    17-CysAlaSerArgIleGluLysValLeuAsnLysLysAspPheValGluSer-33
SEQ. ID. NO. 32872    39-AlaSerGluGluAlaGlnValThrPheAspGlySerLysThrSerVal-54
SEQ. ID. NO. 32873    59-LysIleIleGluLysThrGlyTyrGlyAlaLysGluLysThrGluAspThrLeuProGlnProGluAlaGluHis-83
SEQ. ID. NO. 32874    114-ThrArgHisAspTrp-118
SEQ. ID. NO. 32875    148-IleLysGlyGlyLeu-152
SEQ. ID. NO. 32876    205-LeuGluHisArgThrLysLysSerSerLeuAsn-215
SEQ. ID. NO. 32877    228-ValAsnValGlnArgAsnGlyGluTrpLysGlnLeuProIleAspGln-243
SEQ. ID. NO. 32878    248-AspLeuIleArgThrAsnHisGlyGluArgIleAlaAla-260
SEQ. ID. NO. 32879    262-GlyIleIleGluSerGlySerGlyTrpAlaAspGluSerHisLeuThrGlyGluSerAsnProGluGluLysLysAlaGlyGly-289
SEQ. ID. NO. 32880    298-ThrGluGlySerVal-302
SEQ. ID. NO. 32881    323-SerGluAlaGlnGlySerLysAlaProIle-332
SEQ. ID. NO. 32882    334-ArgValAlaAspLysAlaAla-340
SEQ. ID. NO. 32883    361-IleLysGlyAspTrp-365
SEQ. ID. NO. 32884    396-MetGlyLysAlaValLys-401
SEQ. ID. NO. 32885    409-AlaAlaAlaMetGluGluAlaAlaHis-417
SEQ. ID. NO. 32886    422-ValLeuAspLysThrGlyThrLeuThrGluGlyArgProGlnVal-436
SEQ. ID. NO. 32887    443-ProAspSerGlyPheAspGluAspAlaLeu-452
SEQ. ID. NO. 32888    459-ValGluGlnAsnAla-463
SEQ. ID. NO. 32889    498-AlaGluValGluGly-502
SEQ. ID. NO. 32890    507-LysSerGlyLysAlaGluPheAla-514
SEQ. ID. NO. 32891    520-LysPheSerAspGlyVal-525
SEQ. ID. NO. 32892    535-SerValAsnGlyLysProIle-541
SEQ. ID. NO. 32893    548-AspAlaLeuLysAlaAspThrAlaGluAlaIleGlyArgLeuLysLysHisAsnIle-566
SEQ. ID. NO. 32894    572-SerGlyAspAsnGlnSerThrVal-579
SEQ. ID. NO. 32895    596-SerProCysAspLysAlaAlaGluValGlnLysLeuLysAlaAlaGly-611
SEQ. ID. NO. 32896    617-ValGlyAspGlyIleAsnAspAla-624
SEQ. ID. NO. 32897    636-MetLysGlyGlyAlaAspValAlaGlu-644
Hydrophilic Regions - Hopp-Woods
SEQ. ID. NO. 32898    1-MetGlnGlnLysIleArgPhe-7
SEQ. ID. NO. 32899    19-SerArgIleGluLysValLeuAsnLysLysAspPheValGlu-32
SEQ. ID. NO. 32900    39-AlaSerGluGluAlaGlnVal-45
SEQ. ID. NO. 32901    48-AspGlySerLysThrSerVal-54
SEQ. ID. NO. 32902    64-ThrGlyTyrGlyAlaLysGluLysThrGluAspThrLeuProGlnProGluAlaGluHis-83
SEQ. ID. NO. 32903    205-LeuGluHisArgThrLysLysSerSerLeu-214
SEQ. ID. NO. 32904    229-AsnValGlnArgAsnGlyGluTrpLys-237
SEQ. ID. NO. 32905    253-AsnHisGlyGluArgIleAlaAla-260
SEQ. ID. NO. 32906    262-GlyIleIleGluSer-266
SEQ. ID. NO. 32907    270-TrpAlaAspGluSerHisLeuThrGlyGluSerAsnProGluGluLysLysAlaGlyGly-289
SEQ. ID. NO. 32908    323-SerGluAlaGlnGlySerLysAlaProIle-332
SEQ. ID. NO. 32909    334-ArgValAlaAspLysAlaAla-340
SEQ. ID. NO. 32910    409-AlaAlaAlaMetGluGluAlaAlaHis-417

| | |
|---|---|
| SEQ. ID. NO. 32911 | 422-ValLeuAspLysThrGlyThrLeuThrGluGlyArgProGln-435 |
| SEQ. ID. NO. 32912 | 445-SerGlyPheAspGluAspAlaLeu-452 |
| SEQ. ID. NO. 32913 | 459-ValGluGlnAsnAla-463 |
| SEQ. ID. NO. 32914 | 498-AlaGluValGluGly-502 |
| SEQ. ID. NO. 32915 | 507-LysSerGlyLysAlaGluPheAla-514 |
| SEQ. ID. NO. 32916 | 548-AspAlaLeuLysAlaAspThrAlaGluAlaIleGlyArgLeuLysLysHisAsnIle-566 |
| SEQ. ID. NO. 32917 | 573-GlyAspAsnGlnSer-577 |
| SEQ. ID. NO. 32918 | 596-SerProCysAspLysAlaAlaGluValGlnLysLeuLysAlaAlaGly-611 |
| SEQ. ID. NO. 32919 | 638-GlyGlyAlaAspValAlaGlu-644 | g590
AMPHI Regions - AMPHI

| | |
|---|---|
| SEQ. ID. NO. 32920 | 90-ValThrLeuValAsnHisIleThrHis-98 |
| SEQ. ID. NO. 32921 | 100-ProPheAlaGlyGlyPhe-105 |
| SEQ. ID. NO. 32922 | 123-LysValLeuGluArgPhePhe-129 |
| SEQ. ID. NO. 32923 | 132-GlnValProValSerLeu-137 |
| SEQ. ID. NO. 32924 | 177-TyrGlnLysGlyPheLysSerTyrArgAsnSer-187 |
| SEQ. ID. NO. 32925 | 213-GluThrSerAspGlyIleAsnProLeu-221 |
| SEQ. ID. NO. 32926 | 248-AsnGluLeuValAsnLeuVal-254 |
| SEQ. ID. NO. 32927 | 331-LysArgLysPheAla-335 |
| SEQ. ID. NO. 32928 | 420-LysMetLeuGluAsp-424 |
| SEQ. ID. NO. 32929 | 450-AspIleAsnGluThrLeuArgLeuMet-458 |
| SEQ. ID. NO. 32930 | 460-AspSerThrValGln-464 |

Antigenic Index - Jameson-Wolf

| | |
|---|---|
| SEQ. ID. NO. 32931 | 1-MetLysLysProLeu-5 |
| SEQ. ID. NO. 32932 | 26-LysAlaGluGluSerLeuThrGlnGlnGlnLysIleLeuGlnLysThrGly-42 |
| SEQ. ID. NO. 32933 | 48-SerHisGlnTyrAspArgGlyTrpPheThrSerThrGluThrThrValIleArgLeuLysProGluLeu-70 |
| SEQ. ID. NO. 32934 | 75-GlnLysTyrLeuProAspAsnLeuLys-83 |
| SEQ. ID. NO. 32935 | 111-IleGluThrGluPheLysTyrAlaProGluThrGluLysValLeuGlu-126 |
| SEQ. ID. NO. 32936 | 128-PhePheGlyLysGlnVal-133 |
| SEQ. ID. NO. 32937 | 144-AsnGlySerGlyLysMetGluVal-151 |
| SEQ. ID. NO. 32938 | 157-AspTyrGluGluLeuSerGly-163 |
| SEQ. ID. NO. 32939 | 179-LysGlyPheLysSerTyrArgAsnSerTyrAspAlaProLeu-192 |
| SEQ. ID. NO. 32940 | 196-LysLeuAlaAspLysGlyAspAlaAlaPheGlu-206 |
| SEQ. ID. NO. 32941 | 208-AlaHisPheAspSerGluThrSerAspGlyIleAsn-219 |
| SEQ. ID. NO. 32942 | 233-PheSerLeuGluTrpLysGluGlyValAspTyr-243 |
| SEQ. ID. NO. 32943 | 264-AsnProAsnGlySerIleAlaProSerLysIleGluValGly-277 |
| SEQ. ID. NO. 32944 | 281-PheSerThrLysThrGlyGluSerGlyAla-290 |
| SEQ. ID. NO. 32945 | 292-IleAspSerGluGlyArgPheArgPhe-300 |
| SEQ. ID. NO. 32946 | 304-ValTyrGlyAspGluLysTyrGlyPro-312 |
| SEQ. ID. NO. 32947 | 329-ValLeuLysArgLysPheAla-335 |
| SEQ. ID. NO. 32948 | 338-SerAlaLysLysMetThrGluGluGlnIleArgAsnAspLeu-351 |
| SEQ. ID. NO. 32949 | 355-ValLysGlyAspAlaSerGly-361 |
| SEQ. ID. NO. 32950 | 378-LeuProGlnGlyLysIleAspValGlyGly-387 |
| SEQ. ID. NO. 32951 | 393-GlyMetLysLysGluAspLeuAsnGln-401 |
| SEQ. ID. NO. 32952 | 406-LeuLysLysThrGluAlaAsnIle-413 |
| SEQ. ID. NO. 32953 | 437-AsnAlaGluAspGluAlaGluAlaArgAlaSerIle-448 |
| SEQ. ID. NO. 32954 | 450-AspIleAsnGluThrLeu-455 |
| SEQ. ID. NO. 32955 | 466-MetAlaArgGluLysTyrLeu-472 |
| SEQ. ID. NO. 32956 | 485-LeuLysAsnAsnAlaLeuLysLeuAsnGlyLysThrLeuGlnAsnGluProAspProAspPheAspGluGlyAspMetValSerGlyGlnProHis-516 |

Hydrophilic Regions - Hopp-Woods

| | |
|---|---|
| SEQ. ID. NO. 32957 | 1-MetLysLysProLeu-5 |
| SEQ. ID. NO. 32958 | 26-LysAlaGluGluSerLeuThrGln-33 |
| SEQ. ID. NO. 32959 | 62-ThrValIleArgLeuLysProGluLeu-70 |
| SEQ. ID. NO. 32960 | 77-TyrLeuProAspAsnLeu-82 |
| SEQ. ID. NO. 32961 | 111-IleGluThrGluPheLysTyrAlaProGluThrGluLysValLeuGlu-126 |
| SEQ. ID. NO. 32962 | 147-GlyLysMetGluVal-151 |
| SEQ. ID. NO. 32963 | 157-AspTyrGluGluLeuSerGly-163 |
| SEQ. ID. NO. 32964 | 180-GlyPheLysSerTyrArgAsnSerTyr-188 |
| SEQ. ID. NO. 32965 | 196-LysLeuAlaAspLysGlyAspAlaAlaPheGlu-206 |
| SEQ. ID. NO. 32966 | 208-AlaHisPheAspSerGluThrSerAspGly-217 |
| SEQ. ID. NO. 32967 | 233-PheSerLeuGluTrpLysGluGlyValAspTyr-243 |
| SEQ. ID. NO. 32968 | 272-SerLysIleGluValGly-277 |
| SEQ. ID. NO. 32969 | 292-IleAspSerGluGlyArgPheArgPhe-300 |
| SEQ. ID. NO. 32970 | 304-ValTyrGlyAspGluLysTyrGlyPro-312 |
| SEQ. ID. NO. 32971 | 329-ValLeuLysArgLysPheAla-335 |
| SEQ. ID. NO. 32972 | 338-SerAlaLysLysMetThrGluGluGlnIleArgAsnAspLeu-351 |
| SEQ. ID. NO. 32973 | 355-ValLysGlyAspAla-359 |
| SEQ. ID. NO. 32974 | 381-GlyLysIleAspValGlyGly-387 |
| SEQ. ID. NO. 32975 | 393-GlyMetLysLysGluAspLeuAsn-400 |
| SEQ. ID. NO. 32976 | 406-LeuLysLysThrGluAlaAsnIle-413 |
| SEQ. ID. NO. 32977 | 437-AsnAlaGluAspGluAlaGluAlaArgAlaSerIle-448 |
| SEQ. ID. NO. 32978 | 450-AspIleAsnGluThrLeu-455 |
| SEQ. ID. NO. 32979 | 466-MetAlaArgGluLysTyrLeu-472 |
| SEQ. ID. NO. 32980 | 496-ThrLeuGlnAsnGluProAspProAspPheAspGluGlyAspMetValSer-512 | g591
AMPHI Regions - AMPHI

| | |
|---|---|
| SEQ. ID. NO. 32981 | 6-AlaPheIlePheAla-10 |
| SEQ. ID. NO. 32982 | 17-LeuHisGluPheGlyHisTyrIleValAla-26 |
| SEQ. ID. NO. 32983 | 61-LeuGlyGlyTyrValLysMetValAsp-69 |
| SEQ. ID. NO. 32984 | 143-GlyAspLysIleGlnSerValAsnGlyValSerValGln-155 |

TABLE 1-continued

| SEQ. ID. NO. 32985 | 181-SerGlyAlaGlnThrValArgThrIleAspAlaAlaGlyThrProGluAlaGlyLysIleAlaLys-202 |
| SEQ. ID. NO. 32986 | 218-AlaGlyGlyValGluLys-223 |
| SEQ. ID. NO. 32987 | 234-ProGlyAspArgLeu-238 |
| SEQ. ID. NO. 32988 | 245-ProIleAlaSerTrpGlnGluTrpAlaAsnLeuThrArg-257 |
| SEQ. ID. NO. 32989 | 304-AlaTrpAspAlaGlnIleArg-310 |
| SEQ. ID. NO. 32990 | 313-TyrArgProSerValValArgAlaPheGly-322 |
| SEQ. ID. NO. 32991 | 324-GlyTrpGluLysThrValSerHis-331 |
| SEQ. ID. NO. 32992 | 335-ThrLeuLysPhePheGlyLysLeuIle-343 |
| SEQ. ID. NO. 32993 | 351-HisIleSerGlyProLeuThrIleAla-359 |
| SEQ. ID. NO. 32994 | 373-TyrLeuGluPheLeuAlaLeu-379 |

Antigenic Index - Jameson-Wolf

| SEQ. ID. NO. 32995 | 44-PhePheThrArgLysArgGlyAspThrGlu-53 |
| SEQ. ID. NO. 32996 | 68-ValAspThrArgGluGlyGluValSerGluAlaAspLeu-80 |
| SEQ. ID. NO. 32997 | 84-PheAspLysGlnHisProAlaLysArg-92 |
| SEQ. ID. NO. 32998 | 128-ThrValGluProAspThrValAla-135 |
| SEQ. ID. NO. 32999 | 139-GlyPheGlnSerGlyAspLysIleGlnSer-148 |
| SEQ. ID. NO. 33000 | 156-AspTrpSerSerAlaGlnThr-162 |
| SEQ. ID. NO. 33001 | 187-ArgThrIleAspAlaAlaGlyThrProGluAlaGlyLysIleAlaLysAsnGlnGly-205 |
| SEQ. ID. NO. 33002 | 219-GlyGlyValGluLysGlySerProAlaGluLysAlaGlyLeuLysProGlyAspArgLeuThrAlaAlaAspGlyLysProIle-246 |
| SEQ. ID. NO. 33003 | 254-AsnLeuThrArgGlnSerProGlyLysLysIle-264 |
| SEQ. ID. NO. 33004 | 268-TyrGluArgAlaGlyGlnThrHisThrAlaAspIleArgProAspThrValGluGlnProAspHisThrLeu-291 |
| SEQ. ID. NO. 33005 | 295-ValGlyLeuArgProGlnProAspArgAlaTrp-305 |
| SEQ. ID. NO. 33006 | 307-AlaGlnIleArgArgSerTyrArgProSerVal-317 |
| SEQ. ID. NO. 33007 | 327-LysThrValSerHisSer-332 |
| SEQ. ID. NO. 33008 | 343-IleSerGlyAsnAla-347 |
| SEQ. ID. NO. 33009 | 362-AlaGlyGlnSerAla-366 |
| SEQ. ID. NO. 33010 | 408-IleArgGlyLysProLeuGlyGluArgValGln-418 |

Hydrophilic Regions - Hopp-Woods

| SEQ. ID. NO. 33011 | 44-PhePheThrArgLysArgGlyAspThr-52 |
| SEQ. ID. NO. 33012 | 68-ValAspThrArgGluGlyGluValSerGluAlaAspLeu-80 |
| SEQ. ID. NO. 33013 | 84-PheAspLysGlnHisProAlaLysArg-92 |
| SEQ. ID. NO. 33014 | 129-ValGluProAspThrValAla-135 |
| SEQ. ID. NO. 33015 | 139-GlyPheGlnSerGlyAspLysIleGlnSer-148 |
| SEQ. ID. NO. 33016 | 193-GlyThrProGluAlaGlyLysIleAlaLys-202 |
| SEQ. ID. NO. 33017 | 220-GlyValGluLysGlySerProAlaGluLysAlaGlyLeuLysProGlyAspArgLeuThrAlaAlaAspGlyLysPro-245 |
| SEQ. ID. NO. 33018 | 256-ThrArgGlnSerProGlyLysLysIle-264 |
| SEQ. ID. NO. 33019 | 268-TyrGluArgAlaGlyGln-273 |
| SEQ. ID. NO. 33020 | 277-AlaAspIleArgProAspThrValGluGlnProAsp-288 |
| SEQ. ID. NO. 33021 | 299-ProGlnProAspArgAlaTrp-305 |
| SEQ. ID. NO. 33022 | 308-GlnIleArgArgSerTyrArg-314 |
| SEQ. ID. NO. 33023 | 362-AlaGlyGlnSerAla-366 |
| SEQ. ID. NO. 33024 | 411-LysProLeuGlyGluArgValGln-418 | g592
AMPHI Regions - AMPHI

| SEQ. ID. NO. 33025 | 6-PheGlyGlnIlePheSer-11 |
| SEQ. ID. NO. 33026 | 21-GlyGlyLeuLeuGlyGlyLeuIle-28 |
| SEQ. ID. NO. 33027 | 50-AlaProAsnAlaAlaAlaAlaAla-57 |
| SEQ. ID. NO. 33028 | 65-GlnGlyMetIleGlnMetLeuGlyValPheValAsp-76 |
| SEQ. ID. NO. 33029 | 94-ProTyrGlyAspLeu-98 |
| SEQ. ID. NO. 33030 | 109-ValSerGlnValGlyGlnTrp-115 |
| SEQ. ID. NO. 33031 | 153-ThrAlaValPheArgMet-158 |
| SEQ. ID. NO. 33032 | 165-TyrPheGlyAlaValAla-170 |
| SEQ. ID. NO. 33033 | 185-IleMetAlaTrpIleAsnLeuValAlaIleLeuLeuLeuSer-198 |

Antigenic Index - Jameson-Wolf

| SEQ. ID. NO. 33034 | 35-GlyIleLysArgGlyLeuTyrSerAsnGluAlaGlyMetGlySerAlaProAsnAla-53 |
| SEQ. ID. NO. 33035 | 57-AlaGluValLysHisProValSer-64 |
| SEQ. ID. NO. 33036 | 93-GlnProTyrGlyAspLeuSerGly-100 |
| SEQ. ID. NO. 33037 | 137-AlaTyrAlaGluSerAsnVal-143 |
| SEQ. ID. NO. 33038 | 206-ArgAspTyrThrAlaLysLeuLysMetGlyLysAspProGluPheLysLeuSerGluHisProGlyLeuLysArgArgIleLysSerAspValTrp-237 |

Hydrophilic Regions - Hopp-Woods

| SEQ. ID. NO. 33039 | 35-GlyIleLysArgGlyLeuTyr-41 |
| SEQ. ID. NO. 33040 | 57-AlaGluValLysHisProVal-63 |
| SEQ. ID. NO. 33041 | 212-LeuLysMetGlyLysAspProGluPheLysLeuSerGlu-224 |
| SEQ. ID. NO. 33042 | 226-ProGlyLeuLysArgArgIleLysSer-234 | g593
AMPHI Regions - AMPHI

| SEQ. ID. NO. 33043 | 6-GlyLeuCysLysCysPheGlyGly-13 |
| SEQ. ID. NO. 33044 | 41-SerThrLeuLeuAsnMetIleAlaGlyIleValArg-52 |
| SEQ. ID. NO. 33045 | 87-HisMetSerAlaLeuGlu-92 |
| SEQ. ID. NO. 33046 | 113-LeuSerAlaLeuAlaGlu-118 |
| SEQ. ID. NO. 33047 | 125-AlaHisArgLysProGluLysLeuSerGlyGlyGlu-136 |
| SEQ. ID. NO. 33048 | 159-PheSerSerLeuAsp-163 |
| SEQ. ID. NO. 33049 | 165-HisLeuArgAspArgLeuArgArgMet-173 |
| SEQ. ID. NO. 33050 | 217-GluThrLeuIleGlnThrProAlaGlyValGlnValAlaArgLeuMetGlyLeu-234 |
| SEQ. ID. NO. 33051 | 259-LeuLeuSerLeuValArgLeuProAspSerLeuArg-270 |
| SEQ. ID. NO. 33052 | 290-HisThrAspGlyIle-294 |

Antigenic Index - Jameson-Wolf

| SEQ. ID. NO. 33053 | 10-CysPheGlyGlyLysThrValAla-17 |
| SEQ. ID. NO. 33054 | 24-ValGlyArgGlyLysIle-29 |
| SEQ. ID. NO. 33055 | 33-LeuGlyArgSerGlyCysGlyLysSerThr-42 |

TABLE 1-continued

| | |
|---|---|
| SEQ. ID. NO. 33056 | 50-IleValArgProAspGlyGlyGluIleArgLeuAsnGlyGluAsnIleThr-66 |
| SEQ. ID. NO. 33057 | 69-ProProGluLysArgArgIle-75 |
| SEQ. ID. NO. 33058 | 99-LysMetGlnLysMetProLysAlaGluAlaGluArgLeuAla-112 |
| SEQ. ID. NO. 33059 | 119-ValGlyLeuGluAsnGluAlaHisArgLysProGluLysLeuSerGlyGlyGluLysGlnArgLeuAlaLeu-142 |
| SEQ. ID. NO. 33060 | 157-GluSerPheSerSerLeu-162 |
| SEQ. ID. NO. 33061 | 164-ThrHisLeuArgAspArgLeuArgArgMetThrAlaGluArgIleArgLysGlyGlyIle-183 |
| SEQ. ID. NO. 33062 | 190-HisSerProGluGluAlaCysThrAlaAlaAspGluIleAlaVal-204 |
| SEQ. ID. NO. 33063 | 206-HisGluGlyLysIleLeuGlnCysGlyThrProGluThrLeu-219 |
| SEQ. ID. NO. 33064 | 233-GlyLeuProAsnThrAspAspAspArgHisIleProGlnAsnAla-247 |
| SEQ. ID. NO. 33065 | 250-LeuAspAsnHisGlyThrGluCysArg-258 |
| SEQ. ID. NO. 33066 | 264-ArgLeuProAspSerLeuArgLeu-271 |
| SEQ. ID. NO. 33067 | 275-HisProGluHisGlyGlu-280 |
| SEQ. ID. NO. 33068 | 289-GlnHisThrAspGlyIleSerGlyAsnGly-298 |
| SEQ. ID. NO. 33069 | 300-ValArgIleArgValAspGluGlyArgIleValArgPheArg-313 |
| Hydrophilic Regions - Hopp-Woods | |
| SEQ. ID. NO. 33070 | 25-GlyArgGlyLysIle-29 |
| SEQ. ID. NO. 33071 | 36-SerGlyCysGlyLys-40 |
| SEQ. ID. NO. 33072 | 51-ValArgProAspGlyGlyGluIleArgLeuAsnGly-62 |
| SEQ. ID. NO. 33073 | 69-ProProGluLysArgArgIle-75 |
| SEQ. ID. NO. 33074 | 99-LysMetGlnLysMetProLysAlaGluAlaGluArgLeuAla-112 |
| SEQ. ID. NO. 33075 | 119-ValGlyLeuGluAsnGluAlaHisArgLysProGluLysLeuSerGlyGlyGluLysGlnArgLeuAlaLeu-142 |
| SEQ. ID. NO. 33076 | 164-ThrHisLeuArgAspArgLeuArgArgMetThrAlaGluArgIleArgLysGlyGly-182 |
| SEQ. ID. NO. 33077 | 191-SerProGluGluAlaCysThrAlaAlaAspGluIleAlaVal-204 |
| SEQ. ID. NO. 33078 | 206-HisGluGlyLysIle-210 |
| SEQ. ID. NO. 33079 | 236-AsnThrAspAspAspArgHisIlePro-244 |
| SEQ. ID. NO. 33080 | 253-HisGlyThrGluCysArg-258 |
| SEQ. ID. NO. 33081 | 264-ArgLeuProAspSerLeuArg-270 |
| SEQ. ID. NO. 33082 | 275-HisProGluHisGlyGlu-280 |
| SEQ. ID. NO. 33083 | 289-GlnHisThrAspGlyIleSer-295 |
| SEQ. ID. NO. 33084 | 300-ValArgIleArgValAspGluGlyArgIleValArgPheArg-313 |
| g594 | |
| AMPHI Regions - AMPHI | |
| SEQ. ID. NO. 33085 | 21-SerIleLeuArgLeu-25 |
| SEQ. ID. NO. 33086 | 108-AlaGlyArgLysCysGlnGluThrAlaAlaAla-118 |
| SEQ. ID. NO. 33087 | 138-AlaIleLysHisCysAsnPheThr-145 |
| Antigenic Index - Jameson-Wolf | |
| SEQ. ID. NO. 33088 | 1-MetGlyAlaAspThrAspGlyAspLysAspValArgLeuAsnArgThr-16 |
| SEQ. ID. NO. 33089 | 51-ValGluHisProAsnArgPhe-57 |
| SEQ. ID. NO. 33090 | 75-HisLeuAspGlySerThrGlyGly-82 |
| SEQ. ID. NO. 33091 | 86-PheArgArgGluLysThrGlyHisLysArgArgCysHisThrGlnCys-101 |
| SEQ. ID. NO. 33092 | 103-HisSerAlaArgAlaAlaGlyArgLysCysGlnGluThr-115 |
| SEQ. ID. NO. 33093 | 137-ArgAlaIleLysHisCysAsn-143 |
| Hydrophilic Regions - Hopp-Woods | |
| SEQ. ID. NO. 33094 | 1-MetGlyAlaAspThrAspGlyAspLysAspValArgLeuAsnArg-15 |
| SEQ. ID. NO. 33095 | 86-PheArgArgGluLysThrGlyHisLysArgArgCysHis-98 |
| SEQ. ID. NO. 33096 | 105-AlaArgAlaAlaGlyArgLysCysGlnGluThr-115 |
| g595 | |
| AMPHI Regions - AMPHI | |
| SEQ. ID. NO. 33097 | 20-CysGlnProProGluAla-25 |
| SEQ. ID. NO. 33098 | 98-GlyLeuSerAspLysMetAsnArg-105 |
| SEQ. ID. NO. 33099 | 140-AlaAspLeuGluLysLeuProGlnProLeuAlaAspTyrLys-153 |
| SEQ. ID. NO. 33100 | 157-GlnGlyGluValLys-161 |
| SEQ. ID. NO. 33101 | 170-PheThrGluAlaValLysAlaGlyAspIleGluLysAlaLys-183 |
| SEQ. ID. NO. 33102 | 196-IleGluProIleAlaGluLeuPheSerGluLeuAspProValIleAspAlaCysGluAspAspPheLysAspGly-220 |
| SEQ. ID. NO. 33103 | 224-AlaGlyPheThrGlyPheHisArg-231 |
| SEQ. ID. NO. 33104 | 247-GluThrAlaAlaLysLeuMetThrAspValGluAlaLeuGlnLysGluIleAsp-264 |
| SEQ. ID. NO. 33105 | 274-ValGlyGlyAlaSerGluLeuIleGlu-282 |
| SEQ. ID. NO. 33106 | 311-SerLysLysIleValAspLeuPheArgProLeu-321 |
| SEQ. ID. NO. 33107 | 337-PheLysGlnValAsnGluIleLeuAlaLys-346 |
| SEQ. ID. NO. 33108 | 351-AspGlyPheGluThrTyrAspLysLeuSerGluAlaAsp-363 |
| SEQ. ID. NO. 33109 | 369-AlaProIleAsnAlaLeuAlaGluAspLeuAlaGlnLeuArgGlyIleLeuGlyLeu-387 |
| Antigenic Index - Jameson-Wolf | |
| SEQ. ID. NO. 33110 | 1-MetArgLysPheAsn-5 |
| SEQ. ID. NO. 33111 | 21-GlnProProGluAlaGluLysAlaAlaPro-30 |
| SEQ. ID. NO. 33112 | 32-AlaSerGlyGluThrGlnSerAlaAsnGluGlyGlySer-44 |
| SEQ. ID. NO. 33113 | 50-AsnAspAsnAlaCysGluProMetAsnLeu-59 |
| SEQ. ID. NO. 33114 | 70-IleLysAsnAsnSerGlyArgLysLeuGluTrpGluIle-82 |
| SEQ. ID. NO. 33115 | 87-MetValValAspGluArgGluAsnIleAla-96 |
| SEQ. ID. NO. 33116 | 98-GlyLeuSerAspLysMetAsnArgAsnLeuLeuProGlyGluTyrGluMet-114 |
| SEQ. ID. NO. 33117 | 120-ThrAsnProArgGlyLysLeuValVal-128 |
| SEQ. ID. NO. 33118 | 130-AspSerGlyPheLysAspThrAlaAsnGluAlaAspLeuGluLysLeuPro-146 |
| SEQ. ID. NO. 33119 | 158-GlyGluValLysGluLeuAlaLeuAlaLysThrLysThrPheThrGluAlaValLysAlaGlyAspIleGluLysAlaLysSer-184 |
| SEQ. ID. NO. 33120 | 191-ValHisTyrGluArgIleGluProIle-199 |
| SEQ. ID. NO. 33121 | 204-SerGluLeuAspProValIleAspAlaCysGluAspAspPheLysAspGlyAlaLysAspAlaGly-225 |
| SEQ. ID. NO. 33122 | 238-ValGluLysAspValSerGlyValLysGluThrAlaAla-250 |
| SEQ. ID. NO. 33123 | 252-LeuMetThrAspValGluAlaLeuGlnLysGluIleAsp-264 |

TABLE 1-continued

| | |
|---|---|
| SEQ. ID. NO. 33124 | 269-ProProGlyLysValValGlyGlyAla-277 |
| SEQ. ID. NO. 33125 | 279-GluLeuIleGluGluAlaAlaGlySerLysIleSerGlyGluGluAspArgTyrSerHisThrAspLeuSerAspPheGlnAlaAsnAlaAspGlySerLysLysIleValAsp-316 |
| SEQ. ID. NO. 33126 | 322-IleGluAlaLysAsnLysAlaLeuLeuGluLysThrAspThrAsnPheLysGlnValAsn-341 |
| SEQ. ID. NO. 33127 | 345-AlaLysTyrArgThrLysAspGlyPheGluThrTyrAspLysLeuSerGluAlaAspArgLysAlaLeu-367 |
| SEQ. ID. NO. 33128 | 374-LeuAlaGluAspLeuAlaGln-380 |
| Hydrophilic Regions - Hopp-Woods | |
| SEQ. ID. NO. 33129 | 1-MetArgLysPheAsn-5 |
| SEQ. ID. NO. 33130 | 21-GlnProProGluAlaGluLysAlaAlaPro-30 |
| SEQ. ID. NO. 33131 | 32-AlaSerGlyGluThrGlnSerAlaAsnGluGlyGlySer-44 |
| SEQ. ID. NO. 33132 | 72-AsnAsnSerGlyArgLysLeuGluTrpGluIle-82 |
| SEQ. ID. NO. 33133 | 87-MetValValAspGluArgGluAsnIle-95 |
| SEQ. ID. NO. 33134 | 99-LeuSerAspLysMetAsnArg-105 |
| SEQ. ID. NO. 33135 | 110-GlyGluTyrGluMet-114 |
| SEQ. ID. NO. 33136 | 122-ProArgGlyLysLeuValVal-128 |
| SEQ. ID. NO. 33137 | 131-SerGlyPheLysAspThrAlaAsnGluAlaAspLeuGluLysLeuPro-146 |
| SEQ. ID. NO. 33138 | 158-GlyGluValLysGluLeuAlaAlaLysThrLysThrPheThrGluAlaValLysAlaGlyAspIleGluLysAlaLysSer-184 |
| SEQ. ID. NO. 33139 | 191-ValHisTyrGluArgIleGluProIle-199 |
| SEQ. ID. NO. 33140 | 204-SerGluLeuAspProValIleAspAlaCysGluAspAspPheLysAspGlyAlaLysAspAlaGly-225 |
| SEQ. ID. NO. 33141 | 238-ValGluLysAspValSerGlyValLysGluThrAlaAla-250 |
| SEQ. ID. NO. 33142 | 252-LeuMetThrAspValGluAlaLeuGlnLysGluIleAsp-264 |
| SEQ. ID. NO. 33143 | 279-GluLeuIleGluGluAlaAlaGlySerLysIleSerGlyGluGluAspArgTyrSerHis-298 |
| SEQ. ID. NO. 33144 | 308-AlaAspGlySerLysLysIleValAsp-316 |
| SEQ. ID. NO. 33145 | 322-IleGluAlaLysAsnLysAlaLeuLeuGluLysThrAspThrAsnPhe-337 |
| SEQ. ID. NO. 33146 | 347-TyrArgThrLysAspGlyPheGluThrTyrAspLysLeuSerGluAlaAspArgLysAlaLeu-367 |
| SEQ. ID. NO. 33147 | 374-LeuAlaGluAspLeuAlaGln-380 |
| g596-2 | |
| AMPHI Regions - AMPHI | |
| SEQ. ID. NO. 33148 | 9-MetLeuArgValSerLysValVal-16 |
| SEQ. ID. NO. 33149 | 50-LeuArgIleMetAlaGlyValAspLys-58 |
| SEQ. ID. NO. 33150 | 87-ValArgGluGluValGluSerGlyLeuGlyGluValAlaAlaAlaGlnLysArgLeuGluGluValTyrAlaGluTyr-112 |
| SEQ. ID. NO. 33151 | 192-ProThrAsnHisLeuAsp-197 |
| SEQ. ID. NO. 33152 | 202-GluTrpLeuGluGlnPheLeuValArgPheProGly-213 |
| SEQ. ID. NO. 33153 | 296-ArgPheGluGluMetSerAsnTyr-303 |
| SEQ. ID. NO. 33154 | 322-LeuGlyAsnGluValIleGluPheValAsnValSerLysSerPhe-336 |
| SEQ. ID. NO. 33155 | 366-SerThrLeuPheLysMet-371 |
| SEQ. ID. NO. 33156 | 409-AspAsnIleAlaGlu-413 |
| SEQ. ID. NO. 33157 | 440-AspGlnSerLysIleAlaArgGlnLeuSerGly-450 |
| SEQ. ID. NO. 33158 | 483-LeuArgAlaLeuGluAspAlaLeuLeuGluPheAla-494 |
| Antigenic Index - Jameson-Wolf | |
| SEQ. ID. NO. 33159 | 16-ValProProGlnLysThrIleIleLysAspIleSer-27 |
| SEQ. ID. NO. 33160 | 41-LeuAsnGlyThrGlyLysSerThrVal-49 |
| SEQ. ID. NO. 33161 | 54-AlaGlyValAspLysGluPheGluGlyGluAla-64 |
| SEQ. ID. NO. 33162 | 75-LeuProGlnGluProGluLeuAspProGluLysThrValArgGluGluValGluSerGlyLeu-95 |
| SEQ. ID. NO. 33163 | 99-AlaAlaAlaGlnLysArgLeuGluGluValTyr-109 |
| SEQ. ID. NO. 33164 | 112-TyrAlaAsnProAspAlaAspPheAspAlaLeuAlaGluGluGlnGlyArgLeuGlu-130 |
| SEQ. ID. NO. 33165 | 136-GlySerSerThrGlyGlyGlyAlaGluHisGluLeuGluIleAlaAlaAspAlaLeuArgLeuProAspTrpAspAlaLysIle-163 |
| SEQ. ID. NO. 33166 | 165-AsnLeuSerGlyGlyGluLysArgArgValAla-175 |
| SEQ. ID. NO. 33167 | 181-LeuSerLysProAspMet-186 |
| SEQ. ID. NO. 33168 | 190-AspGluProThrAsnHisLeuAspAlaGluSer-200 |
| SEQ. ID. NO. 33169 | 219-ThrHisAspArgTyrPhe-224 |
| SEQ. ID. NO. 33170 | 233-LeuGluLeuAspArgGlyHisGlyIle-241 |
| SEQ. ID. NO. 33171 | 243-TrpLysGlyAsnTyrSerSer-249 |
| SEQ. ID. NO. 33172 | 251-LeuGluGlnLysGluLysArgLeuGluAsnGluAlaLysSerGluAlaAlaArgValLysAlaMetLysGlnGluLeuGluTrpValArgGlnAsnAlaLysGlyArgGlnAlaLysProLysAlaArgLeuAlaArgPheGluGluMetSerAsnTyrGluTyrGlnLysArgAsnGluThrGlnGlu-313 |
| SEQ. ID. NO. 33173 | 319-AlaGluArgLeuGlyAsnGluVal-326 |
| SEQ. ID. NO. 33174 | 333-SerLysSerPheGlyAspLysValLeu-341 |
| SEQ. ID. NO. 33175 | 360-ProAsnGlyAlaGlyLysSerThrLeu-368 |
| SEQ. ID. NO. 33176 | 373-AlaGlyLysGluGlnProAspSerGlyGluValLysIle-385 |
| SEQ. ID. NO. 33177 | 395-AspGlnSerArgGluGlyLeuAsnAspLysThrValPhe-408 |
| SEQ. ID. NO. 33178 | 411-IleAlaGluGlyArgAspIleLeu-418 |
| SEQ. ID. NO. 33179 | 425-IleProAlaArgGlnTyrLeuGlyArgPheAsnPheLysGlySerAspGlnSerLysIleAlaArgGlnLeuSerGlyGlyGluArgGlyArgLeuHisLeu-458 |
| SEQ. ID. NO. 33180 | 471-LeuAspGluProSerAsnAspLeuAspValGluThrLeuArgAlaLeuGlu-487 |
| SEQ. ID. NO. 33181 | 501-SerHisAspArgTrpPhe-506 |
| SEQ. ID. NO. 33182 | 516-AlaCysGluGlyAspSerLysTrp-523 |
| SEQ. ID. NO. 33183 | 527-AspGlyAsnTyrGlnTyrGluAlaAspLysLysArgArgLeuGlyLysGluGlyAlaLysProLysArgIleLysTyrLysProValThrArg-558 |
| Hydrophilic Regions - Hopp-Woods | |
| SEQ. ID. NO. 33184 | 54-AlaGlyValAspLysGluPheGluGlyGluAla-64 |
| SEQ. ID. NO. 33185 | 77-GlnGluProGluLeuAspProGluLysThrValArgGluGluValGluSerGlyLeu-95 |
| SEQ. ID. NO. 33186 | 99-AlaAlaAlaGlnLysArgLeuGluGluValTyr-109 |
| SEQ. ID. NO. 33187 | 113-AlaAsnProAspAlaAspPheAspAlaLeuAlaGluGluGlnGlyArgLeuGlu-130 |
| SEQ. ID. NO. 33188 | 141-GlyGlyAlaGluHisGluLeuGluIleAlaAlaAspAlaLeuArg-155 |
| SEQ. ID. NO. 33189 | 157-ProAspTrpAspAlaLysIle-163 |
| SEQ. ID. NO. 33190 | 167-SerGlyGlyGluLysArgArgValAla-175 |
| SEQ. ID. NO. 33191 | 181-LeuSerLysProAsp-185 |
| SEQ. ID. NO. 33192 | 190-AspGluProThrAsnHisLeuAspAlaGluSer-200 |
| SEQ. ID. NO. 33193 | 233-LeuGluLeuAspArgGlyHis-239 |
| SEQ. ID. NO. 33194 | 251-LeuGluGlnLysGluLysArgLeuGluAsnGluAlaLysSerGluAlaAlaArgValLysAlaMetLysGlnGluLeuGluTrp-278 |
| SEQ. ID. NO. 33195 | 280-ArgGlnAsnAlaLysGlyArgGlnAlaLysProLysAlaArgLeuAlaArgPheGluGluMetSerAsn-302 |

TABLE 1-continued

| | |
|---|---|
| SEQ. ID. NO. 33196 | 304-GluTyrGlnLysArgAsnGluThrGln-312 |
| SEQ. ID. NO. 33197 | 319-AlaGluArgLeuGlyAsnGluVal-326 |
| SEQ. ID. NO. 33198 | 373-AlaGlyLysGluGlnProAspSerGlyGluValLysIle-385 |
| SEQ. ID. NO. 33199 | 395-AspGlnSerArgGluGlyLeuGlnAsnAspLysThrValPhe-408 |
| SEQ. ID. NO. 33200 | 411-IleAlaGluGlyArgAspIleLeu-418 |
| SEQ. ID. NO. 33201 | 435-AsnPheLysGlySerAspGlnSerLysIleAlaArg-446 |
| SEQ. ID. NO. 33202 | 448-LeuSerGlyGlyGluArgGlyArgLeuHisLeu-458 |
| SEQ. ID. NO. 33203 | 472-AspGluProSerAsnAspLeuAspValGluThrLeuArgAlaLeuGlu-487 |
| SEQ. ID. NO. 33204 | 517-CysGluGlyAspSer-521 |
| SEQ. ID. NO. 33205 | 529-AsnTyrGlnGluTyrGluAlaAspLysLysArgArgLeuGlyLysGluGlyAlaLysProLysArgIleLysTyr-553 | g597
AMPHI Regions - AMPHI

| | |
|---|---|
| SEQ. ID. NO. 33206 | 6-SerAsnSerLeuLysGlnLeuGlnGlu-14 |
| SEQ. ID. NO. 33207 | 45-TrpAspLysPheGlnLysLeu-51 |
| SEQ. ID. NO. 33208 | 68-GlnIleSerArgPheValSerGly-75 |
| SEQ. ID. NO. 33209 | 101-LeuArgTyrThrArgTyrValAsnAla-109 |
| SEQ. ID. NO. 33210 | 111-AsnArgGluValValLysAspLeuGluLysGlnGln-122 |
| SEQ. ID. NO. 33211 | 132-IleAsnAsnGluLeuAlaArgLeuLysLys-141 |
| SEQ. ID. NO. 33212 | 144-AlaAsnValGlnSerLeu-149 |
| SEQ. ID. NO. 33213 | 157-AspAlaAlaGluGlnThrGlu-163 |
| SEQ. ID. NO. 33214 | 170-LysIleSerLysAspAlaArg-176 |
| SEQ. ID. NO. 33215 | 189-AsnLysLeuLeuSer-193 |
| SEQ. ID. NO. 33216 | 253-ProSerValMetGlyIleGlySerAlaAspGlyPheSerArgMetGlnGlyArgLeuLysLysProValAspGlyValProThrGly-281 |
| SEQ. ID. NO. 33217 | 302-ProAlaThrValGluSerIleAla-309 |
| SEQ. ID. NO. 33218 | 314-SerTyrAlaAspGluLeuAspGlyTyrGlyLysVal-325 |
| SEQ. ID. NO. 33219 | 336-SerIleTyrAlaGlyLeuSerGluIleSerAlaGlyLys-348 |

Antigenic Index - Jameson-Wolf

| | |
|---|---|
| SEQ. ID. NO. 33220 | 7-AsnSerLeuLysGlnLeuGlnGluGluArgIleArgGlnGluArgIleArgGlnGluArgIleArgGlnAlaArgGlyAsnLeu-34 |
| SEQ. ID. NO. 33221 | 36-SerValAsnArgLysGlnArgGluAlaTrpAspLysPheGlnLysLeuAsnThrGluLeuAsnArgLeuLysThrGluValAlaAla-64 |
| SEQ. ID. NO. 33222 | 74-SerGlyAsnTyrLysAsnSerArgProAsnAla-84 |
| SEQ. ID. NO. 33223 | 91-AsnAlaGluProGlyGlnLysAsnArgPhe-100 |
| SEQ. ID. NO. 33224 | 107-ValAsnAlaSerAsnArgGluValValLysAspLeuGluLysGlnGlnLys-123 |
| SEQ. ID. NO. 33225 | 128-GlnGluGlnLysIleAsnAsnGluLeuAlaArgLeuLysLysIleGln-143 |
| SEQ. ID. NO. 33226 | 149-LeuLeuLysLysGlnGlyValThrAspAlaAlaGluGlnThrGluSerArgArgGlnAsnAlaLysIleSerLysAspAlaArgLysLeuLeuGluGlnLysGlyAsnGluGlnGlnLeu-188 |
| SEQ. ID. NO. 33227 | 191-LeuLeuSerAsnLeuGluLysLysLysAlaGluHisArgIleGlnAspAlaGluAlaLysArgLysLeuAlaGluAlaLysLeuAlaAlaAlaGluLysAlaArgLysGluAlaAlaGlnGlnLysAlaGluAlaArgArgAlaGluMetSerAsnLeuThrAlaGluAspArgAsnIleGlnAlaProSer-254 |
| SEQ. ID. NO. 33228 | 259-GlySerAlaAspGlyPheSerArgMetGlnGlyArgLeuLysLysProValAspGlyValProThr-280 |
| SEQ. ID. NO. 33229 | 284-GlyGlnAsnArgSerGlyGlyAspVal-292 |
| SEQ. ID. NO. 33230 | 314-SerTyrAlaAspGluLeuAspGlyTyrGly-323 |
| SEQ. ID. NO. 33231 | 329-AspHisGlyGluAsnTyr-334 |
| SEQ. ID. NO. 33232 | 343-GluIleSerAlaGlyLysGlyTyrThr-351 |
| SEQ. ID. NO. 33233 | 354-AlaGlySerLysIleGlyThrSerGlySerLeuProAspGlyGluGluGlyLeu-371 |
| SEQ. ID. NO. 33234 | 375-IleArgTyrArgGlyGlnValLeuAsnProSerGlyTrp-387 |

Hydrophilic Regions - Hopp-Woods

| | |
|---|---|
| SEQ. ID. NO. 33235 | 7-AsnSerLeuLysGlnLeuGlnGluGluArgIleArgGlnGluArgIleArgGlnGluArgIleArgGlnAlaArgGlyAsn-33 |
| SEQ. ID. NO. 33236 | 37-ValAsnArgLysGlnArgGluAlaTrpAspLysPheGlnLysLeuAsnThrGluLeuAsnArgLeuLysThrGluValAlaAla-64 |
| SEQ. ID. NO. 33237 | 77-TyrLysAsnSerArgProAsn-83 |
| SEQ. ID. NO. 33238 | 91-AsnAlaGluProGlyGlnLysAsnArgPhe-100 |
| SEQ. ID. NO. 33239 | 110-SerAsnArgGluValValLysAspLeuGluLysGlnGlnLys-123 |
| SEQ. ID. NO. 33240 | 128-GlnGluGlnLysIleAsnAsnGluLeuAlaArgLeuLysLysIleGln-143 |
| SEQ. ID. NO. 33241 | 149-LeuLeuLysLysGlnGlyValThrAspAlaAlaGluGlnThrGluSerArgArgGlnAsnAlaLysIleSerLysAspAlaArgLysLeuLeuGluGlnLysGlyAsnGluGlnGlnLeu-188 |
| SEQ. ID. NO. 33242 | 193-SerAsnLeuGluLysLysLysAlaGluHisArgIleGlnAspAlaGluAlaLysArgLysLeuAlaGluAlaLysLeuAlaAlaAlaGluLysAlaArgLysGluAlaAlaGlnGlnLysAlaGluAlaArgArgAlaGluMet-240 |
| SEQ. ID. NO. 33243 | 244-ThrAlaGluAspArgAsnIleGln-251 |
| SEQ. ID. NO. 33244 | 267-MetGlnGlyArgLeuLysLysProValAsp-276 |
| SEQ. ID. NO. 33245 | 286-AsnArgSerGlyGlyAspVal-292 |
| SEQ. ID. NO. 33246 | 315-TyrAlaAspGluLeuAspGlyTyrGly-323 |
| SEQ. ID. NO. 33247 | 356-SerLysIleGlyThr-360 |
| SEQ. ID. NO. 33248 | 363-SerLeuProAspGlyGluGluGlyLeu-371 | g601
AMPHI Regions - AMPHI

| | |
|---|---|
| SEQ. ID. NO. 33249 | 7-LeuValAspGluIleAspValProAsnIleGlyArg-18 |
| SEQ. ID. NO. 33250 | 26-AlaGlyIleProThrValPhe-32 |
| SEQ. ID. NO. 33251 | 42-GlyLysGluLeuGlnAspAspIleAsnAsnAspAlaAlaAlaLeuGluLysPheGluThrIleArgAlaTyrGlyAlaLeu-68 |
| SEQ. ID. NO. 33252 | 70-MetGlyLeuIleSerAspValSerGlu-78 |
| SEQ. ID. NO. 33253 | 100-SerSerGlyLysThrValAsn-106 |
| SEQ. ID. NO. 33254 | 137-AlaValLeuGlyThrLeuValAsnLeuAlaAla-147 |
| SEQ. ID. NO. 33255 | 167-GlyAlaAlaAlaGlu-171 |

Antigenic Index - Jameson-Wolf

| | |
|---|---|
| SEQ. ID. NO. 33256 | 3-ProThrGlyAsnLeuValAspGluIleAspValProAsnIleGlyArgLeuLys-20 |
| SEQ. ID. NO. 33257 | 39-GlyTyrThrGlyLysGluLeuGlnAspAspIleAsnAsnAspAlaAlaAlaLeuGluLysPheGluThr-61 |
| SEQ. ID. NO. 33258 | 75-AspValSerGluAlaAlaAlaArgAlaArgThrProLysProAlaPhe-90 |
| SEQ. ID. NO. 33259 | 97-TyrThrAlaSerSerGlyLysThrValAsn-106 |
| SEQ. ID. NO. 33260 | 108-AlaAspIleAspLeuProVal-114 |
| SEQ. ID. NO. 33261 | 147-AlaGlyGlyGlyThrArgLysGluValArgPheGlyHisProSerGlyThrLeuArg-165 |
| SEQ. ID. NO. 33262 | 170-AlaGluCysGlnAspGlyGln-176 |

TABLE 1-continued

| SEQ. ID. NO. 33263 | 183-ValMetSerArgSerAlaArgValIle-191 |
|---|---|
| SEQ. ID. NO. 33264 | 196-ValArgValProAspAspCysPhe-203 |

Hydrophilic Regions - Hopp-Woods

| SEQ. ID. NO. 33265 | 7-LeuValAspGluIleAspVal-13 |
|---|---|
| SEQ. ID. NO. 33266 | 40-TyrThrGlyLysGluLeuGlnAspAspIleAsnAsnAspAlaAlaAlaLeuGluLysPheGluThr-61 |
| SEQ. ID. NO. 33267 | 75-AspValSerGluAlaAlaAlaArgAlaArgThrProLys-87 |
| SEQ. ID. NO. 33268 | 99-AlaSerSerGlyLysThrValAsn-106 |
| SEQ. ID. NO. 33269 | 108-AlaAspIleAspLeuProVal-114 |
| SEQ. ID. NO. 33270 | 149-GlyGlyThrArgLysGluValArgPhe-157 |
| SEQ. ID. NO. 33271 | 170-AlaGluCysGlnAsp-174 |
| SEQ. ID. NO. 33272 | 186-ArgSerAlaArgValIle-191 |
| SEQ. ID. NO. 33273 | 198-ValProAspAspCysPhe-203 | g602
AMPHI Regions - AMPHI

| SEQ. ID. NO. 33274 | 54-ArgGlnValAlaGlnIle-59 |
|---|---|
| SEQ. ID. NO. 33275 | 61-AlaGlyLeuHisValCysAsnGlyVal-69 |

Antigenic Index - Jameson-Wolf

| SEQ. ID. NO. 33276 | 5-GlnCysAspLysAlaArgHisMetArgPro-14 |
|---|---|
| SEQ. ID. NO. 33277 | 17-LeuGlyGlyGlnIleAsnArgHisArgGlnAlaSerAsnArgGlyLeuCys-33 |
| SEQ. ID. NO. 33278 | 35-PheGlyGlyPheGlnGlyAsnArgGluAlaGln-45 |
| SEQ. ID. NO. 33279 | 51-LeuIleAspArgGlnVal-56 |
| SEQ. ID. NO. 33280 | 88-GlyArgGlnMetProSerGluLysThrLeu-97 |
| SEQ. ID. NO. 33281 | 103-GlnMetArgAspTyr-107 |

Hydrophilic Regions - Hopp-Woods

| SEQ. ID. NO. 33282 | 5-GlnCysAspLysAlaArgHisMet-12 |
|---|---|
| SEQ. ID. NO. 33283 | 21-IleAsnArgHisArgGlnAlaSerAsnArgGly-31 |
| SEQ. ID. NO. 33284 | 39-GlnGlyAsnArgGluAlaGln-45 |
| SEQ. ID. NO. 33285 | 51-LeuIleAspArgGlnVal-56 |
| SEQ. ID. NO. 33286 | 91-MetProSerGluLysThrLeu-97 | g603
AMPHI Regions - AMPHI

| SEQ. ID. NO. 33287 | 119-MetLeuLeuAsnGluLeuGluLys-126 |
|---|---|
| SEQ. ID. NO. 33288 | 131-AspArgIleLysAlaIleGlyArgArgIleAlaHisGlyGlyGluLysTyr-147 |
| SEQ. ID. NO. 33289 | 157-ValLeuAspGluLeuLysAlaCysIlePro-166 |
| SEQ. ID. NO. 33290 | 171-HisAsnProAlaAsnIleSerGlyIleLeuAla-181 |
| SEQ. ID. NO. 33291 | 185-HisPheProGlyLeuProAsnValGly-193 |
| SEQ. ID. NO. 33292 | 198-SerPheHisGlnThrMetPro-204 |
| SEQ. ID. NO. 33293 | 211-AlaValProArgGluLeu-216 |
| SEQ. ID. NO. 33294 | 238-GluAlaAlaArgIleLeuGlyLysProLeuGluAspIleArgMetIleIleAlaHis-256 |
| SEQ. ID. NO. 33295 | 259-AsnGlyAlaSerIleThrAlaValLysAsnGlyLysSerVal-272 |
| SEQ. ID. NO. 33296 | 279-ThrProIleGluGly-283 |
| SEQ. ID. NO. 33297 | 298-TyrSerTyrProThr-302 |
| SEQ. ID. NO. 33298 | 323-ProGlyIleSerGluLeuProAsnAspCysArgThr-334 |
| SEQ. ID. NO. 33299 | 356-ArgLeuAlaLysTyrIleAlaSerMetAla-365 |
| SEQ. ID. NO. 33300 | 392-ValSerTyrLeuAsp-396 |

Antigenic Index - Jameson-Wolf

| SEQ. ID. NO. 33301 | 1-MetAspSerArgLeuArgGlyAsnAspAlaArgLysTyrGly-14 |
|---|---|
| SEQ. ID. NO. 33302 | 17-PheAlaGlnArgGlyArgLeuLysHisThrProProAsnAlaHisProPheSerAspGlyProAlaProLysLysGlnProGlnThrThrArgArgAsnIleMetSer-52 |
| SEQ. ID. NO. 33303 | 64-SerSerLeuLysGlyAlaValIleAspArgLysSerGlySer-77 |
| SEQ. ID. NO. 33304 | 83-LeuGlyGluArgLeuThrThrProGluAla-92 |
| SEQ. ID. NO. 33305 | 95-ThrPheAsnLysAspGlyAsnLysArgGlnValProLeuSerGlyArgAsnCysHis-113 |
| SEQ. ID. NO. 33306 | 123-GluLeuGluLysHisGlyLeuHisAspArgIleLysAlaIleGlyArgArgIleAlaHisGlyGlyGluLysTyrHisGlu-149 |
| SEQ. ID. NO. 33307 | 151-ValLeuIleAspGlnAspValLeuAspGluLeuLysAla-163 |
| SEQ. ID. NO. 33308 | 202-ThrMetProGluArgAlaTyr-208 |
| SEQ. ID. NO. 33309 | 214-ArgGluLeuArgLysLysTyrAlaPheArgArgTyrGlyPheHisGlyThrGlyMet-232 |
| SEQ. ID. NO. 33310 | 238-GluAlaAlaArgIleLeuGlyLysProLeuGluAspIleArg-251 |
| SEQ. ID. NO. 33311 | 257-LeuGlyAsnGlyAla-261 |
| SEQ. ID. NO. 33312 | 264-ThrAlaValLysAsnGlyLysSerValAspThrGlyMet-276 |
| SEQ. ID. NO. 33313 | 288-ThrArgCysGlyAspThrAspProGlyVal-297 |
| SEQ. ID. NO. 33314 | 310-AlaGlnValAspGluMetLeuAsnGluLysSerGlyPheProGlyIleSerGluLeuProAsnAspCysArgThrLeuGluIleAlaAlaAspGluGlyArgGluGlyAlaArgLeu-348 |
| SEQ. ID. NO. 33315 | 379-GlyIleGlyGluAsnSerArgAsnIleArgAlaLysThr-391 |
| SEQ. ID. NO. 33316 | 402-IleAspThrLysAlaAsnMetGluLysArgTyrGlyAsnSerGlyIle-417 |
| SEQ. ID. NO. 33317 | 419-SerProThrAspSerSerPro-425 |
| SEQ. ID. NO. 33318 | 431-ProThrAsnGluGluLeu-436 |

Hydrophilic Regions - Hopp-Woods

| SEQ. ID. NO. 33319 | 1-MetAspSerArgLeuArgGlyAsnAspAlaArgLysTyrGly-14 |
|---|---|
| SEQ. ID. NO. 33320 | 17-PheAlaGlnArgGlyArgLeuLysHisThrPro-27 |
| SEQ. ID. NO. 33321 | 34-SerAspGlyProAlaProLysLysGlnProGlnThrThrArgArgAsnIleMet-51 |
| SEQ. ID. NO. 33322 | 69-AlaValIleAspArgLysSerGly-76 |
| SEQ. ID. NO. 33323 | 83-LeuGlyGluArgLeuThrThr-89 |
| SEQ. ID. NO. 33324 | 96-PheAsnLysAspGlyAsnLysArgGlnValProLeuSerGlyArgAsnCysHis-113 |
| SEQ. ID. NO. 33325 | 123-GluLeuGluLysHisGlyLeuHisAspArgIleLysAlaIleGlyArgArgIleAlaHisGlyGlyGluLysTyrHisGlu-149 |
| SEQ. ID. NO. 33326 | 156-AspValLeuAspGluLeuLysAla-163 |
| SEQ. ID. NO. 33327 | 203-MetProGluArgAlaTyr-208 |
| SEQ. ID. NO. 33328 | 214-ArgGluLeuArgLysLysTyrAlaPhe-222 |
| SEQ. ID. NO. 33329 | 238-GluAlaAlaArgIleLeuGlyLysProLeuGluAspIleArg-251 |
| SEQ. ID. NO. 33330 | 267-LysAsnGlyLysSerValAspThr-274 |
| SEQ. ID. NO. 33331 | 289-ArgCysGlyAspThrAspPro-295 |

TABLE 1-continued

| | |
|---|---|
| SEQ. ID. NO. 33332 | 310-AlaGlnValAspGluMetLeuAsnGluLysSerGly-321 |
| SEQ. ID. NO. 33333 | 328-LeuProAsnAspCysArgThrLeuGluIleAlaAlaAspGluGlyArgGluGlyAlaArgLeu-348 |
| SEQ. ID. NO. 33334 | 380-IleGlyGluAsnSerArgAsnIleArgAlaLysThr-391 |
| SEQ. ID. NO. 33335 | 402-IleAspThrLysAlaAsnMetGluLysArgTyrGly-413 |
| SEQ. ID. NO. 33336 | 432-ThrAsnGluGluLeu-436 | g604
AMPHI Regions - AMPHI

| | |
|---|---|
| SEQ. ID. NO. 33337 | 35-SerValValGlnPheAla-40 |
| SEQ. ID. NO. 33338 | 49-IleAspValGlyGlyValTyrGly-56 |
| SEQ. ID. NO. 33339 | 98-AspGlyPheLysPhePheGln-104 |
| SEQ. ID. NO. 33340 | 111-AspValValLeuGlnLeuPheAlaArgValAlaGlnValGlyGlyValGlnGluAsn-129 |
| SEQ. ID. NO. 33341 | 146-ArgHisIleAsnPheValAspGlnIleAlaGlyTrpGlu-158 |

Antigenic Index - Jameson-Wolf

| | |
|---|---|
| SEQ. ID. NO. 33342 | 10-SerAlaAlaCysGlyLysValAspGlnArgThrGluHisGlyGlyGlyAspGlyAspArgGlyAspAlaHis-33 |
| SEQ. ID. NO. 33343 | 44-GlyAlaTyrArgGlnIleAspVal-51 |
| SEQ. ID. NO. 33344 | 65-GlyGlyGlyArgAspGluGlyGlyPheArgArgAlaArgAlaGlyGlyGlyPhe-82 |
| SEQ. ID. NO. 33345 | 95-IleCysAlaAspGly-99 |
| SEQ. ID. NO. 33346 | 101-LysPhePheGlnArgGlyGlyIle-108 |
| SEQ. ID. NO. 33347 | 125-GlyValGlnGluAsnGlyArgAsnAlaArgValAspGluArgGlyPheGln-141 |

Hydrophilic Regions - Hopp-Woods

| | |
|---|---|
| SEQ. ID. NO. 33348 | 14-GlyLysValAspGlnArgThrGluHisGlyGlyGlyAspGlyAspArgGlyAspAlaHis-33 |
| SEQ. ID. NO. 33349 | 66-GlyGlyArgAspGluGlyGlyPheArgArgAlaArgAla-78 |
| SEQ. ID. NO. 33350 | 125-GlyValGlnGluAsnGlyArgAsnAlaArgValAspGluArgGlyPhe-140 | g605
AMPHI Regions - AMPHI

| | |
|---|---|
| SEQ. ID. NO. 33351 | 13-ArgGlnIleTrpLysIleAlaAsp-20 |
| SEQ. ID. NO. 33352 | 38-ThrLeuPheTyrArgPheIleSerGluAsnPheThrAspTyrMetGln-53 |
| SEQ. ID. NO. 33353 | 107-LysLeuLysGluIlePheThrAlaIle-115 |
| SEQ. ID. NO. 33354 | 126-GlnGlyIleLysGlyLeuPheAspAspPheAsp-136 |
| SEQ. ID. NO. 33355 | 141-ArgLeuGlySerThr-145 |
| SEQ. ID. NO. 33356 | 155-AlaValLeuLysGlyValAlaGluLeu-163 |
| SEQ. ID. NO. 33357 | 178-AspAlaTyrGluTyrLeuIleSerAsn-186 |
| SEQ. ID. NO. 33358 | 188-AlaAlaAsnAlaGlyLys-193 |
| SEQ. ID. NO. 33359 | 204-ValSerLysLeuIleAlaArg-210 |
| SEQ. ID. NO. 33360 | 217-GluLysValAsnLysIleTyrAspPro-225 |
| SEQ. ID. NO. 33361 | 240-PheAspGluHisIle-244 |
| SEQ. ID. NO. 33362 | 291-AspSerLysProPheAspAlaValValSerAsn-301 |
| SEQ. ID. NO. 33363 | 341-HisAlaLeuAsnTyr-345 |
| SEQ. ID. NO. 33364 | 355-ValSerPheProGly-359 |
| SEQ. ID. NO. 33365 | 433-GluHisIleAlaGluIleValLysLeuPheAla-443 |
| SEQ. ID. NO. 33366 | 452-AlaGlnAsnAlaAlaGlnGlnThr-459 |
| SEQ. ID. NO. 33367 | 478-ThrArgGluValIleAspIle-484 |
| SEQ. ID. NO. 33368 | 489-AlaGluIleSerGluThrValAlaLysIleGluArgLeuArgArgGluIleAspGluValIleAlaGluIleGlu-513 |

Antigenic Index - Jameson-Wolf

| | |
|---|---|
| SEQ. ID. NO. 33369 | 5-MetGlnGlnArgAlaGlnLeu-11 |
| SEQ. ID. NO. 33370 | 18-IleAlaAspGluValArgGlyAlaValAspGlyTrpAsp-30 |
| SEQ. ID. NO. 33371 | 44-IleSerGluAsnPheThrAspTyrMetGlnAlaGlyAspSerSerIleAsp-60 |
| SEQ. ID. NO. 33372 | 63-AlaMetProAspSer-67 |
| SEQ. ID. NO. 33373 | 71-ProGluIleLysAspAspAlaValLysVal-80 |
| SEQ. ID. NO. 33374 | 98-AlaHisGlnAsnGluGluLeuAsnThrLysLeuLysGlu-110 |
| SEQ. ID. NO. 33375 | 116-GluSerSerAlaSerGlyTyrProSerGluGlnGlyIleLysGlyLeuPheAspAspPheAspThrThrSerSerArgLeu-142 |
| SEQ. ID. NO. 33376 | 146-ValAlaAspLysAsnLysArgLeu-153 |
| SEQ. ID. NO. 33377 | 164-AspPheGlyAsnPheGluAspHisArgIle-173 |
| SEQ. ID. NO. 33378 | 190-AsnAlaGlyLysSerGlyGlyGluPhePheThr-200 |
| SEQ. ID. NO. 33379 | 215-GlyGlnGluLysValAsnLysIleTyrAspProAlaCysGlySerGlySer-231 |
| SEQ. ID. NO. 33380 | 235-GlnAlaLysLysGlnPheAsp-241 |
| SEQ. ID. NO. 33381 | 253-GluIleAsnHisThrThrTyrAsn-260 |
| SEQ. ID. NO. 33382 | 280-LeuGlyAspThrLeuThrAsnProLysLeuLysAspSerLysProPheAspAla-297 |
| SEQ. ID. NO. 33383 | 309-IleGlySerAspAspProThrLeuIleAsnAspAspArgPheAlaPro-324 |
| SEQ. ID. NO. 33384 | 330-ProLysSerLysAlaAsp-335 |
| SEQ. ID. NO. 33385 | 345-TyrLeuSerGlyArgGlyArgAlaAla-353 |
| SEQ. ID. NO. 33386 | 362-TyrArgGlyGlyAlaGluGlnLysIleArg-371 |
| SEQ. ID. NO. 33387 | 403-LeuSerLysHisLysAspAsnThrAsp-411 |
| SEQ. ID. NO. 33388 | 419-GlyPhePheLysLysGluThrAsnAsnAsnValLeuThrGluGluHisIle-435 |
| SEQ. ID. NO. 33389 | 442-PheAlaAspLysAlaAspVal-448 |
| SEQ. ID. NO. 33390 | 458-GlnThrValLysAspAsnGlyTyr-465 |
| SEQ. ID. NO. 33391 | 473-ValGluAlaGluAspThrArgGluValIleAsp-483 |
| SEQ. ID. NO. 33392 | 490-GluIleSerGluThrValAlaLysIleGluArgLeuArgArgGluIleAspGluValIleAlaGluIleGluThr-514 |

Hydrophilic Regions - Hopp-Woods

| | |
|---|---|
| SEQ. ID. NO. 33393 | 18-IleAlaAspGluValArgGlyAlaValAsp-27 |
| SEQ. ID. NO. 33394 | 55-GlyAspSerSerIle-59 |
| SEQ. ID. NO. 33395 | 71-ProGluIleLysAspAspAlaValLysVal-80 |
| SEQ. ID. NO. 33396 | 98-AlaHisGlnAsnGluGluLeuAsnThrLysLeuLysGlu-110 |
| SEQ. ID. NO. 33397 | 131-LeuPheAspAspPheAspThrThrSerSerArgLeu-142 |
| SEQ. ID. NO. 33398 | 146-ValAlaAspLysAsnLysArgLeu-153 |
| SEQ. ID. NO. 33399 | 167-AsnPheGluAspHisArgIle-173 |
| SEQ. ID. NO. 33400 | 191-AlaGlyLysSerGlyGly-196 |
| SEQ. ID. NO. 33401 | 215-GlyGlnGluLysValAsnLysIleTyrAsp-224 |
| SEQ. ID. NO. 33402 | 235-GlnAlaLysLysGlnPheAsp-241 |
| SEQ. ID. NO. 33403 | 287-ProLysLeuLysAspSerLysProPhe-295 |

TABLE 1-continued

| SEQ. ID. NO. 33404 | 310-GlySerAspAspProThrLeuIleAsnAspAspArgPheAla-323 |
| SEQ. ID. NO. 33405 | 330-ProLysSerLysAlaAsp-335 |
| SEQ. ID. NO. 33406 | 348-GlyArgGlyArgAla-352 |
| SEQ. ID. NO. 33407 | 364-GlyGlyAlaGluGlnLysIleArg-371 |
| SEQ. ID. NO. 33408 | 404-SerLysHisLysAspAsnThrAsp-411 |
| SEQ. ID. NO. 33409 | 419-GlyPhePheLysLysGluThrAsn-426 |
| SEQ. ID. NO. 33410 | 430-LeuThrGluGluHisIle-435 |
| SEQ. ID. NO. 33411 | 442-PheAlaAspLysAlaAspVal-448 |
| SEQ. ID. NO. 33412 | 458-GlnThrValLysAspAsnGly-464 |
| SEQ. ID. NO. 33413 | 473-ValGluAlaGluAspThrArgGluValIleAsp-483 |
| SEQ. ID. NO. 33414 | 490-GluIleSerGluThrValAlaLysIleGluArgLeuArgArgGluIleAspGluValIleAlaGluIleGluThr-514 | g606
AMPHI Regions - AMPHI

| SEQ. ID. NO. 33415 | 72-LeuLeuAspHisMetThrArgAspGlu-80 |
| SEQ. ID. NO. 33416 | 90-AlaHisValGlyAsnGlyAsp-96 |
| SEQ. ID. NO. 33417 | 100-LeuThrLeuIleGlnGlyValValAsnThrPhe-110 |
| SEQ. ID. NO. 33418 | 116-ArgIleIleAlaAsn-120 |
| SEQ. ID. NO. 33419 | 139-SerMetValPheGlnIleLeuPheGlyPheLeuAlaSerLeuIleVal-154 |
| SEQ. ID. NO. 33420 | 171-LysLeuValGlyAlaProLysMetIleSerAlaLeuGlnArg-184 |
| SEQ. ID. NO. 33421 | 191-AspLeuProGluGluMetAsnAla-198 |

Antigenic Index - Jameson-Wolf

| SEQ. ID. NO. 33422 | 13-GluValIleAspThrProArgThrGluGluGluAla-24 |
| SEQ. ID. NO. 33423 | 31-GluAlaGlnAlaArgGlnTrpAsnLeuLysThrProGlu-43 |
| SEQ. ID. NO. 33424 | 48-HisSerProGluProAsnAla-54 |
| SEQ. ID. NO. 33425 | 57-ThrGlyAlaSerArgAsnSerSer-64 |
| SEQ. ID. NO. 33426 | 75-HisMetThrArgAspGluValGluAla-83 |
| SEQ. ID. NO. 33427 | 92-ValGlyAsnGlyAsp-96 |
| SEQ. ID. NO. 33428 | 122-IleAlaArgAsnAsnAspGlySerGlnSerGlnGlyThr-134 |
| SEQ. ID. NO. 33429 | 159-ArgGlnArgGluTyrArgAlaAspAlaGlyAla-169 |
| SEQ. ID. NO. 33430 | 182-LeuGlnArgLeuLysGlyAsnProValAspLeuProGluGluMetAsn-197 |
| SEQ. ID. NO. 33431 | 203-GlyAspThrArgAspSerLeuLeuSerThrHisProSerLeuAspAsnArgIleAlaArgLeuLysSer-225 |

Hydrophilic Regions - Hopp-Woods

| SEQ. ID. NO. 33432 | 13-GluValIleAspThrProArgThrGluGluGluAla-24 |
| SEQ. ID. NO. 33433 | 59-AlaSerArgAsnSer-63 |
| SEQ. ID. NO. 33434 | 75-HisMetThrArgAspGluValGluAla-83 |
| SEQ. ID. NO. 33435 | 124-ArgAsnAsnAspGlySerGlnSer-131 |
| SEQ. ID. NO. 33436 | 159-ArgGlnArgGluTyrArgAlaAspAlaGlyAla-169 |
| SEQ. ID. NO. 33437 | 183-GlnArgLeuLysGlyAsnPro-189 |
| SEQ. ID. NO. 33438 | 191-AspLeuProGluGluMetAsn-197 |
| SEQ. ID. NO. 33439 | 203-GlyAspThrArgAspSerLeu-209 |
| SEQ. ID. NO. 33440 | 214-ProSerLeuAspAsnArgIleAlaArgLeuLysSer-225 | g607
AMPHI Regions - AMPHI

| SEQ. ID. NO. 33441 | 15-LysGluIleArgLeuLeuThrAlaLeuAlaLeu-25 |
| SEQ. ID. NO. 33442 | 70-PheMetGlyIleMetAlaAlaLeuAsnProMetIleAlaGln-83 |
| SEQ. ID. NO. 33443 | 90-ThrGlyGluAlaGlyGlu-95 |
| SEQ. ID. NO. 33444 | 104-GlyLeuIleLeuGlyIlePheGlyMetIleLeuMetTrpAlaAlaIleThrProPheArgAsnTrpLeuThrLeuSerAspTyrValGluGlyThrMet-136 |
| SEQ. ID. NO. 33445 | 151-MetValHisArgAlaLeuHisAlaTyrAlaSerSer-162 |
| SEQ. ID. NO. 33446 | 226-PhePheArgProPheGly-231 |
| SEQ. ID. NO. 33447 | 244-PheLysGlnIleTrpLysIleGlyAla-252 |
| SEQ. ID. NO. 33448 | 320-AlaArgTyrIleSerGlyValSerLeu-328 |
| SEQ. ID. NO. 33449 | 337-IleThrValLeuSerLeuVal-343 |
| SEQ. ID. NO. 33450 | 348-ProLeuAlaSerMetTyr-353 |
| SEQ. ID. NO. 33451 | 373-PheGlnProAlaAspPheThrGlnCysIleAlaSerTyrAla-386 |
| SEQ. ID. NO. 33452 | 424-TyrGlyPheTrpThrAlaLeuIleAla-432 |

Antigenic Index - Jameson-Wolf

| SEQ. ID. NO. 33453 | 4-AspLeuAspArgPheSer-9 |
| SEQ. ID. NO. 33454 | 47-GlyAlaGlyLysGluAspLeuAla-54 |
| SEQ. ID. NO. 33455 | 86-GlyAlaGlyLysThrGlyGluAlaGlyGluThrGlyArgGln-99 |
| SEQ. ID. NO. 33456 | 121-ProPheArgAsnTrp-125 |
| SEQ. ID. NO. 33457 | 128-LeuSerAspTyrValGluGlyThr-135 |
| SEQ. ID. NO. 33458 | 160-AlaSerSerLeuAsnArgProArgLeu-168 |
| SEQ. ID. NO. 33459 | 222-AlaLysGluLysPhePheArg-228 |
| SEQ. ID. NO. 33460 | 234-AlaLysPheGlyLysProAspTrp-241 |
| SEQ. ID. NO. 33461 | 311-SerLeuGlyArgArgGluPheSerArgAlaArgTyrIleSer-324 |
| SEQ. ID. NO. 33462 | 348-ProLeuAlaSerMetTyrAsnAspAspProAla-358 |
| SEQ. ID. NO. 33463 | 388-ArgGlyTyrLysValThrLys-394 |
| SEQ. ID. NO. 33464 | 452-LeuValLysSerHisLysAlaVal-459 |

Hydrophilic Regions - Hopp-Woods

| SEQ. ID. NO. 33465 | 47-GlyAlaGlyLysGluAspLeuAla-54 |
| SEQ. ID. NO. 33466 | 89-LysThrGlyGluAlaGlyGluThrGlyArg-98 |
| SEQ. ID. NO. 33467 | 163-LeuAsnArgProArg-167 |
| SEQ. ID. NO. 33468 | 222-AlaLysGluLysPhePhe-227 |
| SEQ. ID. NO. 33469 | 312-LeuGlyArgArgGluPheSerArg-319 |
| SEQ. ID. NO. 33470 | 353-TyrAsnAspAspProAla-358 |
| SEQ. ID. NO. 33471 | 390-TyrLysValThrLys-394 |
| SEQ. ID. NO. 33472 | 452-LeuValLysSerHisLysAlaVal-459 | g608

TABLE 1-continued

AMPHI Regions - AMPHI
SEQ. ID. NO. 33473    66-AlaIleArgLysIleLeuGln-72
SEQ. ID. NO. 33474    93-ValLeuSerLeuLeu-97
SEQ. ID. NO. 33475    103-ArgAlaSerAspGluLeuAlaArgIlePheGlyThr-114
SEQ. ID. NO. 33476    124-AspIleGlyHisGlyIleLysGlnIleGlyArgAsnIleAlaGluGlnIleGlyGlyPheSerArgGluProGluSerAlaAsnThrGlyAsnGlu
                      AlaLeuAlaAspCysLeuAspGluIleSerArgLeuArgAspGlyValGluArgLeuAsnGluArgLeuAspArgLeu-181
Antigenic Index - Jameson-Wolf
SEQ. ID. NO. 33477    13-LeuGlnSerProAspSerArgSerGluLeuThr-23
SEQ. ID. NO. 33478    39-LeuAlaGlyArgIleThrGluAspGlyLeuLeuSerAlaGlyAsnGlyPheAlaAspThrGluIleThrPheArgAsnSerAlaIleArgLysIle
                      LeuGlnGlyGlyGluProGlyAlaGlyAspIleArgLeuGluGly-85
SEQ. ID. NO. 33479    98-GlySerLeuArgSerArgAlaSerAspGluLeuAla-109
SEQ. ID. NO. 33480    116-AlaGlyIleGlySerArgAlaThrAspIle-125
SEQ. ID. NO. 33481    130-LysGlnIleGlyArgAsnIleAla-137
SEQ. ID. NO. 33482    140-IleGlyGlyPheSerArgGluProGluSerAlaAsnThrGlyAsnGluAlaLeuAlaAspCysLeuAspGluIleSerArgLeuArgAspGlyVal
                      GluArgLeuAsnGluArgLeuAspArgLeuGluArgAspIleTrp-186
Hydrophilic Regions - Hopp-Woods
SEQ. ID. NO. 33483    15-SerProAspSerArgSerGluLeu-22
SEQ. ID. NO. 33484    39-LeuAlaGlyArgIleThrGluAspGlyLeu-48
SEQ. ID. NO. 33485    56-AlaAspThrGluIleThrPhe-62
SEQ. ID. NO. 33486    65-SerAlaIleArgLysIleLeuGln-72
SEQ. ID. NO. 33487    74-GlyGluProGlyAlaGlyAspIleArgLeuGluGly-85
SEQ. ID. NO. 33488    100-LeuArgSerArgAlaSerAspGluLeuAla-109
SEQ. ID. NO. 33489    118-IleGlySerArgAlaThrAsp-124
SEQ. ID. NO. 33490    143-PheSerArgGluProGluSerAlaAsnThrGlyAsnGluAlaLeuAlaAspCysLeuAspGluIleSerArgLeuArgAspGlyValGluArgLeu
                      AsnGluArgLeuAspArgLeuGluArgAspIleTrp-186
g609
AMPHI Regions - AMPHI
SEQ. ID. NO. 33491    15-ThrLeuAspAlaPheVal-20
SEQ. ID. NO. 33492    30-HisHisIlePheHisGluPheArgValPheValGlyLeuPhe-43
SEQ. ID. NO. 33493    52-PheGluGlnAlaValGlu-57
SEQ. ID. NO. 33494    67-IleAspAsnPheLeu-71
SEQ. ID. NO. 33495    114-ValAlaValCysProVal-119
Antigenic Index - Jameson-Wolf
SEQ. ID. NO. 33496    10-AlaLeuAspAspGluThrLeu-16
SEQ. ID. NO. 33497    20-ValGlyAsnGlnArgSerSerAspIleAla-29
SEQ. ID. NO. 33498    71-LeuAspThrAspPheGlyIleGlySerGlnAlaAspGlyAsnValArg-86
SEQ. ID. NO. 33499    99-GlyThrArgAlaLysArgGlyTyrGlyAsnHisAspLeu-111
SEQ. ID. NO. 33500    124-ArgGluAlaAspIle-128
Hydrophilic Regions - Hopp-Woods
SEQ. ID. NO. 33501    10-AlaLeuAspAspGluThrLeu-16
SEQ. ID. NO. 33502    23-GlnArgSerSerAspIle-28
SEQ. ID. NO. 33503    79-SerGlnAlaAspGlyAsnVal-85
SEQ. ID. NO. 33504    100-ThrArgAlaLysArgGlyTyrGly-107
SEQ. ID. NO. 33505    124-ArgGluAlaAspIle-128
g610
AMPHI Regions - AMPHI
SEQ. ID. NO. 33506    6-MetGlnPheProTyrArg-11
SEQ. ID. NO. 33507    18-MetArgArgMetArgArg-23
SEQ. ID. NO. 33508    97-ThrGlyArgAlaGlnGluAlaTyr-104
SEQ. ID. NO. 33509    111-ProSerThrValArgAlaLeuArgGluArg-120
SEQ. ID. NO. 33510    187-IleArgGluAlaLeuGlu-192
SEQ. ID. NO. 33511    208-TyrAlaSerAlaPheTyrGlyProPheArgAsp-218
SEQ. ID. NO. 33512    223-SerGlyAsnLeuGlyLysAlaAsp-230
SEQ. ID. NO. 33513    268-LeuAspValValArgArgValLysAspGlu-277
SEQ. ID. NO. 33514    296-AlaAlaValAlaAlaAsn-300
Antigenic Index - Jameson-Wolf
SEQ. ID. NO. 33515    11-ArgAsnValProAlaSerArgMetArgArgMetArgArgAspAspPheSerArgArgLeuMetArg-32
SEQ. ID. NO. 33516    34-HisMetLeuThrAlaAspAsp-40
SEQ. ID. NO. 33517    50-GlyAlaAlaArgGluGluAspValProSerMetProGlyValLysArgGlnSerLeuAsp-69
SEQ. ID. NO. 33518    75-AlaGluGluAlaValLys-80
SEQ. ID. NO. 33519    93-ThrAlaAsnLysThrGlyArgAlaGlnGluAlaTyrAsnProGluGlyLeuVal-110
SEQ. ID. NO. 33520    115-ArgAlaLeuArgGluArgPhePro-122
SEQ. ID. NO. 33521    139-GlyGlnAspGlyLeuThrAspGluAsnGlyTyrValMetAsnAspGluThrVal-156
SEQ. ID. NO. 33522    175-AlaProSerAspMetMetAspGlyArgIleGlyAlaIleArgGluAlaLeuGluAspAlaGlyHis-196
SEQ. ID. NO. 33523    215-ProPheArgAspAlaValGlySerSerGlyAsnLeuGlyLysAlaAspLysLysThrTyrGlnMetAspProAlaAsnThrAspGluAlaLeuHis-246
SEQ. ID. NO. 33524    250-LeuAspIleGlnGluGlyAlaAsp-257
SEQ. ID. NO. 33525    270-ValValArgArgValLysAspGluPheGlyVal-280
SEQ. ID. NO. 33526    302-TrpLeuAspGlyGlyLysValVal-309
SEQ. ID. NO. 33527    317-LysArgAlaGlyAlaAspGly-323
SEQ. ID. NO. 33528    331-GluAlaAlaLysMetLeuLysArg-338
Hydrophilic Regions - Hopp-Woods
SEQ. ID. NO. 33529    14-ProAlaSerArgMetArgArgMetArgArgAspAspPheSerArgArgLeuMetArg-32
SEQ. ID. NO. 33530    34-HisMetLeuThrAla-38
SEQ. ID. NO. 33531    50-GlyAlaAlaArgGluGluAspValProSer-59
SEQ. ID. NO. 33532    61-ProGlyValLysArgGlnSerLeuAsp-69
SEQ. ID. NO. 33533    75-AlaGluGluAlaValLys-80
SEQ. ID. NO. 33534    95-AsnLysThrGlyArgAlaGlnGluAlaTyrAsn-105
SEQ. ID. NO. 33535    115-ArgAlaLeuArgGluArgPhePro-122
SEQ. ID. NO. 33536    141-AspGlyLeuThrAspGluAsnGly-148
SEQ. ID. NO. 33537    151-MetAsnAspGluThrVal-156

TABLE 1-continued

| | |
|---|---|
| SEQ. ID. NO. 33538 | 178-AspMetMetAspGlyArgIleGlyAlaIleArgGluAlaLeuGluAspAlaGly-195 |
| SEQ. ID. NO. 33539 | 216-PheArgAspAlaValGly-221 |
| SEQ. ID. NO. 33540 | 225-AsnLeuGlyLysAlaAspLysLysThrTyrGln-235 |
| SEQ. ID. NO. 33541 | 238-ProAlaAsnThrAspGluAlaLeuHis-246 |
| SEQ. ID. NO. 33542 | 250-LeuAspIleGlnGluGlyAlaAsp-257 |
| SEQ. ID. NO. 33543 | 270-ValValArgArgValLysAspGluPheGly-279 |
| SEQ. ID. NO. 33544 | 317-LysArgAlaGlyAla-321 |
| SEQ. ID. NO. 33545 | 331-GluAlaAlaLysMetLeuLysArg-338 | g611
AMPHI Regions - AMPHI

| | |
|---|---|
| SEQ. ID. NO. 33546 | 15-CysArgLeuPheGlyLysLeuSerLeu-23 |
| SEQ. ID. NO. 33547 | 26-ArgLeuLeuProGlyLeuCysArgGly-34 |
| SEQ. ID. NO. 33548 | 48-ArgSerValArgArgValIle-54 |
| SEQ. ID. NO. 33549 | 63-GlnValValAlaVal-67 |
| SEQ. ID. NO. 33550 | 104-ValPheIleGluAspPheVal-110 |
| SEQ. ID. NO. 33551 | 130-GlyPheLeuGlyAsnValLeuArgThr-138 |

Antigenic Index - Jameson-Wolf

| | |
|---|---|
| SEQ. ID. NO. 33552 | 1-MetProSerGluAsnGlyMetGlyLysArgGlnLeuAla-13 |
| SEQ. ID. NO. 33553 | 29-ProGlyLeuCysArgGlyGlyValCysArgGlyArgCys-41 |
| SEQ. ID. NO. 33554 | 45-PheProSerArgSerValArgArgValIlePheArgArgValArgIle-60 |
| SEQ. ID. NO. 33555 | 119-AsnProAlaAspPheArgVal-125 |
| SEQ. ID. NO. 33556 | 142-AlaProGlnGluAsp-146 |

Hydrophilic Regions - Hopp-Woods

| | |
|---|---|
| SEQ. ID. NO. 33557 | 1-MetProSerGluAsnGlyMetGlyLysArgGlnLeuAla-13 |
| SEQ. ID. NO. 33558 | 35-GlyValCysArgGlyArgCys-41 |
| SEQ. ID. NO. 33559 | 53-ValIlePheArgArgValArgIle-60 |
| SEQ. ID. NO. 33560 | 121-AlaAspPheArgVal-125 | g612
AMPHI Regions - AMPHI

| | |
|---|---|
| SEQ. ID. NO. 33561 | 6-AsnIleAlaLysLysLeuAlaGlyVal-14 |
| SEQ. ID. NO. 33562 | 57-LysAlaValGluLysCysAlaGluAsnValLeu-67 |
| SEQ. ID. NO. 33563 | 80-ValGlyAspPheProAsn-85 |

Antigenic Index - Jameson-Wolf

| | |
|---|---|
| SEQ. ID. NO. 33564 | 7-IleAlaLysLysLeuAlaGlyValAsp-15 |
| SEQ. ID. NO. 33565 | 17-IleAlaPheAspPheAspGly-23 |
| SEQ. ID. NO. 33566 | 27-AspPheGlyArgAspAspAlaValArgHisSerGlyVal-39 |
| SEQ. ID. NO. 33567 | 57-LysAlaValGluLysCysAlaGlu-64 |
| SEQ. ID. NO. 33568 | 98-HisHisArgAsnProTyrIleLysLeuAsnLysSerLysSerProAspIlePheArg-116 |
| SEQ. ID. NO. 33569 | 119-PheTyrGlyHisSerAsn-124 |

Hydrophilic Regions - Hopp-Woods

| | |
|---|---|
| SEQ. ID. NO. 33570 | 7-IleAlaLysLysLeuAlaGlyValAsp-15 |
| SEQ. ID. NO. 33571 | 28-PheGlyArgAspAspAlaValArg-35 |
| SEQ. ID. NO. 33572 | 57-LysAlaValGluLysCysAlaGlu-64 |
| SEQ. ID. NO. 33573 | 105-LysLeuAsnLysSerLysSerProAspIlePhe-115 | g613
AMPHI Regions - AMPHI

| | |
|---|---|
| SEQ. ID. NO. 33574 | 95-MetProArgMetArgSerProSerSerLeuMetSerProAla-108 |
| SEQ. ID. NO. 33575 | 140-SerSerValMetArgProAla-146 |
| SEQ. ID. NO. 33576 | 166-GluArgLeuSerGlyLeuCysArgIle-174 |
| SEQ. ID. NO. 33577 | 184-AspIlePheSerAspTrpGly-190 |

Antigenic Index - Jameson-Wolf

| | |
|---|---|
| SEQ. ID. NO. 33578 | 1-MetSerArgSerSerLeuSerArgArgSerLeuArgArgSerThrProSerArg-18 |
| SEQ. ID. NO. 33579 | 23-SerSerArgGlnSerAlaArgAla-30 |
| SEQ. ID. NO. 33580 | 36-AlaAspSerGlySerArgGluAsnProProIleCysSer-48 |
| SEQ. ID. NO. 33581 | 73-ProLysIleArgAlaAsnSerSerAspAlaArgGluArgArgLeuProSerArgAspSerThrAla-94 |
| SEQ. ID. NO. 33582 | 96-ProArgMetArgSerProSerSerLeu-104 |
| SEQ. ID. NO. 33583 | 107-ProAlaProGlySerProPro-113 |
| SEQ. ID. NO. 33584 | 130-AlaLysProPheProAlaGluSerLysProSerSerValMetArgProAlaSer-147 |
| SEQ. ID. NO. 33585 | 159-ProAlaLysGluValSerSerGluArgLeuSerGlyLeuCysArgIleArgArg-176 |
| SEQ. ID. NO. 33586 | 178-MetMetGlyArgArgAlaAspIlePheSerAspTrpGlyGlyGluCys-193 |

Hydrophilic Regions - Hopp-Woods

| | |
|---|---|
| SEQ. ID. NO. 33587 | 1-MetSerArgSerSerLeuSerArgArgSerLeuArgArgSerThrProSer-17 |
| SEQ. ID. NO. 33588 | 24-SerArgGlnSerAlaArgAla-30 |
| SEQ. ID. NO. 33589 | 38-SerGlySerArgGluAsnProPro-45 |
| SEQ. ID. NO. 33590 | 73-ProLysIleArgAlaAsnSerSerAspAlaArgGluArgArgLeuProSerArgAspSerThrAla-94 |
| SEQ. ID. NO. 33591 | 96-ProArgMetArgSerProSer-102 |
| SEQ. ID. NO. 33592 | 133-PheProAlaGluSerLysProSerSerValMetArg-144 |
| SEQ. ID. NO. 33593 | 159-ProAlaLysGluValSerSerGluArgLeuSerGly-170 |
| SEQ. ID. NO. 33594 | 172-CysArgIleArgArg-176 |
| SEQ. ID. NO. 33595 | 178-MetMetGlyArgArgAlaAspIle-185 | g614
AMPHI Regions - AMPHI

| | |
|---|---|
| SEQ. ID. NO. 33596 | 20-SerGlnPheIleArgGlnValAsnAsnGly-29 |
| SEQ. ID. NO. 33597 | 65-AsnLeuIleGlnThrLeuLeuAsn-72 |
| SEQ. ID. NO. 33598 | 90-AlaLeuPheTyrSerLeuLeuProValLeu-99 |
| SEQ. ID. NO. 33599 | 144-ValAlaGlyCysAspGluAlaLysGluGluValGlnGluIleValAspTyrLeuLysAlaProAsnArgTyrGlnSerLeu-170 |
| SEQ. ID. NO. 33600 | 210-AspPheValGluMetPheVal-216 |
| SEQ. ID. NO. 33601 | 222-ArgValArgAspMetPheGluGln-229 |
| SEQ. ID. NO. 33602 | 242-GluIleAspAlaValGlyArg-248 |
| SEQ. ID. NO. 33603 | 295-ProAlaLeuGlnArgProGlyArgPheAsp-304 |

TABLE 1-continued

| | |
|---|---|
| SEQ. ID. NO. 33604 | 333-SerValAspLeuLeuSerLeuAla-340 |
| SEQ. ID. NO. 33605 | 349-AlaAspLeuAlaLysLeuVal-355 |

Antigenic Index - Jameson-Wolf

| | |
|---|---|
| SEQ. ID. NO. 33606 | 7-LeuAspGlyLysLysGluAspAsnGlyGlnIleGlu-18 |
| SEQ. ID. NO. 33607 | 25-GlnValAsnAsnGlyGluValSerGly-33 |
| SEQ. ID. NO. 33608 | 45-LeuIleLysGlyGluArgThrAspLysSerThrPhe-56 |
| SEQ. ID. NO. 33609 | 59-AsnAlaProLeuAspAspAsnLeu-66 |
| SEQ. ID. NO. 33610 | 70-LeuLeuAsnLysAsnValArgValLysValThrProGluGluLysProSerAla-87 |
| SEQ. ID. NO. 33611 | 112-GlnAlaGlyGlyGlyGlyLysGlyGly-120 |
| SEQ. ID. NO. 33612 | 123-SerPheGlyLysSerArgAlaArgLeuLeuAspLysAspAlaAsnLys-138 |
| SEQ. ID. NO. 33613 | 145-AlaGlyCysAspGluAlaLysGluValGlnGlu-156 |
| SEQ. ID. NO. 33614 | 161-LeuLysAlaProAsnArgTyrGlnSerLeuGlyGlyArgValProArgGly-177 |
| SEQ. ID. NO. 33615 | 182-GlySerProGlyThrGlyLysThrLeuLeu-191 |
| SEQ. ID. NO. 33616 | 207-SerGlySerAspPhe-211 |
| SEQ. ID. NO. 33617 | 219-GlyAlaSerArgValArgAspMetPheGluGlnAlaLysLysAsnAla-234 |
| SEQ. ID. NO. 33618 | 241-AspGluIleAspAlaValGlyArgGlnArgGlyAlaGlyLeuGlyGlyGlyAsnAspGluArgGluGlnThrLeu-265 |
| SEQ. ID. NO. 33619 | 272-MetAspGlyPheGluSerAsnGln-279 |
| SEQ. ID. NO. 33620 | 287-ThrAsnArgProAspValLeuAspProAlaLeuGlnArgProGlyArgPheAspArg-305 |
| SEQ. ID. NO. 33621 | 311-LeuProAspIleArgGlyArgGluGlnXxx-320 |
| SEQ. ID. NO. 33622 | 323-ValHisSerLysLysValProLeuAspGluSerValAsp-335 |
| SEQ. ID. NO. 33623 | 341-ArgGlyThrProGlyPheSerGly-348 |
| SEQ. ID. NO. 33624 | 362-AlaGlyArgArgAsnLysValLysValAspGlnSerAspLeuLysThrProLysThrLysSer-382 |

Hydrophilic Regions - Hopp-Woods

| | |
|---|---|
| SEQ. ID. NO. 33625 | 7-LeuAspGlyLysLysGluAspAsnGlyGln-16 |
| SEQ. ID. NO. 33626 | 26-ValAsnAsnGlyGluValSer-32 |
| SEQ. ID. NO. 33627 | 46-IleLysGlyGluArgThrAspLysSerThr-55 |
| SEQ. ID. NO. 33628 | 61-ProLeuAspAspAsnLeu-66 |
| SEQ. ID. NO. 33629 | 73-LysAsnValArgValLysValThrProGluGluLysProSerAla-87 |
| SEQ. ID. NO. 33630 | 115-GlyGlyGlyLysGlyGly-120 |
| SEQ. ID. NO. 33631 | 125-GlyLysSerArgAlaArgLeuLeuAspLysAspAlaAsnLys-138 |
| SEQ. ID. NO. 33632 | 145-AlaGlyCysAspGluAlaLysGluValGlnGlu-156 |
| SEQ. ID. NO. 33633 | 162-LysAlaProAsnArg-166 |
| SEQ. ID. NO. 33634 | 171-GlyGlyArgValProArg-176 |
| SEQ. ID. NO. 33635 | 221-SerArgValArgAspMetPheGluGlnAlaLysLysAsnAla-234 |
| SEQ. ID. NO. 33636 | 241-AspGluIleAspAlaValGlyArgGlnArgGlyAlaGly-253 |
| SEQ. ID. NO. 33637 | 256-GlyGlyAsnAspGluArgGluGlnThr-264 |
| SEQ. ID. NO. 33638 | 273-AspGlyPheGluSer-277 |
| SEQ. ID. NO. 33639 | 287-ThrAsnArgProAspValLeuAsp-294 |
| SEQ. ID. NO. 33640 | 296-AlaLeuGlnArgProGlyArgPheAspArg-305 |
| SEQ. ID. NO. 33641 | 312-ProAspIleArgGlyArgGluGlnXxx-320 |
| SEQ. ID. NO. 33642 | 324-HisSerLysLysValProLeuAspGluSerValAsp-335 |
| SEQ. ID. NO. 33643 | 362-AlaGlyArgArgAsnLysValLysValAspGlnSerAspLeuLysThrProLysThrLys-381 | g616

AMPHI Regions - AMPHI

| | |
|---|---|
| SEQ. ID. NO. 33644 | 6-LysMetValValGlyLeu-11 |
| SEQ. ID. NO. 33645 | 13-AsnProGlyLysGluTyrGlu-19 |
| SEQ. ID. NO. 33646 | 48-PheGlyGluValAlaArgAla-54 |
| SEQ. ID. NO. 33647 | 77-ValAlaAlaLeuAlaGlnPheTyrLys-85 |
| SEQ. ID. NO. 33648 | 115-GlyHisAsnGlyLeuLysAspIle-122 |
| SEQ. ID. NO. 33649 | 152-LeuAsnLysProSerAla-157 |
| SEQ. ID. NO. 33650 | 177-HisHisPheArgGlnMetGlyArg-184 |
| SEQ. ID. NO. 33651 | 203-ThrAlaPheSerArgPheProTyr-210 |
| SEQ. ID. NO. 33652 | 267-AlaProValGlnAsnLeuProAsnValAla-276 |
| SEQ. ID. NO. 33653 | 299-GlyGlyIleTyrSerLeuLeuPhe-306 |
| SEQ. ID. NO. 33654 | 319-PheAspLysAlaAla-323 |
| SEQ. ID. NO. 33655 | 363-GluCysAlaGlnAlaTrp-368 |
| SEQ. ID. NO. 33656 | 374-ThrGlySerLeuGlyAspValLeuAlaAspLeuThr-385 |

Antigenic Index - Jameson-Wolf

| | |
|---|---|
| SEQ. ID. NO. 33657 | 11-LeuGlyAsnProGlyLysGluTyrGluGlnThrArgHisAsnAlaGlyPhe-27 |
| SEQ. ID. NO. 33658 | 39-AlaSerPheLysGluGluLysLysPhePhe-48 |
| SEQ. ID. NO. 33659 | 55-AlaLeuProAspGly-59 |
| SEQ. ID. NO. 33660 | 70-MetAsnArgSerGlyGlnAla-76 |
| SEQ. ID. NO. 33661 | 86-IleLysProGluGlu-90 |
| SEQ. ID. NO. 33662 | 96-AspGluLeuAspIleProCysGlyArgIleLysPhe-107 |
| SEQ. ID. NO. 33663 | 109-LeuGlyGlyGlyAsnGlyGlyHisAsnGlyLeuLysAspIleGlnAla-124 |
| SEQ. ID. NO. 33664 | 138-IleGlyHisProGlyAspArgAsnLeu-146 |
| SEQ. ID. NO. 33665 | 152-LeuAsnLysProSerAlaGluAlaProProAlaAsnArgArgCysArgArgGlnIleProAlaGlyArgThrArgHisHisPheArgGlnMetGlyArgGlyAsnAlaLeu-188 |
| SEQ. ID. NO. 33666 | 197-ArgLeuLysProPheGlnThrAla-204 |
| SEQ. ID. NO. 33667 | 209-ProTyrProAsnSerHisGluArgThrGlnAla-219 |
| SEQ. ID. NO. 33668 | 221-TyrProAsnGlyIleHisProArgHisArgArgAsnProArgPheProAla-237 |
| SEQ. ID. NO. 33669 | 239-ArgMetGlnHisArgArgSerThrValArgArgArgSerGlyThrMetAlaArgHisThrCysArgThrArgArgGlnIle-265 |
| SEQ. ID. NO. 33670 | 275-ValAlaGlyArgGlyGlyGlyMetLysLeuProArgAsnArgPhe-289 |
| SEQ. ID. NO. 33671 | 308-AlaAlaAspThrAlaProProPro-315 |
| SEQ. ID. NO. 33672 | 317-ProHisPheAspLysAlaAla-323 |
| SEQ. ID. NO. 33673 | 338-AlaPheLysThrGlyLysLeuProIlePro-347 |
| SEQ. ID. NO. 33674 | 371-AlaThrArgThrGlySerLeuGly-378 |
| SEQ. ID. NO. 33675 | 394-AlaArgSerAlaCysArgProAsp-401 |

TABLE 1-continued

Hydrophilic Regions - Hopp-Woods
SEQ. ID. NO. 33676  13-AsnProGlyLysGluTyrGluGlnThrArgHis-23
SEQ. ID. NO. 33677  39-AlaSerPheLysGluGluLysLysPhePhe-48
SEQ. ID. NO. 33678  86-IleLysProGluGlu-90
SEQ. ID. NO. 33679  96-AspGluLeuAspIleProCysGlyArgIleLysPhe-107
SEQ. ID. NO. 33680  117-AsnGlyLeuLysAspIleGlnAla-124
SEQ. ID. NO. 33681  140-HisProGlyAspArgAsnLeu-146
SEQ. ID. NO. 33682  155-ProSerAlaGluAlaProProAlaAsnArgArgCysArgArgGlnIleProAlaGlyArgThrArgHisHisPhe-179
SEQ. ID. NO. 33683  212-AsnSerHisGluArgThrGln-218
SEQ. ID. NO. 33684  225-IleHisProArgHisArgArgAsnProArg-234
SEQ. ID. NO. 33685  240-MetGlnHisArgArgSerThrValArgArgArgSerGlyThrMet-254
SEQ. ID. NO. 33686  257-HisThrCysArgThrArgArgGlnIle-265
SEQ. ID. NO. 33687  276-AlaGlyArgGlyGlyGly-281
SEQ. ID. NO. 33688  283-LysLeuProArgAsnArgPhe-289
SEQ. ID. NO. 33689  308-AlaAlaAspThrAla-312
SEQ. ID. NO. 33690  318-HisPheAspLysAlaAla-323
SEQ. ID. NO. 33691  338-AlaPheLysThrGlyLys-343
SEQ. ID. NO. 33692  396-SerAlaCysArgProAsp-401
g619
AMPHI Regions - AMPHI
SEQ. ID. NO. 33693  50-LysLeuAlaAlaLeuLeu-55
SEQ. ID. NO. 33694  66-GlnLeuPheGlnThrLeuThrAsn-73
SEQ. ID. NO. 33695  146-GlyValIlePheGlyIleLeuPheArgSerLeuSerSerLeuLeuSerArg-162
SEQ. ID. NO. 33696  165-AspProGluGluPhe-169
SEQ. ID. NO. 33697  175-AsnMetPheAlaGlyPheAsn-181
SEQ. ID. NO. 33698  246-AlaValValGlyProValSerPhePheGlyLeuLeuAlaAlaSerLeuAlaAsnHisPheSer-266
SEQ. ID. NO. 33699  303-LeuSerValValValGluPhe-309
Antigenic Index - Jameson-Wolf
SEQ. ID. NO. 33700  1-MetProSerGluLysAsnIle-7
SEQ. ID. NO. 33701  12-GlySerSerArgProLeuArg-18
SEQ. ID. NO. 33702  35-AsnValLysGlyAspTrpAsp-41
SEQ. ID. NO. 33703  132-IleArgGlnGlyGlyArgAspLeuPro-140
SEQ. ID. NO. 33704  163-MetIleAspProGluGluPheThr-170
SEQ. ID. NO. 33705  182-ThrValArgSerGluLeu-187
SEQ. ID. NO. 33706  205-GluArgTyrArgSerAspValHisLeuLeuGlyArgAspGlnAlaVal-220
SEQ. ID. NO. 33707  265-PheSerProSerValArgHisSerVal-273
Hydrophilic Regions - Hopp-Woods
SEQ. ID. NO. 33708  1-MetProSerGluLysAsnIle-7
SEQ. ID. NO. 33709  13-SerSerArgProLeu-17
SEQ. ID. NO. 33710  134-GlnGlyGlyArgAspLeuPro-140
SEQ. ID. NO. 33711  163-MetIleAspProGluGluPheThr-170
SEQ. ID. NO. 33712  183-ValArgSerGluLeu-187
SEQ. ID. NO. 33713  205-GluArgTyrArgSerAspVal-211
SEQ. ID. NO. 33714  213-LeuLeuGlyArgAspGlnAla-219
SEQ. ID. NO. 33715  269-ValArgHisSerVal-273
g620
AMPHI Regions - AMPHI
SEQ. ID. NO. 33716  8-IleValAlaValPheAlaLeuSerAla-16
SEQ. ID. NO. 33717  31-IleSerAspArgSerVal-36
SEQ. ID. NO. 33718  69-ValLysGlnMetPheGlyTyrThrLysLeuProGluGluProLysGlyIleArgValIleTyrValThrAspMetGlyAsnValThrAspTrpThr-100
SEQ. ID. NO. 33719  139-GlnAlaGluLysPhe-143
Antigenic Index - Jameson-Wolf
SEQ. ID. NO. 33720  16-AlaCysArgGlnAlaGluGluAlaProProProLeuProArgGlnIleSerAspArgSerValGlyHisTyrCysSerMetAsnLeuThrGluHis
AsnGlyProLysAla-52
SEQ. ID. NO. 33721  56-LeuAsnGlyLysProAspGlnProVal-64
SEQ. ID. NO. 33722  75-TyrThrLysLeuProGluGluProLysGlyIle-85
SEQ. ID. NO. 33723  92-AspMetGlyAsnValThrAspTrpThrAsnProAsnAlaAspThrGluTrpIleAspAlaLysLys-113
SEQ. ID. NO. 33724  125-GlyMetGlyAlaGluAspAlaLeuProPheGlyAsnLysGluGlnAlaGluLysPheAlaLysAspLysGlyGlyLysValValGly-153
SEQ. ID. NO. 33725  155-AspAspMetProAsp-159
Hydrophilic Regions - Hopp-Woods
SEQ. ID. NO. 33726  18-ArgGlnAlaGluGluAlaProProProLeu-27
SEQ. ID. NO. 33727  30-GlnIleSerAspArgSerVal-36
SEQ. ID. NO. 33728  46-GluHisAsnGlyProLys-51
SEQ. ID. NO. 33729  58-GlyLysProAspGln-62
SEQ. ID. NO. 33730  77-LysLeuProGluGluProLysGlyIle-85
SEQ. ID. NO. 33731  103-AsnAlaAspThrGluTrpIleAspAlaLysLys-113
SEQ. ID. NO. 33732  127-GlyAlaGluAspAlaLeu-132
SEQ. ID. NO. 33733  135-GlyAsnLysGluGlnAlaGluLysPheAlaLysAspLysGlyGlyLys-150
SEQ. ID. NO. 33734  155-AspAspMetProAsp-159
g622
AMPHI Regions - AMPHI
SEQ. ID. NO. 33735  28-LeuProGluAlaValArgAsnLeuAlaArg-37
SEQ. ID. NO. 33736  62-GluGluIleIleArgTrpLeuAlaAsp-70
SEQ. ID. NO. 33737  112-IleLeuGlyGlnIleLysAspAlaValArgAlaAlaGlnGlu-125
SEQ. ID. NO. 33738  132-LysLeuAsnAlaLeuPheGlnLys-139
SEQ. ID. NO. 33739  142-SerValAlaLysGluVal-147
SEQ. ID. NO. 33740  169-GluGlnIlePheProAspIleGlyAsp-177
SEQ. ID. NO. 33741  187-GluMetIleGluLeuValAla-193
SEQ. ID. NO. 33742  214-AlaGlnGluLeuCysAspLys-220
SEQ. ID. NO. 33743  232-AspLeuProAlaIleLeuHis-238

TABLE 1-continued

| | |
|---|---|
| SEQ. ID. NO. 33744 | 288-AspLeuAsnAspAla-292 |
| SEQ. ID. NO. 33745 | 297-ValAspAspMetValAsnIleValGlnSerGly-307 |
| SEQ. ID. NO. 33746 | 324-GluLysValAlaGluPheValArgGlnGln-333 |
| SEQ. ID. NO. 33747 | 345-LeuArgAspGluGlyGluLys-351 |
| SEQ. ID. NO. 33748 | 354-LysGlnValLeuGluAsnAlaMetLysGlnLeuAlaLys-366 |
| SEQ. ID. NO. 33749 | 372-GluValLeuGluArgLeuSerValGlnLeuThr-382 |
| SEQ. ID. NO. 33750 | 384-LysLeuLeuHisSerProThrGlnThrLeuAsnLysAlaGlyGlu-398 |
| Antigenic Index - Jameson-Wolf | |
| SEQ. ID. NO. 33751 | 16-SerIleArgGluLysLeuAla-22 |
| SEQ. ID. NO. 33752 | 30-GluAlaValArgAsnLeuAlaArgSerAsnAlaAla-41 |
| SEQ. ID. NO. 33753 | 49-ThrCysAsnArgThrGlu-54 |
| SEQ. ID. NO. 33754 | 57-CysValGlyAspSerGluGluIleIle-65 |
| SEQ. ID. NO. 33755 | 75-ProIleGluGluIleArgProTyr-82 |
| SEQ. ID. NO. 33756 | 87-AspMetGlnGluThrValArgHis-94 |
| SEQ. ID. NO. 33757 | 115-GlnIleLysAspAlaValArgAlaAlaGlnGluGlnGluSerMetGlyAla-131 |
| SEQ. ID. NO. 33758 | 142-SerValAlaLysGluValArgThrAspThrAlaValGlyGluAsnSerVal-158 |
| SEQ. ID. NO. 33759 | 174-AspIleGlyAspLeuAsn-179 |
| SEQ. ID. NO. 33760 | 199-LysAsnProArgLeu-203 |
| SEQ. ID. NO. 33761 | 210-ThrLeuAlaArgAlaGlnGluLeuCysAspLysLeuGlyValAsnAlaGlu-226 |
| SEQ. ID. NO. 33762 | 257-GlyMetValGluArgAlaLeuLysGlnArgGlnSer-268 |
| SEQ. ID. NO. 33763 | 277-AlaValProArgAspIleGluAlaGluValGlyAspLeuAsnAsp-291 |
| SEQ. ID. NO. 33764 | 305-GlnSerGlyLysGluAlaArgGlnLysAlaAlaAlaAla-317 |
| SEQ. ID. NO. 33765 | 321-LeuValSerGluLysValAlaGluPheValArgGlnGlnGlnGlyArgGlnSerVal-339 |
| SEQ. ID. NO. 33766 | 343-LysAlaLeuArgAspGluGlyGluLysAlaArgLysGlnValLeu-357 |
| SEQ. ID. NO. 33767 | 368-AlaThrAlaGluGluValLeuGlu-375 |
| SEQ. ID. NO. 33768 | 381-LeuThrAsnLysLeuLeuHisSerProThrGlnThrLeuAsnLysAlaGlyGluGluAspLysAspLeuVal-404 |
| Hydrophilic Regions - Hopp-Woods | |
| SEQ. ID. NO. 33769 | 16-SerIleArgGluLysLeuAla-22 |
| SEQ. ID. NO. 33770 | 30-GluAlaValArgAsnLeuAlaArgSerAsnAlaAla-41 |
| SEQ. ID. NO. 33771 | 59-GlyAspSerGluGluIleIle-65 |
| SEQ. ID. NO. 33772 | 75-ProIleGluGluIleArg-80 |
| SEQ. ID. NO. 33773 | 87-AspMetGlnGluThrValArgHis-94 |
| SEQ. ID. NO. 33774 | 115-GlnIleLysAspAlaValArgAlaAlaGlnGluGlnGluSerMetGly-130 |
| SEQ. ID. NO. 33775 | 142-SerValAlaLysGluValArgThrAspThrAlaValGly-154 |
| SEQ. ID. NO. 33776 | 210-ThrLeuAlaArgAlaGlnGluLeuCysAsp-219 |
| SEQ. ID. NO. 33777 | 257-GlyMetValGluArgAlaLeuLysGlnArgGlnSer-268 |
| SEQ. ID. NO. 33778 | 277-AlaValProArgAspIleGluAlaGluValGlyAspLeuAsn-290 |
| SEQ. ID. NO. 33779 | 305-GlnSerGlyLysGluAlaArgGlnLysAlaAlaAlaAla-317 |
| SEQ. ID. NO. 33780 | 321-LeuValSerGluLysValAlaGluPheValArg-331 |
| SEQ. ID. NO. 33781 | 333-GlnGlnGlyArgGlnSer-338 |
| SEQ. ID. NO. 33782 | 343-LysAlaLeuArgAspGluGlyGluLysAlaArgLysGlnValLeu-357 |
| SEQ. ID. NO. 33783 | 368-AlaThrAlaGluGluValLeuGlu-375 |
| SEQ. ID. NO. 33784 | 392-ThrLeuAsnLysAlaGlyGluGluAspLysAspLeuVal-404 |
| g624 | |
| AMPHI Regions - AMPHI | |
| SEQ. ID. NO. 33785 | 17-GlyIleIleGlyIlePheLeuPro-24 |
| SEQ. ID. NO. 33786 | 45-ArgPheHisArgTrpLeuHis-51 |
| SEQ. ID. NO. 33787 | 58-ProMetValHisAsn-62 |
| SEQ. ID. NO. 33788 | 102-SerSerValPheCys-106 |
| Antigenic Index - Jameson-Wolf | |
| SEQ. ID. NO. 33789 | 41-LysAlaSerProArgPheHisArgTrp-49 |
| SEQ. ID. NO. 33790 | 51-HisArgHisArgTyrPheGlyProMet-59 |
| SEQ. ID. NO. 33791 | 63-TrpGluGlnAsnGlyAlaValProArgLysAlaLys-74 |
| SEQ. ID. NO. 33792 | 114-TrpHisArgProGluSer-119 |
| Hydrophilic Regions - Hopp-Woods | |
| SEQ. ID. NO. 33793 | 67-GlyAlaValProArgLysAlaLys-74 |
| SEQ. ID. NO. 33794 | 115-HisArgProGluSer-119 |
| g625 | |
| AMPHI Regions - AMPHI | |
| SEQ. ID. NO. 33795 | 14-ThrArgArgValArgSerTrpLeuAla-22 |
| SEQ. ID. NO. 33796 | 24-SerSerGlyArgIleIleSerIleAlaAla-33 |
| SEQ. ID. NO. 33797 | 64-LysMetProProGluMetValTyrArgAla-73 |
| SEQ. ID. NO. 33798 | 78-MetLysGlyIleTyrSer-83 |
| Antigenic Index - Jameson-Wolf | |
| SEQ. ID. NO. 33799 | 5-ArgLysMetLysLysMetThrMetCysThrArgArgValArg-18 |
| SEQ. ID. NO. 33800 | 57-ProPheLysSerProGlnThrLysMetProPro-67 |
| SEQ. ID. NO. 33801 | 73-AlaSerSerSerArgMetLysGly-80 |
| SEQ. ID. NO. 33802 | 96-AspAlaProLysThrLysLeuAsnGlyMetArgLysSerAsnValGln-111 |
| Hydrophilic Regions - Hopp-Woods | |
| SEQ. ID. NO. 33803 | 5-ArgLysMetLysLysMetThrMetCysThrArgArgValArg-18 |
| SEQ. ID. NO. 33804 | 60-SerProGlnThrLysMetProPro-67 |
| SEQ. ID. NO. 33805 | 74-SerSerSerArgMetLysGly-80 |
| SEQ. ID. NO. 33806 | 96-AspAlaProLysThrLysLeuAsnGlyMetArgLysSerAsnValGln-111 |
| g627 | |
| AMPHI Regions - AMPHI | |
| SEQ. ID. NO. 33807 | 21-LeuGlnAsnLeuVal-25 |
| SEQ. ID. NO. 33808 | 56-IleAlaGluValGlyLysLeuPheLeuGlyIlePheIleThrIlePheProValLeuSerIleLeuLysAlaGlyGluAlaGlyAlaLeuGlyGly ValValSerLeuValHisAspThrAlaGlyHisPro-99 |

TABLE 1-continued

| SEQ. ID. NO. 33809 | 109-GlyIleLeuSerAlaPheLeuAspAsnAla-118 |

SEQ. ID. NO. 33810 153-PheMetGlyAlaLeuThrTyrIleGlyAsnAlaProAsnPheMetValLys-169
SEQ. ID. NO. 33811 180-ProThrPhePheArgTyr-185
Antigenic Index - Jameson-Wolf
SEQ. ID. NO. 33812 3-GlyLeuTrpLysProGluHisProGlyPhe-12
SEQ. ID. NO. 33813 41-ThrProLysGlnValArgAlaGlyAsnGluPheAsnPhe-53
SEQ. ID. NO. 33814 94-AspThrAlaGlyHis-98
SEQ. ID. NO. 33815 128-AlaGlyGlyAspAla-132
SEQ. ID. NO. 33816 170-AlaIleAlaGluGlnArgGlyValPro-178
Hydrophilic Regions - Hopp-Woods
SEQ. ID. NO. 33817 5-TrpLysProGluHisProGly-11
SEQ. ID. NO. 33818 43-LysGlnValArgAlaGlyAsn-49
SEQ. ID. NO. 33819 170-AlaIleAlaGluGlnArgGlyVal-177
g628
AMPHI Regions - AMPHI
SEQ. ID. NO. 33820 10-CysGlyProProAsnSerCysValSerIleLeuAlaAlaPhe-23
SEQ. ID. NO. 33821 25-AspGlyThrSerAlaProAlaAla-32
SEQ. ID. NO. 33822 34-HisThrTrpIleLeuArgSer-40
Antigenic Index - Jameson-Wolf
SEQ. ID. NO. 33823 6-LysProAlaGlyCysGlyProProAsnSer-15
SEQ. ID. NO. 33824 23-PheSerAspGlyThrSerAla-29
SEQ. ID. NO. 33825 40-SerValArgArgLeuAsnThrAsnArgProArgLeuLysSerSerAla-55
SEQ. ID. NO. 33826 77-MetAlaAsnGlySerAlaSerThr-84
SEQ. ID. NO. 33827 91-GlyArgValArgSerAlaValHisLysProAspIleArgLeuArgArg-106
SEQ. ID. NO. 33828 115-SerAlaSerGlyThr-119
Hydrophilic Regions - Hopp-Woods
SEQ. ID. NO. 33829 40-SerValArgArgLeuAsnThrAsnArgProArgLeuLysSerSerAla-55
SEQ. ID. NO. 33830 91-GlyArgValArgSerAlaValHisLysProAspIleArgLeuArgArg-106
g629
AMPHI Regions - AMPHI
SEQ. ID. NO. 33831 32-ArgTrpSerAspValPheSer-38
SEQ. ID. NO. 33832 48-IleSerArgLeuProArgThrPhe-55
SEQ. ID. NO. 33833 116-ValAlaAlaLeuIleGlyMetLeu-123
SEQ. ID. NO. 33834 145-XxxIlePheGlyGlyValValGluAlaValAlaThrPhe-157
SEQ. ID. NO. 33835 164-MetLeuGlnMetLeuGlyValTrpGlnGlnGlyAsp-175
SEQ. ID. NO. 33836 206-IleLeuGlyLeuGlyGlu-211
SEQ. ID. NO. 33837 253-ValProAsnIleValSerArgLeuMetGlyAspArgLeuArgGlnSer-268
SEQ. ID. NO. 33838 285-IleIleGlyArgMet-289
SEQ. ID. NO. 33839 300-ThrValPheGlyValLeu-305
Antigenic Index - Jameson-Wolf
SEQ. ID. NO. 33840 38-SerLeuSerAspSerGln-43
SEQ. ID. NO. 33841 50-ArgLeuProArgThr-54
SEQ. ID. NO. 33842 77-AsnArgPheValGluProSerMetAlaGlyAlaGlyGln-89
SEQ. ID. NO. 33843 130-ArgArgLeuProProThrAla-136
SEQ. ID. NO. 33844 260-LeuMetGlyAspArgLeuArgGlnSer-268
Hydrophilic Regions - Hopp-Woods
SEQ. ID. NO. 33845 260-LeuMetGlyAspArgLeuArgGln-267
g630
AMPHI Regions - AMPHI
SEQ. ID. NO. 33846 30-ProAspLeuLeuGlnGln-35
SEQ. ID. NO. 33847 81-GlyGlyPheTrpGluValLeuPheAla-89
SEQ. ID. NO. 33848 135-PheGlyGlyThrGlyLysAsnPhe-142
SEQ. ID. NO. 33849 169-AlaValAspGlyTyrSerGlyAlaThrAlaLeuAlaGlnTrp-182
SEQ. ID. NO. 33850 187-AlaAspGlyLeuLysAsnAlaVal-194
SEQ. ID. NO. 33851 203-AspAlaPheIleGlyLysLeuProGlySerIleGlyGluValSer-217
SEQ. ID. NO. 33852 230-PheAlaArgIleAlaSerTrpArgIleIleAlaGlyValMet-243
SEQ. ID. NO. 33853 247-IleAlaMetSerSerLeuIleAsnPhe-255
Antigenic Index - Jameson-Wolf
SEQ. ID. NO. 33854 37-IleAlaHisAspGlyAsnTyr-43
SEQ. ID. NO. 33855 53-MetSerProGluAla-57
SEQ. ID. NO. 33856 90-SerValArgLysHisGluIleAsnGlu-98
SEQ. ID. NO. 33857 133-GluValPheGlyGlyThrGlyLysAsnPheMet-143
SEQ. ID. NO. 33858 157-TyrProAlaAsnLeuSerGlyAspAla-165
SEQ. ID. NO. 33859 186-GlyAlaAspGlyLeuLys-191
SEQ. ID. NO. 33860 209-LeuProGlySerIleGly-214
SEQ. ID. NO. 33861 257-GlySerAspThrLysAla-262
SEQ. ID. NO. 33862 271-GlyThrTrpTrpLysAspAspTyrHisSerLeu-281
Hydrophilic Regions - Hopp-Woods
SEQ. ID. NO. 33863 90-SerValArgLysHisGluIleAsn-97
SEQ. ID. NO. 33864 258-SerAspThrLysAla-262
g638
AMPHI Regions - AMPHI
SEQ. ID. NO. 33865 17-LeuAlaArgPheValAspAsnIle-24
SEQ. ID. NO. 33866 30-IleValAspIleValGlu-35
SEQ. ID. NO. 33867 46-AspIleValGluHisPheGluProPheGlyLys-56
SEQ. ID. NO. 33868 108-ProPheGlyAsnValValAlaAsp-115
SEQ. ID. NO. 33869 118-ArgAlaGlyArgValPro-123
SEQ. ID. NO. 33870 148-ArgIleGlyArgThrMetLysValTyrAlaGluArgIleIle-161
SEQ. ID. NO. 33871 198-GluArgTyrValArgArgValTyrGly-206
SEQ. ID. NO. 33872 212-LeuValProPheAspGlyCysGlyThrValGlyArg-223

TABLE 1-continued

| | |
|---|---|
| SEQ. ID. NO. 33873 | 242-SerGlnPheAspArgIleAlaArgProGlyAlaGlyLysAsnPheGlyLysValValLeuArgGlyAsnVal-265 |
| SEQ. ID. NO. 33874 | 304-TrpProAsnLysIleLysHisHis-311 |

Antigenic Index - Jameson-Wolf

| | |
|---|---|
| SEQ. ID. NO. 33875 | 13-GlyLysAsnAlaLeu-17 |
| SEQ. ID. NO. 33876 | 43-AlaAspGlyAspIle-47 |
| SEQ. ID. NO. 33877 | 52-GluProPheGlyLys-56 |
| SEQ. ID. NO. 33878 | 81-ValAspGlyGluThrGlnVal-87 |
| SEQ. ID. NO. 33879 | 99-AlaGlyIleGlyLysAsnAlaVal-106 |
| SEQ. ID. NO. 33880 | 113-ValAlaAspAspLeuArgAlaGlyArgValProAsnGlyAsn-126 |
| SEQ. ID. NO. 33881 | 148-ArgIleGlyArgThrMet-153 |
| SEQ. ID. NO. 33882 | 169-GlnGlyAlaArgGlyGlyPhe-175 |
| SEQ. ID. NO. 33883 | 188-HisThrGlyThrGlyAsnGlyGlnValAlaGluArgTyrValArg-202 |
| SEQ. ID. NO. 33884 | 216-AspGlyCysGlyThrValGlyArgProPheAsnArgAsnArgPheValAsp-232 |
| SEQ. ID. NO. 33885 | 240-AlaGlySerGlnPheAspArgIleAlaArgProGlyAlaGlyLysAsnPheGly-257 |
| SEQ. ID. NO. 33886 | 260-ValLeuArgGlyAsnValAspAspGlyCysArgCysArgLeuLysAsnAlaAlaGlyGlyLysTyrGlnHis-283 |
| SEQ. ID. NO. 33887 | 285-LeuGlnProTyrThrGluArgGlyCys-293 |
| SEQ. ID. NO. 33888 | 304-TrpProAsnLysIleLysHisHisSerAsn-313 |
| SEQ. ID. NO. 33889 | 319-AlaLysProProGluThrValArg-326 |

Hydrophilic Regions - Hopp-Woods

| | |
|---|---|
| SEQ. ID. NO. 33890 | 43-AlaAspGlyAspIle-47 |
| SEQ. ID. NO. 33891 | 81-ValAspGlyGluThrGlnVal-87 |
| SEQ. ID. NO. 33892 | 113-ValAlaAspAspLeuArgAlaGlyArgValProAsn-124 |
| SEQ. ID. NO. 33893 | 148-ArgIleGlyArgThrMet-153 |
| SEQ. ID. NO. 33894 | 195-GlnValAlaGluArgTyrValArg-202 |
| SEQ. ID. NO. 33895 | 243-GlnPheAspArgIleAlaArgProGlyAlaGlyLysAsnPheGly-257 |
| SEQ. ID. NO. 33896 | 263-GlyAsnValAspAspGlyCysArgCysArgLeuLysAsnAlaAla-277 |
| SEQ. ID. NO. 33897 | 288-TyrThrGluArgGlyCys-293 |
| SEQ. ID. NO. 33898 | 320-LysProProGluThrValArg-326 | g639-1
AMPHI Regions - AMPHI

| | |
|---|---|
| SEQ. ID. NO. 33899 | 95-TyrLysAsnAsnArg-99 |
| SEQ. ID. NO. 33900 | 137-LeuLysValPheAspAsnIle-143 |
| SEQ. ID. NO. 33901 | 156-ValAsnTyrSerAspIleHisAspAsnIleIleAsnLysAla-169 |
| SEQ. ID. NO. 33902 | 268-AlaProValSerArg-272 |
| SEQ. ID. NO. 33903 | 289-GlnPheProAlaValLeuProGly-296 |

Antigenic Index - Jameson-Wolf

| | |
|---|---|
| SEQ. ID. NO. 33904 | 25-AsnIlePheAspAsnSerPhe-31 |
| SEQ. ID. NO. 33905 | 41-AlaMetValArgGluAsnLysIleValGly-50 |
| SEQ. ID. NO. 33906 | 52-AlaThrLeuArgValAsnGluArgGlyAsnGly-62 |
| SEQ. ID. NO. 33907 | 75-GlyAsnAspIleSerLysGlyArgAspGlyIlePheSerAsnThrSerThrHisAsnThrTyrLysAsnAsnArgPheSerAsp-102 |
| SEQ. ID. NO. 33908 | 111-TyrThrAsnAspSerGluValSerGly-119 |
| SEQ. ID. NO. 33909 | 135-GluArgLeuLysVal-139 |
| SEQ. ID. NO. 33910 | 145-ValGlySerArgAspGlyIle-151 |
| SEQ. ID. NO. 33911 | 159-SerAspIleHisAspAsnIleIleAsnLysAlaGlyLys-171 |
| SEQ. ID. NO. 33912 | 178-AlaAsnTyrAspLysLeuSerAlaAsnHis-187 |
| SEQ. ID. NO. 33913 | 202-GluGlyThrSerLeuHisAspAsnSer-210 |
| SEQ. ID. NO. 33914 | 212-IleAsnAsnGlySerGlnValLysTyrValSer-222 |
| SEQ. ID. NO. 33915 | 227-AspTrpSerGluGlyGlyGlyHisGlyAsnTyrTrpSerAspAsnSerProPhe-243 |
| SEQ. ID. NO. 33916 | 245-LeuAsnGlyAspGlyPheGlyAspSerAlaTyrArgProAspGlyIleIle-261 |
| SEQ. ID. NO. 33917 | 296-GlyGlyValValAspSerLysProLeuMetLysProTyrAlaProLysIleGlnThr-314 |
| SEQ. ID. NO. 33918 | 317-GlnAlaMetLysAspGluLeuLeuLysGluAlaGluThrArgGlnSerGluArgGlyArgAlaGluAsnGlySerLeuAsn-343 |

Hydrophilic Regions - Hopp-Woods

| | |
|---|---|
| SEQ. ID. NO. 33919 | 41-AlaMetValArgGluAsnLysIleValGly-50 |
| SEQ. ID. NO. 33920 | 52-AlaThrLeuArgValAsnGluArgGlyAsn-61 |
| SEQ. ID. NO. 33921 | 77-AspIleSerLysGlyArgAspGlyIle-85 |
| SEQ. ID. NO. 33922 | 95-TyrLysAsnAsnArgPheSerAsp-102 |
| SEQ. ID. NO. 33923 | 113-AsnAspSerGluValSerGly-119 |
| SEQ. ID. NO. 33924 | 135-GluArgLeuLysVal-139 |
| SEQ. ID. NO. 33925 | 146-GlySerArgAspGlyIle-151 |
| SEQ. ID. NO. 33926 | 179-AsnTyrAspLysLeuSer-184 |
| SEQ. ID. NO. 33927 | 253-SerAlaTyrArgProAspGlyIleIle-261 |
| SEQ. ID. NO. 33928 | 298-ValValAspSerLysProLeuMet-305 |
| SEQ. ID. NO. 33929 | 317-GlnAlaMetLysAspGluLeuLeuLysGluAlaGluThrArgGlnSerGluArgGlyArgAlaGluAsnGlySer-341 | g640
AMPHI Regions - AMPHI

| | |
|---|---|
| SEQ. ID. NO. 33930 | 6-SerIleLeuLysSerIleGly-12 |
| SEQ. ID. NO. 33931 | 22-SerIleArgArgMetSer-27 |
| SEQ. ID. NO. 33932 | 47-LeuProAlaTyrAlaGluArgLeuProAspPheLeuAlaLysIleGlnPro-63 |
| SEQ. ID. NO. 33933 | 72-ArgTyrGlyLysPro-76 |
| SEQ. ID. NO. 33934 | 109-SerLysProIleAspThrLeuMetAla-117 |
| SEQ. ID. NO. 33935 | 127-AlaLysLeuValAspHisHis-133 |
| SEQ. ID. NO. 33936 | 145-ArgValAspLysPheIleAsp-151 |
| SEQ. ID. NO. 33937 | 155-GlyLeuAsnPheIleLysAsnProProThr-164 |
| SEQ. ID. NO. 33938 | 187-IleGlnArgSerTyrLysValIle-194 |
| SEQ. ID. NO. 33939 | 209-AlaSerAlaSerAsp-213 |
| SEQ. ID. NO. 33940 | 224-ArgProArgArgMetAlaAsnProAsp-232 |
| SEQ. ID. NO. 33941 | 255-LeuAspGlnIleAsnLysLeuPheGluLysGly-265 |
| SEQ. ID. NO. 33942 | 267-LysAlaGlyValAlaAspHisAlaGluGlnGly-277 |
| SEQ. ID. NO. 33943 | 281-AspThrPheIleAspLeuTyrVal-288 |

TABLE 1-continued

| SEQ. ID. NO. 33944 | 346-MetIleGlnGlyGluAsnSerPhe-353 |
| SEQ. ID. NO. 33945 | 359-GlnHisGluArgValValGluLeuSerAlaAlaAspAlaProArg-373 |

Antigenic Index - Jameson-Wolf

| SEQ. ID. NO. 33946 | 24-ArgArgMetSerAlaPheArgAlaArgIle-33 |
| SEQ. ID. NO. 33947 | 50-TyrAlaGluArgLeuProAspPhe-57 |
| SEQ. ID. NO. 33948 | 59-AlaLysIleGlnProSerGluIlePheProGlyAlaAspArgTyrGlyLysProGluGlyLysProMetVal-82 |
| SEQ. ID. NO. 33949 | 84-ArgValTyrLysGlyAspGluGlnLeu-92 |
| SEQ. ID. NO. 33950 | 101-AlaValAsnThrArgGlyTyrSerSerLysProIleAsp-113 |
| SEQ. ID. NO. 33951 | 128-LysLeuValAspHisHisGlu-134 |
| SEQ. ID. NO. 33952 | 142-ProGlnSerArgValAspLysPheIleAsp-151 |
| SEQ. ID. NO. 33953 | 159-IleLysAsnProProThrProSerValAlaProGlyAsp-171 |
| SEQ. ID. NO. 33954 | 184-AsnAspSerIleGlnArgSerTyrLys-192 |
| SEQ. ID. NO. 33955 | 196-AsnGlnTyrArgLeuGlySerAspLysAlaLeuGln-207 |
| SEQ. ID. NO. 33956 | 209-AlaSerAlaSerAspValArgGluAlaAlaProAlaSerGluThrArgProArgArgMetAlaAsnProAspLysGlnAspIle-236 |
| SEQ. ID. NO. 33957 | 241-GluLeuLeuLysGlnLysAla-247 |
| SEQ. ID. NO. 33958 | 257-GlnIleAsnLysLeuPheGluLysGlyGlyLysAlaGlyVal-270 |
| SEQ. ID. NO. 33959 | 272-AspHisAlaGluGlnGlyAspProAspAspThrPheIle-284 |
| SEQ. ID. NO. 33960 | 294-ProSerIleGlyLysSerLeuLeuGlyGluAspGlyTrp-306 |
| SEQ. ID. NO. 33961 | 309-LeuGlnLysArgLeuLysProGlyGln-317 |
| SEQ. ID. NO. 33962 | 322-ValAlaGlyGluGlyArgTyrSerTrpLysGlySerGlyTyrValArg-337 |
| SEQ. ID. NO. 33963 | 342-AspArgIleGluMetIleGlnGlyGluAsnSerPheArgPheThrAspAlaGlnHisGluArgValValGlu-365 |
| SEQ. ID. NO. 33964 | 367-SerAlaAlaAspAlaProArgPheLysGlu-376 |
| SEQ. ID. NO. 33965 | 382-IleProGluGlyValAla-387 |
| SEQ. ID. NO. 33966 | 389-AspGlyAlaGluProTrpArg-395 |

Hydrophilic Regions - Hopp-Woods

| SEQ. ID. NO. 33967 | 24-ArgArgMetSerAlaPheArgAlaArgIle-33 |
| SEQ. ID. NO. 33968 | 50-TyrAlaGluArgLeuPro-55 |
| SEQ. ID. NO. 33969 | 68-ProGlyAlaAspArgTyrGlyLysProGluGlyLysProMetVal-82 |
| SEQ. ID. NO. 33970 | 85-ValTyrLysGlyAspGluGlnLeu-92 |
| SEQ. ID. NO. 33971 | 128-LysLeuValAspHisHisGlu-134 |
| SEQ. ID. NO. 33972 | 143-GlnSerArgValAspLysPheIleAsp-151 |
| SEQ. ID. NO. 33973 | 186-SerIleGlnArgSerTyrLys-192 |
| SEQ. ID. NO. 33974 | 200-LeuGlySerAspLysAlaLeuGln-207 |
| SEQ. ID. NO. 33975 | 210-SerAlaSerAspValArgGluAlaAlaProAlaSerGluThrArgProArgArgMetAlaAsnProAspLysGlnAsp-235 |
| SEQ. ID. NO. 33976 | 241-GluLeuLeuLysGlnLysAla-247 |
| SEQ. ID. NO. 33977 | 257-GlnIleAsnLysLeuPheGluLysGlyGlyLysAlaGlyVal-270 |
| SEQ. ID. NO. 33978 | 272-AspHisAlaGluGlnGlyAspProAspAspThrPhe-283 |
| SEQ. ID. NO. 33979 | 309-LeuGlnLysArgLeuLysProGlyGln-317 |
| SEQ. ID. NO. 33980 | 324-GlyGluGlyArgTyrSerTrp-330 |
| SEQ. ID. NO. 33981 | 342-AspArgIleGluMetIleGlnGly-349 |
| SEQ. ID. NO. 33982 | 351-AsnSerPheArgPheThrAspAlaGlnHisGluArgValValGlu-365 |
| SEQ. ID. NO. 33983 | 367-SerAlaAlaAspAlaProArgPheLysGlu-376 | g642
AMPHI Regions - AMPHI

| SEQ. ID. NO. 33984 | 22-LysSerAlaCysArg-26 |
| SEQ. ID. NO. 33985 | 28-IleCysProLeuSerAlaIleSerAlaVal-37 |
| SEQ. ID. NO. 33986 | 63-SerGlyAspAspPhe-67 |
| SEQ. ID. NO. 33987 | 139-IleLysHisIleValArgAlaPhe-146 |
| SEQ. ID. NO. 33988 | 157-AspIleAlaGlyTrpValSerAlaPheLysThrLeuArgAlaGlnGluPheLeuGlnHisLeuArgGlyGlyVal-181 |
| SEQ. ID. NO. 33989 | 184-PheArgGlyGluGly-188 |
| SEQ. ID. NO. 33990 | 190-AspAspValArgLeu-194 |
| SEQ. ID. NO. 33991 | 209-AlaAspValAlaValLysAspPheGlyAsnLeuMetAlaAlaLeuAsp-224 |
| SEQ. ID. NO. 33992 | 241-ValGlnValValLysAspValPheHisAsnAlaValArgHisAlaAspGlnLeuGln-259 |
| SEQ. ID. NO. 33993 | 293-ValAspGlyValThrAspGlyAla-300 |
| SEQ. ID. NO. 33994 | 319-GlnValAspAspPheGlyGluPheAlaValPhe-329 |
| SEQ. ID. NO. 33995 | 348-PheArgGlyValAspVal-353 |
| SEQ. ID. NO. 33996 | 403-GluLeuLeuGlnArg-407 |
| SEQ. ID. NO. 33997 | 410-HisGlnArgAlaPheAspAlaGlyThr-418 |

Antigenic Index - Jameson-Wolf

| SEQ. ID. NO. 33998 | 1-MetArgTyrProPro-5 |
| SEQ. ID. NO. 33999 | 16-CysLeuLeuArgArgProLysSerAlaCysArgArgIleCysPro-30 |
| SEQ. ID. NO. 34000 | 45-ValGlnGlnGluGlyCysGly-51 |
| SEQ. ID. NO. 34001 | 58-TyrGluAspLysLysSerGlyAspAspPheAlaAspGluAspPheLeu-73 |
| SEQ. ID. NO. 34002 | 75-GlyAlaGlyValGly-79 |
| SEQ. ID. NO. 34003 | 98-GlyAsnGlyGlyLysAlaAspIle-105 |
| SEQ. ID. NO. 34004 | 126-PheGlyGlyGlyAlaAspGluLeu-133 |
| SEQ. ID. NO. 34005 | 146-PheLysAsnArgGluGlyAlaAspIleAspGlyAspIle-158 |
| SEQ. ID. NO. 34006 | 166-LysThrLeuArgAla-170 |
| SEQ. ID. NO. 34007 | 184-PheArgGlyGluGlyPheAspAspValArgLeu-194 |
| SEQ. ID. NO. 34008 | 198-MetGlyAspGlyArgAspGlyArgAsnGlyMet-208 |
| SEQ. ID. NO. 34009 | 230-IleAspGluSerAspIleValAla-237 |
| SEQ. ID. NO. 34010 | 253-ArgHisAlaAspGlnLeuGlnAlaAlaAlaAspLysAspValLeuGluArgAlaGlnThrGlySerValAlaProGlyGlu-279 |
| SEQ. ID. NO. 34011 | 281-HisHisGlyGlyCysArg-286 |
| SEQ. ID. NO. 34012 | 288-PheGlyIleAspAlaValAspGlyValThrAspGly-299 |
| SEQ. ID. NO. 34013 | 313-CysPheGlyAspGluGlnGlnValAspAspPheGly-324 |
| SEQ. ID. NO. 34014 | 332-PheGlyGlyAsnGluGluGluValAla-340 |
| SEQ. ID. NO. 34015 | 369-CysAsnArgArgAlaGlyGlyPhe-376 |
| SEQ. ID. NO. 34016 | 412-ArgAlaPheAspAlaGlyThrGlnArgAsnGly-422 |
| SEQ. ID. NO. 34017 | 425-ValMetProArgAsnPro-430 |

TABLE 1-continued

Hydrophilic Regions - Hopp-Woods
SEQ. ID. NO. 34018  16-CysLeuLeuArgArgProLysSerAlaCysArgArgIleCys-29
SEQ. ID. NO. 34019  58-TyrGluAspLysLysSerGlyAspAspPheAlaAspGluAspPheLeu-73
SEQ. ID. NO. 34020  99-AsnGlyGlyLysAlaAspIle-105
SEQ. ID. NO. 34021  129-GlyAlaAspGluLeu-133
SEQ. ID. NO. 34022  146-PheLysAsnArgGluGlyAlaAspIleAspGlyAspIle-158
SEQ. ID. NO. 34023  166-LysThrLeuArgAla-170
SEQ. ID. NO. 34024  187-GluGlyPheAspAspValArgLeu-194
SEQ. ID. NO. 34025  199-GlyAspGlyArgAspGlyArgAsnGlyMet-208
SEQ. ID. NO. 34026  230-IleAspGluSerAspIleValAla-237
SEQ. ID. NO. 34027  253-ArgHisAlaAspGlnLeuGlnAlaAlaAlaAspLysAspValLeuGluArgAlaGlnThr-272
SEQ. ID. NO. 34028  292-AlaValAspGlyValThrAspGly-299
SEQ. ID. NO. 34029  313-CysPheGlyAspGluGlnValAspAspPheGly-324
SEQ. ID. NO. 34030  334-GlyAsnGluGluGluValAla-340
SEQ. ID. NO. 34031  369-CysAsnArgArgAlaGly-374
SEQ. ID. NO. 34032  417-GlyThrGlnArgAsnGly-422
g644
AMPHI Regions - AMPHI
SEQ. ID. NO. 34033  26-GlyArgArgPheAspArgPro-32
SEQ. ID. NO. 34034  55-MetAspThrAlaAlaPheLeuLysHisIleGluSerAlaPheProArgIlePheSerAspGlyIleAspLeuMetArgTyrLeu-82
SEQ. ID. NO. 34035  111-GlnPheGluIleGlnGluValLeuArgIleAlaGly-122
SEQ. ID. NO. 34036  141-GlnProLeuGlnGluPheGlyGly-148
SEQ. ID. NO. 34037  181-ArgGluMetGlnSerCysTyrGluTyr-189
SEQ. ID. NO. 34038  202-TyrTrpGlnGlyAsn-206
SEQ. ID. NO. 34039  224-LeuAlaLysValIleAspLeuLeu-231
SEQ. ID. NO. 34040  267-ValMetLysLeuSerArg-272
SEQ. ID. NO. 34041  278-LeuArgAlaPheGlnAsn-283
SEQ. ID. NO. 34042  295-MetThrHisGlyIleMetGluTyrIleLeuAspAsnLeuAsnArgTyrValArgAsn-313
SEQ. ID. NO. 34043  333-GluIleLeuTyrArgTyrValCysHis-341
SEQ. ID. NO. 34044  343-ValSerProValAlaProValAlaHis-351
SEQ. ID. NO. 34045  356-AlaAsnIleValLysThrLeuAla-363
SEQ. ID. NO. 34046  372-GlnMetLeuGlnLys-376
SEQ. ID. NO. 34047  399-PheThrIlePheGluGlyProAsn-406
SEQ. ID. NO. 34048  408-MetLeuTyrAlaGluIleTyrAspGlnPheValArgAla-420
SEQ. ID. NO. 34049  456-LeuProGluAspIleArgSerPhe-463
SEQ. ID. NO. 34050  481-GlyLysIleIleAlaArgLeu-487
Antigenic Index - Jameson-Wolf
SEQ. ID. NO. 34051  1-MetProSerGluArgProAlaAspCysCys-10
SEQ. ID. NO. 34052  22-ThrLeuAsnCysGlyArgArgPheAspArgProProIleAsnGlyAsnArgGlnArgLysProMetIleHisThrGluProSerAlaGlnProSerThrMetAsp-56
SEQ. ID. NO. 34053  70-ArgIlePheSerAspGlyIleAspLeu-78
SEQ. ID. NO. 34054  82-LeuProGluAspLysTrpLeu-88
SEQ. ID. NO. 34055  100-LeuAspLysLysHisGlyGlyArgLysGlySerGln-111
SEQ. ID. NO. 34056  160-PheLysGlyGluSerArgArgLeuGlyValThrGluProGluThrSerGly-176
SEQ. ID. NO. 34057  178-AlaIleAlaArgGluMetGlnSerCysTyrGluTyrThrAspGluGlnThr-194
SEQ. ID. NO. 34058  202-TyrTrpGlnGlyAsnSerGlnSerAspPhe-211
SEQ. ID. NO. 34059  216-AlaLysGluArgLysAsnGlyLysLeuAlaLys-226
SEQ. ID. NO. 34060  235-LysThrTyrIleArg-239
SEQ. ID. NO. 34061  241-GluThrLeuAlaSerGluGlyLeuArg-249
SEQ. ID. NO. 34062  254-AlaValAsnArgIleAspAlaGluMet-262
SEQ. ID. NO. 34063  269-LysLeuSerArgGlyAspAlaAlaGly-277
SEQ. ID. NO. 34064  306-AsnLeuAsnArgTyrValArgAsnAspIleArgPheValAspTyrGluArgArgGluIleGlnArgArgHisGlnVal-331
SEQ. ID. NO. 34065  381-LysGlyPheGluArgGlyHisProAlaGly-390
SEQ. ID. NO. 34066  403-GluGlyProAsnAspMetLeu-409
SEQ. ID. NO. 34067  420-AlaThrAlaGluGluLysGluAlaGlyIleLysLeuAspLysAsnGlnThr-436
SEQ. ID. NO. 34068  441-ValGlnThrAspValArg-446
SEQ. ID. NO. 34069  449-AlaValAlaArgAspTyrAlaLeu-456
SEQ. ID. NO. 34070  458-GluAspIleArgSerPheLeu-464
SEQ. ID. NO. 34071  492-GlnGluGluHisGluAspThrThr-499
SEQ. ID. NO. 34072  505-AspIleArgLysAspIleLeuAspCysArgTyrCysGly-517
Hydrophilic Regions - Hopp-Woods
SEQ. ID. NO. 34073  1-MetProSerGluArgProAlaAsp-8
SEQ. ID. NO. 34074  25-CysGlyArgArgPheAspArgProProIleAsnGlyAsnArgGlnArgLysProMetIle-44
SEQ. ID. NO. 34075  72-PheSerAspGlyIleAsp-77
SEQ. ID. NO. 34076  82-LeuProGluAspLysTrpLeu-88
SEQ. ID. NO. 34077  100-LeuAspLysLysHisGlyGlyArgLysGlySerGln-111
SEQ. ID. NO. 34078  160-PheLysGlyGluSerArgArgLeuGlyValThrGluProGluThrSerGly-176
SEQ. ID. NO. 34079  178-AlaIleAlaArgGluMetGlnSer-185
SEQ. ID. NO. 34080  188-GluTyrThrAspGluGlnThr-194
SEQ. ID. NO. 34081  216-AlaLysGluArgLysAsnGlyLysLeuAlaLys-226
SEQ. ID. NO. 34082  254-AlaValAsnArgIleAspAlaGluMet-262
SEQ. ID. NO. 34083  269-LysLeuSerArgGlyAspAlaAlaGly-277
SEQ. ID. NO. 34084  306-AsnLeuAsnArgTyrValArgAsnAspIleArgPheValAspTyrGluArgArgGluIleGlnArgArgHisGlnVal-331
SEQ. ID. NO. 34085  381-LysGlyPheGluArgGlyHisPro-388
SEQ. ID. NO. 34086  420-AlaThrAlaGluGluLysGluAlaGlyIleLysLeuAspLysAsnGlnThr-436
SEQ. ID. NO. 34087  441-ValGlnThrAspValArg-446
SEQ. ID. NO. 34088  458-GluAspIleArgSerPheLeu-464
SEQ. ID. NO. 34089  492-GlnGluGluHisGluAspThrThr-499
SEQ. ID. NO. 34090  505-AspIleArgLysAspIleLeuAsp-512
g645

TABLE 1-continued

AMPHI Regions - AMPHI
SEQ. ID. NO. 34091   87-ArgThrLeuProSerLeuAsnGlyLeuThrLys-97
SEQ. ID. NO. 34092   149-ArgThrProLysArgCysSerSerSerIle-158
SEQ. ID. NO. 34093   162-ProLysPheLeuAsnPheMetSerSerCysThrAsnLeuCys-175
SEQ. ID. NO. 34094   211-SerAlaLysArgSer-215
SEQ. ID. NO. 34095   250-SerValLeuProLysProThrSerProHisThrSerArg-262
Antigenic Index - Jameson-Wolf
SEQ. ID. NO. 34096   24-AsnLeuCysCysLysLysSerArgMetThrCysSerSerSerArgSerArgSerCysProCys-44
SEQ. ID. NO. 34097   47-ProIleArgAlaSerGlySerArgValSerSerArgSerArgIle-61
SEQ. ID. NO. 34098   68-SerLeuCysArgLysAsnThrCysProProArgLeuSerSerArgAsnThrAlaSerArgThrLeuProSer-91
SEQ. ID. NO. 34099   99-PheThrAlaArgArgArgLeuGly-106
SEQ. ID. NO. 34100   110-IleSerGluLysSerArgArgProSerSerAlaMetLeuArg-123
SEQ. ID. NO. 34101   137-ThrLeuAlaArgArgArgLeuSerCysSerPheCysArgThrProLysArgCysSerSer-156
SEQ. ID. NO. 34102   158-IleIleAsnLysProLysPheLeuAsn-166
SEQ. ID. NO. 34103   168-MetSerSerCysThrAsn-173
SEQ. ID. NO. 34104   199-LeuLysArgGluArgLeuAla-205
SEQ. ID. NO. 34105   208-ThrGlyLysSerAlaLysArgSerAlaLys-217
SEQ. ID. NO. 34106   222-CysSerThrArgSerValValGlyAla-230
SEQ. ID. NO. 34107   243-AsnAlaAlaArgArgAlaThr-249
SEQ. ID. NO. 34108   251-ValLeuProLysProThrSerProHisThrSerArg-262
Hydrophilic Regions - Hopp-Woods
SEQ. ID. NO. 34109   26-CysCysLysLysSerArgMetThrCysSerSerSerArgSerArgSerCysPro-43
SEQ. ID. NO. 34110   48-IleArgAlaSerGlySerArgValSerSerArgSerArgIle-61
SEQ. ID. NO. 34111   69-LeuCysArgLysAsnThrCysProProArgLeuSerSerArgAsnThrAlaSerArgThr-88
SEQ. ID. NO. 34112   99-PheThrAlaArgArgArgLeuGly-106
SEQ. ID. NO. 34113   110-IleSerGluLysSerArgArgProSer-118
SEQ. ID. NO. 34114   137-ThrLeuAlaArgArgArgLeuSer-144
SEQ. ID. NO. 34115   149-ArgThrProLysArgCysSer-155
SEQ. ID. NO. 34116   158-IleIleAsnLysProLys-163
SEQ. ID. NO. 34117   199-LeuLysArgGluArgLeuAla-205
SEQ. ID. NO. 34118   210-LysSerAlaLysArgSerAlaLys-217
SEQ. ID. NO. 34119   243-AsnAlaAlaArgArgAlaThr-249
g647
AMPHI Regions - AMPHI
SEQ. ID. NO. 34120   38-GlyLysValCysArgCysPheGluGlnVal-47
SEQ. ID. NO. 34121   69-ThrValPheArgGlnIleValGlyValVal-78
Antigenic Index - Jameson-Wolf
SEQ. ID. NO. 34122   26-GlyLeuValLysGluArgAlaArg-33
SEQ. ID. NO. 34123   39-LysValCysArgCysPhe-44
SEQ. ID. NO. 34124   54-GlyThrValGlyGlnThrGluArgGlyThr-63
SEQ. ID. NO. 34125   78-ValAspAspThrAspAlaGluArgThrAlaValHisSerArgGlyThrArgGlyPhe-96
Hydrophilic Regions - Hopp-Woods
SEQ. ID. NO. 34126   26-GlyLeuValLysGluArgAlaArg-33
SEQ. ID. NO. 34127   40-ValCysArgCysPhe-44
SEQ. ID. NO. 34128   56-ValGlyGlnThrGluArgGlyThr-63
SEQ. ID. NO. 34129   78-ValAspAspThrAspAlaGluArgThrAlaValHisSerArgGlyThrArgGly-95
g648
AMPHI Regions - AMPHI
SEQ. ID. NO. 34130   7-ArgIleGluArgAlaValArg-13
SEQ. ID. NO. 34131   15-AlaValIleAspValLeuAsn-21
SEQ. ID. NO. 34132   94-AlaValAspLeuHisAlaIleIleLysLeuAlaAspThr-106
SEQ. ID. NO. 34133   127-GlnGlyValGluGlnGly-132
SEQ. ID. NO. 34134   148-ArgLeuLysHisLeuLysGluGlyAsnAla-157
SEQ. ID. NO. 34135   182-AlaArgAlaLeuGlyAsnValPheHis-190
SEQ. ID. NO. 34136   194-GlySerGlyIleAspGlyIleGlnThrIleValAlaPheAsnGlnHisThr-210
Antigenic Index - Jameson-Wolf
SEQ. ID. NO. 34137   1-MetAsnArgArgAsnAlaArgIleGluArgAlaValArg-13
SEQ. ID. NO. 34138   24-AlaProGlyProGly-28
SEQ. ID. NO. 34139   30-LeuLeuHisGlnArgGlyLysGlnValGlySerArgAsnAspThrLeuAla-46
SEQ. ID. NO. 34140   65-GlyLysLysArgPheValGlnProArgAsnLeuValGlyArgLysGlnArgAsn-82
SEQ. ID. NO. 34141   123-PheAsnMetProGlnGlyValGluGlnGlyCysArg-134
SEQ. ID. NO. 34142   141-LeuArgThrArgPheAspArgArgLeuLysHisLeuLysGluGlyAsnAla-157
SEQ. ID. NO. 34143   170-ValGlnProAlaAspThrSerGlyIleAspAlaAspAlaArgAla-184
SEQ. ID. NO. 34144   191-AsnAlaAlaGlySerGlyIleAspGly-199
Hydrophilic Regions - Hopp-Woods
SEQ. ID. NO. 34145   1-MetAsnArgArgAsnAlaArgIleGluArgAlaValArg-13
SEQ. ID. NO. 34146   33-GlnArgGlyLysGlnValGlySerArgAsnAspThr-44
SEQ. ID. NO. 34147   65-GlyLysLysArgPheValGln-71
SEQ. ID. NO. 34148   74-AsnLeuValGlyArgLysGlnArgAsn-82
SEQ. ID. NO. 34149   127-GlnGlyValGluGlnGlyCysArg-134
SEQ. ID. NO. 34150   141-LeuArgThrArgPheAspArgArgLeuLysHisLeuLysGluGlyAsnAla-157
SEQ. ID. NO. 34151   172-ProAlaAspThrSerGlyIleAspAlaAspAlaArgAla-184
g649
AMPHI Regions - AMPHI
SEQ. ID. NO. 34152   6-LeuSerAlaIleLeuGlyLeuVal-13
SEQ. ID. NO. 34153   24-ProAlaHisArgHisThrLysHisIleSerLysAla-35
SEQ. ID. NO. 34154   57-SerGlnGlyAsnVal-61
SEQ. ID. NO. 34155   63-GluLeuArgGluAsnLys-68
SEQ. ID. NO. 34156   71-ArgLysAlaPheArgThrLeuPro-78

TABLE 1-continued

Antigenic Index - Jameson-Wolf
SEQ. ID. NO. 34157    20-GlyThrSerGluProAlaHisArgHisThrLysHisIleSerLysAlaAsnLys-37
SEQ. ID. NO. 34158    40-LeuHisProGluCysArgLysTyrLeuGluArgArgAlaAla-53
SEQ. ID. NO. 34159    56-ArgSerGlnGlyAsnValGlnGluLeuArgGluAsnLysLysAlaArgLysAlaPheArg-75
SEQ. ID. NO. 34160    80-AlaGluGlnLysIleGlnCys-86
SEQ. ID. NO. 34161    92-AlaPheAspAspPheAspGlyGlyArgPheArgArg-103
Hydrophilic Regions - Hopp-Woods
SEQ. ID. NO. 34162    20-GlyThrSerGluProAlaHisArgHisThrLysHisIleSerLysAlaAsnLys-37
SEQ. ID. NO. 34163    42-ProGluCysArgLysTyrLeuGluArgArgAlaAla-53
SEQ. ID. NO. 34164    59-GlyAsnValGlnGluLeuArgGluAsnLysLysAlaArgLysAlaPheArg-75
SEQ. ID. NO. 34165    80-AlaGluGlnLysIleGlnCys-86
SEQ. ID. NO. 34166    92-AlaPheAspAspPheAspGlyGlyArgPheArgArg-103
g650
AMPHI Regions - AMPHI
SEQ. ID. NO. 34167    15-SerValCysProGly-19
SEQ. ID. NO. 34168    57-LeuTrpAspGluLeuArgGlnGly-64
SEQ. ID. NO. 34169    72-ProGluLeuValArgArgHisGlu-79
SEQ. ID. NO. 34170    89-PheAspArgValValAsn-94
SEQ. ID. NO. 34171    137-SerGlyLeuTrpGln-141
SEQ. ID. NO. 34172    173-AsnTyrLeuGlnTyrLeuTyrGlyLeuPheGlyAspTrpPro-186
SEQ. ID. NO. 34173    198-AsnValGlyArgAlaValAsnArgAlaArg-207
SEQ. ID. NO. 34174    218-LeuArgMetProAsnGluThr-224
SEQ. ID. NO. 34175    260-ValGluProGlyArgProLeu-266
SEQ. ID. NO. 34176    269-GluAlaIleAlaArgLeuAlaGlyIleThrGlnSer-280
SEQ. ID. NO. 34177    314-SerAsnTyrLeuAsnAlaAlaProAsp-322
SEQ. ID. NO. 34178    341-IleSerThrAlaThrGlyMet-347
SEQ. ID. NO. 34179    349-IleAlaAspIleLysArgLeuAsnAsnLeu-358
SEQ. ID. NO. 34180    433-ValArgThrGlyThrArgSer-439
Antigenic Index - Jameson-Wolf
SEQ. ID. NO. 34181    1-MetSerLysLeuLys-5
SEQ. ID. NO. 34182    24-GlnAsnThrSerSerHis-29
SEQ. ID. NO. 34183    38-LeuAsnSerSerIleLeuAspLeuProProThrLysGlnTyrPhe-52
SEQ. ID. NO. 34184    54-SerGlySerLeuTrpAspGluLeuArgGlnGlyPheArgMetGlyGluValAsnProGluLeuValArgArgHisGluSerLysPheIleAla-84
SEQ. ID. NO. 34185    87-SerTyrPheAspArgValValAsnArgSerArgPro-98
SEQ. ID. NO. 34186    105-AsnGluValLysLysArgAsnMetProAla-114
SEQ. ID. NO. 34187    128-ThrLysAlaLysSerHisValGlyAlaSerGly-138
SEQ. ID. NO. 34188    145-AlaThrGlyArgHisTyrGlyLeuGluLysThrProValTyrAspGlyArgHisAspVal-164
SEQ. ID. NO. 34189    192-TyrAsnTrpGlyGluGlyAsnValGlyArgAlaValAsnArgAlaArgAspGlnGlyLeuGluProThrTyrGluAsnLeuArgMetProAsnGlu
                      ThrArgAsnTyrVal-228
SEQ. ID. NO. 34190    247-AsnIleSerAspIleAspAsnLysProTyr-256
SEQ. ID. NO. 34191    259-AlaValGluProGlyArgProLeuAspAsnGluAlaIleAla-272
SEQ. ID. NO. 34192    294-PheIleProLysAsnLysArgLysLeu-302
SEQ. ID. NO. 34193    318-AsnAlaAlaProAspSer-323
SEQ. ID. NO. 34194    332-ProAlaAlaLysThrSerLeuSerAspIleSerThr-343
SEQ. ID. NO. 34195    350-AlaAspIleLysArgLeuAsnAsnLeuAsnGly-360
SEQ. ID. NO. 34196    370-LeuValAlaLysAsnGlyLysThrLeu-378
SEQ. ID. NO. 34197    388-IleAspIleAspAsnThrProAspThrTyrArgSerAsnMetProAla-403
SEQ. ID. NO. 34198    431-GluThrValArgThrGlyThrArgSerProCysProHisTyrArgThrArgProCysAspSerArgSerAlaThrSerAsnArgLysThrAsp
                      CysHisAla-464
Hydrophilic Regions - Hopp-Woods
SEQ. ID. NO. 34199    1-MetSerLysLeuLys-5
SEQ. ID. NO. 34200    59-AspGluLeuArgGlnGlyPheArgMetGlyGluValAsnProGluLeuValArgArgHisGluSerLysPheIleAla-84
SEQ. ID. NO. 34201    92-ValValAsnArgSerArgPro-98
SEQ. ID. NO. 34202    105-AsnGluValLysLysArgAsnMetProAla-114
SEQ. ID. NO. 34203    128-ThrLysAlaLysSerHisVal-134
SEQ. ID. NO. 34204    150-TyrGlyLeuGluLysThrProValTyrAspGlyArgHisAspVal-164
SEQ. ID. NO. 34205    202-AlaValAsnArgAlaArgAspGlnGlyLeu-211
SEQ. ID. NO. 34206    213-ProThrTyrGluAsnLeuArgMetProAsnGluThrArgAsnTyrVal-228
SEQ. ID. NO. 34207    249-SerAspIleAspAsn-253
SEQ. ID. NO. 34208    261-GluProGlyArgProLeuAspAsnGluAlaIleAla-272
SEQ. ID. NO. 34209    296-ProLysAsnLysArgLysLeu-302
SEQ. ID. NO. 34210    334-AlaLysThrSerLeu-338
SEQ. ID. NO. 34211    350-AlaAspIleLysArgLeuAsn-356
SEQ. ID. NO. 34212    373-LysAsnGlyLysThr-377
SEQ. ID. NO. 34213    389-AspIleAspAsnThrProAspThrTyrArg-398
SEQ. ID. NO. 34214    431-GluThrValArgThrGlyThrArgSerPro-440
SEQ. ID. NO. 34215    444-TyrArgThrArgProCysAspSerArgSerAlaThrSerAsnArgLysThrAspCys-462
g652-1
AMPHI Regions - AMPHI
SEQ. ID. NO. 34216    6-AspIlePheAlaArg-10
SEQ. ID. NO. 34217    52-ArgAspGlyAspLys-56
SEQ. ID. NO. 34218    62-LysGlyValLeuLysAlaValGluHisValAsnAsnGlnIleAlaGlnAla-78
SEQ. ID. NO. 34219    130-LeuTyrArgTyrLeuGlyGlyAlaGlyPro-139
SEQ. ID. NO. 34220    149-ValIleAsnGlyGly-153
SEQ. ID. NO. 34221    173-LysSerPheArgGluAlaLeuArgCys-181
SEQ. ID. NO. 34222    184-GluIlePheHisAlaLeuLysLys-191
SEQ. ID. NO. 34223    266-AlaGluPheAlaGluTyrLeuGluGlyLeuValAsn-277
SEQ. ID. NO. 34224    299-LeuThrGluLysLeu-303
SEQ. ID. NO. 34225    323-AlaGluGlyIleGluLysGlyVal-330
SEQ. ID. NO. 34226    338-ValAsnGlnIleGlyThrLeuSerGluThrLeuLysAlaValAspLeuAlaLysCysAsnArgTyrAlaSer-361

TABLE 1-continued

| | |
|---|---|
| SEQ. ID. NO. 34227 | 377-AspLeuAlaValAla-381 |
| SEQ. ID. NO. 34228 | 391-SerLeuSerArgSerAspArgMetAlaLysTyrAsnGlnLeuLeuArgIleGluGlu-409 |

Antigenic Index - Jameson-Wolf

| | |
|---|---|
| SEQ. ID. NO. 34229 | 11-GluIleLeuAspSerArgGlyAsnProThrValGlu-22 |
| SEQ. ID. NO. 34230 | 36-AlaValProSerGlyAlaSerThrGlyGlnLysGluAlaLeuGluLeuArgAspGlyAspLysSerArgTyrSerGlyLysGlyValLeuLysAlaVal GluHisValAsn-72 |
| SEQ. ID. NO. 34231 | 83-AspAlaAsnGluGlnSerTyr-89 |
| SEQ. ID. NO. 34232 | 97-LeuAspGlyThrGluAsnLysGlyAsnLeuGly-107 |
| SEQ. ID. NO. 34233 | 121-AlaAlaAlaGluAspSerGlyLeuPro-129 |
| SEQ. ID. NO. 34234 | 135-GlyGlyAlaGlyProMet-140 |
| SEQ. ID. NO. 34235 | 151-AsnGlyGlyGluHisAlaAsnAsnSer-159 |
| SEQ. ID. NO. 34236 | 173-LysSerPheArgGluAlaLeuArgCysGlyAla-183 |
| SEQ. ID. NO. 34237 | 190-LysLysLeuCysAspSerLysGlyPheProThrThrValGlyAspGluGlyGlyPhe-208 |
| SEQ. ID. NO. 34238 | 211-AsnLeuAsnSerHisLysGluAlaLeu-219 |
| SEQ. ID. NO. 34239 | 243-CysAlaSerSerGluPheTyrLysAspGlyLysTyrHisLeuGluAlaGluGlyArgSerTyrThrAsn-265 |
| SEQ. ID. NO. 34240 | 283-SerIleGluAspGlyMetAspGluAsnAspTrpGluGly-295 |
| SEQ. ID. NO. 34241 | 299-LeuThrGluLysLeuGlyLysLysValGlnLeuValGlyAspAspLeu-314 |
| SEQ. ID. NO. 34242 | 318-AsnProLysIleLeuAlaGluGlyIleGluLysGlyVal-330 |
| SEQ. ID. NO. 34243 | 352-AspLeuAlaLysCysAsnArgTyr-359 |
| SEQ. ID. NO. 34244 | 363-MetSerHisArgSerGlyGluThrGluAspSerThrIle-375 |
| SEQ. ID. NO. 34245 | 388-LysThrGlySerLeuSerArgSerAspArgMetAlaLys-400 |
| SEQ. ID. NO. 34246 | 405-LeuArgIleGluGluGluLeuAlaGlu-413 |

Hydrophilic Regions - Hopp-Woods

| | |
|---|---|
| SEQ. ID. NO. 34247 | 11-GluIleLeuAspSerArgGlyAsnProThrValGlu-22 |
| SEQ. ID. NO. 34248 | 43-ThrGlyGlnLysGluAlaLeuGluLeuArgAspGlyAspLysSerArgTyrSerGly-61 |
| SEQ. ID. NO. 34249 | 63-GlyValLeuLysAlaValGlu-69 |
| SEQ. ID. NO. 34250 | 97-LeuAspGlyThrGluAsnLysGlyAsnLeu-106 |
| SEQ. ID. NO. 34251 | 121-AlaAlaAlaGluAspSerGly-127 |
| SEQ. ID. NO. 34252 | 153-GlyGluHisAlaAsn-157 |
| SEQ. ID. NO. 34253 | 173-LysSerPheArgGluAlaLeuArgCysGlyAla-183 |
| SEQ. ID. NO. 34254 | 190-LysLysLeuCysAspSerLysGly-197 |
| SEQ. ID. NO. 34255 | 202-ValGlyAspGluGlyGlyPhe-208 |
| SEQ. ID. NO. 34256 | 213-AsnSerHisLysGluAlaLeu-219 |
| SEQ. ID. NO. 34257 | 247-GluPheTyrLysAspGlyLysTyrHisLeuGluAlaGluGlyArgSerTyrThr-264 |
| SEQ. ID. NO. 34258 | 283-SerIleGluAspGlyMetAspGluAsnAspTrpGluGly-295 |
| SEQ. ID. NO. 34259 | 299-LeuThrGluLysLeuGlyLysLysValGlnLeuValGly-311 |
| SEQ. ID. NO. 34260 | 321-IleLeuAlaGluGlyIleGluLysGlyVal-330 |
| SEQ. ID. NO. 34261 | 352-AspLeuAlaLysCysAsnArg-358 |
| SEQ. ID. NO. 34262 | 364-SerHisArgSerGlyGluThrGluAspSerThrIle-375 |
| SEQ. ID. NO. 34263 | 391-SerLeuSerArgSerAspArgMetAlaLys-400 |
| SEQ. ID. NO. 34264 | 405-LeuArgIleGluGluGluLeuAlaGlu-413 | g653
AMPHI Regions - AMPHI

| | |
|---|---|
| SEQ. ID. NO. 34265 | 60-ThrMetArgLysProArgLeuThr-67 |
| SEQ. ID. NO. 34266 | 75-AlaLeuIlePheThrCysPheAla-82 |
| SEQ. ID. NO. 34267 | 96-ThrAlaLeuAlaAlaIleThrCysIle-104 |
| SEQ. ID. NO. 34268 | 111-LeuGlyLysMetGluGluPheSer-118 |

Antigenic Index - Jameson-Wolf

| | |
|---|---|
| SEQ. ID. NO. 34269 | 4-GluProMetArgMetProGlu-10 |
| SEQ. ID. NO. 34270 | 14-GlyPheSerGlySer-18 |
| SEQ. ID. NO. 34271 | 45-GlyCysArgSerThrArgLysThr-52 |
| SEQ. ID. NO. 34272 | 56-ValArgProGluThrMetArgLysProArgLeuThrAsnSerSerAla-71 |
| SEQ. ID. NO. 34273 | 86-AsnSerGlyCysAsnAla-91 |
| SEQ. ID. NO. 34274 | 103-CysIleAsnGlyProProCysArgLeuGlyLysMetGluGlu-116 |
| SEQ. ID. NO. 34275 | 125-SerArgHisLysIleThrProProArgGlyProArgArgVal-138 |
| SEQ. ID. NO. 34276 | 145-ThrLysSerGlnAsnGlyThrGly-152 |
| SEQ. ID. NO. 34277 | 156-SerProProAlaThrSerProAla-163 |

Hydrophilic Regions - Hopp-Woods

| | |
|---|---|
| SEQ. ID. NO. 34278 | 4-GluProMetArgMetProGlu-10 |
| SEQ. ID. NO. 34279 | 47-ArgSerThrArgLysThr-52 |
| SEQ. ID. NO. 34280 | 57-ArgProGluThrMetArgLysProArgLeuThrAsn-68 |
| SEQ. ID. NO. 34281 | 107-ProProCysArgLeuGlyLysMetGluGlu-116 |
| SEQ. ID. NO. 34282 | 126-ArgHisLysIleThrProProArgGlyProArg-136 | g656
AMPHI Regions - AMPHI

| | |
|---|---|
| SEQ. ID. NO. 34283 | 6-GlySerIleSerSerMetIleSerIleAlaArgThrPheGlyAlaProGlu-22 |
| SEQ. ID. NO. 34284 | 42-LysGlnProSerThr-46 |
| SEQ. ID. NO. 34285 | 92-LeuAlaSerLeuAsnLysSerCys-99 |

Antigenic Index - Jameson-Wolf

| | |
|---|---|
| SEQ. ID. NO. 34286 | 4-PheSerGlySerIle-8 |
| SEQ. ID. NO. 34287 | 19-GlyAlaProGluSerValProAlaGlyLysValAlaAla-31 |
| SEQ. ID. NO. 34288 | 40-SerPheLysGlnProSerThrLeuGlu-48 |
| SEQ. ID. NO. 34289 | 74-ArgProThrSerLeuArgProLysSerIle-83 |
| SEQ. ID. NO. 34290 | 94-SerLeuAsnLysSerCysSerLeuAlaArgSerSerAlaGlyValLeuProArgArgArgValProAla-116 |
| SEQ. ID. NO. 34291 | 120-ThrMetThrSerSerArgSerArgArgThrArgIleSerGlyGluGluProThrMetTrpLysSerProLysSer-144 |

Hydrophilic Regions - Hopp-Woods

| | |
|---|---|
| SEQ. ID. NO. 34292 | 76-ThrSerLeuArgProLysSer-82 |
| SEQ. ID. NO. 34293 | 99-CysSerLeuAlaArgSerSer-105 |
| SEQ. ID. NO. 34294 | 109-LeuProArgArgArgValProAla-116 |
| SEQ. ID. NO. 34295 | 121-MetThrSerSerArgSerArgArgThrArgIleSerGlyGluGluProThrMet-138 |

TABLE 1-continued

| | |
|---|---|
| SEQ. ID. NO. 34296 | 140-LysSerProLysSer-144 |
| g657 | |
| AMPHI Regions - AMPHI | |
| SEQ. ID. NO. 34297 | 20-LeuGlyArgMetPheAla-25 |
| SEQ. ID. NO. 34298 | 65-AspGluLeuAlaLysCysAlaAla-72 |
| SEQ. ID. NO. 34299 | 83-AspAlaMetArgSerLeuAlaLysHisThrAsn-93 |
| SEQ. ID. NO. 34300 | 128-CysLysAlaGluAspIleThrGluAlaSer-137 |
| SEQ. ID. NO. 34301 | 139-GlnPheLeuProGlyIleLeuLysThr-147 |
| SEQ. ID. NO. 34302 | 161-LysThrLeuAspGluLeuLysAlaAla-169 |
| SEQ. ID. NO. 34303 | 178-CysValLeuGluLysMetValAsp-185 |
| SEQ. ID. NO. 34304 | 205-PheAspProAlaGluAsnIle-211 |
| SEQ. ID. NO. 34305 | 232-GlnGlnAlaArgGlnThrAlaGlnArgLeuAlaAspGluLeuAspTyrValGlyValLeu-251 |
| Antigenic Index - Jameson-Wolf | |
| SEQ. ID. NO. 34306 | 37-ValLeuAspProAspProAsnAlaPro-45 |
| SEQ. ID. NO. 34307 | 57-ProPheAspAspArgAlaAlaLeuAspGluLeuAlaLys-69 |
| SEQ. ID. NO. 34308 | 75-ThrGluPheGluAsnValAsnAlaAspAlaMetArgSerLeuAlaLysHisThrAsnValSerProSerGlyAspCysVal-101 |
| SEQ. ID. NO. 34309 | 104-AlaGlnAsnArgIleGlnGluLysAlaTrpIle-114 |
| SEQ. ID. NO. 34310 | 128-CysLysAlaGluAspIleThrGluAla-136 |
| SEQ. ID. NO. 34311 | 150-LeuGlyTyrAspGlyLysGlyGlnIleArgValLysThrLeuAspGluLeuLysAlaAlaPhe-170 |
| SEQ. ID. NO. 34312 | 182-LysMetValAspLeuArgGlyGluIle-190 |
| SEQ. ID. NO. 34313 | 196-ArgLeuAsnAspGluAsnValGln-203 |
| SEQ. ID. NO. 34314 | 205-PheAspProAlaGluAsnIleHisGluAsnGly-215 |
| SEQ. ID. NO. 34315 | 230-ValGlnGlnGlnAlaArgGlnThrAlaGlnArgLeuAlaAspGluLeuAsp-246 |
| SEQ. ID. NO. 34316 | 268-GluThrAlaProArgThrHisAsnSerGlyHisHis-279 |
| SEQ. ID. NO. 34317 | 288-GlnPheGlnGlnGln-292 |
| SEQ. ID. NO. 34318 | 300-ProProAlaAspThrLysLeuLeuSer-308 |
| SEQ. ID. NO. 34319 | 319-ValTrpGlnGluAspGlyGlyGluProAspTrp-329 |
| SEQ. ID. NO. 34320 | 332-LeuGlnSerArgProAsnAla-338 |
| SEQ. ID. NO. 34321 | 344-GlyLysLysThrAlaGlnLysGlyArgLysMetGly-355 |
| SEQ. ID. NO. 34322 | 361-ThrThrAspSerAspThrAlaPheGlnGluAlaLysLysLeuHis-375 |
| Hydrophilic Regions - Hopp-Woods | |
| SEQ. ID. NO. 34323 | 37-ValLeuAspProAspProAsnAlaPro-45 |
| SEQ. ID. NO. 34324 | 57-ProPheAspAspArgAlaAlaLeuAspGluLeuAlaLys-69 |
| SEQ. ID. NO. 34325 | 75-ThrGluPheGluAsnValAsn-81 |
| SEQ. ID. NO. 34326 | 83-AspAlaMetArgSerLeuAlaLys-90 |
| SEQ. ID. NO. 34327 | 128-CysLysAlaGluAspIleThrGluAla-136 |
| SEQ. ID. NO. 34328 | 152-TyrAspGlyLysGlyGlnIleArgValLysThrLeuAspGluLeuLysAlaAlaPhe-170 |
| SEQ. ID. NO. 34329 | 182-LysMetValAspLeuArgGlyGluIle-190 |
| SEQ. ID. NO. 34330 | 196-ArgLeuAsnAspGluAsnValGln-203 |
| SEQ. ID. NO. 34331 | 206-AspProAlaGluAsnIleHis-212 |
| SEQ. ID. NO. 34332 | 230-ValGlnGlnGlnAlaArgGlnThrAlaGlnArgLeuAlaAspGluLeuAsp-246 |
| SEQ. ID. NO. 34333 | 269-ThrAlaProArgThrHisAsn-275 |
| SEQ. ID. NO. 34334 | 301-ProAlaAspThrLysLeu-306 |
| SEQ. ID. NO. 34335 | 320-TrpGlnGluAspGlyGlyGluProAsp-328 |
| SEQ. ID. NO. 34336 | 344-GlyLysLysThrAlaGlnLysGlyArgLysMetGly-355 |
| SEQ. ID. NO. 34337 | 362-ThrAspSerAspThrAlaPheGlnGluAlaLysLysLeuHis-375 |
| g658 | |
| AMPHI Regions - AMPHI | |
| SEQ. ID. NO. 34338 | 28-ArgGlnTyrAlaAspIleIleGlnPheValArgGlnAlaLeuArgArgLeuProArgLeuLeuLeu-49 |
| SEQ. ID. NO. 34339 | 68-ValAspValPheGlyGlyValGluGly-76 |
| SEQ. ID. NO. 34340 | 93-AlaGlnValHisHisPhePheGlnAsnAlaIleHisAla-105 |
| SEQ. ID. NO. 34341 | 139-GlnLysLeuArgAlaCysPheSerAsnValPheGly-150 |
| SEQ. ID. NO. 34342 | 155-LeuIleArgArgGlyLeuGln-161 |
| Antigenic Index - Jameson-Wolf | |
| SEQ. ID. NO. 34343 | 6-ValArgAlaArgGlyGlyPheIleAsp-14 |
| SEQ. ID. NO. 34344 | 21-AlaAspAsnLysHisPhe-26 |
| SEQ. ID. NO. 34345 | 40-AlaLeuArgArgLeuPro-45 |
| SEQ. ID. NO. 34346 | 53-ThrGlnProArgGlyAspAspGlyIleSerGlnAspAlaVal-66 |
| SEQ. ID. NO. 34347 | 86-TyrAspHisGlyAsn-90 |
| SEQ. ID. NO. 34348 | 107-ValPheGlyLysArgGlyPheGluPhe-115 |
| SEQ. ID. NO. 34349 | 130-GlnArgSerArgPheGlnAspAlaGlyGlnLysLeuArgAla-143 |
| SEQ. ID. NO. 34350 | 154-ArgLeuIleArgArgGlyLeuGln-161 |
| SEQ. ID. NO. 34351 | 193-ArgAlaHisArgValGly-198 |
| SEQ. ID. NO. 34352 | 202-PheLysPheGlyArgAsnArgArgAla-210 |
| SEQ. ID. NO. 34353 | 216-GlnArgGlyProValValLysArgArgAlaGln-226 |
| SEQ. ID. NO. 34354 | 230-GlyLysPheArgArgArgArgIleArgValGlyIleGluAsnGly-244 |
| SEQ. ID. NO. 34355 | 251-PheSerGlyAsnGlyLysHisSerAla-259 |
| Hydrophilic Regions - Hopp-Woods | |
| SEQ. ID. NO. 34356 | 6-ValArgAlaArgGlyGlyPheIle-13 |
| SEQ. ID. NO. 34357 | 21-AlaAspAsnLysHisPhe-26 |
| SEQ. ID. NO. 34358 | 40-AlaLeuArgArgLeuPro-45 |
| SEQ. ID. NO. 34359 | 53-ThrGlnProArgGlyAspAspGlyIleSer-62 |
| SEQ. ID. NO. 34360 | 130-GlnArgSerArgPheGlnAspAlaGlyGlnLysLeuArgAla-143 |
| SEQ. ID. NO. 34361 | 154-ArgLeuIleArgArgGlyLeu-160 |
| SEQ. ID. NO. 34362 | 193-ArgAlaHisArgValGly-198 |
| SEQ. ID. NO. 34363 | 205-GlyArgAsnArgArgAla-210 |
| SEQ. ID. NO. 34364 | 210-ProValValLysArgArgAlaGln-226 |
| SEQ. ID. NO. 34365 | 230-GlyLysPheArgArgArgArgIleArgValGlyIle-241 |
| SEQ. ID. NO. 34366 | 253-GlyAsnGlyLysHisSerAla-259 |
| g661 | |

TABLE 1-continued

AMPHI Regions - AMPHI
SEQ. ID. NO. 34367    19-GlyIleAlaAspLysProPheArgArgLeuCysArgAlaPheGlyAla-34
SEQ. ID. NO. 34368    48-LeuArgAsnThrGlyLysThrLeu-55
SEQ. ID. NO. 34369    76-ProGluGlnMetAlaAsp-81
SEQ. ID. NO. 34370    122-AlaAlaIleLeuGluAlaValValLys-130
SEQ. ID. NO. 34371    152-ProAlaValAlaLysIleAlaGlu-159
SEQ. ID. NO. 34372    222-HisAspArgAlaArg-226
SEQ. ID. NO. 34373    237-PheGluAlaLeuCysArg-242
SEQ. ID. NO. 34374    246-PheThrAlaCysLeuGluPhe-252
Antigenic Index - Jameson-Wolf
SEQ. ID. NO. 34375    20-IleAlaAspLysProPheArgArgLeuCysArg-30
SEQ. ID. NO. 34376    45-AspProThrLeuArgAsnThrGlyLysThrLeuHisArgSerAspPheAlaAspGluGlyGly-65
SEQ. ID. NO. 34377    72-AlaGlySerAspProGluGlnMetAlaAspAlaAlaArg-84
SEQ. ID. NO. 34378    97-AsnMetGlyCysProAlaLysLysValCys-106
SEQ. ID. NO. 34379    115-MetGlnAspGluProLeu-120
SEQ. ID. NO. 34380    143-GlyTrpHisAspAspAspGlnAsnLeu-151
SEQ. ID. NO. 34381    156-LysIleAlaGluAspCysGly-162
SEQ. ID. NO. 34382    169-ProArgAlaArgAla-173
SEQ. ID. NO. 34383    175-AlaAsnValGlnArgArgGlyAlaLeuArgThrHisArgArgAspGlnLysProSerGluHisProGlyLeuGlyGlnArgArgHisHisPheAla
                      AlaLysSerArgArgArgProGlnThrAsnArgArgArgArgHisHisAspArgAlaArgArgAlaArgGln-230
SEQ. ID. NO. 34384    241-CysArgThrArgArgPhe-246
SEQ. ID. NO. 34385    253-GlyArgMetGlnSerArgHisPheGluProHisProArgHisAlaArg-268
SEQ. ID. NO. 34386    271-TrpXxxAspArgArgCysAlaHisArgThrGlnThrHisArgLeuValHisArgArgAsnAlaArgArgArgThrGlyAlaAla-298
Hydrophilic Regions - Hopp-Woods
SEQ. ID. NO. 34387    20-IleAlaAspLysProPheArgArgLeuCysArg-30
SEQ. ID. NO. 34388    46-ProThrLeuArgAsnThrGlyLysThrLeuHisArgSerAspPheAlaAspGluGlyGly-65
SEQ. ID. NO. 34389    73-GlySerAspProGluGlnMetAlaAspAlaAlaArg-84
SEQ. ID. NO. 34390    100-CysProAlaLysLysValCys-106
SEQ. ID. NO. 34391    115-MetGlnAspGluProLeu-120
SEQ. ID. NO. 34392    144-TrpHisAspAspAspGlnAsn-150
SEQ. ID. NO. 34393    156-LysIleAlaGluAspCysGly-162
SEQ. ID. NO. 34394    169-ProArgAlaArgAla-173
SEQ. ID. NO. 34395    175-AlaAsnValGlnArgArgGlyAlaLeuArgThrHisArgArgAspGlnLysProSerGluHisProGlyLeuGlyGlnArgArgHisHisPhe-205
SEQ. ID. NO. 34396    207-AlaLysSerArgArgArgProGlnThrAsnArgArgArgArgHisHisAspArgAlaArgArgAlaArgGln-230
SEQ. ID. NO. 34397    241-CysArgThrArgArgPhe-246
SEQ. ID. NO. 34398    253-GlyArgMetGlnSerArgHisPheGluProHisProArgHisAla-267
SEQ. ID. NO. 34399    271-TrpXxxAspArgArgCysAlaHisArgThrGlnThr-282
SEQ. ID. NO. 34400    285-LeuValHisArgArgAsnAlaArgArgArgThrGlyAla-297
g663
AMPHI Regions - AMPHI
SEQ. ID. NO. 34401    19-ProPheAlaLeuLeuHisLysIleAlaGlyLeuIleGlySerLeuAlaTyr-35
SEQ. ID. NO. 34402    66-LysGlnHisPheLysHisMetAlaLysLeu-75
SEQ. ID. NO. 34403    86-SerAlaLysCysLeuLysSerLeuValArg-95
SEQ. ID. NO. 34404    168-GluGlyLeuArgAlaLeuValLysGlnPheArgLys-179
SEQ. ID. NO. 34405    209-ThrIleThrGlyLeuSerArgIleAlaAlaLeuAlaAsn-221
SEQ. ID. NO. 34406    243-ProAlaTrpLysSer-247
SEQ. ID. NO. 34407    258-GlnArgMetAsnArgPheIleGluGluArgValArgGluHis-271
Antigenic Index - Jameson-Wolf
SEQ. ID. NO. 34408    38-ValLysProArgArgArgIleGlyGlu-46
SEQ. ID. NO. 34409    54-ProGluTrpAspGluGluLysArgLysThrValLeu-65
SEQ. ID. NO. 34410    87-AlaLysCysLeuLysSer-92
SEQ. ID. NO. 34411    94-ValArgTyrArgAsnLysHisTyrLeuAsp-103
SEQ. ID. NO. 34412    105-AlaLeuAlaAlaGlyGluLys-111
SEQ. ID. NO. 34413    139-TyrSerHisGlnLysAsnLysIleLeuAsp-148
SEQ. ID. NO. 34414    150-GlnIleLeuLysGlyArgAsnArgTyr-158
SEQ. ID. NO. 34415    166-ArgThrGluGlyLeuArgAlaLeu-173
SEQ. ID. NO. 34416    175-LysGlnPheArgLysSerSerAla-182
SEQ. ID. NO. 34417    188-ProAspGlnAspPheGlyArgAsnAsnSer-197
SEQ. ID. NO. 34418    229-ProValArgGluAlaAspAsnThrVal-237
SEQ. ID. NO. 34419    243-ProAlaTrpLysSerPheProSerGluAspAlaGlnAlaAspAlaGlnArgMetAsnArgPheIleGluGluArgValArgGluHisProGlu-273
SEQ. ID. NO. 34420    280-LysArgPheLysThrArgProGluGlySerProAspPheTyr-293
Hydrophilic Regions - Hopp-Woods
SEQ. ID. NO. 34421    39-LysProArgArgArgIleGlyGlu-46
SEQ. ID. NO. 34422    54-ProGluTrpAspGluGluLysArgLysThrValLeu-65
SEQ. ID. NO. 34423    88-LysCysLeuLysSer-92
SEQ. ID. NO. 34424    94-ValArgTyrArgAsn-98
SEQ. ID. NO. 34425    105-AlaLeuAlaAlaGlyGluLys-111
SEQ. ID. NO. 34426    142-GlnLysAsnLysIleLeuAsp-148
SEQ. ID. NO. 34427    150-GlnIleLeuLysGlyArgAsnArgTyr-158
SEQ. ID. NO. 34428    166-ArgThrGluGlyLeuArgAlaLeu-173
SEQ. ID. NO. 34429    176-GlnPheArgLysSerSer-181
SEQ. ID. NO. 34430    190-GlnAspPheGlyArg-194
SEQ. ID. NO. 34431    229-ProValArgGluAlaAspAsn-235
SEQ. ID. NO. 34432    248-PheProSerGluAspAlaGlnAlaAspAlaGlnArgMetAsnArgPheIleGluGluArgValArgGluHisProGlu-273
SEQ. ID. NO. 34433    280-LysArgPheLysThrArgProGluGlySerPro-290
g664

TABLE 1-continued

AMPHI Regions - AMPHI
SEQ. ID. NO. 34434  28-AlaHisArgMetGly-32
SEQ. ID. NO. 34435  47-AlaAspValLeuAspAlaAlaHisGlyAlaAlaGly-58
SEQ. ID. NO. 34436  90-ProValValGluIle-94
SEQ. ID. NO. 34437  158-LeuHisArgValPheSerThrIleProArg-167
Antigenic Index - Jameson-Wolf
SEQ. ID. NO. 34438  26-AspGlyAlaHisArgMetGlyGlyArgAla-35
SEQ. ID. NO. 34439  73-PheLeuGlnArgLysLeuGluPro-80
SEQ. ID. NO. 34440  113-AlaValGlyGluAspGluLeuGlyVal-121
SEQ. ID. NO. 34441  138-TyrGlyAspAspHisGluAsn-144
SEQ. ID. NO. 34442  163-SerThrIleProArgGlnSerArgProTrp-172
SEQ. ID. NO. 34443  175-ProLeuArgTrpCysLysThrArgPhe-183
Hydrophilic Regions - Hopp-Woods
SEQ. ID. NO. 34444  27-GlyAlaHisArgMetGlyGly-33
SEQ. ID. NO. 34445  74-LeuGlnArgLysLeuGluPro-80
SEQ. ID. NO. 34446  113-AlaValGlyGluAspGluLeuGlyVal-121
SEQ. ID. NO. 34447  138-TyrGlyAspAspHisGluAsn-144
SEQ. ID. NO. 34448  166-ProArgGlnSerArg-170
g665-1
AMPHI Regions - AMPHI
SEQ. ID. NO. 34449  6-ArgTyrLeuLysAspTyrGln-12
SEQ. ID. NO. 34450  115-GlnCysGluProGluGlyPheArgLysIleThr-125
SEQ. ID. NO. 34451  132-AspValMetSerLysPheThrThrThr-140
SEQ. ID. NO. 34452  167-ArgHisTrpValLysTrpGluAspProPhe-176
SEQ. ID. NO. 34453  225-SerLeuLysAsnAlaMetLys-231
SEQ. ID. NO. 34454  286-GlyIleGluSerValVal-291
SEQ. ID. NO. 34455  294-GluTyrPheHisAsnTrpThr-300
SEQ. ID. NO. 34456  307-ArgAspTrpPheGlnLeuSerLeu-314
SEQ. ID. NO. 34457  329-AspArgAlaGlyArgAlaValArgArgIleGluAsnIleArgLeuLeuArgGln-346
SEQ. ID. NO. 34458  358-HisProValArgProValSerTyrGluGluMetAsnAsnPheTyrThr-373
SEQ. ID. NO. 34459  380-GlyAlaGluValValArgMetTyrHisThrLeu-390
SEQ. ID. NO. 34460  396-PheGlnLysGlyMetLys-401
SEQ. ID. NO. 34461  517-GluGlyValThrGluAlaValValProSerLeuLeuArgGlyPheSerAlaProVal-535
SEQ. ID. NO. 34462  559-CysTrpGluAlaAla-563
SEQ. ID. NO. 34463  575-LeuAlaAlaLeuSerAspGlyIle-582
SEQ. ID. NO. 34464  589-LysLeuLeuAlaAlaValGlu-595
SEQ. ID. NO. 34465  603-LeuAspAsnAlaPheLysAlaLeu-610
SEQ. ID. NO. 34466  622-AspGlyThrGluAsnIleAspProLeu-630
SEQ. ID. NO. 34467  642-ThrLeuAlaValArg-646
SEQ. ID. NO. 34468  648-LeuProLysTrpHisGluLeuAspArg-656
SEQ. ID. NO. 34469  674-AspTrpArgThrLeuArgAsnValCysArgAla-684
SEQ. ID. NO. 34470  696-ThrValAlaGluLysTyrGlyGluMetAlaGlnAsnMet-708
SEQ. ID. NO. 34471  712-TrpGlyIleLeuSer-716
SEQ. ID. NO. 34472  730-LeuAlaGlnPheAlaAspLysPheSer-738
SEQ. ID. NO. 34473  758-AspThrLeuGlnGlnValGlnThrAla-766
SEQ. ID. NO. 34474  782-SerLeuIleGlySerPheSerArgAsnVal-791
SEQ. ID. NO. 34475  822-ArgLeuValGlnAlaPheAsnLeuCysAsnLysLeu-833
Antigenic Index - Jameson-Wolf
SEQ. ID. NO. 34476  1-MetSerLysThrValArgTyrLeuLysAspTyrGlnThrProAla-15
SEQ. ID. NO. 34477  32-ThrValValLysSerArgLeuThrValGluProGlnArgAlaGlyGlu-47
SEQ. ID. NO. 34478  49-LeuValLeuAspGlySerAla-55
SEQ. ID. NO. 34479  79-AlaAspValProSerGluArgPheThrVal-88
SEQ. ID. NO. 34480  90-ValGluThrGluIleLeuProAlaGluAsnLysSerLeu-102
SEQ. ID. NO. 34481  115-GlnCysGluProGluGlyPheArgLys-123
SEQ. ID. NO. 34482  128-IleAspArgProAspValMetSer-135
SEQ. ID. NO. 34483  142-ValAlaAspLysLysArgTyrPro-149
SEQ. ID. NO. 34484  153-SerAsnGlyAsnLysIleAspGlyGlyGluPheSerAspGlyArgHisTrpValLysTrpGluAspProPheAlaLysProSer-180
SEQ. ID. NO. 34485  191-AlaValThrGluAspArgPheThrThrMetSerGlyArgAsnValLysIle-207
SEQ. ID. NO. 34486  211-ThrThrGluAlaAspLysProLysVal-219
SEQ. ID. NO. 34487  230-MetLysTrpAspGluThrArgPhe-237
SEQ. ID. NO. 34488  255-AsnMetGlyAlaMetGluAsnLysGlyLeu-264
SEQ. ID. NO. 34489  275-AspSerArgThrAlaThrAspThrAspPheGluGlyIleGlu-288
SEQ. ID. NO. 34490  295-TyrPheHisAsnTrpThrGlyAsnArgValThrCysArgAspTrp-309
SEQ. ID. NO. 34491  313-SerLeuLysGluGly-317
SEQ. ID. NO. 34492  322-ArgAspGlnGluPheSerGlyAspArgAlaGlyArgAlaValArgArgIleGluAsn-340
SEQ. ID. NO. 34493  342-ArgLeuLeuArgGlnAsnGlnPheProGluAspAlaGlyProThrAlaisProValArgProValSerTyrGluGluMetAsn-369
SEQ. ID. NO. 34494  376-ValTyrGluLysGlyAlaGluVal-383
SEQ. ID. NO. 34495  394-GluGlyPheGlnLysGlyMet-400
SEQ. ID. NO. 34496  404-PheGlnArgHisAspGlyGlnAlaValThrCysAspAspPheArgAlaAlaMet-421
SEQ. ID. NO. 34497  437-SerGlnAlaGlyThrPro-442
SEQ. ID. NO. 34498  444-LeuGluAlaGluGlyArgLeuLysAsnAsnVal-454
SEQ. ID. NO. 34499  459-IleLysGlnThrValProProThrProAspMetAlaAspLysGlnPro-474
SEQ. ID. NO. 34500  483-LeuLeuAsnArgAsnGlyGluAlaVal-491
SEQ. ID. NO. 34501  494-AspTyrGlnGlyLysArgAlaThrGlu-502
SEQ. ID. NO. 34502  508-ThrGluAlaGluGln-512
SEQ. ID. NO. 34503  538-AsnTyrProTyrSerAspAspAspLeu-546
SEQ. ID. NO. 34504  552-HisAspSerAspAla-556
SEQ. ID. NO. 34505  578-LeuSerAspGlyIleGlyLeuProLysHisGluLysLeu-590
SEQ. ID. NO. 34506  594-ValGluLysValIleSerAspAspLeuLeu-603
SEQ. ID. NO. 34507  614-ValProSerGluAlaGluLeuTrpAspGlyThrGluAsnIleAspProLeuArg-631

TABLE 1-continued

| SEQ. ID. NO. 34508 | 633-HisGlnAlaArgGluAlaLeu-639 |
| --- | --- |
| SEQ. ID. NO. 34509 | 652-HisGluLeuAspArgGlnAlaAlaLysGlnGluAsnGlnSerTyrGluTyrSerProGluThrAlaAsp-674 |
| SEQ. ID. NO. 34510 | 676-ArgThrLeuArgAsnValCys-682 |
| SEQ. ID. NO. 34511 | 689-AlaAspProAlaHis-693 |
| SEQ. ID. NO. 34512 | 696-ThrValAlaGluLysTyrGlyGlu-703 |
| SEQ. ID. NO. 34513 | 718-ValAsnGlyAsnGluSerAspThrArgAsnCys-728 |
| SEQ. ID. NO. 34514 | 733-PheAlaAspLysPheSerAspAspAlaLeuVal-743 |
| SEQ. ID. NO. 34515 | 752-GlySerSerArgArgSerAspThrLeuGln-761 |
| SEQ. ID. NO. 34516 | 768-GlnHisProLysPheSerLeuGluAsnProAsnLysAlaArgSer-782 |
| SEQ. ID. NO. 34517 | 785-GlySerPheSerArgAsnValPro-792 |
| SEQ. ID. NO. 34518 | 796-AlaGlnAspGlySerGlyTyrArgPheIleAla-806 |
| SEQ. ID. NO. 34519 | 808-LysValIleGluIleAspArgPheAsnProGlnVal-819 |
| SEQ. ID. NO. 34520 | 831-AsnLysLeuGluProHisArgLysAsnLeuValLysGlnGluLeuGlnCys-847 |
| SEQ. ID. NO. 34521 | 849-ArgAlaGlnGluGlyLeuSerLysAspValGlyGluIleVal-862 |
| Hydrophilic Regions - Hopp-Woods | |
| SEQ. ID. NO. 34522 | 1-MetSerLysThrValArgTyrLeuLys-9 |
| SEQ. ID. NO. 34523 | 32-ThrValValLysSerArgLeuThrValGluProGlnArgAlaGlyGlu-47 |
| SEQ. ID. NO. 34524 | 81-ValProSerGluArgPheThrVal-88 |
| SEQ. ID. NO. 34525 | 90-ValGluThrGluIleLeuProAlaGluAsnLysSer-101 |
| SEQ. ID. NO. 34526 | 116-CysGluProGluGlyPheArg-122 |
| SEQ. ID. NO. 34527 | 129-AspArgProAspValMetSer-135 |
| SEQ. ID. NO. 34528 | 142-ValAlaAspLysLysArgTyr-148 |
| SEQ. ID. NO. 34529 | 154-AsnGlyAsnLysIleAspGlyGlyGluPheSerAsp-165 |
| SEQ. ID. NO. 34530 | 170-ValLysTrpGluAspProPheAla-177 |
| SEQ. ID. NO. 34531 | 191-AlaValThrGluAspArgPheThr-198 |
| SEQ. ID. NO. 34532 | 201-SerGlyArgAsnValLys-206 |
| SEQ. ID. NO. 34533 | 213-GluAlaAspLysProLysVal-219 |
| SEQ. ID. NO. 34534 | 230-MetLysTrpAspGluThrArgPhe-237 |
| SEQ. ID. NO. 34535 | 258-AlaMetGluAsnLysGly-263 |
| SEQ. ID. NO. 34536 | 275-AspSerArgThrAlaThrAspThrAspPheGluGlyIleGlu-288 |
| SEQ. ID. NO. 34537 | 313-SerLeuLysGluGly-317 |
| SEQ. ID. NO. 34538 | 322-ArgAspGlnGluPheSerGlyAspArgAlaGlyArgAlaValArgArgIleGluAsn-340 |
| SEQ. ID. NO. 34539 | 348-GlnPheProGluAspAlaGlyPro-355 |
| SEQ. ID. NO. 34540 | 363-ValSerTyrGluGluMetAsn-369 |
| SEQ. ID. NO. 34541 | 376-ValTyrGluLysGlyAlaGluVal-383 |
| SEQ. ID. NO. 34542 | 394-GluGlyPheGlnLysGlyMet-400 |
| SEQ. ID. NO. 34543 | 406-ArgHisAspGlyGln-410 |
| SEQ. ID. NO. 34544 | 413-ThrCysAspAspPheArgAlaAlaMet-421 |
| SEQ. ID. NO. 34545 | 444-LeuGluAlaGluGlyArgLeuLysAsnAsnVal-454 |
| SEQ. ID. NO. 34546 | 467-ProAspMetAlaAspLysGlnPro-474 |
| SEQ. ID. NO. 34547 | 495-TyrGlnGlyLysArgAlaThrGlu-502 |
| SEQ. ID. NO. 34548 | 508-ThrGluAlaGluGln-512 |
| SEQ. ID. NO. 34549 | 541-TyrSerAspAspAspLeu-546 |
| SEQ. ID. NO. 34550 | 552-HisAspSerAspAla-556 |
| SEQ. ID. NO. 34551 | 585-ProLysHisGluLysLeu-590 |
| SEQ. ID. NO. 34552 | 594-ValGluLysValIleSer-599 |
| SEQ. ID. NO. 34553 | 616-SerGluAlaGluLeu-620 |
| SEQ. ID. NO. 34554 | 622-AspGlyThrGluAsnIleAspPro-629 |
| SEQ. ID. NO. 34555 | 633-HisGlnAlaArgGluAlaLeu-639 |
| SEQ. ID. NO. 34556 | 652-HisGluLeuAspArgGlnAlaAlaLysGlnGluAsnGlnSer-665 |
| SEQ. ID. NO. 34557 | 668-TyrSerProGluThrAlaAsp-674 |
| SEQ. ID. NO. 34558 | 689-AlaAspProAlaHis-693 |
| SEQ. ID. NO. 34559 | 696-ThrValAlaGluLysTyrGlyGlu-703 |
| SEQ. ID. NO. 34560 | 719-AsnGlyAsnGluSerAspThrArgAsn-727 |
| SEQ. ID. NO. 34561 | 733-PheAlaAspLysPheSerAspAspAlaLeuVal-743 |
| SEQ. ID. NO. 34562 | 753-SerSerArgArgSerAspThrLeu-760 |
| SEQ. ID. NO. 34563 | 776-AsnProAsnLysAlaArgSer-782 |
| SEQ. ID. NO. 34564 | 797-GlnAspGlySerGly-801 |
| SEQ. ID. NO. 34565 | 808-LysValIleGluIleAspArgPheAsn-816 |
| SEQ. ID. NO. 34566 | 831-AsnLysLeuGluProHisArgLysAsnLeuValLysGlnGluLeuGlnCys-847 |
| SEQ. ID. NO. 34567 | 849-ArgAlaGlnGluGlyLeuSerLysAspValGlyGluIleVal-862 |
| g666 | |
| AMPHI Regions - AMPHI | |
| SEQ. ID. NO. 34568 | 24-AlaLeuIleMetSerMetVal-30 |
| SEQ. ID. NO. 34569 | 57-HisThrProGluHisValThrGly-64 |
| SEQ. ID. NO. 34570 | 89-GlyTyrAspIleLeuLysGlnGlyGlySer-98 |
| SEQ. ID. NO. 34571 | 162-LeuLysPheMetGluAlaValVal-169 |
| Antigenic Index - Jameson-Wolf | |
| SEQ. ID. NO. 34572 | 6-TyrGlnSerAsnSerGlyGluGlyValLeu-15 |
| SEQ. ID. NO. 34573 | 40-AsnGlnGlyLysValAsnThr-46 |
| SEQ. ID. NO. 34574 | 55-AspAlaHisThrProGluHis-61 |
| SEQ. ID. NO. 34575 | 63-ThrGlyLeuThrGluGlnLysGln-70 |
| SEQ. ID. NO. 34576 | 80-SerAlaAsnProLeuAla-85 |
| SEQ. ID. NO. 34577 | 92-IleLeuLysGlnGlyGlySerAlaAla-100 |
| SEQ. ID. NO. 34578 | 114-GluProGlnSerSerGlyLeuGlyGly-122 |
| SEQ. ID. NO. 34579 | 130-AspAsnThrAlaLysThr-135 |
| SEQ. ID. NO. 34580 | 137-ThrThrPheAspGlyArgGluThrAlaPro-146 |
| SEQ. ID. NO. 34581 | 154-PheLeuAspLysAspGlyXxxProLeuLys-163 |

TABLE 1-continued

Hydrophilic Regions - Hopp-Woods
SEQ. ID. NO. 34582 40-AsnGlnGlyLysValAsnThr-46
SEQ. ID. NO. 34583 66-ThrGluGlnLysGln-70
SEQ. ID. NO. 34584 96-GlyGlySerAlaAla-100
SEQ. ID. NO. 34585 139-PheAspGlyArgGluThrAlaPro-146
SEQ. ID. NO. 34586 154-PheLeuAspLysAspGlyXxxPro-161
g667
AMPHI Regions - AMPHI
SEQ. ID. NO. 34587 46-PheAlaIleIleAlaAsp-51
SEQ. ID. NO. 34588 56-AlaArgValGluArgPheProHisPheAlaAla-66
SEQ. ID. NO. 34589 71-LeuAlaArgLysAlaAlaGlnPhe-78
SEQ. ID. NO. 34590 115-IleAlaAlaValAlaGluIle-121
SEQ. ID. NO. 34591 153-AlaAspGlnLeuArgArgMetPhePheAsnGlnPheGluLysLeuGlyAsnHisAsp-171
SEQ. ID. NO. 34592 202-GluValValLeuHisLysIleAlaAlaGlyLeu-212
Antigenic Index - Jameson-Wolf
SEQ. ID. NO. 34593 7-LeuGlyGlyGluIleValSerAspProCysAspPhe-18
SEQ. ID. NO. 34594 25-ValGluSerAlaAlaAspGlnThrGluThrGln-35
SEQ. ID. NO. 34595 56-AlaArgValGluArg-60
SEQ. ID. NO. 34596 71-LeuAlaArgLysAlaAlaGln-77
SEQ. ID. NO. 34597 84-ArgHisIleArgProArgLeuValLysArgGluGlnIle-96
SEQ. ID. NO. 34598 152-ProAlaAspGlnLeuArg-157
SEQ. ID. NO. 34599 165-GluLysLeuGlyAsnHisAspPhe-172
SEQ. ID. NO. 34600 192-HisThrAlaGlyAsnArgHisAsnLeu-200
SEQ. ID. NO. 34601 225-ValIleArgGlnGlyArgArgGlnValIleGlnArgThrAspThrLeu-240
SEQ. ID. NO. 34602 248-IleGluSerGlnAsnArgIleHisGlySerThrLeuHisSerLysThrAspLeu-265
Hydrophilic Regions - Hopp-Woods
SEQ. ID. NO. 34603 11-IleValSerAspProCysAsp-17
SEQ. ID. NO. 34604 25-ValGluSerAlaAlaAspGlnThrGluThrGln-35
SEQ. ID. NO. 34605 56-AlaArgValGluArg-60
SEQ. ID. NO. 34606 71-LeuAlaArgLysAlaAlaGln-77
SEQ. ID. NO. 34607 84-ArgHisIleArgProArgLeuValLysArgGluGlnIle-96
SEQ. ID. NO. 34608 165-GluLysLeuGlyAsn-169
SEQ. ID. NO. 34609 227-ArgGlnGlyArgArgGlnValIleGlnArgThrAspThr-239
SEQ. ID. NO. 34610 250-SerGlnAsnArgIleHis-255
SEQ. ID. NO. 34611 259-LeuHisSerLysThrAspLeu-265
g669
AMPHI Regions - AMPHI
SEQ. ID. NO. 34612 24-LysLeuHisArgAlaPhe-29
SEQ. ID. NO. 34613 59-GlnIlePheArgHisValGlnSer-66
SEQ. ID. NO. 34614 79-LysProProAsnThrAla-84
Antigenic Index - Jameson-Wolf
SEQ. ID. NO. 34615 1-MetArgArgIleValLysLysHisGlnProValAsnAla-13
SEQ. ID. NO. 34616 33-GlyArgLysArgProHisHisHisAspArgSerLeuArgArgGlnHisGlyIleGluGlyMetGlyPhe-55
SEQ. ID. NO. 34617 64-ValGlnSerSerAsnArgGlnSerGlyArgGlnProValCysThrLysProProAsnThrAlaSer-85
SEQ. ID. NO. 34618 100-AlaAspIleLysArgIleLeu-106
Hydrophilic Regions - Hopp-Woods
SEQ. ID. NO. 34619 1-MetArgArgIleValLysLysHisGlnPro-10
SEQ. ID. NO. 34620 33-GlyArgLysArgProHisHisHisAspArgSerLeuArgArgGlnHisGly-49
SEQ. ID. NO. 34621 65-GlnSerSerAsnArgGlnSerGlyArgGlnProValCysThrLysProProAsn-82
SEQ. ID. NO. 34622 100-AlaAspIleLysArgIleLeu-106
g670
AMPHI Regions - AMPHI
SEQ. ID. NO. 34623 10-ArgSerCysPheGly-14
SEQ. ID. NO. 34624 16-ValLysAsnAlaSerGlyValSer-23
SEQ. ID. NO. 34625 34-IleThrArgSerAla-38
SEQ. ID. NO. 34626 126-PheSerAlaCysSerAlaPheCysProLeu-135
Antigenic Index - Jameson-Wolf
SEQ. ID. NO. 34627 4-CysArgAsnCysLeuAlaArgSerCys-12
SEQ. ID. NO. 34628 18-AsnAlaSerGlyValSerSerArgIleCysProLeuSer-31
SEQ. ID. NO. 34629 33-LysIleThrArgSerAlaThrSerArgAlaAsnProIle-45
SEQ. ID. NO. 34630 65-AsnThrSerProThrIleSerGlySerSerAlaGluValGlySerSerAsnSerIleThrArgGlySerIleAlaSerProArgAlaIleAla-95
SEQ. ID. NO. 34631 100-TrpProProGluSerTrpGluGlyLysAla-109
SEQ. ID. NO. 34632 114-AlaSerProThrArgSerLysSerSer-122
SEQ. ID. NO. 34633 128-AlaCysSerAlaPhe-132
SEQ. ID. NO. 34634 146-AsnThrValArgCysGly-151
Hydrophilic Regions - Hopp-Woods
SEQ. ID. NO. 34635 33-LysIleThrArgSerAlaThrSerArgAlaAsn-43
SEQ. ID. NO. 34636 73-SerSerAlaGluValGlySer-79
SEQ. ID. NO. 34637 116-ProThrArgSerLysSer-121
g671
AMPHI Regions - AMPHI
SEQ. ID. NO. 34638 11-PheAsnAlaProAsn-15
SEQ. ID. NO. 34639 72-LysGlyAlaAlaLys-76
SEQ. ID. NO. 34640 119-ArgLeuPheIleArgTyr-124
Antigenic Index - Jameson-Wolf
SEQ. ID. NO. 34641 9-ThrProPheAsnAlaProAsnThrProProLysMetArgLeuAlaLysProArgProThrAlaGluThrAlaProValSerSerGluArg-38
SEQ. ID. NO. 34642 45-GlnAlaMetThrAsnArgGluMetAsnAspArgAlaAsnAlaAsnArgArgGlyTrpAsnGluAlaLysAlaArgSerAlaLysGlyAlaAla-75
SEQ. ID. NO. 34643 77-SerLeuAlaLysLysLysGluThrThr-85
SEQ. ID. NO. 34644 110-AlaGluAlaArgArgSerAlaMet-117

TABLE 1-continued

Hydrophilic Regions - Hopp-Woods
SEQ. ID. NO. 34645    16-ThrProProLysMetArgLeuAlaLysProArgProThrAlaGlu-30
SEQ. ID. NO. 34646    32-AlaProValSerSerGluArg-38
SEQ. ID. NO. 34647    47-MetThrAsnArgGluMetAsnAspArgAlaAsnAlaAsnArgArgGlyTrpAsnGluAlaLysAlaArgSerAlaLysGlyAlaAla-75
SEQ. ID. NO. 34648    77-SerLeuAlaLysLysLysGluThrThr-85
SEQ. ID. NO. 34649    110-AlaGluAlaArgArgSerAlaMet-117
g672
AMPHI Regions - AMPHI
SEQ. ID. NO. 34650    38-ArgAlaIleAspIleIleLysAlaGlnLys-47
SEQ. ID. NO. 34651    50-AlaAlaLeuProProPheValSerValVal-59
SEQ. ID. NO. 34652    67-AlaGlnAsnIleArgArgIleLeuAlaGluValPro-78
SEQ. ID. NO. 34653    91-AlaPheCysArgGlnPheAspArgProTyr-100
SEQ. ID. NO. 34654    105-ArgValGlnThrAlaSerAspIle-112
SEQ. ID. NO. 34655    115-AlaAlaThrArgPheProAsn-121
SEQ. ID. NO. 34656    131-HisProSerGluTyrGly-136
SEQ. ID. NO. 34657    163-ProGluAsnValGlyGluAlaValArg-171
SEQ. ID. NO. 34658    173-ThrGlyAlaGluAla-177
Antigenic Index - Jameson-Wolf
SEQ. ID. NO. 34659    1-MetArgLysIleArgThrLysIleCysGlyIleThrThrProGluAspAlaLeu-18
SEQ. ID. NO. 34660    34-ProGlnSerProArgAlaIleAspIleIleLysAlaGlnLys-47
SEQ. ID. NO. 34661    65-GluSerAlaGlnAsnIleArgArgIleLeuAla-75
SEQ. ID. NO. 34662    84-PheHisGlyAspGluAspAspAlaPhe-92
SEQ. ID. NO. 34663    95-GlnPheAspArgProTyrIle-101
SEQ. ID. NO. 34664    107-GlnThrAlaSerAspIleArgAsnAlaAla-116
SEQ. ID. NO. 34665    130-TyrHisProSerGluTyrGlyGlyThrGlyHisArgPheAsp-143
SEQ. ID. NO. 34666    149-GluTyrSerGlyLysPro-154
SEQ. ID. NO. 34667    159-GlyGlyLeuThrProGluAsnValGlyGluAlaValArg-171
SEQ. ID. NO. 34668    176-GluAlaValAspValSerGlyGlyValGluAlaSerLysGlyLysLysAspProAlaLys-195
SEQ. ID. NO. 34669    202-ThrAlaAsnArgLeuSerArg-208
Hydrophilic Regions - Hopp-Woods
SEQ. ID. NO. 34670    1-MetArgLysIleArgThrLysIle-8
SEQ. ID. NO. 34671    13-ThrProGluAspAlaLeu-18
SEQ. ID. NO. 34672    36-SerProArgAlaIleAsp-41
SEQ. ID. NO. 34673    43-IleLysAlaGlnLys-47
SEQ. ID. NO. 34674    66-SerAlaGlnAsnIleArgArgIleLeuAla-75
SEQ. ID. NO. 34675    85-HisGlyAspGluAspAspAlaPhe-92
SEQ. ID. NO. 34676    110-SerAspIleArgAsnAlaAla-116
SEQ. ID. NO. 34677    165-AsnValGlyGluAlaValArg-171
SEQ. ID. NO. 34678    184-ValGluAlaSerLysGlyLysLysAspProAlaLys-195
SEQ. ID. NO. 34679    204-AsnArgLeuSerArg-208
g673
AMPHI Regions - AMPHI
SEQ. ID. NO. 34680    84-LeuAsnAspArgLeuAsnGlnAsnValThrGluAlaLeuGlyGlyValAspVal-101
SEQ. ID. NO. 34681    110-ArgLeuThrAspAla-114
SEQ. ID. NO. 34682    117-ValValLeuLysGlnLeuProLys-124
SEQ. ID. NO. 34683    172-ArgIleAlaAsnLeuLeuGluLeuLeuLysProTyrLeu-184
SEQ. ID. NO. 34684    212-LysLeuPheArgTyrLeuGlyGluGlu-220
SEQ. ID. NO. 34685    232-PheGluGluGlyAspGly-237
SEQ. ID. NO. 34686    261-GlyGluArgLeuLysLysIleSerThr-269
SEQ. ID. NO. 34687    286-LysValTrpValLysValLys-292
Antigenic Index - Jameson-Wolf
SEQ. ID. NO. 34688    7-LeuAlaGlyGluArgAlaAlaGlyGlyTyrArg-17
SEQ. ID. NO. 34689    24-ValGlyArgProAsnValGlyLysSerThr-33
SEQ. ID. NO. 34690    44-SerIleThrSerLysLysAlaGlnThrThrArgAsnArgValThr-58
SEQ. ID. NO. 34691    61-TyrThrAspAspThrAla-66
SEQ. ID. NO. 34692    73-ThrProGlyPheGlnThrAspHisArgAsnAlaLeuAsnAspArgLeuAsnGlnAsnValThrGlu-94
SEQ. ID. NO. 34693    109-MetArgLeuThrAspAlaAspArgValVal-118
SEQ. ID. NO. 34694    121-GlnLeuProLysHisThr-126
SEQ. ID. NO. 34695    134-LysIleAspLysAspLysAlaLysAspArgTyrAla-145
SEQ. ID. NO. 34696    153-ValArgAlaGluPhe-157
SEQ. ID. NO. 34697    180-LeuLysProTyrLeuProGluSerVal-188
SEQ. ID. NO. 34698    190-MetTyrProGluAspMetValThrAspLysSerAlaArg-202
SEQ. ID. NO. 34699    208-IleValArgGluLysLeuPhe-214
SEQ. ID. NO. 34700    217-LeuGlyGluGluLeuPro-222
SEQ. ID. NO. 34701    227-ValGluValGluGlnPheGluGluGlyAspGlyLeuAsn-239
SEQ. ID. NO. 34702    247-ValAspLysGluSerGlnLys-253
SEQ. ID. NO. 34703    258-GlyLysGlyGlyGluArgLeuLysLysIleSerThrGluAlaArgLeuAspMetGluLysLeuPheAspAsnLysVal-283
SEQ. ID. NO. 34704    291-ValLysSerGlyTrpAlaAspAspIleArgPheLeuArg-303
Hydrophilic Regions - Hopp-Woods
SEQ. ID. NO. 34705    7-LeuAlaGlyGluArgAlaAlaGly-14
SEQ. ID. NO. 34706    45-IleThrSerLysLysAlaGlnThrThrArgAsnArgVal-57
SEQ. ID. NO. 34707    61-TyrThrAspAspThrAla-66
SEQ. ID. NO. 34708    78-ThrAspHisArgAsnAlaLeuAsnAspArgLeuAsn-89
SEQ. ID. NO. 34709    109-MetArgLeuThrAspAlaAspArgValVal-118
SEQ. ID. NO. 34710    134-LysIleAspLysAspLysAlaLysAspArgTyrAla-145
SEQ. ID. NO. 34711    153-ValArgAlaGluPhe-157
SEQ. ID. NO. 34712    194-AspMetValThrAspLysSerAlaArg-202
SEQ. ID. NO. 34713    208-IleValArgGluLysLeuPhe-214
SEQ. ID. NO. 34714    217-LeuGlyGluGluLeuPro-222
SEQ. ID. NO. 34715    227-ValGluValGluGlnPheGluGluGlyAspGlyLeuAsn-239

TABLE 1-continued

| | |
|---|---|
| SEQ. ID. NO. 34716 | 247-ValAspLysGluSerGlnLys-253 |
| SEQ. ID. NO. 34717 | 259-LysGlyGlyGluArgLeuLysLysIleSerThrGluAlaArgLeuAspMetGluLysLeuPheAsp-280 |
| SEQ. ID. NO. 34718 | 293-SerGlyTrpAlaAspAspIleArgPheLeuArg-303 | g674
AMPHI Regions - AMPHI

| | |
|---|---|
| SEQ. ID. NO. 34719 | 16-ValTyrGlnSerLeuIle-21 |
| SEQ. ID. NO. 34720 | 24-ThrAlaAlaProGluIleAlaLysAsnIleArgGluMetSerAspPheAlaLysAlaAspGluGluLeu-46 |
| SEQ. ID. NO. 34721 | 58-AlaAlaAspTyrIleGlnLysIleArg-66 |
| SEQ. ID. NO. 34722 | 86-ThrAlaCysHisGluLeuSerAlaMetProGluThr-97 |
| SEQ. ID. NO. 34723 | 107-IleGluValThrLysThrPheGlyGlyThrAspGlyHisLysPheValAsnGlyIleLeuAspLysLeuAla-130 |

Antigenic Index - Jameson-Wolf

| | |
|---|---|
| SEQ. ID. NO. 34724 | 1-MetLysThrAlaArgArgArgSerArgGluLeuAla-12 |
| SEQ. ID. NO. 34725 | 28-GluIleAlaLysAsnIleArgGluMetSerAspPheAlaLysAlaAspGluGluLeuPhe-47 |
| SEQ. ID. NO. 34726 | 54-ThrGlnThrAsnAla-58 |
| SEQ. ID. NO. 34727 | 61-TyrIleGlnLysIleArgProLeuLeuAspArgAspGluLysAspLeuAsnProIleGluArg-81 |
| SEQ. ID. NO. 34728 | 93-AlaMetProGluThrProTyr-99 |
| SEQ. ID. NO. 34729 | 105-GluAlaIleGluValThrLysThrPheGlyGlyThrAspGlyHisLysPhe-121 |
| SEQ. ID. NO. 34730 | 129-LeuAlaAlaGlnIleArgProAspGluProLysArgArg-141 |

Hydrophilic Regions - Hopp-Woods

| | |
|---|---|
| SEQ. ID. NO. 34731 | 1-MetLysThrAlaArgArgArgSerArgGluLeuAla-12 |
| SEQ. ID. NO. 34732 | 28-GluIleAlaLysAsnIleArgGluMetSerAspPheAlaLysAlaAspGluGluLeuPhe-47 |
| SEQ. ID. NO. 34733 | 63-GlnLysIleArgProLeuLeuAspArgAspGluLysAspLeuAsnProIleGluArg-81 |
| SEQ. ID. NO. 34734 | 105-GluAlaIleGluVal-109 |
| SEQ. ID. NO. 34735 | 133-IleArgProAspGluProLysArgArg-141 | g675
AMPHI Regions - AMPHI

| | |
|---|---|
| SEQ. ID. NO. 34736 | 21-ArgPheThrAsnGluIleGlySerGlnMetLeuLysValCysCysArgThrLeuGlnGluLeuGly-42 |
| SEQ. ID. NO. 34737 | 74-AlaLeuIleAlaIle-78 |
| SEQ. ID. NO. 34738 | 123-GlnAlaIleGluArgIleGlyGluLysAlaSerAsp-134 |
| SEQ. ID. NO. 34739 | 141-GluCysAlaAsnLeuValAsnLeuLeuLeuGlu-151 |

Antigenic Index - Jameson-Wolf

| | |
|---|---|
| SEQ. ID. NO. 34740 | 6-ProAsnLeuAspGlyLysHisLeuArg-14 |
| SEQ. ID. NO. 34741 | 42-GlyValAlaAspGluAsnIle-48 |
| SEQ. ID. NO. 34742 | 68-SerSerGluLysPheAsp-73 |
| SEQ. ID. NO. 34743 | 82-IleArgGlyGluThrTyr-87 |
| SEQ. ID. NO. 34744 | 93-AlaAsnGluSerGlyAlaGlyIle-100 |
| SEQ. ID. NO. 34745 | 118-ThrGluAsnAspAlaGlnAlaIleGluArgIleGlyGluLysAlaSerAspAlaAlaLysValAlaVal-140 |
| SEQ. ID. NO. 34746 | 152-GluGlnPheGluAspGluGlu-158 |

Hydrophilic Regions - Hopp-Woods

| | |
|---|---|
| SEQ. ID. NO. 34747 | 8-LeuAspGlyLysHisLeuArg-14 |
| SEQ. ID. NO. 34748 | 42-GlyValAlaAspGluAsnIle-48 |
| SEQ. ID. NO. 34749 | 68-SerSerGluLysPheAsp-73 |
| SEQ. ID. NO. 34750 | 82-IleArgGlyGluThrTyr-87 |
| SEQ. ID. NO. 34751 | 95-GluSerGlyAlaGly-99 |
| SEQ. ID. NO. 34752 | 118-ThrGluAsnAspAlaGlnAlaIleGluArgIleGlyGluLysAlaSerAspAlaAlaLysValAlaVal-140 |
| SEQ. ID. NO. 34753 | 152-GluGlnPheGluAspGluGlu-158 | g677
AMPHI Regions - AMPHI

| | |
|---|---|
| SEQ. ID. NO. 34754 | 19-ThrValArgLeuCysArgPheArgArg-27 |
| SEQ. ID. NO. 34755 | 45-LeuThrAlaPheArgArgValGlnAsnHisPheValAlaPheAlaArgPheAsnGlnAlaThrArgGlnArgArg-69 |
| SEQ. ID. NO. 34756 | 79-IleAspPheIleAspAlaAsp-85 |
| SEQ. ID. NO. 34757 | 87-PheAspGlyLeuLeuAla-92 |
| SEQ. ID. NO. 34758 | 155-CysArgProValAspAspLeuAspAsp-163 |
| SEQ. ID. NO. 34759 | 166-AlaPhePheIleAspGlnLeuIleLysLeuValPheGlnCys-179 |

Antigenic Index - Jameson-Wolf

| | |
|---|---|
| SEQ. ID. NO. 34760 | 23-CysArgPheArgArgHisSerArgSerValAsp-33 |
| SEQ. ID. NO. 34761 | 35-AspValPheAspArgLysAspPheAsnPhe-44 |
| SEQ. ID. NO. 34762 | 63-GlnAlaThrArgGlnArgArgAsnProArgAsnPheVal-75 |
| SEQ. ID. NO. 34763 | 82-IleAspAlaAspAspPheAspGly-89 |
| SEQ. ID. NO. 34764 | 97-GlnGlnThrAspGlyArgAlaGluLys-105 |
| SEQ. ID. NO. 34765 | 115-GlyIleAspAspAspGlySerLeu-122 |
| SEQ. ID. NO. 34766 | 125-PheGlyGlnGluThrAspAlaAlaVal-133 |
| SEQ. ID. NO. 34767 | 156-ArgProValAspAspLeuAspAspPheGly-165 |
| SEQ. ID. NO. 34768 | 181-ProSerGlyGlyArgAsn-186 |

Hydrophilic Regions - Hopp-Woods

| | |
|---|---|
| SEQ. ID. NO. 34769 | 23-CysArgPheArgArgHisSerArgSerValAsp-33 |
| SEQ. ID. NO. 34770 | 35-AspValPheAspArgLysAspPhe-42 |
| SEQ. ID. NO. 34771 | 63-GlnAlaThrArgGlnArgArgAsnProArg-72 |
| SEQ. ID. NO. 34772 | 82-IleAspAlaAspAspPheAsp-88 |
| SEQ. ID. NO. 34773 | 97-GlnGlnThrAspGlyArgAlaGluLys-105 |
| SEQ. ID. NO. 34774 | 115-GlyIleAspAspAspGlySer-121 |
| SEQ. ID. NO. 34775 | 126-GlyGlnGluThrAspAlaAlaVal-133 |
| SEQ. ID. NO. 34776 | 156-ArgProValAspAspLeuAspAsp-163 | g678
AMPHI Regions - AMPHI

| | |
|---|---|
| SEQ. ID. NO. 34777 | 24-MetArgGlyValIle-28 |
| SEQ. ID. NO. 34778 | 47-PheAlaAlaProPhe-51 |
| SEQ. ID. NO. 34779 | 80-IleGlnLysMetLeuArgSerLeuLeuThrGlyAla-91 |
| SEQ. ID. NO. 34780 | 102-ArgIleLeuGlyGlyValPheGlyAlaLeu-111 |
| SEQ. ID. NO. 34781 | 130-ProAspThrGluGlu-134 |

TABLE 1-continued

Antigenic Index - Jameson-Wolf
SEQ. ID. NO. 34782    125-SerLysThrAspLeuProAspThrGluGluTrpGlnGlnSerTyr-139
SEQ. ID. NO. 34783    153-AsnHisThrAspAsnAlaProGluSerLeuAspAspAsp-165
Hydrophilic Regions - Hopp-Woods
SEQ. ID. NO. 34784    125-SerLysThrAspLeuProAspThrGluGluTrpGln-136
SEQ. ID. NO. 34785    155-ThrAspAsnAlaProGluSerLeuAspAspAsp-165
g681
AMPHI Regions - AMPHI
SEQ. ID. NO. 34786    12-PheSerGluGluAlaLysPheIleSerAlaMet-22
SEQ. ID. NO. 34787    110-CysAlaValPheGlyLysLeuProArg-118
SEQ. ID. NO. 34788    123-LeuGlyLysGlnCysGly-128
SEQ. ID. NO. 34789    137-ValGlyGluAlaAspAspAla-143
SEQ. ID. NO. 34790    146-ValGlyValValGlyValPheVal-153
SEQ. ID. NO. 34791    202-LysCysValHisCysGlyAsnThr-209
SEQ. ID. NO. 34792    212-GlyGlyLysLeuAlaAspPheThrThrIleProAla-223
SEQ. ID. NO. 34793    235-CysAlaProPheAlaAlaLeuArgCysPheCysIlePheGlyValTrpLysArgIleArgAlaValPheCysGlyArg-260
Antigenic Index - Jameson-Wolf
SEQ. ID. NO. 34794    11-AsnPheSerGluGluAlaLysPhe-18
SEQ. ID. NO. 34795    39-AlaThrProAsnSerTrpArgValArgGlnGln-49
SEQ. ID. NO. 34796    59-LeuValLysArgAlaCys-64
SEQ. ID. NO. 34797    67-ProMetArgArgCysLeuProSerArgLeu-76
SEQ. ID. NO. 34798    91-SerGluCysArgLeuLys-96
SEQ. ID. NO. 34799    122-GlyLeuGlyLysGlnCysGlyGlyPhe-130
SEQ. ID. NO. 34800    134-PheGlyAspValGlyGluAlaAspAspAlaGluVal-145
SEQ. ID. NO. 34801    157-AlaAlaGluThrPro-162
SEQ. ID. NO. 34802    173-AlaValLysGluAlaAspGly-179
SEQ. ID. NO. 34803    185-AspGlyValGlyGlyAspAlaAlaValGluCysArgGlyLysCysLeuCys-201
SEQ. ID. NO. 34804    209-ThrLeuGlyGlyGlyLysLeuAlaAsp-217
SEQ. ID. NO. 34805    224-LeuSerAlaAspGlyGlyGly-230
SEQ. ID. NO. 34806    257-PheCysGlyArgArg-261
Hydrophilic Regions - Hopp-Woods
SEQ. ID. NO. 34807    11-AsnPheSerGluGluAlaLysPhe-18
SEQ. ID. NO. 34808    44-TrpArgValArgGln-48
SEQ. ID. NO. 34809    59-LeuValLysArgAlaCys-64
SEQ. ID. NO. 34810    67-ProMetArgArgCysLeuPro-73
SEQ. ID. NO. 34811    91-SerGluCysArgLeuLys-96
SEQ. ID. NO. 34812    136-AspValGlyGluAlaAspAspAlaGluVal-145
SEQ. ID. NO. 34813    157-AlaAlaGluThrPro-162
SEQ. ID. NO. 34814    173-AlaValLysGluAlaAspGly-179
SEQ. ID. NO. 34815    191-AlaAlaValGluCysArgGlyLysCysLeu-200
SEQ. ID. NO. 34816    257-PheCysGlyArgArg-261
g682
AMPHI Regions - AMPHI
SEQ. ID. NO. 34817    33-ArgLeuArgLysCysGlyArgIleLeuSerGlyIleCysGluProPhe-48
SEQ. ID. NO. 34818    75-IleLysMetProSerGluPro-81
SEQ. ID. NO. 34819    91-AlaGlyPheIleArgPhePro-97
Antigenic Index - Jameson-Wolf
SEQ. ID. NO. 34820    9-ProTyrGlyGluArgArgLysAsnTrpAsp-18
SEQ. ID. NO. 34821    29-LeuSerProThrArgLeuArgLysCysGlyArg-39
SEQ. ID. NO. 34822    70-CysValAsnAspGluIleLysMetProSerGluProAspTrp-83
SEQ. ID. NO. 34823    95-ArgPheProThrAspArgProIleLeu-103
SEQ. ID. NO. 34824    112-IleSerProArgThrGlyPheArgTyrProThrArgSerLeuProLysSerLysLysAlaTyrGly-133
Hydrophilic Regions - Hopp-Woods
SEQ. ID. NO. 34825    11-GlyGluArgArgLysAsnTrpAsp-18
SEQ. ID. NO. 34826    30-SerProThrArgLeuArgLysCysGlyArg-39
SEQ. ID. NO. 34827    72-AsnAspGluIleLysMetProSerGluProAspTrp-83
SEQ. ID. NO. 34828    97-ProThrAspArgProIleLeu-103
SEQ. ID. NO. 34829    124-SerLeuProLysSerLysLysAlaTyrGly-133
g683
AMPHI Regions - AMPHI
SEQ. ID. NO. 34830    26-ThrProAspLysSerAlaArgTrpGluAsnIleGlyThrIleSerAsn-41
SEQ. ID. NO. 34831    75-ArgPheAlaAsnThrPro-80
SEQ. ID. NO. 34832    101-SerSerLeuGlnLeuPhe-106
SEQ. ID. NO. 34833    124-ArgProMetSerIleLeuSerGly-131
Antigenic Index - Jameson-Wolf
SEQ. ID. NO. 34834    24-CysSerThrProAspLysSerAlaArgTrpGluAsn-35
SEQ. ID. NO. 34835    37-GlyThrIleSerAsnGly-42
SEQ. ID. NO. 34836    48-IleAsnLysAspSerValArgLysAsnGlyAsn-58
SEQ. ID. NO. 34837    63-GlnAspLysLysValValThrAsnLeuLysGlnGluArgPheAlaAsnThrProAlaTyr-82
SEQ. ID. NO. 34838    93-CysAsnAsnLysThrTyrArgLeu-100
SEQ. ID. NO. 34839    106-PheAspThrLysAsnThrGluIleSerThrGlnAsnTyrThrAlaSerSerLeuArgPro-125
SEQ. ID. NO. 34840    131-GlyThrLeuThrGluLysGlnTyrGlu-139
SEQ. ID. NO. 34841    141-ValCysGlyLysLysLeu-146
Hydrophilic Regions - Hopp-Woods
SEQ. ID. NO. 34842    25-SerThrProAspLysSerAlaArgTrpGluAsn-35
SEQ. ID. NO. 34843    48-IleAsnLysAspSerValArgLysAsnGly-57
SEQ. ID. NO. 34844    63-GlnAspLysLysValValThr-69
SEQ. ID. NO. 34845    71-LeuLysGlnGluArgPheAla-77
SEQ. ID. NO. 34846    107-AspThrLysAsnThrGluIleSer-114

TABLE 1-continued

SEQ. ID. NO. 34847 133-LeuThrGluLysGlnTyrGlu-139
SEQ. ID. NO. 34848 141-ValCysGlyLysLysLeu-146
g684
AMPHI Regions - AMPHI
SEQ. ID. NO. 34849 13-AlaAlaCysGlyThrValGln-19
SEQ. ID. NO. 34850 47-LeuAlaGluProLeu-51
SEQ. ID. NO. 34851 73-TrpAlaAspThrLeuAspAspMetLeuGluAlaAlaLeuSerAsnAlaPheAsnArgLeuAspSerThrArg-96
SEQ. ID. NO. 34852 110-TrpThrValTyrIleAspAlaPheGlnGlySerTyr-121
SEQ. ID. NO. 34853 154-AlaMetThrAlaAlaLeuGluGlnGlyLeuLysGlnAlaAlaGlnGlnMetVal-171
Antigenic Index - Jameson-Wolf
SEQ. ID. NO. 34854 26-LeuProAspSerArgTyrIleArgProAlaThrGlnGlyGlyGluThrAlaValGluValArgLeuAlaGluProLeuLysArgGlyGlyLeu-56
SEQ. ID. NO. 34855 60-ThrAspProTyrArgIleAsnThrAlaGln-69
SEQ. ID. NO. 34856 76-ThrLeuAspAspMetLeuGlu-82
SEQ. ID. NO. 34857 90-AsnArgLeuAspSerThrArgThrPhe-98
SEQ. ID. NO. 34858 101-AlaSerArgSerGlySerThrAspLys-109
SEQ. ID. NO. 34859 117-PheGlnGlySerTyrThrGlyLysThrLeu-126
SEQ. ID. NO. 34860 133-LeuProAspGlyThrAsnArgProPheHisIleGluThrGluGlnGlnGlyAspGlyTyrAla-153
SEQ. ID. NO. 34861 161-GlnGlyLeuLysGlnAlaAla-167
Hydrophilic Regions - Hopp-Woods
SEQ. ID. NO. 34862 27-ProAspSerArgTyrIleArg-33
SEQ. ID. NO. 34863 35-AlaThrGlnGlyGlyGluThrAlaValGluValArgLeuAlaGluProLeuLysArgGlyGly-55
SEQ. ID. NO. 34864 76-ThrLeuAspAspMetLeuGlu-82
SEQ. ID. NO. 34865 90-AsnArgLeuAspSerThrArg-96
SEQ. ID. NO. 34866 102-SerArgSerGlySerThrAspLys-109
SEQ. ID. NO. 34867 141-PheHisIleGluThrGluGlnGlnGlyAsp-150
SEQ. ID. NO. 34868 161-GlnGlyLeuLysGlnAlaAla-167
g685
AMPHI Regions - AMPHI
SEQ. ID. NO. 34869 7-AsnPheAlaPheCysGlyValVal-14
SEQ. ID. NO. 34870 44-CysAlaValLeuPro-48
SEQ. ID. NO. 34871 61-ValSerAlaAlaSerGln-66
SEQ. ID. NO. 34872 98-TrpAlaAlaLeuAspThrLeuThrGluPro-107
SEQ. ID. NO. 34873 141-CysGluSerLeuHisArgHis-147
SEQ. ID. NO. 34874 158-GlyAlaGluAlaTyrGluGlnLeuAlaLysAsn-168
SEQ. ID. NO. 34875 186-GluLysGlnMetGluThrLeuSerArgIlePheGly-197
SEQ. ID. NO. 34876 300-AlaValGluValLeu-304
SEQ. ID. NO. 34877 340-AlaAlaGluGlnLeuLysAlaAla-347
Antigenic Index - Jameson-Wolf
SEQ. ID. NO. 34878 20-LeuAsnAsnLysHisSerTyrSerTyrAlaLysGluProHisThrValLysProArgPhe-39
SEQ. ID. NO. 34879 51-CysSerProGluProAlaAlaGluLysThrValSer-62
SEQ. ID. NO. 34880 78-ProThrAlaArgGlyAspAlaValValProLysAsnProGluArgValAla-94
SEQ. ID. NO. 34881 103-ThrLeuThrGluProGlyVal-109
SEQ. ID. NO. 34882 126-AlaPheAspLysAlaAla-131
SEQ. ID. NO. 34883 137-PheGluProAspCysGluSerLeuHisArgHisAsnPro-149
SEQ. ID. NO. 34884 155-GlyGlyProGlyAlaGluAlaTyrGluGlnLeuAlaLysAsnAlaThr-170
SEQ. ID. NO. 34885 174-LeuThrValAspAsnGlyAsnIleArgThrSerGlyGluLysGlnMetGluThrLeu-192
SEQ. ID. NO. 34886 195-IlePheGlyLysGluAlaArgValAlaGlu-204
SEQ. ID. NO. 34887 213-PheAlaGlnLysArgGluAlaAlaLysGlyLysGlyArgGlyLeu-227
SEQ. ID. NO. 34888 231-ValThrGlyAsnLysValSerAlaPheGlyThrGlnSerArgLeu-245
SEQ. ID. NO. 34889 251-GlyAspIleGlyLeuProProValAspGluSerLeuArgAsnGluGlyHisGlyGln-269
SEQ. ID. NO. 34890 275-TyrIleLysGluLysAsnProGlyTrp-283
SEQ. ID. NO. 34891 289-ArgThrAlaAlaIleGlyGlnGluGlyProAla-299
SEQ. ID. NO. 34892 313-AsnAlaTrpLysArgLysGln-319
SEQ. ID. NO. 34893 342-GluGlnLeuLysAlaAlaPheGluLysAlaGluProValAla-355
Hydrophilic Regions - Hopp-Woods
SEQ. ID. NO. 34894 28-TyrAlaLysGluProHisThrValLys-36
SEQ. ID. NO. 34895 51-CysSerProGluProAlaAlaGluLysThrValSer-62
SEQ. ID. NO. 34896 79-ThrAlaArgGlyAspAlaValVal-86
SEQ. ID. NO. 34897 88-LysAsnProGluArgValAla-94
SEQ. ID. NO. 34898 126-AlaPheAspLysAlaAla-131
SEQ. ID. NO. 34899 137-PheGluProAspCysGluSerLeuHisArgHis-147
SEQ. ID. NO. 34900 160-GluAlaTyrGluGlnLeuAlaLys-167
SEQ. ID. NO. 34901 179-GlyAsnIleArgThrSerGlyGluLysGlnMetGluThrLeu-192
SEQ. ID. NO. 34902 195-IlePheGlyLysGluAlaArgValAlaGlu-204
SEQ. ID. NO. 34903 213-PheAlaGlnLysArgGluAlaAlaLysGlyLysGlyArgGly-226
SEQ. ID. NO. 34904 257-ProValAspGluSerLeuArgAsnGluGlyHisGly-268
SEQ. ID. NO. 34905 275-TyrIleLysGluLysAsnPro-281
SEQ. ID. NO. 34906 294-GlyGlnGluGlyProAla-299
SEQ. ID. NO. 34907 314-AlaTrpLysArgLysGln-319
SEQ. ID. NO. 34908 342-GluGlnLeuLysAlaAlaPheGluLysAlaGluProValAla-355
g686
AMPHI Regions - AMPHI
SEQ. ID. NO. 34909 10-AspValPheAspAspIleCysSerAlaValGluGlyPheGlyGlyIleAlaArgSerValGlnLeu-31
SEQ. ID. NO. 34910 50-SerAlaGlyIleValGluThrValGlyLysProLeu-61
SEQ. ID. NO. 34911 70-ValGluAlaAspIle-74
SEQ. ID. NO. 34912 86-IleProArgAlaPheGlySerGlyIleAlaAlaAlaLeu-98
Antigenic Index - Jameson-Wolf
SEQ. ID. NO. 34913 1-TerTerAsnPheSerCysArgAlaAspAspValPheAsp-13
SEQ. ID. NO. 34914 46-LeuArgGlnHisSerAlaGlyIle-53
SEQ. ID. NO. 34915 56-ThrValGlyLysProLeuSerGlyAla-64

TABLE 1-continued

| | |
|---|---|
| SEQ. ID. NO. 34916 | 70-ValGluAlaAspIle-74 |
| SEQ. ID. NO. 34917 | 115-AspAlaValLysAlaGluSerValAsnGlyThrThrGly-127 |

Hydrophilic Regions - Hopp-Woods

| | |
|---|---|
| SEQ. ID. NO. 34918 | 6-CysArgAlaAspAspValPheAsp-13 |
| SEQ. ID. NO. 34919 | 70-ValGluAlaAspIle-74 |
| SEQ. ID. NO. 34920 | 115-AspAlaValLysAlaGluSerValAsn-123 | g687
AMPHI Regions - AMPHI

| | |
|---|---|
| SEQ. ID. NO. 34921 | 13-AlaAlaLeuPheAlaLeu-18 |
| SEQ. ID. NO. 34922 | 66-LysValGluValLeuGluPhePheGlyTyrPheCysPro-78 |
| SEQ. ID. NO. 34923 | 80-CysAlaArgLeuGluPro-85 |
| SEQ. ID. NO. 34924 | 87-LeuSerLysHisAlaLysSerPhe-94 |
| SEQ. ID. NO. 34925 | 114-LeuAlaArgLeuAlaAlaAla-120 |
| SEQ. ID. NO. 34926 | 137-PheAspAlaMetVal-141 |
| SEQ. ID. NO. 34927 | 150-ProGluValLeuLysLysTrpLeu-157 |
| SEQ. ID. NO. 34928 | 174-SerProGluSerGln-178 |
| SEQ. ID. NO. 34929 | 182-GlyLysMetGlnGluLeuThrGluThrPhe-191 |

Antigenic Index - Jameson-Wolf

| | |
|---|---|
| SEQ. ID. NO. 34930 | 1-MetLysSerArgHis-5 |
| SEQ. ID. NO. 34931 | 21-CysAspSerLysValGlnThrSerValProAlaAspSerAlaPro-35 |
| SEQ. ID. NO. 34932 | 45-GlyLeuValGluGlyGlnAsnTyr-52 |
| SEQ. ID. NO. 34933 | 58-ProIleProGlnGlnGlnAlaGlyLysValGluVal-69 |
| SEQ. ID. NO. 34934 | 77-CysProHisCysAlaArgLeuGluProValLeu-87 |
| SEQ. ID. NO. 34935 | 89-LysHisAlaLysSerPheLysAspAspMetTyrLeu-100 |
| SEQ. ID. NO. 34936 | 124-AlaAlaAlaGluSerLysAspValAlaAsn-133 |
| SEQ. ID. NO. 34937 | 143-GlnLysIleLysLeuGlnGluProGluValLeuLys-154 |
| SEQ. ID. NO. 34938 | 161-ThrAlaPheAspGlyLysLysVal-168 |
| SEQ. ID. NO. 34939 | 173-GluSerProGluSerGlnAlaArgAlaGlyLysMetGlnGluLeuThrGlu-189 |
| SEQ. ID. NO. 34940 | 191-PheGlnIleAspGlyThrPro-197 |
| SEQ. ID. NO. 34941 | 201-ValGlyGlyLysTyrLysValGluPheAlaAsp-211 |
| SEQ. ID. NO. 34942 | 213-GluSerGlyMetAsnThr-218 |
| SEQ. ID. NO. 34943 | 222-LeuAlaAspLysValArgGluGluGlnLysAlaAlaGln-234 |

Hydrophilic Regions - Hopp-Woods

| | |
|---|---|
| SEQ. ID. NO. 34944 | 1-MetLysSerArgHis-5 |
| SEQ. ID. NO. 34945 | 21-CysAspSerLysValGlnThr-27 |
| SEQ. ID. NO. 34946 | 29-ValProAlaAspSerAlaPro-35 |
| SEQ. ID. NO. 34947 | 63-GlnAlaGlyLysValGluVal-69 |
| SEQ. ID. NO. 34948 | 81-AlaArgLeuGluProValLeu-87 |
| SEQ. ID. NO. 34949 | 89-LysHisAlaLysSerPheLysAspAspMetTyrLeu-100 |
| SEQ. ID. NO. 34950 | 124-AlaAlaAlaGluSerLysAspValAla-132 |
| SEQ. ID. NO. 34951 | 143-GlnLysIleLysLeuGlnGluProGluValLeuLys-154 |
| SEQ. ID. NO. 34952 | 161-ThrAlaPheAspGlyLysLysVal-168 |
| SEQ. ID. NO. 34953 | 173-GluSerProGluSerGlnAlaArgAlaGlyLysMetGlnGluLeuThrGlu-189 |
| SEQ. ID. NO. 34954 | 203-GlyLysTyrLysValGluPheAlaAsp-211 |
| SEQ. ID. NO. 34955 | 222-LeuAlaAspLysValArgGluGluGlnLysAlaAlaGln-234 | g688
AMPHI Regions - AMPHI

| | |
|---|---|
| SEQ. ID. NO. 34956 | 22-LeuSerAlaLeuPheSerLeu-28 |
| SEQ. ID. NO. 34957 | 119-GlyAspAlaLeuGlnAsnAlaAla-126 |

Antigenic Index - Jameson-Wolf

| | |
|---|---|
| SEQ. ID. NO. 34958 | 5-SerArgPheAlaGlnLysGlySerProValAsnLys-16 |
| SEQ. ID. NO. 34959 | 31-CysSerValGluArg-35 |
| SEQ. ID. NO. 34960 | 46-IleIleGlnGlyAsnGluLeuGluProArgAla-56 |
| SEQ. ID. NO. 34961 | 61-ArgProGlyMetThrLysAspGln-68 |
| SEQ. ID. NO. 34962 | 81-AlaPheHisThrAspArgTrpAspTyr-89 |
| SEQ. ID. NO. 34963 | 91-PheAsnThrSerArgAsnGlyIleIleLysGluArgSerAsnLeu-105 |
| SEQ. ID. NO. 34964 | 115-ValArgThrGluGlyAspAlaLeuGlnAsnAlaAlaGluAlaLeuArgAlaLysGlnAsnAlaAspLysGln-138 |

Hydrophilic Regions - Hopp-Woods

| | |
|---|---|
| SEQ. ID. NO. 34965 | 7-PheAlaGlnLysGlySerProVal-14 |
| SEQ. ID. NO. 34966 | 50-AsnGluLeuGluProArgAla-56 |
| SEQ. ID. NO. 34967 | 63-GlyMetThrLysAspGln-68 |
| SEQ. ID. NO. 34968 | 97-GlyIleIleLysGluArgSerAsn-104 |
| SEQ. ID. NO. 34969 | 115-ValArgThrGluGlyAspAlaLeuGlnAsnAlaAlaGluAlaLeuArgAlaLysGlnAsnAlaAspLysGln-138 | g689
AMPHI Regions - AMPHI

| | |
|---|---|
| SEQ. ID. NO. 34970 | 16-ValLeuMetAlaValLeuValAlaLeu-24 |
| SEQ. ID. NO. 34971 | 33-LeuProAlaIleProGluMetAlaGln-41 |
| SEQ. ID. NO. 34972 | 49-ArgIleGluSerLeu-53 |
| SEQ. ID. NO. 34973 | 62-PheGlyGlnValAlaGlyGly-68 |
| SEQ. ID. NO. 34974 | 73-IleLysGlyArgLys-77 |
| SEQ. ID. NO. 34975 | 103-LeuLeuAsnLeuArgAlaValGlnAlaPhe-112 |
| SEQ. ID. NO. 34976 | 138-PheAlaLeuIleGlyIleIleLeu-145 |
| SEQ. ID. NO. 34977 | 152-AlaProMetValGlyAlaLeuLeuGlnGlyLeuGlyGlyTrpArgAlaIlePheVal-170 |
| SEQ. ID. NO. 34978 | 177-ProValLeuProGlyLeuValGlnTyrPhe-186 |
| SEQ. ID. NO. 34979 | 195-LysIleGlyArgAspVal-200 |
| SEQ. ID. NO. 34980 | 207-ArgPheLysArgValLeu-212 |
| SEQ. ID. NO. 34981 | 227-SerPheGlySerMetPheAla-233 |
| SEQ. ID. NO. 34982 | 288-GlyIleValValGln-292 |
| SEQ. ID. NO. 34983 | 347-AlaAsnAlaValSerGlyValPheArgSerLeuIle-358 |

TABLE 1-continued

Antigenic Index - Jameson-Wolf
SEQ. ID. NO. 34984   1-TerTerSerProProLeuProProMetSerGlyLys-12
SEQ. ID. NO. 34985   46-AspIleHisArgIleGluSer-52
SEQ. ID. NO. 34986   71-SerAspIleLysGlyArgLysProVal-79
SEQ. ID. NO. 34987   98-SerSerThrGluGln-102
SEQ. ID. NO. 34988   124-MetValArgAspTyrTyrSerGlyArgLysAlaAla-135
SEQ. ID. NO. 34989   189-AsnProAlaValGlyGlyLysIleGlyArgAspVal-200
SEQ. ID. NO. 34990   207-ArgPheLysArgValLeuLysThrArgAla-216
SEQ. ID. NO. 34991   275-LeuLysThrGlyAlaHisProGlnSer-283
SEQ. ID. NO. 34992   340-PheLysGluGluGlyGlySerAla-347
SEQ. ID. NO. 34993   390-LysAlaTrpLysGluAsnGluLysLysArgIleLeu-401
Hydrophilic Regions - Hopp-Woods
SEQ. ID. NO. 34994   46-AspIleHisArgIleGluSer-52
SEQ. ID. NO. 34995   71-SerAspIleLysGlyArgLysProVal-79
SEQ. ID. NO. 34996   128-TyrTyrSerGlyArgLysAlaAla-135
SEQ. ID. NO. 34997   195-LysIleGlyArgAspVal-200
SEQ. ID. NO. 34998   207-ArgPheLysArgValLeuLysThrArgAla-216
SEQ. ID. NO. 34999   340-PheLysGluGluGlyGlySer-346
SEQ. ID. NO. 35000   390-LysAlaTrpLysGluAsnGluLysLysArgIleLeu-401
g690
AMPHI Regions - AMPHI
SEQ. ID. NO. 35001   38-SerSerAlaSerSer-42
SEQ. ID. NO. 35002   54-SerAlaProAspAsnValLysGlnAla-62
SEQ. ID. NO. 35003   73-HisProAlaAlaGlyIleGlyAspLeuIleGlnGlnIleAlaGluHisIle-89
SEQ. ID. NO. 35004   112-GlyTyrAspAsnIleGlnArgLeu-119
SEQ. ID. NO. 35005   146-ThrArgThrIleSerArgGlnAlaGlnAspAla-156
SEQ. ID. NO. 35006   185-ProLysArgAlaArgTyrPhe-191
SEQ. ID. NO. 35007   209-GlyAsnPheGlnTyrIleGlyGlnLeuProGlyTyrLeuLysMetHisGlyGluMet-227
Antigenic Index - Jameson-Wolf
SEQ. ID. NO. 35008   1-MetLysAsnLysThrSerSerLeu-8
SEQ. ID. NO. 35009   20-ArgSerProSerLysGluAspLysThrLysGluAsnGlyAla-33
SEQ. ID. NO. 35010   37-SerSerSerAlaSerSerAlaSerSerGlnThrAspLeuGlnPro-51
SEQ. ID. NO. 35011   54-SerAlaProAspAsnValLysGlnAlaGluSerAlaProLeuAsnCysThrGly-71
SEQ. ID. NO. 35012   86-AlaGluHisIleAspSerAspCys-93
SEQ. ID. NO. 35013   100-AsnGluLeuGluThrArgPhe-106
SEQ. ID. NO. 35014   108-LeuProGlyGlyGlyGlyTyrAspAsnIleGln-117
SEQ. ID. NO. 35015   122-ProAspIleArgProGluAspProAspTyrHisGln-133
SEQ. ID. NO. 35016   140-GluAspLeuArgTyrGlyThrArgThrIleSerArgGlnAlaGln-154
SEQ. ID. NO. 35017   156-AlaIleMetGluGlnGluArgArgLeuArgGluAlaThr-168
SEQ. ID. NO. 35018   173-GlnGlySerGlnLysThrArgGlyGlnGlyGluGluProLysArgAlaArgTyr-190
SEQ. ID. NO. 35019   199-TyrLeuAsnArgHisAsnAsnGlyLeuGlyGlyAsn-210
SEQ. ID. NO. 35020   223-MetHisGlyGluMetLeuGluAsnGlnSerLeu-233
SEQ. ID. NO. 35021   235-ArgLeuSerAsnArgGluArgAsnProAspLysProPheLeu-248
SEQ. ID. NO. 35022   251-HisPheAspGluAsnGlyLysIleThr-259
SEQ. ID. NO. 35023   263-ValTyrGluLysAsnIle-268
Hydrophilic Regions - Hopp-Woods
SEQ. ID. NO. 35024   1-MetLysAsnLysThrSer-6
SEQ. ID. NO. 35025   20-ArgSerProSerLysGluAspLysThrLysGluAsnGlyAla-33
SEQ. ID. NO. 35026   39-SerAlaSerSerAlaSerSerGlnThrAspLeu-49
SEQ. ID. NO. 35027   54-SerAlaProAspAsnValLysGlnAlaGluSerAlaPro-66
SEQ. ID. NO. 35028   87-GluHisIleAspSer-91
SEQ. ID. NO. 35029   100-AsnGluLeuGluThr-104
SEQ. ID. NO. 35030   124-IleArgProGluAspProAspTyrHisGln-133
SEQ. ID. NO. 35031   140-GluAspLeuArgTyrGlyThr-146
SEQ. ID. NO. 35032   148-ThrIleSerArgGlnAlaGln-154
SEQ. ID. NO. 35033   156-AlaIleMetGluGlnGluArgArgLeuArgGluAlaThr-168
SEQ. ID. NO. 35034   174-GlySerGlnLysThrArgGlyGlnGlyGluGluProLysArgAlaArgTyr-190
SEQ. ID. NO. 35035   223-MetHisGlyGluMetLeuGlu-229
SEQ. ID. NO. 35036   236-LeuSerAsnArgGluArgAsnProAspLysProPhe-247
SEQ. ID. NO. 35037   251-HisPheAspGluAsnGlyLysIleThr-259
g691
AMPHI Regions - AMPHI
SEQ. ID. NO. 35038   11-LysProAlaAlaSer-15
SEQ. ID. NO. 35039   55-HisAsnGluLeuArgLysIleArgAla-63
SEQ. ID. NO. 35040   101-AlaArgAspTyrVal-105
Antigenic Index - Jameson-Wolf
SEQ. ID. NO. 35041   7-CysArgPheAlaLys-11
SEQ. ID. NO. 35042   35-ProProAsnAspPheGlnProAsnCysAspIleArgArgLeuGlyLeuThrGlnGlyGlnHisAsnGluLeuArgLysIleArgAla-63
SEQ. ID. NO. 35043   67-MetAlaGlyAspArgAlaArgLeuLysValMetHis-78
SEQ. ID. NO. 35044   80-GluHisSerArgArgArgSerVal-87
SEQ. ID. NO. 35045   91-IleSerSerAspValPheAsnArgAsnGluAlaArgAspTyrValGluSerArgTyrHisSerSerMet-113
SEQ. ID. NO. 35046   115-PheAlaValAspGluLeuGluIle-122
SEQ. ID. NO. 35047   131-ThrProGlnGlnGlnGln-136
SEQ. ID. NO. 35048   140-SerSerCysLeuLys-144
Hydrophilic Regions - Hopp-Woods
SEQ. ID. NO. 35049   43-CysAspIleArgArgLeuGly-49
SEQ. ID. NO. 35050   54-GlnHisAsnGluLeuArgLysIleArgAla-63
SEQ. ID. NO. 35051   67-MetAlaGlyAspArgAlaArgLeuLysValMetHis-78
SEQ. ID. NO. 35052   80-GluHisSerArgArgArgSerVal-87

TABLE 1-continued

| | |
|---|---|
| SEQ. ID. NO. 35053 | 95-ValPheAsnArgAsnGluAlaArgAspTyrValGlu-106 |
| SEQ. ID. NO. 35054 | 115-PheAlaValAspGluLeuGluIle-122 | g692
AMPHI Regions - AMPHI

| | |
|---|---|
| SEQ. ID. NO. 35055 | 9-SerGluSerIleArgArgIleTrpArgAsnGlyArgGlu-21 |
| SEQ. ID. NO. 35056 | 58-PheValAlaLeuGluAla-63 |
| SEQ. ID. NO. 35057 | 77-LeuGlyTyrValPheLysProLeuAlaValPheVal-88 |
| SEQ. ID. NO. 35058 | 106-GlnGlyPheGlyGlnLeuHis-112 |
| SEQ. ID. NO. 35059 | 143-PheAspValPheGlnValPheArgAsp-151 |
| SEQ. ID. NO. 35060 | 179-CysGluValGlyArgValValGlyArgGlyTyrGlyAlaAlaValPheAspPhePheGlnArgPheGlnPhe-202 |
| SEQ. ID. NO. 35061 | 205-IleGlnSerGlnArgArgGlyArgHisLeuGluGlyPheGlyAsp-219 |
| SEQ. ID. NO. 35062 | 254-ValGlyLysPheAspGlnPheAspGlyVal-263 |
| SEQ. ID. NO. 35063 | 275-PheAspHisIleAlaGluVal-281 |
| SEQ. ID. NO. 35064 | 302-GlyGlyArgGlyCys-306 |

Antigenic Index - Jameson-Wolf

| | |
|---|---|
| SEQ. ID. NO. 35065 | 4-ThrArgCysArgCysSerGluSerIleArgArgIleTrpArgAsnGlyArgGluTrpArgIleLysGlyGlnLysCysArgLeuAsnThrAspAlaValGln-37 |
| SEQ. ID. NO. 35066 | 89-GlyGlyPheAspGlyArgProValAspIleGlyLysAlaArgLeuLeuGlu-105 |
| SEQ. ID. NO. 35067 | 120-AlaValAspAspGlyLysIle-126 |
| SEQ. ID. NO. 35068 | 136-CysGlyPheLysLeuAspAspPheAspVal-145 |
| SEQ. ID. NO. 35069 | 150-ArgAspValGlyPheGlyCysGlyGlnArgIle-160 |
| SEQ. ID. NO. 35070 | 177-GlyAlaCysGluValGlyArgValValGlyArgGlyTyr-189 |
| SEQ. ID. NO. 35071 | 204-ArgIleGlnSerGlnArgArgGlyArgHisLeuGluGlyPheGlyAsp-219 |
| SEQ. ID. NO. 35072 | 236-GluAspValAspVal-240 |
| SEQ. ID. NO. 35073 | 256-LysPheAspGlnPheAspGlyVal-263 |
| SEQ. ID. NO. 35074 | 282-AlaHisGlyArgAlaGluAspAspPhePhePhe-292 |
| SEQ. ID. NO. 35075 | 296-ValIleGlyArgArgGlyGlyGlyArgGlyCysGlyArg-308 |
| SEQ. ID. NO. 35076 | 316-GlyCysGluAspGluArgGluCysGlyGlyGlyLysGlyPheGluGlu-331 |

Hydrophilic Regions - Hopp-Woods

| | |
|---|---|
| SEQ. ID. NO. 35077 | 4-ThrArgCysArgCysSerGluSerIleArgArgIleTrpArgAsnGlyArgGluTrpArgIleLysGlyGlnLysCysArgLeuAsnThr-33 |
| SEQ. ID. NO. 35078 | 91-PheAspGlyArgProValAspIleGlyLysAlaArgLeuLeuGlu-105 |
| SEQ. ID. NO. 35079 | 120-AlaValAspAspGlyLysIle-126 |
| SEQ. ID. NO. 35080 | 139-LysLeuAspAspPheAsp-144 |
| SEQ. ID. NO. 35081 | 179-CysGluValGlyArgValValGly-186 |
| SEQ. ID. NO. 35082 | 206-GlnSerGlnArgArgGlyArgHisLeuGluGlyPheGly-218 |
| SEQ. ID. NO. 35083 | 236-GluAspValAspVal-240 |
| SEQ. ID. NO. 35084 | 282-AlaHisGlyArgAlaGluAspAspPhePhePhe-292 |
| SEQ. ID. NO. 35085 | 296-ValIleGlyArgArgGlyGlyGlyArgGlyCysGly-307 |
| SEQ. ID. NO. 35086 | 316-GlyCysGluAspGluArgGluCysGlyGly-325 |
| SEQ. ID. NO. 35087 | 327-LysGlyPheGluGlu-331 | g694
AMPHI Regions - AMPHI

| | |
|---|---|
| SEQ. ID. NO. 35088 | 13-LeuThrProAlaSerThr-18 |
| SEQ. ID. NO. 35089 | 69-ArgGlyArgAlaCysArg-74 |
| SEQ. ID. NO. 35090 | 88-GlnValGlyArgValVal-93 |
| SEQ. ID. NO. 35091 | 103-CysArgHisPheAlaGln-108 |
| SEQ. ID. NO. 35092 | 110-ValAlaValGlyArgIleGly-116 |
| SEQ. ID. NO. 35093 | 139-ArgArgIleAlaAspValPheLeuVal-147 |
| SEQ. ID. NO. 35094 | 149-IleAlaAspIleGlyGlu-154 |
| SEQ. ID. NO. 35095 | 171-ArgGlyLeuAlaAspIleGlyGluPheValGlyValSerAsp-184 |
| SEQ. ID. NO. 35096 | 194-PheAspGlnLysHisPheAlaArgCys-202 |
| SEQ. ID. NO. 35097 | 238-HisGlnArgAlaSerArgIleLys-245 |
| SEQ. ID. NO. 35098 | 270-ArgAlaArgArgHisPheArgGlnValPheAsp-280 |
| SEQ. ID. NO. 35099 | 298-AspPheValAlaHisIle-303 |
| SEQ. ID. NO. 35100 | 327-AlaAlaArgIleGlyLysAspAsp-334 |

Antigenic Index - Jameson-Wolf

| | |
|---|---|
| SEQ. ID. NO. 35101 | 34-GlyGlnAspGluHisAspAla-40 |
| SEQ. ID. NO. 35102 | 45-ProProPheAlaHisGlyPhe-51 |
| SEQ. ID. NO. 35103 | 53-ProProSerAlaTyrGlyCysGln-60 |
| SEQ. ID. NO. 35104 | 63-ProHisGlnHisPheGlyArgGlyArgAlaCysArgTyr-75 |
| SEQ. ID. NO. 35105 | 82-PheLysProArgAla-86 |
| SEQ. ID. NO. 35106 | 97-ArgIleAspSerAlaArgCysArgHis-105 |
| SEQ. ID. NO. 35107 | 113-GlyArgIleGlyArgThrAspHisAsnHisAsp-123 |
| SEQ. ID. NO. 35108 | 130-LeuPheAspGlyGlyLeuProValGlyArgArgIleAla-142 |
| SEQ. ID. NO. 35109 | 150-AlaAspIleGlyGluThrArgValGlnArgGlyAspAsp-162 |
| SEQ. ID. NO. 35110 | 167-IleAspArgGluArgGlyLeuAlaAsp-175 |
| SEQ. ID. NO. 35111 | 189-HisIleSerAspArgPheAspGlnLysHisPheAla-200 |
| SEQ. ID. NO. 35112 | 202-CysLysLeuProHisArgAlaPheAsp-210 |
| SEQ. ID. NO. 35113 | 214-ProLeuMetProAspHisAspAspPheThr-223 |
| SEQ. ID. NO. 35114 | 237-ArgHisGlnArgAlaSerArgIleLysTyrProGluThrAlaLeu-251 |
| SEQ. ID. NO. 35115 | 265-ArgIleAsnGlnCysArgAlaArgArgHisPhe-275 |
| SEQ. ID. NO. 35116 | 278-ValPheAspLysHisArg-283 |
| SEQ. ID. NO. 35117 | 303-IleAsnArgArgAlaGluPhe-309 |
| SEQ. ID. NO. 35118 | 313-ThrPheAspAsnThrAspCysProIleHisThrGlyAlaGluAlaAlaArgIleGlyLysAspAspGlyPheSer-337 |
| SEQ. ID. NO. 35119 | 344-ProCysSerAspGly-348 |
| SEQ. ID. NO. 35120 | 356-LeuCysAspGlyArgTyrCysGlnAlaProProThrProHisArgArgArg-372 |

Hydrophilic Regions - Hopp-Woods

| | |
|---|---|
| SEQ. ID. NO. 35121 | 34-GlyGlnAspGluHisAspAla-40 |
| SEQ. ID. NO. 35122 | 68-GlyArgGlyArgAlaCysArg-74 |
| SEQ. ID. NO. 35123 | 82-PheLysProArgAla-86 |

TABLE 1-continued

| | |
|---|---|
| SEQ. ID. NO. 35124 | 97-ArgIleAspSerAlaArgCysArgHis-105 |
| SEQ. ID. NO. 35125 | 114-ArgIleGlyArgThrAspHisAsnHis-122 |
| SEQ. ID. NO. 35126 | 137-ValGlyArgArgIleAla-142 |
| SEQ. ID. NO. 35127 | 150-AlaAspIleGlyGluThrArgValGlnArgGlyAspAsp-162 |
| SEQ. ID. NO. 35128 | 167-IleAspArgGluArgGlyLeuAlaAsp-175 |
| SEQ. ID. NO. 35129 | 189-HisIleSerAspArgPheAspGlnLysHisPheAla-200 |
| SEQ. ID. NO. 35130 | 202-CysLysLeuProHisArgAlaPhe-209 |
| SEQ. ID. NO. 35131 | 217-ProAspHisAspAsp-221 |
| SEQ. ID. NO. 35132 | 237-ArgHisGlnArgAlaSerArgIleLysTyrProGluThrAlaLeu-251 |
| SEQ. ID. NO. 35133 | 267-AsnGlnCysArgAlaArgArgHisPhe-275 |
| SEQ. ID. NO. 35134 | 278-ValPheAspLysHisArg-283 |
| SEQ. ID. NO. 35135 | 303-IleAsnArgArgAlaGluPhe-309 |
| SEQ. ID. NO. 35136 | 314-PheAspAsnThrAsp-318 |
| SEQ. ID. NO. 35137 | 325-AlaGluAlaAlaArgIleGlyLysAspAspGlyPheSer-337 |
| SEQ. ID. NO. 35138 | 367-ThrProHisArgArgArg-372 |
| g695 | |
| AMPHI Regions - AMPHI | |
| SEQ. ID. NO. 35139 | 34-GlnAsnSerGlnArg-38 |
| SEQ. ID. NO. 35140 | 41-SerLysProAlaGluArgTyrAlaAspCysProHis-52 |
| SEQ. ID. NO. 35141 | 83-AlaSerCysAlaSerValLeu-89 |
| SEQ. ID. NO. 35142 | 128-ValArgLeuSerAsnGluVal-134 |
| SEQ. ID. NO. 35143 | 157-ValGlnLysLeuAsp-161 |
| SEQ. ID. NO. 35144 | 182-ValGluThrAlaGlnAsnLeuTyrAsnGlnAlaLeuLysHisTyrGlnAsnGly-199 |
| SEQ. ID. NO. 35145 | 237-CysGluSerValIleGluIle-243 |
| SEQ. ID. NO. 35146 | 247-TyrAlaAsnArgPheLysAspSer-254 |
| SEQ. ID. NO. 35147 | 277-AlaArgAlaThrTrpArgSerLeuIleGlnThrTyrProGly-290 |
| Antigenic Index - Jameson-Wolf | |
| SEQ. ID. NO. 35148 | 1-LeuProGlnThrArgProAlaArgArgHisHisArgHisArgGlnTyrPheValGluArgLysGlyAspAlaArgSerGlyPhe-28 |
| SEQ. ID. NO. 35149 | 32-GlnCysGlnAsnSerGlnArgPheGlnSerLysProAlaGluArgTyrAlaAspCysProHisHisProAlaArgArgArgArgPheAspProAlaSerGluLysIleMetLysThrLys-71 |
| SEQ. ID. NO. 35150 | 90-ProValProGluGlySerArgThrGluMetProThrGlnGluAsnAlaSerAspGlyIleProTyr-111 |
| SEQ. ID. NO. 35151 | 116-LeuGlnAspArgLeuAspTyrLeuGlu-124 |
| SEQ. ID. NO. 35152 | 126-LysIleValArgLeuSerAsnGluValGluMetLeuAsnGlyLysValLysAlaLeuGluHisThrLysIleHisProSerGlyArgThrTyrValGlnLysLeuAspAspArgLysLeuLysGlu-167 |
| SEQ. ID. NO. 35153 | 169-TyrLeuAsnThrGluGlyGlySerAla-177 |
| SEQ. ID. NO. 35154 | 192-AlaLeuLysHisTyrGlnAsnGlyArg-200 |
| SEQ. ID. NO. 35155 | 208-LeuLysGlyAlaAspGlyGlyAspGlyGlySerIleAlaGln-221 |
| SEQ. ID. NO. 35156 | 229-GlnSerArgAlaArgMetGlyAsnCys-237 |
| SEQ. ID. NO. 35157 | 243-IleGlyGlyArgTyrAlaAsnArgPheLysAspSerProThrAla-257 |
| SEQ. ID. NO. 35158 | 265-GlyGluCysGlnTyr-269 |
| SEQ. ID. NO. 35159 | 271-LeuGlnGlnLysAspIleAla-277 |
| SEQ. ID. NO. 35160 | 288-TyrProGlySerProAlaAlaLysArgAlaAlaAlaAlaValArgLysArg-304 |
| Hydrophilic Regions - Hopp-Woods | |
| SEQ. ID. NO. 35161 | 2-ProGlnThrArgProAlaArgArgHisHisArgHisArg-14 |
| SEQ. ID. NO. 35162 | 17-PheValGluArgLysGlyAspAlaArgSer-26 |
| SEQ. ID. NO. 35163 | 35-AsnSerGlnArgPheGlnSerLysProAlaGluArgTyrAlaAsp-49 |
| SEQ. ID. NO. 35164 | 51-ProHisHisProAlaArgArgArgArgPheAspProAlaSerGluLysIleMetLysThrLys-71 |
| SEQ. ID. NO. 35165 | 92-ProGluGlySerArgThrGluMetProThrGlnGluAsnAlaSerAsp-107 |
| SEQ. ID. NO. 35166 | 116-LeuGlnAspArgLeuAspTyrLeuGlu-124 |
| SEQ. ID. NO. 35167 | 126-LysIleValArgLeuSerAsnGluValGluMetLeuAsnGlyLysValLysAlaLeuGluHisThrLysIleHisProSerGly-153 |
| SEQ. ID. NO. 35168 | 156-TyrValGlnLysLeuAspAspArgLysLeuLysGlu-167 |
| SEQ. ID. NO. 35169 | 209-LysGlyAlaAspGlyGlyAspGlyGlySerIleAlaGln-221 |
| SEQ. ID. NO. 35170 | 230-SerArgAlaArgMetGlyAsn-236 |
| SEQ. ID. NO. 35171 | 247-TyrAlaAsnArgPheLysAspSerProThrAla-257 |
| SEQ. ID. NO. 35172 | 265-GlyGluCysGlnTyr-269 |
| SEQ. ID. NO. 35173 | 271-LeuGlnGlnLysAspIleAla-277 |
| SEQ. ID. NO. 35174 | 292-ProAlaAlaLysArgAlaAlaAlaAlaValArgLysArg-304 |
| g700 | |
| AMPHI Regions - AMPHI | |
| SEQ. ID. NO. 35175 | 6-ThrLeuPheSerValLeuValProMetPheAlaGlyPhePheIleArgValProLys-24 |
| SEQ. ID. NO. 35176 | 51-ArgValGluAspLeuGlySerArg-58 |
| SEQ. ID. NO. 35177 | 80-AlaLeuAlaValLeuGlyLysLeu-87 |
| SEQ. ID. NO. 35178 | 189-GlyValSerTrpThrLysGlyLeu-196 |
| SEQ. ID. NO. 35179 | 204-TrpTyrSerLeuSerGlyLeuVal-211 |
| SEQ. ID. NO. 35180 | 216-TyrGlyAlaValTrp-220 |
| SEQ. ID. NO. 35181 | 228-AspLeuAlaArgGluLeu-233 |
| SEQ. ID. NO. 35182 | 268-GlyAlaGlyGlyLeu-272 |
| Antigenic Index - Jameson-Wolf | |
| SEQ. ID. NO. 35183 | 21-ArgValProLysProTyrLeuProAlaSerAspLysVal-33 |
| SEQ. ID. NO. 35184 | 50-SerArgValGluAspLeuGlySerArgLeuGlyAsp-61 |
| SEQ. ID. NO. 35185 | 88-SerProTrpArgIleGlyGlyLysGlyLysGlyVal-99 |
| SEQ. ID. NO. 35186 | 103-ValSerGlySerValArg-108 |
| SEQ. ID. NO. 35187 | 118-ValSerGlyLysLeuMet-123 |
| SEQ. ID. NO. 35188 | 128-MetProSerGluAsnAlaGlyMet-135 |
| SEQ. ID. NO. 35189 | 149-LeuLysSerSerGlyValSerLeu-156 |
| SEQ. ID. NO. 35190 | 160-LeuLeuAsnArgArgGlyIleArgLeu-168 |
| SEQ. ID. NO. 35191 | 245-ArgPheProAspAla-249 |
| SEQ. ID. NO. 35192 | 268-GlyAlaGlyGlyLeu-272 |

TABLE 1-continued

Hydrophilic Regions - Hopp-Woods
SEQ. ID. NO. 35193   29-AlaSerAspLysVal-33
SEQ. ID. NO. 35194   50-SerArgValGluAspLeuGlySerArgLeuGlyAsp-61
SEQ. ID. NO. 35195   92-IleGlyGlyLysGlyLysGlyVal-99
SEQ. ID. NO. 35196   149-LeuLysSerSerGlyValSer-155
SEQ. ID. NO. 35197   160-LeuLeuAsnArgArgGlyIleArg-167
g701
AMPHI Regions - AMPHI
SEQ. ID. NO. 35198   6-PheGlnValAlaGly-10
SEQ. ID. NO. 35199   30-CysLeuGluThrSer-34
SEQ. ID. NO. 35200   45-ProAsnSerPheAlaGlyPheLysArgPheSerSerIle-57
SEQ. ID. NO. 35201   79-GlyProAlaProAlaMet-84
SEQ. ID. NO. 35202   111-ArgAlaIleSerSerLeu-116
Antigenic Index - Jameson-Wolf
SEQ. ID. NO. 35203   17-AlaGlnSerThrProSerSerProThrMet-26
SEQ. ID. NO. 35204   29-ThrCysLeuGluThrSerProGluAlaGly-38
SEQ. ID. NO. 35205   52-LysArgPheSerSer-56
SEQ. ID. NO. 35206   72-AsnLysAlaAspIleProThrGlyProAla-81
SEQ. ID. NO. 35207   104-GlyLysAlaSerLeuAsnSerArgAla-112
SEQ. ID. NO. 35208   119-SerCysGlyGlyThrArgLeu-125
Hydrophilic Regions - Hopp-Woods
SEQ. ID. NO. 35209   72-AsnLysAlaAspIleProThr-78
g702
AMPHI Regions - AMPHI
SEQ. ID. NO. 35210   51-CysSerGlyLeuValThrValProAla-59
SEQ. ID. NO. 35211   74-AlaSerSerProThrGlyValArgLysValIle-84
Antigenic Index - Jameson-Wolf
SEQ. ID. NO. 35212   1-MetProCysSerLysAlaSerTrp-8
SEQ. ID. NO. 35213   10-SerProGlyValAla-14
SEQ. ID. NO. 35214   27-AlaLeuAlaArgAspSerCysLysProGlyLeu-37
SEQ. ID. NO. 35215   41-ThrAlaProAlaSerSer-46
SEQ. ID. NO. 35216   69-AlaIleArgArgMetAlaSerSerProThrGlyValArgLysValIleSer-85
SEQ. ID. NO. 35217   88-GlyMetProProSerThrArgAlaArgAspLysSerThrAla-101
SEQ. ID. NO. 35218   118-ArgIleSerArgGlyValSer-124
Hydrophilic Regions - Hopp-Woods
SEQ. ID. NO. 35219   27-AlaLeuAlaArgAspSerCysLys-34
SEQ. ID. NO. 35220   69-AlaIleArgArgMetAlaSer-75
SEQ. ID. NO. 35221   78-ThrGlyValArgLysValIleSer-85
SEQ. ID. NO. 35222   91-ProSerThrArgAlaArgAspLysSerThrAla-101
SEQ. ID. NO. 35223   118-ArgIleSerArgGlyValSer-124
g703
AMPHI Regions - AMPHI
SEQ. ID. NO. 35224   21-GlnThrLeuAlaThrValAsnGly-28
SEQ. ID. NO. 35225   64-GluValValAsnThrValValAlaGlnGlu-73
SEQ. ID. NO. 35226   79-LeuAspArgSerAlaGlu-84
SEQ. ID. NO. 35227   136-GlnGluValLysAlaValTyrAspAsnIleSerGlyPheTyrLysGly-151
SEQ. ID. NO. 35228   181-PheAspAlaValLeu-185
SEQ. ID. NO. 35229   204-ValProLeuLysAspLeuGluGlnGlyValProProLeuTyrGlnAlaIleLysAspLeuLysLys-225
SEQ. ID. NO. 35230   252-ValProSerPheAsp-256
SEQ. ID. NO. 35231   270-ArgIleAspArgAlaValCys-276
Antigenic Index - Jameson-Wolf
SEQ. ID. NO. 35232   1-MetLysAlaLysIle-5
SEQ. ID. NO. 35233   26-ValAsnGlyGlnLysIleAspSerSerVal-35
SEQ. ID. NO. 35234   43-PheArgAlaGluAsnSerArgAlaGluAspThrProGlnLeuArg-57
SEQ. ID. NO. 35235   72-GlnGluValLysArgLeuLysLeuAspArgSerAlaGluPheLysAspAlaLeuAlaLysLeuArgAlaGluAlaLysLysSerGlyAspAspLys
             LysProSerPheLysThr-109
SEQ. ID. NO. 35236   129-LysThrGlnProValSerGluGlnGluValLysAlaValTyr-142
SEQ. ID. NO. 35237   144-AsnIleSerGlyPheTyrLysGlyThrGlnGluValGlnLeu-157
SEQ. ID. NO. 35238   160-IleLeuThrAspLysGluGluAsnAlaLysLysAlaValAlaAspLeuLysAlaLysLysGlyPhe-181
SEQ. ID. NO. 35239   188-TyrSerLeuAsnAspArgThrLysArgThrGlyAlaProAspGlyTyrValPro-205
SEQ. ID. NO. 35240   207-LysAspLeuGluGlnGlyValProPro-215
SEQ. ID. NO. 35241   221-LysAspLeuLysLysGlyGluPheThrAlaThrProLeuLysAsnGlyAspPhe-238
SEQ. ID. NO. 35242   243-TyrValAsnAspSerArgGluValLysValProSerPheAspGluMetLysGly-260
SEQ. ID. NO. 35243   266-LeuGlnAlaGluArgIleAspArgAlaVal-275
SEQ. ID. NO. 35244   282-AlaAsnIleLysProAlaLys-288
Hydrophilic Regions - Hopp-Woods
SEQ. ID. NO. 35245   1-MetLysAlaLysIle-5
SEQ. ID. NO. 35246   29-GlnLysIleAspSerSerVal-35
SEQ. ID. NO. 35247   43-PheArgAlaGluAsnSerArgAlaGluAspThrProGlnLeuArg-57
SEQ. ID. NO. 35248   72-GlnGluValLysArgLeuLysLeuAspArgSerAlaGluPheLysAspAlaLeuAlaLysLeuArgAlaGluAlaLysLysSerGlyAspAspLysLys
             ProSerPhe-107
SEQ. ID. NO. 35249   131-GlnProValSerGluGlnGluValLysAlaValTyr-142
SEQ. ID. NO. 35250   160-IleLeuThrAspLysGluGluAsnAlaLysLysAlaValAlaAspLeuLysAlaLysLysGlyPhe-181
SEQ. ID. NO. 35251   189-SerLeuAsnAspArgThrLysArgThrGlyAla-199
SEQ. ID. NO. 35252   207-LysAspLeuGluGln-211
SEQ. ID. NO. 35253   221-LysAspLeuLysLysGlyGluPhe-228
SEQ. ID. NO. 35254   245-AsnAspSerArgGluValLysValProSerPheAspGluMetLysGly-260
SEQ. ID. NO. 35255   266-LeuGlnAlaGluArgIleAspArgAlaVal-275
SEQ. ID. NO. 35256   282-AlaAsnIleLysProAlaLys-288
g704

TABLE 1-continued

```
AMPHI Regions - AMPHI
SEQ. ID. NO. 35257    36-AlaValAlaGlnSerIleIleAspSerGlyLeuGly-47
SEQ. ID. NO. 35258    65-GlnGluIleLeuAspGlnIleArgLeuTyrAspLeuProGluValGlnSerAspPheValGluThrHis-87
SEQ. ID. NO. 35259    184-LeuGlyMetMetGln-188
SEQ. ID. NO. 35260    208-LeuGlnIleLeuHisTrpGlyGlyPheLeuMetValLeuPro-221
SEQ. ID. NO. 35261    232-GlnGlyAlaLeuArgAspLeuLys-239
SEQ. ID. NO. 35262    252-AlaIleIleMetThrPheIleAlaGlyIleTyrSer-263
SEQ. ID. NO. 35263    289-PheMetGluHisIleAlaArg-295
SEQ. ID. NO. 35264    298-AlaGlyAspAlaAlaGluArgLeuValLysLeuIleProAlaPheCysHisArgMetProGlyTyrProAlaValGlnAsp-324
SEQ. ID. NO. 35265    326-ArgGluSerAlaValVal-331
SEQ. ID. NO. 35266    400-GlyGlyThrArgLeuSerHisIleValArgLeuLeuAspArgAlaLeuAla-416
SEQ. ID. NO. 35267    423-GluLeuAlaGluGlnTyr-428
SEQ. ID. NO. 35268    499-AlaIleGluThrLeuSerGln-505
SEQ. ID. NO. 35269    527-IleGluLeuLeuGlySerMet-533
SEQ. ID. NO. 35270    574-GlnArgLeuAsnArgIleGlyGluGlyValGly-584
SEQ. ID. NO. 35271    639-LeuLysAspSerAlaAlaGluAlaValArgGlnLeuAla-651
SEQ. ID. NO. 35272    670-GluThrAlaArgAlaLeuGlyIle-677
SEQ. ID. NO. 35273    691-GluTyrValGluAlaLeuGlnLysGlu-699
SEQ. ID. NO. 35274    744-AspLeuArgThrValAlaHisLeuLeuAsp-753
SEQ. ID. NO. 35275    780-AlaValLeuGlyTyrValGlnProTrpIleAlaAla-791
SEQ. ID. NO. 35276    799-LeuAlaValLeuGly-803
Antigenic Index - Jameson-Wolf
SEQ. ID. NO. 35277    1-MetLysLysThrCys-5
SEQ. ID. NO. 35278    9-GlyLeuAspValProGluAsn-15
SEQ. ID. NO. 35279    20-ValArgTyrGluGlyGluAspArgGluThrCysCysValGly-33
SEQ. ID. NO. 35280    42-IleAspSerGlyLeuGlySerTyrTyrLysArgArgThrAlaAspAlaLysLysThrGluLeuProProGlnGluIleLeuAsp-69
SEQ. ID. NO. 35281    77-ProGluValGlnSerAspPheValGluThrHisAsnGlyThrHis-91
SEQ. ID. NO. 35282    112-GlnLeuLeuArgThrAspGlyIleVal-120
SEQ. ID. NO. 35283    124-LeuAsnTyrSerThrHisArgCys-131
SEQ. ID. NO. 35284    133-ValValTrpAspAspGlyLysIleArgLeu-142
SEQ. ID. NO. 35285    149-IleArgGlnThrGlyTyr-154
SEQ. ID. NO. 35286    158-ProTyrAspAlaGlnLysIleGluAlaAlaAsnGlnLysGluArgLysGlnTyr-175
SEQ. ID. NO. 35287    199-TyrGlyGlyAspIleGluProAspPhe-207
SEQ. ID. NO. 35288    234-AlaLeuArgAspLeuLysAsnArgArgAlaGlyMetAspThrPro-248
SEQ. ID. NO. 35289    293-IleAlaArgArgLysAlaGlyAspAlaAlaGluArgLeuVal-306
SEQ. ID. NO. 35290    315-ArgMetProGlyTyr-319
SEQ. ID. NO. 35291    323-GlnAspValArgGluSerAlaVal-330
SEQ. ID. NO. 35292    342-LysProGlyGluThrIleProValAspGlyThrVal-353
SEQ. ID. NO. 35293    355-GluGlyAsnSerAlaValAsnGluSer-363
SEQ. ID. NO. 35294    365-LeuThrGlyGluSer-369
SEQ. ID. NO. 35295    374-LysMetProSerGluLysValThrAla-382
SEQ. ID. NO. 35296    393-IleArgThrAspArgThrGlyGlyGlyThrArg-403
SEQ. ID. NO. 35297    414-AlaLeuAlaGlnLysProArgThrAlaGluLeuAlaGlu-426
SEQ. ID. NO. 35298    486-ThrLeuAlaArgGluGlyIle-492
SEQ. ID. NO. 35299    495-GlyGlyLysGlnAlaIle-500
SEQ. ID. NO. 35300    510-IlePheAspLysThrGlyThrLeuThrGlnGlyAsnProAlaValArgArgIleGluLeu-529
SEQ. ID. NO. 35301    544-SerLeuGluGlnGlnSerGluHisProLeu-553
SEQ. ID. NO. 35302    561-ArgIleSerGlyGlySerValPro-568
SEQ. ID. NO. 35303    571-GlnValGlyGlnArgLeuAsnArgIleGlyGluGlyVal-583
SEQ. ID. NO. 35304    589-ValAsnGlyGluThr-593
SEQ. ID. NO. 35305    605-AlaGluIleSerGlyLysGluProGlnThrGluGlyGlyGlySer-619
SEQ. ID. NO. 35306    635-LeuGlnAspProLeuLysAspSerAlaAlaGluAlaValArg-648
SEQ. ID. NO. 35307    650-LeuAlaGlyLysAsnLeu-655
SEQ. ID. NO. 35308    659-IleLeuSerGlyAspArgGluGluAlaValAlaGluThrAlaArg-673
SEQ. ID. NO. 35309    684-AlaMetProGluAspLysLeuGluTyr-692
SEQ. ID. NO. 35310    694-GluAlaLeuGlnLysGluGlyLysLys-702
SEQ. ID. NO. 35311    707-GlyAspGlyIleAsnAspAla-713
SEQ. ID. NO. 35312    727-GlyGlyThrAspIleAlaArgAspGlyAlaAsp-737
SEQ. ID. NO. 35313    743-GluAspLeuArgThr-747
SEQ. ID. NO. 35314    753-AspGlnAlaArgArgThrArgHisIleIle-762
SEQ. ID. NO. 35315    807-ArgLeuHisLysArgGlyGluMetProSerGluGln-818
Hydrophilic Regions - Hopp-Woods
SEQ. ID. NO. 35316    1-MetLysLysThrCys-5
SEQ. ID. NO. 35317    22-TyrGluGlyGluAspArgGluThrCys-30
SEQ. ID. NO. 35318    50-TyrLysArgArgThrAlaAspAlaLysLysThrGluLeuProPro-64
SEQ. ID. NO. 35319    77-ProGluValGlnSerAspPheValGlu-85
SEQ. ID. NO. 35320    87-HisAsnGlyThrHis-91
SEQ. ID. NO. 35321    112-GlnLeuLeuArgThrAspGlyIleVal-120
SEQ. ID. NO. 35322    133-ValValTrpAspAspGlyLysIleArgLeu-142
SEQ. ID. NO. 35323    160-AspAlaGlnLysIleGluAlaAlaAsnGlnLysGluArgLysGlnTyr-175
SEQ. ID. NO. 35324    201-GlyAspIleGluProAspPhe-207
SEQ. ID. NO. 35325    234-AlaLeuArgAspLeuLysAsnArgArgAlaGlyMet-245
SEQ. ID. NO. 35326    293-IleAlaArgArgLysAlaGlyAspAlaAlaGluArgLeuVal-306
SEQ. ID. NO. 35327    323-GlnAspValArgGluSerAlaVal-330
SEQ. ID. NO. 35328    375-MetProSerGluLysValThr-381
SEQ. ID. NO. 35329    393-IleArgThrAspArgThrGlyGlyGlyThrArg-403
SEQ. ID. NO. 35330    414-AlaLeuAlaGlnLysProArgThrAlaGluLeuAlaGlu-426
SEQ. ID. NO. 35331    486-ThrLeuAlaArgGluGlyIle-492
SEQ. ID. NO. 35332    522-ProAlaValArgArgIleGluLeu-529
SEQ. ID. NO. 35333    545-LeuGluGlnGlnSerGluHisProLeu-553
```

TABLE 1-continued

| | |
|---|---|
| SEQ. ID. NO. 35334 | 574-GlnArgLeuAsnArgIleGlyGlu-581 |
| SEQ. ID. NO. 35335 | 607-IleSerGlyLysGluProGlnThrGluGlyGlyGly-618 |
| SEQ. ID. NO. 35336 | 637-AspProLeuLysAspSerAlaAlaGluAlaValArg-648 |
| SEQ. ID. NO. 35337 | 661-SerGlyAspArgGluGluAlaValAlaGluThrAlaArg-673 |
| SEQ. ID. NO. 35338 | 684-AlaMetProGluAspLysLeuGluTyr-692 |
| SEQ. ID. NO. 35339 | 694-GluAlaLeuGlnLysGluGlyLysLys-702 |
| SEQ. ID. NO. 35340 | 730-AspIleAlaArgAspGlyAlaAsp-737 |
| SEQ. ID. NO. 35341 | 743-GluAspLeuArgThr-747 |
| SEQ. ID. NO. 35342 | 753-AspGlnAlaArgArgThrArgHisIleIle-762 |
| SEQ. ID. NO. 35343 | 807-ArgLeuHisLysArgGlyGluMetProSerGluGln-818 | g705
AMPHI Regions - AMPHI

| | |
|---|---|
| SEQ. ID. NO. 35344 | 67-LysCysLeuLeuLysLeu-72 |
| SEQ. ID. NO. 35345 | 104-AsnProIleProAla-108 |
| SEQ. ID. NO. 35346 | 147-TyrMetGlnThrPheArgArgIleValAlaProGln-158 |
| SEQ. ID. NO. 35347 | 169-AsnGluPheIleGlyLeuPheLysAsn-177 |
| SEQ. ID. NO. 35348 | 183-ValValThrValThrGluLeuPheArgValAlaGln-194 |
| SEQ. ID. NO. 35349 | 196-ThrAlaAsnArgThr-200 |

Antigenic Index - Jameson-Wolf

| | |
|---|---|
| SEQ. ID. NO. 35350 | 13-ThrGluThrArgAlaAspMet-19 |
| SEQ. ID. NO. 35351 | 132-ValProLysGlyGlnTrpGlu-138 |
| SEQ. ID. NO. 35352 | 165-ProProLeuSerAsnGlu-170 |
| SEQ. ID. NO. 35353 | 193-AlaGlnGluThrAlaAsnArgThrTyrAsp-202 |
| SEQ. ID. NO. 35354 | 226-AlaArgLeuGluLysArgPheAspArgTyrValAla-237 |

Hydrophilic Regions - Hopp-Woods

| | |
|---|---|
| SEQ. ID. NO. 35355 | 13-ThrGluThrArgAlaAspMet-19 |
| SEQ. ID. NO. 35356 | 193-AlaGlnGluThrAlaAsnArgThr-200 |
| SEQ. ID. NO. 35357 | 226-AlaArgLeuGluLysArgPheAspArgTyrValAla-237 | g706
AMPHI Regions - AMPHI

| | |
|---|---|
| SEQ. ID. NO. 35358 | 11-GlyArgTrpLeuAsnSerTyr-17 |
| SEQ. ID. NO. 35359 | 24-ArgLeuIleHisAlaValArg-30 |
| SEQ. ID. NO. 35360 | 39-ThrAlaLeuAlaArgLeuLeuHis-46 |
| SEQ. ID. NO. 35361 | 70-IleTyrSerAsnAlaValGluArgMetLeuGlyThrValIleGly-84 |
| SEQ. ID. NO. 35362 | 111-ThrAlaSerAlaLeuAlaGlyTrpAlaAla-120 |
| SEQ. ID. NO. 35363 | 153-ArgAlaMetAsnValLeu-158 |
| SEQ. ID. NO. 35364 | 183-LeuAlaAspAsnLeuAlaAspCysSerLysMetIleAlaGluIleSerAsnGlyArg-201 |
| SEQ. ID. NO. 35365 | 241-SerMetMetGluAlaMetGlnHisAlaHisArgLysIleVal-254 |
| SEQ. ID. NO. 35366 | 318-AlaLeuAlaGluHisLeuHis-324 |

Antigenic Index - Jameson-Wolf

| | |
|---|---|
| SEQ. ID. NO. 35367 | 1-MetAsnSerSerGlnArgLysArgLeuSerGlyArgTrpLeuAsnSerTyrGluArgTyrArgHisArgArgLeu-25 |
| SEQ. ID. NO. 35368 | 30-ArgLeuGlyGlyThr-34 |
| SEQ. ID. NO. 35369 | 71-TyrSerAsnAlaValGluArgMetLeu-79 |
| SEQ. ID. NO. 35370 | 97-HisTyrPheHisGlyAsnLeu-103 |
| SEQ. ID. NO. 35371 | 122-GlyLysAsnGlyTyrVal-127 |
| SEQ. ID. NO. 35372 | 140-GlyAspAsnGlySerGluTrpLeuAsp-148 |
| SEQ. ID. NO. 35373 | 186-AsnLeuAlaAspCysSerLysMetIleAlaGluIleSerAsnGlyArgArgMetThrArgGluArgLeuGluGlnAsnMetValLysMetArgGlnIleAsn-219 |
| SEQ. ID. NO. 35374 | 221-ArgMetValLysSerArgSerHisLeuAlaAlaThrSerGlyGluSerArgIleSerProSerMet-242 |
| SEQ. ID. NO. 35375 | 249-AlaHisArgLysIleValAsn-255 |
| SEQ. ID. NO. 35376 | 266-LysLeuGlnSerProLysLeuAsnGlySerGluIleArgLeuLeuAsp-281 |
| SEQ. ID. NO. 35377 | 289-ThrAspLeuGlnGln-293 |
| SEQ. ID. NO. 35378 | 300-GlyArgHisAlaArgArgIleArgIleAspThrAlaIleAsnProGluLeuGluAlaLeuAla-320 |
| SEQ. ID. NO. 35379 | 334-SerThrAsnMetArgGlnGluIle-341 |
| SEQ. ID. NO. 35380 | 349-GlnArgThrArgArgLysTrpLeuAspAlaHisGluArgGlnHisLeu-364 |
| SEQ. ID. NO. 35381 | 367-SerLeuLeuGluThrArgGluHisGly-375 |

Hydrophilic Regions - Hopp-Woods

| | |
|---|---|
| SEQ. ID. NO. 35382 | 3-SerSerGlnArgLysArgLeuSer-10 |
| SEQ. ID. NO. 35383 | 17-TyrGluArgTyrArgHisArgArgLeu-25 |
| SEQ. ID. NO. 35384 | 74-AlaValGluArgMetLeu-79 |
| SEQ. ID. NO. 35385 | 142-AsnGlySerGluTrpLeu-147 |
| SEQ. ID. NO. 35386 | 186-AsnLeuAlaAspCysSerLysMetIleAla-195 |
| SEQ. ID. NO. 35387 | 198-SerAsnGlyArgArgMetThrArgGluArgLeuGluGlnAsnMetValLysMetArgGlnIleAsn-219 |
| SEQ. ID. NO. 35388 | 221-ArgMetValLysSerArgSerHis-228 |
| SEQ. ID. NO. 35389 | 232-ThrSerGlyGluSerArgIleSer-239 |
| SEQ. ID. NO. 35390 | 249-AlaHisArgLysIleValAsn-255 |
| SEQ. ID. NO. 35391 | 266-LysLeuGlnSerProLysLeuAsnGlySerGluIleArgLeuLeuAsp-281 |
| SEQ. ID. NO. 35392 | 301-ArgHisAlaArgArgIleArgIle-308 |
| SEQ. ID. NO. 35393 | 314-ProGluLeuGluAlaLeuAla-320 |
| SEQ. ID. NO. 35394 | 336-AsnMetArgGlnGluIle-341 |
| SEQ. ID. NO. 35395 | 349-GlnArgThrArgArgLysTrpLeuAspAlaHisGluArgGlnHisLeu-364 |
| SEQ. ID. NO. 35396 | 367-SerLeuLeuGluThrArgGluHisGly-375 | g707
AMPHI Regions - AMPHI

| | |
|---|---|
| SEQ. ID. NO. 35397 | 36-GlyIleGluLysMetAlaThrGln-43 |
| SEQ. ID. NO. 35398 | 91-HisAlaGlyAspIleAsnGlnIleMetSerLeu-101 |
| SEQ. ID. NO. 35399 | 116-IleLeuAlaAlaPro-120 |
| SEQ. ID. NO. 35400 | 134-ProGlyTyrLeuArgSerIleArgIle-142 |
| SEQ. ID. NO. 35401 | 168-AspLeuLeuAsnLeuArgAsp-174 |
| SEQ. ID. NO. 35402 | 182-LeuLysCysLeuPro-186 |

TABLE 1-continued

| | |
|---|---|
| SEQ. ID. NO. 35403 | 208-ValGlnTrpArgArgLeuLeuPro-215 |
| SEQ. ID. NO. 35404 | 248-SerAspMetPheTyr-252 |
| SEQ. ID. NO. 35405 | 256-GlyArgSerIleGlyGly-261 |
| SEQ. ID. NO. 35406 | 301-ArgTyrHisGlnAlaValSerGlyLeuSerGluValTyrAsp-314 |
| SEQ. ID. NO. 35407 | 368-TrpLeuAlaGluLeuSerHis-374 |
| SEQ. ID. NO. 35408 | 393-ThrGlyMetLysAspAlaLeuArgAlaProGluGluAlaPheGlyGluGly-409 |
| SEQ. ID. NO. 35409 | 440-HisAlaGlnTrpAsnLys-445 |
| SEQ. ID. NO. 35410 | 542-LeuLysLysProGluTyrPhe-548 |
| Antigenic Index - Jameson-Wolf | |
| SEQ. ID. NO. 35411 | 1-GluAlaValSerGlnGlnGlnAspIleLeuGlnArgGlnArgGluLysGlnLeuArgGluGlnMetGlnProGluGlnAspValArgLeuAspGlyThr AspThrGlyIleGluLysMetAla-41 |
| SEQ. ID. NO. 35412 | 44-ValGlyGlyAlaAsnSerAspGluAlaSerProCys-55 |
| SEQ. ID. NO. 35413 | 62-GluLeuValGlyGluGluAlaAlaLys-70 |
| SEQ. ID. NO. 35414 | 120-ProGlnAspLeuAsnSerGlyLysLeu-128 |
| SEQ. ID. NO. 35415 | 140-IleArgIleAspArgSerAsnAspAspGlnThrHis-151 |
| SEQ. ID. NO. 35416 | 160-AsnLysPheProThrArgSerAsnAspLeuLeuAsn-171 |
| SEQ. ID. NO. 35417 | 173-ArgAspLeuGluGlnGlyLeuGluAsn-181 |
| SEQ. ID. NO. 35418 | 188-AlaGluAlaAspLeu-192 |
| SEQ. ID. NO. 35419 | 196-ProValGluArgGluProAsnGlnSerAsp-205 |
| SEQ. ID. NO. 35420 | 221-GlyMetAspAsnSerGlySerGluAlaThrGlyLysTyrGlnGly-235 |
| SEQ. ID. NO. 35421 | 241-AlaAspAsnProPheGlyLeu-247 |
| SEQ. ID. NO. 35422 | 255-TyrGlyArgSerIleGlyGlyThrProAspGluGluAsnPheAspGlyHisArgLysGluGlyGlySerAsn-278 |
| SEQ. ID. NO. 35423 | 297-HisAsnGlyTyrArg-301 |
| SEQ. ID. NO. 35424 | 311-GluValTyrAspTyrAsnGlyLysSerTyrAsnThrAspPheGlyPhe-326 |
| SEQ. ID. NO. 35425 | 330-LeuTyrArgAspAlaLysArgLysThrTyrLeu-340 |
| SEQ. ID. NO. 35426 | 345-TrpThrArgGluThrLysSerTyrIleAspAspAlaGluLeuThrValGlnArgArgLysThrThr-366 |
| SEQ. ID. NO. 35427 | 372-LeuSerHisLysGlyTyrIleGlyArgSerThrAlaAspPheLysLeuLysTyrLysHisGlyThrGlyMetLysAspAlaLeuArgAlaProGlu GluAlaPheGlyGluGlyThrSerArg-412 |
| SEQ. ID. NO. 35428 | 419-SerAlaAspValAsnThrPro-425 |
| SEQ. ID. NO. 35429 | 442-GlnTrpAsnLysThrProLeuThrSerGlnAspLysLeuAla-455 |
| SEQ. ID. NO. 35430 | 460-HisThrValArgGlyPheAspGlyGluMetSerLeuProAlaGluArgGlyTrpTyrTrpArgAsnAspLeuSerTrpGlnPheLysProGlyHis-491 |
| SEQ. ID. NO. 35431 | 503-SerGlyGlnSerAlaLys-508 |
| SEQ. ID. NO. 35432 | 540-ArgAlaLeuLysLysProGluTyrPheGlnThrLysLysTrpValThr-555 |
| Hydrophilic Regions - Hopp-Woods | |
| SEQ. ID. NO. 35433 | 1-GluAlaValSerGlnGlnGlnAspIleLeuGlnArgGlnArgGluLysGlnLeuArgGluGlnMetGlnProGluGlnAspValArgLeuAspGlyThr AspThrGlyIleGluLysMetAla-41 |
| SEQ. ID. NO. 35434 | 47-AlaAsnSerAspGluAlaSer-53 |
| SEQ. ID. NO. 35435 | 62-GluLeuValGlyGluGluAlaAlaLys-70 |
| SEQ. ID. NO. 35436 | 121-GlnAspLeuAsnSerGlyLys-127 |
| SEQ. ID. NO. 35437 | 140-IleArgIleAspArgSerAsnAspAspGlnThrHis-151 |
| SEQ. ID. NO. 35438 | 162-PheProThrArgSerAsnAsp-168 |
| SEQ. ID. NO. 35439 | 173-ArgAspLeuGluGlnGlyLeuGluAsn-181 |
| SEQ. ID. NO. 35440 | 188-AlaGluAlaAspLeu-192 |
| SEQ. ID. NO. 35441 | 196-ProValGluArgGluProAsnGlnSer-204 |
| SEQ. ID. NO. 35442 | 222-MetAspAsnSerGlySerGluAlaThrGlyLysTyr-233 |
| SEQ. ID. NO. 35443 | 259-IleGlyGlyThrProAspGluGluAsnPheAspGlyHisArgLysGluGlyGlySer-277 |
| SEQ. ID. NO. 35444 | 313-TyrAspTyrAsnGly-317 |
| SEQ. ID. NO. 35445 | 330-LeuTyrArgAspAlaLysArgLysThrTyrLeu-340 |
| SEQ. ID. NO. 35446 | 345-TrpThrArgGluThrLysSerTyrIleAspAspAlaGluLeuThrValGlnArgArgLysThrThr-366 |
| SEQ. ID. NO. 35447 | 381-SerThrAlaAspPheLysLeuLysTyrLysHis-391 |
| SEQ. ID. NO. 35448 | 393-ThrGlyMetLysAspAlaLeuArgAlaProGluGluAlaPheGly-40 |
| SEQ. ID. NO. 35449 | 447-ProLeuThrSerGlnAspLysLeuAla-455 |
| SEQ. ID. NO. 35450 | 463-ArgGlyPheAspGlyGluMet-469 |
| SEQ. ID. NO. 35451 | 540-ArgAlaLeuLysLysProGluTyrPheGln-549 |
| g708 | |
| AMPHI Regions - AMPHI | |
| SEQ. ID. NO. 35452 | 26-ProSerArgAlaGluLysAlaAsnGlnValSerAsnIle-38 |
| SEQ. ID. NO. 35453 | 56-ThrAlaSerIleGluAspAlaLeuLysSerAsnPro-67 |
| SEQ. ID. NO. 35454 | 79-IleTyrGlnTyrLeuLys-84 |
| SEQ. ID. NO. 35455 | 89-AlaGlnGluSerPhe-93 |
| SEQ. ID. NO. 35456 | 119-AsnArgProAlaGluSerMetAla-126 |
| SEQ. ID. NO. 35457 | 128-PheAspLysAlaLeu-132 |
| SEQ. ID. NO. 35458 | 142-IleAlaAsnLeuAsnLys-147 |
| SEQ. ID. NO. 35459 | 176-ProAlaPheLysGluLeuAlaArg-183 |
| SEQ. ID. NO. 35460 | 221-LysAlaLeuGlyAsnValGlnAla-228 |
| Antigenic Index - Jameson-Wolf | |
| SEQ. ID. NO. 35461 | 2-ProPheLysProSerLysArgIleSer-10 |
| SEQ. ID. NO. 35462 | 19-AlaCysSerThrSerTyrArgProSerArgAlaGluLysAlaAsnGln-34 |
| SEQ. ID. NO. 35463 | 46-TyrMetArgGlyGlnAspTyrArgGlnAlaThrAlaSerIleGluAspAlaLeuLysSerAsnProLysAsnGluLeu-71 |
| SEQ. ID. NO. 35464 | 84-LysValAsnAspLysAlaGlnGluSerPheArg-94 |
| SEQ. ID. NO. 35465 | 97-LeuSerIleLysProAspSerAlaGluIleAsnAsnAsnTyrGlyTrp-112 |
| SEQ. ID. NO. 35466 | 115-CysGlyArgLeuAsnArgProAlaGlu-123 |
| SEQ. ID. NO. 35467 | 131-AlaLeuAlaAspProThrTyrProThr-139 |
| SEQ. ID. NO. 35468 | 145-LeuAsnLysGlyIleCysSerAlaLysGlnGlyGln-156 |
| SEQ. ID. NO. 35469 | 176-ProAlaPheLysGluLeuAlaArgThrLysMet-186 |
| SEQ. ID. NO. 35470 | 191-LeuGlyAspAlaAspTyrTyrPheLysLysTyrGlnSerArgValGluValLeuGlnAlaAspAspLeu-213 |
| SEQ. ID. NO. 35471 | 240-PheProTyrSerGluGluLeuGln-247 |
| Hydrophilic Regions - Hopp-Woods | |
| SEQ. ID. NO. 35472 | 4-LysProSerLysArgIle-9 |
| SEQ. ID. NO. 35473 | 24-TyrArgProSerArgAlaGluLysAlaAsnGln-34 |

TABLE 1-continued

| | |
|---|---|
| SEQ. ID. NO. 35474 | 46-TyrMetArgGlyGlnAspTyrArgGln-54 |
| SEQ. ID. NO. 35475 | 56-ThrAlaSerIleGluAspAlaLeuLysSerAsnProLysAsnGlu-70 |
| SEQ. ID. NO. 35476 | 84-LysValAsnAspLysAlaGlnGluSerPheArg-94 |
| SEQ. ID. NO. 35477 | 99-IleLysProAspSerAlaGluIle-106 |
| SEQ. ID. NO. 35478 | 117-ArgLeuAsnArgProAlaGlu-123 |
| SEQ. ID. NO. 35479 | 149-IleCysSerAlaLysGlnGly-155 |
| SEQ. ID. NO. 35480 | 177-AlaPheLysGluLeuAlaArgThrLysMet-186 |
| SEQ. ID. NO. 35481 | 201-TyrGlnSerArgValGluValLeuGlnAlaAspAspLeu-213 | g709
AMPHI Regions - AMPHI

| | |
|---|---|
| SEQ. ID. NO. 35482 | 6-SerLeuLeuAspMetProArgGlyGlu-14 |
| SEQ. ID. NO. 35483 | 18-ValValValAlaLeuIleAlaAlaMetGly-27 |
| SEQ. ID. NO. 35484 | 37-ProHisMetSerIleIleAlaAlaIleValValLeu-48 |
| SEQ. ID. NO. 35485 | 54-AlaArgGlyLeuLysTyr-59 |
| SEQ. ID. NO. 35486 | 67-IleGlyAlaLeuAsnGlnGlyMet-74 |
| SEQ. ID. NO. 35487 | 115-SerAlaPheAlaLeuCysSerVal-122 |
| SEQ. ID. NO. 35488 | 130-SerLeuThrAlaCysAla-135 |
| SEQ. ID. NO. 35489 | 171-ProLeuSerAspThr-175 |
| SEQ. ID. NO. 35490 | 185-IleAspLeuPheGluHisIleLysAsnMetMetTyrThrThr-198 |
| SEQ. ID. NO. 35491 | 221-LeuAsnSerValGluSerPheArg-228 |
| SEQ. ID. NO. 35492 | 245-PheAlaLeuLeuValValLeu-251 |
| SEQ. ID. NO. 35493 | 261-AlaMetLeuPheThrValIleAlaAlaValAlaValThrTyr-274 |
| SEQ. ID. NO. 35494 | 278-ThrProAspLeuArgGlnLeuGlyAlaTrpPhe-288 |
| SEQ. ID. NO. 35495 | 298-AlaPheLysAspIleAlaLysLeuIleSerArgGlyGly-310 |
| SEQ. ID. NO. 35496 | 334-LeuGlyValIleProSerLeuLeuGluAlaValArgThrPheLeuThr-349 |
| SEQ. ID. NO. 35497 | 382-ThrPheLysProVal-386 |
| SEQ. ID. NO. 35498 | 396-AsnLeuSerArgThrLeuGluAspAlaGlyThrValIleAsnProLeuValProTrpSerValCysGlyValPheIleSerHis-423 |

Antigenic Index - Jameson-Wolf

| | |
|---|---|
| SEQ. ID. NO. 35499 | 8-LeuAspMetProArgGlyGluAla-15 |
| SEQ. ID. NO. 35500 | 55-ArgGlyLeuLysTyrAsnAspMetGln-63 |
| SEQ. ID. NO. 35501 | 165-PheGlyAspLysMetSerProLeuSerAspThrThrGly-177 |
| SEQ. ID. NO. 35502 | 222-AsnSerValGluSerPheArgSerGlnLeuGlu-232 |
| SEQ. ID. NO. 35503 | 277-SerThrProAspLeuArgGln-283 |
| SEQ. ID. NO. 35504 | 290-GlyGlyTyrLysLeuGluGlyGluAlaPheLysAspIleAlaLysLeuIleSerArgGlyGlyLeuGlu-312 |
| SEQ. ID. NO. 35505 | 349-ThrAsnAlaGlyArgAlaThr-355 |
| SEQ. ID. NO. 35506 | 378-LeuSerGlyGluThrPheLysProValTyrAspLysLeuGly-391 |
| SEQ. ID. NO. 35507 | 396-AsnLeuSerArgThrLeuGluAspAlaGlyThr-406 |

Hydrophilic Regions - Hopp-Woods

| | |
|---|---|
| SEQ. ID. NO. 35508 | 8-LeuAspMetProArgGlyGluAla-15 |
| SEQ. ID. NO. 35509 | 57-LeuLysTyrAsnAsp-61 |
| SEQ. ID. NO. 35510 | 167-AspLysMetSerProLeuSerAsp-174 |
| SEQ. ID. NO. 35511 | 225-GluSerPheArgSerGlnLeuGlu-232 |
| SEQ. ID. NO. 35512 | 279-ProAspLeuArgGln-283 |
| SEQ. ID. NO. 35513 | 293-LysLeuGluGlyGluAlaPheLysAspIleAlaLysLeuIleSer-307 |
| SEQ. ID. NO. 35514 | 399-ArgThrLeuGluAspAlaGly-405 | g716
AMPHI Regions - AMPHI

| | |
|---|---|
| SEQ. ID. NO. 35515 | 33-GlyValGlnLysSerAlaGlnGly-40 |
| SEQ. ID. NO. 35516 | 81-AlaThrValLysLysAlaHisLysHisThrLysAla-92 |

Antigenic Index - Jameson-Wolf

| | |
|---|---|
| SEQ. ID. NO. 35517 | 1-MetAsnLysAsnIle-5 |
| SEQ. ID. NO. 35518 | 26-LysProAlaSerAsnAlaThrGlyValGlnLysSerAlaGlnGlySerCysGlyAlaSerLysSerAlaGluGlySerCysGlyAlaSerLysSerAlaGluGlySerCysGly-63 |
| SEQ. ID. NO. 35519 | 65-AlaAlaSerLysAlaGlyGluGlyLysCysGlyGluGlyLysCysGlyAlaThrValLysLysAlaHisLysHisThrLysAlaSerLysAlaLysAlaLysSerAlaGluGlyLysCysGlyGluGlyLysCysGlySerLys-112 |

Hydrophilic Regions - Hopp-Woods

| | |
|---|---|
| SEQ. ID. NO. 35520 | 33-GlyValGlnLysSerAlaGln-39 |
| SEQ. ID. NO. 35521 | 43-GlyAlaSerLysSerAlaGluGlySerCysGlyAlaSerLysSerAlaGluGlySerCys-62 |
| SEQ. ID. NO. 35522 | 65-AlaAlaSerLysAlaGlyGluGlyLysCysGlyGluGlyLysCys-79 |
| SEQ. ID. NO. 35523 | 81-AlaThrValLysLysAlaHisLysHisThrLysAlaSerLysAlaLysAlaLysSerAlaGluGlyLysCysGlyGluGlyLysCysGlySerLys-112 | g717
AMPHI Regions - AMPHI

| | |
|---|---|
| SEQ. ID. NO. 35524 | 87-AlaAlaIleAlaAla-91 |
| SEQ. ID. NO. 35525 | 174-ThrAlaValTyrAlaLeuAlaAsn-181 |
| SEQ. ID. NO. 35526 | 209-LeuHisArgGlyLeu-213 |
| SEQ. ID. NO. 35527 | 223-SerLeuAlaTyrTrp-227 |
| SEQ. ID. NO. 35528 | 241-AlaGlyLeuGluGlnLeuGly-247 |
| SEQ. ID. NO. 35529 | 263-GlnSerIlePheSerThrValTrpThrProTyrIlePheArgAlaIleGluGlu-280 |
| SEQ. ID. NO. 35530 | 305-ThrGlyIlePheSerProLeuAlaSer-313 |
| SEQ. ID. NO. 35531 | 347-LeuAsnValValArgLysThr-353 |
| SEQ. ID. NO. 35532 | 358-LeuAlaThrLeuGlyAlaLeuAla-365 |
| SEQ. ID. NO. 35533 | 401-SerSerCysArgLeuTrpGlnProLeuLysArgLeu-412 |
| SEQ. ID. NO. 35534 | 430-CysPheGlyThrPro-434 |
| SEQ. ID. NO. 35535 | 442-GlyValTrpAlaAlaTyrLeuAlaGly-450 |
| SEQ. ID. NO. 35536 | 457-LysAsnLeuHisLysLeuPheHisTyr-465 |

Antigenic Index - Jameson-Wolf

| | |
|---|---|
| SEQ. ID. NO. 35537 | 1-MetAspThrLysGlu-5 |
| SEQ. ID. NO. 35538 | 32-ProAlaAspAspIleGlyArg-38 |
| SEQ. ID. NO. 35539 | 69-AlaAspLysAspThrLeu-74 |
| SEQ. ID. NO. 35540 | 95-SerArgProSerLeuProSerGluIle-103 |

TABLE 1-continued

| | |
|---|---|
| SEQ. ID. NO. 35541 | 135-MetGluGlyArgAla-139 |
| SEQ. ID. NO. 35542 | 192-AsnArgCysArgLeuLysAlaValArgArgAlaProPheSer-205 |
| SEQ. ID. NO. 35543 | 231-SerAlaAspArgLeuPheLeu-237 |
| SEQ. ID. NO. 35544 | 277-AlaIleGluGluAsnAlaThrProAlaArgLeu-287 |
| SEQ. ID. NO. 35545 | 289-AlaThrAlaGluSer-293 |
| SEQ. ID. NO. 35546 | 317-ProGluAsnTyrAla-321 |
| SEQ. ID. NO. 35547 | 349-ValValArgLysThrArgProIleAla-357 |
| SEQ. ID. NO. 35548 | 376-ProSerGlyGlyThrArgGlyAla-383 |
| SEQ. ID. NO. 35549 | 398-LysThrGluSerSerCysArgLeu-405 |
| SEQ. ID. NO. 35550 | 453-LeuArgHisArgLysAsnLeu-459 |
| Hydrophilic Regions - Hopp-Woods | |
| SEQ. ID. NO. 35551 | 1-MetAspThrLysGlu-5 |
| SEQ. ID. NO. 35552 | 69-AlaAspLysAspThrLeu-74 |
| SEQ. ID. NO. 35553 | 135-MetGluGlyArgAla-139 |
| SEQ. ID. NO. 35554 | 192-AsnArgCysArgLeuLysAlaValArgArgAlaPro-203 |
| SEQ. ID. NO. 35555 | 277-AlaIleGluGluAsnAlaThrProAlaArgLeu-287 |
| SEQ. ID. NO. 35556 | 289-AlaThrAlaGluSer-293 |
| SEQ. ID. NO. 35557 | 349-ValValArgLysThrArgPro-355 |
| SEQ. ID. NO. 35558 | 378-GlyGlyThrArgGly-382 |
| SEQ. ID. NO. 35559 | 399-ThrGluSerSerCys-403 |
| SEQ. ID. NO. 35560 | 453-LeuArgHisArgLysAsnLeu-459 |
| g728 | |
| AMPHI Regions - AMPHI | |
| SEQ. ID. NO. 35561 | 11-SerPhePheAlaLeuValPheAla-18 |
| SEQ. ID. NO. 35562 | 39-AlaThrGluValProGluAsnPro-46 |
| SEQ. ID. NO. 35563 | 48-AlaPheValAlaLysLeuAlaArgLeuPheArgAsnAla-60 |
| SEQ. ID. NO. 35564 | 74-GluGluSerLeuAlaGlyAlaValAspAsp-83 |
| SEQ. ID. NO. 35565 | 167-HisGlyGluAsnTyrGluThr-173 |
| SEQ. ID. NO. 35566 | 198-GluAspValTyrGluHisCysLeuGlyCysTyrGlnMet-210 |
| SEQ. ID. NO. 35567 | 218-TyrArgAspValAlaAsn-223 |
| SEQ. ID. NO. 35568 | 235-SerAsnArgIleAlaSer-240 |
| SEQ. ID. NO. 35569 | 251-MetArgGluLeuMetProArg-257 |
| SEQ. ID. NO. 35570 | 355-GluLysGluValSerArgTyrAlaGluAlaAlaAlaArg-367 |
| Antigenic Index - Jameson-Wolf | |
| SEQ. ID. NO. 35571 | 29-IleAsnProArgTrp-33 |
| SEQ. ID. NO. 35572 | 35-LeuSerAspThrAlaThrGluValProGluAsnProAsnAla-48 |
| SEQ. ID. NO. 35573 | 57-PheArgAsnAlaAspArgAla-63 |
| SEQ. ID. NO. 35574 | 67-ValLysGluSerMetArgThrGluGluSerLeu-77 |
| SEQ. ID. NO. 35575 | 80-AlaValAspAspGlyProLeuGlnSerGluLysAspTyr-92 |
| SEQ. ID. NO. 35576 | 98-ArgLeuSerArgLeuLysGluLysAlaLys-107 |
| SEQ. ID. NO. 35577 | 112-ThrGluGlnGluHisGlyGlu-118 |
| SEQ. ID. NO. 35578 | 125-TyrIleGlyGluGlyGly-130 |
| SEQ. ID. NO. 35579 | 136-LeuSerGlnArgSerProGluAlaPheVal-145 |
| SEQ. ID. NO. 35580 | 149-TyrLeuTyrArgAsnAspArgProPheSer-158 |
| SEQ. ID. NO. 35581 | 166-AlaHisGlyGluAsnTyrGluThrThrGlyGluTyrArgVal-179 |
| SEQ. ID. NO. 35582 | 182-GlnProAspGlySerVal-187 |
| SEQ. ID. NO. 35583 | 190-AlaAlaGlyArgGlyLysIleGlyGluAspValTyr-201 |
| SEQ. ID. NO. 35584 | 217-LysTyrArgAspValAlaAsnAspGluGlnLysValTrpAspPheArgGluGluSerAsnArgIleAlaSerAspSerArgAspTyrVal-246 |
| SEQ. ID. NO. 35585 | 250-AsnMetArgGluLeuMetProArgGlyMetLysAlaAsnSer-263 |
| SEQ. ID. NO. 35586 | 267-GlyTyrAspAlaAspGlyLeuProLysLeuLys-276 |
| SEQ. ID. NO. 35587 | 280-SerPheAspAsnGlyLysLysArgGlnSerPheGluTyrTyrLeuLysAsnGlyAsn-298 |
| SEQ. ID. NO. 35588 | 309-LeuLysAlaAspGlyValThr-315 |
| SEQ. ID. NO. 35589 | 329-LeuAspGlyGlyArgIleIleArgGluGluLysGlnGlyAspArgLeuProAspPhe-347 |
| SEQ. ID. NO. 35590 | 349-LeuAsnLeuGluAspLeuGluLysGluValSerArgTyrAlaGluAlaAlaAlaArgArgSerGlyGlyArgArgGlyLeuSerHis-377 |
| Hydrophilic Regions - Hopp-Woods | |
| SEQ. ID. NO. 35591 | 38-ThrAlaThrGluValProGluAsnPro-46 |
| SEQ. ID. NO. 35592 | 57-PheArgAsnAlaAspArgAla-63 |
| SEQ. ID. NO. 35593 | 67-ValLysGluSerMetArgThrGluGluSerLeu-77 |
| SEQ. ID. NO. 35594 | 80-AlaValAspAspGlyProLeuGlnSerGluLysAspTyr-92 |
| SEQ. ID. NO. 35595 | 98-ArgLeuSerArgLeuLysGluLysAlaLys-107 |
| SEQ. ID. NO. 35596 | 112-ThrGluGlnGluHisGlyGlu-118 |
| SEQ. ID. NO. 35597 | 136-LeuSerGlnArgSerProGlu-142 |
| SEQ. ID. NO. 35598 | 151-TyrArgAsnAspArgProPhe-157 |
| SEQ. ID. NO. 35599 | 169-GluAsnTyrGluThrThrGlyGluTyr-177 |
| SEQ. ID. NO. 35600 | 190-AlaAlaGlyArgGlyLysIleGlyGluAspValTyr-201 |
| SEQ. ID. NO. 35601 | 217LysTyrArgAspValAlaAsnAspGluGlnLysValTrpAspPheArgGluGluSerAsnArgIleAlaSerAspSerArgAsp-244 |
| SEQ. ID. NO. 35602 | 250-AsnMetArgGluLeuMetProArgGlyMetLys-260 |
| SEQ. ID. NO. 35603 | 268-TyrAspAlaAspGlyLeuPro-274 |
| SEQ. ID. NO. 35604 | 282-AspAsnGlyLysLysArgGlnSer-289 |
| SEQ. ID. NO. 35605 | 309-LeuLysAlaAspGlyValThr-315 |
| SEQ. ID. NO. 35606 | 331-GlyGlyArgIleIleArgGluGluLysGlnGlyAspArgLeuPro-345 |
| SEQ. ID. NO. 35607 | 349-LeuAsnLeuGluAspLeuGluLysGluValSerArgTyrAlaGluAlaAlaAlaArgArgSerGlyGlyArgArgGlyLeuSer-376 |
| g729 | |
| AMPHI Regions - AMPHI | |
| SEQ. ID. NO. 35608 | 21-CysThrMetIleProGlnTyr-27 |
| SEQ. ID. NO. 35609 | 55-HisAspTyrPheAla-59 |
| SEQ. ID. NO. 35610 | 61-ProArgLeuGlnLysLeuIleAspIle-69 |
| SEQ. ID. NO. 35611 | 149-GlnGlyTyrPheAla-153 |
| SEQ. ID. NO. 35612 | 242-LeuAlaThrLeuIleAsn-247 |
| SEQ. ID. NO. 35613 | 250-IleProGluAspLeuProAla-256 |

| | |
|---|---|
| SEQ. ID. NO. 35614 | 268-LysLeuProAlaGlyLeu-273 |
| SEQ. ID. NO. 35615 | 321-GluLeuGlyGlyLeuPheLysSerGly-329 |
| SEQ. ID. NO. 35616 | 371-ValGlnSerAlaPheGlnAspValAlaAsnAla-381 |
| SEQ. ID. NO. 35617 | 388-LeuAspLysAlaTyrAspAlaLeuSerLysGlnSerArg-400 |
| SEQ. ID. NO. 35618 | 419-GlyAlaLeuAspLeuLeuAspAlaGlu-427 |
| SEQ. ID. NO. 35619 | 442-LeuThrArgAlaGluAsnLeuAlaAspLeuTyrLysAlaLeuAspGlyGlyLeu-459 |
| Antigenic Index - Jameson-Wolf | |
| SEQ. ID. NO. 35620 | 25-ProGlnTyrGluGlnProLysValGluVal-34 |
| SEQ. ID. NO. 35621 | 36-GluThrPheGlnAsnAspThrSerValSerSer-46 |
| SEQ. ID. NO. 35622 | 53-GlyTrpHisAspTyrPheAlaAspProArgLeuGlnLys-65 |
| SEQ. ID. NO. 35623 | 70-AlaLeuGluArgAsnThrSerLeuArgThr-79 |
| SEQ. ID. NO. 35624 | 85-GluIleTyrArgLysGlnTyrMetIleGluArgAsnAsnLeuLeuPro-100 |
| SEQ. ID. NO. 35625 | 106-AlaAsnGlySerArgGlnGlySerLeuSerGlyGlyAsnValSerSerSerTyrAsn-124 |
| SEQ. ID. NO. 35626 | 138-GlyArgValArgSerAsnSerGluAlaAla-147 |
| SEQ. ID. NO. 35627 | 156-AlaAsnArgAspAlaAla-161 |
| SEQ. ID. NO. 35628 | 173-TyrPheAsnGluArgTyrAlaGluLysAlaMet-183 |
| SEQ. ID. NO. 35629 | 188-ArgValLeuLysThrArgGluGluThrTyrLysLeuSerGluLeuArgTyr-204 |
| SEQ. ID. NO. 35630 | 215-ArgGlnGlnGluAlaLeuIleGluSerAlaLysAlaAspTyr-228 |
| SEQ. ID. NO. 35631 | 232-AlaArgSerArgGluGlnAlaArgAsn-240 |
| SEQ. ID. NO. 35632 | 247-AsnArgProIleProGluAspLeuProAla-256 |
| SEQ. ID. NO. 35633 | 277-ValLeuLeuAspArgProAspIleArgAlaAlaGluHisAlaLeuLysGlnAlaAsnAla-296 |
| SEQ. ID. NO. 35634 | 310-ArgLeuThrGlySerValGlyThrGlySer-319 |
| SEQ. ID. NO. 35635 | 326-PheLysSerGlyThr-330 |
| SEQ. ID. NO. 35636 | 347-GlyThrAsnLysAlaAsnLeuAspValAlaLysLeuArgGlnGln-361 |
| SEQ. ID. NO. 35637 | 383-AlaAlaArgGluGlnLeuAspLysAlaTyrAspAlaLeuSerLysGlnSerArgAlaSerLysGluAlaLeuArg-407 |
| SEQ. ID. NO. 35638 | 411-LeuArgTyrLysHisGlyValSer-418 |
| SEQ. ID. NO. 35639 | 424-LeuAspAlaGluArgIleSerTyrSerAlaGluGly-435 |
| SEQ. ID. NO. 35640 | 442-LeuThrArgAlaGluAsnLeu-448 |
| SEQ. ID. NO. 35641 | 455-LeuAspGlyGlyLeuLysArgAspThrGlnThrGlyLys-467 |
| Hydrophilic Regions - Hopp-Woods | |
| SEQ. ID. NO. 35642 | 28-GluGlnProLysValGluVal-34 |
| SEQ. ID. NO. 35643 | 42-ThrSerValSerSer-46 |
| SEQ. ID. NO. 35644 | 61-ProArgLeuGlnLys-65 |
| SEQ. ID. NO. 35645 | 70-AlaLeuGluArgAsnThrSerLeu-77 |
| SEQ. ID. NO. 35646 | 91-TyrMetIleGluArgAsnAsn-97 |
| SEQ. ID. NO. 35647 | 107-AsnGlySerArgGlnGlySer-113 |
| SEQ. ID. NO. 35648 | 138-GlyArgValArgSerAsnSerGluAlaAla-147 |
| SEQ. ID. NO. 35649 | 156-AlaAsnArgAspAlaAla-161 |
| SEQ. ID. NO. 35650 | 177-ArgTyrAlaGluLysAlaMet-183 |
| SEQ. ID. NO. 35651 | 188-ArgValLeuLysThrArgGluGluThrTyrLys-198 |
| SEQ. ID. NO. 35652 | 200-SerGluLeuArgTyr-204 |
| SEQ. ID. NO. 35653 | 215-ArgGlnGlnGluAlaLeuIleGluSerAlaLysAlaAspTyr-228 |
| SEQ. ID. NO. 35654 | 232-AlaArgSerArgGluGlnAlaArgAsn-240 |
| SEQ. ID. NO. 35655 | 249-ProIleProGluAspLeuPro-255 |
| SEQ. ID. NO. 35656 | 277-ValLeuLeuAspArgProAspIleArgAlaAlaGluHisAlaLeuLysGlnAlaAsn-295 |
| SEQ. ID. NO. 35657 | 350-LysAlaAsnLeuAspValAlaLysLeuArgGln-360 |
| SEQ. ID. NO. 35658 | 383-AlaAlaArgGluGlnLeuAspLysAlaTyrAspAlaLeuSerLysGlnSerArgAlaSerLysGluAlaLeuArg-407 |
| SEQ. ID. NO. 35659 | 424-LeuAspAlaGluArgIleSerTyr-431 |
| SEQ. ID. NO. 35660 | 442-LeuThrArgAlaGluAsnLeu-448 |
| SEQ. ID. NO. 35661 | 455-LeuAspGlyGlyLeuLysArgAspThrGlnThrGlyLys-467 |
| g730 | |
| AMPHI Regions - AMPHI | |
| SEQ. ID. NO. 35662 | 6-ArgLeuThrAsnLeuLeuAlaAlaCysAla-15 |
| SEQ. ID. NO. 35663 | 26-LeuAlaAlaAspLeu-30 |
| SEQ. ID. NO. 35664 | 67-LysIleAsnValIleGlnAspTyrThrHisGln-77 |
| SEQ. ID. NO. 35665 | 111-AsnHisAlaAlaAsp-115 |
| SEQ. ID. NO. 35666 | 141-HisProAlaAspAlaTyrAspGlyProLysGlyGlyAsnTyrProLysProThr-158 |
| SEQ. ID. NO. 35667 | 187-GlnArgIlePheAspAsnTyrAsnAsnLeuGlySerAsnPheSerAspArgAlaAspGlu-206 |
| SEQ. ID. NO. 35668 | 214-HisAsnAlaLysLeu-218 |
| SEQ. ID. NO. 35669 | 220-ArgTrpGlyAsnSerMetGluPheValAsnGlyValAla-232 |
| SEQ. ID. NO. 35670 | 234-GlyAlaLeuAsnProPheIleSer-241 |
| SEQ. ID. NO. 35671 | 262-AlaAlaMetArgAsnIleAla-268 |
| SEQ. ID. NO. 35672 | 277-AlaAlaIleGlyGlyLeuGlySerAla-285 |
| SEQ. ID. NO. 35673 | 288-PheGluLysAsnThrArgGluAlaValAspArgTrpIleGlnGlu-302 |
| SEQ. ID. NO. 35674 | 305-AsnAlaAlaGluThrValGluAlaLeuValAsnValLeuProPheAlaLysValLysAsnLeuThrLysAlaAlaLysPro-331 |
| SEQ. ID. NO. 35675 | 353-LeuValLysThrAlaAspGlyTyrLysAlaIleAlaHisIleGlnAla-368 |
| SEQ. ID. NO. 35676 | 390-ArgTyrGlyAsnProTyr-395 |
| SEQ. ID. NO. 35677 | 403-ValSerAspGlyIle-407 |
| SEQ. ID. NO. 35678 | 434-LysAlaGlySerArgLeuLeuSerGluSer-443 |
| SEQ. ID. NO. 35679 | 458-ProLeuLysAlaTyr-462 |
| SEQ. ID. NO. 35680 | 510-AspSerHisArgSerValGlyAspSerAsnArgValValArgGluGlyLys-526 |
| SEQ. ID. NO. 35681 | 553-GlnValThrGlnPheLys-558 |
| Antigenic Index - Jameson-Wolf | |
| SEQ. ID. NO. 35682 | 2-LysProLeuArgArgLeuThr-8 |
| SEQ. ID. NO. 35683 | 35-PheIleThrAspAsnThrGlnArgGlnHisTyrGluProGlyGlyLys-50 |
| SEQ. ID. NO. 35684 | 55-GlyAspProArgGlySerValSerAspArgThrGlyLysIleAsnVal-70 |
| SEQ. ID. NO. 35685 | 99-SerGlyHisGlyHisGluGluHisAlaProPheAsp-110 |
| SEQ. ID. NO. 35686 | 112-HisAlaAlaAspSerAlaSerGluGluLysGlyAsnValAspAspGlyPhe-128 |
| SEQ. ID. NO. 35687 | 133-LeuAsnTrpGluGlyHisGluHisHisProAlaAspAlaTyrAspGlyProLysGlyGlyAsnTyrProLysProThrGlyAlaArgAspGluTyrThrTyrHisVal-168 |

TABLE 1-continued

| SEQ. ID. NO. | Sequence |
|---|---|
| SEQ. ID. NO. 35688 | 170-GlyThrAlaArgSerIleLysLeuAsnProThrAspThrArgSerIleArgGlnArgIle-189 |
| SEQ. ID. NO. 35689 | 191-AspAsnTyrAsnAsnLeuGlySerAsnPheSerAspArgAlaAspGluAlaAsnArgLysMetPheGluHisAsnAlaLysLeuAspArgTrpGlyAsnSer-224 |
| SEQ. ID. NO. 35690 | 257-TyrAlaIleAspLysAlaAlaMet-264 |
| SEQ. ID. NO. 35691 | 271-ProAlaGluGlyLysPhe-276 |
| SEQ. ID. NO. 35692 | 287-GlyPheGluLysAsnThrArgGluAlaValAsp-297 |
| SEQ. ID. NO. 35693 | 299-TrpIleGlnGluAsnProAsnAlaAlaGluThrValGlu-311 |
| SEQ. ID. NO. 35694 | 323-LysAsnLeuThrLysAlaAlaLysProGlyLysAlaAlaValSerGlyAspPheSerLysSerTyr-344 |
| SEQ. ID. NO. 35695 | 355-LysThrAlaAspGlyTyrLys-361 |
| SEQ. ID. NO. 35696 | 367-GlnAlaGlyAspArgValLeuSerLysAspGluAlaSerGlyGluThrGlyTyrLysProValThrAlaArgTyrGlyAsnProTyrGlnGlu-397 |
| SEQ. ID. NO. 35697 | 403-ValSerAspGlyIleGlyAsnSer-410 |
| SEQ. ID. NO. 35698 | 422-TyrSerAspGlyLysTrpIleLysAlaGluAspLeuLysAlaGlySerArgLeuLeuSerGluSerGlyLysThrGlnThr-448 |
| SEQ. ID. NO. 35699 | 453-ValValLysProLysProLeuLys-460 |
| SEQ. ID. NO. 35700 | 474-ValLysGlyAsnGlnAlaGluThrGlu-482 |
| SEQ. ID. NO. 35701 | 487-HisAsnAspCysProProLysProLysProThrAsnHisAlaGlnGlnArgLysGluGluAlaLysAsnAspSerHisArgSerValGlyAspSerAsnArgValValArgGluGlyLysGlnTyrLeuAspSerAspThrGlyAsn-535 |
| SEQ. ID. NO. 35702 | 538-TyrValLysGlyAspLysVal-544 |
| SEQ. ID. NO. 35703 | 547-LeuThrProAspGlyArgGlnValThrGlnPheLysAsnSerLysAlaAsnThrSerLysArgValLysAsnGlyLysTrpThrProLys-576 |
| Hydrophilic Regions - Hopp-Woods | |
| SEQ. ID. NO. 35704 | 2-LysProLeuArgArgLeuThr-8 |
| SEQ. ID. NO. 35705 | 39-AsnThrGlnArgGlnHisTyrGluProGlyGly-49 |
| SEQ. ID. NO. 35706 | 55-GlyAspProArgGlySerValSerAspArgThrGlyLys-67 |
| SEQ. ID. NO. 35707 | 102-GlyHisGluGluHisAlaPro-108 |
| SEQ. ID. NO. 35708 | 112-HisAlaAlaAspSerAlaSerGluGluLysGlyAsnValAspAspGly-127 |
| SEQ. ID. NO. 35709 | 135-TrpGluGlyHisGluHisPro-142 |
| SEQ. ID. NO. 35710 | 144-AspAlaTyrAspGlyProLysGlyGlyAsnTyrProLys-156 |
| SEQ. ID. NO. 35711 | 158-ThrGlyAlaArgAspGluTyr-164 |
| SEQ. ID. NO. 35712 | 170-GlyThrAlaArgSerIleLys-176 |
| SEQ. ID. NO. 35713 | 178-AsnProThrAspThrArgSerIleArgGlnArgIle-189 |
| SEQ. ID. NO. 35714 | 200-PheSerAspArgAlaAspGluAlaAsnArgLysMetPheGluHisAsnlaLysLeuAspArgTrpGlyAsn-223 |
| SEQ. ID. NO. 35715 | 257-TyrAlaIleAspLysAlaAlaMet-264 |
| SEQ. ID. NO. 35716 | 271-ProAlaGluGlyLysPhe-276 |
| SEQ. ID. NO. 35717 | 287-GlyPheGluLysAsnThrArgGluAlaValAsp-297 |
| SEQ. ID. NO. 35718 | 303-AsnProAsnAlaAlaGluThrValGlu-311 |
| SEQ. ID. NO. 35719 | 323-LysAsnLeuThrLysAlaAlaLysProGlyLysAlaAlaVal-336 |
| SEQ. ID. NO. 35720 | 355-LysThrAlaAspGlyTyrLys-361 |
| SEQ. ID. NO. 35721 | 368-AlaGlyAspArgValLeuSerLysAspGluAlaSerGlyGluThrGlyTyr-384 |
| SEQ. ID. NO. 35722 | 403-ValSerAspGlyIleGly-408 |
| SEQ. ID. NO. 35723 | 426-LysTrpIleLysAlaGluAspLeuLysAlaGlySer-437 |
| SEQ. ID. NO. 35724 | 439-LeuLeuSerGluSerGlyLysThrGlnThr-448 |
| SEQ. ID. NO. 35725 | 453-ValValLysProLysProLeuLys-460 |
| SEQ. ID. NO. 35726 | 477-AsnGlnAlaGluThrGlu-482 |
| SEQ. ID. NO. 35727 | 489-AspCysProProLysProLysProThrAsn-498 |
| SEQ. ID. NO. 35728 | 500-AlaGlnGlnArgLysGluGluAlaLysAsnAspSerHisArgSerValGlyAspSerAsnArgValValArgGluGlyLysGlnTyrLeuAspSerAspThrGly-534 |
| SEQ. ID. NO. 35729 | 539-ValLysGlyAspLys-543 |
| SEQ. ID. NO. 35730 | 549-ProAspGlyArgGln-553 |
| SEQ. ID. NO. 35731 | 558-LysAsnSerLysAlaAsnThrSerLysArgValLysAsnGlyLysTrpThrPro-575 |
| g731 | |
| AMPHI Regions - AMPHI | |
| SEQ. ID. NO. 35732 | 17-AlaCysAlaValProGluAlaTyrAspGlyGly-27 |
| SEQ. ID. NO. 35733 | 40-GlyProAspAspPheArgAlaPheSerCys-49 |
| Antigenic Index - Jameson-Wolf | |
| SEQ. ID. NO. 35734 | 22-GluAlaTyrAspGlyGlyGlyArgGlyTyr-31 |
| SEQ. ID. NO. 35735 | 33-ProProValGlnAsnGlnAlaGlyProAspAspPheArgAla-46 |
| SEQ. ID. NO. 35736 | 48-SerCysGluAsnGlyLeu-53 |
| SEQ. ID. NO. 35737 | 55-ValArgValArgAsnLeuAspGlyGlyLysIleAlaLeuArgLeuAspGlyArgArgAlaValLeuSerSerAspValAlaAlaSerGlyGluArgTyrThrAla-89 |
| SEQ. ID. NO. 35738 | 92-GlyLeuPheGlyAsnGlyThrGluTrpHisGlnLysGlyGlyGluAla-107 |
| SEQ. ID. NO. 35739 | 113-AspAlaTyrGlyAsnSerValGluThrSerCysArgAlaArg-126 |
| Hydrophilic Regions - Hopp-Woods | |
| SEQ. ID. NO. 35740 | 22-GluAlaTyrAspGlyGlyGly-28 |
| SEQ. ID. NO. 35741 | 39-AlaGlyProAspAspPheArg-45 |
| SEQ. ID. NO. 35742 | 55-ValArgValArgAsnLeuAspGlyGlyLysIleAlaLeuArgLeuAspGlyArgArgAlaValLeu-76 |
| SEQ. ID. NO. 35743 | 80-ValAlaAlaSerGlyGluArgTyrThrAla-89 |
| SEQ. ID. NO. 35744 | 100-TrpHisGlnLysGlyGlyGlu-106 |
| SEQ. ID. NO. 35745 | 119-ValGluThrSerCysArgAlaArg-126 |
| g732 | |
| AMPHI Regions - AMPHI | |
| SEQ. ID. NO. 35746 | 14-LeuGlyAlaIleSer-18 |
| SEQ. ID. NO. 35747 | 43-ValGlnSerIleArgThrMetAlaGluValTyrGly-54 |
| SEQ. ID. NO. 35748 | 66-AspAlaAspLeuPheGluGlyAlaMetLysGlyMetVal-78 |
| SEQ. ID. NO. 35749 | 95-GluIleLysGluSerThrSerGly-102 |
| SEQ. ID. NO. 35750 | 115-AspGlyPheValLysValValSerProIleGluAsp-126 |
| SEQ. ID. NO. 35751 | 155-GluAlaValLysLysMet-160 |
| SEQ. ID. NO. 35752 | 183-ValAsnLeuThrArg-187 |
| SEQ. ID. NO. 35753 | 214-GluArgThrValGluSerValAsnThrAlaAlaLys-225 |
| SEQ. ID. NO. 35754 | 283-LysAlaValProGluAspTyrValTyr-291 |
| SEQ. ID. NO. 35755 | 293-MetGlyGlyAspProLeuAlaGlyIleProAlaGluLeu-305 |
| SEQ. ID. NO. 35756 | 322-SerGluIleValAlaGly-327 |

TABLE 1-continued

| | |
|---|---|
| SEQ. ID. NO. 35757 | 400-LeuValGlyHisIleGlyAsn-406 |
| SEQ. ID. NO. 35758 | 446-ArgArgIleProAsnProAlaLysAsp-454 |
| SEQ. ID. NO. 35759 | 459-LysAlaLeuAspLeuValLysSerProGluGlnTrpGlnLysSerLeu-474 |
| Antigenic Index - Jameson-Wolf | |
| SEQ. ID. NO. 35760 | 30-AlaAlaGluLysAspGlyArgAspAsnGluVal-40 |
| SEQ. ID. NO. 35761 | 59-AsnTyrTyrHisAspLysProAspAlaAspLeuPhe-70 |
| SEQ. ID. NO. 35762 | 82-AspProHisSerGluTyrMetAspLysLysGlyTyrAlaGluIleLysGluSerThrSerGlyGluPheGlyGly-106 |
| SEQ. ID. NO. 35763 | 111-IleGlyGlnGluAspGlyPhe-117 |
| SEQ. ID. NO. 35764 | 122-SerProIleGluAspThrProAlaGluArgAlaGluValLysSerGlyAspPhe-139 |
| SEQ. ID. NO. 35765 | 144-AspAsnValSerThrArgGlyMetThr-152 |
| SEQ. ID. NO. 35766 | 155-GluAlaValLysLysMetArgGlyLysProGlyThrLysIle-168 |
| SEQ. ID. NO. 35767 | 172-LeuSerArgLysAsnAlaAspLysProIle-181 |
| SEQ. ID. NO. 35768 | 199-LeuIleGluProAspTyrGlyTyr-206 |
| SEQ. ID. NO. 35769 | 211-GlnPheGlnGluArgThrValGlu-218 |
| SEQ. ID. NO. 35770 | 221-AsnThrAlaAlaLysGluLeuValLysGluAsnLysGlyLysProLeuLys-237 |
| SEQ. ID. NO. 35771 | 242-AspLeuArgAspAspProGlyGlyLeu-250 |
| SEQ. ID. NO. 35772 | 269-ValSerThrLysGlyArgAspGlyLysAspGlyMetVal-281 |
| SEQ. ID. NO. 35773 | 284-AlaValProGluAspTyr-289 |
| SEQ. ID. NO. 35774 | 293-MetGlyGlyAspPro-297 |
| SEQ. ID. NO. 35775 | 303-AlaGluLeuLysThr-307 |
| SEQ. ID. NO. 35776 | 316-SerGlySerAlaSerAla-321 |
| SEQ. ID. NO. 35777 | 330-GlnAspHisLysArgAlaVal-336 |
| SEQ. ID. NO. 35778 | 340-ThrGlnSerPheGlyLysGlySerVal-348 |
| SEQ. ID. NO. 35779 | 354-LeuSerAsnGlySer-358 |
| SEQ. ID. NO. 35780 | 368-TyrThrProAsnAspArgSerIleGln-376 |
| SEQ. ID. NO. 35781 | 384-ValGluValLysAspLysGluArgThrPheGluSerArgGluAlaAspLeu-400 |
| SEQ. ID. NO. 35782 | 405-GlyAsnProLeuGlyGlyGluAspValAsnSerGlu-416 |
| SEQ. ID. NO. 35783 | 421-ProLeuGluLysAspAlaAspLysProAlaAlaLysGluLysGlyLysLysLysLysLysAspGluAspLeuSerSerArgArgIleProAsnProAla LysAspAspGlnLeuArgLysAlaLeuAspLeuValLysSerProGluGlnTrpGlnLys-472 |
| SEQ. ID. NO. 35784 | 477-AlaAlaLysLysProValSerAsnLysAspLysLysAspLysLys-491 |
| Hydrophilic Regions - Hopp-Woods | |
| SEQ. ID. NO. 35785 | 30-AlaAlaGluLysAspGlyArgAspAsnGluVal-40 |
| SEQ. ID. NO. 35786 | 60-TyrTyrHisAspLysProAspAlaAspLeuPhe-70 |
| SEQ. ID. NO. 35787 | 82-AspProHisSerGluTyrMetAspLysLysGlyTyrAlaGluIleLysGluSerThrSerGlyGlu-103 |
| SEQ. ID. NO. 35788 | 111-IleGlyGlnGluAspGlyPhe-117 |
| SEQ. ID. NO. 35789 | 122-SerProIleGluAspThrProAlaGluArgAlaGluValLysSerGlyAspPhe-139 |
| SEQ. ID. NO. 35790 | 144-AspAsnValSerThr-148 |
| SEQ. ID. NO. 35791 | 155-GluAlaValLysLysMetArgGlyLysProGlyThr-166 |
| SEQ. ID. NO. 35792 | 172-LeuSerArgLysAsnAlaAspLysProIle-181 |
| SEQ. ID. NO. 35793 | 211-GlnPheGlnGluArgThrValGlu-218 |
| SEQ. ID. NO. 35794 | 221-AsnThrAlaAlaLysGluLeuValLysGluAsnLysGlyLysProLeuLys-237 |
| SEQ. ID. NO. 35795 | 242-AspLeuArgAspAspProGly-248 |
| SEQ. ID. NO. 35796 | 271-ThrLysGlyArgAspGlyLysAspGlyMetVal-281 |
| SEQ. ID. NO. 35797 | 303-AlaGluLeuLysThr-307 |
| SEQ. ID. NO. 35798 | 330-GlnAspHisLysArgAlaVal-336 |
| SEQ. ID. NO. 35799 | 370-ProAsnAspArgSerIleGln-376 |
| SEQ. ID. NO. 35800 | 384-ValGluValLysAspLysGluArgThrPheGluSerArgGluAlaAspLeu-400 |
| SEQ. ID. NO. 35801 | 408-LeuGlyGlyGluAspValAsnSer-415 |
| SEQ. ID. NO. 35802 | 421-ProLeuGluLysAspAlaAspLysProAlaAlaLysGluLysGlyLysLysLysLysLysAspGluAspLeuSerSerArgArgIleProAsnProAla LysAspAspGlnLeuArgLysAlaLeuAspLeuValLysSerProGluGlnTrpGln-471 |
| SEQ. ID. NO. 35803 | 477-AlaAlaLysLysProValSerAsnLysAspLysLysAspLysLys-491 |
| g733 | |
| AMPHI Regions - AMPHI | |
| SEQ. ID. NO. 35804 | 6-ThrLeuGlyArgLeuSer-11 |
| SEQ. ID. NO. 35805 | 16-ValLeuAlaLeuThrAla-21 |
| SEQ. ID. NO. 35806 | 33-TyrGlyGlyTyrProAspThrValTyrGluGly-43 |
| SEQ. ID. NO. 35807 | 53-LysGlnThrGluLysMetGluLysTyrPheAlaGluAlaAlaAsn-67 |
| SEQ. ID. NO. 35808 | 92-GlyAlaPheArgGlnPheGluGlu-99 |
| Antigenic Index - Jameson-Wolf | |
| SEQ. ID. NO. 35809 | 2-MetAsnProLysThrLeuGly-8 |
| SEQ. ID. NO. 35810 | 23-AlaGlyGlyGlyHisLys-28 |
| SEQ. ID. NO. 35811 | 32-TyrTyrGlyGlyTyrProAspThrValTyrGluGlyLeuLysAsnAspAspThrSerLeuGlyLysGlnThrGluLysMetGluLysTyrPhe-62 |
| SEQ. ID. NO. 35812 | 65-AlaAlaAsnLysLysMetAsnAlaAlaProGlyAla-76 |
| SEQ. ID. NO. 35813 | 84-LeuSerArgSerGlyAspLysGluGlyAlaPheArgGlnPheGluGluGluLysArgLeuPheProGlu-106 |
| SEQ. ID. NO. 35814 | 115-MetLysThrGlyLysGlyGlyLysArg-123 |
| Hydrophilic Regions - Hopp-Woods | |
| SEQ. ID. NO. 35815 | 40-ValTyrGluGlyLeuLysAsnAspAspThrSerLeuGlyLysGlnThrGluLysMetGluLysTyrPhe-62 |
| SEQ. ID. NO. 35816 | 65-AlaAlaAsnLysLysMetAsnAla-72 |
| SEQ. ID. NO. 35817 | 86-ArgSerGlyAspLysGluGlyAlaPheArgGlnPheGluGluGluLysArgLeuPhePro-105 |
| SEQ. ID. NO. 35818 | 115-MetLysThrGlyLysGlyGlyLysArg-123 |
| g734 | |
| AMPHI Regions - AMPHI | |
| SEQ. ID. NO. 35819 | 26-TyrLeuAlaValTrpGlnAsnProGlnAspAlaAsnAspValLeuGlnVal-42 |
| SEQ. ID. NO. 35820 | 53-GluAlaPheAlaGluLeuGluAlaPheCysLys-63 |
| SEQ. ID. NO. 35821 | 77-ThrGlyCysArgSerValValSer-84 |
| SEQ. ID. NO. 35822 | 92-LeuAlaTyrProLysAlaLeuGlyAlaMetArg-102 |
| SEQ. ID. NO. 35823 | 113-ArgPheThrSerVal-117 |
| SEQ. ID. NO. 35824 | 121-AlaLeuAsnGlnCysIleLysLys-128 |

TABLE 1-continued

```
Antigenic Index - Jameson-Wolf
SEQ. ID. NO. 35825    31-GlnAsnProGlnAspAlaAsnAspValLeuGln-41
SEQ. ID. NO. 35826    43-LysThrThrLysGluAspSerAlaLysSerGluAlaPheAlaGlu-57
SEQ. ID. NO. 35827    60-AlaPheCysLysGlyGlnAspThr-67
SEQ. ID. NO. 35828    71-IleAlaGluAspGluProThrGlyCysArgSer-81
SEQ. ID. NO. 35829    101-MetArgValGluAsn-105
SEQ. ID. NO. 35830    111-SerProArgPheThrSer-116
SEQ. ID. NO. 35831    125-CysIleLysLysTyrGlyAlaGlnGly-133
SEQ. ID. NO. 35832    145-SerSerTyrTyrGly-149
Hydrophilic Regions - Hopp-Woods
SEQ. ID. NO. 35833    34-GlnAspAlaAsnAsp-38
SEQ. ID. NO. 35834    43-LysThrThrLysGluAspSerAlaLysSerGluAlaPheAlaGlu-57
SEQ. ID. NO. 35835    60-AlaPheCysLysGlyGlnAspThr-67
SEQ. ID. NO. 35836    71-IleAlaGluAspGluProThrGlyCys-79
SEQ. ID. NO. 35837    101-MetArgValGluAsn-105
SEQ. ID. NO. 35838    125-CysIleLysLysTyrGlyAla-131
g736
AMPHI Regions - AMPHI
SEQ. ID. NO. 35839    13-GlyLeuIleGlnSerPheGlySer-20
SEQ. ID. NO. 35840    50-GlyValLeuSerVal-54
SEQ. ID. NO. 35841    61-GlyLeuPheValGly-65
SEQ. ID. NO. 35842    70-LeuGlnGlyTyrThrGlnLeuSerLysPheLysSerAlaAspIle-84
SEQ. ID. NO. 35843    93-LeuLeuArgGluLeuGlyProVal-100
SEQ. ID. NO. 35844    120-LeuMetLysThrThrGlyGlnLeuGluAlaMetAsnValMet-133
SEQ. ID. NO. 35845    135-ValAsnProValAlaArgValVal-142
SEQ. ID. NO. 35846    144-ProArgPheTrpAlaGlyValPheSerMetPro-154
SEQ. ID. NO. 35847    156-LeuAlaSerIlePheAsnValAlaGlyIlePheGlyAla-168
SEQ. ID. NO. 35848    196-AspValIleAsnGlyLeu-201
SEQ. ID. NO. 35849    230-LeuArgAlaSerThrArgThr-236
Antigenic Index - Jameson-Wolf
SEQ. ID. NO. 35850    30-AlaLysSerGlyThrAlaPheAlaArgProArgLeuSerVal-43
SEQ. ID. NO. 35851    77-SerLysPheLysSer-81
SEQ. ID. NO. 35852    93-LeuLeuArgGluLeuGly-98
SEQ. ID. NO. 35853    109-SerAlaGlyGlyAlaMetThrSer-116
SEQ. ID. NO. 35854    186-GlnMetGlnAsnAsn-190
SEQ. ID. NO. 35855    224-ProThrSerGluGlyIleLeuArgAlaSerThr-234
Hydrophilic Regions - Hopp-Woods
SEQ. ID. NO. 35856    37-AlaArgProArgLeuSerVal-43
SEQ. ID. NO. 35857    77-SerLysPheLysSer-81
SEQ. ID. NO. 35858    93-LeuLeuArgGluLeuGly-98
g737
AMPHI Regions - AMPHI
SEQ. ID. NO. 35859    56-AlaAlaTrpAlaArgValGlyGly-63
Antigenic Index - Jameson-Wolf
SEQ. ID. NO. 35860    24-AlaHisHisAspGlyHisGlyAspAspAspHisGlyHis-36
SEQ. ID. NO. 35861    38-AlaHisGlnHisGlyLysGlnAspLysIleIleSer-49
SEQ. ID. NO. 35862    51-AlaGlnAlaGluLysAlaAla-57
SEQ. ID. NO. 35863    60-ArgValGlyGlyLysIleThrAspIleAspLeuGluHisAspAspGlyArgProHisTyrAspValGluIleValLysAsnGlyGlnGluTyr-90
SEQ. ID. NO. 35864    94-ValAspAlaArgThrGlyArgValIleSerSerArgArgAspAsp-108
Hydrophilic Regions - Hopp-Woods
SEQ. ID. NO. 35865    27-AspGlyHisGlyAspAspAspHisGlyHis-36
SEQ. ID. NO. 35866    40-GlnHisGlyLysGlnAspLysIleIleSer-49
SEQ. ID. NO. 35867    51-AlaGlnAlaGluLysAlaAla-57
SEQ. ID. NO. 35868    61-ValGlyGlyLysIleThrAspIleAspLeuGluHisAspAspGlyArgProHisTyr-79
SEQ. ID. NO. 35869    82-GluIleValLysAsnGlyGlnGluTyr-90
SEQ. ID. NO. 35870    94-ValAspAlaArgThrGlyArg-100
SEQ. ID. NO. 35871    102-IleSerSerArgArgAspAsp-108
g738
AMPHI Regions - AMPHI
SEQ. ID. NO. 35872    91-LeuMetAsnLeuIleTyrProGlyMetAsnAspIleAla-103
SEQ. ID. NO. 35873    139-IleGlySerLeuLeuGlnSerCysIle-147
SEQ. ID. NO. 35874    201-LysIleProAlaAlaLeu-206
SEQ. ID. NO. 35875    228-ThrTyrIleAlaAlaIleAlaLeuIle-236
SEQ. ID. NO. 35876    271-AlaIleLeuGluThrPheThrGlyIle-279
SEQ. ID. NO. 35877    285-ValGluArgValAlaAsnGlyGlyPheThrAspLeuProArgGlnSer-300
SEQ. ID. NO. 35878    304-LysAlaLeuAlaAlaPheGlnSer-311
SEQ. ID. NO. 35879    316-GlyHisGlyTrpAsnSerPheAla-323
SEQ. ID. NO. 35880    338-AspAsnPheLeuSerThrLeuPheThr-346
SEQ. ID. NO. 35881    353-LeuGlnLeuLeuAlaGlu-358
SEQ. ID. NO. 35882    371-LeuLeuThrGlyIleAlaGlyLeuLeuLysArg-381
SEQ. ID. NO. 35883    398-MetCysHisSerMetLeu-403
SEQ. ID. NO. 35884    461-ArgLeuValAsnSerPheSerPro-468
SEQ. ID. NO. 35885    472-AspSerAlaLysThrLeuAsnArgLys-480
SEQ. ID. NO. 35886    482-AsnGluLeuArgTyrIleSer-488
SEQ. ID. NO. 35887    507-LeuProGluTyrProGluThr-513
SEQ. ID. NO. 35888    549-AlaLysGlnTrpMetArgAlaThr-556
SEQ. ID. NO. 35889    567-TyrAlaAspGluIleArgLysLeuProVal-576
SEQ. ID. NO. 35890    579-ProLeuLeuProGluLeuLeuLysAspCysLysAlaPheAlaAlaAlaPro-595
```

TABLE 1-continued

```
Antigenic Index - Jameson-Wolf
SEQ. ID. NO. 35891    5-ThrThrValSerGlyAlaArgProAlaAla-14
SEQ. ID. NO. 35892    37-ArgLeuLysProSerProAspPheTyr-45
SEQ. ID. NO. 35893    62-AlaGlyLysLysLeuPheAsp-68
SEQ. ID. NO. 35894    124-TyrGlyGlnGluArgIle-129
SEQ. ID. NO. 35895    167-HisArgGlyGlnGly-171
SEQ. ID. NO. 35896    176-IleGlyGlnArgAsnAsnLeuGly-183
SEQ. ID. NO. 35897    196-LeuAsnGlyGlnArgLysIlePro-203
SEQ. ID. NO. 35898    242-PheArgSerAspLysSerAsnArgArgThrMet-252
SEQ. ID. NO. 35899    283-ThrAlaValGluArgValAlaAsnGlyGlyPheThrAspLeuProArgGlnSerGluTrpAsn-303
SEQ. ID. NO. 35900    316-GlyHisGlyTrpAsnSerPheAla-323
SEQ. ID. NO. 35901    335-ThrIleHisAspAsnPhe-340
SEQ. ID. NO. 35902    378-LeuLeuLysArgSerLeuThrProAlaSer-387
SEQ. ID. NO. 35903    424-ProAlaGluAlaSerAspGlyIleAlaPheLysLysAlaAla-437
SEQ. ID. NO. 35904    467-SerProAlaAlaAspAspSerAlaLysThrLeuAsnArgLysIleAsnGlu-483
SEQ. ID. NO. 35905    508-ProGluTyrProGluThrGlnThrTrpAlaGlu-518
SEQ. ID. NO. 35906    525-LeuLysTyrArgProTyrSerAla-532
SEQ. ID. NO. 35907    542-ArgGlnGlyLysValAlaGluAlaLysGlnTrpMet-553
SEQ. ID. NO. 35908    555-AlaThrGlnSerTyr-559
SEQ. ID. NO. 35909    566-ArgTyrAlaAspGluIleArgLys-573
SEQ. ID. NO. 35910    584-LeuLeuLysAspCysLysAla-590
SEQ. ID. NO. 35911    595-ProGlyHisProGluThrLysProCysLys-604
Hydrophilic Regions - Hopp-Woods
SEQ. ID. NO. 35912    5-ThrThrValSerGlyAlaArgProAlaAla-14
SEQ. ID. NO. 35913    38-LeuLysProSerPro-42
SEQ. ID. NO. 35914    62-AlaGlyLysLysLeuPheAsp-68
SEQ. ID. NO. 35915    125-GlyGlnGluArgIle-129
SEQ. ID. NO. 35916    177-GlyGlnArgAsnAsn-181
SEQ. ID. NO. 35917    198-GlyGlnArgLysIlePro-203
SEQ. ID. NO. 35918    243-ArgSerAspLysSerAsnArgArgThrMet-252
SEQ. ID. NO. 35919    283-ThrAlaValGluArgValAla-289
SEQ. ID. NO. 35920    295-AspLeuProArgGlnSerGluTrpAsn-303
SEQ. ID. NO. 35921    378-LeuLeuLysArgSerLeuThr-384
SEQ. ID. NO. 35922    425-AlaGluAlaSerAsp-429
SEQ. ID. NO. 35923    431-IleAlaPheLysLysAlaAla-437
SEQ. ID. NO. 35924    468-ProAlaAlaAspAspSerAlaLysThrLeuAsnArgLysIleAsnGlu-483
SEQ. ID. NO. 35925    542-ArgGlnGlyLysValAlaGluAlaLysGlnTrpMet-553
SEQ. ID. NO. 35926    566-ArgTyrAlaAspGluIleArgLys-573
SEQ. ID. NO. 35927    584-LeuLeuLysAspCysLysAla-590
SEQ. ID. NO. 35928    596-GlyHisProGluThrLysProCysLys-604
g739
AMPHI Regions - AMPHI
SEQ. ID. NO. 35929    6-AsnLysProPheArgLeu-11
SEQ. ID. NO. 35930    53-HisThrAspSerPro-57
SEQ. ID. NO. 35931    88-GlnProAspGlyThrGlu-93
SEQ. ID. NO. 35932    116-AspAlaAlaArgAlaAlaAspSerLeuThrGlyThr-127
SEQ. ID. NO. 35933    131-AlaGluAsnThrLeu-135
Antigenic Index - Jameson-Wolf
SEQ. ID. NO. 35934    1-MetAlaLysLysProAsnLysProPheArgLeuThrPro-13
SEQ. ID. NO. 35935    39-PheAsnProAsnGlyAspLysThrLeuGlnThrGluProGlnHisThrAspSerProArgGluThrGluPhe-62
SEQ. ID. NO. 35936    64-LeuProAsnGlyAlaValGlyGlnAspAlaAlaGlnProGluHisHisHis-80
SEQ. ID. NO. 35937    82-AlaSerSerGluProAlaGlnProAspGlyThrGluGluSerGlySerGlyLeuProSerProAlaAlaProLysLysAsnArgValLysProArg
                      ProSerAspAlaAlaArgAlaAlaAspSerLeuThrGlyThrGlyThrGlnAlaGluAsnThrLeuLysGluThrProVal-140
SEQ. ID. NO. 35938    142-ProThrAsnAlaProHisProGluProArgLysGluThrProGluLysGlnAlaGlnProLysGluThrProLysGluLysGluThrProLysGlu
                      AsnHisThrLysProAspThrProLysAsnThrProAlaLysProHisLysGluIleLeu-193
Hydrophilic Regions - Hopp-Woods
SEQ. ID. NO. 35939    1-MetAlaLysLysProAsnLysProPheArgLeu-11
SEQ. ID. NO. 35940    41-ProAsnGlyAspLysThrLeuGlnThrGluProGlnHisThrAspSerProArgGluThrGlu-61
SEQ. ID. NO. 35941    69-ValGlyGlnAspAlaAlaGlnProGluHisHisHis-80
SEQ. ID. NO. 35942    82-AlaSerSerGluProAlaGlnProAspGlyThrGluGluSerGlySer-97
SEQ. ID. NO. 35943    103-AlaAlaProLysLysAsnArgValLysProArgProSerAspAlaAlaArgAlaAlaAspSerLeuThr-125
SEQ. ID. NO. 35944    129-ThrGlnAlaGluAsnThrLeuLysGluThrPro-139
SEQ. ID. NO. 35945    146-ProHisProGluProArgLysGluThrProGluLysGlnAlaGlnProLysGluThrProLysGluLysGluThrProLysGluAsnHisThrLys
                      ProAspThrProLysAsnThrProAlaLysProHisLysGluIleLeu-193
g740
AMPHI Regions - AMPHI
SEQ. ID. NO. 35946    6-LeuValArgTrpLeuAlaVal-12
SEQ. ID. NO. 35947    57-IleLysHisHisLeu-61
Antigenic Index - Jameson-Wolf
SEQ. ID. NO. 35948    25-AlaAsnProProGluAspLysProGln-33
SEQ. ID. NO. 35949    57-IleLysHisHisLeu-61
SEQ. ID. NO. 35950    63-GlnGlyPheAspLeuLysArgGlnThr-71
Hydrophilic Regions - Hopp-Woods
SEQ. ID. NO. 35951    27-ProProGluAspLysProGln-33
SEQ. ID. NO. 35952    57-IleLysHisHisLeu-61
SEQ. ID. NO. 35953    63-GlnGlyPheAspLeuLysArgGlnThr-71
g741
AMPHI Regions - AMPHI
SEQ. ID. NO. 35954    35-GlyThrGlyLeuAlaAspAlaLeuThrAla-44
SEQ. ID. NO. 35955    74-GlyAlaGluLysThrPheLysAlaGly-82
```

TABLE 1-continued

| | |
|---|---|
| SEQ. ID. NO. 35956 | 138-LysIleAsnAsnProAspLysIleAspSerLeuIle-149 |
| SEQ. ID. NO. 35957 | 164-ThrAlaPheAsnGlnLeuProAsp-171 |
| SEQ. ID. NO. 35958 | 205-IleGluHisLeuLys-209 |
| Antigenic Index - Jameson-Wolf | |
| SEQ. ID. NO. 35959 | 1-ValAsnArgThrThrPhe-6 |
| SEQ. ID. NO. 35960 | 12-ThrAlaGlyProAspSerAspArgLeuGlnGlnArgArgGlyGlyGlyGlyGlyVal-30 |
| SEQ. ID. NO. 35961 | 46-LeuAspHisLysAspLysGlyLeuLys-54 |
| SEQ. ID. NO. 35962 | 61-SerIleProGlnAsnGly-66 |
| SEQ. ID. NO. 35963 | 73-GlnGlyAlaGluLysThrPheLysAlaGlyGlyLysAspAsnSerLeuAsnThrGlyLysLeuLysAsnAspLysIleSerArg-100 |
| SEQ. ID. NO. 35964 | 107-IleGluValAspGlyGln-112 |
| SEQ. ID. NO. 35965 | 123-IleTyrLysGlnAspHisSerAla-130 |
| SEQ. ID. NO. 35966 | 135-ArgIleGluLysIleAsnAsnProAspLysIleAspSer-147 |
| SEQ. ID. NO. 35967 | 149-IleAsnGlnArgSer-153 |
| SEQ. ID. NO. 35968 | 157-SerAspLeuGlyGlyGluHisThr-164 |
| SEQ. ID. NO. 35969 | 168-GlnLeuProAspGlyLysAlaGluTyrHisGly-178 |
| SEQ. ID. NO. 35970 | 180-AlaPheSerSerAspAspAlaAspGlyLysLeu-190 |
| SEQ. ID. NO. 35971 | 196-PheAlaAlaLysGlnGlyHisGlyLysIleGluHisLeuLysThrProGluGlnAsnVal-215 |
| SEQ. ID. NO. 35972 | 218-AlaSerAlaGluLeuLysAlaAspGluLysSerHis-229 |
| SEQ. ID. NO. 35973 | 234-GlyAspThrArgTyrGlyGlyGluGluLysGlyThrTyrArg-247 |
| SEQ. ID. NO. 35974 | 251-PheGlyAspArgAlaGlnGluIleAlaGly-260 |
| SEQ. ID. NO. 35975 | 265-LysIleGlyGluLysValHisGlu-272 |
| SEQ. ID. NO. 35976 | 274-GlyIleAlaAspLysGln-279 |
| Hydrophilic Regions - Hopp-Woods | |
| SEQ. ID. NO. 35977 | 13-AlaGlyProAspSerAspArgLeuGlnGlnArgArgGlyGlyGly-27 |
| SEQ. ID. NO. 35978 | 46-LeuAspHisLysAspLysGlyLeuLys-54 |
| SEQ. ID. NO. 35979 | 73-GlnGlyAlaGluLysThrPheLysAlaGlyGlyLysAspAsnSerLeuAsn-89 |
| SEQ. ID. NO. 35980 | 91-GlyLysLeuLysAsnAspLysIleSerArg-100 |
| SEQ. ID. NO. 35981 | 107-IleGluValAspGly-111 |
| SEQ. ID. NO. 35982 | 135-ArgIleGluLysIleAsnAsnProAspLysIleAspSer-147 |
| SEQ. ID. NO. 35983 | 170-ProAspGlyLysAlaGluTyrHisGly-178 |
| SEQ. ID. NO. 35984 | 180-AlaPheSerSerAspAspAlaAspGlyLysLeu-190 |
| SEQ. ID. NO. 35985 | 200-GlnGlyHisGlyLysIleGluHisLeuLysThrProGluGlnAsnVal-215 |
| SEQ. ID. NO. 35986 | 218-AlaSerAlaGluLeuLysAlaAspGluLysSerHis-229 |
| SEQ. ID. NO. 35987 | 236-ThrArgTyrGlyGlyGluGluLysGlyThrTyr-246 |
| SEQ. ID. NO. 35988 | 252-GlyAspArgAlaGlnGluIleAlaGly-260 |
| SEQ. ID. NO. 35989 | 265-LysIleGlyGluLysValHisGlu-272 |
| SEQ. ID. NO. 35990 | 274-GlyIleAlaAspLysGln-279 |
| g746 | |
| AMPHI Regions - AMPHI | |
| SEQ. ID. NO. 35991 | 83-ThrAlaAlaAspLysProGlnAsp-90 |
| SEQ. ID. NO. 35992 | 105-SerGluProGluAsn-109 |
| SEQ. ID. NO. 35993 | 126-IleLysGlyLeuGluGluSerGluLysLeuGlnGlnAlaGlu-139 |
| SEQ. ID. NO. 35994 | 154-GluLysValSerAlaThr-159 |
| SEQ. ID. NO. 35995 | 164-AspThrValAlaValGlu-169 |
| SEQ. ID. NO. 35996 | 171-ProLysArgThrAlaGluPro-177 |
| SEQ. ID. NO. 35997 | 181-LysAlaGluArgThr-185 |
| SEQ. ID. NO. 35998 | 195-ThrLysThrAlaGluLysValAlaAspLysProLys-206 |
| SEQ. ID. NO. 35999 | 221-SerAlaValLysGluAlaLysLysAlaAspLysAlaGluGly-234 |
| SEQ. ID. NO. 36000 | 249-GluThrAlaGlnLysThrAspLysAlaAspLysThrLysThrAlaGluLysGluLysSerGlyLysAla-271 |
| SEQ. ID. NO. 36001 | 301-SerThrIleThrGluIleMetThr-308 |
| SEQ. ID. NO. 36002 | 321-TyrLysAsnAlaArgAspAlaGluArgAspLeu-331 |
| Antigenic Index - Jameson-Wolf | |
| SEQ. ID. NO. 36003 | 1-MetSerGluAsnLysGlnAsnGlu-8 |
| SEQ. ID. NO. 36004 | 14-GluGlnLeuLysArgArgAsnArgArgArgLeuValThr-26 |
| SEQ. ID. NO. 36005 | 42-LeuSerSerAspProAlaAspSerAsnProAlaProGlnAlaGlyGluThrGlyAlaThrGluSerGlnThrAlaAsnThrAlaGln-70 |
| SEQ. ID. NO. 36006 | 76-SerAlaAlaGluAsnGlyGluThrAlaAlaAspLysProGlnAspLeuAlaGlyGluAspLysProSerAlaAlaAspSerGluIleSerGluPro<br>GluAsnVal-110 |
| SEQ. ID. NO. 36007 | 118-AsnAspArgLeuGluAspSerAsnIleLysGlyLeuGluGluSerGluLysLeuGlnGlnAlaGluThrAlaLysThrGluProLysGlnAlaLys<br>GlnArgAlaAlaGluLysValSerAlaThrAlaAspSerThrAspThrValAlaValGluLysProLysArgThrAlaGluPro<br>LysProGlnLysAlaGluArgThrAlaGluAlaLysProLysAlaLysGluThrLysThrAlaGluLysValAlaAspLysPro<br>LysThrAlaAlaGluLysThrLysProAspThrAlaLysSerAspSerAlaValLysGluAlaLysLysAlaAspLysAlaGlu<br>GlyLysLysThrAlaGluLysAspArgSerAspGlyLysLysHisGluThrAlaGlnLysThrAspLysAlaAspLysThrLys<br>ThrAlaGluLysGluLysSerGlyLysAlaGlyLysLysAlaAla-276 |
| SEQ. ID. NO. 36008 | 280-GlyTyrAlaGluLysGluArgAlaLeuSerLeuGlnArgLysMetLysAlaAlaGlyIle-299 |
| SEQ. ID. NO. 36009 | 306-IleMetThrAspAsnGlyLysValTyrArgValLysSerSerAsnTyrLysAsnAlaArgAspAlaGluArgAspLeuAsnLysLeuArgVal-336 |
| Hydrophilic Regions - Hopp-Woods | |
| SEQ. ID. NO. 36010 | 1-MetSerGluAsnLysGlnAsnGlu-8 |
| SEQ. ID. NO. 36011 | 14-GluGlnLeuLysArgArgAsnArgArgArgLeuVal-25 |
| SEQ. ID. NO. 36012 | 42-LeuSerSerAspProAlaAspSerAsnPro-51 |
| SEQ. ID. NO. 36013 | 54-GlnAlaGlyGluThrGlyAlaThrGluSerGlnThr-65 |
| SEQ. ID. NO. 36014 | 76-SerAlaAlaGluAsnGlyGluThrAlaAlaAspLysProGlnAspLeuAlaGlyGluAspLysProSerAlaAlaAspSerGluIleSerGluPro<br>GluAsnVal-110 |
| SEQ. ID. NO. 36015 | 119-AspArgLeuGluAspSerAsnIleLysGlyLeuGluGluSerGluLysLeuGlnGlnAlaGluThrAlaLysThrGluProLysGlnAlaLysGln<br>ArgAlaAlaGluLysValSerAlaThrAlaAspSerThrAsp-164 |
| SEQ. ID. NO. 36016 | 166-ValAlaValGluLysProLysArgThrAlaGluProLysProGlnLysAlaGluArgThrAlaGluAlaLysProLysAlaLysGluThrLysThr<br>AlaGluLysValAlaAspLysProLysThrAlaAlaGluLysThrLysProAspThrAlaLysSerAspSerAlaValLysGluAla<br>LysLysAlaAspLysAlaGluGlyLysLysThrAlaGluLysAspArgSerAspGlyLysLysHisGluThrAlaGlnLysThrAsp<br>LysAlaAspLysThrLysThrAlaGluLysGluLysSerGlyLysAlaGlyLysLysAlaAla-276 |

TABLE 1-continued

| | |
|---|---|
| SEQ. ID. NO. 36017 | 281-TyrAlaGluLysGluArgAlaAlaLeuSerLeuGlnArgLysMetLysAlaAlaGlyIle-299 |
| SEQ. ID. NO. 36018 | 306-IleMetThrAspAsnGlyLysValTyrArgValLysSerSerAsnTyrLysAsnAlaArgAspAlaGluArgAspLeuAsnLysLeuArgVal-336 | g748
AMPHI Regions - AMPHI

| | |
|---|---|
| SEQ. ID. NO. 36019 | 22-GlyAlaIleGlyAlaIleGlyGly-29 |
| SEQ. ID. NO. 36020 | 37-GlyGluThrAlaGluArgThrAlaGluSerGlnHis-48 |
| SEQ. ID. NO. 36021 | 82-SerAlaLysGlnLeuGluAsnLeuPheArgThrLeu-93 |
| SEQ. ID. NO. 36022 | 155-LeuGlnGluMetArgAspPheProAsnAspLysLeuGlnLysSerTrp-170 |
| SEQ. ID. NO. 36023 | 188-GlnThrAlaLeuArgAspIleIleLysHisThr-198 |
| SEQ. ID. NO. 36024 | 250-GlyValAlaAlaAsnSer-255 |
| SEQ. ID. NO. 36025 | 257-AspGluProGluTrp-261 |
| SEQ. ID. NO. 36026 | 268-GlnAlaValArgLeuIleArgArgPheValGluPheTrpAspArg-282 |
| SEQ. ID. NO. 36027 | 310-GlnProAspPheAlaLysAspProGlu-318 |
| SEQ. ID. NO. 36028 | 330-LeuAlaAsnProArgAspProGlu-337 |
| SEQ. ID. NO. 36029 | 390-LeuGluGluTyrIleSerProPhe-397 |

Antigenic Index - Jameson-Wolf

| | |
|---|---|
| SEQ. ID. NO. 36030 | 1-MetSerGlnAsnGlnProAlaGlnProThrLysArgAsnLeuPhe-15 |
| SEQ. ID. NO. 36031 | 30-TyrPheGlyGlyLysLysGlnGlyGluThrAlaGluArgThrAlaGluSerGlnHisSerProGlnAla-52 |
| SEQ. ID. NO. 36032 | 80-AlaGlnSerAlaLysGlnLeuGluAsn-88 |
| SEQ. ID. NO. 36033 | 101-ThrGlnGlyGlyGluTyrGlnAspGlyAspAspLysLeuProSerAlaGlySerGly-119 |
| SEQ. ID. NO. 36034 | 125-PheAsnProAspGlyLeuThr-131 |
| SEQ. ID. NO. 36035 | 139-SerLeuPheAspGlyArgPheGlyLeuLysAspLysLysThrValHis-154 |
| SEQ. ID. NO. 36036 | 156-GlnGluMetArgAspPheProAsnAspLysLeuGlnLysSerTrpCysAspGlyAspLeuSer-176 |
| SEQ. ID. NO. 36037 | 183-ThrProGluThrCys-187 |
| SEQ. ID. NO. 36038 | 208-IleAspGlyTrpGlnProLysSerGluProGlyAlaMetAla-221 |
| SEQ. ID. NO. 36039 | 226-LeuGlyPheArgAspGlyThrGlyAsnProLysValSerAspProLysThrAlaAspGlu-245 |
| SEQ. ID. NO. 36040 | 255-SerLeuAspGluProGluTrpAlaLysAsnGlySerTyrGlnAla-269 |
| SEQ. ID. NO. 36041 | 271-ArgLeuIleArgArgPhe-276 |
| SEQ. ID. NO. 36042 | 279-PheTrpAspArgThrProLeuGlnGluGlnThrAspIlePheGlyArgArgLysTyrSerGlyAlaProMetAspGlyLysLysGluAlaAspGln ProAspPheAlaLysAspProGluGlyAspIleThrProLysAspSerHisMetArgLeuAlaAsnProArgAspProGluPheLeuLys-340 |
| SEQ. ID. NO. 36043 | 348-AlaTyrSerTyrSerArgGlyProAlaSerSerGlyGlnLeu-361 |
| SEQ. ID. NO. 36044 | 385-LeuAsnGlyGluProLeuGluGluTyr-393 |
| SEQ. ID. NO. 36045 | 407-GlyValGlyLysGlyGlyPhe-413 |

Hydrophilic Regions - Hopp-Woods

| | |
|---|---|
| SEQ. ID. NO. 36046 | 8-GlnProThrLysArgAsnLeuPhe-15 |
| SEQ. ID. NO. 36047 | 32-GlyGlyLysLysGlnGlyGluThrAlaGluArgThrAlaGluSerGlnHis-48 |
| SEQ. ID. NO. 36048 | 80-AlaGlnSerAlaLysGlnLeuGluAsn-88 |
| SEQ. ID. NO. 36049 | 104-GlyGluTyrGlnAspGlyAspAspLysLeuProSer-115 |
| SEQ. ID. NO. 36050 | 145-PheGlyLeuLysAspLysLysThrValHis-154 |
| SEQ. ID. NO. 36051 | 156-GlnGluMetArgAspPheProAsnAspLysLeuGlnLysSerTrpCysAspGlyAspLeu-175 |
| SEQ. ID. NO. 36052 | 211-TrpGlnProLysSerGluProGlyAlaMetAla-221 |
| SEQ. ID. NO. 36053 | 229-ArgAspGlyThrGlyAsnProLysValSerAspProLysThrAlaAsp-244 |
| SEQ. ID. NO. 36054 | 255-SerLeuAspGluProGluTrpAlaLys-263 |
| SEQ. ID. NO. 36055 | 271-ArgLeuIleArgArgPhe-276 |
| SEQ. ID. NO. 36056 | 283-ThrProLeuGlnGluGlnThrAspIlePheGlyArgArgLysTyrSer-298 |
| SEQ. ID. NO. 36057 | 301-ProMetAspGlyLysLysGluAlaAspGlnProAspPheAlaLysAspProGluGlyAspIleThrProLysAspSerHisMet-328 |
| SEQ. ID. NO. 36058 | 331-AlaAsnProArgAspProGluPheLeuLys-340 |
| SEQ. ID. NO. 36059 | 353-ArgGlyProAlaSer-357 |
| SEQ. ID. NO. 36060 | 388-GluProLeuGluGluTyr-393 | g749
AMPHI Regions - AMPHI

| | |
|---|---|
| SEQ. ID. NO. 36061 | 1-MetArgLysPheAsnLeuThrAlaLeuSerValMetLeuAlaLeuGlyLeuThrAlaCysGlnProProGluAlaGluLysAlaAlaProAlaAlaSerGlyGluThrGlnSerAlaAsnGluGlyGlySerValGlyIleAlaValAsnAspAsnAlaCysGluProMetAsnLeuThrValProSerGlyGlnValValPheAsnIleLysAsnAsnSerGlyArgLysLeuGluTrpGluIleLeuLysGlyValMetValValAspGluArgGluAsnIleAlaProGlyLeuSerAspLysMetThrValThrLeuLeuProGlyGluTyrGluMetThrCysGlyLeuLeuThrAsnProArgGlyLysLeuValValAlaAspSerGlyPheLysAspThrAlaAsnGluAlaAspLeuGluLysLeuProGlnProLeuAlaAspTyrLysAlaTyrValGlnGlyGluValLysGluLeuAlaAlaLysThrLysThrPheThrGluAlaValLysAlaGlyAspIleGluLysAlaLysSerLeuPheAlaAlaThrArgValHisTyrGluArgIleGluProIleAlaGluLeuPheSerGluLeuAspProValIleAspAlaCysGluAspAspPheLysAspGlyAlaLysAspAlaGlyPheThrGlyPheHisArgIleGluHisAlaLeuTrpValGluLysAspValSerGlyValLysGluThrAlaAlaLysLeuMetThrAspValGluAlaLeuGlnLysGluIleAspAlaLeuAlaPheProProGlyLysValValGlyGlyAlaSerGluLeuIleGluGluAlaAlaGlySerLysIleSerGlyGluGluAspArgTyrSerHisThrAspLeuSerAspPheGlnAlaAsnAlaAspGlySerLysLysIleValAspLeuPheArgProLeuIleGluAlaLysAsnLysAlaLeuLeuGluLysThrAspThrAsnPheLysGlnValAsnGluIleLeuAlaLysTyrArgThrLysAspGlyPheGluThrTyrAspLysLeuSerGluAlaAspArgLysAlaLeuGlnAlaProIleAsnAlaLeuAlaGluAspLeuAlaGlnLeuArgGlyIleLeuGlyLeuLys-388 |

Antigenic Index - Jameson-Wolf (SEQ. ID. NO. 36061)
1-MetArgLysPheAsnLeuThrAlaLeuSerValMetLeuAlaLeuGlyLeuThrAlaCysGlnProProGluAl
aGluLysAlaAlaProAlaAlaSerGlyGluThrGlnSerAlaAsnGluGlyGlySerValGlyIleAlaValAsn
AspAsnAlaCysGluProMetAsnLeuThrValProSerGlyGlnValValPheAsnIleLysAsnAsnSerGlyA
rgLysLeuGluTrpGluIleLeuLysGlyValMetValValAspGluArgGluAsnIleAlaProGlyLeuSerAs
pLysMetThrValThrLeuLeuProGlyGluTyrGluMetThrCysGlyLeuLeuThrAsnProArgGlyLysLeu
ValValAlaAspSerGlyPheLysAspThrAlaAsnGluAlaAspLeuGluLysLeuProGlnProLeuAlaAspT
yrLysAlaTyrValGlnGlyGluValLysGluLeuAlaAlaLysThrLysThrPheThrGluAlaValLysAlaGl
yAspIleGluLysAlaLysSerLeuPheAlaAlaThrArgValHisTyrGluArgIleGluProIleAlaGluLeu
PheSerGluLeuAspProValIleAspAlaCysGluAspAspPheLysAspGlyAlaLysAspAlaGlyPheThrG
lyPheHisArgIleGluHisAlaLeuTrpValGluLysAspValSerGlyValLysGluThrAlaAlaLysLeuMe
tThrAspValGluAlaLeuGlnLysGluIleAspAlaLeuAlaPheProProGlyLysValValGlyGlyAlaSer
GluLeuIleGluGluAlaAlaGlySerLysIleSerGlyGluGluAspArgTyrSerHisThrAspLeuSerAspP
heGlnAlaAsnAlaAspGlySerLysLysIleValAspLeuPheArgProLeuIleGluAlaLysAsnLysAlaLe
uLeuGluLysThrAspThrAsnPheLysGlnValAsnGluIleLeuAlaLysTyrArgThrLysAspGlyPheGlu TABLE 1-continued ThrTyrAspLysLeuSerGluAlaAspArgLysAlaLeuGlnAlaProIleAsnAlaLeuAlaGluAspLeuAlaG
lnLeuArgGlyIleLeuGlyLeuLys-388
Hydrophilic Regions - Hopp-Woods (SEQ. ID. NO. 36061)
1-MetArgLysPheAsnLeuThrAlaLeuSerValMetLeuAlaLeuGlyLeuThrAlaCysGlnProProGluAl
aGluLysAlaAlaProAlaAlaSerGlyGluThrGlnSerAlaAsnGluGlyGlySerValGlyIleAlaValAsn
AspAsnAlaCysGluProMetAsnLeuThrValProSerGlyGlnValValPheAsnIleLysAsnAsnSerGlyA
rgLysLeuGluTrpGluIleLeuLysGlyValMetValValAspGluArgGluAsnIleAlaProGlyLeuSerAs
pLysMetThrValThrLeuLeuProGlyGluTyrGluMetThrCysGlyLeuLeuThrAsnProArgLysLysLeu
ValValAlaAspSerGlyPheLysAspThrAlaAsnGluAlaAspLeuGluLysLeuProGlnProLeuAlaAspT
yrLysAlaTyrValGlnGlyGluValLysGluLeuAlaAlaLysThrLysThrPheThrGluAlaValLysAlaGl
yAspIleGluLysAlaLysSerLeuPheAlaAlaThrArgValHisTyrGluArgIleGluProIleAlaGluLeu
PheSerGluLeuAspProValIleAspAlaCysGluAspAspPheLysAspGlyAlaLysAspAlaGlyPheThrG
lyPheHisArgIleGluHisAlaLeuTrpValGluLysAspValSerGlyValLysGluThrAlaAlaLysLeuMe
tThrAspValGluAlaLeuGlnLysGluIleAspAlaLeuAlaPheProProGlyLysValValGlyGlyAlaSer
GluLeuIleGluGluAlaAlaGlySerLysIleSerGlyGluGluAspArgTyrSerHisThrAspLeuSerAspP
heGlnAlaAsnAlaAspGlySerLysLysIleValAspLeuPheArgProLeuIleGluAlaLysAsnLysAlaLe
uLeuGluLysThrAspThrAsnPheLysGlnValAsnGluIleLeuAlaLysTyrArgThrLysAspGlyPheGlu
ThrTyrAspLysLeuSerGluAlaAspArgLysAlaLeuGlnAlaProIleAsnAlaLeuAlaGluAspLeuAlaG
lnLeuArgGlyIleLeuGlyLeuLys-388
g750
AMPHI Regions - AMPHI
SEQ. ID. NO. 36062    1-ValLysProArgPheTyrTrpAlaAlaCysAlaValLeuProAlaAlaCy
sSerProGluProAlaAlaGluLysThrValSerAlaAlaSerGlnAlaAlaSerThrProValAlaThrLeuThrValProThrAlaArgGlyAspAlaValV
alProLysAsnProGluArgValAlaValTyrAspTrpAlaAlaLeuAspThrLeuThrGluProGlyValAsnValGlyAlaThrThrAlaProValArgVal
AspTyrLeuGlnProAlaPheAspLysAlaAlaThrValGlyThrLeuPheGluProAspCysGluSerLeuHisArgHisAsnProGlnPheValIleThrGl
yGlyProGlyAlaGluAlaTyrGluGlnLeuAlaLysAsnAlaThrThrIleAspLeuThrValAspAsnGlyAsnIleArgThrSerGlyGluLysGlnMetG
luThrLeuSerArgIlePheGlyLysGluAlaArgValAlaGluLeuAsnAlaGlnIleAspAlaLeuPheAlaGlnLysArgGluAlaAlaLysGlyLysGly
ArgGlyLeuValLeuSerValThrGlyAsnLysValSerAlaPheGlyThrGlnSerArgLeuAlaSerTrpIleHisGlyAspIleGlyLeuProProValAs
pGluSerLeuArgAsnGluGlyHisGlyGlnProValSerPheGluTyrIleLysGluLysAsnProGlyTrpIlePheIleIl
eAspArgThrAlaAlaIleGlyGlnGluGlyProAlaAlaValGluValLeuAspAsnAlaLeuValCysGlyThrAsnAlaTrpLysArgLysGlnIleIleValMetProAlaAlaAsnTyr
IleValAlaGlyGlyAlaArgGlnLeuIleGlnAlaAlaGluGlnLeuLysAlaAlaPheGluLysAlaGluProValAlaAlaGln-323
Antigenic Index - Jameson-Wolf (SEQ. ID. NO. 36062)
1-ValLysProArgPheTyrTrpAlaAlaCysAlaValLeuProAlaAlaCysSerProGluProAlaAlaGluLy
sThrValSerAlaAlaSerGlnAlaAlaSerThrProValAlaThrLeuThrValProThrAlaArgGlyAspAla
ValValProLysAsnProGluArgValAlaValTyrAspTrpAlaAlaLeuAspThrLeuThrGluProGlyValA
snValGlyAlaThrThrAlaProValArgValAspTyrLeuGlnProAlaPheAspLysAlaAlaThrValGlyTh
rLeuPheGluProAspCysGluSerLeuHisArgHisAsnProGlnPheValIleThrGlyGlyProGlyAlaGlu
AlaTyrGluGlnLeuAlaLysAsnAlaThrThrIleAspLeuThrValAspAsnGlyAsnIleArgThrSerGlyG
luLysGlnMetGluThrLeuSerArgIlePheGlyLysGluAlaArgValAlaGluLeuAsnAlaGlnIleAspAl
aLeuPheAlaGlnLysArgGluAlaAlaLysGlyLysGlyArgGlyLeuValLeuSerValThrGlyAsnLysVal
SerAlaPheGlyThrGlnSerArgLeuAlaSerTrpIleHisGlyAspIleGlyLeuProProValAspGluSerL
euArgAsnGluGlyHisGlyGlnProValSerPheGluTyrIleLysGluLysAsnProGlyTrpIlePheIleIl
eAspArgThrAlaAlaIleGlyGlnGluGlyProAlaAlaValGluValLeuAspAsnAlaLeuValCysGlyThr
AsnAlaTrpLysArgLysGlnIleIleValMetProAlaAlaAsnTyrIleValAlaGlyGlyAlaArgGlnLeuI
leGlnAlaAlaGluGlnLeuLysAlaAlaPheGluLysAlaGluProValAlaAlaGln-323
Hydrophilic Regions - Hopp-Woods (SEQ. ID. NO. 36062)
1-ValLysProArgPheTyrTrpAlaAlaCysAlaValLeuProAlaAlaCysSerProGluProAlaAlaGluLy
sThrValSerAlaAlaSerGlnAlaAlaSerThrProValAlaThrLeuThrValProThrAlaArgGlyAspAla
ValValProLysAsnProGluArgValAlaValTyrAspTrpAlaAlaLeuAspThrLeuThrGluProGlyValA
snValGlyAlaThrThrAlaProValArgValAspTyrLeuGlnProAlaPheAspLysAlaAlaThrValGlyTh
rLeuPheGluProAspCysGluSerLeuHisArgHisAsnProGlnPheValIleThrGlyGlyProGlyAlaGlu
AlaTyrGluGlnLeuAlaLysAsnAlaThrThrIleAspLeuThrValAspAsnGlyAsnIleArgThrSerGlyG
luLysGlnMetGluThrLeuSerArgIlePheGlyLysGluAlaArgValAlaGluLeuAsnAlaGlnIleAspAl
aLeuPheAlaGlnLysArgGluAlaAlaLysGlyLysGlyArgGlyLeuValLeuSerValThrGlyAsnLysVal
SerAlaPheGlyThrGlnSerArgLeuAlaSerTrpIleHisGlyAspIleGlyLeuProProValAspGluSerL
euArgAsnGluGlyHisGlyGlnProValSerPheGluTyrIleLysGluLysAsnProGlyTrpIlePheIleIl
eAspArgThrAlaAlaIleGlyGlnGluGlyProAlaAlaValGluValLeuAspAsnAlaLeuValCysGlyThr
AsnAlaTrpLysArgLysGlnIleIleValMetProAlaAlaAsnTyrIleValAlaGlyGlyAlaArgGlnLeuI
leGlnAlaAlaGluGlnLeuLysAlaAlaPheGluLysAlaGluProValAlaAlaGln-323
g760
AMPHI Regions - AMPHI
SEQ. ID. NO. 36063    1-AsnAsnArgAsnThrArgTyrAlaAlaLeuGlyLysArgValMetGluGl
yValGluThrGluIleSerGlyAlaIleThrProLysTrpGlnIleHisAlaGlyTyrSerTyrLeuHisSerGlnIleLysThrAlaAlaAsnProArgAspA
spGlyIlePheLeuLeuValProLysHisSerAlaAsnLeuTrpThrThrTyrGlnValThrProGlyLeuThrValGlyGlyGlyValAsnAlaMetSerGly
IleThrSerSerAlaGlyMetHisAlaGlyGlyTyrAlaThrPheAspAlaMetAlaAlaTyrArgPheThrProLysLeuLysLeuGlnIleAsnAlaAspAs
nIlePheAsnArgHisTyrTyrAlaArgValGlyGlyThrAsnThrPheAsnIleProGlySerGluArgSerLeuThrAlaAsnLeuArgTyrSerPhe-154
Antigenic Index - Jameson-Wolf (SEQ. ID. NO. 36063)
1-AsnAsnArgAsnThrArgTyrAlaAlaLeuGlyLysArgValMetGluGlyValGluThrGluIleSerGlyAl
aIleThrProLysTrpGlnIleHisAlaGlyTyrSerTyrLeuHisSerGlnIleLysThrAlaAlaAsnProArg
AspAspGlyIlePheLeuLeuValProLysHisSerAlaAsnLeuTrpThrThrTyrGlnValThrProGlyLeuT
hrValGlyGlyGlyValAsnAlaMetSerGlyIleThrSerSerAlaGlyMetHisAlaGlyGlyTyrAlaThrPh
eAspAlaMetAlaAlaTyrArgPheThrProLysLeuLysLeuGlnIleAsnAlaAspAsnIlePheAsnArgHis
TyrTyrAlaArgValGlyGlyThrAsnThrPheAsnIleProGlySerGluArgSerLeuThrAlaAsnLeuArgT
yrSerPhe-154
Hydrophilic Regions - Hopp-Woods (SEQ. ID. NO. 36063)
1-AsnAsnArgAsnThrArgTyrAlaAlaLeuGlyLysArgValMetGluGlyValGluThrGluIleSerGlyAl
aIleThrProLysTrpGlnIleHisAlaGlyTyrSerTyrLeuHisSerGlnIleLysThrAlaAlaAsnProArg
AspAspGlyIlePheLeuLeuValProLysHisSerAlaAsnLeuTrpThrThrTyrGlnValThrProGlyLeuT
hrValGlyGlyGlyValAsnAlaMetSerGlyIleThrSerSerAlaGlyMetHisAlaGlyGlyTyrAlaThrPh
eAspAlaMetAlaAlaTyrArgPheThrProLysLeuLysLeuGlnIleAsnAlaAspAsnIlePheAsnArgHis TABLE 1-continued TyrTyrAlaArgValGlyGlyThrAsnThrPheAsnIleProGlySerGluArgSerLeuThrAlaAsnLeuArgTyrSerPhe-154
g767
AMPHI Regions - AMPHI
SEQ. ID. NO. 36064 41-GlyLysIleGluValLeuGluPhePheGlyTyrPheCysVal-54
SEQ. ID. NO. 36065 89-GlyLeuAlaArgMetAlaAlaAlaValLys-98
SEQ. ID. NO. 36066 140-LysLysLeuMetArgAlaTyrAspSerProGlu-150
SEQ. ID. NO. 36067 160-LysLeuThrGluGlnTyr-165
SEQ. ID. NO. 36068 187-PheAspGlyGlyValHisThrIleLysGluLeuValAla-199
Antigenic Index - Jameson-Wolf
SEQ. ID. NO. 36069 23-ThrGluGlyGluAspTyrLeuVal-30
SEQ. ID. NO. 36070 32-AspLysProIleProGlnGluGlnProGlyLysIleGluVal-45
SEQ. ID. NO. 36071 66-LeuGlyLysAlaLeuProSerAspThrTyrLeuArg-77
SEQ. ID. NO. 36072 99-LeuSerGlyLeuLysTyrGlnAla-106
SEQ. ID. NO. 36073 115-TyrGluGlnLysIleArgLeuGluAsnArgAlaValAla-127
SEQ. ID. NO. 36074 132-LeuSerGlnLysGlyPheAspGlyLysLysLeuMetArgAlaTyrAspSerProGluAla-151
SEQ. ID. NO. 36075 157-LysMetGlnLysLeuThrGluGlnTyrGlyIleAspSerThrPro-171
SEQ. ID. NO. 36076 175-ValGlyGlyLysTyrArgVal-181
SEQ. ID. NO. 36077 183-PheAsnAsnGlyPheAspGlyGly-190
SEQ. ID. NO. 36078 197-LeuValAlaLysValArgGluGluArgLysArgGlnThrProAlaValGlnLys-214
Hydrophilic Regions - Hopp-Woods
SEQ. ID. NO. 36079 23-ThrGluGlyGluAsp-27
SEQ. ID. NO. 36080 33-LysProIleProGlnGluGlnProGlyLysIleGluVal-45
SEQ. ID. NO. 36081 115-TyrGluGlnLysIleArgLeuGluAsnArgAlaValAla-127
SEQ. ID. NO. 36082 135-LysGlyPheAspGlyLysLysLeuMetArgAlaTyrAspSerProGluAla-151
SEQ. ID. NO. 36083 157-LysMetGlnLysLeuThrGlu-163
SEQ. ID. NO. 36084 197-LeuValAlaLysValArgGluGluArgLysArgGlnThrProAlaValGlnLys-214
g768
AMPHI Regions - AMPHI
SEQ. ID. NO. 36085 1-MetAsnIleLysGlnLeuIleThrAlaAlaLeuIleAlaSerAlaAlaPh
eAlaThrGlnAlaAlaProGlnLysProValSerAlaAlaGlnThrAlaGlnHisSerAlaValTrpIleAspValArgSerGluGlnGluPheSerGluGlyH
isLeuHisAsnAlaValAsnIleProValAspGlnIleValArgArgIleTyrGluAlaAlaProAspLysAspThrProValAsnLeuTyrCysArgSerGly
ArgArgAlaGluAlaAlaLeuGlnGluLeuLysLysAlaGlyTyrThrAsnValAlaAsnHisGlyGlyTyrGluAspLeuLeuLysLysGlyMetLys-119
Antigenic Index - Jameson-Wolf (SEQ. ID. NO. 36085)
1-MetAsnIleLysGlnLeuIleThrAlaAlaLeuIleAlaSerAlaAlaPheAlaThrGlnAlaAlaProGlnLy
sProValSerAlaAlaGlnThrAlaGlnHisSerAlaValTrpIleAspValArgSerGluGlnGluPheSerGlu
GlyHisLeuHisAsnAlaValAsnIleProValAspGlnIleValArgArgIleTyrGluAlaAlaProAspLysA
spThrProValAsnLeuTyrCysArgSerGlyArgArgAlaGluAlaAlaLeuGlnGluLeuLysLysAlaGlyTy
rThrAsnValAlaAsnHisGlyGlyTyrGluAspLeuLeuLysLysGlyMetLys-119
Hydrophilic Regions - Hopp-Woods (SEQ. ID. NO. 36085)
1-MetAsnIleLysGlnLeuIleThrAlaAlaLeuIleAlaSerAlaAlaPheAlaThrGlnAlaAlaProGlnLy
sProValSerAlaAlaGlnThrAlaGlnHisSerAlaValTrpIleAspValArgSerGluGlnGluPheSerGlu
GlyHisLeuHisAsnAlaValAsnIleProValAspGlnIleValArgArgIleTyrGluAlaAlaProAspLysA
spThrProValAsnLeuTyrCysArgSerGlyArgArgAlaGluAlaAlaLeuGlnGluLeuLysLysAlaGlyTy
rThrAsnValAlaAsnHisGlyGlyTyrGluAspLeuLeuLysLysGlyMetLys-119
g769
AMPHI Regions - AMPHI
SEQ. ID. NO. 36086 1-LeuIleMetValIlePheTyrPheTyrPheCysGlyLysThrPheMetPr
oAlaArgAsnArgTrpMetLeuLeuProLeuLeuAlaSerAlaAlaTyrAlaGluGluThrProCysGluProAspLeuArgSerArgProGluPheArgLeuH
isGluAlaGluValLysProIleAspArgGluLysValProGlyGlnValArgGluLysGlyLysValLeuGlnValAspGlyGluThrLeuLeuLysAsnPro
GluLeuLeuSerArgAlaMetTyrSerAlaValValSerAsnAsnIleAlaGlyIleArgValIleLeuProIleTyrLeuGlnGlnAlaArgGlnAspLysMe
tLeuAlaLeuTyrAlaGlnGlyIleLeuAlaGlnAlaGluGlyArgValLysGluAlaValSerHisTyrArgGluLeuIleAlaAlaGlnProAspAlaProA
laValArgMetArgLeuAlaAlaAlaLeuPheGluAspArgGlnAsnGluAlaAlaAlaAspGlnPheAspArgLeuLysThrGluAspLeuProProGlnLeu
MetGluGlnValGluLeuTyrArgLysAlaLeuArgGluArgAspAlaTrpLysValAsnGlyGlyPheSerValThrArgGluHisAsnIleAsnGlnAlaPr
oLysGlnGlnGlnTyrGlyAsnTrpThrPheProLysGlnValAspGlyThrAlaValAsnTyrArgPheGlyAlaGluLysLysTrpSerLeuLysAsnGlyT
rpTyrThrThrAlaGlyGlyAspValSerGlyArgValTyrProGlyAsnLysLysPheAsnAspMetThrAlaGlyValSerGlyGlyIleGlyPheAlaAsp
ArgArgLysAspValGlyLeuAlaValPheHisGluArgArgThrTyrGlyAsnAspAlaTyrSerTyrAlaAsnGlyAlaArgLeuTyrPheAsnArgTrpGl
nThrProArgTrpGlnThrLeuSerSerAlaGluTrpGlyArgLeuLysAsnThrArgArgAlaArgSerAspAsnThrHisLeuGlnIleSerAsnSerLeuV
alPheTyrArgAsnAlaArgGlnTyrTrpThrGlyGlyLeuAspPheTyrArgGluArgAsnProAlaAspArgGlyAspAsnPheAsnArgTyrGlyLeuArg
PheAlaTrpGlyGlnGluTrpGlyGlySerGlyLeuSerSerLeuPheArgLeuGlyValAlaLysArgHisTyrGluLysProGlyPhePheSerSerPheLy
sGlyGluArgArgAspLysGluSerAspThrSerLeuSerLeuTrpHisArgAlaLeuHisPheLysGlyIleThrProArgLeuThrLeuSerHisArgG
luThrTrpSerAsnAspValPheAsnGluTyrGluLysAsnArgAlaPheValGluPheAsnLysThrPhe-491
Antigenic Index - Jameson-Wolf (SEQ. ID. NO. 36086)
1-LeuIleMetValIlePheTyrPheTyrPheCysGlyLysThrPheMetProAlaArgAsnArgTrpMetLeuLe
uProLeuLeuAlaSerAlaAlaTyrAlaGluGluThrProCysGluProAspLeuArgSerArgProGluPheArg
LeuHisGluAlaGluValLysProIleAspArgGluLysValProGlyGlnValArgGluLysGlyLysValLeuG
lnValAspGlyGluThrLeuLeuLysAsnProGluLeuLeuSerArgAlaMetTyrSerAlaValValSerAsnAs
nIleAlaGlyIleArgValIleLeuProIleTyrLeuGlnGlnAlaArgGlnAspLysMetLeuAlaLeuTyrAla
GlnGlyIleLeuAlaGlnAlaGluGlyArgValLysGluAlaValSerHisTyrArgGluLeuIleAlaAlaGlnP
roAspAlaProAlaValArgMetArgLeuAlaAlaAlaLeuPheGluAspArgGlnAsnGluAlaAlaAlaAspGl
nPheAspArgLeuLysThrGluAspLeuProProGlnLeuMetGluGlnValGluLeuTyrArgLysAlaLeuArg
GluArgAspAlaTrpLysValAsnGlyGlyPheSerValThrArgGluHisAsnIleAsnGlnAlaProLysGlnG
lnGlnTyrGlyAsnTrpThrPheProLysGlnValAspGlyThrAlaValAsnTyrArgPheGlyAlaGluLysLy
sTrpSerLeuLysAsnGlyTrpTyrThrThrAlaGlyGlyAspValSerGlyArgValTyrProGlyAsnLysLys
PheAsnAspMetThrAlaGlyValSerGlyGlyIleGlyPheAlaAspArgArgLysAspValGlyLeuAlaValP
heHisGluArgArgThrTyrGlyAsnAspAlaTyrSerTyrAlaAsnGlyAlaArgLeuTyrPheAsnArgTrpGl
nThrProArgTrpGlnThrLeuSerSerAlaGluTrpGlyArgLeuLysAsnThrArgArgAlaArgSerAspAsn
ThrHisLeuGlnIleSerAsnSerLeuValPheTyrArgAsnAlaArgGlnTyrTrpThrGlyGlyLeuAspPheT
yrArgGluArgAsnProAlaAspArgGlyAspAsnPheAsnArgTyrGlyLeuArgPheAlaTrpGlyGlnGluTr
pGlyGlySerGlyLeuSerSerLeuPheArgLeuGlyValAlaLysArgHisTyrGluLysProGlyPhePheSer TABLE 1-continued SerPheLysGlyGluArgArgArgAspLysGluSerAspThrSerLeuSerLeuTrpHisArgAlaLeuHisPheL
ysGlyIleThrProArgLeuThrLeuSerHisArgGluThrTrpSerAsnAspValPheAsnGluTyrGluLysAs
nArgAlaPheValGluPheAsnLysThrPhe-491
Hydrophilic Regions - Hopp-Woods (SEQ. ID. NO. 36086)
1-LeuIleMetValIlePheTyrPheTyrPheCysGlyLysThrPheMetProAlaArgAsnArgTrpMetLeuLe
uProLeuLeuAlaSerAlaAlaTyrAlaGluGluThrProCysGluProAspLeuArgSerArgProGluPheArg
LeuHisGluAlaGluValLysProIleAspArgGluLysValProGlyGlnValArgGluLysGlyLysValLeuG
lnValAspGlyGluThrLeuLeuLysAsnProGluLeuLeuSerArgAlaMetTyrSerAlaValValSerAsnAs
nIleAlaGlyIleArgValIleLeuProIleTyrLeuGlnGlnAlaArgGlnAspLysMetLeuAlaLeuTyrAla
GlnGlyIleLeuAlaGlnAlaGluGlyArgValLysGluAlaValSerHisTyrArgGluLeuIleAlaAlaGlnP
roAspAlaProAlaValArgMetArgLeuAlaAlaAlaLeuPheGluAspArgGlnAsnGluAlaAlaAlaAspGl
nPheAspArgLeuLysThrGluAspLeuProProGlnLeuMetGluGlnValGluLeuTyrArgLysAlaLeuArg
GluArgAspAlaTrpLysValAsnGlyGlyPheSerValThrArgGluHisAsnIleAsnGlnAlaProLysGlnG
lnGlnTyrGlyAsnTrpThrPheProLysGlnValAspGlyThrAlaValAsnTyrArgPheGlyAlaGluLysLy
sTrpSerLeuLysAsnGlyTrpTyrThrThrAlaGlyGlyAspValSerGlyArgValTyrProGlyAsnLysLys
PheAsnAspMetThrAlaGlyValSerGlyGlyIleGlyPheAlaAspArgArgLysAspValGlyLeuAlaValP
heHisGluArgArgThrTyrGlyAsnAspAlaTyrSerTyrAlaAsnGlyAlaArgLeuTyrPheAsnArgTrpGl
nThrProArgTrpGlnThrLeuSerSerAlaGluTrpGlyArgLeuLysAsnThrArgArgAlaArgSerAspAsn
ThrHisLeuGlnIleSerAsnSerLeuValPheTyrArgAsnAlaArgGlnTyrTrpThrGlyGlyLeuAspPheT
yrArgGluArgAsnProAlaAspArgGlyAspAsnPheAsnArgTyrGlyLeuArgPheAlaTrpGlyGlnGluTr
pGlyGlySerGlyLeuSerSerLeuPheArgLeuGlyValAlaLysArgHisTyrGluLysProGlyPhePheSer
SerPheLysGlyGluArgArgArgAspLysGluSerAspThrSerLeuSerLeuTrpHisArgAlaLeuHisPheL
ysGlyIleThrProArgLeuThrLeuSerHisArgGluThrTrpSerAsnAspValPheAsnGluTyrGluLysAs
nArgAlaPheValGluPheAsnLysThrPhe-491
g770
AMPHI Regions - AMPHI
SEQ. ID. NO. 36087    1-MetAsnArgLeuLeuLeuLeuSerAlaAlaValLeuProThrAlaCysGl
ySerGlyGluThrAspLysIleGlyArgAlaSerThrValPheAsnMetLeuGlyLysAsnAspArgIleGluValGluGlyPheAspAspProAspValGlnG
lyValAlaCysTyrIleSerTyrAlaLysLysGlyGlyLeuLysGluMetValAsnLeuGluGluAspAlaSerAspAlaSerValSerCysValGlnThrAla
SerSerIleSerPheAspGluThrAlaValArgLysProLysGluValPheLysArgGlyThrGlyPheAlaPheLysSerArgGlnIleValArgTyrTyrAs
pProLysArgLysAlaPheAlaTyrLeuValTyrSerAspLysIleValGlnGlySerProLysAsnSerLeuSerAlaValSerCysPheGlySerGlyIleP
roGlnThrAspGlyValGlnAlaAspThrSerGlyLysLeuLeuAlaGlyAlaCysIleIleSerAsnProIleLysAsnProAspLysArg-186
Antigenic Index - Jameson-Wolf (SEQ. ID. NO. 36087)
1-MetAsnArgLeuLeuLeuLeuSerAlaAlaValLeuProThrAlaCysGlySerGlyGluThrAspLysIleGl
yArgAlaSerThrValPheAsnMetLeuGlyLysAsnAspArgIleGluValGluGlyPheAspAspProAspVal
GlnGlyValAlaCysTyrIleSerTyrAlaLysLysGlyGlyLeuLysGluMetValAsnLeuGluGluAspAlaS
erAspAlaSerValSerCysValGlnThrAlaSerSerIleSerPheAspGluThrAlaValArgLysProLysGl
uValPheLysArgGlyThrGlyPheAlaPheLysSerArgGlnIleValArgTyrTyrAspProLysArgLysAla
PheAlaTyrLeuValTyrSerAspLysIleValGlnGlySerProLysAsnSerLeuSerAlaValSerCysPheG
lySerGlyIleProGlnThrAspGlyValGlnAlaAspThrSerGlyLysLeuLeuAlaGlyAlaCysIleIleSe
rAsnProIleLysAsnProAspLysArg-186
Hydrophilic Regions - Hopp-Woods (SEQ. ID. NO. 36087)
1-MetAsnArgLeuLeuLeuLeuSerAlaAlaValLeuProThrAlaCysGlySerGlyGluThrAspLysIleGl
yArgAlaSerThrValPheAsnMetLeuGlyLysAsnAspArgIleGluValGluGlyPheAspAspProAspVal
GlnGlyValAlaCysTyrIleSerTyrAlaLysLysGlyGlyLeuLysGluMetValAsnLeuGluGluAspAlaS
erAspAlaSerValSerCysValGlnThrAlaSerSerIleSerPheAspGluThrAlaValArgLysProLysGl
uValPheLysArgGlyThrGlyPheAlaPheLysSerArgGlnIleValArgTyrTyrAspProLysArgLysAla
PheAlaTyrLeuValTyrSerAspLysIleValGlnGlySerProLysAsnSerLeuSerAlaValSerCysPheG
lySerGlyIleProGlnThrAspGlyValGlnAlaAspThrSerGlyLysLeuLeuAlaGlyAlaCysIleIleSe
rAsnProIleLysAsnProAspLysArg-186
g771
AMPHI Regions - AMPHI

| SEQ. ID. NO. | Region |
|---|---|
| SEQ. ID. NO. 36088 | 49-SerIleAlaHisThr-53 |
| SEQ. ID. NO. 36089 | 133-IleGlnAspLeuPheAspGlyAla-140 |
| SEQ. ID. NO. 36090 | 312-GlyIleAlaAsnIleGlyAsn-318 |
| SEQ. ID. NO. 36091 | 358-LeuGlnAspThrValAspArgLeuPro-366 |
| SEQ. ID. NO. 36092 | 369-ArgPheIleSerArgLeuAspGlySer-377 |
| SEQ. ID. NO. 36093 | 391-AsnGlyThrPheAsp-395 |
| SEQ. ID. NO. 36094 | 427-TyrLeuAspGluPheArg-432 |
| SEQ. ID. NO. 36095 | 437-LysIlePheProAspIleLeuGlyArgLeuSerGly-448 |
| SEQ. ID. NO. 36096 | 523-LeuGlnAspLeuPheGlyPheHis-530 |
| SEQ. ID. NO. 36097 | 581-GlyLeuSerGlyLys-585 |
| SEQ. ID. NO. 36098 | 601-IleSerAspGlyIleSerArgHisIleAspThr-611 |

Antigenic Index - Jameson-Wolf

| SEQ. ID. NO. | Region |
|---|---|
| SEQ. ID. NO. 36099 | 37-PheThrProGluAsnIleArgSerArgLeuGlnGln-48 |
| SEQ. ID. NO. 36100 | 52-HisThrHisArgLysIleSerPhe-59 |
| SEQ. ID. NO. 36101 | 61-AlaAspIleArgArgArgLeuLeuProArgProThrVal-73 |
| SEQ. ID. NO. 36102 | 79-ThrIleThrGluProAspGlyGlyArg-87 |
| SEQ. ID. NO. 36103 | 90-ValSerValLysGluThrLysIle-97 |
| SEQ. ID. NO. 36104 | 104-LeuTrpSerAspArgIleGlnVal-111 |
| SEQ. ID. NO. 36105 | 122-AlaLeuThrArgAspArgAsnGlyAlaTrp-131 |
| SEQ. ID. NO. 36106 | 135-AspLeuPheAspGlyAlaLysHisSerAlaSerValAsn-147 |
| SEQ. ID. NO. 36107 | 150-IleValGluAsnSerThrValArg-157 |
| SEQ. ID. NO. 36108 | 174-LeuGlnSerProAspSerSerGlyGlnGlnPheGluSerSerGly-188 |
| SEQ. ID. NO. 36109 | 197-ValProTrpLysSerArgGlyLeuPhe-205 |
| SEQ. ID. NO. 36110 | 208-AspGlyIleGlyThrProGluIleSerPro-217 |
| SEQ. ID. NO. 36111 | 222-AlaSerThrSerLeuAspGlyHisGly-230 |
| SEQ. ID. NO. 36112 | 235-ThrThrGlySerProSerValArgPheAsnAlaGlyGlyAlaAsp-249 |
| SEQ. ID. NO. 36113 | 255-LeuArgAlaAspThrSerPhe-261 |
| SEQ. ID. NO. 36114 | 275-LeuLysAsnAsnSerIleLysThrGlyThrVal-285 |

TABLE 1-continued

| | |
|---|---|
| SEQ. ID. NO. 36115 | 291-AlaGlyGlyGluTyrAlaArgTrpProGlySerPheLysLeuAspLysAlaAsnLeu-309 |
| SEQ. ID. NO. 36116 | 317-GlyAsnAlaGluIleSerGlySerPheLysThrProArgLeuGln-331 |
| SEQ. ID. NO. 36117 | 342-TrpSerArgAspAsnGlyLeuAspAlaProArg-352 |
| SEQ. ID. NO. 36118 | 360-AspThrValAspArgLeuProGlnProArgPheIleSerArgLeuAspGlySerLeu-378 |
| SEQ. ID. NO. 36119 | 389-GluLeuAsnGlyThrPheAspArgGlnProVal-399 |
| SEQ. ID. NO. 36120 | 404-LysTyrThrArgGluGlyAlaProHisLeu-413 |
| SEQ. ID. NO. 36121 | 429-AspGluPheArgGlnGlnAsnGlyLysIle-438 |
| SEQ. ID. NO. 36122 | 443-LeuGlyArgLeuSerGlyAsnValGluAla-452 |
| SEQ. ID. NO. 36123 | 464-LeuGlnLeuAspAspMetGlu-470 |
| SEQ. ID. NO. 36124 | 473-LeuHisAlaAspLysAspHisIleAla-481 |
| SEQ. ID. NO. 36125 | 483-SerArgPheLysSerGlyLeuTyrGlyGlyHisThrGluGlyGlyIle-498 |
| SEQ. ID. NO. 36126 | 502-AsnThrArgProAlaThrTyrArgLeuGlnGlnAsnAlaSerAsn-516 |
| SEQ. ID. NO. 36127 | 531-SerPheSerGlyAsnGlyAspAlaVal-539 |
| SEQ. ID. NO. 36128 | 543-ThrAlaSerGlyGluAsnArgLysGlnLeuIleArgSerLeuGlnGlySerLeu-560 |
| SEQ. ID. NO. 36129 | 564-IleSerAsnGlyAla-568 |
| SEQ. ID. NO. 36130 | 573-AspMetAspSerIleLeuLysAsnGlyLeuSerGlyLysIleSerGly-588 |
| SEQ. ID. NO. 36131 | 597-LeuAsnSerGluIleSerAspGlyIleSerArgHisIleAsp-610 |
| SEQ. ID. NO. 36132 | 623-AsnGlyTyrThrAsnLeuAspThrGlnGluLeuSerGlu-635 |
| SEQ. ID. NO. 36133 | 642-AlaValHisProLysAsnLysProIlePro-651 |
| SEQ. ID. NO. 36134 | 656-GlyThrValAspLysProSerIleThrValAspTyrGlyArgLeuThrGlyGlyIleAsnSerArgLysGluLysGlnLysIleLeuGlu-685 |
| SEQ. ID. NO. 36135 | 695-LeuLysProLysGluPro-700 |
| Hydrophilic Regions - Hopp-Woods | |
| SEQ. ID. NO. 36136 | 40-GluAsnIleArgSerArgLeuGln-47 |
| SEQ. ID. NO. 36137 | 53-ThrHisArgLysIleSerPhe-59 |
| SEQ. ID. NO. 36138 | 61-AlaAspIleArgArgArgLeuLeuPro-69 |
| SEQ. ID. NO. 36139 | 81-ThrGluProAspGlyGlyArg-87 |
| SEQ. ID. NO. 36140 | 90-ValSerValLysGluThrLysIle-97 |
| SEQ. ID. NO. 36141 | 122-AlaLeuThrArgAspArgAsnGly-129 |
| SEQ. ID. NO. 36142 | 135-AspLeuPheAspGlyAlaLysHisSerAlaSer-145 |
| SEQ. ID. NO. 36143 | 175-GlnSerProAspSerSerGlyGlnGlnPheGlu-185 |
| SEQ. ID. NO. 36144 | 255-LeuArgAlaAspThrSerPhe-261 |
| SEQ. ID. NO. 36145 | 302-PheLysLeuAspLysAlaAsnLeu-309 |
| SEQ. ID. NO. 36146 | 325-PheLysThrProArgLeu-330 |
| SEQ. ID. NO. 36147 | 344-ArgAspAsnGlyLeuAspAlaProArg-352 |
| SEQ. ID. NO. 36148 | 360-AspThrValAspArgLeuProGln-367 |
| SEQ. ID. NO. 36149 | 370-PheIleSerArgLeuAspGly-376 |
| SEQ. ID. NO. 36150 | 392-GlyThrPheAspArgGlnProVal-399 |
| SEQ. ID. NO. 36151 | 404-LysTyrThrArgGluGlyAlaPro-411 |
| SEQ. ID. NO. 36152 | 429-AspGluPheArgGlnGlnAsn-435 |
| SEQ. ID. NO. 36153 | 465-GlnLeuAspAspMetGlu-470 |
| SEQ. ID. NO. 36154 | 473-LeuHisAlaAspLysAspHisIleAla-481 |
| SEQ. ID. NO. 36155 | 544-AlaSerGlyGluAsnArgLysGlnLeuIle-553 |
| SEQ. ID. NO. 36156 | 600-GluIleSerAspGlyIleSerArgHisIleAsp-610 |
| SEQ. ID. NO. 36157 | 629-AspThrGlnGluLeuSerGlu-635 |
| SEQ. ID. NO. 36158 | 643-ValHisProLysAsnLysProIlePro-651 |
| SEQ. ID. NO. 36159 | 656-GlyThrValAspLysProSerIle-663 |
| SEQ. ID. NO. 36160 | 674-IleAsnSerArgLysGluLysGlnLysIleLeuGlu-685 |
| SEQ. ID. NO. 36161 | 696-LysProLysGluPro-700 |
| g772 | |
| AMPHI Regions - AMPHI | |
| SEQ. ID. NO. 36162 | 1-ValPheGlyThrValLeuArgThrAspAlaAspCysLeuGlnIleIleVa
lValGlyLysPhePheGlnValValAlaTyrGlyPheAlaAlaLeuAlaGluGlyGluPheHisGlnPheGlyGluMetIleGluIleValArgLeuAlaAspT
hrValPheHisArgAsnHisAlaHisHisCysGlyIleAspPheArgArgGlyIleGluArgPheGlyArgHisValAsnGlnGlnLeuHisIleGluLysIle
LeuGlnHisHisThrGlnAlaThrValValValAlaPheArgArgGlyAsnHisAlaLeuAspHisPhePheLeuGlnHisLysValHisIleGlyAspIleVa
lArgHisLeuArgGlnPheGluGlnLysArgArgGlyAspValIleArgGlnValAlaAspAspPheLeuPheAlaAspAlaValGluIleLysLeuGlnHisV
alAlaPheValAsnHisGlnPheIleArgLysArgGlnArgPheGlnThrAlaTyrAspValAlaValAspPheAspAsnValGlnAlaValGlnLeuPheArg
GlnArgPheGlyAsnCysArgGlnThrArgAlaAspPheAsnHisAspIleIleArgLeuArgAlaHisGlyValAspAsnIleAlaAspAsnProArgValLe
uGlnLysIleLeuProGluThrLeuAlaGlyPheValPhePheHisArgValSerSerSerValGluThrProProPheArgAlaAlaGlySerAspSerValT
rpAlaGlyArgAsnProPheGlnIleArgThrThrHisArgAlaValLeuTyrValSerSerCysValLeuGluHisLysCysValTyrSerIleArgLeuMet
SerAlaLeu-297 |

Antigenic Index - Jameson-Wolf (SEQ. ID. NO. 36162)
1-ValPheGlyThrValLeuArgThrAspAlaAspCysLeuGlnIleIleValValGlyLysPhePheGlnValVa
lAlaTyrGlyPheAlaAlaLeuAlaGluGlyGluPheHisGlnPheGlyGluMetIleGluIleValArgLeuAla
AspThrValPheHisArgAsnHisAlaHisHisCysGlyIleAspPheArgArgGlyIleGluArgPheGlyArgH
isValAsnGlnGlnLeuHisIleGluLysIleLeuGlnHisHisThrGlnAlaThrValValValAlaPheArgAr
gGlyAsnHisAlaLeuAspHisPhePheLeuGlnHisLysValHisIleGlyAspIleValArgHisLeuArgGln
PheGluGlnLysArgArgGlyAspValIleArgGlnValAlaAspAspPheLeuPheAlaAspAlaValGluIleL
ysLeuGlnHisValAlaPheValAsnHisGlnPheIleArgLysArgGlnArgPheGlnThrAlaTyrAspValAl
aValAspPheAspAsnValGlnAlaValGlnLeuPheArgGlnArgPheGlyAsnCysArgGlnThrArgAlaAsp
PheAsnHisAspIleIleArgLeuArgAlaHisGlyValAspAsnIleAlaAspAsnProArgValLeuGlnLysI
leLeuProGluThrLeuAlaGlyPheValPhePheHisArgValSerSerSerValGluThrProProPheArgAl
aAlaGlySerAspSerValTrpAlaGlyArgAsnProPheGlnIleArgThrThrHisArgAlaValLeuTyrVal
SerSerCysValLeuGluHisLysCysValTyrSerIleArgLeuMetSerAlaLeu-297
Hydrophilic Regions - Hopp-Woods (SEQ. ID. NO. 36162)
1-ValPheGlyThrValLeuArgThrAspAlaAspCysLeuGlnIleIleValValGlyLysPhePheGlnValVa
lAlaTyrGlyPheAlaAlaLeuAlaGluGlyGluPheHisGlnPheGlyGluMetIleGluIleValArgLeuAla
AspThrValPheHisArgAsnHisAlaHisHisCysGlyIleAspPheArgArgGlyIleGluArgPheGlyArgH
isValAsnGlnGlnLeuHisIleGluLysIleLeuGlnHisHisThrGlnAlaThrValValValAlaPheArgAr
gGlyAsnHisAlaLeuAspHisPhePheLeuGlnHisLysValHisIleGlyAspIleValArgHisLeuArgGln
PheGluGlnLysArgArgGlyAspValIleArgGlnValAlaAspAspPheLeuPheAlaAspAlaValGluIleL TABLE 1-continued ysLeuGlnHisValAlaPheValAsnHisGlnPheIleArgLysArgGlnArgPheGlnThrAlaTyrAspValAl
aValAspPheAspAsnValGlnAlaValGlnLeuPheArgGlnArgPheGlyAsnCysArgGlnThrArgAlaAsp
PheAsnHisAspIleIleArgLeuArgAlaHisGlyValAspAsnIleAlaAspAsnProArgValLeuGlnLysI
leLeuProGluThrLeuAlaGlyPheValPhePheHisArgValSerSerValGluThrProProPheArgAl
aAlaGlySerAspSerValTrpAlaGlyArgAsnProPheGlnIleArgThrThrHisArgAlaValLeuTyrVal
SerSerCysValLeuGluHisLysCysValTyrSerIleArgLeuMetSerAlaLeu-297
g774
AMPHI Regions - AMPHI
SEQ. ID. NO. 36163    16-AlaSerCysAlaSerValLeu-22
SEQ. ID. NO. 36164    61-ValArgLeuSerAsnGluVal-67
SEQ. ID. NO. 36165    90-ValGlnLysLeuAsp-94
SEQ. ID. NO. 36166    115-ValGluThrAlaGlnAsnLeuTyrAsnGlnAlaLeuLysHisTyrGlnAsnGly-132
SEQ. ID. NO. 36167    170-CysGluSerValIleGluIle-176
SEQ. ID. NO. 36168    180-TyrAlaAsnArgPheLysAspSer-187
SEQ. ID. NO. 36169    210-AlaArgAlaThrTrpArgSerLeuIleGlnThrTyrProGly-223
Antigenic Index - Jameson-Wolf
SEQ. ID. NO. 36170    23-ProValProGluGlySerArgThrGluMetProThrGlnGluAsnAlaSerAspGlyIlePro-43
SEQ. ID. NO. 36171    49-LeuGlnAspArgLeuAspTyrLeuGlu-57
SEQ. ID. NO. 36172    59-LysIleValArgLeuSerAsnGluValGluMetLeuAsnGlyLysValLysAlaLeuGluHisThrLysIleHisProSerGlyArgThrTyrVal
                      GlnLysLeuAspAspArgLysLeuLysGlu-100
SEQ. ID. NO. 36173    102-TyrLeuAsnThrGluGlyGlySerAla-110
SEQ. ID. NO. 36174    125-AlaLeuLysHisTyrGlnAsnGlyArgPhe-134
SEQ. ID. NO. 36175    142-LysGlyAlaAspGlyGlyAspGlyGlySerIleAlaGln-154
SEQ. ID. NO. 36176    162-GlnSerArgAlaArgMetGlyAsnCys-170
SEQ. ID. NO. 36177    176-IleGlyGlyArgTyrAlaAsnArgPheLysAspSerProThrAla-190
SEQ. ID. NO. 36178    198-GlyGluCysGlnTyr-202
SEQ. ID. NO. 36179    204-LeuGlnGlnLysAspIleAla-210
SEQ. ID. NO. 36180    221-TyrProGlySerProAlaAlaLysArgAlaAlaAlaAlaValArgLysArg-237
Hydrophilic Regions - Hopp-Woods
SEQ. ID. NO. 36181    25-ProGluGlySerArgThrGluMetProThrGlnGluAsnAlaSerAsp-40
SEQ. ID. NO. 36182    49-LeuGlnAspArgLeuAspTyrLeuGlu-57
SEQ. ID. NO. 36183    59-LysIleValArgLeuSerAsnGluValGluMetLeuAsnGlyLysValLysAlaLeuGluHisThrLysIleHisProSerGly-86
SEQ. ID. NO. 36184    89-TyrValGlnLysLeuAspAspArgLysLeuLysGlu-100
SEQ. ID. NO. 36185    142-LysGlyAlaAspGlyGlyAspGlyGlySerIleAlaGln-154
SEQ. ID. NO. 36186    163-SerArgAlaArgMetGlyAsn-169
SEQ. ID. NO. 36187    180-TyrAlaAsnArgPheLysAspSerProThrAla-190
SEQ. ID. NO. 36188    198-GlyGluCysGlnTyr-202
SEQ. ID. NO. 36189    204-LeuGlnGlnLysAspIleAla-210
SEQ. ID. NO. 36190    225-ProAlaAlaLysArgAlaAlaAlaAlaValArgLysArg-237
g900-2
AMPHI Regions - AMPHI
SEQ. ID. NO. 36191    6-LeuGluAsnGlyThrHisSer-12
SEQ. ID. NO. 36192    19-GluArgThrTyrProGluProCysHisGluCysLysTerTerLeuArgArgIle-36
SEQ. ID. NO. 36193    43-AlaPheAlaGlnPheCys-48
SEQ. ID. NO. 36194    68-ValGlyLysHisLeuArgLysPheArgArgPheArgArgArgGly-82
SEQ. ID. NO. 36195    94-ValGlyLeuPheArgLeuAlaArgLeuPheHisValGlyAsnAspPheValAspArgPheLeuGlyPhePhe-117
SEQ. ID. NO. 36196    130-PheGlyHisPheAlaSer-135
SEQ. ID. NO. 36197    153-GlyGluGluPheLeuGluThrValValGluAlaAlaGlyAsnValAlaArgHisPheAspValLeuAspLeu-176
SEQ. ID. NO. 36198    193-SerHisGlnAsnArgIle-198
SEQ. ID. NO. 36199    230-HisGlnThrLeuGlyGlyAlaAspAlaGly-238
SEQ. ID. NO. 36200    242-ValGlnLeuHisPheGly-248
SEQ. ID. NO. 36201    265-GlyLysProSerGlyGlyAsnGlyLeuGlyGlyLeuValAsn-278
SEQ. ID. NO. 36202    311-AspGlyAlaAspValValAlaGlnMet-319
Antigenic Index - Jameson-Wolf
SEQ. ID. NO. 36203    1-GlyTerProGluProLeuGluAsnGlyThrHisSerGluProThrGluMetAsxGluArgThrTyrProGluProCysHisGluCysLysTerTer
                      LeuArgArgIleArgGlyGlnCys-40
SEQ. ID. NO. 36204    50-PheGlyValAspPheArgArgArgLysPhePhe-60
SEQ. ID. NO. 36205    70-LysHisLeuArgLysPheArgArgPheArgArgArgGlyGluGlyPheIle-86
SEQ. ID. NO. 36206    88-PheLysGlnArgAla-92
SEQ. ID. NO. 36207    105-ValGlyAsnAspPheValAsp-111
SEQ. ID. NO. 36208    120-PheProLysArgAsnGlyIleAla-127
SEQ. ID. NO. 36209    135-SerValGlnThrAspGlnGluPhe-142
SEQ. ID. NO. 36210    150-PheGlyGlnGlyGluGluPheLeu-157
SEQ. ID. NO. 36211    163-AlaAlaGlyAsnVal-167
SEQ. ID. NO. 36212    177-ValAlaProAspGlyAspPheValGly-185
SEQ. ID. NO. 36213    189-GlnAsnValGlySerHisGlnAsnArgIleThrGluGlnThrHisPhe-204
SEQ. ID. NO. 36214    233-LeuGlyGlyAspAlaGlyGlnAsnPro-241
SEQ. ID. NO. 36215    261-ValGluSerAlaGlyLysProSerGlyGlyAsnGly-272
SEQ. ID. NO. 36216    289-ValValIleGlyGluGluGluGluGlyPhe-298
SEQ. ID. NO. 36217    302-ValLeuArgArgAlaAspGlyGlyAlaAspGlyAlaAsp-314
SEQ. ID. NO. 36218    319-MetArgGlyAlaGlyGlyGlyTyrAlaGly-328
SEQ. ID. NO. 36219    343-MetProSerGluArgGluLysMetArgArg-352
SEQ. ID. NO. 36220    361-ProAlaAspAsnArg-365
Hydrophilic Regions - Hopp-Woods
SEQ. ID. NO. 36221    1-GlyTerProGluProLeuGluAsnGlyThrHisSerGluProThrGluMetAsxGluArgThrTyrPro-23
SEQ. ID. NO. 36222    25-ProCysHisGluCysLysTerTerLeuArgArgIleArgGly-38
SEQ. ID. NO. 36223    53-AspPheArgArgArgLysPhePhe-60
SEQ. ID. NO. 36224    70-LysHisLeuArgLysPheArgArgPheArgArgArgGlyGluGly-84
SEQ. ID. NO. 36225    121-ProLysArgAsnGly-125
SEQ. ID. NO. 36226    137-GlnThrAspGlnGluPhe-142

TABLE 1-continued

| SEQ. ID. NO. 36227 | 152-GlnGlyGluGluPheLeu-157 |
| SEQ. ID. NO. 36228 | 177-ValAlaProAspGlyAspPheValGly-185 |
| SEQ. ID. NO. 36229 | 194-HisGlnAsnArgIleThrGlu-200 |
| SEQ. ID. NO. 36230 | 233-LeuGlyGlyAspAlaGlyGln-239 |
| SEQ. ID. NO. 36231 | 263-SerAlaGlyLysProSerGly-269 |
| SEQ. ID. NO. 36232 | 289-ValValIleGlyGluGluGluGluGlyPhe-298 |
| SEQ. ID. NO. 36233 | 302-ValLeuArgArgAlaAspGlyGlyAlaAspGlyAlaAsp-314 |
| SEQ. ID. NO. 36234 | 343-MetProSerGluArgGluLysMetArgArg-352 | g902
AMPHI Regions - AMPHI

| SEQ. ID. NO. 36235 | 56-AlaValGlyHisPheAlaAspValProAla-65 |
| SEQ. ID. NO. 36236 | 77-LeuThrIleLysArgValHisGly-84 |
| SEQ. ID. NO. 36237 | 128-AspAlaValGlyGlyGly-133 |
| SEQ. ID. NO. 36238 | 190-PheGlyAspPheGlyAsp-195 |
| SEQ. ID. NO. 36239 | 216-AlaArgArgLeuAsp-220 |
| SEQ. ID. NO. 36240 | 241-AspValAlaHisPheLeuGlyGlyAla-249 |
| SEQ. ID. NO. 36241 | 266-ArgArgIleArgHisLeuPheGlyVal-274 |
| SEQ. ID. NO. 36242 | 288-GlyLysIleThrAlaValGlnGlyPheSer-297 |
| SEQ. ID. NO. 36243 | 318-ArgProThrGluAlaAlaGluGlyPhe-326 |
| SEQ. ID. NO. 36244 | 334-ArgLysCysAspGlyValValAspLysIleThrAlaAspVal-347 |

Antigenic Index - Jameson-Wolf

| SEQ. ID. NO. 36245 | 1-MetProSerGluProGluArgArgHisGlyAsnThrAla-13 |
| SEQ. ID. NO. 36246 | 26-PheSerGlyLysProPheLysIleThrGly-35 |
| SEQ. ID. NO. 36247 | 38-ValValLeuArgArgArgIleValGln-46 |
| SEQ. ID. NO. 36248 | 72-AlaHisThrAspGlyLeuThrIleLysArgValHisGly-84 |
| SEQ. ID. NO. 36249 | 89-GlnAsnGlyGlySer-93 |
| SEQ. ID. NO. 36250 | 97-GlnThrGlnGlyArgArgXxxAsn-104 |
| SEQ. ID. NO. 36251 | 113-IleAlaGluLysProArgProAlaLeu-121 |
| SEQ. ID. NO. 36252 | 134-LeuPheGluAspGlyGlyGlyPheLeuArgArgSerAspValAlaValAspProGlyArgAspValGln-156 |
| SEQ. ID. NO. 36253 | 175-ArgAlaArgAlaProValAsnGlyLysGlyGlyAsn-186 |
| SEQ. ID. NO. 36254 | 192-AspPheGlyAspGlyGlyGln-198 |
| SEQ. ID. NO. 36255 | 210-PheGluGlyAsnGlyTyrAlaArgArgLeuAspHisArgLeuGlnAsnGlyGlyAsnGlnArgLeu-231 |
| SEQ. ID. NO. 36256 | 252-IleAspValAspAspLeuArgProGluSerAspValValThrArgArgIleArg-269 |
| SEQ. ID. NO. 36257 | 277-GlyAsnLeuHisGlyAsnAspAla-284 |
| SEQ. ID. NO. 36258 | 296-PheSerGlyIleProGluArgArgIleAla-305 |
| SEQ. ID. NO. 36259 | 310-AlaHisArgProThrCysAlaLysArgProThrGluAlaAlaGlu-324 |
| SEQ. ID. NO. 36260 | 330-AlaArgHisArgArgLysCysAspGlyValValAspLysIleThrAla-345 |
| SEQ. ID. NO. 36261 | 347-ValHisAsnGlyProAlaPheGlnLysSerAla-357 |

Hydrophilic Regions - Hopp-Woods

| SEQ. ID. NO. 36262 | 1-MetProSerGluProGluArgArgHisGlyAsn-11 |
| SEQ. ID. NO. 36263 | 29-LysProPheLysIleThrGly-35 |
| SEQ. ID. NO. 36264 | 38-ValValLeuArgArgArgIleValGln-46 |
| SEQ. ID. NO. 36265 | 77-LeuThrIleLysArgValHisGly-84 |
| SEQ. ID. NO. 36266 | 99-GlnGlyArgArgXxxAsn-104 |
| SEQ. ID. NO. 36267 | 113-IleAlaGluLysProArgProAlaLeu-121 |
| SEQ. ID. NO. 36268 | 134-LeuPheGluAspGlyGlyGlyPheLeuArgArgSerAspValAlaValAspProGlyArgAspValGln-156 |
| SEQ. ID. NO. 36269 | 175-ArgAlaArgAlaProValAsnGlyLysGlyGlyAsn-186 |
| SEQ. ID. NO. 36270 | 214-GlyTyrAlaArgArgLeuAspHisArgLeuGlnAsn-225 |
| SEQ. ID. NO. 36271 | 252-IleAspValAspAspLeuArgProGluSerAspValValThrArgArgIleArg-269 |
| SEQ. ID. NO. 36272 | 299-IleProGluArgArgIleAla-305 |
| SEQ. ID. NO. 36273 | 313-ProThrCysAlaLysArgProThrGluAlaAlaGlu-324 |
| SEQ. ID. NO. 36274 | 330-AlaArgHisArgArgLysCysAspGlyValValAspLysIleThrAla-345 | g904
AMPHI Regions - AMPHI

| SEQ. ID. NO. 36275 | 1-MetMetGlnHisAsnArgPhePheAlaValGlyAlaGlyGlyAspAspGl yAspArgArgAlaAlaAspPhePheAsnProPheGlnIleCysPheGlyIleGlyArgGlnCysValValAlaPheHisAlaAspSerArgPheAlaProAlaG lyHisGlyPheValAsnArgPheAlaGlyPheHisArgIleArgThrAlaArgGlnAspValGlyPheAlaAlaAlaTrpGlnPheValAlaAspAlaAspIle AspGlyPheAsnAlaValHisTyrIleGluPheGlyAsnAlaHisThrGlyAsnAlaValAspLeuAspGlyAlaPheGlnGlyGlyGlyIleLysProAlaAl aAlaAlaAlaArgAlaAlaGlyTyrArgThrGluPheValSerAlaLeuArgGlnThrCysAlaTyrPheValGluGlnPheGlyArgGluArgAlaArgThrAspA laArgGlyIleGlyPheAspAspAlaGlnAsnIleIleGlnHisLeuArgThrTyrAlaArgAlaCysArgSerArgAlaGlyGluThrValGlyArgGlyAsn GluGlyValSerAlaValValAspValGlnGlnArgThrLeuArgAlaPheLysGlnGlnPhePheAlaValPheValPhePheValGlnHisAlaGlyHisVa lGlyAsnHisArgArgAsnAlaArgArgAspPhePheAspAsnArgHisHisValPheArgPheAsnArgSerGlyValMetGlnValLeuGluLeuAspValV alIleGlyLysAspGlyIleGlnPhePheThrGlnPhePheArgMetGlnGlnIleGlyGlyAlaAsnGlyAlaAlaCysHisPheValPheValGlyArgAla AspAlaAlaAlaGlyArgAlaAspPheAlaPheAlaAlaArgCysPheAlaGlyLeuValGluArgAspValArgGlnAspGlnArgAlaGlyArgArgAs pPheGlnThrAlaPheAspValPheHisAlaCysArgValGlnLeuValAspPheAlaGlnGlnGlyPheGlyGlyAsnAspAsnAlaArgThrAspGluAlaI leGlnSerPheValGlnAspThrAlaArgAsnGlnAlaGlnAsnGlyPheAlaAlaAspAspGlnGlyMetAlaArgIleValAlaAlaLeuGluAlaHis AspAlaAlaGlyPhePheArgGlnProValAsnAspPheThrPheThrLeuValAlaProLeuCysAlaAspTyrTyrAsnIlePheSerHisSerHisIleThr TyrArgTyr-436 |

Antigenic Index - Jameson-Wolf (SEQ. ID. NO. 36275)
1-MetMetGlnHisAsnArgPhePheAlaValGlyAlaGlyGlyAspAspGlyAspArgArgAlaAlaAspPhePh
eAsnProPheGlnIleCysPheGlyIleGlyArgGlnCysValValAlaPheHisAlaAspSerArgPheAlaPro
AlaGlyHisGlyPheValAsnArgPheAlaGlyPheHisArgIleArgThrAlaArgGlnAspValGlyPheAlaA
laAlaAlaTrpGlnPheValAlaAspAlaAspIleAspGlyPheAsnAlaValHisTyrIleGluPheGlyAsnAlaHi
sThrGlyAsnAlaValAspLeuAspGlyAlaPheGlnGlyGlyGlyIleLysProAlaAlaAlaAlaAlaArgAlaAla
GlyTyrArgThrGluPheValSerAlaLeuArgGlnThrCysAlaTyrPheValGluGlnPheGlyArgGluArgA
laArgThrAspAlaArgGlyIleGlyPheAspAspAlaGlnAsnIleIleGlnHisLeuArgThrTyrAlaArgAl
aCysArgSerArgAlaGlyGluThrValGlyArgGlyAsnGluGlyValSerAlaValValAspValGlnGlnArg
ThrLeuArgAlaPheLysGlnGlnPhePheAlaValPheValPhePheValGlnHisAlaGlyHisValGlyAsnH
isArgArgAsnAlaArgArgAspPhePheAspAsnArgHisHisValPheArgPheAsnArgSerGlyValMetGl
nValLeuGluLeuAspValValIleGlyLysAspGlyIleGlnPhePheThrGlnPhePheArgMetGlnGlnIle TABLE 1-continued GlyGlyAlaAsnGlyAlaAlaCysHisPheValPheValGlyArgAlaAspAlaAlaAlaGlyArgAlaAspPheA
laPheAlaAlaArgCysPheAlaGlyLeuValGluArgAspValValArgGlnAspGlnArgAlaGlyArgArgAs
pPheGlnThrAlaPheAspValPheHisAlaCysArgValGlnLeuValAspPheAlaGlnGlnGlyPheGlyGly
AsnAspAsnAlaArgThrAspGluAlaIleGlnSerPheValGlnAspThrAlaArgAsnGlnAlaGlnAsnGlyP
hePheAlaAlaAspAspGlnGlyMetAlaArgIleValAlaAlaLeuGluAlaHisAspAlaAlaGlyPhePheAr
gGlnProValAsnAspPheThrPheThrLeuValAlaProLeuCysAlaAspTyrTyrAsnIlePheSerHisSer
HisIleThrTyrArgTyr-436
Hydrophilic Regions - Hopp-Woods (SEQ. ID. NO. 36275)
1-MetMetGlnHisAsnArgPhePheAlaValGlyAlaGlyGlyAspAspGlyAspArgArgAlaAlaAspPhePh
eAsnProPheGlnIleCysPheGlyIleGlyArgGlnCysValValAlaPheHisAlaAspSerArgPheAlaPro
AlaGlyHisGlyPheValAsnArgPheAlaGlyPheHisArgIleArgThrAlaArgGlnAspValGlyPheAlaA
laAlaTrpGlnPheValAlaAspAlaAspIleAspGlyPheAsnAlaValHisTyrIleGluPheGlyAsnAlaHi
sThrGlyAsnAlaValAspLeuAspGlyAlaPheGlnGlyGlyGlyIleLysProAlaAlaAlaAlaArgAlaAla
GlyTyrArgThrGluPheValSerAlaLeuArgGlnThrCysAlaTyrPheValGluGlnPheGlyArgGluArgA
laArgThrAspAlaArgGlyIleGlyPheAspAspAlaGlnAsnIleIleGlnHisLeuArgThrTyrAlaArgAl
aCysArgSerArgAlaGlyGluThrValGlyArgGlyAsnGluGlyValSerAlaValValAspValGlnGlnArg
ThrLeuArgAlaPheLysGlnGlnPhePheAlaValPheValPhePheValGlnHisAlaGlyHisValGlyAsnH
isArgArgAsnAlaArgArgAspPhePheAspAsnArgHisHisValPheArgPheAsnArgSerGlyValMetGl
nValLeuGluLeuAspValValIleGlyLysAspGlyIleGlnPhePheThrGlnPhePheArgMetGlnGlnIle
GlyGlyAlaAsnGlyAlaAlaCysHisPheValPheValGlyArgAlaAspAlaAlaAlaGlyArgAlaAspPheA
laPheAlaAlaArgCysPheAlaGlyLeuValGluArgAspValValArgGlnAspGlnArgAlaGlyArgArgAs
pPheGlnThrAlaPheAspValPheHisAlaCysArgValGlnLeuValAspPheAlaGlnGlnGlyPheGlyGly
AsnAspAsnAlaArgThrAspGluAlaIleGlnSerPheValGlnAspThrAlaArgAsnGlnAlaGlnAsnGlyP
hePheAlaAlaAspAspGlnGlyMetAlaArgIleValAlaAlaLeuGluAlaHisAspAlaAlaGlyPhePheAr
gGlnProValAsnAspPheThrPheThrLeuValAlaProLeuCysAlaAspTyrTyrAsnIlePheSerHisSer
HisIleThrTyrArgTyr-436 g907-2
AMPHI Regions - AMPHI

| | |
|---|---|
| SEQ. ID. NO. 36276 | 6-LeuGluAsnGlyThrHisSer-12 |
| SEQ. ID. NO. 36277 | 19-GluArgThrTyrProGluProCysHisGluCysLysTerTerMetLysLysProThrAspThrLeuPro-41 |
| SEQ. ID. NO. 36278 | 74-AspAspValAlaSerValMetArgSer-82 |
| SEQ. ID. NO. 36279 | 98-LysGluGlyGluArgTrpLeuSerAlaMetSer-108 |
| SEQ. ID. NO. 36280 | 110-ArgLeuAlaArgPheValPro-116 |
| SEQ. ID. NO. 36281 | 161-GlyAlaArgGlyLeu-165 |
| SEQ. ID. NO. 36282 | 174-AsnTyrIleGlyLysProAlaHis-181 |
| SEQ. ID. NO. 36283 | 197-LeuArgHisTyrArgAsnLeuGluLysGlyAspIleValArgAlaLeuAlaArgPheAsnGly-217 |

Antigenic Index - Jameson-Wolf

| | |
|---|---|
| SEQ. ID. NO. 36284 | 1-GlyTerProGluProLeuGluAsnGlyThrHisSerGluProThrGluMetAsxGluArgThrTyrProGluProCysHisGluCysLysTer TerMetLysLysProThrAspThrLeuPro-41 |
| SEQ. ID. NO. 36285 | 44-LeuGlnArgArgArgLeuLeu-50 |
| SEQ. ID. NO. 36286 | 65-GlyAlaGlnArgGluGluThrLeuAlaAspAspValAlaSer-78 |
| SEQ. ID. NO. 36287 | 83-SerValGlySerValAsnProProArgLeuValPheAspAsnProLysGluGlyGluArgTrp-103 |
| SEQ. ID. NO. 36288 | 113-ArgPheValProAspGluGlyGluArgArgArgLeu-124 |
| SEQ. ID. NO. 36289 | 129-GlnTyrGluSerSerArgAlaGlyLeu-137 |
| SEQ. ID. NO. 36290 | 147-GluValGluSerAlaPhe-152 |
| SEQ. ID. NO. 36291 | 174-AsnTyrIleGlyLysProAlaHisAsn-182 |
| SEQ. ID. NO. 36292 | 187-ArgThrAsnLeuArgTyrGly-193 |
| SEQ. ID. NO. 36293 | 200-TyrArgAsnLeuGluLysGlyAspIleVal-209 |
| SEQ. ID. NO. 36294 | 216-AsnGlySerLeuGlySerAsnLysTyrProAsnAla-227 |
| SEQ. ID. NO. 36295 | 232-TrpArgAsnArgTrpGlnTrp-238 |

Hydrophilic Regions - Hopp-Woods

| | |
|---|---|
| SEQ. ID. NO. 36296 | 1-GlyTerProGluProLeuGluAsnGlyThrHisSerGluProThrGluMe tAsxGluArgThrTyrPro-23 |
| SEQ. ID. NO. 36297 | 25-ProCysHisGluCysLysTerTerMetLysLysProThrAsp-38 |
| SEQ. ID. NO. 36298 | 44-LeuGlnArgArgArgLeuLeu-50 |
| SEQ. ID. NO. 36299 | 65-GlyAlaGlnArgGluGluThrLeuAlaAspAspValAlaSer-78 |
| SEQ. ID. NO. 36300 | 92-LeuValPheAspAsnProLysGluGlyGluArgTrp-103 |
| SEQ. ID. NO. 36301 | 115-ValProAspGluGlyGluArgArgArgLeu-124 |
| SEQ. ID. NO. 36302 | 131-GluSerSerArgAlaGlyLeu-137 |
| SEQ. ID. NO. 36303 | 147-GluValGluSerAlaPhe-152 |
| SEQ. ID. NO. 36304 | 201-ArgAsnLeuGluLysGlyAspIleVal-209 | g908
AMPHI Regions - AMPHI

| | |
|---|---|
| SEQ. ID. NO. 36305 | 24-ThrAlaAlaGluLeu-28 |
| SEQ. ID. NO. 36306 | 125-ThrAspCysTyrArgSerTyrAspValLeuAspValSerGluPheSerHisPheSer-143 |

Antigenic Index - Jameson-Wolf

| | |
|---|---|
| SEQ. ID. NO. 36307 | 1-LysSerArgLeuSerArgTyrLysGlnAsnLysLeu-12 |
| SEQ. ID. NO. 36308 | 30-GlyIleAsnLysAsnThrAla-36 |
| SEQ. ID. NO. 36309 | 49-GlnAsnGlyProHis-53 |
| SEQ. ID. NO. 36310 | 57-PheAspGlyGluValGluAlaAspGluSerTyrPheGlyGlyGlnArgLysGlyLysArgGlyArgGlyAlaAlaGlyLys-83 |
| SEQ. ID. NO. 36311 | 89-LeuLeuLysArgAsnGlyLysVal-96 |
| SEQ. ID. NO. 36312 | 113-IleArgGluGlnValLysProAspSerIleVal-123 |
| SEQ. ID. NO. 36313 | 125-ThrAspCysTyrArgSerTyrAsp-132 |
| SEQ. ID. NO. 36314 | 159-ArgThrThrLysProTyr-164 |

Hydrophilic Regions - Hopp-Woods

| | |
|---|---|
| SEQ. ID. NO. 36315 | 1-LysSerArgLeuSerArgTyrLysGlnAsnLys-11 |
| SEQ. ID. NO. 36316 | 57-PheAspGlyGluValGluAlaAspGluSerTyr-67 |
| SEQ. ID. NO. 36317 | 70-GlyGlnArgLysGlyLysArgGlyArgGlyAlaAlaGly-82 |

TABLE 1-continued

| SEQ. ID. NO. 36318 | 90-LeuLysArgAsnGlyLys-95 |
| SEQ. ID. NO. 36319 | 113-IleArgGluGlnValLysProAspSer-121 | g909
AMPHI Regions - AMPHI
SEQ. ID. NO. 36320   24-GlnAspGlySerGly-28
Antigenic Index - Jameson-Wolf
SEQ. ID. NO. 36321   22-ThrTyrGlnAspGlySerGlyLysThrAlaValArgAlaLysCysSerThrGlyThrPro-41
SEQ. ID. NO. 36322   45-GlnAspGlyArgGlySerLysLysValAspCysAspGluTyrGlyGlyGluArgArgAlaValLeuArgAsnGlnLysArgGlyLysProAlaThr
                     ArgArgAlaAlaThr-81
SEQ. ID. NO. 36323   83-GlyLysProSerPheArgAlaArgAspGlyGlyGlyArgValAsnArgAlaGluThrGlyGluGlyLysArgSerAlaArg-109
Hydrophilic Regions - Hopp-Woods
SEQ. ID. NO. 36324   23-TyrGlnAspGlySerGlyLysThrAlaValArgAlaLysCysSerThr-38
SEQ. ID. NO. 36325   46-AspGlyArgGlySerLysLysValAspCysAspGluTyrGlyGlyGluArgArgAlaValLeuArgAsnGlnLysArgGlyLysProAlaThrArg
                     ArgAlaAlaThr-81
SEQ. ID. NO. 36326   85-ProSerPheArgAlaArgAspGlyGlyGlyArgValAsnArgAlaGluThrGlyGluGlyLysArgSerAlaArg-109 g910
AMPHI Regions - AMPHI
SEQ. ID. NO. 36327   22-SerAlaGluArgGlnIle-27
SEQ. ID. NO. 36328   39-LysAlaValLysMetLeuGlu-45
SEQ. ID. NO. 36329   69-AlaTyrLysAspGlyArg-74
Antigenic Index - Jameson-Wolf
SEQ. ID. NO. 36330   19-AlaGlyAspSerAlaGluArgGlnIleTyrGlyAspProHisPheGluGlnAsnArgThrLysAlaValLysMetLeuGluGlnArgGlyTyrGln-50
SEQ. ID. NO. 36331   53-AspValAspAlaAspAspTyrTrpGlyLysProValLeuGlu-66
SEQ. ID. NO. 36332   68-GluAlaTyrLysAspGlyArgGluTyrAsp-77
SEQ. ID. NO. 36333   83-ProAspLeuLysIleIleLysGluGlnLeuAspArg-94
Hydrophilic Regions - Hopp-Woods
SEQ. ID. NO. 36334   21-AspSerAlaGluArgGlnIleTyr-28
SEQ. ID. NO. 36335   31-ProHisPheGluGlnAsnArgThrLysAlaValLysMetLeuGluGlnArgGly-48
SEQ. ID. NO. 36336   53-AspValAspAlaAspAspTyrTrp-60
SEQ. ID. NO. 36337   68-GluAlaTyrLysAspGlyArgGluTyrAsp-77
SEQ. ID. NO. 36338   86-LysIleIleLysGluGlnLeuAspArg-94 g911
AMPHI Regions - AMPHI
SEQ. ID. NO. 36339   6-LeuGluPheTrpValGlyLeuPhe-13
SEQ. ID. NO. 36340   43-ValTyrAlaAspPheGlyAspIleGly-51
SEQ. ID. NO. 36341   97-ValSerAlaGlnIle-101
SEQ. ID. NO. 36342   118-GlyAspThrGluAsnLeuAla-124
SEQ. ID. NO. 36343   140-AsnLeuIleGlyLysPheMetThrSerPhe-149
Antigenic Index - Jameson-Wolf
SEQ. ID. NO. 36344   1-MetLysLysAsnIle-5
SEQ. ID. NO. 36345   35-GlyGlySerAspLysThrTyr-41
SEQ. ID. NO. 36346   48-GlyAspIleGlyGlyLeuLysValAsnAlaProValLys-60
SEQ. ID. NO. 36347   74-LeuAspProLysSerTyrGlnAlaArgValArgLeuAspLeuAspGlyLysTyrGlnPheSerSerAspVal-97
SEQ. ID. NO. 36348   103-ThrSerGlyLeuLeuGly-108
SEQ. ID. NO. 36349   115-GlnGlnGlyGlyAspThrGluAsn-122
SEQ. ID. NO. 36350   149-PheAlaGluLysAsnAlaGluGlyGlyAsnAlaGluLysAlaAlaGlu-164
Hydrophilic Regions - Hopp-Woods
SEQ. ID. NO. 36351   1-MetLysLysAsnIle-5
SEQ. ID. NO. 36352   36-GlySerAspLysThr-40
SEQ. ID. NO. 36353   74-LeuAspProLysSerTyrGlnAlaArgValArgLeuAspLeuAspGly-89
SEQ. ID. NO. 36354   116-GlnGlyGlyAspThrGluAsn-122
SEQ. ID. NO. 36355   149-PheAlaGluLysAsnAlaGluGlyGlyAsnAlaGluLysAlaAlaGlu-164 g912
AMPHI Regions - AMPHI
SEQ. ID. NO. 36356   23-SerProAlaAspAlaValGlyGlnIle-31
SEQ. ID. NO. 36357   63-AspPheGlnArgMetThrAlaLeuAlaValGlyAsnProTrpArgThrAlaSerAspAlaGlnLys-84
SEQ. ID. NO. 36358   89-LysGluPheGlnThrLeu-94
SEQ. ID. NO. 36359   169-TyrArgAsnGlnPheGlyGluIleIleLysAlaLysGlyIleAspGlyLeuIleAla-187
Antigenic Index - Jameson-Wolf
SEQ. ID. NO. 36360   1-ValLysLysSerSer-5
SEQ. ID. NO. 36361   23-SerProAlaAspAla-27
SEQ. ID. NO. 36362   31-IleArgGlnAsnAlaThrGln-37
SEQ. ID. NO. 36363   42-LeuLysSerGlyAspAlaAlaSerAlaArgProLysAlaGluAla-56
SEQ. ID. NO. 36364   74-AsnProTrpArgThrAlaSerAspAlaGlnLysGlnAlaLeuAlaLysGluPhe-91
SEQ. ID. NO. 36365   104-LeuLysPheLysAsn-108
SEQ. ID. NO. 36366   112-AsnValLysAspAsnProIleValAsnLysGlyGlyLysGluIleValVal-128
SEQ. ID. NO. 36367   134-IleProGlyGlnLysProValAsnMet-142
SEQ. ID. NO. 36368   146-ThrTyrGlnSerGlyGlyLysTyrArgThr-155
SEQ. ID. NO. 36369   169-TyrArgAsnGlnPhe-173
SEQ. ID. NO. 36370   177-IleLysAlaLysGlyIleAsp-183
SEQ. ID. NO. 36371   189-LeuLysAlaLysAsnGlyGlyLys-196
Hydrophilic Regions - Hopp-Woods
SEQ. ID. NO. 36372   1-ValLysLysSerSer-5
SEQ. ID. NO. 36373   31-IleArgGlnAsnAla-35
SEQ. ID. NO. 36374   43-LysSerGlyAspAlaAlaSerAlaArgProLysAlaGluAla-56
SEQ. ID. NO. 36375   78-ThrAlaSerAspAlaGlnLysGlnAlaLeuAlaLysGluPhe-91
SEQ. ID. NO. 36376   104-LeuLysPheLysAsn-108
SEQ. ID. NO. 36377   112-AsnValLysAspAsnProIleVal-119
SEQ. ID. NO. 36378   121-LysGlyGlyLysGluIleValVal-128

TABLE 1-continued

SEQ. ID. NO. 36379    177-IleLysAlaLysGlyIleAsp-183
SEQ. ID. NO. 36380    189-LeuLysAlaLysAsnGlyGlyLys-196
g913
AMPHI Regions - AMPHI
SEQ. ID. NO. 36381    22-GluThrArgProAlaAspProTyrGluGlyTyrAsnArgAlaValSerLysPheAsnAspGlnAla-43
SEQ. ID. NO. 36382    53-ArgGlyTyrArgLysValThrProLys-61
SEQ. ID. NO. 36383    66-GlyValSerAsnPhePheAsnAsnLeuArgAspValValSer-79
SEQ. ID. NO. 36384    107-LeuGlyGlyLeuIleAspIleAlaGly-115
SEQ. ID. NO. 36385    151-ValArgAspAlaLeuGlyThrGlyIleThrSerValTyr-163
SEQ. ID. NO. 36386    193-AspLeuThrAspSerLeuAspGluAlaAla-202
SEQ. ID. NO. 36387    240-LeuValGluSerAla-244
SEQ. ID. NO. 36388    259-SerGluThrGlnAla-263
Antigenic Index - Jameson-Wolf
SEQ. ID. NO. 36389    1-MetLysLysThrAla-5
SEQ. ID. NO. 36390    21-AlaGluThrArgProAlaAspProTyrGluGlyTyrAsnArgAlaValSerLysPheAsnAspGlnAlaAspArgTyr-46
SEQ. ID. NO. 36391    51-AlaAlaArgGlyTyrArgLysValThrProLysProValArgAla-65
SEQ. ID. NO. 36392    87-LeuAspIleLysArgAlaSerGluAspLeuVal-97
SEQ. ID. NO. 36393    117-GlyGlyValProAspAsnLysAsnThrLeuGlyAsp-128
SEQ. ID. NO. 36394    132-SerTrpGlyTrpLysAsnSerAsn-139
SEQ. ID. NO. 36395    149-SerThrValArgAspAlaLeu-155
SEQ. ID. NO. 36396    163-TyrProProLysAsn-167
SEQ. ID. NO. 36397    173-ProAlaGlyArgTrpGly-178
SEQ. ID. NO. 36398    186-SerThrArgGluGlyLeuLeuAspLeuThrAspSerLeuAspGluAlaAlaIleAspLysTyrSerTyrThrArgAspLeuTyrMet-214
SEQ. ID. NO. 36399    216-ValArgAlaArgGlnThrGlyAlaThrProAlaGluGlyThrGluAspAsnIleAspIleAspIleAspGluLeuValGluSerAlaGluThrGly
                      AlaAla-249
SEQ. ID. NO. 36400    252-AlaValHisGluAspSerValSerGluThrGlnAlaGluAlaAlaGlyGluAlaGluThrGlnProGlyThrGlnPro-277
Hydrophilic Regions - Hopp-Woods
SEQ. ID. NO. 36401    1-MetLysLysThrAla-5
SEQ. ID. NO. 36402    21-AlaGluThrArgProAlaAspProTyrGluGlyTyrAsn-33
SEQ. ID. NO. 36403    35-AlaValSerLysPheAsnAspGlnAlaAsp-44
SEQ. ID. NO. 36404    53-ArgGlyTyrArgLysValThrProLysProValArg-64
SEQ. ID. NO. 36405    87-LeuAspIleLysArgAlaSerGluAspLeuVal-97
SEQ. ID. NO. 36406    118-GlyValProAspAsnLysAsnThrLeu-126
SEQ. ID. NO. 36407    150-ThrValArgAspAlaLeu-155
SEQ. ID. NO. 36408    186-SerThrArgGluGlyLeuLeuAspLeuThrAspSerLeuAspGluAlaAlaIleAsp-204
SEQ. ID. NO. 36409    216-ValArgAlaArgGlnThrGly-222
SEQ. ID. NO. 36410    224-ThrProAlaGluGlyThrGluAspAsnIleAspIleAspIleAspGluLeuValGluSerAlaGluThrGlyAlaAla-249
SEQ. ID. NO. 36411    252-AlaValHisGluAspSerValSerGluThrGlnAlaGluAlaAlaGlyGluAlaGluThrGlnPro-273
g914-2
AMPHI Regions - AMPHI
SEQ. ID. NO. 36412    6-LeuGlyIleLeuThrAlaCysAlaAlaMet-15
SEQ. ID. NO. 36413    17-AlaPheAlaAspArgIleSerAspLeu-25
SEQ. ID. NO. 36414    65-PheGlnLysThrPheGlu-70
SEQ. ID. NO. 36415    81-GlnLysValArgGlnAlaCys-87
Antigenic Index - Jameson-Wolf
SEQ. ID. NO. 36416    18-PheAlaAspArgIleSerAspLeuGluAlaArgLeuAlaGlnLeuGluHisArgValAlaValLeuGluSerGlyGlyAsnThrValLys-47
SEQ. ID. NO. 36417    50-LeuPheGlySerAsnSer-55
SEQ. ID. NO. 36418    64-ProPheGlnLysThrPheGluAlaSerAspArgAsnGluGlyValAlaArgGlnLysValArgGlnAlaCysAsnArgGluThrSerAla-93
SEQ. ID. NO. 36419    96-CysGlyAspGluAlaIleArgCysArgLysPheAsp-107
Hydrophilic Regions - Hopp-Woods
SEQ. ID. NO. 36420    18-PheAlaAspArgIleSerAspLeuGluAlaArgLeuAlaGlnLeuGluHisArgValAlaVal-38
SEQ. ID. NO. 36421    67-LysThrPheGluAlaSerAspArgAsnGluGlyValAlaArgGlnLysValArgGlnAlaCysAsnArgGluThrSer-92
SEQ. ID. NO. 36422    96-CysGlyAspGluAlaIleArgCysArgLysPheAsp-107
g915
AMPHI Regions - AMPHI
SEQ. ID. NO. 36423    8-IleValAlaValPheAlaLeuSerAla-16
SEQ. ID. NO. 36424    31-IleSerAspArgSerVal-36
SEQ. ID. NO. 36425    69-ValLysGlnMetPheGlyTyrThrLysLeuProGluGluProLysGlyIleArgValIleTyrValThrAspMetGlyAsnValThrAspTrpThr-100
SEQ. ID. NO. 36426    139-GlnAlaGluLysPhe-143
Antigenic Index - Jameson-Wolf
SEQ. ID. NO. 36427    16-AlaCysArgGlnAlaGluGluAlaProProProLeuProArgGlnIleSerAspArgSerValGlyHisTyrCysSerMetAsnLeuThrGluHis
                      AsnGlyProLysAla-52
SEQ. ID. NO. 36428    56-LeuAsnGlyLysProAspGlnProVal-64
SEQ. ID. NO. 36429    75-TyrThrLysLeuProGluGluProLysGlyIle-85
SEQ. ID. NO. 36430    92-AspMetGlyAsnValThrAspTrpThrAsnProAsnAlaAspThrGluTrpIleAspAlaLysLys-113
SEQ. ID. NO. 36431    125-GlyMetGlyAlaGluAspAlaLeuProPheGlyAsnGluGlnAlaGluLysPheAlaLysAspLysGlyGlyLysValValGly-153
SEQ. ID. NO. 36432    155-AspAspMetProAsp-159
Hydrophilic Regions - Hopp-Woods
SEQ. ID. NO. 36433    18-ArgGlnAlaGluGluAlaProProProLeu-27
SEQ. ID. NO. 36434    30-GlnIleSerAspArgSerVal-36
SEQ. ID. NO. 36435    46-GluHisAsnGlyProLys-51
SEQ. ID. NO. 36436    58-GlyLysProAspGln-62
SEQ. ID. NO. 36437    77-LysLeuProGluGluProLysGlyIle-85
SEQ. ID. NO. 36438    103-AsnAlaAspThrGluTrpIleAspAlaLysLys-113
SEQ. ID. NO. 36439    127-GlyAlaGluAspAlaLeu-132
SEQ. ID. NO. 36440    135-GlyAsnLysGluGlnAlaGluLysPheAlaLysAspLysGlyGlyLys-150
SEQ. ID. NO. 36441    155-AspAspMetProAsp-159
g917

TABLE 1-continued

AMPHI Regions - AMPHI
SEQ. ID. NO. 36442    6-ProLeuAlaValLeuThrAlaLeuLeuLeu-15
SEQ. ID. NO. 36443    35-GlnAsnValLeuLysIleTyrAsnTrpSerGluTyrValAspProGluThrValAlaAsp-54
SEQ. ID. NO. 36444    99-IleLysAlaGlyAlaTyrGlnLysIleAspLysSer-110
SEQ. ID. NO. 36445    124-ArgLeuMetAspGlyValAsp-130
SEQ. ID. NO. 36446    152-ArgValLysLysAlaLeu-157
SEQ. ID. NO. 36447    188-AspSerAlaAlaGlu-192
SEQ. ID. NO. 36448    206-AsnSerSerAsnThrGluAspIleArgGluAlaThr-217
SEQ. ID. NO. 36449    292-AlaLysAsnValAlaAsnAlaHisLysTyrIleAsnAspPheLeuAsp-307
SEQ. ID. NO. 36450    325-LysProAlaArgAspLeuMetGluAsp-333
Antigenic Index - Jameson-Wolf
SEQ. ID. NO. 36451    18-CysGlyGlySerAspLysProProAlaGluLysProAlaProAlaGluAsnGlnAsnVal-37
SEQ. ID. NO. 36452    44-SerGluTyrValAspProGluThrValAlaAspPheGluLysLysAsnGlyIleLysValThr-64
SEQ. ID. NO. 36453    68-TyrAspSerAspGluThrLeuGluSerLysValLeuThrGlyLysSerGlyTyrAsp-86
SEQ. ID. NO. 36454    102-GlyAlaTyrGlnLysIleAspLysSerMetIleProAsnTyrLysHisLeuAsnProGluMetMetArgLeuMetAspGlyValAspProAsp
                      HisGluTyr-135
SEQ. ID. NO. 36455    149-AsnThrGluArgValLysLysAlaLeuGlyThrAspLysLeuProAspAsnGln-166
SEQ. ID. NO. 36456    171-PheAsnProGluTyr-175
SEQ. ID. NO. 36457    179-LeuLysGlnCysGly-183
SEQ. ID. NO. 36458    201-LeuGlyLysAsnProAsnSerSerAsnThrGluAspIleArgGluAlaThrAlaLeuLeuLysLysAsnArgProAsnIleLysArgPheThrSer
                      SerGlyPheIle-236
SEQ. ID. NO. 36459    238-AspLeuAlaArgGlyAspThr-244
SEQ. ID. NO. 36460    255-AsnIleAlaLysArgArgAlaGluGluAlaGlyGlyLysGluLysIleArgValMetMetProLysGluGlyValGly-280
SEQ. ID. NO. 36461    287-ValIleProLysAspAlaLysAsnValAlaAsn-297
SEQ. ID. NO. 36462    305-PheLeuAspProGluValSerAlaLysAsnGlyAsn-316
SEQ. ID. NO. 36463    320-TyrAlaProSerSerLysProAlaArgAspLeuMetGluAspGluPheLysAsnAspAsnThrIlePheProSerGlyGluAspLeuLysAsn-350
SEQ. ID. NO. 36464    368-GlnTrpGlnAspValLysAlaGlyLys-376
Hydrophilic Regions - Hopp-Woods
SEQ. ID. NO. 36465    19-GlyGlySerAspLysProProAlaGluLysProAlaProAlaGluAsn-34
SEQ. ID. NO. 36466    47-ValAspProGluThrValAlaAspPheGluLysLysAsnGlyIle-61
SEQ. ID. NO. 36467    68-TyrAspSerAspGluThrLeuGluSerLysValLeuThr-80
SEQ. ID. NO. 36468    105-GlnLysIleAspLysSerMet-111
SEQ. ID. NO. 36469    121-GluMetMetArgLeuMetAspGlyValAspProAspHisGluTyr-135
SEQ. ID. NO. 36470    149-AsnThrGluArgValLysLysAlaLeuGlyThrAspLysLeuProAspAsnGln-166
SEQ. ID. NO. 36471    204-AsnProAsnSerSerAsnThrGluAspIleArgGluAlaThrAlaLeuLeuLysLysAsnArgProAsnIleLysArgPheThr-231
SEQ. ID. NO. 36472    238-AspLeuAlaArgGlyAspThr-244
SEQ. ID. NO. 36473    255-AsnIleAlaLysArgArgAlaGluGluAlaGlyGlyLysGluLysIleArgValMetMetProLysGluGly-278
SEQ. ID. NO. 36474    290-LysAspAlaLysAsnValAlaAsn-297
SEQ. ID. NO. 36475    305-PheLeuAspProGluValSerAlaLysAsn-314
SEQ. ID. NO. 36476    322-ProSerSerLysProAlaArgAspLeuMetGluAspGluPheLysAsnAspAsn-339
SEQ. ID. NO. 36477    344-SerGlyGluAspLeuLysAsn-350
SEQ. ID. NO. 36478    370-GlnAspValLysAlaGlyLys-376
g919
AMPHI Regions - AMPHI
SEQ. ID. NO. 36479    8-SerAlaLeuTyrGlyIleAlaAlaAlaAlaIleLeu-18
SEQ. ID. NO. 36480    24-ArgSerIleGlnThrPheProGln-31
SEQ. ID. NO. 36481    37-IleAsnGlyProAspArgProAlaGlyIleProAspProAlaGly-51
SEQ. ID. NO. 36482    76-AspPheAlaLysSerLeuGln-82
SEQ. ID. NO. 36483    98-GlnAspValCysAlaGlnAlaPheGlnThrProVal-109
SEQ. ID. NO. 36484    118-PheGluArgTyrPheThr-123
SEQ. ID. NO. 36485    133-LeuAlaGlyThrValThrGlyTyrTyrGlu-142
SEQ. ID. NO. 36486    161-GlyIleProAspAspPheIleSerValPro-170
SEQ. ID. NO. 36487    176-ArgGlyGlyLysAsnLeuValArgIleArgGln-186
SEQ. ID. NO. 36488    191-SerGlyThrIleAspAsnAlaGlyGlyThr-200
SEQ. ID. NO. 36489    308-GlnGlyIleLysAlaTyrMetArgGlnAsnProGlnArgLeuAlaGluValLeu-325
SEQ. ID. NO. 36490    348-AlaLeuGlyThrProLeuMetGlyGluTyrAlaGlyAlaIle-361
SEQ. ID. NO. 36491    382-ArgLysAlaLeuAsnArg-387
Antigenic Index - Jameson-Wolf
SEQ. ID. NO. 36492    1-MetLysLysHisLeuLeu-6
SEQ. ID. NO. 36493    21-CysGlnSerArgSerIleGln-27
SEQ. ID. NO. 36494    30-ProGlnProAspThr-34
SEQ. ID. NO. 36495    36-ValIleAsnGlyProAspArgProAlaGlyIleProAspProAlaGly-51
SEQ. ID. NO. 36496    76-AspPheAlaLysSerLeuGln-82
SEQ. ID. NO. 36497    87-GlyCysAlaAsnLeuLysAsnArgGlnGlyTrpGln-98
SEQ. ID. NO. 36498    113-GlnAlaLysArgPhePhe-118
SEQ. ID. NO. 36499    121-TyrPheThrProTrp-125
SEQ. ID. NO. 36500    143-ProValLeuLysGlyAspGlyArgArgThrGluArgAlaArg-156
SEQ. ID. NO. 36501    161-GlyIleProAspAspPheIle-167
SEQ. ID. NO. 36502    173-AlaGlyLeuArgGlyGlyLysAsnLeuValArgIleArgGlnThrGlyLysAsnSerGlyThrIleAspAsnAlaGlyGlyThrHis-201
SEQ. ID. NO. 36503    215-ThrAlaIleLysGlyArgPheGluGlySerArgPheLeuProTyrHisThrArgAsnGlnIleAsnGlyGlyAlaLeuAspGlyLysAlaPro-245
SEQ. ID. NO. 36504    250-AlaGluAspProValGlu-255
SEQ. ID. NO. 36505    262-GlnGlySerGlyArgLeuLysThrProSerGlyLysTyrIleArg-276
SEQ. ID. NO. 36506    278-GlyTyrAlaAspLysAsnGluHisPro-286
SEQ. ID. NO. 36507    293-TyrMetAlaAspLysGlyTyrLeuLysLeuGlyGln-304
SEQ. ID. NO. 36508    312-AlaTyrMetArgGlnAsnProGlnArgLeuAlaGlu-323
SEQ. ID. NO. 36509    326-GlyGlnAsnProSer-330
SEQ. ID. NO. 36510    337-LeuAlaGlySerGlyAsnGluGlyProVal-346
SEQ. ID. NO. 36511    359-GlyAlaIleAspArgHisTyr-365
SEQ. ID. NO. 36512    379-ProValThrArgLysAlaLeuAsn-386
SEQ. ID. NO. 36513    393-AspThrGlySerAlaIleLysGlyAlaValArg-403

TABLE 1-continued

| | |
|---|---|
| SEQ. ID. NO. 36514 | 409-GlyTyrGlyAspGluAlaGlyGluLeuAlaGlyLysGlnLysThrThr-424 |
| SEQ. ID. NO. 36515 | 431-LeuProAsnGlyMetLysProGluTyrArgPro-441 |

Hydrophilic Regions - Hopp-Woods

| | |
|---|---|
| SEQ. ID. NO. 36516 | 1-MetLysLysHisLeuLeu-6 |
| SEQ. ID. NO. 36517 | 38-AsnGlyProAspArgProAlaGlyIleProAspProAlaGly-51 |
| SEQ. ID. NO. 36518 | 90-AsnLeuLysAsnArgGlnGlyTrp-97 |
| SEQ. ID. NO. 36519 | 144-ValLeuLysGlyAspGlyArgArgThrGluArgAlaArg-156 |
| SEQ. ID. NO. 36520 | 175-LeuArgGlyGlyLysAsnLeuValArgIleArgGlnThrGlyLysAsnSerGlyThrIleAspAsnAlaGly-198 |
| SEQ. ID. NO. 36521 | 215-ThrAlaIleLysGlyArgPheGluGly-223 |
| SEQ. ID. NO. 36522 | 239-AlaLeuAspGlyLysAla-244 |
| SEQ. ID. NO. 36523 | 250-AlaGluAspProVal-254 |
| SEQ. ID. NO. 36524 | 265-GlyArgLeuLysThrProSer-271 |
| SEQ. ID. NO. 36525 | 279-TyrAlaAspLysAsnGluHis-285 |
| SEQ. ID. NO. 36526 | 317-AsnProGlnArgLeuAlaGlu-323 |
| SEQ. ID. NO. 36527 | 337-LeuAlaGlySerGlyAsnGluGlyPro-345 |
| SEQ. ID. NO. 36528 | 380-ValThrArgLysAlaLeuAsn-386 |
| SEQ. ID. NO. 36529 | 393-AspThrGlySerAlaIle-398 |
| SEQ. ID. NO. 36530 | 412-AspGluAlaGlyGluLeuAlaGlyLysGlnLysThr-423 |
| SEQ. ID. NO. 36531 | 434-GlyMetLysProGluTyrArgPro-441 | g920-2
AMPHI Regions - AMPHI

| | |
|---|---|
| SEQ. ID. NO. 36532 | 43-GlyGluPheProGluLeuGluProIleAla-52 |
| SEQ. ID. NO. 36533 | 117-GlyIleLysGluMetProAsp-123 |
| SEQ. ID. NO. 36534 | 135-LysAsnIleValAsnVal-140 |
| SEQ. ID. NO. 36535 | 163-LeuAspAsnProAlaAsn-168 |
| SEQ. ID. NO. 36536 | 190-ThrValThrAlaThrPheAspGlyPheAspThrSerAspArgSerLys-205 |
| SEQ. ID. NO. 36537 | 212-GlnAlaPheSerAspSerThr-218 |

Antigenic Index - Jameson-Wolf

| | |
|---|---|
| SEQ. ID. NO. 36538 | 40-LeuGlyTyrGlyGluPheProGlu-47 |
| SEQ. ID. NO. 36539 | 49-GluProIleAlaLysAspArgLeu-56 |
| SEQ. ID. NO. 36540 | 66-ValThrGluLysGlyLysGluAsnMetIle-75 |
| SEQ. ID. NO. 36541 | 77-ArgGlyThrTyrAsnTyrGlnTyrArgSerAsnArgProValLysAspGlySerTyr-95 |
| SEQ. ID. NO. 36542 | 104-ThrPheTrpSerLysAsnLysAlaGlyTrp-113 |
| SEQ. ID. NO. 36543 | 116-AlaGlyIleLysGluMetProAspAlaSerTyrCysGluGlnThrArgMetPheGlyLysAsnIleValAsnValGlyHisGluSerAlaAspThr-147 |
| SEQ. ID. NO. 36544 | 152-LysProValGlyGlnAsnLeuGlu-159 |
| SEQ. ID. NO. 36545 | 162-ProLeuAspAsnProAla-167 |
| SEQ. ID. NO. 36546 | 173-GluArgPheLysVal-177 |
| SEQ. ID. NO. 36547 | 181-PheArgGlyGluProLeuProAsnAla-189 |
| SEQ. ID. NO. 36548 | 194-ThrPheAspGlyPheAspThrSerAspArgSerLysThrHisLysThrGluAla-211 |
| SEQ. ID. NO. 36549 | 213-AlaPheSerAspSerThrAspAspLysGlyGluValAsp-225 |
| SEQ. ID. NO. 36550 | 237-AsnValGluHisLysThrAspPheProAspGlnSerValCysGlnLysGlnAlaAsnTyrSer-257 |

Hydrophilic Regions - Hopp-Woods

| | |
|---|---|
| SEQ. ID. NO. 36551 | 49-GluProIleAlaLysAspArgLeu-56 |
| SEQ. ID. NO. 36552 | 66-ValThrGluLysGlyLysGluAsnMetIle-75 |
| SEQ. ID. NO. 36553 | 85-ArgSerAsnArgProValLysAspGlySer-94 |
| SEQ. ID. NO. 36554 | 107-SerLysAsnLysAlaGlyTrp-113 |
| SEQ. ID. NO. 36555 | 116-AlaGlyIleLysGluMetProAsp-123 |
| SEQ. ID. NO. 36556 | 128-GluGlnThrArgMetPheGly-134 |
| SEQ. ID. NO. 36557 | 142-HisGluSerAlaAsp-146 |
| SEQ. ID. NO. 36558 | 173-GluArgPheLysVal-177 |
| SEQ. ID. NO. 36559 | 196-AspGlyPheAspThrSerAspArgSerLysThrHisLysThrGluAla-211 |
| SEQ. ID. NO. 36560 | 213-AlaPheSerAspSerThrAspAspLysGlyGluValAsp-225 |
| SEQ. ID. NO. 36561 | 237-AsnValGluHisLysThrAspPheProAsp-246 |
| SEQ. ID. NO. 36562 | 248-SerValCysGlnLys-252 | g921
AMPHI Regions - AMPHI

| | |
|---|---|
| SEQ. ID. NO. 36563 | 12-AlaValLeuSerGlyCysGlnSerIleTyrValProThrLeuThrGluIleProValAsn-31 |
| SEQ. ID. NO. 36564 | 33-IleAsnThrValLysThr-38 |
| SEQ. ID. NO. 36565 | 51-HisTrpAlaAspValAlaLysIleSerAspGlu-61 |
| SEQ. ID. NO. 36566 | 72-GlyLysMetThrLysValGlnAlaAlaGlnTyrLeuAsnAsnPheArgLys-88 |
| SEQ. ID. NO. 36567 | 98-AspSerMetTyrGluIleTyrLeuArg-106 |
| SEQ. ID. NO. 36568 | 126-GluAsnAlaLeuArgGlyTrpGlnGlnArgTrp-136 |

Antigenic Index - Jameson-Wolf

| | |
|---|---|
| SEQ. ID. NO. 36569 | 36-ValLysThrGluAlaProAlaLysGlyPheArg-46 |
| SEQ. ID. NO. 36570 | 56-AlaLysIleSerAspGluAlaThrArg-64 |
| SEQ. ID. NO. 36571 | 72-GlyLysMetThrLys-76 |
| SEQ. ID. NO. 36572 | 84-AsnAsnPheArgLysArgLeuValGlyArgAsnAlaValAspAspSerMet-100 |
| SEQ. ID. NO. 36573 | 107-SerAlaValAspSerGlnArgGlyGluIleAsnThrGluGlnSerLysLeuTyr-124 |
| SEQ. ID. NO. 36574 | 128-AlaLeuArgGlyTrpGlnGlnArgTrpLysAsnMetAspAlaLysProAspAsnProAla-147 |

Hydrophilic Regions - Hopp-Woods

| | |
|---|---|
| SEQ. ID. NO. 36575 | 36-ValLysThrGluAlaProAlaLysGlyPheArg-46 |
| SEQ. ID. NO. 36576 | 56-AlaLysIleSerAspGluAlaThrArg-64 |
| SEQ. ID. NO. 36577 | 86-PheArgLysArgLeuValGly-92 |
| SEQ. ID. NO. 36578 | 94-AsnAlaValAspAspSerMet-100 |
| SEQ. ID. NO. 36579 | 107-SerAlaValAspSerGlnArgGlyGluIleAsnThrGluGlnSerLysLeuTyr-124 |
| SEQ. ID. NO. 36580 | 136-TrpLysAsnMetAspAlaLysProAspAsn-145 | g922
AMPHI Regions - AMPHI

| | |
|---|---|
| SEQ. ID. NO. 36581 | 16-LeuSerAlaCysThrAla-21 |
| SEQ. ID. NO. 36582 | 28-ArgAlaAsnGluAlaGlnAlaPro-35 |

TABLE 1-continued

| | |
|---|---|
| SEQ. ID. NO. 36583 | 66-ValArgArgPheValAspAsp-72 |
| SEQ. ID. NO. 36584 | 82-AlaGluTrpGlnAspPhePheAspLys-90 |
| SEQ. ID. NO. 36585 | 98-ValLysIleMetHis-102 |
| SEQ. ID. NO. 36586 | 138-AspAspValAlaGln-142 |
| SEQ. ID. NO. 36587 | 166-GlySerPheArgValAlaAspAlaLeu-174 |
| SEQ. ID. NO. 36588 | 190-LysGluLeuValGluLeuLeuLysLeuAla-199 |
| SEQ. ID. NO. 36589 | 216-AlaMetGlyMetPro-220 |
| SEQ. ID. NO. 36590 | 239-HisArgAspIleTrpGlyAsnValGlyAspValAlaAlaSerValAlaAsnTyrMetLysGlnHis-260 |
| SEQ. ID. NO. 36591 | 292-ArgThrValAlaAspLeuLysAlaTyr-300 |
| SEQ. ID. NO. 36592 | 329-TyrLeuGlyLeuAsnAsnPheTyrThr-337 |
| Antigenic Index - Jameson-Wolf | |
| SEQ. ID. NO. 36593 | 1-MetGluLysArgLysIleLeu-7 |
| SEQ. ID. NO. 36594 | 22-MetGluAlaArgThrProArgAlaAsnGluAlaGlnAlaProArgAlaAspGluMetLysLysGluSerArgProAlaPhe-48 |
| SEQ. ID. NO. 36595 | 55-ValSerAspSerGlyPhe-60 |
| SEQ. ID. NO. 36596 | 64-AlaAsnValArgArgPheValAspAspGluValGlyLysGlyAspPheSerGln-81 |
| SEQ. ID. NO. 36597 | 101-MetHisArgProSerThrSerArgPro-109 |
| SEQ. ID. NO. 36598 | 114-ArgThrGlyAsnSerGlyArgGlyAlaLysPheHisGly-125 |
| SEQ. ID. NO. 36599 | 127-ArgArgPheTyrAlaGluAsnArgAlaValIleAspAspValAlaGlnLysTyrGlyVal-146 |
| SEQ. ID. NO. 36600 | 157-IleGluThrAsnTyrGlyLysAsnThrGlySer-167 |
| SEQ. ID. NO. 36601 | 180-AspTyrProArgArgAlaGlyPhePhe-188 |
| SEQ. ID. NO. 36602 | 197-LysLeuAlaLysGluGluGlyGlyAsp-205 |
| SEQ. ID. NO. 36603 | 223-MetProSerSerTyrArgLysTrpAlaValAspTyrAspGlyAspGlyHisArgAspIle-242 |
| SEQ. ID. NO. 36604 | 260-HisGlyTrpArgThrGlyGlyLysMet-268 |
| SEQ. ID. NO. 36605 | 275-AlaProGlyAlaAsp-279 |
| SEQ. ID. NO. 36606 | 284-IleGlyGluLysThrAlaLeu-290 |
| SEQ. ID. NO. 36607 | 304-ProGlyGluThrLeuAlaAspAspGluLysAlaVal-315 |
| SEQ. ID. NO. 36608 | 320-GluThrAlaProGly-324 |
| SEQ. ID. NO. 36609 | 351-ValArgAspIleAlaAsnSerLeuGlyGlyProGlyLeu-363 |
| Hydrophilic Regions - Hopp-Woods | |
| SEQ. ID. NO. 36610 | 1-MetGluLysArgLysIleLeu-7 |
| SEQ. ID. NO. 36611 | 22-MetGluAlaArgThrProArgAlaAsnGluAlaGlnAlaProArgAlaAspGluMetLysLysGluSerArgProAlaPhe-48 |
| SEQ. ID. NO. 36612 | 64-AlaAsnValArgArgPheValAspAspGluValGlyLysGlyAspPheSerGln-81 |
| SEQ. ID. NO. 36613 | 116-GlyAsnSerGlyArgGlyAlaLysPheHisGly-125 |
| SEQ. ID. NO. 36614 | 127-ArgArgPheTyrAlaGluAsnArgAlaValIleAspAspValAlaGln-142 |
| SEQ. ID. NO. 36615 | 160-AsnTyrGlyLysAsnThrGly-166 |
| SEQ. ID. NO. 36616 | 181-TyrProArgArgAlaGlyPhePhe-188 |
| SEQ. ID. NO. 36617 | 197-LysLeuAlaLysGluGluGlyGlyAsp-205 |
| SEQ. ID. NO. 36618 | 234-TyrAspGlyAspGlyHisArgAspIle-242 |
| SEQ. ID. NO. 36619 | 284-IleGlyGluLysThrAlaLeu-290 |
| SEQ. ID. NO. 36620 | 307-ThrLeuAlaAspAspGluLysAlaVal-315 |
| SEQ. ID. NO. 36621 | 351-ValArgAspIleAla-355 |
| g923-2 | |
| AMPHI Regions - AMPHI | |
| SEQ. ID. NO. 36622 | 9-ProMetAlaCysAlaAlaPheLeu-16 |
| SEQ. ID. NO. 36623 | 26-LeuGlyAlaCysTyrAlaIleLeuSerLeuTyrAla-37 |
| SEQ. ID. NO. 36624 | 63-ProAlaLeuPheGlyGlyTrpThrGly-71 |
| Antigenic Index - Jameson-Wolf | |
| SEQ. ID. NO. 36625 | 43-IleAspLysArgArgAlaValArgGlyLysArgArgIleProGluHisArgLeu-60 |
| SEQ. ID. NO. 36626 | 77-ArgMetPheArgHisLysThrAlaLysLysArgPhe-88 |
| Hydrophilic Regions - Hopp-Woods | |
| SEQ. ID. NO. 36627 | 43-IleAspLysArgArgAlaValArgGlyLysArgArgIleProGluHisArgLeu-60 |
| SEQ. ID. NO. 36628 | 77-ArgMetPheArgHisLysThrAlaLysLysArgPhe-88 |
| g925-1 | |
| AMPHI Regions - AMPHI | |
| SEQ. ID. NO. 36629 | 115-LysCysGlyGlnThrAlaGln-121 |
| SEQ. ID. NO. 36630 | 154-PheAspGluLeuGlu-158 |
| Antigenic Index - Jameson-Wolf | |
| SEQ. ID. NO. 36631 | 16-GlyCysGlyLysAspAlaGlyGlyTyrGluGlyTyrTrpArgGluLysSerAspLysLysGluGlyValIleAlaValLysLysLysGlyAsnTyrPhe-48 |
| SEQ. ID. NO. 36632 | 56-ThrGlyLysGluGluSerLeuLeuLeuSerGluLysAspGlyAla-70 |
| SEQ. ID. NO. 36633 | 74-AsnThrGlyIleGly-78 |
| SEQ. ID. NO. 36634 | 80-IleProIleLysLeuSerAspAspGlyLysGluLeuTyrValGluArgArgArgTyrValLysThrAspAlaAlaMetLysAspLysIleIleAlaHisGlnLysLysCysGlyGlnThr-119 |
| SEQ. ID. NO. 36635 | 124-LeuAspAlaArgAsnAlaLeuProSerAsnGlnThrTyrGlnGlnArgGlnAlaAla-142 |
| SEQ. ID. NO. 36636 | 144-GluGlnLeuLysArgArgPheGluAlaGluPheAspGluLeuGluLysGluIleLysCysAsnGlyLysProThr-168 |
| Hydrophilic Regions - Hopp-Woods | |
| SEQ. ID. NO. 36637 | 17-CysGlyLysAspAlaGlyGly-23 |
| SEQ. ID. NO. 36638 | 27-TyrTrpArgGluLysSerAspLysLysGluGlyValIleAlaValLysLysLysGly-45 |
| SEQ. ID. NO. 36639 | 56-ThrGlyLysGluGluSerLeuLeuLeuSerGluLysAspGlyAla-70 |
| SEQ. ID. NO. 36640 | 80-IleProIleLysLeuSerAspAspGlyLysGluLeuTyrValGluArgArgArgTyrValLysThrAspAlaAlaMetLysAspLysIleIleAlaHisGlnLysLysCysGlyGln-118 |
| SEQ. ID. NO. 36641 | 124-LeuAspAlaArgAsnAlaLeu-130 |
| SEQ. ID. NO. 36642 | 136-TyrGlnGlnArgGlnAlaAla-142 |
| SEQ. ID. NO. 36643 | 144-GluGlnLeuLysArgArgPheGluAlaGluPheAspGluLeuGluLysGluIleLysCysAsnGlyLys-166 |
| g926 | |
| AMPHI Regions - AMPHI | |
| SEQ. ID. NO. 36644 | 29-ProSerGluHisIleSerSerPhe-36 |
| SEQ. ID. NO. 36645 | 72-LeuGlySerThrLeuGlyGln-78 |
| SEQ. ID. NO. 36646 | 98-AlaGluGlyThrGluAspLeuSerArgGln-107 |

TABLE 1-continued

Antigenic Index - Jameson-Wolf
SEQ. ID. NO. 36647  19-LeuProGlnAsnAsnGluAsnLeuTrpGlnProSerGluHisIleSer-34
SEQ. ID. NO. 36648  37-AlaAlaGluGlyArgLeuAlaValLysAlaGluGlyLysGlySerTyrAla-53
SEQ. ID. NO. 36649  70-ThrProLeuGlySer-74
SEQ. ID. NO. 36650  79-LeuCysGlnAspArgAspGlyAlaLeu-87
SEQ. ID. NO. 36651  89-ValAspGlyLysGlyAsnValTyr-96
SEQ. ID. NO. 36652  98-AlaGluGlyThrGluAspLeuSerArgGln-107
SEQ. ID. NO. 36653  123-GluGlyArgArgValAlaGlyAlaProTyrArgIleArgSerAspGlyIleLeu-140
SEQ. ID. NO. 36654  143-TyrGlyTrpThrIleGlyGlnAsnCysArgGlnTrpGly-155
SEQ. ID. NO. 36655  157-SerProAsnValAlaThrGlu-163
Hydrophilic Regions - Hopp-Woods
SEQ. ID. NO. 36656  37-AlaAlaGluGlyArgLeuAlaValLysAlaGluGlyLysGlySer-51
SEQ. ID. NO. 36657  80-CysGlnAspArgAspGlyAlaLeu-87
SEQ. ID. NO. 36658  89-ValAspGlyLysGly-93
SEQ. ID. NO. 36659  99-GluGlyThrGluAspLeuSerArg-106
SEQ. ID. NO. 36660  123-GluGlyArgArgValAla-128
SEQ. ID. NO. 36661  132-TyrArgIleArgSerAspGlyIleLeu-140
g927
AMPHI Regions - AMPHI
SEQ. ID. NO. 36662  13-LeuLeuThrAlaCys-17
SEQ. ID. NO. 36663  48-SerTyrAspValThrArgTyrPheTyrLysGlu-58
SEQ. ID. NO. 36664  120-LysGlyTrpGlnGlnAlaLeuPro-127
SEQ. ID. NO. 36665  145-AsnProLysGlnIleArgAspTrpAsnAspLeuAlaLysAspGly-159
SEQ. ID. NO. 36666  195-LysLeuValAlaSerIleLeu-201
Antigenic Index - Jameson-Wolf
SEQ. ID. NO. 36667  17-CysSerProAlaAlaAspSerAsnHisProSerGlyGlnAsnAlaProAlaAsnThrGluSerAspGlyLysAsnIle-42
SEQ. ID. NO. 36668  65-GlyThrTyrGlnSerGluHisProGlyThrSer-75
SEQ. ID. NO. 36669  81-SerHisGlyGlyPheSer-86
SEQ. ID. NO. 36670  104-AsnGlnSerSerAspIleAspLeuLeuGluLysXxxGlyLeuVal-118
SEQ. ID. NO. 36671  126-LeuProAspHisAlaAlaProTyrThr-134
SEQ. ID. NO. 36672  142-ArgLysAsnAsnProLysGlnIleArgAspTrpAsnAspLeuAlaLysAspGlyVal-160
SEQ. ID. NO. 36673  165-AlaLysThrSerGlyAsnGlyArg-172
SEQ. ID. NO. 36674  183-LeuLysAlaAsnAsnGlyAsnGluGlnGluAlaGlnLys-195
SEQ. ID. NO. 36675  201-LeuLysAsnThrProValPheGluAsnGlyGlyArgXxxProProProProSerHisAsnAlaThrSer-224
SEQ. ID. NO. 36676  229-SerLeuLeuLysThrLysProThrThrSerAlaLysAsn-241
Hydrophilic Regions - Hopp-Woods
SEQ. ID. NO. 36677  19-ProAlaAlaAspSerAsnHisProSer-27
SEQ. ID. NO. 36678  33-AlaAsnThrGluSerAspGlyLysAsn-41
SEQ. ID. NO. 36679  68-GlnSerGluHisProGly-73
SEQ. ID. NO. 36680  105-GlnSerSerAspIleAspLeuLeuGluLysXxxGlyLeuVal-118
SEQ. ID. NO. 36681  142-ArgLysAsnAsnProLysGlnIleArgAspTrpAsnAspLeuAlaLysAspGlyVal-160
SEQ. ID. NO. 36682  167-ThrSerGlyAsnGly-171
SEQ. ID. NO. 36683  185-AlaAsnAsnGlyAsnGluGlnGluAlaGlnLys-195
SEQ. ID. NO. 36684  209-AsnGlyGlyArgXxxProProPro-216
SEQ. ID. NO. 36685  231-LeuLysThrLysProThrThrSerAlaLysAsn-241
g929
AMPHI Regions - AMPHI
SEQ. ID. NO. 36686  25-ValProAspGlyValLys-30
SEQ. ID. NO. 36687  34-TrpThrLeuLeuAlaMetPheValGlyValIleAlaAlaIleIleGly-49
SEQ. ID. NO. 36688  53-ProLeuGlyAlaLeuSer-58
SEQ. ID. NO. 36689  76-GlyAlaAlaMetSerAspAlaLeuSerAlaPhe-86
SEQ. ID. NO. 36690  155-HisProIleMetGlnSerIleAlaGlySerTyrGlySerAsnProAlaLys-171
SEQ. ID. NO. 36691  180-TyrLeuAlaLeuVal-184
SEQ. ID. NO. 36692  187-HisSerAsnProIle-191
SEQ. ID. NO. 36693  204-ProLeuIleValAsnLeuIleAlaGluAsnLeuGly-215
SEQ. ID. NO. 36694  233-GlyValIleAlaPhePhe-238
SEQ. ID. NO. 36695  265-ArgLeuSerGluMetGlyLys-271
SEQ. ID. NO. 36696  280-AlaValIlePheGlyIle-285
SEQ. ID. NO. 36697  355-LeuGlyLeuIleLysTrpPheSerGlyValLeuAlaGluSerValGlyGlyLeu-372
SEQ. ID. NO. 36698  398-ThrAlaHisIleThrAlaMetPheGlyAlaPheLeuAla-410
SEQ. ID. NO. 36699  452-TyrThrThrMetGlyGluTrpTrp-459
SEQ. ID. NO. 36700  469-AsnPheLeuIlePheSerValIleGlySerIleTrpTrpLysValLeuGlyTyr-486
Antigenic Index - Jameson-Wolf
SEQ. ID. NO. 36701  25-ValProAspGlyValLysProGln-32
SEQ. ID. NO. 36702  71-ThrAlaAspLysProGlyAlaAlaMet-79
SEQ. ID. NO. 36703  122-GlyArgLysThrLeuGlyIle-128
SEQ. ID. NO. 36704  143-ThrProSerAsnThrAlaArgGlyGlyGly-152
SEQ. ID. NO. 36705  163-GlySerTyrGlySerAsnProAlaLysGlyThrGluGlyLysMetGlyLys-179
SEQ. ID. NO. 36706  187-HisSerAsnProIleSer-192
SEQ. ID. NO. 36707  213-AsnLeuGlySerSerPhe-218
SEQ. ID. NO. 36708  248-TyrProProGluIleLysGluThrProAsn-257
SEQ. ID. NO. 36709  261-PheAlaLysAspArgLeuSerGluMetGlyLysMetSerAlaAspGluIle-277
SEQ. ID. NO. 36710  328-AspValLeuLysGluLysSerAlaTrp-336
Hydrophilic Regions - Hopp-Woods
SEQ. ID. NO. 36711  71-ThrAlaAspLysProGlyAlaAlaMet-79
SEQ. ID. NO. 36712  146-AsnThrAlaArgGly-150
SEQ. ID. NO. 36713  168-AsnProAlaLysGlyThrGluGlyLysMetGlyLys-179
SEQ. ID. NO. 36714  250-ProGluIleLysGluThrProAsn-257

TABLE 1-continued

| | |
|---|---|
| SEQ. ID. NO. 36715 | 261-PheAlaLysAspArgLeuSerGluMetGlyLysMetSerAlaAspGluIle-277 |
| SEQ. ID. NO. 36716 | 328-AspValLeuLysGluLysSerAlaTrp-336 | g930-1
AMPHI Regions - AMPHI

| | |
|---|---|
| SEQ. ID. NO. 36717 | 6-AlaGlyAspIleAsnGlnIleMetSerLeu-15 |
| SEQ. ID. NO. 36718 | 30-IleLeuAlaAlaPro-34 |
| SEQ. ID. NO. 36719 | 48-ProGlyTyrLeuArgSerIleArgIle-56 |
| SEQ. ID. NO. 36720 | 82-AspLeuLeuAsnLeuArgAsp-88 |
| SEQ. ID. NO. 36721 | 96-LeuLysCysLeuPro-100 |
| SEQ. ID. NO. 36722 | 163-SerAspMetPheTyr-167 |
| SEQ. ID. NO. 36723 | 171-GlyArgSerIleGlyGly-176 |
| SEQ. ID. NO. 36724 | 216-ArgTyrHisGlnAlaValSerGlyLeuSerGluValTyrAsp-229 |
| SEQ. ID. NO. 36725 | 283-TrpLeuAlaGluLeuSerHis-289 |
| SEQ. ID. NO. 36726 | 308-ThrGlyMetLysAspAlaLeuArgAlaProGluGluAlaPheGlyGluGly-324 |
| SEQ. ID. NO. 36727 | 355-HisAlaGlnTrpAsnLys-360 |
| SEQ. ID. NO. 36728 | 457-LeuLysLysProGluTyrPhe-463 |

Antigenic Index - Jameson-Wolf

| | |
|---|---|
| SEQ. ID. NO. 36729 | 1-GlyLysCysLeuHisAlaGlyAsp-8 |
| SEQ. ID. NO. 36730 | 34-ProGlnAspLeuAsnSerGlyLysLeu-42 |
| SEQ. ID. NO. 36731 | 54-IleArgIleAspArgSerAsnAspAspGlnThrHisAlaGlyArgIleAla-70 |
| SEQ. ID. NO. 36732 | 74-AsnLysPheProThrArgSerAsnAspLeuLeuAsn-85 |
| SEQ. ID. NO. 36733 | 87-ArgAspLeuGluGlnGlyLeuGluAsn-95 |
| SEQ. ID. NO. 36734 | 102-AlaGluAlaAspLeu-106 |
| SEQ. ID. NO. 36735 | 110-ProValGluArgGluProAsnGlnSerAsp-119 |
| SEQ. ID. NO. 36736 | 136-GlyMetAspAsnSerGlySerGluAlaThrGlyLysTyrGlnGly-150 |
| SEQ. ID. NO. 36737 | 156-AlaAspAsnProPheGlyLeu-162 |
| SEQ. ID. NO. 36738 | 170-TyrGlyArgSerIleGlyGlyThrProAspGluGluAsnPheAspGlyHisArgLysGluGlyGlySerAsn-193 |
| SEQ. ID. NO. 36739 | 212-HisAsnGlyTyrArg-216 |
| SEQ. ID. NO. 36740 | 226-GluValTyrAspTyrAsnGlyLysSerTyrAsnThrAspPheGlyPhe-241 |
| SEQ. ID. NO. 36741 | 245-LeuTyrArgAspAlaLysArgLysThrTyrLeu-255 |
| SEQ. ID. NO. 36742 | 260-TrpThrArgGluThrLysSerTyrIleAspAspAlaGluLeuThrValGlnArgArgLysThrThr-281 |
| SEQ. ID. NO. 36743 | 287-LeuSerHisLysGlyTyrIleGlyArgSerThrAlaAspPheLysLeuLysTyrLysHisGlyThrGlyMetLysAspAlaLeuArgAlaProGluGluAlaPheGlyGluGlyThrSerArg-327 |
| SEQ. ID. NO. 36744 | 334-SerAlaAspValAsnThrPro-340 |
| SEQ. ID. NO. 36745 | 357-GlnTrpAsnLysThrProLeuThrSerGlnAspLysLeuAla-370 |
| SEQ. ID. NO. 36746 | 375-HisThrValArgGlyPheAspGlyGluMetSerLeuProAlaGluArgGlyTrpTyrTrpArgAsnAspLeuSerTrpGlnPheLysProGlyHis-406 |
| SEQ. ID. NO. 36747 | 418-SerGlyGlnSerAlaLys-423 |
| SEQ. ID. NO. 36748 | 455-ArgAlaLeuLysLysProGluTyrPheGlnThrLysLysTrpValThr-470 |

Hydrophilic Regions - Hopp-Woods

| | |
|---|---|
| SEQ. ID. NO. 36749 | 35-GlnAspLeuAsnSerGlyLys-41 |
| SEQ. ID. NO. 36750 | 54-IleArgIleAspArgSerAsnAspAspGlnThrHisAla-66 |
| SEQ. ID. NO. 36751 | 76-PheProThrArgSerAsnAsp-82 |
| SEQ. ID. NO. 36752 | 87-ArgAspLeuGluGlnGlyLeuGluAsn-95 |
| SEQ. ID. NO. 36753 | 102-AlaGluAlaAspLeu-106 |
| SEQ. ID. NO. 36754 | 110-ProValGluArgGluProAsnGlnSer-118 |
| SEQ. ID. NO. 36755 | 137-MetAspAsnSerGlySerGluAlaThrGlyLysTyr-148 |
| SEQ. ID. NO. 36756 | 174-IleGlyGlyThrProAspGluGluAsnPheAspGlyHisArgLysGluGlyGlySer-192 |
| SEQ. ID. NO. 36757 | 228-TyrAspTyrAsnGly-232 |
| SEQ. ID. NO. 36758 | 245-LeuTyrArgAspAlaLysArgLysThrTyrLeu-255 |
| SEQ. ID. NO. 36759 | 260-TrpThrArgGluThrLysSerTyrIleAspAspAlaGluLeuThrValGlnArgArgLysThrThr-281 |
| SEQ. ID. NO. 36760 | 296-SerThrAlaAspPheLysLeuLysTyrLysHis-306 |
| SEQ. ID. NO. 36761 | 308-ThrGlyMetLysAspAlaLeuArgAlaProGluGluAlaPheGly-322 |
| SEQ. ID. NO. 36762 | 362-ProLeuThrSerGlnAspLysLeuAla-370 |
| SEQ. ID. NO. 36763 | 378-ArgGlyPheAspGlyGluMet-384 |
| SEQ. ID. NO. 36764 | 455-ArgAlaLeuLysLysProGluTyrPheGln-464 | g931
AMPHI Regions - AMPHI

| | |
|---|---|
| SEQ. ID. NO. 36765 | 43-LysAlaSerLysThrValAlaAsnPheValArgTyrAlaArgLys-57 |
| SEQ. ID. NO. 36766 | 67-ArgValIleGlyGly-71 |
| SEQ. ID. NO. 36767 | 81-GluAspLeuValGlnLysAlaThrAspLysAla-91 |
| SEQ. ID. NO. 36768 | 93-AlaAsnGluSerGlyAsnGlyLeuLysAsnThrValGly-105 |
| SEQ. ID. NO. 36769 | 142-ThrValPheGlyArgValGluSerGlyMetAspThrValSerLysIleAlaArgValLysThrAlaThrArgGlyPhe-167 |

Antigenic Index - Jameson-Wolf

| | |
|---|---|
| SEQ. ID. NO. 36770 | 1-MetLysProLysPhe-5 |
| SEQ. ID. NO. 36771 | 30-ThrAspMetGlyAsn-34 |
| SEQ. ID. NO. 36772 | 38-ValLeuAspGluSerLysAlaSerLysThr-47 |
| SEQ. ID. NO. 36773 | 54-TyrAlaArgLysGlyPheTyrAspAsn-62 |
| SEQ. ID. NO. 36774 | 75-GlnGlyAspGlyLeuThrGluAspLeuValGlnLysAlaThrAspLysAlaValAlaAsnGluSerGlyAsnGlyLeuLysAsnThrVal-104 |
| SEQ. ID. NO. 36775 | 113-AlaAlaProAspSerAla-118 |
| SEQ. ID. NO. 36776 | 127-AlaAspAsnGlySerLeuAspTyrLysAsnGlyGlnTyrGly-140 |
| SEQ. ID. NO. 36777 | 145-GlyArgValGluSerGlyMetAspThrValSerLysIleAlaArgValLysThrAlaThrArgGlyPhe-167 |
| SEQ. ID. NO. 36778 | 176-ValLysIleArgArg-180 |

Hydrophilic Regions - Hopp-Woods

| | |
|---|---|
| SEQ. ID. NO. 36779 | 1-MetLysProLysPhe-5 |
| SEQ. ID. NO. 36780 | 30-ThrAspMetGlyAsn-34 |
| SEQ. ID. NO. 36781 | 38-ValLeuAspGluSerLysAlaSerLysThr-47 |
| SEQ. ID. NO. 36782 | 78-GlyLeuThrGluAspLeuValGlnLysAlaThrAspLysAlaValAlaAsnGluSerGlyAsnGlyLeu-100 |
| SEQ. ID. NO. 36783 | 113-AlaAlaProAspSerAla-118 |
| SEQ. ID. NO. 36784 | 130-GlySerLeuAspTyrLysAsn-136 |

TABLE 1-continued

| SEQ. ID. NO. 36785 | 145-GlyArgValGluSerGlyMetAspThrValSerLysIleAlaArgValLysThrAlaThr-164 |
| SEQ. ID. NO. 36786 | 176-ValLysIleArgArg-180 | g933
AMPHI Regions - AMPHI

| SEQ. ID. NO. 36787 | 26-ProAsnIleProAlaLeuPheProLysHisProPheAspProPheGluAsnIleAsnAsnSerLysLys-48 |
| SEQ. ID. NO. 36788 | 63-GlyPheAlaArgGly-67 |
| SEQ. ID. NO. 36789 | 78-GluLysProLeuArgGlnTyrPheLysAspCysValAsnThr-91 |
| SEQ. ID. NO. 36790 | 101-IleSerSerPheGlyAsn-106 |
| SEQ. ID. NO. 36791 | 135-ValGlyAsnTyrIleGluTrpLeu-142 |
| SEQ. ID. NO. 36792 | 145-ThrLeuAsnLysLeuThrGlyTrpGlnGluHisLeuTyrAlaGlyLeuAspProPheHisTyrIleGluVal-168 |
| SEQ. ID. NO. 36793 | 264-AlaLeuAspAsnLeuLysHisLeuAspGlyHisGlnIleValLysValAsn-280 |
| SEQ. ID. NO. 36794 | 309-GlyPhePheThrLys-313 |
| SEQ. ID. NO. 36795 | 356-TrpLeuArgValIleAspHisGlyHisSerAsn-365 |
| SEQ. ID. NO. 36796 | 374-ProValGluGlyTyrArgLysGly-381 |
| SEQ. ID. NO. 36797 | 431-AlaGlyValTyrAlaThrTrpHis-438 |
| SEQ. ID. NO. 36798 | 447-AlaTyrValAspSerTrpMetGlnTyrGln-456 |
| SEQ. ID. NO. 36799 | 474-LysGlyIleThrAlaSer-479 |
| SEQ. ID. NO. 36800 | 483-GlyTyrAsnAlaLeuLeuAla-489 |
| SEQ. ID. NO. 36801 | 555-GlnProPheValAlaVal-560 |
| SEQ. ID. NO. 36802 | 606-PheAsnArgGlnThrSer-611 |

Antigenic Index - Jameson-Wolf

| SEQ. ID. NO. 36803 | 1-LysLysLeuArgAspArgAsnSerGluTyrTrpLysGluGluThrTyrHisIleLysSerAsnGlyArgThrTyrPro-26 |
| SEQ. ID. NO. 36804 | 33-ProLysHisProPheAspProPheGluAsnIleAsnAsnSerLysIleSerPheTyrAspLysGluTyrThrGluAspTyr-60 |
| SEQ. ID. NO. 36805 | 68-PheGlyValGluLysArgAsnGlyGluGluGluLysProLeuArg-82 |
| SEQ. ID. NO. 36806 | 88-CysValAsnThrGluAsnSerAsnAsnAspAsnCysLysIleSerSer-103 |
| SEQ. ID. NO. 36807 | 112-IleLysSerAspIle-116 |
| SEQ. ID. NO. 36808 | 122-GlnIleLysAsnSerHisIleAsnSerGluIle-132 |
| SEQ. ID. NO. 36809 | 144-ProThrLeuAsnLysLeuThrGlyTrpGlnGlu-154 |
| SEQ. ID. NO. 36810 | 167-GluValThrAspAsnSerHis-173 |
| SEQ. ID. NO. 36811 | 189-SerLeuTrpLysProArgTrpAsnSerAsnIle-199 |
| SEQ. ID. NO. 36812 | 205-LysAsnAlaGluIleArgPheAsnThrLysAsnGluSerLeuLeuValLysGluAspTyrAlaGlyGlyAlaArgPhe-230 |
| SEQ. ID. NO. 36813 | 234-TyrAspLeuLysAspLysValProGlu-242 |
| SEQ. ID. NO. 36814 | 248-PheGluLysAsnIleThrGlyThrSer-256 |
| SEQ. ID. NO. 36815 | 263-LysAlaLeuAspAsnLeuLysHisLeuAspGlyHisGlnIleValLysValAsnAspThrAlaAspLysAspAlaPheArgLeuSerSerLysTyrArgLys-296 |
| SEQ. ID. NO. 36816 | 303-LeuGlnGlnArgProGluGlyPhe-310 |
| SEQ. ID. NO. 36817 | 313-LysValGlnGluArgAspAspIle-320 |
| SEQ. ID. NO. 36818 | 337-ArgLeuAsnAspLysAsnSerAspIlePheAspArgThrLeuProArgLysGlyLeu-355 |
| SEQ. ID. NO. 36819 | 360-IleAspGlyHisSerAsnGlnTrpValGlnGlyLysThrAlaProValGluGlyTyrArgLysGlyVal-382 |
| SEQ. ID. NO. 36820 | 392-GlnAsnGluSerAsnGlnLeu-398 |
| SEQ. ID. NO. 36821 | 403-MetGlyGlyGlnAlaGluGlnArgSerThrPheArgAsnProAspThrAspAsnLeuThr-422 |
| SEQ. ID. NO. 36822 | 424-GlyAsnValLysGly-428 |
| SEQ. ID. NO. 36823 | 440-LeuGlnAspLysGlnThrGlyAlaTyr-448 |
| SEQ. ID. NO. 36824 | 456-GlnArgPheArgHisArgIleAsnThrGluTyrAlaThrGluArgPheThrSerLysGlyIle-476 |
| SEQ. ID. NO. 36825 | 491-HisPheThrLysLysGlyAsnSerLeu-499 |
| SEQ. ID. NO. 36826 | 514-ValAsnGlyLysPheSerAspSerGluAsnAla-524 |
| SEQ. ID. NO. 36827 | 529-LeuGlySerArgGlnLeuGlnSerArgValGlyVal-540 |
| SEQ. ID. NO. 36828 | 567-LysProPheGlyValGluIleAspGlyAspArgArgValIleAsnAsnLysThrValIleGluThr-588 |
| SEQ. ID. NO. 36829 | 594-AlaLysIleLysSer-598 |
| SEQ. ID. NO. 36830 | 605-SerPheAsnArgGlnThrSerLysHisHisHisAlaLys-617 |

Hydrophilic Regions - Hopp-Woods

| SEQ. ID. NO. 36831 | 1-LysLysLeuArgAspArgAsnSerGluTyrTrpLysGluGluThrTyrHis-17 |
| SEQ. ID. NO. 36832 | 20-SerAsnGlyArgThr-24 |
| SEQ. ID. NO. 36833 | 35-HisProPheAspPro-39 |
| SEQ. ID. NO. 36834 | 44-AsnAsnSerLysLysIleSerPheTyrAspLysGluTyrThrGlu-58 |
| SEQ. ID. NO. 36835 | 68-PheGlyValGluLysArgAsnGlyGluGluGluLysProLeu-81 |
| SEQ. ID. NO. 36836 | 88-CysValAsnThrGluAsnSerAsnAsnAspAsnCysLys-100 |
| SEQ. ID. NO. 36837 | 205-LysAsnAlaGluIleArgPheAsnThrLysAsnGluSerLeuLeuValLysGluAspTyrAlaGly-226 |
| SEQ. ID. NO. 36838 | 234-TyrAspLeuLysAspLysValProGlu-242 |
| SEQ. ID. NO. 36839 | 250-LysAsnIleThrGly-254 |
| SEQ. ID. NO. 36840 | 263-LysAlaLeuAspAsnLeuLysHisLeuAsp-272 |
| SEQ. ID. NO. 36841 | 278-LysValAsnAspThrAlaAspLysAspAlaPheArgLeuSerSerLysTyrArgLys-296 |
| SEQ. ID. NO. 36842 | 304-GlnGlnArgProGluGlyPhe-310 |
| SEQ. ID. NO. 36843 | 314-ValGlnGluArgAspAspIle-320 |
| SEQ. ID. NO. 36844 | 338-LeuAsnAspLysAsnSerAspIlePheAsp-347 |
| SEQ. ID. NO. 36845 | 376-GluGlyTyrArgLysGlyVal-382 |
| SEQ. ID. NO. 36846 | 393-AsnGluSerAsnGln-397 |
| SEQ. ID. NO. 36847 | 406-GlnAlaGluGlnArgSerThrPheArgAsnProAspThrAspAsnLeuThr-422 |
| SEQ. ID. NO. 36848 | 440-LeuGlnAspLysGlnThr-445 |
| SEQ. ID. NO. 36849 | 456-GlnArgPheArgHisArgIleAsnThr-464 |
| SEQ. ID. NO. 36850 | 491-HisPheThrLysLysGlyAsnSer-498 |
| SEQ. ID. NO. 36851 | 517-LysPheSerAspSerGluAsnAla-524 |
| SEQ. ID. NO. 36852 | 532-ArgGlnLeuGlnSer-536 |
| SEQ. ID. NO. 36853 | 569-PheGlyValGluIleAspGlyAspArgArgValIleAsn-581 |
| SEQ. ID. NO. 36854 | 594-AlaLysIleLysSer-598 |
| SEQ. ID. NO. 36855 | 606-PheAsnArgGlnThrSerLysHisHisHisAlaLys-617 | g933
AMPHI Regions - AMPHI

| SEQ. ID. NO. 36856 | 26-ProAsnIleProAlaLeuPheProLysHisProPheAspProPheGluAsnIleAsnAsnSerLysLys-48 |
| SEQ. ID. NO. 36857 | 63-GlyPheAlaArgGly-67 |

TABLE 1-continued

| | |
|---|---|
| SEQ. ID. NO. 36858 | 78-GluLysProLeuArgGlnTyrPheLysAspCysValAsnThr-91 |
| SEQ. ID. NO. 36859 | 101-IleSerSerPheGlyAsn-106 |
| SEQ. ID. NO. 36860 | 135-ValGlyAsnTyrIleGluTrpLeu-142 |
| SEQ. ID. NO. 36861 | 145-ThrLeuAsnLysLeuThrGlyTrpGlnGluHisLeuTyrAlaGlyLeuAspProPheHisTyrIleGluVal-168 |
| SEQ. ID. NO. 36862 | 264-AlaLeuAspAsnLeuLysHisLeuAspGlyHisGlnIleValLysValAsn-280 |
| SEQ. ID. NO. 36863 | 309-GlyPhePheThrLys-313 |
| SEQ. ID. NO. 36864 | 356-TrpLeuArgValIleAspGlyHisSerAsn-365 |
| SEQ. ID. NO. 36865 | 374-ProValGluGlyTyrArgLysGly-381 |
| SEQ. ID. NO. 36866 | 431-AlaGlyValTyrAlaThrTrpHis-438 |
| SEQ. ID. NO. 36867 | 447-AlaTyrValAspSerTrpMetGlnTyrGln-456 |
| SEQ. ID. NO. 36868 | 474-LysGlyIleThrAlaSer-479 |
| SEQ. ID. NO. 36869 | 483-GlyTyrAsnAlaLeuLeuAla-489 |
| SEQ. ID. NO. 36870 | 555-GlnProPheValAlaVal-560 |
| SEQ. ID. NO. 36871 | 606-PheAsnArgGlnThrSer-611 |
| Antigenic Index - Jameson-Wolf | |
| SEQ. ID. NO. 36872 | 1-LysLysLeuArgAspArgAsnSerGluTyrTrpLysGluGluThrTyrHisIleLysSerAsnGlyArgThrTyrPro-26 |
| SEQ. ID. NO. 36873 | 33-ProLysHisProPheAspProPheGluAsnIleAsnAsnSerLysLysIleSerPheTyrAspLysGluTyrThrGluAspTyr-60 |
| SEQ. ID. NO. 36874 | 68-PheGlyValGluLysArgAsnGlyGluGluGluLysProLeuArg-82 |
| SEQ. ID. NO. 36875 | 88-CysValAsnThrGluAsnSerAsnAsnAspAsnCysLysIleSerSer-103 |
| SEQ. ID. NO. 36876 | 112-IleLysSerAspIle-116 |
| SEQ. ID. NO. 36877 | 122-GlnIleLysAsnSerHisIleAsnSerGluIle-132 |
| SEQ. ID. NO. 36878 | 144-ProThrLeuAsnLysLeuThrGlyTrpGlnGlu-154 |
| SEQ. ID. NO. 36879 | 167-GluValThrAspAsnSerHis-173 |
| SEQ. ID. NO. 36880 | 189-SerLeuTrpLysProArgTrpAsnSerAsnIle-199 |
| SEQ. ID. NO. 36881 | 205-LysAsnAlaGluIleArgPheAsnThrLysAsnGluSerLeuLeuValLysGluAspTyrAlaGlyGlyAlaArgPhe-230 |
| SEQ. ID. NO. 36882 | 234-TyrAspLeuLysAspLysValProGlu-242 |
| SEQ. ID. NO. 36883 | 248-PheGluLysAsnIleThrGlyThrSer-256 |
| SEQ. ID. NO. 36884 | 263-LysAlaLeuAspAsnLeuLysHisLeuAspGlyHisGlnIleValLysValAsnAspThrAlaAspLysAspAlaPheArgLeuSerSerLysTyrArgLys-296 |
| SEQ. ID. NO. 36885 | 303-LeuGlnGlnArgProGluGlyPhe-310 |
| SEQ. ID. NO. 36886 | 313-LysValGlnGluArgAspAspIle-320 |
| SEQ. ID. NO. 36887 | 337-ArgLeuAsnAspLysAsnSerAspIlePheAspArgThrLeuProArgLysGlyLeu-355 |
| SEQ. ID. NO. 36888 | 360-IleAspGlyHisSerAsnGlnTrpValGlnGlyLysThrAlaProValGluGlyTyrArgLysGlyVal-382 |
| SEQ. ID. NO. 36889 | 392-GlnAsnGluSerAsnGlnLeu-398 |
| SEQ. ID. NO. 36890 | 403-MetGlyGlyGlnAlaGluGlnArgSerThrPheArgAsnProAspThrAspAsnLeuThr-422 |
| SEQ. ID. NO. 36891 | 424-GlyAsnValLysGly-428 |
| SEQ. ID. NO. 36892 | 440-LeuGlnAspLysGlnThrGlyAlaTyr-448 |
| SEQ. ID. NO. 36893 | 456-GlnArgPheArgHisArgIleAsnThrGluTyrAlaThrGluArgPheThrSerLysGlyIle-476 |
| SEQ. ID. NO. 36894 | 491-HisPheThrLysLysGlyAsnSerLeu-499 |
| SEQ. ID. NO. 36895 | 514-ValAsnGlyLysPheSerAspSerGluAsnAla-524 |
| SEQ. ID. NO. 36896 | 529-LeuGlySerArgGlnLeuGlnSerArgValGlyVal-540 |
| SEQ. ID. NO. 36897 | 567-LysProPheGlyValGluIleAspGlyAspArgArgValIleAsnAsnLysThrValIleGluThr-588 |
| SEQ. ID. NO. 36898 | 594-AlaLysIleLysSer-598 |
| SEQ. ID. NO. 36899 | 605-SerPheAsnArgGlnThrSerLysHisHisHisAlaLys-617 |
| Hydrophilic Regions - Hopp-Woods | |
| SEQ. ID. NO. 36900 | 1-LysLysLeuArgAspArgAsnSerGluTyrTrpLysGluGluThrTyrHis-17 |
| SEQ. ID. NO. 36901 | 20-SerAsnGlyArgThr-24 |
| SEQ. ID. NO. 36902 | 35-HisProPheAspPro-39 |
| SEQ. ID. NO. 36903 | 44-AsnAsnSerLysLysIleSerPheTyrAspLysGluTyrThrGlu-58 |
| SEQ. ID. NO. 36904 | 68-PheGlyValGluLysArgAsnGlyGluGluGluLysProLeu-81 |
| SEQ. ID. NO. 36905 | 88-CysValAsnThrGluAsnSerAsnAsnAspAsnCysLys-100 |
| SEQ. ID. NO. 36906 | 205-LysAsnAlaGluIleArgPheAsnThrLysAsnGluSerLeuLeuValLysGluAspTyrAlaGly-226 |
| SEQ. ID. NO. 36907 | 234-TyrAspLeuLysAspLysValProGlu-242 |
| SEQ. ID. NO. 36908 | 250-LysAsnIleThrGly-254 |
| SEQ. ID. NO. 36909 | 263-LysAlaLeuAspAsnLeuLysHisLeuAsp-272 |
| SEQ. ID. NO. 36910 | 278-LysValAsnAspThrAlaAspLysAspAlaPheArgLeuSerSerLysTyrArgLys-296 |
| SEQ. ID. NO. 36911 | 304-GlnGlnArgProGluGlyPhe-310 |
| SEQ. ID. NO. 36912 | 314-ValGlnGluArgAspAspIle-320 |
| SEQ. ID. NO. 36913 | 338-LeuAsnAspLysAsnSerAspIlePheAsp-347 |
| SEQ. ID. NO. 36914 | 376-GluGlyTyrArgLysGlyVal-382 |
| SEQ. ID. NO. 36915 | 393-AsnGluSerAsnGln-397 |
| SEQ. ID. NO. 36916 | 406-GlnAlaGluGlnArgSerThrPheArgAsnProAspThrAspAsnLeuThr-422 |
| SEQ. ID. NO. 36917 | 440-LeuGlnAspLysGlnThr-445 |
| SEQ. ID. NO. 36918 | 456-GlnArgPheArgHisArgIleAsnThr-464 |
| SEQ. ID. NO. 36919 | 491-HisPheThrLysLysGlyAsnSer-498 |
| SEQ. ID. NO. 36920 | 517-LysPheSerAspSerGluAsnAla-524 |
| SEQ. ID. NO. 36921 | 532-ArgGlnLeuGlnSer-536 |
| SEQ. ID. NO. 36922 | 569-PheGlyValGluIleAspGlyAspArgArgValIleAsn-581 |
| SEQ. ID. NO. 36923 | 594-AlaLysIleLysSer-598 |
| SEQ. ID. NO. 36924 | 606-PheAsnArgGlnThrSerLysHisHisHisAlaLys-617 |
| g936-1 | |
| AMPHI Regions - AMPHI | |
| SEQ. ID. NO. 36925 | 10-ThrLeuIleAlaAla-14 |
| SEQ. ID. NO. 36926 | 19-AlaLeuGlyGlyCysPheSerAlaVal-27 |
| SEQ. ID. NO. 36927 | 100-GlnPheValGlyGlnIle-105 |
| SEQ. ID. NO. 36928 | 112-AlaGluGlyValTyrAsnTyrIleThrValAlaSerLeuProArgThrAlaGlyAspIleAlaGlyAsp-134 |
| Antigenic Index - Jameson-Wolf | |
| SEQ. ID. NO. 36929 | 1-MetLysProLysProHisThrVal-8 |
| SEQ. ID. NO. 36930 | 37-SerValIleAspArgArgThrThrGlyAlaGlnThrAspAspAsnValMet-53 |
| SEQ. ID. NO. 36931 | 56-ArgIleGluThrThrAlaArgSerTyrLeuArgGlnAsnAsnGlnThrLysGlyTyr-74 |

TABLE 1-continued

SEQ. ID. NO. 36932  94-AlaThrGluGlyGluLysGlnPhe-101
SEQ. ID. NO. 36933  106-AlaArgSerGluGlnAlaAla-112
SEQ. ID. NO. 36934  124-LeuProArgThrAlaGlyAspIleAlaGlyAspThrTrpAsnThrSerLysValArgAla-143
SEQ. ID. NO. 36935  149-SerProAlaThrGlnAlaArgValLys-157
SEQ. ID. NO. 36936  172-ThrProGluGluGlnAlaGlnIleThr-180
Hydrophilic Regions - Hopp-Woods
SEQ. ID. NO. 36937  1-MetLysProLysProHisThr-7
SEQ. ID. NO. 36938  37-SerValIleAspArgArgThrThrGlyAlaGlnThrAspAspAsnValMet-53
SEQ. ID. NO. 36939  56-ArgIleGluThrThrAla-61
SEQ. ID. NO. 36940  68-AsnAsnGlnThrLysGlyTyr-74
SEQ. ID. NO. 36941  94-AlaThrGluGlyGluLysGlnPhe-101
SEQ. ID. NO. 36942  106-AlaArgSerGluGlnAlaAla-112
SEQ. ID. NO. 36943  125-ProArgThrAlaGly-129
SEQ. ID. NO. 36944  152-ThrGlnAlaArgValLys-157
SEQ. ID. NO. 36945  172-ThrProGluGluGlnAlaGlnIle-179
g937
AMPHI Regions - AMPHI
SEQ. ID. NO. 36946  121-LysArgMetSerAspIleSerAlaGlyIleSerHis-132
SEQ. ID. NO. 36947  231-LysGlnProAspArgIleAsp-237
Antigenic Index - Jameson-Wolf
SEQ. ID. NO. 36948  18-ThrAspLeuProLeuAsnIle-24
SEQ. ID. NO. 36949  26-AspIleMetThrAspLysGlyLysTrpLysLeuGluThr-38
SEQ. ID. NO. 36950  43-LeuAsnSerGluAsnSerArgAlaAlaLeu-52
SEQ. ID. NO. 36951  69-ProThrGluIleGlnGluAsnGlySerAsnThrAsp-80
SEQ. ID. NO. 36952  94-GlyAsnThrAspIleTyrGlySerGlySer-103
SEQ. ID. NO. 36953  107-HisGluGluArgLysLeuAspGlyAsnGlyLysThrArgAsnLysArgMetSerAspIle-126
SEQ. ID. NO. 36954  134-PheLeuLysAspGlyLysAsnProAla-142
SEQ. ID. NO. 36955  150-ThrValTyrGluLysSerArgAsnLysAlaSerSerGlyLys-163
SEQ. ID. NO. 36956  186-TyrArgIleAsnGlySerLysThrLeuSerAspAspValLysTyrLysAlaGly-203
SEQ. ID. NO. 36957  216-AlaAsnAspArgIleSerLeuThrGlyGly-225
SEQ. ID. NO. 36958  230-GlyLysGlnProAspArgIleAspGlyLysLysGluSerAlaArgAsnThrSerThr-248
SEQ. ID. NO. 36959  272-ValSerGlyGlnSerSerSerGluLeuLysLeu-282
Hydrophilic Regions - Hopp-Woods
SEQ. ID. NO. 36960  26-AspIleMetThrAspLysGlyLysTrpLysLeu-36
SEQ. ID. NO. 36961  46-GluAsnSerArgAlaAlaLeu-52
SEQ. ID. NO. 36962  71-GluIleGlnGluAsnGlySerAsnThr-79
SEQ. ID. NO. 36963  107-HisGluGluArgLysLeuAspGlyAsnGlyLysThrArgAsnLysArgMetSerAspIle-126
SEQ. ID. NO. 36964  134-PheLeuLysAspGlyLysAsn-140
SEQ. ID. NO. 36965  150-ThrValTyrGluLysSerArgAsnLysAlaSerSerGly-162
SEQ. ID. NO. 36966  192-LysThrLeuSerAspAspValLysTyrLysAla-202
SEQ. ID. NO. 36967  216-AlaAsnAspArgIleSer-221
SEQ. ID. NO. 36968  231-LysGlnProAspArgIleAspGlyLysLysGluSerAlaArgAsn-245
SEQ. ID. NO. 36969  276-SerSerSerGluLeuLysLeu-282
g950
AMPHI Regions - AMPHI
SEQ. ID. NO. 36970  33-GlyValGlnLysSerAlaGlnGly-40
SEQ. ID. NO. 36971  81-AlaThrValLysLysAlaHisLysHisThrLysAla-92
Antigenic Index - Jameson-Wolf
SEQ. ID. NO. 36972  1-MetAsnLysAsnIle-5
SEQ. ID. NO. 36973  26-LysProAlaSerAsnAlaThrGlyValGlnLysSerAlaGlnGlySerCysGlyAlaSerLysSerAlaGluGlySerCysGlyAlaSerLysSer
　　　　　　　　　　　AlaGluGlySerCysGly-63
SEQ. ID. NO. 36974  65-AlaAlaSerLysAlaGlyGluGlyLysCysGlyGluGlyLysCysGlyAlaThrValLysLysAlaHisLysHisThrLysAlaSerLysAlaLys
　　　　　　　　　　　AlaLysSerAlaGluGlyLysCysGlyGluGlyLysCysGlySerLys-112
Hydrophilic Regions - Hopp-Woods
SEQ. ID. NO. 36975  33-GlyValGlnLysSerAlaGln-39
SEQ. ID. NO. 36976  43-GlyAlaSerLysSerAlaGluGlySerCysGlyAlaSerLysSerAlaGluGlySerCys-62
SEQ. ID. NO. 36977  65-AlaAlaSerLysAlaGlyGluGlyLysCysGlyGluGlyLysCys-79
SEQ. ID. NO. 36978  81-AlaThrValLysLysAlaHisLysHisThrLysAlaSerLysAlaLysAlaLysSerAlaGluGlyLysCysGlyGluGlyLysCysGlySerLys-112
g951
AMPHI Regions - AMPHI
SEQ. ID. NO. 36979  9-ThrIleLeuSerValLeuAlaAla-16
SEQ. ID. NO. 36980  32-GluLeuProLysGluValGlyLysValLeuArgLysHisArgArgTyr-47
SEQ. ID. NO. 36981  62-ValGlyGluArgValAsnArgValPhe-70
SEQ. ID. NO. 36982  127-TrpArgGlnIleGluProIleProGlyGlu-136
SEQ. ID. NO. 36983  145-ArgAsnValLeuArgGluGlyGlyAsnGlnHisLeuAspGlyLeuGluGluValLeuAla-164
SEQ. ID. NO. 36984  189-AlaGlnLysAlaSerLysAlaValArgArg-198
SEQ. ID. NO. 36985  204-GluHisLeuProGluAlaAla-210
SEQ. ID. NO. 36986  227-IleGluAlaLeuGlnArgLeuAlaLysLeu-236
SEQ. ID. NO. 36987  254-LysTyrProGluIleLeuAspGlyPhePheGlu-264
SEQ. ID. NO. 36988  278-MetGluIleMetAsnLeuValSerLeuArgLysProAspAspAla-292
SEQ. ID. NO. 36989  325-ValIleAspGlyTyrAlaGluLys-332
SEQ. ID. NO. 36990  362-ValArgGlnTrpLeuLys-367
SEQ. ID. NO. 36991  395-AlaLeuArgGlnIleGlyArgValArgLysLeuProGluGlnGln-409
SEQ. ID. NO. 36992  416-AspAsnLeuSerLysIle-421
SEQ. ID. NO. 36993  423-MetLeuAlaLeuSer-427
SEQ. ID. NO. 36994  441-AsnIleIleAlaLysLeuSerAlaAlaGlySerThrGluProLeuAlaGlu-457
SEQ. ID. NO. 36995  474-LysMetIleAlaAspLeuGluThr-481
SEQ. ID. NO. 36996  495-AsnLeuGlyTyrSer-499
SEQ. ID. NO. 36997  503-AspSerLysArgLeu-507
SEQ. ID. NO. 36998  563-HisLeuGlyGluVal-567

TABLE 1-continued

| | |
|---|---|
| SEQ. ID. NO. 36999 | 579-AspValTrpThrGlnAla-584 |
| SEQ. ID. NO. 37000 | 592-LysIleTrpArgGluThrLeuLys-599 |

Antigenic Index - Jameson-Wolf

| | |
|---|---|
| SEQ. ID. NO. 37001 | 29-AlaAspValGluLeuProLysGluValGlyLysValLeuArgLysHisArgArgTyrSerGluGluGluIleLysAsnGluArgAlaArgLeu-59 |
| SEQ. ID. NO. 37002 | 61-AlaValGlyGluArgValAsnArg-68 |
| SEQ. ID. NO. 37003 | 77-ThrAlaLeuGlnLysGlyGlnAla-84 |
| SEQ. ID. NO. 37004 | 96-GluArgThrLysSerProGluValAlaGluArgAlaLeuGlu-109 |
| SEQ. ID. NO. 37005 | 126-LysTrpArgGlnIleGluProIleProGlyGluAlaGlnLysArgAlaGlyTrp-143 |
| SEQ. ID. NO. 37006 | 147-ValLeuArgGluGlyGlyAsnGlnHisLeuAspGlyLeuGluGluValLeuAlaGlnSerAspAspValGlnLysArgArgIle-174 |
| SEQ. ID. NO. 37007 | 187-GlyValAlaGlnLysAlaSerLysAlaValArgArgAlaAlaLeuLys-202 |
| SEQ. ID. NO. 37008 | 219-GlnGlyArgGluLysGluLysAlaIleGluAlaLeuGlnArgLeuAlaLysLeuAspThrGluIleLeuPro-242 |
| SEQ. ID. NO. 37009 | 250-LeuThrAlaArgLysTyrProGluIleLeuAspGlyPhePheGluGlnThrAspThrGlnAsn-270 |
| SEQ. ID. NO. 37010 | 285-SerLeuArgLysProAspAspAlaTyrAla-294 |
| SEQ. ID. NO. 37011 | 301-GluHisAsnProAsnAlaAsn-307 |
| SEQ. ID. NO. 37012 | 317-AlaAsnArgLysGluGlyAlaSer-324 |
| SEQ. ID. NO. 37013 | 326-IleAspGlyTyrAlaGluLysAlaTyrGlyArgGlyThrGlyGluGlnArgGlyArgAla-345 |
| SEQ. ID. NO. 37014 | 354-AlaAspArgArgAspTyrAlaLys-361 |
| SEQ. ID. NO. 37015 | 364-GlnTrpLeuLysLysValSerAlaPro-372 |
| SEQ. ID. NO. 37016 | 375-LeuPheAspLysGlyVal-380 |
| SEQ. ID. NO. 37017 | 387-AlaGluLeuAspGlyGlyArgAlaAlaLeu-396 |
| SEQ. ID. NO. 37018 | 398-GlnIleGlyArgValArgLysLeuProGluGlnGlnGlyArgTyrPheThr-414 |
| SEQ. ID. NO. 37019 | 428-LysLeuProAspLysArgGluAlaLeu-436 |
| SEQ. ID. NO. 37020 | 447-SerAlaAlaGlySerThrGluProLeuAla-456 |
| SEQ. ID. NO. 37021 | 467-GluGlnPheGlyLysArgGlyLysMetIleAlaAspLeuGluThr-481 |
| SEQ. ID. NO. 37022 | 485-LeuThrProAspAsn-489 |
| SEQ. ID. NO. 37023 | 501-LeuSerAspSerLysArgLeuAspGluGlyPhe-511 |
| SEQ. ID. NO. 37024 | 519-GlnIleAsnProAspAspThrAlaValAsnAspSerIle-531 |
| SEQ. ID. NO. 37025 | 537-LeuLysGlyAspAlaGluSerAla-544 |
| SEQ. ID. NO. 37026 | 549-ArgTyrSerPheGluAsnAspProGluProGluVal-560 |
| SEQ. ID. NO. 37027 | 572-GlyGluArgAspGlnAla-577 |
| SEQ. ID. NO. 37028 | 585-AlaHisLeuArgGlyAspLysLysIleTrpArgGluThrLeuLysArgTyrGly-602 |
| SEQ. ID. NO. 37029 | 604-AlaLeuProGluProSerArgLysProArgLys-614 |

Hydrophilic Regions - Hopp-Woods

| | |
|---|---|
| SEQ. ID. NO. 37030 | 29-AlaAspValGluLeuProLysGluValGlyLysValLeuArgLysHisArgArgTyrSerGluGluGluIleLysAsnGluArgAlaArgLeu-59 |
| SEQ. ID. NO. 37031 | 61-AlaValGlyGluArgValAsnArg-68 |
| SEQ. ID. NO. 37032 | 77-ThrAlaLeuGlnLysGlyGlnAla-84 |
| SEQ. ID. NO. 37033 | 96-GluArgThrLysSerProGluValAlaGluArgAlaLeuGlu-109 |
| SEQ. ID. NO. 37034 | 133-IleProGlyGluAlaGlnLysArgAlaGlyTrp-143 |
| SEQ. ID. NO. 37035 | 147-ValLeuArgGluGlyGlyAsnGlnHis-155 |
| SEQ. ID. NO. 37036 | 157-AspGlyLeuGluGluValLeuAlaGlnSerAspAspValGlnLysArgArgIle-174 |
| SEQ. ID. NO. 37037 | 188-ValAlaGlnLysAlaSerLysAlaValArgArgAlaAlaLeuLys-202 |
| SEQ. ID. NO. 37038 | 219-GlnGlyArgGluLysGluLysAlaIleGluAlaLeuGlnArgLeuAlaLysLeuAspThrGluIle-240 |
| SEQ. ID. NO. 37039 | 250-LeuThrAlaArgLysTyrProGluIle-258 |
| SEQ. ID. NO. 37040 | 263-PheGluGlnThrAspThrGlnAsn-270 |
| SEQ. ID. NO. 37041 | 285-SerLeuArgLysProAspAspAlaTyrAla-294 |
| SEQ. ID. NO. 37042 | 317-AlaAsnArgLysGluGlyAlaSer-324 |
| SEQ. ID. NO. 37043 | 329-TyrAlaGluLysAlaTyrGly-335 |
| SEQ. ID. NO. 37044 | 337-GlyThrGlyGluGlnArgGlyArgAla-345 |
| SEQ. ID. NO. 37045 | 354-AlaAspArgArgAspTyrAlaLys-361 |
| SEQ. ID. NO. 37046 | 387-AlaGluLeuAspGlyGlyArgAlaAlaLeu-396 |
| SEQ. ID. NO. 37047 | 398-GlnIleGlyArgValArgLysLeuProGluGlnGlnGly-410 |
| SEQ. ID. NO. 37048 | 428-LysLeuProAspLysArgGluAlaLeu-436 |
| SEQ. ID. NO. 37049 | 450-GlySerThrGluProLeuAla-456 |
| SEQ. ID. NO. 37050 | 469-PheGlyLysArgGlyLysMetIleAlaAspLeuGluThr-481 |
| SEQ. ID. NO. 37051 | 485-LeuThrProAspAsn-489 |
| SEQ. ID. NO. 37052 | 502-SerAspSerLysArgLeuAspGlu-509 |
| SEQ. ID. NO. 37053 | 521-AsnProAspAspThrAlaVal-527 |
| SEQ. ID. NO. 37054 | 539-GlyAspAlaGluSer-543 |
| SEQ. ID. NO. 37055 | 552-PheGluAsnAspProGluProGluVal-560 |
| SEQ. ID. NO. 37056 | 572-GlyGluArgAspGlnAla-577 |
| SEQ. ID. NO. 37057 | 587-LeuArgGlyAspLysLysIleTrpArgGluThrLeuLys-599 |
| SEQ. ID. NO. 37058 | 607-GluProSerArgLysProArgLys-614 | g952
AMPHI Regions - AMPHI

| | |
|---|---|
| SEQ. ID. NO. 37059 | 47-SerValAlaThrLeuLeuAsn-53 |
| SEQ. ID. NO. 37060 | 66-LeuGluLysLeuGlyLysGluGlnMetArgAla-76 |
| SEQ. ID. NO. 37061 | 78-PheGluAspMetArgArgIle-84 |
| SEQ. ID. NO. 37062 | 100-GluGlnLeuAlaGlnLeu-105 |
| SEQ. ID. NO. 37063 | 122-SerValLeuArgGlyVal-127 |
| SEQ. ID. NO. 37064 | 147-AlaGlnPheLeuGluAla-152 |

Antigenic Index - Jameson-Wolf

| | |
|---|---|
| SEQ. ID. NO. 37065 | 24-GlnSerTrpLysAlaArgArgAspPheAsnIleValLysGlnAspLeuAspPheSerCys-43 |
| SEQ. ID. NO. 37066 | 59-LysLeuThrGluGluGluValLeuGluLysLeuGlyLysGluGlnMetArgAlaSerPheGluAspMetArgArgIleMetPro-86 |
| SEQ. ID. NO. 37067 | 88-LeuGlyPheGluAlaLysGlyTyr-95 |
| SEQ. ID. NO. 37068 | 113-LeuLysTyrArgLysAspAspHisPheSer-122 |
| SEQ. ID. NO. 37069 | 125-ArgGlyValAspGlyAsnThr-131 |
| SEQ. ID. NO. 37070 | 135-AlaAspProSerProGlyHis-141 |
| SEQ. ID. NO. 37071 | 153-TrpGlnThrArgGluGlyAsnLeuAlaGly-162 |
| SEQ. ID. NO. 37072 | 168-ValProLysLysAlaGluAlaIleSer-176 |
| SEQ. ID. NO. 37073 | 183-HisHisProLysArgGlnThrGlu-190 |

TABLE 1-continued

Hydrophilic Regions - Hopp-Woods
SEQ. ID. NO. 37074    25-SerTrpLysAlaArgArgAspPheAsnIleValLysGlnAspLeuAspPhe-41
SEQ. ID. NO. 37075    59-LysLeuThrGluGluGluValLeuGluLysLeuGlyLysGluGlnMetArgAlaSerPheGluAspMetArgArgIleMetPro-86
SEQ. ID. NO. 37076    88-LeuGlyPheGluAlaLysGly-94
SEQ. ID. NO. 37077    114-LysTyrArgLysAspAspHisPheSer-122
SEQ. ID. NO. 37078    153-TrpGlnThrArgGluGlyAsnLeu-160
SEQ. ID. NO. 37079    168-ValProLysLysAlaGluAlaIleSer-176
SEQ. ID. NO. 37080    184-HisProLysArgGlnThrGlu-190
g953
AMPHI Regions - AMPHI
SEQ. ID. NO. 37081    38-AsnThrSerThrAsnValGlyGlyPheTyrGlyLeuThr-50
SEQ. ID. NO. 37082    79-ProPheThrGlyHis-83
SEQ. ID. NO. 37083    85-LysSerAlaAspIlePheAspAlaAlaGln-94
SEQ. ID. NO. 37084    150-GlyAspPheSerThrThr-155
Antigenic Index - Jameson-Wolf
SEQ. ID. NO. 37085    21-TyrLysValAspGluTyrHisAla-28
SEQ. ID. NO. 37086    37-PheAsnThrSerThrAsnVal-43
SEQ. ID. NO. 37087    53-ValGluPheAspGlnAlaLysArgAspGlyLysIleAspIle-66
SEQ. ID. NO. 37088    74-GlnSerGlySerGlnPro-79
SEQ. ID. NO. 37089    94-GlnTyrProAspIleArgPheValSer-102
SEQ. ID. NO. 37090    104-LysPheAsnPheAsnGlyLysLysLeuValSer-114
SEQ. ID. NO. 37091    121-MetArgGlyLysThrAlaProValLysLeuLysAlaGluLys-134
SEQ. ID. NO. 37092    136-AsnCysTyrGlnSerProMetAlaGluThrGluValCysGlyGlyAspPheSerThrThrIleAspArgThrLysTrpGlyValAsp-164
SEQ. ID. NO. 37093    170-GlyMetThrLysAsnValArgIle-177
SEQ. ID. NO. 37094    179-IleGlnIleGluAlaAlaLysGln-186
Hydrophilic Regions - Hopp-Woods
SEQ. ID. NO. 37095    21-TyrLysValAspGluTyrHisAla-28
SEQ. ID. NO. 37096    53-ValGluPheAspGlnAlaLysArgAspGlyLysIleAspIle-66
SEQ. ID. NO. 37097    107-PheAsnGlyLysLysLeuValSer-114
SEQ. ID. NO. 37098    121-MetArgGlyLysThrAlaProValLysLeuLysAlaGluLys-134
SEQ. ID. NO. 37099    142-MetAlaGluThrGluValCysGly-149
SEQ. ID. NO. 37100    154-ThrThrIleAspArgThrLysTrp-161
SEQ. ID. NO. 37101    173-LysAsnValArgIle-177
SEQ. ID. NO. 37102    179-IleGlnIleGluAlaAlaLysGln-186
g957-2
AMPHI Regions - AMPHI
SEQ. ID. NO. 37103    11-SerPhePheAlaLeuValPheAla-18
SEQ. ID. NO. 37104    39-AlaThrGluValProGluAsnPro-46
SEQ. ID. NO. 37105    48-AlaPheValAlaLysLeuAlaArgLeuPheArgAsnAla-60
SEQ. ID. NO. 37106    74-GluGluSerLeuAlaGlyAlaValAspAsp-83
SEQ. ID. NO. 37107    167-HisGlyGluAsnTyrGluThr-173
SEQ. ID. NO. 37108    198-GluAspValTyrGluHisCysLeuGlyCysTyrGlnMet-210
SEQ. ID. NO. 37109    218-TyrArgAspValAlaAsn-223
SEQ. ID. NO. 37110    235-SerAsnArgIleAlaSer-240
SEQ. ID. NO. 37111    251-MetArgGluLeuMetProArg-257
SEQ. ID. NO. 37112    355-GluLysGluValSerArgTyrAlaGluAlaAlaAlaArg-367
Antigenic Index - Jameson-Wolf
SEQ. ID. NO. 37113    29-IleAsnProArgTrp-33
SEQ. ID. NO. 37114    35-LeuSerAspThrAlaThrGluValProGluAsnProAsnAla-48
SEQ. ID. NO. 37115    57-PheArgAsnAlaAspArgAla-63
SEQ. ID. NO. 37116    67-ValLysGluSerMetArgThrGluGluSerLeu-77
SEQ. ID. NO. 37117    80-AlaValAspAspGlyProLeuGlnSerGluLysAspTyr-92
SEQ. ID. NO. 37118    98-ArgLeuSerArgLeuLysGluLysAlaLys-107
SEQ. ID. NO. 37119    112-ThrGluGlnGluHisGlyGlu-118
SEQ. ID. NO. 37120    125-TyrIleGlyGluGlyGlyGly-130
SEQ. ID. NO. 37121    136-LeuSerGlnArgSerProGluAlaPheVal-145
SEQ. ID. NO. 37122    149-TyrLeuTyrArgAsnAspArgProPheSer-158
SEQ. ID. NO. 37123    166-AlaHisGlyGluAsnTyrGluThrThrGlyGluTyrArgVal-179
SEQ. ID. NO. 37124    182-GlnProAspGlySerVal-187
SEQ. ID. NO. 37125    190-AlaAlaGlyArgGlyLysIleGlyGluAspValTyr-201
SEQ. ID. NO. 37126    217-LysTyrArgAspValAlaAsnAspGluGlnLysValTrpAspPheArg
                      GluGluSerAsnArgIleAlaSerAspSerArgAspTyrVal-246
SEQ. ID. NO. 37127    250-AsnMetArgGluLeuMetProArgGlyMetLysAlaAsnSer-263
SEQ. ID. NO. 37128    267-GlyTyrAspAlaAspGlyLeuProGlnLys-276
SEQ. ID. NO. 37129    280-SerPheAspAsnGlyLysLysArgGlnSerPheGluTyrTyrLeuLysAsnGlyAsn-298
SEQ. ID. NO. 37130    309-LeuLysAlaAspGlyValThr-315
SEQ. ID. NO. 37131    329-LeuAspGlyGlyArgIleIleArgGlyGluGluLysGlnGlyAspArgLeuProAspPhe-347
SEQ. ID. NO. 37132    349-LeuAsnLeuGluAspLeuGluLysGluValSerArgTyrAlaGluAlaAlaAlaArgArgSerGlyGlyArgArgGlyLeuSerHis-377
Hydrophilic Regions - Hopp-Woods
SEQ. ID. NO. 37133    38-ThrAlaThrGluValProGluAsnPro-46
SEQ. ID. NO. 37134    57-PheArgAsnAlaAspArgAla-63
SEQ. ID. NO. 37135    67-ValLysGluSerMetArgThrGluGluSerLeu-77
SEQ. ID. NO. 37136    80-AlaValAspAspGlyProLeuGlnSerGluLysAspTyr-92
SEQ. ID. NO. 37137    98-ArgLeuSerArgLeuLysGluLysAlaLys-107
SEQ. ID. NO. 37138    112-ThrGluGlnGluHisGlyGlu-118
SEQ. ID. NO. 37139    136-LeuSerGlnArgSerProGlu-142
SEQ. ID. NO. 37140    151-TyrArgAsnAspArgProPhe-157
SEQ. ID. NO. 37141    169-GluAsnTyrGluThrThrGlyGluTyr-177
SEQ. ID. NO. 37142    190-AlaAlaGlyArgGlyLysIleGlyGluAspValTyr-201
SEQ. ID. NO. 37143    217-LysTyrArgAspValAlaAsnAspGluGlnLysValTrpAspPheArgGluGluSerAsnArgIleAlaSerAspSerArgAsp-244

TABLE 1-continued

| | |
|---|---|
| SEQ. ID. NO. 37144 | 250-AsnMetArgGluLeuMetProArgGlyMetLys-260 |
| SEQ. ID. NO. 37145 | 268-TyrAspAlaAspGlyLeuPro-274 |
| SEQ. ID. NO. 37146 | 282-AspAsnGlyLysLysArgGlnSer-289 |
| SEQ. ID. NO. 37147 | 309-LeuLysAlaAspGlyValThr-315 |
| SEQ. ID. NO. 37148 | 331-GlyGlyArgIleIleArgGluGluLysGlnGlyAspArgLeuPro-345 |
| SEQ. ID. NO. 37149 | 349-LeuAsnLeuGluAspLeuGluLysGluValSerArgTyrAlaGluAlaAlaAlaArgArgSerGlyGlyArgArgGlyLeuSer-376 | g958
AMPHIRegions - AMPHI

| | |
|---|---|
| SEQ. ID. NO. 37150 | 39-GlyGlyAlaGlnGlyAlaSerGluSerAlaGln-49 |
| SEQ. ID. NO. 37151 | 85-ProGluAspTyrThrArgIleValAlaAsp-94 |
| SEQ. ID. NO. 37152 | 175-GlyArgArgLeuGlnSerValSerArgThrAlaGluMetLeuGly-189 |
| SEQ. ID. NO. 37153 | 342-IleSerAspThrLeuGln-347 |
| SEQ. ID. NO. 37154 | 400-GlnLysTyrGlnThrLeuAlaAsn-407 |
| SEQ. ID. NO. 37155 | 426-TrpHisLysAsnAlaGly-431 |
| SEQ. ID. NO. 37156 | 489-GlyGlyLysAlaSerArgSerValGlyArgValLeuProValVal-503 |
| SEQ. ID. NO. 37157 | 526-IleGluProArgLeu-530 |
| SEQ. ID. NO. 37158 | 540-GlnAsnAspLeuProAsnPheAsp-547 |
| SEQ. ID. NO. 37159 | 571-AsnAlaAlaAsnSerLeuSerThrAlaValGlnSer-582 |
| | 615-ValGlyLysAsnPro-619 |
| SEQ. ID. NO. 37160 | 692-AspLysLeuSerGln-696 |
| SEQ. ID. NO. 37161 | 722-LysLysProIleGlu-726 |

768-AspLeuSerSerVal-
GlyArgAsnPro-776
Antigenic Index - Jameson-Wolf

| | |
|---|---|
| SEQ. ID. NO. 37162 | 19-GlyThrHisCysAla-23 |
| SEQ. ID. NO. 37163 | 27-ValAlaAlaGluGluAlaAspGlyArgValAlaGluGlyGlyAlaGlnGlyAlaSerGluSerAlaGlnAlaSer-51 |
| SEQ. ID. NO. 37164 | 62-CysSerAsnGluSerGlySerProGluArgThrGluAlaAlaValGlnGlySerGlyGluAlaSerValProGluAspTyrThrArgIleValAla<br>AspArgMetGluGlyGlnSerLysValLysValArgAlaGluGly-108 |
| SEQ. ID. NO. 37165 | 110-ValIleIleGluArgAspGlyAlaValLeu-119 |
| SEQ. ID. NO. 37166 | 122-AspTrpAlaAspTyrAspGlnSerGlyAsp-131 |
| SEQ. ID. NO. 37167 | 134-ThrValGlyAspArgPheAlaLeuGlnGlnAspGlyThrLeuIleArgGlyGluThrLeu-153 |
| SEQ. ID. NO. 37168 | 157-LeuAspGlnGlnThrGlyGluAlaHisAsnValArgMetGluThrGluGlnGlyGlyArgArgLeuGlnSerValSerArgThrAlaGluMetLeu<br>GlyGluGlyArgTyrLysLeuThrGluThrGlnPheAsnThrCysSerAlaGlyAspAlaGlyTrp-210 |
| SEQ. ID. NO. 37169 | 215-AlaSerValGluAlaAspArgGlyLysGlyIleGly-226 |
| SEQ. ID. NO. 37170 | 248-PheProLeuAspGlyAsnArgLysSerGlyLeu-258 |
| SEQ. ID. NO. 37171 | 264-SerAlaGlySerAspGlyVal-270 |
| SEQ. ID. NO. 37172 | 291-GlyIleIleGlyGluArgGlyAlaThrPheAspGlyGlnIleArgTyrLeuArgProAspTyrSerGlyGlnThrAsp-316 |
| SEQ. ID. NO. 37173 | 320-LeuProHisAspLysLysSerGlyArgAsnAsnArgTyrGlnAla-334 |
| SEQ. ID. NO. 37174 | 336-TrpGlnHisArgHisAspIleSerAspThrLeu-346 |
| SEQ. ID. NO. 37175 | 351-AspPheAsnGlnValSerAspSerGlyTyrTyrArgAspPheTyrGlyGlyGluGluIleAlaGlyAsnValAsnLeuAsnArgArgValTrp-381 |
| SEQ. ID. NO. 37176 | 383-AspTyrGlyGlyArgAlaAlaGlyGlySerLeuAsn-394 |
| SEQ. ID. NO. 37177 | 400-GlnLysTyrGlnThr-404 |
| SEQ. ID. NO. 37178 | 406-AlaAsnGlnSerGlyTyrLysAspGluProTyr-416 |
| SEQ. ID. NO. 37179 | 420-ProArgLeuSerAlaAspTrpHisLysAsnAlaGlyArgAlaGlnIle-435 |
| SEQ. ID. NO. 37180 | 443-ArgPheSerHisAspGlyArgGlnAspGlySerArg-454 |
| SEQ. ID. NO. 37181 | 465-PheSerAsnSerTrpGly-470 |
| SEQ. ID. NO. 37182 | 473-ArgProLysLeuGlyLeu-478 |
| SEQ. ID. NO. 37183 | 487-SerPheGlyGlyLysAlaSerArgSerValGlyArg-498 |
| SEQ. ID. NO. 37184 | 506-AspGlyGlyThrThrPheGluArgAsnThrArgLeuPheGlyGlyGly-521 |
| SEQ. ID. NO. 37185 | 537-AlaLysSerGlnAsnAspLeuProAsnPheAspSerSerGluSerSerPheGly-554 |
| SEQ. ID. NO. 37186 | 559-PheArgGluAsnLeuTyrTyrGlyAsnAspArgIleAsnAla-572 |
| SEQ. ID. NO. 37187 | 583-ArgIleLeuAspGlyAlaThrGlyGluGluArgPheArgAlaGlyIleGlyGlnLysPheTyrPheLysAspAspAlaValMetLeuAspGlySerValG<br>lyLysAsnProArgSerArgSerAspTrp-625 |
| SEQ. ID. NO. 37188 | 630-SerGlyGlyIleGlyGly-635 |
| SEQ. ID. NO. 37189 | 641-SerSerIleHisTyrAsnGlnAsnAspLysArgAlaGluHis-654 |
| SEQ. ID. NO. 37190 | 659-AlaGlyTyrArgProAlaProGlyLysValLeuAsnAlaArgTyrLysTyrGlyArgAsnGluLysIle-681 |
| SEQ. ID. NO. 37191 | 692-AspLysLeuSerGln-696 |
| SEQ. ID. NO. 37192 | 717-TyrGlyPheGluAlaLysLysProIleGlu-726 |
| SEQ. ID. NO. 37193 | 731-AlaGluTyrLysSerSerCysGlyCysTrp-740 |
| SEQ. ID. NO. 37194 | 750-ValThrGlyGluAsnThrTyrLysAsn-758 |
| SEQ. ID. NO. 37195 | 765-GlnLeuLysAspLeuSerSerValGlyArgAsnProAlaGlyArgMetAspVal-782 |
| SEQ. ID. NO. 37196 | 792-SerLeuSerAlaGlyArgAsnLysArgPro-801 |

Hydrophilic Regions - Hopp-Woods

| | |
|---|---|
| SEQ. ID. NO. 37197 | 27-ValAlaAlaGluGluAlaAspGlyArgValAlaGluGlyGlyAla-41 |
| SEQ. ID. NO. 37198 | 43-GlyAlaSerGluSerAlaGlnAlaSer-51 |
| SEQ. ID. NO. 37199 | 64-AsnGluSerGlySerProGluArgThrGluAlaAlaVal-76 |
| SEQ. ID. NO. 37200 | 78-GlySerGlyGluAlaSerValProGluAspTyrThr-89 |
| SEQ. ID. NO. 37201 | 92-ValAlaAspArgMetGluGlyGlnSerLysValLysValArgAlaGluGly-108 |
| SEQ. ID. NO. 37202 | 110-ValIleIleGluArgAspGlyAla-117 |
| SEQ. ID. NO. 37203 | 124-AlaAspTyrAspGlnSerGlyAsp-131 |
| SEQ. ID. NO. 37204 | 146-ThrLeuIleArgGlyGluThr-152 |
| SEQ. ID. NO. 37205 | 159-GlnGlnThrGlyGluAlaHisAsnValArgMetGluThrGluGlnGlyGlyArgArgLeuGlnSerValSerArgThrAlaGluMetLeuGlyGlu<br>GlyArgTyrLysLeuThrGlu-197 |
| SEQ. ID. NO. 37206 | 215-AlaSerValGluAlaAspArgGlyLysGly-224 |
| SEQ. ID. NO. 37207 | 249-ProLeuAspGlyAsnArgLysSerGly-257 |
| SEQ. ID. NO. 37208 | 265-AlaGlySerAspGlyVal-270 |
| SEQ. ID. NO. 37209 | 293-IleGlyGluArgGlyAlaThr-299 |
| SEQ. ID. NO. 37210 | 304-IleArgTyrLeuArg-308 |
| SEQ. ID. NO. 37211 | 322-HisAspLysLysSerGlyArgAsnAsnArgTyrGlnAla-334 |
| SEQ. ID. NO. 37212 | 336-TrpGlnHisArgHisAspIleSerAsp-344 |

TABLE 1-continued

| | |
|---|---|
| SEQ. ID. NO. 37213 | 409-SerGlyTyrLysAspGluProTyr-416 |
| SEQ. ID. NO. 37214 | 422-LeuSerAlaAspTrpHisLysAsnAlaGlyArgAla-433 |
| SEQ. ID. NO. 37215 | 444-PheSerHisAspGlyArgGlnAspGlySerArg-454 |
| SEQ. ID. NO. 37216 | 488-PheGlyGlyLysAlaSerArgSerValGly-497 |
| SEQ. ID. NO. 37217 | 509-ThrThrPheGluArgAsnThrArg-516 |
| SEQ. ID. NO. 37218 | 538-LysSerGlnAsnAsp-542 |
| SEQ. ID. NO. 37219 | 547-AspSerSerGluSer-551 |
| SEQ. ID. NO. 37220 | 568-AspArgIleAsnAla-572 |
| SEQ. ID. NO. 37221 | 588-AlaThrGlyGluGluArgPheArgAla-596 |
| SEQ. ID. NO. 37222 | 603-TyrPheLysAspAspAlaValMet-610 |
| SEQ. ID. NO. 37223 | 614-SerValGlyLysAsnProArgSerArgSerAsp-624 |
| SEQ. ID. NO. 37224 | 647-GlnAsnAspLysArgAlaGluHis-654 |
| SEQ. ID. NO. 37225 | 673-TyrLysTyrGlyArgAsnGluLysIle-681 |
| SEQ. ID. NO. 37226 | 719-PheGluAlaLysLysProIleGlu-726 |
| SEQ. ID. NO. 37227 | 731-AlaGluTyrLysSer-735 |
| SEQ. ID. NO. 37228 | 765-GlnLeuLysAspLeuSerSerValGlyArgAsnProAlaGlyArgMetAspVal-782 |
| SEQ. ID. NO. 37229 | 794-SerAlaGlyArgAsnLysArgPro-801 | g959
AMPHI Regions - AMPHI
| | |
|---|---|
| SEQ. ID. NO. 37230 | 56-AlaAlaTrpAlaArgValGlyGly-63 |

Antigenic Index - Jameson-Wolf
| | |
|---|---|
| SEQ. ID. NO. 37231 | 24-AlaHisHisAspGlyHisGlyAspAspAspHisGlyHis-36 |
| SEQ. ID. NO. 37232 | 38-AlaHisGlnHisGlyLysGlnAspLysIleIleSer-49 |
| SEQ. ID. NO. 37233 | 51-AlaGlnAlaGluLysAlaAla-57 |
| SEQ. ID. NO. 37234 | 60-ArgValGlyGlyLysIleThrAspIleAspLeuGluHisAspAspGlyArgProHisTyrAspValGluIleValLysAsnGlyGlnGluTyr-90 |
| SEQ. ID. NO. 37235 | 94-ValAspAlaArgThrGlyArgValIleSerSerArgArgAspAsp-108 |

Hydrophilic Regions - Hopp-Woods
| | |
|---|---|
| SEQ. ID. NO. 37236 | 27-AspGlyHisGlyAspAspAspHisGlyHis-36 |
| SEQ. ID. NO. 37237 | 40-GlnHisGlyLysGlnAspLysIleIleSer-49 |
| SEQ. ID. NO. 37238 | 51-AlaGlnAlaGluLysAlaAla-57 |
| SEQ. ID. NO. 37239 | 61-ValGlyGlyLysIleThrAspIleAspLeuGluHisAspAspGlyArgProHisTyr-79 |
| SEQ. ID. NO. 37240 | 82-GluIleValLysAsnGlyGlnGluTyr-90 |
| SEQ. ID. NO. 37241 | 94-ValAspAlaArgThrGlyArg-100 |
| SEQ. ID. NO. 37242 | 102-IleSerSerArgArgAspAsp-108 | g973
AMPHI Regions - AMPHI
| | |
|---|---|
| SEQ. ID. NO. 37243 | 12-GluArgLeuIleAlaArgLeuAlaArgGluProAspSerAlaGluAspValLeuAsnLeuLeuArgGlnAla-35 |
| SEQ. ID. NO. 37244 | 44-AspThrLeuThrArgLeuGluLysValLeuAspPhe-55 |
| SEQ. ID. NO. 37245 | 77-AspSerIleGluArgIleThrAlaTyr-85 |
| SEQ. ID. NO. 37246 | 112-AspLeuLeuLysTyrMet-117 |
| SEQ. ID. NO. 37247 | 143-AlaLeuLeuLysGluPheArgGluGln-151 |
| SEQ. ID. NO. 37248 | 171-PheGluAspIleIleGluGlnIleValGlyAspIleGluAsp-184 |
| SEQ. ID. NO. 37249 | 190-GluSerAlaAspAspIleHisSerVal-198 |
| SEQ. ID. NO. 37250 | 208-AlaThrGluIleGluAspIleAsnAlaPhe-217 |
| SEQ. ID. NO. 37251 | 235-IleGlnGluLeuGly-239 |

Antigenic Index - Jameson-Wolf
| | |
|---|---|
| SEQ. ID. NO. 37252 | 1-MetAspGlyAlaGlnProLysThrAsnPhe-10 |
| SEQ. ID. NO. 37253 | 18-LeuAlaArgGluProAspSerAlaGluAspVal-28 |
| SEQ. ID. NO. 37254 | 34-GlnAlaHisGluGlnGluValPheAspAlaAspThrLeuThrArgLeuGluLysValLeuAsp-54 |
| SEQ. ID. NO. 37255 | 56-AlaGluLeuGluValArgAspAlaMetIleThrArgSerArgMetAsnValLeuLysGluAsnAspSerIleGluArg-81 |
| SEQ. ID. NO. 37256 | 96-ValIleGlyGluAspLysAspGluVal-104 |
| SEQ. ID. NO. 37257 | 118-PheAsnProGluGlnPheHis-124 |
| SEQ. ID. NO. 37258 | 136-ProGluGlyLysSer-140 |
| SEQ. ID. NO. 37259 | 146-LysGluPheArgGluGlnArgAsnHis-154 |
| SEQ. ID. NO. 37260 | 159-IleAspGluTyrGlyGlyThrSerGly-167 |
| SEQ. ID. NO. 37261 | 178-IleValGlyAspIleGluAspGluPheAspGluAspGluSerAlaAspAspIleHis-196 |
| SEQ. ID. NO. 37262 | 199-SerAlaGluArgTrpArg-204 |
| SEQ. ID. NO. 37263 | 209-ThrGluIleGluAsp-213 |
| SEQ. ID. NO. 37264 | 219-GlyThrGluTyrGlySerGluGluAlaAspThr-229 |
| SEQ. ID. NO. 37265 | 239-GlyHisLeuProValArgGlyGluLysValLeu-249 |
| SEQ. ID. NO. 37266 | 258-AlaArgAlaAspAsnArgArgLeuHis-266 |

Hydrophilic Regions - Hopp-Woods
| | |
|---|---|
| SEQ. ID. NO. 37267 | 1-MetAspGlyAlaGlnProLys-7 |
| SEQ. ID. NO. 37268 | 18-LeuAlaArgGluProAspSerAlaGluAspVal-28 |
| SEQ. ID. NO. 37269 | 34-GlnAlaHisGluGlnGluValPheAsp-42 |
| SEQ. ID. NO. 37270 | 44-AspThrLeuThrArgLeuGluLysValLeuAsp-54 |
| SEQ. ID. NO. 37271 | 56-AlaGluLeuGluValArgAspAlaMetIleThrArgSerArgMetAsnValLeuLysGluAsnAspSerIleGluArg-81 |
| SEQ. ID. NO. 37272 | 96-ValIleGlyGluAspLysAspGluVal-104 |
| SEQ. ID. NO. 37273 | 136-ProGluGlyLysSer-140 |
| SEQ. ID. NO. 37274 | 146-LysGluPheArgGluGlnArgAsn-153 |
| SEQ. ID. NO. 37275 | 178-IleValGlyAspIleGluAspGluPheAspGluAspGluSerAlaAspAspIleHis-196 |
| SEQ. ID. NO. 37276 | 199-SerAlaGluArgTrpArg-204 |
| SEQ. ID. NO. 37277 | 209-ThrGluIleGluAsp-213 |
| SEQ. ID. NO. 37278 | 222-TyrGlySerGluGluAlaAspThr-229 |
| SEQ. ID. NO. 37279 | 243-ValArgGlyGluLysValLeu-249 |
| SEQ. ID. NO. 37280 | 258-AlaArgAlaAspAsnArgArgLeuHis-266 | g981
AMPHI Regions - AMPHI
| | |
|---|---|
| SEQ. ID. NO. 37281 | 32-AsnProGlyLysValTyrArgValAlaSer-41 |
| SEQ. ID. NO. 37282 | 46-AlaProPheGluSerLeuAsp-52 |

TABLE 1-continued

| | |
|---|---|
| SEQ. ID. NO. 37283 | 66-AsnAlaMetAlaLys-70 |
| SEQ. ID. NO. 37284 | 132-LysValSerSerSerSerGluAspLeuLysLysMetAsnLysValGly-146 |
| SEQ. ID. NO. 37285 | 167-LysIleAlaArgPheGlu-172 |
| SEQ. ID. NO. 37286 | 181-LeuGluAsnGlyGlyLeuAspSerValVal-190 |
| SEQ. ID. NO. 37287 | 197-AlaAsnTyrValLysAsnAsnPro-204 |
| SEQ. ID. NO. 37288 | 207-GlyMetAspPheValThrLeuPro-214 |
| SEQ. ID. NO. 37289 | 233-ValLysMetLeuAsnAspAlaLeuGluLysValArgGluSerGlyGluTyr-249 |
| Antigenic Index - Jameson-Wolf | |
| SEQ. ID. NO. 37290 | 19-CysGlyGlyGlnGlyLysAspAlaAlaAla-28 |
| SEQ. ID. NO. 37291 | 30-AlaAlaAsnProGlyLysValTyrArg-38 |
| SEQ. ID. NO. 37292 | 49-GluSerLeuAspSerLysGlyAsnValGluGlyPheAsp-61 |
| SEQ. ID. NO. 37293 | 76-IleGluPheLysHisGlnProTrpAspSer-85 |
| SEQ. ID. NO. 37294 | 90-LeuAsnAsnGlyAspAlaAspVal-97 |
| SEQ. ID. NO. 37295 | 104-IleThrAspAspArgLysGlnSerMetAspPheSerAspProTyrPhe-119 |
| SEQ. ID. NO. 37296 | 127-ValProLysGlyLysLysValSerSerSerGluAspLeuLysLysMetAsnLysValGly-146 |
| SEQ. ID. NO. 37297 | 149-ThrGlyHisThrGlyAspPheSerVal-157 |
| SEQ. ID. NO. 37298 | 159-LysLeuLeuGlyAsnAspAsnProLysIleAlaArg-170 |
| SEQ. ID. NO. 37299 | 179-LysGluLeuGluAsnGlyGlyLeuAspSerValValSerAspSerAla-194 |
| SEQ. ID. NO. 37300 | 201-LysAsnAsnProAlaLysGlyMetAspPhe-210 |
| SEQ. ID. NO. 37301 | 214-ProAspPheThrThr-218 |
| SEQ. ID. NO. 37302 | 225-ValArgLysGlyAspGluAlaThrVal-233 |
| SEQ. ID. NO. 37303 | 235-MetLeuAsnAspAlaLeuGluLysValArgGluSerGlyGluTyrAspLysIleTyr-253 |
| SEQ. ID. NO. 37304 | 257-PheAlaLysGluGlyGlyGlnAlaAlaLys-266 |
| SEQ. ID. NO. 37305 | 21-GlyGlnGlyLysAspAlaAlaAla-28 |
| SEQ. ID. NO. 37306 | 49-GluSerLeuAspSerLysGlyAsnValGluGlyPheAsp-61 |
| SEQ. ID. NO. 37307 | 91-AsnAsnGlyAspAlaAspVal-97 |
| SEQ. ID. NO. 37308 | 104-IleThrAspAspArgLysGlnSerMetAspPheSer-115 |
| SEQ. ID. NO. 37309 | 128-ProLysGlyLysLysValSerSerSerGluAspLeuLysLysMetAsnLys-144 |
| SEQ. ID. NO. 37310 | 164-AspAsnProLysIleAlaArg-170 |
| SEQ. ID. NO. 37311 | 179-LysGluLeuGluAsnGlyGlyLeu-186 |
| SEQ. ID. NO. 37312 | 203-AsnProAlaLysGlyMetAsp-209 |
| SEQ. ID. NO. 37313 | 225-ValArgLysGlyAspGluAlaThrVal-233 |
| SEQ. ID. NO. 37314 | 235-MetLeuAsnAspAlaLeuGluLysValArgGluSerGlyGluTyrAspLysIleTyr-253 |
| SEQ. ID. NO. 37315 | 257-PheAlaLysGluGlyGlyGlnAlaAlaLys-266 |
| g982 | |
| AMPHI Regions - AMPHI | |
| SEQ. ID. NO. 37316 | 10-ArgPheLeuGlnLysMetValAsnGlyValAsnIleLeuProAlaAlaAspTrp-27 |
| SEQ. ID. NO. 37317 | 70-AlaGlnMetValLysGluValAlaSerLysThr-80 |
| SEQ. ID. NO. 37318 | 99-ValAlaGluGlyMetLysTyr-105 |
| SEQ. ID. NO. 37319 | 114-AspLeuLysArgGlyIleAspLysAlaValAlaAlaLeuValGluGluLeuLysAsnIleAlaLysProCysAspThrSerLysGluIleAlaGln ValGlySer-148 |
| SEQ. ID. NO. 37320 | 159-AlaIleIleAlaGluAlaMetGluLysValGly-169 |
| SEQ. ID. NO. 37321 | 184-AsnGluLeuAspValValGluGlyMet-192 |
| SEQ. ID. NO. 37322 | 208-GluLysGlnIleAlaGlyLeuAsp-215 |
| SEQ. ID. NO. 37323 | 226-IleSerAsnIleArgAspLeuLeuProValLeuGluGlnValAlaLysAla-242 |
| SEQ. ID. NO. 37324 | 264-AsnAsnIleArgGlyIleLeuLysThrValAla-274 |
| SEQ. ID. NO. 37325 | 312-ThrLeuAspAspLeuGlyGlnThrLysArg-321 |
| SEQ. ID. NO. 37326 | 330-ThrValIleAspGlyPheGlyAspAlaAla-339 |
| SEQ. ID. NO. 37327 | 366-GluArgValAlaLysLeuAlaGlyGlyVal-375 |
| SEQ. ID. NO. 37328 | 425-LeuGluAsnLeuHisThr-430 |
| SEQ. ID. NO. 37329 | 443-LeuArgAlaValGluSerProLeuArgGlnIleValAlaAsnAla-457 |
| SEQ. ID. NO. 37330 | 483-GluTyrGlyAspMetIleGlyMet-490 |
| SEQ. ID. NO. 37331 | 499-ThrArgSerAlaLeu-503 |
| Antigenic Index - Jameson-Wolf | |
| SEQ. ID. NO. 37332 | 1-AlaSerGlnAsnLeuArgPheAspAsnArgPheLeu-12 |
| SEQ. ID. NO. 37333 | 31-GlyAlaLysGlyArgAsnValValVal-39 |
| SEQ. ID. NO. 37334 | 42-AlaPheGlyGlyProHisIleThrLysAspGlyValThrValAlaLysGluIleGluLeuLysAspLysPheGluAsnMetGly-69 |
| SEQ. ID. NO. 37335 | 72-MetValLysGluValAlaSerLysThrAsnAspValAlaGlyAspGlyThrThr-89 |
| SEQ. ID. NO. 37336 | 111-AsnProThrAspLeuLysArgGlyIleAspLysAlaVal-123 |
| SEQ. ID. NO. 37337 | 128-GluGluLeuLysAsnIleAlaLysProCysAspThrSerLysGluIleAla-144 |
| SEQ. ID. NO. 37338 | 149-IleSerAlaAsnSerAspGluGlnVal-157 |
| SEQ. ID. NO. 37339 | 163-GlyAlaMetGluLysValGlyLysGluGlyValIleThrValGluAspGlyLysSerLeuGluAsnGluLeuAspVal-188 |
| SEQ. ID. NO. 37340 | 192-MetGlnPheAspArgGlyTyr-198 |
| SEQ. ID. NO. 37341 | 206-AspAlaGluLysGlnIleAla-212 |
| SEQ. ID. NO. 37342 | 222-PheAspLysLysIleSerAsnIleArgAsp-231 |
| SEQ. ID. NO. 37343 | 238-GlnValAlaLysAlaSerArg-244 |
| SEQ. ID. NO. 37344 | 251-GluAspValGluGlyGluAla-257 |
| SEQ. ID. NO. 37345 | 265-AsnIleArgGlyIleLeu-270 |
| SEQ. ID. NO. 37346 | 277-AlaProGlyPheGlyAspArgArgLysAlaMetLeu-288 |
| SEQ. ID. NO. 37347 | 300-IleSerGluGluValGlyLeuSerLeuGluLysAlaThrLeuAspAspLeuGlyGlnThrLysArgIleGluIleGlyGluGluAsnThrThr-330 |
| SEQ. ID. NO. 37348 | 333-AspGlyPheGlyAspAlaAlaGlnIleGluAlaArgValAlaGluIleArgGlnGlnIleGluThrAlaThrSerAspTyrAspLysGluLysLeu GlnGluArgValAlaLysLeuAlaGly-373 |
| SEQ. ID. NO. 37349 | 384-ThrGluValGluMetLysGluLysLysAspArgValGluAspAlaLeuHis-400 |
| SEQ. ID. NO. 37350 | 404-AlaAlaValGluGluGlyVal-410 |
| SEQ. ID. NO. 37351 | 420-ArgAlaArgAlaAlaLeu-425 |
| SEQ. ID. NO. 37352 | 428-LeuHisThrGlyAsnAlaAspGlnAspAlaGlyVal-439 |
| SEQ. ID. NO. 37353 | 445-AlaValGluSerProLeuArg-451 |
| SEQ. ID. NO. 37354 | 456-AsnAlaGlyGlyGluProSerVal-463 |
| SEQ. ID. NO. 37355 | 468-ValLeuGluGlyLysGlyAsnTyrGlyTyr-477 |
| SEQ. ID. NO. 37356 | 479-AlaGlySerGlyGluTyrGlyAsp-486 |

TABLE 1-continued

| SEQ. ID. NO. 37357 | 494-AspProAlaLysValThrArgSerAlaLeu-503 |
| --- | --- |
| SEQ. ID. NO. 37358 | 522-GluIleProGluGluLysProAlaValProAspMetGlyGly-535 |

Hydrophilic Regions - Hopp-Woods

| SEQ. ID. NO. 37359 | 5-LeuArgPheAspAsn-9 |
| --- | --- |
| SEQ. ID. NO. 37360 | 32-AlaLysGlyArgAsnValValVal-39 |
| SEQ. ID. NO. 37361 | 47-HisIleThrLysAspGlyValThrValAlaLysGluIleGluLeuLysAspLysPheGluAsn-67 |
| SEQ. ID. NO. 37362 | 72-MetValLysGluValAlaSerLysThrAsnAspValAlaGlyAspGlyThrThr-89 |
| SEQ. ID. NO. 37363 | 113-ThrAspLeuLysArgGlyIleAspLysAlaVal-123 |
| SEQ. ID. NO. 37364 | 128-GluGluLeuLysAsnIleAlaLysProCysAspThrSerLysGluIleAla-144 |
| SEQ. ID. NO. 37365 | 151-AlaAsnSerAspGluGlnVal-157 |
| SEQ. ID. NO. 37366 | 163-GluAlaMetGluLysValGlyLysGluGlyValIleThrValGluAspGlyLysSerLeuGluAsnGluLeuAspVal-188 |
| SEQ. ID. NO. 37367 | 206-AspAlaGluLysGlnIleAla-212 |
| SEQ. ID. NO. 37368 | 222-PheAspLysLysIleSerAsnIleArgAsp-231 |
| SEQ. ID. NO. 37369 | 238-GlnValAlaLysAlaSerArg-244 |
| SEQ. ID. NO. 37370 | 251-GluAspValGluGlyGluAla-257 |
| SEQ. ID. NO. 37371 | 279-GlyPheGlyAspArgArgLysAlaMetLeu-288 |
| SEQ. ID. NO. 37372 | 300-IleSerGluGluValGlyLeuSerLeuGluLysAlaThrLeuAspAspLeuGlyGlnThrLysArgIleGluIleGlyGluGluAsnThrThr-330 |
| SEQ. ID. NO. 37373 | 339-AlaGlnIleGluAlaArgValAlaGluIleArgGlnGlnIleGluThrAlaThrSerAspTyrAspLysGluLysLeuGlnGluArgValAlaLys-370 |
| SEQ. ID. NO. 37374 | 384-ThrGluValGluMetLysGluLysLysAspArgValGluAspAlaLeuHis-400 |
| SEQ. ID. NO. 37375 | 404-AlaAlaValGluGluGlyVal-410 |
| SEQ. ID. NO. 37376 | 420-ArgAlaArgAlaAlaLeu-425 |
| SEQ. ID. NO. 37377 | 431-GlyAsnAlaAspGlnAspAla-437 |
| SEQ. ID. NO. 37378 | 445-AlaValGluSerProLeu-450 |
| SEQ. ID. NO. 37379 | 457-AlaGlyGlyGluPro-461 |
| SEQ. ID. NO. 37380 | 468-ValLeuGluGlyLysGly-473 |
| SEQ. ID. NO. 37381 | 480-GlySerGlyGluTyrGlyAsp-486 |
| SEQ. ID. NO. 37382 | 494-AspProAlaLysValThrArg-500 |
| SEQ. ID. NO. 37383 | 522-GluIleProGluGluLysProAlaVal-530 | g986
AMPHI Regions - AMPHI

| SEQ. ID. NO. 37384 | 6-GlnTyrPheAlaLeuAlaAlaLeuCysAlaAlaLeuLeuAla-19 |
| --- | --- |
| SEQ. ID. NO. 37385 | 21-CysGluLysAlaGly-25 |
| SEQ. ID. NO. 37386 | 36-SerPheValGluArgIleGluHis-43 |
| SEQ. ID. NO. 37387 | 55-ProAspPheAlaGlnLeuValGln-62 |
| SEQ. ID. NO. 37388 | 97-AspProPheTyrGluPhePheLysArgLeuValProAsnMetProGluIleProGln-115 |
| SEQ. ID. NO. 37389 | 145-AlaGlyMetGlySerIle-150 |
| SEQ. ID. NO. 37390 | 162-AlaLysLeuIleGlySerAspVal-169 |
| SEQ. ID. NO. 37391 | 189-IleGlyAsnProLysAsnLeuLysProGly-198 |
| SEQ. ID. NO. 37392 | 200-TrpValAlaAlaIleGly-205 |
| SEQ. ID. NO. 37393 | 287-AlaGluGlnLeuLysAsnThrGlyLysVal-296 |
| SEQ. ID. NO. 37394 | 393-AlaAlaGluHisThrGly-398 |
| SEQ. ID. NO. 37395 | 471-ArgLysAlaMetAspLysAla-477 |

Antigenic Index - Jameson-Wolf

| SEQ. ID. NO. 37396 | 20-GlyCysGluLysAlaGlySer-26 |
| --- | --- |
| SEQ. ID. NO. 37397 | 29-GlyAlaAspLysLysGluAlaSerPheValGluArgIleGluHisThrLysAspAspGlySerVal-50 |
| SEQ. ID. NO. 37398 | 61-ValGlnSerGluGlyProAla-67 |
| SEQ. ID. NO. 37399 | 75-ProAlaProArgThrGlnAsnGlySerGlyAsnAlaGluThrAspSerAspProLeuAlaAspSerAspProPhe-99 |
| SEQ. ID. NO. 37400 | 104-LysArgLeuValProAsnMetProGluIleProGlnGluGluAlaAspAspGlyGlyLeu-123 |
| SEQ. ID. NO. 37401 | 154-LeuAsnAspLysArgGluTyrThr-161 |
| SEQ. ID. NO. 37402 | 165-IleGlySerAspValGlnSerAspValAla-174 |
| SEQ. ID. NO. 37403 | 179-AspAlaThrGluGluLeuPro-185 |
| SEQ. ID. NO. 37404 | 189-IleGlyAsnProLysAsnLeuLysProGlyGlu-199 |
| SEQ. ID. NO. 37405 | 208-PheGlyPheAspAsnSerVal-214 |
| SEQ. ID. NO. 37406 | 219-ValSerAlaLysGlyArgSerLeuProAsnGluSerTyr-231 |
| SEQ. ID. NO. 37407 | 242-AsnProGlyAsnSerGlyGlyPro-249 |
| SEQ. ID. NO. 37408 | 265-TyrSerArgSerGlyGly-270 |
| SEQ. ID. NO. 37409 | 288-GluGlnLeuLysAsnThrGlyLysValGlnArgGlyGlnLeu-301 |
| SEQ. ID. NO. 37410 | 316-PheGlyLeuAspLysAlaSerGly-323 |
| SEQ. ID. NO. 37411 | 330-LeuProGlySerProAlaGluArgAlaGlyLeuGlnAlaGlyAsp-344 |
| SEQ. ID. NO. 37412 | 349-LeuAspGlyGlyGluIleArgSerSerGlyAspLeu-360 |
| SEQ. ID. NO. 37413 | 368-ThrProGlyLysGluValSer-374 |
| SEQ. ID. NO. 37414 | 378-TrpArgLysGlyGluGluIleThrIle-386 |
| SEQ. ID. NO. 37415 | 394-AlaGluHisThrGlyAlaSerSerLysThrAspGluAlaProTyrThrGluGlnGlnSerGlyThrPhe-416 |
| SEQ. ID. NO. 37416 | 427-ThrHisThrAspSerSerGlyLysHis-435 |
| SEQ. ID. NO. 37417 | 440-ArgValSerAspAlaAlaGluArgAlaGlyLeuArgArgGlyAspGluIleLeu-457 |
| SEQ. ID. NO. 37418 | 463-ProValAsnAspGluAlaGlyPheArgLysAlaMetAspLysAlaGlyLysAsnVal-481 |
| SEQ. ID. NO. 37419 | 486-MetArgArgGlyAsnThr-491 |

Hydrophilic Regions - Hopp-Woods

| SEQ. ID. NO. 37420 | 20-GlyCysGluLysAlaGly-25 |
| --- | --- |
| SEQ. ID. NO. 37421 | 29-GlyAlaAspLysLysGluAlaSerPheValGluArgIleGluHisThrLysAspAspGlySer-49 |
| SEQ. ID. NO. 37422 | 75-ProAlaProArgThrGlnAsnGlySerGlyAsnAlaGluThrAspSerAspProLeuAlaAspSerAspPro-98 |
| SEQ. ID. NO. 37423 | 111-ProGluIleProGlnGluGluAlaAspAspGlyGly-122 |
| SEQ. ID. NO. 37424 | 154-LeuAsnAspLysArgGluTyrThr-161 |
| SEQ. ID. NO. 37425 | 179-AspAlaThrGluGluLeuPro-185 |
| SEQ. ID. NO. 37426 | 193-LysAsnLeuLysPro-197 |
| SEQ. ID. NO. 37427 | 221-AlaLysGlyArgSerLeuPro-227 |
| SEQ. ID. NO. 37428 | 288-GluGlnLeuLysAsnThrGlyLysValGlnArgGlyGln-300 |
| SEQ. ID. NO. 37429 | 317-GlyLeuAspLysAlaSer-322 |
| SEQ. ID. NO. 37430 | 333-SerProAlaGluArgAlaGlyLeuGln-341 |
| SEQ. ID. NO. 37431 | 350-AspGlyGlyGluIleArgSerSerGlyAsp-359 |

| | |
|---|---|
| SEQ. ID. NO. 37432 | 368-ThrProGlyLysGluValSer-374 |
| SEQ. ID. NO. 37433 | 379-ArgLysGlyGluGluIleThrIle-386 |
| SEQ. ID. NO. 37434 | 394-AlaGluHisThrGlyAlaSerSerLysThrAspGluAlaProTyrThrGluGlnGlnSer-413 |
| SEQ. ID. NO. 37435 | 428-HisThrAspSerSerGly-433 |
| SEQ. ID. NO. 37436 | 440-ArgValSerAspAlaAlaGluArgAlaGlyLeuArgArgGlyAspGluIleLeu-457 |
| SEQ. ID. NO. 37437 | 463-ProValAsnAspGluAlaGlyPheArgLysAlaMetAspLysAlaGlyLys-479 | g987
AMPHI Regions - AMPHI

| | |
|---|---|
| SEQ. ID. NO. 37438 | 17-CysSerSerTrpLeu-21 |
| SEQ. ID. NO. 37439 | 65-ProHisGluAlaPhe-69 |
| SEQ. ID. NO. 37440 | 121-AsnThrArgGly-124 |
| SEQ. ID. NO. 37441 | 135-HisProAsnIleValArgLeuPheAsnProPheValLeuArgLysTrpArgAlaLeuGlyTyrLeuThrAspPheProArgLeuAsnArg-164 |
| SEQ. ID. NO. 37442 | 186-GlyAspGluTyrPheLysVal-192 |
| SEQ. ID. NO. 37443 | 201-LeuAspIleLeuAlaThr-206 |
| SEQ. ID. NO. 37444 | 210-ValGlyGluValSerHisAspPheAspArgTyrTrpAla-222 |
| SEQ. ID. NO. 37445 | 229-AlaThrArgIleIleArgSerGly-236 |
| SEQ. ID. NO. 37446 | 238-IleGlyLysGlyLeuGlnAla-244 |
| SEQ. ID. NO. 37447 | 288-SerAspSerProAlaLysGlyLeuAspArg-297 |
| SEQ. ID. NO. 37448 | 306-GlyArgLeuGlnAspAlaLeuLysGlnPro-315 |
| SEQ. ID. NO. 37449 | 332-GlyThrAspAlaLeuAlaLysLeuValGlnAsp-342 |
| SEQ. ID. NO. 37450 | 354-GlnAlaThrAspValAlaAla-360 |
| SEQ. ID. NO. 37451 | 442-LysIleAlaGluGlnMetGluArgThrLeuAlaAspThrThrPro-456 |
| SEQ. ID. NO. 37452 | 485-ProGluAlaLysLeuTrpLysArgIleAlaAlaLysIleLeuSerLeuProIleGluGlyLeu-506 |

Antigenic Index - Jameson-Wolf

| | |
|---|---|
| SEQ. ID. NO. 37453 | 1-MetLysThrArgSer-5 |
| SEQ. ID. NO. 37454 | 23-ProLeuGluGluArgThrGluSerArgHisPheAsnThrSerLysProValLeu-40 |
| SEQ. ID. NO. 37455 | 49-HisThrProHisAsnAsnGlyLeuSer-57 |
| SEQ. ID. NO. 37456 | 77-GluSerAlaGluHisSerLeu-83 |
| SEQ. ID. NO. 37457 | 90-TrpArgAsnAspIleSerGlyArgLeu-98 |
| SEQ. ID. NO. 37458 | 107-AlaGluArgGlyValArg-112 |
| SEQ. ID. NO. 37459 | 115-LeuLeuLeuAspAspAsnAsnThrArgGlyLeuAsp-126 |
| SEQ. ID. NO. 37460 | 134-SerHisProAsnIle-138 |
| SEQ. ID. NO. 37461 | 158-AspPheProArgLeuAsnArgArgMetHisAsnLysSerPheThrAlaAspAsnArgAla-177 |
| SEQ. ID. NO. 37462 | 181-GlyGlyArgAsnIleGlyAspGluTyrPheLysValGlyGluAspThrVal-197 |
| SEQ. ID. NO. 37463 | 213-ValSerHisAspPheAspArgTyrTrp-221 |
| SEQ. ID. NO. 37464 | 224-HisSerAlaHisAsn-228 |
| SEQ. ID. NO. 37465 | 231-ArgIleIleArgSerGlyAsnIleGlyLysGlyLeu-242 |
| SEQ. ID. NO. 37466 | 246-GlyTyrAsnAspGluThrSerArg-253 |
| SEQ. ID. NO. 37467 | 258-ArgTyrArgGluThrValGlu-264 |
| SEQ. ID. NO. 37468 | 266-SerProLeuTyrGln-270 |
| SEQ. ID. NO. 37469 | 272-IleGlnThrGlyArgIleAsp-278 |
| SEQ. ID. NO. 37470 | 286-LeuIleSerAspSerProAlaLysGlyLeuAspArgAspArgArgLysProProIle-304 |
| SEQ. ID. NO. 37471 | 307-ArgLeuGlnAspAlaLeuLysGlnProGluLysSer-318 |
| SEQ. ID. NO. 37472 | 327-ValProThrLysSerGlyThrAspAlaLeu-336 |
| SEQ. ID. NO. 37473 | 339-LeuValGlnAspGlyIleAsp-345 |
| SEQ. ID. NO. 37474 | 366-ValLysTyrArgLysProLeuLeu-373 |
| SEQ. ID. NO. 37475 | 390-AlaThrLysAspLysGlyLeuThrGlySerSerVal-401 |
| SEQ. ID. NO. 37476 | 411-ValAspGlyLysArgIlePhe-417 |
| SEQ. ID. NO. 37477 | 421-PheAsnLeuAspProArgSerAlaArgLeuAsnThr-432 |
| SEQ. ID. NO. 37478 | 439-GluSerProLysIleAlaGluGlnMetGluArgThrLeuAlaAspThrThrProGluTyrAlaTyr-460 |
| SEQ. ID. NO. 37479 | 462-ValThrLeuAspLysHisAsnArgLeuGlnTrpHisAspProAlaThrArgLysThrTyrProAsnGluProGluAlaLysLeuTrpLys-491 |

Hydrophilic Regions - Hopp-Woods

| | |
|---|---|
| SEQ. ID. NO. 37480 | 1-MetLysThrArgSer-5 |
| SEQ. ID. NO. 37481 | 24-LeuGluGluArgThrGluSerArgHisPheAsnThr-35 |
| SEQ. ID. NO. 37482 | 77-GluSerAlaGluHisSerLeu-83 |
| SEQ. ID. NO. 37483 | 107-AlaGluArgGlyValArg-112 |
| SEQ. ID. NO. 37484 | 115-LeuLeuLeuAspAspAsnAsnThrArgGlyLeuAsp-126 |
| SEQ. ID. NO. 37485 | 160-ProArgLeuAsnArgArgMetHisAsn-168 |
| SEQ. ID. NO. 37486 | 171-PheThrAlaAspAsnArgAla-177 |
| SEQ. ID. NO. 37487 | 188-GluTyrPheLysValGlyGluAspThrVal-197 |
| SEQ. ID. NO. 37488 | 213-ValSerHisAspPheAspArg-219 |
| SEQ. ID. NO. 37489 | 247-TyrAsnAspGluThrSerArg-253 |
| SEQ. ID. NO. 37490 | 258-ArgTyrArgGluThrValGlu-264 |
| SEQ. ID. NO. 37491 | 273-GlnThrGlyArgIleAsp-278 |
| SEQ. ID. NO. 37492 | 290-SerProAlaLysGlyLeuAspArgAspArgArgLysProProIle-304 |
| SEQ. ID. NO. 37493 | 307-ArgLeuGlnAspAlaLeuLysGlnProGluLysSer-318 |
| SEQ. ID. NO. 37494 | 330-LysSerGlyThrAspAlaLeu-336 |
| SEQ. ID. NO. 37495 | 339-LeuValGlnAspGlyIleAsp-345 |
| SEQ. ID. NO. 37496 | 366-ValLysTyrArgLysProLeuLeu-373 |
| SEQ. ID. NO. 37497 | 390-AlaThrLysAspLysGlyLeuThr-397 |
| SEQ. ID. NO. 37498 | 423-LeuAspProArgSerAlaArgLeuAsnThr-432 |
| SEQ. ID. NO. 37499 | 439-GluSerProLysIleAlaGluGlnMetGluArgThrLeuAla-452 |

TABLE 1-continued

| | |
|---|---|
| SEQ. ID. NO. 37500 | 463-ThrLeuAspLysHisAsnArg-469 |
| SEQ. ID. NO. 37501 | 475-ProAlaThrArgLysThrTyrProAsnGluProGluAlaLysLeuTrpLys-491 |
| g988 | |
| AMPHI Regions - AMPHI | |
| SEQ. ID. NO. 37502 | 45-SerLysIleGluSerLeuAlaArg-52 |
| SEQ. ID. NO. 37503 | 125-GlnMetArgGlyVal-129 |
| SEQ. ID. NO. 37504 | 154-AspIleValGluArgAlaGlnSerLysVal-163 |
| SEQ. ID. NO. 37505 | 221-AlaLysIleIleGluValLeuGlyAspTyrAlaAsp-232 |
| SEQ. ID. NO. 37506 | 248-HisArgPheSerGluAlaCysAlaLysSerAlaLysLysIleProAspHisValArgLys-267 |
| SEQ. ID. NO. 37507 | 288-ThrAlaArgAspPheAspAsp-294 |
| SEQ. ID. NO. 37508 | 299-GluLysValGlyArgAsnTyr-305 |
| SEQ. ID. NO. 37509 | 310-AlaIleAlaAspValSerHisTyrValArgProAspAsp-322 |
| SEQ. ID. NO. 37510 | 348-AsnLeuSerAsnGly-352 |
| SEQ. ID. NO. 37511 | 396-AsnGlnValTrpLysTrpLeuSerAspGlyIleGlyAsnProHisLys-411 |
| SEQ. ID. NO. 37512 | 413-GlnIleAspThrLeuTyrLysLeuPheLysIleLeuGlnLys-426 |
| SEQ. ID. NO. 37513 | 494-LeuGlyProThrProGluLysLeuAlaThrLeu-504 |
| SEQ. ID. NO. 37514 | 524-LysAspTyrAlaAlaLeuAlaGluGlnPheLys-534 |
| SEQ. ID. NO. 37515 | 544-ValMetMetLeuArgSerMetGlnGlnAla-553 |
| SEQ. ID. NO. 37516 | 555-TyrGluProHisCys-559 |
| SEQ. ID. NO. 37517 | 569-AlaTyrAlaHisPheThrSerProIleArgArgTyrProAspLeuThrValHisArgAlaIleLysAlaVal-592 |
| SEQ. ID. NO. 37518 | 618-AlaAspAspAlaGlyArgAspValGluAsnTrpLeuLys-630 |
| SEQ. ID. NO. 37519 | 641-IlePheGluGlyLysIleSerArgGly-649 |
| SEQ. ID. NO. 37520 | 653-PheGlyIlePheValThrLeu-659 |
| SEQ. ID. NO. 37521 | 667-LeuValHisIleSerAspLeuGlyGlu-675 |
| Antigenic Index - Jameson-Wolf | |
| SEQ. ID. NO. 37522 | 1-MetAsnLysAsnIleLys-6 |
| SEQ. ID. NO. 37523 | 8-LeuAsnLeuArgGluLysAspProPheLeuSerArgGluLysGlnArgTyrGluHisProLeuProSerArgGluTrpIle-34 |
| SEQ. ID. NO. 37524 | 37-LeuLeuGluArgLysGlyValProSerLysIleGluSerLeuAlaArgGluLeuSerIleThrGluAspGluTyrValPhePheGluArgArgLeuLysAlaMetAlaArgAspGlyGln-76 |
| SEQ. ID. NO. 37525 | 79-IleAsnArgArgGlyAlaVal-85 |
| SEQ. ID. NO. 37526 | 87-AlaAlaAspLysLeuAspLeuValLysCysArgValGluAlaHisLysAspGlyPhe-105 |
| SEQ. ID. NO. 37527 | 113-ProMetAspGluGlyAsp-118 |
| SEQ. ID. NO. 37528 | 124-ArgGlnMetArgGlyValMetHisGlyAspThrValThr-136 |
| SEQ. ID. NO. 37529 | 138-ArgProAlaGlyMetAspArgArgGlyArgArgGluGlyThrPhe-152 |
| SEQ. ID. NO. 37530 | 154-AspIleValGluArgAlaGlnSerLysValVal-164 |
| SEQ. ID. NO. 37531 | 168-TyrMetAspArgGlyValAla-174 |
| SEQ. ID. NO. 37532 | 176-LeuGluProGluAspLysArgLeuAsnGlnSerIle-187 |
| SEQ. ID. NO. 37533 | 189-LeuGluProAspGlyValAlaArgPheLysProGluSerGlyGln-203 |
| SEQ. ID. NO. 37534 | 210-GluValTyrProGluGlnAsnArgProAlaVal-220 |
| SEQ. ID. NO. 37535 | 227-LeuGlyAspTyrAlaAspSerGlyMetGluIle-237 |
| SEQ. ID. NO. 37536 | 239-IleAlaValArgLysHisHisLeuProHisArgPheSerGluAlaCysAlaLysSerAlaLysLysIleProAspHisValArgLysSerAspLeuLysGlyArgValAspLeuCys-277 |
| SEQ. ID. NO. 37537 | 283-ThrIleAspGlyGluThrAlaArgAspPheAspAsp-294 |
| SEQ. ID. NO. 37538 | 299-GluLysValGlyArgAsnTyrArg-306 |
| SEQ. ID. NO. 37539 | 316-HisTyrValArgProAspAspAlaIleAspAlaGlnGluArgSerThrSerValTyrPheProArgArgMetIleProMetLeuProGluAsnLeuSerAsnGlyIleCysSerLeuAsnProAspValGluArgLeu-363 |
| SEQ. ID. NO. 37540 | 374-AlaGlyAsnIleLysGluTyrArgPhe-382 |
| SEQ. ID. NO. 37541 | 393-LeuThrTyrAsnGln-397 |
| SEQ. ID. NO. 37542 | 402-LeuSerAspGlyIleGlyAsnProHisLysAlaGlnIle-414 |
| SEQ. ID. NO. 37543 | 424-LeuGlnLysLysArgLeuAlaArgGlyAlaValGluPheGluSerValGlu-440 |
| SEQ. ID. NO. 37544 | 443-MetIlePheAspAspAsnGlyLysIleGluLys-453 |
| SEQ. ID. NO. 37545 | 458-ValArgAsnAspAlaHisLysLeuIleGlu-467 |
| SEQ. ID. NO. 37546 | 482-LeuLysAsnLysHisThrAla-488 |
| SEQ. ID. NO. 37547 | 493-HisLeuGlyProThrProGluLysLeuAlaThrLeuArgGluGlnLeu-508 |
| SEQ. ID. NO. 37548 | 516-GlyGlyGlyAspAsnProSerProLysAspTyrAlaAla-528 |
| SEQ. ID. NO. 37549 | 531-GluGlnPheLysGlyArgProAspAlaGluLeu-541 |
| SEQ. ID. NO. 37550 | 555-TyrGluProHisCysGluGlyHis-562 |
| SEQ. ID. NO. 37551 | 575-SerProIleArgArgTyrProAspLeuThrVal-585 |
| SEQ. ID. NO. 37552 | 592-ValLeuAsnArgLysThrTyrThrProAsnLysSerTrp-604 |
| SEQ. ID. NO. 37553 | 613-PheCysGluArgArgAlaAspAspAlaGlyArgAspValGluAsn-627 |
| SEQ. ID. NO. 37554 | 633-TyrMetArgAspLysValGlyGluIlePheGluGlyLysIleSerArgGlyValAla-651 |
| SEQ. ID. NO. 37555 | 671-SerAspLeuGlyGluAspTyrPheAsnPheArgPro-682 |
| SEQ. ID. NO. 37556 | 684-IleMetAlaIleGluGlyGluArgSerGlyIleArgPheAsnMetGlyAspArgValAlaValArgValAlaArgAlaAspLeuAspAspGlyLysIle-716 |
| SEQ. ID. NO. 37557 | 724-GluSerGlyArgArgLysValLysLeu-733 |
| SEQ. ID. NO. 37558 | 735-AlaSerAlaLysProAlaGlyAlaAlaGlyLysGlyLysSerLysThrThrAlaGluLysLysThrAlaArgCysGlyLysValArgGlyArgGlyValProAla-769 |
| SEQ. ID. NO. 37559 | 771-AlaGluSerGlyLysLysAlaLysLysProValProIleLysValLysLysArgLysGlyLysSer-792 |
| Hydrophilic Regions - Hopp-Woods | |
| SEQ. ID. NO. 37560 | 1-MetAsnLysAsnIleLys-6 |
| SEQ. ID. NO. 37561 | 8-LeuAsnLeuArgGluLysAspProPheLeuSerArgGluLysGlnArgTyrGluHis-26 |
| SEQ. ID. NO. 37562 | 37-LeuLeuGluArgLysGlyValProSerLysIleGluSerLeuAlaArgGluLeuSerIleThrGluAspGluTyrValPhePheGluArgArgLeuLysAlaMetAlaArgAspGlyGln-76 |
| SEQ. ID. NO. 37563 | 79-IleAsnArgArgGlyAla-84 |
| SEQ. ID. NO. 37564 | 87-AlaAlaAspLysLeuAspLeuValLysCysArgValGluAlaHisLysAspGlyPhe-105 |
| SEQ. ID. NO. 37565 | 113-ProMetAspGluGlyAsp-118 |
| SEQ. ID. NO. 37566 | 140-AlaGlyMetAspArgArgGlyArgArgGluGlyThr-151 |
| SEQ. ID. NO. 37567 | 155-IleValGluArgAlaGlnSerLysValVal-164 |

TABLE 1-continued

| SEQ. ID. NO. 37568 | 176-LeuGluProGluAspLysArgLeuAsn-184 |
| SEQ. ID. NO. 37569 | 189-LeuGluProAspGlyValAlaArgPheLysProGluSerGly-202 |
| SEQ. ID. NO. 37570 | 210-GluValTyrProGluGlnAsnArgProAlaVal-220 |
| SEQ. ID. NO. 37571 | 230-TyrAlaAspSerGlyMetGluIle-237 |
| SEQ. ID. NO. 37572 | 239-IleAlaValArgLysHisHisLeu-246 |
| SEQ. ID. NO. 37573 | 249-ArgPheSerGluAlaCysAlaLysSerAlaLysLysIleProAspHisValArgLysSerAspLeuLysGlyArgValAspLeu-276 |
| SEQ. ID. NO. 37574 | 284-IleAspGlyGluThrAlaArgAspPheAspAsp-294 |
| SEQ. ID. NO. 37575 | 299-GluLysValGlyArgAsnTyr-305 |
| SEQ. ID. NO. 37576 | 318-ValArgProAspAspAlaIleAspAlaAspAlaGlnGluArgSerThr-333 |
| SEQ. ID. NO. 37577 | 358-ProAspValGluArg-362 |
| SEQ. ID. NO. 37578 | 376-AsnIleLysGluTyrArg-381 |
| SEQ. ID. NO. 37579 | 406-IleGlyAsnProHisLysAlaGlnIle-414 |
| SEQ. ID. NO. 37580 | 424-LeuGlnLysLysArgLeuAlaArgGlyAlaValGluPheGluSerValGlu-440 |
| SEQ. ID. NO. 37581 | 443-MetIlePheAspAspAsnGlyLysIleGluLys-453 |
| SEQ. ID. NO. 37582 | 458-ValArgAsnAspAlaHisLysLeuIleGlu-467 |
| SEQ. ID. NO. 37583 | 496-ProThrProGluLysLeuAlaThrLeuArgGluGlnLeu-508 |
| SEQ. ID. NO. 37584 | 517-GlyGlyAspAsnProSerProLysAspTyrAlaAla-528 |
| SEQ. ID. NO. 37585 | 531-GluGlnPheLysGlyArgProAspAlaGluLeu-541 |
| SEQ. ID. NO. 37586 | 576-ProIleArgArgTyrProAsp-582 |
| SEQ. ID. NO. 37587 | 592-ValLeuAsnArgLysThrTyrThrPro-600 |
| SEQ. ID. NO. 37588 | 613-PheCysGluArgArgAlaAspAlaGlyArgAspValGluAsn-627 |
| SEQ. ID. NO. 37589 | 633-TyrMetArgAspLysValGlyGluIlePheGluGlyLysIleSerArg-648 |
| SEQ. ID. NO. 37590 | 684-IleMetAlaIleGluGlyGluArgSerGlyIle-694 |
| SEQ. ID. NO. 37591 | 697-AsnMetGlyAspArgValAlaValArgValAlaArgAlaAspLeuAspAspGlyLysIle-716 |
| SEQ. ID. NO. 37592 | 724-GluSerGlyArgArgArgLysValLysLeu-733 |
| SEQ. ID. NO. 37593 | 735-AlaSerAlaLysProAlaGlyAlaAlaGlyLysGlyLysSerLysThrThrAlaGluLysLysThrAlaArgCysGlyLysValArgGlyArgGly-766 |
| SEQ. ID. NO. 37594 | 771-AlaGluSerGlyLysLysAlaLysLysProValProIleLysValLysLysArgLysGlyLysSer-792 | g989
AMPHI Regions - AMPHI

| SEQ. ID. NO. 37595 | 36-AlaGlnSerThrAlaAsnAlaAla-43 |
| SEQ. ID. NO. 37596 | 53-AlaGlyLeuThrLysLeu-58 |
| SEQ. ID. NO. 37597 | 80-SerAlaThrAspPhe-84 |
| SEQ. ID. NO. 37598 | 104-ProHisIleTyrGlyAla-109 |
| SEQ. ID. NO. 37599 | 178-GluLeuArgLysTyrAlaAspGlyIle-186 |
| SEQ. ID. NO. 37600 | 195-AlaThrProSerAsnProThr-201 |
| SEQ. ID. NO. 37601 | 287-ValThrProGluSer-291 |
| SEQ. ID. NO. 37602 | 293-SerValHisGlyMetTyrLysValSer-301 |
| SEQ. ID. NO. 37603 | 312-TrpThrArgHisSerArg-317 |
| SEQ. ID. NO. 37604 | 357-SerTyrGlnIleSerGluPro-363 |
| SEQ. ID. NO. 37605 | 439-SerCysAlaArgPheLysAsnHisAlaAsp-448 |

Antigenic Index - Jameson-Wolf

| SEQ. ID. NO. 37606 | 41-AsnAlaAlaAspAlaSer-46 |
| SEQ. ID. NO. 37607 | 52-ProAlaGlyLeuThrLysLeuAspSerSerGlnIle-63 |
| SEQ. ID. NO. 37608 | 76-TyrGluAlaAspSerAlaThrAspPheThr-85 |
| SEQ. ID. NO. 37609 | 89-ValGlnGlySerLysAsnGlyLysIleThrLysThrThr-101 |
| SEQ. ID. NO. 37610 | 111-LysValAsnAspAsnLeuThr-117 |
| SEQ. ID. NO. 37611 | 127-GlySerAlaThrGluTyrGluLysAspSerValLeu-138 |
| SEQ. ID. NO. 37612 | 141-AsnIleAsnLysLeuGly-146 |
| SEQ. ID. NO. 37613 | 159-LysLeuAsnGluArgHisSerPheGly-167 |
| SEQ. ID. NO. 37614 | 174-HisAsnSerAlaGluLeuArgLysTyrAlaAspGlyIleProLysLysAlaGln-191 |
| SEQ. ID. NO. 37615 | 196-ThrProSerAsnPro-200 |
| SEQ. ID. NO. 37616 | 206-IleLysAlaAspGlyHisAlaAspValLysGlySerAspTrpGly-220 |
| SEQ. ID. NO. 37617 | 230-AspIleAsnAspArgAlaArgValGlyValAsnTyrArgSerLysValSerHisThrLeuLysGlyAspAlaGluTrpAlaAla-257 |
| SEQ. ID. NO. 37618 | 259-GlyAlaAlaAlaLysValGlnGlnTrpAsnAspAsnMet-270 |
| SEQ. ID. NO. 37619 | 278-AlaAsnGluLysAlaSerVal-284 |
| SEQ. ID. NO. 37620 | 287-ValThrProGluSer-291 |
| SEQ. ID. NO. 37621 | 298-TyrLysValSerAspLysAlaAspLeu-306 |
| SEQ. ID. NO. 37622 | 313-ThrArgHisSerArgPheAsnLys-320 |
| SEQ. ID. NO. 37623 | 323-LeuPhePheGluLysGluLysAsnIleAlaAsnGlyLysLysSerAspArgThrThrIleThrProAsnTrpArgAsnThrTyrLys-351 |
| SEQ. ID. NO. 37624 | 353-GlyLeuGlyGlySerTyrGlnIleSerGlu-362 |
| SEQ. ID. NO. 37625 | 372-PheAspLysProProValArgAsnAlaAspTyrArgMetAsnSerLeuProAspGlyAsnArg-392 |
| SEQ. ID. NO. 37626 | 402-HisIleGlyLysAsnHisVal-408 |
| SEQ. ID. NO. 37627 | 419-AsnAspThrSerTyrArgThrAlaLysAlaSerGlyAsnAspValAspSerLysGlyAlaSerCysAlaArgPheLysAsnHisAla-447 |

Hydrophilic Regions - Hopp-Woods

| SEQ. ID. NO. 37628 | 56-ThrLysLeuAspSerSerGln-62 |
| SEQ. ID. NO. 37629 | 76-TyrGluAlaAspSerAlaThr-82 |
| SEQ. ID. NO. 37630 | 90-GlnGlySerLysAsnGlyLysIleThrLys-99 |
| SEQ. ID. NO. 37631 | 130-ThrGluTyrGluLysAspSerValLeu-138 |
| SEQ. ID. NO. 37632 | 159-LysLeuAsnGluArgHisSer-165 |
| SEQ. ID. NO. 37633 | 175-AsnSerAlaGluLeuArgLysTyrAlaAspGlyIleProLysLysAlaGln-191 |
| SEQ. ID. NO. 37634 | 206-IleLysAlaAspGlyHisAlaAspValLysGlySerAsp-218 |
| SEQ. ID. NO. 37635 | 231-IleAsnAspArgAlaArgVal-237 |
| SEQ. ID. NO. 37636 | 241-TyrArgSerLysVal-245 |
| SEQ. ID. NO. 37637 | 249-LeuLysGlyAspAlaGluTrpAlaAla-257 |
| SEQ. ID. NO. 37638 | 278-AlaAsnGluLysAlaSerVal-284 |
| SEQ. ID. NO. 37639 | 299-LysValSerAspLysAlaAspLeu-306 |
| SEQ. ID. NO. 37640 | 316-SerArgPheAsnLys-320 |
| SEQ. ID. NO. 37641 | 323-LeuPhePheGluLysGluLysAsnIleAlaAsnGlyLysLysSerAspArgThrThrIle-342 |
| SEQ. ID. NO. 37642 | 372-PheAspLysProProValArgAsnAlaAspTyrArgMet-384 |
| SEQ. ID. NO. 37643 | 386-SerLeuProAspGlyAsn-391 |

TABLE 1-continued

| | |
|---|---|
| SEQ. ID. NO. 37644 | 421-ThrSerTyrArgThrAlaLysAlaSerGlyAsnAspValAspSerLysGlyAlaSer-439 |
| SEQ. ID. NO. 37645 | 441-AlaArgPheLysAsnHisAla-447 | g992
AMPHI Regions - AMPHI

| | |
|---|---|
| SEQ. ID. NO. 37646 | 6-ArgHisLeuLysAsnMetGlnIleLysLysIleMetLysTrp-19 |
| SEQ. ID. NO. 37647 | 24-LeuSerLeuLeuGlyAlaLeuGlyTyr-32 |
| SEQ. ID. NO. 37648 | 45-AlaValLeuAspValLeuGlyThr-52 |
| SEQ. ID. NO. 37649 | 72-HisSerTyrThrGlyThrValSerLysValTyr-82 |
| SEQ. ID. NO. 37650 | 140-TyrGlnArgGluValAlaGlnVal-147 |
| SEQ. ID. NO. 37651 | 158-GlnValGlnAspGly-162 |
| SEQ. ID. NO. 37652 | 179-AspPheAlaAspTyr-183 |

Antigenic Index - Jameson-Wolf

| | |
|---|---|
| SEQ. ID. NO. 37653 | 1-MetPheArgArgHisArgHisLeuLys-9 |
| SEQ. ID. NO. 37654 | 33-ThrGlyTyrAspSerGluAlaValArg-41 |
| SEQ. ID. NO. 37655 | 51-GlyThrAlaGlyAspValGlyPhe-58 |
| SEQ. ID. NO. 37656 | 60-AlaProValArgArgArgAlaSerAlaLysSerGlyHisSerTyr-74 |
| SEQ. ID. NO. 37657 | 79-SerLysValTyrAspGlyAspThr-86 |
| SEQ. ID. NO. 37658 | 90-IleAspGlyAspGlyAlaLysHisLysIle-99 |
| SEQ. ID. NO. 37659 | 105-AspAlaProGluMetLysGlnAlaTyrGlyThrArgSerArgAspAsnLeuArgAlaAlaAlaGluGlyArgLysValSer-131 |
| SEQ. ID. NO. 37660 | 134-ValPheGluThrAspArgTyrGlnArgGluValAla-145 |
| SEQ. ID. NO. 37661 | 148-SerAlaGlyLysThrAspLeu-154 |
| SEQ. ID. NO. 37662 | 168-LysSerTyrAlaLysGluGlnGlnAspLysAlaAspPhe-180 |
| SEQ. ID. NO. 37663 | 187-GlnIleGlnAlaGluArgGluArgLysGlyLeuTrpLysAlaLysAsnProGlnAlaPro-206 |
| SEQ. ID. NO. 37664 | 208-AlaTyrArgArgAlaGlyArgSerGlyGlyGlyAsnLysAspTrpMetAspSerValGlyGlu-228 |

Hydrophilic Regions - Hopp-Woods

| | |
|---|---|
| SEQ. ID. NO. 37665 | 1-MetPheArgArgHisArgHisLeuLys-9 |
| SEQ. ID. NO. 37666 | 35-TyrAspSerGluAlaValArg-41 |
| SEQ. ID. NO. 37667 | 60-AlaProValArgArgArgAlaSerAlaLysSerGlyHis-72 |
| SEQ. ID. NO. 37668 | 80-LysValTyrAspGlyAspThr-86 |
| SEQ. ID. NO. 37669 | 90-IleAspGlyAspGlyAlaLysHisLysIle-99 |
| SEQ. ID. NO. 37670 | 105-AspAlaProGluMetLysGln-111 |
| SEQ. ID. NO. 37671 | 113-TyrGlyThrArgSerArgAspAsnLeuArgAlaAlaAlaGluGlyArgLysValSer-131 |
| SEQ. ID. NO. 37672 | 134-ValPheGluThrAspArgTyrGlnArgGluValAla-145 |
| SEQ. ID. NO. 37673 | 148-SerAlaGlyLysThrAspLeu-154 |
| SEQ. ID. NO. 37674 | 169-SerTyrAlaLysGluGlnGlnAspLysAlaAspPhe-180 |
| SEQ. ID. NO. 37675 | 187-GlnIleGlnAlaGluArgGluArgLysGlyLeuTrpLysAlaLysAsnPro-203 |
| SEQ. ID. NO. 37676 | 211-ArgAlaGlyArgSerGlyGlyGlyAsnLysAspTrpMetAspSerVal-226 | g993
AMPHI Regions - AMPHI

| | |
|---|---|
| SEQ. ID. NO. 37677 | 6-GlySerPheGlnGlyProLeuAspLeuLeuLeu-16 |
| SEQ. ID. NO. 37678 | 35-ThrGlyGlnTyrLeuHisTyrIleAlaGlnMet-45 |
| SEQ. ID. NO. 37679 | 105-GlyLeuAspAlaLeuProArgAla-112 |
| SEQ. ID. NO. 37680 | 133-GluValTyrIleAlaAspLeuMetGlnAlaTrpLeuGly-145 |
| SEQ. ID. NO. 37681 | 152-HisThrArgSerHisGluValIle-159 |
| SEQ. ID. NO. 37682 | 169-MetThrAlaIleLeuArgArgLeuAsnGluHisGlyIleCysArgPheHisAlaLeuPheAsn-189 |
| SEQ. ID. NO. 37683 | 198-IleValAsnPheIleAlaLeuLeu-205 |

Antigenic Index - Jameson-Wolf

| | |
|---|---|
| SEQ. ID. NO. 37684 | 7-SerPheGlnGlyProLeu-12 |
| SEQ. ID. NO. 37685 | 20-ArgLysGlnAsnIleAsp-25 |
| SEQ. ID. NO. 37686 | 70-LeuLeuLeuProArgThrGluAlaValGluAspGluGluAlaAspProArgAlaGluLeuValArg-91 |
| SEQ. ID. NO. 37687 | 108-AlaLeuProArgAlaGlyArgAspPhe-116 |
| SEQ. ID. NO. 37688 | 125-IleAlaAlaGluThrLysLeuPro-132 |
| SEQ. ID. NO. 37689 | 148-SerArgAlaLysHisThrArgSerHisGluValIleGln-160 |
| SEQ. ID. NO. 37690 | 174-ArgArgLeuAsnGluHisGlyIle-181 |
| SEQ. ID. NO. 37691 | 189-AsnProGluGlnGly-193 |
| SEQ. ID. NO. 37692 | 207-LeuAlaLysGluGlyLeu-212 |
| SEQ. ID. NO. 37693 | 216-ValGlnGluAspGlyPheGlyGluIleArgIle-226 |
| SEQ. ID. NO. 37694 | 228-LeuAsnHisGluGlyAlaHisSerAspGlyIlePheGlyThrArgGlyGlyArgAspValPhe-248 |

Hydrophilic Regions - Hopp-Woods

| | |
|---|---|
| SEQ. ID. NO. 37695 | 20-ArgLysGlnAsnIleAsp-25 |
| SEQ. ID. NO. 37696 | 70-LeuLeuLeuProArgThrGluAlaValGluAspGluGluAlaAspProArgAlaGluLeuValArg-91 |
| SEQ. ID. NO. 37697 | 108-AlaLeuProArgAlaGlyArg-114 |
| SEQ. ID. NO. 37698 | 125-IleAlaAlaGluThrLysLeuPro-132 |
| SEQ. ID. NO. 37699 | 148-SerArgAlaLysHisThrArgSerHisGluValIleGln-160 |
| SEQ. ID. NO. 37700 | 174-ArgArgLeuAsnGlu-178 |
| SEQ. ID. NO. 37701 | 207-LeuAlaLysGluGlyLeu-212 |
| SEQ. ID. NO. 37702 | 216-ValGlnGluAspGlyPheGly-222 |
| SEQ. ID. NO. 37703 | 242-ArgGlyGlyArgAspValPhe-248 | g996
AMPHI Regions - AMPHI

| | |
|---|---|
| SEQ. ID. NO. 37704 | 21-LysSerAlaArgThrHisAlaLysIlePro-30 |
| SEQ. ID. NO. 37705 | 50-ProGlyGluSerTyrProAlaGlnLeuGlnLysLeuThrGlyTrpAsn-65 |
| SEQ. ID. NO. 37706 | 75-ThrSerAlaGlnAlaLeuSerArgLeuProAla-85 |
| SEQ. ID. NO. 37707 | 104-LeuArgLysValProGluGlu-110 |
| SEQ. ID. NO. 37708 | 115-AsnIleAlaLysIleIleGluThrValGlnLys-125 |

TABLE 1-continued

| | |
|---|---|
| SEQ. ID. NO. 37709 | 140-LeuGlyAlaLeuPheGlyHisLeuSerAsp-149 |
| SEQ. ID. NO. 37710 | 167-GlyAlaTrpAlaGlu-171 |
| SEQ. ID. NO. 37711 | 186-AsnGlyLysGlyTyrArgLysPheAlaGluAsnLeuAsnGlnPheLeuArgLysHisGlyPhe-206 |
| Antigenic Index - Jameson-Wolf | |
| SEQ. ID. NO. 37712 | 1-MetAsnArgArgThrPhe-6 |
| SEQ. ID. NO. 37713 | 18-CysGlyArgLysSerAlaArgThrHisAlaLysIleProGluGlySerThr-34 |
| SEQ. ID. NO. 37714 | 46-TyrGlyAlaAsnProGlyGluSerTyrPro-55 |
| SEQ. ID. NO. 37715 | 69-GlyGlyValSerGlyAspThrSerAla-77 |
| SEQ. ID. NO. 37716 | 87-LeuAlaArgLysProLys-92 |
| SEQ. ID. NO. 37717 | 99-GlyGlyAsnAspPheLeuArgLysValProGluGluGlnThrArgAlaAsnIle-116 |
| SEQ. ID. NO. 37718 | 121-GluThrValGlnLysGluAsnIle-128 |
| SEQ. ID. NO. 37719 | 148-SerAspHisProLeuTyrGluAspLeuSerGluGluTyrGly-161 |
| SEQ. ID. NO. 37720 | 174-GlyAsnAsnAsnLeu-LysSerAspGlnIleHisAlaAsnGlyLysGlyTyrArgLysPheAlaGluAsnLeuAsnGlnPheLeuArgLysHisGlyPheArg-207 |
| Hydrophilic Regions - Hopp-Woods | |
| SEQ. ID. NO. 37721 | 18-CysGlyArgLysSerAlaArgThrHisAlaLysIleProGlu-31 |
| SEQ. ID. NO. 37722 | 49-AsnProGlyGluSerTyr-54 |
| SEQ. ID. NO. 37723 | 71-ValSerGlyAspThrSerAla-77 |
| SEQ. ID. NO. 37724 | 87-LeuAlaArgLysProLys-92 |
| SEQ. ID. NO. 37725 | 102-AspPheLeuArgLysValProGluGluGlnThrArgAlaAsnIle-116 |
| SEQ. ID. NO. 37726 | 121-GluThrValGlnLysGluAsnIle-128 |
| SEQ. ID. NO. 37727 | 154-GluAspLeuSerGluGluTyrGly-161 |
| SEQ. ID. NO. 37728 | 177-AsnLeuLysSerAspGlnIleHisAlaAsn-186 |
| SEQ. ID. NO. 37729 | 188-LysGlyTyrArgLysPheAlaGlu-195 |
| g997 | |
| AMPHI Regions - AMPHI | |
| SEQ. ID. NO. 37730 | 18-TrpAlaGlyLeuSerAlaAlaVal-25 |
| SEQ. ID. NO. 37731 | 70-TyrArgGlyValLeuArgLeuMetLysThrIleGly-81 |
| SEQ. ID. NO. 37732 | 107-ProLeuProAlaProLeuHisIle-114 |
| SEQ. ID. NO. 37733 | 123-ArgValProSerAlaPheLysAlaLysLeuLeuAlaAspMetSerAspLeuGlnLysSerAlaArgLeuGly-146 |
| SEQ. ID. NO. 37734 | 164-AlaAlaValMetGlnPheTrpGlnProLeuValTrpGly-176 |
| SEQ. ID. NO. 37735 | 189-ValLeuCysAsnValLeuSerAsp-196 |
| SEQ. ID. NO. 37736 | 222-AlaLeuAlaGluLeuGlnArg-228 |
| SEQ. ID. NO. 37737 | 241-ArgLeuAsnThrLeuPro-246 |
| SEQ. ID. NO. 37738 | 275-GluGlyThrProGluHisValGlnThrAla-284 |
| SEQ. ID. NO. 37739 | 300-TyrAlaGluProValArgLeuProAlaProLeuThrGlyIleAlaAspGly-316 |
| Antigenic Index - Jameson-Wolf | |
| SEQ. ID. NO. 37740 | 3-AsnThrProHisProArgProLysIle-11 |
| SEQ. ID. NO. 37741 | 37-GluAlaGlyArgGlnAlaGlyGlyArgAlaArgThrLeuAlaGlyAsnThrAspGlyPheGly-57 |
| SEQ. ID. NO. 37742 | 78-LysThrIleGlySerAspProArgAlaAla-87 |
| SEQ. ID. NO. 37743 | 122-ArgArgValProSerAlaPheLys-129 |
| SEQ. ID. NO. 37744 | 132-LeuLeuAlaAspMetSerAspLeuGlnLysSerAlaArgLeuGlyGlnProAspThrThr-151 |
| SEQ. ID. NO. 37745 | 156-LeuLysGlnArgAsnValProArg-163 |
| SEQ. ID. NO. 37746 | 180-ThrProLeuGluThrAlaSer-186 |
| SEQ. ID. NO. 37747 | 197-GlyValLeuThrLysLysSerGlySerAspTyrLeuLeuProLysGlnAspLeu-214 |
| SEQ. ID. NO. 37748 | 225-GluLeuGlnArgLeuGlyAlaAspIleArgLeuGluThrArgValCysArg-241 |
| SEQ. ID. NO. 37749 | 243-AsnThrLeuProAspGlyLysVal-250 |
| SEQ. ID. NO. 37750 | 273-LeuProGluGlyThrProGluHisVal-281 |
| SEQ. ID. NO. 37751 | 324-ProGlyGlnAlaProAspCysProGlnAsnGluValSer-336 |
| SEQ. ID. NO. 37752 | 341-ValSerAspArgValGlyAlaPheAlaAsnArgTerTerTerTer-355 |
| Hydrophilic Regions - Hopp-Woods | |
| SEQ. ID. NO. 37753 | 5-ProHisProArgProLysIle-11 |
| SEQ. ID. NO. 37754 | 37-GluAlaGlyArgGlnAlaGlyGlyArgAlaArgThrLeuAlaGlyAsn-52 |
| SEQ. ID. NO. 37755 | 80-IleGlySerAspProArgAlaAla-87 |
| SEQ. ID. NO. 37756 | 122-ArgArgValProSer-126 |
| SEQ. ID. NO. 37757 | 132-LeuLeuAlaAspMetSerAspLeuGlnLysSerAlaArgLeuGlyGlnProAspThrThr-151 |
| SEQ. ID. NO. 37758 | 198-ValLeuThrLysLysSerGlySer-205 |
| SEQ. ID. NO. 37759 | 208-LeuLeuProLysGlnAspLeu-214 |
| SEQ. ID. NO. 37760 | 225-GluLeuGlnArgLeuGlyAlaAspIleArgLeuGluThrArgValCysArg-241 |
| SEQ. ID. NO. 37761 | 246-ProAspGlyLysVal-250 |
| SEQ. ID. NO. 37762 | 276-GlyThrProGluHisVal-281 |
| SEQ. ID. NO. 37763 | 326-GlnAlaProAspCysProGlnAsnGluVal-335 |
| SEQ. ID. NO. 37764 | 341-ValSerAspArgValGly-346 |

It will be understood that the invention is described above by way of example only and modifications may be made whilst remaining within the scope and spirit of the invention.

SEQUENCE LISTING (42120 sequences)

SEQ ID NO: 1 - protein, 23 aa, Neisseria
KLLEQLMRFLQFLSEFLFALFRI

SEQ ID NO: 2 - protein, 8 aa, Neisseria
RALKFARR

SEQ ID NO: 3 - protein, 6 aa, Neisseria
NFIRHT

SEQ ID NO: 4 - protein, 6 aa, Neisseria
HAARTF

SEQ ID NO: 5 - protein, 6 aa, Neisseria
QGFYGV

SEQ ID NO: 6 - protein, 16 aa, Neisseria
GFLRFGRFLPTLLQTL

SEQ ID NO: 7 - protein, 16 aa, Neisseria
FTHKSNRALKFARRHH

SEQ ID NO: 8 - protein, 15 aa, Neisseria
HTHRTDNRKRSGSNF

SEQ ID NO: 9 - protein, 5 aa, Neisseria
RHTRH

SEQ ID NO: 10 - protein, 14 aa, Neisseria
AARRHLIDGDGQRN

SEQ ID NO: 11 - protein, 9 aa, Neisseria
  VARIANT 2: Xaa is any amino acid
TXKLRSRQT

SEQ ID NO: 12 - protein, 8 aa, Neisseria
TFQSEQNL

SEQ ID NO: 13 - protein, 14 aa, Neisseria
RLGNQKHRRNLMTQ

SEQ ID NO: 14 - protein, 7 aa, Neisseria
IQHKKAG

SEQ ID NO: 15 - protein, 13 aa, Neisseria
KSNRALKFARRHH

SEQ ID NO: 16 - protein, 12 aa, Neisseria
HTHRTDNRKRSG

SEQ ID NO: 17 - protein, 13 aa, Neisseria
AARRHLIDGDGQR

SEQ ID NO: 18 - protein, 7 aa, Neisseria
  VARIANT 1: Xaa is any amino acid
XKLRSRQ

SEQ ID NO: 19 - protein, 9 aa, Neisseria
GNQKHRRNL

SEQ ID NO: 20 - protein, 7 aa, Neisseria
IQHKKAG

SEQ ID NO: 21 - protein, 5 aa, Neisseria
DSYTF

SEQ ID NO: 22 - protein, 19 aa, Neisseria
  VARIANT 5: Xaa is any amino acid
KSERXSGGNMVPRPSPFLP

SEQ ID NO: 23 - protein, 7 aa, Neisseria
TQLDSYT

SEQ ID NO: 24 - protein, 14 aa, Neisseria
EAAAQKQPKTRAVG

SEQ ID NO: 25 - protein, 6 aa, Neisseria
  VARIANT (1)...(6): Xaa is any amino acid
RSGXKI

SEQ ID NO: 26 - protein, 7 aa, Neisseria
  VARIANT (1)...(7): Xaa is any amino acid
KSERXSG

SEQ ID NO: 27 - protein, 14 aa, Neisseria
EAAAQKQPKTRAVG

SEQ ID NO: 28 - protein, 13 aa, Neisseria
EKPLAGFWKALPH

SEQ ID NO: 29 - protein, 8 aa, Neisseria
MCCVACIV

SEQ ID NO: 30 - protein, 8 aa, Neisseria
WKNPEKPL

SEQ ID NO: 31 - protein, 9 aa, Neisseria
MRARPRSTK

SEQ ID NO: 32 - protein, 6 aa, Neisseria
NPEKPL

SEQ ID NO: 33 - protein, 9 aa, Neisseria
MRARPRSTK

SEQ ID NO: 34 - protein, 5 aa, Neisseria
IQHLR

SEQ ID NO: 35 - protein, 7 aa, Neisseria
HGCQHIF

SEQ ID NO: 36 - protein, 7 aa, Neisseria
MVERHIQ

SEQ ID NO: 37 - protein, 5 aa, Neisseria
LRNGH

SEQ ID NO: 38 - protein, 5 aa, Neisseria
PSQQV

SEQ ID NO: 39 - protein, 17 aa, Neisseria
QMFGGRAYDFRADKAAG

SEQ ID NO: 40 - protein, 7 aa, Neisseria
YFADDKF

SEQ ID NO: 41 - protein, 6 aa, Neisseria
LRGNLR

SEQ ID NO: 42 - protein, 20 aa, Neisseria
FQTDKADLRTGKHHADGAAP

SEQ ID NO: 43 - protein, 9 aa, Neisseria
TAADIRVAA

SEQ ID NO: 44 - protein, 6 aa, Neisseria
QQRQLV

SEQ ID NO: 45 - protein, 13 aa, Neisseria
IACDEDMRNTGLH

SEQ ID NO: 46 - protein, 8 aa, Neisseria
QRVGNRYA

SEQ ID NO: 47 - protein, 7 aa, Neisseria
MVERHIQ

SEQ ID NO: 48 - protein, 11 aa, Neisseria
RAYDFRADKAA

SEQ ID NO: 49 - protein, 7 aa, Neisseria
YFADDKF

SEQ ID NO: 50 - protein, 19 aa, Neisseria
FQTDKADLRTGKHHADGAA

SEQ ID NO: 51 - protein, 9 aa, Neisseria
TAADIRVAA

SEQ ID NO: 52 - protein, 9 aa, Neisseria
IACDEDMRN

SEQ ID NO: 53 - protein, 6 aa, Neisseria
PADNIE

SEQ ID NO: 54 - protein, 11 aa, Neisseria
DYGGYPSALDA

SEQ ID NO: 55 - protein, 9 aa, Neisseria
AAYLENAGD

SEQ ID NO: 56 - protein, 13 aa, Neisseria
AMAENVRNEWLKS

SEQ ID NO: 57 - protein, 25 aa, Neisseria
AAELVKNTGKLPSGCTKLLEQAAAS

SEQ ID NO: 58 - protein, 7 aa, Neisseria
DAWRRVR

SEQ ID NO: 59 - protein, 15 aa, Neisseria
LAAALGSPFDGGTQG

SEQ ID NO: 60 - protein, 10 aa, Neisseria
NVIGKEARKS

SEQ ID NO: 61 - protein, 6 aa, Neisseria
ALLSEM

SEQ ID NO: 62 - protein, 10 aa, Neisseria
NVPAALDYYG

SEQ ID NO: 63 - protein, 19 aa, Neisseria
RRWDELASVISHMPEKLQK

SEQ ID NO: 64 - protein, 10 aa, Neisseria
QEAEKLYKQA

SEQ ID NO: 65 - protein, 11 aa, Neisseria
AGKNSVRRMAE

SEQ ID NO: 66 - protein, 5 aa, Neisseria
RYISP

SEQ ID NO: 67 - protein, 7 aa, Neisseria
QGLMQVM

SEQ ID NO: 68 - protein, 8 aa, Neisseria
RDYVKKVM

SEQ ID NO: 69 - protein, 5 aa, Neisseria
SSTNT

SEQ ID NO: 70 - protein, 40 aa, Neisseria
PAGKTPADNIETADLSASVPTRPAEPERKTLADYGGYPSA

SEQ ID NO: 71 - protein, 9 aa, Neisseria
DAVKQKNDA

SEQ ID NO: 72 - protein, 7 aa, Neisseria
NAGDSAM

SEQ ID NO: 73 - protein, 6 aa, Neisseria
LGARRQ

SEQ ID NO: 74 - protein, 42 aa, Neisseria
EYAKLEPAGRAQEVECYADSSRNDYTRAAELVKNTGKLPSGC

SEQ ID NO: 75 - protein, 14 aa, Neisseria
GLLDGNDAWRRVRG

SEQ ID NO: 76 - protein, 11 aa, Neisseria
LAGRQTTDARN

SEQ ID NO: 77 - protein, 13 aa, Neisseria
SPFDGGTQGSREY

SEQ ID NO: 78 - protein, 11 aa, Neisseria
IGKEARKSPNA

SEQ ID NO: 79 - protein, 13 aa, Neisseria
SEMESGLSLEQRS

SEQ ID NO: 80 - protein, 5 aa, Neisseria
QSQNL

SEQ ID NO: 81 - protein, 16 aa, Neisseria
YYGKVADRRQLTDDQI

SEQ ID NO: 82 - protein, 10 aa, Neisseria
AALRARRWDE

SEQ ID NO: 83 - protein, 10 aa, Neisseria
MPEKLQKSPT

SEQ ID NO: 84 - protein, 17 aa, Neisseria
RSRAATGNTQEAEKLYK

SEQ ID NO: 85 - protein, 6 aa, Neisseria
AATGRN

SEQ ID NO: 86 - protein, 34 aa, Neisseria
AGEELGRKIDTRNNVPDAGKNSVRRMAEDGAVKR

SEQ ID NO: 87 - protein, 17 aa, Neisseria
QNSQSAGDAKMRRQAQA

SEQ ID NO: 88 - protein, 12 aa, Neisseria
FATRGFDEDKLL

SEQ ID NO: 89 - protein, 11 aa, Neisseria
SAERTDRKLNY

SEQ ID NO: 90 - protein, 8 aa, Neisseria
SPFKDTVI

SEQ ID NO: 91 - protein, 9 aa, Neisseria
AQNVNVDPA

SEQ ID NO: 92 - protein, 7 aa, Neisseria
IRQESRF

SEQ ID NO: 93 - protein, 7 aa, Neisseria
AQSRVGA

SEQ ID NO: 94 - protein, 7 aa, Neisseria
TAREIAG

SEQ ID NO: 95 - protein, 10 aa, Neisseria
YTADGNIRMG

SEQ ID NO: 96 - protein, 11 aa, Neisseria
DTKRRLQNNEV

SEQ ID NO: 97 - protein, 19 aa, Neisseria
GYNAGPGRARRWQADTPLE

SEQ ID NO: 98 - protein, 8 aa, Neisseria
SETRDYVK

SEQ ID NO: 99 - protein, 5 aa, Neisseria
LKQRM

SEQ ID NO: 100 - protein, 13 aa, Neisseria
GKTPADNIETADL

SEQ ID NO: 101 - protein, 14 aa, Neisseria
VPTRPAEPERKTLA

SEQ ID NO: 102 - protein, 9 aa, Neisseria
DAVKQKNDA

SEQ ID NO: 103 - protein, 7 aa, Neisseria
NAGDSAM

SEQ ID NO: 104 - protein, 6 aa, Neisseria
LGARRQ

SEQ ID NO: 105 - protein, 42 aa, Neisseria; identical to SEQ ID NO: 74

SEQ ID NO: 106 - protein, 11 aa, Neisseria
DGNDAWRRVRG

SEQ ID NO: 107 - protein, 8 aa, Neisseria
RQTTDARN

SEQ ID NO: 108 - protein, 10 aa, Neisseria
FDGGTQGSRE

SEQ ID NO: 109 - protein, 10 aa, Neisseria
IGKEARKSPN

SEQ ID NO: 110 - protein, 5 aa, Neisseria
SEMES

SEQ ID NO: 111 - protein, 7 aa, Neisseria
LSLEQRS

SEQ ID NO: 112 - protein, 12 aa, Neisseria
VADRRQLTDDQI

SEQ ID NO: 113 - protein, 10 aa, Neisseria
AALRARRWDE

SEQ ID NO: 114 - protein, 7 aa, Neisseria
MPEKLQK

SEQ ID NO: 115 - protein, 6 aa, Neisseria
RSRAAT

SEQ ID NO: 116 - protein, 10 aa, Neisseria
NTQEAEKLYK

SEQ ID NO: 117 - protein, 34 aa, Neisseria; identical to SEQ ID NO: 86

SEQ ID NO: 118 - protein, 14 aa, Neisseria
QSAGDAKMRRQAQA

SEQ ID NO: 119 - protein, 10 aa, Neisseria
TRGFDEDKLL

SEQ ID NO: 120 - protein, 9 aa, Neisseria
SAERTDRKL

SEQ ID NO: 121 - protein, 7 aa, Neisseria
IRQESRF

SEQ ID NO: 122 - protein, 7 aa, Neisseria
TAREIAG

SEQ ID NO: 123 - protein, 8 aa, Neisseria
DTKRRLQN

SEQ ID NO: 124 - protein, 10 aa, Neisseria
GPGRARRWQA

SEQ ID NO: 125 - protein, 8 aa, Neisseria
SETRDYVK

SEQ ID NO: 126 - protein, 5 aa, Neisseria
LKQRM

SEQ ID NO: 127 - protein, 33 aa, Neisseria
KEYSAWQAFFSQTWVKVFTQVSFIAVFLHAWVG

SEQ ID NO: 128 - protein, 8 aa, Neisseria
DLWMDYIK

SEQ ID NO: 129 - protein, 7 aa, Neisseria
MVERKLT

SEQ ID NO: 130 - protein, 6 aa, Neisseria
LPKEYS

SEQ ID NO: 131 - protein, 7 aa, Neisseria
MVERKLT

SEQ ID NO: 132 - protein, 14 aa, Neisseria
AACTAVAALLGGCA

SEQ ID NO: 133 - protein, 16 aa, Neisseria
MQDAPSSAVYNNPYGA

SEQ ID NO: 134 - protein, 10 aa, Neisseria
DFRAWNGMTD

SEQ ID NO: 135 - protein, 7 aa, Neisseria
IGQIVKV

SEQ ID NO: 136 - protein, 12 aa, Neisseria
DFRAWNGMTDNM

SEQ ID NO: 137 - protein, 8 aa, Neisseria
SIGQIVKV

SEQ ID NO: 138 - protein, 10 aa, Neisseria
AVQTPVKPAA

SEQ ID NO: 139 - protein, 7 aa, Neisseria
VQSAPQP

SEQ ID NO: 140 - protein, 5 aa, Neisseria
SGTRS

SEQ ID NO: 141 - protein, 6 aa, Neisseria
KVVADF

SEQ ID NO: 142 - protein, 7 aa, Neisseria
GLRGYGN

SEQ ID NO: 143 - protein, 5 aa, Neisseria
ATQQP

SEQ ID NO: 144 - protein, 10 aa, Neisseria
NSGMQDAPSS

SEQ ID NO: 145 - protein, 13 aa, Neisseria
TPYSPAPAGDAPY

SEQ ID NO: 146 - protein, 5 aa, Neisseria
VRGDT

SEQ ID NO: 147 - protein, 15 aa, Neisseria
NISKRYHISQDDFRA

SEQ ID NO: 148 - protein, 8 aa, Neisseria
NGMTDNTL

SEQ ID NO: 149 - protein, 7 aa, Neisseria
VKVKPAG

SEQ ID NO: 150 - protein, 9 aa, Neisseria
AAVKSRPAV

SEQ ID NO: 151 - protein, 5 aa, Neisseria
QPPVQ

SEQ ID NO: 152 - protein, 5 aa, Neisseria
VRGDT

SEQ ID NO: 153 - protein, 15 aa, Neisseria
NISKRYHISQDDFRA

SEQ ID NO: 154 - protein, 8 aa, Neisseria
NGMTDNML

SEQ ID NO: 155 - protein, 7 aa, Neisseria
VKVKPAG

SEQ ID NO: 156 - protein, 15 aa, Neisseria
AAPKTAAVESRPAVP

SEQ ID NO: 157 - protein, 16 aa, Neisseria
PVKPAAQPPVQSAPQP

SEQ ID NO: 158 - protein, 9 aa, Neisseria
PAAENKAVP

SEQ ID NO: 159 - protein, 17 aa, Neisseria
PAPQSPAASPSGTRSVG

SEQ ID NO: 160 - protein, 19 aa, Neisseria
RPTQGKVVADFGGNNKGVD

SEQ ID NO: 161 - protein, 5 aa, Neisseria
ADGKV

SEQ ID NO: 162 - protein, 7 aa, Neisseria
SGLRGYG

SEQ ID NO: 163 - protein, 5 aa, Neisseria
YGHNQ

SEQ ID NO: 164 - protein, 13 aa, Neisseria
LVGEGQQVKRGQQ

SEQ ID NO: 165 - protein, 10 aa, Neisseria
GNTDASRTQL

SEQ ID NO: 166 - protein, 14 aa, Neisseria
FEVRQNGKPVNPNS

SEQ ID NO: 167 - protein, 7 aa, Neisseria
GMQDAPS

SEQ ID NO: 168 - protein, 5 aa, Neisseria
VRGDT

SEQ ID NO: 169 - protein, 9 aa, Neisseria
YHISQDDFR

SEQ ID NO: 170 - protein, 5 aa, Neisseria
VKVKP

SEQ ID NO: 171 - protein, 9 aa, Neisseria
AAVKSRPAV

SEQ ID NO: 172 - protein, 5 aa, Neisseria
VRGDT

SEQ ID NO: 173 - protein, 9 aa, Neisseria
YHISQDDFR

SEQ ID NO: 174 - protein, 5 aa, Neisseria
VKVKP

SEQ ID NO: 175 - protein, 9 aa, Neisseria
AAVESRPAV

SEQ ID NO: 176 - protein, 5 aa, Neisseria
VKPAA

SEQ ID NO: 177 - protein, 9 aa, Neisseria
PAAENKAVP

SEQ ID NO: 178 - protein, 5 aa, Neisseria
SGTRS

SEQ ID NO: 179 - protein, 8 aa, Neisseria
GGNNKGVD

SEQ ID NO: 180 - protein, 5 aa, Neisseria
ADGKV

SEQ ID NO: 181 - protein, 9 aa, Neisseria
EGQQVKRGQ

SEQ ID NO: 182 - protein, 6 aa, Neisseria
TDASRT

SEQ ID NO: 183 - protein, 9 aa, Neisseria
VRQNGKPVN

SEQ ID NO: 184 - protein, 26 aa, Neisseria
YSAIRLFTQAVIEFPQTAEHCRRTRD

SEQ ID NO: 185 - protein, 5 aa, Neisseria
RRPVQ

SEQ ID NO: 186 - protein, 6 aa, Neisseria
RLKHGV

SEQ ID NO: 187 - protein, 60 aa, Neisseria
PQTAEHCRRTRDQHQERRNRQGFRRPVQHVGRRNQQQRHSQTCGQSGRNHAQKQQCATRQ

SEQ ID NO: 188 - protein, 24 aa, Neisseria
AEHCRRTRDQHQERRNRQGFRRPV

SEQ ID NO: 189 - protein, 12 aa, Neisseria
VGRRNQQQRHSQ

SEQ ID NO: 190 - protein, 16 aa, Neisseria
QSGRNHAQKQQCATRQ

SEQ ID NO: 191 - protein, 7 aa, Neisseria
LRRPLRQ

SEQ ID NO: 192 - protein, 8 aa, Neisseria
PFADNVYP

SEQ ID NO: 193 - protein, 9 aa, Neisseria
TAAVHQFEQ

SEQ ID NO: 194 - protein, 14 aa, Neisseria
VHGQIQHPVQPFLR

SEQ ID NO: 195 - protein, 9 aa, Neisseria
LGLLRRFDV

SEQ ID NO: 196 - protein, 5 aa, Neisseria
MRRNV

SEQ ID NO: 197 - protein, 7 aa, Neisseria
VLRRPLR

SEQ ID NO: 198 - protein, 10 aa, Neisseria
RAVPAGKQGF

SEQ ID NO: 199 - protein, 7 aa, Neisseria
CRLTQRQ

SEQ ID NO: 200 - protein, 5 aa, Neisseria
ADQRH

SEQ ID NO: 201 - protein, 5 aa, Neisseria
HRQRV

SEQ ID NO: 202 - protein, 9 aa, Neisseria
RRFDVGGRV

SEQ ID NO: 203 - protein, 15 aa, Neisseria
LPPRRKLASQRPFPQ

SEQ ID NO: 204 - protein, 5 aa, Neisseria
MRRNV

SEQ ID NO: 205 - protein, 7 aa, Neisseria
VLRRPLR

SEQ ID NO: 206 - protein, 7 aa, Neisseria
RAVPAGK

SEQ ID NO: 207 - protein, 5 aa, Neisseria
CRLTQ

SEQ ID NO: 208 - protein, 5 aa, Neisseria
ADQRH

SEQ ID NO: 209 - protein, 5 aa, Neisseria
HRQRV

SEQ ID NO: 210 - protein, 7 aa, Neisseria
RRFDVGG

SEQ ID NO: 211 - protein, 8 aa, Neisseria
PPRRKLAS

SEQ ID NO: 212 - protein, 15 aa, Neisseria
QYGGLAGFPKRCESE

SEQ ID NO: 213 - protein, 9 aa, Neisseria
GQAFEALNC

SEQ ID NO: 214 - protein, 23 aa, Neisseria
VGALPKYLASNVVRDMHGLLSTV

SEQ ID NO: 215 - protein, 14 aa, Neisseria
QTGKVLDKIPGAME

SEQ ID NO: 216 - protein, 6 aa, Neisseria
IKTLAE

SEQ ID NO: 217 - protein, 6 aa, Neisseria
SLFENF

SEQ ID NO: 218 - protein, 21 aa, Neisseria
GPVDGHNVENLVDVLKDLRSR

SEQ ID NO: 219 - protein, 5 aa, Neisseria
AENDP

SEQ ID NO: 220 - protein, 14 aa, Neisseria
KYHAVANLPKESAA

SEQ ID NO: 221 - protein, 7 aa, Neisseria
YTQVFGK

SEQ ID NO: 222 - protein, 8 aa, Neisseria
FPDRYFDV

SEQ ID NO: 223 - protein, 8 aa, Neisseria
KPVVAIYS

SEQ ID NO: 224 - protein, 9 aa, Neisseria
FLQRAYDQL

SEQ ID NO: 225 - protein, 5 aa, Neisseria
CVPNM

SEQ ID NO: 226 - protein, 11 aa, Neisseria
APAAVRYPRGT

SEQ ID NO: 227 - protein, 9 aa, Neisseria
VSDGMETVE

SEQ ID NO: 228 - protein, 5 aa, Neisseria
IIRRE

SEQ ID NO: 229 - protein, 6 aa, Neisseria
FGSMVA

SEQ ID NO: 230 - protein, 10 aa, Neisseria
MRFVKPIDEE

SEQ ID NO: 231 - protein, 6 aa, Neisseria
RSHDRI

SEQ ID NO: 232 - protein, 6 aa, Neisseria
AVLEVL

SEQ ID NO: 233 - protein, 7 aa, Neisseria
DTVTGHG

SEQ ID NO: 234 - protein, 5 aa, Neisseria
PKKLL

SEQ ID NO: 235 - protein, 13 aa, Neisseria
AGFPKRCESEYDA

SEQ ID NO: 236 - protein, 6 aa, Neisseria
HSSTSI

SEQ ID NO: 237 - protein, 13 aa, Neisseria
AADKLLGSDRRSV

SEQ ID NO: 238 - protein, 6 aa, Neisseria
GDGAMT

SEQ ID NO: 239 - protein, 7 aa, Neisseria
CAGDMDV

SEQ ID NO: 240 - protein, 7 aa, Neisseria
NDNEMSI

SEQ ID NO: 241 - protein, 8 aa, Neisseria
NVVRDMHG

SEQ ID NO: 242 - protein, 14 aa, Neisseria
VKAQTGKVLDKIPG

SEQ ID NO: 243 - protein, 21 aa, Neisseria
FAQKVEHKIKTLAEEAEHAKQ

SEQ ID NO: 244 - protein, 9 aa, Neisseria
YTGPVDGHN

SEQ ID NO: 245 - protein, 12 aa, Neisseria
VLKDLRSRKGPQ

SEQ ID NO: 246 - protein, 16 aa, Neisseria
TKKGNGYKLAENDPVK

SEQ ID NO: 247 - protein, 7 aa, Neisseria
LPKESAA

SEQ ID NO: 248 - protein, 15 aa, Neisseria
MPSEKEPKPAAKPTY

SEQ ID NO: 249 - protein, 8 aa, Neisseria
RAAADSRL

SEQ ID NO: 250 - protein, 20 aa, Neisseria
AMREGSGLVEFEQRFPDRYF

SEQ ID NO: 251 - protein, 8 aa, Neisseria
VGADGPTH

SEQ ID NO: 252 - protein, 10 aa, Neisseria
AAPSDENECR

SEQ ID NO: 253 - protein, 34 aa, Neisseria
RYPRGTGTGAPVSDGMETVEIGKGIIRREGEKTA

SEQ ID NO: 254 - protein, 8 aa, Neisseria
KPIDEELI

SEQ ID NO: 255 - protein, 22 aa, Neisseria
LARSHDRIVTLEENAEQGGAGG

SEQ ID NO: 256 - protein, 16 aa, Neisseria
VTGHGDPKKLLDDLGL

SEQ ID NO: 257 - protein, 8 aa, Neisseria
EAVERRVR

SEQ ID NO: 258 - protein, 8 aa, Neisseria
LSDRDAAN

SEQ ID NO: 259 - protein, 10 aa, Neisseria
FPKRCESEYD

SEQ ID NO: 260 - protein, 13 aa, Neisseria
AADKLLGSDRRSV

SEQ ID NO: 261 - protein, 5 aa, Neisseria
GDMDV

SEQ ID NO: 262 - protein, 7 aa, Neisseria
NDNEMSI

SEQ ID NO: 263 - protein, 6 aa, Neisseria
VVRDMH

SEQ ID NO: 264 - protein, 8 aa, Neisseria
KVLDKIPG

SEQ ID NO: 265 - protein, 21 aa, Neisseria
FAQKVEHKIKTLAEEAEHAKQ

SEQ ID NO: 266 - protein, 11 aa, Neisseria
VLKDLRSRKGP

SEQ ID NO: 267 - protein, 6 aa, Neisseria
TKKGNG

SEQ ID NO: 268 - protein, 9 aa, Neisseria
KLAENDPVK

SEQ ID NO: 269 - protein, 7 aa, Neisseria
LPKESAA

SEQ ID NO: 270 - protein, 11 aa, Neisseria
MPSEKEPKPAA

SEQ ID NO: 271 - protein, 8 aa, Neisseria
RAAADSRL

SEQ ID NO: 272 - protein, 7 aa, Neisseria
AMREGSG

SEQ ID NO: 273 - protein, 12 aa, Neisseria
VEFEQRFPDRYF

SEQ ID NO: 274 - protein, 7 aa, Neisseria
PSDENEC

SEQ ID NO: 275 - protein, 24 aa, Neisseria
PVSDGMETVEIGKGIIRREGEKTA

SEQ ID NO: 276 - protein, 8 aa, Neisseria
KPIDEELI

SEQ ID NO: 277 - protein, 19 aa, Neisseria
LARSHDRIVTLEENAEQGG

SEQ ID NO: 278 - protein, 11 aa, Neisseria
TGHGDPKKLLD

SEQ ID NO: 279 - protein, 8 aa, Neisseria
EAVERRVR

SEQ ID NO: 280 - protein, 8 aa, Neisseria
LSDRDAAN

SEQ ID NO: 281 - protein, 5 aa, Neisseria
LDHAA

SEQ ID NO: 282 - protein, 14 aa, Neisseria
NLEQMRAIMEAADQ

SEQ ID NO: 283 - protein, 9 aa, Neisseria
AVEEFPHIP

SEQ ID NO: 284 - protein, 6 aa, Neisseria
TVVNFS

SEQ ID NO: 285 - protein, 10 aa, Neisseria
IGVLGNLETG

SEQ ID NO: 286 - protein, 7 aa, Neisseria
GAVGKLS

SEQ ID NO: 287 - protein, 9 aa, Neisseria
YKFTRPPTG

SEQ ID NO: 288 - protein, 14 aa, Neisseria
VLRIDRIKEIHQAL

SEQ ID NO: 289 - protein, 35 aa, Neisseria
SVPQEWLKVINEYGGNIGETYGVPVEEIVEGIKHG

SEQ ID NO: 290 - protein, 7 aa, Neisseria
RRYLAEN

SEQ ID NO: 291 - protein, 9 aa, Neisseria
LSKTIEAMK

SEQ ID NO: 292 - protein, 6 aa, Neisseria
LPKETQ

SEQ ID NO: 293 - protein, 8 aa, Neisseria
HAAENSYG

SEQ ID NO: 294 - protein, 14 aa, Neisseria
EQMRAIMEAADQVD

SEQ ID NO: 295 - protein, 8 aa, Neisseria
SAGARKYA

SEQ ID NO: 296 - protein, 15 aa, Neisseria
HQDHGASPDVCQRSI

SEQ ID NO: 297 - protein, 17 aa, Neisseria
MDGSLMEDGKTPSSYEY

SEQ ID NO: 298 - protein, 5 aa, Neisseria
VEGEI

SEQ ID NO: 299 - protein, 13 aa, Neisseria
NLETGEAGEEDGV

SEQ ID NO: 300 - protein, 5 aa, Neisseria
LSHDQ

SEQ ID NO: 301 - protein, 5 aa, Neisseria
KDTGV

SEQ ID NO: 302 - protein, 5 aa, Neisseria
TSHGA

SEQ ID NO: 303 - protein, 20 aa, Neisseria
KFTRPPTGDVLRIDRIKEIH

SEQ ID NO: 304 - protein, 6 aa, Neisseria
GSSSVP

SEQ ID NO: 305 - protein, 9 aa, Neisseria
NEYGGNIGE

SEQ ID NO: 306 - protein, 27 aa, Neisseria
EIVEGIKHGVRKVNIDTDLRLASTGAV

SEQ ID NO: 307 - protein, 16 aa, Neisseria
YLAENPSDFDPRKYLS

SEQ ID NO: 308 - protein, 6 aa, Neisseria
TIEAMK

SEQ ID NO: 309 - protein, 25 aa, Neisseria
CEGQAGKIKPVSLEKMASRYAKGEL

SEQ ID NO: 310 - protein, 14 aa, Neisseria
EQMRAIMEAADQVD

SEQ ID NO: 311 - protein, 7 aa, Neisseria
AGARKYA

SEQ ID NO: 312 - protein, 10 aa, Neisseria
DHGASPDVCQ

SEQ ID NO: 313 - protein, 10 aa, Neisseria
SLMEDGKTPS

SEQ ID NO: 314 - protein, 5 aa, Neisseria
VEGEI

SEQ ID NO: 315 - protein, 11 aa, Neisseria
ETGEAGEEDGV

SEQ ID NO: 316 - protein, 5 aa, Neisseria
KDTGV

SEQ ID NO: 317 - protein, 12 aa, Neisseria
DVLRIDRIKEIH

SEQ ID NO: 318 - protein, 21 aa, Neisseria
EIVEGIKHGVRKVNIDTDLRL

SEQ ID NO: 319 - protein, 11 aa, Neisseria
NPSDFDPRKYL

SEQ ID NO: 320 - protein, 6 aa, Neisseria
TIEAMK

SEQ ID NO: 321 - protein, 23 aa, Neisseria
GQAGKIKPVSLEKMASRYAKGEL

SEQ ID NO: 322 - protein, 8 aa, Neisseria
AVYSACAA

SEQ ID NO: 323 - protein, 7 aa, Neisseria
GRCVNQY

SEQ ID NO: 324 - protein, 10 aa, Neisseria
SSGRFCQTIK

SEQ ID NO: 325 - protein, 7 aa, Neisseria
AASSSQS

SEQ ID NO: 326 - protein, 5 aa, Neisseria
ANRRV

SEQ ID NO: 327 - protein, 26 aa, Neisseria
PARTSSSRRCVSSGRCVNQYSSRADA

SEQ ID NO: 328 - protein, 8 aa, Neisseria
PWRRHSGA

SEQ ID NO: 329 - protein, 9 aa, Neisseria
CSSDSSGRF

SEQ ID NO: 330 - protein, 21 aa, Neisseria
PSFSARKTCSDGETSADSNWR

SEQ ID NO: 331 - protein, 25 aa, Neisseria
HADGLQTASSAASSSQSAQTARRMF

SEQ ID NO: 332 - protein, 23 aa, Neisseria
SGRFCCGRRANRRVRHGRQDNRP

SEQ ID NO: 333 - protein, 10 aa, Neisseria
PMRESRRQSA

SEQ ID NO: 334 - protein, 7 aa, Neisseria
LPARTRC

SEQ ID NO: 335 - protein, 10 aa, Neisseria
CRLKRRIPPA

SEQ ID NO: 336 - protein, 29 aa, Neisseria
PPARPDNRSNGGSSAYRTMHKTLRPYERP

SEQ ID NO: 337 - protein, 11 aa, Neisseria
RTSSSRRCVSS

SEQ ID NO: 338 - protein, 6 aa, Neisseria
YSSRAD

SEQ ID NO: 339 - protein, 5 aa, Neisseria
RRHSG

SEQ ID NO: 340 - protein, 8 aa, Neisseria
CSSDSSGR

SEQ ID NO: 341 - protein, 14 aa, Neisseria
FSARKTCSDGETSA

SEQ ID NO: 342 - protein, 6 aa, Neisseria
ASSSQS

SEQ ID NO: 343 - protein, 7 aa, Neisseria
QTARRMF

SEQ ID NO: 344 - protein, 19 aa, Neisseria
CCGRRANRRVRHGRQDNRP

SEQ ID NO: 345 - protein, 7 aa, Neisseria
RESRRQS

SEQ ID NO: 346 - protein, 7 aa, Neisseria
LPARTRC

SEQ ID NO: 347 - protein, 9 aa, Neisseria
CRLKRRIPP

SEQ ID NO: 348 - protein, 10 aa, Neisseria
ARPDNRSNGG

SEQ ID NO: 349 - protein, 12 aa, Neisseria
TMHKTLRPYERP

SEQ ID NO: 350 - protein, 5 aa, Neisseria
EAKDH

SEQ ID NO: 351 - protein, 4 aa, Neisseria
ESIK

SEQ ID NO: 352 - protein, 15 aa, Neisseria
EKGTGELSAVQEVEK

SEQ ID NO: 353 - protein, 7 aa, Neisseria
APIASLN

SEQ ID NO: 354 - protein, 18 aa, Neisseria
EFGQFLEPVRAYRRQYGV

SEQ ID NO: 355 - protein, 7 aa, Neisseria
TDFRQDF

SEQ ID NO: 356 - protein, 11 aa, Neisseria
EFTTKAGRRSP

SEQ ID NO: 357 - protein, 7 aa, Neisseria
GLFNDGL

SEQ ID NO: 358 - protein, 6 aa, Neisseria
IESGIR

SEQ ID NO: 359 - protein, 6 aa, Neisseria
LAEKGV

SEQ ID NO: 360 - protein, 13 aa, Neisseria
YNRKEAKDHGEGG

SEQ ID NO: 361 - protein, 31 aa, Neisseria
VISAGTSVRESIKLIEAEGATLDRMEKGTGE

SEQ ID NO: 362 - protein, 9 aa, Neisseria
QEVEKQYGL

SEQ ID NO: 363 - protein, 8 aa, Neisseria
QNNPEFGQ

SEQ ID NO: 364 - protein, 11 aa, Neisseria
VRAYRRQYGVE

SEQ ID NO: 365 - protein, 7 aa, Neisseria
TDFRQDF

SEQ ID NO: 366 - protein, 10 aa, Neisseria
EFTTKAGRRS

SEQ ID NO: 367 - protein, 6 aa, Neisseria
LAEKGV

SEQ ID NO: 368 - protein, 11 aa, Neisseria
YNRKEAKDHGE

SEQ ID NO: 369 - protein, 16 aa, Neisseria
TSVRESIKLIEAEGAT

SEQ ID NO: 370 - protein, 10 aa, Neisseria
LDRMEKGTGE

SEQ ID NO: 371 - protein, 7 aa, Neisseria
QEVEKQY

SEQ ID NO: 372 - protein, 8 aa, Neisseria
RAYRRQYG

SEQ ID NO: 373 - protein, 12 aa, Neisseria
VAHFREAVPYIR

SEQ ID NO: 374 - protein, 5 aa, Neisseria
AGIDD

SEQ ID NO: 375 - protein, 6 aa, Neisseria
DTLNKL

SEQ ID NO: 376 - protein, 12 aa, Neisseria
PHYCRGLRVTDE

SEQ ID NO: 377 - protein, 9 aa, Neisseria
LEQAQQFAG

SEQ ID NO: 378 - protein, 9 aa, Neisseria
SVSGFARAP

SEQ ID NO: 379 - protein, 8 aa, Neisseria
RPIGVIDG

SEQ ID NO: 380 - protein, 6 aa, Neisseria
YAGVIR

SEQ ID NO: 381 - protein, 5 aa, Neisseria
LQTAA

SEQ ID NO: 382 - protein, 14 aa, Neisseria
LSDGISRPDGTLAE

SEQ ID NO: 383 - protein, 12 aa, Neisseria
SAQEAQSLAEHA

SEQ ID NO: 384 - protein, 8 aa, Neisseria
SAVAALEG

SEQ ID NO: 385 - protein, 5 aa, Neisseria
IGTSI

SEQ ID NO: 386 - protein, 20 aa, Neisseria
IRQAHSGDIPHIAALIRPLE

SEQ ID NO: 387 - protein, 11 aa, Neisseria
YLENHISEFSI

SEQ ID NO: 388 - protein, 13 aa, Neisseria
YGCAALKTFAEAD

SEQ ID NO: 389 - protein, 6 aa, Neisseria
RLLAHI

SEQ ID NO: 390 - protein, 5 aa, Neisseria
SRLFA

SEQ ID NO: 391 - protein, 8 aa, Neisseria
RQMRGKTL

SEQ ID NO: 392 - protein, 13 aa, Neisseria
GIDDRLLEGDTLN

SEQ ID NO: 393 - protein, 32 aa, Neisseria
HFLDRHAAAQGRTPHYCRGLRVTDETSLEQAQ

SEQ ID NO: 394 - protein, 7 aa, Neisseria
TVRSRFE

SEQ ID NO: 395 - protein, 5 aa, Neisseria
RAPSV

SEQ ID NO: 396 - protein, 7 aa, Neisseria
DGTDMEY

SEQ ID NO: 397 - protein, 8 aa, Neisseria
IRKTDTAA

SEQ ID NO: 398 - protein, 10 aa, Neisseria
LGHSYSGKTF

SEQ ID NO: 399 - protein, 12 aa, Neisseria
SDGISRPDGTLA

SEQ ID NO: 400 - protein, 21 aa, Neisseria
LSAQEAQSLAEHAGGETRRLI

SEQ ID NO: 401 - protein, 5 aa, Neisseria
LEGGV

SEQ ID NO: 402 - protein, 8 aa, Neisseria
GAADGSLL

SEQ ID NO: 403 - protein, 16 aa, Neisseria
FTRNGIGTSIAKEAFV

SEQ ID NO: 404 - protein, 9 aa, Neisseria
IRQAHSGDI

SEQ ID NO: 405 - protein, 7 aa, Neisseria
RPLEEQG

SEQ ID NO: 406 - protein, 9 aa, Neisseria
LLHRSREYL

SEQ ID NO: 407 - protein, 8 aa, Neisseria
LEHDGNLY

SEQ ID NO: 408 - protein, 9 aa, Neisseria
TFAEADCGE

SEQ ID NO: 409 - protein, 12 aa, Neisseria
PQAQDGGYGERL

SEQ ID NO: 410 - protein, 6 aa, Neisseria
IDKARG

SEQ ID NO: 411 - protein, 5 aa, Neisseria
TNTGE

SEQ ID NO: 412 - protein, 29 aa, Neisseria
RGFQTASEDELPETRRKDYRSNGRNSHIL

SEQ ID NO: 413 - protein, 7 aa, Neisseria
RQMRGKT

SEQ ID NO: 414 - protein, 13 aa, Neisseria
GIDDRLLEGDTLN

SEQ ID NO: 415 - protein, 13 aa, Neisseria
HFLDRHAAAQGRT

SEQ ID NO: 416 - protein, 11 aa, Neisseria
LRVTDETSLEQ

SEQ ID NO: 417 - protein, 6 aa, Neisseria
VRSRFE

SEQ ID NO: 418 - protein, 7 aa, Neisseria
DGTDMEY

SEQ ID NO: 419 - protein, 8 aa, Neisseria
IRKTDTAA

SEQ ID NO: 420 - protein, 9 aa, Neisseria
GISRPDGTL

SEQ ID NO: 421 - protein, 11 aa, Neisseria
LSAQEAQSLAE

SEQ ID NO: 422 - protein, 9 aa, Neisseria
AGGETRRLI

SEQ ID NO: 423 - protein, 6 aa, Neisseria
QAHSGD

SEQ ID NO: 424 - protein, 7 aa, Neisseria
RPLEEQG

SEQ ID NO: 425 - protein, 7 aa, Neisseria
HRSREYL

SEQ ID NO: 426 - protein, 9 aa, Neisseria
TFAEADCGE

SEQ ID NO: 427 - protein, 9 aa, Neisseria
QAQDGGYGE

SEQ ID NO: 428 - protein, 6 aa, Neisseria
IDKARG

SEQ ID NO: 429 - protein, 25 aa, Neisseria
RGFQTASEDELPETRRKDYRSNGRN

SEQ ID NO: 430 - protein, 14 aa, Neisseria
DPYRHFENLDSAET

SEQ ID NO: 431 - protein, 5 aa, Neisseria
DGILA

SEQ ID NO: 432 - protein, 10 aa, Neisseria
KGVYRVCTAA

SEQ ID NO: 433 - protein, 8 aa, Neisseria
VADFDELL

SEQ ID NO: 434 - protein, 10 aa, Neisseria
GVSHLVEQPN

SEQ ID NO: 435 - protein, 8 aa, Neisseria
VNAWRYLD

SEQ ID NO: 436 - protein, 7 aa, Neisseria
IDLIEAS

SEQ ID NO: 437 - protein, 13 aa, Neisseria
LNLPNDCDVVGYL

SEQ ID NO: 438 - protein, 6 aa, Neisseria
WNRANQ

SEQ ID NO: 439 - protein, 8 aa, Neisseria
QALESVET

SEQ ID NO: 440 - protein, 10 aa, Neisseria
ASLLENVQGR

SEQ ID NO: 441 - protein, 6 aa, Neisseria
DFTTPL

SEQ ID NO: 442 - protein, 5 aa, Neisseria
QPQQF

SEQ ID NO: 443 - protein, 16 aa, Neisseria
GFGIPELPHYLGSIGK

SEQ ID NO: 444 - protein, 24 aa, Neisseria
AAQGISKHKSVDDLLAVVRDLSER

SEQ ID NO: 445 - protein, 5 aa, Neisseria
SSPEH

SEQ ID NO: 446 - protein, 6 aa, Neisseria
VREPQS

SEQ ID NO: 447 - protein, 7 aa, Neisseria
LTDMIRY

SEQ ID NO: 448 - protein, 12 aa, Neisseria
WTDEYGNPQKYE

SEQ ID NO: 449 - protein, 15 aa, Neisseria
LSPYHNLSDGIDYPP

SEQ ID NO: 450 - protein, 5 aa, Neisseria
AHALK

SEQ ID NO: 451 - protein, 5 aa, Neisseria
YAKLR

SEQ ID NO: 452 - protein, 5 aa, Neisseria
GHTGN

SEQ ID NO: 453 - protein, 5 aa, Neisseria
TQRES

SEQ ID NO: 454 - protein, 20 aa, Neisseria
MKSYPDPYRHFENLDSAETQ

SEQ ID NO: 455 - protein, 21 aa, Neisseria
ANAETRARFLENDKARALSDG

SEQ ID NO: 456 - protein, 9 aa, Neisseria
LQDTRQIPF

SEQ ID NO: 457 - protein, 6 aa, Neisseria
QEHRAR

SEQ ID NO: 458 - protein, 9 aa, Neisseria
QDAEYPKGV

SEQ ID NO: 459 - protein, 8 aa, Neisseria
YRSGYPEW

SEQ ID NO: 460 - protein, 11 aa, Neisseria
DFDELLGDDVY

SEQ ID NO: 461 - protein, 5 aa, Neisseria
EQPNR

SEQ ID NO: 462 - protein, 9 aa, Neisseria
SKLGSDTAY

SEQ ID NO: 463 - protein, 10 aa, Neisseria
VDLEAGELVE

SEQ ID NO: 464 - protein, 14 aa, Neisseria
AGKNHVSWRDENSV

SEQ ID NO: 465 - protein, 30 aa, Neisseria
PAWNERQLTQSGYPREVWLVERGKSFEESL

SEQ ID NO: 466 - protein, 6 aa, Neisseria
IGEDGM

SEQ ID NO: 467 - protein, 20 aa, Neisseria
RYLDPQGSPIDLIEASDGFY

SEQ ID NO: 468 - protein, 18 aa, Neisseria
VSAEGEAKPLNLPNDCDV

SEQ ID NO: 469 - protein, 15 aa, Neisseria
TLRKDWNRANQSYPS

SEQ ID NO: 470 - protein, 8 aa, Neisseria
KLNRGELG

SEQ ID NO: 471 - protein, 6 aa, Neisseria
PDETQA

SEQ ID NO: 472 - protein, 7 aa, Neisseria
ESVETTK

SEQ ID NO: 473 - protein, 7 aa, Neisseria
VQGRLKA

SEQ ID NO: 474 - protein, 18 aa, Neisseria
RFADGKWQEVELPRLPSG

SEQ ID NO: 475 - protein, 9 aa, Neisseria
EMTDQPWGG

SEQ ID NO: 476 - protein, 15 aa, Neisseria
VMRRQPQQFDSDGIN

SEQ ID NO: 477 - protein, 8 aa, Neisseria
TSADGERI

SEQ ID NO: 478 - protein, 8 aa, Neisseria
GKNAAPDM

SEQ ID NO: 479 - protein, 13 aa, Neisseria
NIRGGGEFGPRWH

SEQ ID NO: 480 - protein, 10 aa, Neisseria
GISKHKSVDD

SEQ ID NO: 481 - protein, 14 aa, Neisseria
RDLSERGISSPEHI

SEQ ID NO: 482 - protein, 5 aa, Neisseria
GGSNG

SEQ ID NO: 483 - protein, 10 aa, Neisseria
FVREPQSIGA

SEQ ID NO: 484 - protein, 27 aa, Neisseria
GSSWTDEYGNPQKYEVCKRRLGELSPY

SEQ ID NO: 485 - protein, 9 aa, Neisseria
NLSDGIDYP

SEQ ID NO: 486 - protein, 9 aa, Neisseria
TSLSDDRVH

SEQ ID NO: 487 - protein, 8 aa, Neisseria
AKLRETSA

SEQ ID NO: 488 - protein, 21 aa, Neisseria
YSPDGGGHTGNGTQRESADEL

SEQ ID NO: 489 - protein, 8 aa, Neisseria
SYPDPYRH

SEQ ID NO: 490 - protein, 8 aa, Neisseria
ENLDSAET

SEQ ID NO: 491 - protein, 19 aa, Neisseria
ANAETRARFLENDKARALS

SEQ ID NO: 492 - protein, 5 aa, Neisseria
QDTRQ

SEQ ID NO: 493 - protein, 6 aa, Neisseria
QEHRAR

SEQ ID NO: 494 - protein, 6 aa, Neisseria
QDAEYP

SEQ ID NO: 495 - protein, 7 aa, Neisseria
DFDELLG

SEQ ID NO: 496 - protein, 10 aa, Neisseria
VDLEAGELVE

SEQ ID NO: 497 - protein, 8 aa, Neisseria
VSWRDENS

SEQ ID NO: 498 - protein, 7 aa, Neisseria
WNERQLT

SEQ ID NO: 499 - protein, 10 aa, Neisseria
ERGKSFEESL

SEQ ID NO: 500 - protein, 6 aa, Neisseria
IGEDGM

SEQ ID NO: 501 - protein, 7 aa, Neisseria
DLIEASD

SEQ ID NO: 502 - protein, 9 aa, Neisseria
VSAEGEAKP

SEQ ID NO: 503 - protein, 7 aa, Neisseria
LRKDWNR

SEQ ID NO: 504 - protein, 8 aa, Neisseria
KLNRGELG

SEQ ID NO: 505 - protein, 6 aa, Neisseria
PDETQA

SEQ ID NO: 506 - protein, 7 aa, Neisseria
ESVETTK

SEQ ID NO: 507 - protein, 7 aa, Neisseria
VQGRLKA

SEQ ID NO: 508 - protein, 15 aa, Neisseria
VMRRQPQQFDSDGIN

SEQ ID NO: 509 - protein, 5 aa, Neisseria
ADGER

SEQ ID NO: 510 - protein, 6 aa, Neisseria
KNAAPD

SEQ ID NO: 511 - protein, 7 aa, Neisseria
RGGGEFG

SEQ ID NO: 512 - protein, 10 aa, Neisseria
GISKHKSVDD

SEQ ID NO: 513 - protein, 10 aa, Neisseria
RDLSERGISS

SEQ ID NO: 514 - protein, 7 aa, Neisseria
FVREPQS

SEQ ID NO: 515 - protein, 7 aa, Neisseria
WTDEYGN

SEQ ID NO: 516 - protein, 12 aa, Neisseria
QKYEVCKRRLGE

SEQ ID NO: 517 - protein, 7 aa, Neisseria
LSDDRVH

SEQ ID NO: 518 - protein, 7 aa, Neisseria
AKLRETS

SEQ ID NO: 519 - protein, 10 aa, Neisseria
GTQRESADEL

SEQ ID NO: 520 - protein, 7 aa, Neisseria
ALSNTST

SEQ ID NO: 521 - protein, 8 aa, Neisseria
AVRSMMKI

SEQ ID NO: 522 - protein, 10 aa, Neisseria
SPLVRILPLS

SEQ ID NO: 523 - protein, 9 aa, Neisseria
SMVVAFFAN

SEQ ID NO: 524 - protein, 16 aa, Neisseria
RTSALSNTSTAAGPSC

SEQ ID NO: 525 - protein, 26 aa, Neisseria
YSKETGCPCPSLRKDSSTGGRPMSPC

SEQ ID NO: 526 - protein, 12 aa, Neisseria
LANRDCVPKADT

SEQ ID NO: 527 - protein, 9 aa, Neisseria
TDSTSPRPL

SEQ ID NO: 528 - protein, 12 aa, Neisseria
ARASLPKIRAKV

SEQ ID NO: 529 - protein, 9 aa, Neisseria
CSYASAPGP

SEQ ID NO: 530 - protein, 7 aa, Neisseria
YSKETGC

SEQ ID NO: 531 - protein, 13 aa, Neisseria
SLRKDSSTGGRPM

SEQ ID NO: 532 - protein, 11 aa, Neisseria
ANRDCVPKADT

SEQ ID NO: 533 - protein, 6 aa, Neisseria
DSTSPR

SEQ ID NO: 534 - protein, 9 aa, Neisseria
SLPKIRAKV

SEQ ID NO: 535 - protein, 5 aa, Neisseria
VEPSR

SEQ ID NO: 536 - protein, 15 aa, Neisseria
HGGLDGAAGFDEGER

SEQ ID NO: 537 - protein, 6 aa, Neisseria
ASGDGF

SEQ ID NO: 538 - protein, 9 aa, Neisseria
AGDFGDGQR

SEQ ID NO: 539 - protein, 5 aa, Neisseria
MPPAP

SEQ ID NO: 540 - protein, 18 aa, Neisseria
IRRQKSVMPSERFVEPSR

SEQ ID NO: 541 - protein, 18 aa, Neisseria
VHGGLDGAAGFDEGERVF

SEQ ID NO: 542 - protein, 10 aa, Neisseria
AAQASGDGFA

SEQ ID NO: 543 - protein, 16 aa, Neisseria
QSDAAGDFGDGQRTGE

SEQ ID NO: 544 - protein, 7 aa, Neisseria
VLQDVGG

SEQ ID NO: 545 - protein, 6 aa, Neisseria
AEGEAQ

SEQ ID NO: 546 - protein, 18 aa, Neisseria
IRRQKSVMPSERFVEPSR

SEQ ID NO: 547 - protein, 10 aa, Neisseria
AGFDEGERVF

SEQ ID NO: 548 - protein, 13 aa, Neisseria
DAAGDFGDGQRTG

SEQ ID NO: 549 - protein, 6 aa, Neisseria
AEGEAQ

SEQ ID NO: 550 - protein, 6 aa, Neisseria
RPTSSP

SEQ ID NO: 551 - protein, 9 aa, Neisseria
TSCSGLMVS

SEQ ID NO: 552 - protein, 6 aa, Neisseria
FSLFSS

SEQ ID NO: 553 - protein, 5 aa, Neisseria
KSASS

SEQ ID NO: 554 - protein, 7 aa, Neisseria
SCNAFSS

SEQ ID NO: 555 - protein, 14 aa, Neisseria
TSLLGMAARFCATV

SEQ ID NO: 556 - protein, 11 aa, Neisseria
RPTSSPPRRAC

SEQ ID NO: 557 - protein, 25 aa, Neisseria
IRTRSSAKRKTCNAPGQSIRPASCS

SEQ ID NO: 558 - protein, 7 aa, Neisseria
PNMERLP

SEQ ID NO: 559 - protein, 21 aa, Neisseria
SRYSLERTRAMRPGMLNRSAA

SEQ ID NO: 560 - protein, 38 aa, Neisseria
SLRESASSKSASSAPARSNVKGDAPLPKTVWTSRRLPV

SEQ ID NO: 561 - protein, 8 aa, Neisseria
EPTCPLPK

SEQ ID NO: 562 - protein, 10 aa, Neisseria
PTSSPPRRAC

SEQ ID NO: 563 - protein, 13 aa, Neisseria
IRTRSSAKRKTCN

SEQ ID NO: 564 - protein, 7 aa, Neisseria
QSIRPAS

SEQ ID NO: 565 - protein, 6 aa, Neisseria
NMERLP

SEQ ID NO: 566 - protein, 12 aa, Neisseria
SRYSLERTRAMR

SEQ ID NO: 567 - protein, 12 aa, Neisseria
SLRESASSKSAS

SEQ ID NO: 568 - protein, 13 aa, Neisseria
APARSNVKGDAPL

SEQ ID NO: 569 - protein, 12 aa, Neisseria
IADIAQDLPDGA

SEQ ID NO: 570 - protein, 7 aa, Neisseria
AENIGAV

SEQ ID NO: 571 - protein, 7 aa, Neisseria
RLAKQLE

SEQ ID NO: 572 - protein, 8 aa, Neisseria
YIDEIDVF

SEQ ID NO: 573 - protein, 5 aa, Neisseria
SALLA

SEQ ID NO: 574 - protein, 5 aa, Neisseria
LLEGN

SEQ ID NO: 575 - protein, 6 aa, Neisseria
IGSILA

SEQ ID NO: 576 - protein, 9 aa, Neisseria
SGIKWPEGC

SEQ ID NO: 577 - protein, 10 aa, Neisseria
IAAVVRAGTG

SEQ ID NO: 578 - protein, 9 aa, Neisseria
ILNELEKLI

SEQ ID NO: 579 - protein, 8 aa, Neisseria
QARRGGLL

SEQ ID NO: 580 - protein, 10 aa, Neisseria
IAQDLPDGAD

SEQ ID NO: 581 - protein, 6 aa, Neisseria
YRNNRL

SEQ ID NO: 582 - protein, 5 aa, Neisseria
IEGDE

SEQ ID NO: 583 - protein, 14 aa, Neisseria
PELRPKETSTRRIM

SEQ ID NO: 584 - protein, 5 aa, Neisseria
GGGNI

SEQ ID NO: 585 - protein, 5 aa, Neisseria
KQLEH

SEQ ID NO: 586 - protein, 12 aa, Neisseria
IIECRPRRAEWI

SEQ ID NO: 587 - protein, 7 aa, Neisseria
ENLDNTL

SEQ ID NO: 588 - protein, 17 aa, Neisseria
SATDETLLDNEYIDEID

SEQ ID NO: 589 - protein, 8 aa, Neisseria
TNDDESNI

SEQ ID NO: 590 - protein, 6 aa, Neisseria
LGAKRV

SEQ ID NO: 591 - protein, 5 aa, Neisseria
NRSSY

SEQ ID NO: 592 - protein, 6 aa, Neisseria
LEGNKI

SEQ ID NO: 593 - protein, 8 aa, Neisseria
HIRRGDIV

SEQ ID NO: 594 - protein, 11 aa, Neisseria
PIRRGTAEAIE

SEQ ID NO: 595 - protein, 8 aa, Neisseria
AHGDKKTS

SEQ ID NO: 596 - protein, 15 aa, Neisseria
IGRRISGIKWPEGCH

SEQ ID NO: 597 - protein, 7 aa, Neisseria
RAGTGET

SEQ ID NO: 598 - protein, 7 aa, Neisseria
VIQDGDH

SEQ ID NO: 599 - protein, 12 aa, Neisseria
VSRRRILNELEK

SEQ ID NO: 600 - protein, 6 aa, Neisseria
QARRGG

SEQ ID NO: 601 - protein, 10 aa, Neisseria
IAQDLPDGAD

SEQ ID NO: 602 - protein, 5 aa, Neisseria
IEGDE

SEQ ID NO: 603 - protein, 14 aa, Neisseria
PELRPKETSTRRIM

SEQ ID NO: 604 - protein, 12 aa, Neisseria
IIECRPRRAEWI

SEQ ID NO: 605 - protein, 8 aa, Neisseria
SATDETLL

SEQ ID NO: 606 - protein, 7 aa, Neisseria
EYIDEID

SEQ ID NO: 607 - protein, 8 aa, Neisseria
TNDDESNI

SEQ ID NO: 608 - protein, 6 aa, Neisseria
LGAKRV

SEQ ID NO: 609 - protein, 6 aa, Neisseria
LEGNKI

SEQ ID NO: 610 - protein, 6 aa, Neisseria
IRRGDI

SEQ ID NO: 611 - protein, 11 aa, Neisseria
PIRRGTAEAIE

SEQ ID NO: 612 - protein, 8 aa, Neisseria
AHGDKKTS

SEQ ID NO: 613 - protein, 6 aa, Neisseria
IGRRIS

SEQ ID NO: 614 - protein, 6 aa, Neisseria
VIQDGD

SEQ ID NO: 615 - protein, 11 aa, Neisseria
SRRRILNELEK

SEQ ID NO: 616 - protein, 5 aa, Neisseria
QHLLE

SEQ ID NO: 617 - protein, 10 aa, Neisseria
DDAVDGIGQM

SEQ ID NO: 618 - protein, 5 aa, Neisseria
QPFGQ

SEQ ID NO: 619 - protein, 10 aa, Neisseria
EHFAPVDGFR

SEQ ID NO: 620 - protein, 7 aa, Neisseria
HQRFFRI

SEQ ID NO: 621 - protein, 12 aa, Neisseria
RGAGQRRVSRHC

SEQ ID NO: 622 - protein, 11 aa, Neisseria
ARLTQVFQTFF

SEQ ID NO: 623 - protein, 8 aa, Neisseria
FDYRPRLL

SEQ ID NO: 624 - protein, 6 aa, Neisseria
IGENRH

SEQ ID NO: 625 - protein, 14 aa, Neisseria
LLHRRSDDAVDGIG

SEQ ID NO: 626 - protein, 5 aa, Neisseria
DQPFG

SEQ ID NO: 627 - protein, 19 aa, Neisseria
APVDGFRVQDIDLDGHQRF

SEQ ID NO: 628 - protein, 8 aa, Neisseria
VFRNRRLI

SEQ ID NO: 629 - protein, 5 aa, Neisseria
LSGFK

SEQ ID NO: 630 - protein, 10 aa, Neisseria
GIKPDSPPRF

SEQ ID NO: 631 - protein, 12 aa, Neisseria
FRNRHLQGSLRV

SEQ ID NO: 632 - protein, 9 aa, Neisseria
FLKDDHRVG

SEQ ID NO: 633 - protein, 5 aa, Neisseria
QHTGS

SEQ ID NO: 634 - protein, 21 aa, Neisseria
RHRRVRSGFRGAGQRRVSRHC

SEQ ID NO: 635 - protein, 11 aa, Neisseria
KQTNPRPKRGL

SEQ ID NO: 636 - protein, 6 aa, Neisseria
IGENRH

SEQ ID NO: 637 - protein, 9 aa, Neisseria
HRRSDDAVD

SEQ ID NO: 638 - protein, 15 aa, Neisseria
DGFRVQDIDLDGHQR

SEQ ID NO: 639 - protein, 6 aa, Neisseria
RNRRLI

SEQ ID NO: 640 - protein, 7 aa, Neisseria
KPDSPPR

SEQ ID NO: 641 - protein, 8 aa, Neisseria
FLKDDHRV

SEQ ID NO: 642 - protein, 19 aa, Neisseria
RHRRVRSGFRGAGQRRVSR

SEQ ID NO: 643 - protein, 11 aa, Neisseria
KQTNPRPKRGL

SEQ ID NO: 644 - protein, 14 aa, Neisseria
IQSICDAFQFISYY

SEQ ID NO: 645 - protein, 14 aa, Neisseria
PKDYIDALYKAWQK

SEQ ID NO: 646 - protein, 5 aa, Neisseria
VNEGV

SEQ ID NO: 647 - protein, 12 aa, Neisseria
NPSDNIVDWVLK

SEQ ID NO: 648 - protein, 5 aa, Neisseria
PTMGA

SEQ ID NO: 649 - protein, 9 aa, Neisseria
LELFEKVNA

SEQ ID NO: 650 - protein, 7 aa, Neisseria
GLGGLTT

SEQ ID NO: 651 - protein, 5 aa, Neisseria
AMIPN

SEQ ID NO: 652 - protein, 9 aa, Neisseria
RVEDWPDLT

SEQ ID NO: 653 - protein, 8 aa, Neisseria
NGKRVDVD

SEQ ID NO: 654 - protein, 9 aa, Neisseria
KRLVDMLNK

SEQ ID NO: 655 - protein, 7 aa, Neisseria
VDFTNRL

SEQ ID NO: 656 - protein, 8 aa, Neisseria
PVDPVGDE

SEQ ID NO: 657 - protein, 11 aa, Neisseria
ATRMDKFTRQM

SEQ ID NO: 658 - protein, 6 aa, Neisseria
TDLLGM

SEQ ID NO: 659 - protein, 9 aa, Neisseria
GVATCEAIA

SEQ ID NO: 660 - protein, 8 aa, Neisseria
KSSKVLAF

SEQ ID NO: 661 - protein, 7 aa, Neisseria
ATAPRKW

SEQ ID NO: 662 - protein, 7 aa, Neisseria
IKQEDFI

SEQ ID NO: 663 - protein, 10 aa, Neisseria
YHPKDYIDAL

SEQ ID NO: 664 - protein, 13 aa, Neisseria
WQKEENPAAKDAM

SEQ ID NO: 665 - protein, 16 aa, Neisseria
SRMCAENNRPICQDTG

SEQ ID NO: 666 - protein, 26 aa, Neisseria
MSVEEMVNEGVRRAYTWEGNTLRASV

SEQ ID NO: 667 - protein, 13 aa, Neisseria
DPAGKRQNTKDNT

SEQ ID NO: 668 - protein, 7 aa, Neisseria
PGGKVEV

SEQ ID NO: 669 - protein, 12 aa, Neisseria
AKGGGSENKSKL

SEQ ID NO: 670 - protein, 6 aa, Neisseria
NPSDNI

SEQ ID NO: 671 - protein, 17 aa, Neisseria
GIGGTPEKAVLMAKESL

SEQ ID NO: 672 - protein, 17 aa, Neisseria
DIQELQEKAASGAELST

SEQ ID NO: 673 - protein, 48 aa, Neisseria
RHVEFELDGSGPVELTPPRVEDWPDLTYSPDNGKRVDVDKLTKEEVAS

SEQ ID NO: 674 - protein, 12 aa, Neisseria
LTGRDAAHKRLV

SEQ ID NO: 675 - protein, 8 aa, Neisseria
LNKGEELP

SEQ ID NO: 676 - protein, 33 aa, Neisseria
PVDPVGDEVVGPAGPTTATRMDKFTRQMLEQTD

SEQ ID NO: 677 - protein, 9 aa, Neisseria
GKSERGVAT

SEQ ID NO: 678 - protein, 7 aa, Neisseria
AIADNKA

SEQ ID NO: 679 - protein, 6 aa, Neisseria
AIKSSK

SEQ ID NO: 680 - protein, 7 aa, Neisseria
FEVKDMP

SEQ ID NO: 681 - protein, 8 aa, Neisseria
VDSKGESI

SEQ ID NO: 682 - protein, 7 aa, Neisseria
APRKWQA

SEQ ID NO: 683 - protein, 7 aa, Neisseria
IKQEDFI

SEQ ID NO: 684 - protein, 13 aa, Neisseria
WQKEENPAAKDAM

SEQ ID NO: 685 - protein, 10 aa, Neisseria
MCAENNRPIC

SEQ ID NO: 686 - protein, 13 aa, Neisseria
MSVEEMVNEGVRR

SEQ ID NO: 687 - protein, 12 aa, Neisseria
PAGKRQNTKDNT

SEQ ID NO: 688 - protein, 5 aa, Neisseria
GKVEV

SEQ ID NO: 689 - protein, 12 aa, Neisseria
AKGGGSENKSKL

SEQ ID NO: 690 - protein, 14 aa, Neisseria
GTPEKAVLMAKESL

SEQ ID NO: 691 - protein, 11 aa, Neisseria
DIQELQEKAAS

SEQ ID NO: 692 - protein, 5 aa, Neisseria
AELST

SEQ ID NO: 693 - protein, 9 aa, Neisseria
RHVEFELDG

SEQ ID NO: 694 - protein, 9 aa, Neisseria
TPPRVEDWP

SEQ ID NO: 695 - protein, 19 aa, Neisseria
PDNGKRVDVDKLTKEEVAS

SEQ ID NO: 696 - protein, 12 aa, Neisseria
LTGRDAAHKRLV

SEQ ID NO: 697 - protein, 8 aa, Neisseria
LNKGEELP

SEQ ID NO: 698 - protein, 7 aa, Neisseria
PVGDEVV

SEQ ID NO: 699 - protein, 15 aa, Neisseria
TRMDKFTRQMLEQTD

SEQ ID NO: 700 - protein, 8 aa, Neisseria
GKSERGVA

SEQ ID NO: 701 - protein, 7 aa, Neisseria
AIADNKA

SEQ ID NO: 702 - protein, 6 aa, Neisseria
AIKSSK

SEQ ID NO: 703 - protein, 7 aa, Neisseria
FEVKDMP

SEQ ID NO: 704 - protein, 8 aa, Neisseria
VDSKGESI

SEQ ID NO: 705 - protein, 7 aa, Neisseria
APRKWQA

SEQ ID NO: 706 - protein, 12 aa, Neisseria
APCFKGCEPTGD

SEQ ID NO: 707 - protein, 18 aa, Neisseria
AKASKSATSPKGLDGVSK

SEQ ID NO: 708 - protein, 9 aa, Neisseria
TAAFHSFIS

SEQ ID NO: 709 - protein, 8 aa, Neisseria
MPNLVTML

SEQ ID NO: 710 - protein, 7 aa, Neisseria
VAEETEI

SEQ ID NO: 711 - protein, 21 aa, Neisseria
CFKGCEPTGDSRLLSTTKSAP

SEQ ID NO: 712 - protein, 25 aa, Neisseria
CANSAKASKSATSPKGLDGVSKNSS

SEQ ID NO: 713 - protein, 10 aa, Neisseria
SVGDTRLTPM

SEQ ID NO: 714 - protein, 23 aa, Neisseria
VVPNRLRLETTWSPACRKVKNAA

SEQ ID NO: 715 - protein, 7 aa, Neisseria
VAEETEI

SEQ ID NO: 716 - protein, 11 aa, Neisseria
KGCEPTGDSRL

SEQ ID NO: 717 - protein, 5 aa, Neisseria
TKSAP

SEQ ID NO: 718 - protein, 22 aa, Neisseria
NSAKASKSATSPKGLDGVSKNS

SEQ ID NO: 719 - protein, 5 aa, Neisseria
GDTRL

SEQ ID NO: 720 - protein, 5 aa, Neisseria
NRLRL

SEQ ID NO: 721 - protein, 9 aa, Neisseria
ACRKVKNAA

SEQ ID NO: 722 - protein, 17 aa, Neisseria
KSAAKMPTTIQPASIPS

SEQ ID NO: 723 - protein, 8 aa, Neisseria
APYLRQVL

SEQ ID NO: 724 - protein, 6 aa, Neisseria
FKKCLA

SEQ ID NO: 725 - protein, 20 aa, Neisseria
DFFQTCVNRFFEVVEIIGIG

SEQ ID NO: 726 - protein, 10 aa, Neisseria
ENTKSAAKMP

SEQ ID NO: 727 - protein, 5 aa, Neisseria
AKARG

SEQ ID NO: 728 - protein, 20 aa, Neisseria
FFRRPPNIRKSVFQKSEYDK

SEQ ID NO: 729 - protein, 8 aa, Neisseria
ENTKSAAK

SEQ ID NO: 730 - protein, 5 aa, Neisseria
AKARG

SEQ ID NO: 731 - protein, 20 aa, Neisseria
FFRRPPNIRKSVFQKSEYDK

SEQ ID NO: 732 - protein, 8 aa, Neisseria
EAMERLTR

SEQ ID NO: 733 - protein, 6 aa, Neisseria
FPDTVE

SEQ ID NO: 734 - protein, 8 aa, Neisseria
PVARWGDH

SEQ ID NO: 735 - protein, 15 aa, Neisseria
SAEMLRRYDEFSTVL

SEQ ID NO: 736 - protein, 12 aa, Neisseria
KRLRLFTEAWQH

SEQ ID NO: 737 - protein, 12 aa, Neisseria
MWDNAEAMERLT

SEQ ID NO: 738 - protein, 6 aa, Neisseria
NSNHLP

SEQ ID NO: 739 - protein, 5 aa, Neisseria
VSLKG

SEQ ID NO: 740 - protein, 9 aa, Neisseria
LVYSDKKTL

SEQ ID NO: 741 - protein, 15 aa, Neisseria
NILRTDINGAQEAYR

SEQ ID NO: 742 - protein, 11 aa, Neisseria
MVRRRFPDTVE

SEQ ID NO: 743 - protein, 11 aa, Neisseria
LTERKPVARWG

SEQ ID NO: 744 - protein, 10 aa, Neisseria
ALVDGEGNVF

SEQ ID NO: 745 - protein, 9 aa, Neisseria
ARLDRPGMP

SEQ ID NO: 746 - protein, 7 aa, Neisseria
RGAEGTS

SEQ ID NO: 747 - protein, 8 aa, Neisseria
EMLRRYDE

SEQ ID NO: 748 - protein, 5 aa, Neisseria
LGIKE

SEQ ID NO: 749 - protein, 13 aa, Neisseria
RLGRENEMKRLRL

SEQ ID NO: 750 - protein, 10 aa, Neisseria
LLRKNKNRLS

SEQ ID NO: 751 - protein, 8 aa, Neisseria
MRYKDGFS

SEQ ID NO: 752 - protein, 13 aa, Neisseria
YASDGLPEKESEE

SEQ ID NO: 753 - protein, 10 aa, Neisseria
DNAEAMERLT

SEQ ID NO: 754 - protein, 7 aa, Neisseria
YSDKKTL

SEQ ID NO: 755 - protein, 13 aa, Neisseria
LRTDINGAQEAYR

SEQ ID NO: 756 - protein, 10 aa, Neisseria
MVRRRFPDTV

SEQ ID NO: 757 - protein, 11 aa, Neisseria
LTERKPVARWG

SEQ ID NO: 758 - protein, 10 aa, Neisseria
ALVDGEGNVF

SEQ ID NO: 759 - protein, 7 aa, Neisseria
ARLDRPG

SEQ ID NO: 760 - protein, 7 aa, Neisseria
RGAEGTS

SEQ ID NO: 761 - protein, 8 aa, Neisseria
EMLRRYDE

SEQ ID NO: 762 - protein, 5 aa, Neisseria
LGIKE

SEQ ID NO: 763 - protein, 13 aa, Neisseria
RLGRENEMKRLRL

SEQ ID NO: 764 - protein, 9 aa, Neisseria
LRKNKNRLS

SEQ ID NO: 765 - protein, 8 aa, Neisseria
MRYKDGFS

SEQ ID NO: 766 - protein, 9 aa, Neisseria
GLPEKESEE

SEQ ID NO: 767 - protein, 10 aa, Neisseria
KPVSRIVTDS

SEQ ID NO: 768 - protein, 14 aa, Neisseria
LAALQTLAKAWREN

SEQ ID NO: 769 - protein, 9 aa, Neisseria
KEMLAAVLR

SEQ ID NO: 770 - protein, 5 aa, Neisseria
TAGNF

SEQ ID NO: 771 - protein, 15 aa, Neisseria
  VARIANT (1)...(15): Xaa is any amino acid
MNHFGELAVLTXIAK

SEQ ID NO: 772 - protein, 6 aa, Neisseria
VNNAMR

SEQ ID NO: 773 - protein, 9 aa, Neisseria
DGVGDIAKA

SEQ ID NO: 774 - protein, 14 aa, Neisseria
LNDVAEGLKGFSNI

SEQ ID NO: 775 - protein, 10 aa, Neisseria
AAIDVLARMP

SEQ ID NO: 776 - protein, 13 aa, Neisseria
VMGDMGELGELGE

SEQ ID NO: 777 - protein, 5 aa, Neisseria
VEAAE

SEQ ID NO: 778 - protein, 10 aa, Neisseria
PMPSESKPVS

SEQ ID NO: 779 - protein, 12 aa, Neisseria
IVTDSRDIRAGD

SEQ ID NO: 780 - protein, 7 aa, Neisseria
AGERFDA

SEQ ID NO: 781 - protein, 8 aa, Neisseria
VSREDCAA

SEQ ID NO: 782 - protein, 9 aa, Neisseria
GALKVDDTL

SEQ ID NO: 783 - protein, 9 aa, Neisseria
AWRENVNPF

SEQ ID NO: 784 - protein, 12 aa, Neisseria
GSGGKTTVKEML

SEQ ID NO: 785 - protein, 10 aa, Neisseria
LRRRFGDDAV

SEQ ID NO: 786 - protein, 6 aa, Neisseria
NFNNHI

SEQ ID NO: 787 - protein, 7 aa, Neisseria
KLNEKHR

SEQ ID NO: 788 - protein, 5 aa, Neisseria
AKPNA

SEQ ID NO: 789 - protein, 17 aa, Neisseria
GCGFDGVGDIAKAKSEI

SEQ ID NO: 790 - protein, 7 aa, Neisseria
QGLCSDG

SEQ ID NO: 791 - protein, 6 aa, Neisseria
PQEDAN

SEQ ID NO: 792 - protein, 15 aa, Neisseria
LNTRTFGIDSGDVHA

SEQ ID NO: 793 - protein, 7 aa, Neisseria
CGDERAA

SEQ ID NO: 794 - protein, 7 aa, Neisseria
VPGRHNV

SEQ ID NO: 795 - protein, 7 aa, Neisseria
DVAEGLK

SEQ ID NO: 796 - protein, 16 aa, Neisseria
FSNIKGRLNVKSGIKG

SEQ ID NO: 797 - protein, 17 aa, Neisseria
TLIDDTYNANPDSMKAA

SEQ ID NO: 798 - protein, 14 aa, Neisseria
DMGELGELGEDEAA

SEQ ID NO: 799 - protein, 8 aa, Neisseria
AYARDQGI

SEQ ID NO: 800 - protein, 13 aa, Neisseria
GDNSVEAAEKFGA

SEQ ID NO: 801 - protein, 11 aa, Neisseria
LRHDLPERATV

SEQ ID NO: 802 - protein, 5 aa, Neisseria
VKGSR

SEQ ID NO: 803 - protein, 10 aa, Neisseria
EEVVEALEDK

SEQ ID NO: 804 - protein, 9 aa, Neisseria
MPSESKPVS

SEQ ID NO: 805 - protein, 10 aa, Neisseria
IVTDSRDIRA

SEQ ID NO: 806 - protein, 7 aa, Neisseria
AGERFDA

SEQ ID NO: 807 - protein, 8 aa, Neisseria
VSREDCAA

SEQ ID NO: 808 - protein, 9 aa, Neisseria
GALKVDDTL

SEQ ID NO: 809 - protein, 6 aa, Neisseria
AWRENV

SEQ ID NO: 810 - protein, 11 aa, Neisseria
SGGKTTVKEML

SEQ ID NO: 811 - protein, 7 aa, Neisseria
LRRRFGD

SEQ ID NO: 812 - protein, 7 aa, Neisseria
KLNEKHR

SEQ ID NO: 813 - protein, 12 aa, Neisseria
GVGDIAKAKSEI

SEQ ID NO: 814 - protein, 6 aa, Neisseria
PQEDAN

SEQ ID NO: 815 - protein, 7 aa, Neisseria
DSGDVHA

SEQ ID NO: 816 - protein, 7 aa, Neisseria
CGDERAA

SEQ ID NO: 817 - protein, 7 aa, Neisseria
DVAEGLK

SEQ ID NO: 818 - protein, 7 aa, Neisseria
IKGRLNV

SEQ ID NO: 819 - protein, 12 aa, Neisseria
TYNANPDSMKAA

SEQ ID NO: 820 - protein, 14 aa, Neisseria
DMGELGELGEDEAA

SEQ ID NO: 821 - protein, 8 aa, Neisseria
AYARDQGI

SEQ ID NO: 822 - protein, 11 aa, Neisseria
NSVEAAEKFGA

SEQ ID NO: 823 - protein, 11 aa, Neisseria
LRHDLPERATV

SEQ ID NO: 824 - protein, 10 aa, Neisseria
EEVVEALEDK

SEQ ID NO: 825 - protein, 14 aa, Neisseria
RIKNMNQTLKNTLG

SEQ ID NO: 826 - protein, 5 aa, Neisseria
CALLA

SEQ ID NO: 827 - protein, 6 aa, Neisseria
AVGALA

SEQ ID NO: 828 - protein, 5 aa, Neisseria
FPRVS

SEQ ID NO: 829 - protein, 9 aa, Neisseria
QIVGSILES

SEQ ID NO: 830 - protein, 8 aa, Neisseria
EFVGNLPG

SEQ ID NO: 831 - protein, 17 aa, Neisseria
MKQSARIKNMNQTLKNT

SEQ ID NO: 832 - protein, 8 aa, Neisseria
YEYGYRYS

SEQ ID NO: 833 - protein, 13 aa, Neisseria
LESNPAEAREFVG

SEQ ID NO: 834 - protein, 5 aa, Neisseria
VSGGG

SEQ ID NO: 835 - protein, 14 aa, Neisseria
MKQSARIKNMNQTL

SEQ ID NO: 836 - protein, 9 aa, Neisseria
NPAEAREFV

SEQ ID NO: 837 - protein, 13 aa, Neisseria
ERVSQIGKMFDGL

SEQ ID NO: 838 - protein, 10 aa, Neisseria
LKDALDNGFD

SEQ ID NO: 839 - protein, 14 aa, Neisseria
NGGRVLGDIELLAD

SEQ ID NO: 840 - protein, 6 aa, Neisseria
TSLVGY

SEQ ID NO: 841 - protein, 7 aa, Neisseria
IAGNIGT

SEQ ID NO: 842 - protein, 6 aa, Neisseria
ENTESL

SEQ ID NO: 843 - protein, 11 aa, Neisseria
HLDRYDDLLDY

SEQ ID NO: 844 - protein, 6 aa, Neisseria
RGDGVQ

SEQ ID NO: 845 - protein, 8 aa, Neisseria
FCRAMKRA

SEQ ID NO: 846 - protein, 15 aa, Neisseria
HNAANVMAAVALCEA

SEQ ID NO: 847 - protein, 16 aa, Neisseria
HVKTFQGLPHRVEKIG

SEQ ID NO: 848 - protein, 6 aa, Neisseria
AAIAGL

SEQ ID NO: 849 - protein, 7 aa, Neisseria
GKGQDFT

SEQ ID NO: 850 - protein, 11 aa, Neisseria
DCATLGEAVQT

SEQ ID NO: 851 - protein, 8 aa, Neisseria
SFDMFKGY

SEQ ID NO: 852 - protein, 6 aa, Neisseria
QNKKIL

SEQ ID NO: 853 - protein, 29 aa, Neisseria
YLRKNGAEVAAYDAELKPERVSQIGKMFD

SEQ ID NO: 854 - protein, 11 aa, Neisseria
GRLKDALDNGF

SEQ ID NO: 855 - protein, 23 aa, Neisseria
SPGISERQPDIEAFKQNGGRVLG

SEQ ID NO: 856 - protein, 10 aa, Neisseria
IVNRRDDKVI

SEQ ID NO: 857 - protein, 8 aa, Neisseria
TGSNGKTT

SEQ ID NO: 858 - protein, 10 aa, Neisseria
EWQREGKKAD

SEQ ID NO: 859 - protein, 15 aa, Neisseria
SSFQLENTESLRPTA

SEQ ID NO: 860 - protein, 13 aa, Neisseria
ISEDHLDRYDDLL

SEQ ID NO: 861 - protein, 13 aa, Neisseria
AHTKAKIFRGDGV

SEQ ID NO: 862 - protein, 18 aa, Neisseria
NADDAFCRAMKRAGREVK

SEQ ID NO: 863 - protein, 19 aa, Neisseria
FWLERETGRLKQGNEDLIV

SEQ ID NO: 864 - protein, 7 aa, Neisseria
GLSREAL

SEQ ID NO: 865 - protein, 13 aa, Neisseria
LPHRVEKIGEKNG

SEQ ID NO: 866 - protein, 10 aa, Neisseria
FIDDSKGTNV

SEQ ID NO: 867 - protein, 20 aa, Neisseria
GMGKGQDFTPLRDALVGKAK

SEQ ID NO: 868 - protein, 13 aa, Neisseria
DAPQIRRDLDGCG

SEQ ID NO: 869 - protein, 5 aa, Neisseria
YAHRS

SEQ ID NO: 870 - protein, 6 aa, Neisseria
QNKKIL

SEQ ID NO: 871 - protein, 6 aa, Neisseria
RKNGAE

SEQ ID NO: 872 - protein, 14 aa, Neisseria
AAYDAELKPERVSQ

SEQ ID NO: 873 - protein, 10 aa, Neisseria
RLKDALDNGF

SEQ ID NO: 874 - protein, 17 aa, Neisseria
GISERQPDIEAFKQNGG

SEQ ID NO: 875 - protein, 9 aa, Neisseria
IVNRRDDKV

SEQ ID NO: 876 - protein, 6 aa, Neisseria
SNGKTT

SEQ ID NO: 877 - protein, 10 aa, Neisseria
EWQREGKKAD

SEQ ID NO: 878 - protein, 8 aa, Neisseria
ENTESLRP

SEQ ID NO: 879 - protein, 13 aa, Neisseria
ISEDHLDRYDDLL

SEQ ID NO: 880 - protein, 12 aa, Neisseria
AHTKAKIFRGDG

SEQ ID NO: 881 - protein, 18 aa, Neisseria
NADDAFCRAMKRAGREVK

SEQ ID NO: 882 - protein, 19 aa, Neisseria
FWLERETGRLKQGNEDLIV

SEQ ID NO: 883 - protein, 7 aa, Neisseria
GLSREAL

SEQ ID NO: 884 - protein, 11 aa, Neisseria
HRVEKIGEKNG

SEQ ID NO: 885 - protein, 7 aa, Neisseria
DDSKGTN

SEQ ID NO: 886 - protein, 5 aa, Neisseria
GKGQD

SEQ ID NO: 887 - protein, 12 aa, Neisseria
TPLRDALVGKAK

SEQ ID NO: 888 - protein, 9 aa, Neisseria
PQIRRDLDG

SEQ ID NO: 889 - protein, 5 aa, Neisseria
YAHRS

SEQ ID NO: 890 - protein, 9 aa, Neisseria
MRTWRRLVP

SEQ ID NO: 891 - protein, 6 aa, Neisseria
INGATR

SEQ ID NO: 892 - protein, 9 aa, Neisseria
PTELFKLAV

SEQ ID NO: 893 - protein, 20 aa, Neisseria
EVLRSMESLGWQSIWRGTAN

SEQ ID NO: 894 - protein, 6 aa, Neisseria
EMYGRF

SEQ ID NO: 895 - protein, 5 aa, Neisseria
SFVVI

SEQ ID NO: 896 - protein, 16 aa, Neisseria
RVQRVVAFLDPWKDPQ

SEQ ID NO: 897 - protein, 6 aa, Neisseria
GFFGMC

SEQ ID NO: 898 - protein, 7 aa, Neisseria
WIGIQSF

SEQ ID NO: 899 - protein, 8 aa, Neisseria
LASKEGGD

SEQ ID NO: 900 - protein, 6 aa, Neisseria
MRTWRR

SEQ ID NO: 901 - protein, 9 aa, Neisseria
AGREINGAT

SEQ ID NO: 902 - protein, 12 aa, Neisseria
FTRREEVLRSME

SEQ ID NO: 903 - protein, 5 aa, Neisseria
WRGTA

SEQ ID NO: 904 - protein, 13 aa, Neisseria
ATNPQARRETLEM

SEQ ID NO: 905 - protein, 5 aa, Neisseria
APYRV

SEQ ID NO: 906 - protein, 10 aa, Neisseria
LDPWKDPQGA

SEQ ID NO: 907 - protein, 12 aa, Neisseria
GLGASLSKRGFL

SEQ ID NO: 908 - protein, 10 aa, Neisseria
SIGKQSRDLG

SEQ ID NO: 909 - protein, 6 aa, Neisseria
LPTKGL

SEQ ID NO: 910 - protein, 15 aa, Neisseria
IDYENRRKMRGYRVE

SEQ ID NO: 911 - protein, 7 aa, Neisseria
ASKEGGD

SEQ ID NO: 912 - protein, 7 aa, Neisseria
AGREING

SEQ ID NO: 913 - protein, 12 aa, Neisseria
FTRREEVLRSME

SEQ ID NO: 914 - protein, 10 aa, Neisseria
PQARRETLEM

SEQ ID NO: 915 - protein, 7 aa, Neisseria
PWKDPQG

SEQ ID NO: 916 - protein, 7 aa, Neisseria
LSKRGFL

SEQ ID NO: 917 - protein, 6 aa, Neisseria
KQSRDL

SEQ ID NO: 918 - protein, 15 aa, Neisseria
IDYENRRKMRGYRVE

SEQ ID NO: 919 - protein, 6 aa, Neisseria
VADSLR

SEQ ID NO: 920 - protein, 10 aa, Neisseria
QTVREAQRII

SEQ ID NO: 921 - protein, 17 aa, Neisseria
GFGGFVTFPGGLAAKLL

SEQ ID NO: 922 - protein, 20 aa, Neisseria
GLSNRHLSRWAKRVLYAFPK

SEQ ID NO: 923 - protein, 6 aa, Neisseria
VGNPVR

SEQ ID NO: 924 - protein, 9 aa, Neisseria
GADVLNKTV

SEQ ID NO: 925 - protein, 11 aa, Neisseria
VEFITDMVSAY

SEQ ID NO: 926 - protein, 8 aa, Neisseria
EKLAEILG

SEQ ID NO: 927 - protein, 5 aa, Neisseria
WAENA

SEQ ID NO: 928 - protein, 7 aa, Neisseria
DSLRARG

SEQ ID NO: 929 - protein, 17 aa, Neisseria
LGSKDSMEERIVPQYGI

SEQ ID NO: 930 - protein, 12 aa, Neisseria
KGVRGNGIKRKL

SEQ ID NO: 931 - protein, 14 aa, Neisseria
TVREAQRIIRKHRV

SEQ ID NO: 932 - protein, 11 aa, Neisseria
LSNRHLSRWAK

SEQ ID NO: 933 - protein, 7 aa, Neisseria
FSHEGGL

SEQ ID NO: 934 - protein, 8 aa, Neisseria
NPVRADIS

SEQ ID NO: 935 - protein, 12 aa, Neisseria
PAERFQGREGRL

SEQ ID NO: 936 - protein, 6 aa, Neisseria
VLNKTV

SEQ ID NO: 937 - protein, 19 aa, Neisseria
LPDNARPQMYHQSGRGKLG

SEQ ID NO: 938 - protein, 5 aa, Neisseria
ADYDA

SEQ ID NO: 939 - protein, 6 aa, Neisseria
GVKAEC

SEQ ID NO: 940 - protein, 7 aa, Neisseria
SAYRDAD

SEQ ID NO: 941 - protein, 8 aa, Neisseria
AVDDHQTA

SEQ ID NO: 942 - protein, 9 aa, Neisseria
QLTAEKLAE

SEQ ID NO: 943 - protein, 9 aa, Neisseria
GLNREKCLK

SEQ ID NO: 944 - protein, 6 aa, Neisseria
AENART

SEQ ID NO: 945 - protein, 8 aa, Neisseria
HSADDVAE

SEQ ID NO: 946 - protein, 7 aa, Neisseria
DSLRARG

SEQ ID NO: 947 - protein, 10 aa, Neisseria
SKDSMEERIV

SEQ ID NO: 948 - protein, 7 aa, Neisseria
NGIKRKL

SEQ ID NO: 949 - protein, 14 aa, Neisseria
TVREAQRIIRKHRV

SEQ ID NO: 950 - protein, 7 aa, Neisseria
HLSRWAK

SEQ ID NO: 951 - protein, 5 aa, Neisseria
VRADI

SEQ ID NO: 952 - protein, 12 aa, Neisseria
PAERFQGREGRL

SEQ ID NO: 953 - protein, 6 aa, Neisseria
SGRGKL

SEQ ID NO: 954 - protein, 6 aa, Neisseria
GVKAEC

SEQ ID NO: 955 - protein, 7 aa, Neisseria
SAYRDAD

SEQ ID NO: 956 - protein, 8 aa, Neisseria
AVDDHQTA

SEQ ID NO: 957 - protein, 8 aa, Neisseria
LTAEKLAE

SEQ ID NO: 958 - protein, 8 aa, Neisseria
LNREKCLK

SEQ ID NO: 959 - protein, 5 aa, Neisseria
AENAR

SEQ ID NO: 960 - protein, 8 aa, Neisseria
HSADDVAE

SEQ ID NO: 961 - protein, 16 aa, Neisseria
HFSNWLTGLNIFQYTT

SEQ ID NO: 962 - protein, 7 aa, Neisseria
RAVMAAL

SEQ ID NO: 963 - protein, 12 aa, Neisseria
TIRRLTALKCGQ

SEQ ID NO: 964 - protein, 7 aa, Neisseria
LWGNWAN

SEQ ID NO: 965 - protein, 11 aa, Neisseria
GFYDDWRKVVY

SEQ ID NO: 966 - protein, 8 aa, Neisseria
AIIASLAL

SEQ ID NO: 967 - protein, 10 aa, Neisseria
GFLVLSYLTI

SEQ ID NO: 968 - protein, 16 aa, Neisseria
TSNAVNLTDGLDGLAT

SEQ ID NO: 969 - protein, 12 aa, Neisseria
HSQFAQYLQLPY

SEQ ID NO: 970 - protein, 9 aa, Neisseria
AMCGACLGF

SEQ ID NO: 971 - protein, 15 aa, Neisseria
TALKCGQAVRTDGPQ

SEQ ID NO: 972 - protein, 8 aa, Neisseria
VKNGTPTM

SEQ ID NO: 973 - protein, 18 aa, Neisseria
DDWRKVVYKDPNGVSAKF

SEQ ID NO: 974 - protein, 6 aa, Neisseria
LTDGLD

SEQ ID NO: 975 - protein, 7 aa, Neisseria
KKTKKRI

SEQ ID NO: 976 - protein, 11 aa, Neisseria
YEQKGWKETQV

SEQ ID NO: 977 - protein, 7 aa, Neisseria
VRTDGPQ

SEQ ID NO: 978 - protein, 14 aa, Neisseria
DDWRKVVYKDPNGV

SEQ ID NO: 979 - protein, 7 aa, Neisseria
KKTKKRI

SEQ ID NO: 980 - protein, 5 aa, Neisseria
KGWKE

SEQ ID NO: 981 - protein, 12 aa, Neisseria
FSTRCGRPWKVL

SEQ ID NO: 982 - protein, 13 aa, Neisseria
LAALCRPCNGMSC

SEQ ID NO: 983 - protein, 6 aa, Neisseria
SRPARF

SEQ ID NO: 984 - protein, 10 aa, Neisseria
MPPKITKSGF

SEQ ID NO: 985 - protein, 10 aa, Neisseria
FSTRCGRPWK

SEQ ID NO: 986 - protein, 15 aa, Neisseria
SSNASRDKPMASHKA

SEQ ID NO: 987 - protein, 8 aa, Neisseria
RPCNGMSC

SEQ ID NO: 988 - protein, 50 aa, Neisseria
CFRRPVSRSNQKSASCSNENHFTSRPARFIARQNASSAFKTCTPSPRKIL

SEQ ID NO: 989 - protein, 5 aa, Neisseria
RCGRP

SEQ ID NO: 990 - protein, 13 aa, Neisseria
NASRDKPMASHKA

SEQ ID NO: 991 - protein, 18 aa, Neisseria
CFRRPVSRSNQKSASCSN

SEQ ID NO: 992 - protein, 7 aa, Neisseria
RPARFIA

SEQ ID NO: 993 - protein, 7 aa, Neisseria
TPSPRKI

SEQ ID NO: 994 - protein, 12 aa, Neisseria
SQSLKRFDKHFR

SEQ ID NO: 995 - protein, 9 aa, Neisseria
SQSGAVGHI

SEQ ID NO: 996 - protein, 10 aa, Neisseria
ADFFHAVRQA

SEQ ID NO: 997 - protein, 11 aa, Neisseria
EGFDVFEQCFA

SEQ ID NO: 998 - protein, 7 aa, Neisseria
QTDGLTQ

SEQ ID NO: 999 - protein, 10 aa, Neisseria
VSGVVQTLQR

SEQ ID NO: 1000 - protein, 17 aa, Neisseria
LHRAAERIVRIQNLHAV

SEQ ID NO: 1001 - protein, 12 aa, Neisseria
IETVVQRIFQTA

SEQ ID NO: 1002 - protein, 9 aa, Neisseria
PVKHLTDLR

SEQ ID NO: 1003 - protein, 20 aa, Neisseria
NLRAVFAQVGNHGNTRTAES

SEQ ID NO: 1004 - protein, 13 aa, Neisseria
ASQSLKRFDKHFR

SEQ ID NO: 1005 - protein, 12 aa, Neisseria
HIKARAGGAEQH

SEQ ID NO: 1006 - protein, 7 aa, Neisseria
NGFSQSG

SEQ ID NO: 1007 - protein, 11 aa, Neisseria
ADLRRIDTNQE

SEQ ID NO: 1008 - protein, 6 aa, Neisseria
AQGREV

SEQ ID NO: 1009 - protein, 21 aa, Neisseria
QNHEERILQTGNRGGSRADIR

SEQ ID NO: 1010 - protein, 5 aa, Neisseria
QALEG

SEQ ID NO: 1011 - protein, 19 aa, Neisseria
FARQTDGLTQSHGSHDVSG

SEQ ID NO: 1012 - protein, 7 aa, Neisseria
NVLRDNQ

SEQ ID NO: 1013 - protein, 7 aa, Neisseria
FQRKPFY

SEQ ID NO: 1014 - protein, 8 aa, Neisseria
RAAERIVR

SEQ ID NO: 1015 - protein, 10 aa, Neisseria
QHRRRSRTQA

SEQ ID NO: 1016 - protein, 6 aa, Neisseria
EAGKLQ

SEQ ID NO: 1017 - protein, 15 aa, Neisseria
RLQNRRADIARDNGI

SEQ ID NO: 1018 - protein, 15 aa, Neisseria
PALDTEIADQARYRG

SEQ ID NO: 1019 - protein, 6 aa, Neisseria
AGNRNY

SEQ ID NO: 1020 - protein, 5 aa, Neisseria
VRQQF

SEQ ID NO: 1021 - protein, 9 aa, Neisseria
DAGTESQNI

SEQ ID NO: 1022 - protein, 16 aa, Neisseria
ARVKHQPVKHLTDLRH

SEQ ID NO: 1023 - protein, 7 aa, Neisseria
IIRSNLR

SEQ ID NO: 1024 - protein, 17 aa, Neisseria
GNHGNTRTAESGDEDFF

SEQ ID NO: 1025 - protein, 11 aa, Neisseria
QSLKRFDKHFR

SEQ ID NO: 1026 - protein, 12 aa, Neisseria
HIKARAGGAEQH

SEQ ID NO: 1027 - protein, 10 aa, Neisseria
ADLRRIDTNQ

SEQ ID NO: 1028 - protein, 6 aa, Neisseria
AQGREV

SEQ ID NO: 1029 - protein, 8 aa, Neisseria
QNHEERIL

SEQ ID NO: 1030 - protein, 11 aa, Neisseria
GNRGGSRADIR

SEQ ID NO: 1031 - protein, 7 aa, Neisseria
RQTDGLT

SEQ ID NO: 1032 - protein, 5 aa, Neisseria
GSHDV

SEQ ID NO: 1033 - protein, 7 aa, Neisseria
NVLRDNQ

SEQ ID NO: 1034 - protein, 8 aa, Neisseria
RAAERIVR

SEQ ID NO: 1035 - protein, 9 aa, Neisseria
QHRRRSRTQ

SEQ ID NO: 1036 - protein, 6 aa, Neisseria
EAGKLQ

SEQ ID NO: 1037 - protein, 14 aa, Neisseria
LQNRRADIARDNGI

SEQ ID NO: 1038 - protein, 12 aa, Neisseria
LDTEIADQARYR

SEQ ID NO: 1039 - protein, 8 aa, Neisseria
AGTESQNI

SEQ ID NO: 1040 - protein, 7 aa, Neisseria
ARVKHQP

SEQ ID NO: 1041 - protein, 7 aa, Neisseria
HLTDLRH

SEQ ID NO: 1042 - protein, 6 aa, Neisseria
IIRSNL

SEQ ID NO: 1043 - protein, 14 aa, Neisseria
GNTRTAESGDEDFF

SEQ ID NO: 1044 - protein, 9 aa, Neisseria
PLSDGIASC

SEQ ID NO: 1045 - protein, 8 aa, Neisseria
ITRLQALV

SEQ ID NO: 1046 - protein, 11 aa, Neisseria
VLVSVLTSLAK

SEQ ID NO: 1047 - protein, 17 aa, Neisseria
LSRRCPPLPKPLSDGIA

SEQ ID NO: 1048 - protein, 13 aa, Neisseria
LRCRLPKPSDRFD

SEQ ID NO: 1049 - protein, 17 aa, Neisseria
LDNPLRCRLPIPSDRFG

SEQ ID NO: 1050 - protein, 8 aa, Neisseria
LSRRCPPL

SEQ ID NO: 1051 - protein, 11 aa, Neisseria
CRLPKPSDRFD

SEQ ID NO: 1052 - protein, 5 aa, Neisseria
NPLRC

SEQ ID NO: 1053 - protein, 6 aa, Neisseria
IPSDRF

SEQ ID NO: 1054 - protein, 10 aa, Neisseria
GMSGIAEVLH

SEQ ID NO: 1055 - protein, 9 aa, Neisseria
ARNAATEHL

SEQ ID NO: 1056 - protein, 8 aa, Neisseria
HTAEHVNG

SEQ ID NO: 1057 - protein, 5 aa, Neisseria
VAALE

SEQ ID NO: 1058 - protein, 8 aa, Neisseria
AELMRFRD

SEQ ID NO: 1059 - protein, 12 aa, Neisseria
LTPIMSVVTNID

SEQ ID NO: 1060 - protein, 19 aa, Neisseria
TYGHSVEKLHQAFIDFIHR

SEQ ID NO: 1061 - protein, 13 aa, Neisseria
HVRAILPKVSKPY

SEQ ID NO: 1062 - protein, 8 aa, Neisseria
TYGLDDTA

SEQ ID NO: 1063 - protein, 9 aa, Neisseria
NVLNALAAI

SEQ ID NO: 1064 - protein, 7 aa, Neisseria
VEAIQKG

SEQ ID NO: 1065 - protein, 11 aa, Neisseria
GRRFQKYGDIK

SEQ ID NO: 1066 - protein, 22 aa, Neisseria
RYTRTRDLFEDFTKVLNTVDAL

SEQ ID NO: 1067 - protein, 11 aa, Neisseria
LARAIRVLGKL

SEQ ID NO: 1068 - protein, 13 aa, Neisseria
CENVADLPEMLLN

SEQ ID NO: 1069 - protein, 10 aa, Neisseria
LWRANGQPFK

SEQ ID NO: 1070 - protein, 19 aa, Neisseria
TPLRIENPPERNIMMKNRV

SEQ ID NO: 1071 - protein, 11 aa, Neisseria
VSGSDQARNAA

SEQ ID NO: 1072 - protein, 9 aa, Neisseria
AVKKENPEV

SEQ ID NO: 1073 - protein, 7 aa, Neisseria
MRFRDGI

SEQ ID NO: 1074 - protein, 8 aa, Neisseria
GTHGKTTT

SEQ ID NO: 1075 - protein, 11 aa, Neisseria
GTNARLGKGEY

SEQ ID NO: 1076 - protein, 7 aa, Neisseria
EADESDA

SEQ ID NO: 1077 - protein, 11 aa, Neisseria
NIDEDHMDTYG

SEQ ID NO: 1078 - protein, 6 aa, Neisseria
SVEKLH

SEQ ID NO: 1079 - protein, 6 aa, Neisseria
IDSEHV

SEQ ID NO: 1080 - protein, 10 aa, Neisseria
ILPKVSKPYA

SEQ ID NO: 1081 - protein, 7 aa, Neisseria
GLDDTAD

SEQ ID NO: 1082 - protein, 7 aa, Neisseria
DIENVGA

SEQ ID NO: 1083 - protein, 9 aa, Neisseria
MKGHEQGSF

SEQ ID NO: 1084 - protein, 18 aa, Neisseria
GVGRRFQKYGDIKLPNGG

SEQ ID NO: 1085 - protein, 7 aa, Neisseria
DDYGHHP

SEQ ID NO: 1086 - protein, 7 aa, Neisseria
AYLEKRL

SEQ ID NO: 1087 - protein, 17 aa, Neisseria
QPHRYTRTRDLFEDFTK

SEQ ID NO: 1088 - protein, 17 aa, Neisseria
AAGEEPIAAADSRALAR

SEQ ID NO: 1089 - protein, 6 aa, Neisseria
NVADLP

SEQ ID NO: 1090 - protein, 6 aa, Neisseria
LQDGDI

SEQ ID NO: 1091 - protein, 6 aa, Neisseria
GAGSIN

SEQ ID NO: 1092 - protein, 18 aa, Neisseria
PLRIENPPERNIMMKNRV

SEQ ID NO: 1093 - protein, 10 aa, Neisseria
SGSDQARNAA

SEQ ID NO: 1094 - protein, 8 aa, Neisseria
AVKKENPE

SEQ ID NO: 1095 - protein, 5 aa, Neisseria
MRFRD

SEQ ID NO: 1096 - protein, 5 aa, Neisseria
HGKTT

SEQ ID NO: 1097 - protein, 7 aa, Neisseria
ARLGKGE

SEQ ID NO: 1098 - protein, 7 aa, Neisseria
EADESDA

SEQ ID NO: 1099 - protein, 8 aa, Neisseria
NIDEDHMD

SEQ ID NO: 1100 - protein, 6 aa, Neisseria
SVEKLH

SEQ ID NO: 1101 - protein, 5 aa, Neisseria
DSEHV

SEQ ID NO: 1102 - protein, 7 aa, Neisseria
GLDDTAD

SEQ ID NO: 1103 - protein, 7 aa, Neisseria
KGHEQGS

SEQ ID NO: 1104 - protein, 8 aa, Neisseria
GVGRRFQK

SEQ ID NO: 1105 - protein, 5 aa, Neisseria
GDIKL

SEQ ID NO: 1106 - protein, 7 aa, Neisseria
AYLEKRL

SEQ ID NO: 1107 - protein, 14 aa, Neisseria
RYTRTRDLFEDFTK

SEQ ID NO: 1108 - protein, 17 aa, Neisseria
AAGEEPIAAADSRALAR

SEQ ID NO: 1109 - protein, 6 aa, Neisseria
NVADLP

SEQ ID NO: 1110 - protein, 5 aa, Neisseria
QDGDI

SEQ ID NO: 1111 - protein, 5 aa, Neisseria
TAILN

SEQ ID NO: 1112 - protein, 8 aa, Neisseria
TAFNILHG

SEQ ID NO: 1113 - protein, 10 aa, Neisseria
KSVYEELKHL

SEQ ID NO: 1114 - protein, 9 aa, Neisseria
IHIIPATEF

SEQ ID NO: 1115 - protein, 5 aa, Neisseria
FLKDT

SEQ ID NO: 1116 - protein, 9 aa, Neisseria
INTLPGMTS

SEQ ID NO: 1117 - protein, 15 aa, Neisseria
GGFSSEREISLDSGT

SEQ ID NO: 1118 - protein, 7 aa, Neisseria
LKSKGID

SEQ ID NO: 1119 - protein, 16 aa, Neisseria
AFDPKETPLSELKAQG

SEQ ID NO: 1120 - protein, 9 aa, Neisseria
GTYGEDGAV

SEQ ID NO: 1121 - protein, 7 aa, Neisseria
GMDKYRC

SEQ ID NO: 1122 - protein, 14 aa, Neisseria
HDDTDFDAVEEKLG

SEQ ID NO: 1123 - protein, 7 aa, Neisseria
PAAEGSS

SEQ ID NO: 1124 - protein, 19 aa, Neisseria
KVKGKGRLKSVYEELKHLQ

SEQ ID NO: 1125 - protein, 9 aa, Neisseria
RFIGGGEYS

SEQ ID NO: 1126 - protein, 6 aa, Neisseria
NGKGLP

SEQ ID NO: 1127 - protein, 32 aa, Neisseria
EFYDYEAKYNRDDTIYQCPSEDLTEAEESLMR

SEQ ID NO: 1128 - protein, 6 aa, Neisseria
GAEGCV

SEQ ID NO: 1129 - protein, 8 aa, Neisseria
DFLKDTDG

SEQ ID NO: 1130 - protein, 5 aa, Neisseria
LPGMT

SEQ ID NO: 1131 - protein, 6 aa, Neisseria
VPKSAA

SEQ ID NO: 1132 - protein, 8 aa, Neisseria
SSEREISL

SEQ ID NO: 1133 - protein, 7 aa, Neisseria
LKSKGID

SEQ ID NO: 1134 - protein, 14 aa, Neisseria
AFDPKETPLSELKA

SEQ ID NO: 1135 - protein, 7 aa, Neisseria
YGEDGAV

SEQ ID NO: 1136 - protein, 7 aa, Neisseria
GMDKYRC

SEQ ID NO: 1137 - protein, 14 aa, Neisseria
HDDTDFDAVEEKLG

SEQ ID NO: 1138 - protein, 7 aa, Neisseria
PAAEGSS

SEQ ID NO: 1139 - protein, 19 aa, Neisseria
KVKGKGRLKSVYEELKHLQ

SEQ ID NO: 1140 - protein, 13 aa, Neisseria
YDYEAKYNRDDTI

SEQ ID NO: 1141 - protein, 14 aa, Neisseria
PSEDLTEAEESLMR

SEQ ID NO: 1142 - protein, 8 aa, Neisseria
DFLKDTDG

SEQ ID NO: 1143 - protein, 9 aa, Neisseria
LPPITKVGS

SEQ ID NO: 1144 - protein, 7 aa, Neisseria
FSFLTAV

SEQ ID NO: 1145 - protein, 8 aa, Neisseria
SPLPKRAL

SEQ ID NO: 1146 - protein, 11 aa, Neisseria
GSSPAAPRMEA

SEQ ID NO: 1147 - protein, 18 aa, Neisseria
MPSRKRINSANIRARGIT

SEQ ID NO: 1148 - protein, 6 aa, Neisseria
LPKRAL

SEQ ID NO: 1149 - protein, 7 aa, Neisseria
AAPRMEA

SEQ ID NO: 1150 - protein, 7 aa, Neisseria
PSRKRIN

SEQ ID NO: 1151 - protein, 6 aa, Neisseria
NIRARG

SEQ ID NO: 1152 - protein, 18 aa, Neisseria
CASNLFRQCQQRGGDAVD

SEQ ID NO: 1153 - protein, 18 aa, Neisseria
VLQNVQQHFGQIGNVFAV

SEQ ID NO: 1154 - protein, 22 aa, Neisseria
FGQHQRVNGIEDFGKVFKQIAR

SEQ ID NO: 1155 - protein, 10 aa, Neisseria
GRRHFDGVVS

SEQ ID NO: 1156 - protein, 24 aa, Neisseria
FLDRFNRCADFQRHADGCQCVQHV

SEQ ID NO: 1157 - protein, 5 aa, Neisseria
QHDFK

SEQ ID NO: 1158 - protein, 12 aa, Neisseria
DVGGIVQTVSSI

SEQ ID NO: 1159 - protein, 16 aa, Neisseria
TVDEIDKRLMQFFDAV

SEQ ID NO: 1160 - protein, 7 aa, Neisseria
GCIRLVG

SEQ ID NO: 1161 - protein, 17 aa, Neisseria
NGDAVTEAHQLRQHQGA

SEQ ID NO: 1162 - protein, 12 aa, Neisseria
DDIRTVNVFGGM

SEQ ID NO: 1163 - protein, 13 aa, Neisseria
MLGSGISRLIRTG

SEQ ID NO: 1164 - protein, 13 aa, Neisseria
AQIVQDFGDAAHA

SEQ ID NO: 1165 - protein, 8 aa, Neisseria
SGGCASNL

SEQ ID NO: 1166 - protein, 17 aa, Neisseria
QCQQRGGDAVDASRAHI

SEQ ID NO: 1167 - protein, 19 aa, Neisseria
QHADGAGKSAGIGGGNRLF

SEQ ID NO: 1168 - protein, 13 aa, Neisseria
QHQRVNGIEDFGK

SEQ ID NO: 1169 - protein, 7 aa, Neisseria
VRLEGEY

SEQ ID NO: 1170 - protein, 12 aa, Neisseria
ACGGKGRRHFDG

SEQ ID NO: 1171 - protein, 8 aa, Neisseria
VHQERGPA

SEQ ID NO: 1172 - protein, 12 aa, Neisseria
AAADAFKAEQAF

SEQ ID NO: 1173 - protein, 17 aa, Neisseria
DRFNRCADFQRHADGCQ

SEQ ID NO: 1174 - protein, 5 aa, Neisseria
HDFKR

SEQ ID NO: 1175 - protein, 7 aa, Neisseria
GQNRADV

SEQ ID NO: 1176 - protein, 8 aa, Neisseria
NTQKGFAV

SEQ ID NO: 1177 - protein, 10 aa, Neisseria
HTVDEIDKRL

SEQ ID NO: 1178 - protein, 15 aa, Neisseria
IGNDGHNRCQVQKGC

SEQ ID NO: 1179 - protein, 37 aa, Neisseria
FAADNESRVKSCRAEDGGGQAGGRGFAVRAGNGDAVT

SEQ ID NO: 1180 - protein, 14 aa, Neisseria
HQLRQHQGARNNGN

SEQ ID NO: 1181 - protein, 8 aa, Neisseria
LQRSDNFG

SEQ ID NO: 1182 - protein, 12 aa, Neisseria
FDGGRGNDDIRT

SEQ ID NO: 1183 - protein, 9 aa, Neisseria
RLIRTGNFK

SEQ ID NO: 1184 - protein, 15 aa, Neisseria
AHADAADTDKMDVGN

SEQ ID NO: 1185 - protein, 16 aa, Neisseria
CQQRGGDAVDASRAHI

SEQ ID NO: 1186 - protein, 9 aa, Neisseria
ADGAGKSAG

SEQ ID NO: 1187 - protein, 8 aa, Neisseria
NGIEDFGK

SEQ ID NO: 1188 - protein, 7 aa, Neisseria
VRLEGEY

SEQ ID NO: 1189 - protein, 9 aa, Neisseria
CGGKGRRHF

SEQ ID NO: 1190 - protein, 6 aa, Neisseria
HQERGP

SEQ ID NO: 1191 - protein, 12 aa, Neisseria
AAADAFKAEQAF

SEQ ID NO: 1192 - protein, 9 aa, Neisseria
ADFQRHADG

SEQ ID NO: 1193 - protein, 5 aa, Neisseria
HDFKR

SEQ ID NO: 1194 - protein, 10 aa, Neisseria
HTVDEIDKRL

SEQ ID NO: 1195 - protein, 11 aa, Neisseria
IGNDGHNRCQV

SEQ ID NO: 1196 - protein, 19 aa, Neisseria
FAADNESRVKSCRAEDGGG

SEQ ID NO: 1197 - protein, 8 aa, Neisseria
AGNGDAVT

SEQ ID NO: 1198 - protein, 13 aa, Neisseria
HQLRQHQGARNNG

SEQ ID NO: 1199 - protein, 5 aa, Neisseria
QRSDN

SEQ ID NO: 1200 - protein, 10 aa, Neisseria
GGRGNDDIRT

SEQ ID NO: 1201 - protein, 13 aa, Neisseria
AHADAADTDKMDV

SEQ ID NO: 1202 - protein, 9 aa, Neisseria
GIFEEIDAH

SEQ ID NO: 1203 - protein, 5 aa, Neisseria
AANRQ

SEQ ID NO: 1204 - protein, 5 aa, Neisseria
GVVAV

SEQ ID NO: 1205 - protein, 8 aa, Neisseria
QFFVNAFQ

SEQ ID NO: 1206 - protein, 8 aa, Neisseria
AYAAAFGR

SEQ ID NO: 1207 - protein, 5 aa, Neisseria
NQFAA

SEQ ID NO: 1208 - protein, 10 aa, Neisseria
DTAAGIGNAQ

SEQ ID NO: 1209 - protein, 5 aa, Neisseria
QWGFF

SEQ ID NO: 1210 - protein, 9 aa, Neisseria
MARHTGQGV

SEQ ID NO: 1211 - protein, 5 aa, Neisseria
EEIDA

SEQ ID NO: 1212 - protein, 10 aa, Neisseria
FRTDCLRAAN

SEQ ID NO: 1213 - protein, 8 aa, Neisseria
GCGNDVYA

SEQ ID NO: 1214 - protein, 5 aa, Neisseria
VQDGA

SEQ ID NO: 1215 - protein, 8 aa, Neisseria
AADKTFGN

SEQ ID NO: 1216 - protein, 7 aa, Neisseria
RFHKHRQ

SEQ ID NO: 1217 - protein, 14 aa, Neisseria
VQDGELGNGQSQCL

SEQ ID NO: 1218 - protein, 8 aa, Neisseria
ADGGCGDT

SEQ ID NO: 1219 - protein, 9 aa, Neisseria
TVKDVECRL

SEQ ID NO: 1220 - protein, 7 aa, Neisseria
MARHTGQ

SEQ ID NO: 1221 - protein, 5 aa, Neisseria
EEIDA

SEQ ID NO: 1222 - protein, 7 aa, Neisseria
DCLRAAN

SEQ ID NO: 1223 - protein, 7 aa, Neisseria
AADKTFG

SEQ ID NO: 1224 - protein, 7 aa, Neisseria
RFHKHRQ

SEQ ID NO: 1225 - protein, 7 aa, Neisseria
QDGELGN

SEQ ID NO: 1226 - protein, 6 aa, Neisseria
GGCGDT

SEQ ID NO: 1227 - protein, 9 aa, Neisseria
TVKDVECRL

SEQ ID NO: 1228 - protein, 13 aa, Neisseria
AGLTTFLTMCYIV

SEQ ID NO: 1229 - protein, 5 aa, Neisseria
MGFVG

SEQ ID NO: 1230 - protein, 20 aa, Neisseria
ATLVGLGDIHQPSALLALFG

SEQ ID NO: 1231 - protein, 24 aa, Neisseria
TITVIASLMGLNEFHGIIGEVPSI

SEQ ID NO: 1232 - protein, 5 aa, Neisseria
LFTVS

SEQ ID NO: 1233 - protein, 7 aa, Neisseria
FDSTGTL

SEQ ID NO: 1234 - protein, 10 aa, Neisseria
LAKSVPAFAT

SEQ ID NO: 1235 - protein, 8 aa, Neisseria
MLRSARDI

SEQ ID NO: 1236 - protein, 8 aa, Neisseria
MDTSKQTL

SEQ ID NO: 1237 - protein, 14 aa, Neisseria
FKLKANGTTVRTEL

SEQ ID NO: 1238 - protein, 6 aa, Neisseria
KVREML

SEQ ID NO: 1239 - protein, 5 aa, Neisseria
FDSTG

SEQ ID NO: 1240 - protein, 10 aa, Neisseria
VDGKLPRLKR

SEQ ID NO: 1241 - protein, 7 aa, Neisseria
SAGGRTG

SEQ ID NO: 1242 - protein, 13 aa, Neisseria
RSARDIDWDDMTE

SEQ ID NO: 1243 - protein, 10 aa, Neisseria
LCRRTKDVPP

SEQ ID NO: 1244 - protein, 5 aa, Neisseria
MDTSK

SEQ ID NO: 1245 - protein, 11 aa, Neisseria
KANGTTVRTEL

SEQ ID NO: 1246 - protein, 6 aa, Neisseria
KVREML

SEQ ID NO: 1247 - protein, 8 aa, Neisseria
GKLPRLKR

SEQ ID NO: 1248 - protein, 5 aa, Neisseria
AGGRT

SEQ ID NO: 1249 - protein, 13 aa, Neisseria
RSARDIDWDDMTE

SEQ ID NO: 1250 - protein, 9 aa, Neisseria
LCRRTKDVP

SEQ ID NO: 1251 - protein, 10 aa, Neisseria
AEAGDQFVGD

SEQ ID NO: 1252 - protein, 9 aa, Neisseria
VGDFFKLAF

SEQ ID NO: 1253 - protein, 15 aa, Neisseria
CQIQNVVTAIAQIVA

SEQ ID NO: 1254 - protein, 7 aa, Neisseria
LSSFSHG

SEQ ID NO: 1255 - protein, 13 aa, Neisseria
VQEDAAEAGDQFV

SEQ ID NO: 1256 - protein, 5 aa, Neisseria
MGMCR

SEQ ID NO: 1257 - protein, 9 aa, Neisseria
FNHTDRQAA

SEQ ID NO: 1258 - protein, 20 aa, Neisseria
TANGTQSGITGRNARKRNGF

SEQ ID NO: 1259 - protein, 13 aa, Neisseria
FEGRGLSSFSHGI

SEQ ID NO: 1260 - protein, 9 aa, Neisseria
VFRRPMRIC

SEQ ID NO: 1261 - protein, 10 aa, Neisseria
VQEDAAEAGD

SEQ ID NO: 1262 - protein, 7 aa, Neisseria
NHTDRQA

SEQ ID NO: 1263 - protein, 11 aa, Neisseria
ITGRNARKRNG

SEQ ID NO: 1264 - protein, 5 aa, Neisseria
FEGRG

SEQ ID NO: 1265 - protein, 7 aa, Neisseria
VFRRPMR

SEQ ID NO: 1266 - protein, 8 aa, Neisseria
SMMRLPDI

SEQ ID NO: 1267 - protein, 9 aa, Neisseria
AFVEFFGEG

SEQ ID NO: 1268 - protein, 9 aa, Neisseria
KLVETYAKT

SEQ ID NO: 1269 - protein, 8 aa, Neisseria
WADALKTA

SEQ ID NO: 1270 - protein, 9 aa, Neisseria
TRNMAGPSN

SEQ ID NO: 1271 - protein, 15 aa, Neisseria
AAKGLAKPYEEPSDG

SEQ ID NO: 1272 - protein, 15 aa, Neisseria
AAITSCTNTSNPRNV

SEQ ID NO: 1273 - protein, 6 aa, Neisseria
TCNGMS

SEQ ID NO: 1274 - protein, 19 aa, Neisseria
IDAVVAEYVKPQQFRDVYV

SEQ ID NO: 1275 - protein, 8 aa, Neisseria
PSPLYDWR

SEQ ID NO: 1276 - protein, 5 aa, Neisseria
STYIR

SEQ ID NO: 1277 - protein, 9 aa, Neisseria
RTLRGMRPL

SEQ ID NO: 1278 - protein, 7 aa, Neisseria
DFNSYAT

SEQ ID NO: 1279 - protein, 6 aa, Neisseria
FNEMVK

SEQ ID NO: 1280 - protein, 11 aa, Neisseria
MRMWEAIETYM

SEQ ID NO: 1281 - protein, 5 aa, Neisseria
RLAGV

SEQ ID NO: 1282 - protein, 13 aa, Neisseria
IVAEGFERIHRTN

SEQ ID NO: 1283 - protein, 5 aa, Neisseria
GTETY

SEQ ID NO: 1284 - protein, 9 aa, Neisseria
ELNGKRQAG

SEQ ID NO: 1285 - protein, 8 aa, Neisseria
FLRKERVV

SEQ ID NO: 1286 - protein, 6 aa, Neisseria
GEGARS

SEQ ID NO: 1287 - protein, 7 aa, Neisseria
SIGDRAT

SEQ ID NO: 1288 - protein, 5 aa, Neisseria
MTPEF

SEQ ID NO: 1289 - protein, 5 aa, Neisseria
IDEQT

SEQ ID NO: 1290 - protein, 10 aa, Neisseria
TGRDDAQVKL

SEQ ID NO: 1291 - protein, 13 aa, Neisseria
SVTRNMAGPSNPH

SEQ ID NO: 1292 - protein, 17 aa, Neisseria
GLAKPYEEPSDGQMPDG

SEQ ID NO: 1293 - protein, 10 aa, Neisseria
CTNTSNPRNV

SEQ ID NO: 1294 - protein, 13 aa, Neisseria
NANRLGLKRKPWV

SEQ ID NO: 1295 - protein, 9 aa, Neisseria
SFAPGSKVA

SEQ ID NO: 1296 - protein, 6 aa, Neisseria
PEMEKL

SEQ ID NO: 1297 - protein, 23 aa, Neisseria
TCNGMSGALDPKIQKEIIDRDLY

SEQ ID NO: 1298 - protein, 15 aa, Neisseria
SGNRNFDGRIHPYAK

SEQ ID NO: 1299 - protein, 9 aa, Neisseria
IRFDIENDV

SEQ ID NO: 1300 - protein, 12 aa, Neisseria
GVADGKEIRLKD

SEQ ID NO: 1301 - protein, 10 aa, Neisseria
WPADEEIDAV

SEQ ID NO: 1302 - protein, 10 aa, Neisseria
YVKPQQFRDV

SEQ ID NO: 1303 - protein, 28 aa, Neisseria
DTGTAQKAPSPLYDWRPMSTYIRRPPYW

SEQ ID NO: 1304 - protein, 11 aa, Neisseria
LAGERTLRGMR

SEQ ID NO: 1305 - protein, 14 aa, Neisseria
LPDNITTDHLSPSN

SEQ ID NO: 1306 - protein, 19 aa, Neisseria
GLPEEDFNSYATHRGDHLT

SEQ ID NO: 1307 - protein, 6 aa, Neisseria
ANPKLF

SEQ ID NO: 1308 - protein, 23 aa, Neisseria
MVKNEDGSVRQGSFARVEPEGET

SEQ ID NO: 1309 - protein, 7 aa, Neisseria
YMNRKQP

SEQ ID NO: 1310 - protein, 17 aa, Neisseria
ADYGQGSSRDWAAKGVR

SEQ ID NO: 1311 - protein, 10 aa, Neisseria
GFERIHRTNL

SEQ ID NO: 1312 - protein, 8 aa, Neisseria
FKPDTNRH

SEQ ID NO: 1313 - protein, 21 aa, Neisseria
LQLDGTETYDVVGERTPRCDL

SEQ ID NO: 1314 - protein, 10 aa, Neisseria
IHRKNGETVE

SEQ ID NO: 1315 - protein, 5 aa, Neisseria
DTAEE

SEQ ID NO: 1316 - protein, 8 aa, Neisseria
LNGKRQAG

SEQ ID NO: 1317 - protein, 8 aa, Neisseria
FLRKERVV

SEQ ID NO: 1318 - protein, 5 aa, Neisseria
GEGAR

SEQ ID NO: 1319 - protein, 7 aa, Neisseria
SIGDRAT

SEQ ID NO: 1320 - protein, 5 aa, Neisseria
IDEQT

SEQ ID NO: 1321 - protein, 10 aa, Neisseria
TGRDDAQVKL

SEQ ID NO: 1322 - protein, 16 aa, Neisseria
GLAKPYEEPSDGQMPD

SEQ ID NO: 1323 - protein, 9 aa, Neisseria
LGLKRKPWV

SEQ ID NO: 1324 - protein, 6 aa, Neisseria
PEMEKL

SEQ ID NO: 1325 - protein, 15 aa, Neisseria
LDPKIQKEIIDRDLY

SEQ ID NO: 1326 - protein, 7 aa, Neisseria
RNFDGRI

SEQ ID NO: 1327 - protein, 9 aa, Neisseria
IRFDIENDV

SEQ ID NO: 1328 - protein, 10 aa, Neisseria
ADGKEIRLKD

SEQ ID NO: 1329 - protein, 10 aa, Neisseria
WPADEEIDAV

SEQ ID NO: 1330 - protein, 6 aa, Neisseria
TAQKAP

SEQ ID NO: 1331 - protein, 11 aa, Neisseria
LAGERTLRGMR

SEQ ID NO: 1332 - protein, 8 aa, Neisseria
GLPEEDFN

SEQ ID NO: 1333 - protein, 5 aa, Neisseria
HRGDH

SEQ ID NO: 1334 - protein, 10 aa, Neisseria
MVKNEDGSVR

SEQ ID NO: 1335 - protein, 9 aa, Neisseria
ARVEPEGET

SEQ ID NO: 1336 - protein, 7 aa, Neisseria
YMNRKQP

SEQ ID NO: 1337 - protein, 15 aa, Neisseria
YGQGSSRDWAAKGVR

SEQ ID NO: 1338 - protein, 7 aa, Neisseria
GFERIHR

SEQ ID NO: 1339 - protein, 8 aa, Neisseria
FKPDTNRH

SEQ ID NO: 1340 - protein, 5 aa, Neisseria
DGTET

SEQ ID NO: 1341 - protein, 11 aa, Neisseria
DVVGERTPRCD

SEQ ID NO: 1342 - protein, 9 aa, Neisseria
HRKNGETVE

SEQ ID NO: 1343 - protein, 5 aa, Neisseria
DTAEE

SEQ ID NO: 1344 - protein, 8 aa, Neisseria
PGSYDKLP

SEQ ID NO: 1345 - protein, 9 aa, Neisseria
PTLQSWLGQ

SEQ ID NO: 1346 - protein, 11 aa, Neisseria
TALVDLAGLRD

SEQ ID NO: 1347 - protein, 9 aa, Neisseria
KGGDPAKVN

SEQ ID NO: 1348 - protein, 5 aa, Neisseria
AFRKN

SEQ ID NO: 1349 - protein, 5 aa, Neisseria
DSLGV

SEQ ID NO: 1350 - protein, 9 aa, Neisseria
ASMMRLPDI

SEQ ID NO: 1351 - protein, 9 aa, Neisseria
AFVEFFGEG

SEQ ID NO: 1352 - protein, 9 aa, Neisseria
KLVETYAKT

SEQ ID NO: 1353 - protein, 8 aa, Neisseria
WADALKTA

SEQ ID NO: 1354 - protein, 9 aa, Neisseria
TRNMAGPSN

SEQ ID NO: 1355 - protein, 15 aa, Neisseria
AAKGLAKPYEEPSDG

SEQ ID NO: 1356 - protein, 15 aa, Neisseria
AAITSCTNTSNPRNV

SEQ ID NO: 1357 - protein, 6 aa, Neisseria
TCNGMS

SEQ ID NO: 1358 - protein, 19 aa, Neisseria
IDAVVAEYVKPQQFRDVYV

SEQ ID NO: 1359 - protein, 8 aa, Neisseria
PSPLYDWR

SEQ ID NO: 1360 - protein, 5 aa, Neisseria
STYIR

SEQ ID NO: 1361 - protein, 9 aa, Neisseria
RTLRGMRPL

SEQ ID NO: 1362 - protein, 7 aa, Neisseria
DFNSYAT

SEQ ID NO: 1363 - protein, 6 aa, Neisseria
FNEMVK

SEQ ID NO: 1364 - protein, 11 aa, Neisseria
MRMWEAIETYM

SEQ ID NO: 1365 - protein, 5 aa, Neisseria
RLAGV

SEQ ID NO: 1366 - protein, 13 aa, Neisseria
IVAEGFERIHRTN

SEQ ID NO: 1367 - protein, 5 aa, Neisseria
GTETY

SEQ ID NO: 1368 - protein, 18 aa, Neisseria
ANQRYRKPLPGTDLEYYD

SEQ ID NO: 1369 - protein, 17 aa, Neisseria
RAACEDIKPGSYDKLPY

SEQ ID NO: 1370 - protein, 11 aa, Neisseria
LVNRADKVDLP

SEQ ID NO: 1371 - protein, 7 aa, Neisseria
IEGKQEI

SEQ ID NO: 1372 - protein, 16 aa, Neisseria
AGLRDAIAEKGGDPAK

SEQ ID NO: 1373 - protein, 24 aa, Neisseria
CGGYDPDAFRKNREIEDRRNEDRF

SEQ ID NO: 1374 - protein, 5 aa, Neisseria
TAFEN

SEQ ID NO: 1375 - protein, 6 aa, Neisseria
NLEKMS

SEQ ID NO: 1376 - protein, 14 aa, Neisseria
TCVGTDSHTPHVDS

SEQ ID NO: 1377 - protein, 7 aa, Neisseria
GGLEAET

SEQ ID NO: 1378 - protein, 9 aa, Neisseria
ELNGKRQAG

SEQ ID NO: 1379 - protein, 8 aa, Neisseria
FLRKERVV

SEQ ID NO: 1380 - protein, 6 aa, Neisseria
GEGARS

SEQ ID NO: 1381 - protein, 7 aa, Neisseria
SIGDRAT

SEQ ID NO: 1382 - protein, 5 aa, Neisseria
MTPEF

SEQ ID NO: 1383 - protein, 5 aa, Neisseria
IDEQT

SEQ ID NO: 1384 - protein, 10 aa, Neisseria
TGRDDAQVKL

SEQ ID NO: 1385 - protein, 13 aa, Neisseria
SVTRNMAGPSNPH

SEQ ID NO: 1386 - protein, 17 aa, Neisseria
GLAKPYEEPSDGQMPDG

SEQ ID NO: 1387 - protein, 10 aa, Neisseria
CTNTSNPRNV

SEQ ID NO: 1388 - protein, 13 aa, Neisseria
NANRLGLKRKPWV

SEQ ID NO: 1389 - protein, 9 aa, Neisseria
SFAPGSKVA

SEQ ID NO: 1390 - protein, 6 aa, Neisseria
PEMEKL

SEQ ID NO: 1391 - protein, 23 aa, Neisseria
TCNGMSGALDPKIQKEIIDRDLY

SEQ ID NO: 1392 - protein, 15 aa, Neisseria
SGNRNFDGRIHPYAK

SEQ ID NO: 1393 - protein, 9 aa, Neisseria
IRFDIENDV

SEQ ID NO: 1394 - protein, 12 aa, Neisseria
GVADGKEIRLKD

SEQ ID NO: 1395 - protein, 10 aa, Neisseria
WPADEEIDAV

SEQ ID NO: 1396 - protein, 10 aa, Neisseria
YVKPQQFRDV

SEQ ID NO: 1397 - protein, 28 aa, Neisseria
DTGTAQKAPSPLYDWRPMSTYIRRPPYW

SEQ ID NO: 1398 - protein, 11 aa, Neisseria
LAGERTLRGMR

SEQ ID NO: 1399 - protein, 14 aa, Neisseria
LPDNITTDHLSPSN

SEQ ID NO: 1400 - protein, 19 aa, Neisseria
GLPEEDFNSYATHRGDHLT

SEQ ID NO: 1401 - protein, 6 aa, Neisseria
ANPKLF

SEQ ID NO: 1402 - protein, 23 aa, Neisseria
MVKNEDGSVRQGSFARVEPEGET

SEQ ID NO: 1403 - protein, 7 aa, Neisseria
YMNRKQP

SEQ ID NO: 1404 - protein, 17 aa, Neisseria
ADYGQGSSRDWAAKGVR

SEQ ID NO: 1405 - protein, 10 aa, Neisseria
GFERIHRTNL

SEQ ID NO: 1406 - protein, 8 aa, Neisseria
FKPDTNRH

SEQ ID NO: 1407 - protein, 21 aa, Neisseria
LQLDGTETYDVVGERTPRCDL

SEQ ID NO: 1408 - protein, 10 aa, Neisseria
IHRKNGETVE

SEQ ID NO: 1409 - protein, 5 aa, Neisseria
DTAEE

SEQ ID NO: 1410 - protein, 8 aa, Neisseria
QRYRKPLP

SEQ ID NO: 1411 - protein, 13 aa, Neisseria
RAACEDIKPGSYD

SEQ ID NO: 1412 - protein, 10 aa, Neisseria
LVNRADKVDL

SEQ ID NO: 1413 - protein, 7 aa, Neisseria
IEGKQEI

SEQ ID NO: 1414 - protein, 16 aa, Neisseria
AGLRDAIAEKGGDPAK

SEQ ID NO: 1415 - protein, 23 aa, Neisseria
GGYDPDAFRKNREIEDRRNEDRF

SEQ ID NO: 1416 - protein, 6 aa, Neisseria
NLEKMS

SEQ ID NO: 1417 - protein, 6 aa, Neisseria
DSHTPH

SEQ ID NO: 1418 - protein, 5 aa, Neisseria
LEAET

SEQ ID NO: 1419 - protein, 8 aa, Neisseria
LNGKRQAG

SEQ ID NO: 1420 - protein, 8 aa, Neisseria
FLRKERVV

SEQ ID NO: 1421 - protein, 5 aa, Neisseria
GEGAR

SEQ ID NO: 1422 - protein, 7 aa, Neisseria
SIGDRAT

SEQ ID NO: 1423 - protein, 5 aa, Neisseria
IDEQT

SEQ ID NO: 1424 - protein, 10 aa, Neisseria
TGRDDAQVKL

SEQ ID NO: 1425 - protein, 16 aa, Neisseria
GLAKPYEEPSDGQMPD

SEQ ID NO: 1426 - protein, 9 aa, Neisseria
LGLKRKPWV

SEQ ID NO: 1427 - protein, 6 aa, Neisseria
PEMEKL

SEQ ID NO: 1428 - protein, 15 aa, Neisseria
LDPKIQKEIIDRDLY

SEQ ID NO: 1429 - protein, 7 aa, Neisseria
RNFDGRI

SEQ ID NO: 1430 - protein, 9 aa, Neisseria
IRFDIENDV

SEQ ID NO: 1431 - protein, 10 aa, Neisseria
ADGKEIRLKD

SEQ ID NO: 1432 - protein, 10 aa, Neisseria
WPADEEIDAV

SEQ ID NO: 1433 - protein, 6 aa, Neisseria
TAQKAP

SEQ ID NO: 1434 - protein, 11 aa, Neisseria
LAGERTLRGMR

SEQ ID NO: 1435 - protein, 8 aa, Neisseria
GLPEEDFN

SEQ ID NO: 1436 - protein, 7 aa, Neisseria
HRGDHLT

SEQ ID NO: 1437 - protein, 10 aa, Neisseria
MVKNEDGSVR

SEQ ID NO: 1438 - protein, 9 aa, Neisseria
ARVEPEGET

SEQ ID NO: 1439 - protein, 7 aa, Neisseria
YMNRKQP

SEQ ID NO: 1440 - protein, 15 aa, Neisseria
YGQGSSRDWAAKGVR

SEQ ID NO: 1441 - protein, 7 aa, Neisseria
GFERIHR

SEQ ID NO: 1442 - protein, 8 aa, Neisseria
FKPDTNRH

SEQ ID NO: 1443 - protein, 5 aa, Neisseria
DGTET

SEQ ID NO: 1444 - protein, 11 aa, Neisseria
DVVGERTPRCD

SEQ ID NO: 1445 - protein, 10 aa, Neisseria
IHRKNGETVE

SEQ ID NO: 1446 - protein, 5 aa, Neisseria
DTAEE

SEQ ID NO: 1447 - protein, 10 aa, Neisseria
VLLYTWFSML

SEQ ID NO: 1448 - protein, 23 aa, Neisseria
GASFDTMVKDLLGRGWNIINGIA

SEQ ID NO: 1449 - protein, 9 aa, Neisseria
TAKGLGSAA

SEQ ID NO: 1450 - protein, 10 aa, Neisseria
LVFFGILAFC

SEQ ID NO: 1451 - protein, 9 aa, Neisseria
LVDRFTGVL

SEQ ID NO: 1452 - protein, 5 aa, Neisseria
GMVLT

SEQ ID NO: 1453 - protein, 10 aa, Neisseria
NVSSLLKYFK

SEQ ID NO: 1454 - protein, 6 aa, Neisseria
KVAKSI

SEQ ID NO: 1455 - protein, 26 aa, Neisseria
VLIETLSKFAQTGNMDKILSLFSYMA

SEQ ID NO: 1456 - protein, 12 aa, Neisseria
FDYIADIFKWND

SEQ ID NO: 1457 - protein, 7 aa, Neisseria
FVTAIGY

SEQ ID NO: 1458 - protein, 9 aa, Neisseria
ATVWTGIIP

SEQ ID NO: 1459 - protein, 6 aa, Neisseria
GKTYKV

SEQ ID NO: 1460 - protein, 7 aa, Neisseria
MPNKTPS

SEQ ID NO: 1461 - protein, 5 aa, Neisseria
YPHGA

SEQ ID NO: 1462 - protein, 5 aa, Neisseria
LLGRG

SEQ ID NO: 1463 - protein, 13 aa, Neisseria
DLTAKGLGSAAGG

SEQ ID NO: 1464 - protein, 7 aa, Neisseria
ADAKPSV

SEQ ID NO: 1465 - protein, 7 aa, Neisseria
TQAPAGT

SEQ ID NO: 1466 - protein, 10 aa, Neisseria
YFKGDAPKVA

SEQ ID NO: 1467 - protein, 8 aa, Neisseria
GNLPRNEF

SEQ ID NO: 1468 - protein, 9 aa, Neisseria
AQTGNMDKI

SEQ ID NO: 1469 - protein, 12 aa, Neisseria
KWNDSISGRTKT

SEQ ID NO: 1470 - protein, 16 aa, Neisseria
LYRSRKKFGAGKTYKV

SEQ ID NO: 1471 - protein, 5 aa, Neisseria
MPNKT

SEQ ID NO: 1472 - protein, 5 aa, Neisseria
ADAKP

SEQ ID NO: 1473 - protein, 9 aa, Neisseria
FKGDAPKVA

SEQ ID NO: 1474 - protein, 6 aa, Neisseria
LPRNEF

SEQ ID NO: 1475 - protein, 5 aa, Neisseria
GNMDK

SEQ ID NO: 1476 - protein, 7 aa, Neisseria
ISGRTKT

SEQ ID NO: 1477 - protein, 8 aa, Neisseria
RSRKKFGA

SEQ ID NO: 1478 - protein, 5 aa, Neisseria
WIGLG

SEQ ID NO: 1479 - protein, 6 aa, Neisseria
VTRLLD

SEQ ID NO: 1480 - protein, 9 aa, Neisseria
KVYGNTAEL

SEQ ID NO: 1481 - protein, 14 aa, Neisseria
AAVCDILNGVRDGL

SEQ ID NO: 1482 - protein, 5 aa, Neisseria
TISPT

SEQ ID NO: 1483 - protein, 13 aa, Neisseria
VEAAGGQFAEAPV

SEQ ID NO: 1484 - protein, 11 aa, Neisseria
AVLNPLQKIFS

SEQ ID NO: 1485 - protein, 8 aa, Neisseria
FGDVGKGS

SEQ ID NO: 1486 - protein, 11 aa, Neisseria
NSLLGIFGEAY

SEQ ID NO: 1487 - protein, 9 aa, Neisseria
  VARIANT (1)...(9): Xaa is any amino acid
IVEAIGXSA

SEQ ID NO: 1488 - protein, 12 aa, Neisseria
LEQAGNTLPAVE

SEQ ID NO: 1489 - protein, 10 aa, Neisseria
AASYRKAVEA

SEQ ID NO: 1490 - protein, 7 aa, Neisseria
LLDGGIE

SEQ ID NO: 1491 - protein, 23 aa, Neisseria
VYNRSPDKTAPISAKGAKVYGNT

SEQ ID NO: 1492 - protein, 8 aa, Neisseria
NGVRDGLA

SEQ ID NO: 1493 - protein, 10 aa, Neisseria
STISPTENLA

SEQ ID NO: 1494 - protein, 10 aa, Neisseria
PVSGSVGPAT

SEQ ID NO: 1495 - protein, 5 aa, Neisseria
GGSEA

SEQ ID NO: 1496 - protein, 16 aa, Neisseria
VGKKTFHFGDVGKGSG

SEQ ID NO: 1497 - protein, 9 aa, Neisseria
FGIDTDTIV

SEQ ID NO: 1498 - protein, 21 aa, Neisseria
AMDSPMFQTKKSLWANREFPP

SEQ ID NO: 1499 - protein, 21 aa, Neisseria
HASKDLNLAVKELEQAGNTLP

SEQ ID NO: 1500 - protein, 18 aa, Neisseria
ASYRKAVEAGYGEQDVSG

SEQ ID NO: 1501 - protein, 6 aa, Neisseria
LLDGGI

SEQ ID NO: 1502 - protein, 15 aa, Neisseria
RSPDKTAPISAKGAK

SEQ ID NO: 1503 - protein, 8 aa, Neisseria
NGVRDGLA

SEQ ID NO: 1504 - protein, 7 aa, Neisseria
DVGKGSG

SEQ ID NO: 1505 - protein, 8 aa, Neisseria
FGIDTDTI

SEQ ID NO: 1506 - protein, 8 aa, Neisseria
QTKKSLWA

SEQ ID NO: 1507 - protein, 17 aa, Neisseria
HASKDLNLAVKELEQAG

SEQ ID NO: 1508 - protein, 7 aa, Neisseria
SYRKAVE

SEQ ID NO: 1509 - protein, 7 aa, Neisseria
GYGEQDV

SEQ ID NO: 1510 - protein, 12 aa, Neisseria
GTYRDLHRPASE

SEQ ID NO: 1511 - protein, 10 aa, Neisseria
LIPAMAGTIG

SEQ ID NO: 1512 - protein, 6 aa, Neisseria
AVAAAF

SEQ ID NO: 1513 - protein, 5 aa, Neisseria
GLLMA

SEQ ID NO: 1514 - protein, 7 aa, Neisseria
IMAKLTS

SEQ ID NO: 1515 - protein, 14 aa, Neisseria
GTTGQVKKLFSWAG

SEQ ID NO: 1516 - protein, 14 aa, Neisseria
VMYALLEHWKKRWL

SEQ ID NO: 1517 - protein, 8 aa, Neisseria
VPLGCLIA

SEQ ID NO: 1518 - protein, 7 aa, Neisseria
HQVFQKI

SEQ ID NO: 1519 - protein, 6 aa, Neisseria
VGSILG

SEQ ID NO: 1520 - protein, 6 aa, Neisseria
TSSWGT

SEQ ID NO: 1521 - protein, 18 aa, Neisseria
AVGMLPGIPPFLEHFKSL

SEQ ID NO: 1522 - protein, 16 aa, Neisseria
MEKHNGTYRDLHRPAS

SEQ ID NO: 1523 - protein, 9 aa, Neisseria
FATRDEYLE

SEQ ID NO: 1524 - protein, 19 aa, Neisseria
MQPKRWRPNLPFRDYRFEW

SEQ ID NO: 1525 - protein, 5 aa, Neisseria
LGLPD

SEQ ID NO: 1526 - protein, 9 aa, Neisseria
PGANLPGTH

SEQ ID NO: 1527 - protein, 6 aa, Neisseria
LTSNGV

SEQ ID NO: 1528 - protein, 6 aa, Neisseria
TGQVKK

SEQ ID NO: 1529 - protein, 5 aa, Neisseria
ENSGW

SEQ ID NO: 1530 - protein, 9 aa, Neisseria
SYPEKTDKV

SEQ ID NO: 1531 - protein, 7 aa, Neisseria
NIDDTMT

SEQ ID NO: 1532 - protein, 9 aa, Neisseria
IAKRPIPGG

SEQ ID NO: 1533 - protein, 13 aa, Neisseria
AGMEMTRKGKTTQ

SEQ ID NO: 1534 - protein, 7 aa, Neisseria
GCKERSA

SEQ ID NO: 1535 - protein, 16 aa, Neisseria
MEKHNGTYRDLHRPAS

SEQ ID NO: 1536 - protein, 9 aa, Neisseria
FATRDEYLE

SEQ ID NO: 1537 - protein, 5 aa, Neisseria
KRWRP

SEQ ID NO: 1538 - protein, 7 aa, Neisseria
RDYRFEW

SEQ ID NO: 1539 - protein, 5 aa, Neisseria
GQVKK

SEQ ID NO: 1540 - protein, 9 aa, Neisseria
SYPEKTDKV

SEQ ID NO: 1541 - protein, 6 aa, Neisseria
IDDTMT

SEQ ID NO: 1542 - protein, 7 aa, Neisseria
IAKRPIP

SEQ ID NO: 1543 - protein, 13 aa, Neisseria
AGMEMTRKGKTTQ

SEQ ID NO: 1544 - protein, 7 aa, Neisseria
GCKERSA

SEQ ID NO: 1545 - protein, 8 aa, Neisseria
RLPNFIRV

SEQ ID NO: 1546 - protein, 8 aa, Neisseria
SEQTYTVK

SEQ ID NO: 1547 - protein, 33 aa, Neisseria
PSPAEIQKRIDDALKEVNRQMSFNQHTAGLRIS

SEQ ID NO: 1548 - protein, 7 aa, Neisseria
GPLVNLW

SEQ ID NO: 1549 - protein, 14 aa, Neisseria
IKQAASYTGDYASL

SEQ ID NO: 1550 - protein, 8 aa, Neisseria
LDLSSIAK

SEQ ID NO: 1551 - protein, 10 aa, Neisseria
AGEYLVEIGG

SEQ ID NO: 1552 - protein, 8 aa, Neisseria
NIVQLSHI

SEQ ID NO: 1553 - protein, 5 aa, Neisseria
ETEAL

SEQ ID NO: 1554 - protein, 10 aa, Neisseria
MPSETRLPNF

SEQ ID NO: 1555 - protein, 6 aa, Neisseria
CSEQTA

SEQ ID NO: 1556 - protein, 7 aa, Neisseria
QGETMGY

SEQ ID NO: 1557 - protein, 57 aa, Neisseria
YLSNNRDKLPSPAEIQKRIDDALKEVNRQMSTYQPDSEISRFNQHTAGKPLRISSDF

SEQ ID NO: 1558 - protein, 7 aa, Neisseria
EAVRLNR

SEQ ID NO: 1559 - protein, 21 aa, Neisseria
GFGPDKSVTREPSPEQIKQTG

SEQ ID NO: 1560 - protein, 19 aa, Neisseria
IILKQGKDYASLSKTHPKA

SEQ ID NO: 1561 - protein, 15 aa, Neisseria
SFGVDKVAGELEKYG

SEQ ID NO: 1562 - protein, 26 aa, Neisseria
IGGELHGKGKNARGEPWRIGIEQPNI

SEQ ID NO: 1563 - protein, 17 aa, Neisseria
QGGNLNNRSLATSGDYR

SEQ ID NO: 1564 - protein, 29 aa, Neisseria
FHVDKNGKRLSINPNNKRPISAMTADGLS

SEQ ID NO: 1565 - protein, 13 aa, Neisseria
ETEALKLAEREKL

SEQ ID NO: 1566 - protein, 18 aa, Neisseria
VRDKGGYRMSSEFEKLLR

SEQ ID NO: 1567 - protein, 7 aa, Neisseria
MPSETRL

SEQ ID NO: 1568 - protein, 8 aa, Neisseria
CSEQTATM

SEQ ID NO: 1569 - protein, 9 aa, Neisseria
SNNRDKLPS

SEQ ID NO: 1570 - protein, 25 aa, Neisseria
AEIQKRIDDALKEVNRQQPDSEISR

SEQ ID NO: 1571 - protein, 7 aa, Neisseria
KPLRISS

SEQ ID NO: 1572 - protein, 7 aa, Neisseria
EAVRLNR

SEQ ID NO: 1573 - protein, 17 aa, Neisseria
GPDKSVTREPSPEQIKQ

SEQ ID NO: 1574 - protein, 11 aa, Neisseria
IILKQGKDYAS

SEQ ID NO: 1575 - protein, 5 aa, Neisseria
SKTHP

SEQ ID NO: 1576 - protein, 10 aa, Neisseria
KVAGELEKYG

SEQ ID NO: 1577 - protein, 13 aa, Neisseria
LHGKGKNARGEPW

SEQ ID NO: 1578 - protein, 15 aa, Neisseria
DKNGKRLSPNNKRPI

SEQ ID NO: 1579 - protein, 18 aa, Neisseria
AMTGLETEALKLAEREKL

SEQ ID NO: 1580 - protein, 7 aa, Neisseria
VRDKGGY

SEQ ID NO: 1581 - protein, 8 aa, Neisseria
SEFEKLLR

SEQ ID NO: 1582 - protein, 8 aa, Neisseria
PIQDTQSA

SEQ ID NO: 1583 - protein, 15 aa, Neisseria
LQELREWFDSYCATP

SEQ ID NO: 1584 - protein, 13 aa, Neisseria
GEPLPDHHELDLL

SEQ ID NO: 1585 - protein, 14 aa, Neisseria
DAVAATLLADIGRY

SEQ ID NO: 1586 - protein, 43 aa, Neisseria
PDWLVSCNSTVAELVKGVDEVQKLTHFARVDSLQAETKMLLAM

SEQ ID NO: 1587 - protein, 14 aa, Neisseria
FLSNAPDSPEKDIF

SEQ ID NO: 1588 - protein, 19 aa, Neisseria
KPEKYRRLEYIENFLNILR

SEQ ID NO: 1589 - protein, 11 aa, Neisseria
GRPKHIYSIYK

SEQ ID NO: 1590 - protein, 5 aa, Neisseria
LFDIR

SEQ ID NO: 1591 - protein, 32 aa, Neisseria
ILVDTVPECYTTLGIVHSLWQPIPGEFDDYIA

SEQ ID NO: 1592 - protein, 7 aa, Neisseria
GYKSLHT

SEQ ID NO: 1593 - protein, 11 aa, Neisseria
DMHQFNEFGVA

SEQ ID NO: 1594 - protein, 5 aa, Neisseria
QLLDW

SEQ ID NO: 1595 - protein, 16 aa, Neisseria
DTHGKVHSSIGDRLEN

SEQ ID NO: 1596 - protein, 16 aa, Neisseria
YEKAIGKIRAYQQNAD

SEQ ID NO: 1597 - protein, 38 aa, Neisseria
VREQLAKLQELAEGYKKPEDLYTNRAIQKACGTLNEPP

SEQ ID NO: 1598 - protein, 22 aa, Neisseria
KIKKGGMTTLAKCCKPADDIIG

SEQ ID NO: 1599 - protein, 20 aa, Neisseria
PSFQHLAEHAPEKVLDALQE

SEQ ID NO: 1600 - protein, 6 aa, Neisseria
RDVSDA

SEQ ID NO: 1601 - protein, 23 aa, Neisseria
QVNDLPRVLASLGDVKGVLSVTR

SEQ ID NO: 1602 - protein, 10 aa, Neisseria
SPIQDTQSAT

SEQ ID NO: 1603 - protein, 25 aa, Neisseria
QELREWFDSYCAALPDNDKNLHYPA

SEQ ID NO: 1604 - protein, 13 aa, Neisseria
AATPYGEPLPDHF

SEQ ID NO: 1605 - protein, 5 aa, Neisseria
HDLLP

SEQ ID NO: 1606 - protein, 9 aa, Neisseria
DIGRYVPDW

SEQ ID NO: 1607 - protein, 9 aa, Neisseria
VSERCNSTV

SEQ ID NO: 1608 - protein, 12 aa, Neisseria
ELVKGVDEVQKH

SEQ ID NO: 1609 - protein, 20 aa, Neisseria
ARVDSLATPEERAQQAETMR

SEQ ID NO: 1610 - protein, 6 aa, Neisseria
AMRTRT

SEQ ID NO: 1611 - protein, 16 aa, Neisseria
NAPDSPEKRAVAKETL

SEQ ID NO: 1612 - protein, 25 aa, Neisseria
DLGFRHQKPEKYRELDEKRTERLEY

SEQ ID NO: 1613 - protein, 25 aa, Neisseria
LRGELKKYNVAGRPKHKMVKKKLSF

SEQ ID NO: 1614 - protein, 9 aa, Neisseria
FRATVPECY

SEQ ID NO: 1615 - protein, 35 aa, Neisseria
PIPGEFDDYIANPKGNGYKSIVGPEDKGVEVQIRT

SEQ ID NO: 1616 - protein, 18 aa, Neisseria
NGWRYKEGGKGDSAYEQK

SEQ ID NO: 1617 - protein, 17 aa, Neisseria
LDWRENMAESGKEDLAA

SEQ ID NO: 1618 - protein, 8 aa, Neisseria
TPHGKPTG

SEQ ID NO: 1619 - protein, 49 aa, Neisseria
HSSIGDRCRGAKVEGTPLENGQRVEIITAKEGHPSVNGWVKSNKAIGKA

SEQ ID NO: 1620 - protein, 22 aa, Neisseria
IRQQNADTVREEGRVQLDKQLA

SEQ ID NO: 1621 - protein, 12 aa, Neisseria
LTPKPNLQELAE

SEQ ID NO: 1622 - protein, 33 aa, Neisseria
LGYKKPEDLGQGEISNRAIQKACGTLNEPPPVP

SEQ ID NO: 1623 - protein, 13 aa, Neisseria
KQSKIKKGGKNGV

SEQ ID NO: 1624 - protein, 7 aa, Neisseria
IDGEDGL

SEQ ID NO: 1625 - protein, 29 aa, Neisseria
KCCKPAPPDDIIVTRERGISVHRKTCPSF

SEQ ID NO: 1626 - protein, 33 aa, Neisseria
HAPEKVLDQIEIRAQDRSGLLRDVSDALARHKL

SEQ ID NO: 1627 - protein, 11 aa, Neisseria
QTQSRDLEASM

SEQ ID NO: 1628 - protein, 11 aa, Neisseria
LEVKQVNDLPR

SEQ ID NO: 1629 - protein, 5 aa, Neisseria
GDVKG

SEQ ID NO: 1630 - protein, 5 aa, Neisseria
QDTQS

SEQ ID NO: 1631 - protein, 7 aa, Neisseria
QELREWF

SEQ ID NO: 1632 - protein, 7 aa, Neisseria
PDNDKNL

SEQ ID NO: 1633 - protein, 11 aa, Neisseria
YPAPLPHDLLP

SEQ ID NO: 1634 - protein, 20 aa, Neisseria
VSERCNSTELVKGVDEVQKH

SEQ ID NO: 1635 - protein, 5 aa, Neisseria
ARVDS

SEQ ID NO: 1636 - protein, 14 aa, Neisseria
ATPEERAQQAETMR

SEQ ID NO: 1637 - protein, 21 aa, Neisseria
AMRTRTAPDSPEKRAVAKETL

SEQ ID NO: 1638 - protein, 25 aa, Neisseria
DLGFRHQKPEKYRELDEKRTERLEY

SEQ ID NO: 1639 - protein, 8 aa, Neisseria
LRGELKKY

SEQ ID NO: 1640 - protein, 15 aa, Neisseria
VAGRKHKMVKKKLSF

SEQ ID NO: 1641 - protein, 6 aa, Neisseria
FRATVP

SEQ ID NO: 1642 - protein, 5 aa, Neisseria
GEFDD

SEQ ID NO: 1643 - protein, 5 aa, Neisseria
PKGNG

SEQ ID NO: 1644 - protein, 13 aa, Neisseria
GPEDKGVEVQIRT

SEQ ID NO: 1645 - protein, 33 aa, Neisseria
DQRYKEGGKGDSAYEQLDWRENMAESGKEDLAA

SEQ ID NO: 1646 - protein, 33 aa, Neisseria
FKLFIGDRCRGAKVEGLENGQRVEIITAKEGHP

SEQ ID NO: 1647 - protein, 10 aa, Neisseria
VKSNKAIGKA

SEQ ID NO: 1648 - protein, 20 aa, Neisseria
IQNADTVREEGRVQLDKQLA

SEQ ID NO: 1649 - protein, 10 aa, Neisseria
LGYKKPEDLG

SEQ ID NO: 1650 - protein, 5 aa, Neisseria
GEISN

SEQ ID NO: 1651 - protein, 11 aa, Neisseria
KQSKIKKGGKV

SEQ ID NO: 1652 - protein, 7 aa, Neisseria
IDGEDGL

SEQ ID NO: 1653 - protein, 10 aa, Neisseria
KCCKPAPPDD

SEQ ID NO: 1654 - protein, 20 aa, Neisseria
TRERGISVHRKTCHAPEKVL

SEQ ID NO: 1655 - protein, 35 aa, Neisseria
QIEIRAQDRSGLLRDVSDALARHKLTQSRDLEASM

SEQ ID NO: 1656 - protein, 11 aa, Neisseria
LEVKQVNDLPR

SEQ ID NO: 1657 - protein, 5 aa, Neisseria
GDVKG

SEQ ID NO: 1658 - protein, 9 aa, Neisseria
RRNIGKWYD

SEQ ID NO: 1659 - protein, 15 aa, Neisseria
PRYIGTIIDFLMVPN

SEQ ID NO: 1660 - protein, 8 aa, Neisseria
ERLKTMLR

SEQ ID NO: 1661 - protein, 18 aa, Neisseria
KNFRRNITCFEGYDENSF

SEQ ID NO: 1662 - protein, 34 aa, Neisseria
GKWYDDGVWDDEEYWKLENDLIEVRKKYPYPMDI

SEQ ID NO: 1663 - protein, 14 aa, Neisseria
DSVGINERYERLKT

SEQ ID NO: 1664 - protein, 13 aa, Neisseria
FTEKDIVDYYNKK

SEQ ID NO: 1665 - protein, 8 aa, Neisseria
KNFRRNIT

SEQ ID NO: 1666 - protein, 26 aa, Neisseria
GVWDDEEYWKLENDLIEVRKKYPYDI

SEQ ID NO: 1667 - protein, 12 aa, Neisseria
VGINERYERLKT

SEQ ID NO: 1668 - protein, 7 aa, Neisseria
FTEKDIV

SEQ ID NO: 1669 - protein, 6 aa, Neisseria
KNIFSA

SEQ ID NO: 1670 - protein, 12 aa, Neisseria
SGNAYKIVSTIK

SEQ ID NO: 1671 - protein, 13 aa, Neisseria
NTLHPTYYRDIRR

SEQ ID NO: 1672 - protein, 17 aa, Neisseria
ITNGKKLYSVGGLNKAG

SEQ ID NO: 1673 - protein, 8 aa, Neisseria
PSLNNIPA

SEQ ID NO: 1674 - protein, 4 aa, Neisseria
KTFK

SEQ ID NO: 1675 - protein, 5 aa, Neisseria
SGSYG

SEQ ID NO: 1676 - protein, 10 aa, Neisseria
TFERSGNAYK

SEQ ID NO: 1677 - protein, 8 aa, Neisseria
FESGGTVV

SEQ ID NO: 1678 - protein, 11 aa, Neisseria
RDIRRGKLYAE

SEQ ID NO: 1679 - protein, 23 aa, Neisseria
KFADGSVTYGKAGESKTEQSPKA

SEQ ID NO: 1680 - protein, 20 aa, Neisseria
ANDAKLPPGLKITNGKKLYS

SEQ ID NO: 1681 - protein, 31 aa, Neisseria
GLNKAGTGKYSIGGVETEVVKYRVRRGDDAV

SEQ ID NO: 1682 - protein, 9 aa, Neisseria
GYTDDGKTY

SEQ ID NO: 1683 - protein, 6 aa, Neisseria
GQAAKP

SEQ ID NO: 1684 - protein, 7 aa, Neisseria
TFERSGN

SEQ ID NO: 1685 - protein, 10 aa, Neisseria
RDIRRGKLYA

SEQ ID NO: 1686 - protein, 13 aa, Neisseria
KAGESKTEQSPKA

SEQ ID NO: 1687 - protein, 6 aa, Neisseria
ANDAKL

SEQ ID NO: 1688 - protein, 7 aa, Neisseria
TNGKKLY

SEQ ID NO: 1689 - protein, 6 aa, Neisseria
NKAGTG

SEQ ID NO: 1690 - protein, 16 aa, Neisseria
VETEVVKYRVRRGDDA

SEQ ID NO: 1691 - protein, 8 aa, Neisseria
YTDDGKTY

SEQ ID NO: 1692 - protein, 5 aa, Neisseria
QAAKP

SEQ ID NO: 1693 - protein, 6 aa, Neisseria
PGRLRR

SEQ ID NO: 1694 - protein, 10 aa, Neisseria
QELSRLYAQT

SEQ ID NO: 1695 - protein, 6 aa, Neisseria
TVRHAP

SEQ ID NO: 1696 - protein, 5 aa, Neisseria
PAFHE

SEQ ID NO: 1697 - protein, 9 aa, Neisseria
LNIGGIANI

SEQ ID NO: 1698 - protein, 10 aa, Neisseria
PGNMLMDAWT

SEQ ID NO: 1699 - protein, 12 aa, Neisseria
GNILPQLLDRLL

SEQ ID NO: 1700 - protein, 5 aa, Neisseria
PKSTG

SEQ ID NO: 1701 - protein, 5 aa, Neisseria
ETYLD

SEQ ID NO: 1702 - protein, 20 aa, Neisseria
DVLRTLSRFTAQTVCDAVSH

SEQ ID NO: 1703 - protein, 7 aa, Neisseria
ADLAECF

SEQ ID NO: 1704 - protein, 8 aa, Neisseria
INRIPGSP

SEQ ID NO: 1705 - protein, 7 aa, Neisseria
TSMDGAD

SEQ ID NO: 1706 - protein, 10 aa, Neisseria
IRMDGGKWLG

SEQ ID NO: 1707 - protein, 28 aa, Neisseria
PYPGRLRRQLLDLQDTGADELHRSRILS

SEQ ID NO: 1708 - protein, 9 aa, Neisseria
NLAPSDITA

SEQ ID NO: 1709 - protein, 15 aa, Neisseria
CHGQTVRHAPEHGYS

SEQ ID NO: 1710 - protein, 7 aa, Neisseria
LLAERTR

SEQ ID NO: 1711 - protein, 16 aa, Neisseria
TVGDFRSRDLAAGGQG

SEQ ID NO: 1712 - protein, 10 aa, Neisseria
LFRDNRETRA

SEQ ID NO: 1713 - protein, 5 aa, Neisseria
PPDAP

SEQ ID NO: 1714 - protein, 8 aa, Neisseria
GFDTGPGN

SEQ ID NO: 1715 - protein, 13 aa, Neisseria
PYDKNGAKAAQGN

SEQ ID NO: 1716 - protein, 9 aa, Neisseria
PHPKSTGRE

SEQ ID NO: 1717 - protein, 17 aa, Neisseria
YLDGGENRYDVLRTLSR

SEQ ID NO: 1718 - protein, 6 aa, Neisseria
AADARQ

SEQ ID NO: 1719 - protein, 9 aa, Neisseria
GGGIRNPVL

SEQ ID NO: 1720 - protein, 7 aa, Neisseria
LNLDPQW

SEQ ID NO: 1721 - protein, 16 aa, Neisseria
IPGSPHKATGASKPCI

SEQ ID NO: 1722 - protein, 7 aa, Neisseria
TSMDGAD

SEQ ID NO: 1723 - protein, 25 aa, Neisseria
GRLRRQLLDLQDTGADELHRSRILS

SEQ ID NO: 1724 - protein, 6 aa, Neisseria
TVRHAP

SEQ ID NO: 1725 - protein, 7 aa, Neisseria
LLAERTR

SEQ ID NO: 1726 - protein, 9 aa, Neisseria
DFRSRDLAA

SEQ ID NO: 1727 - protein, 10 aa, Neisseria
LFRDNRETRA

SEQ ID NO: 1728 - protein, 10 aa, Neisseria
YDKNGAKAAQ

SEQ ID NO: 1729 - protein, 8 aa, Neisseria
HPKSTGRE

SEQ ID NO: 1730 - protein, 10 aa, Neisseria
LDGGENRYDV

SEQ ID NO: 1731 - protein, 6 aa, Neisseria
AADARQ

SEQ ID NO: 1732 - protein, 11 aa, Neisseria
PGSPHKATGAS

SEQ ID NO: 1733 - protein, 6 aa, Neisseria
NIHKTF

SEQ ID NO: 1734 - protein, 13 aa, Neisseria
TFLRCLNALEMPE

SEQ ID NO: 1735 - protein, 6 aa, Neisseria
LENVME

SEQ ID NO: 1736 - protein, 5 aa, Neisseria
KLLEK

SEQ ID NO: 1737 - protein, 15 aa, Neisseria
PELVQDVLDTMKELA

SEQ ID NO: 1738 - protein, 8 aa, Neisseria
PQDLFDHP

SEQ ID NO: 1739 - protein, 12 aa, Neisseria
RNIHKTFGENTI

SEQ ID NO: 1740 - protein, 6 aa, Neisseria
DVCKGQ

SEQ ID NO: 1741 - protein, 9 aa, Neisseria
GPSGSGKTT

SEQ ID NO: 1742 - protein, 29 aa, Neisseria
EMPEDGQIEFDNERPLKIDFSKKPSKHDI

SEQ ID NO: 1743 - protein, 8 aa, Neisseria
ALRRKSGM

SEQ ID NO: 1744 - protein, 7 aa, Neisseria
FPHKTAL

SEQ ID NO: 1745 - protein, 16 aa, Neisseria
GKPAAQAREEALKLLE

SEQ ID NO: 1746 - protein, 10 aa, Neisseria
VGLGDKVDLY

SEQ ID NO: 1747 - protein, 13 aa, Neisseria
YQLSGGQQQRVGI

SEQ ID NO: 1748 - protein, 12 aa, Neisseria
DEPTSALDPELV

SEQ ID NO: 1749 - protein, 12 aa, Neisseria
VLDTMKELAQEG

SEQ ID NO: 1750 - protein, 5 aa, Neisseria
MDGGV

SEQ ID NO: 1751 - protein, 23 aa, Neisseria
VEQGSPQDLFDHPKHERTRRFLS

SEQ ID NO: 1752 - protein, 6 aa, Neisseria
IQSTKI

SEQ ID NO: 1753 - protein, 28 aa, Neisseria
EMPEDGQIEFDNERPLKIDFSKKPSKHD

SEQ ID NO: 1754 - protein, 7 aa, Neisseria
ALRRKSG

SEQ ID NO: 1755 - protein, 16 aa, Neisseria
GKPAAQAREEALKLLE

SEQ ID NO: 1756 - protein, 8 aa, Neisseria
VGLGDKVD

SEQ ID NO: 1757 - protein, 12 aa, Neisseria
DEPTSALDPELV

SEQ ID NO: 1758 - protein, 10 aa, Neisseria
VLDTMKELAQ

SEQ ID NO: 1759 - protein, 15 aa, Neisseria
DLFDHPKHERTRRFL

SEQ ID NO: 1760 - protein, 8 aa, Neisseria
GCQSVQEA

SEQ ID NO: 1761 - protein, 6 aa, Neisseria
FQLVEA

SEQ ID NO: 1762 - protein, 6 aa, Neisseria
LDAGCQ

SEQ ID NO: 1763 - protein, 15 aa, Neisseria
LMPWAAPIGTGLGAV

SEQ ID NO: 1764 - protein, 11 aa, Neisseria
SGDPVNMARAF

SEQ ID NO: 1765 - protein, 7 aa, Neisseria
ETFPSRL

SEQ ID NO: 1766 - protein, 7 aa, Neisseria
EILKQSI

SEQ ID NO: 1767 - protein, 16 aa, Neisseria
SLRRAGSGGEAHGQGF

SEQ ID NO: 1768 - protein, 8 aa, Neisseria
QMAREVFE

SEQ ID NO: 1769 - protein, 10 aa, Neisseria
ELIGDDDTLQ

SEQ ID NO: 1770 - protein, 9 aa, Neisseria
LIKDGFKVL

SEQ ID NO: 1771 - protein, 7 aa, Neisseria
RLLDAGC

SEQ ID NO: 1772 - protein, 11 aa, Neisseria
VLRERLPDTPL

SEQ ID NO: 1773 - protein, 10 aa, Neisseria
AVSRSGDPVN

SEQ ID NO: 1774 - protein, 7 aa, Neisseria
ESGRLAF

SEQ ID NO: 1775 - protein, 16 aa, Neisseria
GPVEARDKAQASTPTV

SEQ ID NO: 1776 - protein, 12 aa, Neisseria
SLRRAGSGGEAH

SEQ ID NO: 1777 - protein, 8 aa, Neisseria
QMAREVFE

SEQ ID NO: 1778 - protein, 9 aa, Neisseria
LIGDDDTLQ

SEQ ID NO: 1779 - protein, 8 aa, Neisseria
VLRERLPD

SEQ ID NO: 1780 - protein, 7 aa, Neisseria
VSRSGDP

SEQ ID NO: 1781 - protein, 7 aa, Neisseria
ESGRLAF

SEQ ID NO: 1782 - protein, 11 aa, Neisseria
GPVEARDKAQA

SEQ ID NO: 1783 - protein, 8 aa, Neisseria
MLDTWLGA

SEQ ID NO: 1784 - protein, 7 aa, Neisseria
AVESVAA

SEQ ID NO: 1785 - protein, 7 aa, Neisseria
VGDYIEI

SEQ ID NO: 1786 - protein, 8 aa, Neisseria
INLLNTLM

SEQ ID NO: 1787 - protein, 9 aa, Neisseria
PNPLVGQLA

SEQ ID NO: 1788 - protein, 7 aa, Neisseria
LEPLCAP

SEQ ID NO: 1789 - protein, 12 aa, Neisseria
  VARIANT (1)...(12): Xaa is any amino acid
IPAIQRXLENVQ

SEQ ID NO: 1790 - protein, 10 aa, Neisseria
RIIVRFASPV

SEQ ID NO: 1791 - protein, 9 aa, Neisseria
AVMDEFLRV

SEQ ID NO: 1792 - protein, 7 aa, Neisseria
IRAEAVE

SEQ ID NO: 1793 - protein, 18 aa, Neisseria
HFKRHPDFGIESKRRFLV

SEQ ID NO: 1794 - protein, 8 aa, Neisseria
SATQQYSV

SEQ ID NO: 1795 - protein, 9 aa, Neisseria
NGLRGRVVD

SEQ ID NO: 1796 - protein, 9 aa, Neisseria
HPVRRDNIL

SEQ ID NO: 1797 - protein, 9 aa, Neisseria
LDSDEAVCR

SEQ ID NO: 1798 - protein, 16 aa, Neisseria
AARPRVTRVPYDDKAY

SEQ ID NO: 1799 - protein, 9 aa, Neisseria
SPVSKRLEI

SEQ ID NO: 1800 - protein, 9 aa, Neisseria
NHPAGSETL

SEQ ID NO: 1801 - protein, 7 aa, Neisseria
IRAEAVE

SEQ ID NO: 1802 - protein, 17 aa, Neisseria
FKRHPDFGIESKRRFLV

SEQ ID NO: 1803 - protein, 8 aa, Neisseria
NGLRGRVV

SEQ ID NO: 1804 - protein, 8 aa, Neisseria
PVRRDNIL

SEQ ID NO: 1805 - protein, 9 aa, Neisseria
LDSDEAVCR

SEQ ID NO: 1806 - protein, 15 aa, Neisseria
ARPRVTRVPYDDKAY

SEQ ID NO: 1807 - protein, 7 aa, Neisseria
VSKRLEI

SEQ ID NO: 1808 - protein, 6 aa, Neisseria
AGSETL

SEQ ID NO: 1809 - protein, 40 aa, Neisseria
AQTHTGWANTVEPLTGITERVGRIWGVVSHLNSVADTPEL

SEQ ID NO: 1810 - protein, 9 aa, Neisseria
VYNELMPEI

SEQ ID NO: 1811 - protein, 18 aa, Neisseria
QDIELYNRFKTIKNSPEF

SEQ ID NO: 1812 - protein, 10 aa, Neisseria
FSQNVLDATD

SEQ ID NO: 1813 - protein, 6 aa, Neisseria
GIPEDA

SEQ ID NO: 1814 - protein, 5 aa, Neisseria
HYLAV

SEQ ID NO: 1815 - protein, 35 aa, Neisseria
ELSDDGKFDNTANIDRTLANALQTAKLLGFKNYAE

SEQ ID NO: 1816 - protein, 19 aa, Neisseria
MADTPEQVLNFLHDLARRA

SEQ ID NO: 1817 - protein, 8 aa, Neisseria
AEVKAFAR

SEQ ID NO: 1818 - protein, 16 aa, Neisseria
GKVLNGLFAQIKKLYG

SEQ ID NO: 1819 - protein, 11 aa, Neisseria
LHHLLTQVDEL

SEQ ID NO: 1820 - protein, 6 aa, Neisseria
ELPSQF

SEQ ID NO: 1821 - protein, 13 aa, Neisseria
GRLKNWQQVLDSV

SEQ ID NO: 1822 - protein, 6 aa, Neisseria
SYAWAE

SEQ ID NO: 1823 - protein, 8 aa, Neisseria
AAFEESDD

SEQ ID NO: 1824 - protein, 8 aa, Neisseria
KRFWEILA

SEQ ID NO: 1825 - protein, 9 aa, Neisseria
AAESFKAFR

SEQ ID NO: 1826 - protein, 19 aa, Neisseria
LGEEPRFDQIKTEDIKPAL

SEQ ID NO: 1827 - protein, 8 aa, Neisseria
AEAREQIA

SEQ ID NO: 1828 - protein, 7 aa, Neisseria
AQTHTGW

SEQ ID NO: 1829 - protein, 17 aa, Neisseria
NTVEPLTGITERVGRIW

SEQ ID NO: 1830 - protein, 8 aa, Neisseria
SVADTPEL

SEQ ID NO: 1831 - protein, 37 aa, Neisseria
IGQDIELYNRFKTIKNSPEFDTLSPAQKTKLNHDLRD

SEQ ID NO: 1832 - protein, 25 aa, Neisseria
VLSGAELPPEQQAELAKLQTEGAQL

SEQ ID NO: 1833 - protein, 6 aa, Neisseria
KFSQNV

SEQ ID NO: 1834 - protein, 5 aa, Neisseria
DATDA

SEQ ID NO: 1835 - protein, 5 aa, Neisseria
IPEDA

SEQ ID NO: 1836 - protein, 11 aa, Neisseria
AQSESKTGYKI

SEQ ID NO: 1837 - protein, 10 aa, Neisseria
ADNRELREQI

SEQ ID NO: 1838 - protein, 23 aa, Neisseria
VTRASELSDDGKFDNTANIDRTL

SEQ ID NO: 1839 - protein, 8 aa, Neisseria
KMADTPEQ

SEQ ID NO: 1840 - protein, 15 aa, Neisseria
LARRAKPYAEKDLAE

SEQ ID NO: 1841 - protein, 9 aa, Neisseria
KAFARESLN

SEQ ID NO: 1842 - protein, 20 aa, Neisseria
YASEKLREAKYAFSETEVKK

SEQ ID NO: 1843 - protein, 7 aa, Neisseria
GFTEKTV

SEQ ID NO: 1844 - protein, 15 aa, Neisseria
KDVRYFELQQNGETI

SEQ ID NO: 1845 - protein, 10 aa, Neisseria
YAREGKRGGA

SEQ ID NO: 1846 - protein, 15 aa, Neisseria
MNDYKGRRRFSDGTL

SEQ ID NO: 1847 - protein, 14 aa, Neisseria
PPVGGREARLSHDE

SEQ ID NO: 1848 - protein, 7 aa, Neisseria
QVDELGV

SEQ ID NO: 1849 - protein, 5 aa, Neisseria
ELPSQ

SEQ ID NO: 1850 - protein, 8 aa, Neisseria
SAHEETGV

SEQ ID NO: 1851 - protein, 10 aa, Neisseria
SEDDEGRLKN

SEQ ID NO: 1852 - protein, 8 aa, Neisseria
DSVRKKVA

SEQ ID NO: 1853 - protein, 6 aa, Neisseria
PPEYNR

SEQ ID NO: 1854 - protein, 7 aa, Neisseria
SAGYYSY

SEQ ID NO: 1855 - protein, 15 aa, Neisseria
FEESDDVAATGKRFW

SEQ ID NO: 1856 - protein, 20 aa, Neisseria
GGSRSAAESFKAFRGREPSI

SEQ ID NO: 1857 - protein, 10 aa, Neisseria
LRHSGFDNAV

SEQ ID NO: 1858 - protein, 17 aa, Neisseria
LGEEPRFDQIKTEDIKP

SEQ ID NO: 1859 - protein, 8 aa, Neisseria
AEAREQIA

SEQ ID NO: 1860 - protein, 6 aa, Neisseria
ITERVG

SEQ ID NO: 1861 - protein, 6 aa, Neisseria
ADTPEL

SEQ ID NO: 1862 - protein, 7 aa, Neisseria
IGQDIEL

SEQ ID NO: 1863 - protein, 11 aa, Neisseria
KTIKNSPEFDT

SEQ ID NO: 1864 - protein, 14 aa, Neisseria
SPAQKTKLNHDLRD

SEQ ID NO: 1865 - protein, 20 aa, Neisseria
ELPPEQQAELAKLQTEGAQL

SEQ ID NO: 1866 - protein, 5 aa, Neisseria
IPEDA

SEQ ID NO: 1867 - protein, 9 aa, Neisseria
AQSESKTGY

SEQ ID NO: 1868 - protein, 10 aa, Neisseria
ADNRELREQI

SEQ ID NO: 1869 - protein, 13 aa, Neisseria
RASELSDDGKFDN

SEQ ID NO: 1870 - protein, 7 aa, Neisseria
ANIDRTL

SEQ ID NO: 1871 - protein, 7 aa, Neisseria
KMADTPE

SEQ ID NO: 1872 - protein, 15 aa, Neisseria
LARRAKPYAEKDLAE

SEQ ID NO: 1873 - protein, 9 aa, Neisseria
KAFARESLN

SEQ ID NO: 1874 - protein, 20 aa, Neisseria
YASEKLREAKYAFSETEVKK

SEQ ID NO: 1875 - protein, 5 aa, Neisseria
FTEKT

SEQ ID NO: 1876 - protein, 5 aa, Neisseria
KDVRY

SEQ ID NO: 1877 - protein, 5 aa, Neisseria
QNGET

SEQ ID NO: 1878 - protein, 9 aa, Neisseria
YAREGKRGG

SEQ ID NO: 1879 - protein, 9 aa, Neisseria
YKGRRRFSD

SEQ ID NO: 1880 - protein, 12 aa, Neisseria
VGGREARLSHDE

SEQ ID NO: 1881 - protein, 6 aa, Neisseria
QVDELG

SEQ ID NO: 1882 - protein, 7 aa, Neisseria
SAHEETG

SEQ ID NO: 1883 - protein, 10 aa, Neisseria
SEDDEGRLKN

SEQ ID NO: 1884 - protein, 8 aa, Neisseria
DSVRKKVA

SEQ ID NO: 1885 - protein, 11 aa, Neisseria
FEESDDVAATG

SEQ ID NO: 1886 - protein, 19 aa, Neisseria
GSRSAAESFKAFRGREPSI

SEQ ID NO: 1887 - protein, 6 aa, Neisseria
TLVSGI

SEQ ID NO: 1888 - protein, 6 aa, Neisseria
GSGSFG

SEQ ID NO: 1889 - protein, 6 aa, Neisseria
QPVGQL

SEQ ID NO: 1890 - protein, 6 aa, Neisseria
NVPNAP

SEQ ID NO: 1891 - protein, 17 aa, Neisseria
QGFDTLFQHALNGFNAM

SEQ ID NO: 1892 - protein, 5 aa, Neisseria
TASAP

SEQ ID NO: 1893 - protein, 6 aa, Neisseria
FEATCQ

SEQ ID NO: 1894 - protein, 10 aa, Neisseria
CHGGSIPGIP

SEQ ID NO: 1895 - protein, 5 aa, Neisseria
KGKET

SEQ ID NO: 1896 - protein, 6 aa, Neisseria
EGFNAM

SEQ ID NO: 1897 - protein, 12 aa, Neisseria
MKQLRDNKAQGS

SEQ ID NO: 1898 - protein, 25 aa, Neisseria
AGSGSFGDVDATTEAATQTRIQPVG

SEQ ID NO: 1899 - protein, 13 aa, Neisseria
MGDGIPVGERQGE

SEQ ID NO: 1900 - protein, 19 aa, Neisseria
AADSNVPNAPKLEHNGDWA

SEQ ID NO: 1901 - protein, 5 aa, Neisseria
IAQGF

SEQ ID NO: 1902 - protein, 7 aa, Neisseria
MPAKGGA

SEQ ID NO: 1903 - protein, 9 aa, Neisseria
DLTDQELKR

SEQ ID NO: 1904 - protein, 45 aa, Neisseria
ANKSGGSFPNPDEAAPADNAASGTASAPADSAAPAEAKAEDKGAA

SEQ ID NO: 1905 - protein, 9 aa, Neisseria
GVDGKKVFE

SEQ ID NO: 1906 - protein, 20 aa, Neisseria
GIGKKDDWAPRIKKGKETLH

SEQ ID NO: 1907 - protein, 16 aa, Neisseria
PAKGGNAGLSDDEVKA

SEQ ID NO: 1908 - protein, 5 aa, Neisseria
QSGAK

SEQ ID NO: 1909 - protein, 11 aa, Neisseria
MKQLRDNKAQG

SEQ ID NO: 1910 - protein, 11 aa, Neisseria
GDVDATTEAAT

SEQ ID NO: 1911 - protein, 8 aa, Neisseria
PVGERQGE

SEQ ID NO: 1912 - protein, 6 aa, Neisseria
AADSNV

SEQ ID NO: 1913 - protein, 7 aa, Neisseria
PKLEHNG

SEQ ID NO: 1914 - protein, 6 aa, Neisseria
PAKGGA

SEQ ID NO: 1915 - protein, 9 aa, Neisseria
DLTDQELKR

SEQ ID NO: 1916 - protein, 13 aa, Neisseria
PNPDEAAPADNAA

SEQ ID NO: 1917 - protein, 19 aa, Neisseria
APADSAAPAEAKAEDKGAA

SEQ ID NO: 1918 - protein, 8 aa, Neisseria
VDGKKVFE

SEQ ID NO: 1919 - protein, 19 aa, Neisseria
IGKKDDWAPRIKKGKETLH

SEQ ID NO: 1920 - protein, 6 aa, Neisseria
PAKGGN

SEQ ID NO: 1921 - protein, 9 aa, Neisseria
GLSDDEVKA

SEQ ID NO: 1922 - protein, 7 aa, Neisseria
IISALAV

SEQ ID NO: 1923 - protein, 7 aa, Neisseria
ATCMAMV

SEQ ID NO: 1924 - protein, 14 aa, Neisseria
VQQTQQAPKPVSNT

SEQ ID NO: 1925 - protein, 8 aa, Neisseria
QHGKGADA

SEQ ID NO: 1926 - protein, 7 aa, Neisseria
GSGSGSA

SEQ ID NO: 1927 - protein, 9 aa, Neisseria
HTTKHGLDF

SEQ ID NO: 1928 - protein, 26 aa, Neisseria
NVQQTQQAPKPVSNTEPSAPVPQQQK

SEQ ID NO: 1929 - protein, 6 aa, Neisseria
GKGADA

SEQ ID NO: 1930 - protein, 13 aa, Neisseria
QAPKPVSNTEPSA

SEQ ID NO: 1931 - protein, 7 aa, Neisseria
IQSAGTV

SEQ ID NO: 1932 - protein, 5 aa, Neisseria
GKKTG

SEQ ID NO: 1933 - protein, 8 aa, Neisseria
WMEIEKQR

SEQ ID NO: 1934 - protein, 9 aa, Neisseria
VNLLDTPGH

SEQ ID NO: 1935 - protein, 9 aa, Neisseria
DTYRVLTAV

SEQ ID NO: 1936 - protein, 5 aa, Neisseria
AAGVE

SEQ ID NO: 1937 - protein, 8 aa, Neisseria
IKLLNVCR

SEQ ID NO: 1938 - protein, 6 aa, Neisseria
KYDREV

SEQ ID NO: 1939 - protein, 14 aa, Neisseria
DSLELLDEVENILK

SEQ ID NO: 1940 - protein, 10 aa, Neisseria
KNFKGVYHIL

SEQ ID NO: 1941 - protein, 11 aa, Neisseria
HEFDIIKGIDN

SEQ ID NO: 1942 - protein, 5 aa, Neisseria
FGSAI

SEQ ID NO: 1943 - protein, 11 aa, Neisseria
EILNSLIDWAP

SEQ ID NO: 1944 - protein, 7 aa, Neisseria
KFERGMK

SEQ ID NO: 1945 - protein, 8 aa, Neisseria
DIIGIPNH

SEQ ID NO: 1946 - protein, 8 aa, Neisseria
LFRSVRIK

SEQ ID NO: 1947 - protein, 6 aa, Neisseria
PLKIKQ

SEQ ID NO: 1948 - protein, 9 aa, Neisseria
QKGLQQLGE

SEQ ID NO: 1949 - protein, 8 aa, Neisseria
VQVFKPMS

SEQ ID NO: 1950 - protein, 7 aa, Neisseria
SRLANEY

SEQ ID NO: 1951 - protein, 7 aa, Neisseria
AEFEKAN

SEQ ID NO: 1952 - protein, 5 aa, Neisseria
RWPDI

SEQ ID NO: 1953 - protein, 12 aa, Neisseria
EILDQVRRRRTF

SEQ ID NO: 1954 - protein, 11 aa, Neisseria
SHPDAGKTTLT

SEQ ID NO: 1955 - protein, 13 aa, Neisseria
GTVKGKKTGKFAT

SEQ ID NO: 1956 - protein, 10 aa, Neisseria
DWMEIEKQRG

SEQ ID NO: 1957 - protein, 8 aa, Neisseria
FDYKDHTV

SEQ ID NO: 1958 - protein, 16 aa, Neisseria
LLDTPGHQDFSEDTYR

SEQ ID NO: 1959 - protein, 7 aa, Neisseria
DAAKGVE

SEQ ID NO: 1960 - protein, 7 aa, Neisseria
CRLRDTP

SEQ ID NO: 1961 - protein, 20 aa, Neisseria
MNKYDREVRDSLELLDEVEN

SEQ ID NO: 1962 - protein, 7 aa, Neisseria
GMGKNFK

SEQ ID NO: 1963 - protein, 8 aa, Neisseria
AGGERLPH

SEQ ID NO: 1964 - protein, 14 aa, Neisseria
KGIDNPELEQRFPL

SEQ ID NO: 1965 - protein, 9 aa, Neisseria
QQLRDEIEL

SEQ ID NO: 1966 - protein, 7 aa, Neisseria
ASNEFNL

SEQ ID NO: 1967 - protein, 20 aa, Neisseria
PAPKPRDATVRMVEPDEPKF

SEQ ID NO: 1968 - protein, 13 aa, Neisseria
QANMDPKHRDRIA

SEQ ID NO: 1969 - protein, 23 aa, Neisseria
RVCSGKFERGMKMKHLRINREIA

SEQ ID NO: 1970 - protein, 8 aa, Neisseria
SHDRELVE

SEQ ID NO: 1971 - protein, 5 aa, Neisseria
IPNHG

SEQ ID NO: 1972 - protein, 10 aa, Neisseria
IGDSFSEGEQ

SEQ ID NO: 1973 - protein, 24 aa, Neisseria
VRIKNPLKIKQLQKGLQQLGEEGA

SEQ ID NO: 1974 - protein, 8 aa, Neisseria
RLANEYGV

SEQ ID NO: 1975 - protein, 5 aa, Neisseria
AVFDS

SEQ ID NO: 1976 - protein, 16 aa, Neisseria
SCDDKKKLAEFEKANA

SEQ ID NO: 1977 - protein, 7 aa, Neisseria
APNRVNL

SEQ ID NO: 1978 - protein, 10 aa, Neisseria
LTQERWPDIV

SEQ ID NO: 1979 - protein, 7 aa, Neisseria
ETREHSV

SEQ ID NO: 1980 - protein, 11 aa, Neisseria
EILDQVRRRRT

SEQ ID NO: 1981 - protein, 5 aa, Neisseria
PDAGK

SEQ ID NO: 1982 - protein, 10 aa, Neisseria
GTVKGKKTGK

SEQ ID NO: 1983 - protein, 8 aa, Neisseria
MEIEKQRG

SEQ ID NO: 1984 - protein, 6 aa, Neisseria
DYKDHT

SEQ ID NO: 1985 - protein, 8 aa, Neisseria
QDFSEDTY

SEQ ID NO: 1986 - protein, 7 aa, Neisseria
DAAKGVE

SEQ ID NO: 1987 - protein, 7 aa, Neisseria
CRLRDTP

SEQ ID NO: 1988 - protein, 18 aa, Neisseria
KYDREVRDSLELLDEVEN

SEQ ID NO: 1989 - protein, 8 aa, Neisseria
AGGERLPH

SEQ ID NO: 1990 - protein, 14 aa, Neisseria
KGIDNPELEQRFPL

SEQ ID NO: 1991 - protein, 9 aa, Neisseria
QQLRDEIEL

SEQ ID NO: 1992 - protein, 18 aa, Neisseria
PKPRDATVRMVEPDEPKF

SEQ ID NO: 1993 - protein, 10 aa, Neisseria
MDPKHRDRIA

SEQ ID NO: 1994 - protein, 21 aa, Neisseria
CSGKFERGMKMKHLRINREIA

SEQ ID NO: 1995 - protein, 8 aa, Neisseria
SHDRELVE

SEQ ID NO: 1996 - protein, 7 aa, Neisseria
SFSEGEQ

SEQ ID NO: 1997 - protein, 16 aa, Neisseria
VRIKNPLKIKQLQKGL

SEQ ID NO: 1998 - protein, 6 aa, Neisseria
LGEEGA

SEQ ID NO: 1999 - protein, 16 aa, Neisseria
SCDDKKKLAEFEKANA

SEQ ID NO: 2000 - protein, 6 aa, Neisseria
TQERWP

SEQ ID NO: 2001 - protein, 7 aa, Neisseria
ETREHSV

SEQ ID NO: 2002 - protein, 6 aa, Neisseria
EYTANL

SEQ ID NO: 2003 - protein, 7 aa, Neisseria
DIDGLYT

SEQ ID NO: 2004 - protein, 8 aa, Neisseria
VRLDKIEH

SEQ ID NO: 2005 - protein, 6 aa, Neisseria
GMLTKI

SEQ ID NO: 2006 - protein, 5 aa, Neisseria
LKPDA

SEQ ID NO: 2007 - protein, 5 aa, Neisseria
AEAAE

SEQ ID NO: 2008 - protein, 6 aa, Neisseria
AEHALS

SEQ ID NO: 2009 - protein, 6 aa, Neisseria
IAGIEG

SEQ ID NO: 2010 - protein, 9 aa, Neisseria
SRMDTVTVY

SEQ ID NO: 2011 - protein, 6 aa, Neisseria
KATKQP

SEQ ID NO: 2012 - protein, 7 aa, Neisseria
MKYKRIV

SEQ ID NO: 2013 - protein, 19 aa, Neisseria
GTSSITHSDGSLSRGKIQT

SEQ ID NO: 2014 - protein, 15 aa, Neisseria
GFKKRPVKIADKQAS

SEQ ID NO: 2015 - protein, 6 aa, Neisseria
LSSDGI

SEQ ID NO: 2016 - protein, 14 aa, Neisseria
ADFADKRRYQNAGG

SEQ ID NO: 2017 - protein, 6 aa, Neisseria
LQRRAV

SEQ ID NO: 2018 - protein, 20 aa, Neisseria
INENDTVSVEELKIGDNDTL

SEQ ID NO: 2019 - protein, 19 aa, Neisseria
GNPNSNPDAVRLDKIEHIN

SEQ ID NO: 2020 - protein, 10 aa, Neisseria
GGSGSANGTG

SEQ ID NO: 2021 - protein, 5 aa, Neisseria
TKIKA

SEQ ID NO: 2022 - protein, 5 aa, Neisseria
AESGV

SEQ ID NO: 2023 - protein, 19 aa, Neisseria
CSSLKPDALAEAAEHQADG

SEQ ID NO: 2024 - protein, 10 aa, Neisseria
RAKGLRTQKQ

SEQ ID NO: 2025 - protein, 26 aa, Neisseria
YSESRGSVYVDEGAEHALSEQGKSLL

SEQ ID NO: 2026 - protein, 8 aa, Neisseria
GHFSRMDT

SEQ ID NO: 2027 - protein, 13 aa, Neisseria
SKATKQPLGKGRV

SEQ ID NO: 2028 - protein, 12 aa, Neisseria
AAEDLLKSRKAK

SEQ ID NO: 2029 - protein, 8 aa, Neisseria
IHRDDWIS

SEQ ID NO: 2030 - protein, 7 aa, Neisseria
MKYKRIV

SEQ ID NO: 2031 - protein, 12 aa, Neisseria
THSDGSLSRGKI

SEQ ID NO: 2032 - protein, 15 aa, Neisseria
GFKKRPVKIADKQAS

SEQ ID NO: 2033 - protein, 11 aa, Neisseria
ADFADKRRYQN

SEQ ID NO: 2034 - protein, 6 aa, Neisseria
LQRRAV

SEQ ID NO: 2035 - protein, 19 aa, Neisseria
NENDTVSVEELKIGDNDTL

SEQ ID NO: 2036 - protein, 17 aa, Neisseria
PNSNPDAVRLDKIEHIN

SEQ ID NO: 2037 - protein, 5 aa, Neisseria
TKIKA

SEQ ID NO: 2038 - protein, 15 aa, Neisseria
LKPDALAEAAEHQAD

SEQ ID NO: 2039 - protein, 9 aa, Neisseria
RAKGLRTQK

SEQ ID NO: 2040 - protein, 5 aa, Neisseria
SESRG

SEQ ID NO: 2041 - protein, 16 aa, Neisseria
VYVDEGAEHALSEQGK

SEQ ID NO: 2042 - protein, 7 aa, Neisseria
HFSRMDT

SEQ ID NO: 2043 - protein, 12 aa, Neisseria
KATKQPLGKGRV

SEQ ID NO: 2044 - protein, 12 aa, Neisseria
AAEDLLKSRKAK

SEQ ID NO: 2045 - protein, 5 aa, Neisseria
HRDDW

SEQ ID NO: 2046 - protein, 9 aa, Neisseria
LRFVDDCLP

SEQ ID NO: 2047 - protein, 7 aa, Neisseria
IRQCIRQ

SEQ ID NO: 2048 - protein, 24 aa, Neisseria
QCHDGIKQLFKRFIIDGFKPIGRH

SEQ ID NO: 2049 - protein, 5 aa, Neisseria
CVKIA

SEQ ID NO: 2050 - protein, 5 aa, Neisseria
RHCQN

SEQ ID NO: 2051 - protein, 6 aa, Neisseria
QHFGQP

SEQ ID NO: 2052 - protein, 6 aa, Neisseria
ERCQFV

SEQ ID NO: 2053 - protein, 5 aa, Neisseria
NLVAT

SEQ ID NO: 2054 - protein, 5 aa, Neisseria
QFAQP

SEQ ID NO: 2055 - protein, 11 aa, Neisseria
FGCFGKFSGIH

SEQ ID NO: 2056 - protein, 5 aa, Neisseria
METNA

SEQ ID NO: 2057 - protein, 7 aa, Neisseria
RFVDDCL

SEQ ID NO: 2058 - protein, 7 aa, Neisseria
VDIRQCI

SEQ ID NO: 2059 - protein, 5 aa, Neisseria
LQTDS

SEQ ID NO: 2060 - protein, 10 aa, Neisseria
QCHDGIKQLF

SEQ ID NO: 2061 - protein, 11 aa, Neisseria
DGFKPIGRHNI

SEQ ID NO: 2062 - protein, 18 aa, Neisseria
IRHRGGCFHRHCQNQPFD

SEQ ID NO: 2063 - protein, 8 aa, Neisseria
TFGGGKLR

SEQ ID NO: 2064 - protein, 8 aa, Neisseria
HFGQPVER

SEQ ID NO: 2065 - protein, 9 aa, Neisseria
PAQQRRHKT

SEQ ID NO: 2066 - protein, 11 aa, Neisseria
PPFGCFGKFSG

SEQ ID NO: 2067 - protein, 8 aa, Neisseria
PYYRRNAV

SEQ ID NO: 2068 - protein, 7 aa, Neisseria
VDIRQCI

SEQ ID NO: 2069 - protein, 7 aa, Neisseria
DGIKQLF

SEQ ID NO: 2070 - protein, 8 aa, Neisseria
AQQRRHKT

SEQ ID NO: 2071 - protein, 7 aa, Neisseria
LSYILGF

SEQ ID NO: 2072 - protein, 5 aa, Neisseria
TKESL

SEQ ID NO: 2073 - protein, 6 aa, Neisseria
DFLTWG

SEQ ID NO: 2074 - protein, 18 aa, Neisseria
FSDYLAHPLDIFKVWEGG

SEQ ID NO: 2075 - protein, 13 aa, Neisseria
FLKLMDTVAPLVP

SEQ ID NO: 2076 - protein, 6 aa, Neisseria
RIGNFI

SEQ ID NO: 2077 - protein, 10 aa, Neisseria
WGRVTDINAF

SEQ ID NO: 2078 - protein, 10 aa, Neisseria
PLWAEWLQQY

SEQ ID NO: 2079 - protein, 8 aa, Neisseria
LPRHPSQL

SEQ ID NO: 2080 - protein, 19 aa, Neisseria
YGIFRFIAEFARQPDDYLG

SEQ ID NO: 2081 - protein, 8 aa, Neisseria
LGRRRIAQ

SEQ ID NO: 2082 - protein, 8 aa, Neisseria
FTKESLDD

SEQ ID NO: 2083 - protein, 5 aa, Neisseria
WEGGM

SEQ ID NO: 2084 - protein, 7 aa, Neisseria
LFGRKHG

SEQ ID NO: 2085 - protein, 5 aa, Neisseria
ASGRI

SEQ ID NO: 2086 - protein, 12 aa, Neisseria
PQARYEDAEAAA

SEQ ID NO: 2087 - protein, 7 aa, Neisseria
PRHPSQL

SEQ ID NO: 2088 - protein, 10 aa, Neisseria
FSKKQRSTGQ

SEQ ID NO: 2089 - protein, 9 aa, Neisseria
FARQPDDYL

SEQ ID NO: 2090 - protein, 7 aa, Neisseria
FGMKKQH

SEQ ID NO: 2091 - protein, 6 aa, Neisseria
GRRRIA

SEQ ID NO: 2092 - protein, 7 aa, Neisseria
FTKESLD

SEQ ID NO: 2093 - protein, 6 aa, Neisseria
FGRKHG

SEQ ID NO: 2094 - protein, 10 aa, Neisseria
ARYEDAEAAA

SEQ ID NO: 2095 - protein, 7 aa, Neisseria
KKQRSTG

SEQ ID NO: 2096 - protein, 8 aa, Neisseria
FARQPDDY

SEQ ID NO: 2097 - protein, 6 aa, Neisseria
GMKKQH

SEQ ID NO: 2098 - protein, 9 aa, Neisseria
PYIRRFSGS

SEQ ID NO: 2099 - protein, 7 aa, Neisseria
NAMLEKV

SEQ ID NO: 2100 - protein, 6 aa, Neisseria
EFVQGM

SEQ ID NO: 2101 - protein, 13 aa, Neisseria
VNKEIVSMINTYG

SEQ ID NO: 2102 - protein, 10 aa, Neisseria
IGQVGTVESI

SEQ ID NO: 2103 - protein, 7 aa, Neisseria
TGLVKGL

SEQ ID NO: 2104 - protein, 7 aa, Neisseria
GKLAEEL

SEQ ID NO: 2105 - protein, 19 aa, Neisseria
MTNIAGVMDKTGNLLTKLT

SEQ ID NO: 2106 - protein, 6 aa, Neisseria
RIDELI

SEQ ID NO: 2107 - protein, 15 aa, Neisseria
GMLPKIASAVEAAVN

SEQ ID NO: 2108 - protein, 10 aa, Neisseria
ALLLEIFTDA

SEQ ID NO: 2109 - protein, 6 aa, Neisseria
MESENI

SEQ ID NO: 2110 - protein, 8 aa, Neisseria
AADKARIL

SEQ ID NO: 2111 - protein, 7 aa, Neisseria
IRRFSGS

SEQ ID NO: 2112 - protein, 7 aa, Neisseria
YGGNAMT

SEQ ID NO: 2113 - protein, 8 aa, Neisseria
PALKEGFA

SEQ ID NO: 2114 - protein, 5 aa, Neisseria
GGGPQ

SEQ ID NO: 2115 - protein, 11 aa, Neisseria
MLEKVGKKGEF

SEQ ID NO: 2116 - protein, 9 aa, Neisseria
RVTDKEAMD

SEQ ID NO: 2117 - protein, 5 aa, Neisseria
VNKEI

SEQ ID NO: 2118 - protein, 27 aa, Neisseria
SGRDDHFIKAKKLLIDTPEQNGVDIGQ

SEQ ID NO: 2119 - protein, 7 aa, Neisseria
ESIDTGL

SEQ ID NO: 2120 - protein, 7 aa, Neisseria
LIERGCI

SEQ ID NO: 2121 - protein, 8 aa, Neisseria
GVGEKGEA

SEQ ID NO: 2122 - protein, 10 aa, Neisseria
KLAEELNAEK

SEQ ID NO: 2123 - protein, 22 aa, Neisseria
VMDKTGNLLTKLTPKRIDELIA

SEQ ID NO: 2124 - protein, 6 aa, Neisseria
AVNGVK

SEQ ID NO: 2125 - protein, 8 aa, Neisseria
IDGRLPNA

SEQ ID NO: 2126 - protein, 7 aa, Neisseria
LGGGEDA

SEQ ID NO: 2127 - protein, 5 aa, Neisseria
MESEN

SEQ ID NO: 2128 - protein, 8 aa, Neisseria
AADKARIL

SEQ ID NO: 2129 - protein, 8 aa, Neisseria
PALKEGFA

SEQ ID NO: 2130 - protein, 11 aa, Neisseria
MLEKVGKKGEF

SEQ ID NO: 2131 - protein, 9 aa, Neisseria
RVTDKEAMD

SEQ ID NO: 2132 - protein, 5 aa, Neisseria
VNKEI

SEQ ID NO: 2133 - protein, 24 aa, Neisseria
SGRDDHFIKAKKLLIDTPEQNGVD

SEQ ID NO: 2134 - protein, 7 aa, Neisseria
VGEKGEA

SEQ ID NO: 2135 - protein, 10 aa, Neisseria
KLAEELNAEK

SEQ ID NO: 2136 - protein, 6 aa, Neisseria
VMDKTG

SEQ ID NO: 2137 - protein, 11 aa, Neisseria
LTPKRIDELIA

SEQ ID NO: 2138 - protein, 5 aa, Neisseria
IDGRL

SEQ ID NO: 2139 - protein, 5 aa, Neisseria
GGEDA

SEQ ID NO: 2140 - protein, 8 aa, Neisseria
TTLSACLG

SEQ ID NO: 2141 - protein, 13 aa, Neisseria
DFPNPNDAYKNLI

SEQ ID NO: 2142 - protein, 11 aa, Neisseria
TGESVGSISFP

SEQ ID NO: 2143 - protein, 15 aa, Neisseria
DIRHVKEIGHIDLVS

SEQ ID NO: 2144 - protein, 11 aa, Neisseria
AAIRNAWVKLG

SEQ ID NO: 2145 - protein, 5 aa, Neisseria
GVRIV

SEQ ID NO: 2146 - protein, 7 aa, Neisseria
TADLFQI

SEQ ID NO: 2147 - protein, 9 aa, Neisseria
GIRLMQQSD

SEQ ID NO: 2148 - protein, 12 aa, Neisseria
DRSGEKFKREMY

SEQ ID NO: 2149 - protein, 5 aa, Neisseria
TRTNP

SEQ ID NO: 2150 - protein, 5 aa, Neisseria
TAQDI

SEQ ID NO: 2151 - protein, 10 aa, Neisseria
LDAGKAMNGP

SEQ ID NO: 2152 - protein, 9 aa, Neisseria
YTRLGKLLK

SEQ ID NO: 2153 - protein, 10 aa, Neisseria
SLDSVEKTAG

SEQ ID NO: 2154 - protein, 7 aa, Neisseria
NAARTAS

SEQ ID NO: 2155 - protein, 11 aa, Neisseria
SATPETVETAA

SEQ ID NO: 2156 - protein, 24 aa, Neisseria
RAAAAVQHANAADGVRIFNSLAAT

SEQ ID NO: 2157 - protein, 9 aa, Neisseria
LKAVSDGLD

SEQ ID NO: 2158 - protein, 6 aa, Neisseria
LRVIAQ

SEQ ID NO: 2159 - protein, 5 aa, Neisseria
SLFAG

SEQ ID NO: 2160 - protein, 10 aa, Neisseria
IGYLKGLFSY

SEQ ID NO: 2161 - protein, 6 aa, Neisseria
EHAEGS

SEQ ID NO: 2162 - protein, 5 aa, Neisseria
LGALG

SEQ ID NO: 2163 - protein, 6 aa, Neisseria
GTLVGL

SEQ ID NO: 2164 - protein, 7 aa, Neisseria
GGFTGAT

SEQ ID NO: 2165 - protein, 6 aa, Neisseria
RLVAGL

SEQ ID NO: 2166 - protein, 8 aa, Neisseria
NGWNGLAR

SEQ ID NO: 2167 - protein, 5 aa, Neisseria
MRTTP

SEQ ID NO: 2168 - protein, 9 aa, Neisseria
FPTKTFKPT

SEQ ID NO: 2169 - protein, 29 aa, Neisseria
GGGGGGTSAPDFNAGGTGIGSNSRATTAK

SEQ ID NO: 2170 - protein, 11 aa, Neisseria
IKNEMCKDRSM

SEQ ID NO: 2171 - protein, 37 aa, Neisseria
CAGRDDVAVTDRDAKINAPPPNLHTGDFPNPNDAYKN

SEQ ID NO: 2172 - protein, 7 aa, Neisseria
YTGRGVE

SEQ ID NO: 2173 - protein, 11 aa, Neisseria
DTGESVGSISF

SEQ ID NO: 2174 - protein, 15 aa, Neisseria
LYGRKEHGYNENYKN

SEQ ID NO: 2175 - protein, 41 aa, Neisseria
MRKEAPEDGGGKDIEASFDDEAVIETEAKPTDIRHVKEIGH

SEQ ID NO: 2176 - protein, 16 aa, Neisseria
GRSVDGRPAGGIAPDA

SEQ ID NO: 2177 - protein, 10 aa, Neisseria
NTNDETKNEM

SEQ ID NO: 2178 - protein, 7 aa, Neisseria
LGERGVR

SEQ ID NO: 2179 - protein, 13 aa, Neisseria
NSFGTTSRAGTAD

SEQ ID NO: 2180 - protein, 9 aa, Neisseria
IANSEEQYR

SEQ ID NO: 2181 - protein, 13 aa, Neisseria
DYSGGDKTDEGIR

SEQ ID NO: 2182 - protein, 8 aa, Neisseria
MQQSDYGN

SEQ ID NO: 2183 - protein, 6 aa, Neisseria
IRNKNM

SEQ ID NO: 2184 - protein, 12 aa, Neisseria
STGNDAQAQPNT

SEQ ID NO: 2185 - protein, 7 aa, Neisseria
YEKDAQK

SEQ ID NO: 2186 - protein, 28 aa, Neisseria
GVDRSGEKFKREMYGEPGTEPLEYGSNH

SEQ ID NO: 2187 - protein, 8 aa, Neisseria
VRFTRTNP

SEQ ID NO: 2188 - protein, 8 aa, Neisseria
MSNDNLRT

SEQ ID NO: 2189 - protein, 6 aa, Neisseria
VDSKFG

SEQ ID NO: 2190 - protein, 10 aa, Neisseria
DAGKAMNGPA

SEQ ID NO: 2191 - protein, 10 aa, Neisseria
DFTADTKGTS

SEQ ID NO: 2192 - protein, 9 aa, Neisseria
SFRNDISGT

SEQ ID NO: 2193 - protein, 9 aa, Neisseria
GLIKKGGSQ

SEQ ID NO: 2194 - protein, 15 aa, Neisseria
GNNTYTGKTIIEGGS

SEQ ID NO: 2195 - protein, 13 aa, Neisseria
GNNKSDMRVETKG

SEQ ID NO: 2196 - protein, 10 aa, Neisseria
ASGGSLNSDG

SEQ ID NO: 2197 - protein, 10 aa, Neisseria
ADTDQSGANE

SEQ ID NO: 2198 - protein, 15 aa, Neisseria
VHIKGSLQLDGKGTL

SEQ ID NO: 2199 - protein, 5 aa, Neisseria
LKVDG

SEQ ID NO: 2200 - protein, 9 aa, Neisseria
MSARGKGAG

SEQ ID NO: 2201 - protein, 8 aa, Neisseria
NSTGRRVP

SEQ ID NO: 2202 - protein, 6 aa, Neisseria
KIGQDY

SEQ ID NO: 2203 - protein, 8 aa, Neisseria
NIETDGGL

SEQ ID NO: 2204 - protein, 14 aa, Neisseria
DSVEKTAGSEGDTL

SEQ ID NO: 2205 - protein, 12 aa, Neisseria
YVRRGNAARTAS

SEQ ID NO: 2206 - protein, 11 aa, Neisseria
HAVEQGGSNLE

SEQ ID NO: 2207 - protein, 14 aa, Neisseria
LDASESSATPETVE

SEQ ID NO: 2208 - protein, 15 aa, Neisseria
AAADRTDMPGIRPYG

SEQ ID NO: 2209 - protein, 5 aa, Neisseria
NAADG

SEQ ID NO: 2210 - protein, 7 aa, Neisseria
YADSTAA

SEQ ID NO: 2211 - protein, 21 aa, Neisseria
DMQGRRLKAVSDGLDHNGTGL

SEQ ID NO: 2212 - protein, 22 aa, Neisseria
TQQDGGTWEQGGVEGKMRGSTQ

SEQ ID NO: 2213 - protein, 9 aa, Neisseria
AAKTGENTT

SEQ ID NO: 2214 - protein, 19 aa, Neisseria
GMGRSTWSENSANAKTDSI

SEQ ID NO: 2215 - protein, 7 aa, Neisseria
IRHDAGD

SEQ ID NO: 2216 - protein, 24 aa, Neisseria
SYGRYKNSISRSTGADEHAEGSVN

SEQ ID NO: 2217 - protein, 12 aa, Neisseria
ATGDLTVEGGLR

SEQ ID NO: 2218 - protein, 21 aa, Neisseria
DAFAEKGSALGWSGNSLTEGT

SEQ ID NO: 2219 - protein, 8 aa, Neisseria
LSQPLSDK

SEQ ID NO: 2220 - protein, 13 aa, Neisseria
GVERDLNGRDYTV

SEQ ID NO: 2221 - protein, 13 aa, Neisseria
ATGKTGARNMPHT

SEQ ID NO: 2222 - protein, 7 aa, Neisseria
VEFGNGW

SEQ ID NO: 2223 - protein, 17 aa, Neisseria
SYAGSKQYGNHSGRVGV

SEQ ID NO: 2224 - protein, 9 aa, Neisseria
SNSRATTAK

SEQ ID NO: 2225 - protein, 11 aa, Neisseria
IKNEMCKDRSM

SEQ ID NO: 2226 - protein, 17 aa, Neisseria
AGRDDVAVTDRDAKINA

SEQ ID NO: 2227 - protein, 8 aa, Neisseria
FPNPNDAY

SEQ ID NO: 2228 - protein, 7 aa, Neisseria
DTGESVG

SEQ ID NO: 2229 - protein, 8 aa, Neisseria
YGRKEHGY

SEQ ID NO: 2230 - protein, 41 aa, Neisseria; identical to SEQ ID NO: 2175

SEQ ID NO: 2231 - protein, 9 aa, Neisseria
RSVDGRPAG

SEQ ID NO: 2232 - protein, 9 aa, Neisseria
TNDETKNEM

SEQ ID NO: 2233 - protein, 7 aa, Neisseria
LGERGVR

SEQ ID NO: 2234 - protein, 5 aa, Neisseria
SRAGT

SEQ ID NO: 2235 - protein, 7 aa, Neisseria
NSEEQYR

SEQ ID NO: 2236 - protein, 11 aa, Neisseria
SGGDKTDEGIR

SEQ ID NO: 2237 - protein, 5 aa, Neisseria
IRNKN

SEQ ID NO: 2238 - protein, 6 aa, Neisseria
GNDAQA

SEQ ID NO: 2239 - protein, 7 aa, Neisseria
YEKDAQK

SEQ ID NO: 2240 - protein, 15 aa, Neisseria
GVDRSGEKFKREMYG

SEQ ID NO: 2241 - protein, 7 aa, Neisseria
PGTEPLE

SEQ ID NO: 2242 - protein, 5 aa, Neisseria
VRFTR

SEQ ID NO: 2243 - protein, 7 aa, Neisseria
DAGKAMN

SEQ ID NO: 2244 - protein, 9 aa, Neisseria
FTADTKGTS

SEQ ID NO: 2245 - protein, 5 aa, Neisseria
NDISG

SEQ ID NO: 2246 - protein, 7 aa, Neisseria
LIKKGGS

SEQ ID NO: 2247 - protein, 11 aa, Neisseria
NKSDMRVETKG

SEQ ID NO: 2248 - protein, 9 aa, Neisseria
DTDQSGANE

SEQ ID NO: 2249 - protein, 5 aa, Neisseria
LDGKG

SEQ ID NO: 2250 - protein, 5 aa, Neisseria
LKVDG

SEQ ID NO: 2251 - protein, 5 aa, Neisseria
ARGKG

SEQ ID NO: 2252 - protein, 6 aa, Neisseria
TGRRVP

SEQ ID NO: 2253 - protein, 5 aa, Neisseria
IETDG

SEQ ID NO: 2254 - protein, 13 aa, Neisseria
DSVEKTAGSEGDT

SEQ ID NO: 2255 - protein, 11 aa, Neisseria
VRRGNAARTAS

SEQ ID NO: 2256 - protein, 10 aa, Neisseria
HAVEQGGSNL

SEQ ID NO: 2257 - protein, 14 aa, Neisseria
LDASESSATPETVE

SEQ ID NO: 2258 - protein, 10 aa, Neisseria
AAADRTDMPG

SEQ ID NO: 2259 - protein, 5 aa, Neisseria
NAADG

SEQ ID NO: 2260 - protein, 19 aa, Neisseria
DMQGRRLKAVSDGLDHNGT

SEQ ID NO: 2261 - protein, 11 aa, Neisseria
GGVEGKMRGST

SEQ ID NO: 2262 - protein, 7 aa, Neisseria
KTGENTT

SEQ ID NO: 2263 - protein, 9 aa, Neisseria
NSANAKTDS

SEQ ID NO: 2264 - protein, 7 aa, Neisseria
IRHDAGD

SEQ ID NO: 2265 - protein, 20 aa, Neisseria
RYKNSISRSTGADEHAEGSV

SEQ ID NO: 2266 - protein, 8 aa, Neisseria
DAFAEKGS

SEQ ID NO: 2267 - protein, 6 aa, Neisseria
QPLSDK

SEQ ID NO: 2268 - protein, 12 aa, Neisseria
GVERDLNGRDYT

SEQ ID NO: 2269 - protein, 11 aa, Neisseria
ATGKTGARNMP

SEQ ID NO: 2270 - protein, 11 aa, Neisseria
QSSTMRPIGEI

SEQ ID NO: 2271 - protein, 8 aa, Neisseria
PAEAFKLP

SEQ ID NO: 2272 - protein, 7 aa, Neisseria
ADALRHI

SEQ ID NO: 2273 - protein, 6 aa, Neisseria
FHAIGA

SEQ ID NO: 2274 - protein, 9 aa, Neisseria
NLLAAMLDN

SEQ ID NO: 2275 - protein, 19 aa, Neisseria
QLRNIIDGMGKPVDGVMRP

SEQ ID NO: 2276 - protein, 13 aa, Neisseria
DISDLKERLGILV

SEQ ID NO: 2277 - protein, 13 aa, Neisseria
MAALLKDAIKPNL

SEQ ID NO: 2278 - protein, 7 aa, Neisseria
QTIEGTP

SEQ ID NO: 2279 - protein, 25 aa, Neisseria
PFANIAHGCNSVTATRLAKHLADYA

SEQ ID NO: 2280 - protein, 5 aa, Neisseria
ATVRA

SEQ ID NO: 2281 - protein, 23 aa, Neisseria
LDALEKGLPNLLKHISNLKNVFG

SEQ ID NO: 2282 - protein, 8 aa, Neisseria
SLTEVWGK

SEQ ID NO: 2283 - protein, 13 aa, Neisseria
DLARKVVNAIESQ

SEQ ID NO: 2284 - protein, 6 aa, Neisseria
IASLEK

SEQ ID NO: 2285 - protein, 19 aa, Neisseria
VALCGNMMKMPGLPKVPAA

SEQ ID NO: 2286 - protein, 17 aa, Neisseria
FKTDAEIAQSSTMRPIG

SEQ ID NO: 2287 - protein, 10 aa, Neisseria
LNADNIEPYG

SEQ ID NO: 2288 - protein, 19 aa, Neisseria
YKAKINPAEAFKLPQKQGR

SEQ ID NO: 2289 - protein, 11 aa, Neisseria
NPTPAGEGKTT

SEQ ID NO: 2290 - protein, 10 aa, Neisseria
DALRHIGKDA

SEQ ID NO: 2291 - protein, 8 aa, Neisseria
LREPSLGP

SEQ ID NO: 2292 - protein, 9 aa, Neisseria
VKGGAAGGG

SEQ ID NO: 2293 - protein, 14 aa, Neisseria
QGNELNIDPKRVLW

SEQ ID NO: 2294 - protein, 32 aa, Neisseria
RVVDMNDRQLRNIIDGMGKPVDGVMRPDGFDI

SEQ ID NO: 2295 - protein, 11 aa, Neisseria
KDISDLKERLG

SEQ ID NO: 2296 - protein, 9 aa, Neisseria
YAKDGSPVY

SEQ ID NO: 2297 - protein, 7 aa, Neisseria
KDLKANG

SEQ ID NO: 2298 - protein, 7 aa, Neisseria
DAIKPNL

SEQ ID NO: 2299 - protein, 7 aa, Neisseria
RLAKHLA

SEQ ID NO: 2300 - protein, 20 aa, Neisseria
LGAEKFCDIKCRLAGLKPDA

SEQ ID NO: 2301 - protein, 27 aa, Neisseria
LKYNGGVERANLGEENLDALEKGLPNL

SEQ ID NO: 2302 - protein, 17 aa, Neisseria
FVSDADAELAMIEKACA

SEQ ID NO: 2303 - protein, 17 aa, Neisseria
WGKGGAGGADLARKVVN

SEQ ID NO: 2304 - protein, 9 aa, Neisseria
IESQTNNFG

SEQ ID NO: 2305 - protein, 11 aa, Neisseria
LGIKDKIRAIA

SEQ ID NO: 2306 - protein, 10 aa, Neisseria
YGAEDVDFSA

SEQ ID NO: 2307 - protein, 12 aa, Neisseria
ASLEKLGLDKMP

SEQ ID NO: 2308 - protein, 7 aa, Neisseria
SLSDNAK

SEQ ID NO: 2309 - protein, 8 aa, Neisseria
GCPEDFRI

SEQ ID NO: 2310 - protein, 5 aa, Neisseria
MPGLP

SEQ ID NO: 2311 - protein, 12 aa, Neisseria
PAAEKIDVDAEG

SEQ ID NO: 2312 - protein, 9 aa, Neisseria
FKTDAEIAQ

SEQ ID NO: 2313 - protein, 7 aa, Neisseria
YKAKINP

SEQ ID NO: 2314 - protein, 11 aa, Neisseria
EAFKLPQKQGR

SEQ ID NO: 2315 - protein, 7 aa, Neisseria
PAGEGKT

SEQ ID NO: 2316 - protein, 10 aa, Neisseria
DALRHIGKDA

SEQ ID NO: 2317 - protein, 5 aa, Neisseria
LREPS

SEQ ID NO: 2318 - protein, 10 aa, Neisseria
LNIDPKRVLW

SEQ ID NO: 2319 - protein, 14 aa, Neisseria
RVVDMNDRQLRNII

SEQ ID NO: 2320 - protein, 15 aa, Neisseria
GMGKPVDGVMRPDGF

SEQ ID NO: 2321 - protein, 11 aa, Neisseria
KDISDLKERLG

SEQ ID NO: 2322 - protein, 5 aa, Neisseria
AKDGS

SEQ ID NO: 2323 - protein, 5 aa, Neisseria
KDLKA

SEQ ID NO: 2324 - protein, 7 aa, Neisseria
RLAKHLA

SEQ ID NO: 2325 - protein, 20 aa, Neisseria
LGAEKFCDIKCRLAGLKPDA

SEQ ID NO: 2326 - protein, 20 aa, Neisseria
GGVERANLGEENLDALEKGL

SEQ ID NO: 2327 - protein, 17 aa, Neisseria
FVSDADAELAMIEKACA

SEQ ID NO: 2328 - protein, 8 aa, Neisseria
DLARKVVN

SEQ ID NO: 2329 - protein, 11 aa, Neisseria
LGIKDKIRAIA

SEQ ID NO: 2330 - protein, 10 aa, Neisseria
YGAEDVDFSA

SEQ ID NO: 2331 - protein, 12 aa, Neisseria
ASLEKLGLDKMP

SEQ ID NO: 2332 - protein, 8 aa, Neisseria
GCPEDFRI

SEQ ID NO: 2333 - protein, 12 aa, Neisseria
PAAEKIDVDAEG

SEQ ID NO: 2334 - protein, 11 aa, Neisseria
RFAAMPDVVGK

SEQ ID NO: 2335 - protein, 7 aa, Neisseria
GQPGKMF

SEQ ID NO: 2336 - protein, 6 aa, Neisseria
AVTPCR

SEQ ID NO: 2337 - protein, 6 aa, Neisseria
VCRDDM

SEQ ID NO: 2338 - protein, 10 aa, Neisseria
FLQIRHFSPL

SEQ ID NO: 2339 - protein, 16 aa, Neisseria
LRVQRILDFGKFCQQV

SEQ ID NO: 2340 - protein, 16 aa, Neisseria
LDSVVAFVHFFADFLI

SEQ ID NO: 2341 - protein, 11 aa, Neisseria
ADNQTRFFKAG

SEQ ID NO: 2342 - protein, 10 aa, Neisseria
NARLIRQILK

SEQ ID NO: 2343 - protein, 5 aa, Neisseria
PDVVG

SEQ ID NO: 2344 - protein, 12 aa, Neisseria
LFGRQAGQPGKM

SEQ ID NO: 2345 - protein, 42 aa, Neisseria
QRIDAEAAVFRQDRNDSRTPVDAQHHGRRLVGNRRDRRHCNA

SEQ ID NO: 2346 - protein, 26 aa, Neisseria
TPCRTVCRDDMNACRARCHRITERSL

SEQ ID NO: 2347 - protein, 7 aa, Neisseria
AAHKASP

SEQ ID NO: 2348 - protein, 17 aa, Neisseria
CSSFDSKSRRSDVSARY

SEQ ID NO: 2349 - protein, 7 aa, Neisseria
LDFGKFC

SEQ ID NO: 2350 - protein, 7 aa, Neisseria
QLQKNTS

SEQ ID NO: 2351 - protein, 23 aa, Neisseria
FQADNQTRFFKAGQDTGQAGAQN

SEQ ID NO: 2352 - protein, 16 aa, Neisseria
LKVQRAVFRQKTDNPP

SEQ ID NO: 2353 - protein, 11 aa, Neisseria
IQNRPELGHQG

SEQ ID NO: 2354 - protein, 9 aa, Neisseria
QTDIDRRMF

SEQ ID NO: 2355 - protein, 5 aa, Neisseria
QAGQP

SEQ ID NO: 2356 - protein, 40 aa, Neisseria
QRIDAEAAVFRQDRNDSRTPVDAQHHGRRLVGNRRDRRHC

SEQ ID NO: 2357 - protein, 22 aa, Neisseria
TVCRDDMNACRARCHRITERSL

SEQ ID NO: 2358 - protein, 7 aa, Neisseria
AAHKASP

SEQ ID NO: 2359 - protein, 12 aa, Neisseria
FDSKSRRSDVSA

SEQ ID NO: 2360 - protein, 18 aa, Neisseria
FQADNQTRFFKAGQDTGQ

SEQ ID NO: 2361 - protein, 14 aa, Neisseria
LKVQRAVFRQKTDN

SEQ ID NO: 2362 - protein, 8 aa, Neisseria
IQNRPELG

SEQ ID NO: 2363 - protein, 7 aa, Neisseria
DIDRRMF

SEQ ID NO: 2364 - protein, 8 aa, Neisseria
LGGIVQEF

SEQ ID NO: 2365 - protein, 7 aa, Neisseria
VLADGVR

SEQ ID NO: 2366 - protein, 11 aa, Neisseria
INKQIGRVAGR

SEQ ID NO: 2367 - protein, 5 aa, Neisseria
SADGY

SEQ ID NO: 2368 - protein, 13 aa, Neisseria
SDDLEVFDFSRPK

SEQ ID NO: 2369 - protein, 9 aa, Neisseria
RRETGRAGF

SEQ ID NO: 2370 - protein, 13 aa, Neisseria
AYRVPSDIGRPAA

SEQ ID NO: 2371 - protein, 6 aa, Neisseria
PQDFAR

SEQ ID NO: 2372 - protein, 5 aa, Neisseria
DALAT

SEQ ID NO: 2373 - protein, 10 aa, Neisseria
DSLNWPEFGN

SEQ ID NO: 2374 - protein, 17 aa, Neisseria
MSDTPATRDFGLIDGRA

SEQ ID NO: 2375 - protein, 8 aa, Neisseria
LSNRRGTR

SEQ ID NO: 2376 - protein, 5 aa, Neisseria
DGVRE

SEQ ID NO: 2377 - protein, 15 aa, Neisseria
FDDAASYADNPFQIN

SEQ ID NO: 2378 - protein, 9 aa, Neisseria
VAGRIRGAA

SEQ ID NO: 2379 - protein, 23 aa, Neisseria
DINGRTYRVEANEGRNALHGGSH

SEQ ID NO: 2380 - protein, 9 aa, Neisseria
AADGRSVVL

SEQ ID NO: 2381 - protein, 30 aa, Neisseria
SRLQQSADGYPNDLDLDISYRLDEDDRLTV

SEQ ID NO: 2382 - protein, 9 aa, Neisseria
MPADAEKLP

SEQ ID NO: 2383 - protein, 18 aa, Neisseria
TVSDDLEVFDFSRPKPLD

SEQ ID NO: 2384 - protein, 24 aa, Neisseria
ALRRETGRAGFDDAYRVPSDIGRP

SEQ ID NO: 2385 - protein, 15 aa, Neisseria
AGRRRRISIYSDRNG

SEQ ID NO: 2386 - protein, 12 aa, Neisseria
APQDFARHDAGV

SEQ ID NO: 2387 - protein, 13 aa, Neisseria
EAQTLPDSLNWPE

SEQ ID NO: 2388 - protein, 14 aa, Neisseria
GNIRLNKGDTREAT

SEQ ID NO: 2389 - protein, 9 aa, Neisseria
MSDTPATRD

SEQ ID NO: 2390 - protein, 7 aa, Neisseria
SNRRGTR

SEQ ID NO: 2391 - protein, 5 aa, Neisseria
DGVRE

SEQ ID NO: 2392 - protein, 6 aa, Neisseria
FDDAAS

SEQ ID NO: 2393 - protein, 9 aa, Neisseria
VAGRIRGAA

SEQ ID NO: 2394 - protein, 17 aa, Neisseria
INGRTYRVEANEGRNAL

SEQ ID NO: 2395 - protein, 9 aa, Neisseria
AADGRSVVL

SEQ ID NO: 2396 - protein, 16 aa, Neisseria
SRLQQSADGYPNDLDL

SEQ ID NO: 2397 - protein, 11 aa, Neisseria
YRLDEDDRLTV

SEQ ID NO: 2398 - protein, 9 aa, Neisseria
MPADAEKLP

SEQ ID NO: 2399 - protein, 8 aa, Neisseria
TVSDDLEV

SEQ ID NO: 2400 - protein, 7 aa, Neisseria
SRPKPLD

SEQ ID NO: 2401 - protein, 23 aa, Neisseria
ALRRETGRAGFDDAYRVPSDIGR

SEQ ID NO: 2402 - protein, 15 aa, Neisseria
AGRRRRISIYSDRNG

SEQ ID NO: 2403 - protein, 9 aa, Neisseria
DFARHDAGV

SEQ ID NO: 2404 - protein, 11 aa, Neisseria
RLNKGDTREAT

SEQ ID NO: 2405 - protein, 11 aa, Neisseria
KQYGLLDFMPC

SEQ ID NO: 2406 - protein, 8 aa, Neisseria
PLDNFPTV

SEQ ID NO: 2407 - protein, 6 aa, Neisseria
VANLRR

SEQ ID NO: 2408 - protein, 17 aa, Neisseria
LRACAVIVAKYVGVFQK

SEQ ID NO: 2409 - protein, 5 aa, Neisseria
ARRVR

SEQ ID NO: 2410 - protein, 8 aa, Neisseria
RHQRGFAR

SEQ ID NO: 2411 - protein, 8 aa, Neisseria
PIVSQWTP

SEQ ID NO: 2412 - protein, 15 aa, Neisseria
LRSRQVVIDHDKVKQ

SEQ ID NO: 2413 - protein, 8 aa, Neisseria
LRQPPLDN

SEQ ID NO: 2414 - protein, 28 aa, Neisseria
VRPASVEARGKYVERRRQDKDADGFGQR

SEQ ID NO: 2415 - protein, 7 aa, Neisseria
ANLRRAL

SEQ ID NO: 2416 - protein, 9 aa, Neisseria
ACRRQRIHT

SEQ ID NO: 2417 - protein, 9 aa, Neisseria
SFLRDKRLK

SEQ ID NO: 2418 - protein, 12 aa, Neisseria
RRARRVRHGNAQ

SEQ ID NO: 2419 - protein, 10 aa, Neisseria
QQPRHQRGFA

SEQ ID NO: 2420 - protein, 14 aa, Neisseria
AGSGRNDKDVAFSI

SEQ ID NO: 2421 - protein, 15 aa, Neisseria
LRSRQVVIDHDKVKQ

SEQ ID NO: 2422 - protein, 23 aa, Neisseria
ASVEARGKYVERRRQDKDADGFG

SEQ ID NO: 2423 - protein, 7 aa, Neisseria
ANLRRAL

SEQ ID NO: 2424 - protein, 9 aa, Neisseria
ACRRQRIHT

SEQ ID NO: 2425 - protein, 8 aa, Neisseria
FLRDKRLK

SEQ ID NO: 2426 - protein, 10 aa, Neisseria
RRARRVRHGN

SEQ ID NO: 2427 - protein, 9 aa, Neisseria
QPRHQRGFA

SEQ ID NO: 2428 - protein, 10 aa, Neisseria
GSGRNDKDVA

SEQ ID NO: 2429 - protein, 11 aa, Neisseria
ADKIRKIENWP

SEQ ID NO: 2430 - protein, 12 aa, Neisseria
QSAEYFRLLVDL

SEQ ID NO: 2431 - protein, 13 aa, Neisseria
AGLELIRKLGGEI

SEQ ID NO: 2432 - protein, 17 aa, Neisseria
AAAILEFTDLQGGKNIR

SEQ ID NO: 2433 - protein, 5 aa, Neisseria
KTSNL

SEQ ID NO: 2434 - protein, 15 aa, Neisseria
LADKIRKIENWPQKG

SEQ ID NO: 2435 - protein, 7 aa, Neisseria
MDQKIDI

SEQ ID NO: 2436 - protein, 5 aa, Neisseria
LDARG

SEQ ID NO: 2437 - protein, 9 aa, Neisseria
PIRKKGKLP

SEQ ID NO: 2438 - protein, 6 aa, Neisseria
YGEAAV

SEQ ID NO: 2439 - protein, 10 aa, Neisseria
IHTDAVKLGS

SEQ ID NO: 2440 - protein, 12 aa, Neisseria
ELIRKLGGEIVE

SEQ ID NO: 2441 - protein, 15 aa, Neisseria
TDLQGGKNIRASGAP

SEQ ID NO: 2442 - protein, 8 aa, Neisseria
QNEGCMKG

SEQ ID NO: 2443 - protein, 12 aa, Neisseria
LADKIRKIENWP

SEQ ID NO: 2444 - protein, 7 aa, Neisseria
MDQKIDI

SEQ ID NO: 2445 - protein, 9 aa, Neisseria
PIRKKGKLP

SEQ ID NO: 2446 - protein, 6 aa, Neisseria
YGEAAV

SEQ ID NO: 2447 - protein, 10 aa, Neisseria
IHTDAVKLGS

SEQ ID NO: 2448 - protein, 12 aa, Neisseria
ELIRKLGGEIVE

SEQ ID NO: 2449 - protein, 7 aa, Neisseria
KNIRASG

SEQ ID NO: 2450 - protein, 5 aa, Neisseria
GCMKG

SEQ ID NO: 2451 - protein, 12 aa, Neisseria
NLGDALDGVPGI

SEQ ID NO: 2452 - protein, 17 aa, Neisseria
TGRRIKVLNHHGETGDM

SEQ ID NO: 2453 - protein, 10 aa, Neisseria
QVEILRGPVT

SEQ ID NO: 2454 - protein, 6 aa, Neisseria
VAGLVD

SEQ ID NO: 2455 - protein, 9 aa, Neisseria
PEKMPENGV

SEQ ID NO: 2456 - protein, 5 aa, Neisseria
NLEKL

SEQ ID NO: 2457 - protein, 11 aa, Neisseria
YRNLKRLPDSH

SEQ ID NO: 2458 - protein, 5 aa, Neisseria
FPGFE

SEQ ID NO: 2459 - protein, 11 aa, Neisseria
AGDAVENFFNN

SEQ ID NO: 2460 - protein, 6 aa, Neisseria
PIGRLK

SEQ ID NO: 2461 - protein, 8 aa, Neisseria
LSAISEAV

SEQ ID NO: 2462 - protein, 9 aa, Neisseria
RFGNYIYAQ

SEQ ID NO: 2463 - protein, 11 aa, Neisseria
NDGRGPKSIED

SEQ ID NO: 2464 - protein, 9 aa, Neisseria
RGRLKNLPS

SEQ ID NO: 2465 - protein, 8 aa, Neisseria
MRREAKMA

SEQ ID NO: 2466 - protein, 11 aa, Neisseria
HETEQSVDLET

SEQ ID NO: 2467 - protein, 10 aa, Neisseria
GKSRPRATSG

SEQ ID NO: 2468 - protein, 16 aa, Neisseria
TASDKIISGDTLRQKA

SEQ ID NO: 2469 - protein, 11 aa, Neisseria
IRGQTGRRIKV

SEQ ID NO: 2470 - protein, 16 aa, Neisseria
NHHGETGDMADFSPDH

SEQ ID NO: 2471 - protein, 6 aa, Neisseria
EILRGP

SEQ ID NO: 2472 - protein, 22 aa, Neisseria
DVADGKIPEKMPENGVSGELGL

SEQ ID NO: 2473 - protein, 13 aa, Neisseria
LSSGNLEKLTSGG

SEQ ID NO: 2474 - protein, 30 aa, Neisseria
GLYRKSGDYAVPRYRNLKRLPDSHADSQTG

SEQ ID NO: 2475 - protein, 5 aa, Neisseria
GEKGF

SEQ ID NO: 2476 - protein, 10 aa, Neisseria
AYSDRRDQYG

SEQ ID NO: 2477 - protein, 12 aa, Neisseria
PAHSHEYDDCHA

SEQ ID NO: 2478 - protein, 8 aa, Neisseria
SLINKRYL

SEQ ID NO: 2479 - protein, 13 aa, Neisseria
LTEEDIDYDNPGL

SEQ ID NO: 2480 - protein, 9 aa, Neisseria
GFHDDDNAH

SEQ ID NO: 2481 - protein, 28 aa, Neisseria
HTHSGRPWIDLRNKRYELRAEWKQPFPG

SEQ ID NO: 2482 - protein, 17 aa, Neisseria
HLNRNDYRHDEKAGDAV

SEQ ID NO: 2483 - protein, 24 aa, Neisseria
FNNQTQNARIELRHQPIGRLKGSW

SEQ ID NO: 2484 - protein, 7 aa, Neisseria
LQQKSSA

SEQ ID NO: 2485 - protein, 5 aa, Neisseria
LDNKV

SEQ ID NO: 2486 - protein, 40 aa, Neisseria
ANWDNFTLEGGVRVEKQKASIQYDKALIDRENYYNHPLPD

SEQ ID NO: 2487 - protein, 7 aa, Neisseria
GAHRQTA

SEQ ID NO: 2488 - protein, 16 aa, Neisseria
SHQERLPSTQELYAHG

SEQ ID NO: 2489 - protein, 14 aa, Neisseria
VGNKHLNKERSNNI

SEQ ID NO: 2490 - protein, 7 aa, Neisseria
YEGDRWQ

SEQ ID NO: 2491 - protein, 7 aa, Neisseria
YRNRFGN

SEQ ID NO: 2492 - protein, 19 aa, Neisseria
TLNDGRGPKSIEDDSEMKL

SEQ ID NO: 2493 - protein, 14 aa, Neisseria
RYNQSGADFYGAEG

SEQ ID NO: 2494 - protein, 11 aa, Neisseria
IYFKPTPRYRI

SEQ ID NO: 2495 - protein, 27 aa, Neisseria
VSGDYVRGRLKNLPSLPGREDAYGNRP

SEQ ID NO: 2496 - protein, 13 aa, Neisseria
IAQDDQNAPRVPA

SEQ ID NO: 2497 - protein, 8 aa, Neisseria
SLTDRIDA

SEQ ID NO: 2498 - protein, 13 aa, Neisseria
NKLARYETRTPGH

SEQ ID NO: 2499 - protein, 13 aa, Neisseria
GANYRRNTRYGEW

SEQ ID NO: 2500 - protein, 5 aa, Neisseria
ADNLL

SEQ ID NO: 2501 - protein, 16 aa, Neisseria
FLSDTPQMGRSFTGGV

SEQ ID NO: 2502 - protein, 8 aa, Neisseria
MRREAKMA

SEQ ID NO: 2503 - protein, 11 aa, Neisseria
HETEQSVDLET

SEQ ID NO: 2504 - protein, 8 aa, Neisseria
GKSRPRAT

SEQ ID NO: 2505 - protein, 8 aa, Neisseria
TASDKIIS

SEQ ID NO: 2506 - protein, 7 aa, Neisseria
DTLRQKA

SEQ ID NO: 2507 - protein, 8 aa, Neisseria
QTGRRIKV

SEQ ID NO: 2508 - protein, 11 aa, Neisseria
GETGDMADFSP

SEQ ID NO: 2509 - protein, 17 aa, Neisseria
DVADGKIPEKMPENGVS

SEQ ID NO: 2510 - protein, 9 aa, Neisseria
SSGNLEKLT

SEQ ID NO: 2511 - protein, 8 aa, Neisseria
GLYRKSGD

SEQ ID NO: 2512 - protein, 17 aa, Neisseria
RYRNLKRLPDSHADSQT

SEQ ID NO: 2513 - protein, 8 aa, Neisseria
YSDRRDQY

SEQ ID NO: 2514 - protein, 8 aa, Neisseria
HEYDDCHA

SEQ ID NO: 2515 - protein, 10 aa, Neisseria
LTEEDIDYDN

SEQ ID NO: 2516 - protein, 8 aa, Neisseria
FHDDDNAH

SEQ ID NO: 2517 - protein, 12 aa, Neisseria
LRNKRYELRAEW

SEQ ID NO: 2518 - protein, 17 aa, Neisseria
HLNRNDYRHDEKAGDAV

SEQ ID NO: 2519 - protein, 10 aa, Neisseria
TQNARIELRH

SEQ ID NO: 2520 - protein, 5 aa, Neisseria
GRLKG

SEQ ID NO: 2521 - protein, 10 aa, Neisseria
GGVRVEKQKA

SEQ ID NO: 2522 - protein, 8 aa, Neisseria
ALIDRENY

SEQ ID NO: 2523 - protein, 7 aa, Neisseria
GAHRQTA

SEQ ID NO: 2524 - protein, 8 aa, Neisseria
SHQERLPS

SEQ ID NO: 2525 - protein, 9 aa, Neisseria
HLNKERSNN

SEQ ID NO: 2526 - protein, 6 aa, Neisseria
YEGDRW

SEQ ID NO: 2527 - protein, 18 aa, Neisseria
LNDGRGPKSIEDDSEMKL

SEQ ID NO: 2528 - protein, 5 aa, Neisseria
YGAEG

SEQ ID NO: 2529 - protein, 7 aa, Neisseria
PTPRYRI

SEQ ID NO: 2530 - protein, 9 aa, Neisseria
DYVRGRLKN

SEQ ID NO: 2531 - protein, 8 aa, Neisseria
PGREDAYG

SEQ ID NO: 2532 - protein, 13 aa, Neisseria
IAQDDQNAPRVPA

SEQ ID NO: 2533 - protein, 8 aa, Neisseria
SLTDRIDA

SEQ ID NO: 2534 - protein, 11 aa, Neisseria
KLARYETRTPG

SEQ ID NO: 2535 - protein, 9 aa, Neisseria
NYRRNTRYG

SEQ ID NO: 2536 - protein, 9 aa, Neisseria
ITQLLSGLD

SEQ ID NO: 2537 - protein, 10 aa, Neisseria
VADKAADSLE

SEQ ID NO: 2538 - protein, 8 aa, Neisseria
NGKKAPKL

SEQ ID NO: 2539 - protein, 17 aa, Neisseria
SYPNFCQAGKDFDRRFE

SEQ ID NO: 2540 - protein, 7 aa, Neisseria
AWTDNIA

SEQ ID NO: 2541 - protein, 7 aa, Neisseria
TPPAGLQ

SEQ ID NO: 2542 - protein, 7 aa, Neisseria
REILDLL

SEQ ID NO: 2543 - protein, 6 aa, Neisseria
VARALS

SEQ ID NO: 2544 - protein, 18 aa, Neisseria
FVKGYAAFAHYEELDKII

SEQ ID NO: 2545 - protein, 12 aa, Neisseria
IVDVLHRFPASL

SEQ ID NO: 2546 - protein, 11 aa, Neisseria
EQFIRLLRPLA

SEQ ID NO: 2547 - protein, 6 aa, Neisseria
GVAPFR

SEQ ID NO: 2548 - protein, 8 aa, Neisseria
TEWQQFAK

SEQ ID NO: 2549 - protein, 5 aa, Neisseria
IREQA

SEQ ID NO: 2550 - protein, 16 aa, Neisseria
AAKMAKDVEAALLDVI

SEQ ID NO: 2551 - protein, 9 aa, Neisseria
EYLDMLREE

SEQ ID NO: 2552 - protein, 12 aa, Neisseria
MSEHDMQNTNPP

SEQ ID NO: 2553 - protein, 5 aa, Neisseria
LPPEI

SEQ ID NO: 2554 - protein, 10 aa, Neisseria
KAGNGASAGL

SEQ ID NO: 2555 - protein, 18 aa, Neisseria
SQTGNAKSVADKAADSLE

SEQ ID NO: 2556 - protein, 19 aa, Neisseria
SRAELKDYKAKNIAGERRL

SEQ ID NO: 2557 - protein, 15 aa, Neisseria
TSTQGEGEPPKEAVV

SEQ ID NO: 2558 - protein, 11 aa, Neisseria
LNGKKAPKLDK

SEQ ID NO: 2559 - protein, 39 aa, Neisseria
GLGDSSYPNFCQAGKDFDRRFEELGAKRLLERVDADLDF

SEQ ID NO: 2560 - protein, 32 aa, Neisseria
LKEEAAKNRATPAPQTTPPAGLQTAPDGRYCK

SEQ ID NO: 2561 - protein, 24 aa, Neisseria
QKITARQSDKDVRHIEIDLSGSDL

SEQ ID NO: 2562 - protein, 5 aa, Neisseria
LPGDA

SEQ ID NO: 2563 - protein, 8 aa, Neisseria
FDNDPALV

SEQ ID NO: 2564 - protein, 14 aa, Neisseria
DPATEIQAGGKMMP

SEQ ID NO: 2565 - protein, 10 aa, Neisseria
FELTQNTPAF

SEQ ID NO: 2566 - protein, 8 aa, Neisseria
EELDKIIA

SEQ ID NO: 2567 - protein, 11 aa, Neisseria
SAQAEVGDEVH

SEQ ID NO: 2568 - protein, 16 aa, Neisseria
FEHEGRARTGGASGFL

SEQ ID NO: 2569 - protein, 9 aa, Neisseria
DRLEEDGTV

SEQ ID NO: 2570 - protein, 17 aa, Neisseria
FVERNDGFRLPEDSRKP

SEQ ID NO: 2571 - protein, 5 aa, Neisseria
GSGTG

SEQ ID NO: 2572 - protein, 11 aa, Neisseria
QRAAENAEGKN

SEQ ID NO: 2573 - protein, 25 aa, Neisseria
QFAKDGFLHRYDFAWSRDQEEKIYV

SEQ ID NO: 2574 - protein, 8 aa, Neisseria
DKIREQAE

SEQ ID NO: 2575 - protein, 10 aa, Neisseria
DAAKMAKDVE

SEQ ID NO: 2576 - protein, 26 aa, Neisseria
GHLDEEGAEEYLDMLREEKRYQRDVY

SEQ ID NO: 2577 - protein, 8 aa, Neisseria
MSEHDMQN

SEQ ID NO: 2578 - protein, 15 aa, Neisseria
GNAKSVADKAADSLE

SEQ ID NO: 2579 - protein, 19 aa, Neisseria
SRAELKDYKAKNIAGERRL

SEQ ID NO: 2580 - protein, 13 aa, Neisseria
TQGEGEPPKEAVV

SEQ ID NO: 2581 - protein, 11 aa, Neisseria
LNGKKAPKLDK

SEQ ID NO: 2582 - protein, 27 aa, Neisseria
AGKDFDRRFEELGAKRLLERVDADLDF

SEQ ID NO: 2583 - protein, 12 aa, Neisseria
LKEEAAKNRATP

SEQ ID NO: 2584 - protein, 9 aa, Neisseria
TAPDGRYCK

SEQ ID NO: 2585 - protein, 20 aa, Neisseria
KITARQSDKDVRHIEIDLSG

SEQ ID NO: 2586 - protein, 5 aa, Neisseria
DPALV

SEQ ID NO: 2587 - protein, 8 aa, Neisseria
EELDKIIA

SEQ ID NO: 2588 - protein, 10 aa, Neisseria
AQAEVGDEVH

SEQ ID NO: 2589 - protein, 11 aa, Neisseria
FEHEGRARTGG

SEQ ID NO: 2590 - protein, 9 aa, Neisseria
DRLEEDGTV

SEQ ID NO: 2591 - protein, 17 aa, Neisseria
FVERNDGFRLPEDSRKP

SEQ ID NO: 2592 - protein, 9 aa, Neisseria
RAAENAEGK

SEQ ID NO: 2593 - protein, 11 aa, Neisseria
WSRDQEEKIYV

SEQ ID NO: 2594 - protein, 8 aa, Neisseria
DKIREQAE

SEQ ID NO: 2595 - protein, 10 aa, Neisseria
DAAKMAKDVE

SEQ ID NO: 2596 - protein, 25 aa, Neisseria
HLDEEGAEEYLDMLREEKRYQRDVY

SEQ ID NO: 2597 - protein, 6 aa, Neisseria
NIAIIA

SEQ ID NO: 2598 - protein, 5 aa, Neisseria
DQLLR

SEQ ID NO: 2599 - protein, 6 aa, Neisseria
VDTPGH

SEQ ID NO: 2600 - protein, 14 aa, Neisseria
GGEVERVLGMVDCV

SEQ ID NO: 2601 - protein, 5 aa, Neisseria
KIDKP

SEQ ID NO: 2602 - protein, 10 aa, Neisseria
FELFDNLGAT

SEQ ID NO: 2603 - protein, 16 aa, Neisseria
SGLSGFAKLEETDESN

SEQ ID NO: 2604 - protein, 10 aa, Neisseria
PLFDTILKYT

SEQ ID NO: 2605 - protein, 15 aa, Neisseria
GRINQLLGFKGLERV

SEQ ID NO: 2606 - protein, 7 aa, Neisseria
VIISGIE

SEQ ID NO: 2607 - protein, 9 aa, Neisseria
IRDRLQKEL

SEQ ID NO: 2608 - protein, 5 aa, Neisseria
DTADA

SEQ ID NO: 2609 - protein, 10 aa, Neisseria
CEPYENLTVD

SEQ ID NO: 2610 - protein, 6 aa, Neisseria
LTRGVG

SEQ ID NO: 2611 - protein, 6 aa, Neisseria
MSHVFD

SEQ ID NO: 2612 - protein, 8 aa, Neisseria
KGKKLTNI

SEQ ID NO: 2613 - protein, 7 aa, Neisseria
EAVRLTT

SEQ ID NO: 2614 - protein, 5 aa, Neisseria
MKQIR

SEQ ID NO: 2615 - protein, 8 aa, Neisseria
VDHGKTTL

SEQ ID NO: 2616 - protein, 30 aa, Neisseria
LLRQSGTFRANQQVDERVMDSNDLEKERGI

SEQ ID NO: 2617 - protein, 9 aa, Neisseria
NTAIDYEGY

SEQ ID NO: 2618 - protein, 15 aa, Neisseria
VDTPGHADFGGEVER

SEQ ID NO: 2619 - protein, 14 aa, Neisseria
DAQEGPMPQTRFVT

SEQ ID NO: 2620 - protein, 11 aa, Neisseria
KIDKPSARPSW

SEQ ID NO: 2621 - protein, 8 aa, Neisseria
GATDEQLD

SEQ ID NO: 2622 - protein, 15 aa, Neisseria
AKLEETDESNDMRPL

SEQ ID NO: 2623 - protein, 12 aa, Neisseria
TPAPSGSADETL

SEQ ID NO: 2624 - protein, 8 aa, Neisseria
LDYDNYTG

SEQ ID NO: 2625 - protein, 9 aa, Neisseria
LNGRIKPGQ

SEQ ID NO: 2626 - protein, 7 aa, Neisseria
NHDQQIA

SEQ ID NO: 2627 - protein, 15 aa, Neisseria
KGLERVPLEEAEAGD

SEQ ID NO: 2628 - protein, 6 aa, Neisseria
GIEDIG

SEQ ID NO: 2629 - protein, 11 aa, Neisseria
ITDKDNPKGLP

SEQ ID NO: 2630 - protein, 7 aa, Neisseria
SVDEPTL

SEQ ID NO: 2631 - protein, 26 aa, Neisseria
TSPLAGTEGKFVTSRQIRDRLQKELL

SEQ ID NO: 2632 - protein, 20 aa, Neisseria
LRVEDTADADVFRVSGRGEL

SEQ ID NO: 2633 - protein, 7 aa, Neisseria
NMRREGY

SEQ ID NO: 2634 - protein, 60 aa, Neisseria
VGKPRVVYRDIDGQKCEPYENLTVDVPDDNQGAVMEELGRRRGELTNMESDGNGRTRLEY

SEQ ID NO: 2635 - protein, 18 aa, Neisseria
VFDDYAPVKPDMPGRHNG

SEQ ID NO: 2636 - protein, 5 aa, Neisseria
QEQGE

SEQ ID NO: 2637 - protein, 17 aa, Neisseria
NLEDRGRMFVSPNDKIY

SEQ ID NO: 2638 - protein, 8 aa, Neisseria
IHSRDNDL

SEQ ID NO: 2639 - protein, 20 aa, Neisseria
PLKGKKLTNIRASGTDEAVR

SEQ ID NO: 2640 - protein, 9 aa, Neisseria
FIDDDELVE

SEQ ID NO: 2641 - protein, 25 aa, Neisseria
TPQSIRLRKRYLSELERRRHFKKLD

SEQ ID NO: 2642 - protein, 5 aa, Neisseria
MKQIR

SEQ ID NO: 2643 - protein, 5 aa, Neisseria
GTFRA

SEQ ID NO: 2644 - protein, 19 aa, Neisseria
QQVDERVMDSNDLEKERGI

SEQ ID NO: 2645 - protein, 7 aa, Neisseria
FGGEVER

SEQ ID NO: 2646 - protein, 8 aa, Neisseria
DAQEGPMP

SEQ ID NO: 2647 - protein, 7 aa, Neisseria
KIDKPSA

SEQ ID NO: 2648 - protein, 8 aa, Neisseria
GATDEQLD

SEQ ID NO: 2649 - protein, 15 aa, Neisseria
AKLEETDESNDMRPL

SEQ ID NO: 2650 - protein, 7 aa, Neisseria
GSADETL

SEQ ID NO: 2651 - protein, 7 aa, Neisseria
LNGRIKP

SEQ ID NO: 2652 - protein, 6 aa, Neisseria
HDQQIA

SEQ ID NO: 2653 - protein, 14 aa, Neisseria
GLERVPLEEAEAGD

SEQ ID NO: 2654 - protein, 6 aa, Neisseria
GIEDIG

SEQ ID NO: 2655 - protein, 9 aa, Neisseria
ITDKDNPKG

SEQ ID NO: 2656 - protein, 7 aa, Neisseria
SVDEPTL

SEQ ID NO: 2657 - protein, 9 aa, Neisseria
AGTEGKFVT

SEQ ID NO: 2658 - protein, 12 aa, Neisseria
RQIRDRLQKELL

SEQ ID NO: 2659 - protein, 20 aa, Neisseria
LRVEDTADADVFRVSGRGEL

SEQ ID NO: 2660 - protein, 7 aa, Neisseria
NMRREGY

SEQ ID NO: 2661 - protein, 20 aa, Neisseria
VGKPRVVYRDIDGQKCEPYE

SEQ ID NO: 2662 - protein, 34 aa, Neisseria
DVPDDNQGAVMEELGRRRGELTNMESDGNGRTRL

SEQ ID NO: 2663 - protein, 11 aa, Neisseria
APVKPDMPGRH

SEQ ID NO: 2664 - protein, 5 aa, Neisseria
QEQGE

SEQ ID NO: 2665 - protein, 7 aa, Neisseria
LEDRGRM

SEQ ID NO: 2666 - protein, 6 aa, Neisseria
PNDKIY

SEQ ID NO: 2667 - protein, 7 aa, Neisseria
HSRDNDL

SEQ ID NO: 2668 - protein, 8 aa, Neisseria
LKGKKLTN

SEQ ID NO: 2669 - protein, 10 aa, Neisseria
RASGTDEAVR

SEQ ID NO: 2670 - protein, 9 aa, Neisseria
FIDDDELVE

SEQ ID NO: 2671 - protein, 21 aa, Neisseria
IRLRKRYLSELERRRHFKKLD

SEQ ID NO: 2672 - protein, 6 aa, Neisseria
LPTRLF

SEQ ID NO: 2673 - protein, 31 aa, Neisseria
RFSRFVQGWAGIRGYLKNGIPEHIQPGHNPL

SEQ ID NO: 2674 - protein, 5 aa, Neisseria
ALLAA

SEQ ID NO: 2675 - protein, 12 aa, Neisseria
LNHLVSEHTGSL

SEQ ID NO: 2676 - protein, 18 aa, Neisseria
FKLLAVFSAIHIAAVAAY

SEQ ID NO: 2677 - protein, 7 aa, Neisseria
MKNKTKV

SEQ ID NO: 2678 - protein, 7 aa, Neisseria
SAKAGGD

SEQ ID NO: 2679 - protein, 9 aa, Neisseria
GSDTARFSR

SEQ ID NO: 2680 - protein, 18 aa, Neisseria
GYLKNGIPEHIQPGHNPL

SEQ ID NO: 2681 - protein, 12 aa, Neisseria
AADENTFSTNGY

SEQ ID NO: 2682 - protein, 7 aa, Neisseria
HTGSLMR

SEQ ID NO: 2683 - protein, 7 aa, Neisseria
VFKKKNL

SEQ ID NO: 2684 - protein, 7 aa, Neisseria
IEGKTSI

SEQ ID NO: 2685 - protein, 7 aa, Neisseria
MKNKTKV

SEQ ID NO: 2686 - protein, 5 aa, Neisseria
DTARF

SEQ ID NO: 2687 - protein, 7 aa, Neisseria
AADENTF

SEQ ID NO: 2688 - protein, 7 aa, Neisseria
VFKKKNL

SEQ ID NO: 2689 - protein, 7 aa, Neisseria
IEGKTSI

SEQ ID NO: 2690 - protein, 16 aa, Neisseria
AASVLSLPEMMRLMVF

SEQ ID NO: 2691 - protein, 13 aa, Neisseria
TLVAYIKLSSVAE

SEQ ID NO: 2692 - protein, 7 aa, Neisseria
VSVPQHW

SEQ ID NO: 2693 - protein, 10 aa, Neisseria
VNTILNGIAY

SEQ ID NO: 2694 - protein, 25 aa, Neisseria
AKKLSHLYRITEAVGRWSMIDIFVI

SEQ ID NO: 2695 - protein, 5 aa, Neisseria
IRKQA

SEQ ID NO: 2696 - protein, 5 aa, Neisseria
VRLRQ

SEQ ID NO: 2697 - protein, 5 aa, Neisseria
AEVRF

SEQ ID NO: 2698 - protein, 19 aa, Neisseria
RLTGDNAVQTASEGKTCCS

SEQ ID NO: 2699 - protein, 11 aa, Neisseria
YFRDSAESPCG

SEQ ID NO: 2700 - protein, 11 aa, Neisseria
ELYRRRPKSLS

SEQ ID NO: 2701 - protein, 6 aa, Neisseria
SNPAAT

SEQ ID NO: 2702 - protein, 6 aa, Neisseria
DEGDRL

SEQ ID NO: 2703 - protein, 6 aa, Neisseria
TGAKKL

SEQ ID NO: 2704 - protein, 12 aa, Neisseria
LLWDKRASDGIA

SEQ ID NO: 2705 - protein, 7 aa, Neisseria
NETEKHD

SEQ ID NO: 2706 - protein, 5 aa, Neisseria
VRLRQ

SEQ ID NO: 2707 - protein, 5 aa, Neisseria
AEVRF

SEQ ID NO: 2708 - protein, 9 aa, Neisseria
TASEGKTCC

SEQ ID NO: 2709 - protein, 6 aa, Neisseria
DSAESP

SEQ ID NO: 2710 - protein, 11 aa, Neisseria
ELYRRRPKSLS

SEQ ID NO: 2711 - protein, 6 aa, Neisseria
DEGDRL

SEQ ID NO: 2712 - protein, 5 aa, Neisseria
GAKKL

SEQ ID NO: 2713 - protein, 9 aa, Neisseria
LLWDKRASD

SEQ ID NO: 2714 - protein, 7 aa, Neisseria
NETEKHD

SEQ ID NO: 2715 - protein, 9 aa, Neisseria
GVTGLGTLL

SEQ ID NO: 2716 - protein, 7 aa, Neisseria
QDIPPVT

SEQ ID NO: 2717 - protein, 9 aa, Neisseria
TKNSKNVKS

SEQ ID NO: 2718 - protein, 5 aa, Neisseria
FKQSV

SEQ ID NO: 2719 - protein, 19 aa, Neisseria
SKEHWKQQFQTALNKGLTA

SEQ ID NO: 2720 - protein, 8 aa, Neisseria
SKMIELND

SEQ ID NO: 2721 - protein, 13 aa, Neisseria
KLADLLDKFDKLP

SEQ ID NO: 2722 - protein, 6 aa, Neisseria
VAELNG

SEQ ID NO: 2723 - protein, 30 aa, Neisseria
LSSIDKLVGKPQTQNIPNELNQTLKELRTT

SEQ ID NO: 2724 - protein, 29 aa, Neisseria
IYGDVQNTLQSLDKTLKDVQPVINTLKEK

SEQ ID NO: 2725 - protein, 21 aa, Neisseria
MTDNSPPPNGHAQARVRKNNT

SEQ ID NO: 2726 - protein, 9 aa, Neisseria
KEIRNRGPV

SEQ ID NO: 2727 - protein, 11 aa, Neisseria
DSAEGIEVNNT

SEQ ID NO: 2728 - protein, 18 aa, Neisseria
DVGRVTRIKLRDDQKGVE

SEQ ID NO: 2729 - protein, 11 aa, Neisseria
DVSGLIRSDTQ

SEQ ID NO: 2730 - protein, 9 aa, Neisseria
VKPRIDQSG

SEQ ID NO: 2731 - protein, 13 aa, Neisseria
TPGKSDEAKDVFQ

SEQ ID NO: 2732 - protein, 10 aa, Neisseria
LIGKNDRILN

SEQ ID NO: 2733 - protein, 9 aa, Neisseria
AHFDPSDQS

SEQ ID NO: 2734 - protein, 8 aa, Neisseria
QSPNDKLI

SEQ ID NO: 2735 - protein, 17 aa, Neisseria
ESGINIETTGSGIKLNS

SEQ ID NO: 2736 - protein, 18 aa, Neisseria
SFDSPKTKNSKNVKSEDS

SEQ ID NO: 2737 - protein, 18 aa, Neisseria
TLYDSRSEVANLPDDRSL

SEQ ID NO: 2738 - protein, 6 aa, Neisseria
QSVRGL

SEQ ID NO: 2739 - protein, 7 aa, Neisseria
VEYKGLN

SEQ ID NO: 2740 - protein, 8 aa, Neisseria
PYFDRNDS

SEQ ID NO: 2741 - protein, 24 aa, Neisseria
IRIEPSRLEINADEQSKEHWKQQF

SEQ ID NO: 2742 - protein, 6 aa, Neisseria
ALNKGL

SEQ ID NO: 2743 - protein, 21 aa, Neisseria
LTGSKMIELNDQPSASPKLRP

SEQ ID NO: 2744 - protein, 12 aa, Neisseria
QGGGLDDLQVKL

SEQ ID NO: 2745 - protein, 16 aa, Neisseria
DLLDKFDKLPLDKTVA

SEQ ID NO: 2746 - protein, 15 aa, Neisseria
NGSLAELKSTLKSAN

SEQ ID NO: 2747 - protein, 28 aa, Neisseria
SIDKLVGKPQTQNIPNELNQTLKELRTT

SEQ ID NO: 2748 - protein, 5 aa, Neisseria
VSPQS

SEQ ID NO: 2749 - protein, 10 aa, Neisseria
SLDKTLKDVQ

SEQ ID NO: 2750 - protein, 7 aa, Neisseria
TLKEKPN

SEQ ID NO: 2751 - protein, 13 aa, Neisseria
NSSSKDPIPKGSR

SEQ ID NO: 2752 - protein, 8 aa, Neisseria
MTDNSPPP

SEQ ID NO: 2753 - protein, 9 aa, Neisseria
AQARVRKNN

SEQ ID NO: 2754 - protein, 7 aa, Neisseria
KEIRNRG

SEQ ID NO: 2755 - protein, 7 aa, Neisseria
DSAEGIE

SEQ ID NO: 2756 - protein, 18 aa, Neisseria
DVGRVTRIKLRDDQKGVE

SEQ ID NO: 2757 - protein, 5 aa, Neisseria
IRSDT

SEQ ID NO: 2758 - protein, 5 aa, Neisseria
PRIDQ

SEQ ID NO: 2759 - protein, 11 aa, Neisseria
GKSDEAKDVFQ

SEQ ID NO: 2760 - protein, 7 aa, Neisseria
GKNDRIL

SEQ ID NO: 2761 - protein, 8 aa, Neisseria
AHFDPSDQ

SEQ ID NO: 2762 - protein, 6 aa, Neisseria
PNDKLI

SEQ ID NO: 2763 - protein, 16 aa, Neisseria
DSPKTKNSKNVKSEDS

SEQ ID NO: 2764 - protein, 6 aa, Neisseria
DSRSEV

SEQ ID NO: 2765 - protein, 7 aa, Neisseria
NLPDDRS

SEQ ID NO: 2766 - protein, 5 aa, Neisseria
VEYKG

SEQ ID NO: 2767 - protein, 5 aa, Neisseria
DRNDS

SEQ ID NO: 2768 - protein, 21 aa, Neisseria
IRIEPSRLEINADEQSKEHWK

SEQ ID NO: 2769 - protein, 17 aa, Neisseria
KMIELNDQPSASPKLRP

SEQ ID NO: 2770 - protein, 10 aa, Neisseria
GGLDDLQVKL

SEQ ID NO: 2771 - protein, 16 aa, Neisseria
DLLDKFDKLPLDKTVA

SEQ ID NO: 2772 - protein, 11 aa, Neisseria
AELKSTLKSAN

SEQ ID NO: 2773 - protein, 7 aa, Neisseria
SIDKLVG

SEQ ID NO: 2774 - protein, 5 aa, Neisseria
IPNEL

SEQ ID NO: 2775 - protein, 8 aa, Neisseria
QTLKELRT

SEQ ID NO: 2776 - protein, 10 aa, Neisseria
SLDKTLKDVQ

SEQ ID NO: 2777 - protein, 7 aa, Neisseria
TLKEKPN

SEQ ID NO: 2778 - protein, 11 aa, Neisseria
SSKDPIPKGSR

SEQ ID NO: 2779 - protein, 5 aa, Neisseria
KLGFE

SEQ ID NO: 2780 - protein, 5 aa, Neisseria
AASLD

SEQ ID NO: 2781 - protein, 6 aa, Neisseria
LRAKKV

SEQ ID NO: 2782 - protein, 38 aa, Neisseria
VPRISRAQALDALSSMANISGYRAVIEAANAFGRFFTG

SEQ ID NO: 2783 - protein, 20 aa, Neisseria
VAGLAAIGTANSLGAVVRAF

SEQ ID NO: 2784 - protein, 9 aa, Neisseria
AEQIESMGG

SEQ ID NO: 2785 - protein, 7 aa, Neisseria
DGYAKVM

SEQ ID NO: 2786 - protein, 16 aa, Neisseria
KPAPKLITKEMVESMK

SEQ ID NO: 2787 - protein, 6 aa, Neisseria
LTRPGE

SEQ ID NO: 2788 - protein, 16 aa, Neisseria
VKIIGYTDMANRLAGQ

SEQ ID NO: 2789 - protein, 11 aa, Neisseria
TNLVNLTKLLS

SEQ ID NO: 2790 - protein, 6 aa, Neisseria
KLAPAV

SEQ ID NO: 2791 - protein, 5 aa, Neisseria
NHFIV

SEQ ID NO: 2792 - protein, 16 aa, Neisseria
LHTPLMSVTNAISGII

SEQ ID NO: 2793 - protein, 5 aa, Neisseria
GALLQ

SEQ ID NO: 2794 - protein, 11 aa, Neisseria
NGFVSLLSFVA

SEQ ID NO: 2795 - protein, 6 aa, Neisseria
INIFGG

SEQ ID NO: 2796 - protein, 13 aa, Neisseria
GIPRESLSGETRV

SEQ ID NO: 2797 - protein, 6 aa, Neisseria
SLDDAA

SEQ ID NO: 2798 - protein, 9 aa, Neisseria
VNAPSEQEL

SEQ ID NO: 2799 - protein, 8 aa, Neisseria
WPRQNEAL

SEQ ID NO: 2800 - protein, 7 aa, Neisseria
LRAKKVN

SEQ ID NO: 2801 - protein, 7 aa, Neisseria
MVPRISR

SEQ ID NO: 2802 - protein, 8 aa, Neisseria
AAGKVPPA

SEQ ID NO: 2803 - protein, 17 aa, Neisseria
FDTRLEVAEQIESMGGK

SEQ ID NO: 2804 - protein, 18 aa, Neisseria
DFPQESGGSGDGYAKVMS

SEQ ID NO: 2805 - protein, 10 aa, Neisseria
LFAEQAKEVD

SEQ ID NO: 2806 - protein, 11 aa, Neisseria
IPGKPAPKLIT

SEQ ID NO: 2807 - protein, 10 aa, Neisseria
EMVESMKSGS

SEQ ID NO: 2808 - protein, 15 aa, Neisseria
TGGNCELTRPGELSV

SEQ ID NO: 2809 - protein, 6 aa, Neisseria
LAGQSS

SEQ ID NO: 2810 - protein, 10 aa, Neisseria
LLSPNKDGEI

SEQ ID NO: 2811 - protein, 7 aa, Neisseria
LDFEDVI

SEQ ID NO: 2812 - protein, 10 aa, Neisseria
VTHDGEITFP

SEQ ID NO: 2813 - protein, 21 aa, Neisseria
AQPQQTPSEKAVPAAKPEPKP

SEQ ID NO: 2814 - protein, 13 aa, Neisseria
GIPRESLSGETRV

SEQ ID NO: 2815 - protein, 6 aa, Neisseria
SLDDAA

SEQ ID NO: 2816 - protein, 7 aa, Neisseria
APSEQEL

SEQ ID NO: 2817 - protein, 6 aa, Neisseria
RQNEAL

SEQ ID NO: 2818 - protein, 7 aa, Neisseria
LRAKKVN

SEQ ID NO: 2819 - protein, 7 aa, Neisseria
MVPRISR

SEQ ID NO: 2820 - protein, 15 aa, Neisseria
FDTRLEVAEQIESMG

SEQ ID NO: 2821 - protein, 14 aa, Neisseria
DFPQESGGSGDGYA

SEQ ID NO: 2822 - protein, 10 aa, Neisseria
LFAEQAKEVD

SEQ ID NO: 2823 - protein, 6 aa, Neisseria
PGKPAP

SEQ ID NO: 2824 - protein, 8 aa, Neisseria
EMVESMKS

SEQ ID NO: 2825 - protein, 10 aa, Neisseria
GNCELTRPGE

SEQ ID NO: 2826 - protein, 8 aa, Neisseria
SPNKDGEI

SEQ ID NO: 2827 - protein, 7 aa, Neisseria
LDFEDVI

SEQ ID NO: 2828 - protein, 5 aa, Neisseria
HDGEI

SEQ ID NO: 2829 - protein, 17 aa, Neisseria
QTPSEKAVPAAKPEPKP

SEQ ID NO: 2830 - protein, 9 aa, Neisseria
NGFEAFAPF

SEQ ID NO: 2831 - protein, 18 aa, Neisseria
YAKKAGGFRFKDNHNPRG

SEQ ID NO: 2832 - protein, 5 aa, Neisseria
QGAAA

SEQ ID NO: 2833 - protein, 9 aa, Neisseria
HAAQQNGFE

SEQ ID NO: 2834 - protein, 6 aa, Neisseria
ATGNAA

SEQ ID NO: 2835 - protein, 5 aa, Neisseria
DKAAM

SEQ ID NO: 2836 - protein, 16 aa, Neisseria
YAKKAGGFRFKDNHNP

SEQ ID NO: 2837 - protein, 5 aa, Neisseria
DKAAM

SEQ ID NO: 2838 - protein, 7 aa, Neisseria
GRDVRAA

SEQ ID NO: 2839 - protein, 7 aa, Neisseria
INHLLKR

SEQ ID NO: 2840 - protein, 6 aa, Neisseria
FVRAAQ

SEQ ID NO: 2841 - protein, 5 aa, Neisseria
QLVDR

SEQ ID NO: 2842 - protein, 9 aa, Neisseria
AHDRSLDGF

SEQ ID NO: 2843 - protein, 26 aa, Neisseria
MRNEEKRALRRELRGRRSQMGRDVRA

SEQ ID NO: 2844 - protein, 9 aa, Neisseria
RYIKKGRKI

SEQ ID NO: 2845 - protein, 12 aa, Neisseria
PMGKELRLDGFV

SEQ ID NO: 2846 - protein, 7 aa, Neisseria
AAQKRGA

SEQ ID NO: 2847 - protein, 9 aa, Neisseria
IEPRSRRMW

SEQ ID NO: 2848 - protein, 18 aa, Neisseria
YPADGVKQERKRGRAKLH

SEQ ID NO: 2849 - protein, 9 aa, Neisseria
AGRKKRVHD

SEQ ID NO: 2850 - protein, 7 aa, Neisseria
GMDRLGY

SEQ ID NO: 2851 - protein, 7 aa, Neisseria
MKYRLQA

SEQ ID NO: 2852 - protein, 14 aa, Neisseria
LPVEAHDRSLDGFV

SEQ ID NO: 2853 - protein, 26 aa, Neisseria
MRNEEKRALRRELRGRRSQMGRDVRA

SEQ ID NO: 2854 - protein, 9 aa, Neisseria
RYIKKGRKI

SEQ ID NO: 2855 - protein, 5 aa, Neisseria
KELRL

SEQ ID NO: 2856 - protein, 7 aa, Neisseria
AAQKRGA

SEQ ID NO: 2857 - protein, 7 aa, Neisseria
IEPRSRR

SEQ ID NO: 2858 - protein, 14 aa, Neisseria
DGVKQERKRGRAKL

SEQ ID NO: 2859 - protein, 9 aa, Neisseria
AGRKKRVHD

SEQ ID NO: 2860 - protein, 5 aa, Neisseria
DRLGY

SEQ ID NO: 2861 - protein, 7 aa, Neisseria
MKYRLQA

SEQ ID NO: 2862 - protein, 11 aa, Neisseria
LPVEAHDRSLD

SEQ ID NO: 2863 - protein, 8 aa, Neisseria
FSRAAEQL

SEQ ID NO: 2864 - protein, 10 aa, Neisseria
AVSRIVKRLE

SEQ ID NO: 2865 - protein, 8 aa, Neisseria
GVNLLNRT

SEQ ID NO: 2866 - protein, 14 aa, Neisseria
GAQYFRRAQRILQE

SEQ ID NO: 2867 - protein, 8 aa, Neisseria
LAVHEIPQ

SEQ ID NO: 2868 - protein, 5 aa, Neisseria
VIASP

SEQ ID NO: 2869 - protein, 8 aa, Neisseria
TPQSTEEL

SEQ ID NO: 2870 - protein, 17 aa, Neisseria
HQCLGFTEPGSLNTWAV

SEQ ID NO: 2871 - protein, 8 aa, Neisseria
MKTNSEEL

SEQ ID NO: 2872 - protein, 10 aa, Neisseria
ESGSFSRAAE

SEQ ID NO: 2873 - protein, 11 aa, Neisseria
RIVKRLEEKLG

SEQ ID NO: 2874 - protein, 27 aa, Neisseria
LLNRTTRQLSLTEEGAQYFRRAQRILQ

SEQ ID NO: 2875 - protein, 7 aa, Neisseria
AAAETEM

SEQ ID NO: 2876 - protein, 10 aa, Neisseria
KFNERYPHIR

SEQ ID NO: 2877 - protein, 7 aa, Neisseria
IERKVDI

SEQ ID NO: 2878 - protein, 13 aa, Neisseria
LRAGELDDSGLRA

SEQ ID NO: 2879 - protein, 9 aa, Neisseria
HLFDSRFRV

SEQ ID NO: 2880 - protein, 19 aa, Neisseria
ASPEYLAKHGTPQSTEELA

SEQ ID NO: 2881 - protein, 9 aa, Neisseria
GFTEPGSLN

SEQ ID NO: 2882 - protein, 8 aa, Neisseria
AQGNPYKI

SEQ ID NO: 2883 - protein, 11 aa, Neisseria
PHFTASSGEIL

SEQ ID NO: 2884 - protein, 6 aa, Neisseria
LCLSGC

SEQ ID NO: 2885 - protein, 11 aa, Neisseria
LVDNDIAEGKL

SEQ ID NO: 2886 - protein, 10 aa, Neisseria
EQTSDKTHPF

SEQ ID NO: 2887 - protein, 8 aa, Neisseria
YSDKAVNL

SEQ ID NO: 2888 - protein, 8 aa, Neisseria
ELGNNLCG

SEQ ID NO: 2889 - protein, 8 aa, Neisseria
MKTNSEEL

SEQ ID NO: 2890 - protein, 7 aa, Neisseria
SFSRAAE

SEQ ID NO: 2891 - protein, 11 aa, Neisseria
RIVKRLEEKLG

SEQ ID NO: 2892 - protein, 18 aa, Neisseria
SLTEEGAQYFRRAQRILQ

SEQ ID NO: 2893 - protein, 7 aa, Neisseria
AAAETEM

SEQ ID NO: 2894 - protein, 7 aa, Neisseria
KFNERYP

SEQ ID NO: 2895 - protein, 7 aa, Neisseria
IERKVDI

SEQ ID NO: 2896 - protein, 13 aa, Neisseria
LRAGELDDSGLRA

SEQ ID NO: 2897 - protein, 5 aa, Neisseria
SRFRV

SEQ ID NO: 2898 - protein, 7 aa, Neisseria
QSTEELA

SEQ ID NO: 2899 - protein, 8 aa, Neisseria
NDIAEGKL

SEQ ID NO: 2900 - protein, 7 aa, Neisseria
QTSDKTH

SEQ ID NO: 2901 - protein, 5 aa, Neisseria
KAVNL

SEQ ID NO: 2902 - protein, 10 aa, Neisseria
KLVDFAQLTG

SEQ ID NO: 2903 - protein, 5 aa, Neisseria
GLGHV

SEQ ID NO: 2904 - protein, 10 aa, Neisseria
ADLMNGLPET

SEQ ID NO: 2905 - protein, 11 aa, Neisseria
GTVSMVNALSS

SEQ ID NO: 2906 - protein, 12 aa, Neisseria
LSGVLKGWQDKR

SEQ ID NO: 2907 - protein, 11 aa, Neisseria
HLIQKVIDKPE

SEQ ID NO: 2908 - protein, 6 aa, Neisseria
MVAAAN

SEQ ID NO: 2909 - protein, 5 aa, Neisseria
LMRRF

SEQ ID NO: 2910 - protein, 8 aa, Neisseria
HAFVNHIR

SEQ ID NO: 2911 - protein, 6 aa, Neisseria
FGKAFK

SEQ ID NO: 2912 - protein, 7 aa, Neisseria
DILDKLV

SEQ ID NO: 2913 - protein, 12 aa, Neisseria
SVRHETLQREGL

SEQ ID NO: 2914 - protein, 15 aa, Neisseria
CIDGETSPRPVSTGD

SEQ ID NO: 2915 - protein, 19 aa, Neisseria
LSHDGKCGESLQPDMRQHG

SEQ ID NO: 2916 - protein, 8 aa, Neisseria
QCGNGQDM

SEQ ID NO: 2917 - protein, 7 aa, Neisseria
FRYDTHA

SEQ ID NO: 2918 - protein, 5 aa, Neisseria
LMNGL

SEQ ID NO: 2919 - protein, 7 aa, Neisseria
LESKKPL

SEQ ID NO: 2920 - protein, 9 aa, Neisseria
LEQDKDVEL

SEQ ID NO: 2921 - protein, 8 aa, Neisseria
GWQDKRLG

SEQ ID NO: 2922 - protein, 15 aa, Neisseria
VIDKPEDEWNVDKMV

SEQ ID NO: 2923 - protein, 15 aa, Neisseria
QLMRRFKSRVGLSPH

SEQ ID NO: 2924 - protein, 10 aa, Neisseria
LLLKKNPDSV

SEQ ID NO: 2925 - protein, 6 aa, Neisseria
QSETHF

SEQ ID NO: 2926 - protein, 5 aa, Neisseria
KAFKR

SEQ ID NO: 2927 - protein, 12 aa, Neisseria
SPGQYRKEGGQK

SEQ ID NO: 2928 - protein, 7 aa, Neisseria
DILDKLV

SEQ ID NO: 2929 - protein, 11 aa, Neisseria
VRHETLQREGL

SEQ ID NO: 2930 - protein, 10 aa, Neisseria
DGETSPRPVS

SEQ ID NO: 2931 - protein, 15 aa, Neisseria
HDGKCGESLQPDMRQ

SEQ ID NO: 2932 - protein, 7 aa, Neisseria
QCGNGQD

SEQ ID NO: 2933 - protein, 7 aa, Neisseria
LESKKPL

SEQ ID NO: 2934 - protein, 9 aa, Neisseria
LEQDKDVEL

SEQ ID NO: 2935 - protein, 7 aa, Neisseria
WQDKRLG

SEQ ID NO: 2936 - protein, 11 aa, Neisseria
VIDKPEDEWNV

SEQ ID NO: 2937 - protein, 11 aa, Neisseria
QLMRRFKSRVG

SEQ ID NO: 2938 - protein, 9 aa, Neisseria
LLLKKNPDS

SEQ ID NO: 2939 - protein, 5 aa, Neisseria
KAFKR

SEQ ID NO: 2940 - protein, 9 aa, Neisseria
QYRKEGGQK

SEQ ID NO: 2941 - protein, 6 aa, Neisseria
SSLGNI

SEQ ID NO: 2942 - protein, 6 aa, Neisseria
LGRDED

SEQ ID NO: 2943 - protein, 11 aa, Neisseria
FGFLSWLAMLF

SEQ ID NO: 2944 - protein, 13 aa, Neisseria
AEPLMHYFSDITA

SEQ ID NO: 2945 - protein, 24 aa, Neisseria
ISGRFGDAIDIMALLATFFGIITT

SEQ ID NO: 2946 - protein, 20 aa, Neisseria
MSLAVVSAISGVGKGVKVLS

SEQ ID NO: 2947 - protein, 15 aa, Neisseria
AFGDNIGNYLGNLVR

SEQ ID NO: 2948 - protein, 13 aa, Neisseria
WCSWAPFVGLFIA

SEQ ID NO: 2949 - protein, 7 aa, Neisseria
LFGVLWF

SEQ ID NO: 2950 - protein, 11 aa, Neisseria
AGGMLEKMTSS

SEQ ID NO: 2951 - protein, 22 aa, Neisseria
TLLFKFFNYLPLPELTSIVSLL

SEQ ID NO: 2952 - protein, 7 aa, Neisseria
WGVLMSA

SEQ ID NO: 2953 - protein, 10 aa, Neisseria
GLGNLQSMTL

SEQ ID NO: 2954 - protein, 14 aa, Neisseria
EQDILKFLKQTASP

SEQ ID NO: 2955 - protein, 8 aa, Neisseria
MHELQREL

SEQ ID NO: 2956 - protein, 6 aa, Neisseria
DFMYGI

SEQ ID NO: 2957 - protein, 8 aa, Neisseria
GQDVSDQL

SEQ ID NO: 2958 - protein, 7 aa, Neisseria
ADILKNY

SEQ ID NO: 2959 - protein, 5 aa, Neisseria
DRAKE

SEQ ID NO: 2960 - protein, 10 aa, Neisseria
IRLGRDEDVP

SEQ ID NO: 2961 - protein, 10 aa, Neisseria
TAGTPEHRQQ

SEQ ID NO: 2962 - protein, 14 aa, Neisseria
LKEKISGRFGDAID

SEQ ID NO: 2963 - protein, 6 aa, Neisseria
QLGAGL

SEQ ID NO: 2964 - protein, 8 aa, Neisseria
GVGKGVKV

SEQ ID NO: 2965 - protein, 10 aa, Neisseria
AYEREHKPWF

SEQ ID NO: 2966 - protein, 9 aa, Neisseria
RISKGRTIR

SEQ ID NO: 2967 - protein, 10 aa, Neisseria
MLEKMTSSPE

SEQ ID NO: 2968 - protein, 7 aa, Neisseria
TSADSGI

SEQ ID NO: 2969 - protein, 13 aa, Neisseria
ITSRDKGLSAPRW

SEQ ID NO: 2970 - protein, 7 aa, Neisseria
RSGGLGN

SEQ ID NO: 2971 - protein, 16 aa, Neisseria
LSADKKYFETRVNPTS

SEQ ID NO: 2972 - protein, 9 aa, Neisseria
TGGKWKERL

SEQ ID NO: 2973 - protein, 8 aa, Neisseria
SQTQEQDI

SEQ ID NO: 2974 - protein, 6 aa, Neisseria
LKQTAS

SEQ ID NO: 2975 - protein, 12 aa, Neisseria
ELQRELSEEYGL

SEQ ID NO: 2976 - protein, 13 aa, Neisseria
VRVDKMFHRDEPA

SEQ ID NO: 2977 - protein, 8 aa, Neisseria
VIRKETMR

SEQ ID NO: 2978 - protein, 28 aa, Neisseria
SVGQDVSDQLINDGKLPHIRHQTTYKPY

SEQ ID NO: 2979 - protein, 7 aa, Neisseria
FDGRVGY

SEQ ID NO: 2980 - protein, 8 aa, Neisseria
YMNKDELI

SEQ ID NO: 2981 - protein, 6 aa, Neisseria
ILKNYE

SEQ ID NO: 2982 - protein, 7 aa, Neisseria
EQVELAE

SEQ ID NO: 2983 - protein, 5 aa, Neisseria
DRAKE

SEQ ID NO: 2984 - protein, 9 aa, Neisseria
RLGRDEDVP

SEQ ID NO: 2985 - protein, 7 aa, Neisseria
TPEHRQQ

SEQ ID NO: 2986 - protein, 11 aa, Neisseria
LKEKISGRFGD

SEQ ID NO: 2987 - protein, 7 aa, Neisseria
VGKGVKV

SEQ ID NO: 2988 - protein, 8 aa, Neisseria
AYEREHKP

SEQ ID NO: 2989 - protein, 8 aa, Neisseria
ISKGRTIR

SEQ ID NO: 2990 - protein, 9 aa, Neisseria
MLEKMTSSP

SEQ ID NO: 2991 - protein, 8 aa, Neisseria
TSRDKGLS

SEQ ID NO: 2992 - protein, 9 aa, Neisseria
LSADKKYFE

SEQ ID NO: 2993 - protein, 6 aa, Neisseria
KWKERL

SEQ ID NO: 2994 - protein, 7 aa, Neisseria
QTQEQDI

SEQ ID NO: 2995 - protein, 12 aa, Neisseria
ELQRELSEEYGL

SEQ ID NO: 2996 - protein, 13 aa, Neisseria
VRVDKMFHRDEPA

SEQ ID NO: 2997 - protein, 8 aa, Neisseria
VIRKETMR

SEQ ID NO: 2998 - protein, 8 aa, Neisseria
SVGQDVSD

SEQ ID NO: 2999 - protein, 9 aa, Neisseria
LINDGKLPH

SEQ ID NO: 3000 - protein, 8 aa, Neisseria
YMNKDELI

SEQ ID NO: 3001 - protein, 7 aa, Neisseria
EQVELAE

SEQ ID NO: 3002 - protein, 10 aa, Neisseria
ANFYEMLAAA

SEQ ID NO: 3003 - protein, 8 aa, Neisseria
AYRALKQE

SEQ ID NO: 3004 - protein, 8 aa, Neisseria
AISAIGAV

SEQ ID NO: 3005 - protein, 6 aa, Neisseria
YILNDC

SEQ ID NO: 3006 - protein, 10 aa, Neisseria
LSKELAGLKA

SEQ ID NO: 3007 - protein, 9 aa, Neisseria
FEDVRRFPE

SEQ ID NO: 3008 - protein, 12 aa, Neisseria
LGRQPRINDLAH

SEQ ID NO: 3009 - protein, 16 aa, Neisseria
YANLFANLNGIERIFK

SEQ ID NO: 3010 - protein, 6 aa, Neisseria
VPAIYT

SEQ ID NO: 3011 - protein, 5 aa, Neisseria
WFNRI

SEQ ID NO: 3012 - protein, 10 aa, Neisseria
AKLLEGYGLS

SEQ ID NO: 3013 - protein, 6 aa, Neisseria
EVGELI

SEQ ID NO: 3014 - protein, 6 aa, Neisseria
MRGYLN

SEQ ID NO: 3015 - protein, 8 aa, Neisseria
TIVNGWLK

SEQ ID NO: 3016 - protein, 9 aa, Neisseria
VYPREIEEE

SEQ ID NO: 3017 - protein, 8 aa, Neisseria
FVQLKEGM

SEQ ID NO: 3018 - protein, 9 aa, Neisseria
EIRRHLRTV

SEQ ID NO: 3019 - protein, 6 aa, Neisseria
FKIPKQ

SEQ ID NO: 3020 - protein, 18 aa, Neisseria
NATGKVLKRVLKEQFDGN

SEQ ID NO: 3021 - protein, 5 aa, Neisseria
MNRTY

SEQ ID NO: 3022 - protein, 8 aa, Neisseria
ACRKNGNG

SEQ ID NO: 3023 - protein, 18 aa, Neisseria
FDGKEKTAYRALKQEAEA

SEQ ID NO: 3024 - protein, 6 aa, Neisseria
VSNSTE

SEQ ID NO: 3025 - protein, 7 aa, Neisseria
TFLKNSE

SEQ ID NO: 3026 - protein, 5 aa, Neisseria
NDCKA

SEQ ID NO: 3027 - protein, 8 aa, Neisseria
GLSKELAG

SEQ ID NO: 3028 - protein, 7 aa, Neisseria
KAQTPVE

SEQ ID NO: 3029 - protein, 39 aa, Neisseria
IWTDKSRPTGETAEGDAFFEDVRRFPEKPDLGRQPRIND

SEQ ID NO: 3030 - protein, 10 aa, Neisseria
SGTTGHPKGA

SEQ ID NO: 3031 - protein, 16 aa, Neisseria
LNGIERIFKISKRDRF

SEQ ID NO: 3032 - protein, 5 aa, Neisseria
TLLKR

SEQ ID NO: 3033 - protein, 8 aa, Neisseria
ISGGAPLA

SEQ ID NO: 3034 - protein, 7 aa, Neisseria
FKAKFPR

SEQ ID NO: 3035 - protein, 7 aa, Neisseria
YGLSEAS

SEQ ID NO: 3036 - protein, 9 aa, Neisseria
TPERQKARS

SEQ ID NO: 3037 - protein, 22 aa, Neisseria
LPGLEAKAVDEELVEVPRGEVG

SEQ ID NO: 3038 - protein, 8 aa, Neisseria
IVRGGSVM

SEQ ID NO: 3039 - protein, 7 aa, Neisseria
AATDETI

SEQ ID NO: 3040 - protein, 5 aa, Neisseria
LKTGD

SEQ ID NO: 3041 - protein, 6 aa, Neisseria
TIDEDG

SEQ ID NO: 3042 - protein, 26 aa, Neisseria
VDRKKDLIISKGQNVYPREIEEEIYK

SEQ ID NO: 3043 - protein, 11 aa, Neisseria
GVKDRYADEEI

SEQ ID NO: 3044 - protein, 17 aa, Neisseria
LKEGMDLGENEIRRHLR

SEQ ID NO: 3045 - protein, 28 aa, Neisseria
IHFKDGLPRNATGKVLKRVLKEQFDGNK

SEQ ID NO: 3046 - protein, 7 aa, Neisseria
ACRKNGN

SEQ ID NO: 3047 - protein, 18 aa, Neisseria
FDGKEKTAYRALKQEAEA

SEQ ID NO: 3048 - protein, 8 aa, Neisseria
GLSKELAG

SEQ ID NO: 3049 - protein, 36 aa, Neisseria
DKSRPTGETAEGDAFFEDVRRFPEKPDLGRQPRIND

SEQ ID NO: 3050 - protein, 14 aa, Neisseria
GIERIFKISKRDRF

SEQ ID NO: 3051 - protein, 5 aa, Neisseria
TLLKR

SEQ ID NO: 3052 - protein, 7 aa, Neisseria
FKAKFPR

SEQ ID NO: 3053 - protein, 9 aa, Neisseria
TPERQKARS

SEQ ID NO: 3054 - protein, 19 aa, Neisseria
LEAKAVDEELVEVPRGEVG

SEQ ID NO: 3055 - protein, 7 aa, Neisseria
AATDETI

SEQ ID NO: 3056 - protein, 6 aa, Neisseria
TIDEDG

SEQ ID NO: 3057 - protein, 9 aa, Neisseria
VDRKKDLII

SEQ ID NO: 3058 - protein, 11 aa, Neisseria
YPREIEEEIYK

SEQ ID NO: 3059 - protein, 11 aa, Neisseria
GVKDRYADEEI

SEQ ID NO: 3060 - protein, 17 aa, Neisseria
LKEGMDLGENEIRRHLR

SEQ ID NO: 3061 - protein, 8 aa, Neisseria
DGLPRNAT

SEQ ID NO: 3062 - protein, 15 aa, Neisseria
KVLKRVLKEQFDGNK

SEQ ID NO: 3063 - protein, 10 aa, Neisseria
ATLGVLLKEL

SEQ ID NO: 3064 - protein, 8 aa, Neisseria
TLIERLED

SEQ ID NO: 3065 - protein, 11 aa, Neisseria
IIDPARALNIA

SEQ ID NO: 3066 - protein, 5 aa, Neisseria
QFWAT

SEQ ID NO: 3067 - protein, 5 aa, Neisseria
NAVPH

SEQ ID NO: 3068 - protein, 17 aa, Neisseria
LQKRYDAFKTQKLFENM

SEQ ID NO: 3069 - protein, 12 aa, Neisseria
RLTRQMVKYLQG

SEQ ID NO: 3070 - protein, 13 aa, Neisseria
TEFNRHVEDIKRE

SEQ ID NO: 3071 - protein, 6 aa, Neisseria
GWANMP

SEQ ID NO: 3072 - protein, 5 aa, Neisseria
KTKEE

SEQ ID NO: 3073 - protein, 7 aa, Neisseria
ASLLEYY

SEQ ID NO: 3074 - protein, 8 aa, Neisseria
WEDRLKEL

SEQ ID NO: 3075 - protein, 6 aa, Neisseria
MAEATD

SEQ ID NO: 3076 - protein, 7 aa, Neisseria
KELEPSW

SEQ ID NO: 3077 - protein, 20 aa, Neisseria
ERLEDVALESSNAWNNAGTG

SEQ ID NO: 3078 - protein, 9 aa, Neisseria
AEGKLEDNS

SEQ ID NO: 3079 - protein, 23 aa, Neisseria
MNEDHCSYLQKRYDAFKTQKLFE

SEQ ID NO: 3080 - protein, 12 aa, Neisseria
MEFSTDRNKISD

SEQ ID NO: 3081 - protein, 10 aa, Neisseria
MMRGRDENQP

SEQ ID NO: 3082 - protein, 19 aa, Neisseria
ANYSAEGTDVDFGRLTRQM

SEQ ID NO: 3083 - protein, 23 aa, Neisseria
LQGKGVKTEFNRHVEDIKRESDG

SEQ ID NO: 3084 - protein, 11 aa, Neisseria
TADTRNPDGQL

SEQ ID NO: 3085 - protein, 12 aa, Neisseria
QKSGIPEGKGYG

SEQ ID NO: 3086 - protein, 13 aa, Neisseria
FRNSNPETAEQHN

SEQ ID NO: 3087 - protein, 12 aa, Neisseria
LDTRNVDGKRHL

SEQ ID NO: 3088 - protein, 9 aa, Neisseria
NFLKQGSLM

SEQ ID NO: 3089 - protein, 10 aa, Neisseria
ELRKTKEERF

SEQ ID NO: 3090 - protein, 10 aa, Neisseria
YPEANPDDWE

SEQ ID NO: 3091 - protein, 11 aa, Neisseria
QIIKKDSEKGG

SEQ ID NO: 3092 - protein, 6 aa, Neisseria
AHADGS

SEQ ID NO: 3093 - protein, 6 aa, Neisseria
SPGAST

SEQ ID NO: 3094 - protein, 19 aa, Neisseria
FPERAPSWEDRLKELVPGY

SEQ ID NO: 3095 - protein, 11 aa, Neisseria
KLNENPERADE

SEQ ID NO: 3096 - protein, 6 aa, Neisseria
MAEATD

SEQ ID NO: 3097 - protein, 5 aa, Neisseria
KELEP

SEQ ID NO: 3098 - protein, 10 aa, Neisseria
ERLEDVALES

SEQ ID NO: 3099 - protein, 9 aa, Neisseria
AEGKLEDNS

SEQ ID NO: 3100 - protein, 6 aa, Neisseria
MNEDHC

SEQ ID NO: 3101 - protein, 10 aa, Neisseria
LQKRYDAFKT

SEQ ID NO: 3102 - protein, 12 aa, Neisseria
MEFSTDRNKISD

SEQ ID NO: 3103 - protein, 9 aa, Neisseria
MRGRDENQP

SEQ ID NO: 3104 - protein, 9 aa, Neisseria
SAEGTDVDF

SEQ ID NO: 3105 - protein, 6 aa, Neisseria
RLTRQM

SEQ ID NO: 3106 - protein, 20 aa, Neisseria
KGVKTEFNRHVEDIKRESDG

SEQ ID NO: 3107 - protein, 9 aa, Neisseria
TADTRNPDG

SEQ ID NO: 3108 - protein, 7 aa, Neisseria
GIPEGKG

SEQ ID NO: 3109 - protein, 10 aa, Neisseria
SNPETAEQHN

SEQ ID NO: 3110 - protein, 10 aa, Neisseria
LDTRNVDGKR

SEQ ID NO: 3111 - protein, 10 aa, Neisseria
ELRKTKEERF

SEQ ID NO: 3112 - protein, 7 aa, Neisseria
ANPDDWE

SEQ ID NO: 3113 - protein, 11 aa, Neisseria
QIIKKDSEKGG

SEQ ID NO: 3114 - protein, 16 aa, Neisseria
FPERAPSWEDRLKELV

SEQ ID NO: 3115 - protein, 11 aa, Neisseria
KLNENPERADE

SEQ ID NO: 3116 - protein, 6 aa, Neisseria
MAEATD

SEQ ID NO: 3117 - protein, 5 aa, Neisseria
KELEP

SEQ ID NO: 3118 - protein, 10 aa, Neisseria
ERLEDVALES

SEQ ID NO: 3119 - protein, 9 aa, Neisseria
AEGKLEDNS

SEQ ID NO: 3120 - protein, 6 aa, Neisseria
MNEDHC

SEQ ID NO: 3121 - protein, 10 aa, Neisseria
LQKRYDAFKT

SEQ ID NO: 3122 - protein, 12 aa, Neisseria
MEFSTDRNKISD

SEQ ID NO: 3123 - protein, 9 aa, Neisseria
MRGRDENQP

SEQ ID NO: 3124 - protein, 9 aa, Neisseria
SAEGTDVDF

SEQ ID NO: 3125 - protein, 6 aa, Neisseria
RLTRQM

SEQ ID NO: 3126 - protein, 20 aa, Neisseria
KGVKTEFNRHVEDIKRESDG

SEQ ID NO: 3127 - protein, 9 aa, Neisseria
TADTRNPDG

SEQ ID NO: 3128 - protein, 7 aa, Neisseria
GIPEGKG

SEQ ID NO: 3129 - protein, 10 aa, Neisseria
SNPETAEQHN

SEQ ID NO: 3130 - protein, 10 aa, Neisseria
LDTRNVDGKR

SEQ ID NO: 3131 - protein, 10 aa, Neisseria
ELRKTKEERF

SEQ ID NO: 3132 - protein, 7 aa, Neisseria
ANPDDWE

SEQ ID NO: 3133 - protein, 11 aa, Neisseria
QIIKKDSEKGG

SEQ ID NO: 3134 - protein, 16 aa, Neisseria
FPERAPSWEDRLKELV

SEQ ID NO: 3135 - protein, 11 aa, Neisseria
KLNENPERADE

SEQ ID NO: 3136 - protein, 11 aa, Neisseria
QAFNRITDLFF

SEQ ID NO: 3137 - protein, 5 aa, Neisseria
ALSQI

SEQ ID NO: 3138 - protein, 12 aa, Neisseria
NRRIVDIFDFEN

SEQ ID NO: 3139 - protein, 17 aa, Neisseria
FRRALYRVLRLFRRIFG

SEQ ID NO: 3140 - protein, 7 aa, Neisseria
DQSDNIL

SEQ ID NO: 3141 - protein, 5 aa, Neisseria
AFNRI

SEQ ID NO: 3142 - protein, 10 aa, Neisseria
IQTGNRRIVD

SEQ ID NO: 3143 - protein, 11 aa, Neisseria
FDFENRFRRAL

SEQ ID NO: 3144 - protein, 8 aa, Neisseria
AAGGKQQA

SEQ ID NO: 3145 - protein, 6 aa, Neisseria
YGKRCF

SEQ ID NO: 3146 - protein, 38 aa, Neisseria
SKCRLKRGRRRFGRHRVHFNGRMPTASRTLSNNSRASL

SEQ ID NO: 3147 - protein, 5 aa, Neisseria
PACKI

SEQ ID NO: 3148 - protein, 5 aa, Neisseria
CEGSA

SEQ ID NO: 3149 - protein, 8 aa, Neisseria
TGNRRIVD

SEQ ID NO: 3150 - protein, 11 aa, Neisseria
FDFENRFRRAL

SEQ ID NO: 3151 - protein, 5 aa, Neisseria
GKQQA

SEQ ID NO: 3152 - protein, 6 aa, Neisseria
YGKRCF

SEQ ID NO: 3153 - protein, 17 aa, Neisseria
SKCRLKRGRRRFGRHRV

SEQ ID NO: 3154 - protein, 16 aa, Neisseria
MPTASRTLSNNSRASL

SEQ ID NO: 3155 - protein, 17 aa, Neisseria
SENTAEQPQNAVQSAPK

SEQ ID NO: 3156 - protein, 15 aa, Neisseria
EQNVIRLIGKHPGDL

SEQ ID NO: 3157 - protein, 17 aa, Neisseria
HTLFAKLVGNIAEDGGK

SEQ ID NO: 3158 - protein, 23 aa, Neisseria
CGKSENTAEQPQNAVQSAPKPVF

SEQ ID NO: 3159 - protein, 16 aa, Neisseria
LGQSSEGKTNDGKKQI

SEQ ID NO: 3160 - protein, 10 aa, Neisseria
PIKGLPEQNV

SEQ ID NO: 3161 - protein, 29 aa, Neisseria
IGKHPGDLEAVSGKCMETDDKDSPAGWAE

SEQ ID NO: 3162 - protein, 9 aa, Neisseria
IAEDGGKLT

SEQ ID NO: 3163 - protein, 8 aa, Neisseria
YQAGKSGY

SEQ ID NO: 3164 - protein, 5 aa, Neisseria
IDSEG

SEQ ID NO: 3165 - protein, 7 aa, Neisseria
YFRRRHY

SEQ ID NO: 3166 - protein, 11 aa, Neisseria
GKSENTAEQPQ

SEQ ID NO: 3167 - protein, 15 aa, Neisseria
GQSSEGKTNDGKKQI

SEQ ID NO: 3168 - protein, 9 aa, Neisseria
HPGDLEAVS

SEQ ID NO: 3169 - protein, 11 aa, Neisseria
KCMETDDKDSP

SEQ ID NO: 3170 - protein, 8 aa, Neisseria
IAEDGGKL

SEQ ID NO: 3171 - protein, 6 aa, Neisseria
QAGKSG

SEQ ID NO: 3172 - protein, 5 aa, Neisseria
IDSEG

SEQ ID NO: 3173 - protein, 6 aa, Neisseria
FRRRHY

SEQ ID NO: 3174 - protein, 11 aa, Neisseria
PKQTVRQIQAV

SEQ ID NO: 3175 - protein, 9 aa, Neisseria
ISHIDRTQG

SEQ ID NO: 3176 - protein, 6 aa, Neisseria
CSGMIQ

SEQ ID NO: 3177 - protein, 6 aa, Neisseria
RTARDM

SEQ ID NO: 3178 - protein, 8 aa, Neisseria
SGKTIKTE

SEQ ID NO: 3179 - protein, 7 aa, Neisseria
FPPDKTL

SEQ ID NO: 3180 - protein, 17 aa, Neisseria
GTTSGKHRQPKPKQTVR

SEQ ID NO: 3181 - protein, 10 aa, Neisseria
SHIDRTQGSQ

SEQ ID NO: 3182 - protein, 10 aa, Neisseria
TPYKWGGSST

SEQ ID NO: 3183 - protein, 24 aa, Neisseria
KLPRTARDMAAASRKIPDSRLKAG

SEQ ID NO: 3184 - protein, 8 aa, Neisseria
TGGAHRYS

SEQ ID NO: 3185 - protein, 13 aa, Neisseria
PSSGKTIKTEKLS

SEQ ID NO: 3186 - protein, 14 aa, Neisseria
TSGKHRQPKPKQTV

SEQ ID NO: 3187 - protein, 10 aa, Neisseria
SHIDRTQGSQ

SEQ ID NO: 3188 - protein, 24 aa, Neisseria
KLPRTARDMAAASRKIPDSRLKAG

SEQ ID NO: 3189 - protein, 12 aa, Neisseria
SSGKTIKTEKLS

SEQ ID NO: 3190 - protein, 12 aa, Neisseria
VGNGVDEFGRGA

SEQ ID NO: 3191 - protein, 5 aa, Neisseria
QFERA

SEQ ID NO: 3192 - protein, 10 aa, Neisseria
IEGFDKINPA

SEQ ID NO: 3193 - protein, 30 aa, Neisseria
NQLGGRNGTAVGNGVDEFGRGADNQVEFLE

SEQ ID NO: 3194 - protein, 7 aa, Neisseria
GASGRAA

SEQ ID NO: 3195 - protein, 6 aa, Neisseria
GEDDVV

SEQ ID NO: 3196 - protein, 9 aa, Neisseria
GFDKINPAV

SEQ ID NO: 3197 - protein, 7 aa, Neisseria
LGGRNGT

SEQ ID NO: 3198 - protein, 17 aa, Neisseria
GVDEFGRGADNQVEFLE

SEQ ID NO: 3199 - protein, 6 aa, Neisseria
GEDDVV

SEQ ID NO: 3200 - protein, 6 aa, Neisseria
GFDKIN

SEQ ID NO: 3201 - protein, 9 aa, Neisseria
WDGIPDIRT

SEQ ID NO: 3202 - protein, 6 aa, Neisseria
FQTAQD

SEQ ID NO: 3203 - protein, 12 aa, Neisseria
LQFDSINLIEHI

SEQ ID NO: 3204 - protein, 5 aa, Neisseria
HLHEH

SEQ ID NO: 3205 - protein, 5 aa, Neisseria
RLLGH

SEQ ID NO: 3206 - protein, 16 aa, Neisseria
HNHLYRSITSAEAEKI

SEQ ID NO: 3207 - protein, 7 aa, Neisseria
WNEAEEA

SEQ ID NO: 3208 - protein, 5 aa, Neisseria
DSPDH

SEQ ID NO: 3209 - protein, 12 aa, Neisseria
PLVGALGDIAAM

SEQ ID NO: 3210 - protein, 6 aa, Neisseria
HGTRGL

SEQ ID NO: 3211 - protein, 10 aa, Neisseria
AIAAQILGLP

SEQ ID NO: 3212 - protein, 20 aa, Neisseria
GIPDIRTLDQAIRKHAPPLN

SEQ ID NO: 3213 - protein, 27 aa, Neisseria
PDNQIPDFQTAQDASDAECRLKHRLDQ

SEQ ID NO: 3214 - protein, 5 aa, Neisseria
PPSRT

SEQ ID NO: 3215 - protein, 13 aa, Neisseria
AIPQTESKPDKPW

SEQ ID NO: 3216 - protein, 12 aa, Neisseria
LPQTSERQKPEH

SEQ ID NO: 3217 - protein, 8 aa, Neisseria
LEARKAAQ

SEQ ID NO: 3218 - protein, 6 aa, Neisseria
SGNRQG

SEQ ID NO: 3219 - protein, 11 aa, Neisseria
KISPHDTEQTE

SEQ ID NO: 3220 - protein, 6 aa, Neisseria
GYGYTK

SEQ ID NO: 3221 - protein, 11 aa, Neisseria
LPESETWGGNG

SEQ ID NO: 3222 - protein, 15 aa, Neisseria
NYSRTEQQRNHELGL

SEQ ID NO: 3223 - protein, 9 aa, Neisseria
TSAEAEKIA

SEQ ID NO: 3224 - protein, 8 aa, Neisseria
VPYDHPSC

SEQ ID NO: 3225 - protein, 7 aa, Neisseria
LHEDTPL

SEQ ID NO: 3226 - protein, 10 aa, Neisseria
DISHDGEKWI

SEQ ID NO: 3227 - protein, 9 aa, Neisseria
TGANSPYLP

SEQ ID NO: 3228 - protein, 20 aa, Neisseria
RQIRGQTGLTPSTPFSEQLR

SEQ ID NO: 3229 - protein, 5 aa, Neisseria
PSWHG

SEQ ID NO: 3230 - protein, 18 aa, Neisseria
NSSHTGWNEAEEASNRQA

SEQ ID NO: 3231 - protein, 9 aa, Neisseria
NPNPQKHQG

SEQ ID NO: 3232 - protein, 10 aa, Neisseria
IRCDSPDHLP

SEQ ID NO: 3233 - protein, 12 aa, Neisseria
ALDKNYRIDTPC

SEQ ID NO: 3234 - protein, 7 aa, Neisseria
HGTRGLA

SEQ ID NO: 3235 - protein, 17 aa, Neisseria
HPFSQRLRHALHPNRTI

SEQ ID NO: 3236 - protein, 9 aa, Neisseria
IVRRKDLTP

SEQ ID NO: 3237 - protein, 15 aa, Neisseria
PDIRTLDQAIRKHAP

SEQ ID NO: 3238 - protein, 16 aa, Neisseria
QDASDAECRLKHRLDQ

SEQ ID NO: 3239 - protein, 11 aa, Neisseria
AIPQTESKPDK

SEQ ID NO: 3240 - protein, 10 aa, Neisseria
QTSERQKPEH

SEQ ID NO: 3241 - protein, 8 aa, Neisseria
LEARKAAQ

SEQ ID NO: 3242 - protein, 9 aa, Neisseria
SPHDTEQTE

SEQ ID NO: 3243 - protein, 5 aa, Neisseria
PESET

SEQ ID NO: 3244 - protein, 10 aa, Neisseria
SRTEQQRNHE

SEQ ID NO: 3245 - protein, 9 aa, Neisseria
TSAEAEKIA

SEQ ID NO: 3246 - protein, 7 aa, Neisseria
LHEDTPL

SEQ ID NO: 3247 - protein, 9 aa, Neisseria
ISHDGEKWI

SEQ ID NO: 3248 - protein, 5 aa, Neisseria
RQIRG

SEQ ID NO: 3249 - protein, 11 aa, Neisseria
NEAEEASNRQA

SEQ ID NO: 3250 - protein, 7 aa, Neisseria
NPQKHQG

SEQ ID NO: 3251 - protein, 7 aa, Neisseria
IRCDSPD

SEQ ID NO: 3252 - protein, 7 aa, Neisseria
KNYRIDT

SEQ ID NO: 3253 - protein, 5 aa, Neisseria
QRLRH

SEQ ID NO: 3254 - protein, 9 aa, Neisseria
IVRRKDLTP

SEQ ID NO: 3255 - protein, 7 aa, Neisseria
CKLFVLI

SEQ ID NO: 3256 - protein, 11 aa, Neisseria
VTRGGKGGESV

SEQ ID NO: 3257 - protein, 6 aa, Neisseria
FSQTLD

SEQ ID NO: 3258 - protein, 8 aa, Neisseria
KVQRGGDV

SEQ ID NO: 3259 - protein, 10 aa, Neisseria
TKSGAKSASK

SEQ ID NO: 3260 - protein, 9 aa, Neisseria
LQSDSRQPI

SEQ ID NO: 3261 - protein, 20 aa, Neisseria
IEADQGSLDQANQSTTFSGN

SEQ ID NO: 3262 - protein, 35 aa, Neisseria
RGGKGGESVRAEGSPVRFSQTLDGGKGTVRGQANN

SEQ ID NO: 3263 - protein, 13 aa, Neisseria
GNAKVQRGGDVAE

SEQ ID NO: 3264 - protein, 7 aa, Neisseria
YNTKTEV

SEQ ID NO: 3265 - protein, 18 aa, Neisseria
GSTKSGAKSASKSGRVSV

SEQ ID NO: 3266 - protein, 9 aa, Neisseria
QPSSTQKSE

SEQ ID NO: 3267 - protein, 7 aa, Neisseria
SDSRQPI

SEQ ID NO: 3268 - protein, 12 aa, Neisseria
IEADQGSLDQAN

SEQ ID NO: 3269 - protein, 15 aa, Neisseria
RGGKGGESVRAEGSP

SEQ ID NO: 3270 - protein, 12 aa, Neisseria
LDGGKGTVRGQA

SEQ ID NO: 3271 - protein, 11 aa, Neisseria
AKVQRGGDVAE

SEQ ID NO: 3272 - protein, 15 aa, Neisseria
GSTKSGAKSASKSGR

SEQ ID NO: 3273 - protein, 6 aa, Neisseria
STQKSE

SEQ ID NO: 3274 - protein, 9 aa, Neisseria
SLSAWLGRI

SEQ ID NO: 3275 - protein, 10 aa, Neisseria
SAKGAKQFPE

SEQ ID NO: 3276 - protein, 6 aa, Neisseria
VRWRYG

SEQ ID NO: 3277 - protein, 36 aa, Neisseria
RISEVEIEEVRLNPDEPQYTMDGLDGRRFDEQGYLK

SEQ ID NO: 3278 - protein, 23 aa, Neisseria
HLSAKGAKQFPESSDIHFDSPHL

SEQ ID NO: 3279 - protein, 17 aa, Neisseria
VGSDEAVYHTENKQVLF

SEQ ID NO: 3280 - protein, 32 aa, Neisseria
KTADGKRQAGKVEAEKLHVDTESQYAQTDTPV

SEQ ID NO: 3281 - protein, 16 aa, Neisseria
ASHGQAGGMTYDHKTG

SEQ ID NO: 3282 - protein, 6 aa, Neisseria
FSSKVK

SEQ ID NO: 3283 - protein, 7 aa, Neisseria
IYDTKDM

SEQ ID NO: 3284 - protein, 18 aa, Neisseria
ISEVEIEEVRLNPDEPQY

SEQ ID NO: 3285 - protein, 10 aa, Neisseria
DGLDGRRFDE

SEQ ID NO: 3286 - protein, 18 aa, Neisseria
HLSAKGAKQFPESSDIHF

SEQ ID NO: 3287 - protein, 8 aa, Neisseria
VGSDEAVY

SEQ ID NO: 3288 - protein, 7 aa, Neisseria
TENKQVL

SEQ ID NO: 3289 - protein, 26 aa, Neisseria
KTADGKRQAGKVEAEKLHVDTESQYA

SEQ ID NO: 3290 - protein, 5 aa, Neisseria
YDHKT

SEQ ID NO: 3291 - protein, 7 aa, Neisseria
IYDTKDM

SEQ ID NO: 3292 - protein, 7 aa, Neisseria
KYLDWAR

SEQ ID NO: 3293 - protein, 11 aa, Neisseria
AEGLREIAAEL

SEQ ID NO: 3294 - protein, 5 aa, Neisseria
RKMAA

SEQ ID NO: 3295 - protein, 7 aa, Neisseria
LGDALAV

SEQ ID NO: 3296 - protein, 6 aa, Neisseria
VADIMH

SEQ ID NO: 3297 - protein, 7 aa, Neisseria
LGTPLKE

SEQ ID NO: 3298 - protein, 6 aa, Neisseria
GRLKGV

SEQ ID NO: 3299 - protein, 18 aa, Neisseria
GDLRRLFQECDNFTGLSI

SEQ ID NO: 3300 - protein, 10 aa, Neisseria
MHTHPKTISA

SEQ ID NO: 3301 - protein, 6 aa, Neisseria
KVMQAN

SEQ ID NO: 3302 - protein, 7 aa, Neisseria
MAENGKY

SEQ ID NO: 3303 - protein, 20 aa, Neisseria
VLHAEAEGLREIAAELDKNF

SEQ ID NO: 3304 - protein, 5 aa, Neisseria
CKGRV

SEQ ID NO: 3305 - protein, 13 aa, Neisseria
GMGKSGHIGRKMA

SEQ ID NO: 3306 - protein, 7 aa, Neisseria
EAAHGDL

SEQ ID NO: 3307 - protein, 5 aa, Neisseria
VDNDV

SEQ ID NO: 3308 - protein, 9 aa, Neisseria
SNSGESDEI

SEQ ID NO: 3309 - protein, 7 aa, Neisseria
ALKRKDI

SEQ ID NO: 3310 - protein, 13 aa, Neisseria
TARPDSTMARHAD

SEQ ID NO: 3311 - protein, 7 aa, Neisseria
VSKEACP

SEQ ID NO: 3312 - protein, 9 aa, Neisseria
RAFTPDDFA

SEQ ID NO: 3313 - protein, 8 aa, Neisseria
HPAGSLGK

SEQ ID NO: 3314 - protein, 11 aa, Neisseria
DIMHKGGGLPA

SEQ ID NO: 3315 - protein, 9 aa, Neisseria
LGTPLKEAI

SEQ ID NO: 3316 - protein, 6 aa, Neisseria
MSEKGL

SEQ ID NO: 3317 - protein, 10 aa, Neisseria
VTDGQGRLKG

SEQ ID NO: 3318 - protein, 17 aa, Neisseria
FTDGDLRRLFQECDNFT

SEQ ID NO: 3319 - protein, 16 aa, Neisseria
HPKTISAERLATEALK

SEQ ID NO: 3320 - protein, 5 aa, Neisseria
TDADG

SEQ ID NO: 3321 - protein, 6 aa, Neisseria
MAENGK

SEQ ID NO: 3322 - protein, 18 aa, Neisseria
VLHAEAEGLREIAAELDK

SEQ ID NO: 3323 - protein, 5 aa, Neisseria
CKGRV

SEQ ID NO: 3324 - protein, 8 aa, Neisseria
GHIGRKMA

SEQ ID NO: 3325 - protein, 8 aa, Neisseria
NSGESDEI

SEQ ID NO: 3326 - protein, 7 aa, Neisseria
ALKRKDI

SEQ ID NO: 3327 - protein, 12 aa, Neisseria
ARPDSTMARHAD

SEQ ID NO: 3328 - protein, 6 aa, Neisseria
VSKEAC

SEQ ID NO: 3329 - protein, 9 aa, Neisseria
RAFTPDDFA

SEQ ID NO: 3330 - protein, 7 aa, Neisseria
TPLKEAI

SEQ ID NO: 3331 - protein, 6 aa, Neisseria
MSEKGL

SEQ ID NO: 3332 - protein, 7 aa, Neisseria
DGQGRLK

SEQ ID NO: 3333 - protein, 12 aa, Neisseria
GDLRRLFQECDN

SEQ ID NO: 3334 - protein, 14 aa, Neisseria
KTISAERLATEALK

SEQ ID NO: 3335 - protein, 5 aa, Neisseria
TDADG

SEQ ID NO: 3336 - protein, 5 aa, Neisseria
LLAVT

SEQ ID NO: 3337 - protein, 7 aa, Neisseria
AKVVSTM

SEQ ID NO: 3338 - protein, 7 aa, Neisseria
TMDEIHS

SEQ ID NO: 3339 - protein, 20 aa, Neisseria
ARSWWRNLHGTFGTWVSLIL

SEQ ID NO: 3340 - protein, 13 aa, Neisseria
WGGKFVQAWSQFP

SEQ ID NO: 3341 - protein, 15 aa, Neisseria
DEPMTLETVDRFARE

SEQ ID NO: 3342 - protein, 8 aa, Neisseria
YNPFGKFM

SEQ ID NO: 3343 - protein, 9 aa, Neisseria
LGWWSVLAN

SEQ ID NO: 3344 - protein, 16 aa, Neisseria
TQIKTEADNQSNRRYL

SEQ ID NO: 3345 - protein, 10 aa, Neisseria
ITGKEGERIH

SEQ ID NO: 3346 - protein, 14 aa, Neisseria
AEAARSAVNPETSS

SEQ ID NO: 3347 - protein, 6 aa, Neisseria
PRADDM

SEQ ID NO: 3348 - protein, 7 aa, Neisseria
VNNEGKA

SEQ ID NO: 3349 - protein, 9 aa, Neisseria
STMPRNQGW

SEQ ID NO: 3350 - protein, 8 aa, Neisseria
VKRRGIKA

SEQ ID NO: 3351 - protein, 12 aa, Neisseria
LLPSKGRARSWW

SEQ ID NO: 3352 - protein, 7 aa, Neisseria
NLHGTFG

SEQ ID NO: 3353 - protein, 12 aa, Neisseria
PAGKWGVEPNPV

SEQ ID NO: 3354 - protein, 9 aa, Neisseria
VLNDGKVKE

SEQ ID NO: 3355 - protein, 14 aa, Neisseria
TVGKDGINPDEPMT

SEQ ID NO: 3356 - protein, 8 aa, Neisseria
ETVDRFAR

SEQ ID NO: 3357 - protein, 17 aa, Neisseria
IGFKGRYQLNLPKGEDG

SEQ ID NO: 3358 - protein, 8 aa, Neisseria
LSQDSMSY

SEQ ID NO: 3359 - protein, 7 aa, Neisseria
FADRTVH

SEQ ID NO: 3360 - protein, 9 aa, Neisseria
DQYSGKILA

SEQ ID NO: 3361 - protein, 9 aa, Neisseria
IRFDDYNPF

SEQ ID NO: 3362 - protein, 8 aa, Neisseria
WKRRPTGA

SEQ ID NO: 3363 - protein, 7 aa, Neisseria
PAQKVKL

SEQ ID NO: 3364 - protein, 15 aa, Neisseria
TQIKTEADNQSNRRY

SEQ ID NO: 3365 - protein, 9 aa, Neisseria
TGKEGERIH

SEQ ID NO: 3366 - protein, 14 aa, Neisseria
AEAARSAVNPETSS

SEQ ID NO: 3367 - protein, 6 aa, Neisseria
PRADDM

SEQ ID NO: 3368 - protein, 7 aa, Neisseria
VNNEGKA

SEQ ID NO: 3369 - protein, 6 aa, Neisseria
KRRGIK

SEQ ID NO: 3370 - protein, 5 aa, Neisseria
SKGRA

SEQ ID NO: 3371 - protein, 9 aa, Neisseria
VLNDGKVKE

SEQ ID NO: 3372 - protein, 14 aa, Neisseria
TVGKDGINPDEPMT

SEQ ID NO: 3373 - protein, 8 aa, Neisseria
ETVDRFAR

SEQ ID NO: 3374 - protein, 6 aa, Neisseria
PKGEDG

SEQ ID NO: 3375 - protein, 5 aa, Neisseria
QDSMS

SEQ ID NO: 3376 - protein, 7 aa, Neisseria
FADRTVH

SEQ ID NO: 3377 - protein, 5 aa, Neisseria
IRFDD

SEQ ID NO: 3378 - protein, 6 aa, Neisseria
KRRPTG

SEQ ID NO: 3379 - protein, 5 aa, Neisseria
LLAVT

SEQ ID NO: 3380 - protein, 7 aa, Neisseria
AKVVSTM

SEQ ID NO: 3381 - protein, 7 aa, Neisseria
TMDEIHS

SEQ ID NO: 3382 - protein, 20 aa, Neisseria
ARSWWRNLHGTFGTWVSLIL

SEQ ID NO: 3383 - protein, 13 aa, Neisseria
WGGKFVQAWSQFP

SEQ ID NO: 3384 - protein, 15 aa, Neisseria
DEPMTLETVDRFARE

SEQ ID NO: 3385 - protein, 8 aa, Neisseria
YNPFGKFM

SEQ ID NO: 3386 - protein, 9 aa, Neisseria
LGWWSVLAN

SEQ ID NO: 3387 - protein, 16 aa, Neisseria
TQIKTEADNQSNRRYL

SEQ ID NO: 3388 - protein, 10 aa, Neisseria
ITGKEGERIH

SEQ ID NO: 3389 - protein, 14 aa, Neisseria
AEAARSAVNPETSS

SEQ ID NO: 3390 - protein, 6 aa, Neisseria
PRADDM

SEQ ID NO: 3391 - protein, 7 aa, Neisseria
VNNEGKA

SEQ ID NO: 3392 - protein, 9 aa, Neisseria
STMPRNQGW

SEQ ID NO: 3393 - protein, 8 aa, Neisseria
VKRRGIKA

SEQ ID NO: 3394 - protein, 12 aa, Neisseria
LLPSKGRARSWW

SEQ ID NO: 3395 - protein, 7 aa, Neisseria
NLHGTFG

SEQ ID NO: 3396 - protein, 12 aa, Neisseria
PAGKWGVEPNPV

SEQ ID NO: 3397 - protein, 9 aa, Neisseria
VLNDGKVKE

SEQ ID NO: 3398 - protein, 14 aa, Neisseria
TVGKDGINPDEPMT

SEQ ID NO: 3399 - protein, 8 aa, Neisseria
ETVDRFAR

SEQ ID NO: 3400 - protein, 17 aa, Neisseria
IGFKGRYQLNLPKGEDG

SEQ ID NO: 3401 - protein, 8 aa, Neisseria
LSQDSMSY

SEQ ID NO: 3402 - protein, 7 aa, Neisseria
FADRTVH

SEQ ID NO: 3403 - protein, 9 aa, Neisseria
DQYSGKILA

SEQ ID NO: 3404 - protein, 9 aa, Neisseria
IRFDDYNPF

SEQ ID NO: 3405 - protein, 8 aa, Neisseria
WKRRPTGA

SEQ ID NO: 3406 - protein, 7 aa, Neisseria
PAQKVKL

SEQ ID NO: 3407 - protein, 15 aa, Neisseria
TQIKTEADNQSNRRY

SEQ ID NO: 3408 - protein, 9 aa, Neisseria
TGKEGERIH

SEQ ID NO: 3409 - protein, 14 aa, Neisseria
AEAARSAVNPETSS

SEQ ID NO: 3410 - protein, 6 aa, Neisseria
PRADDM

SEQ ID NO: 3411 - protein, 7 aa, Neisseria
VNNEGKA

SEQ ID NO: 3412 - protein, 6 aa, Neisseria
KRRGIK

SEQ ID NO: 3413 - protein, 5 aa, Neisseria
SKGRA

SEQ ID NO: 3414 - protein, 9 aa, Neisseria
VLNDGKVKE

SEQ ID NO: 3415 - protein, 14 aa, Neisseria
TVGKDGINPDEPMT

SEQ ID NO: 3416 - protein, 8 aa, Neisseria
ETVDRFAR

SEQ ID NO: 3417 - protein, 6 aa, Neisseria
PKGEDG

SEQ ID NO: 3418 - protein, 5 aa, Neisseria
QDSMS

SEQ ID NO: 3419 - protein, 7 aa, Neisseria
FADRTVH

SEQ ID NO: 3420 - protein, 5 aa, Neisseria
IRFDD

SEQ ID NO: 3421 - protein, 6 aa, Neisseria
KRRPTG

SEQ ID NO: 3422 - protein, 7 aa, Neisseria
LADELTN

SEQ ID NO: 3423 - protein, 5 aa, Neisseria
ILRQF

SEQ ID NO: 3424 - protein, 5 aa, Neisseria
NAMGL

SEQ ID NO: 3425 - protein, 7 aa, Neisseria
FMQHIFK

SEQ ID NO: 3426 - protein, 5 aa, Neisseria
TGKNI

SEQ ID NO: 3427 - protein, 7 aa, Neisseria
ALADELT

SEQ ID NO: 3428 - protein, 7 aa, Neisseria
SSREQIL

SEQ ID NO: 3429 - protein, 8 aa, Neisseria
FAEDEQPV

SEQ ID NO: 3430 - protein, 15 aa, Neisseria
NRAPARRAGNADELI

SEQ ID NO: 3431 - protein, 7 aa, Neisseria
GLNEQPV

SEQ ID NO: 3432 - protein, 15 aa, Neisseria
NRVPARRAGNADELI

SEQ ID NO: 3433 - protein, 7 aa, Neisseria
GLNEQPV

SEQ ID NO: 3434 - protein, 17 aa, Neisseria
PVNRAPARRAGNADELI

SEQ ID NO: 3435 - protein, 7 aa, Neisseria
TGFDCSG

SEQ ID NO: 3436 - protein, 11 aa, Neisseria
LPRTSAEQARM

SEQ ID NO: 3437 - protein, 12 aa, Neisseria
TPVARSELQPGD

SEQ ID NO: 3438 - protein, 6 aa, Neisseria
LGGSRI

SEQ ID NO: 3439 - protein, 10 aa, Neisseria
HAPRTGKNIE

SEQ ID NO: 3440 - protein, 10 aa, Neisseria
SLSHKYWSGK

SEQ ID NO: 3441 - protein, 11 aa, Neisseria
RRVKKNDPSRF

SEQ ID NO: 3442 - protein, 7 aa, Neisseria
ALADELT

SEQ ID NO: 3443 - protein, 7 aa, Neisseria
SSREQIL

SEQ ID NO: 3444 - protein, 7 aa, Neisseria
FAEDEQP

SEQ ID NO: 3445 - protein, 14 aa, Neisseria
RAPARRAGNADELI

SEQ ID NO: 3446 - protein, 13 aa, Neisseria
VPARRAGNADELI

SEQ ID NO: 3447 - protein, 14 aa, Neisseria
RAPARRAGNADELI

SEQ ID NO: 3448 - protein, 9 aa, Neisseria
RTSAEQARM

SEQ ID NO: 3449 - protein, 8 aa, Neisseria
VARSELQP

SEQ ID NO: 3450 - protein, 7 aa, Neisseria
RTGKNIE

SEQ ID NO: 3451 - protein, 10 aa, Neisseria
RRVKKNDPSR

SEQ ID NO: 3452 - protein, 6 aa, Neisseria
LIAYLK

SEQ ID NO: 3453 - protein, 9 aa, Neisseria
AAQFIDFWL

SEQ ID NO: 3454 - protein, 11 aa, Neisseria
QLAGSVTGIVT

SEQ ID NO: 3455 - protein, 10 aa, Neisseria
RSIGGIPAIT

SEQ ID NO: 3456 - protein, 11 aa, Neisseria
AGLVGQIAGYK

SEQ ID NO: 3457 - protein, 5 aa, Neisseria
ERSRR

SEQ ID NO: 3458 - protein, 7 aa, Neisseria
EILRQPS

SEQ ID NO: 3459 - protein, 8 aa, Neisseria
VRTRTGNI

SEQ ID NO: 3460 - protein, 7 aa, Neisseria
YQNRRKI

SEQ ID NO: 3461 - protein, 6 aa, Neisseria
GAEREV

SEQ ID NO: 3462 - protein, 6 aa, Neisseria
SKSVTN

SEQ ID NO: 3463 - protein, 7 aa, Neisseria
ITRSIGG

SEQ ID NO: 3464 - protein, 7 aa, Neisseria
KMLKNTV

SEQ ID NO: 3465 - protein, 9 aa, Neisseria
SLERSRRMA

SEQ ID NO: 3466 - protein, 5 aa, Neisseria
VRTRT

SEQ ID NO: 3467 - protein, 6 aa, Neisseria
QNRRKI

SEQ ID NO: 3468 - protein, 6 aa, Neisseria
GAEREV

SEQ ID NO: 3469 - protein, 9 aa, Neisseria
SLERSRRMA

SEQ ID NO: 3470 - protein, 9 aa, Neisseria
GVLFALLQA

SEQ ID NO: 3471 - protein, 8 aa, Neisseria
LQQLTDAL

SEQ ID NO: 3472 - protein, 14 aa, Neisseria
VISYLDLIADDWFS

SEQ ID NO: 3473 - protein, 10 aa, Neisseria
EVKEAVQAVE

SEQ ID NO: 3474 - protein, 22 aa, Neisseria
AASAAESAASAVEEAKDQVKDA

SEQ ID NO: 3475 - protein, 29 aa, Neisseria
EAVTEAAKDTLNKAADATQEAADKMKDAA

SEQ ID NO: 3476 - protein, 13 aa, Neisseria
SQEAKQEVKEAVQ

SEQ ID NO: 3477 - protein, 76 aa, Neisseria
VESDVKDTAASAAESAASAVEEAKDQVKDAAADAKASAEEAVTEAKEAVTEAAKDTLNKAADATQEAADKMKDAAK

SEQ ID NO: 3478 - protein, 13 aa, Neisseria
SQEAKQEVKEAVQ

SEQ ID NO: 3479 - protein, 76 aa, Neisseria; identical to SEQ ID NO: 3477

SEQ ID NO: 3480 - protein, 5 aa, Neisseria
EKYRT

SEQ ID NO: 3481 - protein, 6 aa, Neisseria
DHSINN

SEQ ID NO: 3482 - protein, 5 aa, Neisseria
IQNEQ

SEQ ID NO: 3483 - protein, 5 aa, Neisseria
QSLLQ

SEQ ID NO: 3484 - protein, 6 aa, Neisseria
LKQGAK

SEQ ID NO: 3485 - protein, 6 aa, Neisseria
QIKQII

SEQ ID NO: 3486 - protein, 9 aa, Neisseria
FVEEIRDQF

SEQ ID NO: 3487 - protein, 7 aa, Neisseria
QNLVNLV

SEQ ID NO: 3488 - protein, 15 aa, Neisseria
AEQLIRLTQVNRTIR

SEQ ID NO: 3489 - protein, 5 aa, Neisseria
FIAQV

SEQ ID NO: 3490 - protein, 7 aa, Neisseria
DLQKFYN

SEQ ID NO: 3491 - protein, 13 aa, Neisseria
EVKNAFEERVARL

SEQ ID NO: 3492 - protein, 6 aa, Neisseria
VADFNK

SEQ ID NO: 3493 - protein, 13 aa, Neisseria
DDAFNHPSSLAEA

SEQ ID NO: 3494 - protein, 11 aa, Neisseria
SGMPENLINAV

SEQ ID NO: 3495 - protein, 5 aa, Neisseria
LNGGK

SEQ ID NO: 3496 - protein, 6 aa, Neisseria
EAYAEL

SEQ ID NO: 3497 - protein, 9 aa, Neisseria
VRLIGLPAP

SEQ ID NO: 3498 - protein, 12 aa, Neisseria
EVQAVTPPDDIA

SEQ ID NO: 3499 - protein, 7 aa, Neisseria
LLIRYFN

SEQ ID NO: 3500 - protein, 9 aa, Neisseria
SIEKYRTPA

SEQ ID NO: 3501 - protein, 6 aa, Neisseria
SHPGAD

SEQ ID NO: 3502 - protein, 11 aa, Neisseria
VGDEKISDHSI

SEQ ID NO: 3503 - protein, 16 aa, Neisseria
IQNEQADGGGPSRDAV

SEQ ID NO: 3504 - protein, 6 aa, Neisseria
YLKQGA

SEQ ID NO: 3505 - protein, 7 aa, Neisseria
VSSEQIK

SEQ ID NO: 3506 - protein, 15 aa, Neisseria
IVDDPNFHDANGKFD

SEQ ID NO: 3507 - protein, 18 aa, Neisseria
YLSQRHMSEDQFVEEIRD

SEQ ID NO: 3508 - protein, 16 aa, Neisseria
QVNRTIRSHTFNPDEF

SEQ ID NO: 3509 - protein, 7 aa, Neisseria
KVSEADL

SEQ ID NO: 3510 - protein, 9 aa, Neisseria
YNANKKDYL

SEQ ID NO: 3511 - protein, 23 aa, Neisseria
DFADKQTVSETEVKNAFEERVAR

SEQ ID NO: 3512 - protein, 78 aa, Neisseria
PANEAKPSFEQEKAAVENELKMKKAVADFNKAKEKLGDDAFNHPSSLAEAAKNSGLKVETQETWLSRQDAQMSGMPEN

SEQ ID NO: 3513 - protein, 13 aa, Neisseria
FSDDVLKKKHNSE

SEQ ID NO: 3514 - protein, 12 aa, Neisseria
RAKEVREEKTLP

SEQ ID NO: 3515 - protein, 8 aa, Neisseria
AEAKDAVR

SEQ ID NO: 3516 - protein, 19 aa, Neisseria
AYIRTEAAKLAENKAKDVL

SEQ ID NO: 3517 - protein, 7 aa, Neisseria
NGGKAVD

SEQ ID NO: 3518 - protein, 12 aa, Neisseria
QQARQSMPPEAY

SEQ ID NO: 3519 - protein, 11 aa, Neisseria
LKAKPANGKPA

SEQ ID NO: 3520 - protein, 9 aa, Neisseria
AVTPPDDIA

SEQ ID NO: 3521 - protein, 11 aa, Neisseria
ALAQQQSANTF

SEQ ID NO: 3522 - protein, 20 aa, Neisseria
FNGKIKQTKGAQSVDNGDGQ

SEQ ID NO: 3523 - protein, 5 aa, Neisseria
EKYRT

SEQ ID NO: 3524 - protein, 8 aa, Neisseria
VGDEKISD

SEQ ID NO: 3525 - protein, 16 aa, Neisseria
IQNEQADGGGPSRDAV

SEQ ID NO: 3526 - protein, 7 aa, Neisseria
VSSEQIK

SEQ ID NO: 3527 - protein, 7 aa, Neisseria
IVDDPNF

SEQ ID NO: 3528 - protein, 6 aa, Neisseria
ANGKFD

SEQ ID NO: 3529 - protein, 14 aa, Neisseria
RHMSEDQFVEEIRD

SEQ ID NO: 3530 - protein, 7 aa, Neisseria
KVSEADL

SEQ ID NO: 3531 - protein, 8 aa, Neisseria
NANKKDYL

SEQ ID NO: 3532 - protein, 23 aa, Neisseria
DFADKQTVSETEVKNAFEERVAR

SEQ ID NO: 3533 - protein, 41 aa, Neisseria
PANEAKPSFEQEKAAVENELKMKKAVADFNKAKEKLGDDAF

SEQ ID NO: 3534 - protein, 17 aa, Neisseria
SLAEAAKNSGLKVETQE

SEQ ID NO: 3535 - protein, 9 aa, Neisseria
WLSRQDAQM

SEQ ID NO: 3536 - protein, 9 aa, Neisseria
DVLKKKHNS

SEQ ID NO: 3537 - protein, 12 aa, Neisseria
RAKEVREEKTLP

SEQ ID NO: 3538 - protein, 8 aa, Neisseria
AEAKDAVR

SEQ ID NO: 3539 - protein, 19 aa, Neisseria
AYIRTEAAKLAENKAKDVL

SEQ ID NO: 3540 - protein, 8 aa, Neisseria
QQARQSMP

SEQ ID NO: 3541 - protein, 8 aa, Neisseria
LKAKPANG

SEQ ID NO: 3542 - protein, 7 aa, Neisseria
TPPDDIA

SEQ ID NO: 3543 - protein, 17 aa, Neisseria
KIKQTKGAQSVDNGDGQ

SEQ ID NO: 3544 - protein, 11 aa, Neisseria
INRPYQKPAEL

SEQ ID NO: 3545 - protein, 7 aa, Neisseria
RIFSFPQ

SEQ ID NO: 3546 - protein, 10 aa, Neisseria
AVDNVKGVAV

SEQ ID NO: 3547 - protein, 11 aa, Neisseria
AVAGFRRCSAA

SEQ ID NO: 3548 - protein, 9 aa, Neisseria
LAAVPRITQ

SEQ ID NO: 3549 - protein, 9 aa, Neisseria
KPFHDFFNL

SEQ ID NO: 3550 - protein, 16 aa, Neisseria
MSKRKSINRPYQKPAE

SEQ ID NO: 3551 - protein, 17 aa, Neisseria
PPLQNNPPFYRKNRRLN

SEQ ID NO: 3552 - protein, 17 aa, Neisseria
ADGGCASPQKCRARGFQ

SEQ ID NO: 3553 - protein, 9 aa, Neisseria
SAVRPRRLR

SEQ ID NO: 3554 - protein, 6 aa, Neisseria
MPRRPV

SEQ ID NO: 3555 - protein, 7 aa, Neisseria
FADRNLR

SEQ ID NO: 3556 - protein, 8 aa, Neisseria
AFRRRAQV

SEQ ID NO: 3557 - protein, 5 aa, Neisseria
ARTRA

SEQ ID NO: 3558 - protein, 10 aa, Neisseria
RRVDIRHPDF

SEQ ID NO: 3559 - protein, 5 aa, Neisseria
DNVKG

SEQ ID NO: 3560 - protein, 14 aa, Neisseria
GFRRCSAAGGRVGT

SEQ ID NO: 3561 - protein, 20 aa, Neisseria
VPCRAEYVEYGNRRPHRLAA

SEQ ID NO: 3562 - protein, 15 aa, Neisseria
ITQRTQKRQGDGKPF

SEQ ID NO: 3563 - protein, 7 aa, Neisseria
MPMPSEH

SEQ ID NO: 3564 - protein, 8 aa, Neisseria
MSKRKSIN

SEQ ID NO: 3565 - protein, 7 aa, Neisseria
PYQKPAE

SEQ ID NO: 3566 - protein, 7 aa, Neisseria
FYRKNRR

SEQ ID NO: 3567 - protein, 9 aa, Neisseria
SPQKCRARG

SEQ ID NO: 3568 - protein, 7 aa, Neisseria
VRPRRLR

SEQ ID NO: 3569 - protein, 5 aa, Neisseria
PRRPV

SEQ ID NO: 3570 - protein, 7 aa, Neisseria
FADRNLR

SEQ ID NO: 3571 - protein, 8 aa, Neisseria
AFRRRAQV

SEQ ID NO: 3572 - protein, 5 aa, Neisseria
ARTRA

SEQ ID NO: 3573 - protein, 7 aa, Neisseria
RRVDIRH

SEQ ID NO: 3574 - protein, 14 aa, Neisseria
GFRRCSAAGGRVGT

SEQ ID NO: 3575 - protein, 7 aa, Neisseria
VPCRAEY

SEQ ID NO: 3576 - protein, 9 aa, Neisseria
EYGNRRPHR

SEQ ID NO: 3577 - protein, 15 aa, Neisseria
ITQRTQKRQGDGKPF

SEQ ID NO: 3578 - protein, 10 aa, Neisseria
QFLGAFNDNV

SEQ ID NO: 3579 - protein, 5 aa, Neisseria
GQMLN

SEQ ID NO: 3580 - protein, 27 aa, Neisseria
SLSGQLGNKFDKAVLARWVKVLEMIIM

SEQ ID NO: 3581 - protein, 8 aa, Neisseria
TLFGPLKY

SEQ ID NO: 3582 - protein, 5 aa, Neisseria
AILFG

SEQ ID NO: 3583 - protein, 17 aa, Neisseria
LGTAVAGVPPYIVGILV

SEQ ID NO: 3584 - protein, 10 aa, Neisseria
VRGTKSLLRE

SEQ ID NO: 3585 - protein, 6 aa, Neisseria
LPTFTQ

SEQ ID NO: 3586 - protein, 6 aa, Neisseria
RFEGLN

SEQ ID NO: 3587 - protein, 21 aa, Neisseria
AVMTLIGFFGGFFSVPLYTWL

SEQ ID NO: 3588 - protein, 16 aa, Neisseria
MYAKKGGLGLVKSRRF

SEQ ID NO: 3589 - protein, 11 aa, Neisseria
LSGQLGNKFDK

SEQ ID NO: 3590 - protein, 10 aa, Neisseria
DYLDDKELMM

SEQ ID NO: 3591 - protein, 10 aa, Neisseria
VPAKAADTQI

SEQ ID NO: 3592 - protein, 15 aa, Neisseria
RGTKSLLRETVRHKP

SEQ ID NO: 3593 - protein, 8 aa, Neisseria
HLGGNDNV

SEQ ID NO: 3594 - protein, 7 aa, Neisseria
KFSRERL

SEQ ID NO: 3595 - protein, 7 aa, Neisseria
HGHRFEG

SEQ ID NO: 3596 - protein, 10 aa, Neisseria
ASSETFRARA

SEQ ID NO: 3597 - protein, 8 aa, Neisseria
IKRERRFL

SEQ ID NO: 3598 - protein, 6 aa, Neisseria
AIRKKP

SEQ ID NO: 3599 - protein, 6 aa, Neisseria
YAKKGG

SEQ ID NO: 3600 - protein, 6 aa, Neisseria
VKSRRF

SEQ ID NO: 3601 - protein, 5 aa, Neisseria
NKFDK

SEQ ID NO: 3602 - protein, 8 aa, Neisseria
YLDDKELM

SEQ ID NO: 3603 - protein, 9 aa, Neisseria
PAKAADTQI

SEQ ID NO: 3604 - protein, 13 aa, Neisseria
RGTKSLLRETVRH

SEQ ID NO: 3605 - protein, 7 aa, Neisseria
KFSRERL

SEQ ID NO: 3606 - protein, 5 aa, Neisseria
HRFEG

SEQ ID NO: 3607 - protein, 7 aa, Neisseria
ETFRARA

SEQ ID NO: 3608 - protein, 8 aa, Neisseria
IKRERRFL

SEQ ID NO: 3609 - protein, 6 aa, Neisseria
AIRKKP

SEQ ID NO: 3610 - protein, 7 aa, Neisseria
FADKVQT

SEQ ID NO: 3611 - protein, 7 aa, Neisseria
QVRVWKN

SEQ ID NO: 3612 - protein, 9 aa, Neisseria
NGVAKLLET

SEQ ID NO: 3613 - protein, 12 aa, Neisseria
ALTRLIEQAGNA

SEQ ID NO: 3614 - protein, 14 aa, Neisseria
IPIADTLKCADGGN

SEQ ID NO: 3615 - protein, 10 aa, Neisseria
AAENLDGITD

SEQ ID NO: 3616 - protein, 6 aa, Neisseria
MKRKNI

SEQ ID NO: 3617 - protein, 20 aa, Neisseria
ARFGADKPKQYVEIGSKTVL

SEQ ID NO: 3618 - protein, 7 aa, Neisseria
ERHEAVD

SEQ ID NO: 3619 - protein, 11 aa, Neisseria
SPEDTFADKVQ

SEQ ID NO: 3620 - protein, 16 aa, Neisseria
WKNGGQTRAETVRNGV

SEQ ID NO: 3621 - protein, 5 aa, Neisseria
AETDN

SEQ ID NO: 3622 - protein, 5 aa, Neisseria
DAARC

SEQ ID NO: 3623 - protein, 6 aa, Neisseria
LPSEAL

SEQ ID NO: 3624 - protein, 12 aa, Neisseria
LIEQAGNAAEGG

SEQ ID NO: 3625 - protein, 11 aa, Neisseria
DTLKCADGGNI

SEQ ID NO: 3626 - protein, 7 aa, Neisseria
TVERTSL

SEQ ID NO: 3627 - protein, 18 aa, Neisseria
ENLDGITDEASAVEKLGV

SEQ ID NO: 3628 - protein, 15 aa, Neisseria
GDVRNLKLTQPQDAY

SEQ ID NO: 3629 - protein, 6 aa, Neisseria
MKRKNI

SEQ ID NO: 3630 - protein, 10 aa, Neisseria
FGADKPKQYV

SEQ ID NO: 3631 - protein, 7 aa, Neisseria
ERHEAVD

SEQ ID NO: 3632 - protein, 11 aa, Neisseria
SPEDTFADKVQ

SEQ ID NO: 3633 - protein, 9 aa, Neisseria
GQTRAETVR

SEQ ID NO: 3634 - protein, 5 aa, Neisseria
AETDN

SEQ ID NO: 3635 - protein, 6 aa, Neisseria
AGNAAE

SEQ ID NO: 3636 - protein, 7 aa, Neisseria
DTLKCAD

SEQ ID NO: 3637 - protein, 18 aa, Neisseria
ENLDGITDEASAVEKLGV

SEQ ID NO: 3638 - protein, 7 aa, Neisseria
GDVRNLK

SEQ ID NO: 3639 - protein, 10 aa, Neisseria
RSLEVEKVAS

SEQ ID NO: 3640 - protein, 6 aa, Neisseria
DRLGSQ

SEQ ID NO: 3641 - protein, 13 aa, Neisseria
QQTNRFNVLNRTN

SEQ ID NO: 3642 - protein, 6 aa, Neisseria
GDVTEF

SEQ ID NO: 3643 - protein, 10 aa, Neisseria
AVNSLVQAVD

SEQ ID NO: 3644 - protein, 15 aa, Neisseria
ATESSRSLEVEKVAS

SEQ ID NO: 3645 - protein, 8 aa, Neisseria
TFDNRSSF

SEQ ID NO: 3646 - protein, 13 aa, Neisseria
IFSDGEDRLGSQA

SEQ ID NO: 3647 - protein, 13 aa, Neisseria
QQTNRFNVLNRTN

SEQ ID NO: 3648 - protein, 19 aa, Neisseria
LKQESGISGKAHNLKGADY

SEQ ID NO: 3649 - protein, 13 aa, Neisseria
GDVTEFGRRDVGD

SEQ ID NO: 3650 - protein, 8 aa, Neisseria
LGRGKSQI

SEQ ID NO: 3651 - protein, 5 aa, Neisseria
NTSEI

SEQ ID NO: 3652 - protein, 5 aa, Neisseria
QGAGE

SEQ ID NO: 3653 - protein, 7 aa, Neisseria
ALSNREI

SEQ ID NO: 3654 - protein, 15 aa, Neisseria
GGTSGYDATLNGKVL

SEQ ID NO: 3655 - protein, 10 aa, Neisseria
VDNGAWQPNR

SEQ ID NO: 3656 - protein, 14 aa, Neisseria
ATESSRSLEVEKVA

SEQ ID NO: 3657 - protein, 7 aa, Neisseria
FDNRSSF

SEQ ID NO: 3658 - protein, 13 aa, Neisseria
IFSDGEDRLGSQA

SEQ ID NO: 3659 - protein, 13 aa, Neisseria
LKQESGISGKAHN

SEQ ID NO: 3660 - protein, 12 aa, Neisseria
DVTEFGRRDVGD

SEQ ID NO: 3661 - protein, 5 aa, Neisseria
GRGKS

SEQ ID NO: 3662 - protein, 6 aa, Neisseria
LSNREI

SEQ ID NO: 3663 - protein, 7 aa, Neisseria
LAAVLAL

SEQ ID NO: 3664 - protein, 7 aa, Neisseria
QVQKAPD

SEQ ID NO: 3665 - protein, 7 aa, Neisseria
LTNAADI

SEQ ID NO: 3666 - protein, 10 aa, Neisseria
VRPEKLHQIF

SEQ ID NO: 3667 - protein, 10 aa, Neisseria
SYQILDSVTT

SEQ ID NO: 3668 - protein, 16 aa, Neisseria
GALVSAVVNQIANSLT

SEQ ID NO: 3669 - protein, 12 aa, Neisseria
SKTAAYNLLSPY

SEQ ID NO: 3670 - protein, 17 aa, Neisseria
QKAPDFDYTSFKESKPA

SEQ ID NO: 3671 - protein, 11 aa, Neisseria
PLNESPDVNGT

SEQ ID NO: 3672 - protein, 5 aa, Neisseria
APLSE

SEQ ID NO: 3673 - protein, 10 aa, Neisseria
ETFKQNGLTN

SEQ ID NO: 3674 - protein, 8 aa, Neisseria
HAVRPEKL

SEQ ID NO: 3675 - protein, 31 aa, Neisseria
SAKARLVDSRNGKELWSGSASIREGSNNSNS

SEQ ID NO: 3676 - protein, 13 aa, Neisseria
SLTDRGYQVSKTA

SEQ ID NO: 3677 - protein, 14 aa, Neisseria
GILKGPRFVEEQPK

SEQ ID NO: 3678 - protein, 7 aa, Neisseria
QKAPDFD

SEQ ID NO: 3679 - protein, 7 aa, Neisseria
SFKESKP

SEQ ID NO: 3680 - protein, 7 aa, Neisseria
LNESPDV

SEQ ID NO: 3681 - protein, 8 aa, Neisseria
HAVRPEKL

SEQ ID NO: 3682 - protein, 16 aa, Neisseria
SAKARLVDSRNGKELW

SEQ ID NO: 3683 - protein, 10 aa, Neisseria
ASIREGSNNS

SEQ ID NO: 3684 - protein, 7 aa, Neisseria
LTDRGYQ

SEQ ID NO: 3685 - protein, 9 aa, Neisseria
PRFVEEQPK

SEQ ID NO: 3686 - protein, 7 aa, Neisseria
LCTAFAD

SEQ ID NO: 3687 - protein, 10 aa, Neisseria
FAGFADCRPF

SEQ ID NO: 3688 - protein, 10 aa, Neisseria
DDVPRFFAGE

SEQ ID NO: 3689 - protein, 9 aa, Neisseria
AACMAVCFG

SEQ ID NO: 3690 - protein, 8 aa, Neisseria
KVEGITRI

SEQ ID NO: 3691 - protein, 14 aa, Neisseria
IRLLHGIFNRIKVA

SEQ ID NO: 3692 - protein, 5 aa, Neisseria
FAAVI

SEQ ID NO: 3693 - protein, 13 aa, Neisseria
LRCNDVADGFRHF

SEQ ID NO: 3694 - protein, 8 aa, Neisseria
GFSGNGKF

SEQ ID NO: 3695 - protein, 8 aa, Neisseria
RHQQSKAQ

SEQ ID NO: 3696 - protein, 18 aa, Neisseria
FFRRGNFGFGLQGRTDGF

SEQ ID NO: 3697 - protein, 8 aa, Neisseria
QRLDGGGY

SEQ ID NO: 3698 - protein, 8 aa, Neisseria
GFADCRPF

SEQ ID NO: 3699 - protein, 14 aa, Neisseria
VDGRELVPSMEEDA

SEQ ID NO: 3700 - protein, 5 aa, Neisseria
ADDVP

SEQ ID NO: 3701 - protein, 13 aa, Neisseria
EAQNRCNQENQTA

SEQ ID NO: 3702 - protein, 17 aa, Neisseria
VEVERTQVFRAERNNVF

SEQ ID NO: 3703 - protein, 7 aa, Neisseria
GKVEGIT

SEQ ID NO: 3704 - protein, 7 aa, Neisseria
GKQKAQG

SEQ ID NO: 3705 - protein, 9 aa, Neisseria
IGRCRPQAQ

SEQ ID NO: 3706 - protein, 8 aa, Neisseria
RCNDVADG

SEQ ID NO: 3707 - protein, 6 aa, Neisseria
VDNETM

SEQ ID NO: 3708 - protein, 5 aa, Neisseria
GRTDG

SEQ ID NO: 3709 - protein, 7 aa, Neisseria
QRLDGGG

SEQ ID NO: 3710 - protein, 13 aa, Neisseria
DGRELVPSMEEDA

SEQ ID NO: 3711 - protein, 5 aa, Neisseria
ADDVP

SEQ ID NO: 3712 - protein, 11 aa, Neisseria
AQNRCNQENQT

SEQ ID NO: 3713 - protein, 15 aa, Neisseria
VEVERTQVFRAERNN

SEQ ID NO: 3714 - protein, 5 aa, Neisseria
VEGIT

SEQ ID NO: 3715 - protein, 7 aa, Neisseria
GKQKAQG

SEQ ID NO: 3716 - protein, 8 aa, Neisseria
GRCRPQAQ

SEQ ID NO: 3717 - protein, 8 aa, Neisseria
RCNDVADG

SEQ ID NO: 3718 - protein, 6 aa, Neisseria
VDNETM

SEQ ID NO: 3719 - protein, 5 aa, Neisseria
VHSPF

SEQ ID NO: 3720 - protein, 11 aa, Neisseria
SKSTSDFSGGV

SEQ ID NO: 3721 - protein, 8 aa, Neisseria
YQLHRTGS

SEQ ID NO: 3722 - protein, 10 aa, Neisseria
EDGYDGPQGS

SEQ ID NO: 3723 - protein, 9 aa, Neisseria
ARDIYSYYV

SEQ ID NO: 3724 - protein, 13 aa, Neisseria
DDVRGIVQGAVNP

SEQ ID NO: 3725 - protein, 30 aa, Neisseria
IGAITDSAVSPVTDTAAQQTLQGINDLGKL

SEQ ID NO: 3726 - protein, 10 aa, Neisseria
INSAKQWADA

SEQ ID NO: 3727 - protein, 5 aa, Neisseria
DWVKN

SEQ ID NO: 3728 - protein, 10 aa, Neisseria
KPAARHMQTL

SEQ ID NO: 3729 - protein, 10 aa, Neisseria
GNKPIKSLPN

SEQ ID NO: 3730 - protein, 9 aa, Neisseria
FDSVHKTLT

SEQ ID NO: 3731 - protein, 8 aa, Neisseria
GKQAKDYL

SEQ ID NO: 3732 - protein, 23 aa, Neisseria
HANGLDARLRDDMQAKHYEPGGK

SEQ ID NO: 3733 - protein, 11 aa, Neisseria
NARGSVKKRVY

SEQ ID NO: 3734 - protein, 9 aa, Neisseria
THERTGFEG

SEQ ID NO: 3735 - protein, 30 aa, Neisseria
FSGHGHEVHSPFDHHDSKSTSDFSGGVDGG

SEQ ID NO: 3736 - protein, 30 aa, Neisseria
LHRTGSEIHPEDGYDGPQGSDYPPPGGARD

SEQ ID NO: 3737 - protein, 10 aa, Neisseria
VKGTSTKTKT

SEQ ID NO: 3738 - protein, 13 aa, Neisseria
PFSDRWLKENAGA

SEQ ID NO: 3739 - protein, 7 aa, Neisseria
SRADEAG

SEQ ID NO: 3740 - protein, 9 aa, Neisseria
WESDPNKNW

SEQ ID NO: 3741 - protein, 9 aa, Neisseria
NRMDDVRGI

SEQ ID NO: 3742 - protein, 13 aa, Neisseria
GINDLGKLSPEAQ

SEQ ID NO: 3743 - protein, 14 aa, Neisseria
FAVKDGINSAKQWA

SEQ ID NO: 3744 - protein, 5 aa, Neisseria
AHPNI

SEQ ID NO: 3745 - protein, 27 aa, Neisseria
WRGKKVELNPTKWDWVKNTGYKKPAAR

SEQ ID NO: 3746 - protein, 35 aa, Neisseria
LDGEMAGGNKPIKSLPNSAAEKRKQNFEKFNSNWS

SEQ ID NO: 3747 - protein, 14 aa, Neisseria
ASFDSVHKTLTPNA

SEQ ID NO: 3748 - protein, 27 aa, Neisseria
LSPDKVKTRYTSLDGKITIIKDNENNY

SEQ ID NO: 3749 - protein, 33 aa, Neisseria
RIHDNSRKQYLDSNGNAVKTGNLQGKQAKDYLQ

SEQ ID NO: 3750 - protein, 8 aa, Neisseria
THIRNLDK

SEQ ID NO: 3751 - protein, 18 aa, Neisseria
LDARLRDDMQAKHYEPGG

SEQ ID NO: 3752 - protein, 10 aa, Neisseria
ARGSVKKRVY

SEQ ID NO: 3753 - protein, 7 aa, Neisseria
THERTGF

SEQ ID NO: 3754 - protein, 11 aa, Neisseria
DHHDSKSTSDF

SEQ ID NO: 3755 - protein, 22 aa, Neisseria
RTGSEIHPEDGYDGPQGSDYPP

SEQ ID NO: 3756 - protein, 5 aa, Neisseria
GGARD

SEQ ID NO: 3757 - protein, 7 aa, Neisseria
TSTKTKT

SEQ ID NO: 3758 - protein, 8 aa, Neisseria
RWLKENAG

SEQ ID NO: 3759 - protein, 7 aa, Neisseria
SRADEAG

SEQ ID NO: 3760 - protein, 7 aa, Neisseria
RMDDVRG

SEQ ID NO: 3761 - protein, 7 aa, Neisseria
DLGKLSP

SEQ ID NO: 3762 - protein, 5 aa, Neisseria
DGINS

SEQ ID NO: 3763 - protein, 11 aa, Neisseria
WRGKKVELNPT

SEQ ID NO: 3764 - protein, 9 aa, Neisseria
TGYKKPAAR

SEQ ID NO: 3765 - protein, 13 aa, Neisseria
LDGEMAGGNKPIK

SEQ ID NO: 3766 - protein, 14 aa, Neisseria
SAAEKRKQNFEKFN

SEQ ID NO: 3767 - protein, 25 aa, Neisseria
SPDKVKTRYTSLDGKITIIKDNENN

SEQ ID NO: 3768 - protein, 9 aa, Neisseria
HDNSRKQYL

SEQ ID NO: 3769 - protein, 6 aa, Neisseria
NGNAVK

SEQ ID NO: 3770 - protein, 11 aa, Neisseria
NLQGKQAKDYL

SEQ ID NO: 3771 - protein, 5 aa, Neisseria
RNLDK

SEQ ID NO: 3772 - protein, 7 aa, Neisseria
FRLIQSC

SEQ ID NO: 3773 - protein, 6 aa, Neisseria
NAHRKQ

SEQ ID NO: 3774 - protein, 10 aa, Neisseria
PGFNALPTIF

SEQ ID NO: 3775 - protein, 5 aa, Neisseria
SSNEW

SEQ ID NO: 3776 - protein, 10 aa, Neisseria
FCATICASLR

SEQ ID NO: 3777 - protein, 9 aa, Neisseria
GIARNRRME

SEQ ID NO: 3778 - protein, 15 aa, Neisseria
CRRPDRFVVRQTRLL

SEQ ID NO: 3779 - protein, 7 aa, Neisseria
QSCEIEP

SEQ ID NO: 3780 - protein, 16 aa, Neisseria
HNGKSGNAHRKQQKEI

SEQ ID NO: 3781 - protein, 11 aa, Neisseria
PAVRSATRKTA

SEQ ID NO: 3782 - protein, 10 aa, Neisseria
FRGSSGKSAS

SEQ ID NO: 3783 - protein, 9 aa, Neisseria
AAQRGRGAC

SEQ ID NO: 3784 - protein, 7 aa, Neisseria
RSSNEWK

SEQ ID NO: 3785 - protein, 29 aa, Neisseria
TAKRPPSFRRHMTCGNTAPTSSSSRLIKM

SEQ ID NO: 3786 - protein, 12 aa, Neisseria
VAGSCPRSRVRT

SEQ ID NO: 3787 - protein, 11 aa, Neisseria
RAIRRLNRSSP

SEQ ID NO: 3788 - protein, 9 aa, Neisseria
GIARNRRME

SEQ ID NO: 3789 - protein, 12 aa, Neisseria
RRPDRFVVRQTR

SEQ ID NO: 3790 - protein, 15 aa, Neisseria
NGKSGNAHRKQQKEI

SEQ ID NO: 3791 - protein, 9 aa, Neisseria
VRSATRKTA

SEQ ID NO: 3792 - protein, 7 aa, Neisseria
SSGKSAS

SEQ ID NO: 3793 - protein, 7 aa, Neisseria
QRGRGAC

SEQ ID NO: 3794 - protein, 6 aa, Neisseria
SSNEWK

SEQ ID NO: 3795 - protein, 12 aa, Neisseria
TAKRPPSFRRHM

SEQ ID NO: 3796 - protein, 9 aa, Neisseria
SSSSRLIKM

SEQ ID NO: 3797 - protein, 10 aa, Neisseria
GSCPRSRVRT

SEQ ID NO: 3798 - protein, 11 aa, Neisseria
RAIRRLNRSSP

SEQ ID NO: 3799 - protein, 8 aa, Neisseria
ADVGRFLH

SEQ ID NO: 3800 - protein, 7 aa, Neisseria
IQCLRNH

SEQ ID NO: 3801 - protein, 8 aa, Neisseria
APLFAVCP

SEQ ID NO: 3802 - protein, 13 aa, Neisseria
QGEDFPRAGIQNH

SEQ ID NO: 3803 - protein, 15 aa, Neisseria
VFRGFIARGVQAVHN

SEQ ID NO: 3804 - protein, 6 aa, Neisseria
FKRKFQ

SEQ ID NO: 3805 - protein, 9 aa, Neisseria
GTETRRQFA

SEQ ID NO: 3806 - protein, 11 aa, Neisseria
IAHGRRSDFIR

SEQ ID NO: 3807 - protein, 13 aa, Neisseria
RNHKRFDCRTGFD

SEQ ID NO: 3808 - protein, 23 aa, Neisseria
VGGRIGQGEDFPRAGIQNHHRSG

SEQ ID NO: 3809 - protein, 13 aa, Neisseria
QGLNPLIEGKDDV

SEQ ID NO: 3810 - protein, 7 aa, Neisseria
VPQNDFR

SEQ ID NO: 3811 - protein, 6 aa, Neisseria
VFKRKF

SEQ ID NO: 3812 - protein, 10 aa, Neisseria
NIGKSDDVCK

SEQ ID NO: 3813 - protein, 8 aa, Neisseria
TETRRQFA

SEQ ID NO: 3814 - protein, 9 aa, Neisseria
HGRRSDFIR

SEQ ID NO: 3815 - protein, 8 aa, Neisseria
RNHKRFDC

SEQ ID NO: 3816 - protein, 9 aa, Neisseria
IGQGEDFPR

SEQ ID NO: 3817 - protein, 7 aa, Neisseria
IEGKDDV

SEQ ID NO: 3818 - protein, 6 aa, Neisseria
VFKRKF

SEQ ID NO: 3819 - protein, 8 aa, Neisseria
GKSDDVCK

SEQ ID NO: 3820 - protein, 7 aa, Neisseria
TRAANPP

SEQ ID NO: 3821 - protein, 9 aa, Neisseria
TRTPREPAS

SEQ ID NO: 3822 - protein, 7 aa, Neisseria
FLIGCIA

SEQ ID NO: 3823 - protein, 10 aa, Neisseria
FHACQRMVAV

SEQ ID NO: 3824 - protein, 13 aa, Neisseria
RHIDRIAGILTVQ

SEQ ID NO: 3825 - protein, 11 aa, Neisseria
FVQKLIVGIIH

SEQ ID NO: 3826 - protein, 16 aa, Neisseria
MPTRPTRAANPPTPPT

SEQ ID NO: 3827 - protein, 40 aa, Neisseria
CPRPPYRPPSVQTRTPREPASSTCAAKSANRRENSHNAQP

SEQ ID NO: 3828 - protein, 26 aa, Neisseria
PSNKMPSETEQTLFRRHQIPPSCRQS

SEQ ID NO: 3829 - protein, 5 aa, Neisseria
LKADF

SEQ ID NO: 3830 - protein, 7 aa, Neisseria
TIDDNIA

SEQ ID NO: 3831 - protein, 16 aa, Neisseria
FDFNREHARIFDTDQL

SEQ ID NO: 3832 - protein, 13 aa, Neisseria
RIVGRQRHIDRIA

SEQ ID NO: 3833 - protein, 7 aa, Neisseria
FHQRENA

SEQ ID NO: 3834 - protein, 5 aa, Neisseria
RNHGI

SEQ ID NO: 3835 - protein, 14 aa, Neisseria
HDSHICPFRNSRLI

SEQ ID NO: 3836 - protein, 10 aa, Neisseria
MPTRPTRAAN

SEQ ID NO: 3837 - protein, 12 aa, Neisseria
SVQTRTPREPAS

SEQ ID NO: 3838 - protein, 13 aa, Neisseria
CAAKSANRRENSH

SEQ ID NO: 3839 - protein, 13 aa, Neisseria
NKMPSETEQTLFR

SEQ ID NO: 3840 - protein, 5 aa, Neisseria
LKADF

SEQ ID NO: 3841 - protein, 12 aa, Neisseria
FDFNREHARIFD

SEQ ID NO: 3842 - protein, 13 aa, Neisseria
RIVGRQRHIDRIA

SEQ ID NO: 3843 - protein, 7 aa, Neisseria
FHQRENA

SEQ ID NO: 3844 - protein, 12 aa, Neisseria
SEVVTQFVDFVE

SEQ ID NO: 3845 - protein, 9 aa, Neisseria
AGFCHILQN

SEQ ID NO: 3846 - protein, 5 aa, Neisseria
ADQAQ

SEQ ID NO: 3847 - protein, 11 aa, Neisseria
NPFFDFFQAVV

SEQ ID NO: 3848 - protein, 9 aa, Neisseria
HQSGFGDVF

SEQ ID NO: 3849 - protein, 5 aa, Neisseria
LEQSV

SEQ ID NO: 3850 - protein, 5 aa, Neisseria
FELFQ

SEQ ID NO: 3851 - protein, 10 aa, Neisseria
FGHTRLFDIC

SEQ ID NO: 3852 - protein, 15 aa, Neisseria
HPFADFGNFQNLLAL

SEQ ID NO: 3853 - protein, 10 aa, Neisseria
HFEQRAGGIA

SEQ ID NO: 3854 - protein, 5 aa, Neisseria
VEQEQ

SEQ ID NO: 3855 - protein, 7 aa, Neisseria
TGHRADI

SEQ ID NO: 3856 - protein, 33 aa, Neisseria
SHADIFPPRCFGDGFAQRGFAHARRADQAQNRA

SEQ ID NO: 3857 - protein, 5 aa, Neisseria
HQSGF

SEQ ID NO: 3858 - protein, 7 aa, Neisseria
RQLEQSV

SEQ ID NO: 3859 - protein, 12 aa, Neisseria
AYDGGFRRHRWH

SEQ ID NO: 3860 - protein, 7 aa, Neisseria
MRCDRIG

SEQ ID NO: 3861 - protein, 9 aa, Neisseria
HFEQRAGGI

SEQ ID NO: 3862 - protein, 5 aa, Neisseria
VEQEQ

SEQ ID NO: 3863 - protein, 7 aa, Neisseria
TGHRADI

SEQ ID NO: 3864 - protein, 13 aa, Neisseria
AHARRADQAQNRA

SEQ ID NO: 3865 - protein, 7 aa, Neisseria
RQLEQSV

SEQ ID NO: 3866 - protein, 7 aa, Neisseria
GGFRRHR

SEQ ID NO: 3867 - protein, 7 aa, Neisseria
MRCDRIG

SEQ ID NO: 3868 - protein, 13 aa, Neisseria
ITRLARKAVQRLT

SEQ ID NO: 3869 - protein, 8 aa, Neisseria
  VARIANT (1)...(8): Xaa is any amino acid
HIQXFFTE

SEQ ID NO: 3870 - protein, 9 aa, Neisseria
DSSRITSTI

SEQ ID NO: 3871 - protein, 6 aa, Neisseria
LPSNAP

SEQ ID NO: 3872 - protein, 8 aa, Neisseria
RLARKAVQ

SEQ ID NO: 3873 - protein, 14 aa, Neisseria
SHTGANRSSSSCKP

SEQ ID NO: 3874 - protein, 8 aa, Neisseria
SASDSSRI

SEQ ID NO: 3875 - protein, 9 aa, Neisseria
STTGAVTKS

SEQ ID NO: 3876 - protein, 8 aa, Neisseria
RLARKAVQ

SEQ ID NO: 3877 - protein, 12 aa, Neisseria
HTGANRSSSSCK

SEQ ID NO: 3878 - protein, 7 aa, Neisseria
ASDSSRI

SEQ ID NO: 3879 - protein, 8 aa, Neisseria
KCFLQLVQ

SEQ ID NO: 3880 - protein, 5 aa, Neisseria
HLHAH

SEQ ID NO: 3881 - protein, 9 aa, Neisseria
ISRLCGSLF

SEQ ID NO: 3882 - protein, 9 aa, Neisseria
CLDGFHRLH

SEQ ID NO: 3883 - protein, 5 aa, Neisseria
NRFFT

SEQ ID NO: 3884 - protein, 15 aa, Neisseria
YPRKIRTFSRNFKQK

SEQ ID NO: 3885 - protein, 5 aa, Neisseria
MDIRI

SEQ ID NO: 3886 - protein, 7 aa, Neisseria
FRVDFLD

SEQ ID NO: 3887 - protein, 5 aa, Neisseria
IQKRH

SEQ ID NO: 3888 - protein, 17 aa, Neisseria
LDRQHFHGKLLSGELVR

SEQ ID NO: 3889 - protein, 7 aa, Neisseria
QLGNPRL

SEQ ID NO: 3890 - protein, 40 aa, Neisseria
LKTNWKSKSSYYPRKIRTFSRNFKQKQRISNSFSNPLPKK

SEQ ID NO: 3891 - protein, 5 aa, Neisseria
MDIRI

SEQ ID NO: 3892 - protein, 7 aa, Neisseria
FRVDFLD

SEQ ID NO: 3893 - protein, 7 aa, Neisseria
TNWKSKS

SEQ ID NO: 3894 - protein, 16 aa, Neisseria
RKIRTFSRNFKQKQRI

SEQ ID NO: 3895 - protein, 9 aa, Neisseria
AVNIAQCFT

SEQ ID NO: 3896 - protein, 8 aa, Neisseria
EQFANLFF

SEQ ID NO: 3897 - protein, 5 aa, Neisseria
DMGRF

SEQ ID NO: 3898 - protein, 15 aa, Neisseria
FGCDDVVDNLAGFGR

SEQ ID NO: 3899 - protein, 11 aa, Neisseria
QLSQVFFQLLQ

SEQ ID NO: 3900 - protein, 9 aa, Neisseria
MHGRYGGTQ

SEQ ID NO: 3901 - protein, 13 aa, Neisseria
QTQRTCFSNGKVY

SEQ ID NO: 3902 - protein, 5 aa, Neisseria
TDIGS

SEQ ID NO: 3903 - protein, 7 aa, Neisseria
QRRTEVL

SEQ ID NO: 3904 - protein, 9 aa, Neisseria
DSRHHDMGR

SEQ ID NO: 3905 - protein, 6 aa, Neisseria
LDDELA

SEQ ID NO: 3906 - protein, 8 aa, Neisseria
GCDDVVDN

SEQ ID NO: 3907 - protein, 6 aa, Neisseria
GFGRGF

SEQ ID NO: 3908 - protein, 7 aa, Neisseria
QRRTEVL

SEQ ID NO: 3909 - protein, 7 aa, Neisseria
DSRHHDM

SEQ ID NO: 3910 - protein, 6 aa, Neisseria
LDDELA

SEQ ID NO: 3911 - protein, 11 aa, Neisseria
SYDGMKGFTII

SEQ ID NO: 3912 - protein, 11 aa, Neisseria
LVAGLLSMIVL

SEQ ID NO: 3913 - protein, 6 aa, Neisseria
LNDAAN

SEQ ID NO: 3914 - protein, 6 aa, Neisseria
CFNMSE

SEQ ID NO: 3915 - protein, 7 aa, Neisseria
NYQNFFQ

SEQ ID NO: 3916 - protein, 19 aa, Neisseria
TVVSSCAAISKPGKQIPTL

SEQ ID NO: 3917 - protein, 9 aa, Neisseria
KYTDKFDSA

SEQ ID NO: 3918 - protein, 17 aa, Neisseria
MRRKMLNVPKGSYDGMK

SEQ ID NO: 3919 - protein, 17 aa, Neisseria
YFTSRKLNDAANERLAA

SEQ ID NO: 3920 - protein, 5 aa, Neisseria
QDLRN

SEQ ID NO: 3921 - protein, 9 aa, Neisseria
RDARMAGGF

SEQ ID NO: 3922 - protein, 30 aa, Neisseria
NMSEHPATDVIPDTTQQNSPFSLKRNGIDK

SEQ ID NO: 3923 - protein, 9 aa, Neisseria
AESSNINYQ

SEQ ID NO: 3924 - protein, 8 aa, Neisseria
IDDVNAST

SEQ ID NO: 3925 - protein, 37 aa, Neisseria
AISKPGKQIPTLEDAKKELKIPDQDKEQNGNIARQRH

SEQ ID NO: 3926 - protein, 8 aa, Neisseria
RIADEEGL

SEQ ID NO: 3927 - protein, 11 aa, Neisseria
FQLDDKGKWGN

SEQ ID NO: 3928 - protein, 7 aa, Neisseria
KKVRHMK

SEQ ID NO: 3929 - protein, 24 aa, Neisseria
GCPEDDDAGKEETFKYTDKFDSAQ

SEQ ID NO: 3930 - protein, 14 aa, Neisseria
SGTDTKIAASSDNH

SEQ ID NO: 3931 - protein, 14 aa, Neisseria
ATIRGGNVCANRTL

SEQ ID NO: 3932 - protein, 7 aa, Neisseria
MRRKMLN

SEQ ID NO: 3933 - protein, 5 aa, Neisseria
GSYDG

SEQ ID NO: 3934 - protein, 13 aa, Neisseria
RKLNDAANERLAA

SEQ ID NO: 3935 - protein, 5 aa, Neisseria
QDLRN

SEQ ID NO: 3936 - protein, 5 aa, Neisseria
RDARM

SEQ ID NO: 3937 - protein, 9 aa, Neisseria
SLKRNGIDK

SEQ ID NO: 3938 - protein, 6 aa, Neisseria
IDDVNA

SEQ ID NO: 3939 - protein, 6 aa, Neisseria
SKPGKQ

SEQ ID NO: 3940 - protein, 28 aa, Neisseria
PTLEDAKKELKIPDQDKEQNGNIARQRH

SEQ ID NO: 3941 - protein, 8 aa, Neisseria
RIADEEGL

SEQ ID NO: 3942 - protein, 9 aa, Neisseria
QLDDKGKWG

SEQ ID NO: 3943 - protein, 7 aa, Neisseria
KKVRHMK

SEQ ID NO: 3944 - protein, 23 aa, Neisseria
CPEDDDAGKEETFKYTDKFDSAQ

SEQ ID NO: 3945 - protein, 11 aa, Neisseria
GTDTKIAASSD

SEQ ID NO: 3946 - protein, 7 aa, Neisseria
MRRKMLN

SEQ ID NO: 3947 - protein, 5 aa, Neisseria
GSYDG

SEQ ID NO: 3948 - protein, 13 aa, Neisseria
RKLNDAANERLAA

SEQ ID NO: 3949 - protein, 5 aa, Neisseria
QDLRN

SEQ ID NO: 3950 - protein, 5 aa, Neisseria
RDARM

SEQ ID NO: 3951 - protein, 9 aa, Neisseria
SLKRNGIDK

SEQ ID NO: 3952 - protein, 6 aa, Neisseria
IDDVNA

SEQ ID NO: 3953 - protein, 6 aa, Neisseria
SKPGKQ

SEQ ID NO: 3954 - protein, 28 aa, Neisseria
PTLEDAKKELKIPDQDKEQNGNIARQRH

SEQ ID NO: 3955 - protein, 8 aa, Neisseria
RIADEEGL

SEQ ID NO: 3956 - protein, 9 aa, Neisseria
QLDDKGKWG

SEQ ID NO: 3957 - protein, 7 aa, Neisseria
KKVRHMK

SEQ ID NO: 3958 - protein, 23 aa, Neisseria
CPEDDDAGKEETFKYTDKFDSAQ

SEQ ID NO: 3959 - protein, 11 aa, Neisseria
GTDTKIAASSD

SEQ ID NO: 3960 - protein, 8 aa, Neisseria
MRKQNTLT

SEQ ID NO: 3961 - protein, 8 aa, Neisseria
PTSDGQRG

SEQ ID NO: 3962 - protein, 19 aa, Neisseria
QSYNTEQRISANESDRKLA

SEQ ID NO: 3963 - protein, 9 aa, Neisseria
AALREGELQ

SEQ ID NO: 3964 - protein, 19 aa, Neisseria
LEYDTDSKVTFSENCGKGL

SEQ ID NO: 3965 - protein, 12 aa, Neisseria
NVRTNNDNEEAF

SEQ ID NO: 3966 - protein, 42 aa, Neisseria
QGKPTVEAVKRSCPANSTDLCIDKKGMEYKKGTRSVSKMPRY

SEQ ID NO: 3967 - protein, 10 aa, Neisseria
LGVKNGENVY

SEQ ID NO: 3968 - protein, 8 aa, Neisseria
AWGKNANT

SEQ ID NO: 3969 - protein, 6 aa, Neisseria
VSNNDE

SEQ ID NO: 3970 - protein, 6 aa, Neisseria
MRKQNT

SEQ ID NO: 3971 - protein, 7 aa, Neisseria
PTSDGQR

SEQ ID NO: 3972 - protein, 17 aa, Neisseria
YNTEQRISANESDRKLA

SEQ ID NO: 3973 - protein, 9 aa, Neisseria
AALREGELQ

SEQ ID NO: 3974 - protein, 11 aa, Neisseria
LEYDTDSKVTF

SEQ ID NO: 3975 - protein, 10 aa, Neisseria
RTNNDNEEAF

SEQ ID NO: 3976 - protein, 11 aa, Neisseria
PTVEAVKRSCP

SEQ ID NO: 3977 - protein, 21 aa, Neisseria
LCIDKKGMEYKKGTRSVSKMP

SEQ ID NO: 3978 - protein, 7 aa, Neisseria
KNGENVY

SEQ ID NO: 3979 - protein, 5 aa, Neisseria
SNNDE

SEQ ID NO: 3980 - protein, 5 aa, Neisseria
CFRLK

SEQ ID NO: 3981 - protein, 7 aa, Neisseria
ALIEVLV

SEQ ID NO: 3982 - protein, 8 aa, Neisseria
TVASVREA

SEQ ID NO: 3983 - protein, 14 aa, Neisseria
TIVSQITQNLMEGM

SEQ ID NO: 3984 - protein, 17 aa, Neisseria
MKNNDCFRLKDSQSGMA

SEQ ID NO: 3985 - protein, 8 aa, Neisseria
ASVREAET

SEQ ID NO: 3986 - protein, 12 aa, Neisseria
PTIDSDSNKKNY

SEQ ID NO: 3987 - protein, 6 aa, Neisseria
VDGDFA

SEQ ID NO: 3988 - protein, 9 aa, Neisseria
AMKTKGQLA

SEQ ID NO: 3989 - protein, 13 aa, Neisseria
VCKDSSGNAPTLS

SEQ ID NO: 3990 - protein, 16 aa, Neisseria
NAFSSNCDNKANGDTL

SEQ ID NO: 3991 - protein, 19 aa, Neisseria
DSAGDSDISRTNLEVSGDN

SEQ ID NO: 3992 - protein, 7 aa, Neisseria
ARVGGRE

SEQ ID NO: 3993 - protein, 14 aa, Neisseria
MKNNDCFRLKDSQS

SEQ ID NO: 3994 - protein, 8 aa, Neisseria
ASVREAET

SEQ ID NO: 3995 - protein, 9 aa, Neisseria
IDSDSNKKN

SEQ ID NO: 3996 - protein, 9 aa, Neisseria
AMKTKGQLA

SEQ ID NO: 3997 - protein, 7 aa, Neisseria
VCKDSSG

SEQ ID NO: 3998 - protein, 8 aa, Neisseria
NCDNKANG

SEQ ID NO: 3999 - protein, 12 aa, Neisseria
SAGDSDISRTNL

SEQ ID NO: 4000 - protein, 5 aa, Neisseria
VGGRE

SEQ ID NO: 4001 - protein, 6 aa, Neisseria
FAGGSE

SEQ ID NO: 4002 - protein, 9 aa, Neisseria
ATVNLWAEP

SEQ ID NO: 4003 - protein, 9 aa, Neisseria
LTKTSTALP

SEQ ID NO: 4004 - protein, 9 aa, Neisseria
MQGGQKGMS

SEQ ID NO: 4005 - protein, 5 aa, Neisseria
AGGSE

SEQ ID NO: 4006 - protein, 7 aa, Neisseria
IPLKKAV

SEQ ID NO: 4007 - protein, 8 aa, Neisseria
EIQKRKAA

SEQ ID NO: 4008 - protein, 21 aa, Neisseria
FYSGLTKTSTALPRLSSKKTI

SEQ ID NO: 4009 - protein, 7 aa, Neisseria
IPLKKAV

SEQ ID NO: 4010 - protein, 8 aa, Neisseria
EIQKRKAA

SEQ ID NO: 4011 - protein, 7 aa, Neisseria
LSSKKTI

SEQ ID NO: 4012 - protein, 10 aa, Neisseria
AYGDPIGAGF

SEQ ID NO: 4013 - protein, 12 aa, Neisseria
QVVADFGGIEGF

SEQ ID NO: 4014 - protein, 13 aa, Neisseria
RTVGRTVRLLKMI

SEQ ID NO: 4015 - protein, 8 aa, Neisseria
ARTVFRAH

SEQ ID NO: 4016 - protein, 6 aa, Neisseria
LGQECR

SEQ ID NO: 4017 - protein, 18 aa, Neisseria
RHIARVESLLRVFEYAAD

SEQ ID NO: 4018 - protein, 17 aa, Neisseria
ARADIRPPAQTDIVPNC

SEQ ID NO: 4019 - protein, 8 aa, Neisseria
DAARRAVR

SEQ ID NO: 4020 - protein, 19 aa, Neisseria
ADLPRNDISPAYGDPIGAG

SEQ ID NO: 4021 - protein, 9 aa, Neisseria
LRGRVRRIG

SEQ ID NO: 4022 - protein, 11 aa, Neisseria
EIRAKAVKPEI

SEQ ID NO: 4023 - protein, 5 aa, Neisseria
RLVGT

SEQ ID NO: 4024 - protein, 7 aa, Neisseria
TVGRTVR

SEQ ID NO: 4025 - protein, 8 aa, Neisseria
PVVREAGI

SEQ ID NO: 4026 - protein, 8 aa, Neisseria
VKHARTVF

SEQ ID NO: 4027 - protein, 7 aa, Neisseria
VTGQRTR

SEQ ID NO: 4028 - protein, 19 aa, Neisseria
IKNRLGQECRNRHIARVES

SEQ ID NO: 4029 - protein, 14 aa, Neisseria
LKTKTRAEQPRPAF

SEQ ID NO: 4030 - protein, 10 aa, Neisseria
ARADIRPPAQ

SEQ ID NO: 4031 - protein, 8 aa, Neisseria
DAARRAVR

SEQ ID NO: 4032 - protein, 7 aa, Neisseria
DLPRNDI

SEQ ID NO: 4033 - protein, 7 aa, Neisseria
GRVRRIG

SEQ ID NO: 4034 - protein, 11 aa, Neisseria
EIRAKAVKPEI

SEQ ID NO: 4035 - protein, 7 aa, Neisseria
TVGRTVR

SEQ ID NO: 4036 - protein, 8 aa, Neisseria
PVVREAGI

SEQ ID NO: 4037 - protein, 8 aa, Neisseria
VKHARTVF

SEQ ID NO: 4038 - protein, 17 aa, Neisseria
NRLGQECRNRHIARVES

SEQ ID NO: 4039 - protein, 9 aa, Neisseria
TKTRAEQPR

SEQ ID NO: 4040 - protein, 7 aa, Neisseria
RFNTYSH

SEQ ID NO: 4041 - protein, 7 aa, Neisseria
GHGDGYR

SEQ ID NO: 4042 - protein, 7 aa, Neisseria
KLKSILK

SEQ ID NO: 4043 - protein, 13 aa, Neisseria
VLAVMKSLTASLP

SEQ ID NO: 4044 - protein, 10 aa, Neisseria
YTGERFNTYS

SEQ ID NO: 4045 - protein, 7 aa, Neisseria
GHGDGYR

SEQ ID NO: 4046 - protein, 12 aa, Neisseria
GKLKSILKKTDH

SEQ ID NO: 4047 - protein, 7 aa, Neisseria
SLRNGPG

SEQ ID NO: 4048 - protein, 10 aa, Neisseria
TIGRKSEKRL

SEQ ID NO: 4049 - protein, 10 aa, Neisseria
NDEKIRHGHG

SEQ ID NO: 4050 - protein, 12 aa, Neisseria
GKLKSILKKTDH

SEQ ID NO: 4051 - protein, 10 aa, Neisseria
TIGRKSEKRL

SEQ ID NO: 4052 - protein, 7 aa, Neisseria
NDEKIRH

SEQ ID NO: 4053 - protein, 18 aa, Neisseria
VKTCADFHAFDGVDAHHR

SEQ ID NO: 4054 - protein, 7 aa, Neisseria
GIQGFAH

SEQ ID NO: 4055 - protein, 5 aa, Neisseria
AGGGF

SEQ ID NO: 4056 - protein, 13 aa, Neisseria
DGVDAHHRVGDFG

SEQ ID NO: 4057 - protein, 15 aa, Neisseria
AVKNRFAQADRDIGC

SEQ ID NO: 4058 - protein, 8 aa, Neisseria
QLRADGIQ

SEQ ID NO: 4059 - protein, 8 aa, Neisseria
VGGKKRIL

SEQ ID NO: 4060 - protein, 9 aa, Neisseria
GNVGGDFRA

SEQ ID NO: 4061 - protein, 12 aa, Neisseria
FFGNGSGSNAGG

SEQ ID NO: 4062 - protein, 5 aa, Neisseria
FTGGA

SEQ ID NO: 4063 - protein, 6 aa, Neisseria
GAEAGG

SEQ ID NO: 4064 - protein, 13 aa, Neisseria
DGVDAHHRVGDFG

SEQ ID NO: 4065 - protein, 14 aa, Neisseria
AVKNRFAQADRDIG

SEQ ID NO: 4066 - protein, 6 aa, Neisseria
QLRADG

SEQ ID NO: 4067 - protein, 7 aa, Neisseria
GGKKRIL

SEQ ID NO: 4068 - protein, 5 aa, Neisseria
GDFRA

SEQ ID NO: 4069 - protein, 5 aa, Neisseria
SGSNA

SEQ ID NO: 4070 - protein, 6 aa, Neisseria
GAEAGG

SEQ ID NO: 4071 - protein, 14 aa, Neisseria
GVVVHFRSCGGIAN

SEQ ID NO: 4072 - protein, 8 aa, Neisseria
RYREIYAV

SEQ ID NO: 4073 - protein, 10 aa, Neisseria
NALAKYLGEQ

SEQ ID NO: 4074 - protein, 11 aa, Neisseria
RRFDSGITRLL

SEQ ID NO: 4075 - protein, 9 aa, Neisseria
KSLQGFQTA

SEQ ID NO: 4076 - protein, 20 aa, Neisseria
AAGCKTLGEFDDRFTAPLHG

SEQ ID NO: 4077 - protein, 15 aa, Neisseria
YYRQTSCKPLLKHVA

SEQ ID NO: 4078 - protein, 7 aa, Neisseria
PRADEVS

SEQ ID NO: 4079 - protein, 7 aa, Neisseria
TPPDTPF

SEQ ID NO: 4080 - protein, 10 aa, Neisseria
LRNGNADTIA

SEQ ID NO: 4081 - protein, 23 aa, Neisseria
FLQRPAPAYRRELLPDSTGKTKV

SEQ ID NO: 4082 - protein, 10 aa, Neisseria
DFSDGISPDA

SEQ ID NO: 4083 - protein, 9 aa, Neisseria
LEGSSRSHY

SEQ ID NO: 4084 - protein, 8 aa, Neisseria
AVRDRGWH

SEQ ID NO: 4085 - protein, 5 aa, Neisseria
GDTAE

SEQ ID NO: 4086 - protein, 9 aa, Neisseria
LGEQGKKAL

SEQ ID NO: 4087 - protein, 15 aa, Neisseria
VDAEAAGRRFDSGIT

SEQ ID NO: 4088 - protein, 9 aa, Neisseria
LIPKAKSLQ

SEQ ID NO: 4089 - protein, 10 aa, Neisseria
TLGEFDDRFT

SEQ ID NO: 4090 - protein, 17 aa, Neisseria
FADRHDYYRQTSCKPLL

SEQ ID NO: 4091 - protein, 16 aa, Neisseria
PFLPPEALPRADEVSE

SEQ ID NO: 4092 - protein, 7 aa, Neisseria
SSTGGRL

SEQ ID NO: 4093 - protein, 8 aa, Neisseria
DSFRTNRR

SEQ ID NO: 4094 - protein, 9 aa, Neisseria
PAYRRELLP

SEQ ID NO: 4095 - protein, 7 aa, Neisseria
STGKTKV

SEQ ID NO: 4096 - protein, 6 aa, Neisseria
EGSSRS

SEQ ID NO: 4097 - protein, 6 aa, Neisseria
VRDRGW

SEQ ID NO: 4098 - protein, 9 aa, Neisseria
LGEQGKKAL

SEQ ID NO: 4099 - protein, 14 aa, Neisseria
VDAEAAGRRFDSGI

SEQ ID NO: 4100 - protein, 7 aa, Neisseria
LIPKAKS

SEQ ID NO: 4101 - protein, 10 aa, Neisseria
TLGEFDDRFT

SEQ ID NO: 4102 - protein, 9 aa, Neisseria
FADRHDYYR

SEQ ID NO: 4103 - protein, 10 aa, Neisseria
ALPRADEVSE

SEQ ID NO: 4104 - protein, 6 aa, Neisseria
FRTNRR

SEQ ID NO: 4105 - protein, 5 aa, Neisseria
SFLPN

SEQ ID NO: 4106 - protein, 20 aa, Neisseria
DLVNKVLAEVARLEKIVQPL

SEQ ID NO: 4107 - protein, 10 aa, Neisseria
MGRHFGRRRF

SEQ ID NO: 4108 - protein, 16 aa, Neisseria
AADDEKRNGDEKRNEN

SEQ ID NO: 4109 - protein, 5 aa, Neisseria
GSGAE

SEQ ID NO: 4110 - protein, 11 aa, Neisseria
GVDDRRAADLV

SEQ ID NO: 4111 - protein, 7 aa, Neisseria
ARLEKIV

SEQ ID NO: 4112 - protein, 7 aa, Neisseria
HFGRRRF

SEQ ID NO: 4113 - protein, 15 aa, Neisseria
AADDEKRNGDEKRNE

SEQ ID NO: 4114 - protein, 11 aa, Neisseria
GVDDRRAADLV

SEQ ID NO: 4115 - protein, 7 aa, Neisseria
ARLEKIV

SEQ ID NO: 4116 - protein, 12 aa, Neisseria
YGRVFADIFELS

SEQ ID NO: 4117 - protein, 21 aa, Neisseria
AFKGMLKLTAEYKNIFGDACR

SEQ ID NO: 4118 - protein, 12 aa, Neisseria
NQALQEISKTSE

SEQ ID NO: 4119 - protein, 9 aa, Neisseria
KAYTEELPP

SEQ ID NO: 4120 - protein, 18 aa, Neisseria
SARSKAKAEKFYREKMIQ

SEQ ID NO: 4121 - protein, 5 aa, Neisseria
LEHKP

SEQ ID NO: 4122 - protein, 15 aa, Neisseria
KNHGKGMAEQVRFKA

SEQ ID NO: 4123 - protein, 12 aa, Neisseria
VLPDDEDARTIA

SEQ ID NO: 4124 - protein, 14 aa, Neisseria
GTDAVASGETYGRV

SEQ ID NO: 4125 - protein, 6 aa, Neisseria
LEGRAF

SEQ ID NO: 4126 - protein, 9 aa, Neisseria
DACRSETAL

SEQ ID NO: 4127 - protein, 11 aa, Neisseria
EISKTSEKSKR

SEQ ID NO: 4128 - protein, 7 aa, Neisseria
AYTEELP

SEQ ID NO: 4129 - protein, 17 aa, Neisseria
ARSKAKAEKFYREKMIQ

SEQ ID NO: 4130 - protein, 5 aa, Neisseria
LEHKP

SEQ ID NO: 4131 - protein, 14 aa, Neisseria
NHGKGMAEQVRFKA

SEQ ID NO: 4132 - protein, 12 aa, Neisseria
VLPDDEDARTIA

SEQ ID NO: 4133 - protein, 6 aa, Neisseria
LEGRAF

SEQ ID NO: 4134 - protein, 9 aa, Neisseria
DACRSETAL

SEQ ID NO: 4135 - protein, 11 aa, Neisseria
EISKTSEKSKR

SEQ ID NO: 4136 - protein, 10 aa, Neisseria
PFSSLFRALF

SEQ ID NO: 4137 - protein, 16 aa, Neisseria
FIDSVGQVAARLFQAF

SEQ ID NO: 4138 - protein, 9 aa, Neisseria
QVGIVDLIP

SEQ ID NO: 4139 - protein, 6 aa, Neisseria
LPRAVQ

SEQ ID NO: 4140 - protein, 8 aa, Neisseria
LFEDRVGI

SEQ ID NO: 4141 - protein, 7 aa, Neisseria
GAHDAAE

SEQ ID NO: 4142 - protein, 9 aa, Neisseria
DFLPEEFTR

SEQ ID NO: 4143 - protein, 14 aa, Neisseria
PAFRAREQARRGSG

SEQ ID NO: 4144 - protein, 22 aa, Neisseria
GNDLRMPHKDAVEVDIDGGNTV

SEQ ID NO: 4145 - protein, 8 aa, Neisseria
THFDDGDA

SEQ ID NO: 4146 - protein, 5 aa, Neisseria
AEARF

SEQ ID NO: 4147 - protein, 6 aa, Neisseria
RNAPQG

SEQ ID NO: 4148 - protein, 8 aa, Neisseria
VAFRRVRA

SEQ ID NO: 4149 - protein, 8 aa, Neisseria
LFEDRVGI

SEQ ID NO: 4150 - protein, 7 aa, Neisseria
GAHDAAE

SEQ ID NO: 4151 - protein, 11 aa, Neisseria
FRAREQARRGS

SEQ ID NO: 4152 - protein, 17 aa, Neisseria
NDLRMPHKDAVEVDIDG

SEQ ID NO: 4153 - protein, 7 aa, Neisseria
HFDDGDA

SEQ ID NO: 4154 - protein, 5 aa, Neisseria
AEARF

SEQ ID NO: 4155 - protein, 8 aa, Neisseria
VAFRRVRA

SEQ ID NO: 4156 - protein, 5 aa, Neisseria
QIFRQ

SEQ ID NO: 4157 - protein, 9 aa, Neisseria
DTARAFAAA

SEQ ID NO: 4158 - protein, 6 aa, Neisseria
GLLADI

SEQ ID NO: 4159 - protein, 5 aa, Neisseria
RFDKH

SEQ ID NO: 4160 - protein, 11 aa, Neisseria
AVYKGIRNAVF

SEQ ID NO: 4161 - protein, 7 aa, Neisseria
QGIVRNL

SEQ ID NO: 4162 - protein, 6 aa, Neisseria
DVFAPV

SEQ ID NO: 4163 - protein, 7 aa, Neisseria
CLNQAGG

SEQ ID NO: 4164 - protein, 6 aa, Neisseria
AADDAV

SEQ ID NO: 4165 - protein, 9 aa, Neisseria
VRQRPRLRL

SEQ ID NO: 4166 - protein, 7 aa, Neisseria
HQRRVDL

SEQ ID NO: 4167 - protein, 14 aa, Neisseria
RQIKGNVHRFDKHV

SEQ ID NO: 4168 - protein, 9 aa, Neisseria
AHARDDVPY

SEQ ID NO: 4169 - protein, 10 aa, Neisseria
NRGIEQEKRV

SEQ ID NO: 4170 - protein, 6 aa, Neisseria
SFDGGG

SEQ ID NO: 4171 - protein, 5 aa, Neisseria
RNPAG

SEQ ID NO: 4172 - protein, 7 aa, Neisseria
LESNGLD

SEQ ID NO: 4173 - protein, 17 aa, Neisseria
NQAGGRILTARKDDQGL

SEQ ID NO: 4174 - protein, 6 aa, Neisseria
AADDAV

SEQ ID NO: 4175 - protein, 9 aa, Neisseria
VRQRPRLRL

SEQ ID NO: 4176 - protein, 7 aa, Neisseria
HQRRVDL

SEQ ID NO: 4177 - protein, 9 aa, Neisseria
NVHRFDKHV

SEQ ID NO: 4178 - protein, 7 aa, Neisseria
HARDDVP

SEQ ID NO: 4179 - protein, 9 aa, Neisseria
RGIEQEKRV

SEQ ID NO: 4180 - protein, 9 aa, Neisseria
LTARKDDQG

SEQ ID NO: 4181 - protein, 9 aa, Neisseria
NLIGVLSNA

SEQ ID NO: 4182 - protein, 19 aa, Neisseria
EALAFYQEVGKLNAANSLT

SEQ ID NO: 4183 - protein, 7 aa, Neisseria
KLATLKK

SEQ ID NO: 4184 - protein, 10 aa, Neisseria
KAARALAAGE

SEQ ID NO: 4185 - protein, 9 aa, Neisseria
LGALAAFTQ

SEQ ID NO: 4186 - protein, 9 aa, Neisseria
EELKAFFDA

SEQ ID NO: 4187 - protein, 14 aa, Neisseria
VALATLCNYVNNLG

SEQ ID NO: 4188 - protein, 13 aa, Neisseria
ETAPEAAKARVEA

SEQ ID NO: 4189 - protein, 5 aa, Neisseria
LSNAP

SEQ ID NO: 4190 - protein, 7 aa, Neisseria
ARTNQCG

SEQ ID NO: 4191 - protein, 7 aa, Neisseria
QSVKAAR

SEQ ID NO: 4192 - protein, 8 aa, Neisseria
GEFDDAKL

SEQ ID NO: 4193 - protein, 14 aa, Neisseria
MAKKGAVSDEELKA

SEQ ID NO: 4194 - protein, 9 aa, Neisseria
GQTEINPEL

SEQ ID NO: 4195 - protein, 12 aa, Neisseria
TAPEAAKARVEA

SEQ ID NO: 4196 - protein, 7 aa, Neisseria
QSVKAAR

SEQ ID NO: 4197 - protein, 8 aa, Neisseria
GEFDDAKL

SEQ ID NO: 4198 - protein, 14 aa, Neisseria
MAKKGAVSDEELKA

SEQ ID NO: 4199 - protein, 8 aa, Neisseria
VAEFTQTG

SEQ ID NO: 4200 - protein, 11 aa, Neisseria
IPSYVRVTNTK

SEQ ID NO: 4201 - protein, 7 aa, Neisseria
NRIIDVS

SEQ ID NO: 4202 - protein, 5 aa, Neisseria
LNQAA

SEQ ID NO: 4203 - protein, 29 aa, Neisseria
AVVKAEKLHASANRSYKVAGKRYTPKNQV

SEQ ID NO: 4204 - protein, 10 aa, Neisseria
EFTQTGNASW

SEQ ID NO: 4205 - protein, 16 aa, Neisseria
GGRFHGRKTSGGERYD

SEQ ID NO: 4206 - protein, 9 aa, Neisseria
TNTKNGKSV

SEQ ID NO: 4207 - protein, 21 aa, Neisseria
RVNDRGPFHGNRIIDVSKAAA

SEQ ID NO: 4208 - protein, 16 aa, Neisseria
VPGQSAPVAENKDIFI

SEQ ID NO: 4209 - protein, 10 aa, Neisseria
LKSFGTEHEA

SEQ ID NO: 4210 - protein, 9 aa, Neisseria
SVEKRRYEY

SEQ ID NO: 4211 - protein, 16 aa, Neisseria
GPFTSQERAAEAEAQA

SEQ ID NO: 4212 - protein, 25 aa, Neisseria
AVVKAEKLHASANRSYKVAGKRYTP

SEQ ID NO: 4213 - protein, 13 aa, Neisseria
FHGRKTSGGERYD

SEQ ID NO: 4214 - protein, 7 aa, Neisseria
TNTKNGK

SEQ ID NO: 4215 - protein, 8 aa, Neisseria
VNDRGPFH

SEQ ID NO: 4216 - protein, 10 aa, Neisseria
RIIDVSKAAA

SEQ ID NO: 4217 - protein, 10 aa, Neisseria
PVAENKDIFI

SEQ ID NO: 4218 - protein, 9 aa, Neisseria
KSFGTEHEA

SEQ ID NO: 4219 - protein, 9 aa, Neisseria
SVEKRRYEY

SEQ ID NO: 4220 - protein, 13 aa, Neisseria
TSQERAAEAEAQA

SEQ ID NO: 4221 - protein, 7 aa, Neisseria
ALKRKHF

SEQ ID NO: 4222 - protein, 14 aa, Neisseria
LESRAGSVHDQGWE

SEQ ID NO: 4223 - protein, 7 aa, Neisseria
WHTRNRE

SEQ ID NO: 4224 - protein, 7 aa, Neisseria
ALKRKHF

SEQ ID NO: 4225 - protein, 7 aa, Neisseria
SRAGSVH

SEQ ID NO: 4226 - protein, 13 aa, Neisseria
DGLHKFKHICSAA

SEQ ID NO: 4227 - protein, 8 aa, Neisseria
IKEPLDKV

SEQ ID NO: 4228 - protein, 9 aa, Neisseria
QEAARVSEW

SEQ ID NO: 4229 - protein, 15 aa, Neisseria
EFEQFWKGLPQTVQN

SEQ ID NO: 4230 - protein, 11 aa, Neisseria
SQKTWKSGMDK

SEQ ID NO: 4231 - protein, 7 aa, Neisseria
KTPNGIK

SEQ ID NO: 4232 - protein, 7 aa, Neisseria
VQSRYDG

SEQ ID NO: 4233 - protein, 24 aa, Neisseria
LIKEPLDKVKQRNEELEAAEEAAA

SEQ ID NO: 4234 - protein, 25 aa, Neisseria
ALGREQEAARVSEWEERYKLSRSEF

SEQ ID NO: 4235 - protein, 36 aa, Neisseria
VQNKLQASQKTWKSGMDKICANNAKAEGKTPNGIKF

SEQ ID NO: 4236 - protein, 40 aa, Neisseria
ELACKTAKTEARLEELHNRKKALIDEMAREADKKELSKRL

SEQ ID NO: 4237 - protein, 5 aa, Neisseria
SRYDG

SEQ ID NO: 4238 - protein, 24 aa, Neisseria
LIKEPLDKVKQRNEELEAAEEAAA

SEQ ID NO: 4239 - protein, 25 aa, Neisseria
ALGREQEAARVSEWEERYKLSRSEF

SEQ ID NO: 4240 - protein, 11 aa, Neisseria
KTWKSGMDKIC

SEQ ID NO: 4241 - protein, 10 aa, Neisseria
NAKAEGKTPN

SEQ ID NO: 4242 - protein, 40 aa, Neisseria; identical to SEQ ID NO: 4236

SEQ ID NO: 4243 - protein, 5 aa, Neisseria
ASVPA

SEQ ID NO: 4244 - protein, 7 aa, Neisseria
WDFIQNT

SEQ ID NO: 4245 - protein, 12 aa, Neisseria
FKTRALGRFSSP

SEQ ID NO: 4246 - protein, 16 aa, Neisseria
RSALSCKPCASVPASS

SEQ ID NO: 4247 - protein, 7 aa, Neisseria
TASPKVS

SEQ ID NO: 4248 - protein, 11 aa, Neisseria
FKTRALGRFSS

SEQ ID NO: 4249 - protein, 10 aa, Neisseria
LSERGVKKPL

SEQ ID NO: 4250 - protein, 6 aa, Neisseria
QVDTSA

SEQ ID NO: 4251 - protein, 5 aa, Neisseria
SLRSS

SEQ ID NO: 4252 - protein, 5 aa, Neisseria
ASPKV

SEQ ID NO: 4253 - protein, 7 aa, Neisseria
FKTRALG

SEQ ID NO: 4254 - protein, 10 aa, Neisseria
LSERGVKKPL

SEQ ID NO: 4255 - protein, 6 aa, Neisseria
DLTEGC

SEQ ID NO: 4256 - protein, 5 aa, Neisseria
PDGSR

SEQ ID NO: 4257 - protein, 6 aa, Neisseria
QPSGTW

SEQ ID NO: 4258 - protein, 7 aa, Neisseria
MNKNRKL

SEQ ID NO: 4259 - protein, 25 aa, Neisseria
DLTEGCTLPDGSRVRAAAVSTKKPF

SEQ ID NO: 4260 - protein, 7 aa, Neisseria
HAPAGTE

SEQ ID NO: 4261 - protein, 7 aa, Neisseria
KNMDMGF

SEQ ID NO: 4262 - protein, 10 aa, Neisseria
YMFERQPSGT

SEQ ID NO: 4263 - protein, 9 aa, Neisseria
VEGRRDFTA

SEQ ID NO: 4264 - protein, 6 aa, Neisseria
IGSRTF

SEQ ID NO: 4265 - protein, 7 aa, Neisseria
MNKNRKL

SEQ ID NO: 4266 - protein, 8 aa, Neisseria
PDGSRVRA

SEQ ID NO: 4267 - protein, 6 aa, Neisseria
STKKPF

SEQ ID NO: 4268 - protein, 5 aa, Neisseria
PAGTE

SEQ ID NO: 4269 - protein, 6 aa, Neisseria
MFERQP

SEQ ID NO: 4270 - protein, 9 aa, Neisseria
VEGRRDFTA

SEQ ID NO: 4271 - protein, 5 aa, Neisseria
MARIW

SEQ ID NO: 4272 - protein, 5 aa, Neisseria
SPCPA

SEQ ID NO: 4273 - protein, 5 aa, Neisseria
PKSPA

SEQ ID NO: 4274 - protein, 7 aa, Neisseria
FSSRMAR

SEQ ID NO: 4275 - protein, 10 aa, Neisseria
LTTKPKSPAK

SEQ ID NO: 4276 - protein, 5 aa, Neisseria
RSNCL

SEQ ID NO: 4277 - protein, 10 aa, Neisseria
SSTTGAPTSR

SEQ ID NO: 4278 - protein, 14 aa, Neisseria
SASINKDTRMPASV

SEQ ID NO: 4279 - protein, 10 aa, Neisseria
CCANTSKPPS

SEQ ID NO: 4280 - protein, 8 aa, Neisseria
TKPKSPAK

SEQ ID NO: 4281 - protein, 8 aa, Neisseria
SINKDTRM

SEQ ID NO: 4282 - protein, 6 aa, Neisseria
NTSKPP

SEQ ID NO: 4283 - protein, 7 aa, Neisseria
ITRITDE

SEQ ID NO: 4284 - protein, 8 aa, Neisseria
AEEFSSTN

SEQ ID NO: 4285 - protein, 6 aa, Neisseria
FRTITS

SEQ ID NO: 4286 - protein, 9 aa, Neisseria
IITIEDPIE

SEQ ID NO: 4287 - protein, 13 aa, Neisseria
NWMAALKNTLRQA

SEQ ID NO: 4288 - protein, 9 aa, Neisseria
NQALDRIIN

SEQ ID NO: 4289 - protein, 11 aa, Neisseria
GNIHEIKEVMK

SEQ ID NO: 4290 - protein, 6 aa, Neisseria
DQHLYQ

SEQ ID NO: 4291 - protein, 7 aa, Neisseria
ALKNADS

SEQ ID NO: 4292 - protein, 12 aa, Neisseria
FTDENMTAKEEL

SEQ ID NO: 4293 - protein, 8 aa, Neisseria
MNQNKGSD

SEQ ID NO: 4294 - protein, 21 aa, Neisseria
MKLDGKITRITDEPLTAEKCM

SEQ ID NO: 4295 - protein, 11 aa, Neisseria
KQAEEFSSTNE

SEQ ID NO: 4296 - protein, 9 aa, Neisseria
LPDTSRFRV

SEQ ID NO: 4297 - protein, 12 aa, Neisseria
ITSKIPKFESLN

SEQ ID NO: 4298 - protein, 7 aa, Neisseria
VALKKRG

SEQ ID NO: 4299 - protein, 9 aa, Neisseria
TGSGKSTSL

SEQ ID NO: 4300 - protein, 10 aa, Neisseria
IDYRNENSFG

SEQ ID NO: 4301 - protein, 5 aa, Neisseria
IEDPI

SEQ ID NO: 4302 - protein, 6 aa, Neisseria
HEHKNC

SEQ ID NO: 4303 - protein, 11 aa, Neisseria
TQREVGVDTEN

SEQ ID NO: 4304 - protein, 10 aa, Neisseria
LKNTLRQAPD

SEQ ID NO: 4305 - protein, 8 aa, Neisseria
EIRDRETM

SEQ ID NO: 4306 - protein, 9 aa, Neisseria
NSTNQALDR

SEQ ID NO: 4307 - protein, 10 aa, Neisseria
FPEERREQLL

SEQ ID NO: 4308 - protein, 13 aa, Neisseria
LVPRDGGKGRVAA

SEQ ID NO: 4309 - protein, 11 aa, Neisseria
HEIKEVMKKST

SEQ ID NO: 4310 - protein, 9 aa, Neisseria
LYEKGDISL

SEQ ID NO: 4311 - protein, 12 aa, Neisseria
EALKNADSAHDL

SEQ ID NO: 4312 - protein, 15 aa, Neisseria
LRSRRAQSSSPDLEL

SEQ ID NO: 4313 - protein, 12 aa, Neisseria
FTDENMTAKEEL

SEQ ID NO: 4314 - protein, 8 aa, Neisseria
MNQNKGSD

SEQ ID NO: 4315 - protein, 21 aa, Neisseria
MKLDGKITRITDEPLTAEKCM

SEQ ID NO: 4316 - protein, 8 aa, Neisseria
KQAEEFSS

SEQ ID NO: 4317 - protein, 7 aa, Neisseria
DTSRFRV

SEQ ID NO: 4318 - protein, 7 aa, Neisseria
KIPKFES

SEQ ID NO: 4319 - protein, 7 aa, Neisseria
VALKKRG

SEQ ID NO: 4320 - protein, 7 aa, Neisseria
GSGKSTS

SEQ ID NO: 4321 - protein, 7 aa, Neisseria
DYRNENS

SEQ ID NO: 4322 - protein, 5 aa, Neisseria
IEDPI

SEQ ID NO: 4323 - protein, 5 aa, Neisseria
HEHKN

SEQ ID NO: 4324 - protein, 9 aa, Neisseria
TQREVGVDT

SEQ ID NO: 4325 - protein, 7 aa, Neisseria
NTLRQAP

SEQ ID NO: 4326 - protein, 8 aa, Neisseria
EIRDRETM

SEQ ID NO: 4327 - protein, 5 aa, Neisseria
QALDR

SEQ ID NO: 4328 - protein, 9 aa, Neisseria
PEERREQLL

SEQ ID NO: 4329 - protein, 13 aa, Neisseria
LVPRDGGKGRVAA

SEQ ID NO: 4330 - protein, 11 aa, Neisseria
HEIKEVMKKST

SEQ ID NO: 4331 - protein, 7 aa, Neisseria
EKGDISL

SEQ ID NO: 4332 - protein, 12 aa, Neisseria
EALKNADSAHDL

SEQ ID NO: 4333 - protein, 15 aa, Neisseria
LRSRRAQSSSPDLEL

SEQ ID NO: 4334 - protein, 5 aa, Neisseria
YKDGK

SEQ ID NO: 4335 - protein, 9 aa, Neisseria
EAVFKTLSP

SEQ ID NO: 4336 - protein, 14 aa, Neisseria
LVTDDYYKDGKHID

SEQ ID NO: 4337 - protein, 13 aa, Neisseria
QLHRDEEAVRRHI

SEQ ID NO: 4338 - protein, 5 aa, Neisseria
PDMNA

SEQ ID NO: 4339 - protein, 8 aa, Neisseria
GEFDGKQP

SEQ ID NO: 4340 - protein, 11 aa, Neisseria
HPTRKADDQTV

SEQ ID NO: 4341 - protein, 12 aa, Neisseria
PVGSAQNGRAEY

SEQ ID NO: 4342 - protein, 6 aa, Neisseria
LSPTNH

SEQ ID NO: 4343 - protein, 7 aa, Neisseria
RVEDAAG

SEQ ID NO: 4344 - protein, 28 aa, Neisseria
VENKWITSQGNAVDLTPMDKLFNNTESK

SEQ ID NO: 4345 - protein, 10 aa, Neisseria
DYYKDGKHID

SEQ ID NO: 4346 - protein, 13 aa, Neisseria
QLHRDEEAVRRHI

SEQ ID NO: 4347 - protein, 6 aa, Neisseria
EFDGKQ

SEQ ID NO: 4348 - protein, 10 aa, Neisseria
PTRKADDQTV

SEQ ID NO: 4349 - protein, 7 aa, Neisseria
QNGRAEY

SEQ ID NO: 4350 - protein, 7 aa, Neisseria
RVEDAAG

SEQ ID NO: 4351 - protein, 8 aa, Neisseria
TPMDKLFN

SEQ ID NO: 4352 - protein, 17 aa, Neisseria
MMRSAPSMVVRRWATMM

SEQ ID NO: 4353 - protein, 6 aa, Neisseria
SFKMAR

SEQ ID NO: 4354 - protein, 7 aa, Neisseria
PFDPMGW

SEQ ID NO: 4355 - protein, 9 aa, Neisseria
GRLYRTFSN

SEQ ID NO: 4356 - protein, 7 aa, Neisseria
TKRGSRL

SEQ ID NO: 4357 - protein, 13 aa, Neisseria
STSTLRKLMRPST

SEQ ID NO: 4358 - protein, 8 aa, Neisseria
MRSAPSMV

SEQ ID NO: 4359 - protein, 18 aa, Neisseria
FSIRRSSACWTRRSDSLS

SEQ ID NO: 4360 - protein, 6 aa, Neisseria
SSNNNI

SEQ ID NO: 4361 - protein, 14 aa, Neisseria
MATRCRCPPDKLLP

SEQ ID NO: 4362 - protein, 13 aa, Neisseria
DPMGWCSPSGELS

SEQ ID NO: 4363 - protein, 15 aa, Neisseria
RANRTSASPASGRLY

SEQ ID NO: 4364 - protein, 26 aa, Neisseria
FSNRVSSNRNTSWETRANWARRQSSL

SEQ ID NO: 4365 - protein, 15 aa, Neisseria
LPADGSTKRGSRLTT

SEQ ID NO: 4366 - protein, 15 aa, Neisseria
PLPERPTRATRSPCL

SEQ ID NO: 4367 - protein, 5 aa, Neisseria
LKLSR

SEQ ID NO: 4368 - protein, 24 aa, Neisseria
LMPSERYSTSTLRKLMRPSTRCGA

SEQ ID NO: 4369 - protein, 17 aa, Neisseria
CSGGVSRNAHTPSAARN

SEQ ID NO: 4370 - protein, 7 aa, Neisseria
FSIRRSS

SEQ ID NO: 4371 - protein, 8 aa, Neisseria
WTRRSDSL

SEQ ID NO: 4372 - protein, 11 aa, Neisseria
MATRCRCPPDK

SEQ ID NO: 4373 - protein, 5 aa, Neisseria
SGELS

SEQ ID NO: 4374 - protein, 7 aa, Neisseria
RANRTSA

SEQ ID NO: 4375 - protein, 12 aa, Neisseria
RVSSNRNTSWET

SEQ ID NO: 4376 - protein, 9 aa, Neisseria
ANWARRQSS

SEQ ID NO: 4377 - protein, 9 aa, Neisseria
DGSTKRGSR

SEQ ID NO: 4378 - protein, 11 aa, Neisseria
PLPERPTRATR

SEQ ID NO: 4379 - protein, 5 aa, Neisseria
LKLSR

SEQ ID NO: 4380 - protein, 8 aa, Neisseria
LMPSERYS

SEQ ID NO: 4381 - protein, 12 aa, Neisseria
TLRKLMRPSTRC

SEQ ID NO: 4382 - protein, 7 aa, Neisseria
GVSRNAH

SEQ ID NO: 4383 - protein, 16 aa, Neisseria
GIAVFEVVGGLLDFVL

SEQ ID NO: 4384 - protein, 11 aa, Neisseria
CPNEVVDVFYT

SEQ ID NO: 4385 - protein, 30 aa, Neisseria
AFDAVGDFAEYGRAVDAADLLEIGKLGYFH

SEQ ID NO: 4386 - protein, 8 aa, Neisseria
AVGVVAVA

SEQ ID NO: 4387 - protein, 16 aa, Neisseria
PRFEDKLVGRQGEGGV

SEQ ID NO: 4388 - protein, 7 aa, Neisseria
VGDGVAV

SEQ ID NO: 4389 - protein, 7 aa, Neisseria
RFCPNEV

SEQ ID NO: 4390 - protein, 9 aa, Neisseria
AEYGRAVDA

SEQ ID NO: 4391 - protein, 15 aa, Neisseria
VEPDFPAQTPRAEGG

SEQ ID NO: 4392 - protein, 7 aa, Neisseria
FDKADVV

SEQ ID NO: 4393 - protein, 5 aa, Neisseria
VEIEV

SEQ ID NO: 4394 - protein, 9 aa, Neisseria
GGSGLEGDL

SEQ ID NO: 4395 - protein, 11 aa, Neisseria
LDVGGKPRLGA

SEQ ID NO: 4396 - protein, 7 aa, Neisseria
CAQAGGG

SEQ ID NO: 4397 - protein, 5 aa, Neisseria
GTDFH

SEQ ID NO: 4398 - protein, 6 aa, Neisseria
GLDDGA

SEQ ID NO: 4399 - protein, 14 aa, Neisseria
LQFEDDLLEGKHGL

SEQ ID NO: 4400 - protein, 13 aa, Neisseria
PRFEDKLVGRQGE

SEQ ID NO: 4401 - protein, 9 aa, Neisseria
AEYGRAVDA

SEQ ID NO: 4402 - protein, 5 aa, Neisseria
VEPDF

SEQ ID NO: 4403 - protein, 6 aa, Neisseria
TPRAEG

SEQ ID NO: 4404 - protein, 7 aa, Neisseria
FDKADVV

SEQ ID NO: 4405 - protein, 5 aa, Neisseria
VEIEV

SEQ ID NO: 4406 - protein, 6 aa, Neisseria
GLEGDL

SEQ ID NO: 4407 - protein, 9 aa, Neisseria
VGGKPRLGA

SEQ ID NO: 4408 - protein, 6 aa, Neisseria
GLDDGA

SEQ ID NO: 4409 - protein, 14 aa, Neisseria
LQFEDDLLEGKHGL

SEQ ID NO: 4410 - protein, 7 aa, Neisseria
GAIFSIG

SEQ ID NO: 4411 - protein, 9 aa, Neisseria
IGPLPSIGR

SEQ ID NO: 4412 - protein, 5 aa, Neisseria
TGTSK

SEQ ID NO: 4413 - protein, 9 aa, Neisseria
RTIPSVTEI

SEQ ID NO: 4414 - protein, 12 aa, Neisseria
FSILALIKSLIS

SEQ ID NO: 4415 - protein, 17 aa, Neisseria
LYRQIQNLITHFNFYAA

SEQ ID NO: 4416 - protein, 12 aa, Neisseria
ETLIQHLHQLAD

SEQ ID NO: 4417 - protein, 25 aa, Neisseria
SIGRPNASTTRPTSSRPTGTSKIRP

SEQ ID NO: 4418 - protein, 16 aa, Neisseria
SPNTTAPTESRSRFIA

SEQ ID NO: 4419 - protein, 10 aa, Neisseria
PKVLPGNSSI

SEQ ID NO: 4420 - protein, 9 aa, Neisseria
IASDKPWMR

SEQ ID NO: 4421 - protein, 8 aa, Neisseria
SAFTDRFS

SEQ ID NO: 4422 - protein, 8 aa, Neisseria
RHSRVQGT

SEQ ID NO: 4423 - protein, 7 aa, Neisseria
FDFDRDF

SEQ ID NO: 4424 - protein, 11 aa, Neisseria
TVNDGRFDMVE

SEQ ID NO: 4425 - protein, 23 aa, Neisseria
GRPNASTTRPTSSRPTGTSKIRP

SEQ ID NO: 4426 - protein, 11 aa, Neisseria
APTESRSRFIA

SEQ ID NO: 4427 - protein, 7 aa, Neisseria
IASDKPW

SEQ ID NO: 4428 - protein, 6 aa, Neisseria
RHSRVQ

SEQ ID NO: 4429 - protein, 7 aa, Neisseria
FDFDRDF

SEQ ID NO: 4430 - protein, 9 aa, Neisseria
NDGRFDMVE

SEQ ID NO: 4431 - protein, 6 aa, Neisseria
GCLIST

SEQ ID NO: 4432 - protein, 5 aa, Neisseria
FRASA

SEQ ID NO: 4433 - protein, 9 aa, Neisseria
AAAMARPTA

SEQ ID NO: 4434 - protein, 15 aa, Neisseria
QWEGTDTGSGRARLA

SEQ ID NO: 4435 - protein, 8 aa, Neisseria
CPGELKLT

SEQ ID NO: 4436 - protein, 8 aa, Neisseria
CSSSKPRI

SEQ ID NO: 4437 - protein, 18 aa, Neisseria
TPCGTADCISSARRRTSL

SEQ ID NO: 4438 - protein, 14 aa, Neisseria
WEGTDTGSGRARLA

SEQ ID NO: 4439 - protein, 5 aa, Neisseria
GELKL

SEQ ID NO: 4440 - protein, 7 aa, Neisseria
SSSKPRI

SEQ ID NO: 4441 - protein, 9 aa, Neisseria
SSARRRTSL

SEQ ID NO: 4442 - protein, 10 aa, Neisseria
SFSILGDVAK

SEQ ID NO: 4443 - protein, 8 aa, Neisseria
DIKKIRSA

SEQ ID NO: 4444 - protein, 7 aa, Neisseria
DVQRAVK

SEQ ID NO: 4445 - protein, 12 aa, Neisseria
YTEATKGIQPLK

SEQ ID NO: 4446 - protein, 12 aa, Neisseria
AYAQNVAKALIK

SEQ ID NO: 4447 - protein, 9 aa, Neisseria
VAAIIRQIK

SEQ ID NO: 4448 - protein, 9 aa, Neisseria
EGIKAVFTE

SEQ ID NO: 4449 - protein, 13 aa, Neisseria
KDTRMVDRIAKET

SEQ ID NO: 4450 - protein, 15 aa, Neisseria
LYSDALGNAPADTYI

SEQ ID NO: 4451 - protein, 7 aa, Neisseria
IGGERVS

SEQ ID NO: 4452 - protein, 6 aa, Neisseria
ANQDTH

SEQ ID NO: 4453 - protein, 12 aa, Neisseria
TSGDIKKIRSAK

SEQ ID NO: 4454 - protein, 24 aa, Neisseria
EAADVQRAVKQSKVSYTEATKGIQ

SEQ ID NO: 4455 - protein, 35 aa, Neisseria
LKAEEEGGHHHDHDHDHEGHHHDHGEYDPHVWNDP

SEQ ID NO: 4456 - protein, 12 aa, Neisseria
LIKADPEGKVYY

SEQ ID NO: 4457 - protein, 9 aa, Neisseria
QLKKLHSDA

SEQ ID NO: 4458 - protein, 9 aa, Neisseria
PAAKRKVLT

SEQ ID NO: 4459 - protein, 6 aa, Neisseria
MGKRYH

SEQ ID NO: 4460 - protein, 15 aa, Neisseria
APQGVSSEAEPSAKQ

SEQ ID NO: 4461 - protein, 8 aa, Neisseria
RQIKREGI

SEQ ID NO: 4462 - protein, 18 aa, Neisseria
ENIKDTRMVDRIAKETGV

SEQ ID NO: 4463 - protein, 7 aa, Neisseria
VSGKLYS

SEQ ID NO: 4464 - protein, 5 aa, Neisseria
APADT

SEQ ID NO: 4465 - protein, 5 aa, Neisseria
YRHNI

SEQ ID NO: 4466 - protein, 7 aa, Neisseria
IGGERVS

SEQ ID NO: 4467 - protein, 10 aa, Neisseria
GDIKKIRSAK

SEQ ID NO: 4468 - protein, 13 aa, Neisseria
EAADVQRAVKQSK

SEQ ID NO: 4469 - protein, 5 aa, Neisseria
EATKG

SEQ ID NO: 4470 - protein, 28 aa, Neisseria
LKAEEEGGHHHDHDHDHEGHHHDHGEYD

SEQ ID NO: 4471 - protein, 8 aa, Neisseria
LIKADPEG

SEQ ID NO: 4472 - protein, 9 aa, Neisseria
QLKKLHSDA

SEQ ID NO: 4473 - protein, 9 aa, Neisseria
PAAKRKVLT

SEQ ID NO: 4474 - protein, 11 aa, Neisseria
VSSEAEPSAKQ

SEQ ID NO: 4475 - protein, 8 aa, Neisseria
RQIKREGI

SEQ ID NO: 4476 - protein, 18 aa, Neisseria
ENIKDTRMVDRIAKETGV

SEQ ID NO: 4477 - protein, 16 aa, Neisseria
AAGMLMALLAGLVSRF

SEQ ID NO: 4478 - protein, 11 aa, Neisseria
LQLIAAVSSLT

SEQ ID NO: 4479 - protein, 14 aa, Neisseria
LVSGFQALGTLMSV

SEQ ID NO: 4480 - protein, 5 aa, Neisseria
WAKHM

SEQ ID NO: 4481 - protein, 9 aa, Neisseria
SVLTALLCG

SEQ ID NO: 4482 - protein, 5 aa, Neisseria
RRMSL

SEQ ID NO: 4483 - protein, 8 aa, Neisseria
TTLKEDAN

SEQ ID NO: 4484 - protein, 7 aa, Neisseria
SKNGSSV

SEQ ID NO: 4485 - protein, 7 aa, Neisseria
SVGGKGG

SEQ ID NO: 4486 - protein, 5 aa, Neisseria
IPSGP

SEQ ID NO: 4487 - protein, 7 aa, Neisseria
LGKEGGI

SEQ ID NO: 4488 - protein, 6 aa, Neisseria
HRHHTT

SEQ ID NO: 4489 - protein, 5 aa, Neisseria
RRMSL

SEQ ID NO: 4490 - protein, 8 aa, Neisseria
TTLKEDAN

SEQ ID NO: 4491 - protein, 5 aa, Neisseria
KNGSS

SEQ ID NO: 4492 - protein, 7 aa, Neisseria
LGKEGGI

SEQ ID NO: 4493 - protein, 5 aa, Neisseria
HRHHT

SEQ ID NO: 4494 - protein, 15 aa, Neisseria
LIVAFLVLINPFSAL

SEQ ID NO: 4495 - protein, 15 aa, Neisseria
VFAVIAVFALIGGTL

SEQ ID NO: 4496 - protein, 5 aa, Neisseria
RPARN

SEQ ID NO: 4497 - protein, 5 aa, Neisseria
VSRLL

SEQ ID NO: 4498 - protein, 9 aa, Neisseria
TILNRIMGM

SEQ ID NO: 4499 - protein, 14 aa, Neisseria
TNGHSTKERRKVAR

SEQ ID NO: 4500 - protein, 27 aa, Neisseria
NGNDNPAKQNLGAQPETGQARPARNAG

SEQ ID NO: 4501 - protein, 11 aa, Neisseria
HSTKERRKVAR

SEQ ID NO: 4502 - protein, 11 aa, Neisseria
NGNDNPAKQNL

SEQ ID NO: 4503 - protein, 13 aa, Neisseria
AQPETGQARPARN

SEQ ID NO: 4504 - protein, 7 aa, Neisseria
TLASFLP

SEQ ID NO: 4505 - protein, 13 aa, Neisseria
GGNSYSDVPKQLH

SEQ ID NO: 4506 - protein, 7 aa, Neisseria
ADAGKRT

SEQ ID NO: 4507 - protein, 22 aa, Neisseria
WKDGGGNSYSDVPKQLHPDQSQ

SEQ ID NO: 4508 - protein, 65 aa, Neisseria
LRTRQTKPAVKPAQADAGKRTDGAAQENNPDTAEKNRQLEEEKKRIAETERQNKEENCRISKMNL

SEQ ID NO: 4509 - protein, 24 aa, Neisseria
GNSNAKNKDDLIRKYNNAVNKYCR

SEQ ID NO: 4510 - protein, 7 aa, Neisseria
SYSDVPK

SEQ ID NO: 4511 - protein, 7 aa, Neisseria
LHPDQSQ

SEQ ID NO: 4512 - protein, 65 aa, Neisseria; identical to SEQ ID NO: 4508

SEQ ID NO: 4513 - protein, 14 aa, Neisseria
SNAKNKDDLIRKYN

SEQ ID NO: 4514 - protein, 10 aa, Neisseria
EAFAGFFETV

SEQ ID NO: 4515 - protein, 6 aa, Neisseria
TFAARF

SEQ ID NO: 4516 - protein, 6 aa, Neisseria
VDFDVF

SEQ ID NO: 4517 - protein, 12 aa, Neisseria
VVFRLFRQVVVD

SEQ ID NO: 4518 - protein, 9 aa, Neisseria
DTACGNIGG

SEQ ID NO: 4519 - protein, 10 aa, Neisseria
FAAAFTQIHQ

SEQ ID NO: 4520 - protein, 12 aa, Neisseria
FVQFIRNDFGHG

SEQ ID NO: 4521 - protein, 12 aa, Neisseria
FRVFGQFARQFA

SEQ ID NO: 4522 - protein, 11 aa, Neisseria
CFHDGFDVVDK

SEQ ID NO: 4523 - protein, 8 aa, Neisseria
LHQVHQTA

SEQ ID NO: 4524 - protein, 10 aa, Neisseria
GDNQIDRFAQ

SEQ ID NO: 4525 - protein, 7 aa, Neisseria
ADDADGA

SEQ ID NO: 4526 - protein, 19 aa, Neisseria
QSTRAFARFFAAFGQFLQS

SEQ ID NO: 4527 - protein, 9 aa, Neisseria
MPSETRNRF

SEQ ID NO: 4528 - protein, 5 aa, Neisseria
FDGQF

SEQ ID NO: 4529 - protein, 11 aa, Neisseria
HFGKRNRNTRA

SEQ ID NO: 4530 - protein, 6 aa, Neisseria
GAPDAV

SEQ ID NO: 4531 - protein, 21 aa, Neisseria
NVGNGRYVDTACGNIGGNQNF

SEQ ID NO: 4532 - protein, 16 aa, Neisseria
IRNDFGHGFGGRENHA

SEQ ID NO: 4533 - protein, 6 aa, Neisseria
DFDDFR

SEQ ID NO: 4534 - protein, 15 aa, Neisseria
QFADRAVPSGGEQQS

SEQ ID NO: 4535 - protein, 17 aa, Neisseria
VARRCFHDGFDVVDKAH

SEQ ID NO: 4536 - protein, 33 aa, Neisseria
QTARRGDNQIDRFAQGTGLVAERRAADDADGAE

SEQ ID NO: 4537 - protein, 12 aa, Neisseria
FAGRGQHQSTRA

SEQ ID NO: 4538 - protein, 9 aa, Neisseria
MPSETRNRF

SEQ ID NO: 4539 - protein, 9 aa, Neisseria
GKRNRNTRA

SEQ ID NO: 4540 - protein, 7 aa, Neisseria
GGRENHA

SEQ ID NO: 4541 - protein, 14 aa, Neisseria
QFADRAVPSGGEQQ

SEQ ID NO: 4542 - protein, 7 aa, Neisseria
DVVDKAH

SEQ ID NO: 4543 - protein, 14 aa, Neisseria
QTARRGDNQIDRFA

SEQ ID NO: 4544 - protein, 14 aa, Neisseria
VAERRAADDADGAE

SEQ ID NO: 4545 - protein, 5 aa, Neisseria
GQHQS

SEQ ID NO: 4546 - protein, 5 aa, Neisseria
VCFLG

SEQ ID NO: 4547 - protein, 5 aa, Neisseria
QIPSW

SEQ ID NO: 4548 - protein, 8 aa, Neisseria
GTLLDGFD

SEQ ID NO: 4549 - protein, 9 aa, Neisseria
SLPDSIDLP

SEQ ID NO: 4550 - protein, 5 aa, Neisseria
HSTAR

SEQ ID NO: 4551 - protein, 15 aa, Neisseria
HPFAESLDKTLEEVL

SEQ ID NO: 4552 - protein, 5 aa, Neisseria
VPSLP

SEQ ID NO: 4553 - protein, 7 aa, Neisseria
AIPSFSD

SEQ ID NO: 4554 - protein, 5 aa, Neisseria
QVLGG

SEQ ID NO: 4555 - protein, 7 aa, Neisseria
IGKAADI

SEQ ID NO: 4556 - protein, 5 aa, Neisseria
PDTSR

SEQ ID NO: 4557 - protein, 9 aa, Neisseria
GINRELTRW

SEQ ID NO: 4558 - protein, 12 aa, Neisseria
IAELHNFFKPPF

SEQ ID NO: 4559 - protein, 5 aa, Neisseria
ARGYL

SEQ ID NO: 4560 - protein, 7 aa, Neisseria
FGGNMAN

SEQ ID NO: 4561 - protein, 6 aa, Neisseria
RITASL

SEQ ID NO: 4562 - protein, 5 aa, Neisseria
DLGAL

SEQ ID NO: 4563 - protein, 10 aa, Neisseria
QNITGSLNAA

SEQ ID NO: 4564 - protein, 5 aa, Neisseria
GSIAD

SEQ ID NO: 4565 - protein, 4 aa, Neisseria
TAEL

SEQ ID NO: 4566 - protein, 6 aa, Neisseria
VTGMIK

SEQ ID NO: 4567 - protein, 12 aa, Neisseria
SGGSVRGVGTVR

SEQ ID NO: 4568 - protein, 9 aa, Neisseria
TVSFVGPLN

SEQ ID NO: 4569 - protein, 10 aa, Neisseria
AGVEILGSLN

SEQ ID NO: 4570 - protein, 5 aa, Neisseria
LAGQI

SEQ ID NO: 4571 - protein, 19 aa, Neisseria
VKLIYRLTRAIQAVARIGS

SEQ ID NO: 4572 - protein, 32 aa, Neisseria
ISSQNLKGTLLDGFDGDNWSIETEGADLKISR

SEQ ID NO: 4573 - protein, 11 aa, Neisseria
KPSELMRRSLH

SEQ ID NO: 4574 - protein, 19 aa, Neisseria
KPTPPKEERPPLSLPDSID

SEQ ID NO: 4575 - protein, 20 aa, Neisseria
DRFETGKISMGKAFDKQTVY

SEQ ID NO: 4576 - protein, 32 aa, Neisseria
ERLDASYRYDRKGHRLDLKAADTPWSSSSGAA

SEQ ID NO: 4577 - protein, 7 aa, Neisseria
GLKKPFA

SEQ ID NO: 4578 - protein, 10 aa, Neisseria
TKGGLEGKTI

SEQ ID NO: 4579 - protein, 14 aa, Neisseria
STARLSGSLKDVRA

SEQ ID NO: 4580 - protein, 14 aa, Neisseria
LAIDGGNIRLSGKS

SEQ ID NO: 4581 - protein, 8 aa, Neisseria
ESLDKTLE

SEQ ID NO: 4582 - protein, 5 aa, Neisseria
SLPDA

SEQ ID NO: 4583 - protein, 9 aa, Neisseria
GSLDLENTK

SEQ ID NO: 4584 - protein, 10 aa, Neisseria
GFADRNGIPV

SEQ ID NO: 4585 - protein, 7 aa, Neisseria
IRQDGTV

SEQ ID NO: 4586 - protein, 18 aa, Neisseria
GRGGIRLSGKIDTEKDIL

SEQ ID NO: 4587 - protein, 8 aa, Neisseria
SVGAEDVL

SEQ ID NO: 4588 - protein, 10 aa, Neisseria
AFKGRLDGSI

SEQ ID NO: 4589 - protein, 6 aa, Neisseria
TASPKI

SEQ ID NO: 4590 - protein, 8 aa, Neisseria
TARTDGSL

SEQ ID NO: 4591 - protein, 11 aa, Neisseria
SDPANGQRKLV

SEQ ID NO: 4592 - protein, 6 aa, Neisseria
GQGSLT

SEQ ID NO: 4593 - protein, 25 aa, Neisseria
LFKDRLLKLDIRSRAFDPSRIDPQL

SEQ ID NO: 4594 - protein, 10 aa, Neisseria
ELAKEKFTGK

SEQ ID NO: 4595 - protein, 13 aa, Neisseria
IVYESRHLPRAAV

SEQ ID NO: 4596 - protein, 22 aa, Neisseria
LRLGRNIIKTDGGFGKKGDRLN

SEQ ID NO: 4597 - protein, 8 aa, Neisseria
APDLSRFG

SEQ ID NO: 4598 - protein, 25 aa, Neisseria
NVRGHLSGDLDGGIRTFETDLSGAA

SEQ ID NO: 4599 - protein, 7 aa, Neisseria
KAADIRS

SEQ ID NO: 4600 - protein, 25 aa, Neisseria
LKGSPDTSRPIRADIKGSRLSLSGG

SEQ ID NO: 4601 - protein, 12 aa, Neisseria
DTADLMLDGTGV

SEQ ID NO: 4602 - protein, 5 aa, Neisseria
HRIRT

SEQ ID NO: 4603 - protein, 28 aa, Neisseria
TLDGKPFKFDLDASGGINRELTRWKGSI

SEQ ID NO: 4604 - protein, 7 aa, Neisseria
LQNRMTL

SEQ ID NO: 4605 - protein, 7 aa, Neisseria
AGAERVA

SEQ ID NO: 4606 - protein, 14 aa, Neisseria
SWDKKTGISAKGGA

SEQ ID NO: 4607 - protein, 5 aa, Neisseria
LNGDW

SEQ ID NO: 4608 - protein, 7 aa, Neisseria
YGRNARG

SEQ ID NO: 4609 - protein, 10 aa, Neisseria
ISRQSGDAVL

SEQ ID NO: 4610 - protein, 12 aa, Neisseria
SLKTRFQNDRIG

SEQ ID NO: 4611 - protein, 12 aa, Neisseria
LDGGARFGRINA

SEQ ID NO: 4612 - protein, 7 aa, Neisseria
PLGGRIT

SEQ ID NO: 4613 - protein, 8 aa, Neisseria
GRVGSPSV

SEQ ID NO: 4614 - protein, 12 aa, Neisseria
VNGSSNYGKING

SEQ ID NO: 4615 - protein, 17 aa, Neisseria
VGQSRSFDTAPLGGRLN

SEQ ID NO: 4616 - protein, 7 aa, Neisseria
QTVKGSL

SEQ ID NO: 4617 - protein, 9 aa, Neisseria
SIADPHLGG

SEQ ID NO: 4618 - protein, 12 aa, Neisseria
INGDKLYYRNQT

SEQ ID NO: 4619 - protein, 7 aa, Neisseria
LDNGSLR

SEQ ID NO: 4620 - protein, 7 aa, Neisseria
IAGRKWV

SEQ ID NO: 4621 - protein, 13 aa, Neisseria
LKFRHEGTAELSG

SEQ ID NO: 4622 - protein, 12 aa, Neisseria
VGMENSGPDVDI

SEQ ID NO: 4623 - protein, 14 aa, Neisseria
DKYRILSRPNRRLT

SEQ ID NO: 4624 - protein, 13 aa, Neisseria
GNTRLRYSPQKGI

SEQ ID NO: 4625 - protein, 22 aa, Neisseria
IKTDQGLFGSQKSSMPSVGDDV

SEQ ID NO: 4626 - protein, 7 aa, Neisseria
EVKKEAA

SEQ ID NO: 4627 - protein, 7 aa, Neisseria
DLNDGIR

SEQ ID NO: 4628 - protein, 10 aa, Neisseria
QSGGSVRGVG

SEQ ID NO: 4629 - protein, 16 aa, Neisseria
RVIKGRYKAYGQDLDI

SEQ ID NO: 4630 - protein, 4 aa, Neisseria
TKGT

SEQ ID NO: 4631 - protein, 19 aa, Neisseria
PLNDPNLNIRAERRLSPVG

SEQ ID NO: 4632 - protein, 7 aa, Neisseria
SLNSPRI

SEQ ID NO: 4633 - protein, 11 aa, Neisseria
ANEPMSEKDKL

SEQ ID NO: 4634 - protein, 11 aa, Neisseria
AGSGSSGDNAA

SEQ ID NO: 4635 - protein, 9 aa, Neisseria
GQINDRIGL

SEQ ID NO: 4636 - protein, 22 aa, Neisseria
DDLGFTSKRSRNAQTGELNPAE

SEQ ID NO: 4637 - protein, 7 aa, Neisseria
GKQLTGK

SEQ ID NO: 4638 - protein, 7 aa, Neisseria
SSAEQSV

SEQ ID NO: 4639 - protein, 10 aa, Neisseria
IGSRSSGGEL

SEQ ID NO: 4640 - protein, 20 aa, Neisseria
RFDRFSGSDKKDSAGNGKGK

SEQ ID NO: 4641 - protein, 19 aa, Neisseria
FDGDNWSIETEGADLKISR

SEQ ID NO: 4642 - protein, 8 aa, Neisseria
ELMRRSLH

SEQ ID NO: 4643 - protein, 10 aa, Neisseria
PTPPKEERPP

SEQ ID NO: 4644 - protein, 7 aa, Neisseria
DRFETGK

SEQ ID NO: 4645 - protein, 5 aa, Neisseria
KAFDK

SEQ ID NO: 4646 - protein, 5 aa, Neisseria
ERLDA

SEQ ID NO: 4647 - protein, 16 aa, Neisseria
YRYDRKGHRLDLKAAD

SEQ ID NO: 4648 - protein, 8 aa, Neisseria
GGLEGKTI

SEQ ID NO: 4649 - protein, 8 aa, Neisseria
GSLKDVRA

SEQ ID NO: 4650 - protein, 8 aa, Neisseria
ESLDKTLE

SEQ ID NO: 4651 - protein, 9 aa, Neisseria
GSLDLENTK

SEQ ID NO: 4652 - protein, 9 aa, Neisseria
GFADRNGIP

SEQ ID NO: 4653 - protein, 5 aa, Neisseria
IRQDG

SEQ ID NO: 4654 - protein, 12 aa, Neisseria
LSGKIDTEKDIL

SEQ ID NO: 4655 - protein, 6 aa, Neisseria
GAEDVL

SEQ ID NO: 4656 - protein, 7 aa, Neisseria
FKGRLDG

SEQ ID NO: 4657 - protein, 5 aa, Neisseria
ARTDG

SEQ ID NO: 4658 - protein, 10 aa, Neisseria
DPANGQRKLV

SEQ ID NO: 4659 - protein, 23 aa, Neisseria
LFKDRLLKLDIRSRAFDPSRIDP

SEQ ID NO: 4660 - protein, 9 aa, Neisseria
ELAKEKFTG

SEQ ID NO: 4661 - protein, 9 aa, Neisseria
IVYESRHLP

SEQ ID NO: 4662 - protein, 22 aa, Neisseria
LRLGRNIIKTDGGFGKKGDRLN

SEQ ID NO: 4663 - protein, 18 aa, Neisseria
GDLDGGIRTFETDLSGAA

SEQ ID NO: 4664 - protein, 7 aa, Neisseria
KAADIRS

SEQ ID NO: 4665 - protein, 20 aa, Neisseria
GSPDTSRPIRADIKGSRLSL

SEQ ID NO: 4666 - protein, 7 aa, Neisseria
DTADLML

SEQ ID NO: 4667 - protein, 5 aa, Neisseria
HRIRT

SEQ ID NO: 4668 - protein, 12 aa, Neisseria
LDGKPFKFDLDA

SEQ ID NO: 4669 - protein, 12 aa, Neisseria
GGINRELTRWKG

SEQ ID NO: 4670 - protein, 7 aa, Neisseria
AGAERVA

SEQ ID NO: 4671 - protein, 14 aa, Neisseria
SWDKKTGISAKGGA

SEQ ID NO: 4672 - protein, 5 aa, Neisseria
SRQSG

SEQ ID NO: 4673 - protein, 8 aa, Neisseria
TRFQNDRI

SEQ ID NO: 4674 - protein, 10 aa, Neisseria
GGARFGRINA

SEQ ID NO: 4675 - protein, 11 aa, Neisseria
LKFRHEGTAEL

SEQ ID NO: 4676 - protein, 12 aa, Neisseria
VGMENSGPDVDI

SEQ ID NO: 4677 - protein, 14 aa, Neisseria
DKYRILSRPNRRLT

SEQ ID NO: 4678 - protein, 7 aa, Neisseria
TRLRYSP

SEQ ID NO: 4679 - protein, 5 aa, Neisseria
IKTDQ

SEQ ID NO: 4680 - protein, 5 aa, Neisseria
QKSSM

SEQ ID NO: 4681 - protein, 5 aa, Neisseria
SVGDD

SEQ ID NO: 4682 - protein, 7 aa, Neisseria
EVKKEAA

SEQ ID NO: 4683 - protein, 7 aa, Neisseria
DLNDGIR

SEQ ID NO: 4684 - protein, 18 aa, Neisseria
RVIKGRYKAYGQDLDITK

SEQ ID NO: 4685 - protein, 8 aa, Neisseria
IRAERRLS

SEQ ID NO: 4686 - protein, 9 aa, Neisseria
EPMSEKDKL

SEQ ID NO: 4687 - protein, 11 aa, Neisseria
AGSGSSGDNAA

SEQ ID NO: 4688 - protein, 7 aa, Neisseria
INDRIGL

SEQ ID NO: 4689 - protein, 16 aa, Neisseria
GFTSKRSRNAQTGELN

SEQ ID NO: 4690 - protein, 6 aa, Neisseria
SAEQSV

SEQ ID NO: 4691 - protein, 8 aa, Neisseria
IGSRSSGG

SEQ ID NO: 4692 - protein, 20 aa, Neisseria
RFDRFSGSDKKDSAGNGKGK

SEQ ID NO: 4693 - protein, 6 aa, Neisseria
EIKDMV

SEQ ID NO: 4694 - protein, 6 aa, Neisseria
PDNVKT

SEQ ID NO: 4695 - protein, 6 aa, Neisseria
VAILGD

SEQ ID NO: 4696 - protein, 18 aa, Neisseria
LAEYYRNALENWQQPVGS

SEQ ID NO: 4697 - protein, 8 aa, Neisseria
PLAKLGNT

SEQ ID NO: 4698 - protein, 15 aa, Neisseria
TQRYPEQIVSGLARF

SEQ ID NO: 4699 - protein, 8 aa, Neisseria
DYYNLFNK

SEQ ID NO: 4700 - protein, 5 aa, Neisseria
ISQPR

SEQ ID NO: 4701 - protein, 5 aa, Neisseria
TTQNL

SEQ ID NO: 4702 - protein, 9 aa, Neisseria
TASWKRQLL

SEQ ID NO: 4703 - protein, 6 aa, Neisseria
TLGTFL

SEQ ID NO: 4704 - protein, 5 aa, Neisseria
GASSV

SEQ ID NO: 4705 - protein, 15 aa, Neisseria
LSGAVFHDMGDAAAN

SEQ ID NO: 4706 - protein, 6 aa, Neisseria
RWFSPL

SEQ ID NO: 4707 - protein, 8 aa, Neisseria
MHDTRTMM

SEQ ID NO: 4708 - protein, 8 aa, Neisseria
ADLSENKA

SEQ ID NO: 4709 - protein, 19 aa, Neisseria
FKNKSPDTESVKLKPKFPV

SEQ ID NO: 4710 - protein, 15 aa, Neisseria
DTQDSEIKDMVEEHL

SEQ ID NO: 4711 - protein, 12 aa, Neisseria
QQQEEVLDKEQT

SEQ ID NO: 4712 - protein, 31 aa, Neisseria
LAEEAPDNVKTMLRSKGYFSSKVSLTEKDGA

SEQ ID NO: 4713 - protein, 8 aa, Neisseria
TPGPRTKI

SEQ ID NO: 4714 - protein, 19 aa, Neisseria
ILSDGNLAEYYRNALENWQ

SEQ ID NO: 4715 - protein, 17 aa, Neisseria
VGSDFDQDSWENSKTSV

SEQ ID NO: 4716 - protein, 7 aa, Neisseria
VTRKAYP

SEQ ID NO: 4717 - protein, 8 aa, Neisseria
AVNPDTAT

SEQ ID NO: 4718 - protein, 7 aa, Neisseria
DSGRPIA

SEQ ID NO: 4719 - protein, 12 aa, Neisseria
EITGTQRYPEQI

SEQ ID NO: 4720 - protein, 9 aa, Neisseria
FQPGMPYDL

SEQ ID NO: 4721 - protein, 9 aa, Neisseria
LEQNGHYSG

SEQ ID NO: 4722 - protein, 13 aa, Neisseria
ADFDRLQGDRVPV

SEQ ID NO: 4723 - protein, 24 aa, Neisseria
SVTEVKRHKLETGIRLDSEYGLGG

SEQ ID NO: 4724 - protein, 7 aa, Neisseria
DMDKYET

SEQ ID NO: 4725 - protein, 11 aa, Neisseria
SQPRNYRGNYW

SEQ ID NO: 4726 - protein, 20 aa, Neisseria
NVSYNRSTTQNLEKRAFSGG

SEQ ID NO: 4727 - protein, 13 aa, Neisseria
YVRDRAGIDARLG

SEQ ID NO: 4728 - protein, 12 aa, Neisseria
FLAEGRKIPGSA

SEQ ID NO: 4729 - protein, 6 aa, Neisseria
SWKRQL

SEQ ID NO: 4730 - protein, 12 aa, Neisseria
HPENGHYLDGKI

SEQ ID NO: 4731 - protein, 6 aa, Neisseria
TSARAG

SEQ ID NO: 4732 - protein, 8 aa, Neisseria
FTPENKKL

SEQ ID NO: 4733 - protein, 10 aa, Neisseria
VARDNADVPS

SEQ ID NO: 4734 - protein, 16 aa, Neisseria
FRSGGASSVRGYELDS

SEQ ID NO: 4735 - protein, 7 aa, Neisseria
VLPERAL

SEQ ID NO: 4736 - protein, 5 aa, Neisseria
DMGDA

SEQ ID NO: 4737 - protein, 14 aa, Neisseria
ANFKRMKLKHGSGL

SEQ ID NO: 4738 - protein, 9 aa, Neisseria
YGHSDKKIR

SEQ ID NO: 4739 - protein, 8 aa, Neisseria
MHDTRTMM

SEQ ID NO: 4740 - protein, 8 aa, Neisseria
ADLSENKA

SEQ ID NO: 4741 - protein, 16 aa, Neisseria
KNKSPDTESVKLKPKF

SEQ ID NO: 4742 - protein, 15 aa, Neisseria
DTQDSEIKDMVEEHL

SEQ ID NO: 4743 - protein, 11 aa, Neisseria
QQEEVLDKEQT

SEQ ID NO: 4744 - protein, 15 aa, Neisseria
LAEEAPDNVKTMLRS

SEQ ID NO: 4745 - protein, 9 aa, Neisseria
VSLTEKDGA

SEQ ID NO: 4746 - protein, 7 aa, Neisseria
PGPRTKI

SEQ ID NO: 4747 - protein, 13 aa, Neisseria
SDFDQDSWENSKT

SEQ ID NO: 4748 - protein, 7 aa, Neisseria
VTRKAYP

SEQ ID NO: 4749 - protein, 7 aa, Neisseria
VNPDTAT

SEQ ID NO: 4750 - protein, 5 aa, Neisseria
QRYPE

SEQ ID NO: 4751 - protein, 13 aa, Neisseria
ADFDRLQGDRVPV

SEQ ID NO: 4752 - protein, 20 aa, Neisseria
SVTEVKRHKLETGIRLDSEY

SEQ ID NO: 4753 - protein, 7 aa, Neisseria
DMDKYET

SEQ ID NO: 4754 - protein, 12 aa, Neisseria
RSTTQNLEKRAF

SEQ ID NO: 4755 - protein, 12 aa, Neisseria
VRDRAGIDARLG

SEQ ID NO: 4756 - protein, 9 aa, Neisseria
FLAEGRKIP

SEQ ID NO: 4757 - protein, 6 aa, Neisseria
PENKKL

SEQ ID NO: 4758 - protein, 8 aa, Neisseria
VARDNADV

SEQ ID NO: 4759 - protein, 7 aa, Neisseria
RGYELDS

SEQ ID NO: 4760 - protein, 7 aa, Neisseria
VLPERAL

SEQ ID NO: 4761 - protein, 5 aa, Neisseria
DMGDA

SEQ ID NO: 4762 - protein, 10 aa, Neisseria
ANFKRMKLKH

SEQ ID NO: 4763 - protein, 7 aa, Neisseria
HSDKKIR

SEQ ID NO: 4764 - protein, 11 aa, Neisseria
KSADTLSKPAA

SEQ ID NO: 4765 - protein, 5 aa, Neisseria
GSQDM

SEQ ID NO: 4766 - protein, 23 aa, Neisseria
ATDAGESSQPANQPDMANAADGM

SEQ ID NO: 4767 - protein, 14 aa, Neisseria
NAGNTAAQGANQAG

SEQ ID NO: 4768 - protein, 14 aa, Neisseria
FEKLSDADKISNYK

SEQ ID NO: 4769 - protein, 12 aa, Neisseria
PTSFARFRRSAR

SEQ ID NO: 4770 - protein, 9 aa, Neisseria
KSVDGIIDS

SEQ ID NO: 4771 - protein, 7 aa, Neisseria
GFKGTWT

SEQ ID NO: 4772 - protein, 6 aa, Neisseria
VSGKFY

SEQ ID NO: 4773 - protein, 21 aa, Neisseria
CGGGGGGSPDVKSADTLSKPA

SEQ ID NO: 4774 - protein, 31 aa, Neisseria
VSEKETEAKEDAPQAGSQGQGAPSAQGSQDM

SEQ ID NO: 4775 - protein, 49 aa, Neisseria
AVSEENTGNGGAVTADNPKNEDEVAQNDMPQNAAGTDSSTPNHTPDPNM

SEQ ID NO: 4776 - protein, 84 aa, Neisseria
NMENQATDAGESSQPANQPDMANAADGMQGDDPSAGGQNAGNTAAQGANQAGNNQAAGSSDPIPASNPAPANGGSNFGRVDLAN

SEQ ID NO: 4777 - protein, 6 aa, Neisseria
DGPSQN

SEQ ID NO: 4778 - protein, 45 aa, Neisseria
THCKGDSCSGNNFLDEEVQLKSEFEKLSDADKISNYKKDGKNDKF

SEQ ID NO: 4779 - protein, 23 aa, Neisseria
YKPKPTSFARFRRSARSRRSLPA

SEQ ID NO: 4780 - protein, 8 aa, Neisseria
TLIVDGEA

SEQ ID NO: 4781 - protein, 9 aa, Neisseria
APEGNYRYL

SEQ ID NO: 4782 - protein, 10 aa, Neisseria
GAEKLPGGSY

SEQ ID NO: 4783 - protein, 10 aa, Neisseria
VQGEPAKGEM

SEQ ID NO: 4784 - protein, 16 aa, Neisseria
HTENGRPYPTRGRFAA

SEQ ID NO: 4785 - protein, 48 aa, Neisseria
VDFGSKSVDGIIDSGDDLHMGTQKFKAAIDGNGFKGTWTENGSGDVSG

SEQ ID NO: 4786 - protein, 25 aa, Neisseria
FYGPAGEEVAGKYSYRPTDAEKGGF

SEQ ID NO: 4787 - protein, 7 aa, Neisseria
AGKKEQD

SEQ ID NO: 4788 - protein, 17 aa, Neisseria
GGGSPDVKSADTLSKPA

SEQ ID NO: 4789 - protein, 14 aa, Neisseria
VSEKETEAKEDAPQ

SEQ ID NO: 4790 - protein, 6 aa, Neisseria
GSQGQG

SEQ ID NO: 4791 - protein, 5 aa, Neisseria
QGSQD

SEQ ID NO: 4792 - protein, 8 aa, Neisseria
AVSEENTG

SEQ ID NO: 4793 - protein, 19 aa, Neisseria
VTADNPKNEDEVAQNDMPQ

SEQ ID NO: 4794 - protein, 7 aa, Neisseria
AGTDSST

SEQ ID NO: 4795 - protein, 35 aa, Neisseria
MENQATDAGESSQPANQPDMANAADGMQGDDPSAG

SEQ ID NO: 4796 - protein, 8 aa, Neisseria
AGSSDPIP

SEQ ID NO: 4797 - protein, 7 aa, Neisseria
CKGDSCS

SEQ ID NO: 4798 - protein, 33 aa, Neisseria
FLDEEVQLKSEFEKLSDADKISNYKKDGKNDKF

SEQ ID NO: 4799 - protein, 14 aa, Neisseria
ARFRRSARSRRSLP

SEQ ID NO: 4800 - protein, 7 aa, Neisseria
LIVDGEA

SEQ ID NO: 4801 - protein, 6 aa, Neisseria
GAEKLP

SEQ ID NO: 4802 - protein, 10 aa, Neisseria
VQGEPAKGEM

SEQ ID NO: 4803 - protein, 14 aa, Neisseria
ENGRPYPTRGRFAA

SEQ ID NO: 4804 - protein, 19 aa, Neisseria
VDFGSKSVDGIIDSGDDLH

SEQ ID NO: 4805 - protein, 8 aa, Neisseria
QKFKAAID

SEQ ID NO: 4806 - protein, 7 aa, Neisseria
GSGDVSG

SEQ ID NO: 4807 - protein, 7 aa, Neisseria
AGEEVAG

SEQ ID NO: 4808 - protein, 12 aa, Neisseria
YSYRPTDAEKGG

SEQ ID NO: 4809 - protein, 7 aa, Neisseria
AGKKEQD

SEQ ID NO: 4810 - protein, 5 aa, Neisseria
VSRVL

SEQ ID NO: 4811 - protein, 6 aa, Neisseria
IVTKCA

SEQ ID NO: 4812 - protein, 11 aa, Neisseria
RPYRTFSPLPV

SEQ ID NO: 4813 - protein, 5 aa, Neisseria
HSTLR

SEQ ID NO: 4814 - protein, 8 aa, Neisseria
ALFQAGFD

SEQ ID NO: 4815 - protein, 5 aa, Neisseria
HTGQA

SEQ ID NO: 4816 - protein, 9 aa, Neisseria
NLPERSAGS

SEQ ID NO: 4817 - protein, 11 aa, Neisseria
CAVRPYRTFSP

SEQ ID NO: 4818 - protein, 7 aa, Neisseria
LPKQPSA

SEQ ID NO: 4819 - protein, 21 aa, Neisseria
LPRPAVNRHSTLRSPDFPPRM

SEQ ID NO: 4820 - protein, 7 aa, Neisseria
IRGDCLP

SEQ ID NO: 4821 - protein, 22 aa, Neisseria
IITRNTKMPSETVQVSDGIQPK

SEQ ID NO: 4822 - protein, 6 aa, Neisseria
GFDEAV

SEQ ID NO: 4823 - protein, 7 aa, Neisseria
NLPERSA

SEQ ID NO: 4824 - protein, 5 aa, Neisseria
CAVRP

SEQ ID NO: 4825 - protein, 10 aa, Neisseria
STLRSPDFPP

SEQ ID NO: 4826 - protein, 5 aa, Neisseria
IRGDC

SEQ ID NO: 4827 - protein, 15 aa, Neisseria
IITRNTKMPSETVQV

SEQ ID NO: 4828 - protein, 6 aa, Neisseria
GFDEAV

SEQ ID NO: 4829 - protein, 11 aa, Neisseria
KILTPFTVLPL

SEQ ID NO: 4830 - protein, 5 aa, Neisseria
GKSVA

SEQ ID NO: 4831 - protein, 6 aa, Neisseria
VLSVSE

SEQ ID NO: 4832 - protein, 7 aa, Neisseria
PVKGIYE

SEQ ID NO: 4833 - protein, 6 aa, Neisseria
ERAADL

SEQ ID NO: 4834 - protein, 11 aa, Neisseria
PLDKAIKEVRG

SEQ ID NO: 4835 - protein, 16 aa, Neisseria
FCKRLEHEFEKMTDVT

SEQ ID NO: 4836 - protein, 8 aa, Neisseria
KAWTDWMR

SEQ ID NO: 4837 - protein, 6 aa, Neisseria
ICDNPV

SEQ ID NO: 4838 - protein, 5 aa, Neisseria
MKTKL

SEQ ID NO: 4839 - protein, 21 aa, Neisseria
TPVSNANAEPAVKAESAGKSV

SEQ ID NO: 4840 - protein, 15 aa, Neisseria
LKARLEKTYSAQDLK

SEQ ID NO: 4841 - protein, 8 aa, Neisseria
SETPVKGI

SEQ ID NO: 4842 - protein, 8 aa, Neisseria
YTDAEGGY

SEQ ID NO: 4843 - protein, 19 aa, Neisseria
INIDTRKNLTEERAADLNK

SEQ ID NO: 4844 - protein, 17 aa, Neisseria
PLDKAIKEVRGNGKLKV

SEQ ID NO: 4845 - protein, 9 aa, Neisseria
VFSDPDCPF

SEQ ID NO: 4846 - protein, 12 aa, Neisseria
KRLEHEFEKMTD

SEQ ID NO: 4847 - protein, 8 aa, Neisseria
HPDAARKA

SEQ ID NO: 4848 - protein, 8 aa, Neisseria
CQPDRAKA

SEQ ID NO: 4849 - protein, 9 aa, Neisseria
WMRKGKFPV

SEQ ID NO: 4850 - protein, 16 aa, Neisseria
GSICDNPVAETTSLGE

SEQ ID NO: 4851 - protein, 12 aa, Neisseria
FPNGRSQSGYSP

SEQ ID NO: 4852 - protein, 11 aa, Neisseria
PQLEEIIRKNQ

SEQ ID NO: 4853 - protein, 5 aa, Neisseria
MKTKL

SEQ ID NO: 4854 - protein, 16 aa, Neisseria
ANAEPAVKAESAGKSV

SEQ ID NO: 4855 - protein, 10 aa, Neisseria
LKARLEKTYS

SEQ ID NO: 4856 - protein, 19 aa, Neisseria
INIDTRKNLTEERAADLNK

SEQ ID NO: 4857 - protein, 16 aa, Neisseria
PLDKAIKEVRGNGKLK

SEQ ID NO: 4858 - protein, 7 aa, Neisseria
SDPDCPF

SEQ ID NO: 4859 - protein, 12 aa, Neisseria
KRLEHEFEKMTD

SEQ ID NO: 4860 - protein, 6 aa, Neisseria
DAARKA

SEQ ID NO: 4861 - protein, 7 aa, Neisseria
QPDRAKA

SEQ ID NO: 4862 - protein, 7 aa, Neisseria
WMRKGKF

SEQ ID NO: 4863 - protein, 5 aa, Neisseria
GRSQS

SEQ ID NO: 4864 - protein, 11 aa, Neisseria
PQLEEIIRKNQ

SEQ ID NO: 4865 - protein, 11 aa, Neisseria
RFPAAFRRYSA

SEQ ID NO: 4866 - protein, 5 aa, Neisseria
KPADT

SEQ ID NO: 4867 - protein, 24 aa, Neisseria
WHRVRRFKSNRRMRGGKPLKKPYR

SEQ ID NO: 4868 - protein, 30 aa, Neisseria
RAWTALSHNIAERARESPRRCGKRYADIGG

SEQ ID NO: 4869 - protein, 9 aa, Neisseria
YAVAHIVHL

SEQ ID NO: 4870 - protein, 9 aa, Neisseria
VSREARREV

SEQ ID NO: 4871 - protein, 5 aa, Neisseria
AMSYR

SEQ ID NO: 4872 - protein, 12 aa, Neisseria
SILGEPFATSFG

SEQ ID NO: 4873 - protein, 8 aa, Neisseria
AFSVLAHF

SEQ ID NO: 4874 - protein, 11 aa, Neisseria
TVGWSKYIHAV

SEQ ID NO: 4875 - protein, 9 aa, Neisseria
VVRTSSNRF

SEQ ID NO: 4876 - protein, 7 aa, Neisseria
FRRYSAF

SEQ ID NO: 4877 - protein, 43 aa, Neisseria
FPKPADTPWHRVRRFKSNRRMRGGKPLKKPYRPRGGGCRCRRA

SEQ ID NO: 4878 - protein, 37 aa, Neisseria
IAERARESPRRCGKRYADIGGDSDTIRIRVFRLEHRM

SEQ ID NO: 4879 - protein, 18 aa, Neisseria
HTGRVSREARREVEKAMS

SEQ ID NO: 4880 - protein, 5 aa, Neisseria
KMARS

SEQ ID NO: 4881 - protein, 8 aa, Neisseria
VVRTSSNR

SEQ ID NO: 4882 - protein, 36 aa, Neisseria
PWHRVRRFKSNRRMRGGKPLKKPYRPRGGGCRCRRA

SEQ ID NO: 4883 - protein, 27 aa, Neisseria
IAERARESPRRCGKRYADIGGDSDTIR

SEQ ID NO: 4884 - protein, 9 aa, Neisseria
RVFRLEHRM

SEQ ID NO: 4885 - protein, 15 aa, Neisseria
RVSREARREVEKAMS

SEQ ID NO: 4886 - protein, 7 aa, Neisseria
FRQPRRI

SEQ ID NO: 4887 - protein, 8 aa, Neisseria
VQRFFRQP

SEQ ID NO: 4888 - protein, 8 aa, Neisseria
VIRKIAAL

SEQ ID NO: 4889 - protein, 9 aa, Neisseria
HQQRRIGKT

SEQ ID NO: 4890 - protein, 7 aa, Neisseria
ICRGTSG

SEQ ID NO: 4891 - protein, 8 aa, Neisseria
YIIKPLEH

SEQ ID NO: 4892 - protein, 9 aa, Neisseria
MARHDDQQR

SEQ ID NO: 4893 - protein, 6 aa, Neisseria
LPRRQQ

SEQ ID NO: 4894 - protein, 23 aa, Neisseria
AAAHGNRPASDAFFKLPRQRFHL

SEQ ID NO: 4895 - protein, 15 aa, Neisseria
HGCRAQFRQPRRIRL

SEQ ID NO: 4896 - protein, 17 aa, Neisseria
LRQTPRQRSGGRTDQAA

SEQ ID NO: 4897 - protein, 17 aa, Neisseria
FRQPRIRQKQRHTRAPA

SEQ ID NO: 4898 - protein, 6 aa, Neisseria
VGPDFG

SEQ ID NO: 4899 - protein, 7 aa, Neisseria
QNAEHRA

SEQ ID NO: 4900 - protein, 32 aa, Neisseria
RIGKQNLRGFPPRRGHLRHQQRRIGKTPPQLA

SEQ ID NO: 4901 - protein, 24 aa, Neisseria
GGTRFSDRNGVYPNRAGNGIRIRL

SEQ ID NO: 4902 - protein, 8 aa, Neisseria
PICRGTSG

SEQ ID NO: 4903 - protein, 11 aa, Neisseria
PYPYRRKQPQY

SEQ ID NO: 4904 - protein, 7 aa, Neisseria
ISCKTNA

SEQ ID NO: 4905 - protein, 8 aa, Neisseria
FRQRNQIS

SEQ ID NO: 4906 - protein, 8 aa, Neisseria
ARHDDQQR

SEQ ID NO: 4907 - protein, 6 aa, Neisseria
LPRRQQ

SEQ ID NO: 4908 - protein, 10 aa, Neisseria
AAAHGNRPAS

SEQ ID NO: 4909 - protein, 11 aa, Neisseria
AQFRQPRRIRL

SEQ ID NO: 4910 - protein, 15 aa, Neisseria
QTPRQRSGGRTDQAA

SEQ ID NO: 4911 - protein, 11 aa, Neisseria
PRIRQKQRHTR

SEQ ID NO: 4912 - protein, 5 aa, Neisseria
AEHRA

SEQ ID NO: 4913 - protein, 7 aa, Neisseria
RIGKQNL

SEQ ID NO: 4914 - protein, 20 aa, Neisseria
FPPRRGHLRHQQRRIGKTPP

SEQ ID NO: 4915 - protein, 7 aa, Neisseria
RFSDRNG

SEQ ID NO: 4916 - protein, 5 aa, Neisseria
IRIRL

SEQ ID NO: 4917 - protein, 6 aa, Neisseria
PICRGT

SEQ ID NO: 4918 - protein, 7 aa, Neisseria
PYRRKQP

SEQ ID NO: 4919 - protein, 7 aa, Neisseria
FRQRNQI

SEQ ID NO: 4920 - protein, 5 aa, Neisseria
RTERV

SEQ ID NO: 4921 - protein, 11 aa, Neisseria
QPGDSLADVLA

SEQ ID NO: 4922 - protein, 10 aa, Neisseria
DEIARITEKY

SEQ ID NO: 4923 - protein, 5 aa, Neisseria
LPTLR

SEQ ID NO: 4924 - protein, 6 aa, Neisseria
LKEGDA

SEQ ID NO: 4925 - protein, 8 aa, Neisseria
LVYTRISS

SEQ ID NO: 4926 - protein, 16 aa, Neisseria
HANGVETLYAHLSAFS

SEQ ID NO: 4927 - protein, 7 aa, Neisseria
AKHRKYA

SEQ ID NO: 4928 - protein, 26 aa, Neisseria
STERTERVRPQRVEQNLPPLSWGGSG

SEQ ID NO: 4929 - protein, 9 aa, Neisseria
AVQPGDSLA

SEQ ID NO: 4930 - protein, 33 aa, Neisseria
LARSGMARDEIARITEKYGGEADLRHLRADQSV

SEQ ID NO: 4931 - protein, 9 aa, Neisseria
GGDGGAREV

SEQ ID NO: 4932 - protein, 30 aa, Neisseria
TDEDGERNLVALEKKGGIWRRSASEADMKV

SEQ ID NO: 4933 - protein, 21 aa, Neisseria
TSARGSLARAEVPVEIRESLS

SEQ ID NO: 4934 - protein, 12 aa, Neisseria
FSLDGLKEGDAV

SEQ ID NO: 4935 - protein, 9 aa, Neisseria
EVVKGGTRH

SEQ ID NO: 4936 - protein, 29 aa, Neisseria
YYRSDKEGGGGGNYYDEDGKVLQEKGGFN

SEQ ID NO: 4937 - protein, 8 aa, Neisseria
RISSPFGY

SEQ ID NO: 4938 - protein, 7 aa, Neisseria
HTGIDYA

SEQ ID NO: 4939 - protein, 12 aa, Neisseria
PQGTPVRASADG

SEQ ID NO: 4940 - protein, 9 aa, Neisseria
FKGRKGGYG

SEQ ID NO: 4941 - protein, 6 aa, Neisseria
HANGVE

SEQ ID NO: 4942 - protein, 9 aa, Neisseria
AEGNVRGGE

SEQ ID NO: 4943 - protein, 10 aa, Neisseria
STGRSTGPHL

SEQ ID NO: 4944 - protein, 11 aa, Neisseria
YEARINGQPVN

SEQ ID NO: 4945 - protein, 12 aa, Neisseria
PTPELTQADKAA

SEQ ID NO: 4946 - protein, 8 aa, Neisseria
QKQKADAL

SEQ ID NO: 4947 - protein, 5 aa, Neisseria
VSQSD

SEQ ID NO: 4948 - protein, 7 aa, Neisseria
AKHRKYA

SEQ ID NO: 4949 - protein, 16 aa, Neisseria
STERTERVRPQRVEQN

SEQ ID NO: 4950 - protein, 8 aa, Neisseria
VQPGDSLA

SEQ ID NO: 4951 - protein, 27 aa, Neisseria
GMARDEIARITEKYGGEADLRHLRADQ

SEQ ID NO: 4952 - protein, 6 aa, Neisseria
DGGARE

SEQ ID NO: 4953 - protein, 30 aa, Neisseria; identical to SEQ ID NO: 4932

SEQ ID NO: 4954 - protein, 20 aa, Neisseria
TSARGSLARAEVPVEIRESL

SEQ ID NO: 4955 - protein, 12 aa, Neisseria
FSLDGLKEGDAV

SEQ ID NO: 4956 - protein, 8 aa, Neisseria
EVVKGGTR

SEQ ID NO: 4957 - protein, 8 aa, Neisseria
RSDKEGGG

SEQ ID NO: 4958 - protein, 15 aa, Neisseria
YYDEDGKVLQEKGGF

SEQ ID NO: 4959 - protein, 7 aa, Neisseria
TPVRASA

SEQ ID NO: 4960 - protein, 7 aa, Neisseria
KGRKGGY

SEQ ID NO: 4961 - protein, 9 aa, Neisseria
AEGNVRGGE

SEQ ID NO: 4962 - protein, 6 aa, Neisseria
TGRSTG

SEQ ID NO: 4963 - protein, 5 aa, Neisseria
ARING

SEQ ID NO: 4964 - protein, 9 aa, Neisseria
ELTQADKAA

SEQ ID NO: 4965 - protein, 8 aa, Neisseria
QKQKADAL

SEQ ID NO: 4966 - protein, 6 aa, Neisseria
SLFSSI

SEQ ID NO: 4967 - protein, 6 aa, Neisseria
MSALIA

SEQ ID NO: 4968 - protein, 7 aa, Neisseria
INAYWQQ

SEQ ID NO: 4969 - protein, 5 aa, Neisseria
PLAAY

SEQ ID NO: 4970 - protein, 8 aa, Neisseria
LSDGIKAF

SEQ ID NO: 4971 - protein, 8 aa, Neisseria
GSADMPSE

SEQ ID NO: 4972 - protein, 6 aa, Neisseria
LMQGVA

SEQ ID NO: 4973 - protein, 6 aa, Neisseria
VQKSLK

SEQ ID NO: 4974 - protein, 23 aa, Neisseria
SYPSFFDWPKTIEETLQKHPEIS

SEQ ID NO: 4975 - protein, 6 aa, Neisseria
NDPWDF

SEQ ID NO: 4976 - protein, 13 aa, Neisseria
AQEYLKRVDRILE

SEQ ID NO: 4977 - protein, 13 aa, Neisseria
QMRYLDKLLSEHL

SEQ ID NO: 4978 - protein, 5 aa, Neisseria
RYTDS

SEQ ID NO: 4979 - protein, 6 aa, Neisseria
AKIMEK

SEQ ID NO: 4980 - protein, 8 aa, Neisseria
SQNPINAY

SEQ ID NO: 4981 - protein, 9 aa, Neisseria
YHRNSPLEP

SEQ ID NO: 4982 - protein, 11 aa, Neisseria
GWWRSGAALQE

SEQ ID NO: 4983 - protein, 23 aa, Neisseria
LSGETPPTAQDGGSADMPSEAAA

SEQ ID NO: 4984 - protein, 27 aa, Neisseria
EAVPQTGETEWKQDTEAAAVRSGDKVF

SEQ ID NO: 4985 - protein, 20 aa, Neisseria
KSLKQQYGIESVNLSKQSTG

SEQ ID NO: 4986 - protein, 16 aa, Neisseria
FDWPKTIEETLQKHPE

SEQ ID NO: 4987 - protein, 10 aa, Neisseria
GPNDPWDFPV

SEQ ID NO: 4988 - protein, 6 aa, Neisseria
ASDEWA

SEQ ID NO: 4989 - protein, 10 aa, Neisseria
YLKRVDRILE

SEQ ID NO: 4990 - protein, 15 aa, Neisseria
YMKKAKLDGQMRYLD

SEQ ID NO: 4991 - protein, 8 aa, Neisseria
LLSEHLKG

SEQ ID NO: 4992 - protein, 27 aa, Neisseria
LSGGKDRYTDSVNVNGKPVRYRSKDGI

SEQ ID NO: 4993 - protein, 10 aa, Neisseria
PSTQPSSTQP

SEQ ID NO: 4994 - protein, 20 aa, Neisseria
ETPPTAQDGGSADMPSEAAA

SEQ ID NO: 4995 - protein, 24 aa, Neisseria
EAVPQTGETEWKQDTEAAAVRSGD

SEQ ID NO: 4996 - protein, 7 aa, Neisseria
NLSKQST

SEQ ID NO: 4997 - protein, 12 aa, Neisseria
KTIEETLQKHPE

SEQ ID NO: 4998 - protein, 10 aa, Neisseria
YLKRVDRILE

SEQ ID NO: 4999 - protein, 15 aa, Neisseria
YMKKAKLDGQMRYLD

SEQ ID NO: 5000 - protein, 8 aa, Neisseria
LLSEHLKG

SEQ ID NO: 5001 - protein, 9 aa, Neisseria
SGGKDRYTD

SEQ ID NO: 5002 - protein, 16 aa, Neisseria
VNVNGKPVRYRSKDGI

SEQ ID NO: 5003 - protein, 9 aa, Neisseria
STQPSSTQP

SEQ ID NO: 5004 - protein, 15 aa, Neisseria
ASPWMKKLQSVAQGS

SEQ ID NO: 5005 - protein, 8 aa, Neisseria
TFRILQIG

SEQ ID NO: 5006 - protein, 16 aa, Neisseria
DFFTDSLRKRLQKTWG

SEQ ID NO: 5007 - protein, 8 aa, Neisseria
QLTQWSKW

SEQ ID NO: 5008 - protein, 10 aa, Neisseria
ADRMNDLAQT

SEQ ID NO: 5009 - protein, 15 aa, Neisseria
EQKWLDTVRQIRDSL

SEQ ID NO: 5010 - protein, 7 aa, Neisseria
ESLKNTL

SEQ ID NO: 5011 - protein, 15 aa, Neisseria
RLTEVQQMQRRVARQ

SEQ ID NO: 5012 - protein, 6 aa, Neisseria
WQNAMG

SEQ ID NO: 5013 - protein, 23 aa, Neisseria
GYRRAAEMLADSLEELVRSAAIR

SEQ ID NO: 5014 - protein, 5 aa, Neisseria
MNPKH

SEQ ID NO: 5015 - protein, 11 aa, Neisseria
PSAPYTDTNGL

SEQ ID NO: 5016 - protein, 15 aa, Neisseria
DYGNASASPWMKKLQ

SEQ ID NO: 5017 - protein, 7 aa, Neisseria
AQGSGET

SEQ ID NO: 5018 - protein, 26 aa, Neisseria
GDSHTAGDFFTDSLRKRLQKTWGDGG

SEQ ID NO: 5019 - protein, 7 aa, Neisseria
ANVKGQR

SEQ ID NO: 5020 - protein, 20 aa, Neisseria
RHNGNWQSLTSRNNTGDFPL

SEQ ID NO: 5021 - protein, 11 aa, Neisseria
ASDGIASKQRV

SEQ ID NO: 5022 - protein, 10 aa, Neisseria
GNTVSANGGG

SEQ ID NO: 5023 - protein, 6 aa, Neisseria
ENPAGG

SEQ ID NO: 5024 - protein, 18 aa, Neisseria
QWSKWRADRMNDLAQTGA

SEQ ID NO: 5025 - protein, 19 aa, Neisseria
GTNEAFNNNIDIADTEQKW

SEQ ID NO: 5026 - protein, 11 aa, Neisseria
DTVRQIRDSLP

SEQ ID NO: 5027 - protein, 8 aa, Neisseria
APESLKNT

SEQ ID NO: 5028 - protein, 21 aa, Neisseria
RPVRLTEVQQMQRRVARQGQT

SEQ ID NO: 5029 - protein, 8 aa, Neisseria
GWAAKDGV

SEQ ID NO: 5030 - protein, 22 aa, Neisseria
FSAKGYRRAAEMLADSLEELVR

SEQ ID NO: 5031 - protein, 5 aa, Neisseria
AAIRQ

SEQ ID NO: 5032 - protein, 5 aa, Neisseria
GSGET

SEQ ID NO: 5033 - protein, 11 aa, Neisseria
SLRKRLQKTWG

SEQ ID NO: 5034 - protein, 5 aa, Neisseria
VKGQR

SEQ ID NO: 5035 - protein, 7 aa, Neisseria
TSRNNTG

SEQ ID NO: 5036 - protein, 9 aa, Neisseria
DGIASKQRV

SEQ ID NO: 5037 - protein, 8 aa, Neisseria
WRADRMND

SEQ ID NO: 5038 - protein, 9 aa, Neisseria
DIADTEQKW

SEQ ID NO: 5039 - protein, 9 aa, Neisseria
VRQIRDSLP

SEQ ID NO: 5040 - protein, 7 aa, Neisseria
RPVRLTE

SEQ ID NO: 5041 - protein, 11 aa, Neisseria
QQMQRRVARQG

SEQ ID NO: 5042 - protein, 6 aa, Neisseria
AAKDGV

SEQ ID NO: 5043 - protein, 19 aa, Neisseria
KGYRRAAEMLADSLEELVR

SEQ ID NO: 5044 - protein, 5 aa, Neisseria
AAIRQ

SEQ ID NO: 5045 - protein, 18 aa, Neisseria
DGRFLRTVEWLGNMLPHP

SEQ ID NO: 5046 - protein, 30 aa, Neisseria
LNADGFIKILTHTVKNFTGFAPLGTVLVSL

SEQ ID NO: 5047 - protein, 5 aa, Neisseria
SALMR

SEQ ID NO: 5048 - protein, 17 aa, Neisseria
GRHPLAGLAAAFAGVSG

SEQ ID NO: 5049 - protein, 14 aa, Neisseria
GTIDPLLAGITQQA

SEQ ID NO: 5050 - protein, 6 aa, Neisseria
VIALIG

SEQ ID NO: 5051 - protein, 6 aa, Neisseria
RHSNEI

SEQ ID NO: 5052 - protein, 7 aa, Neisseria
LSALLAW

SEQ ID NO: 5053 - protein, 8 aa, Neisseria
ILRHPETG

SEQ ID NO: 5054 - protein, 23 aa, Neisseria
YGRVTRSLRGEQEVVNAMAESMS

SEQ ID NO: 5055 - protein, 14 aa, Neisseria
FVAFFNWTNIGQYI

SEQ ID NO: 5056 - protein, 31 aa, Neisseria
APEVIQAAYRIGDSVTNIITPMMSYFGLIMA

SEQ ID NO: 5057 - protein, 9 aa, Neisseria
IAWIALFCI

SEQ ID NO: 5058 - protein, 16 aa, Neisseria
KEKQMSQTDTQRDGRF

SEQ ID NO: 5059 - protein, 18 aa, Neisseria
SVPDPRPVGAKGRADDGL

SEQ ID NO: 5060 - protein, 6 aa, Neisseria
IAEKSG

SEQ ID NO: 5061 - protein, 9 aa, Neisseria
LTKSPRKLT

SEQ ID NO: 5062 - protein, 7 aa, Neisseria
LSNTASE

SEQ ID NO: 5063 - protein, 6 aa, Neisseria
LGRHPL

SEQ ID NO: 5064 - protein, 33 aa, Neisseria
KIVEPQLGPYQSDLSQEEKDIRHSNEITPLEYK

SEQ ID NO: 5065 - protein, 15 aa, Neisseria
PADGILRHPETGLVS

SEQ ID NO: 5066 - protein, 12 aa, Neisseria
RVTRSLRGEQEV

SEQ ID NO: 5067 - protein, 5 aa, Neisseria
VGLGG

SEQ ID NO: 5068 - protein, 8 aa, Neisseria
KYKKDAGV

SEQ ID NO: 5069 - protein, 16 aa, Neisseria
KEKQMSQTDTQRDGRF

SEQ ID NO: 5070 - protein, 14 aa, Neisseria
PDPRPVGAKGRADD

SEQ ID NO: 5071 - protein, 6 aa, Neisseria
IAEKSG

SEQ ID NO: 5072 - protein, 6 aa, Neisseria
KSPRKL

SEQ ID NO: 5073 - protein, 13 aa, Neisseria
LSQEEKDIRHSNE

SEQ ID NO: 5074 - protein, 7 aa, Neisseria
GILRHPE

SEQ ID NO: 5075 - protein, 12 aa, Neisseria
RVTRSLRGEQEV

SEQ ID NO: 5076 - protein, 7 aa, Neisseria
KYKKDAG

SEQ ID NO: 5077 - protein, 14 aa, Neisseria
LMMGLVEGFTEFLP

SEQ ID NO: 5078 - protein, 6 aa, Neisseria
FGNLIG

SEQ ID NO: 5079 - protein, 6 aa, Neisseria
FSNVLH

SEQ ID NO: 5080 - protein, 5 aa, Neisseria
AAVMG

SEQ ID NO: 5081 - protein, 11 aa, Neisseria
LFGKQIKEYLF

SEQ ID NO: 5082 - protein, 10 aa, Neisseria
DVDALRPIDA

SEQ ID NO: 5083 - protein, 6 aa, Neisseria
VAQVFA

SEQ ID NO: 5084 - protein, 14 aa, Neisseria
AYDVLKHYRFFTLH

SEQ ID NO: 5085 - protein, 9 aa, Neisseria
IGFIAAFVS

SEQ ID NO: 5086 - protein, 6 aa, Neisseria
VKALLR

SEQ ID NO: 5087 - protein, 6 aa, Neisseria
SNHKVF

SEQ ID NO: 5088 - protein, 8 aa, Neisseria
EYRQRFSN

SEQ ID NO: 5089 - protein, 9 aa, Neisseria
GLGKDRKAN

SEQ ID NO: 5090 - protein, 14 aa, Neisseria
VEKRQSRAEPKIAD

SEQ ID NO: 5091 - protein, 7 aa, Neisseria
DALRPID

SEQ ID NO: 5092 - protein, 8 aa, Neisseria
PGTSRSGS

SEQ ID NO: 5093 - protein, 7 aa, Neisseria
IERKTAT

SEQ ID NO: 5094 - protein, 7 aa, Neisseria
FVSKKNY

SEQ ID NO: 5095 - protein, 5 aa, Neisseria
YRQRF

SEQ ID NO: 5096 - protein, 8 aa, Neisseria
LGKDRKAN

SEQ ID NO: 5097 - protein, 14 aa, Neisseria
VEKRQSRAEPKIAD

SEQ ID NO: 5098 - protein, 7 aa, Neisseria
DALRPID

SEQ ID NO: 5099 - protein, 6 aa, Neisseria
TSRSGS

SEQ ID NO: 5100 - protein, 7 aa, Neisseria
IERKTAT

SEQ ID NO: 5101 - protein, 5 aa, Neisseria
VSKKN

SEQ ID NO: 5102 - protein, 8 aa, Neisseria
FYRILGVA

SEQ ID NO: 5103 - protein, 6 aa, Neisseria
NLYPRL

SEQ ID NO: 5104 - protein, 6 aa, Neisseria
TIIAGL

SEQ ID NO: 5105 - protein, 8 aa, Neisseria
ALELLRAQ

SEQ ID NO: 5106 - protein, 8 aa, Neisseria
AEMARASE

SEQ ID NO: 5107 - protein, 14 aa, Neisseria
LADFVHPIGNIGAC

SEQ ID NO: 5108 - protein, 14 aa, Neisseria
SMRTLASVAHGFGD

SEQ ID NO: 5109 - protein, 12 aa, Neisseria
LAHLDNMKRVTE

SEQ ID NO: 5110 - protein, 9 aa, Neisseria
LYPRLSDFC

SEQ ID NO: 5111 - protein, 7 aa, Neisseria
WERRMMV

SEQ ID NO: 5112 - protein, 8 aa, Neisseria
LRAQDVET

SEQ ID NO: 5113 - protein, 19 aa, Neisseria
SKGAEMARASETAYARDEV

SEQ ID NO: 5114 - protein, 8 aa, Neisseria
GTFKTDGM

SEQ ID NO: 5115 - protein, 7 aa, Neisseria
GFGDNLL

SEQ ID NO: 5116 - protein, 13 aa, Neisseria
RAADVVLKERRRL

SEQ ID NO: 5117 - protein, 5 aa, Neisseria
RETPL

SEQ ID NO: 5118 - protein, 10 aa, Neisseria
DNMKRVTEMG

SEQ ID NO: 5119 - protein, 12 aa, Neisseria
MYRKPQTADDIV

SEQ ID NO: 5120 - protein, 8 aa, Neisseria
IDTPDSAE

SEQ ID NO: 5121 - protein, 7 aa, Neisseria
WERRMMV

SEQ ID NO: 5122 - protein, 8 aa, Neisseria
LRAQDVET

SEQ ID NO: 5123 - protein, 10 aa, Neisseria
KGAEMARASE

SEQ ID NO: 5124 - protein, 7 aa, Neisseria
AYARDEV

SEQ ID NO: 5125 - protein, 5 aa, Neisseria
FKTDG

SEQ ID NO: 5126 - protein, 13 aa, Neisseria
RAADVVLKERRRL

SEQ ID NO: 5127 - protein, 8 aa, Neisseria
DNMKRVTE

SEQ ID NO: 5128 - protein, 12 aa, Neisseria
MYRKPQTADDIV

SEQ ID NO: 5129 - protein, 7 aa, Neisseria
DTPDSAE

SEQ ID NO: 5130 - protein, 25 aa, Neisseria
SHWRVLAELADGLPQHVSQLARMAD

SEQ ID NO: 5131 - protein, 17 aa, Neisseria
LNGFWQQMPAHIRGLLR

SEQ ID NO: 5132 - protein, 23 aa, Neisseria
HDGYWRLVRPLAVFDAEGLRELG

SEQ ID NO: 5133 - protein, 10 aa, Neisseria
RQGRKWSHRL

SEQ ID NO: 5134 - protein, 5 aa, Neisseria
RALSR

SEQ ID NO: 5135 - protein, 12 aa, Neisseria
VENAASVQSLFQ

SEQ ID NO: 5136 - protein, 13 aa, Neisseria
FEGTVKGVDGQGV

SEQ ID NO: 5137 - protein, 13 aa, Neisseria
TVGSAPYRDLSPL

SEQ ID NO: 5138 - protein, 9 aa, Neisseria
CAVCGEFKK

SEQ ID NO: 5139 - protein, 18 aa, Neisseria
YRHPEEHGSDRWFNALGS

SEQ ID NO: 5140 - protein, 6 aa, Neisseria
NLNRHA

SEQ ID NO: 5141 - protein, 11 aa, Neisseria
AVASGMMDAVC

SEQ ID NO: 5142 - protein, 10 aa, Neisseria
AAKVAEALPP

SEQ ID NO: 5143 - protein, 6 aa, Neisseria
YGLLNM

SEQ ID NO: 5144 - protein, 9 aa, Neisseria
RMADMKPQQ

SEQ ID NO: 5145 - protein, 9 aa, Neisseria
GLLRQHDGY

SEQ ID NO: 5146 - protein, 12 aa, Neisseria
EGLRELGERSGF

SEQ ID NO: 5147 - protein, 14 aa, Neisseria
LKHECASSNDEILE

SEQ ID NO: 5148 - protein, 9 aa, Neisseria
RIAPDKAHK

SEQ ID NO: 5149 - protein, 20 aa, Neisseria
HLQSKGRGRQGRKWSHRLGE

SEQ ID NO: 5150 - protein, 10 aa, Neisseria
FDRPQYELGS

SEQ ID NO: 5151 - protein, 7 aa, Neisseria
ACRRALS

SEQ ID NO: 5152 - protein, 9 aa, Neisseria
LVVGRDKLG

SEQ ID NO: 5153 - protein, 9 aa, Neisseria
TVRTGGKTV

SEQ ID NO: 5154 - protein, 7 aa, Neisseria
LPKEVEN

SEQ ID NO: 5155 - protein, 9 aa, Neisseria
TASRRGNAD

SEQ ID NO: 5156 - protein, 7 aa, Neisseria
YARDGFA

SEQ ID NO: 5157 - protein, 8 aa, Neisseria
AANRDHGK

SEQ ID NO: 5158 - protein, 8 aa, Neisseria
LRDGETVF

SEQ ID NO: 5159 - protein, 10 aa, Neisseria
GTVKGVDGQG

SEQ ID NO: 5160 - protein, 33 aa, Neisseria
ETAEGKQTVVSGEISLRSDDRPVSVPKRRDSER

SEQ ID NO: 5161 - protein, 7 aa, Neisseria
DGGNSRL

SEQ ID NO: 5162 - protein, 12 aa, Neisseria
GSAPYRDLSPLG

SEQ ID NO: 5163 - protein, 11 aa, Neisseria
WAEKADGNVRI

SEQ ID NO: 5164 - protein, 9 aa, Neisseria
GEFKKAQVQ

SEQ ID NO: 5165 - protein, 7 aa, Neisseria
QLARKIE

SEQ ID NO: 5166 - protein, 14 aa, Neisseria
NHYRHPEEHGSDRW

SEQ ID NO: 5167 - protein, 11 aa, Neisseria
ALGSRRFSRNA

SEQ ID NO: 5168 - protein, 10 aa, Neisseria
ALTDDGHYLG

SEQ ID NO: 5169 - protein, 6 aa, Neisseria
MKESLA

SEQ ID NO: 5170 - protein, 12 aa, Neisseria
ANLNRHAGKRYP

SEQ ID NO: 5171 - protein, 13 aa, Neisseria
GRLKEKTGAGKPV

SEQ ID NO: 5172 - protein, 9 aa, Neisseria
GGGAAKVAE

SEQ ID NO: 5173 - protein, 7 aa, Neisseria
NTVRVAD

SEQ ID NO: 5174 - protein, 8 aa, Neisseria
AEGREYEH

SEQ ID NO: 5175 - protein, 9 aa, Neisseria
RMADMKPQQ

SEQ ID NO: 5176 - protein, 6 aa, Neisseria
GLLRQH

SEQ ID NO: 5177 - protein, 12 aa, Neisseria
EGLRELGERSGF

SEQ ID NO: 5178 - protein, 14 aa, Neisseria
LKHECASSNDEILE

SEQ ID NO: 5179 - protein, 9 aa, Neisseria
RIAPDKAHK

SEQ ID NO: 5180 - protein, 18 aa, Neisseria
QSKGRGRQGRKWSHRLGE

SEQ ID NO: 5181 - protein, 7 aa, Neisseria
ACRRALS

SEQ ID NO: 5182 - protein, 8 aa, Neisseria
VVGRDKLG

SEQ ID NO: 5183 - protein, 7 aa, Neisseria
TVRTGGK

SEQ ID NO: 5184 - protein, 5 aa, Neisseria
KEVEN

SEQ ID NO: 5185 - protein, 8 aa, Neisseria
ASRRGNAD

SEQ ID NO: 5186 - protein, 5 aa, Neisseria
ARDGF

SEQ ID NO: 5187 - protein, 8 aa, Neisseria
AANRDHGK

SEQ ID NO: 5188 - protein, 7 aa, Neisseria
RDGETVF

SEQ ID NO: 5189 - protein, 8 aa, Neisseria
GTVKGVDG

SEQ ID NO: 5190 - protein, 10 aa, Neisseria
ETAEGKQTVV

SEQ ID NO: 5191 - protein, 20 aa, Neisseria
ISLRSDDRPVSVPKRRDSER

SEQ ID NO: 5192 - protein, 5 aa, Neisseria
GNSRL

SEQ ID NO: 5193 - protein, 6 aa, Neisseria
PYRDLS

SEQ ID NO: 5194 - protein, 9 aa, Neisseria
WAEKADGNV

SEQ ID NO: 5195 - protein, 8 aa, Neisseria
GEFKKAQV

SEQ ID NO: 5196 - protein, 7 aa, Neisseria
QLARKIE

SEQ ID NO: 5197 - protein, 11 aa, Neisseria
NHYRHPEEHGS

SEQ ID NO: 5198 - protein, 7 aa, Neisseria
GSRRFSR

SEQ ID NO: 5199 - protein, 7 aa, Neisseria
ALTDDGH

SEQ ID NO: 5200 - protein, 6 aa, Neisseria
MKESLA

SEQ ID NO: 5201 - protein, 11 aa, Neisseria
NLNRHAGKRYP

SEQ ID NO: 5202 - protein, 13 aa, Neisseria
GRLKEKTGAGKPV

SEQ ID NO: 5203 - protein, 7 aa, Neisseria
GAAKVAE

SEQ ID NO: 5204 - protein, 7 aa, Neisseria
NTVRVAD

SEQ ID NO: 5205 - protein, 8 aa, Neisseria
AEGREYEH

SEQ ID NO: 5206 - protein, 11 aa, Neisseria
GEILETVKMVA

SEQ ID NO: 5207 - protein, 5 aa, Neisseria
DCISS

SEQ ID NO: 5208 - protein, 12 aa, Neisseria
QNIYNKITTVGK

SEQ ID NO: 5209 - protein, 8 aa, Neisseria
IAQIAAAT

SEQ ID NO: 5210 - protein, 12 aa, Neisseria
VSVAQTLDKAAK

SEQ ID NO: 5211 - protein, 13 aa, Neisseria
GVSFIGGFSALVQ

SEQ ID NO: 5212 - protein, 9 aa, Neisseria
RSIPEAMKT

SEQ ID NO: 5213 - protein, 8 aa, Neisseria
GETVKRTA

SEQ ID NO: 5214 - protein, 9 aa, Neisseria
GCAKIVVFC

SEQ ID NO: 5215 - protein, 15 aa, Neisseria
SDATTLTEVAEVVKK

SEQ ID NO: 5216 - protein, 14 aa, Neisseria
ITRVGELIGREASK

SEQ ID NO: 5217 - protein, 13 aa, Neisseria
VGDSVARILEEMG

SEQ ID NO: 5218 - protein, 5 aa, Neisseria
LNDAV

SEQ ID NO: 5219 - protein, 8 aa, Neisseria
SAVGGLSG

SEQ ID NO: 5220 - protein, 11 aa, Neisseria
LTLDKLEAMTA

SEQ ID NO: 5221 - protein, 10 aa, Neisseria
TPAHTISGII

SEQ ID NO: 5222 - protein, 12 aa, Neisseria
VGDSVEFGGLLG

SEQ ID NO: 5223 - protein, 7 aa, Neisseria
QSGEILE

SEQ ID NO: 5224 - protein, 10 aa, Neisseria
KMVADQNFDV

SEQ ID NO: 5225 - protein, 5 aa, Neisseria
ISSDI

SEQ ID NO: 5226 - protein, 8 aa, Neisseria
TVGKDLVT

SEQ ID NO: 5227 - protein, 5 aa, Neisseria
THADS

SEQ ID NO: 5228 - protein, 7 aa, Neisseria
TLDKAAK

SEQ ID NO: 5229 - protein, 11 aa, Neisseria
QKGMSPSDEVL

SEQ ID NO: 5230 - protein, 10 aa, Neisseria
SIPEAMKTTD

SEQ ID NO: 5231 - protein, 5 aa, Neisseria
GSTRA

SEQ ID NO: 5232 - protein, 22 aa, Neisseria
DAVKLAGETVKRTAEITPEGFG

SEQ ID NO: 5233 - protein, 7 aa, Neisseria
AVEDNPF

SEQ ID NO: 5234 - protein, 8 aa, Neisseria
HGSGEADA

SEQ ID NO: 5235 - protein, 8 aa, Neisseria
AALENSDA

SEQ ID NO: 5236 - protein, 7 aa, Neisseria
EVAEVVK

SEQ ID NO: 5237 - protein, 12 aa, Neisseria
RVGELIGREASK

SEQ ID NO: 5238 - protein, 11 aa, Neisseria
AVGDSVARILE

SEQ ID NO: 5239 - protein, 8 aa, Neisseria
DAVKKGGM

SEQ ID NO: 5240 - protein, 7 aa, Neisseria
VSEDEGM

SEQ ID NO: 5241 - protein, 5 aa, Neisseria
DKLEA

SEQ ID NO: 5242 - protein, 7 aa, Neisseria
VPGDTPA

SEQ ID NO: 5243 - protein, 6 aa, Neisseria
IADEAA

SEQ ID NO: 5244 - protein, 7 aa, Neisseria
INSKTTA

SEQ ID NO: 5245 - protein, 10 aa, Neisseria
TGKTVGDSVE

SEQ ID NO: 5246 - protein, 7 aa, Neisseria
PVKEGSC

SEQ ID NO: 5247 - protein, 8 aa, Neisseria
FVNRGGRI

SEQ ID NO: 5248 - protein, 5 aa, Neisseria
QSMKN

SEQ ID NO: 5249 - protein, 5 aa, Neisseria
QNFDV

SEQ ID NO: 5250 - protein, 8 aa, Neisseria
TVGKDLVT

SEQ ID NO: 5251 - protein, 7 aa, Neisseria
TLDKAAK

SEQ ID NO: 5252 - protein, 9 aa, Neisseria
GMSPSDEVL

SEQ ID NO: 5253 - protein, 10 aa, Neisseria
SIPEAMKTTD

SEQ ID NO: 5254 - protein, 18 aa, Neisseria
DAVKLAGETVKRTAEITP

SEQ ID NO: 5255 - protein, 6 aa, Neisseria
AVEDNP

SEQ ID NO: 5256 - protein, 5 aa, Neisseria
GEADA

SEQ ID NO: 5257 - protein, 8 aa, Neisseria
AALENSDA

SEQ ID NO: 5258 - protein, 7 aa, Neisseria
EVAEVVK

SEQ ID NO: 5259 - protein, 12 aa, Neisseria
RVGELIGREASK

SEQ ID NO: 5260 - protein, 7 aa, Neisseria
SVARILE

SEQ ID NO: 5261 - protein, 8 aa, Neisseria
DAVKKGGM

SEQ ID NO: 5262 - protein, 7 aa, Neisseria
VSEDEGM

SEQ ID NO: 5263 - protein, 5 aa, Neisseria
DKLEA

SEQ ID NO: 5264 - protein, 6 aa, Neisseria
IADEAA

SEQ ID NO: 5265 - protein, 7 aa, Neisseria
TVGDSVE

SEQ ID NO: 5266 - protein, 7 aa, Neisseria
PVKEGSC

SEQ ID NO: 5267 - protein, 5 aa, Neisseria
RGGRI

SEQ ID NO: 5268 - protein, 5 aa, Neisseria
QSMKN

SEQ ID NO: 5269 - protein, 11 aa, Neisseria
GMDDPRTYGSG

SEQ ID NO: 5270 - protein, 5 aa, Neisseria
ATNVL

SEQ ID NO: 5271 - protein, 5 aa, Neisseria
DAAKG

SEQ ID NO: 5272 - protein, 12 aa, Neisseria
VAVLLARVLQEP

SEQ ID NO: 5273 - protein, 12 aa, Neisseria
VALAALVGHMWP

SEQ ID NO: 5274 - protein, 13 aa, Neisseria
SLAALTATIAAPV

SEQ ID NO: 5275 - protein, 16 aa, Neisseria
YGMDDPRTYGSGNPGA

SEQ ID NO: 5276 - protein, 8 aa, Neisseria
RSGKKKAA

SEQ ID NO: 5277 - protein, 12 aa, Neisseria
VLQEPLGLSDSA

SEQ ID NO: 5278 - protein, 7 aa, Neisseria
FKGGKGV

SEQ ID NO: 5279 - protein, 5 aa, Neisseria
HKSNI

SEQ ID NO: 5280 - protein, 12 aa, Neisseria
LEGRESKIGGSR

SEQ ID NO: 5281 - protein, 10 aa, Neisseria
YGMDDPRTYG

SEQ ID NO: 5282 - protein, 8 aa, Neisseria
RSGKKKAA

SEQ ID NO: 5283 - protein, 6 aa, Neisseria
KGGKGV

SEQ ID NO: 5284 - protein, 5 aa, Neisseria
HKSNI

SEQ ID NO: 5285 - protein, 12 aa, Neisseria
LEGRESKIGGSR

SEQ ID NO: 5286 - protein, 7 aa, Neisseria
VKPYNAL

SEQ ID NO: 5287 - protein, 13 aa, Neisseria
CYNCHSQMIRPFR

SEQ ID NO: 5288 - protein, 12 aa, Neisseria
VGGRYSDEWHRI

SEQ ID NO: 5289 - protein, 9 aa, Neisseria
MKALRKVGT

SEQ ID NO: 5290 - protein, 8 aa, Neisseria
IAKAPEAL

SEQ ID NO: 5291 - protein, 7 aa, Neisseria
QLAEEKI

SEQ ID NO: 5292 - protein, 13 aa, Neisseria
AATQPAPGVKPYN

SEQ ID NO: 5293 - protein, 15 aa, Neisseria
AGRDIYIREGCYNCH

SEQ ID NO: 5294 - protein, 12 aa, Neisseria
RPFRAETERYGH

SEQ ID NO: 5295 - protein, 5 aa, Neisseria
GESVY

SEQ ID NO: 5296 - protein, 24 aa, Neisseria
FQWGSKRTGPDLARVGGRYSDEWH

SEQ ID NO: 5297 - protein, 14 aa, Neisseria
LLNPRDVVPESNMP

SEQ ID NO: 5298 - protein, 7 aa, Neisseria
NKVDVDA

SEQ ID NO: 5299 - protein, 20 aa, Neisseria
KALRKVGTPYSDEEIAKAPE

SEQ ID NO: 5300 - protein, 9 aa, Neisseria
LANKSELDA

SEQ ID NO: 5301 - protein, 7 aa, Neisseria
QLAEEKI

SEQ ID NO: 5302 - protein, 9 aa, Neisseria
FRAETERYG

SEQ ID NO: 5303 - protein, 21 aa, Neisseria
GSKRTGPDLARVGGRYSDEWH

SEQ ID NO: 5304 - protein, 7 aa, Neisseria
NPRDVVP

SEQ ID NO: 5305 - protein, 7 aa, Neisseria
NKVDVDA

SEQ ID NO: 5306 - protein, 7 aa, Neisseria
KALRKVG

SEQ ID NO: 5307 - protein, 11 aa, Neisseria
YSDEEIAKAPE

SEQ ID NO: 5308 - protein, 9 aa, Neisseria
LANKSELDA

SEQ ID NO: 5309 - protein, 5 aa, Neisseria
FLSGL

SEQ ID NO: 5310 - protein, 6 aa, Neisseria
AGIADF

SEQ ID NO: 5311 - protein, 8 aa, Neisseria
TGFSGFVH

SEQ ID NO: 5312 - protein, 6 aa, Neisseria
AVVRGL

SEQ ID NO: 5313 - protein, 5 aa, Neisseria
KSGRQ

SEQ ID NO: 5314 - protein, 6 aa, Neisseria
FANVAG

SEQ ID NO: 5315 - protein, 13 aa, Neisseria
VFQNIADRPDRLI

SEQ ID NO: 5316 - protein, 10 aa, Neisseria
DVFNSVNGIE

SEQ ID NO: 5317 - protein, 5 aa, Neisseria
KSGIR

SEQ ID NO: 5318 - protein, 13 aa, Neisseria
SWARVLSAIPEMQ

SEQ ID NO: 5319 - protein, 8 aa, Neisseria
RKWLRRHP

SEQ ID NO: 5320 - protein, 11 aa, Neisseria
AEFLKQVQSHL

SEQ ID NO: 5321 - protein, 14 aa, Neisseria
HSPHAFATAVHSIP

SEQ ID NO: 5322 - protein, 6 aa, Neisseria
QRLSRL

SEQ ID NO: 5323 - protein, 5 aa, Neisseria
AAQKV

SEQ ID NO: 5324 - protein, 8 aa, Neisseria
VNTKPNTS

SEQ ID NO: 5325 - protein, 9 aa, Neisseria
RICRSRFVD

SEQ ID NO: 5326 - protein, 13 aa, Neisseria
VGTDGNKSGRQVS

SEQ ID NO: 5327 - protein, 14 aa, Neisseria
IADRPDRLIENKHG

SEQ ID NO: 5328 - protein, 9 aa, Neisseria
YHRDGDKVV

SEQ ID NO: 5329 - protein, 8 aa, Neisseria
NSVNGIER

SEQ ID NO: 5330 - protein, 8 aa, Neisseria
SLKSGIRR

SEQ ID NO: 5331 - protein, 6 aa, Neisseria
IADEPQ

SEQ ID NO: 5332 - protein, 26 aa, Neisseria
LQDKRVEIVLDDGRKWLRRHPDEKFD

SEQ ID NO: 5333 - protein, 6 aa, Neisseria
HLTPDG

SEQ ID NO: 5334 - protein, 12 aa, Neisseria
FPNKELLKQRLS

SEQ ID NO: 5335 - protein, 14 aa, Neisseria
WPESGRHVFDSSTV

SEQ ID NO: 5336 - protein, 7 aa, Neisseria
MTEPSAG

SEQ ID NO: 5337 - protein, 7 aa, Neisseria
VITDDNM

SEQ ID NO: 5338 - protein, 9 aa, Neisseria
VEYKYGRGI

SEQ ID NO: 5339 - protein, 11 aa, Neisseria
GTDGNKSGRQV

SEQ ID NO: 5340 - protein, 13 aa, Neisseria
IADRPDRLIENKH

SEQ ID NO: 5341 - protein, 8 aa, Neisseria
HRDGDKVV

SEQ ID NO: 5342 - protein, 6 aa, Neisseria
LKSGIR

SEQ ID NO: 5343 - protein, 6 aa, Neisseria
IADEPQ

SEQ ID NO: 5344 - protein, 26 aa, Neisseria
LQDKRVEIVLDDGRKWLRRHPDEKFD

SEQ ID NO: 5345 - protein, 11 aa, Neisseria
PNKELLKQRLS

SEQ ID NO: 5346 - protein, 7 aa, Neisseria
ESGRHVF

SEQ ID NO: 5347 - protein, 6 aa, Neisseria
TEPSAG

SEQ ID NO: 5348 - protein, 7 aa, Neisseria
VITDDNM

SEQ ID NO: 5349 - protein, 17 aa, Neisseria
VEVLQELFRQYRVARQL

SEQ ID NO: 5350 - protein, 8 aa, Neisseria
VFAAFQAV

SEQ ID NO: 5351 - protein, 8 aa, Neisseria
FQGFDNGF

SEQ ID NO: 5352 - protein, 6 aa, Neisseria
ADAFQG

SEQ ID NO: 5353 - protein, 15 aa, Neisseria
VFEVVGDITRRTTEA

SEQ ID NO: 5354 - protein, 12 aa, Neisseria
DGFTRINRCGQC

SEQ ID NO: 5355 - protein, 8 aa, Neisseria
HAFGDFID

SEQ ID NO: 5356 - protein, 5 aa, Neisseria
LTADA

SEQ ID NO: 5357 - protein, 18 aa, Neisseria
AAGGDGKVQHHFDGRVAF

SEQ ID NO: 5358 - protein, 6 aa, Neisseria
VETEGQ

SEQ ID NO: 5359 - protein, 10 aa, Neisseria
VRADGEAVEV

SEQ ID NO: 5360 - protein, 5 aa, Neisseria
FDNGF

SEQ ID NO: 5361 - protein, 14 aa, Neisseria
QSADERNHDFNVGQ

SEQ ID NO: 5362 - protein, 12 aa, Neisseria
GDITRRTTEAQH

SEQ ID NO: 5363 - protein, 20 aa, Neisseria
GHTDDGFTRINRCGQCRHAF

SEQ ID NO: 5364 - protein, 18 aa, Neisseria
IDVEVDRGRVTGDTAGNF

SEQ ID NO: 5365 - protein, 5 aa, Neisseria
LTADA

SEQ ID NO: 5366 - protein, 6 aa, Neisseria
GGDGKV

SEQ ID NO: 5367 - protein, 6 aa, Neisseria
VETEGQ

SEQ ID NO: 5368 - protein, 10 aa, Neisseria
VRADGEAVEV

SEQ ID NO: 5369 - protein, 9 aa, Neisseria
QSADERNHD

SEQ ID NO: 5370 - protein, 12 aa, Neisseria
GDITRRTTEAQH

SEQ ID NO: 5371 - protein, 12 aa, Neisseria
GHTDDGFTRINR

SEQ ID NO: 5372 - protein, 14 aa, Neisseria
IDVEVDRGRVTGDT

SEQ ID NO: 5373 - protein, 9 aa, Neisseria
NLFQFLAVC

SEQ ID NO: 5374 - protein, 22 aa, Neisseria
GAVDALKQFNNDADGISGSFTQ

SEQ ID NO: 5375 - protein, 8 aa, Neisseria
QVTKSSQD

SEQ ID NO: 5376 - protein, 13 aa, Neisseria
KQFNNDADGISGS

SEQ ID NO: 5377 - protein, 14 aa, Neisseria
TVQSKKKTQTAHGT

SEQ ID NO: 5378 - protein, 7 aa, Neisseria
EYTKPYR

SEQ ID NO: 5379 - protein, 15 aa, Neisseria
QVTKSSQDQAIGGSP

SEQ ID NO: 5380 - protein, 21 aa, Neisseria
LSNKTALESSYTLKEDGSSNG

SEQ ID NO: 5381 - protein, 9 aa, Neisseria
ATPKRNNAG

SEQ ID NO: 5382 - protein, 5 aa, Neisseria
FKGGN

SEQ ID NO: 5383 - protein, 10 aa, Neisseria
QLKDSFGNQT

SEQ ID NO: 5384 - protein, 11 aa, Neisseria
NTNPQLSRGAF

SEQ ID NO: 5385 - protein, 9 aa, Neisseria
FTPPKGVDV

SEQ ID NO: 5386 - protein, 8 aa, Neisseria
FNNDADGI

SEQ ID NO: 5387 - protein, 9 aa, Neisseria
VQSKKKTQT

SEQ ID NO: 5388 - protein, 9 aa, Neisseria
TKSSQDQAI

SEQ ID NO: 5389 - protein, 10 aa, Neisseria
YTLKEDGSSN

SEQ ID NO: 5390 - protein, 7 aa, Neisseria
TPKRNNA

SEQ ID NO: 5391 - protein, 7 aa, Neisseria
QLKDSFG

SEQ ID NO: 5392 - protein, 15 aa, Neisseria
SSTSNFASAAEMRSL

SEQ ID NO: 5393 - protein, 10 aa, Neisseria
SLYREANTWC

SEQ ID NO: 5394 - protein, 26 aa, Neisseria
PANDASGRSSAVAEERTATEMSAPPA

SEQ ID NO: 5395 - protein, 11 aa, Neisseria
SASSCSGKGVS

SEQ ID NO: 5396 - protein, 14 aa, Neisseria
LPTRASSATSSTSN

SEQ ID NO: 5397 - protein, 7 aa, Neisseria
AEMRSLR

SEQ ID NO: 5398 - protein, 7 aa, Neisseria
LCARNAR

SEQ ID NO: 5399 - protein, 5 aa, Neisseria
SLYRE

SEQ ID NO: 5400 - protein, 23 aa, Neisseria
PANDASGRSSAVAEERTATEMSA

SEQ ID NO: 5401 - protein, 7 aa, Neisseria
CSGKGVS

SEQ ID NO: 5402 - protein, 5 aa, Neisseria
TRASS

SEQ ID NO: 5403 - protein, 7 aa, Neisseria
AEMRSLR

SEQ ID NO: 5404 - protein, 16 aa, Neisseria
LTALLKCLSLLPLSCL

SEQ ID NO: 5405 - protein, 5 aa, Neisseria
TLGNR

SEQ ID NO: 5406 - protein, 28 aa, Neisseria
PAFFRKPEDIETMFKAVHGWEHVQQALD

SEQ ID NO: 5407 - protein, 18 aa, Neisseria
AMYKPPKIKAIDKIMQAG

SEQ ID NO: 5408 - protein, 12 aa, Neisseria
IQGVKQIIKALR

SEQ ID NO: 5409 - protein, 10 aa, Neisseria
GVWVDFFGKP

SEQ ID NO: 5410 - protein, 5 aa, Neisseria
GNRLG

SEQ ID NO: 5411 - protein, 8 aa, Neisseria
LKEDRARI

SEQ ID NO: 5412 - protein, 11 aa, Neisseria
AGLNPDPKTVK

SEQ ID NO: 5413 - protein, 7 aa, Neisseria
ETAKGGL

SEQ ID NO: 5414 - protein, 9 aa, Neisseria
FRKPEDIET

SEQ ID NO: 5415 - protein, 6 aa, Neisseria
ALDKHE

SEQ ID NO: 5416 - protein, 9 aa, Neisseria
YDLGGRYIS

SEQ ID NO: 5417 - protein, 14 aa, Neisseria
YKPPKIKAIDKIMQ

SEQ ID NO: 5418 - protein, 13 aa, Neisseria
GRVRGKGKTAPTS

SEQ ID NO: 5419 - protein, 12 aa, Neisseria
QIIKALRSGEAT

SEQ ID NO: 5420 - protein, 13 aa, Neisseria
DHVPSPQEGGEGV

SEQ ID NO: 5421 - protein, 8 aa, Neisseria
ERLPGGQG

SEQ ID NO: 5422 - protein, 12 aa, Neisseria
VQGELNGDKAHD

SEQ ID NO: 5423 - protein, 6 aa, Neisseria
NRYKMP

SEQ ID NO: 5424 - protein, 8 aa, Neisseria
LKEDRARI

SEQ ID NO: 5425 - protein, 9 aa, Neisseria
GLNPDPKTV

SEQ ID NO: 5426 - protein, 7 aa, Neisseria
ETAKGGL

SEQ ID NO: 5427 - protein, 9 aa, Neisseria
FRKPEDIET

SEQ ID NO: 5428 - protein, 6 aa, Neisseria
ALDKHE

SEQ ID NO: 5429 - protein, 13 aa, Neisseria
KPPKIKAIDKIMQ

SEQ ID NO: 5430 - protein, 11 aa, Neisseria
GRVRGKGKTAP

SEQ ID NO: 5431 - protein, 10 aa, Neisseria
QIIKALRSGE

SEQ ID NO: 5432 - protein, 9 aa, Neisseria
VPSPQEGGE

SEQ ID NO: 5433 - protein, 12 aa, Neisseria
VQGELNGDKAHD

SEQ ID NO: 5434 - protein, 12 aa, Neisseria
EVGRVAHCGGGV

SEQ ID NO: 5435 - protein, 11 aa, Neisseria
RVVHQVEQGAR

SEQ ID NO: 5436 - protein, 5 aa, Neisseria
FQRRF

SEQ ID NO: 5437 - protein, 16 aa, Neisseria
ATRTIDGNLAEVYAQT

SEQ ID NO: 5438 - protein, 7 aa, Neisseria
GNEVARC

SEQ ID NO: 5439 - protein, 12 aa, Neisseria
QVKRMIRYFFRV

SEQ ID NO: 5440 - protein, 6 aa, Neisseria
CGGGVA

SEQ ID NO: 5441 - protein, 6 aa, Neisseria
EQGARL

SEQ ID NO: 5442 - protein, 10 aa, Neisseria
VDFQRRFGEV

SEQ ID NO: 5443 - protein, 10 aa, Neisseria
RATRTIDGNL

SEQ ID NO: 5444 - protein, 13 aa, Neisseria
GADTGNEVARCEG

SEQ ID NO: 5445 - protein, 10 aa, Neisseria
PNFGQVKRMI

SEQ ID NO: 5446 - protein, 5 aa, Neisseria
HDLDV

SEQ ID NO: 5447 - protein, 5 aa, Neisseria
RPFRK

SEQ ID NO: 5448 - protein, 6 aa, Neisseria
EQGARL

SEQ ID NO: 5449 - protein, 9 aa, Neisseria
VDFQRRFGE

SEQ ID NO: 5450 - protein, 7 aa, Neisseria
RATRTID

SEQ ID NO: 5451 - protein, 11 aa, Neisseria
DTGNEVARCEG

SEQ ID NO: 5452 - protein, 6 aa, Neisseria
QVKRMI

SEQ ID NO: 5453 - protein, 5 aa, Neisseria
HDLDV

SEQ ID NO: 5454 - protein, 5 aa, Neisseria
RPFRK

SEQ ID NO: 5455 - protein, 6 aa, Neisseria
NAAAAA

SEQ ID NO: 5456 - protein, 12 aa, Neisseria
QGMIQMLGVFVD

SEQ ID NO: 5457 - protein, 5 aa, Neisseria
PYGDL

SEQ ID NO: 5458 - protein, 7 aa, Neisseria
VSQVGQW

SEQ ID NO: 5459 - protein, 6 aa, Neisseria
TAVFRM

SEQ ID NO: 5460 - protein, 6 aa, Neisseria
YFGAVA

SEQ ID NO: 5461 - protein, 14 aa, Neisseria
IMAWINLVAILLLS

SEQ ID NO: 5462 - protein, 6 aa, Neisseria
GSAPNA

SEQ ID NO: 5463 - protein, 7 aa, Neisseria
AEVKHPV

SEQ ID NO: 5464 - protein, 8 aa, Neisseria
QPYGDLSG

SEQ ID NO: 5465 - protein, 7 aa, Neisseria
AYAESNV

SEQ ID NO: 5466 - protein, 32 aa, Neisseria
RDYTAKLKMGKDPEFKLSEHPGLKRRIKSDVW

SEQ ID NO: 5467 - protein, 5 aa, Neisseria
AEVKH

SEQ ID NO: 5468 - protein, 13 aa, Neisseria
LKMGKDPEFKLSE

SEQ ID NO: 5469 - protein, 9 aa, Neisseria
PGLKRRIKS

SEQ ID NO: 5470 - protein, 17 aa, Neisseria
RAAGVARGLHTEFARAV

SEQ ID NO: 5471 - protein, 19 aa, Neisseria
DVRFFAQVEEIGQDFFADA

SEQ ID NO: 5472 - protein, 12 aa, Neisseria
AGECADEVSDKT

SEQ ID NO: 5473 - protein, 16 aa, Neisseria
ESAQSAAGGGLTDGFG

SEQ ID NO: 5474 - protein, 7 aa, Neisseria
CGKTVGV

SEQ ID NO: 5475 - protein, 5 aa, Neisseria
GVFDA

SEQ ID NO: 5476 - protein, 5 aa, Neisseria
FGGVA

SEQ ID NO: 5477 - protein, 15 aa, Neisseria
DGGFDGVLQGFFGEV

SEQ ID NO: 5478 - protein, 8 aa, Neisseria
VTAEEIAF

SEQ ID NO: 5479 - protein, 8 aa, Neisseria
HEARCGGN

SEQ ID NO: 5480 - protein, 9 aa, Neisseria
IAAAERAGD

SEQ ID NO: 5481 - protein, 5 aa, Neisseria
EEIGQ

SEQ ID NO: 5482 - protein, 6 aa, Neisseria
AVDQET

SEQ ID NO: 5483 - protein, 42 aa, Neisseria
LAVERAAGECADEVSDKTARNGGIEEDGVAACRDAAAAESAQ

SEQ ID NO: 5484 - protein, 8 aa, Neisseria
AGGGLTDG

SEQ ID NO: 5485 - protein, 8 aa, Neisseria
GGNDAAGN

SEQ ID NO: 5486 - protein, 5 aa, Neisseria
LHRRA

SEQ ID NO: 5487 - protein, 6 aa, Neisseria
ADGGFR

SEQ ID NO: 5488 - protein, 9 aa, Neisseria
HQTGIGKSG

SEQ ID NO: 5489 - protein, 9 aa, Neisseria
GDVDGGFDG

SEQ ID NO: 5490 - protein, 6 aa, Neisseria
VGSTGA

SEQ ID NO: 5491 - protein, 7 aa, Neisseria
DVNGNVQ

SEQ ID NO: 5492 - protein, 8 aa, Neisseria
VTAEEIAF

SEQ ID NO: 5493 - protein, 6 aa, Neisseria
HEARCG

SEQ ID NO: 5494 - protein, 9 aa, Neisseria
IAAAERAGD

SEQ ID NO: 5495 - protein, 6 aa, Neisseria
AVDQET

SEQ ID NO: 5496 - protein, 42 aa, Neisseria; identical to SEQ ID NO: 5483

SEQ ID NO: 5497 - protein, 5 aa, Neisseria
NDAAG

SEQ ID NO: 5498 - protein, 5 aa, Neisseria
LHRRA

SEQ ID NO: 5499 - protein, 6 aa, Neisseria
GIGKSG

SEQ ID NO: 5500 - protein, 7 aa, Neisseria
GDVDGGF

SEQ ID NO: 5501 - protein, 5 aa, Neisseria
GFKSF

SEQ ID NO: 5502 - protein, 15 aa, Neisseria
VVERLGRFHRALTAG

SEQ ID NO: 5503 - protein, 14 aa, Neisseria
MAITQLAQTTLRSV

SEQ ID NO: 5504 - protein, 6 aa, Neisseria
ALDEAA

SEQ ID NO: 5505 - protein, 8 aa, Neisseria
EILRSMQA

SEQ ID NO: 5506 - protein, 5 aa, Neisseria
KIEQI

SEQ ID NO: 5507 - protein, 10 aa, Neisseria
SNAEKIARIN

SEQ ID NO: 5508 - protein, 8 aa, Neisseria
AIRQIAAA

SEQ ID NO: 5509 - protein, 11 aa, Neisseria
QYVAAFNNLAK

SEQ ID NO: 5510 - protein, 23 aa, Neisseria
ANVADIGSLISAGMKIIDSSKTA

SEQ ID NO: 5511 - protein, 8 aa, Neisseria
ERLGRFHR

SEQ ID NO: 5512 - protein, 13 aa, Neisseria
HSLKEIPLDVPSQ

SEQ ID NO: 5513 - protein, 11 aa, Neisseria
CITRDNTQLTV

SEQ ID NO: 5514 - protein, 7 aa, Neisseria
TDPKLAS

SEQ ID NO: 5515 - protein, 14 aa, Neisseria
MELDKTFEERDEIN

SEQ ID NO: 5516 - protein, 7 aa, Neisseria
ALDEAAG

SEQ ID NO: 5517 - protein, 10 aa, Neisseria
LRYEIKDLVP

SEQ ID NO: 5518 - protein, 21 aa, Neisseria
ITAEREKRARIAESEGRKIEQ

SEQ ID NO: 5519 - protein, 20 aa, Neisseria
NLASGQREAEIQQSEGEAQA

SEQ ID NO: 5520 - protein, 23 aa, Neisseria
NASNAEKIARINRAKGEAESLRL

SEQ ID NO: 5521 - protein, 7 aa, Neisseria
ANAEAIR

SEQ ID NO: 5522 - protein, 10 aa, Neisseria
QTQGGADAVN

SEQ ID NO: 5523 - protein, 7 aa, Neisseria
LAKESNT

SEQ ID NO: 5524 - protein, 13 aa, Neisseria
AGMKIIDSSKTAK

SEQ ID NO: 5525 - protein, 8 aa, Neisseria
ERLGRFHR

SEQ ID NO: 5526 - protein, 8 aa, Neisseria
HSLKEIPL

SEQ ID NO: 5527 - protein, 6 aa, Neisseria
ITRDNT

SEQ ID NO: 5528 - protein, 5 aa, Neisseria
TDPKL

SEQ ID NO: 5529 - protein, 14 aa, Neisseria
MELDKTFEERDEIN

SEQ ID NO: 5530 - protein, 6 aa, Neisseria
ALDEAA

SEQ ID NO: 5531 - protein, 10 aa, Neisseria
LRYEIKDLVP

SEQ ID NO: 5532 - protein, 21 aa, Neisseria
ITAEREKRARIAESEGRKIEQ

SEQ ID NO: 5533 - protein, 17 aa, Neisseria
SGQREAEIQQSEGEAQA

SEQ ID NO: 5534 - protein, 21 aa, Neisseria
SNAEKIARINRAKGEAESLRL

SEQ ID NO: 5535 - protein, 7 aa, Neisseria
ANAEAIR

SEQ ID NO: 5536 - protein, 6 aa, Neisseria
LAKESN

SEQ ID NO: 5537 - protein, 10 aa, Neisseria
KIIDSSKTAK

SEQ ID NO: 5538 - protein, 16 aa, Neisseria
LTKAADGQVCRAFSSL

SEQ ID NO: 5539 - protein, 7 aa, Neisseria
KPSRRAL

SEQ ID NO: 5540 - protein, 8 aa, Neisseria
ASGKISLP

SEQ ID NO: 5541 - protein, 29 aa, Neisseria
PPNNSTTTSTSSRATSSNGSLTKAADGQV

SEQ ID NO: 5542 - protein, 30 aa, Neisseria
SSLKSHTAEIRISRPKRREISSALSRNTAA

SEQ ID NO: 5543 - protein, 10 aa, Neisseria
PTVPKPKRPM

SEQ ID NO: 5544 - protein, 8 aa, Neisseria
SPCKPTEM

SEQ ID NO: 5545 - protein, 7 aa, Neisseria
KPSRRAL

SEQ ID NO: 5546 - protein, 8 aa, Neisseria
TSSRATSS

SEQ ID NO: 5547 - protein, 7 aa, Neisseria
SLTKAAD

SEQ ID NO: 5548 - protein, 18 aa, Neisseria
KSHTAEIRISRPKRREIS

SEQ ID NO: 5549 - protein, 6 aa, Neisseria
LSRNTA

SEQ ID NO: 5550 - protein, 9 aa, Neisseria
TVPKPKRPM

SEQ ID NO: 5551 - protein, 6 aa, Neisseria
CKPTEM

SEQ ID NO: 5552 - protein, 7 aa, Neisseria
TKPSKSC

SEQ ID NO: 5553 - protein, 5 aa, Neisseria
LPPIG

SEQ ID NO: 5554 - protein, 10 aa, Neisseria
QTPEPVSSPS

SEQ ID NO: 5555 - protein, 5 aa, Neisseria
GGQVV

SEQ ID NO: 5556 - protein, 9 aa, Neisseria
VKTVSKPAK

SEQ ID NO: 5557 - protein, 9 aa, Neisseria
QARLAKGGN

SEQ ID NO: 5558 - protein, 97 aa, Neisseria
VYTTKPSKSCHSTDLPPIGNYSSERYIPPQTPEPVSSPSNGGQVVKYKAPVKTVSKPAKSNTPPPQQAPSNNSRRSILETELSNERKALVEAQKMLS

SEQ ID NO: 5559 - protein, 9 aa, Neisseria
RLAKGGNIN

SEQ ID NO: 5560 - protein, 9 aa, Neisseria
SNVLDRQQN

SEQ ID NO: 5561 - protein, 7 aa, Neisseria
LQRELGR

SEQ ID NO: 5562 - protein, 7 aa, Neisseria
KPSKSCH

SEQ ID NO: 5563 - protein, 6 aa, Neisseria
SSERYI

SEQ ID NO: 5564 - protein, 7 aa, Neisseria
QTPEPVS

SEQ ID NO: 5565 - protein, 7 aa, Neisseria
VKYKAPV

SEQ ID NO: 5566 - protein, 12 aa, Neisseria
TVSKPAKSNTPP

SEQ ID NO: 5567 - protein, 31 aa, Neisseria
QAPSNNSRRSILETELSNERKALVEAQKMLS

SEQ ID NO: 5568 - protein, 7 aa, Neisseria
VLDRQQN

SEQ ID NO: 5569 - protein, 7 aa, Neisseria
LQRELGR

SEQ ID NO: 5570 - protein, 14 aa, Neisseria
WVILALLALTALLS

SEQ ID NO: 5571 - protein, 8 aa, Neisseria
KIVESCVK

SEQ ID NO: 5572 - protein, 32 aa, Neisseria
MWEQPLDRLSEKQIRSFGKLGAQEQLDLLGGA

SEQ ID NO: 5573 - protein, 26 aa, Neisseria
MTEPKHEMLTKEQVAARKKAKAKIRT

SEQ ID NO: 5574 - protein, 17 aa, Neisseria
AMSKPQAKQKIVESCVK

SEQ ID NO: 5575 - protein, 19 aa, Neisseria
KWQNDLRARGLDSNNTRLA

SEQ ID NO: 5576 - protein, 19 aa, Neisseria
QPLDRLSEKQIRSFGKLGA

SEQ ID NO: 5577 - protein, 17 aa, Neisseria
NAFEARDKQCVADLKSE

SEQ ID NO: 5578 - protein, 26 aa, Neisseria
MTEPKHEMLTKEQVAARKKAKAKIRT

SEQ ID NO: 5579 - protein, 16 aa, Neisseria
AMSKPQAKQKIVESCV

SEQ ID NO: 5580 - protein, 16 aa, Neisseria
KWQNDLRARGLDSNNT

SEQ ID NO: 5581 - protein, 14 aa, Neisseria
PLDRLSEKQIRSFG

SEQ ID NO: 5582 - protein, 15 aa, Neisseria
FEARDKQCVADLKSE

SEQ ID NO: 5583 - protein, 11 aa, Neisseria
EFAEFVNSHPQ

SEQ ID NO: 5584 - protein, 7 aa, Neisseria
KHWMKNG

SEQ ID NO: 5585 - protein, 10 aa, Neisseria
RLPTIDEWEF

SEQ ID NO: 5586 - protein, 6 aa, Neisseria
TILDWY

SEQ ID NO: 5587 - protein, 8 aa, Neisseria
RKGLHDVG

SEQ ID NO: 5588 - protein, 5 aa, Neisseria
WGVYD

SEQ ID NO: 5589 - protein, 5 aa, Neisseria
WEWTE

SEQ ID NO: 5590 - protein, 21 aa, Neisseria
VQIEGGSYRPLYLKKDTGLIK

SEQ ID NO: 5591 - protein, 11 aa, Neisseria
KPFKLDKYPVT

SEQ ID NO: 5592 - protein, 15 aa, Neisseria
HPQWQKGRIGSKQAE

SEQ ID NO: 5593 - protein, 19 aa, Neisseria
WMKNGSRSYAPKAGELKQP

SEQ ID NO: 5594 - protein, 12 aa, Neisseria
QGKRLPTIDEWE

SEQ ID NO: 5595 - protein, 15 aa, Neisseria
ATQKNGSNEPGYNRT

SEQ ID NO: 5596 - protein, 19 aa, Neisseria
YADGGRKGLHDVGKGRPNY

SEQ ID NO: 5597 - protein, 15 aa, Neisseria
WTEDFNSSLLSSGNA

SEQ ID NO: 5598 - protein, 11 aa, Neisseria
ASIGSSDSSNY

SEQ ID NO: 5599 - protein, 6 aa, Neisseria
SLQSKY

SEQ ID NO: 5600 - protein, 10 aa, Neisseria
YLKKDTGLIK

SEQ ID NO: 5601 - protein, 9 aa, Neisseria
KPFKLDKYP

SEQ ID NO: 5602 - protein, 11 aa, Neisseria
QKGRIGSKQAE

SEQ ID NO: 5603 - protein, 15 aa, Neisseria
NGSRSYAPKAGELKQ

SEQ ID NO: 5604 - protein, 7 aa, Neisseria
QGKRLPT

SEQ ID NO: 5605 - protein, 12 aa, Neisseria
ATQKNGSNEPGY

SEQ ID NO: 5606 - protein, 14 aa, Neisseria
GGRKGLHDVGKGRP

SEQ ID NO: 5607 - protein, 7 aa, Neisseria
GSSDSSN

SEQ ID NO: 5608 - protein, 6 aa, Neisseria
FFQPVQ

SEQ ID NO: 5609 - protein, 14 aa, Neisseria
SDAAELVELFALFP

SEQ ID NO: 5610 - protein, 17 aa, Neisseria
GKGIERQVDNIADVYGF

SEQ ID NO: 5611 - protein, 7 aa, Neisseria
GGSDAAE

SEQ ID NO: 5612 - protein, 7 aa, Neisseria
QKPRLGC

SEQ ID NO: 5613 - protein, 14 aa, Neisseria
FIGKGIERQVDNIA

SEQ ID NO: 5614 - protein, 24 aa, Neisseria
LLRKGTGLEKTCRPKPFVQPHGGR

SEQ ID NO: 5615 - protein, 6 aa, Neisseria
GSDAAE

SEQ ID NO: 5616 - protein, 7 aa, Neisseria
QKPRLGC

SEQ ID NO: 5617 - protein, 10 aa, Neisseria
GIERQVDNIA

SEQ ID NO: 5618 - protein, 16 aa, Neisseria
LLRKGTGLEKTCRPKP

SEQ ID NO: 5619 - protein, 11 aa, Neisseria
KYTAMAALLAF

SEQ ID NO: 5620 - protein, 23 aa, Neisseria
RLAGWYECSSLTGWCKPRKPAAI

SEQ ID NO: 5621 - protein, 5 aa, Neisseria
NRSVR

SEQ ID NO: 5622 - protein, 7 aa, Neisseria
YRKIGKF

SEQ ID NO: 5623 - protein, 7 aa, Neisseria
PLIETFK

SEQ ID NO: 5624 - protein, 5 aa, Neisseria
MEIRA

SEQ ID NO: 5625 - protein, 16 aa, Neisseria
ECSSLTGWCKPRKPAA

SEQ ID NO: 5626 - protein, 35 aa, Neisseria
DIGGESPPSLGDYEIPLSDGNRSVRANEYESAQQS

SEQ ID NO: 5627 - protein, 20 aa, Neisseria
KIGKFEACGLDWRTRDGKPL

SEQ ID NO: 5628 - protein, 26 aa, Neisseria
TFKQGGFDCLEKQGLRRNGLSERVRW

SEQ ID NO: 5629 - protein, 5 aa, Neisseria
MEIRA

SEQ ID NO: 5630 - protein, 8 aa, Neisseria
CKPRKPAA

SEQ ID NO: 5631 - protein, 7 aa, Neisseria
GGESPPS

SEQ ID NO: 5632 - protein, 7 aa, Neisseria
GDYEIPL

SEQ ID NO: 5633 - protein, 15 aa, Neisseria
DGNRSVRANEYESAQ

SEQ ID NO: 5634 - protein, 8 aa, Neisseria
KIGKFEAC

SEQ ID NO: 5635 - protein, 9 aa, Neisseria
WRTRDGKPL

SEQ ID NO: 5636 - protein, 19 aa, Neisseria
DCLEKQGLRRNGLSERVRW

SEQ ID NO: 5637 - protein, 10 aa, Neisseria
LALIGLAACS

SEQ ID NO: 5638 - protein, 5 aa, Neisseria
SHRLI

SEQ ID NO: 5639 - protein, 12 aa, Neisseria
NPDQGNLYRLPA

SEQ ID NO: 5640 - protein, 16 aa, Neisseria
QQPADAEVLKSVKGVR

SEQ ID NO: 5641 - protein, 9 aa, Neisseria
QDSLRRLFD

SEQ ID NO: 5642 - protein, 5 aa, Neisseria
AMKEV

SEQ ID NO: 5643 - protein, 10 aa, Neisseria
AFLTRFMQYL

SEQ ID NO: 5644 - protein, 5 aa, Neisseria
ANEMA

SEQ ID NO: 5645 - protein, 8 aa, Neisseria
GRNWRRTV

SEQ ID NO: 5646 - protein, 22 aa, Neisseria
CSGSKTEQPKLDYQSRSHRLIK

SEQ ID NO: 5647 - protein, 15 aa, Neisseria
EVPPDLNNPDQGNLY

SEQ ID NO: 5648 - protein, 19 aa, Neisseria
AGSGAVRASDLEKRRTPAV

SEQ ID NO: 5649 - protein, 22 aa, Neisseria
QPADAEVLKSVKGVRLERDGSQ

SEQ ID NO: 5650 - protein, 9 aa, Neisseria
VVDGKSPAE

SEQ ID NO: 5651 - protein, 13 aa, Neisseria
QENGFDIKSEEPA

SEQ ID NO: 5652 - protein, 22 aa, Neisseria
METEWAENRAKIPQDSLRRLFD

SEQ ID NO: 5653 - protein, 20 aa, Neisseria
STGERDKFIVRIEQGKNGVS

SEQ ID NO: 5654 - protein, 15 aa, Neisseria
KAMKEVYGGKDKDTT

SEQ ID NO: 5655 - protein, 9 aa, Neisseria
QPSPSDPNL

SEQ ID NO: 5656 - protein, 17 aa, Neisseria
GVDGQQAENASAKKPTL

SEQ ID NO: 5657 - protein, 10 aa, Neisseria
NEMARIEGKS

SEQ ID NO: 5658 - protein, 10 aa, Neisseria
DYGRNWRRTV

SEQ ID NO: 5659 - protein, 8 aa, Neisseria
GQNTERHA

SEQ ID NO: 5660 - protein, 17 aa, Neisseria
QKAPNESNAVTEQKPGL

SEQ ID NO: 5661 - protein, 15 aa, Neisseria
LLGKGKAEKPAEQPE

SEQ ID NO: 5662 - protein, 6 aa, Neisseria
VANGSR

SEQ ID NO: 5663 - protein, 15 aa, Neisseria
LLNKDGSAYAGKDAS

SEQ ID NO: 5664 - protein, 6 aa, Neisseria
LHSELR

SEQ ID NO: 5665 - protein, 21 aa, Neisseria
SGSKTEQPKLDYQSRSHRLIK

SEQ ID NO: 5666 - protein, 11 aa, Neisseria
EVPPDLNNPDQ

SEQ ID NO: 5667 - protein, 15 aa, Neisseria
GAVRASDLEKRRTPA

SEQ ID NO: 5668 - protein, 22 aa, Neisseria
QPADAEVLKSVKGVRLERDGSQ

SEQ ID NO: 5669 - protein, 6 aa, Neisseria
DGKSPA

SEQ ID NO: 5670 - protein, 11 aa, Neisseria
NGFDIKSEEPA

SEQ ID NO: 5671 - protein, 22 aa, Neisseria
METEWAENRAKIPQDSLRRLFD

SEQ ID NO: 5672 - protein, 9 aa, Neisseria
TGERDKFIV

SEQ ID NO: 5673 - protein, 8 aa, Neisseria
IEQGKNGV

SEQ ID NO: 5674 - protein, 15 aa, Neisseria
KAMKEVYGGKDKDTT

SEQ ID NO: 5675 - protein, 7 aa, Neisseria
SPSDPNL

SEQ ID NO: 5676 - protein, 14 aa, Neisseria
DGQQAENASAKKPT

SEQ ID NO: 5677 - protein, 10 aa, Neisseria
NEMARIEGKS

SEQ ID NO: 5678 - protein, 6 aa, Neisseria
YGRNWR

SEQ ID NO: 5679 - protein, 5 aa, Neisseria
NTERH

SEQ ID NO: 5680 - protein, 15 aa, Neisseria
APNESNAVTEQKPGL

SEQ ID NO: 5681 - protein, 15 aa, Neisseria
LLGKGKAEKPAEQPE

SEQ ID NO: 5682 - protein, 5 aa, Neisseria
NKDGS

SEQ ID NO: 5683 - protein, 6 aa, Neisseria
AGKDAS

SEQ ID NO: 5684 - protein, 6 aa, Neisseria
LHSELR

SEQ ID NO: 5685 - protein, 16 aa, Neisseria
SLAGILADYVAGIWGT

SEQ ID NO: 5686 - protein, 16 aa, Neisseria
GSIIGIFFSLPGLILG

SEQ ID NO: 5687 - protein, 6 aa, Neisseria
IGAAAG

SEQ ID NO: 5688 - protein, 6 aa, Neisseria
LLGLVV

SEQ ID NO: 5689 - protein, 11 aa, Neisseria
TKYTGAGKLAV

SEQ ID NO: 5690 - protein, 8 aa, Neisseria
ELIERRNM

SEQ ID NO: 5691 - protein, 8 aa, Neisseria
ELIERRNM

SEQ ID NO: 5692 - protein, 5 aa, Neisseria
GKGAD

SEQ ID NO: 5693 - protein, 18 aa, Neisseria
ALLSAVTHLLAIFVPMIT

SEQ ID NO: 5694 - protein, 9 aa, Neisseria
YLQVNRFGP

SEQ ID NO: 5695 - protein, 5 aa, Neisseria
STLLG

SEQ ID NO: 5696 - protein, 7 aa, Neisseria
KVITPTV

SEQ ID NO: 5697 - protein, 9 aa, Neisseria
TFGSMENLG

SEQ ID NO: 5698 - protein, 5 aa, Neisseria
CMKNP

SEQ ID NO: 5699 - protein, 6 aa, Neisseria
GYIVAL

SEQ ID NO: 5700 - protein, 8 aa, Neisseria
FSALQNLP

SEQ ID NO: 5701 - protein, 12 aa, Neisseria
LSVFEAVGDLTA

SEQ ID NO: 5702 - protein, 8 aa, Neisseria
TKRLRGGV

SEQ ID NO: 5703 - protein, 12 aa, Neisseria
DGLVSVIATALG

SEQ ID NO: 5704 - protein, 8 aa, Neisseria
ASRHVGKY

SEQ ID NO: 5705 - protein, 10 aa, Neisseria
RAFTTIPSPV

SEQ ID NO: 5706 - protein, 12 aa, Neisseria
MSGQLGKGADAP

SEQ ID NO: 5707 - protein, 9 aa, Neisseria
LEDRPPFGN

SEQ ID NO: 5708 - protein, 5 aa, Neisseria
NRFGP

SEQ ID NO: 5709 - protein, 13 aa, Neisseria
AGMKEGGLTKDAM

SEQ ID NO: 5710 - protein, 11 aa, Neisseria
FGAKADGTFGS

SEQ ID NO: 5711 - protein, 7 aa, Neisseria
MKNPLLR

SEQ ID NO: 5712 - protein, 20 aa, Neisseria
VSDQPIEGEEYTKRLRGGVL

SEQ ID NO: 5713 - protein, 11 aa, Neisseria
VSHGIRRREAV

SEQ ID NO: 5714 - protein, 19 aa, Neisseria
LPEDKTEAAVKFDTDHLEH

SEQ ID NO: 5715 - protein, 9 aa, Neisseria
QLGKGADAP

SEQ ID NO: 5716 - protein, 7 aa, Neisseria
LEDRPPF

SEQ ID NO: 5717 - protein, 12 aa, Neisseria
GMKEGGLTKDAM

SEQ ID NO: 5718 - protein, 5 aa, Neisseria
AKADG

SEQ ID NO: 5719 - protein, 14 aa, Neisseria
QPIEGEEYTKRLRG

SEQ ID NO: 5720 - protein, 8 aa, Neisseria
GIRRREAV

SEQ ID NO: 5721 - protein, 19 aa, Neisseria
LPEDKTEAAVKFDTDHLEH

SEQ ID NO: 5722 - protein, 15 aa, Neisseria
QIRDGGDALHYLNRI

SEQ ID NO: 5723 - protein, 5 aa, Neisseria
HGEHH

SEQ ID NO: 5724 - protein, 9 aa, Neisseria
GYLYNGVHE

SEQ ID NO: 5725 - protein, 11 aa, Neisseria
RQVDGLMSAIY

SEQ ID NO: 5726 - protein, 6 aa, Neisseria
RFERHC

SEQ ID NO: 5727 - protein, 11 aa, Neisseria
PEAGRKYYRNA

SEQ ID NO: 5728 - protein, 9 aa, Neisseria
RPVRVLTAG

SEQ ID NO: 5729 - protein, 14 aa, Neisseria
YTAVFDYVRNGRRA

SEQ ID NO: 5730 - protein, 9 aa, Neisseria
TQNQSLPAG

SEQ ID NO: 5731 - protein, 14 aa, Neisseria
VYPSAPQIRDGGDA

SEQ ID NO: 5732 - protein, 8 aa, Neisseria
NSARRHAS

SEQ ID NO: 5733 - protein, 16 aa, Neisseria
LNPEDGHGEHHPDNPH

SEQ ID NO: 5734 - protein, 9 aa, Neisseria
QKLTERTRL

SEQ ID NO: 5735 - protein, 29 aa, Neisseria
VHENISTEEEAAESSDSDIRTQQRQVDGL

SEQ ID NO: 5736 - protein, 11 aa, Neisseria
SLLDRHTDEAG

SEQ ID NO: 5737 - protein, 8 aa, Neisseria
FVRENGKT

SEQ ID NO: 5738 - protein, 31 aa, Neisseria
QGNGRFERHCAQGRNQPEAGRKYYRNACHNG

SEQ ID NO: 5739 - protein, 7 aa, Neisseria
YTDEAMP

SEQ ID NO: 5740 - protein, 20 aa, Neisseria
FHGERPDPVPEYEITGNPAS

SEQ ID NO: 5741 - protein, 7 aa, Neisseria
DFSEAAG

SEQ ID NO: 5742 - protein, 5 aa, Neisseria
ITMKS

SEQ ID NO: 5743 - protein, 9 aa, Neisseria
YQGKNEIRP

SEQ ID NO: 5744 - protein, 11 aa, Neisseria
TAGNDPNGRLT

SEQ ID NO: 5745 - protein, 11 aa, Neisseria
DYVRNGRRAQA

SEQ ID NO: 5746 - protein, 10 aa, Neisseria
FRTRKPDYPY

SEQ ID NO: 5747 - protein, 15 aa, Neisseria
EVNGGETLAVRKGEK

SEQ ID NO: 5748 - protein, 7 aa, Neisseria
WRGRWCL

SEQ ID NO: 5749 - protein, 20 aa, Neisseria
YTYRQRPGSRLSIGRHEAGG

SEQ ID NO: 5750 - protein, 6 aa, Neisseria
DGMAGS

SEQ ID NO: 5751 - protein, 12 aa, Neisseria
ITLAPEGETERG

SEQ ID NO: 5752 - protein, 8 aa, Neisseria
PQIRDGGD

SEQ ID NO: 5753 - protein, 7 aa, Neisseria
NSARRHA

SEQ ID NO: 5754 - protein, 12 aa, Neisseria
NPEDGHGEHHPD

SEQ ID NO: 5755 - protein, 8 aa, Neisseria
KLTERTRL

SEQ ID NO: 5756 - protein, 23 aa, Neisseria
ISTEEEAAESSDSDIRTQQRQVD

SEQ ID NO: 5757 - protein, 11 aa, Neisseria
SLLDRHTDEAG

SEQ ID NO: 5758 - protein, 7 aa, Neisseria
FVRENGK

SEQ ID NO: 5759 - protein, 24 aa, Neisseria
GNGRFERHCAQGRNQPEAGRKYYR

SEQ ID NO: 5760 - protein, 10 aa, Neisseria
HGERPDPVPE

SEQ ID NO: 5761 - protein, 7 aa, Neisseria
DFSEAAG

SEQ ID NO: 5762 - protein, 5 aa, Neisseria
ITMKS

SEQ ID NO: 5763 - protein, 8 aa, Neisseria
QGKNEIRP

SEQ ID NO: 5764 - protein, 7 aa, Neisseria
GNDPNGR

SEQ ID NO: 5765 - protein, 8 aa, Neisseria
RNGRRAQA

SEQ ID NO: 5766 - protein, 7 aa, Neisseria
FRTRKPD

SEQ ID NO: 5767 - protein, 8 aa, Neisseria
LAVRKGEK

SEQ ID NO: 5768 - protein, 8 aa, Neisseria
TYRQRPGS

SEQ ID NO: 5769 - protein, 7 aa, Neisseria
SIGRHEA

SEQ ID NO: 5770 - protein, 8 aa, Neisseria
PEGETERG

SEQ ID NO: 5771 - protein, 14 aa, Neisseria
TALAEAVELVKAAG

SEQ ID NO: 5772 - protein, 10 aa, Neisseria
KAAELSEAVA

SEQ ID NO: 5773 - protein, 17 aa, Neisseria
QLSHLAGRLIRGYGHLQ

SEQ ID NO: 5774 - protein, 9 aa, Neisseria
INALKKQLA

SEQ ID NO: 5775 - protein, 14 aa, Neisseria
SGTIKTFALVGYTN

SEQ ID NO: 5776 - protein, 6 aa, Neisseria
FNRLTK

SEQ ID NO: 5777 - protein, 19 aa, Neisseria
GFVSDLPHKLISAFSATLE

SEQ ID NO: 5778 - protein, 17 aa, Neisseria
NSGQQIEDVENVLQEIH

SEQ ID NO: 5779 - protein, 17 aa, Neisseria
ENTGIDALREAIAESCA

SEQ ID NO: 5780 - protein, 17 aa, Neisseria
MTGRTGGNGSTQAQPER

SEQ ID NO: 5781 - protein, 13 aa, Neisseria
MLDKDGTGSSAAR

SEQ ID NO: 5782 - protein, 5 aa, Neisseria
VELVK

SEQ ID NO: 5783 - protein, 18 aa, Neisseria
AGGDSVRVETAKRDRPHT

SEQ ID NO: 5784 - protein, 9 aa, Neisseria
TGKAAELSE

SEQ ID NO: 5785 - protein, 20 aa, Neisseria
ELTPTQERNLEKELKCRVLD

SEQ ID NO: 5786 - protein, 13 aa, Neisseria
ARRARTQEGRLQV

SEQ ID NO: 5787 - protein, 24 aa, Neisseria
QSQRGGIGMKGPGETKLETDRRLI

SEQ ID NO: 5788 - protein, 28 aa, Neisseria
NALKKQLANLKKQRALRRKSRESGTIKT

SEQ ID NO: 5789 - protein, 7 aa, Neisseria
NVGKSSL

SEQ ID NO: 5790 - protein, 9 aa, Neisseria
RLTKSGIYA

SEQ ID NO: 5791 - protein, 6 aa, Neisseria
YISPEC

SEQ ID NO: 5792 - protein, 7 aa, Neisseria
TLEETAQ

SEQ ID NO: 5793 - protein, 16 aa, Neisseria
AAPNSGQQIEDVENVL

SEQ ID NO: 5794 - protein, 6 aa, Neisseria
HAGDIP

SEQ ID NO: 5795 - protein, 16 aa, Neisseria
YNKTDLLPSEEQNTGI

SEQ ID NO: 5796 - protein, 13 aa, Neisseria
ENTGIDALREAIA

SEQ ID NO: 5797 - protein, 13 aa, Neisseria
CAAAPNTDETEMP

SEQ ID NO: 5798 - protein, 7 aa, Neisseria
MTGRTGG

SEQ ID NO: 5799 - protein, 5 aa, Neisseria
AQPER

SEQ ID NO: 5800 - protein, 7 aa, Neisseria
LDKDGTG

SEQ ID NO: 5801 - protein, 5 aa, Neisseria
VELVK

SEQ ID NO: 5802 - protein, 17 aa, Neisseria
AGGDSVRVETAKRDRPH

SEQ ID NO: 5803 - protein, 8 aa, Neisseria
GKAAELSE

SEQ ID NO: 5804 - protein, 19 aa, Neisseria
LTPTQERNLEKELKCRVLD

SEQ ID NO: 5805 - protein, 13 aa, Neisseria
ARRARTQEGRLQV

SEQ ID NO: 5806 - protein, 7 aa, Neisseria
QSQRGGI

SEQ ID NO: 5807 - protein, 14 aa, Neisseria
GPGETKLETDRRLI

SEQ ID NO: 5808 - protein, 25 aa, Neisseria
NALKKQLANLKKQRALRRKSRESGT

SEQ ID NO: 5809 - protein, 7 aa, Neisseria
TLEETAQ

SEQ ID NO: 5810 - protein, 10 aa, Neisseria
QQIEDVENVL

SEQ ID NO: 5811 - protein, 9 aa, Neisseria
DLLPSEEQN

SEQ ID NO: 5812 - protein, 8 aa, Neisseria
DALREAIA

SEQ ID NO: 5813 - protein, 9 aa, Neisseria
PNTDETEMP

SEQ ID NO: 5814 - protein, 8 aa, Neisseria
RQREHHRL

SEQ ID NO: 5815 - protein, 24 aa, Neisseria
LVGGFDFLRVIGCGGVAYLPDFQQ

SEQ ID NO: 5816 - protein, 8 aa, Neisseria
MEDLQEIG

SEQ ID NO: 5817 - protein, 23 aa, Neisseria
KVGRQREHHRLHHPQPGNGEADD

SEQ ID NO: 5818 - protein, 11 aa, Neisseria
PDFQQNVGKAD

SEQ ID NO: 5819 - protein, 7 aa, Neisseria
VPDDAAA

SEQ ID NO: 5820 - protein, 10 aa, Neisseria
IEVDADDAVC

SEQ ID NO: 5821 - protein, 16 aa, Neisseria
LFDQPDAGGAGDAAEH

SEQ ID NO: 5822 - protein, 8 aa, Neisseria
MEDLQEIG

SEQ ID NO: 5823 - protein, 10 aa, Neisseria
KVGRQREHHR

SEQ ID NO: 5824 - protein, 7 aa, Neisseria
GNGEADD

SEQ ID NO: 5825 - protein, 5 aa, Neisseria
VGKAD

SEQ ID NO: 5826 - protein, 6 aa, Neisseria
PDDAAA

SEQ ID NO: 5827 - protein, 10 aa, Neisseria
IEVDADDAVC

SEQ ID NO: 5828 - protein, 16 aa, Neisseria
LFDQPDAGGAGDAAEH

SEQ ID NO: 5829 - protein, 7 aa, Neisseria
RIRRCSV

SEQ ID NO: 5830 - protein, 12 aa, Neisseria
MPKWSRIRRCSV

SEQ ID NO: 5831 - protein, 11 aa, Neisseria
VRLKSSDGIAS

SEQ ID NO: 5832 - protein, 31 aa, Neisseria
GPMPSETVSHKSDSSRNTSASRRNVSPKCPF

SEQ ID NO: 5833 - protein, 14 aa, Neisseria
FRQDAAKPRRFGGK

SEQ ID NO: 5834 - protein, 5 aa, Neisseria
LTGSR

SEQ ID NO: 5835 - protein, 7 aa, Neisseria
SRIRRCS

SEQ ID NO: 5836 - protein, 10 aa, Neisseria
VRLKSSDGIA

SEQ ID NO: 5837 - protein, 25 aa, Neisseria
MPSETVSHKSDSSRNTSASRRNVSP

SEQ ID NO: 5838 - protein, 13 aa, Neisseria
FRQDAAKPRRFGG

SEQ ID NO: 5839 - protein, 6 aa, Neisseria
ALIGIL

SEQ ID NO: 5840 - protein, 20 aa, Neisseria
FWFPSCPGCVSEMPKIIKTA

SEQ ID NO: 5841 - protein, 17 aa, Neisseria
LAVAQPIDPIESVRQYV

SEQ ID NO: 5842 - protein, 7 aa, Neisseria
KAVGQAF

SEQ ID NO: 5843 - protein, 5 aa, Neisseria
MKKIL

SEQ ID NO: 5844 - protein, 8 aa, Neisseria
IPDSKTAP

SEQ ID NO: 5845 - protein, 14 aa, Neisseria
DLHGKTVSNADLQG

SEQ ID NO: 5846 - protein, 5 aa, Neisseria
SCPGC

SEQ ID NO: 5847 - protein, 17 aa, Neisseria
EMPKIIKTANDYKNKNF

SEQ ID NO: 5848 - protein, 16 aa, Neisseria
PIDPIESVRQYVKDYG

SEQ ID NO: 5849 - protein, 6 aa, Neisseria
DADKAV

SEQ ID NO: 5850 - protein, 8 aa, Neisseria
IGKKGEIL

SEQ ID NO: 5851 - protein, 23 aa, Neisseria
VGEPDFGKLYQEIDTAWRNSDAV

SEQ ID NO: 5852 - protein, 5 aa, Neisseria
MKKIL

SEQ ID NO: 5853 - protein, 5 aa, Neisseria
PDSKT

SEQ ID NO: 5854 - protein, 16 aa, Neisseria
EMPKIIKTANDYKNKN

SEQ ID NO: 5855 - protein, 11 aa, Neisseria
DPIESVRQYVK

SEQ ID NO: 5856 - protein, 6 aa, Neisseria
DADKAV

SEQ ID NO: 5857 - protein, 7 aa, Neisseria
IGKKGEI

SEQ ID NO: 5858 - protein, 11 aa, Neisseria
IDTAWRNSDAV

SEQ ID NO: 5859 - protein, 17 aa, Neisseria
FNKTVASFAQIVETFDV

SEQ ID NO: 5860 - protein, 5 aa, Neisseria
NRSFK

SEQ ID NO: 5861 - protein, 7 aa, Neisseria
LHIFTNI

SEQ ID NO: 5862 - protein, 8 aa, Neisseria
ELLTILVK

SEQ ID NO: 5863 - protein, 9 aa, Neisseria
VDNGFNKTV

SEQ ID NO: 5864 - protein, 7 aa, Neisseria
QMKQRCG

SEQ ID NO: 5865 - protein, 15 aa, Neisseria
FPRCGFEIPNRSFKE

SEQ ID NO: 5866 - protein, 13 aa, Neisseria
LSERFRTNAEVEM

SEQ ID NO: 5867 - protein, 10 aa, Neisseria
NLSPNGKKRF

SEQ ID NO: 5868 - protein, 5 aa, Neisseria
MKQRC

SEQ ID NO: 5869 - protein, 8 aa, Neisseria
IPNRSFKE

SEQ ID NO: 5870 - protein, 13 aa, Neisseria
LSERFRTNAEVEM

SEQ ID NO: 5871 - protein, 9 aa, Neisseria
LSPNGKKRF

SEQ ID NO: 5872 - protein, 9 aa, Neisseria
VLAALAACK

SEQ ID NO: 5873 - protein, 9 aa, Neisseria
SAAENAAKP

SEQ ID NO: 5874 - protein, 10 aa, Neisseria
FTHCPDVCPT

SEQ ID NO: 5875 - protein, 11 aa, Neisseria
YSDTLKQLGGQ

SEQ ID NO: 5876 - protein, 8 aa, Neisseria
EIIGKYAK

SEQ ID NO: 5877 - protein, 9 aa, Neisseria
CKPQDNSAA

SEQ ID NO: 5878 - protein, 36 aa, Neisseria
SAAENAAKPQTRGTDMRKEDIGGDFTLTDGEGKPFN

SEQ ID NO: 5879 - protein, 5 aa, Neisseria
SDLKG

SEQ ID NO: 5880 - protein, 7 aa, Neisseria
HCPDVCP

SEQ ID NO: 5881 - protein, 15 aa, Neisseria
SDTLKQLGGQAKDVK

SEQ ID NO: 5882 - protein, 22 aa, Neisseria
IDPERDTPEIIGKYAKQFNPDF

SEQ ID NO: 5883 - protein, 5 aa, Neisseria
ATGGQ

SEQ ID NO: 5884 - protein, 12 aa, Neisseria
KVNQKDDSENYL

SEQ ID NO: 5885 - protein, 7 aa, Neisseria
LIDKNGE

SEQ ID NO: 5886 - protein, 14 aa, Neisseria
SPYGSEPETIAADV

SEQ ID NO: 5887 - protein, 7 aa, Neisseria
KPQDNSA

SEQ ID NO: 5888 - protein, 23 aa, Neisseria
SAAENAAKPQTRGTDMRKEDIGG

SEQ ID NO: 5889 - protein, 9 aa, Neisseria
TLTDGEGKP

SEQ ID NO: 5890 - protein, 5 aa, Neisseria
SDLKG

SEQ ID NO: 5891 - protein, 8 aa, Neisseria
GGQAKDVK

SEQ ID NO: 5892 - protein, 11 aa, Neisseria
IDPERDTPEII

SEQ ID NO: 5893 - protein, 12 aa, Neisseria
KVNQKDDSENYL

SEQ ID NO: 5894 - protein, 5 aa, Neisseria
DKNGE

SEQ ID NO: 5895 - protein, 11 aa, Neisseria
GSEPETIAADV

SEQ ID NO: 5896 - protein, 9 aa, Neisseria
VLAALAACK

SEQ ID NO: 5897 - protein, 9 aa, Neisseria
SAAENAAKP

SEQ ID NO: 5898 - protein, 10 aa, Neisseria
FTHCPDVCPT

SEQ ID NO: 5899 - protein, 11 aa, Neisseria
YSDTLKQLGGQ

SEQ ID NO: 5900 - protein, 8 aa, Neisseria
EIIGKYAK

SEQ ID NO: 5901 - protein, 9 aa, Neisseria
CKPQDNSAA

SEQ ID NO: 5902 - protein, 36 aa, Neisseria; identical to SEQ ID NO: 5878

SEQ ID NO: 5903 - protein, 5 aa, Neisseria
SDLKG

SEQ ID NO: 5904 - protein, 7 aa, Neisseria
HCPDVCP

SEQ ID NO: 5905 - protein, 15 aa, Neisseria
SDTLKQLGGQAKDVK

SEQ ID NO: 5906 - protein, 22 aa, Neisseria
IDPERDTPEIIGKYAKQFNPDF

SEQ ID NO: 5907 - protein, 5 aa, Neisseria
ATGGQ

SEQ ID NO: 5908 - protein, 12 aa, Neisseria
KVNQKDDSENYL

SEQ ID NO: 5909 - protein, 7 aa, Neisseria
LIDKNGE

SEQ ID NO: 5910 - protein, 14 aa, Neisseria
SPYGSEPETIAADV

SEQ ID NO: 5911 - protein, 7 aa, Neisseria
KPQDNSA

SEQ ID NO: 5912 - protein, 23 aa, Neisseria
SAAENAAKPQTRGTDMRKEDIGG

SEQ ID NO: 5913 - protein, 9 aa, Neisseria
TLTDGEGKP

SEQ ID NO: 5914 - protein, 5 aa, Neisseria
SDLKG

SEQ ID NO: 5915 - protein, 8 aa, Neisseria
GGQAKDVK

SEQ ID NO: 5916 - protein, 11 aa, Neisseria
IDPERDTPEII

SEQ ID NO: 5917 - protein, 12 aa, Neisseria
KVNQKDDSENYL

SEQ ID NO: 5918 - protein, 5 aa, Neisseria
DKNGE

SEQ ID NO: 5919 - protein, 11 aa, Neisseria
GSEPETIAADV

SEQ ID NO: 5920 - protein, 8 aa, Neisseria
CTNAFAAP

SEQ ID NO: 5921 - protein, 9 aa, Neisseria
ASLARWLDT

SEQ ID NO: 5922 - protein, 27 aa, Neisseria
DRDIEKNMIEGFNAGFKPYADKALAEM

SEQ ID NO: 5923 - protein, 12 aa, Neisseria
AAEAFNRYRENV

SEQ ID NO: 5924 - protein, 8 aa, Neisseria
DLITPEVK

SEQ ID NO: 5925 - protein, 6 aa, Neisseria
IDGMIA

SEQ ID NO: 5926 - protein, 8 aa, Neisseria
IKKSMSEI

SEQ ID NO: 5927 - protein, 18 aa, Neisseria
SGKIAQHHLPEFTEELRR

SEQ ID NO: 5928 - protein, 7 aa, Neisseria
PPSDASL

SEQ ID NO: 5929 - protein, 15 aa, Neisseria
LDTQNFDRDIEKNMI

SEQ ID NO: 5930 - protein, 19 aa, Neisseria
PYADKALAEMPEAKKDQAA

SEQ ID NO: 5931 - protein, 10 aa, Neisseria
AFNRYRENVL

SEQ ID NO: 5932 - protein, 10 aa, Neisseria
LITPEVKQAV

SEQ ID NO: 5933 - protein, 14 aa, Neisseria
KNAREIYTQEEIDG

SEQ ID NO: 5934 - protein, 14 aa, Neisseria
VVAKNPRLIKKSMS

SEQ ID NO: 5935 - protein, 5 aa, Neisseria
LSGKI

SEQ ID NO: 5936 - protein, 8 aa, Neisseria
EFTEELRR

SEQ ID NO: 5937 - protein, 23 aa, Neisseria
ICGGKNPDAGCKQAGQVGKRHQK

SEQ ID NO: 5938 - protein, 6 aa, Neisseria
PSDASL

SEQ ID NO: 5939 - protein, 12 aa, Neisseria
QNFDRDIEKNMI

SEQ ID NO: 5940 - protein, 19 aa, Neisseria
PYADKALAEMPEAKKDQAA

SEQ ID NO: 5941 - protein, 10 aa, Neisseria
AFNRYRENVL

SEQ ID NO: 5942 - protein, 10 aa, Neisseria
LITPEVKQAV

SEQ ID NO: 5943 - protein, 8 aa, Neisseria
KNAREIYT

SEQ ID NO: 5944 - protein, 5 aa, Neisseria
EEIDG

SEQ ID NO: 5945 - protein, 14 aa, Neisseria
VVAKNPRLIKKSMS

SEQ ID NO: 5946 - protein, 8 aa, Neisseria
EFTEELRR

SEQ ID NO: 5947 - protein, 20 aa, Neisseria
GKNPDAGCKQAGQVGKRHQK

SEQ ID NO: 5948 - protein, 9 aa, Neisseria
LTSILSYYG

SEQ ID NO: 5949 - protein, 10 aa, Neisseria
NLADIMRFGN

SEQ ID NO: 5950 - protein, 5 aa, Neisseria
ELSNL

SEQ ID NO: 5951 - protein, 7 aa, Neisseria
GFNKKLP

SEQ ID NO: 5952 - protein, 10 aa, Neisseria
TDLRTLRQKY

SEQ ID NO: 5953 - protein, 5 aa, Neisseria
KGANL

SEQ ID NO: 5954 - protein, 22 aa, Neisseria
RFGNEMNLTPRALRLELDELSN

SEQ ID NO: 5955 - protein, 7 aa, Neisseria
SISKDSI

SEQ ID NO: 5956 - protein, 16 aa, Neisseria
PAVGMRKIKMDEVSQK

SEQ ID NO: 5957 - protein, 13 aa, Neisseria
THFEEKKETKKIK

SEQ ID NO: 5958 - protein, 6 aa, Neisseria
LRGGQA

SEQ ID NO: 5959 - protein, 8 aa, Neisseria
TDLRTLRQ

SEQ ID NO: 5960 - protein, 11 aa, Neisseria
RALRLELDELS

SEQ ID NO: 5961 - protein, 5 aa, Neisseria
ISKDS

SEQ ID NO: 5962 - protein, 13 aa, Neisseria
VGMRKIKMDEVSQ

SEQ ID NO: 5963 - protein, 12 aa, Neisseria
HFEEKKETKKIK

SEQ ID NO: 5964 - protein, 10 aa, Neisseria
APTFQTPETL

SEQ ID NO: 5965 - protein, 7 aa, Neisseria
AALTQLM

SEQ ID NO: 5966 - protein, 10 aa, Neisseria
RMFVRPGDTV

SEQ ID NO: 5967 - protein, 5 aa, Neisseria
LLKGM

SEQ ID NO: 5968 - protein, 12 aa, Neisseria
SIENFVQQMNKE

SEQ ID NO: 5969 - protein, 15 aa, Neisseria
EALMRDFPEYYPLFS

SEQ ID NO: 5970 - protein, 5 aa, Neisseria
TVAQI

SEQ ID NO: 5971 - protein, 12 aa, Neisseria
EQILETIQPIPA

SEQ ID NO: 5972 - protein, 9 aa, Neisseria
SPAPNRPTV

SEQ ID NO: 5973 - protein, 7 aa, Neisseria
TFQTPET

SEQ ID NO: 5974 - protein, 5 aa, Neisseria
LQSKQ

SEQ ID NO: 5975 - protein, 9 aa, Neisseria
AKNINTPVE

SEQ ID NO: 5976 - protein, 18 aa, Neisseria
KNMKSGNIQSEENLKIPE

SEQ ID NO: 5977 - protein, 22 aa, Neisseria
WASEGSRMFVRPGDTVSTDKLL

SEQ ID NO: 5978 - protein, 10 aa, Neisseria
RLGNGSIENF

SEQ ID NO: 5979 - protein, 32 aa, Neisseria
MNKEARRLGMKNTVFKNPTGLSREGQVSTAKD

SEQ ID NO: 5980 - protein, 10 aa, Neisseria
ALMRDFPEYY

SEQ ID NO: 5981 - protein, 11 aa, Neisseria
KNIEQNNRNIL

SEQ ID NO: 5982 - protein, 20 aa, Neisseria
YRDNNVNGLKAGHTESGGYN

SEQ ID NO: 5983 - protein, 7 aa, Neisseria
YSGNGRH

SEQ ID NO: 5984 - protein, 15 aa, Neisseria
LGSESAETRASDNSK

SEQ ID NO: 5985 - protein, 12 aa, Neisseria
FDTPKIYPKGKT

SEQ ID NO: 5986 - protein, 10 aa, Neisseria
ISGGSKKTVR

SEQ ID NO: 5987 - protein, 12 aa, Neisseria
PHKEAKMAEQIL

SEQ ID NO: 5988 - protein, 19 aa, Neisseria
APVKKGQILGKIKIRQNGY

SEQ ID NO: 5989 - protein, 8 aa, Neisseria
IAEKEIVA

SEQ ID NO: 5990 - protein, 11 aa, Neisseria
ENVKKRSRWQR

SEQ ID NO: 5991 - protein, 6 aa, Neisseria
APNRPT

SEQ ID NO: 5992 - protein, 17 aa, Neisseria
NMKSGNIQSEENLKIPE

SEQ ID NO: 5993 - protein, 19 aa, Neisseria
EGSRMFVRPGDTVSTDKLL

SEQ ID NO: 5994 - protein, 10 aa, Neisseria
MNKEARRLGM

SEQ ID NO: 5995 - protein, 14 aa, Neisseria
TGLSREGQVSTAKD

SEQ ID NO: 5996 - protein, 8 aa, Neisseria
KNIEQNNR

SEQ ID NO: 5997 - protein, 6 aa, Neisseria
RDNNVN

SEQ ID NO: 5998 - protein, 6 aa, Neisseria
GHTESG

SEQ ID NO: 5999 - protein, 13 aa, Neisseria
SESAETRASDNSK

SEQ ID NO: 6000 - protein, 8 aa, Neisseria
KIYPKGKT

SEQ ID NO: 6001 - protein, 8 aa, Neisseria
GGSKKTVR

SEQ ID NO: 6002 - protein, 12 aa, Neisseria
PHKEAKMAEQIL

SEQ ID NO: 6003 - protein, 7 aa, Neisseria
PVKKGQI

SEQ ID NO: 6004 - protein, 5 aa, Neisseria
IKIRQ

SEQ ID NO: 6005 - protein, 8 aa, Neisseria
IAEKEIVA

SEQ ID NO: 6006 - protein, 9 aa, Neisseria
ENVKKRSRW

SEQ ID NO: 6007 - protein, 5 aa, Neisseria
IERLK

SEQ ID NO: 6008 - protein, 9 aa, Neisseria
MDNKTKLRL

SEQ ID NO: 6009 - protein, 44 aa, Neisseria
TSRRQQRQFIERLKKFDIDPEKGRINEANLRRMYHSGGQHQKDA

SEQ ID NO: 6010 - protein, 23 aa, Neisseria
SQKCSVDEAHAMFKKRPTRQEIN

SEQ ID NO: 6011 - protein, 13 aa, Neisseria
AAKQSRGQKRPHR

SEQ ID NO: 6012 - protein, 9 aa, Neisseria
MDNKTKLRL

SEQ ID NO: 6013 - protein, 33 aa, Neisseria
SRRQQRQFIERLKKFDIDPEKGRINEANLRRMY

SEQ ID NO: 6014 - protein, 6 aa, Neisseria
QHQKDA

SEQ ID NO: 6015 - protein, 20 aa, Neisseria
CSVDEAHAMFKKRPTRQEIN

SEQ ID NO: 6016 - protein, 13 aa, Neisseria
AAKQSRGQKRPHR

SEQ ID NO: 6017 - protein, 5 aa, Neisseria
GADGI

SEQ ID NO: 6018 - protein, 8 aa, Neisseria
SGRVDDAA

SEQ ID NO: 6019 - protein, 25 aa, Neisseria
LKGADGISPPLTYRSWHIEGGQALR

SEQ ID NO: 6020 - protein, 10 aa, Neisseria
ASGRVDDAAG

SEQ ID NO: 6021 - protein, 14 aa, Neisseria
LRIDSVSQNKETYT

SEQ ID NO: 6022 - protein, 13 aa, Neisseria
QVLKRGEPVGKPM

SEQ ID NO: 6023 - protein, 13 aa, Neisseria
ADNEILGKQEEEA

SEQ ID NO: 6024 - protein, 11 aa, Neisseria
MRQDAAEQIVR

SEQ ID NO: 6025 - protein, 6 aa, Neisseria
KGADGI

SEQ ID NO: 6026 - protein, 8 aa, Neisseria
GRVDDAAG

SEQ ID NO: 6027 - protein, 14 aa, Neisseria
LRIDSVSQNKETYT

SEQ ID NO: 6028 - protein, 10 aa, Neisseria
QVLKRGEPVG

SEQ ID NO: 6029 - protein, 10 aa, Neisseria
EILGKQEEEA

SEQ ID NO: 6030 - protein, 11 aa, Neisseria
MRQDAAEQIVR

SEQ ID NO: 6031 - protein, 14 aa, Neisseria
FRDGAHKMARVWVG

SEQ ID NO: 6032 - protein, 6 aa, Neisseria
RMAKMF

SEQ ID NO: 6033 - protein, 7 aa, Neisseria
FLKYPGE

SEQ ID NO: 6034 - protein, 11 aa, Neisseria
ELMEKCEHLIE

SEQ ID NO: 6035 - protein, 9 aa, Neisseria
PFRDGAHKM

SEQ ID NO: 6036 - protein, 10 aa, Neisseria
GAENIPDRPA

SEQ ID NO: 6037 - protein, 6 aa, Neisseria
HQSGWE

SEQ ID NO: 6038 - protein, 7 aa, Neisseria
VAKRELF

SEQ ID NO: 6039 - protein, 16 aa, Neisseria
IGIDRNNRREANEQLI

SEQ ID NO: 6040 - protein, 9 aa, Neisseria
GLVRKNEGY

SEQ ID NO: 6041 - protein, 18 aa, Neisseria
PEGTRLAPGKRGKYKLGG

SEQ ID NO: 6042 - protein, 18 aa, Neisseria
NSGEFWPKNSFLKYPGEI

SEQ ID NO: 6043 - protein, 17 aa, Neisseria
HASGSEAELMEKCEHLI

SEQ ID NO: 6044 - protein, 6 aa, Neisseria
MPSETA

SEQ ID NO: 6045 - protein, 9 aa, Neisseria
PFRDGAHKM

SEQ ID NO: 6046 - protein, 7 aa, Neisseria
NIPDRPA

SEQ ID NO: 6047 - protein, 7 aa, Neisseria
VAKRELF

SEQ ID NO: 6048 - protein, 16 aa, Neisseria
IGIDRNNRREANEQLI

SEQ ID NO: 6049 - protein, 7 aa, Neisseria
GLVRKNE

SEQ ID NO: 6050 - protein, 17 aa, Neisseria
EGTRLAPGKRGKYKLGG

SEQ ID NO: 6051 - protein, 15 aa, Neisseria
SGSEAELMEKCEHLI

SEQ ID NO: 6052 - protein, 6 aa, Neisseria
MPSETA

SEQ ID NO: 6053 - protein, 8 aa, Neisseria
GLWVGLAA

SEQ ID NO: 6054 - protein, 9 aa, Neisseria
ASVIEEAGN

SEQ ID NO: 6055 - protein, 13 aa, Neisseria
VAEFEKSLKRIAQ

SEQ ID NO: 6056 - protein, 8 aa, Neisseria
SYRRPTQV

SEQ ID NO: 6057 - protein, 6 aa, Neisseria
MTLVSS

SEQ ID NO: 6058 - protein, 22 aa, Neisseria
VIRPLQALREGAERIGRRCFDI

SEQ ID NO: 6059 - protein, 11 aa, Neisseria
FKQVGRCFNQM

SEQ ID NO: 6060 - protein, 17 aa, Neisseria
DDLEGQVAEQTRSLEKQ

SEQ ID NO: 6061 - protein, 7 aa, Neisseria
TRDLHQS

SEQ ID NO: 6062 - protein, 7 aa, Neisseria
QQAAEHF

SEQ ID NO: 6063 - protein, 5 aa, Neisseria
NRILP

SEQ ID NO: 6064 - protein, 9 aa, Neisseria
ASDLGKYHE

SEQ ID NO: 6065 - protein, 9 aa, Neisseria
RLLLSFPNG

SEQ ID NO: 6066 - protein, 9 aa, Neisseria
LQTLGRQLG

SEQ ID NO: 6067 - protein, 12 aa, Neisseria
QGLHDSIAQALT

SEQ ID NO: 6068 - protein, 12 aa, Neisseria
GVQECYEDVREL

SEQ ID NO: 6069 - protein, 14 aa, Neisseria
KEFPEAVADLFARF

SEQ ID NO: 6070 - protein, 9 aa, Neisseria
LSNIRKHAR

SEQ ID NO: 6071 - protein, 8 aa, Neisseria
TEKIGEPT

SEQ ID NO: 6072 - protein, 7 aa, Neisseria
RFSDGIS

SEQ ID NO: 6073 - protein, 7 aa, Neisseria
VIEEAGN

SEQ ID NO: 6074 - protein, 32 aa, Neisseria
AGEGSPRAQIDNQVAEFEKSLKRIAQSDAIHP

SEQ ID NO: 6075 - protein, 7 aa, Neisseria
IPSDTPL

SEQ ID NO: 6076 - protein, 14 aa, Neisseria
PPLQSYRRPTQVDL

SEQ ID NO: 6077 - protein, 8 aa, Neisseria
ENANEKNT

SEQ ID NO: 6078 - protein, 16 aa, Neisseria
QALREGAERIGRRCFD

SEQ ID NO: 6079 - protein, 49 aa, Neisseria
PVPEGGTPEFKQVGRCFNQMGGRLKILYDDLEGQVAEQTRSLEKQNQNL

SEQ ID NO: 6080 - protein, 11 aa, Neisseria
QTTRDLHQSYI

SEQ ID NO: 6081 - protein, 15 aa, Neisseria
VGADSGRVCLDGGSD

SEQ ID NO: 6082 - protein, 16 aa, Neisseria
HADCGTAASDLGKYHE

SEQ ID NO: 6083 - protein, 7 aa, Neisseria
YQNETLG

SEQ ID NO: 6084 - protein, 14 aa, Neisseria
FPNGISLDEDDRIL

SEQ ID NO: 6085 - protein, 6 aa, Neisseria
TLGRQL

SEQ ID NO: 6086 - protein, 10 aa, Neisseria
GAKQEEEKRL

SEQ ID NO: 6087 - protein, 6 aa, Neisseria
LQERNL

SEQ ID NO: 6088 - protein, 5 aa, Neisseria
LHDSI

SEQ ID NO: 6089 - protein, 12 aa, Neisseria
AFAENKREEAAE

SEQ ID NO: 6090 - protein, 11 aa, Neisseria
GVQECYEDVRE

SEQ ID NO: 6091 - protein, 13 aa, Neisseria
RTKISNKEFPEAV

SEQ ID NO: 6092 - protein, 6 aa, Neisseria
AWENGS

SEQ ID NO: 6093 - protein, 5 aa, Neisseria
PPQEA

SEQ ID NO: 6094 - protein, 10 aa, Neisseria
SLSNIRKHAR

SEQ ID NO: 6095 - protein, 9 aa, Neisseria
TLSEHGGRF

SEQ ID NO: 6096 - protein, 20 aa, Neisseria
IQDNGQGFDTEKIGEPTGSH

SEQ ID NO: 6097 - protein, 8 aa, Neisseria
MQERAKRI

SEQ ID NO: 6098 - protein, 11 aa, Neisseria
EIRSQAQQGTT

SEQ ID NO: 6099 - protein, 7 aa, Neisseria
ASEESLK

SEQ ID NO: 6100 - protein, 7 aa, Neisseria
VIEEAGN

SEQ ID NO: 6101 - protein, 8 aa, Neisseria
EGSPRAQI

SEQ ID NO: 6102 - protein, 14 aa, Neisseria
QVAEFEKSLKRIAQ

SEQ ID NO: 6103 - protein, 7 aa, Neisseria
SYRRPTQ

SEQ ID NO: 6104 - protein, 6 aa, Neisseria
ENANEK

SEQ ID NO: 6105 - protein, 15 aa, Neisseria
QALREGAERIGRRCF

SEQ ID NO: 6106 - protein, 11 aa, Neisseria
EGGTPEFKQVG

SEQ ID NO: 6107 - protein, 22 aa, Neisseria
ILYDDLEGQVAEQTRSLEKQNQ

SEQ ID NO: 6108 - protein, 6 aa, Neisseria
TTRDLH

SEQ ID NO: 6109 - protein, 9 aa, Neisseria
GADSGRVCL

SEQ ID NO: 6110 - protein, 14 aa, Neisseria
DCGTAASDLGKYHE

SEQ ID NO: 6111 - protein, 9 aa, Neisseria
SLDEDDRIL

SEQ ID NO: 6112 - protein, 10 aa, Neisseria
GAKQEEEKRL

SEQ ID NO: 6113 - protein, 6 aa, Neisseria
LQERNL

SEQ ID NO: 6114 - protein, 12 aa, Neisseria
AFAENKREEAAE

SEQ ID NO: 6115 - protein, 8 aa, Neisseria
ECYEDVRE

SEQ ID NO: 6116 - protein, 12 aa, Neisseria
TKISNKEFPEAV

SEQ ID NO: 6117 - protein, 10 aa, Neisseria
SLSNIRKHAR

SEQ ID NO: 6118 - protein, 16 aa, Neisseria
DNGQGFDTEKIGEPTG

SEQ ID NO: 6119 - protein, 8 aa, Neisseria
MQERAKRI

SEQ ID NO: 6120 - protein, 7 aa, Neisseria
EIRSQAQ

SEQ ID NO: 6121 - protein, 7 aa, Neisseria
ASEESLK

SEQ ID NO: 6122 - protein, 11 aa, Neisseria
WSLVSAWMVVI

SEQ ID NO: 6123 - protein, 12 aa, Neisseria
LETTVMSAVRTL

SEQ ID NO: 6124 - protein, 11 aa, Neisseria
FTPYTTVASTS

SEQ ID NO: 6125 - protein, 9 aa, Neisseria
TFFAPLSRW

SEQ ID NO: 6126 - protein, 16 aa, Neisseria
NAPVHSMTKSTPSSFH

SEQ ID NO: 6127 - protein, 9 aa, Neisseria
VSNLVRWAL

SEQ ID NO: 6128 - protein, 9 aa, Neisseria
FNSGSTKPT

SEQ ID NO: 6129 - protein, 11 aa, Neisseria
PLRARRRSLWR

SEQ ID NO: 6130 - protein, 8 aa, Neisseria
ATGERQLV

SEQ ID NO: 6131 - protein, 10 aa, Neisseria
STSSPPGAEM

SEQ ID NO: 6132 - protein, 14 aa, Neisseria
MTKSTPSSFHGSSA

SEQ ID NO: 6133 - protein, 13 aa, Neisseria
LRVEKKGILSPLT

SEQ ID NO: 6134 - protein, 16 aa, Neisseria
RLPPSWDTSASKRPCT

SEQ ID NO: 6135 - protein, 9 aa, Neisseria
LRARRRSLW

SEQ ID NO: 6136 - protein, 8 aa, Neisseria
ATGERQLV

SEQ ID NO: 6137 - protein, 5 aa, Neisseria
PGAEM

SEQ ID NO: 6138 - protein, 5 aa, Neisseria
TKSTP

SEQ ID NO: 6139 - protein, 8 aa, Neisseria
LRVEKKGI

SEQ ID NO: 6140 - protein, 8 aa, Neisseria
SASKRPCT

SEQ ID NO: 6141 - protein, 6 aa, Neisseria
TKREGK

SEQ ID NO: 6142 - protein, 6 aa, Neisseria
NQYAQF

SEQ ID NO: 6143 - protein, 10 aa, Neisseria
VNQINSSHSS

SEQ ID NO: 6144 - protein, 10 aa, Neisseria
DFTRILSYHS

SEQ ID NO: 6145 - protein, 9 aa, Neisseria
AANTSNNTA

SEQ ID NO: 6146 - protein, 6 aa, Neisseria
KLGGMY

SEQ ID NO: 6147 - protein, 5 aa, Neisseria
KDTDN

SEQ ID NO: 6148 - protein, 6 aa, Neisseria
NNQGKL

SEQ ID NO: 6149 - protein, 7 aa, Neisseria
SSNQTGN

SEQ ID NO: 6150 - protein, 7 aa, Neisseria
SNITAPT

SEQ ID NO: 6151 - protein, 7 aa, Neisseria
RTHGALD

SEQ ID NO: 6152 - protein, 10 aa, Neisseria
QQGLNNAGQI

SEQ ID NO: 6153 - protein, 11 aa, Neisseria
LDNAHGKLLSA

SEQ ID NO: 6154 - protein, 7 aa, Neisseria
LDNAAQG

SEQ ID NO: 6155 - protein, 7 aa, Neisseria
QMNNIGT

SEQ ID NO: 6156 - protein, 15 aa, Neisseria
TGKAQRIHNAGATIE

SEQ ID NO: 6157 - protein, 6 aa, Neisseria
LHNTNE

SEQ ID NO: 6158 - protein, 6 aa, Neisseria
YEAFGR

SEQ ID NO: 6159 - protein, 15 aa, Neisseria
SDHLRTPDGAAHENW

SEQ ID NO: 6160 - protein, 5 aa, Neisseria
TAPAK

SEQ ID NO: 6161 - protein, 6 aa, Neisseria
LHSYWR

SEQ ID NO: 6162 - protein, 5 aa, Neisseria
EEITR

SEQ ID NO: 6163 - protein, 9 aa, Neisseria
LHKRLGDGY

SEQ ID NO: 6164 - protein, 17 aa, Neisseria
EQIAELTGHRRLDGYQN

SEQ ID NO: 6165 - protein, 5 aa, Neisseria
KALMD

SEQ ID NO: 6166 - protein, 5 aa, Neisseria
QVAQL

SEQ ID NO: 6167 - protein, 7 aa, Neisseria
TLDNIGG

SEQ ID NO: 6168 - protein, 12 aa, Neisseria
ATQDINNIGGML

SEQ ID NO: 6169 - protein, 6 aa, Neisseria
QAGRDI

SEQ ID NO: 6170 - protein, 11 aa, Neisseria
IRGSTNEVGSS

SEQ ID NO: 6171 - protein, 10 aa, Neisseria
VDDASKHTGR

SEQ ID NO: 6172 - protein, 5 aa, Neisseria
SHHET

SEQ ID NO: 6173 - protein, 6 aa, Neisseria
QAGNHV

SEQ ID NO: 6174 - protein, 7 aa, Neisseria
QSETYHQ

SEQ ID NO: 6175 - protein, 10 aa, Neisseria
KHYEQIGSTV

SEQ ID NO: 6176 - protein, 6 aa, Neisseria
PVTDLA

SEQ ID NO: 6177 - protein, 16 aa, Neisseria
YQTGKSAQNLANGTTN

SEQ ID NO: 6178 - protein, 9 aa, Neisseria
EQSNTERGQ

SEQ ID NO: 6179 - protein, 9 aa, Neisseria
GGNVGKGYG

SEQ ID NO: 6180 - protein, 6 aa, Neisseria
KNHSQY

SEQ ID NO: 6181 - protein, 10 aa, Neisseria
LGQGAQNKPQ

SEQ ID NO: 6182 - protein, 16 aa, Neisseria
TDTAERHSGSLKNTFN

SEQ ID NO: 6183 - protein, 10 aa, Neisseria
VSQDFSKNVQ

SEQ ID NO: 6184 - protein, 10 aa, Neisseria
ILNMLASGLA

SEQ ID NO: 6185 - protein, 9 aa, Neisseria
GQHFKDLAG

SEQ ID NO: 6186 - protein, 6 aa, Neisseria
LGAAVA

SEQ ID NO: 6187 - protein, 11 aa, Neisseria
AITNVLGTATG

SEQ ID NO: 6188 - protein, 8 aa, Neisseria
GNSATDAA

SEQ ID NO: 6189 - protein, 5 aa, Neisseria
HKDPG

SEQ ID NO: 6190 - protein, 10 aa, Neisseria
ITREFGKDIA

SEQ ID NO: 6191 - protein, 5 aa, Neisseria
NSHES

SEQ ID NO: 6192 - protein, 12 aa, Neisseria
ADEMIDQLNNEI

SEQ ID NO: 6193 - protein, 5 aa, Neisseria
MNKTL

SEQ ID NO: 6194 - protein, 9 aa, Neisseria
IFNRKRGAV

SEQ ID NO: 6195 - protein, 19 aa, Neisseria
ETTKREGKSCADSDSGSAH

SEQ ID NO: 6196 - protein, 12 aa, Neisseria
IIADKAAPKTQQ

SEQ ID NO: 6197 - protein, 17 aa, Neisseria
VGNRGAILNNSRSNTQT

SEQ ID NO: 6198 - protein, 5 aa, Neisseria
NPWLA

SEQ ID NO: 6199 - protein, 5 aa, Neisseria
GEARV

SEQ ID NO: 6200 - protein, 11 aa, Neisseria
INSSHSSQMNG

SEQ ID NO: 6201 - protein, 10 aa, Neisseria
IEVGGRRAEV

SEQ ID NO: 6202 - protein, 7 aa, Neisseria
NASRATL

SEQ ID NO: 6203 - protein, 20 aa, Neisseria
TGQPQYQAGDLSGFKIRQGN

SEQ ID NO: 6204 - protein, 9 aa, Neisseria
GLDARDTDF

SEQ ID NO: 6205 - protein, 8 aa, Neisseria
SYHSKIDA

SEQ ID NO: 6206 - protein, 5 aa, Neisseria
QDVRV

SEQ ID NO: 6207 - protein, 11 aa, Neisseria
NTSNNTANNGT

SEQ ID NO: 6208 - protein, 7 aa, Neisseria
DTGKLGG

SEQ ID NO: 6209 - protein, 9 aa, Neisseria
AGIRNQGQL

SEQ ID NO: 6210 - protein, 8 aa, Neisseria
DANGRLVN

SEQ ID NO: 6211 - protein, 35 aa, Neisseria
NAKDTDNTAEHKVNIRSQGVENSGTAVSQQGTQIH

SEQ ID NO: 6212 - protein, 6 aa, Neisseria
QSIQNT

SEQ ID NO: 6213 - protein, 41 aa, Neisseria
NSGSLKNETSGTIEAARLAIDTDTLNNQGKLSQTGSQKLHI

SEQ ID NO: 6214 - protein, 32 aa, Neisseria
AQGKMDNRGRMGLQDTAPTASNGSSNQTGNSY

SEQ ID NO: 6215 - protein, 8 aa, Neisseria
SSTTTPTT

SEQ ID NO: 6216 - protein, 18 aa, Neisseria
TFADGTIRTHGALDNSGS

SEQ ID NO: 6217 - protein, 9 aa, Neisseria
ANGQTDVSA

SEQ ID NO: 6218 - protein, 8 aa, Neisseria
QGLNNAGQ

SEQ ID NO: 6219 - protein, 6 aa, Neisseria
NAKGSA

SEQ ID NO: 6220 - protein, 5 aa, Neisseria
DNHNG

SEQ ID NO: 6221 - protein, 28 aa, Neisseria
GSLNNQNGNITTRQQLEIETDQLDNAHG

SEQ ID NO: 6222 - protein, 12 aa, Neisseria
SLNNQNGEIATN

SEQ ID NO: 6223 - protein, 8 aa, Neisseria
IIHDGQQS

SEQ ID NO: 6224 - protein, 14 aa, Neisseria
NTNGTIQSGRDVAI

SEQ ID NO: 6225 - protein, 7 aa, Neisseria
KSLSNNG

SEQ ID NO: 6226 - protein, 9 aa, Neisseria
ADNKLDIAL

SEQ ID NO: 6227 - protein, 6 aa, Neisseria
DDFYVE

SEQ ID NO: 6228 - protein, 8 aa, Neisseria
NIVAGNEL

SEQ ID NO: 6229 - protein, 12 aa, Neisseria
LSTRGSLKNSHT

SEQ ID NO: 6230 - protein, 48 aa, Neisseria
AGKRIRIKANNLDNAAQGNIQSGGTTDIGTQHNLTNRGLIDGQQTKIQ

SEQ ID NO: 6231 - protein, 13 aa, Neisseria
ATRLDNQDENGTG

SEQ ID NO: 6232 - protein, 7 aa, Neisseria
AARENLN

SEQ ID NO: 6233 - protein, 8 aa, Neisseria
LNNRENSL

SEQ ID NO: 6234 - protein, 21 aa, Neisseria
GALDTNGQATGKAQRIHNAGA

SEQ ID NO: 6235 - protein, 20 aa, Neisseria
AAGKMRLGVEKLHNTNEHLK

SEQ ID NO: 6236 - protein, 8 aa, Neisseria
ETGREHIV

SEQ ID NO: 6237 - protein, 9 aa, Neisseria
ELLREGTQH

SEQ ID NO: 6238 - protein, 17 aa, Neisseria
VYNDESDHLRTPDGAAH

SEQ ID NO: 6239 - protein, 14 aa, Neisseria
HKYDYEKVTQKTQV

SEQ ID NO: 6240 - protein, 17 aa, Neisseria
SGNDLTIDGKEVFNTDS

SEQ ID NO: 6241 - protein, 55 aa, Neisseria
QTEKDGLHNEQTFGEKKVFSENGKLHSYWREKHKGRDSTGHSEQNYTLPEEITRN

SEQ ID NO: 6242 - protein, 7 aa, Neisseria
ESHRKAL

SEQ ID NO: 6243 - protein, 15 aa, Neisseria
HAPSQGTELPQSNGI

SEQ ID NO: 6244 - protein, 11 aa, Neisseria
YLVETDPRFAN

SEQ ID NO: 6245 - protein, 23 aa, Neisseria
LKLDPNNLHKRLGDGYYEQRLIN

SEQ ID NO: 6246 - protein, 32 aa, Neisseria
TGHRRLDGYQNDEEQFKALMDNGATAALRSMN

SEQ ID NO: 6247 - protein, 10 aa, Neisseria
KEVKLPDGGT

SEQ ID NO: 6248 - protein, 11 aa, Neisseria
RVKNGDIDGKG

SEQ ID NO: 6249 - protein, 15 aa, Neisseria
GSLKASSGTIAGRNA

SEQ ID NO: 6250 - protein, 10 aa, Neisseria
NTDTLDNIGG

SEQ ID NO: 6251 - protein, 7 aa, Neisseria
IHAQKSA

SEQ ID NO: 6252 - protein, 24 aa, Neisseria
AGNNINSQSTTASSQNTQGSSTYL

SEQ ID NO: 6253 - protein, 7 aa, Neisseria
TGKEKGV

SEQ ID NO: 6254 - protein, 7 aa, Neisseria
AGKDINI

SEQ ID NO: 6255 - protein, 29 aa, Neisseria
ISNQSEQGQTRLQAGRDINLDTVQTSKHQ

SEQ ID NO: 6256 - protein, 25 aa, Neisseria
FDADNHVIRGSTNEVGSSIQTKGDV

SEQ ID NO: 6257 - protein, 16 aa, Neisseria
GNNLNAKAAEVSSANG

SEQ ID NO: 6258 - protein, 5 aa, Neisseria
AKNDI

SEQ ID NO: 6259 - protein, 21 aa, Neisseria
THVDDASKHTGRSGGGNKLVI

SEQ ID NO: 6260 - protein, 19 aa, Neisseria
DKAQSHHETAQSSTFEGKQ

SEQ ID NO: 6261 - protein, 7 aa, Neisseria
QAGNDAN

SEQ ID NO: 6262 - protein, 11 aa, Neisseria
VISDNGTQIQA

SEQ ID NO: 6263 - protein, 20 aa, Neisseria
GTTQTQSQSETYHQTQKSGL

SEQ ID NO: 6264 - protein, 30 aa, Neisseria
GSKTNTQENQSQSNEHTGSTVGSLKGDTTI

SEQ ID NO: 6265 - protein, 8 aa, Neisseria
AGKHYEQI

SEQ ID NO: 6266 - protein, 8 aa, Neisseria
VSSPEGNN

SEQ ID NO: 6267 - protein, 19 aa, Neisseria
AAHNKLNSNTTQTYEQKGL

SEQ ID NO: 6268 - protein, 15 aa, Neisseria
QSSKQVGQSKNDRVN

SEQ ID NO: 6269 - protein, 9 aa, Neisseria
AYQTGKSAQ

SEQ ID NO: 6270 - protein, 9 aa, Neisseria
LANGTTNAK

SEQ ID NO: 6271 - protein, 11 aa, Neisseria
YGEQQNRQTTQ

SEQ ID NO: 6272 - protein, 10 aa, Neisseria
SQIQAGGKTT

SEQ ID NO: 6273 - protein, 6 aa, Neisseria
AAEQSN

SEQ ID NO: 6274 - protein, 7 aa, Neisseria
GSDVAGK

SEQ ID NO: 6275 - protein, 6 aa, Neisseria
ADNDIT

SEQ ID NO: 6276 - protein, 19 aa, Neisseria
QSAEQSNTERGQNKSAGWN

SEQ ID NO: 6277 - protein, 25 aa, Neisseria
GNVGKGYGNGDSITHRHSHIGDKGS

SEQ ID NO: 6278 - protein, 9 aa, Neisseria
QSGGDTTIK

SEQ ID NO: 6279 - protein, 14 aa, Neisseria
AQVRGKGVQVNAKN

SEQ ID NO: 6280 - protein, 15 aa, Neisseria
SVQDRETYQSKQQNA

SEQ ID NO: 6281 - protein, 14 aa, Neisseria
AGGDYSQSKIRADH

SEQ ID NO: 6282 - protein, 14 aa, Neisseria
TEQSGIYAGEDGYQ

SEQ ID NO: 6283 - protein, 10 aa, Neisseria
GNHTDLKGGI

SEQ ID NO: 6284 - protein, 14 aa, Neisseria
TQSAEDKGLYNRFQ

SEQ ID NO: 6285 - protein, 16 aa, Neisseria
THSDIKNHSQYKGESF

SEQ ID NO: 6286 - protein, 18 aa, Neisseria
ISGKTLGQGAQNKPQNKH

SEQ ID NO: 6287 - protein, 8 aa, Neisseria
VADKNSAS

SEQ ID NO: 6288 - protein, 21 aa, Neisseria
GYGSDSDSQSSITKSGINTRN

SEQ ID NO: 6289 - protein, 8 aa, Neisseria
QITDEAAQ

SEQ ID NO: 6290 - protein, 65 aa, Neisseria
RLTGKTAAQTLYADIDTNVTTDTAERHSGSLKNTFNKEAVQSELDLQRTVSQDFSKNVQQANTEI

SEQ ID NO: 6291 - protein, 17 aa, Neisseria
QHLDKLKADKEAAETAA

SEQ ID NO: 6292 - protein, 27 aa, Neisseria
ANGDMETAKRKAHEAQDAAAKADNWQQ

SEQ ID NO: 6293 - protein, 5 aa, Neisseria
PTQSG

SEQ ID NO: 6294 - protein, 20 aa, Neisseria
HFKDLAGQNANGKLTASQET

SEQ ID NO: 6295 - protein, 5 aa, Neisseria
GDNNA

SEQ ID NO: 6296 - protein, 7 aa, Neisseria
SAGGSEA

SEQ ID NO: 6297 - protein, 18 aa, Neisseria
LYGKEKGSDLTAEEKETV

SEQ ID NO: 6298 - protein, 15 aa, Neisseria
VGNSATDAAQGSLNA

SEQ ID NO: 6299 - protein, 12 aa, Neisseria
SAVENNDTVEQV

SEQ ID NO: 6300 - protein, 5 aa, Neisseria
LRHPR

SEQ ID NO: 6301 - protein, 13 aa, Neisseria
VHKDPGSTLEPNI

SEQ ID NO: 6302 - protein, 12 aa, Neisseria
FPNSEFGGEGGV

SEQ ID NO: 6303 - protein, 11 aa, Neisseria
ITREFGKDIAV

SEQ ID NO: 6304 - protein, 29 aa, Neisseria
VGNSHESGEKINYSIRRNLSLDKADEMID

SEQ ID NO: 6305 - protein, 10 aa, Neisseria
LNNEIGREIA

SEQ ID NO: 6306 - protein, 10 aa, Neisseria
NTNRLNTKEL

SEQ ID NO: 6307 - protein, 8 aa, Neisseria
ETYKNNGF

SEQ ID NO: 6308 - protein, 27 aa, Neisseria
QAERNSNGNYDVVRKRLSEKDYQNTSN

SEQ ID NO: 6309 - protein, 9 aa, Neisseria
IQQRRKQIR

SEQ ID NO: 6310 - protein, 5 aa, Neisseria
RQWRR

SEQ ID NO: 6311 - protein, 7 aa, Neisseria
FNRKRGA

SEQ ID NO: 6312 - protein, 19 aa, Neisseria
ETTKREGKSCADSDSGSAH

SEQ ID NO: 6313 - protein, 12 aa, Neisseria
IIADKAAPKTQQ

SEQ ID NO: 6314 - protein, 6 aa, Neisseria
NSRSNT

SEQ ID NO: 6315 - protein, 5 aa, Neisseria
GEARV

SEQ ID NO: 6316 - protein, 8 aa, Neisseria
VGGRRAEV

SEQ ID NO: 6317 - protein, 7 aa, Neisseria
SGFKIRQ

SEQ ID NO: 6318 - protein, 8 aa, Neisseria
LDARDTDF

SEQ ID NO: 6319 - protein, 5 aa, Neisseria
AGIRN

SEQ ID NO: 6320 - protein, 24 aa, Neisseria
NAKDTDNTAEHKVNIRSQGVENSG

SEQ ID NO: 6321 - protein, 25 aa, Neisseria
GSLKNETSGTIEAARLAIDTDTLNN

SEQ ID NO: 6322 - protein, 5 aa, Neisseria
GKLSQ

SEQ ID NO: 6323 - protein, 13 aa, Neisseria
AQGKMDNRGRMGL

SEQ ID NO: 6324 - protein, 7 aa, Neisseria
NGSSNQT

SEQ ID NO: 6325 - protein, 5 aa, Neisseria
LDNSG

SEQ ID NO: 6326 - protein, 7 aa, Neisseria
GQTDVSA

SEQ ID NO: 6327 - protein, 14 aa, Neisseria
QQLEIETDQLDNAH

SEQ ID NO: 6328 - protein, 7 aa, Neisseria
QNGEIAT

SEQ ID NO: 6329 - protein, 8 aa, Neisseria
QSGRDVAI

SEQ ID NO: 6330 - protein, 9 aa, Neisseria
ADNKLDIAL

SEQ ID NO: 6331 - protein, 5 aa, Neisseria
GSLKN

SEQ ID NO: 6332 - protein, 16 aa, Neisseria
AGKRIRIKANNLDNAA

SEQ ID NO: 6333 - protein, 6 aa, Neisseria
QQTKIQ

SEQ ID NO: 6334 - protein, 11 aa, Neisseria
TRLDNQDENGT

SEQ ID NO: 6335 - protein, 6 aa, Neisseria
AARENL

SEQ ID NO: 6336 - protein, 6 aa, Neisseria
NNRENS

SEQ ID NO: 6337 - protein, 5 aa, Neisseria
LDTNG

SEQ ID NO: 6338 - protein, 9 aa, Neisseria
ATGKAQRIH

SEQ ID NO: 6339 - protein, 20 aa, Neisseria
AAGKMRLGVEKLHNTNEHLK

SEQ ID NO: 6340 - protein, 8 aa, Neisseria
ETGREHIV

SEQ ID NO: 6341 - protein, 9 aa, Neisseria
ELLREGTQH

SEQ ID NO: 6342 - protein, 14 aa, Neisseria
NDESDHLRTPDGAA

SEQ ID NO: 6343 - protein, 8 aa, Neisseria
YDYEKVTQ

SEQ ID NO: 6344 - protein, 10 aa, Neisseria
LTIDGKEVFN

SEQ ID NO: 6345 - protein, 9 aa, Neisseria
QTEKDGLHN

SEQ ID NO: 6346 - protein, 13 aa, Neisseria
TFGEKKVFSENGK

SEQ ID NO: 6347 - protein, 16 aa, Neisseria
WREKHKGRDSTGHSEQ

SEQ ID NO: 6348 - protein, 5 aa, Neisseria
EEITR

SEQ ID NO: 6349 - protein, 7 aa, Neisseria
ESHRKAL

SEQ ID NO: 6350 - protein, 7 aa, Neisseria
QGTELPQ

SEQ ID NO: 6351 - protein, 7 aa, Neisseria
TDPRFAN

SEQ ID NO: 6352 - protein, 5 aa, Neisseria
LKLDP

SEQ ID NO: 6353 - protein, 7 aa, Neisseria
NLHKRLG

SEQ ID NO: 6354 - protein, 20 aa, Neisseria
TGHRRLDGYQNDEEQFKALM

SEQ ID NO: 6355 - protein, 6 aa, Neisseria
GATAAR

SEQ ID NO: 6356 - protein, 10 aa, Neisseria
KEVKLPDGGT

SEQ ID NO: 6357 - protein, 10 aa, Neisseria
VKNGDIDGKG

SEQ ID NO: 6358 - protein, 5 aa, Neisseria
GSLKN

SEQ ID NO: 6359 - protein, 7 aa, Neisseria
IHAQKSA

SEQ ID NO: 6360 - protein, 5 aa, Neisseria
QNTQG

SEQ ID NO: 6361 - protein, 6 aa, Neisseria
GKEKGV

SEQ ID NO: 6362 - protein, 6 aa, Neisseria
AGKDIN

SEQ ID NO: 6363 - protein, 18 aa, Neisseria
NQSEQGQTRLQAGRDINL

SEQ ID NO: 6364 - protein, 6 aa, Neisseria
QTSKHQ

SEQ ID NO: 6365 - protein, 7 aa, Neisseria
FDADNHV

SEQ ID NO: 6366 - protein, 7 aa, Neisseria
STNEVGS

SEQ ID NO: 6367 - protein, 7 aa, Neisseria
IQTKGDV

SEQ ID NO: 6368 - protein, 10 aa, Neisseria
LNAKAAEVSS

SEQ ID NO: 6369 - protein, 5 aa, Neisseria
AKNDI

SEQ ID NO: 6370 - protein, 15 aa, Neisseria
HVDDASKHTGRSGGG

SEQ ID NO: 6371 - protein, 11 aa, Neisseria
DKAQSHHETAQ

SEQ ID NO: 6372 - protein, 7 aa, Neisseria
STFEGKQ

SEQ ID NO: 6373 - protein, 6 aa, Neisseria
QSQSET

SEQ ID NO: 6374 - protein, 17 aa, Neisseria
SKTNTQENQSQSNEHTG

SEQ ID NO: 6375 - protein, 5 aa, Neisseria
LKGDT

SEQ ID NO: 6376 - protein, 6 aa, Neisseria
SSPEGN

SEQ ID NO: 6377 - protein, 8 aa, Neisseria
AAHNKLNS

SEQ ID NO: 6378 - protein, 5 aa, Neisseria
YEQKG

SEQ ID NO: 6379 - protein, 15 aa, Neisseria
QSSKQVGQSKNDRVN

SEQ ID NO: 6380 - protein, 7 aa, Neisseria
QTGKSAQ

SEQ ID NO: 6381 - protein, 8 aa, Neisseria
EQQNRQTT

SEQ ID NO: 6382 - protein, 6 aa, Neisseria
AAEQSN

SEQ ID NO: 6383 - protein, 5 aa, Neisseria
DVAGK

SEQ ID NO: 6384 - protein, 5 aa, Neisseria
ADNDI

SEQ ID NO: 6385 - protein, 13 aa, Neisseria
SAEQSNTERGQNK

SEQ ID NO: 6386 - protein, 5 aa, Neisseria
DSITH

SEQ ID NO: 6387 - protein, 7 aa, Neisseria
HIGDKGS

SEQ ID NO: 6388 - protein, 7 aa, Neisseria
GGDTTIK

SEQ ID NO: 6389 - protein, 8 aa, Neisseria
AQVRGKGV

SEQ ID NO: 6390 - protein, 15 aa, Neisseria
SVQDRETYQSKQQNA

SEQ ID NO: 6391 - protein, 12 aa, Neisseria
GDYSQSKIRADH

SEQ ID NO: 6392 - protein, 7 aa, Neisseria
AGEDGYQ

SEQ ID NO: 6393 - protein, 5 aa, Neisseria
TDLKG

SEQ ID NO: 6394 - protein, 11 aa, Neisseria
QSAEDKGKNRF

SEQ ID NO: 6395 - protein, 5 aa, Neisseria
SDIKN

SEQ ID NO: 6396 - protein, 7 aa, Neisseria
SQYKGES

SEQ ID NO: 6397 - protein, 9 aa, Neisseria
AQNKPQNKH

SEQ ID NO: 6398 - protein, 7 aa, Neisseria
VADKNSA

SEQ ID NO: 6399 - protein, 10 aa, Neisseria
SDSDSQSSIT

SEQ ID NO: 6400 - protein, 8 aa, Neisseria
QITDEAAQ

SEQ ID NO: 6401 - protein, 11 aa, Neisseria
TAAQTKADIDT

SEQ ID NO: 6402 - protein, 10 aa, Neisseria
DTAERHSGSL

SEQ ID NO: 6403 - protein, 15 aa, Neisseria
TFNKEAVQSELDLQR

SEQ ID NO: 6404 - protein, 5 aa, Neisseria
ANTEI

SEQ ID NO: 6405 - protein, 17 aa, Neisseria
QHLDKLKADKEAAETAA

SEQ ID NO: 6406 - protein, 22 aa, Neisseria
GDMETAKRKAHEAQDAAAKADN

SEQ ID NO: 6407 - protein, 7 aa, Neisseria
HFKDLAG

SEQ ID NO: 6408 - protein, 7 aa, Neisseria
LTASQET

SEQ ID NO: 6409 - protein, 5 aa, Neisseria
GGSEA

SEQ ID NO: 6410 - protein, 17 aa, Neisseria
YGKEKGSDLTAEEKETV

SEQ ID NO: 6411 - protein, 7 aa, Neisseria
SATDAAQ

SEQ ID NO: 6412 - protein, 12 aa, Neisseria
SAVENNDTVEQV

SEQ ID NO: 6413 - protein, 5 aa, Neisseria
LRHPR

SEQ ID NO: 6414 - protein, 9 aa, Neisseria
VHKDPGSTL

SEQ ID NO: 6415 - protein, 7 aa, Neisseria
ITREFGK

SEQ ID NO: 6416 - protein, 27 aa, Neisseria
NSHESGEKINYSIRRNLSLDKADEMID

SEQ ID NO: 6417 - protein, 7 aa, Neisseria
EIGREIA

SEQ ID NO: 6418 - protein, 7 aa, Neisseria
RLNTKEL

SEQ ID NO: 6419 - protein, 8 aa, Neisseria
QAERNSNG

SEQ ID NO: 6420 - protein, 14 aa, Neisseria
DVVRKRLSEKDYQN

SEQ ID NO: 6421 - protein, 9 aa, Neisseria
IQQRRKQIR

SEQ ID NO: 6422 - protein, 5 aa, Neisseria
RQWRR

SEQ ID NO: 6423 - protein, 5 aa, Neisseria
YKVVF

SEQ ID NO: 6424 - protein, 7 aa, Neisseria
KREGKNT

SEQ ID NO: 6425 - protein, 16 aa, Neisseria
LPNDIAGFAGFIHSIS

SEQ ID NO: 6426 - protein, 6 aa, Neisseria
NQYAQF

SEQ ID NO: 6427 - protein, 13 aa, Neisseria
VNQINSSHSSQLN

SEQ ID NO: 6428 - protein, 10 aa, Neisseria
DYTRILSYHS

SEQ ID NO: 6429 - protein, 9 aa, Neisseria
AANTSNNTA

SEQ ID NO: 6430 - protein, 6 aa, Neisseria
KLGGMY

SEQ ID NO: 6431 - protein, 7 aa, Neisseria
LISTVEQ

SEQ ID NO: 6432 - protein, 5 aa, Neisseria
SQTLD

SEQ ID NO: 6433 - protein, 11 aa, Neisseria
VRNLGRLKNQN

SEQ ID NO: 6434 - protein, 11 aa, Neisseria
LDNTGNITQTG

SEQ ID NO: 6435 - protein, 10 aa, Neisseria
LVSAGKFDNS

SEQ ID NO: 6436 - protein, 7 aa, Neisseria
IPQIPST

SEQ ID NO: 6437 - protein, 15 aa, Neisseria
IQTTGAFDNAGSINA

SEQ ID NO: 6438 - protein, 7 aa, Neisseria
SFNNTVK

SEQ ID NO: 6439 - protein, 5 aa, Neisseria
LHNAG

SEQ ID NO: 6440 - protein, 6 aa, Neisseria
GLHNAG

SEQ ID NO: 6441 - protein, 7 aa, Neisseria
LRNTGKV

SEQ ID NO: 6442 - protein, 6 aa, Neisseria
LYNQHG

SEQ ID NO: 6443 - protein, 7 aa, Neisseria
DGTIQSA

SEQ ID NO: 6444 - protein, 7 aa, Neisseria
DNQVTGK

SEQ ID NO: 6445 - protein, 9 aa, Neisseria
DGLTHIGAG

SEQ ID NO: 6446 - protein, 10 aa, Neisseria
LTNTGTGKIY

SEQ ID NO: 6447 - protein, 8 aa, Neisseria
AGMADTFV

SEQ ID NO: 6448 - protein, 11 aa, Neisseria
SVRNMQNINNH

SEQ ID NO: 6449 - protein, 5 aa, Neisseria
AEKQV

SEQ ID NO: 6450 - protein, 8 aa, Neisseria
TQWDSVTK

SEQ ID NO: 6451 - protein, 9 aa, Neisseria
IKLIDGVST

SEQ ID NO: 6452 - protein, 8 aa, Neisseria
HKRLGDGY

SEQ ID NO: 6453 - protein, 15 aa, Neisseria
EQIHQLTGYRRLDGY

SEQ ID NO: 6454 - protein, 7 aa, Neisseria
FKALMDN

SEQ ID NO: 6455 - protein, 5 aa, Neisseria
QVARL

SEQ ID NO: 6456 - protein, 22 aa, Neisseria
TAIDRMAGINVVGSHTEQVDNR

SEQ ID NO: 6457 - protein, 9 aa, Neisseria
SNQVKDGTT

SEQ ID NO: 6458 - protein, 5 aa, Neisseria
TAGNN

SEQ ID NO: 6459 - protein, 9 aa, Neisseria
RHVRQSTEV

SEQ ID NO: 6460 - protein, 6 aa, Neisseria
RQITEL

SEQ ID NO: 6461 - protein, 6 aa, Neisseria
IIGSLN

SEQ ID NO: 6462 - protein, 14 aa, Neisseria
AQNFIQAAQNVGKS

SEQ ID NO: 6463 - protein, 7 aa, Neisseria
YQATQQM

SEQ ID NO: 6464 - protein, 6 aa, Neisseria
EAAASQ

SEQ ID NO: 6465 - protein, 5 aa, Neisseria
GSEQS

SEQ ID NO: 6466 - protein, 8 aa, Neisseria
GGNIGKGK

SEQ ID NO: 6467 - protein, 6 aa, Neisseria
DIQNHS

SEQ ID NO: 6468 - protein, 11 aa, Neisseria
QGRPTDRISPA

SEQ ID NO: 6469 - protein, 12 aa, Neisseria
AGQLARTGRTAK

SEQ ID NO: 6470 - protein, 11 aa, Neisseria
DQHSGHLKNSF

SEQ ID NO: 6471 - protein, 11 aa, Neisseria
EVTKEFGRNAA

SEQ ID NO: 6472 - protein, 16 aa, Neisseria
AVADKLGNTQSYERYQ

SEQ ID NO: 6473 - protein, 7 aa, Neisseria
RYDTWKE

SEQ ID NO: 6474 - protein, 9 aa, Neisseria
RSILHGAAG

SEQ ID NO: 6475 - protein, 9 aa, Neisseria
TGSLGGILA

SEQ ID NO: 6476 - protein, 13 aa, Neisseria
APYLDKAAENLGP

SEQ ID NO: 6477 - protein, 7 aa, Neisseria
AAVNALG

SEQ ID NO: 6478 - protein, 8 aa, Neisseria
KYAEALKR

SEQ ID NO: 6479 - protein, 6 aa, Neisseria
VEKREG

SEQ ID NO: 6480 - protein, 13 aa, Neisseria
QILRWVDKGSQDG

SEQ ID NO: 6481 - protein, 12 aa, Neisseria
QTYNDPKLFEEY

SEQ ID NO: 6482 - protein, 7 aa, Neisseria
EGLTSLV

SEQ ID NO: 6483 - protein, 10 aa, Neisseria
LAGIRNLKNI

SEQ ID NO: 6484 - protein, 6 aa, Neisseria
VAKGDR

SEQ ID NO: 6485 - protein, 5 aa, Neisseria
KPQRQ

SEQ ID NO: 6486 - protein, 6 aa, Neisseria
DVCTEC

SEQ ID NO: 6487 - protein, 5 aa, Neisseria
PEIER

SEQ ID NO: 6488 - protein, 8 aa, Neisseria
FNKHRNCM

SEQ ID NO: 6489 - protein, 12 aa, Neisseria
ENAKREGKNTAD

SEQ ID NO: 6490 - protein, 11 aa, Neisseria
VADKSAPAQQQ

SEQ ID NO: 6491 - protein, 17 aa, Neisseria
VGNRGAILNNSRSNTQT

SEQ ID NO: 6492 - protein, 5 aa, Neisseria
NPWLA

SEQ ID NO: 6493 - protein, 5 aa, Neisseria
GEARV

SEQ ID NO: 6494 - protein, 11 aa, Neisseria
INSSHSSQLNG

SEQ ID NO: 6495 - protein, 10 aa, Neisseria
IEVGGRRAEV

SEQ ID NO: 6496 - protein, 7 aa, Neisseria
NASRATL

SEQ ID NO: 6497 - protein, 17 aa, Neisseria
PQYQAGDLSGFKIRQGN

SEQ ID NO: 6498 - protein, 11 aa, Neisseria
GLDARDTDYTR

SEQ ID NO: 6499 - protein, 8 aa, Neisseria
SYHSKIDA

SEQ ID NO: 6500 - protein, 5 aa, Neisseria
QDVRV

SEQ ID NO: 6501 - protein, 14 aa, Neisseria
GQNDVAATGDAHSP

SEQ ID NO: 6502 - protein, 11 aa, Neisseria
NTSNNTANNGT

SEQ ID NO: 6503 - protein, 7 aa, Neisseria
DTGKLGG

SEQ ID NO: 6504 - protein, 10 aa, Neisseria
EQAGIRNQGQ

SEQ ID NO: 6505 - protein, 8 aa, Neisseria
NAEGKLVN

SEQ ID NO: 6506 - protein, 5 aa, Neisseria
TGENH

SEQ ID NO: 6507 - protein, 17 aa, Neisseria
NVHNSGTVASQDDANIH

SEQ ID NO: 6508 - protein, 9 aa, Neisseria
QTLDNSGTV

SEQ ID NO: 6509 - protein, 7 aa, Neisseria
SSGRLTV

SEQ ID NO: 6510 - protein, 11 aa, Neisseria
NLGRLKNQNNG

SEQ ID NO: 6511 - protein, 22 aa, Neisseria
ARLDMSTGGLDNTGNITQTGSQ

SEQ ID NO: 6512 - protein, 25 aa, Neisseria
GKFDNSGKIGVSDVPQTGLNPNPSV

SEQ ID NO: 6513 - protein, 5 aa, Neisseria
TGSGS

SEQ ID NO: 6514 - protein, 22 aa, Neisseria
VSVSKPGSNNPVSPTAPAKNYA

SEQ ID NO: 6515 - protein, 13 aa, Neisseria
DNAGSINAGGQID

SEQ ID NO: 6516 - protein, 8 aa, Neisseria
NGLGNSGS

SEQ ID NO: 6517 - protein, 20 aa, Neisseria
AKLRVSGDSFNNTVKGKLQA

SEQ ID NO: 6518 - protein, 8 aa, Neisseria
QTAKNSGH

SEQ ID NO: 6519 - protein, 15 aa, Neisseria
QTGKIDNRELHNAGE

SEQ ID NO: 6520 - protein, 13 aa, Neisseria
HSGRLSNDKKGNI

SEQ ID NO: 6521 - protein, 43 aa, Neisseria
ADSGTVTTKNNLRNTGKVSVARLNTEGQTLDNTRGRIEAETVN

SEQ ID NO: 6522 - protein, 8 aa, Neisseria
QLTNQSGH

SEQ ID NO: 6523 - protein, 15 aa, Neisseria
INSRNVDNQNGKLLS

SEQ ID NO: 6524 - protein, 10 aa, Neisseria
VSDGLYNQHG

SEQ ID NO: 6525 - protein, 9 aa, Neisseria
SIHDKNQNT

SEQ ID NO: 6526 - protein, 8 aa, Neisseria
LNNADGTI

SEQ ID NO: 6527 - protein, 7 aa, Neisseria
SLANNGT

SEQ ID NO: 6528 - protein, 6 aa, Neisseria
AGNKLD

SEQ ID NO: 6529 - protein, 15 aa, Neisseria
LTDDFVVERDLTAGK

SEQ ID NO: 6530 - protein, 10 aa, Neisseria
IKGRLKNTHT

SEQ ID NO: 6531 - protein, 9 aa, Neisseria
NAGNIDNQV

SEQ ID NO: 6532 - protein, 24 aa, Neisseria
IGGEQTDITSEQHVDNRGLINSDG

SEQ ID NO: 6533 - protein, 11 aa, Neisseria
TLTNTGTGKIY

SEQ ID NO: 6534 - protein, 13 aa, Neisseria
LNREETTEGSTKA

SEQ ID NO: 6535 - protein, 18 aa, Neisseria
AARKRLDIGAKEIHNQEG

SEQ ID NO: 6536 - protein, 5 aa, Neisseria
LSSEG

SEQ ID NO: 6537 - protein, 9 aa, Neisseria
GNRLDEQHH

SEQ ID NO: 6538 - protein, 22 aa, Neisseria
QNINNHFKTETYLAKAEKQVRD

SEQ ID NO: 6539 - protein, 19 aa, Neisseria
QAGKDGLFDNSQGQKDQTT

SEQ ID NO: 6540 - protein, 10 aa, Neisseria
HLKNGSRIEA

(The sequence listing continues in the following parts.)

What is claimed is:

1. An isolated polypeptide having the amino acid sequence of SEQ ID NO: 35971.
2. The isolated polypeptide of claim 1, wherein the polypeptide does not comprise the full length protein sequence of SEQ ID NO: 41367.
3. The isolated polypeptide of claim 1, wherein the amino acid sequence of SEQ ID NO: 35971 is an antigenic fragment of SEQ ID NO: 41367.
4. The isolated polypeptide of claim 3, wherein the polypeptide does not comprise the full length protein sequence of SEQ ID NO: 41367.
5. A composition comprising the isolated polypeptide of claim 1 with a pharmaceutically acceptable carrier.
6. The composition of claim 5 further comprising aluminum phosphate.
7. A composition comprising the isolated polypeptide of claim 2 with a pharmaceutically acceptable carrier.
8. The composition of claim 7 further comprising aluminum phosphate.
9. A composition comprising the isolated polypeptide of claim 3 with a pharmaceutically acceptable carrier.
10. The composition of claim 9 further comprising aluminum phosphate.
11. A composition comprising the isolated polypeptide of claim 4 with a pharmaceutically acceptable carrier.
12. The composition of claim 11 further comprising aluminum phosphate.
13. A purified polypeptide having the amino acid sequence of SEQ ID NO: 35971.
14. The purified polypeptide of claim 13, wherein the polypeptide does not comprise the full length protein sequence of SEQ ID NO: 41367.
15. The purified polypeptide of claim 13, wherein the amino acid sequence of SEQ ID NO: 35971 is an antigenic fragment of SEQ ID NO: 41367.
16. The purified polypeptide of claim 15, wherein the polypeptide does not comprise the full length protein sequence of SEQ ID NO: 41367.
17. A composition comprising the purified polypeptide of claim 13 with a pharmaceutically acceptable carrier.
18. The composition of claim 17 further comprising aluminum phosphate.
19. A composition comprising the purified polypeptide of claim 14 with a pharmaceutically acceptable carrier.
20. The composition of claim 19 further comprising aluminum phosphate.
21. A composition comprising the purified polypeptide of claim 15 with a pharmaceutically acceptable carrier.
22. The composition of claim 21 further comprising aluminum phosphate.
23. A composition comprising the purified polypeptide of claim 16 with a pharmaceutically acceptable carrier.
24. The composition of claim 23 further comprising aluminum phosphate.

* * * * *